United States Patent 7,655,785 (BIOINFORMATICALLY DETECTABLE GROUP OF NOVEL REGULATORY OLIGONUCLEOTIDES AND USES THEREOF) - sequence listing, part 16

SEQ ID NO: 623099 - RNA, 10 nt, Homo sapiens
caauuucacu

SEQ ID NO: 623100 - RNA, 13 nt, Homo sapiens
caauuucccuuca

SEQ ID NO: 623101 - RNA, 22 nt, Homo sapiens
caauuugagauucuacaguaag

SEQ ID NO: 623102 - RNA, 18 nt, Homo sapiens
caauuugccauuguuucu

SEQ ID NO: 623103 - RNA, 13 nt, Homo sapiens
caauuugccuuuu

SEQ ID NO: 623104 - RNA, 21 nt, Homo sapiens
caauuugguaaaaaugcugcu

SEQ ID NO: 623105 - RNA, 15 nt, Homo sapiens
caauuuguauaaaau

SEQ ID NO: 623106 - RNA, 17 nt, Homo sapiens
caauuuuagauaucaug

SEQ ID NO: 623107 - RNA, 21 nt, Homo sapiens
caauuuuccuuggaacacaua

SEQ ID NO: 623108 - RNA, 15 nt, Homo sapiens
caauuuuguugcauc

SEQ ID NO: 623109 - RNA, 18 nt, Homo sapiens
caauuuuuuaucaugcau

SEQ ID NO: 623110 - RNA, 18 nt, Homo sapiens
cacaaaaaggcauaugca

SEQ ID NO: 623111 - RNA, 21 nt, Homo sapiens
cacaaaaaggcauaugcaaua

SEQ ID NO: 623112 - RNA, 17 nt, Homo sapiens
caggcuuaugaauauau

SEQ ID NO: 623113 - RNA, 15 nt, Homo sapiens
caggcuucugagcac

SEQ ID NO: 623114 - RNA, 21 nt, Homo sapiens
caggcuuggauggaacaugcc

SEQ ID NO: 623115 - RNA, 22 nt, Homo sapiens
caggcuuguuaccaccaugcuc

SEQ ID NO: 623116 - RNA, 17 nt, Homo sapiens
cagggaaacaacaugaa

SEQ ID NO: 623117 - RNA, 19 nt, Homo sapiens
cagggaagcugucccucac

SEQ ID NO: 623118 - RNA, 14 nt, Homo sapiens
cagggaagguaauu

SEQ ID NO: 623119 - RNA, 22 nt, Homo sapiens
cagggacacacagccuagcaca

SEQ ID NO: 623120 - RNA, 11 nt, Homo sapiens
cagggacccac

SEQ ID NO: 623121 - RNA, 15 nt, Homo sapiens
cagggacccacuuca

SEQ ID NO: 623122 - RNA, 17 nt, Homo sapiens
cagggacccacuucaca

SEQ ID NO: 623123 - RNA, 17 nt, Homo sapiens
cagggaccguccagggg

SEQ ID NO: 623124 - RNA, 22 nt, Homo sapiens
cagggacucaaggguccagaag

SEQ ID NO: 623125 - RNA, 19 nt, Homo sapiens
cagggacuguaaacacaga

SEQ ID NO: 623126 - RNA, 12 nt, Homo sapiens
cagggacuugaa

SEQ ID NO: 623127 - RNA, 24 nt, Homo sapiens
cagggagaaguagcuaguagcaau

SEQ ID NO: 623128 - RNA, 17 nt, Homo sapiens
cagggaggcaacacugc

SEQ ID NO: 623129 - RNA, 15 nt, Homo sapiens
cagggagggcugugg

SEQ ID NO: 623130 - RNA, 19 nt, Homo sapiens
cagggagugcacauaucca

SEQ ID NO: 623131 - RNA, 17 nt, Homo sapiens
cagggagugggagccaa

SEQ ID NO: 623132 - RNA, 16 nt, Homo sapiens
cagggauaauacugug

SEQ ID NO: 623133 - RNA, 16 nt, Homo sapiens
cagggauccaauauga

SEQ ID NO: 623134 - RNA, 17 nt, Homo sapiens
cagggaugacagauuug

SEQ ID NO: 623135 - RNA, 16 nt, Homo sapiens
cagggauuacuggugu

SEQ ID NO: 623136 - RNA, 19 nt, Homo sapiens
cagggauuuagcccaugac

SEQ ID NO: 623137 - RNA, 21 nt, Homo sapiens
cagggcaaaagggcagcugug

SEQ ID NO: 623138 - RNA, 22 nt, Homo sapiens
cagggcaaggauccugugcugc

SEQ ID NO: 623139 - RNA, 13 nt, Homo sapiens
cagggcacuacau

SEQ ID NO: 623140 - RNA, 15 nt, Homo sapiens
cagggcacuacauaa

SEQ ID NO: 623141 - RNA, 21 nt, Homo sapiens
cagggcagcaagggaccugcu

SEQ ID NO: 623142 - RNA, 23 nt, Homo sapiens
cagggcagcaagggaccugcuca

SEQ ID NO: 623143 - RNA, 18 nt, Homo sapiens
cagggcagcgccaggcug

SEQ ID NO: 623144 - RNA, 23 nt, Homo sapiens
cagggcaggaaggggaaacacag

SEQ ID NO: 623145 - RNA, 14 nt, Homo sapiens
cagggcauuuuaca

SEQ ID NO: 623146 - RNA, 18 nt, Homo sapiens
cagggcauuuugguccaa

SEQ ID NO: 623147 - RNA, 15 nt, Homo sapiens
cagggccacauagau

SEQ ID NO: 623148 - RNA, 12 nt, Homo sapiens
cagggccagugc

SEQ ID NO: 623149 - RNA, 18 nt, Homo sapiens
cagggcccaagucccugu

SEQ ID NO: 623150 - RNA, 19 nt, Homo sapiens
cagggcccaggccaugugg

SEQ ID NO: 623151 - RNA, 14 nt, Homo sapiens
cagggcccagugac

SEQ ID NO: 623152 - RNA, 22 nt, Homo sapiens
cagggccccuggggaucuugcc

SEQ ID NO: 623153 - RNA, 21 nt, Homo sapiens
cagggcccucccagcccauug

SEQ ID NO: 623154 - RNA, 20 nt, Homo sapiens
cagggcccugagcucggugg

SEQ ID NO: 623155 - RNA, 14 nt, Homo sapiens
cagggccgugagca

SEQ ID NO: 623156 - RNA, 14 nt, Homo sapiens
cagggccguugccc

SEQ ID NO: 623157 - RNA, 14 nt, Homo sapiens
cagggccucaaagu

SEQ ID NO: 623158 - RNA, 15 nt, Homo sapiens
cagggccucaucuca

SEQ ID NO: 623159 - RNA, 18 nt, Homo sapiens
cagggccuggagccccau

SEQ ID NO: 623160 - RNA, 21 nt, Homo sapiens
cagggcuauauuucagugaca

SEQ ID NO: 623161 - RNA, 16 nt, Homo sapiens
cagggcucacacuccu

SEQ ID NO: 623162 - RNA, 13 nt, Homo sapiens
cagggcucugcag

SEQ ID NO: 623163 - RNA, 20 nt, Homo sapiens
cagggcucugugaccaggaa

SEQ ID NO: 623164 - RNA, 14 nt, Homo sapiens
cagggcugcucccc

SEQ ID NO: 623165 - RNA, 21 nt, Homo sapiens
cagggcugcuccccaacaccu

SEQ ID NO: 623166 - RNA, 20 nt, Homo sapiens
cagggcuggcacgugacagg

SEQ ID NO: 623167 - RNA, 15 nt, Homo sapiens
caggggaccacaccu

SEQ ID NO: 623168 - RNA, 17 nt, Homo sapiens
caggggacgugggcccu

SEQ ID NO: 623169 - RNA, 22 nt, Homo sapiens
caggggacuugaaucuuuccaa

SEQ ID NO: 623170 - RNA, 17 nt, Homo sapiens
caggggagaagcugaag

SEQ ID NO: 623171 - RNA, 16 nt, Homo sapiens
caggggaguaugcaaa

SEQ ID NO: 623172 - RNA, 18 nt, Homo sapiens
caggggaguguucagggc

SEQ ID NO: 623173 - RNA, 15 nt, Homo sapiens
caggggaucauguua

SEQ ID NO: 623174 - RNA, 16 nt, Homo sapiens
caggggccaggggugg

SEQ ID NO: 623175 - RNA, 18 nt, Homo sapiens
caggggccggccaguggc

SEQ ID NO: 623176 - RNA, 20 nt, Homo sapiens
cagggggugugucugcucag

SEQ ID NO: 623177 - RNA, 23 nt, Homo sapiens
caggggucucccuggagugcagu

SEQ ID NO: 623178 - RNA, 23 nt, Homo sapiens
cagggguggggguggaggcuucc

SEQ ID NO: 623179 - RNA, 17 nt, Homo sapiens
caggguaaaaggugcag

SEQ ID NO: 623180 - RNA, 20 nt, Homo sapiens
caggguaccucaagccccau

SEQ ID NO: 623181 - RNA, 17 nt, Homo sapiens
caggguccaaaggccag

SEQ ID NO: 623182 - RNA, 20 nt, Homo sapiens
caggguccagugggaacuga

SEQ ID NO: 623183 - RNA, 18 nt, Homo sapiens
cagggucccucuguguau

SEQ ID NO: 623184 - RNA, 18 nt, Homo sapiens
caggguccgcaccagcug

SEQ ID NO: 623185 - RNA, 21 nt, Homo sapiens
cagggucucuagugcugugaa

SEQ ID NO: 623186 - RNA, 16 nt, Homo sapiens
cagggucugcucuuuc

SEQ ID NO: 623187 - RNA, 20 nt, Homo sapiens
cagggugacccugaagugag

SEQ ID NO: 623188 - RNA, 21 nt, Homo sapiens
cagggugcagcccaaucugcc

SEQ ID NO: 623189 - RNA, 22 nt, Homo sapiens
caggguggagaugaggugcuca

SEQ ID NO: 623190 - RNA, 20 nt, Homo sapiens
cagggugggaucagcccugc

SEQ ID NO: 623191 - RNA, 18 nt, Homo sapiens
caggguguguacugcaca

SEQ ID NO: 623192 - RNA, 20 nt, Homo sapiens
caggguguguacugcacaag

SEQ ID NO: 623193 - RNA, 20 nt, Homo sapiens
caggguuaggaaucucuuca

SEQ ID NO: 623194 - RNA, 15 nt, Homo sapiens
caggguucucuuagc

SEQ ID NO: 623195 - RNA, 16 nt, Homo sapiens
caggguuucuccaugu

SEQ ID NO: 623196 - RNA, 20 nt, Homo sapiens
cacaaaacaacaaaaaccaa

SEQ ID NO: 623197 - RNA, 21 nt, Homo sapiens
cacaaaacauucauguaacuc

SEQ ID NO: 623198 - RNA, 13 nt, Homo sapiens
cacaaaacauuua

SEQ ID NO: 623199 - RNA, 20 nt, Homo sapiens
cacaaaauguaggguuauaa

SEQ ID NO: 623200 - RNA, 22 nt, Homo sapiens
cacaaaccuucuuuaaggcaua

SEQ ID NO: 623201 - RNA, 14 nt, Homo sapiens
cacaaacggagccc

SEQ ID NO: 623202 - RNA, 19 nt, Homo sapiens
cacaaacugcagcugugag

SEQ ID NO: 623203 - RNA, 21 nt, Homo sapiens
cacaaacugcagcugugagug

SEQ ID NO: 623204 - RNA, 22 nt, Homo sapiens
cacaaacugcagcugugagugc

SEQ ID NO: 623205 - RNA, 18 nt, Homo sapiens
cacaaagcccuuccaugu

SEQ ID NO: 623206 - RNA, 12 nt, Homo sapiens
cacaaagccuua

SEQ ID NO: 623207 - RNA, 17 nt, Homo sapiens
cacaaaggcugaugucu

SEQ ID NO: 623208 - RNA, 11 nt, Homo sapiens
cacaaagggaa

SEQ ID NO: 623209 - RNA, 19 nt, Homo sapiens
cacaaaguagaggaaucca

SEQ ID NO: 623210 - RNA, 23 nt, Homo sapiens
cacaaaguaucuaacaaaaccaa

SEQ ID NO: 623211 - RNA, 13 nt, Homo sapiens
cacaaaugcauga

SEQ ID NO: 623212 - RNA, 20 nt, Homo sapiens
cacaaaugguagcauacuuu

SEQ ID NO: 623213 - RNA, 22 nt, Homo sapiens
cacaaaugguggguacaaaaag

SEQ ID NO: 623214 - RNA, 17 nt, Homo sapiens
cacaaauuauacuuuau

SEQ ID NO: 623215 - RNA, 12 nt, Homo sapiens
cacaaauuccac

SEQ ID NO: 623216 - RNA, 11 nt, Homo sapiens
cacaacacaga

SEQ ID NO: 623217 - RNA, 13 nt, Homo sapiens
cacaacagugaaa

SEQ ID NO: 623218 - RNA, 12 nt, Homo sapiens
cacaaccaaaaa

SEQ ID NO: 623219 - RNA, 14 nt, Homo sapiens
cacaacccaagaau

SEQ ID NO: 623220 - RNA, 14 nt, Homo sapiens
cacaaccuggauuu

SEQ ID NO: 623221 - RNA, 20 nt, Homo sapiens
cacaacgcaccagacacuca

SEQ ID NO: 623222 - RNA, 16 nt, Homo sapiens
cacaacggcagugaag

SEQ ID NO: 623223 - RNA, 16 nt, Homo sapiens
cacaacuaaaacugga

SEQ ID NO: 623224 - RNA, 20 nt, Homo sapiens
cacaagaagcugguggagca

SEQ ID NO: 623225 - RNA, 23 nt, Homo sapiens
cacaagaaguucuuguucuucag

SEQ ID NO: 623226 - RNA, 14 nt, Homo sapiens
cacaagaauugaau

SEQ ID NO: 623227 - RNA, 15 nt, Homo sapiens
cacaagaauugaaua

SEQ ID NO: 623228 - RNA, 14 nt, Homo sapiens
cacaagagugaauu

SEQ ID NO: 623229 - RNA, 15 nt, Homo sapiens
cacaagcaacaaacc

SEQ ID NO: 623230 - RNA, 15 nt, Homo sapiens
cacaagcaugaagug

SEQ ID NO: 623231 - RNA, 22 nt, Homo sapiens
cacaagccacaagucuuccaga

SEQ ID NO: 623232 - RNA, 13 nt, Homo sapiens
cacaagccagacc

SEQ ID NO: 623233 - RNA, 15 nt, Homo sapiens
cacaagcguguuucu

SEQ ID NO: 623234 - RNA, 18 nt, Homo sapiens
cacaagcguguuucuaga

SEQ ID NO: 623235 - RNA, 17 nt, Homo sapiens
cacaagcuggaagcaca

SEQ ID NO: 623236 - RNA, 18 nt, Homo sapiens
cacaagcuggaagcacau

SEQ ID NO: 623237 - RNA, 21 nt, Homo sapiens
cacaaggaaaaggccauuaaa

SEQ ID NO: 623238 - RNA, 13 nt, Homo sapiens
cacaaggacccuu

SEQ ID NO: 623239 - RNA, 16 nt, Homo sapiens
cacaaggucacuagau

SEQ ID NO: 623240 - RNA, 15 nt, Homo sapiens
cacaaguccugugaa

SEQ ID NO: 623241 - RNA, 23 nt, Homo sapiens
cacaauaaauggccagugcugcu

SEQ ID NO: 623242 - RNA, 19 nt, Homo sapiens
cacaauauaaaacuguacu

SEQ ID NO: 623243 - RNA, 19 nt, Homo sapiens
cacaauaugggcacuuuaa

SEQ ID NO: 623244 - RNA, 23 nt, Homo sapiens
cacaaucccuguacucugaccca

SEQ ID NO: 623245 - RNA, 23 nt, Homo sapiens
cacaauccuguggaucugggcaa

SEQ ID NO: 623246 - RNA, 17 nt, Homo sapiens
cacaaucugggacuuuc

SEQ ID NO: 623247 - RNA, 13 nt, Homo sapiens
cacaaugaaugua

SEQ ID NO: 623248 - RNA, 15 nt, Homo sapiens
cacaaugcugaugaa

SEQ ID NO: 623249 - RNA, 22 nt, Homo sapiens
cacaauguggauuuggggacca

SEQ ID NO: 623250 - RNA, 12 nt, Homo sapiens
cacaauucacua

SEQ ID NO: 623251 - RNA, 19 nt, Homo sapiens
cacacaaaaaaacaaguau

SEQ ID NO: 623252 - RNA, 17 nt, Homo sapiens
cacacaaagacuccuug

SEQ ID NO: 623253 - RNA, 15 nt, Homo sapiens
cacacaacuguccau

SEQ ID NO: 623254 - RNA, 15 nt, Homo sapiens
cacacaaggugcaaa

SEQ ID NO: 623255 - RNA, 23 nt, Homo sapiens
cacacaauguggacgugcacuga

SEQ ID NO: 623256 - RNA, 10 nt, Homo sapiens
cacacacaaa

SEQ ID NO: 623257 - RNA, 15 nt, Homo sapiens
cacacacacacauac

SEQ ID NO: 623258 - RNA, 13 nt, Homo sapiens
cacacacacacga

SEQ ID NO: 623259 - RNA, 17 nt, Homo sapiens
cacacacagccuauauc

SEQ ID NO: 623260 - RNA, 13 nt, Homo sapiens
cacacacauauau

SEQ ID NO: 623261 - RNA, 21 nt, Homo sapiens
cacacacccccccacaaggaa

SEQ ID NO: 623262 - RNA, 22 nt, Homo sapiens
cacacacccccccacaaggaac

SEQ ID NO: 623263 - RNA, 13 nt, Homo sapiens
cacacacgaugca

SEQ ID NO: 623264 - RNA, 20 nt, Homo sapiens
cacacacuggcugguggaga

SEQ ID NO: 623265 - RNA, 19 nt, Homo sapiens
cacacagauuugagcucag

SEQ ID NO: 623266 - RNA, 22 nt, Homo sapiens
cacacagcuacucuccccacga

SEQ ID NO: 623267 - RNA, 13 nt, Homo sapiens
cacacagcugccc

SEQ ID NO: 623268 - RNA, 16 nt, Homo sapiens
cacacagcugcccuag

SEQ ID NO: 623269 - RNA, 11 nt, Homo sapiens
cacacaguguu

SEQ ID NO: 623270 - RNA, 16 nt, Homo sapiens
cacacauauacaugua

SEQ ID NO: 623271 - RNA, 14 nt, Homo sapiens
cacacauauugcac

SEQ ID NO: 623272 - RNA, 22 nt, Homo sapiens
cacacauccccuuuguguagaa

SEQ ID NO: 623273 - RNA, 12 nt, Homo sapiens
cacacaucucau

SEQ ID NO: 623274 - RNA, 17 nt, Homo sapiens
cacaccauucgucauca

SEQ ID NO: 623275 - RNA, 15 nt, Homo sapiens
cacacccaggaaggg

SEQ ID NO: 623276 - RNA, 22 nt, Homo sapiens
cacacccaugcacacucaugca

SEQ ID NO: 623277 - RNA, 21 nt, Homo sapiens
cacaccccuccggacauccag

SEQ ID NO: 623278 - RNA, 16 nt, Homo sapiens
cacacccgugagaaau

SEQ ID NO: 623279 - RNA, 20 nt, Homo sapiens
cacacccuggaggauuucau

SEQ ID NO: 623280 - RNA, 16 nt, Homo sapiens
cacaccgucuuccuuc

SEQ ID NO: 623281 - RNA, 17 nt, Homo sapiens
cacaccugaacuugccu

SEQ ID NO: 623282 - RNA, 23 nt, Homo sapiens
cacaccuggcauggugcagggag

SEQ ID NO: 623283 - RNA, 17 nt, Homo sapiens
cacaccuuuuauugaca

SEQ ID NO: 623284 - RNA, 14 nt, Homo sapiens
cacacgagcaaacc

SEQ ID NO: 623285 - RNA, 20 nt, Homo sapiens
cacacgaggucacgugugga

SEQ ID NO: 623286 - RNA, 13 nt, Homo sapiens
cacacgaugcauu

SEQ ID NO: 623287 - RNA, 15 nt, Homo sapiens
cacacgaugcauuua

SEQ ID NO: 623288 - RNA, 16 nt, Homo sapiens
cacacgaugcauuuaa

SEQ ID NO: 623289 - RNA, 17 nt, Homo sapiens
cacacgaugcauuuaau

SEQ ID NO: 623290 - RNA, 15 nt, Homo sapiens
cacacgcaggaacuc

SEQ ID NO: 623291 - RNA, 21 nt, Homo sapiens
cacacgccucccacugggguc

SEQ ID NO: 623292 - RNA, 16 nt, Homo sapiens
cacacuaaacucuggg

SEQ ID NO: 623293 - RNA, 18 nt, Homo sapiens
cacacuagaaaugcagca

SEQ ID NO: 623294 - RNA, 12 nt, Homo sapiens
cacacuauggca

SEQ ID NO: 623295 - RNA, 14 nt, Homo sapiens
cacacucagcacaa

SEQ ID NO: 623296 - RNA, 10 nt, Homo sapiens
cacacugaga

SEQ ID NO: 623297 - RNA, 22 nt, Homo sapiens
cacacugggugcgucuccaguc

SEQ ID NO: 623298 - RNA, 14 nt, Homo sapiens
cacacugguacuua

SEQ ID NO: 623299 - RNA, 15 nt, Homo sapiens
cacacuggugacugc

SEQ ID NO: 623300 - RNA, 10 nt, Homo sapiens
cacacugucu

SEQ ID NO: 623301 - RNA, 16 nt, Homo sapiens
cacacuuuuggaacca

SEQ ID NO: 623302 - RNA, 21 nt, Homo sapiens
cacagaaagcuccuuccagac

SEQ ID NO: 623303 - RNA, 21 nt, Homo sapiens
cacagaacuauguacuuuaaa

SEQ ID NO: 623304 - RNA, 19 nt, Homo sapiens
cacagaaggaauaagguca

SEQ ID NO: 623305 - RNA, 12 nt, Homo sapiens
cacagaaguagc

SEQ ID NO: 623306 - RNA, 19 nt, Homo sapiens
cacagaauauguauguaua

SEQ ID NO: 623307 - RNA, 18 nt, Homo sapiens
cacagacacaauauguau

SEQ ID NO: 623308 - RNA, 14 nt, Homo sapiens
cacagacacuuaca

SEQ ID NO: 623309 - RNA, 14 nt, Homo sapiens
cacagacaguuucu

SEQ ID NO: 623310 - RNA, 16 nt, Homo sapiens
cacagacugauuggaa

SEQ ID NO: 623311 - RNA, 13 nt, Homo sapiens
cacagacuggcaa

SEQ ID NO: 623312 - RNA, 18 nt, Homo sapiens
cacagagaaggcuaugua

SEQ ID NO: 623313 - RNA, 21 nt, Homo sapiens
cacagagagggacacaugccc

SEQ ID NO: 623314 - RNA, 18 nt, Homo sapiens
cacagagauucuggaucu

SEQ ID NO: 623315 - RNA, 20 nt, Homo sapiens
cacagagcaggacugcacag

SEQ ID NO: 623316 - RNA, 15 nt, Homo sapiens
cacagaggagugcag

SEQ ID NO: 623317 - RNA, 17 nt, Homo sapiens
cacagaggagugcagcc

SEQ ID NO: 623318 - RNA, 16 nt, Homo sapiens
cacagaguagaaacuc

SEQ ID NO: 623319 - RNA, 17 nt, Homo sapiens
cacagagugugcugcua

SEQ ID NO: 623320 - RNA, 20 nt, Homo sapiens
cauaaaaaagaagcacuuug

SEQ ID NO: 623321 - RNA, 23 nt, Homo sapiens
cauaaaaauacaacagugcauuu

SEQ ID NO: 623322 - RNA, 18 nt, Homo sapiens
cauaaaacaaaaccaagc

SEQ ID NO: 623323 - RNA, 21 nt, Homo sapiens
cauaaaagaaaaucuuuaggc

SEQ ID NO: 623324 - RNA, 16 nt, Homo sapiens
cauaaaaucugugaau

SEQ ID NO: 623325 - RNA, 22 nt, Homo sapiens
cauaaacacccaugaaucaaag

SEQ ID NO: 623326 - RNA, 19 nt, Homo sapiens
cauaaacguuguguucaua

SEQ ID NO: 623327 - RNA, 16 nt, Homo sapiens
cauaaacuucagggau

SEQ ID NO: 623328 - RNA, 16 nt, Homo sapiens
cauaaagaagcaauaa

SEQ ID NO: 623329 - RNA, 18 nt, Homo sapiens
cauaaagaagcaauaaag

SEQ ID NO: 623330 - RNA, 13 nt, Homo sapiens
cauaaagcauuuu

SEQ ID NO: 623331 - RNA, 11 nt, Homo sapiens
cauaaagccaa

SEQ ID NO: 623332 - RNA, 17 nt, Homo sapiens
cauaaaugaagcagcuu

SEQ ID NO: 623333 - RNA, 14 nt, Homo sapiens
cauaaaugaaucau

SEQ ID NO: 623334 - RNA, 22 nt, Homo sapiens
cauaaauuacagucaucugucu

SEQ ID NO: 623335 - RNA, 13 nt, Homo sapiens
cauaaauuacuuu

SEQ ID NO: 623336 - RNA, 17 nt, Homo sapiens
cauaaauuggcuuuuca

SEQ ID NO: 623337 - RNA, 18 nt, Homo sapiens
cauaaauugguauaauaa

SEQ ID NO: 623338 - RNA, 20 nt, Homo sapiens
cauaaauuuuauaugcacag

SEQ ID NO: 623339 - RNA, 16 nt, Homo sapiens
cauaacaugcuuuaga

SEQ ID NO: 623340 - RNA, 14 nt, Homo sapiens
cauaacauggguac

SEQ ID NO: 623341 - RNA, 23 nt, Homo sapiens
cauaacauuguacuguaauggag

SEQ ID NO: 623342 - RNA, 15 nt, Homo sapiens
cauaaccaacauuaa

SEQ ID NO: 623343 - RNA, 14 nt, Homo sapiens
cauaacccaugaag

SEQ ID NO: 623344 - RNA, 22 nt, Homo sapiens
cauaacggaaaaauaauugcca

SEQ ID NO: 623345 - RNA, 11 nt, Homo sapiens
cauaacuguag

SEQ ID NO: 623346 - RNA, 22 nt, Homo sapiens
cauaacuucauagaugcaggag

SEQ ID NO: 623347 - RNA, 12 nt, Homo sapiens
cauaacuugaaa

SEQ ID NO: 623348 - RNA, 15 nt, Homo sapiens
cauaacuugcugaau

SEQ ID NO: 623349 - RNA, 17 nt, Homo sapiens
cauaacuugcugaauuu

SEQ ID NO: 623350 - RNA, 19 nt, Homo sapiens
cauaacuugcugaauuuca

SEQ ID NO: 623351 - RNA, 15 nt, Homo sapiens
cauaagaaagcacua

SEQ ID NO: 623352 - RNA, 18 nt, Homo sapiens
cauaagaaagcacuauua

SEQ ID NO: 623353 - RNA, 21 nt, Homo sapiens
cauaagaauuuuuuauaagua

SEQ ID NO: 623354 - RNA, 20 nt, Homo sapiens
cauaagacaaacuccugaaa

SEQ ID NO: 623355 - RNA, 23 nt, Homo sapiens
cauaagacaaacuccugaaaugc

SEQ ID NO: 623356 - RNA, 20 nt, Homo sapiens
cauaagagagccuugguuca

SEQ ID NO: 623357 - RNA, 18 nt, Homo sapiens
cauaagcaaagacuauga

SEQ ID NO: 623358 - RNA, 17 nt, Homo sapiens
cauaagccaaaacugag

SEQ ID NO: 623359 - RNA, 20 nt, Homo sapiens
cauaagccuccauuuaguuc

SEQ ID NO: 623360 - RNA, 19 nt, Homo sapiens
cauaagggacugugccaga

SEQ ID NO: 623361 - RNA, 21 nt, Homo sapiens
cauaagguuuuauucauauau

SEQ ID NO: 623362 - RNA, 23 nt, Homo sapiens
cauaaguaaucacuaaugcucaa

SEQ ID NO: 623363 - RNA, 11 nt, Homo sapiens
cauaaguccuc

SEQ ID NO: 623364 - RNA, 21 nt, Homo sapiens
cauaagucgucacuaauacac

SEQ ID NO: 623365 - RNA, 21 nt, Homo sapiens
cauaagugaaaaucuuacaac

SEQ ID NO: 623366 - RNA, 16 nt, Homo sapiens
cauaaguuuaacugua

SEQ ID NO: 623367 - RNA, 21 nt, Homo sapiens
cauaauaaaaaauuaugacaa

SEQ ID NO: 623368 - RNA, 16 nt, Homo sapiens
cauaauaaaaaggcaa

SEQ ID NO: 623369 - RNA, 21 nt, Homo sapiens
cauaauaaaaggaguucagau

SEQ ID NO: 623370 - RNA, 18 nt, Homo sapiens
cauaauaaaguggugauu

SEQ ID NO: 623371 - RNA, 16 nt, Homo sapiens
cauaauaaauaauuaa

SEQ ID NO: 623372 - RNA, 22 nt, Homo sapiens
cauaauaaauaauuaaccacca

SEQ ID NO: 623373 - RNA, 17 nt, Homo sapiens
cauaauaagcuaaagag

SEQ ID NO: 623374 - RNA, 20 nt, Homo sapiens
cauaauagcuacagugcaua

SEQ ID NO: 623375 - RNA, 15 nt, Homo sapiens
cauaauagucaauuu

SEQ ID NO: 623376 - RNA, 15 nt, Homo sapiens
cauaaucuaguuuac

SEQ ID NO: 623377 - RNA, 19 nt, Homo sapiens
cauaaugaaaaacuauguc

SEQ ID NO: 623378 - RNA, 21 nt, Homo sapiens
cauaauggacucuguggugcc

SEQ ID NO: 623379 - RNA, 21 nt, Homo sapiens
cauaauuauuauuuccagugu

SEQ ID NO: 623380 - RNA, 17 nt, Homo sapiens
cauaauuauuuuguuga

SEQ ID NO: 623381 - RNA, 20 nt, Homo sapiens
cauaauucagcacuuaacua

SEQ ID NO: 623382 - RNA, 15 nt, Homo sapiens
cauaauucuaaguua

SEQ ID NO: 623383 - RNA, 19 nt, Homo sapiens
cauaauucuuuugaaaaua

SEQ ID NO: 623384 - RNA, 16 nt, Homo sapiens
cauaauuguucuuagu

SEQ ID NO: 623385 - RNA, 15 nt, Homo sapiens
cauaauuuaaaaaua

SEQ ID NO: 623386 - RNA, 23 nt, Homo sapiens
cauaauuuaaaaaucuccauuaa

SEQ ID NO: 623387 - RNA, 20 nt, Homo sapiens
cauacaaauucuacuuuaau

SEQ ID NO: 623388 - RNA, 14 nt, Homo sapiens
cauacaauguaugu

SEQ ID NO: 623389 - RNA, 23 nt, Homo sapiens
cauacaauuauuuuuacaguucu

SEQ ID NO: 623390 - RNA, 21 nt, Homo sapiens
cauacaccacugcaaaauguc

SEQ ID NO: 623391 - RNA, 16 nt, Homo sapiens
cauacacuuauuggaa

SEQ ID NO: 623392 - RNA, 16 nt, Homo sapiens
cauacagagacagaua

SEQ ID NO: 623393 - RNA, 16 nt, Homo sapiens
cauacagcuucauaaa

SEQ ID NO: 623394 - RNA, 14 nt, Homo sapiens
cauacaguuuucau

SEQ ID NO: 623395 - RNA, 15 nt, Homo sapiens
cauacauacauacau

SEQ ID NO: 623396 - RNA, 15 nt, Homo sapiens
cauacauacauauau

SEQ ID NO: 623397 - RNA, 16 nt, Homo sapiens
cauacauacauauaua

SEQ ID NO: 623398 - RNA, 13 nt, Homo sapiens
cauacauagacau

SEQ ID NO: 623399 - RNA, 21 nt, Homo sapiens
cauaccaagacccccgucucu

SEQ ID NO: 623400 - RNA, 20 nt, Homo sapiens
cauacccacccuuacuuccu

SEQ ID NO: 623401 - RNA, 20 nt, Homo sapiens
cauacccuuacucugccaga

SEQ ID NO: 623402 - RNA, 20 nt, Homo sapiens
cauaccuuuggauuuagugu

SEQ ID NO: 623403 - RNA, 15 nt, Homo sapiens
cauacggagcagaau

SEQ ID NO: 623404 - RNA, 14 nt, Homo sapiens
cauacgucagcauu

SEQ ID NO: 623405 - RNA, 22 nt, Homo sapiens
cauacuccaacugaaauguuaa

SEQ ID NO: 623406 - RNA, 22 nt, Homo sapiens
cauacuccuuuuaagcagugag

SEQ ID NO: 623407 - RNA, 20 nt, Homo sapiens
cagguuccuuaucugucaca

SEQ ID NO: 623408 - RNA, 12 nt, Homo sapiens
cagguucuuagg

SEQ ID NO: 623409 - RNA, 18 nt, Homo sapiens
cagguugaagccaugucu

SEQ ID NO: 623410 - RNA, 21 nt, Homo sapiens
cagguuggaugggagugggca

SEQ ID NO: 623411 - RNA, 15 nt, Homo sapiens
cagguuggugggggc

SEQ ID NO: 623412 - RNA, 16 nt, Homo sapiens
cagguuuacuauguuu

SEQ ID NO: 623413 - RNA, 16 nt, Homo sapiens
cagguuuagacaguau

SEQ ID NO: 623414 - RNA, 19 nt, Homo sapiens
cagguuuaugaaugacagu

SEQ ID NO: 623415 - RNA, 16 nt, Homo sapiens
cagguuuccugacucc

SEQ ID NO: 623416 - RNA, 12 nt, Homo sapiens
cagguuugccag

SEQ ID NO: 623417 - RNA, 21 nt, Homo sapiens
cagguuugguuuuuuuguaca

SEQ ID NO: 623418 - RNA, 14 nt, Homo sapiens
cagguuuguuacau

SEQ ID NO: 623419 - RNA, 18 nt, Homo sapiens
caguaaaaacuguucucu

SEQ ID NO: 623420 - RNA, 17 nt, Homo sapiens
caguaaagaaacugaug

SEQ ID NO: 623421 - RNA, 22 nt, Homo sapiens
caguaaagcacuugcaaccguc

SEQ ID NO: 623422 - RNA, 18 nt, Homo sapiens
caguaaaggcugcugcua

SEQ ID NO: 623423 - RNA, 16 nt, Homo sapiens
caguaaauaacuggaa

SEQ ID NO: 623424 - RNA, 14 nt, Homo sapiens
caguaaauaccuug

SEQ ID NO: 623425 - RNA, 20 nt, Homo sapiens
caguaaaugugauucaccuc

SEQ ID NO: 623426 - RNA, 19 nt, Homo sapiens
caguaacugugacugauga

SEQ ID NO: 623427 - RNA, 17 nt, Homo sapiens
caguaagaaaaagaaga

SEQ ID NO: 623428 - RNA, 15 nt, Homo sapiens
caguaaucagaguua

SEQ ID NO: 623429 - RNA, 18 nt, Homo sapiens
caguaaucccauuuccca

SEQ ID NO: 623430 - RNA, 12 nt, Homo sapiens
caguaaucuuua

SEQ ID NO: 623431 - RNA, 14 nt, Homo sapiens
caguaauggaauga

SEQ ID NO: 623432 - RNA, 15 nt, Homo sapiens
caguaauggaaugaa

SEQ ID NO: 623433 - RNA, 17 nt, Homo sapiens
caguaauuccuguuacu

SEQ ID NO: 623434 - RNA, 12 nt, Homo sapiens
caguacauuuaa

SEQ ID NO: 623435 - RNA, 22 nt, Homo sapiens
caguaccccugguaaaccaagc

SEQ ID NO: 623436 - RNA, 16 nt, Homo sapiens
caguacccucucagcu

SEQ ID NO: 623437 - RNA, 11 nt, Homo sapiens
caguaccucaa

SEQ ID NO: 623438 - RNA, 21 nt, Homo sapiens
caguacuguugcgccgcaguu

SEQ ID NO: 623439 - RNA, 18 nt, Homo sapiens
caguagaaagcauaacaa

SEQ ID NO: 623440 - RNA, 23 nt, Homo sapiens
caguagaaagcauaacaaaaaga

SEQ ID NO: 623441 - RNA, 14 nt, Homo sapiens
caguagaacuccag

SEQ ID NO: 623442 - RNA, 14 nt, Homo sapiens
caguagagaucuau

SEQ ID NO: 623443 - RNA, 16 nt, Homo sapiens
caguagagcucuacug

SEQ ID NO: 623444 - RNA, 14 nt, Homo sapiens
caguagauacuaaa

SEQ ID NO: 623445 - RNA, 14 nt, Homo sapiens
caguagauuuucca

SEQ ID NO: 623446 - RNA, 18 nt, Homo sapiens
caguagcaaacuuuucac

SEQ ID NO: 623447 - RNA, 22 nt, Homo sapiens
caguagcaucuguaacagcauu

SEQ ID NO: 623448 - RNA, 20 nt, Homo sapiens
caguagcuaaagugcaagac

SEQ ID NO: 623449 - RNA, 16 nt, Homo sapiens
caguagcuccaacacu

SEQ ID NO: 623450 - RNA, 20 nt, Homo sapiens
caguagcuccaacacuuuga

SEQ ID NO: 623451 - RNA, 18 nt, Homo sapiens
caguaguauaugguguuc

SEQ ID NO: 623452 - RNA, 22 nt, Homo sapiens
caguagucccugcacagugacu

SEQ ID NO: 623453 - RNA, 22 nt, Homo sapiens
caguauaagcaucugccaucug

SEQ ID NO: 623454 - RNA, 15 nt, Homo sapiens
caguauaagccuuuu

SEQ ID NO: 623455 - RNA, 17 nt, Homo sapiens
caguauaaucuuuucau

SEQ ID NO: 623456 - RNA, 22 nt, Homo sapiens
caguaucagaauacuugcacuc

SEQ ID NO: 623457 - RNA, 14 nt, Homo sapiens
caguaucaucucca

SEQ ID NO: 623458 - RNA, 16 nt, Homo sapiens
caguaucccacaucca

SEQ ID NO: 623459 - RNA, 18 nt, Homo sapiens
caguaucccacauccaac

SEQ ID NO: 623460 - RNA, 14 nt, Homo sapiens
caguaugacaguau

SEQ ID NO: 623461 - RNA, 14 nt, Homo sapiens
caguaugacauuuc

SEQ ID NO: 623462 - RNA, 20 nt, Homo sapiens
caguaugagucaaugugcag

SEQ ID NO: 623463 - RNA, 21 nt, Homo sapiens
caguaugagucaaugugcagu

SEQ ID NO: 623464 - RNA, 17 nt, Homo sapiens
caguaugggaucugaua

SEQ ID NO: 623465 - RNA, 14 nt, Homo sapiens
caguauuaagugug

SEQ ID NO: 623466 - RNA, 18 nt, Homo sapiens
caguauucugacauguaa

SEQ ID NO: 623467 - RNA, 19 nt, Homo sapiens
caguauucuguaaagcuua

SEQ ID NO: 623468 - RNA, 22 nt, Homo sapiens
caguauuuacucugcuccaaag

SEQ ID NO: 623469 - RNA, 21 nt, Homo sapiens
caguauuucauugccugugua

SEQ ID NO: 623470 - RNA, 18 nt, Homo sapiens
cagucaaggauggaugca

SEQ ID NO: 623471 - RNA, 18 nt, Homo sapiens
cagucaaucuaugagggu

SEQ ID NO: 623472 - RNA, 13 nt, Homo sapiens
cagucacaacaga

SEQ ID NO: 623473 - RNA, 12 nt, Homo sapiens
cagucacagcca

SEQ ID NO: 623474 - RNA, 17 nt, Homo sapiens
cagucacccuucugggc

SEQ ID NO: 623475 - RNA, 20 nt, Homo sapiens
cagucacgcaagcuaguucc

SEQ ID NO: 623476 - RNA, 20 nt, Homo sapiens
cagucacugcugcaaggugg

SEQ ID NO: 623477 - RNA, 23 nt, Homo sapiens
cagucacugugguguaauaugaa

SEQ ID NO: 623478 - RNA, 16 nt, Homo sapiens
cagucagaugaggcaa

SEQ ID NO: 623479 - RNA, 11 nt, Homo sapiens
cagucagggac

SEQ ID NO: 623480 - RNA, 14 nt, Homo sapiens
cagucaucuacuuu

SEQ ID NO: 623481 - RNA, 17 nt, Homo sapiens
cagucaucugucuuuca

SEQ ID NO: 623482 - RNA, 21 nt, Homo sapiens
cagucauggaaucuugcugca

SEQ ID NO: 623483 - RNA, 19 nt, Homo sapiens
cagucauggccugagaugc

SEQ ID NO: 623484 - RNA, 16 nt, Homo sapiens
caguccaauaggugua

SEQ ID NO: 623485 - RNA, 15 nt, Homo sapiens
caguccaggccucuc

SEQ ID NO: 623486 - RNA, 13 nt, Homo sapiens
caguccaugucuc

SEQ ID NO: 623487 - RNA, 13 nt, Homo sapiens
caguccauugcuc

SEQ ID NO: 623488 - RNA, 21 nt, Homo sapiens
caguccauuuccuaauguaua

SEQ ID NO: 623489 - RNA, 15 nt, Homo sapiens
cagucccaucagaga

SEQ ID NO: 623490 - RNA, 15 nt, Homo sapiens
caguccccagcccuu

SEQ ID NO: 623491 - RNA, 18 nt, Homo sapiens
cagucccucacaccuggg

SEQ ID NO: 623492 - RNA, 20 nt, Homo sapiens
caguccuggguuguuuccag

SEQ ID NO: 623493 - RNA, 16 nt, Homo sapiens
ccagaacaggacucca

SEQ ID NO: 623494 - RNA, 17 nt, Homo sapiens
ccagaacuguuuucuca

SEQ ID NO: 623495 - RNA, 22 nt, Homo sapiens
ccagaagaaagggccuucacag

SEQ ID NO: 623496 - RNA, 13 nt, Homo sapiens
ccagaagauucua

SEQ ID NO: 623497 - RNA, 16 nt, Homo sapiens
ccagaaggauauuuac

SEQ ID NO: 623498 - RNA, 17 nt, Homo sapiens
ccagaauaucugggauu

SEQ ID NO: 623499 - RNA, 15 nt, Homo sapiens
ccagaaugcugaacu

SEQ ID NO: 623500 - RNA, 12 nt, Homo sapiens
ccagaaugcugc

SEQ ID NO: 623501 - RNA, 22 nt, Homo sapiens
ccagaaugcugcaggacuugag

SEQ ID NO: 623502 - RNA, 17 nt, Homo sapiens
ccagaauggagccugcu

SEQ ID NO: 623503 - RNA, 16 nt, Homo sapiens
ccagacaaccaaaaca

SEQ ID NO: 623504 - RNA, 19 nt, Homo sapiens
ccagacaauggcccagguc

SEQ ID NO: 623505 - RNA, 15 nt, Homo sapiens
ccagacaauuccauu

SEQ ID NO: 623506 - RNA, 16 nt, Homo sapiens
ccagacacagacuggc

SEQ ID NO: 623507 - RNA, 19 nt, Homo sapiens
ccagacacagacuggcaau

SEQ ID NO: 623508 - RNA, 19 nt, Homo sapiens
ccagacaccagugcgugcu

SEQ ID NO: 623509 - RNA, 15 nt, Homo sapiens
ccagacacugagcuu

SEQ ID NO: 623510 - RNA, 21 nt, Homo sapiens
ccagacagacaacacugggaa

SEQ ID NO: 623511 - RNA, 23 nt, Homo sapiens
ccagacagcaacggggaggccaa

SEQ ID NO: 623512 - RNA, 14 nt, Homo sapiens
ccagacccacugaa

SEQ ID NO: 623513 - RNA, 21 nt, Homo sapiens
ccagaccccaaaccagcccuu

SEQ ID NO: 623514 - RNA, 16 nt, Homo sapiens
ccagaccccguggcuc

SEQ ID NO: 623515 - RNA, 17 nt, Homo sapiens
ccagacccgagucaauu

SEQ ID NO: 623516 - RNA, 23 nt, Homo sapiens
aucuucagcccaggcuuuugcua

SEQ ID NO: 623517 - RNA, 24 nt, Homo sapiens
aucuucagcucuuuuuguggauau

SEQ ID NO: 623518 - RNA, 21 nt, Homo sapiens
aucuucagggaacugcauaga

SEQ ID NO: 623519 - RNA, 22 nt, Homo sapiens
aucuucagggaacugcauagau

SEQ ID NO: 623520 - RNA, 18 nt, Homo sapiens
aucuuccaaggguacuaa

SEQ ID NO: 623521 - RNA, 21 nt, Homo sapiens
aucuuccaaggguacuaagga

SEQ ID NO: 623522 - RNA, 21 nt, Homo sapiens
aucuuccaccucaccucuuug

SEQ ID NO: 623523 - RNA, 19 nt, Homo sapiens
aucuuccccaagagggacu

SEQ ID NO: 623524 - RNA, 14 nt, Homo sapiens
aucuuccugugucc

SEQ ID NO: 623525 - RNA, 22 nt, Homo sapiens
aucuucuaaacccaauccaaau

SEQ ID NO: 623526 - RNA, 15 nt, Homo sapiens
aucuucugccuuagu

SEQ ID NO: 623527 - RNA, 21 nt, Homo sapiens
aucuucugggagcaggaacaa

SEQ ID NO: 623528 - RNA, 19 nt, Homo sapiens
aucuucuuagcucaucuua

SEQ ID NO: 623529 - RNA, 16 nt, Homo sapiens
aucuucuucaccauuu

SEQ ID NO: 623530 - RNA, 19 nt, Homo sapiens
aucuucuuccagauuuccu

SEQ ID NO: 623531 - RNA, 20 nt, Homo sapiens
aucuucuugcaucuaaugaa

SEQ ID NO: 623532 - RNA, 15 nt, Homo sapiens
aucuugagggaccaa

SEQ ID NO: 623533 - RNA, 14 nt, Homo sapiens
aucuugaguauuua

SEQ ID NO: 623534 - RNA, 17 nt, Homo sapiens
aucuugaguugcagcuc

SEQ ID NO: 623535 - RNA, 15 nt, Homo sapiens
aucuugauaccaccu

SEQ ID NO: 623536 - RNA, 14 nt, Homo sapiens
aucuugaucugugu

SEQ ID NO: 623537 - RNA, 17 nt, Homo sapiens
aucuugauuucacugga

SEQ ID NO: 623538 - RNA, 24 nt, Homo sapiens
aucuugccugucuggcucaggguc

SEQ ID NO: 623539 - RNA, 15 nt, Homo sapiens
aucuugcuaccagua

SEQ ID NO: 623540 - RNA, 14 nt, Homo sapiens
aucuugcucugcau

SEQ ID NO: 623541 - RNA, 13 nt, Homo sapiens
aucuugcuggcua

SEQ ID NO: 623542 - RNA, 14 nt, Homo sapiens
aucuuggacugaca

SEQ ID NO: 623543 - RNA, 19 nt, Homo sapiens
aucuuggagaaugugagaa

SEQ ID NO: 623544 - RNA, 20 nt, Homo sapiens
aucuuggagacccugcaaac

SEQ ID NO: 623545 - RNA, 23 nt, Homo sapiens
aucuuguuuuuccacuacugcua

SEQ ID NO: 623546 - RNA, 20 nt, Homo sapiens
aucuuuaaagccgugcucuu

SEQ ID NO: 623547 - RNA, 21 nt, Homo sapiens
aucuuuacaaaacuacaugag

SEQ ID NO: 623548 - RNA, 16 nt, Homo sapiens
aucuuuacguacugua

SEQ ID NO: 623549 - RNA, 17 nt, Homo sapiens
aucuuuacguacuguaa

SEQ ID NO: 623550 - RNA, 15 nt, Homo sapiens
aucuuuacucaggca

SEQ ID NO: 623551 - RNA, 14 nt, Homo sapiens
aucuuuauugaacu

SEQ ID NO: 623552 - RNA, 16 nt, Homo sapiens
aucuuucuaaaacugc

SEQ ID NO: 623553 - RNA, 10 nt, Homo sapiens
aucuuucuac

SEQ ID NO: 623554 - RNA, 16 nt, Homo sapiens
aucuuucuccuugaau

SEQ ID NO: 623555 - RNA, 19 nt, Homo sapiens
aucuuucucuuacaaucug

SEQ ID NO: 623556 - RNA, 23 nt, Homo sapiens
aucuuucuuuccaaaacauuucu

SEQ ID NO: 623557 - RNA, 22 nt, Homo sapiens
aucuuucuuuucccaacauaug

SEQ ID NO: 623558 - RNA, 15 nt, Homo sapiens
aucuuugagcccauu

SEQ ID NO: 623559 - RNA, 13 nt, Homo sapiens
aucuuugauacuu

SEQ ID NO: 623560 - RNA, 18 nt, Homo sapiens
aucuuugccuuuaucucu

SEQ ID NO: 623561 - RNA, 15 nt, Homo sapiens
aucuuuggauuugau

SEQ ID NO: 623562 - RNA, 18 nt, Homo sapiens
aucuuuguggccaaggag

SEQ ID NO: 623563 - RNA, 23 nt, Homo sapiens
aucuuuguguaaucuaaguauau

SEQ ID NO: 623564 - RNA, 13 nt, Homo sapiens
aucuuuuacuuuu

SEQ ID NO: 623565 - RNA, 23 nt, Homo sapiens
aucuuuuaguuuuaguugcagaa

SEQ ID NO: 623566 - RNA, 19 nt, Homo sapiens
aucuuuuauaaugauucau

SEQ ID NO: 623567 - RNA, 19 nt, Homo sapiens
aucuuuuauagacgcucuu

SEQ ID NO: 623568 - RNA, 14 nt, Homo sapiens
aucuuuugugagau

SEQ ID NO: 623569 - RNA, 18 nt, Homo sapiens
augaaaaaaaaaugggaa

SEQ ID NO: 623570 - RNA, 18 nt, Homo sapiens
augaaaaauguaaauacu

SEQ ID NO: 623571 - RNA, 23 nt, Homo sapiens
augaaaaauguguuccauugcca

SEQ ID NO: 623572 - RNA, 21 nt, Homo sapiens
augaaaacauagcaucucagg

SEQ ID NO: 623573 - RNA, 22 nt, Homo sapiens
augaaaacauagcaucucagga

SEQ ID NO: 623574 - RNA, 13 nt, Homo sapiens
augaaaagcagaa

SEQ ID NO: 623575 - RNA, 20 nt, Homo sapiens
augaaaaggucagacugaaa

SEQ ID NO: 623576 - RNA, 13 nt, Homo sapiens
augaaaagugcau

SEQ ID NO: 623577 - RNA, 17 nt, Homo sapiens
augaaacaaauaaucac

SEQ ID NO: 623578 - RNA, 18 nt, Homo sapiens
augaaacaaauaaucaca

SEQ ID NO: 623579 - RNA, 15 nt, Homo sapiens
augaaacaccuucuc

SEQ ID NO: 623580 - RNA, 16 nt, Homo sapiens
augaaacauuuuguca

SEQ ID NO: 623581 - RNA, 20 nt, Homo sapiens
augaaaccccguuucuacua

SEQ ID NO: 623582 - RNA, 22 nt, Homo sapiens
augaaaccuuauuuuuucccaa

SEQ ID NO: 623583 - RNA, 14 nt, Homo sapiens
augaaaguggacaa

SEQ ID NO: 623584 - RNA, 20 nt, Homo sapiens
augaaauaaaaagauccugc

SEQ ID NO: 623585 - RNA, 21 nt, Homo sapiens
augaaauccagugagcacuag

SEQ ID NO: 623586 - RNA, 15 nt, Homo sapiens
augaaaugcuuccaa

SEQ ID NO: 623587 - RNA, 18 nt, Homo sapiens
augaaauguaugugcucu

SEQ ID NO: 623588 - RNA, 18 nt, Homo sapiens
augaaauguccucuugaa

SEQ ID NO: 623589 - RNA, 17 nt, Homo sapiens
augaaauuccagcaaua

SEQ ID NO: 623590 - RNA, 20 nt, Homo sapiens
augaaauucuugaaguucau

SEQ ID NO: 623591 - RNA, 20 nt, Homo sapiens
augaaauuguaaaaccuguc

SEQ ID NO: 623592 - RNA, 15 nt, Homo sapiens
augaaauugucaaaa

SEQ ID NO: 623593 - RNA, 11 nt, Homo sapiens
augaacacaga

SEQ ID NO: 623594 - RNA, 14 nt, Homo sapiens
augaacauccaaau

SEQ ID NO: 623595 - RNA, 16 nt, Homo sapiens
augaacaugcaguuca

SEQ ID NO: 623596 - RNA, 13 nt, Homo sapiens
augaacccaaaaa

SEQ ID NO: 623597 - RNA, 15 nt, Homo sapiens
augaacucuuaauca

SEQ ID NO: 623598 - RNA, 23 nt, Homo sapiens
augaacuguuagguucugaugac

SEQ ID NO: 623599 - RNA, 18 nt, Homo sapiens
augaagaaaaucacuuag

SEQ ID NO: 623600 - RNA, 16 nt, Homo sapiens
augaagacaucaggaa

SEQ ID NO: 623601 - RNA, 17 nt, Homo sapiens
augaagaccaaagacca

SEQ ID NO: 623602 - RNA, 15 nt, Homo sapiens
augaagaccaugccu

SEQ ID NO: 623603 - RNA, 20 nt, Homo sapiens
augaagacccuggaguucaa

SEQ ID NO: 623604 - RNA, 21 nt, Homo sapiens
augaagauucuccugugcuag

SEQ ID NO: 623605 - RNA, 15 nt, Homo sapiens
auugucuuagucaaa

SEQ ID NO: 623606 - RNA, 12 nt, Homo sapiens
auugugaauauu

SEQ ID NO: 623607 - RNA, 16 nt, Homo sapiens
auugugaauuccuuaa

SEQ ID NO: 623608 - RNA, 15 nt, Homo sapiens
auugugagccaccac

SEQ ID NO: 623609 - RNA, 18 nt, Homo sapiens
auugugauauuuuuacuu

SEQ ID NO: 623610 - RNA, 15 nt, Homo sapiens
auugugauuuauuuc

SEQ ID NO: 623611 - RNA, 18 nt, Homo sapiens
auugugcacaucuugucu

SEQ ID NO: 623612 - RNA, 17 nt, Homo sapiens
auugugcuuucaccaga

SEQ ID NO: 623613 - RNA, 12 nt, Homo sapiens
auuguggaagac

SEQ ID NO: 623614 - RNA, 12 nt, Homo sapiens
auuguggcugca

SEQ ID NO: 623615 - RNA, 18 nt, Homo sapiens
auuguggguaacgugaga

SEQ ID NO: 623616 - RNA, 18 nt, Homo sapiens
auuguguauugaugcaau

SEQ ID NO: 623617 - RNA, 21 nt, Homo sapiens
auugugugucacaagaauuua

SEQ ID NO: 623618 - RNA, 16 nt, Homo sapiens
auuguguguuaauguc

SEQ ID NO: 623619 - RNA, 20 nt, Homo sapiens
auuguguuuugagguuuccu

SEQ ID NO: 623620 - RNA, 15 nt, Homo sapiens
auuguuaauuaucua

SEQ ID NO: 623621 - RNA, 20 nt, Homo sapiens
auuguuacauuauguggaaa

SEQ ID NO: 623622 - RNA, 16 nt, Homo sapiens
auuguuaccucugagu

SEQ ID NO: 623623 - RNA, 20 nt, Homo sapiens
auuguuaggagugguucuca

SEQ ID NO: 623624 - RNA, 17 nt, Homo sapiens
auuguuauaaagacaca

SEQ ID NO: 623625 - RNA, 20 nt, Homo sapiens
auuguuauacacagcuuuau

SEQ ID NO: 623626 - RNA, 21 nt, Homo sapiens
auuguuccaaaugaauguugu

SEQ ID NO: 623627 - RNA, 18 nt, Homo sapiens
auuguugacaacugugac

SEQ ID NO: 623628 - RNA, 19 nt, Homo sapiens
auuguugacaacugugacu

SEQ ID NO: 623629 - RNA, 18 nt, Homo sapiens
auuguuguugccaaagag

SEQ ID NO: 623630 - RNA, 14 nt, Homo sapiens
auuguuuaccauag

SEQ ID NO: 623631 - RNA, 13 nt, Homo sapiens
auuguuucauuca

SEQ ID NO: 623632 - RNA, 23 nt, Homo sapiens
auuguuugaacccgggaggcaga

SEQ ID NO: 623633 - RNA, 16 nt, Homo sapiens
auuguuuuaccagcuc

SEQ ID NO: 623634 - RNA, 21 nt, Homo sapiens
auuguuuugaaacucaguaug

SEQ ID NO: 623635 - RNA, 19 nt, Homo sapiens
auuguuuugagcuuuccau

SEQ ID NO: 623636 - RNA, 22 nt, Homo sapiens
auuguuuuuuacucgucuuccu

SEQ ID NO: 623637 - RNA, 20 nt, Homo sapiens
auuuaaaaaaacgagcaauu

SEQ ID NO: 623638 - RNA, 21 nt, Homo sapiens
auuuaaaaaacuaacacccag

SEQ ID NO: 623639 - RNA, 14 nt, Homo sapiens
auuuaaaaauaagu

SEQ ID NO: 623640 - RNA, 20 nt, Homo sapiens
auuuaaaacgcaugugcagc

SEQ ID NO: 623641 - RNA, 19 nt, Homo sapiens
auuuaaaacguuuugguca

SEQ ID NO: 623642 - RNA, 16 nt, Homo sapiens
auuuaaaaugagaucg

SEQ ID NO: 623643 - RNA, 12 nt, Homo sapiens
auuuaaacuaaa

SEQ ID NO: 623644 - RNA, 16 nt, Homo sapiens
auuuaaacucaagaca

SEQ ID NO: 623645 - RNA, 14 nt, Homo sapiens
auuuaaagcuuuca

SEQ ID NO: 623646 - RNA, 15 nt, Homo sapiens
auuuaaagcuuucaa

SEQ ID NO: 623647 - RNA, 14 nt, Homo sapiens
auuuaaaguauucu

SEQ ID NO: 623648 - RNA, 13 nt, Homo sapiens
auuuaaaguggca

SEQ ID NO: 623649 - RNA, 21 nt, Homo sapiens
auuuaaaguuguuugugccuu

SEQ ID NO: 623650 - RNA, 13 nt, Homo sapiens
auuuaaauuccac

SEQ ID NO: 623651 - RNA, 14 nt, Homo sapiens
auuuaaauuccaca

SEQ ID NO: 623652 - RNA, 15 nt, Homo sapiens
auuuaacauuaucua

SEQ ID NO: 623653 - RNA, 21 nt, Homo sapiens
auuuaaguauggaauauucau

SEQ ID NO: 623654 - RNA, 12 nt, Homo sapiens
auuuaagucugu

SEQ ID NO: 623655 - RNA, 12 nt, Homo sapiens
auuuaagugaau

SEQ ID NO: 623656 - RNA, 19 nt, Homo sapiens
auuuaaguuaucaacuuua

SEQ ID NO: 623657 - RNA, 21 nt, Homo sapiens
auuuaauaaaugacaaaugua

SEQ ID NO: 623658 - RNA, 20 nt, Homo sapiens
auuuaauguauuaaucuguu

SEQ ID NO: 623659 - RNA, 16 nt, Homo sapiens
auuuaauuuccagggu

SEQ ID NO: 623660 - RNA, 17 nt, Homo sapiens
aucaugaagcacaucaa

SEQ ID NO: 623661 - RNA, 21 nt, Homo sapiens
aucaugaagcacaucaauuac

SEQ ID NO: 623662 - RNA, 21 nt, Homo sapiens
aucaugcauagagugugaugu

SEQ ID NO: 623663 - RNA, 14 nt, Homo sapiens
aucaugcauuguug

SEQ ID NO: 623664 - RNA, 20 nt, Homo sapiens
aucaugcgauggucccccac

SEQ ID NO: 623665 - RNA, 16 nt, Homo sapiens
aucaugggcuggacau

SEQ ID NO: 623666 - RNA, 15 nt, Homo sapiens
aucaugguauuugac

SEQ ID NO: 623667 - RNA, 13 nt, Homo sapiens
aucauguauuuau

SEQ ID NO: 623668 - RNA, 13 nt, Homo sapiens
aucaugucuguau

SEQ ID NO: 623669 - RNA, 20 nt, Homo sapiens
aucaugugggugagccagug

SEQ ID NO: 623670 - RNA, 15 nt, Homo sapiens
aucauguguguccac

SEQ ID NO: 623671 - RNA, 18 nt, Homo sapiens
aucauguugaaacaaacc

SEQ ID NO: 623672 - RNA, 21 nt, Homo sapiens
aucauguugaauaaugcuguu

SEQ ID NO: 623673 - RNA, 20 nt, Homo sapiens
aucauuacugccaucuuuau

SEQ ID NO: 623674 - RNA, 19 nt, Homo sapiens
aucauuacugguaaagccu

SEQ ID NO: 623675 - RNA, 14 nt, Homo sapiens
aucauuacuuauga

SEQ ID NO: 623676 - RNA, 12 nt, Homo sapiens
aucauuagaaca

SEQ ID NO: 623677 - RNA, 20 nt, Homo sapiens
aucauuagagaaaugcaaau

SEQ ID NO: 623678 - RNA, 23 nt, Homo sapiens
aucauuagagaaaugcaaaucga

SEQ ID NO: 623679 - RNA, 14 nt, Homo sapiens
aucauuauaucauu

SEQ ID NO: 623680 - RNA, 19 nt, Homo sapiens
aucauuauuuagcaccguu

SEQ ID NO: 623681 - RNA, 16 nt, Homo sapiens
aucauucaacucucca

SEQ ID NO: 623682 - RNA, 19 nt, Homo sapiens
aucauucagcaucuacucu

SEQ ID NO: 623683 - RNA, 22 nt, Homo sapiens
aucauucauccaggacugagau

SEQ ID NO: 623684 - RNA, 12 nt, Homo sapiens
aucauugcauuu

SEQ ID NO: 623685 - RNA, 12 nt, Homo sapiens
aucauugguucg

SEQ ID NO: 623686 - RNA, 23 nt, Homo sapiens
aucauuuccugggagaaagacca

SEQ ID NO: 623687 - RNA, 15 nt, Homo sapiens
aucauuugacuaaga

SEQ ID NO: 623688 - RNA, 17 nt, Homo sapiens
aucauuuuaacaggugc

SEQ ID NO: 623689 - RNA, 19 nt, Homo sapiens
aucauuuuagcugguguca

SEQ ID NO: 623690 - RNA, 18 nt, Homo sapiens
aucauuuugaacaugugu

SEQ ID NO: 623691 - RNA, 19 nt, Homo sapiens
aucauuuuuaaauauaggu

SEQ ID NO: 623692 - RNA, 23 nt, Homo sapiens
auccaaaaauguguaagaacaac

SEQ ID NO: 623693 - RNA, 21 nt, Homo sapiens
auccaaagaacuugauuugca

SEQ ID NO: 623694 - RNA, 17 nt, Homo sapiens
auccaaaggugcucaga

SEQ ID NO: 623695 - RNA, 21 nt, Homo sapiens
auccaaauaagccuugaaaaa

SEQ ID NO: 623696 - RNA, 13 nt, Homo sapiens
auccaaccacugu

SEQ ID NO: 623697 - RNA, 16 nt, Homo sapiens
auccaaccuccuguca

SEQ ID NO: 623698 - RNA, 13 nt, Homo sapiens
auccaacuccagc

SEQ ID NO: 623699 - RNA, 16 nt, Homo sapiens
auccaacuccaggaua

SEQ ID NO: 623700 - RNA, 18 nt, Homo sapiens
auccaacuggaaauucca

SEQ ID NO: 623701 - RNA, 17 nt, Homo sapiens
auccaagaagcaugcag

SEQ ID NO: 623702 - RNA, 19 nt, Homo sapiens
auccaagccuugugucugc

SEQ ID NO: 623703 - RNA, 23 nt, Homo sapiens
auccaagcgaggucaacagagaa

SEQ ID NO: 623704 - RNA, 17 nt, Homo sapiens
auccaaggaaacaugca

SEQ ID NO: 623705 - RNA, 19 nt, Homo sapiens
auccaauccacuaacacuu

SEQ ID NO: 623706 - RNA, 17 nt, Homo sapiens
auccaaugaguguuaca

SEQ ID NO: 623707 - RNA, 12 nt, Homo sapiens
auccacaaagua

SEQ ID NO: 623708 - RNA, 20 nt, Homo sapiens
auccacaaaugaagggauau

SEQ ID NO: 623709 - RNA, 18 nt, Homo sapiens
auccacaacuuguaccaa

SEQ ID NO: 623710 - RNA, 14 nt, Homo sapiens
auccacaagccauu

SEQ ID NO: 623711 - RNA, 15 nt, Homo sapiens
auccacaagccauuu

SEQ ID NO: 623712 - RNA, 16 nt, Homo sapiens
auccacaauagcugac

SEQ ID NO: 623713 - RNA, 14 nt, Homo sapiens
auccacaauucauu

SEQ ID NO: 623714 - RNA, 15 nt, Homo sapiens
auccacacugagaga

SEQ ID NO: 623715 - RNA, 15 nt, Homo sapiens
auccacacugcacac

SEQ ID NO: 623716 - RNA, 20 nt, Homo sapiens
auccacagcuauauccugau

SEQ ID NO: 623717 - RNA, 17 nt, Homo sapiens
auccacaguacucacuu

SEQ ID NO: 623718 - RNA, 18 nt, Homo sapiens
auccaccaagaacauaag

SEQ ID NO: 623719 - RNA, 15 nt, Homo sapiens
auccaccaccucccu

SEQ ID NO: 623720 - RNA, 18 nt, Homo sapiens
auccaccccguugcucaa

SEQ ID NO: 623721 - RNA, 19 nt, Homo sapiens
auccaccccguugcucaag

SEQ ID NO: 623722 - RNA, 17 nt, Homo sapiens
auccaccucccuaccaa

SEQ ID NO: 623723 - RNA, 12 nt, Homo sapiens
auccaccugccu

SEQ ID NO: 623724 - RNA, 20 nt, Homo sapiens
auccacuaacacuuuaguua

SEQ ID NO: 623725 - RNA, 14 nt, Homo sapiens
auccacuccuuccu

SEQ ID NO: 623726 - RNA, 15 nt, Homo sapiens
auccacuucucucag

SEQ ID NO: 623727 - RNA, 12 nt, Homo sapiens
auccacuucuug

SEQ ID NO: 623728 - RNA, 14 nt, Homo sapiens
auccagaaggggag

SEQ ID NO: 623729 - RNA, 19 nt, Homo sapiens
auccagaccaaccuuccau

SEQ ID NO: 623730 - RNA, 13 nt, Homo sapiens
auccagagcaauu

SEQ ID NO: 623731 - RNA, 15 nt, Homo sapiens
auccagauccagacu

SEQ ID NO: 623732 - RNA, 12 nt, Homo sapiens
auccagcacugg

SEQ ID NO: 623733 - RNA, 15 nt, Homo sapiens
auccagcaguauuuu

SEQ ID NO: 623734 - RNA, 15 nt, Homo sapiens
auccagcuccucuag

SEQ ID NO: 623735 - RNA, 17 nt, Homo sapiens
auccaggacucugucaa

SEQ ID NO: 623736 - RNA, 15 nt, Homo sapiens
auccaggacugagau

SEQ ID NO: 623737 - RNA, 17 nt, Homo sapiens
auccaggcaccaggacu

SEQ ID NO: 623738 - RNA, 17 nt, Homo sapiens
auccaggccucagccuc

SEQ ID NO: 623739 - RNA, 20 nt, Homo sapiens
auccagggcccccaucucau

SEQ ID NO: 623740 - RNA, 20 nt, Homo sapiens
auccaguguauaaauccaau

SEQ ID NO: 623741 - RNA, 22 nt, Homo sapiens
auccaguguauaaauccaauau

SEQ ID NO: 623742 - RNA, 19 nt, Homo sapiens
auccaguuaacaucaucac

SEQ ID NO: 623743 - RNA, 21 nt, Homo sapiens
auccaguuucccaccaccuug

SEQ ID NO: 623744 - RNA, 17 nt, Homo sapiens
auccauaacuuuagucu

SEQ ID NO: 623745 - RNA, 22 nt, Homo sapiens
auccauagugcacuagcauuuu

SEQ ID NO: 623746 - RNA, 13 nt, Homo sapiens
auccauccaaagg

SEQ ID NO: 623747 - RNA, 14 nt, Homo sapiens
auccauccauccaa

SEQ ID NO: 623748 - RNA, 24 nt, Homo sapiens
auccaucugcuuacaauucccugc

SEQ ID NO: 623749 - RNA, 19 nt, Homo sapiens
auccaugcaccuaccuuag

SEQ ID NO: 623750 - RNA, 16 nt, Homo sapiens
auccauuuuacacagc

SEQ ID NO: 623751 - RNA, 17 nt, Homo sapiens
auuucacgaacuguuca

SEQ ID NO: 623752 - RNA, 22 nt, Homo sapiens
auuucacgcuuuuaauucucau

SEQ ID NO: 623753 - RNA, 18 nt, Homo sapiens
auuucacugaugcuucua

SEQ ID NO: 623754 - RNA, 13 nt, Homo sapiens
auuucacugaugu

SEQ ID NO: 623755 - RNA, 20 nt, Homo sapiens
auuucagaucauauuucaca

SEQ ID NO: 623756 - RNA, 13 nt, Homo sapiens
auuucagcacauu

SEQ ID NO: 623757 - RNA, 13 nt, Homo sapiens
auuucagcucuug

SEQ ID NO: 623758 - RNA, 22 nt, Homo sapiens
auuucagggucuuggcugccug

SEQ ID NO: 623759 - RNA, 15 nt, Homo sapiens
auuucaggugugaga

SEQ ID NO: 623760 - RNA, 18 nt, Homo sapiens
auuucaguaucaucucca

SEQ ID NO: 623761 - RNA, 21 nt, Homo sapiens
auuucauacccaugucagauu

SEQ ID NO: 623762 - RNA, 22 nt, Homo sapiens
auuucauccuugaauccuaugu

SEQ ID NO: 623763 - RNA, 19 nt, Homo sapiens
auuucaugugaaucccuuu

SEQ ID NO: 623764 - RNA, 13 nt, Homo sapiens
auuucauuaucau

SEQ ID NO: 623765 - RNA, 16 nt, Homo sapiens
auuucauuuagcuuuu

SEQ ID NO: 623766 - RNA, 22 nt, Homo sapiens
auuucauuucagccacuucugc

SEQ ID NO: 623767 - RNA, 13 nt, Homo sapiens
auuuccacaaaau

SEQ ID NO: 623768 - RNA, 16 nt, Homo sapiens
auuuccacugaacaaa

SEQ ID NO: 623769 - RNA, 15 nt, Homo sapiens
auuuccacuguauau

SEQ ID NO: 623770 - RNA, 16 nt, Homo sapiens
auuuccagaacuacca

SEQ ID NO: 623771 - RNA, 14 nt, Homo sapiens
auuuccagacaaau

SEQ ID NO: 623772 - RNA, 19 nt, Homo sapiens
auuuccagagccagcucaa

SEQ ID NO: 623773 - RNA, 22 nt, Homo sapiens
auuuccaguguucuaugaacaa

SEQ ID NO: 623774 - RNA, 13 nt, Homo sapiens
auuuccauauucu

SEQ ID NO: 623775 - RNA, 18 nt, Homo sapiens
auuuccauuguguggccu

SEQ ID NO: 623776 - RNA, 19 nt, Homo sapiens
auuucccauuugugccaga

SEQ ID NO: 623777 - RNA, 17 nt, Homo sapiens
auuuccccaguugcccu

SEQ ID NO: 623778 - RNA, 18 nt, Homo sapiens
auuucccugcagaccuca

SEQ ID NO: 623779 - RNA, 20 nt, Homo sapiens
auuuccuaaugucagaguag

SEQ ID NO: 623780 - RNA, 20 nt, Homo sapiens
auuuccuacagaaauacugc

SEQ ID NO: 623781 - RNA, 22 nt, Homo sapiens
auuuccuauuguucacuuuauu

SEQ ID NO: 623782 - RNA, 20 nt, Homo sapiens
auuuccucuaguaucacuuu

SEQ ID NO: 623783 - RNA, 13 nt, Homo sapiens
auuuccucugggc

SEQ ID NO: 623784 - RNA, 13 nt, Homo sapiens
auuuccugacaga

SEQ ID NO: 623785 - RNA, 15 nt, Homo sapiens
auuuccugacuugag

SEQ ID NO: 623786 - RNA, 19 nt, Homo sapiens
auuuccugauacauuaaaa

SEQ ID NO: 623787 - RNA, 20 nt, Homo sapiens
auuuccuguguguguugccc

SEQ ID NO: 623788 - RNA, 19 nt, Homo sapiens
auuuccuucaaugugcaua

SEQ ID NO: 623789 - RNA, 15 nt, Homo sapiens
auuuccuucugcuau

SEQ ID NO: 623790 - RNA, 23 nt, Homo sapiens
auuuccuuucuacaauuucaauu

SEQ ID NO: 623791 - RNA, 20 nt, Homo sapiens
auuuccuuuuugacacugaa

SEQ ID NO: 623792 - RNA, 14 nt, Homo sapiens
auuucgaaacugcc

SEQ ID NO: 623793 - RNA, 15 nt, Homo sapiens
auuucggagcaugaa

SEQ ID NO: 623794 - RNA, 17 nt, Homo sapiens
auuucuacaaguucaga

SEQ ID NO: 623795 - RNA, 16 nt, Homo sapiens
auuucuaccugaguga

SEQ ID NO: 623796 - RNA, 13 nt, Homo sapiens
auuucuacuguca

SEQ ID NO: 623797 - RNA, 23 nt, Homo sapiens
auuucuacuucuggaagucaucu

SEQ ID NO: 623798 - RNA, 20 nt, Homo sapiens
auuucuagaagcacaugugu

SEQ ID NO: 623799 - RNA, 20 nt, Homo sapiens
auuucuagacaguauugcca

SEQ ID NO: 623800 - RNA, 15 nt, Homo sapiens
auuucuaguccaaaa

SEQ ID NO: 623801 - RNA, 23 nt, Homo sapiens
auuucucauuugaguauuacaau

SEQ ID NO: 623802 - RNA, 16 nt, Homo sapiens
auuucuccaaagccuu

SEQ ID NO: 623803 - RNA, 16 nt, Homo sapiens
auuucuccuccauggg

SEQ ID NO: 623804 - RNA, 19 nt, Homo sapiens
auuucuccucccuuccuuu

SEQ ID NO: 623805 - RNA, 16 nt, Homo sapiens
auuucucuacuuguca

SEQ ID NO: 623806 - RNA, 17 nt, Homo sapiens
auuucucuacuugucau

SEQ ID NO: 623807 - RNA, 16 nt, Homo sapiens
aguaaucuguguacaa

SEQ ID NO: 623808 - RNA, 14 nt, Homo sapiens
aguaauggcauuuu

SEQ ID NO: 623809 - RNA, 17 nt, Homo sapiens
aguaauuccuguuacuu

SEQ ID NO: 623810 - RNA, 13 nt, Homo sapiens
aguacaacccaua

SEQ ID NO: 623811 - RNA, 21 nt, Homo sapiens
aguacaauaauaaauccucag

SEQ ID NO: 623812 - RNA, 22 nt, Homo sapiens
aguacagagaaauucuguggug

SEQ ID NO: 623813 - RNA, 10 nt, Homo sapiens
aguacagggg

SEQ ID NO: 623814 - RNA, 18 nt, Homo sapiens
aguaccacacauauugca

SEQ ID NO: 623815 - RNA, 22 nt, Homo sapiens
aguaccacacugaguucuauca

SEQ ID NO: 623816 - RNA, 21 nt, Homo sapiens
aguacccacucuggagcauuu

SEQ ID NO: 623817 - RNA, 15 nt, Homo sapiens
aguacccaucuagua

SEQ ID NO: 623818 - RNA, 18 nt, Homo sapiens
aguaccccccuaccacac

SEQ ID NO: 623819 - RNA, 18 nt, Homo sapiens
aguaccuacaucagucaa

SEQ ID NO: 623820 - RNA, 13 nt, Homo sapiens
aguaccuggaccu

SEQ ID NO: 623821 - RNA, 22 nt, Homo sapiens
aguaccuuuccauuuauucuuu

SEQ ID NO: 623822 - RNA, 16 nt, Homo sapiens
aguacuaagggaacaa

SEQ ID NO: 623823 - RNA, 15 nt, Homo sapiens
aguacuagagauauu

SEQ ID NO: 623824 - RNA, 23 nt, Homo sapiens
aguacucuacaauuccucugaua

SEQ ID NO: 623825 - RNA, 19 nt, Homo sapiens
aguacucucugcucuagcc

SEQ ID NO: 623826 - RNA, 22 nt, Homo sapiens
aguacugcacccagcaguguca

SEQ ID NO: 623827 - RNA, 18 nt, Homo sapiens
aguacuggcacaaaaaca

SEQ ID NO: 623828 - RNA, 17 nt, Homo sapiens
aguacuggcaugguacg

SEQ ID NO: 623829 - RNA, 12 nt, Homo sapiens
aguacugggaag

SEQ ID NO: 623830 - RNA, 22 nt, Homo sapiens
aguacuguugguuaaaugacaa

SEQ ID NO: 623831 - RNA, 17 nt, Homo sapiens
aguacuuaaacuuccac

SEQ ID NO: 623832 - RNA, 17 nt, Homo sapiens
aguacuuauagaccuua

SEQ ID NO: 623833 - RNA, 18 nt, Homo sapiens
aguacuuauguugcacaa

SEQ ID NO: 623834 - RNA, 21 nt, Homo sapiens
aguacuuccugcaguacaaga

SEQ ID NO: 623835 - RNA, 22 nt, Homo sapiens
aguacuuugguuucugagcacc

SEQ ID NO: 623836 - RNA, 15 nt, Homo sapiens
aguagaaaaggaucu

SEQ ID NO: 623837 - RNA, 17 nt, Homo sapiens
aguagaaagcauaacaa

SEQ ID NO: 623838 - RNA, 16 nt, Homo sapiens
aguagaaauuuuacaa

SEQ ID NO: 623839 - RNA, 11 nt, Homo sapiens
aguagaacuca

SEQ ID NO: 623840 - RNA, 14 nt, Homo sapiens
aguagaauccuaaa

SEQ ID NO: 623841 - RNA, 19 nt, Homo sapiens
aguagagacgggguuucac

SEQ ID NO: 623842 - RNA, 20 nt, Homo sapiens
aguagagacgggguuucacc

SEQ ID NO: 623843 - RNA, 21 nt, Homo sapiens
aguagagcagccacaaccaaa

SEQ ID NO: 623844 - RNA, 12 nt, Homo sapiens
aguagagccagc

SEQ ID NO: 623845 - RNA, 16 nt, Homo sapiens
aguagaucaugcauag

SEQ ID NO: 623846 - RNA, 22 nt, Homo sapiens
aguagaucuauauuagaucaaa

SEQ ID NO: 623847 - RNA, 21 nt, Homo sapiens
aguagcagcagaggccagugg

SEQ ID NO: 623848 - RNA, 19 nt, Homo sapiens
aguagcaggucaaaaaccu

SEQ ID NO: 623849 - RNA, 22 nt, Homo sapiens
aguagcaggucaaaaaccugcc

SEQ ID NO: 623850 - RNA, 15 nt, Homo sapiens
aguagcaugaucagu

SEQ ID NO: 623851 - RNA, 16 nt, Homo sapiens
aguagccuucuucccu

SEQ ID NO: 623852 - RNA, 21 nt, Homo sapiens
aguagcuggauuacaggcaug

SEQ ID NO: 623853 - RNA, 13 nt, Homo sapiens
aguagcugggauu

SEQ ID NO: 623854 - RNA, 14 nt, Homo sapiens
aguaggaugaauca

SEQ ID NO: 623855 - RNA, 13 nt, Homo sapiens
aguagguuuacau

SEQ ID NO: 623856 - RNA, 19 nt, Homo sapiens
aguaguauuuuguacuauc

SEQ ID NO: 623857 - RNA, 21 nt, Homo sapiens
aguagucacaaacugaucuaa

SEQ ID NO: 623858 - RNA, 9 nt, Homo sapiens
aguaguccu

SEQ ID NO: 623859 - RNA, 20 nt, Homo sapiens
aguaguccuuggcauagaca

SEQ ID NO: 623860 - RNA, 15 nt, Homo sapiens
aguagucuugaugac

SEQ ID NO: 623861 - RNA, 15 nt, Homo sapiens
aguagugcugugauu

SEQ ID NO: 623862 - RNA, 22 nt, Homo sapiens
aguaguucacauacaaaucauc

SEQ ID NO: 623863 - RNA, 19 nt, Homo sapiens
aguaguuuucaaaacacau

SEQ ID NO: 623864 - RNA, 23 nt, Homo sapiens
aguaguuuuuacagcuguguuau

SEQ ID NO: 623865 - RNA, 17 nt, Homo sapiens
aguauaaagucacuucc

SEQ ID NO: 623866 - RNA, 19 nt, Homo sapiens
aguauaaagucacuuccag

SEQ ID NO: 623867 - RNA, 18 nt, Homo sapiens
aguauaacugaguuaaau

SEQ ID NO: 623868 - RNA, 18 nt, Homo sapiens
aguauacuuuuccccugu

SEQ ID NO: 623869 - RNA, 13 nt, Homo sapiens
aguauagcuuuau

SEQ ID NO: 623870 - RNA, 16 nt, Homo sapiens
aguauauaauauguca

SEQ ID NO: 623871 - RNA, 15 nt, Homo sapiens
aguauauaggugcug

SEQ ID NO: 623872 - RNA, 14 nt, Homo sapiens
aguauauauagaau

SEQ ID NO: 623873 - RNA, 16 nt, Homo sapiens
aguauauuuaaacuca

SEQ ID NO: 623874 - RNA, 21 nt, Homo sapiens
aguauauuuauagucacaaga

SEQ ID NO: 623875 - RNA, 16 nt, Homo sapiens
aguaucacgauuugca

SEQ ID NO: 623876 - RNA, 18 nt, Homo sapiens
aguaucacuuuaacucag

SEQ ID NO: 623877 - RNA, 17 nt, Homo sapiens
aguaucauuacauauag

SEQ ID NO: 623878 - RNA, 13 nt, Homo sapiens
aguauccacuuug

SEQ ID NO: 623879 - RNA, 19 nt, Homo sapiens
aguauccugcuucugauau

SEQ ID NO: 623880 - RNA, 22 nt, Homo sapiens
aguaucuagcaaucacaacacu

SEQ ID NO: 623881 - RNA, 11 nt, Homo sapiens
aguaucuauau

SEQ ID NO: 623882 - RNA, 11 nt, Homo sapiens
aguaucuguaa

SEQ ID NO: 623883 - RNA, 17 nt, Homo sapiens
aguaucuguaacccuug

SEQ ID NO: 623884 - RNA, 13 nt, Homo sapiens
aguaucuuaccug

SEQ ID NO: 623885 - RNA, 14 nt, Homo sapiens
aguaucuugggugu

SEQ ID NO: 623886 - RNA, 14 nt, Homo sapiens
aguaugaaguauaa

SEQ ID NO: 623887 - RNA, 22 nt, Homo sapiens
aguaugcuuaaugguagcaacu

SEQ ID NO: 623888 - RNA, 20 nt, Homo sapiens
aguaugggaaaaaaacugaa

SEQ ID NO: 623889 - RNA, 23 nt, Homo sapiens
aguaugguucucagaucuugaca

SEQ ID NO: 623890 - RNA, 14 nt, Homo sapiens
aguauguaaaacau

SEQ ID NO: 623891 - RNA, 20 nt, Homo sapiens
aguauguccuucagcugacu

SEQ ID NO: 623892 - RNA, 21 nt, Homo sapiens
aguaugugaguguguccaagu

SEQ ID NO: 623893 - RNA, 14 nt, Homo sapiens
aguaugugauggac

SEQ ID NO: 623894 - RNA, 16 nt, Homo sapiens
aguauuccaugagcug

SEQ ID NO: 623895 - RNA, 18 nt, Homo sapiens
aguauucuuaguuguuca

SEQ ID NO: 623896 - RNA, 15 nt, Homo sapiens
aguauugcaugcuca

SEQ ID NO: 623897 - RNA, 21 nt, Homo sapiens
aguauuggacgguuucuagcc

SEQ ID NO: 623898 - RNA, 17 nt, Homo sapiens
aguauuucagaugcuuu

SEQ ID NO: 623899 - RNA, 12 nt, Homo sapiens
aguauuucccag

SEQ ID NO: 623900 - RNA, 17 nt, Homo sapiens
aguauuucccagcacau

SEQ ID NO: 623901 - RNA, 23 nt, Homo sapiens
aguauuuuaucuggaacaacuug

SEQ ID NO: 623902 - RNA, 20 nt, Homo sapiens
aguauuuuccuaagcacaaa

SEQ ID NO: 623903 - RNA, 19 nt, Homo sapiens
aguauuuuuaacacuuaaa

SEQ ID NO: 623904 - RNA, 22 nt, Homo sapiens
aguauuuuuuaauccuaccuca

SEQ ID NO: 623905 - RNA, 15 nt, Homo sapiens
agucaaaacagagau

SEQ ID NO: 623906 - RNA, 17 nt, Homo sapiens
agucaaagagcacugga

SEQ ID NO: 623907 - RNA, 12 nt, Homo sapiens
agucaacaaacu

SEQ ID NO: 623908 - RNA, 15 nt, Homo sapiens
agucaacucuggcca

SEQ ID NO: 623909 - RNA, 20 nt, Homo sapiens
agucaaggacgaauuugcac

SEQ ID NO: 623910 - RNA, 21 nt, Homo sapiens
agucaaggacgaauuugcaca

SEQ ID NO: 623911 - RNA, 23 nt, Homo sapiens
agucaaggauggaugcagaucca

SEQ ID NO: 623912 - RNA, 16 nt, Homo sapiens
agucaaggucacuuaa

SEQ ID NO: 623913 - RNA, 20 nt, Homo sapiens
agucacggcugcgcacugug

SEQ ID NO: 623914 - RNA, 17 nt, Homo sapiens
agucacugacaguuaau

SEQ ID NO: 623915 - RNA, 13 nt, Homo sapiens
agucacugacccu

SEQ ID NO: 623916 - RNA, 23 nt, Homo sapiens
agucacugcacagugcaucucag

SEQ ID NO: 623917 - RNA, 17 nt, Homo sapiens
agucacugccaagucau

SEQ ID NO: 623918 - RNA, 12 nt, Homo sapiens
agucacugccug

SEQ ID NO: 623919 - RNA, 17 nt, Homo sapiens
agucacuggcaucucac

SEQ ID NO: 623920 - RNA, 23 nt, Homo sapiens
agucagaaugugaaaaaggaaua

SEQ ID NO: 623921 - RNA, 16 nt, Homo sapiens
agucagacugucagaa

SEQ ID NO: 623922 - RNA, 14 nt, Homo sapiens
agucagagacagau

SEQ ID NO: 623923 - RNA, 15 nt, Homo sapiens
agucagagacagaua

SEQ ID NO: 623924 - RNA, 16 nt, Homo sapiens
agucagagacagauac

SEQ ID NO: 623925 - RNA, 21 nt, Homo sapiens
agucagagagggugacaagau

SEQ ID NO: 623926 - RNA, 12 nt, Homo sapiens
agucagcaggga

SEQ ID NO: 623927 - RNA, 16 nt, Homo sapiens
agucaguaauugccaa

SEQ ID NO: 623928 - RNA, 14 nt, Homo sapiens
agucaguccaggau

SEQ ID NO: 623929 - RNA, 15 nt, Homo sapiens
agucaguugcucaaa

SEQ ID NO: 623930 - RNA, 15 nt, Homo sapiens
agucauacugucacu

SEQ ID NO: 623931 - RNA, 17 nt, Homo sapiens
agucauaucaaagggua

SEQ ID NO: 623932 - RNA, 18 nt, Homo sapiens
agucaucuccaucagcug

SEQ ID NO: 623933 - RNA, 11 nt, Homo sapiens
agucaucuccc

SEQ ID NO: 623934 - RNA, 14 nt, Homo sapiens
agucaugauccuug

SEQ ID NO: 623935 - RNA, 18 nt, Homo sapiens
agucauggauaacuacau

SEQ ID NO: 623936 - RNA, 20 nt, Homo sapiens
agucaugugagccucguguc

SEQ ID NO: 623937 - RNA, 19 nt, Homo sapiens
agucauuaugagaggcaau

SEQ ID NO: 623938 - RNA, 18 nt, Homo sapiens
agucauugaggcccugcu

SEQ ID NO: 623939 - RNA, 18 nt, Homo sapiens
agucauuggaauaaggca

SEQ ID NO: 623940 - RNA, 21 nt, Homo sapiens
agucauuugcugagcauguac

SEQ ID NO: 623941 - RNA, 16 nt, Homo sapiens
aguccaaaugugauca

SEQ ID NO: 623942 - RNA, 22 nt, Homo sapiens
aguccaaccugccugugcauga

SEQ ID NO: 623943 - RNA, 21 nt, Homo sapiens
aguccaaggccaguccccauu

SEQ ID NO: 623944 - RNA, 17 nt, Homo sapiens
aguccaauuuuuacuca

SEQ ID NO: 623945 - RNA, 16 nt, Homo sapiens
aguccacaaagcauuu

SEQ ID NO: 623946 - RNA, 16 nt, Homo sapiens
aguccaccugaggaac

SEQ ID NO: 623947 - RNA, 21 nt, Homo sapiens
aguccacuuguucuguacuug

SEQ ID NO: 623948 - RNA, 12 nt, Homo sapiens
aguccacuuuac

SEQ ID NO: 623949 - RNA, 21 nt, Homo sapiens
aguccagagcuggaucucuca

SEQ ID NO: 623950 - RNA, 13 nt, Homo sapiens
aguccagauuuac

SEQ ID NO: 623951 - RNA, 15 nt, Homo sapiens
aguccagauuuacac

SEQ ID NO: 623952 - RNA, 17 nt, Homo sapiens
aguccagcucagucuca

SEQ ID NO: 623953 - RNA, 21 nt, Homo sapiens
aguccaggcacaggaugcugu

SEQ ID NO: 623954 - RNA, 20 nt, Homo sapiens
aguccaggcgccuggagcaa

SEQ ID NO: 623955 - RNA, 21 nt, Homo sapiens
aguccaggcgccuggagcaag

SEQ ID NO: 623956 - RNA, 10 nt, Homo sapiens
aguccauuuc

SEQ ID NO: 623957 - RNA, 17 nt, Homo sapiens
agucccacacugugcag

SEQ ID NO: 623958 - RNA, 15 nt, Homo sapiens
agucccacacugugg

SEQ ID NO: 623959 - RNA, 17 nt, Homo sapiens
agucccagagcaccuca

SEQ ID NO: 623960 - RNA, 12 nt, Homo sapiens
agucccauucau

SEQ ID NO: 623961 - RNA, 22 nt, Homo sapiens
aguccccaucccauuuucaucc

SEQ ID NO: 623962 - RNA, 23 nt, Homo sapiens
agucccccaacucugagcccaug

SEQ ID NO: 623963 - RNA, 20 nt, Homo sapiens
aguccccucaccuccucuaa

SEQ ID NO: 623964 - RNA, 22 nt, Homo sapiens
agucccgggucucaacuuuaag

SEQ ID NO: 623965 - RNA, 17 nt, Homo sapiens
agucccgucgugcaguc

SEQ ID NO: 623966 - RNA, 21 nt, Homo sapiens
agucccucaugcaaaucaauu

SEQ ID NO: 623967 - RNA, 18 nt, Homo sapiens
aguccuaacuuccugugc

SEQ ID NO: 623968 - RNA, 14 nt, Homo sapiens
aguccuacccugaa

SEQ ID NO: 623969 - RNA, 20 nt, Homo sapiens
aguccuauuuuucaauggga

SEQ ID NO: 623970 - RNA, 17 nt, Homo sapiens
aguccugacacuauuca

SEQ ID NO: 623971 - RNA, 16 nt, Homo sapiens
aguccuggacgcacaa

SEQ ID NO: 623972 - RNA, 13 nt, Homo sapiens
aguccuguugaag

SEQ ID NO: 623973 - RNA, 17 nt, Homo sapiens
aguccuguuugcaggga

SEQ ID NO: 623974 - RNA, 12 nt, Homo sapiens
aguccuugcaaa

SEQ ID NO: 623975 - RNA, 19 nt, Homo sapiens
aguccuuucugugaagcua

SEQ ID NO: 623976 - RNA, 20 nt, Homo sapiens
agucgaauguuagauuccuc

SEQ ID NO: 623977 - RNA, 20 nt, Homo sapiens
agucgccagucacugcugca

SEQ ID NO: 623978 - RNA, 22 nt, Homo sapiens
agucgcuggcauguuucacucc

SEQ ID NO: 623979 - RNA, 19 nt, Homo sapiens
agucggccccaucucucau

SEQ ID NO: 623980 - RNA, 20 nt, Homo sapiens
agucgggaccucccaggaca

SEQ ID NO: 623981 - RNA, 15 nt, Homo sapiens
agucgguuagucauu

SEQ ID NO: 623982 - RNA, 20 nt, Homo sapiens
agucuaagauguguuccuug

SEQ ID NO: 623983 - RNA, 17 nt, Homo sapiens
agucuaggagcugggag

SEQ ID NO: 623984 - RNA, 20 nt, Homo sapiens
agucuauaccauagcaaugu

SEQ ID NO: 623985 - RNA, 22 nt, Homo sapiens
agucuaucaaccccagacacug

SEQ ID NO: 623986 - RNA, 17 nt, Homo sapiens
agucuauguauguguaa

SEQ ID NO: 623987 - RNA, 19 nt, Homo sapiens
agucuauguauguguaaaa

SEQ ID NO: 623988 - RNA, 23 nt, Homo sapiens
agucuauuaaagaaagaaaaaug

SEQ ID NO: 623989 - RNA, 13 nt, Homo sapiens
agucuauuuccac

SEQ ID NO: 623990 - RNA, 15 nt, Homo sapiens
agucucaacaugugu

SEQ ID NO: 623991 - RNA, 21 nt, Homo sapiens
agucucacuuuuauugauaaa

SEQ ID NO: 623992 - RNA, 17 nt, Homo sapiens
agucucagagaccagca

SEQ ID NO: 623993 - RNA, 19 nt, Homo sapiens
agucucagugaagacuaug

SEQ ID NO: 623994 - RNA, 16 nt, Homo sapiens
agucuccagauguuaa

SEQ ID NO: 623995 - RNA, 20 nt, Homo sapiens
agucuccaugcaagauuucu

SEQ ID NO: 623996 - RNA, 19 nt, Homo sapiens
agucuccccaccucuuccc

SEQ ID NO: 623997 - RNA, 20 nt, Homo sapiens
agucuccccaccucuucccu

SEQ ID NO: 623998 - RNA, 21 nt, Homo sapiens
agucuccccaccucuucccug

SEQ ID NO: 623999 - RNA, 22 nt, Homo sapiens
agucucccugauggacccucag

SEQ ID NO: 624000 - RNA, 16 nt, Homo sapiens
agucuccucacucugu

SEQ ID NO: 624001 - RNA, 16 nt, Homo sapiens
agucucucacccucau

SEQ ID NO: 624002 - RNA, 22 nt, Homo sapiens
agucucucuggggccacacaga

SEQ ID NO: 624003 - RNA, 21 nt, Homo sapiens
agucucugaggggcuaccagg

SEQ ID NO: 624004 - RNA, 18 nt, Homo sapiens
agucucugcccaaacaua

SEQ ID NO: 624005 - RNA, 12 nt, Homo sapiens
agucucugugaa

SEQ ID NO: 624006 - RNA, 21 nt, Homo sapiens
agucugaaagacagaauguca

SEQ ID NO: 624007 - RNA, 23 nt, Homo sapiens
agucugaagcucgcauccagaca

SEQ ID NO: 624008 - RNA, 13 nt, Homo sapiens
agucugaagcugg

SEQ ID NO: 624009 - RNA, 18 nt, Homo sapiens
agucugaaugcugccaca

SEQ ID NO: 624010 - RNA, 23 nt, Homo sapiens
agucugaaugcugccacaaccag

SEQ ID NO: 624011 - RNA, 23 nt, Homo sapiens
agucugauuuaauugggcacuau

SEQ ID NO: 624012 - RNA, 14 nt, Homo sapiens
agucugcucaaggu

SEQ ID NO: 624013 - RNA, 13 nt, Homo sapiens
agucugcucugcu

SEQ ID NO: 624014 - RNA, 22 nt, Homo sapiens
agucuggcaaugggacucugag

SEQ ID NO: 624015 - RNA, 17 nt, Homo sapiens
agucuguaaaaccagca

SEQ ID NO: 624016 - RNA, 16 nt, Homo sapiens
agucuguacuucauca

SEQ ID NO: 624017 - RNA, 23 nt, Homo sapiens
agucuguauggcaugacaacuac

SEQ ID NO: 624018 - RNA, 22 nt, Homo sapiens
agugaaauaauagaaugagcac

SEQ ID NO: 624019 - RNA, 12 nt, Homo sapiens
agugaaauuacu

SEQ ID NO: 624020 - RNA, 14 nt, Homo sapiens
agugaacacucagu

SEQ ID NO: 624021 - RNA, 19 nt, Homo sapiens
agugaacacucuacuacau

SEQ ID NO: 624022 - RNA, 14 nt, Homo sapiens
agugaaccaaagag

SEQ ID NO: 624023 - RNA, 17 nt, Homo sapiens
agugaaccuagauugca

SEQ ID NO: 624024 - RNA, 20 nt, Homo sapiens
agugaagaacacuacugcua

SEQ ID NO: 624025 - RNA, 21 nt, Homo sapiens
agugaagcuaauuaaacacau

SEQ ID NO: 624026 - RNA, 15 nt, Homo sapiens
agugaaggguuuugu

SEQ ID NO: 624027 - RNA, 16 nt, Homo sapiens
agugaagugaaucuga

SEQ ID NO: 624028 - RNA, 19 nt, Homo sapiens
agugaauaaaccaucaucu

SEQ ID NO: 624029 - RNA, 14 nt, Homo sapiens
agugaauacauuaa

SEQ ID NO: 624030 - RNA, 22 nt, Homo sapiens
agugaauacauuaacggugcua

SEQ ID NO: 624031 - RNA, 13 nt, Homo sapiens
agugaaucuugcu

SEQ ID NO: 624032 - RNA, 21 nt, Homo sapiens
agugaaucuuucuccugguga

SEQ ID NO: 624033 - RNA, 16 nt, Homo sapiens
agugaaugaacaaaug

SEQ ID NO: 624034 - RNA, 13 nt, Homo sapiens
agugaauggucuc

SEQ ID NO: 624035 - RNA, 15 nt, Homo sapiens
agugaaugugucugg

SEQ ID NO: 624036 - RNA, 23 nt, Homo sapiens
agugacaaaauagacaauuugca

SEQ ID NO: 624037 - RNA, 16 nt, Homo sapiens
agugacaaaccaucca

SEQ ID NO: 624038 - RNA, 14 nt, Homo sapiens
agugacaaggcccu

SEQ ID NO: 624039 - RNA, 22 nt, Homo sapiens
agugacauauauauguauauac

SEQ ID NO: 624040 - RNA, 13 nt, Homo sapiens
agugaccaaaggu

SEQ ID NO: 624041 - RNA, 14 nt, Homo sapiens
agugaccauuauuc

SEQ ID NO: 624042 - RNA, 15 nt, Homo sapiens
agugacccacccuag

SEQ ID NO: 624043 - RNA, 23 nt, Homo sapiens
agugaccccugaccucacuguga

SEQ ID NO: 624044 - RNA, 12 nt, Homo sapiens
agugacccucag

SEQ ID NO: 624045 - RNA, 21 nt, Homo sapiens
agugaccgaaagguuauguua

SEQ ID NO: 624046 - RNA, 17 nt, Homo sapiens
agugaccuaaccacuua

SEQ ID NO: 624047 - RNA, 18 nt, Homo sapiens
agugacugcaagcauuuu

SEQ ID NO: 624048 - RNA, 17 nt, Homo sapiens
agugagaaaaagcuccu

SEQ ID NO: 624049 - RNA, 17 nt, Homo sapiens
agugagaaaacugugac

SEQ ID NO: 624050 - RNA, 13 nt, Homo sapiens
agugagaaacuga

SEQ ID NO: 624051 - RNA, 13 nt, Homo sapiens
agugagacuccac

SEQ ID NO: 624052 - RNA, 18 nt, Homo sapiens
agugagacuccaccucaa

SEQ ID NO: 624053 - RNA, 14 nt, Homo sapiens
agugagagcuuccu

SEQ ID NO: 624054 - RNA, 15 nt, Homo sapiens
agugagcaaccagcu

SEQ ID NO: 624055 - RNA, 21 nt, Homo sapiens
agugagcagagauguacugca

SEQ ID NO: 624056 - RNA, 21 nt, Homo sapiens
agugagccaagaaacacugcc

SEQ ID NO: 624057 - RNA, 15 nt, Homo sapiens
agugagcugauauca

SEQ ID NO: 624058 - RNA, 15 nt, Homo sapiens
agugaggaacccuga

SEQ ID NO: 624059 - RNA, 20 nt, Homo sapiens
agugaggacucggccacugu

SEQ ID NO: 624060 - RNA, 22 nt, Homo sapiens
agugaggagcccauacucagcc

SEQ ID NO: 624061 - RNA, 16 nt, Homo sapiens
agugaggggcccucca

SEQ ID NO: 624062 - RNA, 13 nt, Homo sapiens
agugagucucuuc

SEQ ID NO: 624063 - RNA, 22 nt, Homo sapiens
agugauaucaccucucuucagc

SEQ ID NO: 624064 - RNA, 22 nt, Homo sapiens
agugauaucccccagccucaag

SEQ ID NO: 624065 - RNA, 17 nt, Homo sapiens
agugauauuguggguaa

SEQ ID NO: 624066 - RNA, 14 nt, Homo sapiens
agugauccaugucc

SEQ ID NO: 624067 - RNA, 21 nt, Homo sapiens
agugauccuguccuuuuaaca

SEQ ID NO: 624068 - RNA, 13 nt, Homo sapiens
agugaucucaggg

SEQ ID NO: 624069 - RNA, 20 nt, Homo sapiens
agugaucucccugaacauuu

SEQ ID NO: 624070 - RNA, 20 nt, Homo sapiens
agugaucuuucccaagagaa

SEQ ID NO: 624071 - RNA, 21 nt, Homo sapiens
agugaugcugugauaccuuag

SEQ ID NO: 624072 - RNA, 12 nt, Homo sapiens
agugauggagcu

SEQ ID NO: 624073 - RNA, 12 nt, Homo sapiens
agugaugucagg

SEQ ID NO: 624074 - RNA, 15 nt, Homo sapiens
agugauguuagcaga

SEQ ID NO: 624075 - RNA, 15 nt, Homo sapiens
agugauuaucucuuu

SEQ ID NO: 624076 - RNA, 19 nt, Homo sapiens
agugauucuuccaccucag

SEQ ID NO: 624077 - RNA, 17 nt, Homo sapiens
agugauugcagcuuuau

SEQ ID NO: 624078 - RNA, 16 nt, Homo sapiens
agugauuggcucugug

SEQ ID NO: 624079 - RNA, 23 nt, Homo sapiens
agugauugugucugcauuguuau

SEQ ID NO: 624080 - RNA, 21 nt, Homo sapiens
agugauuuuuuucauugucca

SEQ ID NO: 624081 - RNA, 18 nt, Homo sapiens
agugcaagcagcacucaa

SEQ ID NO: 624082 - RNA, 21 nt, Homo sapiens
agugcaagccccugcuccaga

SEQ ID NO: 624083 - RNA, 20 nt, Homo sapiens
agugcacaggcgcaucccag

SEQ ID NO: 624084 - RNA, 15 nt, Homo sapiens
agugcacugacugug

SEQ ID NO: 624085 - RNA, 17 nt, Homo sapiens
agugcacugacugugaa

SEQ ID NO: 624086 - RNA, 21 nt, Homo sapiens
agugcacugcauuccugugcc

SEQ ID NO: 624087 - RNA, 12 nt, Homo sapiens
agugcagccacu

SEQ ID NO: 624088 - RNA, 23 nt, Homo sapiens
agugcagggaggaaaagugcaag

SEQ ID NO: 624089 - RNA, 12 nt, Homo sapiens
agugcagggcug

SEQ ID NO: 624090 - RNA, 15 nt, Homo sapiens
agugcaguggcacaa

SEQ ID NO: 624091 - RNA, 20 nt, Homo sapiens
agugcaguggugugaucuca

SEQ ID NO: 624092 - RNA, 10 nt, Homo sapiens
agugcaguuu

SEQ ID NO: 624093 - RNA, 13 nt, Homo sapiens
agugcauccaaag

SEQ ID NO: 624094 - RNA, 15 nt, Homo sapiens
agugcauccaaaggu

SEQ ID NO: 624095 - RNA, 21 nt, Homo sapiens
agugcaugacguuuaaggcca

SEQ ID NO: 624096 - RNA, 12 nt, Homo sapiens
agugcauuugcc

SEQ ID NO: 624097 - RNA, 16 nt, Homo sapiens
agugccacucauuccu

SEQ ID NO: 624098 - RNA, 21 nt, Homo sapiens
agugccacuuaauguauguua

SEQ ID NO: 624099 - RNA, 16 nt, Homo sapiens
agugccagcaaugaca

SEQ ID NO: 624100 - RNA, 13 nt, Homo sapiens
agugccagguggc

SEQ ID NO: 624101 - RNA, 16 nt, Homo sapiens
agugccagguggcuca

SEQ ID NO: 624102 - RNA, 19 nt, Homo sapiens
agugccagguggcucagug

SEQ ID NO: 624103 - RNA, 20 nt, Homo sapiens
agugccaugauugcuagcca

SEQ ID NO: 624104 - RNA, 18 nt, Homo sapiens
agugccauuacuacugua

SEQ ID NO: 624105 - RNA, 15 nt, Homo sapiens
agugccauuccacuc

SEQ ID NO: 624106 - RNA, 21 nt, Homo sapiens
agugccauuccacuccacuca

SEQ ID NO: 624107 - RNA, 20 nt, Homo sapiens
agugcccaacccuaucccag

SEQ ID NO: 624108 - RNA, 23 nt, Homo sapiens
agugcccaaggaauuucugcucu

SEQ ID NO: 624109 - RNA, 22 nt, Homo sapiens
agugccccagacugagcucucc

SEQ ID NO: 624110 - RNA, 16 nt, Homo sapiens
agugccguaacaacug

SEQ ID NO: 624111 - RNA, 16 nt, Homo sapiens
agugccugcauuccca

SEQ ID NO: 624112 - RNA, 14 nt, Homo sapiens
agugccuuaccucc

SEQ ID NO: 624113 - RNA, 12 nt, Homo sapiens
agugccuuccac

SEQ ID NO: 624114 - RNA, 13 nt, Homo sapiens
agugccuuggcca

SEQ ID NO: 624115 - RNA, 21 nt, Homo sapiens
agugccuuuugguuucaccuu

SEQ ID NO: 624116 - RNA, 19 nt, Homo sapiens
agugcgcagaucugugccu

SEQ ID NO: 624117 - RNA, 23 nt, Homo sapiens
agugcgugcucccgaugcugcua

SEQ ID NO: 624118 - RNA, 20 nt, Homo sapiens
agugcgugguauaaucucca

SEQ ID NO: 624119 - RNA, 21 nt, Homo sapiens
agugcugaaauaaaaugauaa

SEQ ID NO: 624120 - RNA, 21 nt, Homo sapiens
agugcugcguugacuacugcu

SEQ ID NO: 624121 - RNA, 11 nt, Homo sapiens
agugcugcuau

SEQ ID NO: 624122 - RNA, 21 nt, Homo sapiens
agugcugggauuauaggcaug

SEQ ID NO: 624123 - RNA, 23 nt, Homo sapiens
agugcuguugguggcagugacuu

SEQ ID NO: 624124 - RNA, 15 nt, Homo sapiens
agugcuugucaugga

SEQ ID NO: 624125 - RNA, 19 nt, Homo sapiens
agugcuuuuacuaucugug

SEQ ID NO: 624126 - RNA, 19 nt, Homo sapiens
agugcuuuucagugauacu

SEQ ID NO: 624127 - RNA, 19 nt, Homo sapiens
aguggaacuaaaauucugu

SEQ ID NO: 624128 - RNA, 14 nt, Homo sapiens
aguggaaggcauca

SEQ ID NO: 624129 - RNA, 13 nt, Homo sapiens
aguggaauuguga

SEQ ID NO: 624130 - RNA, 23 nt, Homo sapiens
aguggacagucuggccacuguca

SEQ ID NO: 624131 - RNA, 13 nt, Homo sapiens
aguggacccugga

SEQ ID NO: 624132 - RNA, 17 nt, Homo sapiens
aguggacgugguaugaa

SEQ ID NO: 624133 - RNA, 19 nt, Homo sapiens
aguggacucagaaagccaa

SEQ ID NO: 624134 - RNA, 20 nt, Homo sapiens
aguggagauuuacacuacau

SEQ ID NO: 624135 - RNA, 13 nt, Homo sapiens
aguggagccaggu

SEQ ID NO: 624136 - RNA, 18 nt, Homo sapiens
aguggagcuggucugcca

SEQ ID NO: 624137 - RNA, 15 nt, Homo sapiens
aguggaggcacuuua

SEQ ID NO: 624138 - RNA, 16 nt, Homo sapiens
aguggaggcacuuuag

SEQ ID NO: 624139 - RNA, 22 nt, Homo sapiens
aguggagugagagcaauuguaa

SEQ ID NO: 624140 - RNA, 16 nt, Homo sapiens
aguggauuacugccau

SEQ ID NO: 624141 - RNA, 20 nt, Homo sapiens
auccccgcagugugcacuaa

SEQ ID NO: 624142 - RNA, 20 nt, Homo sapiens
auccccggggcggcaggaag

SEQ ID NO: 624143 - RNA, 17 nt, Homo sapiens
auccccuuuacuaucau

SEQ ID NO: 624144 - RNA, 22 nt, Homo sapiens
auccccuuuggcuaccugaugg

SEQ ID NO: 624145 - RNA, 17 nt, Homo sapiens
auccccuuuguguagaa

SEQ ID NO: 624146 - RNA, 17 nt, Homo sapiens
aucccgaaaaucucucg

SEQ ID NO: 624147 - RNA, 16 nt, Homo sapiens
aucccgagucugggac

SEQ ID NO: 624148 - RNA, 22 nt, Homo sapiens
aucccguaccucuucccaugac

SEQ ID NO: 624149 - RNA, 19 nt, Homo sapiens
aucccuacugccaaccugg

SEQ ID NO: 624150 - RNA, 14 nt, Homo sapiens
aucccucaccugua

SEQ ID NO: 624151 - RNA, 15 nt, Homo sapiens
aucccucaccuguag

SEQ ID NO: 624152 - RNA, 12 nt, Homo sapiens
aucccucagauc

SEQ ID NO: 624153 - RNA, 18 nt, Homo sapiens
aucccucauaccauggag

SEQ ID NO: 624154 - RNA, 23 nt, Homo sapiens
aucccucucucccuagugccuuc

SEQ ID NO: 624155 - RNA, 18 nt, Homo sapiens
aucccucugucaggguca

SEQ ID NO: 624156 - RNA, 17 nt, Homo sapiens
aucccugaaacaucuca

SEQ ID NO: 624157 - RNA, 15 nt, Homo sapiens
aucccugcagcucaa

SEQ ID NO: 624158 - RNA, 18 nt, Homo sapiens
aucccuuaacaguuguau

SEQ ID NO: 624159 - RNA, 16 nt, Homo sapiens
aucccuucggagccaa

SEQ ID NO: 624160 - RNA, 19 nt, Homo sapiens
aucccuuuuuuuacauuuc

SEQ ID NO: 624161 - RNA, 20 nt, Homo sapiens
aucccuuuuuuuacauuuca

SEQ ID NO: 624162 - RNA, 13 nt, Homo sapiens
auccgaaguauga

SEQ ID NO: 624163 - RNA, 16 nt, Homo sapiens
auccgcccaccucagc

SEQ ID NO: 624164 - RNA, 17 nt, Homo sapiens
auccgcugccagccuug

SEQ ID NO: 624165 - RNA, 21 nt, Homo sapiens
auccgguccccugccuggaac

SEQ ID NO: 624166 - RNA, 20 nt, Homo sapiens
auccguacauucaauguuua

SEQ ID NO: 624167 - RNA, 14 nt, Homo sapiens
auccuaagcaaaaa

SEQ ID NO: 624168 - RNA, 22 nt, Homo sapiens
auccuacaagacacagugacca

SEQ ID NO: 624169 - RNA, 22 nt, Homo sapiens
auccuacuguaauaaagaugau

SEQ ID NO: 624170 - RNA, 15 nt, Homo sapiens
auccuagacuugaaa

SEQ ID NO: 624171 - RNA, 17 nt, Homo sapiens
auccuagggcacuucua

SEQ ID NO: 624172 - RNA, 17 nt, Homo sapiens
auccuaguaauugccua

SEQ ID NO: 624173 - RNA, 17 nt, Homo sapiens
auccuaguaugccaaaa

SEQ ID NO: 624174 - RNA, 21 nt, Homo sapiens
auccuaucacagucuacugac

SEQ ID NO: 624175 - RNA, 20 nt, Homo sapiens
auccuaucuggggagcuccu

SEQ ID NO: 624176 - RNA, 17 nt, Homo sapiens
auccucacucauuccca

SEQ ID NO: 624177 - RNA, 21 nt, Homo sapiens
auccucagguaguacugggaa

SEQ ID NO: 624178 - RNA, 13 nt, Homo sapiens
auccuccaacagc

SEQ ID NO: 624179 - RNA, 14 nt, Homo sapiens
auccuccauugcuc

SEQ ID NO: 624180 - RNA, 23 nt, Homo sapiens
auccuccccagcgccaucugugu

SEQ ID NO: 624181 - RNA, 17 nt, Homo sapiens
auccucccuacuuccaa

SEQ ID NO: 624182 - RNA, 21 nt, Homo sapiens
auccuccugucuaauuugcac

SEQ ID NO: 624183 - RNA, 16 nt, Homo sapiens
auccuccuugucuuaa

SEQ ID NO: 624184 - RNA, 19 nt, Homo sapiens
auccucuuccuccccaguc

SEQ ID NO: 624185 - RNA, 15 nt, Homo sapiens
auccucuuccucuga

SEQ ID NO: 624186 - RNA, 20 nt, Homo sapiens
auccugaauaaaccaguauc

SEQ ID NO: 624187 - RNA, 17 nt, Homo sapiens
auccugaccuugcacaa

SEQ ID NO: 624188 - RNA, 22 nt, Homo sapiens
auccugauaaacauuaaacacu

SEQ ID NO: 624189 - RNA, 17 nt, Homo sapiens
auccuggccuuguacuu

SEQ ID NO: 624190 - RNA, 18 nt, Homo sapiens
auccugggauccagugua

SEQ ID NO: 624191 - RNA, 19 nt, Homo sapiens
auccuggggcagcacuccc

SEQ ID NO: 624192 - RNA, 15 nt, Homo sapiens
auccugggggaccaa

SEQ ID NO: 624193 - RNA, 17 nt, Homo sapiens
auccugggggccugggu

SEQ ID NO: 624194 - RNA, 18 nt, Homo sapiens
auccugguuucaaugacg

SEQ ID NO: 624195 - RNA, 17 nt, Homo sapiens
auccugucaccaugacu

SEQ ID NO: 624196 - RNA, 13 nt, Homo sapiens
auccugugcugcu

SEQ ID NO: 624197 - RNA, 14 nt, Homo sapiens
auccugugcugcug

SEQ ID NO: 624198 - RNA, 16 nt, Homo sapiens
auccuguguuaucugu

SEQ ID NO: 624199 - RNA, 18 nt, Homo sapiens
auccuuaaugcagagcua

SEQ ID NO: 624200 - RNA, 16 nt, Homo sapiens
auccuuccacuaucau

SEQ ID NO: 624201 - RNA, 21 nt, Homo sapiens
auccuucugagcuccaccucu

SEQ ID NO: 624202 - RNA, 15 nt, Homo sapiens
auccuugcugauaaa

SEQ ID NO: 624203 - RNA, 21 nt, Homo sapiens
auccuuggggagcacuugucc

SEQ ID NO: 624204 - RNA, 23 nt, Homo sapiens
auccuugucuuuugagcuauuca

SEQ ID NO: 624205 - RNA, 14 nt, Homo sapiens
auccuuuacauuca

SEQ ID NO: 624206 - RNA, 21 nt, Homo sapiens
auccuuuaccacucuaccaaa

SEQ ID NO: 624207 - RNA, 20 nt, Homo sapiens
auccuuuagguaagaaguuu

SEQ ID NO: 624208 - RNA, 19 nt, Homo sapiens
aucgaaucuacuaauucca

SEQ ID NO: 624209 - RNA, 20 nt, Homo sapiens
aucgacaccauccuggcuaa

SEQ ID NO: 624210 - RNA, 17 nt, Homo sapiens
aucgaugcagugcuucc

SEQ ID NO: 624211 - RNA, 16 nt, Homo sapiens
aucgcaccacugcacu

SEQ ID NO: 624212 - RNA, 18 nt, Homo sapiens
aucgcucauagaucagca

SEQ ID NO: 624213 - RNA, 14 nt, Homo sapiens
aucgcugccugcca

SEQ ID NO: 624214 - RNA, 16 nt, Homo sapiens
aucgcuugaaccuggg

SEQ ID NO: 624215 - RNA, 23 nt, Homo sapiens
aucggaucuggggcucugggaua

SEQ ID NO: 624216 - RNA, 18 nt, Homo sapiens
aucguaaagcuguucaaa

SEQ ID NO: 624217 - RNA, 20 nt, Homo sapiens
aucgugugugccuugggucu

SEQ ID NO: 624218 - RNA, 14 nt, Homo sapiens
aucguucucucuuu

SEQ ID NO: 624219 - RNA, 17 nt, Homo sapiens
aucguuguuuacagugu

SEQ ID NO: 624220 - RNA, 14 nt, Homo sapiens
aucuaaaaacuuag

SEQ ID NO: 624221 - RNA, 21 nt, Homo sapiens
aucuaaauauuuccauauucu

SEQ ID NO: 624222 - RNA, 18 nt, Homo sapiens
aucuaaauguauucugca

SEQ ID NO: 624223 - RNA, 16 nt, Homo sapiens
aucuaagcaguggcau

SEQ ID NO: 624224 - RNA, 17 nt, Homo sapiens
aucuaaggaugucacag

SEQ ID NO: 624225 - RNA, 20 nt, Homo sapiens
aucuaaggaugucacagggc

SEQ ID NO: 624226 - RNA, 16 nt, Homo sapiens
aucuaagggucucuca

SEQ ID NO: 624227 - RNA, 14 nt, Homo sapiens
aucuaagugauaua

SEQ ID NO: 624228 - RNA, 17 nt, Homo sapiens
aucuaauaauuauucau

SEQ ID NO: 624229 - RNA, 16 nt, Homo sapiens
aucuaauaugauagcg

SEQ ID NO: 624230 - RNA, 22 nt, Homo sapiens
aucuaauauggccacaguaguc

SEQ ID NO: 624231 - RNA, 18 nt, Homo sapiens
aucuacaaaaaacaacaa

SEQ ID NO: 624232 - RNA, 18 nt, Homo sapiens
aucuacaaaaauuuauua

SEQ ID NO: 624233 - RNA, 13 nt, Homo sapiens
aucuacaagccaa

SEQ ID NO: 624234 - RNA, 13 nt, Homo sapiens
aucuacacccacc

SEQ ID NO: 624235 - RNA, 18 nt, Homo sapiens
aucuaccacuguaugagu

SEQ ID NO: 624236 - RNA, 13 nt, Homo sapiens
aucuaccugcuug

SEQ ID NO: 624237 - RNA, 22 nt, Homo sapiens
aucuacuccuuguaaagacugu

SEQ ID NO: 624238 - RNA, 22 nt, Homo sapiens
aucuacuucaacacuucaugua

SEQ ID NO: 624239 - RNA, 15 nt, Homo sapiens
aucuacuucuacauc

SEQ ID NO: 624240 - RNA, 17 nt, Homo sapiens
aucuagaagacugucag

SEQ ID NO: 624241 - RNA, 17 nt, Homo sapiens
aucuagagaaggcauuu

SEQ ID NO: 624242 - RNA, 20 nt, Homo sapiens
aucuagagaaggcauuucau

SEQ ID NO: 624243 - RNA, 12 nt, Homo sapiens
aucuagcacucc

SEQ ID NO: 624244 - RNA, 21 nt, Homo sapiens
aucuagcaguaaauacuugca

SEQ ID NO: 624245 - RNA, 20 nt, Homo sapiens
aucuaggagaagggucucau

SEQ ID NO: 624246 - RNA, 15 nt, Homo sapiens
aucuaggaugugaug

SEQ ID NO: 624247 - RNA, 15 nt, Homo sapiens
aucuagguucaggaa

SEQ ID NO: 624248 - RNA, 22 nt, Homo sapiens
aucuagguucaggaagaccaca

SEQ ID NO: 624249 - RNA, 18 nt, Homo sapiens
aucuagugcuagauguau

SEQ ID NO: 624250 - RNA, 14 nt, Homo sapiens
aucuaguucauuga

SEQ ID NO: 624251 - RNA, 14 nt, Homo sapiens
aucuaguucucaau

SEQ ID NO: 624252 - RNA, 12 nt, Homo sapiens
aucuaguuuaca

SEQ ID NO: 624253 - RNA, 19 nt, Homo sapiens
aucuauaaaaugacagauc

SEQ ID NO: 624254 - RNA, 19 nt, Homo sapiens
aucuauaaagaagaacuug

SEQ ID NO: 624255 - RNA, 13 nt, Homo sapiens
aucuauacauacc

SEQ ID NO: 624256 - RNA, 19 nt, Homo sapiens
aucuauagcuaaguacaca

SEQ ID NO: 624257 - RNA, 15 nt, Homo sapiens
aucuaucaacuauaa

SEQ ID NO: 624258 - RNA, 10 nt, Homo sapiens
aucuauccaa

SEQ ID NO: 624259 - RNA, 19 nt, Homo sapiens
aucuauguuugugugauuu

SEQ ID NO: 624260 - RNA, 14 nt, Homo sapiens
aucuauuaucucaa

SEQ ID NO: 624261 - RNA, 22 nt, Homo sapiens
aucucaaacuacuggcaauuug

SEQ ID NO: 624262 - RNA, 14 nt, Homo sapiens
aucucaaagcacaa

SEQ ID NO: 624263 - RNA, 10 nt, Homo sapiens
aucucaaagu

SEQ ID NO: 624264 - RNA, 18 nt, Homo sapiens
ccagggucaaaguacaga

SEQ ID NO: 624265 - RNA, 22 nt, Homo sapiens
ccaggguugaucacacucuggg

SEQ ID NO: 624266 - RNA, 14 nt, Homo sapiens
ccaggguuuugccc

SEQ ID NO: 624267 - RNA, 15 nt, Homo sapiens
ccagguaagcccuuu

SEQ ID NO: 624268 - RNA, 18 nt, Homo sapiens
ccagguacaggagaggca

SEQ ID NO: 624269 - RNA, 21 nt, Homo sapiens
ccagguacaggagaggcagca

SEQ ID NO: 624270 - RNA, 18 nt, Homo sapiens
ccagguagcucggcacca

SEQ ID NO: 624271 - RNA, 22 nt, Homo sapiens
ccaggucaggaugcacauuucu

SEQ ID NO: 624272 - RNA, 19 nt, Homo sapiens
ccagguccaaacccuucaa

SEQ ID NO: 624273 - RNA, 20 nt, Homo sapiens
ccaggucguccaagcaaaaa

SEQ ID NO: 624274 - RNA, 18 nt, Homo sapiens
ccaggucugggugaaagg

SEQ ID NO: 624275 - RNA, 13 nt, Homo sapiens
ccaggugagaaac

SEQ ID NO: 624276 - RNA, 16 nt, Homo sapiens
ccaggugagaagugag

SEQ ID NO: 624277 - RNA, 13 nt, Homo sapiens
ccaggugcaauua

SEQ ID NO: 624278 - RNA, 12 nt, Homo sapiens
ccagguggcaaa

SEQ ID NO: 624279 - RNA, 13 nt, Homo sapiens
ccaggugggccug

SEQ ID NO: 624280 - RNA, 22 nt, Homo sapiens
ccagguggugguuccgccucca

SEQ ID NO: 624281 - RNA, 19 nt, Homo sapiens
ccagguguugccauuucuc

SEQ ID NO: 624282 - RNA, 19 nt, Homo sapiens
ccagguugcugugggugca

SEQ ID NO: 624283 - RNA, 17 nt, Homo sapiens
ccagguugggggcagug

SEQ ID NO: 624284 - RNA, 18 nt, Homo sapiens
ccagguuuaugaaugaca

SEQ ID NO: 624285 - RNA, 22 nt, Homo sapiens
gucacuccaggcauauguuucc

SEQ ID NO: 624286 - RNA, 21 nt, Homo sapiens
gucacugacucaagacacuga

SEQ ID NO: 624287 - RNA, 19 nt, Homo sapiens
gucacugauacacagaaua

SEQ ID NO: 624288 - RNA, 13 nt, Homo sapiens
gucacugccaacg

SEQ ID NO: 624289 - RNA, 17 nt, Homo sapiens
gucacugcccaccaaag

SEQ ID NO: 624290 - RNA, 19 nt, Homo sapiens
gucacugcucuggacugug

SEQ ID NO: 624291 - RNA, 13 nt, Homo sapiens
gucacuugccaca

SEQ ID NO: 624292 - RNA, 17 nt, Homo sapiens
gucacuuuuauuugaaa

SEQ ID NO: 624293 - RNA, 17 nt, Homo sapiens
gucagaaacaaugacau

SEQ ID NO: 624294 - RNA, 23 nt, Homo sapiens
gucagaaacaaugacauccagaa

SEQ ID NO: 624295 - RNA, 18 nt, Homo sapiens
gucagaaauauucuuauu

SEQ ID NO: 624296 - RNA, 20 nt, Homo sapiens
gucagacacuacaugaugac

SEQ ID NO: 624297 - RNA, 15 nt, Homo sapiens
gucagaccaguacug

SEQ ID NO: 624298 - RNA, 12 nt, Homo sapiens
gucagacugaaa

SEQ ID NO: 624299 - RNA, 23 nt, Homo sapiens
gucagacuuuguguucauuucau

SEQ ID NO: 624300 - RNA, 19 nt, Homo sapiens
gucagagacagauaccucc

SEQ ID NO: 624301 - RNA, 20 nt, Homo sapiens
gucagagacagauaccucca

SEQ ID NO: 624302 - RNA, 12 nt, Homo sapiens
gucagagcuaaa

SEQ ID NO: 624303 - RNA, 16 nt, Homo sapiens
gucagaggaccccagg

SEQ ID NO: 624304 - RNA, 20 nt, Homo sapiens
gucagaggaccccagggugg

SEQ ID NO: 624305 - RNA, 22 nt, Homo sapiens
gucagauuugcuguucacccac

SEQ ID NO: 624306 - RNA, 17 nt, Homo sapiens
gucagcaaaaagcaaaa

SEQ ID NO: 624307 - RNA, 18 nt, Homo sapiens
gucagcagaugccaguga

SEQ ID NO: 624308 - RNA, 15 nt, Homo sapiens
gucagcauccagguu

SEQ ID NO: 624309 - RNA, 18 nt, Homo sapiens
gucagcauguacuccccu

SEQ ID NO: 624310 - RNA, 14 nt, Homo sapiens
gucagcgggugcac

SEQ ID NO: 624311 - RNA, 22 nt, Homo sapiens
gucagcuaaagaaguuugaaca

SEQ ID NO: 624312 - RNA, 12 nt, Homo sapiens
gucagcucucuc

SEQ ID NO: 624313 - RNA, 23 nt, Homo sapiens
gucagcugcuucugcugccuagg

SEQ ID NO: 624314 - RNA, 15 nt, Homo sapiens
gucaggaaaccaaau

SEQ ID NO: 624315 - RNA, 14 nt, Homo sapiens
gucaggacugugac

SEQ ID NO: 624316 - RNA, 15 nt, Homo sapiens
gucaggaugcacauu

SEQ ID NO: 624317 - RNA, 23 nt, Homo sapiens
gucaggcccugaucuagugcagu

SEQ ID NO: 624318 - RNA, 16 nt, Homo sapiens
gucagggagaggucac

SEQ ID NO: 624319 - RNA, 18 nt, Homo sapiens
gucagguggacucuggga

SEQ ID NO: 624320 - RNA, 22 nt, Homo sapiens
gucaguaaagauauuugaauau

SEQ ID NO: 624321 - RNA, 19 nt, Homo sapiens
uagucauuuuuagcacugg

SEQ ID NO: 624322 - RNA, 17 nt, Homo sapiens
uagucccaaaauucaua

SEQ ID NO: 624323 - RNA, 23 nt, Homo sapiens
uagucccauuuuucucuugccau

SEQ ID NO: 624324 - RNA, 19 nt, Homo sapiens
uaguccgcuuucucuugcu

SEQ ID NO: 624325 - RNA, 15 nt, Homo sapiens
uaguccuuccuggca

SEQ ID NO: 624326 - RNA, 16 nt, Homo sapiens
uauacaaaacuuuauc

SEQ ID NO: 624327 - RNA, 15 nt, Homo sapiens
uauacaacuguaaag

SEQ ID NO: 624328 - RNA, 23 nt, Homo sapiens
uauacaagcuuuuaguauccaca

SEQ ID NO: 624329 - RNA, 19 nt, Homo sapiens
uauacaaguuguucuagua

SEQ ID NO: 624330 - RNA, 16 nt, Homo sapiens
uauacaauacagauca

SEQ ID NO: 624331 - RNA, 17 nt, Homo sapiens
uauacacacauauacau

SEQ ID NO: 624332 - RNA, 20 nt, Homo sapiens
uauacacacauauacauaua

SEQ ID NO: 624333 - RNA, 21 nt, Homo sapiens
uauacacacauauacauauau

SEQ ID NO: 624334 - RNA, 16 nt, Homo sapiens
uauacacgaauagaca

SEQ ID NO: 624335 - RNA, 11 nt, Homo sapiens
uauacagcauu

SEQ ID NO: 624336 - RNA, 13 nt, Homo sapiens
uauacagcauuga

SEQ ID NO: 624337 - RNA, 13 nt, Homo sapiens
uauacagcuguau

SEQ ID NO: 624338 - RNA, 21 nt, Homo sapiens
uauacauaggcaucauuucac

SEQ ID NO: 624339 - RNA, 23 nt, Homo sapiens
uauacauuuuuuaggacaucuua

SEQ ID NO: 624340 - RNA, 21 nt, Homo sapiens
uauaccaaccaaaccaauuca

SEQ ID NO: 624341 - RNA, 14 nt, Homo sapiens
uauaccaacuaaaa

SEQ ID NO: 624342 - RNA, 17 nt, Homo sapiens
uauaccagccuacugua

SEQ ID NO: 624343 - RNA, 22 nt, Homo sapiens
uauaccauaugucugcuucugu

SEQ ID NO: 624344 - RNA, 23 nt, Homo sapiens
uauaccuggcaauucacaaauag

SEQ ID NO: 624345 - RNA, 15 nt, Homo sapiens
uauacguauaaauau

SEQ ID NO: 624346 - RNA, 18 nt, Homo sapiens
uauacgugacagaauugu

SEQ ID NO: 624347 - RNA, 16 nt, Homo sapiens
uauacuagauguuaag

SEQ ID NO: 624348 - RNA, 22 nt, Homo sapiens
uauacugcauuagcccaagaga

SEQ ID NO: 624349 - RNA, 14 nt, Homo sapiens
uauacuguuuacug

SEQ ID NO: 624350 - RNA, 21 nt, Homo sapiens
uauacuuuaguagacauuuau

SEQ ID NO: 624351 - RNA, 14 nt, Homo sapiens
uauacuuuugugaa

SEQ ID NO: 624352 - RNA, 22 nt, Homo sapiens
uauacuuuuuucuuauuuaacu

SEQ ID NO: 624353 - RNA, 19 nt, Homo sapiens
uauagaaaauaaccuuuua

SEQ ID NO: 624354 - RNA, 22 nt, Homo sapiens
uauagaaagucggcuguugaua

SEQ ID NO: 624355 - RNA, 16 nt, Homo sapiens
uauagaaaugcugguu

SEQ ID NO: 624356 - RNA, 22 nt, Homo sapiens
uauagcaacuuuaagaaguaau

SEQ ID NO: 624357 - RNA, 17 nt, Homo sapiens
uauagcagauuguguaa

SEQ ID NO: 624358 - RNA, 13 nt, Homo sapiens
uauagccauaaac

SEQ ID NO: 624359 - RNA, 20 nt, Homo sapiens
uauagccuggggugggguca

SEQ ID NO: 624360 - RNA, 17 nt, Homo sapiens
uauagcuaaguacacaa

SEQ ID NO: 624361 - RNA, 14 nt, Homo sapiens
uauagcugugugaa

SEQ ID NO: 624362 - RNA, 20 nt, Homo sapiens
uauaggaaacauaauuuuga

SEQ ID NO: 624363 - RNA, 15 nt, Homo sapiens
uauaggaacaauucu

SEQ ID NO: 624364 - RNA, 22 nt, Homo sapiens
uauaggaucauuuguuggaaug

SEQ ID NO: 624365 - RNA, 16 nt, Homo sapiens
uauaggccaucuguaa

SEQ ID NO: 624366 - RNA, 13 nt, Homo sapiens
uauaggcucuugu

SEQ ID NO: 624367 - RNA, 18 nt, Homo sapiens
uauagguuuugguuccac

SEQ ID NO: 624368 - RNA, 14 nt, Homo sapiens
uauaguaaaugccu

SEQ ID NO: 624369 - RNA, 14 nt, Homo sapiens
uauagucacaagag

SEQ ID NO: 624370 - RNA, 21 nt, Homo sapiens
uauagugucuugggaauuuuc

SEQ ID NO: 624371 - RNA, 21 nt, Homo sapiens
uauaguguucacaaacuguga

SEQ ID NO: 624372 - RNA, 21 nt, Homo sapiens
uauaguuaugcauacauacac

SEQ ID NO: 624373 - RNA, 21 nt, Homo sapiens
uauaguuauugcacaaguuca

SEQ ID NO: 624374 - RNA, 18 nt, Homo sapiens
uauaguuccuugccuuaa

SEQ ID NO: 624375 - RNA, 23 nt, Homo sapiens
uauaguuuguuuuuaaacuaaua

SEQ ID NO: 624376 - RNA, 14 nt, Homo sapiens
uauauaaaccugga

SEQ ID NO: 624377 - RNA, 14 nt, Homo sapiens
uauauaaacuuaac

SEQ ID NO: 624378 - RNA, 12 nt, Homo sapiens
uauauaaccaau

SEQ ID NO: 624379 - RNA, 13 nt, Homo sapiens
uauauaagccagu

SEQ ID NO: 624380 - RNA, 18 nt, Homo sapiens
uauauaaguuuacaccuu

SEQ ID NO: 624381 - RNA, 12 nt, Homo sapiens
uauauacauuuc

SEQ ID NO: 624382 - RNA, 13 nt, Homo sapiens
uauauaccaaagc

SEQ ID NO: 624383 - RNA, 18 nt, Homo sapiens
uauauaccaaagcacauu

SEQ ID NO: 624384 - RNA, 20 nt, Homo sapiens
uauauacccguacaacgugu

SEQ ID NO: 624385 - RNA, 17 nt, Homo sapiens
uauauaguagcauuuca

SEQ ID NO: 624386 - RNA, 23 nt, Homo sapiens
uauauaguggguacaucaagucc

SEQ ID NO: 624387 - RNA, 13 nt, Homo sapiens
uauauauauagua

SEQ ID NO: 624388 - RNA, 16 nt, Homo sapiens
uauauauauguguaua

SEQ ID NO: 624389 - RNA, 22 nt, Homo sapiens
uauauaugcuuggcuaacuaua

SEQ ID NO: 624390 - RNA, 13 nt, Homo sapiens
uauauauuacaag

SEQ ID NO: 624391 - RNA, 13 nt, Homo sapiens
uauauauuacuug

SEQ ID NO: 624392 - RNA, 13 nt, Homo sapiens
uauauauucccaa

SEQ ID NO: 624393 - RNA, 12 nt, Homo sapiens
uauauauugaau

SEQ ID NO: 624394 - RNA, 14 nt, Homo sapiens
uauauauugcuuau

SEQ ID NO: 624395 - RNA, 21 nt, Homo sapiens
uauauauuuaauugauuucug

SEQ ID NO: 624396 - RNA, 20 nt, Homo sapiens
uauauauuuucauccuauaa

SEQ ID NO: 624397 - RNA, 18 nt, Homo sapiens
uauauauuuuugugcaca

SEQ ID NO: 624398 - RNA, 21 nt, Homo sapiens
uauauauuuuugugcacauuu

SEQ ID NO: 624399 - RNA, 12 nt, Homo sapiens
uauaucagggaa

SEQ ID NO: 624400 - RNA, 13 nt, Homo sapiens
uauaucaguccuc

SEQ ID NO: 624401 - RNA, 19 nt, Homo sapiens
uauaucaguccucuuucaa

SEQ ID NO: 624402 - RNA, 20 nt, Homo sapiens
uauaucauaacuauacuuga

SEQ ID NO: 624403 - RNA, 13 nt, Homo sapiens
uauaucauaugua

SEQ ID NO: 624404 - RNA, 12 nt, Homo sapiens
uauauccuguga

SEQ ID NO: 624405 - RNA, 14 nt, Homo sapiens
uauauccugugacu

SEQ ID NO: 624406 - RNA, 14 nt, Homo sapiens
uauaucgaucucuu

SEQ ID NO: 624407 - RNA, 17 nt, Homo sapiens
uauaucgcuuaaucuua

SEQ ID NO: 624408 - RNA, 18 nt, Homo sapiens
uauaugauauacuaugac

SEQ ID NO: 624409 - RNA, 18 nt, Homo sapiens
uauaugaucaguguuacu

SEQ ID NO: 624410 - RNA, 16 nt, Homo sapiens
uauaugcacuauguau

SEQ ID NO: 624411 - RNA, 12 nt, Homo sapiens
uauaugccucau

SEQ ID NO: 624412 - RNA, 17 nt, Homo sapiens
uauaugccucauacaca

SEQ ID NO: 624413 - RNA, 11 nt, Homo sapiens
uauaugcucug

SEQ ID NO: 624414 - RNA, 15 nt, Homo sapiens
uauaugguucuccaa

SEQ ID NO: 624415 - RNA, 13 nt, Homo sapiens
uauauguaccgua

SEQ ID NO: 624416 - RNA, 11 nt, Homo sapiens
uauauguauuu

SEQ ID NO: 624417 - RNA, 20 nt, Homo sapiens
uauaugugauuuacauuuca

SEQ ID NO: 624418 - RNA, 13 nt, Homo sapiens
uauauguguauau

SEQ ID NO: 624419 - RNA, 16 nt, Homo sapiens
uauauguuuauauacu

SEQ ID NO: 624420 - RNA, 24 nt, Homo sapiens
uauauguuuugugggaacagaugu

SEQ ID NO: 624421 - RNA, 18 nt, Homo sapiens
uauauuaacaucaucuua

SEQ ID NO: 624422 - RNA, 15 nt, Homo sapiens
uauauuacucucauu

SEQ ID NO: 624423 - RNA, 16 nt, Homo sapiens
uauauucauccaugcc

SEQ ID NO: 624424 - RNA, 15 nt, Homo sapiens
uauauucucagugua

SEQ ID NO: 624425 - RNA, 12 nt, Homo sapiens
uauauugccuua

SEQ ID NO: 624426 - RNA, 16 nt, Homo sapiens
uauauuuaauggcaau

SEQ ID NO: 624427 - RNA, 12 nt, Homo sapiens
uauauuucacau

SEQ ID NO: 624428 - RNA, 21 nt, Homo sapiens
uauauuucagguuauauccaa

SEQ ID NO: 624429 - RNA, 14 nt, Homo sapiens
uauauuucagugac

SEQ ID NO: 624430 - RNA, 15 nt, Homo sapiens
uauauuucagugaca

SEQ ID NO: 624431 - RNA, 22 nt, Homo sapiens
uauauuugaaaaaaacuucauu

SEQ ID NO: 624432 - RNA, 13 nt, Homo sapiens
uauauuugucaug

SEQ ID NO: 624433 - RNA, 21 nt, Homo sapiens
uauauuuuaaaaauaaauuca

SEQ ID NO: 624434 - RNA, 20 nt, Homo sapiens
uauauuuuuuuaaaauguua

SEQ ID NO: 624435 - RNA, 20 nt, Homo sapiens
uaucaaaaaguacaauaaua

SEQ ID NO: 624436 - RNA, 16 nt, Homo sapiens
uaucaaaaaguauuaa

SEQ ID NO: 624437 - RNA, 16 nt, Homo sapiens
uaucaaaaaguauuau

SEQ ID NO: 624438 - RNA, 22 nt, Homo sapiens
uaucaaaauagucuaaggccau

SEQ ID NO: 624439 - RNA, 21 nt, Homo sapiens
uaucaaacccuagccuugcuu

SEQ ID NO: 624440 - RNA, 19 nt, Homo sapiens
uaucaaacuagugcaugaa

SEQ ID NO: 624441 - RNA, 24 nt, Homo sapiens
uaucaaagagaaguuacauauuag

SEQ ID NO: 624442 - RNA, 15 nt, Homo sapiens
uaucaaauacauuua

SEQ ID NO: 624443 - RNA, 16 nt, Homo sapiens
uaucaaauacauuuaa

SEQ ID NO: 624444 - RNA, 19 nt, Homo sapiens
uaucaaccccagacacugg

SEQ ID NO: 624445 - RNA, 14 nt, Homo sapiens
uaucaagcuuuuaa

SEQ ID NO: 624446 - RNA, 16 nt, Homo sapiens
uaucaagugucuucca

SEQ ID NO: 624447 - RNA, 18 nt, Homo sapiens
ucauccccucccagaugu

SEQ ID NO: 624448 - RNA, 18 nt, Homo sapiens
ucaucccuuaauaaaaua

SEQ ID NO: 624449 - RNA, 19 nt, Homo sapiens
ucauccucaagcucagggc

SEQ ID NO: 624450 - RNA, 15 nt, Homo sapiens
ucauccugauacugu

SEQ ID NO: 624451 - RNA, 18 nt, Homo sapiens
ucaucggaaauggcggua

SEQ ID NO: 624452 - RNA, 12 nt, Homo sapiens
ucaucuacugaa

SEQ ID NO: 624453 - RNA, 15 nt, Homo sapiens
ucaucuagcgcaauu

SEQ ID NO: 624454 - RNA, 20 nt, Homo sapiens
ucaucuauaaagaagaacuu

SEQ ID NO: 624455 - RNA, 16 nt, Homo sapiens
ucaucuauaacaugca

SEQ ID NO: 624456 - RNA, 17 nt, Homo sapiens
ucaucuauaacaugcau

SEQ ID NO: 624457 - RNA, 21 nt, Homo sapiens
ucauuugacuaagagucucca

SEQ ID NO: 624458 - RNA, 14 nt, Homo sapiens
ucauuugaugcuaa

SEQ ID NO: 624459 - RNA, 21 nt, Homo sapiens
ucauuuguaccucgaguuuua

SEQ ID NO: 624460 - RNA, 14 nt, Homo sapiens
ucauuuuacucaga

SEQ ID NO: 624461 - RNA, 18 nt, Homo sapiens
ucauuuuccauaaaggua

SEQ ID NO: 624462 - RNA, 14 nt, Homo sapiens
ucauuuugcacuga

SEQ ID NO: 624463 - RNA, 20 nt, Homo sapiens
ucauuuuuacacuauuguga

SEQ ID NO: 624464 - RNA, 22 nt, Homo sapiens
ucauuuuuacagaguuugugaa

SEQ ID NO: 624465 - RNA, 14 nt, Homo sapiens
ucauuuuugugcac

SEQ ID NO: 624466 - RNA, 12 nt, Homo sapiens
uccaaaaccucc

SEQ ID NO: 624467 - RNA, 14 nt, Homo sapiens
uccaaaaccuuccu

SEQ ID NO: 624468 - RNA, 18 nt, Homo sapiens
uccaaaacuguccagggc

SEQ ID NO: 624469 - RNA, 23 nt, Homo sapiens
uccaaaacuuuaaugaacuaacu

SEQ ID NO: 624470 - RNA, 13 nt, Homo sapiens
uccaaaagcacau

SEQ ID NO: 624471 - RNA, 13 nt, Homo sapiens
uccaaaagcacuu

SEQ ID NO: 624472 - RNA, 14 nt, Homo sapiens
uccaaaagcacuua

SEQ ID NO: 624473 - RNA, 23 nt, Homo sapiens
uccaaaagggggccccuugagaa

SEQ ID NO: 624474 - RNA, 19 nt, Homo sapiens
uccaaacagaccccuguuc

SEQ ID NO: 624475 - RNA, 22 nt, Homo sapiens
uccaaaccuggccugagccucc

SEQ ID NO: 624476 - RNA, 19 nt, Homo sapiens
uccaaacucaaacuugaga

SEQ ID NO: 624477 - RNA, 18 nt, Homo sapiens
uccaaagaacaucugcac

SEQ ID NO: 624478 - RNA, 20 nt, Homo sapiens
uccaaagaagguguuuuccu

SEQ ID NO: 624479 - RNA, 14 nt, Homo sapiens
uccaaagacuguac

SEQ ID NO: 624480 - RNA, 17 nt, Homo sapiens
uccaaagacuguacugg

SEQ ID NO: 624481 - RNA, 18 nt, Homo sapiens
uccaaaggaaauccaaaa

SEQ ID NO: 624482 - RNA, 18 nt, Homo sapiens
uccaaagugccacucauu

SEQ ID NO: 624483 - RNA, 14 nt, Homo sapiens
uccaaauagcauua

SEQ ID NO: 624484 - RNA, 17 nt, Homo sapiens
uccaaauauuguugaca

SEQ ID NO: 624485 - RNA, 17 nt, Homo sapiens
uccaaaucccuuucaug

SEQ ID NO: 624486 - RNA, 23 nt, Homo sapiens
uccaaaucccuuucaugucuuuc

SEQ ID NO: 624487 - RNA, 14 nt, Homo sapiens
uccaaaucuguccu

SEQ ID NO: 624488 - RNA, 13 nt, Homo sapiens
uccaaauucacaa

SEQ ID NO: 624489 - RNA, 17 nt, Homo sapiens
uccaaauucaguuucau

SEQ ID NO: 624490 - RNA, 23 nt, Homo sapiens
uccaaauuuaaccauaaaucaau

SEQ ID NO: 624491 - RNA, 13 nt, Homo sapiens
uccaaauuucuca

SEQ ID NO: 624492 - RNA, 14 nt, Homo sapiens
uccaacaccacaga

SEQ ID NO: 624493 - RNA, 17 nt, Homo sapiens
uccaacagccagugugu

SEQ ID NO: 624494 - RNA, 11 nt, Homo sapiens
uccaaccacug

SEQ ID NO: 624495 - RNA, 14 nt, Homo sapiens
uccaacccagccac

SEQ ID NO: 624496 - RNA, 19 nt, Homo sapiens
uccaaccccccaccugcca

SEQ ID NO: 624497 - RNA, 20 nt, Homo sapiens
uccaacccugccgucaccac

SEQ ID NO: 624498 - RNA, 14 nt, Homo sapiens
uccaaccucaggga

SEQ ID NO: 624499 - RNA, 20 nt, Homo sapiens
uccaaccucccggggggacg

SEQ ID NO: 624500 - RNA, 20 nt, Homo sapiens
uccaaccugccugugcauga

SEQ ID NO: 624501 - RNA, 15 nt, Homo sapiens
uccaaccuucccaaa

SEQ ID NO: 624502 - RNA, 14 nt, Homo sapiens
uccaacuccaggau

SEQ ID NO: 624503 - RNA, 16 nt, Homo sapiens
uccaacuucccaguuc

SEQ ID NO: 624504 - RNA, 15 nt, Homo sapiens
uccaacuugaaggau

SEQ ID NO: 624505 - RNA, 14 nt, Homo sapiens
uccaagaccagaga

SEQ ID NO: 624506 - RNA, 14 nt, Homo sapiens
uccaagcauuucau

SEQ ID NO: 624507 - RNA, 12 nt, Homo sapiens
uccaagcccuuu

SEQ ID NO: 624508 - RNA, 19 nt, Homo sapiens
uccaagcgcgcuguugauu

SEQ ID NO: 624509 - RNA, 20 nt, Homo sapiens
uccaagcgcgguuacuaugg

SEQ ID NO: 624510 - RNA, 18 nt, Homo sapiens
uccaaggaguuccaugaa

SEQ ID NO: 624511 - RNA, 19 nt, Homo sapiens
uccaaggccgcggcccaga

SEQ ID NO: 624512 - RNA, 14 nt, Homo sapiens
uccaagggacccuu

SEQ ID NO: 624513 - RNA, 22 nt, Homo sapiens
uccaaggguaugggaagccaua

SEQ ID NO: 624514 - RNA, 19 nt, Homo sapiens
uccaagguguaacucuaau

SEQ ID NO: 624515 - RNA, 20 nt, Homo sapiens
uccaagucucucugugaaua

SEQ ID NO: 624516 - RNA, 14 nt, Homo sapiens
uccaagucuucuca

SEQ ID NO: 624517 - RNA, 13 nt, Homo sapiens
uccaagugccaau

SEQ ID NO: 624518 - RNA, 17 nt, Homo sapiens
uccaaguugcuaauaca

SEQ ID NO: 624519 - RNA, 17 nt, Homo sapiens
uccaauaggcauuugau

SEQ ID NO: 624520 - RNA, 14 nt, Homo sapiens
uccaauaugacuca

SEQ ID NO: 624521 - RNA, 19 nt, Homo sapiens
uccaaugaaggaaacauca

SEQ ID NO: 624522 - RNA, 12 nt, Homo sapiens
uccaaugagcuc

SEQ ID NO: 624523 - RNA, 16 nt, Homo sapiens
uccaaugcauugcuaa

SEQ ID NO: 624524 - RNA, 20 nt, Homo sapiens
uccaauggaacaguagcuuu

SEQ ID NO: 624525 - RNA, 19 nt, Homo sapiens
uccaauggaauacugaaaa

SEQ ID NO: 624526 - RNA, 16 nt, Homo sapiens
uccaaugucaauguga

SEQ ID NO: 624527 - RNA, 18 nt, Homo sapiens
uccaaugucaaugugaac

SEQ ID NO: 624528 - RNA, 14 nt, Homo sapiens
uccaauguguucaa

SEQ ID NO: 624529 - RNA, 16 nt, Homo sapiens
uccaauuaguuuccuu

SEQ ID NO: 624530 - RNA, 18 nt, Homo sapiens
uccaauuccaaagccaga

SEQ ID NO: 624531 - RNA, 17 nt, Homo sapiens
uccaauucgaaaacaac

SEQ ID NO: 624532 - RNA, 20 nt, Homo sapiens
uccaauugaacuuucacaua

SEQ ID NO: 624533 - RNA, 22 nt, Homo sapiens
uccaauugaacuuucacauagc

SEQ ID NO: 624534 - RNA, 17 nt, Homo sapiens
uccaauuuuaauuuagu

SEQ ID NO: 624535 - RNA, 19 nt, Homo sapiens
uccacaaagaaaauuccua

SEQ ID NO: 624536 - RNA, 14 nt, Homo sapiens
uccacaaagcaaag

SEQ ID NO: 624537 - RNA, 19 nt, Homo sapiens
uccacaaagcaaaggcagu

SEQ ID NO: 624538 - RNA, 16 nt, Homo sapiens
uccacaaaucaucugu

SEQ ID NO: 624539 - RNA, 13 nt, Homo sapiens
uccacaagccauu

SEQ ID NO: 624540 - RNA, 18 nt, Homo sapiens
uccacaauucaaaagcac

SEQ ID NO: 624541 - RNA, 19 nt, Homo sapiens
uccacaauucuucugucaa

SEQ ID NO: 624542 - RNA, 19 nt, Homo sapiens
uccacacagcguuugccac

SEQ ID NO: 624543 - RNA, 17 nt, Homo sapiens
uccacaccugggcauuu

SEQ ID NO: 624544 - RNA, 14 nt, Homo sapiens
uccacacgccaagc

SEQ ID NO: 624545 - RNA, 12 nt, Homo sapiens
uccacacugaga

SEQ ID NO: 624546 - RNA, 11 nt, Homo sapiens
uccacagcuua

SEQ ID NO: 624547 - RNA, 22 nt, Homo sapiens
uccacagcuuacagcaauuuga

SEQ ID NO: 624548 - RNA, 14 nt, Homo sapiens
uccacagugcugcu

SEQ ID NO: 624549 - RNA, 16 nt, Homo sapiens
uccacauaaaugcucc

SEQ ID NO: 624550 - RNA, 22 nt, Homo sapiens
uccacauccuuucuaaacaaga

SEQ ID NO: 624551 - RNA, 16 nt, Homo sapiens
uccacauguucaacua

SEQ ID NO: 624552 - RNA, 14 nt, Homo sapiens
uccaccacaucugc

SEQ ID NO: 624553 - RNA, 15 nt, Homo sapiens
uccacccagcaaaga

SEQ ID NO: 624554 - RNA, 21 nt, Homo sapiens
uccacccagcaggcagagugg

SEQ ID NO: 624555 - RNA, 14 nt, Homo sapiens
uccacccauccagu

SEQ ID NO: 624556 - RNA, 15 nt, Homo sapiens
uccaccccagugugc

SEQ ID NO: 624557 - RNA, 19 nt, Homo sapiens
uccaccccgacugcucagu

SEQ ID NO: 624558 - RNA, 15 nt, Homo sapiens
uccacccgucucucu

SEQ ID NO: 624559 - RNA, 13 nt, Homo sapiens
uccacccuuccau

SEQ ID NO: 624560 - RNA, 13 nt, Homo sapiens
uccacccuuggcc

SEQ ID NO: 624561 - RNA, 14 nt, Homo sapiens
uccaccgcacagac

SEQ ID NO: 624562 - RNA, 16 nt, Homo sapiens
uccaccuagacuguaa

SEQ ID NO: 624563 - RNA, 21 nt, Homo sapiens
uccaccucccauuacuuugau

SEQ ID NO: 624564 - RNA, 14 nt, Homo sapiens
uccaccugaggaac

SEQ ID NO: 624565 - RNA, 16 nt, Homo sapiens
uccacgauucacucau

SEQ ID NO: 624566 - RNA, 20 nt, Homo sapiens
uccacgcaauggaacauuau

SEQ ID NO: 624567 - RNA, 17 nt, Homo sapiens
uccacgcuucuccggau

SEQ ID NO: 624568 - RNA, 18 nt, Homo sapiens
uccacggaaacagaacuc

SEQ ID NO: 624569 - RNA, 16 nt, Homo sapiens
uccagaaacagcugcu

SEQ ID NO: 624570 - RNA, 21 nt, Homo sapiens
uccagaagaagagaagcugcu

SEQ ID NO: 624571 - RNA, 22 nt, Homo sapiens
uccagaagauagcuucacccca

SEQ ID NO: 624572 - RNA, 15 nt, Homo sapiens
uccagaagaucugaa

SEQ ID NO: 624573 - RNA, 17 nt, Homo sapiens
uccagaauccugauggu

SEQ ID NO: 624574 - RNA, 22 nt, Homo sapiens
uccagaaucgcuagacuaagaa

SEQ ID NO: 624575 - RNA, 23 nt, Homo sapiens
uccagaauugguaaaaacagcag

SEQ ID NO: 624576 - RNA, 13 nt, Homo sapiens
uccagacaccagu

SEQ ID NO: 624577 - RNA, 18 nt, Homo sapiens
uccagacauacaaacaua

SEQ ID NO: 624578 - RNA, 18 nt, Homo sapiens
uccagaccaaccuuccau

SEQ ID NO: 624579 - RNA, 22 nt, Homo sapiens
uccagacccugccugagcccag

SEQ ID NO: 624580 - RNA, 17 nt, Homo sapiens
uccagacucacuugcca

SEQ ID NO: 624581 - RNA, 21 nt, Homo sapiens
uccagacucagagggcuggau

SEQ ID NO: 624582 - RNA, 18 nt, Homo sapiens
uccagagacaacagguaa

SEQ ID NO: 624583 - RNA, 15 nt, Homo sapiens
uccagagaugacuau

SEQ ID NO: 624584 - RNA, 21 nt, Homo sapiens
uccagagcccaaggucaggga

SEQ ID NO: 624585 - RNA, 14 nt, Homo sapiens
uccagagcugagau

SEQ ID NO: 624586 - RNA, 14 nt, Homo sapiens
uccagaggaauuga

SEQ ID NO: 624587 - RNA, 22 nt, Homo sapiens
uccagagguauuccucucuuaa

SEQ ID NO: 624588 - RNA, 17 nt, Homo sapiens
uccagagguccuccgua

SEQ ID NO: 624589 - RNA, 16 nt, Homo sapiens
uccagaguaagugaug

SEQ ID NO: 624590 - RNA, 14 nt, Homo sapiens
uccagaucagauuc

SEQ ID NO: 624591 - RNA, 16 nt, Homo sapiens
uccagaucagauucuu

SEQ ID NO: 624592 - RNA, 17 nt, Homo sapiens
uccagaugcagggcagu

SEQ ID NO: 624593 - RNA, 22 nt, Homo sapiens
uccagcacaccugccgucuuca

SEQ ID NO: 624594 - RNA, 11 nt, Homo sapiens
uccagcaccuu

SEQ ID NO: 624595 - RNA, 14 nt, Homo sapiens
uccagcacuggaag

SEQ ID NO: 624596 - RNA, 19 nt, Homo sapiens
uccagcagaagacaaaaag

SEQ ID NO: 624597 - RNA, 13 nt, Homo sapiens
uccagcagcugcc

SEQ ID NO: 624598 - RNA, 22 nt, Homo sapiens
uccagcagugaaugcuagacag

SEQ ID NO: 624599 - RNA, 13 nt, Homo sapiens
uccagccaccacc

SEQ ID NO: 624600 - RNA, 15 nt, Homo sapiens
uccagcccaggacuc

SEQ ID NO: 624601 - RNA, 20 nt, Homo sapiens
uccagccccagacaacagcc

SEQ ID NO: 624602 - RNA, 17 nt, Homo sapiens
uccagccgccauugcca

SEQ ID NO: 624603 - RNA, 20 nt, Homo sapiens
uccagcgugacggagcccac

SEQ ID NO: 624604 - RNA, 16 nt, Homo sapiens
uccagcucagucucag

SEQ ID NO: 624605 - RNA, 23 nt, Homo sapiens
uccagcuggaagggucaacaucu

SEQ ID NO: 624606 - RNA, 22 nt, Homo sapiens
uccagcuggccgggagccugau

SEQ ID NO: 624607 - RNA, 20 nt, Homo sapiens
uccagcuguacuagugccau

SEQ ID NO: 624608 - RNA, 19 nt, Homo sapiens
uccagcuugggcaacagag

SEQ ID NO: 624609 - RNA, 20 nt, Homo sapiens
uccagcuugggcaacagagc

SEQ ID NO: 624610 - RNA, 18 nt, Homo sapiens
uccagcuugggugauaaa

SEQ ID NO: 624611 - RNA, 15 nt, Homo sapiens
uccagcuuucugcca

SEQ ID NO: 624612 - RNA, 17 nt, Homo sapiens
uccaggaaaguggccaa

SEQ ID NO: 624613 - RNA, 15 nt, Homo sapiens
uccaggaaccaaaaa

SEQ ID NO: 624614 - RNA, 14 nt, Homo sapiens
uccaggaacugccu

SEQ ID NO: 624615 - RNA, 22 nt, Homo sapiens
uccaggacuuagaauagugccu

SEQ ID NO: 624616 - RNA, 16 nt, Homo sapiens
uccaggagaaggccaa

SEQ ID NO: 624617 - RNA, 13 nt, Homo sapiens
uccaggagcucag

SEQ ID NO: 624618 - RNA, 20 nt, Homo sapiens
uccaggaggggccugggcag

SEQ ID NO: 624619 - RNA, 17 nt, Homo sapiens
uccaggaucuccacuga

SEQ ID NO: 624620 - RNA, 23 nt, Homo sapiens
uccaggcaaaauugauauacuuu

SEQ ID NO: 624621 - RNA, 13 nt, Homo sapiens
uccaggcacagcu

SEQ ID NO: 624622 - RNA, 18 nt, Homo sapiens
uccaggcccaacugugag

SEQ ID NO: 624623 - RNA, 14 nt, Homo sapiens
uccaggccccaaaa

SEQ ID NO: 624624 - RNA, 19 nt, Homo sapiens
uccaggcccuucucuacac

SEQ ID NO: 624625 - RNA, 16 nt, Homo sapiens
uccaggccugcagcag

SEQ ID NO: 624626 - RNA, 15 nt, Homo sapiens
uccaggcgaugugca

SEQ ID NO: 624627 - RNA, 18 nt, Homo sapiens
uccaggcuggagugcaau

SEQ ID NO: 624628 - RNA, 23 nt, Homo sapiens
uccagggaugauucaagccauuc

SEQ ID NO: 624629 - RNA, 19 nt, Homo sapiens
uccagggcccccaucucau

SEQ ID NO: 624630 - RNA, 21 nt, Homo sapiens
uccaggguauggccauggagu

SEQ ID NO: 624631 - RNA, 23 nt, Homo sapiens
uccaggucaggaugcacauuucu

SEQ ID NO: 624632 - RNA, 13 nt, Homo sapiens
uccaggugagaac

SEQ ID NO: 624633 - RNA, 14 nt, Homo sapiens
uccagguucacuuu

SEQ ID NO: 624634 - RNA, 15 nt, Homo sapiens
uccagguuuaugaau

SEQ ID NO: 624635 - RNA, 17 nt, Homo sapiens
uccagguuuaugaauga

SEQ ID NO: 624636 - RNA, 14 nt, Homo sapiens
uccaguauugaaaa

SEQ ID NO: 624637 - RNA, 16 nt, Homo sapiens
uccagucacacucccc

SEQ ID NO: 624638 - RNA, 15 nt, Homo sapiens
uccagucuacuugag

SEQ ID NO: 624639 - RNA, 16 nt, Homo sapiens
uccagucugaucugug

SEQ ID NO: 624640 - RNA, 16 nt, Homo sapiens
uccagugaguccaggc

SEQ ID NO: 624641 - RNA, 19 nt, Homo sapiens
uccagugccagcaaugaca

SEQ ID NO: 624642 - RNA, 19 nt, Homo sapiens
uccagugguucugcuucaa

SEQ ID NO: 624643 - RNA, 21 nt, Homo sapiens
uccagugguuugagacacugg

SEQ ID NO: 624644 - RNA, 16 nt, Homo sapiens
uccaguguacagugaa

SEQ ID NO: 624645 - RNA, 18 nt, Homo sapiens
uccaguguauaaauccaa

SEQ ID NO: 624646 - RNA, 20 nt, Homo sapiens
uccagugugggcuugaccag

SEQ ID NO: 624647 - RNA, 14 nt, Homo sapiens
uccaguucaaauaa

SEQ ID NO: 624648 - RNA, 18 nt, Homo sapiens
uccaguucauaaacaaca

SEQ ID NO: 624649 - RNA, 14 nt, Homo sapiens
uccaguuccgggag

SEQ ID NO: 624650 - RNA, 19 nt, Homo sapiens
uccaguuccucuuuugugc

SEQ ID NO: 624651 - RNA, 15 nt, Homo sapiens
uccaguucugacaca

SEQ ID NO: 624652 - RNA, 16 nt, Homo sapiens
uccaguuguguugaca

SEQ ID NO: 624653 - RNA, 19 nt, Homo sapiens
uccaguuucccaccaccuu

SEQ ID NO: 624654 - RNA, 16 nt, Homo sapiens
uccaguuugcauuugg

SEQ ID NO: 624655 - RNA, 23 nt, Homo sapiens
uccaguuuuauaaaaaguggaga

SEQ ID NO: 624656 - RNA, 20 nt, Homo sapiens
uccauaaauuuggacugucu

SEQ ID NO: 624657 - RNA, 13 nt, Homo sapiens
uccauaauuauua

SEQ ID NO: 624658 - RNA, 23 nt, Homo sapiens
uccauagauuuauuuuacauuua

SEQ ID NO: 624659 - RNA, 21 nt, Homo sapiens
uccauagggccuccuuagauc

SEQ ID NO: 624660 - RNA, 14 nt, Homo sapiens
uccauauaacaauu

SEQ ID NO: 624661 - RNA, 13 nt, Homo sapiens
uccauauauauuc

SEQ ID NO: 624662 - RNA, 21 nt, Homo sapiens
uccaucaccugaaacacugga

SEQ ID NO: 624663 - RNA, 22 nt, Homo sapiens
uccaucagguuccaucccgaaa

SEQ ID NO: 624664 - RNA, 16 nt, Homo sapiens
uccauccacguggccu

SEQ ID NO: 624665 - RNA, 14 nt, Homo sapiens
uccauccaguuccu

SEQ ID NO: 624666 - RNA, 16 nt, Homo sapiens
uccauccuccaaaccu

SEQ ID NO: 624667 - RNA, 11 nt, Homo sapiens
uccauccugac

SEQ ID NO: 624668 - RNA, 17 nt, Homo sapiens
uccauccugcucaggaa

SEQ ID NO: 624669 - RNA, 22 nt, Homo sapiens
uccaucgcgccagcgaccucuc

SEQ ID NO: 624670 - RNA, 14 nt, Homo sapiens
uccaucgugugugc

SEQ ID NO: 624671 - RNA, 15 nt, Homo sapiens
uccaucucaaaaaag

SEQ ID NO: 624672 - RNA, 15 nt, Homo sapiens
uccaucuccacucca

SEQ ID NO: 624673 - RNA, 14 nt, Homo sapiens
uccaucugucuguc

SEQ ID NO: 624674 - RNA, 22 nt, Homo sapiens
uccaucuuccacgaaaugggcc

SEQ ID NO: 624675 - RNA, 20 nt, Homo sapiens
uccaucuuuacaaaacuaca

SEQ ID NO: 624676 - RNA, 13 nt, Homo sapiens
uccaucuuucuac

SEQ ID NO: 624677 - RNA, 17 nt, Homo sapiens
uccaucuuucuacagag

SEQ ID NO: 624678 - RNA, 17 nt, Homo sapiens
ucucuaacauuuccuua

SEQ ID NO: 624679 - RNA, 14 nt, Homo sapiens
ucucuaauauggca

SEQ ID NO: 624680 - RNA, 23 nt, Homo sapiens
ucucuacaaacucccacuuguca

SEQ ID NO: 624681 - RNA, 23 nt, Homo sapiens
ucucuacagugccaacuccucac

SEQ ID NO: 624682 - RNA, 18 nt, Homo sapiens
ucucuacugaaaguacaa

SEQ ID NO: 624683 - RNA, 22 nt, Homo sapiens
ucucuaggagggagccuuguga

SEQ ID NO: 624684 - RNA, 17 nt, Homo sapiens
ucucuagugucuuuugc

SEQ ID NO: 624685 - RNA, 22 nt, Homo sapiens
ucucuauauucggaauguaacu

SEQ ID NO: 624686 - RNA, 11 nt, Homo sapiens
ucucucaggag

SEQ ID NO: 624687 - RNA, 21 nt, Homo sapiens
ucucucauuuccaaaccauca

SEQ ID NO: 624688 - RNA, 12 nt, Homo sapiens
ucucuccacuga

SEQ ID NO: 624689 - RNA, 22 nt, Homo sapiens
ucucucccaccccggccuccac

SEQ ID NO: 624690 - RNA, 23 nt, Homo sapiens
ucucucccacuuccuccuaccug

SEQ ID NO: 624691 - RNA, 19 nt, Homo sapiens
ucucuccccagaugugacu

SEQ ID NO: 624692 - RNA, 23 nt, Homo sapiens
ucucuccgucuguuuuugcaacu

SEQ ID NO: 624693 - RNA, 15 nt, Homo sapiens
ucucuccucaguuuc

SEQ ID NO: 624694 - RNA, 19 nt, Homo sapiens
ucucuccuuauagacacuu

SEQ ID NO: 624695 - RNA, 16 nt, Homo sapiens
ucucucuaccagucua

SEQ ID NO: 624696 - RNA, 21 nt, Homo sapiens
ucucucugaagaugucaaauc

SEQ ID NO: 624697 - RNA, 16 nt, Homo sapiens
ucucucugaccuuuca

SEQ ID NO: 624698 - RNA, 12 nt, Homo sapiens
ucucucugggcu

SEQ ID NO: 624699 - RNA, 14 nt, Homo sapiens
ucucucuucccuca

SEQ ID NO: 624700 - RNA, 13 nt, Homo sapiens
ucucucuucucca

SEQ ID NO: 624701 - RNA, 14 nt, Homo sapiens
ucucucuucuccac

SEQ ID NO: 624702 - RNA, 17 nt, Homo sapiens
ucucugaaaguggugcu

SEQ ID NO: 624703 - RNA, 15 nt, Homo sapiens
ucucugaacugcaac

SEQ ID NO: 624704 - RNA, 20 nt, Homo sapiens
ucucugaacugcaacacugg

SEQ ID NO: 624705 - RNA, 15 nt, Homo sapiens
ucucugaauacacag

SEQ ID NO: 624706 - RNA, 15 nt, Homo sapiens
ucucugacauaugcu

SEQ ID NO: 624707 - RNA, 13 nt, Homo sapiens
ucucugaggacaa

SEQ ID NO: 624708 - RNA, 17 nt, Homo sapiens
ucucugaggacaagaga

SEQ ID NO: 624709 - RNA, 14 nt, Homo sapiens
ucucugauacacag

SEQ ID NO: 624710 - RNA, 17 nt, Homo sapiens
ucucugccacccacuca

SEQ ID NO: 624711 - RNA, 13 nt, Homo sapiens
ucucugccuguac

SEQ ID NO: 624712 - RNA, 23 nt, Homo sapiens
ucucugccuguacugaagcugaa

SEQ ID NO: 624713 - RNA, 12 nt, Homo sapiens
ucucugcucugc

SEQ ID NO: 624714 - RNA, 23 nt, Homo sapiens
ucucugcucuuguuucacuccac

SEQ ID NO: 624715 - RNA, 17 nt, Homo sapiens
ucucuggaaagggggga

SEQ ID NO: 624716 - RNA, 15 nt, Homo sapiens
ucucuggcuggucuu

SEQ ID NO: 624717 - RNA, 21 nt, Homo sapiens
ucucuggcugucugucugcag

SEQ ID NO: 624718 - RNA, 19 nt, Homo sapiens
ucucuggcuuuauuacucc

SEQ ID NO: 624719 - RNA, 16 nt, Homo sapiens
ucucugggacucuccu

SEQ ID NO: 624720 - RNA, 20 nt, Homo sapiens
ucucugggauuuaugcucau

SEQ ID NO: 624721 - RNA, 15 nt, Homo sapiens
ucucuggucuuccag

SEQ ID NO: 624722 - RNA, 14 nt, Homo sapiens
ucucugguggugcu

SEQ ID NO: 624723 - RNA, 22 nt, Homo sapiens
ucucuguacccuuccuggugcu

SEQ ID NO: 624724 - RNA, 22 nt, Homo sapiens
ucucugucccuugcuguaugcu

SEQ ID NO: 624725 - RNA, 10 nt, Homo sapiens
ucucuguccu

SEQ ID NO: 624726 - RNA, 13 nt, Homo sapiens
ucucugucucuca

SEQ ID NO: 624727 - RNA, 19 nt, Homo sapiens
ucucugugcccuccagcaa

SEQ ID NO: 624728 - RNA, 19 nt, Homo sapiens
ucucugugcuuugacucac

SEQ ID NO: 624729 - RNA, 13 nt, Homo sapiens
ucucugugugauc

SEQ ID NO: 624730 - RNA, 16 nt, Homo sapiens
ucucugugugcacaaa

SEQ ID NO: 624731 - RNA, 23 nt, Homo sapiens
ucucuuaaaaaaaaaauuacuuc

SEQ ID NO: 624732 - RNA, 14 nt, Homo sapiens
ucucuuaauuuuuc

SEQ ID NO: 624733 - RNA, 21 nt, Homo sapiens
ucucuuaccgcgagacugaga

SEQ ID NO: 624734 - RNA, 14 nt, Homo sapiens
ucucuuaccuguua

SEQ ID NO: 624735 - RNA, 12 nt, Homo sapiens
ucucuucacuac

SEQ ID NO: 624736 - RNA, 18 nt, Homo sapiens
ucucuucagaaaacccuu

SEQ ID NO: 624737 - RNA, 18 nt, Homo sapiens
ucucuucagacucaugga

SEQ ID NO: 624738 - RNA, 18 nt, Homo sapiens
ucucuuccacauguuacu

SEQ ID NO: 624739 - RNA, 15 nt, Homo sapiens
ucucuucuccgugca

SEQ ID NO: 624740 - RNA, 15 nt, Homo sapiens
ucucuugaaccuggg

SEQ ID NO: 624741 - RNA, 13 nt, Homo sapiens
ucucuugccauuu

SEQ ID NO: 624742 - RNA, 19 nt, Homo sapiens
ucucuugccauuuguagcu

SEQ ID NO: 624743 - RNA, 20 nt, Homo sapiens
ucucuugccccuuguccuga

SEQ ID NO: 624744 - RNA, 12 nt, Homo sapiens
ucucuugccuua

SEQ ID NO: 624745 - RNA, 14 nt, Homo sapiens
ucucuuuaaaucaa

SEQ ID NO: 624746 - RNA, 21 nt, Homo sapiens
ucucuuuaaauggcuuuaugc

SEQ ID NO: 624747 - RNA, 21 nt, Homo sapiens
ucucuuuaguauaauugaccu

SEQ ID NO: 624748 - RNA, 15 nt, Homo sapiens
ucucuuuauucuaaa

SEQ ID NO: 624749 - RNA, 22 nt, Homo sapiens
ucucuuucacggggccgugaca

SEQ ID NO: 624750 - RNA, 19 nt, Homo sapiens
ucucuuugauuauuugcau

SEQ ID NO: 624751 - RNA, 23 nt, Homo sapiens
ucucuuuggaaaauaguuugcaa

SEQ ID NO: 624752 - RNA, 19 nt, Homo sapiens
ucucuuuuaggaggcacaa

SEQ ID NO: 624753 - RNA, 23 nt, Homo sapiens
ucucuuuuuagagaaauuugcca

SEQ ID NO: 624754 - RNA, 22 nt, Homo sapiens
ucucuuuuuggaggugcuuaag

SEQ ID NO: 624755 - RNA, 20 nt, Homo sapiens
ucugaaaaaguauccugcuu

SEQ ID NO: 624756 - RNA, 12 nt, Homo sapiens
ucugaaacuggg

SEQ ID NO: 624757 - RNA, 14 nt, Homo sapiens
ucugaaagcuuuau

SEQ ID NO: 624758 - RNA, 15 nt, Homo sapiens
ucugaaaggagacau

SEQ ID NO: 624759 - RNA, 19 nt, Homo sapiens
ucugaacucaaacugagga

SEQ ID NO: 624760 - RNA, 23 nt, Homo sapiens
ucugaacugaccuugaaucuuuu

SEQ ID NO: 624761 - RNA, 13 nt, Homo sapiens
ucugaagagccug

SEQ ID NO: 624762 - RNA, 14 nt, Homo sapiens
ucugaagaguagaa

SEQ ID NO: 624763 - RNA, 22 nt, Homo sapiens
ucugaagcucgcauccagacag

SEQ ID NO: 624764 - RNA, 21 nt, Homo sapiens
ucugaaggagccccauuccug

SEQ ID NO: 624765 - RNA, 12 nt, Homo sapiens
ucugaaguacuu

SEQ ID NO: 624766 - RNA, 20 nt, Homo sapiens
ucugaagucacaucacagga

SEQ ID NO: 624767 - RNA, 16 nt, Homo sapiens
ucugaauaacuugaag

SEQ ID NO: 624768 - RNA, 18 nt, Homo sapiens
ucugaauacaaagugaug

SEQ ID NO: 624769 - RNA, 16 nt, Homo sapiens
ucugaauagugucacc

SEQ ID NO: 624770 - RNA, 20 nt, Homo sapiens
ucugaaucagccagucucag

SEQ ID NO: 624771 - RNA, 18 nt, Homo sapiens
ucugaaugggagccagaa

SEQ ID NO: 624772 - RNA, 21 nt, Homo sapiens
ucugaauugcacaugugagca

SEQ ID NO: 624773 - RNA, 19 nt, Homo sapiens
ucugaguaagcccucagga

SEQ ID NO: 624774 - RNA, 15 nt, Homo sapiens
ucugaguccugagac

SEQ ID NO: 624775 - RNA, 20 nt, Homo sapiens
ucugagucuauguucaaaga

SEQ ID NO: 624776 - RNA, 21 nt, Homo sapiens
ucugagucuauguucaaagac

SEQ ID NO: 624777 - RNA, 19 nt, Homo sapiens
ucugauacagacagcaguc

SEQ ID NO: 624778 - RNA, 13 nt, Homo sapiens
ucugauaccucaa

SEQ ID NO: 624779 - RNA, 13 nt, Homo sapiens
ucugauacgugua

SEQ ID NO: 624780 - RNA, 16 nt, Homo sapiens
ucugauauaacaaacu

SEQ ID NO: 624781 - RNA, 15 nt, Homo sapiens
ucugaucugugaauu

SEQ ID NO: 624782 - RNA, 13 nt, Homo sapiens
ucugauggccagc

SEQ ID NO: 624783 - RNA, 14 nt, Homo sapiens
ucugauguggaaug

SEQ ID NO: 624784 - RNA, 16 nt, Homo sapiens
ucugauguggcaaaag

SEQ ID NO: 624785 - RNA, 17 nt, Homo sapiens
ucugauguggcaaaagg

SEQ ID NO: 624786 - RNA, 14 nt, Homo sapiens
ucugauguuaacca

SEQ ID NO: 624787 - RNA, 19 nt, Homo sapiens
ucugauuaacuauuccuau

SEQ ID NO: 624788 - RNA, 18 nt, Homo sapiens
ucugauucacagucucau

SEQ ID NO: 624789 - RNA, 20 nt, Homo sapiens
ucugauuccuucaacuggcu

SEQ ID NO: 624790 - RNA, 14 nt, Homo sapiens
ucugauuggcucac

SEQ ID NO: 624791 - RNA, 21 nt, Homo sapiens
ucugauuguugucaggccaua

SEQ ID NO: 624792 - RNA, 16 nt, Homo sapiens
ucugauuuacauucaa

SEQ ID NO: 624793 - RNA, 13 nt, Homo sapiens
ucugauuucauaa

SEQ ID NO: 624794 - RNA, 16 nt, Homo sapiens
ucugauuuccuuccaa

SEQ ID NO: 624795 - RNA, 20 nt, Homo sapiens
ucugauuuuggccaucagga

SEQ ID NO: 624796 - RNA, 21 nt, Homo sapiens
ucugcaaaaugggaacaauga

SEQ ID NO: 624797 - RNA, 15 nt, Homo sapiens
ucugcaaacaugcca

SEQ ID NO: 624798 - RNA, 21 nt, Homo sapiens
ucugcaagcacaucugcauuu

SEQ ID NO: 624799 - RNA, 18 nt, Homo sapiens
ucugcaagggcccagagu

SEQ ID NO: 624800 - RNA, 19 nt, Homo sapiens
ucugcagagucacucacac

SEQ ID NO: 624801 - RNA, 15 nt, Homo sapiens
ucugcagaguucucc

SEQ ID NO: 624802 - RNA, 14 nt, Homo sapiens
ucugcagcaaugaa

SEQ ID NO: 624803 - RNA, 19 nt, Homo sapiens
ucugcagcacucuuaucua

SEQ ID NO: 624804 - RNA, 16 nt, Homo sapiens
ucugcagguacuuccu

SEQ ID NO: 624805 - RNA, 17 nt, Homo sapiens
ucugcaguccuccgggg

SEQ ID NO: 624806 - RNA, 17 nt, Homo sapiens
ucugcauccagagauuc

SEQ ID NO: 624807 - RNA, 21 nt, Homo sapiens
ucugcauccuuuucaaaaccu

SEQ ID NO: 624808 - RNA, 14 nt, Homo sapiens
ucugcaucuugggg

SEQ ID NO: 624809 - RNA, 13 nt, Homo sapiens
ucugcaugaagga

SEQ ID NO: 624810 - RNA, 21 nt, Homo sapiens
ucugcauuucgguggcuaguc

SEQ ID NO: 624811 - RNA, 13 nt, Homo sapiens
ucugcauuuugcu

SEQ ID NO: 624812 - RNA, 18 nt, Homo sapiens
ucugccaccacaccuggc

SEQ ID NO: 624813 - RNA, 16 nt, Homo sapiens
ucugccaggugcuugg

SEQ ID NO: 624814 - RNA, 16 nt, Homo sapiens
ucugccauaucaguga

SEQ ID NO: 624815 - RNA, 21 nt, Homo sapiens
ucugccauaucagugaaccuu

SEQ ID NO: 624816 - RNA, 14 nt, Homo sapiens
ucugcccagaauuc

SEQ ID NO: 624817 - RNA, 20 nt, Homo sapiens
ucugccccagcucuggcuuc

SEQ ID NO: 624818 - RNA, 16 nt, Homo sapiens
ucugccccagucguua

SEQ ID NO: 624819 - RNA, 18 nt, Homo sapiens
ucugccccguuucuugcc

SEQ ID NO: 624820 - RNA, 18 nt, Homo sapiens
ucugcccugccugaggag

SEQ ID NO: 624821 - RNA, 18 nt, Homo sapiens
ucugcccuuuccuaggcc

SEQ ID NO: 624822 - RNA, 21 nt, Homo sapiens
ucugccgcccuccacaccucu

SEQ ID NO: 624823 - RNA, 17 nt, Homo sapiens
ucugccuaacuuguaaa

SEQ ID NO: 624824 - RNA, 21 nt, Homo sapiens
ucugccuagaguguagccuaa

SEQ ID NO: 624825 - RNA, 18 nt, Homo sapiens
ucugccugggcucuggaa

SEQ ID NO: 624826 - RNA, 19 nt, Homo sapiens
ucugccuguuauaacucug

SEQ ID NO: 624827 - RNA, 22 nt, Homo sapiens
ucugccuguuauaacucugcac

SEQ ID NO: 624828 - RNA, 15 nt, Homo sapiens
ucugccuuacaaaau

SEQ ID NO: 624829 - RNA, 14 nt, Homo sapiens
ucugccuuagccua

SEQ ID NO: 624830 - RNA, 15 nt, Homo sapiens
ucugccuucucagga

SEQ ID NO: 624831 - RNA, 23 nt, Homo sapiens
ucugccuuuccccccucacacau

SEQ ID NO: 624832 - RNA, 21 nt, Homo sapiens
ucugccuuuggggacuuuucu

SEQ ID NO: 624833 - RNA, 20 nt, Homo sapiens
ucugcggcuuucacugcuga

SEQ ID NO: 624834 - RNA, 18 nt, Homo sapiens
ucugcuaccucacugggg

SEQ ID NO: 624835 - RNA, 16 nt, Homo sapiens
ucugcuauaugccuua

SEQ ID NO: 624836 - RNA, 19 nt, Homo sapiens
ucugcucaaaacuuucaaa

SEQ ID NO: 624837 - RNA, 12 nt, Homo sapiens
ucugcucaaggu

SEQ ID NO: 624838 - RNA, 18 nt, Homo sapiens
ucugcuccucuccaggca

SEQ ID NO: 624839 - RNA, 19 nt, Homo sapiens
ucugcugccucuguggaag

SEQ ID NO: 624840 - RNA, 16 nt, Homo sapiens
ucugcugggcucugcc

SEQ ID NO: 624841 - RNA, 15 nt, Homo sapiens
ucugcuggucuucaa

SEQ ID NO: 624842 - RNA, 20 nt, Homo sapiens
ucugcugucuaaccugugac

SEQ ID NO: 624843 - RNA, 17 nt, Homo sapiens
ucugcugucucaucaca

SEQ ID NO: 624844 - RNA, 14 nt, Homo sapiens
ucugcugucucucc

SEQ ID NO: 624845 - RNA, 12 nt, Homo sapiens
ucugcugugguc

SEQ ID NO: 624846 - RNA, 15 nt, Homo sapiens
ucugcuguggucuga

SEQ ID NO: 624847 - RNA, 23 nt, Homo sapiens
ucugcuucucaucuaaauauuuc

SEQ ID NO: 624848 - RNA, 16 nt, Homo sapiens
ucugcuucuccaagga

SEQ ID NO: 624849 - RNA, 15 nt, Homo sapiens
ucugcuucucggggu

SEQ ID NO: 624850 - RNA, 13 nt, Homo sapiens
ucugcuugaucaa

SEQ ID NO: 624851 - RNA, 19 nt, Homo sapiens
ucugcuuuucccauugcca

SEQ ID NO: 624852 - RNA, 20 nt, Homo sapiens
ucugcuuuucccauugccau

SEQ ID NO: 624853 - RNA, 23 nt, Homo sapiens
ucuggaaaaauaaguacauauag

SEQ ID NO: 624854 - RNA, 22 nt, Homo sapiens
ucuggaaaggaaacauugccau

SEQ ID NO: 624855 - RNA, 18 nt, Homo sapiens
ucuggaaagugaugucag

SEQ ID NO: 624856 - RNA, 22 nt, Homo sapiens
ucuggaaauaccgggaagccca

SEQ ID NO: 624857 - RNA, 18 nt, Homo sapiens
ucuggaagaucugcaaac

SEQ ID NO: 624858 - RNA, 20 nt, Homo sapiens
ucuggaagcauccugugcug

SEQ ID NO: 624859 - RNA, 16 nt, Homo sapiens
ucuggaagccuggacu

SEQ ID NO: 624860 - RNA, 20 nt, Homo sapiens
ucuggaagccuggacucuaa

SEQ ID NO: 624861 - RNA, 22 nt, Homo sapiens
ucuggaaggggcagcccugagu

SEQ ID NO: 624862 - RNA, 21 nt, Homo sapiens
ucuggaagucaucucauucca

SEQ ID NO: 624863 - RNA, 13 nt, Homo sapiens
ucuggaaguccaa

SEQ ID NO: 624864 - RNA, 14 nt, Homo sapiens
ucuggaaguggagu

SEQ ID NO: 624865 - RNA, 15 nt, Homo sapiens
ucuggacacacuguu

SEQ ID NO: 624866 - RNA, 13 nt, Homo sapiens
ucuggacacugag

SEQ ID NO: 624867 - RNA, 17 nt, Homo sapiens
ucugggagagccagcuu

SEQ ID NO: 624868 - RNA, 22 nt, Homo sapiens
ucugggagagccagcuuugcua

SEQ ID NO: 624869 - RNA, 22 nt, Homo sapiens
ucugggagcuacaaaauuucau

SEQ ID NO: 624870 - RNA, 23 nt, Homo sapiens
ucugggaguuauaggucauggga

SEQ ID NO: 624871 - RNA, 19 nt, Homo sapiens
ucugggauauggcugccca

SEQ ID NO: 624872 - RNA, 18 nt, Homo sapiens
ucugggauucccaccaag

SEQ ID NO: 624873 - RNA, 15 nt, Homo sapiens
ucugggcaccaccuc

SEQ ID NO: 624874 - RNA, 16 nt, Homo sapiens
ucugggcuacugccac

SEQ ID NO: 624875 - RNA, 20 nt, Homo sapiens
ucugggcuuggggcuuccua

SEQ ID NO: 624876 - RNA, 17 nt, Homo sapiens
ucuggggaaaaaaaaga

SEQ ID NO: 624877 - RNA, 11 nt, Homo sapiens
ucuggggaccc

SEQ ID NO: 624878 - RNA, 21 nt, Homo sapiens
ucuggggagaaaucccucaga

SEQ ID NO: 624879 - RNA, 23 nt, Homo sapiens
ucuggggaggcaggcauuccuga

SEQ ID NO: 624880 - RNA, 23 nt, Homo sapiens
ucuggggaugagguugcuuacua

SEQ ID NO: 624881 - RNA, 15 nt, Homo sapiens
ucuggggcagauccc

SEQ ID NO: 624882 - RNA, 22 nt, Homo sapiens
ucuggggcgcggccacagggga

SEQ ID NO: 624883 - RNA, 17 nt, Homo sapiens
ucuggggggauauuucc

SEQ ID NO: 624884 - RNA, 23 nt, Homo sapiens
ucugggguccauucucugaguca

SEQ ID NO: 624885 - RNA, 15 nt, Homo sapiens
ucuggguagcuguaa

SEQ ID NO: 624886 - RNA, 18 nt, Homo sapiens
ucuggguccauacaccag

SEQ ID NO: 624887 - RNA, 19 nt, Homo sapiens
ucugggugaaagggauacu

SEQ ID NO: 624888 - RNA, 15 nt, Homo sapiens
ucugggugaccucac

SEQ ID NO: 624889 - RNA, 23 nt, Homo sapiens
ucugggugugcuuuuugggacca

SEQ ID NO: 624890 - RNA, 16 nt, Homo sapiens
ucuggguuacucuucg

SEQ ID NO: 624891 - RNA, 16 nt, Homo sapiens
ucugguaauauugacu

SEQ ID NO: 624892 - RNA, 16 nt, Homo sapiens
ucugguaggaggcaaa

SEQ ID NO: 624893 - RNA, 14 nt, Homo sapiens
ucugguccuaccca

SEQ ID NO: 624894 - RNA, 21 nt, Homo sapiens
ucuggucucuaccacugcuga

SEQ ID NO: 624895 - RNA, 20 nt, Homo sapiens
ucugguggccacuucauucc

SEQ ID NO: 624896 - RNA, 18 nt, Homo sapiens
ucugguugagagccugcc

SEQ ID NO: 624897 - RNA, 22 nt, Homo sapiens
ucuguaaaagcagacccaccuc

SEQ ID NO: 624898 - RNA, 16 nt, Homo sapiens
ucuguaaugguacuga

SEQ ID NO: 624899 - RNA, 10 nt, Homo sapiens
ucuguacaau

SEQ ID NO: 624900 - RNA, 23 nt, Homo sapiens
ucuguacaaugaacccccaugau

SEQ ID NO: 624901 - RNA, 13 nt, Homo sapiens
ucuguacagauca

SEQ ID NO: 624902 - RNA, 16 nt, Homo sapiens
ucuguacuaacaaagc

SEQ ID NO: 624903 - RNA, 19 nt, Homo sapiens
ucuguagcuuguucccugu

SEQ ID NO: 624904 - RNA, 16 nt, Homo sapiens
ucuguaggaaccgugg

SEQ ID NO: 624905 - RNA, 17 nt, Homo sapiens
ucuguaggaauaagcau

SEQ ID NO: 624906 - RNA, 15 nt, Homo sapiens
ucuguagugagauag

SEQ ID NO: 624907 - RNA, 16 nt, Homo sapiens
ucuguauaugauucuc

SEQ ID NO: 624908 - RNA, 22 nt, Homo sapiens
ucuguaucuuugacaauucugg

SEQ ID NO: 624909 - RNA, 20 nt, Homo sapiens
ucuguauuacagcuuucaca

SEQ ID NO: 624910 - RNA, 15 nt, Homo sapiens
ucugucaaaugcagu

SEQ ID NO: 624911 - RNA, 16 nt, Homo sapiens
ucugucaagcuuacua

SEQ ID NO: 624912 - RNA, 17 nt, Homo sapiens
ucugucaaucacagucu

SEQ ID NO: 624913 - RNA, 23 nt, Homo sapiens
ucugucacaauaaauggccagug

SEQ ID NO: 624914 - RNA, 23 nt, Homo sapiens
ucugucaccaacugaaguggcua

SEQ ID NO: 624915 - RNA, 12 nt, Homo sapiens
ucugucaccagc

SEQ ID NO: 624916 - RNA, 12 nt, Homo sapiens
ucugucaggggu

SEQ ID NO: 624917 - RNA, 16 nt, Homo sapiens
ucugucauaugcagaa

SEQ ID NO: 624918 - RNA, 19 nt, Homo sapiens
ucuguccacgauucacuca

SEQ ID NO: 624919 - RNA, 18 nt, Homo sapiens
ucuguccagaggcuuuaa

SEQ ID NO: 624920 - RNA, 12 nt, Homo sapiens
ucuguccaggcc

SEQ ID NO: 624921 - RNA, 18 nt, Homo sapiens
ucuguccauuuauccaca

SEQ ID NO: 624922 - RNA, 23 nt, Homo sapiens
ucuguccucuugccuuuuacuua

SEQ ID NO: 624923 - RNA, 18 nt, Homo sapiens
ucuguccuuuaugauccc

SEQ ID NO: 624924 - RNA, 20 nt, Homo sapiens
ucugucuacuguggugaucu

SEQ ID NO: 624925 - RNA, 13 nt, Homo sapiens
ucugucugaauua

SEQ ID NO: 624926 - RNA, 17 nt, Homo sapiens
ucugucuggcauuacaa

SEQ ID NO: 624927 - RNA, 13 nt, Homo sapiens
ucugucuggcuga

SEQ ID NO: 624928 - RNA, 15 nt, Homo sapiens
ucugucugucucucc

SEQ ID NO: 624929 - RNA, 18 nt, Homo sapiens
ucugucuguuaccauaag

SEQ ID NO: 624930 - RNA, 20 nt, Homo sapiens
ucugucuuuaagaacuaauu

SEQ ID NO: 624931 - RNA, 15 nt, Homo sapiens
ucugugaaauaucau

SEQ ID NO: 624932 - RNA, 17 nt, Homo sapiens
ucugugauaacucugca

SEQ ID NO: 624933 - RNA, 14 nt, Homo sapiens
ucugugaugauccu

SEQ ID NO: 624934 - RNA, 15 nt, Homo sapiens
ucugugcacuagccu

SEQ ID NO: 624935 - RNA, 15 nt, Homo sapiens
ucugugcacugccca

SEQ ID NO: 624936 - RNA, 20 nt, Homo sapiens
ucugugccagacauugcucu

SEQ ID NO: 624937 - RNA, 14 nt, Homo sapiens
ucugugccagagau

SEQ ID NO: 624938 - RNA, 14 nt, Homo sapiens
ucugugccugaaua

SEQ ID NO: 624939 - RNA, 23 nt, Homo sapiens
ucugugcuuugacucaccuguua

SEQ ID NO: 624940 - RNA, 15 nt, Homo sapiens
ucuguggaaugauuc

SEQ ID NO: 624941 - RNA, 22 nt, Homo sapiens
ucuguggcaaaaguuuaaucag

SEQ ID NO: 624942 - RNA, 15 nt, Homo sapiens
ucuguggucacagag

SEQ ID NO: 624943 - RNA, 21 nt, Homo sapiens
ucuguguagcaagcuauucaa

SEQ ID NO: 624944 - RNA, 16 nt, Homo sapiens
ucuguguuuaauauua

SEQ ID NO: 624945 - RNA, 21 nt, Homo sapiens
ucuguguuuguacugugcagu

SEQ ID NO: 624946 - RNA, 23 nt, Homo sapiens
ucuguguuuguacugugcaguuu

SEQ ID NO: 624947 - RNA, 22 nt, Homo sapiens
ucuguguuuugaaugguguugu

SEQ ID NO: 624948 - RNA, 19 nt, Homo sapiens
ucuguuaacaucuagccua

SEQ ID NO: 624949 - RNA, 15 nt, Homo sapiens
ucuguuaccacauug

SEQ ID NO: 624950 - RNA, 14 nt, Homo sapiens
ucuguuauauagug

SEQ ID NO: 624951 - RNA, 22 nt, Homo sapiens
ucuguuauuaacaaacaucacu

SEQ ID NO: 624952 - RNA, 13 nt, Homo sapiens
ucuguucacuuuc

SEQ ID NO: 624953 - RNA, 13 nt, Homo sapiens
ucuguucacuuuu

SEQ ID NO: 624954 - RNA, 13 nt, Homo sapiens
ucuguucauuuca

SEQ ID NO: 624955 - RNA, 17 nt, Homo sapiens
ucuguucccuugccauc

SEQ ID NO: 624956 - RNA, 18 nt, Homo sapiens
ucuguucucccugggaag

SEQ ID NO: 624957 - RNA, 23 nt, Homo sapiens
ucuguucuguuggaugacuuuga

SEQ ID NO: 624958 - RNA, 18 nt, Homo sapiens
ucuguugaaaagcacaca

SEQ ID NO: 624959 - RNA, 17 nt, Homo sapiens
ucuguugaggcaucaaa

SEQ ID NO: 624960 - RNA, 19 nt, Homo sapiens
gaguguuucuuccacaaca

SEQ ID NO: 624961 - RNA, 20 nt, Homo sapiens
gaguguuuuuacauugaucu

SEQ ID NO: 624962 - RNA, 16 nt, Homo sapiens
gaguuaaaucuuccag

SEQ ID NO: 624963 - RNA, 21 nt, Homo sapiens
gaguuaauauauagaagggua

SEQ ID NO: 624964 - RNA, 17 nt, Homo sapiens
gaguuacuuccuaucaa

SEQ ID NO: 624965 - RNA, 23 nt, Homo sapiens
gaguuccacuucaacaaguaccu

SEQ ID NO: 624966 - RNA, 23 nt, Homo sapiens
gaguuccaugaagaccacaucca

SEQ ID NO: 624967 - RNA, 17 nt, Homo sapiens
gaguuccggccugggca

SEQ ID NO: 624968 - RNA, 16 nt, Homo sapiens
gaguuccucugcaguu

SEQ ID NO: 624969 - RNA, 15 nt, Homo sapiens
gaguuccuucucacu

SEQ ID NO: 624970 - RNA, 15 nt, Homo sapiens
gaguucuagaccucu

SEQ ID NO: 624971 - RNA, 15 nt, Homo sapiens
gaguucuauccccaa

SEQ ID NO: 624972 - RNA, 9 nt, Homo sapiens
gaguucucu

SEQ ID NO: 624973 - RNA, 18 nt, Homo sapiens
gaguugagauuuugcaau

SEQ ID NO: 624974 - RNA, 17 nt, Homo sapiens
gaguugagcagccuuuc

SEQ ID NO: 624975 - RNA, 19 nt, Homo sapiens
gaguugaucaaaaucaauu

SEQ ID NO: 624976 - RNA, 21 nt, Homo sapiens
gaguugauucagcucugcaag

SEQ ID NO: 624977 - RNA, 20 nt, Homo sapiens
gaguugcagccagggccagu

SEQ ID NO: 624978 - RNA, 15 nt, Homo sapiens
gaguugcuuugccag

SEQ ID NO: 624979 - RNA, 14 nt, Homo sapiens
gaguuggcaaaaug

SEQ ID NO: 624980 - RNA, 14 nt, Homo sapiens
gaguuuaaaagcau

SEQ ID NO: 624981 - RNA, 23 nt, Homo sapiens
gaguuucuggcucuugaggcauu

SEQ ID NO: 624982 - RNA, 14 nt, Homo sapiens
gaguuucuguucuc

SEQ ID NO: 624983 - RNA, 23 nt, Homo sapiens
gaguuugaaggaggugagggaug

SEQ ID NO: 624984 - RNA, 17 nt, Homo sapiens
gaguuugcaaugucaca

SEQ ID NO: 624985 - RNA, 18 nt, Homo sapiens
gaguuuguauuauuacaa

SEQ ID NO: 624986 - RNA, 20 nt, Homo sapiens
gaguuugugucuguugcuug

SEQ ID NO: 624987 - RNA, 18 nt, Homo sapiens
gaguuuuacccagacuca

SEQ ID NO: 624988 - RNA, 15 nt, Homo sapiens
gaguuuuacugccug

SEQ ID NO: 624989 - RNA, 13 nt, Homo sapiens
gaguuuucugacc

SEQ ID NO: 624990 - RNA, 16 nt, Homo sapiens
gaguuuugcaaagugc

SEQ ID NO: 624991 - RNA, 20 nt, Homo sapiens
gaguuuuuccucccagugag

SEQ ID NO: 624992 - RNA, 22 nt, Homo sapiens
gauaaaagagaagccaaacagc

SEQ ID NO: 624993 - RNA, 20 nt, Homo sapiens
gauaaaauacuaaacuacau

SEQ ID NO: 624994 - RNA, 23 nt, Homo sapiens
gauaaaauuacaggauaucacau

SEQ ID NO: 624995 - RNA, 13 nt, Homo sapiens
gauaaacaucaca

SEQ ID NO: 624996 - RNA, 10 nt, Homo sapiens
gauaaacuag

SEQ ID NO: 624997 - RNA, 13 nt, Homo sapiens
gauaaacucagaa

SEQ ID NO: 624998 - RNA, 17 nt, Homo sapiens
gauaaagagacagugau

SEQ ID NO: 624999 - RNA, 11 nt, Homo sapiens
gauaaagccac

SEQ ID NO: 625000 - RNA, 16 nt, Homo sapiens
gauaaaugcaauauuc

SEQ ID NO: 625001 - RNA, 18 nt, Homo sapiens
gauaaaugcacauuucag

SEQ ID NO: 625002 - RNA, 16 nt, Homo sapiens
gauaacuuagguggca

SEQ ID NO: 625003 - RNA, 20 nt, Homo sapiens
gauaaggggccuugcucuga

SEQ ID NO: 625004 - RNA, 12 nt, Homo sapiens
gauaagugacaa

SEQ ID NO: 625005 - RNA, 13 nt, Homo sapiens
gauaauaguuuac

SEQ ID NO: 625006 - RNA, 24 nt, Homo sapiens
gauaauauccagccucccacaaga

SEQ ID NO: 625007 - RNA, 15 nt, Homo sapiens
gcccuaaaaugacaa

SEQ ID NO: 625008 - RNA, 16 nt, Homo sapiens
gcccuagcccagacuc

SEQ ID NO: 625009 - RNA, 17 nt, Homo sapiens
gcccuagcccagacucu

SEQ ID NO: 625010 - RNA, 12 nt, Homo sapiens
gcccucacagag

SEQ ID NO: 625011 - RNA, 13 nt, Homo sapiens
gcccucaccagcc

SEQ ID NO: 625012 - RNA, 17 nt, Homo sapiens
gcccucaccccaauccc

SEQ ID NO: 625013 - RNA, 12 nt, Homo sapiens
gcccucaccugc

SEQ ID NO: 625014 - RNA, 15 nt, Homo sapiens
gcccucagacauuua

SEQ ID NO: 625015 - RNA, 11 nt, Homo sapiens
gcccucaggag

SEQ ID NO: 625016 - RNA, 20 nt, Homo sapiens
gcccucaggccauuccccaa

SEQ ID NO: 625017 - RNA, 15 nt, Homo sapiens
gcccuccacaccucu

SEQ ID NO: 625018 - RNA, 15 nt, Homo sapiens
gcccuccaugguccu

SEQ ID NO: 625019 - RNA, 13 nt, Homo sapiens
gcccuccaugugu

SEQ ID NO: 625020 - RNA, 19 nt, Homo sapiens
gcccuccccaucccaugua

SEQ ID NO: 625021 - RNA, 15 nt, Homo sapiens
gcccucccuuggaaa

SEQ ID NO: 625022 - RNA, 23 nt, Homo sapiens
gcccucccuuuaccuucauaugu

SEQ ID NO: 625023 - RNA, 23 nt, Homo sapiens
gcccuccuuaauagccauaugca

SEQ ID NO: 625024 - RNA, 16 nt, Homo sapiens
gcccuccuuucugugc

SEQ ID NO: 625025 - RNA, 20 nt, Homo sapiens
gcccuccuuugccuuccacc

SEQ ID NO: 625026 - RNA, 22 nt, Homo sapiens
gcccucucccuguguucugggc

SEQ ID NO: 625027 - RNA, 18 nt, Homo sapiens
gcccucugaacuugccuu

SEQ ID NO: 625028 - RNA, 20 nt, Homo sapiens
gcccucugaacuugccuuaa

SEQ ID NO: 625029 - RNA, 12 nt, Homo sapiens
gcccucugcucu

SEQ ID NO: 625030 - RNA, 15 nt, Homo sapiens
gcccucuguggucac

SEQ ID NO: 625031 - RNA, 13 nt, Homo sapiens
gcccugaacaaaa

SEQ ID NO: 625032 - RNA, 17 nt, Homo sapiens
gcccugaacccacugcu

SEQ ID NO: 625033 - RNA, 19 nt, Homo sapiens
gcccugaaggugccacucc

SEQ ID NO: 625034 - RNA, 17 nt, Homo sapiens
gcccugacccuguggaa

SEQ ID NO: 625035 - RNA, 19 nt, Homo sapiens
gcccugagcuuuguccuga

SEQ ID NO: 625036 - RNA, 21 nt, Homo sapiens
gcccugauguguccucaggga

SEQ ID NO: 625037 - RNA, 18 nt, Homo sapiens
gcccugcagcccaccaga

SEQ ID NO: 625038 - RNA, 16 nt, Homo sapiens
gcccugcccuuccuca

SEQ ID NO: 625039 - RNA, 17 nt, Homo sapiens
gcccugcccuuggcacc

SEQ ID NO: 625040 - RNA, 17 nt, Homo sapiens
gcccuggcuccuugcag

SEQ ID NO: 625041 - RNA, 16 nt, Homo sapiens
gcccuggcugacccca

SEQ ID NO: 625042 - RNA, 19 nt, Homo sapiens
gcccugggccccaccaccu

SEQ ID NO: 625043 - RNA, 13 nt, Homo sapiens
gcccugucaucca

SEQ ID NO: 625044 - RNA, 22 nt, Homo sapiens
gcccugucauccagcucacuca

SEQ ID NO: 625045 - RNA, 23 nt, Homo sapiens
gcccugucugaaggacacuuccu

SEQ ID NO: 625046 - RNA, 17 nt, Homo sapiens
gcccuguguacauauaa

SEQ ID NO: 625047 - RNA, 14 nt, Homo sapiens
gcccuuaaggacaa

SEQ ID NO: 625048 - RNA, 16 nt, Homo sapiens
gcccuucauugccaca

SEQ ID NO: 625049 - RNA, 17 nt, Homo sapiens
gcccuuccaaacucuuc

SEQ ID NO: 625050 - RNA, 10 nt, Homo sapiens
gcccuuccag

SEQ ID NO: 625051 - RNA, 21 nt, Homo sapiens
gcccuucccacuggaggucac

SEQ ID NO: 625052 - RNA, 15 nt, Homo sapiens
gcccuuccugaagaa

SEQ ID NO: 625053 - RNA, 22 nt, Homo sapiens
gcccuucugacccaaagcaaaa

SEQ ID NO: 625054 - RNA, 13 nt, Homo sapiens
gcccuugcccuug

SEQ ID NO: 625055 - RNA, 14 nt, Homo sapiens
gcccuuggcugcag

SEQ ID NO: 625056 - RNA, 23 nt, Homo sapiens
gcccuuggggagaggugauucuc

SEQ ID NO: 625057 - RNA, 23 nt, Homo sapiens
gcccuuuaacuuucagaggcaau

SEQ ID NO: 625058 - RNA, 21 nt, Homo sapiens
gcccuuucauaaaaaccaaac

SEQ ID NO: 625059 - RNA, 20 nt, Homo sapiens
gcccuuucauggucugcuga

SEQ ID NO: 625060 - RNA, 18 nt, Homo sapiens
gcccuuuccccccauguu

SEQ ID NO: 625061 - RNA, 15 nt, Homo sapiens
gcccuuuccuuccag

SEQ ID NO: 625062 - RNA, 16 nt, Homo sapiens
gcccuuuccuuccaga

SEQ ID NO: 625063 - RNA, 11 nt, Homo sapiens
gcccuuuucag

SEQ ID NO: 625064 - RNA, 14 nt, Homo sapiens
gcccuuuucaggaa

SEQ ID NO: 625065 - RNA, 14 nt, Homo sapiens
gcccuuuucagggc

SEQ ID NO: 625066 - RNA, 19 nt, Homo sapiens
gccgaagaauugucuugca

SEQ ID NO: 625067 - RNA, 19 nt, Homo sapiens
gccgacccugcggccucca

SEQ ID NO: 625068 - RNA, 21 nt, Homo sapiens
gccauucacuucauaauccag

SEQ ID NO: 625069 - RNA, 22 nt, Homo sapiens
gccauuccaagucaacacucuu

SEQ ID NO: 625070 - RNA, 23 nt, Homo sapiens
gccauucuuuuaaauauuuguga

SEQ ID NO: 625071 - RNA, 19 nt, Homo sapiens
gccauugaacaaaugugug

SEQ ID NO: 625072 - RNA, 20 nt, Homo sapiens
gccauugaacagcugugagc

SEQ ID NO: 625073 - RNA, 15 nt, Homo sapiens
gccauugcacuccag

SEQ ID NO: 625074 - RNA, 16 nt, Homo sapiens
gccauugcacuccagc

SEQ ID NO: 625075 - RNA, 15 nt, Homo sapiens
gccauugcauuccag

SEQ ID NO: 625076 - RNA, 20 nt, Homo sapiens
gccauuggguuuggggccau

SEQ ID NO: 625077 - RNA, 17 nt, Homo sapiens
gcccaaagaaagagcua

SEQ ID NO: 625078 - RNA, 16 nt, Homo sapiens
gcccaacuaacaguca

SEQ ID NO: 625079 - RNA, 16 nt, Homo sapiens
gcccaagagaugaaga

SEQ ID NO: 625080 - RNA, 18 nt, Homo sapiens
gcccaagaggacugagac

SEQ ID NO: 625081 - RNA, 15 nt, Homo sapiens
gcccaagaggucuga

SEQ ID NO: 625082 - RNA, 14 nt, Homo sapiens
gcccaagcacuuca

SEQ ID NO: 625083 - RNA, 22 nt, Homo sapiens
gcccaaggaugccuuagcaugu

SEQ ID NO: 625084 - RNA, 22 nt, Homo sapiens
gcccaauccauccugcucagga

SEQ ID NO: 625085 - RNA, 15 nt, Homo sapiens
gcccaauguaaugca

SEQ ID NO: 625086 - RNA, 14 nt, Homo sapiens
gcccacacccaggc

SEQ ID NO: 625087 - RNA, 13 nt, Homo sapiens
gcccacacuugag

SEQ ID NO: 625088 - RNA, 14 nt, Homo sapiens
gcccaccaccuguc

SEQ ID NO: 625089 - RNA, 12 nt, Homo sapiens
gcccacccaggg

SEQ ID NO: 625090 - RNA, 18 nt, Homo sapiens
gcccacccccaccaugca

SEQ ID NO: 625091 - RNA, 19 nt, Homo sapiens
gcccacccgaguaccucca

SEQ ID NO: 625092 - RNA, 20 nt, Homo sapiens
gcccaccuccuccaccacag

SEQ ID NO: 625093 - RNA, 21 nt, Homo sapiens
gcccacgccuguaaucccagc

SEQ ID NO: 625094 - RNA, 23 nt, Homo sapiens
gcccacugaggaaugaugaagcu

SEQ ID NO: 625095 - RNA, 21 nt, Homo sapiens
gcccacugcccaaugccugcu

SEQ ID NO: 625096 - RNA, 13 nt, Homo sapiens
gcccacuggagac

SEQ ID NO: 625097 - RNA, 13 nt, Homo sapiens
gcccagacaagau

SEQ ID NO: 625098 - RNA, 17 nt, Homo sapiens
gcccagacccccagugu

SEQ ID NO: 625099 - RNA, 21 nt, Homo sapiens
gcccagaguugcugugccgug

SEQ ID NO: 625100 - RNA, 21 nt, Homo sapiens
gcccagaucgcaccacugcac

SEQ ID NO: 625101 - RNA, 21 nt, Homo sapiens
gcccagauucuaccacacagc

SEQ ID NO: 625102 - RNA, 15 nt, Homo sapiens
gcccagcacugucug

SEQ ID NO: 625103 - RNA, 21 nt, Homo sapiens
gcccagccuccaagcuccauc

SEQ ID NO: 625104 - RNA, 16 nt, Homo sapiens
gcccagcgcucgccac

SEQ ID NO: 625105 - RNA, 13 nt, Homo sapiens
gcccagcggcccc

SEQ ID NO: 625106 - RNA, 16 nt, Homo sapiens
gcccagcuacauuccu

SEQ ID NO: 625107 - RNA, 16 nt, Homo sapiens
gcccagcuugggccca

SEQ ID NO: 625108 - RNA, 22 nt, Homo sapiens
gcccagcuuuuagaaaaugcag

SEQ ID NO: 625109 - RNA, 19 nt, Homo sapiens
gcccaggaccaucauccua

SEQ ID NO: 625110 - RNA, 13 nt, Homo sapiens
gcccaggcagcua

SEQ ID NO: 625111 - RNA, 14 nt, Homo sapiens
gcccaggccaugug

SEQ ID NO: 625112 - RNA, 20 nt, Homo sapiens
gcccaggcuggagugcagua

SEQ ID NO: 625113 - RNA, 19 nt, Homo sapiens
gcccaggcugggugcaguc

SEQ ID NO: 625114 - RNA, 17 nt, Homo sapiens
gcccaggcugugcagcg

SEQ ID NO: 625115 - RNA, 19 nt, Homo sapiens
gcccagggcugcgucugca

SEQ ID NO: 625116 - RNA, 23 nt, Homo sapiens
gcccagggcugcgucugcaaagg

SEQ ID NO: 625117 - RNA, 20 nt, Homo sapiens
gcccaggguccugugccugg

SEQ ID NO: 625118 - RNA, 15 nt, Homo sapiens
gcccagggugcagug

SEQ ID NO: 625119 - RNA, 23 nt, Homo sapiens
gcccaggguucccccagcccugu

SEQ ID NO: 625120 - RNA, 15 nt, Homo sapiens
gcccaggucucucaa

SEQ ID NO: 625121 - RNA, 21 nt, Homo sapiens
gcccaggucucucaacuucau

SEQ ID NO: 625122 - RNA, 17 nt, Homo sapiens
gcccagguuacaaagac

SEQ ID NO: 625123 - RNA, 22 nt, Homo sapiens
gcccagguucgagacccaaacc

SEQ ID NO: 625124 - RNA, 13 nt, Homo sapiens
gcccagguugcug

SEQ ID NO: 625125 - RNA, 18 nt, Homo sapiens
gcccauaucugugaaaug

SEQ ID NO: 625126 - RNA, 16 nt, Homo sapiens
gcccaucaagugcagu

SEQ ID NO: 625127 - RNA, 22 nt, Homo sapiens
gcccaucacaggguugggccca

SEQ ID NO: 625128 - RNA, 14 nt, Homo sapiens
ggacucucuaagga

SEQ ID NO: 625129 - RNA, 20 nt, Homo sapiens
ggacucugcuucaguccacu

SEQ ID NO: 625130 - RNA, 20 nt, Homo sapiens
ggacugagcccucucacucc

SEQ ID NO: 625131 - RNA, 10 nt, Homo sapiens
ggacugcugg

SEQ ID NO: 625132 - RNA, 15 nt, Homo sapiens
ggacugcuggcaugc

SEQ ID NO: 625133 - RNA, 16 nt, Homo sapiens
ggacugggcagauccu

SEQ ID NO: 625134 - RNA, 13 nt, Homo sapiens
ggacugugccuga

SEQ ID NO: 625135 - RNA, 16 nt, Homo sapiens
ggacuuacuauuuauu

SEQ ID NO: 625136 - RNA, 21 nt, Homo sapiens
ggacuucaagccccaccacau

SEQ ID NO: 625137 - RNA, 14 nt, Homo sapiens
ggacuucagugugu

SEQ ID NO: 625138 - RNA, 15 nt, Homo sapiens
ggacuuccauuugcu

SEQ ID NO: 625139 - RNA, 18 nt, Homo sapiens
ggacuuccuugcucuccc

SEQ ID NO: 625140 - RNA, 16 nt, Homo sapiens
ggacuucugcagcuau

SEQ ID NO: 625141 - RNA, 17 nt, Homo sapiens
ggacuucuggcagggaa

SEQ ID NO: 625142 - RNA, 22 nt, Homo sapiens
ggacuugccacccccaguuccu

SEQ ID NO: 625143 - RNA, 11 nt, Homo sapiens
ggacuugccuc

SEQ ID NO: 625144 - RNA, 22 nt, Homo sapiens
ggacuugguuuguuauaucagg

SEQ ID NO: 625145 - RNA, 13 nt, Homo sapiens
ggacuuguaggga

SEQ ID NO: 625146 - RNA, 16 nt, Homo sapiens
ggacuuuccugcaacu

SEQ ID NO: 625147 - RNA, 22 nt, Homo sapiens
ggacuuugcccaggaugacaua

SEQ ID NO: 625148 - RNA, 19 nt, Homo sapiens
ggacuuuugauaguucuau

SEQ ID NO: 625149 - RNA, 22 nt, Homo sapiens
ggagaaaauaacaagaguuuua

SEQ ID NO: 625150 - RNA, 16 nt, Homo sapiens
ggagaaaauucaauug

SEQ ID NO: 625151 - RNA, 13 nt, Homo sapiens
ggagaaacucauc

SEQ ID NO: 625152 - RNA, 21 nt, Homo sapiens
ggagaaaggaguuuugcaaag

SEQ ID NO: 625153 - RNA, 17 nt, Homo sapiens
ggagaaaugacuuugaa

SEQ ID NO: 625154 - RNA, 18 nt, Homo sapiens
ggagaagaagucagagag

SEQ ID NO: 625155 - RNA, 14 nt, Homo sapiens
ggagaagcacagcu

SEQ ID NO: 625156 - RNA, 18 nt, Homo sapiens
ggagaagcucacccaaua

SEQ ID NO: 625157 - RNA, 23 nt, Homo sapiens
ggagaagcugcaggcuuugccau

SEQ ID NO: 625158 - RNA, 19 nt, Homo sapiens
ggagaaggucuccaaggga

SEQ ID NO: 625159 - RNA, 13 nt, Homo sapiens
ggagaauggugcu

SEQ ID NO: 625160 - RNA, 16 nt, Homo sapiens
ggagacaaggugcuaa

SEQ ID NO: 625161 - RNA, 21 nt, Homo sapiens
ggagacagggcugcuccccaa

SEQ ID NO: 625162 - RNA, 18 nt, Homo sapiens
ggagacagugguagagag

SEQ ID NO: 625163 - RNA, 13 nt, Homo sapiens
ggagacccauugc

SEQ ID NO: 625164 - RNA, 16 nt, Homo sapiens
ggagaccucaugccau

SEQ ID NO: 625165 - RNA, 14 nt, Homo sapiens
ggagaccuggcacu

SEQ ID NO: 625166 - RNA, 17 nt, Homo sapiens
ggagaccuggcacugga

SEQ ID NO: 625167 - RNA, 13 nt, Homo sapiens
ggagacuaaagau

SEQ ID NO: 625168 - RNA, 13 nt, Homo sapiens
ggagacuccauga

SEQ ID NO: 625169 - RNA, 20 nt, Homo sapiens
ggagacuccuggucugugaa

SEQ ID NO: 625170 - RNA, 17 nt, Homo sapiens
ggagacugacacgaagc

SEQ ID NO: 625171 - RNA, 14 nt, Homo sapiens
ggagagaaaaaaga

SEQ ID NO: 625172 - RNA, 13 nt, Homo sapiens
ggagagaacugaa

SEQ ID NO: 625173 - RNA, 21 nt, Homo sapiens
ggagagaaguuaauccacauc

SEQ ID NO: 625174 - RNA, 13 nt, Homo sapiens
ggagagaaguuuc

SEQ ID NO: 625175 - RNA, 15 nt, Homo sapiens
ggagagcagcuggcu

SEQ ID NO: 625176 - RNA, 13 nt, Homo sapiens
ggagagcccuuca

SEQ ID NO: 625177 - RNA, 17 nt, Homo sapiens
ggagaggaaaauguuuc

SEQ ID NO: 625178 - RNA, 12 nt, Homo sapiens
ggccaaguguac

SEQ ID NO: 625179 - RNA, 23 nt, Homo sapiens
ggccaauaacuuuucaccaauga

SEQ ID NO: 625180 - RNA, 12 nt, Homo sapiens
ggccaaugucag

SEQ ID NO: 625181 - RNA, 11 nt, Homo sapiens
ggccacacugg

SEQ ID NO: 625182 - RNA, 13 nt, Homo sapiens
ggccacaggcagu

SEQ ID NO: 625183 - RNA, 21 nt, Homo sapiens
ggccacauagaugcugaugga

SEQ ID NO: 625184 - RNA, 13 nt, Homo sapiens
ggccaccacugca

SEQ ID NO: 625185 - RNA, 17 nt, Homo sapiens
ggccaccgccagagcuc

SEQ ID NO: 625186 - RNA, 23 nt, Homo sapiens
ggccaccugccugcgucuuccgc

SEQ ID NO: 625187 - RNA, 19 nt, Homo sapiens
ggccacgcaggggcccuga

SEQ ID NO: 625188 - RNA, 17 nt, Homo sapiens
ggccacgggggcagugu

SEQ ID NO: 625189 - RNA, 13 nt, Homo sapiens
ggccacgugugcu

SEQ ID NO: 625190 - RNA, 15 nt, Homo sapiens
ggccacucuaccuga

SEQ ID NO: 625191 - RNA, 14 nt, Homo sapiens
ggccagagggcagu

SEQ ID NO: 625192 - RNA, 19 nt, Homo sapiens
ggccagcaagcucuucacu

SEQ ID NO: 625193 - RNA, 16 nt, Homo sapiens
ggccagccagugccau

SEQ ID NO: 625194 - RNA, 17 nt, Homo sapiens
ggccagccccagcaccu

SEQ ID NO: 625195 - RNA, 23 nt, Homo sapiens
ggccagcccugcagcccaaaacc

SEQ ID NO: 625196 - RNA, 17 nt, Homo sapiens
ggccagcuucgugcugg

SEQ ID NO: 625197 - RNA, 17 nt, Homo sapiens
ggccaggagcccacagu

SEQ ID NO: 625198 - RNA, 15 nt, Homo sapiens
ggccaggauggucuc

SEQ ID NO: 625199 - RNA, 16 nt, Homo sapiens
ggccaggcugagugca

SEQ ID NO: 625200 - RNA, 22 nt, Homo sapiens
ggccaggcugccugugugcaug

SEQ ID NO: 625201 - RNA, 20 nt, Homo sapiens
ggccaggcuggagugcagug

SEQ ID NO: 625202 - RNA, 20 nt, Homo sapiens
ggccaggcuggucuugaacu

SEQ ID NO: 625203 - RNA, 18 nt, Homo sapiens
ggccagggcagcaaggga

SEQ ID NO: 625204 - RNA, 17 nt, Homo sapiens
ggccagggcuauagcuc

SEQ ID NO: 625205 - RNA, 19 nt, Homo sapiens
ggccagggcugcccugaga

SEQ ID NO: 625206 - RNA, 20 nt, Homo sapiens
ggccagggucugugugaaug

SEQ ID NO: 625207 - RNA, 17 nt, Homo sapiens
ggccaguaccuuuccau

SEQ ID NO: 625208 - RNA, 20 nt, Homo sapiens
ggccaguagcuaaagugcaa

SEQ ID NO: 625209 - RNA, 23 nt, Homo sapiens
ggccaguaucuauauauguguau

SEQ ID NO: 625210 - RNA, 22 nt, Homo sapiens
ggccagugggccugguagcaca

SEQ ID NO: 625211 - RNA, 22 nt, Homo sapiens
ggccaguggggccuguggaaug

SEQ ID NO: 625212 - RNA, 22 nt, Homo sapiens
ggccauggaagguucucugugc

SEQ ID NO: 625213 - RNA, 14 nt, Homo sapiens
ggccauggugcaca

SEQ ID NO: 625214 - RNA, 20 nt, Homo sapiens
ggccaugguggagggcacuu

SEQ ID NO: 625215 - RNA, 14 nt, Homo sapiens
ggccauguccaaag

SEQ ID NO: 625216 - RNA, 18 nt, Homo sapiens
ggccauugugaaccaaug

SEQ ID NO: 625217 - RNA, 18 nt, Homo sapiens
ggcccaaaggcccaggga

SEQ ID NO: 625218 - RNA, 19 nt, Homo sapiens
ggcccaagccccaucucau

SEQ ID NO: 625219 - RNA, 13 nt, Homo sapiens
ggcccagccuugu

SEQ ID NO: 625220 - RNA, 13 nt, Homo sapiens
ggcccagugccag

SEQ ID NO: 625221 - RNA, 15 nt, Homo sapiens
ggcccauggcauuuu

SEQ ID NO: 625222 - RNA, 13 nt, Homo sapiens
ggccccacuggac

SEQ ID NO: 625223 - RNA, 22 nt, Homo sapiens
ggccccagcgucugcaggguga

SEQ ID NO: 625224 - RNA, 17 nt, Homo sapiens
ggccccaguucaaucuc

SEQ ID NO: 625225 - RNA, 20 nt, Homo sapiens
cucagcauagggucacuuug

SEQ ID NO: 625226 - RNA, 19 nt, Homo sapiens
cucagccauaggugcaguu

SEQ ID NO: 625227 - RNA, 11 nt, Homo sapiens
cucagcccagc

SEQ ID NO: 625228 - RNA, 22 nt, Homo sapiens
cucagcccgccuucaggcugcc

SEQ ID NO: 625229 - RNA, 20 nt, Homo sapiens
ccagccuggccaacauggca

SEQ ID NO: 625230 - RNA, 22 nt, Homo sapiens
ccagccuggccaacauggugaa

SEQ ID NO: 625231 - RNA, 20 nt, Homo sapiens
ccagccuggccagacaagaa

SEQ ID NO: 625232 - RNA, 22 nt, Homo sapiens
ccagccuggccaguauggugaa

SEQ ID NO: 625233 - RNA, 15 nt, Homo sapiens
ccagccugggugaca

SEQ ID NO: 625234 - RNA, 15 nt, Homo sapiens
ccagccuguggugcu

SEQ ID NO: 625235 - RNA, 19 nt, Homo sapiens
ccagccuuauguguuacau

SEQ ID NO: 625236 - RNA, 15 nt, Homo sapiens
ccagccuuggcgaca

SEQ ID NO: 625237 - RNA, 14 nt, Homo sapiens
ccagcgcaccuguu

SEQ ID NO: 625238 - RNA, 18 nt, Homo sapiens
ccagcggaaacaggugug

SEQ ID NO: 625239 - RNA, 23 nt, Homo sapiens
ccagcggaaacagguguguguga

SEQ ID NO: 625240 - RNA, 16 nt, Homo sapiens
ccagcggccucagggu

SEQ ID NO: 625241 - RNA, 17 nt, Homo sapiens
ccagcggccucaggguc

SEQ ID NO: 625242 - RNA, 16 nt, Homo sapiens
ccagcgguccaaaguu

SEQ ID NO: 625243 - RNA, 15 nt, Homo sapiens
ccagcgucccagucu

SEQ ID NO: 625244 - RNA, 18 nt, Homo sapiens
ccagcgugugacuacucc

SEQ ID NO: 625245 - RNA, 15 nt, Homo sapiens
ccagcuaauaagaag

SEQ ID NO: 625246 - RNA, 13 nt, Homo sapiens
ccagcuacauucc

SEQ ID NO: 625247 - RNA, 21 nt, Homo sapiens
ccagcuacucaagaggcugag

SEQ ID NO: 625248 - RNA, 12 nt, Homo sapiens
ccagcuaugaau

SEQ ID NO: 625249 - RNA, 17 nt, Homo sapiens
ccagcuccgaccucucu

SEQ ID NO: 625250 - RNA, 16 nt, Homo sapiens
ccagcucuaguuuuca

SEQ ID NO: 625251 - RNA, 17 nt, Homo sapiens
cucccugggcagugcuc

SEQ ID NO: 625252 - RNA, 22 nt, Homo sapiens
cucccugguuugcagcuguuuu

SEQ ID NO: 625253 - RNA, 15 nt, Homo sapiens
cucccuguaacucca

SEQ ID NO: 625254 - RNA, 19 nt, Homo sapiens
cucccugucacacacugga

SEQ ID NO: 625255 - RNA, 20 nt, Homo sapiens
cucccugucauagagcugca

SEQ ID NO: 625256 - RNA, 14 nt, Homo sapiens
cucccuguccuccu

SEQ ID NO: 625257 - RNA, 15 nt, Homo sapiens
cuguaauauuuacaa

SEQ ID NO: 625258 - RNA, 20 nt, Homo sapiens
cuguaauauuuacaauguau

SEQ ID NO: 625259 - RNA, 16 nt, Homo sapiens
cuguaaucauguacuu

SEQ ID NO: 625260 - RNA, 17 nt, Homo sapiens
cuguaaucccagcacuu

SEQ ID NO: 625261 - RNA, 20 nt, Homo sapiens
cuguaaucccagcacuuuag

SEQ ID NO: 625262 - RNA, 20 nt, Homo sapiens
cuguaaucccagcacuuugg

SEQ ID NO: 625263 - RNA, 23 nt, Homo sapiens
cuguaaucccagcacuuugggag

SEQ ID NO: 625264 - RNA, 19 nt, Homo sapiens
cuguaaucccagcuacuca

SEQ ID NO: 625265 - RNA, 22 nt, Homo sapiens
cuguaaucccagcuacuccggg

SEQ ID NO: 625266 - RNA, 23 nt, Homo sapiens
cuguaaucccagcuacuccggga

SEQ ID NO: 625267 - RNA, 18 nt, Homo sapiens
cuguaaucccagcuacuu

SEQ ID NO: 625268 - RNA, 18 nt, Homo sapiens
cuguaauccuagcacuuu

SEQ ID NO: 625269 - RNA, 18 nt, Homo sapiens
cuguaaugaaacaccuuc

SEQ ID NO: 625270 - RNA, 15 nt, Homo sapiens
cuguaaugacaaaua

SEQ ID NO: 625271 - RNA, 20 nt, Homo sapiens
cuguuaaauuuguaaacaau

SEQ ID NO: 625272 - RNA, 15 nt, Homo sapiens
cuguuaacuuuugua

SEQ ID NO: 625273 - RNA, 21 nt, Homo sapiens
cuguuaauacacaguacuuua

SEQ ID NO: 625274 - RNA, 13 nt, Homo sapiens
cuguuaauaguca

SEQ ID NO: 625275 - RNA, 22 nt, Homo sapiens
cuguuacagcuuucugugcaga

SEQ ID NO: 625276 - RNA, 19 nt, Homo sapiens
cuguuaccauaagucugau

SEQ ID NO: 625277 - RNA, 15 nt, Homo sapiens
cuguuaccauucuga

SEQ ID NO: 625278 - RNA, 14 nt, Homo sapiens
cuguuacccagaga

SEQ ID NO: 625279 - RNA, 18 nt, Homo sapiens
cuguuacugauguucaau

SEQ ID NO: 625280 - RNA, 20 nt, Homo sapiens
cuguuagcacuguugaugua

SEQ ID NO: 625281 - RNA, 18 nt, Homo sapiens
cuguuaucgaacacauuc

SEQ ID NO: 625282 - RNA, 19 nt, Homo sapiens
cuguuauuauauuugacau

SEQ ID NO: 625283 - RNA, 14 nt, Homo sapiens
cuguucacuuugua

SEQ ID NO: 625284 - RNA, 17 nt, Homo sapiens
cuguucauguuacucau

SEQ ID NO: 625285 - RNA, 14 nt, Homo sapiens
cuguucauuucaca

SEQ ID NO: 625286 - RNA, 19 nt, Homo sapiens
cuguucauuucacacagug

SEQ ID NO: 625287 - RNA, 14 nt, Homo sapiens
cuguuccuucacau

SEQ ID NO: 625288 - RNA, 18 nt, Homo sapiens
gaaaccuacacacuguca

SEQ ID NO: 625289 - RNA, 17 nt, Homo sapiens
gaaaccuaucucaggga

SEQ ID NO: 625290 - RNA, 20 nt, Homo sapiens
gaaaccuguuaaaacaacca

SEQ ID NO: 625291 - RNA, 16 nt, Homo sapiens
gaaaccuuaguuucaa

SEQ ID NO: 625292 - RNA, 21 nt, Homo sapiens
gaaaccuuauuuuuucccaaa

SEQ ID NO: 625293 - RNA, 20 nt, Homo sapiens
gaaacggaggcagauggaga

SEQ ID NO: 625294 - RNA, 17 nt, Homo sapiens
gaaacgguauccucccu

SEQ ID NO: 625295 - RNA, 21 nt, Homo sapiens
gaaacggucacgagacccaga

SEQ ID NO: 625296 - RNA, 20 nt, Homo sapiens
gaaacguuugccccauggga

SEQ ID NO: 625297 - RNA, 16 nt, Homo sapiens
gaaacuauaaguaauu

SEQ ID NO: 625298 - RNA, 11 nt, Homo sapiens
gaaacuauuaa

SEQ ID NO: 625299 - RNA, 16 nt, Homo sapiens
gaaacucagugcaaaa

SEQ ID NO: 625300 - RNA, 13 nt, Homo sapiens
gaaacuccaucuc

SEQ ID NO: 625301 - RNA, 14 nt, Homo sapiens
gaaacuccgucuca

SEQ ID NO: 625302 - RNA, 21 nt, Homo sapiens
gaaacuccuuuugcugucuuu

SEQ ID NO: 625303 - RNA, 15 nt, Homo sapiens
gaaacucucuguuca

SEQ ID NO: 625304 - RNA, 22 nt, Homo sapiens
gaaacucuggcucagccugucu

SEQ ID NO: 625305 - RNA, 17 nt, Homo sapiens
gaaacugcgaggccagu

SEQ ID NO: 625306 - RNA, 17 nt, Homo sapiens
gaaacugcuaaauucua

SEQ ID NO: 625307 - RNA, 14 nt, Homo sapiens
gaaacuggcacuga

SEQ ID NO: 625308 - RNA, 22 nt, Homo sapiens
gaaacuguacauacugcagugu

SEQ ID NO: 625309 - RNA, 14 nt, Homo sapiens
gaaacuuagaucau

SEQ ID NO: 625310 - RNA, 20 nt, Homo sapiens
gaaacuugcauacagagaca

SEQ ID NO: 625311 - RNA, 14 nt, Homo sapiens
gaaagaaacaugug

SEQ ID NO: 625312 - RNA, 14 nt, Homo sapiens
gaaagaaaugccca

SEQ ID NO: 625313 - RNA, 19 nt, Homo sapiens
gaaagaacuuaagucucga

SEQ ID NO: 625314 - RNA, 17 nt, Homo sapiens
gaaagaagcaguucuca

SEQ ID NO: 625315 - RNA, 19 nt, Homo sapiens
gaaagaaguuauuuuccag

SEQ ID NO: 625316 - RNA, 20 nt, Homo sapiens
gaaagaauagaacacaguuu

SEQ ID NO: 625317 - RNA, 18 nt, Homo sapiens
gaaagaaucagucuugca

SEQ ID NO: 625318 - RNA, 14 nt, Homo sapiens
gaaagaaugcauuc

SEQ ID NO: 625319 - RNA, 19 nt, Homo sapiens
gaaagaaugcauuccagaa

SEQ ID NO: 625320 - RNA, 23 nt, Homo sapiens
gaaagaauuauuuuuguguuucu

SEQ ID NO: 625321 - RNA, 20 nt, Homo sapiens
gaaagaccaggccaauguca

SEQ ID NO: 625322 - RNA, 16 nt, Homo sapiens
gaaagaccuaugagca

SEQ ID NO: 625323 - RNA, 15 nt, Homo sapiens
gaaagacugaagaaa

SEQ ID NO: 625324 - RNA, 15 nt, Homo sapiens
gaaagagaguaccau

SEQ ID NO: 625325 - RNA, 14 nt, Homo sapiens
gaaagagcaaguga

SEQ ID NO: 625326 - RNA, 18 nt, Homo sapiens
gaaagagcaagugacuuu

SEQ ID NO: 625327 - RNA, 14 nt, Homo sapiens
gaaagaucaaagac

SEQ ID NO: 625328 - RNA, 14 nt, Homo sapiens
gaaagaugagaaau

SEQ ID NO: 625329 - RNA, 14 nt, Homo sapiens
gaaagaugcagugg

SEQ ID NO: 625330 - RNA, 20 nt, Homo sapiens
gaaagauggggcauauucau

SEQ ID NO: 625331 - RNA, 16 nt, Homo sapiens
gaaagaugucuaugua

SEQ ID NO: 625332 - RNA, 11 nt, Homo sapiens
gaaagcacuac

SEQ ID NO: 625333 - RNA, 11 nt, Homo sapiens
gaaagcacuau

SEQ ID NO: 625334 - RNA, 23 nt, Homo sapiens
gaaagcaggauguaguucugcca

SEQ ID NO: 625335 - RNA, 17 nt, Homo sapiens
gaaagcaguaaccaaga

SEQ ID NO: 625336 - RNA, 16 nt, Homo sapiens
gaaagcauaucccacc

SEQ ID NO: 625337 - RNA, 15 nt, Homo sapiens
gaaagcaucacugcc

SEQ ID NO: 625338 - RNA, 17 nt, Homo sapiens
gaaagcaucacugccuu

SEQ ID NO: 625339 - RNA, 22 nt, Homo sapiens
gaaagccauauuccagcaguga

SEQ ID NO: 625340 - RNA, 15 nt, Homo sapiens
gaaagcccucuagga

SEQ ID NO: 625341 - RNA, 15 nt, Homo sapiens
gaaagccucagccau

SEQ ID NO: 625342 - RNA, 19 nt, Homo sapiens
gaaagccucugcugccaug

SEQ ID NO: 625343 - RNA, 15 nt, Homo sapiens
gaaagccucuggaaa

SEQ ID NO: 625344 - RNA, 20 nt, Homo sapiens
gaaagccugggugacauuug

SEQ ID NO: 625345 - RNA, 14 nt, Homo sapiens
gaaagccuuaggga

SEQ ID NO: 625346 - RNA, 21 nt, Homo sapiens
gaaagcguuucuguguagaaa

SEQ ID NO: 625347 - RNA, 18 nt, Homo sapiens
gaaagcuauauaagacaa

SEQ ID NO: 625348 - RNA, 19 nt, Homo sapiens
gaaagcucacuguagcuuu

SEQ ID NO: 625349 - RNA, 22 nt, Homo sapiens
gaaagcuuacuguuuuugauaa

SEQ ID NO: 625350 - RNA, 21 nt, Homo sapiens
gaaaggaaauaguaccuucaa

SEQ ID NO: 625351 - RNA, 13 nt, Homo sapiens
gaaaggaacugca

SEQ ID NO: 625352 - RNA, 20 nt, Homo sapiens
gaaaggaagcuccacuguca

SEQ ID NO: 625353 - RNA, 13 nt, Homo sapiens
gaaaggacccugu

SEQ ID NO: 625354 - RNA, 19 nt, Homo sapiens
gaaaggauuuuaccaaagc

SEQ ID NO: 625355 - RNA, 13 nt, Homo sapiens
gaaaggccuucag

SEQ ID NO: 625356 - RNA, 16 nt, Homo sapiens
gaaaggcucauuuaaa

SEQ ID NO: 625357 - RNA, 17 nt, Homo sapiens
gaaagggaagcacauga

SEQ ID NO: 625358 - RNA, 16 nt, Homo sapiens
gaaagggauaguccaa

SEQ ID NO: 625359 - RNA, 18 nt, Homo sapiens
gaaagggauaguccaaag

SEQ ID NO: 625360 - RNA, 15 nt, Homo sapiens
gaaaggggaaugugg

SEQ ID NO: 625361 - RNA, 13 nt, Homo sapiens
gaaaggggugcuu

SEQ ID NO: 625362 - RNA, 17 nt, Homo sapiens
gaaagggguugggguga

SEQ ID NO: 625363 - RNA, 19 nt, Homo sapiens
gaaagguacuauauuugcu

SEQ ID NO: 625364 - RNA, 21 nt, Homo sapiens
gaaaggucugaggaugaugua

SEQ ID NO: 625365 - RNA, 13 nt, Homo sapiens
gaaaggugcccuu

SEQ ID NO: 625366 - RNA, 16 nt, Homo sapiens
gaaagguuuuccuuau

SEQ ID NO: 625367 - RNA, 17 nt, Homo sapiens
gaaaguaagugguagcu

SEQ ID NO: 625368 - RNA, 17 nt, Homo sapiens
gaaaguauaaagucacu

SEQ ID NO: 625369 - RNA, 15 nt, Homo sapiens
gaaaguauaacugag

SEQ ID NO: 625370 - RNA, 23 nt, Homo sapiens
gaaaguccaauuccaaagccaga

SEQ ID NO: 625371 - RNA, 17 nt, Homo sapiens
gaaaguccagcacugga

SEQ ID NO: 625372 - RNA, 11 nt, Homo sapiens
gaaagugaaac

SEQ ID NO: 625373 - RNA, 15 nt, Homo sapiens
gaaagugaccauguu

SEQ ID NO: 625374 - RNA, 18 nt, Homo sapiens
gaaaguuaacucuucaaa

SEQ ID NO: 625375 - RNA, 22 nt, Homo sapiens
gaaaguucccccaucaguuccc

SEQ ID NO: 625376 - RNA, 13 nt, Homo sapiens
gaaaguucugcug

SEQ ID NO: 625377 - RNA, 17 nt, Homo sapiens
gaaaguuggacuugaga

SEQ ID NO: 625378 - RNA, 22 nt, Homo sapiens
gaaaguuuaacaaaugacugua

SEQ ID NO: 625379 - RNA, 15 nt, Homo sapiens
gaaaguuugcacugu

SEQ ID NO: 625380 - RNA, 14 nt, Homo sapiens
gaaauaaaaugaua

SEQ ID NO: 625381 - RNA, 13 nt, Homo sapiens
gaaauaaacugag

SEQ ID NO: 625382 - RNA, 15 nt, Homo sapiens
gaaauaaaucagaga

SEQ ID NO: 625383 - RNA, 15 nt, Homo sapiens
gaaauaacauugcac

SEQ ID NO: 625384 - RNA, 23 nt, Homo sapiens
gaaauaagaauucagacaucuga

SEQ ID NO: 625385 - RNA, 15 nt, Homo sapiens
gaaauaagcugugau

SEQ ID NO: 625386 - RNA, 18 nt, Homo sapiens
gaaauaauaaaaugcaaa

SEQ ID NO: 625387 - RNA, 14 nt, Homo sapiens
gaaauaauagcaau

SEQ ID NO: 625388 - RNA, 13 nt, Homo sapiens
gaaauaauguucu

SEQ ID NO: 625389 - RNA, 23 nt, Homo sapiens
gaaauaauuguugauuaauuuga

SEQ ID NO: 625390 - RNA, 21 nt, Homo sapiens
gaaauaauuguuguucuguua

SEQ ID NO: 625391 - RNA, 22 nt, Homo sapiens
gaaauaccacagcucagccacu

SEQ ID NO: 625392 - RNA, 20 nt, Homo sapiens
gaaauagaagcaaaugacaa

SEQ ID NO: 625393 - RNA, 16 nt, Homo sapiens
gaaauagacaguauau

SEQ ID NO: 625394 - RNA, 18 nt, Homo sapiens
gaaauagagccaacugau

SEQ ID NO: 625395 - RNA, 21 nt, Homo sapiens
gaaauagguuaaacugaagca

SEQ ID NO: 625396 - RNA, 16 nt, Homo sapiens
gaaauaguaccuucaa

SEQ ID NO: 625397 - RNA, 21 nt, Homo sapiens
gaaauauaacaagugggugaa

SEQ ID NO: 625398 - RNA, 21 nt, Homo sapiens
gaaauauaggauagacacugg

SEQ ID NO: 625399 - RNA, 22 nt, Homo sapiens
gaaauauaggauagacacugga

SEQ ID NO: 625400 - RNA, 16 nt, Homo sapiens
gaaauaugaaugcccc

SEQ ID NO: 625401 - RNA, 22 nt, Homo sapiens
gaaauauggaacuuacauuguu

SEQ ID NO: 625402 - RNA, 14 nt, Homo sapiens
gaaauauuauagag

SEQ ID NO: 625403 - RNA, 16 nt, Homo sapiens
gaaauauuauuggugu

SEQ ID NO: 625404 - RNA, 15 nt, Homo sapiens
gaaauauugugcuua

SEQ ID NO: 625405 - RNA, 17 nt, Homo sapiens
gaaauauuuaaguauau

SEQ ID NO: 625406 - RNA, 20 nt, Homo sapiens
gaaauauuuagaagugcuaa

SEQ ID NO: 625407 - RNA, 16 nt, Homo sapiens
gaaauauuuucuagga

SEQ ID NO: 625408 - RNA, 16 nt, Homo sapiens
gaaaucaaaaagggaa

SEQ ID NO: 625409 - RNA, 15 nt, Homo sapiens
gaaaucaaaauccaa

SEQ ID NO: 625410 - RNA, 14 nt, Homo sapiens
gaaaucagugcgau

SEQ ID NO: 625411 - RNA, 15 nt, Homo sapiens
gaaaucauagaaggu

SEQ ID NO: 625412 - RNA, 15 nt, Homo sapiens
gaaaucauuguagaa

SEQ ID NO: 625413 - RNA, 16 nt, Homo sapiens
gaaauccaguuuccca

SEQ ID NO: 625414 - RNA, 17 nt, Homo sapiens
gaaauccauaucuuaaa

SEQ ID NO: 625415 - RNA, 22 nt, Homo sapiens
gaaauccuuccuaaacccaaug

SEQ ID NO: 625416 - RNA, 22 nt, Homo sapiens
gaaaucuaccaagcuugcaaga

SEQ ID NO: 625417 - RNA, 17 nt, Homo sapiens
gaaaucuagaagacugu

SEQ ID NO: 625418 - RNA, 18 nt, Homo sapiens
gaaaucuagaagacuguc

SEQ ID NO: 625419 - RNA, 15 nt, Homo sapiens
gaaaucucacugggg

SEQ ID NO: 625420 - RNA, 16 nt, Homo sapiens
gaaaucuuaaaccuua

SEQ ID NO: 625421 - RNA, 14 nt, Homo sapiens
gaaaucuugcuuca

SEQ ID NO: 625422 - RNA, 12 nt, Homo sapiens
gaaaucuugucu

SEQ ID NO: 625423 - RNA, 21 nt, Homo sapiens
gaaaucuuuauuaauguuuag

SEQ ID NO: 625424 - RNA, 16 nt, Homo sapiens
gaaaucuuucucccuc

SEQ ID NO: 625425 - RNA, 17 nt, Homo sapiens
gaaaucuuucucccuca

SEQ ID NO: 625426 - RNA, 24 nt, Homo sapiens
gaaaugaccaggccaagacucaag

SEQ ID NO: 625427 - RNA, 18 nt, Homo sapiens
gaaaugagaaacuuugau

SEQ ID NO: 625428 - RNA, 16 nt, Homo sapiens
gaaaugagaacauucc

SEQ ID NO: 625429 - RNA, 19 nt, Homo sapiens
gaaaugagauacauucccg

SEQ ID NO: 625430 - RNA, 16 nt, Homo sapiens
gaaaugaggagacaca

SEQ ID NO: 625431 - RNA, 20 nt, Homo sapiens
gaaaugauaaagacuuuuau

SEQ ID NO: 625432 - RNA, 17 nt, Homo sapiens
gaaaugauaugaccaaa

SEQ ID NO: 625433 - RNA, 21 nt, Homo sapiens
gaaaugcccaucuaugucccu

SEQ ID NO: 625434 - RNA, 21 nt, Homo sapiens
gaaaugcggaccaaacuacuu

SEQ ID NO: 625435 - RNA, 14 nt, Homo sapiens
gaaaugcugcagga

SEQ ID NO: 625436 - RNA, 16 nt, Homo sapiens
gaaaugcugcaggauu

SEQ ID NO: 625437 - RNA, 23 nt, Homo sapiens
gaaaugcugguuuuucaguuuuc

SEQ ID NO: 625438 - RNA, 17 nt, Homo sapiens
gaaauggcgaaugucau

SEQ ID NO: 625439 - RNA, 11 nt, Homo sapiens
cuuaagacaga

SEQ ID NO: 625440 - RNA, 16 nt, Homo sapiens
cuuaagagacacucca

SEQ ID NO: 625441 - RNA, 12 nt, Homo sapiens
cuuaagauuugg

SEQ ID NO: 625442 - RNA, 13 nt, Homo sapiens
cuuaagcacuuug

SEQ ID NO: 625443 - RNA, 16 nt, Homo sapiens
cuuaagccauaaaaua

SEQ ID NO: 625444 - RNA, 19 nt, Homo sapiens
cuuaagcccagugcacuga

SEQ ID NO: 625445 - RNA, 21 nt, Homo sapiens
cuuaagccuuuugcucacaaa

SEQ ID NO: 625446 - RNA, 14 nt, Homo sapiens
cuuaaggucuccaa

SEQ ID NO: 625447 - RNA, 20 nt, Homo sapiens
cuuaaguucuuugauuugua

SEQ ID NO: 625448 - RNA, 16 nt, Homo sapiens
cuuaauaaacauguca

SEQ ID NO: 625449 - RNA, 19 nt, Homo sapiens
cuuaauaacuguguacugu

SEQ ID NO: 625450 - RNA, 18 nt, Homo sapiens
cuuaauagccauaugcaa

SEQ ID NO: 625451 - RNA, 14 nt, Homo sapiens
cuuaauauguucuu

SEQ ID NO: 625452 - RNA, 15 nt, Homo sapiens
cuuaaucacuacugu

SEQ ID NO: 625453 - RNA, 23 nt, Homo sapiens
cuuaaucacuacuguauguaaua

SEQ ID NO: 625454 - RNA, 19 nt, Homo sapiens
cuuaauccaauauuuugcc

SEQ ID NO: 625455 - RNA, 17 nt, Homo sapiens
cuuaauccaccaaguuu

SEQ ID NO: 625456 - RNA, 17 nt, Homo sapiens
cuuaauccauuucuuga

SEQ ID NO: 625457 - RNA, 15 nt, Homo sapiens
gaacucuuucauccc

SEQ ID NO: 625458 - RNA, 15 nt, Homo sapiens
gaacugaacauucca

SEQ ID NO: 625459 - RNA, 13 nt, Homo sapiens
gaacugaagccac

SEQ ID NO: 625460 - RNA, 18 nt, Homo sapiens
gaacugaaggcauaugca

SEQ ID NO: 625461 - RNA, 17 nt, Homo sapiens
gaacugacaaugaaggg

SEQ ID NO: 625462 - RNA, 13 nt, Homo sapiens
gaacugacgcugg

SEQ ID NO: 625463 - RNA, 15 nt, Homo sapiens
gaacugcaacacugg

SEQ ID NO: 625464 - RNA, 16 nt, Homo sapiens
gaacugcaacacugga

SEQ ID NO: 625465 - RNA, 13 nt, Homo sapiens
gaacugcacuuuu

SEQ ID NO: 625466 - RNA, 17 nt, Homo sapiens
gaacugcauauguuucg

SEQ ID NO: 625467 - RNA, 20 nt, Homo sapiens
gaacuguauucuaguggcug

SEQ ID NO: 625468 - RNA, 16 nt, Homo sapiens
gaacugugcauagugc

SEQ ID NO: 625469 - RNA, 21 nt, Homo sapiens
gaacuguggugccacaugacc

SEQ ID NO: 625470 - RNA, 21 nt, Homo sapiens
gaacuguuuggucgagucuuu

SEQ ID NO: 625471 - RNA, 22 nt, Homo sapiens
gaacuguuuuguaagugcugcu

SEQ ID NO: 625472 - RNA, 23 nt, Homo sapiens
gaacuguuuuguaagugcugcua

SEQ ID NO: 625473 - RNA, 17 nt, Homo sapiens
gaacuuaauaacugugu

SEQ ID NO: 625474 - RNA, 23 nt, Homo sapiens
gaacuucccaaccuuguuugaag

SEQ ID NO: 625475 - RNA, 17 nt, Homo sapiens
gaacuuggcacacucuc

SEQ ID NO: 625476 - RNA, 19 nt, Homo sapiens
gaacuuggcacacucucca

SEQ ID NO: 625477 - RNA, 22 nt, Homo sapiens
gaacuuuccccaauuacagggu

SEQ ID NO: 625478 - RNA, 14 nt, Homo sapiens
gaacuuuuguacug

SEQ ID NO: 625479 - RNA, 20 nt, Homo sapiens
gaagaaaagcugccauuucc

SEQ ID NO: 625480 - RNA, 23 nt, Homo sapiens
gaagaaaauaguggugugauuug

SEQ ID NO: 625481 - RNA, 17 nt, Homo sapiens
gaagaaacacacuggau

SEQ ID NO: 625482 - RNA, 20 nt, Homo sapiens
gaagaaagccccucguugcc

SEQ ID NO: 625483 - RNA, 21 nt, Homo sapiens
gaagaacagcuguuccugugu

SEQ ID NO: 625484 - RNA, 19 nt, Homo sapiens
gaagaacaguaacugccau

SEQ ID NO: 625485 - RNA, 19 nt, Homo sapiens
gaagaaccauuuacaugca

SEQ ID NO: 625486 - RNA, 19 nt, Homo sapiens
gaagaacccucaggucaca

SEQ ID NO: 625487 - RNA, 23 nt, Homo sapiens
gaagaaccugacauccacuguuu

SEQ ID NO: 625488 - RNA, 14 nt, Homo sapiens
gaagaacucaccag

SEQ ID NO: 625489 - RNA, 12 nt, Homo sapiens
gaagaacugacu

SEQ ID NO: 625490 - RNA, 20 nt, Homo sapiens
gaagaagacaaaugacagau

SEQ ID NO: 625491 - RNA, 14 nt, Homo sapiens
gaagaagaguuucu

SEQ ID NO: 625492 - RNA, 19 nt, Homo sapiens
gaagaauauucaggacuua

SEQ ID NO: 625493 - RNA, 16 nt, Homo sapiens
gaagaauucuguuuag

SEQ ID NO: 625494 - RNA, 20 nt, Homo sapiens
gaagaauuggccaucuuaaa

SEQ ID NO: 625495 - RNA, 20 nt, Homo sapiens
gaagaauuggggauucucua

SEQ ID NO: 625496 - RNA, 22 nt, Homo sapiens
gaagaauuuaauggacugugaa

SEQ ID NO: 625497 - RNA, 22 nt, Homo sapiens
gaagacaacagcauaacuaaau

SEQ ID NO: 625498 - RNA, 13 nt, Homo sapiens
gaagacaauguga

SEQ ID NO: 625499 - RNA, 15 nt, Homo sapiens
gaagacagagggaaa

SEQ ID NO: 625500 - RNA, 12 nt, Homo sapiens
gaagacaggaug

SEQ ID NO: 625501 - RNA, 21 nt, Homo sapiens
gaagacauuaagcagccuuaa

SEQ ID NO: 625502 - RNA, 20 nt, Homo sapiens
gaagaccagcuuugcaguga

SEQ ID NO: 625503 - RNA, 19 nt, Homo sapiens
gaagacccacgugcuaggg

SEQ ID NO: 625504 - RNA, 17 nt, Homo sapiens
gaagacccgcucuccau

SEQ ID NO: 625505 - RNA, 13 nt, Homo sapiens
gaagaccuggacc

SEQ ID NO: 625506 - RNA, 17 nt, Homo sapiens
gaagaccuguuauguag

SEQ ID NO: 625507 - RNA, 12 nt, Homo sapiens
gaagacucugac

SEQ ID NO: 625508 - RNA, 13 nt, Homo sapiens
gaagagaagacau

SEQ ID NO: 625509 - RNA, 14 nt, Homo sapiens
gaagagauccuucu

SEQ ID NO: 625510 - RNA, 11 nt, Homo sapiens
gaagagcauug

SEQ ID NO: 625511 - RNA, 21 nt, Homo sapiens
gaagagcuccccuccacagcu

SEQ ID NO: 625512 - RNA, 21 nt, Homo sapiens
gaagagucgaugaucaccaag

SEQ ID NO: 625513 - RNA, 19 nt, Homo sapiens
gaagaguggguuucacaag

SEQ ID NO: 625514 - RNA, 20 nt, Homo sapiens
gaagauaacuugagcaccgu

SEQ ID NO: 625515 - RNA, 13 nt, Homo sapiens
gaagauagaucca

SEQ ID NO: 625516 - RNA, 16 nt, Homo sapiens
gaagauagaugcacuu

SEQ ID NO: 625517 - RNA, 14 nt, Homo sapiens
gaagauaguaacug

SEQ ID NO: 625518 - RNA, 15 nt, Homo sapiens
gaagauaucuugaaa

SEQ ID NO: 625519 - RNA, 21 nt, Homo sapiens
gaagaucaacgccucacugaa

SEQ ID NO: 625520 - RNA, 15 nt, Homo sapiens
gaagaucaagccagu

SEQ ID NO: 625521 - RNA, 18 nt, Homo sapiens
gaagaucaauuucuccca

SEQ ID NO: 625522 - RNA, 18 nt, Homo sapiens
gaagaugaucauuugccc

SEQ ID NO: 625523 - RNA, 18 nt, Homo sapiens
gaagauggccaugcccuc

SEQ ID NO: 625524 - RNA, 12 nt, Homo sapiens
gaagauguauca

SEQ ID NO: 625525 - RNA, 20 nt, Homo sapiens
gaagauguugguuauggugu

SEQ ID NO: 625526 - RNA, 22 nt, Homo sapiens
gaagauguugguuaugguguua

SEQ ID NO: 625527 - RNA, 21 nt, Homo sapiens
gaagauugcgguuuacagcua

SEQ ID NO: 625528 - RNA, 18 nt, Homo sapiens
gaagcaaguuuucuucca

SEQ ID NO: 625529 - RNA, 11 nt, Homo sapiens
gaagcaauaac

SEQ ID NO: 625530 - RNA, 16 nt, Homo sapiens
gaagcacagagggcua

SEQ ID NO: 625531 - RNA, 19 nt, Homo sapiens
gaagcacagagggcuaggg

SEQ ID NO: 625532 - RNA, 17 nt, Homo sapiens
gaagcacagcagcaucu

SEQ ID NO: 625533 - RNA, 14 nt, Homo sapiens
gaagcacagcuccu

SEQ ID NO: 625534 - RNA, 20 nt, Homo sapiens
gaagcagaaauauagugcaa

SEQ ID NO: 625535 - RNA, 16 nt, Homo sapiens
gaagcagcucaaggga

SEQ ID NO: 625536 - RNA, 13 nt, Homo sapiens
gaagcagcugcuu

SEQ ID NO: 625537 - RNA, 16 nt, Homo sapiens
gaagcagucucuuccu

SEQ ID NO: 625538 - RNA, 13 nt, Homo sapiens
gaagcaugaguua

SEQ ID NO: 625539 - RNA, 10 nt, Homo sapiens
gaagcauuuu

SEQ ID NO: 625540 - RNA, 20 nt, Homo sapiens
gaagccacugaagcugggau

SEQ ID NO: 625541 - RNA, 15 nt, Homo sapiens
gaagccagagcccca

SEQ ID NO: 625542 - RNA, 18 nt, Homo sapiens
gaagccauauaugaccag

SEQ ID NO: 625543 - RNA, 23 nt, Homo sapiens
gaagccauccugcccuucugacc

SEQ ID NO: 625544 - RNA, 12 nt, Homo sapiens
gaagccaugucu

SEQ ID NO: 625545 - RNA, 19 nt, Homo sapiens
gaagcccugauguguccuc

SEQ ID NO: 625546 - RNA, 16 nt, Homo sapiens
gaagccggucaucacc

SEQ ID NO: 625547 - RNA, 20 nt, Homo sapiens
gaagccgucugacuccagag

SEQ ID NO: 625548 - RNA, 17 nt, Homo sapiens
gaagccuauguaugcca

SEQ ID NO: 625549 - RNA, 13 nt, Homo sapiens
gaagccucagcua

SEQ ID NO: 625550 - RNA, 17 nt, Homo sapiens
gaagccuggacucugcc

SEQ ID NO: 625551 - RNA, 18 nt, Homo sapiens
gaaggcuuugccaugggc

SEQ ID NO: 625552 - RNA, 15 nt, Homo sapiens
gaagggaauccuccu

SEQ ID NO: 625553 - RNA, 19 nt, Homo sapiens
gaagggacacacaagaaga

SEQ ID NO: 625554 - RNA, 19 nt, Homo sapiens
gaagggaggagcagcaaga

SEQ ID NO: 625555 - RNA, 15 nt, Homo sapiens
gaagggauaucuacu

SEQ ID NO: 625556 - RNA, 23 nt, Homo sapiens
gaagggauuguuguguagucaag

SEQ ID NO: 625557 - RNA, 15 nt, Homo sapiens
gaagggcaauaucua

SEQ ID NO: 625558 - RNA, 10 nt, Homo sapiens
gaagggccag

SEQ ID NO: 625559 - RNA, 12 nt, Homo sapiens
gaagggccaguc

SEQ ID NO: 625560 - RNA, 19 nt, Homo sapiens
gaagggcugaguggucuga

SEQ ID NO: 625561 - RNA, 16 nt, Homo sapiens
gaaggggaaacacagc

SEQ ID NO: 625562 - RNA, 11 nt, Homo sapiens
gaaggggccac

SEQ ID NO: 625563 - RNA, 17 nt, Homo sapiens
gaagggggacacuccau

SEQ ID NO: 625564 - RNA, 19 nt, Homo sapiens
gaagggggucaaaggaaga

SEQ ID NO: 625565 - RNA, 21 nt, Homo sapiens
gaaggguuuugcuacauucua

SEQ ID NO: 625566 - RNA, 16 nt, Homo sapiens
gaaggucccucagaca

SEQ ID NO: 625567 - RNA, 16 nt, Homo sapiens
gaaggucuuuguuaug

SEQ ID NO: 625568 - RNA, 22 nt, Homo sapiens
gaagguguguccuugaacugag

SEQ ID NO: 625569 - RNA, 20 nt, Homo sapiens
gaagguucucugugcuccuc

SEQ ID NO: 625570 - RNA, 13 nt, Homo sapiens
gaagguugcaccu

SEQ ID NO: 625571 - RNA, 15 nt, Homo sapiens
gaagguugugaugaa

SEQ ID NO: 625572 - RNA, 16 nt, Homo sapiens
gaagguuuucauuugc

SEQ ID NO: 625573 - RNA, 18 nt, Homo sapiens
gaagguuuucauuugcca

SEQ ID NO: 625574 - RNA, 22 nt, Homo sapiens
gaagguuuuuuugucgauuagu

SEQ ID NO: 625575 - RNA, 20 nt, Homo sapiens
gaaguaaaagcaaguacucu

SEQ ID NO: 625576 - RNA, 18 nt, Homo sapiens
gaaguaaacagauggcac

SEQ ID NO: 625577 - RNA, 14 nt, Homo sapiens
gaaguaaacugcag

SEQ ID NO: 625578 - RNA, 12 nt, Homo sapiens
gaaguaaagccu

SEQ ID NO: 625579 - RNA, 20 nt, Homo sapiens
gaaguacagcagaagcccca

SEQ ID NO: 625580 - RNA, 14 nt, Homo sapiens
gaaguagcucuuuu

SEQ ID NO: 625581 - RNA, 17 nt, Homo sapiens
gaaguaggcauauauca

SEQ ID NO: 625582 - RNA, 18 nt, Homo sapiens
gaaguaggcauauaucac

SEQ ID NO: 625583 - RNA, 15 nt, Homo sapiens
gaaguaucaagccau

SEQ ID NO: 625584 - RNA, 13 nt, Homo sapiens
gaagucacaucac

SEQ ID NO: 625585 - RNA, 18 nt, Homo sapiens
gaagucagccacacuggg

SEQ ID NO: 625586 - RNA, 19 nt, Homo sapiens
gaaguccugucacugagca

SEQ ID NO: 625587 - RNA, 18 nt, Homo sapiens
gaagucuaaaagcagaaa

SEQ ID NO: 625588 - RNA, 19 nt, Homo sapiens
gaagucucaggagucucug

SEQ ID NO: 625589 - RNA, 20 nt, Homo sapiens
gaagucuucucugccuguaa

SEQ ID NO: 625590 - RNA, 14 nt, Homo sapiens
gaagugacucucac

SEQ ID NO: 625591 - RNA, 20 nt, Homo sapiens
gaagugagcaaggugcucuu

SEQ ID NO: 625592 - RNA, 18 nt, Homo sapiens
gaagugagggcucacuca

SEQ ID NO: 625593 - RNA, 22 nt, Homo sapiens
gaagugagggcucacucagcca

SEQ ID NO: 625594 - RNA, 17 nt, Homo sapiens
gaagugcauccaaaggu

SEQ ID NO: 625595 - RNA, 15 nt, Homo sapiens
gaagugcgugaaugu

SEQ ID NO: 625596 - RNA, 13 nt, Homo sapiens
gaagugcucuuuc

SEQ ID NO: 625597 - RNA, 18 nt, Homo sapiens
gaaguggagaggguguca

SEQ ID NO: 625598 - RNA, 17 nt, Homo sapiens
gaagugugaagugcaga

SEQ ID NO: 625599 - RNA, 22 nt, Homo sapiens
gaaguuauuaacgggcauguau

SEQ ID NO: 625600 - RNA, 20 nt, Homo sapiens
gaaguucaguuuuuacugag

SEQ ID NO: 625601 - RNA, 19 nt, Homo sapiens
gaaguuccuuagguuuucu

SEQ ID NO: 625602 - RNA, 17 nt, Homo sapiens
gaaguucuccagcuuca

SEQ ID NO: 625603 - RNA, 22 nt, Homo sapiens
gaaguucuccagcuucagcuca

SEQ ID NO: 625604 - RNA, 20 nt, Homo sapiens
gaaguugcagugagcugaua

SEQ ID NO: 625605 - RNA, 12 nt, Homo sapiens
gaaguuugccaa

SEQ ID NO: 625606 - RNA, 13 nt, Homo sapiens
gaaguuuuacuag

SEQ ID NO: 625607 - RNA, 17 nt, Homo sapiens
gaaguuuuuuacuuugg

SEQ ID NO: 625608 - RNA, 18 nt, Homo sapiens
gaauaaaagaugauuucu

SEQ ID NO: 625609 - RNA, 20 nt, Homo sapiens
gaauaaaagaugauuucuca

SEQ ID NO: 625610 - RNA, 21 nt, Homo sapiens
gaauaaaagaugauuucucaa

SEQ ID NO: 625611 - RNA, 18 nt, Homo sapiens
gaauaaaauuagcuugag

SEQ ID NO: 625612 - RNA, 19 nt, Homo sapiens
gaauaaaauuccuaucuca

SEQ ID NO: 625613 - RNA, 20 nt, Homo sapiens
gaauaaaauuccuaucucau

SEQ ID NO: 625614 - RNA, 19 nt, Homo sapiens
gaauaaacuagacucugaa

SEQ ID NO: 625615 - RNA, 23 nt, Homo sapiens
gaauaaagccacuguaugauucu

SEQ ID NO: 625616 - RNA, 18 nt, Homo sapiens
gaauaaauaaauguaucu

SEQ ID NO: 625617 - RNA, 22 nt, Homo sapiens
gaauaaauaagcaaaaugccaa

SEQ ID NO: 625618 - RNA, 17 nt, Homo sapiens
gaauaaauaauucuucc

SEQ ID NO: 625619 - RNA, 16 nt, Homo sapiens
gaauaaauguuuuauu

SEQ ID NO: 625620 - RNA, 19 nt, Homo sapiens
gaauaaguaccuuuguguc

SEQ ID NO: 625621 - RNA, 19 nt, Homo sapiens
gaauaauaagcuacuugcc

SEQ ID NO: 625622 - RNA, 18 nt, Homo sapiens
gaauaauacaguaucuca

SEQ ID NO: 625623 - RNA, 16 nt, Homo sapiens
gaauaauaugaugcca

SEQ ID NO: 625624 - RNA, 16 nt, Homo sapiens
gaauaaugaauggacu

SEQ ID NO: 625625 - RNA, 12 nt, Homo sapiens
gaauaaugcugu

SEQ ID NO: 625626 - RNA, 15 nt, Homo sapiens
gaauaaugcuguuuu

SEQ ID NO: 625627 - RNA, 12 nt, Homo sapiens
gaauacaguaag

SEQ ID NO: 625628 - RNA, 21 nt, Homo sapiens
gaauacaguuuugaguagagu

SEQ ID NO: 625629 - RNA, 17 nt, Homo sapiens
gaauacauggaaauauu

SEQ ID NO: 625630 - RNA, 23 nt, Homo sapiens
gaauaccaguguuauuaaugaca

SEQ ID NO: 625631 - RNA, 15 nt, Homo sapiens
gaauaccuucuucgc

SEQ ID NO: 625632 - RNA, 19 nt, Homo sapiens
gaauaccuuggucucaccu

SEQ ID NO: 625633 - RNA, 13 nt, Homo sapiens
gaauacuggccau

SEQ ID NO: 625634 - RNA, 15 nt, Homo sapiens
gaauacuuugcuuca

SEQ ID NO: 625635 - RNA, 23 nt, Homo sapiens
gaauagaaauaaaggaugugauu

SEQ ID NO: 625636 - RNA, 12 nt, Homo sapiens
gaauagcacaaa

SEQ ID NO: 625637 - RNA, 18 nt, Homo sapiens
gaauaguccauccccaga

SEQ ID NO: 625638 - RNA, 12 nt, Homo sapiens
gaauaguccuug

SEQ ID NO: 625639 - RNA, 22 nt, Homo sapiens
gaauaguguuggaaaaugugca

SEQ ID NO: 625640 - RNA, 14 nt, Homo sapiens
gaauauaauacugu

SEQ ID NO: 625641 - RNA, 14 nt, Homo sapiens
gaauauacauuguc

SEQ ID NO: 625642 - RNA, 13 nt, Homo sapiens
gaauauagagggu

SEQ ID NO: 625643 - RNA, 21 nt, Homo sapiens
gaauauauuauaaucuuccau

SEQ ID NO: 625644 - RNA, 14 nt, Homo sapiens
gagggaaagugcau

SEQ ID NO: 625645 - RNA, 16 nt, Homo sapiens
gagggaacagugccca

SEQ ID NO: 625646 - RNA, 18 nt, Homo sapiens
gagggaagaccagaauuc

SEQ ID NO: 625647 - RNA, 23 nt, Homo sapiens
gagggaagaucuugaugguguuu

SEQ ID NO: 625648 - RNA, 13 nt, Homo sapiens
gagggaaggugac

SEQ ID NO: 625649 - RNA, 22 nt, Homo sapiens
gagggacgacaccucugguuuu

SEQ ID NO: 625650 - RNA, 15 nt, Homo sapiens
gagggagacuccugg

SEQ ID NO: 625651 - RNA, 21 nt, Homo sapiens
gagggaggcgcugcugguguu

SEQ ID NO: 625652 - RNA, 12 nt, Homo sapiens
gagggagugcag

SEQ ID NO: 625653 - RNA, 16 nt, Homo sapiens
gagggcagucugcuca

SEQ ID NO: 625654 - RNA, 13 nt, Homo sapiens
gagggcauuccau

SEQ ID NO: 625655 - RNA, 15 nt, Homo sapiens
gagggccaagcccag

SEQ ID NO: 625656 - RNA, 14 nt, Homo sapiens
gagggcgccaugca

SEQ ID NO: 625657 - RNA, 21 nt, Homo sapiens
gagggcucaccucuugccuuc

SEQ ID NO: 625658 - RNA, 20 nt, Homo sapiens
gagggcuggcuggccucacc

SEQ ID NO: 625659 - RNA, 13 nt, Homo sapiens
gagggcuggguuu

SEQ ID NO: 625660 - RNA, 13 nt, Homo sapiens
gagggcuguggug

SEQ ID NO: 625661 - RNA, 23 nt, Homo sapiens
gagggcuuccucuagaagccaag

SEQ ID NO: 625662 - RNA, 21 nt, Homo sapiens
gaggggacuauuuaugaaggc

SEQ ID NO: 625663 - RNA, 15 nt, Homo sapiens
gaggggcaacgaaga

SEQ ID NO: 625664 - RNA, 20 nt, Homo sapiens
gagggggcacggcaggcgug

SEQ ID NO: 625665 - RNA, 19 nt, Homo sapiens
gaggguaugucagugucac

SEQ ID NO: 625666 - RNA, 21 nt, Homo sapiens
gaggguccuuuaguaccugaa

SEQ ID NO: 625667 - RNA, 15 nt, Homo sapiens
gagggucuucuuaca

SEQ ID NO: 625668 - RNA, 21 nt, Homo sapiens
gagggugaggggcuggcacug

SEQ ID NO: 625669 - RNA, 20 nt, Homo sapiens
gagggugguuuaugauuaag

SEQ ID NO: 625670 - RNA, 17 nt, Homo sapiens
gagguaaauaaguaaaa

SEQ ID NO: 625671 - RNA, 16 nt, Homo sapiens
gaggucacauucagga

SEQ ID NO: 625672 - RNA, 20 nt, Homo sapiens
gaggucagaggggacucuga

SEQ ID NO: 625673 - RNA, 22 nt, Homo sapiens
gaggucagugcuucgugccucg

SEQ ID NO: 625674 - RNA, 17 nt, Homo sapiens
gaggucuccaaacugau

SEQ ID NO: 625675 - RNA, 15 nt, Homo sapiens
gaggucucccaaacg

SEQ ID NO: 625676 - RNA, 19 nt, Homo sapiens
gaggugaauacucuugaaa

SEQ ID NO: 625677 - RNA, 16 nt, Homo sapiens
gaggugcaacaagguc

SEQ ID NO: 625678 - RNA, 20 nt, Homo sapiens
gagguggagcuugcagugag

SEQ ID NO: 625679 - RNA, 20 nt, Homo sapiens
gagguggaggcugcagugag

SEQ ID NO: 625680 - RNA, 21 nt, Homo sapiens
gagguggcggccugcugcugu

SEQ ID NO: 625681 - RNA, 12 nt, Homo sapiens
gagguggcugcg

SEQ ID NO: 625682 - RNA, 17 nt, Homo sapiens
gaggugggcagguggug

SEQ ID NO: 625683 - RNA, 17 nt, Homo sapiens
gagguggugccuucuca

SEQ ID NO: 625684 - RNA, 15 nt, Homo sapiens
gaggugucgggacau

SEQ ID NO: 625685 - RNA, 14 nt, Homo sapiens
gagguuaaggcaua

SEQ ID NO: 625686 - RNA, 20 nt, Homo sapiens
gagguuacagaggcugacuu

SEQ ID NO: 625687 - RNA, 15 nt, Homo sapiens
gagguugaagccaag

SEQ ID NO: 625688 - RNA, 12 nt, Homo sapiens
gagguugcacug

SEQ ID NO: 625689 - RNA, 14 nt, Homo sapiens
ugauaagacuguuu

SEQ ID NO: 625690 - RNA, 18 nt, Homo sapiens
ugauaagcauugacuugc

SEQ ID NO: 625691 - RNA, 22 nt, Homo sapiens
ugauaaggggccuugcucugag

SEQ ID NO: 625692 - RNA, 17 nt, Homo sapiens
ugauaaguuucauacuc

SEQ ID NO: 625693 - RNA, 14 nt, Homo sapiens
ugauaauacuugac

SEQ ID NO: 625694 - RNA, 16 nt, Homo sapiens
ugauaaugcagacuuc

SEQ ID NO: 625695 - RNA, 13 nt, Homo sapiens
ugauaaugcucac

SEQ ID NO: 625696 - RNA, 15 nt, Homo sapiens
ugauacaaauuccac

SEQ ID NO: 625697 - RNA, 12 nt, Homo sapiens
ugauacacagua

SEQ ID NO: 625698 - RNA, 22 nt, Homo sapiens
ugauacauccaaagcagacagc

SEQ ID NO: 625699 - RNA, 21 nt, Homo sapiens
ugauacauuaaaaaaauucca

SEQ ID NO: 625700 - RNA, 19 nt, Homo sapiens
ugauacccaacaguuuauu

SEQ ID NO: 625701 - RNA, 22 nt, Homo sapiens
ugauacccaaguuauugggaug

SEQ ID NO: 625702 - RNA, 13 nt, Homo sapiens
ugauacguguaug

SEQ ID NO: 625703 - RNA, 21 nt, Homo sapiens
ugauacucccaccucugccuu

SEQ ID NO: 625704 - RNA, 22 nt, Homo sapiens
ugauacugcugagucagacugu

SEQ ID NO: 625705 - RNA, 20 nt, Homo sapiens
ugauacuuacugaacugugu

SEQ ID NO: 625706 - RNA, 18 nt, Homo sapiens
ugauacuucaggugcuuu

SEQ ID NO: 625707 - RNA, 17 nt, Homo sapiens
ugauacuuuagccauca

SEQ ID NO: 625708 - RNA, 18 nt, Homo sapiens
ugauacuuugacaguguu

SEQ ID NO: 625709 - RNA, 16 nt, Homo sapiens
ugauagaguguuauca

SEQ ID NO: 625710 - RNA, 17 nt, Homo sapiens
ugauagcuuacacugag

SEQ ID NO: 625711 - RNA, 15 nt, Homo sapiens
ugauagggaacuggg

SEQ ID NO: 625712 - RNA, 12 nt, Homo sapiens
ugauaguccuuu

SEQ ID NO: 625713 - RNA, 15 nt, Homo sapiens
ugauauaaucuuuca

SEQ ID NO: 625714 - RNA, 14 nt, Homo sapiens
ugauauacaaagug

SEQ ID NO: 625715 - RNA, 14 nt, Homo sapiens
ugauauacacagug

SEQ ID NO: 625716 - RNA, 13 nt, Homo sapiens
ugauauauuucag

SEQ ID NO: 625717 - RNA, 12 nt, Homo sapiens
ugauaucucaau

SEQ ID NO: 625718 - RNA, 15 nt, Homo sapiens
ugauaugaccaaaau

SEQ ID NO: 625719 - RNA, 15 nt, Homo sapiens
ugauaugauccagag

SEQ ID NO: 625720 - RNA, 21 nt, Homo sapiens
ugauaugcaccaggucucaag

SEQ ID NO: 625721 - RNA, 20 nt, Homo sapiens
ugauauggcggccugcagug

SEQ ID NO: 625722 - RNA, 18 nt, Homo sapiens
ugauauuauggcaaguga

SEQ ID NO: 625723 - RNA, 21 nt, Homo sapiens
ugauauuauggcaagugauau

SEQ ID NO: 625724 - RNA, 18 nt, Homo sapiens
ugauauuccccauuuccu

SEQ ID NO: 625725 - RNA, 12 nt, Homo sapiens
ugauauugcagc

SEQ ID NO: 625726 - RNA, 18 nt, Homo sapiens
ugauauuuucucuaggaa

SEQ ID NO: 625727 - RNA, 18 nt, Homo sapiens
ugaucaaaggacaaagac

SEQ ID NO: 625728 - RNA, 16 nt, Homo sapiens
ugaucaagaaugcaau

SEQ ID NO: 625729 - RNA, 19 nt, Homo sapiens
ugaucaauuucaacaugga

SEQ ID NO: 625730 - RNA, 21 nt, Homo sapiens
ugaucacaucuaaagcuuuau

SEQ ID NO: 625731 - RNA, 22 nt, Homo sapiens
ugaucaccauguuagccuuaga

SEQ ID NO: 625732 - RNA, 16 nt, Homo sapiens
ugaucacccaaugcau

SEQ ID NO: 625733 - RNA, 18 nt, Homo sapiens
ugaucacuccagugcacu

SEQ ID NO: 625734 - RNA, 14 nt, Homo sapiens
ugaucagaccuugg

SEQ ID NO: 625735 - RNA, 12 nt, Homo sapiens
ugaucagacuga

SEQ ID NO: 625736 - RNA, 17 nt, Homo sapiens
ugaucagccuugcaaau

SEQ ID NO: 625737 - RNA, 21 nt, Homo sapiens
ugaucaucuugaugucuauga

SEQ ID NO: 625738 - RNA, 20 nt, Homo sapiens
ugaucauuauaucauuggaa

SEQ ID NO: 625739 - RNA, 13 nt, Homo sapiens
ugaucauuugccc

SEQ ID NO: 625740 - RNA, 23 nt, Homo sapiens
ugaucauuuuccccccacucucc

SEQ ID NO: 625741 - RNA, 22 nt, Homo sapiens
ugauccaacuucagcaaugaau

SEQ ID NO: 625742 - RNA, 21 nt, Homo sapiens
ugauccacagaaauacaugaa

SEQ ID NO: 625743 - RNA, 16 nt, Homo sapiens
ugauccagagcacaga

SEQ ID NO: 625744 - RNA, 18 nt, Homo sapiens
ugauccagagcacagauc

SEQ ID NO: 625745 - RNA, 21 nt, Homo sapiens
ugauccagagcagaguuuacg

SEQ ID NO: 625746 - RNA, 15 nt, Homo sapiens
ugauccagauguuau

SEQ ID NO: 625747 - RNA, 13 nt, Homo sapiens
ugauccgccuacc

SEQ ID NO: 625748 - RNA, 17 nt, Homo sapiens
ugauccguuccauugca

SEQ ID NO: 625749 - RNA, 16 nt, Homo sapiens
ugauccuuccaccuca

SEQ ID NO: 625750 - RNA, 14 nt, Homo sapiens
ugaucuaauuuaca

SEQ ID NO: 625751 - RNA, 15 nt, Homo sapiens
ugaucuacuugccuc

SEQ ID NO: 625752 - RNA, 16 nt, Homo sapiens
ugaucuacuugccuca

SEQ ID NO: 625753 - RNA, 15 nt, Homo sapiens
ugaucuauacaaauu

SEQ ID NO: 625754 - RNA, 20 nt, Homo sapiens
ugaucucaaagcacaaugug

SEQ ID NO: 625755 - RNA, 14 nt, Homo sapiens
ugaucucacacaca

SEQ ID NO: 625756 - RNA, 18 nt, Homo sapiens
ugaucuccauaaacauga

SEQ ID NO: 625757 - RNA, 20 nt, Homo sapiens
ugaucucuuagaagccaugg

SEQ ID NO: 625758 - RNA, 13 nt, Homo sapiens
ugaucugcacauu

SEQ ID NO: 625759 - RNA, 12 nt, Homo sapiens
ugaucuguguuu

SEQ ID NO: 625760 - RNA, 19 nt, Homo sapiens
ugaucuuaauauauuugaa

SEQ ID NO: 625761 - RNA, 22 nt, Homo sapiens
ugaucuucagggaacugcauag

SEQ ID NO: 625762 - RNA, 17 nt, Homo sapiens
ugaucuugauugugggu

SEQ ID NO: 625763 - RNA, 19 nt, Homo sapiens
ugaucuuucucaaucuuga

SEQ ID NO: 625764 - RNA, 14 nt, Homo sapiens
ugaugaaacauuca

SEQ ID NO: 625765 - RNA, 17 nt, Homo sapiens
ugaugaaagcugauuac

SEQ ID NO: 625766 - RNA, 15 nt, Homo sapiens
ugaugaaauaucacu

SEQ ID NO: 625767 - RNA, 15 nt, Homo sapiens
ugaugaagaccaaag

SEQ ID NO: 625768 - RNA, 15 nt, Homo sapiens
ugaugacuaccucag

SEQ ID NO: 625769 - RNA, 20 nt, Homo sapiens
ugauuaacaucuacaaucag

SEQ ID NO: 625770 - RNA, 14 nt, Homo sapiens
ugauuaacugugaa

SEQ ID NO: 625771 - RNA, 19 nt, Homo sapiens
ugauuacuaucauggcaua

SEQ ID NO: 625772 - RNA, 15 nt, Homo sapiens
ugauuacuaugcucu

SEQ ID NO: 625773 - RNA, 15 nt, Homo sapiens
ugauuacugcucuau

SEQ ID NO: 625774 - RNA, 17 nt, Homo sapiens
ugauuacuguccagcuu

SEQ ID NO: 625775 - RNA, 23 nt, Homo sapiens
ugauuagaaagaccaggccaaug

SEQ ID NO: 625776 - RNA, 21 nt, Homo sapiens
ugauuagaaggcaaguuucua

SEQ ID NO: 625777 - RNA, 22 nt, Homo sapiens
ugauuaguauaauauuucuuaa

SEQ ID NO: 625778 - RNA, 21 nt, Homo sapiens
ugauuaguauucaggcacuga

SEQ ID NO: 625779 - RNA, 17 nt, Homo sapiens
ugauuauauagcacaua

SEQ ID NO: 625780 - RNA, 16 nt, Homo sapiens
ugauuauauucacaga

SEQ ID NO: 625781 - RNA, 13 nt, Homo sapiens
ugauuaucuucag

SEQ ID NO: 625782 - RNA, 15 nt, Homo sapiens
ugauuauuaaagucc

SEQ ID NO: 625783 - RNA, 21 nt, Homo sapiens
ugauuauuuuuuauacuguau

SEQ ID NO: 625784 - RNA, 18 nt, Homo sapiens
ugauucaaauugcugcuu

SEQ ID NO: 625785 - RNA, 15 nt, Homo sapiens
ugauucaacacuuaa

SEQ ID NO: 625786 - RNA, 23 nt, Homo sapiens
ugauucacugccuuccucucucu

SEQ ID NO: 625787 - RNA, 21 nt, Homo sapiens
ugauucagccaaaugcaggga

SEQ ID NO: 625788 - RNA, 15 nt, Homo sapiens
ugauucauaagacac

SEQ ID NO: 625789 - RNA, 13 nt, Homo sapiens
ugauuccaaauau

SEQ ID NO: 625790 - RNA, 13 nt, Homo sapiens
ugauuccagaaca

SEQ ID NO: 625791 - RNA, 16 nt, Homo sapiens
ugauucccuccugcua

SEQ ID NO: 625792 - RNA, 22 nt, Homo sapiens
ugauucuaaggcaggaauuuga

SEQ ID NO: 625793 - RNA, 18 nt, Homo sapiens
ugauucuaauggggacac

SEQ ID NO: 625794 - RNA, 13 nt, Homo sapiens
ugauucuaugucu

SEQ ID NO: 625795 - RNA, 22 nt, Homo sapiens
ugauucuccugccucagccucc

SEQ ID NO: 625796 - RNA, 20 nt, Homo sapiens
ugauucucuuuaacugugug

SEQ ID NO: 625797 - RNA, 16 nt, Homo sapiens
ugauucuuacauauga

SEQ ID NO: 625798 - RNA, 14 nt, Homo sapiens
ugauucuuguaaau

SEQ ID NO: 625799 - RNA, 20 nt, Homo sapiens
ugauugaaguauucaaucaa

SEQ ID NO: 625800 - RNA, 15 nt, Homo sapiens
ugauugagacucaaa

SEQ ID NO: 625801 - RNA, 14 nt, Homo sapiens
ugauugcuuugcug

SEQ ID NO: 625802 - RNA, 21 nt, Homo sapiens
ugauuggacauuuucuucaga

SEQ ID NO: 625803 - RNA, 13 nt, Homo sapiens
ugauuggcucacc

SEQ ID NO: 625804 - RNA, 21 nt, Homo sapiens
ugauuggcuccuggguuucau

SEQ ID NO: 625805 - RNA, 15 nt, Homo sapiens
ugauuggugauucaa

SEQ ID NO: 625806 - RNA, 20 nt, Homo sapiens
ugauuguauaaaugcaauaa

SEQ ID NO: 625807 - RNA, 15 nt, Homo sapiens
ugauugucaccauga

SEQ ID NO: 625808 - RNA, 17 nt, Homo sapiens
ugauugucagcuacuaa

SEQ ID NO: 625809 - RNA, 17 nt, Homo sapiens
ugauuguggaauggaga

SEQ ID NO: 625810 - RNA, 16 nt, Homo sapiens
ugauuguuauguguau

SEQ ID NO: 625811 - RNA, 18 nt, Homo sapiens
ugauuguugucaggccau

SEQ ID NO: 625812 - RNA, 14 nt, Homo sapiens
ugauuuaaaucagc

SEQ ID NO: 625813 - RNA, 21 nt, Homo sapiens
ugauuuacagacugaugccag

SEQ ID NO: 625814 - RNA, 13 nt, Homo sapiens
ugauuuacauuuc

SEQ ID NO: 625815 - RNA, 15 nt, Homo sapiens
ugauuuagugaucaa

SEQ ID NO: 625816 - RNA, 15 nt, Homo sapiens
ugauuuaucuuucaa

SEQ ID NO: 625817 - RNA, 17 nt, Homo sapiens
ugauuuauuugcuucuu

SEQ ID NO: 625818 - RNA, 13 nt, Homo sapiens
ugauuucaagacc

SEQ ID NO: 625819 - RNA, 14 nt, Homo sapiens
ugauuucagaagga

SEQ ID NO: 625820 - RNA, 14 nt, Homo sapiens
ugauuucagcacau

SEQ ID NO: 625821 - RNA, 14 nt, Homo sapiens
ugauuuccagugag

SEQ ID NO: 625822 - RNA, 14 nt, Homo sapiens
ugauuuccuuccaa

SEQ ID NO: 625823 - RNA, 18 nt, Homo sapiens
ugauuucuacaacuggag

SEQ ID NO: 625824 - RNA, 12 nt, Homo sapiens
ugauuucucaaa

SEQ ID NO: 625825 - RNA, 14 nt, Homo sapiens
ugauuucucaaaaa

SEQ ID NO: 625826 - RNA, 14 nt, Homo sapiens
ugauuucucugaac

SEQ ID NO: 625827 - RNA, 13 nt, Homo sapiens
ugauuugguggau

SEQ ID NO: 625828 - RNA, 20 nt, Homo sapiens
ugauuugguugcacuuuaga

SEQ ID NO: 625829 - RNA, 16 nt, Homo sapiens
ugauuuguagcacuga

SEQ ID NO: 625830 - RNA, 19 nt, Homo sapiens
ugauuuuaaagaacaguga

SEQ ID NO: 625831 - RNA, 18 nt, Homo sapiens
ugauuuuaaauggauguc

SEQ ID NO: 625832 - RNA, 14 nt, Homo sapiens
ugauuuuacaauug

SEQ ID NO: 625833 - RNA, 13 nt, Homo sapiens
ugauuuucuccau

SEQ ID NO: 625834 - RNA, 22 nt, Homo sapiens
ugauuuuuugcauuccugacaa

SEQ ID NO: 625835 - RNA, 16 nt, Homo sapiens
ugcaaaaaacucagag

SEQ ID NO: 625836 - RNA, 16 nt, Homo sapiens
ugcaaaaguacaaggg

SEQ ID NO: 625837 - RNA, 22 nt, Homo sapiens
ugcaaaauaaguuuuucuuuaa

SEQ ID NO: 625838 - RNA, 14 nt, Homo sapiens
ugcaaaauuaguac

SEQ ID NO: 625839 - RNA, 22 nt, Homo sapiens
ugcaaacaauuuuaaugauggu

SEQ ID NO: 625840 - RNA, 12 nt, Homo sapiens
ugcaaacacagc

SEQ ID NO: 625841 - RNA, 13 nt, Homo sapiens
ugcaaaccaggau

SEQ ID NO: 625842 - RNA, 19 nt, Homo sapiens
ugcaaacucacugcucaag

SEQ ID NO: 625843 - RNA, 15 nt, Homo sapiens
ugcaaacuuguuaga

SEQ ID NO: 625844 - RNA, 13 nt, Homo sapiens
ugcaaacuuuuaa

SEQ ID NO: 625845 - RNA, 15 nt, Homo sapiens
ugcaaagaccaccuc

SEQ ID NO: 625846 - RNA, 17 nt, Homo sapiens
ugcaaagaccaccucca

SEQ ID NO: 625847 - RNA, 22 nt, Homo sapiens
uggagacagacugauguguaua

SEQ ID NO: 625848 - RNA, 22 nt, Homo sapiens
uggagacggguguugucgggga

SEQ ID NO: 625849 - RNA, 15 nt, Homo sapiens
uggagagaacugaau

SEQ ID NO: 625850 - RNA, 16 nt, Homo sapiens
uggagaggaacccaga

SEQ ID NO: 625851 - RNA, 18 nt, Homo sapiens
uggagagggacuggcaga

SEQ ID NO: 625852 - RNA, 22 nt, Homo sapiens
uggagauaacagccucuugccc

SEQ ID NO: 625853 - RNA, 13 nt, Homo sapiens
uggagaugaagcc

SEQ ID NO: 625854 - RNA, 19 nt, Homo sapiens
uggagaugcagcuacugga

SEQ ID NO: 625855 - RNA, 20 nt, Homo sapiens
uggagaugcagcuacuggaa

SEQ ID NO: 625856 - RNA, 11 nt, Homo sapiens
uggagaugucu

SEQ ID NO: 625857 - RNA, 23 nt, Homo sapiens
uggagauucaguuuucauuuggu

SEQ ID NO: 625858 - RNA, 13 nt, Homo sapiens
uggagauucucau

SEQ ID NO: 625859 - RNA, 17 nt, Homo sapiens
uggagcaaacagcugua

SEQ ID NO: 625860 - RNA, 14 nt, Homo sapiens
uggagcaaaccauu

SEQ ID NO: 625861 - RNA, 16 nt, Homo sapiens
uggagcaaauguccua

SEQ ID NO: 625862 - RNA, 16 nt, Homo sapiens
uggagcacaaaauuca

SEQ ID NO: 625863 - RNA, 13 nt, Homo sapiens
uggagcacgugga

SEQ ID NO: 625864 - RNA, 19 nt, Homo sapiens
uggagcaggagccccgcca

SEQ ID NO: 625865 - RNA, 17 nt, Homo sapiens
uggagcaucugacucac

SEQ ID NO: 625866 - RNA, 10 nt, Homo sapiens
uggagccagg

SEQ ID NO: 625867 - RNA, 23 nt, Homo sapiens
uggagccaucccuucggagccaa

SEQ ID NO: 625868 - RNA, 18 nt, Homo sapiens
uggagccauugaacagcu

SEQ ID NO: 625869 - RNA, 23 nt, Homo sapiens
uggagccauugaacagcugugag

SEQ ID NO: 625870 - RNA, 17 nt, Homo sapiens
uggagcccacaaccuuc

SEQ ID NO: 625871 - RNA, 19 nt, Homo sapiens
uggagccccauccuguguu

SEQ ID NO: 625872 - RNA, 20 nt, Homo sapiens
uggagccccauccuguguua

SEQ ID NO: 625873 - RNA, 18 nt, Homo sapiens
uggagccugggguguccu

SEQ ID NO: 625874 - RNA, 20 nt, Homo sapiens
uggagcggggaucugaugaa

SEQ ID NO: 625875 - RNA, 16 nt, Homo sapiens
uggagcucagguccca

SEQ ID NO: 625876 - RNA, 15 nt, Homo sapiens
uggagcugaaaacau

SEQ ID NO: 625877 - RNA, 20 nt, Homo sapiens
uggagcuugucaccauugga

SEQ ID NO: 625878 - RNA, 22 nt, Homo sapiens
uggaggaacacagagaaauccu

SEQ ID NO: 625879 - RNA, 10 nt, Homo sapiens
uggaggacca

SEQ ID NO: 625880 - RNA, 13 nt, Homo sapiens
uggaggacuccag

SEQ ID NO: 625881 - RNA, 17 nt, Homo sapiens
uggaggagaaggacauu

SEQ ID NO: 625882 - RNA, 19 nt, Homo sapiens
uggaggaggaaggcaagag

SEQ ID NO: 625883 - RNA, 14 nt, Homo sapiens
uggaggauugcuau

SEQ ID NO: 625884 - RNA, 16 nt, Homo sapiens
uggaggcagagaccuc

SEQ ID NO: 625885 - RNA, 11 nt, Homo sapiens
uggaggcuucc

SEQ ID NO: 625886 - RNA, 16 nt, Homo sapiens
uggagggaaugcucag

SEQ ID NO: 625887 - RNA, 13 nt, Homo sapiens
uggagggagcucc

SEQ ID NO: 625888 - RNA, 18 nt, Homo sapiens
uggagggaggcucuucag

SEQ ID NO: 625889 - RNA, 19 nt, Homo sapiens
uggaggggagggaucuccu

SEQ ID NO: 625890 - RNA, 11 nt, Homo sapiens
uggaggggugu

SEQ ID NO: 625891 - RNA, 20 nt, Homo sapiens
uggaggguguucggggccca

SEQ ID NO: 625892 - RNA, 13 nt, Homo sapiens
uggaggugagaaa

SEQ ID NO: 625893 - RNA, 23 nt, Homo sapiens
uggagguggaaaagcaacauuca

SEQ ID NO: 625894 - RNA, 14 nt, Homo sapiens
uggagguugcagug

SEQ ID NO: 625895 - RNA, 19 nt, Homo sapiens
uggaguacuauauuuacaa

SEQ ID NO: 625896 - RNA, 23 nt, Homo sapiens
uggaguacuuagcuaguuuuauu

SEQ ID NO: 625897 - RNA, 16 nt, Homo sapiens
uggaguauaauauuca

SEQ ID NO: 625898 - RNA, 21 nt, Homo sapiens
uggaguauagugcaaauucau

SEQ ID NO: 625899 - RNA, 22 nt, Homo sapiens
uggaguccccucaccuccucua

SEQ ID NO: 625900 - RNA, 19 nt, Homo sapiens
uggagucuguucuagggaa

SEQ ID NO: 625901 - RNA, 21 nt, Homo sapiens
uggagugauuuauacugugaa

SEQ ID NO: 625902 - RNA, 16 nt, Homo sapiens
uggagugcaccaaaga

SEQ ID NO: 625903 - RNA, 16 nt, Homo sapiens
uggagugcagugccac

SEQ ID NO: 625904 - RNA, 22 nt, Homo sapiens
uggaguggcugccauggaagga

SEQ ID NO: 625905 - RNA, 23 nt, Homo sapiens
uggaguguuuuuacauugaucuu

SEQ ID NO: 625906 - RNA, 15 nt, Homo sapiens
uggaguuagaucucu

SEQ ID NO: 625907 - RNA, 14 nt, Homo sapiens
uggaguuccugcuc

SEQ ID NO: 625908 - RNA, 12 nt, Homo sapiens
uggaguugacug

SEQ ID NO: 625909 - RNA, 14 nt, Homo sapiens
uggaguuguucaaa

SEQ ID NO: 625910 - RNA, 22 nt, Homo sapiens
uggaguuuaauacagugagcuc

SEQ ID NO: 625911 - RNA, 24 nt, Homo sapiens
uggaguuucauguacaagaugaag

SEQ ID NO: 625912 - RNA, 19 nt, Homo sapiens
uggaguuuuguuuccucug

SEQ ID NO: 625913 - RNA, 20 nt, Homo sapiens
aaaacuuaccuauaaauuaa

SEQ ID NO: 625914 - RNA, 16 nt, Homo sapiens
aaaacuuaugaccucu

SEQ ID NO: 625915 - RNA, 15 nt, Homo sapiens
aaaacuucaaagcug

SEQ ID NO: 625916 - RNA, 15 nt, Homo sapiens
aaaacuugaaaugag

SEQ ID NO: 625917 - RNA, 11 nt, Homo sapiens
aaaacuuguaa

SEQ ID NO: 625918 - RNA, 11 nt, Homo sapiens
aaaacuuuauu

SEQ ID NO: 625919 - RNA, 23 nt, Homo sapiens
aaaacuuucauccugguuuccac

SEQ ID NO: 625920 - RNA, 21 nt, Homo sapiens
aaaacuuuggaguccccucac

SEQ ID NO: 625921 - RNA, 15 nt, Homo sapiens
aaaagaaaagaaaau

SEQ ID NO: 625922 - RNA, 18 nt, Homo sapiens
aaaagaaagaaccacuca

SEQ ID NO: 625923 - RNA, 17 nt, Homo sapiens
aaaagaacaacugccaa

SEQ ID NO: 625924 - RNA, 12 nt, Homo sapiens
aaaagaacauaa

SEQ ID NO: 625925 - RNA, 12 nt, Homo sapiens
aaaagaaccaaa

SEQ ID NO: 625926 - RNA, 18 nt, Homo sapiens
aaaagaaccgagcaauuu

SEQ ID NO: 625927 - RNA, 13 nt, Homo sapiens
aaaagaaguugua

SEQ ID NO: 625928 - RNA, 16 nt, Homo sapiens
aaaagaauacagaaag

SEQ ID NO: 625929 - RNA, 18 nt, Homo sapiens
aaaagaaugaugcuauga

SEQ ID NO: 625930 - RNA, 20 nt, Homo sapiens
aaaagaaugaugcuaugaaa

SEQ ID NO: 625931 - RNA, 15 nt, Homo sapiens
aaaagacaaaaauca

SEQ ID NO: 625932 - RNA, 17 nt, Homo sapiens
aaaagacaagacuucag

SEQ ID NO: 625933 - RNA, 20 nt, Homo sapiens
aaaagacauuuuuauuuagu

SEQ ID NO: 625934 - RNA, 19 nt, Homo sapiens
aaaagacucugaccagaga

SEQ ID NO: 625935 - RNA, 20 nt, Homo sapiens
aaaagacucugaccagagau

SEQ ID NO: 625936 - RNA, 20 nt, Homo sapiens
aaaagacugaaucuaccugc

SEQ ID NO: 625937 - RNA, 15 nt, Homo sapiens
aaaagagagaucuug

SEQ ID NO: 625938 - RNA, 18 nt, Homo sapiens
aaaagaguuaacauccca

SEQ ID NO: 625939 - RNA, 16 nt, Homo sapiens
aaaagauaacaagauc

SEQ ID NO: 625940 - RNA, 21 nt, Homo sapiens
aaaagaucuugaauagucuca

SEQ ID NO: 625941 - RNA, 16 nt, Homo sapiens
aaaagaugauuucuca

SEQ ID NO: 625942 - RNA, 18 nt, Homo sapiens
aaaagaugauuucucaaa

SEQ ID NO: 625943 - RNA, 19 nt, Homo sapiens
aaaagaugguaaaccagau

SEQ ID NO: 625944 - RNA, 13 nt, Homo sapiens
aaaagauguagau

SEQ ID NO: 625945 - RNA, 17 nt, Homo sapiens
aaaagcaaaaaugacaa

SEQ ID NO: 625946 - RNA, 21 nt, Homo sapiens
aaaagcaacaggccauuguga

SEQ ID NO: 625947 - RNA, 14 nt, Homo sapiens
aaaagcaauacugu

SEQ ID NO: 625948 - RNA, 16 nt, Homo sapiens
aaaagcaauguuuaaa

SEQ ID NO: 625949 - RNA, 18 nt, Homo sapiens
aaaagcacaaaguucuca

SEQ ID NO: 625950 - RNA, 16 nt, Homo sapiens
aaaagcacaaguacuu

SEQ ID NO: 625951 - RNA, 14 nt, Homo sapiens
aaaagcacaaucac

SEQ ID NO: 625952 - RNA, 21 nt, Homo sapiens
aaaagcacagccucagaauaa

SEQ ID NO: 625953 - RNA, 12 nt, Homo sapiens
aaaagcagcuca

SEQ ID NO: 625954 - RNA, 22 nt, Homo sapiens
aaaagcagcucaagaacacaug

SEQ ID NO: 625955 - RNA, 18 nt, Homo sapiens
aaaagcaguaacugacaa

SEQ ID NO: 625956 - RNA, 12 nt, Homo sapiens
aaaagccaaaaa

SEQ ID NO: 625957 - RNA, 22 nt, Homo sapiens
aaaagccagggcuggagaacaa

SEQ ID NO: 625958 - RNA, 21 nt, Homo sapiens
aaaagccauguauuucaggga

SEQ ID NO: 625959 - RNA, 20 nt, Homo sapiens
aaaagcccaccugaaagccu

SEQ ID NO: 625960 - RNA, 15 nt, Homo sapiens
aaaagcccacugugg

SEQ ID NO: 625961 - RNA, 14 nt, Homo sapiens
aaaagccucaguga

SEQ ID NO: 625962 - RNA, 16 nt, Homo sapiens
aaaagccuuuuccaga

SEQ ID NO: 625963 - RNA, 20 nt, Homo sapiens
aaaagcgacccauucagaga

SEQ ID NO: 625964 - RNA, 21 nt, Homo sapiens
aaaagcuauguaucgcuccua

SEQ ID NO: 625965 - RNA, 12 nt, Homo sapiens
aaaagcuuuaaa

SEQ ID NO: 625966 - RNA, 13 nt, Homo sapiens
aaaagcuuuccug

SEQ ID NO: 625967 - RNA, 20 nt, Homo sapiens
aaaaggaaagcuguguuuau

SEQ ID NO: 625968 - RNA, 20 nt, Homo sapiens
aaaaggaguagggaguucau

SEQ ID NO: 625969 - RNA, 22 nt, Homo sapiens
aaaaggauauuaucuaccuguu

SEQ ID NO: 625970 - RNA, 17 nt, Homo sapiens
aaaagggaggcucucug

SEQ ID NO: 625971 - RNA, 15 nt, Homo sapiens
aaaagggcacuccca

SEQ ID NO: 625972 - RNA, 20 nt, Homo sapiens
aaaagggcagggcaucuccu

SEQ ID NO: 625973 - RNA, 22 nt, Homo sapiens
aaaagggccaaagaaccaaaga

SEQ ID NO: 625974 - RNA, 19 nt, Homo sapiens
aaaagggcugacauuuucu

SEQ ID NO: 625975 - RNA, 22 nt, Homo sapiens
aaaagggucuugggaaauauga

SEQ ID NO: 625976 - RNA, 13 nt, Homo sapiens
aaaaggucauaua

SEQ ID NO: 625977 - RNA, 18 nt, Homo sapiens
aaaaggucucaccacaua

SEQ ID NO: 625978 - RNA, 16 nt, Homo sapiens
aaaaggugccaucuca

SEQ ID NO: 625979 - RNA, 22 nt, Homo sapiens
aaaagguuaaacccacagccaa

SEQ ID NO: 625980 - RNA, 15 nt, Homo sapiens
aaaagguuauauacc

SEQ ID NO: 625981 - RNA, 19 nt, Homo sapiens
aaaaguaacacaguggacu

SEQ ID NO: 625982 - RNA, 20 nt, Homo sapiens
aaaaguagagcaaaacuaua

SEQ ID NO: 625983 - RNA, 16 nt, Homo sapiens
aaaaguaucuuuaaca

SEQ ID NO: 625984 - RNA, 15 nt, Homo sapiens
aaaagucaguaucau

SEQ ID NO: 625985 - RNA, 23 nt, Homo sapiens
aaaagucccaacccaaugggcuc

SEQ ID NO: 625986 - RNA, 13 nt, Homo sapiens
aaaagucuaccug

SEQ ID NO: 625987 - RNA, 21 nt, Homo sapiens
aaaagugaucaauaaaaugug

SEQ ID NO: 625988 - RNA, 10 nt, Homo sapiens
aaaagugaug

SEQ ID NO: 625989 - RNA, 22 nt, Homo sapiens
aaaagugcuucauucuuugcag

SEQ ID NO: 625990 - RNA, 18 nt, Homo sapiens
aaaagugucucaaaggag

SEQ ID NO: 625991 - RNA, 17 nt, Homo sapiens
aaaaguguuuucacaac

SEQ ID NO: 625992 - RNA, 14 nt, Homo sapiens
aaaaguuaagcaaa

SEQ ID NO: 625993 - RNA, 19 nt, Homo sapiens
aaaaguuaauaacagcucc

SEQ ID NO: 625994 - RNA, 13 nt, Homo sapiens
aaaaguuauacuc

SEQ ID NO: 625995 - RNA, 15 nt, Homo sapiens
aaaaguuaugguacu

SEQ ID NO: 625996 - RNA, 23 nt, Homo sapiens
aaaaguucagggaccguccaggg

SEQ ID NO: 625997 - RNA, 13 nt, Homo sapiens
aaaaguugugauu

SEQ ID NO: 625998 - RNA, 14 nt, Homo sapiens
aaaaguuguuuguu

SEQ ID NO: 625999 - RNA, 18 nt, Homo sapiens
aaaaguuuacaacuugau

SEQ ID NO: 626000 - RNA, 16 nt, Homo sapiens
aaaaguuucuuaagga

SEQ ID NO: 626001 - RNA, 16 nt, Homo sapiens
aaaaguuuugaugaaa

SEQ ID NO: 626002 - RNA, 22 nt, Homo sapiens
aaaauaaaaaagaucuccaagc

SEQ ID NO: 626003 - RNA, 15 nt, Homo sapiens
aaaauaaacaucagu

SEQ ID NO: 626004 - RNA, 15 nt, Homo sapiens
aaaauaaauguacau

SEQ ID NO: 626005 - RNA, 13 nt, Homo sapiens
aaaauaaauuaca

SEQ ID NO: 626006 - RNA, 13 nt, Homo sapiens
aaaauaaauucaa

SEQ ID NO: 626007 - RNA, 12 nt, Homo sapiens
aaaauaaauucc

SEQ ID NO: 626008 - RNA, 12 nt, Homo sapiens
aaaauaaucuau

SEQ ID NO: 626009 - RNA, 20 nt, Homo sapiens
aaaauaauuauaaauaucau

SEQ ID NO: 626010 - RNA, 16 nt, Homo sapiens
aaaauaccagccagua

SEQ ID NO: 626011 - RNA, 18 nt, Homo sapiens
aaaauaccuucugaacua

SEQ ID NO: 626012 - RNA, 20 nt, Homo sapiens
aaaauaccuuuguaacggcu

SEQ ID NO: 626013 - RNA, 22 nt, Homo sapiens
aaaauacuuuugcuuucaggga

SEQ ID NO: 626014 - RNA, 16 nt, Homo sapiens
aaaauagaaacuugcu

SEQ ID NO: 626015 - RNA, 17 nt, Homo sapiens
aaaauagaugguguaug

SEQ ID NO: 626016 - RNA, 19 nt, Homo sapiens
aaaauagccuauccuuaau

SEQ ID NO: 626017 - RNA, 19 nt, Homo sapiens
aaaauaggauugcuucaau

SEQ ID NO: 626018 - RNA, 16 nt, Homo sapiens
aaaauauaaccauuac

SEQ ID NO: 626019 - RNA, 13 nt, Homo sapiens
aaaauauaaucua

SEQ ID NO: 626020 - RNA, 19 nt, Homo sapiens
aaaauauaauuuacauuaa

SEQ ID NO: 626021 - RNA, 15 nt, Homo sapiens
aaaauauacauucaa

SEQ ID NO: 626022 - RNA, 16 nt, Homo sapiens
aaaauauagacauucu

SEQ ID NO: 626023 - RNA, 14 nt, Homo sapiens
aaaauauagcugua

SEQ ID NO: 626024 - RNA, 22 nt, Homo sapiens
aaaauaugaaaaaaagaaauga

SEQ ID NO: 626025 - RNA, 21 nt, Homo sapiens
aaaauaugugcuugaaaugag

SEQ ID NO: 626026 - RNA, 15 nt, Homo sapiens
aaaauauuguuucug

SEQ ID NO: 626027 - RNA, 14 nt, Homo sapiens
aaaaucaacuguau

SEQ ID NO: 626028 - RNA, 13 nt, Homo sapiens
aaaaucacaaaaa

SEQ ID NO: 626029 - RNA, 22 nt, Homo sapiens
aaaaucacacagccaagccagu

SEQ ID NO: 626030 - RNA, 12 nt, Homo sapiens
aaaaucacucaa

SEQ ID NO: 626031 - RNA, 19 nt, Homo sapiens
aaaaucacucucagugcuu

SEQ ID NO: 626032 - RNA, 19 nt, Homo sapiens
aaaaucagccugcuccagc

SEQ ID NO: 626033 - RNA, 19 nt, Homo sapiens
aaaaucaugccauugcacu

SEQ ID NO: 626034 - RNA, 16 nt, Homo sapiens
aaaaucauggaaagac

SEQ ID NO: 626035 - RNA, 20 nt, Homo sapiens
aaaaucauucuacugaacag

SEQ ID NO: 626036 - RNA, 21 nt, Homo sapiens
aaaaucauuuuauaugucaaa

SEQ ID NO: 626037 - RNA, 19 nt, Homo sapiens
aaaauccccuguugugugg

SEQ ID NO: 626038 - RNA, 16 nt, Homo sapiens
aaaauccuaacauuca

SEQ ID NO: 626039 - RNA, 15 nt, Homo sapiens
aaaauccuaaggaac

SEQ ID NO: 626040 - RNA, 18 nt, Homo sapiens
aaaauccugaacuuucuc

SEQ ID NO: 626041 - RNA, 15 nt, Homo sapiens
aaaauccuggaagac

SEQ ID NO: 626042 - RNA, 12 nt, Homo sapiens
aaaaucuacuuu

SEQ ID NO: 626043 - RNA, 12 nt, Homo sapiens
aaaaucuagagg

SEQ ID NO: 626044 - RNA, 14 nt, Homo sapiens
aaaaucucccaaag

SEQ ID NO: 626045 - RNA, 20 nt, Homo sapiens
aaaaucuguuauagcuuuaa

SEQ ID NO: 626046 - RNA, 18 nt, Homo sapiens
aaaaucuucuagcauguu

SEQ ID NO: 626047 - RNA, 23 nt, Homo sapiens
aaaaugaaaagcuuaggaccaga

SEQ ID NO: 626048 - RNA, 15 nt, Homo sapiens
aaaaugaaaauucua

SEQ ID NO: 626049 - RNA, 14 nt, Homo sapiens
aaaaugaaaggaag

SEQ ID NO: 626050 - RNA, 20 nt, Homo sapiens
aaaaugaaaggaaguuucag

SEQ ID NO: 626051 - RNA, 11 nt, Homo sapiens
aaaaugaagga

SEQ ID NO: 626052 - RNA, 23 nt, Homo sapiens
aaaaugaaggaaaagcauguuau

SEQ ID NO: 626053 - RNA, 11 nt, Homo sapiens
aaaaugaauuu

SEQ ID NO: 626054 - RNA, 11 nt, Homo sapiens
aaaaugacaaa

SEQ ID NO: 626055 - RNA, 17 nt, Homo sapiens
aaaaugacaaugaugau

SEQ ID NO: 626056 - RNA, 17 nt, Homo sapiens
aaaaugauaaacaaguc

SEQ ID NO: 626057 - RNA, 21 nt, Homo sapiens
aaaaugauuuuaucugugaau

SEQ ID NO: 626058 - RNA, 17 nt, Homo sapiens
aaaaugcagaacuuaau

SEQ ID NO: 626059 - RNA, 22 nt, Homo sapiens
aaaaugcagcagggaugcccug

SEQ ID NO: 626060 - RNA, 16 nt, Homo sapiens
aaaaugccacucccua

SEQ ID NO: 626061 - RNA, 18 nt, Homo sapiens
aaaaugccucaauucaca

SEQ ID NO: 626062 - RNA, 18 nt, Homo sapiens
aaaaugccucaguguauu

SEQ ID NO: 626063 - RNA, 18 nt, Homo sapiens
aaaaugcgagacucugau

SEQ ID NO: 626064 - RNA, 19 nt, Homo sapiens
aaaaugcugaacauugcau

SEQ ID NO: 626065 - RNA, 19 nt, Homo sapiens
aaaauggacaaaauccaug

SEQ ID NO: 626066 - RNA, 22 nt, Homo sapiens
aaaaugggagacagccucuuac

SEQ ID NO: 626067 - RNA, 18 nt, Homo sapiens
aaaaugguaauuguugcu

SEQ ID NO: 626068 - RNA, 14 nt, Homo sapiens
aaaauggucaucca

SEQ ID NO: 626069 - RNA, 16 nt, Homo sapiens
aaaauggucucuaaca

SEQ ID NO: 626070 - RNA, 20 nt, Homo sapiens
aaaaugguguuuucauguaa

SEQ ID NO: 626071 - RNA, 18 nt, Homo sapiens
aaaauguaagaaaagcug

SEQ ID NO: 626072 - RNA, 14 nt, Homo sapiens
aaaauguacucagc

SEQ ID NO: 626073 - RNA, 17 nt, Homo sapiens
aaaauguauauuuugau

SEQ ID NO: 626074 - RNA, 15 nt, Homo sapiens
aaaauguccugccuu

SEQ ID NO: 626075 - RNA, 16 nt, Homo sapiens
aaaauguccugccuuu

SEQ ID NO: 626076 - RNA, 17 nt, Homo sapiens
aaaauguccugccuuuu

SEQ ID NO: 626077 - RNA, 20 nt, Homo sapiens
aaaaugucuguuaacuuaau

SEQ ID NO: 626078 - RNA, 16 nt, Homo sapiens
aaaaugucuguuucaa

SEQ ID NO: 626079 - RNA, 18 nt, Homo sapiens
aaaaugucuuaaugcaaa

SEQ ID NO: 626080 - RNA, 19 nt, Homo sapiens
aaaaugugcuauacugcau

SEQ ID NO: 626081 - RNA, 18 nt, Homo sapiens
aaaauguguccuaucuau

SEQ ID NO: 626082 - RNA, 18 nt, Homo sapiens
aaaauguuauuaugucaa

SEQ ID NO: 626083 - RNA, 22 nt, Homo sapiens
aaaauguucuguuugcugugga

SEQ ID NO: 626084 - RNA, 15 nt, Homo sapiens
aaaauguucuuacac

SEQ ID NO: 626085 - RNA, 19 nt, Homo sapiens
aaaauguugagaaucccaa

SEQ ID NO: 626086 - RNA, 22 nt, Homo sapiens
aaaauguuuuccccaaaccaua

SEQ ID NO: 626087 - RNA, 16 nt, Homo sapiens
aaaauuaaaauggaug

SEQ ID NO: 626088 - RNA, 16 nt, Homo sapiens
aaaauuaauagcuuuu

SEQ ID NO: 626089 - RNA, 16 nt, Homo sapiens
aaaauuagacugugau

SEQ ID NO: 626090 - RNA, 23 nt, Homo sapiens
aaaauuagccaggcaugguggca

SEQ ID NO: 626091 - RNA, 13 nt, Homo sapiens
aaaauuagugagu

SEQ ID NO: 626092 - RNA, 13 nt, Homo sapiens
aaaauuauucaaa

SEQ ID NO: 626093 - RNA, 23 nt, Homo sapiens
aaaauuauuuaaaccgcuaaaag

SEQ ID NO: 626094 - RNA, 13 nt, Homo sapiens
aaaauucaaagca

SEQ ID NO: 626095 - RNA, 16 nt, Homo sapiens
aaaauucacaaauggg

SEQ ID NO: 626096 - RNA, 20 nt, Homo sapiens
aaaauucacaagcuaacuuc

SEQ ID NO: 626097 - RNA, 13 nt, Homo sapiens
aaaauucacauga

SEQ ID NO: 626098 - RNA, 14 nt, Homo sapiens
aaaauucagaugcu

SEQ ID NO: 626099 - RNA, 18 nt, Homo sapiens
aaaauucauuucuaauua

SEQ ID NO: 626100 - RNA, 19 nt, Homo sapiens
aaaauucucuuaaucacua

SEQ ID NO: 626101 - RNA, 14 nt, Homo sapiens
aaaauugacaauga

SEQ ID NO: 626102 - RNA, 21 nt, Homo sapiens
aaaauugcaguuucauguaug

SEQ ID NO: 626103 - RNA, 17 nt, Homo sapiens
aaaauugcuauguuacu

SEQ ID NO: 626104 - RNA, 14 nt, Homo sapiens
aaaauuguagcuuu

SEQ ID NO: 626105 - RNA, 11 nt, Homo sapiens
aaaauugugaa

SEQ ID NO: 626106 - RNA, 17 nt, Homo sapiens
aaaauugugaucagacc

SEQ ID NO: 626107 - RNA, 18 nt, Homo sapiens
aaaauuguuuaccauaga

SEQ ID NO: 626108 - RNA, 21 nt, Homo sapiens
aaaauuuaggaccaauaccuc

SEQ ID NO: 626109 - RNA, 16 nt, Homo sapiens
aaaauuugaaaauguc

SEQ ID NO: 626110 - RNA, 14 nt, Homo sapiens
aaaauuugucuuaa

SEQ ID NO: 626111 - RNA, 18 nt, Homo sapiens
aaaauuuguuuugacgga

SEQ ID NO: 626112 - RNA, 20 nt, Homo sapiens
aaacaaaauggguuacuuga

SEQ ID NO: 626113 - RNA, 10 nt, Homo sapiens
aaacaaagug

SEQ ID NO: 626114 - RNA, 21 nt, Homo sapiens
aaacaaauaaucacauugacu

SEQ ID NO: 626115 - RNA, 14 nt, Homo sapiens
aaacaaauaugcaa

SEQ ID NO: 626116 - RNA, 16 nt, Homo sapiens
aaacaaaucaguuggc

SEQ ID NO: 626117 - RNA, 15 nt, Homo sapiens
aaacaacagauguac

SEQ ID NO: 626118 - RNA, 12 nt, Homo sapiens
aaacaacagcuu

SEQ ID NO: 626119 - RNA, 23 nt, Homo sapiens
aaacaacuuucuccuacucuucc

SEQ ID NO: 626120 - RNA, 20 nt, Homo sapiens
aaacaagaaaccaagugggc

SEQ ID NO: 626121 - RNA, 19 nt, Homo sapiens
aaacaagcaaugggcaaug

SEQ ID NO: 626122 - RNA, 12 nt, Homo sapiens
aaacaagccuua

SEQ ID NO: 626123 - RNA, 16 nt, Homo sapiens
aaacaaggaagccaaa

SEQ ID NO: 626124 - RNA, 17 nt, Homo sapiens
aaacaauauguuugcaa

SEQ ID NO: 626125 - RNA, 22 nt, Homo sapiens
aaacaaucuguuuuggcuuuau

SEQ ID NO: 626126 - RNA, 18 nt, Homo sapiens
aaacaaugacauccagaa

SEQ ID NO: 626127 - RNA, 22 nt, Homo sapiens
aaacaauuugacuuuuguucca

SEQ ID NO: 626128 - RNA, 17 nt, Homo sapiens
aaacacaaaacaacaaa

SEQ ID NO: 626129 - RNA, 12 nt, Homo sapiens
aaacacagagaa

SEQ ID NO: 626130 - RNA, 17 nt, Homo sapiens
aaacaccaaaaagggau

SEQ ID NO: 626131 - RNA, 22 nt, Homo sapiens
aaacaccaaacucauaacaguc

SEQ ID NO: 626132 - RNA, 13 nt, Homo sapiens
aaacaccauucau

SEQ ID NO: 626133 - RNA, 20 nt, Homo sapiens
aaacacccaugaaucaaaga

SEQ ID NO: 626134 - RNA, 22 nt, Homo sapiens
aaacaccuagcuuuauucuuca

SEQ ID NO: 626135 - RNA, 16 nt, Homo sapiens
aaacaccuucucugga

SEQ ID NO: 626136 - RNA, 22 nt, Homo sapiens
agcucuugcuucagagcagauu

SEQ ID NO: 626137 - RNA, 23 nt, Homo sapiens
agcugaaauuuuagaaauauuca

SEQ ID NO: 626138 - RNA, 14 nt, Homo sapiens
agcugaacaauagg

SEQ ID NO: 626139 - RNA, 14 nt, Homo sapiens
agcugaaccacaga

SEQ ID NO: 626140 - RNA, 15 nt, Homo sapiens
agcugaagcuggugc

SEQ ID NO: 626141 - RNA, 15 nt, Homo sapiens
agcugaauacauucu

SEQ ID NO: 626142 - RNA, 20 nt, Homo sapiens
agcugaaugccuccuguggg

SEQ ID NO: 626143 - RNA, 14 nt, Homo sapiens
agcugacaucucag

SEQ ID NO: 626144 - RNA, 15 nt, Homo sapiens
agcugagaagcaaug

SEQ ID NO: 626145 - RNA, 17 nt, Homo sapiens
agcugagaagcaauggg

SEQ ID NO: 626146 - RNA, 22 nt, Homo sapiens
agcugagacuacaagugugugc

SEQ ID NO: 626147 - RNA, 21 nt, Homo sapiens
agcugagaucacgccacugca

SEQ ID NO: 626148 - RNA, 16 nt, Homo sapiens
agcugagaucgugcua

SEQ ID NO: 626149 - RNA, 15 nt, Homo sapiens
agcugagauggaacc

SEQ ID NO: 626150 - RNA, 22 nt, Homo sapiens
agcugagauugugccacuucac

SEQ ID NO: 626151 - RNA, 16 nt, Homo sapiens
agcugaggccuaugca

SEQ ID NO: 626152 - RNA, 17 nt, Homo sapiens
agcugaggccuaugcag

SEQ ID NO: 626153 - RNA, 19 nt, Homo sapiens
agcugagggacguggugcc

SEQ ID NO: 626154 - RNA, 23 nt, Homo sapiens
agcugagguuuagaugugcaacc

SEQ ID NO: 626155 - RNA, 19 nt, Homo sapiens
agcugagguuugcacuucc

SEQ ID NO: 626156 - RNA, 17 nt, Homo sapiens
agcugagugcugaaaua

SEQ ID NO: 626157 - RNA, 21 nt, Homo sapiens
agcugaguggccagccagugc

SEQ ID NO: 626158 - RNA, 23 nt, Homo sapiens
agcugaguuuccuaugggaacaa

SEQ ID NO: 626159 - RNA, 14 nt, Homo sapiens
agcugauccagaug

SEQ ID NO: 626160 - RNA, 20 nt, Homo sapiens
agcugauguuuugguguauu

SEQ ID NO: 626161 - RNA, 16 nt, Homo sapiens
agcugauuaaaacaca

SEQ ID NO: 626162 - RNA, 15 nt, Homo sapiens
agcugauucacuaug

SEQ ID NO: 626163 - RNA, 15 nt, Homo sapiens
agcugcacagcaaaa

SEQ ID NO: 626164 - RNA, 19 nt, Homo sapiens
agcugcacugaucacccaa

SEQ ID NO: 626165 - RNA, 19 nt, Homo sapiens
agcugcagaugccacaccu

SEQ ID NO: 626166 - RNA, 23 nt, Homo sapiens
agcugcaggcuuugccauuguga

SEQ ID NO: 626167 - RNA, 12 nt, Homo sapiens
agcugcauauga

SEQ ID NO: 626168 - RNA, 17 nt, Homo sapiens
agcugcauggagccugg

SEQ ID NO: 626169 - RNA, 20 nt, Homo sapiens
agcugcaugggugccugcug

SEQ ID NO: 626170 - RNA, 12 nt, Homo sapiens
agcugcauuaaa

SEQ ID NO: 626171 - RNA, 15 nt, Homo sapiens
agcugccaugucaga

SEQ ID NO: 626172 - RNA, 18 nt, Homo sapiens
agcugccccacaggugug

SEQ ID NO: 626173 - RNA, 22 nt, Homo sapiens
agcugccccuccuggagcagaa

SEQ ID NO: 626174 - RNA, 11 nt, Homo sapiens
agcugcccuag

SEQ ID NO: 626175 - RNA, 20 nt, Homo sapiens
agcugcccuuccugccugau

SEQ ID NO: 626176 - RNA, 18 nt, Homo sapiens
agcugccuccuggucucu

SEQ ID NO: 626177 - RNA, 14 nt, Homo sapiens
agcugccucucuca

SEQ ID NO: 626178 - RNA, 15 nt, Homo sapiens
agcugccucugcucc

SEQ ID NO: 626179 - RNA, 16 nt, Homo sapiens
agcugccugcagcaca

SEQ ID NO: 626180 - RNA, 14 nt, Homo sapiens
agcugccuguuucc

SEQ ID NO: 626181 - RNA, 13 nt, Homo sapiens
agcugcucaggga

SEQ ID NO: 626182 - RNA, 23 nt, Homo sapiens
agcugcuccgaggacccaggaaa

SEQ ID NO: 626183 - RNA, 15 nt, Homo sapiens
agcugcucugagcca

SEQ ID NO: 626184 - RNA, 13 nt, Homo sapiens
agcugcucuggaa

SEQ ID NO: 626185 - RNA, 15 nt, Homo sapiens
agcugcugacugcca

SEQ ID NO: 626186 - RNA, 21 nt, Homo sapiens
agcugcugcuggaucacagcu

SEQ ID NO: 626187 - RNA, 13 nt, Homo sapiens
agcugcugggcua

SEQ ID NO: 626188 - RNA, 15 nt, Homo sapiens
agcugcuuugagcua

SEQ ID NO: 626189 - RNA, 18 nt, Homo sapiens
agcuggaaaaaguguccu

SEQ ID NO: 626190 - RNA, 14 nt, Homo sapiens
agcuggaaaaccuc

SEQ ID NO: 626191 - RNA, 17 nt, Homo sapiens
agcuggaaaagggucuu

SEQ ID NO: 626192 - RNA, 22 nt, Homo sapiens
agcuggaagggucaacaucuuu

SEQ ID NO: 626193 - RNA, 23 nt, Homo sapiens
agcuggaagggucaacaucuuuu

SEQ ID NO: 626194 - RNA, 17 nt, Homo sapiens
agcuggacuaguguccu

SEQ ID NO: 626195 - RNA, 22 nt, Homo sapiens
agcuggagcagcggauugcucu

SEQ ID NO: 626196 - RNA, 17 nt, Homo sapiens
agcuggagcucuuggaa

SEQ ID NO: 626197 - RNA, 17 nt, Homo sapiens
agcuggaggcaucacgc

SEQ ID NO: 626198 - RNA, 15 nt, Homo sapiens
agcuggagugcugcu

SEQ ID NO: 626199 - RNA, 17 nt, Homo sapiens
agcuggauauaauguau

SEQ ID NO: 626200 - RNA, 17 nt, Homo sapiens
agcuggauuacaggcau

SEQ ID NO: 626201 - RNA, 14 nt, Homo sapiens
agcuggcaaaggug

SEQ ID NO: 626202 - RNA, 13 nt, Homo sapiens
agcuggcugugcc

SEQ ID NO: 626203 - RNA, 20 nt, Homo sapiens
agcuggcuuuucccauuuca

SEQ ID NO: 626204 - RNA, 13 nt, Homo sapiens
agcugggagacaa

SEQ ID NO: 626205 - RNA, 12 nt, Homo sapiens
agcugggagcac

SEQ ID NO: 626206 - RNA, 14 nt, Homo sapiens
agcugggagccugg

SEQ ID NO: 626207 - RNA, 22 nt, Homo sapiens
agcugggauaaucacauuauca

SEQ ID NO: 626208 - RNA, 23 nt, Homo sapiens
agcugggauaaucacauuaucau

SEQ ID NO: 626209 - RNA, 14 nt, Homo sapiens
agcugggauuacag

SEQ ID NO: 626210 - RNA, 17 nt, Homo sapiens
agcugggauuacaggcg

SEQ ID NO: 626211 - RNA, 17 nt, Homo sapiens
agcugggcaaagccaca

SEQ ID NO: 626212 - RNA, 22 nt, Homo sapiens
agcugggcaaagccacaaggcu

SEQ ID NO: 626213 - RNA, 17 nt, Homo sapiens
agcugggccugugcacu

SEQ ID NO: 626214 - RNA, 19 nt, Homo sapiens
agcuggggacaacugcggu

SEQ ID NO: 626215 - RNA, 14 nt, Homo sapiens
aauaagcucaguga

SEQ ID NO: 626216 - RNA, 18 nt, Homo sapiens
aauaaggaaacgaugaaa

SEQ ID NO: 626217 - RNA, 19 nt, Homo sapiens
aauaaguacuguguacaga

SEQ ID NO: 626218 - RNA, 17 nt, Homo sapiens
aauaagugcauuuguaa

SEQ ID NO: 626219 - RNA, 15 nt, Homo sapiens
aauaauaagugaugu

SEQ ID NO: 626220 - RNA, 17 nt, Homo sapiens
aauaauacaacuccuau

SEQ ID NO: 626221 - RNA, 16 nt, Homo sapiens
aauaauacaccagaga

SEQ ID NO: 626222 - RNA, 15 nt, Homo sapiens
aauaauauacaugca

SEQ ID NO: 626223 - RNA, 21 nt, Homo sapiens
aauaaucaacugaauugcaaa

SEQ ID NO: 626224 - RNA, 20 nt, Homo sapiens
aauaaucacgcuuuccugaa

SEQ ID NO: 626225 - RNA, 21 nt, Homo sapiens
aauaaucaucccuccuugccu

SEQ ID NO: 626226 - RNA, 23 nt, Homo sapiens
aauaaucaucccuccuugccuag

SEQ ID NO: 626227 - RNA, 16 nt, Homo sapiens
aauaaucccaaggcaa

SEQ ID NO: 626228 - RNA, 17 nt, Homo sapiens
aauaaucccaaggcaaa

SEQ ID NO: 626229 - RNA, 21 nt, Homo sapiens
aauaaucccaaggcaaaucuc

SEQ ID NO: 626230 - RNA, 15 nt, Homo sapiens
aauaaucuauauuaa

SEQ ID NO: 626231 - RNA, 16 nt, Homo sapiens
aauaaugaacacuaca

SEQ ID NO: 626232 - RNA, 17 nt, Homo sapiens
aauaaugaauacauuuc

SEQ ID NO: 626233 - RNA, 15 nt, Homo sapiens
aauaaugcaaacuuu

SEQ ID NO: 626234 - RNA, 16 nt, Homo sapiens
aauaauggcccuuaau

SEQ ID NO: 626235 - RNA, 16 nt, Homo sapiens
aauaauguacaucugg

SEQ ID NO: 626236 - RNA, 22 nt, Homo sapiens
aauaauuacccacaaaugccac

SEQ ID NO: 626237 - RNA, 17 nt, Homo sapiens
aauaauucuucaccuaa

SEQ ID NO: 626238 - RNA, 12 nt, Homo sapiens
aauaauucuucc

SEQ ID NO: 626239 - RNA, 12 nt, Homo sapiens
aauaauugcuca

SEQ ID NO: 626240 - RNA, 15 nt, Homo sapiens
aauaauuguuccaaa

SEQ ID NO: 626241 - RNA, 22 nt, Homo sapiens
aauaauuuagacuucaagcaug

SEQ ID NO: 626242 - RNA, 16 nt, Homo sapiens
aauacaaaaaugagcu

SEQ ID NO: 626243 - RNA, 16 nt, Homo sapiens
aauacaaaaggcauuu

SEQ ID NO: 626244 - RNA, 12 nt, Homo sapiens
aauacaaacuau

SEQ ID NO: 626245 - RNA, 13 nt, Homo sapiens
aauacaacacuga

SEQ ID NO: 626246 - RNA, 19 nt, Homo sapiens
aauacaacagugcauuuac

SEQ ID NO: 626247 - RNA, 13 nt, Homo sapiens
aauacaaccagcc

SEQ ID NO: 626248 - RNA, 20 nt, Homo sapiens
aauacaauggguaucgcuga

SEQ ID NO: 626249 - RNA, 20 nt, Homo sapiens
aauacaauggucauuuccag

SEQ ID NO: 626250 - RNA, 23 nt, Homo sapiens
aauacacagaugauaauaugcua

SEQ ID NO: 626251 - RNA, 21 nt, Homo sapiens
aauacacuauuaucuucuuaa

SEQ ID NO: 626252 - RNA, 20 nt, Homo sapiens
aauacagauagauauaugcu

SEQ ID NO: 626253 - RNA, 15 nt, Homo sapiens
aauacagaucaucuu

SEQ ID NO: 626254 - RNA, 15 nt, Homo sapiens
aauacaggggugaaa

SEQ ID NO: 626255 - RNA, 19 nt, Homo sapiens
aauacaggggugaaagggg

SEQ ID NO: 626256 - RNA, 13 nt, Homo sapiens
aauacagucuucc

SEQ ID NO: 626257 - RNA, 11 nt, Homo sapiens
aauacagugaa

SEQ ID NO: 626258 - RNA, 13 nt, Homo sapiens
aauacaguucugc

SEQ ID NO: 626259 - RNA, 15 nt, Homo sapiens
aauacauaagaccau

SEQ ID NO: 626260 - RNA, 22 nt, Homo sapiens
aauacauauaucuacacauaca

SEQ ID NO: 626261 - RNA, 21 nt, Homo sapiens
aauacauaucgcugacuucau

SEQ ID NO: 626262 - RNA, 13 nt, Homo sapiens
aauacaugcacac

SEQ ID NO: 626263 - RNA, 15 nt, Homo sapiens
aauacaugcaucuca

SEQ ID NO: 626264 - RNA, 16 nt, Homo sapiens
aauacauguaccuaua

SEQ ID NO: 626265 - RNA, 17 nt, Homo sapiens
aauacauuucaauuaua

SEQ ID NO: 626266 - RNA, 17 nt, Homo sapiens
aauaccagugaaccaaa

SEQ ID NO: 626267 - RNA, 20 nt, Homo sapiens
aauaccagugaaccaaagag

SEQ ID NO: 626268 - RNA, 19 nt, Homo sapiens
aauaccuucugaacuacac

SEQ ID NO: 626269 - RNA, 22 nt, Homo sapiens
aauaccuuggcugauguugcag

SEQ ID NO: 626270 - RNA, 18 nt, Homo sapiens
aauaccuuggucucaccu

SEQ ID NO: 626271 - RNA, 15 nt, Homo sapiens
aauaccuuuucucac

SEQ ID NO: 626272 - RNA, 20 nt, Homo sapiens
aauacuacugacguccuccc

SEQ ID NO: 626273 - RNA, 18 nt, Homo sapiens
aauacuauacagccauaa

SEQ ID NO: 626274 - RNA, 20 nt, Homo sapiens
aauacuauacagccauaaaa

SEQ ID NO: 626275 - RNA, 22 nt, Homo sapiens
aauacuauauuuauacuguaua

SEQ ID NO: 626276 - RNA, 11 nt, Homo sapiens
aauacuaugua

SEQ ID NO: 626277 - RNA, 20 nt, Homo sapiens
aauacuccagagacagggaa

SEQ ID NO: 626278 - RNA, 15 nt, Homo sapiens
aauacuccagcaccu

SEQ ID NO: 626279 - RNA, 14 nt, Homo sapiens
aauacuccuaagac

SEQ ID NO: 626280 - RNA, 21 nt, Homo sapiens
aauacucuugaaauguagaau

SEQ ID NO: 626281 - RNA, 13 nt, Homo sapiens
aauacugagccau

SEQ ID NO: 626282 - RNA, 20 nt, Homo sapiens
aauacuguaaaugcauugga

SEQ ID NO: 626283 - RNA, 15 nt, Homo sapiens
aauacuguauuugag

SEQ ID NO: 626284 - RNA, 13 nt, Homo sapiens
aauacuguuucca

SEQ ID NO: 626285 - RNA, 14 nt, Homo sapiens
aauacuuaacucaa

SEQ ID NO: 626286 - RNA, 21 nt, Homo sapiens
aauacuuaccgagucagacuu

SEQ ID NO: 626287 - RNA, 14 nt, Homo sapiens
aauacuucucucuc

SEQ ID NO: 626288 - RNA, 23 nt, Homo sapiens
aauacuuugcagcacagcugaga

SEQ ID NO: 626289 - RNA, 14 nt, Homo sapiens
aauacuuugcuuca

SEQ ID NO: 626290 - RNA, 16 nt, Homo sapiens
aauacuuugcuucaua

SEQ ID NO: 626291 - RNA, 20 nt, Homo sapiens
aauacuuuugcugaugcuuu

SEQ ID NO: 626292 - RNA, 21 nt, Homo sapiens
aauacuuuuuuuuuaaagcca

SEQ ID NO: 626293 - RNA, 16 nt, Homo sapiens
aauagaaauaaauucc

SEQ ID NO: 626294 - RNA, 13 nt, Homo sapiens
aauagaacacagu

SEQ ID NO: 626295 - RNA, 16 nt, Homo sapiens
aauagaaccacuauga

SEQ ID NO: 626296 - RNA, 14 nt, Homo sapiens
aauagaauaaucua

SEQ ID NO: 626297 - RNA, 21 nt, Homo sapiens
aauagaauauaauuaucggaa

SEQ ID NO: 626298 - RNA, 14 nt, Homo sapiens
aauagacaaaaagu

SEQ ID NO: 626299 - RNA, 15 nt, Homo sapiens
aauagacacugggga

SEQ ID NO: 626300 - RNA, 17 nt, Homo sapiens
aauagacauacagagau

SEQ ID NO: 626301 - RNA, 21 nt, Homo sapiens
aauagacauuucuccaaagaa

SEQ ID NO: 626302 - RNA, 15 nt, Homo sapiens
aauagagacuguaga

SEQ ID NO: 626303 - RNA, 15 nt, Homo sapiens
aauagagcaaccagu

SEQ ID NO: 626304 - RNA, 20 nt, Homo sapiens
aauagaggugaugcugcuaa

SEQ ID NO: 626305 - RNA, 17 nt, Homo sapiens
aauagauaaacuauaca

SEQ ID NO: 626306 - RNA, 12 nt, Homo sapiens
aauagauaugaa

SEQ ID NO: 626307 - RNA, 13 nt, Homo sapiens
aauagauggaauu

SEQ ID NO: 626308 - RNA, 21 nt, Homo sapiens
aauagauuguuuugccacuua

SEQ ID NO: 626309 - RNA, 22 nt, Homo sapiens
aauagauuuuugauucagcuca

SEQ ID NO: 626310 - RNA, 15 nt, Homo sapiens
aauagcauuugccac

SEQ ID NO: 626311 - RNA, 20 nt, Homo sapiens
aauagcuauauccauguacu

SEQ ID NO: 626312 - RNA, 20 nt, Homo sapiens
aauagcuccgaccuccauga

SEQ ID NO: 626313 - RNA, 18 nt, Homo sapiens
aauagcugccuucaagga

SEQ ID NO: 626314 - RNA, 12 nt, Homo sapiens
aauagcugcuag

SEQ ID NO: 626315 - RNA, 20 nt, Homo sapiens
aauagcuguuuuguguauau

SEQ ID NO: 626316 - RNA, 22 nt, Homo sapiens
aauaggaguggguauuaugcaa

SEQ ID NO: 626317 - RNA, 15 nt, Homo sapiens
aauagguagagucau

SEQ ID NO: 626318 - RNA, 17 nt, Homo sapiens
aauaguaccuucaauac

SEQ ID NO: 626319 - RNA, 20 nt, Homo sapiens
aauaguaccuucaauacuua

SEQ ID NO: 626320 - RNA, 19 nt, Homo sapiens
aauaguauuacccauggga

SEQ ID NO: 626321 - RNA, 14 nt, Homo sapiens
aauaguauuuauga

SEQ ID NO: 626322 - RNA, 21 nt, Homo sapiens
aauagucuagauggcuccucu

SEQ ID NO: 626323 - RNA, 13 nt, Homo sapiens
aauagucuucuca

SEQ ID NO: 626324 - RNA, 15 nt, Homo sapiens
aauagugccaggaaa

SEQ ID NO: 626325 - RNA, 22 nt, Homo sapiens
aauagugucaccaauuccacca

SEQ ID NO: 626326 - RNA, 15 nt, Homo sapiens
aauagugucauccuc

SEQ ID NO: 626327 - RNA, 21 nt, Homo sapiens
aauauaaaacuguacuucacu

SEQ ID NO: 626328 - RNA, 22 nt, Homo sapiens
aauauaaaaggcaaauguguac

SEQ ID NO: 626329 - RNA, 14 nt, Homo sapiens
aaucagaugcagcu

SEQ ID NO: 626330 - RNA, 17 nt, Homo sapiens
aaucagauuagccugua

SEQ ID NO: 626331 - RNA, 20 nt, Homo sapiens
aaucagcaaaaugguccugu

SEQ ID NO: 626332 - RNA, 13 nt, Homo sapiens
aaucagcaauaaa

SEQ ID NO: 626333 - RNA, 14 nt, Homo sapiens
aaucagcaggaugu

SEQ ID NO: 626334 - RNA, 17 nt, Homo sapiens
aaucagcauucucacuc

SEQ ID NO: 626335 - RNA, 20 nt, Homo sapiens
aaucagcugcuacuacuccu

SEQ ID NO: 626336 - RNA, 17 nt, Homo sapiens
aaucaggaaccacagau

SEQ ID NO: 626337 - RNA, 19 nt, Homo sapiens
aaucaggaauauuuuccaa

SEQ ID NO: 626338 - RNA, 18 nt, Homo sapiens
aaucaguaaauaguguca

SEQ ID NO: 626339 - RNA, 21 nt, Homo sapiens
aaucagugaagccaaagggac

SEQ ID NO: 626340 - RNA, 17 nt, Homo sapiens
aaggcguccauguuuau

SEQ ID NO: 626341 - RNA, 17 nt, Homo sapiens
aaggcguccuuuuggua

SEQ ID NO: 626342 - RNA, 17 nt, Homo sapiens
aaggcuaaaaagcaaca

SEQ ID NO: 626343 - RNA, 20 nt, Homo sapiens
aaggcuacaguaaccaaaac

SEQ ID NO: 626344 - RNA, 18 nt, Homo sapiens
aaggcucaaggcugugca

SEQ ID NO: 626345 - RNA, 15 nt, Homo sapiens
aaggcucacaccuca

SEQ ID NO: 626346 - RNA, 21 nt, Homo sapiens
aaggcucagucgcuagcauuu

SEQ ID NO: 626347 - RNA, 14 nt, Homo sapiens
aaggcucauuuaaa

SEQ ID NO: 626348 - RNA, 23 nt, Homo sapiens
aaggcucgauuuuguaucugcag

SEQ ID NO: 626349 - RNA, 22 nt, Homo sapiens
aaggcucugagcaaauguggcu

SEQ ID NO: 626350 - RNA, 21 nt, Homo sapiens
aaggcucuuacccccuuuuaa

SEQ ID NO: 626351 - RNA, 18 nt, Homo sapiens
aaggcugacagacucacu

SEQ ID NO: 626352 - RNA, 16 nt, Homo sapiens
aaggcugcacagcuca

SEQ ID NO: 626353 - RNA, 13 nt, Homo sapiens
aaggcugcuguga

SEQ ID NO: 626354 - RNA, 20 nt, Homo sapiens
aaggcugcuuagaauccaaa

SEQ ID NO: 626355 - RNA, 21 nt, Homo sapiens
aaggcugugagccaaggaggg

SEQ ID NO: 626356 - RNA, 18 nt, Homo sapiens
aaggcugugcaggcacau

SEQ ID NO: 626357 - RNA, 15 nt, Homo sapiens
aaggcuuuaucucag

SEQ ID NO: 626358 - RNA, 15 nt, Homo sapiens
aaggcuuugaguuaa

SEQ ID NO: 626359 - RNA, 15 nt, Homo sapiens
aaggcuuugccaugg

SEQ ID NO: 626360 - RNA, 16 nt, Homo sapiens
aagggaaacaggcuaa

SEQ ID NO: 626361 - RNA, 16 nt, Homo sapiens
aagggaaagauaauaa

SEQ ID NO: 626362 - RNA, 16 nt, Homo sapiens
aagggaaauuguuuau

SEQ ID NO: 626363 - RNA, 22 nt, Homo sapiens
aagggaaccauguauaugagcu

SEQ ID NO: 626364 - RNA, 14 nt, Homo sapiens
aagggaacuaugga

SEQ ID NO: 626365 - RNA, 18 nt, Homo sapiens
aagggaagugaggcccaa

SEQ ID NO: 626366 - RNA, 14 nt, Homo sapiens
aagggaauccuccu

SEQ ID NO: 626367 - RNA, 20 nt, Homo sapiens
aagggaauuucuucaacucc

SEQ ID NO: 626368 - RNA, 21 nt, Homo sapiens
aagggacccagaauauccaaa

SEQ ID NO: 626369 - RNA, 19 nt, Homo sapiens
aagggacuaggagcacugu

SEQ ID NO: 626370 - RNA, 15 nt, Homo sapiens
aagggagaaaugcca

SEQ ID NO: 626371 - RNA, 13 nt, Homo sapiens
aagggagugcaug

SEQ ID NO: 626372 - RNA, 21 nt, Homo sapiens
aagggauaaucaucucuguca

SEQ ID NO: 626373 - RNA, 17 nt, Homo sapiens
aagggauaguccaaaga

SEQ ID NO: 626374 - RNA, 18 nt, Homo sapiens
aagggauaguccaaagac

SEQ ID NO: 626375 - RNA, 16 nt, Homo sapiens
aagggaucuuccuugg

SEQ ID NO: 626376 - RNA, 19 nt, Homo sapiens
aagggauggaaaaggaaga

SEQ ID NO: 626377 - RNA, 12 nt, Homo sapiens
aagggauugcuu

SEQ ID NO: 626378 - RNA, 17 nt, Homo sapiens
aagggcacucauuugga

SEQ ID NO: 626379 - RNA, 13 nt, Homo sapiens
aagggcacuccca

SEQ ID NO: 626380 - RNA, 19 nt, Homo sapiens
aagggcacucccaacccug

SEQ ID NO: 626381 - RNA, 14 nt, Homo sapiens
aagggcaggaccaa

SEQ ID NO: 626382 - RNA, 13 nt, Homo sapiens
aagggccaggugc

SEQ ID NO: 626383 - RNA, 16 nt, Homo sapiens
aagggccgacuaagag

SEQ ID NO: 626384 - RNA, 15 nt, Homo sapiens
aagggcuccagacac

SEQ ID NO: 626385 - RNA, 19 nt, Homo sapiens
aaggggaaacacagcugau

SEQ ID NO: 626386 - RNA, 15 nt, Homo sapiens
aaggggagaagggaa

SEQ ID NO: 626387 - RNA, 20 nt, Homo sapiens
aaggggagccagaaaugggc

SEQ ID NO: 626388 - RNA, 16 nt, Homo sapiens
aaggggaggaaccaga

SEQ ID NO: 626389 - RNA, 18 nt, Homo sapiens
aaggggauggaggccaga

SEQ ID NO: 626390 - RNA, 22 nt, Homo sapiens
aaggggcccaagccccaucuca

SEQ ID NO: 626391 - RNA, 14 nt, Homo sapiens
aagggggugacugg

SEQ ID NO: 626392 - RNA, 14 nt, Homo sapiens
aaggggugggccac

SEQ ID NO: 626393 - RNA, 18 nt, Homo sapiens
aagggucguuaccagaga

SEQ ID NO: 626394 - RNA, 16 nt, Homo sapiens
aagggugggugcucag

SEQ ID NO: 626395 - RNA, 19 nt, Homo sapiens
aagggugggugcucagaau

SEQ ID NO: 626396 - RNA, 23 nt, Homo sapiens
aaggguguugcuaagcuguaacc

SEQ ID NO: 626397 - RNA, 23 nt, Homo sapiens
aaggguuauagacugccaugcua

SEQ ID NO: 626398 - RNA, 20 nt, Homo sapiens
aaggguucagagacucaggg

SEQ ID NO: 626399 - RNA, 23 nt, Homo sapiens
aaggguuucgacugguccagcuc

SEQ ID NO: 626400 - RNA, 14 nt, Homo sapiens
aagguaacuacugc

SEQ ID NO: 626401 - RNA, 22 nt, Homo sapiens
aagguaauaauacagccaaaga

SEQ ID NO: 626402 - RNA, 20 nt, Homo sapiens
aagguaaugaccaguuguua

SEQ ID NO: 626403 - RNA, 18 nt, Homo sapiens
aagguaauuguagcacau

SEQ ID NO: 626404 - RNA, 13 nt, Homo sapiens
aagguacacuggu

SEQ ID NO: 626405 - RNA, 14 nt, Homo sapiens
aagguacacuggua

SEQ ID NO: 626406 - RNA, 22 nt, Homo sapiens
aagguaccccgauggccaagca

SEQ ID NO: 626407 - RNA, 21 nt, Homo sapiens
aagguauuuuguagaugugau

SEQ ID NO: 626408 - RNA, 13 nt, Homo sapiens
aaggucacuguuu

SEQ ID NO: 626409 - RNA, 22 nt, Homo sapiens
aaggucaggaguucgagaccag

SEQ ID NO: 626410 - RNA, 21 nt, Homo sapiens
aaggucauaagggagcaugau

SEQ ID NO: 626411 - RNA, 16 nt, Homo sapiens
aaggucauccaaagaa

SEQ ID NO: 626412 - RNA, 21 nt, Homo sapiens
aagguccacucccugcuccac

SEQ ID NO: 626413 - RNA, 20 nt, Homo sapiens
aagguccucugucagucaca

SEQ ID NO: 626414 - RNA, 22 nt, Homo sapiens
aagguccugcuauuacuaagga

SEQ ID NO: 626415 - RNA, 16 nt, Homo sapiens
aaggucucuaaagcau

SEQ ID NO: 626416 - RNA, 20 nt, Homo sapiens
aaggucuguacuaacaaagc

SEQ ID NO: 626417 - RNA, 22 nt, Homo sapiens
aaggucuuugacggcaccaucu

SEQ ID NO: 626418 - RNA, 17 nt, Homo sapiens
aaggugaauagcacagg

SEQ ID NO: 626419 - RNA, 20 nt, Homo sapiens
aaggugaaugaaagaucuuc

SEQ ID NO: 626420 - RNA, 12 nt, Homo sapiens
aaggugaccucu

SEQ ID NO: 626421 - RNA, 21 nt, Homo sapiens
aaggugcacauuuuccacgga

SEQ ID NO: 626422 - RNA, 16 nt, Homo sapiens
aaggugccucauagca

SEQ ID NO: 626423 - RNA, 12 nt, Homo sapiens
aaggugcuuccg

SEQ ID NO: 626424 - RNA, 22 nt, Homo sapiens
aaggugggccuugcuaccucaa

SEQ ID NO: 626425 - RNA, 21 nt, Homo sapiens
aagguggggauugcccaucca

SEQ ID NO: 626426 - RNA, 13 nt, Homo sapiens
aagguuaaaccca

SEQ ID NO: 626427 - RNA, 13 nt, Homo sapiens
aagguuaucagug

SEQ ID NO: 626428 - RNA, 11 nt, Homo sapiens
aagguucucug

SEQ ID NO: 626429 - RNA, 14 nt, Homo sapiens
aagguucucugugc

SEQ ID NO: 626430 - RNA, 16 nt, Homo sapiens
aagguuggagauguca

SEQ ID NO: 626431 - RNA, 13 nt, Homo sapiens
aagguugugauga

SEQ ID NO: 626432 - RNA, 21 nt, Homo sapiens
aagguuuuaaccgcacaugca

SEQ ID NO: 626433 - RNA, 23 nt, Homo sapiens
aagguuuuauaaggcugauguca

SEQ ID NO: 626434 - RNA, 15 nt, Homo sapiens
aagguuuucauuugc

SEQ ID NO: 626435 - RNA, 18 nt, Homo sapiens
aagguuuucuucauucau

SEQ ID NO: 626436 - RNA, 17 nt, Homo sapiens
aagguuuuuacugugag

SEQ ID NO: 626437 - RNA, 15 nt, Homo sapiens
aaguaaauguugaca

SEQ ID NO: 626438 - RNA, 15 nt, Homo sapiens
aaguaacauuugccu

SEQ ID NO: 626439 - RNA, 23 nt, Homo sapiens
aaguaacucuuaccuaaacugag

SEQ ID NO: 626440 - RNA, 21 nt, Homo sapiens
aaguaacugaaccauuccaac

SEQ ID NO: 626441 - RNA, 18 nt, Homo sapiens
aaguaacugaauuauuuc

SEQ ID NO: 626442 - RNA, 18 nt, Homo sapiens
aaguaacuucacauuaaa

SEQ ID NO: 626443 - RNA, 19 nt, Homo sapiens
aaguaacuucugacuuacu

SEQ ID NO: 626444 - RNA, 18 nt, Homo sapiens
aaguaaguaccacucagg

SEQ ID NO: 626445 - RNA, 16 nt, Homo sapiens
aaguaauacaaacuaa

SEQ ID NO: 626446 - RNA, 13 nt, Homo sapiens
aaguaaugaugaa

SEQ ID NO: 626447 - RNA, 17 nt, Homo sapiens
aaguaauguuaauucuu

SEQ ID NO: 626448 - RNA, 23 nt, Homo sapiens
aaguaauuaucgggaacaguguu

SEQ ID NO: 626449 - RNA, 22 nt, Homo sapiens
aaguaauuccucucacuaaacu

SEQ ID NO: 626450 - RNA, 24 nt, Homo sapiens
aaguaauuccuguauucuacagca

SEQ ID NO: 626451 - RNA, 23 nt, Homo sapiens
aaguaauuucuuugaucuggaca

SEQ ID NO: 626452 - RNA, 18 nt, Homo sapiens
aaguacaaaauugccuau

SEQ ID NO: 626453 - RNA, 14 nt, Homo sapiens
aaguacaaguauau

SEQ ID NO: 626454 - RNA, 19 nt, Homo sapiens
aaguacaucucuacuaaaa

SEQ ID NO: 626455 - RNA, 18 nt, Homo sapiens
aaguacauguuaaacuua

SEQ ID NO: 626456 - RNA, 16 nt, Homo sapiens
aaguaccaaugcuguu

SEQ ID NO: 626457 - RNA, 20 nt, Homo sapiens
aaaauccaaggcaauuccug

SEQ ID NO: 626458 - RNA, 17 nt, Homo sapiens
aaaauccagaacucaaa

SEQ ID NO: 626459 - RNA, 22 nt, Homo sapiens
aaaauccuauaucuguuuguau

SEQ ID NO: 626460 - RNA, 21 nt, Homo sapiens
aaaauccucacucauucccau

SEQ ID NO: 626461 - RNA, 22 nt, Homo sapiens
aaaaucucagcaaugauuacuc

SEQ ID NO: 626462 - RNA, 22 nt, Homo sapiens
aaaaucugcucuuuguaugaca

SEQ ID NO: 626463 - RNA, 19 nt, Homo sapiens
aaaaucuguaauugauaau

SEQ ID NO: 626464 - RNA, 16 nt, Homo sapiens
aaaaucuguguaacug

SEQ ID NO: 626465 - RNA, 12 nt, Homo sapiens
aaaaucuuggau

SEQ ID NO: 626466 - RNA, 23 nt, Homo sapiens
aaaaugaaaauucuaacccaaga

SEQ ID NO: 626467 - RNA, 24 nt, Homo sapiens
aaaaugaacugaaguuucacauga

SEQ ID NO: 626468 - RNA, 20 nt, Homo sapiens
aaaaugaaguuuugauuuau

SEQ ID NO: 626469 - RNA, 14 nt, Homo sapiens
aaaaugaauaucua

SEQ ID NO: 626470 - RNA, 21 nt, Homo sapiens
aaaaugaaucuucacaaaaca

SEQ ID NO: 626471 - RNA, 18 nt, Homo sapiens
aaaaugaauuugggauac

SEQ ID NO: 626472 - RNA, 12 nt, Homo sapiens
aaaaugacauua

SEQ ID NO: 626473 - RNA, 13 nt, Homo sapiens
aaaaugacauuaa

SEQ ID NO: 626474 - RNA, 21 nt, Homo sapiens
aaaaugacauuaaaugcaaua

SEQ ID NO: 626475 - RNA, 14 nt, Homo sapiens
aaaaugagcaaaag

SEQ ID NO: 626476 - RNA, 17 nt, Homo sapiens
aaaaugaggaauccaaa

SEQ ID NO: 626477 - RNA, 22 nt, Homo sapiens
aaaaugagguucaacuguugau

SEQ ID NO: 626478 - RNA, 14 nt, Homo sapiens
aaaguaauuuuguc

SEQ ID NO: 626479 - RNA, 19 nt, Homo sapiens
aaaguacaaaauugccuau

SEQ ID NO: 626480 - RNA, 19 nt, Homo sapiens
aaaguacaucucuacuaaa

SEQ ID NO: 626481 - RNA, 13 nt, Homo sapiens
aaaguacauguau

SEQ ID NO: 626482 - RNA, 14 nt, Homo sapiens
aaaguaccacacau

SEQ ID NO: 626483 - RNA, 20 nt, Homo sapiens
aaaguaccacacauauugca

SEQ ID NO: 626484 - RNA, 22 nt, Homo sapiens
aaaguaccacacugaguucuau

SEQ ID NO: 626485 - RNA, 17 nt, Homo sapiens
aaaguacuguccucaaa

SEQ ID NO: 626486 - RNA, 20 nt, Homo sapiens
aaaguagaggaauccaugua

SEQ ID NO: 626487 - RNA, 20 nt, Homo sapiens
aaaguagcaaaacaaauuca

SEQ ID NO: 626488 - RNA, 14 nt, Homo sapiens
aaaguagcaauuuc

SEQ ID NO: 626489 - RNA, 17 nt, Homo sapiens
aaaguaggaaauacaau

SEQ ID NO: 626490 - RNA, 22 nt, Homo sapiens
aaaguagucauggauaacuaca

SEQ ID NO: 626491 - RNA, 16 nt, Homo sapiens
aaaguauaacugaguu

SEQ ID NO: 626492 - RNA, 14 nt, Homo sapiens
aaaguauauuuucc

SEQ ID NO: 626493 - RNA, 16 nt, Homo sapiens
aaaguaucauuacaua

SEQ ID NO: 626494 - RNA, 21 nt, Homo sapiens
aaaguaucccggaagcucaca

SEQ ID NO: 626495 - RNA, 18 nt, Homo sapiens
aaaguaucuaccuggaaa

SEQ ID NO: 626496 - RNA, 22 nt, Homo sapiens
aaaguauguuuuuacauuaugc

SEQ ID NO: 626497 - RNA, 22 nt, Homo sapiens
aaaguauuauucaaaccaauuu

SEQ ID NO: 626498 - RNA, 15 nt, Homo sapiens
aaaguauuccaccuu

SEQ ID NO: 626499 - RNA, 22 nt, Homo sapiens
aaaguauucguuacaucuugua

SEQ ID NO: 626500 - RNA, 15 nt, Homo sapiens
aaaguauucucaaag

SEQ ID NO: 626501 - RNA, 19 nt, Homo sapiens
aaaguauucuucucuuccu

SEQ ID NO: 626502 - RNA, 16 nt, Homo sapiens
aaagucaaaaggugcc

SEQ ID NO: 626503 - RNA, 22 nt, Homo sapiens
aaagucaaacgacuaaccuauc

SEQ ID NO: 626504 - RNA, 17 nt, Homo sapiens
aaagucaaaugccaaac

SEQ ID NO: 626505 - RNA, 23 nt, Homo sapiens
aaagucagaauaguccuugggca

SEQ ID NO: 626506 - RNA, 15 nt, Homo sapiens
aaagucagagacaga

SEQ ID NO: 626507 - RNA, 21 nt, Homo sapiens
aaagucagagacagauaccuc

SEQ ID NO: 626508 - RNA, 23 nt, Homo sapiens
aaagucagagacagauaccucca

SEQ ID NO: 626509 - RNA, 20 nt, Homo sapiens
aaagucauccccucucagga

SEQ ID NO: 626510 - RNA, 14 nt, Homo sapiens
aaagucauuuguga

SEQ ID NO: 626511 - RNA, 15 nt, Homo sapiens
aaaguccacaguuua

SEQ ID NO: 626512 - RNA, 13 nt, Homo sapiens
aaaguccagcuca

SEQ ID NO: 626513 - RNA, 19 nt, Homo sapiens
aaagucccucccugccuga

SEQ ID NO: 626514 - RNA, 21 nt, Homo sapiens
aaagucccuugagacucccca

SEQ ID NO: 626515 - RNA, 12 nt, Homo sapiens
aaaguccugaca

SEQ ID NO: 626516 - RNA, 21 nt, Homo sapiens
aaagucuaccccugcuaagga

SEQ ID NO: 626517 - RNA, 19 nt, Homo sapiens
aaagucuguugauuaaaga

SEQ ID NO: 626518 - RNA, 14 nt, Homo sapiens
aaagugacauuugu

SEQ ID NO: 626519 - RNA, 15 nt, Homo sapiens
aaagugacuauucag

SEQ ID NO: 626520 - RNA, 21 nt, Homo sapiens
aaagugacucacuuaucccaa

SEQ ID NO: 626521 - RNA, 10 nt, Homo sapiens
aaagugcaua

SEQ ID NO: 626522 - RNA, 17 nt, Homo sapiens
aaagugcgaguccucca

SEQ ID NO: 626523 - RNA, 12 nt, Homo sapiens
aaagugcugcug

SEQ ID NO: 626524 - RNA, 14 nt, Homo sapiens
aaaguggugcuaua

SEQ ID NO: 626525 - RNA, 23 nt, Homo sapiens
aaaguguaacaauuguguagccu

SEQ ID NO: 626526 - RNA, 17 nt, Homo sapiens
aaaguguguaucuagcu

SEQ ID NO: 626527 - RNA, 21 nt, Homo sapiens
aaaguguugggauuacaggcg

SEQ ID NO: 626528 - RNA, 16 nt, Homo sapiens
aaaguguuuguuggca

SEQ ID NO: 626529 - RNA, 18 nt, Homo sapiens
aaaguuacauguuugcac

SEQ ID NO: 626530 - RNA, 21 nt, Homo sapiens
aaaguuagucaauccugucau

SEQ ID NO: 626531 - RNA, 22 nt, Homo sapiens
aaaguuagucaauccugucaua

SEQ ID NO: 626532 - RNA, 22 nt, Homo sapiens
aaaguucagggaccguccaggg

SEQ ID NO: 626533 - RNA, 16 nt, Homo sapiens
aaaguuccaugaauuc

SEQ ID NO: 626534 - RNA, 18 nt, Homo sapiens
aaaguucccacuccuuca

SEQ ID NO: 626535 - RNA, 23 nt, Homo sapiens
aaaguucccuacuuccugugacu

SEQ ID NO: 626536 - RNA, 17 nt, Homo sapiens
aaaguuccugucauucc

SEQ ID NO: 626537 - RNA, 15 nt, Homo sapiens
aaaguuccuuccuaa

SEQ ID NO: 626538 - RNA, 17 nt, Homo sapiens
aaaguucucaauguucu

SEQ ID NO: 626539 - RNA, 18 nt, Homo sapiens
aaaguucuugguggugga

SEQ ID NO: 626540 - RNA, 18 nt, Homo sapiens
aaaguucuuuuugcucua

SEQ ID NO: 626541 - RNA, 13 nt, Homo sapiens
aaaguugaugcua

SEQ ID NO: 626542 - RNA, 23 nt, Homo sapiens
aaaguuggggacaugcugcuaca

SEQ ID NO: 626543 - RNA, 22 nt, Homo sapiens
aaaguugguguagcagcaguug

SEQ ID NO: 626544 - RNA, 23 nt, Homo sapiens
aaaguuguuguaaccugcuguga

SEQ ID NO: 626545 - RNA, 18 nt, Homo sapiens
aaaguuguuugugccuuu

SEQ ID NO: 626546 - RNA, 20 nt, Homo sapiens
aaaguuuacauuguccugua

SEQ ID NO: 626547 - RNA, 17 nt, Homo sapiens
aaaguuuacccaugaag

SEQ ID NO: 626548 - RNA, 19 nt, Homo sapiens
aaaguuuagccccugaaag

SEQ ID NO: 626549 - RNA, 15 nt, Homo sapiens
aaaguuucuuaagga

SEQ ID NO: 626550 - RNA, 17 nt, Homo sapiens
aaaguuucuuaaggaaa

SEQ ID NO: 626551 - RNA, 22 nt, Homo sapiens
aaaguuucuuaaggaaauggug

SEQ ID NO: 626552 - RNA, 19 nt, Homo sapiens
aaaguuuggaagcacugau

SEQ ID NO: 626553 - RNA, 23 nt, Homo sapiens
aaauaaaaaucauucuacugaac

SEQ ID NO: 626554 - RNA, 15 nt, Homo sapiens
aaauaaaacauagca

SEQ ID NO: 626555 - RNA, 13 nt, Homo sapiens
aaauaaaacccaa

SEQ ID NO: 626556 - RNA, 15 nt, Homo sapiens
aaauaaaacuucaca

SEQ ID NO: 626557 - RNA, 18 nt, Homo sapiens
aaauaaaagcuagauacu

SEQ ID NO: 626558 - RNA, 17 nt, Homo sapiens
aaauaaaaggaagccaa

SEQ ID NO: 626559 - RNA, 16 nt, Homo sapiens
aaauaaaauacuaaac

SEQ ID NO: 626560 - RNA, 14 nt, Homo sapiens
aaauaaaaucacca

SEQ ID NO: 626561 - RNA, 21 nt, Homo sapiens
aaauaaaaugauaaacaaguc

SEQ ID NO: 626562 - RNA, 19 nt, Homo sapiens
aaauaaacacauagauuca

SEQ ID NO: 626563 - RNA, 23 nt, Homo sapiens
aaauaaaccacuggucccagagc

SEQ ID NO: 626564 - RNA, 16 nt, Homo sapiens
aaauaaaguaccauua

SEQ ID NO: 626565 - RNA, 22 nt, Homo sapiens
aaauaaaguauauauagaaucu

SEQ ID NO: 626566 - RNA, 17 nt, Homo sapiens
aaauaaagucaucagca

SEQ ID NO: 626567 - RNA, 16 nt, Homo sapiens
aaauaaauagcuauau

SEQ ID NO: 626568 - RNA, 16 nt, Homo sapiens
aaauaaaugccuucca

SEQ ID NO: 626569 - RNA, 19 nt, Homo sapiens
aaauaaauucaaauuauuc

SEQ ID NO: 626570 - RNA, 17 nt, Homo sapiens
aaauaaauucagaucaa

SEQ ID NO: 626571 - RNA, 19 nt, Homo sapiens
aaauaaauucugacuuaug

SEQ ID NO: 626572 - RNA, 15 nt, Homo sapiens
aaauaaauugugaaa

SEQ ID NO: 626573 - RNA, 12 nt, Homo sapiens
aaauaacagcug

SEQ ID NO: 626574 - RNA, 20 nt, Homo sapiens
aaauaacccugggcugucca

SEQ ID NO: 626575 - RNA, 20 nt, Homo sapiens
aaauaacuucaguccugcuc

SEQ ID NO: 626576 - RNA, 17 nt, Homo sapiens
aaauaagacuuccacuc

SEQ ID NO: 626577 - RNA, 15 nt, Homo sapiens
aaauaagaucucuuu

SEQ ID NO: 626578 - RNA, 21 nt, Homo sapiens
aaauaaggauaauaaucauuc

SEQ ID NO: 626579 - RNA, 19 nt, Homo sapiens
aaauaaggaugacuuuaga

SEQ ID NO: 626580 - RNA, 19 nt, Homo sapiens
aaauaaguggaaaccgugu

SEQ ID NO: 626581 - RNA, 14 nt, Homo sapiens
aaauaaguggguca

SEQ ID NO: 626582 - RNA, 19 nt, Homo sapiens
aaauaauauggcuaugcuu

SEQ ID NO: 626583 - RNA, 13 nt, Homo sapiens
aaauaaucaagau

SEQ ID NO: 626584 - RNA, 17 nt, Homo sapiens
aaauaaucuauauuaaa

SEQ ID NO: 626585 - RNA, 14 nt, Homo sapiens
aaauaaugaauaca

SEQ ID NO: 626586 - RNA, 14 nt, Homo sapiens
aaauacacauagca

SEQ ID NO: 626587 - RNA, 16 nt, Homo sapiens
aaauacacuuccugcu

SEQ ID NO: 626588 - RNA, 22 nt, Homo sapiens
aaauacagucuuccacaaagaa

SEQ ID NO: 626589 - RNA, 15 nt, Homo sapiens
aaauaccaaucacaa

SEQ ID NO: 626590 - RNA, 16 nt, Homo sapiens
aaauacccaaaugucc

SEQ ID NO: 626591 - RNA, 16 nt, Homo sapiens
aaauacccaacgcaca

SEQ ID NO: 626592 - RNA, 17 nt, Homo sapiens
aaauacccacuaacaaa

SEQ ID NO: 626593 - RNA, 21 nt, Homo sapiens
aaauaccugucaauacuaugg

SEQ ID NO: 626594 - RNA, 21 nt, Homo sapiens
aaauaccuuuucucacaaaaa

SEQ ID NO: 626595 - RNA, 17 nt, Homo sapiens
aaauacucaugugcaau

SEQ ID NO: 626596 - RNA, 17 nt, Homo sapiens
aaauacuggacucagga

SEQ ID NO: 626597 - RNA, 12 nt, Homo sapiens
aaauacugugaa

SEQ ID NO: 626598 - RNA, 19 nt, Homo sapiens
aaauacuucuugaagccga

SEQ ID NO: 626599 - RNA, 23 nt, Homo sapiens
aaauucgcugcaaccuguugaua

SEQ ID NO: 626600 - RNA, 15 nt, Homo sapiens
aaauucuacuuuaau

SEQ ID NO: 626601 - RNA, 20 nt, Homo sapiens
aaauucuauaggaacauaug

SEQ ID NO: 626602 - RNA, 18 nt, Homo sapiens
aaauucucaaccuaccac

SEQ ID NO: 626603 - RNA, 12 nt, Homo sapiens
aaauucugauga

SEQ ID NO: 626604 - RNA, 21 nt, Homo sapiens
aaauucugaugagcauuacua

SEQ ID NO: 626605 - RNA, 18 nt, Homo sapiens
aaauucuguggcaguuuu

SEQ ID NO: 626606 - RNA, 12 nt, Homo sapiens
aaauucuuucag

SEQ ID NO: 626607 - RNA, 19 nt, Homo sapiens
aaauugaaaggcauucucu

SEQ ID NO: 626608 - RNA, 16 nt, Homo sapiens
aaauugacauaaccaa

SEQ ID NO: 626609 - RNA, 16 nt, Homo sapiens
aaauugacgacuucac

SEQ ID NO: 626610 - RNA, 19 nt, Homo sapiens
aaauugagaccugagugaa

SEQ ID NO: 626611 - RNA, 15 nt, Homo sapiens
aaauugcacagagca

SEQ ID NO: 626612 - RNA, 23 nt, Homo sapiens
aaauugcagaauucaaaagugau

SEQ ID NO: 626613 - RNA, 12 nt, Homo sapiens
aaauugcugcuu

SEQ ID NO: 626614 - RNA, 17 nt, Homo sapiens
aaauuggacagaacaga

SEQ ID NO: 626615 - RNA, 19 nt, Homo sapiens
aaauugggacaacagugcu

SEQ ID NO: 626616 - RNA, 21 nt, Homo sapiens
aaauugggcuggauugugcuu

SEQ ID NO: 626617 - RNA, 14 nt, Homo sapiens
aaauugguacauag

SEQ ID NO: 626618 - RNA, 21 nt, Homo sapiens
aaauugguauuaacuaugauc

SEQ ID NO: 626619 - RNA, 17 nt, Homo sapiens
aaauuggugaacagugu

SEQ ID NO: 626620 - RNA, 20 nt, Homo sapiens
aaauuguaucaaaugugaca

SEQ ID NO: 626621 - RNA, 14 nt, Homo sapiens
aaauuguauuauca

SEQ ID NO: 626622 - RNA, 15 nt, Homo sapiens
aaauuguauuaucaa

SEQ ID NO: 626623 - RNA, 13 nt, Homo sapiens
aaauugucccauu

SEQ ID NO: 626624 - RNA, 18 nt, Homo sapiens
aaauuguuuaccauagaa

SEQ ID NO: 626625 - RNA, 19 nt, Homo sapiens
aaauuuaacaguuaccuga

SEQ ID NO: 626626 - RNA, 23 nt, Homo sapiens
aaauuuaagaaaacaaguauaua

SEQ ID NO: 626627 - RNA, 13 nt, Homo sapiens
aaauuuaagcauu

SEQ ID NO: 626628 - RNA, 23 nt, Homo sapiens
aaauuuaauguuuuuuaaacuag

SEQ ID NO: 626629 - RNA, 21 nt, Homo sapiens
aaauuuagagucaauuugcug

SEQ ID NO: 626630 - RNA, 19 nt, Homo sapiens
aaauuuauaaaggucugca

SEQ ID NO: 626631 - RNA, 15 nt, Homo sapiens
aaauuuaucuuucaa

SEQ ID NO: 626632 - RNA, 17 nt, Homo sapiens
aaauuuauucacauaua

SEQ ID NO: 626633 - RNA, 14 nt, Homo sapiens
aaauuucaccacug

SEQ ID NO: 626634 - RNA, 16 nt, Homo sapiens
aaauuugaauaaucag

SEQ ID NO: 626635 - RNA, 14 nt, Homo sapiens
aaauuugauuuuga

SEQ ID NO: 626636 - RNA, 20 nt, Homo sapiens
aaauuuggcucacuugccuu

SEQ ID NO: 626637 - RNA, 18 nt, Homo sapiens
aaauuuguuugucacugc

SEQ ID NO: 626638 - RNA, 20 nt, Homo sapiens
aaauuuuaaaagccacaggu

SEQ ID NO: 626639 - RNA, 22 nt, Homo sapiens
aaauuuuaaaagccacaggugu

SEQ ID NO: 626640 - RNA, 14 nt, Homo sapiens
aaauuuuaaccuau

SEQ ID NO: 626641 - RNA, 14 nt, Homo sapiens
aaauuuuacaguaa

SEQ ID NO: 626642 - RNA, 18 nt, Homo sapiens
aaauuuucacugcugcuc

SEQ ID NO: 626643 - RNA, 15 nt, Homo sapiens
aaauuuugagauuaa

SEQ ID NO: 626644 - RNA, 18 nt, Homo sapiens
aaauuuugugacauuccu

SEQ ID NO: 626645 - RNA, 15 nt, Homo sapiens
aaauuuuuaccuguu

SEQ ID NO: 626646 - RNA, 20 nt, Homo sapiens
aaauuuuucaaaucauuccu

SEQ ID NO: 626647 - RNA, 21 nt, Homo sapiens
aacaaaaaaaccucuaugcaa

SEQ ID NO: 626648 - RNA, 16 nt, Homo sapiens
aacaaaaaaacuauaa

SEQ ID NO: 626649 - RNA, 14 nt, Homo sapiens
aacaaaaaaccaca

SEQ ID NO: 626650 - RNA, 18 nt, Homo sapiens
aacaaaaaacuaugugau

SEQ ID NO: 626651 - RNA, 16 nt, Homo sapiens
aacaaaaacagaauuu

SEQ ID NO: 626652 - RNA, 15 nt, Homo sapiens
aacaaaaaccaaaaa

SEQ ID NO: 626653 - RNA, 19 nt, Homo sapiens
aacaaaaagaaaaacaaau

SEQ ID NO: 626654 - RNA, 20 nt, Homo sapiens
aacaaaaagaaaucuugucu

SEQ ID NO: 626655 - RNA, 10 nt, Homo sapiens
aacaaaaagu

SEQ ID NO: 626656 - RNA, 21 nt, Homo sapiens
aacaaaacccucagcacuguu

SEQ ID NO: 626657 - RNA, 17 nt, Homo sapiens
aacaaaagaaucuucca

SEQ ID NO: 626658 - RNA, 19 nt, Homo sapiens
aacaaaagcgacccauuca

SEQ ID NO: 626659 - RNA, 20 nt, Homo sapiens
aacaaaaugaauucugggaa

SEQ ID NO: 626660 - RNA, 12 nt, Homo sapiens
aacaaacagggc

SEQ ID NO: 626661 - RNA, 15 nt, Homo sapiens
aacaaacuacaugua

SEQ ID NO: 626662 - RNA, 22 nt, Homo sapiens
aacaaacucauucauuagucau

SEQ ID NO: 626663 - RNA, 19 nt, Homo sapiens
aacaaagaaauaauggucu

SEQ ID NO: 626664 - RNA, 13 nt, Homo sapiens
aacaaagaagaca

SEQ ID NO: 626665 - RNA, 12 nt, Homo sapiens
aacaaagcccuu

SEQ ID NO: 626666 - RNA, 22 nt, Homo sapiens
aacaaaguuucagaguauauug

SEQ ID NO: 626667 - RNA, 23 nt, Homo sapiens
aacaaauaugcaaaccaggauuu

SEQ ID NO: 626668 - RNA, 19 nt, Homo sapiens
aacaaauucaaauaaucca

SEQ ID NO: 626669 - RNA, 23 nt, Homo sapiens
aacaaauucauauucugucugga

SEQ ID NO: 626670 - RNA, 21 nt, Homo sapiens
aacaaccguuggaaacauaac

SEQ ID NO: 626671 - RNA, 16 nt, Homo sapiens
aacaaccugaaugucc

SEQ ID NO: 626672 - RNA, 22 nt, Homo sapiens
aacaacuaggcuucagcauauu

SEQ ID NO: 626673 - RNA, 13 nt, Homo sapiens
aacaacucuaguc

SEQ ID NO: 626674 - RNA, 21 nt, Homo sapiens
aacaacucugauuaacuauuc

SEQ ID NO: 626675 - RNA, 19 nt, Homo sapiens
aacaacuuaauguucugaa

SEQ ID NO: 626676 - RNA, 16 nt, Homo sapiens
aacaacuuacacuuau

SEQ ID NO: 626677 - RNA, 12 nt, Homo sapiens
aacaacuuugaa

SEQ ID NO: 626678 - RNA, 14 nt, Homo sapiens
aacaagaacuuuaa

SEQ ID NO: 626679 - RNA, 22 nt, Homo sapiens
aacaagacuuuuuguacugaaa

SEQ ID NO: 626680 - RNA, 19 nt, Homo sapiens
aacaagaguugucuugucc

SEQ ID NO: 626681 - RNA, 16 nt, Homo sapiens
aacaagccucaaaguc

SEQ ID NO: 626682 - RNA, 21 nt, Homo sapiens
aacaaggucugcucugcuccu

SEQ ID NO: 626683 - RNA, 20 nt, Homo sapiens
aacaagguucccucugagaa

SEQ ID NO: 626684 - RNA, 22 nt, Homo sapiens
aacaaguggaccucgucccauc

SEQ ID NO: 626685 - RNA, 16 nt, Homo sapiens
aacaauaaaaugucuu

SEQ ID NO: 626686 - RNA, 23 nt, Homo sapiens
aacaauaaaaugucuucucccac

SEQ ID NO: 626687 - RNA, 16 nt, Homo sapiens
aacaauaacgauacaa

SEQ ID NO: 626688 - RNA, 15 nt, Homo sapiens
aacaauacuguucua

SEQ ID NO: 626689 - RNA, 18 nt, Homo sapiens
aacaauacuguucuauac

SEQ ID NO: 626690 - RNA, 13 nt, Homo sapiens
aacaauauauguc

SEQ ID NO: 626691 - RNA, 16 nt, Homo sapiens
aacaauaugaaguaca

SEQ ID NO: 626692 - RNA, 21 nt, Homo sapiens
aacaauauuguauacuaccau

SEQ ID NO: 626693 - RNA, 15 nt, Homo sapiens
aacaauccaugugau

SEQ ID NO: 626694 - RNA, 16 nt, Homo sapiens
aacaaugaaauauugc

SEQ ID NO: 626695 - RNA, 20 nt, Homo sapiens
aacaaugcugauuuggugac

SEQ ID NO: 626696 - RNA, 21 nt, Homo sapiens
aacaauguaaaccaccaucuu

SEQ ID NO: 626697 - RNA, 21 nt, Homo sapiens
aacaauguuguccaacaauaa

SEQ ID NO: 626698 - RNA, 18 nt, Homo sapiens
aacaauucaguggucuua

SEQ ID NO: 626699 - RNA, 11 nt, Homo sapiens
aacaauuccac

SEQ ID NO: 626700 - RNA, 22 nt, Homo sapiens
aacaauugcuuuugaggcucag

SEQ ID NO: 626701 - RNA, 14 nt, Homo sapiens
aacaauuucaauaa

SEQ ID NO: 626702 - RNA, 14 nt, Homo sapiens
aacacaaaacauuc

SEQ ID NO: 626703 - RNA, 20 nt, Homo sapiens
aacacaaacgggcucagcaa

SEQ ID NO: 626704 - RNA, 16 nt, Homo sapiens
aacacaagagacuuaa

SEQ ID NO: 626705 - RNA, 14 nt, Homo sapiens
aacacaagccacag

SEQ ID NO: 626706 - RNA, 13 nt, Homo sapiens
aacacacacaaaa

SEQ ID NO: 626707 - RNA, 13 nt, Homo sapiens
aacacacagauuu

SEQ ID NO: 626708 - RNA, 23 nt, Homo sapiens
aacacacuaccgaaugugucuuu

SEQ ID NO: 626709 - RNA, 13 nt, Homo sapiens
aacacagaggcag

SEQ ID NO: 626710 - RNA, 17 nt, Homo sapiens
aacacagcaugugccaa

SEQ ID NO: 626711 - RNA, 21 nt, Homo sapiens
aacacagcauguguauuucca

SEQ ID NO: 626712 - RNA, 14 nt, Homo sapiens
aacacagcugauga

SEQ ID NO: 626713 - RNA, 21 nt, Homo sapiens
aacacaguuuagugcuuuaca

SEQ ID NO: 626714 - RNA, 14 nt, Homo sapiens
aacacauacaggaa

SEQ ID NO: 626715 - RNA, 13 nt, Homo sapiens
aacacaugccaaa

SEQ ID NO: 626716 - RNA, 14 nt, Homo sapiens
aacacaugccuuaa

SEQ ID NO: 626717 - RNA, 21 nt, Homo sapiens
aacacauuucucugaucucca

SEQ ID NO: 626718 - RNA, 20 nt, Homo sapiens
aacacauuugcccaauucca

SEQ ID NO: 626719 - RNA, 15 nt, Homo sapiens
aacaccaagcacagc

SEQ ID NO: 626720 - RNA, 23 nt, Homo sapiens
aacaccagacagacaacacuggg

SEQ ID NO: 626721 - RNA, 14 nt, Homo sapiens
aaccccugaaguau

SEQ ID NO: 626722 - RNA, 16 nt, Homo sapiens
aaccccugcuccaguc

SEQ ID NO: 626723 - RNA, 12 nt, Homo sapiens
aaccccuuccag

SEQ ID NO: 626724 - RNA, 22 nt, Homo sapiens
aaccccuuccagaucacugcca

SEQ ID NO: 626725 - RNA, 23 nt, Homo sapiens
aaccccuuccagaucacugccac

SEQ ID NO: 626726 - RNA, 22 nt, Homo sapiens
aacccgacauguguaccucagc

SEQ ID NO: 626727 - RNA, 23 nt, Homo sapiens
aacccgagggacagcagauucca

SEQ ID NO: 626728 - RNA, 13 nt, Homo sapiens
aacccggcacugc

SEQ ID NO: 626729 - RNA, 14 nt, Homo sapiens
aacccggcuuccug

SEQ ID NO: 626730 - RNA, 22 nt, Homo sapiens
aacccuacuuugcuuccgccac

SEQ ID NO: 626731 - RNA, 19 nt, Homo sapiens
aacccuaucuccugacaga

SEQ ID NO: 626732 - RNA, 18 nt, Homo sapiens
aacccucacaagcaugaa

SEQ ID NO: 626733 - RNA, 20 nt, Homo sapiens
aacccucacaagcaugaagu

SEQ ID NO: 626734 - RNA, 17 nt, Homo sapiens
aacccucagcacuguua

SEQ ID NO: 626735 - RNA, 15 nt, Homo sapiens
aacccucucuucccu

SEQ ID NO: 626736 - RNA, 19 nt, Homo sapiens
aacccugccgucaccacca

SEQ ID NO: 626737 - RNA, 20 nt, Homo sapiens
aacccugcugaacacagugu

SEQ ID NO: 626738 - RNA, 22 nt, Homo sapiens
aacccugcugaacacagugucu

SEQ ID NO: 626739 - RNA, 12 nt, Homo sapiens
aacccugucuga

SEQ ID NO: 626740 - RNA, 14 nt, Homo sapiens
aacccuugcuugca

SEQ ID NO: 626741 - RNA, 11 nt, Homo sapiens
aaccgaauaaa

SEQ ID NO: 626742 - RNA, 21 nt, Homo sapiens
aaccgaugguccucacaagcc

SEQ ID NO: 626743 - RNA, 17 nt, Homo sapiens
aaccggggccuacuaga

SEQ ID NO: 626744 - RNA, 13 nt, Homo sapiens
aaccuaauucuug

SEQ ID NO: 626745 - RNA, 22 nt, Homo sapiens
aaccuaauucuuguagaugcau

SEQ ID NO: 626746 - RNA, 23 nt, Homo sapiens
aaccuacaguuuuaacuguggau

SEQ ID NO: 626747 - RNA, 17 nt, Homo sapiens
aaccuacgcacauaccu

SEQ ID NO: 626748 - RNA, 12 nt, Homo sapiens
aaccuagaauuu

SEQ ID NO: 626749 - RNA, 23 nt, Homo sapiens
aaccuaguacugccccccaugag

SEQ ID NO: 626750 - RNA, 12 nt, Homo sapiens
aaccuagugaau

SEQ ID NO: 626751 - RNA, 18 nt, Homo sapiens
aaccuauguguccucuaa

SEQ ID NO: 626752 - RNA, 12 nt, Homo sapiens
aaccuauuggga

SEQ ID NO: 626753 - RNA, 21 nt, Homo sapiens
aaccucaacugccuacuccaa

SEQ ID NO: 626754 - RNA, 14 nt, Homo sapiens
aaccucacaaagua

SEQ ID NO: 626755 - RNA, 14 nt, Homo sapiens
aaccucacugcccu

SEQ ID NO: 626756 - RNA, 20 nt, Homo sapiens
aaccucaggcuuccuuggca

SEQ ID NO: 626757 - RNA, 11 nt, Homo sapiens
aaccucagggc

SEQ ID NO: 626758 - RNA, 21 nt, Homo sapiens
aaccucaguuauuacauguaa

SEQ ID NO: 626759 - RNA, 14 nt, Homo sapiens
aaccucauugacaa

SEQ ID NO: 626760 - RNA, 14 nt, Homo sapiens
aaccuccaguguca

SEQ ID NO: 626761 - RNA, 19 nt, Homo sapiens
aaccuccgccucucagguu

SEQ ID NO: 626762 - RNA, 20 nt, Homo sapiens
aaccuccgccuuccggguuc

SEQ ID NO: 626763 - RNA, 14 nt, Homo sapiens
aaccuccuuuacca

SEQ ID NO: 626764 - RNA, 13 nt, Homo sapiens
aaccucuaugcaa

SEQ ID NO: 626765 - RNA, 17 nt, Homo sapiens
aaccucucuaagccaca

SEQ ID NO: 626766 - RNA, 15 nt, Homo sapiens
aaccucugcacuacu

SEQ ID NO: 626767 - RNA, 16 nt, Homo sapiens
aaccucuucaugagcu

SEQ ID NO: 626768 - RNA, 19 nt, Homo sapiens
aaccucuuuucugcaucau

SEQ ID NO: 626769 - RNA, 20 nt, Homo sapiens
aaccugacuuccucugccac

SEQ ID NO: 626770 - RNA, 17 nt, Homo sapiens
aaccugauacauuuaca

SEQ ID NO: 626771 - RNA, 15 nt, Homo sapiens
aaccugccaguccca

SEQ ID NO: 626772 - RNA, 17 nt, Homo sapiens
aaccugcgucauuucag

SEQ ID NO: 626773 - RNA, 13 nt, Homo sapiens
aaccugcucuccu

SEQ ID NO: 626774 - RNA, 16 nt, Homo sapiens
aaccugcuuccuucag

SEQ ID NO: 626775 - RNA, 12 nt, Homo sapiens
aaccuggaccca

SEQ ID NO: 626776 - RNA, 21 nt, Homo sapiens
aaccuggagccacuucuaucu

SEQ ID NO: 626777 - RNA, 17 nt, Homo sapiens
aaccuggauccagcacu

SEQ ID NO: 626778 - RNA, 16 nt, Homo sapiens
aaccuguaacucacau

SEQ ID NO: 626779 - RNA, 23 nt, Homo sapiens
aaccuguccuaaggaaccuuccu

SEQ ID NO: 626780 - RNA, 12 nt, Homo sapiens
aaccugucucac

SEQ ID NO: 626781 - RNA, 16 nt, Homo sapiens
aaccuuaaauacacug

SEQ ID NO: 626782 - RNA, 16 nt, Homo sapiens
aaccuuccucuuccag

SEQ ID NO: 626783 - RNA, 20 nt, Homo sapiens
aaccuugaaugcugccagug

SEQ ID NO: 626784 - RNA, 22 nt, Homo sapiens
aaccuuggaccacuccuguccc

SEQ ID NO: 626785 - RNA, 18 nt, Homo sapiens
aaccuugucucuaugcca

SEQ ID NO: 626786 - RNA, 14 nt, Homo sapiens
aaccuugugccuug

SEQ ID NO: 626787 - RNA, 22 nt, Homo sapiens
aaccuuuagaauaucuuuucaa

SEQ ID NO: 626788 - RNA, 23 nt, Homo sapiens
aaccuuuucaccuccaacuggau

SEQ ID NO: 626789 - RNA, 14 nt, Homo sapiens
aacgacacauucag

SEQ ID NO: 626790 - RNA, 12 nt, Homo sapiens
aacgagauacca

SEQ ID NO: 626791 - RNA, 23 nt, Homo sapiens
aacgauacaaauuuggccuuaag

SEQ ID NO: 626792 - RNA, 12 nt, Homo sapiens
aacgaugugucu

SEQ ID NO: 626793 - RNA, 16 nt, Homo sapiens
aacgcaaugucauuuu

SEQ ID NO: 626794 - RNA, 11 nt, Homo sapiens
aacgccagucu

SEQ ID NO: 626795 - RNA, 15 nt, Homo sapiens
aacgccgagugcacu

SEQ ID NO: 626796 - RNA, 18 nt, Homo sapiens
aacgccgcugacugccac

SEQ ID NO: 626797 - RNA, 16 nt, Homo sapiens
aacgccuuuuauucua

SEQ ID NO: 626798 - RNA, 24 nt, Homo sapiens
aacggcucagacaggcagauuuga

SEQ ID NO: 626799 - RNA, 17 nt, Homo sapiens
aacgggcagucugcucu

SEQ ID NO: 626800 - RNA, 16 nt, Homo sapiens
aacguaacccauuaaa

SEQ ID NO: 626801 - RNA, 22 nt, Homo sapiens
aacguagcuucuaccaugaaca

SEQ ID NO: 626802 - RNA, 19 nt, Homo sapiens
aacgucuaggaaaucuaga

SEQ ID NO: 626803 - RNA, 15 nt, Homo sapiens
aacgugcugcucaag

SEQ ID NO: 626804 - RNA, 21 nt, Homo sapiens
aacguggacucauuucacuau

SEQ ID NO: 626805 - RNA, 17 nt, Homo sapiens
aacgugucagaauccuu

SEQ ID NO: 626806 - RNA, 20 nt, Homo sapiens
aacguugaauugaugaugca

SEQ ID NO: 626807 - RNA, 23 nt, Homo sapiens
aacguugaauugaugaugcaguu

SEQ ID NO: 626808 - RNA, 19 nt, Homo sapiens
aacuaaaacccccaauaaa

SEQ ID NO: 626809 - RNA, 17 nt, Homo sapiens
aacuaaacaauaagcaa

SEQ ID NO: 626810 - RNA, 21 nt, Homo sapiens
aacuaagaaaauucuauguua

SEQ ID NO: 626811 - RNA, 22 nt, Homo sapiens
aacuaauaaaagcauaaaugca

SEQ ID NO: 626812 - RNA, 16 nt, Homo sapiens
aacuaaucaccauauu

SEQ ID NO: 626813 - RNA, 23 nt, Homo sapiens
aacuaaucugauguuaaccaaug

SEQ ID NO: 626814 - RNA, 20 nt, Homo sapiens
aacuacacaaauuauaagca

SEQ ID NO: 626815 - RNA, 16 nt, Homo sapiens
aacuacagacuaaaga

SEQ ID NO: 626816 - RNA, 22 nt, Homo sapiens
aacuacagaguuuaugauuuaa

SEQ ID NO: 626817 - RNA, 23 nt, Homo sapiens
aacuacauauuguaaagcccauu

SEQ ID NO: 626818 - RNA, 14 nt, Homo sapiens
aacuacaucugccu

SEQ ID NO: 626819 - RNA, 17 nt, Homo sapiens
aacuacauuaguacaca

SEQ ID NO: 626820 - RNA, 13 nt, Homo sapiens
aacuaccaucuga

SEQ ID NO: 626821 - RNA, 14 nt, Homo sapiens
aacuaccaucugau

SEQ ID NO: 626822 - RNA, 23 nt, Homo sapiens
aacuacccagguauuacacaagc

SEQ ID NO: 626823 - RNA, 12 nt, Homo sapiens
aacuacuaaagu

SEQ ID NO: 626824 - RNA, 17 nt, Homo sapiens
aacuacuaaagugccua

SEQ ID NO: 626825 - RNA, 15 nt, Homo sapiens
aacuacuggcaauuu

SEQ ID NO: 626826 - RNA, 13 nt, Homo sapiens
aacuacugugauc

SEQ ID NO: 626827 - RNA, 12 nt, Homo sapiens
aacuacuucuua

SEQ ID NO: 626828 - RNA, 12 nt, Homo sapiens
aacuacuucuuu

SEQ ID NO: 626829 - RNA, 17 nt, Homo sapiens
aacuagaauuuauucaa

SEQ ID NO: 626830 - RNA, 20 nt, Homo sapiens
aacuagagcacagaaggaau

SEQ ID NO: 626831 - RNA, 23 nt, Homo sapiens
aacuagcaauugguuguuuaaca

SEQ ID NO: 626832 - RNA, 13 nt, Homo sapiens
aacuagcagauuu

SEQ ID NO: 626833 - RNA, 17 nt, Homo sapiens
aacuagcauuacauuau

SEQ ID NO: 626834 - RNA, 15 nt, Homo sapiens
aacuaggaaaaucac

SEQ ID NO: 626835 - RNA, 19 nt, Homo sapiens
aacuaguuuuuauagcuau

SEQ ID NO: 626836 - RNA, 14 nt, Homo sapiens
agcccuuugcucug

SEQ ID NO: 626837 - RNA, 18 nt, Homo sapiens
agccgagaucacaccacu

SEQ ID NO: 626838 - RNA, 14 nt, Homo sapiens
agccgagauugcac

SEQ ID NO: 626839 - RNA, 20 nt, Homo sapiens
agccgagauugcaccacugc

SEQ ID NO: 626840 - RNA, 19 nt, Homo sapiens
agccgcagagacccucuca

SEQ ID NO: 626841 - RNA, 19 nt, Homo sapiens
agccgcauuggugacucac

SEQ ID NO: 626842 - RNA, 18 nt, Homo sapiens
agccgccugaaagccaca

SEQ ID NO: 626843 - RNA, 21 nt, Homo sapiens
agccgcgggcgcucgcucagg

SEQ ID NO: 626844 - RNA, 13 nt, Homo sapiens
agccgcugugagc

SEQ ID NO: 626845 - RNA, 11 nt, Homo sapiens
agccgggaccc

SEQ ID NO: 626846 - RNA, 18 nt, Homo sapiens
agccgggacccucaggug

SEQ ID NO: 626847 - RNA, 21 nt, Homo sapiens
agccgggcguguuggugugca

SEQ ID NO: 626848 - RNA, 14 nt, Homo sapiens
agccggucagagga

SEQ ID NO: 626849 - RNA, 15 nt, Homo sapiens
agccguccauggcac

SEQ ID NO: 626850 - RNA, 15 nt, Homo sapiens
agccgugaugcucag

SEQ ID NO: 626851 - RNA, 15 nt, Homo sapiens
agccguguguucaaa

SEQ ID NO: 626852 - RNA, 14 nt, Homo sapiens
agccuaaggcugua

SEQ ID NO: 626853 - RNA, 24 nt, Homo sapiens
agccuacaguuauguucagucaca

SEQ ID NO: 626854 - RNA, 17 nt, Homo sapiens
agccuacauaacacauu

SEQ ID NO: 626855 - RNA, 23 nt, Homo sapiens
agccuacaugaugcaaacugugg

SEQ ID NO: 626856 - RNA, 13 nt, Homo sapiens
agccuagagaagg

SEQ ID NO: 626857 - RNA, 20 nt, Homo sapiens
agccuagagaccauguugac

SEQ ID NO: 626858 - RNA, 16 nt, Homo sapiens
agccuagcacagcagc

SEQ ID NO: 626859 - RNA, 17 nt, Homo sapiens
agccuagccgaccucag

SEQ ID NO: 626860 - RNA, 23 nt, Homo sapiens
agccuauguaugccauggaggca

SEQ ID NO: 626861 - RNA, 13 nt, Homo sapiens
agccucaaccucc

SEQ ID NO: 626862 - RNA, 16 nt, Homo sapiens
agccucagaaagggau

SEQ ID NO: 626863 - RNA, 16 nt, Homo sapiens
agccucagaaggcccc

SEQ ID NO: 626864 - RNA, 19 nt, Homo sapiens
agccucagccauucacugc

SEQ ID NO: 626865 - RNA, 13 nt, Homo sapiens
agccucagucucc

SEQ ID NO: 626866 - RNA, 13 nt, Homo sapiens
agccucaucucuu

SEQ ID NO: 626867 - RNA, 12 nt, Homo sapiens
agccuccacugc

SEQ ID NO: 626868 - RNA, 22 nt, Homo sapiens
agccucccccucagaugaucuc

SEQ ID NO: 626869 - RNA, 18 nt, Homo sapiens
agccuccccgugccaaaa

SEQ ID NO: 626870 - RNA, 20 nt, Homo sapiens
agccucccugaagaccaaaa

SEQ ID NO: 626871 - RNA, 17 nt, Homo sapiens
agccuccgccauuccaa

SEQ ID NO: 626872 - RNA, 15 nt, Homo sapiens
agccuccgccugcug

SEQ ID NO: 626873 - RNA, 17 nt, Homo sapiens
agccuccgccugcugug

SEQ ID NO: 626874 - RNA, 20 nt, Homo sapiens
agccuccucuggacuccacc

SEQ ID NO: 626875 - RNA, 21 nt, Homo sapiens
agccuccugaaguugcugcug

SEQ ID NO: 626876 - RNA, 19 nt, Homo sapiens
agccucuccccgcucugga

SEQ ID NO: 626877 - RNA, 21 nt, Homo sapiens
agccucugacuuaagcugccu

SEQ ID NO: 626878 - RNA, 19 nt, Homo sapiens
agccucugcccugccuccc

SEQ ID NO: 626879 - RNA, 23 nt, Homo sapiens
agccugaaacucauagacacuga

SEQ ID NO: 626880 - RNA, 13 nt, Homo sapiens
agccugaacacuc

SEQ ID NO: 626881 - RNA, 17 nt, Homo sapiens
agccugaacagaagcuc

SEQ ID NO: 626882 - RNA, 13 nt, Homo sapiens
agccugaccugag

SEQ ID NO: 626883 - RNA, 13 nt, Homo sapiens
agccugagccaca

SEQ ID NO: 626884 - RNA, 20 nt, Homo sapiens
agccugaugcugacauucac

SEQ ID NO: 626885 - RNA, 18 nt, Homo sapiens
agccugcaaacucacugc

SEQ ID NO: 626886 - RNA, 15 nt, Homo sapiens
agccugcagaaucca

SEQ ID NO: 626887 - RNA, 18 nt, Homo sapiens
agccugcaucuucuugca

SEQ ID NO: 626888 - RNA, 12 nt, Homo sapiens
agccugcauuga

SEQ ID NO: 626889 - RNA, 12 nt, Homo sapiens
agccugccaaau

SEQ ID NO: 626890 - RNA, 20 nt, Homo sapiens
agccugccauauuugucaua

SEQ ID NO: 626891 - RNA, 17 nt, Homo sapiens
agccugcccaccucucc

SEQ ID NO: 626892 - RNA, 20 nt, Homo sapiens
agccugcucauguaccucug

SEQ ID NO: 626893 - RNA, 20 nt, Homo sapiens
agccugcucccuagccagag

SEQ ID NO: 626894 - RNA, 19 nt, Homo sapiens
agccugcucuagugggaca

SEQ ID NO: 626895 - RNA, 18 nt, Homo sapiens
agccugcuggcacccacc

SEQ ID NO: 626896 - RNA, 16 nt, Homo sapiens
agccuggaguuugaga

SEQ ID NO: 626897 - RNA, 17 nt, Homo sapiens
agccuggauuccagcag

SEQ ID NO: 626898 - RNA, 15 nt, Homo sapiens
agccuggcacccacc

SEQ ID NO: 626899 - RNA, 16 nt, Homo sapiens
agccuggccaacaugg

SEQ ID NO: 626900 - RNA, 15 nt, Homo sapiens
agccuggccagacaa

SEQ ID NO: 626901 - RNA, 22 nt, Homo sapiens
agccuggccccaggccccagac

SEQ ID NO: 626902 - RNA, 19 nt, Homo sapiens
agccuggccccggccuuua

SEQ ID NO: 626903 - RNA, 16 nt, Homo sapiens
agccugggagcccaga

SEQ ID NO: 626904 - RNA, 14 nt, Homo sapiens
agccugggcaacau

SEQ ID NO: 626905 - RNA, 23 nt, Homo sapiens
agccugggcaacauaccaagacc

SEQ ID NO: 626906 - RNA, 17 nt, Homo sapiens
agccugggccagagaag

SEQ ID NO: 626907 - RNA, 17 nt, Homo sapiens
agccugggccaucucuu

SEQ ID NO: 626908 - RNA, 15 nt, Homo sapiens
agccuggugcugcug

SEQ ID NO: 626909 - RNA, 20 nt, Homo sapiens
agccugguucagacacagcu

SEQ ID NO: 626910 - RNA, 14 nt, Homo sapiens
agccugguuugcaa

SEQ ID NO: 626911 - RNA, 18 nt, Homo sapiens
agccugguuugcaaagac

SEQ ID NO: 626912 - RNA, 22 nt, Homo sapiens
agccugguuugcaaagaccacc

SEQ ID NO: 626913 - RNA, 23 nt, Homo sapiens
agcucagauuauuuaaaugggaa

SEQ ID NO: 626914 - RNA, 16 nt, Homo sapiens
agcucagcauuuccac

SEQ ID NO: 626915 - RNA, 16 nt, Homo sapiens
agcucaggacugccau

SEQ ID NO: 626916 - RNA, 20 nt, Homo sapiens
agcucaggucccaggccagc

SEQ ID NO: 626917 - RNA, 17 nt, Homo sapiens
agcucagucccaucaga

SEQ ID NO: 626918 - RNA, 12 nt, Homo sapiens
agcucaguuuau

SEQ ID NO: 626919 - RNA, 19 nt, Homo sapiens
agcucauguaggugagccu

SEQ ID NO: 626920 - RNA, 21 nt, Homo sapiens
agcucauguaggugagccugg

SEQ ID NO: 626921 - RNA, 22 nt, Homo sapiens
agcucauuugagauaaagucaa

SEQ ID NO: 626922 - RNA, 17 nt, Homo sapiens
agcuccacacauuccag

SEQ ID NO: 626923 - RNA, 18 nt, Homo sapiens
agcucccuaggagaccaa

SEQ ID NO: 626924 - RNA, 18 nt, Homo sapiens
agcuccucuccuugggcu

SEQ ID NO: 626925 - RNA, 16 nt, Homo sapiens
agcuccucugagccau

SEQ ID NO: 626926 - RNA, 14 nt, Homo sapiens
agcuccugggaccc

SEQ ID NO: 626927 - RNA, 15 nt, Homo sapiens
agcuccuguguuaca

SEQ ID NO: 626928 - RNA, 16 nt, Homo sapiens
agcuccuucaaugcaa

SEQ ID NO: 626929 - RNA, 18 nt, Homo sapiens
agcuccuucaaugcaaag

SEQ ID NO: 626930 - RNA, 12 nt, Homo sapiens
agcuccuuccac

SEQ ID NO: 626931 - RNA, 15 nt, Homo sapiens
agcucgguggaccca

SEQ ID NO: 626932 - RNA, 19 nt, Homo sapiens
agcucuacgugcuccucag

SEQ ID NO: 626933 - RNA, 17 nt, Homo sapiens
agcucuauaagagcugg

SEQ ID NO: 626934 - RNA, 18 nt, Homo sapiens
agcucuaucaccaaggag

SEQ ID NO: 626935 - RNA, 16 nt, Homo sapiens
agcucucacaugcaca

SEQ ID NO: 626936 - RNA, 14 nt, Homo sapiens
agcucucccaguga

SEQ ID NO: 626937 - RNA, 15 nt, Homo sapiens
agcucuccccucaga

SEQ ID NO: 626938 - RNA, 12 nt, Homo sapiens
agcucucuggga

SEQ ID NO: 626939 - RNA, 20 nt, Homo sapiens
agcucugaaaccaguguuag

SEQ ID NO: 626940 - RNA, 17 nt, Homo sapiens
agcucugcgccaaucac

SEQ ID NO: 626941 - RNA, 21 nt, Homo sapiens
agcucugcuccccuaaagccu

SEQ ID NO: 626942 - RNA, 17 nt, Homo sapiens
agcucuggaugaaggca

SEQ ID NO: 626943 - RNA, 15 nt, Homo sapiens
agcucuggcuuccag

SEQ ID NO: 626944 - RNA, 23 nt, Homo sapiens
agcucugggccucuuuuugcccu

SEQ ID NO: 626945 - RNA, 14 nt, Homo sapiens
agcucuggggacag

SEQ ID NO: 626946 - RNA, 22 nt, Homo sapiens
agcucuggggugggcaguuuuu

SEQ ID NO: 626947 - RNA, 14 nt, Homo sapiens
agcucuggugaccu

SEQ ID NO: 626948 - RNA, 15 nt, Homo sapiens
agcucuuaauguugc

SEQ ID NO: 626949 - RNA, 16 nt, Homo sapiens
agcucuuagucucuuu

SEQ ID NO: 626950 - RNA, 17 nt, Homo sapiens
agcucuucaggccuccc

SEQ ID NO: 626951 - RNA, 21 nt, Homo sapiens
agcucuucaggccucccucuc

SEQ ID NO: 626952 - RNA, 17 nt, Homo sapiens
agcucuuccaggagcca

SEQ ID NO: 626953 - RNA, 17 nt, Homo sapiens
agcucuuccgaaaacca

SEQ ID NO: 626954 - RNA, 19 nt, Homo sapiens
agcucuuccuauccuguag

SEQ ID NO: 626955 - RNA, 13 nt, Homo sapiens
agcucuucuuccc

SEQ ID NO: 626956 - RNA, 21 nt, Homo sapiens
agcucuugcuucagagcagau

SEQ ID NO: 626957 - RNA, 13 nt, Homo sapiens
agccugguuuuuc

SEQ ID NO: 626958 - RNA, 15 nt, Homo sapiens
agccuguacaaccua

SEQ ID NO: 626959 - RNA, 16 nt, Homo sapiens
agccuguacaaccuac

SEQ ID NO: 626960 - RNA, 11 nt, Homo sapiens
agccugucacc

SEQ ID NO: 626961 - RNA, 21 nt, Homo sapiens
agccuguccugguacagcagg

SEQ ID NO: 626962 - RNA, 14 nt, Homo sapiens
agccugugcaaaaa

SEQ ID NO: 626963 - RNA, 17 nt, Homo sapiens
agccuguggugcuugaa

SEQ ID NO: 626964 - RNA, 21 nt, Homo sapiens
agccugugguuacagugcaga

SEQ ID NO: 626965 - RNA, 13 nt, Homo sapiens
agccuuaagccau

SEQ ID NO: 626966 - RNA, 19 nt, Homo sapiens
agccuuauuuaugauguau

SEQ ID NO: 626967 - RNA, 20 nt, Homo sapiens
agccuuccacagugaaugug

SEQ ID NO: 626968 - RNA, 16 nt, Homo sapiens
agccuucggacagaca

SEQ ID NO: 626969 - RNA, 16 nt, Homo sapiens
agccuugaucagugac

SEQ ID NO: 626970 - RNA, 17 nt, Homo sapiens
agccuugcugggccagg

SEQ ID NO: 626971 - RNA, 15 nt, Homo sapiens
agccuugggguugga

SEQ ID NO: 626972 - RNA, 19 nt, Homo sapiens
agccuuuacuguuugauau

SEQ ID NO: 626973 - RNA, 15 nt, Homo sapiens
agccuuuccaaguca

SEQ ID NO: 626974 - RNA, 11 nt, Homo sapiens
agccuuuccag

SEQ ID NO: 626975 - RNA, 14 nt, Homo sapiens
agccuuugccuccc

SEQ ID NO: 626976 - RNA, 14 nt, Homo sapiens
agccuuugccuuua

SEQ ID NO: 626977 - RNA, 19 nt, Homo sapiens
agcgaauguguacaaagug

SEQ ID NO: 626978 - RNA, 17 nt, Homo sapiens
agcgagagucugucuca

SEQ ID NO: 626979 - RNA, 19 nt, Homo sapiens
agcgaggaggcuccagagg

SEQ ID NO: 626980 - RNA, 19 nt, Homo sapiens
agcgaugaggggacauuuu

SEQ ID NO: 626981 - RNA, 17 nt, Homo sapiens
agcgauggagcagucuc

SEQ ID NO: 626982 - RNA, 17 nt, Homo sapiens
agcgauugauugaugua

SEQ ID NO: 626983 - RNA, 18 nt, Homo sapiens
agcgauugauugauguac

SEQ ID NO: 626984 - RNA, 13 nt, Homo sapiens
agcgcacagggag

SEQ ID NO: 626985 - RNA, 22 nt, Homo sapiens
agcgcagguuuaguuuacucaa

SEQ ID NO: 626986 - RNA, 19 nt, Homo sapiens
agcgccacacacugcacau

SEQ ID NO: 626987 - RNA, 15 nt, Homo sapiens
agcgccagcucugcc

SEQ ID NO: 626988 - RNA, 18 nt, Homo sapiens
agcgccaggcugaccaca

SEQ ID NO: 626989 - RNA, 20 nt, Homo sapiens
agcgccugccgccccgggga

SEQ ID NO: 626990 - RNA, 22 nt, Homo sapiens
agcgccuuucccaacucuagcu

SEQ ID NO: 626991 - RNA, 17 nt, Homo sapiens
agcgcuacccaccucca

SEQ ID NO: 626992 - RNA, 18 nt, Homo sapiens
agcgcucgccacgcucag

SEQ ID NO: 626993 - RNA, 15 nt, Homo sapiens
agcgcuguaaacccu

SEQ ID NO: 626994 - RNA, 22 nt, Homo sapiens
agcgcuuuaaaagcgaccucuc

SEQ ID NO: 626995 - RNA, 15 nt, Homo sapiens
agcggaaacaggugu

SEQ ID NO: 626996 - RNA, 11 nt, Homo sapiens
agcggacauca

SEQ ID NO: 626997 - RNA, 14 nt, Homo sapiens
agcggccucagggu

SEQ ID NO: 626998 - RNA, 23 nt, Homo sapiens
agcggcuggcagcccaccccuca

SEQ ID NO: 626999 - RNA, 19 nt, Homo sapiens
agcggcuguuuacugcuuu

SEQ ID NO: 627000 - RNA, 14 nt, Homo sapiens
agcgggaauggcag

SEQ ID NO: 627001 - RNA, 17 nt, Homo sapiens
agcgggaggcagaguuu

SEQ ID NO: 627002 - RNA, 14 nt, Homo sapiens
agccacuguaugau

SEQ ID NO: 627003 - RNA, 15 nt, Homo sapiens
agccacugugcugaa

SEQ ID NO: 627004 - RNA, 21 nt, Homo sapiens
agccacuuaccaauugcuaag

SEQ ID NO: 627005 - RNA, 15 nt, Homo sapiens
agccacuugugagua

SEQ ID NO: 627006 - RNA, 18 nt, Homo sapiens
agccagaaaucccagcgc

SEQ ID NO: 627007 - RNA, 14 nt, Homo sapiens
agccagacaacuuc

SEQ ID NO: 627008 - RNA, 18 nt, Homo sapiens
agccagagagcaucuuuc

SEQ ID NO: 627009 - RNA, 22 nt, Homo sapiens
agccagagcugugccugcucag

SEQ ID NO: 627010 - RNA, 21 nt, Homo sapiens
agccagcaaguaagcuagcca

SEQ ID NO: 627011 - RNA, 16 nt, Homo sapiens
agccagcaaugauguc

SEQ ID NO: 627012 - RNA, 22 nt, Homo sapiens
agccagcacucacaccacuaac

SEQ ID NO: 627013 - RNA, 14 nt, Homo sapiens
agccagcacuugua

SEQ ID NO: 627014 - RNA, 22 nt, Homo sapiens
agccagcauccccaacugcgac

SEQ ID NO: 627015 - RNA, 13 nt, Homo sapiens
agccagccaugca

SEQ ID NO: 627016 - RNA, 23 nt, Homo sapiens
agccagcccuccuugacccagaa

SEQ ID NO: 627017 - RNA, 16 nt, Homo sapiens
agccagccggugccug

SEQ ID NO: 627018 - RNA, 16 nt, Homo sapiens
agccagccuugcuccu

SEQ ID NO: 627019 - RNA, 15 nt, Homo sapiens
agccagcucaaauca

SEQ ID NO: 627020 - RNA, 14 nt, Homo sapiens
agccagcugcuuga

SEQ ID NO: 627021 - RNA, 22 nt, Homo sapiens
agccaggacaugaagaaaagga

SEQ ID NO: 627022 - RNA, 21 nt, Homo sapiens
agccaggagugcccccgggaa

SEQ ID NO: 627023 - RNA, 19 nt, Homo sapiens
agccaggccaacagcaccu

SEQ ID NO: 627024 - RNA, 14 nt, Homo sapiens
agccaggcugacca

SEQ ID NO: 627025 - RNA, 16 nt, Homo sapiens
agccaggcugccaagg

SEQ ID NO: 627026 - RNA, 18 nt, Homo sapiens
agccagggcagaggaaug

SEQ ID NO: 627027 - RNA, 15 nt, Homo sapiens
agccagggccagugg

SEQ ID NO: 627028 - RNA, 16 nt, Homo sapiens
agccagguaaugugaa

SEQ ID NO: 627029 - RNA, 16 nt, Homo sapiens
agccaguaaucuuuau

SEQ ID NO: 627030 - RNA, 15 nt, Homo sapiens
agccagugacacuaa

SEQ ID NO: 627031 - RNA, 12 nt, Homo sapiens
agccagugccau

SEQ ID NO: 627032 - RNA, 13 nt, Homo sapiens
agccagugccauu

SEQ ID NO: 627033 - RNA, 14 nt, Homo sapiens
agccagugccauuc

SEQ ID NO: 627034 - RNA, 22 nt, Homo sapiens
agccaguggagcuggucugcca

SEQ ID NO: 627035 - RNA, 13 nt, Homo sapiens
agccaguggugcu

SEQ ID NO: 627036 - RNA, 16 nt, Homo sapiens
agccaguggugcuaaa

SEQ ID NO: 627037 - RNA, 22 nt, Homo sapiens
agccaguuaauuuuaagaauuu

SEQ ID NO: 627038 - RNA, 18 nt, Homo sapiens
agccauaagaaagcacua

SEQ ID NO: 627039 - RNA, 16 nt, Homo sapiens
agccauaggugcaguu

SEQ ID NO: 627040 - RNA, 22 nt, Homo sapiens
agccauaguggagagaacugaa

SEQ ID NO: 627041 - RNA, 17 nt, Homo sapiens
agccauaugaaugucag

SEQ ID NO: 627042 - RNA, 18 nt, Homo sapiens
agccaucacccucaccca

SEQ ID NO: 627043 - RNA, 23 nt, Homo sapiens
agccaucaccuugauaaugggau

SEQ ID NO: 627044 - RNA, 16 nt, Homo sapiens
agccaucauaacucac

SEQ ID NO: 627045 - RNA, 18 nt, Homo sapiens
agccaucuugaucugugu

SEQ ID NO: 627046 - RNA, 13 nt, Homo sapiens
agccaugccagcu

SEQ ID NO: 627047 - RNA, 18 nt, Homo sapiens
agccaugccucaugccac

SEQ ID NO: 627048 - RNA, 23 nt, Homo sapiens
agccauggcuucgucauuugcaa

SEQ ID NO: 627049 - RNA, 16 nt, Homo sapiens
agccaugggaccuccu

SEQ ID NO: 627050 - RNA, 20 nt, Homo sapiens
agccauggucccaggcuucc

SEQ ID NO: 627051 - RNA, 18 nt, Homo sapiens
agccauugaacagcugug

SEQ ID NO: 627052 - RNA, 11 nt, Homo sapiens
agccauuuagg

SEQ ID NO: 627053 - RNA, 17 nt, Homo sapiens
agccauuucacucucaa

SEQ ID NO: 627054 - RNA, 20 nt, Homo sapiens
agccauuucccccuccucag

SEQ ID NO: 627055 - RNA, 18 nt, Homo sapiens
agccauuuuucaaagcaa

SEQ ID NO: 627056 - RNA, 18 nt, Homo sapiens
agcccaagcuucccucca

SEQ ID NO: 627057 - RNA, 19 nt, Homo sapiens
agcccaccccucaacaccu

SEQ ID NO: 627058 - RNA, 20 nt, Homo sapiens
agcccacugccuccugccug

SEQ ID NO: 627059 - RNA, 18 nt, Homo sapiens
agcccagaauagcuuuga

SEQ ID NO: 627060 - RNA, 16 nt, Homo sapiens
agcccagagacuuugu

SEQ ID NO: 627061 - RNA, 14 nt, Homo sapiens
agcccagccauuac

SEQ ID NO: 627062 - RNA, 14 nt, Homo sapiens
agcccagccuggga

SEQ ID NO: 627063 - RNA, 15 nt, Homo sapiens
agcccaggacucuaa

SEQ ID NO: 627064 - RNA, 14 nt, Homo sapiens
agcccaggcagcua

SEQ ID NO: 627065 - RNA, 18 nt, Homo sapiens
agcccagggccccuguga

SEQ ID NO: 627066 - RNA, 12 nt, Homo sapiens
agcccagugugg

SEQ ID NO: 627067 - RNA, 18 nt, Homo sapiens
agcccagugugggacuga

SEQ ID NO: 627068 - RNA, 19 nt, Homo sapiens
agcccauaaagucugagaa

SEQ ID NO: 627069 - RNA, 16 nt, Homo sapiens
agcccauagccagcug

SEQ ID NO: 627070 - RNA, 12 nt, Homo sapiens
agcccauaucac

SEQ ID NO: 627071 - RNA, 13 nt, Homo sapiens
agcccaucaccuc

SEQ ID NO: 627072 - RNA, 16 nt, Homo sapiens
agcccaucaccucuaa

SEQ ID NO: 627073 - RNA, 16 nt, Homo sapiens
agcccauccagucucc

SEQ ID NO: 627074 - RNA, 22 nt, Homo sapiens
agcccaugacguguuucuugaa

SEQ ID NO: 627075 - RNA, 20 nt, Homo sapiens
agcccauggcccccaauaaa

SEQ ID NO: 627076 - RNA, 23 nt, Homo sapiens
agcccauggcuuuagcuaccuca

SEQ ID NO: 627077 - RNA, 14 nt, Homo sapiens
agcccaugucuucu

SEQ ID NO: 627078 - RNA, 15 nt, Homo sapiens
agccccaagcugggc

SEQ ID NO: 627079 - RNA, 17 nt, Homo sapiens
agacucaguuugucaga

SEQ ID NO: 627080 - RNA, 14 nt, Homo sapiens
agacucauaccaca

SEQ ID NO: 627081 - RNA, 22 nt, Homo sapiens
agacucauugcagcagguggua

SEQ ID NO: 627082 - RNA, 14 nt, Homo sapiens
agacuccaucucaa

SEQ ID NO: 627083 - RNA, 13 nt, Homo sapiens
agacuccaugaga

SEQ ID NO: 627084 - RNA, 18 nt, Homo sapiens
agacuccccaauaccuaa

SEQ ID NO: 627085 - RNA, 19 nt, Homo sapiens
agacuccuuugcuaaugcu

SEQ ID NO: 627086 - RNA, 16 nt, Homo sapiens
agacucgcuagcacuc

SEQ ID NO: 627087 - RNA, 19 nt, Homo sapiens
agacucguuuuuaaggugg

SEQ ID NO: 627088 - RNA, 18 nt, Homo sapiens
agacucugucuaccuggu

SEQ ID NO: 627089 - RNA, 13 nt, Homo sapiens
agacucugucuca

SEQ ID NO: 627090 - RNA, 21 nt, Homo sapiens
agacucuuaaugcagacucuu

SEQ ID NO: 627091 - RNA, 17 nt, Homo sapiens
agacucuuguacuugau

SEQ ID NO: 627092 - RNA, 16 nt, Homo sapiens
agacucuuuaugaucu

SEQ ID NO: 627093 - RNA, 18 nt, Homo sapiens
agacugaacauguuuaca

SEQ ID NO: 627094 - RNA, 17 nt, Homo sapiens
agacugaaucuaccugc

SEQ ID NO: 627095 - RNA, 20 nt, Homo sapiens
agacugaccauauugugcuu

SEQ ID NO: 627096 - RNA, 20 nt, Homo sapiens
agacugaguacguugugcau

SEQ ID NO: 627097 - RNA, 10 nt, Homo sapiens
agacugauga

SEQ ID NO: 627098 - RNA, 16 nt, Homo sapiens
agacugaugagcacau

SEQ ID NO: 627099 - RNA, 22 nt, Homo sapiens
agacugaugagcacaucucucu

SEQ ID NO: 627100 - RNA, 21 nt, Homo sapiens
agacugaugccagacaaaccu

SEQ ID NO: 627101 - RNA, 12 nt, Homo sapiens
agacugauuucu

SEQ ID NO: 627102 - RNA, 21 nt, Homo sapiens
agacugcccagcuaaagcaau

SEQ ID NO: 627103 - RNA, 16 nt, Homo sapiens
agacugcccuucucac

SEQ ID NO: 627104 - RNA, 18 nt, Homo sapiens
agacuggaacuugaacug

SEQ ID NO: 627105 - RNA, 22 nt, Homo sapiens
agacuggaauauaauuucaaac

SEQ ID NO: 627106 - RNA, 18 nt, Homo sapiens
agacuggagcaucugacu

SEQ ID NO: 627107 - RNA, 16 nt, Homo sapiens
agacuggauacugccc

SEQ ID NO: 627108 - RNA, 18 nt, Homo sapiens
agacuggauucgugacaa

SEQ ID NO: 627109 - RNA, 18 nt, Homo sapiens
agacuggcaauaaacucc

SEQ ID NO: 627110 - RNA, 21 nt, Homo sapiens
agacuggcaauaaacuccuac

SEQ ID NO: 627111 - RNA, 16 nt, Homo sapiens
agacugggacuauggc

SEQ ID NO: 627112 - RNA, 17 nt, Homo sapiens
agacugggaugccuguc

SEQ ID NO: 627113 - RNA, 19 nt, Homo sapiens
agacuggggcauccugugc

SEQ ID NO: 627114 - RNA, 16 nt, Homo sapiens
agacugguuagugaug

SEQ ID NO: 627115 - RNA, 22 nt, Homo sapiens
agacugugcccugggagcucug

SEQ ID NO: 627116 - RNA, 11 nt, Homo sapiens
agacugugcug

SEQ ID NO: 627117 - RNA, 15 nt, Homo sapiens
agacugugcugagaa

SEQ ID NO: 627118 - RNA, 13 nt, Homo sapiens
agacugugcuguu

SEQ ID NO: 627119 - RNA, 20 nt, Homo sapiens
agacuuagaaaaauccuaca

SEQ ID NO: 627120 - RNA, 19 nt, Homo sapiens
agacuuauggaacagggau

SEQ ID NO: 627121 - RNA, 11 nt, Homo sapiens
agacuucccag

SEQ ID NO: 627122 - RNA, 12 nt, Homo sapiens
agacuuccccau

SEQ ID NO: 627123 - RNA, 16 nt, Homo sapiens
agacuucgacucagga

SEQ ID NO: 627124 - RNA, 23 nt, Homo sapiens
agacuugaaauacuacuuaccau

SEQ ID NO: 627125 - RNA, 23 nt, Homo sapiens
agacuugcuuuucuaacuaagag

SEQ ID NO: 627126 - RNA, 13 nt, Homo sapiens
agacuuggcuuug

SEQ ID NO: 627127 - RNA, 20 nt, Homo sapiens
agacuuggguugaacuauaa

SEQ ID NO: 627128 - RNA, 14 nt, Homo sapiens
agacuuuacaugga

SEQ ID NO: 627129 - RNA, 17 nt, Homo sapiens
agacuuucccaaaugua

SEQ ID NO: 627130 - RNA, 14 nt, Homo sapiens
agacuuugcuguua

SEQ ID NO: 627131 - RNA, 14 nt, Homo sapiens
agacuuugggauag

SEQ ID NO: 627132 - RNA, 15 nt, Homo sapiens
agagaaaagaaacca

SEQ ID NO: 627133 - RNA, 13 nt, Homo sapiens
agagaaaagggaa

SEQ ID NO: 627134 - RNA, 23 nt, Homo sapiens
agagaaaauuugaaaauguccuu

SEQ ID NO: 627135 - RNA, 21 nt, Homo sapiens
agcagguguaaccguaaccca

SEQ ID NO: 627136 - RNA, 20 nt, Homo sapiens
agcagguucccaagcucaga

SEQ ID NO: 627137 - RNA, 20 nt, Homo sapiens
agcaguaaauacuugcaguu

SEQ ID NO: 627138 - RNA, 19 nt, Homo sapiens
agcaguauguuuguuucau

SEQ ID NO: 627139 - RNA, 22 nt, Homo sapiens
agcagucacugacaguuaauaa

SEQ ID NO: 627140 - RNA, 20 nt, Homo sapiens
agcagucagaguccagugcu

SEQ ID NO: 627141 - RNA, 15 nt, Homo sapiens
agcagucagcccuua

SEQ ID NO: 627142 - RNA, 22 nt, Homo sapiens
agcaguccacaaagcauuuuca

SEQ ID NO: 627143 - RNA, 19 nt, Homo sapiens
agcagucccaguauucuca

SEQ ID NO: 627144 - RNA, 24 nt, Homo sapiens
agcagucuucucuucugccuuuau

SEQ ID NO: 627145 - RNA, 16 nt, Homo sapiens
agcagugaucucaggg

SEQ ID NO: 627146 - RNA, 18 nt, Homo sapiens
agcagugaucucagggca

SEQ ID NO: 627147 - RNA, 16 nt, Homo sapiens
agcagugccuuccaua

SEQ ID NO: 627148 - RNA, 17 nt, Homo sapiens
agcagugccuuccauaa

SEQ ID NO: 627149 - RNA, 17 nt, Homo sapiens
agcagugcuuuucacua

SEQ ID NO: 627150 - RNA, 22 nt, Homo sapiens
agcagugcuuuucacuacuuug

SEQ ID NO: 627151 - RNA, 11 nt, Homo sapiens
agcaguggcau

SEQ ID NO: 627152 - RNA, 17 nt, Homo sapiens
agcagugggcagguggc

SEQ ID NO: 627153 - RNA, 20 nt, Homo sapiens
agcaguguccugugcuuucu

SEQ ID NO: 627154 - RNA, 21 nt, Homo sapiens
agcaguguccugugcuuucug

SEQ ID NO: 627155 - RNA, 17 nt, Homo sapiens
agcagugucuuccauaa

SEQ ID NO: 627156 - RNA, 23 nt, Homo sapiens
agcaguuacaaaaaccuucccca

SEQ ID NO: 627157 - RNA, 14 nt, Homo sapiens
agcaguuagcucau

SEQ ID NO: 627158 - RNA, 20 nt, Homo sapiens
agcaguucagcuccuuccac

SEQ ID NO: 627159 - RNA, 20 nt, Homo sapiens
agcaguucugaaaaaugcag

SEQ ID NO: 627160 - RNA, 14 nt, Homo sapiens
agcaguucugcaaa

SEQ ID NO: 627161 - RNA, 21 nt, Homo sapiens
agcaguugaaacaagaagcca

SEQ ID NO: 627162 - RNA, 17 nt, Homo sapiens
agcaguuugcugccaug

SEQ ID NO: 627163 - RNA, 15 nt, Homo sapiens
agcauaacaaaaaga

SEQ ID NO: 627164 - RNA, 16 nt, Homo sapiens
agcauaacauggagcu

SEQ ID NO: 627165 - RNA, 16 nt, Homo sapiens
agcauaacuguucuca

SEQ ID NO: 627166 - RNA, 18 nt, Homo sapiens
agcauaauaaaaaggcaa

SEQ ID NO: 627167 - RNA, 14 nt, Homo sapiens
agcauaaugcuccc

SEQ ID NO: 627168 - RNA, 20 nt, Homo sapiens
agcauaaugcucccaucucc

SEQ ID NO: 627169 - RNA, 17 nt, Homo sapiens
agcauaccaccaugccu

SEQ ID NO: 627170 - RNA, 18 nt, Homo sapiens
agcauacgguaugauauu

SEQ ID NO: 627171 - RNA, 13 nt, Homo sapiens
agcauacuuuaua

SEQ ID NO: 627172 - RNA, 23 nt, Homo sapiens
agcauagggucacuuugccauua

SEQ ID NO: 627173 - RNA, 22 nt, Homo sapiens
agcauauaggugauguuugcuc

SEQ ID NO: 627174 - RNA, 13 nt, Homo sapiens
agcauauggugcu

SEQ ID NO: 627175 - RNA, 15 nt, Homo sapiens
agcaucaaucuuguu

SEQ ID NO: 627176 - RNA, 14 nt, Homo sapiens
agcaucaccucagg

SEQ ID NO: 627177 - RNA, 13 nt, Homo sapiens
agcaucacugccc

SEQ ID NO: 627178 - RNA, 17 nt, Homo sapiens
agcaucacugccuuggc

SEQ ID NO: 627179 - RNA, 21 nt, Homo sapiens
agcaucauaaacaggcugacu

SEQ ID NO: 627180 - RNA, 11 nt, Homo sapiens
agcauccaugu

SEQ ID NO: 627181 - RNA, 13 nt, Homo sapiens
agcauccaugugu

SEQ ID NO: 627182 - RNA, 21 nt, Homo sapiens
agcauccuggccaacauggug

SEQ ID NO: 627183 - RNA, 21 nt, Homo sapiens
agcaucuacaccugaggacaa

SEQ ID NO: 627184 - RNA, 14 nt, Homo sapiens
agcaucucauucau

SEQ ID NO: 627185 - RNA, 20 nt, Homo sapiens
agcaucucugagcacccaag

SEQ ID NO: 627186 - RNA, 16 nt, Homo sapiens
agcaucuggcucuaau

SEQ ID NO: 627187 - RNA, 16 nt, Homo sapiens
agcaucuguaacagca

SEQ ID NO: 627188 - RNA, 13 nt, Homo sapiens
agcaucugugaug

SEQ ID NO: 627189 - RNA, 14 nt, Homo sapiens
agcaugaaagugga

SEQ ID NO: 627190 - RNA, 20 nt, Homo sapiens
agcaugaccugugaccagca

SEQ ID NO: 627191 - RNA, 23 nt, Homo sapiens
agcaugaggacagaccacagagc

SEQ ID NO: 627192 - RNA, 14 nt, Homo sapiens
agcaugaggcaaaa

SEQ ID NO: 627193 - RNA, 22 nt, Homo sapiens
agcaugauaggauuuggggcag

SEQ ID NO: 627194 - RNA, 21 nt, Homo sapiens
agcaugaucuuguuacuguga

SEQ ID NO: 627195 - RNA, 12 nt, Homo sapiens
agcaugcacaug

SEQ ID NO: 627196 - RNA, 21 nt, Homo sapiens
agcaugcuuugcugcuaugaa

SEQ ID NO: 627197 - RNA, 15 nt, Homo sapiens
agcauggacucuggg

SEQ ID NO: 627198 - RNA, 18 nt, Homo sapiens
agcauggaggaggaggga

SEQ ID NO: 627199 - RNA, 12 nt, Homo sapiens
agcauggcuguc

SEQ ID NO: 627200 - RNA, 16 nt, Homo sapiens
agcaugggaggugagg

SEQ ID NO: 627201 - RNA, 20 nt, Homo sapiens
agcaugugccaagauucuac

SEQ ID NO: 627202 - RNA, 15 nt, Homo sapiens
agcauguguauuucc

SEQ ID NO: 627203 - RNA, 22 nt, Homo sapiens
agcauguguauuuccagugcaa

SEQ ID NO: 627204 - RNA, 18 nt, Homo sapiens
agcauuaaaauuuuaccu

SEQ ID NO: 627205 - RNA, 16 nt, Homo sapiens
agcauuaagaacacuu

SEQ ID NO: 627206 - RNA, 15 nt, Homo sapiens
agcauuacaguauuu

SEQ ID NO: 627207 - RNA, 14 nt, Homo sapiens
agcauuacaguggg

SEQ ID NO: 627208 - RNA, 15 nt, Homo sapiens
agcauuacagugggu

SEQ ID NO: 627209 - RNA, 20 nt, Homo sapiens
acccuuucauucagccuuua

SEQ ID NO: 627210 - RNA, 14 nt, Homo sapiens
acccuuugcuguga

SEQ ID NO: 627211 - RNA, 17 nt, Homo sapiens
acccuuuugcaggcucc

SEQ ID NO: 627212 - RNA, 23 nt, Homo sapiens
acccuuuuuugaaccaacaucuu

SEQ ID NO: 627213 - RNA, 13 nt, Homo sapiens
accgagacaccac

SEQ ID NO: 627214 - RNA, 20 nt, Homo sapiens
accgagccacgcagugccug

SEQ ID NO: 627215 - RNA, 20 nt, Homo sapiens
accgagcgcuuucuggaaaa

SEQ ID NO: 627216 - RNA, 22 nt, Homo sapiens
accgaggugcaaauucauuuca

SEQ ID NO: 627217 - RNA, 18 nt, Homo sapiens
accgccacgucccagcau

SEQ ID NO: 627218 - RNA, 21 nt, Homo sapiens
accgcccugcgggccacaggg

SEQ ID NO: 627219 - RNA, 23 nt, Homo sapiens
accgccuggcccucuguggucac

SEQ ID NO: 627220 - RNA, 21 nt, Homo sapiens
accgcgcccagccucaucucu

SEQ ID NO: 627221 - RNA, 20 nt, Homo sapiens
accgcgcccggccucagugc

SEQ ID NO: 627222 - RNA, 14 nt, Homo sapiens
accgcucaguauua

SEQ ID NO: 627223 - RNA, 21 nt, Homo sapiens
accgcugggugguuuuuuccc

SEQ ID NO: 627224 - RNA, 16 nt, Homo sapiens
accgcuuauccccuca

SEQ ID NO: 627225 - RNA, 15 nt, Homo sapiens
accggaacugggcug

SEQ ID NO: 627226 - RNA, 22 nt, Homo sapiens
accggaaggaggccaaccagcc

SEQ ID NO: 627227 - RNA, 23 nt, Homo sapiens
accggaguuaugacaagcuuucc

SEQ ID NO: 627228 - RNA, 18 nt, Homo sapiens
accggaucuacacccacc

SEQ ID NO: 627229 - RNA, 19 nt, Homo sapiens
accgggaggacagcugccu

SEQ ID NO: 627230 - RNA, 18 nt, Homo sapiens
accgggcucacuugcuca

SEQ ID NO: 627231 - RNA, 19 nt, Homo sapiens
accggugcaugaugcugcc

SEQ ID NO: 627232 - RNA, 15 nt, Homo sapiens
accgucccucaguga

SEQ ID NO: 627233 - RNA, 23 nt, Homo sapiens
accgucucggcccugaaccacga

SEQ ID NO: 627234 - RNA, 19 nt, Homo sapiens
accgucuuccuucagggau

SEQ ID NO: 627235 - RNA, 21 nt, Homo sapiens
accgucuucucccuauucccu

SEQ ID NO: 627236 - RNA, 19 nt, Homo sapiens
accguggaccuuccugcca

SEQ ID NO: 627237 - RNA, 22 nt, Homo sapiens
accguggaggaggaaggcaaga

SEQ ID NO: 627238 - RNA, 21 nt, Homo sapiens
accguucagugucccaggcag

SEQ ID NO: 627239 - RNA, 14 nt, Homo sapiens
accguucugugcac

SEQ ID NO: 627240 - RNA, 18 nt, Homo sapiens
accuaaaacaucucauca

SEQ ID NO: 627241 - RNA, 16 nt, Homo sapiens
accuaaccacuuagca

SEQ ID NO: 627242 - RNA, 16 nt, Homo sapiens
accuaagcccugcccc

SEQ ID NO: 627243 - RNA, 18 nt, Homo sapiens
accuaagucucugugaau

SEQ ID NO: 627244 - RNA, 17 nt, Homo sapiens
accuaauucgaugaagg

SEQ ID NO: 627245 - RNA, 19 nt, Homo sapiens
accuacacaggagucuuca

SEQ ID NO: 627246 - RNA, 14 nt, Homo sapiens
accuacauuaucuc

SEQ ID NO: 627247 - RNA, 16 nt, Homo sapiens
accuacauuaucucac

SEQ ID NO: 627248 - RNA, 17 nt, Homo sapiens
accuaccaaaauggaau

SEQ ID NO: 627249 - RNA, 16 nt, Homo sapiens
accuaccaucagggac

SEQ ID NO: 627250 - RNA, 16 nt, Homo sapiens
accuacuaggccauua

SEQ ID NO: 627251 - RNA, 15 nt, Homo sapiens
accuacugcacugag

SEQ ID NO: 627252 - RNA, 20 nt, Homo sapiens
accuacugcuuacuguugcu

SEQ ID NO: 627253 - RNA, 12 nt, Homo sapiens
accuacuuugua

SEQ ID NO: 627254 - RNA, 16 nt, Homo sapiens
accuagaauagucuca

SEQ ID NO: 627255 - RNA, 20 nt, Homo sapiens
accuagaaugucagauuucu

SEQ ID NO: 627256 - RNA, 21 nt, Homo sapiens
accuagaccaguuugcaugau

SEQ ID NO: 627257 - RNA, 19 nt, Homo sapiens
accuagagcuagauguguc

SEQ ID NO: 627258 - RNA, 16 nt, Homo sapiens
accuagaguuuuauca

SEQ ID NO: 627259 - RNA, 23 nt, Homo sapiens
accuaggagggugugaguggcau

SEQ ID NO: 627260 - RNA, 13 nt, Homo sapiens
accuaggauuuca

SEQ ID NO: 627261 - RNA, 16 nt, Homo sapiens
accuagggcacuuuaa

SEQ ID NO: 627262 - RNA, 23 nt, Homo sapiens
accuaguacugccccccaugagg

SEQ ID NO: 627263 - RNA, 15 nt, Homo sapiens
accuagugaaacuuu

SEQ ID NO: 627264 - RNA, 16 nt, Homo sapiens
accuauaagaagccuu

SEQ ID NO: 627265 - RNA, 13 nt, Homo sapiens
accuauacauuau

SEQ ID NO: 627266 - RNA, 18 nt, Homo sapiens
accuaucaaaaauuauuc

SEQ ID NO: 627267 - RNA, 15 nt, Homo sapiens
accuaucuguggaaa

SEQ ID NO: 627268 - RNA, 21 nt, Homo sapiens
accuaugagauggccaugcuc

SEQ ID NO: 627269 - RNA, 21 nt, Homo sapiens
accuauguguccucuaaguca

SEQ ID NO: 627270 - RNA, 17 nt, Homo sapiens
accuauuucugaugaug

SEQ ID NO: 627271 - RNA, 14 nt, Homo sapiens
accucaaaggugau

SEQ ID NO: 627272 - RNA, 17 nt, Homo sapiens
accucaaccuaugguau

SEQ ID NO: 627273 - RNA, 13 nt, Homo sapiens
accucaaccugug

SEQ ID NO: 627274 - RNA, 22 nt, Homo sapiens
accucaacugccuacuccaaaa

SEQ ID NO: 627275 - RNA, 21 nt, Homo sapiens
accucaagcaaccaugaacuc

SEQ ID NO: 627276 - RNA, 13 nt, Homo sapiens
accucaaggucau

SEQ ID NO: 627277 - RNA, 20 nt, Homo sapiens
accucacaggccccaggaaa

SEQ ID NO: 627278 - RNA, 16 nt, Homo sapiens
accucaccugaccuca

SEQ ID NO: 627279 - RNA, 18 nt, Homo sapiens
accucaccugggcaggga

SEQ ID NO: 627280 - RNA, 16 nt, Homo sapiens
accucacuaugcugcu

SEQ ID NO: 627281 - RNA, 16 nt, Homo sapiens
accucacuccuguuac

SEQ ID NO: 627282 - RNA, 12 nt, Homo sapiens
accucacugggg

SEQ ID NO: 627283 - RNA, 13 nt, Homo sapiens
accucacugucag

SEQ ID NO: 627284 - RNA, 12 nt, Homo sapiens
accucacuguga

SEQ ID NO: 627285 - RNA, 12 nt, Homo sapiens
accucacuuuag

SEQ ID NO: 627286 - RNA, 19 nt, Homo sapiens
accucagccucccaaagug

SEQ ID NO: 627287 - RNA, 16 nt, Homo sapiens
accucagcugcacauu

SEQ ID NO: 627288 - RNA, 19 nt, Homo sapiens
accucagcugcacauuccu

SEQ ID NO: 627289 - RNA, 18 nt, Homo sapiens
accucagucucccagcua

SEQ ID NO: 627290 - RNA, 18 nt, Homo sapiens
accucaguuuccucaucu

SEQ ID NO: 627291 - RNA, 12 nt, Homo sapiens
accucaguuuua

SEQ ID NO: 627292 - RNA, 19 nt, Homo sapiens
accucaugagucuaccuga

SEQ ID NO: 627293 - RNA, 21 nt, Homo sapiens
accucauuccggccacaucau

SEQ ID NO: 627294 - RNA, 17 nt, Homo sapiens
accuccaagcauuucau

SEQ ID NO: 627295 - RNA, 20 nt, Homo sapiens
accuccaagcauuucaugaa

SEQ ID NO: 627296 - RNA, 17 nt, Homo sapiens
accuccacccacugucc

SEQ ID NO: 627297 - RNA, 13 nt, Homo sapiens
accuccaggggcu

SEQ ID NO: 627298 - RNA, 15 nt, Homo sapiens
accuccauuucccaa

SEQ ID NO: 627299 - RNA, 15 nt, Homo sapiens
accucccagcccuau

SEQ ID NO: 627300 - RNA, 21 nt, Homo sapiens
accucccauuacuuugauauc

SEQ ID NO: 627301 - RNA, 21 nt, Homo sapiens
accucccccuuucacacugga

SEQ ID NO: 627302 - RNA, 18 nt, Homo sapiens
accuccccuccuugccuc

SEQ ID NO: 627303 - RNA, 19 nt, Homo sapiens
accucccugccuccaggaa

SEQ ID NO: 627304 - RNA, 18 nt, Homo sapiens
accuccgagaggcagcca

SEQ ID NO: 627305 - RNA, 19 nt, Homo sapiens
accuccgccagauccugca

SEQ ID NO: 627306 - RNA, 16 nt, Homo sapiens
accuccgccauccacc

SEQ ID NO: 627307 - RNA, 22 nt, Homo sapiens
accuccuagaggugggcagcug

SEQ ID NO: 627308 - RNA, 20 nt, Homo sapiens
accuccuauggguugucacc

SEQ ID NO: 627309 - RNA, 21 nt, Homo sapiens
accuccucccuaaugcucacc

SEQ ID NO: 627310 - RNA, 13 nt, Homo sapiens
accuccucuguga

SEQ ID NO: 627311 - RNA, 23 nt, Homo sapiens
accuccugaccugucaccgugag

SEQ ID NO: 627312 - RNA, 18 nt, Homo sapiens
accuccugagccccucaa

SEQ ID NO: 627313 - RNA, 17 nt, Homo sapiens
accuccuggugguacca

SEQ ID NO: 627314 - RNA, 19 nt, Homo sapiens
accuccuucuuccuagcca

SEQ ID NO: 627315 - RNA, 12 nt, Homo sapiens
accuccuugacu

SEQ ID NO: 627316 - RNA, 19 nt, Homo sapiens
accuccuuguguugcacug

SEQ ID NO: 627317 - RNA, 14 nt, Homo sapiens
accuccuuuaccag

SEQ ID NO: 627318 - RNA, 22 nt, Homo sapiens
accuccuuucaucacacugggu

SEQ ID NO: 627319 - RNA, 17 nt, Homo sapiens
accucgaccugaugcag

SEQ ID NO: 627320 - RNA, 19 nt, Homo sapiens
accucggccucccaaagug

SEQ ID NO: 627321 - RNA, 20 nt, Homo sapiens
accucggccucccaaagugc

SEQ ID NO: 627322 - RNA, 22 nt, Homo sapiens
accucuauauaccaaagcacau

SEQ ID NO: 627323 - RNA, 20 nt, Homo sapiens
accucucaacauuaccaaaa

SEQ ID NO: 627324 - RNA, 19 nt, Homo sapiens
accucucuccuuugcugag

SEQ ID NO: 627325 - RNA, 23 nt, Homo sapiens
accucucugaacugcaacacugg

SEQ ID NO: 627326 - RNA, 13 nt, Homo sapiens
accucucugggcc

SEQ ID NO: 627327 - RNA, 12 nt, Homo sapiens
accucugacaca

SEQ ID NO: 627328 - RNA, 23 nt, Homo sapiens
accucugagaggggagaguccag

SEQ ID NO: 627329 - RNA, 12 nt, Homo sapiens
accucugaggac

SEQ ID NO: 627330 - RNA, 19 nt, Homo sapiens
accucugauggcugaagaa

SEQ ID NO: 627331 - RNA, 16 nt, Homo sapiens
aaaucaauguguacaa

SEQ ID NO: 627332 - RNA, 13 nt, Homo sapiens
aaaucacucucag

SEQ ID NO: 627333 - RNA, 13 nt, Homo sapiens
aaaucacugucaa

SEQ ID NO: 627334 - RNA, 14 nt, Homo sapiens
aaaucaggggccag

SEQ ID NO: 627335 - RNA, 14 nt, Homo sapiens
aaaucagucuuccu

SEQ ID NO: 627336 - RNA, 17 nt, Homo sapiens
aaaucauccucaugucc

SEQ ID NO: 627337 - RNA, 21 nt, Homo sapiens
aaaucaugccauugcacucca

SEQ ID NO: 627338 - RNA, 14 nt, Homo sapiens
aaaucaugugauaa

SEQ ID NO: 627339 - RNA, 13 nt, Homo sapiens
aaaucauguguug

SEQ ID NO: 627340 - RNA, 16 nt, Homo sapiens
aaaucauucagaucau

SEQ ID NO: 627341 - RNA, 16 nt, Homo sapiens
aaauccaaauuucuca

SEQ ID NO: 627342 - RNA, 16 nt, Homo sapiens
aaauccacaagccauu

SEQ ID NO: 627343 - RNA, 14 nt, Homo sapiens
aaauccagaacuca

SEQ ID NO: 627344 - RNA, 13 nt, Homo sapiens
aaauccaggucau

SEQ ID NO: 627345 - RNA, 20 nt, Homo sapiens
aaaucccaagaaauggaauc

SEQ ID NO: 627346 - RNA, 19 nt, Homo sapiens
aauuaaaauccucaaucca

SEQ ID NO: 627347 - RNA, 14 nt, Homo sapiens
aauuaaaaugacaa

SEQ ID NO: 627348 - RNA, 23 nt, Homo sapiens
aauuaaaccagauuggagcaauu

SEQ ID NO: 627349 - RNA, 13 nt, Homo sapiens
aauuaaagaccua

SEQ ID NO: 627350 - RNA, 20 nt, Homo sapiens
aauuaaagaugccauagcau

SEQ ID NO: 627351 - RNA, 13 nt, Homo sapiens
aauuaaagcacac

SEQ ID NO: 627352 - RNA, 11 nt, Homo sapiens
aauuaaagccc

SEQ ID NO: 627353 - RNA, 17 nt, Homo sapiens
aauuaaaggaacagagu

SEQ ID NO: 627354 - RNA, 14 nt, Homo sapiens
aauuaaaguacuuu

SEQ ID NO: 627355 - RNA, 15 nt, Homo sapiens
aauuaaaucuagaca

SEQ ID NO: 627356 - RNA, 18 nt, Homo sapiens
aauuaacacaguguuuca

SEQ ID NO: 627357 - RNA, 21 nt, Homo sapiens
aauuaacagagauugaacucc

SEQ ID NO: 627358 - RNA, 17 nt, Homo sapiens
aauuaacauaugucacg

SEQ ID NO: 627359 - RNA, 14 nt, Homo sapiens
aauuaacucaagau

SEQ ID NO: 627360 - RNA, 22 nt, Homo sapiens
aauuaaguuuuggguaagugug

SEQ ID NO: 627361 - RNA, 18 nt, Homo sapiens
aauuaauauucauauuau

SEQ ID NO: 627362 - RNA, 23 nt, Homo sapiens
aauuaauuugugaauuugcaaca

SEQ ID NO: 627363 - RNA, 16 nt, Homo sapiens
aauuacaaaacucaga

SEQ ID NO: 627364 - RNA, 21 nt, Homo sapiens
aauuacaguaaucccauuucc

SEQ ID NO: 627365 - RNA, 18 nt, Homo sapiens
aauuacagucaucugucu

SEQ ID NO: 627366 - RNA, 23 nt, Homo sapiens
aauuacauguuuuuucauuugua

SEQ ID NO: 627367 - RNA, 11 nt, Homo sapiens
aauuaccaugc

SEQ ID NO: 627368 - RNA, 20 nt, Homo sapiens
aauuaccauuaauuacauac

SEQ ID NO: 627369 - RNA, 15 nt, Homo sapiens
aauuacccuuuugca

SEQ ID NO: 627370 - RNA, 21 nt, Homo sapiens
aauuaccgugagugacauagc

SEQ ID NO: 627371 - RNA, 14 nt, Homo sapiens
aauuaccuguggau

SEQ ID NO: 627372 - RNA, 13 nt, Homo sapiens
aauuacuaauaaa

SEQ ID NO: 627373 - RNA, 18 nt, Homo sapiens
aauuacugccuuacugua

SEQ ID NO: 627374 - RNA, 15 nt, Homo sapiens
aauuacugugaauug

SEQ ID NO: 627375 - RNA, 22 nt, Homo sapiens
aauuagaauaguguucugcaaa

SEQ ID NO: 627376 - RNA, 14 nt, Homo sapiens
aauuagacaucuuc

SEQ ID NO: 627377 - RNA, 20 nt, Homo sapiens
aauuagaucgguucugugcc

SEQ ID NO: 627378 - RNA, 21 nt, Homo sapiens
aauuagcugugugaaauacca

SEQ ID NO: 627379 - RNA, 20 nt, Homo sapiens
aauuagucuuuuguaauauc

SEQ ID NO: 627380 - RNA, 15 nt, Homo sapiens
aauuagugaguauaa

SEQ ID NO: 627381 - RNA, 18 nt, Homo sapiens
aauuaguuaacaguuuuu

SEQ ID NO: 627382 - RNA, 19 nt, Homo sapiens
aauuaguuuaccucaucca

SEQ ID NO: 627383 - RNA, 12 nt, Homo sapiens
aauuaguuucaa

SEQ ID NO: 627384 - RNA, 16 nt, Homo sapiens
aauuauaagcauacaa

SEQ ID NO: 627385 - RNA, 13 nt, Homo sapiens
aauuauaucacuu

SEQ ID NO: 627386 - RNA, 16 nt, Homo sapiens
aauuaucaaaaagcua

SEQ ID NO: 627387 - RNA, 22 nt, Homo sapiens
aauuaucaugcguuuuauaucu

SEQ ID NO: 627388 - RNA, 22 nt, Homo sapiens
aauuauccauuacgugcauuua

SEQ ID NO: 627389 - RNA, 18 nt, Homo sapiens
aauuaucgggaacagugu

SEQ ID NO: 627390 - RNA, 23 nt, Homo sapiens
aauuaucuugaauguaguauuca

SEQ ID NO: 627391 - RNA, 18 nt, Homo sapiens
aauuaugaaacauuuuag

SEQ ID NO: 627392 - RNA, 16 nt, Homo sapiens
aauuaugucugcugaa

SEQ ID NO: 627393 - RNA, 19 nt, Homo sapiens
aauuauucugccuacguuc

SEQ ID NO: 627394 - RNA, 16 nt, Homo sapiens
aauuauugacacugaa

SEQ ID NO: 627395 - RNA, 18 nt, Homo sapiens
aauuauugcuguauguaa

SEQ ID NO: 627396 - RNA, 20 nt, Homo sapiens
aauuauuuauuacuugugca

SEQ ID NO: 627397 - RNA, 18 nt, Homo sapiens
aauuauuugucaagcaaa

SEQ ID NO: 627398 - RNA, 16 nt, Homo sapiens
aauuauuuuauaucau

SEQ ID NO: 627399 - RNA, 16 nt, Homo sapiens
aauuauuuugguacuu

SEQ ID NO: 627400 - RNA, 19 nt, Homo sapiens
aauuauuuuuacaguucuc

SEQ ID NO: 627401 - RNA, 13 nt, Homo sapiens
aauucaaaaguga

SEQ ID NO: 627402 - RNA, 12 nt, Homo sapiens
aauucaaccacu

SEQ ID NO: 627403 - RNA, 21 nt, Homo sapiens
aauucaacccagccaugcaau

SEQ ID NO: 627404 - RNA, 15 nt, Homo sapiens
aauucaagcauuuag

SEQ ID NO: 627405 - RNA, 12 nt, Homo sapiens
aauucaauacag

SEQ ID NO: 627406 - RNA, 16 nt, Homo sapiens
aauucaauuuggcaaa

SEQ ID NO: 627407 - RNA, 21 nt, Homo sapiens
aauucacaaguuacacugcca

SEQ ID NO: 627408 - RNA, 16 nt, Homo sapiens
aauucaccaacacagu

SEQ ID NO: 627409 - RNA, 19 nt, Homo sapiens
aauucacuucucuuccucc

SEQ ID NO: 627410 - RNA, 15 nt, Homo sapiens
aauucagacagagac

SEQ ID NO: 627411 - RNA, 14 nt, Homo sapiens
aauucagaguccuu

SEQ ID NO: 627412 - RNA, 14 nt, Homo sapiens
aauucagcacuuaa

SEQ ID NO: 627413 - RNA, 13 nt, Homo sapiens
aauucagcauuug

SEQ ID NO: 627414 - RNA, 13 nt, Homo sapiens
aauucaguacaac

SEQ ID NO: 627415 - RNA, 12 nt, Homo sapiens
aauucagugucu

SEQ ID NO: 627416 - RNA, 20 nt, Homo sapiens
aauucaguugcuuugcccaa

SEQ ID NO: 627417 - RNA, 18 nt, Homo sapiens
aauucauaaagaaaugca

SEQ ID NO: 627418 - RNA, 16 nt, Homo sapiens
aauucauaaucacucu

SEQ ID NO: 627419 - RNA, 14 nt, Homo sapiens
aauucaucagucau

SEQ ID NO: 627420 - RNA, 12 nt, Homo sapiens
aauucauguuuc

SEQ ID NO: 627421 - RNA, 20 nt, Homo sapiens
aauucauuuuuuucacugga

SEQ ID NO: 627422 - RNA, 13 nt, Homo sapiens
aauuccaaagcaa

SEQ ID NO: 627423 - RNA, 21 nt, Homo sapiens
aauuccaaagcaaaaccagaa

SEQ ID NO: 627424 - RNA, 14 nt, Homo sapiens
aauuccaaagccag

SEQ ID NO: 627425 - RNA, 23 nt, Homo sapiens
aauuccaagacagugcccaugaa

SEQ ID NO: 627426 - RNA, 13 nt, Homo sapiens
aauuccaauauga

SEQ ID NO: 627427 - RNA, 22 nt, Homo sapiens
aauuccacaccuuuuauugaca

SEQ ID NO: 627428 - RNA, 14 nt, Homo sapiens
aauuccaccaagac

SEQ ID NO: 627429 - RNA, 17 nt, Homo sapiens
aauuccaggaaccaaaa

SEQ ID NO: 627430 - RNA, 18 nt, Homo sapiens
aauucccauuuugcaaaa

SEQ ID NO: 627431 - RNA, 22 nt, Homo sapiens
aauuccuauauccugugacugu

SEQ ID NO: 627432 - RNA, 16 nt, Homo sapiens
aauuccugcuaugaca

SEQ ID NO: 627433 - RNA, 14 nt, Homo sapiens
aauuccuggcauga

SEQ ID NO: 627434 - RNA, 17 nt, Homo sapiens
aauucgaaaacaaccgu

SEQ ID NO: 627435 - RNA, 22 nt, Homo sapiens
aauucgcugcaaccuguugaua

SEQ ID NO: 627436 - RNA, 16 nt, Homo sapiens
aauucguuuuugcaau

SEQ ID NO: 627437 - RNA, 16 nt, Homo sapiens
aauucuaacaagucau

SEQ ID NO: 627438 - RNA, 23 nt, Homo sapiens
aauucuaacccagguauccaaaa

SEQ ID NO: 627439 - RNA, 19 nt, Homo sapiens
aauucuaaguuauuuacuu

SEQ ID NO: 627440 - RNA, 22 nt, Homo sapiens
aauucuaccaaggucuucuuaa

SEQ ID NO: 627441 - RNA, 18 nt, Homo sapiens
aauucuaccuccuugugu

SEQ ID NO: 627442 - RNA, 11 nt, Homo sapiens
aauucuacugg

SEQ ID NO: 627443 - RNA, 20 nt, Homo sapiens
aauucuagauuaccaugaag

SEQ ID NO: 627444 - RNA, 14 nt, Homo sapiens
aauucuauaguaag

SEQ ID NO: 627445 - RNA, 23 nt, Homo sapiens
aauucucucacaaaguccacuuu

SEQ ID NO: 627446 - RNA, 23 nt, Homo sapiens
aauucucucccccuauuuauuga

SEQ ID NO: 627447 - RNA, 13 nt, Homo sapiens
aauucucuuucac

SEQ ID NO: 627448 - RNA, 19 nt, Homo sapiens
aauucugaugagcauuacu

SEQ ID NO: 627449 - RNA, 13 nt, Homo sapiens
aauucugccuugg

SEQ ID NO: 627450 - RNA, 17 nt, Homo sapiens
aauucugcucagauaga

SEQ ID NO: 627451 - RNA, 19 nt, Homo sapiens
aauucuggcaggaccucac

SEQ ID NO: 627452 - RNA, 16 nt, Homo sapiens
aauucugggaauccac

SEQ ID NO: 627453 - RNA, 18 nt, Homo sapiens
aauucugguauacauuga

SEQ ID NO: 627454 - RNA, 17 nt, Homo sapiens
aauucuguaucuguaga

SEQ ID NO: 627455 - RNA, 16 nt, Homo sapiens
aauucugugacauaca

SEQ ID NO: 627456 - RNA, 20 nt, Homo sapiens
aauucuguggcaguuuuaaa

SEQ ID NO: 627457 - RNA, 21 nt, Homo sapiens
aauucuguuuuuaaugcuauu

SEQ ID NO: 627458 - RNA, 18 nt, Homo sapiens
aauucuuagaauaucuaa

SEQ ID NO: 627459 - RNA, 22 nt, Homo sapiens
aauucuucuguccugagaagca

SEQ ID NO: 627460 - RNA, 16 nt, Homo sapiens
aauucuugaaguucau

SEQ ID NO: 627461 - RNA, 13 nt, Homo sapiens
aauucuuguagau

SEQ ID NO: 627462 - RNA, 14 nt, Homo sapiens
aauucuuucacuug

SEQ ID NO: 627463 - RNA, 16 nt, Homo sapiens
aauucuuucuguugaa

SEQ ID NO: 627464 - RNA, 15 nt, Homo sapiens
aauucuuuuauaaau

SEQ ID NO: 627465 - RNA, 23 nt, Homo sapiens
aauugaaacuuuuuucauuuuga

SEQ ID NO: 627466 - RNA, 15 nt, Homo sapiens
aauugaaagaacuua

SEQ ID NO: 627467 - RNA, 16 nt, Homo sapiens
aauugaagugucuucu

SEQ ID NO: 627468 - RNA, 21 nt, Homo sapiens
aauugaauucuggaaacuccu

SEQ ID NO: 627469 - RNA, 21 nt, Homo sapiens
acaguuggauuuauucugcca

SEQ ID NO: 627470 - RNA, 20 nt, Homo sapiens
acaguugggacccaaaacac

SEQ ID NO: 627471 - RNA, 17 nt, Homo sapiens
acaguuuacuuugccaa

SEQ ID NO: 627472 - RNA, 22 nt, Homo sapiens
acaguuuagugcuuuacaugcu

SEQ ID NO: 627473 - RNA, 12 nt, Homo sapiens
acaguuuuccaa

SEQ ID NO: 627474 - RNA, 14 nt, Homo sapiens
acauaaaagacaca

SEQ ID NO: 627475 - RNA, 15 nt, Homo sapiens
acauaacaugcuuua

SEQ ID NO: 627476 - RNA, 17 nt, Homo sapiens
acauaacccacucuguc

SEQ ID NO: 627477 - RNA, 14 nt, Homo sapiens
acauaacuccaucu

SEQ ID NO: 627478 - RNA, 20 nt, Homo sapiens
acauaagaccauaacagcca

SEQ ID NO: 627479 - RNA, 13 nt, Homo sapiens
acauaaggaugaa

SEQ ID NO: 627480 - RNA, 16 nt, Homo sapiens
acauaaguaacuuuua

SEQ ID NO: 627481 - RNA, 21 nt, Homo sapiens
acauaaugguuuuguuagauu

SEQ ID NO: 627482 - RNA, 17 nt, Homo sapiens
acauaauuuugugcaug

SEQ ID NO: 627483 - RNA, 17 nt, Homo sapiens
acauacacuguauguua

SEQ ID NO: 627484 - RNA, 13 nt, Homo sapiens
acauacagacaca

SEQ ID NO: 627485 - RNA, 16 nt, Homo sapiens
acauacauacauacau

SEQ ID NO: 627486 - RNA, 15 nt, Homo sapiens
acauacauacauaua

SEQ ID NO: 627487 - RNA, 12 nt, Homo sapiens
acauacauauau

SEQ ID NO: 627488 - RNA, 14 nt, Homo sapiens
acauacuccaacug

SEQ ID NO: 627489 - RNA, 11 nt, Homo sapiens
acauacugcug

SEQ ID NO: 627490 - RNA, 16 nt, Homo sapiens
acauacuguucacuca

SEQ ID NO: 627491 - RNA, 15 nt, Homo sapiens
acauacuuaaugcau

SEQ ID NO: 627492 - RNA, 16 nt, Homo sapiens
acauacuuacauuuca

SEQ ID NO: 627493 - RNA, 17 nt, Homo sapiens
acauagaaaacaaucaa

SEQ ID NO: 627494 - RNA, 23 nt, Homo sapiens
acauagaaauggaaauuuugcua

SEQ ID NO: 627495 - RNA, 18 nt, Homo sapiens
acauagagugaucuuucc

SEQ ID NO: 627496 - RNA, 15 nt, Homo sapiens
acauagcaucucagg

SEQ ID NO: 627497 - RNA, 19 nt, Homo sapiens
acauagguaaaaacuggaa

SEQ ID NO: 627498 - RNA, 19 nt, Homo sapiens
acauaguagaacgcuaucu

SEQ ID NO: 627499 - RNA, 22 nt, Homo sapiens
acauaguagguacccaauucaa

SEQ ID NO: 627500 - RNA, 23 nt, Homo sapiens
acauagucuugaugacauuucac

SEQ ID NO: 627501 - RNA, 17 nt, Homo sapiens
acauaguguauuuugca

SEQ ID NO: 627502 - RNA, 15 nt, Homo sapiens
acauaguguccugcc

SEQ ID NO: 627503 - RNA, 16 nt, Homo sapiens
acauaguuaaaugugc

SEQ ID NO: 627504 - RNA, 22 nt, Homo sapiens
acauauaaaugaaucugguguu

SEQ ID NO: 627505 - RNA, 13 nt, Homo sapiens
acauauacucaaa

SEQ ID NO: 627506 - RNA, 18 nt, Homo sapiens
acauauauauuaauacug

SEQ ID NO: 627507 - RNA, 17 nt, Homo sapiens
acauauaucaaagugag

SEQ ID NO: 627508 - RNA, 22 nt, Homo sapiens
acauauccuuucaagacagaaa

SEQ ID NO: 627509 - RNA, 13 nt, Homo sapiens
acauaugacaaug

SEQ ID NO: 627510 - RNA, 22 nt, Homo sapiens
acauaugauccaguuaacauca

SEQ ID NO: 627511 - RNA, 20 nt, Homo sapiens
acauauggauguuacucucu

SEQ ID NO: 627512 - RNA, 15 nt, Homo sapiens
acauaugugcuggaa

SEQ ID NO: 627513 - RNA, 22 nt, Homo sapiens
acauauuaggaaaauauggguu

SEQ ID NO: 627514 - RNA, 14 nt, Homo sapiens
acauauuaucucau

SEQ ID NO: 627515 - RNA, 16 nt, Homo sapiens
acauauuaugucuuca

SEQ ID NO: 627516 - RNA, 18 nt, Homo sapiens
acauauuguaaagcccau

SEQ ID NO: 627517 - RNA, 12 nt, Homo sapiens
acauauuuagcg

SEQ ID NO: 627518 - RNA, 22 nt, Homo sapiens
acauauuuuuauacuuuauuga

SEQ ID NO: 627519 - RNA, 16 nt, Homo sapiens
acaucaaaacuaacca

SEQ ID NO: 627520 - RNA, 22 nt, Homo sapiens
acaucaaaacuaaccaucugaa

SEQ ID NO: 627521 - RNA, 16 nt, Homo sapiens
acaucaaaacuuaaga

SEQ ID NO: 627522 - RNA, 19 nt, Homo sapiens
acaucaaagugguaaauac

SEQ ID NO: 627523 - RNA, 23 nt, Homo sapiens
acaucaaagugguaaauacugug

SEQ ID NO: 627524 - RNA, 20 nt, Homo sapiens
acaucaaauuugccaccacu

SEQ ID NO: 627525 - RNA, 23 nt, Homo sapiens
acaucaacauggcaauugcacuc

SEQ ID NO: 627526 - RNA, 16 nt, Homo sapiens
acaucacaacauuuac

SEQ ID NO: 627527 - RNA, 14 nt, Homo sapiens
acaucacauuccag

SEQ ID NO: 627528 - RNA, 23 nt, Homo sapiens
acaucaccuuuuugacuuuucca

SEQ ID NO: 627529 - RNA, 12 nt, Homo sapiens
acaucacuuugu

SEQ ID NO: 627530 - RNA, 17 nt, Homo sapiens
acaucagcaaacaggau

SEQ ID NO: 627531 - RNA, 14 nt, Homo sapiens
acaucagcagagaa

SEQ ID NO: 627532 - RNA, 20 nt, Homo sapiens
acaucagcagagaacuggaa

SEQ ID NO: 627533 - RNA, 17 nt, Homo sapiens
acaucagucuccaacau

SEQ ID NO: 627534 - RNA, 15 nt, Homo sapiens
acaucauaacccaug

SEQ ID NO: 627535 - RNA, 15 nt, Homo sapiens
acaucauaauuacau

SEQ ID NO: 627536 - RNA, 17 nt, Homo sapiens
acaucauaauuacauuc

SEQ ID NO: 627537 - RNA, 13 nt, Homo sapiens
acaucauggacug

SEQ ID NO: 627538 - RNA, 24 nt, Homo sapiens
acaucauuacugccaucuuuauca

SEQ ID NO: 627539 - RNA, 21 nt, Homo sapiens
acaucauuacuuaugaugaug

SEQ ID NO: 627540 - RNA, 20 nt, Homo sapiens
acaucauuauuggcaguuuc

SEQ ID NO: 627541 - RNA, 17 nt, Homo sapiens
acauccaaaauaguuaa

SEQ ID NO: 627542 - RNA, 20 nt, Homo sapiens
acauccaaagcagacagcuc

SEQ ID NO: 627543 - RNA, 14 nt, Homo sapiens
acauccagcccagg

SEQ ID NO: 627544 - RNA, 13 nt, Homo sapiens
acaucccacagug

SEQ ID NO: 627545 - RNA, 14 nt, Homo sapiens
acaucccacagugg

SEQ ID NO: 627546 - RNA, 22 nt, Homo sapiens
acaucccaguccaccugaggaa

SEQ ID NO: 627547 - RNA, 16 nt, Homo sapiens
acaucccauugcccug

SEQ ID NO: 627548 - RNA, 17 nt, Homo sapiens
acaucccugauucucuc

SEQ ID NO: 627549 - RNA, 22 nt, Homo sapiens
acaucccugauucucucuccau

SEQ ID NO: 627550 - RNA, 20 nt, Homo sapiens
acauccuccagauaguguag

SEQ ID NO: 627551 - RNA, 15 nt, Homo sapiens
acauccucuacaggu

SEQ ID NO: 627552 - RNA, 17 nt, Homo sapiens
acaucuacaaucaggag

SEQ ID NO: 627553 - RNA, 19 nt, Homo sapiens
acaucuacaaucaguugac

SEQ ID NO: 627554 - RNA, 20 nt, Homo sapiens
acaucuauugcagagacuca

SEQ ID NO: 627555 - RNA, 22 nt, Homo sapiens
acaucuauuuuggauuguauau

SEQ ID NO: 627556 - RNA, 12 nt, Homo sapiens
acaucucagggg

SEQ ID NO: 627557 - RNA, 17 nt, Homo sapiens
acaucucaucaugucua

SEQ ID NO: 627558 - RNA, 23 nt, Homo sapiens
acaucucccuuuuccaugacugu

SEQ ID NO: 627559 - RNA, 19 nt, Homo sapiens
acaucucguauaauauuca

SEQ ID NO: 627560 - RNA, 15 nt, Homo sapiens
acaucucucugcccu

SEQ ID NO: 627561 - RNA, 21 nt, Homo sapiens
acaucucucuggcuucugaag

SEQ ID NO: 627562 - RNA, 13 nt, Homo sapiens
acaucucugggaa

SEQ ID NO: 627563 - RNA, 23 nt, Homo sapiens
acaucucuuccuccgaggccagu

SEQ ID NO: 627564 - RNA, 23 nt, Homo sapiens
acaucugccuuaaaaccaaagag

SEQ ID NO: 627565 - RNA, 16 nt, Homo sapiens
acaucuggcugcacag

SEQ ID NO: 627566 - RNA, 20 nt, Homo sapiens
acaucuggcugcacaggcug

SEQ ID NO: 627567 - RNA, 22 nt, Homo sapiens
acaucuggucuuccaggcacuc

SEQ ID NO: 627568 - RNA, 15 nt, Homo sapiens
acaucugugucuugu

SEQ ID NO: 627569 - RNA, 15 nt, Homo sapiens
acaucuuaaauucau

SEQ ID NO: 627570 - RNA, 12 nt, Homo sapiens
acaucuuaccuc

SEQ ID NO: 627571 - RNA, 15 nt, Homo sapiens
acaucuuaccucuca

SEQ ID NO: 627572 - RNA, 13 nt, Homo sapiens
acaucuucuaucu

SEQ ID NO: 627573 - RNA, 11 nt, Homo sapiens
acaucuucuca

SEQ ID NO: 627574 - RNA, 11 nt, Homo sapiens
acaucuuucac

SEQ ID NO: 627575 - RNA, 14 nt, Homo sapiens
acaucuuucacauu

SEQ ID NO: 627576 - RNA, 19 nt, Homo sapiens
acaucuuuguugauguuua

SEQ ID NO: 627577 - RNA, 22 nt, Homo sapiens
acaucuuuucuaaucacagugu

SEQ ID NO: 627578 - RNA, 16 nt, Homo sapiens
acaugaaaaacaggug

SEQ ID NO: 627579 - RNA, 19 nt, Homo sapiens
acaugaacacuuuuuauca

SEQ ID NO: 627580 - RNA, 13 nt, Homo sapiens
acaugaacagaca

SEQ ID NO: 627581 - RNA, 14 nt, Homo sapiens
acaugaacagacac

SEQ ID NO: 627582 - RNA, 13 nt, Homo sapiens
acaugaacauaug

SEQ ID NO: 627583 - RNA, 21 nt, Homo sapiens
acaugaacauauguccaucca

SEQ ID NO: 627584 - RNA, 15 nt, Homo sapiens
acaugaacuacagac

SEQ ID NO: 627585 - RNA, 14 nt, Homo sapiens
acaugaagaagcua

SEQ ID NO: 627586 - RNA, 17 nt, Homo sapiens
acaugaagaaugcauuc

SEQ ID NO: 627587 - RNA, 20 nt, Homo sapiens
acaugaagcaaacuaacuuu

SEQ ID NO: 627588 - RNA, 22 nt, Homo sapiens
acaugaagcuguugugugaggu

SEQ ID NO: 627589 - RNA, 23 nt, Homo sapiens
acaugaauugcauuuuacuuuaa

SEQ ID NO: 627590 - RNA, 21 nt, Homo sapiens
acaugacauucuuagcuguaa

SEQ ID NO: 627591 - RNA, 13 nt, Homo sapiens
aauugacaggauu

SEQ ID NO: 627592 - RNA, 21 nt, Homo sapiens
aauugacauaaccaacauuaa

SEQ ID NO: 627593 - RNA, 13 nt, Homo sapiens
aauugacaugugc

SEQ ID NO: 627594 - RNA, 14 nt, Homo sapiens
aauugacucucaca

SEQ ID NO: 627595 - RNA, 14 nt, Homo sapiens
aauugacugucacg

SEQ ID NO: 627596 - RNA, 22 nt, Homo sapiens
aauugaguaucacuuuaacuca

SEQ ID NO: 627597 - RNA, 22 nt, Homo sapiens
aauugauaagcuagucccaaaa

SEQ ID NO: 627598 - RNA, 13 nt, Homo sapiens
aauugauagucaa

SEQ ID NO: 627599 - RNA, 19 nt, Homo sapiens
aauugauauugaaugaugu

SEQ ID NO: 627600 - RNA, 14 nt, Homo sapiens
aauugauguugcug

SEQ ID NO: 627601 - RNA, 13 nt, Homo sapiens
aauugauuauucu

SEQ ID NO: 627602 - RNA, 21 nt, Homo sapiens
aauugauucuuagacauugca

SEQ ID NO: 627603 - RNA, 13 nt, Homo sapiens
aauugcaauacau

SEQ ID NO: 627604 - RNA, 18 nt, Homo sapiens
aauugcaauacauuucaa

SEQ ID NO: 627605 - RNA, 23 nt, Homo sapiens
aauugcacacacucagugcagca

SEQ ID NO: 627606 - RNA, 14 nt, Homo sapiens
aauugcacauaguu

SEQ ID NO: 627607 - RNA, 15 nt, Homo sapiens
aauugcacuauugca

SEQ ID NO: 627608 - RNA, 22 nt, Homo sapiens
aauugcagaauucaaaagugau

SEQ ID NO: 627609 - RNA, 13 nt, Homo sapiens
aauugcaguuuug

SEQ ID NO: 627610 - RNA, 16 nt, Homo sapiens
aauugcaguuuugccu

SEQ ID NO: 627611 - RNA, 16 nt, Homo sapiens
aauugccacagcugua

SEQ ID NO: 627612 - RNA, 20 nt, Homo sapiens
aauugcuacaaucccaaagc

SEQ ID NO: 627613 - RNA, 17 nt, Homo sapiens
aauugcucauaagcaau

SEQ ID NO: 627614 - RNA, 14 nt, Homo sapiens
aauugcucaugcau

SEQ ID NO: 627615 - RNA, 15 nt, Homo sapiens
aauuggcucuaguca

SEQ ID NO: 627616 - RNA, 19 nt, Homo sapiens
aauuggcucuagucacugg

SEQ ID NO: 627617 - RNA, 21 nt, Homo sapiens
aauuggcuuuucauagugcuc

SEQ ID NO: 627618 - RNA, 19 nt, Homo sapiens
aauugggaguccaggcaca

SEQ ID NO: 627619 - RNA, 23 nt, Homo sapiens
aauugguaaaaacagcagcucau

SEQ ID NO: 627620 - RNA, 23 nt, Homo sapiens
aauuguaacgacuucuccaucuc

SEQ ID NO: 627621 - RNA, 13 nt, Homo sapiens
aauuguaauugac

SEQ ID NO: 627622 - RNA, 17 nt, Homo sapiens
aauuguaauugcaugac

SEQ ID NO: 627623 - RNA, 18 nt, Homo sapiens
aauuguaucaaaugugac

SEQ ID NO: 627624 - RNA, 20 nt, Homo sapiens
aauuguaucucauuacuuau

SEQ ID NO: 627625 - RNA, 17 nt, Homo sapiens
aauugucguuuuuauuc

SEQ ID NO: 627626 - RNA, 19 nt, Homo sapiens
aauugucuaaaaugucagu

SEQ ID NO: 627627 - RNA, 21 nt, Homo sapiens
aauugucuuuguucugugauu

SEQ ID NO: 627628 - RNA, 23 nt, Homo sapiens
aauugugacauaauaauagcagu

SEQ ID NO: 627629 - RNA, 14 nt, Homo sapiens
aauugugauuagac

SEQ ID NO: 627630 - RNA, 18 nt, Homo sapiens
aauuguguauugaugcaa

SEQ ID NO: 627631 - RNA, 14 nt, Homo sapiens
aauugugugucaca

SEQ ID NO: 627632 - RNA, 23 nt, Homo sapiens
aauuguguugucuucagcaguca

SEQ ID NO: 627633 - RNA, 14 nt, Homo sapiens
aauuguugugugua

SEQ ID NO: 627634 - RNA, 17 nt, Homo sapiens
aauuguuguucuguuaa

SEQ ID NO: 627635 - RNA, 17 nt, Homo sapiens
aauuguuuaaaaaccga

SEQ ID NO: 627636 - RNA, 19 nt, Homo sapiens
aauuguuuaaaaaccgaau

SEQ ID NO: 627637 - RNA, 14 nt, Homo sapiens
aauuguuuaugugu

SEQ ID NO: 627638 - RNA, 13 nt, Homo sapiens
aauuuaaaacuuu

SEQ ID NO: 627639 - RNA, 14 nt, Homo sapiens
aauuuaaacucuga

SEQ ID NO: 627640 - RNA, 16 nt, Homo sapiens
aauuuaaggcaaaaaa

SEQ ID NO: 627641 - RNA, 17 nt, Homo sapiens
aauuuaaucacuuucau

SEQ ID NO: 627642 - RNA, 14 nt, Homo sapiens
aauuuaaugcugcc

SEQ ID NO: 627643 - RNA, 17 nt, Homo sapiens
aauuuacaagagcuguu

SEQ ID NO: 627644 - RNA, 12 nt, Homo sapiens
aauuuacuguga

SEQ ID NO: 627645 - RNA, 17 nt, Homo sapiens
aauuuacuuucugcacc

SEQ ID NO: 627646 - RNA, 12 nt, Homo sapiens
aauuuacuuugu

SEQ ID NO: 627647 - RNA, 14 nt, Homo sapiens
aauuuagggagaaa

SEQ ID NO: 627648 - RNA, 17 nt, Homo sapiens
aauuuagucacaccauc

SEQ ID NO: 627649 - RNA, 18 nt, Homo sapiens
aauuuauaaauauauuca

SEQ ID NO: 627650 - RNA, 20 nt, Homo sapiens
aauuuauacaccagcaauuu

SEQ ID NO: 627651 - RNA, 18 nt, Homo sapiens
aauuuaucuuuaccaaaa

SEQ ID NO: 627652 - RNA, 15 nt, Homo sapiens
aauuuaugcauuuca

SEQ ID NO: 627653 - RNA, 19 nt, Homo sapiens
aauuuaugcauuucauuca

SEQ ID NO: 627654 - RNA, 18 nt, Homo sapiens
aauuuauuaacuaaucaa

SEQ ID NO: 627655 - RNA, 13 nt, Homo sapiens
aauuuauuacaaa

SEQ ID NO: 627656 - RNA, 15 nt, Homo sapiens
aauuuauuacugaaa

SEQ ID NO: 627657 - RNA, 19 nt, Homo sapiens
aauuuauuauacaccuuag

SEQ ID NO: 627658 - RNA, 19 nt, Homo sapiens
aauuuauuauuaacauacc

SEQ ID NO: 627659 - RNA, 18 nt, Homo sapiens
aauuuauuauuaagguaa

SEQ ID NO: 627660 - RNA, 14 nt, Homo sapiens
aauuuauugcacau

SEQ ID NO: 627661 - RNA, 15 nt, Homo sapiens
aauuuauuucaaaaa

SEQ ID NO: 627662 - RNA, 19 nt, Homo sapiens
aauuuauuuccacuaaaaa

SEQ ID NO: 627663 - RNA, 20 nt, Homo sapiens
aauuuauuucucccuguaaa

SEQ ID NO: 627664 - RNA, 17 nt, Homo sapiens
aauuucaacuuuugaca

SEQ ID NO: 627665 - RNA, 22 nt, Homo sapiens
aauuucaagaaguguaguucaa

SEQ ID NO: 627666 - RNA, 18 nt, Homo sapiens
aauuucaauguccaguga

SEQ ID NO: 627667 - RNA, 12 nt, Homo sapiens
aauuucacaagc

SEQ ID NO: 627668 - RNA, 16 nt, Homo sapiens
aauuucagaguuuuua

SEQ ID NO: 627669 - RNA, 11 nt, Homo sapiens
aauuucagggu

SEQ ID NO: 627670 - RNA, 14 nt, Homo sapiens
aauuucagucaauu

SEQ ID NO: 627671 - RNA, 20 nt, Homo sapiens
aauuuccaaaauaaucuaua

SEQ ID NO: 627672 - RNA, 15 nt, Homo sapiens
aauuuccucugacau

SEQ ID NO: 627673 - RNA, 14 nt, Homo sapiens
aauuuccugauaca

SEQ ID NO: 627674 - RNA, 22 nt, Homo sapiens
aauuuccugaugcauauugccc

SEQ ID NO: 627675 - RNA, 16 nt, Homo sapiens
aauuuccuggucacau

SEQ ID NO: 627676 - RNA, 20 nt, Homo sapiens
aauuucggauuuuuuccaaa

SEQ ID NO: 627677 - RNA, 20 nt, Homo sapiens
aauuucuaccuuuacuacau

SEQ ID NO: 627678 - RNA, 23 nt, Homo sapiens
aauuucuacuacaggcauugaga

SEQ ID NO: 627679 - RNA, 21 nt, Homo sapiens
aauuucuacuucuggaaguca

SEQ ID NO: 627680 - RNA, 21 nt, Homo sapiens
aauuucuaguucacagacaua

SEQ ID NO: 627681 - RNA, 18 nt, Homo sapiens
aauuucuauuuuuaucug

SEQ ID NO: 627682 - RNA, 19 nt, Homo sapiens
aauuucuccucccuuccuu

SEQ ID NO: 627683 - RNA, 16 nt, Homo sapiens
aauuucucugaggaca

SEQ ID NO: 627684 - RNA, 13 nt, Homo sapiens
aauuucugucaaa

SEQ ID NO: 627685 - RNA, 16 nt, Homo sapiens
aauuucuuccuuccac

SEQ ID NO: 627686 - RNA, 21 nt, Homo sapiens
aauuucuucuaauaaagucau

SEQ ID NO: 627687 - RNA, 22 nt, Homo sapiens
aauuucuucuuuagaugccaaa

SEQ ID NO: 627688 - RNA, 22 nt, Homo sapiens
aauuugaaaacauaaucugcaa

SEQ ID NO: 627689 - RNA, 11 nt, Homo sapiens
aauuugaacug

SEQ ID NO: 627690 - RNA, 18 nt, Homo sapiens
aauuugaaucugagugaa

SEQ ID NO: 627691 - RNA, 15 nt, Homo sapiens
aauuugaugccagga

SEQ ID NO: 627692 - RNA, 17 nt, Homo sapiens
aauuugcuagcaguaaa

SEQ ID NO: 627693 - RNA, 14 nt, Homo sapiens
aauuugcugccaaa

SEQ ID NO: 627694 - RNA, 21 nt, Homo sapiens
aauuuggagcacaaaauucaa

SEQ ID NO: 627695 - RNA, 20 nt, Homo sapiens
aauuuggagucugacugugc

SEQ ID NO: 627696 - RNA, 17 nt, Homo sapiens
aauuuggcugcuucuac

SEQ ID NO: 627697 - RNA, 13 nt, Homo sapiens
aauuugggggaaa

SEQ ID NO: 627698 - RNA, 19 nt, Homo sapiens
aauuugggggaaaauggca

SEQ ID NO: 627699 - RNA, 14 nt, Homo sapiens
aauuuggugcuuau

SEQ ID NO: 627700 - RNA, 16 nt, Homo sapiens
aauuuguaggaaaaag

SEQ ID NO: 627701 - RNA, 21 nt, Homo sapiens
aauuugugucuguguuuaaua

SEQ ID NO: 627702 - RNA, 19 nt, Homo sapiens
aauuuuaaauuauaacuua

SEQ ID NO: 627703 - RNA, 16 nt, Homo sapiens
aauuuuagcgugcuca

SEQ ID NO: 627704 - RNA, 17 nt, Homo sapiens
aauuuuaguguuaauga

SEQ ID NO: 627705 - RNA, 20 nt, Homo sapiens
aauuuuauaugcuuacugau

SEQ ID NO: 627706 - RNA, 20 nt, Homo sapiens
aauuuuauucaagaaugcca

SEQ ID NO: 627707 - RNA, 16 nt, Homo sapiens
aauuuucaauuugaga

SEQ ID NO: 627708 - RNA, 15 nt, Homo sapiens
aauuuucacugcugc

SEQ ID NO: 627709 - RNA, 19 nt, Homo sapiens
aauuuuccacuucuggcau

SEQ ID NO: 627710 - RNA, 21 nt, Homo sapiens
aauuuucuagauuuucuacuu

SEQ ID NO: 627711 - RNA, 20 nt, Homo sapiens
aauuuucugaaacugcauaa

SEQ ID NO: 627712 - RNA, 23 nt, Homo sapiens
aauuuucuguguuuugcuguacc

SEQ ID NO: 627713 - RNA, 24 nt, Homo sapiens
aauuuucuucaugcaaugacaucu

SEQ ID NO: 627714 - RNA, 20 nt, Homo sapiens
accagcuggccugggguccc

SEQ ID NO: 627715 - RNA, 22 nt, Homo sapiens
accaggaaccuccuccacacca

SEQ ID NO: 627716 - RNA, 22 nt, Homo sapiens
accaggagcagcagccagcacc

SEQ ID NO: 627717 - RNA, 14 nt, Homo sapiens
accaggauuuccuu

SEQ ID NO: 627718 - RNA, 20 nt, Homo sapiens
accaggcgcccgggauccag

SEQ ID NO: 627719 - RNA, 14 nt, Homo sapiens
accagggagcuucc

SEQ ID NO: 627720 - RNA, 17 nt, Homo sapiens
accagggcccugggcag

SEQ ID NO: 627721 - RNA, 22 nt, Homo sapiens
accaggguccgcaccagcugcu

SEQ ID NO: 627722 - RNA, 22 nt, Homo sapiens
accaguaaaggcugcugcuaca

SEQ ID NO: 627723 - RNA, 16 nt, Homo sapiens
accaguacucaguaua

SEQ ID NO: 627724 - RNA, 13 nt, Homo sapiens
accaguccaugag

SEQ ID NO: 627725 - RNA, 19 nt, Homo sapiens
accagucccgucgugcagu

SEQ ID NO: 627726 - RNA, 20 nt, Homo sapiens
accagucccgucgugcaguc

SEQ ID NO: 627727 - RNA, 22 nt, Homo sapiens
accagucccgucgugcagucag

SEQ ID NO: 627728 - RNA, 15 nt, Homo sapiens
accagucuauuucca

SEQ ID NO: 627729 - RNA, 22 nt, Homo sapiens
accagucuauuuccacugaaca

SEQ ID NO: 627730 - RNA, 23 nt, Homo sapiens
accagucuauuuccacugaacaa

SEQ ID NO: 627731 - RNA, 20 nt, Homo sapiens
accagucuccuccccuacuc

SEQ ID NO: 627732 - RNA, 19 nt, Homo sapiens
accagucugucuacugugg

SEQ ID NO: 627733 - RNA, 17 nt, Homo sapiens
accagugaaccaaagag

SEQ ID NO: 627734 - RNA, 21 nt, Homo sapiens
accagugauccauguccugaa

SEQ ID NO: 627735 - RNA, 15 nt, Homo sapiens
accagugcagacuca

SEQ ID NO: 627736 - RNA, 16 nt, Homo sapiens
accagugcagacucaa

SEQ ID NO: 627737 - RNA, 12 nt, Homo sapiens
accaguggaccu

SEQ ID NO: 627738 - RNA, 20 nt, Homo sapiens
accaguguagcaucuuccuc

SEQ ID NO: 627739 - RNA, 17 nt, Homo sapiens
accagugugacaucuac

SEQ ID NO: 627740 - RNA, 16 nt, Homo sapiens
accaguuaagagacaa

SEQ ID NO: 627741 - RNA, 23 nt, Homo sapiens
accaguuaagagacaacuaucaa

SEQ ID NO: 627742 - RNA, 17 nt, Homo sapiens
accaguugggagcacug

SEQ ID NO: 627743 - RNA, 22 nt, Homo sapiens
accaguuuuuggauaaagaaua

SEQ ID NO: 627744 - RNA, 16 nt, Homo sapiens
accauaaagccuuuaa

SEQ ID NO: 627745 - RNA, 19 nt, Homo sapiens
accauaagggacugugcca

SEQ ID NO: 627746 - RNA, 11 nt, Homo sapiens
accauaaugua

SEQ ID NO: 627747 - RNA, 13 nt, Homo sapiens
accauaauguuac

SEQ ID NO: 627748 - RNA, 14 nt, Homo sapiens
accauaauguuaca

SEQ ID NO: 627749 - RNA, 21 nt, Homo sapiens
accauacucccuuucagggcc

SEQ ID NO: 627750 - RNA, 19 nt, Homo sapiens
accauagaaagaugacaaa

SEQ ID NO: 627751 - RNA, 20 nt, Homo sapiens
accauagccaaccuguaguu

SEQ ID NO: 627752 - RNA, 14 nt, Homo sapiens
accauauugcccag

SEQ ID NO: 627753 - RNA, 23 nt, Homo sapiens
accauauugugcuucacaguaga

SEQ ID NO: 627754 - RNA, 15 nt, Homo sapiens
accaucacaucccuu

SEQ ID NO: 627755 - RNA, 17 nt, Homo sapiens
accaucacaugaccaca

SEQ ID NO: 627756 - RNA, 15 nt, Homo sapiens
accauccagugacaa

SEQ ID NO: 627757 - RNA, 20 nt, Homo sapiens
accauccuggccaacauugu

SEQ ID NO: 627758 - RNA, 14 nt, Homo sapiens
accaucguccuucc

SEQ ID NO: 627759 - RNA, 12 nt, Homo sapiens
accaucucaggc

SEQ ID NO: 627760 - RNA, 21 nt, Homo sapiens
accaucugaagaaacuuccca

SEQ ID NO: 627761 - RNA, 11 nt, Homo sapiens
accaucugcau

SEQ ID NO: 627762 - RNA, 21 nt, Homo sapiens
accaucuggaaggacaucuac

SEQ ID NO: 627763 - RNA, 22 nt, Homo sapiens
accaucuggaaggacaucuaca

SEQ ID NO: 627764 - RNA, 22 nt, Homo sapiens
accaucugguaucaucuucuca

SEQ ID NO: 627765 - RNA, 17 nt, Homo sapiens
accaucuucuauucaaa

SEQ ID NO: 627766 - RNA, 16 nt, Homo sapiens
accaugaaauauccag

SEQ ID NO: 627767 - RNA, 16 nt, Homo sapiens
accaugaagacaggau

SEQ ID NO: 627768 - RNA, 20 nt, Homo sapiens
accaugaccccuucucucuc

SEQ ID NO: 627769 - RNA, 17 nt, Homo sapiens
accaugacgcacugcuc

SEQ ID NO: 627770 - RNA, 14 nt, Homo sapiens
accaugacugugac

SEQ ID NO: 627771 - RNA, 15 nt, Homo sapiens
accaugagaugguuu

SEQ ID NO: 627772 - RNA, 13 nt, Homo sapiens
accaugagcaccu

SEQ ID NO: 627773 - RNA, 11 nt, Homo sapiens
accaugaucac

SEQ ID NO: 627774 - RNA, 20 nt, Homo sapiens
accaugauuaaccacuucag

SEQ ID NO: 627775 - RNA, 23 nt, Homo sapiens
accaugauuaaccacuucagcug

SEQ ID NO: 627776 - RNA, 13 nt, Homo sapiens
accaugcacugua

SEQ ID NO: 627777 - RNA, 13 nt, Homo sapiens
accaugcagaaca

SEQ ID NO: 627778 - RNA, 13 nt, Homo sapiens
accaugcaguggg

SEQ ID NO: 627779 - RNA, 14 nt, Homo sapiens
accaugcuucacaa

SEQ ID NO: 627780 - RNA, 19 nt, Homo sapiens
accauggcaugguuauuga

SEQ ID NO: 627781 - RNA, 22 nt, Homo sapiens
accauggcaugguuauugauga

SEQ ID NO: 627782 - RNA, 17 nt, Homo sapiens
accaugguuuuggcucu

SEQ ID NO: 627783 - RNA, 18 nt, Homo sapiens
accaugugccaucuguac

SEQ ID NO: 627784 - RNA, 20 nt, Homo sapiens
accauguggauaacuuuaca

SEQ ID NO: 627785 - RNA, 17 nt, Homo sapiens
accauguggaugcagca

SEQ ID NO: 627786 - RNA, 12 nt, Homo sapiens
accauguggcaa

SEQ ID NO: 627787 - RNA, 14 nt, Homo sapiens
accauguuagccuu

SEQ ID NO: 627788 - RNA, 15 nt, Homo sapiens
accauguuagccuua

SEQ ID NO: 627789 - RNA, 17 nt, Homo sapiens
accauguuagccuuaga

SEQ ID NO: 627790 - RNA, 20 nt, Homo sapiens
accauguugacuuuccucau

SEQ ID NO: 627791 - RNA, 23 nt, Homo sapiens
accauguuggccaggauggucuc

SEQ ID NO: 627792 - RNA, 18 nt, Homo sapiens
accauucaggacacaggg

SEQ ID NO: 627793 - RNA, 23 nt, Homo sapiens
accauuccaggaaaacugggaca

SEQ ID NO: 627794 - RNA, 21 nt, Homo sapiens
accauucuaccugaggccagg

SEQ ID NO: 627795 - RNA, 20 nt, Homo sapiens
accauugcuucacuacccau

SEQ ID NO: 627796 - RNA, 23 nt, Homo sapiens
accauuuguaauaaaguauauaa

SEQ ID NO: 627797 - RNA, 23 nt, Homo sapiens
accauuuuccuuuggacuguuca

SEQ ID NO: 627798 - RNA, 21 nt, Homo sapiens
accauuuuguuauugacuaac

SEQ ID NO: 627799 - RNA, 16 nt, Homo sapiens
accauuuuuuaaggaa

SEQ ID NO: 627800 - RNA, 17 nt, Homo sapiens
accauuuuuuaaggaaa

SEQ ID NO: 627801 - RNA, 11 nt, Homo sapiens
acccaaaacac

SEQ ID NO: 627802 - RNA, 12 nt, Homo sapiens
acccaaagacca

SEQ ID NO: 627803 - RNA, 16 nt, Homo sapiens
acccaacaggugcuga

SEQ ID NO: 627804 - RNA, 17 nt, Homo sapiens
acccaacccaaucccuc

SEQ ID NO: 627805 - RNA, 13 nt, Homo sapiens
acccaagccugau

SEQ ID NO: 627806 - RNA, 22 nt, Homo sapiens
acccaagugaagguucccaagg

SEQ ID NO: 627807 - RNA, 19 nt, Homo sapiens
acccaaguugaagacuuug

SEQ ID NO: 627808 - RNA, 12 nt, Homo sapiens
acccaaucugcc

SEQ ID NO: 627809 - RNA, 15 nt, Homo sapiens
acccaaugccuguga

SEQ ID NO: 627810 - RNA, 18 nt, Homo sapiens
acccaaugucucccacac

SEQ ID NO: 627811 - RNA, 16 nt, Homo sapiens
acccaauuggcccaac

SEQ ID NO: 627812 - RNA, 14 nt, Homo sapiens
acccacagaugucu

SEQ ID NO: 627813 - RNA, 16 nt, Homo sapiens
acccacagaugucucu

SEQ ID NO: 627814 - RNA, 16 nt, Homo sapiens
acccacagcucugggc

SEQ ID NO: 627815 - RNA, 16 nt, Homo sapiens
acccaccccugcacag

SEQ ID NO: 627816 - RNA, 12 nt, Homo sapiens
acccaccucagc

SEQ ID NO: 627817 - RNA, 19 nt, Homo sapiens
acccaccugcuagugugaa

SEQ ID NO: 627818 - RNA, 19 nt, Homo sapiens
acccagaaaucauuuuacc

SEQ ID NO: 627819 - RNA, 13 nt, Homo sapiens
acccagaacagga

SEQ ID NO: 627820 - RNA, 16 nt, Homo sapiens
acccagacaaccaaaa

SEQ ID NO: 627821 - RNA, 20 nt, Homo sapiens
acccagacguggaguggagu

SEQ ID NO: 627822 - RNA, 21 nt, Homo sapiens
acccagaggcuacucuugacu

SEQ ID NO: 627823 - RNA, 23 nt, Homo sapiens
acccagaguagagccaggugcuu

SEQ ID NO: 627824 - RNA, 15 nt, Homo sapiens
acccagauuuccuaa

SEQ ID NO: 627825 - RNA, 12 nt, Homo sapiens
acccagcaauag

SEQ ID NO: 627826 - RNA, 15 nt, Homo sapiens
acccagccagcugca

SEQ ID NO: 627827 - RNA, 21 nt, Homo sapiens
acccagcccagaccucugaca

SEQ ID NO: 627828 - RNA, 21 nt, Homo sapiens
acccagcccuuguuagauuca

SEQ ID NO: 627829 - RNA, 15 nt, Homo sapiens
acccagcuacucugu

SEQ ID NO: 627830 - RNA, 21 nt, Homo sapiens
acccagcuacucuguccaggc

SEQ ID NO: 627831 - RNA, 15 nt, Homo sapiens
acccagcuccagggg

SEQ ID NO: 627832 - RNA, 18 nt, Homo sapiens
acccaggaauaguggaca

SEQ ID NO: 627833 - RNA, 16 nt, Homo sapiens
acccaggaccaagcca

SEQ ID NO: 627834 - RNA, 18 nt, Homo sapiens
acccaggaccaagccaca

SEQ ID NO: 627835 - RNA, 20 nt, Homo sapiens
acccaggcuggagugcagug

SEQ ID NO: 627836 - RNA, 22 nt, Homo sapiens
acccagucccacacuguggcca

SEQ ID NO: 627837 - RNA, 22 nt, Homo sapiens
acauguagguaggaagcacuga

SEQ ID NO: 627838 - RNA, 23 nt, Homo sapiens
acauguagguaggaagcacugaa

SEQ ID NO: 627839 - RNA, 19 nt, Homo sapiens
acauguaugugcauuucaa

SEQ ID NO: 627840 - RNA, 17 nt, Homo sapiens
acauguauugcacauug

SEQ ID NO: 627841 - RNA, 16 nt, Homo sapiens
acaugucaaucugucc

SEQ ID NO: 627842 - RNA, 19 nt, Homo sapiens
acaugucuccuauccuggu

SEQ ID NO: 627843 - RNA, 17 nt, Homo sapiens
acaugucuguccucaga

SEQ ID NO: 627844 - RNA, 15 nt, Homo sapiens
acaugugacuggcag

SEQ ID NO: 627845 - RNA, 18 nt, Homo sapiens
acaugugcuggacacugu

SEQ ID NO: 627846 - RNA, 13 nt, Homo sapiens
acaugugguggga

SEQ ID NO: 627847 - RNA, 12 nt, Homo sapiens
acauguguaccu

SEQ ID NO: 627848 - RNA, 13 nt, Homo sapiens
acauguuaagaua

SEQ ID NO: 627849 - RNA, 22 nt, Homo sapiens
acauguucauggguuuaccacu

SEQ ID NO: 627850 - RNA, 22 nt, Homo sapiens
acauguuccuuuaagguacuga

SEQ ID NO: 627851 - RNA, 18 nt, Homo sapiens
acauguuguacauuucac

SEQ ID NO: 627852 - RNA, 14 nt, Homo sapiens
acauguugugccug

SEQ ID NO: 627853 - RNA, 20 nt, Homo sapiens
acauguuuaaauagccuaaa

SEQ ID NO: 627854 - RNA, 18 nt, Homo sapiens
acauuaaaaaaauuccau

SEQ ID NO: 627855 - RNA, 16 nt, Homo sapiens
acauuaaacacacuua

SEQ ID NO: 627856 - RNA, 22 nt, Homo sapiens
acauuaacucccuccaccagcc

SEQ ID NO: 627857 - RNA, 13 nt, Homo sapiens
acauuaagcacug

SEQ ID NO: 627858 - RNA, 17 nt, Homo sapiens
acauuaaguaaaugcug

SEQ ID NO: 627859 - RNA, 22 nt, Homo sapiens
acauuaaguaaaugcuguagaa

SEQ ID NO: 627860 - RNA, 18 nt, Homo sapiens
acauuaaugagaauuccu

SEQ ID NO: 627861 - RNA, 12 nt, Homo sapiens
acauuacaaucc

SEQ ID NO: 627862 - RNA, 12 nt, Homo sapiens
acauuaccauau

SEQ ID NO: 627863 - RNA, 14 nt, Homo sapiens
acauuaccauauaa

SEQ ID NO: 627864 - RNA, 12 nt, Homo sapiens
acauuagccuug

SEQ ID NO: 627865 - RNA, 13 nt, Homo sapiens
acauuaggggauu

SEQ ID NO: 627866 - RNA, 15 nt, Homo sapiens
acauuauacauuuga

SEQ ID NO: 627867 - RNA, 15 nt, Homo sapiens
acauuaucaucugaa

SEQ ID NO: 627868 - RNA, 12 nt, Homo sapiens
acauuaucucac

SEQ ID NO: 627869 - RNA, 12 nt, Homo sapiens
acauuaugugga

SEQ ID NO: 627870 - RNA, 19 nt, Homo sapiens
acauuauuucuaguccaaa

SEQ ID NO: 627871 - RNA, 20 nt, Homo sapiens
acauuauuucuaguccaaaa

SEQ ID NO: 627872 - RNA, 21 nt, Homo sapiens
acauucaaggcauuucuauca

SEQ ID NO: 627873 - RNA, 15 nt, Homo sapiens
acauucacacacuca

SEQ ID NO: 627874 - RNA, 13 nt, Homo sapiens
acauucacaccau

SEQ ID NO: 627875 - RNA, 12 nt, Homo sapiens
acauucacaccu

SEQ ID NO: 627876 - RNA, 15 nt, Homo sapiens
acauucacuauaaug

SEQ ID NO: 627877 - RNA, 14 nt, Homo sapiens
acauucaguuccca

SEQ ID NO: 627878 - RNA, 15 nt, Homo sapiens
acauucaucaauauc

SEQ ID NO: 627879 - RNA, 12 nt, Homo sapiens
acauucccaugg

SEQ ID NO: 627880 - RNA, 21 nt, Homo sapiens
acauucccucuaauuugaacu

SEQ ID NO: 627881 - RNA, 21 nt, Homo sapiens
acauucccugggccaacagac

SEQ ID NO: 627882 - RNA, 15 nt, Homo sapiens
acauuccugcauuca

SEQ ID NO: 627883 - RNA, 12 nt, Homo sapiens
acauuccuggcc

SEQ ID NO: 627884 - RNA, 24 nt, Homo sapiens
acauuccuuagucucaagggcuag

SEQ ID NO: 627885 - RNA, 21 nt, Homo sapiens
acauucuagcugagaagcaau

SEQ ID NO: 627886 - RNA, 22 nt, Homo sapiens
acauucuagcugagaagcaaug

SEQ ID NO: 627887 - RNA, 15 nt, Homo sapiens
acauucuauagccau

SEQ ID NO: 627888 - RNA, 19 nt, Homo sapiens
acauucucgcuucccugaa

SEQ ID NO: 627889 - RNA, 17 nt, Homo sapiens
acauucugaugagcaac

SEQ ID NO: 627890 - RNA, 20 nt, Homo sapiens
acauucugcaagcacaucug

SEQ ID NO: 627891 - RNA, 23 nt, Homo sapiens
acauucuguuuaucaagccauaa

SEQ ID NO: 627892 - RNA, 22 nt, Homo sapiens
acauucuuccaucaucacugua

SEQ ID NO: 627893 - RNA, 17 nt, Homo sapiens
acauucuugguuguuaa

SEQ ID NO: 627894 - RNA, 22 nt, Homo sapiens
acauucuuguuuuaagugccuu

SEQ ID NO: 627895 - RNA, 18 nt, Homo sapiens
acauucuuuaucuugaca

SEQ ID NO: 627896 - RNA, 19 nt, Homo sapiens
acauucuuuuucuguugaa

SEQ ID NO: 627897 - RNA, 19 nt, Homo sapiens
acauucuuuuuucuauuca

SEQ ID NO: 627898 - RNA, 17 nt, Homo sapiens
acauugaguuggaauca

SEQ ID NO: 627899 - RNA, 13 nt, Homo sapiens
acauugcacuuua

SEQ ID NO: 627900 - RNA, 14 nt, Homo sapiens
acauugccaaaaag

SEQ ID NO: 627901 - RNA, 23 nt, Homo sapiens
acauugcuuaaaauauauaguga

SEQ ID NO: 627902 - RNA, 13 nt, Homo sapiens
acauugcuuuuau

SEQ ID NO: 627903 - RNA, 16 nt, Homo sapiens
acauugggagucugua

SEQ ID NO: 627904 - RNA, 21 nt, Homo sapiens
acauugggcugaccgugucuc

SEQ ID NO: 627905 - RNA, 19 nt, Homo sapiens
acauuguaaaguaugugag

SEQ ID NO: 627906 - RNA, 21 nt, Homo sapiens
acauuguacaaggaaugaaag

SEQ ID NO: 627907 - RNA, 13 nt, Homo sapiens
acauuguacuguu

SEQ ID NO: 627908 - RNA, 15 nt, Homo sapiens
acauuguacuguugc

SEQ ID NO: 627909 - RNA, 13 nt, Homo sapiens
acauuguacuuaa

SEQ ID NO: 627910 - RNA, 20 nt, Homo sapiens
acauuguauuaauaccaaag

SEQ ID NO: 627911 - RNA, 21 nt, Homo sapiens
acauuguauuaauaccaaagu

SEQ ID NO: 627912 - RNA, 15 nt, Homo sapiens
acauugucaccauuu

SEQ ID NO: 627913 - RNA, 20 nt, Homo sapiens
acauugugggauguucagca

SEQ ID NO: 627914 - RNA, 16 nt, Homo sapiens
acauuuaaaauucaau

SEQ ID NO: 627915 - RNA, 17 nt, Homo sapiens
acauuuaaaauugcuau

SEQ ID NO: 627916 - RNA, 19 nt, Homo sapiens
acauuuaaauguaacuuau

SEQ ID NO: 627917 - RNA, 15 nt, Homo sapiens
acauuuaaauuccac

SEQ ID NO: 627918 - RNA, 17 nt, Homo sapiens
acauuuaaauuccacag

SEQ ID NO: 627919 - RNA, 17 nt, Homo sapiens
acauuuaauaaaacugc

SEQ ID NO: 627920 - RNA, 17 nt, Homo sapiens
acauuuaauaauaucaa

SEQ ID NO: 627921 - RNA, 13 nt, Homo sapiens
acauuuaucacug

SEQ ID NO: 627922 - RNA, 18 nt, Homo sapiens
acauuuauccaagaccug

SEQ ID NO: 627923 - RNA, 13 nt, Homo sapiens
acauuucaccaug

SEQ ID NO: 627924 - RNA, 16 nt, Homo sapiens
acauuuccacaccaga

SEQ ID NO: 627925 - RNA, 17 nt, Homo sapiens
acauuuccucagucaag

SEQ ID NO: 627926 - RNA, 16 nt, Homo sapiens
acauuucuaacucuau

SEQ ID NO: 627927 - RNA, 18 nt, Homo sapiens
accacugguacuuccuuu

SEQ ID NO: 627928 - RNA, 14 nt, Homo sapiens
accacuucagcuga

SEQ ID NO: 627929 - RNA, 10 nt, Homo sapiens
accacuucau

SEQ ID NO: 627930 - RNA, 17 nt, Homo sapiens
accacuucgaaaccugg

SEQ ID NO: 627931 - RNA, 15 nt, Homo sapiens
accacuucuccaugc

SEQ ID NO: 627932 - RNA, 11 nt, Homo sapiens
accacuuucuu

SEQ ID NO: 627933 - RNA, 14 nt, Homo sapiens
accacuuuuuguaa

SEQ ID NO: 627934 - RNA, 15 nt, Homo sapiens
accagaacaguauga

SEQ ID NO: 627935 - RNA, 16 nt, Homo sapiens
accagaacaguaugaa

SEQ ID NO: 627936 - RNA, 17 nt, Homo sapiens
accagaacuggaacuac

SEQ ID NO: 627937 - RNA, 23 nt, Homo sapiens
accagaagaaagggccuucacag

SEQ ID NO: 627938 - RNA, 15 nt, Homo sapiens
accagaagccaaaga

SEQ ID NO: 627939 - RNA, 19 nt, Homo sapiens
accagacagacaacacugg

SEQ ID NO: 627940 - RNA, 15 nt, Homo sapiens
accagacccugaauu

SEQ ID NO: 627941 - RNA, 21 nt, Homo sapiens
accagacuugaauacaacauu

SEQ ID NO: 627942 - RNA, 13 nt, Homo sapiens
accagagcugccg

SEQ ID NO: 627943 - RNA, 16 nt, Homo sapiens
accagaggucaggugu

SEQ ID NO: 627944 - RNA, 23 nt, Homo sapiens
accagagugauguccucucucag

SEQ ID NO: 627945 - RNA, 16 nt, Homo sapiens
accagauauuuuguuc

SEQ ID NO: 627946 - RNA, 17 nt, Homo sapiens
accagauggaacacugg

SEQ ID NO: 627947 - RNA, 16 nt, Homo sapiens
accagcaaacagcuga

SEQ ID NO: 627948 - RNA, 13 nt, Homo sapiens
accagcaagaaua

SEQ ID NO: 627949 - RNA, 13 nt, Homo sapiens
accagcacugucu

SEQ ID NO: 627950 - RNA, 13 nt, Homo sapiens
accagcagcaugg

SEQ ID NO: 627951 - RNA, 18 nt, Homo sapiens
accagcagcccugucacg

SEQ ID NO: 627952 - RNA, 22 nt, Homo sapiens
accagcauaauaaaaaggcaau

SEQ ID NO: 627953 - RNA, 16 nt, Homo sapiens
accagcauacccuuac

SEQ ID NO: 627954 - RNA, 14 nt, Homo sapiens
accagcccaaccau

SEQ ID NO: 627955 - RNA, 17 nt, Homo sapiens
accagccccucacaggc

SEQ ID NO: 627956 - RNA, 17 nt, Homo sapiens
accagccguauuuuaca

SEQ ID NO: 627957 - RNA, 22 nt, Homo sapiens
accagccugggcaacaugaugu

SEQ ID NO: 627958 - RNA, 22 nt, Homo sapiens
accagccuggucaacaugguga

SEQ ID NO: 627959 - RNA, 18 nt, Homo sapiens
accagcgugugacuacuc

SEQ ID NO: 627960 - RNA, 13 nt, Homo sapiens
accagcucagggg

SEQ ID NO: 627961 - RNA, 18 nt, Homo sapiens
accagcucugaacuucca

SEQ ID NO: 627962 - RNA, 19 nt, Homo sapiens
accagcucugaacuuccaa

SEQ ID NO: 627963 - RNA, 19 nt, Homo sapiens
aucuuugucuguucacuuu

SEQ ID NO: 627964 - RNA, 18 nt, Homo sapiens
aucuuuguuuaaaugcca

SEQ ID NO: 627965 - RNA, 19 nt, Homo sapiens
aucuuuguuuaaaugccaa

SEQ ID NO: 627966 - RNA, 20 nt, Homo sapiens
aucuuuuccagaguaugcaa

SEQ ID NO: 627967 - RNA, 18 nt, Homo sapiens
aucuuuugcuaaugcaau

SEQ ID NO: 627968 - RNA, 18 nt, Homo sapiens
aucuuuuuaaaaacucuu

SEQ ID NO: 627969 - RNA, 20 nt, Homo sapiens
aucuuuuucuauauucucau

SEQ ID NO: 627970 - RNA, 16 nt, Homo sapiens
aucuuuuuuagcauaa

SEQ ID NO: 627971 - RNA, 20 nt, Homo sapiens
augaaaaaaaugcauuuuau

SEQ ID NO: 627972 - RNA, 22 nt, Homo sapiens
augaaaaacaaaaagcuaacau

SEQ ID NO: 627973 - RNA, 17 nt, Homo sapiens
augaaaaacaucccaaa

SEQ ID NO: 627974 - RNA, 20 nt, Homo sapiens
augaaaaagacaagauuuau

SEQ ID NO: 627975 - RNA, 23 nt, Homo sapiens
augaaaaauauugcugaacuacu

SEQ ID NO: 627976 - RNA, 17 nt, Homo sapiens
augaaaaauguguucca

SEQ ID NO: 627977 - RNA, 13 nt, Homo sapiens
augaaaacaaaua

SEQ ID NO: 627978 - RNA, 12 nt, Homo sapiens
augaaaaccuga

SEQ ID NO: 627979 - RNA, 17 nt, Homo sapiens
augaaaacuaaggauuu

SEQ ID NO: 627980 - RNA, 19 nt, Homo sapiens
augaaaaggauauuaucua

SEQ ID NO: 627981 - RNA, 14 nt, Homo sapiens
augaaaaugaaucu

SEQ ID NO: 627982 - RNA, 15 nt, Homo sapiens
augaaaaugagcccu

SEQ ID NO: 627983 - RNA, 13 nt, Homo sapiens
augaaaaugucag

SEQ ID NO: 627984 - RNA, 15 nt, Homo sapiens
augaaacaauuugag

SEQ ID NO: 627985 - RNA, 22 nt, Homo sapiens
augaaacauuguagguauauau

SEQ ID NO: 627986 - RNA, 16 nt, Homo sapiens
augaaaccagaaggau

SEQ ID NO: 627987 - RNA, 22 nt, Homo sapiens
augaaacuccugauuuuguagu

SEQ ID NO: 627988 - RNA, 17 nt, Homo sapiens
augaaagaacaauauag

SEQ ID NO: 627989 - RNA, 22 nt, Homo sapiens
augaaaggacaguuaaguauuu

SEQ ID NO: 627990 - RNA, 20 nt, Homo sapiens
augaaaggcaggccuauuuc

SEQ ID NO: 627991 - RNA, 16 nt, Homo sapiens
augaaagggcaaagac

SEQ ID NO: 627992 - RNA, 23 nt, Homo sapiens
augaaagguacuauauuugcuag

SEQ ID NO: 627993 - RNA, 18 nt, Homo sapiens
augaaaguauuggcauuc

SEQ ID NO: 627994 - RNA, 14 nt, Homo sapiens
augaaagugacuuu

SEQ ID NO: 627995 - RNA, 13 nt, Homo sapiens
augaaauaaucag

SEQ ID NO: 627996 - RNA, 15 nt, Homo sapiens
augaaauacugagau

SEQ ID NO: 627997 - RNA, 20 nt, Homo sapiens
augaaauccagugagcacua

SEQ ID NO: 627998 - RNA, 22 nt, Homo sapiens
augaaauccugcuucaguguau

SEQ ID NO: 627999 - RNA, 19 nt, Homo sapiens
augaaaucugcuagaaagu

SEQ ID NO: 628000 - RNA, 13 nt, Homo sapiens
augaaaucuugca

SEQ ID NO: 628001 - RNA, 15 nt, Homo sapiens
augaaaucuugcaau

SEQ ID NO: 628002 - RNA, 15 nt, Homo sapiens
augaaaugauuggaa

SEQ ID NO: 628003 - RNA, 14 nt, Homo sapiens
augaaaugcauauu

SEQ ID NO: 628004 - RNA, 15 nt, Homo sapiens
augaaauggagucau

SEQ ID NO: 628005 - RNA, 20 nt, Homo sapiens
augaaaugucuggucugucc

SEQ ID NO: 628006 - RNA, 19 nt, Homo sapiens
augaacauauguccaucca

SEQ ID NO: 628007 - RNA, 21 nt, Homo sapiens
augaacaucuuuagugucuga

SEQ ID NO: 628008 - RNA, 22 nt, Homo sapiens
augaacccauccgguuugccau

SEQ ID NO: 628009 - RNA, 15 nt, Homo sapiens
augaacccccaugau

SEQ ID NO: 628010 - RNA, 23 nt, Homo sapiens
augaaccugcccugcucccacag

SEQ ID NO: 628011 - RNA, 16 nt, Homo sapiens
augaacucuuaaucaa

SEQ ID NO: 628012 - RNA, 19 nt, Homo sapiens
augaacuguggugccacau

SEQ ID NO: 628013 - RNA, 22 nt, Homo sapiens
augaacuugcacuuguuauauu

SEQ ID NO: 628014 - RNA, 13 nt, Homo sapiens
augaacuuuguca

SEQ ID NO: 628015 - RNA, 15 nt, Homo sapiens
augaagaaaauugag

SEQ ID NO: 628016 - RNA, 23 nt, Homo sapiens
augaagaaauuuaugaagcagau

SEQ ID NO: 628017 - RNA, 20 nt, Homo sapiens
augaagaaguuucuaaaaac

SEQ ID NO: 628018 - RNA, 17 nt, Homo sapiens
augaagaaugcauucaa

SEQ ID NO: 628019 - RNA, 15 nt, Homo sapiens
augaagaccaaagac

SEQ ID NO: 628020 - RNA, 14 nt, Homo sapiens
augaagaccaugcc

SEQ ID NO: 628021 - RNA, 15 nt, Homo sapiens
augaagagcuaauuu

SEQ ID NO: 628022 - RNA, 15 nt, Homo sapiens
augaagcagauuuau

SEQ ID NO: 628023 - RNA, 12 nt, Homo sapiens
augaagccagcu

SEQ ID NO: 628024 - RNA, 22 nt, Homo sapiens
augaagcguugccauugaacuc

SEQ ID NO: 628025 - RNA, 23 nt, Homo sapiens
augaagcugcucugaaaucuccu

SEQ ID NO: 628026 - RNA, 12 nt, Homo sapiens
agccuaccuuca

SEQ ID NO: 628027 - RNA, 21 nt, Homo sapiens
agccuacuuucacacuaagaa

SEQ ID NO: 628028 - RNA, 22 nt, Homo sapiens
agccuacuuucacacuaagaaa

SEQ ID NO: 628029 - RNA, 14 nt, Homo sapiens
agccuagaacaucc

SEQ ID NO: 628030 - RNA, 19 nt, Homo sapiens
agccuagaagagcuucuga

SEQ ID NO: 628031 - RNA, 12 nt, Homo sapiens
agccuagacaac

SEQ ID NO: 628032 - RNA, 16 nt, Homo sapiens
agccuagccgaccuca

SEQ ID NO: 628033 - RNA, 15 nt, Homo sapiens
agccuagcggagccc

SEQ ID NO: 628034 - RNA, 18 nt, Homo sapiens
agccuaggaccacucagc

SEQ ID NO: 628035 - RNA, 16 nt, Homo sapiens
agccuauuuuuuuaga

SEQ ID NO: 628036 - RNA, 23 nt, Homo sapiens
agccucaagucuuauuuccucaa

SEQ ID NO: 628037 - RNA, 23 nt, Homo sapiens
agccucacguauuucacagagca

SEQ ID NO: 628038 - RNA, 22 nt, Homo sapiens
agccucagaaggccccagagag

SEQ ID NO: 628039 - RNA, 13 nt, Homo sapiens
agccucagaauaa

SEQ ID NO: 628040 - RNA, 21 nt, Homo sapiens
agccucagaauaaaagaugau

SEQ ID NO: 628041 - RNA, 15 nt, Homo sapiens
agccucagugaccca

SEQ ID NO: 628042 - RNA, 12 nt, Homo sapiens
agccucaucucu

SEQ ID NO: 628043 - RNA, 14 nt, Homo sapiens
agccucaucucuuu

SEQ ID NO: 628044 - RNA, 19 nt, Homo sapiens
agccucauucagcaugggu

SEQ ID NO: 628045 - RNA, 14 nt, Homo sapiens
agccucauucugag

SEQ ID NO: 628046 - RNA, 12 nt, Homo sapiens
agccucauuuga

SEQ ID NO: 628047 - RNA, 14 nt, Homo sapiens
agccuccaccugau

SEQ ID NO: 628048 - RNA, 23 nt, Homo sapiens
agccuccaccugauauucaggcu

SEQ ID NO: 628049 - RNA, 15 nt, Homo sapiens
agccuccacugccuc

SEQ ID NO: 628050 - RNA, 12 nt, Homo sapiens
agccucccaagu

SEQ ID NO: 628051 - RNA, 23 nt, Homo sapiens
agccucccacacugaaaccaaaa

SEQ ID NO: 628052 - RNA, 21 nt, Homo sapiens
agccucccccucagaugaucu

SEQ ID NO: 628053 - RNA, 17 nt, Homo sapiens
agccuccccgugccaaa

SEQ ID NO: 628054 - RNA, 19 nt, Homo sapiens
agccuccccgugccaaaaa

SEQ ID NO: 628055 - RNA, 18 nt, Homo sapiens
agccuccccuucuucccg

SEQ ID NO: 628056 - RNA, 15 nt, Homo sapiens
agccuccuccugacc

SEQ ID NO: 628057 - RNA, 15 nt, Homo sapiens
agccuccucucucaa

SEQ ID NO: 628058 - RNA, 13 nt, Homo sapiens
agccuccucugga

SEQ ID NO: 628059 - RNA, 21 nt, Homo sapiens
agccucguuggagagcagcag

SEQ ID NO: 628060 - RNA, 15 nt, Homo sapiens
agccucucaccugga

SEQ ID NO: 628061 - RNA, 23 nt, Homo sapiens
agccucucaccuggacuccagua

SEQ ID NO: 628062 - RNA, 22 nt, Homo sapiens
agccucucaguacagcacuccu

SEQ ID NO: 628063 - RNA, 19 nt, Homo sapiens
agccucucgaagugcugag

SEQ ID NO: 628064 - RNA, 16 nt, Homo sapiens
agccucugaaaaccaa

SEQ ID NO: 628065 - RNA, 11 nt, Homo sapiens
agccucuggcu

SEQ ID NO: 628066 - RNA, 16 nt, Homo sapiens
agccucuggcuagagg

SEQ ID NO: 628067 - RNA, 13 nt, Homo sapiens
agccugaccucua

SEQ ID NO: 628068 - RNA, 15 nt, Homo sapiens
agccugaccucuagc

SEQ ID NO: 628069 - RNA, 17 nt, Homo sapiens
agccugagcagagacau

SEQ ID NO: 628070 - RNA, 14 nt, Homo sapiens
agccugagcucauc

SEQ ID NO: 628071 - RNA, 16 nt, Homo sapiens
agccugaggcucaggc

SEQ ID NO: 628072 - RNA, 13 nt, Homo sapiens
agccugcacuggg

SEQ ID NO: 628073 - RNA, 21 nt, Homo sapiens
agccugcagaaguaagccuca

SEQ ID NO: 628074 - RNA, 18 nt, Homo sapiens
agccugcagaauccagcu

SEQ ID NO: 628075 - RNA, 19 nt, Homo sapiens
agccugccaaagugccugg

SEQ ID NO: 628076 - RNA, 12 nt, Homo sapiens
agccugccaaga

SEQ ID NO: 628077 - RNA, 16 nt, Homo sapiens
agccugccucuuccag

SEQ ID NO: 628078 - RNA, 22 nt, Homo sapiens
agccugccuggcaggcugucug

SEQ ID NO: 628079 - RNA, 21 nt, Homo sapiens
agccugcucccccacccccuc

SEQ ID NO: 628080 - RNA, 12 nt, Homo sapiens
agccugcucccu

SEQ ID NO: 628081 - RNA, 14 nt, Homo sapiens
agccugcucccuag

SEQ ID NO: 628082 - RNA, 17 nt, Homo sapiens
agccugcucccuagcca

SEQ ID NO: 628083 - RNA, 18 nt, Homo sapiens
agccugcucccuagccag

SEQ ID NO: 628084 - RNA, 14 nt, Homo sapiens
agccugcugcaugg

SEQ ID NO: 628085 - RNA, 15 nt, Homo sapiens
agccugcuucuuccc

SEQ ID NO: 628086 - RNA, 23 nt, Homo sapiens
agccugcuuguugggaaaagccc

SEQ ID NO: 628087 - RNA, 20 nt, Homo sapiens
agccugcuuugcuuuacugc

SEQ ID NO: 628088 - RNA, 14 nt, Homo sapiens
agccuggaagccau

SEQ ID NO: 628089 - RNA, 17 nt, Homo sapiens
agccuggccaacaugau

SEQ ID NO: 628090 - RNA, 19 nt, Homo sapiens
agccuggccaacaugguga

SEQ ID NO: 628091 - RNA, 18 nt, Homo sapiens
agccuggccaccagccau

SEQ ID NO: 628092 - RNA, 13 nt, Homo sapiens
agccuggccagac

SEQ ID NO: 628093 - RNA, 15 nt, Homo sapiens
agccugggcaaugug

SEQ ID NO: 628094 - RNA, 17 nt, Homo sapiens
agccuggggcucccucu

SEQ ID NO: 628095 - RNA, 14 nt, Homo sapiens
agccugggggacag

SEQ ID NO: 628096 - RNA, 15 nt, Homo sapiens
agccuggggugaccu

SEQ ID NO: 628097 - RNA, 21 nt, Homo sapiens
agccuggucccacgagggugc

SEQ ID NO: 628098 - RNA, 22 nt, Homo sapiens
agccuguaaacuuuaucacuua

SEQ ID NO: 628099 - RNA, 12 nt, Homo sapiens
agccuguaagag

SEQ ID NO: 628100 - RNA, 15 nt, Homo sapiens
agccuguauguggug

SEQ ID NO: 628101 - RNA, 14 nt, Homo sapiens
agccugucccagga

SEQ ID NO: 628102 - RNA, 14 nt, Homo sapiens
agccugugaagucc

SEQ ID NO: 628103 - RNA, 16 nt, Homo sapiens
agccugugaaguccua

SEQ ID NO: 628104 - RNA, 12 nt, Homo sapiens
agccugugauua

SEQ ID NO: 628105 - RNA, 14 nt, Homo sapiens
agccugugauuaac

SEQ ID NO: 628106 - RNA, 18 nt, Homo sapiens
agccugugccagcaccuu

SEQ ID NO: 628107 - RNA, 23 nt, Homo sapiens
agccuguggcaucuuugccuugg

SEQ ID NO: 628108 - RNA, 22 nt, Homo sapiens
agccuguggcuuggaguggcca

SEQ ID NO: 628109 - RNA, 16 nt, Homo sapiens
agccuguggugcuuga

SEQ ID NO: 628110 - RNA, 22 nt, Homo sapiens
agccuguguuagugucugucca

SEQ ID NO: 628111 - RNA, 23 nt, Homo sapiens
agccuguguuagugucuguccau

SEQ ID NO: 628112 - RNA, 20 nt, Homo sapiens
agccuguugcggaucuucau

SEQ ID NO: 628113 - RNA, 15 nt, Homo sapiens
agccuuaagccauag

SEQ ID NO: 628114 - RNA, 15 nt, Homo sapiens
agccuuaauuugcac

SEQ ID NO: 628115 - RNA, 16 nt, Homo sapiens
agccuuagcugccagu

SEQ ID NO: 628116 - RNA, 16 nt, Homo sapiens
agccuucagccuuaau

SEQ ID NO: 628117 - RNA, 15 nt, Homo sapiens
agccuuccacaguga

SEQ ID NO: 628118 - RNA, 15 nt, Homo sapiens
agccuugcagauauc

SEQ ID NO: 628119 - RNA, 20 nt, Homo sapiens
agccuugcauguacuugaag

SEQ ID NO: 628120 - RNA, 22 nt, Homo sapiens
agccuugggggggcugccuuug

SEQ ID NO: 628121 - RNA, 21 nt, Homo sapiens
agccuugugugaacucaccaa

SEQ ID NO: 628122 - RNA, 22 nt, Homo sapiens
agccuuguguuuggucaugugg

SEQ ID NO: 628123 - RNA, 15 nt, Homo sapiens
agccuuuaaaaccag

SEQ ID NO: 628124 - RNA, 21 nt, Homo sapiens
agccuuuccaagucacuagaa

SEQ ID NO: 628125 - RNA, 13 nt, Homo sapiens
agccuuuccauaa

SEQ ID NO: 628126 - RNA, 17 nt, Homo sapiens
agccuuuccuguagccu

SEQ ID NO: 628127 - RNA, 17 nt, Homo sapiens
agccuuucugcugauua

SEQ ID NO: 628128 - RNA, 13 nt, Homo sapiens
cacauucuauuaa

SEQ ID NO: 628129 - RNA, 22 nt, Homo sapiens
cacauucuauuuuggguauuaa

SEQ ID NO: 628130 - RNA, 20 nt, Homo sapiens
cacauucuuaaauauuucca

SEQ ID NO: 628131 - RNA, 18 nt, Homo sapiens
cacauugaaugcgcuuua

SEQ ID NO: 628132 - RNA, 23 nt, Homo sapiens
cacauugacuccuuuccaauaga

SEQ ID NO: 628133 - RNA, 15 nt, Homo sapiens
cacauugugccuuuu

SEQ ID NO: 628134 - RNA, 18 nt, Homo sapiens
cacauuuauauauauaug

SEQ ID NO: 628135 - RNA, 15 nt, Homo sapiens
cacauuucuaugcca

SEQ ID NO: 628136 - RNA, 15 nt, Homo sapiens
cacauuucucugugu

SEQ ID NO: 628137 - RNA, 15 nt, Homo sapiens
cacauuugauguaca

SEQ ID NO: 628138 - RNA, 19 nt, Homo sapiens
cacauuuuaagugcuucac

SEQ ID NO: 628139 - RNA, 16 nt, Homo sapiens
cacauuuuacaggcaa

SEQ ID NO: 628140 - RNA, 12 nt, Homo sapiens
cacauuuuuaca

SEQ ID NO: 628141 - RNA, 18 nt, Homo sapiens
cacauuuuuacaaauagg

SEQ ID NO: 628142 - RNA, 23 nt, Homo sapiens
cacauuuuuauaaaaaugagugc

SEQ ID NO: 628143 - RNA, 22 nt, Homo sapiens
cacauuuuuuuaugcucuugaa

SEQ ID NO: 628144 - RNA, 14 nt, Homo sapiens
caccaaaaccaaac

SEQ ID NO: 628145 - RNA, 15 nt, Homo sapiens
caccaaagacaguug

SEQ ID NO: 628146 - RNA, 13 nt, Homo sapiens
caccaaagccacc

SEQ ID NO: 628147 - RNA, 23 nt, Homo sapiens
caccaaaucagcugcuacuacuc

SEQ ID NO: 628148 - RNA, 16 nt, Homo sapiens
cacucggcauuucaaa

SEQ ID NO: 628149 - RNA, 23 nt, Homo sapiens
cacucuauaagauuccaaaaagc

SEQ ID NO: 628150 - RNA, 16 nt, Homo sapiens
cacucucagugcuucu

SEQ ID NO: 628151 - RNA, 18 nt, Homo sapiens
cacucuccccucccucuu

SEQ ID NO: 628152 - RNA, 23 nt, Homo sapiens
cacucuccccucccucuuccuuc

SEQ ID NO: 628153 - RNA, 17 nt, Homo sapiens
cacucuggagcauuucu

SEQ ID NO: 628154 - RNA, 23 nt, Homo sapiens
cacucugguggcaggugccuugu

SEQ ID NO: 628155 - RNA, 17 nt, Homo sapiens
cacucuguaauaguuca

SEQ ID NO: 628156 - RNA, 18 nt, Homo sapiens
cacucuguaguuacugug

SEQ ID NO: 628157 - RNA, 19 nt, Homo sapiens
cacucuguaguuacugugg

SEQ ID NO: 628158 - RNA, 21 nt, Homo sapiens
cacucuuaucuacauaaggau

SEQ ID NO: 628159 - RNA, 22 nt, Homo sapiens
cacucuuaucuacauaaggaug

SEQ ID NO: 628160 - RNA, 20 nt, Homo sapiens
cacucuucuccccgugcuuu

SEQ ID NO: 628161 - RNA, 14 nt, Homo sapiens
cacucuucuguaaa

SEQ ID NO: 628162 - RNA, 14 nt, Homo sapiens
cacucuuguaauaa

SEQ ID NO: 628163 - RNA, 20 nt, Homo sapiens
cacucuuuugcuuuauucca

SEQ ID NO: 628164 - RNA, 20 nt, Homo sapiens
cacugaaaauuuaacaguau

SEQ ID NO: 628165 - RNA, 16 nt, Homo sapiens
cacugaacaaaaccua

SEQ ID NO: 628166 - RNA, 14 nt, Homo sapiens
cacugaacaggcug

SEQ ID NO: 628167 - RNA, 23 nt, Homo sapiens
cacugaacuccaccgaccaacug

SEQ ID NO: 628168 - RNA, 15 nt, Homo sapiens
cacugaacuuugcaa

SEQ ID NO: 628169 - RNA, 23 nt, Homo sapiens
cacugaagaagucacugaacaaa

SEQ ID NO: 628170 - RNA, 13 nt, Homo sapiens
cacugaagcacca

SEQ ID NO: 628171 - RNA, 16 nt, Homo sapiens
cacugaagugcuugca

SEQ ID NO: 628172 - RNA, 23 nt, Homo sapiens
cacugaaugccucaaugugacca

SEQ ID NO: 628173 - RNA, 18 nt, Homo sapiens
cacugaauuaaucaucua

SEQ ID NO: 628174 - RNA, 20 nt, Homo sapiens
cacugaauuuuguguguacc

SEQ ID NO: 628175 - RNA, 13 nt, Homo sapiens
cacugacugagau

SEQ ID NO: 628176 - RNA, 12 nt, Homo sapiens
cacugacuguga

SEQ ID NO: 628177 - RNA, 20 nt, Homo sapiens
cacugacugugaaaccuuua

SEQ ID NO: 628178 - RNA, 13 nt, Homo sapiens
cacugacuugaga

SEQ ID NO: 628179 - RNA, 19 nt, Homo sapiens
cacugagaagauugugaau

SEQ ID NO: 628180 - RNA, 19 nt, Homo sapiens
cacugaggagauacugaac

SEQ ID NO: 628181 - RNA, 19 nt, Homo sapiens
cacugaggguggcacucaa

SEQ ID NO: 628182 - RNA, 16 nt, Homo sapiens
cacugagucagaauuc

SEQ ID NO: 628183 - RNA, 15 nt, Homo sapiens
cacugaguucuauca

SEQ ID NO: 628184 - RNA, 22 nt, Homo sapiens
cacugaucauuagagaaaugca

SEQ ID NO: 628185 - RNA, 17 nt, Homo sapiens
cacugaucuaagcagug

SEQ ID NO: 628186 - RNA, 21 nt, Homo sapiens
cacugaucugcuagugcugua

SEQ ID NO: 628187 - RNA, 22 nt, Homo sapiens
cacugaucugcuagugcuguaa

SEQ ID NO: 628188 - RNA, 21 nt, Homo sapiens
cacugaugaacuagugaugua

SEQ ID NO: 628189 - RNA, 20 nt, Homo sapiens
cacugaugaguuucacugua

SEQ ID NO: 628190 - RNA, 22 nt, Homo sapiens
cacugauggaaaauaccagugu

SEQ ID NO: 628191 - RNA, 16 nt, Homo sapiens
cacugauguacaauua

SEQ ID NO: 628192 - RNA, 18 nt, Homo sapiens
cacugcacacagugacuu

SEQ ID NO: 628193 - RNA, 19 nt, Homo sapiens
cacugcaccugaccugcug

SEQ ID NO: 628194 - RNA, 20 nt, Homo sapiens
cacugcaccugcccagcucc

SEQ ID NO: 628195 - RNA, 15 nt, Homo sapiens
cacugcacuccagcu

SEQ ID NO: 628196 - RNA, 18 nt, Homo sapiens
cacugcagaacagcauca

SEQ ID NO: 628197 - RNA, 16 nt, Homo sapiens
cacugcagcugaagag

SEQ ID NO: 628198 - RNA, 23 nt, Homo sapiens
cacugcagucugcagaguucucc

SEQ ID NO: 628199 - RNA, 14 nt, Homo sapiens
cacugcagugcuga

SEQ ID NO: 628200 - RNA, 13 nt, Homo sapiens
cacugcauuucau

SEQ ID NO: 628201 - RNA, 21 nt, Homo sapiens
cacugccagggguucuugagc

SEQ ID NO: 628202 - RNA, 20 nt, Homo sapiens
cacugcccacaugggaccug

SEQ ID NO: 628203 - RNA, 15 nt, Homo sapiens
cacugcccaccaaag

SEQ ID NO: 628204 - RNA, 17 nt, Homo sapiens
cacugccccucucucag

SEQ ID NO: 628205 - RNA, 17 nt, Homo sapiens
cacugcccgaaaagcau

SEQ ID NO: 628206 - RNA, 19 nt, Homo sapiens
cacugccgacaucagcauu

SEQ ID NO: 628207 - RNA, 23 nt, Homo sapiens
cacugcgcccuuaacugcaucca

SEQ ID NO: 628208 - RNA, 14 nt, Homo sapiens
cacugcucaagaag

SEQ ID NO: 628209 - RNA, 14 nt, Homo sapiens
cacugcucauuugg

SEQ ID NO: 628210 - RNA, 21 nt, Homo sapiens
cacugcucauuuggaucccag

SEQ ID NO: 628211 - RNA, 17 nt, Homo sapiens
cacugcucguggccaaa

SEQ ID NO: 628212 - RNA, 21 nt, Homo sapiens
cacugcugcccccagaaaaag

SEQ ID NO: 628213 - RNA, 16 nt, Homo sapiens
cacugcuuaacuucac

SEQ ID NO: 628214 - RNA, 16 nt, Homo sapiens
cacuggaacauuccag

SEQ ID NO: 628215 - RNA, 22 nt, Homo sapiens
cacuggaauauaaaacagucau

SEQ ID NO: 628216 - RNA, 14 nt, Homo sapiens
cacuggaugcagaa

SEQ ID NO: 628217 - RNA, 22 nt, Homo sapiens
cacuggccccucaaaucgucca

SEQ ID NO: 628218 - RNA, 17 nt, Homo sapiens
cacugggaagcuggagu

SEQ ID NO: 628219 - RNA, 17 nt, Homo sapiens
cacugggacccucagcc

SEQ ID NO: 628220 - RNA, 19 nt, Homo sapiens
cacugggagaggugccagc

SEQ ID NO: 628221 - RNA, 17 nt, Homo sapiens
cacugggccugucacug

SEQ ID NO: 628222 - RNA, 21 nt, Homo sapiens
cacugggugagagaggaauaa

SEQ ID NO: 628223 - RNA, 20 nt, Homo sapiens
cacuggguguaaacacaucu

SEQ ID NO: 628224 - RNA, 16 nt, Homo sapiens
cacugguauuaacuuu

SEQ ID NO: 628225 - RNA, 18 nt, Homo sapiens
cacuggucaggugcuucu

SEQ ID NO: 628226 - RNA, 18 nt, Homo sapiens
cacuggucuaauguuugu

SEQ ID NO: 628227 - RNA, 13 nt, Homo sapiens
cacuggucuguag

SEQ ID NO: 628228 - RNA, 22 nt, Homo sapiens
cacuggugguucuacugaccca

SEQ ID NO: 628229 - RNA, 14 nt, Homo sapiens
cacuguaaagacaa

SEQ ID NO: 628230 - RNA, 22 nt, Homo sapiens
cacuguaaucuuaaaaguguaa

SEQ ID NO: 628231 - RNA, 20 nt, Homo sapiens
cacuguacacauaagccaaa

SEQ ID NO: 628232 - RNA, 20 nt, Homo sapiens
cacugucaugcuucaucauu

SEQ ID NO: 628233 - RNA, 18 nt, Homo sapiens
cacugucccuugccucaa

SEQ ID NO: 628234 - RNA, 14 nt, Homo sapiens
cacuguccuaccag

SEQ ID NO: 628235 - RNA, 16 nt, Homo sapiens
cacugucugcccugaa

SEQ ID NO: 628236 - RNA, 19 nt, Homo sapiens
cacugucuugccagauuac

SEQ ID NO: 628237 - RNA, 18 nt, Homo sapiens
cacugucuuuaauucugu

SEQ ID NO: 628238 - RNA, 12 nt, Homo sapiens
cacugucuuuca

SEQ ID NO: 628239 - RNA, 23 nt, Homo sapiens
cacugugaagagaaccauaucaa

SEQ ID NO: 628240 - RNA, 13 nt, Homo sapiens
cacugugaagggu

SEQ ID NO: 628241 - RNA, 22 nt, Homo sapiens
cacugugagugguucaagcaca

SEQ ID NO: 628242 - RNA, 21 nt, Homo sapiens
cacuguggcauugucuguaau

SEQ ID NO: 628243 - RNA, 18 nt, Homo sapiens
cacugugggaaggccagc

SEQ ID NO: 628244 - RNA, 16 nt, Homo sapiens
cacugugggcuuuuau

SEQ ID NO: 628245 - RNA, 10 nt, Homo sapiens
cacuguguaa

SEQ ID NO: 628246 - RNA, 22 nt, Homo sapiens
cacugugugccuucugccaacg

SEQ ID NO: 628247 - RNA, 16 nt, Homo sapiens
cacuguucaaaccucu

SEQ ID NO: 628248 - RNA, 17 nt, Homo sapiens
cacuguucaauacugua

SEQ ID NO: 628249 - RNA, 14 nt, Homo sapiens
cacuguugccaaua

SEQ ID NO: 628250 - RNA, 15 nt, Homo sapiens
cacuguugucaaaaa

SEQ ID NO: 628251 - RNA, 19 nt, Homo sapiens
cacuguuuauacacugugu

SEQ ID NO: 628252 - RNA, 22 nt, Homo sapiens
cacuguuuuuuucccagguguu

SEQ ID NO: 628253 - RNA, 18 nt, Homo sapiens
cacuuaaaaaauguccau

SEQ ID NO: 628254 - RNA, 14 nt, Homo sapiens
agcuucuuuugcca

SEQ ID NO: 628255 - RNA, 17 nt, Homo sapiens
agcuugaaagcaguuaa

SEQ ID NO: 628256 - RNA, 23 nt, Homo sapiens
agcuugauuaaaucaaccaccua

SEQ ID NO: 628257 - RNA, 22 nt, Homo sapiens
agcuugcacagccaacgagaca

SEQ ID NO: 628258 - RNA, 22 nt, Homo sapiens
agcuuggaguucucuauacuca

SEQ ID NO: 628259 - RNA, 22 nt, Homo sapiens
agcuuggauggagacuccauga

SEQ ID NO: 628260 - RNA, 18 nt, Homo sapiens
agcuuggccuacagucau

SEQ ID NO: 628261 - RNA, 18 nt, Homo sapiens
agcuugggcuucuuccuc

SEQ ID NO: 628262 - RNA, 19 nt, Homo sapiens
agcuuggguccaccaugca

SEQ ID NO: 628263 - RNA, 22 nt, Homo sapiens
agcuuguugucuccacuuguau

SEQ ID NO: 628264 - RNA, 18 nt, Homo sapiens
agcuuguuuucuucacag

SEQ ID NO: 628265 - RNA, 17 nt, Homo sapiens
agcuuuaaacucaggga

SEQ ID NO: 628266 - RNA, 21 nt, Homo sapiens
agcuuuaacuuguaaaccaca

SEQ ID NO: 628267 - RNA, 22 nt, Homo sapiens
agcuuuaagcaaauucuuuuaa

SEQ ID NO: 628268 - RNA, 18 nt, Homo sapiens
auagccuggguuaaguau

SEQ ID NO: 628269 - RNA, 19 nt, Homo sapiens
auagcuaauuuuugcaaau

SEQ ID NO: 628270 - RNA, 20 nt, Homo sapiens
auagcuacuuuggaggacaa

SEQ ID NO: 628271 - RNA, 22 nt, Homo sapiens
auagcucuggggugggcaguuu

SEQ ID NO: 628272 - RNA, 11 nt, Homo sapiens
auagcuuccaa

SEQ ID NO: 628273 - RNA, 16 nt, Homo sapiens
auagcuugaagcccaa

SEQ ID NO: 628274 - RNA, 14 nt, Homo sapiens
auaggaaaacauug

SEQ ID NO: 628275 - RNA, 12 nt, Homo sapiens
auaggacauacu

SEQ ID NO: 628276 - RNA, 17 nt, Homo sapiens
auaggacauugugucag

SEQ ID NO: 628277 - RNA, 18 nt, Homo sapiens
auaggcauuugauuuugc

SEQ ID NO: 628278 - RNA, 17 nt, Homo sapiens
auaggccagaguugcaa

SEQ ID NO: 628279 - RNA, 22 nt, Homo sapiens
auaggcuggagaagcucaccca

SEQ ID NO: 628280 - RNA, 20 nt, Homo sapiens
auagggagacccccaucuuu

SEQ ID NO: 628281 - RNA, 22 nt, Homo sapiens
auagggagacccccaucuuuac

SEQ ID NO: 628282 - RNA, 20 nt, Homo sapiens
auagggggaagacagauaug

SEQ ID NO: 628283 - RNA, 17 nt, Homo sapiens
auagguagauccagauc

SEQ ID NO: 628284 - RNA, 14 nt, Homo sapiens
auaggugacagggc

SEQ ID NO: 628285 - RNA, 12 nt, Homo sapiens
auaggugcuuau

SEQ ID NO: 628286 - RNA, 21 nt, Homo sapiens
auagguguugguuuugggggu

SEQ ID NO: 628287 - RNA, 21 nt, Homo sapiens
auagguuuuucucauguaucu

SEQ ID NO: 628288 - RNA, 13 nt, Homo sapiens
auaguaaaugccu

SEQ ID NO: 628289 - RNA, 17 nt, Homo sapiens
auaguaacuacuuuuua

SEQ ID NO: 628290 - RNA, 17 nt, Homo sapiens
auaguaagccccuguga

SEQ ID NO: 628291 - RNA, 14 nt, Homo sapiens
auaguaaugugaug

SEQ ID NO: 628292 - RNA, 19 nt, Homo sapiens
auaguaccauuuauacaaa

SEQ ID NO: 628293 - RNA, 20 nt, Homo sapiens
auaguacucuuuguagcaaa

SEQ ID NO: 628294 - RNA, 13 nt, Homo sapiens
auaguacuggcau

SEQ ID NO: 628295 - RNA, 16 nt, Homo sapiens
auaguagaaccaguga

SEQ ID NO: 628296 - RNA, 17 nt, Homo sapiens
auaguaugaaugcagug

SEQ ID NO: 628297 - RNA, 13 nt, Homo sapiens
auaguaugggaaa

SEQ ID NO: 628298 - RNA, 21 nt, Homo sapiens
auaguccaccucccauuacuu

SEQ ID NO: 628299 - RNA, 17 nt, Homo sapiens
auaguccauggacaaua

SEQ ID NO: 628300 - RNA, 18 nt, Homo sapiens
auagucccagcuacccag

SEQ ID NO: 628301 - RNA, 16 nt, Homo sapiens
auagugaacacacuga

SEQ ID NO: 628302 - RNA, 23 nt, Homo sapiens
auagugagagaggaggccuggac

SEQ ID NO: 628303 - RNA, 18 nt, Homo sapiens
auagugcaacaucucuga

SEQ ID NO: 628304 - RNA, 13 nt, Homo sapiens
auagugcaauagu

SEQ ID NO: 628305 - RNA, 20 nt, Homo sapiens
auagugcaauagugcaacau

SEQ ID NO: 628306 - RNA, 17 nt, Homo sapiens
auagugcacuagcauuu

SEQ ID NO: 628307 - RNA, 18 nt, Homo sapiens
auagugcacuagcauuuu

SEQ ID NO: 628308 - RNA, 12 nt, Homo sapiens
auagugcucaga

SEQ ID NO: 628309 - RNA, 20 nt, Homo sapiens
ccaggccucucucugcucca

SEQ ID NO: 628310 - RNA, 16 nt, Homo sapiens
ccaggccucuuggcag

SEQ ID NO: 628311 - RNA, 18 nt, Homo sapiens
ccaggccuguugcuauag

SEQ ID NO: 628312 - RNA, 15 nt, Homo sapiens
ccaggcgaugugcaa

SEQ ID NO: 628313 - RNA, 16 nt, Homo sapiens
ccaggcuagagugcaa

SEQ ID NO: 628314 - RNA, 18 nt, Homo sapiens
ccaggcuagagugcaaug

SEQ ID NO: 628315 - RNA, 20 nt, Homo sapiens
ccaggcugaauuacagugaa

SEQ ID NO: 628316 - RNA, 18 nt, Homo sapiens
ccaggcugaccacagcac

SEQ ID NO: 628317 - RNA, 23 nt, Homo sapiens
ccaggcugaccacagcacagcca

SEQ ID NO: 628318 - RNA, 17 nt, Homo sapiens
ccaggcugcacugcagu

SEQ ID NO: 628319 - RNA, 18 nt, Homo sapiens
ccaggcugcacugcagug

SEQ ID NO: 628320 - RNA, 19 nt, Homo sapiens
ccaggcugcacugcaguga

SEQ ID NO: 628321 - RNA, 12 nt, Homo sapiens
ccaggcugccuc

SEQ ID NO: 628322 - RNA, 19 nt, Homo sapiens
ccaggcugcuggagugcag

SEQ ID NO: 628323 - RNA, 21 nt, Homo sapiens
ccaggcugcuggagugcagug

SEQ ID NO: 628324 - RNA, 22 nt, Homo sapiens
ccaggcugcuggagugcagugg

SEQ ID NO: 628325 - RNA, 18 nt, Homo sapiens
ccaggcuggaaugcagug

SEQ ID NO: 628326 - RNA, 21 nt, Homo sapiens
ccaggcuggacgugguggcuc

SEQ ID NO: 628327 - RNA, 13 nt, Homo sapiens
ccaggcuggagac

SEQ ID NO: 628328 - RNA, 18 nt, Homo sapiens
ccaggcuggagugcaaug

SEQ ID NO: 628329 - RNA, 16 nt, Homo sapiens
ccaggcuggagugcag

SEQ ID NO: 628330 - RNA, 18 nt, Homo sapiens
ccaggcuggagugcagug

SEQ ID NO: 628331 - RNA, 19 nt, Homo sapiens
ccaggcuggagugcaguga

SEQ ID NO: 628332 - RNA, 21 nt, Homo sapiens
ccaggcuggucucaaacuccu

SEQ ID NO: 628333 - RNA, 21 nt, Homo sapiens
ccaggcuguuggaaaauccag

SEQ ID NO: 628334 - RNA, 19 nt, Homo sapiens
ccaggcuuuguugcuuccg

SEQ ID NO: 628335 - RNA, 20 nt, Homo sapiens
ccagggaagaagaucaacgc

SEQ ID NO: 628336 - RNA, 13 nt, Homo sapiens
ccagggaaggugg

SEQ ID NO: 628337 - RNA, 16 nt, Homo sapiens
ccagggaguccagggu

SEQ ID NO: 628338 - RNA, 14 nt, Homo sapiens
ccagggaucacugg

SEQ ID NO: 628339 - RNA, 18 nt, Homo sapiens
ccagggaugauucaagcc

SEQ ID NO: 628340 - RNA, 18 nt, Homo sapiens
ccagggcaaugccaucag

SEQ ID NO: 628341 - RNA, 21 nt, Homo sapiens
ccagggccuggaggcugugag

SEQ ID NO: 628342 - RNA, 19 nt, Homo sapiens
ccagggccugggggcagug

SEQ ID NO: 628343 - RNA, 13 nt, Homo sapiens
ccagggcgccagg

SEQ ID NO: 628344 - RNA, 15 nt, Homo sapiens
ccagggcuaguauaa

SEQ ID NO: 628345 - RNA, 18 nt, Homo sapiens
ccagggcugcagccugag

SEQ ID NO: 628346 - RNA, 22 nt, Homo sapiens
ccaggggaaccugccaugccag

SEQ ID NO: 628347 - RNA, 13 nt, Homo sapiens
ccaggggugggag

SEQ ID NO: 628348 - RNA, 15 nt, Homo sapiens
ccagggguguagaug

SEQ ID NO: 628349 - RNA, 22 nt, Homo sapiens
ccaggguagagcaaaggagaca

SEQ ID NO: 628350 - RNA, 22 nt, Homo sapiens
ccagggucuugggcuacuggca

SEQ ID NO: 628351 - RNA, 21 nt, Homo sapiens
ccagggugauuuuaugaucag

SEQ ID NO: 628352 - RNA, 16 nt, Homo sapiens
ccaggguggcugccag

SEQ ID NO: 628353 - RNA, 17 nt, Homo sapiens
ccaggguggcugccagc

SEQ ID NO: 628354 - RNA, 18 nt, Homo sapiens
ccaggucaccauccucag

SEQ ID NO: 628355 - RNA, 22 nt, Homo sapiens
ccaggucagcuguuacuuucuu

SEQ ID NO: 628356 - RNA, 12 nt, Homo sapiens
ccaggugcaaaa

SEQ ID NO: 628357 - RNA, 22 nt, Homo sapiens
ccaggugggacuuagcagugag

SEQ ID NO: 628358 - RNA, 16 nt, Homo sapiens
ccagguguguggugca

SEQ ID NO: 628359 - RNA, 14 nt, Homo sapiens
ccagguguucuaca

SEQ ID NO: 628360 - RNA, 19 nt, Homo sapiens
ccagguguucuacacucau

SEQ ID NO: 628361 - RNA, 22 nt, Homo sapiens
ccagguugcaguagcaguggau

SEQ ID NO: 628362 - RNA, 19 nt, Homo sapiens
ccagguuuuaauaaccaca

SEQ ID NO: 628363 - RNA, 14 nt, Homo sapiens
ccaguaaagccuua

SEQ ID NO: 628364 - RNA, 16 nt, Homo sapiens
ccaguaacgugcugcu

SEQ ID NO: 628365 - RNA, 16 nt, Homo sapiens
ccaguacgugcuaaca

SEQ ID NO: 628366 - RNA, 23 nt, Homo sapiens
ccaguacugggagauacagccau

SEQ ID NO: 628367 - RNA, 18 nt, Homo sapiens
ccaguacuuccugcagua

SEQ ID NO: 628368 - RNA, 19 nt, Homo sapiens
ccaguagcuaaagugcaag

SEQ ID NO: 628369 - RNA, 18 nt, Homo sapiens
ccaguauaagacuacuga

SEQ ID NO: 628370 - RNA, 13 nt, Homo sapiens
ccaguauaaucuc

SEQ ID NO: 628371 - RNA, 19 nt, Homo sapiens
ccaguauaugcugauggac

SEQ ID NO: 628372 - RNA, 13 nt, Homo sapiens
ccaguaucuccaa

SEQ ID NO: 628373 - RNA, 13 nt, Homo sapiens
ccaguauggugaa

SEQ ID NO: 628374 - RNA, 22 nt, Homo sapiens
ccaguauuuuuauuucuuuaau

SEQ ID NO: 628375 - RNA, 23 nt, Homo sapiens
ccagucaugagcguuagacugac

SEQ ID NO: 628376 - RNA, 20 nt, Homo sapiens
ccaguccagauauuucacau

SEQ ID NO: 628377 - RNA, 12 nt, Homo sapiens
ccaguccaugag

SEQ ID NO: 628378 - RNA, 12 nt, Homo sapiens
ccaguccaugcu

SEQ ID NO: 628379 - RNA, 15 nt, Homo sapiens
ccagucccacacugu

SEQ ID NO: 628380 - RNA, 21 nt, Homo sapiens
ccagucccagacaauuccauu

SEQ ID NO: 628381 - RNA, 19 nt, Homo sapiens
ccagucccgucgugcaguc

SEQ ID NO: 628382 - RNA, 14 nt, Homo sapiens
ccaguccuccagac

SEQ ID NO: 628383 - RNA, 18 nt, Homo sapiens
ccagucuauuuccacuga

SEQ ID NO: 628384 - RNA, 15 nt, Homo sapiens
ccagucucaucuccu

SEQ ID NO: 628385 - RNA, 23 nt, Homo sapiens
ccagucucugucguggagccauu

SEQ ID NO: 628386 - RNA, 19 nt, Homo sapiens
ccagucuguugaguuaguu

SEQ ID NO: 628387 - RNA, 17 nt, Homo sapiens
ccagugaaccaaagaga

SEQ ID NO: 628388 - RNA, 14 nt, Homo sapiens
ccagugagggcagu

SEQ ID NO: 628389 - RNA, 18 nt, Homo sapiens
ccagugauccauguccug

SEQ ID NO: 628390 - RNA, 13 nt, Homo sapiens
ccaugcucaauga

SEQ ID NO: 628391 - RNA, 12 nt, Homo sapiens
ccaugcugccag

SEQ ID NO: 628392 - RNA, 20 nt, Homo sapiens
ccaugcugcccgcuucucac

SEQ ID NO: 628393 - RNA, 16 nt, Homo sapiens
ccaugcugugcugugu

SEQ ID NO: 628394 - RNA, 22 nt, Homo sapiens
ccauggaaggaagaaaagcugc

SEQ ID NO: 628395 - RNA, 18 nt, Homo sapiens
ccauggaagguucucugu

SEQ ID NO: 628396 - RNA, 22 nt, Homo sapiens
ccauggacacuccagugccagc

SEQ ID NO: 628397 - RNA, 16 nt, Homo sapiens
ccauggcccccaauaa

SEQ ID NO: 628398 - RNA, 18 nt, Homo sapiens
ccauggcccccaauaaag

SEQ ID NO: 628399 - RNA, 22 nt, Homo sapiens
ccauggcccccaauaaaggcag

SEQ ID NO: 628400 - RNA, 17 nt, Homo sapiens
ccauggccuugggcucu

SEQ ID NO: 628401 - RNA, 22 nt, Homo sapiens
ccaugggagguggggccucaau

SEQ ID NO: 628402 - RNA, 17 nt, Homo sapiens
ccauggggaggagaccu

SEQ ID NO: 628403 - RNA, 12 nt, Homo sapiens
ccaugggucugu

SEQ ID NO: 628404 - RNA, 16 nt, Homo sapiens
ccauggugaagugcuu

SEQ ID NO: 628405 - RNA, 16 nt, Homo sapiens
ccauggugacauugug

SEQ ID NO: 628406 - RNA, 15 nt, Homo sapiens
ccauggugcacaaaa

SEQ ID NO: 628407 - RNA, 16 nt, Homo sapiens
ccauggugugaucguc

SEQ ID NO: 628408 - RNA, 17 nt, Homo sapiens
ccauguaauaagcacuu

SEQ ID NO: 628409 - RNA, 18 nt, Homo sapiens
ccauguaaucagauuuau

SEQ ID NO: 628410 - RNA, 13 nt, Homo sapiens
ccauguaucuuuu

SEQ ID NO: 628411 - RNA, 14 nt, Homo sapiens
ccauguauucccuu

SEQ ID NO: 628412 - RNA, 17 nt, Homo sapiens
ccauguauuucagggac

SEQ ID NO: 628413 - RNA, 22 nt, Homo sapiens
ccaugucagauaaguguaaaua

SEQ ID NO: 628414 - RNA, 22 nt, Homo sapiens
ccaugucagaugggaaaucugc

SEQ ID NO: 628415 - RNA, 10 nt, Homo sapiens
ccauguccaa

SEQ ID NO: 628416 - RNA, 14 nt, Homo sapiens
ccauguccaaagag

SEQ ID NO: 628417 - RNA, 12 nt, Homo sapiens
ccaugucuuucu

SEQ ID NO: 628418 - RNA, 21 nt, Homo sapiens
ccaugucuuuggacaaccaug

SEQ ID NO: 628419 - RNA, 14 nt, Homo sapiens
ccaugugaacagca

SEQ ID NO: 628420 - RNA, 12 nt, Homo sapiens
ccaugugcaaua

SEQ ID NO: 628421 - RNA, 21 nt, Homo sapiens
ccauguguaagaacaaugcca

SEQ ID NO: 628422 - RNA, 16 nt, Homo sapiens
ccaugugugagugugu

SEQ ID NO: 628423 - RNA, 14 nt, Homo sapiens
ccauguuaaaugac

SEQ ID NO: 628424 - RNA, 21 nt, Homo sapiens
ccauguugcugccaaccauac

SEQ ID NO: 628425 - RNA, 13 nt, Homo sapiens
ccauguuggaucu

SEQ ID NO: 628426 - RNA, 17 nt, Homo sapiens
ccauguuguaaugcugc

SEQ ID NO: 628427 - RNA, 22 nt, Homo sapiens
ccauguuguaaugcugcacuuc

SEQ ID NO: 628428 - RNA, 16 nt, Homo sapiens
ccauuaaaaacuacca

SEQ ID NO: 628429 - RNA, 20 nt, Homo sapiens
ccauuaaaaagugggcaaag

SEQ ID NO: 628430 - RNA, 22 nt, Homo sapiens
ccauuaacaaauguaucacuag

SEQ ID NO: 628431 - RNA, 13 nt, Homo sapiens
ccauuacuacugu

SEQ ID NO: 628432 - RNA, 17 nt, Homo sapiens
ccauuauuauguaaaua

SEQ ID NO: 628433 - RNA, 21 nt, Homo sapiens
ccauuauuauuucuguucuua

SEQ ID NO: 628434 - RNA, 23 nt, Homo sapiens
auaugaagcaggaucacaaaaga

SEQ ID NO: 628435 - RNA, 17 nt, Homo sapiens
auaugaaggauuacucu

SEQ ID NO: 628436 - RNA, 14 nt, Homo sapiens
auaugaaguguuag

SEQ ID NO: 628437 - RNA, 17 nt, Homo sapiens
auaugaaugucaguagu

SEQ ID NO: 628438 - RNA, 12 nt, Homo sapiens
auaugacucaga

SEQ ID NO: 628439 - RNA, 14 nt, Homo sapiens
auaugacugauuac

SEQ ID NO: 628440 - RNA, 17 nt, Homo sapiens
auaugauagaugacaaa

SEQ ID NO: 628441 - RNA, 20 nt, Homo sapiens
auaugauauauaaaugugau

SEQ ID NO: 628442 - RNA, 20 nt, Homo sapiens
auaugaucaguguuacugcc

SEQ ID NO: 628443 - RNA, 21 nt, Homo sapiens
auaugaucccuaauguguuuc

SEQ ID NO: 628444 - RNA, 16 nt, Homo sapiens
auaugaucuaauacaa

SEQ ID NO: 628445 - RNA, 18 nt, Homo sapiens
auaugauuuuuauccaug

SEQ ID NO: 628446 - RNA, 14 nt, Homo sapiens
auaugcaaagucua

SEQ ID NO: 628447 - RNA, 19 nt, Homo sapiens
auaugcaaauggcuacuaa

SEQ ID NO: 628448 - RNA, 17 nt, Homo sapiens
auaugcaagugcaaaag

SEQ ID NO: 628449 - RNA, 17 nt, Homo sapiens
auaugcaauauuuacau

SEQ ID NO: 628450 - RNA, 17 nt, Homo sapiens
auaugccucauacacau

SEQ ID NO: 628451 - RNA, 17 nt, Homo sapiens
auaugccugcaaucuga

SEQ ID NO: 628452 - RNA, 19 nt, Homo sapiens
auaugcugacagcucuuca

SEQ ID NO: 628453 - RNA, 22 nt, Homo sapiens
auaugcuuagcauagauuugca

SEQ ID NO: 628454 - RNA, 23 nt, Homo sapiens
auauggaugauucagaaauugga

SEQ ID NO: 628455 - RNA, 15 nt, Homo sapiens
auaugggcacuuuaa

SEQ ID NO: 628456 - RNA, 16 nt, Homo sapiens
auaugggcucaaguca

SEQ ID NO: 628457 - RNA, 21 nt, Homo sapiens
auaugguaaauaaaacgugac

SEQ ID NO: 628458 - RNA, 18 nt, Homo sapiens
auauguaaagcacaucag

SEQ ID NO: 628459 - RNA, 14 nt, Homo sapiens
auauguagccuuca

SEQ ID NO: 628460 - RNA, 14 nt, Homo sapiens
auauguaguauaau

SEQ ID NO: 628461 - RNA, 15 nt, Homo sapiens
auauguauauauaug

SEQ ID NO: 628462 - RNA, 12 nt, Homo sapiens
auauguaugggu

SEQ ID NO: 628463 - RNA, 19 nt, Homo sapiens
auaugucaugccucacuuu

SEQ ID NO: 628464 - RNA, 14 nt, Homo sapiens
auaugucugauaau

SEQ ID NO: 628465 - RNA, 22 nt, Homo sapiens
auaugucugcuucuguccagga

SEQ ID NO: 628466 - RNA, 11 nt, Homo sapiens
auaugugccaa

SEQ ID NO: 628467 - RNA, 17 nt, Homo sapiens
auauguguauguacguu

SEQ ID NO: 628468 - RNA, 15 nt, Homo sapiens
auauguuaaauguau

SEQ ID NO: 628469 - RNA, 22 nt, Homo sapiens
auauguuaaugcaaagcuaaaa

SEQ ID NO: 628470 - RNA, 15 nt, Homo sapiens
auauguucagauuau

SEQ ID NO: 628471 - RNA, 15 nt, Homo sapiens
auauguucccuccag

SEQ ID NO: 628472 - RNA, 16 nt, Homo sapiens
auauuaaauguugcuu

SEQ ID NO: 628473 - RNA, 21 nt, Homo sapiens
auauuaacaacaauaacacug

SEQ ID NO: 628474 - RNA, 13 nt, Homo sapiens
auauuaacacgcu

SEQ ID NO: 628475 - RNA, 15 nt, Homo sapiens
auauuaacauauucu

SEQ ID NO: 628476 - RNA, 12 nt, Homo sapiens
auauuaacauuc

SEQ ID NO: 628477 - RNA, 20 nt, Homo sapiens
auauuaacuuuuaaugguga

SEQ ID NO: 628478 - RNA, 14 nt, Homo sapiens
auauuaaguccaaa

SEQ ID NO: 628479 - RNA, 13 nt, Homo sapiens
auauuaaucaaaa

SEQ ID NO: 628480 - RNA, 19 nt, Homo sapiens
auauuacccagcugaauag

SEQ ID NO: 628481 - RNA, 23 nt, Homo sapiens
auauuacuuguuuucacuuuauc

SEQ ID NO: 628482 - RNA, 15 nt, Homo sapiens
auauuagugcagcca

SEQ ID NO: 628483 - RNA, 17 nt, Homo sapiens
auauuauacagaccgaa

SEQ ID NO: 628484 - RNA, 15 nt, Homo sapiens
auauuaucuaccugu

SEQ ID NO: 628485 - RNA, 17 nt, Homo sapiens
auauuauugauucacuu

SEQ ID NO: 628486 - RNA, 14 nt, Homo sapiens
auauucaagugaua

SEQ ID NO: 628487 - RNA, 16 nt, Homo sapiens
auauucacacauauuc

SEQ ID NO: 628488 - RNA, 14 nt, Homo sapiens
auauucacuaagga

SEQ ID NO: 628489 - RNA, 20 nt, Homo sapiens
auauucacugguuuuacaca

SEQ ID NO: 628490 - RNA, 23 nt, Homo sapiens
auauucacuugacuaaaaucacu

SEQ ID NO: 628491 - RNA, 17 nt, Homo sapiens
auauucagccagcuuaa

SEQ ID NO: 628492 - RNA, 16 nt, Homo sapiens
auauucaggacuugaa

SEQ ID NO: 628493 - RNA, 21 nt, Homo sapiens
auauucaggcuacucauucag

SEQ ID NO: 628494 - RNA, 18 nt, Homo sapiens
auauucaugaaaugugga

SEQ ID NO: 628495 - RNA, 14 nt, Homo sapiens
auauucaugguugu

SEQ ID NO: 628496 - RNA, 22 nt, Homo sapiens
auauucauuggcagcucaaaga

SEQ ID NO: 628497 - RNA, 14 nt, Homo sapiens
auauuccagcagug

SEQ ID NO: 628498 - RNA, 21 nt, Homo sapiens
auauuccagcagugaaacuug

SEQ ID NO: 628499 - RNA, 18 nt, Homo sapiens
auauuccuauauguagcu

SEQ ID NO: 628500 - RNA, 18 nt, Homo sapiens
auauuccugcauuuguga

SEQ ID NO: 628501 - RNA, 20 nt, Homo sapiens
auauucuaagccaguuuuca

SEQ ID NO: 628502 - RNA, 14 nt, Homo sapiens
auauucuauuccau

SEQ ID NO: 628503 - RNA, 21 nt, Homo sapiens
auauucucaguguagggcaga

SEQ ID NO: 628504 - RNA, 22 nt, Homo sapiens
auauucucuuugugaggacaaa

SEQ ID NO: 628505 - RNA, 18 nt, Homo sapiens
auauucugguuacugugg

SEQ ID NO: 628506 - RNA, 14 nt, Homo sapiens
auauucuuaaugac

SEQ ID NO: 628507 - RNA, 16 nt, Homo sapiens
auauucuuuguaugau

SEQ ID NO: 628508 - RNA, 22 nt, Homo sapiens
auauugaauaaaaaauagacau

SEQ ID NO: 628509 - RNA, 22 nt, Homo sapiens
auauugaaugaugugauacaaa

SEQ ID NO: 628510 - RNA, 14 nt, Homo sapiens
auauugcagucaau

SEQ ID NO: 628511 - RNA, 12 nt, Homo sapiens
auauugccuuau

SEQ ID NO: 628512 - RNA, 20 nt, Homo sapiens
cauccagguggagacccuga

SEQ ID NO: 628513 - RNA, 15 nt, Homo sapiens
cauccagguuuauga

SEQ ID NO: 628514 - RNA, 17 nt, Homo sapiens
cauccaguucaugagaa

SEQ ID NO: 628515 - RNA, 16 nt, Homo sapiens
cauccauaauugugau

SEQ ID NO: 628516 - RNA, 22 nt, Homo sapiens
cauccauagugcacuagcauuu

SEQ ID NO: 628517 - RNA, 15 nt, Homo sapiens
cauccauccaaaggc

SEQ ID NO: 628518 - RNA, 15 nt, Homo sapiens
cauccaugcacuuua

SEQ ID NO: 628519 - RNA, 23 nt, Homo sapiens
cauccaugcugugcuguguuauu

SEQ ID NO: 628520 - RNA, 19 nt, Homo sapiens
caucccagcaccugccucc

SEQ ID NO: 628521 - RNA, 15 nt, Homo sapiens
caucccaucaucuug

SEQ ID NO: 628522 - RNA, 17 nt, Homo sapiens
cauccccaccacugaua

SEQ ID NO: 628523 - RNA, 18 nt, Homo sapiens
cauccccaccacugauau

SEQ ID NO: 628524 - RNA, 18 nt, Homo sapiens
cauccccauccuccagcu

SEQ ID NO: 628525 - RNA, 20 nt, Homo sapiens
cauccccuuuggcuaccuga

SEQ ID NO: 628526 - RNA, 19 nt, Homo sapiens
caucccugaaacaucucaa

SEQ ID NO: 628527 - RNA, 17 nt, Homo sapiens
caucccuuaguuuccac

SEQ ID NO: 628528 - RNA, 22 nt, Homo sapiens
caucccuuccuggaaacagcau

SEQ ID NO: 628529 - RNA, 22 nt, Homo sapiens
cauccgaagaugguggccacag

SEQ ID NO: 628530 - RNA, 20 nt, Homo sapiens
cauccggccaaaugcaaaau

SEQ ID NO: 628531 - RNA, 15 nt, Homo sapiens
cauccguggcugcag

SEQ ID NO: 628532 - RNA, 18 nt, Homo sapiens
cauccuaaaaaguuccau

SEQ ID NO: 628533 - RNA, 20 nt, Homo sapiens
cauccuaccccuuugcacuu

SEQ ID NO: 628534 - RNA, 19 nt, Homo sapiens
cauccucacaugugacaaa

SEQ ID NO: 628535 - RNA, 18 nt, Homo sapiens
cauccuccagauagugua

SEQ ID NO: 628536 - RNA, 23 nt, Homo sapiens
cauccuccccuagcuuagcuguc

SEQ ID NO: 628537 - RNA, 22 nt, Homo sapiens
cauccugaaaaggguguugcua

SEQ ID NO: 628538 - RNA, 14 nt, Homo sapiens
cauccugaccagcu

SEQ ID NO: 628539 - RNA, 19 nt, Homo sapiens
cauccugaccuugcacaaa

SEQ ID NO: 628540 - RNA, 12 nt, Homo sapiens
cauccuggcacg

SEQ ID NO: 628541 - RNA, 17 nt, Homo sapiens
cauccuggccaacauug

SEQ ID NO: 628542 - RNA, 21 nt, Homo sapiens
cauccuggcuaacacggugaa

SEQ ID NO: 628543 - RNA, 18 nt, Homo sapiens
cauccugguuuccacugu

SEQ ID NO: 628544 - RNA, 14 nt, Homo sapiens
cauccugucaccau

SEQ ID NO: 628545 - RNA, 16 nt, Homo sapiens
cauccugucaccauga

SEQ ID NO: 628546 - RNA, 18 nt, Homo sapiens
cauccugugcugugcaca

SEQ ID NO: 628547 - RNA, 17 nt, Homo sapiens
cauccuucaagaacucu

SEQ ID NO: 628548 - RNA, 20 nt, Homo sapiens
cauccuucugucuccagggc

SEQ ID NO: 628549 - RNA, 21 nt, Homo sapiens
cauccuugaugcaagugcaac

SEQ ID NO: 628550 - RNA, 24 nt, Homo sapiens
cauccuuggaaauuggaagagcac

SEQ ID NO: 628551 - RNA, 22 nt, Homo sapiens
cauccuugucugggucuaccag

SEQ ID NO: 628552 - RNA, 20 nt, Homo sapiens
cauccuuuuacuuuuugccc

SEQ ID NO: 628553 - RNA, 17 nt, Homo sapiens
caucggaaaaauaauca

SEQ ID NO: 628554 - RNA, 12 nt, Homo sapiens
caucgggagcac

SEQ ID NO: 628555 - RNA, 18 nt, Homo sapiens
caucggucuaaagcuuug

SEQ ID NO: 628556 - RNA, 23 nt, Homo sapiens
caucgguucauauuaagacauaa

SEQ ID NO: 628557 - RNA, 22 nt, Homo sapiens
caucuaaccucaucuucuucac

SEQ ID NO: 628558 - RNA, 11 nt, Homo sapiens
caucuaagcau

SEQ ID NO: 628559 - RNA, 13 nt, Homo sapiens
caucuaagccuga

SEQ ID NO: 628560 - RNA, 12 nt, Homo sapiens
caucuaauauga

SEQ ID NO: 628561 - RNA, 16 nt, Homo sapiens
caucuacaaucaggag

SEQ ID NO: 628562 - RNA, 16 nt, Homo sapiens
caucuaccuauacuua

SEQ ID NO: 628563 - RNA, 13 nt, Homo sapiens
caucuauucaagc

SEQ ID NO: 628564 - RNA, 21 nt, Homo sapiens
caucuauuuuggauuguauau

SEQ ID NO: 628565 - RNA, 22 nt, Homo sapiens
caucucaaaaauaaugcauaaa

SEQ ID NO: 628566 - RNA, 22 nt, Homo sapiens
caucucaacaaccugaaugucc

SEQ ID NO: 628567 - RNA, 13 nt, Homo sapiens
caucucacuuuau

SEQ ID NO: 628568 - RNA, 14 nt, Homo sapiens
caucucagugcagg

SEQ ID NO: 628569 - RNA, 15 nt, Homo sapiens
caucucagugcagga

SEQ ID NO: 628570 - RNA, 12 nt, Homo sapiens
caucucaugccc

SEQ ID NO: 628571 - RNA, 22 nt, Homo sapiens
caucuccagggagcaagacaga

SEQ ID NO: 628572 - RNA, 16 nt, Homo sapiens
caucuccauguagaau

SEQ ID NO: 628573 - RNA, 21 nt, Homo sapiens
caucuccccucagauuccacc

SEQ ID NO: 628574 - RNA, 15 nt, Homo sapiens
caucucccucugauu

SEQ ID NO: 628575 - RNA, 20 nt, Homo sapiens
caucuccuauaaucugucaa

SEQ ID NO: 628576 - RNA, 13 nt, Homo sapiens
caucucuacaaaa

SEQ ID NO: 628577 - RNA, 15 nt, Homo sapiens
caucucugcagguuu

SEQ ID NO: 628578 - RNA, 19 nt, Homo sapiens
caucucuggagccagagag

SEQ ID NO: 628579 - RNA, 19 nt, Homo sapiens
caucucugguuuucuugcc

SEQ ID NO: 628580 - RNA, 18 nt, Homo sapiens
caucugacucacaagaag

SEQ ID NO: 628581 - RNA, 20 nt, Homo sapiens
caucugacucacaagaagac

SEQ ID NO: 628582 - RNA, 12 nt, Homo sapiens
caucugcaaaag

SEQ ID NO: 628583 - RNA, 15 nt, Homo sapiens
caucugcaaaauggg

SEQ ID NO: 628584 - RNA, 18 nt, Homo sapiens
caucugcuccuguucaca

SEQ ID NO: 628585 - RNA, 14 nt, Homo sapiens
caucugcugcaguu

SEQ ID NO: 628586 - RNA, 16 nt, Homo sapiens
caucugcugcaguuac

SEQ ID NO: 628587 - RNA, 12 nt, Homo sapiens
caucugcuuaca

SEQ ID NO: 628588 - RNA, 22 nt, Homo sapiens
caucugcuuuucccauugccau

SEQ ID NO: 628589 - RNA, 18 nt, Homo sapiens
caucuggaaggacaucua

SEQ ID NO: 628590 - RNA, 16 nt, Homo sapiens
caucuggguagcugua

SEQ ID NO: 628591 - RNA, 18 nt, Homo sapiens
caucuguaacagcauuaa

SEQ ID NO: 628592 - RNA, 18 nt, Homo sapiens
caucugucuguccuaccc

SEQ ID NO: 628593 - RNA, 12 nt, Homo sapiens
caucuuaccucu

SEQ ID NO: 628594 - RNA, 20 nt, Homo sapiens
caucuuccaccucaccucuu

SEQ ID NO: 628595 - RNA, 22 nt, Homo sapiens
caucuuccgcgcaggugccaac

SEQ ID NO: 628596 - RNA, 16 nt, Homo sapiens
caucuuccucugcaga

SEQ ID NO: 628597 - RNA, 13 nt, Homo sapiens
caucuucucucau

SEQ ID NO: 628598 - RNA, 15 nt, Homo sapiens
caucuugaucugugu

SEQ ID NO: 628599 - RNA, 14 nt, Homo sapiens
caucuuggucacau

SEQ ID NO: 628600 - RNA, 17 nt, Homo sapiens
caucuuggucacauaca

SEQ ID NO: 628601 - RNA, 13 nt, Homo sapiens
caucuuguuucau

SEQ ID NO: 628602 - RNA, 10 nt, Homo sapiens
caucuuuaag

SEQ ID NO: 628603 - RNA, 20 nt, Homo sapiens
caucuuuaucuguucuugcu

SEQ ID NO: 628604 - RNA, 21 nt, Homo sapiens
caucuuucuucuauuuuauuc

SEQ ID NO: 628605 - RNA, 20 nt, Homo sapiens
caucuuugauacuuguucaa

SEQ ID NO: 628606 - RNA, 16 nt, Homo sapiens
caucuuuggcugagcu

SEQ ID NO: 628607 - RNA, 20 nt, Homo sapiens
caucuuuuauagacgcucuu

SEQ ID NO: 628608 - RNA, 21 nt, Homo sapiens
caucuuuucuaaucacagugu

SEQ ID NO: 628609 - RNA, 22 nt, Homo sapiens
caucuuuucuguugccccaucc

SEQ ID NO: 628610 - RNA, 21 nt, Homo sapiens
caucuuuuuaaccugcaaaau

SEQ ID NO: 628611 - RNA, 18 nt, Homo sapiens
caucuuuuuuucuaugaa

SEQ ID NO: 628612 - RNA, 23 nt, Homo sapiens
caugaaaaaauacucaacauuau

SEQ ID NO: 628613 - RNA, 18 nt, Homo sapiens
caugaaaacacacauaca

SEQ ID NO: 628614 - RNA, 16 nt, Homo sapiens
cauucauaguaagaau

SEQ ID NO: 628615 - RNA, 22 nt, Homo sapiens
cauucauaguggauuaaugcau

SEQ ID NO: 628616 - RNA, 17 nt, Homo sapiens
cauucaucacuccaaaa

SEQ ID NO: 628617 - RNA, 12 nt, Homo sapiens
cauucauccuga

SEQ ID NO: 628618 - RNA, 16 nt, Homo sapiens
cauucaucucauucca

SEQ ID NO: 628619 - RNA, 19 nt, Homo sapiens
cauuccaaggguaugggaa

SEQ ID NO: 628620 - RNA, 13 nt, Homo sapiens
cauuccacuccac

SEQ ID NO: 628621 - RNA, 18 nt, Homo sapiens
cauuccagaaucuugacu

SEQ ID NO: 628622 - RNA, 18 nt, Homo sapiens
cauuccagacugcuucca

SEQ ID NO: 628623 - RNA, 18 nt, Homo sapiens
cauuccaggaaaacuggg

SEQ ID NO: 628624 - RNA, 16 nt, Homo sapiens
cauuccauuugaagca

SEQ ID NO: 628625 - RNA, 22 nt, Homo sapiens
cauuccauuuugugaauuguga

SEQ ID NO: 628626 - RNA, 20 nt, Homo sapiens
cauuccccuccccacuccuc

SEQ ID NO: 628627 - RNA, 22 nt, Homo sapiens
cauuccccucgugugacucucu

SEQ ID NO: 628628 - RNA, 15 nt, Homo sapiens
cauucccugggccaa

SEQ ID NO: 628629 - RNA, 18 nt, Homo sapiens
cauucccuuuuccauaua

SEQ ID NO: 628630 - RNA, 17 nt, Homo sapiens
cauuccgagauuuuaaa

SEQ ID NO: 628631 - RNA, 20 nt, Homo sapiens
cauuccugaaagaaacaguu

SEQ ID NO: 628632 - RNA, 18 nt, Homo sapiens
cauuccugcgcauggugc

SEQ ID NO: 628633 - RNA, 17 nt, Homo sapiens
cauuccuguagucaaaa

SEQ ID NO: 628634 - RNA, 19 nt, Homo sapiens
cauuccuuagauaccuuga

SEQ ID NO: 628635 - RNA, 14 nt, Homo sapiens
cauuccuugucacc

SEQ ID NO: 628636 - RNA, 17 nt, Homo sapiens
cauuccuuugucuucaa

SEQ ID NO: 628637 - RNA, 19 nt, Homo sapiens
cauucgucuuguuguuauu

SEQ ID NO: 628638 - RNA, 21 nt, Homo sapiens
agucugcccuauggauuugaa

SEQ ID NO: 628639 - RNA, 21 nt, Homo sapiens
agucugcucugcugcucugac

SEQ ID NO: 628640 - RNA, 17 nt, Homo sapiens
agucuggaaagugaugu

SEQ ID NO: 628641 - RNA, 19 nt, Homo sapiens
agucuggaaagugauguca

SEQ ID NO: 628642 - RNA, 18 nt, Homo sapiens
agucuggcaacagagcaa

SEQ ID NO: 628643 - RNA, 18 nt, Homo sapiens
agucuggccacugucaag

SEQ ID NO: 628644 - RNA, 23 nt, Homo sapiens
agucuggcuagguuaaaggccag

SEQ ID NO: 628645 - RNA, 15 nt, Homo sapiens
agucuguaaaaccag

SEQ ID NO: 628646 - RNA, 18 nt, Homo sapiens
agucuguaauacacucca

SEQ ID NO: 628647 - RNA, 16 nt, Homo sapiens
agucugucacacucuc

SEQ ID NO: 628648 - RNA, 20 nt, Homo sapiens
agucugucgauuuaugccuc

SEQ ID NO: 628649 - RNA, 14 nt, Homo sapiens
agucugucuacugu

SEQ ID NO: 628650 - RNA, 14 nt, Homo sapiens
agucuguugauuaa

SEQ ID NO: 628651 - RNA, 20 nt, Homo sapiens
agucuguuuucuaaagccag

SEQ ID NO: 628652 - RNA, 14 nt, Homo sapiens
cauaggcagcaucu

SEQ ID NO: 628653 - RNA, 14 nt, Homo sapiens
cauagggugcucug

SEQ ID NO: 628654 - RNA, 21 nt, Homo sapiens
cauagguaacaguuauaucaa

SEQ ID NO: 628655 - RNA, 20 nt, Homo sapiens
cauagguauauauaugccau

SEQ ID NO: 628656 - RNA, 13 nt, Homo sapiens
cauaggucccuga

SEQ ID NO: 628657 - RNA, 20 nt, Homo sapiens
cauaguaccauuuauacaaa

SEQ ID NO: 628658 - RNA, 17 nt, Homo sapiens
cauaguacuggcacaaa

SEQ ID NO: 628659 - RNA, 17 nt, Homo sapiens
cauaguaguaugaugau

SEQ ID NO: 628660 - RNA, 18 nt, Homo sapiens
agggaaugccuggagggu

SEQ ID NO: 628661 - RNA, 18 nt, Homo sapiens
agggaauuccugcuauga

SEQ ID NO: 628662 - RNA, 15 nt, Homo sapiens
agggaauuucuucaa

SEQ ID NO: 628663 - RNA, 17 nt, Homo sapiens
agggacacuuucacagu

SEQ ID NO: 628664 - RNA, 17 nt, Homo sapiens
agggacaggcacuccaa

SEQ ID NO: 628665 - RNA, 16 nt, Homo sapiens
agggaccaugugucac

SEQ ID NO: 628666 - RNA, 20 nt, Homo sapiens
agggacccugggugggagca

SEQ ID NO: 628667 - RNA, 21 nt, Homo sapiens
agggacucagggccaugccug

SEQ ID NO: 628668 - RNA, 19 nt, Homo sapiens
agggacuccaugcugccag

SEQ ID NO: 628669 - RNA, 16 nt, Homo sapiens
agggacucccacaaca

SEQ ID NO: 628670 - RNA, 20 nt, Homo sapiens
agggacugacaaaagacuug

SEQ ID NO: 628671 - RNA, 13 nt, Homo sapiens
agggacugugagu

SEQ ID NO: 628672 - RNA, 17 nt, Homo sapiens
agggacuuuagagaaua

SEQ ID NO: 628673 - RNA, 15 nt, Homo sapiens
agggagaacuugaaa

SEQ ID NO: 628674 - RNA, 15 nt, Homo sapiens
agggagaccaugccu

SEQ ID NO: 628675 - RNA, 13 nt, Homo sapiens
agggagagacuaa

SEQ ID NO: 628676 - RNA, 18 nt, Homo sapiens
agggagaggucaccagcu

SEQ ID NO: 628677 - RNA, 17 nt, Homo sapiens
agggagcacuguucaca

SEQ ID NO: 628678 - RNA, 15 nt, Homo sapiens
agggagcgaggucag

SEQ ID NO: 628679 - RNA, 21 nt, Homo sapiens
agggagcuaucaggaacagcu

SEQ ID NO: 628680 - RNA, 20 nt, Homo sapiens
agggagcucuggggacagcu

SEQ ID NO: 628681 - RNA, 20 nt, Homo sapiens
agggagcugaguaacaccau

SEQ ID NO: 628682 - RNA, 14 nt, Homo sapiens
agggagcuggaaaa

SEQ ID NO: 628683 - RNA, 13 nt, Homo sapiens
agggagcuuccug

SEQ ID NO: 628684 - RNA, 17 nt, Homo sapiens
agggaggagcagcaaga

SEQ ID NO: 628685 - RNA, 19 nt, Homo sapiens
agggaggaggccaccucuc

SEQ ID NO: 628686 - RNA, 22 nt, Homo sapiens
agggaggcaacacugcugucca

SEQ ID NO: 628687 - RNA, 18 nt, Homo sapiens
agggaggcagcgugggcu

SEQ ID NO: 628688 - RNA, 18 nt, Homo sapiens
agggaggcggauuucccu

SEQ ID NO: 628689 - RNA, 15 nt, Homo sapiens
agggagggcugucau

SEQ ID NO: 628690 - RNA, 16 nt, Homo sapiens
agggagggcuguggug

SEQ ID NO: 628691 - RNA, 18 nt, Homo sapiens
agggagggcuguggugcc

SEQ ID NO: 628692 - RNA, 19 nt, Homo sapiens
agggaggggagcuaugcua

SEQ ID NO: 628693 - RNA, 18 nt, Homo sapiens
agggaggggcuggggcag

SEQ ID NO: 628694 - RNA, 16 nt, Homo sapiens
agggaggucacuggaa

SEQ ID NO: 628695 - RNA, 13 nt, Homo sapiens
agggauacagggg

SEQ ID NO: 628696 - RNA, 17 nt, Homo sapiens
agggaugauucaagcca

SEQ ID NO: 628697 - RNA, 18 nt, Homo sapiens
agggaugauucaagccau

SEQ ID NO: 628698 - RNA, 17 nt, Homo sapiens
agggaugcugccugagu

SEQ ID NO: 628699 - RNA, 21 nt, Homo sapiens
agggauuuuuuuuuucagggc

SEQ ID NO: 628700 - RNA, 22 nt, Homo sapiens
agggcaaggugugguagcucac

SEQ ID NO: 628701 - RNA, 23 nt, Homo sapiens
agggcaauggcaccgucuuggcu

SEQ ID NO: 628702 - RNA, 18 nt, Homo sapiens
agggcacccaaaacucaa

SEQ ID NO: 628703 - RNA, 14 nt, Homo sapiens
agggcacugggcug

SEQ ID NO: 628704 - RNA, 18 nt, Homo sapiens
agggcagagaauggcugg

SEQ ID NO: 628705 - RNA, 14 nt, Homo sapiens
agggcagaggugga

SEQ ID NO: 628706 - RNA, 12 nt, Homo sapiens
agggcagcacug

SEQ ID NO: 628707 - RNA, 22 nt, Homo sapiens
agggcagcuggcccccagcccu

SEQ ID NO: 628708 - RNA, 16 nt, Homo sapiens
agggcagcugugauga

SEQ ID NO: 628709 - RNA, 23 nt, Homo sapiens
agggcagcuguggcuucuaggug

SEQ ID NO: 628710 - RNA, 23 nt, Homo sapiens
agggcagggcaucuccugugcau

SEQ ID NO: 628711 - RNA, 23 nt, Homo sapiens
agggcagggugaccuacucccca

SEQ ID NO: 628712 - RNA, 16 nt, Homo sapiens
agggcagucugcucaa

SEQ ID NO: 628713 - RNA, 17 nt, Homo sapiens
agggcaguggcuucuuu

SEQ ID NO: 628714 - RNA, 17 nt, Homo sapiens
agggcaguucugagugu

SEQ ID NO: 628715 - RNA, 20 nt, Homo sapiens
agggcauacauccacagauu

SEQ ID NO: 628716 - RNA, 14 nt, Homo sapiens
agggcaugcuuuau

SEQ ID NO: 628717 - RNA, 17 nt, Homo sapiens
agggcauggccaggugg

SEQ ID NO: 628718 - RNA, 12 nt, Homo sapiens
agggccaaagaa

SEQ ID NO: 628719 - RNA, 18 nt, Homo sapiens
agggccaaagaaccaaag

SEQ ID NO: 628720 - RNA, 23 nt, Homo sapiens
agggccacauagaugcugaugga

SEQ ID NO: 628721 - RNA, 16 nt, Homo sapiens
agggccacaugggagg

SEQ ID NO: 628722 - RNA, 13 nt, Homo sapiens
agggccagagcaa

SEQ ID NO: 628723 - RNA, 19 nt, Homo sapiens
agggcccacccaugucacc

SEQ ID NO: 628724 - RNA, 22 nt, Homo sapiens
agggcccagugacaaggcccug

SEQ ID NO: 628725 - RNA, 18 nt, Homo sapiens
agggccccucccucugcc

SEQ ID NO: 628726 - RNA, 17 nt, Homo sapiens
agggcccuccgaccacu

SEQ ID NO: 628727 - RNA, 21 nt, Homo sapiens
agggccgacguuccaccuggg

SEQ ID NO: 628728 - RNA, 17 nt, Homo sapiens
agggccugcccagacaa

SEQ ID NO: 628729 - RNA, 19 nt, Homo sapiens
agggcgccuacucuucagg

SEQ ID NO: 628730 - RNA, 20 nt, Homo sapiens
agggcggggguugcgucuca

SEQ ID NO: 628731 - RNA, 18 nt, Homo sapiens
agggcuagcaucccugag

SEQ ID NO: 628732 - RNA, 15 nt, Homo sapiens
agggcuauagcagaa

SEQ ID NO: 628733 - RNA, 16 nt, Homo sapiens
agggcucacucagcca

SEQ ID NO: 628734 - RNA, 13 nt, Homo sapiens
agggcuccaugcu

SEQ ID NO: 628735 - RNA, 19 nt, Homo sapiens
agggcuccugcacuuacuu

SEQ ID NO: 628736 - RNA, 15 nt, Homo sapiens
agggcugaaagccau

SEQ ID NO: 628737 - RNA, 16 nt, Homo sapiens
agggcugaaucuucug

SEQ ID NO: 628738 - RNA, 18 nt, Homo sapiens
agggcugcacauugccug

SEQ ID NO: 628739 - RNA, 19 nt, Homo sapiens
agggcugucaucugugcac

SEQ ID NO: 628740 - RNA, 21 nt, Homo sapiens
agggcuguggugccggugcuu

SEQ ID NO: 628741 - RNA, 15 nt, Homo sapiens
aggggaaaaucucag

SEQ ID NO: 628742 - RNA, 21 nt, Homo sapiens
aggggaagagauuagucucuu

SEQ ID NO: 628743 - RNA, 20 nt, Homo sapiens
aggggaagcugccaccccuc

SEQ ID NO: 628744 - RNA, 17 nt, Homo sapiens
aggggaaggccuuuuca

SEQ ID NO: 628745 - RNA, 13 nt, Homo sapiens
aggggaauggagg

SEQ ID NO: 628746 - RNA, 18 nt, Homo sapiens
aggggaaugggaagcagc

SEQ ID NO: 628747 - RNA, 19 nt, Homo sapiens
aggggaauuuucucuccau

SEQ ID NO: 628748 - RNA, 22 nt, Homo sapiens
aggggacacuggccccacagga

SEQ ID NO: 628749 - RNA, 16 nt, Homo sapiens
aggggacccagcuccu

SEQ ID NO: 628750 - RNA, 14 nt, Homo sapiens
aggggaccccacuc

SEQ ID NO: 628751 - RNA, 15 nt, Homo sapiens
aggggacuccaaagc

SEQ ID NO: 628752 - RNA, 12 nt, Homo sapiens
aggggacugggg

SEQ ID NO: 628753 - RNA, 20 nt, Homo sapiens
aggggagcaagcuuacacaa

SEQ ID NO: 628754 - RNA, 15 nt, Homo sapiens
aggggaggacacugg

SEQ ID NO: 628755 - RNA, 15 nt, Homo sapiens
aggggagggaucucc

SEQ ID NO: 628756 - RNA, 18 nt, Homo sapiens
aggggagggcaggcuugg

SEQ ID NO: 628757 - RNA, 15 nt, Homo sapiens
aggggaggguguuca

SEQ ID NO: 628758 - RNA, 18 nt, Homo sapiens
aggggcaaccaacugccc

SEQ ID NO: 628759 - RNA, 14 nt, Homo sapiens
aggggcaacgaaga

SEQ ID NO: 628760 - RNA, 13 nt, Homo sapiens
aggggcacagggu

SEQ ID NO: 628761 - RNA, 14 nt, Homo sapiens
aggggcacucuccc

SEQ ID NO: 628762 - RNA, 14 nt, Homo sapiens
aggggcaguggugg

SEQ ID NO: 628763 - RNA, 14 nt, Homo sapiens
aggggcauuucaca

SEQ ID NO: 628764 - RNA, 19 nt, Homo sapiens
aggggccacacuaugccug

SEQ ID NO: 628765 - RNA, 19 nt, Homo sapiens
aggggccagagagcagggg

SEQ ID NO: 628766 - RNA, 11 nt, Homo sapiens
aggggcccaag

SEQ ID NO: 628767 - RNA, 14 nt, Homo sapiens
aggggcccacaggg

SEQ ID NO: 628768 - RNA, 16 nt, Homo sapiens
aggggccggccagugg

SEQ ID NO: 628769 - RNA, 19 nt, Homo sapiens
aggggccuaggccucagcc

SEQ ID NO: 628770 - RNA, 21 nt, Homo sapiens
aggggccuuagggcacugggc

SEQ ID NO: 628771 - RNA, 14 nt, Homo sapiens
aggggcucaguggc

SEQ ID NO: 628772 - RNA, 21 nt, Homo sapiens
aggggcugaaagaacauggac

SEQ ID NO: 628773 - RNA, 20 nt, Homo sapiens
aggggcuguguuuccaucuc

SEQ ID NO: 628774 - RNA, 21 nt, Homo sapiens
caucauucauuuuuguuguug

SEQ ID NO: 628775 - RNA, 12 nt, Homo sapiens
caucauuucagc

SEQ ID NO: 628776 - RNA, 16 nt, Homo sapiens
caucauuuucuacuug

SEQ ID NO: 628777 - RNA, 18 nt, Homo sapiens
caucauuuugcauucaaa

SEQ ID NO: 628778 - RNA, 14 nt, Homo sapiens
cauccaaagaacau

SEQ ID NO: 628779 - RNA, 19 nt, Homo sapiens
cauccaaagaacaucugca

SEQ ID NO: 628780 - RNA, 18 nt, Homo sapiens
cauccaaccacuguacac

SEQ ID NO: 628781 - RNA, 18 nt, Homo sapiens
cauccaaggcuguuacca

SEQ ID NO: 628782 - RNA, 14 nt, Homo sapiens
cauccagacagucg

SEQ ID NO: 628783 - RNA, 16 nt, Homo sapiens
cauccaggacugagau

SEQ ID NO: 628784 - RNA, 22 nt, Homo sapiens
aggggguggggaagaagacaca

SEQ ID NO: 628785 - RNA, 23 nt, Homo sapiens
aggggguucuuauuuugcauucc

SEQ ID NO: 628786 - RNA, 18 nt, Homo sapiens
aggggucagagcacuccc

SEQ ID NO: 628787 - RNA, 14 nt, Homo sapiens
agggguccagccuc

SEQ ID NO: 628788 - RNA, 17 nt, Homo sapiens
aggggugauuucagaga

SEQ ID NO: 628789 - RNA, 13 nt, Homo sapiens
aggggugcauucu

SEQ ID NO: 628790 - RNA, 23 nt, Homo sapiens
aggggugcggcggucccagcucc

SEQ ID NO: 628791 - RNA, 19 nt, Homo sapiens
agggguggaaacauaggga

SEQ ID NO: 628792 - RNA, 23 nt, Homo sapiens
agggguuaaagcagacagucaca

SEQ ID NO: 628793 - RNA, 13 nt, Homo sapiens
agggguuccucaa

SEQ ID NO: 628794 - RNA, 24 nt, Homo sapiens
agggguugagggaagguucuucau

SEQ ID NO: 628795 - RNA, 15 nt, Homo sapiens
agggguuucuucaag

SEQ ID NO: 628796 - RNA, 18 nt, Homo sapiens
aggguaacuuaacagagu

SEQ ID NO: 628797 - RNA, 14 nt, Homo sapiens
aggguaaguuguua

SEQ ID NO: 628798 - RNA, 12 nt, Homo sapiens
aggguaauuucc

SEQ ID NO: 628799 - RNA, 20 nt, Homo sapiens
aggguagcuauuacugucca

SEQ ID NO: 628800 - RNA, 22 nt, Homo sapiens
aggguaguucaaagagucuguc

SEQ ID NO: 628801 - RNA, 19 nt, Homo sapiens
aggguaugauaagcuuuau

SEQ ID NO: 628802 - RNA, 14 nt, Homo sapiens
agggucaagccucu

SEQ ID NO: 628803 - RNA, 14 nt, Homo sapiens
aggguccaguggau

SEQ ID NO: 628804 - RNA, 22 nt, Homo sapiens
aggguccccuccccagcucccu

SEQ ID NO: 628805 - RNA, 18 nt, Homo sapiens
aggguccuaaaacuugga

SEQ ID NO: 628806 - RNA, 18 nt, Homo sapiens
aggguccuccuccaucuu

SEQ ID NO: 628807 - RNA, 13 nt, Homo sapiens
aggguccucuagc

SEQ ID NO: 628808 - RNA, 21 nt, Homo sapiens
aggguccugggccuccugaca

SEQ ID NO: 628809 - RNA, 20 nt, Homo sapiens
agggucucuagugcugugaa

SEQ ID NO: 628810 - RNA, 15 nt, Homo sapiens
agggucugcuucccc

SEQ ID NO: 628811 - RNA, 21 nt, Homo sapiens
agggucugggggcagcugucc

SEQ ID NO: 628812 - RNA, 22 nt, Homo sapiens
agggucuugggaaauaugaaug

SEQ ID NO: 628813 - RNA, 21 nt, Homo sapiens
agggugaccacaccuuggccu

SEQ ID NO: 628814 - RNA, 20 nt, Homo sapiens
agggugagacacugcacaga

SEQ ID NO: 628815 - RNA, 13 nt, Homo sapiens
agggugagugcaa

SEQ ID NO: 628816 - RNA, 14 nt, Homo sapiens
agggugagugcaag

SEQ ID NO: 628817 - RNA, 19 nt, Homo sapiens
agggugcagcccucuugcc

SEQ ID NO: 628818 - RNA, 14 nt, Homo sapiens
agggugcaggagag

SEQ ID NO: 628819 - RNA, 16 nt, Homo sapiens
agggugcugcuucccu

SEQ ID NO: 628820 - RNA, 20 nt, Homo sapiens
aggguggcaagggaugugcu

SEQ ID NO: 628821 - RNA, 18 nt, Homo sapiens
aggguggcccuugcaguu

SEQ ID NO: 628822 - RNA, 18 nt, Homo sapiens
agggugggaccaaugucc

SEQ ID NO: 628823 - RNA, 13 nt, Homo sapiens
aggguggucucaa

SEQ ID NO: 628824 - RNA, 11 nt, Homo sapiens
agggugguggu

SEQ ID NO: 628825 - RNA, 16 nt, Homo sapiens
aggguguaggggccac

SEQ ID NO: 628826 - RNA, 14 nt, Homo sapiens
aggguguguguuca

SEQ ID NO: 628827 - RNA, 15 nt, Homo sapiens
aggguguguguucac

SEQ ID NO: 628828 - RNA, 18 nt, Homo sapiens
aggguuacugacguguaa

SEQ ID NO: 628829 - RNA, 19 nt, Homo sapiens
aggguuccccuggccuuaa

SEQ ID NO: 628830 - RNA, 17 nt, Homo sapiens
aggguuggaggcaaugu

SEQ ID NO: 628831 - RNA, 23 nt, Homo sapiens
aggguuuugccccaaguccucau

SEQ ID NO: 628832 - RNA, 21 nt, Homo sapiens
aggguuuuuuuuaaugugaau

SEQ ID NO: 628833 - RNA, 13 nt, Homo sapiens
agguaacaguuau

SEQ ID NO: 628834 - RNA, 19 nt, Homo sapiens
agguaacucuuugcacaua

SEQ ID NO: 628835 - RNA, 19 nt, Homo sapiens
agguaauccggagugagca

SEQ ID NO: 628836 - RNA, 17 nt, Homo sapiens
agguaauucuagccuuu

SEQ ID NO: 628837 - RNA, 14 nt, Homo sapiens
agguacaaguggcu

SEQ ID NO: 628838 - RNA, 15 nt, Homo sapiens
agguacacacuuuca

SEQ ID NO: 628839 - RNA, 18 nt, Homo sapiens
agguacagaaaacauguu

SEQ ID NO: 628840 - RNA, 12 nt, Homo sapiens
agguacauauuu

SEQ ID NO: 628841 - RNA, 21 nt, Homo sapiens
agguaccagcugcgcuugcuu

SEQ ID NO: 628842 - RNA, 17 nt, Homo sapiens
agguacgaugacagugu

SEQ ID NO: 628843 - RNA, 20 nt, Homo sapiens
agguacuauauuugcuagac

SEQ ID NO: 628844 - RNA, 18 nt, Homo sapiens
agguacugcuguguaaug

SEQ ID NO: 628845 - RNA, 14 nt, Homo sapiens
agguagagugguca

SEQ ID NO: 628846 - RNA, 21 nt, Homo sapiens
agguagcauucuuuggaguua

SEQ ID NO: 628847 - RNA, 14 nt, Homo sapiens
agguagccauccca

SEQ ID NO: 628848 - RNA, 16 nt, Homo sapiens
agguagccaucccaug

SEQ ID NO: 628849 - RNA, 17 nt, Homo sapiens
agguaggaucaucccac

SEQ ID NO: 628850 - RNA, 15 nt, Homo sapiens
agguagggacuggag

SEQ ID NO: 628851 - RNA, 15 nt, Homo sapiens
agguaguuuggauau

SEQ ID NO: 628852 - RNA, 17 nt, Homo sapiens
agguauaaugauacugc

SEQ ID NO: 628853 - RNA, 18 nt, Homo sapiens
agguaugcaaucaaaucu

SEQ ID NO: 628854 - RNA, 12 nt, Homo sapiens
agguaugcauuu

SEQ ID NO: 628855 - RNA, 21 nt, Homo sapiens
agguauggcagaggugcaaga

SEQ ID NO: 628856 - RNA, 16 nt, Homo sapiens
agguauggcucugcac

SEQ ID NO: 628857 - RNA, 23 nt, Homo sapiens
agguauuacacucuguaauugaa

SEQ ID NO: 628858 - RNA, 17 nt, Homo sapiens
aggucaaaaaucugucc

SEQ ID NO: 628859 - RNA, 16 nt, Homo sapiens
aggucaaggcugcagu

SEQ ID NO: 628860 - RNA, 14 nt, Homo sapiens
aggucaaguaagaa

SEQ ID NO: 628861 - RNA, 16 nt, Homo sapiens
aggucaauuuccugau

SEQ ID NO: 628862 - RNA, 18 nt, Homo sapiens
aggucaauuuccugaugc

SEQ ID NO: 628863 - RNA, 12 nt, Homo sapiens
aggucaccagcu

SEQ ID NO: 628864 - RNA, 17 nt, Homo sapiens
aggucacguguggaauu

SEQ ID NO: 628865 - RNA, 12 nt, Homo sapiens
aggucacuggaa

SEQ ID NO: 628866 - RNA, 13 nt, Homo sapiens
aggucaggacggc

SEQ ID NO: 628867 - RNA, 12 nt, Homo sapiens
aggucaggagau

SEQ ID NO: 628868 - RNA, 12 nt, Homo sapiens
aggucagugcuu

SEQ ID NO: 628869 - RNA, 22 nt, Homo sapiens
aggucagugcuucgugccucga

SEQ ID NO: 628870 - RNA, 17 nt, Homo sapiens
aggucaguuuagcaaga

SEQ ID NO: 628871 - RNA, 17 nt, Homo sapiens
aggucauuaaaauuaca

SEQ ID NO: 628872 - RNA, 23 nt, Homo sapiens
agguccaccgagccccugacccc

SEQ ID NO: 628873 - RNA, 11 nt, Homo sapiens
aggucccaagg

SEQ ID NO: 628874 - RNA, 15 nt, Homo sapiens
aggucccucagacau

SEQ ID NO: 628875 - RNA, 23 nt, Homo sapiens
aggucccuugucccaaguuccac

SEQ ID NO: 628876 - RNA, 17 nt, Homo sapiens
agguccuaaaguacugg

SEQ ID NO: 628877 - RNA, 16 nt, Homo sapiens
agguccuggugguauu

SEQ ID NO: 628878 - RNA, 17 nt, Homo sapiens
agguccugucucugcac

SEQ ID NO: 628879 - RNA, 20 nt, Homo sapiens
agguccuuaggccucugaga

SEQ ID NO: 628880 - RNA, 20 nt, Homo sapiens
agguccuuguuguuucuugc

SEQ ID NO: 628881 - RNA, 21 nt, Homo sapiens
aggucgaccccaaagccccuu

SEQ ID NO: 628882 - RNA, 15 nt, Homo sapiens
aggucgagacauucc

SEQ ID NO: 628883 - RNA, 17 nt, Homo sapiens
aggucgagacauuccug

SEQ ID NO: 628884 - RNA, 17 nt, Homo sapiens
aggucguuuuccaaaga

SEQ ID NO: 628885 - RNA, 20 nt, Homo sapiens
aggucucacgggcaugggca

SEQ ID NO: 628886 - RNA, 22 nt, Homo sapiens
aggucucauagguugagcaauu

SEQ ID NO: 628887 - RNA, 19 nt, Homo sapiens
aggucuccaaacugauuaa

SEQ ID NO: 628888 - RNA, 21 nt, Homo sapiens
aggucucgucccagcccuccc

SEQ ID NO: 628889 - RNA, 18 nt, Homo sapiens
aggucucucaacuucauc

SEQ ID NO: 628890 - RNA, 20 nt, Homo sapiens
aggucugcucugcuccugaa

SEQ ID NO: 628891 - RNA, 17 nt, Homo sapiens
aggucuggcggcuccau

SEQ ID NO: 628892 - RNA, 20 nt, Homo sapiens
aggucuguuuaaaguggcaa

SEQ ID NO: 628893 - RNA, 23 nt, Homo sapiens
aggucuugaauagauuuucucug

SEQ ID NO: 628894 - RNA, 20 nt, Homo sapiens
aggugaagucgagcacucua

SEQ ID NO: 628895 - RNA, 14 nt, Homo sapiens
aggugaauagcaca

SEQ ID NO: 628896 - RNA, 14 nt, Homo sapiens
aguaauacaaacua

SEQ ID NO: 628897 - RNA, 19 nt, Homo sapiens
aguaaucaauacagacaag

SEQ ID NO: 628898 - RNA, 19 nt, Homo sapiens
aguaaucaaucuacucaaa

SEQ ID NO: 628899 - RNA, 19 nt, Homo sapiens
aguaaucuaauauggccac

SEQ ID NO: 628900 - RNA, 21 nt, Homo sapiens
aguaaugaauuuuuaugauau

SEQ ID NO: 628901 - RNA, 20 nt, Homo sapiens
aguaauugccuagaaauauc

SEQ ID NO: 628902 - RNA, 19 nt, Homo sapiens
aguaauuguaauacaccaa

SEQ ID NO: 628903 - RNA, 16 nt, Homo sapiens
aguaauuguauuguca

SEQ ID NO: 628904 - RNA, 14 nt, Homo sapiens
aguaauugugacaa

SEQ ID NO: 628905 - RNA, 20 nt, Homo sapiens
aguacaaaacaaucucucaa

SEQ ID NO: 628906 - RNA, 17 nt, Homo sapiens
aguacaagagcuuaaca

SEQ ID NO: 628907 - RNA, 14 nt, Homo sapiens
aggagacauuggua

SEQ ID NO: 628908 - RNA, 15 nt, Homo sapiens
aggagacuagauugc

SEQ ID NO: 628909 - RNA, 18 nt, Homo sapiens
aggagagagugagugcau

SEQ ID NO: 628910 - RNA, 12 nt, Homo sapiens
aggagagccugg

SEQ ID NO: 628911 - RNA, 23 nt, Homo sapiens
aggagaggaaaaguaaggugcag

SEQ ID NO: 628912 - RNA, 16 nt, Homo sapiens
aggagaggacugggcc

SEQ ID NO: 628913 - RNA, 13 nt, Homo sapiens
aggagagucccag

SEQ ID NO: 628914 - RNA, 20 nt, Homo sapiens
aggagaucgacaccauccug

SEQ ID NO: 628915 - RNA, 21 nt, Homo sapiens
aggagaugaccagugccuugg

SEQ ID NO: 628916 - RNA, 13 nt, Homo sapiens
aggagaugugguc

SEQ ID NO: 628917 - RNA, 20 nt, Homo sapiens
aggagauguggucaauggaa

SEQ ID NO: 628918 - RNA, 15 nt, Homo sapiens
aggagauuccuuucc

SEQ ID NO: 628919 - RNA, 16 nt, Homo sapiens
aggagauuucaugccu

SEQ ID NO: 628920 - RNA, 20 nt, Homo sapiens
aggagccaaacauccuacaa

SEQ ID NO: 628921 - RNA, 19 nt, Homo sapiens
aggagccaacauaacagau

SEQ ID NO: 628922 - RNA, 18 nt, Homo sapiens
aggagccaccaguucuca

SEQ ID NO: 628923 - RNA, 15 nt, Homo sapiens
aggagccagccaggg

SEQ ID NO: 628924 - RNA, 22 nt, Homo sapiens
aggagccaggccuugggcuccu

SEQ ID NO: 628925 - RNA, 16 nt, Homo sapiens
aggagccgaccgggaa

SEQ ID NO: 628926 - RNA, 15 nt, Homo sapiens
aggagccggcugccu

SEQ ID NO: 628927 - RNA, 22 nt, Homo sapiens
aggagccucuggcuucccuaaa

SEQ ID NO: 628928 - RNA, 20 nt, Homo sapiens
aggagcuccccuguuugcau

SEQ ID NO: 628929 - RNA, 17 nt, Homo sapiens
aggagcugagguuucac

SEQ ID NO: 628930 - RNA, 23 nt, Homo sapiens
aggagcugauacuuugacagugu

SEQ ID NO: 628931 - RNA, 15 nt, Homo sapiens
aggagcuggacaccu

SEQ ID NO: 628932 - RNA, 13 nt, Homo sapiens
aggagcuguuacu

SEQ ID NO: 628933 - RNA, 13 nt, Homo sapiens
aggagcuuucuca

SEQ ID NO: 628934 - RNA, 22 nt, Homo sapiens
aggaggagaaaucucacuuuuc

SEQ ID NO: 628935 - RNA, 23 nt, Homo sapiens
aggaggagcaccuccgccagauc

SEQ ID NO: 628936 - RNA, 20 nt, Homo sapiens
aggaggcucccgaggggaag

SEQ ID NO: 628937 - RNA, 15 nt, Homo sapiens
aggaggcuggugaca

SEQ ID NO: 628938 - RNA, 22 nt, Homo sapiens
aggaggggccgcugccacccac

SEQ ID NO: 628939 - RNA, 20 nt, Homo sapiens
aggagggggacuaaacucaa

SEQ ID NO: 628940 - RNA, 23 nt, Homo sapiens
aggaggguguaauggagcaucaa

SEQ ID NO: 628941 - RNA, 20 nt, Homo sapiens
aggagguggaggcugcagug

SEQ ID NO: 628942 - RNA, 17 nt, Homo sapiens
aggaguacaaugcccag

SEQ ID NO: 628943 - RNA, 20 nt, Homo sapiens
aggaguacaaugcccagauc

SEQ ID NO: 628944 - RNA, 14 nt, Homo sapiens
aggaguaccuggac

SEQ ID NO: 628945 - RNA, 15 nt, Homo sapiens
aggagucaacuggcu

SEQ ID NO: 628946 - RNA, 15 nt, Homo sapiens
aggagucacugagac

SEQ ID NO: 628947 - RNA, 21 nt, Homo sapiens
aggagucccugguucauugau

SEQ ID NO: 628948 - RNA, 19 nt, Homo sapiens
aggagucgggagcacagcu

SEQ ID NO: 628949 - RNA, 19 nt, Homo sapiens
aggagucugaggacugucc

SEQ ID NO: 628950 - RNA, 19 nt, Homo sapiens
aggagugcaagcagcacuc

SEQ ID NO: 628951 - RNA, 19 nt, Homo sapiens
aggagugccaggaccagcc

SEQ ID NO: 628952 - RNA, 20 nt, Homo sapiens
aggagugggaaaacacugcc

SEQ ID NO: 628953 - RNA, 19 nt, Homo sapiens
aggaguguccucuucccuc

SEQ ID NO: 628954 - RNA, 21 nt, Homo sapiens
aggaguguccucuucccucuc

SEQ ID NO: 628955 - RNA, 18 nt, Homo sapiens
aggaguuugagaccaacc

SEQ ID NO: 628956 - RNA, 15 nt, Homo sapiens
aggauaacuugcuuu

SEQ ID NO: 628957 - RNA, 22 nt, Homo sapiens
aggauacgacaguacacuguca

SEQ ID NO: 628958 - RNA, 18 nt, Homo sapiens
aggauacuuuacaugguu

SEQ ID NO: 628959 - RNA, 23 nt, Homo sapiens
aggauagaagcugcagugguauu

SEQ ID NO: 628960 - RNA, 16 nt, Homo sapiens
aggauaucacauugga

SEQ ID NO: 628961 - RNA, 14 nt, Homo sapiens
aggauaucuuggcu

SEQ ID NO: 628962 - RNA, 13 nt, Homo sapiens
aggauauuaacaa

SEQ ID NO: 628963 - RNA, 18 nt, Homo sapiens
aggauauuaucuaccugu

SEQ ID NO: 628964 - RNA, 12 nt, Homo sapiens
aggaucaucucu

SEQ ID NO: 628965 - RNA, 18 nt, Homo sapiens
aggaucauuugagcccag

SEQ ID NO: 628966 - RNA, 18 nt, Homo sapiens
aggauccagugacaugau

SEQ ID NO: 628967 - RNA, 20 nt, Homo sapiens
aggauccagugacaugauuc

SEQ ID NO: 628968 - RNA, 19 nt, Homo sapiens
aggaucccugaucccauuu

SEQ ID NO: 628969 - RNA, 19 nt, Homo sapiens
aggaugaauguaugugcac

SEQ ID NO: 628970 - RNA, 20 nt, Homo sapiens
aggaugaauguaugugcacu

SEQ ID NO: 628971 - RNA, 18 nt, Homo sapiens
aggaugagaaugugaccu

SEQ ID NO: 628972 - RNA, 17 nt, Homo sapiens
aggaugaguuacuugaa

SEQ ID NO: 628973 - RNA, 12 nt, Homo sapiens
aggaugcacauu

SEQ ID NO: 628974 - RNA, 18 nt, Homo sapiens
aggaugcggcuuucucug

SEQ ID NO: 628975 - RNA, 17 nt, Homo sapiens
aggaugcuuguacauaa

SEQ ID NO: 628976 - RNA, 14 nt, Homo sapiens
aggauggagcugaa

SEQ ID NO: 628977 - RNA, 14 nt, Homo sapiens
aggauggcaaagag

SEQ ID NO: 628978 - RNA, 19 nt, Homo sapiens
aggaugggaaucaggcaug

SEQ ID NO: 628979 - RNA, 16 nt, Homo sapiens
aggaugggauguauuu

SEQ ID NO: 628980 - RNA, 21 nt, Homo sapiens
aggauguagagagaacaggug

SEQ ID NO: 628981 - RNA, 20 nt, Homo sapiens
aggaugucugagaccacuug

SEQ ID NO: 628982 - RNA, 11 nt, Homo sapiens
aggaugugaua

SEQ ID NO: 628983 - RNA, 12 nt, Homo sapiens
aggaugugauau

SEQ ID NO: 628984 - RNA, 19 nt, Homo sapiens
aggaugugauuguggaaug

SEQ ID NO: 628985 - RNA, 16 nt, Homo sapiens
aggauguuuuucauga

SEQ ID NO: 628986 - RNA, 15 nt, Homo sapiens
aggauuaaacacaca

SEQ ID NO: 628987 - RNA, 22 nt, Homo sapiens
aggauuaauaaagauggcacuu

SEQ ID NO: 628988 - RNA, 14 nt, Homo sapiens
aggauucagcuauu

SEQ ID NO: 628989 - RNA, 20 nt, Homo sapiens
aggauuccgucuucucucau

SEQ ID NO: 628990 - RNA, 18 nt, Homo sapiens
aggauuuuacagaaacgu

SEQ ID NO: 628991 - RNA, 16 nt, Homo sapiens
aggauuuuaccaaagc

SEQ ID NO: 628992 - RNA, 19 nt, Homo sapiens
aggauuuuugagcacaaaa

SEQ ID NO: 628993 - RNA, 16 nt, Homo sapiens
aggcaaaaaacucuua

SEQ ID NO: 628994 - RNA, 13 nt, Homo sapiens
aggcaaaaagaca

SEQ ID NO: 628995 - RNA, 20 nt, Homo sapiens
aggcaaaauugauauacuuu

SEQ ID NO: 628996 - RNA, 21 nt, Homo sapiens
aggcaaagacugcaguaucca

SEQ ID NO: 628997 - RNA, 13 nt, Homo sapiens
aggcaaaggcaga

SEQ ID NO: 628998 - RNA, 14 nt, Homo sapiens
aggcaaaguacaaa

SEQ ID NO: 628999 - RNA, 12 nt, Homo sapiens
aggcaacacugg

SEQ ID NO: 629000 - RNA, 15 nt, Homo sapiens
aggcaacauccaaaa

SEQ ID NO: 629001 - RNA, 12 nt, Homo sapiens
aggcaagcacuu

SEQ ID NO: 629002 - RNA, 19 nt, Homo sapiens
aggcaagccccucagcccu

SEQ ID NO: 629003 - RNA, 23 nt, Homo sapiens
aggcaaggaguuugagaccagcu

SEQ ID NO: 629004 - RNA, 19 nt, Homo sapiens
aggcaaggaugucugagac

SEQ ID NO: 629005 - RNA, 17 nt, Homo sapiens
aggcaagggauaacucu

SEQ ID NO: 629006 - RNA, 16 nt, Homo sapiens
aggcaagugguaggga

SEQ ID NO: 629007 - RNA, 18 nt, Homo sapiens
aggcaauccuaccuugcu

SEQ ID NO: 629008 - RNA, 21 nt, Homo sapiens
aggcaauuucaccaccaaaug

SEQ ID NO: 629009 - RNA, 18 nt, Homo sapiens
aggcacaacaguucucuu

SEQ ID NO: 629010 - RNA, 22 nt, Homo sapiens
aggcacacaccaccaugcucaa

SEQ ID NO: 629011 - RNA, 19 nt, Homo sapiens
aggcacagcugaguuauga

SEQ ID NO: 629012 - RNA, 12 nt, Homo sapiens
aggcacaucaau

SEQ ID NO: 629013 - RNA, 23 nt, Homo sapiens
aggcaccaccaggagcagcagcc

SEQ ID NO: 629014 - RNA, 18 nt, Homo sapiens
aggcaccaugcaaauguc

SEQ ID NO: 629015 - RNA, 18 nt, Homo sapiens
aggcaccucuuccuugau

SEQ ID NO: 629016 - RNA, 22 nt, Homo sapiens
aggcaccuggccugcugggaac

SEQ ID NO: 629017 - RNA, 15 nt, Homo sapiens
aggcacgaagcaauu

SEQ ID NO: 629018 - RNA, 19 nt, Homo sapiens
aggcacgcaccaccaugcc

SEQ ID NO: 629019 - RNA, 13 nt, Homo sapiens
aggcacgugccac

SEQ ID NO: 629020 - RNA, 14 nt, Homo sapiens
aggcacugcccuuu

SEQ ID NO: 629021 - RNA, 23 nt, Homo sapiens
aggcacuguggcccuucugucca

SEQ ID NO: 629022 - RNA, 18 nt, Homo sapiens
aggcacuguggcucugca

SEQ ID NO: 629023 - RNA, 14 nt, Homo sapiens
aggcagagaaucau

SEQ ID NO: 629024 - RNA, 19 nt, Homo sapiens
aggcagaguuugccuuccu

SEQ ID NO: 629025 - RNA, 21 nt, Homo sapiens
aggcagaguuugccuuccuuu

SEQ ID NO: 629026 - RNA, 18 nt, Homo sapiens
aggcagaucccacuugca

SEQ ID NO: 629027 - RNA, 19 nt, Homo sapiens
aggcagcacagugugugaa

SEQ ID NO: 629028 - RNA, 15 nt, Homo sapiens
aggcagcagugugag

SEQ ID NO: 629029 - RNA, 13 nt, Homo sapiens
aggcagccagacc

SEQ ID NO: 629030 - RNA, 15 nt, Homo sapiens
aggcagccagggcuu

SEQ ID NO: 629031 - RNA, 23 nt, Homo sapiens
aggcagcugcaggcgcucuccuc

SEQ ID NO: 629032 - RNA, 21 nt, Homo sapiens
aggcaggagaaucacuugaac

SEQ ID NO: 629033 - RNA, 21 nt, Homo sapiens
aggcagggccuugcccagaga

SEQ ID NO: 629034 - RNA, 15 nt, Homo sapiens
aggcaggucugcaag

SEQ ID NO: 629035 - RNA, 18 nt, Homo sapiens
aggcaguaccauucagga

SEQ ID NO: 629036 - RNA, 16 nt, Homo sapiens
aggcaguagaacucca

SEQ ID NO: 629037 - RNA, 22 nt, Homo sapiens
aggcaguauuauugagcucuau

SEQ ID NO: 629038 - RNA, 19 nt, Homo sapiens
aggcaguauuuuguguccu

SEQ ID NO: 629039 - RNA, 14 nt, Homo sapiens
aggcagucccggga

SEQ ID NO: 629040 - RNA, 18 nt, Homo sapiens
aggcagugauuagcacuu

SEQ ID NO: 629041 - RNA, 21 nt, Homo sapiens
aggcagugucuggaugaugcu

SEQ ID NO: 629042 - RNA, 22 nt, Homo sapiens
aggcauaagacccuaagccucc

SEQ ID NO: 629043 - RNA, 18 nt, Homo sapiens
aggcauacacacagcagu

SEQ ID NO: 629044 - RNA, 14 nt, Homo sapiens
aggcauaguuuuua

SEQ ID NO: 629045 - RNA, 19 nt, Homo sapiens
aggcauaugcacagucaag

SEQ ID NO: 629046 - RNA, 18 nt, Homo sapiens
aggcaugagccacugugc

SEQ ID NO: 629047 - RNA, 20 nt, Homo sapiens
aggcauggcggcgcaugccu

SEQ ID NO: 629048 - RNA, 15 nt, Homo sapiens
aggcaugggugcaag

SEQ ID NO: 629049 - RNA, 13 nt, Homo sapiens
aggaaacuugaaa

SEQ ID NO: 629050 - RNA, 23 nt, Homo sapiens
aggaaacuugaaaggucugagga

SEQ ID NO: 629051 - RNA, 16 nt, Homo sapiens
aggaaagcagcauucu

SEQ ID NO: 629052 - RNA, 19 nt, Homo sapiens
aggaaagccacaucuugcu

SEQ ID NO: 629053 - RNA, 13 nt, Homo sapiens
aggaaagggcaaa

SEQ ID NO: 629054 - RNA, 16 nt, Homo sapiens
aggaaagucacccaaa

SEQ ID NO: 629055 - RNA, 19 nt, Homo sapiens
aggaaaguuuacccaugaa

SEQ ID NO: 629056 - RNA, 15 nt, Homo sapiens
aggaaauaccaguuc

SEQ ID NO: 629057 - RNA, 22 nt, Homo sapiens
aggaaauaccaguucugggcaa

SEQ ID NO: 629058 - RNA, 15 nt, Homo sapiens
aggaaauacuuugca

SEQ ID NO: 629059 - RNA, 19 nt, Homo sapiens
aggaaauauacuuuuacaa

SEQ ID NO: 629060 - RNA, 15 nt, Homo sapiens
aggaaauauuuccau

SEQ ID NO: 629061 - RNA, 19 nt, Homo sapiens
aggaaauggcuuugugauu

SEQ ID NO: 629062 - RNA, 12 nt, Homo sapiens
aggaaauggugg

SEQ ID NO: 629063 - RNA, 14 nt, Homo sapiens
aggaacaaagacag

SEQ ID NO: 629064 - RNA, 20 nt, Homo sapiens
aggaacaauaaaaugucuuc

SEQ ID NO: 629065 - RNA, 14 nt, Homo sapiens
aggaacacugcacu

SEQ ID NO: 629066 - RNA, 13 nt, Homo sapiens
aauuggcucuagu

SEQ ID NO: 629067 - RNA, 16 nt, Homo sapiens
aauuggcuuuucauag

SEQ ID NO: 629068 - RNA, 19 nt, Homo sapiens
aauuggcuuuucauagugc

SEQ ID NO: 629069 - RNA, 24 nt, Homo sapiens
aauuggcuuuucauagugcucaga

SEQ ID NO: 629070 - RNA, 19 nt, Homo sapiens
aauugggauaaacaucaca

SEQ ID NO: 629071 - RNA, 22 nt, Homo sapiens
aauugguaaaacucacugugau

SEQ ID NO: 629072 - RNA, 20 nt, Homo sapiens
aauuguaaaauuuaaaucau

SEQ ID NO: 629073 - RNA, 21 nt, Homo sapiens
aauuguaauuccaaaauccaa

SEQ ID NO: 629074 - RNA, 13 nt, Homo sapiens
aauuguacugaau

SEQ ID NO: 629075 - RNA, 13 nt, Homo sapiens
aauuguccguguu

SEQ ID NO: 629076 - RNA, 15 nt, Homo sapiens
aauugucuacauuca

SEQ ID NO: 629077 - RNA, 17 nt, Homo sapiens
aauugucuuaaaaccag

SEQ ID NO: 629078 - RNA, 12 nt, Homo sapiens
aauugucuugca

SEQ ID NO: 629079 - RNA, 17 nt, Homo sapiens
aauugugaucagaccau

SEQ ID NO: 629080 - RNA, 16 nt, Homo sapiens
aauugugcaguacuuu

SEQ ID NO: 629081 - RNA, 18 nt, Homo sapiens
aauugugugucacaagaa

SEQ ID NO: 629082 - RNA, 20 nt, Homo sapiens
aauuguucaucgcugcugga

SEQ ID NO: 629083 - RNA, 21 nt, Homo sapiens
aauuguugacaguucugaaga

SEQ ID NO: 629084 - RNA, 18 nt, Homo sapiens
aauuguuuaccauagaaa

SEQ ID NO: 629085 - RNA, 22 nt, Homo sapiens
aauuguuuauacacaacuuugc

SEQ ID NO: 629086 - RNA, 19 nt, Homo sapiens
aauuguuucuugacaagcu

SEQ ID NO: 629087 - RNA, 16 nt, Homo sapiens
aauuguuuugagcuuu

SEQ ID NO: 629088 - RNA, 15 nt, Homo sapiens
aauuguuuugcacuu

SEQ ID NO: 629089 - RNA, 22 nt, Homo sapiens
aauuguuuuuguacaguuauca

SEQ ID NO: 629090 - RNA, 20 nt, Homo sapiens
aauuguuuuuuaaagcaagu

SEQ ID NO: 629091 - RNA, 22 nt, Homo sapiens
aauuguuuuuuaaagcaaguca

SEQ ID NO: 629092 - RNA, 17 nt, Homo sapiens
aauuguuuuuugcucuu

SEQ ID NO: 629093 - RNA, 22 nt, Homo sapiens
aauuuaaaagacacuguuuaca

SEQ ID NO: 629094 - RNA, 18 nt, Homo sapiens
aauuuaaagggaaaaccc

SEQ ID NO: 629095 - RNA, 18 nt, Homo sapiens
aauuuaaaggguguacuu

SEQ ID NO: 629096 - RNA, 20 nt, Homo sapiens
aguaaauugacguacuugca

SEQ ID NO: 629097 - RNA, 14 nt, Homo sapiens
aguaacaguuguga

SEQ ID NO: 629098 - RNA, 22 nt, Homo sapiens
aguaacaugaggggacauuuug

SEQ ID NO: 629099 - RNA, 15 nt, Homo sapiens
aguaacauguguuaa

SEQ ID NO: 629100 - RNA, 21 nt, Homo sapiens
aguaacauuaacucaguggaa

SEQ ID NO: 629101 - RNA, 14 nt, Homo sapiens
aguaacauuugccu

SEQ ID NO: 629102 - RNA, 18 nt, Homo sapiens
aguaaccaaaacagcaua

SEQ ID NO: 629103 - RNA, 12 nt, Homo sapiens
aguaacugugac

SEQ ID NO: 629104 - RNA, 20 nt, Homo sapiens
aguaacuuucaaccuugcca

SEQ ID NO: 629105 - RNA, 19 nt, Homo sapiens
aguaagaguacugggagaa

SEQ ID NO: 629106 - RNA, 18 nt, Homo sapiens
aguaagcauuuccagccu

SEQ ID NO: 629107 - RNA, 11 nt, Homo sapiens
aguaagcccuu

SEQ ID NO: 629108 - RNA, 12 nt, Homo sapiens
aguaagccucau

SEQ ID NO: 629109 - RNA, 15 nt, Homo sapiens
aguaagccucaucau

SEQ ID NO: 629110 - RNA, 14 nt, Homo sapiens
aguaaguaaagugg

SEQ ID NO: 629111 - RNA, 13 nt, Homo sapiens
aguaagugcuuuu

SEQ ID NO: 629112 - RNA, 22 nt, Homo sapiens
aguaaguuugauuucauuaaua

SEQ ID NO: 629113 - RNA, 17 nt, Homo sapiens
aguaauaagauggcugu

SEQ ID NO: 629114 - RNA, 22 nt, Homo sapiens
aguaauagauuguuuugccacu

SEQ ID NO: 629115 - RNA, 19 nt, Homo sapiens
aguaauauagcugagacua

SEQ ID NO: 629116 - RNA, 13 nt, Homo sapiens
aguaaucaggcag

SEQ ID NO: 629117 - RNA, 18 nt, Homo sapiens
aguaaucuguguacaaag

SEQ ID NO: 629118 - RNA, 21 nt, Homo sapiens
aguaaugccacacauugugcu

SEQ ID NO: 629119 - RNA, 16 nt, Homo sapiens
aguaauuucaguguaa

SEQ ID NO: 629120 - RNA, 18 nt, Homo sapiens
aguacaaacacaggauuu

SEQ ID NO: 629121 - RNA, 22 nt, Homo sapiens
aguacaaacaugaaaaacaaac

SEQ ID NO: 629122 - RNA, 15 nt, Homo sapiens
aguacagaaaaauac

SEQ ID NO: 629123 - RNA, 14 nt, Homo sapiens
aguacagauaugaa

SEQ ID NO: 629124 - RNA, 18 nt, Homo sapiens
aguacagugagccaagau

SEQ ID NO: 629125 - RNA, 15 nt, Homo sapiens
aguacaucucuacua

SEQ ID NO: 629126 - RNA, 16 nt, Homo sapiens
aguacauuaaaacacu

SEQ ID NO: 629127 - RNA, 14 nt, Homo sapiens
aguaccacacugag

SEQ ID NO: 629128 - RNA, 20 nt, Homo sapiens
aguaccauuaaaaccagaaa

SEQ ID NO: 629129 - RNA, 15 nt, Homo sapiens
aguacccuuucaaac

SEQ ID NO: 629130 - RNA, 14 nt, Homo sapiens
aguaccuucaauac

SEQ ID NO: 629131 - RNA, 21 nt, Homo sapiens
aguaccuugcuucuuacugau

SEQ ID NO: 629132 - RNA, 14 nt, Homo sapiens
aguacguugugcau

SEQ ID NO: 629133 - RNA, 19 nt, Homo sapiens
aguacucacuuuucacuug

SEQ ID NO: 629134 - RNA, 15 nt, Homo sapiens
aguacuccugcaaaa

SEQ ID NO: 629135 - RNA, 17 nt, Homo sapiens
aguacugacuuucugau

SEQ ID NO: 629136 - RNA, 15 nt, Homo sapiens
aguacuggcacaaaa

SEQ ID NO: 629137 - RNA, 18 nt, Homo sapiens
aguacugguugacuuucu

SEQ ID NO: 629138 - RNA, 15 nt, Homo sapiens
aguacuuuaccuccu

SEQ ID NO: 629139 - RNA, 14 nt, Homo sapiens
aguacuuuauugca

SEQ ID NO: 629140 - RNA, 19 nt, Homo sapiens
aguagaaacgggguuucac

SEQ ID NO: 629141 - RNA, 20 nt, Homo sapiens
aguagaaacgggguuucacc

SEQ ID NO: 629142 - RNA, 13 nt, Homo sapiens
aguagaagggaaa

SEQ ID NO: 629143 - RNA, 23 nt, Homo sapiens
aguagaaguuacuuaauugccag

SEQ ID NO: 629144 - RNA, 13 nt, Homo sapiens
aguagaauuuuag

SEQ ID NO: 629145 - RNA, 18 nt, Homo sapiens
aguagacuauaagcagaa

SEQ ID NO: 629146 - RNA, 18 nt, Homo sapiens
aguagagcaaaucuauga

SEQ ID NO: 629147 - RNA, 17 nt, Homo sapiens
aguagaggcaugaugau

SEQ ID NO: 629148 - RNA, 16 nt, Homo sapiens
aguagaggcuauggac

SEQ ID NO: 629149 - RNA, 16 nt, Homo sapiens
aguagauucuuacaag

SEQ ID NO: 629150 - RNA, 19 nt, Homo sapiens
aguagcaaguucuagagaa

SEQ ID NO: 629151 - RNA, 12 nt, Homo sapiens
aguagcaauuuc

SEQ ID NO: 629152 - RNA, 16 nt, Homo sapiens
aguagcagugucugua

SEQ ID NO: 629153 - RNA, 17 nt, Homo sapiens
aguagcauuuuucuaaa

SEQ ID NO: 629154 - RNA, 23 nt, Homo sapiens
aguagcguuuuuuaaauguauac

SEQ ID NO: 629155 - RNA, 15 nt, Homo sapiens
aguaggauccaguga

SEQ ID NO: 629156 - RNA, 16 nt, Homo sapiens
aguaggcacuaaauac

SEQ ID NO: 629157 - RNA, 14 nt, Homo sapiens
aguagggggagcaa

SEQ ID NO: 629158 - RNA, 13 nt, Homo sapiens
aguaggucuggga

SEQ ID NO: 629159 - RNA, 20 nt, Homo sapiens
aguagucauacucccuggug

SEQ ID NO: 629160 - RNA, 21 nt, Homo sapiens
aguagugacacacagacucua

SEQ ID NO: 629161 - RNA, 19 nt, Homo sapiens
aguauaaaugaauuugcau

SEQ ID NO: 629162 - RNA, 15 nt, Homo sapiens
aguauaacaacuuug

SEQ ID NO: 629163 - RNA, 22 nt, Homo sapiens
aguauaauuguguugauucuuu

SEQ ID NO: 629164 - RNA, 15 nt, Homo sapiens
aguauacaacugccu

SEQ ID NO: 629165 - RNA, 14 nt, Homo sapiens
aguauacucagcua

SEQ ID NO: 629166 - RNA, 12 nt, Homo sapiens
aguauacugugu

SEQ ID NO: 629167 - RNA, 22 nt, Homo sapiens
aguauagcuuuauacucucucc

SEQ ID NO: 629168 - RNA, 16 nt, Homo sapiens
aguauauuaauaucau

SEQ ID NO: 629169 - RNA, 20 nt, Homo sapiens
aguauauucuuugguuguga

SEQ ID NO: 629170 - RNA, 21 nt, Homo sapiens
aguauauuuuccucccaguuc

SEQ ID NO: 629171 - RNA, 24 nt, Homo sapiens
aguauauuuuugucugcagcuguu

SEQ ID NO: 629172 - RNA, 18 nt, Homo sapiens
aguaucagaauacuugca

SEQ ID NO: 629173 - RNA, 17 nt, Homo sapiens
aguauccacaggauauu

SEQ ID NO: 629174 - RNA, 16 nt, Homo sapiens
aguauccaggcuuugu

SEQ ID NO: 629175 - RNA, 12 nt, Homo sapiens
aguauccaguca

SEQ ID NO: 629176 - RNA, 15 nt, Homo sapiens
aguaucccacaucca

SEQ ID NO: 629177 - RNA, 16 nt, Homo sapiens
aguaucccuacuguaa

SEQ ID NO: 629178 - RNA, 21 nt, Homo sapiens
aguaucuaccuggaaacagcu

SEQ ID NO: 629179 - RNA, 13 nt, Homo sapiens
aguaucuauuucu

SEQ ID NO: 629180 - RNA, 16 nt, Homo sapiens
aguaucuccaagggua

SEQ ID NO: 629181 - RNA, 23 nt, Homo sapiens
aguaucuguauguauauauacac

SEQ ID NO: 629182 - RNA, 12 nt, Homo sapiens
aguaucuuaccu

SEQ ID NO: 629183 - RNA, 19 nt, Homo sapiens
aguaugaauauuacucuca

SEQ ID NO: 629184 - RNA, 15 nt, Homo sapiens
aguaugaaugcagug

SEQ ID NO: 629185 - RNA, 12 nt, Homo sapiens
aguaugccuuaa

SEQ ID NO: 629186 - RNA, 18 nt, Homo sapiens
aguaugccuuaagcagaa

SEQ ID NO: 629187 - RNA, 18 nt, Homo sapiens
aguauggcaugaacaucu

SEQ ID NO: 629188 - RNA, 14 nt, Homo sapiens
agucguggaaucaa

SEQ ID NO: 629189 - RNA, 18 nt, Homo sapiens
agucguggggugugcugg

SEQ ID NO: 629190 - RNA, 17 nt, Homo sapiens
agucguucccagugugg

SEQ ID NO: 629191 - RNA, 13 nt, Homo sapiens
agucuaaaacaca

SEQ ID NO: 629192 - RNA, 16 nt, Homo sapiens
agucuaaacuguuaaa

SEQ ID NO: 629193 - RNA, 13 nt, Homo sapiens
agucuagccuugu

SEQ ID NO: 629194 - RNA, 18 nt, Homo sapiens
agucuaggcuaagcacuu

SEQ ID NO: 629195 - RNA, 19 nt, Homo sapiens
agucuaggcuaagcacuuu

SEQ ID NO: 629196 - RNA, 13 nt, Homo sapiens
agucucaccuuca

SEQ ID NO: 629197 - RNA, 23 nt, Homo sapiens
agucucacugugggaaggccagc

SEQ ID NO: 629198 - RNA, 13 nt, Homo sapiens
agucucacuuugg

SEQ ID NO: 629199 - RNA, 14 nt, Homo sapiens
agucucagucugau

SEQ ID NO: 629200 - RNA, 15 nt, Homo sapiens
agucucauagguuaa

SEQ ID NO: 629201 - RNA, 23 nt, Homo sapiens
agucuccacgccgucagcugaga

SEQ ID NO: 629202 - RNA, 16 nt, Homo sapiens
agucuccccacuccac

SEQ ID NO: 629203 - RNA, 20 nt, Homo sapiens
agucucugaauacacaguau

SEQ ID NO: 629204 - RNA, 20 nt, Homo sapiens
agucucugaguccuuugcua

SEQ ID NO: 629205 - RNA, 20 nt, Homo sapiens
agucucugauacacaguaau

SEQ ID NO: 629206 - RNA, 16 nt, Homo sapiens
agucucuggaaaaaga

SEQ ID NO: 629207 - RNA, 18 nt, Homo sapiens
agucucugugcuuugacu

SEQ ID NO: 629208 - RNA, 13 nt, Homo sapiens
agucucuucugau

SEQ ID NO: 629209 - RNA, 19 nt, Homo sapiens
agucucuuguacagcguuu

SEQ ID NO: 629210 - RNA, 23 nt, Homo sapiens
agucugaaagacagaaugucacc

SEQ ID NO: 629211 - RNA, 22 nt, Homo sapiens
agucugagacuccucauaccuc

SEQ ID NO: 629212 - RNA, 15 nt, Homo sapiens
agucugagcuucuuu

SEQ ID NO: 629213 - RNA, 18 nt, Homo sapiens
agucugaggccugaguga

SEQ ID NO: 629214 - RNA, 13 nt, Homo sapiens
agucugauuuaau

SEQ ID NO: 629215 - RNA, 13 nt, Homo sapiens
agucugcaaaaug

SEQ ID NO: 629216 - RNA, 19 nt, Homo sapiens
agucugccacuugucaaag

SEQ ID NO: 629217 - RNA, 21 nt, Homo sapiens
agucugccacuugucaaagaa

SEQ ID NO: 629218 - RNA, 23 nt, Homo sapiens
agucugcccacgcagaggacgca

SEQ ID NO: 629219 - RNA, 14 nt, Homo sapiens
agucugcuuagaaa

SEQ ID NO: 629220 - RNA, 21 nt, Homo sapiens
agucuggaaaacagaaaccau

SEQ ID NO: 629221 - RNA, 16 nt, Homo sapiens
agucuggccacuguca

SEQ ID NO: 629222 - RNA, 17 nt, Homo sapiens
acaaaauucaaagcaug

SEQ ID NO: 629223 - RNA, 22 nt, Homo sapiens
acaaacaaaaaacccauguguu

SEQ ID NO: 629224 - RNA, 15 nt, Homo sapiens
acaaacaaacagaaa

SEQ ID NO: 629225 - RNA, 21 nt, Homo sapiens
acaaacauuugcugaauagcu

SEQ ID NO: 629226 - RNA, 20 nt, Homo sapiens
acaaacccguuuuaugauuu

SEQ ID NO: 629227 - RNA, 18 nt, Homo sapiens
acaaaccgagugcaauga

SEQ ID NO: 629228 - RNA, 21 nt, Homo sapiens
acaaaccgagugcaaugaaug

SEQ ID NO: 629229 - RNA, 16 nt, Homo sapiens
acaaaccuaccaaaau

SEQ ID NO: 629230 - RNA, 16 nt, Homo sapiens
acaaaccucacugaga

SEQ ID NO: 629231 - RNA, 23 nt, Homo sapiens
acaaaccuugggaagauguauca

SEQ ID NO: 629232 - RNA, 18 nt, Homo sapiens
acaaacggagccccugaa

SEQ ID NO: 629233 - RNA, 16 nt, Homo sapiens
acaaacuacauguaau

SEQ ID NO: 629234 - RNA, 19 nt, Homo sapiens
acaaacucauucauuaguc

SEQ ID NO: 629235 - RNA, 23 nt, Homo sapiens
acaaacuccugaaaugccaagug

SEQ ID NO: 629236 - RNA, 13 nt, Homo sapiens
acaaacucucacc

SEQ ID NO: 629237 - RNA, 11 nt, Homo sapiens
acaaacugcaa

SEQ ID NO: 629238 - RNA, 18 nt, Homo sapiens
acaaacugcagcugugag

SEQ ID NO: 629239 - RNA, 15 nt, Homo sapiens
acaaacuucaaagag

SEQ ID NO: 629240 - RNA, 20 nt, Homo sapiens
acaaagaaaaaaaaucuuau

SEQ ID NO: 629241 - RNA, 15 nt, Homo sapiens
acaaagacuaccuga

SEQ ID NO: 629242 - RNA, 17 nt, Homo sapiens
acaaagcacaguuugaa

SEQ ID NO: 629243 - RNA, 22 nt, Homo sapiens
acaaagcaggaguggaagguga

SEQ ID NO: 629244 - RNA, 19 nt, Homo sapiens
acaaagcaguuacuaauau

SEQ ID NO: 629245 - RNA, 14 nt, Homo sapiens
acaaagcauuuuca

SEQ ID NO: 629246 - RNA, 19 nt, Homo sapiens
acaaagcucaaaguaugca

SEQ ID NO: 629247 - RNA, 19 nt, Homo sapiens
acaaaggacagaguaugaa

SEQ ID NO: 629248 - RNA, 24 nt, Homo sapiens
acaaaggagagcuagcagcaggga

SEQ ID NO: 629249 - RNA, 18 nt, Homo sapiens
acaaaggcugaugucuua

SEQ ID NO: 629250 - RNA, 20 nt, Homo sapiens
acaaagggacuuuggaaaac

SEQ ID NO: 629251 - RNA, 17 nt, Homo sapiens
acaaagggcacuuagca

SEQ ID NO: 629252 - RNA, 17 nt, Homo sapiens
acaaagggccagcaguc

SEQ ID NO: 629253 - RNA, 14 nt, Homo sapiens
acaaaggugaaaau

SEQ ID NO: 629254 - RNA, 20 nt, Homo sapiens
acaaaguagaggaauccaug

SEQ ID NO: 629255 - RNA, 19 nt, Homo sapiens
acaaaguccacuuuacuca

SEQ ID NO: 629256 - RNA, 17 nt, Homo sapiens
acaaaguguguauuaaa

SEQ ID NO: 629257 - RNA, 23 nt, Homo sapiens
acaaaguuacugauucacugcau

SEQ ID NO: 629258 - RNA, 16 nt, Homo sapiens
acaaauaaaaaauuca

SEQ ID NO: 629259 - RNA, 15 nt, Homo sapiens
acaaauaaauguuca

SEQ ID NO: 629260 - RNA, 19 nt, Homo sapiens
acaaauacuaaaugugcaa

SEQ ID NO: 629261 - RNA, 22 nt, Homo sapiens
acaaauacuugacucagugaua

SEQ ID NO: 629262 - RNA, 22 nt, Homo sapiens
acaaauaggagugaguguaugu

SEQ ID NO: 629263 - RNA, 16 nt, Homo sapiens
acaaauagucuaucaa

SEQ ID NO: 629264 - RNA, 17 nt, Homo sapiens
acaaauauucucucugu

SEQ ID NO: 629265 - RNA, 14 nt, Homo sapiens
acaaauauugucau

SEQ ID NO: 629266 - RNA, 19 nt, Homo sapiens
acaaaucaacagaagcauu

SEQ ID NO: 629267 - RNA, 21 nt, Homo sapiens
acaaaucucaaaguguacaaa

SEQ ID NO: 629268 - RNA, 12 nt, Homo sapiens
acaaaucuucac

SEQ ID NO: 629269 - RNA, 22 nt, Homo sapiens
acaaaucuuuuucuauauucuc

SEQ ID NO: 629270 - RNA, 21 nt, Homo sapiens
acaaaugaucgcuaucuagca

SEQ ID NO: 629271 - RNA, 18 nt, Homo sapiens
acaaaugguagcauacuu

SEQ ID NO: 629272 - RNA, 21 nt, Homo sapiens
acaaaugguggguacaaaaag

SEQ ID NO: 629273 - RNA, 22 nt, Homo sapiens
acaaaugucuaucaacuuuaau

SEQ ID NO: 629274 - RNA, 18 nt, Homo sapiens
acaaauuaagauguucag

SEQ ID NO: 629275 - RNA, 24 nt, Homo sapiens
acaaauuagccauuucacucucaa

SEQ ID NO: 629276 - RNA, 16 nt, Homo sapiens
acaaauuauaagcaua

SEQ ID NO: 629277 - RNA, 14 nt, Homo sapiens
acaaauucaaauaa

SEQ ID NO: 629278 - RNA, 16 nt, Homo sapiens
acaaauuuuucaaauc

SEQ ID NO: 629279 - RNA, 21 nt, Homo sapiens
acaaauuuuucaaaucauucc

SEQ ID NO: 629280 - RNA, 15 nt, Homo sapiens
acaacaaaaaccaaa

SEQ ID NO: 629281 - RNA, 20 nt, Homo sapiens
acaacaacauguaccuguau

SEQ ID NO: 629282 - RNA, 22 nt, Homo sapiens
acaacaacgagauaccaucuca

SEQ ID NO: 629283 - RNA, 16 nt, Homo sapiens
acaacacuuaauagca

SEQ ID NO: 629284 - RNA, 13 nt, Homo sapiens
acaacagagugaa

SEQ ID NO: 629285 - RNA, 22 nt, Homo sapiens
acaacagcaaaacuccaucuca

SEQ ID NO: 629286 - RNA, 20 nt, Homo sapiens
acaacagguaaaacagggcc

SEQ ID NO: 629287 - RNA, 13 nt, Homo sapiens
acaacagugaaaa

SEQ ID NO: 629288 - RNA, 19 nt, Homo sapiens
acaacaguucugagcugua

SEQ ID NO: 629289 - RNA, 13 nt, Homo sapiens
acaacauaucuca

SEQ ID NO: 629290 - RNA, 14 nt, Homo sapiens
acaacaucgcaaua

SEQ ID NO: 629291 - RNA, 19 nt, Homo sapiens
acaacaugcgaccgugacc

SEQ ID NO: 629292 - RNA, 17 nt, Homo sapiens
acaacauuauaacugua

SEQ ID NO: 629293 - RNA, 17 nt, Homo sapiens
acaacauuguagccuca

SEQ ID NO: 629294 - RNA, 14 nt, Homo sapiens
acaacauuuacuua

SEQ ID NO: 629295 - RNA, 22 nt, Homo sapiens
acaacauuucucaaaugcacau

SEQ ID NO: 629296 - RNA, 22 nt, Homo sapiens
acaaccaacagaaaacauccca

SEQ ID NO: 629297 - RNA, 21 nt, Homo sapiens
acaacccacaccgucuuccuu

SEQ ID NO: 629298 - RNA, 22 nt, Homo sapiens
acaacccaggcaguaccauuca

SEQ ID NO: 629299 - RNA, 17 nt, Homo sapiens
acaaccgguaaccaaag

SEQ ID NO: 629300 - RNA, 17 nt, Homo sapiens
acaaccugaauguccca

SEQ ID NO: 629301 - RNA, 18 nt, Homo sapiens
acaaccugaaugucccaa

SEQ ID NO: 629302 - RNA, 12 nt, Homo sapiens
acaaccuugucc

SEQ ID NO: 629303 - RNA, 20 nt, Homo sapiens
acaacgagauaccaucucac

SEQ ID NO: 629304 - RNA, 22 nt, Homo sapiens
acaacgccugucacagaguaga

SEQ ID NO: 629305 - RNA, 22 nt, Homo sapiens
acaacucccuuaaggucuccaa

SEQ ID NO: 629306 - RNA, 15 nt, Homo sapiens
acaacuccuauucac

SEQ ID NO: 629307 - RNA, 16 nt, Homo sapiens
acaacucggggacaaa

SEQ ID NO: 629308 - RNA, 14 nt, Homo sapiens
acaacugugugauu

SEQ ID NO: 629309 - RNA, 17 nt, Homo sapiens
aguguggcagugaccau

SEQ ID NO: 629310 - RNA, 17 nt, Homo sapiens
aguguggccaggcugcc

SEQ ID NO: 629311 - RNA, 18 nt, Homo sapiens
aguguggccugugccagc

SEQ ID NO: 629312 - RNA, 23 nt, Homo sapiens
aguguguaaauaauuugcacuga

SEQ ID NO: 629313 - RNA, 15 nt, Homo sapiens
aguguguaugugcau

SEQ ID NO: 629314 - RNA, 13 nt, Homo sapiens
agugugugcacau

SEQ ID NO: 629315 - RNA, 18 nt, Homo sapiens
agugugugcuuacaguaa

SEQ ID NO: 629316 - RNA, 22 nt, Homo sapiens
agugugugugcuugaaugugag

SEQ ID NO: 629317 - RNA, 18 nt, Homo sapiens
aguguguguuuaacauuc

SEQ ID NO: 629318 - RNA, 19 nt, Homo sapiens
aguguuaagcguucaguga

SEQ ID NO: 629319 - RNA, 22 nt, Homo sapiens
aguguuaucagucauaacuaaa

SEQ ID NO: 629320 - RNA, 12 nt, Homo sapiens
aguguuauugca

SEQ ID NO: 629321 - RNA, 19 nt, Homo sapiens
aguguucaaauaccaguga

SEQ ID NO: 629322 - RNA, 10 nt, Homo sapiens
aguguucacu

SEQ ID NO: 629323 - RNA, 22 nt, Homo sapiens
aguguucaugcuuuguaccaaa

SEQ ID NO: 629324 - RNA, 15 nt, Homo sapiens
aguguuccauuugaa

SEQ ID NO: 629325 - RNA, 19 nt, Homo sapiens
aguguuccccaucuggguc

SEQ ID NO: 629326 - RNA, 20 nt, Homo sapiens
aguguuccccgauaccaugc

SEQ ID NO: 629327 - RNA, 13 nt, Homo sapiens
aguguucccugac

SEQ ID NO: 629328 - RNA, 12 nt, Homo sapiens
aguguugcuugg

SEQ ID NO: 629329 - RNA, 17 nt, Homo sapiens
aguguuguggacacugc

SEQ ID NO: 629330 - RNA, 22 nt, Homo sapiens
aguguuuacaaggugacaaaug

SEQ ID NO: 629331 - RNA, 12 nt, Homo sapiens
aguguuuuggag

SEQ ID NO: 629332 - RNA, 21 nt, Homo sapiens
aguuaaaagccuaccuaagca

SEQ ID NO: 629333 - RNA, 21 nt, Homo sapiens
aguuaaauagaguauaugcac

SEQ ID NO: 629334 - RNA, 20 nt, Homo sapiens
aguuaaccccauguccucag

SEQ ID NO: 629335 - RNA, 21 nt, Homo sapiens
aguuaacccugucugagaugc

SEQ ID NO: 629336 - RNA, 14 nt, Homo sapiens
aguuaagauauccc

SEQ ID NO: 629337 - RNA, 19 nt, Homo sapiens
aguuaaggauuguuuuaaa

SEQ ID NO: 629338 - RNA, 13 nt, Homo sapiens
aguuaagugugga

SEQ ID NO: 629339 - RNA, 15 nt, Homo sapiens
aguuaauaacagcuc

SEQ ID NO: 629340 - RNA, 16 nt, Homo sapiens
aguuaauccacaucuu

SEQ ID NO: 629341 - RNA, 17 nt, Homo sapiens
aguuaaugucagugaca

SEQ ID NO: 629342 - RNA, 15 nt, Homo sapiens
aguuaauucaccuau

SEQ ID NO: 629343 - RNA, 20 nt, Homo sapiens
aguuaauucucaccauuccu

SEQ ID NO: 629344 - RNA, 16 nt, Homo sapiens
aguuacaaacagacca

SEQ ID NO: 629345 - RNA, 13 nt, Homo sapiens
aguuacuacugau

SEQ ID NO: 629346 - RNA, 11 nt, Homo sapiens
aguuacucagg

SEQ ID NO: 629347 - RNA, 17 nt, Homo sapiens
acaccagcaaugaagga

SEQ ID NO: 629348 - RNA, 20 nt, Homo sapiens
acaccagcagcccugucacg

SEQ ID NO: 629349 - RNA, 16 nt, Homo sapiens
acaccagcccagcucc

SEQ ID NO: 629350 - RNA, 17 nt, Homo sapiens
acaccagggaugguacu

SEQ ID NO: 629351 - RNA, 11 nt, Homo sapiens
acaccaucucc

SEQ ID NO: 629352 - RNA, 17 nt, Homo sapiens
acaccaugauuaaccac

SEQ ID NO: 629353 - RNA, 21 nt, Homo sapiens
acaccauuuuggcaagcucua

SEQ ID NO: 629354 - RNA, 23 nt, Homo sapiens
acaccauuuuggcaagcucuauc

SEQ ID NO: 629355 - RNA, 12 nt, Homo sapiens
acacccaaaaau

SEQ ID NO: 629356 - RNA, 14 nt, Homo sapiens
acacccaagaagaa

SEQ ID NO: 629357 - RNA, 23 nt, Homo sapiens
acacccacugccccgugugaaug

SEQ ID NO: 629358 - RNA, 17 nt, Homo sapiens
acacccagcaauagaga

SEQ ID NO: 629359 - RNA, 18 nt, Homo sapiens
acacccaggucucuuccu

SEQ ID NO: 629360 - RNA, 17 nt, Homo sapiens
acacccaugccagagag

SEQ ID NO: 629361 - RNA, 14 nt, Homo sapiens
acaccccacaggca

SEQ ID NO: 629362 - RNA, 19 nt, Homo sapiens
acacccccgacggccucca

SEQ ID NO: 629363 - RNA, 16 nt, Homo sapiens
acacccuuucuugaca

SEQ ID NO: 629364 - RNA, 16 nt, Homo sapiens
acaccgcucaguauua

SEQ ID NO: 629365 - RNA, 16 nt, Homo sapiens
acaccgcugcacucaa

SEQ ID NO: 629366 - RNA, 23 nt, Homo sapiens
acaccguguaaaccaaagcccua

SEQ ID NO: 629367 - RNA, 21 nt, Homo sapiens
acaccuacaugaaaagcagaa

SEQ ID NO: 629368 - RNA, 15 nt, Homo sapiens
acaccuagcuuuauu

SEQ ID NO: 629369 - RNA, 16 nt, Homo sapiens
acaccucaguucccuu

SEQ ID NO: 629370 - RNA, 19 nt, Homo sapiens
acaccuccaaugcugccug

SEQ ID NO: 629371 - RNA, 23 nt, Homo sapiens
acaccucccccuuucacacugga

SEQ ID NO: 629372 - RNA, 17 nt, Homo sapiens
acaccucuaaacaucuc

SEQ ID NO: 629373 - RNA, 15 nt, Homo sapiens
acaccucugcuccaa

SEQ ID NO: 629374 - RNA, 15 nt, Homo sapiens
acaccugcucucucc

SEQ ID NO: 629375 - RNA, 16 nt, Homo sapiens
acaccuggaauguuag

SEQ ID NO: 629376 - RNA, 17 nt, Homo sapiens
acaccuggaugucuggg

SEQ ID NO: 629377 - RNA, 14 nt, Homo sapiens
acaccuggccuuaa

SEQ ID NO: 629378 - RNA, 22 nt, Homo sapiens
acaccugggagaaggucuccaa

SEQ ID NO: 629379 - RNA, 17 nt, Homo sapiens
acaccuguaaucccagc

SEQ ID NO: 629380 - RNA, 21 nt, Homo sapiens
acaccuguaaucccagcacuu

SEQ ID NO: 629381 - RNA, 15 nt, Homo sapiens
acaccuguaguccca

SEQ ID NO: 629382 - RNA, 20 nt, Homo sapiens
acaccuuagguugacauuca

SEQ ID NO: 629383 - RNA, 16 nt, Homo sapiens
acaccuuagucuuucc

SEQ ID NO: 629384 - RNA, 22 nt, Homo sapiens
acaccuucuuggcuucugggac

SEQ ID NO: 629385 - RNA, 16 nt, Homo sapiens
acaccuuggacuguua

SEQ ID NO: 629386 - RNA, 16 nt, Homo sapiens
acaccuuggauuugga

SEQ ID NO: 629387 - RNA, 20 nt, Homo sapiens
acaccuuggccuucugggaa

SEQ ID NO: 629388 - RNA, 22 nt, Homo sapiens
acacgaagccagcagaggucag

SEQ ID NO: 629389 - RNA, 16 nt, Homo sapiens
acacgaguuccagacc

SEQ ID NO: 629390 - RNA, 24 nt, Homo sapiens
acacgcacgcacacgcacacaucu

SEQ ID NO: 629391 - RNA, 21 nt, Homo sapiens
acacgcccuccccagacucca

SEQ ID NO: 629392 - RNA, 21 nt, Homo sapiens
acacgcugcaccuaaagccua

SEQ ID NO: 629393 - RNA, 22 nt, Homo sapiens
acacggacucccgggccacgcc

SEQ ID NO: 629394 - RNA, 13 nt, Homo sapiens
acacggacugagg

SEQ ID NO: 629395 - RNA, 15 nt, Homo sapiens
acacggacugugcau

SEQ ID NO: 629396 - RNA, 20 nt, Homo sapiens
acacggccucccucugcuac

SEQ ID NO: 629397 - RNA, 15 nt, Homo sapiens
acacggggcaguggc

SEQ ID NO: 629398 - RNA, 17 nt, Homo sapiens
acacguaccucucauca

SEQ ID NO: 629399 - RNA, 17 nt, Homo sapiens
acacgucgauucugucc

SEQ ID NO: 629400 - RNA, 23 nt, Homo sapiens
acacguucugauuucugcccuug

SEQ ID NO: 629401 - RNA, 14 nt, Homo sapiens
acacuaacauauaa

SEQ ID NO: 629402 - RNA, 14 nt, Homo sapiens
acacuaacucacca

SEQ ID NO: 629403 - RNA, 11 nt, Homo sapiens
acacuaaugca

SEQ ID NO: 629404 - RNA, 19 nt, Homo sapiens
acacuaaugcagccacgau

SEQ ID NO: 629405 - RNA, 18 nt, Homo sapiens
acacuaaugggaagacca

SEQ ID NO: 629406 - RNA, 22 nt, Homo sapiens
acacuacagaggggccagggga

SEQ ID NO: 629407 - RNA, 17 nt, Homo sapiens
acacuacaugaugacuc

SEQ ID NO: 629408 - RNA, 14 nt, Homo sapiens
acacuagucugugu

SEQ ID NO: 629409 - RNA, 21 nt, Homo sapiens
acacuaguuuugugccagccg

SEQ ID NO: 629410 - RNA, 13 nt, Homo sapiens
acacuaugugcaa

SEQ ID NO: 629411 - RNA, 14 nt, Homo sapiens
acacuaugugcaaa

SEQ ID NO: 629412 - RNA, 13 nt, Homo sapiens
acacuauuuacaa

SEQ ID NO: 629413 - RNA, 19 nt, Homo sapiens
acacucauccccucacuug

SEQ ID NO: 629414 - RNA, 21 nt, Homo sapiens
acacucauccccucacuugcc

SEQ ID NO: 629415 - RNA, 22 nt, Homo sapiens
acacuccagugccagcaaugac

SEQ ID NO: 629416 - RNA, 18 nt, Homo sapiens
acacucuacuacauguga

SEQ ID NO: 629417 - RNA, 19 nt, Homo sapiens
acacucuauaagauuccaa

SEQ ID NO: 629418 - RNA, 15 nt, Homo sapiens
acacucuccaaacag

SEQ ID NO: 629419 - RNA, 12 nt, Homo sapiens
acacucucugga

SEQ ID NO: 629420 - RNA, 20 nt, Homo sapiens
acacucucuggaagcccugg

SEQ ID NO: 629421 - RNA, 17 nt, Homo sapiens
acacucucuugggccag

SEQ ID NO: 629422 - RNA, 23 nt, Homo sapiens
acacucugccugaaggcucacac

SEQ ID NO: 629423 - RNA, 21 nt, Homo sapiens
acacugaaaaaucuaagugau

SEQ ID NO: 629424 - RNA, 15 nt, Homo sapiens
acacugaaguuaaca

SEQ ID NO: 629425 - RNA, 23 nt, Homo sapiens
acacugagagggcaaucuuugcc

SEQ ID NO: 629426 - RNA, 17 nt, Homo sapiens
acacugagauauucagc

SEQ ID NO: 629427 - RNA, 22 nt, Homo sapiens
acacugaucugcuagugcugua

SEQ ID NO: 629428 - RNA, 21 nt, Homo sapiens
acacugaucuuauguguuaca

SEQ ID NO: 629429 - RNA, 21 nt, Homo sapiens
acacugcaaauaaacuuggua

SEQ ID NO: 629430 - RNA, 21 nt, Homo sapiens
acagcacuggggagucuuugu

SEQ ID NO: 629431 - RNA, 15 nt, Homo sapiens
acagcagaacuucug

SEQ ID NO: 629432 - RNA, 17 nt, Homo sapiens
acagcagagaagcugua

SEQ ID NO: 629433 - RNA, 18 nt, Homo sapiens
acagcagauacuuuguca

SEQ ID NO: 629434 - RNA, 13 nt, Homo sapiens
acagcagauucca

SEQ ID NO: 629435 - RNA, 13 nt, Homo sapiens
acagcagauuuca

SEQ ID NO: 629436 - RNA, 23 nt, Homo sapiens
acagcagcuucaccagagcauuu

SEQ ID NO: 629437 - RNA, 15 nt, Homo sapiens
acagcagugaucuca

SEQ ID NO: 629438 - RNA, 13 nt, Homo sapiens
acagcagugcaua

SEQ ID NO: 629439 - RNA, 22 nt, Homo sapiens
acagcaugggccucaccuccuc

SEQ ID NO: 629440 - RNA, 15 nt, Homo sapiens
acagcauuaacuguc

SEQ ID NO: 629441 - RNA, 17 nt, Homo sapiens
acagcauucuugucaca

SEQ ID NO: 629442 - RNA, 12 nt, Homo sapiens
acagcauugcuu

SEQ ID NO: 629443 - RNA, 18 nt, Homo sapiens
acagccaaaaaggaccaa

SEQ ID NO: 629444 - RNA, 12 nt, Homo sapiens
acagccaagggg

SEQ ID NO: 629445 - RNA, 22 nt, Homo sapiens
acagccaccguuucuuccugcc

SEQ ID NO: 629446 - RNA, 21 nt, Homo sapiens
acagccacuaaaacacaaaaa

SEQ ID NO: 629447 - RNA, 22 nt, Homo sapiens
acagccacugcggaguccaggc

SEQ ID NO: 629448 - RNA, 19 nt, Homo sapiens
acagcccacggggaucaca

SEQ ID NO: 629449 - RNA, 18 nt, Homo sapiens
acagcccaucaccucuaa

SEQ ID NO: 629450 - RNA, 18 nt, Homo sapiens
acagccccagucuuccuu

SEQ ID NO: 629451 - RNA, 22 nt, Homo sapiens
acagcccgggugugccugcccu

SEQ ID NO: 629452 - RNA, 20 nt, Homo sapiens
acagcccucacuaacaaaga

SEQ ID NO: 629453 - RNA, 15 nt, Homo sapiens
acagcccucagcaau

SEQ ID NO: 629454 - RNA, 21 nt, Homo sapiens
acagcccuccuugacccugaa

SEQ ID NO: 629455 - RNA, 20 nt, Homo sapiens
acagccgcuccugucugcca

SEQ ID NO: 629456 - RNA, 13 nt, Homo sapiens
acagccucuugcc

SEQ ID NO: 629457 - RNA, 18 nt, Homo sapiens
acagcgagggcagcugcu

SEQ ID NO: 629458 - RNA, 12 nt, Homo sapiens
acagcuacucuc

SEQ ID NO: 629459 - RNA, 18 nt, Homo sapiens
acagcuauuagaacuaau

SEQ ID NO: 629460 - RNA, 19 nt, Homo sapiens
acagcuauuagaacuaaua

SEQ ID NO: 629461 - RNA, 21 nt, Homo sapiens
acagcucaagucuucccugau

SEQ ID NO: 629462 - RNA, 23 nt, Homo sapiens
acagcucaguucuagucucucug

SEQ ID NO: 629463 - RNA, 18 nt, Homo sapiens
acagcuccuaggaaaaug

SEQ ID NO: 629464 - RNA, 14 nt, Homo sapiens
acagcucugagauc

SEQ ID NO: 629465 - RNA, 13 nt, Homo sapiens
acagcugaugaac

SEQ ID NO: 629466 - RNA, 14 nt, Homo sapiens
acagcugcauuaaa

SEQ ID NO: 629467 - RNA, 20 nt, Homo sapiens
acagcugccuguuuccuccc

SEQ ID NO: 629468 - RNA, 13 nt, Homo sapiens
acagcugcuucuc

SEQ ID NO: 629469 - RNA, 23 nt, Homo sapiens
acagcugcuuucuguugucauug

SEQ ID NO: 629470 - RNA, 20 nt, Homo sapiens
acagcuggggacaacugcgg

SEQ ID NO: 629471 - RNA, 14 nt, Homo sapiens
aguuucuaagcaug

SEQ ID NO: 629472 - RNA, 21 nt, Homo sapiens
aguuucuagugucacugauga

SEQ ID NO: 629473 - RNA, 17 nt, Homo sapiens
aguuucuauucugucag

SEQ ID NO: 629474 - RNA, 22 nt, Homo sapiens
aguuucuccuuuugaccaaaua

SEQ ID NO: 629475 - RNA, 23 nt, Homo sapiens
aguuucuccuuuugaccaaauaa

SEQ ID NO: 629476 - RNA, 21 nt, Homo sapiens
aguuucugcggaagcugguga

SEQ ID NO: 629477 - RNA, 17 nt, Homo sapiens
aguuucuggcucuugag

SEQ ID NO: 629478 - RNA, 23 nt, Homo sapiens
aguuucuugaggccaaacacacu

SEQ ID NO: 629479 - RNA, 23 nt, Homo sapiens
aguuucuugcuuggaagccaggu

SEQ ID NO: 629480 - RNA, 20 nt, Homo sapiens
aguuugaagcacaacucccu

SEQ ID NO: 629481 - RNA, 21 nt, Homo sapiens
aguuugaagcacaacucccuu

SEQ ID NO: 629482 - RNA, 20 nt, Homo sapiens
aguuugagacaggagaccug

SEQ ID NO: 629483 - RNA, 19 nt, Homo sapiens
aguuugagaccaaccuggg

SEQ ID NO: 629484 - RNA, 17 nt, Homo sapiens
aguuugagacuauggaa

SEQ ID NO: 629485 - RNA, 13 nt, Homo sapiens
aguuugcugccau

SEQ ID NO: 629486 - RNA, 17 nt, Homo sapiens
aguuugcuuuguaugca

SEQ ID NO: 629487 - RNA, 16 nt, Homo sapiens
aguuuggagucacugu

SEQ ID NO: 629488 - RNA, 15 nt, Homo sapiens
aguuuggauguugua

SEQ ID NO: 629489 - RNA, 21 nt, Homo sapiens
aguuuggcaguaccucaaaaa

SEQ ID NO: 629490 - RNA, 22 nt, Homo sapiens
aguuuggcaguaccucaaaaag

SEQ ID NO: 629491 - RNA, 13 nt, Homo sapiens
aguuuguagcuca

SEQ ID NO: 629492 - RNA, 20 nt, Homo sapiens
aguuuguauuuagcugccaa

SEQ ID NO: 629493 - RNA, 13 nt, Homo sapiens
aguuuguguuaga

SEQ ID NO: 629494 - RNA, 19 nt, Homo sapiens
aguuuguugaagugcacau

SEQ ID NO: 629495 - RNA, 20 nt, Homo sapiens
aguuuguuuuagaaccagcc

SEQ ID NO: 629496 - RNA, 21 nt, Homo sapiens
aguuuuaauaagaacagauca

SEQ ID NO: 629497 - RNA, 20 nt, Homo sapiens
aguuuuacuaaaacacugaa

SEQ ID NO: 629498 - RNA, 18 nt, Homo sapiens
aguuuuaggacaaacagc

SEQ ID NO: 629499 - RNA, 13 nt, Homo sapiens
aguuuuaguugca

SEQ ID NO: 629500 - RNA, 19 nt, Homo sapiens
aguuuuaguuuucucuuag

SEQ ID NO: 629501 - RNA, 18 nt, Homo sapiens
aguuuuauggcaugauuu

SEQ ID NO: 629502 - RNA, 23 nt, Homo sapiens
aguuuuauuuuuucgugcacucu

SEQ ID NO: 629503 - RNA, 13 nt, Homo sapiens
aguuuucaaguca

SEQ ID NO: 629504 - RNA, 24 nt, Homo sapiens
aguuuucaggaugagaugacagau

SEQ ID NO: 629505 - RNA, 16 nt, Homo sapiens
aguuuucuaauuugca

SEQ ID NO: 629506 - RNA, 18 nt, Homo sapiens
aguuuucuauucuuggag

SEQ ID NO: 629507 - RNA, 20 nt, Homo sapiens
aguuuucuggagugagcacu

SEQ ID NO: 629508 - RNA, 18 nt, Homo sapiens
aguuuugaguguacugug

SEQ ID NO: 629509 - RNA, 11 nt, Homo sapiens
aguuuugcacu

SEQ ID NO: 629510 - RNA, 14 nt, Homo sapiens
aguuuuggaaucua

SEQ ID NO: 629511 - RNA, 22 nt, Homo sapiens
aguuuuggcaagaagucuauua

SEQ ID NO: 629512 - RNA, 17 nt, Homo sapiens
aguuuuguaaaaacuga

SEQ ID NO: 629513 - RNA, 21 nt, Homo sapiens
aguuuuguaaaaacugaagaa

SEQ ID NO: 629514 - RNA, 17 nt, Homo sapiens
aguuuuugauagcuuua

SEQ ID NO: 629515 - RNA, 17 nt, Homo sapiens
auaaaaaacauauacaa

SEQ ID NO: 629516 - RNA, 18 nt, Homo sapiens
auaaaaaauaaaguacca

SEQ ID NO: 629517 - RNA, 13 nt, Homo sapiens
auaaaaacccugu

SEQ ID NO: 629518 - RNA, 14 nt, Homo sapiens
auaaaaacccugua

SEQ ID NO: 629519 - RNA, 21 nt, Homo sapiens
auaaaaacccuguauggcacu

SEQ ID NO: 629520 - RNA, 13 nt, Homo sapiens
auaaaaacucuua

SEQ ID NO: 629521 - RNA, 14 nt, Homo sapiens
auaaaaagaguaug

SEQ ID NO: 629522 - RNA, 13 nt, Homo sapiens
auaaaaaggaaua

SEQ ID NO: 629523 - RNA, 15 nt, Homo sapiens
auaaaaagugacaca

SEQ ID NO: 629524 - RNA, 20 nt, Homo sapiens
auaaaaagugacacagcagc

SEQ ID NO: 629525 - RNA, 14 nt, Homo sapiens
auaaaaaugagugc

SEQ ID NO: 629526 - RNA, 15 nt, Homo sapiens
auaaaaaugagugcu

SEQ ID NO: 629527 - RNA, 21 nt, Homo sapiens
auaaaaauguuucuacagaua

SEQ ID NO: 629528 - RNA, 19 nt, Homo sapiens
auaaaacaaaaccaacuca

SEQ ID NO: 629529 - RNA, 14 nt, Homo sapiens
auaaaaccaaguuu

SEQ ID NO: 629530 - RNA, 19 nt, Homo sapiens
auaaaacgugacagggaaa

SEQ ID NO: 629531 - RNA, 13 nt, Homo sapiens
auaaaacugaugu

SEQ ID NO: 629532 - RNA, 12 nt, Homo sapiens
auaaaagacuuu

SEQ ID NO: 629533 - RNA, 16 nt, Homo sapiens
auaaaagagaagccaa

SEQ ID NO: 629534 - RNA, 15 nt, Homo sapiens
auaaaagagcugucu

SEQ ID NO: 629535 - RNA, 14 nt, Homo sapiens
auaaaagaucuuga

SEQ ID NO: 629536 - RNA, 19 nt, Homo sapiens
auaaaagaugauuucucaa

SEQ ID NO: 629537 - RNA, 18 nt, Homo sapiens
auaaaagauuuacauucc

SEQ ID NO: 629538 - RNA, 14 nt, Homo sapiens
auaaaagcuagaua

SEQ ID NO: 629539 - RNA, 19 nt, Homo sapiens
auaaaauauuauugaacua

SEQ ID NO: 629540 - RNA, 19 nt, Homo sapiens
auaaaauccuaagacacaa

SEQ ID NO: 629541 - RNA, 19 nt, Homo sapiens
auaaaaucugugaauuaaa

SEQ ID NO: 629542 - RNA, 23 nt, Homo sapiens
auaaaaucuuucugauaaugcau

SEQ ID NO: 629543 - RNA, 16 nt, Homo sapiens
auaaaaugaaccugau

SEQ ID NO: 629544 - RNA, 12 nt, Homo sapiens
auaaaaugauaa

SEQ ID NO: 629545 - RNA, 15 nt, Homo sapiens
auaaaauggcaccuu

SEQ ID NO: 629546 - RNA, 17 nt, Homo sapiens
auaaaauguaauuacuu

SEQ ID NO: 629547 - RNA, 15 nt, Homo sapiens
auaaaauguauucaa

SEQ ID NO: 629548 - RNA, 19 nt, Homo sapiens
auaaaauguguacagugaa

SEQ ID NO: 629549 - RNA, 18 nt, Homo sapiens
auaaaauguucagugcaa

SEQ ID NO: 629550 - RNA, 21 nt, Homo sapiens
auaaaauguuuaaucucugcu

SEQ ID NO: 629551 - RNA, 16 nt, Homo sapiens
auaaaauuagcuugag

SEQ ID NO: 629552 - RNA, 13 nt, Homo sapiens
auaagacuacuau

SEQ ID NO: 629553 - RNA, 21 nt, Homo sapiens
auaagacuacugaaucugcua

SEQ ID NO: 629554 - RNA, 19 nt, Homo sapiens
auaagagcuggaugcacau

SEQ ID NO: 629555 - RNA, 16 nt, Homo sapiens
auaagauuaaaggaag

SEQ ID NO: 629556 - RNA, 23 nt, Homo sapiens
auaagcaaagggagcacuggguu

SEQ ID NO: 629557 - RNA, 16 nt, Homo sapiens
auaagcaauaccagca

SEQ ID NO: 629558 - RNA, 19 nt, Homo sapiens
auaagcacugaaaaacaac

SEQ ID NO: 629559 - RNA, 17 nt, Homo sapiens
auaagcaugacauacuu

SEQ ID NO: 629560 - RNA, 14 nt, Homo sapiens
auaagcauucaaua

SEQ ID NO: 629561 - RNA, 17 nt, Homo sapiens
auaagccacucuguccc

SEQ ID NO: 629562 - RNA, 15 nt, Homo sapiens
auaagcucagugaua

SEQ ID NO: 629563 - RNA, 22 nt, Homo sapiens
auaagcucuccccaaacuugcu

SEQ ID NO: 629564 - RNA, 18 nt, Homo sapiens
auaagcuggacuaguguc

SEQ ID NO: 629565 - RNA, 15 nt, Homo sapiens
auaagcuguuuuuau

SEQ ID NO: 629566 - RNA, 19 nt, Homo sapiens
auaagcuuuauauaccucu

SEQ ID NO: 629567 - RNA, 15 nt, Homo sapiens
auaaggcauggcuca

SEQ ID NO: 629568 - RNA, 14 nt, Homo sapiens
auaaggcauuccac

SEQ ID NO: 629569 - RNA, 17 nt, Homo sapiens
auaaggggucaaaauuu

SEQ ID NO: 629570 - RNA, 23 nt, Homo sapiens
auaaggggucaaaauuugcugcc

SEQ ID NO: 629571 - RNA, 14 nt, Homo sapiens
auaagguaugugcu

SEQ ID NO: 629572 - RNA, 16 nt, Homo sapiens
auaaguaaagaauuac

SEQ ID NO: 629573 - RNA, 23 nt, Homo sapiens
auaagugggucaaguacaccagc

SEQ ID NO: 629574 - RNA, 20 nt, Homo sapiens
auaaguuaauuuugcauuuu

SEQ ID NO: 629575 - RNA, 17 nt, Homo sapiens
auaaguucuuaauguca

SEQ ID NO: 629576 - RNA, 16 nt, Homo sapiens
auaaguuugcaguugg

SEQ ID NO: 629577 - RNA, 21 nt, Homo sapiens
auaauaaaaauuguagcuuuu

SEQ ID NO: 629578 - RNA, 16 nt, Homo sapiens
auaauaaaaugcaaau

SEQ ID NO: 629579 - RNA, 23 nt, Homo sapiens
auaauaaagacauuuccuaccug

SEQ ID NO: 629580 - RNA, 15 nt, Homo sapiens
auaauaaaguagcaa

SEQ ID NO: 629581 - RNA, 16 nt, Homo sapiens
auaauaaauacacaau

SEQ ID NO: 629582 - RNA, 22 nt, Homo sapiens
auaauaacuuuauugcauauag

SEQ ID NO: 629583 - RNA, 17 nt, Homo sapiens
auaauacaguaucucag

SEQ ID NO: 629584 - RNA, 12 nt, Homo sapiens
auaauacuauau

SEQ ID NO: 629585 - RNA, 10 nt, Homo sapiens
auaauacucu

SEQ ID NO: 629586 - RNA, 12 nt, Homo sapiens
auaauacuugac

SEQ ID NO: 629587 - RNA, 17 nt, Homo sapiens
auaauagacacugggga

SEQ ID NO: 629588 - RNA, 16 nt, Homo sapiens
auaauagagauaaguc

SEQ ID NO: 629589 - RNA, 15 nt, Homo sapiens
auaauaggaauucaa

SEQ ID NO: 629590 - RNA, 23 nt, Homo sapiens
auaauagguuugugacuuuccua

SEQ ID NO: 629591 - RNA, 22 nt, Homo sapiens
auaauauauuuucaaggauguu

SEQ ID NO: 629592 - RNA, 17 nt, Homo sapiens
auaauaugaaaaucucc

SEQ ID NO: 629593 - RNA, 16 nt, Homo sapiens
auaauaugagaaucag

SEQ ID NO: 629594 - RNA, 16 nt, Homo sapiens
auaauaugcugccaaa

SEQ ID NO: 629595 - RNA, 22 nt, Homo sapiens
acaguguauguacuaagcagua

SEQ ID NO: 629596 - RNA, 22 nt, Homo sapiens
acagugucugugccauggauuu

SEQ ID NO: 629597 - RNA, 19 nt, Homo sapiens
acaguguguuggugcuuua

SEQ ID NO: 629598 - RNA, 19 nt, Homo sapiens
acaguguugaaaauguuca

SEQ ID NO: 629599 - RNA, 22 nt, Homo sapiens
acaguguuguucccucccucaa

SEQ ID NO: 629600 - RNA, 14 nt, Homo sapiens
acaguuacagagug

SEQ ID NO: 629601 - RNA, 16 nt, Homo sapiens
acaguuacuccaguau

SEQ ID NO: 629602 - RNA, 17 nt, Homo sapiens
acaguuagguagcuuua

SEQ ID NO: 629603 - RNA, 18 nt, Homo sapiens
acaguuagguagcuuuag

SEQ ID NO: 629604 - RNA, 23 nt, Homo sapiens
acaguuaucauuaucaucaucau

SEQ ID NO: 629605 - RNA, 21 nt, Homo sapiens
acaguucauguuugcuucaua

SEQ ID NO: 629606 - RNA, 22 nt, Homo sapiens
acaguugaaaaacagcugaggg

SEQ ID NO: 629607 - RNA, 23 nt, Homo sapiens
acaguuggauuuauucugccaaa

SEQ ID NO: 629608 - RNA, 24 nt, Homo sapiens
acaguuuacagacgcugcugucac

SEQ ID NO: 629609 - RNA, 18 nt, Homo sapiens
acaguuuacuuugccaac

SEQ ID NO: 629610 - RNA, 20 nt, Homo sapiens
acaguuuaggaguacugaua

SEQ ID NO: 629611 - RNA, 20 nt, Homo sapiens
acaguuuauauuguggaaua

SEQ ID NO: 629612 - RNA, 15 nt, Homo sapiens
acaguuuauugauau

SEQ ID NO: 629613 - RNA, 22 nt, Homo sapiens
acaguuuauuuuuauacuuuca

SEQ ID NO: 629614 - RNA, 23 nt, Homo sapiens
acaguuuauuuuuauacuuucag

SEQ ID NO: 629615 - RNA, 21 nt, Homo sapiens
acaguuuccaaauugcccuau

SEQ ID NO: 629616 - RNA, 18 nt, Homo sapiens
acaguuucuugcuuggaa

SEQ ID NO: 629617 - RNA, 17 nt, Homo sapiens
acaguuuguggcuuaua

SEQ ID NO: 629618 - RNA, 18 nt, Homo sapiens
acaguuuugccugcuaaa

SEQ ID NO: 629619 - RNA, 21 nt, Homo sapiens
acauaaaaaauaaaguaccac

SEQ ID NO: 629620 - RNA, 13 nt, Homo sapiens
acauaaaauccaa

SEQ ID NO: 629621 - RNA, 13 nt, Homo sapiens
acauaaacccagu

SEQ ID NO: 629622 - RNA, 12 nt, Homo sapiens
acauaaacugac

SEQ ID NO: 629623 - RNA, 16 nt, Homo sapiens
acauaaagacugugcu

SEQ ID NO: 629624 - RNA, 23 nt, Homo sapiens
acauaaauuacuuuuucauucuu

SEQ ID NO: 629625 - RNA, 22 nt, Homo sapiens
acauaacacuauaaagguugac

SEQ ID NO: 629626 - RNA, 23 nt, Homo sapiens
acauaacccuagaauucuuaguc

SEQ ID NO: 629627 - RNA, 13 nt, Homo sapiens
acauaacuuccua

SEQ ID NO: 629628 - RNA, 13 nt, Homo sapiens
acauaagaaggca

SEQ ID NO: 629629 - RNA, 19 nt, Homo sapiens
acauaagcaaagacuauga

SEQ ID NO: 629630 - RNA, 12 nt, Homo sapiens
acauaagcauaa

SEQ ID NO: 629631 - RNA, 18 nt, Homo sapiens
acauaaguguugguagca

SEQ ID NO: 629632 - RNA, 23 nt, Homo sapiens
acauaaucauggauuauguugac

SEQ ID NO: 629633 - RNA, 15 nt, Homo sapiens
acauaaucuguacaa

SEQ ID NO: 629634 - RNA, 13 nt, Homo sapiens
acauaauguucca

SEQ ID NO: 629635 - RNA, 17 nt, Homo sapiens
acauaauuccagucaca

SEQ ID NO: 629636 - RNA, 13 nt, Homo sapiens
acauaauugauua

SEQ ID NO: 629637 - RNA, 21 nt, Homo sapiens
acauaauuggacucugucaca

SEQ ID NO: 629638 - RNA, 21 nt, Homo sapiens
acauacaaacauaaggcacau

SEQ ID NO: 629639 - RNA, 20 nt, Homo sapiens
acauacaauuccaaacacau

SEQ ID NO: 629640 - RNA, 19 nt, Homo sapiens
acauacaggccauacuuua

SEQ ID NO: 629641 - RNA, 22 nt, Homo sapiens
acauacaggccauacuuuacaa

SEQ ID NO: 629642 - RNA, 12 nt, Homo sapiens
acauacauacau

SEQ ID NO: 629643 - RNA, 17 nt, Homo sapiens
acauacauacauauaua

SEQ ID NO: 629644 - RNA, 18 nt, Homo sapiens
acauacauauuaucucau

SEQ ID NO: 629645 - RNA, 16 nt, Homo sapiens
acauaccuaccaguau

SEQ ID NO: 629646 - RNA, 13 nt, Homo sapiens
acauacugcagug

SEQ ID NO: 629647 - RNA, 18 nt, Homo sapiens
acauacuggccuggacug

SEQ ID NO: 629648 - RNA, 17 nt, Homo sapiens
acauacuuacaugugug

SEQ ID NO: 629649 - RNA, 19 nt, Homo sapiens
acauacuuuaucaaugugu

SEQ ID NO: 629650 - RNA, 22 nt, Homo sapiens
acauagaaacucgggcuugagu

SEQ ID NO: 629651 - RNA, 14 nt, Homo sapiens
acauagaacaugug

SEQ ID NO: 629652 - RNA, 19 nt, Homo sapiens
acauagacaaaaaauuuga

SEQ ID NO: 629653 - RNA, 13 nt, Homo sapiens
acauagagaucua

SEQ ID NO: 629654 - RNA, 18 nt, Homo sapiens
acauagaugucccuuucu

SEQ ID NO: 629655 - RNA, 17 nt, Homo sapiens
acauagcagacuuuccc

SEQ ID NO: 629656 - RNA, 16 nt, Homo sapiens
acauagccgauucucu

SEQ ID NO: 629657 - RNA, 17 nt, Homo sapiens
acauaggaaaaugccau

SEQ ID NO: 629658 - RNA, 18 nt, Homo sapiens
acauaggaaaaugccaug

SEQ ID NO: 629659 - RNA, 21 nt, Homo sapiens
acauaggcaaagcaaucaagc

SEQ ID NO: 629660 - RNA, 20 nt, Homo sapiens
acauaggccugcucagccuc

SEQ ID NO: 629661 - RNA, 12 nt, Homo sapiens
acauagugagac

SEQ ID NO: 629662 - RNA, 14 nt, Homo sapiens
acauagugugagaa

SEQ ID NO: 629663 - RNA, 22 nt, Homo sapiens
acauauaaaauguaauuacuua

SEQ ID NO: 629664 - RNA, 15 nt, Homo sapiens
acauaucauuuguga

SEQ ID NO: 629665 - RNA, 18 nt, Homo sapiens
acauauccuuucaagaca

SEQ ID NO: 629666 - RNA, 14 nt, Homo sapiens
acauaugacuugau

SEQ ID NO: 629667 - RNA, 22 nt, Homo sapiens
acauauguauuaagccaaacau

SEQ ID NO: 629668 - RNA, 12 nt, Homo sapiens
acauaugugcug

SEQ ID NO: 629669 - RNA, 14 nt, Homo sapiens
acauaugugugugu

SEQ ID NO: 629670 - RNA, 14 nt, Homo sapiens
acauauuacuguug

SEQ ID NO: 629671 - RNA, 15 nt, Homo sapiens
acauauucaaauucc

SEQ ID NO: 629672 - RNA, 16 nt, Homo sapiens
acauauucaagugaua

SEQ ID NO: 629673 - RNA, 14 nt, Homo sapiens
auccaaauuucuca

SEQ ID NO: 629674 - RNA, 13 nt, Homo sapiens
auccaacuuccaa

SEQ ID NO: 629675 - RNA, 23 nt, Homo sapiens
auccaagaaggccuucauggccc

SEQ ID NO: 629676 - RNA, 18 nt, Homo sapiens
auccaagaaucagugaag

SEQ ID NO: 629677 - RNA, 12 nt, Homo sapiens
auccaagaccug

SEQ ID NO: 629678 - RNA, 21 nt, Homo sapiens
auccaaggccgcggcccagac

SEQ ID NO: 629679 - RNA, 21 nt, Homo sapiens
auccaaguguuauaccaacua

SEQ ID NO: 629680 - RNA, 17 nt, Homo sapiens
auccaauaugacucaga

SEQ ID NO: 629681 - RNA, 18 nt, Homo sapiens
auccaauggaacaguagc

SEQ ID NO: 629682 - RNA, 19 nt, Homo sapiens
auccacauccucuacaggu

SEQ ID NO: 629683 - RNA, 19 nt, Homo sapiens
auccaccaagaacauaaga

SEQ ID NO: 629684 - RNA, 16 nt, Homo sapiens
auccacccaacccuau

SEQ ID NO: 629685 - RNA, 18 nt, Homo sapiens
auccacccaccuuggccu

SEQ ID NO: 629686 - RNA, 22 nt, Homo sapiens
auccacccagcaggcagagugg

SEQ ID NO: 629687 - RNA, 21 nt, Homo sapiens
auccaccccguugcucaagcc

SEQ ID NO: 629688 - RNA, 18 nt, Homo sapiens
auccacuucucucaggau

SEQ ID NO: 629689 - RNA, 13 nt, Homo sapiens
auccagacagucg

SEQ ID NO: 629690 - RNA, 15 nt, Homo sapiens
auccagacagucgcu

SEQ ID NO: 629691 - RNA, 13 nt, Homo sapiens
auccagaggaauu

SEQ ID NO: 629692 - RNA, 14 nt, Homo sapiens
auccagcacuggug

SEQ ID NO: 629693 - RNA, 17 nt, Homo sapiens
auccagcacuggugaac

SEQ ID NO: 629694 - RNA, 23 nt, Homo sapiens
auccagcacuggugaacugagcu

SEQ ID NO: 629695 - RNA, 23 nt, Homo sapiens
auccagccagaccccacgcugac

SEQ ID NO: 629696 - RNA, 18 nt, Homo sapiens
auccagugagcacuagaa

SEQ ID NO: 629697 - RNA, 16 nt, Homo sapiens
auccagugauccuuac

SEQ ID NO: 629698 - RNA, 15 nt, Homo sapiens
auccauaaugcauuc

SEQ ID NO: 629699 - RNA, 15 nt, Homo sapiens
auccauaauuauuaa

SEQ ID NO: 629700 - RNA, 17 nt, Homo sapiens
auccauauugagucaaa

SEQ ID NO: 629701 - RNA, 18 nt, Homo sapiens
auccauauuuccuauugu

SEQ ID NO: 629702 - RNA, 22 nt, Homo sapiens
auccaucacuagccaugauaac

SEQ ID NO: 629703 - RNA, 17 nt, Homo sapiens
auccauccugcucagga

SEQ ID NO: 629704 - RNA, 12 nt, Homo sapiens
auccaucuacuu

SEQ ID NO: 629705 - RNA, 17 nt, Homo sapiens
auccaugaaccaagacc

SEQ ID NO: 629706 - RNA, 17 nt, Homo sapiens
auccaugcaccuaccuu

SEQ ID NO: 629707 - RNA, 14 nt, Homo sapiens
auccaugcccuccc

SEQ ID NO: 629708 - RNA, 18 nt, Homo sapiens
auccaugcgucaguuuuu

SEQ ID NO: 629709 - RNA, 15 nt, Homo sapiens
auccaugcugugcug

SEQ ID NO: 629710 - RNA, 18 nt, Homo sapiens
auccauguguggacucaa

SEQ ID NO: 629711 - RNA, 21 nt, Homo sapiens
auccauguuaguuuuuacuuu

SEQ ID NO: 629712 - RNA, 15 nt, Homo sapiens
auccauuacgugcau

SEQ ID NO: 629713 - RNA, 21 nt, Homo sapiens
aucccaaaucugucagcaucu

SEQ ID NO: 629714 - RNA, 13 nt, Homo sapiens
aucccaacuuccu

SEQ ID NO: 629715 - RNA, 15 nt, Homo sapiens
aucccaagaaaugga

SEQ ID NO: 629716 - RNA, 18 nt, Homo sapiens
aucccaagaaauggaauc

SEQ ID NO: 629717 - RNA, 16 nt, Homo sapiens
aucccaagugcacuuu

SEQ ID NO: 629718 - RNA, 20 nt, Homo sapiens
aucccaccaaccuccagugu

SEQ ID NO: 629719 - RNA, 18 nt, Homo sapiens
aucccagauaauggagaa

SEQ ID NO: 629720 - RNA, 12 nt, Homo sapiens
aucccagcacuu

SEQ ID NO: 629721 - RNA, 20 nt, Homo sapiens
aucccagcagcccaagcuua

SEQ ID NO: 629722 - RNA, 16 nt, Homo sapiens
aucccagcuaccucaa

SEQ ID NO: 629723 - RNA, 15 nt, Homo sapiens
aucccagcuacucag

SEQ ID NO: 629724 - RNA, 22 nt, Homo sapiens
aucccaggcgggcggcacgcca

SEQ ID NO: 629725 - RNA, 15 nt, Homo sapiens
aucccaguggccuca

SEQ ID NO: 629726 - RNA, 17 nt, Homo sapiens
aucccaugaacacacug

SEQ ID NO: 629727 - RNA, 15 nt, Homo sapiens
aucccauguauuuau

SEQ ID NO: 629728 - RNA, 13 nt, Homo sapiens
aucccaugucacc

SEQ ID NO: 629729 - RNA, 22 nt, Homo sapiens
auccccaacugcgacugugacc

SEQ ID NO: 629730 - RNA, 18 nt, Homo sapiens
auccccaagugugaacaa

SEQ ID NO: 629731 - RNA, 15 nt, Homo sapiens
accuccauuccccug

SEQ ID NO: 629732 - RNA, 14 nt, Homo sapiens
accucccauuacuu

SEQ ID NO: 629733 - RNA, 16 nt, Homo sapiens
accucccauuacuuug

SEQ ID NO: 629734 - RNA, 18 nt, Homo sapiens
accucccauuacuuugau

SEQ ID NO: 629735 - RNA, 21 nt, Homo sapiens
accucccccaaugucuucaag

SEQ ID NO: 629736 - RNA, 19 nt, Homo sapiens
accuccccugaggcucagg

SEQ ID NO: 629737 - RNA, 16 nt, Homo sapiens
accucccgaagccacc

SEQ ID NO: 629738 - RNA, 18 nt, Homo sapiens
accucccuccccgucuca

SEQ ID NO: 629739 - RNA, 21 nt, Homo sapiens
accucccucgccccaagguuc

SEQ ID NO: 629740 - RNA, 14 nt, Homo sapiens
accucccucugcca

SEQ ID NO: 629741 - RNA, 17 nt, Homo sapiens
accucccucugccaguc

SEQ ID NO: 629742 - RNA, 21 nt, Homo sapiens
accucccugacccgucuaaua

SEQ ID NO: 629743 - RNA, 18 nt, Homo sapiens
accuccgccagauccugc

SEQ ID NO: 629744 - RNA, 20 nt, Homo sapiens
accuccgccagauccugcag

SEQ ID NO: 629745 - RNA, 20 nt, Homo sapiens
accuccuccacucacuccag

SEQ ID NO: 629746 - RNA, 14 nt, Homo sapiens
accuccucccucau

SEQ ID NO: 629747 - RNA, 20 nt, Homo sapiens
accuccuccucuggacaaag

SEQ ID NO: 629748 - RNA, 15 nt, Homo sapiens
accuccuuagcccug

SEQ ID NO: 629749 - RNA, 15 nt, Homo sapiens
accuccuugcacaaa

SEQ ID NO: 629750 - RNA, 17 nt, Homo sapiens
accucgcuggacucuca

SEQ ID NO: 629751 - RNA, 19 nt, Homo sapiens
accucgucaagagcaugca

SEQ ID NO: 629752 - RNA, 13 nt, Homo sapiens
accucgugccacc

SEQ ID NO: 629753 - RNA, 19 nt, Homo sapiens
accucuaacauccuugucu

SEQ ID NO: 629754 - RNA, 14 nt, Homo sapiens
accucuaacccuca

SEQ ID NO: 629755 - RNA, 13 nt, Homo sapiens
accucuaugcaau

SEQ ID NO: 629756 - RNA, 22 nt, Homo sapiens
accucuccuucaugacagccuc

SEQ ID NO: 629757 - RNA, 20 nt, Homo sapiens
accucucucugggauuuacc

SEQ ID NO: 629758 - RNA, 21 nt, Homo sapiens
accucucugaacugcaacacu

SEQ ID NO: 629759 - RNA, 21 nt, Homo sapiens
accucugacgcaccacugcca

SEQ ID NO: 629760 - RNA, 15 nt, Homo sapiens
accucugagcacaua

SEQ ID NO: 629761 - RNA, 15 nt, Homo sapiens
accucugcaagacaa

SEQ ID NO: 629762 - RNA, 14 nt, Homo sapiens
accucugcacuacu

SEQ ID NO: 629763 - RNA, 17 nt, Homo sapiens
accucuggacuggcuag

SEQ ID NO: 629764 - RNA, 23 nt, Homo sapiens
accucuguauuaguuuuugauca

SEQ ID NO: 629765 - RNA, 12 nt, Homo sapiens
accucuguggac

SEQ ID NO: 629766 - RNA, 18 nt, Homo sapiens
accucugugggcacuggu

SEQ ID NO: 629767 - RNA, 16 nt, Homo sapiens
accucuguucauuuca

SEQ ID NO: 629768 - RNA, 19 nt, Homo sapiens
accucuguucauuucacac

SEQ ID NO: 629769 - RNA, 17 nt, Homo sapiens
accucuguuguccuccc

SEQ ID NO: 629770 - RNA, 14 nt, Homo sapiens
accucuuagcugag

SEQ ID NO: 629771 - RNA, 20 nt, Homo sapiens
accucuucccaugacugcac

SEQ ID NO: 629772 - RNA, 22 nt, Homo sapiens
accucuuuauuuuuugauugaa

SEQ ID NO: 629773 - RNA, 20 nt, Homo sapiens
accucuuugucccagaguua

SEQ ID NO: 629774 - RNA, 17 nt, Homo sapiens
accucuuuuucuuacca

SEQ ID NO: 629775 - RNA, 21 nt, Homo sapiens
accugaaaguuuuuuugguuu

SEQ ID NO: 629776 - RNA, 20 nt, Homo sapiens
accugaacacaucgugauga

SEQ ID NO: 629777 - RNA, 20 nt, Homo sapiens
accugaaggaauaaaaugau

SEQ ID NO: 629778 - RNA, 16 nt, Homo sapiens
accugacagcuuuauc

SEQ ID NO: 629779 - RNA, 23 nt, Homo sapiens
accugacaggugaggucuguucc

SEQ ID NO: 629780 - RNA, 21 nt, Homo sapiens
accugaggcugguuucuuuca

SEQ ID NO: 629781 - RNA, 12 nt, Homo sapiens
accugaggucag

SEQ ID NO: 629782 - RNA, 17 nt, Homo sapiens
accugaugcagagccuu

SEQ ID NO: 629783 - RNA, 15 nt, Homo sapiens
accugaugccauaaa

SEQ ID NO: 629784 - RNA, 18 nt, Homo sapiens
accugcacuuaaggcacu

SEQ ID NO: 629785 - RNA, 21 nt, Homo sapiens
accugcacuuauacccaugaa

SEQ ID NO: 629786 - RNA, 21 nt, Homo sapiens
accugcagcccauggugagcu

SEQ ID NO: 629787 - RNA, 21 nt, Homo sapiens
accugcagggacuccaugcug

SEQ ID NO: 629788 - RNA, 13 nt, Homo sapiens
accugccaugcca

SEQ ID NO: 629789 - RNA, 19 nt, Homo sapiens
accugcccaaggaugcugu

SEQ ID NO: 629790 - RNA, 21 nt, Homo sapiens
accugcccaaggaugcuguca

SEQ ID NO: 629791 - RNA, 20 nt, Homo sapiens
accugccccggaccuaccuc

SEQ ID NO: 629792 - RNA, 22 nt, Homo sapiens
accugccccugccugacagccu

SEQ ID NO: 629793 - RNA, 15 nt, Homo sapiens
accugcccugccuga

SEQ ID NO: 629794 - RNA, 18 nt, Homo sapiens
accugccugcgucuuccg

SEQ ID NO: 629795 - RNA, 15 nt, Homo sapiens
acgagggucccgauc

SEQ ID NO: 629796 - RNA, 14 nt, Homo sapiens
acgaggucuuguug

SEQ ID NO: 629797 - RNA, 20 nt, Homo sapiens
acgagguuaaagaagcugca

SEQ ID NO: 629798 - RNA, 18 nt, Homo sapiens
acgaguggaccauuauca

SEQ ID NO: 629799 - RNA, 23 nt, Homo sapiens
acgaucaaguuguugacugugau

SEQ ID NO: 629800 - RNA, 14 nt, Homo sapiens
acgaugacaguguu

SEQ ID NO: 629801 - RNA, 22 nt, Homo sapiens
acgauugaaaugaaaacucuau

SEQ ID NO: 629802 - RNA, 19 nt, Homo sapiens
acgauugaccuguccucuu

SEQ ID NO: 629803 - RNA, 13 nt, Homo sapiens
acgauuugucagu

SEQ ID NO: 629804 - RNA, 22 nt, Homo sapiens
acgcaauuuuaccuaguuugca

SEQ ID NO: 629805 - RNA, 14 nt, Homo sapiens
acgcacagugcagu

SEQ ID NO: 629806 - RNA, 15 nt, Homo sapiens
acgcacagugcaguu

SEQ ID NO: 629807 - RNA, 13 nt, Homo sapiens
acgcaccagacac

SEQ ID NO: 629808 - RNA, 14 nt, Homo sapiens
acgcaccugccuca

SEQ ID NO: 629809 - RNA, 17 nt, Homo sapiens
acgcacgcucgcugcca

SEQ ID NO: 629810 - RNA, 11 nt, Homo sapiens
acgcagaucac

SEQ ID NO: 629811 - RNA, 23 nt, Homo sapiens
acgcaggccacccgggcugccug

SEQ ID NO: 629812 - RNA, 13 nt, Homo sapiens
acgcaugcagugu

SEQ ID NO: 629813 - RNA, 15 nt, Homo sapiens
acgcaugugcagcua

SEQ ID NO: 629814 - RNA, 16 nt, Homo sapiens
acgcaugugcagcuau

SEQ ID NO: 629815 - RNA, 17 nt, Homo sapiens
acgcauucucguaucca

SEQ ID NO: 629816 - RNA, 19 nt, Homo sapiens
acgcauucucguauccaac

SEQ ID NO: 629817 - RNA, 15 nt, Homo sapiens
acgccagcuccucuc

SEQ ID NO: 629818 - RNA, 19 nt, Homo sapiens
acgccaguugccucuugaa

SEQ ID NO: 629819 - RNA, 22 nt, Homo sapiens
acgccauuuccuuuuccuucaa

SEQ ID NO: 629820 - RNA, 15 nt, Homo sapiens
acgcccuccccagac

SEQ ID NO: 629821 - RNA, 22 nt, Homo sapiens
acgccuacuuaagagugcugug

SEQ ID NO: 629822 - RNA, 17 nt, Homo sapiens
acgccucuuuucccucu

SEQ ID NO: 629823 - RNA, 14 nt, Homo sapiens
acgccugcccuccc

SEQ ID NO: 629824 - RNA, 17 nt, Homo sapiens
acgccuguaaucccagc

SEQ ID NO: 629825 - RNA, 19 nt, Homo sapiens
acgccuguaguccuagcca

SEQ ID NO: 629826 - RNA, 21 nt, Homo sapiens
acgccuguauucccacaccag

SEQ ID NO: 629827 - RNA, 14 nt, Homo sapiens
acgccuuguuccug

SEQ ID NO: 629828 - RNA, 20 nt, Homo sapiens
acgcgguuccagauguggau

SEQ ID NO: 629829 - RNA, 13 nt, Homo sapiens
acgcucgcugcca

SEQ ID NO: 629830 - RNA, 16 nt, Homo sapiens
acgcucgcugccauca

SEQ ID NO: 629831 - RNA, 21 nt, Homo sapiens
acgcucuccucgagcccuccc

SEQ ID NO: 629832 - RNA, 21 nt, Homo sapiens
acgcugcugucacaaccaaga

SEQ ID NO: 629833 - RNA, 15 nt, Homo sapiens
acgcugucuccagac

SEQ ID NO: 629834 - RNA, 20 nt, Homo sapiens
acgcuuaagucaucauuacu

SEQ ID NO: 629835 - RNA, 16 nt, Homo sapiens
acgcuugccuggucac

SEQ ID NO: 629836 - RNA, 14 nt, Homo sapiens
acgcuugugacagu

SEQ ID NO: 629837 - RNA, 21 nt, Homo sapiens
acgcuuugucacacaaaaagu

SEQ ID NO: 629838 - RNA, 19 nt, Homo sapiens
acgcuuuucuuuguuauac

SEQ ID NO: 629839 - RNA, 16 nt, Homo sapiens
acggaagaggcugcug

SEQ ID NO: 629840 - RNA, 22 nt, Homo sapiens
acggaagaggcugcugagaaag

SEQ ID NO: 629841 - RNA, 18 nt, Homo sapiens
acggacaaagagauugag

SEQ ID NO: 629842 - RNA, 12 nt, Homo sapiens
acggaccaaagc

SEQ ID NO: 629843 - RNA, 16 nt, Homo sapiens
acggacugucaguucu

SEQ ID NO: 629844 - RNA, 21 nt, Homo sapiens
acggagacuuucaaacauaua

SEQ ID NO: 629845 - RNA, 20 nt, Homo sapiens
acggagccacuccucugacu

SEQ ID NO: 629846 - RNA, 21 nt, Homo sapiens
acggagccgcgggacagccaa

SEQ ID NO: 629847 - RNA, 23 nt, Homo sapiens
acggaguuuaguuuuauauugcu

SEQ ID NO: 629848 - RNA, 21 nt, Homo sapiens
acggaucugcugggcucugcc

SEQ ID NO: 629849 - RNA, 20 nt, Homo sapiens
acggcaacugccuuccugcc

SEQ ID NO: 629850 - RNA, 17 nt, Homo sapiens
acggcgauucuccccau

SEQ ID NO: 629851 - RNA, 19 nt, Homo sapiens
acggcguuucaccauguug

SEQ ID NO: 629852 - RNA, 20 nt, Homo sapiens
acggcucacgcuuaccucaa

SEQ ID NO: 629853 - RNA, 18 nt, Homo sapiens
acggcuccuccuuaugac

SEQ ID NO: 629854 - RNA, 15 nt, Homo sapiens
acggcucucaccagu

SEQ ID NO: 629855 - RNA, 23 nt, Homo sapiens
acggcugcucggcuugaucacag

SEQ ID NO: 629856 - RNA, 17 nt, Homo sapiens
acgggaaacucaaggag

SEQ ID NO: 629857 - RNA, 22 nt, Homo sapiens
acgguaccaauucagugucugu

SEQ ID NO: 629858 - RNA, 17 nt, Homo sapiens
acggucaggaaaacugu

SEQ ID NO: 629859 - RNA, 13 nt, Homo sapiens
acggucugagcua

SEQ ID NO: 629860 - RNA, 19 nt, Homo sapiens
acggugaaaccccaucucu

SEQ ID NO: 629861 - RNA, 20 nt, Homo sapiens
acggugaaaccccaucucua

SEQ ID NO: 629862 - RNA, 21 nt, Homo sapiens
acggugcagucugggugcucg

SEQ ID NO: 629863 - RNA, 23 nt, Homo sapiens
acggugcccaaacaccagucacc

SEQ ID NO: 629864 - RNA, 14 nt, Homo sapiens
acggugcugugagg

SEQ ID NO: 629865 - RNA, 20 nt, Homo sapiens
acgguggcucaugccuguaa

SEQ ID NO: 629866 - RNA, 16 nt, Homo sapiens
acggugugcaccaaca

SEQ ID NO: 629867 - RNA, 20 nt, Homo sapiens
acgguuuuauaaaagccuug

SEQ ID NO: 629868 - RNA, 18 nt, Homo sapiens
acguaaaauuuacaguca

SEQ ID NO: 629869 - RNA, 19 nt, Homo sapiens
acguaaccuaugucagaca

SEQ ID NO: 629870 - RNA, 23 nt, Homo sapiens
acguacaaaauccagcuaugaau

SEQ ID NO: 629871 - RNA, 14 nt, Homo sapiens
acguaccuucaugu

SEQ ID NO: 629872 - RNA, 15 nt, Homo sapiens
acguaugaaugauau

SEQ ID NO: 629873 - RNA, 16 nt, Homo sapiens
acguaugguggcucau

SEQ ID NO: 629874 - RNA, 14 nt, Homo sapiens
acgucacugcacuc

SEQ ID NO: 629875 - RNA, 15 nt, Homo sapiens
acgucagugcucaga

SEQ ID NO: 629876 - RNA, 18 nt, Homo sapiens
acguccagcucguucucu

SEQ ID NO: 629877 - RNA, 18 nt, Homo sapiens
acgucgcccgcugagcug

SEQ ID NO: 629878 - RNA, 21 nt, Homo sapiens
acgucgcgguguguccucugu

SEQ ID NO: 629879 - RNA, 23 nt, Homo sapiens
acgucgcgguguguccucugugc

SEQ ID NO: 629880 - RNA, 19 nt, Homo sapiens
acgucuccuagccaaucag

SEQ ID NO: 629881 - RNA, 16 nt, Homo sapiens
acgucuggcucccugc

SEQ ID NO: 629882 - RNA, 18 nt, Homo sapiens
acgugaccucugcaagac

SEQ ID NO: 629883 - RNA, 10 nt, Homo sapiens
acgugcaaua

SEQ ID NO: 629884 - RNA, 17 nt, Homo sapiens
acgugcaggacagcucu

SEQ ID NO: 629885 - RNA, 19 nt, Homo sapiens
acgugcauuuaaacucugc

SEQ ID NO: 629886 - RNA, 16 nt, Homo sapiens
acgugccagcucuagu

SEQ ID NO: 629887 - RNA, 16 nt, Homo sapiens
acgugcugcucaagga

SEQ ID NO: 629888 - RNA, 19 nt, Homo sapiens
acguggaaccucugucuca

SEQ ID NO: 629889 - RNA, 14 nt, Homo sapiens
acguggacuccucu

SEQ ID NO: 629890 - RNA, 19 nt, Homo sapiens
acguggagagugcacugac

SEQ ID NO: 629891 - RNA, 12 nt, Homo sapiens
acguggccucuu

SEQ ID NO: 629892 - RNA, 17 nt, Homo sapiens
acguggccucuugagca

SEQ ID NO: 629893 - RNA, 13 nt, Homo sapiens
acgugggcauuuu

SEQ ID NO: 629894 - RNA, 19 nt, Homo sapiens
acguguguccuuugguacu

SEQ ID NO: 629895 - RNA, 11 nt, Homo sapiens
acguguugccu

SEQ ID NO: 629896 - RNA, 14 nt, Homo sapiens
acguugaauugaug

SEQ ID NO: 629897 - RNA, 22 nt, Homo sapiens
acguugccuaauaaacauccuu

SEQ ID NO: 629898 - RNA, 16 nt, Homo sapiens
acguuuaaagugcagu

SEQ ID NO: 629899 - RNA, 12 nt, Homo sapiens
acguuugauaca

SEQ ID NO: 629900 - RNA, 21 nt, Homo sapiens
acguuugcucauuuaagaauu

SEQ ID NO: 629901 - RNA, 13 nt, Homo sapiens
acguuugcuuaaa

SEQ ID NO: 629902 - RNA, 19 nt, Homo sapiens
acguuuguuucuucgugcc

SEQ ID NO: 629903 - RNA, 14 nt, Homo sapiens
acuaaaaaccaaug

SEQ ID NO: 629904 - RNA, 18 nt, Homo sapiens
acuaaaaaggaaacuuca

SEQ ID NO: 629905 - RNA, 14 nt, Homo sapiens
acuaaaaauauuau

SEQ ID NO: 629906 - RNA, 14 nt, Homo sapiens
acuaaaacacugaa

SEQ ID NO: 629907 - RNA, 19 nt, Homo sapiens
acuaaaagguaugcaauca

SEQ ID NO: 629908 - RNA, 16 nt, Homo sapiens
acuaaaaguacauuaa

SEQ ID NO: 629909 - RNA, 19 nt, Homo sapiens
acuaaaauuaggacuguau

SEQ ID NO: 629910 - RNA, 18 nt, Homo sapiens
acuaaacaacuaccuccu

SEQ ID NO: 629911 - RNA, 21 nt, Homo sapiens
acuaaacaacuaccuccucag

SEQ ID NO: 629912 - RNA, 20 nt, Homo sapiens
acuaaacagaaaacucccaa

SEQ ID NO: 629913 - RNA, 14 nt, Homo sapiens
acuaaacauuuugu

SEQ ID NO: 629914 - RNA, 23 nt, Homo sapiens
acuaaacugcugcaaaaguucuc

SEQ ID NO: 629915 - RNA, 12 nt, Homo sapiens
acuaaacuuuca

SEQ ID NO: 629916 - RNA, 15 nt, Homo sapiens
acuaaauucaaagaa

SEQ ID NO: 629917 - RNA, 16 nt, Homo sapiens
acucacagcaaggaug

SEQ ID NO: 629918 - RNA, 20 nt, Homo sapiens
acucacauacacacacaccu

SEQ ID NO: 629919 - RNA, 23 nt, Homo sapiens
acucacauucuauuaaaauuuag

SEQ ID NO: 629920 - RNA, 16 nt, Homo sapiens
acucaccaacuugcca

SEQ ID NO: 629921 - RNA, 14 nt, Homo sapiens
acucaccaccuuag

SEQ ID NO: 629922 - RNA, 22 nt, Homo sapiens
acucacccuccacaaagcaaag

SEQ ID NO: 629923 - RNA, 19 nt, Homo sapiens
acucacccugggagccagu

SEQ ID NO: 629924 - RNA, 20 nt, Homo sapiens
acucacccuuccuggcccag

SEQ ID NO: 629925 - RNA, 15 nt, Homo sapiens
acucaccugcacuaa

SEQ ID NO: 629926 - RNA, 16 nt, Homo sapiens
acucaccugcacuaac

SEQ ID NO: 629927 - RNA, 15 nt, Homo sapiens
acucaccuugucuca

SEQ ID NO: 629928 - RNA, 19 nt, Homo sapiens
acucacuauauaagucaca

SEQ ID NO: 629929 - RNA, 11 nt, Homo sapiens
acucacuccag

SEQ ID NO: 629930 - RNA, 21 nt, Homo sapiens
acucacugacucuucuaugca

SEQ ID NO: 629931 - RNA, 23 nt, Homo sapiens
acucacugcugcaaauacuguau

SEQ ID NO: 629932 - RNA, 12 nt, Homo sapiens
acucacugugau

SEQ ID NO: 629933 - RNA, 13 nt, Homo sapiens
acucacugugauc

SEQ ID NO: 629934 - RNA, 17 nt, Homo sapiens
acucacuucucuuuuua

SEQ ID NO: 629935 - RNA, 18 nt, Homo sapiens
acucacuugccauugcca

SEQ ID NO: 629936 - RNA, 14 nt, Homo sapiens
acucagaaagccaa

SEQ ID NO: 629937 - RNA, 22 nt, Homo sapiens
acucagaaugcacuugauucag

SEQ ID NO: 629938 - RNA, 16 nt, Homo sapiens
acucagacauuccaag

SEQ ID NO: 629939 - RNA, 15 nt, Homo sapiens
acucagagacuucac

SEQ ID NO: 629940 - RNA, 13 nt, Homo sapiens
acucagaugucca

SEQ ID NO: 629941 - RNA, 21 nt, Homo sapiens
acucagcacauucgggaccaa

SEQ ID NO: 629942 - RNA, 17 nt, Homo sapiens
acucaggaggcugaggc

SEQ ID NO: 629943 - RNA, 16 nt, Homo sapiens
acucaggagucugcca

SEQ ID NO: 629944 - RNA, 12 nt, Homo sapiens
acucaggaucca

SEQ ID NO: 629945 - RNA, 16 nt, Homo sapiens
acucaggauccaguga

SEQ ID NO: 629946 - RNA, 18 nt, Homo sapiens
acucaggccaacaagcca

SEQ ID NO: 629947 - RNA, 15 nt, Homo sapiens
acucaggccacagug

SEQ ID NO: 629948 - RNA, 21 nt, Homo sapiens
acucaggucuguaacugccca

SEQ ID NO: 629949 - RNA, 17 nt, Homo sapiens
acucagugcagcaauau

SEQ ID NO: 629950 - RNA, 18 nt, Homo sapiens
acucagugccuccacaug

SEQ ID NO: 629951 - RNA, 15 nt, Homo sapiens
acucauaaucuauaa

SEQ ID NO: 629952 - RNA, 18 nt, Homo sapiens
acucauagggugcucuga

SEQ ID NO: 629953 - RNA, 17 nt, Homo sapiens
acucauaggucccugac

SEQ ID NO: 629954 - RNA, 16 nt, Homo sapiens
acucauauucugggcu

SEQ ID NO: 629955 - RNA, 21 nt, Homo sapiens
acucaucaauggggccaguca

SEQ ID NO: 629956 - RNA, 20 nt, Homo sapiens
acucaucauuuucuacuugu

SEQ ID NO: 629957 - RNA, 20 nt, Homo sapiens
acucaugaaugaaaauacau

SEQ ID NO: 629958 - RNA, 16 nt, Homo sapiens
acucauuaaugaauca

SEQ ID NO: 629959 - RNA, 16 nt, Homo sapiens
acucauuagugacuuc

SEQ ID NO: 629960 - RNA, 15 nt, Homo sapiens
acucauucaguccca

SEQ ID NO: 629961 - RNA, 17 nt, Homo sapiens
acucauuucacagccuu

SEQ ID NO: 629962 - RNA, 18 nt, Homo sapiens
acucauuucacagccuuu

SEQ ID NO: 629963 - RNA, 14 nt, Homo sapiens
acuccaaccucucg

SEQ ID NO: 629964 - RNA, 12 nt, Homo sapiens
acuccaacugaa

SEQ ID NO: 629965 - RNA, 11 nt, Homo sapiens
acuccaaggag

SEQ ID NO: 629966 - RNA, 20 nt, Homo sapiens
acuccaaugucugcugagga

SEQ ID NO: 629967 - RNA, 17 nt, Homo sapiens
acuccacagucaauauu

SEQ ID NO: 629968 - RNA, 23 nt, Homo sapiens
acuccacccuccaccuuccauuu

SEQ ID NO: 629969 - RNA, 23 nt, Homo sapiens
acuccaccgaccaacugcccuaa

SEQ ID NO: 629970 - RNA, 13 nt, Homo sapiens
acuccaccucaaa

SEQ ID NO: 629971 - RNA, 14 nt, Homo sapiens
acuccacucagguu

SEQ ID NO: 629972 - RNA, 17 nt, Homo sapiens
acuccacuggucugucu

SEQ ID NO: 629973 - RNA, 14 nt, Homo sapiens
acuccagauaugaa

SEQ ID NO: 629974 - RNA, 14 nt, Homo sapiens
acuccagaugccac

SEQ ID NO: 629975 - RNA, 21 nt, Homo sapiens
acuccagauuuuuuacagcug

SEQ ID NO: 629976 - RNA, 16 nt, Homo sapiens
acuccaggauucagga

SEQ ID NO: 629977 - RNA, 19 nt, Homo sapiens
acuccaggggggacaauau

SEQ ID NO: 629978 - RNA, 13 nt, Homo sapiens
acuccaguagcuc

SEQ ID NO: 629979 - RNA, 13 nt, Homo sapiens
acuccagugccag

SEQ ID NO: 629980 - RNA, 15 nt, Homo sapiens
acuccaguggugaag

SEQ ID NO: 629981 - RNA, 15 nt, Homo sapiens
acuccaugagugucu

SEQ ID NO: 629982 - RNA, 13 nt, Homo sapiens
acuccaugcaaac

SEQ ID NO: 629983 - RNA, 18 nt, Homo sapiens
acuccaugcugccagccu

SEQ ID NO: 629984 - RNA, 15 nt, Homo sapiens
acucccaacccuggc

SEQ ID NO: 629985 - RNA, 19 nt, Homo sapiens
acucccaccacaggcauaa

SEQ ID NO: 629986 - RNA, 21 nt, Homo sapiens
acucccacucaguacuguaca

SEQ ID NO: 629987 - RNA, 12 nt, Homo sapiens
acucccagacau

SEQ ID NO: 629988 - RNA, 15 nt, Homo sapiens
acucccagcacuuug

SEQ ID NO: 629989 - RNA, 23 nt, Homo sapiens
acuccccauuaacagauggaaaa

SEQ ID NO: 629990 - RNA, 16 nt, Homo sapiens
acucccccaaccaagg

SEQ ID NO: 629991 - RNA, 19 nt, Homo sapiens
acucccggccugucauuca

SEQ ID NO: 629992 - RNA, 21 nt, Homo sapiens
acucccuagucuccaccugag

SEQ ID NO: 629993 - RNA, 21 nt, Homo sapiens
acucccucuugguuuuuauca

SEQ ID NO: 629994 - RNA, 15 nt, Homo sapiens
acucccugcugugug

SEQ ID NO: 629995 - RNA, 17 nt, Homo sapiens
acucccuuugccagugc

SEQ ID NO: 629996 - RNA, 12 nt, Homo sapiens
acuccuacuaaa

SEQ ID NO: 629997 - RNA, 12 nt, Homo sapiens
acuccucaagac

SEQ ID NO: 629998 - RNA, 14 nt, Homo sapiens
acuccuccaaagca

SEQ ID NO: 629999 - RNA, 17 nt, Homo sapiens
acuccuccucacuaaaa

SEQ ID NO: 630000 - RNA, 19 nt, Homo sapiens
acuccucucccacagagug

SEQ ID NO: 630001 - RNA, 23 nt, Homo sapiens
acuccugaagggaaggcaaaggc

SEQ ID NO: 630002 - RNA, 20 nt, Homo sapiens
acuccugaccccucuccuca

SEQ ID NO: 630003 - RNA, 12 nt, Homo sapiens
acuccugcaaaa

SEQ ID NO: 630004 - RNA, 16 nt, Homo sapiens
acuccugcccuguugu

SEQ ID NO: 630005 - RNA, 17 nt, Homo sapiens
acuccugggcucugaac

SEQ ID NO: 630006 - RNA, 19 nt, Homo sapiens
acuccuggguugagcuguu

SEQ ID NO: 630007 - RNA, 19 nt, Homo sapiens
acuccuguaacugucucag

SEQ ID NO: 630008 - RNA, 19 nt, Homo sapiens
acuccuguaggaagguuaa

SEQ ID NO: 630009 - RNA, 22 nt, Homo sapiens
acuccuuguaaagacuguagaa

SEQ ID NO: 630010 - RNA, 15 nt, Homo sapiens
acuccuuguggacug

SEQ ID NO: 630011 - RNA, 14 nt, Homo sapiens
acucgagagugggc

SEQ ID NO: 630012 - RNA, 19 nt, Homo sapiens
acucgcccgcccacugucc

SEQ ID NO: 630013 - RNA, 16 nt, Homo sapiens
acucgcuagcacucaa

SEQ ID NO: 630014 - RNA, 15 nt, Homo sapiens
acucggaaacuauaa

SEQ ID NO: 630015 - RNA, 21 nt, Homo sapiens
acucgggaccaauacuacuga

SEQ ID NO: 630016 - RNA, 14 nt, Homo sapiens
acucgggagcugca

SEQ ID NO: 630017 - RNA, 17 nt, Homo sapiens
acucgucuuccuuguua

SEQ ID NO: 630018 - RNA, 14 nt, Homo sapiens
acucuaaaaucuca

SEQ ID NO: 630019 - RNA, 20 nt, Homo sapiens
acucuaaaccccguguucaa

SEQ ID NO: 630020 - RNA, 13 nt, Homo sapiens
acucuaaacugca

SEQ ID NO: 630021 - RNA, 21 nt, Homo sapiens
acucuaaagucuguugauuaa

SEQ ID NO: 630022 - RNA, 16 nt, Homo sapiens
acucuaauagugcuua

SEQ ID NO: 630023 - RNA, 14 nt, Homo sapiens
acucuacagacucc

SEQ ID NO: 630024 - RNA, 15 nt, Homo sapiens
acucuagaaaaaagg

SEQ ID NO: 630025 - RNA, 18 nt, Homo sapiens
acucuaggguccagugga

SEQ ID NO: 630026 - RNA, 20 nt, Homo sapiens
acucuagugcuacaugaugc

SEQ ID NO: 630027 - RNA, 13 nt, Homo sapiens
acucuaguucugu

SEQ ID NO: 630028 - RNA, 20 nt, Homo sapiens
acucuaucauuggccuccaa

SEQ ID NO: 630029 - RNA, 22 nt, Homo sapiens
acucucacuccacccagaguag

SEQ ID NO: 630030 - RNA, 19 nt, Homo sapiens
acucucauccaaauggcau

SEQ ID NO: 630031 - RNA, 19 nt, Homo sapiens
acucuccaaauagcauuag

SEQ ID NO: 630032 - RNA, 18 nt, Homo sapiens
acucuccccuucuucccc

SEQ ID NO: 630033 - RNA, 14 nt, Homo sapiens
acucuccuagucaa

SEQ ID NO: 630034 - RNA, 11 nt, Homo sapiens
acucucugaac

SEQ ID NO: 630035 - RNA, 14 nt, Homo sapiens
acucucugaagaug

SEQ ID NO: 630036 - RNA, 18 nt, Homo sapiens
acucucugugaccugccc

SEQ ID NO: 630037 - RNA, 21 nt, Homo sapiens
acucucuuuccuugagcuguu

SEQ ID NO: 630038 - RNA, 15 nt, Homo sapiens
acucugaaagaccua

SEQ ID NO: 630039 - RNA, 14 nt, Homo sapiens
acucugaagccaca

SEQ ID NO: 630040 - RNA, 19 nt, Homo sapiens
gagccugccaaagugccug

SEQ ID NO: 630041 - RNA, 15 nt, Homo sapiens
gagccugguccuucc

SEQ ID NO: 630042 - RNA, 20 nt, Homo sapiens
gagccugguucagacacagc

SEQ ID NO: 630043 - RNA, 18 nt, Homo sapiens
gagccuuagaggucuuua

SEQ ID NO: 630044 - RNA, 20 nt, Homo sapiens
gagccuucucagaagcacag

SEQ ID NO: 630045 - RNA, 23 nt, Homo sapiens
gagccuuuuaccccugcacaguu

SEQ ID NO: 630046 - RNA, 11 nt, Homo sapiens
gagcgacccca

SEQ ID NO: 630047 - RNA, 20 nt, Homo sapiens
gagcgcaagauagauuugga

SEQ ID NO: 630048 - RNA, 13 nt, Homo sapiens
gagcgcacaggga

SEQ ID NO: 630049 - RNA, 14 nt, Homo sapiens
gagcgguaugcucu

SEQ ID NO: 630050 - RNA, 17 nt, Homo sapiens
gagcgugaaucuguauc

SEQ ID NO: 630051 - RNA, 18 nt, Homo sapiens
gagcuagaugugucuuac

SEQ ID NO: 630052 - RNA, 17 nt, Homo sapiens
gagcuagggcugcugcu

SEQ ID NO: 630053 - RNA, 17 nt, Homo sapiens
gagcuauggugaggugu

SEQ ID NO: 630054 - RNA, 23 nt, Homo sapiens
gagcuaugugacucggauggucu

SEQ ID NO: 630055 - RNA, 18 nt, Homo sapiens
gagcucagagaggcuaga

SEQ ID NO: 630056 - RNA, 14 nt, Homo sapiens
gagcuccccaucac

SEQ ID NO: 630057 - RNA, 21 nt, Homo sapiens
gagcucccgaggaagcacagc

SEQ ID NO: 630058 - RNA, 17 nt, Homo sapiens
gagcucuccaggccagg

SEQ ID NO: 630059 - RNA, 12 nt, Homo sapiens
gagcucucugag

SEQ ID NO: 630060 - RNA, 15 nt, Homo sapiens
gagcugaaaaacuua

SEQ ID NO: 630061 - RNA, 16 nt, Homo sapiens
gagcugaaaugcugca

SEQ ID NO: 630062 - RNA, 15 nt, Homo sapiens
gagcugaacuggggu

SEQ ID NO: 630063 - RNA, 14 nt, Homo sapiens
gagcugagcuggaa

SEQ ID NO: 630064 - RNA, 21 nt, Homo sapiens
gagcugaggauuuccuggagu

SEQ ID NO: 630065 - RNA, 15 nt, Homo sapiens
gagcugaguaaaaug

SEQ ID NO: 630066 - RNA, 13 nt, Homo sapiens
gagcugagugcug

SEQ ID NO: 630067 - RNA, 15 nt, Homo sapiens
gagcugagugcugaa

SEQ ID NO: 630068 - RNA, 16 nt, Homo sapiens
gaguugcagcucugua

SEQ ID NO: 630069 - RNA, 20 nt, Homo sapiens
gaguugccaagacaaaucaa

SEQ ID NO: 630070 - RNA, 20 nt, Homo sapiens
gaguugccaggcacuuugag

SEQ ID NO: 630071 - RNA, 15 nt, Homo sapiens
gaguuggaguuuuau

SEQ ID NO: 630072 - RNA, 18 nt, Homo sapiens
gaguugggacaauugcuu

SEQ ID NO: 630073 - RNA, 16 nt, Homo sapiens
gaguugggcagccagg

SEQ ID NO: 630074 - RNA, 17 nt, Homo sapiens
gaguugucaagucucug

SEQ ID NO: 630075 - RNA, 18 nt, Homo sapiens
gaguuguggaaagccucu

SEQ ID NO: 630076 - RNA, 20 nt, Homo sapiens
gaguuuaaaaaugguaucaa

SEQ ID NO: 630077 - RNA, 15 nt, Homo sapiens
gaguuuaacaugugu

SEQ ID NO: 630078 - RNA, 14 nt, Homo sapiens
gaguuuacauucua

SEQ ID NO: 630079 - RNA, 15 nt, Homo sapiens
gaguuuaguuuuaua

SEQ ID NO: 630080 - RNA, 19 nt, Homo sapiens
gaguuucacaaauccuuca

SEQ ID NO: 630081 - RNA, 18 nt, Homo sapiens
gaguuucacuguacugca

SEQ ID NO: 630082 - RNA, 18 nt, Homo sapiens
gaguuuccacuaucccaa

SEQ ID NO: 630083 - RNA, 14 nt, Homo sapiens
gaguuucugcaguu

SEQ ID NO: 630084 - RNA, 21 nt, Homo sapiens
gaguuugagcugccuucccua

SEQ ID NO: 630085 - RNA, 22 nt, Homo sapiens
gaguuuuccucuauacaucucu

SEQ ID NO: 630086 - RNA, 23 nt, Homo sapiens
gaguuuugaagcuuuaagcaaau

SEQ ID NO: 630087 - RNA, 17 nt, Homo sapiens
gaguuuuguauucaaua

SEQ ID NO: 630088 - RNA, 18 nt, Homo sapiens
gaguuuuuaaaaagugaa

SEQ ID NO: 630089 - RNA, 21 nt, Homo sapiens
gaguuuuuauuuuguuacaaa

SEQ ID NO: 630090 - RNA, 16 nt, Homo sapiens
gauaaaagguaauaac

SEQ ID NO: 630091 - RNA, 14 nt, Homo sapiens
gauaaaauuaauuu

SEQ ID NO: 630092 - RNA, 18 nt, Homo sapiens
gauaaacaucaaaauauu

SEQ ID NO: 630093 - RNA, 16 nt, Homo sapiens
gauaaacauuccuguu

SEQ ID NO: 630094 - RNA, 12 nt, Homo sapiens
gauaaaccaguu

SEQ ID NO: 630095 - RNA, 16 nt, Homo sapiens
gauaaagaugcaagga

SEQ ID NO: 630096 - RNA, 15 nt, Homo sapiens
gauaaagcacccugu

SEQ ID NO: 630097 - RNA, 18 nt, Homo sapiens
gauaaagucaaaugccaa

SEQ ID NO: 630098 - RNA, 15 nt, Homo sapiens
gauaaaguuccuuaa

SEQ ID NO: 630099 - RNA, 16 nt, Homo sapiens
gauaaaugauagacaa

SEQ ID NO: 630100 - RNA, 16 nt, Homo sapiens
gauaacagccucuugc

SEQ ID NO: 630101 - RNA, 18 nt, Homo sapiens
gauaaccuugugccuugg

SEQ ID NO: 630102 - RNA, 18 nt, Homo sapiens
gauaacucugagcaguuu

SEQ ID NO: 630103 - RNA, 20 nt, Homo sapiens
gauaacuuggggaggcaaga

SEQ ID NO: 630104 - RNA, 20 nt, Homo sapiens
gauaagaacagagugccugc

SEQ ID NO: 630105 - RNA, 21 nt, Homo sapiens
gauaagcuugucuaugguaca

SEQ ID NO: 630106 - RNA, 21 nt, Homo sapiens
gauaaguagggcuaagccagu

SEQ ID NO: 630107 - RNA, 15 nt, Homo sapiens
gauaaguguccccua

SEQ ID NO: 630108 - RNA, 15 nt, Homo sapiens
gauaauacacuauua

SEQ ID NO: 630109 - RNA, 22 nt, Homo sapiens
gauaauacuugaccucugugac

SEQ ID NO: 630110 - RNA, 19 nt, Homo sapiens
gauaaugcuguugccucau

SEQ ID NO: 630111 - RNA, 17 nt, Homo sapiens
gauaauucuggaccaga

SEQ ID NO: 630112 - RNA, 12 nt, Homo sapiens
gauaauucuuaa

SEQ ID NO: 630113 - RNA, 15 nt, Homo sapiens
gauacaaaguacaga

SEQ ID NO: 630114 - RNA, 15 nt, Homo sapiens
gauacaauaaauugc

SEQ ID NO: 630115 - RNA, 20 nt, Homo sapiens
gauacaaugaacacuuauaa

SEQ ID NO: 630116 - RNA, 15 nt, Homo sapiens
gauacacugcagcug

SEQ ID NO: 630117 - RNA, 13 nt, Homo sapiens
gauacauaaagac

SEQ ID NO: 630118 - RNA, 21 nt, Homo sapiens
gauacauaaugggccacugaa

SEQ ID NO: 630119 - RNA, 21 nt, Homo sapiens
gauacaucacugcuugaugaa

SEQ ID NO: 630120 - RNA, 19 nt, Homo sapiens
gauacaugcauugcucuua

SEQ ID NO: 630121 - RNA, 13 nt, Homo sapiens
gauaccacugcac

SEQ ID NO: 630122 - RNA, 20 nt, Homo sapiens
gauacccaggaccaagccac

SEQ ID NO: 630123 - RNA, 17 nt, Homo sapiens
gauaccuccaacccugc

SEQ ID NO: 630124 - RNA, 15 nt, Homo sapiens
gauacugaugcauug

SEQ ID NO: 630125 - RNA, 13 nt, Homo sapiens
gauacugcugagu

SEQ ID NO: 630126 - RNA, 21 nt, Homo sapiens
gauacuuggaugcagcucuug

SEQ ID NO: 630127 - RNA, 17 nt, Homo sapiens
gauacuuuagccaucau

SEQ ID NO: 630128 - RNA, 11 nt, Homo sapiens
gauacuuugac

SEQ ID NO: 630129 - RNA, 13 nt, Homo sapiens
gauagaacuacuu

SEQ ID NO: 630130 - RNA, 14 nt, Homo sapiens
gauagacacuggac

SEQ ID NO: 630131 - RNA, 21 nt, Homo sapiens
gauagacuuugugaaucugaa

SEQ ID NO: 630132 - RNA, 15 nt, Homo sapiens
gauagagaccaucuu

SEQ ID NO: 630133 - RNA, 15 nt, Homo sapiens
gauagauauaugcuc

SEQ ID NO: 630134 - RNA, 17 nt, Homo sapiens
gauagcaaauggccuca

SEQ ID NO: 630135 - RNA, 23 nt, Homo sapiens
gauagcauggggccccuggccca

SEQ ID NO: 630136 - RNA, 14 nt, Homo sapiens
gauagcauugcuuu

SEQ ID NO: 630137 - RNA, 22 nt, Homo sapiens
gauagcccaggagcaacagccu

SEQ ID NO: 630138 - RNA, 21 nt, Homo sapiens
gauagcuucaccccaauccca

SEQ ID NO: 630139 - RNA, 14 nt, Homo sapiens
gauaggccuguggg

SEQ ID NO: 630140 - RNA, 12 nt, Homo sapiens
gauagggacuga

SEQ ID NO: 630141 - RNA, 23 nt, Homo sapiens
gauaggggcagauaggagcugca

SEQ ID NO: 630142 - RNA, 17 nt, Homo sapiens
gauaguccuuccuggca

SEQ ID NO: 630143 - RNA, 13 nt, Homo sapiens
gauagugguauga

SEQ ID NO: 630144 - RNA, 11 nt, Homo sapiens
gauaguguucu

SEQ ID NO: 630145 - RNA, 19 nt, Homo sapiens
gauaguugauucuugccuu

SEQ ID NO: 630146 - RNA, 18 nt, Homo sapiens
gauauaaaaauaauguca

SEQ ID NO: 630147 - RNA, 21 nt, Homo sapiens
gauauagcuaggugacauaua

SEQ ID NO: 630148 - RNA, 21 nt, Homo sapiens
gauauaggucagugaggccca

SEQ ID NO: 630149 - RNA, 15 nt, Homo sapiens
gauauauacaaggug

SEQ ID NO: 630150 - RNA, 18 nt, Homo sapiens
gauauauacacacagugg

SEQ ID NO: 630151 - RNA, 15 nt, Homo sapiens
gauauauaugugcuc

SEQ ID NO: 630152 - RNA, 13 nt, Homo sapiens
gauauaugcucug

SEQ ID NO: 630153 - RNA, 20 nt, Homo sapiens
gauauauguguauacauaca

SEQ ID NO: 630154 - RNA, 16 nt, Homo sapiens
gauaucaccucucuuc

SEQ ID NO: 630155 - RNA, 17 nt, Homo sapiens
gauaucaccucucuuca

SEQ ID NO: 630156 - RNA, 21 nt, Homo sapiens
gauaucauuuaggaguauuau

SEQ ID NO: 630157 - RNA, 17 nt, Homo sapiens
gauaucucaaucugcag

SEQ ID NO: 630158 - RNA, 11 nt, Homo sapiens
gauaucuugga

SEQ ID NO: 630159 - RNA, 15 nt, Homo sapiens
gauaucuuugcugcu

SEQ ID NO: 630160 - RNA, 17 nt, Homo sapiens
gauaugacccacacugc

SEQ ID NO: 630161 - RNA, 19 nt, Homo sapiens
gauaugcacuugaaaugau

SEQ ID NO: 630162 - RNA, 18 nt, Homo sapiens
gauauggcacuucuccaa

SEQ ID NO: 630163 - RNA, 12 nt, Homo sapiens
gauauguaagag

SEQ ID NO: 630164 - RNA, 18 nt, Homo sapiens
gauauuaacaacaauaac

SEQ ID NO: 630165 - RNA, 19 nt, Homo sapiens
gauauucuaagaaauaucu

SEQ ID NO: 630166 - RNA, 19 nt, Homo sapiens
gauauuugaagcaucacau

SEQ ID NO: 630167 - RNA, 16 nt, Homo sapiens
gauauuuuaaauaucc

SEQ ID NO: 630168 - RNA, 17 nt, Homo sapiens
gauauuuucacacuggu

SEQ ID NO: 630169 - RNA, 19 nt, Homo sapiens
gauauuuuuaugugcagcg

SEQ ID NO: 630170 - RNA, 17 nt, Homo sapiens
gauauuuuuuacuuuag

SEQ ID NO: 630171 - RNA, 18 nt, Homo sapiens
gaucaaagaaauucagaa

SEQ ID NO: 630172 - RNA, 13 nt, Homo sapiens
gaucaaauacuuu

SEQ ID NO: 630173 - RNA, 18 nt, Homo sapiens
gaucaacauuuaugaccu

SEQ ID NO: 630174 - RNA, 18 nt, Homo sapiens
gaucaacgccucacugaa

SEQ ID NO: 630175 - RNA, 18 nt, Homo sapiens
gaucaagaaaaaaaggga

SEQ ID NO: 630176 - RNA, 13 nt, Homo sapiens
gaucaagccaguu

SEQ ID NO: 630177 - RNA, 18 nt, Homo sapiens
gaucaauaaaaugugauu

SEQ ID NO: 630178 - RNA, 15 nt, Homo sapiens
gaucaauuucaacau

SEQ ID NO: 630179 - RNA, 15 nt, Homo sapiens
gaucacacaguguua

SEQ ID NO: 630180 - RNA, 16 nt, Homo sapiens
gaucaccaagcaggaa

SEQ ID NO: 630181 - RNA, 16 nt, Homo sapiens
gaucacgacaggaaaa

SEQ ID NO: 630182 - RNA, 19 nt, Homo sapiens
gaucacuaaauaagcuucc

SEQ ID NO: 630183 - RNA, 20 nt, Homo sapiens
gaucacuaaauaagcuucca

SEQ ID NO: 630184 - RNA, 19 nt, Homo sapiens
gaucacucaccauucccag

SEQ ID NO: 630185 - RNA, 12 nt, Homo sapiens
gaucacuccugg

SEQ ID NO: 630186 - RNA, 14 nt, Homo sapiens
gaucacugccacac

SEQ ID NO: 630187 - RNA, 20 nt, Homo sapiens
gaucacuggggggcucucag

SEQ ID NO: 630188 - RNA, 11 nt, Homo sapiens
gaucacuugag

SEQ ID NO: 630189 - RNA, 19 nt, Homo sapiens
gaucagacuuuaauuucuc

SEQ ID NO: 630190 - RNA, 19 nt, Homo sapiens
gaucagcaaaccggggccu

SEQ ID NO: 630191 - RNA, 19 nt, Homo sapiens
gauggccaagcaauuccuc

SEQ ID NO: 630192 - RNA, 17 nt, Homo sapiens
gauggcccaagggaugg

SEQ ID NO: 630193 - RNA, 22 nt, Homo sapiens
gauggcgaggccucucucagga

SEQ ID NO: 630194 - RNA, 23 nt, Homo sapiens
gauggcgaggccucucucaggag

SEQ ID NO: 630195 - RNA, 22 nt, Homo sapiens
gauggcucagagggggacugcu

SEQ ID NO: 630196 - RNA, 21 nt, Homo sapiens
gauggcuggggcucucuccau

SEQ ID NO: 630197 - RNA, 19 nt, Homo sapiens
gauggcuuuuucuccuugg

SEQ ID NO: 630198 - RNA, 20 nt, Homo sapiens
gaugggacacccaacacuuu

SEQ ID NO: 630199 - RNA, 17 nt, Homo sapiens
gaugggaccagggaugg

SEQ ID NO: 630200 - RNA, 22 nt, Homo sapiens
gaugggaggagagccacugggc

SEQ ID NO: 630201 - RNA, 19 nt, Homo sapiens
gaugggagugggcaccuca

SEQ ID NO: 630202 - RNA, 12 nt, Homo sapiens
gaugggcaaagc

SEQ ID NO: 630203 - RNA, 15 nt, Homo sapiens
gaugggcaacuggcu

SEQ ID NO: 630204 - RNA, 15 nt, Homo sapiens
gaugggccaccgggg

SEQ ID NO: 630205 - RNA, 14 nt, Homo sapiens
gauggggcucccag

SEQ ID NO: 630206 - RNA, 15 nt, Homo sapiens
gaugggggaugcuuc

SEQ ID NO: 630207 - RNA, 23 nt, Homo sapiens
gaugggguaaucuauaacacauc

SEQ ID NO: 630208 - RNA, 22 nt, Homo sapiens
gauggguauuaaacuugucaga

SEQ ID NO: 630209 - RNA, 14 nt, Homo sapiens
gauggguggugcuc

SEQ ID NO: 630210 - RNA, 19 nt, Homo sapiens
gauggucccaggaagcagg

SEQ ID NO: 630211 - RNA, 18 nt, Homo sapiens
gauggugacauugaaacu

SEQ ID NO: 630212 - RNA, 13 nt, Homo sapiens
gaugguggcacag

SEQ ID NO: 630213 - RNA, 17 nt, Homo sapiens
gaugguguccuucccug

SEQ ID NO: 630214 - RNA, 14 nt, Homo sapiens
gaugguucauauca

SEQ ID NO: 630215 - RNA, 22 nt, Homo sapiens
gaugguucuucuccaguuagaa

SEQ ID NO: 630216 - RNA, 14 nt, Homo sapiens
gauguaaccaagcu

SEQ ID NO: 630217 - RNA, 22 nt, Homo sapiens
gauguaccaggcucucgcacac

SEQ ID NO: 630218 - RNA, 23 nt, Homo sapiens
gauguauaaugaaaaaggauaau

SEQ ID NO: 630219 - RNA, 13 nt, Homo sapiens
gauguauauccau

SEQ ID NO: 630220 - RNA, 16 nt, Homo sapiens
gauguaugaaggcuuu

SEQ ID NO: 630221 - RNA, 14 nt, Homo sapiens
gauguaugcagcua

SEQ ID NO: 630222 - RNA, 23 nt, Homo sapiens
gauguauuuuugauguauauauc

SEQ ID NO: 630223 - RNA, 14 nt, Homo sapiens
gaugucacaaagau

SEQ ID NO: 630224 - RNA, 18 nt, Homo sapiens
gaugucacaugucagaga

SEQ ID NO: 630225 - RNA, 21 nt, Homo sapiens
gaugucauaucauuucacugu

SEQ ID NO: 630226 - RNA, 12 nt, Homo sapiens
gaugucauuuga

SEQ ID NO: 630227 - RNA, 20 nt, Homo sapiens
gauguccccaaaguaccaca

SEQ ID NO: 630228 - RNA, 12 nt, Homo sapiens
gauguccuacua

SEQ ID NO: 630229 - RNA, 22 nt, Homo sapiens
gaugucgcccuacucaccugag

SEQ ID NO: 630230 - RNA, 16 nt, Homo sapiens
gaugucggucuugcaa

SEQ ID NO: 630231 - RNA, 17 nt, Homo sapiens
gaugucucuuguagaag

SEQ ID NO: 630232 - RNA, 17 nt, Homo sapiens
gaugugaaaaucaugaa

SEQ ID NO: 630233 - RNA, 16 nt, Homo sapiens
gaugugaaaugaaugu

SEQ ID NO: 630234 - RNA, 15 nt, Homo sapiens
gaugugacauuccau

SEQ ID NO: 630235 - RNA, 15 nt, Homo sapiens
gaugugaguccuguu

SEQ ID NO: 630236 - RNA, 17 nt, Homo sapiens
gaugugaucacugagac

SEQ ID NO: 630237 - RNA, 19 nt, Homo sapiens
gaugugaucauagcucacu

SEQ ID NO: 630238 - RNA, 16 nt, Homo sapiens
gaugugauuagugucu

SEQ ID NO: 630239 - RNA, 17 nt, Homo sapiens
gaugugcugcagcgcuu

SEQ ID NO: 630240 - RNA, 21 nt, Homo sapiens
gaugugggccaaguccacugu

SEQ ID NO: 630241 - RNA, 20 nt, Homo sapiens
gauguguauacguaggaauu

SEQ ID NO: 630242 - RNA, 20 nt, Homo sapiens
gaugugugucucaccccuca

SEQ ID NO: 630243 - RNA, 20 nt, Homo sapiens
gauguuaacaagaggggaaa

SEQ ID NO: 630244 - RNA, 13 nt, Homo sapiens
gauguuaaccaau

SEQ ID NO: 630245 - RNA, 21 nt, Homo sapiens
gauguuagaaagugcugauaa

SEQ ID NO: 630246 - RNA, 16 nt, Homo sapiens
gauguuagcagaccca

SEQ ID NO: 630247 - RNA, 21 nt, Homo sapiens
gauguucauccuaacaugaca

SEQ ID NO: 630248 - RNA, 18 nt, Homo sapiens
gauguuccaccugccaca

SEQ ID NO: 630249 - RNA, 17 nt, Homo sapiens
gauguugaaacuuugaa

SEQ ID NO: 630250 - RNA, 16 nt, Homo sapiens
gauguugaacugguca

SEQ ID NO: 630251 - RNA, 20 nt, Homo sapiens
gauguugacgccuaacugaa

SEQ ID NO: 630252 - RNA, 18 nt, Homo sapiens
gauguugcuggacuguca

SEQ ID NO: 630253 - RNA, 19 nt, Homo sapiens
gauguuuacagacugugag

SEQ ID NO: 630254 - RNA, 20 nt, Homo sapiens
gauguuuccugggugcccug

SEQ ID NO: 630255 - RNA, 18 nt, Homo sapiens
gauguuugaggcuuucag

SEQ ID NO: 630256 - RNA, 20 nt, Homo sapiens
gauguuugaggcuuucagaa

SEQ ID NO: 630257 - RNA, 13 nt, Homo sapiens
gauguuuuacgca

SEQ ID NO: 630258 - RNA, 20 nt, Homo sapiens
gauguuuuacgucugggaga

SEQ ID NO: 630259 - RNA, 15 nt, Homo sapiens
gauuaaaagcacaag

SEQ ID NO: 630260 - RNA, 13 nt, Homo sapiens
gauuaaacuuaau

SEQ ID NO: 630261 - RNA, 17 nt, Homo sapiens
gauuaacaacaggaaau

SEQ ID NO: 630262 - RNA, 17 nt, Homo sapiens
gauuaagaguugccaaa

SEQ ID NO: 630263 - RNA, 20 nt, Homo sapiens
gauuaauggaaauguuuaca

SEQ ID NO: 630264 - RNA, 17 nt, Homo sapiens
gauuaauuuuuccauaa

SEQ ID NO: 630265 - RNA, 21 nt, Homo sapiens
gauuacaaaucagaagucauc

SEQ ID NO: 630266 - RNA, 23 nt, Homo sapiens
gauuacaaggcuuuaucucaggg

SEQ ID NO: 630267 - RNA, 18 nt, Homo sapiens
gauuaccagucugauuau

SEQ ID NO: 630268 - RNA, 17 nt, Homo sapiens
gauuaccgacacuguca

SEQ ID NO: 630269 - RNA, 20 nt, Homo sapiens
gauuacuaucauggcauaua

SEQ ID NO: 630270 - RNA, 17 nt, Homo sapiens
gauuacucuuugagaua

SEQ ID NO: 630271 - RNA, 15 nt, Homo sapiens
gauuacuggugugag

SEQ ID NO: 630272 - RNA, 22 nt, Homo sapiens
gauuacuguccagcuuauaguc

SEQ ID NO: 630273 - RNA, 19 nt, Homo sapiens
gauuacuuugcugccuuaa

SEQ ID NO: 630274 - RNA, 17 nt, Homo sapiens
gauuagaugacucucag

SEQ ID NO: 630275 - RNA, 23 nt, Homo sapiens
gauuagguagacuuugcuuagua

SEQ ID NO: 630276 - RNA, 21 nt, Homo sapiens
gauuaguauucaggcacugag

SEQ ID NO: 630277 - RNA, 17 nt, Homo sapiens
gauuauaugaaugccua

SEQ ID NO: 630278 - RNA, 14 nt, Homo sapiens
gauuaucuacagaa

SEQ ID NO: 630279 - RNA, 16 nt, Homo sapiens
gauuaugaaagcaaca

SEQ ID NO: 630280 - RNA, 20 nt, Homo sapiens
gauuaugaugcauacaguuu

SEQ ID NO: 630281 - RNA, 15 nt, Homo sapiens
gauuauuuaucacau

SEQ ID NO: 630282 - RNA, 12 nt, Homo sapiens
gauuauuugaac

SEQ ID NO: 630283 - RNA, 12 nt, Homo sapiens
gauuauuugcau

SEQ ID NO: 630284 - RNA, 18 nt, Homo sapiens
gauuauuuuuuauacugu

SEQ ID NO: 630285 - RNA, 14 nt, Homo sapiens
gauucaaaucuaug

SEQ ID NO: 630286 - RNA, 13 nt, Homo sapiens
gauucaagccauu

SEQ ID NO: 630287 - RNA, 15 nt, Homo sapiens
gauucaauauugaau

SEQ ID NO: 630288 - RNA, 15 nt, Homo sapiens
gauucaccucuucuu

SEQ ID NO: 630289 - RNA, 21 nt, Homo sapiens
gauucacuuuguuuaugcaua

SEQ ID NO: 630290 - RNA, 22 nt, Homo sapiens
gauucagaaauuggaacagaau

SEQ ID NO: 630291 - RNA, 20 nt, Homo sapiens
gauucagacuuggacuauga

SEQ ID NO: 630292 - RNA, 17 nt, Homo sapiens
gauucagaugucauuua

SEQ ID NO: 630293 - RNA, 19 nt, Homo sapiens
uauaacuccuuguuucaga

SEQ ID NO: 630294 - RNA, 12 nt, Homo sapiens
uauaacucugca

SEQ ID NO: 630295 - RNA, 16 nt, Homo sapiens
uauaacuguauuugaa

SEQ ID NO: 630296 - RNA, 12 nt, Homo sapiens
uauaacugucuu

SEQ ID NO: 630297 - RNA, 21 nt, Homo sapiens
uauaacuuaggccuagccucu

SEQ ID NO: 630298 - RNA, 22 nt, Homo sapiens
uauaacuuaggccuagccucuu

SEQ ID NO: 630299 - RNA, 22 nt, Homo sapiens
uauaagaaaagcagacgcagca

SEQ ID NO: 630300 - RNA, 13 nt, Homo sapiens
uauaagcaaaaac

SEQ ID NO: 630301 - RNA, 21 nt, Homo sapiens
uauaagcaagaaggcaaaaau

SEQ ID NO: 630302 - RNA, 17 nt, Homo sapiens
uauaagcagucuuucua

SEQ ID NO: 630303 - RNA, 20 nt, Homo sapiens
uauaagcauacaacuggacu

SEQ ID NO: 630304 - RNA, 12 nt, Homo sapiens
uauaagcuuaaa

SEQ ID NO: 630305 - RNA, 16 nt, Homo sapiens
uauaagguacauauuu

SEQ ID NO: 630306 - RNA, 12 nt, Homo sapiens
uauaagugcuca

SEQ ID NO: 630307 - RNA, 12 nt, Homo sapiens
uauaauacugua

SEQ ID NO: 630308 - RNA, 15 nt, Homo sapiens
uauaauauuguacag

SEQ ID NO: 630309 - RNA, 22 nt, Homo sapiens
uauaaucaaagcucauaaugga

SEQ ID NO: 630310 - RNA, 13 nt, Homo sapiens
uauaaucauauca

SEQ ID NO: 630311 - RNA, 22 nt, Homo sapiens
uauaaucaucaaguaauacaaa

SEQ ID NO: 630312 - RNA, 20 nt, Homo sapiens
uauaaucugcagugaugcaa

SEQ ID NO: 630313 - RNA, 15 nt, Homo sapiens
uauauuuuugugcac

SEQ ID NO: 630314 - RNA, 23 nt, Homo sapiens
uauauuuuuuaaaauaagucuga

SEQ ID NO: 630315 - RNA, 15 nt, Homo sapiens
uaucaaaaagcuaau

SEQ ID NO: 630316 - RNA, 21 nt, Homo sapiens
uaucaaaaagcuaaugugcag

SEQ ID NO: 630317 - RNA, 15 nt, Homo sapiens
uaucaaaaaguauua

SEQ ID NO: 630318 - RNA, 20 nt, Homo sapiens
uaucaaaacaaguacugguu

SEQ ID NO: 630319 - RNA, 14 nt, Homo sapiens
uaucaacagcauuu

SEQ ID NO: 630320 - RNA, 22 nt, Homo sapiens
uaucaauccaggcuacaaucuu

SEQ ID NO: 630321 - RNA, 20 nt, Homo sapiens
uaucaaugaguaacaggaaa

SEQ ID NO: 630322 - RNA, 18 nt, Homo sapiens
uaucaauuacaacaguga

SEQ ID NO: 630323 - RNA, 20 nt, Homo sapiens
uaucaauuggcagugacuuu

SEQ ID NO: 630324 - RNA, 17 nt, Homo sapiens
uaucaccgugggcuccc

SEQ ID NO: 630325 - RNA, 16 nt, Homo sapiens
uaucacgccuacuuaa

SEQ ID NO: 630326 - RNA, 23 nt, Homo sapiens
uaucacuaaaaauuuuuacaaaa

SEQ ID NO: 630327 - RNA, 20 nt, Homo sapiens
uaucacucaauuucucugag

SEQ ID NO: 630328 - RNA, 19 nt, Homo sapiens
uaucacuuaaacuugcauc

SEQ ID NO: 630329 - RNA, 14 nt, Homo sapiens
uaucagaauucuca

SEQ ID NO: 630330 - RNA, 13 nt, Homo sapiens
uaucagacaagca

SEQ ID NO: 630331 - RNA, 15 nt, Homo sapiens
uaucagcaauacuca

SEQ ID NO: 630332 - RNA, 12 nt, Homo sapiens
uaucaggagaaa

SEQ ID NO: 630333 - RNA, 14 nt, Homo sapiens
uaucaggggugcau

SEQ ID NO: 630334 - RNA, 17 nt, Homo sapiens
uaucaggggugcauucu

SEQ ID NO: 630335 - RNA, 15 nt, Homo sapiens
uaucaggguauucca

SEQ ID NO: 630336 - RNA, 22 nt, Homo sapiens
uaucaggucccaucaauucuua

SEQ ID NO: 630337 - RNA, 20 nt, Homo sapiens
uaucagguguauaaauguac

SEQ ID NO: 630338 - RNA, 15 nt, Homo sapiens
uaucaguacaugccu

SEQ ID NO: 630339 - RNA, 17 nt, Homo sapiens
uaucauaacuauacuug

SEQ ID NO: 630340 - RNA, 18 nt, Homo sapiens
uaucauaauucagcacuu

SEQ ID NO: 630341 - RNA, 20 nt, Homo sapiens
uaucauaauucagcacuuaa

SEQ ID NO: 630342 - RNA, 18 nt, Homo sapiens
uaucaucuuuugaucuuu

SEQ ID NO: 630343 - RNA, 19 nt, Homo sapiens
uaucaugaagcacaucaau

SEQ ID NO: 630344 - RNA, 11 nt, Homo sapiens
uaucaugcaaa

SEQ ID NO: 630345 - RNA, 20 nt, Homo sapiens
uaucaugguagucacuaaca

SEQ ID NO: 630346 - RNA, 19 nt, Homo sapiens
uaucauuuauccuuacauu

SEQ ID NO: 630347 - RNA, 17 nt, Homo sapiens
uauccaaagacuguacu

SEQ ID NO: 630348 - RNA, 23 nt, Homo sapiens
uauccacagcuuacagcaauuug

SEQ ID NO: 630349 - RNA, 21 nt, Homo sapiens
uauccaccucccuaccaaaaa

SEQ ID NO: 630350 - RNA, 17 nt, Homo sapiens
uauccagaaggggagcu

SEQ ID NO: 630351 - RNA, 22 nt, Homo sapiens
uauccagaggaauugauuguca

SEQ ID NO: 630352 - RNA, 18 nt, Homo sapiens
uauccagcagaucauuua

SEQ ID NO: 630353 - RNA, 12 nt, Homo sapiens
uauccaucuccu

SEQ ID NO: 630354 - RNA, 13 nt, Homo sapiens
uauccaugcaccu

SEQ ID NO: 630355 - RNA, 22 nt, Homo sapiens
uaucccacauccaacuccagca

SEQ ID NO: 630356 - RNA, 15 nt, Homo sapiens
uaucccagugaucac

SEQ ID NO: 630357 - RNA, 18 nt, Homo sapiens
uauccccaccuacuccug

SEQ ID NO: 630358 - RNA, 21 nt, Homo sapiens
uaucccuacauguauugcaca

SEQ ID NO: 630359 - RNA, 16 nt, Homo sapiens
uaucccuugacaaaaa

SEQ ID NO: 630360 - RNA, 14 nt, Homo sapiens
uauccuauguuaaa

SEQ ID NO: 630361 - RNA, 23 nt, Homo sapiens
uauccugacaaguuccuaggaaa

SEQ ID NO: 630362 - RNA, 20 nt, Homo sapiens
uauccugagccaucggugaa

SEQ ID NO: 630363 - RNA, 12 nt, Homo sapiens
uauccuguucuu

SEQ ID NO: 630364 - RNA, 17 nt, Homo sapiens
uauccuugcaccucagc

SEQ ID NO: 630365 - RNA, 15 nt, Homo sapiens
uaucgggaacagugu

SEQ ID NO: 630366 - RNA, 17 nt, Homo sapiens
uaucgggaacaguguuu

SEQ ID NO: 630367 - RNA, 18 nt, Homo sapiens
uaucguaaagcuguucaa

SEQ ID NO: 630368 - RNA, 20 nt, Homo sapiens
uaucgucaggaaaccaaaua

SEQ ID NO: 630369 - RNA, 21 nt, Homo sapiens
uaucuaacccucccauggcac

SEQ ID NO: 630370 - RNA, 18 nt, Homo sapiens
uaucuacaauacauauau

SEQ ID NO: 630371 - RNA, 14 nt, Homo sapiens
uaucuagcauuuau

SEQ ID NO: 630372 - RNA, 14 nt, Homo sapiens
uaucuauuaucuca

SEQ ID NO: 630373 - RNA, 16 nt, Homo sapiens
uaucucaaacuacugg

SEQ ID NO: 630374 - RNA, 23 nt, Homo sapiens
uaucucaaacuacuggcaauuug

SEQ ID NO: 630375 - RNA, 13 nt, Homo sapiens
uaucucagccaua

SEQ ID NO: 630376 - RNA, 11 nt, Homo sapiens
uaucucaggga

SEQ ID NO: 630377 - RNA, 22 nt, Homo sapiens
uaucucaggggccaacuaggca

SEQ ID NO: 630378 - RNA, 14 nt, Homo sapiens
uaucucauuacuua

SEQ ID NO: 630379 - RNA, 12 nt, Homo sapiens
uaucuccuccaa

SEQ ID NO: 630380 - RNA, 23 nt, Homo sapiens
uaucuccugacagaaggugccac

SEQ ID NO: 630381 - RNA, 14 nt, Homo sapiens
uaucugaaccaaga

SEQ ID NO: 630382 - RNA, 14 nt, Homo sapiens
uaucugauuuccua

SEQ ID NO: 630383 - RNA, 21 nt, Homo sapiens
uaucugcucuuaggugcuucu

SEQ ID NO: 630384 - RNA, 21 nt, Homo sapiens
uaucugggugcaugaucuuga

SEQ ID NO: 630385 - RNA, 15 nt, Homo sapiens
uaucuguacagauca

SEQ ID NO: 630386 - RNA, 15 nt, Homo sapiens
uaucugucauauagu

SEQ ID NO: 630387 - RNA, 15 nt, Homo sapiens
uaucugucuuuccac

SEQ ID NO: 630388 - RNA, 18 nt, Homo sapiens
uaucugugaauucagauu

SEQ ID NO: 630389 - RNA, 13 nt, Homo sapiens
uaucugugcuuug

SEQ ID NO: 630390 - RNA, 13 nt, Homo sapiens
uaucuguucuguu

SEQ ID NO: 630391 - RNA, 13 nt, Homo sapiens
uaucuguugccuu

SEQ ID NO: 630392 - RNA, 11 nt, Homo sapiens
uaucuuaccug

SEQ ID NO: 630393 - RNA, 18 nt, Homo sapiens
uaucuuauauacuuauca

SEQ ID NO: 630394 - RNA, 22 nt, Homo sapiens
uaucuucagcccaggcuuuugc

SEQ ID NO: 630395 - RNA, 20 nt, Homo sapiens
uaucuuccaaaugcaauuug

SEQ ID NO: 630396 - RNA, 20 nt, Homo sapiens
uaucuugaauguaguauuca

SEQ ID NO: 630397 - RNA, 15 nt, Homo sapiens
uaucuugauaaacua

SEQ ID NO: 630398 - RNA, 17 nt, Homo sapiens
uaucuuggacaaaucac

SEQ ID NO: 630399 - RNA, 19 nt, Homo sapiens
uaucuuuauguagcacuac

SEQ ID NO: 630400 - RNA, 19 nt, Homo sapiens
uaucuuuauuaaucacuau

SEQ ID NO: 630401 - RNA, 14 nt, Homo sapiens
uaucuuucaaagag

SEQ ID NO: 630402 - RNA, 16 nt, Homo sapiens
uaucuuucuaaaacug

SEQ ID NO: 630403 - RNA, 19 nt, Homo sapiens
uaugaaaaaucaaugucaa

SEQ ID NO: 630404 - RNA, 20 nt, Homo sapiens
uaugaaaacagcuaucucac

SEQ ID NO: 630405 - RNA, 20 nt, Homo sapiens
uaugaaaauauagacauucu

SEQ ID NO: 630406 - RNA, 12 nt, Homo sapiens
uaugaaacugca

SEQ ID NO: 630407 - RNA, 22 nt, Homo sapiens
uaugaaauaaaauuacacagua

SEQ ID NO: 630408 - RNA, 14 nt, Homo sapiens
uaugaacaacagua

SEQ ID NO: 630409 - RNA, 12 nt, Homo sapiens
uaugaacacaga

SEQ ID NO: 630410 - RNA, 20 nt, Homo sapiens
uaugaacuugagaucuguau

SEQ ID NO: 630411 - RNA, 13 nt, Homo sapiens
uaugaacuuuaua

SEQ ID NO: 630412 - RNA, 12 nt, Homo sapiens
uaugaaguacag

SEQ ID NO: 630413 - RNA, 15 nt, Homo sapiens
uaugaauaugauccc

SEQ ID NO: 630414 - RNA, 17 nt, Homo sapiens
uaugaaucacaguauug

SEQ ID NO: 630415 - RNA, 16 nt, Homo sapiens
uaugacaagcuuucca

SEQ ID NO: 630416 - RNA, 13 nt, Homo sapiens
uaugaccacuggg

SEQ ID NO: 630417 - RNA, 23 nt, Homo sapiens
uaugaccucgcccuccacaaaug

SEQ ID NO: 630418 - RNA, 13 nt, Homo sapiens
uaugacucagaga

SEQ ID NO: 630419 - RNA, 21 nt, Homo sapiens
gcaacagauaaguuugcaguu

SEQ ID NO: 630420 - RNA, 24 nt, Homo sapiens
gcaacagauggauagucuguccaa

SEQ ID NO: 630421 - RNA, 13 nt, Homo sapiens
gcaacagcacugg

SEQ ID NO: 630422 - RNA, 22 nt, Homo sapiens
gcaacauuauuuguaauagcca

SEQ ID NO: 630423 - RNA, 16 nt, Homo sapiens
gcaacauuguacaagu

SEQ ID NO: 630424 - RNA, 16 nt, Homo sapiens
gcaacauuguccuuaa

SEQ ID NO: 630425 - RNA, 17 nt, Homo sapiens
gcaacauuuguauggau

SEQ ID NO: 630426 - RNA, 14 nt, Homo sapiens
gcaaccacuaagaa

SEQ ID NO: 630427 - RNA, 20 nt, Homo sapiens
gcaaccagaggaaacuugca

SEQ ID NO: 630428 - RNA, 20 nt, Homo sapiens
gcaaccaggcagcugagacc

SEQ ID NO: 630429 - RNA, 21 nt, Homo sapiens
gcaacccacguguaacuguca

SEQ ID NO: 630430 - RNA, 12 nt, Homo sapiens
gcaaccucugua

SEQ ID NO: 630431 - RNA, 23 nt, Homo sapiens
gcaaccuuuuugauuucuuccag

SEQ ID NO: 630432 - RNA, 23 nt, Homo sapiens
gcaacguaagauguccuccuuga

SEQ ID NO: 630433 - RNA, 21 nt, Homo sapiens
gcaacuaaaaugugucuugcu

SEQ ID NO: 630434 - RNA, 13 nt, Homo sapiens
gcaacuaaggaca

SEQ ID NO: 630435 - RNA, 13 nt, Homo sapiens
ucacaugugaaaa

SEQ ID NO: 630436 - RNA, 14 nt, Homo sapiens
ucacaugugacaaa

SEQ ID NO: 630437 - RNA, 14 nt, Homo sapiens
ucacauucaggaag

SEQ ID NO: 630438 - RNA, 14 nt, Homo sapiens
ucacauucuuggcu

SEQ ID NO: 630439 - RNA, 15 nt, Homo sapiens
ucacauucuuuccaa

SEQ ID NO: 630440 - RNA, 14 nt, Homo sapiens
ucacauugugccuu

SEQ ID NO: 630441 - RNA, 19 nt, Homo sapiens
ucacauuuagaaaagugaa

SEQ ID NO: 630442 - RNA, 16 nt, Homo sapiens
ucacauuucuaugcca

SEQ ID NO: 630443 - RNA, 11 nt, Homo sapiens
ucacauuugcg

SEQ ID NO: 630444 - RNA, 23 nt, Homo sapiens
ucacauuuguauguguguagacu

SEQ ID NO: 630445 - RNA, 15 nt, Homo sapiens
ucacauuuuaccaau

SEQ ID NO: 630446 - RNA, 15 nt, Homo sapiens
ucacauuuugccuuu

SEQ ID NO: 630447 - RNA, 19 nt, Homo sapiens
ucacauuuuuuuaugcucu

SEQ ID NO: 630448 - RNA, 18 nt, Homo sapiens
ucaccaaaucagcugcua

SEQ ID NO: 630449 - RNA, 19 nt, Homo sapiens
ucaccaagcuaggugcuau

SEQ ID NO: 630450 - RNA, 14 nt, Homo sapiens
ucaccaagugcaau

SEQ ID NO: 630451 - RNA, 12 nt, Homo sapiens
ucaccaaugagc

SEQ ID NO: 630452 - RNA, 22 nt, Homo sapiens
ucaccaauggcuccuugcccuc

SEQ ID NO: 630453 - RNA, 21 nt, Homo sapiens
ucaccacaccacagguucuca

SEQ ID NO: 630454 - RNA, 17 nt, Homo sapiens
ucaccaccaaaugccaa

SEQ ID NO: 630455 - RNA, 18 nt, Homo sapiens
ucaccacguggggcucac

SEQ ID NO: 630456 - RNA, 14 nt, Homo sapiens
ucaccacugcuuua

SEQ ID NO: 630457 - RNA, 15 nt, Homo sapiens
ucaccacugcuuuaa

SEQ ID NO: 630458 - RNA, 22 nt, Homo sapiens
ucaccacuguaguucucucauu

SEQ ID NO: 630459 - RNA, 13 nt, Homo sapiens
ucaccacuucccu

SEQ ID NO: 630460 - RNA, 19 nt, Homo sapiens
ucaccagacccgagucaau

SEQ ID NO: 630461 - RNA, 18 nt, Homo sapiens
ucaccagcccuagcuguc

SEQ ID NO: 630462 - RNA, 18 nt, Homo sapiens
ucaccagcuaucugucau

SEQ ID NO: 630463 - RNA, 20 nt, Homo sapiens
ucaccagucugucuacugug

SEQ ID NO: 630464 - RNA, 21 nt, Homo sapiens
ucaccagucugucuacugugg

SEQ ID NO: 630465 - RNA, 18 nt, Homo sapiens
ucaccaguggccuuucag

SEQ ID NO: 630466 - RNA, 19 nt, Homo sapiens
ucaccaguuaaaagcauuu

SEQ ID NO: 630467 - RNA, 17 nt, Homo sapiens
ucaccauacacacuguu

SEQ ID NO: 630468 - RNA, 19 nt, Homo sapiens
ucaccauguuagccuuaga

SEQ ID NO: 630469 - RNA, 15 nt, Homo sapiens
ucaccauugugaagc

SEQ ID NO: 630470 - RNA, 19 nt, Homo sapiens
ucaccauuucuuggcauug

SEQ ID NO: 630471 - RNA, 19 nt, Homo sapiens
ucaccauuuggcaaugcca

SEQ ID NO: 630472 - RNA, 20 nt, Homo sapiens
ucaccauuuggcaaugccau

SEQ ID NO: 630473 - RNA, 22 nt, Homo sapiens
ucacccaaagccugucccagga

SEQ ID NO: 630474 - RNA, 20 nt, Homo sapiens
ucacccaggcuggacugcaa

SEQ ID NO: 630475 - RNA, 16 nt, Homo sapiens
ucacccauuggugacc

SEQ ID NO: 630476 - RNA, 18 nt, Homo sapiens
ucaccccaacuaguagcu

SEQ ID NO: 630477 - RNA, 17 nt, Homo sapiens
ucacccgggacucuccc

SEQ ID NO: 630478 - RNA, 14 nt, Homo sapiens
ucacccucaugaaa

SEQ ID NO: 630479 - RNA, 16 nt, Homo sapiens
ucacccuguauguuag

SEQ ID NO: 630480 - RNA, 17 nt, Homo sapiens
ucacccugucaaguuaa

SEQ ID NO: 630481 - RNA, 20 nt, Homo sapiens
ucacccuugcaccguccuca

SEQ ID NO: 630482 - RNA, 16 nt, Homo sapiens
ucacccuuguccuuga

SEQ ID NO: 630483 - RNA, 14 nt, Homo sapiens
ucaccgacaacaug

SEQ ID NO: 630484 - RNA, 16 nt, Homo sapiens
ucaccgacaacaugcu

SEQ ID NO: 630485 - RNA, 18 nt, Homo sapiens
ucaccgcugggugguuuu

SEQ ID NO: 630486 - RNA, 21 nt, Homo sapiens
ucaccguggaccuuccugcca

SEQ ID NO: 630487 - RNA, 20 nt, Homo sapiens
ucaccuaaacuuguacuuua

SEQ ID NO: 630488 - RNA, 20 nt, Homo sapiens
ucaccuaagucucugugaau

SEQ ID NO: 630489 - RNA, 15 nt, Homo sapiens
ucaccuacuccagag

SEQ ID NO: 630490 - RNA, 22 nt, Homo sapiens
ucaccucacugaaaacaucugg

SEQ ID NO: 630491 - RNA, 17 nt, Homo sapiens
ucaccuccucugugauu

SEQ ID NO: 630492 - RNA, 18 nt, Homo sapiens
ucaccuccucugugauuu

SEQ ID NO: 630493 - RNA, 20 nt, Homo sapiens
ucaccucuccuacucacuua

SEQ ID NO: 630494 - RNA, 15 nt, Homo sapiens
ucaccucuuccucug

SEQ ID NO: 630495 - RNA, 21 nt, Homo sapiens
ucaccuggacuuaagcaucug

SEQ ID NO: 630496 - RNA, 18 nt, Homo sapiens
ucaccuggcuaacugaug

SEQ ID NO: 630497 - RNA, 18 nt, Homo sapiens
ucaccugggccuuuccug

SEQ ID NO: 630498 - RNA, 13 nt, Homo sapiens
ucaccuguaaaac

SEQ ID NO: 630499 - RNA, 15 nt, Homo sapiens
ucaccuuaucuggaa

SEQ ID NO: 630500 - RNA, 20 nt, Homo sapiens
ucaccuuauucuucauuucg

SEQ ID NO: 630501 - RNA, 14 nt, Homo sapiens
ucaccuuccagugu

SEQ ID NO: 630502 - RNA, 14 nt, Homo sapiens
ucaccuuccauguc

SEQ ID NO: 630503 - RNA, 15 nt, Homo sapiens
ucaccuucuagucuu

SEQ ID NO: 630504 - RNA, 21 nt, Homo sapiens
ucaccuucuagucuuggccag

SEQ ID NO: 630505 - RNA, 20 nt, Homo sapiens
ucaccuuuuuuuaaguagua

SEQ ID NO: 630506 - RNA, 20 nt, Homo sapiens
ucacgaacuguucacacugc

SEQ ID NO: 630507 - RNA, 23 nt, Homo sapiens
ucacgaacuguucacacugcaga

SEQ ID NO: 630508 - RNA, 14 nt, Homo sapiens
ucacgaacuugaaa

SEQ ID NO: 630509 - RNA, 20 nt, Homo sapiens
ucacgaacuugaaaguuuuc

SEQ ID NO: 630510 - RNA, 14 nt, Homo sapiens
ucacgacuggucac

SEQ ID NO: 630511 - RNA, 19 nt, Homo sapiens
ucacgccuguaaucccagc

SEQ ID NO: 630512 - RNA, 13 nt, Homo sapiens
ucacgcggcagcu

SEQ ID NO: 630513 - RNA, 14 nt, Homo sapiens
ucacggccaagugu

SEQ ID NO: 630514 - RNA, 14 nt, Homo sapiens
ucacggcugcgcac

SEQ ID NO: 630515 - RNA, 17 nt, Homo sapiens
ucacggcugcgcacugu

SEQ ID NO: 630516 - RNA, 14 nt, Homo sapiens
ucacguguggaauu

SEQ ID NO: 630517 - RNA, 17 nt, Homo sapiens
ucacuaaaauuaaucug

SEQ ID NO: 630518 - RNA, 19 nt, Homo sapiens
ucacuaaacucucauuucu

SEQ ID NO: 630519 - RNA, 17 nt, Homo sapiens
ucacuaaaguauccuga

SEQ ID NO: 630520 - RNA, 19 nt, Homo sapiens
ucacuaaugaucacauucu

SEQ ID NO: 630521 - RNA, 12 nt, Homo sapiens
ucacuacaggug

SEQ ID NO: 630522 - RNA, 18 nt, Homo sapiens
ucacuagaaguccugcug

SEQ ID NO: 630523 - RNA, 20 nt, Homo sapiens
ucacuagaaguccugcugga

SEQ ID NO: 630524 - RNA, 22 nt, Homo sapiens
ucacuagccaugauaacugcaa

SEQ ID NO: 630525 - RNA, 23 nt, Homo sapiens
ucacuagccaugauaacugcaau

SEQ ID NO: 630526 - RNA, 21 nt, Homo sapiens
ucacuaggcccccacuugccu

SEQ ID NO: 630527 - RNA, 22 nt, Homo sapiens
ucacuaggcccccacuugccuc

SEQ ID NO: 630528 - RNA, 15 nt, Homo sapiens
ucacuaugcauuuua

SEQ ID NO: 630529 - RNA, 16 nt, Homo sapiens
ucacucaccauuccca

SEQ ID NO: 630530 - RNA, 20 nt, Homo sapiens
ucacucauuaaugaaucaca

SEQ ID NO: 630531 - RNA, 14 nt, Homo sapiens
ucacucauugcuga

SEQ ID NO: 630532 - RNA, 17 nt, Homo sapiens
ucacuccaaugucugcu

SEQ ID NO: 630533 - RNA, 21 nt, Homo sapiens
ucacucccucugccuucaggc

SEQ ID NO: 630534 - RNA, 23 nt, Homo sapiens
ucacuccuuuuuugcaugugcaa

SEQ ID NO: 630535 - RNA, 19 nt, Homo sapiens
ucacucuaagucauguaug

SEQ ID NO: 630536 - RNA, 23 nt, Homo sapiens
ucacucucugaagaugaucauuu

SEQ ID NO: 630537 - RNA, 11 nt, Homo sapiens
ucacucuguca

SEQ ID NO: 630538 - RNA, 17 nt, Homo sapiens
ucacucugucagccagc

SEQ ID NO: 630539 - RNA, 14 nt, Homo sapiens
ucacucuucacuug

SEQ ID NO: 630540 - RNA, 15 nt, Homo sapiens
ucacucuucacuuga

SEQ ID NO: 630541 - RNA, 19 nt, Homo sapiens
ucacugaaaacaucuggaa

SEQ ID NO: 630542 - RNA, 11 nt, Homo sapiens
ucacugaacaa

SEQ ID NO: 630543 - RNA, 22 nt, Homo sapiens
ucacugaagaaaccuucagauu

SEQ ID NO: 630544 - RNA, 16 nt, Homo sapiens
ucacugaaucuucacg

SEQ ID NO: 630545 - RNA, 14 nt, Homo sapiens
ucacugacaguuaa

SEQ ID NO: 630546 - RNA, 14 nt, Homo sapiens
ucacugagaagauu

SEQ ID NO: 630547 - RNA, 22 nt, Homo sapiens
ucacugagaagauugugaauau

SEQ ID NO: 630548 - RNA, 14 nt, Homo sapiens
ucacugcaaccucc

SEQ ID NO: 630549 - RNA, 19 nt, Homo sapiens
gccaccagggaguggccau

SEQ ID NO: 630550 - RNA, 17 nt, Homo sapiens
gccaccagucacugucc

SEQ ID NO: 630551 - RNA, 13 nt, Homo sapiens
gccaccaguucuc

SEQ ID NO: 630552 - RNA, 21 nt, Homo sapiens
gccacccccaggcaucuguua

SEQ ID NO: 630553 - RNA, 13 nt, Homo sapiens
gccacccuaccug

SEQ ID NO: 630554 - RNA, 22 nt, Homo sapiens
gccacccucacacacacagcug

SEQ ID NO: 630555 - RNA, 14 nt, Homo sapiens
gccacccucuggga

SEQ ID NO: 630556 - RNA, 23 nt, Homo sapiens
gccaccgugauagaaaaaaaauc

SEQ ID NO: 630557 - RNA, 23 nt, Homo sapiens
gccauuggggcagggacccuccu

SEQ ID NO: 630558 - RNA, 16 nt, Homo sapiens
gccauuucacucucaa

SEQ ID NO: 630559 - RNA, 14 nt, Homo sapiens
gccauuugccauca

SEQ ID NO: 630560 - RNA, 15 nt, Homo sapiens
gccauuuuucugggg

SEQ ID NO: 630561 - RNA, 14 nt, Homo sapiens
gcccaaacccuuaa

SEQ ID NO: 630562 - RNA, 19 nt, Homo sapiens
gcccaaacuggagugcagu

SEQ ID NO: 630563 - RNA, 16 nt, Homo sapiens
gcccaaauucuuucag

SEQ ID NO: 630564 - RNA, 18 nt, Homo sapiens
gcccaaccuaaugcucuc

SEQ ID NO: 630565 - RNA, 16 nt, Homo sapiens
gcccaaccuauccugu

SEQ ID NO: 630566 - RNA, 20 nt, Homo sapiens
gcccaaccuccuauauauag

SEQ ID NO: 630567 - RNA, 17 nt, Homo sapiens
gcccaacuccaccagau

SEQ ID NO: 630568 - RNA, 19 nt, Homo sapiens
gcccaacugcagaccaacu

SEQ ID NO: 630569 - RNA, 18 nt, Homo sapiens
gcccaaggagcuuaccca

SEQ ID NO: 630570 - RNA, 15 nt, Homo sapiens
gcccaauacagccau

SEQ ID NO: 630571 - RNA, 22 nt, Homo sapiens
gcccaaucucugccauaucagu

SEQ ID NO: 630572 - RNA, 12 nt, Homo sapiens
gcccaauuccag

SEQ ID NO: 630573 - RNA, 13 nt, Homo sapiens
gcccacaucccag

SEQ ID NO: 630574 - RNA, 18 nt, Homo sapiens
gcccacauuaagcacugu

SEQ ID NO: 630575 - RNA, 14 nt, Homo sapiens
gcccaccagccagc

SEQ ID NO: 630576 - RNA, 19 nt, Homo sapiens
gcccacccccaacaggaau

SEQ ID NO: 630577 - RNA, 23 nt, Homo sapiens
gcccacccccagucuccagggac

SEQ ID NO: 630578 - RNA, 20 nt, Homo sapiens
gcccacccgucuucaaucuc

SEQ ID NO: 630579 - RNA, 14 nt, Homo sapiens
gcccaccuccuucc

SEQ ID NO: 630580 - RNA, 15 nt, Homo sapiens
gcccacgcagaggac

SEQ ID NO: 630581 - RNA, 16 nt, Homo sapiens
gcccacggcaacugcc

SEQ ID NO: 630582 - RNA, 16 nt, Homo sapiens
gcccacuagacccacu

SEQ ID NO: 630583 - RNA, 22 nt, Homo sapiens
gcccacucuguaauaguucagu

SEQ ID NO: 630584 - RNA, 14 nt, Homo sapiens
gcccacuggccgcu

SEQ ID NO: 630585 - RNA, 19 nt, Homo sapiens
gcccagaaucauguggcca

SEQ ID NO: 630586 - RNA, 14 nt, Homo sapiens
gcccagacaagauu

SEQ ID NO: 630587 - RNA, 21 nt, Homo sapiens
gcccagacacagacuggcaau

SEQ ID NO: 630588 - RNA, 22 nt, Homo sapiens
gcccagacacagacuggcaaua

SEQ ID NO: 630589 - RNA, 20 nt, Homo sapiens
gcccagacaccaugugcaau

SEQ ID NO: 630590 - RNA, 14 nt, Homo sapiens
gcccagacccagcc

SEQ ID NO: 630591 - RNA, 22 nt, Homo sapiens
gcccagacgcagcugagucgga

SEQ ID NO: 630592 - RNA, 15 nt, Homo sapiens
gcccagacugaugag

SEQ ID NO: 630593 - RNA, 15 nt, Homo sapiens
gcccagagccuggcu

SEQ ID NO: 630594 - RNA, 20 nt, Homo sapiens
gcccagaucaccaccugaac

SEQ ID NO: 630595 - RNA, 14 nt, Homo sapiens
gcccagcacugucu

SEQ ID NO: 630596 - RNA, 22 nt, Homo sapiens
gcccagcagagguuugcugaca

SEQ ID NO: 630597 - RNA, 17 nt, Homo sapiens
gcccagcaggcaggcac

SEQ ID NO: 630598 - RNA, 22 nt, Homo sapiens
gcccagccaggccaacagcacc

SEQ ID NO: 630599 - RNA, 23 nt, Homo sapiens
gcccagccccuacugcugugaac

SEQ ID NO: 630600 - RNA, 23 nt, Homo sapiens
gcccagccuuguaaauaaccaca

SEQ ID NO: 630601 - RNA, 22 nt, Homo sapiens
gcccagcggccccucccacaca

SEQ ID NO: 630602 - RNA, 21 nt, Homo sapiens
gcccagcucauguaggugagc

SEQ ID NO: 630603 - RNA, 14 nt, Homo sapiens
gcccagcugcaccu

SEQ ID NO: 630604 - RNA, 23 nt, Homo sapiens
gcccagcuuuuagaaaaugcagu

SEQ ID NO: 630605 - RNA, 17 nt, Homo sapiens
gcccaggaaacaagggg

SEQ ID NO: 630606 - RNA, 14 nt, Homo sapiens
gcccaggagcaaca

SEQ ID NO: 630607 - RNA, 20 nt, Homo sapiens
gcccaggccuugcugacucu

SEQ ID NO: 630608 - RNA, 20 nt, Homo sapiens
gcccaggcuggaaugcagug

SEQ ID NO: 630609 - RNA, 15 nt, Homo sapiens
gcccaggcuggagcu

SEQ ID NO: 630610 - RNA, 18 nt, Homo sapiens
gcccaggcuggagugcaa

SEQ ID NO: 630611 - RNA, 20 nt, Homo sapiens
gcccaggcuggaguggagug

SEQ ID NO: 630612 - RNA, 16 nt, Homo sapiens
gcccagggaagccaaa

SEQ ID NO: 630613 - RNA, 16 nt, Homo sapiens
gcccaggguuuugccc

SEQ ID NO: 630614 - RNA, 20 nt, Homo sapiens
gcccaggucucucaacuuca

SEQ ID NO: 630615 - RNA, 15 nt, Homo sapiens
gcccaguccuuccac

SEQ ID NO: 630616 - RNA, 18 nt, Homo sapiens
gcccagucgagaccucac

SEQ ID NO: 630617 - RNA, 17 nt, Homo sapiens
gcccagugcacugaaag

SEQ ID NO: 630618 - RNA, 19 nt, Homo sapiens
gcccaguuagaagcgacuu

SEQ ID NO: 630619 - RNA, 14 nt, Homo sapiens
gcccauaaccagua

SEQ ID NO: 630620 - RNA, 14 nt, Homo sapiens
gcccauaucuguga

SEQ ID NO: 630621 - RNA, 20 nt, Homo sapiens
gcccaucagccauuugccau

SEQ ID NO: 630622 - RNA, 14 nt, Homo sapiens
gcccauccagucuc

SEQ ID NO: 630623 - RNA, 13 nt, Homo sapiens
gcccaucucaaca

SEQ ID NO: 630624 - RNA, 19 nt, Homo sapiens
gcccaugcccaccugccca

SEQ ID NO: 630625 - RNA, 22 nt, Homo sapiens
gcccauggcuuuagcuaccuca

SEQ ID NO: 630626 - RNA, 23 nt, Homo sapiens
gcccauggcuuuagcuaccucac

SEQ ID NO: 630627 - RNA, 20 nt, Homo sapiens
gcccaugugugagugugugc

SEQ ID NO: 630628 - RNA, 23 nt, Homo sapiens
gcccaugugugagugugugcaag

SEQ ID NO: 630629 - RNA, 17 nt, Homo sapiens
gcccauucuucugggug

SEQ ID NO: 630630 - RNA, 20 nt, Homo sapiens
gcccauuuuucuagacuguc

SEQ ID NO: 630631 - RNA, 16 nt, Homo sapiens
gccccaaaaccacagc

SEQ ID NO: 630632 - RNA, 20 nt, Homo sapiens
gccccaacaagcaccccgcu

SEQ ID NO: 630633 - RNA, 17 nt, Homo sapiens
gccccaaucuugcccac

SEQ ID NO: 630634 - RNA, 22 nt, Homo sapiens
gccccacccaguuucuggaaaa

SEQ ID NO: 630635 - RNA, 22 nt, Homo sapiens
gccccacucccuggccaucuca

SEQ ID NO: 630636 - RNA, 12 nt, Homo sapiens
gccccacugcca

SEQ ID NO: 630637 - RNA, 12 nt, Homo sapiens
gccccacuuuga

SEQ ID NO: 630638 - RNA, 13 nt, Homo sapiens
gccccacuuugaa

SEQ ID NO: 630639 - RNA, 18 nt, Homo sapiens
gccccagaaggcagggaa

SEQ ID NO: 630640 - RNA, 23 nt, Homo sapiens
gccccagagcuguuuauggccuc

SEQ ID NO: 630641 - RNA, 16 nt, Homo sapiens
gccccagccccuucca

SEQ ID NO: 630642 - RNA, 16 nt, Homo sapiens
gccccagucggcccca

SEQ ID NO: 630643 - RNA, 20 nt, Homo sapiens
gccccagugcgguuccucau

SEQ ID NO: 630644 - RNA, 19 nt, Homo sapiens
gccccaguuuggggugcca

SEQ ID NO: 630645 - RNA, 16 nt, Homo sapiens
gccccauccuguguua

SEQ ID NO: 630646 - RNA, 22 nt, Homo sapiens
gccccaugcugcccgcuucuca

SEQ ID NO: 630647 - RNA, 12 nt, Homo sapiens
gcccccaccagc

SEQ ID NO: 630648 - RNA, 16 nt, Homo sapiens
gcccccaccucagguu

SEQ ID NO: 630649 - RNA, 14 nt, Homo sapiens
gcccccacuccagu

SEQ ID NO: 630650 - RNA, 21 nt, Homo sapiens
gcccccagcagauggaaagaa

SEQ ID NO: 630651 - RNA, 23 nt, Homo sapiens
gcccccaggccaggugaggucca

SEQ ID NO: 630652 - RNA, 21 nt, Homo sapiens
gccccccagaaagcugccaga

SEQ ID NO: 630653 - RNA, 20 nt, Homo sapiens
gccccccuugccagacaugu

SEQ ID NO: 630654 - RNA, 20 nt, Homo sapiens
gcccccgccugccaccggag

SEQ ID NO: 630655 - RNA, 14 nt, Homo sapiens
gcccccgcuguguc

SEQ ID NO: 630656 - RNA, 18 nt, Homo sapiens
gcccccuccacaccagug

SEQ ID NO: 630657 - RNA, 22 nt, Homo sapiens
gcccccuccaggagagagccag

SEQ ID NO: 630658 - RNA, 16 nt, Homo sapiens
gcccccuccucuagcu

SEQ ID NO: 630659 - RNA, 13 nt, Homo sapiens
gcccccucuacca

SEQ ID NO: 630660 - RNA, 13 nt, Homo sapiens
gcccccuugccca

SEQ ID NO: 630661 - RNA, 18 nt, Homo sapiens
gcccccuugggugaccuc

SEQ ID NO: 630662 - RNA, 23 nt, Homo sapiens
gccccgaaccucaccugaccuca

SEQ ID NO: 630663 - RNA, 16 nt, Homo sapiens
gccccgccgccuggua

SEQ ID NO: 630664 - RNA, 16 nt, Homo sapiens
gccccggcugugccag

SEQ ID NO: 630665 - RNA, 19 nt, Homo sapiens
gccccguccuugugccagg

SEQ ID NO: 630666 - RNA, 15 nt, Homo sapiens
gccccguuucuugcc

SEQ ID NO: 630667 - RNA, 14 nt, Homo sapiens
gccccuaaguuauu

SEQ ID NO: 630668 - RNA, 11 nt, Homo sapiens
gccccuacccc

SEQ ID NO: 630669 - RNA, 16 nt, Homo sapiens
gccccuacccuggacu

SEQ ID NO: 630670 - RNA, 16 nt, Homo sapiens
gccccuacugcuguga

SEQ ID NO: 630671 - RNA, 15 nt, Homo sapiens
gccccuaugugacag

SEQ ID NO: 630672 - RNA, 17 nt, Homo sapiens
gccccucacauccucuc

SEQ ID NO: 630673 - RNA, 17 nt, Homo sapiens
gccccuccugugacgca

SEQ ID NO: 630674 - RNA, 13 nt, Homo sapiens
ucagcaaugauua

SEQ ID NO: 630675 - RNA, 21 nt, Homo sapiens
ucagcacaggaauucucaaga

SEQ ID NO: 630676 - RNA, 13 nt, Homo sapiens
ucagcacauucca

SEQ ID NO: 630677 - RNA, 14 nt, Homo sapiens
ucagcaccagugaa

SEQ ID NO: 630678 - RNA, 17 nt, Homo sapiens
ucagcaccugacccugu

SEQ ID NO: 630679 - RNA, 13 nt, Homo sapiens
gaaauauuuccau

SEQ ID NO: 630680 - RNA, 23 nt, Homo sapiens
gaaauauuuccauuaacagcaau

SEQ ID NO: 630681 - RNA, 21 nt, Homo sapiens
gaaauauuugucuucucaggc

SEQ ID NO: 630682 - RNA, 19 nt, Homo sapiens
gaaauauuuuacaguuuuu

SEQ ID NO: 630683 - RNA, 17 nt, Homo sapiens
gaaaucaaaaagggaau

SEQ ID NO: 630684 - RNA, 14 nt, Homo sapiens
gaaaucacugugaa

SEQ ID NO: 630685 - RNA, 16 nt, Homo sapiens
gaaaucaguguuuuag

SEQ ID NO: 630686 - RNA, 13 nt, Homo sapiens
gaaaucauagaag

SEQ ID NO: 630687 - RNA, 23 nt, Homo sapiens
gaaaucauaggguucugaucaca

SEQ ID NO: 630688 - RNA, 21 nt, Homo sapiens
gaaaucauaguuuaaacugca

SEQ ID NO: 630689 - RNA, 20 nt, Homo sapiens
gaaauccauuccauuuugug

SEQ ID NO: 630690 - RNA, 22 nt, Homo sapiens
gaaaucuaaaagaauuuuacca

SEQ ID NO: 630691 - RNA, 18 nt, Homo sapiens
gaaaucugccuaugucau

SEQ ID NO: 630692 - RNA, 18 nt, Homo sapiens
gaaaucuguaaagccagu

SEQ ID NO: 630693 - RNA, 22 nt, Homo sapiens
gaaaucuguuucaacagaugac

SEQ ID NO: 630694 - RNA, 21 nt, Homo sapiens
gaaaucuugcuucagaccauc

SEQ ID NO: 630695 - RNA, 22 nt, Homo sapiens
gaaaucuuucucccucaacuga

SEQ ID NO: 630696 - RNA, 20 nt, Homo sapiens
gaaaugaccaggccaagacu

SEQ ID NO: 630697 - RNA, 14 nt, Homo sapiens
gaaaugacuuugaa

SEQ ID NO: 630698 - RNA, 18 nt, Homo sapiens
gaaaugauaugaccaaaa

SEQ ID NO: 630699 - RNA, 22 nt, Homo sapiens
gaaaugaugaaaagguugccug

SEQ ID NO: 630700 - RNA, 19 nt, Homo sapiens
gaaaugcagagaagaauaa

SEQ ID NO: 630701 - RNA, 14 nt, Homo sapiens
gaaaugcauugcuc

SEQ ID NO: 630702 - RNA, 23 nt, Homo sapiens
gaaaugcccaucuaugucccuug

SEQ ID NO: 630703 - RNA, 17 nt, Homo sapiens
gaaaugcugcaggauua

SEQ ID NO: 630704 - RNA, 20 nt, Homo sapiens
gaaaugcugccugccugucu

SEQ ID NO: 630705 - RNA, 14 nt, Homo sapiens
gaaaugcuuagaaa

SEQ ID NO: 630706 - RNA, 15 nt, Homo sapiens
gaaaugggcagugaa

SEQ ID NO: 630707 - RNA, 17 nt, Homo sapiens
gaaauguaccuucuuuc

SEQ ID NO: 630708 - RNA, 15 nt, Homo sapiens
gaaauguauccugau

SEQ ID NO: 630709 - RNA, 17 nt, Homo sapiens
gaaauguaugugcucuu

SEQ ID NO: 630710 - RNA, 22 nt, Homo sapiens
gaaaugucuccacccgugucca

SEQ ID NO: 630711 - RNA, 17 nt, Homo sapiens
gaaaugugcaaccacug

SEQ ID NO: 630712 - RNA, 20 nt, Homo sapiens
gaaauguguggucgagcuuu

SEQ ID NO: 630713 - RNA, 22 nt, Homo sapiens
gaaauguuaaagguucacaggg

SEQ ID NO: 630714 - RNA, 23 nt, Homo sapiens
gaaauguugagggcaagccacca

SEQ ID NO: 630715 - RNA, 13 nt, Homo sapiens
gaaauuaaccaua

SEQ ID NO: 630716 - RNA, 17 nt, Homo sapiens
gaaauuaagaaggcaaa

SEQ ID NO: 630717 - RNA, 19 nt, Homo sapiens
gaaauuaguuuaccucauc

SEQ ID NO: 630718 - RNA, 20 nt, Homo sapiens
gaaauuauauuuuagccuuu

SEQ ID NO: 630719 - RNA, 20 nt, Homo sapiens
gaaauuaucugucauuugag

SEQ ID NO: 630720 - RNA, 17 nt, Homo sapiens
gaaauuaugugacauuu

SEQ ID NO: 630721 - RNA, 18 nt, Homo sapiens
gaaauucagguacagaaa

SEQ ID NO: 630722 - RNA, 20 nt, Homo sapiens
gaaauuuaauucauguuucu

SEQ ID NO: 630723 - RNA, 16 nt, Homo sapiens
gaaauuuauucacaua

SEQ ID NO: 630724 - RNA, 18 nt, Homo sapiens
gaaauuuauuuaauguga

SEQ ID NO: 630725 - RNA, 24 nt, Homo sapiens
gaaauuugcaacucacugauucuc

SEQ ID NO: 630726 - RNA, 23 nt, Homo sapiens
gaaauuugccaauuuacuuuguu

SEQ ID NO: 630727 - RNA, 16 nt, Homo sapiens
gaaauuuugggggaaa

SEQ ID NO: 630728 - RNA, 17 nt, Homo sapiens
gaaauuuuguaagaagg

SEQ ID NO: 630729 - RNA, 18 nt, Homo sapiens
gaacaaaaaaaucugcag

SEQ ID NO: 630730 - RNA, 14 nt, Homo sapiens
gaacaaaaugaauu

SEQ ID NO: 630731 - RNA, 23 nt, Homo sapiens
gaacaaacaaggcauucauggga

SEQ ID NO: 630732 - RNA, 17 nt, Homo sapiens
gaacaaagcagccacga

SEQ ID NO: 630733 - RNA, 19 nt, Homo sapiens
gaacaaaguccacaguuua

SEQ ID NO: 630734 - RNA, 20 nt, Homo sapiens
gaacaaaucauuauguuucc

SEQ ID NO: 630735 - RNA, 14 nt, Homo sapiens
gaacaaaugaauaa

SEQ ID NO: 630736 - RNA, 15 nt, Homo sapiens
gaacaacagcaucuu

SEQ ID NO: 630737 - RNA, 14 nt, Homo sapiens
gaacaacauaucuc

SEQ ID NO: 630738 - RNA, 20 nt, Homo sapiens
gaacaaccugcacaaccugg

SEQ ID NO: 630739 - RNA, 17 nt, Homo sapiens
gaacaacgccugucaca

SEQ ID NO: 630740 - RNA, 14 nt, Homo sapiens
gaacaacuaccuga

SEQ ID NO: 630741 - RNA, 15 nt, Homo sapiens
gaacaagaaauggau

SEQ ID NO: 630742 - RNA, 16 nt, Homo sapiens
gaacaagcaugaucuu

SEQ ID NO: 630743 - RNA, 22 nt, Homo sapiens
gaacaaggaguucucuuccgca

SEQ ID NO: 630744 - RNA, 19 nt, Homo sapiens
gaacaauaaaaugucuucu

SEQ ID NO: 630745 - RNA, 17 nt, Homo sapiens
gaacaaucaaagcacuu

SEQ ID NO: 630746 - RNA, 18 nt, Homo sapiens
gaacaaucaaagcacuug

SEQ ID NO: 630747 - RNA, 14 nt, Homo sapiens
gaacaaugacaaac

SEQ ID NO: 630748 - RNA, 15 nt, Homo sapiens
gaacaauugaaguaa

SEQ ID NO: 630749 - RNA, 20 nt, Homo sapiens
gaacaauuuccaaaacuguc

SEQ ID NO: 630750 - RNA, 15 nt, Homo sapiens
gaacacacauuauua

SEQ ID NO: 630751 - RNA, 21 nt, Homo sapiens
gaacacaguuuagugcuuuac

SEQ ID NO: 630752 - RNA, 21 nt, Homo sapiens
gaacacccgacuccucaaaag

SEQ ID NO: 630753 - RNA, 16 nt, Homo sapiens
uaccacgaggaaaaga

SEQ ID NO: 630754 - RNA, 18 nt, Homo sapiens
uaccacuaacuccugaga

SEQ ID NO: 630755 - RNA, 20 nt, Homo sapiens
uaccacuuauaucaacuuau

SEQ ID NO: 630756 - RNA, 23 nt, Homo sapiens
uaccagauguuuugauguuaucg

SEQ ID NO: 630757 - RNA, 15 nt, Homo sapiens
uaccagcauacgcuc

SEQ ID NO: 630758 - RNA, 14 nt, Homo sapiens
uaccagcucagggg

SEQ ID NO: 630759 - RNA, 22 nt, Homo sapiens
uaccagguggcaaaguacuugu

SEQ ID NO: 630760 - RNA, 17 nt, Homo sapiens
uaccaguauaagcaucu

SEQ ID NO: 630761 - RNA, 21 nt, Homo sapiens
uaccagucuauuuccacugaa

SEQ ID NO: 630762 - RNA, 18 nt, Homo sapiens
uaccagugaaccaaagag

SEQ ID NO: 630763 - RNA, 15 nt, Homo sapiens
uaccaguucugggca

SEQ ID NO: 630764 - RNA, 21 nt, Homo sapiens
uaccaguugcccuagcccaga

SEQ ID NO: 630765 - RNA, 16 nt, Homo sapiens
uaccauaugucugcuu

SEQ ID NO: 630766 - RNA, 22 nt, Homo sapiens
uaccauccccgaccaucugauu

SEQ ID NO: 630767 - RNA, 14 nt, Homo sapiens
uaccaucuguagag

SEQ ID NO: 630768 - RNA, 23 nt, Homo sapiens
uaccaucuuguauacacauauau

SEQ ID NO: 630769 - RNA, 12 nt, Homo sapiens
uaccaugcugaa

SEQ ID NO: 630770 - RNA, 19 nt, Homo sapiens
uaccaugugaaacucuacc

SEQ ID NO: 630771 - RNA, 14 nt, Homo sapiens
uaccaugugugcua

SEQ ID NO: 630772 - RNA, 17 nt, Homo sapiens
uacccaaaggucuucaa

SEQ ID NO: 630773 - RNA, 20 nt, Homo sapiens
uacccaaaugucccugcaag

SEQ ID NO: 630774 - RNA, 15 nt, Homo sapiens
uacccacacauucca

SEQ ID NO: 630775 - RNA, 13 nt, Homo sapiens
uacccacauguac

SEQ ID NO: 630776 - RNA, 13 nt, Homo sapiens
uacccaccccagc

SEQ ID NO: 630777 - RNA, 23 nt, Homo sapiens
uacccacccuuacuuccuggccu

SEQ ID NO: 630778 - RNA, 19 nt, Homo sapiens
uacccacucuggagcauuu

SEQ ID NO: 630779 - RNA, 14 nt, Homo sapiens
uacccacugccaug

SEQ ID NO: 630780 - RNA, 16 nt, Homo sapiens
uacccacuggucugcu

SEQ ID NO: 630781 - RNA, 18 nt, Homo sapiens
uacccagagaguccugug

SEQ ID NO: 630782 - RNA, 22 nt, Homo sapiens
uacccagagaguccugugcuga

SEQ ID NO: 630783 - RNA, 19 nt, Homo sapiens
uacccaguauuacugcugc

SEQ ID NO: 630784 - RNA, 17 nt, Homo sapiens
uacccaguuacuuauga

SEQ ID NO: 630785 - RNA, 13 nt, Homo sapiens
uaccccaccacga

SEQ ID NO: 630786 - RNA, 20 nt, Homo sapiens
uaccccgagggcgccaugca

SEQ ID NO: 630787 - RNA, 19 nt, Homo sapiens
uaccccgauggccaagcaa

SEQ ID NO: 630788 - RNA, 16 nt, Homo sapiens
uaccccucaaacugca

SEQ ID NO: 630789 - RNA, 15 nt, Homo sapiens
uaccccugcucccau

SEQ ID NO: 630790 - RNA, 18 nt, Homo sapiens
uaccccugguaaaccaag

SEQ ID NO: 630791 - RNA, 19 nt, Homo sapiens
uaccccuuccuguccugcc

SEQ ID NO: 630792 - RNA, 17 nt, Homo sapiens
uacccgaaagcaucacu

SEQ ID NO: 630793 - RNA, 16 nt, Homo sapiens
uacccggcccagagac

SEQ ID NO: 630794 - RNA, 22 nt, Homo sapiens
uacccuauucuauccaucuccu

SEQ ID NO: 630795 - RNA, 15 nt, Homo sapiens
uacccucccaccaga

SEQ ID NO: 630796 - RNA, 20 nt, Homo sapiens
uacccuccuuccacauguac

SEQ ID NO: 630797 - RNA, 14 nt, Homo sapiens
uacccugaaguguu

SEQ ID NO: 630798 - RNA, 13 nt, Homo sapiens
uacccugaucuga

SEQ ID NO: 630799 - RNA, 18 nt, Homo sapiens
uacccuuccucaccacuu

SEQ ID NO: 630800 - RNA, 20 nt, Homo sapiens
gacugagguauaaagacaag

SEQ ID NO: 630801 - RNA, 14 nt, Homo sapiens
gacugauccaaaaa

SEQ ID NO: 630802 - RNA, 17 nt, Homo sapiens
gacugauguuacaucac

SEQ ID NO: 630803 - RNA, 22 nt, Homo sapiens
gacugcacagcguccuguccac

SEQ ID NO: 630804 - RNA, 19 nt, Homo sapiens
gacugcagggguccacugu

SEQ ID NO: 630805 - RNA, 11 nt, Homo sapiens
gacugcaguug

SEQ ID NO: 630806 - RNA, 13 nt, Homo sapiens
gacugcaguugaa

SEQ ID NO: 630807 - RNA, 17 nt, Homo sapiens
gacugccaugcuagaca

SEQ ID NO: 630808 - RNA, 18 nt, Homo sapiens
gacugccggucauuugaa

SEQ ID NO: 630809 - RNA, 19 nt, Homo sapiens
gacugcugugaaauggaga

SEQ ID NO: 630810 - RNA, 19 nt, Homo sapiens
gacugcuucaucugcugua

SEQ ID NO: 630811 - RNA, 16 nt, Homo sapiens
gacuggaacuugaacu

SEQ ID NO: 630812 - RNA, 17 nt, Homo sapiens
gacuggaugcucgccau

SEQ ID NO: 630813 - RNA, 22 nt, Homo sapiens
gacuggauuuuugcucugcccc

SEQ ID NO: 630814 - RNA, 13 nt, Homo sapiens
gacuggcaauaaa

SEQ ID NO: 630815 - RNA, 10 nt, Homo sapiens
gacuggccau

SEQ ID NO: 630816 - RNA, 22 nt, Homo sapiens
gacuggcccuguccuggcauca

SEQ ID NO: 630817 - RNA, 16 nt, Homo sapiens
gacugggaaaaacauc

SEQ ID NO: 630818 - RNA, 19 nt, Homo sapiens
gacuggggagcacaggugu

SEQ ID NO: 630819 - RNA, 16 nt, Homo sapiens
gacugguaaguaacug

SEQ ID NO: 630820 - RNA, 14 nt, Homo sapiens
gacugguacucaag

SEQ ID NO: 630821 - RNA, 13 nt, Homo sapiens
gacuguaaacauc

SEQ ID NO: 630822 - RNA, 16 nt, Homo sapiens
gacuguaaaugcucca

SEQ ID NO: 630823 - RNA, 14 nt, Homo sapiens
gacuguacuccucc

SEQ ID NO: 630824 - RNA, 17 nt, Homo sapiens
gacuguccaagugccac

SEQ ID NO: 630825 - RNA, 23 nt, Homo sapiens
gacuguccaagugccacaugccu

SEQ ID NO: 630826 - RNA, 16 nt, Homo sapiens
gacugucucacuuaau

SEQ ID NO: 630827 - RNA, 22 nt, Homo sapiens
gacugugaacugggcauuucac

SEQ ID NO: 630828 - RNA, 19 nt, Homo sapiens
gacugugauuagaucacau

SEQ ID NO: 630829 - RNA, 17 nt, Homo sapiens
gacugugguagccagca

SEQ ID NO: 630830 - RNA, 14 nt, Homo sapiens
gacugugucugccu

SEQ ID NO: 630831 - RNA, 11 nt, Homo sapiens
gacuguuacag

SEQ ID NO: 630832 - RNA, 23 nt, Homo sapiens
gacuguugaugccuuugaguuuu

SEQ ID NO: 630833 - RNA, 22 nt, Homo sapiens
gacuguuuauagcuguuggaag

SEQ ID NO: 630834 - RNA, 20 nt, Homo sapiens
gacuguuucauucacugugc

SEQ ID NO: 630835 - RNA, 20 nt, Homo sapiens
gacuuaaacagcagauuuca

SEQ ID NO: 630836 - RNA, 22 nt, Homo sapiens
gacuuaagcccagugcacugaa

SEQ ID NO: 630837 - RNA, 19 nt, Homo sapiens
gacuuaaggacagcauguc

SEQ ID NO: 630838 - RNA, 21 nt, Homo sapiens
gacuuaauguaaaacccaaaa

SEQ ID NO: 630839 - RNA, 14 nt, Homo sapiens
gacuuaaugugauu

SEQ ID NO: 630840 - RNA, 17 nt, Homo sapiens
gacuuacaaaaugccaa

SEQ ID NO: 630841 - RNA, 18 nt, Homo sapiens
gacuuacaaaaugccaag

SEQ ID NO: 630842 - RNA, 19 nt, Homo sapiens
gacuuaccuggcagacuug

SEQ ID NO: 630843 - RNA, 13 nt, Homo sapiens
gacuuacugucag

SEQ ID NO: 630844 - RNA, 16 nt, Homo sapiens
gacuuagaaaaauccu

SEQ ID NO: 630845 - RNA, 18 nt, Homo sapiens
gacuuauggaacagggau

SEQ ID NO: 630846 - RNA, 15 nt, Homo sapiens
gacuuauugccaaaa

SEQ ID NO: 630847 - RNA, 13 nt, Homo sapiens
gacuucacuguau

SEQ ID NO: 630848 - RNA, 20 nt, Homo sapiens
gacuucaugacaagcauuuu

SEQ ID NO: 630849 - RNA, 14 nt, Homo sapiens
gacuuccacuuugu

SEQ ID NO: 630850 - RNA, 19 nt, Homo sapiens
gacuuccauuugcuuuguc

SEQ ID NO: 630851 - RNA, 14 nt, Homo sapiens
gacuuccuggugag

SEQ ID NO: 630852 - RNA, 20 nt, Homo sapiens
gacuucuggagaaagcucau

SEQ ID NO: 630853 - RNA, 23 nt, Homo sapiens
gacuucuugguacccagucaccu

SEQ ID NO: 630854 - RNA, 16 nt, Homo sapiens
gacuucuugguuuucu

SEQ ID NO: 630855 - RNA, 22 nt, Homo sapiens
gacuugcguggacagucagggu

SEQ ID NO: 630856 - RNA, 13 nt, Homo sapiens
gacuuggggccag

SEQ ID NO: 630857 - RNA, 21 nt, Homo sapiens
gacuugguaagaugacucuga

SEQ ID NO: 630858 - RNA, 20 nt, Homo sapiens
gacuuggucugauuucagga

SEQ ID NO: 630859 - RNA, 21 nt, Homo sapiens
gacuuguaggaaucugccuuc

SEQ ID NO: 630860 - RNA, 23 nt, Homo sapiens
gacuuuauguuguaugauuccaa

SEQ ID NO: 630861 - RNA, 22 nt, Homo sapiens
gacuuucccaaauguauugauu

SEQ ID NO: 630862 - RNA, 19 nt, Homo sapiens
gacuuucuucuagugcuuu

SEQ ID NO: 630863 - RNA, 15 nt, Homo sapiens
gacuuugaagaccag

SEQ ID NO: 630864 - RNA, 16 nt, Homo sapiens
gacuuugauugcacau

SEQ ID NO: 630865 - RNA, 23 nt, Homo sapiens
gacuuuggaggcaaaauguguug

SEQ ID NO: 630866 - RNA, 20 nt, Homo sapiens
gacuuuuuagccagugacuu

SEQ ID NO: 630867 - RNA, 21 nt, Homo sapiens
gagaaaaaugcuccccacagc

SEQ ID NO: 630868 - RNA, 14 nt, Homo sapiens
gagaaaagacauaa

SEQ ID NO: 630869 - RNA, 17 nt, Homo sapiens
gagaaaagccucuccag

SEQ ID NO: 630870 - RNA, 22 nt, Homo sapiens
gagaaaagugggcugcagcagc

SEQ ID NO: 630871 - RNA, 22 nt, Homo sapiens
gagaaaauauuugcgagucaua

SEQ ID NO: 630872 - RNA, 18 nt, Homo sapiens
gagaaaauccaggucaug

SEQ ID NO: 630873 - RNA, 16 nt, Homo sapiens
gagaaaaugaauuugg

SEQ ID NO: 630874 - RNA, 17 nt, Homo sapiens
gagaaaauuugaaaaug

SEQ ID NO: 630875 - RNA, 13 nt, Homo sapiens
gagaaaccagcuu

SEQ ID NO: 630876 - RNA, 20 nt, Homo sapiens
gagaaaccuuauuguaccuc

SEQ ID NO: 630877 - RNA, 22 nt, Homo sapiens
gagaaaccuuauuguaccucuc

SEQ ID NO: 630878 - RNA, 14 nt, Homo sapiens
gagaaagaaaggga

SEQ ID NO: 630879 - RNA, 23 nt, Homo sapiens
gagaaagagcacuuaagagaaua

SEQ ID NO: 630880 - RNA, 17 nt, Homo sapiens
gagaaagcuuauggcug

SEQ ID NO: 630881 - RNA, 17 nt, Homo sapiens
gagaaagggagugcaug

SEQ ID NO: 630882 - RNA, 21 nt, Homo sapiens
gagaaagggagugcaugugcg

SEQ ID NO: 630883 - RNA, 17 nt, Homo sapiens
gagaaaguucucauuua

SEQ ID NO: 630884 - RNA, 19 nt, Homo sapiens
gagaaaugaauaauuuccc

SEQ ID NO: 630885 - RNA, 20 nt, Homo sapiens
gagaaaugcagagaagaaua

SEQ ID NO: 630886 - RNA, 12 nt, Homo sapiens
gagaaaugcugc

SEQ ID NO: 630887 - RNA, 14 nt, Homo sapiens
gagaaaugugucau

SEQ ID NO: 630888 - RNA, 21 nt, Homo sapiens
gagaacaccgagcacugaacu

SEQ ID NO: 630889 - RNA, 20 nt, Homo sapiens
gagaacacguuggcucaguc

SEQ ID NO: 630890 - RNA, 19 nt, Homo sapiens
ggugggauccacacugaga

SEQ ID NO: 630891 - RNA, 20 nt, Homo sapiens
ggugggauuccacucgugug

SEQ ID NO: 630892 - RNA, 20 nt, Homo sapiens
ggugggcacccacccuggga

SEQ ID NO: 630893 - RNA, 23 nt, Homo sapiens
ggugggcaggaucucaagccagc

SEQ ID NO: 630894 - RNA, 19 nt, Homo sapiens
ggugggccauaugccuaca

SEQ ID NO: 630895 - RNA, 17 nt, Homo sapiens
ggugggccucgggucca

SEQ ID NO: 630896 - RNA, 21 nt, Homo sapiens
ggugggggucagguggacucu

SEQ ID NO: 630897 - RNA, 20 nt, Homo sapiens
ggugguauguaauuuaugca

SEQ ID NO: 630898 - RNA, 24 nt, Homo sapiens
gguggucugaauauuaaagcucuu

SEQ ID NO: 630899 - RNA, 20 nt, Homo sapiens
ggugguggaaggguagagag

SEQ ID NO: 630900 - RNA, 21 nt, Homo sapiens
ggugguggcgugcauauguaa

SEQ ID NO: 630901 - RNA, 18 nt, Homo sapiens
gguguaauuuuguccucu

SEQ ID NO: 630902 - RNA, 23 nt, Homo sapiens
gguguacuuauauccacacugca

SEQ ID NO: 630903 - RNA, 13 nt, Homo sapiens
gguguaggggcca

SEQ ID NO: 630904 - RNA, 16 nt, Homo sapiens
gguguauguaugagua

SEQ ID NO: 630905 - RNA, 15 nt, Homo sapiens
gguguauugaagucc

SEQ ID NO: 630906 - RNA, 19 nt, Homo sapiens
ggugucacauggugccccu

SEQ ID NO: 630907 - RNA, 20 nt, Homo sapiens
ggugucaccaugagcaccuc

SEQ ID NO: 630908 - RNA, 20 nt, Homo sapiens
ggugucaggcagguuugcca

SEQ ID NO: 630909 - RNA, 14 nt, Homo sapiens
gguguccccuaucc

SEQ ID NO: 630910 - RNA, 21 nt, Homo sapiens
ggugucuagacugccagggag

SEQ ID NO: 630911 - RNA, 11 nt, Homo sapiens
ggugucuguga

SEQ ID NO: 630912 - RNA, 15 nt, Homo sapiens
ggugugauugcacag

SEQ ID NO: 630913 - RNA, 17 nt, Homo sapiens
gguguggcccguggccu

SEQ ID NO: 630914 - RNA, 12 nt, Homo sapiens
gguguguuacac

SEQ ID NO: 630915 - RNA, 15 nt, Homo sapiens
gguguuugucugugu

SEQ ID NO: 630916 - RNA, 13 nt, Homo sapiens
gguguuuugccau

SEQ ID NO: 630917 - RNA, 14 nt, Homo sapiens
gguuaauccagcuu

SEQ ID NO: 630918 - RNA, 23 nt, Homo sapiens
gguuacuaagaugaaauugccaa

SEQ ID NO: 630919 - RNA, 15 nt, Homo sapiens
cuccuacuaugcaau

SEQ ID NO: 630920 - RNA, 21 nt, Homo sapiens
cuccuagacacuccccacggg

SEQ ID NO: 630921 - RNA, 20 nt, Homo sapiens
cuccuagaggugggcagcug

SEQ ID NO: 630922 - RNA, 21 nt, Homo sapiens
cuccuauugaaagaccagauc

SEQ ID NO: 630923 - RNA, 21 nt, Homo sapiens
cuccuauuuaugaaaaccaua

SEQ ID NO: 630924 - RNA, 18 nt, Homo sapiens
cuccucaaacccagucuc

SEQ ID NO: 630925 - RNA, 19 nt, Homo sapiens
cuccucaaacccagucuca

SEQ ID NO: 630926 - RNA, 16 nt, Homo sapiens
cuccucacagaccucu

SEQ ID NO: 630927 - RNA, 19 nt, Homo sapiens
cuccucaccucaugcccac

SEQ ID NO: 630928 - RNA, 21 nt, Homo sapiens
cuccucagaucugaacacagu

SEQ ID NO: 630929 - RNA, 20 nt, Homo sapiens
cuccucagcggcuccagcuc

SEQ ID NO: 630930 - RNA, 11 nt, Homo sapiens
cuccucaggac

SEQ ID NO: 630931 - RNA, 16 nt, Homo sapiens
cuccucaggcacacag

SEQ ID NO: 630932 - RNA, 19 nt, Homo sapiens
cuccucaggcacacagcua

SEQ ID NO: 630933 - RNA, 21 nt, Homo sapiens
cuccucaggcacacagcuacu

SEQ ID NO: 630934 - RNA, 23 nt, Homo sapiens
cuccucaggcccagcugcucccc

SEQ ID NO: 630935 - RNA, 15 nt, Homo sapiens
cuccucauagcauga

SEQ ID NO: 630936 - RNA, 13 nt, Homo sapiens
cuccuccagggaa

SEQ ID NO: 630937 - RNA, 22 nt, Homo sapiens
cuccuccaggguggcagcaaca

SEQ ID NO: 630938 - RNA, 21 nt, Homo sapiens
cuccucccaggaacugggcca

SEQ ID NO: 630939 - RNA, 19 nt, Homo sapiens
cuccucccucugacucuaa

SEQ ID NO: 630940 - RNA, 16 nt, Homo sapiens
cuccuccucagcugca

SEQ ID NO: 630941 - RNA, 12 nt, Homo sapiens
cuccuccuguca

SEQ ID NO: 630942 - RNA, 14 nt, Homo sapiens
cuccucgcugccag

SEQ ID NO: 630943 - RNA, 16 nt, Homo sapiens
cuccucgcugccagau

SEQ ID NO: 630944 - RNA, 14 nt, Homo sapiens
cuccucggagagca

SEQ ID NO: 630945 - RNA, 13 nt, Homo sapiens
cuccucggaggau

SEQ ID NO: 630946 - RNA, 12 nt, Homo sapiens
cuccucugaccu

SEQ ID NO: 630947 - RNA, 21 nt, Homo sapiens
cuccucuguuaaaaaaaauga

SEQ ID NO: 630948 - RNA, 22 nt, Homo sapiens
cuccucuuucaaccucagugau

SEQ ID NO: 630949 - RNA, 15 nt, Homo sapiens
cuccugaagccacag

SEQ ID NO: 630950 - RNA, 13 nt, Homo sapiens
cuccugacagcaa

SEQ ID NO: 630951 - RNA, 13 nt, Homo sapiens
cuccugaccucaa

SEQ ID NO: 630952 - RNA, 20 nt, Homo sapiens
cuccugaccucaagugaucc

SEQ ID NO: 630953 - RNA, 19 nt, Homo sapiens
cuccugagccccucaaucc

SEQ ID NO: 630954 - RNA, 23 nt, Homo sapiens
cuccugaggcuuuggauuugaca

SEQ ID NO: 630955 - RNA, 19 nt, Homo sapiens
cuccugaguagcuggauua

SEQ ID NO: 630956 - RNA, 20 nt, Homo sapiens
cuccugauggagugugcaga

SEQ ID NO: 630957 - RNA, 12 nt, Homo sapiens
cuccugcaaaau

SEQ ID NO: 630958 - RNA, 11 nt, Homo sapiens
cuccugcaaac

SEQ ID NO: 630959 - RNA, 15 nt, Homo sapiens
cuccugcaaaccuca

SEQ ID NO: 630960 - RNA, 17 nt, Homo sapiens
cuccugccaccagcauc

SEQ ID NO: 630961 - RNA, 17 nt, Homo sapiens
cuccugcccaagcacuu

SEQ ID NO: 630962 - RNA, 12 nt, Homo sapiens
cuccugccccug

SEQ ID NO: 630963 - RNA, 16 nt, Homo sapiens
cuccugcgcugacaag

SEQ ID NO: 630964 - RNA, 19 nt, Homo sapiens
cuccugcucauauugugau

SEQ ID NO: 630965 - RNA, 12 nt, Homo sapiens
cuccugcuccuc

SEQ ID NO: 630966 - RNA, 20 nt, Homo sapiens
cuccuggaaccuugcugucc

SEQ ID NO: 630967 - RNA, 16 nt, Homo sapiens
cuccuggcccacugca

SEQ ID NO: 630968 - RNA, 18 nt, Homo sapiens
cuccuggccucaagcaau

SEQ ID NO: 630969 - RNA, 23 nt, Homo sapiens
cuccuggcuggggccuguugaag

SEQ ID NO: 630970 - RNA, 18 nt, Homo sapiens
cuccugggcccaagugau

SEQ ID NO: 630971 - RNA, 19 nt, Homo sapiens
cuccugggcccaagugauc

SEQ ID NO: 630972 - RNA, 13 nt, Homo sapiens
cuccugggcucag

SEQ ID NO: 630973 - RNA, 17 nt, Homo sapiens
cuccuggguucaagcaa

SEQ ID NO: 630974 - RNA, 20 nt, Homo sapiens
cuccuguauuuaacaaaaag

SEQ ID NO: 630975 - RNA, 14 nt, Homo sapiens
cuccugucaccuag

SEQ ID NO: 630976 - RNA, 20 nt, Homo sapiens
cuccugugcuagaugugcaa

SEQ ID NO: 630977 - RNA, 18 nt, Homo sapiens
cuccugugggagaucuuc

SEQ ID NO: 630978 - RNA, 23 nt, Homo sapiens
cuccugugucuguguauauuaca

SEQ ID NO: 630979 - RNA, 16 nt, Homo sapiens
cuccuguuuugcacag

SEQ ID NO: 630980 - RNA, 21 nt, Homo sapiens
cuccuguuuuuuucaggcucc

SEQ ID NO: 630981 - RNA, 19 nt, Homo sapiens
cuccuuaagaacacaaagc

SEQ ID NO: 630982 - RNA, 17 nt, Homo sapiens
cuccuuccacauguaca

SEQ ID NO: 630983 - RNA, 18 nt, Homo sapiens
cuccuuccagcacugacu

SEQ ID NO: 630984 - RNA, 16 nt, Homo sapiens
cuccuuccccauuucc

SEQ ID NO: 630985 - RNA, 13 nt, Homo sapiens
cuccuucgcuuaa

SEQ ID NO: 630986 - RNA, 15 nt, Homo sapiens
cuccuugagcccuug

SEQ ID NO: 630987 - RNA, 21 nt, Homo sapiens
cuccuugcugcauugauccag

SEQ ID NO: 630988 - RNA, 16 nt, Homo sapiens
cuccuuggccacagac

SEQ ID NO: 630989 - RNA, 16 nt, Homo sapiens
cuccuuggcuuaccug

SEQ ID NO: 630990 - RNA, 13 nt, Homo sapiens
cuccuuguguuac

SEQ ID NO: 630991 - RNA, 23 nt, Homo sapiens
cuccuuuaccccucauccaaagu

SEQ ID NO: 630992 - RNA, 13 nt, Homo sapiens
cuccuuuagccau

SEQ ID NO: 630993 - RNA, 15 nt, Homo sapiens
cuccuuuccaauaga

SEQ ID NO: 630994 - RNA, 18 nt, Homo sapiens
cuccuuucuccugugaau

SEQ ID NO: 630995 - RNA, 14 nt, Homo sapiens
cuccuuucucuuau

SEQ ID NO: 630996 - RNA, 17 nt, Homo sapiens
cuccuuuggccauucca

SEQ ID NO: 630997 - RNA, 19 nt, Homo sapiens
cuccuuuguguguguguca

SEQ ID NO: 630998 - RNA, 22 nt, Homo sapiens
cuccuuugugugugugucagcu

SEQ ID NO: 630999 - RNA, 17 nt, Homo sapiens
cuccuuuguucuguauu

SEQ ID NO: 631000 - RNA, 13 nt, Homo sapiens
cuccuuuugacca

SEQ ID NO: 631001 - RNA, 18 nt, Homo sapiens
cuccuuuugaccaaauaa

SEQ ID NO: 631002 - RNA, 14 nt, Homo sapiens
cuccuuuugaggcu

SEQ ID NO: 631003 - RNA, 24 nt, Homo sapiens
cuccuuuugcuguuuggauguuuc

SEQ ID NO: 631004 - RNA, 23 nt, Homo sapiens
cuccuuuugcuugaaaccaaaga

SEQ ID NO: 631005 - RNA, 20 nt, Homo sapiens
cuccuuuuuugcaugugcaa

SEQ ID NO: 631006 - RNA, 17 nt, Homo sapiens
cucgaaaaccaucacau

SEQ ID NO: 631007 - RNA, 15 nt, Homo sapiens
cucgaaguucuagga

SEQ ID NO: 631008 - RNA, 17 nt, Homo sapiens
cucgaaucucugugccu

SEQ ID NO: 631009 - RNA, 16 nt, Homo sapiens
cucgaggccugcaaac

SEQ ID NO: 631010 - RNA, 21 nt, Homo sapiens
cucgaggccugcaaaccuucc

SEQ ID NO: 631011 - RNA, 17 nt, Homo sapiens
cucgcagccucucagug

SEQ ID NO: 631012 - RNA, 20 nt, Homo sapiens
cugcaccagugugacaucua

SEQ ID NO: 631013 - RNA, 17 nt, Homo sapiens
cugcacccacccaggag

SEQ ID NO: 631014 - RNA, 13 nt, Homo sapiens
cugcaccccaaga

SEQ ID NO: 631015 - RNA, 19 nt, Homo sapiens
cugcaccccugcaguuuga

SEQ ID NO: 631016 - RNA, 19 nt, Homo sapiens
cugcaccuacccacaugca

SEQ ID NO: 631017 - RNA, 20 nt, Homo sapiens
cugcaccuacccacaugcac

SEQ ID NO: 631018 - RNA, 21 nt, Homo sapiens
cugcaccuuuuugcaugauau

SEQ ID NO: 631019 - RNA, 19 nt, Homo sapiens
cugcacuccagccuggcaa

SEQ ID NO: 631020 - RNA, 20 nt, Homo sapiens
cugcacuccagccugggcaa

SEQ ID NO: 631021 - RNA, 16 nt, Homo sapiens
cugcacucuaaacugc

SEQ ID NO: 631022 - RNA, 16 nt, Homo sapiens
cugcacuggggccacc

SEQ ID NO: 631023 - RNA, 18 nt, Homo sapiens
cugcacuuauacccauga

SEQ ID NO: 631024 - RNA, 19 nt, Homo sapiens
cugcagaaguaagccucau

SEQ ID NO: 631025 - RNA, 17 nt, Homo sapiens
cugcagaaguacuccua

SEQ ID NO: 631026 - RNA, 20 nt, Homo sapiens
cugcagaauaaaaucucuau

SEQ ID NO: 631027 - RNA, 13 nt, Homo sapiens
cugcagaauccag

SEQ ID NO: 631028 - RNA, 15 nt, Homo sapiens
cugcagacagaccuc

SEQ ID NO: 631029 - RNA, 18 nt, Homo sapiens
cugcagaccucaagccau

SEQ ID NO: 631030 - RNA, 14 nt, Homo sapiens
cugcagagcaauaa

SEQ ID NO: 631031 - RNA, 21 nt, Homo sapiens
cugcagagcaauaacacuaua

SEQ ID NO: 631032 - RNA, 18 nt, Homo sapiens
cugcagagcaccuuugca

SEQ ID NO: 631033 - RNA, 13 nt, Homo sapiens
cugcagcacuuua

SEQ ID NO: 631034 - RNA, 14 nt, Homo sapiens
cugcagcacuuuaa

SEQ ID NO: 631035 - RNA, 18 nt, Homo sapiens
cugcagcccaaaacccag

SEQ ID NO: 631036 - RNA, 16 nt, Homo sapiens
cugcagccucauacuc

SEQ ID NO: 631037 - RNA, 15 nt, Homo sapiens
cugcagcugcugaag

SEQ ID NO: 631038 - RNA, 21 nt, Homo sapiens
cugcagcuuaaaacaagcaaa

SEQ ID NO: 631039 - RNA, 21 nt, Homo sapiens
cugcagcuuuguuuguuguca

SEQ ID NO: 631040 - RNA, 22 nt, Homo sapiens
cugcaggaacgagcacuggcca

SEQ ID NO: 631041 - RNA, 21 nt, Homo sapiens
cugcaggacagucaaggugau

SEQ ID NO: 631042 - RNA, 19 nt, Homo sapiens
cugcaggcagagacugaaa

SEQ ID NO: 631043 - RNA, 18 nt, Homo sapiens
cugcaggccaggccagcu

SEQ ID NO: 631044 - RNA, 18 nt, Homo sapiens
cugcaggcuggagacugg

SEQ ID NO: 631045 - RNA, 18 nt, Homo sapiens
cugcagggacuccaugcu

SEQ ID NO: 631046 - RNA, 22 nt, Homo sapiens
cugcagggggugugucugcuca

SEQ ID NO: 631047 - RNA, 16 nt, Homo sapiens
cugcaggggugccugg

SEQ ID NO: 631048 - RNA, 21 nt, Homo sapiens
cugcagguuccuuaucuguca

SEQ ID NO: 631049 - RNA, 20 nt, Homo sapiens
cugcaguaugggaucugaua

SEQ ID NO: 631050 - RNA, 17 nt, Homo sapiens
guccugccucagccucc

SEQ ID NO: 631051 - RNA, 15 nt, Homo sapiens
guccugccuccucau

SEQ ID NO: 631052 - RNA, 19 nt, Homo sapiens
guccugcugucccugucag

SEQ ID NO: 631053 - RNA, 22 nt, Homo sapiens
guccugggcauggguccagggc

SEQ ID NO: 631054 - RNA, 18 nt, Homo sapiens
guccugggccuccugaca

SEQ ID NO: 631055 - RNA, 16 nt, Homo sapiens
guccugggucuguguc

SEQ ID NO: 631056 - RNA, 17 nt, Homo sapiens
guccugggucuguguca

SEQ ID NO: 631057 - RNA, 16 nt, Homo sapiens
guccuguccugcucau

SEQ ID NO: 631058 - RNA, 15 nt, Homo sapiens
guccuuaccucgggg

SEQ ID NO: 631059 - RNA, 17 nt, Homo sapiens
guccuuauucuucucau

SEQ ID NO: 631060 - RNA, 14 nt, Homo sapiens
guccuucaccucac

SEQ ID NO: 631061 - RNA, 18 nt, Homo sapiens
guccuucaccucacugaa

SEQ ID NO: 631062 - RNA, 19 nt, Homo sapiens
guccuucaccucacugaaa

SEQ ID NO: 631063 - RNA, 23 nt, Homo sapiens
guccuucagugagccccucccca

SEQ ID NO: 631064 - RNA, 13 nt, Homo sapiens
guccuuccugacc

SEQ ID NO: 631065 - RNA, 17 nt, Homo sapiens
guccuuccuugacuguc

SEQ ID NO: 631066 - RNA, 11 nt, Homo sapiens
guccuugcccc

SEQ ID NO: 631067 - RNA, 23 nt, Homo sapiens
guccuuucccuucaguacccucu

SEQ ID NO: 631068 - RNA, 18 nt, Homo sapiens
guccuuucuaaguauuuu

SEQ ID NO: 631069 - RNA, 21 nt, Homo sapiens
guccuuuugacacugcucuaa

SEQ ID NO: 631070 - RNA, 16 nt, Homo sapiens
guccuuuuguaccaug

SEQ ID NO: 631071 - RNA, 16 nt, Homo sapiens
guccuuuuuaucugau

SEQ ID NO: 631072 - RNA, 22 nt, Homo sapiens
guccuuuuuccaauguuuuauu

SEQ ID NO: 631073 - RNA, 16 nt, Homo sapiens
gucgaacaauucauau

SEQ ID NO: 631074 - RNA, 19 nt, Homo sapiens
gucgaauguuagauuccuc

SEQ ID NO: 631075 - RNA, 20 nt, Homo sapiens
gucggagucuguaaaaccag

SEQ ID NO: 631076 - RNA, 17 nt, Homo sapiens
gucguuuuccaaagagc

SEQ ID NO: 631077 - RNA, 16 nt, Homo sapiens
gucuaaaaacaccaaa

SEQ ID NO: 631078 - RNA, 18 nt, Homo sapiens
gucuaaaaacaccaaaaa

SEQ ID NO: 631079 - RNA, 16 nt, Homo sapiens
gucuaaaaugcagugg

SEQ ID NO: 631080 - RNA, 19 nt, Homo sapiens
gucuaacgcugaacugaca

SEQ ID NO: 631081 - RNA, 12 nt, Homo sapiens
gucuaauuugca

SEQ ID NO: 631082 - RNA, 16 nt, Homo sapiens
gucuaauuugcaccuu

SEQ ID NO: 631083 - RNA, 18 nt, Homo sapiens
gucuacucagcauuugau

SEQ ID NO: 631084 - RNA, 17 nt, Homo sapiens
gucuagacugccaggga

SEQ ID NO: 631085 - RNA, 22 nt, Homo sapiens
gucuagccacucccucccagaa

SEQ ID NO: 631086 - RNA, 14 nt, Homo sapiens
gucuagccacugau

SEQ ID NO: 631087 - RNA, 17 nt, Homo sapiens
gucuagguacuucaggg

SEQ ID NO: 631088 - RNA, 21 nt, Homo sapiens
gucuauuuaaaaaaaaaguca

SEQ ID NO: 631089 - RNA, 15 nt, Homo sapiens
gucuauuuccacuga

SEQ ID NO: 631090 - RNA, 19 nt, Homo sapiens
gucuauuugagacuuagaa

SEQ ID NO: 631091 - RNA, 15 nt, Homo sapiens
gucuauuuucagagc

SEQ ID NO: 631092 - RNA, 18 nt, Homo sapiens
gucuauuuucucagucau

SEQ ID NO: 631093 - RNA, 19 nt, Homo sapiens
gucucaaacuccugaccuc

SEQ ID NO: 631094 - RNA, 19 nt, Homo sapiens
gucucaauucuuuguauau

SEQ ID NO: 631095 - RNA, 19 nt, Homo sapiens
gucucacucugucgcucag

SEQ ID NO: 631096 - RNA, 18 nt, Homo sapiens
gucucacuuuuauugaua

SEQ ID NO: 631097 - RNA, 19 nt, Homo sapiens
gucucagaaccacuccugg

SEQ ID NO: 631098 - RNA, 13 nt, Homo sapiens
gucucagcugcug

SEQ ID NO: 631099 - RNA, 15 nt, Homo sapiens
gucucaguuucacuu

SEQ ID NO: 631100 - RNA, 13 nt, Homo sapiens
gucucauccuccu

SEQ ID NO: 631101 - RNA, 14 nt, Homo sapiens
gucucaucucuuca

SEQ ID NO: 631102 - RNA, 13 nt, Homo sapiens
gucucauguggaa

SEQ ID NO: 631103 - RNA, 13 nt, Homo sapiens
gucucauuuagaa

SEQ ID NO: 631104 - RNA, 16 nt, Homo sapiens
gucucauuuagaacuu

SEQ ID NO: 631105 - RNA, 12 nt, Homo sapiens
gucuccaagacc

SEQ ID NO: 631106 - RNA, 16 nt, Homo sapiens
gucuccaugcuggaua

SEQ ID NO: 631107 - RNA, 22 nt, Homo sapiens
gucuccauuuucuucucuguga

SEQ ID NO: 631108 - RNA, 22 nt, Homo sapiens
gucuccuacucuguguaaauau

SEQ ID NO: 631109 - RNA, 22 nt, Homo sapiens
gucuccucuuaaaaaauaaaaa

SEQ ID NO: 631110 - RNA, 18 nt, Homo sapiens
gucuccuuugcacugagg

SEQ ID NO: 631111 - RNA, 23 nt, Homo sapiens
gucuccuuugcacugagggccac

SEQ ID NO: 631112 - RNA, 15 nt, Homo sapiens
gucucgaacuccuga

SEQ ID NO: 631113 - RNA, 21 nt, Homo sapiens
gucucgaacuccugaccucaa

SEQ ID NO: 631114 - RNA, 18 nt, Homo sapiens
gucucgcgcgacugagaa

SEQ ID NO: 631115 - RNA, 21 nt, Homo sapiens
gucucggccccucugauuguu

SEQ ID NO: 631116 - RNA, 15 nt, Homo sapiens
gucucuaaccauuca

SEQ ID NO: 631117 - RNA, 16 nt, Homo sapiens
gucucuaaccauucaa

SEQ ID NO: 631118 - RNA, 21 nt, Homo sapiens
gucucuacuaaaaaugcaaaa

SEQ ID NO: 631119 - RNA, 16 nt, Homo sapiens
gucucuaucuccugaa

SEQ ID NO: 631120 - RNA, 22 nt, Homo sapiens
gucucucuaguugaacccuggg

SEQ ID NO: 631121 - RNA, 15 nt, Homo sapiens
gucucugccucccuc

SEQ ID NO: 631122 - RNA, 19 nt, Homo sapiens
gucucugcuccuacaucca

SEQ ID NO: 631123 - RNA, 22 nt, Homo sapiens
gucucuuccuggucugaacucc

SEQ ID NO: 631124 - RNA, 19 nt, Homo sapiens
gucucuuggcuuugucacu

SEQ ID NO: 631125 - RNA, 19 nt, Homo sapiens
gucucuuuuugguaauaac

SEQ ID NO: 631126 - RNA, 17 nt, Homo sapiens
gucugaaggcauuugca

SEQ ID NO: 631127 - RNA, 17 nt, Homo sapiens
gucugaauucuggaauc

SEQ ID NO: 631128 - RNA, 13 nt, Homo sapiens
gucugacucucca

SEQ ID NO: 631129 - RNA, 14 nt, Homo sapiens
gucugagaccacuu

SEQ ID NO: 631130 - RNA, 18 nt, Homo sapiens
gucugagacucacaggaa

SEQ ID NO: 631131 - RNA, 20 nt, Homo sapiens
gucugauaaugauuugcucu

SEQ ID NO: 631132 - RNA, 12 nt, Homo sapiens
gucugaugacac

SEQ ID NO: 631133 - RNA, 23 nt, Homo sapiens
cugccugaaggcucacaccucau

SEQ ID NO: 631134 - RNA, 15 nt, Homo sapiens
cugccugaguuucca

SEQ ID NO: 631135 - RNA, 17 nt, Homo sapiens
cugccuggagagcuccu

SEQ ID NO: 631136 - RNA, 20 nt, Homo sapiens
cugccuggggggcaggguua

SEQ ID NO: 631137 - RNA, 16 nt, Homo sapiens
cugccugguauaucca

SEQ ID NO: 631138 - RNA, 19 nt, Homo sapiens
cugccuguagcaauggcca

SEQ ID NO: 631139 - RNA, 14 nt, Homo sapiens
cugccuguagcccc

SEQ ID NO: 631140 - RNA, 14 nt, Homo sapiens
cugccugugcauga

SEQ ID NO: 631141 - RNA, 22 nt, Homo sapiens
cugccugugcaugaccugauca

SEQ ID NO: 631142 - RNA, 12 nt, Homo sapiens
cugccuguggag

SEQ ID NO: 631143 - RNA, 22 nt, Homo sapiens
cugccuguuauaacucugcacu

SEQ ID NO: 631144 - RNA, 21 nt, Homo sapiens
cugccuguuggcaggcccacu

SEQ ID NO: 631145 - RNA, 16 nt, Homo sapiens
cugccuuaaaaccaaa

SEQ ID NO: 631146 - RNA, 15 nt, Homo sapiens
cugccuuacuguaca

SEQ ID NO: 631147 - RNA, 14 nt, Homo sapiens
cugccuuagccuac

SEQ ID NO: 631148 - RNA, 21 nt, Homo sapiens
cugccuuagccuaccauguga

SEQ ID NO: 631149 - RNA, 22 nt, Homo sapiens
cugccuuaggguagugcuaaga

SEQ ID NO: 631150 - RNA, 16 nt, Homo sapiens
cugccuucaccccacu

SEQ ID NO: 631151 - RNA, 13 nt, Homo sapiens
cugccuucuuggg

SEQ ID NO: 631152 - RNA, 17 nt, Homo sapiens
cugccuuguccugaugc

SEQ ID NO: 631153 - RNA, 14 nt, Homo sapiens
cugccuuugaucac

SEQ ID NO: 631154 - RNA, 13 nt, Homo sapiens
cugcgaccuugca

SEQ ID NO: 631155 - RNA, 13 nt, Homo sapiens
cugcgacugauga

SEQ ID NO: 631156 - RNA, 15 nt, Homo sapiens
cugcgauaacugaga

SEQ ID NO: 631157 - RNA, 15 nt, Homo sapiens
cugcgcaccaaggaa

SEQ ID NO: 631158 - RNA, 19 nt, Homo sapiens
cugcgcccaguccuuccac

SEQ ID NO: 631159 - RNA, 18 nt, Homo sapiens
cugcggaccccucgucau

SEQ ID NO: 631160 - RNA, 19 nt, Homo sapiens
cugcggggggcaccagagg

SEQ ID NO: 631161 - RNA, 18 nt, Homo sapiens
cugcggguccucagcugc

SEQ ID NO: 631162 - RNA, 18 nt, Homo sapiens
cugcguccccacucccuu

SEQ ID NO: 631163 - RNA, 14 nt, Homo sapiens
cugcgucugcucuu

SEQ ID NO: 631164 - RNA, 12 nt, Homo sapiens
cugcguuuucau

SEQ ID NO: 631165 - RNA, 19 nt, Homo sapiens
cugcuaaaggacaguggau

SEQ ID NO: 631166 - RNA, 22 nt, Homo sapiens
cugcuaaauaucaccuagcaug

SEQ ID NO: 631167 - RNA, 18 nt, Homo sapiens
cugcuaaaugcacugacc

SEQ ID NO: 631168 - RNA, 15 nt, Homo sapiens
cugcuaaugugugau

SEQ ID NO: 631169 - RNA, 17 nt, Homo sapiens
cugcuaauguugaucag

SEQ ID NO: 631170 - RNA, 21 nt, Homo sapiens
cugcuacuggcaaaaggaucu

SEQ ID NO: 631171 - RNA, 14 nt, Homo sapiens
cugcuagucuguca

SEQ ID NO: 631172 - RNA, 17 nt, Homo sapiens
cugcuauaucuauccau

SEQ ID NO: 631173 - RNA, 20 nt, Homo sapiens
cugcuaugacaaaaccuuua

SEQ ID NO: 631174 - RNA, 18 nt, Homo sapiens
gucuuauaugcuuagcau

SEQ ID NO: 631175 - RNA, 13 nt, Homo sapiens
gucuucacuuccc

SEQ ID NO: 631176 - RNA, 13 nt, Homo sapiens
gucuucagcaccc

SEQ ID NO: 631177 - RNA, 13 nt, Homo sapiens
gucuucaguggaa

SEQ ID NO: 631178 - RNA, 19 nt, Homo sapiens
gucuuccagcgagguggga

SEQ ID NO: 631179 - RNA, 18 nt, Homo sapiens
gucuuccugacacuuuaa

SEQ ID NO: 631180 - RNA, 12 nt, Homo sapiens
gucuucucaggc

SEQ ID NO: 631181 - RNA, 18 nt, Homo sapiens
gucuucuccuaauucugc

SEQ ID NO: 631182 - RNA, 20 nt, Homo sapiens
gucuucuguaauucauugag

SEQ ID NO: 631183 - RNA, 16 nt, Homo sapiens
gucuucuuuugauaua

SEQ ID NO: 631184 - RNA, 15 nt, Homo sapiens
gucuugaaacaagca

SEQ ID NO: 631185 - RNA, 23 nt, Homo sapiens
gucuugaaaguggcaccagaggu

SEQ ID NO: 631186 - RNA, 21 nt, Homo sapiens
gucuugagaggagacuuguga

SEQ ID NO: 631187 - RNA, 17 nt, Homo sapiens
gucuugcaacagugcca

SEQ ID NO: 631188 - RNA, 15 nt, Homo sapiens
gucuugccagauuac

SEQ ID NO: 631189 - RNA, 11 nt, Homo sapiens
gucuugccagg

SEQ ID NO: 631190 - RNA, 16 nt, Homo sapiens
gucuugcucuguuacc

SEQ ID NO: 631191 - RNA, 20 nt, Homo sapiens
gucuuggcauuaaaccacau

SEQ ID NO: 631192 - RNA, 12 nt, Homo sapiens
gucuuggcucac

SEQ ID NO: 631193 - RNA, 17 nt, Homo sapiens
gucuugggggucagggg

SEQ ID NO: 631194 - RNA, 17 nt, Homo sapiens
gucuuguuauguacaaa

SEQ ID NO: 631195 - RNA, 18 nt, Homo sapiens
gucuuguuuuuuacucaa

SEQ ID NO: 631196 - RNA, 15 nt, Homo sapiens
gucuuuacuuccauc

SEQ ID NO: 631197 - RNA, 14 nt, Homo sapiens
gucuuucacagugg

SEQ ID NO: 631198 - RNA, 21 nt, Homo sapiens
gucuuucaccgggcaauccaa

SEQ ID NO: 631199 - RNA, 14 nt, Homo sapiens
gucuuucacuggaa

SEQ ID NO: 631200 - RNA, 22 nt, Homo sapiens
gucuuucggggugcuccugugg

SEQ ID NO: 631201 - RNA, 13 nt, Homo sapiens
gucuuucuccuca

SEQ ID NO: 631202 - RNA, 18 nt, Homo sapiens
gucuuucuggaaaggaaa

SEQ ID NO: 631203 - RNA, 21 nt, Homo sapiens
gucuuucuuuuauacugacac

SEQ ID NO: 631204 - RNA, 14 nt, Homo sapiens
gucuuugaacccuu

SEQ ID NO: 631205 - RNA, 21 nt, Homo sapiens
gucuuuguaaugucaccaccu

SEQ ID NO: 631206 - RNA, 17 nt, Homo sapiens
gucuuuguucugugauu

SEQ ID NO: 631207 - RNA, 17 nt, Homo sapiens
gucuuuucaucugggaa

SEQ ID NO: 631208 - RNA, 13 nt, Homo sapiens
gucuuuugaauau

SEQ ID NO: 631209 - RNA, 17 nt, Homo sapiens
gucuuuugagcuauuca

SEQ ID NO: 631210 - RNA, 18 nt, Homo sapiens
gucuuuuuuauguuaaaa

SEQ ID NO: 631211 - RNA, 14 nt, Homo sapiens
gugaaaaacuuaag

SEQ ID NO: 631212 - RNA, 22 nt, Homo sapiens
gugaaaacgcaaacaugaauau

SEQ ID NO: 631213 - RNA, 21 nt, Homo sapiens
gugaaacccugucucuacuaa

SEQ ID NO: 631214 - RNA, 20 nt, Homo sapiens
gugaaauaaaaguagaauaa

SEQ ID NO: 631215 - RNA, 14 nt, Homo sapiens
gugaaaugcuggca

SEQ ID NO: 631216 - RNA, 18 nt, Homo sapiens
gugaaauggccacuacuu

SEQ ID NO: 631217 - RNA, 19 nt, Homo sapiens
gugaaauggccacuacuuu

SEQ ID NO: 631218 - RNA, 14 nt, Homo sapiens
gugaacaguguaua

SEQ ID NO: 631219 - RNA, 21 nt, Homo sapiens
gugaacauugguucuuucauu

SEQ ID NO: 631220 - RNA, 21 nt, Homo sapiens
gugaaccgaggggcucaggaa

SEQ ID NO: 631221 - RNA, 17 nt, Homo sapiens
gugaacgcugugaugcu

SEQ ID NO: 631222 - RNA, 22 nt, Homo sapiens
gugaacucaaucuccagggcuc

SEQ ID NO: 631223 - RNA, 13 nt, Homo sapiens
gugaacugagcug

SEQ ID NO: 631224 - RNA, 15 nt, Homo sapiens
gugaacugugcauag

SEQ ID NO: 631225 - RNA, 14 nt, Homo sapiens
gugaagacccagga

SEQ ID NO: 631226 - RNA, 16 nt, Homo sapiens
gugaagacuugccuuu

SEQ ID NO: 631227 - RNA, 20 nt, Homo sapiens
gugaagagggagaagcauga

SEQ ID NO: 631228 - RNA, 16 nt, Homo sapiens
gugaaguauacuguau

SEQ ID NO: 631229 - RNA, 12 nt, Homo sapiens
gugaagugcaga

SEQ ID NO: 631230 - RNA, 12 nt, Homo sapiens
gugaaguguuac

SEQ ID NO: 631231 - RNA, 22 nt, Homo sapiens
gugaauacauuaacggugcuaa

SEQ ID NO: 631232 - RNA, 17 nt, Homo sapiens
gugaauacucuucccac

SEQ ID NO: 631233 - RNA, 23 nt, Homo sapiens
gugaaucccuuuaggauguuuuc

SEQ ID NO: 631234 - RNA, 11 nt, Homo sapiens
gugaaucugau

SEQ ID NO: 631235 - RNA, 13 nt, Homo sapiens
gugaaugaucucu

SEQ ID NO: 631236 - RNA, 22 nt, Homo sapiens
gugaauguaggcuggcuuucag

SEQ ID NO: 631237 - RNA, 20 nt, Homo sapiens
gugaauguggauucuuccca

SEQ ID NO: 631238 - RNA, 13 nt, Homo sapiens
gugaaugugggca

SEQ ID NO: 631239 - RNA, 14 nt, Homo sapiens
gugaauuauucuga

SEQ ID NO: 631240 - RNA, 18 nt, Homo sapiens
gugaauuauugacacuga

SEQ ID NO: 631241 - RNA, 18 nt, Homo sapiens
gugaauugaauggugcau

SEQ ID NO: 631242 - RNA, 18 nt, Homo sapiens
gugaauugccugcagaga

SEQ ID NO: 631243 - RNA, 20 nt, Homo sapiens
gugaauuuuuaaucagcaau

SEQ ID NO: 631244 - RNA, 21 nt, Homo sapiens
gugacagccccuuauuugcac

SEQ ID NO: 631245 - RNA, 18 nt, Homo sapiens
gugacaggcccaguggaa

SEQ ID NO: 631246 - RNA, 15 nt, Homo sapiens
gugacagggccagug

SEQ ID NO: 631247 - RNA, 16 nt, Homo sapiens
gugacaucaguggcau

SEQ ID NO: 631248 - RNA, 15 nt, Homo sapiens
gugacauuccuucuc

SEQ ID NO: 631249 - RNA, 16 nt, Homo sapiens
gugacauuuccaugca

SEQ ID NO: 631250 - RNA, 19 nt, Homo sapiens
gugacauuuccaugcauaa

SEQ ID NO: 631251 - RNA, 16 nt, Homo sapiens
gugacauuugggagac

SEQ ID NO: 631252 - RNA, 16 nt, Homo sapiens
gugaccacugaagcac

SEQ ID NO: 631253 - RNA, 21 nt, Homo sapiens
gugaccagcggaaacaggugu

SEQ ID NO: 631254 - RNA, 21 nt, Homo sapiens
gugaccauguuuccucucaau

SEQ ID NO: 631255 - RNA, 16 nt, Homo sapiens
cuggaaaaauuccaga

SEQ ID NO: 631256 - RNA, 23 nt, Homo sapiens
cuggaaaacagaaaccauucuag

SEQ ID NO: 631257 - RNA, 16 nt, Homo sapiens
cuggaaaacagaacac

SEQ ID NO: 631258 - RNA, 18 nt, Homo sapiens
cuggaaaacucaggauuc

SEQ ID NO: 631259 - RNA, 22 nt, Homo sapiens
cuggaaaagggucuugggaaau

SEQ ID NO: 631260 - RNA, 23 nt, Homo sapiens
cuggaaaagggucuugggaaaua

SEQ ID NO: 631261 - RNA, 17 nt, Homo sapiens
cuggaaacacagucacu

SEQ ID NO: 631262 - RNA, 23 nt, Homo sapiens
cuggaaaggcucagucucaggag

SEQ ID NO: 631263 - RNA, 18 nt, Homo sapiens
cuggaacauuaguaguua

SEQ ID NO: 631264 - RNA, 17 nt, Homo sapiens
cuggaaccugcaaaaaa

SEQ ID NO: 631265 - RNA, 21 nt, Homo sapiens
cuggaacuuuuuagauuauuc

SEQ ID NO: 631266 - RNA, 23 nt, Homo sapiens
cuggaagaaaaaaaccacacaaa

SEQ ID NO: 631267 - RNA, 19 nt, Homo sapiens
cuggaagacaacccaggca

SEQ ID NO: 631268 - RNA, 12 nt, Homo sapiens
cuggaagacacu

SEQ ID NO: 631269 - RNA, 12 nt, Homo sapiens
cuggaagaugua

SEQ ID NO: 631270 - RNA, 15 nt, Homo sapiens
cuggaagcauuuguu

SEQ ID NO: 631271 - RNA, 17 nt, Homo sapiens
cuggaagcuaauuugca

SEQ ID NO: 631272 - RNA, 17 nt, Homo sapiens
cuggaaggacacaguga

SEQ ID NO: 631273 - RNA, 15 nt, Homo sapiens
cuggaaggacaucua

SEQ ID NO: 631274 - RNA, 23 nt, Homo sapiens
cuggaaggagugagaggggacaa

SEQ ID NO: 631275 - RNA, 13 nt, Homo sapiens
cuggaaggcuucc

SEQ ID NO: 631276 - RNA, 16 nt, Homo sapiens
cuggaaggcuuccacu

SEQ ID NO: 631277 - RNA, 14 nt, Homo sapiens
cuggaauacaugaa

SEQ ID NO: 631278 - RNA, 18 nt, Homo sapiens
cuggaauauugugauucu

SEQ ID NO: 631279 - RNA, 17 nt, Homo sapiens
cuggaaucagcucagga

SEQ ID NO: 631280 - RNA, 14 nt, Homo sapiens
cuggaaucgcuuga

SEQ ID NO: 631281 - RNA, 17 nt, Homo sapiens
cuggaaucuggagacca

SEQ ID NO: 631282 - RNA, 15 nt, Homo sapiens
cuggaaugcugggua

SEQ ID NO: 631283 - RNA, 14 nt, Homo sapiens
cuggaaugugucaa

SEQ ID NO: 631284 - RNA, 23 nt, Homo sapiens
cuggaauuaaaaggaaagucaag

SEQ ID NO: 631285 - RNA, 15 nt, Homo sapiens
cuggaauucuaacaa

SEQ ID NO: 631286 - RNA, 23 nt, Homo sapiens
cuggaauugauauugaaugaugu

SEQ ID NO: 631287 - RNA, 12 nt, Homo sapiens
cuggacacacua

SEQ ID NO: 631288 - RNA, 16 nt, Homo sapiens
cuggacacacucucau

SEQ ID NO: 631289 - RNA, 23 nt, Homo sapiens
cuggacacuguccaugaagcacu

SEQ ID NO: 631290 - RNA, 16 nt, Homo sapiens
cuggacaguaucccac

SEQ ID NO: 631291 - RNA, 21 nt, Homo sapiens
cuggacaguaucccacaucca

SEQ ID NO: 631292 - RNA, 16 nt, Homo sapiens
cuggacauucgaggaa

SEQ ID NO: 631293 - RNA, 23 nt, Homo sapiens
cuggaccagucccgucgugcagu

SEQ ID NO: 631294 - RNA, 23 nt, Homo sapiens
cuggaccauuccaggaaaacugg

SEQ ID NO: 631295 - RNA, 13 nt, Homo sapiens
cuggaccauuccu

SEQ ID NO: 631296 - RNA, 21 nt, Homo sapiens
cuggacgugcgcgaugccugg

SEQ ID NO: 631297 - RNA, 21 nt, Homo sapiens
cuggacuacacccaagccuga

SEQ ID NO: 631298 - RNA, 18 nt, Homo sapiens
gugauccgccuaccucag

SEQ ID NO: 631299 - RNA, 18 nt, Homo sapiens
gugauccuuccaccucag

SEQ ID NO: 631300 - RNA, 20 nt, Homo sapiens
gugaucucccaagcuaucua

SEQ ID NO: 631301 - RNA, 17 nt, Homo sapiens
gugaugaaaacauucaa

SEQ ID NO: 631302 - RNA, 16 nt, Homo sapiens
gugaugagagaaugga

SEQ ID NO: 631303 - RNA, 14 nt, Homo sapiens
gugaugccauuaca

SEQ ID NO: 631304 - RNA, 18 nt, Homo sapiens
gugauggauggcacaaug

SEQ ID NO: 631305 - RNA, 23 nt, Homo sapiens
gugauggcgcgggaggcaccagc

SEQ ID NO: 631306 - RNA, 19 nt, Homo sapiens
gugauggcgggcacugggu

SEQ ID NO: 631307 - RNA, 11 nt, Homo sapiens
gugauguauau

SEQ ID NO: 631308 - RNA, 13 nt, Homo sapiens
gugauuaaaugac

SEQ ID NO: 631309 - RNA, 22 nt, Homo sapiens
gugauucuguuuauucuuccag

SEQ ID NO: 631310 - RNA, 22 nt, Homo sapiens
gugauugacagcuuugcugcug

SEQ ID NO: 631311 - RNA, 16 nt, Homo sapiens
gugauugucaccauga

SEQ ID NO: 631312 - RNA, 14 nt, Homo sapiens
gugauuuacauuuc

SEQ ID NO: 631313 - RNA, 24 nt, Homo sapiens
gugauuucaccccacagacacuua

SEQ ID NO: 631314 - RNA, 15 nt, Homo sapiens
gugauuuccacaggu

SEQ ID NO: 631315 - RNA, 19 nt, Homo sapiens
gugauuucuuucuuugcac

SEQ ID NO: 631316 - RNA, 17 nt, Homo sapiens
gugauuuucauugcugg

SEQ ID NO: 631317 - RNA, 16 nt, Homo sapiens
gugcaaaaucuguuau

SEQ ID NO: 631318 - RNA, 18 nt, Homo sapiens
gugcaaaauggucaguau

SEQ ID NO: 631319 - RNA, 16 nt, Homo sapiens
gugcaaagacucugag

SEQ ID NO: 631320 - RNA, 11 nt, Homo sapiens
gugcaaaggga

SEQ ID NO: 631321 - RNA, 19 nt, Homo sapiens
gugcaaaguucccuacuuc

SEQ ID NO: 631322 - RNA, 18 nt, Homo sapiens
gugcaaaugugcugguca

SEQ ID NO: 631323 - RNA, 13 nt, Homo sapiens
gugcaagaugggg

SEQ ID NO: 631324 - RNA, 19 nt, Homo sapiens
gugcaagugugugcacaug

SEQ ID NO: 631325 - RNA, 23 nt, Homo sapiens
gugcaaucacagcucacugcagc

SEQ ID NO: 631326 - RNA, 14 nt, Homo sapiens
gugcaaugaaugau

SEQ ID NO: 631327 - RNA, 16 nt, Homo sapiens
gugcacaucugugucu

SEQ ID NO: 631328 - RNA, 12 nt, Homo sapiens
gugcacauuuau

SEQ ID NO: 631329 - RNA, 20 nt, Homo sapiens
gugcacauuucauaguuuca

SEQ ID NO: 631330 - RNA, 18 nt, Homo sapiens
gugcaccacuucaaguga

SEQ ID NO: 631331 - RNA, 18 nt, Homo sapiens
gugcacuagccugugauu

SEQ ID NO: 631332 - RNA, 12 nt, Homo sapiens
gugcacugggca

SEQ ID NO: 631333 - RNA, 21 nt, Homo sapiens
gugcagaccuuacucagggga

SEQ ID NO: 631334 - RNA, 13 nt, Homo sapiens
gugcagauaucac

SEQ ID NO: 631335 - RNA, 17 nt, Homo sapiens
gugcagaugcugcugaa

SEQ ID NO: 631336 - RNA, 16 nt, Homo sapiens
gugcagaugggcuguu

SEQ ID NO: 631337 - RNA, 17 nt, Homo sapiens
gugcagcccucuugccc

SEQ ID NO: 631338 - RNA, 16 nt, Homo sapiens
gugcagcugauuuuaa

SEQ ID NO: 631339 - RNA, 16 nt, Homo sapiens
gugcaggacagcucuu

SEQ ID NO: 631340 - RNA, 19 nt, Homo sapiens
gugcagggagacaucugca

SEQ ID NO: 631341 - RNA, 23 nt, Homo sapiens
gugcagguaccugcgauguuuac

SEQ ID NO: 631342 - RNA, 23 nt, Homo sapiens
gugcaguaucaugcccugugcaa

SEQ ID NO: 631343 - RNA, 15 nt, Homo sapiens
gugcagucacuggag

SEQ ID NO: 631344 - RNA, 17 nt, Homo sapiens
gugcaguccauuuccua

SEQ ID NO: 631345 - RNA, 13 nt, Homo sapiens
gugcagucuuuga

SEQ ID NO: 631346 - RNA, 12 nt, Homo sapiens
gugcagugauac

SEQ ID NO: 631347 - RNA, 12 nt, Homo sapiens
gugcagugccgc

SEQ ID NO: 631348 - RNA, 19 nt, Homo sapiens
gugcaguggugugaucuca

SEQ ID NO: 631349 - RNA, 21 nt, Homo sapiens
gugcaucacggauggugcaug

SEQ ID NO: 631350 - RNA, 15 nt, Homo sapiens
gugcauccccacgac

SEQ ID NO: 631351 - RNA, 15 nt, Homo sapiens
gugcaucccugagac

SEQ ID NO: 631352 - RNA, 12 nt, Homo sapiens
gugcaugcucuc

SEQ ID NO: 631353 - RNA, 16 nt, Homo sapiens
gugcauguauguauac

SEQ ID NO: 631354 - RNA, 13 nt, Homo sapiens
gugcaugugcacu

SEQ ID NO: 631355 - RNA, 15 nt, Homo sapiens
gugcaugugcacuug

SEQ ID NO: 631356 - RNA, 11 nt, Homo sapiens
gugcauuuuau

SEQ ID NO: 631357 - RNA, 19 nt, Homo sapiens
gugcauuuucucaucaucc

SEQ ID NO: 631358 - RNA, 19 nt, Homo sapiens
gugccaaaaaucuuuucau

SEQ ID NO: 631359 - RNA, 17 nt, Homo sapiens
gugccacacgcaugggc

SEQ ID NO: 631360 - RNA, 19 nt, Homo sapiens
gugccagacauugcucuca

SEQ ID NO: 631361 - RNA, 20 nt, Homo sapiens
gugccagaggcuggaccaca

SEQ ID NO: 631362 - RNA, 15 nt, Homo sapiens
gugccagcaaugaca

SEQ ID NO: 631363 - RNA, 17 nt, Homo sapiens
gugccagcaaugacauc

SEQ ID NO: 631364 - RNA, 21 nt, Homo sapiens
gugccaggcuguaagcauucu

SEQ ID NO: 631365 - RNA, 12 nt, Homo sapiens
gugccaguuccu

SEQ ID NO: 631366 - RNA, 15 nt, Homo sapiens
gugccaguucuuucc

SEQ ID NO: 631367 - RNA, 18 nt, Homo sapiens
gugccauccccaccuuca

SEQ ID NO: 631368 - RNA, 13 nt, Homo sapiens
gugccaugaucug

SEQ ID NO: 631369 - RNA, 17 nt, Homo sapiens
gugccauuacuacugua

SEQ ID NO: 631370 - RNA, 21 nt, Homo sapiens
gugccauuuuaagaguuacuu

SEQ ID NO: 631371 - RNA, 15 nt, Homo sapiens
gugcccaaaagccau

SEQ ID NO: 631372 - RNA, 15 nt, Homo sapiens
gugcccaccaacauc

SEQ ID NO: 631373 - RNA, 14 nt, Homo sapiens
gugcccagguugcu

SEQ ID NO: 631374 - RNA, 19 nt, Homo sapiens
gugcccaucaagugcaguc

SEQ ID NO: 631375 - RNA, 20 nt, Homo sapiens
gugcccauccugccauccuc

SEQ ID NO: 631376 - RNA, 13 nt, Homo sapiens
gugcccaugaaga

SEQ ID NO: 631377 - RNA, 23 nt, Homo sapiens
cuggccucgugaucugcccuucu

SEQ ID NO: 631378 - RNA, 15 nt, Homo sapiens
cuggccugagaguca

SEQ ID NO: 631379 - RNA, 23 nt, Homo sapiens
cuggccuggaucuccccacucua

SEQ ID NO: 631380 - RNA, 17 nt, Homo sapiens
cuggccuugugucacug

SEQ ID NO: 631381 - RNA, 16 nt, Homo sapiens
cuggcgagaauacagc

SEQ ID NO: 631382 - RNA, 14 nt, Homo sapiens
cuggcuaacugaug

SEQ ID NO: 631383 - RNA, 22 nt, Homo sapiens
cuggcuagaguccucacuccca

SEQ ID NO: 631384 - RNA, 16 nt, Homo sapiens
cuggcuaugcauuuga

SEQ ID NO: 631385 - RNA, 15 nt, Homo sapiens
cuggcucacaguaca

SEQ ID NO: 631386 - RNA, 16 nt, Homo sapiens
cuggcucacaguacag

SEQ ID NO: 631387 - RNA, 13 nt, Homo sapiens
cuggcucaucucu

SEQ ID NO: 631388 - RNA, 17 nt, Homo sapiens
cuggcuccuucacugaa

SEQ ID NO: 631389 - RNA, 14 nt, Homo sapiens
cuggcucucagaag

SEQ ID NO: 631390 - RNA, 12 nt, Homo sapiens
cuggcugccagg

SEQ ID NO: 631391 - RNA, 19 nt, Homo sapiens
cuggcugcccuggcccuga

SEQ ID NO: 631392 - RNA, 22 nt, Homo sapiens
cuggcugcuuuguucaaugcua

SEQ ID NO: 631393 - RNA, 15 nt, Homo sapiens
cuggcuggaaaaagg

SEQ ID NO: 631394 - RNA, 15 nt, Homo sapiens
cuggcuggccagucu

SEQ ID NO: 631395 - RNA, 22 nt, Homo sapiens
cuggcugggaguccuuaccucg

SEQ ID NO: 631396 - RNA, 13 nt, Homo sapiens
cuggcugggcaug

SEQ ID NO: 631397 - RNA, 17 nt, Homo sapiens
cuggcugucugccugua

SEQ ID NO: 631398 - RNA, 20 nt, Homo sapiens
cuggcugucugucugcagug

SEQ ID NO: 631399 - RNA, 14 nt, Homo sapiens
cuggcuguggacca

SEQ ID NO: 631400 - RNA, 23 nt, Homo sapiens
cuggcuuccagguaucuccagga

SEQ ID NO: 631401 - RNA, 17 nt, Homo sapiens
cuggcuucucuccucag

SEQ ID NO: 631402 - RNA, 20 nt, Homo sapiens
cuggcuucucuugagucaca

SEQ ID NO: 631403 - RNA, 23 nt, Homo sapiens
cuggcuugccccaggacucuggc

SEQ ID NO: 631404 - RNA, 14 nt, Homo sapiens
cuggcuuggaacac

SEQ ID NO: 631405 - RNA, 23 nt, Homo sapiens
cuggcuuggggucaagaaacagc

SEQ ID NO: 631406 - RNA, 22 nt, Homo sapiens
cuggcuuuucaccccagaggac

SEQ ID NO: 631407 - RNA, 18 nt, Homo sapiens
cugggaacacaucuggcu

SEQ ID NO: 631408 - RNA, 16 nt, Homo sapiens
cugggaaccacuccca

SEQ ID NO: 631409 - RNA, 12 nt, Homo sapiens
cugggaaccagc

SEQ ID NO: 631410 - RNA, 18 nt, Homo sapiens
cugggaaccagcaucuca

SEQ ID NO: 631411 - RNA, 15 nt, Homo sapiens
cugggaauggggaca

SEQ ID NO: 631412 - RNA, 20 nt, Homo sapiens
cugggacccuuggcuaugaa

SEQ ID NO: 631413 - RNA, 15 nt, Homo sapiens
cugggaccugaaccu

SEQ ID NO: 631414 - RNA, 17 nt, Homo sapiens
cugggacuacaggugug

SEQ ID NO: 631415 - RNA, 15 nt, Homo sapiens
cugggagaaccucag

SEQ ID NO: 631416 - RNA, 21 nt, Homo sapiens
cugggagacuuugaagaccag

SEQ ID NO: 631417 - RNA, 18 nt, Homo sapiens
cugggagauacagccauc

SEQ ID NO: 631418 - RNA, 16 nt, Homo sapiens
cugggagcacuggugu

SEQ ID NO: 631419 - RNA, 22 nt, Homo sapiens
cugggagcagcucugugacucc

SEQ ID NO: 631420 - RNA, 14 nt, Homo sapiens
cugggagccagugu

SEQ ID NO: 631421 - RNA, 22 nt, Homo sapiens
cugggagccagugugcccaaaa

SEQ ID NO: 631422 - RNA, 14 nt, Homo sapiens
gugcuugggcucca

SEQ ID NO: 631423 - RNA, 23 nt, Homo sapiens
gugcuuguucuguccucuugccu

SEQ ID NO: 631424 - RNA, 14 nt, Homo sapiens
gugcuuguuuacag

SEQ ID NO: 631425 - RNA, 19 nt, Homo sapiens
gugcuuuuugggaccauca

SEQ ID NO: 631426 - RNA, 13 nt, Homo sapiens
guggaaaaggaaa

SEQ ID NO: 631427 - RNA, 13 nt, Homo sapiens
guggaaaauggaa

SEQ ID NO: 631428 - RNA, 14 nt, Homo sapiens
guggaaaauggaau

SEQ ID NO: 631429 - RNA, 19 nt, Homo sapiens
guggaaacaauaaaaccug

SEQ ID NO: 631430 - RNA, 16 nt, Homo sapiens
guggaaauaauuugaa

SEQ ID NO: 631431 - RNA, 13 nt, Homo sapiens
guggaacaaaagu

SEQ ID NO: 631432 - RNA, 13 nt, Homo sapiens
guggaacauucug

SEQ ID NO: 631433 - RNA, 12 nt, Homo sapiens
guggaaggugag

SEQ ID NO: 631434 - RNA, 22 nt, Homo sapiens
guggacacagaucccacuggaa

SEQ ID NO: 631435 - RNA, 17 nt, Homo sapiens
guggacacgcgugauug

SEQ ID NO: 631436 - RNA, 18 nt, Homo sapiens
guggacgugcacugacag

SEQ ID NO: 631437 - RNA, 14 nt, Homo sapiens
guggacugugcugg

SEQ ID NO: 631438 - RNA, 19 nt, Homo sapiens
guggacugugcuggugcau

SEQ ID NO: 631439 - RNA, 23 nt, Homo sapiens
guggagacccugccacagccaga

SEQ ID NO: 631440 - RNA, 22 nt, Homo sapiens
guggagauuuacacuacauugu

SEQ ID NO: 631441 - RNA, 23 nt, Homo sapiens
guggagccauugaacagcuguga

SEQ ID NO: 631442 - RNA, 13 nt, Homo sapiens
guggagcucagcc

SEQ ID NO: 631443 - RNA, 13 nt, Homo sapiens
guggagguucugu

SEQ ID NO: 631444 - RNA, 13 nt, Homo sapiens
guggagguugcag

SEQ ID NO: 631445 - RNA, 21 nt, Homo sapiens
guggauauuaaaaaucuguaa

SEQ ID NO: 631446 - RNA, 14 nt, Homo sapiens
guggaugacuguug

SEQ ID NO: 631447 - RNA, 15 nt, Homo sapiens
guggaugauguuucg

SEQ ID NO: 631448 - RNA, 12 nt, Homo sapiens
guggauguauaa

SEQ ID NO: 631449 - RNA, 18 nt, Homo sapiens
guggauuccgagugguga

SEQ ID NO: 631450 - RNA, 21 nt, Homo sapiens
guggauucuucccacacagaa

SEQ ID NO: 631451 - RNA, 22 nt, Homo sapiens
guggcaagcugugacuucucca

SEQ ID NO: 631452 - RNA, 13 nt, Homo sapiens
guggcacaggagu

SEQ ID NO: 631453 - RNA, 21 nt, Homo sapiens
guggcagauaaucagccucuu

SEQ ID NO: 631454 - RNA, 16 nt, Homo sapiens
guggcagauuuaguga

SEQ ID NO: 631455 - RNA, 14 nt, Homo sapiens
guggcauccuguga

SEQ ID NO: 631456 - RNA, 19 nt, Homo sapiens
guggccaaggagcugcuau

SEQ ID NO: 631457 - RNA, 10 nt, Homo sapiens
guggccacag

SEQ ID NO: 631458 - RNA, 13 nt, Homo sapiens
guggccacagacu

SEQ ID NO: 631459 - RNA, 22 nt, Homo sapiens
guggccaccaguaugacaguau

SEQ ID NO: 631460 - RNA, 17 nt, Homo sapiens
guggccagcacucugaa

SEQ ID NO: 631461 - RNA, 16 nt, Homo sapiens
guggccaggcugccug

SEQ ID NO: 631462 - RNA, 18 nt, Homo sapiens
guggcccaagggugguga

SEQ ID NO: 631463 - RNA, 17 nt, Homo sapiens
guggccgaggacuuuga

SEQ ID NO: 631464 - RNA, 14 nt, Homo sapiens
guggccugccuuca

SEQ ID NO: 631465 - RNA, 13 nt, Homo sapiens
guggccugggauc

SEQ ID NO: 631466 - RNA, 14 nt, Homo sapiens
guggccuuccccuu

SEQ ID NO: 631467 - RNA, 17 nt, Homo sapiens
guggccuugaccuccaa

SEQ ID NO: 631468 - RNA, 16 nt, Homo sapiens
guggcucagugccuuc

SEQ ID NO: 631469 - RNA, 14 nt, Homo sapiens
guggcuccuaucug

SEQ ID NO: 631470 - RNA, 19 nt, Homo sapiens
guggcugcaccacuuccag

SEQ ID NO: 631471 - RNA, 22 nt, Homo sapiens
guggcugcugaaacucauuuga

SEQ ID NO: 631472 - RNA, 20 nt, Homo sapiens
guggcugggugcccucucag

SEQ ID NO: 631473 - RNA, 16 nt, Homo sapiens
guggcugugacaucua

SEQ ID NO: 631474 - RNA, 14 nt, Homo sapiens
guggcugugccacc

SEQ ID NO: 631475 - RNA, 14 nt, Homo sapiens
guggcuuugcauag

SEQ ID NO: 631476 - RNA, 20 nt, Homo sapiens
gugggaaaaaaaugaaugag

SEQ ID NO: 631477 - RNA, 21 nt, Homo sapiens
gugggaaggucccuuguuucc

SEQ ID NO: 631478 - RNA, 18 nt, Homo sapiens
gugggacaaaccagagca

SEQ ID NO: 631479 - RNA, 15 nt, Homo sapiens
gugggagaaggacua

SEQ ID NO: 631480 - RNA, 20 nt, Homo sapiens
gugggagauguuagacucau

SEQ ID NO: 631481 - RNA, 21 nt, Homo sapiens
gugggagcagcgguuugggga

SEQ ID NO: 631482 - RNA, 13 nt, Homo sapiens
gugggaggcagaa

SEQ ID NO: 631483 - RNA, 21 nt, Homo sapiens
gugggauggcauuuggucuca

SEQ ID NO: 631484 - RNA, 15 nt, Homo sapiens
gugggcaccucagaa

SEQ ID NO: 631485 - RNA, 12 nt, Homo sapiens
gugggcacuggu

SEQ ID NO: 631486 - RNA, 13 nt, Homo sapiens
gugggcacuggug

SEQ ID NO: 631487 - RNA, 18 nt, Homo sapiens
gugggcagagccuuccac

SEQ ID NO: 631488 - RNA, 20 nt, Homo sapiens
gugggcagaucacgagguca

SEQ ID NO: 631489 - RNA, 11 nt, Homo sapiens
gugggccacag

SEQ ID NO: 631490 - RNA, 12 nt, Homo sapiens
gugggcccagca

SEQ ID NO: 631491 - RNA, 20 nt, Homo sapiens
gugggccguaucugucacaa

SEQ ID NO: 631492 - RNA, 17 nt, Homo sapiens
gugggccuuaacauccc

SEQ ID NO: 631493 - RNA, 20 nt, Homo sapiens
gugggcucccugacugggag

SEQ ID NO: 631494 - RNA, 12 nt, Homo sapiens
gugggcugugag

SEQ ID NO: 631495 - RNA, 15 nt, Homo sapiens
gugggcugugccaag

SEQ ID NO: 631496 - RNA, 17 nt, Homo sapiens
guggggaggugucacau

SEQ ID NO: 631497 - RNA, 18 nt, Homo sapiens
guggggauguuuugacau

SEQ ID NO: 631498 - RNA, 15 nt, Homo sapiens
guggggggacugccu

SEQ ID NO: 631499 - RNA, 14 nt, Homo sapiens
guggggugcacucg

SEQ ID NO: 631500 - RNA, 15 nt, Homo sapiens
cugguacucaagcca

SEQ ID NO: 631501 - RNA, 17 nt, Homo sapiens
cugguacuuagaguuuc

SEQ ID NO: 631502 - RNA, 12 nt, Homo sapiens
cugguagcacau

SEQ ID NO: 631503 - RNA, 22 nt, Homo sapiens
cugguaggaagauggagguuua

SEQ ID NO: 631504 - RNA, 18 nt, Homo sapiens
cugguauuuauauuucaa

SEQ ID NO: 631505 - RNA, 20 nt, Homo sapiens
cuggucaccuugcacuccuc

SEQ ID NO: 631506 - RNA, 16 nt, Homo sapiens
cuggucccucuucucu

SEQ ID NO: 631507 - RNA, 15 nt, Homo sapiens
cuggucccuugcagc

SEQ ID NO: 631508 - RNA, 20 nt, Homo sapiens
cugguccuucugaccccacu

SEQ ID NO: 631509 - RNA, 15 nt, Homo sapiens
cuggucucaaacucc

SEQ ID NO: 631510 - RNA, 13 nt, Homo sapiens
cuggucuccuugc

SEQ ID NO: 631511 - RNA, 16 nt, Homo sapiens
cuggugaaggaucuug

SEQ ID NO: 631512 - RNA, 20 nt, Homo sapiens
cuggugaaggaucuugccug

SEQ ID NO: 631513 - RNA, 23 nt, Homo sapiens
cuggugaauccucguucuaauaa

SEQ ID NO: 631514 - RNA, 17 nt, Homo sapiens
cuggugagguuguggag

SEQ ID NO: 631515 - RNA, 22 nt, Homo sapiens
cuggugauguugaaauaugcau

SEQ ID NO: 631516 - RNA, 18 nt, Homo sapiens
cuggugcagucauuauga

SEQ ID NO: 631517 - RNA, 12 nt, Homo sapiens
cuggugccccac

SEQ ID NO: 631518 - RNA, 16 nt, Homo sapiens
cuggugccccuuugcc

SEQ ID NO: 631519 - RNA, 14 nt, Homo sapiens
cuggugcuccaguu

SEQ ID NO: 631520 - RNA, 16 nt, Homo sapiens
cugguggcaccagaug

SEQ ID NO: 631521 - RNA, 23 nt, Homo sapiens
cuggugggcuagccaauagaguu

SEQ ID NO: 631522 - RNA, 16 nt, Homo sapiens
cugguggugcugcacc

SEQ ID NO: 631523 - RNA, 19 nt, Homo sapiens
cuggugguucuacugaccc

SEQ ID NO: 631524 - RNA, 23 nt, Homo sapiens
cuggugucacccuggauaggcaa

SEQ ID NO: 631525 - RNA, 14 nt, Homo sapiens
cugguguccugacc

SEQ ID NO: 631526 - RNA, 16 nt, Homo sapiens
cugguguucugaagug

SEQ ID NO: 631527 - RNA, 15 nt, Homo sapiens
cugguguuggggaaa

SEQ ID NO: 631528 - RNA, 15 nt, Homo sapiens
cugguuagaaaugca

SEQ ID NO: 631529 - RNA, 15 nt, Homo sapiens
cugguuauaacagca

SEQ ID NO: 631530 - RNA, 19 nt, Homo sapiens
cugguugccucucuugccc

SEQ ID NO: 631531 - RNA, 16 nt, Homo sapiens
cugguugucaguuaca

SEQ ID NO: 631532 - RNA, 14 nt, Homo sapiens
cugguuguucuguu

SEQ ID NO: 631533 - RNA, 21 nt, Homo sapiens
cugguuguugccaaacagcca

SEQ ID NO: 631534 - RNA, 22 nt, Homo sapiens
cugguuucuaccagcucauaca

SEQ ID NO: 631535 - RNA, 13 nt, Homo sapiens
cugguuugacuca

SEQ ID NO: 631536 - RNA, 16 nt, Homo sapiens
cugguuuucugccaau

SEQ ID NO: 631537 - RNA, 18 nt, Homo sapiens
cuguaaaaaauggagcuc

SEQ ID NO: 631538 - RNA, 20 nt, Homo sapiens
cuguaaaaaauggagcucag

SEQ ID NO: 631539 - RNA, 15 nt, Homo sapiens
cuguaaacuguguau

SEQ ID NO: 631540 - RNA, 14 nt, Homo sapiens
cuguaaacuuccaa

SEQ ID NO: 631541 - RNA, 21 nt, Homo sapiens
cuguaaacuuuaucacuuaaa

SEQ ID NO: 631542 - RNA, 14 nt, Homo sapiens
cuguaaagacuuuu

SEQ ID NO: 631543 - RNA, 23 nt, Homo sapiens
cuguaaagguuuuuggaauuaug

SEQ ID NO: 631544 - RNA, 15 nt, Homo sapiens
cuguaaauaaccuau

SEQ ID NO: 631545 - RNA, 19 nt, Homo sapiens
cuguaaauauuuuucacau

SEQ ID NO: 631546 - RNA, 17 nt, Homo sapiens
cuguaaaugacacuuuc

SEQ ID NO: 631547 - RNA, 20 nt, Homo sapiens
gugucaggcagguuugccag

SEQ ID NO: 631548 - RNA, 16 nt, Homo sapiens
gugucauaaacuuucu

SEQ ID NO: 631549 - RNA, 16 nt, Homo sapiens
gugucaugaauuccuu

SEQ ID NO: 631550 - RNA, 13 nt, Homo sapiens
gugucauggugac

SEQ ID NO: 631551 - RNA, 18 nt, Homo sapiens
gugucauuggaagccauc

SEQ ID NO: 631552 - RNA, 13 nt, Homo sapiens
guguccagacuca

SEQ ID NO: 631553 - RNA, 11 nt, Homo sapiens
guguccaugcc

SEQ ID NO: 631554 - RNA, 13 nt, Homo sapiens
guguccaugugug

SEQ ID NO: 631555 - RNA, 22 nt, Homo sapiens
guguccauuuugcaaacccaac

SEQ ID NO: 631556 - RNA, 15 nt, Homo sapiens
gugucccaugaccca

SEQ ID NO: 631557 - RNA, 20 nt, Homo sapiens
guguccccucacgcaagugc

SEQ ID NO: 631558 - RNA, 19 nt, Homo sapiens
guguccccucacucuguca

SEQ ID NO: 631559 - RNA, 22 nt, Homo sapiens
guguccccuuccccugcugacc

SEQ ID NO: 631560 - RNA, 20 nt, Homo sapiens
guguccgaccuacguuccug

SEQ ID NO: 631561 - RNA, 14 nt, Homo sapiens
guguccucagggag

SEQ ID NO: 631562 - RNA, 17 nt, Homo sapiens
gugucugccaaacacau

SEQ ID NO: 631563 - RNA, 16 nt, Homo sapiens
gugucugcugacuguu

SEQ ID NO: 631564 - RNA, 18 nt, Homo sapiens
gugucugucagcugugaa

SEQ ID NO: 631565 - RNA, 14 nt, Homo sapiens
gugucuguguauau

SEQ ID NO: 631566 - RNA, 17 nt, Homo sapiens
gugucuuacgugccacc

SEQ ID NO: 631567 - RNA, 21 nt, Homo sapiens
gugucuucaaugucaacagau

SEQ ID NO: 631568 - RNA, 18 nt, Homo sapiens
gugucuuucacagcuccu

SEQ ID NO: 631569 - RNA, 14 nt, Homo sapiens
gugugaacugggca

SEQ ID NO: 631570 - RNA, 18 nt, Homo sapiens
gugugaagcuuugcacac

SEQ ID NO: 631571 - RNA, 23 nt, Homo sapiens
gugugaauguagcuuccaccuca

SEQ ID NO: 631572 - RNA, 20 nt, Homo sapiens
gugugagcguggccuuggga

SEQ ID NO: 631573 - RNA, 22 nt, Homo sapiens
gugugaucuuaauauauuugaa

SEQ ID NO: 631574 - RNA, 14 nt, Homo sapiens
gugugaugcaccug

SEQ ID NO: 631575 - RNA, 13 nt, Homo sapiens
gugugauugcaca

SEQ ID NO: 631576 - RNA, 18 nt, Homo sapiens
gugugauuuccuacagaa

SEQ ID NO: 631577 - RNA, 12 nt, Homo sapiens
gugugcaagugu

SEQ ID NO: 631578 - RNA, 20 nt, Homo sapiens
gugugcaagugugugcacau

SEQ ID NO: 631579 - RNA, 13 nt, Homo sapiens
gugugccauguca

SEQ ID NO: 631580 - RNA, 21 nt, Homo sapiens
gugugccuccuagagugcagg

SEQ ID NO: 631581 - RNA, 13 nt, Homo sapiens
gugugcgugcaug

SEQ ID NO: 631582 - RNA, 19 nt, Homo sapiens
gugugcgugugcgugcgug

SEQ ID NO: 631583 - RNA, 22 nt, Homo sapiens
guguggacuuugagcacacuuu

SEQ ID NO: 631584 - RNA, 15 nt, Homo sapiens
guguggagcacgugg

SEQ ID NO: 631585 - RNA, 23 nt, Homo sapiens
guguggauuuucuacuguaagaa

SEQ ID NO: 631586 - RNA, 14 nt, Homo sapiens
guguggcuuuccag

SEQ ID NO: 631587 - RNA, 22 nt, Homo sapiens
gugugggaaagcgcggacgugc

SEQ ID NO: 631588 - RNA, 14 nt, Homo sapiens
guguggggccaugc

SEQ ID NO: 631589 - RNA, 23 nt, Homo sapiens
gugugguguccccuccuuucuau

SEQ ID NO: 631590 - RNA, 22 nt, Homo sapiens
guguguauauaaauacaugcac

SEQ ID NO: 631591 - RNA, 21 nt, Homo sapiens
gugugucaggcccucugccug

SEQ ID NO: 631592 - RNA, 23 nt, Homo sapiens
guguguccaugugugugcaagug

SEQ ID NO: 631593 - RNA, 23 nt, Homo sapiens
gugugucgcuuaugucuauaacu

SEQ ID NO: 631594 - RNA, 16 nt, Homo sapiens
gugugugcgcacacau

SEQ ID NO: 631595 - RNA, 17 nt, Homo sapiens
gugugugcgugugucca

SEQ ID NO: 631596 - RNA, 18 nt, Homo sapiens
guguguuuggaagacuau

SEQ ID NO: 631597 - RNA, 18 nt, Homo sapiens
guguuaagcguucaguga

SEQ ID NO: 631598 - RNA, 13 nt, Homo sapiens
guguuaccauccc

SEQ ID NO: 631599 - RNA, 21 nt, Homo sapiens
guguuacgcacacguacuuaa

SEQ ID NO: 631600 - RNA, 19 nt, Homo sapiens
guguuauuugugggguaca

SEQ ID NO: 631601 - RNA, 18 nt, Homo sapiens
guguucacaacagugaaa

SEQ ID NO: 631602 - RNA, 22 nt, Homo sapiens
guguuccauugccauagcugac

SEQ ID NO: 631603 - RNA, 21 nt, Homo sapiens
guguuccuaaaauggugauau

SEQ ID NO: 631604 - RNA, 17 nt, Homo sapiens
guguucugaagugggaa

SEQ ID NO: 631605 - RNA, 16 nt, Homo sapiens
guguucuguaaucaaa

SEQ ID NO: 631606 - RNA, 12 nt, Homo sapiens
guguugauccca

SEQ ID NO: 631607 - RNA, 14 nt, Homo sapiens
guguugaucccaag

SEQ ID NO: 631608 - RNA, 17 nt, Homo sapiens
guguuucugucucucca

SEQ ID NO: 631609 - RNA, 23 nt, Homo sapiens
guguuucuuccccuuacucucac

SEQ ID NO: 631610 - RNA, 24 nt, Homo sapiens
guguuucuucuggcuuagucuguu

SEQ ID NO: 631611 - RNA, 13 nt, Homo sapiens
guguuucuuuuga

SEQ ID NO: 631612 - RNA, 14 nt, Homo sapiens
guguuugaggccaa

SEQ ID NO: 631613 - RNA, 17 nt, Homo sapiens
guguuugggaugaccag

SEQ ID NO: 631614 - RNA, 15 nt, Homo sapiens
guguuuuauugacau

SEQ ID NO: 631615 - RNA, 22 nt, Homo sapiens
guguuuucaucauuucagccaa

SEQ ID NO: 631616 - RNA, 16 nt, Homo sapiens
guguuuuguacacuua

SEQ ID NO: 631617 - RNA, 14 nt, Homo sapiens
guguuuugucagac

SEQ ID NO: 631618 - RNA, 22 nt, Homo sapiens
guguuuuuaauaaagacagggu

SEQ ID NO: 631619 - RNA, 18 nt, Homo sapiens
guguuuuucacauuugcg

SEQ ID NO: 631620 - RNA, 21 nt, Homo sapiens
guguuuuucuuuuuccacaag

SEQ ID NO: 631621 - RNA, 12 nt, Homo sapiens
guuaaaacaaag

SEQ ID NO: 631622 - RNA, 21 nt, Homo sapiens
cugucacaaagggacuuugga

SEQ ID NO: 631623 - RNA, 16 nt, Homo sapiens
cugucacagaguagaa

SEQ ID NO: 631624 - RNA, 20 nt, Homo sapiens
cugucacaucagcaauuuca

SEQ ID NO: 631625 - RNA, 14 nt, Homo sapiens
cugucaccaugacu

SEQ ID NO: 631626 - RNA, 12 nt, Homo sapiens
cugucacucuag

SEQ ID NO: 631627 - RNA, 14 nt, Homo sapiens
cugucacugagcaa

SEQ ID NO: 631628 - RNA, 19 nt, Homo sapiens
cugucacuggcagagcaca

SEQ ID NO: 631629 - RNA, 22 nt, Homo sapiens
cugucagaaaaagcuagcacua

SEQ ID NO: 631630 - RNA, 14 nt, Homo sapiens
cugucagcugugaa

SEQ ID NO: 631631 - RNA, 15 nt, Homo sapiens
cugucagcugugaag

SEQ ID NO: 631632 - RNA, 15 nt, Homo sapiens
cugucaguggagcag

SEQ ID NO: 631633 - RNA, 21 nt, Homo sapiens
cugucaguuguacuucugcuc

SEQ ID NO: 631634 - RNA, 18 nt, Homo sapiens
cugucaucagccugugua

SEQ ID NO: 631635 - RNA, 16 nt, Homo sapiens
cugucauccucaggaa

SEQ ID NO: 631636 - RNA, 13 nt, Homo sapiens
cugucauguggaa

SEQ ID NO: 631637 - RNA, 22 nt, Homo sapiens
cugucauguggaaacuauuuaa

SEQ ID NO: 631638 - RNA, 18 nt, Homo sapiens
cugucauuuuuaacagca

SEQ ID NO: 631639 - RNA, 13 nt, Homo sapiens
cuguccaaaugga

SEQ ID NO: 631640 - RNA, 17 nt, Homo sapiens
cuguccaaccagacuuu

SEQ ID NO: 631641 - RNA, 18 nt, Homo sapiens
cuguccaaccagacuuug

SEQ ID NO: 631642 - RNA, 16 nt, Homo sapiens
cuguccaccaguuuau

SEQ ID NO: 631643 - RNA, 21 nt, Homo sapiens
cuguccaugaagcacugagca

SEQ ID NO: 631644 - RNA, 22 nt, Homo sapiens
cugucccagagcuuauuggcca

SEQ ID NO: 631645 - RNA, 20 nt, Homo sapiens
cugucccccuacccaccgau

SEQ ID NO: 631646 - RNA, 23 nt, Homo sapiens
cuguccccucuuccuacccugcc

SEQ ID NO: 631647 - RNA, 21 nt, Homo sapiens
cugucccgccuuccuccucca

SEQ ID NO: 631648 - RNA, 17 nt, Homo sapiens
cugucccuauacacuag

SEQ ID NO: 631649 - RNA, 11 nt, Homo sapiens
cugucccugaa

SEQ ID NO: 631650 - RNA, 16 nt, Homo sapiens
cugucccuguagcuca

SEQ ID NO: 631651 - RNA, 17 nt, Homo sapiens
cugucccuguagcucag

SEQ ID NO: 631652 - RNA, 17 nt, Homo sapiens
cuguccuaccaguugcc

SEQ ID NO: 631653 - RNA, 12 nt, Homo sapiens
cuguccuaggcc

SEQ ID NO: 631654 - RNA, 13 nt, Homo sapiens
cuguccucaagua

SEQ ID NO: 631655 - RNA, 15 nt, Homo sapiens
cuguccuuccugacc

SEQ ID NO: 631656 - RNA, 16 nt, Homo sapiens
cuguccuuucuugcag

SEQ ID NO: 631657 - RNA, 21 nt, Homo sapiens
cuguccuuuuccccuacagaa

SEQ ID NO: 631658 - RNA, 16 nt, Homo sapiens
cugucgcccuucuccc

SEQ ID NO: 631659 - RNA, 18 nt, Homo sapiens
cugucgguggcugccuuu

SEQ ID NO: 631660 - RNA, 13 nt, Homo sapiens
cugucguggacac

SEQ ID NO: 631661 - RNA, 13 nt, Homo sapiens
cugucuacugugg

SEQ ID NO: 631662 - RNA, 11 nt, Homo sapiens
cugucuaggac

SEQ ID NO: 631663 - RNA, 20 nt, Homo sapiens
cugucucagaaccacuccug

SEQ ID NO: 631664 - RNA, 14 nt, Homo sapiens
cugucuccaugcug

SEQ ID NO: 631665 - RNA, 24 nt, Homo sapiens
cugucucccuccccaaauggcugc

SEQ ID NO: 631666 - RNA, 17 nt, Homo sapiens
cugucucuaaccauuca

SEQ ID NO: 631667 - RNA, 20 nt, Homo sapiens
cugucugaaggacacuuccu

SEQ ID NO: 631668 - RNA, 17 nt, Homo sapiens
cugucugcccugaaccc

SEQ ID NO: 631669 - RNA, 23 nt, Homo sapiens
cugucugcccugaacccacugcu

SEQ ID NO: 631670 - RNA, 17 nt, Homo sapiens
cugucuggcccugggga

SEQ ID NO: 631671 - RNA, 16 nt, Homo sapiens
cugucugucaccagcu

SEQ ID NO: 631672 - RNA, 18 nt, Homo sapiens
guuagacuuaaacagcag

SEQ ID NO: 631673 - RNA, 21 nt, Homo sapiens
guuagagagggaccauguguc

SEQ ID NO: 631674 - RNA, 23 nt, Homo sapiens
guuaggaaaauuucacauuaaua

SEQ ID NO: 631675 - RNA, 20 nt, Homo sapiens
guuaggcauuuccugcugaa

SEQ ID NO: 631676 - RNA, 23 nt, Homo sapiens
guuagucaauccugucauauaau

SEQ ID NO: 631677 - RNA, 15 nt, Homo sapiens
guuagugauggagcu

SEQ ID NO: 631678 - RNA, 19 nt, Homo sapiens
guuaguggauuacugccau

SEQ ID NO: 631679 - RNA, 14 nt, Homo sapiens
guuaguuccuucau

SEQ ID NO: 631680 - RNA, 23 nt, Homo sapiens
guuaguugugaaagaaagcugag

SEQ ID NO: 631681 - RNA, 17 nt, Homo sapiens
guuauaaaucaauguca

SEQ ID NO: 631682 - RNA, 18 nt, Homo sapiens
guuauaaaucaaugucac

SEQ ID NO: 631683 - RNA, 21 nt, Homo sapiens
guuauaacucugcacuacucc

SEQ ID NO: 631684 - RNA, 22 nt, Homo sapiens
guuauaauaauguuaacaugga

SEQ ID NO: 631685 - RNA, 14 nt, Homo sapiens
guuauacacagcuu

SEQ ID NO: 631686 - RNA, 20 nt, Homo sapiens
guuauagacagucguuccca

SEQ ID NO: 631687 - RNA, 17 nt, Homo sapiens
guuauaucauauguaua

SEQ ID NO: 631688 - RNA, 16 nt, Homo sapiens
guuauauccaauagua

SEQ ID NO: 631689 - RNA, 17 nt, Homo sapiens
guuaucagugcuucccg

SEQ ID NO: 631690 - RNA, 16 nt, Homo sapiens
guuauccccuccuuua

SEQ ID NO: 631691 - RNA, 22 nt, Homo sapiens
guuauccugcuagcuguagaaa

SEQ ID NO: 631692 - RNA, 16 nt, Homo sapiens
guuaucuaauacaaaa

SEQ ID NO: 631693 - RNA, 12 nt, Homo sapiens
guuaucugcuag

SEQ ID NO: 631694 - RNA, 11 nt, Homo sapiens
guuaucuguga

SEQ ID NO: 631695 - RNA, 13 nt, Homo sapiens
guuaucugugguu

SEQ ID NO: 631696 - RNA, 17 nt, Homo sapiens
guuaucuuccacuggaa

SEQ ID NO: 631697 - RNA, 22 nt, Homo sapiens
guuauggguacggcaaccacau

SEQ ID NO: 631698 - RNA, 13 nt, Homo sapiens
guuaugugaauga

SEQ ID NO: 631699 - RNA, 14 nt, Homo sapiens
guuaugugcauuau

SEQ ID NO: 631700 - RNA, 15 nt, Homo sapiens
guuauguucagucac

SEQ ID NO: 631701 - RNA, 15 nt, Homo sapiens
guuauucagaaccua

SEQ ID NO: 631702 - RNA, 23 nt, Homo sapiens
guuauugguguaagguacuuuca

SEQ ID NO: 631703 - RNA, 13 nt, Homo sapiens
guuauuguuugau

SEQ ID NO: 631704 - RNA, 21 nt, Homo sapiens
guuauuuaucaauuuuuccca

SEQ ID NO: 631705 - RNA, 14 nt, Homo sapiens
guuauuuuccauuu

SEQ ID NO: 631706 - RNA, 19 nt, Homo sapiens
guuauuuugcuauuugccu

SEQ ID NO: 631707 - RNA, 20 nt, Homo sapiens
guucaaaaaacucuugauau

SEQ ID NO: 631708 - RNA, 22 nt, Homo sapiens
guucaaaaugcagauuccucag

SEQ ID NO: 631709 - RNA, 14 nt, Homo sapiens
guucaaagacugug

SEQ ID NO: 631710 - RNA, 14 nt, Homo sapiens
guucaaagagguga

SEQ ID NO: 631711 - RNA, 16 nt, Homo sapiens
guucaaauucuucuga

SEQ ID NO: 631712 - RNA, 12 nt, Homo sapiens
guucaagccaug

SEQ ID NO: 631713 - RNA, 22 nt, Homo sapiens
guucaagcgauucuccugccuc

SEQ ID NO: 631714 - RNA, 20 nt, Homo sapiens
guucaaguuauagauucaau

SEQ ID NO: 631715 - RNA, 15 nt, Homo sapiens
guucacaaacuguga

SEQ ID NO: 631716 - RNA, 18 nt, Homo sapiens
guucacaccauucuccug

SEQ ID NO: 631717 - RNA, 16 nt, Homo sapiens
guucacacugcagaga

SEQ ID NO: 631718 - RNA, 22 nt, Homo sapiens
guucacaguagaguaggguaga

SEQ ID NO: 631719 - RNA, 22 nt, Homo sapiens
guucaccuucaaaauguucuau

SEQ ID NO: 631720 - RNA, 13 nt, Homo sapiens
guucaccuugccg

SEQ ID NO: 631721 - RNA, 17 nt, Homo sapiens
guucacugacacaguaa

SEQ ID NO: 631722 - RNA, 24 nt, Homo sapiens
guucacugagcuccccagaucucc

SEQ ID NO: 631723 - RNA, 14 nt, Homo sapiens
guucacugcuccuu

SEQ ID NO: 631724 - RNA, 11 nt, Homo sapiens
guucagaguuc

SEQ ID NO: 631725 - RNA, 20 nt, Homo sapiens
guucagcuccuuccaccaca

SEQ ID NO: 631726 - RNA, 18 nt, Homo sapiens
guucaggaaaacuacuga

SEQ ID NO: 631727 - RNA, 20 nt, Homo sapiens
guucaggagucccaaggaaa

SEQ ID NO: 631728 - RNA, 18 nt, Homo sapiens
guucaggcagcacaucaa

SEQ ID NO: 631729 - RNA, 12 nt, Homo sapiens
guucagugccuu

SEQ ID NO: 631730 - RNA, 13 nt, Homo sapiens
guucagugccuuc

SEQ ID NO: 631731 - RNA, 19 nt, Homo sapiens
guucaguuuuagacucuga

SEQ ID NO: 631732 - RNA, 18 nt, Homo sapiens
guucauuucacacaguga

SEQ ID NO: 631733 - RNA, 17 nt, Homo sapiens
guucauuuuagugacug

SEQ ID NO: 631734 - RNA, 17 nt, Homo sapiens
guuccaaugucaaugug

SEQ ID NO: 631735 - RNA, 19 nt, Homo sapiens
guuccaaugucaaugugaa

SEQ ID NO: 631736 - RNA, 14 nt, Homo sapiens
guuccacugagcuc

SEQ ID NO: 631737 - RNA, 23 nt, Homo sapiens
guuccacuucaacaaguaccuga

SEQ ID NO: 631738 - RNA, 15 nt, Homo sapiens
guuccagaccagccu

SEQ ID NO: 631739 - RNA, 17 nt, Homo sapiens
guuccagauagcagggc

SEQ ID NO: 631740 - RNA, 16 nt, Homo sapiens
guuccagauggggccu

SEQ ID NO: 631741 - RNA, 13 nt, Homo sapiens
guuccaggccuga

SEQ ID NO: 631742 - RNA, 17 nt, Homo sapiens
guuccaugaagaccaca

SEQ ID NO: 631743 - RNA, 19 nt, Homo sapiens
guuccauuugaaccaguga

SEQ ID NO: 631744 - RNA, 14 nt, Homo sapiens
guuggggugacagu

SEQ ID NO: 631745 - RNA, 19 nt, Homo sapiens
guugguaccuuucuagccu

SEQ ID NO: 631746 - RNA, 20 nt, Homo sapiens
guuggugaauuucacaagcu

SEQ ID NO: 631747 - RNA, 23 nt, Homo sapiens
guuggugcugcuuucuuguugcu

SEQ ID NO: 631748 - RNA, 20 nt, Homo sapiens
guuguaaaccaagugaucaa

SEQ ID NO: 631749 - RNA, 14 nt, Homo sapiens
guuguaccaaaaca

SEQ ID NO: 631750 - RNA, 21 nt, Homo sapiens
guuguaguuaccuacugagua

SEQ ID NO: 631751 - RNA, 19 nt, Homo sapiens
guuguauuuucuuacugaa

SEQ ID NO: 631752 - RNA, 14 nt, Homo sapiens
guugucaccaagcu

SEQ ID NO: 631753 - RNA, 20 nt, Homo sapiens
guugucagaauggaauccau

SEQ ID NO: 631754 - RNA, 14 nt, Homo sapiens
guugucaggccaua

SEQ ID NO: 631755 - RNA, 14 nt, Homo sapiens
guuguccgugauaa

SEQ ID NO: 631756 - RNA, 19 nt, Homo sapiens
guugucuacaccaaugccc

SEQ ID NO: 631757 - RNA, 18 nt, Homo sapiens
guugugauauagaacaaa

SEQ ID NO: 631758 - RNA, 19 nt, Homo sapiens
guugugccaaagugcauag

SEQ ID NO: 631759 - RNA, 16 nt, Homo sapiens
guuguggaugcuccag

SEQ ID NO: 631760 - RNA, 16 nt, Homo sapiens
guuguuaaaaauguca

SEQ ID NO: 631761 - RNA, 13 nt, Homo sapiens
guuguuaaaggca

SEQ ID NO: 631762 - RNA, 22 nt, Homo sapiens
guuguugaaagcugaaaagcau

SEQ ID NO: 631763 - RNA, 18 nt, Homo sapiens
guuguuuuauauguugcu

SEQ ID NO: 631764 - RNA, 17 nt, Homo sapiens
guuuaaaaacaaaggaa

SEQ ID NO: 631765 - RNA, 15 nt, Homo sapiens
guuuaaaacagaagc

SEQ ID NO: 631766 - RNA, 13 nt, Homo sapiens
guuuaaaauccaa

SEQ ID NO: 631767 - RNA, 14 nt, Homo sapiens
guuuaaacccaagu

SEQ ID NO: 631768 - RNA, 18 nt, Homo sapiens
guuuaaacccaagugcug

SEQ ID NO: 631769 - RNA, 13 nt, Homo sapiens
guuuaaagucuca

SEQ ID NO: 631770 - RNA, 14 nt, Homo sapiens
guuuaaagugcagu

SEQ ID NO: 631771 - RNA, 17 nt, Homo sapiens
guuuaacauuuccucag

SEQ ID NO: 631772 - RNA, 16 nt, Homo sapiens
guuuaagggugauagu

SEQ ID NO: 631773 - RNA, 16 nt, Homo sapiens
guuuaauaacauauua

SEQ ID NO: 631774 - RNA, 14 nt, Homo sapiens
guuuacagacugug

SEQ ID NO: 631775 - RNA, 22 nt, Homo sapiens
guuuacaggcccugcuccugca

SEQ ID NO: 631776 - RNA, 18 nt, Homo sapiens
guuuaccaguugccuuuu

SEQ ID NO: 631777 - RNA, 21 nt, Homo sapiens
guuuacccaguauuccauuuu

SEQ ID NO: 631778 - RNA, 22 nt, Homo sapiens
guuuacccucaacccuauucau

SEQ ID NO: 631779 - RNA, 17 nt, Homo sapiens
guuuaccguguguuaua

SEQ ID NO: 631780 - RNA, 21 nt, Homo sapiens
guuuagccccugaaagccaug

SEQ ID NO: 631781 - RNA, 18 nt, Homo sapiens
guuuagcccugaacauuu

SEQ ID NO: 631782 - RNA, 16 nt, Homo sapiens
guuuaguuacuauuac

SEQ ID NO: 631783 - RNA, 22 nt, Homo sapiens
guuuauacacaacuuugcaaau

SEQ ID NO: 631784 - RNA, 15 nt, Homo sapiens
guuuauacacugugu

SEQ ID NO: 631785 - RNA, 14 nt, Homo sapiens
guuuaucagcaaaa

SEQ ID NO: 631786 - RNA, 18 nt, Homo sapiens
guuuauccuuagcucaca

SEQ ID NO: 631787 - RNA, 14 nt, Homo sapiens
guuuaugagccaga

SEQ ID NO: 631788 - RNA, 20 nt, Homo sapiens
guuuaugcauagauaaucuc

SEQ ID NO: 631789 - RNA, 22 nt, Homo sapiens
guuuaugcauagauaaucucuc

SEQ ID NO: 631790 - RNA, 20 nt, Homo sapiens
guuuauguaagagcaccuuc

SEQ ID NO: 631791 - RNA, 15 nt, Homo sapiens
guuuauugauauuca

SEQ ID NO: 631792 - RNA, 16 nt, Homo sapiens
guuuauugauauucaa

SEQ ID NO: 631793 - RNA, 20 nt, Homo sapiens
guuuauuuugcuugucauau

SEQ ID NO: 631794 - RNA, 17 nt, Homo sapiens
guuucaaaaaaucugac

SEQ ID NO: 631795 - RNA, 14 nt, Homo sapiens
guuucaaaaccaug

SEQ ID NO: 631796 - RNA, 15 nt, Homo sapiens
guuucaaaaccaugc

SEQ ID NO: 631797 - RNA, 13 nt, Homo sapiens
guuucaacagaug

SEQ ID NO: 631798 - RNA, 18 nt, Homo sapiens
cuguuauuaacaaacauc

SEQ ID NO: 631799 - RNA, 20 nt, Homo sapiens
cuguuauuaacaaacaucac

SEQ ID NO: 631800 - RNA, 22 nt, Homo sapiens
cuguuauuaccauuagcauucu

SEQ ID NO: 631801 - RNA, 13 nt, Homo sapiens
cuguucaaaaagg

SEQ ID NO: 631802 - RNA, 15 nt, Homo sapiens
cuguucaaaccucug

SEQ ID NO: 631803 - RNA, 13 nt, Homo sapiens
cuguucauuucac

SEQ ID NO: 631804 - RNA, 21 nt, Homo sapiens
cuguucauuucacacagugaa

SEQ ID NO: 631805 - RNA, 17 nt, Homo sapiens
cuguuccagauuccuau

SEQ ID NO: 631806 - RNA, 21 nt, Homo sapiens
cuguuccaggcccuccagugg

SEQ ID NO: 631807 - RNA, 21 nt, Homo sapiens
cuguuccccucugcuacuagc

SEQ ID NO: 631808 - RNA, 18 nt, Homo sapiens
cuguuccuucacauccug

SEQ ID NO: 631809 - RNA, 22 nt, Homo sapiens
cuguucggaagggguuccucaa

SEQ ID NO: 631810 - RNA, 20 nt, Homo sapiens
cuguucucauuuuauugcua

SEQ ID NO: 631811 - RNA, 20 nt, Homo sapiens
cuguucucgaacuccugacc

SEQ ID NO: 631812 - RNA, 18 nt, Homo sapiens
cuguucucucugugcucu

SEQ ID NO: 631813 - RNA, 11 nt, Homo sapiens
cuguucucugc

SEQ ID NO: 631814 - RNA, 20 nt, Homo sapiens
cuguucucuugggaacugaa

SEQ ID NO: 631815 - RNA, 14 nt, Homo sapiens
cuguucuucacuuc

SEQ ID NO: 631816 - RNA, 15 nt, Homo sapiens
cuguucuucacuucu

SEQ ID NO: 631817 - RNA, 22 nt, Homo sapiens
cuguucuugcuacccaugacuu

SEQ ID NO: 631818 - RNA, 17 nt, Homo sapiens
cuguucuugcuccaaag

SEQ ID NO: 631819 - RNA, 15 nt, Homo sapiens
cuguucuuuugcaau

SEQ ID NO: 631820 - RNA, 15 nt, Homo sapiens
cuguugaaaagcaca

SEQ ID NO: 631821 - RNA, 18 nt, Homo sapiens
cuguugaauuucccacau

SEQ ID NO: 631822 - RNA, 20 nt, Homo sapiens
cuguugaccugugcaccuac

SEQ ID NO: 631823 - RNA, 21 nt, Homo sapiens
cuguugaucccacuucacugu

SEQ ID NO: 631824 - RNA, 14 nt, Homo sapiens
cuguugaugccguu

SEQ ID NO: 631825 - RNA, 18 nt, Homo sapiens
cuguugcaaacucagugc

SEQ ID NO: 631826 - RNA, 22 nt, Homo sapiens
cuguugcaaacucagugcaaac

SEQ ID NO: 631827 - RNA, 14 nt, Homo sapiens
cuguugcacagcca

SEQ ID NO: 631828 - RNA, 19 nt, Homo sapiens
cuguugccucaguccccca

SEQ ID NO: 631829 - RNA, 12 nt, Homo sapiens
cuguugcuuguc

SEQ ID NO: 631830 - RNA, 12 nt, Homo sapiens
cuguuggaugau

SEQ ID NO: 631831 - RNA, 13 nt, Homo sapiens
cuguuggcagcuc

SEQ ID NO: 631832 - RNA, 17 nt, Homo sapiens
cuguugguccacugugu

SEQ ID NO: 631833 - RNA, 12 nt, Homo sapiens
cuguuggucugu

SEQ ID NO: 631834 - RNA, 15 nt, Homo sapiens
cuguugucaaaaagu

SEQ ID NO: 631835 - RNA, 23 nt, Homo sapiens
cuguuguucuguggucacaguga

SEQ ID NO: 631836 - RNA, 15 nt, Homo sapiens
cuguuuaagcuacua

SEQ ID NO: 631837 - RNA, 19 nt, Homo sapiens
cuguuuaauguucugugau

SEQ ID NO: 631838 - RNA, 14 nt, Homo sapiens
cuguuuacaucucc

SEQ ID NO: 631839 - RNA, 21 nt, Homo sapiens
cuguuuauugaaagaauuauc

SEQ ID NO: 631840 - RNA, 15 nt, Homo sapiens
cuguuucaaacugag

SEQ ID NO: 631841 - RNA, 15 nt, Homo sapiens
cuguuucacauugca

SEQ ID NO: 631842 - RNA, 15 nt, Homo sapiens
cuguuucaggcuucc

SEQ ID NO: 631843 - RNA, 21 nt, Homo sapiens
cuguuucagugugagucagaa

SEQ ID NO: 631844 - RNA, 19 nt, Homo sapiens
cuguuuccauagggugaca

SEQ ID NO: 631845 - RNA, 21 nt, Homo sapiens
cuguuucccuuugauucucca

SEQ ID NO: 631846 - RNA, 15 nt, Homo sapiens
cuguuucuccacaac

SEQ ID NO: 631847 - RNA, 19 nt, Homo sapiens
cuguuugaaaacuucagaa

SEQ ID NO: 631848 - RNA, 21 nt, Homo sapiens
cuguuugagaaccauuuacuu

SEQ ID NO: 631849 - RNA, 14 nt, Homo sapiens
cuguuugaugcuau

SEQ ID NO: 631850 - RNA, 20 nt, Homo sapiens
cuguuugcccccauucacuu

SEQ ID NO: 631851 - RNA, 14 nt, Homo sapiens
cuguuugcugugga

SEQ ID NO: 631852 - RNA, 17 nt, Homo sapiens
cuguuugucugaacaaa

SEQ ID NO: 631853 - RNA, 13 nt, Homo sapiens
cuguuuguuaaaa

SEQ ID NO: 631854 - RNA, 14 nt, Homo sapiens
cuguuuuaaagggu

SEQ ID NO: 631855 - RNA, 17 nt, Homo sapiens
cuguuuuaugugcacac

SEQ ID NO: 631856 - RNA, 12 nt, Homo sapiens
cuguuuucaaua

SEQ ID NO: 631857 - RNA, 23 nt, Homo sapiens
cuguuuucaauaacaaagcacau

SEQ ID NO: 631858 - RNA, 18 nt, Homo sapiens
cuguuuucuaaagccagg

SEQ ID NO: 631859 - RNA, 18 nt, Homo sapiens
cuguuuucugaaacacac

SEQ ID NO: 631860 - RNA, 15 nt, Homo sapiens
cuguuuugcauauga

SEQ ID NO: 631861 - RNA, 15 nt, Homo sapiens
cuguuuugccuucac

SEQ ID NO: 631862 - RNA, 15 nt, Homo sapiens
cuguuuuugcaacua

SEQ ID NO: 631863 - RNA, 21 nt, Homo sapiens
cuguuuuuucagucugugaaa

SEQ ID NO: 631864 - RNA, 14 nt, Homo sapiens
cuguuuuuucucca

SEQ ID NO: 631865 - RNA, 17 nt, Homo sapiens
cuguuuuuuuugcugcu

SEQ ID NO: 631866 - RNA, 16 nt, Homo sapiens
uaagacgaaugauuua

SEQ ID NO: 631867 - RNA, 18 nt, Homo sapiens
uaagacuagauacucgug

SEQ ID NO: 631868 - RNA, 20 nt, Homo sapiens
uaagacuauaaauaaaaacu

SEQ ID NO: 631869 - RNA, 12 nt, Homo sapiens
uaagacuaugau

SEQ ID NO: 631870 - RNA, 14 nt, Homo sapiens
uaagacucauuccc

SEQ ID NO: 631871 - RNA, 16 nt, Homo sapiens
uaagacuguaaugugu

SEQ ID NO: 631872 - RNA, 15 nt, Homo sapiens
uaagagaacaaugug

SEQ ID NO: 631873 - RNA, 15 nt, Homo sapiens
uaagagacacuccaa

SEQ ID NO: 631874 - RNA, 15 nt, Homo sapiens
uaagagaucccuuaa

SEQ ID NO: 631875 - RNA, 17 nt, Homo sapiens
uaagaggaucuccuguc

SEQ ID NO: 631876 - RNA, 18 nt, Homo sapiens
uaagagguuuauuugggu

SEQ ID NO: 631877 - RNA, 18 nt, Homo sapiens
uaagaguaaaauuccucu

SEQ ID NO: 631878 - RNA, 13 nt, Homo sapiens
uaagaguugccaa

SEQ ID NO: 631879 - RNA, 16 nt, Homo sapiens
uaagaguuuacaguuu

SEQ ID NO: 631880 - RNA, 18 nt, Homo sapiens
uaagauauauacauggaa

SEQ ID NO: 631881 - RNA, 21 nt, Homo sapiens
uaagauaucccuaaggaauuu

SEQ ID NO: 631882 - RNA, 17 nt, Homo sapiens
uaagauauuuaguaaua

SEQ ID NO: 631883 - RNA, 14 nt, Homo sapiens
uaagauccacaaau

SEQ ID NO: 631884 - RNA, 16 nt, Homo sapiens
uaagaugagggggcca

SEQ ID NO: 631885 - RNA, 18 nt, Homo sapiens
uaagaugaucaucuccag

SEQ ID NO: 631886 - RNA, 16 nt, Homo sapiens
uaagaugccagcauau

SEQ ID NO: 631887 - RNA, 11 nt, Homo sapiens
uaagcaaaaag

SEQ ID NO: 631888 - RNA, 19 nt, Homo sapiens
uaagcaaauugcuuuuuuc

SEQ ID NO: 631889 - RNA, 14 nt, Homo sapiens
uaagcaaauuuugu

SEQ ID NO: 631890 - RNA, 18 nt, Homo sapiens
uaagcaacuugcuucuaa

SEQ ID NO: 631891 - RNA, 20 nt, Homo sapiens
uaagcaccaggacgcccucg

SEQ ID NO: 631892 - RNA, 20 nt, Homo sapiens
uaagcaccugccucagcaau

SEQ ID NO: 631893 - RNA, 21 nt, Homo sapiens
uaagcaccugccucagcaauu

SEQ ID NO: 631894 - RNA, 15 nt, Homo sapiens
uaagcacuguggauc

SEQ ID NO: 631895 - RNA, 23 nt, Homo sapiens
uaagcagaaauccugcaaugaaa

SEQ ID NO: 631896 - RNA, 19 nt, Homo sapiens
uaagcagaagcacauauga

SEQ ID NO: 631897 - RNA, 20 nt, Homo sapiens
uaagcaguauauuaguauua

SEQ ID NO: 631898 - RNA, 15 nt, Homo sapiens
uaagcauacaacugg

SEQ ID NO: 631899 - RNA, 14 nt, Homo sapiens
uaagcauacuuugu

SEQ ID NO: 631900 - RNA, 23 nt, Homo sapiens
uaagccaaagaaacaagcugugc

SEQ ID NO: 631901 - RNA, 13 nt, Homo sapiens
uaagccagggauu

SEQ ID NO: 631902 - RNA, 14 nt, Homo sapiens
uaagcccacuguua

SEQ ID NO: 631903 - RNA, 17 nt, Homo sapiens
uaagcccagugcacuga

SEQ ID NO: 631904 - RNA, 20 nt, Homo sapiens
uaagcccagugcugcuguaa

SEQ ID NO: 631905 - RNA, 13 nt, Homo sapiens
uaagccccuguga

SEQ ID NO: 631906 - RNA, 15 nt, Homo sapiens
uaagcccuuugcucu

SEQ ID NO: 631907 - RNA, 14 nt, Homo sapiens
uaagccgcagagac

SEQ ID NO: 631908 - RNA, 17 nt, Homo sapiens
uaagccuaaaugccuua

SEQ ID NO: 631909 - RNA, 14 nt, Homo sapiens
uaagccuucauuug

SEQ ID NO: 631910 - RNA, 19 nt, Homo sapiens
uaagccuucauuugcaauu

SEQ ID NO: 631911 - RNA, 15 nt, Homo sapiens
uaagccuuuccauaa

SEQ ID NO: 631912 - RNA, 15 nt, Homo sapiens
uaagcuaaagccuga

SEQ ID NO: 631913 - RNA, 15 nt, Homo sapiens
uaagcuagucccaaa

SEQ ID NO: 631914 - RNA, 15 nt, Homo sapiens
uaagcuaucagcaau

SEQ ID NO: 631915 - RNA, 20 nt, Homo sapiens
uaagcucacguccugagaaa

SEQ ID NO: 631916 - RNA, 17 nt, Homo sapiens
uaagcuccaugugcaua

SEQ ID NO: 631917 - RNA, 12 nt, Homo sapiens
uaagcugggaua

SEQ ID NO: 631918 - RNA, 12 nt, Homo sapiens
uaagcugugauu

SEQ ID NO: 631919 - RNA, 18 nt, Homo sapiens
uaagcuuuuagaagguaa

SEQ ID NO: 631920 - RNA, 20 nt, Homo sapiens
uaaggaaaauuaauccucac

SEQ ID NO: 631921 - RNA, 16 nt, Homo sapiens
uaaggaaacgaugaaa

SEQ ID NO: 631922 - RNA, 14 nt, Homo sapiens
uaaggaaagcaaua

SEQ ID NO: 631923 - RNA, 22 nt, Homo sapiens
uaaggaauuauagaccucuagu

SEQ ID NO: 631924 - RNA, 16 nt, Homo sapiens
uaaggacaaauuagca

SEQ ID NO: 631925 - RNA, 21 nt, Homo sapiens
uaaggaccaauagcaucugug

SEQ ID NO: 631926 - RNA, 16 nt, Homo sapiens
uaaggacuucugcagc

SEQ ID NO: 631927 - RNA, 16 nt, Homo sapiens
uaaggagccuuuccag

SEQ ID NO: 631928 - RNA, 17 nt, Homo sapiens
uaaggauaugcauuaac

SEQ ID NO: 631929 - RNA, 13 nt, Homo sapiens
uaaggaugaaggu

SEQ ID NO: 631930 - RNA, 18 nt, Homo sapiens
uaaggaugucacagggcc

SEQ ID NO: 631931 - RNA, 16 nt, Homo sapiens
uaaggcaggagaauca

SEQ ID NO: 631932 - RNA, 22 nt, Homo sapiens
cuuuaaucuguuuuauaccuug

SEQ ID NO: 631933 - RNA, 14 nt, Homo sapiens
cuuuaaugaacuaa

SEQ ID NO: 631934 - RNA, 21 nt, Homo sapiens
cuuuaaugaacuaacugacag

SEQ ID NO: 631935 - RNA, 15 nt, Homo sapiens
cuuuaaugcuuuuau

SEQ ID NO: 631936 - RNA, 13 nt, Homo sapiens
cuuuaauguugcc

SEQ ID NO: 631937 - RNA, 22 nt, Homo sapiens
cuuuaauguugcccacauuaag

SEQ ID NO: 631938 - RNA, 12 nt, Homo sapiens
cuuuaauuguau

SEQ ID NO: 631939 - RNA, 11 nt, Homo sapiens
cuuuaauuuca

SEQ ID NO: 631940 - RNA, 19 nt, Homo sapiens
cuuuaauuuuuuacuauuu

SEQ ID NO: 631941 - RNA, 21 nt, Homo sapiens
cuuuacaaucugcacuuuaac

SEQ ID NO: 631942 - RNA, 16 nt, Homo sapiens
cuuuaccaugcucaau

SEQ ID NO: 631943 - RNA, 13 nt, Homo sapiens
cuuuaccuagcug

SEQ ID NO: 631944 - RNA, 12 nt, Homo sapiens
cuuuaccucagg

SEQ ID NO: 631945 - RNA, 23 nt, Homo sapiens
cuuuaccuccuuuucucuuucac

SEQ ID NO: 631946 - RNA, 11 nt, Homo sapiens
cuuuaccuuca

SEQ ID NO: 631947 - RNA, 14 nt, Homo sapiens
cuuuaccuuccuca

SEQ ID NO: 631948 - RNA, 14 nt, Homo sapiens
cuuuaccuuuucag

SEQ ID NO: 631949 - RNA, 15 nt, Homo sapiens
cuuuacgguccaugc

SEQ ID NO: 631950 - RNA, 19 nt, Homo sapiens
cuuuacuaauaaacugugu

SEQ ID NO: 631951 - RNA, 17 nt, Homo sapiens
cuuuacuaucauucuca

SEQ ID NO: 631952 - RNA, 20 nt, Homo sapiens
cuuuacuccguaacagauuu

SEQ ID NO: 631953 - RNA, 12 nt, Homo sapiens
cuuuacuccugg

SEQ ID NO: 631954 - RNA, 12 nt, Homo sapiens
cuuuacucuggg

SEQ ID NO: 631955 - RNA, 12 nt, Homo sapiens
cuuuacucuuga

SEQ ID NO: 631956 - RNA, 14 nt, Homo sapiens
cuuuacugugcuua

SEQ ID NO: 631957 - RNA, 18 nt, Homo sapiens
cuuuacuguuagucauuu

SEQ ID NO: 631958 - RNA, 11 nt, Homo sapiens
cuuuacuugac

SEQ ID NO: 631959 - RNA, 17 nt, Homo sapiens
cuuuagaaacucaaaaa

SEQ ID NO: 631960 - RNA, 22 nt, Homo sapiens
cuuuagaaggacucaguauuau

SEQ ID NO: 631961 - RNA, 15 nt, Homo sapiens
cuuuagacuucccac

SEQ ID NO: 631962 - RNA, 19 nt, Homo sapiens
cuuuagagaaguauacaua

SEQ ID NO: 631963 - RNA, 15 nt, Homo sapiens
cuuuagagugcaagu

SEQ ID NO: 631964 - RNA, 18 nt, Homo sapiens
cuuuagaugccaaaccac

SEQ ID NO: 631965 - RNA, 13 nt, Homo sapiens
cuuuagaugcuga

SEQ ID NO: 631966 - RNA, 17 nt, Homo sapiens
cuuuagccaagcuccuc

SEQ ID NO: 631967 - RNA, 19 nt, Homo sapiens
cuuuagcgggacucaguga

SEQ ID NO: 631968 - RNA, 21 nt, Homo sapiens
cuuuagcuaccucacuaugcu

SEQ ID NO: 631969 - RNA, 19 nt, Homo sapiens
cuuuaguccuucugccauu

SEQ ID NO: 631970 - RNA, 13 nt, Homo sapiens
cuuuagucugcaa

SEQ ID NO: 631971 - RNA, 19 nt, Homo sapiens
cuuuagucugcaaaaugag

SEQ ID NO: 631972 - RNA, 16 nt, Homo sapiens
cuuuaguggagccagg

SEQ ID NO: 631973 - RNA, 21 nt, Homo sapiens
cuuuaguucuaguuagucauc

SEQ ID NO: 631974 - RNA, 19 nt, Homo sapiens
cuuuaguuucagagugugg

SEQ ID NO: 631975 - RNA, 17 nt, Homo sapiens
cuuuauacuggguuuca

SEQ ID NO: 631976 - RNA, 19 nt, Homo sapiens
cuuuauagauuauaugaau

SEQ ID NO: 631977 - RNA, 13 nt, Homo sapiens
cuuuauagcucua

SEQ ID NO: 631978 - RNA, 21 nt, Homo sapiens
cuuuauauuuuuaacuuuaag

SEQ ID NO: 631979 - RNA, 17 nt, Homo sapiens
cuuuaucaccucauucu

SEQ ID NO: 631980 - RNA, 17 nt, Homo sapiens
cuuuaucccuaacuucu

SEQ ID NO: 631981 - RNA, 24 nt, Homo sapiens
cuuuaugaugcuaugguuugccau

SEQ ID NO: 631982 - RNA, 21 nt, Homo sapiens
cuuuaugcagagccacagcug

SEQ ID NO: 631983 - RNA, 18 nt, Homo sapiens
cuuuaugccggaugugcu

SEQ ID NO: 631984 - RNA, 21 nt, Homo sapiens
cuuuaugccggaugugcuuuu

SEQ ID NO: 631985 - RNA, 21 nt, Homo sapiens
cuuuaugcuaguuugaccuca

SEQ ID NO: 631986 - RNA, 16 nt, Homo sapiens
cuuuauuaaauacaaa

SEQ ID NO: 631987 - RNA, 15 nt, Homo sapiens
cuuuauuagcuuucu

SEQ ID NO: 631988 - RNA, 18 nt, Homo sapiens
cuuuauucuuuacuauua

SEQ ID NO: 631989 - RNA, 14 nt, Homo sapiens
cuuuguauaugcau

SEQ ID NO: 631990 - RNA, 15 nt, Homo sapiens
cuuuguauauuacau

SEQ ID NO: 631991 - RNA, 18 nt, Homo sapiens
cuuuguaucaauccaggc

SEQ ID NO: 631992 - RNA, 15 nt, Homo sapiens
cuuuguaugcacuuu

SEQ ID NO: 631993 - RNA, 11 nt, Homo sapiens
cuuugucacuu

SEQ ID NO: 631994 - RNA, 22 nt, Homo sapiens
cuuugucauucaagccugugaa

SEQ ID NO: 631995 - RNA, 17 nt, Homo sapiens
cuuugucccggggcucc

SEQ ID NO: 631996 - RNA, 19 nt, Homo sapiens
cuuugucgugguucuuaaa

SEQ ID NO: 631997 - RNA, 19 nt, Homo sapiens
cuuugucugucaaucacag

SEQ ID NO: 631998 - RNA, 14 nt, Homo sapiens
cuuugugaaucuga

SEQ ID NO: 631999 - RNA, 20 nt, Homo sapiens
cuuugugagccuaugauauu

SEQ ID NO: 632000 - RNA, 19 nt, Homo sapiens
cuuugugauaguucagucc

SEQ ID NO: 632001 - RNA, 15 nt, Homo sapiens
cuuugugcuugucau

SEQ ID NO: 632002 - RNA, 18 nt, Homo sapiens
cuuugugcuugucauucc

SEQ ID NO: 632003 - RNA, 20 nt, Homo sapiens
cuuuguggggcucaaaaccu

SEQ ID NO: 632004 - RNA, 21 nt, Homo sapiens
cuuugugugauuaaaugacac

SEQ ID NO: 632005 - RNA, 20 nt, Homo sapiens
cuuuguugcaagaugugaau

SEQ ID NO: 632006 - RNA, 11 nt, Homo sapiens
cuuuguugccc

SEQ ID NO: 632007 - RNA, 21 nt, Homo sapiens
cuuuguuuagcccaaaaccaa

SEQ ID NO: 632008 - RNA, 14 nt, Homo sapiens
cuuuguuuaugcau

SEQ ID NO: 632009 - RNA, 23 nt, Homo sapiens
cuuuuaaaaggcccuguggucug

SEQ ID NO: 632010 - RNA, 19 nt, Homo sapiens
cuuuuaaauacauucccug

SEQ ID NO: 632011 - RNA, 16 nt, Homo sapiens
cuuuuaaaugcauaaa

SEQ ID NO: 632012 - RNA, 20 nt, Homo sapiens
cuuuuaacaugcauguuggg

SEQ ID NO: 632013 - RNA, 16 nt, Homo sapiens
cuuuuaacugccaaga

SEQ ID NO: 632014 - RNA, 19 nt, Homo sapiens
cuuuuaagaaacacagggu

SEQ ID NO: 632015 - RNA, 18 nt, Homo sapiens
cuuuuaagcagugaguua

SEQ ID NO: 632016 - RNA, 17 nt, Homo sapiens
cuuuuaagugccuugga

SEQ ID NO: 632017 - RNA, 13 nt, Homo sapiens
cuuuuaaguugcu

SEQ ID NO: 632018 - RNA, 23 nt, Homo sapiens
cuuuuaaguugcugaugaacucu

SEQ ID NO: 632019 - RNA, 14 nt, Homo sapiens
cuuuuaaucaguga

SEQ ID NO: 632020 - RNA, 21 nt, Homo sapiens
cuuuuaauggugaugggguaa

SEQ ID NO: 632021 - RNA, 18 nt, Homo sapiens
cuuuuacaacugccucga

SEQ ID NO: 632022 - RNA, 17 nt, Homo sapiens
cuuuuacagacuagcag

SEQ ID NO: 632023 - RNA, 12 nt, Homo sapiens
cuuuuacauucu

SEQ ID NO: 632024 - RNA, 21 nt, Homo sapiens
cuuuuagacaacuagauuugu

SEQ ID NO: 632025 - RNA, 20 nt, Homo sapiens
cuuuuaggagaauucacaga

SEQ ID NO: 632026 - RNA, 20 nt, Homo sapiens
cuuuuauaaacuuuaccuuu

SEQ ID NO: 632027 - RNA, 14 nt, Homo sapiens
cuuuuauagaggcu

SEQ ID NO: 632028 - RNA, 14 nt, Homo sapiens
cuuuuaucugcaga

SEQ ID NO: 632029 - RNA, 20 nt, Homo sapiens
cuuuuaucugcccagaauuc

SEQ ID NO: 632030 - RNA, 14 nt, Homo sapiens
cuuuuaugccuuca

SEQ ID NO: 632031 - RNA, 14 nt, Homo sapiens
cuuuuauguagcac

SEQ ID NO: 632032 - RNA, 12 nt, Homo sapiens
cuuuuauuacau

SEQ ID NO: 632033 - RNA, 15 nt, Homo sapiens
cuuuuauuacugggg

SEQ ID NO: 632034 - RNA, 16 nt, Homo sapiens
cuuuuauuccuuugaa

SEQ ID NO: 632035 - RNA, 18 nt, Homo sapiens
cuuuuauugacacagaaa

SEQ ID NO: 632036 - RNA, 15 nt, Homo sapiens
cuuuuauugccauga

SEQ ID NO: 632037 - RNA, 19 nt, Homo sapiens
cuuuuauuuagggccuuuu

SEQ ID NO: 632038 - RNA, 19 nt, Homo sapiens
cuuuuauuugaaaugucau

SEQ ID NO: 632039 - RNA, 20 nt, Homo sapiens
cuuuucacaugcuaaugugc

SEQ ID NO: 632040 - RNA, 13 nt, Homo sapiens
cuuuucaccaaug

SEQ ID NO: 632041 - RNA, 15 nt, Homo sapiens
cuuuucaccaaugag

SEQ ID NO: 632042 - RNA, 14 nt, Homo sapiens
cuuuucacuacuuu

SEQ ID NO: 632043 - RNA, 23 nt, Homo sapiens
cuuuucacugcuggcugccuuag

SEQ ID NO: 632044 - RNA, 22 nt, Homo sapiens
cuuuucagcccuuugcucugau

SEQ ID NO: 632045 - RNA, 12 nt, Homo sapiens
cuuuucagggcc

SEQ ID NO: 632046 - RNA, 21 nt, Homo sapiens
cuuuucagggcuggcuccuga

SEQ ID NO: 632047 - RNA, 17 nt, Homo sapiens
cuuuucagugauacuca

SEQ ID NO: 632048 - RNA, 18 nt, Homo sapiens
cuuuucauuaaagaaugu

SEQ ID NO: 632049 - RNA, 14 nt, Homo sapiens
cuuuucauuauucu

SEQ ID NO: 632050 - RNA, 15 nt, Homo sapiens
cuuuuccaagcuccu

SEQ ID NO: 632051 - RNA, 19 nt, Homo sapiens
cuuuuccaagcugccacug

SEQ ID NO: 632052 - RNA, 16 nt, Homo sapiens
cuuuuccacuccauug

SEQ ID NO: 632053 - RNA, 19 nt, Homo sapiens
cuuuuccacuccuauggaa

SEQ ID NO: 632054 - RNA, 12 nt, Homo sapiens
cuuuuccagaaa

SEQ ID NO: 632055 - RNA, 15 nt, Homo sapiens
cuuuucccuauccac

SEQ ID NO: 632056 - RNA, 15 nt, Homo sapiens
cuuuucccugaagca

SEQ ID NO: 632057 - RNA, 21 nt, Homo sapiens
uaaucccgugccccuuuccuu

SEQ ID NO: 632058 - RNA, 15 nt, Homo sapiens
uaauccuucuggcaa

SEQ ID NO: 632059 - RNA, 19 nt, Homo sapiens
uaaucgaaguaauuuuggg

SEQ ID NO: 632060 - RNA, 18 nt, Homo sapiens
uaaucuaagaaaagggga

SEQ ID NO: 632061 - RNA, 14 nt, Homo sapiens
uaaucuacuguaaa

SEQ ID NO: 632062 - RNA, 14 nt, Homo sapiens
uaaucuaugaauuc

SEQ ID NO: 632063 - RNA, 17 nt, Homo sapiens
uaaucuauuauuuggag

SEQ ID NO: 632064 - RNA, 14 nt, Homo sapiens
uaaucucagcacuu

SEQ ID NO: 632065 - RNA, 19 nt, Homo sapiens
uaaucucucugcagcugcc

SEQ ID NO: 632066 - RNA, 20 nt, Homo sapiens
uaaucugaccguucuauugu

SEQ ID NO: 632067 - RNA, 13 nt, Homo sapiens
uaaucugcaguga

SEQ ID NO: 632068 - RNA, 19 nt, Homo sapiens
uaaucuggaauaugcaaca

SEQ ID NO: 632069 - RNA, 16 nt, Homo sapiens
uaaucuguauucuugc

SEQ ID NO: 632070 - RNA, 16 nt, Homo sapiens
uaaucuguguguauau

SEQ ID NO: 632071 - RNA, 17 nt, Homo sapiens
uaaucuguuuuauaccu

SEQ ID NO: 632072 - RNA, 22 nt, Homo sapiens
uaaucuuuauacuggguuucaa

SEQ ID NO: 632073 - RNA, 17 nt, Homo sapiens
uaaugaaaaacaaaaag

SEQ ID NO: 632074 - RNA, 22 nt, Homo sapiens
uaaugaaagacuguacaaagua

SEQ ID NO: 632075 - RNA, 14 nt, Homo sapiens
uaaugaaauacauc

SEQ ID NO: 632076 - RNA, 14 nt, Homo sapiens
uaaugaacauguga

SEQ ID NO: 632077 - RNA, 14 nt, Homo sapiens
uaaugaacuaccau

SEQ ID NO: 632078 - RNA, 20 nt, Homo sapiens
uaaugaacuaccaucugaug

SEQ ID NO: 632079 - RNA, 13 nt, Homo sapiens
uaaugaagaauca

SEQ ID NO: 632080 - RNA, 22 nt, Homo sapiens
uaaugaagaaucacgauuucau

SEQ ID NO: 632081 - RNA, 16 nt, Homo sapiens
uaaugaagacauagcc

SEQ ID NO: 632082 - RNA, 19 nt, Homo sapiens
uaaugaaggaguucacugu

SEQ ID NO: 632083 - RNA, 21 nt, Homo sapiens
uaaugaaguagaaguuacuua

SEQ ID NO: 632084 - RNA, 18 nt, Homo sapiens
uaaugaauacauuuccaa

SEQ ID NO: 632085 - RNA, 18 nt, Homo sapiens
uaaugacaaaggcacuga

SEQ ID NO: 632086 - RNA, 16 nt, Homo sapiens
uaaugacaaaugcccu

SEQ ID NO: 632087 - RNA, 12 nt, Homo sapiens
uaaugacacucc

SEQ ID NO: 632088 - RNA, 14 nt, Homo sapiens
uaaugacauuucac

SEQ ID NO: 632089 - RNA, 21 nt, Homo sapiens
uaaugacucuuucugaaggaa

SEQ ID NO: 632090 - RNA, 16 nt, Homo sapiens
uaaugagagcucagac

SEQ ID NO: 632091 - RNA, 18 nt, Homo sapiens
uaaugagagugcacugcu

SEQ ID NO: 632092 - RNA, 21 nt, Homo sapiens
uaaugauaaaauacuaaacua

SEQ ID NO: 632093 - RNA, 16 nt, Homo sapiens
uaaugaucaaaacaug

SEQ ID NO: 632094 - RNA, 14 nt, Homo sapiens
uaaugaugaucuuc

SEQ ID NO: 632095 - RNA, 19 nt, Homo sapiens
uaaugauucugauauguau

SEQ ID NO: 632096 - RNA, 18 nt, Homo sapiens
uaaugauuguuugucaau

SEQ ID NO: 632097 - RNA, 16 nt, Homo sapiens
uaaugcacaucugcag

SEQ ID NO: 632098 - RNA, 19 nt, Homo sapiens
uaaugcucaacaauuuauc

SEQ ID NO: 632099 - RNA, 16 nt, Homo sapiens
uaaugcucaccuuuau

SEQ ID NO: 632100 - RNA, 15 nt, Homo sapiens
uaaugcugaaacauc

SEQ ID NO: 632101 - RNA, 18 nt, Homo sapiens
uaauggaaaaaaagacug

SEQ ID NO: 632102 - RNA, 14 nt, Homo sapiens
uaauggaaaccaag

SEQ ID NO: 632103 - RNA, 14 nt, Homo sapiens
uaauggaauuuaga

SEQ ID NO: 632104 - RNA, 20 nt, Homo sapiens
uaauggacauugacuuguga

SEQ ID NO: 632105 - RNA, 20 nt, Homo sapiens
uaauggauuguuaaaaucau

SEQ ID NO: 632106 - RNA, 15 nt, Homo sapiens
uaauggcaucaauau

SEQ ID NO: 632107 - RNA, 18 nt, Homo sapiens
uaauggggacacagauca

SEQ ID NO: 632108 - RNA, 15 nt, Homo sapiens
uaaugguagcauucu

SEQ ID NO: 632109 - RNA, 20 nt, Homo sapiens
uaaugguagucagauuucau

SEQ ID NO: 632110 - RNA, 19 nt, Homo sapiens
uaaugguguagaacacuaa

SEQ ID NO: 632111 - RNA, 19 nt, Homo sapiens
gcaccuuuuauaccagaga

SEQ ID NO: 632112 - RNA, 15 nt, Homo sapiens
gcaccuuuucaugua

SEQ ID NO: 632113 - RNA, 17 nt, Homo sapiens
gcaccuuuucauguaca

SEQ ID NO: 632114 - RNA, 24 nt, Homo sapiens
gcaccuuuucauguacagcauuaa

SEQ ID NO: 632115 - RNA, 21 nt, Homo sapiens
gcacgcccuacuccacugccc

SEQ ID NO: 632116 - RNA, 17 nt, Homo sapiens
gcacgcucgcugccauc

SEQ ID NO: 632117 - RNA, 20 nt, Homo sapiens
gcacgcugcccaggggcuuc

SEQ ID NO: 632118 - RNA, 13 nt, Homo sapiens
gcacggacucucc

SEQ ID NO: 632119 - RNA, 19 nt, Homo sapiens
gcacggcccaaggggcuuc

SEQ ID NO: 632120 - RNA, 22 nt, Homo sapiens
gcacuaacucguguuuggagcu

SEQ ID NO: 632121 - RNA, 20 nt, Homo sapiens
gcacuaauguguuaugagaa

SEQ ID NO: 632122 - RNA, 19 nt, Homo sapiens
gcacuacauaaacugacuu

SEQ ID NO: 632123 - RNA, 22 nt, Homo sapiens
gcacuaccacgccaagcuaauu

SEQ ID NO: 632124 - RNA, 16 nt, Homo sapiens
gcacuagaauauuuaa

SEQ ID NO: 632125 - RNA, 13 nt, Homo sapiens
gcacuauguauau

SEQ ID NO: 632126 - RNA, 18 nt, Homo sapiens
gcacucaaagcuuguuaa

SEQ ID NO: 632127 - RNA, 15 nt, Homo sapiens
gcacucacacaggac

SEQ ID NO: 632128 - RNA, 18 nt, Homo sapiens
gcacucacccaugugcca

SEQ ID NO: 632129 - RNA, 20 nt, Homo sapiens
gcacucacgcccuaagcgca

SEQ ID NO: 632130 - RNA, 17 nt, Homo sapiens
gcacucagggagcauuu

SEQ ID NO: 632131 - RNA, 17 nt, Homo sapiens
gcacucauagggugcuc

SEQ ID NO: 632132 - RNA, 14 nt, Homo sapiens
gcacucuaaacugc

SEQ ID NO: 632133 - RNA, 22 nt, Homo sapiens
gcacucugaguuuaccauuugu

SEQ ID NO: 632134 - RNA, 22 nt, Homo sapiens
gcacugacugauagcuuacacu

SEQ ID NO: 632135 - RNA, 17 nt, Homo sapiens
gcacugaggaccagcca

SEQ ID NO: 632136 - RNA, 14 nt, Homo sapiens
gcacugagggccac

SEQ ID NO: 632137 - RNA, 22 nt, Homo sapiens
gcacugcagucugcagaguucu

SEQ ID NO: 632138 - RNA, 17 nt, Homo sapiens
gcacugcccaucaguga

SEQ ID NO: 632139 - RNA, 17 nt, Homo sapiens
gcacugcccauggacag

SEQ ID NO: 632140 - RNA, 21 nt, Homo sapiens
gcacugcuaggcgagugccag

SEQ ID NO: 632141 - RNA, 12 nt, Homo sapiens
gcacugggauga

SEQ ID NO: 632142 - RNA, 13 nt, Homo sapiens
gcacuggggccac

SEQ ID NO: 632143 - RNA, 15 nt, Homo sapiens
gcacugucacuuugc

SEQ ID NO: 632144 - RNA, 21 nt, Homo sapiens
gcacuguggcccuucugucca

SEQ ID NO: 632145 - RNA, 12 nt, Homo sapiens
gcacuguucaca

SEQ ID NO: 632146 - RNA, 20 nt, Homo sapiens
gcacuguucccccugugcag

SEQ ID NO: 632147 - RNA, 17 nt, Homo sapiens
gcacuguugcaaacuca

SEQ ID NO: 632148 - RNA, 14 nt, Homo sapiens
gcacuucagaauuc

SEQ ID NO: 632149 - RNA, 13 nt, Homo sapiens
gcacuucaucuga

SEQ ID NO: 632150 - RNA, 15 nt, Homo sapiens
gcacuugauucagga

SEQ ID NO: 632151 - RNA, 20 nt, Homo sapiens
gcacuuuaagucagugacag

SEQ ID NO: 632152 - RNA, 15 nt, Homo sapiens
gcacuuuagaucacu

SEQ ID NO: 632153 - RNA, 14 nt, Homo sapiens
gcacuuucuucucu

SEQ ID NO: 632154 - RNA, 12 nt, Homo sapiens
gcacuuuggaca

SEQ ID NO: 632155 - RNA, 13 nt, Homo sapiens
gcacuuuugaaaa

SEQ ID NO: 632156 - RNA, 18 nt, Homo sapiens
gcagaaacaaaaugacug

SEQ ID NO: 632157 - RNA, 20 nt, Homo sapiens
gcagaaaccuaucucaggga

SEQ ID NO: 632158 - RNA, 12 nt, Homo sapiens
gcagaaagcaaa

SEQ ID NO: 632159 - RNA, 19 nt, Homo sapiens
gcagaaauacagucuucca

SEQ ID NO: 632160 - RNA, 20 nt, Homo sapiens
gcagaaauuuaaacucugaa

SEQ ID NO: 632161 - RNA, 17 nt, Homo sapiens
gcagaaccaaagcucaa

SEQ ID NO: 632162 - RNA, 12 nt, Homo sapiens
gcagaaccacaa

SEQ ID NO: 632163 - RNA, 16 nt, Homo sapiens
gcagaaccuccuggaa

SEQ ID NO: 632164 - RNA, 22 nt, Homo sapiens
gcagaagagaaaggacucagug

SEQ ID NO: 632165 - RNA, 23 nt, Homo sapiens
gcagaagaucaaggaguacaaug

SEQ ID NO: 632166 - RNA, 16 nt, Homo sapiens
gcagaagcccugaugu

SEQ ID NO: 632167 - RNA, 17 nt, Homo sapiens
gcagaagcuggaggcac

SEQ ID NO: 632168 - RNA, 13 nt, Homo sapiens
gcagaauaaucuu

SEQ ID NO: 632169 - RNA, 15 nt, Homo sapiens
gcagaauacauucaa

SEQ ID NO: 632170 - RNA, 14 nt, Homo sapiens
gcagaauccagcua

SEQ ID NO: 632171 - RNA, 17 nt, Homo sapiens
gcagacaacaccuuccu

SEQ ID NO: 632172 - RNA, 19 nt, Homo sapiens
gcagacacauugucaucag

SEQ ID NO: 632173 - RNA, 14 nt, Homo sapiens
gcagacaccagcag

SEQ ID NO: 632174 - RNA, 14 nt, Homo sapiens
gcagacagaccuca

SEQ ID NO: 632175 - RNA, 17 nt, Homo sapiens
gcagacaggccauguga

SEQ ID NO: 632176 - RNA, 13 nt, Homo sapiens
gcagaccacugau

SEQ ID NO: 632177 - RNA, 16 nt, Homo sapiens
gcagacccccaugaga

SEQ ID NO: 632178 - RNA, 18 nt, Homo sapiens
gcagaccccucuaccucc

SEQ ID NO: 632179 - RNA, 15 nt, Homo sapiens
gcagacuacacagga

SEQ ID NO: 632180 - RNA, 14 nt, Homo sapiens
gcagagaaccaaag

SEQ ID NO: 632181 - RNA, 21 nt, Homo sapiens
gcagagaagcuguaggacugu

SEQ ID NO: 632182 - RNA, 14 nt, Homo sapiens
gcagagagaagccu

SEQ ID NO: 632183 - RNA, 18 nt, Homo sapiens
gcagagcaaagugcggug

SEQ ID NO: 632184 - RNA, 15 nt, Homo sapiens
gcagagcauucagac

SEQ ID NO: 632185 - RNA, 13 nt, Homo sapiens
gcagagcauuuaa

SEQ ID NO: 632186 - RNA, 20 nt, Homo sapiens
gcagagccacagcugugcau

SEQ ID NO: 632187 - RNA, 12 nt, Homo sapiens
gcaaguuugcac

SEQ ID NO: 632188 - RNA, 17 nt, Homo sapiens
gcaauaaacauaugugu

SEQ ID NO: 632189 - RNA, 20 nt, Homo sapiens
gcaauaaacuccuacuaaau

SEQ ID NO: 632190 - RNA, 15 nt, Homo sapiens
gcaauaaacuuuuag

SEQ ID NO: 632191 - RNA, 16 nt, Homo sapiens
gcaauaaaguuauuca

SEQ ID NO: 632192 - RNA, 14 nt, Homo sapiens
gcaauaaauauuag

SEQ ID NO: 632193 - RNA, 16 nt, Homo sapiens
gcaauaacucucuaca

SEQ ID NO: 632194 - RNA, 17 nt, Homo sapiens
gcaauaauaagugaugu

SEQ ID NO: 632195 - RNA, 18 nt, Homo sapiens
gcaauacaacuuuaccau

SEQ ID NO: 632196 - RNA, 17 nt, Homo sapiens
gcaauacagacuacuuc

SEQ ID NO: 632197 - RNA, 22 nt, Homo sapiens
gcaauacagacuacuucuuccc

SEQ ID NO: 632198 - RNA, 21 nt, Homo sapiens
gcaauagggugcaguuuucca

SEQ ID NO: 632199 - RNA, 21 nt, Homo sapiens
gcaauauaucugaagagcuau

SEQ ID NO: 632200 - RNA, 21 nt, Homo sapiens
gcaauauggaagcaaccagca

SEQ ID NO: 632201 - RNA, 20 nt, Homo sapiens
gcaauauucuguaacuauug

SEQ ID NO: 632202 - RNA, 11 nt, Homo sapiens
gcaaucacaac

SEQ ID NO: 632203 - RNA, 13 nt, Homo sapiens
gcaaucacuugag

SEQ ID NO: 632204 - RNA, 18 nt, Homo sapiens
gcaaucagaguguacaaa

SEQ ID NO: 632205 - RNA, 18 nt, Homo sapiens
gcaauccaccugccuugg

SEQ ID NO: 632206 - RNA, 22 nt, Homo sapiens
gcaauccaugaucuauacacau

SEQ ID NO: 632207 - RNA, 23 nt, Homo sapiens
gcaauccuucccugcucuugcag

SEQ ID NO: 632208 - RNA, 17 nt, Homo sapiens
gcaaucuauguuugcac

SEQ ID NO: 632209 - RNA, 15 nt, Homo sapiens
gcaaucucauuacug

SEQ ID NO: 632210 - RNA, 15 nt, Homo sapiens
gcaaucugacccuau

SEQ ID NO: 632211 - RNA, 14 nt, Homo sapiens
gcaaucuuugccuu

SEQ ID NO: 632212 - RNA, 15 nt, Homo sapiens
gcaaugacaucucag

SEQ ID NO: 632213 - RNA, 16 nt, Homo sapiens
gcaaugacucaaaguc

SEQ ID NO: 632214 - RNA, 13 nt, Homo sapiens
gcaaugacucagg

SEQ ID NO: 632215 - RNA, 15 nt, Homo sapiens
gcaauggaacauuau

SEQ ID NO: 632216 - RNA, 23 nt, Homo sapiens
gcaauggugucaguauccaggcu

SEQ ID NO: 632217 - RNA, 16 nt, Homo sapiens
gcaauguauagugucu

SEQ ID NO: 632218 - RNA, 12 nt, Homo sapiens
gcaaugucacaa

SEQ ID NO: 632219 - RNA, 20 nt, Homo sapiens
gcaaugugaguuaucacuuc

SEQ ID NO: 632220 - RNA, 12 nt, Homo sapiens
gcaaugugcuac

SEQ ID NO: 632221 - RNA, 19 nt, Homo sapiens
gcaauguggagcagcagcc

SEQ ID NO: 632222 - RNA, 20 nt, Homo sapiens
gcaauuaaaacuaugugcua

SEQ ID NO: 632223 - RNA, 14 nt, Homo sapiens
gcaauuccucugaa

SEQ ID NO: 632224 - RNA, 18 nt, Homo sapiens
gcaauuccucugaacaaa

SEQ ID NO: 632225 - RNA, 17 nt, Homo sapiens
gcaauugcucaugcaua

SEQ ID NO: 632226 - RNA, 13 nt, Homo sapiens
gcaauuguggaag

SEQ ID NO: 632227 - RNA, 18 nt, Homo sapiens
gcaauuucagaaccaaaa

SEQ ID NO: 632228 - RNA, 22 nt, Homo sapiens
gcacaaaucuugggucuugggg

SEQ ID NO: 632229 - RNA, 21 nt, Homo sapiens
gcacaacgcaccagacacuca

SEQ ID NO: 632230 - RNA, 18 nt, Homo sapiens
gcacaaggccaucugggc

SEQ ID NO: 632231 - RNA, 16 nt, Homo sapiens
gcacaaggcugaccaa

SEQ ID NO: 632232 - RNA, 18 nt, Homo sapiens
gcacaaggcugaccaaga

SEQ ID NO: 632233 - RNA, 22 nt, Homo sapiens
gcacaagggcacgugaagucau

SEQ ID NO: 632234 - RNA, 16 nt, Homo sapiens
gcacaauuguaauuga

SEQ ID NO: 632235 - RNA, 17 nt, Homo sapiens
gcacacacacaaacaca

SEQ ID NO: 632236 - RNA, 14 nt, Homo sapiens
gcacacacauauau

SEQ ID NO: 632237 - RNA, 12 nt, Homo sapiens
gcacacacugug

SEQ ID NO: 632238 - RNA, 18 nt, Homo sapiens
gcacacagagauucugga

SEQ ID NO: 632239 - RNA, 13 nt, Homo sapiens
gcacacagguguu

SEQ ID NO: 632240 - RNA, 12 nt, Homo sapiens
gcacacauauac

SEQ ID NO: 632241 - RNA, 17 nt, Homo sapiens
gcacacaucuuaccucu

SEQ ID NO: 632242 - RNA, 11 nt, Homo sapiens
gcacacuuugc

SEQ ID NO: 632243 - RNA, 15 nt, Homo sapiens
gcacagaagacagca

SEQ ID NO: 632244 - RNA, 11 nt, Homo sapiens
gcacagaauuu

SEQ ID NO: 632245 - RNA, 18 nt, Homo sapiens
gcacagagggaagccaug

SEQ ID NO: 632246 - RNA, 17 nt, Homo sapiens
gcacagaugcccacgua

SEQ ID NO: 632247 - RNA, 12 nt, Homo sapiens
gcacagccaccc

SEQ ID NO: 632248 - RNA, 23 nt, Homo sapiens
gcacagcccugggagggggcuau

SEQ ID NO: 632249 - RNA, 14 nt, Homo sapiens
gcacagccucagaa

SEQ ID NO: 632250 - RNA, 15 nt, Homo sapiens
gcacagccucgggga

SEQ ID NO: 632251 - RNA, 21 nt, Homo sapiens
gcacagcugaguuaugaugua

SEQ ID NO: 632252 - RNA, 22 nt, Homo sapiens
gcacaggaguguccucuucccu

SEQ ID NO: 632253 - RNA, 21 nt, Homo sapiens
gcacaggcuggagugcagugg

SEQ ID NO: 632254 - RNA, 14 nt, Homo sapiens
gcacaggugacaag

SEQ ID NO: 632255 - RNA, 17 nt, Homo sapiens
gcacagguuagggcaug

SEQ ID NO: 632256 - RNA, 23 nt, Homo sapiens
gcacagguuagggugugugccac

SEQ ID NO: 632257 - RNA, 20 nt, Homo sapiens
gcacaguaucuuuucuuuca

SEQ ID NO: 632258 - RNA, 21 nt, Homo sapiens
gcacagucuauuuuuuguaua

SEQ ID NO: 632259 - RNA, 11 nt, Homo sapiens
gagucacugua

SEQ ID NO: 632260 - RNA, 17 nt, Homo sapiens
gagucagaaaacagaga

SEQ ID NO: 632261 - RNA, 19 nt, Homo sapiens
gagucagcaccuuggccca

SEQ ID NO: 632262 - RNA, 13 nt, Homo sapiens
gagucaugaugaa

SEQ ID NO: 632263 - RNA, 23 nt, Homo sapiens
gaguccacuguggcacuggccac

SEQ ID NO: 632264 - RNA, 19 nt, Homo sapiens
gaguccaugaaaauaccau

SEQ ID NO: 632265 - RNA, 19 nt, Homo sapiens
gagucccacggaaugggga

SEQ ID NO: 632266 - RNA, 14 nt, Homo sapiens
gagucccagagcuc

SEQ ID NO: 632267 - RNA, 16 nt, Homo sapiens
gaguccuaggacuuaa

SEQ ID NO: 632268 - RNA, 14 nt, Homo sapiens
gaguccucacuccc

SEQ ID NO: 632269 - RNA, 16 nt, Homo sapiens
gagucgcugugccaca

SEQ ID NO: 632270 - RNA, 17 nt, Homo sapiens
gagucgggacuaaccca

SEQ ID NO: 632271 - RNA, 18 nt, Homo sapiens
gagucgggagcacagcug

SEQ ID NO: 632272 - RNA, 23 nt, Homo sapiens
gagucgguuagucauugauagaa

SEQ ID NO: 632273 - RNA, 23 nt, Homo sapiens
gagucuaaccugcgucauuucag

SEQ ID NO: 632274 - RNA, 12 nt, Homo sapiens
gagucuauguuc

SEQ ID NO: 632275 - RNA, 22 nt, Homo sapiens
gagucucccacugcaacuugug

SEQ ID NO: 632276 - RNA, 15 nt, Homo sapiens
gagucugaggccuga

SEQ ID NO: 632277 - RNA, 21 nt, Homo sapiens
gagucugugcaguuucugaca

SEQ ID NO: 632278 - RNA, 18 nt, Homo sapiens
gagucuugcucuguuacc

SEQ ID NO: 632279 - RNA, 20 nt, Homo sapiens
gagucuugcucuguugccca

SEQ ID NO: 632280 - RNA, 15 nt, Homo sapiens
gagucuuugcagaga

SEQ ID NO: 632281 - RNA, 13 nt, Homo sapiens
gagugagacucca

SEQ ID NO: 632282 - RNA, 22 nt, Homo sapiens
gagugagaggguuugagucaaa

SEQ ID NO: 632283 - RNA, 16 nt, Homo sapiens
gagugagcaaccagcu

SEQ ID NO: 632284 - RNA, 15 nt, Homo sapiens
gagugagcaaggggg

SEQ ID NO: 632285 - RNA, 15 nt, Homo sapiens
gagugagcacucacg

SEQ ID NO: 632286 - RNA, 13 nt, Homo sapiens
gagugaguguaug

SEQ ID NO: 632287 - RNA, 19 nt, Homo sapiens
gagugcaauggugcaauca

SEQ ID NO: 632288 - RNA, 11 nt, Homo sapiens
gagugcagugc

SEQ ID NO: 632289 - RNA, 22 nt, Homo sapiens
gagugcugaaauaaaaugauaa

SEQ ID NO: 632290 - RNA, 19 nt, Homo sapiens
gagugcugggcacugcucc

SEQ ID NO: 632291 - RNA, 18 nt, Homo sapiens
gagugcuggucacacccc

SEQ ID NO: 632292 - RNA, 17 nt, Homo sapiens
gagugcugucgggacca

SEQ ID NO: 632293 - RNA, 20 nt, Homo sapiens
gagugcuuguccccuaagag

SEQ ID NO: 632294 - RNA, 14 nt, Homo sapiens
gaguggaaggugag

SEQ ID NO: 632295 - RNA, 16 nt, Homo sapiens
gaguggccagccagug

SEQ ID NO: 632296 - RNA, 22 nt, Homo sapiens
gaguggccagccagugccauuc

SEQ ID NO: 632297 - RNA, 16 nt, Homo sapiens
gaguggcccaccgugg

SEQ ID NO: 632298 - RNA, 15 nt, Homo sapiens
gaguggccuagagca

SEQ ID NO: 632299 - RNA, 19 nt, Homo sapiens
gaguggccuagagcacucu

SEQ ID NO: 632300 - RNA, 11 nt, Homo sapiens
gaguggcugca

SEQ ID NO: 632301 - RNA, 21 nt, Homo sapiens
gaguggcuuggccucaagaga

SEQ ID NO: 632302 - RNA, 18 nt, Homo sapiens
gagugggguggggagcau

SEQ ID NO: 632303 - RNA, 13 nt, Homo sapiens
gaguggucuucaa

SEQ ID NO: 632304 - RNA, 14 nt, Homo sapiens
gagugguugcuaua

SEQ ID NO: 632305 - RNA, 14 nt, Homo sapiens
gaguguaaaccaaa

SEQ ID NO: 632306 - RNA, 16 nt, Homo sapiens
gaguguagacuguggc

SEQ ID NO: 632307 - RNA, 21 nt, Homo sapiens
gaguguccggcugaggccuga

SEQ ID NO: 632308 - RNA, 23 nt, Homo sapiens
gagugucuuuccacggagccacu

SEQ ID NO: 632309 - RNA, 18 nt, Homo sapiens
gagugugagugugagaga

SEQ ID NO: 632310 - RNA, 13 nt, Homo sapiens
gagugugcugcua

SEQ ID NO: 632311 - RNA, 13 nt, Homo sapiens
gagugugugcaag

SEQ ID NO: 632312 - RNA, 15 nt, Homo sapiens
gaguguuauugcaug

SEQ ID NO: 632313 - RNA, 21 nt, Homo sapiens
gaguguucaaaauacuacuga

SEQ ID NO: 632314 - RNA, 21 nt, Homo sapiens
gaguguuccccuuccacugag

SEQ ID NO: 632315 - RNA, 18 nt, Homo sapiens
gaguguuuaaaguucaac

SEQ ID NO: 632316 - RNA, 18 nt, Homo sapiens
gaguuaagauaucccuaa

SEQ ID NO: 632317 - RNA, 21 nt, Homo sapiens
gaguuaccacuuuccacuccc

SEQ ID NO: 632318 - RNA, 19 nt, Homo sapiens
gaguuacuuagaaugccau

SEQ ID NO: 632319 - RNA, 21 nt, Homo sapiens
gaguuaggaccaccaauggau

SEQ ID NO: 632320 - RNA, 15 nt, Homo sapiens
ccacucuaccaaaua

SEQ ID NO: 632321 - RNA, 13 nt, Homo sapiens
ccacucuaccuga

SEQ ID NO: 632322 - RNA, 19 nt, Homo sapiens
ccacucugauucaccucuu

SEQ ID NO: 632323 - RNA, 16 nt, Homo sapiens
ccacucuguaauaguu

SEQ ID NO: 632324 - RNA, 15 nt, Homo sapiens
ccacucuguccugga

SEQ ID NO: 632325 - RNA, 14 nt, Homo sapiens
ccacucuucuugca

SEQ ID NO: 632326 - RNA, 14 nt, Homo sapiens
ccacugacuuccuc

SEQ ID NO: 632327 - RNA, 20 nt, Homo sapiens
ccacugcaaauaaagccuuu

SEQ ID NO: 632328 - RNA, 22 nt, Homo sapiens
ccacugcacuccagucuggcaa

SEQ ID NO: 632329 - RNA, 13 nt, Homo sapiens
ccacugcacucua

SEQ ID NO: 632330 - RNA, 12 nt, Homo sapiens
ccacugcuccau

SEQ ID NO: 632331 - RNA, 17 nt, Homo sapiens
ccacuggacaacacuga

SEQ ID NO: 632332 - RNA, 20 nt, Homo sapiens
ccacuggcaaauguaacugu

SEQ ID NO: 632333 - RNA, 22 nt, Homo sapiens
ccacuggccucaagugagccaa

SEQ ID NO: 632334 - RNA, 22 nt, Homo sapiens
ccacugugccucagagaccagg

SEQ ID NO: 632335 - RNA, 19 nt, Homo sapiens
ccacuguggcacuggccac

SEQ ID NO: 632336 - RNA, 15 nt, Homo sapiens
ccacuguguauuuaa

SEQ ID NO: 632337 - RNA, 21 nt, Homo sapiens
ccacuguuucucuugagcugg

SEQ ID NO: 632338 - RNA, 19 nt, Homo sapiens
ccacuuaaaaaauguccau

SEQ ID NO: 632339 - RNA, 18 nt, Homo sapiens
ccacuuaaguucuuugau

SEQ ID NO: 632340 - RNA, 18 nt, Homo sapiens
ccacuuagaauagcauuu

SEQ ID NO: 632341 - RNA, 16 nt, Homo sapiens
ccacuucuaaauagca

SEQ ID NO: 632342 - RNA, 19 nt, Homo sapiens
ccacuucuccaugcugcaa

SEQ ID NO: 632343 - RNA, 23 nt, Homo sapiens
ccacuucugggucaugcacugag

SEQ ID NO: 632344 - RNA, 15 nt, Homo sapiens
ccacuucugugccac

SEQ ID NO: 632345 - RNA, 15 nt, Homo sapiens
ccacuugaagcacuu

SEQ ID NO: 632346 - RNA, 18 nt, Homo sapiens
ccacuuugcuguuccuua

SEQ ID NO: 632347 - RNA, 14 nt, Homo sapiens
ccagaaaagcaaua

SEQ ID NO: 632348 - RNA, 20 nt, Homo sapiens
ccagaacaguaugaauuuga

SEQ ID NO: 632349 - RNA, 18 nt, Homo sapiens
ccagaagaagagaagcug

SEQ ID NO: 632350 - RNA, 17 nt, Homo sapiens
ccagaagcuuccauagu

SEQ ID NO: 632351 - RNA, 15 nt, Homo sapiens
ccagaaggcaaaaag

SEQ ID NO: 632352 - RNA, 22 nt, Homo sapiens
ccagaaggcagagguugcagug

SEQ ID NO: 632353 - RNA, 14 nt, Homo sapiens
ccagaaguguuuca

SEQ ID NO: 632354 - RNA, 18 nt, Homo sapiens
ccagaaguuacagaugag

SEQ ID NO: 632355 - RNA, 23 nt, Homo sapiens
ccagaaguuuuaacuuccagugg

SEQ ID NO: 632356 - RNA, 21 nt, Homo sapiens
ccagaauaaaacgcaaagggc

SEQ ID NO: 632357 - RNA, 22 nt, Homo sapiens
ccagaaucuugacuuucugauu

SEQ ID NO: 632358 - RNA, 18 nt, Homo sapiens
ccagacaagaagacuguc

SEQ ID NO: 632359 - RNA, 17 nt, Homo sapiens
ccagacacagacuggca

SEQ ID NO: 632360 - RNA, 18 nt, Homo sapiens
ccagacacagacuggcaa

SEQ ID NO: 632361 - RNA, 18 nt, Homo sapiens
ccagacaccaugugcaau

SEQ ID NO: 632362 - RNA, 18 nt, Homo sapiens
ccagaccagccugggcaa

SEQ ID NO: 632363 - RNA, 12 nt, Homo sapiens
ccagacccugaa

SEQ ID NO: 632364 - RNA, 23 nt, Homo sapiens
ccagacuccaccgucagcuguaa

SEQ ID NO: 632365 - RNA, 21 nt, Homo sapiens
ccagacuggacaggcaaagac

SEQ ID NO: 632366 - RNA, 18 nt, Homo sapiens
ccagacuuccuccuuucc

SEQ ID NO: 632367 - RNA, 20 nt, Homo sapiens
ccagagaacugcagaccuca

SEQ ID NO: 632368 - RNA, 19 nt, Homo sapiens
ccagagagaacaacaggca

SEQ ID NO: 632369 - RNA, 13 nt, Homo sapiens
ccagagagacaga

SEQ ID NO: 632370 - RNA, 18 nt, Homo sapiens
ccagagagcaacucugag

SEQ ID NO: 632371 - RNA, 24 nt, Homo sapiens
ccagagagcagcuucagugacaaa

SEQ ID NO: 632372 - RNA, 15 nt, Homo sapiens
ccagagaguggcucc

SEQ ID NO: 632373 - RNA, 13 nt, Homo sapiens
ccagagaugacua

SEQ ID NO: 632374 - RNA, 21 nt, Homo sapiens
ccagagaugacuauuacuuuu

SEQ ID NO: 632375 - RNA, 23 nt, Homo sapiens
gagaugggcuuguuuucuugcca

SEQ ID NO: 632376 - RNA, 11 nt, Homo sapiens
gagauguaucc

SEQ ID NO: 632377 - RNA, 12 nt, Homo sapiens
gagaugucuucu

SEQ ID NO: 632378 - RNA, 15 nt, Homo sapiens
gagauuauucuuugu

SEQ ID NO: 632379 - RNA, 19 nt, Homo sapiens
gagauuccagucuacuuga

SEQ ID NO: 632380 - RNA, 13 nt, Homo sapiens
gagauucuucccc

SEQ ID NO: 632381 - RNA, 19 nt, Homo sapiens
gagauugcacagucaaaac

SEQ ID NO: 632382 - RNA, 20 nt, Homo sapiens
gagauugcacuauugcacuc

SEQ ID NO: 632383 - RNA, 15 nt, Homo sapiens
gagauuggauuugcu

SEQ ID NO: 632384 - RNA, 16 nt, Homo sapiens
gagauuucaugccugg

SEQ ID NO: 632385 - RNA, 21 nt, Homo sapiens
gagauuugucuaauugcaucu

SEQ ID NO: 632386 - RNA, 16 nt, Homo sapiens
gagcaaacagcuguau

SEQ ID NO: 632387 - RNA, 18 nt, Homo sapiens
gagcaaaggcccaugccc

SEQ ID NO: 632388 - RNA, 21 nt, Homo sapiens
gagcaaaucaucugcauuccu

SEQ ID NO: 632389 - RNA, 18 nt, Homo sapiens
gagcaaauguggcuccug

SEQ ID NO: 632390 - RNA, 14 nt, Homo sapiens
gagcaacagaguga

SEQ ID NO: 632391 - RNA, 14 nt, Homo sapiens
gagcaacucuccac

SEQ ID NO: 632392 - RNA, 22 nt, Homo sapiens
gagcaagacuccaucucaaaaa

SEQ ID NO: 632393 - RNA, 17 nt, Homo sapiens
gagcaagaugauguaau

SEQ ID NO: 632394 - RNA, 16 nt, Homo sapiens
gagcaagcgcuguaaa

SEQ ID NO: 632395 - RNA, 15 nt, Homo sapiens
gagcaagggcacaaa

SEQ ID NO: 632396 - RNA, 15 nt, Homo sapiens
gagcaagggggccca

SEQ ID NO: 632397 - RNA, 19 nt, Homo sapiens
gagcacaaaaugauaauca

SEQ ID NO: 632398 - RNA, 23 nt, Homo sapiens
gagcacaauuucccuucauacuc

SEQ ID NO: 632399 - RNA, 21 nt, Homo sapiens
gagcacaggucccaccuccag

SEQ ID NO: 632400 - RNA, 16 nt, Homo sapiens
gagcacccaagccagg

SEQ ID NO: 632401 - RNA, 16 nt, Homo sapiens
gagcacccauuccaaa

SEQ ID NO: 632402 - RNA, 22 nt, Homo sapiens
gagcaccugggccccacuggac

SEQ ID NO: 632403 - RNA, 19 nt, Homo sapiens
gagcaccuuugcacaggau

SEQ ID NO: 632404 - RNA, 15 nt, Homo sapiens
gagcacuggccagag

SEQ ID NO: 632405 - RNA, 16 nt, Homo sapiens
gagcacuugagaacca

SEQ ID NO: 632406 - RNA, 13 nt, Homo sapiens
gagcagaacaggu

SEQ ID NO: 632407 - RNA, 19 nt, Homo sapiens
gagcagaagcuggaggcac

SEQ ID NO: 632408 - RNA, 23 nt, Homo sapiens
gagcagacaccagcagcccuguc

SEQ ID NO: 632409 - RNA, 17 nt, Homo sapiens
gagcagaggucucccaa

SEQ ID NO: 632410 - RNA, 17 nt, Homo sapiens
gagcagcuucagugaca

SEQ ID NO: 632411 - RNA, 19 nt, Homo sapiens
gagcagcuucugggaccau

SEQ ID NO: 632412 - RNA, 15 nt, Homo sapiens
gagcaggaacaauga

SEQ ID NO: 632413 - RNA, 16 nt, Homo sapiens
gagcaggaagcauuca

SEQ ID NO: 632414 - RNA, 18 nt, Homo sapiens
gagcaggcucagacucug

SEQ ID NO: 632415 - RNA, 11 nt, Homo sapiens
gagcagggauu

SEQ ID NO: 632416 - RNA, 20 nt, Homo sapiens
gagcaggggcauugcugauu

SEQ ID NO: 632417 - RNA, 21 nt, Homo sapiens
gagcagugaaugauucagugu

SEQ ID NO: 632418 - RNA, 22 nt, Homo sapiens
gagcagugccaaucgggcagaa

SEQ ID NO: 632419 - RNA, 23 nt, Homo sapiens
gagcagugggaggguaccagcag

SEQ ID NO: 632420 - RNA, 14 nt, Homo sapiens
gagcaguucagagu

SEQ ID NO: 632421 - RNA, 15 nt, Homo sapiens
gagcauagaagccac

SEQ ID NO: 632422 - RNA, 23 nt, Homo sapiens
gagcaucaaucuuguuacugcug

SEQ ID NO: 632423 - RNA, 19 nt, Homo sapiens
gagcauccccagccacaac

SEQ ID NO: 632424 - RNA, 18 nt, Homo sapiens
gagcauccugcaagguga

SEQ ID NO: 632425 - RNA, 21 nt, Homo sapiens
gagcaucuguuuaccuggcag

SEQ ID NO: 632426 - RNA, 20 nt, Homo sapiens
gagcaugcucaguuggugcu

SEQ ID NO: 632427 - RNA, 15 nt, Homo sapiens
gagcauggaacacuu

SEQ ID NO: 632428 - RNA, 21 nt, Homo sapiens
gagcauucagacuccaaacag

SEQ ID NO: 632429 - RNA, 21 nt, Homo sapiens
gagcauuuaagagugaaguca

SEQ ID NO: 632430 - RNA, 19 nt, Homo sapiens
gagcauuuauaaauggaca

SEQ ID NO: 632431 - RNA, 22 nt, Homo sapiens
gagcauuuccaacaccacagac

SEQ ID NO: 632432 - RNA, 17 nt, Homo sapiens
gagcauuucucaucagu

SEQ ID NO: 632433 - RNA, 18 nt, Homo sapiens
gagccaaaaugacuuuga

SEQ ID NO: 632434 - RNA, 22 nt, Homo sapiens
gagccaacugauuuuguaugua

SEQ ID NO: 632435 - RNA, 21 nt, Homo sapiens
gagccacaagcugcacuguga

SEQ ID NO: 632436 - RNA, 12 nt, Homo sapiens
gagccacagugc

SEQ ID NO: 632437 - RNA, 20 nt, Homo sapiens
gagccaccacguccagcugg

SEQ ID NO: 632438 - RNA, 15 nt, Homo sapiens
gagccaccgugccug

SEQ ID NO: 632439 - RNA, 21 nt, Homo sapiens
gagccacucagucucuuccac

SEQ ID NO: 632440 - RNA, 19 nt, Homo sapiens
gagccagaaagggugccag

SEQ ID NO: 632441 - RNA, 20 nt, Homo sapiens
gaggcaggagagucacuuga

SEQ ID NO: 632442 - RNA, 17 nt, Homo sapiens
gaggcaggcggaucaug

SEQ ID NO: 632443 - RNA, 19 nt, Homo sapiens
gaggcaggggacaagggag

SEQ ID NO: 632444 - RNA, 19 nt, Homo sapiens
gaggcagguggaucaccug

SEQ ID NO: 632445 - RNA, 20 nt, Homo sapiens
gaggcagguggaucgcuuga

SEQ ID NO: 632446 - RNA, 20 nt, Homo sapiens
gaggcaucaguugcuauaua

SEQ ID NO: 632447 - RNA, 14 nt, Homo sapiens
gaggcaucuggaaa

SEQ ID NO: 632448 - RNA, 23 nt, Homo sapiens
gaggcauuccagccccuauguua

SEQ ID NO: 632449 - RNA, 15 nt, Homo sapiens
gaggccaaacacacu

SEQ ID NO: 632450 - RNA, 23 nt, Homo sapiens
gaggccaauaaaaaguucagagu

SEQ ID NO: 632451 - RNA, 14 nt, Homo sapiens
gaggccacccagag

SEQ ID NO: 632452 - RNA, 23 nt, Homo sapiens
gaggccagggcuauagcucagga

SEQ ID NO: 632453 - RNA, 21 nt, Homo sapiens
gaggccauccaagauggcaug

SEQ ID NO: 632454 - RNA, 14 nt, Homo sapiens
gaggccauccugcc

SEQ ID NO: 632455 - RNA, 19 nt, Homo sapiens
gaggccccaggucaccucg

SEQ ID NO: 632456 - RNA, 18 nt, Homo sapiens
gaggcccugcccaaugag

SEQ ID NO: 632457 - RNA, 13 nt, Homo sapiens
gaggcccugugau

SEQ ID NO: 632458 - RNA, 16 nt, Homo sapiens
gaggccucauccaggg

SEQ ID NO: 632459 - RNA, 15 nt, Homo sapiens
gaggccucgacccac

SEQ ID NO: 632460 - RNA, 22 nt, Homo sapiens
gaggccuggacuuuccugcaac

SEQ ID NO: 632461 - RNA, 23 nt, Homo sapiens
gaggccugugaagccaaacaaua

SEQ ID NO: 632462 - RNA, 17 nt, Homo sapiens
gaggcgaugccacgcuu

SEQ ID NO: 632463 - RNA, 19 nt, Homo sapiens
gaggcggagaguacaguga

SEQ ID NO: 632464 - RNA, 19 nt, Homo sapiens
gaggcggguggaucacuug

SEQ ID NO: 632465 - RNA, 17 nt, Homo sapiens
gaggcgucuucaucucc

SEQ ID NO: 632466 - RNA, 13 nt, Homo sapiens
gaggcuaccucac

SEQ ID NO: 632467 - RNA, 16 nt, Homo sapiens
gaggcuaccucaccug

SEQ ID NO: 632468 - RNA, 21 nt, Homo sapiens
gaggcucucccucucucucau

SEQ ID NO: 632469 - RNA, 18 nt, Homo sapiens
gaggcucugucacugagc

SEQ ID NO: 632470 - RNA, 18 nt, Homo sapiens
gaggcugagacaggagaa

SEQ ID NO: 632471 - RNA, 21 nt, Homo sapiens
gaggcugagccuacagaugaa

SEQ ID NO: 632472 - RNA, 17 nt, Homo sapiens
gaggcugaggcacuggc

SEQ ID NO: 632473 - RNA, 20 nt, Homo sapiens
gaggcugcacccacccagga

SEQ ID NO: 632474 - RNA, 15 nt, Homo sapiens
gaggcugcacuggag

SEQ ID NO: 632475 - RNA, 12 nt, Homo sapiens
gaggcugcagaa

SEQ ID NO: 632476 - RNA, 13 nt, Homo sapiens
gaggcugcaguga

SEQ ID NO: 632477 - RNA, 16 nt, Homo sapiens
gaggcugcaugcucug

SEQ ID NO: 632478 - RNA, 12 nt, Homo sapiens
gaggcuggccaa

SEQ ID NO: 632479 - RNA, 12 nt, Homo sapiens
gaggcugucaca

SEQ ID NO: 632480 - RNA, 15 nt, Homo sapiens
gaggcuuccagagag

SEQ ID NO: 632481 - RNA, 21 nt, Homo sapiens
gaggcuucuccgccagccucc

SEQ ID NO: 632482 - RNA, 23 nt, Homo sapiens
gaggcuuucuccaggaggauuag

SEQ ID NO: 632483 - RNA, 15 nt, Homo sapiens
gagggagagggaggu

SEQ ID NO: 632484 - RNA, 15 nt, Homo sapiens
gagggagccauggaa

SEQ ID NO: 632485 - RNA, 17 nt, Homo sapiens
gagggaggccaggcggg

SEQ ID NO: 632486 - RNA, 13 nt, Homo sapiens
gagggaggcgcug

SEQ ID NO: 632487 - RNA, 19 nt, Homo sapiens
gagggauaaaaacaauacu

SEQ ID NO: 632488 - RNA, 22 nt, Homo sapiens
gagggaugcuggaaccaguuac

SEQ ID NO: 632489 - RNA, 13 nt, Homo sapiens
gagggcagcugcu

SEQ ID NO: 632490 - RNA, 14 nt, Homo sapiens
gagggcagggacca

SEQ ID NO: 632491 - RNA, 16 nt, Homo sapiens
gagggcagucgauaga

SEQ ID NO: 632492 - RNA, 22 nt, Homo sapiens
gagggccaaaauauuuggaaug

SEQ ID NO: 632493 - RNA, 17 nt, Homo sapiens
gagggccccgcccagug

SEQ ID NO: 632494 - RNA, 18 nt, Homo sapiens
gagggccccgcccagugc

SEQ ID NO: 632495 - RNA, 22 nt, Homo sapiens
gagggcccuccgaccacuucca

SEQ ID NO: 632496 - RNA, 15 nt, Homo sapiens
gagggcgaaggccau

SEQ ID NO: 632497 - RNA, 18 nt, Homo sapiens
gagggcgccaugcagcgg

SEQ ID NO: 632498 - RNA, 21 nt, Homo sapiens
cuugccaggggcaguuuuagc

SEQ ID NO: 632499 - RNA, 15 nt, Homo sapiens
cuugcccaaguccca

SEQ ID NO: 632500 - RNA, 21 nt, Homo sapiens
cuugcccacccccaccaugca

SEQ ID NO: 632501 - RNA, 20 nt, Homo sapiens
cuugcccagagaugccucca

SEQ ID NO: 632502 - RNA, 22 nt, Homo sapiens
cuugcccagggugcagugugag

SEQ ID NO: 632503 - RNA, 18 nt, Homo sapiens
cuugcccccuuugaccuu

SEQ ID NO: 632504 - RNA, 23 nt, Homo sapiens
cuugcccgccagccucagugcca

SEQ ID NO: 632505 - RNA, 17 nt, Homo sapiens
cuugcccucaagcaaua

SEQ ID NO: 632506 - RNA, 13 nt, Homo sapiens
cuugcccuuuacg

SEQ ID NO: 632507 - RNA, 14 nt, Homo sapiens
cuugccuaagacuu

SEQ ID NO: 632508 - RNA, 19 nt, Homo sapiens
cuugccuaagacuugccca

SEQ ID NO: 632509 - RNA, 15 nt, Homo sapiens
cuugccuaggccaaa

SEQ ID NO: 632510 - RNA, 16 nt, Homo sapiens
cuugccuccgugccca

SEQ ID NO: 632511 - RNA, 17 nt, Homo sapiens
cuugcuaccaguauuua

SEQ ID NO: 632512 - RNA, 14 nt, Homo sapiens
cuugcucaaaacac

SEQ ID NO: 632513 - RNA, 17 nt, Homo sapiens
cuugcuccuguguaaaa

SEQ ID NO: 632514 - RNA, 14 nt, Homo sapiens
cuugcucugucacc

SEQ ID NO: 632515 - RNA, 18 nt, Homo sapiens
cuugcucuucaucauaua

SEQ ID NO: 632516 - RNA, 19 nt, Homo sapiens
cuugcugaauuucaggcau

SEQ ID NO: 632517 - RNA, 16 nt, Homo sapiens
cuugcugauggcuuga

SEQ ID NO: 632518 - RNA, 19 nt, Homo sapiens
cuugcugccacauucuaaa

SEQ ID NO: 632519 - RNA, 16 nt, Homo sapiens
cuugcugcugagugca

SEQ ID NO: 632520 - RNA, 23 nt, Homo sapiens
cuugcuggacggggacuggggau

SEQ ID NO: 632521 - RNA, 15 nt, Homo sapiens
cuugcuggcucugag

SEQ ID NO: 632522 - RNA, 18 nt, Homo sapiens
cuugcuggguugaucuag

SEQ ID NO: 632523 - RNA, 12 nt, Homo sapiens
cuugcugugagc

SEQ ID NO: 632524 - RNA, 21 nt, Homo sapiens
cuugcuuccccuuuugccaau

SEQ ID NO: 632525 - RNA, 20 nt, Homo sapiens
cuugcuuuccaaguaaaggu

SEQ ID NO: 632526 - RNA, 14 nt, Homo sapiens
cauccuacaagaca

SEQ ID NO: 632527 - RNA, 20 nt, Homo sapiens
cauccuacaagacacaguga

SEQ ID NO: 632528 - RNA, 18 nt, Homo sapiens
cauccuaccccuuugcac

SEQ ID NO: 632529 - RNA, 16 nt, Homo sapiens
cauccuaguaauaaag

SEQ ID NO: 632530 - RNA, 15 nt, Homo sapiens
cauccuaugcuuaau

SEQ ID NO: 632531 - RNA, 13 nt, Homo sapiens
cauccuccagcuu

SEQ ID NO: 632532 - RNA, 19 nt, Homo sapiens
cauccugauggaccugccc

SEQ ID NO: 632533 - RNA, 20 nt, Homo sapiens
cauccugguuuccacugucu

SEQ ID NO: 632534 - RNA, 19 nt, Homo sapiens
cauccuguaagugcuuaau

SEQ ID NO: 632535 - RNA, 21 nt, Homo sapiens
cauccuguauaagcacugaaa

SEQ ID NO: 632536 - RNA, 18 nt, Homo sapiens
cauccugucaccaugacu

SEQ ID NO: 632537 - RNA, 20 nt, Homo sapiens
cauccuguuuguaugaaauu

SEQ ID NO: 632538 - RNA, 23 nt, Homo sapiens
cauccuuaaaacaauucugugac

SEQ ID NO: 632539 - RNA, 24 nt, Homo sapiens
cauccuuaaaacaauucugugaca

SEQ ID NO: 632540 - RNA, 22 nt, Homo sapiens
cauccuuauucacguugacagu

SEQ ID NO: 632541 - RNA, 20 nt, Homo sapiens
cauccuucuuucuaguucag

SEQ ID NO: 632542 - RNA, 12 nt, Homo sapiens
cauccuugaugc

SEQ ID NO: 632543 - RNA, 14 nt, Homo sapiens
cauccuugcugcag

SEQ ID NO: 632544 - RNA, 15 nt, Homo sapiens
cauccuuuacguguu

SEQ ID NO: 632545 - RNA, 20 nt, Homo sapiens
cauccuuuucaaaaccuaaa

SEQ ID NO: 632546 - RNA, 22 nt, Homo sapiens
caucgaaucuacuaauuccaca

SEQ ID NO: 632547 - RNA, 20 nt, Homo sapiens
caucgcaauaguuuuuuacu

SEQ ID NO: 632548 - RNA, 20 nt, Homo sapiens
caucgcaggaugacagcucc

SEQ ID NO: 632549 - RNA, 18 nt, Homo sapiens
caucggagggagucccag

SEQ ID NO: 632550 - RNA, 15 nt, Homo sapiens
caucgucaucaucau

SEQ ID NO: 632551 - RNA, 21 nt, Homo sapiens
caucguggccuugaccuccaa

SEQ ID NO: 632552 - RNA, 19 nt, Homo sapiens
caucguuuucuucacuguc

SEQ ID NO: 632553 - RNA, 17 nt, Homo sapiens
caucuaaauauuuccau

SEQ ID NO: 632554 - RNA, 14 nt, Homo sapiens
caucuaauaaauca

SEQ ID NO: 632555 - RNA, 19 nt, Homo sapiens
caucuaauaaguauauaau

SEQ ID NO: 632556 - RNA, 13 nt, Homo sapiens
caucuaauaugau

SEQ ID NO: 632557 - RNA, 20 nt, Homo sapiens
caucuacccugcugaccucc

SEQ ID NO: 632558 - RNA, 19 nt, Homo sapiens
caucuagcgcaauugaagg

SEQ ID NO: 632559 - RNA, 17 nt, Homo sapiens
caucucaaaaagaaaag

SEQ ID NO: 632560 - RNA, 15 nt, Homo sapiens
caucucaauaacaaa

SEQ ID NO: 632561 - RNA, 15 nt, Homo sapiens
caucucacuuuauga

SEQ ID NO: 632562 - RNA, 14 nt, Homo sapiens
caucucaggggcca

SEQ ID NO: 632563 - RNA, 23 nt, Homo sapiens
caucucagguuggcggcagacac

SEQ ID NO: 632564 - RNA, 15 nt, Homo sapiens
caucucaucaacuua

SEQ ID NO: 632565 - RNA, 15 nt, Homo sapiens
caucucaucaugucu

SEQ ID NO: 632566 - RNA, 16 nt, Homo sapiens
caucucauuccaacuu

SEQ ID NO: 632567 - RNA, 14 nt, Homo sapiens
caucuccagccucc

SEQ ID NO: 632568 - RNA, 17 nt, Homo sapiens
caucuccagugugccag

SEQ ID NO: 632569 - RNA, 21 nt, Homo sapiens
caucucccagaccgccaguga

SEQ ID NO: 632570 - RNA, 21 nt, Homo sapiens
caucucccagauaaugugaaa

SEQ ID NO: 632571 - RNA, 20 nt, Homo sapiens
caucuccccucagauuccac

SEQ ID NO: 632572 - RNA, 19 nt, Homo sapiens
caucuccuauaaucuguca

SEQ ID NO: 632573 - RNA, 14 nt, Homo sapiens
caucuccugacccu

SEQ ID NO: 632574 - RNA, 20 nt, Homo sapiens
caucucguauaauauucaca

SEQ ID NO: 632575 - RNA, 12 nt, Homo sapiens
caucucuacuaa

SEQ ID NO: 632576 - RNA, 15 nt, Homo sapiens
caucucuacugaaaa

SEQ ID NO: 632577 - RNA, 17 nt, Homo sapiens
caucucuaguguagcug

SEQ ID NO: 632578 - RNA, 18 nt, Homo sapiens
caucucuccccaacccua

SEQ ID NO: 632579 - RNA, 17 nt, Homo sapiens
caucucugcuuucacuc

SEQ ID NO: 632580 - RNA, 18 nt, Homo sapiens
caucucuuccccagagag

SEQ ID NO: 632581 - RNA, 21 nt, Homo sapiens
caucucuugaaaccuguuaaa

SEQ ID NO: 632582 - RNA, 22 nt, Homo sapiens
caucucuugaaaccuguuaaaa

SEQ ID NO: 632583 - RNA, 15 nt, Homo sapiens
caucugagaggcucu

SEQ ID NO: 632584 - RNA, 17 nt, Homo sapiens
caucugcaacaaaaagu

SEQ ID NO: 632585 - RNA, 11 nt, Homo sapiens
caucugcaaua

SEQ ID NO: 632586 - RNA, 18 nt, Homo sapiens
caucugcaugucuacuca

SEQ ID NO: 632587 - RNA, 15 nt, Homo sapiens
caucugcgugacaau

SEQ ID NO: 632588 - RNA, 12 nt, Homo sapiens
caucuggcugca

SEQ ID NO: 632589 - RNA, 17 nt, Homo sapiens
caucugggaaagacauc

SEQ ID NO: 632590 - RNA, 20 nt, Homo sapiens
caucugggaaagacauccau

SEQ ID NO: 632591 - RNA, 14 nt, Homo sapiens
caucuggggcaccu

SEQ ID NO: 632592 - RNA, 18 nt, Homo sapiens
caucugggugcccugaaa

SEQ ID NO: 632593 - RNA, 14 nt, Homo sapiens
caucuggugcucuu

SEQ ID NO: 632594 - RNA, 18 nt, Homo sapiens
caucuguaaagaaaacca

SEQ ID NO: 632595 - RNA, 23 nt, Homo sapiens
caucuguaacaauuauguuuuca

SEQ ID NO: 632596 - RNA, 13 nt, Homo sapiens
caucugucagcca

SEQ ID NO: 632597 - RNA, 11 nt, Homo sapiens
caucugugaau

SEQ ID NO: 632598 - RNA, 21 nt, Homo sapiens
caucugugcacugcccaugga

SEQ ID NO: 632599 - RNA, 22 nt, Homo sapiens
caucugugcacugcccauggac

SEQ ID NO: 632600 - RNA, 13 nt, Homo sapiens
caucugugccaga

SEQ ID NO: 632601 - RNA, 15 nt, Homo sapiens
caucugugccagaga

SEQ ID NO: 632602 - RNA, 16 nt, Homo sapiens
caucugugccagagau

SEQ ID NO: 632603 - RNA, 11 nt, Homo sapiens
caucuuaccuc

SEQ ID NO: 632604 - RNA, 19 nt, Homo sapiens
caucuucaaagcuugaaga

SEQ ID NO: 632605 - RNA, 23 nt, Homo sapiens
caucuucaauuuauuacugaaaa

SEQ ID NO: 632606 - RNA, 17 nt, Homo sapiens
caucuucacugcaauuu

SEQ ID NO: 632607 - RNA, 14 nt, Homo sapiens
caucuuccaacuca

SEQ ID NO: 632608 - RNA, 11 nt, Homo sapiens
caucuuccaag

SEQ ID NO: 632609 - RNA, 20 nt, Homo sapiens
caucuucuaggccaagcauu

SEQ ID NO: 632610 - RNA, 13 nt, Homo sapiens
caucuucuauuca

SEQ ID NO: 632611 - RNA, 22 nt, Homo sapiens
caucuucuggagucuccagugg

SEQ ID NO: 632612 - RNA, 12 nt, Homo sapiens
caucuugccagc

SEQ ID NO: 632613 - RNA, 16 nt, Homo sapiens
caucuugcuaccagua

SEQ ID NO: 632614 - RNA, 17 nt, Homo sapiens
caucuugcucugcauuu

SEQ ID NO: 632615 - RNA, 15 nt, Homo sapiens
caucuugcugcuaau

SEQ ID NO: 632616 - RNA, 14 nt, Homo sapiens
caucuuggagcuuu

SEQ ID NO: 632617 - RNA, 18 nt, Homo sapiens
caucuuggggacaucucu

SEQ ID NO: 632618 - RNA, 18 nt, Homo sapiens
caucuugucaacaugcau

SEQ ID NO: 632619 - RNA, 13 nt, Homo sapiens
caucuugugagug

SEQ ID NO: 632620 - RNA, 14 nt, Homo sapiens
cuuguuacugugau

SEQ ID NO: 632621 - RNA, 13 nt, Homo sapiens
cuuguucagauua

SEQ ID NO: 632622 - RNA, 22 nt, Homo sapiens
cuuguucaucauccagaugugg

SEQ ID NO: 632623 - RNA, 20 nt, Homo sapiens
cuuguucauggagagcuguu

SEQ ID NO: 632624 - RNA, 23 nt, Homo sapiens
cuuguuccccacugacagccucc

SEQ ID NO: 632625 - RNA, 20 nt, Homo sapiens
cuuguucuauuuuucaauca

SEQ ID NO: 632626 - RNA, 11 nt, Homo sapiens
cuuguucuguc

SEQ ID NO: 632627 - RNA, 18 nt, Homo sapiens
cuuguugaauacugagaa

SEQ ID NO: 632628 - RNA, 15 nt, Homo sapiens
cuuguugagugccag

SEQ ID NO: 632629 - RNA, 14 nt, Homo sapiens
cuuguugcacuaaa

SEQ ID NO: 632630 - RNA, 13 nt, Homo sapiens
cuuguugcacugc

SEQ ID NO: 632631 - RNA, 16 nt, Homo sapiens
cuuguugcugcaucuc

SEQ ID NO: 632632 - RNA, 12 nt, Homo sapiens
cuuguugugaca

SEQ ID NO: 632633 - RNA, 17 nt, Homo sapiens
cuuguuguuauugaugu

SEQ ID NO: 632634 - RNA, 14 nt, Homo sapiens
cuuguuuacucauu

SEQ ID NO: 632635 - RNA, 17 nt, Homo sapiens
cuuguuuacucauugaa

SEQ ID NO: 632636 - RNA, 22 nt, Homo sapiens
cuuguuuguuugagcuuaggga

SEQ ID NO: 632637 - RNA, 16 nt, Homo sapiens
cuuguuuucuucacag

SEQ ID NO: 632638 - RNA, 21 nt, Homo sapiens
cuuguuuuuccacuacugcua

SEQ ID NO: 632639 - RNA, 23 nt, Homo sapiens
cuuguuuuuccacuacugcuacc

SEQ ID NO: 632640 - RNA, 16 nt, Homo sapiens
cuuguuuuugcacaug

SEQ ID NO: 632641 - RNA, 15 nt, Homo sapiens
cuuguuuuuuacuca

SEQ ID NO: 632642 - RNA, 19 nt, Homo sapiens
cuuuaaaaacuguuuuaga

SEQ ID NO: 632643 - RNA, 15 nt, Homo sapiens
cuuuaaaagucauua

SEQ ID NO: 632644 - RNA, 20 nt, Homo sapiens
cuuuaaaauauaucuggaac

SEQ ID NO: 632645 - RNA, 14 nt, Homo sapiens
cuuuaaaaugccaa

SEQ ID NO: 632646 - RNA, 16 nt, Homo sapiens
cuuuaaaaugcgaaau

SEQ ID NO: 632647 - RNA, 14 nt, Homo sapiens
cuuuaaaccaccua

SEQ ID NO: 632648 - RNA, 16 nt, Homo sapiens
cuuuaaacucagggac

SEQ ID NO: 632649 - RNA, 19 nt, Homo sapiens
cuuuaaagagaguuugcca

SEQ ID NO: 632650 - RNA, 15 nt, Homo sapiens
caugaauaaaacacu

SEQ ID NO: 632651 - RNA, 18 nt, Homo sapiens
caugaauaaaacacucau

SEQ ID NO: 632652 - RNA, 21 nt, Homo sapiens
caugaauaacauuuaaauucc

SEQ ID NO: 632653 - RNA, 16 nt, Homo sapiens
caugaauacacuuaca

SEQ ID NO: 632654 - RNA, 19 nt, Homo sapiens
caugaauauaaaugggaaa

SEQ ID NO: 632655 - RNA, 14 nt, Homo sapiens
caugaaucaaagac

SEQ ID NO: 632656 - RNA, 14 nt, Homo sapiens
caugaauccagucc

SEQ ID NO: 632657 - RNA, 17 nt, Homo sapiens
caugaauguaucaggaa

SEQ ID NO: 632658 - RNA, 13 nt, Homo sapiens
caugaaugugcug

SEQ ID NO: 632659 - RNA, 22 nt, Homo sapiens
caugaaugugcuggugaacacu

SEQ ID NO: 632660 - RNA, 18 nt, Homo sapiens
caugaauuauuacagugu

SEQ ID NO: 632661 - RNA, 19 nt, Homo sapiens
caugacaaacacacaucca

SEQ ID NO: 632662 - RNA, 14 nt, Homo sapiens
caugacaagaacaa

SEQ ID NO: 632663 - RNA, 19 nt, Homo sapiens
caugacaagaacaaagcca

SEQ ID NO: 632664 - RNA, 16 nt, Homo sapiens
caugaccacugcccug

SEQ ID NO: 632665 - RNA, 20 nt, Homo sapiens
caugacccaccccugugcuc

SEQ ID NO: 632666 - RNA, 13 nt, Homo sapiens
caugaccuggaaa

SEQ ID NO: 632667 - RNA, 19 nt, Homo sapiens
caugacgaagacgccaaaa

SEQ ID NO: 632668 - RNA, 11 nt, Homo sapiens
caugacugugg

SEQ ID NO: 632669 - RNA, 23 nt, Homo sapiens
caugagaagguuggcgugcccug

SEQ ID NO: 632670 - RNA, 14 nt, Homo sapiens
caugagaauaagag

SEQ ID NO: 632671 - RNA, 21 nt, Homo sapiens
caugagagaaggaggggagca

SEQ ID NO: 632672 - RNA, 21 nt, Homo sapiens
caugagagaauuguaucauuu

SEQ ID NO: 632673 - RNA, 15 nt, Homo sapiens
caugagauaacucaa

SEQ ID NO: 632674 - RNA, 19 nt, Homo sapiens
caugagauucauucaguua

SEQ ID NO: 632675 - RNA, 21 nt, Homo sapiens
caugagcgucuguggagccau

SEQ ID NO: 632676 - RNA, 19 nt, Homo sapiens
caugagcugcucauuacag

SEQ ID NO: 632677 - RNA, 21 nt, Homo sapiens
caugaggaccaggguggagcu

SEQ ID NO: 632678 - RNA, 20 nt, Homo sapiens
caugaggccaccaguaaaag

SEQ ID NO: 632679 - RNA, 14 nt, Homo sapiens
caugaggucuuccc

SEQ ID NO: 632680 - RNA, 20 nt, Homo sapiens
caugaguauuccuagcaaau

SEQ ID NO: 632681 - RNA, 18 nt, Homo sapiens
caugagugaauaaauguc

SEQ ID NO: 632682 - RNA, 18 nt, Homo sapiens
caugaguuaucaugaauu

SEQ ID NO: 632683 - RNA, 15 nt, Homo sapiens
caugauaaggcucuu

SEQ ID NO: 632684 - RNA, 21 nt, Homo sapiens
caugauaccaccuuuacugug

SEQ ID NO: 632685 - RNA, 12 nt, Homo sapiens
caugauagacuu

SEQ ID NO: 632686 - RNA, 16 nt, Homo sapiens
caugaucaagauauau

SEQ ID NO: 632687 - RNA, 16 nt, Homo sapiens
caugaucauagcucac

SEQ ID NO: 632688 - RNA, 18 nt, Homo sapiens
caugaucaucacaaucau

SEQ ID NO: 632689 - RNA, 18 nt, Homo sapiens
caugauccuugcugauaa

SEQ ID NO: 632690 - RNA, 20 nt, Homo sapiens
caugaucuugugacauauua

SEQ ID NO: 632691 - RNA, 23 nt, Homo sapiens
caugaugagucugaaggcauuug

SEQ ID NO: 632692 - RNA, 16 nt, Homo sapiens
caugaugcccugcuga

SEQ ID NO: 632693 - RNA, 20 nt, Homo sapiens
caugaugcuaaaggcugcga

SEQ ID NO: 632694 - RNA, 19 nt, Homo sapiens
caugauggagcgcaccugc

SEQ ID NO: 632695 - RNA, 20 nt, Homo sapiens
caugauggagcgcaccugcc

SEQ ID NO: 632696 - RNA, 19 nt, Homo sapiens
caugauggagucagguuug

SEQ ID NO: 632697 - RNA, 15 nt, Homo sapiens
caugauguagagugu

SEQ ID NO: 632698 - RNA, 16 nt, Homo sapiens
caugauuucauuucaa

SEQ ID NO: 632699 - RNA, 21 nt, Homo sapiens
caugcacacacacacaucuca

SEQ ID NO: 632700 - RNA, 13 nt, Homo sapiens
caugcacacagau

SEQ ID NO: 632701 - RNA, 14 nt, Homo sapiens
caugcacacggcug

SEQ ID NO: 632702 - RNA, 18 nt, Homo sapiens
caugcaccuguagucuca

SEQ ID NO: 632703 - RNA, 21 nt, Homo sapiens
caugcagaacaccaauauuaa

SEQ ID NO: 632704 - RNA, 18 nt, Homo sapiens
caugcagccagccaucaa

SEQ ID NO: 632705 - RNA, 21 nt, Homo sapiens
caugcagccagccaucaaaua

SEQ ID NO: 632706 - RNA, 21 nt, Homo sapiens
caugcagcucuucaacaugac

SEQ ID NO: 632707 - RNA, 21 nt, Homo sapiens
caugcagcuguggcagaguua

SEQ ID NO: 632708 - RNA, 22 nt, Homo sapiens
caugcagguggugggacacugg

SEQ ID NO: 632709 - RNA, 15 nt, Homo sapiens
caugcagugcccuca

SEQ ID NO: 632710 - RNA, 21 nt, Homo sapiens
caugcaguugcagugaauuca

SEQ ID NO: 632711 - RNA, 22 nt, Homo sapiens
caugcauaucauuaaacaaaua

SEQ ID NO: 632712 - RNA, 19 nt, Homo sapiens
caugccacccuguuuucag

SEQ ID NO: 632713 - RNA, 15 nt, Homo sapiens
caugccacugccagg

SEQ ID NO: 632714 - RNA, 19 nt, Homo sapiens
caugcccacaacuugucac

SEQ ID NO: 632715 - RNA, 16 nt, Homo sapiens
caugccccuggaccag

SEQ ID NO: 632716 - RNA, 23 nt, Homo sapiens
caugcccuggauccaucaggcca

SEQ ID NO: 632717 - RNA, 12 nt, Homo sapiens
caugcccugugu

SEQ ID NO: 632718 - RNA, 18 nt, Homo sapiens
caugccgggcgcaguggc

SEQ ID NO: 632719 - RNA, 14 nt, Homo sapiens
caugccucagugaa

SEQ ID NO: 632720 - RNA, 22 nt, Homo sapiens
caugccugccccccucaucuca

SEQ ID NO: 632721 - RNA, 22 nt, Homo sapiens
caugccuguaaucucagcacuu

SEQ ID NO: 632722 - RNA, 20 nt, Homo sapiens
caugcgguagccagcacaca

SEQ ID NO: 632723 - RNA, 16 nt, Homo sapiens
caugcgguuuccaagg

SEQ ID NO: 632724 - RNA, 23 nt, Homo sapiens
caugcuacuuuuuuuuaguucaa

SEQ ID NO: 632725 - RNA, 22 nt, Homo sapiens
caugcuaugcugaagacauuca

SEQ ID NO: 632726 - RNA, 18 nt, Homo sapiens
caugcucaguuggugcug

SEQ ID NO: 632727 - RNA, 11 nt, Homo sapiens
caugcucccuc

SEQ ID NO: 632728 - RNA, 13 nt, Homo sapiens
caugcuccucacc

SEQ ID NO: 632729 - RNA, 14 nt, Homo sapiens
caugcugaaaacca

SEQ ID NO: 632730 - RNA, 19 nt, Homo sapiens
caugcugcccagccacucc

SEQ ID NO: 632731 - RNA, 20 nt, Homo sapiens
caugcugcccagccacucca

SEQ ID NO: 632732 - RNA, 20 nt, Homo sapiens
caugcuggaaccugcaaaaa

SEQ ID NO: 632733 - RNA, 18 nt, Homo sapiens
caugcugggaaugagaca

SEQ ID NO: 632734 - RNA, 14 nt, Homo sapiens
caugcuggugcaua

SEQ ID NO: 632735 - RNA, 14 nt, Homo sapiens
caugcugugcugug

SEQ ID NO: 632736 - RNA, 21 nt, Homo sapiens
caugcugugugcuggagacac

SEQ ID NO: 632737 - RNA, 22 nt, Homo sapiens
caugcuuaauaaacaugucaca

SEQ ID NO: 632738 - RNA, 14 nt, Homo sapiens
caugcuucuucuca

SEQ ID NO: 632739 - RNA, 14 nt, Homo sapiens
caugcuugacauac

SEQ ID NO: 632740 - RNA, 23 nt, Homo sapiens
caugcuuuagauuauauauuccg

SEQ ID NO: 632741 - RNA, 12 nt, Homo sapiens
caugcuuuauua

SEQ ID NO: 632742 - RNA, 21 nt, Homo sapiens
caugcuuugaaguuucuggaa

SEQ ID NO: 632743 - RNA, 14 nt, Homo sapiens
caugcuuuucugcc

SEQ ID NO: 632744 - RNA, 15 nt, Homo sapiens
cauggaaaacaccag

SEQ ID NO: 632745 - RNA, 19 nt, Homo sapiens
cauggaaaacagaguauuu

SEQ ID NO: 632746 - RNA, 21 nt, Homo sapiens
cauggaaauguauuuuaguua

SEQ ID NO: 632747 - RNA, 17 nt, Homo sapiens
cauggaauaguuuugua

SEQ ID NO: 632748 - RNA, 18 nt, Homo sapiens
cauggaauggcagguguc

SEQ ID NO: 632749 - RNA, 19 nt, Homo sapiens
cauggacaccccuuaucca

SEQ ID NO: 632750 - RNA, 21 nt, Homo sapiens
cauggacacuccagugccagc

SEQ ID NO: 632751 - RNA, 21 nt, Homo sapiens
cauggacagauagacagugcu

SEQ ID NO: 632752 - RNA, 17 nt, Homo sapiens
cauggacauguguacau

SEQ ID NO: 632753 - RNA, 20 nt, Homo sapiens
cauggacucuggguuucaua

SEQ ID NO: 632754 - RNA, 14 nt, Homo sapiens
cauggagaacagca

SEQ ID NO: 632755 - RNA, 20 nt, Homo sapiens
cauggagaagccccgucucu

SEQ ID NO: 632756 - RNA, 13 nt, Homo sapiens
cauggagaccuca

SEQ ID NO: 632757 - RNA, 16 nt, Homo sapiens
cauggaggucauacau

SEQ ID NO: 632758 - RNA, 12 nt, Homo sapiens
cauggauacuuc

SEQ ID NO: 632759 - RNA, 13 nt, Homo sapiens
cauggaucugauc

SEQ ID NO: 632760 - RNA, 19 nt, Homo sapiens
cauggauucauuacagcuu

SEQ ID NO: 632761 - RNA, 13 nt, Homo sapiens
cauggcaaauggg

SEQ ID NO: 632762 - RNA, 16 nt, Homo sapiens
cauggcaccaaagcca

SEQ ID NO: 632763 - RNA, 21 nt, Homo sapiens
cauggcagaaggcaaacccau

SEQ ID NO: 632764 - RNA, 15 nt, Homo sapiens
cauggcauugaacug

SEQ ID NO: 632765 - RNA, 14 nt, Homo sapiens
cauggccaccucca

SEQ ID NO: 632766 - RNA, 18 nt, Homo sapiens
cauggccauuucugugga

SEQ ID NO: 632767 - RNA, 21 nt, Homo sapiens
cauggcccccaauaaaggcag

SEQ ID NO: 632768 - RNA, 22 nt, Homo sapiens
cauggcccugggacacccacag

SEQ ID NO: 632769 - RNA, 21 nt, Homo sapiens
cauggcccuucaaauuggaau

SEQ ID NO: 632770 - RNA, 20 nt, Homo sapiens
cauggccuugaaacaguucc

SEQ ID NO: 632771 - RNA, 14 nt, Homo sapiens
cauggcugaacgcg

SEQ ID NO: 632772 - RNA, 21 nt, Homo sapiens
cuuuaaaggauaauuauccaa

SEQ ID NO: 632773 - RNA, 16 nt, Homo sapiens
cuuuaaaggcaucuac

SEQ ID NO: 632774 - RNA, 16 nt, Homo sapiens
cuuuaacagcugauaa

SEQ ID NO: 632775 - RNA, 16 nt, Homo sapiens
cuuuaacagucuaaaa

SEQ ID NO: 632776 - RNA, 19 nt, Homo sapiens
cuuuaacugacaagccauc

SEQ ID NO: 632777 - RNA, 12 nt, Homo sapiens
cuuuaagaaugu

SEQ ID NO: 632778 - RNA, 20 nt, Homo sapiens
cuuuaagccugcauucuuaa

SEQ ID NO: 632779 - RNA, 21 nt, Homo sapiens
cuuuaaguucuucuauuucaa

SEQ ID NO: 632780 - RNA, 18 nt, Homo sapiens
cuuuaauaaagaaguauu

SEQ ID NO: 632781 - RNA, 13 nt, Homo sapiens
cuuuaauucugua

SEQ ID NO: 632782 - RNA, 19 nt, Homo sapiens
cuuuaauucuguaucugua

SEQ ID NO: 632783 - RNA, 15 nt, Homo sapiens
cuuuacaaauauguc

SEQ ID NO: 632784 - RNA, 22 nt, Homo sapiens
cuuuacaacuaaauaacacaga

SEQ ID NO: 632785 - RNA, 14 nt, Homo sapiens
cuuuacaccaacuc

SEQ ID NO: 632786 - RNA, 16 nt, Homo sapiens
cuuuacagacaggaaa

SEQ ID NO: 632787 - RNA, 13 nt, Homo sapiens
cuuuacaguuaca

SEQ ID NO: 632788 - RNA, 15 nt, Homo sapiens
cuuuacauaugcuuu

SEQ ID NO: 632789 - RNA, 12 nt, Homo sapiens
cuuuacauauuc

SEQ ID NO: 632790 - RNA, 18 nt, Homo sapiens
cuuuaccauaaagccuuu

SEQ ID NO: 632791 - RNA, 19 nt, Homo sapiens
cuuuaccccucauccaaag

SEQ ID NO: 632792 - RNA, 18 nt, Homo sapiens
cuuuaccugagaccaguu

SEQ ID NO: 632793 - RNA, 22 nt, Homo sapiens
cuuuaccuucauauguguaaaa

SEQ ID NO: 632794 - RNA, 17 nt, Homo sapiens
cuuuaccuuuucagggc

SEQ ID NO: 632795 - RNA, 15 nt, Homo sapiens
cuuuacguaucugcu

SEQ ID NO: 632796 - RNA, 21 nt, Homo sapiens
cuuuacuaauaaacuguguag

SEQ ID NO: 632797 - RNA, 18 nt, Homo sapiens
cuuuacucaaauugguga

SEQ ID NO: 632798 - RNA, 14 nt, Homo sapiens
cuuuacuccuggcu

SEQ ID NO: 632799 - RNA, 19 nt, Homo sapiens
cuuuacuguuagucauuug

SEQ ID NO: 632800 - RNA, 20 nt, Homo sapiens
cuuuacuucauggacuucca

SEQ ID NO: 632801 - RNA, 17 nt, Homo sapiens
cuuuacuucccaguaua

SEQ ID NO: 632802 - RNA, 21 nt, Homo sapiens
cuuuagagaauaccaguguua

SEQ ID NO: 632803 - RNA, 20 nt, Homo sapiens
cuuuagagccagcccauggc

SEQ ID NO: 632804 - RNA, 23 nt, Homo sapiens
cuuuagaguagcaugagagaauu

SEQ ID NO: 632805 - RNA, 18 nt, Homo sapiens
cuuuagauauacauauca

SEQ ID NO: 632806 - RNA, 14 nt, Homo sapiens
cuuuagaugccaaa

SEQ ID NO: 632807 - RNA, 18 nt, Homo sapiens
cuuuagcaagugugcacu

SEQ ID NO: 632808 - RNA, 13 nt, Homo sapiens
cuuuagcaugcua

SEQ ID NO: 632809 - RNA, 14 nt, Homo sapiens
cuuuagcuaccuca

SEQ ID NO: 632810 - RNA, 18 nt, Homo sapiens
cuuuaggauuuauugcau

SEQ ID NO: 632811 - RNA, 13 nt, Homo sapiens
cuuuaggccaggc

SEQ ID NO: 632812 - RNA, 17 nt, Homo sapiens
cuuuagggcuguugcua

SEQ ID NO: 632813 - RNA, 21 nt, Homo sapiens
cuuuagucaggaauggcugca

SEQ ID NO: 632814 - RNA, 16 nt, Homo sapiens
cuuuagucugcaaaau

SEQ ID NO: 632815 - RNA, 21 nt, Homo sapiens
cuuuauaaaacauguacaaaa

SEQ ID NO: 632816 - RNA, 15 nt, Homo sapiens
cuuuauaaauaucaa

SEQ ID NO: 632817 - RNA, 19 nt, Homo sapiens
cuuuauaaucuacuccuug

SEQ ID NO: 632818 - RNA, 19 nt, Homo sapiens
cuuuauacacaguggauug

SEQ ID NO: 632819 - RNA, 22 nt, Homo sapiens
cuuuauagagugucucagggug

SEQ ID NO: 632820 - RNA, 20 nt, Homo sapiens
cuuuauagguuuauuacaag

SEQ ID NO: 632821 - RNA, 14 nt, Homo sapiens
cuuuaucauaugcu

SEQ ID NO: 632822 - RNA, 17 nt, Homo sapiens
cuuuauccagcaguauu

SEQ ID NO: 632823 - RNA, 11 nt, Homo sapiens
cuuuaucucag

SEQ ID NO: 632824 - RNA, 17 nt, Homo sapiens
cuuuaucuugacauuca

SEQ ID NO: 632825 - RNA, 22 nt, Homo sapiens
cuuuaugcuaguuugaccucau

SEQ ID NO: 632826 - RNA, 13 nt, Homo sapiens
cuuuauguacugc

SEQ ID NO: 632827 - RNA, 13 nt, Homo sapiens
cuuuauguaucuc

SEQ ID NO: 632828 - RNA, 18 nt, Homo sapiens
cuuuauguggaacaucua

SEQ ID NO: 632829 - RNA, 17 nt, Homo sapiens
cuuuauuagcuuucucc

SEQ ID NO: 632830 - RNA, 14 nt, Homo sapiens
cuuuauugcagaau

SEQ ID NO: 632831 - RNA, 16 nt, Homo sapiens
cuuuauuucugaucua

SEQ ID NO: 632832 - RNA, 22 nt, Homo sapiens
cuuuauuuguaaaccauuguaa

SEQ ID NO: 632833 - RNA, 22 nt, Homo sapiens
cuuucaaaagaagaguuuuaga

SEQ ID NO: 632834 - RNA, 15 nt, Homo sapiens
cuuucaaaagggaag

SEQ ID NO: 632835 - RNA, 15 nt, Homo sapiens
cuuucaaccuugcca

SEQ ID NO: 632836 - RNA, 20 nt, Homo sapiens
cuuucaagucugacucucca

SEQ ID NO: 632837 - RNA, 15 nt, Homo sapiens
cuuucacaagcaaca

SEQ ID NO: 632838 - RNA, 17 nt, Homo sapiens
cuuucacauagcacaga

SEQ ID NO: 632839 - RNA, 17 nt, Homo sapiens
cuuucacccucaugaaa

SEQ ID NO: 632840 - RNA, 14 nt, Homo sapiens
cuuucacucuguca

SEQ ID NO: 632841 - RNA, 13 nt, Homo sapiens
cuuucacuuugaa

SEQ ID NO: 632842 - RNA, 15 nt, Homo sapiens
cuuucaggaccuuuu

SEQ ID NO: 632843 - RNA, 16 nt, Homo sapiens
cuuucaggcuaccuuu

SEQ ID NO: 632844 - RNA, 20 nt, Homo sapiens
cuuucauaaacuucagggau

SEQ ID NO: 632845 - RNA, 20 nt, Homo sapiens
cuuucauauucucuuuguga

SEQ ID NO: 632846 - RNA, 20 nt, Homo sapiens
cuuucauccacuagugcaaa

SEQ ID NO: 632847 - RNA, 17 nt, Homo sapiens
cuuucaucccauacuca

SEQ ID NO: 632848 - RNA, 19 nt, Homo sapiens
cuuucaucuuaaacuaaua

SEQ ID NO: 632849 - RNA, 13 nt, Homo sapiens
cuuucaugcucca

SEQ ID NO: 632850 - RNA, 22 nt, Homo sapiens
cuuucauuaggcaaaguacaaa

SEQ ID NO: 632851 - RNA, 20 nt, Homo sapiens
cuuucauucuucucacaucc

SEQ ID NO: 632852 - RNA, 18 nt, Homo sapiens
cuuuccaaauacccaaau

SEQ ID NO: 632853 - RNA, 18 nt, Homo sapiens
cuuuccaggagacauaua

SEQ ID NO: 632854 - RNA, 20 nt, Homo sapiens
cuuucccauuucuaccuaag

SEQ ID NO: 632855 - RNA, 23 nt, Homo sapiens
cuuucccccuucccgccuuccaa

SEQ ID NO: 632856 - RNA, 19 nt, Homo sapiens
cuuucccuagaaagccaua

SEQ ID NO: 632857 - RNA, 13 nt, Homo sapiens
cuuucccuuccag

SEQ ID NO: 632858 - RNA, 18 nt, Homo sapiens
cuuucccuucuuggugcu

SEQ ID NO: 632859 - RNA, 15 nt, Homo sapiens
cuuucccuuuaucag

SEQ ID NO: 632860 - RNA, 19 nt, Homo sapiens
cuuucccuuuaucaguuug

SEQ ID NO: 632861 - RNA, 20 nt, Homo sapiens
cuuuccgacacauuuaccaa

SEQ ID NO: 632862 - RNA, 23 nt, Homo sapiens
cuuuccgacacauuuaccaaauu

SEQ ID NO: 632863 - RNA, 21 nt, Homo sapiens
cuuuccugucugcacaaguga

SEQ ID NO: 632864 - RNA, 14 nt, Homo sapiens
cuuuccuugcucaa

SEQ ID NO: 632865 - RNA, 21 nt, Homo sapiens
cuuuccuuguuagaaugcaag

SEQ ID NO: 632866 - RNA, 22 nt, Homo sapiens
cuuuccuuuacuccuggcucaa

SEQ ID NO: 632867 - RNA, 23 nt, Homo sapiens
cuuucguagccuaaaagacaauu

SEQ ID NO: 632868 - RNA, 18 nt, Homo sapiens
cuuucuaaaggaaaucaa

SEQ ID NO: 632869 - RNA, 22 nt, Homo sapiens
cuuucuaaaggaaaucaaauga

SEQ ID NO: 632870 - RNA, 15 nt, Homo sapiens
cuuucuagccuuaga

SEQ ID NO: 632871 - RNA, 17 nt, Homo sapiens
cuuucuagccuuagaca

SEQ ID NO: 632872 - RNA, 23 nt, Homo sapiens
cuuucuaggagggagacacuggc

SEQ ID NO: 632873 - RNA, 21 nt, Homo sapiens
cuuucuaucuuauauacuuau

SEQ ID NO: 632874 - RNA, 17 nt, Homo sapiens
cuuucuauuuaugcaac

SEQ ID NO: 632875 - RNA, 21 nt, Homo sapiens
cuuucucaaagagggggcucu

SEQ ID NO: 632876 - RNA, 13 nt, Homo sapiens
cuuucuccacaga

SEQ ID NO: 632877 - RNA, 15 nt, Homo sapiens
cuuucuccagaucag

SEQ ID NO: 632878 - RNA, 17 nt, Homo sapiens
cuuucuccaggaccaau

SEQ ID NO: 632879 - RNA, 19 nt, Homo sapiens
cuuucuccaggaccaauaa

SEQ ID NO: 632880 - RNA, 20 nt, Homo sapiens
cuuucuccauuguaaaccac

SEQ ID NO: 632881 - RNA, 12 nt, Homo sapiens
cuuucuccucag

SEQ ID NO: 632882 - RNA, 16 nt, Homo sapiens
cuuucuccugugccca

SEQ ID NO: 632883 - RNA, 21 nt, Homo sapiens
cuuucucgugguagaagccag

SEQ ID NO: 632884 - RNA, 23 nt, Homo sapiens
cuuucucgugguagaagccagua

SEQ ID NO: 632885 - RNA, 13 nt, Homo sapiens
cuuucucuacuga

SEQ ID NO: 632886 - RNA, 15 nt, Homo sapiens
cuuucugaauugcac

SEQ ID NO: 632887 - RNA, 23 nt, Homo sapiens
cuuucugaggagcuguuacugaa

SEQ ID NO: 632888 - RNA, 23 nt, Homo sapiens
cuuucugaggcccugagcauucu

SEQ ID NO: 632889 - RNA, 20 nt, Homo sapiens
cuuucugaugacgccugucu

SEQ ID NO: 632890 - RNA, 20 nt, Homo sapiens
cuuucugauucacagucuca

SEQ ID NO: 632891 - RNA, 12 nt, Homo sapiens
cuuucugcuaaa

SEQ ID NO: 632892 - RNA, 16 nt, Homo sapiens
cuuucuggccuguuau

SEQ ID NO: 632893 - RNA, 22 nt, Homo sapiens
cuuucugggaugucacagucca

SEQ ID NO: 632894 - RNA, 21 nt, Homo sapiens
cauggcugaaggaaaccagug

SEQ ID NO: 632895 - RNA, 23 nt, Homo sapiens
cauggcugauugcagccuugacc

SEQ ID NO: 632896 - RNA, 20 nt, Homo sapiens
caugggacuaaaugaacuaa

SEQ ID NO: 632897 - RNA, 18 nt, Homo sapiens
caugggcaccaaccugca

SEQ ID NO: 632898 - RNA, 20 nt, Homo sapiens
caugggcuaaugaagaucau

SEQ ID NO: 632899 - RNA, 17 nt, Homo sapiens
caugggcugggggccag

SEQ ID NO: 632900 - RNA, 17 nt, Homo sapiens
caugggggugaccccac

SEQ ID NO: 632901 - RNA, 18 nt, Homo sapiens
cauggguccuugaugcca

SEQ ID NO: 632902 - RNA, 23 nt, Homo sapiens
caugggugcagacccugaaccca

SEQ ID NO: 632903 - RNA, 17 nt, Homo sapiens
cauggguggaaagugcu

SEQ ID NO: 632904 - RNA, 16 nt, Homo sapiens
cauggguuuaccacua

SEQ ID NO: 632905 - RNA, 12 nt, Homo sapiens
caugguacaaac

SEQ ID NO: 632906 - RNA, 18 nt, Homo sapiens
cauggugaaaauguacug

SEQ ID NO: 632907 - RNA, 23 nt, Homo sapiens
cauggugcagugccgcucuguag

SEQ ID NO: 632908 - RNA, 22 nt, Homo sapiens
caugguggcucacgccuguaau

SEQ ID NO: 632909 - RNA, 23 nt, Homo sapiens
caugguggugauguccaaaagau

SEQ ID NO: 632910 - RNA, 22 nt, Homo sapiens
caugguuauugaugaguuucuu

SEQ ID NO: 632911 - RNA, 16 nt, Homo sapiens
cauguaaaugcucauu

SEQ ID NO: 632912 - RNA, 15 nt, Homo sapiens
cauguaaauugcaaa

SEQ ID NO: 632913 - RNA, 17 nt, Homo sapiens
cauguaacuauguauca

SEQ ID NO: 632914 - RNA, 18 nt, Homo sapiens
cauguaaggcuuaacaca

SEQ ID NO: 632915 - RNA, 11 nt, Homo sapiens
cauguacaaaa

SEQ ID NO: 632916 - RNA, 20 nt, Homo sapiens
cauguacagacauacauuua

SEQ ID NO: 632917 - RNA, 13 nt, Homo sapiens
cauguacuugaag

SEQ ID NO: 632918 - RNA, 17 nt, Homo sapiens
cauguaguaguacuuga

SEQ ID NO: 632919 - RNA, 20 nt, Homo sapiens
cauguaucucaguaccccau

SEQ ID NO: 632920 - RNA, 18 nt, Homo sapiens
cauguaugcaaaccucau

SEQ ID NO: 632921 - RNA, 18 nt, Homo sapiens
cauguauguauauaauca

SEQ ID NO: 632922 - RNA, 23 nt, Homo sapiens
caugucaacuucuggcuccucaa

SEQ ID NO: 632923 - RNA, 23 nt, Homo sapiens
caugucaccucagcugauauuau

SEQ ID NO: 632924 - RNA, 15 nt, Homo sapiens
caugucagacuguac

SEQ ID NO: 632925 - RNA, 14 nt, Homo sapiens
caugucagcaaaaa

SEQ ID NO: 632926 - RNA, 11 nt, Homo sapiens
caugucaggcc

SEQ ID NO: 632927 - RNA, 15 nt, Homo sapiens
cauguccaaguccaa

SEQ ID NO: 632928 - RNA, 15 nt, Homo sapiens
cauguccuaauucuu

SEQ ID NO: 632929 - RNA, 16 nt, Homo sapiens
caugucuauucagcuu

SEQ ID NO: 632930 - RNA, 20 nt, Homo sapiens
caugucucugguggugcugg

SEQ ID NO: 632931 - RNA, 14 nt, Homo sapiens
caugucuugugcau

SEQ ID NO: 632932 - RNA, 13 nt, Homo sapiens
caugugaacaucc

SEQ ID NO: 632933 - RNA, 17 nt, Homo sapiens
caugugcaaaugugcug

SEQ ID NO: 632934 - RNA, 22 nt, Homo sapiens
caugugcaaaugugcuggucac

SEQ ID NO: 632935 - RNA, 21 nt, Homo sapiens
caugugccaagauucuacucu

SEQ ID NO: 632936 - RNA, 18 nt, Homo sapiens
caugugccuuuaguccac

SEQ ID NO: 632937 - RNA, 19 nt, Homo sapiens
caugugcgcgcgugcaugu

SEQ ID NO: 632938 - RNA, 21 nt, Homo sapiens
caugugcggcugaacugagaa

SEQ ID NO: 632939 - RNA, 18 nt, Homo sapiens
caugugcuggacacuguc

SEQ ID NO: 632940 - RNA, 22 nt, Homo sapiens
cauguggcccuccaguguauga

SEQ ID NO: 632941 - RNA, 18 nt, Homo sapiens
cauguggccuuuaucuca

SEQ ID NO: 632942 - RNA, 14 nt, Homo sapiens
caugugggcacgga

SEQ ID NO: 632943 - RNA, 14 nt, Homo sapiens
caugugguacuuga

SEQ ID NO: 632944 - RNA, 19 nt, Homo sapiens
caugugguuucuaugcaaa

SEQ ID NO: 632945 - RNA, 18 nt, Homo sapiens
cauguguaauaugcacaa

SEQ ID NO: 632946 - RNA, 14 nt, Homo sapiens
cauguguauguguc

SEQ ID NO: 632947 - RNA, 21 nt, Homo sapiens
cauguguaugugucugcuaau

SEQ ID NO: 632948 - RNA, 23 nt, Homo sapiens
cauguguccccucacucugucag

SEQ ID NO: 632949 - RNA, 20 nt, Homo sapiens
caugugugcgagugugugca

SEQ ID NO: 632950 - RNA, 17 nt, Homo sapiens
caugugugcgugugcgu

SEQ ID NO: 632951 - RNA, 20 nt, Homo sapiens
caugugugcgugugcgugca

SEQ ID NO: 632952 - RNA, 12 nt, Homo sapiens
caugugugugca

SEQ ID NO: 632953 - RNA, 17 nt, Homo sapiens
cauguuacugaccagca

SEQ ID NO: 632954 - RNA, 18 nt, Homo sapiens
cauguuacugaccagcaa

SEQ ID NO: 632955 - RNA, 22 nt, Homo sapiens
cauguuacuuuauucagagcua

SEQ ID NO: 632956 - RNA, 14 nt, Homo sapiens
cauguuagccuuag

SEQ ID NO: 632957 - RNA, 22 nt, Homo sapiens
cauguuauuaaacguaugcaug

SEQ ID NO: 632958 - RNA, 16 nt, Homo sapiens
cauguuauucucucac

SEQ ID NO: 632959 - RNA, 14 nt, Homo sapiens
cauguucacuguga

SEQ ID NO: 632960 - RNA, 13 nt, Homo sapiens
cauguucaugggu

SEQ ID NO: 632961 - RNA, 19 nt, Homo sapiens
cauguucauugcaaacaga

SEQ ID NO: 632962 - RNA, 13 nt, Homo sapiens
cauguucuuguca

SEQ ID NO: 632963 - RNA, 22 nt, Homo sapiens
cauguuggucaggcuggucuca

SEQ ID NO: 632964 - RNA, 21 nt, Homo sapiens
cauguugguuuauuuucacag

SEQ ID NO: 632965 - RNA, 19 nt, Homo sapiens
cauguugucaauacguaua

SEQ ID NO: 632966 - RNA, 15 nt, Homo sapiens
cauguuucacuccug

SEQ ID NO: 632967 - RNA, 21 nt, Homo sapiens
cauguuuuccgugaaaacgga

SEQ ID NO: 632968 - RNA, 19 nt, Homo sapiens
cauguuuugauuuguagca

SEQ ID NO: 632969 - RNA, 18 nt, Homo sapiens
cauguuuuguauguuaaa

SEQ ID NO: 632970 - RNA, 17 nt, Homo sapiens
cauuaaaaaaauuccau

SEQ ID NO: 632971 - RNA, 21 nt, Homo sapiens
cauuaaaagcauuguccaaaa

SEQ ID NO: 632972 - RNA, 22 nt, Homo sapiens
cauuaaaauauagagacaggac

SEQ ID NO: 632973 - RNA, 15 nt, Homo sapiens
cauuaaacaugacau

SEQ ID NO: 632974 - RNA, 21 nt, Homo sapiens
cauuaaaccugucuccacugu

SEQ ID NO: 632975 - RNA, 21 nt, Homo sapiens
cauuaaacucuaaagauuagg

SEQ ID NO: 632976 - RNA, 14 nt, Homo sapiens
cauuaaacuugaag

SEQ ID NO: 632977 - RNA, 19 nt, Homo sapiens
cauuaaaucaaucaggaau

SEQ ID NO: 632978 - RNA, 18 nt, Homo sapiens
cauuaaaucuugaacuuu

SEQ ID NO: 632979 - RNA, 21 nt, Homo sapiens
cauuaaauggaauaauaugau

SEQ ID NO: 632980 - RNA, 18 nt, Homo sapiens
cauuaaauucacaaacuu

SEQ ID NO: 632981 - RNA, 20 nt, Homo sapiens
cauuaacugcacaaacaaua

SEQ ID NO: 632982 - RNA, 13 nt, Homo sapiens
cauuaacuucucu

SEQ ID NO: 632983 - RNA, 13 nt, Homo sapiens
ccaagcauuucau

SEQ ID NO: 632984 - RNA, 15 nt, Homo sapiens
ccaagcgaccaagga

SEQ ID NO: 632985 - RNA, 22 nt, Homo sapiens
ccaagcuaggcuuaaaccugga

SEQ ID NO: 632986 - RNA, 16 nt, Homo sapiens
ccaagcuccaaaucca

SEQ ID NO: 632987 - RNA, 21 nt, Homo sapiens
ccaagcugccucugggccaug

SEQ ID NO: 632988 - RNA, 14 nt, Homo sapiens
ccaagcuucugagu

SEQ ID NO: 632989 - RNA, 21 nt, Homo sapiens
ccaagcuuucagacaagaaug

SEQ ID NO: 632990 - RNA, 20 nt, Homo sapiens
ccaaggaauuucugcucugg

SEQ ID NO: 632991 - RNA, 19 nt, Homo sapiens
ccaaggaggggcuguaaaa

SEQ ID NO: 632992 - RNA, 21 nt, Homo sapiens
ccaaggagggugagugcaagg

SEQ ID NO: 632993 - RNA, 18 nt, Homo sapiens
ccaaggagucacugagac

SEQ ID NO: 632994 - RNA, 22 nt, Homo sapiens
ccaaggauccucuccacuccau

SEQ ID NO: 632995 - RNA, 19 nt, Homo sapiens
ccaaggaugaccacacccg

SEQ ID NO: 632996 - RNA, 10 nt, Homo sapiens
ccaaggcaaa

SEQ ID NO: 632997 - RNA, 16 nt, Homo sapiens
ccaaggcucugagcaa

SEQ ID NO: 632998 - RNA, 22 nt, Homo sapiens
ccaaggcugagacagugaauuu

SEQ ID NO: 632999 - RNA, 20 nt, Homo sapiens
ccaagggacccuuugccuuu

SEQ ID NO: 633000 - RNA, 16 nt, Homo sapiens
ccaaggggcagucuug

SEQ ID NO: 633001 - RNA, 19 nt, Homo sapiens
ccaagggggugacuggaag

SEQ ID NO: 633002 - RNA, 18 nt, Homo sapiens
ccaaggggguggacgcaa

SEQ ID NO: 633003 - RNA, 20 nt, Homo sapiens
ccaagggguuaaugaaacaa

SEQ ID NO: 633004 - RNA, 18 nt, Homo sapiens
ccaaggguacuaaggaau

SEQ ID NO: 633005 - RNA, 21 nt, Homo sapiens
ccaaggguaugggaagccaua

SEQ ID NO: 633006 - RNA, 18 nt, Homo sapiens
ccaaggguuucgacuggu

SEQ ID NO: 633007 - RNA, 14 nt, Homo sapiens
ccaagguaggcaga

SEQ ID NO: 633008 - RNA, 14 nt, Homo sapiens
ccaagguauuuuua

SEQ ID NO: 633009 - RNA, 12 nt, Homo sapiens
ccaaggugguga

SEQ ID NO: 633010 - RNA, 20 nt, Homo sapiens
ccaagguggugaaaucccau

SEQ ID NO: 633011 - RNA, 19 nt, Homo sapiens
ccaaguagcugggauuaca

SEQ ID NO: 633012 - RNA, 17 nt, Homo sapiens
ccaaguccagauuuaca

SEQ ID NO: 633013 - RNA, 14 nt, Homo sapiens
ccaaguccucauuu

SEQ ID NO: 633014 - RNA, 21 nt, Homo sapiens
ccaagugaacacuagccagac

SEQ ID NO: 633015 - RNA, 22 nt, Homo sapiens
ccaagugauccuuccaccucag

SEQ ID NO: 633016 - RNA, 16 nt, Homo sapiens
ccaagugccagucuug

SEQ ID NO: 633017 - RNA, 13 nt, Homo sapiens
ccaagugccugcu

SEQ ID NO: 633018 - RNA, 17 nt, Homo sapiens
ccaagugcugcacaaaa

SEQ ID NO: 633019 - RNA, 17 nt, Homo sapiens
ccaagugugugugcgug

SEQ ID NO: 633020 - RNA, 24 nt, Homo sapiens
ccaaguuccacuuuucugcaggua

SEQ ID NO: 633021 - RNA, 13 nt, Homo sapiens
ccaaguuccguca

SEQ ID NO: 633022 - RNA, 21 nt, Homo sapiens
ccaaguucuuaguugcuguau

SEQ ID NO: 633023 - RNA, 17 nt, Homo sapiens
ccaaguugcagugagca

SEQ ID NO: 633024 - RNA, 14 nt, Homo sapiens
ccaaguuuauauac

SEQ ID NO: 633025 - RNA, 14 nt, Homo sapiens
gaaggccuuuucac

SEQ ID NO: 633026 - RNA, 18 nt, Homo sapiens
gaaggcgcugggugccug

SEQ ID NO: 633027 - RNA, 19 nt, Homo sapiens
gaaggcgcugggugccugc

SEQ ID NO: 633028 - RNA, 17 nt, Homo sapiens
gaaggcuacauauacau

SEQ ID NO: 633029 - RNA, 14 nt, Homo sapiens
gaagggaagugcau

SEQ ID NO: 633030 - RNA, 20 nt, Homo sapiens
gaagggaauuaaaaagaaga

SEQ ID NO: 633031 - RNA, 24 nt, Homo sapiens
gaagggaccaaggcaaggcaggug

SEQ ID NO: 633032 - RNA, 19 nt, Homo sapiens
gaagggcucuuucucucug

SEQ ID NO: 633033 - RNA, 18 nt, Homo sapiens
gaagggcuggaaacaagu

SEQ ID NO: 633034 - RNA, 14 nt, Homo sapiens
gaaggggccaugac

SEQ ID NO: 633035 - RNA, 14 nt, Homo sapiens
gaagggguccugca

SEQ ID NO: 633036 - RNA, 13 nt, Homo sapiens
gaaggggugcccc

SEQ ID NO: 633037 - RNA, 13 nt, Homo sapiens
gaagggguggcug

SEQ ID NO: 633038 - RNA, 23 nt, Homo sapiens
gaaggguaccuugaacacugggg

SEQ ID NO: 633039 - RNA, 18 nt, Homo sapiens
gaagggucggagucugua

SEQ ID NO: 633040 - RNA, 19 nt, Homo sapiens
gaagggucggagucuguaa

SEQ ID NO: 633041 - RNA, 19 nt, Homo sapiens
gaagggugccgcgagccag

SEQ ID NO: 633042 - RNA, 22 nt, Homo sapiens
gaagguauuccuuuuguguaca

SEQ ID NO: 633043 - RNA, 17 nt, Homo sapiens
gaaggucuauuggccaa

SEQ ID NO: 633044 - RNA, 20 nt, Homo sapiens
gaaggugaggggauggagua

SEQ ID NO: 633045 - RNA, 24 nt, Homo sapiens
gaaggugccacuccagugcccauc

SEQ ID NO: 633046 - RNA, 20 nt, Homo sapiens
gaaggugccuggccauguca

SEQ ID NO: 633047 - RNA, 21 nt, Homo sapiens
gaaggugucucuggucuucca

SEQ ID NO: 633048 - RNA, 14 nt, Homo sapiens
gaagguuaccaaga

SEQ ID NO: 633049 - RNA, 22 nt, Homo sapiens
gaagguuggcgggggcacgugu

SEQ ID NO: 633050 - RNA, 18 nt, Homo sapiens
gaagguuggcgugcccug

SEQ ID NO: 633051 - RNA, 14 nt, Homo sapiens
gaaguaaaagcaaa

SEQ ID NO: 633052 - RNA, 23 nt, Homo sapiens
gaaguaacaaaagaagugacauc

SEQ ID NO: 633053 - RNA, 15 nt, Homo sapiens
gaaguaacauuugcc

SEQ ID NO: 633054 - RNA, 16 nt, Homo sapiens
gaaguaacauuugccu

SEQ ID NO: 633055 - RNA, 14 nt, Homo sapiens
gaaguaagccucau

SEQ ID NO: 633056 - RNA, 21 nt, Homo sapiens
gaaguacaaagguugcagugc

SEQ ID NO: 633057 - RNA, 22 nt, Homo sapiens
gaaguacugcacccagcagugu

SEQ ID NO: 633058 - RNA, 19 nt, Homo sapiens
gaaguacuuaaacuuccac

SEQ ID NO: 633059 - RNA, 23 nt, Homo sapiens
gaaguagguauaagaaguccuau

SEQ ID NO: 633060 - RNA, 20 nt, Homo sapiens
gaaguagguggcuugagcua

SEQ ID NO: 633061 - RNA, 17 nt, Homo sapiens
gaaguaggugugacuug

SEQ ID NO: 633062 - RNA, 22 nt, Homo sapiens
gaaguaguucuguuuggugugu

SEQ ID NO: 633063 - RNA, 16 nt, Homo sapiens
gaaguauuucugugga

SEQ ID NO: 633064 - RNA, 20 nt, Homo sapiens
gaaguauuuuccuccaggca

SEQ ID NO: 633065 - RNA, 21 nt, Homo sapiens
gaaguauuuuccuccaggcaa

SEQ ID NO: 633066 - RNA, 22 nt, Homo sapiens
gaaguauuuuccuccaggcaaa

SEQ ID NO: 633067 - RNA, 22 nt, Homo sapiens
gaagucaugggaacgcagccuc

SEQ ID NO: 633068 - RNA, 15 nt, Homo sapiens
gaaguccuccagaca

SEQ ID NO: 633069 - RNA, 22 nt, Homo sapiens
gaagucgggcaugguggcucau

SEQ ID NO: 633070 - RNA, 18 nt, Homo sapiens
gaagucuggcuuugcucu

SEQ ID NO: 633071 - RNA, 21 nt, Homo sapiens
gaagucuucuccuccaugaac

SEQ ID NO: 633072 - RNA, 14 nt, Homo sapiens
gaagucuugcaguu

SEQ ID NO: 633073 - RNA, 22 nt, Homo sapiens
gaagucuuuucugucaccaaau

SEQ ID NO: 633074 - RNA, 11 nt, Homo sapiens
gaagugaaaac

SEQ ID NO: 633075 - RNA, 17 nt, Homo sapiens
gaagugaaaacuuugua

SEQ ID NO: 633076 - RNA, 21 nt, Homo sapiens
gaagugagcaaggugcucuug

SEQ ID NO: 633077 - RNA, 17 nt, Homo sapiens
gaagugcagcagguuaa

SEQ ID NO: 633078 - RNA, 22 nt, Homo sapiens
gaagugcgugguauaaucucca

SEQ ID NO: 633079 - RNA, 11 nt, Homo sapiens
gaagugcuugc

SEQ ID NO: 633080 - RNA, 17 nt, Homo sapiens
gaaguggagauuuacac

SEQ ID NO: 633081 - RNA, 17 nt, Homo sapiens
gaaguggauuuaacuaa

SEQ ID NO: 633082 - RNA, 17 nt, Homo sapiens
gaagugguugcauucua

SEQ ID NO: 633083 - RNA, 11 nt, Homo sapiens
gaaguguaauu

SEQ ID NO: 633084 - RNA, 20 nt, Homo sapiens
gaaguguguccauccugacc

SEQ ID NO: 633085 - RNA, 19 nt, Homo sapiens
gaaguguucugagcuguau

SEQ ID NO: 633086 - RNA, 21 nt, Homo sapiens
gaaguguugagccaugcuaca

SEQ ID NO: 633087 - RNA, 12 nt, Homo sapiens
gaaguuacuuuu

SEQ ID NO: 633088 - RNA, 14 nt, Homo sapiens
gaaguuacuuuuug

SEQ ID NO: 633089 - RNA, 14 nt, Homo sapiens
gaaguuauuuucca

SEQ ID NO: 633090 - RNA, 13 nt, Homo sapiens
gaaguucagugau

SEQ ID NO: 633091 - RNA, 16 nt, Homo sapiens
gaaguuccaguguucu

SEQ ID NO: 633092 - RNA, 20 nt, Homo sapiens
gaaguugcaccauugcacuc

SEQ ID NO: 633093 - RNA, 17 nt, Homo sapiens
gaaguugcugcugugaa

SEQ ID NO: 633094 - RNA, 18 nt, Homo sapiens
gaaguugcugcugugaau

SEQ ID NO: 633095 - RNA, 20 nt, Homo sapiens
gaaguugcugcugugaaucu

SEQ ID NO: 633096 - RNA, 17 nt, Homo sapiens
gaaguuggcacauuuca

SEQ ID NO: 633097 - RNA, 19 nt, Homo sapiens
gaaguuggccaccuugcuu

SEQ ID NO: 633098 - RNA, 19 nt, Homo sapiens
gaaguuuauucucauuugg

SEQ ID NO: 633099 - RNA, 13 nt, Homo sapiens
gaaguuugcuauu

SEQ ID NO: 633100 - RNA, 13 nt, Homo sapiens
gaaguuuggcaau

SEQ ID NO: 633101 - RNA, 16 nt, Homo sapiens
gaaguuuuuucuacca

SEQ ID NO: 633102 - RNA, 13 nt, Homo sapiens
gaauaaaaccauc

SEQ ID NO: 633103 - RNA, 17 nt, Homo sapiens
gaauaaaagaugauuuc

SEQ ID NO: 633104 - RNA, 14 nt, Homo sapiens
ccacagacucuuac

SEQ ID NO: 633105 - RNA, 21 nt, Homo sapiens
ccacagagagggagagcagag

SEQ ID NO: 633106 - RNA, 14 nt, Homo sapiens
ccacagagaugcau

SEQ ID NO: 633107 - RNA, 19 nt, Homo sapiens
ccacagagugagccaguga

SEQ ID NO: 633108 - RNA, 15 nt, Homo sapiens
ccacagagugcugga

SEQ ID NO: 633109 - RNA, 14 nt, Homo sapiens
ccacagauuaucaa

SEQ ID NO: 633110 - RNA, 12 nt, Homo sapiens
ccacagccaugg

SEQ ID NO: 633111 - RNA, 21 nt, Homo sapiens
ccacagcgagggcagcugcua

SEQ ID NO: 633112 - RNA, 12 nt, Homo sapiens
ccacagcugcag

SEQ ID NO: 633113 - RNA, 15 nt, Homo sapiens
ccacagcugugcaug

SEQ ID NO: 633114 - RNA, 19 nt, Homo sapiens
ccacaggcaaaacucagua

SEQ ID NO: 633115 - RNA, 14 nt, Homo sapiens
ccacaggcagucca

SEQ ID NO: 633116 - RNA, 23 nt, Homo sapiens
ccacaggccgcccugcgggugaa

SEQ ID NO: 633117 - RNA, 23 nt, Homo sapiens
ccacagggcgagacuccgucuca

SEQ ID NO: 633118 - RNA, 20 nt, Homo sapiens
ccacagggcuuguuuuccaa

SEQ ID NO: 633119 - RNA, 17 nt, Homo sapiens
ccacaggucaucagaug

SEQ ID NO: 633120 - RNA, 23 nt, Homo sapiens
ccacaggugcgggaccaucugau

SEQ ID NO: 633121 - RNA, 14 nt, Homo sapiens
ccacaguugagagg

SEQ ID NO: 633122 - RNA, 23 nt, Homo sapiens
ccacauaggaaaaugccaugaaa

SEQ ID NO: 633123 - RNA, 16 nt, Homo sapiens
ccacaucuaaugucuc

SEQ ID NO: 633124 - RNA, 24 nt, Homo sapiens
ccacaugacuuauuaugcauaaag

SEQ ID NO: 633125 - RNA, 17 nt, Homo sapiens
ccacauguacagacaua

SEQ ID NO: 633126 - RNA, 12 nt, Homo sapiens
ccacauguuuca

SEQ ID NO: 633127 - RNA, 23 nt, Homo sapiens
ccacauuaucaguugacagugua

SEQ ID NO: 633128 - RNA, 15 nt, Homo sapiens
ccacauucuacuuca

SEQ ID NO: 633129 - RNA, 22 nt, Homo sapiens
ccacauugcuuuucacauccau

SEQ ID NO: 633130 - RNA, 16 nt, Homo sapiens
ccacauuuagaacuuu

SEQ ID NO: 633131 - RNA, 18 nt, Homo sapiens
ccacauuugguucuaaga

SEQ ID NO: 633132 - RNA, 16 nt, Homo sapiens
ccaccaaaugugcuuu

SEQ ID NO: 633133 - RNA, 19 nt, Homo sapiens
ccaccaaaugugcuuugag

SEQ ID NO: 633134 - RNA, 17 nt, Homo sapiens
ccaccaagaagcacugg

SEQ ID NO: 633135 - RNA, 20 nt, Homo sapiens
ccaccaaugggccuccagag

SEQ ID NO: 633136 - RNA, 13 nt, Homo sapiens
ccaccacauuuag

SEQ ID NO: 633137 - RNA, 18 nt, Homo sapiens
ccaccaccaucaccagac

SEQ ID NO: 633138 - RNA, 13 nt, Homo sapiens
ccaccaccugucc

SEQ ID NO: 633139 - RNA, 18 nt, Homo sapiens
ccaccacgcaugcucagu

SEQ ID NO: 633140 - RNA, 21 nt, Homo sapiens
ccaccacucaggccacagugg

SEQ ID NO: 633141 - RNA, 20 nt, Homo sapiens
ccaccagcauccacacugcc

SEQ ID NO: 633142 - RNA, 19 nt, Homo sapiens
ccaccaggccucacuggcu

SEQ ID NO: 633143 - RNA, 15 nt, Homo sapiens
ccaccaucaccagac

SEQ ID NO: 633144 - RNA, 16 nt, Homo sapiens
ccaccauccuauugca

SEQ ID NO: 633145 - RNA, 14 nt, Homo sapiens
ccaccaugcacugu

SEQ ID NO: 633146 - RNA, 13 nt, Homo sapiens
ccacccaaaacac

SEQ ID NO: 633147 - RNA, 10 nt, Homo sapiens
ccacccaaac

SEQ ID NO: 633148 - RNA, 19 nt, Homo sapiens
ccacccaagcuuggcagcc

SEQ ID NO: 633149 - RNA, 18 nt, Homo sapiens
gaauauuuguauacacau

SEQ ID NO: 633150 - RNA, 20 nt, Homo sapiens
gaauauuuguuuuaauacca

SEQ ID NO: 633151 - RNA, 20 nt, Homo sapiens
gaauauuuuaagaauuucac

SEQ ID NO: 633152 - RNA, 18 nt, Homo sapiens
gaaucaaaucucuuccac

SEQ ID NO: 633153 - RNA, 16 nt, Homo sapiens
gaaucaaaugcaauuu

SEQ ID NO: 633154 - RNA, 18 nt, Homo sapiens
gaaucaaauuuugccaga

SEQ ID NO: 633155 - RNA, 17 nt, Homo sapiens
gaaucaagcacacugua

SEQ ID NO: 633156 - RNA, 14 nt, Homo sapiens
gaaucacaaaccaa

SEQ ID NO: 633157 - RNA, 14 nt, Homo sapiens
gaaucacacagaca

SEQ ID NO: 633158 - RNA, 18 nt, Homo sapiens
gaaucacuagguaacuua

SEQ ID NO: 633159 - RNA, 12 nt, Homo sapiens
gaaucacuggaa

SEQ ID NO: 633160 - RNA, 15 nt, Homo sapiens
gaaucacuugcacuc

SEQ ID NO: 633161 - RNA, 18 nt, Homo sapiens
gaaucagacuucacacug

SEQ ID NO: 633162 - RNA, 14 nt, Homo sapiens
gaaucagcaugaaa

SEQ ID NO: 633163 - RNA, 15 nt, Homo sapiens
gaaucagguuuccaa

SEQ ID NO: 633164 - RNA, 21 nt, Homo sapiens
gaaucagugaagccaaaggga

SEQ ID NO: 633165 - RNA, 21 nt, Homo sapiens
gaaucauacugccuacuguua

SEQ ID NO: 633166 - RNA, 21 nt, Homo sapiens
gaaucaugagccugcuggaag

SEQ ID NO: 633167 - RNA, 18 nt, Homo sapiens
gaaucauuaauacaaaga

SEQ ID NO: 633168 - RNA, 20 nt, Homo sapiens
gaaucauugcuuaugacaug

SEQ ID NO: 633169 - RNA, 19 nt, Homo sapiens
gaaucauuguuaaccacag

SEQ ID NO: 633170 - RNA, 15 nt, Homo sapiens
gaauccaaaagacaa

SEQ ID NO: 633171 - RNA, 13 nt, Homo sapiens
gaauccacagcuc

SEQ ID NO: 633172 - RNA, 21 nt, Homo sapiens
gaauccagaccaaccuuccau

SEQ ID NO: 633173 - RNA, 19 nt, Homo sapiens
gaauccauaaauguguucc

SEQ ID NO: 633174 - RNA, 16 nt, Homo sapiens
gaaucccuuaaacuca

SEQ ID NO: 633175 - RNA, 22 nt, Homo sapiens
gaaucccuuugcaccugagacc

SEQ ID NO: 633176 - RNA, 14 nt, Homo sapiens
gaauccucagagag

SEQ ID NO: 633177 - RNA, 16 nt, Homo sapiens
gaauccuggcagccca

SEQ ID NO: 633178 - RNA, 18 nt, Homo sapiens
gaauccugguaauuaaaa

SEQ ID NO: 633179 - RNA, 21 nt, Homo sapiens
gaauccuuggggagcacuugu

SEQ ID NO: 633180 - RNA, 23 nt, Homo sapiens
gaauccuuuggugccaacuggug

SEQ ID NO: 633181 - RNA, 17 nt, Homo sapiens
gaaucgccccagacucc

SEQ ID NO: 633182 - RNA, 18 nt, Homo sapiens
gaaucgcuugaacccagg

SEQ ID NO: 633183 - RNA, 17 nt, Homo sapiens
gaaucuacuaauuccac

SEQ ID NO: 633184 - RNA, 21 nt, Homo sapiens
gaaucuauccauugaacuaaa

SEQ ID NO: 633185 - RNA, 15 nt, Homo sapiens
gaaucucucuacuca

SEQ ID NO: 633186 - RNA, 17 nt, Homo sapiens
gaaucucucuacucaga

SEQ ID NO: 633187 - RNA, 17 nt, Homo sapiens
gaaucucuucacuaccc

SEQ ID NO: 633188 - RNA, 14 nt, Homo sapiens
gaaucuggagacca

SEQ ID NO: 633189 - RNA, 17 nt, Homo sapiens
gaaucugugcuggccau

SEQ ID NO: 633190 - RNA, 21 nt, Homo sapiens
gaaucugugugaaacuuucau

SEQ ID NO: 633191 - RNA, 17 nt, Homo sapiens
gaaucuuaaugcuugua

SEQ ID NO: 633192 - RNA, 20 nt, Homo sapiens
gaaucuucaagaccaaagca

SEQ ID NO: 633193 - RNA, 14 nt, Homo sapiens
gaaucuucaccuca

SEQ ID NO: 633194 - RNA, 23 nt, Homo sapiens
gaaucuucaccucagaguggagu

SEQ ID NO: 633195 - RNA, 20 nt, Homo sapiens
gaaucuuccaucugcaucuu

SEQ ID NO: 633196 - RNA, 11 nt, Homo sapiens
gaaucuucucu

SEQ ID NO: 633197 - RNA, 17 nt, Homo sapiens
gaaucuuuguaccaaaa

SEQ ID NO: 633198 - RNA, 16 nt, Homo sapiens
gaaugaacaaagucca

SEQ ID NO: 633199 - RNA, 15 nt, Homo sapiens
gaaugaacacucccc

SEQ ID NO: 633200 - RNA, 21 nt, Homo sapiens
gaaugaaccuucuggccuccc

SEQ ID NO: 633201 - RNA, 23 nt, Homo sapiens
gaaugaagcguugccauugaacu

SEQ ID NO: 633202 - RNA, 20 nt, Homo sapiens
gaaugaauuuaucuuuacca

SEQ ID NO: 633203 - RNA, 22 nt, Homo sapiens
gaaugacuuucagucucucuga

SEQ ID NO: 633204 - RNA, 17 nt, Homo sapiens
gaaugagaagaaugacu

SEQ ID NO: 633205 - RNA, 19 nt, Homo sapiens
gaaugagagcgacacagac

SEQ ID NO: 633206 - RNA, 18 nt, Homo sapiens
gaaugagagguuccuaag

SEQ ID NO: 633207 - RNA, 18 nt, Homo sapiens
gaaugauuuuucuuuaca

SEQ ID NO: 633208 - RNA, 14 nt, Homo sapiens
gaaugcaagcugga

SEQ ID NO: 633209 - RNA, 18 nt, Homo sapiens
gaaugcacaagaauggau

SEQ ID NO: 633210 - RNA, 18 nt, Homo sapiens
gaaugcacaguacuguuu

SEQ ID NO: 633211 - RNA, 18 nt, Homo sapiens
gaaugcagaggucuccaa

SEQ ID NO: 633212 - RNA, 12 nt, Homo sapiens
gaaugcagggaa

SEQ ID NO: 633213 - RNA, 18 nt, Homo sapiens
gaaugcauugucaauauu

SEQ ID NO: 633214 - RNA, 12 nt, Homo sapiens
gaaugcugccag

SEQ ID NO: 633215 - RNA, 20 nt, Homo sapiens
gaaugcuggguaugcucugu

SEQ ID NO: 633216 - RNA, 14 nt, Homo sapiens
gaauggaaccaaaa

SEQ ID NO: 633217 - RNA, 18 nt, Homo sapiens
gaauggaaggcuuugcca

SEQ ID NO: 633218 - RNA, 15 nt, Homo sapiens
gaauggcaugcugaa

SEQ ID NO: 633219 - RNA, 22 nt, Homo sapiens
gaauggcugcaccuuuuugcau

SEQ ID NO: 633220 - RNA, 19 nt, Homo sapiens
gaaugggaagggucauaga

SEQ ID NO: 633221 - RNA, 14 nt, Homo sapiens
gaaugggagaaaau

SEQ ID NO: 633222 - RNA, 21 nt, Homo sapiens
gaaugggcuugaaacauuaua

SEQ ID NO: 633223 - RNA, 14 nt, Homo sapiens
gaaugggguagaaa

SEQ ID NO: 633224 - RNA, 20 nt, Homo sapiens
gaauggguguuguaugggga

SEQ ID NO: 633225 - RNA, 20 nt, Homo sapiens
gaauggucuggcaauauucu

SEQ ID NO: 633226 - RNA, 21 nt, Homo sapiens
gaccaauauuguacaguuuuu

SEQ ID NO: 633227 - RNA, 20 nt, Homo sapiens
gaccaaucaucaacuaccau

SEQ ID NO: 633228 - RNA, 20 nt, Homo sapiens
gaccaauugugcugccauuu

SEQ ID NO: 633229 - RNA, 14 nt, Homo sapiens
gaccacaauuaucu

SEQ ID NO: 633230 - RNA, 15 nt, Homo sapiens
gaccacaauuaucuu

SEQ ID NO: 633231 - RNA, 23 nt, Homo sapiens
gaccacacuuccuguccagagag

SEQ ID NO: 633232 - RNA, 18 nt, Homo sapiens
gaccacaguuuaccucag

SEQ ID NO: 633233 - RNA, 12 nt, Homo sapiens
gaccaccaaagu

SEQ ID NO: 633234 - RNA, 17 nt, Homo sapiens
gaccaccaccaggacug

SEQ ID NO: 633235 - RNA, 16 nt, Homo sapiens
gaccaccuaauaucaa

SEQ ID NO: 633236 - RNA, 12 nt, Homo sapiens
gaccacuacagu

SEQ ID NO: 633237 - RNA, 24 nt, Homo sapiens
gaccacugggcaaugauggcaauu

SEQ ID NO: 633238 - RNA, 13 nt, Homo sapiens
gaccacugucucc

SEQ ID NO: 633239 - RNA, 15 nt, Homo sapiens
gaccacuuccagggg

SEQ ID NO: 633240 - RNA, 23 nt, Homo sapiens
gaccacuuccaggggaaccugcc

SEQ ID NO: 633241 - RNA, 17 nt, Homo sapiens
gaccacuuggaaauaaa

SEQ ID NO: 633242 - RNA, 16 nt, Homo sapiens
gaccagaaauucccuu

SEQ ID NO: 633243 - RNA, 14 nt, Homo sapiens
gaccagaaccagag

SEQ ID NO: 633244 - RNA, 17 nt, Homo sapiens
gaccagaagcauuucac

SEQ ID NO: 633245 - RNA, 13 nt, Homo sapiens
gaccagagaucga

SEQ ID NO: 633246 - RNA, 23 nt, Homo sapiens
gaccagagugauguccucucuca

SEQ ID NO: 633247 - RNA, 16 nt, Homo sapiens
gaccagccugggcaac

SEQ ID NO: 633248 - RNA, 15 nt, Homo sapiens
gaccaguacugggaa

SEQ ID NO: 633249 - RNA, 24 nt, Homo sapiens
gaccagucacugacccugugcaga

SEQ ID NO: 633250 - RNA, 13 nt, Homo sapiens
gaccagugcaguu

SEQ ID NO: 633251 - RNA, 13 nt, Homo sapiens
gaccauccuugac

SEQ ID NO: 633252 - RNA, 21 nt, Homo sapiens
gaccaucugaugugaugugaa

SEQ ID NO: 633253 - RNA, 17 nt, Homo sapiens
gaccaucuuugccaaca

SEQ ID NO: 633254 - RNA, 15 nt, Homo sapiens
gaccaugcagccgca

SEQ ID NO: 633255 - RNA, 21 nt, Homo sapiens
gaccaugccagacccacugaa

SEQ ID NO: 633256 - RNA, 21 nt, Homo sapiens
gaccaugcucaucugcugguc

SEQ ID NO: 633257 - RNA, 23 nt, Homo sapiens
gaccauggccaccccagagccau

SEQ ID NO: 633258 - RNA, 13 nt, Homo sapiens
gaccauguggcca

SEQ ID NO: 633259 - RNA, 11 nt, Homo sapiens
gacccaaaaca

SEQ ID NO: 633260 - RNA, 17 nt, Homo sapiens
gacccaagagaacucac

SEQ ID NO: 633261 - RNA, 14 nt, Homo sapiens
gacccacagacugg

SEQ ID NO: 633262 - RNA, 14 nt, Homo sapiens
gacccaccccaacu

SEQ ID NO: 633263 - RNA, 20 nt, Homo sapiens
gacccaccccugugcuccgu

SEQ ID NO: 633264 - RNA, 19 nt, Homo sapiens
gacccacgaacgcucuuag

SEQ ID NO: 633265 - RNA, 21 nt, Homo sapiens
gacccagcuccucugagccau

SEQ ID NO: 633266 - RNA, 15 nt, Homo sapiens
gacccaggcccucca

SEQ ID NO: 633267 - RNA, 14 nt, Homo sapiens
gacccagggccuga

SEQ ID NO: 633268 - RNA, 23 nt, Homo sapiens
gacccaggggucagccuuaggaa

SEQ ID NO: 633269 - RNA, 19 nt, Homo sapiens
gacccagugagugaaucag

SEQ ID NO: 633270 - RNA, 14 nt, Homo sapiens
gacccaugugcaag

SEQ ID NO: 633271 - RNA, 18 nt, Homo sapiens
gaccccaaaggagucaga

SEQ ID NO: 633272 - RNA, 19 nt, Homo sapiens
gaccccagaggauugcugc

SEQ ID NO: 633273 - RNA, 16 nt, Homo sapiens
gaccccaggaacaaua

SEQ ID NO: 633274 - RNA, 16 nt, Homo sapiens
gaccccaggucagggg

SEQ ID NO: 633275 - RNA, 14 nt, Homo sapiens
gacccccagcacuu

SEQ ID NO: 633276 - RNA, 15 nt, Homo sapiens
gacccccaucugagc

SEQ ID NO: 633277 - RNA, 18 nt, Homo sapiens
gaccccgagaagugcucu

SEQ ID NO: 633278 - RNA, 18 nt, Homo sapiens
gaccccuaaugucagcuu

SEQ ID NO: 633279 - RNA, 20 nt, Homo sapiens
gaccccucaccuugcaacac

SEQ ID NO: 633280 - RNA, 16 nt, Homo sapiens
gaccccucccaaccuc

SEQ ID NO: 633281 - RNA, 21 nt, Homo sapiens
gaccccuccuuucuuccucca

SEQ ID NO: 633282 - RNA, 23 nt, Homo sapiens
gaccccuucccuguccuugcccu

SEQ ID NO: 633283 - RNA, 17 nt, Homo sapiens
gaccccuuguugcacug

SEQ ID NO: 633284 - RNA, 14 nt, Homo sapiens
gacccuauugcugc

SEQ ID NO: 633285 - RNA, 16 nt, Homo sapiens
gacccucagcugucac

SEQ ID NO: 633286 - RNA, 13 nt, Homo sapiens
gacccuccagagg

SEQ ID NO: 633287 - RNA, 21 nt, Homo sapiens
gacccucccacucccaucucc

SEQ ID NO: 633288 - RNA, 21 nt, Homo sapiens
gacccucccagucucaucucc

SEQ ID NO: 633289 - RNA, 24 nt, Homo sapiens
gacccuccccaaggaugaccacac

SEQ ID NO: 633290 - RNA, 20 nt, Homo sapiens
gacccucugaaugguccagg

SEQ ID NO: 633291 - RNA, 20 nt, Homo sapiens
gacccucugacccuagcucu

SEQ ID NO: 633292 - RNA, 17 nt, Homo sapiens
gacccugccacagccag

SEQ ID NO: 633293 - RNA, 15 nt, Homo sapiens
gacccugccacucuc

SEQ ID NO: 633294 - RNA, 20 nt, Homo sapiens
gacccuggaccauuccagga

SEQ ID NO: 633295 - RNA, 15 nt, Homo sapiens
gacccugggaccaca

SEQ ID NO: 633296 - RNA, 16 nt, Homo sapiens
gacccuggucugagga

SEQ ID NO: 633297 - RNA, 15 nt, Homo sapiens
gacccuguccugcag

SEQ ID NO: 633298 - RNA, 15 nt, Homo sapiens
gacccugugcaucug

SEQ ID NO: 633299 - RNA, 22 nt, Homo sapiens
gacccuguggccaggugcuuuu

SEQ ID NO: 633300 - RNA, 20 nt, Homo sapiens
gacccuuaccugaaccagcc

SEQ ID NO: 633301 - RNA, 13 nt, Homo sapiens
gacccuuugccuu

SEQ ID NO: 633302 - RNA, 16 nt, Homo sapiens
gacccuuuucucagga

SEQ ID NO: 633303 - RNA, 17 nt, Homo sapiens
gacccuuuucucaggac

SEQ ID NO: 633304 - RNA, 23 nt, Homo sapiens
gaccgaccccuccccagugccuc

SEQ ID NO: 633305 - RNA, 15 nt, Homo sapiens
gaccgccugcccugc

SEQ ID NO: 633306 - RNA, 15 nt, Homo sapiens
gaccgugaccaucuu

SEQ ID NO: 633307 - RNA, 18 nt, Homo sapiens
gaccgugcgagcugccgu

SEQ ID NO: 633308 - RNA, 21 nt, Homo sapiens
gaccuaaaaaggucuguuaau

SEQ ID NO: 633309 - RNA, 19 nt, Homo sapiens
gaccuaccugcagugggaa

SEQ ID NO: 633310 - RNA, 15 nt, Homo sapiens
gaccuagagacuuca

SEQ ID NO: 633311 - RNA, 21 nt, Homo sapiens
gaccuaguccccuuuccucua

SEQ ID NO: 633312 - RNA, 17 nt, Homo sapiens
gaccuaugagcacauag

SEQ ID NO: 633313 - RNA, 13 nt, Homo sapiens
gaccuauuuccag

SEQ ID NO: 633314 - RNA, 22 nt, Homo sapiens
gaccucacugugaccuugacuu

SEQ ID NO: 633315 - RNA, 14 nt, Homo sapiens
gaccucaugccaug

SEQ ID NO: 633316 - RNA, 17 nt, Homo sapiens
gaccuccaaccaggagu

SEQ ID NO: 633317 - RNA, 22 nt, Homo sapiens
gaccucccaacucuaaagccaa

SEQ ID NO: 633318 - RNA, 13 nt, Homo sapiens
gaccuccugacaa

SEQ ID NO: 633319 - RNA, 14 nt, Homo sapiens
gaccuccugucacu

SEQ ID NO: 633320 - RNA, 23 nt, Homo sapiens
gaccucuuccuccucgcugccag

SEQ ID NO: 633321 - RNA, 23 nt, Homo sapiens
gaccugacaccgucccucaguga

SEQ ID NO: 633322 - RNA, 16 nt, Homo sapiens
gaccugccaccaggga

SEQ ID NO: 633323 - RNA, 22 nt, Homo sapiens
gaccugccccggaccuaccucc

SEQ ID NO: 633324 - RNA, 16 nt, Homo sapiens
gaccugccuccugccu

SEQ ID NO: 633325 - RNA, 18 nt, Homo sapiens
gaccugcuccgccaggaa

SEQ ID NO: 633326 - RNA, 17 nt, Homo sapiens
gaccuggaaucagugaa

SEQ ID NO: 633327 - RNA, 17 nt, Homo sapiens
gaccuggccuuucacuu

SEQ ID NO: 633328 - RNA, 18 nt, Homo sapiens
gaccuggggggagggaca

SEQ ID NO: 633329 - RNA, 16 nt, Homo sapiens
gaccuguguucuugcu

SEQ ID NO: 633330 - RNA, 21 nt, Homo sapiens
gaccuguuuaugagaugcugg

SEQ ID NO: 633331 - RNA, 17 nt, Homo sapiens
gaccuuagcguucugga

SEQ ID NO: 633332 - RNA, 14 nt, Homo sapiens
gaccuucauuucau

SEQ ID NO: 633333 - RNA, 21 nt, Homo sapiens
gaccuucucccucacuccugc

SEQ ID NO: 633334 - RNA, 18 nt, Homo sapiens
gaccuuggaucagaugaa

SEQ ID NO: 633335 - RNA, 22 nt, Homo sapiens
gaccuuuaggucaaacucccua

SEQ ID NO: 633336 - RNA, 22 nt, Homo sapiens
gaccuuuauaucugucuuuuau

SEQ ID NO: 633337 - RNA, 23 nt, Homo sapiens
gaccuuuauccagcuagugccaa

SEQ ID NO: 633338 - RNA, 21 nt, Homo sapiens
gaccuuuuuuaggaagcaagc

SEQ ID NO: 633339 - RNA, 21 nt, Homo sapiens
gacgagauccuguuucagcua

SEQ ID NO: 633340 - RNA, 20 nt, Homo sapiens
gacgcaacuuaagcugggau

SEQ ID NO: 633341 - RNA, 15 nt, Homo sapiens
gacgcuugugacagu

SEQ ID NO: 633342 - RNA, 22 nt, Homo sapiens
gacgggguuucaccauguuggc

SEQ ID NO: 633343 - RNA, 14 nt, Homo sapiens
gacggucaguccau

SEQ ID NO: 633344 - RNA, 23 nt, Homo sapiens
gacggugggccuggcacacgccu

SEQ ID NO: 633345 - RNA, 21 nt, Homo sapiens
gacgguuaacuuguauauucc

SEQ ID NO: 633346 - RNA, 17 nt, Homo sapiens
gacgugauuuugcugua

SEQ ID NO: 633347 - RNA, 16 nt, Homo sapiens
gacuugagcuuggcag

SEQ ID NO: 633348 - RNA, 17 nt, Homo sapiens
gacuugauuagugccuu

SEQ ID NO: 633349 - RNA, 11 nt, Homo sapiens
gacuugccucc

SEQ ID NO: 633350 - RNA, 15 nt, Homo sapiens
gacuuggagagcaaa

SEQ ID NO: 633351 - RNA, 16 nt, Homo sapiens
gacuuggggucaggaa

SEQ ID NO: 633352 - RNA, 20 nt, Homo sapiens
gacuugguccuaagcaccug

SEQ ID NO: 633353 - RNA, 20 nt, Homo sapiens
gacuuguuuuaaacuugccu

SEQ ID NO: 633354 - RNA, 20 nt, Homo sapiens
gacuuguuuuaugcucaggg

SEQ ID NO: 633355 - RNA, 15 nt, Homo sapiens
gacuuuagaaauaaa

SEQ ID NO: 633356 - RNA, 21 nt, Homo sapiens
gacuuucugauuacuguccag

SEQ ID NO: 633357 - RNA, 18 nt, Homo sapiens
gacuuugugaguuagcau

SEQ ID NO: 633358 - RNA, 15 nt, Homo sapiens
gacuuuuaaugucau

SEQ ID NO: 633359 - RNA, 18 nt, Homo sapiens
gacuuuuccaagcccuuu

SEQ ID NO: 633360 - RNA, 23 nt, Homo sapiens
gagaaaaaauauuuuccugccag

SEQ ID NO: 633361 - RNA, 21 nt, Homo sapiens
gagaaaaaggugccaucucag

SEQ ID NO: 633362 - RNA, 22 nt, Homo sapiens
gagaaaagaaaccagagucaaa

SEQ ID NO: 633363 - RNA, 14 nt, Homo sapiens
gagaaaagccucuc

SEQ ID NO: 633364 - RNA, 23 nt, Homo sapiens
gagaaaccauucuuuccccucag

SEQ ID NO: 633365 - RNA, 15 nt, Homo sapiens
gagaaagcuaaaaug

SEQ ID NO: 633366 - RNA, 18 nt, Homo sapiens
gagaaaguaacacaaaca

SEQ ID NO: 633367 - RNA, 17 nt, Homo sapiens
gagaaauccuuccuaaa

SEQ ID NO: 633368 - RNA, 15 nt, Homo sapiens
gagaaaugacuuuga

SEQ ID NO: 633369 - RNA, 20 nt, Homo sapiens
gagaaaugauaagugacaaa

SEQ ID NO: 633370 - RNA, 20 nt, Homo sapiens
gagaaaugcuuagaaauuca

SEQ ID NO: 633371 - RNA, 18 nt, Homo sapiens
gagaaauggcgaauguca

SEQ ID NO: 633372 - RNA, 22 nt, Homo sapiens
gagaaauugacagaucaagcug

SEQ ID NO: 633373 - RNA, 20 nt, Homo sapiens
gagaaauuugccuuguucaa

SEQ ID NO: 633374 - RNA, 14 nt, Homo sapiens
gagaacaagaaagg

SEQ ID NO: 633375 - RNA, 16 nt, Homo sapiens
gagaacaaugugcuau

SEQ ID NO: 633376 - RNA, 15 nt, Homo sapiens
gagaacaguuucauc

SEQ ID NO: 633377 - RNA, 20 nt, Homo sapiens
gagaaccuuuagaauaucuu

SEQ ID NO: 633378 - RNA, 16 nt, Homo sapiens
gagaacuauccaaaac

SEQ ID NO: 633379 - RNA, 15 nt, Homo sapiens
gagaacuccucauuc

SEQ ID NO: 633380 - RNA, 12 nt, Homo sapiens
gagaacugccuu

SEQ ID NO: 633381 - RNA, 18 nt, Homo sapiens
gagaacuggaaagacaua

SEQ ID NO: 633382 - RNA, 23 nt, Homo sapiens
gagaacuuucugauucacagucu

SEQ ID NO: 633383 - RNA, 17 nt, Homo sapiens
gagaagaaguuugacca

SEQ ID NO: 633384 - RNA, 14 nt, Homo sapiens
gagaagacauucug

SEQ ID NO: 633385 - RNA, 17 nt, Homo sapiens
gagaagauuuaugucag

SEQ ID NO: 633386 - RNA, 13 nt, Homo sapiens
gagaagauuucag

SEQ ID NO: 633387 - RNA, 14 nt, Homo sapiens
gagaagcaaugggu

SEQ ID NO: 633388 - RNA, 21 nt, Homo sapiens
gagaagcacaacugaaaccag

SEQ ID NO: 633389 - RNA, 13 nt, Homo sapiens
gagaagcaccagc

SEQ ID NO: 633390 - RNA, 17 nt, Homo sapiens
gagaagccaaacagcaa

SEQ ID NO: 633391 - RNA, 22 nt, Homo sapiens
gagaagccuucagcuccaggga

SEQ ID NO: 633392 - RNA, 20 nt, Homo sapiens
gagaagcggauuuccaggga

SEQ ID NO: 633393 - RNA, 20 nt, Homo sapiens
gagaagcugcaggcuuugcc

SEQ ID NO: 633394 - RNA, 15 nt, Homo sapiens
gagaaggaggggagc

SEQ ID NO: 633395 - RNA, 18 nt, Homo sapiens
gagaaggcgaggucaagu

SEQ ID NO: 633396 - RNA, 23 nt, Homo sapiens
gagaaggcuauguaaacaaacca

SEQ ID NO: 633397 - RNA, 13 nt, Homo sapiens
cacuccccuaggg

SEQ ID NO: 633398 - RNA, 20 nt, Homo sapiens
cacucccucugccuucaggc

SEQ ID NO: 633399 - RNA, 16 nt, Homo sapiens
cacuccuccuacugua

SEQ ID NO: 633400 - RNA, 19 nt, Homo sapiens
cacuccuguaacugucuca

SEQ ID NO: 633401 - RNA, 20 nt, Homo sapiens
cacuccuucucucacugugu

SEQ ID NO: 633402 - RNA, 19 nt, Homo sapiens
cacuccuuuuuugcaugug

SEQ ID NO: 633403 - RNA, 14 nt, Homo sapiens
cacucgacucugcu

SEQ ID NO: 633404 - RNA, 16 nt, Homo sapiens
cacucuaacuguauau

SEQ ID NO: 633405 - RNA, 20 nt, Homo sapiens
cacucuacuaaugccucuuc

SEQ ID NO: 633406 - RNA, 20 nt, Homo sapiens
cacucucagaccaagcagca

SEQ ID NO: 633407 - RNA, 14 nt, Homo sapiens
cacucuccaaacag

SEQ ID NO: 633408 - RNA, 17 nt, Homo sapiens
cacucugauucaccucu

SEQ ID NO: 633409 - RNA, 15 nt, Homo sapiens
cacucuggagcauuu

SEQ ID NO: 633410 - RNA, 13 nt, Homo sapiens
cacucuucacuug

SEQ ID NO: 633411 - RNA, 13 nt, Homo sapiens
cacucuucuguaa

SEQ ID NO: 633412 - RNA, 15 nt, Homo sapiens
cacucuucuguaaau

SEQ ID NO: 633413 - RNA, 21 nt, Homo sapiens
cacucuucuguaaauagauga

SEQ ID NO: 633414 - RNA, 15 nt, Homo sapiens
cacucuucuugagca

SEQ ID NO: 633415 - RNA, 13 nt, Homo sapiens
cacucuucuugca

SEQ ID NO: 633416 - RNA, 16 nt, Homo sapiens
cacucuuuugcuuuau

SEQ ID NO: 633417 - RNA, 21 nt, Homo sapiens
cacugaaaaauauuccaagcu

SEQ ID NO: 633418 - RNA, 23 nt, Homo sapiens
cacugaaaaaucuaagugauaua

SEQ ID NO: 633419 - RNA, 21 nt, Homo sapiens
cacugaaaaugucacauucua

SEQ ID NO: 633420 - RNA, 13 nt, Homo sapiens
cacugaaaccaaa

SEQ ID NO: 633421 - RNA, 18 nt, Homo sapiens
cacugaaaccaaaacaua

SEQ ID NO: 633422 - RNA, 19 nt, Homo sapiens
cacugaaaugaccaagaca

SEQ ID NO: 633423 - RNA, 19 nt, Homo sapiens
cacugaagggcuagaguuu

SEQ ID NO: 633424 - RNA, 20 nt, Homo sapiens
cacugaaucuccccuccuca

SEQ ID NO: 633425 - RNA, 15 nt, Homo sapiens
cacugacucaagaca

SEQ ID NO: 633426 - RNA, 17 nt, Homo sapiens
cacugacucugacucau

SEQ ID NO: 633427 - RNA, 20 nt, Homo sapiens
cacugagcuccccagaucuc

SEQ ID NO: 633428 - RNA, 17 nt, Homo sapiens
cacugaggaccagccau

SEQ ID NO: 633429 - RNA, 13 nt, Homo sapiens
cacugaguucuau

SEQ ID NO: 633430 - RNA, 22 nt, Homo sapiens
cacugauaaaaguuuugauauu

SEQ ID NO: 633431 - RNA, 17 nt, Homo sapiens
cacugauacacagaaua

SEQ ID NO: 633432 - RNA, 16 nt, Homo sapiens
cacugaucacccaaug

SEQ ID NO: 633433 - RNA, 21 nt, Homo sapiens
cacugaucacccaaugcauca

SEQ ID NO: 633434 - RNA, 20 nt, Homo sapiens
cacugaucuaagcaguggca

SEQ ID NO: 633435 - RNA, 22 nt, Homo sapiens
cacugaugcuuagauguuccag

SEQ ID NO: 633436 - RNA, 22 nt, Homo sapiens
cacugauguaaguguuguggaa

SEQ ID NO: 633437 - RNA, 18 nt, Homo sapiens
cacugauuguccauuuac

SEQ ID NO: 633438 - RNA, 19 nt, Homo sapiens
cacugauuguccauuuaca

SEQ ID NO: 633439 - RNA, 17 nt, Homo sapiens
cacugcaaaaugucuua

SEQ ID NO: 633440 - RNA, 21 nt, Homo sapiens
cacugcaaauaaacuugguag

SEQ ID NO: 633441 - RNA, 21 nt, Homo sapiens
cacugcaccugaccugcugaa

SEQ ID NO: 633442 - RNA, 24 nt, Homo sapiens
cacugcaggacagucaaggugaua

SEQ ID NO: 633443 - RNA, 14 nt, Homo sapiens
cacugcagucagau

SEQ ID NO: 633444 - RNA, 19 nt, Homo sapiens
cacugccaggccagccucc

SEQ ID NO: 633445 - RNA, 19 nt, Homo sapiens
cacugccagucucacugug

SEQ ID NO: 633446 - RNA, 17 nt, Homo sapiens
cacugcccgagcuggug

SEQ ID NO: 633447 - RNA, 19 nt, Homo sapiens
cacugccggcaggaugcag

SEQ ID NO: 633448 - RNA, 20 nt, Homo sapiens
cacugcuccuugcugcauug

SEQ ID NO: 633449 - RNA, 17 nt, Homo sapiens
cacugcucucuguggug

SEQ ID NO: 633450 - RNA, 21 nt, Homo sapiens
cacugcugaggagucugagga

SEQ ID NO: 633451 - RNA, 11 nt, Homo sapiens
cacugcugcau

SEQ ID NO: 633452 - RNA, 15 nt, Homo sapiens
cacugcuugaggaaa

SEQ ID NO: 633453 - RNA, 16 nt, Homo sapiens
cacuggaagccagaga

SEQ ID NO: 633454 - RNA, 14 nt, Homo sapiens
cacuggaggucaca

SEQ ID NO: 633455 - RNA, 23 nt, Homo sapiens
cacuggauccaucuugagccaca

SEQ ID NO: 633456 - RNA, 22 nt, Homo sapiens
cacuggauugacuuugcuguca

SEQ ID NO: 633457 - RNA, 18 nt, Homo sapiens
cacuggcacacugcucuu

SEQ ID NO: 633458 - RNA, 20 nt, Homo sapiens
cacuggcaucucacuuuaug

SEQ ID NO: 633459 - RNA, 13 nt, Homo sapiens
cacuggcauuguc

SEQ ID NO: 633460 - RNA, 17 nt, Homo sapiens
cacuggccaccaggcug

SEQ ID NO: 633461 - RNA, 22 nt, Homo sapiens
cacugggaugagccgcugugag

SEQ ID NO: 633462 - RNA, 17 nt, Homo sapiens
cacugggccuuuccaga

SEQ ID NO: 633463 - RNA, 17 nt, Homo sapiens
cacuggguguugaucuu

SEQ ID NO: 633464 - RNA, 13 nt, Homo sapiens
cacuggguugacu

SEQ ID NO: 633465 - RNA, 21 nt, Homo sapiens
cacuggugggccauuagauuu

SEQ ID NO: 633466 - RNA, 12 nt, Homo sapiens
cacugguucugc

SEQ ID NO: 633467 - RNA, 22 nt, Homo sapiens
cacuguacauuauaaaccuuca

SEQ ID NO: 633468 - RNA, 18 nt, Homo sapiens
cacuguaccgacuuugau

SEQ ID NO: 633469 - RNA, 22 nt, Homo sapiens
cacugucaccacccugcucauc

SEQ ID NO: 633470 - RNA, 16 nt, Homo sapiens
cacuguccacauguga

SEQ ID NO: 633471 - RNA, 22 nt, Homo sapiens
cacuguccaugaagcacugagc

SEQ ID NO: 633472 - RNA, 16 nt, Homo sapiens
cacuguccugucuuaa

SEQ ID NO: 633473 - RNA, 21 nt, Homo sapiens
cacugucuauuuaagugcaau

SEQ ID NO: 633474 - RNA, 19 nt, Homo sapiens
cacugucuccuuucucuua

SEQ ID NO: 633475 - RNA, 22 nt, Homo sapiens
cacugucugagaauuuccaaaa

SEQ ID NO: 633476 - RNA, 23 nt, Homo sapiens
cacuguggagacuuucuguuacu

SEQ ID NO: 633477 - RNA, 16 nt, Homo sapiens
cacugugucauucugu

SEQ ID NO: 633478 - RNA, 21 nt, Homo sapiens
cacuguguuuaguugcaagga

SEQ ID NO: 633479 - RNA, 19 nt, Homo sapiens
cacuguuaauauucuauua

SEQ ID NO: 633480 - RNA, 12 nt, Homo sapiens
cacuguucaaua

SEQ ID NO: 633481 - RNA, 22 nt, Homo sapiens
cacuguugcaaacucagugcaa

SEQ ID NO: 633482 - RNA, 13 nt, Homo sapiens
cacuguugcaaag

SEQ ID NO: 633483 - RNA, 22 nt, Homo sapiens
cacuguugucaaaaaguuccau

SEQ ID NO: 633484 - RNA, 16 nt, Homo sapiens
cacuguuuuuuuccca

SEQ ID NO: 633485 - RNA, 20 nt, Homo sapiens
cacuuaaaaaauguccauga

SEQ ID NO: 633486 - RNA, 17 nt, Homo sapiens
cacuuaaugauacaugu

SEQ ID NO: 633487 - RNA, 22 nt, Homo sapiens
cacuuaauuuguaaacuucuga

SEQ ID NO: 633488 - RNA, 15 nt, Homo sapiens
cacuuacauuuacaa

SEQ ID NO: 633489 - RNA, 16 nt, Homo sapiens
cacuuagccauugaaa

SEQ ID NO: 633490 - RNA, 16 nt, Homo sapiens
cacuuagcccaagagg

SEQ ID NO: 633491 - RNA, 13 nt, Homo sapiens
cacuuagccucuu

SEQ ID NO: 633492 - RNA, 23 nt, Homo sapiens
cacuuaguauugcagccaaagaa

SEQ ID NO: 633493 - RNA, 19 nt, Homo sapiens
cacuuaguccuuuaucauc

SEQ ID NO: 633494 - RNA, 17 nt, Homo sapiens
cacuuagugaucauuua

SEQ ID NO: 633495 - RNA, 22 nt, Homo sapiens
cacuuauaagaaagaucaaaga

SEQ ID NO: 633496 - RNA, 15 nt, Homo sapiens
cacuuauaccaaagg

SEQ ID NO: 633497 - RNA, 19 nt, Homo sapiens
cacuuauacccaugaacuu

SEQ ID NO: 633498 - RNA, 19 nt, Homo sapiens
cacuuaucaguuugcuaau

SEQ ID NO: 633499 - RNA, 12 nt, Homo sapiens
cacuuaucugau

SEQ ID NO: 633500 - RNA, 18 nt, Homo sapiens
cacuuauguuauacaaua

SEQ ID NO: 633501 - RNA, 16 nt, Homo sapiens
cacuuauugacuauua

SEQ ID NO: 633502 - RNA, 18 nt, Homo sapiens
cacuucagaauuccauau

SEQ ID NO: 633503 - RNA, 15 nt, Homo sapiens
cacuucagucugugu

SEQ ID NO: 633504 - RNA, 13 nt, Homo sapiens
cacuucaucugau

SEQ ID NO: 633505 - RNA, 12 nt, Homo sapiens
cacuuccagugc

SEQ ID NO: 633506 - RNA, 23 nt, Homo sapiens
cacuucccuguuuauaaaaccuc

SEQ ID NO: 633507 - RNA, 16 nt, Homo sapiens
cacuuccuccuaccug

SEQ ID NO: 633508 - RNA, 17 nt, Homo sapiens
cacuuccuguccagaga

SEQ ID NO: 633509 - RNA, 19 nt, Homo sapiens
cacuuccuuguaaaaucua

SEQ ID NO: 633510 - RNA, 20 nt, Homo sapiens
cacuucucaucauauuguau

SEQ ID NO: 633511 - RNA, 20 nt, Homo sapiens
cacuucuuuauuaauuacca

SEQ ID NO: 633512 - RNA, 15 nt, Homo sapiens
cacuugaacccagga

SEQ ID NO: 633513 - RNA, 15 nt, Homo sapiens
cucuuucccaacccc

SEQ ID NO: 633514 - RNA, 17 nt, Homo sapiens
cucuuuccuaaagccaa

SEQ ID NO: 633515 - RNA, 18 nt, Homo sapiens
cucuuucuguauauacuu

SEQ ID NO: 633516 - RNA, 12 nt, Homo sapiens
cucuuucuugga

SEQ ID NO: 633517 - RNA, 18 nt, Homo sapiens
cucuuugacaauuccuag

SEQ ID NO: 633518 - RNA, 14 nt, Homo sapiens
cacuugacauuccu

SEQ ID NO: 633519 - RNA, 15 nt, Homo sapiens
cacuugacauuccuu

SEQ ID NO: 633520 - RNA, 21 nt, Homo sapiens
cacuugaugccguuucuuuca

SEQ ID NO: 633521 - RNA, 19 nt, Homo sapiens
cacuugcacgcccaugugu

SEQ ID NO: 633522 - RNA, 14 nt, Homo sapiens
cacuugccauugcc

SEQ ID NO: 633523 - RNA, 14 nt, Homo sapiens
cacuugcucaaaac

SEQ ID NO: 633524 - RNA, 22 nt, Homo sapiens
cacuugcucaugcccugccaag

SEQ ID NO: 633525 - RNA, 20 nt, Homo sapiens
cacuugcucccaacccauuc

SEQ ID NO: 633526 - RNA, 13 nt, Homo sapiens
cacuugcucuuug

SEQ ID NO: 633527 - RNA, 16 nt, Homo sapiens
cacuuggaugcagggu

SEQ ID NO: 633528 - RNA, 22 nt, Homo sapiens
cacuuggauuucauuuguaacu

SEQ ID NO: 633529 - RNA, 22 nt, Homo sapiens
cacuugggauugucuuacuguu

SEQ ID NO: 633530 - RNA, 23 nt, Homo sapiens
cacuugggccacacuacccaccu

SEQ ID NO: 633531 - RNA, 22 nt, Homo sapiens
cacuugucaaagaaggugcuga

SEQ ID NO: 633532 - RNA, 21 nt, Homo sapiens
cacuugugcaguguugacagu

SEQ ID NO: 633533 - RNA, 20 nt, Homo sapiens
cacuugugugugggcuguga

SEQ ID NO: 633534 - RNA, 24 nt, Homo sapiens
cacuuuaauugaagaacugcacuu

SEQ ID NO: 633535 - RNA, 21 nt, Homo sapiens
cacuuuacacaagaaucuaga

SEQ ID NO: 633536 - RNA, 13 nt, Homo sapiens
cacuuuacuacuc

SEQ ID NO: 633537 - RNA, 20 nt, Homo sapiens
cacuuuagauauacauauca

SEQ ID NO: 633538 - RNA, 17 nt, Homo sapiens
cacuuuagggcuguaaa

SEQ ID NO: 633539 - RNA, 19 nt, Homo sapiens
cacuuuauauuuuccucuu

SEQ ID NO: 633540 - RNA, 20 nt, Homo sapiens
cacuuuaugccggaugugcu

SEQ ID NO: 633541 - RNA, 13 nt, Homo sapiens
cacuuucuggaac

SEQ ID NO: 633542 - RNA, 19 nt, Homo sapiens
cacuuugagaagcugaggu

SEQ ID NO: 633543 - RNA, 16 nt, Homo sapiens
cacuuugaggacauuu

SEQ ID NO: 633544 - RNA, 13 nt, Homo sapiens
cacuuugcagcua

SEQ ID NO: 633545 - RNA, 22 nt, Homo sapiens
cacuuuggacauggcucacaaa

SEQ ID NO: 633546 - RNA, 22 nt, Homo sapiens
cacuuuggacuucucugaaaua

SEQ ID NO: 633547 - RNA, 19 nt, Homo sapiens
cacuuugggaggcugaggc

SEQ ID NO: 633548 - RNA, 16 nt, Homo sapiens
cacuuuguugcaagau

SEQ ID NO: 633549 - RNA, 16 nt, Homo sapiens
cacuuuguuuaugcau

SEQ ID NO: 633550 - RNA, 14 nt, Homo sapiens
cacuuuucauauca

SEQ ID NO: 633551 - RNA, 15 nt, Homo sapiens
cacuuuuguucugcu

SEQ ID NO: 633552 - RNA, 16 nt, Homo sapiens
cacuuuuugugaauua

SEQ ID NO: 633553 - RNA, 22 nt, Homo sapiens
cacuuuuuuuauaagcaaaaac

SEQ ID NO: 633554 - RNA, 19 nt, Homo sapiens
cagaaaaaaaagugucuca

SEQ ID NO: 633555 - RNA, 22 nt, Homo sapiens
cagaaaaaaauaaauguucuaa

SEQ ID NO: 633556 - RNA, 20 nt, Homo sapiens
cagaaaaacucugggaaaua

SEQ ID NO: 633557 - RNA, 18 nt, Homo sapiens
cagaaaaacuggcucuga

SEQ ID NO: 633558 - RNA, 18 nt, Homo sapiens
cagaaaaaugguggucau

SEQ ID NO: 633559 - RNA, 20 nt, Homo sapiens
cagaaaacaagaugagauug

SEQ ID NO: 633560 - RNA, 17 nt, Homo sapiens
cagaaaagaugugcaga

SEQ ID NO: 633561 - RNA, 19 nt, Homo sapiens
cagaaaaggcugcugugaa

SEQ ID NO: 633562 - RNA, 15 nt, Homo sapiens
cagaaaagugacagu

SEQ ID NO: 633563 - RNA, 17 nt, Homo sapiens
cagaaaagugacagugg

SEQ ID NO: 633564 - RNA, 15 nt, Homo sapiens
cagaaaagugccuga

SEQ ID NO: 633565 - RNA, 16 nt, Homo sapiens
cagaaaauguucuguu

SEQ ID NO: 633566 - RNA, 19 nt, Homo sapiens
cagaaacaaaucucaaagu

SEQ ID NO: 633567 - RNA, 22 nt, Homo sapiens
cagaaacaaugacauccagaaa

SEQ ID NO: 633568 - RNA, 16 nt, Homo sapiens
cagaaacagggcagca

SEQ ID NO: 633569 - RNA, 23 nt, Homo sapiens
cagaaacagugggagcccugacc

SEQ ID NO: 633570 - RNA, 22 nt, Homo sapiens
cagaaacccggcuuccugugcu

SEQ ID NO: 633571 - RNA, 19 nt, Homo sapiens
cagaaaccgugccaaaaga

SEQ ID NO: 633572 - RNA, 22 nt, Homo sapiens
cagaaaccugcagggacuccau

SEQ ID NO: 633573 - RNA, 14 nt, Homo sapiens
cagaaacuacugac

SEQ ID NO: 633574 - RNA, 20 nt, Homo sapiens
cagaaagacagugacuguac

SEQ ID NO: 633575 - RNA, 12 nt, Homo sapiens
cagaaagaucuu

SEQ ID NO: 633576 - RNA, 14 nt, Homo sapiens
cagaaagauuuucc

SEQ ID NO: 633577 - RNA, 15 nt, Homo sapiens
cagaaagcugaggaa

SEQ ID NO: 633578 - RNA, 16 nt, Homo sapiens
cagaaaguaagcauuu

SEQ ID NO: 633579 - RNA, 18 nt, Homo sapiens
cagaaaguggccaugcca

SEQ ID NO: 633580 - RNA, 15 nt, Homo sapiens
cagaaauacaugaaa

SEQ ID NO: 633581 - RNA, 23 nt, Homo sapiens
cagaaauagacuuaauaaagguu

SEQ ID NO: 633582 - RNA, 17 nt, Homo sapiens
cagaaaucacugugaaa

SEQ ID NO: 633583 - RNA, 19 nt, Homo sapiens
cagaaaugccuuacccuca

SEQ ID NO: 633584 - RNA, 20 nt, Homo sapiens
cagaacaagaccccgucuca

SEQ ID NO: 633585 - RNA, 18 nt, Homo sapiens
cagaacacaagacaccaa

SEQ ID NO: 633586 - RNA, 14 nt, Homo sapiens
cagaacaccuaugc

SEQ ID NO: 633587 - RNA, 22 nt, Homo sapiens
cagaacaccuaugcaaagauga

SEQ ID NO: 633588 - RNA, 17 nt, Homo sapiens
cagaacacuuauguuau

SEQ ID NO: 633589 - RNA, 17 nt, Homo sapiens
cagaacaucgauaugua

SEQ ID NO: 633590 - RNA, 18 nt, Homo sapiens
cagaacaucgauauguau

SEQ ID NO: 633591 - RNA, 20 nt, Homo sapiens
cagaacaucgauauguauau

SEQ ID NO: 633592 - RNA, 11 nt, Homo sapiens
cagaaccacaa

SEQ ID NO: 633593 - RNA, 12 nt, Homo sapiens
cagaaccacaaa

SEQ ID NO: 633594 - RNA, 12 nt, Homo sapiens
cagaaccacaga

SEQ ID NO: 633595 - RNA, 16 nt, Homo sapiens
cagaacccagggcucu

SEQ ID NO: 633596 - RNA, 21 nt, Homo sapiens
cagaaccuacuguuccuuuca

SEQ ID NO: 633597 - RNA, 21 nt, Homo sapiens
cagaacggguucaguuuuaga

SEQ ID NO: 633598 - RNA, 12 nt, Homo sapiens
cagaacugccau

SEQ ID NO: 633599 - RNA, 13 nt, Homo sapiens
cagaacugccauu

SEQ ID NO: 633600 - RNA, 13 nt, Homo sapiens
cagaacuucugaa

SEQ ID NO: 633601 - RNA, 14 nt, Homo sapiens
cagaacuugaaugu

SEQ ID NO: 633602 - RNA, 18 nt, Homo sapiens
cagaacuuucuaguugcc

SEQ ID NO: 633603 - RNA, 18 nt, Homo sapiens
cagaagaauauucaggac

SEQ ID NO: 633604 - RNA, 22 nt, Homo sapiens
cagaagauaacuugagcaccgu

SEQ ID NO: 633605 - RNA, 21 nt, Homo sapiens
cagaagauccaagaggcccug

SEQ ID NO: 633606 - RNA, 13 nt, Homo sapiens
cagaagaucugaa

SEQ ID NO: 633607 - RNA, 16 nt, Homo sapiens
cagaagaugccagcuu

SEQ ID NO: 633608 - RNA, 14 nt, Homo sapiens
cagaagaugugaug

SEQ ID NO: 633609 - RNA, 15 nt, Homo sapiens
cagaagcaagccaga

SEQ ID NO: 633610 - RNA, 21 nt, Homo sapiens
cagaagcacauaugaacugga

SEQ ID NO: 633611 - RNA, 12 nt, Homo sapiens
cagaagcacaug

SEQ ID NO: 633612 - RNA, 23 nt, Homo sapiens
cagaagcagcuucuuuugucucc

SEQ ID NO: 633613 - RNA, 17 nt, Homo sapiens
cagaagcagguucuuga

SEQ ID NO: 633614 - RNA, 23 nt, Homo sapiens
cagaagcagguucuugaugucau

SEQ ID NO: 633615 - RNA, 23 nt, Homo sapiens
cagaagcauuuuaaauguaguuu

SEQ ID NO: 633616 - RNA, 12 nt, Homo sapiens
cagaagcccuga

SEQ ID NO: 633617 - RNA, 15 nt, Homo sapiens
cagaagccuccaagc

SEQ ID NO: 633618 - RNA, 14 nt, Homo sapiens
cagaagccugaugc

SEQ ID NO: 633619 - RNA, 17 nt, Homo sapiens
cagaagccuggacucug

SEQ ID NO: 633620 - RNA, 23 nt, Homo sapiens
cagaagcgcuccaguaucuccaa

SEQ ID NO: 633621 - RNA, 21 nt, Homo sapiens
cagaaggauauuuacuacuuu

SEQ ID NO: 633622 - RNA, 19 nt, Homo sapiens
cagaaggcaaaaagacauu

SEQ ID NO: 633623 - RNA, 16 nt, Homo sapiens
cagaaggcaaacccau

SEQ ID NO: 633624 - RNA, 11 nt, Homo sapiens
cagaaggcaau

SEQ ID NO: 633625 - RNA, 18 nt, Homo sapiens
cagaaggcuacauauaca

SEQ ID NO: 633626 - RNA, 20 nt, Homo sapiens
cagaaggcuacauauacaua

SEQ ID NO: 633627 - RNA, 16 nt, Homo sapiens
cagaagggaauugcuc

SEQ ID NO: 633628 - RNA, 15 nt, Homo sapiens
cagaagggcagugac

SEQ ID NO: 633629 - RNA, 18 nt, Homo sapiens
cagaagggggccaugagg

SEQ ID NO: 633630 - RNA, 22 nt, Homo sapiens
cagaaggugccacuuuacccac

SEQ ID NO: 633631 - RNA, 21 nt, Homo sapiens
cagaaguuugagaucagccug

SEQ ID NO: 633632 - RNA, 21 nt, Homo sapiens
cagaauaauggaaacauuaca

SEQ ID NO: 633633 - RNA, 19 nt, Homo sapiens
cagaauacaguaagcugcu

SEQ ID NO: 633634 - RNA, 11 nt, Homo sapiens
cagaauacugg

SEQ ID NO: 633635 - RNA, 22 nt, Homo sapiens
cagaauaggaaaacauugcaau

SEQ ID NO: 633636 - RNA, 17 nt, Homo sapiens
cagaaucaaaugcaauu

SEQ ID NO: 633637 - RNA, 14 nt, Homo sapiens
cagaaucagaauca

SEQ ID NO: 633638 - RNA, 17 nt, Homo sapiens
cagaaucaguguuaaau

SEQ ID NO: 633639 - RNA, 17 nt, Homo sapiens
cugcuacuuaauuccuu

SEQ ID NO: 633640 - RNA, 13 nt, Homo sapiens
cagaauccugaug

SEQ ID NO: 633641 - RNA, 15 nt, Homo sapiens
cagaaucucaaauaa

SEQ ID NO: 633642 - RNA, 22 nt, Homo sapiens
cagaaugaacccauagggagcu

SEQ ID NO: 633643 - RNA, 18 nt, Homo sapiens
cagaaugaacccuccucc

SEQ ID NO: 633644 - RNA, 22 nt, Homo sapiens
cagaaugcacuugauucaggag

SEQ ID NO: 633645 - RNA, 18 nt, Homo sapiens
cagaaugcugcaggacuu

SEQ ID NO: 633646 - RNA, 13 nt, Homo sapiens
cagaauguaucug

SEQ ID NO: 633647 - RNA, 16 nt, Homo sapiens
cagaaugucaagccaa

SEQ ID NO: 633648 - RNA, 19 nt, Homo sapiens
cagaauguguuauuuguca

SEQ ID NO: 633649 - RNA, 19 nt, Homo sapiens
cagaauguuguacuugaaa

SEQ ID NO: 633650 - RNA, 22 nt, Homo sapiens
cagaauguuuuuaaaauaugag

SEQ ID NO: 633651 - RNA, 14 nt, Homo sapiens
cagaauuaagugga

SEQ ID NO: 633652 - RNA, 12 nt, Homo sapiens
cagaauuaugaa

SEQ ID NO: 633653 - RNA, 19 nt, Homo sapiens
cagaauuaugaagagguau

SEQ ID NO: 633654 - RNA, 16 nt, Homo sapiens
cagaauuggaaucaca

SEQ ID NO: 633655 - RNA, 19 nt, Homo sapiens
cagaauuugauucguauga

SEQ ID NO: 633656 - RNA, 22 nt, Homo sapiens
cagaauuugauucguaugauca

SEQ ID NO: 633657 - RNA, 15 nt, Homo sapiens
cagaauuuuuaacaa

SEQ ID NO: 633658 - RNA, 21 nt, Homo sapiens
cagacaaaguaauuccucuca

SEQ ID NO: 633659 - RNA, 12 nt, Homo sapiens
cagacaaaugga

SEQ ID NO: 633660 - RNA, 23 nt, Homo sapiens
cagacaacuucuguuucuucucu

SEQ ID NO: 633661 - RNA, 19 nt, Homo sapiens
cagacaacuuguccugacu

SEQ ID NO: 633662 - RNA, 21 nt, Homo sapiens
cagacaagaaugugcacucuc

SEQ ID NO: 633663 - RNA, 15 nt, Homo sapiens
cagacacaacccaau

SEQ ID NO: 633664 - RNA, 19 nt, Homo sapiens
cagacacacacacacacaa

SEQ ID NO: 633665 - RNA, 16 nt, Homo sapiens
cagacacagguguaga

SEQ ID NO: 633666 - RNA, 18 nt, Homo sapiens
cagacacaugcuauguuc

SEQ ID NO: 633667 - RNA, 11 nt, Homo sapiens
cagacaccagu

SEQ ID NO: 633668 - RNA, 16 nt, Homo sapiens
cagacaccuggacuga

SEQ ID NO: 633669 - RNA, 19 nt, Homo sapiens
cagacaccuggacugagcc

SEQ ID NO: 633670 - RNA, 19 nt, Homo sapiens
cagacacuaaaugcagaca

SEQ ID NO: 633671 - RNA, 20 nt, Homo sapiens
cagacacucugacuaccucc

SEQ ID NO: 633672 - RNA, 23 nt, Homo sapiens
cagacacugaccauccacucuac

SEQ ID NO: 633673 - RNA, 21 nt, Homo sapiens
cagacacuggcguuacugcuu

SEQ ID NO: 633674 - RNA, 16 nt, Homo sapiens
cagacagacaacacug

SEQ ID NO: 633675 - RNA, 13 nt, Homo sapiens
cagacagucacac

SEQ ID NO: 633676 - RNA, 19 nt, Homo sapiens
cagacauacauuuaugcac

SEQ ID NO: 633677 - RNA, 22 nt, Homo sapiens
cagacauacauuuaugcacauu

SEQ ID NO: 633678 - RNA, 21 nt, Homo sapiens
cagacaucuccagugugccag

SEQ ID NO: 633679 - RNA, 20 nt, Homo sapiens
cagacauucauugucccuga

SEQ ID NO: 633680 - RNA, 18 nt, Homo sapiens
cagaccacagagcuguca

SEQ ID NO: 633681 - RNA, 16 nt, Homo sapiens
cagaccacggcucgau

SEQ ID NO: 633682 - RNA, 16 nt, Homo sapiens
cagaccacugucucca

SEQ ID NO: 633683 - RNA, 22 nt, Homo sapiens
cagaccaguuucagagaaauac

SEQ ID NO: 633684 - RNA, 15 nt, Homo sapiens
cagaccauucaggac

SEQ ID NO: 633685 - RNA, 23 nt, Homo sapiens
cagaccauucaggacacagggaa

SEQ ID NO: 633686 - RNA, 23 nt, Homo sapiens
cagacccacugaaaugaccaaga

SEQ ID NO: 633687 - RNA, 22 nt, Homo sapiens
cagacccauaccuuuccagggu

SEQ ID NO: 633688 - RNA, 17 nt, Homo sapiens
cagaccccaaaccagcc

SEQ ID NO: 633689 - RNA, 17 nt, Homo sapiens
cagaccccguggcucug

SEQ ID NO: 633690 - RNA, 17 nt, Homo sapiens
cagacccuucaauggaa

SEQ ID NO: 633691 - RNA, 15 nt, Homo sapiens
cagaccucaagggac

SEQ ID NO: 633692 - RNA, 15 nt, Homo sapiens
cagacgggaaugccu

SEQ ID NO: 633693 - RNA, 16 nt, Homo sapiens
cagacgggcacacaga

SEQ ID NO: 633694 - RNA, 14 nt, Homo sapiens
cagacuacacagga

SEQ ID NO: 633695 - RNA, 16 nt, Homo sapiens
cagacucaaaugcuca

SEQ ID NO: 633696 - RNA, 14 nt, Homo sapiens
cagacucacuggga

SEQ ID NO: 633697 - RNA, 19 nt, Homo sapiens
cagacucagacuccauuug

SEQ ID NO: 633698 - RNA, 14 nt, Homo sapiens
cagacuccaaaagg

SEQ ID NO: 633699 - RNA, 12 nt, Homo sapiens
cagacuccaugg

SEQ ID NO: 633700 - RNA, 16 nt, Homo sapiens
cagacuccugugcaac

SEQ ID NO: 633701 - RNA, 18 nt, Homo sapiens
cagacucgggaccaauac

SEQ ID NO: 633702 - RNA, 15 nt, Homo sapiens
cagacucuucauuca

SEQ ID NO: 633703 - RNA, 13 nt, Homo sapiens
cagacugaaaaac

SEQ ID NO: 633704 - RNA, 20 nt, Homo sapiens
cagacugaacucgcagggaa

SEQ ID NO: 633705 - RNA, 16 nt, Homo sapiens
cagacugacaaaugug

SEQ ID NO: 633706 - RNA, 15 nt, Homo sapiens
cagacuggauuaaaa

SEQ ID NO: 633707 - RNA, 20 nt, Homo sapiens
cagacuggugggcuagccaa

SEQ ID NO: 633708 - RNA, 23 nt, Homo sapiens
cagacuguaagauguuguuuuag

SEQ ID NO: 633709 - RNA, 19 nt, Homo sapiens
cagacuucaagaccauccu

SEQ ID NO: 633710 - RNA, 17 nt, Homo sapiens
cagacuucacacugcaa

SEQ ID NO: 633711 - RNA, 13 nt, Homo sapiens
cagacuucagcug

SEQ ID NO: 633712 - RNA, 20 nt, Homo sapiens
cagacuucccugaauguauu

SEQ ID NO: 633713 - RNA, 14 nt, Homo sapiens
cagacuucuccaga

SEQ ID NO: 633714 - RNA, 22 nt, Homo sapiens
cagacuuggacuaugauuaucu

SEQ ID NO: 633715 - RNA, 21 nt, Homo sapiens
cagacuuuguguucauuucau

SEQ ID NO: 633716 - RNA, 21 nt, Homo sapiens
cagagaaaauaauuaauuuca

SEQ ID NO: 633717 - RNA, 15 nt, Homo sapiens
cagagaaaauuguga

SEQ ID NO: 633718 - RNA, 18 nt, Homo sapiens
cagagaaaggacugugga

SEQ ID NO: 633719 - RNA, 15 nt, Homo sapiens
cagagaaauucugug

SEQ ID NO: 633720 - RNA, 22 nt, Homo sapiens
cagagaacagucauguaugcaa

SEQ ID NO: 633721 - RNA, 16 nt, Homo sapiens
cagagaaccagugcag

SEQ ID NO: 633722 - RNA, 13 nt, Homo sapiens
cagagaagcugua

SEQ ID NO: 633723 - RNA, 21 nt, Homo sapiens
cagagaaguucuggcugaaca

SEQ ID NO: 633724 - RNA, 23 nt, Homo sapiens
cagagaaguugcugcuugugauc

SEQ ID NO: 633725 - RNA, 20 nt, Homo sapiens
cagagaauucucuuauccaa

SEQ ID NO: 633726 - RNA, 15 nt, Homo sapiens
cagagacagauaccu

SEQ ID NO: 633727 - RNA, 17 nt, Homo sapiens
cagagacagauaccucc

SEQ ID NO: 633728 - RNA, 19 nt, Homo sapiens
cagagacaggcccaagaga

SEQ ID NO: 633729 - RNA, 22 nt, Homo sapiens
cagagaccccaggaacaauaaa

SEQ ID NO: 633730 - RNA, 15 nt, Homo sapiens
cagagaccugaggca

SEQ ID NO: 633731 - RNA, 14 nt, Homo sapiens
cagagacuaucuga

SEQ ID NO: 633732 - RNA, 13 nt, Homo sapiens
cagagacuaugua

SEQ ID NO: 633733 - RNA, 19 nt, Homo sapiens
cagagacugcccuucucac

SEQ ID NO: 633734 - RNA, 21 nt, Homo sapiens
cagagagacagacuugagaac

SEQ ID NO: 633735 - RNA, 23 nt, Homo sapiens
cagagagcagcuucagugacaaa

SEQ ID NO: 633736 - RNA, 21 nt, Homo sapiens
cagagagcagcuuuaaacuca

SEQ ID NO: 633737 - RNA, 19 nt, Homo sapiens
cagagagccuagaacaucc

SEQ ID NO: 633738 - RNA, 21 nt, Homo sapiens
cagagagcugcccuucagcga

SEQ ID NO: 633739 - RNA, 17 nt, Homo sapiens
cagagaggcucugagaa

SEQ ID NO: 633740 - RNA, 13 nt, Homo sapiens
cagagagggccca

SEQ ID NO: 633741 - RNA, 20 nt, Homo sapiens
cagagaguccugugcugaau

SEQ ID NO: 633742 - RNA, 21 nt, Homo sapiens
cagagaguguacaucauguua

SEQ ID NO: 633743 - RNA, 14 nt, Homo sapiens
cagagauacacaga

SEQ ID NO: 633744 - RNA, 16 nt, Homo sapiens
cagagauaccauucaa

SEQ ID NO: 633745 - RNA, 20 nt, Homo sapiens
cagagaucgagaccauccua

SEQ ID NO: 633746 - RNA, 20 nt, Homo sapiens
cagagaucguguauugagau

SEQ ID NO: 633747 - RNA, 18 nt, Homo sapiens
cagagaugaaacuauggc

SEQ ID NO: 633748 - RNA, 13 nt, Homo sapiens
cagagaugacugu

SEQ ID NO: 633749 - RNA, 22 nt, Homo sapiens
cagagaugcaugcgcaggcuca

SEQ ID NO: 633750 - RNA, 19 nt, Homo sapiens
cagagcaagcgcuguaaac

SEQ ID NO: 633751 - RNA, 13 nt, Homo sapiens
cagagcacagccc

SEQ ID NO: 633752 - RNA, 17 nt, Homo sapiens
cagagcacauuugucag

SEQ ID NO: 633753 - RNA, 13 nt, Homo sapiens
cagagcagagccu

SEQ ID NO: 633754 - RNA, 22 nt, Homo sapiens
cagagcaggggcuccagcaccu

SEQ ID NO: 633755 - RNA, 12 nt, Homo sapiens
cagagccagaaa

SEQ ID NO: 633756 - RNA, 12 nt, Homo sapiens
cagagccaguga

SEQ ID NO: 633757 - RNA, 18 nt, Homo sapiens
cagagccaugccaggcug

SEQ ID NO: 633758 - RNA, 23 nt, Homo sapiens
cagagccauggucccaggcuucc

SEQ ID NO: 633759 - RNA, 15 nt, Homo sapiens
cagagccccacuccc

SEQ ID NO: 633760 - RNA, 11 nt, Homo sapiens
cuggacuguca

SEQ ID NO: 633761 - RNA, 20 nt, Homo sapiens
cuggagaagaauggcuuuca

SEQ ID NO: 633762 - RNA, 22 nt, Homo sapiens
cuggagacccguagaugccagg

SEQ ID NO: 633763 - RNA, 17 nt, Homo sapiens
cuggagacguggaaccu

SEQ ID NO: 633764 - RNA, 12 nt, Homo sapiens
cuggagauccuc

SEQ ID NO: 633765 - RNA, 15 nt, Homo sapiens
cuggagcaguggacu

SEQ ID NO: 633766 - RNA, 17 nt, Homo sapiens
cuggagccaaguccaga

SEQ ID NO: 633767 - RNA, 12 nt, Homo sapiens
cuggagcccaca

SEQ ID NO: 633768 - RNA, 22 nt, Homo sapiens
cuggagcggggaucugaugaaa

SEQ ID NO: 633769 - RNA, 23 nt, Homo sapiens
cuggagcuggcgucugucuucaa

SEQ ID NO: 633770 - RNA, 15 nt, Homo sapiens
cuggaggaacacuug

SEQ ID NO: 633771 - RNA, 17 nt, Homo sapiens
cuggaggccaaggugug

SEQ ID NO: 633772 - RNA, 20 nt, Homo sapiens
cuggagggaggggugagaua

SEQ ID NO: 633773 - RNA, 22 nt, Homo sapiens
cuggaggguaacuggggggcca

SEQ ID NO: 633774 - RNA, 20 nt, Homo sapiens
cuggaguacaguggcacgau

SEQ ID NO: 633775 - RNA, 14 nt, Homo sapiens
cuggaguccagugc

SEQ ID NO: 633776 - RNA, 21 nt, Homo sapiens
cuggagucccaaaugucauca

SEQ ID NO: 633777 - RNA, 13 nt, Homo sapiens
cuggagugcaaug

SEQ ID NO: 633778 - RNA, 22 nt, Homo sapiens
cuggagugcagugagcuauuac

SEQ ID NO: 633779 - RNA, 20 nt, Homo sapiens
cuggagugcagugaugcaau

SEQ ID NO: 633780 - RNA, 17 nt, Homo sapiens
cuggagugcagugccac

SEQ ID NO: 633781 - RNA, 18 nt, Homo sapiens
cuggagugcaguggcaca

SEQ ID NO: 633782 - RNA, 20 nt, Homo sapiens
cuggagugcaguggcgcaau

SEQ ID NO: 633783 - RNA, 20 nt, Homo sapiens
cuggagugcaguggcgugau

SEQ ID NO: 633784 - RNA, 21 nt, Homo sapiens
cuggagugcaguggugugauc

SEQ ID NO: 633785 - RNA, 20 nt, Homo sapiens
cuggagugcgguggcgcaau

SEQ ID NO: 633786 - RNA, 14 nt, Homo sapiens
cuggagugcugcuu

SEQ ID NO: 633787 - RNA, 18 nt, Homo sapiens
cuggaguggccacuaagc

SEQ ID NO: 633788 - RNA, 20 nt, Homo sapiens
cuggaguguaguggcgcgau

SEQ ID NO: 633789 - RNA, 21 nt, Homo sapiens
cuggaguuucauguacaagau

SEQ ID NO: 633790 - RNA, 13 nt, Homo sapiens
cuggauaaaccac

SEQ ID NO: 633791 - RNA, 21 nt, Homo sapiens
cuggauaacuuagguggcaag

SEQ ID NO: 633792 - RNA, 14 nt, Homo sapiens
cuggauauaaugua

SEQ ID NO: 633793 - RNA, 19 nt, Homo sapiens
cuggaucacagacacugca

SEQ ID NO: 633794 - RNA, 18 nt, Homo sapiens
cuggaucacgacgcugca

SEQ ID NO: 633795 - RNA, 21 nt, Homo sapiens
cuggaucccgagguauggcag

SEQ ID NO: 633796 - RNA, 17 nt, Homo sapiens
cuggaucuauguguaug

SEQ ID NO: 633797 - RNA, 21 nt, Homo sapiens
cuggaucuugccuaaauccca

SEQ ID NO: 633798 - RNA, 13 nt, Homo sapiens
cuggauggcacca

SEQ ID NO: 633799 - RNA, 20 nt, Homo sapiens
cuggauggccccuccuugca

SEQ ID NO: 633800 - RNA, 19 nt, Homo sapiens
cuggaugguccucuuacca

SEQ ID NO: 633801 - RNA, 17 nt, Homo sapiens
cuggaugugggccaagu

SEQ ID NO: 633802 - RNA, 13 nt, Homo sapiens
cuggauucauuuc

SEQ ID NO: 633803 - RNA, 15 nt, Homo sapiens
cuggauucgugacaa

SEQ ID NO: 633804 - RNA, 14 nt, Homo sapiens
cuggauugggacgc

SEQ ID NO: 633805 - RNA, 18 nt, Homo sapiens
cuggauuucauacuguaa

SEQ ID NO: 633806 - RNA, 23 nt, Homo sapiens
cuggcaaaaucuuguuaauguca

SEQ ID NO: 633807 - RNA, 22 nt, Homo sapiens
cuggcaacaaaaaguaaugaag

SEQ ID NO: 633808 - RNA, 15 nt, Homo sapiens
cuggcaacacagagg

SEQ ID NO: 633809 - RNA, 14 nt, Homo sapiens
cuggcaacaucuuu

SEQ ID NO: 633810 - RNA, 14 nt, Homo sapiens
cuggcaacaugaag

SEQ ID NO: 633811 - RNA, 15 nt, Homo sapiens
cuggcaagaaagcuu

SEQ ID NO: 633812 - RNA, 19 nt, Homo sapiens
cuggcaagccugucuucag

SEQ ID NO: 633813 - RNA, 17 nt, Homo sapiens
cuggcaagucaccugca

SEQ ID NO: 633814 - RNA, 15 nt, Homo sapiens
cuggcaauaaacucc

SEQ ID NO: 633815 - RNA, 18 nt, Homo sapiens
cuggcaauaaacuuuuag

SEQ ID NO: 633816 - RNA, 19 nt, Homo sapiens
cuggcaaugggacucugag

SEQ ID NO: 633817 - RNA, 22 nt, Homo sapiens
cuggcacaguguaauccagggg

SEQ ID NO: 633818 - RNA, 19 nt, Homo sapiens
cuggcacgcccuacuccac

SEQ ID NO: 633819 - RNA, 20 nt, Homo sapiens
cuggcacuuagcccaagagg

SEQ ID NO: 633820 - RNA, 21 nt, Homo sapiens
cuggcagaaacaggaggcucc

SEQ ID NO: 633821 - RNA, 15 nt, Homo sapiens
cuggcagacugagga

SEQ ID NO: 633822 - RNA, 18 nt, Homo sapiens
cuggcagggccaccugca

SEQ ID NO: 633823 - RNA, 19 nt, Homo sapiens
cuggcagggcucacacucc

SEQ ID NO: 633824 - RNA, 15 nt, Homo sapiens
cuggcaucucacuuu

SEQ ID NO: 633825 - RNA, 16 nt, Homo sapiens
cuggcaugacacucua

SEQ ID NO: 633826 - RNA, 17 nt, Homo sapiens
cuggcauuacaauugca

SEQ ID NO: 633827 - RNA, 19 nt, Homo sapiens
cuggcauuugcaccuaccu

SEQ ID NO: 633828 - RNA, 17 nt, Homo sapiens
cuggccaaauaugcacu

SEQ ID NO: 633829 - RNA, 20 nt, Homo sapiens
cuggccaaauaugcacuuuc

SEQ ID NO: 633830 - RNA, 13 nt, Homo sapiens
cuggccaccagcc

SEQ ID NO: 633831 - RNA, 14 nt, Homo sapiens
cuggccacugucaa

SEQ ID NO: 633832 - RNA, 21 nt, Homo sapiens
cuggccagacaagaagacugu

SEQ ID NO: 633833 - RNA, 12 nt, Homo sapiens
cuggccagagag

SEQ ID NO: 633834 - RNA, 20 nt, Homo sapiens
cuggccagcaaggcagguug

SEQ ID NO: 633835 - RNA, 19 nt, Homo sapiens
cuggccaguccugguccug

SEQ ID NO: 633836 - RNA, 12 nt, Homo sapiens
cuggccaugaau

SEQ ID NO: 633837 - RNA, 15 nt, Homo sapiens
cuggccaugcugucc

SEQ ID NO: 633838 - RNA, 18 nt, Homo sapiens
cuggcccagggccugaaa

SEQ ID NO: 633839 - RNA, 15 nt, Homo sapiens
cuggcccauucuuga

SEQ ID NO: 633840 - RNA, 23 nt, Homo sapiens
cuggcccucgacacucaccauga

SEQ ID NO: 633841 - RNA, 19 nt, Homo sapiens
cuggcccucuguggucaca

SEQ ID NO: 633842 - RNA, 13 nt, Homo sapiens
cuggcccuugcaa

SEQ ID NO: 633843 - RNA, 16 nt, Homo sapiens
cuggcccuugcuuacc

SEQ ID NO: 633844 - RNA, 22 nt, Homo sapiens
cuggccgccacccccaucuucc

SEQ ID NO: 633845 - RNA, 18 nt, Homo sapiens
cuggccucaagugagcca

SEQ ID NO: 633846 - RNA, 20 nt, Homo sapiens
cuggccucucuagcacaauu

SEQ ID NO: 633847 - RNA, 15 nt, Homo sapiens
cuggccucugcugaa

SEQ ID NO: 633848 - RNA, 20 nt, Homo sapiens
cuggccuuccccuccaaaac

SEQ ID NO: 633849 - RNA, 19 nt, Homo sapiens
cuggccuugguaugugcca

SEQ ID NO: 633850 - RNA, 21 nt, Homo sapiens
cuggccuugguaugugccagg

SEQ ID NO: 633851 - RNA, 20 nt, Homo sapiens
cuggccuuuguaagugcagg

SEQ ID NO: 633852 - RNA, 16 nt, Homo sapiens
cuggcguucucaagaa

SEQ ID NO: 633853 - RNA, 16 nt, Homo sapiens
cuggcuaacacgguga

SEQ ID NO: 633854 - RNA, 16 nt, Homo sapiens
cuggcucaugccucag

SEQ ID NO: 633855 - RNA, 14 nt, Homo sapiens
cuggcucucuccag

SEQ ID NO: 633856 - RNA, 20 nt, Homo sapiens
cuggcucugcccccuccccc

SEQ ID NO: 633857 - RNA, 21 nt, Homo sapiens
cuggcucugccccucaggggg

SEQ ID NO: 633858 - RNA, 13 nt, Homo sapiens
cuggcugagcuga

SEQ ID NO: 633859 - RNA, 19 nt, Homo sapiens
cuggcugaugauccagaac

SEQ ID NO: 633860 - RNA, 13 nt, Homo sapiens
cuggcugcaguga

SEQ ID NO: 633861 - RNA, 17 nt, Homo sapiens
cuggcugcuuuguucaa

SEQ ID NO: 633862 - RNA, 19 nt, Homo sapiens
cuggcugggccccugggga

SEQ ID NO: 633863 - RNA, 18 nt, Homo sapiens
cuggcuggggccuguuga

SEQ ID NO: 633864 - RNA, 20 nt, Homo sapiens
cuggcugucaguaugacauu

SEQ ID NO: 633865 - RNA, 18 nt, Homo sapiens
cuggcuguguggccaagg

SEQ ID NO: 633866 - RNA, 15 nt, Homo sapiens
cuggcuucacucucc

SEQ ID NO: 633867 - RNA, 21 nt, Homo sapiens
cuggcuuccuuggcuugccug

SEQ ID NO: 633868 - RNA, 15 nt, Homo sapiens
cuggcuuuccagcuu

SEQ ID NO: 633869 - RNA, 17 nt, Homo sapiens
cuggcuuugcucuauua

SEQ ID NO: 633870 - RNA, 23 nt, Homo sapiens
cugggaaaaaaguuuugaugaaa

SEQ ID NO: 633871 - RNA, 14 nt, Homo sapiens
cugggaaagacauc

SEQ ID NO: 633872 - RNA, 14 nt, Homo sapiens
cugggaaccuagca

SEQ ID NO: 633873 - RNA, 22 nt, Homo sapiens
cugggaagacgccugagcucac

SEQ ID NO: 633874 - RNA, 15 nt, Homo sapiens
cugggaauggaauaa

SEQ ID NO: 633875 - RNA, 13 nt, Homo sapiens
cugggaauggagg

SEQ ID NO: 633876 - RNA, 18 nt, Homo sapiens
cugggacacuuaacagau

SEQ ID NO: 633877 - RNA, 17 nt, Homo sapiens
cugggacaggcuuugau

SEQ ID NO: 633878 - RNA, 16 nt, Homo sapiens
cugggagaaccucagg

SEQ ID NO: 633879 - RNA, 17 nt, Homo sapiens
cugggagaaccucaggc

SEQ ID NO: 633880 - RNA, 16 nt, Homo sapiens
cugggagacugaagac

SEQ ID NO: 633881 - RNA, 22 nt, Homo sapiens
cugggagacuuugaagaccagu

SEQ ID NO: 633882 - RNA, 18 nt, Homo sapiens
cagauguuggaccaacac

SEQ ID NO: 633883 - RNA, 17 nt, Homo sapiens
cagauguuuuggucaag

SEQ ID NO: 633884 - RNA, 18 nt, Homo sapiens
cagauuaagaguugccaa

SEQ ID NO: 633885 - RNA, 20 nt, Homo sapiens
cagauuauccuuccuccuca

SEQ ID NO: 633886 - RNA, 21 nt, Homo sapiens
cugggaguguccuuaguguau

SEQ ID NO: 633887 - RNA, 18 nt, Homo sapiens
cugggauauggcugccca

SEQ ID NO: 633888 - RNA, 22 nt, Homo sapiens
cugggaugacaggugugagcca

SEQ ID NO: 633889 - RNA, 18 nt, Homo sapiens
cugggauggaggggagug

SEQ ID NO: 633890 - RNA, 22 nt, Homo sapiens
cugggauuacaggcaugugcca

SEQ ID NO: 633891 - RNA, 17 nt, Homo sapiens
cugggauuacaggugug

SEQ ID NO: 633892 - RNA, 21 nt, Homo sapiens
cugggauuacaggugugagcc

SEQ ID NO: 633893 - RNA, 22 nt, Homo sapiens
cugggauuauaggcaugagcca

SEQ ID NO: 633894 - RNA, 19 nt, Homo sapiens
cugggauucccaccaaggu

SEQ ID NO: 633895 - RNA, 18 nt, Homo sapiens
cugggauugggaaggagu

SEQ ID NO: 633896 - RNA, 13 nt, Homo sapiens
cugggcaaucaga

SEQ ID NO: 633897 - RNA, 14 nt, Homo sapiens
cugggcacagucag

SEQ ID NO: 633898 - RNA, 15 nt, Homo sapiens
cugggcacaguggac

SEQ ID NO: 633899 - RNA, 13 nt, Homo sapiens
cugggcaccaccu

SEQ ID NO: 633900 - RNA, 14 nt, Homo sapiens
cugggcagcauagc

SEQ ID NO: 633901 - RNA, 14 nt, Homo sapiens
cugggcauuucacg

SEQ ID NO: 633902 - RNA, 21 nt, Homo sapiens
cugggcauuuggugagaguca

SEQ ID NO: 633903 - RNA, 15 nt, Homo sapiens
cugggccacugggga

SEQ ID NO: 633904 - RNA, 14 nt, Homo sapiens
cugggccagggucu

SEQ ID NO: 633905 - RNA, 11 nt, Homo sapiens
cugggccagug

SEQ ID NO: 633906 - RNA, 21 nt, Homo sapiens
cugggccaugcgaggggccag

SEQ ID NO: 633907 - RNA, 13 nt, Homo sapiens
cugggccaugucc

SEQ ID NO: 633908 - RNA, 22 nt, Homo sapiens
cugggccauucuccacagcaac

SEQ ID NO: 633909 - RNA, 17 nt, Homo sapiens
cugggccccacuggaca

SEQ ID NO: 633910 - RNA, 22 nt, Homo sapiens
cugggcccggaagggcuuuggu

SEQ ID NO: 633911 - RNA, 16 nt, Homo sapiens
cugggcccuugugcuc

SEQ ID NO: 633912 - RNA, 15 nt, Homo sapiens
cugggccucaguuca

SEQ ID NO: 633913 - RNA, 13 nt, Homo sapiens
cugggccugaugg

SEQ ID NO: 633914 - RNA, 16 nt, Homo sapiens
cugggccugugcagca

SEQ ID NO: 633915 - RNA, 14 nt, Homo sapiens
cugggccuucucac

SEQ ID NO: 633916 - RNA, 14 nt, Homo sapiens
cugggcuacaauuu

SEQ ID NO: 633917 - RNA, 14 nt, Homo sapiens
cugggcucaagcaa

SEQ ID NO: 633918 - RNA, 17 nt, Homo sapiens
cugggcucaagugaucc

SEQ ID NO: 633919 - RNA, 17 nt, Homo sapiens
cugggcucacugugcug

SEQ ID NO: 633920 - RNA, 16 nt, Homo sapiens
cugggcucagccugag

SEQ ID NO: 633921 - RNA, 13 nt, Homo sapiens
cugggcucugcca

SEQ ID NO: 633922 - RNA, 22 nt, Homo sapiens
cugggcugauggaagauggucc

SEQ ID NO: 633923 - RNA, 17 nt, Homo sapiens
cugggcugccaccagcc

SEQ ID NO: 633924 - RNA, 17 nt, Homo sapiens
cugggcuggacuggcca

SEQ ID NO: 633925 - RNA, 15 nt, Homo sapiens
cugggcuugucugua

SEQ ID NO: 633926 - RNA, 19 nt, Homo sapiens
cugggcuuugucaugucuc

SEQ ID NO: 633927 - RNA, 20 nt, Homo sapiens
cuggggaagagaaaagccca

SEQ ID NO: 633928 - RNA, 19 nt, Homo sapiens
cuggggaauauacgugcuu

SEQ ID NO: 633929 - RNA, 18 nt, Homo sapiens
cuggggacagcuuccuca

SEQ ID NO: 633930 - RNA, 14 nt, Homo sapiens
cuggggaggugaac

SEQ ID NO: 633931 - RNA, 16 nt, Homo sapiens
cuggggaggugaacug

SEQ ID NO: 633932 - RNA, 15 nt, Homo sapiens
cuggggaucuugccc

SEQ ID NO: 633933 - RNA, 19 nt, Homo sapiens
cuggggauggaauuauugu

SEQ ID NO: 633934 - RNA, 18 nt, Homo sapiens
cuggggaugguaggauug

SEQ ID NO: 633935 - RNA, 15 nt, Homo sapiens
cuggggcaaugggag

SEQ ID NO: 633936 - RNA, 17 nt, Homo sapiens
cuggggcagaaacacuc

SEQ ID NO: 633937 - RNA, 15 nt, Homo sapiens
cuggggcaggucacu

SEQ ID NO: 633938 - RNA, 18 nt, Homo sapiens
cuggggcaggucacuuua

SEQ ID NO: 633939 - RNA, 16 nt, Homo sapiens
cuggggcauccugugc

SEQ ID NO: 633940 - RNA, 18 nt, Homo sapiens
cuggggccccaucuugau

SEQ ID NO: 633941 - RNA, 14 nt, Homo sapiens
cuggggcucugugc

SEQ ID NO: 633942 - RNA, 19 nt, Homo sapiens
cuggggcuuguccugugcu

SEQ ID NO: 633943 - RNA, 18 nt, Homo sapiens
cugggggagguccaagca

SEQ ID NO: 633944 - RNA, 11 nt, Homo sapiens
cugggggaguu

SEQ ID NO: 633945 - RNA, 13 nt, Homo sapiens
cugggggccaagg

SEQ ID NO: 633946 - RNA, 14 nt, Homo sapiens
cugggggccaugag

SEQ ID NO: 633947 - RNA, 21 nt, Homo sapiens
cuggggguuuuguuuuugcuu

SEQ ID NO: 633948 - RNA, 19 nt, Homo sapiens
cuggggucaggugccacug

SEQ ID NO: 633949 - RNA, 17 nt, Homo sapiens
cuggggucccucugaag

SEQ ID NO: 633950 - RNA, 16 nt, Homo sapiens
cuggggucuccgaaga

SEQ ID NO: 633951 - RNA, 14 nt, Homo sapiens
cugggguugagggc

SEQ ID NO: 633952 - RNA, 17 nt, Homo sapiens
cugggucaugcacugag

SEQ ID NO: 633953 - RNA, 18 nt, Homo sapiens
cugggugagaauccugcc

SEQ ID NO: 633954 - RNA, 13 nt, Homo sapiens
cugggugagcucu

SEQ ID NO: 633955 - RNA, 22 nt, Homo sapiens
cugggugggugggguacaggca

SEQ ID NO: 633956 - RNA, 15 nt, Homo sapiens
cuggguggguggugg

SEQ ID NO: 633957 - RNA, 20 nt, Homo sapiens
cuggguuaauggcuaguacu

SEQ ID NO: 633958 - RNA, 22 nt, Homo sapiens
cuggguucuggggcaucagcca

SEQ ID NO: 633959 - RNA, 20 nt, Homo sapiens
cuggguugaucuagaugucu

SEQ ID NO: 633960 - RNA, 21 nt, Homo sapiens
cuggguugggggcuagggaga

SEQ ID NO: 633961 - RNA, 17 nt, Homo sapiens
cuggguuucucuguaua

SEQ ID NO: 633962 - RNA, 18 nt, Homo sapiens
cuggguuugcccaguccu

SEQ ID NO: 633963 - RNA, 21 nt, Homo sapiens
cugguaacaguucauguuugc

SEQ ID NO: 633964 - RNA, 22 nt, Homo sapiens
cugguaauauugacuuguauau

SEQ ID NO: 633965 - RNA, 18 nt, Homo sapiens
cugguacaguaugggggu

SEQ ID NO: 633966 - RNA, 16 nt, Homo sapiens
cugguagaaauaccca

SEQ ID NO: 633967 - RNA, 13 nt, Homo sapiens
cugguagcacuug

SEQ ID NO: 633968 - RNA, 15 nt, Homo sapiens
cugguagcugagggg

SEQ ID NO: 633969 - RNA, 20 nt, Homo sapiens
cugguagggauauggcagga

SEQ ID NO: 633970 - RNA, 15 nt, Homo sapiens
cugguauauaaucca

SEQ ID NO: 633971 - RNA, 16 nt, Homo sapiens
cugguauauccaaaag

SEQ ID NO: 633972 - RNA, 20 nt, Homo sapiens
cugguauauguaaguguuca

SEQ ID NO: 633973 - RNA, 15 nt, Homo sapiens
cugguauguguggau

SEQ ID NO: 633974 - RNA, 19 nt, Homo sapiens
cugguauuaacuuuauaca

SEQ ID NO: 633975 - RNA, 21 nt, Homo sapiens
cuggucagcauguacuccccu

SEQ ID NO: 633976 - RNA, 23 nt, Homo sapiens
cuggucagucugcccuugucacu

SEQ ID NO: 633977 - RNA, 21 nt, Homo sapiens
cugguccacugggaacucaaa

SEQ ID NO: 633978 - RNA, 21 nt, Homo sapiens
cugguccaugcagggggcucc

SEQ ID NO: 633979 - RNA, 16 nt, Homo sapiens
cuggucccaagacagu

SEQ ID NO: 633980 - RNA, 21 nt, Homo sapiens
cuggucccggggccagcacuu

SEQ ID NO: 633981 - RNA, 19 nt, Homo sapiens
cugguccuagguccucuga

SEQ ID NO: 633982 - RNA, 14 nt, Homo sapiens
cuggucuucaauua

SEQ ID NO: 633983 - RNA, 19 nt, Homo sapiens
cuggucuuccaggcacuca

SEQ ID NO: 633984 - RNA, 16 nt, Homo sapiens
cuggucuuuucuccua

SEQ ID NO: 633985 - RNA, 18 nt, Homo sapiens
cuggugaacacugugacc

SEQ ID NO: 633986 - RNA, 15 nt, Homo sapiens
cuggugacagccuug

SEQ ID NO: 633987 - RNA, 14 nt, Homo sapiens
cuggugacaggcca

SEQ ID NO: 633988 - RNA, 16 nt, Homo sapiens
cuggugacaggccaaa

SEQ ID NO: 633989 - RNA, 23 nt, Homo sapiens
cuggugcaauuacagcaaaaagg

SEQ ID NO: 633990 - RNA, 16 nt, Homo sapiens
cuggugcccagcacau

SEQ ID NO: 633991 - RNA, 17 nt, Homo sapiens
cuggugccccacugaau

SEQ ID NO: 633992 - RNA, 18 nt, Homo sapiens
cuggugccccuuugcccg

SEQ ID NO: 633993 - RNA, 18 nt, Homo sapiens
cuggugcuacuugcuuga

SEQ ID NO: 633994 - RNA, 11 nt, Homo sapiens
cuggugcugcc

SEQ ID NO: 633995 - RNA, 15 nt, Homo sapiens
cugguggcacaggag

SEQ ID NO: 633996 - RNA, 22 nt, Homo sapiens
cugguggcacaggaguguccuc

SEQ ID NO: 633997 - RNA, 16 nt, Homo sapiens
cuggugggucuuuaau

SEQ ID NO: 633998 - RNA, 13 nt, Homo sapiens
cugguggugcugc

SEQ ID NO: 633999 - RNA, 12 nt, Homo sapiens
cugguguccuga

SEQ ID NO: 634000 - RNA, 16 nt, Homo sapiens
cuggugugaagguccu

SEQ ID NO: 634001 - RNA, 15 nt, Homo sapiens
cuggugugcucucuu

SEQ ID NO: 634002 - RNA, 13 nt, Homo sapiens
cugguuagguaga

SEQ ID NO: 634003 - RNA, 16 nt, Homo sapiens
cugguuagugugaaau

SEQ ID NO: 634004 - RNA, 13 nt, Homo sapiens
caguacaacaguu

SEQ ID NO: 634005 - RNA, 20 nt, Homo sapiens
caguacagcaugugccuuaa

SEQ ID NO: 634006 - RNA, 19 nt, Homo sapiens
caguacaggggugcugcag

SEQ ID NO: 634007 - RNA, 16 nt, Homo sapiens
caguaccuagcuggcu

SEQ ID NO: 634008 - RNA, 16 nt, Homo sapiens
caguaccuagcuguaa

SEQ ID NO: 634009 - RNA, 14 nt, Homo sapiens
caguacgauuugca

SEQ ID NO: 634010 - RNA, 16 nt, Homo sapiens
caguacuaaugaagug

SEQ ID NO: 634011 - RNA, 14 nt, Homo sapiens
caguacucacuuuu

SEQ ID NO: 634012 - RNA, 16 nt, Homo sapiens
caguacugaagacucu

SEQ ID NO: 634013 - RNA, 12 nt, Homo sapiens
caguacugggag

SEQ ID NO: 634014 - RNA, 21 nt, Homo sapiens
caguacuguugguuaaaugac

SEQ ID NO: 634015 - RNA, 14 nt, Homo sapiens
caguacuguuucaa

SEQ ID NO: 634016 - RNA, 21 nt, Homo sapiens
caguacuugucauauguagcc

SEQ ID NO: 634017 - RNA, 19 nt, Homo sapiens
caguagagcaaaucuauga

SEQ ID NO: 634018 - RNA, 14 nt, Homo sapiens
caguagaugugcuu

SEQ ID NO: 634019 - RNA, 19 nt, Homo sapiens
caguagcaaacuuuucaca

SEQ ID NO: 634020 - RNA, 17 nt, Homo sapiens
caguagcacaaguuauu

SEQ ID NO: 634021 - RNA, 12 nt, Homo sapiens
caguagcugcua

SEQ ID NO: 634022 - RNA, 16 nt, Homo sapiens
caguagcuguggugag

SEQ ID NO: 634023 - RNA, 13 nt, Homo sapiens
cuguuagguccau

SEQ ID NO: 634024 - RNA, 15 nt, Homo sapiens
cuguuauauaucucu

SEQ ID NO: 634025 - RNA, 15 nt, Homo sapiens
cuguuaucugcuaga

SEQ ID NO: 634026 - RNA, 17 nt, Homo sapiens
cuguuaugucagaggaa

SEQ ID NO: 634027 - RNA, 16 nt, Homo sapiens
cuguucaaagcugccu

SEQ ID NO: 634028 - RNA, 17 nt, Homo sapiens
cuguucagagcacucau

SEQ ID NO: 634029 - RNA, 17 nt, Homo sapiens
cuguucagcugguugag

SEQ ID NO: 634030 - RNA, 22 nt, Homo sapiens
cuguucaucaccagucuguaaa

SEQ ID NO: 634031 - RNA, 19 nt, Homo sapiens
cuguucauuguaagcacuu

SEQ ID NO: 634032 - RNA, 20 nt, Homo sapiens
cuguucauuguaagcacuuu

SEQ ID NO: 634033 - RNA, 21 nt, Homo sapiens
cuguuccagucacauugccau

SEQ ID NO: 634034 - RNA, 21 nt, Homo sapiens
cuguucccccacccuccaugc

SEQ ID NO: 634035 - RNA, 17 nt, Homo sapiens
cuguuccccugcucugu

SEQ ID NO: 634036 - RNA, 18 nt, Homo sapiens
cuguucccuugcaggggu

SEQ ID NO: 634037 - RNA, 15 nt, Homo sapiens
cuguucccuugccau

SEQ ID NO: 634038 - RNA, 16 nt, Homo sapiens
cuguucccuugccauc

SEQ ID NO: 634039 - RNA, 16 nt, Homo sapiens
cuguucuaacauguaa

SEQ ID NO: 634040 - RNA, 21 nt, Homo sapiens
cuguucuaccaagaacugaag

SEQ ID NO: 634041 - RNA, 20 nt, Homo sapiens
cuguucugggggacagagaa

SEQ ID NO: 634042 - RNA, 21 nt, Homo sapiens
cuguucuguagcuuucuggaa

SEQ ID NO: 634043 - RNA, 22 nt, Homo sapiens
cuguucuguuggaugacuuuga

SEQ ID NO: 634044 - RNA, 21 nt, Homo sapiens
cuguucuguuuggcacuugua

SEQ ID NO: 634045 - RNA, 22 nt, Homo sapiens
cuguucuuagaguguagcugua

SEQ ID NO: 634046 - RNA, 15 nt, Homo sapiens
cuguucuuuccaaag

SEQ ID NO: 634047 - RNA, 14 nt, Homo sapiens
cuguucuuucuggc

SEQ ID NO: 634048 - RNA, 18 nt, Homo sapiens
cuguugaaucugagcugc

SEQ ID NO: 634049 - RNA, 22 nt, Homo sapiens
cuguugaauuauguuuugacac

SEQ ID NO: 634050 - RNA, 13 nt, Homo sapiens
cuguugacauauu

SEQ ID NO: 634051 - RNA, 12 nt, Homo sapiens
cuguugagaaaa

SEQ ID NO: 634052 - RNA, 19 nt, Homo sapiens
cuguugagacugauucaga

SEQ ID NO: 634053 - RNA, 23 nt, Homo sapiens
cuguugagguggcuguagauggu

SEQ ID NO: 634054 - RNA, 22 nt, Homo sapiens
cuguugauguaucugaguugcc

SEQ ID NO: 634055 - RNA, 20 nt, Homo sapiens
cuguugauuucuuuccagag

SEQ ID NO: 634056 - RNA, 12 nt, Homo sapiens
cuguugcugaaa

SEQ ID NO: 634057 - RNA, 14 nt, Homo sapiens
cuguugcuuuacag

SEQ ID NO: 634058 - RNA, 14 nt, Homo sapiens
cuguuggucugucc

SEQ ID NO: 634059 - RNA, 18 nt, Homo sapiens
cuguugguuaaaugacaa

SEQ ID NO: 634060 - RNA, 15 nt, Homo sapiens
cuguuguaauagucc

SEQ ID NO: 634061 - RNA, 20 nt, Homo sapiens
cuguuguaggguugccagau

SEQ ID NO: 634062 - RNA, 15 nt, Homo sapiens
cuguugucauugcug

SEQ ID NO: 634063 - RNA, 20 nt, Homo sapiens
cuguuguuccauuuuaugca

SEQ ID NO: 634064 - RNA, 20 nt, Homo sapiens
cuguuguuuggacuguaaca

SEQ ID NO: 634065 - RNA, 13 nt, Homo sapiens
cuguuuaacauuu

SEQ ID NO: 634066 - RNA, 19 nt, Homo sapiens
cuguuuaacauuuccucag

SEQ ID NO: 634067 - RNA, 17 nt, Homo sapiens
cuguuuaguuuuacacu

SEQ ID NO: 634068 - RNA, 19 nt, Homo sapiens
cuguuuauuacuuccauga

SEQ ID NO: 634069 - RNA, 16 nt, Homo sapiens
cuguuucacuugcucu

SEQ ID NO: 634070 - RNA, 12 nt, Homo sapiens
cuguuucauuca

SEQ ID NO: 634071 - RNA, 21 nt, Homo sapiens
cuguuuccucuugaucucaaa

SEQ ID NO: 634072 - RNA, 17 nt, Homo sapiens
cuguuucugcuugcucu

SEQ ID NO: 634073 - RNA, 13 nt, Homo sapiens
cuguuucuguaua

SEQ ID NO: 634074 - RNA, 22 nt, Homo sapiens
cuguuucuucaaugguucucuu

SEQ ID NO: 634075 - RNA, 13 nt, Homo sapiens
cuguuucuugcac

SEQ ID NO: 634076 - RNA, 21 nt, Homo sapiens
cuguuugaugcuauuuaugca

SEQ ID NO: 634077 - RNA, 21 nt, Homo sapiens
cuguuugccaagcugaagcua

SEQ ID NO: 634078 - RNA, 17 nt, Homo sapiens
cuguuuggcacuuguau

SEQ ID NO: 634079 - RNA, 20 nt, Homo sapiens
cuguuuguaaauuauuugcu

SEQ ID NO: 634080 - RNA, 12 nt, Homo sapiens
cuguuuguacug

SEQ ID NO: 634081 - RNA, 22 nt, Homo sapiens
cuguuuguuuuuaaaaagcaaa

SEQ ID NO: 634082 - RNA, 16 nt, Homo sapiens
cuguuuuagcugaggg

SEQ ID NO: 634083 - RNA, 21 nt, Homo sapiens
cuguuuuauaaugaacccauc

SEQ ID NO: 634084 - RNA, 16 nt, Homo sapiens
cuguuuuauauucaac

SEQ ID NO: 634085 - RNA, 19 nt, Homo sapiens
cuguuuucuuuugguaaag

SEQ ID NO: 634086 - RNA, 13 nt, Homo sapiens
cuguuuugcauau

SEQ ID NO: 634087 - RNA, 20 nt, Homo sapiens
cuguuuuguaagugcugcua

SEQ ID NO: 634088 - RNA, 14 nt, Homo sapiens
cuguuuugugagaa

SEQ ID NO: 634089 - RNA, 22 nt, Homo sapiens
cuguuuuguuaauauaccccaa

SEQ ID NO: 634090 - RNA, 20 nt, Homo sapiens
cuguuuuucaaaaauggaag

SEQ ID NO: 634091 - RNA, 17 nt, Homo sapiens
cuguuuuucggacaguu

SEQ ID NO: 634092 - RNA, 23 nt, Homo sapiens
cuguuuuuuuugcugcuaaagaa

SEQ ID NO: 634093 - RNA, 16 nt, Homo sapiens
cuuaaaaaaagcacau

SEQ ID NO: 634094 - RNA, 17 nt, Homo sapiens
cuuaaaaaaagcacaug

SEQ ID NO: 634095 - RNA, 16 nt, Homo sapiens
cuuaaaaaauguccau

SEQ ID NO: 634096 - RNA, 15 nt, Homo sapiens
cuuaaaaaugcacac

SEQ ID NO: 634097 - RNA, 19 nt, Homo sapiens
cuuaaaagguuaaauuuca

SEQ ID NO: 634098 - RNA, 13 nt, Homo sapiens
cuuaaaaguauuc

SEQ ID NO: 634099 - RNA, 18 nt, Homo sapiens
cuuaaaauacaagacugc

SEQ ID NO: 634100 - RNA, 21 nt, Homo sapiens
cuuaaaauaugugaaguuuuc

SEQ ID NO: 634101 - RNA, 19 nt, Homo sapiens
cuuaaaaugacaaagccau

SEQ ID NO: 634102 - RNA, 16 nt, Homo sapiens
cuuaaaauuaccagac

SEQ ID NO: 634103 - RNA, 22 nt, Homo sapiens
cuuaaaauugugagcgaauuag

SEQ ID NO: 634104 - RNA, 15 nt, Homo sapiens
cuuaaacacaaauuu

SEQ ID NO: 634105 - RNA, 13 nt, Homo sapiens
cuuaaacaguauu

SEQ ID NO: 634106 - RNA, 15 nt, Homo sapiens
cuuaaacccauacaa

SEQ ID NO: 634107 - RNA, 16 nt, Homo sapiens
cuuaaacccauacaau

SEQ ID NO: 634108 - RNA, 20 nt, Homo sapiens
cuuaaaccuuaagauacuaa

SEQ ID NO: 634109 - RNA, 20 nt, Homo sapiens
cuuaaacucuggacacucua

SEQ ID NO: 634110 - RNA, 16 nt, Homo sapiens
cuuaaacuguguaaaa

SEQ ID NO: 634111 - RNA, 16 nt, Homo sapiens
cuuaaagcauuucagg

SEQ ID NO: 634112 - RNA, 17 nt, Homo sapiens
cuuaaagggucuuauga

SEQ ID NO: 634113 - RNA, 13 nt, Homo sapiens
cuuaaagucagaa

SEQ ID NO: 634114 - RNA, 15 nt, Homo sapiens
cuuaaaguuguaaca

SEQ ID NO: 634115 - RNA, 18 nt, Homo sapiens
cuuaaauuugaaucugag

SEQ ID NO: 634116 - RNA, 22 nt, Homo sapiens
cuuaaauuuuuagccauuucuc

SEQ ID NO: 634117 - RNA, 15 nt, Homo sapiens
cuuaacaaaccaaca

SEQ ID NO: 634118 - RNA, 21 nt, Homo sapiens
cuuaacaaagccuuugcuuug

SEQ ID NO: 634119 - RNA, 18 nt, Homo sapiens
cuuaacaugggcucuuca

SEQ ID NO: 634120 - RNA, 15 nt, Homo sapiens
cuuaacauucauaga

SEQ ID NO: 634121 - RNA, 21 nt, Homo sapiens
cuuaaccagucucucaaguga

SEQ ID NO: 634122 - RNA, 20 nt, Homo sapiens
cuuaaccucucuaagccaca

SEQ ID NO: 634123 - RNA, 17 nt, Homo sapiens
cuuaacggcuccaggau

SEQ ID NO: 634124 - RNA, 16 nt, Homo sapiens
cuuaacuaagacuccc

SEQ ID NO: 634125 - RNA, 20 nt, Homo sapiens
cuuaacuauaaggugccuca

SEQ ID NO: 634126 - RNA, 16 nt, Homo sapiens
cuuaugcaaucuaugu

SEQ ID NO: 634127 - RNA, 19 nt, Homo sapiens
cuuauggacacugccuuag

SEQ ID NO: 634128 - RNA, 15 nt, Homo sapiens
cuuauguguugugua

SEQ ID NO: 634129 - RNA, 14 nt, Homo sapiens
cuuauguugcacaa

SEQ ID NO: 634130 - RNA, 13 nt, Homo sapiens
cuuauuaaagcaa

SEQ ID NO: 634131 - RNA, 14 nt, Homo sapiens
cuuauuaguuacaa

SEQ ID NO: 634132 - RNA, 19 nt, Homo sapiens
cuuauuaugcauaaagcca

SEQ ID NO: 634133 - RNA, 14 nt, Homo sapiens
cuuauucccagugu

SEQ ID NO: 634134 - RNA, 23 nt, Homo sapiens
cuuauucgcaauagacaaaguga

SEQ ID NO: 634135 - RNA, 14 nt, Homo sapiens
cuuauucucuguag

SEQ ID NO: 634136 - RNA, 19 nt, Homo sapiens
cuuauucugucuggcauua

SEQ ID NO: 634137 - RNA, 22 nt, Homo sapiens
cuuauucuugagcacaaaauga

SEQ ID NO: 634138 - RNA, 14 nt, Homo sapiens
cuuauugacuauua

SEQ ID NO: 634139 - RNA, 24 nt, Homo sapiens
cuuauugcaucccaaaccacgccu

SEQ ID NO: 634140 - RNA, 14 nt, Homo sapiens
cuuauuuauaccuc

SEQ ID NO: 634141 - RNA, 15 nt, Homo sapiens
cuuauuucauaaaca

SEQ ID NO: 634142 - RNA, 20 nt, Homo sapiens
cuuauuucuagaagcacaug

SEQ ID NO: 634143 - RNA, 16 nt, Homo sapiens
cuuauuuugcauucca

SEQ ID NO: 634144 - RNA, 18 nt, Homo sapiens
cuuauuuugguugcaguu

SEQ ID NO: 634145 - RNA, 21 nt, Homo sapiens
cuuauuuugucuuauucuuaa

SEQ ID NO: 634146 - RNA, 21 nt, Homo sapiens
cuuauuuugugugcuuuccca

SEQ ID NO: 634147 - RNA, 17 nt, Homo sapiens
caguggauugcauuucu

SEQ ID NO: 634148 - RNA, 20 nt, Homo sapiens
caguggcacaaucauggcuc

SEQ ID NO: 634149 - RNA, 13 nt, Homo sapiens
caguggcacugaa

SEQ ID NO: 634150 - RNA, 18 nt, Homo sapiens
caguggcccauggcauuu

SEQ ID NO: 634151 - RNA, 15 nt, Homo sapiens
caguggcccuuucaa

SEQ ID NO: 634152 - RNA, 23 nt, Homo sapiens
caguggcggggggguuuugccua

SEQ ID NO: 634153 - RNA, 15 nt, Homo sapiens
caguggcucaugccu

SEQ ID NO: 634154 - RNA, 16 nt, Homo sapiens
cagugggaucccagac

SEQ ID NO: 634155 - RNA, 16 nt, Homo sapiens
cagugggccugcugag

SEQ ID NO: 634156 - RNA, 20 nt, Homo sapiens
cagugggguugggaccucag

SEQ ID NO: 634157 - RNA, 22 nt, Homo sapiens
caguggugugaaacacacaaug

SEQ ID NO: 634158 - RNA, 16 nt, Homo sapiens
caguguaauccagggg

SEQ ID NO: 634159 - RNA, 14 nt, Homo sapiens
caguguacagucuu

SEQ ID NO: 634160 - RNA, 14 nt, Homo sapiens
caguguacagugaa

SEQ ID NO: 634161 - RNA, 20 nt, Homo sapiens
caguguagcccacacuugag

SEQ ID NO: 634162 - RNA, 15 nt, Homo sapiens
caguguaggcauuua

SEQ ID NO: 634163 - RNA, 16 nt, Homo sapiens
caguguauaaauccaa

SEQ ID NO: 634164 - RNA, 16 nt, Homo sapiens
caguguauguacuaag

SEQ ID NO: 634165 - RNA, 12 nt, Homo sapiens
cagugucauuua

SEQ ID NO: 634166 - RNA, 20 nt, Homo sapiens
caguguccccuccacuguca

SEQ ID NO: 634167 - RNA, 15 nt, Homo sapiens
caguguccucuucaa

SEQ ID NO: 634168 - RNA, 19 nt, Homo sapiens
caguguccucuugcucaaa

SEQ ID NO: 634169 - RNA, 20 nt, Homo sapiens
cagugucugugccauggauu

SEQ ID NO: 634170 - RNA, 16 nt, Homo sapiens
cagugucuuccauaau

SEQ ID NO: 634171 - RNA, 15 nt, Homo sapiens
cagugugacacugcu

SEQ ID NO: 634172 - RNA, 13 nt, Homo sapiens
cagugugcaaggg

SEQ ID NO: 634173 - RNA, 22 nt, Homo sapiens
caguguggcccagggaagccaa

SEQ ID NO: 634174 - RNA, 22 nt, Homo sapiens
caguguggcuucuaugagccca

SEQ ID NO: 634175 - RNA, 21 nt, Homo sapiens
caguguggggauaaagacaga

SEQ ID NO: 634176 - RNA, 15 nt, Homo sapiens
cagugugguuugcau

SEQ ID NO: 634177 - RNA, 23 nt, Homo sapiens
caguguguaaauaauuugcacug

SEQ ID NO: 634178 - RNA, 15 nt, Homo sapiens
caguguucuaugaac

SEQ ID NO: 634179 - RNA, 22 nt, Homo sapiens
caguguugugccccuucacuca

SEQ ID NO: 634180 - RNA, 11 nt, Homo sapiens
caguguuuaca

SEQ ID NO: 634181 - RNA, 12 nt, Homo sapiens
caguguuuacaa

SEQ ID NO: 634182 - RNA, 18 nt, Homo sapiens
caguguuuuuauugcucg

SEQ ID NO: 634183 - RNA, 19 nt, Homo sapiens
caguuaacuauugcauuua

SEQ ID NO: 634184 - RNA, 14 nt, Homo sapiens
caguuacucaggag

SEQ ID NO: 634185 - RNA, 20 nt, Homo sapiens
caguuacuuuuuuacacuga

SEQ ID NO: 634186 - RNA, 13 nt, Homo sapiens
caguuaggugcug

SEQ ID NO: 634187 - RNA, 17 nt, Homo sapiens
caguuauagaaaaucua

SEQ ID NO: 634188 - RNA, 19 nt, Homo sapiens
caguuaugcagaauccaaa

SEQ ID NO: 634189 - RNA, 23 nt, Homo sapiens
caguuauuaaucuggacauucga

SEQ ID NO: 634190 - RNA, 14 nt, Homo sapiens
caguucaagacuua

SEQ ID NO: 634191 - RNA, 15 nt, Homo sapiens
caguucaagacuuag

SEQ ID NO: 634192 - RNA, 16 nt, Homo sapiens
caguucaccuugaaga

SEQ ID NO: 634193 - RNA, 12 nt, Homo sapiens
caguucagauaa

SEQ ID NO: 634194 - RNA, 21 nt, Homo sapiens
caguucaggagucccaaggaa

SEQ ID NO: 634195 - RNA, 19 nt, Homo sapiens
caguuccaggccugaucuu

SEQ ID NO: 634196 - RNA, 16 nt, Homo sapiens
caguucccacauuaaa

SEQ ID NO: 634197 - RNA, 18 nt, Homo sapiens
caguucccccaguaccuc

SEQ ID NO: 634198 - RNA, 19 nt, Homo sapiens
caguucccuccuucuuaca

SEQ ID NO: 634199 - RNA, 18 nt, Homo sapiens
caguuccugaguaccuuc

SEQ ID NO: 634200 - RNA, 15 nt, Homo sapiens
caguucuaaccuccu

SEQ ID NO: 634201 - RNA, 17 nt, Homo sapiens
caguucuacacugauac

SEQ ID NO: 634202 - RNA, 15 nt, Homo sapiens
caguucuacuuuuau

SEQ ID NO: 634203 - RNA, 18 nt, Homo sapiens
caguucucaaauguugga

SEQ ID NO: 634204 - RNA, 13 nt, Homo sapiens
caguucucacucc

SEQ ID NO: 634205 - RNA, 20 nt, Homo sapiens
caguucucccaccagccucc

SEQ ID NO: 634206 - RNA, 16 nt, Homo sapiens
caguucucucccuucc

SEQ ID NO: 634207 - RNA, 17 nt, Homo sapiens
caguucugaacuggaac

SEQ ID NO: 634208 - RNA, 15 nt, Homo sapiens
caguucugggcaaag

SEQ ID NO: 634209 - RNA, 13 nt, Homo sapiens
caguucugugguu

SEQ ID NO: 634210 - RNA, 19 nt, Homo sapiens
caguucuuagauucagggg

SEQ ID NO: 634211 - RNA, 20 nt, Homo sapiens
caguugagagagaaucucaa

SEQ ID NO: 634212 - RNA, 15 nt, Homo sapiens
caguugcauucauua

SEQ ID NO: 634213 - RNA, 16 nt, Homo sapiens
caguugccagugauaa

SEQ ID NO: 634214 - RNA, 21 nt, Homo sapiens
caguugcccuagcccagacuc

SEQ ID NO: 634215 - RNA, 22 nt, Homo sapiens
caguugcucaaaaagaaaucaa

SEQ ID NO: 634216 - RNA, 14 nt, Homo sapiens
caguugcuguggac

SEQ ID NO: 634217 - RNA, 15 nt, Homo sapiens
caguugcuuugccca

SEQ ID NO: 634218 - RNA, 23 nt, Homo sapiens
caguuggauuuauucugccaaac

SEQ ID NO: 634219 - RNA, 19 nt, Homo sapiens
caguugggacccaaaacac

SEQ ID NO: 634220 - RNA, 13 nt, Homo sapiens
caguuggugcugc

SEQ ID NO: 634221 - RNA, 12 nt, Homo sapiens
caguuguaauaa

SEQ ID NO: 634222 - RNA, 19 nt, Homo sapiens
caguuguacuucugcucca

SEQ ID NO: 634223 - RNA, 15 nt, Homo sapiens
caguuguguugacac

SEQ ID NO: 634224 - RNA, 21 nt, Homo sapiens
caguuguuuguuuuugcuugu

SEQ ID NO: 634225 - RNA, 17 nt, Homo sapiens
caguuuaauauuccaau

SEQ ID NO: 634226 - RNA, 16 nt, Homo sapiens
caguuuacuuugccaa

SEQ ID NO: 634227 - RNA, 21 nt, Homo sapiens
caguuuauccugacauauuca

SEQ ID NO: 634228 - RNA, 16 nt, Homo sapiens
caguuuauuuccacua

SEQ ID NO: 634229 - RNA, 17 nt, Homo sapiens
caguuucuggaaaaagu

SEQ ID NO: 634230 - RNA, 15 nt, Homo sapiens
caguuugacuguggc

SEQ ID NO: 634231 - RNA, 20 nt, Homo sapiens
caguuugcuuuguaugcacu

SEQ ID NO: 634232 - RNA, 16 nt, Homo sapiens
caguuuggagucacug

SEQ ID NO: 634233 - RNA, 23 nt, Homo sapiens
caguuuuauauuuauaagccuua

SEQ ID NO: 634234 - RNA, 20 nt, Homo sapiens
caguuuucauaguauccaua

SEQ ID NO: 634235 - RNA, 15 nt, Homo sapiens
caguuuucguagguu

SEQ ID NO: 634236 - RNA, 18 nt, Homo sapiens
caguuuugcuuauugugu

SEQ ID NO: 634237 - RNA, 19 nt, Homo sapiens
caguuuuuaaaaugcugcu

SEQ ID NO: 634238 - RNA, 19 nt, Homo sapiens
caguuuuuauauagucuac

SEQ ID NO: 634239 - RNA, 21 nt, Homo sapiens
caguuuuuuaaaaauguguca

SEQ ID NO: 634240 - RNA, 14 nt, Homo sapiens
cauaaaaaaaugau

SEQ ID NO: 634241 - RNA, 15 nt, Homo sapiens
cauaaaaaaaugaug

SEQ ID NO: 634242 - RNA, 17 nt, Homo sapiens
cauaaaaaaaugaugca

SEQ ID NO: 634243 - RNA, 19 nt, Homo sapiens
cauaaaaaauaaaguacca

SEQ ID NO: 634244 - RNA, 20 nt, Homo sapiens
cauaaaaaauaaaguaccac

SEQ ID NO: 634245 - RNA, 14 nt, Homo sapiens
cauaaaaaccaaac

SEQ ID NO: 634246 - RNA, 17 nt, Homo sapiens
cauaaaaagacaacuca

SEQ ID NO: 634247 - RNA, 20 nt, Homo sapiens
cauaaaaauaaaucaguuca

SEQ ID NO: 634248 - RNA, 21 nt, Homo sapiens
cauaaaaauaaaucaguucau

SEQ ID NO: 634249 - RNA, 17 nt, Homo sapiens
cauaaaacccuauacaa

SEQ ID NO: 634250 - RNA, 18 nt, Homo sapiens
cauaaagaaaagaugaaa

SEQ ID NO: 634251 - RNA, 12 nt, Homo sapiens
cauaaagcauuu

SEQ ID NO: 634252 - RNA, 13 nt, Homo sapiens
cauaaagccuuua

SEQ ID NO: 634253 - RNA, 16 nt, Homo sapiens
cauaaagugucuauaa

SEQ ID NO: 634254 - RNA, 17 nt, Homo sapiens
cauaaauaaaguuucag

SEQ ID NO: 634255 - RNA, 18 nt, Homo sapiens
cauaaauaaaguuucagc

SEQ ID NO: 634256 - RNA, 15 nt, Homo sapiens
cauaaauacugucaa

SEQ ID NO: 634257 - RNA, 12 nt, Homo sapiens
cauaaaucacaa

SEQ ID NO: 634258 - RNA, 22 nt, Homo sapiens
cauaaaucuuguaaucauguua

SEQ ID NO: 634259 - RNA, 19 nt, Homo sapiens
cauaaaugaagcagcuuua

SEQ ID NO: 634260 - RNA, 17 nt, Homo sapiens
cauaaaugacacuacuu

SEQ ID NO: 634261 - RNA, 13 nt, Homo sapiens
cauaacaauuccu

SEQ ID NO: 634262 - RNA, 14 nt, Homo sapiens
cauaacaugcuuua

SEQ ID NO: 634263 - RNA, 15 nt, Homo sapiens
cauaacuauacuuga

SEQ ID NO: 634264 - RNA, 17 nt, Homo sapiens
cauaacuggauuuugaa

SEQ ID NO: 634265 - RNA, 20 nt, Homo sapiens
cauaacuggauuuugaacgc

SEQ ID NO: 634266 - RNA, 16 nt, Homo sapiens
cauaagaaaacuaaga

SEQ ID NO: 634267 - RNA, 18 nt, Homo sapiens
cauaagcaauaccagcaa

SEQ ID NO: 634268 - RNA, 17 nt, Homo sapiens
cauaagcauaauuuccu

SEQ ID NO: 634269 - RNA, 16 nt, Homo sapiens
cauaagcccaguucau

SEQ ID NO: 634270 - RNA, 17 nt, Homo sapiens
cuuauuuuuaugugguc

SEQ ID NO: 634271 - RNA, 14 nt, Homo sapiens
cuuauuuuucucca

SEQ ID NO: 634272 - RNA, 17 nt, Homo sapiens
cuuauuuuugacagugu

SEQ ID NO: 634273 - RNA, 22 nt, Homo sapiens
cuucaaaagccauaacuugaaa

SEQ ID NO: 634274 - RNA, 17 nt, Homo sapiens
cuucaaacccucaagag

SEQ ID NO: 634275 - RNA, 19 nt, Homo sapiens
cuucaaagaggaaccagga

SEQ ID NO: 634276 - RNA, 15 nt, Homo sapiens
cuucaaauauuuccc

SEQ ID NO: 634277 - RNA, 22 nt, Homo sapiens
cuucaacaaccggccaccagau

SEQ ID NO: 634278 - RNA, 21 nt, Homo sapiens
cuucaacaugacauccagaga

SEQ ID NO: 634279 - RNA, 13 nt, Homo sapiens
cuucaaccaguga

SEQ ID NO: 634280 - RNA, 12 nt, Homo sapiens
cuucaacccagu

SEQ ID NO: 634281 - RNA, 14 nt, Homo sapiens
cuucaacccagugg

SEQ ID NO: 634282 - RNA, 17 nt, Homo sapiens
cuucaaccucauugaca

SEQ ID NO: 634283 - RNA, 14 nt, Homo sapiens
cuucaagaucucau

SEQ ID NO: 634284 - RNA, 13 nt, Homo sapiens
cuucaaguggcag

SEQ ID NO: 634285 - RNA, 19 nt, Homo sapiens
cuucaaguuaaagugaaua

SEQ ID NO: 634286 - RNA, 17 nt, Homo sapiens
cuucaaguuguaaaaau

SEQ ID NO: 634287 - RNA, 14 nt, Homo sapiens
cuucaauacuuaaa

SEQ ID NO: 634288 - RNA, 23 nt, Homo sapiens
cuucaaucucuguucugcuccca

SEQ ID NO: 634289 - RNA, 19 nt, Homo sapiens
cuucaaucucuugcacuca

SEQ ID NO: 634290 - RNA, 21 nt, Homo sapiens
cuucaaucuucauuuuggagg

SEQ ID NO: 634291 - RNA, 16 nt, Homo sapiens
cuucaaugcuagaaaa

SEQ ID NO: 634292 - RNA, 17 nt, Homo sapiens
cuucaauuguauuauau

SEQ ID NO: 634293 - RNA, 19 nt, Homo sapiens
cuucacagggguacagaaa

SEQ ID NO: 634294 - RNA, 12 nt, Homo sapiens
cuucacaguacc

SEQ ID NO: 634295 - RNA, 14 nt, Homo sapiens
cuucaccacuguag

SEQ ID NO: 634296 - RNA, 23 nt, Homo sapiens
cuucaccagucugucuacugugg

SEQ ID NO: 634297 - RNA, 19 nt, Homo sapiens
cuucaccuacauuaucuca

SEQ ID NO: 634298 - RNA, 14 nt, Homo sapiens
cuucaccucacuga

SEQ ID NO: 634299 - RNA, 22 nt, Homo sapiens
cuucaccuccagguucaaguga

SEQ ID NO: 634300 - RNA, 21 nt, Homo sapiens
cuucaccuuugucgcuggguc

SEQ ID NO: 634301 - RNA, 17 nt, Homo sapiens
cuucacucuucacuuga

SEQ ID NO: 634302 - RNA, 14 nt, Homo sapiens
cuucacucuuugaa

SEQ ID NO: 634303 - RNA, 15 nt, Homo sapiens
cuucacugaacaugc

SEQ ID NO: 634304 - RNA, 14 nt, Homo sapiens
cuucacugccauga

SEQ ID NO: 634305 - RNA, 22 nt, Homo sapiens
cuucacuguccuccaagccagc

SEQ ID NO: 634306 - RNA, 20 nt, Homo sapiens
cuucacuuacccauuagcca

SEQ ID NO: 634307 - RNA, 14 nt, Homo sapiens
cuucacuucuggga

SEQ ID NO: 634308 - RNA, 22 nt, Homo sapiens
cuucagaaaaggaguggccaca

SEQ ID NO: 634309 - RNA, 16 nt, Homo sapiens
cuucagaagacacugc

SEQ ID NO: 634310 - RNA, 17 nt, Homo sapiens
cuucagaagacacugca

SEQ ID NO: 634311 - RNA, 23 nt, Homo sapiens
cuucagaagacacugcaaaggcg

SEQ ID NO: 634312 - RNA, 23 nt, Homo sapiens
cuucagaagucacacauuacaaa

SEQ ID NO: 634313 - RNA, 14 nt, Homo sapiens
cuucagaauuccau

SEQ ID NO: 634314 - RNA, 15 nt, Homo sapiens
cuucagagacuaucu

SEQ ID NO: 634315 - RNA, 20 nt, Homo sapiens
cuucagaggauaaauaucaa

SEQ ID NO: 634316 - RNA, 20 nt, Homo sapiens
cuucagagggaaacucagau

SEQ ID NO: 634317 - RNA, 18 nt, Homo sapiens
cuucagauacaaacugca

SEQ ID NO: 634318 - RNA, 13 nt, Homo sapiens
cuucagcaaguua

SEQ ID NO: 634319 - RNA, 15 nt, Homo sapiens
cuucagcaccugccc

SEQ ID NO: 634320 - RNA, 18 nt, Homo sapiens
cuucagcccuggccaagc

SEQ ID NO: 634321 - RNA, 17 nt, Homo sapiens
cuucagccuuaauggaa

SEQ ID NO: 634322 - RNA, 21 nt, Homo sapiens
cuucaggaaggacauggacaa

SEQ ID NO: 634323 - RNA, 21 nt, Homo sapiens
cuucaggaucaaguccuaguu

SEQ ID NO: 634324 - RNA, 13 nt, Homo sapiens
cuucagggccaga

SEQ ID NO: 634325 - RNA, 14 nt, Homo sapiens
cuucagggccaguc

SEQ ID NO: 634326 - RNA, 18 nt, Homo sapiens
cuucagggcugaguucug

SEQ ID NO: 634327 - RNA, 13 nt, Homo sapiens
cuucagguggaug

SEQ ID NO: 634328 - RNA, 17 nt, Homo sapiens
cuucagguucucaugau

SEQ ID NO: 634329 - RNA, 23 nt, Homo sapiens
cuucaguacacuugguguacugg

SEQ ID NO: 634330 - RNA, 21 nt, Homo sapiens
cuucaguauguugucaaagag

SEQ ID NO: 634331 - RNA, 20 nt, Homo sapiens
cuucaguccacuucugcucu

SEQ ID NO: 634332 - RNA, 17 nt, Homo sapiens
cuucaguccuucuacug

SEQ ID NO: 634333 - RNA, 19 nt, Homo sapiens
cuucagucuugguaaaaca

SEQ ID NO: 634334 - RNA, 22 nt, Homo sapiens
cuucagugaauuuugauaaugg

SEQ ID NO: 634335 - RNA, 19 nt, Homo sapiens
cuucagugacaaacauauc

SEQ ID NO: 634336 - RNA, 13 nt, Homo sapiens
cuucauagguaga

SEQ ID NO: 634337 - RNA, 16 nt, Homo sapiens
cuucauaucaucacaa

SEQ ID NO: 634338 - RNA, 15 nt, Homo sapiens
cuucauccaacuucc

SEQ ID NO: 634339 - RNA, 17 nt, Homo sapiens
cuucaucucaccauccu

SEQ ID NO: 634340 - RNA, 13 nt, Homo sapiens
cuucaucucauga

SEQ ID NO: 634341 - RNA, 21 nt, Homo sapiens
cuucaucugaaacccacagau

SEQ ID NO: 634342 - RNA, 15 nt, Homo sapiens
cuucaucugggacaa

SEQ ID NO: 634343 - RNA, 21 nt, Homo sapiens
cuucaugaucaucacaaucau

SEQ ID NO: 634344 - RNA, 14 nt, Homo sapiens
cuucaugaugugug

SEQ ID NO: 634345 - RNA, 15 nt, Homo sapiens
cuucaugcaaugaca

SEQ ID NO: 634346 - RNA, 20 nt, Homo sapiens
cuucaugcuugacauaccua

SEQ ID NO: 634347 - RNA, 17 nt, Homo sapiens
cuucauggaauucacaa

SEQ ID NO: 634348 - RNA, 15 nt, Homo sapiens
cuucauggacuucca

SEQ ID NO: 634349 - RNA, 17 nt, Homo sapiens
cuucauggccucaggag

SEQ ID NO: 634350 - RNA, 17 nt, Homo sapiens
cuucaugggccuuccau

SEQ ID NO: 634351 - RNA, 16 nt, Homo sapiens
cuucaugucuaggaua

SEQ ID NO: 634352 - RNA, 23 nt, Homo sapiens
cuucauuagcuuugggugccuuu

SEQ ID NO: 634353 - RNA, 14 nt, Homo sapiens
cuucauucugcaag

SEQ ID NO: 634354 - RNA, 17 nt, Homo sapiens
cuucauuuccaccaggc

SEQ ID NO: 634355 - RNA, 18 nt, Homo sapiens
cuucauuucgccugguga

SEQ ID NO: 634356 - RNA, 18 nt, Homo sapiens
cuucauuugaugcuaaau

SEQ ID NO: 634357 - RNA, 24 nt, Homo sapiens
cuucauuugaugcuaaauaggaga

SEQ ID NO: 634358 - RNA, 21 nt, Homo sapiens
cuuccaaacagaacuauggaa

SEQ ID NO: 634359 - RNA, 17 nt, Homo sapiens
cuuccaaaugugucaga

SEQ ID NO: 634360 - RNA, 22 nt, Homo sapiens
cuuccacaacagaaguauuucu

SEQ ID NO: 634361 - RNA, 20 nt, Homo sapiens
cuuccacccccaccauccag

SEQ ID NO: 634362 - RNA, 20 nt, Homo sapiens
cuuccacgccaguugccucu

SEQ ID NO: 634363 - RNA, 14 nt, Homo sapiens
cuuccacugagggc

SEQ ID NO: 634364 - RNA, 15 nt, Homo sapiens
cuuccacuguagcua

SEQ ID NO: 634365 - RNA, 19 nt, Homo sapiens
cuuccacuuugaguaccaa

SEQ ID NO: 634366 - RNA, 12 nt, Homo sapiens
cuuccacuuugc

SEQ ID NO: 634367 - RNA, 20 nt, Homo sapiens
cuuccagaaggcagcaaaga

SEQ ID NO: 634368 - RNA, 20 nt, Homo sapiens
cuuccagauauccacauaaa

SEQ ID NO: 634369 - RNA, 13 nt, Homo sapiens
cuuccagauccug

SEQ ID NO: 634370 - RNA, 13 nt, Homo sapiens
cacaagucuucca

SEQ ID NO: 634371 - RNA, 16 nt, Homo sapiens
cacaaguggaccuuag

SEQ ID NO: 634372 - RNA, 14 nt, Homo sapiens
cacaauaccacuau

SEQ ID NO: 634373 - RNA, 23 nt, Homo sapiens
cacaauauacgaaaagccagcuu

SEQ ID NO: 634374 - RNA, 15 nt, Homo sapiens
cacaauauccagcga

SEQ ID NO: 634375 - RNA, 20 nt, Homo sapiens
cacaauaugggcacuuuaaa

SEQ ID NO: 634376 - RNA, 12 nt, Homo sapiens
cacaauccucca

SEQ ID NO: 634377 - RNA, 15 nt, Homo sapiens
cacaauccuccaaga

SEQ ID NO: 634378 - RNA, 19 nt, Homo sapiens
cacaaucugucaguucuaa

SEQ ID NO: 634379 - RNA, 17 nt, Homo sapiens
cacaaugagaugcauga

SEQ ID NO: 634380 - RNA, 19 nt, Homo sapiens
cacaaugcaugugcugucu

SEQ ID NO: 634381 - RNA, 12 nt, Homo sapiens
cacaaugccaga

SEQ ID NO: 634382 - RNA, 18 nt, Homo sapiens
cacaauguuaaguuauau

SEQ ID NO: 634383 - RNA, 22 nt, Homo sapiens
cacaauuaauucaucccuuaau

SEQ ID NO: 634384 - RNA, 17 nt, Homo sapiens
cacaauuaugugcaaag

SEQ ID NO: 634385 - RNA, 15 nt, Homo sapiens
cacaauuucccuuca

SEQ ID NO: 634386 - RNA, 18 nt, Homo sapiens
cacacaaaauaguuuuag

SEQ ID NO: 634387 - RNA, 14 nt, Homo sapiens
cacacaaccaugac

SEQ ID NO: 634388 - RNA, 16 nt, Homo sapiens
cacacaaggugcaaau

SEQ ID NO: 634389 - RNA, 19 nt, Homo sapiens
cacacacaaaaugcucaag

SEQ ID NO: 634390 - RNA, 13 nt, Homo sapiens
cacacacacaaac

SEQ ID NO: 634391 - RNA, 13 nt, Homo sapiens
cacacacauacag

SEQ ID NO: 634392 - RNA, 20 nt, Homo sapiens
cacacaccaaguaccaguau

SEQ ID NO: 634393 - RNA, 19 nt, Homo sapiens
cacacaccaccaugcucaa

SEQ ID NO: 634394 - RNA, 14 nt, Homo sapiens
cacacacgaugcau

SEQ ID NO: 634395 - RNA, 17 nt, Homo sapiens
cacacacgaugcauuua

SEQ ID NO: 634396 - RNA, 17 nt, Homo sapiens
cacacacucaccagugg

SEQ ID NO: 634397 - RNA, 12 nt, Homo sapiens
cacacacuggac

SEQ ID NO: 634398 - RNA, 20 nt, Homo sapiens
cacacagacaguuucugaca

SEQ ID NO: 634399 - RNA, 22 nt, Homo sapiens
cacacagauuuuuauguuuucu

SEQ ID NO: 634400 - RNA, 22 nt, Homo sapiens
cacacagcacgggggccaagga

SEQ ID NO: 634401 - RNA, 22 nt, Homo sapiens
cacacagccuauaucaaacaug

SEQ ID NO: 634402 - RNA, 20 nt, Homo sapiens
cacacaguuauuuaaucaaa

SEQ ID NO: 634403 - RNA, 11 nt, Homo sapiens
cacacauauac

SEQ ID NO: 634404 - RNA, 14 nt, Homo sapiens
cacacaucucauuu

SEQ ID NO: 634405 - RNA, 18 nt, Homo sapiens
cacacaugcuaggaugcg

SEQ ID NO: 634406 - RNA, 15 nt, Homo sapiens
cacacauuccagggc

SEQ ID NO: 634407 - RNA, 14 nt, Homo sapiens
cacacauugcagcu

SEQ ID NO: 634408 - RNA, 14 nt, Homo sapiens
cacacauugugcuu

SEQ ID NO: 634409 - RNA, 13 nt, Homo sapiens
cacaccaacagug

SEQ ID NO: 634410 - RNA, 16 nt, Homo sapiens
cacaccacaaauggga

SEQ ID NO: 634411 - RNA, 15 nt, Homo sapiens
cacaccaggucuucc

SEQ ID NO: 634412 - RNA, 14 nt, Homo sapiens
cacacccaugcaca

SEQ ID NO: 634413 - RNA, 17 nt, Homo sapiens
cacaccuccugccuuua

SEQ ID NO: 634414 - RNA, 15 nt, Homo sapiens
cacaccugggcauuu

SEQ ID NO: 634415 - RNA, 23 nt, Homo sapiens
cacaccuuuguccacugucaggg

SEQ ID NO: 634416 - RNA, 15 nt, Homo sapiens
cacacgcacacaucu

SEQ ID NO: 634417 - RNA, 23 nt, Homo sapiens
cacacgcacugcgccugucagua

SEQ ID NO: 634418 - RNA, 14 nt, Homo sapiens
cacacguacuuaaa

SEQ ID NO: 634419 - RNA, 24 nt, Homo sapiens
cacacguguguaugagugcgcaga

SEQ ID NO: 634420 - RNA, 21 nt, Homo sapiens
cacacuaguuuaugcuaccua

SEQ ID NO: 634421 - RNA, 14 nt, Homo sapiens
cacacuauggcaug

SEQ ID NO: 634422 - RNA, 21 nt, Homo sapiens
cacacuauuucccucuacuga

SEQ ID NO: 634423 - RNA, 13 nt, Homo sapiens
cacacucaaggga

SEQ ID NO: 634424 - RNA, 15 nt, Homo sapiens
cacacucacagaugu

SEQ ID NO: 634425 - RNA, 16 nt, Homo sapiens
cacacuccaagauaug

SEQ ID NO: 634426 - RNA, 20 nt, Homo sapiens
cacacuccacucugauucac

SEQ ID NO: 634427 - RNA, 20 nt, Homo sapiens
cacacuccuccaaggcacaa

SEQ ID NO: 634428 - RNA, 22 nt, Homo sapiens
cacacucgcccgcccacugucc

SEQ ID NO: 634429 - RNA, 15 nt, Homo sapiens
cacacugaaucagcu

SEQ ID NO: 634430 - RNA, 17 nt, Homo sapiens
cacacugaguucuauca

SEQ ID NO: 634431 - RNA, 14 nt, Homo sapiens
cacacugcuagcaa

SEQ ID NO: 634432 - RNA, 18 nt, Homo sapiens
cacacuggcugguggaga

SEQ ID NO: 634433 - RNA, 20 nt, Homo sapiens
cacacuggucacaggcaaag

SEQ ID NO: 634434 - RNA, 14 nt, Homo sapiens
cacacuggugcuga

SEQ ID NO: 634435 - RNA, 13 nt, Homo sapiens
cacacuucuugaa

SEQ ID NO: 634436 - RNA, 13 nt, Homo sapiens
cacacuuugcacu

SEQ ID NO: 634437 - RNA, 22 nt, Homo sapiens
cacacuuuuggaaccaugccuu

SEQ ID NO: 634438 - RNA, 15 nt, Homo sapiens
cacagaaacuugaac

SEQ ID NO: 634439 - RNA, 17 nt, Homo sapiens
cacagaaauacaugaaa

SEQ ID NO: 634440 - RNA, 14 nt, Homo sapiens
cacagaaaucacag

SEQ ID NO: 634441 - RNA, 20 nt, Homo sapiens
cacagaacacagcaauuccu

SEQ ID NO: 634442 - RNA, 14 nt, Homo sapiens
cacagaagccagga

SEQ ID NO: 634443 - RNA, 17 nt, Homo sapiens
cacagaagguccuggug

SEQ ID NO: 634444 - RNA, 14 nt, Homo sapiens
cacagaauuugcua

SEQ ID NO: 634445 - RNA, 20 nt, Homo sapiens
cacagaauuuguauguauuu

SEQ ID NO: 634446 - RNA, 15 nt, Homo sapiens
cacagacacuaacga

SEQ ID NO: 634447 - RNA, 19 nt, Homo sapiens
cacagaccccgggucuccu

SEQ ID NO: 634448 - RNA, 19 nt, Homo sapiens
cacagagaugcaugcgcag

SEQ ID NO: 634449 - RNA, 19 nt, Homo sapiens
cacagagcacgccugccau

SEQ ID NO: 634450 - RNA, 14 nt, Homo sapiens
cacagaggacacag

SEQ ID NO: 634451 - RNA, 16 nt, Homo sapiens
cacagaggagugcagc

SEQ ID NO: 634452 - RNA, 16 nt, Homo sapiens
cacagaggcuggcacu

SEQ ID NO: 634453 - RNA, 16 nt, Homo sapiens
cacagagggaagccau

SEQ ID NO: 634454 - RNA, 22 nt, Homo sapiens
cacagagggcaggcacucccau

SEQ ID NO: 634455 - RNA, 14 nt, Homo sapiens
cacagagugcauug

SEQ ID NO: 634456 - RNA, 16 nt, Homo sapiens
cacagaugaccaaagu

SEQ ID NO: 634457 - RNA, 18 nt, Homo sapiens
cacagaugauacuuccaa

SEQ ID NO: 634458 - RNA, 13 nt, Homo sapiens
cacagaugcucca

SEQ ID NO: 634459 - RNA, 17 nt, Homo sapiens
cacagauguaauuaugu

SEQ ID NO: 634460 - RNA, 15 nt, Homo sapiens
cacagaugugaaaug

SEQ ID NO: 634461 - RNA, 19 nt, Homo sapiens
cacagaugugaaaugaaug

SEQ ID NO: 634462 - RNA, 20 nt, Homo sapiens
cacagcaagacuccgucuca

SEQ ID NO: 634463 - RNA, 17 nt, Homo sapiens
cacagcaaggaaauguc

SEQ ID NO: 634464 - RNA, 14 nt, Homo sapiens
cacagcagcaauug

SEQ ID NO: 634465 - RNA, 15 nt, Homo sapiens
cacagcagcaguuac

SEQ ID NO: 634466 - RNA, 22 nt, Homo sapiens
cacagcaucauuuugcauucaa

SEQ ID NO: 634467 - RNA, 13 nt, Homo sapiens
cacagcauggccu

SEQ ID NO: 634468 - RNA, 23 nt, Homo sapiens
cacagccaacgagacacauugcc

SEQ ID NO: 634469 - RNA, 19 nt, Homo sapiens
cacagccaccccugagauc

SEQ ID NO: 634470 - RNA, 22 nt, Homo sapiens
cacagcccagaaccacagaugu

SEQ ID NO: 634471 - RNA, 13 nt, Homo sapiens
cuagaaacccaag

SEQ ID NO: 634472 - RNA, 18 nt, Homo sapiens
cuagaaagccauauucca

SEQ ID NO: 634473 - RNA, 19 nt, Homo sapiens
cuagaaaggaagacagauu

SEQ ID NO: 634474 - RNA, 12 nt, Homo sapiens
cuagaaauaucu

SEQ ID NO: 634475 - RNA, 17 nt, Homo sapiens
cuagaaaugcagcaucu

SEQ ID NO: 634476 - RNA, 17 nt, Homo sapiens
cuagaacacuaacucac

SEQ ID NO: 634477 - RNA, 19 nt, Homo sapiens
cuagaacaugcacauuuau

SEQ ID NO: 634478 - RNA, 14 nt, Homo sapiens
cuagaacucuccau

SEQ ID NO: 634479 - RNA, 13 nt, Homo sapiens
cuagaagacuguc

SEQ ID NO: 634480 - RNA, 15 nt, Homo sapiens
cuagaagccaaggga

SEQ ID NO: 634481 - RNA, 20 nt, Homo sapiens
cuagaagugugaagugcaga

SEQ ID NO: 634482 - RNA, 22 nt, Homo sapiens
cuagaaucauacuuaacauuuc

SEQ ID NO: 634483 - RNA, 23 nt, Homo sapiens
cuagaaucauacuuaacauuuca

SEQ ID NO: 634484 - RNA, 19 nt, Homo sapiens
cuagaauguggauuugauu

SEQ ID NO: 634485 - RNA, 15 nt, Homo sapiens
cuagaauucauguga

SEQ ID NO: 634486 - RNA, 19 nt, Homo sapiens
cuagaauuuucucccuuua

SEQ ID NO: 634487 - RNA, 18 nt, Homo sapiens
cuagacaauuucuucuaa

SEQ ID NO: 634488 - RNA, 16 nt, Homo sapiens
cuagacaguauugcca

SEQ ID NO: 634489 - RNA, 18 nt, Homo sapiens
cuagaccuauuacaaaga

SEQ ID NO: 634490 - RNA, 22 nt, Homo sapiens
cuagacuaagaagauuuaguuu

SEQ ID NO: 634491 - RNA, 19 nt, Homo sapiens
cuagacuacucaauauuaa

SEQ ID NO: 634492 - RNA, 16 nt, Homo sapiens
cuagacucuagacaag

SEQ ID NO: 634493 - RNA, 15 nt, Homo sapiens
cucugccauguguuu

SEQ ID NO: 634494 - RNA, 11 nt, Homo sapiens
cucugccauuc

SEQ ID NO: 634495 - RNA, 18 nt, Homo sapiens
cucugccugaaggcucac

SEQ ID NO: 634496 - RNA, 19 nt, Homo sapiens
cucugccugagacuuucag

SEQ ID NO: 634497 - RNA, 23 nt, Homo sapiens
cucugcucaggccucccuagcac

SEQ ID NO: 634498 - RNA, 23 nt, Homo sapiens
cucugcuccaaaggaaauccaaa

SEQ ID NO: 634499 - RNA, 14 nt, Homo sapiens
cucugcuccaaagu

SEQ ID NO: 634500 - RNA, 15 nt, Homo sapiens
cucugcuccaaagua

SEQ ID NO: 634501 - RNA, 11 nt, Homo sapiens
cucugcucccu

SEQ ID NO: 634502 - RNA, 17 nt, Homo sapiens
cucugcuccuacaucca

SEQ ID NO: 634503 - RNA, 11 nt, Homo sapiens
cucugcuccuu

SEQ ID NO: 634504 - RNA, 15 nt, Homo sapiens
cucugcugcucugac

SEQ ID NO: 634505 - RNA, 15 nt, Homo sapiens
cucugcuguagcuua

SEQ ID NO: 634506 - RNA, 11 nt, Homo sapiens
cucugcuuacu

SEQ ID NO: 634507 - RNA, 19 nt, Homo sapiens
cucugcuuccagcaguauu

SEQ ID NO: 634508 - RNA, 15 nt, Homo sapiens
cucuggacacagccc

SEQ ID NO: 634509 - RNA, 18 nt, Homo sapiens
cucuggacagaugaauac

SEQ ID NO: 634510 - RNA, 18 nt, Homo sapiens
cucuggacagccagugac

SEQ ID NO: 634511 - RNA, 11 nt, Homo sapiens
cucuggaccag

SEQ ID NO: 634512 - RNA, 13 nt, Homo sapiens
cucuggaccagcc

SEQ ID NO: 634513 - RNA, 19 nt, Homo sapiens
cucuggaccagccuguugg

SEQ ID NO: 634514 - RNA, 17 nt, Homo sapiens
cucuggaccauauacca

SEQ ID NO: 634515 - RNA, 16 nt, Homo sapiens
cucuggagcaauguug

SEQ ID NO: 634516 - RNA, 16 nt, Homo sapiens
cucuggagccagagag

SEQ ID NO: 634517 - RNA, 23 nt, Homo sapiens
cucuggaggaaguucuccagcuu

SEQ ID NO: 634518 - RNA, 15 nt, Homo sapiens
cucuggauggcacca

SEQ ID NO: 634519 - RNA, 18 nt, Homo sapiens
cucuggcacauugacaaa

SEQ ID NO: 634520 - RNA, 21 nt, Homo sapiens
cucugggaaguggucagcgca

SEQ ID NO: 634521 - RNA, 18 nt, Homo sapiens
cucuggggaagucagggg

SEQ ID NO: 634522 - RNA, 19 nt, Homo sapiens
cucuggggacccuccagag

SEQ ID NO: 634523 - RNA, 13 nt, Homo sapiens
cucuggggcucaa

SEQ ID NO: 634524 - RNA, 15 nt, Homo sapiens
cucuggggguuuugu

SEQ ID NO: 634525 - RNA, 21 nt, Homo sapiens
cucuggggucuuuuuaugcau

SEQ ID NO: 634526 - RNA, 17 nt, Homo sapiens
cucugguuagaaaaagg

SEQ ID NO: 634527 - RNA, 17 nt, Homo sapiens
cucugguuuucuugcca

SEQ ID NO: 634528 - RNA, 11 nt, Homo sapiens
cucuguaaaac

SEQ ID NO: 634529 - RNA, 22 nt, Homo sapiens
cucuguagggaacucugggguc

SEQ ID NO: 634530 - RNA, 22 nt, Homo sapiens
cucuguauuacagcuuucacag

SEQ ID NO: 634531 - RNA, 12 nt, Homo sapiens
cucuguauuccg

SEQ ID NO: 634532 - RNA, 17 nt, Homo sapiens
cucugucacaaagggac

SEQ ID NO: 634533 - RNA, 14 nt, Homo sapiens
cucugucucaaaaa

SEQ ID NO: 634534 - RNA, 14 nt, Homo sapiens
cucugugaccaaug

SEQ ID NO: 634535 - RNA, 23 nt, Homo sapiens
cucugugagggugcugacuggcu

SEQ ID NO: 634536 - RNA, 21 nt, Homo sapiens
cucuguggaaugaauacacac

SEQ ID NO: 634537 - RNA, 18 nt, Homo sapiens
cucugugggcuccaugua

SEQ ID NO: 634538 - RNA, 14 nt, Homo sapiens
cucugugugcacac

SEQ ID NO: 634539 - RNA, 19 nt, Homo sapiens
cucuguucagaaagcaaua

SEQ ID NO: 634540 - RNA, 16 nt, Homo sapiens
cucuguucccuuccuc

SEQ ID NO: 634541 - RNA, 19 nt, Homo sapiens
cucuguugguccacugugu

SEQ ID NO: 634542 - RNA, 20 nt, Homo sapiens
cucuguuuauagugacccac

SEQ ID NO: 634543 - RNA, 19 nt, Homo sapiens
cucuuaaaucauuugguua

SEQ ID NO: 634544 - RNA, 17 nt, Homo sapiens
cucuuaaucaaauagca

SEQ ID NO: 634545 - RNA, 14 nt, Homo sapiens
cucuuaaucacuac

SEQ ID NO: 634546 - RNA, 18 nt, Homo sapiens
cucuuaaucacuacugua

SEQ ID NO: 634547 - RNA, 13 nt, Homo sapiens
cucuuacaaaagc

SEQ ID NO: 634548 - RNA, 19 nt, Homo sapiens
cucuuacagagccuugaga

SEQ ID NO: 634549 - RNA, 20 nt, Homo sapiens
cucuuaccgcgagacugaga

SEQ ID NO: 634550 - RNA, 20 nt, Homo sapiens
cucuuacguuuaacauacaa

SEQ ID NO: 634551 - RNA, 16 nt, Homo sapiens
cucuuagaaaaaccac

SEQ ID NO: 634552 - RNA, 14 nt, Homo sapiens
cucuuagcaaaaac

SEQ ID NO: 634553 - RNA, 14 nt, Homo sapiens
cucuuagugauuga

SEQ ID NO: 634554 - RNA, 20 nt, Homo sapiens
cucuuaguuauugcugaaga

SEQ ID NO: 634555 - RNA, 17 nt, Homo sapiens
cucuuauccaacaucaa

SEQ ID NO: 634556 - RNA, 18 nt, Homo sapiens
cucuucaacugaccagcc

SEQ ID NO: 634557 - RNA, 21 nt, Homo sapiens
cucuucaacugaccagccucc

SEQ ID NO: 634558 - RNA, 13 nt, Homo sapiens
cucuucacagucc

SEQ ID NO: 634559 - RNA, 19 nt, Homo sapiens
cucuucagaaaacccuuuu

SEQ ID NO: 634560 - RNA, 20 nt, Homo sapiens
cucuucagccauaguggauc

SEQ ID NO: 634561 - RNA, 20 nt, Homo sapiens
cucuucagccccuagugcua

SEQ ID NO: 634562 - RNA, 13 nt, Homo sapiens
cucuuccacagga

SEQ ID NO: 634563 - RNA, 13 nt, Homo sapiens
cucuucccaugac

SEQ ID NO: 634564 - RNA, 15 nt, Homo sapiens
cucuucccaugacug

SEQ ID NO: 634565 - RNA, 17 nt, Homo sapiens
cucuucccccaccacca

SEQ ID NO: 634566 - RNA, 20 nt, Homo sapiens
cucuucccuuccuccauugc

SEQ ID NO: 634567 - RNA, 16 nt, Homo sapiens
cucuuccuaaguauau

SEQ ID NO: 634568 - RNA, 22 nt, Homo sapiens
cucuuccuacccaaccacucaa

SEQ ID NO: 634569 - RNA, 12 nt, Homo sapiens
cucuuccugacg

SEQ ID NO: 634570 - RNA, 20 nt, Homo sapiens
cucuuccuggucugaacucc

SEQ ID NO: 634571 - RNA, 15 nt, Homo sapiens
cucuuccugugaucc

SEQ ID NO: 634572 - RNA, 13 nt, Homo sapiens
cucuucuaacaca

SEQ ID NO: 634573 - RNA, 23 nt, Homo sapiens
cucuucuccaccucccacaaagg

SEQ ID NO: 634574 - RNA, 16 nt, Homo sapiens
cucuucugccuucuca

SEQ ID NO: 634575 - RNA, 17 nt, Homo sapiens
cucuucugggaacuucc

SEQ ID NO: 634576 - RNA, 20 nt, Homo sapiens
cucuucugggaacuuccuca

SEQ ID NO: 634577 - RNA, 21 nt, Homo sapiens
cucuucuucauugcaguuauu

SEQ ID NO: 634578 - RNA, 22 nt, Homo sapiens
cucuucuuccccagguccuucc

SEQ ID NO: 634579 - RNA, 15 nt, Homo sapiens
cucuucuuuauugca

SEQ ID NO: 634580 - RNA, 20 nt, Homo sapiens
cucuucuuuuucuuaccucc

SEQ ID NO: 634581 - RNA, 16 nt, Homo sapiens
cucuugaaauguagaa

SEQ ID NO: 634582 - RNA, 14 nt, Homo sapiens
cucuugaaccacag

SEQ ID NO: 634583 - RNA, 21 nt, Homo sapiens
cucuugaagacaacucugaaa

SEQ ID NO: 634584 - RNA, 14 nt, Homo sapiens
cucuugaccaggcu

SEQ ID NO: 634585 - RNA, 12 nt, Homo sapiens
cucuugagaaau

SEQ ID NO: 634586 - RNA, 21 nt, Homo sapiens
cucuugagccugggaggucaa

SEQ ID NO: 634587 - RNA, 23 nt, Homo sapiens
cucuugagucucuuuaccuaaug

SEQ ID NO: 634588 - RNA, 14 nt, Homo sapiens
cucuugaucugugu

SEQ ID NO: 634589 - RNA, 16 nt, Homo sapiens
cucuugcaaaguagcc

SEQ ID NO: 634590 - RNA, 16 nt, Homo sapiens
cucuugccagcauuuu

SEQ ID NO: 634591 - RNA, 18 nt, Homo sapiens
cucuugccuaaguauucc

SEQ ID NO: 634592 - RNA, 17 nt, Homo sapiens
cucuuggacaacagcuc

SEQ ID NO: 634593 - RNA, 12 nt, Homo sapiens
cucuuggcaguc

SEQ ID NO: 634594 - RNA, 19 nt, Homo sapiens
cucuuggcuccacugggau

SEQ ID NO: 634595 - RNA, 15 nt, Homo sapiens
cucuuggcuuccaga

SEQ ID NO: 634596 - RNA, 22 nt, Homo sapiens
cucuuguaagucaucuacuuaa

SEQ ID NO: 634597 - RNA, 19 nt, Homo sapiens
cucuuguacugccugccac

SEQ ID NO: 634598 - RNA, 17 nt, Homo sapiens
cucuuguauaugaugau

SEQ ID NO: 634599 - RNA, 21 nt, Homo sapiens
cucuuguauaugaugaucugg

SEQ ID NO: 634600 - RNA, 15 nt, Homo sapiens
cucuuguccugugau

SEQ ID NO: 634601 - RNA, 11 nt, Homo sapiens
cucuugucucc

SEQ ID NO: 634602 - RNA, 12 nt, Homo sapiens
cucuugucuccc

SEQ ID NO: 634603 - RNA, 21 nt, Homo sapiens
cucuugugcccuucugagccc

SEQ ID NO: 634604 - RNA, 17 nt, Homo sapiens
cucuuguuucacuccac

SEQ ID NO: 634605 - RNA, 17 nt, Homo sapiens
cucuuuaaauggcuuua

SEQ ID NO: 634606 - RNA, 19 nt, Homo sapiens
cucuuuauuuuuugauuga

SEQ ID NO: 634607 - RNA, 15 nt, Homo sapiens
cucuuucaaagcuaa

SEQ ID NO: 634608 - RNA, 21 nt, Homo sapiens
acucagaggagcugcaaauug

SEQ ID NO: 634609 - RNA, 16 nt, Homo sapiens
acucagaucugaucaa

SEQ ID NO: 634610 - RNA, 13 nt, Homo sapiens
acucagcacauuc

SEQ ID NO: 634611 - RNA, 14 nt, Homo sapiens
acucagcagcagag

SEQ ID NO: 634612 - RNA, 16 nt, Homo sapiens
acucagcagcagagag

SEQ ID NO: 634613 - RNA, 13 nt, Homo sapiens
acucagccaagac

SEQ ID NO: 634614 - RNA, 18 nt, Homo sapiens
acucagccacccugaguu

SEQ ID NO: 634615 - RNA, 16 nt, Homo sapiens
acucagccccuacccc

SEQ ID NO: 634616 - RNA, 17 nt, Homo sapiens
acucaggcuuucacuau

SEQ ID NO: 634617 - RNA, 16 nt, Homo sapiens
acucagggagcauuua

SEQ ID NO: 634618 - RNA, 13 nt, Homo sapiens
acucagggcuccu

SEQ ID NO: 634619 - RNA, 16 nt, Homo sapiens
acucaggggaccccac

SEQ ID NO: 634620 - RNA, 23 nt, Homo sapiens
acucagguucuucagggccaguc

SEQ ID NO: 634621 - RNA, 13 nt, Homo sapiens
acucaguagagau

SEQ ID NO: 634622 - RNA, 18 nt, Homo sapiens
acucagucucucuucucu

SEQ ID NO: 634623 - RNA, 16 nt, Homo sapiens
acucagugcagcaaua

SEQ ID NO: 634624 - RNA, 20 nt, Homo sapiens
acucauaggcuuauuuccaa

SEQ ID NO: 634625 - RNA, 15 nt, Homo sapiens
acucaucagagcagc

SEQ ID NO: 634626 - RNA, 17 nt, Homo sapiens
acucaucugacucauuc

SEQ ID NO: 634627 - RNA, 15 nt, Homo sapiens
acucaucuguuaucc

SEQ ID NO: 634628 - RNA, 18 nt, Homo sapiens
acucaugaagcauacccc

SEQ ID NO: 634629 - RNA, 13 nt, Homo sapiens
acucauucagucc

SEQ ID NO: 634630 - RNA, 19 nt, Homo sapiens
acucauucccauguuguca

SEQ ID NO: 634631 - RNA, 15 nt, Homo sapiens
acucauuucaucuca

SEQ ID NO: 634632 - RNA, 22 nt, Homo sapiens
acucauuucauuccuaacacag

SEQ ID NO: 634633 - RNA, 20 nt, Homo sapiens
acucauuuggauugccuuac

SEQ ID NO: 634634 - RNA, 22 nt, Homo sapiens
acuccaaacagaccccuguuca

SEQ ID NO: 634635 - RNA, 20 nt, Homo sapiens
acuccaagaccaccaggguc

SEQ ID NO: 634636 - RNA, 12 nt, Homo sapiens
acuccacagugu

SEQ ID NO: 634637 - RNA, 21 nt, Homo sapiens
acuccacucagguucuucagg

SEQ ID NO: 634638 - RNA, 20 nt, Homo sapiens
acuccacuggccuccuggca

SEQ ID NO: 634639 - RNA, 19 nt, Homo sapiens
acuccacuugaagcacuua

SEQ ID NO: 634640 - RNA, 14 nt, Homo sapiens
acuccagacuugua

SEQ ID NO: 634641 - RNA, 17 nt, Homo sapiens
acuccagagacagggaa

SEQ ID NO: 634642 - RNA, 17 nt, Homo sapiens
acuccagagggccuucc

SEQ ID NO: 634643 - RNA, 13 nt, Homo sapiens
acuccagccugag

SEQ ID NO: 634644 - RNA, 16 nt, Homo sapiens
acuccagcucugagac

SEQ ID NO: 634645 - RNA, 14 nt, Homo sapiens
acuccagcugcaag

SEQ ID NO: 634646 - RNA, 20 nt, Homo sapiens
acuccagcugggagacacag

SEQ ID NO: 634647 - RNA, 22 nt, Homo sapiens
acuccaggggcccccguguuca

SEQ ID NO: 634648 - RNA, 13 nt, Homo sapiens
acuccaguaaaaa

SEQ ID NO: 634649 - RNA, 13 nt, Homo sapiens
acuccagugccca

SEQ ID NO: 634650 - RNA, 12 nt, Homo sapiens
acuccaucucaa

SEQ ID NO: 634651 - RNA, 13 nt, Homo sapiens
acuccaucucuac

SEQ ID NO: 634652 - RNA, 19 nt, Homo sapiens
acuccaugcuccuugagag

SEQ ID NO: 634653 - RNA, 12 nt, Homo sapiens
acuccauucaaa

SEQ ID NO: 634654 - RNA, 19 nt, Homo sapiens
acuccauuggaucugcaag

SEQ ID NO: 634655 - RNA, 18 nt, Homo sapiens
acucccaccacaggcaua

SEQ ID NO: 634656 - RNA, 19 nt, Homo sapiens
acucccagauggcucuuuc

SEQ ID NO: 634657 - RNA, 16 nt, Homo sapiens
acucccccucuuucac

SEQ ID NO: 634658 - RNA, 17 nt, Homo sapiens
acuccccuaaacuccag

SEQ ID NO: 634659 - RNA, 24 nt, Homo sapiens
acucccucuucacuguggccacag

SEQ ID NO: 634660 - RNA, 18 nt, Homo sapiens
acucccugcagaugccac

SEQ ID NO: 634661 - RNA, 23 nt, Homo sapiens
acucccuucucguguuugcuuaa

SEQ ID NO: 634662 - RNA, 15 nt, Homo sapiens
acuccggagguagag

SEQ ID NO: 634663 - RNA, 13 nt, Homo sapiens
acuccggggagcg

SEQ ID NO: 634664 - RNA, 18 nt, Homo sapiens
acuccuaagacuuaugua

SEQ ID NO: 634665 - RNA, 20 nt, Homo sapiens
acuccuauaaggagaguuca

SEQ ID NO: 634666 - RNA, 17 nt, Homo sapiens
acuccucaaaccacuug

SEQ ID NO: 634667 - RNA, 22 nt, Homo sapiens
acuccucagaucugaacacagu

SEQ ID NO: 634668 - RNA, 15 nt, Homo sapiens
acuccucauaccuca

SEQ ID NO: 634669 - RNA, 14 nt, Homo sapiens
acuccuccaaggca

SEQ ID NO: 634670 - RNA, 18 nt, Homo sapiens
acuccuccuuuuacagaa

SEQ ID NO: 634671 - RNA, 22 nt, Homo sapiens
acuccucucccuugagggauaa

SEQ ID NO: 634672 - RNA, 21 nt, Homo sapiens
acuccucugucauaugcagaa

SEQ ID NO: 634673 - RNA, 13 nt, Homo sapiens
acuccucuuggug

SEQ ID NO: 634674 - RNA, 23 nt, Homo sapiens
acuccugacgucugaagcuugac

SEQ ID NO: 634675 - RNA, 14 nt, Homo sapiens
acuccugccauagu

SEQ ID NO: 634676 - RNA, 13 nt, Homo sapiens
acuccuggacaac

SEQ ID NO: 634677 - RNA, 12 nt, Homo sapiens
acuccuggagaa

SEQ ID NO: 634678 - RNA, 17 nt, Homo sapiens
acuccuggccucaagca

SEQ ID NO: 634679 - RNA, 18 nt, Homo sapiens
acuccuguaacugucuca

SEQ ID NO: 634680 - RNA, 20 nt, Homo sapiens
acuccuguaacugucucaga

SEQ ID NO: 634681 - RNA, 21 nt, Homo sapiens
acuccugucccuguagcucag

SEQ ID NO: 634682 - RNA, 17 nt, Homo sapiens
acuccugugucugugua

SEQ ID NO: 634683 - RNA, 17 nt, Homo sapiens
acuccuuagagacauca

SEQ ID NO: 634684 - RNA, 21 nt, Homo sapiens
acuccuuaggcuuuguugaau

SEQ ID NO: 634685 - RNA, 14 nt, Homo sapiens
acuccuuauuuggc

SEQ ID NO: 634686 - RNA, 13 nt, Homo sapiens
acuccuuccauca

SEQ ID NO: 634687 - RNA, 13 nt, Homo sapiens
acuccuuccuuca

SEQ ID NO: 634688 - RNA, 19 nt, Homo sapiens
acuccuuguaaagacugua

SEQ ID NO: 634689 - RNA, 12 nt, Homo sapiens
acucgacccaga

SEQ ID NO: 634690 - RNA, 13 nt, Homo sapiens
acucgcagcaccc

SEQ ID NO: 634691 - RNA, 21 nt, Homo sapiens
acucggaaacuauaaguaauu

SEQ ID NO: 634692 - RNA, 17 nt, Homo sapiens
acucggcuuccuguggg

SEQ ID NO: 634693 - RNA, 22 nt, Homo sapiens
acucgggaccaauacuacugac

SEQ ID NO: 634694 - RNA, 17 nt, Homo sapiens
acucggggcaggccagc

SEQ ID NO: 634695 - RNA, 13 nt, Homo sapiens
acucgugugcaac

SEQ ID NO: 634696 - RNA, 19 nt, Homo sapiens
acucuaaagccaagcacuu

SEQ ID NO: 634697 - RNA, 17 nt, Homo sapiens
acucuaacccuguggaa

SEQ ID NO: 634698 - RNA, 18 nt, Homo sapiens
acucuaagcuggagcucu

SEQ ID NO: 634699 - RNA, 14 nt, Homo sapiens
acucuacacuguga

SEQ ID NO: 634700 - RNA, 13 nt, Homo sapiens
acucuaccaaaua

SEQ ID NO: 634701 - RNA, 17 nt, Homo sapiens
acucuaccucauaucag

SEQ ID NO: 634702 - RNA, 16 nt, Homo sapiens
acucuacgccaaagug

SEQ ID NO: 634703 - RNA, 21 nt, Homo sapiens
acucuagccugggccagagaa

SEQ ID NO: 634704 - RNA, 18 nt, Homo sapiens
acucuagggaaaaaccag

SEQ ID NO: 634705 - RNA, 16 nt, Homo sapiens
acucuaggguccagug

SEQ ID NO: 634706 - RNA, 21 nt, Homo sapiens
acucuaguagggagaggcucu

SEQ ID NO: 634707 - RNA, 14 nt, Homo sapiens
acucuaguccuugg

SEQ ID NO: 634708 - RNA, 17 nt, Homo sapiens
acucuauaagauuccaa

SEQ ID NO: 634709 - RNA, 18 nt, Homo sapiens
acucuauaagauuccaaa

SEQ ID NO: 634710 - RNA, 22 nt, Homo sapiens
acucuauaagauuccaaaaagc

SEQ ID NO: 634711 - RNA, 14 nt, Homo sapiens
acucucacacugaa

SEQ ID NO: 634712 - RNA, 23 nt, Homo sapiens
acucucacccgaccggugcauga

SEQ ID NO: 634713 - RNA, 17 nt, Homo sapiens
acucucaucaccccaga

SEQ ID NO: 634714 - RNA, 20 nt, Homo sapiens
acucuccaauguucuauuaa

SEQ ID NO: 634715 - RNA, 22 nt, Homo sapiens
acucuccccucccucuuccuuc

SEQ ID NO: 634716 - RNA, 21 nt, Homo sapiens
acucuccuagagacagaagca

SEQ ID NO: 634717 - RNA, 18 nt, Homo sapiens
acucucugcaguccuccg

SEQ ID NO: 634718 - RNA, 23 nt, Homo sapiens
acucucugccuguaaauguuccc

SEQ ID NO: 634719 - RNA, 13 nt, Homo sapiens
acucucugcucua

SEQ ID NO: 634720 - RNA, 20 nt, Homo sapiens
acucucuguuuuaguguuua

SEQ ID NO: 634721 - RNA, 19 nt, Homo sapiens
acucucuugccagcauuuu

SEQ ID NO: 634722 - RNA, 12 nt, Homo sapiens
acucugaaaaug

SEQ ID NO: 634723 - RNA, 16 nt, Homo sapiens
acucugaaacugagaa

SEQ ID NO: 634724 - RNA, 22 nt, Homo sapiens
acucugaagaccuuuaauggcu

SEQ ID NO: 634725 - RNA, 19 nt, Homo sapiens
acucugaccacagcccgcu

SEQ ID NO: 634726 - RNA, 14 nt, Homo sapiens
acucugaccuguac

SEQ ID NO: 634727 - RNA, 14 nt, Homo sapiens
acucugaguccacu

SEQ ID NO: 634728 - RNA, 16 nt, Homo sapiens
acucugcacuacuccu

SEQ ID NO: 634729 - RNA, 15 nt, Homo sapiens
acucugcuccaaagu

SEQ ID NO: 634730 - RNA, 23 nt, Homo sapiens
acucugcuuaaacaaagcaguau

SEQ ID NO: 634731 - RNA, 18 nt, Homo sapiens
acugagcuacuagagaua

SEQ ID NO: 634732 - RNA, 15 nt, Homo sapiens
acugaggaauuucac

SEQ ID NO: 634733 - RNA, 21 nt, Homo sapiens
acugaggacuguuugcaauug

SEQ ID NO: 634734 - RNA, 20 nt, Homo sapiens
acugaggcagacagcagcuc

SEQ ID NO: 634735 - RNA, 19 nt, Homo sapiens
acugagguugggguguacu

SEQ ID NO: 634736 - RNA, 22 nt, Homo sapiens
acugaguacguugugcauuugg

SEQ ID NO: 634737 - RNA, 23 nt, Homo sapiens
acugaguccucguagccaucucu

SEQ ID NO: 634738 - RNA, 13 nt, Homo sapiens
acugauaaucucu

SEQ ID NO: 634739 - RNA, 13 nt, Homo sapiens
acugauacuuuca

SEQ ID NO: 634740 - RNA, 18 nt, Homo sapiens
acugaucaccuguuagca

SEQ ID NO: 634741 - RNA, 20 nt, Homo sapiens
acugaucugcuagugcugua

SEQ ID NO: 634742 - RNA, 12 nt, Homo sapiens
acugaugacuuu

SEQ ID NO: 634743 - RNA, 17 nt, Homo sapiens
acugauggaaaauacca

SEQ ID NO: 634744 - RNA, 15 nt, Homo sapiens
acugauucacugcau

SEQ ID NO: 634745 - RNA, 14 nt, Homo sapiens
acugauuccuggag

SEQ ID NO: 634746 - RNA, 14 nt, Homo sapiens
acugauucucuaca

SEQ ID NO: 634747 - RNA, 15 nt, Homo sapiens
acugauucucuacau

SEQ ID NO: 634748 - RNA, 14 nt, Homo sapiens
acugauuucacaac

SEQ ID NO: 634749 - RNA, 20 nt, Homo sapiens
acugauuuuuagcuuuacaa

SEQ ID NO: 634750 - RNA, 16 nt, Homo sapiens
acugcaaaccauggug

SEQ ID NO: 634751 - RNA, 15 nt, Homo sapiens
acugcaaccucugcc

SEQ ID NO: 634752 - RNA, 16 nt, Homo sapiens
acugcaaccucugccu

SEQ ID NO: 634753 - RNA, 20 nt, Homo sapiens
acugcacacacagcuccucu

SEQ ID NO: 634754 - RNA, 15 nt, Homo sapiens
acugcacacugccug

SEQ ID NO: 634755 - RNA, 19 nt, Homo sapiens
acugcacagugcaucucag

SEQ ID NO: 634756 - RNA, 16 nt, Homo sapiens
acugcaccaacgagcu

SEQ ID NO: 634757 - RNA, 21 nt, Homo sapiens
acugcaccugggcagcuccuc

SEQ ID NO: 634758 - RNA, 20 nt, Homo sapiens
acugcacuccagccugggca

SEQ ID NO: 634759 - RNA, 22 nt, Homo sapiens
acugcagacgggaaugccuagg

SEQ ID NO: 634760 - RNA, 16 nt, Homo sapiens
acugcagcaccuccag

SEQ ID NO: 634761 - RNA, 20 nt, Homo sapiens
acugcagccuugaacuccug

SEQ ID NO: 634762 - RNA, 19 nt, Homo sapiens
acugcagcgcgcuccugac

SEQ ID NO: 634763 - RNA, 13 nt, Homo sapiens
acugcagcuuugu

SEQ ID NO: 634764 - RNA, 23 nt, Homo sapiens
acugcaggggaggccacgugcag

SEQ ID NO: 634765 - RNA, 20 nt, Homo sapiens
acugcauaaaccaaugagcu

SEQ ID NO: 634766 - RNA, 22 nt, Homo sapiens
acugcaucguuucaucuuccaa

SEQ ID NO: 634767 - RNA, 16 nt, Homo sapiens
acugcauguaagccaa

SEQ ID NO: 634768 - RNA, 18 nt, Homo sapiens
acugcauucuucugagca

SEQ ID NO: 634769 - RNA, 22 nt, Homo sapiens
acugcauucuucugagcacugu

SEQ ID NO: 634770 - RNA, 20 nt, Homo sapiens
acugccacacucuccaucac

SEQ ID NO: 634771 - RNA, 13 nt, Homo sapiens
acugccagcagca

SEQ ID NO: 634772 - RNA, 17 nt, Homo sapiens
acugccagcucucugau

SEQ ID NO: 634773 - RNA, 21 nt, Homo sapiens
acugcccaggccuaucuggaa

SEQ ID NO: 634774 - RNA, 21 nt, Homo sapiens
acugccccacggagacagagg

SEQ ID NO: 634775 - RNA, 21 nt, Homo sapiens
acugccccccgaggcugcuag

SEQ ID NO: 634776 - RNA, 23 nt, Homo sapiens
acugccccccugccuugcucccc

SEQ ID NO: 634777 - RNA, 13 nt, Homo sapiens
acugcccuuccag

SEQ ID NO: 634778 - RNA, 16 nt, Homo sapiens
acuauuaauacucugc

SEQ ID NO: 634779 - RNA, 21 nt, Homo sapiens
acuauucacugaugcagaaag

SEQ ID NO: 634780 - RNA, 16 nt, Homo sapiens
acuauugaaaucaagc

SEQ ID NO: 634781 - RNA, 21 nt, Homo sapiens
acuauugaaguugcagauuca

SEQ ID NO: 634782 - RNA, 16 nt, Homo sapiens
acuauugagccuugca

SEQ ID NO: 634783 - RNA, 22 nt, Homo sapiens
acuauuggugcuugacucucac

SEQ ID NO: 634784 - RNA, 18 nt, Homo sapiens
acuauuuaaagccuccuc

SEQ ID NO: 634785 - RNA, 21 nt, Homo sapiens
acuauuuaaaggaaaaucaca

SEQ ID NO: 634786 - RNA, 22 nt, Homo sapiens
acuauuuaaguaaauacaguag

SEQ ID NO: 634787 - RNA, 18 nt, Homo sapiens
acuauuuccaaaagcaca

SEQ ID NO: 634788 - RNA, 22 nt, Homo sapiens
acuauuucugggucuuuugcua

SEQ ID NO: 634789 - RNA, 19 nt, Homo sapiens
acuauuucuugugguuaua

SEQ ID NO: 634790 - RNA, 15 nt, Homo sapiens
acuauuuuaccugaa

SEQ ID NO: 634791 - RNA, 21 nt, Homo sapiens
acucaaaaauccuaacauuca

SEQ ID NO: 634792 - RNA, 19 nt, Homo sapiens
acucaaaacacccaaaaau

SEQ ID NO: 634793 - RNA, 14 nt, Homo sapiens
acucaaaagagaga

SEQ ID NO: 634794 - RNA, 15 nt, Homo sapiens
acucaaaauauguca

SEQ ID NO: 634795 - RNA, 13 nt, Homo sapiens
acucaaacugccu

SEQ ID NO: 634796 - RNA, 15 nt, Homo sapiens
acucaaaugcucaga

SEQ ID NO: 634797 - RNA, 21 nt, Homo sapiens
acucaaaugcucagaccagcu

SEQ ID NO: 634798 - RNA, 13 nt, Homo sapiens
acucaacccauug

SEQ ID NO: 634799 - RNA, 22 nt, Homo sapiens
acucaacuucuuuccucuggag

SEQ ID NO: 634800 - RNA, 17 nt, Homo sapiens
acucaaggaauuugcau

SEQ ID NO: 634801 - RNA, 23 nt, Homo sapiens
acucaagguggacgugcguucug

SEQ ID NO: 634802 - RNA, 20 nt, Homo sapiens
acucaaguccuuaccucuuc

SEQ ID NO: 634803 - RNA, 22 nt, Homo sapiens
acucaaguuucagguaugcuua

SEQ ID NO: 634804 - RNA, 14 nt, Homo sapiens
acucaaucauuucu

SEQ ID NO: 634805 - RNA, 16 nt, Homo sapiens
acucaaucuccagggc

SEQ ID NO: 634806 - RNA, 15 nt, Homo sapiens
acucaaugccaacuu

SEQ ID NO: 634807 - RNA, 22 nt, Homo sapiens
acucaaugccaacuuuuuguua

SEQ ID NO: 634808 - RNA, 15 nt, Homo sapiens
acucacagcuucucc

SEQ ID NO: 634809 - RNA, 17 nt, Homo sapiens
acucaccuguucucacu

SEQ ID NO: 634810 - RNA, 21 nt, Homo sapiens
acucacguuugcuuaaacccu

SEQ ID NO: 634811 - RNA, 21 nt, Homo sapiens
acucacuccagcccaacagaa

SEQ ID NO: 634812 - RNA, 21 nt, Homo sapiens
acucacucucccccuccucuu

SEQ ID NO: 634813 - RNA, 13 nt, Homo sapiens
acucacugccuag

SEQ ID NO: 634814 - RNA, 14 nt, Homo sapiens
acucacugccuagg

SEQ ID NO: 634815 - RNA, 15 nt, Homo sapiens
acucacugccuagga

SEQ ID NO: 634816 - RNA, 22 nt, Homo sapiens
acucacugcugugagugcgccu

SEQ ID NO: 634817 - RNA, 23 nt, Homo sapiens
acucacugggaagcucccacccc

SEQ ID NO: 634818 - RNA, 17 nt, Homo sapiens
acucacuucucagcuga

SEQ ID NO: 634819 - RNA, 23 nt, Homo sapiens
acucagaaagccaacauguggcu

SEQ ID NO: 634820 - RNA, 14 nt, Homo sapiens
acucagagacuuca

SEQ ID NO: 634821 - RNA, 20 nt, Homo sapiens
agauaccggugcuucuggaa

SEQ ID NO: 634822 - RNA, 20 nt, Homo sapiens
agauacuaguuuugcugaaa

SEQ ID NO: 634823 - RNA, 19 nt, Homo sapiens
agauacucauuagugacuu

SEQ ID NO: 634824 - RNA, 16 nt, Homo sapiens
agauacuggaaaccua

SEQ ID NO: 634825 - RNA, 16 nt, Homo sapiens
agauacuguuguuacu

SEQ ID NO: 634826 - RNA, 14 nt, Homo sapiens
agauacuuaugaaa

SEQ ID NO: 634827 - RNA, 16 nt, Homo sapiens
agauagaagaacugca

SEQ ID NO: 634828 - RNA, 17 nt, Homo sapiens
agauagaagaacugcaa

SEQ ID NO: 634829 - RNA, 15 nt, Homo sapiens
agauagagaccaucu

SEQ ID NO: 634830 - RNA, 19 nt, Homo sapiens
agauagaugcacuuaugca

SEQ ID NO: 634831 - RNA, 16 nt, Homo sapiens
agauagcuucacccca

SEQ ID NO: 634832 - RNA, 15 nt, Homo sapiens
agauagguaaauacc

SEQ ID NO: 634833 - RNA, 18 nt, Homo sapiens
agauagguggugccagug

SEQ ID NO: 634834 - RNA, 14 nt, Homo sapiens
agauaguagaacca

SEQ ID NO: 634835 - RNA, 20 nt, Homo sapiens
agauaguagcauacauuuau

SEQ ID NO: 634836 - RNA, 12 nt, Homo sapiens
agauagucacag

SEQ ID NO: 634837 - RNA, 23 nt, Homo sapiens
agauagucuauguauguguaaaa

SEQ ID NO: 634838 - RNA, 14 nt, Homo sapiens
agauagugccaggu

SEQ ID NO: 634839 - RNA, 20 nt, Homo sapiens
agauaguugauucuugccuu

SEQ ID NO: 634840 - RNA, 15 nt, Homo sapiens
agauauauaugugcu

SEQ ID NO: 634841 - RNA, 21 nt, Homo sapiens
agauauauaugugcucuuaau

SEQ ID NO: 634842 - RNA, 20 nt, Homo sapiens
agauauauguguauacauac

SEQ ID NO: 634843 - RNA, 22 nt, Homo sapiens
agauaugauaccaaagacacaa

SEQ ID NO: 634844 - RNA, 11 nt, Homo sapiens
agauaugcaaa

SEQ ID NO: 634845 - RNA, 15 nt, Homo sapiens
agauaugcuuauaca

SEQ ID NO: 634846 - RNA, 21 nt, Homo sapiens
agauauguugaauuaacauaa

SEQ ID NO: 634847 - RNA, 17 nt, Homo sapiens
agauauuaauguuaaca

SEQ ID NO: 634848 - RNA, 18 nt, Homo sapiens
agauauuaggucccauca

SEQ ID NO: 634849 - RNA, 22 nt, Homo sapiens
agauauugucagaguucugcuc

SEQ ID NO: 634850 - RNA, 18 nt, Homo sapiens
agauauuuuaaacuuuug

SEQ ID NO: 634851 - RNA, 21 nt, Homo sapiens
agauauuuugcuuugugauuu

SEQ ID NO: 634852 - RNA, 15 nt, Homo sapiens
agaucacaauacuca

SEQ ID NO: 634853 - RNA, 13 nt, Homo sapiens
agaucacacauca

SEQ ID NO: 634854 - RNA, 15 nt, Homo sapiens
agaucacccacuccu

SEQ ID NO: 634855 - RNA, 16 nt, Homo sapiens
agaucacccacuccua

SEQ ID NO: 634856 - RNA, 22 nt, Homo sapiens
agaucacugccacacucuccau

SEQ ID NO: 634857 - RNA, 22 nt, Homo sapiens
agaucacuuguuguuuuacuaa

SEQ ID NO: 634858 - RNA, 15 nt, Homo sapiens
agaucagaacaugaa

SEQ ID NO: 634859 - RNA, 16 nt, Homo sapiens
agaucagaacaugaaa

SEQ ID NO: 634860 - RNA, 22 nt, Homo sapiens
agaucagccugaccaacauggu

SEQ ID NO: 634861 - RNA, 16 nt, Homo sapiens
agaucagguuugccca

SEQ ID NO: 634862 - RNA, 18 nt, Homo sapiens
agaucauaggaaguggcu

SEQ ID NO: 634863 - RNA, 14 nt, Homo sapiens
agaucaucagucac

SEQ ID NO: 634864 - RNA, 11 nt, Homo sapiens
agaucaugaca

SEQ ID NO: 634865 - RNA, 19 nt, Homo sapiens
agaucaugacauaugacuu

SEQ ID NO: 634866 - RNA, 23 nt, Homo sapiens
agaucaugccauugcauuccagc

SEQ ID NO: 634867 - RNA, 15 nt, Homo sapiens
agaucaugggucaag

SEQ ID NO: 634868 - RNA, 20 nt, Homo sapiens
agauccagauccagacugua

SEQ ID NO: 634869 - RNA, 16 nt, Homo sapiens
agauccccaagccugg

SEQ ID NO: 634870 - RNA, 16 nt, Homo sapiens
agauccccguguuacu

SEQ ID NO: 634871 - RNA, 17 nt, Homo sapiens
agauccgagugugauuu

SEQ ID NO: 634872 - RNA, 20 nt, Homo sapiens
agauccuaagucucuuacaa

SEQ ID NO: 634873 - RNA, 20 nt, Homo sapiens
agauccugagcucacagagu

SEQ ID NO: 634874 - RNA, 20 nt, Homo sapiens
agaucgagaccauccuggcc

SEQ ID NO: 634875 - RNA, 20 nt, Homo sapiens
agaucgagaccauccuggcu

SEQ ID NO: 634876 - RNA, 21 nt, Homo sapiens
agaucgauccuggauucacuc

SEQ ID NO: 634877 - RNA, 21 nt, Homo sapiens
agaucgaugauaugaccagaa

SEQ ID NO: 634878 - RNA, 15 nt, Homo sapiens
agaucgcaccacugc

SEQ ID NO: 634879 - RNA, 19 nt, Homo sapiens
agaucgcgccauugcacuc

SEQ ID NO: 634880 - RNA, 19 nt, Homo sapiens
agaucguucucugccucac

SEQ ID NO: 634881 - RNA, 16 nt, Homo sapiens
agaucguuuaaaaaca

SEQ ID NO: 634882 - RNA, 20 nt, Homo sapiens
agaucuaagccuuuccauaa

SEQ ID NO: 634883 - RNA, 21 nt, Homo sapiens
agaucuaauauugacugccuc

SEQ ID NO: 634884 - RNA, 22 nt, Homo sapiens
agaucuaauauugacugccucu

SEQ ID NO: 634885 - RNA, 14 nt, Homo sapiens
agaucuacauacaa

SEQ ID NO: 634886 - RNA, 16 nt, Homo sapiens
agaucucccaugugua

SEQ ID NO: 634887 - RNA, 15 nt, Homo sapiens
agaucugaacccagc

SEQ ID NO: 634888 - RNA, 19 nt, Homo sapiens
agaucugagauugaauauu

SEQ ID NO: 634889 - RNA, 21 nt, Homo sapiens
agaucugcuugaucaauuccc

SEQ ID NO: 634890 - RNA, 20 nt, Homo sapiens
agaucuggggaggcaggcau

SEQ ID NO: 634891 - RNA, 18 nt, Homo sapiens
agaucuggucccuugcag

SEQ ID NO: 634892 - RNA, 22 nt, Homo sapiens
agaucuuaguucuagauggaga

SEQ ID NO: 634893 - RNA, 13 nt, Homo sapiens
agaucuuccccaa

SEQ ID NO: 634894 - RNA, 13 nt, Homo sapiens
agaucuugaauag

SEQ ID NO: 634895 - RNA, 19 nt, Homo sapiens
agaucuugaauagucucau

SEQ ID NO: 634896 - RNA, 10 nt, Homo sapiens
agaucuugau

SEQ ID NO: 634897 - RNA, 16 nt, Homo sapiens
agaucuuucucuuccc

SEQ ID NO: 634898 - RNA, 18 nt, Homo sapiens
agaugaaauuuauuucca

SEQ ID NO: 634899 - RNA, 22 nt, Homo sapiens
agaugaaccugcagcaagcagc

SEQ ID NO: 634900 - RNA, 16 nt, Homo sapiens
agaugaagacaacagc

SEQ ID NO: 634901 - RNA, 20 nt, Homo sapiens
agaugaaggagaggcaacau

SEQ ID NO: 634902 - RNA, 12 nt, Homo sapiens
agaugaauuuau

SEQ ID NO: 634903 - RNA, 14 nt, Homo sapiens
agaugacaaaccau

SEQ ID NO: 634904 - RNA, 21 nt, Homo sapiens
agaugaccuacagugcugugu

SEQ ID NO: 634905 - RNA, 17 nt, Homo sapiens
agaugacgaguaacucc

SEQ ID NO: 634906 - RNA, 13 nt, Homo sapiens
agaugacugucca

SEQ ID NO: 634907 - RNA, 18 nt, Homo sapiens
agaugagaaagcuuuuau

SEQ ID NO: 634908 - RNA, 21 nt, Homo sapiens
agaugaguaauuucuuuggca

SEQ ID NO: 634909 - RNA, 18 nt, Homo sapiens
agaugagucagugccaug

SEQ ID NO: 634910 - RNA, 19 nt, Homo sapiens
agaugauacauccaaagca

SEQ ID NO: 634911 - RNA, 14 nt, Homo sapiens
agaugaucaucucc

SEQ ID NO: 634912 - RNA, 15 nt, Homo sapiens
agaugaucauuugcc

SEQ ID NO: 634913 - RNA, 17 nt, Homo sapiens
agaugaucccagucacu

SEQ ID NO: 634914 - RNA, 13 nt, Homo sapiens
agaugaucucucc

SEQ ID NO: 634915 - RNA, 17 nt, Homo sapiens
agaugauuuuccucccu

SEQ ID NO: 634916 - RNA, 15 nt, Homo sapiens
agaugcaaccucacu

SEQ ID NO: 634917 - RNA, 19 nt, Homo sapiens
agaugcaaggaccaggacu

SEQ ID NO: 634918 - RNA, 21 nt, Homo sapiens
agaugcaggaggcucagguga

SEQ ID NO: 634919 - RNA, 17 nt, Homo sapiens
agaugcaucacugggug

SEQ ID NO: 634920 - RNA, 18 nt, Homo sapiens
agaugccaaaccacaaga

SEQ ID NO: 634921 - RNA, 15 nt, Homo sapiens
agaugccacauucaa

SEQ ID NO: 634922 - RNA, 17 nt, Homo sapiens
agaugccagggcuggaa

SEQ ID NO: 634923 - RNA, 13 nt, Homo sapiens
agaugccagugaa

SEQ ID NO: 634924 - RNA, 18 nt, Homo sapiens
agaugcccccuccaggag

SEQ ID NO: 634925 - RNA, 20 nt, Homo sapiens
agaugcccucauaaaccaau

SEQ ID NO: 634926 - RNA, 15 nt, Homo sapiens
agaugcccuccaauc

SEQ ID NO: 634927 - RNA, 14 nt, Homo sapiens
agaugccuucccuu

SEQ ID NO: 634928 - RNA, 20 nt, Homo sapiens
agaugcuacgcuccagcuga

SEQ ID NO: 634929 - RNA, 15 nt, Homo sapiens
agaugcuacuggacu

SEQ ID NO: 634930 - RNA, 20 nt, Homo sapiens
agaugcugguuuucuaccca

SEQ ID NO: 634931 - RNA, 15 nt, Homo sapiens
agaugcuguugugaa

SEQ ID NO: 634932 - RNA, 15 nt, Homo sapiens
agaugcuugguugug

SEQ ID NO: 634933 - RNA, 16 nt, Homo sapiens
agauggaaaagaaauu

SEQ ID NO: 634934 - RNA, 19 nt, Homo sapiens
agauggaaaagaaauugca

SEQ ID NO: 634935 - RNA, 20 nt, Homo sapiens
agauggaaaagaaauugcau

SEQ ID NO: 634936 - RNA, 22 nt, Homo sapiens
agauggaagucaccuuucuggg

SEQ ID NO: 634937 - RNA, 16 nt, Homo sapiens
agauggacacugccaa

SEQ ID NO: 634938 - RNA, 16 nt, Homo sapiens
agauggacagcgauga

SEQ ID NO: 634939 - RNA, 22 nt, Homo sapiens
agauggacucaggauccaguga

SEQ ID NO: 634940 - RNA, 14 nt, Homo sapiens
agauggagucuugc

SEQ ID NO: 634941 - RNA, 15 nt, Homo sapiens
agauggaguuucacu

SEQ ID NO: 634942 - RNA, 17 nt, Homo sapiens
agauggauuuguaucaa

SEQ ID NO: 634943 - RNA, 18 nt, Homo sapiens
agcaauuccucugaacaa

SEQ ID NO: 634944 - RNA, 20 nt, Homo sapiens
agcaauuguauuacuuccuc

SEQ ID NO: 634945 - RNA, 22 nt, Homo sapiens
agcaauuugauaaaauauacuu

SEQ ID NO: 634946 - RNA, 11 nt, Homo sapiens
agcacaaacau

SEQ ID NO: 634947 - RNA, 21 nt, Homo sapiens
agcacaaccggucccuuccau

SEQ ID NO: 634948 - RNA, 16 nt, Homo sapiens
agcacaaggccuuaau

SEQ ID NO: 634949 - RNA, 22 nt, Homo sapiens
agcacaaucacuaaacuuuauu

SEQ ID NO: 634950 - RNA, 15 nt, Homo sapiens
agcacaauuugcacu

SEQ ID NO: 634951 - RNA, 20 nt, Homo sapiens
agcacacaauaagcauucaa

SEQ ID NO: 634952 - RNA, 15 nt, Homo sapiens
agcacaccaaguggc

SEQ ID NO: 634953 - RNA, 17 nt, Homo sapiens
agcacaccaaguggcug

SEQ ID NO: 634954 - RNA, 21 nt, Homo sapiens
agcacaccuacagagcaccug

SEQ ID NO: 634955 - RNA, 15 nt, Homo sapiens
agcacaccucugggg

SEQ ID NO: 634956 - RNA, 16 nt, Homo sapiens
agcacacuuuacacaa

SEQ ID NO: 634957 - RNA, 23 nt, Homo sapiens
agcacagagucgcuggcauguuu

SEQ ID NO: 634958 - RNA, 15 nt, Homo sapiens
agcacagcagcaucu

SEQ ID NO: 634959 - RNA, 20 nt, Homo sapiens
agcacagcagccccugcaca

SEQ ID NO: 634960 - RNA, 11 nt, Homo sapiens
agcacagccaa

SEQ ID NO: 634961 - RNA, 16 nt, Homo sapiens
agcacagcuccugcca

SEQ ID NO: 634962 - RNA, 17 nt, Homo sapiens
agcacagcugcauuaaa

SEQ ID NO: 634963 - RNA, 23 nt, Homo sapiens
agcacaggccauggugcacaaaa

SEQ ID NO: 634964 - RNA, 17 nt, Homo sapiens
agcacagguuagggcau

SEQ ID NO: 634965 - RNA, 11 nt, Homo sapiens
agcacaguaaa

SEQ ID NO: 634966 - RNA, 18 nt, Homo sapiens
agcacagugccugacaca

SEQ ID NO: 634967 - RNA, 18 nt, Homo sapiens
agcacauacuguguucca

SEQ ID NO: 634968 - RNA, 17 nt, Homo sapiens
agcacauagcuugccua

SEQ ID NO: 634969 - RNA, 13 nt, Homo sapiens
agcacaucaccuc

SEQ ID NO: 634970 - RNA, 17 nt, Homo sapiens
agcacaucucucugccc

SEQ ID NO: 634971 - RNA, 13 nt, Homo sapiens
agcacaugugcug

SEQ ID NO: 634972 - RNA, 15 nt, Homo sapiens
agcacaugugcugcc

SEQ ID NO: 634973 - RNA, 16 nt, Homo sapiens
agcaccauaacuuugu

SEQ ID NO: 634974 - RNA, 14 nt, Homo sapiens
agcaccaucucugc

SEQ ID NO: 634975 - RNA, 19 nt, Homo sapiens
agcacccauuucaaugugu

SEQ ID NO: 634976 - RNA, 14 nt, Homo sapiens
agcaccccaugcca

SEQ ID NO: 634977 - RNA, 15 nt, Homo sapiens
agcacccuacaggga

SEQ ID NO: 634978 - RNA, 19 nt, Homo sapiens
agcaccuacaguguacagu

SEQ ID NO: 634979 - RNA, 10 nt, Homo sapiens
agcaccucau

SEQ ID NO: 634980 - RNA, 18 nt, Homo sapiens
agcaccuccagccugaac

SEQ ID NO: 634981 - RNA, 21 nt, Homo sapiens
agcaccugaagugaccuggaa

SEQ ID NO: 634982 - RNA, 22 nt, Homo sapiens
agcaccugccccggcagugggg

SEQ ID NO: 634983 - RNA, 18 nt, Homo sapiens
agcaccuucuuucuggac

SEQ ID NO: 634984 - RNA, 21 nt, Homo sapiens
agcacgaggccucaggucggc

SEQ ID NO: 634985 - RNA, 14 nt, Homo sapiens
agcacggacucucc

SEQ ID NO: 634986 - RNA, 20 nt, Homo sapiens
agcacggccaccucucaggg

SEQ ID NO: 634987 - RNA, 18 nt, Homo sapiens
agcacgggggccaaggau

SEQ ID NO: 634988 - RNA, 20 nt, Homo sapiens
agcacggugacucuguccag

SEQ ID NO: 634989 - RNA, 17 nt, Homo sapiens
agcacuaggauugugau

SEQ ID NO: 634990 - RNA, 19 nt, Homo sapiens
agcacuauguggagcucag

SEQ ID NO: 634991 - RNA, 15 nt, Homo sapiens
agcacuauuaauacu

SEQ ID NO: 634992 - RNA, 12 nt, Homo sapiens
agcacucaagac

SEQ ID NO: 634993 - RNA, 21 nt, Homo sapiens
agcacuccccagagcugugcc

SEQ ID NO: 634994 - RNA, 22 nt, Homo sapiens
agcacucccuaauuuaugugcu

SEQ ID NO: 634995 - RNA, 20 nt, Homo sapiens
agcacucccuuaggcauuau

SEQ ID NO: 634996 - RNA, 19 nt, Homo sapiens
agcacuccgcaucaccuca

SEQ ID NO: 634997 - RNA, 12 nt, Homo sapiens
agcacuccucaa

SEQ ID NO: 634998 - RNA, 16 nt, Homo sapiens
agcacucgagaccauc

SEQ ID NO: 634999 - RNA, 14 nt, Homo sapiens
agcacugagcagaa

SEQ ID NO: 635000 - RNA, 15 nt, Homo sapiens
agcacugggugacca

SEQ ID NO: 635001 - RNA, 12 nt, Homo sapiens
agcacuggguug

SEQ ID NO: 635002 - RNA, 19 nt, Homo sapiens
agcacuggugaacugagcu

SEQ ID NO: 635003 - RNA, 17 nt, Homo sapiens
agcacuguuuauacacu

SEQ ID NO: 635004 - RNA, 23 nt, Homo sapiens
agcacuuuaacccucucuucccu

SEQ ID NO: 635005 - RNA, 11 nt, Homo sapiens
agcacuuuauc

SEQ ID NO: 635006 - RNA, 20 nt, Homo sapiens
agcacuuuggacauggcuca

SEQ ID NO: 635007 - RNA, 12 nt, Homo sapiens
agcacuuuugaa

SEQ ID NO: 635008 - RNA, 22 nt, Homo sapiens
agcagaaaucuagaagacuguc

SEQ ID NO: 635009 - RNA, 23 nt, Homo sapiens
agcagaaaucuagaagacuguca

SEQ ID NO: 635010 - RNA, 20 nt, Homo sapiens
agcagacaggccccgugagg

SEQ ID NO: 635011 - RNA, 21 nt, Homo sapiens
agcagacucagcucugacauu

SEQ ID NO: 635012 - RNA, 14 nt, Homo sapiens
agcagagaacugcc

SEQ ID NO: 635013 - RNA, 15 nt, Homo sapiens
agcagagaacuggaa

SEQ ID NO: 635014 - RNA, 17 nt, Homo sapiens
agcagagauguacugca

SEQ ID NO: 635015 - RNA, 18 nt, Homo sapiens
agcagagauguacugcaa

SEQ ID NO: 635016 - RNA, 15 nt, Homo sapiens
aaaaagccaucugau

SEQ ID NO: 635017 - RNA, 13 nt, Homo sapiens
aaaaagcugcuuc

SEQ ID NO: 635018 - RNA, 16 nt, Homo sapiens
aaaaaggaugcacaga

SEQ ID NO: 635019 - RNA, 14 nt, Homo sapiens
aaaaaggccaaaga

SEQ ID NO: 635020 - RNA, 21 nt, Homo sapiens
aaaaagggauccguacauuca

SEQ ID NO: 635021 - RNA, 21 nt, Homo sapiens
aaaaagguuggagcagugcuu

SEQ ID NO: 635022 - RNA, 20 nt, Homo sapiens
aaaaagucaauucaguucua

SEQ ID NO: 635023 - RNA, 18 nt, Homo sapiens
aaaaagucuguauggcau

SEQ ID NO: 635024 - RNA, 22 nt, Homo sapiens
aaaaagugggcaaaggacauga

SEQ ID NO: 635025 - RNA, 16 nt, Homo sapiens
aaaaaguuucacaggu

SEQ ID NO: 635026 - RNA, 16 nt, Homo sapiens
aaaaauaaaacuucac

SEQ ID NO: 635027 - RNA, 14 nt, Homo sapiens
aaaaauaaaagauc

SEQ ID NO: 635028 - RNA, 21 nt, Homo sapiens
aaaaauaaacggaaguuacau

SEQ ID NO: 635029 - RNA, 20 nt, Homo sapiens
aaaaauaaaguaccacacau

SEQ ID NO: 635030 - RNA, 23 nt, Homo sapiens
aaaaauaaaguaccacacauauu

SEQ ID NO: 635031 - RNA, 20 nt, Homo sapiens
aaaaauaaauucaaauuauu

SEQ ID NO: 635032 - RNA, 14 nt, Homo sapiens
aaaaauaauugcca

SEQ ID NO: 635033 - RNA, 22 nt, Homo sapiens
aaaaauacaacagugcauuuac

SEQ ID NO: 635034 - RNA, 19 nt, Homo sapiens
aaaaauagacuuaaaucuc

SEQ ID NO: 635035 - RNA, 21 nt, Homo sapiens
aaaaauagccugccucuucuc

SEQ ID NO: 635036 - RNA, 20 nt, Homo sapiens
aaaaauagcuuucaaaagaa

SEQ ID NO: 635037 - RNA, 21 nt, Homo sapiens
aaaaauauguugaguguucau

SEQ ID NO: 635038 - RNA, 20 nt, Homo sapiens
aaaaauauuguuucugcauu

SEQ ID NO: 635039 - RNA, 20 nt, Homo sapiens
aaaaauauuuauucauuauu

SEQ ID NO: 635040 - RNA, 16 nt, Homo sapiens
aaaaauauuugcugag

SEQ ID NO: 635041 - RNA, 15 nt, Homo sapiens
aaaaaucaauaugca

SEQ ID NO: 635042 - RNA, 13 nt, Homo sapiens
aaaaaucacucac

SEQ ID NO: 635043 - RNA, 17 nt, Homo sapiens
aaaaaucauaguacucu

SEQ ID NO: 635044 - RNA, 15 nt, Homo sapiens
aaaaaucaugugaua

SEQ ID NO: 635045 - RNA, 13 nt, Homo sapiens
aaaaauccuugaa

SEQ ID NO: 635046 - RNA, 17 nt, Homo sapiens
aaaaaucuuuucauuaa

SEQ ID NO: 635047 - RNA, 15 nt, Homo sapiens
aaaaaugaaguuuau

SEQ ID NO: 635048 - RNA, 11 nt, Homo sapiens
aaaaaugauuu

SEQ ID NO: 635049 - RNA, 16 nt, Homo sapiens
aaaaaugcagggugau

SEQ ID NO: 635050 - RNA, 14 nt, Homo sapiens
aaaaaugcucaauc

SEQ ID NO: 635051 - RNA, 16 nt, Homo sapiens
aaaaaugcucaaucuc

SEQ ID NO: 635052 - RNA, 13 nt, Homo sapiens
aaaaaugcugaac

SEQ ID NO: 635053 - RNA, 21 nt, Homo sapiens
aaaaauggacaaaauccauga

SEQ ID NO: 635054 - RNA, 12 nt, Homo sapiens
aaaaaugguacu

SEQ ID NO: 635055 - RNA, 20 nt, Homo sapiens
aaaaaugguugauggaaaau

SEQ ID NO: 635056 - RNA, 21 nt, Homo sapiens
aaaaauguaucugugugugau

SEQ ID NO: 635057 - RNA, 15 nt, Homo sapiens
aaaaaugucaucuca

SEQ ID NO: 635058 - RNA, 15 nt, Homo sapiens
aaaaauguccagcca

SEQ ID NO: 635059 - RNA, 21 nt, Homo sapiens
aaaaauguguuccauugccau

SEQ ID NO: 635060 - RNA, 18 nt, Homo sapiens
aaaaauguucuuacacaa

SEQ ID NO: 635061 - RNA, 17 nt, Homo sapiens
aaaaauuaaaaccugau

SEQ ID NO: 635062 - RNA, 14 nt, Homo sapiens
aaaaauuagcugug

SEQ ID NO: 635063 - RNA, 23 nt, Homo sapiens
aaaaauuauuagaacauucacuu

SEQ ID NO: 635064 - RNA, 16 nt, Homo sapiens
aaaaauucccuaaaga

SEQ ID NO: 635065 - RNA, 16 nt, Homo sapiens
aaaaauugagacauuu

SEQ ID NO: 635066 - RNA, 19 nt, Homo sapiens
aaaaauuuugugacauucc

SEQ ID NO: 635067 - RNA, 14 nt, Homo sapiens
aaaacaaaaaaccc

SEQ ID NO: 635068 - RNA, 21 nt, Homo sapiens
aaaacaaagccaugccaauaa

SEQ ID NO: 635069 - RNA, 13 nt, Homo sapiens
aaaacaaauucau

SEQ ID NO: 635070 - RNA, 19 nt, Homo sapiens
aaaacaacuuggcauuucu

SEQ ID NO: 635071 - RNA, 19 nt, Homo sapiens
aaaacaagaaaccaagugg

SEQ ID NO: 635072 - RNA, 14 nt, Homo sapiens
aaaacaagccuuaa

SEQ ID NO: 635073 - RNA, 14 nt, Homo sapiens
aaaacaauacucaa

SEQ ID NO: 635074 - RNA, 15 nt, Homo sapiens
aaaacaauaucugca

SEQ ID NO: 635075 - RNA, 18 nt, Homo sapiens
aaaacacacguagacuga

SEQ ID NO: 635076 - RNA, 11 nt, Homo sapiens
aaaacacauau

SEQ ID NO: 635077 - RNA, 14 nt, Homo sapiens
aaaacaccaugaaa

SEQ ID NO: 635078 - RNA, 18 nt, Homo sapiens
aaaacacugcccucuugu

SEQ ID NO: 635079 - RNA, 14 nt, Homo sapiens
aaaacacugugcac

SEQ ID NO: 635080 - RNA, 12 nt, Homo sapiens
aaaacacugugg

SEQ ID NO: 635081 - RNA, 12 nt, Homo sapiens
aaaacagaauuu

SEQ ID NO: 635082 - RNA, 12 nt, Homo sapiens
aaaacaguauuc

SEQ ID NO: 635083 - RNA, 23 nt, Homo sapiens
aaaacaguuuugucagucuuucu

SEQ ID NO: 635084 - RNA, 23 nt, Homo sapiens
aaaacaugcugaaaacuacacaa

SEQ ID NO: 635085 - RNA, 11 nt, Homo sapiens
aaaacauguau

SEQ ID NO: 635086 - RNA, 12 nt, Homo sapiens
aaaacauguaug

SEQ ID NO: 635087 - RNA, 16 nt, Homo sapiens
aaaacauguaugugca

SEQ ID NO: 635088 - RNA, 18 nt, Homo sapiens
aaaacauuaagaaaauca

SEQ ID NO: 635089 - RNA, 11 nt, Homo sapiens
aaaacauucaa

SEQ ID NO: 635090 - RNA, 19 nt, Homo sapiens
aaaacauugauuauaagca

SEQ ID NO: 635091 - RNA, 15 nt, Homo sapiens
aaaaccaaacccaga

SEQ ID NO: 635092 - RNA, 24 nt, Homo sapiens
aaaaccaauguucucucuucucca

SEQ ID NO: 635093 - RNA, 20 nt, Homo sapiens
aaaaccccaucuuuacuaaa

SEQ ID NO: 635094 - RNA, 14 nt, Homo sapiens
aaaaccccucccac

SEQ ID NO: 635095 - RNA, 22 nt, Homo sapiens
aaaaccuacacacguaccuuca

SEQ ID NO: 635096 - RNA, 23 nt, Homo sapiens
aaaaccuacacacguaccuucau

SEQ ID NO: 635097 - RNA, 23 nt, Homo sapiens
aaaaccuacgcacauaccuucau

SEQ ID NO: 635098 - RNA, 12 nt, Homo sapiens
aaaaccucaaac

SEQ ID NO: 635099 - RNA, 15 nt, Homo sapiens
aaaaccucuaugcaa

SEQ ID NO: 635100 - RNA, 23 nt, Homo sapiens
aaaaccugaagaguucacuuuug

SEQ ID NO: 635101 - RNA, 13 nt, Homo sapiens
aaaaccuucccca

SEQ ID NO: 635102 - RNA, 15 nt, Homo sapiens
aaaaccuuuacaguu

SEQ ID NO: 635103 - RNA, 17 nt, Homo sapiens
aaaaccuuuacaguuag

SEQ ID NO: 635104 - RNA, 15 nt, Homo sapiens
aaaaccuuuuacugg

SEQ ID NO: 635105 - RNA, 18 nt, Homo sapiens
aaaacgguggaggccagg

SEQ ID NO: 635106 - RNA, 23 nt, Homo sapiens
aaaacguugaauugaugaugcag

SEQ ID NO: 635107 - RNA, 16 nt, Homo sapiens
aaaacuaaacuuucau

SEQ ID NO: 635108 - RNA, 15 nt, Homo sapiens
aaaacuaagcacaaa

SEQ ID NO: 635109 - RNA, 13 nt, Homo sapiens
aaaacuaauuucc

SEQ ID NO: 635110 - RNA, 20 nt, Homo sapiens
aaaacuaauuuccucugaca

SEQ ID NO: 635111 - RNA, 14 nt, Homo sapiens
aaaacuacaaauca

SEQ ID NO: 635112 - RNA, 17 nt, Homo sapiens
aacuaugcaucugagaa

SEQ ID NO: 635113 - RNA, 21 nt, Homo sapiens
aacuaugucgaugcacaguau

SEQ ID NO: 635114 - RNA, 22 nt, Homo sapiens
aacuaugugcuaucacauguga

SEQ ID NO: 635115 - RNA, 12 nt, Homo sapiens
aacuauguguuc

SEQ ID NO: 635116 - RNA, 18 nt, Homo sapiens
aacuauugagccuugcau

SEQ ID NO: 635117 - RNA, 20 nt, Homo sapiens
aacuauuggggugaggauaa

SEQ ID NO: 635118 - RNA, 19 nt, Homo sapiens
aacuauuuucaaagacuua

SEQ ID NO: 635119 - RNA, 20 nt, Homo sapiens
aacucaaaacacccaaaaau

SEQ ID NO: 635120 - RNA, 14 nt, Homo sapiens
aacucaaaugagcc

SEQ ID NO: 635121 - RNA, 13 nt, Homo sapiens
aacucaagacaau

SEQ ID NO: 635122 - RNA, 17 nt, Homo sapiens
aacucacacaaccauga

SEQ ID NO: 635123 - RNA, 20 nt, Homo sapiens
aacucaccagccccacugcc

SEQ ID NO: 635124 - RNA, 15 nt, Homo sapiens
aacucacucugggcu

SEQ ID NO: 635125 - RNA, 14 nt, Homo sapiens
aacucacugagggu

SEQ ID NO: 635126 - RNA, 15 nt, Homo sapiens
aacucacugcucaag

SEQ ID NO: 635127 - RNA, 19 nt, Homo sapiens
aacucagaaugcacuugau

SEQ ID NO: 635128 - RNA, 16 nt, Homo sapiens
aacucagacauuccaa

SEQ ID NO: 635129 - RNA, 18 nt, Homo sapiens
aacucaggaggcagaggu

SEQ ID NO: 635130 - RNA, 17 nt, Homo sapiens
aacucaguuucuaggca

SEQ ID NO: 635131 - RNA, 14 nt, Homo sapiens
aacucaucuguuau

SEQ ID NO: 635132 - RNA, 12 nt, Homo sapiens
aacucauuugau

SEQ ID NO: 635133 - RNA, 16 nt, Homo sapiens
aacuccacaugcuggu

SEQ ID NO: 635134 - RNA, 13 nt, Homo sapiens
aacuccaucucaa

SEQ ID NO: 635135 - RNA, 17 nt, Homo sapiens
aacuccaucucuacuga

SEQ ID NO: 635136 - RNA, 19 nt, Homo sapiens
aacuccaugcaaaccaugc

SEQ ID NO: 635137 - RNA, 19 nt, Homo sapiens
aacuccauucauaguggau

SEQ ID NO: 635138 - RNA, 22 nt, Homo sapiens
aacuccccucagggauacgaca

SEQ ID NO: 635139 - RNA, 18 nt, Homo sapiens
aacuccuacuaaaucccu

SEQ ID NO: 635140 - RNA, 19 nt, Homo sapiens
aacuccugaccucagguga

SEQ ID NO: 635141 - RNA, 13 nt, Homo sapiens
aacuccugagaaa

SEQ ID NO: 635142 - RNA, 22 nt, Homo sapiens
aacuccugauuuuguaguuaau

SEQ ID NO: 635143 - RNA, 14 nt, Homo sapiens
aacucgaugcacug

SEQ ID NO: 635144 - RNA, 13 nt, Homo sapiens
aacucggggacaa

SEQ ID NO: 635145 - RNA, 15 nt, Homo sapiens
aacucuagaagacca

SEQ ID NO: 635146 - RNA, 21 nt, Homo sapiens
aacucuccaauguucuauuaa

SEQ ID NO: 635147 - RNA, 21 nt, Homo sapiens
aacucuccaucuuauuuucau

SEQ ID NO: 635148 - RNA, 13 nt, Homo sapiens
aacucuccccagu

SEQ ID NO: 635149 - RNA, 19 nt, Homo sapiens
aacucuccuacacuuccau

SEQ ID NO: 635150 - RNA, 13 nt, Homo sapiens
aacucugagcagu

SEQ ID NO: 635151 - RNA, 15 nt, Homo sapiens
aacucugcacuacuc

SEQ ID NO: 635152 - RNA, 16 nt, Homo sapiens
aacucugcacuacucc

SEQ ID NO: 635153 - RNA, 17 nt, Homo sapiens
aacucugggucuuggcc

SEQ ID NO: 635154 - RNA, 15 nt, Homo sapiens
aacucugguuucuac

SEQ ID NO: 635155 - RNA, 20 nt, Homo sapiens
aacucuucagaacacacaga

SEQ ID NO: 635156 - RNA, 13 nt, Homo sapiens
aacucuucagugc

SEQ ID NO: 635157 - RNA, 15 nt, Homo sapiens
aacucuucaguuaau

SEQ ID NO: 635158 - RNA, 17 nt, Homo sapiens
aacucuucuuugcugca

SEQ ID NO: 635159 - RNA, 15 nt, Homo sapiens
aacucuugugaauua

SEQ ID NO: 635160 - RNA, 22 nt, Homo sapiens
aacucuuucauucuucucacau

SEQ ID NO: 635161 - RNA, 17 nt, Homo sapiens
aacucuuuuaagugccu

SEQ ID NO: 635162 - RNA, 16 nt, Homo sapiens
aacugaaaauggaccu

SEQ ID NO: 635163 - RNA, 21 nt, Homo sapiens
aacugaaacuuuucuaaagug

SEQ ID NO: 635164 - RNA, 13 nt, Homo sapiens
aacugaaauguua

SEQ ID NO: 635165 - RNA, 14 nt, Homo sapiens
aacugaacauccaa

SEQ ID NO: 635166 - RNA, 14 nt, Homo sapiens
aacugaagccacuu

SEQ ID NO: 635167 - RNA, 13 nt, Homo sapiens
aacugaaggcaua

SEQ ID NO: 635168 - RNA, 22 nt, Homo sapiens
aacugaaggcuaaaaagcaaca

SEQ ID NO: 635169 - RNA, 14 nt, Homo sapiens
aacugaaucaggaa

SEQ ID NO: 635170 - RNA, 15 nt, Homo sapiens
aacugacaagccauc

SEQ ID NO: 635171 - RNA, 13 nt, Homo sapiens
aacugacaaugaa

SEQ ID NO: 635172 - RNA, 22 nt, Homo sapiens
aacugacaggcagccuggacau

SEQ ID NO: 635173 - RNA, 20 nt, Homo sapiens
aacugaccagccuccaugcu

SEQ ID NO: 635174 - RNA, 19 nt, Homo sapiens
aacugacgcuggagaugca

SEQ ID NO: 635175 - RNA, 22 nt, Homo sapiens
aacugacugaaggaaaagcaag

SEQ ID NO: 635176 - RNA, 23 nt, Homo sapiens
aacugaggacuguuugcaauuga

SEQ ID NO: 635177 - RNA, 21 nt, Homo sapiens
aacugagguauggccaugccc

SEQ ID NO: 635178 - RNA, 22 nt, Homo sapiens
aacugauuauuacuucuguuuc

SEQ ID NO: 635179 - RNA, 18 nt, Homo sapiens
aacugauuuaugaucacu

SEQ ID NO: 635180 - RNA, 18 nt, Homo sapiens
aacugauuuuguauguaa

SEQ ID NO: 635181 - RNA, 15 nt, Homo sapiens
aacugcaacacugga

SEQ ID NO: 635182 - RNA, 17 nt, Homo sapiens
aacugcaacugaaugac

SEQ ID NO: 635183 - RNA, 17 nt, Homo sapiens
aacugcaccaacgagcu

SEQ ID NO: 635184 - RNA, 17 nt, Homo sapiens
aacugcaccugucauca

SEQ ID NO: 635185 - RNA, 22 nt, Homo sapiens
aacugcaggcccuggccucccc

SEQ ID NO: 635186 - RNA, 21 nt, Homo sapiens
aacugcauggaccuaacauuc

SEQ ID NO: 635187 - RNA, 22 nt, Homo sapiens
aacugcauucuucugagcacug

SEQ ID NO: 635188 - RNA, 13 nt, Homo sapiens
aacugcauuuccu

SEQ ID NO: 635189 - RNA, 11 nt, Homo sapiens
aacugccaaag

SEQ ID NO: 635190 - RNA, 19 nt, Homo sapiens
aacugccucgaaacacaga

SEQ ID NO: 635191 - RNA, 20 nt, Homo sapiens
aacugccuuauuaaagcaaa

SEQ ID NO: 635192 - RNA, 23 nt, Homo sapiens
aacugccuuauuaaagcaaaaau

SEQ ID NO: 635193 - RNA, 14 nt, Homo sapiens
aacugccuuugaua

SEQ ID NO: 635194 - RNA, 18 nt, Homo sapiens
aacugcgaggacaucaaa

SEQ ID NO: 635195 - RNA, 16 nt, Homo sapiens
aacugcguuaugaaga

SEQ ID NO: 635196 - RNA, 18 nt, Homo sapiens
aacugcucagagcuuuaa

SEQ ID NO: 635197 - RNA, 16 nt, Homo sapiens
aacugcucuacuuuga

SEQ ID NO: 635198 - RNA, 17 nt, Homo sapiens
aacugcugcugugcaca

SEQ ID NO: 635199 - RNA, 14 nt, Homo sapiens
aacugcugucaaua

SEQ ID NO: 635200 - RNA, 21 nt, Homo sapiens
aacugcuuuccauuccauaau

SEQ ID NO: 635201 - RNA, 14 nt, Homo sapiens
aacugcuuugugca

SEQ ID NO: 635202 - RNA, 15 nt, Homo sapiens
aacuggaagcacagc

SEQ ID NO: 635203 - RNA, 14 nt, Homo sapiens
aacuggcaguuuuc

SEQ ID NO: 635204 - RNA, 13 nt, Homo sapiens
aacuggccagcca

SEQ ID NO: 635205 - RNA, 19 nt, Homo sapiens
aacugguauauacauauau

SEQ ID NO: 635206 - RNA, 23 nt, Homo sapiens
aacuguacauacugcagugugaa

SEQ ID NO: 635207 - RNA, 14 nt, Homo sapiens
aacuguacauguga

SEQ ID NO: 635208 - RNA, 14 nt, Homo sapiens
aacuguagauggaa

SEQ ID NO: 635209 - RNA, 15 nt, Homo sapiens
aacuguagggccagg

SEQ ID NO: 635210 - RNA, 17 nt, Homo sapiens
aacuguauauauuccca

SEQ ID NO: 635211 - RNA, 14 nt, Homo sapiens
aacuguaugaaugu

SEQ ID NO: 635212 - RNA, 17 nt, Homo sapiens
aacugucaccagccgca

SEQ ID NO: 635213 - RNA, 14 nt, Homo sapiens
aacugucacucauu

SEQ ID NO: 635214 - RNA, 13 nt, Homo sapiens
aacugucucagaa

SEQ ID NO: 635215 - RNA, 14 nt, Homo sapiens
aacugucucucuuc

SEQ ID NO: 635216 - RNA, 17 nt, Homo sapiens
aacugugaagcauuuac

SEQ ID NO: 635217 - RNA, 15 nt, Homo sapiens
aacugugcaaggccu

SEQ ID NO: 635218 - RNA, 12 nt, Homo sapiens
aacugugcucuu

SEQ ID NO: 635219 - RNA, 16 nt, Homo sapiens
aacuguggugccacau

SEQ ID NO: 635220 - RNA, 12 nt, Homo sapiens
aacuguguaaaa

SEQ ID NO: 635221 - RNA, 18 nt, Homo sapiens
aacuguguauguacauau

SEQ ID NO: 635222 - RNA, 17 nt, Homo sapiens
aacuguguggacuguga

SEQ ID NO: 635223 - RNA, 18 nt, Homo sapiens
aacuguguuguauuaaca

SEQ ID NO: 635224 - RNA, 15 nt, Homo sapiens
aacuguuaccaguug

SEQ ID NO: 635225 - RNA, 15 nt, Homo sapiens
aacuguucaaacuca

SEQ ID NO: 635226 - RNA, 18 nt, Homo sapiens
aacuguucccaccugcug

SEQ ID NO: 635227 - RNA, 11 nt, Homo sapiens
aacuguugcuc

SEQ ID NO: 635228 - RNA, 23 nt, Homo sapiens
aacuguuucccuuugauucucca

SEQ ID NO: 635229 - RNA, 20 nt, Homo sapiens
aacuguuuucucaugaugcc

SEQ ID NO: 635230 - RNA, 18 nt, Homo sapiens
aacuuaaaaaaagcacau

SEQ ID NO: 635231 - RNA, 22 nt, Homo sapiens
aacuuaagggaaaaguucuccu

SEQ ID NO: 635232 - RNA, 15 nt, Homo sapiens
aacuuacacugauca

SEQ ID NO: 635233 - RNA, 17 nt, Homo sapiens
aacuuaccuacugggga

SEQ ID NO: 635234 - RNA, 20 nt, Homo sapiens
aacuuacuguccaccaguuu

SEQ ID NO: 635235 - RNA, 23 nt, Homo sapiens
aagaagggauaauagacacauca

SEQ ID NO: 635236 - RNA, 21 nt, Homo sapiens
aagaagggauaucuacugugg

SEQ ID NO: 635237 - RNA, 11 nt, Homo sapiens
aagaaggguua

SEQ ID NO: 635238 - RNA, 17 nt, Homo sapiens
aagaaggugucuccuag

SEQ ID NO: 635239 - RNA, 22 nt, Homo sapiens
aagaagguuggugaauuucaca

SEQ ID NO: 635240 - RNA, 17 nt, Homo sapiens
aagaaguaaaacuauuu

SEQ ID NO: 635241 - RNA, 14 nt, Homo sapiens
aagaagucuucucu

SEQ ID NO: 635242 - RNA, 17 nt, Homo sapiens
aagaagugggacuuccc

SEQ ID NO: 635243 - RNA, 19 nt, Homo sapiens
aagaaguguccgagaacua

SEQ ID NO: 635244 - RNA, 23 nt, Homo sapiens
aagaaguuguuugaggcaaauua

SEQ ID NO: 635245 - RNA, 17 nt, Homo sapiens
aagaauaaaauugcacu

SEQ ID NO: 635246 - RNA, 14 nt, Homo sapiens
aagaauaagugucu

SEQ ID NO: 635247 - RNA, 15 nt, Homo sapiens
aagaauacacaggau

SEQ ID NO: 635248 - RNA, 13 nt, Homo sapiens
aagaauacagaaa

SEQ ID NO: 635249 - RNA, 15 nt, Homo sapiens
aagaauacuucucau

SEQ ID NO: 635250 - RNA, 14 nt, Homo sapiens
aagaauagcuuuaa

SEQ ID NO: 635251 - RNA, 15 nt, Homo sapiens
aagaaucaagcuaga

SEQ ID NO: 635252 - RNA, 13 nt, Homo sapiens
aagaaucagucuu

SEQ ID NO: 635253 - RNA, 16 nt, Homo sapiens
aagaaucagucuugca

SEQ ID NO: 635254 - RNA, 16 nt, Homo sapiens
aagaaucuacuggaau

SEQ ID NO: 635255 - RNA, 20 nt, Homo sapiens
aagaaucuauaguucacuga

SEQ ID NO: 635256 - RNA, 22 nt, Homo sapiens
aagaaucuauaguucacugaca

SEQ ID NO: 635257 - RNA, 16 nt, Homo sapiens
aagaaugaacacuccc

SEQ ID NO: 635258 - RNA, 16 nt, Homo sapiens
aagaaugacuaugcaa

SEQ ID NO: 635259 - RNA, 17 nt, Homo sapiens
aagaaugagacugaacu

SEQ ID NO: 635260 - RNA, 17 nt, Homo sapiens
aagaaugaugcuaugaa

SEQ ID NO: 635261 - RNA, 13 nt, Homo sapiens
aagaauggcuuuc

SEQ ID NO: 635262 - RNA, 23 nt, Homo sapiens
aagaaugucucggucacaucagg

SEQ ID NO: 635263 - RNA, 22 nt, Homo sapiens
aagaauguuuggcacucucuaa

SEQ ID NO: 635264 - RNA, 13 nt, Homo sapiens
aagaauuaacaga

SEQ ID NO: 635265 - RNA, 19 nt, Homo sapiens
aagaauuaagaggaugcug

SEQ ID NO: 635266 - RNA, 17 nt, Homo sapiens
aagaauuauuuuauaca

SEQ ID NO: 635267 - RNA, 18 nt, Homo sapiens
aagaauucaaaccugacc

SEQ ID NO: 635268 - RNA, 23 nt, Homo sapiens
aagaauucaaacuggggccucca

SEQ ID NO: 635269 - RNA, 13 nt, Homo sapiens
aagaauuccacca

SEQ ID NO: 635270 - RNA, 14 nt, Homo sapiens
aagaauugaggaau

SEQ ID NO: 635271 - RNA, 23 nt, Homo sapiens
aagaauuggucuuaauguugaau

SEQ ID NO: 635272 - RNA, 17 nt, Homo sapiens
aagaauuuaaaacgcau

SEQ ID NO: 635273 - RNA, 13 nt, Homo sapiens
aagaauuucuuca

SEQ ID NO: 635274 - RNA, 12 nt, Homo sapiens
aagaauuugcau

SEQ ID NO: 635275 - RNA, 17 nt, Homo sapiens
aagaauuuugagugaau

SEQ ID NO: 635276 - RNA, 21 nt, Homo sapiens
aagaauuuuguuuuacuuuuu

SEQ ID NO: 635277 - RNA, 12 nt, Homo sapiens
aagacaaaaaug

SEQ ID NO: 635278 - RNA, 15 nt, Homo sapiens
aagacaaacuuugca

SEQ ID NO: 635279 - RNA, 23 nt, Homo sapiens
aagacaaauuagccauuucacuc

SEQ ID NO: 635280 - RNA, 22 nt, Homo sapiens
aagacaaggcuggcaaacccuc

SEQ ID NO: 635281 - RNA, 20 nt, Homo sapiens
aagacaauaaaacacuuuug

SEQ ID NO: 635282 - RNA, 16 nt, Homo sapiens
aagacaauaguauuac

SEQ ID NO: 635283 - RNA, 16 nt, Homo sapiens
aagacaauuugauaca

SEQ ID NO: 635284 - RNA, 14 nt, Homo sapiens
aagacacagacugc

SEQ ID NO: 635285 - RNA, 14 nt, Homo sapiens
aagacagaauguca

SEQ ID NO: 635286 - RNA, 16 nt, Homo sapiens
aagacagaugccccag

SEQ ID NO: 635287 - RNA, 15 nt, Homo sapiens
aagacagcagacaaa

SEQ ID NO: 635288 - RNA, 23 nt, Homo sapiens
aagacaggacccugggaccacag

SEQ ID NO: 635289 - RNA, 21 nt, Homo sapiens
aagacaggucuagacuuucuc

SEQ ID NO: 635290 - RNA, 21 nt, Homo sapiens
aagacagucuucuaauuccuc

SEQ ID NO: 635291 - RNA, 21 nt, Homo sapiens
aagacauccugagcagugcca

SEQ ID NO: 635292 - RNA, 17 nt, Homo sapiens
aagacaugcuuacuuuu

SEQ ID NO: 635293 - RNA, 18 nt, Homo sapiens
aagacaugcuuacuuuuu

SEQ ID NO: 635294 - RNA, 15 nt, Homo sapiens
aagacauuuccuacc

SEQ ID NO: 635295 - RNA, 23 nt, Homo sapiens
aagacauuuuuugcuauaaucau

SEQ ID NO: 635296 - RNA, 11 nt, Homo sapiens
aagaccaaaaa

SEQ ID NO: 635297 - RNA, 16 nt, Homo sapiens
aagaccaaaauuacua

SEQ ID NO: 635298 - RNA, 21 nt, Homo sapiens
aagaccacacuugguguuacc

SEQ ID NO: 635299 - RNA, 24 nt, Homo sapiens
aagaccagucacucccucugccuu

SEQ ID NO: 635300 - RNA, 20 nt, Homo sapiens
aagaccaguccuguuugcag

SEQ ID NO: 635301 - RNA, 19 nt, Homo sapiens
aagaccaguuuccauuuau

SEQ ID NO: 635302 - RNA, 15 nt, Homo sapiens
aagaccaucccugaa

SEQ ID NO: 635303 - RNA, 17 nt, Homo sapiens
aagaccgccccagggcu

SEQ ID NO: 635304 - RNA, 13 nt, Homo sapiens
aagaccuggaccg

SEQ ID NO: 635305 - RNA, 22 nt, Homo sapiens
aagaccuucguauccccucuca

SEQ ID NO: 635306 - RNA, 21 nt, Homo sapiens
aagacgauuugucaguuauuu

SEQ ID NO: 635307 - RNA, 16 nt, Homo sapiens
aagacgccuucaucug

SEQ ID NO: 635308 - RNA, 17 nt, Homo sapiens
aagacguggacuccucu

SEQ ID NO: 635309 - RNA, 15 nt, Homo sapiens
aagacuaacuugaaa

SEQ ID NO: 635310 - RNA, 21 nt, Homo sapiens
aagacuaaucgaaugaacaaa

SEQ ID NO: 635311 - RNA, 13 nt, Homo sapiens
aagacuacuauac

SEQ ID NO: 635312 - RNA, 13 nt, Homo sapiens
aagacuagccugg

SEQ ID NO: 635313 - RNA, 14 nt, Homo sapiens
aagacuccgucuca

SEQ ID NO: 635314 - RNA, 11 nt, Homo sapiens
aagacucugac

SEQ ID NO: 635315 - RNA, 21 nt, Homo sapiens
aagacucuuuggguccauuca

SEQ ID NO: 635316 - RNA, 23 nt, Homo sapiens
aagacugaaucuaccugcccuaa

SEQ ID NO: 635317 - RNA, 22 nt, Homo sapiens
aagacugaguacguugugcauu

SEQ ID NO: 635318 - RNA, 23 nt, Homo sapiens
aagacugauuuuaauagggaaua

SEQ ID NO: 635319 - RNA, 18 nt, Homo sapiens
aagacugcagcugcugaa

SEQ ID NO: 635320 - RNA, 21 nt, Homo sapiens
aagacuggaagcuaauuugca

SEQ ID NO: 635321 - RNA, 20 nt, Homo sapiens
aagacuggaauauaauuuca

SEQ ID NO: 635322 - RNA, 18 nt, Homo sapiens
aagacugggugaggauaa

SEQ ID NO: 635323 - RNA, 18 nt, Homo sapiens
aagacugguuuucugcca

SEQ ID NO: 635324 - RNA, 19 nt, Homo sapiens
aagacugguuuucugccaa

SEQ ID NO: 635325 - RNA, 19 nt, Homo sapiens
aagacuguugccacuuaac

SEQ ID NO: 635326 - RNA, 15 nt, Homo sapiens
aagacuguugcucaa

SEQ ID NO: 635327 - RNA, 18 nt, Homo sapiens
aagacuucucuacccauc

SEQ ID NO: 635328 - RNA, 13 nt, Homo sapiens
aagacuugugcau

SEQ ID NO: 635329 - RNA, 18 nt, Homo sapiens
aagacuuuaaaccaccua

SEQ ID NO: 635330 - RNA, 19 nt, Homo sapiens
aagacuuuugucugaucaa

SEQ ID NO: 635331 - RNA, 14 nt, Homo sapiens
aagagaacucaccu

SEQ ID NO: 635332 - RNA, 15 nt, Homo sapiens
aagagaagaaauagc

SEQ ID NO: 635333 - RNA, 16 nt, Homo sapiens
aagagaagagggccca

SEQ ID NO: 635334 - RNA, 14 nt, Homo sapiens
aagagacacuccaa

SEQ ID NO: 635335 - RNA, 18 nt, Homo sapiens
aagagacagaacugucca

SEQ ID NO: 635336 - RNA, 20 nt, Homo sapiens
aagagacaggagacaugagu

SEQ ID NO: 635337 - RNA, 13 nt, Homo sapiens
aagagacugaguc

SEQ ID NO: 635338 - RNA, 20 nt, Homo sapiens
aagagacuggagcaucugac

SEQ ID NO: 635339 - RNA, 14 nt, Homo sapiens
aagagagccaguaa

SEQ ID NO: 635340 - RNA, 20 nt, Homo sapiens
aagagaucacaauacucaaa

SEQ ID NO: 635341 - RNA, 22 nt, Homo sapiens
aagagauccuucuguaaagguu

SEQ ID NO: 635342 - RNA, 16 nt, Homo sapiens
aagagaucuuucuuuc

SEQ ID NO: 635343 - RNA, 17 nt, Homo sapiens
aagagaucuuucuuucc

SEQ ID NO: 635344 - RNA, 17 nt, Homo sapiens
aagagaugcacuauaug

SEQ ID NO: 635345 - RNA, 17 nt, Homo sapiens
aagagauugcacaguca

SEQ ID NO: 635346 - RNA, 20 nt, Homo sapiens
aagagauuuaucuuuauaca

SEQ ID NO: 635347 - RNA, 17 nt, Homo sapiens
aagagcaaccaguauca

SEQ ID NO: 635348 - RNA, 20 nt, Homo sapiens
aagagcagcuucggugugca

SEQ ID NO: 635349 - RNA, 23 nt, Homo sapiens
aagagcagucacaacagagugaa

SEQ ID NO: 635350 - RNA, 22 nt, Homo sapiens
aagagcagugguaagaauagua

SEQ ID NO: 635351 - RNA, 14 nt, Homo sapiens
aagagcgaguacag

SEQ ID NO: 635352 - RNA, 22 nt, Homo sapiens
aagagcucccgaggaagcacag

SEQ ID NO: 635353 - RNA, 12 nt, Homo sapiens
aagagcuguuau

SEQ ID NO: 635354 - RNA, 15 nt, Homo sapiens
aagagcuugcuccag

SEQ ID NO: 635355 - RNA, 22 nt, Homo sapiens
aggcauguggccuuuaucucaa

SEQ ID NO: 635356 - RNA, 14 nt, Homo sapiens
aggcauuuccagac

SEQ ID NO: 635357 - RNA, 21 nt, Homo sapiens
aggccaaacuggcaaacuuca

SEQ ID NO: 635358 - RNA, 15 nt, Homo sapiens
aggccaagaauauug

SEQ ID NO: 635359 - RNA, 19 nt, Homo sapiens
aggccaagggccaagagaa

SEQ ID NO: 635360 - RNA, 21 nt, Homo sapiens
aggccaauaaaaaguucagag

SEQ ID NO: 635361 - RNA, 18 nt, Homo sapiens
aggccacaggagacauua

SEQ ID NO: 635362 - RNA, 12 nt, Homo sapiens
aggccacagugg

SEQ ID NO: 635363 - RNA, 21 nt, Homo sapiens
aggccacauugacaguggugg

SEQ ID NO: 635364 - RNA, 17 nt, Homo sapiens
aggccagagccaugcca

SEQ ID NO: 635365 - RNA, 19 nt, Homo sapiens
aggccagagggcaguggcc

SEQ ID NO: 635366 - RNA, 18 nt, Homo sapiens
aggccaggccagcugccu

SEQ ID NO: 635367 - RNA, 20 nt, Homo sapiens
aggccaggugcaguggcuca

SEQ ID NO: 635368 - RNA, 12 nt, Homo sapiens
aggccagugcua

SEQ ID NO: 635369 - RNA, 22 nt, Homo sapiens
aggccagugugccgaccucucu

SEQ ID NO: 635370 - RNA, 19 nt, Homo sapiens
aggccaguguggugucuug

SEQ ID NO: 635371 - RNA, 21 nt, Homo sapiens
aggccauggcagaauaaucuu

SEQ ID NO: 635372 - RNA, 17 nt, Homo sapiens
aggccauggugcacaaa

SEQ ID NO: 635373 - RNA, 14 nt, Homo sapiens
aggcccaacauuaa

SEQ ID NO: 635374 - RNA, 21 nt, Homo sapiens
aggcccaacugugagcaagga

SEQ ID NO: 635375 - RNA, 16 nt, Homo sapiens
aggcccagcaugcagg

SEQ ID NO: 635376 - RNA, 14 nt, Homo sapiens
aggcccauucuuca

SEQ ID NO: 635377 - RNA, 16 nt, Homo sapiens
aggccccaaucuugcc

SEQ ID NO: 635378 - RNA, 22 nt, Homo sapiens
aggccccaaucuugcccacugg

SEQ ID NO: 635379 - RNA, 15 nt, Homo sapiens
aggcccccacuucuc

SEQ ID NO: 635380 - RNA, 15 nt, Homo sapiens
aggcccccagugggg

SEQ ID NO: 635381 - RNA, 14 nt, Homo sapiens
aggcccgcaccgcu

SEQ ID NO: 635382 - RNA, 16 nt, Homo sapiens
aggcccgcaccgcugg

SEQ ID NO: 635383 - RNA, 15 nt, Homo sapiens
aggcccgcucuacau

SEQ ID NO: 635384 - RNA, 21 nt, Homo sapiens
aggcccgcuugcuggguaccu

SEQ ID NO: 635385 - RNA, 15 nt, Homo sapiens
aggcccuacuaccca

SEQ ID NO: 635386 - RNA, 20 nt, Homo sapiens
aggcccuagcggcagaaagg

SEQ ID NO: 635387 - RNA, 16 nt, Homo sapiens
aggcccugcugaguca

SEQ ID NO: 635388 - RNA, 21 nt, Homo sapiens
aggcccuguccuaagcacuuu

SEQ ID NO: 635389 - RNA, 13 nt, Homo sapiens
aggcccuuaggga

SEQ ID NO: 635390 - RNA, 22 nt, Homo sapiens
aggcccuuccucuccacugccu

SEQ ID NO: 635391 - RNA, 16 nt, Homo sapiens
aggcccuuuucagggc

SEQ ID NO: 635392 - RNA, 16 nt, Homo sapiens
aggccgaggugggcag

SEQ ID NO: 635393 - RNA, 20 nt, Homo sapiens
aggccggaugcgguggcuca

SEQ ID NO: 635394 - RNA, 23 nt, Homo sapiens
aggccgugcaguggcugugccac

SEQ ID NO: 635395 - RNA, 20 nt, Homo sapiens
aggccuacaugcuuugugaa

SEQ ID NO: 635396 - RNA, 12 nt, Homo sapiens
aggccucaagaa

SEQ ID NO: 635397 - RNA, 15 nt, Homo sapiens
aggccucaagaacaa

SEQ ID NO: 635398 - RNA, 20 nt, Homo sapiens
aggccucacuggcucaugcc

SEQ ID NO: 635399 - RNA, 14 nt, Homo sapiens
aggccucagccuca

SEQ ID NO: 635400 - RNA, 14 nt, Homo sapiens
aggccucaguggac

SEQ ID NO: 635401 - RNA, 16 nt, Homo sapiens
aggccuccgucuuccc

SEQ ID NO: 635402 - RNA, 23 nt, Homo sapiens
aggccucgaaaaccaucacauga

SEQ ID NO: 635403 - RNA, 17 nt, Homo sapiens
aggccucucucugcucc

SEQ ID NO: 635404 - RNA, 13 nt, Homo sapiens
aggccucugagaa

SEQ ID NO: 635405 - RNA, 18 nt, Homo sapiens
aggccugaacccguccau

SEQ ID NO: 635406 - RNA, 18 nt, Homo sapiens
aggccugaggagcagugu

SEQ ID NO: 635407 - RNA, 15 nt, Homo sapiens
aggccugaggaugag

SEQ ID NO: 635408 - RNA, 12 nt, Homo sapiens
aggccugccugu

SEQ ID NO: 635409 - RNA, 15 nt, Homo sapiens
aggccugcuggcauc

SEQ ID NO: 635410 - RNA, 15 nt, Homo sapiens
aggccuggagggcac

SEQ ID NO: 635411 - RNA, 17 nt, Homo sapiens
aggccuggagggcacuu

SEQ ID NO: 635412 - RNA, 18 nt, Homo sapiens
aggccugggccgcugcca

SEQ ID NO: 635413 - RNA, 16 nt, Homo sapiens
aggccuuacaucuggc

SEQ ID NO: 635414 - RNA, 18 nt, Homo sapiens
aggcgauggggcaagaca

SEQ ID NO: 635415 - RNA, 16 nt, Homo sapiens
aggcgccugccaucau

SEQ ID NO: 635416 - RNA, 18 nt, Homo sapiens
aggcgcugagacugugcu

SEQ ID NO: 635417 - RNA, 18 nt, Homo sapiens
aggcgcuuggcaucacac

SEQ ID NO: 635418 - RNA, 23 nt, Homo sapiens
aggcggccucgugccaugaucug

SEQ ID NO: 635419 - RNA, 17 nt, Homo sapiens
aggcggcuacaugccuc

SEQ ID NO: 635420 - RNA, 17 nt, Homo sapiens
aggcgggagcaucucuu

SEQ ID NO: 635421 - RNA, 20 nt, Homo sapiens
aggcgggaggauugcuugag

SEQ ID NO: 635422 - RNA, 22 nt, Homo sapiens
aggcggucaugugugcauguga

SEQ ID NO: 635423 - RNA, 22 nt, Homo sapiens
aggcgucagucaaaggcauuuu

SEQ ID NO: 635424 - RNA, 16 nt, Homo sapiens
aggcgucuucaucucc

SEQ ID NO: 635425 - RNA, 19 nt, Homo sapiens
aggcguguggcagccacac

SEQ ID NO: 635426 - RNA, 14 nt, Homo sapiens
aggcguucuccugc

SEQ ID NO: 635427 - RNA, 23 nt, Homo sapiens
aggcguuuguuauauaaaaauac

SEQ ID NO: 635428 - RNA, 15 nt, Homo sapiens
aggcuaaaaagcaac

SEQ ID NO: 635429 - RNA, 15 nt, Homo sapiens
aggcuaaacucaaga

SEQ ID NO: 635430 - RNA, 14 nt, Homo sapiens
aggcuaaaugagau

SEQ ID NO: 635431 - RNA, 13 nt, Homo sapiens
aggcuaaaugcac

SEQ ID NO: 635432 - RNA, 12 nt, Homo sapiens
aggcuacuugag

SEQ ID NO: 635433 - RNA, 16 nt, Homo sapiens
aggcuaucaacaaaga

SEQ ID NO: 635434 - RNA, 15 nt, Homo sapiens
aggcucagauuguaa

SEQ ID NO: 635435 - RNA, 14 nt, Homo sapiens
aggcucagcacuuu

SEQ ID NO: 635436 - RNA, 14 nt, Homo sapiens
aggcuccaguugaa

SEQ ID NO: 635437 - RNA, 21 nt, Homo sapiens
aggcucggaggacccuggaaa

SEQ ID NO: 635438 - RNA, 17 nt, Homo sapiens
aggcucguugacuggcu

SEQ ID NO: 635439 - RNA, 16 nt, Homo sapiens
aggcucuaauguacaa

SEQ ID NO: 635440 - RNA, 16 nt, Homo sapiens
aggcucugcuucucca

SEQ ID NO: 635441 - RNA, 17 nt, Homo sapiens
aggcucugcuucuccaa

SEQ ID NO: 635442 - RNA, 22 nt, Homo sapiens
aggcucugggcacagugcugcc

SEQ ID NO: 635443 - RNA, 20 nt, Homo sapiens
aggcucuuagcagcuuccag

SEQ ID NO: 635444 - RNA, 18 nt, Homo sapiens
aggcugaauuacagugaa

SEQ ID NO: 635445 - RNA, 14 nt, Homo sapiens
aggcugaggacuua

SEQ ID NO: 635446 - RNA, 22 nt, Homo sapiens
aggcugaggccuggacuuuccu

SEQ ID NO: 635447 - RNA, 23 nt, Homo sapiens
aggcugaggcuggcacaggacau

SEQ ID NO: 635448 - RNA, 13 nt, Homo sapiens
aggcugagugcau

SEQ ID NO: 635449 - RNA, 15 nt, Homo sapiens
aggcugauuacugaa

SEQ ID NO: 635450 - RNA, 15 nt, Homo sapiens
aggcugcacugcagu

SEQ ID NO: 635451 - RNA, 22 nt, Homo sapiens
aggcugcagaugaucagggauc

SEQ ID NO: 635452 - RNA, 18 nt, Homo sapiens
aggcugcagucccuggaa

SEQ ID NO: 635453 - RNA, 16 nt, Homo sapiens
aggcugcccccaucca

SEQ ID NO: 635454 - RNA, 19 nt, Homo sapiens
aggcugccccucucaccaa

SEQ ID NO: 635455 - RNA, 20 nt, Homo sapiens
aggcugcgacugaugaaggc

SEQ ID NO: 635456 - RNA, 21 nt, Homo sapiens
aggcugcuggaaacacaguca

SEQ ID NO: 635457 - RNA, 17 nt, Homo sapiens
aggcugcuggagugcag

SEQ ID NO: 635458 - RNA, 23 nt, Homo sapiens
aggcugcuggagugcaguggcac

SEQ ID NO: 635459 - RNA, 14 nt, Homo sapiens
aggcugcugugaac

SEQ ID NO: 635460 - RNA, 20 nt, Homo sapiens
aggcuggaaugcaguggugu

SEQ ID NO: 635461 - RNA, 20 nt, Homo sapiens
aggcuggaguacaauggcgu

SEQ ID NO: 635462 - RNA, 20 nt, Homo sapiens
aggcuggaguacaguggcac

SEQ ID NO: 635463 - RNA, 20 nt, Homo sapiens
aggcuggagugcaguggcgu

SEQ ID NO: 635464 - RNA, 20 nt, Homo sapiens
aggcuggagugcaguggugu

SEQ ID NO: 635465 - RNA, 17 nt, Homo sapiens
aggcuggcacaggacau

SEQ ID NO: 635466 - RNA, 20 nt, Homo sapiens
aggcuggcuccagaugcagg

SEQ ID NO: 635467 - RNA, 12 nt, Homo sapiens
aggcugggagac

SEQ ID NO: 635468 - RNA, 17 nt, Homo sapiens
aggcugggccaugucca

SEQ ID NO: 635469 - RNA, 21 nt, Homo sapiens
aggcugggccauguccaaaga

SEQ ID NO: 635470 - RNA, 19 nt, Homo sapiens
aggcugguauuuuugucug

SEQ ID NO: 635471 - RNA, 14 nt, Homo sapiens
aggcugguggcaag

SEQ ID NO: 635472 - RNA, 15 nt, Homo sapiens
aggcugucacagucc

SEQ ID NO: 635473 - RNA, 23 nt, Homo sapiens
aggcugucacccuccaccgagcc

SEQ ID NO: 635474 - RNA, 13 nt, Homo sapiens
aggcugugcugcc

SEQ ID NO: 635475 - RNA, 14 nt, Homo sapiens
aggcuguggcauca

SEQ ID NO: 635476 - RNA, 13 nt, Homo sapiens
aggcuguugaauc

SEQ ID NO: 635477 - RNA, 17 nt, Homo sapiens
aggcuuaacacaguggg

SEQ ID NO: 635478 - RNA, 20 nt, Homo sapiens
aaucuuccaucugcaucuua

SEQ ID NO: 635479 - RNA, 12 nt, Homo sapiens
aaucuucuacuu

SEQ ID NO: 635480 - RNA, 15 nt, Homo sapiens
aaucuucuacuuuaa

SEQ ID NO: 635481 - RNA, 23 nt, Homo sapiens
aaucuucucuuugacaauuccua

SEQ ID NO: 635482 - RNA, 16 nt, Homo sapiens
aaucuucuuaugcaau

SEQ ID NO: 635483 - RNA, 18 nt, Homo sapiens
aaucuucuugauccacuu

SEQ ID NO: 635484 - RNA, 22 nt, Homo sapiens
aaucuucuugauccacuucucu

SEQ ID NO: 635485 - RNA, 21 nt, Homo sapiens
aaucuugcugcaggcccuccc

SEQ ID NO: 635486 - RNA, 16 nt, Homo sapiens
aaucuuucacuugaaa

SEQ ID NO: 635487 - RNA, 19 nt, Homo sapiens
aaucuuugccuuuaucucu

SEQ ID NO: 635488 - RNA, 17 nt, Homo sapiens
aaucuuuuaaaucuuug

SEQ ID NO: 635489 - RNA, 20 nt, Homo sapiens
aaucuuuuugauaagcacau

SEQ ID NO: 635490 - RNA, 22 nt, Homo sapiens
aaugaaacaagucuagucuucu

SEQ ID NO: 635491 - RNA, 17 nt, Homo sapiens
aaugaaacugcugugaa

SEQ ID NO: 635492 - RNA, 16 nt, Homo sapiens
aaugaaauccagugag

SEQ ID NO: 635493 - RNA, 17 nt, Homo sapiens
aaugaaauguaugugcu

SEQ ID NO: 635494 - RNA, 18 nt, Homo sapiens
aaugaacacaucuugagu

SEQ ID NO: 635495 - RNA, 13 nt, Homo sapiens
aaugaacacuccc

SEQ ID NO: 635496 - RNA, 16 nt, Homo sapiens
aaugaaccccacuggg

SEQ ID NO: 635497 - RNA, 18 nt, Homo sapiens
aaugaaccccacugggug

SEQ ID NO: 635498 - RNA, 16 nt, Homo sapiens
aaugaaccuucugcaa

SEQ ID NO: 635499 - RNA, 22 nt, Homo sapiens
aaugaaccuucugcaacaucuu

SEQ ID NO: 635500 - RNA, 11 nt, Homo sapiens
aaugaacuaau

SEQ ID NO: 635501 - RNA, 13 nt, Homo sapiens
aaugaacuaguuu

SEQ ID NO: 635502 - RNA, 15 nt, Homo sapiens
aaugaacuaguuuaa

SEQ ID NO: 635503 - RNA, 13 nt, Homo sapiens
aaugaacuuugaa

SEQ ID NO: 635504 - RNA, 22 nt, Homo sapiens
aaugaagaacugcauguggcuu

SEQ ID NO: 635505 - RNA, 15 nt, Homo sapiens
aaugaagaugucuaa

SEQ ID NO: 635506 - RNA, 16 nt, Homo sapiens
aaugaagcagcuuuaa

SEQ ID NO: 635507 - RNA, 22 nt, Homo sapiens
aaugaagcuaauaauucuucac

SEQ ID NO: 635508 - RNA, 13 nt, Homo sapiens
aaugaagcugcca

SEQ ID NO: 635509 - RNA, 22 nt, Homo sapiens
aaugaaguagaaguuacuuaau

SEQ ID NO: 635510 - RNA, 13 nt, Homo sapiens
aaugaaguuauuu

SEQ ID NO: 635511 - RNA, 21 nt, Homo sapiens
aaugaauagaggggcauucac

SEQ ID NO: 635512 - RNA, 12 nt, Homo sapiens
aaugaaucuuca

SEQ ID NO: 635513 - RNA, 14 nt, Homo sapiens
aaugaaucuucaca

SEQ ID NO: 635514 - RNA, 18 nt, Homo sapiens
aaugaaucuucacaaaac

SEQ ID NO: 635515 - RNA, 14 nt, Homo sapiens
aaugaaugcccaaa

SEQ ID NO: 635516 - RNA, 15 nt, Homo sapiens
aaugaauucaguuuc

SEQ ID NO: 635517 - RNA, 22 nt, Homo sapiens
aaugaauugugccuaguggaga

SEQ ID NO: 635518 - RNA, 20 nt, Homo sapiens
aaugaauuuuauaaucugca

SEQ ID NO: 635519 - RNA, 21 nt, Homo sapiens
aaugacaaaaaguguccauaa

SEQ ID NO: 635520 - RNA, 14 nt, Homo sapiens
aaugacaaagccau

SEQ ID NO: 635521 - RNA, 17 nt, Homo sapiens
aaugacaacagaaaaac

SEQ ID NO: 635522 - RNA, 12 nt, Homo sapiens
aaugacaaugau

SEQ ID NO: 635523 - RNA, 20 nt, Homo sapiens
aaugacacccugaucuucac

SEQ ID NO: 635524 - RNA, 22 nt, Homo sapiens
aaugacacuagcuaauaucaau

SEQ ID NO: 635525 - RNA, 12 nt, Homo sapiens
aaugacagaucc

SEQ ID NO: 635526 - RNA, 13 nt, Homo sapiens
aaugacaguaguc

SEQ ID NO: 635527 - RNA, 20 nt, Homo sapiens
aaugacaucucaggggccag

SEQ ID NO: 635528 - RNA, 14 nt, Homo sapiens
aaugacaucuucaa

SEQ ID NO: 635529 - RNA, 10 nt, Homo sapiens
aaugacauuc

SEQ ID NO: 635530 - RNA, 12 nt, Homo sapiens
aaugaccaagac

SEQ ID NO: 635531 - RNA, 20 nt, Homo sapiens
aaugaccaugaaagacuucu

SEQ ID NO: 635532 - RNA, 16 nt, Homo sapiens
aaugacccaaagacca

SEQ ID NO: 635533 - RNA, 19 nt, Homo sapiens
aaugacgugccuaccucuu

SEQ ID NO: 635534 - RNA, 18 nt, Homo sapiens
aaugacuaaucagaugau

SEQ ID NO: 635535 - RNA, 19 nt, Homo sapiens
aaugacucaggacaucccc

SEQ ID NO: 635536 - RNA, 20 nt, Homo sapiens
aaugacugccggucauuuga

SEQ ID NO: 635537 - RNA, 11 nt, Homo sapiens
aaugacuguau

SEQ ID NO: 635538 - RNA, 17 nt, Homo sapiens
aaugacuucuaauuuau

SEQ ID NO: 635539 - RNA, 16 nt, Homo sapiens
aaugacuuuauugcau

SEQ ID NO: 635540 - RNA, 20 nt, Homo sapiens
aaugacuuugaaaaccuggc

SEQ ID NO: 635541 - RNA, 21 nt, Homo sapiens
aaugagaagaaugacuaugca

SEQ ID NO: 635542 - RNA, 14 nt, Homo sapiens
aaugagaagacaug

SEQ ID NO: 635543 - RNA, 20 nt, Homo sapiens
aaugagacauaggccaugaa

SEQ ID NO: 635544 - RNA, 21 nt, Homo sapiens
aaugagacauaggccaugaaa

SEQ ID NO: 635545 - RNA, 20 nt, Homo sapiens
aaugagaucguuguuuacag

SEQ ID NO: 635546 - RNA, 15 nt, Homo sapiens
aaugagcaccuccau

SEQ ID NO: 635547 - RNA, 22 nt, Homo sapiens
aaugagguugggggaaccagca

SEQ ID NO: 635548 - RNA, 10 nt, Homo sapiens
aaugagucag

SEQ ID NO: 635549 - RNA, 16 nt, Homo sapiens
aaugauaaaauacuaa

SEQ ID NO: 635550 - RNA, 22 nt, Homo sapiens
aaugauaaacucagaucugauc

SEQ ID NO: 635551 - RNA, 18 nt, Homo sapiens
aaugauaagugacaaaag

SEQ ID NO: 635552 - RNA, 12 nt, Homo sapiens
aaugaucagccu

SEQ ID NO: 635553 - RNA, 15 nt, Homo sapiens
aaugaucagccuugc

SEQ ID NO: 635554 - RNA, 19 nt, Homo sapiens
aaugaucucggaugaccaa

SEQ ID NO: 635555 - RNA, 21 nt, Homo sapiens
aaugaugauggggugggagac

SEQ ID NO: 635556 - RNA, 23 nt, Homo sapiens
aaugaugcucaaaaucuuuccaa

SEQ ID NO: 635557 - RNA, 16 nt, Homo sapiens
aaugaugggacaauaa

SEQ ID NO: 635558 - RNA, 22 nt, Homo sapiens
aaugaugguaaagccauguuaa

SEQ ID NO: 635559 - RNA, 15 nt, Homo sapiens
aaugaugguguuaaa

SEQ ID NO: 635560 - RNA, 18 nt, Homo sapiens
aaugauguuagccugauu

SEQ ID NO: 635561 - RNA, 20 nt, Homo sapiens
aaugauugguuaaaauguga

SEQ ID NO: 635562 - RNA, 16 nt, Homo sapiens
aaugauuguuugucaa

SEQ ID NO: 635563 - RNA, 21 nt, Homo sapiens
aaugauuguuugucaauauaa

SEQ ID NO: 635564 - RNA, 17 nt, Homo sapiens
aaugauuuacauaaaag

SEQ ID NO: 635565 - RNA, 19 nt, Homo sapiens
aaugauuuagguacgucaa

SEQ ID NO: 635566 - RNA, 16 nt, Homo sapiens
aaugauuugcucauaa

SEQ ID NO: 635567 - RNA, 20 nt, Homo sapiens
aaugauuugggaaaacaauu

SEQ ID NO: 635568 - RNA, 19 nt, Homo sapiens
aaugcaaaacacauuuuau

SEQ ID NO: 635569 - RNA, 18 nt, Homo sapiens
aaugcaaaguacauguau

SEQ ID NO: 635570 - RNA, 14 nt, Homo sapiens
aaugcaacaguuuu

SEQ ID NO: 635571 - RNA, 13 nt, Homo sapiens
aaugcaaucagga

SEQ ID NO: 635572 - RNA, 16 nt, Homo sapiens
aaugcaauccuucccu

SEQ ID NO: 635573 - RNA, 16 nt, Homo sapiens
aaugcaaugucuuaaa

SEQ ID NO: 635574 - RNA, 13 nt, Homo sapiens
aaugcacaucuca

SEQ ID NO: 635575 - RNA, 13 nt, Homo sapiens
aaugcaccuggaa

SEQ ID NO: 635576 - RNA, 19 nt, Homo sapiens
agggccuucccugacuuac

SEQ ID NO: 635577 - RNA, 17 nt, Homo sapiens
agggcgagacuccgucu

SEQ ID NO: 635578 - RNA, 13 nt, Homo sapiens
agggcucacucag

SEQ ID NO: 635579 - RNA, 16 nt, Homo sapiens
agggcucccuaaacuu

SEQ ID NO: 635580 - RNA, 20 nt, Homo sapiens
agggcuccuaggcucagugg

SEQ ID NO: 635581 - RNA, 18 nt, Homo sapiens
agggcugcaaaacuggaa

SEQ ID NO: 635582 - RNA, 23 nt, Homo sapiens
agggcuggaaacaagugacccca

SEQ ID NO: 635583 - RNA, 17 nt, Homo sapiens
agggcuggagccugggg

SEQ ID NO: 635584 - RNA, 15 nt, Homo sapiens
agggcuggggacaga

SEQ ID NO: 635585 - RNA, 17 nt, Homo sapiens
aggggaagccagugaca

SEQ ID NO: 635586 - RNA, 21 nt, Homo sapiens
aggggaccacaccucccugaa

SEQ ID NO: 635587 - RNA, 17 nt, Homo sapiens
aggggagaagucagcua

SEQ ID NO: 635588 - RNA, 21 nt, Homo sapiens
aggggagccagaaaugggcag

SEQ ID NO: 635589 - RNA, 17 nt, Homo sapiens
aggggcagccuccguca

SEQ ID NO: 635590 - RNA, 19 nt, Homo sapiens
aggggcaguuuuagcagca

SEQ ID NO: 635591 - RNA, 10 nt, Homo sapiens
aggggccagc

SEQ ID NO: 635592 - RNA, 14 nt, Homo sapiens
aggggcccuuggga

SEQ ID NO: 635593 - RNA, 13 nt, Homo sapiens
aggggcgcugucc

SEQ ID NO: 635594 - RNA, 19 nt, Homo sapiens
aggggcguucucccaaaga

SEQ ID NO: 635595 - RNA, 19 nt, Homo sapiens
aggggcuccgggucacugc

SEQ ID NO: 635596 - RNA, 13 nt, Homo sapiens
aggggcugcauga

SEQ ID NO: 635597 - RNA, 16 nt, Homo sapiens
agggggaagaagcaga

SEQ ID NO: 635598 - RNA, 17 nt, Homo sapiens
agggggaagaagcagag

SEQ ID NO: 635599 - RNA, 14 nt, Homo sapiens
agggggaagacaga

SEQ ID NO: 635600 - RNA, 21 nt, Homo sapiens
agggggaaguucagaaggugu

SEQ ID NO: 635601 - RNA, 15 nt, Homo sapiens
agggggacacuccau

SEQ ID NO: 635602 - RNA, 13 nt, Homo sapiens
aaugccucuucau

SEQ ID NO: 635603 - RNA, 19 nt, Homo sapiens
aaugccugucucuagcugu

SEQ ID NO: 635604 - RNA, 14 nt, Homo sapiens
aaugccugugccaa

SEQ ID NO: 635605 - RNA, 19 nt, Homo sapiens
aaugcuaagaaaugcugaa

SEQ ID NO: 635606 - RNA, 13 nt, Homo sapiens
aaugcuacuuuau

SEQ ID NO: 635607 - RNA, 19 nt, Homo sapiens
aaugcucuggagugugcau

SEQ ID NO: 635608 - RNA, 16 nt, Homo sapiens
aaugcucuuuacuuca

SEQ ID NO: 635609 - RNA, 20 nt, Homo sapiens
aaugcucuuuacuucaugga

SEQ ID NO: 635610 - RNA, 19 nt, Homo sapiens
aaugcugaugaaaacuguc

SEQ ID NO: 635611 - RNA, 18 nt, Homo sapiens
aaugcugcaggaaaagca

SEQ ID NO: 635612 - RNA, 20 nt, Homo sapiens
aaugcugcaggacuugagaa

SEQ ID NO: 635613 - RNA, 16 nt, Homo sapiens
aaugcuggcauuugca

SEQ ID NO: 635614 - RNA, 17 nt, Homo sapiens
aaugcuggcauuugcac

SEQ ID NO: 635615 - RNA, 18 nt, Homo sapiens
aaugcugugguugauauu

SEQ ID NO: 635616 - RNA, 20 nt, Homo sapiens
aaugcuuuuaaaugcucucu

SEQ ID NO: 635617 - RNA, 14 nt, Homo sapiens
aauggaaucuucuc

SEQ ID NO: 635618 - RNA, 17 nt, Homo sapiens
aauggacaaacugccag

SEQ ID NO: 635619 - RNA, 23 nt, Homo sapiens
aauggacauugagauacuaucau

SEQ ID NO: 635620 - RNA, 22 nt, Homo sapiens
aauggaccuccguggccaaaaa

SEQ ID NO: 635621 - RNA, 15 nt, Homo sapiens
aauggacguacuggu

SEQ ID NO: 635622 - RNA, 20 nt, Homo sapiens
aauggacguuauccucucag

SEQ ID NO: 635623 - RNA, 17 nt, Homo sapiens
aauggagcaucaagcca

SEQ ID NO: 635624 - RNA, 18 nt, Homo sapiens
aauggagccaugacaaga

SEQ ID NO: 635625 - RNA, 19 nt, Homo sapiens
aauggaucuuaaagcauuc

SEQ ID NO: 635626 - RNA, 18 nt, Homo sapiens
aauggauucucuauucaa

SEQ ID NO: 635627 - RNA, 14 nt, Homo sapiens
aauggcaccuuccc

SEQ ID NO: 635628 - RNA, 15 nt, Homo sapiens
aauggcacugagaaa

SEQ ID NO: 635629 - RNA, 15 nt, Homo sapiens
aauggcacuguugca

SEQ ID NO: 635630 - RNA, 19 nt, Homo sapiens
aauggcagcuagugccuuu

SEQ ID NO: 635631 - RNA, 14 nt, Homo sapiens
aauggcagcugcca

SEQ ID NO: 635632 - RNA, 13 nt, Homo sapiens
aauggcagggaua

SEQ ID NO: 635633 - RNA, 21 nt, Homo sapiens
aauggcagggauacccaguga

SEQ ID NO: 635634 - RNA, 22 nt, Homo sapiens
aauggcagggauacccagugau

SEQ ID NO: 635635 - RNA, 23 nt, Homo sapiens
aauggcauaggcugacuuuugca

SEQ ID NO: 635636 - RNA, 19 nt, Homo sapiens
aauggcaucaauauacaua

SEQ ID NO: 635637 - RNA, 17 nt, Homo sapiens
aauggcauuugcaauaa

SEQ ID NO: 635638 - RNA, 14 nt, Homo sapiens
aauggcuacacuca

SEQ ID NO: 635639 - RNA, 15 nt, Homo sapiens
aauggcuaguacugu

SEQ ID NO: 635640 - RNA, 20 nt, Homo sapiens
aauggcugagccucgugucc

SEQ ID NO: 635641 - RNA, 22 nt, Homo sapiens
aauggcuucccucuuucaucuc

SEQ ID NO: 635642 - RNA, 16 nt, Homo sapiens
aauggcuuguucauca

SEQ ID NO: 635643 - RNA, 20 nt, Homo sapiens
aauggcuuguucaucaucca

SEQ ID NO: 635644 - RNA, 15 nt, Homo sapiens
aaugggaaaaccaga

SEQ ID NO: 635645 - RNA, 14 nt, Homo sapiens
aaugggaagaccaa

SEQ ID NO: 635646 - RNA, 24 nt, Homo sapiens
aaugggaauauuuuauacugacag

SEQ ID NO: 635647 - RNA, 20 nt, Homo sapiens
aaugggagagcucuuguuau

SEQ ID NO: 635648 - RNA, 18 nt, Homo sapiens
aaugggagccuuuccaau

SEQ ID NO: 635649 - RNA, 21 nt, Homo sapiens
aaugggagccuuuccaaugaa

SEQ ID NO: 635650 - RNA, 14 nt, Homo sapiens
aaugggcacuggga

SEQ ID NO: 635651 - RNA, 16 nt, Homo sapiens
aaugggcagagccagg

SEQ ID NO: 635652 - RNA, 19 nt, Homo sapiens
aaugggcagcuauccagug

SEQ ID NO: 635653 - RNA, 17 nt, Homo sapiens
aaugggccuccagagac

SEQ ID NO: 635654 - RNA, 16 nt, Homo sapiens
aauggggaggacaaaa

SEQ ID NO: 635655 - RNA, 18 nt, Homo sapiens
aauggggggcgggccagg

SEQ ID NO: 635656 - RNA, 15 nt, Homo sapiens
aaugggggugcauuu

SEQ ID NO: 635657 - RNA, 20 nt, Homo sapiens
aauggguuuuguguacugua

SEQ ID NO: 635658 - RNA, 23 nt, Homo sapiens
aaugguaaccgagccagcagcug

SEQ ID NO: 635659 - RNA, 13 nt, Homo sapiens
aaugguacuucau

SEQ ID NO: 635660 - RNA, 18 nt, Homo sapiens
aaugguagcaacugaaag

SEQ ID NO: 635661 - RNA, 19 nt, Homo sapiens
aaugguaggauaucuuggc

SEQ ID NO: 635662 - RNA, 20 nt, Homo sapiens
aaugguaggauaucuuggcu

SEQ ID NO: 635663 - RNA, 20 nt, Homo sapiens
aaugguaggucaaguaauaa

SEQ ID NO: 635664 - RNA, 23 nt, Homo sapiens
aaugguaucauauuaacauauuc

SEQ ID NO: 635665 - RNA, 14 nt, Homo sapiens
aauggucauccaaa

SEQ ID NO: 635666 - RNA, 17 nt, Homo sapiens
aauggucgcccaggaga

SEQ ID NO: 635667 - RNA, 17 nt, Homo sapiens
aauggucucuaacauuu

SEQ ID NO: 635668 - RNA, 16 nt, Homo sapiens
aauggugauccaccca

SEQ ID NO: 635669 - RNA, 21 nt, Homo sapiens
aauggugcaaaaaaaaacuua

SEQ ID NO: 635670 - RNA, 12 nt, Homo sapiens
aaugguguuaca

SEQ ID NO: 635671 - RNA, 17 nt, Homo sapiens
aaugguuaaauuuuaca

SEQ ID NO: 635672 - RNA, 19 nt, Homo sapiens
aaugguuaagaacugugaa

SEQ ID NO: 635673 - RNA, 17 nt, Homo sapiens
aaugguuaugugcauua

SEQ ID NO: 635674 - RNA, 15 nt, Homo sapiens
aaugguuucaaguua

SEQ ID NO: 635675 - RNA, 14 nt, Homo sapiens
aaugguuucacuug

SEQ ID NO: 635676 - RNA, 22 nt, Homo sapiens
aaugguuugggggcagacucuu

SEQ ID NO: 635677 - RNA, 23 nt, Homo sapiens
aaugguuuuaauguucuuuugac

SEQ ID NO: 635678 - RNA, 14 nt, Homo sapiens
aauguaaauacuca

SEQ ID NO: 635679 - RNA, 17 nt, Homo sapiens
aauguaacuauaaucuc

SEQ ID NO: 635680 - RNA, 14 nt, Homo sapiens
aauguaauacugga

SEQ ID NO: 635681 - RNA, 14 nt, Homo sapiens
aauguaaugaugcu

SEQ ID NO: 635682 - RNA, 17 nt, Homo sapiens
aauguacaauaaagcaa

SEQ ID NO: 635683 - RNA, 21 nt, Homo sapiens
aauguacacuaccaaacacuc

SEQ ID NO: 635684 - RNA, 15 nt, Homo sapiens
aauguacauuuauuc

SEQ ID NO: 635685 - RNA, 20 nt, Homo sapiens
aauguaccuucuuucacucu

SEQ ID NO: 635686 - RNA, 13 nt, Homo sapiens
aauguacuaaaaa

SEQ ID NO: 635687 - RNA, 13 nt, Homo sapiens
aauguagcacuua

SEQ ID NO: 635688 - RNA, 20 nt, Homo sapiens
aauguagcuucagucauuaa

SEQ ID NO: 635689 - RNA, 15 nt, Homo sapiens
aauguaggacuguau

SEQ ID NO: 635690 - RNA, 13 nt, Homo sapiens
aauguagucaaua

SEQ ID NO: 635691 - RNA, 20 nt, Homo sapiens
aauguauauaaaguacuuua

SEQ ID NO: 635692 - RNA, 20 nt, Homo sapiens
aauguaucuauuuguacaau

SEQ ID NO: 635693 - RNA, 16 nt, Homo sapiens
aauguaucuuggugcu

SEQ ID NO: 635694 - RNA, 13 nt, Homo sapiens
aauguaugugcac

SEQ ID NO: 635695 - RNA, 18 nt, Homo sapiens
aauguauuuugacacugg

SEQ ID NO: 635696 - RNA, 22 nt, Homo sapiens
aaugucaacagauccgacuuug

SEQ ID NO: 635697 - RNA, 20 nt, Homo sapiens
aaugucaagaucacaaagac

SEQ ID NO: 635698 - RNA, 13 nt, Homo sapiens
aggucaugggaag

SEQ ID NO: 635699 - RNA, 18 nt, Homo sapiens
aggucauuauuuuuuaca

SEQ ID NO: 635700 - RNA, 13 nt, Homo sapiens
agguccaagcaca

SEQ ID NO: 635701 - RNA, 14 nt, Homo sapiens
agguccaagcacau

SEQ ID NO: 635702 - RNA, 20 nt, Homo sapiens
agguccacaacacacagauu

SEQ ID NO: 635703 - RNA, 15 nt, Homo sapiens
agguccagcucugga

SEQ ID NO: 635704 - RNA, 17 nt, Homo sapiens
agguccaggcuugccuc

SEQ ID NO: 635705 - RNA, 19 nt, Homo sapiens
agguccccuccacauccca

SEQ ID NO: 635706 - RNA, 23 nt, Homo sapiens
aggucccgggcuuagugugagca

SEQ ID NO: 635707 - RNA, 15 nt, Homo sapiens
aggucccugacauuu

SEQ ID NO: 635708 - RNA, 22 nt, Homo sapiens
agguccgcccgaccaggaucag

SEQ ID NO: 635709 - RNA, 13 nt, Homo sapiens
agguccuugccuc

SEQ ID NO: 635710 - RNA, 18 nt, Homo sapiens
aggucgagacauuccugc

SEQ ID NO: 635711 - RNA, 12 nt, Homo sapiens
aggucggcacuu

SEQ ID NO: 635712 - RNA, 15 nt, Homo sapiens
aggucguagcauuug

SEQ ID NO: 635713 - RNA, 13 nt, Homo sapiens
aggucuccaaaau

SEQ ID NO: 635714 - RNA, 17 nt, Homo sapiens
aggucuccaaaccagac

SEQ ID NO: 635715 - RNA, 11 nt, Homo sapiens
aggucucucaa

SEQ ID NO: 635716 - RNA, 16 nt, Homo sapiens
aggucugaaauggagg

SEQ ID NO: 635717 - RNA, 16 nt, Homo sapiens
aggucugacacgucug

SEQ ID NO: 635718 - RNA, 19 nt, Homo sapiens
aggucuguacuaacaaagc

SEQ ID NO: 635719 - RNA, 19 nt, Homo sapiens
aggucuuccugcuuuccau

SEQ ID NO: 635720 - RNA, 19 nt, Homo sapiens
aggucuucuuguguccuga

SEQ ID NO: 635721 - RNA, 16 nt, Homo sapiens
aggucuuucuccucag

SEQ ID NO: 635722 - RNA, 17 nt, Homo sapiens
aggugaacugggagcag

SEQ ID NO: 635723 - RNA, 23 nt, Homo sapiens
aggugaacugggagcagcucugu

SEQ ID NO: 635724 - RNA, 13 nt, Homo sapiens
aggugacugggaa

SEQ ID NO: 635725 - RNA, 18 nt, Homo sapiens
aggugagaaaaggggcau

SEQ ID NO: 635726 - RNA, 15 nt, Homo sapiens
aaugucuuaaugcaa

SEQ ID NO: 635727 - RNA, 14 nt, Homo sapiens
aaugucuucacucu

SEQ ID NO: 635728 - RNA, 16 nt, Homo sapiens
aaugucuucacucuau

SEQ ID NO: 635729 - RNA, 20 nt, Homo sapiens
aaugucuucaguggaacaca

SEQ ID NO: 635730 - RNA, 19 nt, Homo sapiens
aaugucuugaugcaugcac

SEQ ID NO: 635731 - RNA, 14 nt, Homo sapiens
aaugugaaacggaa

SEQ ID NO: 635732 - RNA, 12 nt, Homo sapiens
aaugugaacuua

SEQ ID NO: 635733 - RNA, 20 nt, Homo sapiens
aaugugaauaaguaaagaau

SEQ ID NO: 635734 - RNA, 20 nt, Homo sapiens
aaugugacauuauaugcacu

SEQ ID NO: 635735 - RNA, 16 nt, Homo sapiens
aaugugaccaggggug

SEQ ID NO: 635736 - RNA, 22 nt, Homo sapiens
aaugugaguguguaugucagug

SEQ ID NO: 635737 - RNA, 23 nt, Homo sapiens
aaugugauuacugcucuauucca

SEQ ID NO: 635738 - RNA, 15 nt, Homo sapiens
aaugugcaaccacug

SEQ ID NO: 635739 - RNA, 18 nt, Homo sapiens
aaugugcagaugcaauug

SEQ ID NO: 635740 - RNA, 18 nt, Homo sapiens
aaugugcagcucccauuu

SEQ ID NO: 635741 - RNA, 15 nt, Homo sapiens
aaugugcucaugcau

SEQ ID NO: 635742 - RNA, 22 nt, Homo sapiens
aaugugcuggugaacacuguga

SEQ ID NO: 635743 - RNA, 23 nt, Homo sapiens
aauguggaaggaaaauauuucau

SEQ ID NO: 635744 - RNA, 17 nt, Homo sapiens
aauguggauucuuccca

SEQ ID NO: 635745 - RNA, 14 nt, Homo sapiens
aauguggccuccau

SEQ ID NO: 635746 - RNA, 18 nt, Homo sapiens
aaugugguuacuuccuac

SEQ ID NO: 635747 - RNA, 20 nt, Homo sapiens
aauguguauuuuucaaggca

SEQ ID NO: 635748 - RNA, 12 nt, Homo sapiens
aaugugucacua

SEQ ID NO: 635749 - RNA, 21 nt, Homo sapiens
aaugugucuugcugucauuua

SEQ ID NO: 635750 - RNA, 18 nt, Homo sapiens
aauguguuucaaaaccau

SEQ ID NO: 635751 - RNA, 15 nt, Homo sapiens
aauguguuugcaaua

SEQ ID NO: 635752 - RNA, 14 nt, Homo sapiens
aauguuaagcuuua

SEQ ID NO: 635753 - RNA, 15 nt, Homo sapiens
aauguuacauuauua

SEQ ID NO: 635754 - RNA, 18 nt, Homo sapiens
aauguuacauuauuauca

SEQ ID NO: 635755 - RNA, 19 nt, Homo sapiens
aauguuaccacuacuuuaa

SEQ ID NO: 635756 - RNA, 19 nt, Homo sapiens
aauguuacugaucaugcau

SEQ ID NO: 635757 - RNA, 18 nt, Homo sapiens
aauguuagucauuguuau

SEQ ID NO: 635758 - RNA, 23 nt, Homo sapiens
aauguuaucaaccaacugcacaa

SEQ ID NO: 635759 - RNA, 19 nt, Homo sapiens
aauguuauuauuaccagca

SEQ ID NO: 635760 - RNA, 21 nt, Homo sapiens
aauguuauuuuuuaauuauua

SEQ ID NO: 635761 - RNA, 10 nt, Homo sapiens
aauguucaca

SEQ ID NO: 635762 - RNA, 15 nt, Homo sapiens
aauguucauggacua

SEQ ID NO: 635763 - RNA, 16 nt, Homo sapiens
aauguucauugcacau

SEQ ID NO: 635764 - RNA, 12 nt, Homo sapiens
aauguuccauuc

SEQ ID NO: 635765 - RNA, 21 nt, Homo sapiens
aauguuccugaaaauugcaau

SEQ ID NO: 635766 - RNA, 16 nt, Homo sapiens
aauguucuaacagauc

SEQ ID NO: 635767 - RNA, 21 nt, Homo sapiens
aauguucucaugaacuacccc

SEQ ID NO: 635768 - RNA, 15 nt, Homo sapiens
aauguugacaggcaa

SEQ ID NO: 635769 - RNA, 23 nt, Homo sapiens
aauguugcauuuaugaugcaguu

SEQ ID NO: 635770 - RNA, 12 nt, Homo sapiens
aauguugccagc

SEQ ID NO: 635771 - RNA, 20 nt, Homo sapiens
aauguuggacagacacuguu

SEQ ID NO: 635772 - RNA, 21 nt, Homo sapiens
aauguuggacagacacuguug

SEQ ID NO: 635773 - RNA, 23 nt, Homo sapiens
aauguuggaugaugaaacauuca

SEQ ID NO: 635774 - RNA, 16 nt, Homo sapiens
aauguugggacugcua

SEQ ID NO: 635775 - RNA, 14 nt, Homo sapiens
aauguugggagaaa

SEQ ID NO: 635776 - RNA, 16 nt, Homo sapiens
aauguuguccaggaaa

SEQ ID NO: 635777 - RNA, 19 nt, Homo sapiens
aauguuuaagauaaacaga

SEQ ID NO: 635778 - RNA, 23 nt, Homo sapiens
aauguuuaaguauuaacuuacaa

SEQ ID NO: 635779 - RNA, 13 nt, Homo sapiens
aauguuuaaucuc

SEQ ID NO: 635780 - RNA, 21 nt, Homo sapiens
aauguuuauuaaaugcuucau

SEQ ID NO: 635781 - RNA, 23 nt, Homo sapiens
aauguuuauuuagcucugaagca

SEQ ID NO: 635782 - RNA, 23 nt, Homo sapiens
aauguuuccaaccuggaguauaa

SEQ ID NO: 635783 - RNA, 18 nt, Homo sapiens
aauguuuguauacauguu

SEQ ID NO: 635784 - RNA, 22 nt, Homo sapiens
aauguuugucuggauuggcuau

SEQ ID NO: 635785 - RNA, 22 nt, Homo sapiens
aauguuuguuauuuacacuggu

SEQ ID NO: 635786 - RNA, 21 nt, Homo sapiens
aauguuuucauuauguucaug

SEQ ID NO: 635787 - RNA, 16 nt, Homo sapiens
aauuaaaaaagcauac

SEQ ID NO: 635788 - RNA, 17 nt, Homo sapiens
aauuaaaaaagcauacu

SEQ ID NO: 635789 - RNA, 15 nt, Homo sapiens
aauuaaaaacuuuaa

SEQ ID NO: 635790 - RNA, 13 nt, Homo sapiens
aauuaaaaccaau

SEQ ID NO: 635791 - RNA, 16 nt, Homo sapiens
aauuaaaaccaauuua

SEQ ID NO: 635792 - RNA, 23 nt, Homo sapiens
aauuaaaacuaagcacaaagcca

SEQ ID NO: 635793 - RNA, 14 nt, Homo sapiens
aauuaaacaauuua

SEQ ID NO: 635794 - RNA, 11 nt, Homo sapiens
aauuaaaggaa

SEQ ID NO: 635795 - RNA, 16 nt, Homo sapiens
aauuaaauagugugau

SEQ ID NO: 635796 - RNA, 17 nt, Homo sapiens
aauuaaaugccuuguau

SEQ ID NO: 635797 - RNA, 17 nt, Homo sapiens
aauuaaauggcaucagc

SEQ ID NO: 635798 - RNA, 15 nt, Homo sapiens
aauuaacugcuccaa

SEQ ID NO: 635799 - RNA, 17 nt, Homo sapiens
aauuaacugcuccaaau

SEQ ID NO: 635800 - RNA, 12 nt, Homo sapiens
aauuaacuugag

SEQ ID NO: 635801 - RNA, 19 nt, Homo sapiens
aauuaagacuugugcauga

SEQ ID NO: 635802 - RNA, 14 nt, Homo sapiens
aauuaauacauucu

SEQ ID NO: 635803 - RNA, 21 nt, Homo sapiens
aauuaauaucccuacauguau

SEQ ID NO: 635804 - RNA, 23 nt, Homo sapiens
aauuaaucaaguaccuauauuga

SEQ ID NO: 635805 - RNA, 23 nt, Homo sapiens
aauuaauugggccagcuuuucaa

SEQ ID NO: 635806 - RNA, 15 nt, Homo sapiens
aauuaauuugugaau

SEQ ID NO: 635807 - RNA, 23 nt, Homo sapiens
aauuacaaccacagaaagcacuc

SEQ ID NO: 635808 - RNA, 16 nt, Homo sapiens
aauuacaaccauugua

SEQ ID NO: 635809 - RNA, 22 nt, Homo sapiens
aauuacacaguaagucauuuaa

SEQ ID NO: 635810 - RNA, 14 nt, Homo sapiens
aauuacagccuuau

SEQ ID NO: 635811 - RNA, 16 nt, Homo sapiens
aauuacaguacacauc

SEQ ID NO: 635812 - RNA, 18 nt, Homo sapiens
aauuaccaugcuucacaa

SEQ ID NO: 635813 - RNA, 21 nt, Homo sapiens
aauuaccauuaauuacauaca

SEQ ID NO: 635814 - RNA, 13 nt, Homo sapiens
aauuacguuuaaa

SEQ ID NO: 635815 - RNA, 17 nt, Homo sapiens
aauuacuauuuacuuua

SEQ ID NO: 635816 - RNA, 22 nt, Homo sapiens
aauuacugccuuacuguacaua

SEQ ID NO: 635817 - RNA, 19 nt, Homo sapiens
aauuacuuauuguauuuau

SEQ ID NO: 635818 - RNA, 20 nt, Homo sapiens
aauuagagagcaucugcaac

SEQ ID NO: 635819 - RNA, 20 nt, Homo sapiens
aauuagccggucaugguggu

SEQ ID NO: 635820 - RNA, 15 nt, Homo sapiens
agguuugccagugaa

SEQ ID NO: 635821 - RNA, 16 nt, Homo sapiens
agguuugccugugauu

SEQ ID NO: 635822 - RNA, 14 nt, Homo sapiens
agguuuguccacau

SEQ ID NO: 635823 - RNA, 16 nt, Homo sapiens
agguuugucccaguca

SEQ ID NO: 635824 - RNA, 18 nt, Homo sapiens
agguuugucccagucaga

SEQ ID NO: 635825 - RNA, 16 nt, Homo sapiens
agguuuuaaagugauu

SEQ ID NO: 635826 - RNA, 23 nt, Homo sapiens
agguuuuuaaguugucugucuga

SEQ ID NO: 635827 - RNA, 19 nt, Homo sapiens
agguuuuucucauguaucu

SEQ ID NO: 635828 - RNA, 21 nt, Homo sapiens
agguuuuuuugucaacauugu

SEQ ID NO: 635829 - RNA, 22 nt, Homo sapiens
aguaaaaaaggagacaguuuau

SEQ ID NO: 635830 - RNA, 16 nt, Homo sapiens
aguaaaaauccaaaaa

SEQ ID NO: 635831 - RNA, 16 nt, Homo sapiens
aguaaaacuguauaaa

SEQ ID NO: 635832 - RNA, 22 nt, Homo sapiens
aguaaaagaucagguuauacuu

SEQ ID NO: 635833 - RNA, 15 nt, Homo sapiens
aguaaaagugcuuuc

SEQ ID NO: 635834 - RNA, 13 nt, Homo sapiens
aguaaacaaugaa

SEQ ID NO: 635835 - RNA, 12 nt, Homo sapiens
aguaaacuugaa

SEQ ID NO: 635836 - RNA, 13 nt, Homo sapiens
aguaaacuugaaa

SEQ ID NO: 635837 - RNA, 19 nt, Homo sapiens
aguaaacuuuucaguauug

SEQ ID NO: 635838 - RNA, 20 nt, Homo sapiens
aguaaaggcaguaaugccuu

SEQ ID NO: 635839 - RNA, 19 nt, Homo sapiens
aguaaaggccucaucuccu

SEQ ID NO: 635840 - RNA, 23 nt, Homo sapiens
aguaaaggcugcugcuacaaugu

SEQ ID NO: 635841 - RNA, 21 nt, Homo sapiens
aguaaagguuuuuguaauaaa

SEQ ID NO: 635842 - RNA, 17 nt, Homo sapiens
aguaaauaacaggcauu

SEQ ID NO: 635843 - RNA, 15 nt, Homo sapiens
aguaaauaacuggaa

SEQ ID NO: 635844 - RNA, 18 nt, Homo sapiens
aguaaauauauaugucaa

SEQ ID NO: 635845 - RNA, 17 nt, Homo sapiens
aguaaauauuucaggca

SEQ ID NO: 635846 - RNA, 14 nt, Homo sapiens
aguaaaugccucau

SEQ ID NO: 635847 - RNA, 13 nt, Homo sapiens
aguaaaugcgugc

SEQ ID NO: 635848 - RNA, 19 nt, Homo sapiens
aguaaauguguuucuugcu

SEQ ID NO: 635849 - RNA, 15 nt, Homo sapiens
aauucaaacauauuc

SEQ ID NO: 635850 - RNA, 14 nt, Homo sapiens
aauucaaacugggg

SEQ ID NO: 635851 - RNA, 13 nt, Homo sapiens
aauucaacccagc

SEQ ID NO: 635852 - RNA, 15 nt, Homo sapiens
aauucaagugacaca

SEQ ID NO: 635853 - RNA, 20 nt, Homo sapiens
aauucaagugacacauuaau

SEQ ID NO: 635854 - RNA, 16 nt, Homo sapiens
aauucaaugucuuaaa

SEQ ID NO: 635855 - RNA, 14 nt, Homo sapiens
aauucaauuuggca

SEQ ID NO: 635856 - RNA, 20 nt, Homo sapiens
aauucacagaauagcacaaa

SEQ ID NO: 635857 - RNA, 20 nt, Homo sapiens
aauucacagugcucuuuucu

SEQ ID NO: 635858 - RNA, 16 nt, Homo sapiens
aauucaccaguguucc

SEQ ID NO: 635859 - RNA, 20 nt, Homo sapiens
aauucacccccuuuccugga

SEQ ID NO: 635860 - RNA, 17 nt, Homo sapiens
aauucagaacaagcaau

SEQ ID NO: 635861 - RNA, 19 nt, Homo sapiens
aauucagcaguuuuauccu

SEQ ID NO: 635862 - RNA, 14 nt, Homo sapiens
aauucagcauuuga

SEQ ID NO: 635863 - RNA, 18 nt, Homo sapiens
aauucagccaacauguga

SEQ ID NO: 635864 - RNA, 16 nt, Homo sapiens
aauucaguccuaagaa

SEQ ID NO: 635865 - RNA, 19 nt, Homo sapiens
aauucauaaaaacugcuua

SEQ ID NO: 635866 - RNA, 18 nt, Homo sapiens
aauucauccucuuaccag

SEQ ID NO: 635867 - RNA, 16 nt, Homo sapiens
aauucaucuucagucu

SEQ ID NO: 635868 - RNA, 22 nt, Homo sapiens
aauucaugugagaaagcuaaaa

SEQ ID NO: 635869 - RNA, 17 nt, Homo sapiens
aauucauugugauuuau

SEQ ID NO: 635870 - RNA, 22 nt, Homo sapiens
aauucauuguguuaccuguaga

SEQ ID NO: 635871 - RNA, 21 nt, Homo sapiens
aauucauuucuagacucaaaa

SEQ ID NO: 635872 - RNA, 14 nt, Homo sapiens
aauucauuuugcag

SEQ ID NO: 635873 - RNA, 22 nt, Homo sapiens
aauuccaaagcaaaaccagaac

SEQ ID NO: 635874 - RNA, 20 nt, Homo sapiens
aauuccaagacagugcccau

SEQ ID NO: 635875 - RNA, 17 nt, Homo sapiens
aauuccacagauuauca

SEQ ID NO: 635876 - RNA, 22 nt, Homo sapiens
aauuccagaggacucugcuuaa

SEQ ID NO: 635877 - RNA, 17 nt, Homo sapiens
aauuccaguuaaccuau

SEQ ID NO: 635878 - RNA, 14 nt, Homo sapiens
aauuccauagugga

SEQ ID NO: 635879 - RNA, 17 nt, Homo sapiens
aauuccaugucagauaa

SEQ ID NO: 635880 - RNA, 20 nt, Homo sapiens
aauucccaacauuucuuaaa

SEQ ID NO: 635881 - RNA, 14 nt, Homo sapiens
aauucccaagcuuu

SEQ ID NO: 635882 - RNA, 15 nt, Homo sapiens
aauucccaagcuuuu

SEQ ID NO: 635883 - RNA, 17 nt, Homo sapiens
aauucccuuucauuuga

SEQ ID NO: 635884 - RNA, 17 nt, Homo sapiens
aauucccuuuuaaucaa

SEQ ID NO: 635885 - RNA, 15 nt, Homo sapiens
aauuccuaccucccu

SEQ ID NO: 635886 - RNA, 22 nt, Homo sapiens
aauuccuacugacaacauuaua

SEQ ID NO: 635887 - RNA, 22 nt, Homo sapiens
aauuccuguauucuacagcaga

SEQ ID NO: 635888 - RNA, 16 nt, Homo sapiens
aauuccuguuacuuua

SEQ ID NO: 635889 - RNA, 13 nt, Homo sapiens
aauuccuuugugu

SEQ ID NO: 635890 - RNA, 22 nt, Homo sapiens
aauucuaaaauacaaacccaug

SEQ ID NO: 635891 - RNA, 18 nt, Homo sapiens
aauucuaaauaaugcaaa

SEQ ID NO: 635892 - RNA, 13 nt, Homo sapiens
aauucuacuuuga

SEQ ID NO: 635893 - RNA, 19 nt, Homo sapiens
aauucuaguauuuuaucug

SEQ ID NO: 635894 - RNA, 15 nt, Homo sapiens
aauucuagugcugcu

SEQ ID NO: 635895 - RNA, 21 nt, Homo sapiens
aauucuauaggaacauaugaa

SEQ ID NO: 635896 - RNA, 19 nt, Homo sapiens
aauucuaugccugucuuaa

SEQ ID NO: 635897 - RNA, 23 nt, Homo sapiens
aauucucaaaagaaaaggcaaaa

SEQ ID NO: 635898 - RNA, 22 nt, Homo sapiens
aauucucagucaguaauugcca

SEQ ID NO: 635899 - RNA, 15 nt, Homo sapiens
aauucucuuugguca

SEQ ID NO: 635900 - RNA, 15 nt, Homo sapiens
aauucugaacuuuau

SEQ ID NO: 635901 - RNA, 22 nt, Homo sapiens
aauucugauuuauuccuacauu

SEQ ID NO: 635902 - RNA, 20 nt, Homo sapiens
aauucugcaacuagccaagg

SEQ ID NO: 635903 - RNA, 22 nt, Homo sapiens
aauucugccuugguucuggcca

SEQ ID NO: 635904 - RNA, 11 nt, Homo sapiens
aauucugugac

SEQ ID NO: 635905 - RNA, 18 nt, Homo sapiens
aauucuuagccaggugua

SEQ ID NO: 635906 - RNA, 13 nt, Homo sapiens
aauucuucauccu

SEQ ID NO: 635907 - RNA, 18 nt, Homo sapiens
aauucuucuguccugaga

SEQ ID NO: 635908 - RNA, 15 nt, Homo sapiens
aauucuugaugguaa

SEQ ID NO: 635909 - RNA, 19 nt, Homo sapiens
aauucuuucaauucuucau

SEQ ID NO: 635910 - RNA, 21 nt, Homo sapiens
aauucuuuucuuuuccauuua

SEQ ID NO: 635911 - RNA, 19 nt, Homo sapiens
aauugaaaaugaccaaaau

SEQ ID NO: 635912 - RNA, 14 nt, Homo sapiens
aauugaaagaacuu

SEQ ID NO: 635913 - RNA, 17 nt, Homo sapiens
aauugaaaggcauucuc

SEQ ID NO: 635914 - RNA, 19 nt, Homo sapiens
aauugaaaguuuauaugcu

SEQ ID NO: 635915 - RNA, 15 nt, Homo sapiens
aauugaauaguaaga

SEQ ID NO: 635916 - RNA, 14 nt, Homo sapiens
aauugaauuugcac

SEQ ID NO: 635917 - RNA, 17 nt, Homo sapiens
aauugacaguugcagaa

SEQ ID NO: 635918 - RNA, 15 nt, Homo sapiens
aauugacgacuucac

SEQ ID NO: 635919 - RNA, 15 nt, Homo sapiens
aauugacuaaaaagu

SEQ ID NO: 635920 - RNA, 22 nt, Homo sapiens
aauugacuaccguuguuugcaa

SEQ ID NO: 635921 - RNA, 19 nt, Homo sapiens
aauugacucucacacugaa

SEQ ID NO: 635922 - RNA, 15 nt, Homo sapiens
aauugagaccacagg

SEQ ID NO: 635923 - RNA, 15 nt, Homo sapiens
aauugauacuucagg

SEQ ID NO: 635924 - RNA, 13 nt, Homo sapiens
aauugaugaugca

SEQ ID NO: 635925 - RNA, 16 nt, Homo sapiens
aauugaugaugcaguu

SEQ ID NO: 635926 - RNA, 21 nt, Homo sapiens
aauugauuauucugauuccac

SEQ ID NO: 635927 - RNA, 19 nt, Homo sapiens
aauugauuuuucucuucau

SEQ ID NO: 635928 - RNA, 20 nt, Homo sapiens
aauugcaacagaagcaaaaa

SEQ ID NO: 635929 - RNA, 22 nt, Homo sapiens
aauugcagguauuggggaacag

SEQ ID NO: 635930 - RNA, 12 nt, Homo sapiens
aauugcauuucc

SEQ ID NO: 635931 - RNA, 16 nt, Homo sapiens
aauugcauuucugcuc

SEQ ID NO: 635932 - RNA, 14 nt, Homo sapiens
aauugccagcaaau

SEQ ID NO: 635933 - RNA, 16 nt, Homo sapiens
aauugcuaauguugcu

SEQ ID NO: 635934 - RNA, 18 nt, Homo sapiens
aauugcuagucaggguga

SEQ ID NO: 635935 - RNA, 11 nt, Homo sapiens
aauugcucaag

SEQ ID NO: 635936 - RNA, 20 nt, Homo sapiens
aauugcucuuggcugugaaa

SEQ ID NO: 635937 - RNA, 14 nt, Homo sapiens
aauuggaaucuuca

SEQ ID NO: 635938 - RNA, 16 nt, Homo sapiens
aauuggacucugucac

SEQ ID NO: 635939 - RNA, 15 nt, Homo sapiens
aauuggccaucuuaa

SEQ ID NO: 635940 - RNA, 14 nt, Homo sapiens
aauuggccaugucg

SEQ ID NO: 635941 - RNA, 17 nt, Homo sapiens
aauuggccgcugucacu

SEQ ID NO: 635942 - RNA, 12 nt, Homo sapiens
auagccaaaaau

SEQ ID NO: 635943 - RNA, 19 nt, Homo sapiens
auagccacuaaccuugccu

SEQ ID NO: 635944 - RNA, 16 nt, Homo sapiens
auagccaggcucucug

SEQ ID NO: 635945 - RNA, 18 nt, Homo sapiens
auagccaggcucucugcu

SEQ ID NO: 635946 - RNA, 18 nt, Homo sapiens
auagcgagaagaugcucu

SEQ ID NO: 635947 - RNA, 17 nt, Homo sapiens
auagcuaauuuuugcaa

SEQ ID NO: 635948 - RNA, 17 nt, Homo sapiens
auagcuacaguguaaua

SEQ ID NO: 635949 - RNA, 19 nt, Homo sapiens
auagcuauuaagauacuua

SEQ ID NO: 635950 - RNA, 23 nt, Homo sapiens
auagcucuggggugggcaguuuu

SEQ ID NO: 635951 - RNA, 21 nt, Homo sapiens
auagcugcaaguguaucuccu

SEQ ID NO: 635952 - RNA, 13 nt, Homo sapiens
auagcugcuuccg

SEQ ID NO: 635953 - RNA, 20 nt, Homo sapiens
auagcugugugaacguguau

SEQ ID NO: 635954 - RNA, 12 nt, Homo sapiens
auagcuucagga

SEQ ID NO: 635955 - RNA, 13 nt, Homo sapiens
auagcuucaggag

SEQ ID NO: 635956 - RNA, 16 nt, Homo sapiens
auagcuuuauacucuc

SEQ ID NO: 635957 - RNA, 22 nt, Homo sapiens
auaggaaaagauguauggucua

SEQ ID NO: 635958 - RNA, 20 nt, Homo sapiens
auaggaauguccaccaugaa

SEQ ID NO: 635959 - RNA, 16 nt, Homo sapiens
auaggacauacugcau

SEQ ID NO: 635960 - RNA, 20 nt, Homo sapiens
auaggacucuagacggcauc

SEQ ID NO: 635961 - RNA, 15 nt, Homo sapiens
auaggagugaauaca

SEQ ID NO: 635962 - RNA, 19 nt, Homo sapiens
auaggauuaaacacacaca

SEQ ID NO: 635963 - RNA, 22 nt, Homo sapiens
auaggauuaaacacacacaaaa

SEQ ID NO: 635964 - RNA, 16 nt, Homo sapiens
auaggcaaaagacaug

SEQ ID NO: 635965 - RNA, 13 nt, Homo sapiens
auaggcaauaaua

SEQ ID NO: 635966 - RNA, 14 nt, Homo sapiens
auaggcacaggcaa

SEQ ID NO: 635967 - RNA, 13 nt, Homo sapiens
auaggcagcaucu

SEQ ID NO: 635968 - RNA, 19 nt, Homo sapiens
auaggcauuugauuuugcc

SEQ ID NO: 635969 - RNA, 15 nt, Homo sapiens
auaggccugggugcu

SEQ ID NO: 635970 - RNA, 22 nt, Homo sapiens
auaggcugacuuuugcagaugg

SEQ ID NO: 635971 - RNA, 21 nt, Homo sapiens
auagggaaguaacauuugccu

SEQ ID NO: 635972 - RNA, 19 nt, Homo sapiens
auagggagcagaugcaaug

SEQ ID NO: 635973 - RNA, 13 nt, Homo sapiens
auagguagaguca

SEQ ID NO: 635974 - RNA, 13 nt, Homo sapiens
auaggucacuggc

SEQ ID NO: 635975 - RNA, 20 nt, Homo sapiens
auaggucuuucucucaguga

SEQ ID NO: 635976 - RNA, 13 nt, Homo sapiens
auaggugacaggg

SEQ ID NO: 635977 - RNA, 15 nt, Homo sapiens
auaggugugugagac

SEQ ID NO: 635978 - RNA, 20 nt, Homo sapiens
auagguuuuucucauguauc

SEQ ID NO: 635979 - RNA, 14 nt, Homo sapiens
auaguaaaugcuuu

SEQ ID NO: 635980 - RNA, 21 nt, Homo sapiens
auaguagaaagacaucugccu

SEQ ID NO: 635981 - RNA, 13 nt, Homo sapiens
auaguagcauuuc

SEQ ID NO: 635982 - RNA, 14 nt, Homo sapiens
auagucauaccugg

SEQ ID NO: 635983 - RNA, 22 nt, Homo sapiens
auagucauuccaaauaugagau

SEQ ID NO: 635984 - RNA, 13 nt, Homo sapiens
auaguccaaagac

SEQ ID NO: 635985 - RNA, 22 nt, Homo sapiens
auagucccauuuuucucuugcc

SEQ ID NO: 635986 - RNA, 13 nt, Homo sapiens
auagucuguccaa

SEQ ID NO: 635987 - RNA, 20 nt, Homo sapiens
auagucuuaguaauagcauc

SEQ ID NO: 635988 - RNA, 14 nt, Homo sapiens
auagugaacacacu

SEQ ID NO: 635989 - RNA, 23 nt, Homo sapiens
auagugacuaugaacuucucuca

SEQ ID NO: 635990 - RNA, 17 nt, Homo sapiens
acauuuggacauuucca

SEQ ID NO: 635991 - RNA, 19 nt, Homo sapiens
acauuuggauuaaucucca

SEQ ID NO: 635992 - RNA, 21 nt, Homo sapiens
acauuuggugagagaaguaca

SEQ ID NO: 635993 - RNA, 16 nt, Homo sapiens
acauuugucuucauga

SEQ ID NO: 635994 - RNA, 15 nt, Homo sapiens
acauuuguuccugga

SEQ ID NO: 635995 - RNA, 14 nt, Homo sapiens
acauuuuaaaugaa

SEQ ID NO: 635996 - RNA, 20 nt, Homo sapiens
acauuuuaauuuuaguuuca

SEQ ID NO: 635997 - RNA, 14 nt, Homo sapiens
acauuuuacauuaa

SEQ ID NO: 635998 - RNA, 19 nt, Homo sapiens
acauuuuacccacacacag

SEQ ID NO: 635999 - RNA, 23 nt, Homo sapiens
acauuuuacuuuuuccuggcuca

SEQ ID NO: 636000 - RNA, 15 nt, Homo sapiens
acauuuuauacugua

SEQ ID NO: 636001 - RNA, 20 nt, Homo sapiens
acauuuuauucuucuaauua

SEQ ID NO: 636002 - RNA, 14 nt, Homo sapiens
acauuuucauugau

SEQ ID NO: 636003 - RNA, 23 nt, Homo sapiens
acauuuucguccuguagcacgcu

SEQ ID NO: 636004 - RNA, 21 nt, Homo sapiens
acauuuucuauaacauaugau

SEQ ID NO: 636005 - RNA, 23 nt, Homo sapiens
acauuuuggaaacaacauauuac

SEQ ID NO: 636006 - RNA, 14 nt, Homo sapiens
acauuuuguuauag

SEQ ID NO: 636007 - RNA, 22 nt, Homo sapiens
acauuuuuaaaagaacaaugac

SEQ ID NO: 636008 - RNA, 18 nt, Homo sapiens
acauuuuuccguuugcuu

SEQ ID NO: 636009 - RNA, 16 nt, Homo sapiens
acauuuuugugccauu

SEQ ID NO: 636010 - RNA, 20 nt, Homo sapiens
acauuuuugugccauuauau

SEQ ID NO: 636011 - RNA, 18 nt, Homo sapiens
acauuuuuuaacuuucua

SEQ ID NO: 636012 - RNA, 21 nt, Homo sapiens
acauuuuuucagucauauaaa

SEQ ID NO: 636013 - RNA, 15 nt, Homo sapiens
acauuuuuugggcag

SEQ ID NO: 636014 - RNA, 23 nt, Homo sapiens
acauuuuuuuuaacuacuauauu

SEQ ID NO: 636015 - RNA, 14 nt, Homo sapiens
accaaaaacugaaa

SEQ ID NO: 636016 - RNA, 17 nt, Homo sapiens
accaaaacaccccaacu

SEQ ID NO: 636017 - RNA, 13 nt, Homo sapiens
accaaaacauaaa

SEQ ID NO: 636018 - RNA, 14 nt, Homo sapiens
accaaaacaugccg

SEQ ID NO: 636019 - RNA, 21 nt, Homo sapiens
accaaaacuauccugauucca

SEQ ID NO: 636020 - RNA, 16 nt, Homo sapiens
accaaaaguuacaugu

SEQ ID NO: 636021 - RNA, 21 nt, Homo sapiens
accaaaaugacaaugaugaug

SEQ ID NO: 636022 - RNA, 17 nt, Homo sapiens
accaaacugccucaauc

SEQ ID NO: 636023 - RNA, 21 nt, Homo sapiens
accaaagagacuggagcaucu

SEQ ID NO: 636024 - RNA, 23 nt, Homo sapiens
accaaagagacuggagcaucuga

SEQ ID NO: 636025 - RNA, 15 nt, Homo sapiens
accaaagcugcccac

SEQ ID NO: 636026 - RNA, 19 nt, Homo sapiens
accaaagucacaaaucauc

SEQ ID NO: 636027 - RNA, 15 nt, Homo sapiens
accaaagugauaaau

SEQ ID NO: 636028 - RNA, 16 nt, Homo sapiens
accaaauaaaguacca

SEQ ID NO: 636029 - RNA, 17 nt, Homo sapiens
accaaauaaaguaccau

SEQ ID NO: 636030 - RNA, 18 nt, Homo sapiens
accaaauaaaguaccauu

SEQ ID NO: 636031 - RNA, 11 nt, Homo sapiens
accaaauaaga

SEQ ID NO: 636032 - RNA, 14 nt, Homo sapiens
accaaauaagacuu

SEQ ID NO: 636033 - RNA, 15 nt, Homo sapiens
accaaauaauuucau

SEQ ID NO: 636034 - RNA, 21 nt, Homo sapiens
accaaauaggauuaaacacac

SEQ ID NO: 636035 - RNA, 19 nt, Homo sapiens
accaaauuugaugcgaucu

SEQ ID NO: 636036 - RNA, 18 nt, Homo sapiens
accaacaaaaagaacaaa

SEQ ID NO: 636037 - RNA, 14 nt, Homo sapiens
accaacacugaccc

SEQ ID NO: 636038 - RNA, 14 nt, Homo sapiens
accaacauggagaa

SEQ ID NO: 636039 - RNA, 12 nt, Homo sapiens
accaaccacagc

SEQ ID NO: 636040 - RNA, 21 nt, Homo sapiens
accaacccuguuuccugaguu

SEQ ID NO: 636041 - RNA, 15 nt, Homo sapiens
accaaccucauagag

SEQ ID NO: 636042 - RNA, 15 nt, Homo sapiens
accaaccugcucugu

SEQ ID NO: 636043 - RNA, 17 nt, Homo sapiens
accaacgcacaacagga

SEQ ID NO: 636044 - RNA, 18 nt, Homo sapiens
accaacugggcccaagac

SEQ ID NO: 636045 - RNA, 15 nt, Homo sapiens
accaacuguacaaaa

SEQ ID NO: 636046 - RNA, 17 nt, Homo sapiens
accaacuuaagaauuug

SEQ ID NO: 636047 - RNA, 17 nt, Homo sapiens
accaagaacauaagaau

SEQ ID NO: 636048 - RNA, 18 nt, Homo sapiens
accaagaacauaagaauu

SEQ ID NO: 636049 - RNA, 14 nt, Homo sapiens
accaagaacugaag

SEQ ID NO: 636050 - RNA, 14 nt, Homo sapiens
accaagaucuccaa

SEQ ID NO: 636051 - RNA, 20 nt, Homo sapiens
accaagauggguggcaccaa

SEQ ID NO: 636052 - RNA, 21 nt, Homo sapiens
accaagccucccacacugaaa

SEQ ID NO: 636053 - RNA, 17 nt, Homo sapiens
accaagcuauuccuuuc

SEQ ID NO: 636054 - RNA, 14 nt, Homo sapiens
accaaggaagcagc

SEQ ID NO: 636055 - RNA, 18 nt, Homo sapiens
accaaggaagcagccuca

SEQ ID NO: 636056 - RNA, 18 nt, Homo sapiens
accaaggagccaaacauc

SEQ ID NO: 636057 - RNA, 18 nt, Homo sapiens
accaaggaggggccagug

SEQ ID NO: 636058 - RNA, 13 nt, Homo sapiens
accaaggaugaau

SEQ ID NO: 636059 - RNA, 18 nt, Homo sapiens
accaaggcagugcaugca

SEQ ID NO: 636060 - RNA, 18 nt, Homo sapiens
accaaggccccgagcuca

SEQ ID NO: 636061 - RNA, 13 nt, Homo sapiens
accaaggucuuca

SEQ ID NO: 636062 - RNA, 17 nt, Homo sapiens
accaaguaccaguauaa

SEQ ID NO: 636063 - RNA, 13 nt, Homo sapiens
accaagugcaaua

SEQ ID NO: 636064 - RNA, 20 nt, Homo sapiens
auauauuuuugugcacauuu

SEQ ID NO: 636065 - RNA, 22 nt, Homo sapiens
auaucaaaaaaccuuuacaguu

SEQ ID NO: 636066 - RNA, 14 nt, Homo sapiens
auaucaaaauucua

SEQ ID NO: 636067 - RNA, 13 nt, Homo sapiens
auaucaacacuug

SEQ ID NO: 636068 - RNA, 14 nt, Homo sapiens
auaucaccucucuu

SEQ ID NO: 636069 - RNA, 13 nt, Homo sapiens
auaucagagcucu

SEQ ID NO: 636070 - RNA, 14 nt, Homo sapiens
auaucagagcucuu

SEQ ID NO: 636071 - RNA, 22 nt, Homo sapiens
auaucaguauucugacauguaa

SEQ ID NO: 636072 - RNA, 16 nt, Homo sapiens
auaucauacuguucaa

SEQ ID NO: 636073 - RNA, 12 nt, Homo sapiens
auaucaugaaga

SEQ ID NO: 636074 - RNA, 23 nt, Homo sapiens
auaucaugccccuguacuccagc

SEQ ID NO: 636075 - RNA, 18 nt, Homo sapiens
auaucaugguagucacua

SEQ ID NO: 636076 - RNA, 18 nt, Homo sapiens
auaucaugucuugugcau

SEQ ID NO: 636077 - RNA, 19 nt, Homo sapiens
auaucauuuauccuuacau

SEQ ID NO: 636078 - RNA, 22 nt, Homo sapiens
auaucauuuuaaaaacuuuauu

SEQ ID NO: 636079 - RNA, 15 nt, Homo sapiens
auauccacaguacuc

SEQ ID NO: 636080 - RNA, 16 nt, Homo sapiens
auauccaguuccugcu

SEQ ID NO: 636081 - RNA, 16 nt, Homo sapiens
auaucccuacauguau

SEQ ID NO: 636082 - RNA, 15 nt, Homo sapiens
auauccugugacugu

SEQ ID NO: 636083 - RNA, 13 nt, Homo sapiens
auaucgaucucuu

SEQ ID NO: 636084 - RNA, 22 nt, Homo sapiens
auaucgcuggccagcauuauaa

SEQ ID NO: 636085 - RNA, 12 nt, Homo sapiens
auaucuaaaaac

SEQ ID NO: 636086 - RNA, 14 nt, Homo sapiens
auaucuacuguggu

SEQ ID NO: 636087 - RNA, 20 nt, Homo sapiens
auaucuauuauucaaaaaau

SEQ ID NO: 636088 - RNA, 15 nt, Homo sapiens
auaucucacacaguu

SEQ ID NO: 636089 - RNA, 16 nt, Homo sapiens
auaucugaaccaagau

SEQ ID NO: 636090 - RNA, 14 nt, Homo sapiens
auaucuggcacugu

SEQ ID NO: 636091 - RNA, 21 nt, Homo sapiens
auaucugggauucuacuuuaa

SEQ ID NO: 636092 - RNA, 11 nt, Homo sapiens
auaucuuggcc

SEQ ID NO: 636093 - RNA, 16 nt, Homo sapiens
auaucuuuauuaauca

SEQ ID NO: 636094 - RNA, 16 nt, Homo sapiens
auaugaaaaucuccau

SEQ ID NO: 636095 - RNA, 22 nt, Homo sapiens
auaugaaauaaaaagauccugc

SEQ ID NO: 636096 - RNA, 21 nt, Homo sapiens
auaugaacaaacuaugaucac

SEQ ID NO: 636097 - RNA, 18 nt, Homo sapiens
auaugaacuggaccugca

SEQ ID NO: 636098 - RNA, 17 nt, Homo sapiens
auaugaagaacugagga

SEQ ID NO: 636099 - RNA, 19 nt, Homo sapiens
auaugaagaagacaccucu

SEQ ID NO: 636100 - RNA, 15 nt, Homo sapiens
auaugaaggauuacu

SEQ ID NO: 636101 - RNA, 17 nt, Homo sapiens
auaugagaauauaccuu

SEQ ID NO: 636102 - RNA, 21 nt, Homo sapiens
auaugaguaauacaucaaaga

SEQ ID NO: 636103 - RNA, 15 nt, Homo sapiens
auaugauaccaaaga

SEQ ID NO: 636104 - RNA, 23 nt, Homo sapiens
auaugauccagagcagaguuuac

SEQ ID NO: 636105 - RNA, 14 nt, Homo sapiens
auaugaucccuaau

SEQ ID NO: 636106 - RNA, 13 nt, Homo sapiens
auaugauucugcu

SEQ ID NO: 636107 - RNA, 15 nt, Homo sapiens
auaugcaagcagcuu

SEQ ID NO: 636108 - RNA, 21 nt, Homo sapiens
auaugcacaauagcaguugaa

SEQ ID NO: 636109 - RNA, 22 nt, Homo sapiens
auaugcaccccuggaaccagca

SEQ ID NO: 636110 - RNA, 16 nt, Homo sapiens
auaugcagccaaccaa

SEQ ID NO: 636111 - RNA, 18 nt, Homo sapiens
auaugcagccaaccaaga

SEQ ID NO: 636112 - RNA, 14 nt, Homo sapiens
auaugcagugauau

SEQ ID NO: 636113 - RNA, 15 nt, Homo sapiens
auaugcagugauaua

SEQ ID NO: 636114 - RNA, 22 nt, Homo sapiens
accacugguuaaaauaaagccu

SEQ ID NO: 636115 - RNA, 13 nt, Homo sapiens
accacugucucca

SEQ ID NO: 636116 - RNA, 17 nt, Homo sapiens
accagaaaagcaauacu

SEQ ID NO: 636117 - RNA, 15 nt, Homo sapiens
accagaaacaccccu

SEQ ID NO: 636118 - RNA, 19 nt, Homo sapiens
accagaaaccacaagcaaa

SEQ ID NO: 636119 - RNA, 21 nt, Homo sapiens
accagaaaguguguguguucu

SEQ ID NO: 636120 - RNA, 14 nt, Homo sapiens
accagaaauuccag

SEQ ID NO: 636121 - RNA, 17 nt, Homo sapiens
accagaagcauuucacc

SEQ ID NO: 636122 - RNA, 13 nt, Homo sapiens
accagaaguggac

SEQ ID NO: 636123 - RNA, 13 nt, Homo sapiens
accagaauucccu

SEQ ID NO: 636124 - RNA, 16 nt, Homo sapiens
accagaauuguccuca

SEQ ID NO: 636125 - RNA, 14 nt, Homo sapiens
accagaauuucuaa

SEQ ID NO: 636126 - RNA, 13 nt, Homo sapiens
accagacacucac

SEQ ID NO: 636127 - RNA, 15 nt, Homo sapiens
accagacucuugccu

SEQ ID NO: 636128 - RNA, 19 nt, Homo sapiens
accagacuuuugcuuaccu

SEQ ID NO: 636129 - RNA, 13 nt, Homo sapiens
accagagcucaga

SEQ ID NO: 636130 - RNA, 12 nt, Homo sapiens
accagagcucua

SEQ ID NO: 636131 - RNA, 13 nt, Homo sapiens
accagaggacaaa

SEQ ID NO: 636132 - RNA, 11 nt, Homo sapiens
accagaggcag

SEQ ID NO: 636133 - RNA, 17 nt, Homo sapiens
accagaggcugcagaag

SEQ ID NO: 636134 - RNA, 17 nt, Homo sapiens
accagaucugucuccaa

SEQ ID NO: 636135 - RNA, 17 nt, Homo sapiens
accagaugaacauuuca

SEQ ID NO: 636136 - RNA, 13 nt, Homo sapiens
accagauuugcua

SEQ ID NO: 636137 - RNA, 18 nt, Homo sapiens
accagcagcccaagggcu

SEQ ID NO: 636138 - RNA, 17 nt, Homo sapiens
accagcccuacuccugc

SEQ ID NO: 636139 - RNA, 21 nt, Homo sapiens
accagccugguccacugggaa

SEQ ID NO: 636140 - RNA, 13 nt, Homo sapiens
accagccugucac

SEQ ID NO: 636141 - RNA, 16 nt, Homo sapiens
accagccuuguccuaa

SEQ ID NO: 636142 - RNA, 21 nt, Homo sapiens
accagcguuggguuugcucau

SEQ ID NO: 636143 - RNA, 17 nt, Homo sapiens
accagcugggguccugu

SEQ ID NO: 636144 - RNA, 23 nt, Homo sapiens
accagcuucauguggcuucccuu

SEQ ID NO: 636145 - RNA, 15 nt, Homo sapiens
accagcuuugcagug

SEQ ID NO: 636146 - RNA, 20 nt, Homo sapiens
accaggaaagccacacggag

SEQ ID NO: 636147 - RNA, 16 nt, Homo sapiens
accaggacuagggcug

SEQ ID NO: 636148 - RNA, 16 nt, Homo sapiens
accaggacuauagccc

SEQ ID NO: 636149 - RNA, 20 nt, Homo sapiens
accaggacucccuccucacc

SEQ ID NO: 636150 - RNA, 15 nt, Homo sapiens
accaggacugcagcu

SEQ ID NO: 636151 - RNA, 20 nt, Homo sapiens
accaggagagagggcaaagg

SEQ ID NO: 636152 - RNA, 15 nt, Homo sapiens
accaggaggacaaga

SEQ ID NO: 636153 - RNA, 16 nt, Homo sapiens
accaggccaccucccc

SEQ ID NO: 636154 - RNA, 13 nt, Homo sapiens
accaggcuacaag

SEQ ID NO: 636155 - RNA, 14 nt, Homo sapiens
accaggcuuggccu

SEQ ID NO: 636156 - RNA, 16 nt, Homo sapiens
accagggaguggccau

SEQ ID NO: 636157 - RNA, 16 nt, Homo sapiens
accagggcucuucuca

SEQ ID NO: 636158 - RNA, 14 nt, Homo sapiens
accaggguggacca

SEQ ID NO: 636159 - RNA, 20 nt, Homo sapiens
accaggguugaccccagagg

SEQ ID NO: 636160 - RNA, 14 nt, Homo sapiens
accaguacugggaa

SEQ ID NO: 636161 - RNA, 13 nt, Homo sapiens
accagucacuguc

SEQ ID NO: 636162 - RNA, 22 nt, Homo sapiens
accaguccuguuugcagggaag

SEQ ID NO: 636163 - RNA, 18 nt, Homo sapiens
accagucugaaguuucau

SEQ ID NO: 636164 - RNA, 19 nt, Homo sapiens
accagugcaacagcacugg

SEQ ID NO: 636165 - RNA, 20 nt, Homo sapiens
accaguguccccuccacugu

SEQ ID NO: 636166 - RNA, 23 nt, Homo sapiens
accaguguccccuccacugucac

SEQ ID NO: 636167 - RNA, 18 nt, Homo sapiens
accagugugacaucuaca

SEQ ID NO: 636168 - RNA, 21 nt, Homo sapiens
accaguguuauuaaugacaaa

SEQ ID NO: 636169 - RNA, 19 nt, Homo sapiens
accaguguuccugaagcug

SEQ ID NO: 636170 - RNA, 17 nt, Homo sapiens
accaguuaaaagcauuu

SEQ ID NO: 636171 - RNA, 15 nt, Homo sapiens
accaguuaugugaau

SEQ ID NO: 636172 - RNA, 13 nt, Homo sapiens
accauaacagcca

SEQ ID NO: 636173 - RNA, 14 nt, Homo sapiens
accauaacugacaa

SEQ ID NO: 636174 - RNA, 14 nt, Homo sapiens
accauacacacugu

SEQ ID NO: 636175 - RNA, 15 nt, Homo sapiens
accauacacacuguu

SEQ ID NO: 636176 - RNA, 23 nt, Homo sapiens
accauagggcuggggacugggga

SEQ ID NO: 636177 - RNA, 14 nt, Homo sapiens
accauauaaaugaa

SEQ ID NO: 636178 - RNA, 15 nt, Homo sapiens
accauauaccaucuc

SEQ ID NO: 636179 - RNA, 22 nt, Homo sapiens
accauauauugagguucauugg

SEQ ID NO: 636180 - RNA, 23 nt, Homo sapiens
accauauucuaaguuagacucuu

SEQ ID NO: 636181 - RNA, 19 nt, Homo sapiens
accauauugcccagggugg

SEQ ID NO: 636182 - RNA, 14 nt, Homo sapiens
accaucauagcuca

SEQ ID NO: 636183 - RNA, 15 nt, Homo sapiens
accaucauagcucac

SEQ ID NO: 636184 - RNA, 21 nt, Homo sapiens
accauccaccuucccuucuac

SEQ ID NO: 636185 - RNA, 14 nt, Homo sapiens
accauccuguauuc

SEQ ID NO: 636186 - RNA, 16 nt, Homo sapiens
accaucucacaccagu

SEQ ID NO: 636187 - RNA, 14 nt, Homo sapiens
acccccagcacuug

SEQ ID NO: 636188 - RNA, 15 nt, Homo sapiens
acccccagcucaaug

SEQ ID NO: 636189 - RNA, 15 nt, Homo sapiens
acccccaguuccuau

SEQ ID NO: 636190 - RNA, 15 nt, Homo sapiens
accccccuaccacac

SEQ ID NO: 636191 - RNA, 18 nt, Homo sapiens
accccccuauugcugcug

SEQ ID NO: 636192 - RNA, 17 nt, Homo sapiens
acccccgccacggccac

SEQ ID NO: 636193 - RNA, 13 nt, Homo sapiens
acccccugcccug

SEQ ID NO: 636194 - RNA, 15 nt, Homo sapiens
accccgagacuacca

SEQ ID NO: 636195 - RNA, 18 nt, Homo sapiens
accccgagggcugaggag

SEQ ID NO: 636196 - RNA, 22 nt, Homo sapiens
accccggggccucccccgugac

SEQ ID NO: 636197 - RNA, 14 nt, Homo sapiens
accccguguucaaa

SEQ ID NO: 636198 - RNA, 15 nt, Homo sapiens
accccuacucacaua

SEQ ID NO: 636199 - RNA, 19 nt, Homo sapiens
accccucaaacugcacauc

SEQ ID NO: 636200 - RNA, 16 nt, Homo sapiens
accccucagcaaauac

SEQ ID NO: 636201 - RNA, 23 nt, Homo sapiens
accccucaguuaauugcagucua

SEQ ID NO: 636202 - RNA, 14 nt, Homo sapiens
accccuccaggaau

SEQ ID NO: 636203 - RNA, 20 nt, Homo sapiens
accccucccacggugcccaa

SEQ ID NO: 636204 - RNA, 23 nt, Homo sapiens
accccuccggacauccagcguga

SEQ ID NO: 636205 - RNA, 18 nt, Homo sapiens
accccucucugcaucuga

SEQ ID NO: 636206 - RNA, 16 nt, Homo sapiens
accccucuuccagcuu

SEQ ID NO: 636207 - RNA, 18 nt, Homo sapiens
accccucuucugcuccuu

SEQ ID NO: 636208 - RNA, 14 nt, Homo sapiens
accccugacucauc

SEQ ID NO: 636209 - RNA, 14 nt, Homo sapiens
accccugcacaguu

SEQ ID NO: 636210 - RNA, 14 nt, Homo sapiens
accccugcacuacu

SEQ ID NO: 636211 - RNA, 19 nt, Homo sapiens
accccugccuuuucauugc

SEQ ID NO: 636212 - RNA, 15 nt, Homo sapiens
accccugcuaaggag

SEQ ID NO: 636213 - RNA, 22 nt, Homo sapiens
accccugcucaguaaagcacuu

SEQ ID NO: 636214 - RNA, 17 nt, Homo sapiens
accccuuacacaaaugu

SEQ ID NO: 636215 - RNA, 14 nt, Homo sapiens
accccuuagccucc

SEQ ID NO: 636216 - RNA, 20 nt, Homo sapiens
accccuucgacaugcugcca

SEQ ID NO: 636217 - RNA, 17 nt, Homo sapiens
accccuuucuaguucaa

SEQ ID NO: 636218 - RNA, 13 nt, Homo sapiens
accccuuugcacu

SEQ ID NO: 636219 - RNA, 14 nt, Homo sapiens
accccuuugcccuu

SEQ ID NO: 636220 - RNA, 17 nt, Homo sapiens
accccuuuuugccuuac

SEQ ID NO: 636221 - RNA, 18 nt, Homo sapiens
acccgacugaaacuggaa

SEQ ID NO: 636222 - RNA, 15 nt, Homo sapiens
acccgaggcugagaa

SEQ ID NO: 636223 - RNA, 22 nt, Homo sapiens
acccgagggacagcagauucca

SEQ ID NO: 636224 - RNA, 15 nt, Homo sapiens
acccgaguaccucca

SEQ ID NO: 636225 - RNA, 17 nt, Homo sapiens
acccgccgccucccacg

SEQ ID NO: 636226 - RNA, 13 nt, Homo sapiens
acccgccugcucc

SEQ ID NO: 636227 - RNA, 15 nt, Homo sapiens
acccggacagguggg

SEQ ID NO: 636228 - RNA, 14 nt, Homo sapiens
acccguagaugcca

SEQ ID NO: 636229 - RNA, 12 nt, Homo sapiens
acccguccuccc

SEQ ID NO: 636230 - RNA, 15 nt, Homo sapiens
acccuaaacauccau

SEQ ID NO: 636231 - RNA, 13 nt, Homo sapiens
acccuaaagggag

SEQ ID NO: 636232 - RNA, 16 nt, Homo sapiens
acccuaaaucuugacu

SEQ ID NO: 636233 - RNA, 15 nt, Homo sapiens
acccuaagaugaagc

SEQ ID NO: 636234 - RNA, 15 nt, Homo sapiens
acccuaccagcuccu

SEQ ID NO: 636235 - RNA, 13 nt, Homo sapiens
acccuacucugga

SEQ ID NO: 636236 - RNA, 13 nt, Homo sapiens
acccuagucccuu

SEQ ID NO: 636237 - RNA, 20 nt, Homo sapiens
acccuaguuucccugaagga

SEQ ID NO: 636238 - RNA, 14 nt, Homo sapiens
acccucaaauguca

SEQ ID NO: 636239 - RNA, 15 nt, Homo sapiens
acccucaaaugucag

SEQ ID NO: 636240 - RNA, 13 nt, Homo sapiens
acccucacauggg

SEQ ID NO: 636241 - RNA, 18 nt, Homo sapiens
aucaagaagggcugcaug

SEQ ID NO: 636242 - RNA, 15 nt, Homo sapiens
aucaagagaaucaac

SEQ ID NO: 636243 - RNA, 14 nt, Homo sapiens
aucaagagggauaa

SEQ ID NO: 636244 - RNA, 17 nt, Homo sapiens
aucaaguccuuuaauua

SEQ ID NO: 636245 - RNA, 14 nt, Homo sapiens
aucaagugucuucc

SEQ ID NO: 636246 - RNA, 15 nt, Homo sapiens
aucaagugucuucca

SEQ ID NO: 636247 - RNA, 21 nt, Homo sapiens
aucaaguuugaccagugcagu

SEQ ID NO: 636248 - RNA, 22 nt, Homo sapiens
aucaaguuugaccagugcaguu

SEQ ID NO: 636249 - RNA, 13 nt, Homo sapiens
aucaauacagcuu

SEQ ID NO: 636250 - RNA, 19 nt, Homo sapiens
aucaauagaaggauguaca

SEQ ID NO: 636251 - RNA, 17 nt, Homo sapiens
aucaauauacauaauac

SEQ ID NO: 636252 - RNA, 22 nt, Homo sapiens
aucaauauuuuuauaucaugca

SEQ ID NO: 636253 - RNA, 24 nt, Homo sapiens
aucaauauuuuuauaucaugcaaa

SEQ ID NO: 636254 - RNA, 16 nt, Homo sapiens
aucaaugcaagaguga

SEQ ID NO: 636255 - RNA, 22 nt, Homo sapiens
aucaaugcaagagugauugcag

SEQ ID NO: 636256 - RNA, 20 nt, Homo sapiens
aucaauggagcaugugugca

SEQ ID NO: 636257 - RNA, 21 nt, Homo sapiens
aucaauggagcaugugugcaa

SEQ ID NO: 636258 - RNA, 15 nt, Homo sapiens
aucaauguaauguca

SEQ ID NO: 636259 - RNA, 15 nt, Homo sapiens
aucaaugucaaguac

SEQ ID NO: 636260 - RNA, 15 nt, Homo sapiens
aucaauucccuugaa

SEQ ID NO: 636261 - RNA, 21 nt, Homo sapiens
aucaauucuauuacgugcaau

SEQ ID NO: 636262 - RNA, 13 nt, Homo sapiens
aucaauucuuaga

SEQ ID NO: 636263 - RNA, 21 nt, Homo sapiens
aucaauucuuagaauaucuaa

SEQ ID NO: 636264 - RNA, 19 nt, Homo sapiens
aucaauuggcagugacuuu

SEQ ID NO: 636265 - RNA, 12 nt, Homo sapiens
aucacaaaaaca

SEQ ID NO: 636266 - RNA, 12 nt, Homo sapiens
aucacaacaaac

SEQ ID NO: 636267 - RNA, 16 nt, Homo sapiens
aucacaacauuccuca

SEQ ID NO: 636268 - RNA, 19 nt, Homo sapiens
aucacaacauuuacuuaac

SEQ ID NO: 636269 - RNA, 22 nt, Homo sapiens
aucacaauuuacgaaaccaaaa

SEQ ID NO: 636270 - RNA, 12 nt, Homo sapiens
aucacacagugu

SEQ ID NO: 636271 - RNA, 23 nt, Homo sapiens
aucacaccguccuccacgccauu

SEQ ID NO: 636272 - RNA, 11 nt, Homo sapiens
aucacaccuca

SEQ ID NO: 636273 - RNA, 16 nt, Homo sapiens
aucacaccucugggcu

SEQ ID NO: 636274 - RNA, 16 nt, Homo sapiens
aucacagcagugcaua

SEQ ID NO: 636275 - RNA, 13 nt, Homo sapiens
aucacagcucacu

SEQ ID NO: 636276 - RNA, 22 nt, Homo sapiens
aucacagcucccuagguaggca

SEQ ID NO: 636277 - RNA, 19 nt, Homo sapiens
aucacaggagcaaucacag

SEQ ID NO: 636278 - RNA, 16 nt, Homo sapiens
aucacaguguuuuuau

SEQ ID NO: 636279 - RNA, 20 nt, Homo sapiens
aucacauaauuccagucaca

SEQ ID NO: 636280 - RNA, 19 nt, Homo sapiens
aucacauaugcuuacucuu

SEQ ID NO: 636281 - RNA, 16 nt, Homo sapiens
aucacaucacuaccua

SEQ ID NO: 636282 - RNA, 23 nt, Homo sapiens
aucacaugaauauaaaugggaaa

SEQ ID NO: 636283 - RNA, 15 nt, Homo sapiens
aucacaugugcugca

SEQ ID NO: 636284 - RNA, 18 nt, Homo sapiens
aucacauuaucaucugaa

SEQ ID NO: 636285 - RNA, 21 nt, Homo sapiens
aucacauuauuugcauguuac

SEQ ID NO: 636286 - RNA, 17 nt, Homo sapiens
aucacauuccucugccc

SEQ ID NO: 636287 - RNA, 21 nt, Homo sapiens
aucacauucuguuuaucaagc

SEQ ID NO: 636288 - RNA, 18 nt, Homo sapiens
aucaccaaggagccaaac

SEQ ID NO: 636289 - RNA, 22 nt, Homo sapiens
aucaccaaucauaguguaccca

SEQ ID NO: 636290 - RNA, 21 nt, Homo sapiens
aucaccccaaacaacucagcu

SEQ ID NO: 636291 - RNA, 14 nt, Homo sapiens
aucacccucuuccu

SEQ ID NO: 636292 - RNA, 15 nt, Homo sapiens
aucaccucucuucag

SEQ ID NO: 636293 - RNA, 22 nt, Homo sapiens
aucaccucugauggcugaagaa

SEQ ID NO: 636294 - RNA, 17 nt, Homo sapiens
aucaccugaaacacugg

SEQ ID NO: 636295 - RNA, 20 nt, Homo sapiens
aucaccugccaaaugaauaa

SEQ ID NO: 636296 - RNA, 21 nt, Homo sapiens
aucacgacagauuuaaccucu

SEQ ID NO: 636297 - RNA, 17 nt, Homo sapiens
aucacgcagaucacuaa

SEQ ID NO: 636298 - RNA, 20 nt, Homo sapiens
aucacgucagugcucagaaa

SEQ ID NO: 636299 - RNA, 19 nt, Homo sapiens
aucacuaagggauggggca

SEQ ID NO: 636300 - RNA, 15 nt, Homo sapiens
aucacuaaugcucaa

SEQ ID NO: 636301 - RNA, 21 nt, Homo sapiens
aucacuagaagaaaagcccau

SEQ ID NO: 636302 - RNA, 17 nt, Homo sapiens
aucacuagccaugauaa

SEQ ID NO: 636303 - RNA, 23 nt, Homo sapiens
aucacucaagaugccuccuguca

SEQ ID NO: 636304 - RNA, 13 nt, Homo sapiens
aucacuccagugc

SEQ ID NO: 636305 - RNA, 17 nt, Homo sapiens
aucacucuaauucggau

SEQ ID NO: 636306 - RNA, 17 nt, Homo sapiens
aucacucucaccuucca

SEQ ID NO: 636307 - RNA, 16 nt, Homo sapiens
aucacugccacacucu

SEQ ID NO: 636308 - RNA, 20 nt, Homo sapiens
aucacugccacacucuccau

SEQ ID NO: 636309 - RNA, 18 nt, Homo sapiens
aaagcagaaugugauauc

SEQ ID NO: 636310 - RNA, 22 nt, Homo sapiens
aaagcagacagcuccacccugg

SEQ ID NO: 636311 - RNA, 22 nt, Homo sapiens
aaagcagaguggacugcauuua

SEQ ID NO: 636312 - RNA, 12 nt, Homo sapiens
aaagcagcaucu

SEQ ID NO: 636313 - RNA, 16 nt, Homo sapiens
aaagcagccacgaggu

SEQ ID NO: 636314 - RNA, 15 nt, Homo sapiens
aaagcagccugugaa

SEQ ID NO: 636315 - RNA, 17 nt, Homo sapiens
aaagcagcucaagaaca

SEQ ID NO: 636316 - RNA, 18 nt, Homo sapiens
aaagcaggggaguaugca

SEQ ID NO: 636317 - RNA, 19 nt, Homo sapiens
aaagcagguggcaucucua

SEQ ID NO: 636318 - RNA, 19 nt, Homo sapiens
aaagcaguggacaccagga

SEQ ID NO: 636319 - RNA, 10 nt, Homo sapiens
aaagcagugu

SEQ ID NO: 636320 - RNA, 19 nt, Homo sapiens
aaagcaguuacuaauaugc

SEQ ID NO: 636321 - RNA, 21 nt, Homo sapiens
aaagcauauuggugcuagaaa

SEQ ID NO: 636322 - RNA, 15 nt, Homo sapiens
aaagcauccaugugu

SEQ ID NO: 636323 - RNA, 12 nt, Homo sapiens
aaagcaugugcu

SEQ ID NO: 636324 - RNA, 23 nt, Homo sapiens
aaagcauuuuguaauaauaaaga

SEQ ID NO: 636325 - RNA, 20 nt, Homo sapiens
aaagcauuuuuuaaaagcau

SEQ ID NO: 636326 - RNA, 14 nt, Homo sapiens
aaagugugagcaaa

SEQ ID NO: 636327 - RNA, 12 nt, Homo sapiens
aaaguguguauu

SEQ ID NO: 636328 - RNA, 19 nt, Homo sapiens
aaaguguguuucuauguga

SEQ ID NO: 636329 - RNA, 15 nt, Homo sapiens
aaaguguuuucacaa

SEQ ID NO: 636330 - RNA, 16 nt, Homo sapiens
aaaguuacuacugauu

SEQ ID NO: 636331 - RNA, 20 nt, Homo sapiens
aaaguuacuagguaacuuca

SEQ ID NO: 636332 - RNA, 15 nt, Homo sapiens
aaaguucaauacucu

SEQ ID NO: 636333 - RNA, 13 nt, Homo sapiens
aaaguuccagaaa

SEQ ID NO: 636334 - RNA, 22 nt, Homo sapiens
aaaguuccaugaauucuugauu

SEQ ID NO: 636335 - RNA, 13 nt, Homo sapiens
aaaguuccuguca

SEQ ID NO: 636336 - RNA, 20 nt, Homo sapiens
aaaguugagggaaagagcuu

SEQ ID NO: 636337 - RNA, 16 nt, Homo sapiens
aaaguugcagauguau

SEQ ID NO: 636338 - RNA, 17 nt, Homo sapiens
aaaguuggggacaugcu

SEQ ID NO: 636339 - RNA, 21 nt, Homo sapiens
aaaguuuaacaaaugacugua

SEQ ID NO: 636340 - RNA, 14 nt, Homo sapiens
aaaguuucagagaa

SEQ ID NO: 636341 - RNA, 23 nt, Homo sapiens
aaaguuuuauaacuuguguuauu

SEQ ID NO: 636342 - RNA, 18 nt, Homo sapiens
aaaguuuuccaguauuga

SEQ ID NO: 636343 - RNA, 21 nt, Homo sapiens
aaaguuuuuuauuaugcauua

SEQ ID NO: 636344 - RNA, 19 nt, Homo sapiens
aaauaaaaaacauauacaa

SEQ ID NO: 636345 - RNA, 22 nt, Homo sapiens
aaauaaaaagugacacagcagc

SEQ ID NO: 636346 - RNA, 20 nt, Homo sapiens
aaauaaaaaucucuuuucca

SEQ ID NO: 636347 - RNA, 17 nt, Homo sapiens
aaauaaaaugcagacag

SEQ ID NO: 636348 - RNA, 13 nt, Homo sapiens
aaauaaaauguuc

SEQ ID NO: 636349 - RNA, 22 nt, Homo sapiens
aaauaaaauuuuccuuggcaau

SEQ ID NO: 636350 - RNA, 14 nt, Homo sapiens
aaauaaacaugacc

SEQ ID NO: 636351 - RNA, 17 nt, Homo sapiens
aaauaaagauauuguuc

SEQ ID NO: 636352 - RNA, 13 nt, Homo sapiens
aaauaaaguacca

SEQ ID NO: 636353 - RNA, 24 nt, Homo sapiens
aaauaaaguaccacacauauugca

SEQ ID NO: 636354 - RNA, 16 nt, Homo sapiens
aaauaaauacguguca

SEQ ID NO: 636355 - RNA, 12 nt, Homo sapiens
aaauaaauucaa

SEQ ID NO: 636356 - RNA, 17 nt, Homo sapiens
aaauaagagcagucaca

SEQ ID NO: 636357 - RNA, 14 nt, Homo sapiens
aaauaaguuauaca

SEQ ID NO: 636358 - RNA, 19 nt, Homo sapiens
aaauaauaaacaguggaau

SEQ ID NO: 636359 - RNA, 16 nt, Homo sapiens
aaauaauaaaucuggu

SEQ ID NO: 636360 - RNA, 19 nt, Homo sapiens
aaauaauaacaaucacaaa

SEQ ID NO: 636361 - RNA, 14 nt, Homo sapiens
aaauaaucacagau

SEQ ID NO: 636362 - RNA, 16 nt, Homo sapiens
aaauaauucuuccucu

SEQ ID NO: 636363 - RNA, 15 nt, Homo sapiens
aaauacaaaaagcaa

SEQ ID NO: 636364 - RNA, 14 nt, Homo sapiens
aaauacaacacuga

SEQ ID NO: 636365 - RNA, 18 nt, Homo sapiens
aaauacagacuggaugua

SEQ ID NO: 636366 - RNA, 15 nt, Homo sapiens
aaauacagcuaugaa

SEQ ID NO: 636367 - RNA, 19 nt, Homo sapiens
aaauacagucuuccacaaa

SEQ ID NO: 636368 - RNA, 16 nt, Homo sapiens
aaauacauacggucag

SEQ ID NO: 636369 - RNA, 13 nt, Homo sapiens
aaauacaugcaca

SEQ ID NO: 636370 - RNA, 17 nt, Homo sapiens
aaauacauguaccuaua

SEQ ID NO: 636371 - RNA, 14 nt, Homo sapiens
aaauaccagugaac

SEQ ID NO: 636372 - RNA, 17 nt, Homo sapiens
aaauaccagugaaccaa

SEQ ID NO: 636373 - RNA, 19 nt, Homo sapiens
aaauacccacuaacaaaga

SEQ ID NO: 636374 - RNA, 18 nt, Homo sapiens
aaauaccuuggcugaugu

SEQ ID NO: 636375 - RNA, 22 nt, Homo sapiens
aaauacgaaguggagauuuaca

SEQ ID NO: 636376 - RNA, 20 nt, Homo sapiens
aaauacgguaaggauacuuu

SEQ ID NO: 636377 - RNA, 11 nt, Homo sapiens
aaauacucuga

SEQ ID NO: 636378 - RNA, 12 nt, Homo sapiens
aaauacugucaa

SEQ ID NO: 636379 - RNA, 22 nt, Homo sapiens
aaauacugugcagaauaaugga

SEQ ID NO: 636380 - RNA, 18 nt, Homo sapiens
aaauagaaagaagccaua

SEQ ID NO: 636381 - RNA, 17 nt, Homo sapiens
aaauagaaccacuauga

SEQ ID NO: 636382 - RNA, 21 nt, Homo sapiens
aaauagaagaguuuaaaagca

SEQ ID NO: 636383 - RNA, 15 nt, Homo sapiens
aaauagagaauccca

SEQ ID NO: 636384 - RNA, 22 nt, Homo sapiens
aaauagaugugucuuaacauaa

SEQ ID NO: 636385 - RNA, 19 nt, Homo sapiens
aaauagcuauauccaugua

SEQ ID NO: 636386 - RNA, 16 nt, Homo sapiens
aaauaguaaacauuaa

SEQ ID NO: 636387 - RNA, 14 nt, Homo sapiens
aaauagucuaucaa

SEQ ID NO: 636388 - RNA, 17 nt, Homo sapiens
aaauagucuuccacaaa

SEQ ID NO: 636389 - RNA, 14 nt, Homo sapiens
aaauagucuucuca

SEQ ID NO: 636390 - RNA, 22 nt, Homo sapiens
aaauagugacaagugaagaaca

SEQ ID NO: 636391 - RNA, 23 nt, Homo sapiens
aaauaguguucccagagcacuuu

SEQ ID NO: 636392 - RNA, 16 nt, Homo sapiens
aaauaguugcauagca

SEQ ID NO: 636393 - RNA, 22 nt, Homo sapiens
aaauauaaguggugcuuagaaa

SEQ ID NO: 636394 - RNA, 17 nt, Homo sapiens
aaauauaauaugcacac

SEQ ID NO: 636395 - RNA, 23 nt, Homo sapiens
aaauauaauucuuaguggaagac

SEQ ID NO: 636396 - RNA, 14 nt, Homo sapiens
aaauauaauugaca

SEQ ID NO: 636397 - RNA, 18 nt, Homo sapiens
aaauauaauuuacauuaa

SEQ ID NO: 636398 - RNA, 22 nt, Homo sapiens
aaauauacuuuuacaaguaaca

SEQ ID NO: 636399 - RNA, 13 nt, Homo sapiens
aaauauagccaaa

SEQ ID NO: 636400 - RNA, 22 nt, Homo sapiens
aaauauagcuaauaacauguga

SEQ ID NO: 636401 - RNA, 17 nt, Homo sapiens
aaauauauagcuugaaa

SEQ ID NO: 636402 - RNA, 16 nt, Homo sapiens
aaauauauaugucaau

SEQ ID NO: 636403 - RNA, 14 nt, Homo sapiens
aaauauauaugugu

SEQ ID NO: 636404 - RNA, 19 nt, Homo sapiens
aaauauaugucuauauaca

SEQ ID NO: 636405 - RNA, 14 nt, Homo sapiens
aaauauauuauuca

SEQ ID NO: 636406 - RNA, 18 nt, Homo sapiens
aaauaucaaagucauuaa

SEQ ID NO: 636407 - RNA, 15 nt, Homo sapiens
aaauaucaugcacaa

SEQ ID NO: 636408 - RNA, 18 nt, Homo sapiens
aaauauccuccaaugugu

SEQ ID NO: 636409 - RNA, 12 nt, Homo sapiens
aaauaucuuccu

SEQ ID NO: 636410 - RNA, 17 nt, Homo sapiens
aaauaugaagacauaaa

SEQ ID NO: 636411 - RNA, 22 nt, Homo sapiens
aaauaugagaugcguuguuaca

SEQ ID NO: 636412 - RNA, 23 nt, Homo sapiens
aaauaugagccgguuauuacuuc

SEQ ID NO: 636413 - RNA, 19 nt, Homo sapiens
aaauauggacugcucagga

SEQ ID NO: 636414 - RNA, 14 nt, Homo sapiens
aaauauguccuggg

SEQ ID NO: 636415 - RNA, 19 nt, Homo sapiens
aaauauguugaguguucau

SEQ ID NO: 636416 - RNA, 20 nt, Homo sapiens
aaauauguuucacacaaaca

SEQ ID NO: 636417 - RNA, 22 nt, Homo sapiens
aaauauuaccaggucaguacua

SEQ ID NO: 636418 - RNA, 12 nt, Homo sapiens
aaauauuauuca

SEQ ID NO: 636419 - RNA, 16 nt, Homo sapiens
aaauauuauugguguu

SEQ ID NO: 636420 - RNA, 22 nt, Homo sapiens
aaauauuauugguguuuaccca

SEQ ID NO: 636421 - RNA, 20 nt, Homo sapiens
aaauauucuacacauguaaa

SEQ ID NO: 636422 - RNA, 17 nt, Homo sapiens
aaauauugcuucaauaa

SEQ ID NO: 636423 - RNA, 22 nt, Homo sapiens
aaauauuguauaaagcauuugu

SEQ ID NO: 636424 - RNA, 23 nt, Homo sapiens
aaauauuguugacaacugugacu

SEQ ID NO: 636425 - RNA, 23 nt, Homo sapiens
aaauauuuaugagaaaguucuca

SEQ ID NO: 636426 - RNA, 17 nt, Homo sapiens
aaauauuuaugcuuaaa

SEQ ID NO: 636427 - RNA, 15 nt, Homo sapiens
aaauauuuccaucag

SEQ ID NO: 636428 - RNA, 23 nt, Homo sapiens
aaauauuucccauuugugccaga

SEQ ID NO: 636429 - RNA, 20 nt, Homo sapiens
aaaucaaaagggccaaagaa

SEQ ID NO: 636430 - RNA, 13 nt, Homo sapiens
aaaucaacaugac

SEQ ID NO: 636431 - RNA, 13 nt, Homo sapiens
aaaucaacugaau

SEQ ID NO: 636432 - RNA, 13 nt, Homo sapiens
aaaucaagagcuu

SEQ ID NO: 636433 - RNA, 20 nt, Homo sapiens
aaacuauuuaaaauuggcac

SEQ ID NO: 636434 - RNA, 15 nt, Homo sapiens
aaacuauuugggaua

SEQ ID NO: 636435 - RNA, 17 nt, Homo sapiens
aaacuauuuuauguuca

SEQ ID NO: 636436 - RNA, 17 nt, Homo sapiens
aaacucaccuugucuca

SEQ ID NO: 636437 - RNA, 13 nt, Homo sapiens
aaacuccaucucu

SEQ ID NO: 636438 - RNA, 14 nt, Homo sapiens
aaacuccuacuaaa

SEQ ID NO: 636439 - RNA, 18 nt, Homo sapiens
aaacucuacuuaauccaa

SEQ ID NO: 636440 - RNA, 22 nt, Homo sapiens
aaacucuaucagcauuguuuca

SEQ ID NO: 636441 - RNA, 22 nt, Homo sapiens
aaacucugcauccagagauuca

SEQ ID NO: 636442 - RNA, 13 nt, Homo sapiens
aaacucuggggcu

SEQ ID NO: 636443 - RNA, 17 nt, Homo sapiens
aaacucuucagugcaaa

SEQ ID NO: 636444 - RNA, 22 nt, Homo sapiens
aaacucuuucauucuucucaca

SEQ ID NO: 636445 - RNA, 23 nt, Homo sapiens
aaacucuuucauucuucucacau

SEQ ID NO: 636446 - RNA, 17 nt, Homo sapiens
aaacugaaaaucuaaua

SEQ ID NO: 636447 - RNA, 21 nt, Homo sapiens
aaacugacaguaaaucucaca

SEQ ID NO: 636448 - RNA, 18 nt, Homo sapiens
aaacugacuaaacuuaca

SEQ ID NO: 636449 - RNA, 19 nt, Homo sapiens
aaacugauuuuuagcuuua

SEQ ID NO: 636450 - RNA, 23 nt, Homo sapiens
aaacugcaauagagacuguagau

SEQ ID NO: 636451 - RNA, 20 nt, Homo sapiens
aaacugcagccucucuggcu

SEQ ID NO: 636452 - RNA, 22 nt, Homo sapiens
ucuccuguuuguugagugcacu

SEQ ID NO: 636453 - RNA, 17 nt, Homo sapiens
ucuccuuaccucuggaa

SEQ ID NO: 636454 - RNA, 18 nt, Homo sapiens
ucuccuuccacaaugacu

SEQ ID NO: 636455 - RNA, 14 nt, Homo sapiens
ucuccuuccagggc

SEQ ID NO: 636456 - RNA, 11 nt, Homo sapiens
ucuccuuccau

SEQ ID NO: 636457 - RNA, 18 nt, Homo sapiens
ucuccuuugcacugaggg

SEQ ID NO: 636458 - RNA, 18 nt, Homo sapiens
ucuccuuuggccauucca

SEQ ID NO: 636459 - RNA, 15 nt, Homo sapiens
ucuccuuuugaccaa

SEQ ID NO: 636460 - RNA, 14 nt, Homo sapiens
ucucgaaaaaagag

SEQ ID NO: 636461 - RNA, 14 nt, Homo sapiens
ucucgaacaguauu

SEQ ID NO: 636462 - RNA, 15 nt, Homo sapiens
ucucgacaguaucca

SEQ ID NO: 636463 - RNA, 17 nt, Homo sapiens
ucucgaucucuugaccu

SEQ ID NO: 636464 - RNA, 14 nt, Homo sapiens
ucucgcacaaugca

SEQ ID NO: 636465 - RNA, 22 nt, Homo sapiens
ucucggagcccucagacaucuc

SEQ ID NO: 636466 - RNA, 15 nt, Homo sapiens
ucucgggcacaggcc

SEQ ID NO: 636467 - RNA, 14 nt, Homo sapiens
ucucuaacauuucc

SEQ ID NO: 636468 - RNA, 10 nt, Homo sapiens
ucucuaauaa

SEQ ID NO: 636469 - RNA, 15 nt, Homo sapiens
ucucuacagacucca

SEQ ID NO: 636470 - RNA, 20 nt, Homo sapiens
ucucuacccggcccagagac

SEQ ID NO: 636471 - RNA, 14 nt, Homo sapiens
ucucuagugcugug

SEQ ID NO: 636472 - RNA, 11 nt, Homo sapiens
ucucuaguucc

SEQ ID NO: 636473 - RNA, 18 nt, Homo sapiens
ucucuauucucugcaauu

SEQ ID NO: 636474 - RNA, 12 nt, Homo sapiens
ucucucagaaau

SEQ ID NO: 636475 - RNA, 18 nt, Homo sapiens
ucucucagacuuacuuua

SEQ ID NO: 636476 - RNA, 16 nt, Homo sapiens
ucucucaguucuacac

SEQ ID NO: 636477 - RNA, 17 nt, Homo sapiens
ucucuccagcugacuaa

SEQ ID NO: 636478 - RNA, 23 nt, Homo sapiens
ucucuccugugugcuugucagug

SEQ ID NO: 636479 - RNA, 20 nt, Homo sapiens
ucucucggcuccccaugugu

SEQ ID NO: 636480 - RNA, 15 nt, Homo sapiens
ucucucuaccuccac

SEQ ID NO: 636481 - RNA, 14 nt, Homo sapiens
ucucucuccagggu

SEQ ID NO: 636482 - RNA, 16 nt, Homo sapiens
ucucucucucuacaaa

SEQ ID NO: 636483 - RNA, 13 nt, Homo sapiens
ucucucuggcuuc

SEQ ID NO: 636484 - RNA, 11 nt, Homo sapiens
ucucucugugg

SEQ ID NO: 636485 - RNA, 23 nt, Homo sapiens
ucucugaagaugaucauuugccc

SEQ ID NO: 636486 - RNA, 23 nt, Homo sapiens
ucucugauuccccaaaucugcau

SEQ ID NO: 636487 - RNA, 20 nt, Homo sapiens
ucucugcagaaacuacugac

SEQ ID NO: 636488 - RNA, 17 nt, Homo sapiens
ucucugcauccauuuga

SEQ ID NO: 636489 - RNA, 12 nt, Homo sapiens
ucucugccagug

SEQ ID NO: 636490 - RNA, 15 nt, Homo sapiens
ucucugccagugaca

SEQ ID NO: 636491 - RNA, 16 nt, Homo sapiens
ucucugccgcaauaca

SEQ ID NO: 636492 - RNA, 17 nt, Homo sapiens
ucucuggagguacugag

SEQ ID NO: 636493 - RNA, 17 nt, Homo sapiens
ucucuggcuggucuuca

SEQ ID NO: 636494 - RNA, 11 nt, Homo sapiens
ucucugggcug

SEQ ID NO: 636495 - RNA, 12 nt, Homo sapiens
ucucuguacuuu

SEQ ID NO: 636496 - RNA, 19 nt, Homo sapiens
ucucugucccuugcuguau

SEQ ID NO: 636497 - RNA, 11 nt, Homo sapiens
ucucugugaag

SEQ ID NO: 636498 - RNA, 12 nt, Homo sapiens
ucucugugaauu

SEQ ID NO: 636499 - RNA, 14 nt, Homo sapiens
ucucugugccuucg

SEQ ID NO: 636500 - RNA, 11 nt, Homo sapiens
ucucugugcuc

SEQ ID NO: 636501 - RNA, 19 nt, Homo sapiens
ucucuuaaucacuacugua

SEQ ID NO: 636502 - RNA, 21 nt, Homo sapiens
ucucuuacaaaagcuuugaau

SEQ ID NO: 636503 - RNA, 23 nt, Homo sapiens
ucucuuagaagccaugggaccuc

SEQ ID NO: 636504 - RNA, 14 nt, Homo sapiens
ucucuucaaucucu

SEQ ID NO: 636505 - RNA, 23 nt, Homo sapiens
ucucuucauuauucucugcuaua

SEQ ID NO: 636506 - RNA, 15 nt, Homo sapiens
ucucuucccagugaa

SEQ ID NO: 636507 - RNA, 13 nt, Homo sapiens
ucucuuccccaga

SEQ ID NO: 636508 - RNA, 23 nt, Homo sapiens
ucucuucccugcgccugugaugc

SEQ ID NO: 636509 - RNA, 22 nt, Homo sapiens
ucucuuccugccccucuuucuc

SEQ ID NO: 636510 - RNA, 23 nt, Homo sapiens
ucucuuccuguuuuguacauaga

SEQ ID NO: 636511 - RNA, 22 nt, Homo sapiens
ucucuucguacucgguuauuaa

SEQ ID NO: 636512 - RNA, 13 nt, Homo sapiens
ucucuucugccuu

SEQ ID NO: 636513 - RNA, 18 nt, Homo sapiens
ucucuucugccuuuauga

SEQ ID NO: 636514 - RNA, 12 nt, Homo sapiens
ucucuucugugu

SEQ ID NO: 636515 - RNA, 20 nt, Homo sapiens
ucucuugaccucgugaucca

SEQ ID NO: 636516 - RNA, 18 nt, Homo sapiens
ucucuugcacucaaagcu

SEQ ID NO: 636517 - RNA, 15 nt, Homo sapiens
ucucuugcugccaca

SEQ ID NO: 636518 - RNA, 20 nt, Homo sapiens
ucucuuuaaguuuugauuaa

SEQ ID NO: 636519 - RNA, 20 nt, Homo sapiens
ucucuuuacuucccaguaua

SEQ ID NO: 636520 - RNA, 21 nt, Homo sapiens
ucucuuucuagaggugcuaca

SEQ ID NO: 636521 - RNA, 21 nt, Homo sapiens
ucucuuuggcuggaauuacaa

SEQ ID NO: 636522 - RNA, 12 nt, Homo sapiens
ucucuuuggucu

SEQ ID NO: 636523 - RNA, 22 nt, Homo sapiens
ucucuuuugagcuaaucuucau

SEQ ID NO: 636524 - RNA, 20 nt, Homo sapiens
ucugaaaaacauuccaggaa

SEQ ID NO: 636525 - RNA, 20 nt, Homo sapiens
ucugaaaaauuuguaguuua

SEQ ID NO: 636526 - RNA, 17 nt, Homo sapiens
ucugaaacccuugagcu

SEQ ID NO: 636527 - RNA, 21 nt, Homo sapiens
ucugaaagagaaaucaaugaa

SEQ ID NO: 636528 - RNA, 20 nt, Homo sapiens
ucugaaagauaagaaucacu

SEQ ID NO: 636529 - RNA, 23 nt, Homo sapiens
ucugaaaggauguggaagagcau

SEQ ID NO: 636530 - RNA, 22 nt, Homo sapiens
ucugaaaugcuugaaaccagaa

SEQ ID NO: 636531 - RNA, 17 nt, Homo sapiens
ucugaacaaacacugaa

SEQ ID NO: 636532 - RNA, 15 nt, Homo sapiens
ucugaacauucuccu

SEQ ID NO: 636533 - RNA, 12 nt, Homo sapiens
ucugaacuucca

SEQ ID NO: 636534 - RNA, 13 nt, Homo sapiens
ucugaacuuccaa

SEQ ID NO: 636535 - RNA, 18 nt, Homo sapiens
ucugaagaaacuucccaa

SEQ ID NO: 636536 - RNA, 20 nt, Homo sapiens
ucugaaggaagagaagacau

SEQ ID NO: 636537 - RNA, 22 nt, Homo sapiens
ucugaaggacacuuccugccua

SEQ ID NO: 636538 - RNA, 13 nt, Homo sapiens
ucugaagugcucu

SEQ ID NO: 636539 - RNA, 20 nt, Homo sapiens
ucugaauaaaguguaacaau

SEQ ID NO: 636540 - RNA, 17 nt, Homo sapiens
ucugaauaaauaauucu

SEQ ID NO: 636541 - RNA, 13 nt, Homo sapiens
ucugaaucagcca

SEQ ID NO: 636542 - RNA, 19 nt, Homo sapiens
ucugaauccuuuuaaucua

SEQ ID NO: 636543 - RNA, 14 nt, Homo sapiens
ucugaauugcacau

SEQ ID NO: 636544 - RNA, 13 nt, Homo sapiens
ucugacauuuaua

SEQ ID NO: 636545 - RNA, 14 nt, Homo sapiens
ucugaccagcuuuu

SEQ ID NO: 636546 - RNA, 18 nt, Homo sapiens
ucugaccauuucaggggu

SEQ ID NO: 636547 - RNA, 15 nt, Homo sapiens
ucugacccugggcuu

SEQ ID NO: 636548 - RNA, 15 nt, Homo sapiens
ucugaccugagcuau

SEQ ID NO: 636549 - RNA, 19 nt, Homo sapiens
ucugacgcuugugacagug

SEQ ID NO: 636550 - RNA, 14 nt, Homo sapiens
ucugacgucucuuu

SEQ ID NO: 636551 - RNA, 13 nt, Homo sapiens
ucugacuaccucc

SEQ ID NO: 636552 - RNA, 12 nt, Homo sapiens
ucugacucucca

SEQ ID NO: 636553 - RNA, 11 nt, Homo sapiens
ucugacugcug

SEQ ID NO: 636554 - RNA, 13 nt, Homo sapiens
ucugagaaacucu

SEQ ID NO: 636555 - RNA, 23 nt, Homo sapiens
ucugagaccacuugggcgcuguu

SEQ ID NO: 636556 - RNA, 19 nt, Homo sapiens
ucugagacccuuuucucag

SEQ ID NO: 636557 - RNA, 22 nt, Homo sapiens
ucugagacccuuuucucaggac

SEQ ID NO: 636558 - RNA, 13 nt, Homo sapiens
ucugagacucaca

SEQ ID NO: 636559 - RNA, 21 nt, Homo sapiens
ucugagagugaaaccaugacu

SEQ ID NO: 636560 - RNA, 23 nt, Homo sapiens
ucugagagugaaaccaugacugu

SEQ ID NO: 636561 - RNA, 13 nt, Homo sapiens
ucugagauacuaa

SEQ ID NO: 636562 - RNA, 13 nt, Homo sapiens
ucugagaugcuaa

SEQ ID NO: 636563 - RNA, 21 nt, Homo sapiens
ucugagauuuuugauaucuca

SEQ ID NO: 636564 - RNA, 20 nt, Homo sapiens
ucugagcaagagcuggcaaa

SEQ ID NO: 636565 - RNA, 19 nt, Homo sapiens
ucugagcacagcugcauua

SEQ ID NO: 636566 - RNA, 19 nt, Homo sapiens
ucugagcacccaagccagg

SEQ ID NO: 636567 - RNA, 21 nt, Homo sapiens
ucugagcccccacugcuucua

SEQ ID NO: 636568 - RNA, 21 nt, Homo sapiens
ucugagcucuggcuuugccuu

SEQ ID NO: 636569 - RNA, 23 nt, Homo sapiens
ucugagcuguaauuucgccuuaa

SEQ ID NO: 636570 - RNA, 15 nt, Homo sapiens
ucugaggacacagau

SEQ ID NO: 636571 - RNA, 21 nt, Homo sapiens
ucugaggccugagugauccac

SEQ ID NO: 636572 - RNA, 15 nt, Homo sapiens
ucugaggggcuacca

SEQ ID NO: 636573 - RNA, 13 nt, Homo sapiens
ucugaggucauua

SEQ ID NO: 636574 - RNA, 18 nt, Homo sapiens
ucugaguccuuugcuaau

SEQ ID NO: 636575 - RNA, 14 nt, Homo sapiens
ucugagugggccca

SEQ ID NO: 636576 - RNA, 13 nt, Homo sapiens
ucuauguguacag

SEQ ID NO: 636577 - RNA, 22 nt, Homo sapiens
ucuauguguuucuguaacaaau

SEQ ID NO: 636578 - RNA, 15 nt, Homo sapiens
ucuauguucaaagac

SEQ ID NO: 636579 - RNA, 13 nt, Homo sapiens
ucuauguuugcac

SEQ ID NO: 636580 - RNA, 12 nt, Homo sapiens
ucuauuaaucaa

SEQ ID NO: 636581 - RNA, 14 nt, Homo sapiens
ucuauuaaucaccu

SEQ ID NO: 636582 - RNA, 21 nt, Homo sapiens
ucuauuauguuaucauccucc

SEQ ID NO: 636583 - RNA, 23 nt, Homo sapiens
ucuauuauuuggagccugccaag

SEQ ID NO: 636584 - RNA, 15 nt, Homo sapiens
ucuauucaagcacuu

SEQ ID NO: 636585 - RNA, 22 nt, Homo sapiens
ucuauucaggcuguuguuggcu

SEQ ID NO: 636586 - RNA, 12 nt, Homo sapiens
ucuauucuagcc

SEQ ID NO: 636587 - RNA, 15 nt, Homo sapiens
ucuauucucaaagcu

SEQ ID NO: 636588 - RNA, 16 nt, Homo sapiens
ucuauuuaacaacugg

SEQ ID NO: 636589 - RNA, 23 nt, Homo sapiens
ucuauuuaacaacugggucaugu

SEQ ID NO: 636590 - RNA, 16 nt, Homo sapiens
ucuauuuaagugcaau

SEQ ID NO: 636591 - RNA, 17 nt, Homo sapiens
ucuauuuaagugcaauu

SEQ ID NO: 636592 - RNA, 13 nt, Homo sapiens
ucuauuuaugcaa

SEQ ID NO: 636593 - RNA, 19 nt, Homo sapiens
ucuauuucuccuccauggg

SEQ ID NO: 636594 - RNA, 15 nt, Homo sapiens
ucuauuuugugauga

SEQ ID NO: 636595 - RNA, 23 nt, Homo sapiens
ucucaaaacagagggcugcauuc

SEQ ID NO: 636596 - RNA, 20 nt, Homo sapiens
ucucaaacucccgaccucag

SEQ ID NO: 636597 - RNA, 20 nt, Homo sapiens
ucucaaacuccugaccucaa

SEQ ID NO: 636598 - RNA, 17 nt, Homo sapiens
ucucaaagaaggcauuu

SEQ ID NO: 636599 - RNA, 13 nt, Homo sapiens
ucucaaagccucu

SEQ ID NO: 636600 - RNA, 15 nt, Homo sapiens
ucucaaaguguacaa

SEQ ID NO: 636601 - RNA, 20 nt, Homo sapiens
ucucaaaugaaaauuuaauu

SEQ ID NO: 636602 - RNA, 14 nt, Homo sapiens
ucucaaaugcacau

SEQ ID NO: 636603 - RNA, 14 nt, Homo sapiens
ucucaacaaccuga

SEQ ID NO: 636604 - RNA, 18 nt, Homo sapiens
ucucaacaaccugaaugu

SEQ ID NO: 636605 - RNA, 15 nt, Homo sapiens
ucucaagcuaguguu

SEQ ID NO: 636606 - RNA, 20 nt, Homo sapiens
ucucaauuauuggccugcua

SEQ ID NO: 636607 - RNA, 12 nt, Homo sapiens
ucucacaaacau

SEQ ID NO: 636608 - RNA, 22 nt, Homo sapiens
ucucacaagauggaaaucacau

SEQ ID NO: 636609 - RNA, 16 nt, Homo sapiens
ucucacacaguuuaaa

SEQ ID NO: 636610 - RNA, 21 nt, Homo sapiens
ucucacacaucacauucccau

SEQ ID NO: 636611 - RNA, 18 nt, Homo sapiens
ucucacaguguugcccag

SEQ ID NO: 636612 - RNA, 14 nt, Homo sapiens
ucucacaugcacag

SEQ ID NO: 636613 - RNA, 21 nt, Homo sapiens
ucucacgggcucuaugccugc

SEQ ID NO: 636614 - RNA, 19 nt, Homo sapiens
ucucacuaaagauguuagu

SEQ ID NO: 636615 - RNA, 23 nt, Homo sapiens
ucucacucccuguuuuaauucaa

SEQ ID NO: 636616 - RNA, 16 nt, Homo sapiens
ucucacugcaagcaca

SEQ ID NO: 636617 - RNA, 22 nt, Homo sapiens
ucucacugugggaaggccagcu

SEQ ID NO: 636618 - RNA, 15 nt, Homo sapiens
ucucacuguguuacu

SEQ ID NO: 636619 - RNA, 18 nt, Homo sapiens
ucucacuugugcaguguu

SEQ ID NO: 636620 - RNA, 15 nt, Homo sapiens
ucucacuuuuuaccc

SEQ ID NO: 636621 - RNA, 21 nt, Homo sapiens
ucucagaaagugccugacaca

SEQ ID NO: 636622 - RNA, 17 nt, Homo sapiens
ucucagaauguuggcaa

SEQ ID NO: 636623 - RNA, 14 nt, Homo sapiens
ucucagaauucuuc

SEQ ID NO: 636624 - RNA, 15 nt, Homo sapiens
ucucagagccuucca

SEQ ID NO: 636625 - RNA, 20 nt, Homo sapiens
ucucagaguccacuguggca

SEQ ID NO: 636626 - RNA, 18 nt, Homo sapiens
ucucagaugaacaauuau

SEQ ID NO: 636627 - RNA, 23 nt, Homo sapiens
ucucagauguugaaacuuugaau

SEQ ID NO: 636628 - RNA, 19 nt, Homo sapiens
ucucagccauaggugcagu

SEQ ID NO: 636629 - RNA, 20 nt, Homo sapiens
ucucagccauaggugcaguu

SEQ ID NO: 636630 - RNA, 18 nt, Homo sapiens
ucucagcccccaccucag

SEQ ID NO: 636631 - RNA, 18 nt, Homo sapiens
ucucagcuaacauuccau

SEQ ID NO: 636632 - RNA, 19 nt, Homo sapiens
ucucagcucaccucaaccu

SEQ ID NO: 636633 - RNA, 14 nt, Homo sapiens
ucucagcucuucca

SEQ ID NO: 636634 - RNA, 14 nt, Homo sapiens
ucucagcuuugaga

SEQ ID NO: 636635 - RNA, 20 nt, Homo sapiens
ucucaggaccaaagcuuuca

SEQ ID NO: 636636 - RNA, 17 nt, Homo sapiens
ucucaggaccucuguag

SEQ ID NO: 636637 - RNA, 17 nt, Homo sapiens
ucucaggagucucuggu

SEQ ID NO: 636638 - RNA, 18 nt, Homo sapiens
ucucagggaaagccucug

SEQ ID NO: 636639 - RNA, 20 nt, Homo sapiens
ucucaggggccaacuaggca

SEQ ID NO: 636640 - RNA, 21 nt, Homo sapiens
ucucagguagaagguugacac

SEQ ID NO: 636641 - RNA, 18 nt, Homo sapiens
ucucagguguugccaaau

SEQ ID NO: 636642 - RNA, 17 nt, Homo sapiens
ucucaguacagcacucc

SEQ ID NO: 636643 - RNA, 12 nt, Homo sapiens
ucucagugcagg

SEQ ID NO: 636644 - RNA, 21 nt, Homo sapiens
ucucagugcuucuuacuauua

SEQ ID NO: 636645 - RNA, 20 nt, Homo sapiens
ucucaguucguguuugauuc

SEQ ID NO: 636646 - RNA, 15 nt, Homo sapiens
ucucauauacccuau

SEQ ID NO: 636647 - RNA, 16 nt, Homo sapiens
ucucaucagacucuga

SEQ ID NO: 636648 - RNA, 16 nt, Homo sapiens
ucucaucaguccauug

SEQ ID NO: 636649 - RNA, 22 nt, Homo sapiens
ucucaucugcacccuucuuuuc

SEQ ID NO: 636650 - RNA, 15 nt, Homo sapiens
ucucaugcuccuuaa

SEQ ID NO: 636651 - RNA, 10 nt, Homo sapiens
ucucauguca

SEQ ID NO: 636652 - RNA, 15 nt, Homo sapiens
ucucaugucauuuaa

SEQ ID NO: 636653 - RNA, 13 nt, Homo sapiens
ucucauuaaaauc

SEQ ID NO: 636654 - RNA, 22 nt, Homo sapiens
ucucauucccuuuuccucuauu

SEQ ID NO: 636655 - RNA, 15 nt, Homo sapiens
ucucauuuaagggaa

SEQ ID NO: 636656 - RNA, 18 nt, Homo sapiens
ucucauuuagaacuugca

SEQ ID NO: 636657 - RNA, 14 nt, Homo sapiens
ucuccaaacaguca

SEQ ID NO: 636658 - RNA, 19 nt, Homo sapiens
ucuccaacuuggucuuuca

SEQ ID NO: 636659 - RNA, 22 nt, Homo sapiens
ucuccaaucaguguuuggugua

SEQ ID NO: 636660 - RNA, 13 nt, Homo sapiens
ucuccaaugcucu

SEQ ID NO: 636661 - RNA, 18 nt, Homo sapiens
ucuccacacccacuuugu

SEQ ID NO: 636662 - RNA, 19 nt, Homo sapiens
ucuccacgucuuuccugcu

SEQ ID NO: 636663 - RNA, 17 nt, Homo sapiens
ucuccacuuucucaaug

SEQ ID NO: 636664 - RNA, 14 nt, Homo sapiens
ucuccagauguuaa

SEQ ID NO: 636665 - RNA, 22 nt, Homo sapiens
ucuccagcaauaauguuuucua

SEQ ID NO: 636666 - RNA, 22 nt, Homo sapiens
ucuccagccagcaaugaugucc

SEQ ID NO: 636667 - RNA, 21 nt, Homo sapiens
ucuccaggcauuuagcccuca

SEQ ID NO: 636668 - RNA, 13 nt, Homo sapiens
ucuccaguggauu

SEQ ID NO: 636669 - RNA, 15 nt, Homo sapiens
ucuccagugugccag

SEQ ID NO: 636670 - RNA, 16 nt, Homo sapiens
ucuccagugugccaga

SEQ ID NO: 636671 - RNA, 12 nt, Homo sapiens
ucuccaugcugc

SEQ ID NO: 636672 - RNA, 20 nt, Homo sapiens
ucuccauggcccugucccag

SEQ ID NO: 636673 - RNA, 22 nt, Homo sapiens
ucuccauguuugauguaucuga

SEQ ID NO: 636674 - RNA, 23 nt, Homo sapiens
ucuccauuuucuucucugugaag

SEQ ID NO: 636675 - RNA, 12 nt, Homo sapiens
ucucccaaagug

SEQ ID NO: 636676 - RNA, 13 nt, Homo sapiens
ucucccaaggcca

SEQ ID NO: 636677 - RNA, 22 nt, Homo sapiens
ucucccaggcugcuggagugca

SEQ ID NO: 636678 - RNA, 14 nt, Homo sapiens
ucucccaguccaag

SEQ ID NO: 636679 - RNA, 18 nt, Homo sapiens
ucucccaguccauuucca

SEQ ID NO: 636680 - RNA, 21 nt, Homo sapiens
ucucccagugacaacaucgca

SEQ ID NO: 636681 - RNA, 22 nt, Homo sapiens
ucuccccacugcucauuuggau

SEQ ID NO: 636682 - RNA, 21 nt, Homo sapiens
ucucccccuccugauuaaaaa

SEQ ID NO: 636683 - RNA, 18 nt, Homo sapiens
ucuccccuaggcgcuguu

SEQ ID NO: 636684 - RNA, 23 nt, Homo sapiens
ucuccccuuccuccucugcucuu

SEQ ID NO: 636685 - RNA, 10 nt, Homo sapiens
ucucccucac

SEQ ID NO: 636686 - RNA, 13 nt, Homo sapiens
ucucccucucagu

SEQ ID NO: 636687 - RNA, 18 nt, Homo sapiens
ucucccuggaucuaccug

SEQ ID NO: 636688 - RNA, 19 nt, Homo sapiens
ucucccuuugaagaaacua

SEQ ID NO: 636689 - RNA, 16 nt, Homo sapiens
ucuccguaauuagcau

SEQ ID NO: 636690 - RNA, 14 nt, Homo sapiens
ucuccuaauucugc

SEQ ID NO: 636691 - RNA, 13 nt, Homo sapiens
ucuccuacccuga

SEQ ID NO: 636692 - RNA, 13 nt, Homo sapiens
ucuccuacucacu

SEQ ID NO: 636693 - RNA, 14 nt, Homo sapiens
ucuccuagacacuc

SEQ ID NO: 636694 - RNA, 18 nt, Homo sapiens
ucuccuauguaguucuca

SEQ ID NO: 636695 - RNA, 18 nt, Homo sapiens
ucuccugaaacccaaagc

SEQ ID NO: 636696 - RNA, 16 nt, Homo sapiens
ucuccugauuauuuau

SEQ ID NO: 636697 - RNA, 16 nt, Homo sapiens
ucuccugccaccaaga

SEQ ID NO: 636698 - RNA, 17 nt, Homo sapiens
ucuccuguucucucugu

SEQ ID NO: 636699 - RNA, 16 nt, Homo sapiens
ucuaaagccaagcacu

SEQ ID NO: 636700 - RNA, 12 nt, Homo sapiens
ucuaaagccagg

SEQ ID NO: 636701 - RNA, 20 nt, Homo sapiens
ucuaaagcuaguaaacuucc

SEQ ID NO: 636702 - RNA, 15 nt, Homo sapiens
ucuaaaggaaaucaa

SEQ ID NO: 636703 - RNA, 20 nt, Homo sapiens
ucuaaaggaaaucaaaugaa

SEQ ID NO: 636704 - RNA, 14 nt, Homo sapiens
ucuaaaggcuugau

SEQ ID NO: 636705 - RNA, 22 nt, Homo sapiens
ucuaaagguaccaaacaaggaa

SEQ ID NO: 636706 - RNA, 16 nt, Homo sapiens
ucuaaaguuacuacug

SEQ ID NO: 636707 - RNA, 17 nt, Homo sapiens
ucuaaaguuacuacuga

SEQ ID NO: 636708 - RNA, 15 nt, Homo sapiens
ucuaaauauuuccau

SEQ ID NO: 636709 - RNA, 22 nt, Homo sapiens
ucuaaaucaaaccaggugcaau

SEQ ID NO: 636710 - RNA, 23 nt, Homo sapiens
ucuaaauccgacuugaauauucc

SEQ ID NO: 636711 - RNA, 19 nt, Homo sapiens
ucuaacauaugauacugau

SEQ ID NO: 636712 - RNA, 12 nt, Homo sapiens
ucuaacauuucc

SEQ ID NO: 636713 - RNA, 14 nt, Homo sapiens
ucuaaccagaugga

SEQ ID NO: 636714 - RNA, 20 nt, Homo sapiens
ucuaaccugcgucauuucag

SEQ ID NO: 636715 - RNA, 18 nt, Homo sapiens
ucuaacgggcauucacaa

SEQ ID NO: 636716 - RNA, 19 nt, Homo sapiens
ucuaacuagaaaucugcca

SEQ ID NO: 636717 - RNA, 12 nt, Homo sapiens
ucuaacucuccc

SEQ ID NO: 636718 - RNA, 15 nt, Homo sapiens
ucuaagaaagaaauu

SEQ ID NO: 636719 - RNA, 14 nt, Homo sapiens
ucuaagaacuucau

SEQ ID NO: 636720 - RNA, 20 nt, Homo sapiens
ucuaagauaagaguugagau

SEQ ID NO: 636721 - RNA, 22 nt, Homo sapiens
ucuaagauacacugcacuuugu

SEQ ID NO: 636722 - RNA, 19 nt, Homo sapiens
ucuaagcaguuauggugau

SEQ ID NO: 636723 - RNA, 19 nt, Homo sapiens
ucuaagcugcucuaaaguc

SEQ ID NO: 636724 - RNA, 12 nt, Homo sapiens
ucuaagcugugu

SEQ ID NO: 636725 - RNA, 14 nt, Homo sapiens
ucuaaguaaauaca

SEQ ID NO: 636726 - RNA, 12 nt, Homo sapiens
ucuaaguauuua

SEQ ID NO: 636727 - RNA, 17 nt, Homo sapiens
ucuaaguucauguuugu

SEQ ID NO: 636728 - RNA, 15 nt, Homo sapiens
ucuaaguuccacuga

SEQ ID NO: 636729 - RNA, 20 nt, Homo sapiens
ucuaauacaaagaugagcuc

SEQ ID NO: 636730 - RNA, 18 nt, Homo sapiens
ucuaauauggcaaccauu

SEQ ID NO: 636731 - RNA, 13 nt, Homo sapiens
ucuaauccuaucu

SEQ ID NO: 636732 - RNA, 22 nt, Homo sapiens
ucuaaucuuuuaauguauuugu

SEQ ID NO: 636733 - RNA, 18 nt, Homo sapiens
ucuaaugagacugaccau

SEQ ID NO: 636734 - RNA, 16 nt, Homo sapiens
ucuaaugugcauuaaa

SEQ ID NO: 636735 - RNA, 20 nt, Homo sapiens
ucuaauuaauuguaaucuga

SEQ ID NO: 636736 - RNA, 20 nt, Homo sapiens
ucuaauuauuuacucaaaga

SEQ ID NO: 636737 - RNA, 14 nt, Homo sapiens
ucuaauugcaaaga

SEQ ID NO: 636738 - RNA, 14 nt, Homo sapiens
ucuaauuuucacac

SEQ ID NO: 636739 - RNA, 21 nt, Homo sapiens
ucuacaaacucccacuuguca

SEQ ID NO: 636740 - RNA, 20 nt, Homo sapiens
ucuacaagauccuccugcug

SEQ ID NO: 636741 - RNA, 17 nt, Homo sapiens
ucuacaccaacgccaag

SEQ ID NO: 636742 - RNA, 20 nt, Homo sapiens
ucuacaccuggaccauuuga

SEQ ID NO: 636743 - RNA, 16 nt, Homo sapiens
ucuacagacuccaaaa

SEQ ID NO: 636744 - RNA, 17 nt, Homo sapiens
ucuacagacuccaaaag

SEQ ID NO: 636745 - RNA, 14 nt, Homo sapiens
ucuacagacuccca

SEQ ID NO: 636746 - RNA, 21 nt, Homo sapiens
ucuacaguuaggguugaguua

SEQ ID NO: 636747 - RNA, 22 nt, Homo sapiens
ucuacauaaauuuuauaugcac

SEQ ID NO: 636748 - RNA, 15 nt, Homo sapiens
ucuaccagcauaaau

SEQ ID NO: 636749 - RNA, 16 nt, Homo sapiens
ucuaccaggcaaauuc

SEQ ID NO: 636750 - RNA, 16 nt, Homo sapiens
ucuaccaggugaucua

SEQ ID NO: 636751 - RNA, 18 nt, Homo sapiens
ucuaccaugaacagaaaa

SEQ ID NO: 636752 - RNA, 21 nt, Homo sapiens
ucuacccaaaggauacuguaa

SEQ ID NO: 636753 - RNA, 10 nt, Homo sapiens
ucuaccccag

SEQ ID NO: 636754 - RNA, 23 nt, Homo sapiens
ucuaccuccuuguguugcacuga

SEQ ID NO: 636755 - RNA, 22 nt, Homo sapiens
ucuacgugauuuggcugcacuu

SEQ ID NO: 636756 - RNA, 12 nt, Homo sapiens
ucuacuaauucc

SEQ ID NO: 636757 - RNA, 15 nt, Homo sapiens
ucuacuaauuccaca

SEQ ID NO: 636758 - RNA, 16 nt, Homo sapiens
ucuacuacaugugacu

SEQ ID NO: 636759 - RNA, 16 nt, Homo sapiens
ucuacuaccacaagga

SEQ ID NO: 636760 - RNA, 17 nt, Homo sapiens
ucuacucuugucauuuu

SEQ ID NO: 636761 - RNA, 19 nt, Homo sapiens
ucuacugaaugucauugaa

SEQ ID NO: 636762 - RNA, 21 nt, Homo sapiens
ucuacugacuuuucccauuca

SEQ ID NO: 636763 - RNA, 19 nt, Homo sapiens
ucuacugcaauguaaauag

SEQ ID NO: 636764 - RNA, 18 nt, Homo sapiens
ucuacuggucuuguggaa

SEQ ID NO: 636765 - RNA, 17 nt, Homo sapiens
ucuacuguacacaaucu

SEQ ID NO: 636766 - RNA, 19 nt, Homo sapiens
ucuacuucucucucucuga

SEQ ID NO: 636767 - RNA, 22 nt, Homo sapiens
ucuacuucuggaagucaucuca

SEQ ID NO: 636768 - RNA, 21 nt, Homo sapiens
ucuacuugccucauuucccua

SEQ ID NO: 636769 - RNA, 14 nt, Homo sapiens
ucuacuugucauau

SEQ ID NO: 636770 - RNA, 15 nt, Homo sapiens
ucuacuuuaucaauu

SEQ ID NO: 636771 - RNA, 14 nt, Homo sapiens
ucuacuuugauucu

SEQ ID NO: 636772 - RNA, 15 nt, Homo sapiens
ucuagaaacagaucu

SEQ ID NO: 636773 - RNA, 15 nt, Homo sapiens
ucuagaacacaggca

SEQ ID NO: 636774 - RNA, 22 nt, Homo sapiens
ucuagaacacaggcaaaauccu

SEQ ID NO: 636775 - RNA, 12 nt, Homo sapiens
ucuagaagccaa

SEQ ID NO: 636776 - RNA, 13 nt, Homo sapiens
ucuagaagccaag

SEQ ID NO: 636777 - RNA, 17 nt, Homo sapiens
ucuagacauauuugcau

SEQ ID NO: 636778 - RNA, 14 nt, Homo sapiens
ucuagacuagcaau

SEQ ID NO: 636779 - RNA, 20 nt, Homo sapiens
ucuagacuagcaaucucuuc

SEQ ID NO: 636780 - RNA, 15 nt, Homo sapiens
ucuagauuucuaaug

SEQ ID NO: 636781 - RNA, 22 nt, Homo sapiens
ucuagcaccaggacucagagga

SEQ ID NO: 636782 - RNA, 19 nt, Homo sapiens
ucuagccugggcaacaaca

SEQ ID NO: 636783 - RNA, 14 nt, Homo sapiens
ucuagccuuagaca

SEQ ID NO: 636784 - RNA, 11 nt, Homo sapiens
ucuagccuuuu

SEQ ID NO: 636785 - RNA, 12 nt, Homo sapiens
ucuagcugucug

SEQ ID NO: 636786 - RNA, 22 nt, Homo sapiens
ucuagcuucuucagagaucaag

SEQ ID NO: 636787 - RNA, 16 nt, Homo sapiens
ucuaggucacuucuca

SEQ ID NO: 636788 - RNA, 16 nt, Homo sapiens
ucuagguucugagcuc

SEQ ID NO: 636789 - RNA, 18 nt, Homo sapiens
ucuaguaagaugcacuga

SEQ ID NO: 636790 - RNA, 22 nt, Homo sapiens
ucuaguccuauucuauugcagu

SEQ ID NO: 636791 - RNA, 21 nt, Homo sapiens
ucuagugaaugaaucucaaga

SEQ ID NO: 636792 - RNA, 16 nt, Homo sapiens
ucuaguugcaguauug

SEQ ID NO: 636793 - RNA, 20 nt, Homo sapiens
ucuaguuucuugugggcuaa

SEQ ID NO: 636794 - RNA, 18 nt, Homo sapiens
ucuaguuuuggcaagaag

SEQ ID NO: 636795 - RNA, 15 nt, Homo sapiens
ucuaguuuugucaaa

SEQ ID NO: 636796 - RNA, 14 nt, Homo sapiens
ucuauaacacauca

SEQ ID NO: 636797 - RNA, 15 nt, Homo sapiens
ucuauaagauuccaa

SEQ ID NO: 636798 - RNA, 21 nt, Homo sapiens
ucuauaauggaaacauuuaca

SEQ ID NO: 636799 - RNA, 14 nt, Homo sapiens
ucuauaauuuaccu

SEQ ID NO: 636800 - RNA, 19 nt, Homo sapiens
ucuauaauuuugccuuuaa

SEQ ID NO: 636801 - RNA, 20 nt, Homo sapiens
ucuauacaaaaugauuuuga

SEQ ID NO: 636802 - RNA, 13 nt, Homo sapiens
ucuauaccugccu

SEQ ID NO: 636803 - RNA, 15 nt, Homo sapiens
ucuauagaacaucca

SEQ ID NO: 636804 - RNA, 13 nt, Homo sapiens
ucuauaggcagcu

SEQ ID NO: 636805 - RNA, 14 nt, Homo sapiens
ucuauaggcagcuu

SEQ ID NO: 636806 - RNA, 18 nt, Homo sapiens
ucuaucaggggugcauuc

SEQ ID NO: 636807 - RNA, 19 nt, Homo sapiens
ucuaucaggggugcauucu

SEQ ID NO: 636808 - RNA, 14 nt, Homo sapiens
ucuaucagguccca

SEQ ID NO: 636809 - RNA, 15 nt, Homo sapiens
ucuaucaucugcuaa

SEQ ID NO: 636810 - RNA, 16 nt, Homo sapiens
ucuauccucuguaaac

SEQ ID NO: 636811 - RNA, 17 nt, Homo sapiens
ucuaucugcuuagcaac

SEQ ID NO: 636812 - RNA, 18 nt, Homo sapiens
ucuaucugcuuuugccua

SEQ ID NO: 636813 - RNA, 13 nt, Homo sapiens
ucuaucuugucaa

SEQ ID NO: 636814 - RNA, 21 nt, Homo sapiens
ucuaugaaacugcacauuggu

SEQ ID NO: 636815 - RNA, 22 nt, Homo sapiens
ucuaugaacaacaguaguuucu

SEQ ID NO: 636816 - RNA, 19 nt, Homo sapiens
ucuaugaaguugcuguuua

SEQ ID NO: 636817 - RNA, 15 nt, Homo sapiens
ucuaugagcccagau

SEQ ID NO: 636818 - RNA, 16 nt, Homo sapiens
ucuaugagcccagauc

SEQ ID NO: 636819 - RNA, 21 nt, Homo sapiens
ucuaugcauaaaaaaaugaug

SEQ ID NO: 636820 - RNA, 22 nt, Homo sapiens
ucuaugggguucguuaugccaa

SEQ ID NO: 636821 - RNA, 23 nt, Homo sapiens
ucuaugggguucguuaugccaaa

SEQ ID NO: 636822 - RNA, 22 nt, Homo sapiens
uuuuaagaagacauacugcuug

SEQ ID NO: 636823 - RNA, 17 nt, Homo sapiens
uuuuaagaagcauuuua

SEQ ID NO: 636824 - RNA, 12 nt, Homo sapiens
uuuuaagccauc

SEQ ID NO: 636825 - RNA, 18 nt, Homo sapiens
uuuuaauacauugaucag

SEQ ID NO: 636826 - RNA, 22 nt, Homo sapiens
uuuuaaucaaaugcuuuggacu

SEQ ID NO: 636827 - RNA, 15 nt, Homo sapiens
uuuuaauccuaccuc

SEQ ID NO: 636828 - RNA, 17 nt, Homo sapiens
uuuuaaugcuauuugaa

SEQ ID NO: 636829 - RNA, 19 nt, Homo sapiens
uuuuaaugggagccuuucc

SEQ ID NO: 636830 - RNA, 16 nt, Homo sapiens
uuuuaauucaguacaa

SEQ ID NO: 636831 - RNA, 15 nt, Homo sapiens
uuuuacacugauaaa

SEQ ID NO: 636832 - RNA, 22 nt, Homo sapiens
uuuuacauuuagaguauuuaca

SEQ ID NO: 636833 - RNA, 23 nt, Homo sapiens
uuuuaccaaagugucuuuugaca

SEQ ID NO: 636834 - RNA, 22 nt, Homo sapiens
uuuuaccaccgucugucucaga

SEQ ID NO: 636835 - RNA, 18 nt, Homo sapiens
uuuuaccugcccaaggau

SEQ ID NO: 636836 - RNA, 18 nt, Homo sapiens
uuuuacuaaaacacugaa

SEQ ID NO: 636837 - RNA, 17 nt, Homo sapiens
uuuuacucaugaucuug

SEQ ID NO: 636838 - RNA, 20 nt, Homo sapiens
uuuuacuccccuugagcuga

SEQ ID NO: 636839 - RNA, 18 nt, Homo sapiens
uuuuacucuuaugaucaa

SEQ ID NO: 636840 - RNA, 17 nt, Homo sapiens
uuuuacugcucugagaa

SEQ ID NO: 636841 - RNA, 16 nt, Homo sapiens
uuuuagaugaccaaaa

SEQ ID NO: 636842 - RNA, 15 nt, Homo sapiens
uuuuagcugguguca

SEQ ID NO: 636843 - RNA, 22 nt, Homo sapiens
uuuuaggaaaagugaaucuugc

SEQ ID NO: 636844 - RNA, 15 nt, Homo sapiens
uuuuaggacaucuua

SEQ ID NO: 636845 - RNA, 12 nt, Homo sapiens
uuuuagucacua

SEQ ID NO: 636846 - RNA, 20 nt, Homo sapiens
uuuuagucuaauugaauccc

SEQ ID NO: 636847 - RNA, 16 nt, Homo sapiens
uuuuagugacuguaau

SEQ ID NO: 636848 - RNA, 22 nt, Homo sapiens
uuuuauaaauucagaaagucau

SEQ ID NO: 636849 - RNA, 16 nt, Homo sapiens
uuuuauaagcaaaaac

SEQ ID NO: 636850 - RNA, 14 nt, Homo sapiens
uuuuauaauacaaa

SEQ ID NO: 636851 - RNA, 21 nt, Homo sapiens
uuuuauaccgcugcauaguau

SEQ ID NO: 636852 - RNA, 22 nt, Homo sapiens
uuuuauacugcacaguggcaca

SEQ ID NO: 636853 - RNA, 14 nt, Homo sapiens
uuuuauacuuucag

SEQ ID NO: 636854 - RNA, 20 nt, Homo sapiens
uuuuauaggcauaccuccua

SEQ ID NO: 636855 - RNA, 23 nt, Homo sapiens
uuuuauaugucuaauaucuuaau

SEQ ID NO: 636856 - RNA, 22 nt, Homo sapiens
uuuuauauguuuauauucuuuc

SEQ ID NO: 636857 - RNA, 19 nt, Homo sapiens
uuuuauauucuaagccagu

SEQ ID NO: 636858 - RNA, 17 nt, Homo sapiens
uuuuauauugaucuguu

SEQ ID NO: 636859 - RNA, 14 nt, Homo sapiens
uuuuauauugccuu

SEQ ID NO: 636860 - RNA, 18 nt, Homo sapiens
uuuuauauuuauugugcu

SEQ ID NO: 636861 - RNA, 20 nt, Homo sapiens
uuuuaucaaauuugccauga

SEQ ID NO: 636862 - RNA, 19 nt, Homo sapiens
uuuuaucuuugcuuuagaa

SEQ ID NO: 636863 - RNA, 13 nt, Homo sapiens
uuuuaugcauuga

SEQ ID NO: 636864 - RNA, 22 nt, Homo sapiens
uuuuauggacaguaaguccagu

SEQ ID NO: 636865 - RNA, 14 nt, Homo sapiens
uuuuauguucuugg

SEQ ID NO: 636866 - RNA, 11 nt, Homo sapiens
uuuuauuaguu

SEQ ID NO: 636867 - RNA, 15 nt, Homo sapiens
uuuuauugugcuuca

SEQ ID NO: 636868 - RNA, 23 nt, Homo sapiens
uuuuauuguuguuguuugauccc

SEQ ID NO: 636869 - RNA, 17 nt, Homo sapiens
uuuucaaccuaguagaa

SEQ ID NO: 636870 - RNA, 15 nt, Homo sapiens
uuuucaagagcuccu

SEQ ID NO: 636871 - RNA, 16 nt, Homo sapiens
uuuucaaggccuucag

SEQ ID NO: 636872 - RNA, 22 nt, Homo sapiens
uuuucaagguuuuaaaacaguc

SEQ ID NO: 636873 - RNA, 21 nt, Homo sapiens
uuuucaauaaugugaaugcua

SEQ ID NO: 636874 - RNA, 21 nt, Homo sapiens
uuuucaaucauaauaccugcu

SEQ ID NO: 636875 - RNA, 13 nt, Homo sapiens
uuuucacagauug

SEQ ID NO: 636876 - RNA, 18 nt, Homo sapiens
uuuucacagauuggggua

SEQ ID NO: 636877 - RNA, 17 nt, Homo sapiens
uuuucacagucacugau

SEQ ID NO: 636878 - RNA, 13 nt, Homo sapiens
uuuucaccccacc

SEQ ID NO: 636879 - RNA, 10 nt, Homo sapiens
uuuucacuga

SEQ ID NO: 636880 - RNA, 21 nt, Homo sapiens
uuuucacugcuggcugccuua

SEQ ID NO: 636881 - RNA, 16 nt, Homo sapiens
uuuucacuugucuccu

SEQ ID NO: 636882 - RNA, 15 nt, Homo sapiens
uuuucagaccccagc

SEQ ID NO: 636883 - RNA, 14 nt, Homo sapiens
uuuucagacuuuaa

SEQ ID NO: 636884 - RNA, 15 nt, Homo sapiens
uuuucagacuuuaaa

SEQ ID NO: 636885 - RNA, 17 nt, Homo sapiens
uuuucaguauacugugu

SEQ ID NO: 636886 - RNA, 17 nt, Homo sapiens
uuuucaguuuuaccucu

SEQ ID NO: 636887 - RNA, 18 nt, Homo sapiens
uuuucauguacagcauua

SEQ ID NO: 636888 - RNA, 14 nt, Homo sapiens
uuuucauuuguaca

SEQ ID NO: 636889 - RNA, 12 nt, Homo sapiens
uuuuccaaauaa

SEQ ID NO: 636890 - RNA, 16 nt, Homo sapiens
uuuuccacauaggaaa

SEQ ID NO: 636891 - RNA, 13 nt, Homo sapiens
uuuuccacuuaga

SEQ ID NO: 636892 - RNA, 23 nt, Homo sapiens
uuuuccauuuuuauuucaaaaua

SEQ ID NO: 636893 - RNA, 21 nt, Homo sapiens
uuuucccaggaaagaagcauu

SEQ ID NO: 636894 - RNA, 16 nt, Homo sapiens
uuuuccuaugcuauug

SEQ ID NO: 636895 - RNA, 18 nt, Homo sapiens
uuuuccucgccuaggccu

SEQ ID NO: 636896 - RNA, 18 nt, Homo sapiens
uuuuccuguucagugaga

SEQ ID NO: 636897 - RNA, 15 nt, Homo sapiens
uuuuccuguucuuaa

SEQ ID NO: 636898 - RNA, 13 nt, Homo sapiens
uuuuccuuaccau

SEQ ID NO: 636899 - RNA, 13 nt, Homo sapiens
uuuuccuucucau

SEQ ID NO: 636900 - RNA, 21 nt, Homo sapiens
uuuuccuuguauguucuuggg

SEQ ID NO: 636901 - RNA, 18 nt, Homo sapiens
uuuucuaagaaaagcauu

SEQ ID NO: 636902 - RNA, 21 nt, Homo sapiens
uuuucuagaaauguuuagguu

SEQ ID NO: 636903 - RNA, 18 nt, Homo sapiens
uuuucuagccccucugga

SEQ ID NO: 636904 - RNA, 12 nt, Homo sapiens
uuuucucaggac

SEQ ID NO: 636905 - RNA, 16 nt, Homo sapiens
uuuucuccgcauugga

SEQ ID NO: 636906 - RNA, 18 nt, Homo sapiens
uuuucuccggguccuccu

SEQ ID NO: 636907 - RNA, 12 nt, Homo sapiens
uuuucucuugcc

SEQ ID NO: 636908 - RNA, 13 nt, Homo sapiens
uuuucugaagaca

SEQ ID NO: 636909 - RNA, 15 nt, Homo sapiens
uuuucugauaaaaga

SEQ ID NO: 636910 - RNA, 13 nt, Homo sapiens
uuuucugccaaga

SEQ ID NO: 636911 - RNA, 14 nt, Homo sapiens
uuuucugccaggga

SEQ ID NO: 636912 - RNA, 19 nt, Homo sapiens
uuuucuguaaauaaccuau

SEQ ID NO: 636913 - RNA, 20 nt, Homo sapiens
uuuucuguagcaccagagaa

SEQ ID NO: 636914 - RNA, 17 nt, Homo sapiens
uuuucuguuuauuuugc

SEQ ID NO: 636915 - RNA, 19 nt, Homo sapiens
uuuucuucuuuuugcuuca

SEQ ID NO: 636916 - RNA, 15 nt, Homo sapiens
uuuucuugccaauga

SEQ ID NO: 636917 - RNA, 18 nt, Homo sapiens
uuuucuuguugcaaaaaa

SEQ ID NO: 636918 - RNA, 17 nt, Homo sapiens
uuuucuuugagucuguu

SEQ ID NO: 636919 - RNA, 22 nt, Homo sapiens
uuuucuuuuaagcuauccacag

SEQ ID NO: 636920 - RNA, 13 nt, Homo sapiens
uuuugaaagaagc

SEQ ID NO: 636921 - RNA, 13 nt, Homo sapiens
uuuugaaagucag

SEQ ID NO: 636922 - RNA, 17 nt, Homo sapiens
uuuugaaauuaaccucu

SEQ ID NO: 636923 - RNA, 13 nt, Homo sapiens
uuuugaaggcaaa

SEQ ID NO: 636924 - RNA, 14 nt, Homo sapiens
uuuugaaggcaaaa

SEQ ID NO: 636925 - RNA, 18 nt, Homo sapiens
uuuugacaucagcauuag

SEQ ID NO: 636926 - RNA, 22 nt, Homo sapiens
uuuugaccaaauaaaguaccau

SEQ ID NO: 636927 - RNA, 14 nt, Homo sapiens
uuuugagaguauau

SEQ ID NO: 636928 - RNA, 17 nt, Homo sapiens
uuuugagcuaaucuuca

SEQ ID NO: 636929 - RNA, 22 nt, Homo sapiens
uuuugaggaauuaucaugggaa

SEQ ID NO: 636930 - RNA, 21 nt, Homo sapiens
uuuugaggccuuuuuugccag

SEQ ID NO: 636931 - RNA, 21 nt, Homo sapiens
uuuugaguaaagcuccuaucu

SEQ ID NO: 636932 - RNA, 16 nt, Homo sapiens
uuuugaguguauacau

SEQ ID NO: 636933 - RNA, 19 nt, Homo sapiens
uuuugauaaaguaauucau

SEQ ID NO: 636934 - RNA, 22 nt, Homo sapiens
uuuugauaacaaugacacuaga

SEQ ID NO: 636935 - RNA, 15 nt, Homo sapiens
uuuugauaauggcuu

SEQ ID NO: 636936 - RNA, 21 nt, Homo sapiens
uuuugaugacuucagugaaau

SEQ ID NO: 636937 - RNA, 20 nt, Homo sapiens
uuugcauugaugaauuuugu

SEQ ID NO: 636938 - RNA, 11 nt, Homo sapiens
uuugcauuugg

SEQ ID NO: 636939 - RNA, 21 nt, Homo sapiens
uuugccaacagaaacaugcca

SEQ ID NO: 636940 - RNA, 22 nt, Homo sapiens
uuugccacaggagcugaaguua

SEQ ID NO: 636941 - RNA, 21 nt, Homo sapiens
uuugccagagcgugcuuucaa

SEQ ID NO: 636942 - RNA, 14 nt, Homo sapiens
uuugccauguugcc

SEQ ID NO: 636943 - RNA, 17 nt, Homo sapiens
uuugccauuaugcaaau

SEQ ID NO: 636944 - RNA, 17 nt, Homo sapiens
uuugcccccuugcccau

SEQ ID NO: 636945 - RNA, 16 nt, Homo sapiens
uuugccuaauggcaaa

SEQ ID NO: 636946 - RNA, 19 nt, Homo sapiens
uuugccuaucuuuaaacau

SEQ ID NO: 636947 - RNA, 22 nt, Homo sapiens
uuugccugauccuccaacagcu

SEQ ID NO: 636948 - RNA, 10 nt, Homo sapiens
uuugccuucc

SEQ ID NO: 636949 - RNA, 11 nt, Homo sapiens
uuugccuuccu

SEQ ID NO: 636950 - RNA, 19 nt, Homo sapiens
uuugccuuggcuuugccag

SEQ ID NO: 636951 - RNA, 16 nt, Homo sapiens
uuugcgcugcuaagaa

SEQ ID NO: 636952 - RNA, 16 nt, Homo sapiens
uuugcggaaugcauug

SEQ ID NO: 636953 - RNA, 19 nt, Homo sapiens
uuugcuaaaugugaaugau

SEQ ID NO: 636954 - RNA, 22 nt, Homo sapiens
uuugcuaaugcaauuagcauua

SEQ ID NO: 636955 - RNA, 14 nt, Homo sapiens
uuugcuacauucua

SEQ ID NO: 636956 - RNA, 23 nt, Homo sapiens
uuugcuacuaaguucacauuaga

SEQ ID NO: 636957 - RNA, 15 nt, Homo sapiens
uuugcuaucugggcu

SEQ ID NO: 636958 - RNA, 21 nt, Homo sapiens
uuugcuccauccuccugggau

SEQ ID NO: 636959 - RNA, 20 nt, Homo sapiens
uuugcuccgcucccaccgcc

SEQ ID NO: 636960 - RNA, 20 nt, Homo sapiens
uuugcugcugcuuaauccua

SEQ ID NO: 636961 - RNA, 14 nt, Homo sapiens
uuugcugguuucau

SEQ ID NO: 636962 - RNA, 18 nt, Homo sapiens
uuugcuuaaacuaaugaa

SEQ ID NO: 636963 - RNA, 21 nt, Homo sapiens
uuugcuuaccuuuuccuauuc

SEQ ID NO: 636964 - RNA, 17 nt, Homo sapiens
uuugcuuaguauuguga

SEQ ID NO: 636965 - RNA, 19 nt, Homo sapiens
uuugcuucaaaaacauucu

SEQ ID NO: 636966 - RNA, 22 nt, Homo sapiens
uuugcuucaaauucaaggccuu

SEQ ID NO: 636967 - RNA, 16 nt, Homo sapiens
uuugcuuuucaggguu

SEQ ID NO: 636968 - RNA, 15 nt, Homo sapiens
uuuggaaaauagauu

SEQ ID NO: 636969 - RNA, 16 nt, Homo sapiens
uuuggaaccaugccuu

SEQ ID NO: 636970 - RNA, 13 nt, Homo sapiens
uuuggaagcacug

SEQ ID NO: 636971 - RNA, 17 nt, Homo sapiens
uuuggaauauuguccau

SEQ ID NO: 636972 - RNA, 22 nt, Homo sapiens
uuuggacucuaaaaucucagca

SEQ ID NO: 636973 - RNA, 19 nt, Homo sapiens
uuuggagaaaugcuuagaa

SEQ ID NO: 636974 - RNA, 22 nt, Homo sapiens
uuuggagccucccuucugccuu

SEQ ID NO: 636975 - RNA, 17 nt, Homo sapiens
uuuggagugagaaauca

SEQ ID NO: 636976 - RNA, 20 nt, Homo sapiens
uuuggauaauaggaauucaa

SEQ ID NO: 636977 - RNA, 16 nt, Homo sapiens
uuuggauaugaucuuu

SEQ ID NO: 636978 - RNA, 16 nt, Homo sapiens
uuuggauugggguccc

SEQ ID NO: 636979 - RNA, 15 nt, Homo sapiens
uuuggauuguaucaa

SEQ ID NO: 636980 - RNA, 19 nt, Homo sapiens
uuuggcaagcucuaucacc

SEQ ID NO: 636981 - RNA, 22 nt, Homo sapiens
uuuggcaagcucuaucaccaag

SEQ ID NO: 636982 - RNA, 21 nt, Homo sapiens
uuuggcacuugccauuccaaa

SEQ ID NO: 636983 - RNA, 19 nt, Homo sapiens
uuuggcuagguaucauuca

SEQ ID NO: 636984 - RNA, 18 nt, Homo sapiens
uuuggcuggaauuacaaa

SEQ ID NO: 636985 - RNA, 21 nt, Homo sapiens
uuugggaguguucugugggcu

SEQ ID NO: 636986 - RNA, 17 nt, Homo sapiens
uuuggggacucauuuca

SEQ ID NO: 636987 - RNA, 19 nt, Homo sapiens
uuuggggagcaggaggcca

SEQ ID NO: 636988 - RNA, 21 nt, Homo sapiens
uuuggggagcaggaggccaau

SEQ ID NO: 636989 - RNA, 12 nt, Homo sapiens
uuuggguauuaa

SEQ ID NO: 636990 - RNA, 23 nt, Homo sapiens
uuuggguggaauggacuacucca

SEQ ID NO: 636991 - RNA, 22 nt, Homo sapiens
uuuggguucacagaagcacagc

SEQ ID NO: 636992 - RNA, 23 nt, Homo sapiens
uuugguaguggaauagugaauac

SEQ ID NO: 636993 - RNA, 16 nt, Homo sapiens
uuuggucaguuacaaa

SEQ ID NO: 636994 - RNA, 18 nt, Homo sapiens
uuuggucgaggaguaaca

SEQ ID NO: 636995 - RNA, 20 nt, Homo sapiens
uuuggucuguuuugccuuca

SEQ ID NO: 636996 - RNA, 22 nt, Homo sapiens
uuuggugacuguguaacuuucu

SEQ ID NO: 636997 - RNA, 18 nt, Homo sapiens
uuugguuccacaaucucu

SEQ ID NO: 636998 - RNA, 10 nt, Homo sapiens
uuugguucua

SEQ ID NO: 636999 - RNA, 19 nt, Homo sapiens
uuuguaaaaauguccccac

SEQ ID NO: 637000 - RNA, 16 nt, Homo sapiens
uuuguaaaacauuagu

SEQ ID NO: 637001 - RNA, 16 nt, Homo sapiens
uuuguaaaggauauca

SEQ ID NO: 637002 - RNA, 16 nt, Homo sapiens
uuuguaaauaugcaaa

SEQ ID NO: 637003 - RNA, 18 nt, Homo sapiens
uuuguaaaucugccacaa

SEQ ID NO: 637004 - RNA, 18 nt, Homo sapiens
uuuguaaauuauugauga

SEQ ID NO: 637005 - RNA, 13 nt, Homo sapiens
uuuguaaauuccc

SEQ ID NO: 637006 - RNA, 18 nt, Homo sapiens
uuuguaauauuuuccaua

SEQ ID NO: 637007 - RNA, 13 nt, Homo sapiens
uuuguaaugcugc

SEQ ID NO: 637008 - RNA, 14 nt, Homo sapiens
uuuguaaugcugca

SEQ ID NO: 637009 - RNA, 15 nt, Homo sapiens
uuuguacaacccuga

SEQ ID NO: 637010 - RNA, 22 nt, Homo sapiens
uuuguacagauggggucuugcu

SEQ ID NO: 637011 - RNA, 17 nt, Homo sapiens
uuuguagccuuccucca

SEQ ID NO: 637012 - RNA, 17 nt, Homo sapiens
uuugucaacauugugau

SEQ ID NO: 637013 - RNA, 18 nt, Homo sapiens
uuugucacaaauaaacau

SEQ ID NO: 637014 - RNA, 16 nt, Homo sapiens
uuugucagagugcaca

SEQ ID NO: 637015 - RNA, 18 nt, Homo sapiens
uuugucauucaagccugu

SEQ ID NO: 637016 - RNA, 14 nt, Homo sapiens
uuuguccuacauuc

SEQ ID NO: 637017 - RNA, 19 nt, Homo sapiens
uuuguccuggucaugcaca

SEQ ID NO: 637018 - RNA, 13 nt, Homo sapiens
uuugucucagaag

SEQ ID NO: 637019 - RNA, 20 nt, Homo sapiens
uuugucuuuuuucuauguaa

SEQ ID NO: 637020 - RNA, 19 nt, Homo sapiens
uuugugagagcccagucau

SEQ ID NO: 637021 - RNA, 15 nt, Homo sapiens
uuugugcugagauca

SEQ ID NO: 637022 - RNA, 17 nt, Homo sapiens
uuuguggaaacugucau

SEQ ID NO: 637023 - RNA, 14 nt, Homo sapiens
uuuguggaagcacu

SEQ ID NO: 637024 - RNA, 14 nt, Homo sapiens
uuuguguauucuuc

SEQ ID NO: 637025 - RNA, 18 nt, Homo sapiens
uuugugucaaaaggacau

SEQ ID NO: 637026 - RNA, 11 nt, Homo sapiens
uuugugugauc

SEQ ID NO: 637027 - RNA, 21 nt, Homo sapiens
uuuguguucuguuuguuaaaa

SEQ ID NO: 637028 - RNA, 19 nt, Homo sapiens
uuuguuacaaaaagacaaa

SEQ ID NO: 637029 - RNA, 20 nt, Homo sapiens
uuuguuacaaaaagacaaaa

SEQ ID NO: 637030 - RNA, 18 nt, Homo sapiens
uuuguuacauaaggauga

SEQ ID NO: 637031 - RNA, 12 nt, Homo sapiens
uuuguuaccaua

SEQ ID NO: 637032 - RNA, 15 nt, Homo sapiens
uuuguuagcaaagau

SEQ ID NO: 637033 - RNA, 18 nt, Homo sapiens
uuuguuaugacagugaau

SEQ ID NO: 637034 - RNA, 18 nt, Homo sapiens
uuuguuauuuuuccccaa

SEQ ID NO: 637035 - RNA, 13 nt, Homo sapiens
uuuguucagagag

SEQ ID NO: 637036 - RNA, 22 nt, Homo sapiens
uuuguugaccauuuuguuaaaa

SEQ ID NO: 637037 - RNA, 14 nt, Homo sapiens
uuuguugaccucaa

SEQ ID NO: 637038 - RNA, 16 nt, Homo sapiens
uuuguuuaagcugacu

SEQ ID NO: 637039 - RNA, 14 nt, Homo sapiens
uuuguuuguggcau

SEQ ID NO: 637040 - RNA, 16 nt, Homo sapiens
uuuguuuuuacaaaau

SEQ ID NO: 637041 - RNA, 17 nt, Homo sapiens
uuuuaaaaaauucuugu

SEQ ID NO: 637042 - RNA, 16 nt, Homo sapiens
uuuuaaaaccauuuaa

SEQ ID NO: 637043 - RNA, 23 nt, Homo sapiens
uuuuaaaagguagagucuuacaa

SEQ ID NO: 637044 - RNA, 20 nt, Homo sapiens
uuuuaaaauaaaaauuuaau

SEQ ID NO: 637045 - RNA, 17 nt, Homo sapiens
uuuuaaacagugcuuug

SEQ ID NO: 637046 - RNA, 21 nt, Homo sapiens
uuuuaaagacccaacuugcca

SEQ ID NO: 637047 - RNA, 21 nt, Homo sapiens
uuuuaaagcauauuggugcua

SEQ ID NO: 637048 - RNA, 22 nt, Homo sapiens
uuuuaaaguauguuauugcaua

SEQ ID NO: 637049 - RNA, 14 nt, Homo sapiens
uuuuaaaguuuguu

SEQ ID NO: 637050 - RNA, 23 nt, Homo sapiens
uuuuaaauaaaaauaaguguaca

SEQ ID NO: 637051 - RNA, 20 nt, Homo sapiens
uuuuaaauacaaaaggcauu

SEQ ID NO: 637052 - RNA, 21 nt, Homo sapiens
uuuuaaccaguucugucuuca

SEQ ID NO: 637053 - RNA, 15 nt, Homo sapiens
uuuuaaccauuccaa

SEQ ID NO: 637054 - RNA, 24 nt, Homo sapiens
uuucuaccuuguuguguuucuauc

SEQ ID NO: 637055 - RNA, 22 nt, Homo sapiens
uuucuacuaaaaauacaaaaau

SEQ ID NO: 637056 - RNA, 21 nt, Homo sapiens
uuucuagaagcacauguguau

SEQ ID NO: 637057 - RNA, 19 nt, Homo sapiens
uuucuagacaguauugcca

SEQ ID NO: 637058 - RNA, 17 nt, Homo sapiens
uuucuagaugucucuga

SEQ ID NO: 637059 - RNA, 20 nt, Homo sapiens
uuucuaggguaaugccguag

SEQ ID NO: 637060 - RNA, 21 nt, Homo sapiens
uuucuaguuucuugugggcua

SEQ ID NO: 637061 - RNA, 15 nt, Homo sapiens
uuucuauaccugucu

SEQ ID NO: 637062 - RNA, 14 nt, Homo sapiens
uuucuauacuuuac

SEQ ID NO: 637063 - RNA, 15 nt, Homo sapiens
uuucuauagccaaaa

SEQ ID NO: 637064 - RNA, 12 nt, Homo sapiens
uuucuaugcaaa

SEQ ID NO: 637065 - RNA, 15 nt, Homo sapiens
uuucuaugcauaaaa

SEQ ID NO: 637066 - RNA, 14 nt, Homo sapiens
uuucuauucuguca

SEQ ID NO: 637067 - RNA, 12 nt, Homo sapiens
uuucucacugaa

SEQ ID NO: 637068 - RNA, 17 nt, Homo sapiens
uuucucagggucacugu

SEQ ID NO: 637069 - RNA, 14 nt, Homo sapiens
uuucucauacuuag

SEQ ID NO: 637070 - RNA, 13 nt, Homo sapiens
uuucucaugaagc

SEQ ID NO: 637071 - RNA, 13 nt, Homo sapiens
uuucuccaugagu

SEQ ID NO: 637072 - RNA, 12 nt, Homo sapiens
uuucuccauugu

SEQ ID NO: 637073 - RNA, 20 nt, Homo sapiens
uuucucccucuuucuuccca

SEQ ID NO: 637074 - RNA, 15 nt, Homo sapiens
uuucucccugcagcc

SEQ ID NO: 637075 - RNA, 15 nt, Homo sapiens
uuucuccuuagucuu

SEQ ID NO: 637076 - RNA, 13 nt, Homo sapiens
uuucuccuuuuga

SEQ ID NO: 637077 - RNA, 22 nt, Homo sapiens
uuucuccuuuugaccaaauaaa

SEQ ID NO: 637078 - RNA, 16 nt, Homo sapiens
uuucucuaaaacugcc

SEQ ID NO: 637079 - RNA, 16 nt, Homo sapiens
uuucucuaaagucacu

SEQ ID NO: 637080 - RNA, 14 nt, Homo sapiens
uuucucugaucucc

SEQ ID NO: 637081 - RNA, 18 nt, Homo sapiens
uuucucugccuucuucca

SEQ ID NO: 637082 - RNA, 23 nt, Homo sapiens
uuucucugcuuacccuucaccuu

SEQ ID NO: 637083 - RNA, 22 nt, Homo sapiens
uuucucuucucagcucuuccau

SEQ ID NO: 637084 - RNA, 17 nt, Homo sapiens
uuucugaaugucuguga

SEQ ID NO: 637085 - RNA, 16 nt, Homo sapiens
uuucugaauugcacau

SEQ ID NO: 637086 - RNA, 18 nt, Homo sapiens
uuucugagagagugccau

SEQ ID NO: 637087 - RNA, 19 nt, Homo sapiens
uuucugagagagugccaug

SEQ ID NO: 637088 - RNA, 17 nt, Homo sapiens
uuucugagaugcucacu

SEQ ID NO: 637089 - RNA, 12 nt, Homo sapiens
uuucugagcuuu

SEQ ID NO: 637090 - RNA, 14 nt, Homo sapiens
uuucugaguuucau

SEQ ID NO: 637091 - RNA, 18 nt, Homo sapiens
uuucuggaaaacugccuu

SEQ ID NO: 637092 - RNA, 19 nt, Homo sapiens
uuucuggaaaguagaucuu

SEQ ID NO: 637093 - RNA, 15 nt, Homo sapiens
uuucuggaauggaaa

SEQ ID NO: 637094 - RNA, 15 nt, Homo sapiens
uuucuggccugccuu

SEQ ID NO: 637095 - RNA, 11 nt, Homo sapiens
uuucugucaag

SEQ ID NO: 637096 - RNA, 15 nt, Homo sapiens
uuucugugcagagau

SEQ ID NO: 637097 - RNA, 16 nt, Homo sapiens
uuucugugcagagaug

SEQ ID NO: 637098 - RNA, 17 nt, Homo sapiens
uuucuguggcuaaacag

SEQ ID NO: 637099 - RNA, 18 nt, Homo sapiens
uuucuguucccuugccau

SEQ ID NO: 637100 - RNA, 12 nt, Homo sapiens
uuucuguucuca

SEQ ID NO: 637101 - RNA, 16 nt, Homo sapiens
uuucuuaaaaaacaua

SEQ ID NO: 637102 - RNA, 14 nt, Homo sapiens
uuucuuacuccucc

SEQ ID NO: 637103 - RNA, 16 nt, Homo sapiens
uuucuuagugugccaa

SEQ ID NO: 637104 - RNA, 20 nt, Homo sapiens
uuucuucaagaacauucuac

SEQ ID NO: 637105 - RNA, 14 nt, Homo sapiens
uuucuucaccaaau

SEQ ID NO: 637106 - RNA, 15 nt, Homo sapiens
uuucuucagagacag

SEQ ID NO: 637107 - RNA, 21 nt, Homo sapiens
uuucuuccaaagcacauugaa

SEQ ID NO: 637108 - RNA, 12 nt, Homo sapiens
uuucuugcagau

SEQ ID NO: 637109 - RNA, 20 nt, Homo sapiens
uuucuugggguacucuugau

SEQ ID NO: 637110 - RNA, 17 nt, Homo sapiens
uuucuuguuuaacauau

SEQ ID NO: 637111 - RNA, 18 nt, Homo sapiens
uuucuuuacuuaacauau

SEQ ID NO: 637112 - RNA, 15 nt, Homo sapiens
uuucuuuagucuuua

SEQ ID NO: 637113 - RNA, 18 nt, Homo sapiens
uuucuuuuaaaauuuuga

SEQ ID NO: 637114 - RNA, 15 nt, Homo sapiens
uuucuuuuccauuua

SEQ ID NO: 637115 - RNA, 17 nt, Homo sapiens
uuucuuuuguauguaaa

SEQ ID NO: 637116 - RNA, 16 nt, Homo sapiens
uuucuuuuuacagcau

SEQ ID NO: 637117 - RNA, 22 nt, Homo sapiens
uuugaaaacauauaaagcacua

SEQ ID NO: 637118 - RNA, 13 nt, Homo sapiens
uuugaaacaguug

SEQ ID NO: 637119 - RNA, 17 nt, Homo sapiens
uuugaaacugaauguuu

SEQ ID NO: 637120 - RNA, 12 nt, Homo sapiens
uuugaaagcagu

SEQ ID NO: 637121 - RNA, 24 nt, Homo sapiens
uuugaaauaauaaaucugguagaa

SEQ ID NO: 637122 - RNA, 22 nt, Homo sapiens
uuugaaaugugguuuuccugaa

SEQ ID NO: 637123 - RNA, 12 nt, Homo sapiens
uuugaaccauaa

SEQ ID NO: 637124 - RNA, 22 nt, Homo sapiens
uuugaaccauaaagggugccag

SEQ ID NO: 637125 - RNA, 13 nt, Homo sapiens
uuugaagaauuua

SEQ ID NO: 637126 - RNA, 13 nt, Homo sapiens
uuugaagcaaagc

SEQ ID NO: 637127 - RNA, 21 nt, Homo sapiens
uuugaagcacaacucccuuaa

SEQ ID NO: 637128 - RNA, 20 nt, Homo sapiens
uuugaagcagucuugcucug

SEQ ID NO: 637129 - RNA, 15 nt, Homo sapiens
uuugaagcgagcagu

SEQ ID NO: 637130 - RNA, 19 nt, Homo sapiens
uuugaagcugcagugagcu

SEQ ID NO: 637131 - RNA, 15 nt, Homo sapiens
uuugaaguccacuug

SEQ ID NO: 637132 - RNA, 21 nt, Homo sapiens
uuugaagucuucccucagauu

SEQ ID NO: 637133 - RNA, 16 nt, Homo sapiens
uuugaauagcaauuag

SEQ ID NO: 637134 - RNA, 15 nt, Homo sapiens
uuugaauucugugau

SEQ ID NO: 637135 - RNA, 22 nt, Homo sapiens
uuugacacaccccuaaguacaa

SEQ ID NO: 637136 - RNA, 23 nt, Homo sapiens
uuugacacaccccuaaguacaag

SEQ ID NO: 637137 - RNA, 14 nt, Homo sapiens
uuugacacuaagaa

SEQ ID NO: 637138 - RNA, 14 nt, Homo sapiens
uuugacacugcucu

SEQ ID NO: 637139 - RNA, 22 nt, Homo sapiens
uuugaccaaauaaaguaccauu

SEQ ID NO: 637140 - RNA, 17 nt, Homo sapiens
uuugaccuucagagcca

SEQ ID NO: 637141 - RNA, 16 nt, Homo sapiens
uuugacucaguuccag

SEQ ID NO: 637142 - RNA, 15 nt, Homo sapiens
uuugacucuggcaaa

SEQ ID NO: 637143 - RNA, 20 nt, Homo sapiens
uuugacuugcaugaagagaa

SEQ ID NO: 637144 - RNA, 23 nt, Homo sapiens
uuugacuuugguuguguuuaaau

SEQ ID NO: 637145 - RNA, 22 nt, Homo sapiens
uuugagacaacaguacauauaa

SEQ ID NO: 637146 - RNA, 17 nt, Homo sapiens
uuugagagaaauaugaa

SEQ ID NO: 637147 - RNA, 22 nt, Homo sapiens
uuugagauggagucuugcucug

SEQ ID NO: 637148 - RNA, 15 nt, Homo sapiens
uuugagcaggucuca

SEQ ID NO: 637149 - RNA, 21 nt, Homo sapiens
uuugagccaacaacucugauu

SEQ ID NO: 637150 - RNA, 21 nt, Homo sapiens
uuugagcccacaaagccuuau

SEQ ID NO: 637151 - RNA, 21 nt, Homo sapiens
uuugagcccauucuucugggu

SEQ ID NO: 637152 - RNA, 15 nt, Homo sapiens
uuugagcgcgcugag

SEQ ID NO: 637153 - RNA, 23 nt, Homo sapiens
uuugagcuaaucuucauuucuaa

SEQ ID NO: 637154 - RNA, 20 nt, Homo sapiens
uuugaggaauuaucauggga

SEQ ID NO: 637155 - RNA, 12 nt, Homo sapiens
uuugaggccaaa

SEQ ID NO: 637156 - RNA, 20 nt, Homo sapiens
uuugaggccuuuuuugccag

SEQ ID NO: 637157 - RNA, 23 nt, Homo sapiens
uuugagugugugugugcaugugu

SEQ ID NO: 637158 - RNA, 14 nt, Homo sapiens
uuugauaaagcagu

SEQ ID NO: 637159 - RNA, 20 nt, Homo sapiens
uuugauacucccagucuugu

SEQ ID NO: 637160 - RNA, 14 nt, Homo sapiens
uuugauagaaccau

SEQ ID NO: 637161 - RNA, 20 nt, Homo sapiens
uuugauauaccaaauuaaaa

SEQ ID NO: 637162 - RNA, 18 nt, Homo sapiens
uuugauaugaaguguuag

SEQ ID NO: 637163 - RNA, 19 nt, Homo sapiens
uuugaucaagaaugcaaua

SEQ ID NO: 637164 - RNA, 18 nt, Homo sapiens
uuugaucuuuguuuaaau

SEQ ID NO: 637165 - RNA, 18 nt, Homo sapiens
uuugaucuuuuuauauuc

SEQ ID NO: 637166 - RNA, 14 nt, Homo sapiens
uuugauugauuuga

SEQ ID NO: 637167 - RNA, 18 nt, Homo sapiens
uuugauuucgccaaucau

SEQ ID NO: 637168 - RNA, 22 nt, Homo sapiens
uuugcaacugucucucuucuca

SEQ ID NO: 637169 - RNA, 20 nt, Homo sapiens
uuugcaagggaaaagucucu

SEQ ID NO: 637170 - RNA, 20 nt, Homo sapiens
uuugcacaggaaagagucac

SEQ ID NO: 637171 - RNA, 16 nt, Homo sapiens
uuugcaccugcucucu

SEQ ID NO: 637172 - RNA, 18 nt, Homo sapiens
uuugcagaauacauucaa

SEQ ID NO: 637173 - RNA, 13 nt, Homo sapiens
uuugcagagccuu

SEQ ID NO: 637174 - RNA, 19 nt, Homo sapiens
uuugcauaacgucugccuu

SEQ ID NO: 637175 - RNA, 22 nt, Homo sapiens
uucucuugacguuuacauauau

SEQ ID NO: 637176 - RNA, 11 nt, Homo sapiens
uucucuuugcu

SEQ ID NO: 637177 - RNA, 15 nt, Homo sapiens
uucugaaaaaguauc

SEQ ID NO: 637178 - RNA, 20 nt, Homo sapiens
uucugaaaaccuaccagcca

SEQ ID NO: 637179 - RNA, 23 nt, Homo sapiens
uucugaaaaccuaccagccagag

SEQ ID NO: 637180 - RNA, 15 nt, Homo sapiens
uucugaaacugcaua

SEQ ID NO: 637181 - RNA, 22 nt, Homo sapiens
uucugaacuggaacaugggcau

SEQ ID NO: 637182 - RNA, 14 nt, Homo sapiens
uucugaagggcaua

SEQ ID NO: 637183 - RNA, 16 nt, Homo sapiens
uucugacuuacuguca

SEQ ID NO: 637184 - RNA, 13 nt, Homo sapiens
uucugacuuauga

SEQ ID NO: 637185 - RNA, 23 nt, Homo sapiens
uucugacuugacuuuagucugca

SEQ ID NO: 637186 - RNA, 17 nt, Homo sapiens
uucugagaucuguugau

SEQ ID NO: 637187 - RNA, 14 nt, Homo sapiens
uucugagcacuguu

SEQ ID NO: 637188 - RNA, 20 nt, Homo sapiens
uucugagcauaaugcuccca

SEQ ID NO: 637189 - RNA, 23 nt, Homo sapiens
uucugaggcccugcccaaugaga

SEQ ID NO: 637190 - RNA, 16 nt, Homo sapiens
uucugauaaacacaau

SEQ ID NO: 637191 - RNA, 18 nt, Homo sapiens
uucugauaaaguuccuua

SEQ ID NO: 637192 - RNA, 16 nt, Homo sapiens
uucugauaaugcauua

SEQ ID NO: 637193 - RNA, 16 nt, Homo sapiens
uucugauaccacugca

SEQ ID NO: 637194 - RNA, 16 nt, Homo sapiens
uucugauacguguaug

SEQ ID NO: 637195 - RNA, 23 nt, Homo sapiens
uucugauccucagccccuccagu

SEQ ID NO: 637196 - RNA, 12 nt, Homo sapiens
uucugaucucag

SEQ ID NO: 637197 - RNA, 13 nt, Homo sapiens
uucugaugagcau

SEQ ID NO: 637198 - RNA, 14 nt, Homo sapiens
uucugauuucugcc

SEQ ID NO: 637199 - RNA, 17 nt, Homo sapiens
uucugcaccacaccugg

SEQ ID NO: 637200 - RNA, 16 nt, Homo sapiens
uucugcacuucauauc

SEQ ID NO: 637201 - RNA, 23 nt, Homo sapiens
uucugcagguugaagccaugucu

SEQ ID NO: 637202 - RNA, 16 nt, Homo sapiens
uucugcagucaucucc

SEQ ID NO: 637203 - RNA, 14 nt, Homo sapiens
uucugccgcuguca

SEQ ID NO: 637204 - RNA, 21 nt, Homo sapiens
uucugccuccauucugaccau

SEQ ID NO: 637205 - RNA, 17 nt, Homo sapiens
uucugccucuccaggca

SEQ ID NO: 637206 - RNA, 16 nt, Homo sapiens
uucugccuuguuucau

SEQ ID NO: 637207 - RNA, 15 nt, Homo sapiens
uucugcuaugacaaa

SEQ ID NO: 637208 - RNA, 23 nt, Homo sapiens
uucugcuguuuuuuuugcugcua

SEQ ID NO: 637209 - RNA, 16 nt, Homo sapiens
uucugcuuugcacagg

SEQ ID NO: 637210 - RNA, 21 nt, Homo sapiens
uucuggaaaaaaaauauauau

SEQ ID NO: 637211 - RNA, 16 nt, Homo sapiens
uucuggaaaagcaaaa

SEQ ID NO: 637212 - RNA, 14 nt, Homo sapiens
uucuggacaugacg

SEQ ID NO: 637213 - RNA, 20 nt, Homo sapiens
uucuggauuucauacuguaa

SEQ ID NO: 637214 - RNA, 17 nt, Homo sapiens
uucuggccucccacaga

SEQ ID NO: 637215 - RNA, 20 nt, Homo sapiens
uucuggcuucagcccccacc

SEQ ID NO: 637216 - RNA, 18 nt, Homo sapiens
uucugggaacuuccucag

SEQ ID NO: 637217 - RNA, 16 nt, Homo sapiens
uucuggguccugaaga

SEQ ID NO: 637218 - RNA, 19 nt, Homo sapiens
uucuggguggccucgggac

SEQ ID NO: 637219 - RNA, 15 nt, Homo sapiens
uucuggugggacaau

SEQ ID NO: 637220 - RNA, 17 nt, Homo sapiens
uucuguaauuacauauu

SEQ ID NO: 637221 - RNA, 11 nt, Homo sapiens
uucuguacaac

SEQ ID NO: 637222 - RNA, 14 nt, Homo sapiens
uucuguaguacucc

SEQ ID NO: 637223 - RNA, 21 nt, Homo sapiens
uucuguauauuugucaugaca

SEQ ID NO: 637224 - RNA, 14 nt, Homo sapiens
uucugucaauuuca

SEQ ID NO: 637225 - RNA, 15 nt, Homo sapiens
uucugucaccaaauu

SEQ ID NO: 637226 - RNA, 14 nt, Homo sapiens
uucugucuucccaa

SEQ ID NO: 637227 - RNA, 18 nt, Homo sapiens
uucugucuuuauaaucua

SEQ ID NO: 637228 - RNA, 16 nt, Homo sapiens
uucugugacugaagaa

SEQ ID NO: 637229 - RNA, 13 nt, Homo sapiens
uucugugaucuuu

SEQ ID NO: 637230 - RNA, 22 nt, Homo sapiens
uucugugccagacauugcucuc

SEQ ID NO: 637231 - RNA, 15 nt, Homo sapiens
uucuguggcuaaaca

SEQ ID NO: 637232 - RNA, 22 nt, Homo sapiens
uucugugggcuuggccuugugu

SEQ ID NO: 637233 - RNA, 20 nt, Homo sapiens
uucuguguugaagcacuguu

SEQ ID NO: 637234 - RNA, 13 nt, Homo sapiens
uucuguugccaca

SEQ ID NO: 637235 - RNA, 18 nt, Homo sapiens
uucuguuggcagagcuuu

SEQ ID NO: 637236 - RNA, 14 nt, Homo sapiens
uucuguuguuccau

SEQ ID NO: 637237 - RNA, 19 nt, Homo sapiens
uucuguuuaucaagccaua

SEQ ID NO: 637238 - RNA, 22 nt, Homo sapiens
uucuuaaaacaaagccaugcca

SEQ ID NO: 637239 - RNA, 21 nt, Homo sapiens
uucuuaaaauguuaacuggca

SEQ ID NO: 637240 - RNA, 14 nt, Homo sapiens
uucuuaaagccuua

SEQ ID NO: 637241 - RNA, 15 nt, Homo sapiens
uucuuaaauaagaaa

SEQ ID NO: 637242 - RNA, 14 nt, Homo sapiens
uucuuaaccaucuu

SEQ ID NO: 637243 - RNA, 18 nt, Homo sapiens
uucuuaacccuuuccaga

SEQ ID NO: 637244 - RNA, 19 nt, Homo sapiens
uucuuaacuuugaaccaua

SEQ ID NO: 637245 - RNA, 13 nt, Homo sapiens
uucuuaagacaug

SEQ ID NO: 637246 - RNA, 20 nt, Homo sapiens
uucuuaaguaaugauacugu

SEQ ID NO: 637247 - RNA, 21 nt, Homo sapiens
uucuuacaauugcacugcugu

SEQ ID NO: 637248 - RNA, 13 nt, Homo sapiens
uucuuacauauga

SEQ ID NO: 637249 - RNA, 19 nt, Homo sapiens
uucuuacauaugauccagu

SEQ ID NO: 637250 - RNA, 16 nt, Homo sapiens
uucuuacaucuguaaa

SEQ ID NO: 637251 - RNA, 14 nt, Homo sapiens
uucuuacucugaaa

SEQ ID NO: 637252 - RNA, 20 nt, Homo sapiens
uucuuagauacacuaaaaau

SEQ ID NO: 637253 - RNA, 15 nt, Homo sapiens
uucuuaguggaagac

SEQ ID NO: 637254 - RNA, 18 nt, Homo sapiens
uucuuauaccuucugaca

SEQ ID NO: 637255 - RNA, 23 nt, Homo sapiens
uucuuauuaaggaaauacuuugc

SEQ ID NO: 637256 - RNA, 16 nt, Homo sapiens
uucuucaagacucuga

SEQ ID NO: 637257 - RNA, 19 nt, Homo sapiens
uucuucacuuaaacucagc

SEQ ID NO: 637258 - RNA, 15 nt, Homo sapiens
uucuucagcucugaa

SEQ ID NO: 637259 - RNA, 11 nt, Homo sapiens
uucuucagggc

SEQ ID NO: 637260 - RNA, 16 nt, Homo sapiens
uucuucagggccaguc

SEQ ID NO: 637261 - RNA, 14 nt, Homo sapiens
uucuucaugaggcc

SEQ ID NO: 637262 - RNA, 14 nt, Homo sapiens
uucuucaugaucca

SEQ ID NO: 637263 - RNA, 12 nt, Homo sapiens
uucuucauuuca

SEQ ID NO: 637264 - RNA, 17 nt, Homo sapiens
uucuucccauacuugca

SEQ ID NO: 637265 - RNA, 21 nt, Homo sapiens
uucuuccgcaccgucccgcca

SEQ ID NO: 637266 - RNA, 20 nt, Homo sapiens
uucuuccugcauagucuguu

SEQ ID NO: 637267 - RNA, 21 nt, Homo sapiens
uucuuccuuaaagcauuugca

SEQ ID NO: 637268 - RNA, 12 nt, Homo sapiens
uucuucuagcuc

SEQ ID NO: 637269 - RNA, 13 nt, Homo sapiens
uucuucucauaaa

SEQ ID NO: 637270 - RNA, 15 nt, Homo sapiens
uucuucucuuauccu

SEQ ID NO: 637271 - RNA, 15 nt, Homo sapiens
uucuucuggggucag

SEQ ID NO: 637272 - RNA, 13 nt, Homo sapiens
uucuucugucaag

SEQ ID NO: 637273 - RNA, 16 nt, Homo sapiens
uaugagucuucuguaa

SEQ ID NO: 637274 - RNA, 22 nt, Homo sapiens
uaugagugcugauucaaaccaa

SEQ ID NO: 637275 - RNA, 17 nt, Homo sapiens
uaugauaaaacacugcc

SEQ ID NO: 637276 - RNA, 19 nt, Homo sapiens
uaugauaaaacacugcccu

SEQ ID NO: 637277 - RNA, 16 nt, Homo sapiens
uaugauauauugcugu

SEQ ID NO: 637278 - RNA, 19 nt, Homo sapiens
uaugauauuuugucuccua

SEQ ID NO: 637279 - RNA, 23 nt, Homo sapiens
uaugaugagaggccagcacauua

SEQ ID NO: 637280 - RNA, 11 nt, Homo sapiens
uaugaugcuaa

SEQ ID NO: 637281 - RNA, 15 nt, Homo sapiens
uaugaugggggaaaa

SEQ ID NO: 637282 - RNA, 15 nt, Homo sapiens
uaugauguaaucucu

SEQ ID NO: 637283 - RNA, 18 nt, Homo sapiens
uaugauucagauuguuau

SEQ ID NO: 637284 - RNA, 15 nt, Homo sapiens
uaugauuuaagacua

SEQ ID NO: 637285 - RNA, 19 nt, Homo sapiens
uaugauuuaagacuaugau

SEQ ID NO: 637286 - RNA, 19 nt, Homo sapiens
uaugcaaacaguucuugga

SEQ ID NO: 637287 - RNA, 18 nt, Homo sapiens
uaugcaaaccucaucuuu

SEQ ID NO: 637288 - RNA, 13 nt, Homo sapiens
uaugcaaccauaa

SEQ ID NO: 637289 - RNA, 17 nt, Homo sapiens
uaugcaacucaucuuca

SEQ ID NO: 637290 - RNA, 23 nt, Homo sapiens
uaugcaacucaucuucacagauu

SEQ ID NO: 637291 - RNA, 15 nt, Homo sapiens
uaugcaagugcaaaa

SEQ ID NO: 637292 - RNA, 13 nt, Homo sapiens
uaugcaauucuua

SEQ ID NO: 637293 - RNA, 14 nt, Homo sapiens
uaugcacauucacg

SEQ ID NO: 637294 - RNA, 14 nt, Homo sapiens
uaugcagaauguuu

SEQ ID NO: 637295 - RNA, 20 nt, Homo sapiens
uaugcagagccacagcugug

SEQ ID NO: 637296 - RNA, 19 nt, Homo sapiens
uaugcagagguccacaaca

SEQ ID NO: 637297 - RNA, 22 nt, Homo sapiens
uaugcaguaaauuaucuuggga

SEQ ID NO: 637298 - RNA, 21 nt, Homo sapiens
uucuuucuaacuguagcuauc

SEQ ID NO: 637299 - RNA, 16 nt, Homo sapiens
uucuuucuuaguccag

SEQ ID NO: 637300 - RNA, 22 nt, Homo sapiens
uucuuugacaucauucaugaca

SEQ ID NO: 637301 - RNA, 20 nt, Homo sapiens
uucuuugcugcagucaucua

SEQ ID NO: 637302 - RNA, 19 nt, Homo sapiens
uucuuuguauaugcauucu

SEQ ID NO: 637303 - RNA, 14 nt, Homo sapiens
uucuuugucuuauc

SEQ ID NO: 637304 - RNA, 20 nt, Homo sapiens
uucuuuuaauccaauccacu

SEQ ID NO: 637305 - RNA, 15 nt, Homo sapiens
uucuuuuaccacuga

SEQ ID NO: 637306 - RNA, 19 nt, Homo sapiens
uucuuuuauacugacacaa

SEQ ID NO: 637307 - RNA, 13 nt, Homo sapiens
uucuuuuauguga

SEQ ID NO: 637308 - RNA, 18 nt, Homo sapiens
uucuuuuauuaucaguua

SEQ ID NO: 637309 - RNA, 14 nt, Homo sapiens
uucuuuucacuucg

SEQ ID NO: 637310 - RNA, 22 nt, Homo sapiens
uucuuuuccugggaauggaaua

SEQ ID NO: 637311 - RNA, 19 nt, Homo sapiens
uucuuuuggcuuccaugau

SEQ ID NO: 637312 - RNA, 14 nt, Homo sapiens
uucuuuuugcucua

SEQ ID NO: 637313 - RNA, 15 nt, Homo sapiens
uucuuuuugcucuaa

SEQ ID NO: 637314 - RNA, 13 nt, Homo sapiens
uucuuuuuugcca

SEQ ID NO: 637315 - RNA, 20 nt, Homo sapiens
uugaaaaaaaacaguggauc

SEQ ID NO: 637316 - RNA, 21 nt, Homo sapiens
uugaaaaagggaagccauucc

SEQ ID NO: 637317 - RNA, 18 nt, Homo sapiens
uugaaaaauauugcuaaa

SEQ ID NO: 637318 - RNA, 13 nt, Homo sapiens
uugaaaacacuac

SEQ ID NO: 637319 - RNA, 12 nt, Homo sapiens
uugaaaacacuu

SEQ ID NO: 637320 - RNA, 12 nt, Homo sapiens
uugaaaaccugg

SEQ ID NO: 637321 - RNA, 16 nt, Homo sapiens
uugaaaacucacagaa

SEQ ID NO: 637322 - RNA, 16 nt, Homo sapiens
uugaaaauaaccuaau

SEQ ID NO: 637323 - RNA, 17 nt, Homo sapiens
uugaaaauaauuguucc

SEQ ID NO: 637324 - RNA, 19 nt, Homo sapiens
uugaaaauauuuuguugcc

SEQ ID NO: 637325 - RNA, 14 nt, Homo sapiens
uugaaaaugcauua

SEQ ID NO: 637326 - RNA, 14 nt, Homo sapiens
uugaaaauguucag

SEQ ID NO: 637327 - RNA, 14 nt, Homo sapiens
uugaaaccagaaga

SEQ ID NO: 637328 - RNA, 14 nt, Homo sapiens
uugaaacugaaugu

SEQ ID NO: 637329 - RNA, 23 nt, Homo sapiens
uugaaacuggaauaaguguuuau

SEQ ID NO: 637330 - RNA, 15 nt, Homo sapiens
uugaaagaaauggug

SEQ ID NO: 637331 - RNA, 14 nt, Homo sapiens
uugaaagaaccaga

SEQ ID NO: 637332 - RNA, 21 nt, Homo sapiens
uugaaagaacuuaagucucga

SEQ ID NO: 637333 - RNA, 20 nt, Homo sapiens
uugaaagaucaaaagguuaa

SEQ ID NO: 637334 - RNA, 12 nt, Homo sapiens
uugaaaguaaaa

SEQ ID NO: 637335 - RNA, 18 nt, Homo sapiens
uugaaaguuaacauuaau

SEQ ID NO: 637336 - RNA, 17 nt, Homo sapiens
uugaaauaagaaagugc

SEQ ID NO: 637337 - RNA, 19 nt, Homo sapiens
uugaaauaagaaagugcga

SEQ ID NO: 637338 - RNA, 23 nt, Homo sapiens
uugaaauaauaaaucugguagaa

SEQ ID NO: 637339 - RNA, 16 nt, Homo sapiens
uugaaauaccagugaa

SEQ ID NO: 637340 - RNA, 23 nt, Homo sapiens
uugaaauaccagugaaccaaaga

SEQ ID NO: 637341 - RNA, 13 nt, Homo sapiens
uugaaauauucag

SEQ ID NO: 637342 - RNA, 22 nt, Homo sapiens
uugaaaucaaugcaagagugau

SEQ ID NO: 637343 - RNA, 15 nt, Homo sapiens
uugaaaucugaaugc

SEQ ID NO: 637344 - RNA, 20 nt, Homo sapiens
uugaaaugagaaacuuugau

SEQ ID NO: 637345 - RNA, 22 nt, Homo sapiens
uugaaaugaguaaaaacuagaa

SEQ ID NO: 637346 - RNA, 16 nt, Homo sapiens
uugaaauggcauuuaa

SEQ ID NO: 637347 - RNA, 19 nt, Homo sapiens
uugaacaaccagaugguga

SEQ ID NO: 637348 - RNA, 23 nt, Homo sapiens
uugaacaacuaggcuucagcaua

SEQ ID NO: 637349 - RNA, 18 nt, Homo sapiens
uugaacacuagucugugu

SEQ ID NO: 637350 - RNA, 13 nt, Homo sapiens
uugaaccaauaau

SEQ ID NO: 637351 - RNA, 20 nt, Homo sapiens
uugaaccagugauccauguc

SEQ ID NO: 637352 - RNA, 15 nt, Homo sapiens
uugaaccugugcuca

SEQ ID NO: 637353 - RNA, 18 nt, Homo sapiens
uugaacuaggcugagcaa

SEQ ID NO: 637354 - RNA, 12 nt, Homo sapiens
uugaacugguuc

SEQ ID NO: 637355 - RNA, 19 nt, Homo sapiens
uugaacuguuagaugcuga

SEQ ID NO: 637356 - RNA, 22 nt, Homo sapiens
uugaacuucauaagguaauuca

SEQ ID NO: 637357 - RNA, 13 nt, Homo sapiens
uugaacuuugacc

SEQ ID NO: 637358 - RNA, 22 nt, Homo sapiens
uugaagaaucugccccuguuga

SEQ ID NO: 637359 - RNA, 12 nt, Homo sapiens
uugaagagcaaa

SEQ ID NO: 637360 - RNA, 17 nt, Homo sapiens
uugaagaggagaacaaa

SEQ ID NO: 637361 - RNA, 17 nt, Homo sapiens
uugaagaggccaaagga

SEQ ID NO: 637362 - RNA, 16 nt, Homo sapiens
uugaagauaguaacug

SEQ ID NO: 637363 - RNA, 19 nt, Homo sapiens
uugaagauaguaacuguag

SEQ ID NO: 637364 - RNA, 21 nt, Homo sapiens
uugaagauaguaacuguagau

SEQ ID NO: 637365 - RNA, 22 nt, Homo sapiens
uugaagauuuaugaugcacuua

SEQ ID NO: 637366 - RNA, 11 nt, Homo sapiens
uugaagccaaa

SEQ ID NO: 637367 - RNA, 13 nt, Homo sapiens
uugaagucuauaa

SEQ ID NO: 637368 - RNA, 14 nt, Homo sapiens
uugaaguguucuga

SEQ ID NO: 637369 - RNA, 19 nt, Homo sapiens
uugaaguguuugcuuuucu

SEQ ID NO: 637370 - RNA, 21 nt, Homo sapiens
uugaaguuuuagcggucaauu

SEQ ID NO: 637371 - RNA, 14 nt, Homo sapiens
uugaauacaaguuu

SEQ ID NO: 637372 - RNA, 21 nt, Homo sapiens
uugaauaccauuaaaacugcu

SEQ ID NO: 637373 - RNA, 14 nt, Homo sapiens
uugaauacugugaa

SEQ ID NO: 637374 - RNA, 21 nt, Homo sapiens
uugaauccagaacacaaccuu

SEQ ID NO: 637375 - RNA, 20 nt, Homo sapiens
uugaaucuacaaaaaacaac

SEQ ID NO: 637376 - RNA, 20 nt, Homo sapiens
uugaaucuacaacucugaaa

SEQ ID NO: 637377 - RNA, 15 nt, Homo sapiens
uugaaugaugagccu

SEQ ID NO: 637378 - RNA, 20 nt, Homo sapiens
uugaaugaugugauacaaau

SEQ ID NO: 637379 - RNA, 19 nt, Homo sapiens
uugaauggaaaacacaugg

SEQ ID NO: 637380 - RNA, 21 nt, Homo sapiens
uugaauggguccauuuugccc

SEQ ID NO: 637381 - RNA, 17 nt, Homo sapiens
uugaauguccuuuuaug

SEQ ID NO: 637382 - RNA, 19 nt, Homo sapiens
uugaaugugguuacuuccu

SEQ ID NO: 637383 - RNA, 23 nt, Homo sapiens
uugaauguugguuuuaauacuug

SEQ ID NO: 637384 - RNA, 17 nt, Homo sapiens
uugaauuccugggcuca

SEQ ID NO: 637385 - RNA, 15 nt, Homo sapiens
uugaauugcacugaa

SEQ ID NO: 637386 - RNA, 14 nt, Homo sapiens
uugaauuucacugu

SEQ ID NO: 637387 - RNA, 19 nt, Homo sapiens
uugaauuucugccaggcau

SEQ ID NO: 637388 - RNA, 18 nt, Homo sapiens
uugaauuugguaucuuau

SEQ ID NO: 637389 - RNA, 19 nt, Homo sapiens
uugacaaaaguaaauggga

SEQ ID NO: 637390 - RNA, 17 nt, Homo sapiens
uugacaaaguuacugau

SEQ ID NO: 637391 - RNA, 15 nt, Homo sapiens
uugacaacugugacu

SEQ ID NO: 637392 - RNA, 11 nt, Homo sapiens
uugacaaugau

SEQ ID NO: 637393 - RNA, 21 nt, Homo sapiens
uugacaccuagauuauagucu

SEQ ID NO: 637394 - RNA, 15 nt, Homo sapiens
uugacacugcucuaa

SEQ ID NO: 637395 - RNA, 17 nt, Homo sapiens
uugacaggaauacuuaa

SEQ ID NO: 637396 - RNA, 13 nt, Homo sapiens
uugacaggauuau

SEQ ID NO: 637397 - RNA, 11 nt, Homo sapiens
uugaccaaaga

SEQ ID NO: 637398 - RNA, 15 nt, Homo sapiens
uauuacgugcaauac

SEQ ID NO: 637399 - RNA, 15 nt, Homo sapiens
uauuacuaauucuau

SEQ ID NO: 637400 - RNA, 12 nt, Homo sapiens
uauuacugcugc

SEQ ID NO: 637401 - RNA, 14 nt, Homo sapiens
uauuacuugugcac

SEQ ID NO: 637402 - RNA, 14 nt, Homo sapiens
uauuagaaauuaga

SEQ ID NO: 637403 - RNA, 16 nt, Homo sapiens
uauuagcuuauauauu

SEQ ID NO: 637404 - RNA, 19 nt, Homo sapiens
uauuaggaaauucugauga

SEQ ID NO: 637405 - RNA, 15 nt, Homo sapiens
uauuaggccauauau

SEQ ID NO: 637406 - RNA, 18 nt, Homo sapiens
uauuaguuaaaacacaua

SEQ ID NO: 637407 - RNA, 20 nt, Homo sapiens
uauuauaauaagcaaaaaga

SEQ ID NO: 637408 - RNA, 17 nt, Homo sapiens
uauuauacgcuggcaac

SEQ ID NO: 637409 - RNA, 18 nt, Homo sapiens
uauuauagcaacuuuaag

SEQ ID NO: 637410 - RNA, 16 nt, Homo sapiens
uauuauauauuuacag

SEQ ID NO: 637411 - RNA, 14 nt, Homo sapiens
uauuauauuaucau

SEQ ID NO: 637412 - RNA, 23 nt, Homo sapiens
uauuaucccagcuugcugagggg

SEQ ID NO: 637413 - RNA, 18 nt, Homo sapiens
uauuauccuucuacuugu

SEQ ID NO: 637414 - RNA, 22 nt, Homo sapiens
uauuaucuaccuguucuguagc

SEQ ID NO: 637415 - RNA, 16 nt, Homo sapiens
uauuaucuguugccuu

SEQ ID NO: 637416 - RNA, 17 nt, Homo sapiens
uauuaugaauucacaga

SEQ ID NO: 637417 - RNA, 14 nt, Homo sapiens
uauuaugcuggaau

SEQ ID NO: 637418 - RNA, 17 nt, Homo sapiens
uauuauguaaauuuugc

SEQ ID NO: 637419 - RNA, 14 nt, Homo sapiens
uauuauguccugug

SEQ ID NO: 637420 - RNA, 20 nt, Homo sapiens
uugacuucuuugagaaugca

SEQ ID NO: 637421 - RNA, 16 nt, Homo sapiens
uugacuugaaggcagu

SEQ ID NO: 637422 - RNA, 14 nt, Homo sapiens
uugacuuucuaauu

SEQ ID NO: 637423 - RNA, 23 nt, Homo sapiens
uugacuuucugauuggugauuca

SEQ ID NO: 637424 - RNA, 20 nt, Homo sapiens
uugagaagucuaauucacag

SEQ ID NO: 637425 - RNA, 14 nt, Homo sapiens
uugagaaucccaaa

SEQ ID NO: 637426 - RNA, 17 nt, Homo sapiens
uugagacaggaugguua

SEQ ID NO: 637427 - RNA, 22 nt, Homo sapiens
uugagacuuucuucuagugcuu

SEQ ID NO: 637428 - RNA, 16 nt, Homo sapiens
uugagagccaguggcg

SEQ ID NO: 637429 - RNA, 20 nt, Homo sapiens
uugagauaaagucaaaugcc

SEQ ID NO: 637430 - RNA, 22 nt, Homo sapiens
uugagauaaagucaaaugccaa

SEQ ID NO: 637431 - RNA, 13 nt, Homo sapiens
uugagcaagccga

SEQ ID NO: 637432 - RNA, 13 nt, Homo sapiens
uugagcccaggag

SEQ ID NO: 637433 - RNA, 16 nt, Homo sapiens
uugagccggacaccaa

SEQ ID NO: 637434 - RNA, 21 nt, Homo sapiens
uugagccuuggcccacacuga

SEQ ID NO: 637435 - RNA, 14 nt, Homo sapiens
uugagcgacaucuc

SEQ ID NO: 637436 - RNA, 14 nt, Homo sapiens
uugagcgagcccau

SEQ ID NO: 637437 - RNA, 15 nt, Homo sapiens
uugagcgagcccauu

SEQ ID NO: 637438 - RNA, 15 nt, Homo sapiens
uugaggaagcucucc

SEQ ID NO: 637439 - RNA, 18 nt, Homo sapiens
uugaggagugucccgccu

SEQ ID NO: 637440 - RNA, 18 nt, Homo sapiens
uugaggccuuuuuugcca

SEQ ID NO: 637441 - RNA, 18 nt, Homo sapiens
uugaggcucugucacuga

SEQ ID NO: 637442 - RNA, 12 nt, Homo sapiens
uugaggcuuuca

SEQ ID NO: 637443 - RNA, 19 nt, Homo sapiens
uugaggggcuggccuuccu

SEQ ID NO: 637444 - RNA, 15 nt, Homo sapiens
uugagggguggaccc

SEQ ID NO: 637445 - RNA, 13 nt, Homo sapiens
uugaggugcaagg

SEQ ID NO: 637446 - RNA, 17 nt, Homo sapiens
uugaguagaguugauca

SEQ ID NO: 637447 - RNA, 14 nt, Homo sapiens
uugagucugucaca

SEQ ID NO: 637448 - RNA, 21 nt, Homo sapiens
uugagugacagcuuucuggga

SEQ ID NO: 637449 - RNA, 20 nt, Homo sapiens
uugagugacucgaggguugg

SEQ ID NO: 637450 - RNA, 19 nt, Homo sapiens
uugagugacuugagcccaa

SEQ ID NO: 637451 - RNA, 21 nt, Homo sapiens
uugaguuugucgcucaugugu

SEQ ID NO: 637452 - RNA, 22 nt, Homo sapiens
uugauaaaauaaaaaucauucu

SEQ ID NO: 637453 - RNA, 14 nt, Homo sapiens
uugauaaugggaug

SEQ ID NO: 637454 - RNA, 16 nt, Homo sapiens
uugauacaaaguacag

SEQ ID NO: 637455 - RNA, 21 nt, Homo sapiens
uugauagauuucuacacugag

SEQ ID NO: 637456 - RNA, 16 nt, Homo sapiens
uugauagcagauauca

SEQ ID NO: 637457 - RNA, 15 nt, Homo sapiens
uugauauaaucuuuc

SEQ ID NO: 637458 - RNA, 15 nt, Homo sapiens
uugauaucugaucaa

SEQ ID NO: 637459 - RNA, 19 nt, Homo sapiens
uugauauguuuuauuucau

SEQ ID NO: 637460 - RNA, 15 nt, Homo sapiens
uugauauuaucuaca

SEQ ID NO: 637461 - RNA, 14 nt, Homo sapiens
uugaucacuacaag

SEQ ID NO: 637462 - RNA, 13 nt, Homo sapiens
uugaucagacuga

SEQ ID NO: 637463 - RNA, 22 nt, Homo sapiens
uugaucauuuuuauaugaaaua

SEQ ID NO: 637464 - RNA, 15 nt, Homo sapiens
uugaucuagaugucu

SEQ ID NO: 637465 - RNA, 22 nt, Homo sapiens
uugaucucugcuuaccguucaa

SEQ ID NO: 637466 - RNA, 19 nt, Homo sapiens
uugaucuuaacaaagccuu

SEQ ID NO: 637467 - RNA, 22 nt, Homo sapiens
uugaucuuuugcuaaugcaauu

SEQ ID NO: 637468 - RNA, 19 nt, Homo sapiens
uugaugauuaauucaccuu

SEQ ID NO: 637469 - RNA, 14 nt, Homo sapiens
uugaugauuuccua

SEQ ID NO: 637470 - RNA, 17 nt, Homo sapiens
uugaugugaaacauuau

SEQ ID NO: 637471 - RNA, 18 nt, Homo sapiens
uugauguuaacugagcua

SEQ ID NO: 637472 - RNA, 23 nt, Homo sapiens
uugauguuaacugagcuacuaga

SEQ ID NO: 637473 - RNA, 20 nt, Homo sapiens
uugauguucagaguggcuca

SEQ ID NO: 637474 - RNA, 14 nt, Homo sapiens
uugauuauuugcau

SEQ ID NO: 637475 - RNA, 14 nt, Homo sapiens
uugauucagcucau

SEQ ID NO: 637476 - RNA, 16 nt, Homo sapiens
uugauucaucucuggu

SEQ ID NO: 637477 - RNA, 16 nt, Homo sapiens
uugauuccacauucca

SEQ ID NO: 637478 - RNA, 21 nt, Homo sapiens
uugauuccugguuugacucag

SEQ ID NO: 637479 - RNA, 12 nt, Homo sapiens
uugauucuugcc

SEQ ID NO: 637480 - RNA, 22 nt, Homo sapiens
uugauugaggagcugcacugau

SEQ ID NO: 637481 - RNA, 20 nt, Homo sapiens
uugauuugcucuuacuacag

SEQ ID NO: 637482 - RNA, 17 nt, Homo sapiens
uugauuuguagcacuga

SEQ ID NO: 637483 - RNA, 19 nt, Homo sapiens
uugauuuuaauccuguaua

SEQ ID NO: 637484 - RNA, 21 nt, Homo sapiens
uugauuuuaaugaaugccuaa

SEQ ID NO: 637485 - RNA, 22 nt, Homo sapiens
uugauuuuuauaaauacugcaa

SEQ ID NO: 637486 - RNA, 12 nt, Homo sapiens
uugcaaacuaug

SEQ ID NO: 637487 - RNA, 16 nt, Homo sapiens
uugcaaagaccaccuc

SEQ ID NO: 637488 - RNA, 19 nt, Homo sapiens
uugcaaagguuccaacugu

SEQ ID NO: 637489 - RNA, 21 nt, Homo sapiens
uugcaaagguuccaacuguau

SEQ ID NO: 637490 - RNA, 21 nt, Homo sapiens
uugcaaaguaucccuacugua

SEQ ID NO: 637491 - RNA, 16 nt, Homo sapiens
uugcaaauacauggau

SEQ ID NO: 637492 - RNA, 21 nt, Homo sapiens
uugcaaauauugguuaguauu

SEQ ID NO: 637493 - RNA, 15 nt, Homo sapiens
uugcaaaucaguguu

SEQ ID NO: 637494 - RNA, 21 nt, Homo sapiens
uugcaaccacugcaauaucuu

SEQ ID NO: 637495 - RNA, 16 nt, Homo sapiens
uugcaacuaaggacaa

SEQ ID NO: 637496 - RNA, 17 nt, Homo sapiens
uugcaacuaaggacaaa

SEQ ID NO: 637497 - RNA, 22 nt, Homo sapiens
uugcaacucacugauucucuac

SEQ ID NO: 637498 - RNA, 15 nt, Homo sapiens
uugcaagacauagaa

SEQ ID NO: 637499 - RNA, 17 nt, Homo sapiens
uugcaauacauuucaau

SEQ ID NO: 637500 - RNA, 16 nt, Homo sapiens
uugcaaucuucuacuu

SEQ ID NO: 637501 - RNA, 19 nt, Homo sapiens
uugcacaaaaucacacagc

SEQ ID NO: 637502 - RNA, 13 nt, Homo sapiens
uugcacacccacu

SEQ ID NO: 637503 - RNA, 13 nt, Homo sapiens
uugcacagaauuu

SEQ ID NO: 637504 - RNA, 19 nt, Homo sapiens
uugcacagagcacacuuau

SEQ ID NO: 637505 - RNA, 12 nt, Homo sapiens
uugcacagcagc

SEQ ID NO: 637506 - RNA, 11 nt, Homo sapiens
uugcacaggau

SEQ ID NO: 637507 - RNA, 15 nt, Homo sapiens
uugcacagggauucu

SEQ ID NO: 637508 - RNA, 20 nt, Homo sapiens
uugcacaguaggauguggaa

SEQ ID NO: 637509 - RNA, 19 nt, Homo sapiens
uugcacauaacaugcuuua

SEQ ID NO: 637510 - RNA, 22 nt, Homo sapiens
uugcacaugaacauauguccau

SEQ ID NO: 637511 - RNA, 18 nt, Homo sapiens
uugcacauuaaucagauu

SEQ ID NO: 637512 - RNA, 20 nt, Homo sapiens
uugcacauuaaucagauuag

SEQ ID NO: 637513 - RNA, 18 nt, Homo sapiens
uugcaccaaagacaucag

SEQ ID NO: 637514 - RNA, 17 nt, Homo sapiens
uugcaccuaucucagcc

SEQ ID NO: 637515 - RNA, 16 nt, Homo sapiens
uugcaccucuguucau

SEQ ID NO: 637516 - RNA, 14 nt, Homo sapiens
uugcacucaucaua

SEQ ID NO: 637517 - RNA, 13 nt, Homo sapiens
uugcacuguuacu

SEQ ID NO: 637518 - RNA, 18 nt, Homo sapiens
uugcagaagagaaacuga

SEQ ID NO: 637519 - RNA, 20 nt, Homo sapiens
uugcagagaaccucagauca

SEQ ID NO: 637520 - RNA, 17 nt, Homo sapiens
uugcagaguggccuaga

SEQ ID NO: 637521 - RNA, 16 nt, Homo sapiens
uugcagcaggugguaa

SEQ ID NO: 637522 - RNA, 16 nt, Homo sapiens
uauuuccaaaagcaca

SEQ ID NO: 637523 - RNA, 16 nt, Homo sapiens
uauuuccacugaacaa

SEQ ID NO: 637524 - RNA, 22 nt, Homo sapiens
uauuuccaucagcccaucucaa

SEQ ID NO: 637525 - RNA, 17 nt, Homo sapiens
uauuuccaucuaggacu

SEQ ID NO: 637526 - RNA, 19 nt, Homo sapiens
uauuuccauucaacaagag

SEQ ID NO: 637527 - RNA, 19 nt, Homo sapiens
uauuucccauuugugccag

SEQ ID NO: 637528 - RNA, 22 nt, Homo sapiens
uauuuccccaccccacuauccu

SEQ ID NO: 637529 - RNA, 16 nt, Homo sapiens
uauuuccccugucagu

SEQ ID NO: 637530 - RNA, 12 nt, Homo sapiens
uauuuccuugcc

SEQ ID NO: 637531 - RNA, 15 nt, Homo sapiens
uauuucuacauaguc

SEQ ID NO: 637532 - RNA, 22 nt, Homo sapiens
uauuucuucuacugcuaucuac

SEQ ID NO: 637533 - RNA, 13 nt, Homo sapiens
uauuucuugaaga

SEQ ID NO: 637534 - RNA, 20 nt, Homo sapiens
uauuucuuuacagaauggau

SEQ ID NO: 637535 - RNA, 16 nt, Homo sapiens
uauuugaaaacauaua

SEQ ID NO: 637536 - RNA, 12 nt, Homo sapiens
uauuugaaugau

SEQ ID NO: 637537 - RNA, 14 nt, Homo sapiens
uauuugacuuacca

SEQ ID NO: 637538 - RNA, 17 nt, Homo sapiens
uauuugagagacauuug

SEQ ID NO: 637539 - RNA, 17 nt, Homo sapiens
uauuugcacuucaccuu

SEQ ID NO: 637540 - RNA, 18 nt, Homo sapiens
uauuugcagaagcuguga

SEQ ID NO: 637541 - RNA, 21 nt, Homo sapiens
uauuugcaguucaccugcacu

SEQ ID NO: 637542 - RNA, 15 nt, Homo sapiens
uugcauuuguaaaaa

SEQ ID NO: 637543 - RNA, 14 nt, Homo sapiens
uugccaaaaacaaa

SEQ ID NO: 637544 - RNA, 15 nt, Homo sapiens
uugccaaaaccaaga

SEQ ID NO: 637545 - RNA, 14 nt, Homo sapiens
uugccaaacagcca

SEQ ID NO: 637546 - RNA, 22 nt, Homo sapiens
uugccaaacagcccaaacugua

SEQ ID NO: 637547 - RNA, 18 nt, Homo sapiens
uugccaaagagaaacaaa

SEQ ID NO: 637548 - RNA, 24 nt, Homo sapiens
uugccaagacaaaucaacagaagc

SEQ ID NO: 637549 - RNA, 18 nt, Homo sapiens
uugccaagcagugcacau

SEQ ID NO: 637550 - RNA, 23 nt, Homo sapiens
uugccaagcagugcacauuucau

SEQ ID NO: 637551 - RNA, 18 nt, Homo sapiens
uugccaaggcaagaucua

SEQ ID NO: 637552 - RNA, 20 nt, Homo sapiens
uugccaagugccuaugcaaa

SEQ ID NO: 637553 - RNA, 21 nt, Homo sapiens
uugccaauuuuccuacucuca

SEQ ID NO: 637554 - RNA, 18 nt, Homo sapiens
uugccacagaugauacuu

SEQ ID NO: 637555 - RNA, 21 nt, Homo sapiens
uugccacagaugauacuucca

SEQ ID NO: 637556 - RNA, 12 nt, Homo sapiens
uugccaccagaa

SEQ ID NO: 637557 - RNA, 17 nt, Homo sapiens
uugccaccagaaaccac

SEQ ID NO: 637558 - RNA, 19 nt, Homo sapiens
uugccacggaaacauacag

SEQ ID NO: 637559 - RNA, 19 nt, Homo sapiens
uugccacugcugugugauu

SEQ ID NO: 637560 - RNA, 18 nt, Homo sapiens
uugccagaugcaauacaa

SEQ ID NO: 637561 - RNA, 23 nt, Homo sapiens
uugccagauuaccgacacuguca

SEQ ID NO: 637562 - RNA, 22 nt, Homo sapiens
uugccagcgauuuuaguucaau

SEQ ID NO: 637563 - RNA, 17 nt, Homo sapiens
uugccaguauuaugcau

SEQ ID NO: 637564 - RNA, 20 nt, Homo sapiens
uugccauagcugacuacaaa

SEQ ID NO: 637565 - RNA, 23 nt, Homo sapiens
uugccauccugauggaccugccc

SEQ ID NO: 637566 - RNA, 12 nt, Homo sapiens
uugccauucaag

SEQ ID NO: 637567 - RNA, 21 nt, Homo sapiens
uugccauuccucuacugcaau

SEQ ID NO: 637568 - RNA, 15 nt, Homo sapiens
uugccauugccagga

SEQ ID NO: 637569 - RNA, 13 nt, Homo sapiens
uugcccaccccuc

SEQ ID NO: 637570 - RNA, 19 nt, Homo sapiens
uugccccacccaacaagcc

SEQ ID NO: 637571 - RNA, 15 nt, Homo sapiens
uugcccccuugccca

SEQ ID NO: 637572 - RNA, 19 nt, Homo sapiens
uugcccugaguggaucucc

SEQ ID NO: 637573 - RNA, 18 nt, Homo sapiens
uugcccuuccuacuccuc

SEQ ID NO: 637574 - RNA, 19 nt, Homo sapiens
uugccuaagacuugcccaa

SEQ ID NO: 637575 - RNA, 22 nt, Homo sapiens
uugccucuacuuugauucugau

SEQ ID NO: 637576 - RNA, 16 nt, Homo sapiens
uugccucucucaggag

SEQ ID NO: 637577 - RNA, 21 nt, Homo sapiens
uugccugaaguuggagugagu

SEQ ID NO: 637578 - RNA, 12 nt, Homo sapiens
uugccugcaaaa

SEQ ID NO: 637579 - RNA, 13 nt, Homo sapiens
uugccugcaaaaa

SEQ ID NO: 637580 - RNA, 20 nt, Homo sapiens
uugccugccuggugugccuc

SEQ ID NO: 637581 - RNA, 15 nt, Homo sapiens
uugccuuaaccaguc

SEQ ID NO: 637582 - RNA, 21 nt, Homo sapiens
uugccuuaaccagucucucaa

SEQ ID NO: 637583 - RNA, 15 nt, Homo sapiens
uugccuucucugccc

SEQ ID NO: 637584 - RNA, 18 nt, Homo sapiens
uugccuuuccaggguuau

SEQ ID NO: 637585 - RNA, 20 nt, Homo sapiens
uugccuuuugcaaccaggaa

SEQ ID NO: 637586 - RNA, 19 nt, Homo sapiens
uugcgacaccucaaggugu

SEQ ID NO: 637587 - RNA, 20 nt, Homo sapiens
uugcgagccucgcagccucc

SEQ ID NO: 637588 - RNA, 21 nt, Homo sapiens
uugcggaagcuguuggaugau

SEQ ID NO: 637589 - RNA, 20 nt, Homo sapiens
uugcgucaagucuaaaccaa

SEQ ID NO: 637590 - RNA, 22 nt, Homo sapiens
uugcgucaagucuaaaccaaga

SEQ ID NO: 637591 - RNA, 16 nt, Homo sapiens
uugcgucucaaucucc

SEQ ID NO: 637592 - RNA, 23 nt, Homo sapiens
uugcuaacugugcuccucacuuc

SEQ ID NO: 637593 - RNA, 15 nt, Homo sapiens
uugcuaccucaaggg

SEQ ID NO: 637594 - RNA, 12 nt, Homo sapiens
uugcuacuguca

SEQ ID NO: 637595 - RNA, 12 nt, Homo sapiens
uugcuagauuuc

SEQ ID NO: 637596 - RNA, 17 nt, Homo sapiens
uugcuagccaucuugau

SEQ ID NO: 637597 - RNA, 18 nt, Homo sapiens
uugcuaugagguuugcuu

SEQ ID NO: 637598 - RNA, 14 nt, Homo sapiens
uugcucaguuccau

SEQ ID NO: 637599 - RNA, 23 nt, Homo sapiens
uugcucauaagcaauaccagcaa

SEQ ID NO: 637600 - RNA, 18 nt, Homo sapiens
uugcucccuguugcugaa

SEQ ID NO: 637601 - RNA, 19 nt, Homo sapiens
uugcuccuggguucaagua

SEQ ID NO: 637602 - RNA, 20 nt, Homo sapiens
uugcucuaggaagacauuuu

SEQ ID NO: 637603 - RNA, 15 nt, Homo sapiens
uugcucuaugucugc

SEQ ID NO: 637604 - RNA, 19 nt, Homo sapiens
uugcucugagaaaguacaa

SEQ ID NO: 637605 - RNA, 18 nt, Homo sapiens
uugcucuuacuacacuga

SEQ ID NO: 637606 - RNA, 13 nt, Homo sapiens
uugcucuuuggua

SEQ ID NO: 637607 - RNA, 14 nt, Homo sapiens
uugcugaacucagc

SEQ ID NO: 637608 - RNA, 12 nt, Homo sapiens
uugcugacaggu

SEQ ID NO: 637609 - RNA, 16 nt, Homo sapiens
uugcugaguuguucua

SEQ ID NO: 637610 - RNA, 14 nt, Homo sapiens
uugcugcaaagaga

SEQ ID NO: 637611 - RNA, 14 nt, Homo sapiens
uugcugccaaaugc

SEQ ID NO: 637612 - RNA, 20 nt, Homo sapiens
uugcugccuuaaugacauuc

SEQ ID NO: 637613 - RNA, 15 nt, Homo sapiens
uugcugccuuugucc

SEQ ID NO: 637614 - RNA, 15 nt, Homo sapiens
uugcugcugugaauc

SEQ ID NO: 637615 - RNA, 16 nt, Homo sapiens
uugcuggaaaccaagu

SEQ ID NO: 637616 - RNA, 14 nt, Homo sapiens
uugcuggacuguca

SEQ ID NO: 637617 - RNA, 15 nt, Homo sapiens
uugcuggaguacuua

SEQ ID NO: 637618 - RNA, 19 nt, Homo sapiens
uugcuguccugaucuguga

SEQ ID NO: 637619 - RNA, 17 nt, Homo sapiens
uugcugugcguggaaug

SEQ ID NO: 637620 - RNA, 21 nt, Homo sapiens
uugcugugggugcagcuguca

SEQ ID NO: 637621 - RNA, 23 nt, Homo sapiens
uugcugugggugcagcugucaca

SEQ ID NO: 637622 - RNA, 12 nt, Homo sapiens
uugcuguucacc

SEQ ID NO: 637623 - RNA, 12 nt, Homo sapiens
uugcuucaauua

SEQ ID NO: 637624 - RNA, 16 nt, Homo sapiens
uugcuucagacaugua

SEQ ID NO: 637625 - RNA, 13 nt, Homo sapiens
uugcuucagugga

SEQ ID NO: 637626 - RNA, 14 nt, Homo sapiens
uugcuuccauuauu

SEQ ID NO: 637627 - RNA, 23 nt, Homo sapiens
uugcuuccugauuaccagucuga

SEQ ID NO: 637628 - RNA, 20 nt, Homo sapiens
uugcuucuguaguacuccuu

SEQ ID NO: 637629 - RNA, 13 nt, Homo sapiens
uugcuucuugcca

SEQ ID NO: 637630 - RNA, 21 nt, Homo sapiens
uugcuugccgagccuaaugaa

SEQ ID NO: 637631 - RNA, 20 nt, Homo sapiens
uugcuuuaaaguaccuguag

SEQ ID NO: 637632 - RNA, 22 nt, Homo sapiens
uugcuuuagcacaggacaacuu

SEQ ID NO: 637633 - RNA, 14 nt, Homo sapiens
uugcuuugggagac

SEQ ID NO: 637634 - RNA, 18 nt, Homo sapiens
uugcuuuugccucugccc

SEQ ID NO: 637635 - RNA, 16 nt, Homo sapiens
uuggaaaacacuuuca

SEQ ID NO: 637636 - RNA, 15 nt, Homo sapiens
uuggaaaaugugcaa

SEQ ID NO: 637637 - RNA, 17 nt, Homo sapiens
uuggaaaaugugcaaua

SEQ ID NO: 637638 - RNA, 13 nt, Homo sapiens
uuggaaacagaga

SEQ ID NO: 637639 - RNA, 14 nt, Homo sapiens
uuggaaaguacucc

SEQ ID NO: 637640 - RNA, 22 nt, Homo sapiens
uuggaaauagaaauuuccagag

SEQ ID NO: 637641 - RNA, 14 nt, Homo sapiens
uuggaaaucugcca

SEQ ID NO: 637642 - RNA, 13 nt, Homo sapiens
uuggaaccaaagu

SEQ ID NO: 637643 - RNA, 17 nt, Homo sapiens
uuggaacuuacauacau

SEQ ID NO: 637644 - RNA, 15 nt, Homo sapiens
uuggaaucacauucu

SEQ ID NO: 637645 - RNA, 13 nt, Homo sapiens
uuggaaugaagga

SEQ ID NO: 637646 - RNA, 20 nt, Homo sapiens
ucaaaggaaaauaguaaugu

SEQ ID NO: 637647 - RNA, 17 nt, Homo sapiens
ucaaaggagcuuucuca

SEQ ID NO: 637648 - RNA, 18 nt, Homo sapiens
ucaaaggagcuuucucaa

SEQ ID NO: 637649 - RNA, 18 nt, Homo sapiens
ucaaaguaaaacuugcug

SEQ ID NO: 637650 - RNA, 20 nt, Homo sapiens
ucaaaguaaagaacacgaaa

SEQ ID NO: 637651 - RNA, 19 nt, Homo sapiens
ucaaagucuaacauauuca

SEQ ID NO: 637652 - RNA, 17 nt, Homo sapiens
ucaaagugacuauucag

SEQ ID NO: 637653 - RNA, 14 nt, Homo sapiens
ucaaaguuaauuca

SEQ ID NO: 637654 - RNA, 21 nt, Homo sapiens
ucaaaguuuggauuguaucaa

SEQ ID NO: 637655 - RNA, 21 nt, Homo sapiens
ucaaauacauuuaaaacauua

SEQ ID NO: 637656 - RNA, 19 nt, Homo sapiens
ucaaauagauggauuugua

SEQ ID NO: 637657 - RNA, 14 nt, Homo sapiens
ucaaauagcauaag

SEQ ID NO: 637658 - RNA, 22 nt, Homo sapiens
ucaaauaggcuauuaaaaaagu

SEQ ID NO: 637659 - RNA, 21 nt, Homo sapiens
ucaaauauauuucaagcuaua

SEQ ID NO: 637660 - RNA, 14 nt, Homo sapiens
ucaaauauuugcug

SEQ ID NO: 637661 - RNA, 15 nt, Homo sapiens
ucaaaucaaaccuca

SEQ ID NO: 637662 - RNA, 16 nt, Homo sapiens
ucaaaucaaaccucag

SEQ ID NO: 637663 - RNA, 14 nt, Homo sapiens
ucaaaucauuccuu

SEQ ID NO: 637664 - RNA, 15 nt, Homo sapiens
gcuccaggacucccu

SEQ ID NO: 637665 - RNA, 19 nt, Homo sapiens
gcuccagggaauccaagcc

SEQ ID NO: 637666 - RNA, 23 nt, Homo sapiens
gcuccagggcagccuccaccuug

SEQ ID NO: 637667 - RNA, 13 nt, Homo sapiens
gcuccaguaucuc

SEQ ID NO: 637668 - RNA, 16 nt, Homo sapiens
gcuccaguguaucuca

SEQ ID NO: 637669 - RNA, 16 nt, Homo sapiens
gcucccaaaacauuuu

SEQ ID NO: 637670 - RNA, 22 nt, Homo sapiens
gcucccacaaugcugaugaaaa

SEQ ID NO: 637671 - RNA, 14 nt, Homo sapiens
gcucccacagaaca

SEQ ID NO: 637672 - RNA, 22 nt, Homo sapiens
gcucccacauucugaugagcaa

SEQ ID NO: 637673 - RNA, 23 nt, Homo sapiens
gcucccacauucugaugagcaac

SEQ ID NO: 637674 - RNA, 21 nt, Homo sapiens
gcucccacuauggugggagac

SEQ ID NO: 637675 - RNA, 12 nt, Homo sapiens
gcucccauuccu

SEQ ID NO: 637676 - RNA, 18 nt, Homo sapiens
gcuccccagaacuggcug

SEQ ID NO: 637677 - RNA, 16 nt, Homo sapiens
gcuccccucacucugu

SEQ ID NO: 637678 - RNA, 20 nt, Homo sapiens
gcucccgaagccugagcuca

SEQ ID NO: 637679 - RNA, 15 nt, Homo sapiens
gcucccuacauuccc

SEQ ID NO: 637680 - RNA, 20 nt, Homo sapiens
gcucccuagccagaggcucu

SEQ ID NO: 637681 - RNA, 22 nt, Homo sapiens
gcucccuagguaggcaccacag

SEQ ID NO: 637682 - RNA, 14 nt, Homo sapiens
gcucccuccuccag

SEQ ID NO: 637683 - RNA, 22 nt, Homo sapiens
gcucccucuauuuauguuugca

SEQ ID NO: 637684 - RNA, 13 nt, Homo sapiens
gcuccgaccucuc

SEQ ID NO: 637685 - RNA, 18 nt, Homo sapiens
gcuccggaggacucacca

SEQ ID NO: 637686 - RNA, 22 nt, Homo sapiens
gcuccgggcaaauggcugagau

SEQ ID NO: 637687 - RNA, 22 nt, Homo sapiens
cccgucauguuccucaaaagca

SEQ ID NO: 637688 - RNA, 14 nt, Homo sapiens
cccgucgugcaguc

SEQ ID NO: 637689 - RNA, 16 nt, Homo sapiens
cccgucgugcagucag

SEQ ID NO: 637690 - RNA, 23 nt, Homo sapiens
cccguuucuuaaaaaacauauau

SEQ ID NO: 637691 - RNA, 21 nt, Homo sapiens
cccuaaaaauccagacucuuu

SEQ ID NO: 637692 - RNA, 13 nt, Homo sapiens
cccuaaaauccau

SEQ ID NO: 637693 - RNA, 10 nt, Homo sapiens
cccuaaggga

SEQ ID NO: 637694 - RNA, 20 nt, Homo sapiens
cccuaaguaaguuucuuccu

SEQ ID NO: 637695 - RNA, 12 nt, Homo sapiens
cccuaaguacaa

SEQ ID NO: 637696 - RNA, 20 nt, Homo sapiens
cccuaaucuuucacuugaaa

SEQ ID NO: 637697 - RNA, 14 nt, Homo sapiens
cccuacacugugaa

SEQ ID NO: 637698 - RNA, 12 nt, Homo sapiens
cccuacagaauu

SEQ ID NO: 637699 - RNA, 11 nt, Homo sapiens
cccuacaugga

SEQ ID NO: 637700 - RNA, 18 nt, Homo sapiens
cccuaccagcgcccgcug

SEQ ID NO: 637701 - RNA, 14 nt, Homo sapiens
cccuacccaccgau

SEQ ID NO: 637702 - RNA, 18 nt, Homo sapiens
cccuacuauucaguggcg

SEQ ID NO: 637703 - RNA, 15 nt, Homo sapiens
cccuacucaccugag

SEQ ID NO: 637704 - RNA, 15 nt, Homo sapiens
cccuacuccacugcc

SEQ ID NO: 637705 - RNA, 20 nt, Homo sapiens
cccuacucccucuucacugu

SEQ ID NO: 637706 - RNA, 16 nt, Homo sapiens
cccuacugcaaauggc

SEQ ID NO: 637707 - RNA, 13 nt, Homo sapiens
cccuacugcugug

SEQ ID NO: 637708 - RNA, 15 nt, Homo sapiens
cccuacugcugugaa

SEQ ID NO: 637709 - RNA, 13 nt, Homo sapiens
cccuacuggaguc

SEQ ID NO: 637710 - RNA, 23 nt, Homo sapiens
cccuacuuugcuuccgccacuca

SEQ ID NO: 637711 - RNA, 15 nt, Homo sapiens
cccuagaaacccaag

SEQ ID NO: 637712 - RNA, 16 nt, Homo sapiens
cccuagccaaugucuc

SEQ ID NO: 637713 - RNA, 23 nt, Homo sapiens
cccuagccagagaauagaucagu

SEQ ID NO: 637714 - RNA, 17 nt, Homo sapiens
cccuagccagaggcucu

SEQ ID NO: 637715 - RNA, 19 nt, Homo sapiens
cccuagcgcucucuuccag

SEQ ID NO: 637716 - RNA, 13 nt, Homo sapiens
cccuagcugaccc

SEQ ID NO: 637717 - RNA, 20 nt, Homo sapiens
cccuaggaaacucacacucc

SEQ ID NO: 637718 - RNA, 22 nt, Homo sapiens
cccuaguuaguguuuugccuca

SEQ ID NO: 637719 - RNA, 14 nt, Homo sapiens
cccuauccacaggg

SEQ ID NO: 637720 - RNA, 22 nt, Homo sapiens
cccuaugugggugggaccacag

SEQ ID NO: 637721 - RNA, 20 nt, Homo sapiens
cccuauuugauaugcugucc

SEQ ID NO: 637722 - RNA, 17 nt, Homo sapiens
cccucaaaucugaggga

SEQ ID NO: 637723 - RNA, 18 nt, Homo sapiens
cccucaacaccucugcac

SEQ ID NO: 637724 - RNA, 23 nt, Homo sapiens
cccucaacaccucugcacaagcu

SEQ ID NO: 637725 - RNA, 19 nt, Homo sapiens
cccucaaugcagucagugu

SEQ ID NO: 637726 - RNA, 22 nt, Homo sapiens
cccucacuccugccaguugaaa

SEQ ID NO: 637727 - RNA, 14 nt, Homo sapiens
cccucacugagccu

SEQ ID NO: 637728 - RNA, 15 nt, Homo sapiens
cccucagagugcaag

SEQ ID NO: 637729 - RNA, 18 nt, Homo sapiens
cccucagagugcaagccc

SEQ ID NO: 637730 - RNA, 13 nt, Homo sapiens
cccucagauucca

SEQ ID NO: 637731 - RNA, 20 nt, Homo sapiens
cccucagauuccaccuagag

SEQ ID NO: 637732 - RNA, 22 nt, Homo sapiens
cccucagauuugaugauuuccu

SEQ ID NO: 637733 - RNA, 18 nt, Homo sapiens
cccucagauuuuauauuu

SEQ ID NO: 637734 - RNA, 12 nt, Homo sapiens
cccucagcacug

SEQ ID NO: 637735 - RNA, 20 nt, Homo sapiens
cccucaggagccucugcucc

SEQ ID NO: 637736 - RNA, 16 nt, Homo sapiens
cccucagggagcgauc

SEQ ID NO: 637737 - RNA, 17 nt, Homo sapiens
cccucagggaucuugca

SEQ ID NO: 637738 - RNA, 15 nt, Homo sapiens
cccucagguguagcu

SEQ ID NO: 637739 - RNA, 18 nt, Homo sapiens
cccucaugaaaacacaca

SEQ ID NO: 637740 - RNA, 14 nt, Homo sapiens
cccuccaaaagcac

SEQ ID NO: 637741 - RNA, 12 nt, Homo sapiens
cccuccaaagag

SEQ ID NO: 637742 - RNA, 21 nt, Homo sapiens
cccuccaaaggucugaugucu

SEQ ID NO: 637743 - RNA, 20 nt, Homo sapiens
cccuccaagccuggcaccca

SEQ ID NO: 637744 - RNA, 22 nt, Homo sapiens
cccuccacgugauuuccaguga

SEQ ID NO: 637745 - RNA, 21 nt, Homo sapiens
cccuccauaaguuuaacuuua

SEQ ID NO: 637746 - RNA, 14 nt, Homo sapiens
cccuccccagugcc

SEQ ID NO: 637747 - RNA, 17 nt, Homo sapiens
cccuccccucagcgcag

SEQ ID NO: 637748 - RNA, 16 nt, Homo sapiens
cccuccccucguguca

SEQ ID NO: 637749 - RNA, 14 nt, Homo sapiens
cccucccugcccaa

SEQ ID NO: 637750 - RNA, 19 nt, Homo sapiens
cccuccgaccucucucggc

SEQ ID NO: 637751 - RNA, 21 nt, Homo sapiens
cccuccucagauggggcacca

SEQ ID NO: 637752 - RNA, 13 nt, Homo sapiens
cccuccuccacuu

SEQ ID NO: 637753 - RNA, 20 nt, Homo sapiens
cccuccuccagaccauucag

SEQ ID NO: 637754 - RNA, 13 nt, Homo sapiens
cccuccuccagua

SEQ ID NO: 637755 - RNA, 14 nt, Homo sapiens
cccuccucuuggaa

SEQ ID NO: 637756 - RNA, 12 nt, Homo sapiens
cccuccuguaaa

SEQ ID NO: 637757 - RNA, 19 nt, Homo sapiens
cccuccugugcugggggaa

SEQ ID NO: 637758 - RNA, 14 nt, Homo sapiens
cccuccuuaucaaa

SEQ ID NO: 637759 - RNA, 13 nt, Homo sapiens
cccuccuucaucc

SEQ ID NO: 637760 - RNA, 17 nt, Homo sapiens
cccuccuuucuuccucc

SEQ ID NO: 637761 - RNA, 15 nt, Homo sapiens
cccucgcaugacugu

SEQ ID NO: 637762 - RNA, 15 nt, Homo sapiens
cccucuaagggaccu

SEQ ID NO: 637763 - RNA, 23 nt, Homo sapiens
cccucucccuggggauaugcaac

SEQ ID NO: 637764 - RNA, 19 nt, Homo sapiens
cccucucucacacaucaca

SEQ ID NO: 637765 - RNA, 14 nt, Homo sapiens
cccucucucugggc

SEQ ID NO: 637766 - RNA, 14 nt, Homo sapiens
cccucucugaaccu

SEQ ID NO: 637767 - RNA, 23 nt, Homo sapiens
cccucugacucuaagaauucucu

SEQ ID NO: 637768 - RNA, 21 nt, Homo sapiens
cccucugucggcuuuuugcca

SEQ ID NO: 637769 - RNA, 18 nt, Homo sapiens
cccucuguggucacagag

SEQ ID NO: 637770 - RNA, 13 nt, Homo sapiens
cccucuuaucuca

SEQ ID NO: 637771 - RNA, 11 nt, Homo sapiens
cccucuuccaa

SEQ ID NO: 637772 - RNA, 13 nt, Homo sapiens
cccucuucccuga

SEQ ID NO: 637773 - RNA, 15 nt, Homo sapiens
cccucuuccugugau

SEQ ID NO: 637774 - RNA, 15 nt, Homo sapiens
cccucuugccagccu

SEQ ID NO: 637775 - RNA, 14 nt, Homo sapiens
cccucuuugaggga

SEQ ID NO: 637776 - RNA, 20 nt, Homo sapiens
cccucuuuggaacagauauu

SEQ ID NO: 637777 - RNA, 14 nt, Homo sapiens
cccucuuuuggcca

SEQ ID NO: 637778 - RNA, 23 nt, Homo sapiens
cccugaaacacgaaacuuguuau

SEQ ID NO: 637779 - RNA, 17 nt, Homo sapiens
cccugaacccacugcug

SEQ ID NO: 637780 - RNA, 19 nt, Homo sapiens
cccugaccuguccagguga

SEQ ID NO: 637781 - RNA, 18 nt, Homo sapiens
cccugacgugcagccaca

SEQ ID NO: 637782 - RNA, 22 nt, Homo sapiens
cccugagauacuucccaaagcc

SEQ ID NO: 637783 - RNA, 13 nt, Homo sapiens
cccugagcaaugu

SEQ ID NO: 637784 - RNA, 16 nt, Homo sapiens
cccugaggcucaggga

SEQ ID NO: 637785 - RNA, 18 nt, Homo sapiens
cccugaguggaucuccaa

SEQ ID NO: 637786 - RNA, 12 nt, Homo sapiens
cccugaucuuca

SEQ ID NO: 637787 - RNA, 15 nt, Homo sapiens
cccugaucuucacug

SEQ ID NO: 637788 - RNA, 13 nt, Homo sapiens
cccugcaaaaaga

SEQ ID NO: 637789 - RNA, 14 nt, Homo sapiens
cccugcaaagccca

SEQ ID NO: 637790 - RNA, 11 nt, Homo sapiens
gcugucucucc

SEQ ID NO: 637791 - RNA, 16 nt, Homo sapiens
gcugucuggggccuuu

SEQ ID NO: 637792 - RNA, 22 nt, Homo sapiens
gcugucuuugcagggcacagau

SEQ ID NO: 637793 - RNA, 17 nt, Homo sapiens
gcugugcaucaguggga

SEQ ID NO: 637794 - RNA, 23 nt, Homo sapiens
gcugugcccagcaggcccagcau

SEQ ID NO: 637795 - RNA, 15 nt, Homo sapiens
gcuguggacuguccu

SEQ ID NO: 637796 - RNA, 14 nt, Homo sapiens
gcuguggaugcuuc

SEQ ID NO: 637797 - RNA, 18 nt, Homo sapiens
gcuguggcagaguuacag

SEQ ID NO: 637798 - RNA, 22 nt, Homo sapiens
gcugugggcaagccuaagggau

SEQ ID NO: 637799 - RNA, 22 nt, Homo sapiens
gcugugggccaaaaucaugcca

SEQ ID NO: 637800 - RNA, 20 nt, Homo sapiens
gcuguggggcgggcaugggg

SEQ ID NO: 637801 - RNA, 14 nt, Homo sapiens
gcuguguaagcuca

SEQ ID NO: 637802 - RNA, 20 nt, Homo sapiens
gcuguguggacuucaucuca

SEQ ID NO: 637803 - RNA, 16 nt, Homo sapiens
gcuguguuuccaucuc

SEQ ID NO: 637804 - RNA, 13 nt, Homo sapiens
gcuguguuugcag

SEQ ID NO: 637805 - RNA, 15 nt, Homo sapiens
gcuguuaaaauaaga

SEQ ID NO: 637806 - RNA, 13 nt, Homo sapiens
gcuguuaaacugu

SEQ ID NO: 637807 - RNA, 20 nt, Homo sapiens
gcuguuaccagagccucuuu

SEQ ID NO: 637808 - RNA, 23 nt, Homo sapiens
gcuguucauguuacucaugacuc

SEQ ID NO: 637809 - RNA, 15 nt, Homo sapiens
gcuguugacaucagc

SEQ ID NO: 637810 - RNA, 15 nt, Homo sapiens
cguauacauaggcau

SEQ ID NO: 637811 - RNA, 20 nt, Homo sapiens
cguaugccaccaacuuacaa

SEQ ID NO: 637812 - RNA, 20 nt, Homo sapiens
cguaugguggcucaugucua

SEQ ID NO: 637813 - RNA, 20 nt, Homo sapiens
cguauuaucuguugccuuau

SEQ ID NO: 637814 - RNA, 21 nt, Homo sapiens
cguauuuuuucuaaugugcau

SEQ ID NO: 637815 - RNA, 22 nt, Homo sapiens
cguauuuuuucuaaugugcauu

SEQ ID NO: 637816 - RNA, 21 nt, Homo sapiens
cgucaagagcaugcacaugcu

SEQ ID NO: 637817 - RNA, 14 nt, Homo sapiens
cgucaagucuaaac

SEQ ID NO: 637818 - RNA, 15 nt, Homo sapiens
cgucacccaacauca

SEQ ID NO: 637819 - RNA, 15 nt, Homo sapiens
cgucacuaauacaca

SEQ ID NO: 637820 - RNA, 20 nt, Homo sapiens
cgucagaccaguacugggaa

SEQ ID NO: 637821 - RNA, 14 nt, Homo sapiens
cgucaggaaaccaa

SEQ ID NO: 637822 - RNA, 23 nt, Homo sapiens
cgucagggagaggucaccagcug

SEQ ID NO: 637823 - RNA, 17 nt, Homo sapiens
cgucauguguuuugcca

SEQ ID NO: 637824 - RNA, 19 nt, Homo sapiens
cguccauauuuaacaugua

SEQ ID NO: 637825 - RNA, 11 nt, Homo sapiens
cgucuccuagc

SEQ ID NO: 637826 - RNA, 15 nt, Homo sapiens
cgucuccucccucag

SEQ ID NO: 637827 - RNA, 22 nt, Homo sapiens
cgucuguugugcgaaugacuga

SEQ ID NO: 637828 - RNA, 18 nt, Homo sapiens
cgucuugcccagcagcuc

SEQ ID NO: 637829 - RNA, 14 nt, Homo sapiens
cgugagacccagug

SEQ ID NO: 637830 - RNA, 17 nt, Homo sapiens
cgugagacccagugcac

SEQ ID NO: 637831 - RNA, 12 nt, Homo sapiens
cgugaguggucu

SEQ ID NO: 637832 - RNA, 16 nt, Homo sapiens
cgugaguggucuucaa

SEQ ID NO: 637833 - RNA, 16 nt, Homo sapiens
cgugauuuccagugag

SEQ ID NO: 637834 - RNA, 19 nt, Homo sapiens
cgugauuuugcuguagaag

SEQ ID NO: 637835 - RNA, 15 nt, Homo sapiens
cgugccaaaaaucuu

SEQ ID NO: 637836 - RNA, 19 nt, Homo sapiens
cgugcccaucaagugcagu

SEQ ID NO: 637837 - RNA, 20 nt, Homo sapiens
cgugccccgccuccccgaaa

SEQ ID NO: 637838 - RNA, 22 nt, Homo sapiens
cgugccugaucugcacauuuca

SEQ ID NO: 637839 - RNA, 17 nt, Homo sapiens
cgugcucccgaugcugc

SEQ ID NO: 637840 - RNA, 17 nt, Homo sapiens
cgugcugggaccaacuc

SEQ ID NO: 637841 - RNA, 15 nt, Homo sapiens
cgugcuggugggcau

SEQ ID NO: 637842 - RNA, 12 nt, Homo sapiens
cgugcuguaaau

SEQ ID NO: 637843 - RNA, 22 nt, Homo sapiens
cgugcuuuucugcggcugugua

SEQ ID NO: 637844 - RNA, 14 nt, Homo sapiens
cguggaacauucug

SEQ ID NO: 637845 - RNA, 12 nt, Homo sapiens
cguggacuuggc

SEQ ID NO: 637846 - RNA, 20 nt, Homo sapiens
cguggaugcgcagugccuug

SEQ ID NO: 637847 - RNA, 23 nt, Homo sapiens
cguggauguauggggaaucuaag

SEQ ID NO: 637848 - RNA, 16 nt, Homo sapiens
cguggauugcacgugg

SEQ ID NO: 637849 - RNA, 11 nt, Homo sapiens
cguggauuuua

SEQ ID NO: 637850 - RNA, 18 nt, Homo sapiens
cguggcaaauuaacuuga

SEQ ID NO: 637851 - RNA, 16 nt, Homo sapiens
cguggcuccaccuuga

SEQ ID NO: 637852 - RNA, 18 nt, Homo sapiens
cgugggcaaacaggcagu

SEQ ID NO: 637853 - RNA, 23 nt, Homo sapiens
cgugggcagcaaaacgacacugc

SEQ ID NO: 637854 - RNA, 13 nt, Homo sapiens
cguggucccugag

SEQ ID NO: 637855 - RNA, 20 nt, Homo sapiens
cgugucucagacugcaugua

SEQ ID NO: 637856 - RNA, 19 nt, Homo sapiens
cgugugcgugcaugugcac

SEQ ID NO: 637857 - RNA, 21 nt, Homo sapiens
cguguguauuagaaugcaugu

SEQ ID NO: 637858 - RNA, 13 nt, Homo sapiens
cgugugugcaagu

SEQ ID NO: 637859 - RNA, 17 nt, Homo sapiens
cgugugugcaagugucu

SEQ ID NO: 637860 - RNA, 23 nt, Homo sapiens
cguguucugucugugucuucagg

SEQ ID NO: 637861 - RNA, 21 nt, Homo sapiens
cguuaaggagaugggccuuuu

SEQ ID NO: 637862 - RNA, 11 nt, Homo sapiens
cguuaccagag

SEQ ID NO: 637863 - RNA, 12 nt, Homo sapiens
cguuaccagaga

SEQ ID NO: 637864 - RNA, 15 nt, Homo sapiens
cguucaauaagcauu

SEQ ID NO: 637865 - RNA, 15 nt, Homo sapiens
cguucucacacccac

SEQ ID NO: 637866 - RNA, 15 nt, Homo sapiens
cguucucccaaagau

SEQ ID NO: 637867 - RNA, 23 nt, Homo sapiens
cguucucugccccguuucuugcc

SEQ ID NO: 637868 - RNA, 15 nt, Homo sapiens
cguucugugcacaaa

SEQ ID NO: 637869 - RNA, 20 nt, Homo sapiens
cguugaagaggaagggcaaa

SEQ ID NO: 637870 - RNA, 17 nt, Homo sapiens
cguugcccagcacuguc

SEQ ID NO: 637871 - RNA, 17 nt, Homo sapiens
cguugggagccuagcuc

SEQ ID NO: 637872 - RNA, 17 nt, Homo sapiens
cguugguucugcacuaa

SEQ ID NO: 637873 - RNA, 20 nt, Homo sapiens
cguuguaguaaaugcgugcu

SEQ ID NO: 637874 - RNA, 13 nt, Homo sapiens
cguuguguuguug

SEQ ID NO: 637875 - RNA, 23 nt, Homo sapiens
cguuuacaagcccccccuuccac

SEQ ID NO: 637876 - RNA, 11 nt, Homo sapiens
cguuucuugcc

SEQ ID NO: 637877 - RNA, 12 nt, Homo sapiens
cguuugcuauau

SEQ ID NO: 637878 - RNA, 22 nt, Homo sapiens
cguuugguuuacuugucuguca

SEQ ID NO: 637879 - RNA, 18 nt, Homo sapiens
cguuuguuuguuucaaua

SEQ ID NO: 637880 - RNA, 12 nt, Homo sapiens
cguuuuccucau

SEQ ID NO: 637881 - RNA, 19 nt, Homo sapiens
cguuuuguaaauguugugc

SEQ ID NO: 637882 - RNA, 24 nt, Homo sapiens
cguuuuuaagguggaaacuccugu

SEQ ID NO: 637883 - RNA, 22 nt, Homo sapiens
cuaaaaaacagaggccauggca

SEQ ID NO: 637884 - RNA, 13 nt, Homo sapiens
cuaaaaaguauca

SEQ ID NO: 637885 - RNA, 14 nt, Homo sapiens
cuaaaaaguuccau

SEQ ID NO: 637886 - RNA, 17 nt, Homo sapiens
cuaaaaaugcaucacau

SEQ ID NO: 637887 - RNA, 12 nt, Homo sapiens
cuaaaaauugau

SEQ ID NO: 637888 - RNA, 17 nt, Homo sapiens
cuaaaacaaucuaaaac

SEQ ID NO: 637889 - RNA, 14 nt, Homo sapiens
cuaaaacacugaaa

SEQ ID NO: 637890 - RNA, 14 nt, Homo sapiens
cuaaaacagggugg

SEQ ID NO: 637891 - RNA, 14 nt, Homo sapiens
cuaaaacugcauuu

SEQ ID NO: 637892 - RNA, 17 nt, Homo sapiens
cuaaaacuggccugacu

SEQ ID NO: 637893 - RNA, 18 nt, Homo sapiens
cuaaaacuuaacauucau

SEQ ID NO: 637894 - RNA, 15 nt, Homo sapiens
cuaaaagcacacuca

SEQ ID NO: 637895 - RNA, 12 nt, Homo sapiens
cuaaaagcuuuc

SEQ ID NO: 637896 - RNA, 17 nt, Homo sapiens
cuaaaaggaaaucucac

SEQ ID NO: 637897 - RNA, 23 nt, Homo sapiens
cuaaaaguuuucuaauuugcacu

SEQ ID NO: 637898 - RNA, 16 nt, Homo sapiens
cuaaaauacaaaccca

SEQ ID NO: 637899 - RNA, 13 nt, Homo sapiens
cuaaaauauuauu

SEQ ID NO: 637900 - RNA, 21 nt, Homo sapiens
cuaaaauauuuuagauguuau

SEQ ID NO: 637901 - RNA, 11 nt, Homo sapiens
cuaaaauccau

SEQ ID NO: 637902 - RNA, 21 nt, Homo sapiens
cuaaaaugugucuugcuguca

SEQ ID NO: 637903 - RNA, 13 nt, Homo sapiens
cuaaaauuccacu

SEQ ID NO: 637904 - RNA, 17 nt, Homo sapiens
cuaaaauuuuaggcacu

SEQ ID NO: 637905 - RNA, 16 nt, Homo sapiens
cuaaacaaugcugauu

SEQ ID NO: 637906 - RNA, 14 nt, Homo sapiens
cuaaaccaaguuau

SEQ ID NO: 637907 - RNA, 16 nt, Homo sapiens
cuaaaccaaguuauuu

SEQ ID NO: 637908 - RNA, 16 nt, Homo sapiens
cuaaaccccuguccca

SEQ ID NO: 637909 - RNA, 16 nt, Homo sapiens
cuaaacccuguuccug

SEQ ID NO: 637910 - RNA, 11 nt, Homo sapiens
cuaaacuacaa

SEQ ID NO: 637911 - RNA, 17 nt, Homo sapiens
cuaaacugcugcaaaag

SEQ ID NO: 637912 - RNA, 22 nt, Homo sapiens
cuaaacugcugcaaaaguucuc

SEQ ID NO: 637913 - RNA, 20 nt, Homo sapiens
cuaaacuucaccuacauuau

SEQ ID NO: 637914 - RNA, 22 nt, Homo sapiens
cuaaagaguuauucaaaugaag

SEQ ID NO: 637915 - RNA, 12 nt, Homo sapiens
cuaaagccucaa

SEQ ID NO: 637916 - RNA, 18 nt, Homo sapiens
cuaaagcgaagagacaag

SEQ ID NO: 637917 - RNA, 13 nt, Homo sapiens
cuaaagcuuuauc

SEQ ID NO: 637918 - RNA, 22 nt, Homo sapiens
cuaaaggaagaaauacauauuu

SEQ ID NO: 637919 - RNA, 19 nt, Homo sapiens
cuaaagggagaaaugccag

SEQ ID NO: 637920 - RNA, 16 nt, Homo sapiens
cuaaaguauacaacug

SEQ ID NO: 637921 - RNA, 12 nt, Homo sapiens
cuaaagugcaag

SEQ ID NO: 637922 - RNA, 18 nt, Homo sapiens
cuaaagugccuaccccag

SEQ ID NO: 637923 - RNA, 20 nt, Homo sapiens
cuaaagugcuggaacuuuag

SEQ ID NO: 637924 - RNA, 17 nt, Homo sapiens
cuaaagugucaaggugu

SEQ ID NO: 637925 - RNA, 15 nt, Homo sapiens
cuaaaguuacaaaca

SEQ ID NO: 637926 - RNA, 20 nt, Homo sapiens
cuaaaguuacaaacagacca

SEQ ID NO: 637927 - RNA, 11 nt, Homo sapiens
cuaaaguuaua

SEQ ID NO: 637928 - RNA, 20 nt, Homo sapiens
cuaaauaaauuucccaguua

SEQ ID NO: 637929 - RNA, 18 nt, Homo sapiens
gauauuuauuacuuccuc

SEQ ID NO: 637930 - RNA, 15 nt, Homo sapiens
gauauuuuaugcaaa

SEQ ID NO: 637931 - RNA, 20 nt, Homo sapiens
gaucaaaaccugcuaccucc

SEQ ID NO: 637932 - RNA, 21 nt, Homo sapiens
gaucaaaauaaaaagugacac

SEQ ID NO: 637933 - RNA, 14 nt, Homo sapiens
gaucaaaaucaauu

SEQ ID NO: 637934 - RNA, 16 nt, Homo sapiens
gaucaaacuacauauu

SEQ ID NO: 637935 - RNA, 15 nt, Homo sapiens
gaucaaagaaauuca

SEQ ID NO: 637936 - RNA, 15 nt, Homo sapiens
gaucaaauacuuuaa

SEQ ID NO: 637937 - RNA, 17 nt, Homo sapiens
gaucaaauugugcagua

SEQ ID NO: 637938 - RNA, 15 nt, Homo sapiens
gaucaagaaugcaau

SEQ ID NO: 637939 - RNA, 21 nt, Homo sapiens
gaucaagccaguucuccuucc

SEQ ID NO: 637940 - RNA, 14 nt, Homo sapiens
gaucaagcugugag

SEQ ID NO: 637941 - RNA, 21 nt, Homo sapiens
gaucaagucaccggagcuuuc

SEQ ID NO: 637942 - RNA, 12 nt, Homo sapiens
gaucacaccuca

SEQ ID NO: 637943 - RNA, 11 nt, Homo sapiens
gaucacauugc

SEQ ID NO: 637944 - RNA, 14 nt, Homo sapiens
gaucaccaccugaa

SEQ ID NO: 637945 - RNA, 18 nt, Homo sapiens
gaucacuacaaguauuau

SEQ ID NO: 637946 - RNA, 15 nt, Homo sapiens
gaucacuaugcauuu

SEQ ID NO: 637947 - RNA, 16 nt, Homo sapiens
gaucacuggcaaugaa

SEQ ID NO: 637948 - RNA, 21 nt, Homo sapiens
gaucacuggggggcucucagg

SEQ ID NO: 637949 - RNA, 19 nt, Homo sapiens
gaucacuugaggccaguga

SEQ ID NO: 637950 - RNA, 18 nt, Homo sapiens
gaucagagcgcacaggga

SEQ ID NO: 637951 - RNA, 21 nt, Homo sapiens
gaucagaugcugaauugagaa

SEQ ID NO: 637952 - RNA, 16 nt, Homo sapiens
gaucagcaucugugau

SEQ ID NO: 637953 - RNA, 17 nt, Homo sapiens
gaucagcaucugugaug

SEQ ID NO: 637954 - RNA, 21 nt, Homo sapiens
gaucagccccgccugucacaa

SEQ ID NO: 637955 - RNA, 19 nt, Homo sapiens
gaucagcccugccaggugg

SEQ ID NO: 637956 - RNA, 20 nt, Homo sapiens
gaucagccugggcaauguga

SEQ ID NO: 637957 - RNA, 15 nt, Homo sapiens
gaucagcuucuugca

SEQ ID NO: 637958 - RNA, 14 nt, Homo sapiens
gaucaggaauucua

SEQ ID NO: 637959 - RNA, 21 nt, Homo sapiens
gaucaguagccccuaaucaca

SEQ ID NO: 637960 - RNA, 21 nt, Homo sapiens
gaucaguggugucugugaagg

SEQ ID NO: 637961 - RNA, 18 nt, Homo sapiens
gaucauagguauuucaaa

SEQ ID NO: 637962 - RNA, 19 nt, Homo sapiens
gaucauagguauuucaaaa

SEQ ID NO: 637963 - RNA, 19 nt, Homo sapiens
gaucaucuuggaacugcau

SEQ ID NO: 637964 - RNA, 20 nt, Homo sapiens
gaucaugccacuacacucca

SEQ ID NO: 637965 - RNA, 15 nt, Homo sapiens
gaucauuucugccau

SEQ ID NO: 637966 - RNA, 21 nt, Homo sapiens
gaucauuuuuaacugauucuu

SEQ ID NO: 637967 - RNA, 17 nt, Homo sapiens
gaucauuuuuauaugaa

SEQ ID NO: 637968 - RNA, 21 nt, Homo sapiens
gauccaauggaauacugaaaa

SEQ ID NO: 637969 - RNA, 18 nt, Homo sapiens
gauccacuucucucagga

SEQ ID NO: 637970 - RNA, 21 nt, Homo sapiens
gauccagccuuuccaagucac

SEQ ID NO: 637971 - RNA, 13 nt, Homo sapiens
gauccagcucauc

SEQ ID NO: 637972 - RNA, 18 nt, Homo sapiens
gaucccagacccauuccu

SEQ ID NO: 637973 - RNA, 16 nt, Homo sapiens
gauccccacuguccua

SEQ ID NO: 637974 - RNA, 19 nt, Homo sapiens
gauccccgacaguggcucu

SEQ ID NO: 637975 - RNA, 21 nt, Homo sapiens
gauccccggggcggcaggaag

SEQ ID NO: 637976 - RNA, 12 nt, Homo sapiens
gaucccugacau

SEQ ID NO: 637977 - RNA, 21 nt, Homo sapiens
gauccgucuuuggccuccucc

SEQ ID NO: 637978 - RNA, 15 nt, Homo sapiens
gauccuccacagaga

SEQ ID NO: 637979 - RNA, 16 nt, Homo sapiens
gauccucccucauggc

SEQ ID NO: 637980 - RNA, 17 nt, Homo sapiens
gauccuccugaccucaa

SEQ ID NO: 637981 - RNA, 22 nt, Homo sapiens
gauccuccugucuaauuugcac

SEQ ID NO: 637982 - RNA, 14 nt, Homo sapiens
gauccucuggacac

SEQ ID NO: 637983 - RNA, 21 nt, Homo sapiens
gauccugcaccccagcauucc

SEQ ID NO: 637984 - RNA, 17 nt, Homo sapiens
gauccuucagcacagga

SEQ ID NO: 637985 - RNA, 18 nt, Homo sapiens
cuacaugaucuggagcaa

SEQ ID NO: 637986 - RNA, 15 nt, Homo sapiens
cuacaugaugacuca

SEQ ID NO: 637987 - RNA, 19 nt, Homo sapiens
cuacaugaugacucaaggc

SEQ ID NO: 637988 - RNA, 11 nt, Homo sapiens
cuacaugccuc

SEQ ID NO: 637989 - RNA, 15 nt, Homo sapiens
cuacauguauugcac

SEQ ID NO: 637990 - RNA, 22 nt, Homo sapiens
cuacauuuaaaaauacuucucu

SEQ ID NO: 637991 - RNA, 20 nt, Homo sapiens
cuaccacagcaacuauauau

SEQ ID NO: 637992 - RNA, 12 nt, Homo sapiens
cuaccacuguau

SEQ ID NO: 637993 - RNA, 16 nt, Homo sapiens
cuaccaguugcccuag

SEQ ID NO: 637994 - RNA, 17 nt, Homo sapiens
cuaccaguuggccauga

SEQ ID NO: 637995 - RNA, 15 nt, Homo sapiens
cuaccaucagggaca

SEQ ID NO: 637996 - RNA, 18 nt, Homo sapiens
cuaccauuugaauuugug

SEQ ID NO: 637997 - RNA, 17 nt, Homo sapiens
cuacccaaacccuaggu

SEQ ID NO: 637998 - RNA, 14 nt, Homo sapiens
cuacccagguauua

SEQ ID NO: 637999 - RNA, 13 nt, Homo sapiens
cuacccauauccc

SEQ ID NO: 638000 - RNA, 16 nt, Homo sapiens
cuacccauuguucccu

SEQ ID NO: 638001 - RNA, 20 nt, Homo sapiens
cuaccccaaaguuugcucaa

SEQ ID NO: 638002 - RNA, 19 nt, Homo sapiens
cuaccccgagggcgccaug

SEQ ID NO: 638003 - RNA, 21 nt, Homo sapiens
cuaccccgagggcgccaugca

SEQ ID NO: 638004 - RNA, 17 nt, Homo sapiens
cuacccuauucuaucca

SEQ ID NO: 638005 - RNA, 17 nt, Homo sapiens
cuacccuuaauaacaua

SEQ ID NO: 638006 - RNA, 23 nt, Homo sapiens
cuacccuuccagugcccuaggcc

SEQ ID NO: 638007 - RNA, 22 nt, Homo sapiens
cuacccuuccucaccacuuccc

SEQ ID NO: 638008 - RNA, 17 nt, Homo sapiens
cuacccuuggcagugug

SEQ ID NO: 638009 - RNA, 15 nt, Homo sapiens
cuaccguuguuugca

SEQ ID NO: 638010 - RNA, 14 nt, Homo sapiens
cuaccuccaaagcu

SEQ ID NO: 638011 - RNA, 20 nt, Homo sapiens
cuaccuccagaguuguugaa

SEQ ID NO: 638012 - RNA, 23 nt, Homo sapiens
cuaccucuggugaugguuuccac

SEQ ID NO: 638013 - RNA, 23 nt, Homo sapiens
cuaccugcucguugccugccacu

SEQ ID NO: 638014 - RNA, 17 nt, Homo sapiens
cuaccuguggugauguu

SEQ ID NO: 638015 - RNA, 22 nt, Homo sapiens
cuaccuugguucccccacugau

SEQ ID NO: 638016 - RNA, 19 nt, Homo sapiens
cuaccuuuuaccuagccac

SEQ ID NO: 638017 - RNA, 15 nt, Homo sapiens
cuaccuuuugucucu

SEQ ID NO: 638018 - RNA, 14 nt, Homo sapiens
cuacguauccugca

SEQ ID NO: 638019 - RNA, 19 nt, Homo sapiens
cuacgugcgcucugccauu

SEQ ID NO: 638020 - RNA, 20 nt, Homo sapiens
cuacuaaguucacauuagaa

SEQ ID NO: 638021 - RNA, 16 nt, Homo sapiens
cuacuacaugugacug

SEQ ID NO: 638022 - RNA, 17 nt, Homo sapiens
cuacuacccgagcccag

SEQ ID NO: 638023 - RNA, 14 nt, Homo sapiens
cuacuagagucuga

SEQ ID NO: 638024 - RNA, 22 nt, Homo sapiens
cuacuagagucugaacagcugu

SEQ ID NO: 638025 - RNA, 14 nt, Homo sapiens
cuacucaagcugcu

SEQ ID NO: 638026 - RNA, 22 nt, Homo sapiens
cuacucaaugccuggagacaga

SEQ ID NO: 638027 - RNA, 19 nt, Homo sapiens
cuacucaggcugguggaga

SEQ ID NO: 638028 - RNA, 12 nt, Homo sapiens
cuacuccaaaau

SEQ ID NO: 638029 - RNA, 20 nt, Homo sapiens
cuacuccccauuguucugga

SEQ ID NO: 638030 - RNA, 16 nt, Homo sapiens
cuacucccucuuccaa

SEQ ID NO: 638031 - RNA, 22 nt, Homo sapiens
cuacucccuuauguguugugua

SEQ ID NO: 638032 - RNA, 22 nt, Homo sapiens
cuacuccuagaagaaccaaaua

SEQ ID NO: 638033 - RNA, 15 nt, Homo sapiens
cuacucuaguucugu

SEQ ID NO: 638034 - RNA, 16 nt, Homo sapiens
cuacucuaguucuguu

SEQ ID NO: 638035 - RNA, 16 nt, Homo sapiens
cuacucucaugcugca

SEQ ID NO: 638036 - RNA, 14 nt, Homo sapiens
cuacucucuugcca

SEQ ID NO: 638037 - RNA, 12 nt, Homo sapiens
cuacucuggaau

SEQ ID NO: 638038 - RNA, 22 nt, Homo sapiens
cuacucuuacagagccuugaga

SEQ ID NO: 638039 - RNA, 17 nt, Homo sapiens
cuacucuuccuguccua

SEQ ID NO: 638040 - RNA, 12 nt, Homo sapiens
cuacucuuugau

SEQ ID NO: 638041 - RNA, 14 nt, Homo sapiens
cuacugacccaacu

SEQ ID NO: 638042 - RNA, 19 nt, Homo sapiens
cuacugagcauuugcaccu

SEQ ID NO: 638043 - RNA, 20 nt, Homo sapiens
cuacugaguagggggagcaa

SEQ ID NO: 638044 - RNA, 16 nt, Homo sapiens
cuacugauuguuucau

SEQ ID NO: 638045 - RNA, 21 nt, Homo sapiens
cuacugauuuuaaaaugaaua

SEQ ID NO: 638046 - RNA, 14 nt, Homo sapiens
cuacugcaaauggc

SEQ ID NO: 638047 - RNA, 17 nt, Homo sapiens
cuacugcuaaauccuca

SEQ ID NO: 638048 - RNA, 19 nt, Homo sapiens
cuacugcuaauguugauca

SEQ ID NO: 638049 - RNA, 12 nt, Homo sapiens
cuacugcuccug

SEQ ID NO: 638050 - RNA, 16 nt, Homo sapiens
cuacugcuuacuguug

SEQ ID NO: 638051 - RNA, 23 nt, Homo sapiens
cuacugggugucauuucauucca

SEQ ID NO: 638052 - RNA, 18 nt, Homo sapiens
cuacuguaauuugugaua

SEQ ID NO: 638053 - RNA, 15 nt, Homo sapiens
cuacuguacuauuua

SEQ ID NO: 638054 - RNA, 15 nt, Homo sapiens
cuacuuaaugagaua

SEQ ID NO: 638055 - RNA, 15 nt, Homo sapiens
cuacuuaaugcacag

SEQ ID NO: 638056 - RNA, 18 nt, Homo sapiens
cuacuuccccuucuugcc

SEQ ID NO: 638057 - RNA, 20 nt, Homo sapiens
cuacuuccccuucuugccau

SEQ ID NO: 638058 - RNA, 22 nt, Homo sapiens
cuacuucuccccuccucuugcc

SEQ ID NO: 638059 - RNA, 16 nt, Homo sapiens
cuacuuuaucaauuaa

SEQ ID NO: 638060 - RNA, 19 nt, Homo sapiens
cuacuuuuaguugacucac

SEQ ID NO: 638061 - RNA, 18 nt, Homo sapiens
cuacuuuuggugcuuaaa

SEQ ID NO: 638062 - RNA, 15 nt, Homo sapiens
cuacuuuuuauacuc

SEQ ID NO: 638063 - RNA, 22 nt, Homo sapiens
cuacuuuuuuuuaguucaauac

SEQ ID NO: 638064 - RNA, 21 nt, Homo sapiens
cuagaaaauuagacugugauu

SEQ ID NO: 638065 - RNA, 13 nt, Homo sapiens
cuagaaacaaaca

SEQ ID NO: 638066 - RNA, 18 nt, Homo sapiens
cuagaacaacgccuguca

SEQ ID NO: 638067 - RNA, 19 nt, Homo sapiens
cuagaacaugguuaccaug

SEQ ID NO: 638068 - RNA, 17 nt, Homo sapiens
cuagaaccucucguagu

SEQ ID NO: 638069 - RNA, 21 nt, Homo sapiens
cuagaaccucucguaguccau

SEQ ID NO: 638070 - RNA, 19 nt, Homo sapiens
cuagaagaaccaaauaccu

SEQ ID NO: 638071 - RNA, 20 nt, Homo sapiens
cuagaagcacauguguauuu

SEQ ID NO: 638072 - RNA, 22 nt, Homo sapiens
cuagaaggcguccauguuuauu

SEQ ID NO: 638073 - RNA, 23 nt, Homo sapiens
cuagaagugguuuccugauaaca

SEQ ID NO: 638074 - RNA, 16 nt, Homo sapiens
cuagaagugugaagug

SEQ ID NO: 638075 - RNA, 15 nt, Homo sapiens
cuagaauaaucucau

SEQ ID NO: 638076 - RNA, 21 nt, Homo sapiens
cuagaauauuauguuccucaa

SEQ ID NO: 638077 - RNA, 22 nt, Homo sapiens
cuagaaugcaaguauccugcga

SEQ ID NO: 638078 - RNA, 21 nt, Homo sapiens
cuagaauguggauuugauuca

SEQ ID NO: 638079 - RNA, 13 nt, Homo sapiens
cuagacaguauug

SEQ ID NO: 638080 - RNA, 18 nt, Homo sapiens
cuagacccacuggacuca

SEQ ID NO: 638081 - RNA, 19 nt, Homo sapiens
cuagagaaggacccggagg

SEQ ID NO: 638082 - RNA, 21 nt, Homo sapiens
cuagagaaggcugugagccaa

SEQ ID NO: 638083 - RNA, 21 nt, Homo sapiens
cuagagcuagaugugucuuac

SEQ ID NO: 638084 - RNA, 22 nt, Homo sapiens
cuagagcuagaugugucuuacc

SEQ ID NO: 638085 - RNA, 23 nt, Homo sapiens
cuagagcuagaugugucuuacca

SEQ ID NO: 638086 - RNA, 15 nt, Homo sapiens
cuagagggggucuca

SEQ ID NO: 638087 - RNA, 23 nt, Homo sapiens
cuagagucacugauacacagaau

SEQ ID NO: 638088 - RNA, 14 nt, Homo sapiens
cuagagucauguga

SEQ ID NO: 638089 - RNA, 20 nt, Homo sapiens
cuagagucauuuacucuccu

SEQ ID NO: 638090 - RNA, 13 nt, Homo sapiens
cuagagugcaaug

SEQ ID NO: 638091 - RNA, 12 nt, Homo sapiens
cuagagugcagg

SEQ ID NO: 638092 - RNA, 23 nt, Homo sapiens
cuagagugcagggauuacaggcg

SEQ ID NO: 638093 - RNA, 20 nt, Homo sapiens
cuagagugcgguggcgcgau

SEQ ID NO: 638094 - RNA, 14 nt, Homo sapiens
cuagauacaauaaa

SEQ ID NO: 638095 - RNA, 15 nt, Homo sapiens
cuagauacugaaugu

SEQ ID NO: 638096 - RNA, 14 nt, Homo sapiens
cuagauacuggaaa

SEQ ID NO: 638097 - RNA, 15 nt, Homo sapiens
cuagaucaacagauc

SEQ ID NO: 638098 - RNA, 13 nt, Homo sapiens
gcuuugcuuauaa

SEQ ID NO: 638099 - RNA, 15 nt, Homo sapiens
gcuuugggugccuuu

SEQ ID NO: 638100 - RNA, 22 nt, Homo sapiens
gcuuuggguggcucacuacuga

SEQ ID NO: 638101 - RNA, 21 nt, Homo sapiens
gcuuugguucuucagaugcuc

SEQ ID NO: 638102 - RNA, 23 nt, Homo sapiens
gcuuuguauucaaaaauuaucua

SEQ ID NO: 638103 - RNA, 13 nt, Homo sapiens
gcuuuguuuggau

SEQ ID NO: 638104 - RNA, 20 nt, Homo sapiens
gcuuuuaaaugcucucucau

SEQ ID NO: 638105 - RNA, 18 nt, Homo sapiens
gcuuuuaagaaacacagg

SEQ ID NO: 638106 - RNA, 18 nt, Homo sapiens
gcuuuucagccaauuugu

SEQ ID NO: 638107 - RNA, 16 nt, Homo sapiens
uccucuggagcccuaa

SEQ ID NO: 638108 - RNA, 13 nt, Homo sapiens
uccucuggaucac

SEQ ID NO: 638109 - RNA, 21 nt, Homo sapiens
uccucuggcuuucccaggaga

SEQ ID NO: 638110 - RNA, 24 nt, Homo sapiens
uccucuguaccuagaauagucuca

SEQ ID NO: 638111 - RNA, 21 nt, Homo sapiens
uccucugucagucacagccac

SEQ ID NO: 638112 - RNA, 11 nt, Homo sapiens
uccucuucuau

SEQ ID NO: 638113 - RNA, 17 nt, Homo sapiens
uccucuucuuguugacc

SEQ ID NO: 638114 - RNA, 15 nt, Homo sapiens
uccucuugaaccaca

SEQ ID NO: 638115 - RNA, 14 nt, Homo sapiens
uccucuugugauuu

SEQ ID NO: 638116 - RNA, 23 nt, Homo sapiens
uccucuuucaaagguagccauca

SEQ ID NO: 638117 - RNA, 16 nt, Homo sapiens
uccucuuucaaccuca

SEQ ID NO: 638118 - RNA, 16 nt, Homo sapiens
uccucuuugguggcau

SEQ ID NO: 638119 - RNA, 18 nt, Homo sapiens
uccugaaccgcacagcuc

SEQ ID NO: 638120 - RNA, 23 nt, Homo sapiens
uccugaagggaaggcaaaggcag

SEQ ID NO: 638121 - RNA, 21 nt, Homo sapiens
uccugaagggggacacuccau

SEQ ID NO: 638122 - RNA, 19 nt, Homo sapiens
uccugaauccaaacuaauc

SEQ ID NO: 638123 - RNA, 19 nt, Homo sapiens
uccugacaacgucucuuca

SEQ ID NO: 638124 - RNA, 13 nt, Homo sapiens
uccugacacuuga

SEQ ID NO: 638125 - RNA, 14 nt, Homo sapiens
uccugacagcaaua

SEQ ID NO: 638126 - RNA, 18 nt, Homo sapiens
uccugaccccucccugca

SEQ ID NO: 638127 - RNA, 12 nt, Homo sapiens
uccugaccucag

SEQ ID NO: 638128 - RNA, 19 nt, Homo sapiens
uccugacuuuuaaugucau

SEQ ID NO: 638129 - RNA, 16 nt, Homo sapiens
uccugagccaaggagg

SEQ ID NO: 638130 - RNA, 19 nt, Homo sapiens
uccugagccccucaauccu

SEQ ID NO: 638131 - RNA, 20 nt, Homo sapiens
uccugaguagcugggauuac

SEQ ID NO: 638132 - RNA, 17 nt, Homo sapiens
uccugauaaacauuaaa

SEQ ID NO: 638133 - RNA, 21 nt, Homo sapiens
uccugauaaacauuaaacacu

SEQ ID NO: 638134 - RNA, 19 nt, Homo sapiens
uccugauuauaggauuuua

SEQ ID NO: 638135 - RNA, 14 nt, Homo sapiens
uccugauuccaaau

SEQ ID NO: 638136 - RNA, 13 nt, Homo sapiens
uccugcaacucaa

SEQ ID NO: 638137 - RNA, 12 nt, Homo sapiens
uccugcagacac

SEQ ID NO: 638138 - RNA, 20 nt, Homo sapiens
uccugcagccuccuccugac

SEQ ID NO: 638139 - RNA, 15 nt, Homo sapiens
uccugcagucccaca

SEQ ID NO: 638140 - RNA, 16 nt, Homo sapiens
uccugcauagucuguu

SEQ ID NO: 638141 - RNA, 11 nt, Homo sapiens
uccugcauguu

SEQ ID NO: 638142 - RNA, 19 nt, Homo sapiens
uccugcauuucucuucuca

SEQ ID NO: 638143 - RNA, 14 nt, Homo sapiens
uccugccauguuua

SEQ ID NO: 638144 - RNA, 21 nt, Homo sapiens
uccugcccaaacagcuguauu

SEQ ID NO: 638145 - RNA, 18 nt, Homo sapiens
uccugcccaagcacuuca

SEQ ID NO: 638146 - RNA, 20 nt, Homo sapiens
uccugcccaggacugcauug

SEQ ID NO: 638147 - RNA, 20 nt, Homo sapiens
uccugcccucacaucuucca

SEQ ID NO: 638148 - RNA, 19 nt, Homo sapiens
uccugccuaagguugucua

SEQ ID NO: 638149 - RNA, 23 nt, Homo sapiens
uccugcuacucuguuccuucaca

SEQ ID NO: 638150 - RNA, 18 nt, Homo sapiens
uccugcucaggaaaccac

SEQ ID NO: 638151 - RNA, 19 nt, Homo sapiens
uccugcugaacguuucccc

SEQ ID NO: 638152 - RNA, 18 nt, Homo sapiens
uccugcugauccagaugc

SEQ ID NO: 638153 - RNA, 17 nt, Homo sapiens
uccuggaaauucugcug

SEQ ID NO: 638154 - RNA, 20 nt, Homo sapiens
uccuggaagcaggugcuaca

SEQ ID NO: 638155 - RNA, 17 nt, Homo sapiens
uccuggacaaccuggac

SEQ ID NO: 638156 - RNA, 19 nt, Homo sapiens
uccuggaggcacugggaag

SEQ ID NO: 638157 - RNA, 18 nt, Homo sapiens
uccuggaguacaaacaca

SEQ ID NO: 638158 - RNA, 19 nt, Homo sapiens
uccuggcacuaacguugag

SEQ ID NO: 638159 - RNA, 21 nt, Homo sapiens
uccuggcaucuauuuccucug

SEQ ID NO: 638160 - RNA, 20 nt, Homo sapiens
uccuggcccuggaaggugcc

SEQ ID NO: 638161 - RNA, 23 nt, Homo sapiens
uccuggcccuggaaggugccacu

SEQ ID NO: 638162 - RNA, 18 nt, Homo sapiens
uccuggccucaagggauc

SEQ ID NO: 638163 - RNA, 19 nt, Homo sapiens
uccuggcuaacauggugaa

SEQ ID NO: 638164 - RNA, 15 nt, Homo sapiens
uccuggcugagagag

SEQ ID NO: 638165 - RNA, 19 nt, Homo sapiens
uccugggaacacaucuggc

SEQ ID NO: 638166 - RNA, 11 nt, Homo sapiens
uccugggaccc

SEQ ID NO: 638167 - RNA, 18 nt, Homo sapiens
uccugggcccaagugauc

SEQ ID NO: 638168 - RNA, 18 nt, Homo sapiens
uccugggcucaagugauc

SEQ ID NO: 638169 - RNA, 19 nt, Homo sapiens
uccuggggaauacuggcca

SEQ ID NO: 638170 - RNA, 14 nt, Homo sapiens
uccuggggcuggaa

SEQ ID NO: 638171 - RNA, 15 nt, Homo sapiens
uccuggggucacuca

SEQ ID NO: 638172 - RNA, 16 nt, Homo sapiens
uccuggguacugaaag

SEQ ID NO: 638173 - RNA, 18 nt, Homo sapiens
uccuggugccaauuucaa

SEQ ID NO: 638174 - RNA, 22 nt, Homo sapiens
uccuggugccccccaccccugg

SEQ ID NO: 638175 - RNA, 20 nt, Homo sapiens
uccugguggauacuguagaa

SEQ ID NO: 638176 - RNA, 16 nt, Homo sapiens
uccugguuuccacugu

SEQ ID NO: 638177 - RNA, 16 nt, Homo sapiens
uccugguuuuugccua

SEQ ID NO: 638178 - RNA, 17 nt, Homo sapiens
uccuguaaagaaacauu

SEQ ID NO: 638179 - RNA, 15 nt, Homo sapiens
uccuguaaauggugu

SEQ ID NO: 638180 - RNA, 22 nt, Homo sapiens
uccuguacaaucaugaacagcu

SEQ ID NO: 638181 - RNA, 18 nt, Homo sapiens
uccuguacauuucacaaa

SEQ ID NO: 638182 - RNA, 20 nt, Homo sapiens
uccuguaccgucgacaagaa

SEQ ID NO: 638183 - RNA, 17 nt, Homo sapiens
uccuguacuuuuuccag

SEQ ID NO: 638184 - RNA, 16 nt, Homo sapiens
uccuguauuccugacc

SEQ ID NO: 638185 - RNA, 22 nt, Homo sapiens
uccuguauucuacagcagauac

SEQ ID NO: 638186 - RNA, 17 nt, Homo sapiens
uccugucacugagcaca

SEQ ID NO: 638187 - RNA, 21 nt, Homo sapiens
uccuguccucuggaucacaga

SEQ ID NO: 638188 - RNA, 17 nt, Homo sapiens
uccugucuaauuugcac

SEQ ID NO: 638189 - RNA, 21 nt, Homo sapiens
uccugucugcccuagggagaa

SEQ ID NO: 638190 - RNA, 13 nt, Homo sapiens
uccugugccacua

SEQ ID NO: 638191 - RNA, 20 nt, Homo sapiens
uccugugcggugucaccaug

SEQ ID NO: 638192 - RNA, 21 nt, Homo sapiens
uccugugcuugaugcuagaaa

SEQ ID NO: 638193 - RNA, 13 nt, Homo sapiens
uccuguguaaaug

SEQ ID NO: 638194 - RNA, 16 nt, Homo sapiens
uccugugucuguguau

SEQ ID NO: 638195 - RNA, 20 nt, Homo sapiens
uccuguguguacucugucca

SEQ ID NO: 638196 - RNA, 23 nt, Homo sapiens
uccuguucacaccagagaaccag

SEQ ID NO: 638197 - RNA, 19 nt, Homo sapiens
uccuguucucucugugcuc

SEQ ID NO: 638198 - RNA, 15 nt, Homo sapiens
uccuguugaugggaa

SEQ ID NO: 638199 - RNA, 14 nt, Homo sapiens
uccuguugucuaca

SEQ ID NO: 638200 - RNA, 18 nt, Homo sapiens
uccuguuuuuagugcuga

SEQ ID NO: 638201 - RNA, 18 nt, Homo sapiens
uccuuaaagguagucaag

SEQ ID NO: 638202 - RNA, 17 nt, Homo sapiens
uccuuaauaacaacaga

SEQ ID NO: 638203 - RNA, 13 nt, Homo sapiens
uccuuaaugcaga

SEQ ID NO: 638204 - RNA, 22 nt, Homo sapiens
uccuuaauuuaauugcuuugaa

SEQ ID NO: 638205 - RNA, 12 nt, Homo sapiens
uccuuacauuuu

SEQ ID NO: 638206 - RNA, 20 nt, Homo sapiens
uccuuacuaagcauagcaaa

SEQ ID NO: 638207 - RNA, 15 nt, Homo sapiens
uccuuacuguuuaca

SEQ ID NO: 638208 - RNA, 15 nt, Homo sapiens
uccuuacuugcacug

SEQ ID NO: 638209 - RNA, 18 nt, Homo sapiens
uccuuagcuuagaccuca

SEQ ID NO: 638210 - RNA, 19 nt, Homo sapiens
uccuuaguccuacccugaa

SEQ ID NO: 638211 - RNA, 13 nt, Homo sapiens
uccuuaguguaua

SEQ ID NO: 638212 - RNA, 14 nt, Homo sapiens
uccuuaucaaagga

SEQ ID NO: 638213 - RNA, 14 nt, Homo sapiens
uccuuauuguucag

SEQ ID NO: 638214 - RNA, 21 nt, Homo sapiens
uccuuauuuugugugcuuucc

SEQ ID NO: 638215 - RNA, 12 nt, Homo sapiens
uccuuccauccc

SEQ ID NO: 638216 - RNA, 19 nt, Homo sapiens
uccuucccauuucucuaca

SEQ ID NO: 638217 - RNA, 22 nt, Homo sapiens
uccuuccccauuuccacuguau

SEQ ID NO: 638218 - RNA, 19 nt, Homo sapiens
uccuucccucucaugacuu

SEQ ID NO: 638219 - RNA, 16 nt, Homo sapiens
ggaaucaaaucugugc

SEQ ID NO: 638220 - RNA, 22 nt, Homo sapiens
ggaaucaauucaauuuggacug

SEQ ID NO: 638221 - RNA, 23 nt, Homo sapiens
ggaaucaccaauggcuccuugcc

SEQ ID NO: 638222 - RNA, 12 nt, Homo sapiens
ggaaucacuguu

SEQ ID NO: 638223 - RNA, 21 nt, Homo sapiens
ggaauccauguaaauugcaaa

SEQ ID NO: 638224 - RNA, 15 nt, Homo sapiens
ggaaucccacuguau

SEQ ID NO: 638225 - RNA, 16 nt, Homo sapiens
ggaaucuucugaauuu

SEQ ID NO: 638226 - RNA, 17 nt, Homo sapiens
ggaaugcaauccuuccc

SEQ ID NO: 638227 - RNA, 20 nt, Homo sapiens
ggaaugcaccuccccaaagc

SEQ ID NO: 638228 - RNA, 12 nt, Homo sapiens
ggaaugccuugg

SEQ ID NO: 638229 - RNA, 20 nt, Homo sapiens
uccuucuuacagaaguauuu

SEQ ID NO: 638230 - RNA, 22 nt, Homo sapiens
uccuugaacugaggcccuguga

SEQ ID NO: 638231 - RNA, 13 nt, Homo sapiens
uccuugaaucuuc

SEQ ID NO: 638232 - RNA, 13 nt, Homo sapiens
uccuugacccaga

SEQ ID NO: 638233 - RNA, 17 nt, Homo sapiens
uccuugacuucuuugag

SEQ ID NO: 638234 - RNA, 23 nt, Homo sapiens
uccuugagaggagaaaugcaaua

SEQ ID NO: 638235 - RNA, 18 nt, Homo sapiens
uccuugagcacccggaaa

SEQ ID NO: 638236 - RNA, 17 nt, Homo sapiens
uccuugauacugcucau

SEQ ID NO: 638237 - RNA, 20 nt, Homo sapiens
uccuugcccagacuacaggg

SEQ ID NO: 638238 - RNA, 14 nt, Homo sapiens
uccuugcgccucag

SEQ ID NO: 638239 - RNA, 15 nt, Homo sapiens
uccuugcuuccuguc

SEQ ID NO: 638240 - RNA, 18 nt, Homo sapiens
uccuugcuuccugucuua

SEQ ID NO: 638241 - RNA, 15 nt, Homo sapiens
uccuuggaaauugga

SEQ ID NO: 638242 - RNA, 10 nt, Homo sapiens
uccuuggcau

SEQ ID NO: 638243 - RNA, 17 nt, Homo sapiens
uccuuggcucccauuca

SEQ ID NO: 638244 - RNA, 18 nt, Homo sapiens
uccuugggaugaucuuga

SEQ ID NO: 638245 - RNA, 21 nt, Homo sapiens
uccuugggcgucucccccaga

SEQ ID NO: 638246 - RNA, 16 nt, Homo sapiens
uccuuggggagcacuu

SEQ ID NO: 638247 - RNA, 21 nt, Homo sapiens
uccuuggggagcacuugucca

SEQ ID NO: 638248 - RNA, 21 nt, Homo sapiens
uccuugguuguauaaagcaaa

SEQ ID NO: 638249 - RNA, 15 nt, Homo sapiens
uccuuguaaguuauu

SEQ ID NO: 638250 - RNA, 21 nt, Homo sapiens
uccuugugccugcuccuguac

SEQ ID NO: 638251 - RNA, 12 nt, Homo sapiens
uccuuguggucu

SEQ ID NO: 638252 - RNA, 20 nt, Homo sapiens
uccuuuacgguccaugccuu

SEQ ID NO: 638253 - RNA, 13 nt, Homo sapiens
uccuuuaugaucc

SEQ ID NO: 638254 - RNA, 21 nt, Homo sapiens
uccuuuccuacuguccuggaa

SEQ ID NO: 638255 - RNA, 15 nt, Homo sapiens
uccuuucuccaggac

SEQ ID NO: 638256 - RNA, 15 nt, Homo sapiens
uccuuucuccuguga

SEQ ID NO: 638257 - RNA, 20 nt, Homo sapiens
uccuuucugugcccuacuca

SEQ ID NO: 638258 - RNA, 12 nt, Homo sapiens
uccuuucuuuuc

SEQ ID NO: 638259 - RNA, 20 nt, Homo sapiens
uccuuugaaaagagaauauu

SEQ ID NO: 638260 - RNA, 16 nt, Homo sapiens
uccuuugaagcuuuag

SEQ ID NO: 638261 - RNA, 20 nt, Homo sapiens
uccuuugccugauccuccaa

SEQ ID NO: 638262 - RNA, 13 nt, Homo sapiens
uccuuugugcuua

SEQ ID NO: 638263 - RNA, 20 nt, Homo sapiens
uccuuuuaaaaaccuagguc

SEQ ID NO: 638264 - RNA, 16 nt, Homo sapiens
uccuuuuaacugccaa

SEQ ID NO: 638265 - RNA, 17 nt, Homo sapiens
uccuuuuaagcagugag

SEQ ID NO: 638266 - RNA, 21 nt, Homo sapiens
uccuuuuauucccugggucuc

SEQ ID NO: 638267 - RNA, 15 nt, Homo sapiens
uccuuuuccagaaau

SEQ ID NO: 638268 - RNA, 16 nt, Homo sapiens
uccuuuucccaaagca

SEQ ID NO: 638269 - RNA, 22 nt, Homo sapiens
uccuuuucccaaagcaucccuc

SEQ ID NO: 638270 - RNA, 16 nt, Homo sapiens
uccuuuucccuauuuc

SEQ ID NO: 638271 - RNA, 16 nt, Homo sapiens
uccuuuucuccuugcc

SEQ ID NO: 638272 - RNA, 14 nt, Homo sapiens
uccuuuucuucacc

SEQ ID NO: 638273 - RNA, 13 nt, Homo sapiens
uccuuuugaccaa

SEQ ID NO: 638274 - RNA, 17 nt, Homo sapiens
uccuuuugaccaaauaa

SEQ ID NO: 638275 - RNA, 13 nt, Homo sapiens
uccuuuugcaaag

SEQ ID NO: 638276 - RNA, 15 nt, Homo sapiens
uccuuuugguuuugg

SEQ ID NO: 638277 - RNA, 16 nt, Homo sapiens
uccuuuuucacuuuga

SEQ ID NO: 638278 - RNA, 17 nt, Homo sapiens
uccuuuuucuucacuua

SEQ ID NO: 638279 - RNA, 19 nt, Homo sapiens
ucgaacuccaggcuuucug

SEQ ID NO: 638280 - RNA, 20 nt, Homo sapiens
ucgaagaaacccuugcugcu

SEQ ID NO: 638281 - RNA, 13 nt, Homo sapiens
ucgaagcucagcc

SEQ ID NO: 638282 - RNA, 15 nt, Homo sapiens
ucgaaguugaugcaa

SEQ ID NO: 638283 - RNA, 23 nt, Homo sapiens
ucgaauacaaaucaaagauuugu

SEQ ID NO: 638284 - RNA, 17 nt, Homo sapiens
ucgaaucucugugccuu

SEQ ID NO: 638285 - RNA, 17 nt, Homo sapiens
ucgaauucucacaagga

SEQ ID NO: 638286 - RNA, 16 nt, Homo sapiens
ucgacaugcugccagg

SEQ ID NO: 638287 - RNA, 18 nt, Homo sapiens
ucgagaccauccuggcua

SEQ ID NO: 638288 - RNA, 22 nt, Homo sapiens
ucgagagcuggccaaagagccu

SEQ ID NO: 638289 - RNA, 16 nt, Homo sapiens
ucgagauugcacugcu

SEQ ID NO: 638290 - RNA, 13 nt, Homo sapiens
ucgauagccugag

SEQ ID NO: 638291 - RNA, 22 nt, Homo sapiens
ucgauauguauaucauucuaca

SEQ ID NO: 638292 - RNA, 17 nt, Homo sapiens
ucgaugcguauucugug

SEQ ID NO: 638293 - RNA, 20 nt, Homo sapiens
ucgauggaugggaugcacuc

SEQ ID NO: 638294 - RNA, 18 nt, Homo sapiens
ucgauggcucaaucuauc

SEQ ID NO: 638295 - RNA, 14 nt, Homo sapiens
ucgaugugcucagc

SEQ ID NO: 638296 - RNA, 14 nt, Homo sapiens
ucgauuaugugacu

SEQ ID NO: 638297 - RNA, 18 nt, Homo sapiens
ucgauuuucuauuaugga

SEQ ID NO: 638298 - RNA, 13 nt, Homo sapiens
ucgcacacagggc

SEQ ID NO: 638299 - RNA, 15 nt, Homo sapiens
ucgcaccacugcacu

SEQ ID NO: 638300 - RNA, 14 nt, Homo sapiens
ucgcaccuuuccaa

SEQ ID NO: 638301 - RNA, 16 nt, Homo sapiens
ucgcacucaaugccaa

SEQ ID NO: 638302 - RNA, 22 nt, Homo sapiens
ucgcacugcccacaugggaccu

SEQ ID NO: 638303 - RNA, 12 nt, Homo sapiens
ucgcagccugaa

SEQ ID NO: 638304 - RNA, 15 nt, Homo sapiens
ucgcaggaccaaggg

SEQ ID NO: 638305 - RNA, 15 nt, Homo sapiens
ucgcauccagacagu

SEQ ID NO: 638306 - RNA, 16 nt, Homo sapiens
ucgcaucucagugcag

SEQ ID NO: 638307 - RNA, 17 nt, Homo sapiens
ucgcaucucagugcagg

SEQ ID NO: 638308 - RNA, 17 nt, Homo sapiens
ucgcauggcagccauca

SEQ ID NO: 638309 - RNA, 23 nt, Homo sapiens
ucgccaucuucuucccuuaacuc

SEQ ID NO: 638310 - RNA, 21 nt, Homo sapiens
ucgcccacccgaguaccucca

SEQ ID NO: 638311 - RNA, 17 nt, Homo sapiens
ucgcccagacaccaugu

SEQ ID NO: 638312 - RNA, 17 nt, Homo sapiens
ucgcccaggagacaucc

SEQ ID NO: 638313 - RNA, 14 nt, Homo sapiens
ucgccuguggagcu

SEQ ID NO: 638314 - RNA, 19 nt, Homo sapiens
ucgccuuuugacagcugug

SEQ ID NO: 638315 - RNA, 15 nt, Homo sapiens
ucgcgccacugcacu

SEQ ID NO: 638316 - RNA, 14 nt, Homo sapiens
ucgcggucuugggc

SEQ ID NO: 638317 - RNA, 16 nt, Homo sapiens
ucgcucagucuguuca

SEQ ID NO: 638318 - RNA, 20 nt, Homo sapiens
ucgcuccuccuucccaggga

SEQ ID NO: 638319 - RNA, 19 nt, Homo sapiens
ucgcugcauaaacuguugu

SEQ ID NO: 638320 - RNA, 14 nt, Homo sapiens
ucgcugccagauga

SEQ ID NO: 638321 - RNA, 22 nt, Homo sapiens
ucgcugccagaugauuguucaa

SEQ ID NO: 638322 - RNA, 14 nt, Homo sapiens
ucgcugccaucacc

SEQ ID NO: 638323 - RNA, 22 nt, Homo sapiens
ucgcuguguguuaguucccaac

SEQ ID NO: 638324 - RNA, 16 nt, Homo sapiens
ucgcuuaagccagcac

SEQ ID NO: 638325 - RNA, 23 nt, Homo sapiens
ucggacaagacccccagcacuug

SEQ ID NO: 638326 - RNA, 19 nt, Homo sapiens
ucggacggccaauggugcu

SEQ ID NO: 638327 - RNA, 18 nt, Homo sapiens
ucggauacacacucgaau

SEQ ID NO: 638328 - RNA, 15 nt, Homo sapiens
ucggauacuugccaa

SEQ ID NO: 638329 - RNA, 19 nt, Homo sapiens
ucggauuugccauagccuu

SEQ ID NO: 638330 - RNA, 20 nt, Homo sapiens
ucggauuugccauagccuug

SEQ ID NO: 638331 - RNA, 15 nt, Homo sapiens
ucggcacacacugug

SEQ ID NO: 638332 - RNA, 19 nt, Homo sapiens
ucggccagagucuguuuca

SEQ ID NO: 638333 - RNA, 14 nt, Homo sapiens
ucggccccaucucu

SEQ ID NO: 638334 - RNA, 16 nt, Homo sapiens
ucggcccggagcagca

SEQ ID NO: 638335 - RNA, 11 nt, Homo sapiens
ucggccuucac

SEQ ID NO: 638336 - RNA, 20 nt, Homo sapiens
ucggcuccccauguguccug

SEQ ID NO: 638337 - RNA, 14 nt, Homo sapiens
ucggcuccugaugg

SEQ ID NO: 638338 - RNA, 20 nt, Homo sapiens
ucggcuuccuacagccagca

SEQ ID NO: 638339 - RNA, 16 nt, Homo sapiens
ucggcuugaucacagc

SEQ ID NO: 638340 - RNA, 12 nt, Homo sapiens
ucggcuuuuugc

SEQ ID NO: 638341 - RNA, 15 nt, Homo sapiens
ucggcuuuuugccau

SEQ ID NO: 638342 - RNA, 17 nt, Homo sapiens
ugaaauaagcugugauu

SEQ ID NO: 638343 - RNA, 18 nt, Homo sapiens
ugaaauaccagugaacca

SEQ ID NO: 638344 - RNA, 21 nt, Homo sapiens
ugaaauaccagugaaccaaag

SEQ ID NO: 638345 - RNA, 23 nt, Homo sapiens
ugaaauacuauuuaaagccuccu

SEQ ID NO: 638346 - RNA, 12 nt, Homo sapiens
ugaaauaucauc

SEQ ID NO: 638347 - RNA, 22 nt, Homo sapiens
ugaaauaugauaauaaaggcau

SEQ ID NO: 638348 - RNA, 16 nt, Homo sapiens
ugaaauaugcauacua

SEQ ID NO: 638349 - RNA, 23 nt, Homo sapiens
ugaaauauuuagaagugcuaauu

SEQ ID NO: 638350 - RNA, 16 nt, Homo sapiens
ugaaaucagcaugaca

SEQ ID NO: 638351 - RNA, 20 nt, Homo sapiens
ugaaauccagugagcacuag

SEQ ID NO: 638352 - RNA, 16 nt, Homo sapiens
ugaaaucuguaucugu

SEQ ID NO: 638353 - RNA, 15 nt, Homo sapiens
ugaaaugaaaacaug

SEQ ID NO: 638354 - RNA, 16 nt, Homo sapiens
ugaaaugcuggcauuu

SEQ ID NO: 638355 - RNA, 19 nt, Homo sapiens
ugaaaugcuggcauuugca

SEQ ID NO: 638356 - RNA, 13 nt, Homo sapiens
ugaaaugcuucca

SEQ ID NO: 638357 - RNA, 14 nt, Homo sapiens
ugaaaugcuuuuau

SEQ ID NO: 638358 - RNA, 17 nt, Homo sapiens
ugaaauguaugugcucu

SEQ ID NO: 638359 - RNA, 17 nt, Homo sapiens
ugaaaugucgaucaaga

SEQ ID NO: 638360 - RNA, 20 nt, Homo sapiens
ugaaaugucuggucugucca

SEQ ID NO: 638361 - RNA, 16 nt, Homo sapiens
ugaaauuagggcccaa

SEQ ID NO: 638362 - RNA, 15 nt, Homo sapiens
ugaaauuauaaucug

SEQ ID NO: 638363 - RNA, 22 nt, Homo sapiens
ugaaauuaugugacauuuuaca

SEQ ID NO: 638364 - RNA, 17 nt, Homo sapiens
ugaaauucacaguaaua

SEQ ID NO: 638365 - RNA, 15 nt, Homo sapiens
gguggacuucagugu

SEQ ID NO: 638366 - RNA, 17 nt, Homo sapiens
gguggagauugcaguga

SEQ ID NO: 638367 - RNA, 23 nt, Homo sapiens
gguggagggaaggauaaagccac

SEQ ID NO: 638368 - RNA, 21 nt, Homo sapiens
gguggauuuuguggaggugag

SEQ ID NO: 638369 - RNA, 16 nt, Homo sapiens
gguggcaggugccuug

SEQ ID NO: 638370 - RNA, 13 nt, Homo sapiens
gguggccacagcg

SEQ ID NO: 638371 - RNA, 19 nt, Homo sapiens
gguggccgucacgcuuuca

SEQ ID NO: 638372 - RNA, 16 nt, Homo sapiens
gguggcggcugcacaa

SEQ ID NO: 638373 - RNA, 20 nt, Homo sapiens
gguggcgggaauccuauuua

SEQ ID NO: 638374 - RNA, 17 nt, Homo sapiens
gguggcucacgccugua

SEQ ID NO: 638375 - RNA, 19 nt, Homo sapiens
ggugggccuccucugucca

SEQ ID NO: 638376 - RNA, 16 nt, Homo sapiens
ggugggcggacaaaag

SEQ ID NO: 638377 - RNA, 13 nt, Homo sapiens
ggugggugggaug

SEQ ID NO: 638378 - RNA, 14 nt, Homo sapiens
gguggguguggcca

SEQ ID NO: 638379 - RNA, 13 nt, Homo sapiens
ggugguaccugag

SEQ ID NO: 638380 - RNA, 18 nt, Homo sapiens
gguguacacggaggucuc

SEQ ID NO: 638381 - RNA, 14 nt, Homo sapiens
gguguauguaugag

SEQ ID NO: 638382 - RNA, 21 nt, Homo sapiens
ggugucaguauccaggcuuug

SEQ ID NO: 638383 - RNA, 19 nt, Homo sapiens
gguguccccuauccucccc

SEQ ID NO: 638384 - RNA, 14 nt, Homo sapiens
ggugugaguccaaa

SEQ ID NO: 638385 - RNA, 20 nt, Homo sapiens
ggugugugccacucagagac

SEQ ID NO: 638386 - RNA, 18 nt, Homo sapiens
gguguguguucaccuuca

SEQ ID NO: 638387 - RNA, 22 nt, Homo sapiens
gguguuuuguaaaggauaucaa

SEQ ID NO: 638388 - RNA, 16 nt, Homo sapiens
gguuaaaacaaaaaca

SEQ ID NO: 638389 - RNA, 20 nt, Homo sapiens
gguuaaacccacagccaaac

SEQ ID NO: 638390 - RNA, 13 nt, Homo sapiens
gguuaaagcuaaa

SEQ ID NO: 638391 - RNA, 14 nt, Homo sapiens
gguuaaauuugaau

SEQ ID NO: 638392 - RNA, 15 nt, Homo sapiens
gguuaauucauuugg

SEQ ID NO: 638393 - RNA, 18 nt, Homo sapiens
gguuacaaucauugcuga

SEQ ID NO: 638394 - RNA, 12 nt, Homo sapiens
gguuacuacccu

SEQ ID NO: 638395 - RNA, 17 nt, Homo sapiens
gguuauagcuucaggag

SEQ ID NO: 638396 - RNA, 16 nt, Homo sapiens
gguuauguaucagaag

SEQ ID NO: 638397 - RNA, 12 nt, Homo sapiens
gguucaagugac

SEQ ID NO: 638398 - RNA, 15 nt, Homo sapiens
gguucaagugacucu

SEQ ID NO: 638399 - RNA, 22 nt, Homo sapiens
gguucacagaagcacagcaccc

SEQ ID NO: 638400 - RNA, 16 nt, Homo sapiens
gguucaccaugcagug

SEQ ID NO: 638401 - RNA, 13 nt, Homo sapiens
gguucacugagcu

SEQ ID NO: 638402 - RNA, 14 nt, Homo sapiens
gguuccaacuguau

SEQ ID NO: 638403 - RNA, 22 nt, Homo sapiens
gguucccaagaguauccuaccc

SEQ ID NO: 638404 - RNA, 14 nt, Homo sapiens
gguuccgccacucc

SEQ ID NO: 638405 - RNA, 16 nt, Homo sapiens
gguucguuuaccaaau

SEQ ID NO: 638406 - RNA, 12 nt, Homo sapiens
gguucucuacag

SEQ ID NO: 638407 - RNA, 23 nt, Homo sapiens
gguucucuuagcaacucagagaa

SEQ ID NO: 638408 - RNA, 14 nt, Homo sapiens
gguucugcacuguu

SEQ ID NO: 638409 - RNA, 16 nt, Homo sapiens
gguucuucagggccag

SEQ ID NO: 638410 - RNA, 17 nt, Homo sapiens
gguucuucagggccagu

SEQ ID NO: 638411 - RNA, 23 nt, Homo sapiens
gguugaaaaaauagauccaauca

SEQ ID NO: 638412 - RNA, 21 nt, Homo sapiens
gguugaacucugguggcacag

SEQ ID NO: 638413 - RNA, 12 nt, Homo sapiens
gguugaaggcag

SEQ ID NO: 638414 - RNA, 12 nt, Homo sapiens
gguugacauuuu

SEQ ID NO: 638415 - RNA, 22 nt, Homo sapiens
gguugcagugcugagcuguggg

SEQ ID NO: 638416 - RNA, 14 nt, Homo sapiens
gguugcauucuacu

SEQ ID NO: 638417 - RNA, 17 nt, Homo sapiens
gguugccucucuugccc

SEQ ID NO: 638418 - RNA, 21 nt, Homo sapiens
gguuggauggauggguggaug

SEQ ID NO: 638419 - RNA, 13 nt, Homo sapiens
gguuggauggugg

SEQ ID NO: 638420 - RNA, 21 nt, Homo sapiens
gguuggcugggcccagaaggu

SEQ ID NO: 638421 - RNA, 15 nt, Homo sapiens
gguugggcagccaga

SEQ ID NO: 638422 - RNA, 20 nt, Homo sapiens
gguuggggugacagucauca

SEQ ID NO: 638423 - RNA, 18 nt, Homo sapiens
gguuggugcacagugauu

SEQ ID NO: 638424 - RNA, 15 nt, Homo sapiens
gguugugcagggugu

SEQ ID NO: 638425 - RNA, 17 nt, Homo sapiens
gguuuaucagcaaaaaa

SEQ ID NO: 638426 - RNA, 21 nt, Homo sapiens
gguuucacccuuaacccaagg

SEQ ID NO: 638427 - RNA, 14 nt, Homo sapiens
gguuucaccugggc

SEQ ID NO: 638428 - RNA, 14 nt, Homo sapiens
gguuucaccuuccc

SEQ ID NO: 638429 - RNA, 14 nt, Homo sapiens
gguuucacuauucc

SEQ ID NO: 638430 - RNA, 22 nt, Homo sapiens
gguuucagaaaauaaaugguuu

SEQ ID NO: 638431 - RNA, 20 nt, Homo sapiens
gguuucauguucacugugag

SEQ ID NO: 638432 - RNA, 12 nt, Homo sapiens
gguuucauucug

SEQ ID NO: 638433 - RNA, 17 nt, Homo sapiens
gguuucucucccuccuu

SEQ ID NO: 638434 - RNA, 14 nt, Homo sapiens
gguuucucuguaua

SEQ ID NO: 638435 - RNA, 21 nt, Homo sapiens
gguuucuggcagccaguaccu

SEQ ID NO: 638436 - RNA, 14 nt, Homo sapiens
gguuucuucaagag

SEQ ID NO: 638437 - RNA, 16 nt, Homo sapiens
gguuugggcugucuua

SEQ ID NO: 638438 - RNA, 17 nt, Homo sapiens
gguuuggggucugccac

SEQ ID NO: 638439 - RNA, 20 nt, Homo sapiens
gguuugguagacuuggacau

SEQ ID NO: 638440 - RNA, 23 nt, Homo sapiens
gguuugucacacgauaaagggau

SEQ ID NO: 638441 - RNA, 15 nt, Homo sapiens
gguuugucaguucuu

SEQ ID NO: 638442 - RNA, 19 nt, Homo sapiens
gguuuguguuugaguuuua

SEQ ID NO: 638443 - RNA, 19 nt, Homo sapiens
gguuuguuauaucagggaa

SEQ ID NO: 638444 - RNA, 20 nt, Homo sapiens
gguuuuaaccgcacaugcac

SEQ ID NO: 638445 - RNA, 15 nt, Homo sapiens
gguuuuacugcagcu

SEQ ID NO: 638446 - RNA, 21 nt, Homo sapiens
gguuuuauaaggcugauguca

SEQ ID NO: 638447 - RNA, 15 nt, Homo sapiens
gguuuuuaaaccuuc

SEQ ID NO: 638448 - RNA, 21 nt, Homo sapiens
guaaaaauugauuacaauuga

SEQ ID NO: 638449 - RNA, 17 nt, Homo sapiens
guaaaaauuuuuuugca

SEQ ID NO: 638450 - RNA, 13 nt, Homo sapiens
guaaaacaaagag

SEQ ID NO: 638451 - RNA, 14 nt, Homo sapiens
guaaaacaaucugu

SEQ ID NO: 638452 - RNA, 21 nt, Homo sapiens
guaaaacaugcugaaaacuac

SEQ ID NO: 638453 - RNA, 15 nt, Homo sapiens
guaaaacuauauucu

SEQ ID NO: 638454 - RNA, 21 nt, Homo sapiens
guaaaacuauauucucagugu

SEQ ID NO: 638455 - RNA, 16 nt, Homo sapiens
guaaaagugugagcag

SEQ ID NO: 638456 - RNA, 21 nt, Homo sapiens
guaaaaguucuuuuugcucua

SEQ ID NO: 638457 - RNA, 14 nt, Homo sapiens
guaaaauauaucau

SEQ ID NO: 638458 - RNA, 15 nt, Homo sapiens
guaaaaugaaggaaa

SEQ ID NO: 638459 - RNA, 20 nt, Homo sapiens
guaaacugaggcccaaagca

SEQ ID NO: 638460 - RNA, 15 nt, Homo sapiens
guaaacuguaucaaa

SEQ ID NO: 638461 - RNA, 12 nt, Homo sapiens
guaaacuuccaa

SEQ ID NO: 638462 - RNA, 20 nt, Homo sapiens
guaaacuucugaagacugag

SEQ ID NO: 638463 - RNA, 22 nt, Homo sapiens
guaaacuuuucaguauugcugu

SEQ ID NO: 638464 - RNA, 21 nt, Homo sapiens
guacauggaauaacauguaau

SEQ ID NO: 638465 - RNA, 18 nt, Homo sapiens
guacauguaacauuaaag

SEQ ID NO: 638466 - RNA, 22 nt, Homo sapiens
guacauucaauguuuaugcaag

SEQ ID NO: 638467 - RNA, 20 nt, Homo sapiens
guacauucuuccaucaucac

SEQ ID NO: 638468 - RNA, 11 nt, Homo sapiens
guacauuucac

SEQ ID NO: 638469 - RNA, 11 nt, Homo sapiens
guaccaaaaca

SEQ ID NO: 638470 - RNA, 21 nt, Homo sapiens
guaccacucaggccaacaagc

SEQ ID NO: 638471 - RNA, 15 nt, Homo sapiens
guaccauuccuucaa

SEQ ID NO: 638472 - RNA, 12 nt, Homo sapiens
guaccauuuaau

SEQ ID NO: 638473 - RNA, 22 nt, Homo sapiens
guaccauuuaugaagguuuguu

SEQ ID NO: 638474 - RNA, 14 nt, Homo sapiens
guacccaagugaag

SEQ ID NO: 638475 - RNA, 13 nt, Homo sapiens
guaccgacuuuga

SEQ ID NO: 638476 - RNA, 21 nt, Homo sapiens
guaccggcuuccauccuguca

SEQ ID NO: 638477 - RNA, 19 nt, Homo sapiens
guaccuccagucacacucc

SEQ ID NO: 638478 - RNA, 18 nt, Homo sapiens
guaccuccucucaguguu

SEQ ID NO: 638479 - RNA, 13 nt, Homo sapiens
guaccucuaagua

SEQ ID NO: 638480 - RNA, 21 nt, Homo sapiens
guaccuguauuaaaagauucc

SEQ ID NO: 638481 - RNA, 21 nt, Homo sapiens
guacgaaucgaauacaaauca

SEQ ID NO: 638482 - RNA, 13 nt, Homo sapiens
guacuaaccugga

SEQ ID NO: 638483 - RNA, 24 nt, Homo sapiens
guacuaagcaguaagcuaucuuca

SEQ ID NO: 638484 - RNA, 22 nt, Homo sapiens
guacuaugucugaacauagaaa

SEQ ID NO: 638485 - RNA, 16 nt, Homo sapiens
guacucagcgaaugaa

SEQ ID NO: 638486 - RNA, 20 nt, Homo sapiens
guacuccagccugggugaca

SEQ ID NO: 638487 - RNA, 16 nt, Homo sapiens
guacuccuuaagaaca

SEQ ID NO: 638488 - RNA, 15 nt, Homo sapiens
guacucggcuuccug

SEQ ID NO: 638489 - RNA, 18 nt, Homo sapiens
guacucuguccaguuccu

SEQ ID NO: 638490 - RNA, 16 nt, Homo sapiens
ugaagggccacuggga

SEQ ID NO: 638491 - RNA, 19 nt, Homo sapiens
ugaagggccacugggaccc

SEQ ID NO: 638492 - RNA, 24 nt, Homo sapiens
ugaaggggaaccccggggugccca

SEQ ID NO: 638493 - RNA, 16 nt, Homo sapiens
ugaaggucacucuucc

SEQ ID NO: 638494 - RNA, 13 nt, Homo sapiens
ugaaggugauuca

SEQ ID NO: 638495 - RNA, 13 nt, Homo sapiens
ugaaggugguggg

SEQ ID NO: 638496 - RNA, 23 nt, Homo sapiens
ugaaguacaguaguuucccuacu

SEQ ID NO: 638497 - RNA, 21 nt, Homo sapiens
ugaaguagacucauucuucac

SEQ ID NO: 638498 - RNA, 20 nt, Homo sapiens
ugaaguaggugugacuugaa

SEQ ID NO: 638499 - RNA, 13 nt, Homo sapiens
ugaagucucagga

SEQ ID NO: 638500 - RNA, 16 nt, Homo sapiens
ugaagugcuguggcug

SEQ ID NO: 638501 - RNA, 11 nt, Homo sapiens
ugaagugcuug

SEQ ID NO: 638502 - RNA, 12 nt, Homo sapiens
ugaagugucaca

SEQ ID NO: 638503 - RNA, 16 nt, Homo sapiens
ugaaguguccuaaaua

SEQ ID NO: 638504 - RNA, 23 nt, Homo sapiens
ugaaguucagugauaacucugag

SEQ ID NO: 638505 - RNA, 15 nt, Homo sapiens
ugaaguuuacaauca

SEQ ID NO: 638506 - RNA, 16 nt, Homo sapiens
ugaaguuugaacuuca

SEQ ID NO: 638507 - RNA, 15 nt, Homo sapiens
ugaaguuugcuauuc

SEQ ID NO: 638508 - RNA, 17 nt, Homo sapiens
ugaaguuuugauuuauu

SEQ ID NO: 638509 - RNA, 22 nt, Homo sapiens
ugaauaaaaaauagacauguag

SEQ ID NO: 638510 - RNA, 16 nt, Homo sapiens
ugaauaaaagugcaca

SEQ ID NO: 638511 - RNA, 22 nt, Homo sapiens
ugaauaaaguguaaguucacaa

SEQ ID NO: 638512 - RNA, 19 nt, Homo sapiens
ugaauaaaguugaagcuaa

SEQ ID NO: 638513 - RNA, 23 nt, Homo sapiens
ugaauaaaugauuaaaaaaucag

SEQ ID NO: 638514 - RNA, 18 nt, Homo sapiens
ugaauaaauugaacuaaa

SEQ ID NO: 638515 - RNA, 22 nt, Homo sapiens
ugaauaacauuugugugguggg

SEQ ID NO: 638516 - RNA, 16 nt, Homo sapiens
ugaauaaccacuuaaa

SEQ ID NO: 638517 - RNA, 14 nt, Homo sapiens
ugaauaacugagcu

SEQ ID NO: 638518 - RNA, 19 nt, Homo sapiens
ugaauaagacaacaaagag

SEQ ID NO: 638519 - RNA, 19 nt, Homo sapiens
ugaauaagcuuucucucag

SEQ ID NO: 638520 - RNA, 20 nt, Homo sapiens
ugaauaagcuuucucucaga

SEQ ID NO: 638521 - RNA, 22 nt, Homo sapiens
ugaauaauacaguaucucaggg

SEQ ID NO: 638522 - RNA, 16 nt, Homo sapiens
ugaauacaaagugaug

SEQ ID NO: 638523 - RNA, 23 nt, Homo sapiens
ugaauacaggagcccucuccuca

SEQ ID NO: 638524 - RNA, 13 nt, Homo sapiens
ugaauacauuucc

SEQ ID NO: 638525 - RNA, 17 nt, Homo sapiens
ugaauacucuucccaca

SEQ ID NO: 638526 - RNA, 22 nt, Homo sapiens
ugaauacuuacuauaauuugac

SEQ ID NO: 638527 - RNA, 13 nt, Homo sapiens
ugaauagcuuguu

SEQ ID NO: 638528 - RNA, 14 nt, Homo sapiens
ugaauaguacauuu

SEQ ID NO: 638529 - RNA, 21 nt, Homo sapiens
ugaauauaaaugggaaaucag

SEQ ID NO: 638530 - RNA, 19 nt, Homo sapiens
ugaauaucaggcuauuauu

SEQ ID NO: 638531 - RNA, 13 nt, Homo sapiens
ugaauauccagaa

SEQ ID NO: 638532 - RNA, 14 nt, Homo sapiens
ugaauaugacaaag

SEQ ID NO: 638533 - RNA, 13 nt, Homo sapiens
ugaauauguagua

SEQ ID NO: 638534 - RNA, 21 nt, Homo sapiens
ugaauauuuguauacacauaa

SEQ ID NO: 638535 - RNA, 21 nt, Homo sapiens
ugaauauuuuuuuuuugccaa

SEQ ID NO: 638536 - RNA, 22 nt, Homo sapiens
ugaaucaaugaaaaauguaauu

SEQ ID NO: 638537 - RNA, 17 nt, Homo sapiens
ugaaucagacccuaccc

SEQ ID NO: 638538 - RNA, 23 nt, Homo sapiens
ugaaucaguccuagaauguuuca

SEQ ID NO: 638539 - RNA, 21 nt, Homo sapiens
ugaaucaugagccugcuggaa

SEQ ID NO: 638540 - RNA, 18 nt, Homo sapiens
ugaauccaaaucuguccu

SEQ ID NO: 638541 - RNA, 17 nt, Homo sapiens
ugaaucuauaaguagua

SEQ ID NO: 638542 - RNA, 17 nt, Homo sapiens
ugaaucucccacuccag

SEQ ID NO: 638543 - RNA, 18 nt, Homo sapiens
ugaaucugaacugcucua

SEQ ID NO: 638544 - RNA, 20 nt, Homo sapiens
ugaaucugguguuggggaaa

SEQ ID NO: 638545 - RNA, 20 nt, Homo sapiens
ugaaucugugcuggccaugg

SEQ ID NO: 638546 - RNA, 20 nt, Homo sapiens
ugaaugaaaauacaucuuuu

SEQ ID NO: 638547 - RNA, 20 nt, Homo sapiens
ugaaugaacacucuuuugcu

SEQ ID NO: 638548 - RNA, 14 nt, Homo sapiens
ugaaugauaaacuc

SEQ ID NO: 638549 - RNA, 19 nt, Homo sapiens
ugaaugaucuuguguaagg

SEQ ID NO: 638550 - RNA, 14 nt, Homo sapiens
ugaaugcaaaguag

SEQ ID NO: 638551 - RNA, 20 nt, Homo sapiens
ugaaugccuaaauauaauua

SEQ ID NO: 638552 - RNA, 14 nt, Homo sapiens
ugaaugcugccaca

SEQ ID NO: 638553 - RNA, 16 nt, Homo sapiens
ugaaugcugccacaac

SEQ ID NO: 638554 - RNA, 15 nt, Homo sapiens
ugaaugggcugagaa

SEQ ID NO: 638555 - RNA, 22 nt, Homo sapiens
ugaaugguccaggguugaucac

SEQ ID NO: 638556 - RNA, 14 nt, Homo sapiens
ugaaugguggugga

SEQ ID NO: 638557 - RNA, 15 nt, Homo sapiens
ugaauguagcuucca

SEQ ID NO: 638558 - RNA, 22 nt, Homo sapiens
ugaaugugcuggugaacacugu

SEQ ID NO: 638559 - RNA, 13 nt, Homo sapiens
ugaauguggacuc

SEQ ID NO: 638560 - RNA, 23 nt, Homo sapiens
ugaaugugguuacuuccuacugu

SEQ ID NO: 638561 - RNA, 14 nt, Homo sapiens
ugaaugugucaggu

SEQ ID NO: 638562 - RNA, 12 nt, Homo sapiens
ugaauguucaau

SEQ ID NO: 638563 - RNA, 13 nt, Homo sapiens
ugaauguuuccaa

SEQ ID NO: 638564 - RNA, 14 nt, Homo sapiens
ugaauuaagccauc

SEQ ID NO: 638565 - RNA, 15 nt, Homo sapiens
ugaauuaaucaucua

SEQ ID NO: 638566 - RNA, 19 nt, Homo sapiens
ugaauuagaagccaucuga

SEQ ID NO: 638567 - RNA, 15 nt, Homo sapiens
ugaauuauggaucag

SEQ ID NO: 638568 - RNA, 19 nt, Homo sapiens
ugaauuauguuuugacaca

SEQ ID NO: 638569 - RNA, 17 nt, Homo sapiens
ugaauuauugacacuga

SEQ ID NO: 638570 - RNA, 17 nt, Homo sapiens
ugaauucuggaaucaca

SEQ ID NO: 638571 - RNA, 15 nt, Homo sapiens
ugaauugaaucuaca

SEQ ID NO: 638572 - RNA, 12 nt, Homo sapiens
ugaauugcacau

SEQ ID NO: 638573 - RNA, 17 nt, Homo sapiens
ugaauuguuaauucaca

SEQ ID NO: 638574 - RNA, 13 nt, Homo sapiens
ugaauuucacugu

SEQ ID NO: 638575 - RNA, 16 nt, Homo sapiens
ugaauuucccacauac

SEQ ID NO: 638576 - RNA, 13 nt, Homo sapiens
ugaauuuguccaa

SEQ ID NO: 638577 - RNA, 16 nt, Homo sapiens
ugaauuuuaaauguuc

SEQ ID NO: 638578 - RNA, 14 nt, Homo sapiens
ugaauuuucagaga

SEQ ID NO: 638579 - RNA, 14 nt, Homo sapiens
ugaauuuucccuga

SEQ ID NO: 638580 - RNA, 19 nt, Homo sapiens
ugaauuuuuaagcugcaaa

SEQ ID NO: 638581 - RNA, 16 nt, Homo sapiens
ugaauuuuuacauuug

SEQ ID NO: 638582 - RNA, 23 nt, Homo sapiens
ugacaaaaaggugcagaaggcaa

SEQ ID NO: 638583 - RNA, 18 nt, Homo sapiens
ugacaaaaaugguuuuga

SEQ ID NO: 638584 - RNA, 20 nt, Homo sapiens
ugacaaaagaaaauuuucca

SEQ ID NO: 638585 - RNA, 16 nt, Homo sapiens
ugacaaacauauccuu

SEQ ID NO: 638586 - RNA, 18 nt, Homo sapiens
gucuucccucagauuucc

SEQ ID NO: 638587 - RNA, 19 nt, Homo sapiens
gucuucccugaucaaguca

SEQ ID NO: 638588 - RNA, 20 nt, Homo sapiens
gucuucccuucugauugaug

SEQ ID NO: 638589 - RNA, 21 nt, Homo sapiens
gucuuccugaguggugccaaa

SEQ ID NO: 638590 - RNA, 22 nt, Homo sapiens
gucuuccugaguggugccaaac

SEQ ID NO: 638591 - RNA, 14 nt, Homo sapiens
gucuucuaauuccu

SEQ ID NO: 638592 - RNA, 19 nt, Homo sapiens
gucuucuaauuucaaaaau

SEQ ID NO: 638593 - RNA, 18 nt, Homo sapiens
gucuucugggcacagugg

SEQ ID NO: 638594 - RNA, 19 nt, Homo sapiens
gucuugacucauggcagcu

SEQ ID NO: 638595 - RNA, 17 nt, Homo sapiens
gucuugaugacugcuga

SEQ ID NO: 638596 - RNA, 15 nt, Homo sapiens
gucuugcucugucac

SEQ ID NO: 638597 - RNA, 18 nt, Homo sapiens
gucuuggaacauuggaau

SEQ ID NO: 638598 - RNA, 22 nt, Homo sapiens
gucuuggcucacugcaacuucu

SEQ ID NO: 638599 - RNA, 14 nt, Homo sapiens
gucuuggcuuucau

SEQ ID NO: 638600 - RNA, 20 nt, Homo sapiens
gucuuggcuuucauguuauu

SEQ ID NO: 638601 - RNA, 13 nt, Homo sapiens
gucuuguguuucu

SEQ ID NO: 638602 - RNA, 15 nt, Homo sapiens
gucuuuacagaauca

SEQ ID NO: 638603 - RNA, 20 nt, Homo sapiens
gucuuuaugaaguuugcuau

SEQ ID NO: 638604 - RNA, 13 nt, Homo sapiens
gucuuucaaugac

SEQ ID NO: 638605 - RNA, 14 nt, Homo sapiens
gucuuucauugcua

SEQ ID NO: 638606 - RNA, 14 nt, Homo sapiens
gucuuucucucuca

SEQ ID NO: 638607 - RNA, 19 nt, Homo sapiens
gucuuugccagucauucag

SEQ ID NO: 638608 - RNA, 22 nt, Homo sapiens
gucuuuggauaauaggaauuca

SEQ ID NO: 638609 - RNA, 13 nt, Homo sapiens
gucuuuguggacu

SEQ ID NO: 638610 - RNA, 16 nt, Homo sapiens
gucuuuguucugugau

SEQ ID NO: 638611 - RNA, 21 nt, Homo sapiens
gucuuuuacccugugucagag

SEQ ID NO: 638612 - RNA, 14 nt, Homo sapiens
gucuuuugaugaau

SEQ ID NO: 638613 - RNA, 21 nt, Homo sapiens
gucuuuuuuucccuaccauuc

SEQ ID NO: 638614 - RNA, 22 nt, Homo sapiens
gucuuuuuuucccuaccauuca

SEQ ID NO: 638615 - RNA, 15 nt, Homo sapiens
gugaaaaaagcaaau

SEQ ID NO: 638616 - RNA, 14 nt, Homo sapiens
gugaaaaaggaaua

SEQ ID NO: 638617 - RNA, 21 nt, Homo sapiens
gugaaaaaguuaaacauugaa

SEQ ID NO: 638618 - RNA, 23 nt, Homo sapiens
gugaaaaggguacagaugugcug

SEQ ID NO: 638619 - RNA, 12 nt, Homo sapiens
gugaaaauauga

SEQ ID NO: 638620 - RNA, 16 nt, Homo sapiens
gugaaaccccaucucu

SEQ ID NO: 638621 - RNA, 13 nt, Homo sapiens
gugaaacuaacag

SEQ ID NO: 638622 - RNA, 21 nt, Homo sapiens
gugaaaggaagcuccacuguc

SEQ ID NO: 638623 - RNA, 17 nt, Homo sapiens
gugaaaggcuguggcau

SEQ ID NO: 638624 - RNA, 17 nt, Homo sapiens
gugaaauaaacagucua

SEQ ID NO: 638625 - RNA, 21 nt, Homo sapiens
gugaaauaauaaaaugcaaau

SEQ ID NO: 638626 - RNA, 15 nt, Homo sapiens
gugaaauaauuccuc

SEQ ID NO: 638627 - RNA, 19 nt, Homo sapiens
gugaaaugcuggcauuugc

SEQ ID NO: 638628 - RNA, 19 nt, Homo sapiens
gugaaauguaacaugaagc

SEQ ID NO: 638629 - RNA, 14 nt, Homo sapiens
gugaacacacugau

SEQ ID NO: 638630 - RNA, 12 nt, Homo sapiens
gugaacaucccc

SEQ ID NO: 638631 - RNA, 12 nt, Homo sapiens
gugaaccaaaga

SEQ ID NO: 638632 - RNA, 21 nt, Homo sapiens
gugaaccauggugaagugcuu

SEQ ID NO: 638633 - RNA, 17 nt, Homo sapiens
gugaaccuuaguaccua

SEQ ID NO: 638634 - RNA, 14 nt, Homo sapiens
gugaacugugcaua

SEQ ID NO: 638635 - RNA, 23 nt, Homo sapiens
gugaagacaaugacuuacuguac

SEQ ID NO: 638636 - RNA, 11 nt, Homo sapiens
gugaagaccaa

SEQ ID NO: 638637 - RNA, 21 nt, Homo sapiens
ugcuguugauucagacuuuca

SEQ ID NO: 638638 - RNA, 15 nt, Homo sapiens
ugcuguugugaagcu

SEQ ID NO: 638639 - RNA, 15 nt, Homo sapiens
ugcuguuuacuugaa

SEQ ID NO: 638640 - RNA, 22 nt, Homo sapiens
ugcuuaaacuaaugaacaaaua

SEQ ID NO: 638641 - RNA, 21 nt, Homo sapiens
ugcuuaaguucuuaaguauug

SEQ ID NO: 638642 - RNA, 13 nt, Homo sapiens
ugcuuaaucauau

SEQ ID NO: 638643 - RNA, 20 nt, Homo sapiens
ugcuuaggaaaccucacgac

SEQ ID NO: 638644 - RNA, 19 nt, Homo sapiens
ugcuuaggaugugugcaug

SEQ ID NO: 638645 - RNA, 22 nt, Homo sapiens
ugcuuaucugaaaugcuugaaa

SEQ ID NO: 638646 - RNA, 19 nt, Homo sapiens
ugcuuauuguuccaagaca

SEQ ID NO: 638647 - RNA, 13 nt, Homo sapiens
ugcuucaaacccu

SEQ ID NO: 638648 - RNA, 22 nt, Homo sapiens
ugcuucaaauaaaguccugaca

SEQ ID NO: 638649 - RNA, 19 nt, Homo sapiens
ugcuucaauuaaaauuaca

SEQ ID NO: 638650 - RNA, 19 nt, Homo sapiens
ugcuucacaguagagccag

SEQ ID NO: 638651 - RNA, 15 nt, Homo sapiens
ugcuucagaguuugu

SEQ ID NO: 638652 - RNA, 23 nt, Homo sapiens
ugcuucagaguuuguguguauuu

SEQ ID NO: 638653 - RNA, 21 nt, Homo sapiens
ugcuucauaaaugaagcagcu

SEQ ID NO: 638654 - RNA, 14 nt, Homo sapiens
ugcuuccaacaagg

SEQ ID NO: 638655 - RNA, 15 nt, Homo sapiens
ugcuuccauuaaaag

SEQ ID NO: 638656 - RNA, 14 nt, Homo sapiens
ugcuuccauuugac

SEQ ID NO: 638657 - RNA, 14 nt, Homo sapiens
ugcuucccgaguga

SEQ ID NO: 638658 - RNA, 16 nt, Homo sapiens
ugcuuccguucaugga

SEQ ID NO: 638659 - RNA, 12 nt, Homo sapiens
ugcuuccuccca

SEQ ID NO: 638660 - RNA, 19 nt, Homo sapiens
ugcuuccucccaacaagca

SEQ ID NO: 638661 - RNA, 21 nt, Homo sapiens
ugcuuccucccaacaagcagc

SEQ ID NO: 638662 - RNA, 23 nt, Homo sapiens
ugcuuccucccaacaagcagcug

SEQ ID NO: 638663 - RNA, 13 nt, Homo sapiens
ugcuuccuccuca

SEQ ID NO: 638664 - RNA, 18 nt, Homo sapiens
ugcuuccugucugaguaa

SEQ ID NO: 638665 - RNA, 22 nt, Homo sapiens
ugcuucuaagaugccagcauau

SEQ ID NO: 638666 - RNA, 19 nt, Homo sapiens
ugcuucuaaguaaauacaa

SEQ ID NO: 638667 - RNA, 21 nt, Homo sapiens
ugcuucuagaaacucuggcuc

SEQ ID NO: 638668 - RNA, 14 nt, Homo sapiens
ugcuucuccaguuu

SEQ ID NO: 638669 - RNA, 13 nt, Homo sapiens
ugcuucucggggu

SEQ ID NO: 638670 - RNA, 19 nt, Homo sapiens
ugcuucucucagccagcug

SEQ ID NO: 638671 - RNA, 21 nt, Homo sapiens
ugcuucucuucuuuauugcac

SEQ ID NO: 638672 - RNA, 17 nt, Homo sapiens
ugcuucucuuucuaaaa

SEQ ID NO: 638673 - RNA, 15 nt, Homo sapiens
ugcuucuguccagga

SEQ ID NO: 638674 - RNA, 15 nt, Homo sapiens
ugcuucuugccauca

SEQ ID NO: 638675 - RNA, 15 nt, Homo sapiens
ugcuucuuuaccaag

SEQ ID NO: 638676 - RNA, 21 nt, Homo sapiens
ugcuugaacccagaaggcaga

SEQ ID NO: 638677 - RNA, 15 nt, Homo sapiens
ugcuugaacuaggcu

SEQ ID NO: 638678 - RNA, 14 nt, Homo sapiens
ugcuugaccaaaga

SEQ ID NO: 638679 - RNA, 21 nt, Homo sapiens
ugcuugagcccaggaauuuga

SEQ ID NO: 638680 - RNA, 16 nt, Homo sapiens
ugcuugagcucaggag

SEQ ID NO: 638681 - RNA, 23 nt, Homo sapiens
ugcuugauauguaaguacuucca

SEQ ID NO: 638682 - RNA, 19 nt, Homo sapiens
ugcuugaucauuauaucau

SEQ ID NO: 638683 - RNA, 13 nt, Homo sapiens
ugcuugcacuuug

SEQ ID NO: 638684 - RNA, 12 nt, Homo sapiens
ugcuugccugau

SEQ ID NO: 638685 - RNA, 11 nt, Homo sapiens
ugcuugcugaa

SEQ ID NO: 638686 - RNA, 19 nt, Homo sapiens
ugcuugcuguaauguauau

SEQ ID NO: 638687 - RNA, 14 nt, Homo sapiens
ugcuuggauucucu

SEQ ID NO: 638688 - RNA, 14 nt, Homo sapiens
ugcuuggauuuuga

SEQ ID NO: 638689 - RNA, 22 nt, Homo sapiens
ugcuugggacguguacagcaca

SEQ ID NO: 638690 - RNA, 17 nt, Homo sapiens
ugcuugggcugacccag

SEQ ID NO: 638691 - RNA, 14 nt, Homo sapiens
ugcuuggguguaac

SEQ ID NO: 638692 - RNA, 12 nt, Homo sapiens
ugcuugugccac

SEQ ID NO: 638693 - RNA, 20 nt, Homo sapiens
ugcuuuaccacaaugagcaa

SEQ ID NO: 638694 - RNA, 15 nt, Homo sapiens
ugcuuucacucuuua

SEQ ID NO: 638695 - RNA, 16 nt, Homo sapiens
ugcuuucacucuuuag

SEQ ID NO: 638696 - RNA, 13 nt, Homo sapiens
ugcuuucuguucc

SEQ ID NO: 638697 - RNA, 13 nt, Homo sapiens
ugcuuugacucac

SEQ ID NO: 638698 - RNA, 13 nt, Homo sapiens
ugcuuugcaggaa

SEQ ID NO: 638699 - RNA, 22 nt, Homo sapiens
ugcuuugcaggaagugucuaga

SEQ ID NO: 638700 - RNA, 17 nt, Homo sapiens
ugcuuugggucauaaau

SEQ ID NO: 638701 - RNA, 20 nt, Homo sapiens
ugcuuuguuaucaaauggac

SEQ ID NO: 638702 - RNA, 16 nt, Homo sapiens
ugcuuuuaacucuaga

SEQ ID NO: 638703 - RNA, 13 nt, Homo sapiens
ugcuuuucagggu

SEQ ID NO: 638704 - RNA, 15 nt, Homo sapiens
ugcuuuuccauuucg

SEQ ID NO: 638705 - RNA, 18 nt, Homo sapiens
ugcuuuuccucaagcaau

SEQ ID NO: 638706 - RNA, 21 nt, Homo sapiens
ugcuuuucugcggcuguguag

SEQ ID NO: 638707 - RNA, 14 nt, Homo sapiens
ugcuuuucuguccu

SEQ ID NO: 638708 - RNA, 19 nt, Homo sapiens
gugcuccugcugaccuucu

SEQ ID NO: 638709 - RNA, 17 nt, Homo sapiens
gugcugacuaagccgaa

SEQ ID NO: 638710 - RNA, 15 nt, Homo sapiens
gugcugacucuggcc

SEQ ID NO: 638711 - RNA, 23 nt, Homo sapiens
gugcugcaugaaaaacauuccac

SEQ ID NO: 638712 - RNA, 22 nt, Homo sapiens
gugcugccccuugcaagccaua

SEQ ID NO: 638713 - RNA, 23 nt, Homo sapiens
gugcugccccuugcaagccauaa

SEQ ID NO: 638714 - RNA, 15 nt, Homo sapiens
gugcuggagacacuc

SEQ ID NO: 638715 - RNA, 18 nt, Homo sapiens
gugcuggccucucugaca

SEQ ID NO: 638716 - RNA, 13 nt, Homo sapiens
gugcugggaccaa

SEQ ID NO: 638717 - RNA, 21 nt, Homo sapiens
gugcugggaugacagguguga

SEQ ID NO: 638718 - RNA, 22 nt, Homo sapiens
gugcugggauuauaggcaugag

SEQ ID NO: 638719 - RNA, 15 nt, Homo sapiens
gugcuggggcacggc

SEQ ID NO: 638720 - RNA, 19 nt, Homo sapiens
gugcuggugaacacuguga

SEQ ID NO: 638721 - RNA, 15 nt, Homo sapiens
gugcugugcagcucu

SEQ ID NO: 638722 - RNA, 20 nt, Homo sapiens
gugcuuaagcagaagcauua

SEQ ID NO: 638723 - RNA, 21 nt, Homo sapiens
gugcuuaagcagaagcauuaa

SEQ ID NO: 638724 - RNA, 17 nt, Homo sapiens
gugcuuacacaucucag

SEQ ID NO: 638725 - RNA, 22 nt, Homo sapiens
gugcuuucccagucccauuccu

SEQ ID NO: 638726 - RNA, 22 nt, Homo sapiens
gugcuuucccauaucuugccuu

SEQ ID NO: 638727 - RNA, 13 nt, Homo sapiens
gugcuuugugaua

SEQ ID NO: 638728 - RNA, 24 nt, Homo sapiens
gugcuuugugauaguucaguccca

SEQ ID NO: 638729 - RNA, 20 nt, Homo sapiens
gugcuuuuugggaccaucac

SEQ ID NO: 638730 - RNA, 18 nt, Homo sapiens
guggaaaacuuaugcuga

SEQ ID NO: 638731 - RNA, 14 nt, Homo sapiens
guggaacauugggg

SEQ ID NO: 638732 - RNA, 18 nt, Homo sapiens
guggaaccaacacuaaca

SEQ ID NO: 638733 - RNA, 22 nt, Homo sapiens
guggaaguuaaagggcauuucc

SEQ ID NO: 638734 - RNA, 19 nt, Homo sapiens
guggaauagccucccugua

SEQ ID NO: 638735 - RNA, 12 nt, Homo sapiens
guggaaugagug

SEQ ID NO: 638736 - RNA, 16 nt, Homo sapiens
guggaaugcagggaag

SEQ ID NO: 638737 - RNA, 14 nt, Homo sapiens
guggacaccccaga

SEQ ID NO: 638738 - RNA, 19 nt, Homo sapiens
guggaccaaugcaucucuu

SEQ ID NO: 638739 - RNA, 12 nt, Homo sapiens
guggaccaggcc

SEQ ID NO: 638740 - RNA, 17 nt, Homo sapiens
guggacucagcagugac

SEQ ID NO: 638741 - RNA, 19 nt, Homo sapiens
guggacugcagucggcaug

SEQ ID NO: 638742 - RNA, 12 nt, Homo sapiens
guggacugugau

SEQ ID NO: 638743 - RNA, 12 nt, Homo sapiens
guggacugugcc

SEQ ID NO: 638744 - RNA, 16 nt, Homo sapiens
guggagaaagcacuga

SEQ ID NO: 638745 - RNA, 18 nt, Homo sapiens
guggagaaagcacugacc

SEQ ID NO: 638746 - RNA, 17 nt, Homo sapiens
guggagaugcagaggua

SEQ ID NO: 638747 - RNA, 13 nt, Homo sapiens
guggaggcacuuu

SEQ ID NO: 638748 - RNA, 13 nt, Homo sapiens
guggaggcuuccu

SEQ ID NO: 638749 - RNA, 12 nt, Homo sapiens
guggagggccac

SEQ ID NO: 638750 - RNA, 13 nt, Homo sapiens
guggaguuugaca

SEQ ID NO: 638751 - RNA, 16 nt, Homo sapiens
guggauaacuuuacag

SEQ ID NO: 638752 - RNA, 13 nt, Homo sapiens
guggaucacgaca

SEQ ID NO: 638753 - RNA, 17 nt, Homo sapiens
guggaucacgaggucag

SEQ ID NO: 638754 - RNA, 17 nt, Homo sapiens
guggaugcuagugcugu

SEQ ID NO: 638755 - RNA, 12 nt, Homo sapiens
guggaugugaug

SEQ ID NO: 638756 - RNA, 20 nt, Homo sapiens
guggauuggcuuugugcuug

SEQ ID NO: 638757 - RNA, 18 nt, Homo sapiens
guggauuuuguagauguu

SEQ ID NO: 638758 - RNA, 23 nt, Homo sapiens
guggcaaagguuuauuccagaga

SEQ ID NO: 638759 - RNA, 16 nt, Homo sapiens
guggcacucagucucu

SEQ ID NO: 638760 - RNA, 17 nt, Homo sapiens
guggcagccgucccagg

SEQ ID NO: 638761 - RNA, 16 nt, Homo sapiens
guggcaggaggcuuug

SEQ ID NO: 638762 - RNA, 23 nt, Homo sapiens
uggagauucucauaacuugagac

SEQ ID NO: 638763 - RNA, 22 nt, Homo sapiens
uggagcaccugggccccacugg

SEQ ID NO: 638764 - RNA, 23 nt, Homo sapiens
uggagcaccugggccccacugga

SEQ ID NO: 638765 - RNA, 11 nt, Homo sapiens
uggagcacgug

SEQ ID NO: 638766 - RNA, 18 nt, Homo sapiens
uggagcaggaugagggaa

SEQ ID NO: 638767 - RNA, 19 nt, Homo sapiens
uggagcaucauaauggacu

SEQ ID NO: 638768 - RNA, 11 nt, Homo sapiens
uggagccagac

SEQ ID NO: 638769 - RNA, 15 nt, Homo sapiens
uggagcccgugcagu

SEQ ID NO: 638770 - RNA, 16 nt, Homo sapiens
uggagcccgugcagua

SEQ ID NO: 638771 - RNA, 21 nt, Homo sapiens
uggagcccuguuggcagcucu

SEQ ID NO: 638772 - RNA, 19 nt, Homo sapiens
uggagcgccacacacugca

SEQ ID NO: 638773 - RNA, 14 nt, Homo sapiens
uggagcugggcuaa

SEQ ID NO: 638774 - RNA, 16 nt, Homo sapiens
uggaggaagagccacc

SEQ ID NO: 638775 - RNA, 15 nt, Homo sapiens
uggaggaaugacaau

SEQ ID NO: 638776 - RNA, 17 nt, Homo sapiens
uggaggaauucagcuca

SEQ ID NO: 638777 - RNA, 21 nt, Homo sapiens
uggaggcacugaagugcuuag

SEQ ID NO: 638778 - RNA, 14 nt, Homo sapiens
uggaggcugagcug

SEQ ID NO: 638779 - RNA, 16 nt, Homo sapiens
uggaggcugagcugca

SEQ ID NO: 638780 - RNA, 15 nt, Homo sapiens
uggaggcugcaguga

SEQ ID NO: 638781 - RNA, 21 nt, Homo sapiens
uggaggcugccugcugugcug

SEQ ID NO: 638782 - RNA, 22 nt, Homo sapiens
uggaggcuucugauacguguau

SEQ ID NO: 638783 - RNA, 16 nt, Homo sapiens
uggagggcucagggca

SEQ ID NO: 638784 - RNA, 21 nt, Homo sapiens
uggaggggcagagccaggaag

SEQ ID NO: 638785 - RNA, 20 nt, Homo sapiens
uggagggguguggcuccuuc

SEQ ID NO: 638786 - RNA, 15 nt, Homo sapiens
uggagggucucuagu

SEQ ID NO: 638787 - RNA, 20 nt, Homo sapiens
uggaggucauacaugcauac

SEQ ID NO: 638788 - RNA, 15 nt, Homo sapiens
uggagguugcaguga

SEQ ID NO: 638789 - RNA, 20 nt, Homo sapiens
uggagguugcagugagccaa

SEQ ID NO: 638790 - RNA, 15 nt, Homo sapiens
uggagguugugcaug

SEQ ID NO: 638791 - RNA, 18 nt, Homo sapiens
uggaguaaucagaaugaa

SEQ ID NO: 638792 - RNA, 20 nt, Homo sapiens
uggaguagccauucuuuauu

SEQ ID NO: 638793 - RNA, 23 nt, Homo sapiens
uggagucuugugccaaaccuacu

SEQ ID NO: 638794 - RNA, 17 nt, Homo sapiens
uggagugaugguguccu

SEQ ID NO: 638795 - RNA, 13 nt, Homo sapiens
uggagugauucuc

SEQ ID NO: 638796 - RNA, 13 nt, Homo sapiens
uggagugugucag

SEQ ID NO: 638797 - RNA, 13 nt, Homo sapiens
uggaguucagaga

SEQ ID NO: 638798 - RNA, 17 nt, Homo sapiens
uggaguucaguggugca

SEQ ID NO: 638799 - RNA, 16 nt, Homo sapiens
uggaguugacucggug

SEQ ID NO: 638800 - RNA, 14 nt, Homo sapiens
uggauaacuuuaca

SEQ ID NO: 638801 - RNA, 19 nt, Homo sapiens
uggauacaucugcugugug

SEQ ID NO: 638802 - RNA, 18 nt, Homo sapiens
uggauaccagcucagggg

SEQ ID NO: 638803 - RNA, 14 nt, Homo sapiens
uggauagcauuguu

SEQ ID NO: 638804 - RNA, 22 nt, Homo sapiens
uggauauuaaaaaucuguaaau

SEQ ID NO: 638805 - RNA, 13 nt, Homo sapiens
uggaucaaaagga

SEQ ID NO: 638806 - RNA, 14 nt, Homo sapiens
uggaucaaguauua

SEQ ID NO: 638807 - RNA, 12 nt, Homo sapiens
uggaucagaaua

SEQ ID NO: 638808 - RNA, 13 nt, Homo sapiens
uggaucagcauuu

SEQ ID NO: 638809 - RNA, 14 nt, Homo sapiens
uggauccagcacug

SEQ ID NO: 638810 - RNA, 17 nt, Homo sapiens
uggaucuaccagcauaa

SEQ ID NO: 638811 - RNA, 22 nt, Homo sapiens
uggaucuaccagcauaaauauc

SEQ ID NO: 638812 - RNA, 18 nt, Homo sapiens
uggaugaugaaacauuca

SEQ ID NO: 638813 - RNA, 19 nt, Homo sapiens
uggaugcagaaacaguuca

SEQ ID NO: 638814 - RNA, 14 nt, Homo sapiens
uggaugcaggguuu

SEQ ID NO: 638815 - RNA, 14 nt, Homo sapiens
uggaugcucgccau

SEQ ID NO: 638816 - RNA, 16 nt, Homo sapiens
uggaugcugagcugug

SEQ ID NO: 638817 - RNA, 14 nt, Homo sapiens
uggauggcacaaug

SEQ ID NO: 638818 - RNA, 16 nt, Homo sapiens
uggauggcacaaugaa

SEQ ID NO: 638819 - RNA, 21 nt, Homo sapiens
uggaugugaagcucacacuga

SEQ ID NO: 638820 - RNA, 22 nt, Homo sapiens
uggauguucugacccugcuuca

SEQ ID NO: 638821 - RNA, 21 nt, Homo sapiens
uggauguugcuuuugcaccua

SEQ ID NO: 638822 - RNA, 13 nt, Homo sapiens
uggauuaaagacu

SEQ ID NO: 638823 - RNA, 16 nt, Homo sapiens
uggauuaacauauagc

SEQ ID NO: 638824 - RNA, 16 nt, Homo sapiens
uggauuacuauugcaa

SEQ ID NO: 638825 - RNA, 13 nt, Homo sapiens
uggauuauuucau

SEQ ID NO: 638826 - RNA, 15 nt, Homo sapiens
uggauucacucacuc

SEQ ID NO: 638827 - RNA, 15 nt, Homo sapiens
uggauucaucagcau

SEQ ID NO: 638828 - RNA, 18 nt, Homo sapiens
uggauucaucagcauuug

SEQ ID NO: 638829 - RNA, 17 nt, Homo sapiens
uggauucauucucauaa

SEQ ID NO: 638830 - RNA, 20 nt, Homo sapiens
uggauucccagggacuucag

SEQ ID NO: 638831 - RNA, 16 nt, Homo sapiens
uguucaucaccagucu

SEQ ID NO: 638832 - RNA, 17 nt, Homo sapiens
uguucauccucauugcc

SEQ ID NO: 638833 - RNA, 17 nt, Homo sapiens
uguucauggacuauucc

SEQ ID NO: 638834 - RNA, 18 nt, Homo sapiens
uguucauguuacucauga

SEQ ID NO: 638835 - RNA, 16 nt, Homo sapiens
uguucauuauaaucuc

SEQ ID NO: 638836 - RNA, 22 nt, Homo sapiens
uguuccaauuugacaaaaccca

SEQ ID NO: 638837 - RNA, 18 nt, Homo sapiens
uguuccagaggagcucuc

SEQ ID NO: 638838 - RNA, 21 nt, Homo sapiens
uguucccccagccugccaaau

SEQ ID NO: 638839 - RNA, 18 nt, Homo sapiens
uguuccccuuccacugag

SEQ ID NO: 638840 - RNA, 21 nt, Homo sapiens
uguucccgacauaacauugua

SEQ ID NO: 638841 - RNA, 15 nt, Homo sapiens
uguucccuugaccau

SEQ ID NO: 638842 - RNA, 14 nt, Homo sapiens
uguuccuauggaaa

SEQ ID NO: 638843 - RNA, 14 nt, Homo sapiens
uguuccucaaagcu

SEQ ID NO: 638844 - RNA, 20 nt, Homo sapiens
uguuccugaaaauugcaaua

SEQ ID NO: 638845 - RNA, 21 nt, Homo sapiens
uguuccuggaggucagcauuu

SEQ ID NO: 638846 - RNA, 17 nt, Homo sapiens
uguuccuuucagaugac

SEQ ID NO: 638847 - RNA, 19 nt, Homo sapiens
uguuccuuugggucuguga

SEQ ID NO: 638848 - RNA, 14 nt, Homo sapiens
uguucuaaguauuu

SEQ ID NO: 638849 - RNA, 15 nt, Homo sapiens
uguucuagcagugaa

SEQ ID NO: 638850 - RNA, 13 nt, Homo sapiens
uguucuauuuaac

SEQ ID NO: 638851 - RNA, 14 nt, Homo sapiens
uguucucaguggug

SEQ ID NO: 638852 - RNA, 21 nt, Homo sapiens
uguucucauuugaucagggga

SEQ ID NO: 638853 - RNA, 22 nt, Homo sapiens
uguucucgaacuccugaccuca

SEQ ID NO: 638854 - RNA, 19 nt, Homo sapiens
uguucucuauuagacuuua

SEQ ID NO: 638855 - RNA, 18 nt, Homo sapiens
uguucucugcuugacaga

SEQ ID NO: 638856 - RNA, 16 nt, Homo sapiens
uguucugaacacuuua

SEQ ID NO: 638857 - RNA, 22 nt, Homo sapiens
uguucugccucucccugggucu

SEQ ID NO: 638858 - RNA, 23 nt, Homo sapiens
uguucugggaaaauccacuauga

SEQ ID NO: 638859 - RNA, 22 nt, Homo sapiens
uguucuguuggaugacuuugag

SEQ ID NO: 638860 - RNA, 19 nt, Homo sapiens
uguucuguuugcuguggaa

SEQ ID NO: 638861 - RNA, 17 nt, Homo sapiens
uguucuuuaguagcaac

SEQ ID NO: 638862 - RNA, 16 nt, Homo sapiens
uguucuuuuuauugaa

SEQ ID NO: 638863 - RNA, 18 nt, Homo sapiens
uguucuuuuuucuuacca

SEQ ID NO: 638864 - RNA, 14 nt, Homo sapiens
uguugaaauaugca

SEQ ID NO: 638865 - RNA, 23 nt, Homo sapiens
uguugacagcaaaauguugaaga

SEQ ID NO: 638866 - RNA, 12 nt, Homo sapiens
uguugacauaca

SEQ ID NO: 638867 - RNA, 14 nt, Homo sapiens
uguugacauacauu

SEQ ID NO: 638868 - RNA, 17 nt, Homo sapiens
uguugacauuagucuca

SEQ ID NO: 638869 - RNA, 15 nt, Homo sapiens
uguugacugcugcuc

SEQ ID NO: 638870 - RNA, 14 nt, Homo sapiens
uguugauaaaugac

SEQ ID NO: 638871 - RNA, 18 nt, Homo sapiens
uguugauaauuucaggga

SEQ ID NO: 638872 - RNA, 13 nt, Homo sapiens
uguugauagcaag

SEQ ID NO: 638873 - RNA, 14 nt, Homo sapiens
uguugauuacauaa

SEQ ID NO: 638874 - RNA, 20 nt, Homo sapiens
uguugcaaacucagugcaaa

SEQ ID NO: 638875 - RNA, 12 nt, Homo sapiens
uguugcacugcc

SEQ ID NO: 638876 - RNA, 21 nt, Homo sapiens
uguugcauuuacuuuuaauaa

SEQ ID NO: 638877 - RNA, 10 nt, Homo sapiens
uguugccagc

SEQ ID NO: 638878 - RNA, 21 nt, Homo sapiens
uguugccccauuccuaagagg

SEQ ID NO: 638879 - RNA, 17 nt, Homo sapiens
uguugccuucaucuuca

SEQ ID NO: 638880 - RNA, 17 nt, Homo sapiens
uguugcgcucccaccuc

SEQ ID NO: 638881 - RNA, 20 nt, Homo sapiens
uguugcuccuagcuaaugcu

SEQ ID NO: 638882 - RNA, 17 nt, Homo sapiens
uguuggaaaaugugucu

SEQ ID NO: 638883 - RNA, 19 nt, Homo sapiens
uguuggacccgcucuggac

SEQ ID NO: 638884 - RNA, 19 nt, Homo sapiens
uguuggagguuaaggcaua

SEQ ID NO: 638885 - RNA, 19 nt, Homo sapiens
uguuggaguggaacauugg

SEQ ID NO: 638886 - RNA, 21 nt, Homo sapiens
uguuggcaagcugcagguuug

SEQ ID NO: 638887 - RNA, 15 nt, Homo sapiens
uguuggcccuuccag

SEQ ID NO: 638888 - RNA, 17 nt, Homo sapiens
uguugguauuauauaau

SEQ ID NO: 638889 - RNA, 22 nt, Homo sapiens
uguuggucaggcuggucucaaa

SEQ ID NO: 638890 - RNA, 14 nt, Homo sapiens
uguuggugcuuuag

SEQ ID NO: 638891 - RNA, 15 nt, Homo sapiens
uguuguacauuucac

SEQ ID NO: 638892 - RNA, 17 nt, Homo sapiens
uguuguagcucugguau

SEQ ID NO: 638893 - RNA, 18 nt, Homo sapiens
uguuguagguuucaggga

SEQ ID NO: 638894 - RNA, 14 nt, Homo sapiens
uguugucaaaaagu

SEQ ID NO: 638895 - RNA, 14 nt, Homo sapiens
uguuguccaggaaa

SEQ ID NO: 638896 - RNA, 14 nt, Homo sapiens
uguuguguagucaa

SEQ ID NO: 638897 - RNA, 21 nt, Homo sapiens
uguuguguuuuuaacauguca

SEQ ID NO: 638898 - RNA, 15 nt, Homo sapiens
uguuguuauucagaa

SEQ ID NO: 638899 - RNA, 18 nt, Homo sapiens
uguuguuugguucaggga

SEQ ID NO: 638900 - RNA, 17 nt, Homo sapiens
uguuuaaacuuugacaa

SEQ ID NO: 638901 - RNA, 20 nt, Homo sapiens
uguuuaaauagccuaaauga

SEQ ID NO: 638902 - RNA, 19 nt, Homo sapiens
uguuuaaauucacaucuca

SEQ ID NO: 638903 - RNA, 13 nt, Homo sapiens
uguuuacaaagca

SEQ ID NO: 638904 - RNA, 16 nt, Homo sapiens
uguuuacucaaagucu

SEQ ID NO: 638905 - RNA, 17 nt, Homo sapiens
uguuuagaaaaguauuc

SEQ ID NO: 638906 - RNA, 15 nt, Homo sapiens
uguuuauacacugug

SEQ ID NO: 638907 - RNA, 15 nt, Homo sapiens
uaauaagcuaaagag

SEQ ID NO: 638908 - RNA, 22 nt, Homo sapiens
uaauaaucauucuuuccccuca

SEQ ID NO: 638909 - RNA, 13 nt, Homo sapiens
uaauaauggaaug

SEQ ID NO: 638910 - RNA, 15 nt, Homo sapiens
uaauaauguuuaaua

SEQ ID NO: 638911 - RNA, 22 nt, Homo sapiens
uaauaauuuacagguucuuagg

SEQ ID NO: 638912 - RNA, 22 nt, Homo sapiens
uaauacaguuuucuauucuugg

SEQ ID NO: 638913 - RNA, 15 nt, Homo sapiens
uaauacaugauugca

SEQ ID NO: 638914 - RNA, 15 nt, Homo sapiens
uaauaccagaacucu

SEQ ID NO: 638915 - RNA, 17 nt, Homo sapiens
uaauaccagaacucuaa

SEQ ID NO: 638916 - RNA, 14 nt, Homo sapiens
uaauacguacaugu

SEQ ID NO: 638917 - RNA, 21 nt, Homo sapiens
uaauacuauauuuauacugua

SEQ ID NO: 638918 - RNA, 18 nt, Homo sapiens
uaauacuccuaagacuua

SEQ ID NO: 638919 - RNA, 17 nt, Homo sapiens
uaauacucugcagugau

SEQ ID NO: 638920 - RNA, 14 nt, Homo sapiens
uaauacugaaggac

SEQ ID NO: 638921 - RNA, 12 nt, Homo sapiens
uaauacuggaau

SEQ ID NO: 638922 - RNA, 22 nt, Homo sapiens
uaauacuugcaacuaaggacaa

SEQ ID NO: 638923 - RNA, 14 nt, Homo sapiens
uaauacuuuugcug

SEQ ID NO: 638924 - RNA, 14 nt, Homo sapiens
uaauagacacauca

SEQ ID NO: 638925 - RNA, 16 nt, Homo sapiens
uaauagacacugggga

SEQ ID NO: 638926 - RNA, 21 nt, Homo sapiens
uaauagacaguagccaaguua

SEQ ID NO: 638927 - RNA, 19 nt, Homo sapiens
uaauagacucgcuagucag

SEQ ID NO: 638928 - RNA, 18 nt, Homo sapiens
uaauagagauaaguccau

SEQ ID NO: 638929 - RNA, 16 nt, Homo sapiens
uaauagccauaugcaa

SEQ ID NO: 638930 - RNA, 17 nt, Homo sapiens
uaauagccauaugcaau

SEQ ID NO: 638931 - RNA, 22 nt, Homo sapiens
uaauagcuauggaaucaauuca

SEQ ID NO: 638932 - RNA, 19 nt, Homo sapiens
uaauagucaauuucuacuu

SEQ ID NO: 638933 - RNA, 15 nt, Homo sapiens
uaauauaaauucacu

SEQ ID NO: 638934 - RNA, 19 nt, Homo sapiens
uaauauacaaaacaauuaa

SEQ ID NO: 638935 - RNA, 13 nt, Homo sapiens
uaauauaccccaa

SEQ ID NO: 638936 - RNA, 21 nt, Homo sapiens
uaauauccuaaacaucauuca

SEQ ID NO: 638937 - RNA, 18 nt, Homo sapiens
uaauaucuaaaguuauau

SEQ ID NO: 638938 - RNA, 15 nt, Homo sapiens
uaauaugaagcagga

SEQ ID NO: 638939 - RNA, 17 nt, Homo sapiens
uaauaugccuagcacaa

SEQ ID NO: 638940 - RNA, 13 nt, Homo sapiens
uaauauggcaaaa

SEQ ID NO: 638941 - RNA, 17 nt, Homo sapiens
uaauaugguuacauuua

SEQ ID NO: 638942 - RNA, 21 nt, Homo sapiens
uaauauuucuucaaauaucuc

SEQ ID NO: 638943 - RNA, 17 nt, Homo sapiens
uaauauuuuaaauugcu

SEQ ID NO: 638944 - RNA, 15 nt, Homo sapiens
uaauauuuuguaaua

SEQ ID NO: 638945 - RNA, 19 nt, Homo sapiens
uaaucaaggccagugcuaa

SEQ ID NO: 638946 - RNA, 20 nt, Homo sapiens
uaaucaauaucccaacauuc

SEQ ID NO: 638947 - RNA, 21 nt, Homo sapiens
uaaucaauaucccaacauucu

SEQ ID NO: 638948 - RNA, 14 nt, Homo sapiens
uaaucaccaaagua

SEQ ID NO: 638949 - RNA, 15 nt, Homo sapiens
uaaucaccucucugu

SEQ ID NO: 638950 - RNA, 13 nt, Homo sapiens
uaaucacuacugu

SEQ ID NO: 638951 - RNA, 20 nt, Homo sapiens
uaaucacuauuguuccagca

SEQ ID NO: 638952 - RNA, 12 nt, Homo sapiens
uaaucacucuaa

SEQ ID NO: 638953 - RNA, 17 nt, Homo sapiens
uacagaggcugacuuca

SEQ ID NO: 638954 - RNA, 23 nt, Homo sapiens
uacagauguggggagauguaaua

SEQ ID NO: 638955 - RNA, 18 nt, Homo sapiens
uacagauugcugcuucug

SEQ ID NO: 638956 - RNA, 22 nt, Homo sapiens
uacagauuuuaccuauccacaa

SEQ ID NO: 638957 - RNA, 16 nt, Homo sapiens
uacagcaacaauuuau

SEQ ID NO: 638958 - RNA, 23 nt, Homo sapiens
uacagcagaaaaucuuuuacuag

SEQ ID NO: 638959 - RNA, 20 nt, Homo sapiens
uacagcagaaaggagaacua

SEQ ID NO: 638960 - RNA, 23 nt, Homo sapiens
uacagcaugugccuuaaugcuuc

SEQ ID NO: 638961 - RNA, 14 nt, Homo sapiens
uacagcucuggcca

SEQ ID NO: 638962 - RNA, 14 nt, Homo sapiens
uacagcucuuggca

SEQ ID NO: 638963 - RNA, 18 nt, Homo sapiens
uacagcucuuggcauuuu

SEQ ID NO: 638964 - RNA, 14 nt, Homo sapiens
uacagcuucaguga

SEQ ID NO: 638965 - RNA, 17 nt, Homo sapiens
uacaggaaauugacuua

SEQ ID NO: 638966 - RNA, 23 nt, Homo sapiens
uacaggaagcaccccaugccaaa

SEQ ID NO: 638967 - RNA, 17 nt, Homo sapiens
uacaggaaguaguucua

SEQ ID NO: 638968 - RNA, 14 nt, Homo sapiens
uacaggacauauau

SEQ ID NO: 638969 - RNA, 19 nt, Homo sapiens
uacaggcaacaaugagcag

SEQ ID NO: 638970 - RNA, 14 nt, Homo sapiens
uacaggcacccacc

SEQ ID NO: 638971 - RNA, 14 nt, Homo sapiens
uacaggcauaaaau

SEQ ID NO: 638972 - RNA, 20 nt, Homo sapiens
uacaggccuacagaaauuga

SEQ ID NO: 638973 - RNA, 18 nt, Homo sapiens
uacagggcauucaaaugg

SEQ ID NO: 638974 - RNA, 14 nt, Homo sapiens
uacagggcuaggca

SEQ ID NO: 638975 - RNA, 19 nt, Homo sapiens
uacaggugaaggcucucac

SEQ ID NO: 638976 - RNA, 22 nt, Homo sapiens
uacagguuacagugagcaaaga

SEQ ID NO: 638977 - RNA, 14 nt, Homo sapiens
uacaguaagcauag

SEQ ID NO: 638978 - RNA, 16 nt, Homo sapiens
uacaguauacauauau

SEQ ID NO: 638979 - RNA, 19 nt, Homo sapiens
uacagucucuuucuuccuu

SEQ ID NO: 638980 - RNA, 18 nt, Homo sapiens
uacagucugucaugaaca

SEQ ID NO: 638981 - RNA, 18 nt, Homo sapiens
uacagugagcucuagcaa

SEQ ID NO: 638982 - RNA, 17 nt, Homo sapiens
uacaguggaauugugaa

SEQ ID NO: 638983 - RNA, 16 nt, Homo sapiens
uacaguguauguacua

SEQ ID NO: 638984 - RNA, 20 nt, Homo sapiens
uacaguguauguacuaagca

SEQ ID NO: 638985 - RNA, 12 nt, Homo sapiens
uacaguguuauu

SEQ ID NO: 638986 - RNA, 15 nt, Homo sapiens
uacaguguuuauccu

SEQ ID NO: 638987 - RNA, 16 nt, Homo sapiens
uacaguuaacucuccc

SEQ ID NO: 638988 - RNA, 22 nt, Homo sapiens
uacaguucacagaggucuuuca

SEQ ID NO: 638989 - RNA, 22 nt, Homo sapiens
uacaguuuggcuuuuuucacau

SEQ ID NO: 638990 - RNA, 20 nt, Homo sapiens
uacaguuuuuauugcuuguu

SEQ ID NO: 638991 - RNA, 15 nt, Homo sapiens
uacauaacuugauau

SEQ ID NO: 638992 - RNA, 15 nt, Homo sapiens
uacauaauugauuaa

SEQ ID NO: 638993 - RNA, 19 nt, Homo sapiens
uacauaauugcuguucugc

SEQ ID NO: 638994 - RNA, 18 nt, Homo sapiens
uacauacaaacaaugcaa

SEQ ID NO: 638995 - RNA, 12 nt, Homo sapiens
uacauacauaca

SEQ ID NO: 638996 - RNA, 12 nt, Homo sapiens
uacauacauaua

SEQ ID NO: 638997 - RNA, 13 nt, Homo sapiens
uacauacugcugu

SEQ ID NO: 638998 - RNA, 22 nt, Homo sapiens
uacauagugcaaaacuguguca

SEQ ID NO: 638999 - RNA, 15 nt, Homo sapiens
uacauauacuuuuau

SEQ ID NO: 639000 - RNA, 20 nt, Homo sapiens
uacauauaguuuuugcaggg

SEQ ID NO: 639001 - RNA, 17 nt, Homo sapiens
uacauauauaugucagg

SEQ ID NO: 639002 - RNA, 21 nt, Homo sapiens
uacauauaucuacacauacag

SEQ ID NO: 639003 - RNA, 13 nt, Homo sapiens
uacauauuaucuc

SEQ ID NO: 639004 - RNA, 17 nt, Homo sapiens
uacauauuuguggaaua

SEQ ID NO: 639005 - RNA, 19 nt, Homo sapiens
uacaucacugcuugaugaa

SEQ ID NO: 639006 - RNA, 13 nt, Homo sapiens
uacauccaaagca

SEQ ID NO: 639007 - RNA, 22 nt, Homo sapiens
uacauccaaagcagacagcucc

SEQ ID NO: 639008 - RNA, 21 nt, Homo sapiens
uacauccagcuccucuagggg

SEQ ID NO: 639009 - RNA, 20 nt, Homo sapiens
uacauccagucacuuugcca

SEQ ID NO: 639010 - RNA, 23 nt, Homo sapiens
uacaucuguaaagaaaaccauaa

SEQ ID NO: 639011 - RNA, 12 nt, Homo sapiens
uacaucuuucac

SEQ ID NO: 639012 - RNA, 18 nt, Homo sapiens
uacaugaaacuacucaua

SEQ ID NO: 639013 - RNA, 20 nt, Homo sapiens
uacaugagaaagaugucuau

SEQ ID NO: 639014 - RNA, 16 nt, Homo sapiens
uacaugagauaacuca

SEQ ID NO: 639015 - RNA, 20 nt, Homo sapiens
uacaugaugcccugcugacc

SEQ ID NO: 639016 - RNA, 23 nt, Homo sapiens
uacaugaugcuaaaggcugcgaa

SEQ ID NO: 639017 - RNA, 14 nt, Homo sapiens
uacaugcaauuuau

SEQ ID NO: 639018 - RNA, 12 nt, Homo sapiens
uacaugcaccuu

SEQ ID NO: 639019 - RNA, 14 nt, Homo sapiens
uacaugcauacaaa

SEQ ID NO: 639020 - RNA, 19 nt, Homo sapiens
uacaugccucagugaagga

SEQ ID NO: 639021 - RNA, 16 nt, Homo sapiens
uacaugcuuugugaac

SEQ ID NO: 639022 - RNA, 18 nt, Homo sapiens
uacauggaaaggauuuug

SEQ ID NO: 639023 - RNA, 15 nt, Homo sapiens
uacauguaauccauc

SEQ ID NO: 639024 - RNA, 20 nt, Homo sapiens
uacaugugugggugcugaua

SEQ ID NO: 639025 - RNA, 16 nt, Homo sapiens
uacauguucuugucau

SEQ ID NO: 639026 - RNA, 15 nt, Homo sapiens
uacauuaauuaccuu

SEQ ID NO: 639027 - RNA, 13 nt, Homo sapiens
uacauuaucucac

SEQ ID NO: 639028 - RNA, 14 nt, Homo sapiens
uacauuauguugcu

SEQ ID NO: 639029 - RNA, 17 nt, Homo sapiens
uacauuauguugcuuaa

SEQ ID NO: 639030 - RNA, 10 nt, Homo sapiens
uacauucaau

SEQ ID NO: 639031 - RNA, 17 nt, Homo sapiens
uacauuccucagcugcc

SEQ ID NO: 639032 - RNA, 19 nt, Homo sapiens
uacauucuuuaucuugaca

SEQ ID NO: 639033 - RNA, 22 nt, Homo sapiens
uuaauaccugggugauuacaua

SEQ ID NO: 639034 - RNA, 15 nt, Homo sapiens
uuaauacuccagaga

SEQ ID NO: 639035 - RNA, 22 nt, Homo sapiens
uuaauacuccagagacagggaa

SEQ ID NO: 639036 - RNA, 12 nt, Homo sapiens
uuaauagacuga

SEQ ID NO: 639037 - RNA, 18 nt, Homo sapiens
uuaauagcuuuugauuag

SEQ ID NO: 639038 - RNA, 21 nt, Homo sapiens
uuaauaggugcagucuuugag

SEQ ID NO: 639039 - RNA, 23 nt, Homo sapiens
uuaauaggugcagucuuugagau

SEQ ID NO: 639040 - RNA, 21 nt, Homo sapiens
uuaauaguuuugauccuaaau

SEQ ID NO: 639041 - RNA, 16 nt, Homo sapiens
uuaauaucaacucuga

SEQ ID NO: 639042 - RNA, 19 nt, Homo sapiens
uuaauaucccuacauguau

SEQ ID NO: 639043 - RNA, 12 nt, Homo sapiens
uuaauaugucaa

SEQ ID NO: 639044 - RNA, 21 nt, Homo sapiens
uuaauaugugcugaacauugu

SEQ ID NO: 639045 - RNA, 18 nt, Homo sapiens
uuaauauuaccaacuaca

SEQ ID NO: 639046 - RNA, 14 nt, Homo sapiens
uuaauauugaggcu

SEQ ID NO: 639047 - RNA, 16 nt, Homo sapiens
uuaauauugugcaaac

SEQ ID NO: 639048 - RNA, 22 nt, Homo sapiens
uuaauauuuaaacagcaguguu

SEQ ID NO: 639049 - RNA, 20 nt, Homo sapiens
uuaauauuuuuccacuuaaa

SEQ ID NO: 639050 - RNA, 13 nt, Homo sapiens
uuaaucaacagaa

SEQ ID NO: 639051 - RNA, 15 nt, Homo sapiens
uuaaucaccacucaa

SEQ ID NO: 639052 - RNA, 14 nt, Homo sapiens
uuaaucacugcauu

SEQ ID NO: 639053 - RNA, 20 nt, Homo sapiens
uuaauccaguguuacugugu

SEQ ID NO: 639054 - RNA, 21 nt, Homo sapiens
uuaaucccaguacgauuugca

SEQ ID NO: 639055 - RNA, 18 nt, Homo sapiens
uuaaucuccucagacagu

SEQ ID NO: 639056 - RNA, 20 nt, Homo sapiens
uuaaucuccucagacaguaa

SEQ ID NO: 639057 - RNA, 18 nt, Homo sapiens
uuaaucuguuauguacua

SEQ ID NO: 639058 - RNA, 14 nt, Homo sapiens
uuaaugaacauaug

SEQ ID NO: 639059 - RNA, 20 nt, Homo sapiens
uuaaugaacaugugaaguua

SEQ ID NO: 639060 - RNA, 20 nt, Homo sapiens
uuaaugaggguuugugcuac

SEQ ID NO: 639061 - RNA, 17 nt, Homo sapiens
uuaaugcacuuucuauc

SEQ ID NO: 639062 - RNA, 13 nt, Homo sapiens
uuaaugcuucauu

SEQ ID NO: 639063 - RNA, 15 nt, Homo sapiens
uuaaugcuucauuca

SEQ ID NO: 639064 - RNA, 18 nt, Homo sapiens
uuaauggggauuccacua

SEQ ID NO: 639065 - RNA, 23 nt, Homo sapiens
uuaauggguuuuguguacuguaa

SEQ ID NO: 639066 - RNA, 15 nt, Homo sapiens
uuaauguaaaaccca

SEQ ID NO: 639067 - RNA, 12 nt, Homo sapiens
uuaauguacaaa

SEQ ID NO: 639068 - RNA, 17 nt, Homo sapiens
uuaauguauucccuuca

SEQ ID NO: 639069 - RNA, 17 nt, Homo sapiens
uuaaugucuggugcuuu

SEQ ID NO: 639070 - RNA, 20 nt, Homo sapiens
uuaaugucuucacucuauac

SEQ ID NO: 639071 - RNA, 12 nt, Homo sapiens
uuaaugugaugg

SEQ ID NO: 639072 - RNA, 18 nt, Homo sapiens
uuaauguuaacaagacaa

SEQ ID NO: 639073 - RNA, 15 nt, Homo sapiens
uuaauguucugugau

SEQ ID NO: 639074 - RNA, 20 nt, Homo sapiens
uuaauguuuuuuaaacuagu

SEQ ID NO: 639075 - RNA, 19 nt, Homo sapiens
aagaggaaaaaaaguaaau

SEQ ID NO: 639076 - RNA, 21 nt, Homo sapiens
aagaggaaggccucuguggca

SEQ ID NO: 639077 - RNA, 14 nt, Homo sapiens
aagaggacugagac

SEQ ID NO: 639078 - RNA, 21 nt, Homo sapiens
aagaggacuuuuuugauuaag

SEQ ID NO: 639079 - RNA, 20 nt, Homo sapiens
aagaggagauuggccaguga

SEQ ID NO: 639080 - RNA, 15 nt, Homo sapiens
aagaggauagaauac

SEQ ID NO: 639081 - RNA, 22 nt, Homo sapiens
aagaggcccacuagagggccca

SEQ ID NO: 639082 - RNA, 23 nt, Homo sapiens
aagaggcccugucuguaccuaac

SEQ ID NO: 639083 - RNA, 19 nt, Homo sapiens
aagagggacaggcugaaga

SEQ ID NO: 639084 - RNA, 18 nt, Homo sapiens
aagagggccugugggagc

SEQ ID NO: 639085 - RNA, 13 nt, Homo sapiens
aagagggcuuccu

SEQ ID NO: 639086 - RNA, 19 nt, Homo sapiens
aagagggggagaaugagaa

SEQ ID NO: 639087 - RNA, 17 nt, Homo sapiens
aagaguaacuuuacucu

SEQ ID NO: 639088 - RNA, 14 nt, Homo sapiens
aagagucauuguua

SEQ ID NO: 639089 - RNA, 19 nt, Homo sapiens
aagagucuacccgacauaa

SEQ ID NO: 639090 - RNA, 16 nt, Homo sapiens
aagagucucuaaugag

SEQ ID NO: 639091 - RNA, 19 nt, Homo sapiens
aagagugagacuccaccuc

SEQ ID NO: 639092 - RNA, 20 nt, Homo sapiens
aagagugagacuccaccuca

SEQ ID NO: 639093 - RNA, 19 nt, Homo sapiens
aagagugccguaacaacug

SEQ ID NO: 639094 - RNA, 24 nt, Homo sapiens
aagaguucuauggagacuuugcug

SEQ ID NO: 639095 - RNA, 22 nt, Homo sapiens
aagaguugcuuugccagagcag

SEQ ID NO: 639096 - RNA, 19 nt, Homo sapiens
aagauaacaagaucuuuca

SEQ ID NO: 639097 - RNA, 20 nt, Homo sapiens
aagauaauccuagagucuua

SEQ ID NO: 639098 - RNA, 14 nt, Homo sapiens
aagauacaacagcu

SEQ ID NO: 639099 - RNA, 16 nt, Homo sapiens
aagauacacugcagcu

SEQ ID NO: 639100 - RNA, 19 nt, Homo sapiens
aagauagaugcacuuaugc

SEQ ID NO: 639101 - RNA, 22 nt, Homo sapiens
aagauagggaacacucaucccu

SEQ ID NO: 639102 - RNA, 16 nt, Homo sapiens
aagauaguuuucuccu

SEQ ID NO: 639103 - RNA, 15 nt, Homo sapiens
aagauauauguguau

SEQ ID NO: 639104 - RNA, 13 nt, Homo sapiens
aagauaucuugaa

SEQ ID NO: 639105 - RNA, 13 nt, Homo sapiens
aagauauuguaca

SEQ ID NO: 639106 - RNA, 12 nt, Homo sapiens
aagaucaaagac

SEQ ID NO: 639107 - RNA, 17 nt, Homo sapiens
aagaucacaaagacaga

SEQ ID NO: 639108 - RNA, 15 nt, Homo sapiens
aagaucaccuuguau

SEQ ID NO: 639109 - RNA, 18 nt, Homo sapiens
aagaucauuuaauaucuu

SEQ ID NO: 639110 - RNA, 18 nt, Homo sapiens
aagauccgagucuaccca

SEQ ID NO: 639111 - RNA, 17 nt, Homo sapiens
aagauccuccugcugca

SEQ ID NO: 639112 - RNA, 18 nt, Homo sapiens
aagauccuccugcugcag

SEQ ID NO: 639113 - RNA, 17 nt, Homo sapiens
aagaucguucucugccu

SEQ ID NO: 639114 - RNA, 23 nt, Homo sapiens
aagaucuccaacagccagugugu

SEQ ID NO: 639115 - RNA, 18 nt, Homo sapiens
aagaucuugaauagucuc

SEQ ID NO: 639116 - RNA, 19 nt, Homo sapiens
aagaucuuuaaacugcuuu

SEQ ID NO: 639117 - RNA, 20 nt, Homo sapiens
aagaucuuuccaaauaccca

SEQ ID NO: 639118 - RNA, 20 nt, Homo sapiens
aagaugagccuugcagauau

SEQ ID NO: 639119 - RNA, 20 nt, Homo sapiens
aagaugagcuuuucuaggcu

SEQ ID NO: 639120 - RNA, 18 nt, Homo sapiens
aagaugaguaaaacuggu

SEQ ID NO: 639121 - RNA, 21 nt, Homo sapiens
aagaugaguuauuuaacuggu

SEQ ID NO: 639122 - RNA, 14 nt, Homo sapiens
aagaugauuucuca

SEQ ID NO: 639123 - RNA, 21 nt, Homo sapiens
aagaugccagugaaacuucaa

SEQ ID NO: 639124 - RNA, 14 nt, Homo sapiens
aagaugccuugagg

SEQ ID NO: 639125 - RNA, 16 nt, Homo sapiens
aagaugcguuugccuc

SEQ ID NO: 639126 - RNA, 21 nt, Homo sapiens
aagaugcuuuguuucuuucau

SEQ ID NO: 639127 - RNA, 17 nt, Homo sapiens
aagauggacuuaccugg

SEQ ID NO: 639128 - RNA, 20 nt, Homo sapiens
aagauggauguaaugcacuu

SEQ ID NO: 639129 - RNA, 12 nt, Homo sapiens
aagauggcauaa

SEQ ID NO: 639130 - RNA, 18 nt, Homo sapiens
aagauggcuuuuucuccu

SEQ ID NO: 639131 - RNA, 16 nt, Homo sapiens
aagaugggaacacugg

SEQ ID NO: 639132 - RNA, 18 nt, Homo sapiens
aagaugguaaaccagauc

SEQ ID NO: 639133 - RNA, 14 nt, Homo sapiens
aagauguacuucuc

SEQ ID NO: 639134 - RNA, 14 nt, Homo sapiens
aagauguacuugug

SEQ ID NO: 639135 - RNA, 20 nt, Homo sapiens
aagauguccugacuuugccc

SEQ ID NO: 639136 - RNA, 17 nt, Homo sapiens
aagaugucuauguagcu

SEQ ID NO: 639137 - RNA, 19 nt, Homo sapiens
aagaugucuauguagcuga

SEQ ID NO: 639138 - RNA, 19 nt, Homo sapiens
aagaugucuccucaagccu

SEQ ID NO: 639139 - RNA, 17 nt, Homo sapiens
aagauguguaaacaggu

SEQ ID NO: 639140 - RNA, 17 nt, Homo sapiens
aagauguucacuguggc

SEQ ID NO: 639141 - RNA, 18 nt, Homo sapiens
aagauguuucaaaaaauc

SEQ ID NO: 639142 - RNA, 20 nt, Homo sapiens
aagauuaugugacuugcaau

SEQ ID NO: 639143 - RNA, 11 nt, Homo sapiens
aagauuccaaa

SEQ ID NO: 639144 - RNA, 15 nt, Homo sapiens
aagauuccaaaaagc

SEQ ID NO: 639145 - RNA, 19 nt, Homo sapiens
aagauuccaaaaagcacau

SEQ ID NO: 639146 - RNA, 14 nt, Homo sapiens
aagauucuaucaaa

SEQ ID NO: 639147 - RNA, 23 nt, Homo sapiens
aagauucugaccuuaaaugcaac

SEQ ID NO: 639148 - RNA, 14 nt, Homo sapiens
aagauugaacuuaa

SEQ ID NO: 639149 - RNA, 19 nt, Homo sapiens
aagauuuauacaguugaaa

SEQ ID NO: 639150 - RNA, 21 nt, Homo sapiens
aagauuuccacaauucuucug

SEQ ID NO: 639151 - RNA, 14 nt, Homo sapiens
aagauuuuacuuua

SEQ ID NO: 639152 - RNA, 16 nt, Homo sapiens
aagauuuucaaacaaa

SEQ ID NO: 639153 - RNA, 18 nt, Homo sapiens
aagauuuuugaaaauccu

SEQ ID NO: 639154 - RNA, 10 nt, Homo sapiens
aagcaaaaag

SEQ ID NO: 639155 - RNA, 14 nt, Homo sapiens
aagcaaaaucauuu

SEQ ID NO: 639156 - RNA, 13 nt, Homo sapiens
aagcaaacacuua

SEQ ID NO: 639157 - RNA, 19 nt, Homo sapiens
aagcaaauaaaugccuucc

SEQ ID NO: 639158 - RNA, 22 nt, Homo sapiens
aagcaaaugcuacauauaugca

SEQ ID NO: 639159 - RNA, 14 nt, Homo sapiens
aagcaacacagagc

SEQ ID NO: 639160 - RNA, 12 nt, Homo sapiens
aagcaacauuca

SEQ ID NO: 639161 - RNA, 14 nt, Homo sapiens
aagcaacuguuaug

SEQ ID NO: 639162 - RNA, 21 nt, Homo sapiens
aagcaagacccuaaacaucca

SEQ ID NO: 639163 - RNA, 13 nt, Homo sapiens
aagcaaggccaaa

SEQ ID NO: 639164 - RNA, 18 nt, Homo sapiens
aagcaaggcuuuaaauga

SEQ ID NO: 639165 - RNA, 14 nt, Homo sapiens
aagcaaguuuucuu

SEQ ID NO: 639166 - RNA, 16 nt, Homo sapiens
aagcaauaaccucaaa

SEQ ID NO: 639167 - RNA, 17 nt, Homo sapiens
aagcaauaacuccaagc

SEQ ID NO: 639168 - RNA, 11 nt, Homo sapiens
aagcaaugugg

SEQ ID NO: 639169 - RNA, 17 nt, Homo sapiens
aagcaauucuccugccu

SEQ ID NO: 639170 - RNA, 19 nt, Homo sapiens
aagcaauugaaaugcauug

SEQ ID NO: 639171 - RNA, 13 nt, Homo sapiens
aagcaauugucug

SEQ ID NO: 639172 - RNA, 15 nt, Homo sapiens
aagcacaaagccauu

SEQ ID NO: 639173 - RNA, 22 nt, Homo sapiens
aagcacaacugaaaccaguagc

SEQ ID NO: 639174 - RNA, 16 nt, Homo sapiens
aagcacacuaaaccaa

SEQ ID NO: 639175 - RNA, 24 nt, Homo sapiens
aagcacagaguggcuuggccucaa

SEQ ID NO: 639176 - RNA, 15 nt, Homo sapiens
aagcacaguuugaac

SEQ ID NO: 639177 - RNA, 19 nt, Homo sapiens
aagcacauaugaacuggac

SEQ ID NO: 639178 - RNA, 14 nt, Homo sapiens
aagcacaucaauua

SEQ ID NO: 639179 - RNA, 13 nt, Homo sapiens
aagcacauguaau

SEQ ID NO: 639180 - RNA, 15 nt, Homo sapiens
aagcacauguauuga

SEQ ID NO: 639181 - RNA, 18 nt, Homo sapiens
aagcaccccagucacuag

SEQ ID NO: 639182 - RNA, 17 nt, Homo sapiens
aagcaccugccgaccuc

SEQ ID NO: 639183 - RNA, 15 nt, Homo sapiens
aagcaccuguuaaua

SEQ ID NO: 639184 - RNA, 14 nt, Homo sapiens
aagcacuacaccuu

SEQ ID NO: 639185 - RNA, 18 nt, Homo sapiens
aagcacuacaccuugccu

SEQ ID NO: 639186 - RNA, 19 nt, Homo sapiens
aagcacuacauaaacugac

SEQ ID NO: 639187 - RNA, 21 nt, Homo sapiens
aagcacucgugugcaacagac

SEQ ID NO: 639188 - RNA, 17 nt, Homo sapiens
aagcacucucugcaguc

SEQ ID NO: 639189 - RNA, 23 nt, Homo sapiens
aagcacucuggaugauggauucc

SEQ ID NO: 639190 - RNA, 14 nt, Homo sapiens
aagcacuguggauc

SEQ ID NO: 639191 - RNA, 15 nt, Homo sapiens
aagcacuugcuauuu

SEQ ID NO: 639192 - RNA, 19 nt, Homo sapiens
aagcacuugcuuacauccu

SEQ ID NO: 639193 - RNA, 15 nt, Homo sapiens
aagcagacagucaca

SEQ ID NO: 639194 - RNA, 20 nt, Homo sapiens
aagcagacccaccucccagc

SEQ ID NO: 639195 - RNA, 17 nt, Homo sapiens
aagcagagaaaauaauu

SEQ ID NO: 639196 - RNA, 19 nt, Homo sapiens
aagcagagcuaguaaugcu

SEQ ID NO: 639197 - RNA, 21 nt, Homo sapiens
aagcuccggauggaggccagc

SEQ ID NO: 639198 - RNA, 15 nt, Homo sapiens
aagcuccuuccagac

SEQ ID NO: 639199 - RNA, 16 nt, Homo sapiens
aagcucuaaagaccau

SEQ ID NO: 639200 - RNA, 12 nt, Homo sapiens
aagcucuaguuc

SEQ ID NO: 639201 - RNA, 16 nt, Homo sapiens
aagcucugaagucaca

SEQ ID NO: 639202 - RNA, 20 nt, Homo sapiens
aagcucugccucccggguuc

SEQ ID NO: 639203 - RNA, 23 nt, Homo sapiens
aagcucuggcugaacccugugcu

SEQ ID NO: 639204 - RNA, 22 nt, Homo sapiens
aagcugaaaugcaggaaguggu

SEQ ID NO: 639205 - RNA, 15 nt, Homo sapiens
aagcugacauugcca

SEQ ID NO: 639206 - RNA, 20 nt, Homo sapiens
aagcugacucuuugcucuaa

SEQ ID NO: 639207 - RNA, 17 nt, Homo sapiens
aagcugacuuugccaaa

SEQ ID NO: 639208 - RNA, 19 nt, Homo sapiens
aagcugaggccuaugcaga

SEQ ID NO: 639209 - RNA, 15 nt, Homo sapiens
aagcugauucacuau

SEQ ID NO: 639210 - RNA, 12 nt, Homo sapiens
aagcugcacaug

SEQ ID NO: 639211 - RNA, 15 nt, Homo sapiens
aagcugcacaugugc

SEQ ID NO: 639212 - RNA, 16 nt, Homo sapiens
aagcugcccacuguuu

SEQ ID NO: 639213 - RNA, 12 nt, Homo sapiens
aagcugcucagg

SEQ ID NO: 639214 - RNA, 20 nt, Homo sapiens
aagcugcuccaggccugcag

SEQ ID NO: 639215 - RNA, 22 nt, Homo sapiens
aagcugcuccaggccugcagca

SEQ ID NO: 639216 - RNA, 13 nt, Homo sapiens
aagcugcuuuaaa

SEQ ID NO: 639217 - RNA, 13 nt, Homo sapiens
aagcuggagagac

SEQ ID NO: 639218 - RNA, 18 nt, Homo sapiens
aagcuggagcucuuggaa

SEQ ID NO: 639219 - RNA, 16 nt, Homo sapiens
aagcugggagcacagg

SEQ ID NO: 639220 - RNA, 23 nt, Homo sapiens
aagcuggugucugauuuuggcca

SEQ ID NO: 639221 - RNA, 22 nt, Homo sapiens
aagcugugaaagaaccaaaaga

SEQ ID NO: 639222 - RNA, 21 nt, Homo sapiens
aagcugugagacagugggaaa

SEQ ID NO: 639223 - RNA, 19 nt, Homo sapiens
aagcuguugaagucucagg

SEQ ID NO: 639224 - RNA, 21 nt, Homo sapiens
aagcuuaauaugugcugaaca

SEQ ID NO: 639225 - RNA, 13 nt, Homo sapiens
aagcuuacacaag

SEQ ID NO: 639226 - RNA, 16 nt, Homo sapiens
aagcuuacuacaguga

SEQ ID NO: 639227 - RNA, 22 nt, Homo sapiens
aagcuuccauuccaagccugac

SEQ ID NO: 639228 - RNA, 17 nt, Homo sapiens
aagcuugaagcugugga

SEQ ID NO: 639229 - RNA, 18 nt, Homo sapiens
aagcuugaagcuguggag

SEQ ID NO: 639230 - RNA, 20 nt, Homo sapiens
aagcuugagucucaagggug

SEQ ID NO: 639231 - RNA, 14 nt, Homo sapiens
aagcuugucaaaga

SEQ ID NO: 639232 - RNA, 14 nt, Homo sapiens
aagcuuguguacuu

SEQ ID NO: 639233 - RNA, 14 nt, Homo sapiens
aagcuuuaagcaaa

SEQ ID NO: 639234 - RNA, 18 nt, Homo sapiens
aagcuuucaaauccuccc

SEQ ID NO: 639235 - RNA, 19 nt, Homo sapiens
aagcuuugaauacugugaa

SEQ ID NO: 639236 - RNA, 15 nt, Homo sapiens
aagcuuuguaccuuu

SEQ ID NO: 639237 - RNA, 22 nt, Homo sapiens
aagcuuuuggagggugauauaa

SEQ ID NO: 639238 - RNA, 18 nt, Homo sapiens
aaggaaaaaauaaaagau

SEQ ID NO: 639239 - RNA, 12 nt, Homo sapiens
aaggaaagcuca

SEQ ID NO: 639240 - RNA, 13 nt, Homo sapiens
aaggaaauacuuu

SEQ ID NO: 639241 - RNA, 19 nt, Homo sapiens
aaggaaaucuccucuuuug

SEQ ID NO: 639242 - RNA, 14 nt, Homo sapiens
aaggaaaugguggc

SEQ ID NO: 639243 - RNA, 21 nt, Homo sapiens
aaggaacauuccuuagucuca

SEQ ID NO: 639244 - RNA, 21 nt, Homo sapiens
aaggaacucuacuucagucaa

SEQ ID NO: 639245 - RNA, 15 nt, Homo sapiens
aaggaacugucacca

SEQ ID NO: 639246 - RNA, 23 nt, Homo sapiens
aaggaagaaauuccaggaaaauc

SEQ ID NO: 639247 - RNA, 17 nt, Homo sapiens
aaggaagacaaugugaa

SEQ ID NO: 639248 - RNA, 13 nt, Homo sapiens
aaggaagacuuga

SEQ ID NO: 639249 - RNA, 21 nt, Homo sapiens
aaggaagcaaguuuucuucca

SEQ ID NO: 639250 - RNA, 18 nt, Homo sapiens
aaggaagggauacaugau

SEQ ID NO: 639251 - RNA, 15 nt, Homo sapiens
aaggaaucauuguuc

SEQ ID NO: 639252 - RNA, 20 nt, Homo sapiens
aaggaauccuggauuuugcc

SEQ ID NO: 639253 - RNA, 18 nt, Homo sapiens
aaggaaucuggcauucua

SEQ ID NO: 639254 - RNA, 20 nt, Homo sapiens
aaggaauguguccaagacac

SEQ ID NO: 639255 - RNA, 19 nt, Homo sapiens
aaggaauuuccucccaauu

SEQ ID NO: 639256 - RNA, 18 nt, Homo sapiens
aaggaauuugauugcuuu

SEQ ID NO: 639257 - RNA, 22 nt, Homo sapiens
aaggaauuuugucucacuuuua

SEQ ID NO: 639258 - RNA, 17 nt, Homo sapiens
aaggacaagacacugag

SEQ ID NO: 639259 - RNA, 13 nt, Homo sapiens
aaggacacaguga

SEQ ID NO: 639260 - RNA, 20 nt, Homo sapiens
aaggacaccuuuuaacucac

SEQ ID NO: 639261 - RNA, 14 nt, Homo sapiens
aaggacccugugag

SEQ ID NO: 639262 - RNA, 20 nt, Homo sapiens
aaggaccucucucaaugcca

SEQ ID NO: 639263 - RNA, 17 nt, Homo sapiens
aaggacgguucuuacac

SEQ ID NO: 639264 - RNA, 16 nt, Homo sapiens
aaggacuaugaaaagc

SEQ ID NO: 639265 - RNA, 11 nt, Homo sapiens
aaggacucuca

SEQ ID NO: 639266 - RNA, 21 nt, Homo sapiens
aaggacugagggcagugcccu

SEQ ID NO: 639267 - RNA, 15 nt, Homo sapiens
aaggagaacuaucca

SEQ ID NO: 639268 - RNA, 19 nt, Homo sapiens
aaggagaacuauccaaaac

SEQ ID NO: 639269 - RNA, 18 nt, Homo sapiens
aaggagaggcaacaucca

SEQ ID NO: 639270 - RNA, 16 nt, Homo sapiens
aaggagcucacugugg

SEQ ID NO: 639271 - RNA, 22 nt, Homo sapiens
aaggagggagcucugaugagca

SEQ ID NO: 639272 - RNA, 22 nt, Homo sapiens
aaggaggucaggccccacuccu

SEQ ID NO: 639273 - RNA, 21 nt, Homo sapiens
aaggaguaaucuguguacaaa

SEQ ID NO: 639274 - RNA, 20 nt, Homo sapiens
aaggaguacaaugcccagau

SEQ ID NO: 639275 - RNA, 22 nt, Homo sapiens
aaggaguacaaugcccagauca

SEQ ID NO: 639276 - RNA, 17 nt, Homo sapiens
aaggaguucagauguuu

SEQ ID NO: 639277 - RNA, 14 nt, Homo sapiens
aaggauauuuacua

SEQ ID NO: 639278 - RNA, 20 nt, Homo sapiens
aaggauauuuacuacuuuug

SEQ ID NO: 639279 - RNA, 18 nt, Homo sapiens
aaggauccucuccacucc

SEQ ID NO: 639280 - RNA, 15 nt, Homo sapiens
aaggauccugugcug

SEQ ID NO: 639281 - RNA, 17 nt, Homo sapiens
aaggaucuccucuggaa

SEQ ID NO: 639282 - RNA, 15 nt, Homo sapiens
aaggaucucucagga

SEQ ID NO: 639283 - RNA, 12 nt, Homo sapiens
aaggaugaauga

SEQ ID NO: 639284 - RNA, 14 nt, Homo sapiens
aaggaugacuuuag

SEQ ID NO: 639285 - RNA, 18 nt, Homo sapiens
aaggaugccuuagcaugu

SEQ ID NO: 639286 - RNA, 18 nt, Homo sapiens
aaggauggagccagcucu

SEQ ID NO: 639287 - RNA, 19 nt, Homo sapiens
aaggaugucacagggccaa

SEQ ID NO: 639288 - RNA, 13 nt, Homo sapiens
aaggaugugggcc

SEQ ID NO: 639289 - RNA, 17 nt, Homo sapiens
aaggauuuuaccaaagc

SEQ ID NO: 639290 - RNA, 18 nt, Homo sapiens
aaggauuuuaccaaagca

SEQ ID NO: 639291 - RNA, 17 nt, Homo sapiens
aaggcaaaguuuacaga

SEQ ID NO: 639292 - RNA, 14 nt, Homo sapiens
aaggcaacugugag

SEQ ID NO: 639293 - RNA, 21 nt, Homo sapiens
aaggcaauccuaagcaaaaag

SEQ ID NO: 639294 - RNA, 12 nt, Homo sapiens
aaggcacacaga

SEQ ID NO: 639295 - RNA, 19 nt, Homo sapiens
aaggcacccaucugucugc

SEQ ID NO: 639296 - RNA, 16 nt, Homo sapiens
aaggcagcugccucug

SEQ ID NO: 639297 - RNA, 20 nt, Homo sapiens
aaggcagcugccucugcucc

SEQ ID NO: 639298 - RNA, 19 nt, Homo sapiens
aaggcaggaggaucacuug

SEQ ID NO: 639299 - RNA, 17 nt, Homo sapiens
aaggcaggugccuccag

SEQ ID NO: 639300 - RNA, 12 nt, Homo sapiens
aaggcaggugga

SEQ ID NO: 639301 - RNA, 15 nt, Homo sapiens
aaggcaguagaacuc

SEQ ID NO: 639302 - RNA, 14 nt, Homo sapiens
aaggcaguauuuca

SEQ ID NO: 639303 - RNA, 16 nt, Homo sapiens
aaggcagucauaucaa

SEQ ID NO: 639304 - RNA, 20 nt, Homo sapiens
aaggcagugauuagcacuug

SEQ ID NO: 639305 - RNA, 14 nt, Homo sapiens
aaggcauaaaugac

SEQ ID NO: 639306 - RNA, 15 nt, Homo sapiens
aaggcauaucuucua

SEQ ID NO: 639307 - RNA, 22 nt, Homo sapiens
aaggcauaugcuggcccauaaa

SEQ ID NO: 639308 - RNA, 19 nt, Homo sapiens
aaggcaucuacacaauuua

SEQ ID NO: 639309 - RNA, 12 nt, Homo sapiens
aaggcaucucag

SEQ ID NO: 639310 - RNA, 18 nt, Homo sapiens
aaggcauuccucaucacc

SEQ ID NO: 639311 - RNA, 19 nt, Homo sapiens
aaggcauuccucaucacca

SEQ ID NO: 639312 - RNA, 19 nt, Homo sapiens
aaggcauuguccugugaaa

SEQ ID NO: 639313 - RNA, 15 nt, Homo sapiens
aaggccacaggcagu

SEQ ID NO: 639314 - RNA, 14 nt, Homo sapiens
aaggccacauguca

SEQ ID NO: 639315 - RNA, 13 nt, Homo sapiens
aaggccagcugaa

SEQ ID NO: 639316 - RNA, 19 nt, Homo sapiens
aaggccccgagcucagggc

SEQ ID NO: 639317 - RNA, 16 nt, Homo sapiens
aaggccccugcaaugu

SEQ ID NO: 639318 - RNA, 13 nt, Homo sapiens
aaggcccuuuuca

SEQ ID NO: 639319 - RNA, 13 nt, Homo sapiens
auugcuuuuauua

SEQ ID NO: 639320 - RNA, 20 nt, Homo sapiens
auugcuuuuguugugacuuu

SEQ ID NO: 639321 - RNA, 18 nt, Homo sapiens
auuggaaauuuguuauaa

SEQ ID NO: 639322 - RNA, 16 nt, Homo sapiens
auuggaacucuacuca

SEQ ID NO: 639323 - RNA, 14 nt, Homo sapiens
auuggaagagcaca

SEQ ID NO: 639324 - RNA, 19 nt, Homo sapiens
auuggaaucuucaccucag

SEQ ID NO: 639325 - RNA, 22 nt, Homo sapiens
auuggaaugcagaggucuccaa

SEQ ID NO: 639326 - RNA, 21 nt, Homo sapiens
auuggacgguuucuagccucu

SEQ ID NO: 639327 - RNA, 22 nt, Homo sapiens
auuggagaauacuuugcuucau

SEQ ID NO: 639328 - RNA, 16 nt, Homo sapiens
auuggcagccaaggaa

SEQ ID NO: 639329 - RNA, 13 nt, Homo sapiens
auuggcucagccc

SEQ ID NO: 639330 - RNA, 14 nt, Homo sapiens
auuggcucuaguca

SEQ ID NO: 639331 - RNA, 22 nt, Homo sapiens
auugggaagcugggggaagggu

SEQ ID NO: 639332 - RNA, 20 nt, Homo sapiens
auugggacgcacagugcagu

SEQ ID NO: 639333 - RNA, 15 nt, Homo sapiens
auugggcaggugaaa

SEQ ID NO: 639334 - RNA, 14 nt, Homo sapiens
auugguacacgugu

SEQ ID NO: 639335 - RNA, 22 nt, Homo sapiens
auugguccagcuugcucuucag

SEQ ID NO: 639336 - RNA, 19 nt, Homo sapiens
auuggucuaauuuauucaa

SEQ ID NO: 639337 - RNA, 21 nt, Homo sapiens
auugguggggcuggguaccaa

SEQ ID NO: 639338 - RNA, 15 nt, Homo sapiens
auugguuuugcagaa

SEQ ID NO: 639339 - RNA, 21 nt, Homo sapiens
auugguuuugguuuugacuca

SEQ ID NO: 639340 - RNA, 14 nt, Homo sapiens
auuguaaaacccca

SEQ ID NO: 639341 - RNA, 15 nt, Homo sapiens
auuguaaaguaugug

SEQ ID NO: 639342 - RNA, 21 nt, Homo sapiens
auuguaauccuagcacuuugg

SEQ ID NO: 639343 - RNA, 13 nt, Homo sapiens
auuguacaaguca

SEQ ID NO: 639344 - RNA, 21 nt, Homo sapiens
auuguacuuaaaccuccugcu

SEQ ID NO: 639345 - RNA, 12 nt, Homo sapiens
auuguagccuca

SEQ ID NO: 639346 - RNA, 12 nt, Homo sapiens
auuguagcuuuu

SEQ ID NO: 639347 - RNA, 15 nt, Homo sapiens
auuguaguuaaugau

SEQ ID NO: 639348 - RNA, 17 nt, Homo sapiens
auuguauacuaccauag

SEQ ID NO: 639349 - RNA, 20 nt, Homo sapiens
auuguauacuaccauaguga

SEQ ID NO: 639350 - RNA, 19 nt, Homo sapiens
auuguaucaaaugugacau

SEQ ID NO: 639351 - RNA, 12 nt, Homo sapiens
auuguaugucaa

SEQ ID NO: 639352 - RNA, 14 nt, Homo sapiens
auuguauuuaguua

SEQ ID NO: 639353 - RNA, 23 nt, Homo sapiens
auuguauuuuggauuuuuacaca

SEQ ID NO: 639354 - RNA, 14 nt, Homo sapiens
auugucacagauga

SEQ ID NO: 639355 - RNA, 13 nt, Homo sapiens
auugucaccauga

SEQ ID NO: 639356 - RNA, 12 nt, Homo sapiens
auuguccaggcu

SEQ ID NO: 639357 - RNA, 16 nt, Homo sapiens
auuguccccaaugaau

SEQ ID NO: 639358 - RNA, 19 nt, Homo sapiens
auuguccccuuuuuaguuu

SEQ ID NO: 639359 - RNA, 15 nt, Homo sapiens
auugucccucugccc

SEQ ID NO: 639360 - RNA, 18 nt, Homo sapiens
auugucccuguguugucc

SEQ ID NO: 639361 - RNA, 21 nt, Homo sapiens
auugucuccuuccacaaugac

SEQ ID NO: 639362 - RNA, 16 nt, Homo sapiens
auugucugagguaaau

SEQ ID NO: 639363 - RNA, 18 nt, Homo sapiens
auugucuguaaugacaaa

SEQ ID NO: 639364 - RNA, 20 nt, Homo sapiens
auugucuuguuauguacaaa

SEQ ID NO: 639365 - RNA, 19 nt, Homo sapiens
auugugaagcaccuacuau

SEQ ID NO: 639366 - RNA, 20 nt, Homo sapiens
auugugaaugauucauguua

SEQ ID NO: 639367 - RNA, 18 nt, Homo sapiens
auugugacuucacuguau

SEQ ID NO: 639368 - RNA, 20 nt, Homo sapiens
auugugaguuuucuauuuca

SEQ ID NO: 639369 - RNA, 14 nt, Homo sapiens
auugugcacaucuc

SEQ ID NO: 639370 - RNA, 15 nt, Homo sapiens
auugugcacaucucg

SEQ ID NO: 639371 - RNA, 19 nt, Homo sapiens
auugugccacuucacucca

SEQ ID NO: 639372 - RNA, 13 nt, Homo sapiens
auugugcugccau

SEQ ID NO: 639373 - RNA, 16 nt, Homo sapiens
auugugcuucgaguga

SEQ ID NO: 639374 - RNA, 20 nt, Homo sapiens
auugugcuucgagugacuga

SEQ ID NO: 639375 - RNA, 15 nt, Homo sapiens
auuguggaaaaccag

SEQ ID NO: 639376 - RNA, 15 nt, Homo sapiens
auuguggaugaugau

SEQ ID NO: 639377 - RNA, 17 nt, Homo sapiens
auugugguuccaugcag

SEQ ID NO: 639378 - RNA, 14 nt, Homo sapiens
auugugugucacaa

SEQ ID NO: 639379 - RNA, 15 nt, Homo sapiens
auuguuaaaauaacu

SEQ ID NO: 639380 - RNA, 17 nt, Homo sapiens
auuguuaugaaaauccu

SEQ ID NO: 639381 - RNA, 17 nt, Homo sapiens
auuguucaaagcacaga

SEQ ID NO: 639382 - RNA, 18 nt, Homo sapiens
auuguucaaagcacagaa

SEQ ID NO: 639383 - RNA, 14 nt, Homo sapiens
auuguucccaguga

SEQ ID NO: 639384 - RNA, 17 nt, Homo sapiens
auuguugacaacuguga

SEQ ID NO: 639385 - RNA, 17 nt, Homo sapiens
auuguugucaggccaua

SEQ ID NO: 639386 - RNA, 22 nt, Homo sapiens
auuguuguucuguuaacugaau

SEQ ID NO: 639387 - RNA, 16 nt, Homo sapiens
auuguuguugccaaag

SEQ ID NO: 639388 - RNA, 19 nt, Homo sapiens
auuguuuaaaaaccgaaua

SEQ ID NO: 639389 - RNA, 21 nt, Homo sapiens
auuguuuauaaaacaaugacu

SEQ ID NO: 639390 - RNA, 22 nt, Homo sapiens
auuguuuucaguguacauggaa

SEQ ID NO: 639391 - RNA, 20 nt, Homo sapiens
auuguuuucccaaguguaau

SEQ ID NO: 639392 - RNA, 17 nt, Homo sapiens
auuguuuucuuuuacag

SEQ ID NO: 639393 - RNA, 20 nt, Homo sapiens
auuguuuugaccccuuacac

SEQ ID NO: 639394 - RNA, 18 nt, Homo sapiens
auuguuuuugcucaaggc

SEQ ID NO: 639395 - RNA, 24 nt, Homo sapiens
auuuaaaaaaaaagucagagacag

SEQ ID NO: 639396 - RNA, 17 nt, Homo sapiens
auuuaaaacaucauuac

SEQ ID NO: 639397 - RNA, 21 nt, Homo sapiens
auuuaaaaugcucaauuucag

SEQ ID NO: 639398 - RNA, 22 nt, Homo sapiens
auuuaaaauuacguuuguuauu

SEQ ID NO: 639399 - RNA, 17 nt, Homo sapiens
auuuaaacucaagacaa

SEQ ID NO: 639400 - RNA, 22 nt, Homo sapiens
auuuaaagaaaauaaacaccau

SEQ ID NO: 639401 - RNA, 15 nt, Homo sapiens
auuuaaagccuccuc

SEQ ID NO: 639402 - RNA, 16 nt, Homo sapiens
ccugagagauuuaaca

SEQ ID NO: 639403 - RNA, 21 nt, Homo sapiens
ccugagaggaaccagagcaga

SEQ ID NO: 639404 - RNA, 13 nt, Homo sapiens
ccugagagucagg

SEQ ID NO: 639405 - RNA, 17 nt, Homo sapiens
ccugagcagaauacugg

SEQ ID NO: 639406 - RNA, 17 nt, Homo sapiens
ccugagcagugccagcu

SEQ ID NO: 639407 - RNA, 17 nt, Homo sapiens
ccugagccccucaaucc

SEQ ID NO: 639408 - RNA, 15 nt, Homo sapiens
ccugaggaagaugac

SEQ ID NO: 639409 - RNA, 11 nt, Homo sapiens
ccugaggaaug

SEQ ID NO: 639410 - RNA, 15 nt, Homo sapiens
ccugaggaccucuca

SEQ ID NO: 639411 - RNA, 20 nt, Homo sapiens
ccugaggaggccgcuuagug

SEQ ID NO: 639412 - RNA, 16 nt, Homo sapiens
ccugaggucagggagu

SEQ ID NO: 639413 - RNA, 21 nt, Homo sapiens
ccugaggugaaagggagcuau

SEQ ID NO: 639414 - RNA, 13 nt, Homo sapiens
ccugaggugcauu

SEQ ID NO: 639415 - RNA, 20 nt, Homo sapiens
ccugagguuugccagcauuu

SEQ ID NO: 639416 - RNA, 17 nt, Homo sapiens
ccugaguggugccaaac

SEQ ID NO: 639417 - RNA, 20 nt, Homo sapiens
ccugaguucauccaggccca

SEQ ID NO: 639418 - RNA, 17 nt, Homo sapiens
ccugaguuggagcucau

SEQ ID NO: 639419 - RNA, 17 nt, Homo sapiens
ccugaucacuaugcauu

SEQ ID NO: 639420 - RNA, 21 nt, Homo sapiens
ccugaucagagccgugguccu

SEQ ID NO: 639421 - RNA, 18 nt, Homo sapiens
ccugauccugacacauuc

SEQ ID NO: 639422 - RNA, 18 nt, Homo sapiens
ccugaucgccaaccuuuc

SEQ ID NO: 639423 - RNA, 17 nt, Homo sapiens
ccugaucuggacccuug

SEQ ID NO: 639424 - RNA, 14 nt, Homo sapiens
ccugaucugugaua

SEQ ID NO: 639425 - RNA, 21 nt, Homo sapiens
ccugaugacagagcgagauuc

SEQ ID NO: 639426 - RNA, 13 nt, Homo sapiens
ccugaugagauuu

SEQ ID NO: 639427 - RNA, 17 nt, Homo sapiens
ccugaugcagccugugg

SEQ ID NO: 639428 - RNA, 21 nt, Homo sapiens
ccugaugccccuuccccaaga

SEQ ID NO: 639429 - RNA, 23 nt, Homo sapiens
ccugauggaaguuaacccggagc

SEQ ID NO: 639430 - RNA, 16 nt, Homo sapiens
ccugauggagugugca

SEQ ID NO: 639431 - RNA, 21 nt, Homo sapiens
ccugauggccuuuggacccag

SEQ ID NO: 639432 - RNA, 20 nt, Homo sapiens
ccugauuacacuacauagaa

SEQ ID NO: 639433 - RNA, 23 nt, Homo sapiens
ccugauuagaugacucucagucc

SEQ ID NO: 639434 - RNA, 18 nt, Homo sapiens
ccugauucauacuccuuu

SEQ ID NO: 639435 - RNA, 21 nt, Homo sapiens
ccugcaaacucacugcucaag

SEQ ID NO: 639436 - RNA, 17 nt, Homo sapiens
ccugcacagauaccuca

SEQ ID NO: 639437 - RNA, 20 nt, Homo sapiens
ccugcacagauaccucauca

SEQ ID NO: 639438 - RNA, 18 nt, Homo sapiens
ccugcaccccugcaguuu

SEQ ID NO: 639439 - RNA, 14 nt, Homo sapiens
ccugcaccgucuca

SEQ ID NO: 639440 - RNA, 14 nt, Homo sapiens
ccugcaccugugca

SEQ ID NO: 639441 - RNA, 20 nt, Homo sapiens
auuuagaguucuagaccucu

SEQ ID NO: 639442 - RNA, 17 nt, Homo sapiens
auuuaguaaaguuuguu

SEQ ID NO: 639443 - RNA, 15 nt, Homo sapiens
auuuagucaugugac

SEQ ID NO: 639444 - RNA, 16 nt, Homo sapiens
auuuagucuugccagg

SEQ ID NO: 639445 - RNA, 19 nt, Homo sapiens
auuuaguguuuuuaccucu

SEQ ID NO: 639446 - RNA, 14 nt, Homo sapiens
auuuaguuccacaa

SEQ ID NO: 639447 - RNA, 15 nt, Homo sapiens
auuuaguuggaauau

SEQ ID NO: 639448 - RNA, 17 nt, Homo sapiens
auuuaguuggaauauca

SEQ ID NO: 639449 - RNA, 17 nt, Homo sapiens
auuuauaaaacuucuca

SEQ ID NO: 639450 - RNA, 16 nt, Homo sapiens
auuuauaaaugagcaa

SEQ ID NO: 639451 - RNA, 19 nt, Homo sapiens
auuuauaacagcauucuug

SEQ ID NO: 639452 - RNA, 15 nt, Homo sapiens
auuuauaacucauca

SEQ ID NO: 639453 - RNA, 18 nt, Homo sapiens
auuuauacaccagcaauu

SEQ ID NO: 639454 - RNA, 20 nt, Homo sapiens
auuuauacaccagcaauuua

SEQ ID NO: 639455 - RNA, 14 nt, Homo sapiens
auuuauaccucagu

SEQ ID NO: 639456 - RNA, 15 nt, Homo sapiens
auuuauagcuaugaa

SEQ ID NO: 639457 - RNA, 23 nt, Homo sapiens
auuuauccaaaauguguauuucu

SEQ ID NO: 639458 - RNA, 16 nt, Homo sapiens
auuuauccaagaccug

SEQ ID NO: 639459 - RNA, 14 nt, Homo sapiens
auuuaucugugcaa

SEQ ID NO: 639460 - RNA, 16 nt, Homo sapiens
auuuaugaaucacagu

SEQ ID NO: 639461 - RNA, 15 nt, Homo sapiens
auuuaugacauuaca

SEQ ID NO: 639462 - RNA, 15 nt, Homo sapiens
auuuaugaugcacuu

SEQ ID NO: 639463 - RNA, 16 nt, Homo sapiens
auuuaugcgaaccuau

SEQ ID NO: 639464 - RNA, 13 nt, Homo sapiens
auuuaugucucau

SEQ ID NO: 639465 - RNA, 22 nt, Homo sapiens
auuuauguggauuuugcaugua

SEQ ID NO: 639466 - RNA, 13 nt, Homo sapiens
auuuauguguaua

SEQ ID NO: 639467 - RNA, 19 nt, Homo sapiens
auuuauuauuaacauaccu

SEQ ID NO: 639468 - RNA, 18 nt, Homo sapiens
auuuauugcuguguaaca

SEQ ID NO: 639469 - RNA, 15 nt, Homo sapiens
auuuauuuaagcuua

SEQ ID NO: 639470 - RNA, 16 nt, Homo sapiens
auuuauuuauggagga

SEQ ID NO: 639471 - RNA, 18 nt, Homo sapiens
auuuauuuuccuaaagag

SEQ ID NO: 639472 - RNA, 19 nt, Homo sapiens
auuucaaaauauacauuca

SEQ ID NO: 639473 - RNA, 19 nt, Homo sapiens
auuucaaauugaauuugca

SEQ ID NO: 639474 - RNA, 15 nt, Homo sapiens
auuucaacaagaaua

SEQ ID NO: 639475 - RNA, 21 nt, Homo sapiens
auuucaagaaguguaguucaa

SEQ ID NO: 639476 - RNA, 13 nt, Homo sapiens
auuucacaagcua

SEQ ID NO: 639477 - RNA, 15 nt, Homo sapiens
auuucacaagcuauu

SEQ ID NO: 639478 - RNA, 16 nt, Homo sapiens
auuucacaagcuauuu

SEQ ID NO: 639479 - RNA, 12 nt, Homo sapiens
auuucacacagu

SEQ ID NO: 639480 - RNA, 14 nt, Homo sapiens
auuucacagugugu

SEQ ID NO: 639481 - RNA, 13 nt, Homo sapiens
auuucacauuaau

SEQ ID NO: 639482 - RNA, 15 nt, Homo sapiens
auuucaccaccaaau

SEQ ID NO: 639483 - RNA, 16 nt, Homo sapiens
auuucaccuacuuugu

SEQ ID NO: 639484 - RNA, 20 nt, Homo sapiens
auuucacuaggacucagaaa

SEQ ID NO: 639485 - RNA, 13 nt, Homo sapiens
auuucacucucaa

SEQ ID NO: 639486 - RNA, 19 nt, Homo sapiens
auuucacucucaaacuuca

SEQ ID NO: 639487 - RNA, 21 nt, Homo sapiens
auuucacugaugcuucuguca

SEQ ID NO: 639488 - RNA, 23 nt, Homo sapiens
auuucacuugaugauacaaugaa

SEQ ID NO: 639489 - RNA, 20 nt, Homo sapiens
auuucagacauauccaaagg

SEQ ID NO: 639490 - RNA, 12 nt, Homo sapiens
auuucagauauc

SEQ ID NO: 639491 - RNA, 15 nt, Homo sapiens
auuucagcugaucag

SEQ ID NO: 639492 - RNA, 19 nt, Homo sapiens
auuucaggaggaauacuga

SEQ ID NO: 639493 - RNA, 17 nt, Homo sapiens
auuucaguaagcugugu

SEQ ID NO: 639494 - RNA, 15 nt, Homo sapiens
auuucauaaacaacu

SEQ ID NO: 639495 - RNA, 22 nt, Homo sapiens
auuucauaaugaaaaacuaugu

SEQ ID NO: 639496 - RNA, 13 nt, Homo sapiens
auuucauacugua

SEQ ID NO: 639497 - RNA, 14 nt, Homo sapiens
auuucauagcugua

SEQ ID NO: 639498 - RNA, 13 nt, Homo sapiens
auuucaugauuca

SEQ ID NO: 639499 - RNA, 20 nt, Homo sapiens
auuucaugauuucauuucaa

SEQ ID NO: 639500 - RNA, 21 nt, Homo sapiens
auuucaugggacuaaaugaac

SEQ ID NO: 639501 - RNA, 22 nt, Homo sapiens
auuucaugggacuaaaugaacu

SEQ ID NO: 639502 - RNA, 13 nt, Homo sapiens
auuucaugugaau

SEQ ID NO: 639503 - RNA, 22 nt, Homo sapiens
auuucauguuuuugaucaaaaa

SEQ ID NO: 639504 - RNA, 15 nt, Homo sapiens
auuucauuaucacau

SEQ ID NO: 639505 - RNA, 18 nt, Homo sapiens
auuucauuaugcuuugaa

SEQ ID NO: 639506 - RNA, 18 nt, Homo sapiens
auuucauuccauugccua

SEQ ID NO: 639507 - RNA, 16 nt, Homo sapiens
auuucauuuccauuua

SEQ ID NO: 639508 - RNA, 18 nt, Homo sapiens
auuucauuuguaacuuua

SEQ ID NO: 639509 - RNA, 21 nt, Homo sapiens
auuuccaaaacuuuaaugaac

SEQ ID NO: 639510 - RNA, 19 nt, Homo sapiens
auuuccaaaccaucagcug

SEQ ID NO: 639511 - RNA, 16 nt, Homo sapiens
auuuccaaacuugaaa

SEQ ID NO: 639512 - RNA, 20 nt, Homo sapiens
auuuccaaauguggccucca

SEQ ID NO: 639513 - RNA, 14 nt, Homo sapiens
auuuccaacaccac

SEQ ID NO: 639514 - RNA, 15 nt, Homo sapiens
auuuccaacaccaca

SEQ ID NO: 639515 - RNA, 16 nt, Homo sapiens
auuuccaacaccacag

SEQ ID NO: 639516 - RNA, 18 nt, Homo sapiens
auuuccaacaccacagac

SEQ ID NO: 639517 - RNA, 21 nt, Homo sapiens
auuuccacaaaaucuguccaa

SEQ ID NO: 639518 - RNA, 14 nt, Homo sapiens
auuuccacaccaag

SEQ ID NO: 639519 - RNA, 21 nt, Homo sapiens
auuuccacuauuuucaaagaa

SEQ ID NO: 639520 - RNA, 15 nt, Homo sapiens
auuuccacugaacaa

SEQ ID NO: 639521 - RNA, 15 nt, Homo sapiens
auuuccagacaaauu

SEQ ID NO: 639522 - RNA, 22 nt, Homo sapiens
auuuccaggaaaaaauaaaaag

SEQ ID NO: 639523 - RNA, 13 nt, Homo sapiens
auuuccaucagcc

SEQ ID NO: 639524 - RNA, 14 nt, Homo sapiens
auuuccauuuacuu

SEQ ID NO: 639525 - RNA, 23 nt, Homo sapiens
auuuccccaccccagcucaugcc

SEQ ID NO: 639526 - RNA, 13 nt, Homo sapiens
ccuggcaauguuu

SEQ ID NO: 639527 - RNA, 15 nt, Homo sapiens
ccuggcacauucauu

SEQ ID NO: 639528 - RNA, 20 nt, Homo sapiens
ccuggcacuggaugcagaaa

SEQ ID NO: 639529 - RNA, 20 nt, Homo sapiens
ccuggcagaacugagcuccu

SEQ ID NO: 639530 - RNA, 16 nt, Homo sapiens
ccuggcagagccaugg

SEQ ID NO: 639531 - RNA, 17 nt, Homo sapiens
ccuggcagcacaggaaa

SEQ ID NO: 639532 - RNA, 16 nt, Homo sapiens
ccuggcaggacuccag

SEQ ID NO: 639533 - RNA, 23 nt, Homo sapiens
ccuggcauuauguccacugugua

SEQ ID NO: 639534 - RNA, 14 nt, Homo sapiens
ccuggccaggagcu

SEQ ID NO: 639535 - RNA, 17 nt, Homo sapiens
ccuggccaggagcucuu

SEQ ID NO: 639536 - RNA, 13 nt, Homo sapiens
ccuggccaucuca

SEQ ID NO: 639537 - RNA, 18 nt, Homo sapiens
ccuggcccccaaccucag

SEQ ID NO: 639538 - RNA, 17 nt, Homo sapiens
ccuggcccgggccuaug

SEQ ID NO: 639539 - RNA, 15 nt, Homo sapiens
ccuggccgaugguac

SEQ ID NO: 639540 - RNA, 17 nt, Homo sapiens
ccuggccucuucugggc

SEQ ID NO: 639541 - RNA, 17 nt, Homo sapiens
ccuggccuuguccucag

SEQ ID NO: 639542 - RNA, 14 nt, Homo sapiens
ccuggcgugagaug

SEQ ID NO: 639543 - RNA, 14 nt, Homo sapiens
ccuggcuauguccu

SEQ ID NO: 639544 - RNA, 22 nt, Homo sapiens
ccuggcugagagaggaagagcu

SEQ ID NO: 639545 - RNA, 16 nt, Homo sapiens
ccuggcugaugaucca

SEQ ID NO: 639546 - RNA, 15 nt, Homo sapiens
ccuggcugcacucuu

SEQ ID NO: 639547 - RNA, 21 nt, Homo sapiens
ccuggcuggcauggaggguga

SEQ ID NO: 639548 - RNA, 20 nt, Homo sapiens
ccuggcuggggccuguugaa

SEQ ID NO: 639549 - RNA, 14 nt, Homo sapiens
ccugggaauggaau

SEQ ID NO: 639550 - RNA, 13 nt, Homo sapiens
ccugggaccacag

SEQ ID NO: 639551 - RNA, 21 nt, Homo sapiens
ccugggagcccccaccacaaa

SEQ ID NO: 639552 - RNA, 21 nt, Homo sapiens
ccugggaggaaauuugaaugg

SEQ ID NO: 639553 - RNA, 18 nt, Homo sapiens
ccugggaucuggugguca

SEQ ID NO: 639554 - RNA, 14 nt, Homo sapiens
ccugggcaauguga

SEQ ID NO: 639555 - RNA, 17 nt, Homo sapiens
ccugggcaauuccgcau

SEQ ID NO: 639556 - RNA, 17 nt, Homo sapiens
ccugggcagagggccug

SEQ ID NO: 639557 - RNA, 20 nt, Homo sapiens
ccugggcagaugucccccac

SEQ ID NO: 639558 - RNA, 22 nt, Homo sapiens
ccugggcauuguugagguuaag

SEQ ID NO: 639559 - RNA, 16 nt, Homo sapiens
ccugggccccacugga

SEQ ID NO: 639560 - RNA, 18 nt, Homo sapiens
ccugggccccacuggaca

SEQ ID NO: 639561 - RNA, 9 nt, Homo sapiens
ccugggcug

SEQ ID NO: 639562 - RNA, 19 nt, Homo sapiens
ccugggcuugagcugcaga

SEQ ID NO: 639563 - RNA, 20 nt, Homo sapiens
ccuggggaaagacgccuuca

SEQ ID NO: 639564 - RNA, 22 nt, Homo sapiens
auuucugcacaugguucaccau

SEQ ID NO: 639565 - RNA, 15 nt, Homo sapiens
auuucugggugaccc

SEQ ID NO: 639566 - RNA, 23 nt, Homo sapiens
auuucugguuguuaugugaucau

SEQ ID NO: 639567 - RNA, 19 nt, Homo sapiens
auuucuguauaagacuguu

SEQ ID NO: 639568 - RNA, 15 nt, Homo sapiens
auuucugucuacuaa

SEQ ID NO: 639569 - RNA, 22 nt, Homo sapiens
auuucuguucuuacaaauguga

SEQ ID NO: 639570 - RNA, 23 nt, Homo sapiens
auuucuguucuuacaaaugugaa

SEQ ID NO: 639571 - RNA, 17 nt, Homo sapiens
auuucuguuuugcauau

SEQ ID NO: 639572 - RNA, 17 nt, Homo sapiens
auuucuuaugugacauu

SEQ ID NO: 639573 - RNA, 13 nt, Homo sapiens
auuucuucacaaa

SEQ ID NO: 639574 - RNA, 22 nt, Homo sapiens
auuucuucccgcacaaauucca

SEQ ID NO: 639575 - RNA, 23 nt, Homo sapiens
auuucuucuucuaagaagacauu

SEQ ID NO: 639576 - RNA, 17 nt, Homo sapiens
auuucuugaaaagccuu

SEQ ID NO: 639577 - RNA, 21 nt, Homo sapiens
auuucuugaagaauaaauucu

SEQ ID NO: 639578 - RNA, 20 nt, Homo sapiens
auuucuuuauuuucuucucc

SEQ ID NO: 639579 - RNA, 18 nt, Homo sapiens
auuucuuuucuacacauu

SEQ ID NO: 639580 - RNA, 21 nt, Homo sapiens
auuucuuuucuggccaaaagc

SEQ ID NO: 639581 - RNA, 19 nt, Homo sapiens
auuucuuuuguuguacuuu

SEQ ID NO: 639582 - RNA, 23 nt, Homo sapiens
auuugaaaaaaacuucauucucg

SEQ ID NO: 639583 - RNA, 13 nt, Homo sapiens
auuugaaaacaua

SEQ ID NO: 639584 - RNA, 20 nt, Homo sapiens
auuugaaaacauaaucugca

SEQ ID NO: 639585 - RNA, 14 nt, Homo sapiens
auuugaaaugucau

SEQ ID NO: 639586 - RNA, 13 nt, Homo sapiens
auuugaacacugg

SEQ ID NO: 639587 - RNA, 22 nt, Homo sapiens
auuugaacuacuuaaacaguau

SEQ ID NO: 639588 - RNA, 17 nt, Homo sapiens
auuugaagaacauguga

SEQ ID NO: 639589 - RNA, 14 nt, Homo sapiens
auuugaagaagagu

SEQ ID NO: 639590 - RNA, 15 nt, Homo sapiens
auuugaaguuugcca

SEQ ID NO: 639591 - RNA, 13 nt, Homo sapiens
auuugaaugauuu

SEQ ID NO: 639592 - RNA, 21 nt, Homo sapiens
auuugaauguaaaacaggaaa

SEQ ID NO: 639593 - RNA, 18 nt, Homo sapiens
auuugaccggaucuacac

SEQ ID NO: 639594 - RNA, 17 nt, Homo sapiens
auuugacuaagagucuc

SEQ ID NO: 639595 - RNA, 16 nt, Homo sapiens
auuugagcaugcacag

SEQ ID NO: 639596 - RNA, 19 nt, Homo sapiens
auuugaggucaaguaagaa

SEQ ID NO: 639597 - RNA, 21 nt, Homo sapiens
auuugauacauuuuuguacua

SEQ ID NO: 639598 - RNA, 15 nt, Homo sapiens
auuugauguacaugu

SEQ ID NO: 639599 - RNA, 15 nt, Homo sapiens
auuugauuuugccca

SEQ ID NO: 639600 - RNA, 15 nt, Homo sapiens
auuugcaagacauag

SEQ ID NO: 639601 - RNA, 23 nt, Homo sapiens
auuugcacuucaccuuuugacca

SEQ ID NO: 639602 - RNA, 15 nt, Homo sapiens
auuugcagacuagaa

SEQ ID NO: 639603 - RNA, 19 nt, Homo sapiens
auuugcauaacaauuccuc

SEQ ID NO: 639604 - RNA, 14 nt, Homo sapiens
auuugcauggauuu

SEQ ID NO: 639605 - RNA, 23 nt, Homo sapiens
auuugcauuugcucuuucaucuc

SEQ ID NO: 639606 - RNA, 14 nt, Homo sapiens
auuugccauucaag

SEQ ID NO: 639607 - RNA, 16 nt, Homo sapiens
auuugcccaauuccag

SEQ ID NO: 639608 - RNA, 19 nt, Homo sapiens
auuugcccuuaaggacaaa

SEQ ID NO: 639609 - RNA, 12 nt, Homo sapiens
auuugccuguuu

SEQ ID NO: 639610 - RNA, 19 nt, Homo sapiens
auuugcuaacaggaccagg

SEQ ID NO: 639611 - RNA, 16 nt, Homo sapiens
auuugcuguucaccca

SEQ ID NO: 639612 - RNA, 23 nt, Homo sapiens
auuuggaagccacucaccacugu

SEQ ID NO: 639613 - RNA, 14 nt, Homo sapiens
auuuggaggcaauc

SEQ ID NO: 639614 - RNA, 21 nt, Homo sapiens
auuuggaggcaauccuaccuu

SEQ ID NO: 639615 - RNA, 16 nt, Homo sapiens
auuuggcaaugccauc

SEQ ID NO: 639616 - RNA, 17 nt, Homo sapiens
auuugggagacauguga

SEQ ID NO: 639617 - RNA, 18 nt, Homo sapiens
auuugggagacaugugac

SEQ ID NO: 639618 - RNA, 21 nt, Homo sapiens
auuugggauggaagcaggaca

SEQ ID NO: 639619 - RNA, 23 nt, Homo sapiens
auuuggggaccaaaggucaggga

SEQ ID NO: 639620 - RNA, 21 nt, Homo sapiens
auuugggguugggacagggag

SEQ ID NO: 639621 - RNA, 15 nt, Homo sapiens
auuugggugaacaaa

SEQ ID NO: 639622 - RNA, 13 nt, Homo sapiens
auuuggucugcca

SEQ ID NO: 639623 - RNA, 17 nt, Homo sapiens
auuugguggaugugaug

SEQ ID NO: 639624 - RNA, 17 nt, Homo sapiens
auuuggugguacuuuau

SEQ ID NO: 639625 - RNA, 22 nt, Homo sapiens
auuugguguagguaggucuguu

SEQ ID NO: 639626 - RNA, 16 nt, Homo sapiens
auuuguaaaucugcca

SEQ ID NO: 639627 - RNA, 17 nt, Homo sapiens
auuuguaaaucugccac

SEQ ID NO: 639628 - RNA, 20 nt, Homo sapiens
auuuguaacacagucauucu

SEQ ID NO: 639629 - RNA, 19 nt, Homo sapiens
auuuguaauagccaaaaag

SEQ ID NO: 639630 - RNA, 20 nt, Homo sapiens
auuuguaauuaaaagcaaau

SEQ ID NO: 639631 - RNA, 17 nt, Homo sapiens
auuuguaauugaacuua

SEQ ID NO: 639632 - RNA, 21 nt, Homo sapiens
auuuguaccucuaaguacaua

SEQ ID NO: 639633 - RNA, 15 nt, Homo sapiens
auuuguagcaauuua

SEQ ID NO: 639634 - RNA, 22 nt, Homo sapiens
auuuguagguaauguuccugaa

SEQ ID NO: 639635 - RNA, 19 nt, Homo sapiens
auuuguaguugcauauuua

SEQ ID NO: 639636 - RNA, 15 nt, Homo sapiens
auuuguauaucucaa

SEQ ID NO: 639637 - RNA, 20 nt, Homo sapiens
auuuguccugcagugcucau

SEQ ID NO: 639638 - RNA, 20 nt, Homo sapiens
auuugucuguaaaaaaugga

SEQ ID NO: 639639 - RNA, 15 nt, Homo sapiens
auuugugaauuugca

SEQ ID NO: 639640 - RNA, 15 nt, Homo sapiens
auuugugccacuuua

SEQ ID NO: 639641 - RNA, 21 nt, Homo sapiens
auuuguggucacagccaugaa

SEQ ID NO: 639642 - RNA, 16 nt, Homo sapiens
auuuguguacuugugu

SEQ ID NO: 639643 - RNA, 18 nt, Homo sapiens
auuugugugugugauaua

SEQ ID NO: 639644 - RNA, 23 nt, Homo sapiens
auuugugugugugauauaugcau

SEQ ID NO: 639645 - RNA, 17 nt, Homo sapiens
auuugugugugugcaag

SEQ ID NO: 639646 - RNA, 17 nt, Homo sapiens
auuuguuauacuucaaa

SEQ ID NO: 639647 - RNA, 12 nt, Homo sapiens
auuuguucucac

SEQ ID NO: 639648 - RNA, 18 nt, Homo sapiens
auuuguuuaaacaaucuu

SEQ ID NO: 639649 - RNA, 15 nt, Homo sapiens
auuuguuucuucucu

SEQ ID NO: 639650 - RNA, 22 nt, Homo sapiens
ccuguucauuguaagcacuuuu

SEQ ID NO: 639651 - RNA, 20 nt, Homo sapiens
ccuguuccuggaggucagca

SEQ ID NO: 639652 - RNA, 18 nt, Homo sapiens
ccuguucucucugugcuc

SEQ ID NO: 639653 - RNA, 22 nt, Homo sapiens
ccuguuugacgacagugcauuu

SEQ ID NO: 639654 - RNA, 11 nt, Homo sapiens
ccuguuugcau

SEQ ID NO: 639655 - RNA, 13 nt, Homo sapiens
ccuguuuguacug

SEQ ID NO: 639656 - RNA, 22 nt, Homo sapiens
ccuguuuuaauucaacccagcc

SEQ ID NO: 639657 - RNA, 21 nt, Homo sapiens
ccuguuuuauaaugaacccau

SEQ ID NO: 639658 - RNA, 22 nt, Homo sapiens
ccuuaaaauaaugaauacauuu

SEQ ID NO: 639659 - RNA, 23 nt, Homo sapiens
ccuuaaaguauaaauaaacacac

SEQ ID NO: 639660 - RNA, 19 nt, Homo sapiens
ccuuaaauguuuugccagc

SEQ ID NO: 639661 - RNA, 12 nt, Homo sapiens
ccuuaaauuugu

SEQ ID NO: 639662 - RNA, 20 nt, Homo sapiens
ccuuaaauuuuuagccauuu

SEQ ID NO: 639663 - RNA, 15 nt, Homo sapiens
ccuuaagccaguucc

SEQ ID NO: 639664 - RNA, 21 nt, Homo sapiens
ccuuaagggacaacauccuua

SEQ ID NO: 639665 - RNA, 17 nt, Homo sapiens
ccuuaagucaaaagaga

SEQ ID NO: 639666 - RNA, 20 nt, Homo sapiens
ccuuaauaacauacaaugac

SEQ ID NO: 639667 - RNA, 19 nt, Homo sapiens
ccuuaauagccauaugcaa

SEQ ID NO: 639668 - RNA, 17 nt, Homo sapiens
ccuuaaugguguucucu

SEQ ID NO: 639669 - RNA, 19 nt, Homo sapiens
ccuuaauucacucccacac

SEQ ID NO: 639670 - RNA, 21 nt, Homo sapiens
ccuuacacaaaugucuuacuc

SEQ ID NO: 639671 - RNA, 12 nt, Homo sapiens
ccuuacacugaa

SEQ ID NO: 639672 - RNA, 14 nt, Homo sapiens
ccuuagacacuuug

SEQ ID NO: 639673 - RNA, 14 nt, Homo sapiens
ccuuagagguccuc

SEQ ID NO: 639674 - RNA, 23 nt, Homo sapiens
ccuuagaugccucgcucuuuuca

SEQ ID NO: 639675 - RNA, 22 nt, Homo sapiens
ccuuagauuagcucuggaccag

SEQ ID NO: 639676 - RNA, 15 nt, Homo sapiens
ccuuagcuggcauua

SEQ ID NO: 639677 - RNA, 18 nt, Homo sapiens
ccuuagcuuagaccucag

SEQ ID NO: 639678 - RNA, 23 nt, Homo sapiens
ccuuaggcuuuguaugacaguga

SEQ ID NO: 639679 - RNA, 21 nt, Homo sapiens
ccuuaucagcuucauacuuca

SEQ ID NO: 639680 - RNA, 16 nt, Homo sapiens
ccuuaugaccagugag

SEQ ID NO: 639681 - RNA, 12 nt, Homo sapiens
ccuuaugacucc

SEQ ID NO: 639682 - RNA, 16 nt, Homo sapiens
ccuuauucuacauuuc

SEQ ID NO: 639683 - RNA, 16 nt, Homo sapiens
ccuuauugaacauucu

SEQ ID NO: 639684 - RNA, 16 nt, Homo sapiens
ccuuauuguaccucuc

SEQ ID NO: 639685 - RNA, 19 nt, Homo sapiens
auuuucaagaaacugagga

SEQ ID NO: 639686 - RNA, 14 nt, Homo sapiens
auuuucaaggccuu

SEQ ID NO: 639687 - RNA, 14 nt, Homo sapiens
auuuucaaguaauu

SEQ ID NO: 639688 - RNA, 14 nt, Homo sapiens
auuuucacuucugu

SEQ ID NO: 639689 - RNA, 19 nt, Homo sapiens
auuuucagaccaugaauga

SEQ ID NO: 639690 - RNA, 14 nt, Homo sapiens
auuuucagcauuaa

SEQ ID NO: 639691 - RNA, 14 nt, Homo sapiens
auuuucagcucaau

SEQ ID NO: 639692 - RNA, 23 nt, Homo sapiens
auuuucaucccguaucacagugu

SEQ ID NO: 639693 - RNA, 12 nt, Homo sapiens
auuuucauuccu

SEQ ID NO: 639694 - RNA, 20 nt, Homo sapiens
auuuucccccuuuucugcau

SEQ ID NO: 639695 - RNA, 18 nt, Homo sapiens
auuuuccccuagcuuucc

SEQ ID NO: 639696 - RNA, 17 nt, Homo sapiens
auuuuccuccaggcaaa

SEQ ID NO: 639697 - RNA, 18 nt, Homo sapiens
auuuuccuguucagugag

SEQ ID NO: 639698 - RNA, 15 nt, Homo sapiens
auuuuccuguuguca

SEQ ID NO: 639699 - RNA, 17 nt, Homo sapiens
auuuuccuguuuacuga

SEQ ID NO: 639700 - RNA, 13 nt, Homo sapiens
auuuucuaagaca

SEQ ID NO: 639701 - RNA, 22 nt, Homo sapiens
auuuucuaauguugacuuuaau

SEQ ID NO: 639702 - RNA, 15 nt, Homo sapiens
auuuucuagacuuuc

SEQ ID NO: 639703 - RNA, 16 nt, Homo sapiens
auuuucuagauacaau

SEQ ID NO: 639704 - RNA, 22 nt, Homo sapiens
auuuucucccucuuucuuccca

SEQ ID NO: 639705 - RNA, 22 nt, Homo sapiens
auuuucucuauacauagagcuc

SEQ ID NO: 639706 - RNA, 15 nt, Homo sapiens
auuuucuggaaugga

SEQ ID NO: 639707 - RNA, 17 nt, Homo sapiens
auuuucuuuacagguau

SEQ ID NO: 639708 - RNA, 23 nt, Homo sapiens
auuuucuuucuuuuucuggaaau

SEQ ID NO: 639709 - RNA, 16 nt, Homo sapiens
auuuugaaaaaugaga

SEQ ID NO: 639710 - RNA, 23 nt, Homo sapiens
auuuugaaaugaaacaagcuuac

SEQ ID NO: 639711 - RNA, 17 nt, Homo sapiens
auuuugaauagcaauua

SEQ ID NO: 639712 - RNA, 23 nt, Homo sapiens
auuuugacaaagugccucaugca

SEQ ID NO: 639713 - RNA, 13 nt, Homo sapiens
auuuugacacugg

SEQ ID NO: 639714 - RNA, 16 nt, Homo sapiens
auuuugcaaagauuua

SEQ ID NO: 639715 - RNA, 17 nt, Homo sapiens
auuuugcacugaggaua

SEQ ID NO: 639716 - RNA, 15 nt, Homo sapiens
auuuugcagcaguga

SEQ ID NO: 639717 - RNA, 19 nt, Homo sapiens
auuuugcuaaaugugaaug

SEQ ID NO: 639718 - RNA, 14 nt, Homo sapiens
auuuugcugagaug

SEQ ID NO: 639719 - RNA, 19 nt, Homo sapiens
auuuugcuugucauauucg

SEQ ID NO: 639720 - RNA, 15 nt, Homo sapiens
auuuuggccaaagug

SEQ ID NO: 639721 - RNA, 21 nt, Homo sapiens
auuuugggagugacucaagaa

SEQ ID NO: 639722 - RNA, 14 nt, Homo sapiens
auuuuggggaggag

SEQ ID NO: 639723 - RNA, 21 nt, Homo sapiens
auuuugggguuguguugucac

SEQ ID NO: 639724 - RNA, 17 nt, Homo sapiens
auuuugguuuguguauc

SEQ ID NO: 639725 - RNA, 19 nt, Homo sapiens
auuuuguaaaauauuaugu

SEQ ID NO: 639726 - RNA, 18 nt, Homo sapiens
auuuuguaaauaugcaaa

SEQ ID NO: 639727 - RNA, 19 nt, Homo sapiens
auuuuguaaauaugcaaau

SEQ ID NO: 639728 - RNA, 17 nt, Homo sapiens
auuuuguaagaaguuuc

SEQ ID NO: 639729 - RNA, 21 nt, Homo sapiens
auuuuguaauaauaaagaaua

SEQ ID NO: 639730 - RNA, 15 nt, Homo sapiens
auuuuguaccagugg

SEQ ID NO: 639731 - RNA, 24 nt, Homo sapiens
auuuuguaugaaaaaucaauguca

SEQ ID NO: 639732 - RNA, 21 nt, Homo sapiens
auuuugucuguacucauguca

SEQ ID NO: 639733 - RNA, 16 nt, Homo sapiens
auuuugugaauuguga

SEQ ID NO: 639734 - RNA, 17 nt, Homo sapiens
auuuugugaugaugcug

SEQ ID NO: 639735 - RNA, 13 nt, Homo sapiens
auuuugugcaaaa

SEQ ID NO: 639736 - RNA, 18 nt, Homo sapiens
auuuuguucuaguuuuca

SEQ ID NO: 639737 - RNA, 15 nt, Homo sapiens
auuuuguucugcaaa

SEQ ID NO: 639738 - RNA, 13 nt, Homo sapiens
auuuuguuucaaa

SEQ ID NO: 639739 - RNA, 19 nt, Homo sapiens
auuuuuaaaauauuacaca

SEQ ID NO: 639740 - RNA, 18 nt, Homo sapiens
auuuuuaacaggaauuua

SEQ ID NO: 639741 - RNA, 15 nt, Homo sapiens
auuuuuaagaacuuc

SEQ ID NO: 639742 - RNA, 17 nt, Homo sapiens
auuuuuaagcugcaaau

SEQ ID NO: 639743 - RNA, 20 nt, Homo sapiens
auuuuuaaguuuuucacuuu

SEQ ID NO: 639744 - RNA, 19 nt, Homo sapiens
auuuuuaccuaaagacguc

SEQ ID NO: 639745 - RNA, 22 nt, Homo sapiens
auuuuuagaauaagaauuugca

SEQ ID NO: 639746 - RNA, 15 nt, Homo sapiens
auuuuuagaauuaaa

SEQ ID NO: 639747 - RNA, 13 nt, Homo sapiens
auuuuuagccuaa

SEQ ID NO: 639748 - RNA, 22 nt, Homo sapiens
auuuuuauaaauuacuaucugu

SEQ ID NO: 639749 - RNA, 16 nt, Homo sapiens
auuuuuaugugcaaua

SEQ ID NO: 639750 - RNA, 16 nt, Homo sapiens
auuuuuaugugcagcg

SEQ ID NO: 639751 - RNA, 14 nt, Homo sapiens
auuuuuauuacaac

SEQ ID NO: 639752 - RNA, 12 nt, Homo sapiens
auuuuucacugu

SEQ ID NO: 639753 - RNA, 17 nt, Homo sapiens
auuuuucagcuccuuca

SEQ ID NO: 639754 - RNA, 17 nt, Homo sapiens
auuuuucaugcuaucaa

SEQ ID NO: 639755 - RNA, 17 nt, Homo sapiens
auuuuuccaggacucuu

SEQ ID NO: 639756 - RNA, 17 nt, Homo sapiens
auuuuuccugcauguuc

SEQ ID NO: 639757 - RNA, 14 nt, Homo sapiens
auuuuucuaaagaa

SEQ ID NO: 639758 - RNA, 16 nt, Homo sapiens
auuuuucuaucaaaua

SEQ ID NO: 639759 - RNA, 19 nt, Homo sapiens
auuuuucuuaagacagagu

SEQ ID NO: 639760 - RNA, 20 nt, Homo sapiens
auuuuucuuagugugccaag

SEQ ID NO: 639761 - RNA, 21 nt, Homo sapiens
auuuuugaaaauccugaauaa

SEQ ID NO: 639762 - RNA, 15 nt, Homo sapiens
auuuuugauacaguu

SEQ ID NO: 639763 - RNA, 13 nt, Homo sapiens
auuuuuguggaag

SEQ ID NO: 639764 - RNA, 18 nt, Homo sapiens
auuuuuguggaagcacuu

SEQ ID NO: 639765 - RNA, 15 nt, Homo sapiens
auuuuuguuuaugua

SEQ ID NO: 639766 - RNA, 21 nt, Homo sapiens
auuuuuguuuuuguaaugcac

SEQ ID NO: 639767 - RNA, 23 nt, Homo sapiens
auuuuuuaaaacaagccaagaaa

SEQ ID NO: 639768 - RNA, 17 nt, Homo sapiens
auuuuuuaaggaaacaa

SEQ ID NO: 639769 - RNA, 18 nt, Homo sapiens
auuuuuuaauccuaccuc

SEQ ID NO: 639770 - RNA, 20 nt, Homo sapiens
auuuuuuaguauaaguacau

SEQ ID NO: 639771 - RNA, 13 nt, Homo sapiens
auuuuuuccuuaa

SEQ ID NO: 639772 - RNA, 13 nt, Homo sapiens
auuuuuugacuuu

SEQ ID NO: 639773 - RNA, 20 nt, Homo sapiens
ccuuggcugcucacugucca

SEQ ID NO: 639774 - RNA, 16 nt, Homo sapiens
ccuuggcuucugugau

SEQ ID NO: 639775 - RNA, 14 nt, Homo sapiens
ccuugggaagaugu

SEQ ID NO: 639776 - RNA, 23 nt, Homo sapiens
ccuugggccuuucagucccaaag

SEQ ID NO: 639777 - RNA, 12 nt, Homo sapiens
ccuuggggccug

SEQ ID NO: 639778 - RNA, 17 nt, Homo sapiens
ccuugguaucauuuucu

SEQ ID NO: 639779 - RNA, 14 nt, Homo sapiens
ccuuggugugaccc

SEQ ID NO: 639780 - RNA, 19 nt, Homo sapiens
ccuugguucccccacugau

SEQ ID NO: 639781 - RNA, 15 nt, Homo sapiens
ccuugguucuggcca

SEQ ID NO: 639782 - RNA, 16 nt, Homo sapiens
ccuugguucuggccac

SEQ ID NO: 639783 - RNA, 15 nt, Homo sapiens
ccuuguaaagacaga

SEQ ID NO: 639784 - RNA, 16 nt, Homo sapiens
ccuuguaaagacugua

SEQ ID NO: 639785 - RNA, 21 nt, Homo sapiens
ccuuguaauaccugauugauc

SEQ ID NO: 639786 - RNA, 21 nt, Homo sapiens
ccuuguaccucaaucuauucu

SEQ ID NO: 639787 - RNA, 22 nt, Homo sapiens
ccuugucaauacugagccauuu

SEQ ID NO: 639788 - RNA, 16 nt, Homo sapiens
ccuuguccucagccag

SEQ ID NO: 639789 - RNA, 17 nt, Homo sapiens
ccuuguccucagggcua

SEQ ID NO: 639790 - RNA, 17 nt, Homo sapiens
ccuuguccugccagcug

SEQ ID NO: 639791 - RNA, 24 nt, Homo sapiens
ccuuguccuugaaaguaggauaua

SEQ ID NO: 639792 - RNA, 15 nt, Homo sapiens
ccuugucugcacugu

SEQ ID NO: 639793 - RNA, 19 nt, Homo sapiens
ccuugugagagcccauucc

SEQ ID NO: 639794 - RNA, 17 nt, Homo sapiens
ccuuguggcuugggaca

SEQ ID NO: 639795 - RNA, 15 nt, Homo sapiens
ccuuguuaaaucauu

SEQ ID NO: 639796 - RNA, 17 nt, Homo sapiens
ccuuguuccaauuugac

SEQ ID NO: 639797 - RNA, 19 nt, Homo sapiens
ccuuguuccaauuugacaa

SEQ ID NO: 639798 - RNA, 22 nt, Homo sapiens
ccuuguucuauuuuucaaucau

SEQ ID NO: 639799 - RNA, 19 nt, Homo sapiens
ccuuguucucaguggugca

SEQ ID NO: 639800 - RNA, 13 nt, Homo sapiens
ccuuuaaaaccag

SEQ ID NO: 639801 - RNA, 18 nt, Homo sapiens
ccuuuaaauauuucacau

SEQ ID NO: 639802 - RNA, 23 nt, Homo sapiens
ccuuuaaaucugugaugauccuc

SEQ ID NO: 639803 - RNA, 19 nt, Homo sapiens
ccuuuaacugacaagccau

SEQ ID NO: 639804 - RNA, 18 nt, Homo sapiens
ccuuuaagccugcauucu

SEQ ID NO: 639805 - RNA, 21 nt, Homo sapiens
ccuuuaagccugcauucuuaa

SEQ ID NO: 639806 - RNA, 21 nt, Homo sapiens
ccuuuaauuugcuacugucau

SEQ ID NO: 639807 - RNA, 16 nt, Homo sapiens
caccaccuucccagcu

SEQ ID NO: 639808 - RNA, 19 nt, Homo sapiens
caccacggcguuguaccug

SEQ ID NO: 639809 - RNA, 21 nt, Homo sapiens
caccacucaggccacaguggg

SEQ ID NO: 639810 - RNA, 11 nt, Homo sapiens
caccacuccac

SEQ ID NO: 639811 - RNA, 14 nt, Homo sapiens
caccacugauauca

SEQ ID NO: 639812 - RNA, 14 nt, Homo sapiens
caccagaauguaua

SEQ ID NO: 639813 - RNA, 20 nt, Homo sapiens
caccagagauaauaugagaa

SEQ ID NO: 639814 - RNA, 20 nt, Homo sapiens
caccagagcauuuccaacac

SEQ ID NO: 639815 - RNA, 23 nt, Homo sapiens
caccagagggauaaaaacaauac

SEQ ID NO: 639816 - RNA, 22 nt, Homo sapiens
caccagauguccacaacaauau

SEQ ID NO: 639817 - RNA, 11 nt, Homo sapiens
caccagcauuu

SEQ ID NO: 639818 - RNA, 20 nt, Homo sapiens
caccagcccagcucccgugu

SEQ ID NO: 639819 - RNA, 21 nt, Homo sapiens
caccagccccacuucuggguc

SEQ ID NO: 639820 - RNA, 15 nt, Homo sapiens
caccagcccuagcug

SEQ ID NO: 639821 - RNA, 21 nt, Homo sapiens
caccagcguuggguuugcuca

SEQ ID NO: 639822 - RNA, 16 nt, Homo sapiens
caccagcuaucuguca

SEQ ID NO: 639823 - RNA, 20 nt, Homo sapiens
caccagcugcugugccccac

SEQ ID NO: 639824 - RNA, 22 nt, Homo sapiens
caccaggaauccccaacaugca

SEQ ID NO: 639825 - RNA, 16 nt, Homo sapiens
caccaggcacugccug

SEQ ID NO: 639826 - RNA, 14 nt, Homo sapiens
caccagggacugca

SEQ ID NO: 639827 - RNA, 20 nt, Homo sapiens
caccagggaguggccauuug

SEQ ID NO: 639828 - RNA, 15 nt, Homo sapiens
caccaggugccuuuc

SEQ ID NO: 639829 - RNA, 20 nt, Homo sapiens
caccagucaccucgucuccc

SEQ ID NO: 639830 - RNA, 15 nt, Homo sapiens
caccagucacugucc

SEQ ID NO: 639831 - RNA, 16 nt, Homo sapiens
caccaguggccuuuca

SEQ ID NO: 639832 - RNA, 18 nt, Homo sapiens
caccagugguacuaagca

SEQ ID NO: 639833 - RNA, 17 nt, Homo sapiens
caccaguguuccugaag

SEQ ID NO: 639834 - RNA, 18 nt, Homo sapiens
caccaucaccagacaggu

SEQ ID NO: 639835 - RNA, 14 nt, Homo sapiens
caccaucugauuaa

SEQ ID NO: 639836 - RNA, 18 nt, Homo sapiens
caccaucuucuauucaaa

SEQ ID NO: 639837 - RNA, 22 nt, Homo sapiens
caccaucuuuugugagauguaa

SEQ ID NO: 639838 - RNA, 15 nt, Homo sapiens
caccaugaaacuuua

SEQ ID NO: 639839 - RNA, 13 nt, Homo sapiens
caccaugaucacu

SEQ ID NO: 639840 - RNA, 16 nt, Homo sapiens
caccaugcuugccuga

SEQ ID NO: 639841 - RNA, 18 nt, Homo sapiens
caccaugcuugccugaag

SEQ ID NO: 639842 - RNA, 13 nt, Homo sapiens
caccauggugacu

SEQ ID NO: 639843 - RNA, 17 nt, Homo sapiens
caccauucgucaucacu

SEQ ID NO: 639844 - RNA, 21 nt, Homo sapiens
cacccaaaaauaucuccucca

SEQ ID NO: 639845 - RNA, 22 nt, Homo sapiens
cacccaaaagaauuaucauccc

SEQ ID NO: 639846 - RNA, 23 nt, Homo sapiens
cacccaaaagucaaaaggugccu

SEQ ID NO: 639847 - RNA, 21 nt, Homo sapiens
cacccaaagccugucccagga

SEQ ID NO: 639848 - RNA, 22 nt, Homo sapiens
cacccaaauguaaaaauccuuu

SEQ ID NO: 639849 - RNA, 15 nt, Homo sapiens
cacccaacaagccau

SEQ ID NO: 639850 - RNA, 21 nt, Homo sapiens
cacccaaguugaagacuuugu

SEQ ID NO: 639851 - RNA, 15 nt, Homo sapiens
cacccacaaucacaa

SEQ ID NO: 639852 - RNA, 12 nt, Homo sapiens
cacccaccagag

SEQ ID NO: 639853 - RNA, 22 nt, Homo sapiens
cacccaccagcuccacacauuc

SEQ ID NO: 639854 - RNA, 19 nt, Homo sapiens
cacccaccauauuguuuga

SEQ ID NO: 639855 - RNA, 14 nt, Homo sapiens
cacccagaacagug

SEQ ID NO: 639856 - RNA, 13 nt, Homo sapiens
cacccagcaaaga

SEQ ID NO: 639857 - RNA, 12 nt, Homo sapiens
cacccagcaaua

SEQ ID NO: 639858 - RNA, 22 nt, Homo sapiens
cacccaggcccgcaccgcuggg

SEQ ID NO: 639859 - RNA, 15 nt, Homo sapiens
cacccaggcugcacu

SEQ ID NO: 639860 - RNA, 19 nt, Homo sapiens
cacccaggucccccgacug

SEQ ID NO: 639861 - RNA, 21 nt, Homo sapiens
cacccaguuggugacugggaa

SEQ ID NO: 639862 - RNA, 15 nt, Homo sapiens
cacccaugaaucaaa

SEQ ID NO: 639863 - RNA, 17 nt, Homo sapiens
cacccaugaaucaaaga

SEQ ID NO: 639864 - RNA, 15 nt, Homo sapiens
cacccaugccagaga

SEQ ID NO: 639865 - RNA, 16 nt, Homo sapiens
cacccaugccagagag

SEQ ID NO: 639866 - RNA, 15 nt, Homo sapiens
caccccaacucuccc

SEQ ID NO: 639867 - RNA, 21 nt, Homo sapiens
caccccagaaaucacugugaa

SEQ ID NO: 639868 - RNA, 22 nt, Homo sapiens
caccccagaaaucacugugaaa

SEQ ID NO: 639869 - RNA, 21 nt, Homo sapiens
cacccccaacaggaauucuau

SEQ ID NO: 639870 - RNA, 15 nt, Homo sapiens
cacccccagucucca

SEQ ID NO: 639871 - RNA, 18 nt, Homo sapiens
cacccccagucuccaggg

SEQ ID NO: 639872 - RNA, 14 nt, Homo sapiens
cacccccagugcag

SEQ ID NO: 639873 - RNA, 15 nt, Homo sapiens
caccccuaaagagau

SEQ ID NO: 639874 - RNA, 17 nt, Homo sapiens
caccccuacacugugaa

SEQ ID NO: 639875 - RNA, 16 nt, Homo sapiens
caccccucacucuggc

SEQ ID NO: 639876 - RNA, 16 nt, Homo sapiens
caccccugcacaguug

SEQ ID NO: 639877 - RNA, 21 nt, Homo sapiens
caccccuuuccuccccauaca

SEQ ID NO: 639878 - RNA, 16 nt, Homo sapiens
cacccgacuccucaaa

SEQ ID NO: 639879 - RNA, 17 nt, Homo sapiens
cacccgacuccucaaaa

SEQ ID NO: 639880 - RNA, 22 nt, Homo sapiens
cacccgcccgagggauggugcc

SEQ ID NO: 639881 - RNA, 16 nt, Homo sapiens
cacccucaaaugucag

SEQ ID NO: 639882 - RNA, 17 nt, Homo sapiens
cacccucaaaugucaga

SEQ ID NO: 639883 - RNA, 21 nt, Homo sapiens
cacccucaaaugucagagcua

SEQ ID NO: 639884 - RNA, 18 nt, Homo sapiens
cacccucuccuccagugu

SEQ ID NO: 639885 - RNA, 14 nt, Homo sapiens
cacccugaucuuca

SEQ ID NO: 639886 - RNA, 14 nt, Homo sapiens
cacccugggagcca

SEQ ID NO: 639887 - RNA, 23 nt, Homo sapiens
cacccuggggccuggaccugccu

SEQ ID NO: 639888 - RNA, 20 nt, Homo sapiens
cacccuguagguucuugaua

SEQ ID NO: 639889 - RNA, 12 nt, Homo sapiens
cacccuucuccc

SEQ ID NO: 639890 - RNA, 22 nt, Homo sapiens
cacccuugguuccuaacuggaa

SEQ ID NO: 639891 - RNA, 21 nt, Homo sapiens
cacccuuguccuugagugcuc

SEQ ID NO: 639892 - RNA, 19 nt, Homo sapiens
caccgaguggccauggcau

SEQ ID NO: 639893 - RNA, 23 nt, Homo sapiens
caccgcggaggaggcuggugaca

SEQ ID NO: 639894 - RNA, 21 nt, Homo sapiens
caccgcuccaaugccuacuga

SEQ ID NO: 639895 - RNA, 18 nt, Homo sapiens
caccgcugccagcacaga

SEQ ID NO: 639896 - RNA, 14 nt, Homo sapiens
caccguguccuccu

SEQ ID NO: 639897 - RNA, 17 nt, Homo sapiens
caccguucugugcacaa

SEQ ID NO: 639898 - RNA, 19 nt, Homo sapiens
caccuaauaauaguaauuc

SEQ ID NO: 639899 - RNA, 18 nt, Homo sapiens
caccuaauaggcugggag

SEQ ID NO: 639900 - RNA, 22 nt, Homo sapiens
caccuaauguuuaugagccaga

SEQ ID NO: 639901 - RNA, 14 nt, Homo sapiens
caccuacacaggag

SEQ ID NO: 639902 - RNA, 16 nt, Homo sapiens
caccuagaacacuaac

SEQ ID NO: 639903 - RNA, 12 nt, Homo sapiens
caccuagcuuua

SEQ ID NO: 639904 - RNA, 14 nt, Homo sapiens
caccuaguucuccc

SEQ ID NO: 639905 - RNA, 22 nt, Homo sapiens
caccuauauagaugcagcauuu

SEQ ID NO: 639906 - RNA, 22 nt, Homo sapiens
caccuauuuaagagggaacuua

SEQ ID NO: 639907 - RNA, 12 nt, Homo sapiens
caccuauuucca

SEQ ID NO: 639908 - RNA, 16 nt, Homo sapiens
caccucagaguggagu

SEQ ID NO: 639909 - RNA, 16 nt, Homo sapiens
caccucagcugauauu

SEQ ID NO: 639910 - RNA, 20 nt, Homo sapiens
cuauuuuugacuguagccac

SEQ ID NO: 639911 - RNA, 20 nt, Homo sapiens
cuauuuuuuaaagacuguga

SEQ ID NO: 639912 - RNA, 19 nt, Homo sapiens
cuauuuuuuuuuguuguuu

SEQ ID NO: 639913 - RNA, 17 nt, Homo sapiens
cucaaaacacccaaaaa

SEQ ID NO: 639914 - RNA, 16 nt, Homo sapiens
cucaaaaggaaaccaa

SEQ ID NO: 639915 - RNA, 14 nt, Homo sapiens
cucaaaaggguuaa

SEQ ID NO: 639916 - RNA, 17 nt, Homo sapiens
cucaaaauaaaaagccu

SEQ ID NO: 639917 - RNA, 15 nt, Homo sapiens
cucaaaauaugucaa

SEQ ID NO: 639918 - RNA, 21 nt, Homo sapiens
cucaaaauaugucaacuuaaa

SEQ ID NO: 639919 - RNA, 19 nt, Homo sapiens
cucaaacucuuaaaaccca

SEQ ID NO: 639920 - RNA, 16 nt, Homo sapiens
cucaaacuugagaaaa

SEQ ID NO: 639921 - RNA, 15 nt, Homo sapiens
cucaaagaucugaau

SEQ ID NO: 639922 - RNA, 21 nt, Homo sapiens
cucaaagucuaacauauucaa

SEQ ID NO: 639923 - RNA, 18 nt, Homo sapiens
cucaaagugacuauucag

SEQ ID NO: 639924 - RNA, 14 nt, Homo sapiens
cucaaaguguacaa

SEQ ID NO: 639925 - RNA, 19 nt, Homo sapiens
cucaaaucaggguccagug

SEQ ID NO: 639926 - RNA, 16 nt, Homo sapiens
cucaaaugacccaaag

SEQ ID NO: 639927 - RNA, 15 nt, Homo sapiens
cucaacaucucagga

SEQ ID NO: 639928 - RNA, 23 nt, Homo sapiens
cucaacauuguguucccauuuca

SEQ ID NO: 639929 - RNA, 22 nt, Homo sapiens
caccucuuggggacccugccua

SEQ ID NO: 639930 - RNA, 16 nt, Homo sapiens
caccugaaagccuguc

SEQ ID NO: 639931 - RNA, 16 nt, Homo sapiens
caccugaacguucugu

SEQ ID NO: 639932 - RNA, 19 nt, Homo sapiens
caccugacaauggcagcua

SEQ ID NO: 639933 - RNA, 20 nt, Homo sapiens
caccugcagcccauggugag

SEQ ID NO: 639934 - RNA, 17 nt, Homo sapiens
caccugccaaaugaaua

SEQ ID NO: 639935 - RNA, 16 nt, Homo sapiens
caccugccauuugcac

SEQ ID NO: 639936 - RNA, 16 nt, Homo sapiens
caccugcccugcugag

SEQ ID NO: 639937 - RNA, 16 nt, Homo sapiens
caccugccgcaugcuc

SEQ ID NO: 639938 - RNA, 16 nt, Homo sapiens
caccugccgucuucac

SEQ ID NO: 639939 - RNA, 12 nt, Homo sapiens
caccugccuugg

SEQ ID NO: 639940 - RNA, 16 nt, Homo sapiens
caccugcucacaggga

SEQ ID NO: 639941 - RNA, 19 nt, Homo sapiens
caccugcuccaauuucccc

SEQ ID NO: 639942 - RNA, 23 nt, Homo sapiens
caccuggacacaacaccaaaaag

SEQ ID NO: 639943 - RNA, 22 nt, Homo sapiens
caccuggaugggggucccugug

SEQ ID NO: 639944 - RNA, 16 nt, Homo sapiens
caccuggcacauucau

SEQ ID NO: 639945 - RNA, 17 nt, Homo sapiens
caccuggcccuugcaau

SEQ ID NO: 639946 - RNA, 18 nt, Homo sapiens
caccugggccccacugga

SEQ ID NO: 639947 - RNA, 23 nt, Homo sapiens
caccugggccgggcuguagauca

SEQ ID NO: 639948 - RNA, 20 nt, Homo sapiens
caccugggcuccugcauccu

SEQ ID NO: 639949 - RNA, 20 nt, Homo sapiens
caccuguaaucccagcacuu

SEQ ID NO: 639950 - RNA, 18 nt, Homo sapiens
caccuguacucuuccgaa

SEQ ID NO: 639951 - RNA, 12 nt, Homo sapiens
caccuguagcug

SEQ ID NO: 639952 - RNA, 15 nt, Homo sapiens
caccuguagucccag

SEQ ID NO: 639953 - RNA, 20 nt, Homo sapiens
caccuguagucccagcuacu

SEQ ID NO: 639954 - RNA, 22 nt, Homo sapiens
caccuguccggcccagugccag

SEQ ID NO: 639955 - RNA, 13 nt, Homo sapiens
caccugugacaaa

SEQ ID NO: 639956 - RNA, 14 nt, Homo sapiens
caccugugcugcug

SEQ ID NO: 639957 - RNA, 18 nt, Homo sapiens
caccuguuaaaauguaca

SEQ ID NO: 639958 - RNA, 17 nt, Homo sapiens
caccuuaucuggaagau

SEQ ID NO: 639959 - RNA, 14 nt, Homo sapiens
caccuuccauguca

SEQ ID NO: 639960 - RNA, 20 nt, Homo sapiens
caccuugaucccaauccuua

SEQ ID NO: 639961 - RNA, 19 nt, Homo sapiens
caccuugccagggcagggu

SEQ ID NO: 639962 - RNA, 19 nt, Homo sapiens
caccuuggacccuggugac

SEQ ID NO: 639963 - RNA, 19 nt, Homo sapiens
caccuuggccuucugggaa

SEQ ID NO: 639964 - RNA, 16 nt, Homo sapiens
caccuuugcacaggau

SEQ ID NO: 639965 - RNA, 17 nt, Homo sapiens
caccuuugucgcugggu

SEQ ID NO: 639966 - RNA, 17 nt, Homo sapiens
caccuuuuauugacaca

SEQ ID NO: 639967 - RNA, 22 nt, Homo sapiens
caccuuuucagcgauguaugca

SEQ ID NO: 639968 - RNA, 16 nt, Homo sapiens
cacgaacccaccugcu

SEQ ID NO: 639969 - RNA, 13 nt, Homo sapiens
cacgaacuguuca

SEQ ID NO: 639970 - RNA, 19 nt, Homo sapiens
cacgaagcacgaucagucc

SEQ ID NO: 639971 - RNA, 15 nt, Homo sapiens
cacgacugccaugua

SEQ ID NO: 639972 - RNA, 15 nt, Homo sapiens
cacgagcuuaaucaa

SEQ ID NO: 639973 - RNA, 12 nt, Homo sapiens
cacgaggaaaag

SEQ ID NO: 639974 - RNA, 11 nt, Homo sapiens
cacgaggucag

SEQ ID NO: 639975 - RNA, 18 nt, Homo sapiens
cacgagugggaaggacuu

SEQ ID NO: 639976 - RNA, 16 nt, Homo sapiens
cacgaucguuaugcug

SEQ ID NO: 639977 - RNA, 12 nt, Homo sapiens
cacgaugcauuu

SEQ ID NO: 639978 - RNA, 19 nt, Homo sapiens
cacgauuugucuuaucccc

SEQ ID NO: 639979 - RNA, 19 nt, Homo sapiens
cacgcaccggaguucugcc

SEQ ID NO: 639980 - RNA, 12 nt, Homo sapiens
cacgcacgcaca

SEQ ID NO: 639981 - RNA, 14 nt, Homo sapiens
cacgcacuggguug

SEQ ID NO: 639982 - RNA, 21 nt, Homo sapiens
cacgcagccgccgccgcccac

SEQ ID NO: 639983 - RNA, 14 nt, Homo sapiens
cacgcccuccucag

SEQ ID NO: 639984 - RNA, 15 nt, Homo sapiens
cacgccuaaaacuca

SEQ ID NO: 639985 - RNA, 14 nt, Homo sapiens
cacgccugccaucu

SEQ ID NO: 639986 - RNA, 20 nt, Homo sapiens
cacgcugcaccuaaagccua

SEQ ID NO: 639987 - RNA, 18 nt, Homo sapiens
cacgcuuguuugccugaa

SEQ ID NO: 639988 - RNA, 19 nt, Homo sapiens
cacggaacuggagaaggag

SEQ ID NO: 639989 - RNA, 22 nt, Homo sapiens
cacggaguggcuugagcuucug

SEQ ID NO: 639990 - RNA, 16 nt, Homo sapiens
cacggauggugcaugg

SEQ ID NO: 639991 - RNA, 22 nt, Homo sapiens
cacggcuccuccuuaugacucc

SEQ ID NO: 639992 - RNA, 15 nt, Homo sapiens
cacgggacugacgca

SEQ ID NO: 639993 - RNA, 15 nt, Homo sapiens
cacggggaucacagc

SEQ ID NO: 639994 - RNA, 20 nt, Homo sapiens
cacggucuguucuugaagca

SEQ ID NO: 639995 - RNA, 17 nt, Homo sapiens
cacguggcagaccguga

SEQ ID NO: 639996 - RNA, 16 nt, Homo sapiens
cacgugucucagacug

SEQ ID NO: 639997 - RNA, 22 nt, Homo sapiens
cacguucugauuucugcccuug

SEQ ID NO: 639998 - RNA, 22 nt, Homo sapiens
cacguuggucuugaacuccuga

SEQ ID NO: 639999 - RNA, 21 nt, Homo sapiens
cacuaagaaaauagcaagagu

SEQ ID NO: 640000 - RNA, 13 nt, Homo sapiens
cacuaaucugaaa

SEQ ID NO: 640001 - RNA, 15 nt, Homo sapiens
cacuaauugcuuucu

SEQ ID NO: 640002 - RNA, 18 nt, Homo sapiens
cacuacaccuugccuugc

SEQ ID NO: 640003 - RNA, 11 nt, Homo sapiens
cacuacaggca

SEQ ID NO: 640004 - RNA, 19 nt, Homo sapiens
cacuacauuguacaaggaa

SEQ ID NO: 640005 - RNA, 16 nt, Homo sapiens
cacuaccguaaauguc

SEQ ID NO: 640006 - RNA, 21 nt, Homo sapiens
cacuacugggugucauuucau

SEQ ID NO: 640007 - RNA, 17 nt, Homo sapiens
cacuagaaaugcagcau

SEQ ID NO: 640008 - RNA, 13 nt, Homo sapiens
cacuagagaccaa

SEQ ID NO: 640009 - RNA, 12 nt, Homo sapiens
cacuagcauuuu

SEQ ID NO: 640010 - RNA, 18 nt, Homo sapiens
cacuagccagacacucug

SEQ ID NO: 640011 - RNA, 15 nt, Homo sapiens
cacuagccugugauu

SEQ ID NO: 640012 - RNA, 19 nt, Homo sapiens
cacuaggaauucuuugcau

SEQ ID NO: 640013 - RNA, 18 nt, Homo sapiens
cacuaggguccaccagga

SEQ ID NO: 640014 - RNA, 15 nt, Homo sapiens
cacuauaugaucagu

SEQ ID NO: 640015 - RNA, 18 nt, Homo sapiens
cacuaucugggugcauga

SEQ ID NO: 640016 - RNA, 14 nt, Homo sapiens
cacuauguauauac

SEQ ID NO: 640017 - RNA, 17 nt, Homo sapiens
cacuauguauauacaua

SEQ ID NO: 640018 - RNA, 14 nt, Homo sapiens
cacuauguuacaug

SEQ ID NO: 640019 - RNA, 20 nt, Homo sapiens
cacuauucuuaagcacuuug

SEQ ID NO: 640020 - RNA, 16 nt, Homo sapiens
cacuauucuugaauua

SEQ ID NO: 640021 - RNA, 16 nt, Homo sapiens
cacuauuuucaaagaa

SEQ ID NO: 640022 - RNA, 16 nt, Homo sapiens
cacucaaaccuggagc

SEQ ID NO: 640023 - RNA, 21 nt, Homo sapiens
cacucacacggacacucaaaa

SEQ ID NO: 640024 - RNA, 15 nt, Homo sapiens
cacucaccccagcga

SEQ ID NO: 640025 - RNA, 21 nt, Homo sapiens
cacucagccucauucagcaug

SEQ ID NO: 640026 - RNA, 13 nt, Homo sapiens
cacucagcucuug

SEQ ID NO: 640027 - RNA, 17 nt, Homo sapiens
cacucaggauugggaau

SEQ ID NO: 640028 - RNA, 17 nt, Homo sapiens
cacucagggagcauuua

SEQ ID NO: 640029 - RNA, 18 nt, Homo sapiens
cacucauccccucacuug

SEQ ID NO: 640030 - RNA, 16 nt, Homo sapiens
cacucaugcacacaga

SEQ ID NO: 640031 - RNA, 12 nt, Homo sapiens
cacucauuccuu

SEQ ID NO: 640032 - RNA, 17 nt, Homo sapiens
cacucauuccuucacuc

SEQ ID NO: 640033 - RNA, 13 nt, Homo sapiens
cacucauuuggau

SEQ ID NO: 640034 - RNA, 15 nt, Homo sapiens
cacuccagcucugag

SEQ ID NO: 640035 - RNA, 18 nt, Homo sapiens
cucagcaguugacaucca

SEQ ID NO: 640036 - RNA, 21 nt, Homo sapiens
cucagccacuugccugugcua

SEQ ID NO: 640037 - RNA, 23 nt, Homo sapiens
cucagcccaggccucgggaccaa

SEQ ID NO: 640038 - RNA, 15 nt, Homo sapiens
cucagccucauccuc

SEQ ID NO: 640039 - RNA, 17 nt, Homo sapiens
cucagccuccaaagugg

SEQ ID NO: 640040 - RNA, 19 nt, Homo sapiens
cucagccuggagaggccug

SEQ ID NO: 640041 - RNA, 16 nt, Homo sapiens
cucagccuggggcucu

SEQ ID NO: 640042 - RNA, 15 nt, Homo sapiens
cucagccuugcacac

SEQ ID NO: 640043 - RNA, 21 nt, Homo sapiens
cucagccuugcacacccacug

SEQ ID NO: 640044 - RNA, 20 nt, Homo sapiens
cucagcgccagcucuaccag

SEQ ID NO: 640045 - RNA, 16 nt, Homo sapiens
cucagcuaacauucca

SEQ ID NO: 640046 - RNA, 23 nt, Homo sapiens
cucagcuaacauuccauguuuca

SEQ ID NO: 640047 - RNA, 15 nt, Homo sapiens
cucagcuacugccaa

SEQ ID NO: 640048 - RNA, 19 nt, Homo sapiens
cucagcucuuggcuccacu

SEQ ID NO: 640049 - RNA, 16 nt, Homo sapiens
cucagcugcacauucc

SEQ ID NO: 640050 - RNA, 15 nt, Homo sapiens
cucagcuguccugca

SEQ ID NO: 640051 - RNA, 17 nt, Homo sapiens
cuccagcgguccaaagu

SEQ ID NO: 640052 - RNA, 16 nt, Homo sapiens
cuccaggaucuauuga

SEQ ID NO: 640053 - RNA, 18 nt, Homo sapiens
cuccaggcuuucaauguu

SEQ ID NO: 640054 - RNA, 19 nt, Homo sapiens
cuccaggcuuucuggaguu

SEQ ID NO: 640055 - RNA, 23 nt, Homo sapiens
cuccagggaauccaagccuccac

SEQ ID NO: 640056 - RNA, 22 nt, Homo sapiens
cuccagggaugauucaagccau

SEQ ID NO: 640057 - RNA, 23 nt, Homo sapiens
cuccagggaugauucaagccauu

SEQ ID NO: 640058 - RNA, 22 nt, Homo sapiens
cuccagggccugaucuuuacca

SEQ ID NO: 640059 - RNA, 23 nt, Homo sapiens
cuccaggugugcacguggcaugu

SEQ ID NO: 640060 - RNA, 19 nt, Homo sapiens
cuccaguaccuugcuucuu

SEQ ID NO: 640061 - RNA, 17 nt, Homo sapiens
cuccaguauucuuguca

SEQ ID NO: 640062 - RNA, 19 nt, Homo sapiens
cuccagucuggcaacagag

SEQ ID NO: 640063 - RNA, 12 nt, Homo sapiens
cuccagugccag

SEQ ID NO: 640064 - RNA, 19 nt, Homo sapiens
cuccaguggcagacaaaca

SEQ ID NO: 640065 - RNA, 21 nt, Homo sapiens
cuccaguggcagacaaacaga

SEQ ID NO: 640066 - RNA, 19 nt, Homo sapiens
cuccagugggcugaugcug

SEQ ID NO: 640067 - RNA, 17 nt, Homo sapiens
cuccagugguugcuguu

SEQ ID NO: 640068 - RNA, 23 nt, Homo sapiens
cuccaguuagaaugcaccaugga

SEQ ID NO: 640069 - RNA, 19 nt, Homo sapiens
cuccauacucaagcugucu

SEQ ID NO: 640070 - RNA, 17 nt, Homo sapiens
cuccauaucuccauggc

SEQ ID NO: 640071 - RNA, 18 nt, Homo sapiens
cuccauaugcuguacaug

SEQ ID NO: 640072 - RNA, 20 nt, Homo sapiens
cuccauaugcuguacaugac

SEQ ID NO: 640073 - RNA, 17 nt, Homo sapiens
cuccauauuuauuuaaa

SEQ ID NO: 640074 - RNA, 18 nt, Homo sapiens
cuccaucauaugccugac

SEQ ID NO: 640075 - RNA, 18 nt, Homo sapiens
cuccaucccaaccaggca

SEQ ID NO: 640076 - RNA, 22 nt, Homo sapiens
cuccaucgccaucuucuucccu

SEQ ID NO: 640077 - RNA, 16 nt, Homo sapiens
cuccaucucaaaaaag

SEQ ID NO: 640078 - RNA, 16 nt, Homo sapiens
cuccaucucagccauu

SEQ ID NO: 640079 - RNA, 17 nt, Homo sapiens
cuccaucuccacuccag

SEQ ID NO: 640080 - RNA, 16 nt, Homo sapiens
cuccaucucuacugaa

SEQ ID NO: 640081 - RNA, 15 nt, Homo sapiens
cuccaugacuggcug

SEQ ID NO: 640082 - RNA, 14 nt, Homo sapiens
cuccaugcugccag

SEQ ID NO: 640083 - RNA, 19 nt, Homo sapiens
cuccaugcugccuccagaa

SEQ ID NO: 640084 - RNA, 21 nt, Homo sapiens
cuccauguguaagaacaaugc

SEQ ID NO: 640085 - RNA, 14 nt, Homo sapiens
cuccauguuugaug

SEQ ID NO: 640086 - RNA, 16 nt, Homo sapiens
cuccauguuugaugua

SEQ ID NO: 640087 - RNA, 12 nt, Homo sapiens
cuccauucauag

SEQ ID NO: 640088 - RNA, 14 nt, Homo sapiens
cuccauucugacca

SEQ ID NO: 640089 - RNA, 17 nt, Homo sapiens
cuccauuucuuucuucc

SEQ ID NO: 640090 - RNA, 21 nt, Homo sapiens
cucccaaaaaacuacuucuuu

SEQ ID NO: 640091 - RNA, 19 nt, Homo sapiens
cucccaaagugcugggauu

SEQ ID NO: 640092 - RNA, 19 nt, Homo sapiens
cucccaaauugcugggauu

SEQ ID NO: 640093 - RNA, 18 nt, Homo sapiens
cucccaacucuugcacag

SEQ ID NO: 640094 - RNA, 14 nt, Homo sapiens
cucccaaguccaca

SEQ ID NO: 640095 - RNA, 19 nt, Homo sapiens
cucccacaacaacaaaagc

SEQ ID NO: 640096 - RNA, 20 nt, Homo sapiens
cucccacacugaaaccaaaa

SEQ ID NO: 640097 - RNA, 13 nt, Homo sapiens
cucccacacuucc

SEQ ID NO: 640098 - RNA, 15 nt, Homo sapiens
cucccacauugucac

SEQ ID NO: 640099 - RNA, 13 nt, Homo sapiens
cucccaccucccu

SEQ ID NO: 640100 - RNA, 16 nt, Homo sapiens
cucccaccuccuggug

SEQ ID NO: 640101 - RNA, 23 nt, Homo sapiens
cucccacuaaagggguuccaaau

SEQ ID NO: 640102 - RNA, 14 nt, Homo sapiens
cucccacuauggug

SEQ ID NO: 640103 - RNA, 12 nt, Homo sapiens
cucccacuccag

SEQ ID NO: 640104 - RNA, 23 nt, Homo sapiens
cucccacugggguccagggagca

SEQ ID NO: 640105 - RNA, 22 nt, Homo sapiens
cucccagaaaaacuggcucuga

SEQ ID NO: 640106 - RNA, 19 nt, Homo sapiens
cucccagagugcugggauu

SEQ ID NO: 640107 - RNA, 15 nt, Homo sapiens
cucccagcccuaugg

SEQ ID NO: 640108 - RNA, 16 nt, Homo sapiens
cucccagcuccuuuca

SEQ ID NO: 640109 - RNA, 16 nt, Homo sapiens
cucccagguaccagcu

SEQ ID NO: 640110 - RNA, 17 nt, Homo sapiens
cucccagguggauuuug

SEQ ID NO: 640111 - RNA, 20 nt, Homo sapiens
cucccagguucccccagcaa

SEQ ID NO: 640112 - RNA, 20 nt, Homo sapiens
cucccauaagcuaagccuua

SEQ ID NO: 640113 - RNA, 21 nt, Homo sapiens
cucccauccccuggacuggga

SEQ ID NO: 640114 - RNA, 21 nt, Homo sapiens
cucccaucucuaccccaaaga

SEQ ID NO: 640115 - RNA, 11 nt, Homo sapiens
cucccauguca

SEQ ID NO: 640116 - RNA, 23 nt, Homo sapiens
cucccauuacuuugauaucugau

SEQ ID NO: 640117 - RNA, 13 nt, Homo sapiens
cuccccacuccac

SEQ ID NO: 640118 - RNA, 13 nt, Homo sapiens
cuccccacucuag

SEQ ID NO: 640119 - RNA, 20 nt, Homo sapiens
cuccccagacuccaccguca

SEQ ID NO: 640120 - RNA, 21 nt, Homo sapiens
cuccccagaugugacuacuga

SEQ ID NO: 640121 - RNA, 23 nt, Homo sapiens
cuccccagcccuggcucugcaau

SEQ ID NO: 640122 - RNA, 13 nt, Homo sapiens
cuccccaggggag

SEQ ID NO: 640123 - RNA, 19 nt, Homo sapiens
cuccccaguagcugggauu

SEQ ID NO: 640124 - RNA, 20 nt, Homo sapiens
cuccccaguagcugggauua

SEQ ID NO: 640125 - RNA, 18 nt, Homo sapiens
cuccccaucuguccagcu

SEQ ID NO: 640126 - RNA, 20 nt, Homo sapiens
cuccccaugccacguuccac

SEQ ID NO: 640127 - RNA, 21 nt, Homo sapiens
cuccccaugggcacaguggug

SEQ ID NO: 640128 - RNA, 17 nt, Homo sapiens
cucccccagcccuguca

SEQ ID NO: 640129 - RNA, 15 nt, Homo sapiens
cucccccagcuccuu

SEQ ID NO: 640130 - RNA, 16 nt, Homo sapiens
cuccccuaacaggugc

SEQ ID NO: 640131 - RNA, 12 nt, Homo sapiens
cuccccuaucca

SEQ ID NO: 640132 - RNA, 16 nt, Homo sapiens
cuccccucagauucca

SEQ ID NO: 640133 - RNA, 15 nt, Homo sapiens
cuccccucccagucc

SEQ ID NO: 640134 - RNA, 20 nt, Homo sapiens
cuccccuugucugcacuguu

SEQ ID NO: 640135 - RNA, 24 nt, Homo sapiens
cucccgacagcccaucaccucuaa

SEQ ID NO: 640136 - RNA, 19 nt, Homo sapiens
cucccggggacgcuuuuga

SEQ ID NO: 640137 - RNA, 19 nt, Homo sapiens
cucccuaaggaaucugaaa

SEQ ID NO: 640138 - RNA, 17 nt, Homo sapiens
cucccuaggcugcccac

SEQ ID NO: 640139 - RNA, 15 nt, Homo sapiens
cucccuccaccuccu

SEQ ID NO: 640140 - RNA, 18 nt, Homo sapiens
cucccuccagacaaugcc

SEQ ID NO: 640141 - RNA, 22 nt, Homo sapiens
cucccucucucuucugcuccac

SEQ ID NO: 640142 - RNA, 24 nt, Homo sapiens
cucccucuuucuucccaugacccc

SEQ ID NO: 640143 - RNA, 20 nt, Homo sapiens
cucccugcaucugaccagca

SEQ ID NO: 640144 - RNA, 15 nt, Homo sapiens
cucccugccaccagg

SEQ ID NO: 640145 - RNA, 17 nt, Homo sapiens
cucccugcugugccaug

SEQ ID NO: 640146 - RNA, 22 nt, Homo sapiens
cucccuggagaagcaccagcaa

SEQ ID NO: 640147 - RNA, 16 nt, Homo sapiens
cucccuggccaucuca

SEQ ID NO: 640148 - RNA, 17 nt, Homo sapiens
cucccuggccaucucaa

SEQ ID NO: 640149 - RNA, 22 nt, Homo sapiens
cucccugggcagugcuccuccg

SEQ ID NO: 640150 - RNA, 17 nt, Homo sapiens
cucccugggucugggga

SEQ ID NO: 640151 - RNA, 21 nt, Homo sapiens
cucccuggugccucugugcac

SEQ ID NO: 640152 - RNA, 16 nt, Homo sapiens
cucccugguugccucu

SEQ ID NO: 640153 - RNA, 20 nt, Homo sapiens
cucccuguagcucugccucc

SEQ ID NO: 640154 - RNA, 18 nt, Homo sapiens
cucccuguuaucugcuag

SEQ ID NO: 640155 - RNA, 13 nt, Homo sapiens
cucccuguugcug

SEQ ID NO: 640156 - RNA, 18 nt, Homo sapiens
cucccuuccguccauccc

SEQ ID NO: 640157 - RNA, 19 nt, Homo sapiens
cucccuucucguguuugcu

SEQ ID NO: 640158 - RNA, 13 nt, Homo sapiens
cucccuugucuca

SEQ ID NO: 640159 - RNA, 21 nt, Homo sapiens
cuccgaccacuuccaggggaa

SEQ ID NO: 640160 - RNA, 13 nt, Homo sapiens
cuccgaggccagu

SEQ ID NO: 640161 - RNA, 14 nt, Homo sapiens
cuccgaggccagua

SEQ ID NO: 640162 - RNA, 14 nt, Homo sapiens
cuccgcaucaccuc

SEQ ID NO: 640163 - RNA, 16 nt, Homo sapiens
cuccgccucucagguu

SEQ ID NO: 640164 - RNA, 19 nt, Homo sapiens
cuccgcgggagaccccuug

SEQ ID NO: 640165 - RNA, 14 nt, Homo sapiens
cuccggaggacuga

SEQ ID NO: 640166 - RNA, 16 nt, Homo sapiens
cuccggcgucuugccc

SEQ ID NO: 640167 - RNA, 22 nt, Homo sapiens
cuccgggcaaauggcugagaug

SEQ ID NO: 640168 - RNA, 23 nt, Homo sapiens
cuccgggccuuucucuggcuucc

SEQ ID NO: 640169 - RNA, 12 nt, Homo sapiens
cuccggggagcg

SEQ ID NO: 640170 - RNA, 14 nt, Homo sapiens
cuccgucugacccu

SEQ ID NO: 640171 - RNA, 12 nt, Homo sapiens
cuccuaaaacaa

SEQ ID NO: 640172 - RNA, 15 nt, Homo sapiens
cucuacccuauacaa

SEQ ID NO: 640173 - RNA, 13 nt, Homo sapiens
cucuacgccaaag

SEQ ID NO: 640174 - RNA, 21 nt, Homo sapiens
cucuacggaccucacauccau

SEQ ID NO: 640175 - RNA, 21 nt, Homo sapiens
cucuacucuagggaaaaacca

SEQ ID NO: 640176 - RNA, 22 nt, Homo sapiens
cucuacugaggugcuauguucu

SEQ ID NO: 640177 - RNA, 14 nt, Homo sapiens
cucuacugcuaaau

SEQ ID NO: 640178 - RNA, 17 nt, Homo sapiens
cucuacugcuucaggaa

SEQ ID NO: 640179 - RNA, 16 nt, Homo sapiens
cucuacuuaaugagau

SEQ ID NO: 640180 - RNA, 19 nt, Homo sapiens
cucuacuugucauaucacu

SEQ ID NO: 640181 - RNA, 15 nt, Homo sapiens
cucuagaagaccaaa

SEQ ID NO: 640182 - RNA, 18 nt, Homo sapiens
cucuagagaaaagucuac

SEQ ID NO: 640183 - RNA, 19 nt, Homo sapiens
cucuagccuggcaacagag

SEQ ID NO: 640184 - RNA, 20 nt, Homo sapiens
cucuagccugggccacaggg

SEQ ID NO: 640185 - RNA, 22 nt, Homo sapiens
cucuagccugggccacagggcg

SEQ ID NO: 640186 - RNA, 12 nt, Homo sapiens
cucuagcucucu

SEQ ID NO: 640187 - RNA, 19 nt, Homo sapiens
cucuaggccuguugccucg

SEQ ID NO: 640188 - RNA, 17 nt, Homo sapiens
cucuagggccucuccag

SEQ ID NO: 640189 - RNA, 17 nt, Homo sapiens
cucuaguaagaugcacu

SEQ ID NO: 640190 - RNA, 14 nt, Homo sapiens
cucuaguccuuggc

SEQ ID NO: 640191 - RNA, 16 nt, Homo sapiens
cucuagugcugugaaa

SEQ ID NO: 640192 - RNA, 14 nt, Homo sapiens
cucuagugggacag

SEQ ID NO: 640193 - RNA, 21 nt, Homo sapiens
cucuagugucuuuugccuuua

SEQ ID NO: 640194 - RNA, 19 nt, Homo sapiens
cucuaguugaguuucuggc

SEQ ID NO: 640195 - RNA, 18 nt, Homo sapiens
cucuauaagauuccaaaa

SEQ ID NO: 640196 - RNA, 22 nt, Homo sapiens
cucuauaaucugcagugaugca

SEQ ID NO: 640197 - RNA, 20 nt, Homo sapiens
cucuauauaccaaagcacau

SEQ ID NO: 640198 - RNA, 20 nt, Homo sapiens
cucuaugaaaauuauaucuc

SEQ ID NO: 640199 - RNA, 15 nt, Homo sapiens
cucuauuccaaaaag

SEQ ID NO: 640200 - RNA, 17 nt, Homo sapiens
cucuauucucugcaauu

SEQ ID NO: 640201 - RNA, 15 nt, Homo sapiens
cucuauuugagaaua

SEQ ID NO: 640202 - RNA, 21 nt, Homo sapiens
cucuauuuguaauugaacuua

SEQ ID NO: 640203 - RNA, 20 nt, Homo sapiens
cucuauuuuaauuacugcua

SEQ ID NO: 640204 - RNA, 18 nt, Homo sapiens
cucucaagcagguuuuua

SEQ ID NO: 640205 - RNA, 16 nt, Homo sapiens
cucucaagcuagccag

SEQ ID NO: 640206 - RNA, 22 nt, Homo sapiens
cucucaauuaaagucuauucaa

SEQ ID NO: 640207 - RNA, 17 nt, Homo sapiens
cucucaauuucuggaaa

SEQ ID NO: 640208 - RNA, 21 nt, Homo sapiens
cucucaccccaagcggccuuu

SEQ ID NO: 640209 - RNA, 13 nt, Homo sapiens
cucucaccucauu

SEQ ID NO: 640210 - RNA, 23 nt, Homo sapiens
cucucaccuguacuauugcagac

SEQ ID NO: 640211 - RNA, 17 nt, Homo sapiens
cucucacucagccuguu

SEQ ID NO: 640212 - RNA, 12 nt, Homo sapiens
cucucacuccag

SEQ ID NO: 640213 - RNA, 22 nt, Homo sapiens
cucucagaccaagcagcaggaa

SEQ ID NO: 640214 - RNA, 12 nt, Homo sapiens
cucucagggcca

SEQ ID NO: 640215 - RNA, 22 nt, Homo sapiens
cucucagugcuucuuacuauua

SEQ ID NO: 640216 - RNA, 15 nt, Homo sapiens
cucucaguucucgau

SEQ ID NO: 640217 - RNA, 13 nt, Homo sapiens
cucucauguuccu

SEQ ID NO: 640218 - RNA, 20 nt, Homo sapiens
cucucauuuccaaaccauca

SEQ ID NO: 640219 - RNA, 20 nt, Homo sapiens
cucuccacauggaagcccaa

SEQ ID NO: 640220 - RNA, 22 nt, Homo sapiens
cucuccaccccauuuuacagag

SEQ ID NO: 640221 - RNA, 13 nt, Homo sapiens
cucuccacugaaa

SEQ ID NO: 640222 - RNA, 20 nt, Homo sapiens
cucuccacugcuggacauga

SEQ ID NO: 640223 - RNA, 19 nt, Homo sapiens
cucucccaguccauuucca

SEQ ID NO: 640224 - RNA, 20 nt, Homo sapiens
cucuccccucagagugcaag

SEQ ID NO: 640225 - RNA, 22 nt, Homo sapiens
cucucccgucagggcccaaguc

SEQ ID NO: 640226 - RNA, 14 nt, Homo sapiens
cucucccuugaggg

SEQ ID NO: 640227 - RNA, 14 nt, Homo sapiens
cucuccucagacuu

SEQ ID NO: 640228 - RNA, 15 nt, Homo sapiens
cucuccuccucagcu

SEQ ID NO: 640229 - RNA, 23 nt, Homo sapiens
cucuccuguauuuaacaaaaagu

SEQ ID NO: 640230 - RNA, 17 nt, Homo sapiens
cucuccuuggccacaga

SEQ ID NO: 640231 - RNA, 15 nt, Homo sapiens
cucucgacaguaucc

SEQ ID NO: 640232 - RNA, 20 nt, Homo sapiens
cucucuacccggcccagaga

SEQ ID NO: 640233 - RNA, 14 nt, Homo sapiens
cucucuaccuccac

SEQ ID NO: 640234 - RNA, 11 nt, Homo sapiens
cucucuagcac

SEQ ID NO: 640235 - RNA, 12 nt, Homo sapiens
cucucucaggag

SEQ ID NO: 640236 - RNA, 12 nt, Homo sapiens
cucucuccuuau

SEQ ID NO: 640237 - RNA, 22 nt, Homo sapiens
cucucuccuuucagggccaauc

SEQ ID NO: 640238 - RNA, 11 nt, Homo sapiens
cucucucucag

SEQ ID NO: 640239 - RNA, 23 nt, Homo sapiens
cucucugacgcuugugacagugc

SEQ ID NO: 640240 - RNA, 19 nt, Homo sapiens
cucucugagagcaaacagg

SEQ ID NO: 640241 - RNA, 13 nt, Homo sapiens
cucucugcuccuu

SEQ ID NO: 640242 - RNA, 22 nt, Homo sapiens
cucucuggcuggucuucacuuu

SEQ ID NO: 640243 - RNA, 17 nt, Homo sapiens
cucucugggacucuccu

SEQ ID NO: 640244 - RNA, 18 nt, Homo sapiens
cucucugggauuuaccag

SEQ ID NO: 640245 - RNA, 15 nt, Homo sapiens
cucucuguagacuga

SEQ ID NO: 640246 - RNA, 15 nt, Homo sapiens
cucucuucugcucca

SEQ ID NO: 640247 - RNA, 14 nt, Homo sapiens
cucucuuuacauuu

SEQ ID NO: 640248 - RNA, 22 nt, Homo sapiens
cucucuuuuuggaggugcuuaa

SEQ ID NO: 640249 - RNA, 13 nt, Homo sapiens
cucugaaaaccaa

SEQ ID NO: 640250 - RNA, 19 nt, Homo sapiens
cucugaaacauggccuguu

SEQ ID NO: 640251 - RNA, 19 nt, Homo sapiens
cucugaaaucucagaauuc

SEQ ID NO: 640252 - RNA, 16 nt, Homo sapiens
cucugaacuugccuua

SEQ ID NO: 640253 - RNA, 11 nt, Homo sapiens
cucugaaguca

SEQ ID NO: 640254 - RNA, 14 nt, Homo sapiens
cucugacacauuag

SEQ ID NO: 640255 - RNA, 12 nt, Homo sapiens
cucugacagucc

SEQ ID NO: 640256 - RNA, 18 nt, Homo sapiens
cucugacaguccacaggg

SEQ ID NO: 640257 - RNA, 24 nt, Homo sapiens
cucugacccgguugcagucacugu

SEQ ID NO: 640258 - RNA, 17 nt, Homo sapiens
cucugacccuccuucua

SEQ ID NO: 640259 - RNA, 13 nt, Homo sapiens
cucugaccuguac

SEQ ID NO: 640260 - RNA, 13 nt, Homo sapiens
cucugaccuuuca

SEQ ID NO: 640261 - RNA, 21 nt, Homo sapiens
cucugacguugaucccagaga

SEQ ID NO: 640262 - RNA, 20 nt, Homo sapiens
cucugagaacuccucauucc

SEQ ID NO: 640263 - RNA, 15 nt, Homo sapiens
cucugagaaguacuu

SEQ ID NO: 640264 - RNA, 17 nt, Homo sapiens
cucugagacacacccca

SEQ ID NO: 640265 - RNA, 15 nt, Homo sapiens
cucugagaucuaagg

SEQ ID NO: 640266 - RNA, 20 nt, Homo sapiens
cucugagcaaauguggcucc

SEQ ID NO: 640267 - RNA, 15 nt, Homo sapiens
cucugaggcuaugga

SEQ ID NO: 640268 - RNA, 21 nt, Homo sapiens
cucugaggggaggcaccucca

SEQ ID NO: 640269 - RNA, 22 nt, Homo sapiens
cucugagucagugguuauuuga

SEQ ID NO: 640270 - RNA, 13 nt, Homo sapiens
cucugaucccucu

SEQ ID NO: 640271 - RNA, 22 nt, Homo sapiens
cucugaucuccauaaacaugaa

SEQ ID NO: 640272 - RNA, 23 nt, Homo sapiens
cucugaugacccugaaucugauc

SEQ ID NO: 640273 - RNA, 14 nt, Homo sapiens
cucugcaacacuuu

SEQ ID NO: 640274 - RNA, 20 nt, Homo sapiens
cucugcaacugcucagcucu

SEQ ID NO: 640275 - RNA, 23 nt, Homo sapiens
cucugcaaugggcacugggauga

SEQ ID NO: 640276 - RNA, 13 nt, Homo sapiens
cucugcacaagcu

SEQ ID NO: 640277 - RNA, 19 nt, Homo sapiens
cucugcaccguacugugga

SEQ ID NO: 640278 - RNA, 16 nt, Homo sapiens
cucugcagacuuccca

SEQ ID NO: 640279 - RNA, 20 nt, Homo sapiens
cucugcagacuucccagcua

SEQ ID NO: 640280 - RNA, 14 nt, Homo sapiens
cucugcagcacuuu

SEQ ID NO: 640281 - RNA, 18 nt, Homo sapiens
cucugcaguaaaacacau

SEQ ID NO: 640282 - RNA, 15 nt, Homo sapiens
cuguccucuguagua

SEQ ID NO: 640283 - RNA, 17 nt, Homo sapiens
cuguccugaucugugau

SEQ ID NO: 640284 - RNA, 18 nt, Homo sapiens
cuguccugaucugugaua

SEQ ID NO: 640285 - RNA, 23 nt, Homo sapiens
cuguccugcagucccacacugug

SEQ ID NO: 640286 - RNA, 17 nt, Homo sapiens
cuguccugccuccucau

SEQ ID NO: 640287 - RNA, 21 nt, Homo sapiens
cuguccuggaaccugucucca

SEQ ID NO: 640288 - RNA, 18 nt, Homo sapiens
cuguccuggaggcacugg

SEQ ID NO: 640289 - RNA, 16 nt, Homo sapiens
cagccaggacaucucu

SEQ ID NO: 640290 - RNA, 21 nt, Homo sapiens
cagccaggcuaugguugccac

SEQ ID NO: 640291 - RNA, 14 nt, Homo sapiens
cagccaggcugcca

SEQ ID NO: 640292 - RNA, 12 nt, Homo sapiens
cagccagucuca

SEQ ID NO: 640293 - RNA, 19 nt, Homo sapiens
cagccauaagaaagcacua

SEQ ID NO: 640294 - RNA, 19 nt, Homo sapiens
cagccaucaaauagugaau

SEQ ID NO: 640295 - RNA, 23 nt, Homo sapiens
cagccaucguccugggacucgga

SEQ ID NO: 640296 - RNA, 22 nt, Homo sapiens
cagccaugcaaugccaaauaau

SEQ ID NO: 640297 - RNA, 12 nt, Homo sapiens
cagccaugccag

SEQ ID NO: 640298 - RNA, 13 nt, Homo sapiens
cagccaugggaac

SEQ ID NO: 640299 - RNA, 17 nt, Homo sapiens
cagccaugucugcauuu

SEQ ID NO: 640300 - RNA, 12 nt, Homo sapiens
cagccauuaaaa

SEQ ID NO: 640301 - RNA, 14 nt, Homo sapiens
cagcccaacccggc

SEQ ID NO: 640302 - RNA, 19 nt, Homo sapiens
cagcccaagcuucccucca

SEQ ID NO: 640303 - RNA, 13 nt, Homo sapiens
cagcccagagcca

SEQ ID NO: 640304 - RNA, 14 nt, Homo sapiens
cagcccagcccagc

SEQ ID NO: 640305 - RNA, 21 nt, Homo sapiens
cagcccagccccuccaaaggu

SEQ ID NO: 640306 - RNA, 15 nt, Homo sapiens
cagcccagcuggugg

SEQ ID NO: 640307 - RNA, 23 nt, Homo sapiens
cagcccauggugagcucugggaa

SEQ ID NO: 640308 - RNA, 15 nt, Homo sapiens
cagccccacugccag

SEQ ID NO: 640309 - RNA, 15 nt, Homo sapiens
cagcccccacuccag

SEQ ID NO: 640310 - RNA, 17 nt, Homo sapiens
cagcccccacuccaguc

SEQ ID NO: 640311 - RNA, 18 nt, Homo sapiens
cagccccggcaagccaca

SEQ ID NO: 640312 - RNA, 20 nt, Homo sapiens
cagccccuagaaacccaagc

SEQ ID NO: 640313 - RNA, 22 nt, Homo sapiens
cagccccugggcccuugugcuc

SEQ ID NO: 640314 - RNA, 15 nt, Homo sapiens
cagccccuuucccca

SEQ ID NO: 640315 - RNA, 22 nt, Homo sapiens
cagcccggaggggacugguccc

SEQ ID NO: 640316 - RNA, 21 nt, Homo sapiens
cagcccuaaaguuuuaaacuc

SEQ ID NO: 640317 - RNA, 13 nt, Homo sapiens
cagcccuccuacg

SEQ ID NO: 640318 - RNA, 17 nt, Homo sapiens
cagcccuccuucagggg

SEQ ID NO: 640319 - RNA, 12 nt, Homo sapiens
cagcccugugga

SEQ ID NO: 640320 - RNA, 19 nt, Homo sapiens
cagcccugugugugucacc

SEQ ID NO: 640321 - RNA, 17 nt, Homo sapiens
cagcccuuauggccaau

SEQ ID NO: 640322 - RNA, 14 nt, Homo sapiens
cagccgauguggua

SEQ ID NO: 640323 - RNA, 23 nt, Homo sapiens
cagccgccagcugggagcacugg

SEQ ID NO: 640324 - RNA, 19 nt, Homo sapiens
cagccgccugaaagccaca

SEQ ID NO: 640325 - RNA, 20 nt, Homo sapiens
cagccuaaucccgugccccu

SEQ ID NO: 640326 - RNA, 20 nt, Homo sapiens
cagccuacuuucacacuaag

SEQ ID NO: 640327 - RNA, 17 nt, Homo sapiens
cagccuaggcagaggcu

SEQ ID NO: 640328 - RNA, 13 nt, Homo sapiens
cagccucacggag

SEQ ID NO: 640329 - RNA, 12 nt, Homo sapiens
cagccucagaau

SEQ ID NO: 640330 - RNA, 14 nt, Homo sapiens
cagccucagaauaa

SEQ ID NO: 640331 - RNA, 21 nt, Homo sapiens
cagccucauccuccccaggac

SEQ ID NO: 640332 - RNA, 22 nt, Homo sapiens
cagccuccaaaguggagcuggg

SEQ ID NO: 640333 - RNA, 15 nt, Homo sapiens
cagccucccauccag

SEQ ID NO: 640334 - RNA, 17 nt, Homo sapiens
cagccuccccgugccaa

SEQ ID NO: 640335 - RNA, 20 nt, Homo sapiens
cagccucccucugaccugca

SEQ ID NO: 640336 - RNA, 16 nt, Homo sapiens
cagccuccuccugacc

SEQ ID NO: 640337 - RNA, 13 nt, Homo sapiens
cagccuccugggu

SEQ ID NO: 640338 - RNA, 22 nt, Homo sapiens
cagccucugaaaaccaauguuc

SEQ ID NO: 640339 - RNA, 14 nt, Homo sapiens
cagccucugccagc

SEQ ID NO: 640340 - RNA, 12 nt, Homo sapiens
cagccucuggac

SEQ ID NO: 640341 - RNA, 20 nt, Homo sapiens
cagccucuucucugcacguu

SEQ ID NO: 640342 - RNA, 22 nt, Homo sapiens
cagccugaaagauacaggggau

SEQ ID NO: 640343 - RNA, 13 nt, Homo sapiens
cagccugccaaau

SEQ ID NO: 640344 - RNA, 22 nt, Homo sapiens
cagccugcgggccuaacauguu

SEQ ID NO: 640345 - RNA, 14 nt, Homo sapiens
cagccugcucccua

SEQ ID NO: 640346 - RNA, 19 nt, Homo sapiens
cagccuggccaguauggug

SEQ ID NO: 640347 - RNA, 20 nt, Homo sapiens
cagccugggcaacgagugaa

SEQ ID NO: 640348 - RNA, 24 nt, Homo sapiens
cagccuggggcggugugugugcca

SEQ ID NO: 640349 - RNA, 16 nt, Homo sapiens
cagccuggggugaccu

SEQ ID NO: 640350 - RNA, 19 nt, Homo sapiens
cagccugggugacagagca

SEQ ID NO: 640351 - RNA, 21 nt, Homo sapiens
cagccuggucaacauggugaa

SEQ ID NO: 640352 - RNA, 15 nt, Homo sapiens
cagccugguuugcaa

SEQ ID NO: 640353 - RNA, 21 nt, Homo sapiens
cagccuguagcuccccugcug

SEQ ID NO: 640354 - RNA, 16 nt, Homo sapiens
cagccuguauguggug

SEQ ID NO: 640355 - RNA, 12 nt, Homo sapiens
cagccugucacc

SEQ ID NO: 640356 - RNA, 16 nt, Homo sapiens
cagccuguccaacaga

SEQ ID NO: 640357 - RNA, 23 nt, Homo sapiens
cagccugucccauggacacucca

SEQ ID NO: 640358 - RNA, 22 nt, Homo sapiens
cagccuugcaaauaaucacaga

SEQ ID NO: 640359 - RNA, 20 nt, Homo sapiens
cagccuuguuccucagcacc

SEQ ID NO: 640360 - RNA, 17 nt, Homo sapiens
cagccuuuccagccucc

SEQ ID NO: 640361 - RNA, 17 nt, Homo sapiens
cagcgaaaggauguaaa

SEQ ID NO: 640362 - RNA, 17 nt, Homo sapiens
cagcgaaugaaugcugu

SEQ ID NO: 640363 - RNA, 23 nt, Homo sapiens
cagcgagaggcagagaaagaaga

SEQ ID NO: 640364 - RNA, 21 nt, Homo sapiens
cagcgagcuaugaucgcgcca

SEQ ID NO: 640365 - RNA, 21 nt, Homo sapiens
cagcgauucccuguguagcuc

SEQ ID NO: 640366 - RNA, 21 nt, Homo sapiens
cagcgcagcuggacucugcau

SEQ ID NO: 640367 - RNA, 18 nt, Homo sapiens
cagcgcagggcuggcacg

SEQ ID NO: 640368 - RNA, 23 nt, Homo sapiens
cagcgcccccaucugucuucagc

SEQ ID NO: 640369 - RNA, 15 nt, Homo sapiens
cagcgggagcacugc

SEQ ID NO: 640370 - RNA, 14 nt, Homo sapiens
cagcgggugcugcu

SEQ ID NO: 640371 - RNA, 16 nt, Homo sapiens
cagcgucccagucucu

SEQ ID NO: 640372 - RNA, 20 nt, Homo sapiens
cagcgugacaauauacuuca

SEQ ID NO: 640373 - RNA, 23 nt, Homo sapiens
cagcguggaugucgaugacuuca

SEQ ID NO: 640374 - RNA, 22 nt, Homo sapiens
cagcguuucuaugacacaugca

SEQ ID NO: 640375 - RNA, 19 nt, Homo sapiens
cagcuaaaauaagcucagu

SEQ ID NO: 640376 - RNA, 21 nt, Homo sapiens
cagcuaaaauaagcucaguga

SEQ ID NO: 640377 - RNA, 18 nt, Homo sapiens
cagcuaaagaaguuugaa

SEQ ID NO: 640378 - RNA, 20 nt, Homo sapiens
cagcuaacauuccauguuuc

SEQ ID NO: 640379 - RNA, 21 nt, Homo sapiens
cagcuaauugagaccacaggc

SEQ ID NO: 640380 - RNA, 22 nt, Homo sapiens
cagcuacauuccucagcugcca

SEQ ID NO: 640381 - RNA, 15 nt, Homo sapiens
cagcuagugccuuua

SEQ ID NO: 640382 - RNA, 19 nt, Homo sapiens
cagcuaguggcucuucuca

SEQ ID NO: 640383 - RNA, 18 nt, Homo sapiens
cagcuaucugucaucucu

SEQ ID NO: 640384 - RNA, 19 nt, Homo sapiens
cagcuauuuucaacauaac

SEQ ID NO: 640385 - RNA, 14 nt, Homo sapiens
cagcucaaagacuu

SEQ ID NO: 640386 - RNA, 20 nt, Homo sapiens
cagcucaacucacagcuucu

SEQ ID NO: 640387 - RNA, 13 nt, Homo sapiens
cagcucagagaug

SEQ ID NO: 640388 - RNA, 21 nt, Homo sapiens
cagcucaggggacacuggccc

SEQ ID NO: 640389 - RNA, 14 nt, Homo sapiens
cagcucaguaguau

SEQ ID NO: 640390 - RNA, 17 nt, Homo sapiens
cagcucaguaguauaug

SEQ ID NO: 640391 - RNA, 17 nt, Homo sapiens
cagcucccauuucauca

SEQ ID NO: 640392 - RNA, 15 nt, Homo sapiens
cagcucccuucucug

SEQ ID NO: 640393 - RNA, 21 nt, Homo sapiens
cagcuccucccuuguucucua

SEQ ID NO: 640394 - RNA, 15 nt, Homo sapiens
cagcuccugccaggg

SEQ ID NO: 640395 - RNA, 14 nt, Homo sapiens
cagcucguucucug

SEQ ID NO: 640396 - RNA, 17 nt, Homo sapiens
cagcucuagcuuugcag

SEQ ID NO: 640397 - RNA, 19 nt, Homo sapiens
cagcucuccccaggcauuu

SEQ ID NO: 640398 - RNA, 23 nt, Homo sapiens
cagcucuccccaggcauuugcca

SEQ ID NO: 640399 - RNA, 17 nt, Homo sapiens
cagcucucuccuuucag

SEQ ID NO: 640400 - RNA, 11 nt, Homo sapiens
cagcucugcaa

SEQ ID NO: 640401 - RNA, 12 nt, Homo sapiens
cagcucuuccau

SEQ ID NO: 640402 - RNA, 22 nt, Homo sapiens
cagcucuuggcuccacugggau

SEQ ID NO: 640403 - RNA, 21 nt, Homo sapiens
cauuggauucaucagcauuug

SEQ ID NO: 640404 - RNA, 21 nt, Homo sapiens
cauuggcuaauaaauguugcc

SEQ ID NO: 640405 - RNA, 16 nt, Homo sapiens
cauugggagucuguag

SEQ ID NO: 640406 - RNA, 19 nt, Homo sapiens
cauugggcugacaccuacc

SEQ ID NO: 640407 - RNA, 23 nt, Homo sapiens
cauuggucuaauuuauucaaagg

SEQ ID NO: 640408 - RNA, 21 nt, Homo sapiens
cauuggugaccugcggcagua

SEQ ID NO: 640409 - RNA, 18 nt, Homo sapiens
cauugguuaagucugugu

SEQ ID NO: 640410 - RNA, 23 nt, Homo sapiens
cauugguucuuucauuugcuuug

SEQ ID NO: 640411 - RNA, 23 nt, Homo sapiens
cauugguuggaagcuaccagagc

SEQ ID NO: 640412 - RNA, 20 nt, Homo sapiens
cauuguaaaagcauuuugua

SEQ ID NO: 640413 - RNA, 17 nt, Homo sapiens
cauuguaaaguauguga

SEQ ID NO: 640414 - RNA, 18 nt, Homo sapiens
cauuguaaaucugaagaa

SEQ ID NO: 640415 - RNA, 17 nt, Homo sapiens
cauuguagaaacacagu

SEQ ID NO: 640416 - RNA, 18 nt, Homo sapiens
cauuguaucugucuuucc

SEQ ID NO: 640417 - RNA, 13 nt, Homo sapiens
cauuguaugugcu

SEQ ID NO: 640418 - RNA, 17 nt, Homo sapiens
cauuguauuaauaccaa

SEQ ID NO: 640419 - RNA, 21 nt, Homo sapiens
cauuguccauuacuugccagg

SEQ ID NO: 640420 - RNA, 17 nt, Homo sapiens
cauuguccuguagcuuu

SEQ ID NO: 640421 - RNA, 23 nt, Homo sapiens
cauugucgcuauugauuuuuacu

SEQ ID NO: 640422 - RNA, 11 nt, Homo sapiens
cauugucuccc

SEQ ID NO: 640423 - RNA, 15 nt, Homo sapiens
cauugucugucugca

SEQ ID NO: 640424 - RNA, 16 nt, Homo sapiens
cauugugaaccaaugc

SEQ ID NO: 640425 - RNA, 14 nt, Homo sapiens
cauugugauguaua

SEQ ID NO: 640426 - RNA, 18 nt, Homo sapiens
cauugugccuaaguccag

SEQ ID NO: 640427 - RNA, 19 nt, Homo sapiens
cauuguugagguggucuga

SEQ ID NO: 640428 - RNA, 19 nt, Homo sapiens
cauuguuucguaacacagc

SEQ ID NO: 640429 - RNA, 17 nt, Homo sapiens
cauuuaaaacaggcaaa

SEQ ID NO: 640430 - RNA, 19 nt, Homo sapiens
cauuuaaagaaagaaugca

SEQ ID NO: 640431 - RNA, 21 nt, Homo sapiens
cauuuaaagaaagaaugcauu

SEQ ID NO: 640432 - RNA, 20 nt, Homo sapiens
cauuuaaauaaaacuuucca

SEQ ID NO: 640433 - RNA, 15 nt, Homo sapiens
cauuuaaauuccaca

SEQ ID NO: 640434 - RNA, 18 nt, Homo sapiens
cauuuaaauuuuacccuu

SEQ ID NO: 640435 - RNA, 13 nt, Homo sapiens
cauuuaaccccuu

SEQ ID NO: 640436 - RNA, 20 nt, Homo sapiens
cauuuacagcccucagcaau

SEQ ID NO: 640437 - RNA, 17 nt, Homo sapiens
cuuuuccauugcuuauu

SEQ ID NO: 640438 - RNA, 13 nt, Homo sapiens
cuuuuccauuucg

SEQ ID NO: 640439 - RNA, 18 nt, Homo sapiens
cuuuucccauugccaugc

SEQ ID NO: 640440 - RNA, 20 nt, Homo sapiens
cuuuuccuggcagcugcugu

SEQ ID NO: 640441 - RNA, 15 nt, Homo sapiens
cuuuuccuuucugcc

SEQ ID NO: 640442 - RNA, 16 nt, Homo sapiens
cuuuucuaacucuccc

SEQ ID NO: 640443 - RNA, 20 nt, Homo sapiens
cuuuucuaaucacaguguug

SEQ ID NO: 640444 - RNA, 13 nt, Homo sapiens
cuuuucucaggac

SEQ ID NO: 640445 - RNA, 21 nt, Homo sapiens
cuuuucucuccugugugcuug

SEQ ID NO: 640446 - RNA, 22 nt, Homo sapiens
cuuuucucugagacauuccacc

SEQ ID NO: 640447 - RNA, 17 nt, Homo sapiens
cuuuucugccacuccau

SEQ ID NO: 640448 - RNA, 16 nt, Homo sapiens
cuuuucuggccaaaag

SEQ ID NO: 640449 - RNA, 21 nt, Homo sapiens
cuuuucuguccgagcuuugaa

SEQ ID NO: 640450 - RNA, 23 nt, Homo sapiens
cuuuugaaaaaacaaaaaaccuc

SEQ ID NO: 640451 - RNA, 17 nt, Homo sapiens
cuuuugaaaaacaacug

SEQ ID NO: 640452 - RNA, 18 nt, Homo sapiens
cuuuugaagagcaaaggg

SEQ ID NO: 640453 - RNA, 19 nt, Homo sapiens
cuuuugaagucuucccuca

SEQ ID NO: 640454 - RNA, 15 nt, Homo sapiens
cuuuugaccaaauaa

SEQ ID NO: 640455 - RNA, 18 nt, Homo sapiens
cuuuugacggccuucuug

SEQ ID NO: 640456 - RNA, 20 nt, Homo sapiens
cuuuugacggccuucuuggu

SEQ ID NO: 640457 - RNA, 21 nt, Homo sapiens
cuuuugaggggcugacuucaa

SEQ ID NO: 640458 - RNA, 20 nt, Homo sapiens
cuuuugagugugugugugca

SEQ ID NO: 640459 - RNA, 17 nt, Homo sapiens
cuuuugcaacuuaauac

SEQ ID NO: 640460 - RNA, 16 nt, Homo sapiens
cuuuugccaguauuau

SEQ ID NO: 640461 - RNA, 19 nt, Homo sapiens
cuuuugccaguauuaugca

SEQ ID NO: 640462 - RNA, 10 nt, Homo sapiens
cuuuugccau

SEQ ID NO: 640463 - RNA, 15 nt, Homo sapiens
cuuuugccuacguga

SEQ ID NO: 640464 - RNA, 20 nt, Homo sapiens
cuuuugcuugaaaccaaaga

SEQ ID NO: 640465 - RNA, 18 nt, Homo sapiens
cuuuugcuugauccagaa

SEQ ID NO: 640466 - RNA, 16 nt, Homo sapiens
cuuuuggaacauuucu

SEQ ID NO: 640467 - RNA, 19 nt, Homo sapiens
cuuuuggugguauguuggu

SEQ ID NO: 640468 - RNA, 23 nt, Homo sapiens
cuuuugguguguuggacagagaa

SEQ ID NO: 640469 - RNA, 21 nt, Homo sapiens
cuuuugguuaugaauacuuug

SEQ ID NO: 640470 - RNA, 23 nt, Homo sapiens
cuuuuguaaauauucuuguccac

SEQ ID NO: 640471 - RNA, 14 nt, Homo sapiens
cuuuugucuaauua

SEQ ID NO: 640472 - RNA, 14 nt, Homo sapiens
cuuuugucugcaau

SEQ ID NO: 640473 - RNA, 22 nt, Homo sapiens
cuuuugugcaaagccaaaaccu

SEQ ID NO: 640474 - RNA, 11 nt, Homo sapiens
cuuuugugcau

SEQ ID NO: 640475 - RNA, 21 nt, Homo sapiens
cuuuuguuaaaagaugguaaa

SEQ ID NO: 640476 - RNA, 18 nt, Homo sapiens
cuuuuguuccuuuguuaa

SEQ ID NO: 640477 - RNA, 20 nt, Homo sapiens
cuuuuguugaaauagcuuua

SEQ ID NO: 640478 - RNA, 18 nt, Homo sapiens
cuuuuguuguccuugccc

SEQ ID NO: 640479 - RNA, 17 nt, Homo sapiens
cuuuuuaaaaaauacca

SEQ ID NO: 640480 - RNA, 17 nt, Homo sapiens
cuuuuuaaccugcaaaa

SEQ ID NO: 640481 - RNA, 20 nt, Homo sapiens
cuuuuuaagaugucuauuau

SEQ ID NO: 640482 - RNA, 20 nt, Homo sapiens
cuuuuuaauauugauaugcu

SEQ ID NO: 640483 - RNA, 16 nt, Homo sapiens
cuuuuuacaauuaaaa

SEQ ID NO: 640484 - RNA, 16 nt, Homo sapiens
cuuuuuacucaaagag

SEQ ID NO: 640485 - RNA, 17 nt, Homo sapiens
cuuuuuaucuucuuagc

SEQ ID NO: 640486 - RNA, 15 nt, Homo sapiens
cuuuuuaugcaaaag

SEQ ID NO: 640487 - RNA, 14 nt, Homo sapiens
cuuuuucacuuuga

SEQ ID NO: 640488 - RNA, 15 nt, Homo sapiens
cuuuuucacuuugaa

SEQ ID NO: 640489 - RNA, 12 nt, Homo sapiens
cuuuuucauaua

SEQ ID NO: 640490 - RNA, 18 nt, Homo sapiens
cuuuuucauauuucuacc

SEQ ID NO: 640491 - RNA, 13 nt, Homo sapiens
cuuuuucauucuu

SEQ ID NO: 640492 - RNA, 12 nt, Homo sapiens
cuuuuuccagag

SEQ ID NO: 640493 - RNA, 16 nt, Homo sapiens
cuuuuucugagcuuuu

SEQ ID NO: 640494 - RNA, 16 nt, Homo sapiens
cuuuuucuuguauuca

SEQ ID NO: 640495 - RNA, 13 nt, Homo sapiens
cuuuuucuuugag

SEQ ID NO: 640496 - RNA, 14 nt, Homo sapiens
cuuuuuuacacuga

SEQ ID NO: 640497 - RNA, 12 nt, Homo sapiens
cuuuuuuaucuu

SEQ ID NO: 640498 - RNA, 17 nt, Homo sapiens
cuuuuuuguacuuuucu

SEQ ID NO: 640499 - RNA, 23 nt, Homo sapiens
cuuuuuugucccccaacuugaga

SEQ ID NO: 640500 - RNA, 16 nt, Homo sapiens
cuuuuuuucuguacca

SEQ ID NO: 640501 - RNA, 18 nt, Homo sapiens
cuuuuuuuuaaguuacac

SEQ ID NO: 640502 - RNA, 18 nt, Homo sapiens
cuuuuuuuuaguucaaua

SEQ ID NO: 640503 - RNA, 22 nt, Homo sapiens
gaaaaaaaaaaaaaaucacugu

SEQ ID NO: 640504 - RNA, 17 nt, Homo sapiens
gaaaaaaaaaacacuug

SEQ ID NO: 640505 - RNA, 17 nt, Homo sapiens
gaaaaaaaaacagccac

SEQ ID NO: 640506 - RNA, 17 nt, Homo sapiens
gaaaaaaaagugucuca

SEQ ID NO: 640507 - RNA, 13 nt, Homo sapiens
gaaaaaaagggag

SEQ ID NO: 640508 - RNA, 13 nt, Homo sapiens
gaaaaaauucuuu

SEQ ID NO: 640509 - RNA, 18 nt, Homo sapiens
gaaaaacauuccaggaaa

SEQ ID NO: 640510 - RNA, 19 nt, Homo sapiens
gaaaaacauuccaggaaac

SEQ ID NO: 640511 - RNA, 15 nt, Homo sapiens
gaaaaagacacagac

SEQ ID NO: 640512 - RNA, 15 nt, Homo sapiens
gaaaaagccaccuag

SEQ ID NO: 640513 - RNA, 19 nt, Homo sapiens
gaaaaaguuaaacauugaa

SEQ ID NO: 640514 - RNA, 12 nt, Homo sapiens
gaaaaauaauca

SEQ ID NO: 640515 - RNA, 21 nt, Homo sapiens
gaaaaauacguuuuguguaua

SEQ ID NO: 640516 - RNA, 17 nt, Homo sapiens
gaaaaauaugugcuuga

SEQ ID NO: 640517 - RNA, 21 nt, Homo sapiens
gaaaaaucggcuuaccauuaa

SEQ ID NO: 640518 - RNA, 14 nt, Homo sapiens
gaaaaaugaggaau

SEQ ID NO: 640519 - RNA, 14 nt, Homo sapiens
gaaaaauguguuag

SEQ ID NO: 640520 - RNA, 19 nt, Homo sapiens
gaaaaauuuuuuucuuuga

SEQ ID NO: 640521 - RNA, 10 nt, Homo sapiens
gaaaacaauu

SEQ ID NO: 640522 - RNA, 22 nt, Homo sapiens
gaaaacacuacacagggcugcu

SEQ ID NO: 640523 - RNA, 13 nt, Homo sapiens
gaaaacacuuuca

SEQ ID NO: 640524 - RNA, 15 nt, Homo sapiens
gaaaacagaaaccau

SEQ ID NO: 640525 - RNA, 15 nt, Homo sapiens
gaaacuauucaugaa

SEQ ID NO: 640526 - RNA, 24 nt, Homo sapiens
gaaacuauuucuguuccagucaca

SEQ ID NO: 640527 - RNA, 14 nt, Homo sapiens
gaaacucaaaaaua

SEQ ID NO: 640528 - RNA, 16 nt, Homo sapiens
gaaacucacacucccc

SEQ ID NO: 640529 - RNA, 19 nt, Homo sapiens
gaaacuccaucucuacuga

SEQ ID NO: 640530 - RNA, 16 nt, Homo sapiens
gaaacuccgucucaaa

SEQ ID NO: 640531 - RNA, 22 nt, Homo sapiens
gaaacucuacauguaacuauuu

SEQ ID NO: 640532 - RNA, 23 nt, Homo sapiens
gaaacucuuucauucuucucaca

SEQ ID NO: 640533 - RNA, 21 nt, Homo sapiens
gaaacugcucccaucauuccu

SEQ ID NO: 640534 - RNA, 21 nt, Homo sapiens
gaaacugggaaucucauagga

SEQ ID NO: 640535 - RNA, 16 nt, Homo sapiens
gaaacuguaaauaugu

SEQ ID NO: 640536 - RNA, 14 nt, Homo sapiens
gaaacuucaguuga

SEQ ID NO: 640537 - RNA, 17 nt, Homo sapiens
gaaacuugcauacagag

SEQ ID NO: 640538 - RNA, 16 nt, Homo sapiens
gaaacuugcuuaucaa

SEQ ID NO: 640539 - RNA, 19 nt, Homo sapiens
gaaacuugugaaguggaaa

SEQ ID NO: 640540 - RNA, 16 nt, Homo sapiens
gaaacuuugccucaag

SEQ ID NO: 640541 - RNA, 16 nt, Homo sapiens
gaaagaaaaagcaaua

SEQ ID NO: 640542 - RNA, 16 nt, Homo sapiens
gaaagaaaaauaccau

SEQ ID NO: 640543 - RNA, 13 nt, Homo sapiens
gaaagaaagggaa

SEQ ID NO: 640544 - RNA, 20 nt, Homo sapiens
gaaagaagacaaacuuugca

SEQ ID NO: 640545 - RNA, 17 nt, Homo sapiens
gaaagaaggacccagaa

SEQ ID NO: 640546 - RNA, 14 nt, Homo sapiens
gaaagaaugcaaga

SEQ ID NO: 640547 - RNA, 23 nt, Homo sapiens
gaaagaaugcauuccagaacaaa

SEQ ID NO: 640548 - RNA, 12 nt, Homo sapiens
gaaagacaucca

SEQ ID NO: 640549 - RNA, 13 nt, Homo sapiens
gaaagacucuuaa

SEQ ID NO: 640550 - RNA, 17 nt, Homo sapiens
gaaagacuggacucuaa

SEQ ID NO: 640551 - RNA, 13 nt, Homo sapiens
gaaagacuugaaa

SEQ ID NO: 640552 - RNA, 23 nt, Homo sapiens
gaaagacuuggguugaacuauaa

SEQ ID NO: 640553 - RNA, 17 nt, Homo sapiens
gaaagagaacuacuaag

SEQ ID NO: 640554 - RNA, 21 nt, Homo sapiens
gaaagagaaugaacuguggaa

SEQ ID NO: 640555 - RNA, 18 nt, Homo sapiens
gaaagagacuccgucuca

SEQ ID NO: 640556 - RNA, 21 nt, Homo sapiens
gaaagagaucacccacuccua

SEQ ID NO: 640557 - RNA, 15 nt, Homo sapiens
gaaagagcauaauga

SEQ ID NO: 640558 - RNA, 18 nt, Homo sapiens
gaaagaggcaccaggaag

SEQ ID NO: 640559 - RNA, 13 nt, Homo sapiens
gaaagaucaaaga

SEQ ID NO: 640560 - RNA, 18 nt, Homo sapiens
gaaagauccacccucaaa

SEQ ID NO: 640561 - RNA, 14 nt, Homo sapiens
gaaagaugacaaaa

SEQ ID NO: 640562 - RNA, 18 nt, Homo sapiens
gaaagaugaucauuugua

SEQ ID NO: 640563 - RNA, 22 nt, Homo sapiens
gaaagaugguguggguguccug

SEQ ID NO: 640564 - RNA, 21 nt, Homo sapiens
gaaagauuuucuccacagugu

SEQ ID NO: 640565 - RNA, 18 nt, Homo sapiens
gaaagccaacauguggcu

SEQ ID NO: 640566 - RNA, 16 nt, Homo sapiens
gaaagcccucaugugc

SEQ ID NO: 640567 - RNA, 20 nt, Homo sapiens
gaaagcccucaugugcagua

SEQ ID NO: 640568 - RNA, 20 nt, Homo sapiens
gaaagccucagccauucacu

SEQ ID NO: 640569 - RNA, 23 nt, Homo sapiens
gaaagccuuuccucggucucccu

SEQ ID NO: 640570 - RNA, 18 nt, Homo sapiens
gaaagcucuaaagaccau

SEQ ID NO: 640571 - RNA, 18 nt, Homo sapiens
gaaagcugacauugccaa

SEQ ID NO: 640572 - RNA, 19 nt, Homo sapiens
gaaagcugauuacugucaa

SEQ ID NO: 640573 - RNA, 14 nt, Homo sapiens
gaaaggaacauuuu

SEQ ID NO: 640574 - RNA, 18 nt, Homo sapiens
gaaaggaagccuugcuca

SEQ ID NO: 640575 - RNA, 17 nt, Homo sapiens
gaaaggaagcuccacug

SEQ ID NO: 640576 - RNA, 22 nt, Homo sapiens
gaaaggagaacuauccaaaacu

SEQ ID NO: 640577 - RNA, 17 nt, Homo sapiens
gaaaggauuuuaccaaa

SEQ ID NO: 640578 - RNA, 20 nt, Homo sapiens
gaaaggauuuuaccaaagca

SEQ ID NO: 640579 - RNA, 16 nt, Homo sapiens
gaaaggcauucucuga

SEQ ID NO: 640580 - RNA, 12 nt, Homo sapiens
gaaaggccuuca

SEQ ID NO: 640581 - RNA, 23 nt, Homo sapiens
gaaaggcgcuuggcaucacacau

SEQ ID NO: 640582 - RNA, 18 nt, Homo sapiens
gaaagggaugguggagug

SEQ ID NO: 640583 - RNA, 18 nt, Homo sapiens
gaaagggauugcuuugca

SEQ ID NO: 640584 - RNA, 13 nt, Homo sapiens
gaaaggggugaga

SEQ ID NO: 640585 - RNA, 21 nt, Homo sapiens
gaaagggguuggggugacagu

SEQ ID NO: 640586 - RNA, 16 nt, Homo sapiens
gaaaggguaauuuccu

SEQ ID NO: 640587 - RNA, 20 nt, Homo sapiens
gaaaggguuugauauggaga

SEQ ID NO: 640588 - RNA, 22 nt, Homo sapiens
gaaagguacuauauuugcuaga

SEQ ID NO: 640589 - RNA, 21 nt, Homo sapiens
gaaaggucauccaaagaacau

SEQ ID NO: 640590 - RNA, 13 nt, Homo sapiens
gaaaggugcagga

SEQ ID NO: 640591 - RNA, 23 nt, Homo sapiens
gaaagguuaauucucuagggcua

SEQ ID NO: 640592 - RNA, 17 nt, Homo sapiens
gaaaguaagcauuucca

SEQ ID NO: 640593 - RNA, 22 nt, Homo sapiens
gaaaguacccucuuuuaccaac

SEQ ID NO: 640594 - RNA, 17 nt, Homo sapiens
gaaaguauuggcauuca

SEQ ID NO: 640595 - RNA, 14 nt, Homo sapiens
gaaagucacccaaa

SEQ ID NO: 640596 - RNA, 22 nt, Homo sapiens
gaaagucagcugaaggaugguu

SEQ ID NO: 640597 - RNA, 18 nt, Homo sapiens
gaaaguccagcacuggaa

SEQ ID NO: 640598 - RNA, 14 nt, Homo sapiens
gaaagugacuuuaa

SEQ ID NO: 640599 - RNA, 20 nt, Homo sapiens
gaaagugagagccagcagca

SEQ ID NO: 640600 - RNA, 12 nt, Homo sapiens
gaaagugauauc

SEQ ID NO: 640601 - RNA, 18 nt, Homo sapiens
gaaagugcgaguccucca

SEQ ID NO: 640602 - RNA, 14 nt, Homo sapiens
gaaagugcugauaa

SEQ ID NO: 640603 - RNA, 18 nt, Homo sapiens
gaaauaaaaggaagccaa

SEQ ID NO: 640604 - RNA, 15 nt, Homo sapiens
gaaauaaacagucua

SEQ ID NO: 640605 - RNA, 18 nt, Homo sapiens
gaaauaaauuuuguuuca

SEQ ID NO: 640606 - RNA, 19 nt, Homo sapiens
gaaauaacaagucgaugaa

SEQ ID NO: 640607 - RNA, 16 nt, Homo sapiens
gaaauaacauugcacu

SEQ ID NO: 640608 - RNA, 18 nt, Homo sapiens
gaaauaagcccaacagac

SEQ ID NO: 640609 - RNA, 13 nt, Homo sapiens
gaaauaaugccuc

SEQ ID NO: 640610 - RNA, 12 nt, Homo sapiens
gaaauaauguga

SEQ ID NO: 640611 - RNA, 18 nt, Homo sapiens
gaaauacagucuuccaca

SEQ ID NO: 640612 - RNA, 17 nt, Homo sapiens
gaaauaccagugaacca

SEQ ID NO: 640613 - RNA, 14 nt, Homo sapiens
gaaauacuacuccu

SEQ ID NO: 640614 - RNA, 16 nt, Homo sapiens
gaaauacucaugugca

SEQ ID NO: 640615 - RNA, 18 nt, Homo sapiens
gaaauagaaagaagccau

SEQ ID NO: 640616 - RNA, 15 nt, Homo sapiens
gaaauagacaguaua

SEQ ID NO: 640617 - RNA, 15 nt, Homo sapiens
gaaauaguucauguu

SEQ ID NO: 640618 - RNA, 20 nt, Homo sapiens
gaaauauaacaaguggguga

SEQ ID NO: 640619 - RNA, 22 nt, Homo sapiens
gaaauauauaacaacaaugaag

SEQ ID NO: 640620 - RNA, 19 nt, Homo sapiens
gaaauauccagaacauacu

SEQ ID NO: 640621 - RNA, 20 nt, Homo sapiens
gaaauauggaacuuacauug

SEQ ID NO: 640622 - RNA, 19 nt, Homo sapiens
gaaauauucuuaggcagau

SEQ ID NO: 640623 - RNA, 23 nt, Homo sapiens
gaaaucaaaagauaguugauucu

SEQ ID NO: 640624 - RNA, 18 nt, Homo sapiens
gaaaucaaugaagcaagu

SEQ ID NO: 640625 - RNA, 14 nt, Homo sapiens
gaaaucaaugcaag

SEQ ID NO: 640626 - RNA, 13 nt, Homo sapiens
gaaaucacuguga

SEQ ID NO: 640627 - RNA, 14 nt, Homo sapiens
gaaaucagcagaca

SEQ ID NO: 640628 - RNA, 15 nt, Homo sapiens
gaaaucagcaugaca

SEQ ID NO: 640629 - RNA, 23 nt, Homo sapiens
gaaaucauuuuacccuuggcuca

SEQ ID NO: 640630 - RNA, 24 nt, Homo sapiens
gaaauccaaauuucucauguuccu

SEQ ID NO: 640631 - RNA, 21 nt, Homo sapiens
gaaauccuuccuaaacccaau

SEQ ID NO: 640632 - RNA, 13 nt, Homo sapiens
gaaaucugccaau

SEQ ID NO: 640633 - RNA, 12 nt, Homo sapiens
gaaaucuugcuu

SEQ ID NO: 640634 - RNA, 22 nt, Homo sapiens
gaaaucuuguuggcaaaucaga

SEQ ID NO: 640635 - RNA, 21 nt, Homo sapiens
gaaaugaaacaaauaaucaca

SEQ ID NO: 640636 - RNA, 21 nt, Homo sapiens
gaaaugaaauauuguuuccaa

SEQ ID NO: 640637 - RNA, 21 nt, Homo sapiens
gaaaugaauagccaggccuga

SEQ ID NO: 640638 - RNA, 15 nt, Homo sapiens
gaaaugaccaagaca

SEQ ID NO: 640639 - RNA, 16 nt, Homo sapiens
gaaaugaccaggccaa

SEQ ID NO: 640640 - RNA, 14 nt, Homo sapiens
gaaaugacccuauu

SEQ ID NO: 640641 - RNA, 14 nt, Homo sapiens
gaaaugauaaguga

SEQ ID NO: 640642 - RNA, 17 nt, Homo sapiens
gaaaugauaagugacaa

SEQ ID NO: 640643 - RNA, 17 nt, Homo sapiens
gaaaugccugcuuugaa

SEQ ID NO: 640644 - RNA, 13 nt, Homo sapiens
gaaaugcuuugag

SEQ ID NO: 640645 - RNA, 13 nt, Homo sapiens
gaaauggaaucag

SEQ ID NO: 640646 - RNA, 20 nt, Homo sapiens
gaaauggauuuaucaucacc

SEQ ID NO: 640647 - RNA, 17 nt, Homo sapiens
gaagcgcggcuaacuua

SEQ ID NO: 640648 - RNA, 18 nt, Homo sapiens
gaagcggauuuccaggga

SEQ ID NO: 640649 - RNA, 18 nt, Homo sapiens
gaagcguuaugugcagua

SEQ ID NO: 640650 - RNA, 14 nt, Homo sapiens
gaagcguugccauu

SEQ ID NO: 640651 - RNA, 20 nt, Homo sapiens
gaagcuaaugaacucuuuca

SEQ ID NO: 640652 - RNA, 22 nt, Homo sapiens
gaagcuaauguaggacuguaua

SEQ ID NO: 640653 - RNA, 13 nt, Homo sapiens
gaagcucacccaa

SEQ ID NO: 640654 - RNA, 16 nt, Homo sapiens
gaagcuccacugucac

SEQ ID NO: 640655 - RNA, 22 nt, Homo sapiens
gaagcuccugggggaugcucua

SEQ ID NO: 640656 - RNA, 16 nt, Homo sapiens
gaagcucugaagucac

SEQ ID NO: 640657 - RNA, 15 nt, Homo sapiens
gaagcugcacaugug

SEQ ID NO: 640658 - RNA, 21 nt, Homo sapiens
gaagcugcaggcuuugccauu

SEQ ID NO: 640659 - RNA, 12 nt, Homo sapiens
gaagcugcuccu

SEQ ID NO: 640660 - RNA, 22 nt, Homo sapiens
gaagcugcugaccaauugugcu

SEQ ID NO: 640661 - RNA, 24 nt, Homo sapiens
gaagcuggaggcacaacgcaccag

SEQ ID NO: 640662 - RNA, 22 nt, Homo sapiens
gaagcuggccuggaccauuccu

SEQ ID NO: 640663 - RNA, 17 nt, Homo sapiens
gaagcuguauaauuaau

SEQ ID NO: 640664 - RNA, 13 nt, Homo sapiens
gaagcuguugcua

SEQ ID NO: 640665 - RNA, 17 nt, Homo sapiens
gaagcuucaugccaggu

SEQ ID NO: 640666 - RNA, 15 nt, Homo sapiens
gaagcuuccauucca

SEQ ID NO: 640667 - RNA, 15 nt, Homo sapiens
gaagcuuuaagcaaa

SEQ ID NO: 640668 - RNA, 15 nt, Homo sapiens
gaaggaaaagcaugu

SEQ ID NO: 640669 - RNA, 12 nt, Homo sapiens
gaaggaaaccag

SEQ ID NO: 640670 - RNA, 22 nt, Homo sapiens
gaaggaaagggaagagucuucc

SEQ ID NO: 640671 - RNA, 20 nt, Homo sapiens
gaaggaacucuggcuuccag

SEQ ID NO: 640672 - RNA, 14 nt, Homo sapiens
gaaggaaggcagug

SEQ ID NO: 640673 - RNA, 20 nt, Homo sapiens
gaaggaauggaggagucuca

SEQ ID NO: 640674 - RNA, 16 nt, Homo sapiens
gaaggacacagugaug

SEQ ID NO: 640675 - RNA, 19 nt, Homo sapiens
gaaggacacagugaugaau

SEQ ID NO: 640676 - RNA, 18 nt, Homo sapiens
gaaggacugaacuccauc

SEQ ID NO: 640677 - RNA, 14 nt, Homo sapiens
gaaggagaagucua

SEQ ID NO: 640678 - RNA, 18 nt, Homo sapiens
gaaggagauagauuugug

SEQ ID NO: 640679 - RNA, 15 nt, Homo sapiens
gaaggagaugcugcu

SEQ ID NO: 640680 - RNA, 15 nt, Homo sapiens
gaaggagcucaguua

SEQ ID NO: 640681 - RNA, 14 nt, Homo sapiens
gaaggaguucacug

SEQ ID NO: 640682 - RNA, 17 nt, Homo sapiens
gaaggaguuucacccug

SEQ ID NO: 640683 - RNA, 23 nt, Homo sapiens
gaaggaugucccggguguguaca

SEQ ID NO: 640684 - RNA, 15 nt, Homo sapiens
gaaggauuacucucc

SEQ ID NO: 640685 - RNA, 23 nt, Homo sapiens
gaaggcaauuuuaguguauuaau

SEQ ID NO: 640686 - RNA, 14 nt, Homo sapiens
gaaggcagagccau

SEQ ID NO: 640687 - RNA, 18 nt, Homo sapiens
gaaggcccugcugaguca

SEQ ID NO: 640688 - RNA, 20 nt, Homo sapiens
ccaaacucuucccucucuca

SEQ ID NO: 640689 - RNA, 19 nt, Homo sapiens
ccaaacugauccaguauaa

SEQ ID NO: 640690 - RNA, 22 nt, Homo sapiens
ccaaacuuauagcgcugaccaa

SEQ ID NO: 640691 - RNA, 12 nt, Homo sapiens
ccaaagaaccaa

SEQ ID NO: 640692 - RNA, 16 nt, Homo sapiens
ccaaagacuguacugg

SEQ ID NO: 640693 - RNA, 16 nt, Homo sapiens
ccaaagagaaugcccu

SEQ ID NO: 640694 - RNA, 16 nt, Homo sapiens
ccaaagagacuggagc

SEQ ID NO: 640695 - RNA, 22 nt, Homo sapiens
ccaaagaguagaauugcauuga

SEQ ID NO: 640696 - RNA, 21 nt, Homo sapiens
ccaaagauucuuuauaucuga

SEQ ID NO: 640697 - RNA, 10 nt, Homo sapiens
ccaaagggac

SEQ ID NO: 640698 - RNA, 19 nt, Homo sapiens
ccaaagggcuccguggaga

SEQ ID NO: 640699 - RNA, 17 nt, Homo sapiens
ccaaaguccucugcucc

SEQ ID NO: 640700 - RNA, 20 nt, Homo sapiens
ccaaagucuaaacugagcuc

SEQ ID NO: 640701 - RNA, 18 nt, Homo sapiens
ccaaagugcugggauuac

SEQ ID NO: 640702 - RNA, 13 nt, Homo sapiens
ccaaaguuugcuc

SEQ ID NO: 640703 - RNA, 16 nt, Homo sapiens
ccaaauaaaguaccau

SEQ ID NO: 640704 - RNA, 14 nt, Homo sapiens
ccaaauaacuucag

SEQ ID NO: 640705 - RNA, 20 nt, Homo sapiens
ccaaauaauuguugugugua

SEQ ID NO: 640706 - RNA, 14 nt, Homo sapiens
ccaaauacccaaau

SEQ ID NO: 640707 - RNA, 18 nt, Homo sapiens
ccaaauccacaagccauu

SEQ ID NO: 640708 - RNA, 11 nt, Homo sapiens
ccaaaucucag

SEQ ID NO: 640709 - RNA, 21 nt, Homo sapiens
ccaaaugauuucagaauuuag

SEQ ID NO: 640710 - RNA, 15 nt, Homo sapiens
ccaaauggacauaag

SEQ ID NO: 640711 - RNA, 22 nt, Homo sapiens
ccaaauguaaaaauccuuuuga

SEQ ID NO: 640712 - RNA, 22 nt, Homo sapiens
ccaaauguucauccucauugcc

SEQ ID NO: 640713 - RNA, 13 nt, Homo sapiens
ccaaauguuccau

SEQ ID NO: 640714 - RNA, 15 nt, Homo sapiens
ccaaauuaucuugau

SEQ ID NO: 640715 - RNA, 12 nt, Homo sapiens
ccaaauugcagc

SEQ ID NO: 640716 - RNA, 16 nt, Homo sapiens
ccaacaagccucaaag

SEQ ID NO: 640717 - RNA, 15 nt, Homo sapiens
ccaacacccugucua

SEQ ID NO: 640718 - RNA, 13 nt, Homo sapiens
ccaacacuuugag

SEQ ID NO: 640719 - RNA, 22 nt, Homo sapiens
ccaacagaagcagacuuuucag

SEQ ID NO: 640720 - RNA, 18 nt, Homo sapiens
ccaacagccaagacccaa

SEQ ID NO: 640721 - RNA, 20 nt, Homo sapiens
ccaacaucaacaucuugguc

SEQ ID NO: 640722 - RNA, 11 nt, Homo sapiens
ccaacaucuuu

SEQ ID NO: 640723 - RNA, 13 nt, Homo sapiens
ccaacauggugaa

SEQ ID NO: 640724 - RNA, 23 nt, Homo sapiens
ccaacauggugaaacuccaucuc

SEQ ID NO: 640725 - RNA, 20 nt, Homo sapiens
ccaacauuaaaacucauaau

SEQ ID NO: 640726 - RNA, 19 nt, Homo sapiens
ccaacauuuuuucccagug

SEQ ID NO: 640727 - RNA, 15 nt, Homo sapiens
ccaaccaaaccaauu

SEQ ID NO: 640728 - RNA, 14 nt, Homo sapiens
ccaaccacagagaa

SEQ ID NO: 640729 - RNA, 19 nt, Homo sapiens
ccaacccuaucuccugaca

SEQ ID NO: 640730 - RNA, 16 nt, Homo sapiens
ccaaccuccaguguca

SEQ ID NO: 640731 - RNA, 14 nt, Homo sapiens
ccaaccuccugacc

SEQ ID NO: 640732 - RNA, 15 nt, Homo sapiens
ccaaccucuggagca

SEQ ID NO: 640733 - RNA, 19 nt, Homo sapiens
ccaacgagacacauugccu

SEQ ID NO: 640734 - RNA, 20 nt, Homo sapiens
ccaacgagacacauugccuu

SEQ ID NO: 640735 - RNA, 24 nt, Homo sapiens
ccaacguaugugguuaucugugaa

SEQ ID NO: 640736 - RNA, 15 nt, Homo sapiens
ccaacucaagguucu

SEQ ID NO: 640737 - RNA, 17 nt, Homo sapiens
ccaacuccaaccucucg

SEQ ID NO: 640738 - RNA, 19 nt, Homo sapiens
ccaacuccaaccucucggc

SEQ ID NO: 640739 - RNA, 20 nt, Homo sapiens
ccaacuccaggaaagagcag

SEQ ID NO: 640740 - RNA, 13 nt, Homo sapiens
ccaacuccagggg

SEQ ID NO: 640741 - RNA, 23 nt, Homo sapiens
ccaacuccccuccgucugugaca

SEQ ID NO: 640742 - RNA, 22 nt, Homo sapiens
ccaacucugagcccauguucug

SEQ ID NO: 640743 - RNA, 16 nt, Homo sapiens
ccaacucugcacucca

SEQ ID NO: 640744 - RNA, 14 nt, Homo sapiens
ccaacucuugcaca

SEQ ID NO: 640745 - RNA, 20 nt, Homo sapiens
ccaacuucagcaaugaauug

SEQ ID NO: 640746 - RNA, 21 nt, Homo sapiens
ccaacuucauuugaugcuaaa

SEQ ID NO: 640747 - RNA, 18 nt, Homo sapiens
ccaacuugaugugaaaag

SEQ ID NO: 640748 - RNA, 16 nt, Homo sapiens
ccaacuugauguucca

SEQ ID NO: 640749 - RNA, 17 nt, Homo sapiens
ccaacuugccaaaaugu

SEQ ID NO: 640750 - RNA, 19 nt, Homo sapiens
ccaacuugguuuugcuaca

SEQ ID NO: 640751 - RNA, 23 nt, Homo sapiens
ccaagaaacacugccugcccucu

SEQ ID NO: 640752 - RNA, 20 nt, Homo sapiens
ccaagacagauggacacugc

SEQ ID NO: 640753 - RNA, 15 nt, Homo sapiens
ccaagacagugaagu

SEQ ID NO: 640754 - RNA, 15 nt, Homo sapiens
ccaagacaugacauu

SEQ ID NO: 640755 - RNA, 14 nt, Homo sapiens
ccaagacccaacag

SEQ ID NO: 640756 - RNA, 22 nt, Homo sapiens
ccaagaccccaaaucaccacaa

SEQ ID NO: 640757 - RNA, 13 nt, Homo sapiens
ccaagacccugug

SEQ ID NO: 640758 - RNA, 20 nt, Homo sapiens
ccaagacucugaaaucucag

SEQ ID NO: 640759 - RNA, 23 nt, Homo sapiens
ccaagacucuuuaugaucuggcc

SEQ ID NO: 640760 - RNA, 13 nt, Homo sapiens
ccaagagaacuca

SEQ ID NO: 640761 - RNA, 10 nt, Homo sapiens
ccaagagcua

SEQ ID NO: 640762 - RNA, 15 nt, Homo sapiens
ccaagaguaacuuua

SEQ ID NO: 640763 - RNA, 17 nt, Homo sapiens
ccaagaguuaagauauc

SEQ ID NO: 640764 - RNA, 22 nt, Homo sapiens
ccaagauguaaaacaagaaaug

SEQ ID NO: 640765 - RNA, 11 nt, Homo sapiens
ccaagcaccuc

SEQ ID NO: 640766 - RNA, 22 nt, Homo sapiens
ccaagcaccuccaaccaaauaa

SEQ ID NO: 640767 - RNA, 17 nt, Homo sapiens
ccaagcagaguguuuua

SEQ ID NO: 640768 - RNA, 13 nt, Homo sapiens
ccaagcagugcac

SEQ ID NO: 640769 - RNA, 18 nt, Homo sapiens
guaaauccuagacuugaa

SEQ ID NO: 640770 - RNA, 19 nt, Homo sapiens
guaaauccugccauuuaaa

SEQ ID NO: 640771 - RNA, 17 nt, Homo sapiens
guaaaucuaaagaaaua

SEQ ID NO: 640772 - RNA, 11 nt, Homo sapiens
guaaaucucac

SEQ ID NO: 640773 - RNA, 20 nt, Homo sapiens
guaaaugacacuuucuaugc

SEQ ID NO: 640774 - RNA, 14 nt, Homo sapiens
guaaaugcuccauu

SEQ ID NO: 640775 - RNA, 15 nt, Homo sapiens
guaaauguccauuua

SEQ ID NO: 640776 - RNA, 13 nt, Homo sapiens
guaaaugugcauu

SEQ ID NO: 640777 - RNA, 21 nt, Homo sapiens
guaaauguuaucuuauacugu

SEQ ID NO: 640778 - RNA, 15 nt, Homo sapiens
guaaauuaguauuua

SEQ ID NO: 640779 - RNA, 15 nt, Homo sapiens
guaaauucaaccacu

SEQ ID NO: 640780 - RNA, 13 nt, Homo sapiens
guaaauugcaaau

SEQ ID NO: 640781 - RNA, 14 nt, Homo sapiens
guaaauugcaaaua

SEQ ID NO: 640782 - RNA, 12 nt, Homo sapiens
guaaauugcaca

SEQ ID NO: 640783 - RNA, 19 nt, Homo sapiens
guaacaaaccugcacuuau

SEQ ID NO: 640784 - RNA, 18 nt, Homo sapiens
guaacaacuguggucaau

SEQ ID NO: 640785 - RNA, 17 nt, Homo sapiens
guaacaauacaaaugga

SEQ ID NO: 640786 - RNA, 18 nt, Homo sapiens
guaacaauacaugagaaa

SEQ ID NO: 640787 - RNA, 11 nt, Homo sapiens
guaacaauaug

SEQ ID NO: 640788 - RNA, 12 nt, Homo sapiens
guaacacuacag

SEQ ID NO: 640789 - RNA, 18 nt, Homo sapiens
guaacagcauuaacuguc

SEQ ID NO: 640790 - RNA, 15 nt, Homo sapiens
guaacaguuguguca

SEQ ID NO: 640791 - RNA, 23 nt, Homo sapiens
guaacauacuggccuggacuguu

SEQ ID NO: 640792 - RNA, 14 nt, Homo sapiens
guaacauagacaaa

SEQ ID NO: 640793 - RNA, 16 nt, Homo sapiens
guaacauagaguauau

SEQ ID NO: 640794 - RNA, 23 nt, Homo sapiens
guaacaugaggggacauuuuggu

SEQ ID NO: 640795 - RNA, 13 nt, Homo sapiens
guaacaugauguu

SEQ ID NO: 640796 - RNA, 17 nt, Homo sapiens
guaacauuucuguucuc

SEQ ID NO: 640797 - RNA, 16 nt, Homo sapiens
guaaccaaaacagcau

SEQ ID NO: 640798 - RNA, 16 nt, Homo sapiens
guaaccaaauguuggc

SEQ ID NO: 640799 - RNA, 15 nt, Homo sapiens
guaaccuagugaauu

SEQ ID NO: 640800 - RNA, 20 nt, Homo sapiens
guaacuaaaacuuuucaguu

SEQ ID NO: 640801 - RNA, 14 nt, Homo sapiens
cucuacauguaacu

SEQ ID NO: 640802 - RNA, 17 nt, Homo sapiens
cucuacgucccagggag

SEQ ID NO: 640803 - RNA, 16 nt, Homo sapiens
cucuacuaaugccucu

SEQ ID NO: 640804 - RNA, 14 nt, Homo sapiens
cucuacuccacaga

SEQ ID NO: 640805 - RNA, 17 nt, Homo sapiens
cucuacuccuaccucag

SEQ ID NO: 640806 - RNA, 21 nt, Homo sapiens
cucuacugaaaguacaaaaau

SEQ ID NO: 640807 - RNA, 23 nt, Homo sapiens
cucuagaaagcucuaaagaccau

SEQ ID NO: 640808 - RNA, 13 nt, Homo sapiens
cucuagaagccaa

SEQ ID NO: 640809 - RNA, 14 nt, Homo sapiens
cucuagaagccaag

SEQ ID NO: 640810 - RNA, 21 nt, Homo sapiens
cucuagaggguugcugccuuu

SEQ ID NO: 640811 - RNA, 18 nt, Homo sapiens
cucuagaugcaaauacau

SEQ ID NO: 640812 - RNA, 13 nt, Homo sapiens
cucuagcuguucu

SEQ ID NO: 640813 - RNA, 23 nt, Homo sapiens
cucuaggccucuccaguuugcac

SEQ ID NO: 640814 - RNA, 19 nt, Homo sapiens
cucuagggaaucuggauua

SEQ ID NO: 640815 - RNA, 20 nt, Homo sapiens
cucuaguaagaugcacugaa

SEQ ID NO: 640816 - RNA, 14 nt, Homo sapiens
cucuaguaucacuu

SEQ ID NO: 640817 - RNA, 12 nt, Homo sapiens
cucuaguauuua

SEQ ID NO: 640818 - RNA, 14 nt, Homo sapiens
cucuagucagcaca

SEQ ID NO: 640819 - RNA, 15 nt, Homo sapiens
cucuaguucuuaaca

SEQ ID NO: 640820 - RNA, 18 nt, Homo sapiens
cucuaguuuccagaggcu

SEQ ID NO: 640821 - RNA, 15 nt, Homo sapiens
cucuauaacagaucc

SEQ ID NO: 640822 - RNA, 14 nt, Homo sapiens
cucuauacaucucu

SEQ ID NO: 640823 - RNA, 20 nt, Homo sapiens
cucuaucaccaaggagccaa

SEQ ID NO: 640824 - RNA, 19 nt, Homo sapiens
cucuaugccagcucagucc

SEQ ID NO: 640825 - RNA, 14 nt, Homo sapiens
cucuaugucugccu

SEQ ID NO: 640826 - RNA, 13 nt, Homo sapiens
cucuauuaucuca

SEQ ID NO: 640827 - RNA, 14 nt, Homo sapiens
cucuauugcugcuc

SEQ ID NO: 640828 - RNA, 14 nt, Homo sapiens
cucuauuguuaccu

SEQ ID NO: 640829 - RNA, 14 nt, Homo sapiens
cucucaaacuucac

SEQ ID NO: 640830 - RNA, 15 nt, Homo sapiens
cucucaagcagguuu

SEQ ID NO: 640831 - RNA, 17 nt, Homo sapiens
cucucaagcuagccaga

SEQ ID NO: 640832 - RNA, 23 nt, Homo sapiens
cucucaauaaaguuccccuguga

SEQ ID NO: 640833 - RNA, 21 nt, Homo sapiens
cucucaauuuuugguugaaua

SEQ ID NO: 640834 - RNA, 14 nt, Homo sapiens
cucucacacugaau

SEQ ID NO: 640835 - RNA, 13 nt, Homo sapiens
cucucacaugcac

SEQ ID NO: 640836 - RNA, 17 nt, Homo sapiens
cucucacccgaccggug

SEQ ID NO: 640837 - RNA, 12 nt, Homo sapiens
cucucaccucau

SEQ ID NO: 640838 - RNA, 19 nt, Homo sapiens
cucucaccuuaucuggaag

SEQ ID NO: 640839 - RNA, 21 nt, Homo sapiens
cucucacuaggcuaaacucaa

SEQ ID NO: 640840 - RNA, 19 nt, Homo sapiens
cucucacuccccagccugg

SEQ ID NO: 640841 - RNA, 13 nt, Homo sapiens
cucucacugcauu

SEQ ID NO: 640842 - RNA, 21 nt, Homo sapiens
cucucagaggccugcugccag

SEQ ID NO: 640843 - RNA, 15 nt, Homo sapiens
cucucagcauagccu

SEQ ID NO: 640844 - RNA, 21 nt, Homo sapiens
cucucaggcaugccuguguga

SEQ ID NO: 640845 - RNA, 18 nt, Homo sapiens
cucucaguucuacacuga

SEQ ID NO: 640846 - RNA, 19 nt, Homo sapiens
cucucauauaagacaaaua

SEQ ID NO: 640847 - RNA, 19 nt, Homo sapiens
cucucaugggguccaaguu

SEQ ID NO: 640848 - RNA, 23 nt, Homo sapiens
cucucauguuccuggcgugagau

SEQ ID NO: 640849 - RNA, 22 nt, Homo sapiens
cucucauguuuucaacugccaa

SEQ ID NO: 640850 - RNA, 21 nt, Homo sapiens
cucucauuucuggaaagugca

SEQ ID NO: 640851 - RNA, 19 nt, Homo sapiens
cucuccaaacagucaccau

SEQ ID NO: 640852 - RNA, 18 nt, Homo sapiens
cucuccaaauagcauuag

SEQ ID NO: 640853 - RNA, 23 nt, Homo sapiens
cucuccaaccacugugccacuga

SEQ ID NO: 640854 - RNA, 14 nt, Homo sapiens
cucuccagccauug

SEQ ID NO: 640855 - RNA, 18 nt, Homo sapiens
cucuccaucuuccacgaa

SEQ ID NO: 640856 - RNA, 14 nt, Homo sapiens
cucucccaacucaa

SEQ ID NO: 640857 - RNA, 13 nt, Homo sapiens
cucucccagugaa

SEQ ID NO: 640858 - RNA, 23 nt, Homo sapiens
cucuccccaacccccauucucau

SEQ ID NO: 640859 - RNA, 18 nt, Homo sapiens
cucuccccacugcucauu

SEQ ID NO: 640860 - RNA, 21 nt, Homo sapiens
cucuccccagccuccccgugc

SEQ ID NO: 640861 - RNA, 19 nt, Homo sapiens
cucuccccaggcauuugcc

SEQ ID NO: 640862 - RNA, 22 nt, Homo sapiens
cucuccccuguccugauggcac

SEQ ID NO: 640863 - RNA, 18 nt, Homo sapiens
cucucccgccagacuguu

SEQ ID NO: 640864 - RNA, 18 nt, Homo sapiens
cucucccucccuugccac

SEQ ID NO: 640865 - RNA, 19 nt, Homo sapiens
cucucccucuucucaagug

SEQ ID NO: 640866 - RNA, 17 nt, Homo sapiens
cucucccugacccugua

SEQ ID NO: 640867 - RNA, 21 nt, Homo sapiens
cucucccugggucuggggaca

SEQ ID NO: 640868 - RNA, 17 nt, Homo sapiens
cucuccucgguucaagg

SEQ ID NO: 640869 - RNA, 14 nt, Homo sapiens
cucuccucuugcca

SEQ ID NO: 640870 - RNA, 16 nt, Homo sapiens
cucuccugaauccuuu

SEQ ID NO: 640871 - RNA, 12 nt, Homo sapiens
cucuccugcaaa

SEQ ID NO: 640872 - RNA, 13 nt, Homo sapiens
cucuccugccuca

SEQ ID NO: 640873 - RNA, 23 nt, Homo sapiens
cucuccuggcccugaaggugcca

SEQ ID NO: 640874 - RNA, 11 nt, Homo sapiens
cucuccugucc

SEQ ID NO: 640875 - RNA, 16 nt, Homo sapiens
cucucgacaguaucca

SEQ ID NO: 640876 - RNA, 22 nt, Homo sapiens
cucucuaacguccacuagcuua

SEQ ID NO: 640877 - RNA, 20 nt, Homo sapiens
cucucuaagguaacauuuau

SEQ ID NO: 640878 - RNA, 15 nt, Homo sapiens
cucucuacagugcca

SEQ ID NO: 640879 - RNA, 14 nt, Homo sapiens
cucucuaccagucu

SEQ ID NO: 640880 - RNA, 15 nt, Homo sapiens
cucucuaccagucua

SEQ ID NO: 640881 - RNA, 23 nt, Homo sapiens
cucucuaccuccacccugcauuu

SEQ ID NO: 640882 - RNA, 22 nt, Homo sapiens
cucucuagcuuaaguguaaaug

SEQ ID NO: 640883 - RNA, 15 nt, Homo sapiens
cucucuaguuuccag

SEQ ID NO: 640884 - RNA, 15 nt, Homo sapiens
cucucucacacauca

SEQ ID NO: 640885 - RNA, 14 nt, Homo sapiens
cucucuccugucca

SEQ ID NO: 640886 - RNA, 13 nt, Homo sapiens
cucucucuaccag

SEQ ID NO: 640887 - RNA, 13 nt, Homo sapiens
cucucucuguggg

SEQ ID NO: 640888 - RNA, 14 nt, Homo sapiens
cucucugaaccuca

SEQ ID NO: 640889 - RNA, 20 nt, Homo sapiens
cucucugaagcgacucuccu

SEQ ID NO: 640890 - RNA, 14 nt, Homo sapiens
cucucuggacacuu

SEQ ID NO: 640891 - RNA, 23 nt, Homo sapiens
cucucugguaccgagccccugaa

SEQ ID NO: 640892 - RNA, 19 nt, Homo sapiens
cucucuguaggcacagagc

SEQ ID NO: 640893 - RNA, 17 nt, Homo sapiens
cucucugugcucuugca

SEQ ID NO: 640894 - RNA, 13 nt, Homo sapiens
cucucuguucccu

SEQ ID NO: 640895 - RNA, 14 nt, Homo sapiens
cucucuucaaucuc

SEQ ID NO: 640896 - RNA, 15 nt, Homo sapiens
cucucuucguccuga

SEQ ID NO: 640897 - RNA, 12 nt, Homo sapiens
cucucuucucag

SEQ ID NO: 640898 - RNA, 14 nt, Homo sapiens
cucucuucuggaau

SEQ ID NO: 640899 - RNA, 23 nt, Homo sapiens
cucucuuuaaaucaaguccuuua

SEQ ID NO: 640900 - RNA, 14 nt, Homo sapiens
cucucuuuaacccu

SEQ ID NO: 640901 - RNA, 12 nt, Homo sapiens
cucucuuuacau

SEQ ID NO: 640902 - RNA, 16 nt, Homo sapiens
cucucuuuaugcuugc

SEQ ID NO: 640903 - RNA, 23 nt, Homo sapiens
cucucuuucuagaggugcuacau

SEQ ID NO: 640904 - RNA, 15 nt, Homo sapiens
cucugaaaccagugu

SEQ ID NO: 640905 - RNA, 20 nt, Homo sapiens
cucugaaccccucccuccau

SEQ ID NO: 640906 - RNA, 13 nt, Homo sapiens
cucugaacuucca

SEQ ID NO: 640907 - RNA, 23 nt, Homo sapiens
cucugaagucacaucacaggaca

SEQ ID NO: 640908 - RNA, 17 nt, Homo sapiens
cucugaaguguccuaaa

SEQ ID NO: 640909 - RNA, 22 nt, Homo sapiens
cucugaauauuuuguaauaaag

SEQ ID NO: 640910 - RNA, 20 nt, Homo sapiens
cucugaaugaaccuucuggc

SEQ ID NO: 640911 - RNA, 22 nt, Homo sapiens
cucugacaguccacaggggcca

SEQ ID NO: 640912 - RNA, 18 nt, Homo sapiens
cucugacccuccuucuau

SEQ ID NO: 640913 - RNA, 15 nt, Homo sapiens
cucugaccugcacug

SEQ ID NO: 640914 - RNA, 16 nt, Homo sapiens
cucugaccuuccagag

SEQ ID NO: 640915 - RNA, 18 nt, Homo sapiens
cucugacuuaagcugccu

SEQ ID NO: 640916 - RNA, 22 nt, Homo sapiens
cucugagauacuaauaggugug

SEQ ID NO: 640917 - RNA, 15 nt, Homo sapiens
cucugaggauguaua

SEQ ID NO: 640918 - RNA, 17 nt, Homo sapiens
cucugaggcuauggagg

SEQ ID NO: 640919 - RNA, 22 nt, Homo sapiens
cucugaggggaggcaccuccag

SEQ ID NO: 640920 - RNA, 13 nt, Homo sapiens
cucugagggugau

SEQ ID NO: 640921 - RNA, 12 nt, Homo sapiens
cucugauuucag

SEQ ID NO: 640922 - RNA, 18 nt, Homo sapiens
cucugcacuccauggcca

SEQ ID NO: 640923 - RNA, 21 nt, Homo sapiens
cucugcagcccagccuaguca

SEQ ID NO: 640924 - RNA, 14 nt, Homo sapiens
guaacuacaaugau

SEQ ID NO: 640925 - RNA, 12 nt, Homo sapiens
guaacuccagau

SEQ ID NO: 640926 - RNA, 16 nt, Homo sapiens
guaacuggcaguuuuc

SEQ ID NO: 640927 - RNA, 21 nt, Homo sapiens
guaacugggaucgcaccuuuu

SEQ ID NO: 640928 - RNA, 17 nt, Homo sapiens
guaacugugacugauga

SEQ ID NO: 640929 - RNA, 22 nt, Homo sapiens
guaacugugccaguucuuucca

SEQ ID NO: 640930 - RNA, 20 nt, Homo sapiens
guaacuuauuuuaaauaugc

SEQ ID NO: 640931 - RNA, 22 nt, Homo sapiens
guaacuuccugcugcacccugc

SEQ ID NO: 640932 - RNA, 14 nt, Homo sapiens
guaacuugcugcuu

SEQ ID NO: 640933 - RNA, 23 nt, Homo sapiens
guaacuugcuuaaauuucuuaug

SEQ ID NO: 640934 - RNA, 15 nt, Homo sapiens
guaagaaguuuuaaa

SEQ ID NO: 640935 - RNA, 20 nt, Homo sapiens
guaagaauaaagccacugua

SEQ ID NO: 640936 - RNA, 14 nt, Homo sapiens
guaagacucauucc

SEQ ID NO: 640937 - RNA, 15 nt, Homo sapiens
guaagacucauuccc

SEQ ID NO: 640938 - RNA, 19 nt, Homo sapiens
guaagacucgggauuagua

SEQ ID NO: 640939 - RNA, 23 nt, Homo sapiens
guaagacucgggauuaguacaca

SEQ ID NO: 640940 - RNA, 14 nt, Homo sapiens
guaagagguguuau

SEQ ID NO: 640941 - RNA, 16 nt, Homo sapiens
guaagaugacucugag

SEQ ID NO: 640942 - RNA, 20 nt, Homo sapiens
guaagaugcuccugguggcu

SEQ ID NO: 640943 - RNA, 19 nt, Homo sapiens
guaagauuuuccauuguau

SEQ ID NO: 640944 - RNA, 15 nt, Homo sapiens
guaagccaagucaug

SEQ ID NO: 640945 - RNA, 14 nt, Homo sapiens
guaagcucuacuga

SEQ ID NO: 640946 - RNA, 20 nt, Homo sapiens
guaaggcaauccuaagcaaa

SEQ ID NO: 640947 - RNA, 11 nt, Homo sapiens
guaaguauuuu

SEQ ID NO: 640948 - RNA, 14 nt, Homo sapiens
guaagugcugcuau

SEQ ID NO: 640949 - RNA, 14 nt, Homo sapiens
guaaguguucucau

SEQ ID NO: 640950 - RNA, 13 nt, Homo sapiens
guaauaagcaauc

SEQ ID NO: 640951 - RNA, 23 nt, Homo sapiens
guaauaauuggagaagauuuaug

SEQ ID NO: 640952 - RNA, 23 nt, Homo sapiens
guaauaguucuauccuuuugccu

SEQ ID NO: 640953 - RNA, 13 nt, Homo sapiens
guaauauguuaca

SEQ ID NO: 640954 - RNA, 13 nt, Homo sapiens
guaaucauuuuaa

SEQ ID NO: 640955 - RNA, 18 nt, Homo sapiens
guaaucccagcacuuugg

SEQ ID NO: 640956 - RNA, 18 nt, Homo sapiens
guaaucccagcuacucga

SEQ ID NO: 640957 - RNA, 18 nt, Homo sapiens
guaaucccauuucccaaa

SEQ ID NO: 640958 - RNA, 15 nt, Homo sapiens
guaauccucaagaaa

SEQ ID NO: 640959 - RNA, 21 nt, Homo sapiens
guaaucuagguguggcuguga

SEQ ID NO: 640960 - RNA, 18 nt, Homo sapiens
guaaucucucugcagcug

SEQ ID NO: 640961 - RNA, 14 nt, Homo sapiens
guaaucucugugaa

SEQ ID NO: 640962 - RNA, 13 nt, Homo sapiens
guaaucugagcag

SEQ ID NO: 640963 - RNA, 22 nt, Homo sapiens
guaaugaaacaaagaguucaag

SEQ ID NO: 640964 - RNA, 13 nt, Homo sapiens
guaaugaugcuga

SEQ ID NO: 640965 - RNA, 17 nt, Homo sapiens
guaaugcugcacagaaa

SEQ ID NO: 640966 - RNA, 19 nt, Homo sapiens
guaauggaacuuagccauu

SEQ ID NO: 640967 - RNA, 19 nt, Homo sapiens
guaauguauucuaucucuc

SEQ ID NO: 640968 - RNA, 20 nt, Homo sapiens
guaauguuuuauacuguuua

SEQ ID NO: 640969 - RNA, 20 nt, Homo sapiens
guaauugcagauaacuuuga

SEQ ID NO: 640970 - RNA, 23 nt, Homo sapiens
guaauugcauuucugcucuucca

SEQ ID NO: 640971 - RNA, 16 nt, Homo sapiens
guaauuucgccuuaaa

SEQ ID NO: 640972 - RNA, 20 nt, Homo sapiens
guaauuugugauacaaugcu

SEQ ID NO: 640973 - RNA, 22 nt, Homo sapiens
guaauuuuguucuaguuuucag

SEQ ID NO: 640974 - RNA, 16 nt, Homo sapiens
guacaaagauuaguuu

SEQ ID NO: 640975 - RNA, 17 nt, Homo sapiens
guacaaauauaagaaua

SEQ ID NO: 640976 - RNA, 17 nt, Homo sapiens
guacaaauguaagcaaa

SEQ ID NO: 640977 - RNA, 20 nt, Homo sapiens
guacaacccauaaucaugua

SEQ ID NO: 640978 - RNA, 18 nt, Homo sapiens
guacaaguuuuguauaaa

SEQ ID NO: 640979 - RNA, 12 nt, Homo sapiens
guacaaugacuu

SEQ ID NO: 640980 - RNA, 12 nt, Homo sapiens
guacacaacaau

SEQ ID NO: 640981 - RNA, 16 nt, Homo sapiens
guacacagcaccagaa

SEQ ID NO: 640982 - RNA, 22 nt, Homo sapiens
guacacagugagaguacucacu

SEQ ID NO: 640983 - RNA, 14 nt, Homo sapiens
guacagaaugcuau

SEQ ID NO: 640984 - RNA, 14 nt, Homo sapiens
guacagacauauuu

SEQ ID NO: 640985 - RNA, 16 nt, Homo sapiens
guacagaguaaccuau

SEQ ID NO: 640986 - RNA, 16 nt, Homo sapiens
guacagauugcugcuu

SEQ ID NO: 640987 - RNA, 18 nt, Homo sapiens
guacaggaaggugccugg

SEQ ID NO: 640988 - RNA, 19 nt, Homo sapiens
guacaggaaugaaccuucu

SEQ ID NO: 640989 - RNA, 15 nt, Homo sapiens
guacaggcaacaaug

SEQ ID NO: 640990 - RNA, 16 nt, Homo sapiens
guacaggcaacaauga

SEQ ID NO: 640991 - RNA, 13 nt, Homo sapiens
guacagugucuuu

SEQ ID NO: 640992 - RNA, 20 nt, Homo sapiens
guacauaaauuccagaggac

SEQ ID NO: 640993 - RNA, 16 nt, Homo sapiens
guacauagucuguucc

SEQ ID NO: 640994 - RNA, 21 nt, Homo sapiens
guacaucaaguccaucugaca

SEQ ID NO: 640995 - RNA, 23 nt, Homo sapiens
guacaugauaaaugauagacaau

SEQ ID NO: 640996 - RNA, 17 nt, Homo sapiens
guacaugguguuugugg

SEQ ID NO: 640997 - RNA, 17 nt, Homo sapiens
guacauguuaaacuuac

SEQ ID NO: 640998 - RNA, 16 nt, Homo sapiens
guacauuugugcucca

SEQ ID NO: 640999 - RNA, 21 nt, Homo sapiens
guacauuuuuuaacuuucuag

SEQ ID NO: 641000 - RNA, 22 nt, Homo sapiens
guaccaauucagugucuguucc

SEQ ID NO: 641001 - RNA, 14 nt, Homo sapiens
guaccacacauauu

SEQ ID NO: 641002 - RNA, 22 nt, Homo sapiens
guaccacacuagaauucaugug

SEQ ID NO: 641003 - RNA, 15 nt, Homo sapiens
guaccacuuuugcaa

SEQ ID NO: 641004 - RNA, 21 nt, Homo sapiens
guacccacucuggagcauuuc

SEQ ID NO: 641005 - RNA, 15 nt, Homo sapiens
guaccccauggagcu

SEQ ID NO: 641006 - RNA, 17 nt, Homo sapiens
guaccccccuaccacac

SEQ ID NO: 641007 - RNA, 22 nt, Homo sapiens
guacccucgcaugacuguuaca

SEQ ID NO: 641008 - RNA, 14 nt, Homo sapiens
guacccuuccaccu

SEQ ID NO: 641009 - RNA, 21 nt, Homo sapiens
guacccuuucaaacuauuuau

SEQ ID NO: 641010 - RNA, 20 nt, Homo sapiens
guaccucaaucuauucugua

SEQ ID NO: 641011 - RNA, 14 nt, Homo sapiens
guaccucucuuaua

SEQ ID NO: 641012 - RNA, 18 nt, Homo sapiens
guaccucuucccaugacu

SEQ ID NO: 641013 - RNA, 14 nt, Homo sapiens
guaccugaugcuau

SEQ ID NO: 641014 - RNA, 18 nt, Homo sapiens
guaccugcccccaaucca

SEQ ID NO: 641015 - RNA, 15 nt, Homo sapiens
guaccuguuccuccc

SEQ ID NO: 641016 - RNA, 12 nt, Homo sapiens
guaccuucccac

SEQ ID NO: 641017 - RNA, 18 nt, Homo sapiens
guaccuugaacacugggg

SEQ ID NO: 641018 - RNA, 15 nt, Homo sapiens
guacgaugacagugu

SEQ ID NO: 641019 - RNA, 15 nt, Homo sapiens
guacguugugcauuu

SEQ ID NO: 641020 - RNA, 17 nt, Homo sapiens
guacguugugcauuugg

SEQ ID NO: 641021 - RNA, 16 nt, Homo sapiens
guacuagcaguguuuc

SEQ ID NO: 641022 - RNA, 14 nt, Homo sapiens
guacuagugccauu

SEQ ID NO: 641023 - RNA, 16 nt, Homo sapiens
guacuauguaucaaug

SEQ ID NO: 641024 - RNA, 16 nt, Homo sapiens
guacucacacaugcca

SEQ ID NO: 641025 - RNA, 16 nt, Homo sapiens
guacucacuuuuucca

SEQ ID NO: 641026 - RNA, 18 nt, Homo sapiens
guacuccucacuuuucaa

SEQ ID NO: 641027 - RNA, 13 nt, Homo sapiens
guacucuccugga

SEQ ID NO: 641028 - RNA, 15 nt, Homo sapiens
guacucuugcugaug

SEQ ID NO: 641029 - RNA, 17 nt, Homo sapiens
guacucuuuaacauaca

SEQ ID NO: 641030 - RNA, 21 nt, Homo sapiens
guacugcaagaaggagcucag

SEQ ID NO: 641031 - RNA, 15 nt, Homo sapiens
guacugcacaaggac

SEQ ID NO: 641032 - RNA, 14 nt, Homo sapiens
guacuguacagggu

SEQ ID NO: 641033 - RNA, 16 nt, Homo sapiens
guacugugcaguuuuc

SEQ ID NO: 641034 - RNA, 21 nt, Homo sapiens
guacuuaucccugcucuccca

SEQ ID NO: 641035 - RNA, 16 nt, Homo sapiens
guacuuauguugcaca

SEQ ID NO: 641036 - RNA, 18 nt, Homo sapiens
guacuuccuguguacucu

SEQ ID NO: 641037 - RNA, 15 nt, Homo sapiens
guacuucuguguuca

SEQ ID NO: 641038 - RNA, 14 nt, Homo sapiens
guacuuuaccugaa

SEQ ID NO: 641039 - RNA, 20 nt, Homo sapiens
guacuuugaguauaacauca

SEQ ID NO: 641040 - RNA, 18 nt, Homo sapiens
guacuuuuauaaugaaaa

SEQ ID NO: 641041 - RNA, 21 nt, Homo sapiens
guacuuuucuguucaucacca

SEQ ID NO: 641042 - RNA, 15 nt, Homo sapiens
guacuuuuuccagac

SEQ ID NO: 641043 - RNA, 23 nt, Homo sapiens
guagaaaaagcaguaacugacaa

SEQ ID NO: 641044 - RNA, 22 nt, Homo sapiens
guagaaaauuuguuauuuugca

SEQ ID NO: 641045 - RNA, 18 nt, Homo sapiens
guagaaauaauaugcauu

SEQ ID NO: 641046 - RNA, 19 nt, Homo sapiens
guagaacucacagaaauaa

SEQ ID NO: 641047 - RNA, 20 nt, Homo sapiens
cucugcaggccuaggugcag

SEQ ID NO: 641048 - RNA, 17 nt, Homo sapiens
cucugcaguccuacuca

SEQ ID NO: 641049 - RNA, 19 nt, Homo sapiens
cucugccagccacauccaa

SEQ ID NO: 641050 - RNA, 20 nt, Homo sapiens
cucugcccaaacauaaagag

SEQ ID NO: 641051 - RNA, 21 nt, Homo sapiens
cucugccccucagggggccag

SEQ ID NO: 641052 - RNA, 11 nt, Homo sapiens
cucugccccug

SEQ ID NO: 641053 - RNA, 15 nt, Homo sapiens
cucugccuuaaacac

SEQ ID NO: 641054 - RNA, 24 nt, Homo sapiens
cucugccuuaaacacacauugcag

SEQ ID NO: 641055 - RNA, 21 nt, Homo sapiens
cucugcgccggacuuggugcg

SEQ ID NO: 641056 - RNA, 14 nt, Homo sapiens
cucugcugcaucuu

SEQ ID NO: 641057 - RNA, 20 nt, Homo sapiens
cucugcugucuaaccuguga

SEQ ID NO: 641058 - RNA, 22 nt, Homo sapiens
cucugcuuaaacaaagcaguau

SEQ ID NO: 641059 - RNA, 12 nt, Homo sapiens
cucugcuuacuu

SEQ ID NO: 641060 - RNA, 14 nt, Homo sapiens
cucugcuucuccaa

SEQ ID NO: 641061 - RNA, 17 nt, Homo sapiens
cucuggaaaaagacuga

SEQ ID NO: 641062 - RNA, 22 nt, Homo sapiens
cucuggaaaacucaggauucuc

SEQ ID NO: 641063 - RNA, 18 nt, Homo sapiens
cucuggaaaaugugaccc

SEQ ID NO: 641064 - RNA, 20 nt, Homo sapiens
cucuggaaagaaacauguga

SEQ ID NO: 641065 - RNA, 14 nt, Homo sapiens
cucuggaagaccug

SEQ ID NO: 641066 - RNA, 20 nt, Homo sapiens
cucuggacacucuauaugua

SEQ ID NO: 641067 - RNA, 11 nt, Homo sapiens
cucuggaccaa

SEQ ID NO: 641068 - RNA, 16 nt, Homo sapiens
cucuggaccagccugu

SEQ ID NO: 641069 - RNA, 16 nt, Homo sapiens
cucuggaccauauacc

SEQ ID NO: 641070 - RNA, 22 nt, Homo sapiens
cucuggaccugucucuaccuaa

SEQ ID NO: 641071 - RNA, 17 nt, Homo sapiens
cucuggagaguaaucug

SEQ ID NO: 641072 - RNA, 20 nt, Homo sapiens
cucuggagcaauguugcuua

SEQ ID NO: 641073 - RNA, 17 nt, Homo sapiens
cucuggagcagccaagg

SEQ ID NO: 641074 - RNA, 18 nt, Homo sapiens
cucuggaggaaguucucc

SEQ ID NO: 641075 - RNA, 19 nt, Homo sapiens
cucuggaggccucuggccc

SEQ ID NO: 641076 - RNA, 14 nt, Homo sapiens
cucuggauucccuu

SEQ ID NO: 641077 - RNA, 14 nt, Homo sapiens
cucuggcacaguga

SEQ ID NO: 641078 - RNA, 15 nt, Homo sapiens
cucuggcgacaguuu

SEQ ID NO: 641079 - RNA, 17 nt, Homo sapiens
cucuggcgacaguuuuc

SEQ ID NO: 641080 - RNA, 16 nt, Homo sapiens
cucuggcucucauggg

SEQ ID NO: 641081 - RNA, 16 nt, Homo sapiens
cucuggcuggucuuca

SEQ ID NO: 641082 - RNA, 23 nt, Homo sapiens
cucuggcuucccuaaacugcagc

SEQ ID NO: 641083 - RNA, 21 nt, Homo sapiens
cucuggcuuccugcugagucc

SEQ ID NO: 641084 - RNA, 22 nt, Homo sapiens
cucuggcuuugccuuggcuuug

SEQ ID NO: 641085 - RNA, 21 nt, Homo sapiens
cucugggaauuuggagugacc

SEQ ID NO: 641086 - RNA, 17 nt, Homo sapiens
cucugguaugaauucac

SEQ ID NO: 641087 - RNA, 19 nt, Homo sapiens
cucugguccuucugacccc

SEQ ID NO: 641088 - RNA, 13 nt, Homo sapiens
cucugguggcaca

SEQ ID NO: 641089 - RNA, 21 nt, Homo sapiens
cucugguggcaggugccuugu

SEQ ID NO: 641090 - RNA, 22 nt, Homo sapiens
cucugguggccacuucauucca

SEQ ID NO: 641091 - RNA, 19 nt, Homo sapiens
cucuguaaaaacacugaaa

SEQ ID NO: 641092 - RNA, 19 nt, Homo sapiens
cucuguaaguguagcucaa

SEQ ID NO: 641093 - RNA, 14 nt, Homo sapiens
cucuguaauugaau

SEQ ID NO: 641094 - RNA, 13 nt, Homo sapiens
cucuguagagggu

SEQ ID NO: 641095 - RNA, 19 nt, Homo sapiens
cucuguaggucauuggcca

SEQ ID NO: 641096 - RNA, 14 nt, Homo sapiens
cucugucauaugca

SEQ ID NO: 641097 - RNA, 18 nt, Homo sapiens
cucuguccaaacauuuca

SEQ ID NO: 641098 - RNA, 23 nt, Homo sapiens
cucuguccuggaggcacugggaa

SEQ ID NO: 641099 - RNA, 17 nt, Homo sapiens
cucugucgccaggcuag

SEQ ID NO: 641100 - RNA, 21 nt, Homo sapiens
cucugugaacgauuuagaaag

SEQ ID NO: 641101 - RNA, 18 nt, Homo sapiens
cucugugaauugaaaugu

SEQ ID NO: 641102 - RNA, 17 nt, Homo sapiens
cucugugcccuccagca

SEQ ID NO: 641103 - RNA, 15 nt, Homo sapiens
cucugugcucugaau

SEQ ID NO: 641104 - RNA, 20 nt, Homo sapiens
cucugugcuucgacuacugc

SEQ ID NO: 641105 - RNA, 12 nt, Homo sapiens
cucugugcuuug

SEQ ID NO: 641106 - RNA, 13 nt, Homo sapiens
cucuguuaccaca

SEQ ID NO: 641107 - RNA, 15 nt, Homo sapiens
cucuguucauuucac

SEQ ID NO: 641108 - RNA, 15 nt, Homo sapiens
cucuguuuacaucuc

SEQ ID NO: 641109 - RNA, 23 nt, Homo sapiens
cucuguuucucuuuccuuggcuc

SEQ ID NO: 641110 - RNA, 15 nt, Homo sapiens
cucuguuucuucaau

SEQ ID NO: 641111 - RNA, 18 nt, Homo sapiens
cucuuaaaagaugccuua

SEQ ID NO: 641112 - RNA, 14 nt, Homo sapiens
cucuuaaaucauuu

SEQ ID NO: 641113 - RNA, 19 nt, Homo sapiens
cucuuaagccuaaaugccu

SEQ ID NO: 641114 - RNA, 22 nt, Homo sapiens
cucuuaagcuuccgccgucuca

SEQ ID NO: 641115 - RNA, 17 nt, Homo sapiens
cucuuaaucacuacugu

SEQ ID NO: 641116 - RNA, 19 nt, Homo sapiens
cucuuaaucacuacuguau

SEQ ID NO: 641117 - RNA, 14 nt, Homo sapiens
cucuuaauguugcu

SEQ ID NO: 641118 - RNA, 22 nt, Homo sapiens
cucuuacguggagagugcacug

SEQ ID NO: 641119 - RNA, 16 nt, Homo sapiens
cucuuagacccacaga

SEQ ID NO: 641120 - RNA, 17 nt, Homo sapiens
cucuuagcuuacaggaa

SEQ ID NO: 641121 - RNA, 14 nt, Homo sapiens
cucuuaguagggac

SEQ ID NO: 641122 - RNA, 18 nt, Homo sapiens
cucuuaugugugccuuug

SEQ ID NO: 641123 - RNA, 15 nt, Homo sapiens
cucuucaacaugaca

SEQ ID NO: 641124 - RNA, 19 nt, Homo sapiens
cucuucaacugaccagccu

SEQ ID NO: 641125 - RNA, 15 nt, Homo sapiens
cucuucaaguacugu

SEQ ID NO: 641126 - RNA, 16 nt, Homo sapiens
cucuucaaucucuugc

SEQ ID NO: 641127 - RNA, 14 nt, Homo sapiens
cucuucaccacugu

SEQ ID NO: 641128 - RNA, 16 nt, Homo sapiens
cucuucagaacacaca

SEQ ID NO: 641129 - RNA, 16 nt, Homo sapiens
cucuucaguuaauucu

SEQ ID NO: 641130 - RNA, 20 nt, Homo sapiens
cucuuccaaaggcauaagac

SEQ ID NO: 641131 - RNA, 19 nt, Homo sapiens
cucuuccagaagaugcccu

SEQ ID NO: 641132 - RNA, 12 nt, Homo sapiens
cucuucccacau

SEQ ID NO: 641133 - RNA, 19 nt, Homo sapiens
cucuucccuuccuccauug

SEQ ID NO: 641134 - RNA, 21 nt, Homo sapiens
cucuucccuuccuccauugca

SEQ ID NO: 641135 - RNA, 14 nt, Homo sapiens
cucuucgauguacu

SEQ ID NO: 641136 - RNA, 23 nt, Homo sapiens
cucuucuaaaaaaugauacacac

SEQ ID NO: 641137 - RNA, 19 nt, Homo sapiens
cucuucuacuuguaaaaug

SEQ ID NO: 641138 - RNA, 14 nt, Homo sapiens
cucuucuccacugg

SEQ ID NO: 641139 - RNA, 23 nt, Homo sapiens
cucuucuggacugcacacuucca

SEQ ID NO: 641140 - RNA, 20 nt, Homo sapiens
cucuucugggcuacugccac

SEQ ID NO: 641141 - RNA, 17 nt, Homo sapiens
cucuucuuuauugcacu

SEQ ID NO: 641142 - RNA, 22 nt, Homo sapiens
cucuucuuuuggcuuccaugau

SEQ ID NO: 641143 - RNA, 22 nt, Homo sapiens
cucuucuuuuuucuuguugcaa

SEQ ID NO: 641144 - RNA, 12 nt, Homo sapiens
cucuugacuacu

SEQ ID NO: 641145 - RNA, 13 nt, Homo sapiens
cucuugagcauca

SEQ ID NO: 641146 - RNA, 17 nt, Homo sapiens
cucuugagucacacugc

SEQ ID NO: 641147 - RNA, 16 nt, Homo sapiens
cucuugaguuccucug

SEQ ID NO: 641148 - RNA, 21 nt, Homo sapiens
cucuugaguuccucugcaguu

SEQ ID NO: 641149 - RNA, 13 nt, Homo sapiens
cucuugcacucaa

SEQ ID NO: 641150 - RNA, 15 nt, Homo sapiens
cucuugcugccagcu

SEQ ID NO: 641151 - RNA, 12 nt, Homo sapiens
cucuugcugucu

SEQ ID NO: 641152 - RNA, 14 nt, Homo sapiens
cucuugcuuucaca

SEQ ID NO: 641153 - RNA, 21 nt, Homo sapiens
cucuuggaauuacaagcccug

SEQ ID NO: 641154 - RNA, 14 nt, Homo sapiens
cucuuggcagucac

SEQ ID NO: 641155 - RNA, 20 nt, Homo sapiens
cucuuggguucaagugauuc

SEQ ID NO: 641156 - RNA, 19 nt, Homo sapiens
cucuuggugugauugcaca

SEQ ID NO: 641157 - RNA, 19 nt, Homo sapiens
cucuuguaauaaaaugucu

SEQ ID NO: 641158 - RNA, 14 nt, Homo sapiens
cucuuguacuugau

SEQ ID NO: 641159 - RNA, 12 nt, Homo sapiens
cucuugugcauu

SEQ ID NO: 641160 - RNA, 17 nt, Homo sapiens
cucuuguggugcauuga

SEQ ID NO: 641161 - RNA, 13 nt, Homo sapiens
cucuuguuauuau

SEQ ID NO: 641162 - RNA, 17 nt, Homo sapiens
cucuuguugagugccag

SEQ ID NO: 641163 - RNA, 18 nt, Homo sapiens
cucuuguugagugccagc

SEQ ID NO: 641164 - RNA, 20 nt, Homo sapiens
cucuuguuucuuuucacaua

SEQ ID NO: 641165 - RNA, 14 nt, Homo sapiens
cucuuuaaguauuu

SEQ ID NO: 641166 - RNA, 15 nt, Homo sapiens
cucuuuaaucuucag

SEQ ID NO: 641167 - RNA, 21 nt, Homo sapiens
cucuuuaguauaauugaccua

SEQ ID NO: 641168 - RNA, 12 nt, Homo sapiens
cucuuucacuuc

SEQ ID NO: 641169 - RNA, 16 nt, Homo sapiens
cucuuucgcuuggcag

SEQ ID NO: 641170 - RNA, 13 nt, Homo sapiens
guagaacuuggau

SEQ ID NO: 641171 - RNA, 17 nt, Homo sapiens
guagaagguaacucuuu

SEQ ID NO: 641172 - RNA, 18 nt, Homo sapiens
guagaauauucagacaaa

SEQ ID NO: 641173 - RNA, 21 nt, Homo sapiens
guagaaucucuucaugcuuga

SEQ ID NO: 641174 - RNA, 21 nt, Homo sapiens
guagaccuagggaggaccuua

SEQ ID NO: 641175 - RNA, 17 nt, Homo sapiens
guagacucauucuucac

SEQ ID NO: 641176 - RNA, 12 nt, Homo sapiens
guagacuguggc

SEQ ID NO: 641177 - RNA, 18 nt, Homo sapiens
guagacuuuugcuuuaug

SEQ ID NO: 641178 - RNA, 21 nt, Homo sapiens
guagagaaaagcacacuugua

SEQ ID NO: 641179 - RNA, 15 nt, Homo sapiens
guagagaagcaagua

SEQ ID NO: 641180 - RNA, 18 nt, Homo sapiens
guagagaggggacugggg

SEQ ID NO: 641181 - RNA, 22 nt, Homo sapiens
guagagggaguugucaagucuc

SEQ ID NO: 641182 - RNA, 14 nt, Homo sapiens
guagaguggugcug

SEQ ID NO: 641183 - RNA, 17 nt, Homo sapiens
guagaguuagcugauaa

SEQ ID NO: 641184 - RNA, 17 nt, Homo sapiens
guagaguucacuguugu

SEQ ID NO: 641185 - RNA, 15 nt, Homo sapiens
guagauguagcauug

SEQ ID NO: 641186 - RNA, 15 nt, Homo sapiens
guagauguaugcaca

SEQ ID NO: 641187 - RNA, 12 nt, Homo sapiens
guagaugugcug

SEQ ID NO: 641188 - RNA, 21 nt, Homo sapiens
guagauuacugaaaaaugcaa

SEQ ID NO: 641189 - RNA, 18 nt, Homo sapiens
guagauuuuaaaagauaa

SEQ ID NO: 641190 - RNA, 18 nt, Homo sapiens
guagcaaguucuagagaa

SEQ ID NO: 641191 - RNA, 13 nt, Homo sapiens
guagcagcuauau

SEQ ID NO: 641192 - RNA, 16 nt, Homo sapiens
guagcagguuucacua

SEQ ID NO: 641193 - RNA, 15 nt, Homo sapiens
guagcaucuuccucu

SEQ ID NO: 641194 - RNA, 18 nt, Homo sapiens
guagcauuuuaaacaaaa

SEQ ID NO: 641195 - RNA, 22 nt, Homo sapiens
guagcauuuuucuaaaaccuua

SEQ ID NO: 641196 - RNA, 12 nt, Homo sapiens
guagccagguac

SEQ ID NO: 641197 - RNA, 18 nt, Homo sapiens
guagccuaacacacucca

SEQ ID NO: 641198 - RNA, 15 nt, Homo sapiens
guagccuucuucccu

SEQ ID NO: 641199 - RNA, 16 nt, Homo sapiens
guagcuaaagugcaag

SEQ ID NO: 641200 - RNA, 16 nt, Homo sapiens
guagcucaaucugcaa

SEQ ID NO: 641201 - RNA, 16 nt, Homo sapiens
guagcucucccuaggc

SEQ ID NO: 641202 - RNA, 13 nt, Homo sapiens
guagcugaugaaa

SEQ ID NO: 641203 - RNA, 24 nt, Homo sapiens
guagcugggacuacaggugugcac

SEQ ID NO: 641204 - RNA, 16 nt, Homo sapiens
guagcugggauuacag

SEQ ID NO: 641205 - RNA, 17 nt, Homo sapiens
guagcugggauuacaga

SEQ ID NO: 641206 - RNA, 23 nt, Homo sapiens
guagcugggccugugcacugggc

SEQ ID NO: 641207 - RNA, 22 nt, Homo sapiens
guagcuuuccacauuugucaca

SEQ ID NO: 641208 - RNA, 14 nt, Homo sapiens
guaggaacaagcau

SEQ ID NO: 641209 - RNA, 21 nt, Homo sapiens
guaggaccaagcaucuugggg

SEQ ID NO: 641210 - RNA, 21 nt, Homo sapiens
guaggagcugccuuggcucag

SEQ ID NO: 641211 - RNA, 13 nt, Homo sapiens
guaggauugcugu

SEQ ID NO: 641212 - RNA, 20 nt, Homo sapiens
guaggcaggaaggacugucc

SEQ ID NO: 641213 - RNA, 13 nt, Homo sapiens
guaggcagggaac

SEQ ID NO: 641214 - RNA, 23 nt, Homo sapiens
guaggcgaaucauuuguucaaag

SEQ ID NO: 641215 - RNA, 16 nt, Homo sapiens
guaggcuuaguuugug

SEQ ID NO: 641216 - RNA, 14 nt, Homo sapiens
guaggggcaaaaau

SEQ ID NO: 641217 - RNA, 13 nt, Homo sapiens
guagguaagggcc

SEQ ID NO: 641218 - RNA, 21 nt, Homo sapiens
guagguaggucuguuugccac

SEQ ID NO: 641219 - RNA, 17 nt, Homo sapiens
guaggucauugcaccua

SEQ ID NO: 641220 - RNA, 16 nt, Homo sapiens
guagguggaucaccug

SEQ ID NO: 641221 - RNA, 16 nt, Homo sapiens
guagguuaacacugaa

SEQ ID NO: 641222 - RNA, 15 nt, Homo sapiens
guaguaccccaagaa

SEQ ID NO: 641223 - RNA, 20 nt, Homo sapiens
guaguauuaaaaguugcauu

SEQ ID NO: 641224 - RNA, 15 nt, Homo sapiens
guaguauuuuugcca

SEQ ID NO: 641225 - RNA, 15 nt, Homo sapiens
guagugaaauuauac

SEQ ID NO: 641226 - RNA, 12 nt, Homo sapiens
guagugaccuaa

SEQ ID NO: 641227 - RNA, 20 nt, Homo sapiens
guaguuagcaacuagggcua

SEQ ID NO: 641228 - RNA, 16 nt, Homo sapiens
guaguuagccaucuaa

SEQ ID NO: 641229 - RNA, 18 nt, Homo sapiens
guaguucaauagucuaau

SEQ ID NO: 641230 - RNA, 11 nt, Homo sapiens
guaguuugugc

SEQ ID NO: 641231 - RNA, 21 nt, Homo sapiens
guaguuuuuacagcuguguua

SEQ ID NO: 641232 - RNA, 19 nt, Homo sapiens
guauaaaaauuaucaaaaa

SEQ ID NO: 641233 - RNA, 13 nt, Homo sapiens
guauaaacacucu

SEQ ID NO: 641234 - RNA, 16 nt, Homo sapiens
guauaaacaugacccu

SEQ ID NO: 641235 - RNA, 17 nt, Homo sapiens
guauaaagucacuucca

SEQ ID NO: 641236 - RNA, 14 nt, Homo sapiens
guauaaauggaccu

SEQ ID NO: 641237 - RNA, 21 nt, Homo sapiens
guauaaauuaaauaaacuguu

SEQ ID NO: 641238 - RNA, 19 nt, Homo sapiens
guauaacacaauaugaaua

SEQ ID NO: 641239 - RNA, 14 nt, Homo sapiens
guauaagcacugaa

SEQ ID NO: 641240 - RNA, 22 nt, Homo sapiens
guauaagcacugaaaaacaaca

SEQ ID NO: 641241 - RNA, 14 nt, Homo sapiens
guauaagcaucugc

SEQ ID NO: 641242 - RNA, 17 nt, Homo sapiens
guauaagguacauauuu

SEQ ID NO: 641243 - RNA, 21 nt, Homo sapiens
guauaaguggaggcacuuuag

SEQ ID NO: 641244 - RNA, 15 nt, Homo sapiens
guauaauagagauaa

SEQ ID NO: 641245 - RNA, 21 nt, Homo sapiens
guauaauucaaagcaccaaaa

SEQ ID NO: 641246 - RNA, 14 nt, Homo sapiens
guauaauugaccua

SEQ ID NO: 641247 - RNA, 20 nt, Homo sapiens
guauacauaaguuuaggaua

SEQ ID NO: 641248 - RNA, 16 nt, Homo sapiens
guauacauuacaauca

SEQ ID NO: 641249 - RNA, 17 nt, Homo sapiens
guauacuaccauaguga

SEQ ID NO: 641250 - RNA, 14 nt, Homo sapiens
guauacuauaguac

SEQ ID NO: 641251 - RNA, 16 nt, Homo sapiens
guauagaguacugcag

SEQ ID NO: 641252 - RNA, 23 nt, Homo sapiens
guauagcauuuuuauucaugcca

SEQ ID NO: 641253 - RNA, 21 nt, Homo sapiens
guauaggggcaacuguaugaa

SEQ ID NO: 641254 - RNA, 13 nt, Homo sapiens
guauaguguucac

SEQ ID NO: 641255 - RNA, 21 nt, Homo sapiens
guauauaaauuuucccaaaac

SEQ ID NO: 641256 - RNA, 15 nt, Homo sapiens
guauauacaauaaca

SEQ ID NO: 641257 - RNA, 16 nt, Homo sapiens
guauauauaauacuga

SEQ ID NO: 641258 - RNA, 10 nt, Homo sapiens
guauaugcac

SEQ ID NO: 641259 - RNA, 19 nt, Homo sapiens
guauauuaagaagcaauaa

SEQ ID NO: 641260 - RNA, 18 nt, Homo sapiens
guauauuacaaugaucac

SEQ ID NO: 641261 - RNA, 20 nt, Homo sapiens
guauauucugguuacugugg

SEQ ID NO: 641262 - RNA, 23 nt, Homo sapiens
guauauuugugauagcacuuucu

SEQ ID NO: 641263 - RNA, 14 nt, Homo sapiens
guaucaaaugugac

SEQ ID NO: 641264 - RNA, 21 nt, Homo sapiens
guaucaaaugugacauuauau

SEQ ID NO: 641265 - RNA, 16 nt, Homo sapiens
guaucaacacuguuac

SEQ ID NO: 641266 - RNA, 12 nt, Homo sapiens
guaucacagugu

SEQ ID NO: 641267 - RNA, 13 nt, Homo sapiens
guaucacucccac

SEQ ID NO: 641268 - RNA, 17 nt, Homo sapiens
guaucaugcccugugca

SEQ ID NO: 641269 - RNA, 12 nt, Homo sapiens
guaucauuacau

SEQ ID NO: 641270 - RNA, 12 nt, Homo sapiens
guaucauucaac

SEQ ID NO: 641271 - RNA, 16 nt, Homo sapiens
guauccacaggauauu

SEQ ID NO: 641272 - RNA, 18 nt, Homo sapiens
guaucccacauccaacuc

SEQ ID NO: 641273 - RNA, 23 nt, Homo sapiens
guauccugcgaccuugcaaccuc

SEQ ID NO: 641274 - RNA, 13 nt, Homo sapiens
guaucgcugagac

SEQ ID NO: 641275 - RNA, 14 nt, Homo sapiens
guaucgcugagacu

SEQ ID NO: 641276 - RNA, 19 nt, Homo sapiens
guaucuuccuuucuugucu

SEQ ID NO: 641277 - RNA, 19 nt, Homo sapiens
guaucuuuugaacuggcaa

SEQ ID NO: 641278 - RNA, 23 nt, Homo sapiens
guaucuuuugaacuggcaauugu

SEQ ID NO: 641279 - RNA, 16 nt, Homo sapiens
guaugaaaaucagcau

SEQ ID NO: 641280 - RNA, 14 nt, Homo sapiens
guaugacuaaagag

SEQ ID NO: 641281 - RNA, 14 nt, Homo sapiens
guaugaggcauuug

SEQ ID NO: 641282 - RNA, 15 nt, Homo sapiens
guaugaggcauuugu

SEQ ID NO: 641283 - RNA, 17 nt, Homo sapiens
guaugagucuucuguaa

SEQ ID NO: 641284 - RNA, 16 nt, Homo sapiens
guaugaucaguacuga

SEQ ID NO: 641285 - RNA, 18 nt, Homo sapiens
guaugcacacacauauau

SEQ ID NO: 641286 - RNA, 16 nt, Homo sapiens
guaugcagaauguuuu

SEQ ID NO: 641287 - RNA, 13 nt, Homo sapiens
guaugcaugugaa

SEQ ID NO: 641288 - RNA, 12 nt, Homo sapiens
guaugccaagug

SEQ ID NO: 641289 - RNA, 21 nt, Homo sapiens
guaugccuuaagcagaacaaa

SEQ ID NO: 641290 - RNA, 21 nt, Homo sapiens
guaugccuuuaaaucugugau

SEQ ID NO: 641291 - RNA, 18 nt, Homo sapiens
guaugcuggccagcaccc

SEQ ID NO: 641292 - RNA, 20 nt, Homo sapiens
guauggaaaaaccauuugaa

SEQ ID NO: 641293 - RNA, 13 nt, Homo sapiens
guauggcucugca

SEQ ID NO: 641294 - RNA, 23 nt, Homo sapiens
cucuuucuauuuaugcaacucau

SEQ ID NO: 641295 - RNA, 18 nt, Homo sapiens
cucuuucucucuucccuc

SEQ ID NO: 641296 - RNA, 17 nt, Homo sapiens
cucuuucucugccagug

SEQ ID NO: 641297 - RNA, 18 nt, Homo sapiens
cucuuugaucuacuugcc

SEQ ID NO: 641298 - RNA, 18 nt, Homo sapiens
cucuuugauuauuugcau

SEQ ID NO: 641299 - RNA, 22 nt, Homo sapiens
cucuuuggcuccccuguaccuu

SEQ ID NO: 641300 - RNA, 13 nt, Homo sapiens
cucuuuuccuggc

SEQ ID NO: 641301 - RNA, 14 nt, Homo sapiens
cucuuuucuuucaa

SEQ ID NO: 641302 - RNA, 20 nt, Homo sapiens
cucuuuugagacuuugccca

SEQ ID NO: 641303 - RNA, 13 nt, Homo sapiens
cucuuuugcuuaa

SEQ ID NO: 641304 - RNA, 15 nt, Homo sapiens
cucuuuuggccaaau

SEQ ID NO: 641305 - RNA, 13 nt, Homo sapiens
cucuuuuguggac

SEQ ID NO: 641306 - RNA, 22 nt, Homo sapiens
cucuuuuuguauuuugcaucug

SEQ ID NO: 641307 - RNA, 19 nt, Homo sapiens
cucuuuuuuugagugacag

SEQ ID NO: 641308 - RNA, 18 nt, Homo sapiens
cugaaaaaauacuaccua

SEQ ID NO: 641309 - RNA, 20 nt, Homo sapiens
cugaaaaaugcucaaucuca

SEQ ID NO: 641310 - RNA, 23 nt, Homo sapiens
cugaaaaaugguaauuguugcua

SEQ ID NO: 641311 - RNA, 13 nt, Homo sapiens
cugaaaaauguca

SEQ ID NO: 641312 - RNA, 11 nt, Homo sapiens
cugaaaaccaa

SEQ ID NO: 641313 - RNA, 19 nt, Homo sapiens
cugaaaaccaauguucucu

SEQ ID NO: 641314 - RNA, 14 nt, Homo sapiens
cugaaaaccuacca

SEQ ID NO: 641315 - RNA, 20 nt, Homo sapiens
cugaaaacuaauguacugua

SEQ ID NO: 641316 - RNA, 21 nt, Homo sapiens
cugaaaaugucacauucuauu

SEQ ID NO: 641317 - RNA, 15 nt, Homo sapiens
cugaaacacuggacc

SEQ ID NO: 641318 - RNA, 15 nt, Homo sapiens
cugaaacaucucaac

SEQ ID NO: 641319 - RNA, 13 nt, Homo sapiens
cugaaaccaaaac

SEQ ID NO: 641320 - RNA, 17 nt, Homo sapiens
cugaaacccaaagcccu

SEQ ID NO: 641321 - RNA, 18 nt, Homo sapiens
cugaaacccuugagcuca

SEQ ID NO: 641322 - RNA, 22 nt, Homo sapiens
cugaaacuucucaaccagaaga

SEQ ID NO: 641323 - RNA, 14 nt, Homo sapiens
cugaaagaagacau

SEQ ID NO: 641324 - RNA, 17 nt, Homo sapiens
cugaaagagaaaucaau

SEQ ID NO: 641325 - RNA, 12 nt, Homo sapiens
cugaaagccagg

SEQ ID NO: 641326 - RNA, 22 nt, Homo sapiens
cugaaagccauggagauucuca

SEQ ID NO: 641327 - RNA, 17 nt, Homo sapiens
cugaaagccuuagggaa

SEQ ID NO: 641328 - RNA, 17 nt, Homo sapiens
cugaaaggaacacuggc

SEQ ID NO: 641329 - RNA, 22 nt, Homo sapiens
cugaaaggauguggaagagcau

SEQ ID NO: 641330 - RNA, 21 nt, Homo sapiens
cugaaaggcagaacucagaac

SEQ ID NO: 641331 - RNA, 18 nt, Homo sapiens
cugaaaggggcagauuaa

SEQ ID NO: 641332 - RNA, 22 nt, Homo sapiens
cugaaauaaaaugauaaacaag

SEQ ID NO: 641333 - RNA, 19 nt, Homo sapiens
cugaaaucaagucaucuau

SEQ ID NO: 641334 - RNA, 24 nt, Homo sapiens
cugaaaucugucaagaguaguuau

SEQ ID NO: 641335 - RNA, 22 nt, Homo sapiens
cugaaauuuaagauaaugaguu

SEQ ID NO: 641336 - RNA, 17 nt, Homo sapiens
cugaaauuuauucacau

SEQ ID NO: 641337 - RNA, 16 nt, Homo sapiens
cugaacaaaagcucag

SEQ ID NO: 641338 - RNA, 23 nt, Homo sapiens
cugaacaaacuaaaggugcacug

SEQ ID NO: 641339 - RNA, 22 nt, Homo sapiens
cugaacagaagcucuuacucuu

SEQ ID NO: 641340 - RNA, 12 nt, Homo sapiens
cugaacagccaa

SEQ ID NO: 641341 - RNA, 20 nt, Homo sapiens
cugaacaugccugccaaaga

SEQ ID NO: 641342 - RNA, 18 nt, Homo sapiens
cugaaccaucccugaugu

SEQ ID NO: 641343 - RNA, 14 nt, Homo sapiens
cugaaccauuccaa

SEQ ID NO: 641344 - RNA, 13 nt, Homo sapiens
cugaaccccaugg

SEQ ID NO: 641345 - RNA, 23 nt, Homo sapiens
cugaacccugcuccguuggucag

SEQ ID NO: 641346 - RNA, 15 nt, Homo sapiens
cugaaccuugagcaa

SEQ ID NO: 641347 - RNA, 18 nt, Homo sapiens
cugaacgucuccuagcca

SEQ ID NO: 641348 - RNA, 22 nt, Homo sapiens
cugaacuaauaaaucuguugcc

SEQ ID NO: 641349 - RNA, 17 nt, Homo sapiens
cugaacuccugccauag

SEQ ID NO: 641350 - RNA, 19 nt, Homo sapiens
cugaacuccuggcuuucca

SEQ ID NO: 641351 - RNA, 20 nt, Homo sapiens
cugaacucuuaggcacauca

SEQ ID NO: 641352 - RNA, 17 nt, Homo sapiens
cugaacugcaacacugg

SEQ ID NO: 641353 - RNA, 18 nt, Homo sapiens
cugaacugcaacacugga

SEQ ID NO: 641354 - RNA, 12 nt, Homo sapiens
cugaacugcugu

SEQ ID NO: 641355 - RNA, 18 nt, Homo sapiens
cugaacuuucucccucau

SEQ ID NO: 641356 - RNA, 17 nt, Homo sapiens
cugaagaaaguuauucu

SEQ ID NO: 641357 - RNA, 15 nt, Homo sapiens
cugaagaacaguaac

SEQ ID NO: 641358 - RNA, 20 nt, Homo sapiens
cugaagaacaguaacugcca

SEQ ID NO: 641359 - RNA, 17 nt, Homo sapiens
cugaagaacuuggcaca

SEQ ID NO: 641360 - RNA, 20 nt, Homo sapiens
cugaagaccccaaagaucuc

SEQ ID NO: 641361 - RNA, 23 nt, Homo sapiens
cugaagaucaagccaguucuccu

SEQ ID NO: 641362 - RNA, 20 nt, Homo sapiens
cugaagcuggccuggaccau

SEQ ID NO: 641363 - RNA, 22 nt, Homo sapiens
cugaaggaaaaacacaagcaaa

SEQ ID NO: 641364 - RNA, 18 nt, Homo sapiens
cugaaggcagucauauca

SEQ ID NO: 641365 - RNA, 21 nt, Homo sapiens
cugaaggcauaugcacaguca

SEQ ID NO: 641366 - RNA, 18 nt, Homo sapiens
cugaaggcugaguguccg

SEQ ID NO: 641367 - RNA, 14 nt, Homo sapiens
cugaaggggaaccc

SEQ ID NO: 641368 - RNA, 16 nt, Homo sapiens
cugaaguaaacagcug

SEQ ID NO: 641369 - RNA, 14 nt, Homo sapiens
cugaaguacuuaaa

SEQ ID NO: 641370 - RNA, 21 nt, Homo sapiens
cugaagucaccucuugguuac

SEQ ID NO: 641371 - RNA, 18 nt, Homo sapiens
cugaagugcauccaaagg

SEQ ID NO: 641372 - RNA, 14 nt, Homo sapiens
cugaaguggcuaaa

SEQ ID NO: 641373 - RNA, 14 nt, Homo sapiens
cugaaguuagaaau

SEQ ID NO: 641374 - RNA, 20 nt, Homo sapiens
cugaaguuucacaugagcua

SEQ ID NO: 641375 - RNA, 14 nt, Homo sapiens
cugaauaaauaccu

SEQ ID NO: 641376 - RNA, 16 nt, Homo sapiens
cugaauaaauaccucu

SEQ ID NO: 641377 - RNA, 19 nt, Homo sapiens
cugaauaaauugaacuaaa

SEQ ID NO: 641378 - RNA, 19 nt, Homo sapiens
cugaauaacuugaagaaca

SEQ ID NO: 641379 - RNA, 17 nt, Homo sapiens
cugaauacaaagugaug

SEQ ID NO: 641380 - RNA, 13 nt, Homo sapiens
cugaauaguguca

SEQ ID NO: 641381 - RNA, 22 nt, Homo sapiens
cugaauauggacccugcugaaa

SEQ ID NO: 641382 - RNA, 18 nt, Homo sapiens
cugaauauuaaagcucuu

SEQ ID NO: 641383 - RNA, 14 nt, Homo sapiens
cugaaucaugagcc

SEQ ID NO: 641384 - RNA, 16 nt, Homo sapiens
cugaaugaccucucua

SEQ ID NO: 641385 - RNA, 17 nt, Homo sapiens
cugaaugcugcuacuua

SEQ ID NO: 641386 - RNA, 23 nt, Homo sapiens
cugaauucaguugcuuugcccaa

SEQ ID NO: 641387 - RNA, 20 nt, Homo sapiens
cugaauucuuuuucauuuga

SEQ ID NO: 641388 - RNA, 13 nt, Homo sapiens
cugaauugcacau

SEQ ID NO: 641389 - RNA, 13 nt, Homo sapiens
cugaauuuugcuu

SEQ ID NO: 641390 - RNA, 21 nt, Homo sapiens
cugaauuuuggggauuuucaa

SEQ ID NO: 641391 - RNA, 16 nt, Homo sapiens
cugacaaauauuuuag

SEQ ID NO: 641392 - RNA, 17 nt, Homo sapiens
cugacaaauauuuuaga

SEQ ID NO: 641393 - RNA, 17 nt, Homo sapiens
cugacaaauuuuaauua

SEQ ID NO: 641394 - RNA, 23 nt, Homo sapiens
cugacaagagaggcgucugcugu

SEQ ID NO: 641395 - RNA, 22 nt, Homo sapiens
cugacaagggacuagugaguca

SEQ ID NO: 641396 - RNA, 22 nt, Homo sapiens
cugacacaagaauggucuuucu

SEQ ID NO: 641397 - RNA, 13 nt, Homo sapiens
cugacacagccac

SEQ ID NO: 641398 - RNA, 23 nt, Homo sapiens
cugacacaguaaaauuaacucug

SEQ ID NO: 641399 - RNA, 12 nt, Homo sapiens
cugacaccuacc

SEQ ID NO: 641400 - RNA, 22 nt, Homo sapiens
cugacacggccucccucugcua

SEQ ID NO: 641401 - RNA, 16 nt, Homo sapiens
cugacacuuucugcug

SEQ ID NO: 641402 - RNA, 21 nt, Homo sapiens
cugacagaaggugccacuuua

SEQ ID NO: 641403 - RNA, 13 nt, Homo sapiens
cugacagcaauaa

SEQ ID NO: 641404 - RNA, 17 nt, Homo sapiens
cugacagcuucaugaaa

SEQ ID NO: 641405 - RNA, 19 nt, Homo sapiens
cugacagggccagugcagu

SEQ ID NO: 641406 - RNA, 15 nt, Homo sapiens
cugacauaugcuaac

SEQ ID NO: 641407 - RNA, 23 nt, Homo sapiens
cugacauaugcuaacccccaaau

SEQ ID NO: 641408 - RNA, 18 nt, Homo sapiens
cugacauauucaagugau

SEQ ID NO: 641409 - RNA, 11 nt, Homo sapiens
cugacauugcc

SEQ ID NO: 641410 - RNA, 19 nt, Homo sapiens
cugacauuuuuuccuaagg

SEQ ID NO: 641411 - RNA, 23 nt, Homo sapiens
cugaccaaacagccaacuagccc

SEQ ID NO: 641412 - RNA, 14 nt, Homo sapiens
cugaccaacgcaca

SEQ ID NO: 641413 - RNA, 15 nt, Homo sapiens
cugaccaauauugua

SEQ ID NO: 641414 - RNA, 21 nt, Homo sapiens
cugaccaauauuguacaguuu

SEQ ID NO: 641415 - RNA, 19 nt, Homo sapiens
cugaccacagcacagccaa

SEQ ID NO: 641416 - RNA, 13 nt, Homo sapiens
guaugggaucuga

SEQ ID NO: 641417 - RNA, 21 nt, Homo sapiens
guauguauacacacauauaca

SEQ ID NO: 641418 - RNA, 16 nt, Homo sapiens
guauguauauauacac

SEQ ID NO: 641419 - RNA, 14 nt, Homo sapiens
guaugucuaccugg

SEQ ID NO: 641420 - RNA, 17 nt, Homo sapiens
guaugugaaacacacau

SEQ ID NO: 641421 - RNA, 18 nt, Homo sapiens
guaugugcgugugugcaa

SEQ ID NO: 641422 - RNA, 16 nt, Homo sapiens
guauguuaugaacaug

SEQ ID NO: 641423 - RNA, 22 nt, Homo sapiens
guauguugucauaacauuuaaa

SEQ ID NO: 641424 - RNA, 22 nt, Homo sapiens
guauguuuuaauugcauuuaaa

SEQ ID NO: 641425 - RNA, 20 nt, Homo sapiens
guauuaacuuuauacacuug

SEQ ID NO: 641426 - RNA, 18 nt, Homo sapiens
guauuaauaaagcauucu

SEQ ID NO: 641427 - RNA, 18 nt, Homo sapiens
guauuauucuguuuugca

SEQ ID NO: 641428 - RNA, 15 nt, Homo sapiens
guauucaagcaaaca

SEQ ID NO: 641429 - RNA, 20 nt, Homo sapiens
guauuccaugagcugcucau

SEQ ID NO: 641430 - RNA, 23 nt, Homo sapiens
guauuccauuucuggacaugacg

SEQ ID NO: 641431 - RNA, 20 nt, Homo sapiens
guauucccacaccaggucuu

SEQ ID NO: 641432 - RNA, 18 nt, Homo sapiens
guauuccgauacaaagug

SEQ ID NO: 641433 - RNA, 15 nt, Homo sapiens
guauucuuauuuaau

SEQ ID NO: 641434 - RNA, 16 nt, Homo sapiens
guauugaaaacuucaa

SEQ ID NO: 641435 - RNA, 12 nt, Homo sapiens
guauugacugua

SEQ ID NO: 641436 - RNA, 19 nt, Homo sapiens
guauugacuguaccacaga

SEQ ID NO: 641437 - RNA, 15 nt, Homo sapiens
guauuguugaaaaag

SEQ ID NO: 641438 - RNA, 20 nt, Homo sapiens
guauuguugcuuuuuuucca

SEQ ID NO: 641439 - RNA, 17 nt, Homo sapiens
guauuuaggcagauuga

SEQ ID NO: 641440 - RNA, 21 nt, Homo sapiens
guauuuccuuccacuguagcu

SEQ ID NO: 641441 - RNA, 19 nt, Homo sapiens
guauuugaaaacucacaga

SEQ ID NO: 641442 - RNA, 16 nt, Homo sapiens
guauuugaaauaagaa

SEQ ID NO: 641443 - RNA, 23 nt, Homo sapiens
guauuuuauuacaucuuucacau

SEQ ID NO: 641444 - RNA, 16 nt, Homo sapiens
guauuuucaaccauaa

SEQ ID NO: 641445 - RNA, 14 nt, Homo sapiens
guauuuugaaaaag

SEQ ID NO: 641446 - RNA, 15 nt, Homo sapiens
guauuuugacacugg

SEQ ID NO: 641447 - RNA, 14 nt, Homo sapiens
guauuuugccagac

SEQ ID NO: 641448 - RNA, 18 nt, Homo sapiens
guauuuugcuagugcauu

SEQ ID NO: 641449 - RNA, 19 nt, Homo sapiens
guauuuuguagaugugauu

SEQ ID NO: 641450 - RNA, 20 nt, Homo sapiens
guauuuuugccggcugguga

SEQ ID NO: 641451 - RNA, 18 nt, Homo sapiens
guauuuuuucacuuguac

SEQ ID NO: 641452 - RNA, 17 nt, Homo sapiens
gucaaaaagggcuugag

SEQ ID NO: 641453 - RNA, 13 nt, Homo sapiens
gucaaaaaucugu

SEQ ID NO: 641454 - RNA, 23 nt, Homo sapiens
gucaaaacagauuguuugcaaag

SEQ ID NO: 641455 - RNA, 16 nt, Homo sapiens
gucaaaacuacugaca

SEQ ID NO: 641456 - RNA, 14 nt, Homo sapiens
gucaaaaggugccu

SEQ ID NO: 641457 - RNA, 20 nt, Homo sapiens
gucaaaccgcacucacccau

SEQ ID NO: 641458 - RNA, 13 nt, Homo sapiens
gucaaacuguaga

SEQ ID NO: 641459 - RNA, 13 nt, Homo sapiens
gucaaagaagcuu

SEQ ID NO: 641460 - RNA, 22 nt, Homo sapiens
gucaaaguaaaacuugcugccu

SEQ ID NO: 641461 - RNA, 17 nt, Homo sapiens
gucaaagugaugaauau

SEQ ID NO: 641462 - RNA, 13 nt, Homo sapiens
gucaaaugccaaa

SEQ ID NO: 641463 - RNA, 14 nt, Homo sapiens
gucaaaugccaaac

SEQ ID NO: 641464 - RNA, 11 nt, Homo sapiens
gucaacaaacu

SEQ ID NO: 641465 - RNA, 20 nt, Homo sapiens
gucaacagauccgacuuugg

SEQ ID NO: 641466 - RNA, 16 nt, Homo sapiens
gucaacagcgugcagg

SEQ ID NO: 641467 - RNA, 16 nt, Homo sapiens
gucaaccuuguuucua

SEQ ID NO: 641468 - RNA, 21 nt, Homo sapiens
gucaaccuuguuucuacuguu

SEQ ID NO: 641469 - RNA, 23 nt, Homo sapiens
gucaacgcaacgucuaacuggac

SEQ ID NO: 641470 - RNA, 14 nt, Homo sapiens
gucaacggagggag

SEQ ID NO: 641471 - RNA, 11 nt, Homo sapiens
gucaacuuaaa

SEQ ID NO: 641472 - RNA, 20 nt, Homo sapiens
gucaacuuucuuagcucaag

SEQ ID NO: 641473 - RNA, 20 nt, Homo sapiens
gucaagaagaggaaagggag

SEQ ID NO: 641474 - RNA, 22 nt, Homo sapiens
gucaagaagcguuaugugcagu

SEQ ID NO: 641475 - RNA, 23 nt, Homo sapiens
gucaagaagcguuaugugcagua

SEQ ID NO: 641476 - RNA, 20 nt, Homo sapiens
gucaagaccagccugggcaa

SEQ ID NO: 641477 - RNA, 13 nt, Homo sapiens
gucaagcauguau

SEQ ID NO: 641478 - RNA, 22 nt, Homo sapiens
gucaaggauggaugcagaucca

SEQ ID NO: 641479 - RNA, 22 nt, Homo sapiens
gucaaggccgagggccaggcag

SEQ ID NO: 641480 - RNA, 14 nt, Homo sapiens
gucaaggcucaguc

SEQ ID NO: 641481 - RNA, 18 nt, Homo sapiens
gucaagguuuguguuacc

SEQ ID NO: 641482 - RNA, 18 nt, Homo sapiens
gucaagucaccaugcuga

SEQ ID NO: 641483 - RNA, 22 nt, Homo sapiens
gucaaguuggguucacuugcca

SEQ ID NO: 641484 - RNA, 18 nt, Homo sapiens
gucaauccgaaguaugag

SEQ ID NO: 641485 - RNA, 18 nt, Homo sapiens
gucaauccugucauauaa

SEQ ID NO: 641486 - RNA, 14 nt, Homo sapiens
gucaaugugcagug

SEQ ID NO: 641487 - RNA, 15 nt, Homo sapiens
gucaauguguucuua

SEQ ID NO: 641488 - RNA, 22 nt, Homo sapiens
gucaauuggaaagacuauccaa

SEQ ID NO: 641489 - RNA, 14 nt, Homo sapiens
gucacaauccuaac

SEQ ID NO: 641490 - RNA, 21 nt, Homo sapiens
gucacaauccuaacacauuau

SEQ ID NO: 641491 - RNA, 15 nt, Homo sapiens
gucacaccaucuuaa

SEQ ID NO: 641492 - RNA, 11 nt, Homo sapiens
gucacacuggu

SEQ ID NO: 641493 - RNA, 15 nt, Homo sapiens
gucacagaagcagcu

SEQ ID NO: 641494 - RNA, 13 nt, Homo sapiens
gucacagaugaag

SEQ ID NO: 641495 - RNA, 13 nt, Homo sapiens
gucacagccaccc

SEQ ID NO: 641496 - RNA, 14 nt, Homo sapiens
gucacagccaugaa

SEQ ID NO: 641497 - RNA, 22 nt, Homo sapiens
gucacauuuuaccaauaugcau

SEQ ID NO: 641498 - RNA, 22 nt, Homo sapiens
gucaccaaaucagcugcuacua

SEQ ID NO: 641499 - RNA, 16 nt, Homo sapiens
gucaccacgacuggcc

SEQ ID NO: 641500 - RNA, 12 nt, Homo sapiens
gucaccagagac

SEQ ID NO: 641501 - RNA, 19 nt, Homo sapiens
gucaccaggugaccagugg

SEQ ID NO: 641502 - RNA, 13 nt, Homo sapiens
gucaccugcagcc

SEQ ID NO: 641503 - RNA, 18 nt, Homo sapiens
gucaccugcucacaggga

SEQ ID NO: 641504 - RNA, 21 nt, Homo sapiens
gucaccuucuaccaccagggc

SEQ ID NO: 641505 - RNA, 14 nt, Homo sapiens
gucaccuugcacuc

SEQ ID NO: 641506 - RNA, 16 nt, Homo sapiens
gucacgagacccagag

SEQ ID NO: 641507 - RNA, 15 nt, Homo sapiens
gucacgcaugcagug

SEQ ID NO: 641508 - RNA, 20 nt, Homo sapiens
gucacgcuugccuggucacc

SEQ ID NO: 641509 - RNA, 18 nt, Homo sapiens
gucacguuuggugcuucu

SEQ ID NO: 641510 - RNA, 12 nt, Homo sapiens
gucacuccaggc

SEQ ID NO: 641511 - RNA, 15 nt, Homo sapiens
gucacuccucucuag

SEQ ID NO: 641512 - RNA, 16 nt, Homo sapiens
gucacugauacacaga

SEQ ID NO: 641513 - RNA, 10 nt, Homo sapiens
gucacuggaa

SEQ ID NO: 641514 - RNA, 16 nt, Homo sapiens
gucacuggcaucucac

SEQ ID NO: 641515 - RNA, 15 nt, Homo sapiens
gucacuucucacaau

SEQ ID NO: 641516 - RNA, 22 nt, Homo sapiens
gucacuucuucaccucuuccac

SEQ ID NO: 641517 - RNA, 20 nt, Homo sapiens
gucagaaaaaggaaaccaca

SEQ ID NO: 641518 - RNA, 16 nt, Homo sapiens
gucagaaaacagagaa

SEQ ID NO: 641519 - RNA, 17 nt, Homo sapiens
gucagaauaguccuugg

SEQ ID NO: 641520 - RNA, 18 nt, Homo sapiens
gucagacacgauugagaa

SEQ ID NO: 641521 - RNA, 13 nt, Homo sapiens
gucagacugaaac

SEQ ID NO: 641522 - RNA, 19 nt, Homo sapiens
gucagaguggcgugagcug

SEQ ID NO: 641523 - RNA, 15 nt, Homo sapiens
gucagaguucugcuc

SEQ ID NO: 641524 - RNA, 17 nt, Homo sapiens
gucagaguucugcucua

SEQ ID NO: 641525 - RNA, 15 nt, Homo sapiens
gucagaugaggcaaa

SEQ ID NO: 641526 - RNA, 22 nt, Homo sapiens
gucagauguacauagagaucua

SEQ ID NO: 641527 - RNA, 18 nt, Homo sapiens
gucagcagaugcuguugu

SEQ ID NO: 641528 - RNA, 16 nt, Homo sapiens
gucagcaugccucuag

SEQ ID NO: 641529 - RNA, 17 nt, Homo sapiens
gucagccagacuggaca

SEQ ID NO: 641530 - RNA, 17 nt, Homo sapiens
gucagccauaucuccau

SEQ ID NO: 641531 - RNA, 21 nt, Homo sapiens
gucagcccuuggcuucugcuu

SEQ ID NO: 641532 - RNA, 15 nt, Homo sapiens
gucagccgguccaug

SEQ ID NO: 641533 - RNA, 16 nt, Homo sapiens
gucagccuugcaucaa

SEQ ID NO: 641534 - RNA, 20 nt, Homo sapiens
gucagcucccuucucuguag

SEQ ID NO: 641535 - RNA, 21 nt, Homo sapiens
gucagcucucuccuuucaggg

SEQ ID NO: 641536 - RNA, 16 nt, Homo sapiens
gucagcucucugcccu

SEQ ID NO: 641537 - RNA, 15 nt, Homo sapiens
gucaggaaacauuca

SEQ ID NO: 641538 - RNA, 18 nt, Homo sapiens
gucaggaguuccagacca

SEQ ID NO: 641539 - RNA, 19 nt, Homo sapiens
cugaccagcagcgccuuuc

SEQ ID NO: 641540 - RNA, 15 nt, Homo sapiens
cugaccauugcccua

SEQ ID NO: 641541 - RNA, 14 nt, Homo sapiens
cugacccaccugcg

SEQ ID NO: 641542 - RNA, 14 nt, Homo sapiens
cugaccccaaagag

SEQ ID NO: 641543 - RNA, 20 nt, Homo sapiens
cugaccccagugaaugaagc

SEQ ID NO: 641544 - RNA, 23 nt, Homo sapiens
cugacccgguugcagucacugug

SEQ ID NO: 641545 - RNA, 18 nt, Homo sapiens
cugacccucccagucuca

SEQ ID NO: 641546 - RNA, 16 nt, Homo sapiens
cugacccuucucucac

SEQ ID NO: 641547 - RNA, 22 nt, Homo sapiens
cugaccucaagcaaccaugaac

SEQ ID NO: 641548 - RNA, 15 nt, Homo sapiens
cugaccucacuguga

SEQ ID NO: 641549 - RNA, 17 nt, Homo sapiens
cugaccucacugugacc

SEQ ID NO: 641550 - RNA, 13 nt, Homo sapiens
cugaccucaggug

SEQ ID NO: 641551 - RNA, 16 nt, Homo sapiens
cugaccucccagugac

SEQ ID NO: 641552 - RNA, 20 nt, Homo sapiens
cugaccuguaggucaggacc

SEQ ID NO: 641553 - RNA, 20 nt, Homo sapiens
cugacgucagcgcaccaaaa

SEQ ID NO: 641554 - RNA, 23 nt, Homo sapiens
cugacuaauuuuuguauuuuuag

SEQ ID NO: 641555 - RNA, 16 nt, Homo sapiens
cugacuacuacucugc

SEQ ID NO: 641556 - RNA, 20 nt, Homo sapiens
cugacuagaagggccagucc

SEQ ID NO: 641557 - RNA, 21 nt, Homo sapiens
cugacucacaagaagaccaga

SEQ ID NO: 641558 - RNA, 22 nt, Homo sapiens
cugacuccuuagagacaucaaa

SEQ ID NO: 641559 - RNA, 21 nt, Homo sapiens
cugacucucugugaccugccc

SEQ ID NO: 641560 - RNA, 17 nt, Homo sapiens
cugacugagcaauaugc

SEQ ID NO: 641561 - RNA, 21 nt, Homo sapiens
cugacugguugucagaaugga

SEQ ID NO: 641562 - RNA, 12 nt, Homo sapiens
cugacuguaaau

SEQ ID NO: 641563 - RNA, 15 nt, Homo sapiens
cugacugucagggag

SEQ ID NO: 641564 - RNA, 16 nt, Homo sapiens
cugacugugaaaccuu

SEQ ID NO: 641565 - RNA, 18 nt, Homo sapiens
cugacuuaaguggcauua

SEQ ID NO: 641566 - RNA, 23 nt, Homo sapiens
cugacuucagugggacucgguga

SEQ ID NO: 641567 - RNA, 13 nt, Homo sapiens
cugacuuccucug

SEQ ID NO: 641568 - RNA, 16 nt, Homo sapiens
cugacuuggcacuuaa

SEQ ID NO: 641569 - RNA, 20 nt, Homo sapiens
cugacuuguuugucuuccau

SEQ ID NO: 641570 - RNA, 22 nt, Homo sapiens
cugacuuugcccccuugcccau

SEQ ID NO: 641571 - RNA, 15 nt, Homo sapiens
cugacuuuuaaccca

SEQ ID NO: 641572 - RNA, 16 nt, Homo sapiens
cugacuuuuaauguca

SEQ ID NO: 641573 - RNA, 17 nt, Homo sapiens
cugagaaaagccucucc

SEQ ID NO: 641574 - RNA, 13 nt, Homo sapiens
cugagaaaccucg

SEQ ID NO: 641575 - RNA, 22 nt, Homo sapiens
cugagaaaggucugaaauccag

SEQ ID NO: 641576 - RNA, 15 nt, Homo sapiens
cugagaaauguucag

SEQ ID NO: 641577 - RNA, 17 nt, Homo sapiens
cugagaaccgugacauc

SEQ ID NO: 641578 - RNA, 14 nt, Homo sapiens
cugagaacuggaca

SEQ ID NO: 641579 - RNA, 22 nt, Homo sapiens
cugagaacuggacaguggcagg

SEQ ID NO: 641580 - RNA, 13 nt, Homo sapiens
cugagaaggcagu

SEQ ID NO: 641581 - RNA, 18 nt, Homo sapiens
cugagaaggcaguaguuu

SEQ ID NO: 641582 - RNA, 15 nt, Homo sapiens
cugagaauguggaau

SEQ ID NO: 641583 - RNA, 18 nt, Homo sapiens
cugagacagacacacagc

SEQ ID NO: 641584 - RNA, 18 nt, Homo sapiens
cugagacagcaccacugc

SEQ ID NO: 641585 - RNA, 14 nt, Homo sapiens
cugagacagggauu

SEQ ID NO: 641586 - RNA, 16 nt, Homo sapiens
cugagacagugaauuu

SEQ ID NO: 641587 - RNA, 17 nt, Homo sapiens
cugagaccaaaguagau

SEQ ID NO: 641588 - RNA, 22 nt, Homo sapiens
cugagaccacccccaaacacaa

SEQ ID NO: 641589 - RNA, 23 nt, Homo sapiens
cugagaccaguugggagcacugg

SEQ ID NO: 641590 - RNA, 12 nt, Homo sapiens
cugagacugugc

SEQ ID NO: 641591 - RNA, 18 nt, Homo sapiens
cugagacuuguucuuggu

SEQ ID NO: 641592 - RNA, 19 nt, Homo sapiens
cugagagugagcaaccagc

SEQ ID NO: 641593 - RNA, 17 nt, Homo sapiens
cugagaguggugcccug

SEQ ID NO: 641594 - RNA, 19 nt, Homo sapiens
cugagauauauuugcuaga

SEQ ID NO: 641595 - RNA, 17 nt, Homo sapiens
cugagaugaagcuaauu

SEQ ID NO: 641596 - RNA, 17 nt, Homo sapiens
cugagaugcucacuuua

SEQ ID NO: 641597 - RNA, 18 nt, Homo sapiens
cugagcacagcugcauua

SEQ ID NO: 641598 - RNA, 19 nt, Homo sapiens
cugagcaccgaauauugag

SEQ ID NO: 641599 - RNA, 20 nt, Homo sapiens
cugagcacuguuuauacacu

SEQ ID NO: 641600 - RNA, 16 nt, Homo sapiens
cugagcagugccagcu

SEQ ID NO: 641601 - RNA, 16 nt, Homo sapiens
cugagcauaaugcucc

SEQ ID NO: 641602 - RNA, 21 nt, Homo sapiens
cugagccacucgcagucgcag

SEQ ID NO: 641603 - RNA, 19 nt, Homo sapiens
cugagcccaccuucuugcu

SEQ ID NO: 641604 - RNA, 19 nt, Homo sapiens
cugagccccagggugccca

SEQ ID NO: 641605 - RNA, 15 nt, Homo sapiens
cugagccccuacccc

SEQ ID NO: 641606 - RNA, 23 nt, Homo sapiens
cugagcgggaggcagaguuugcc

SEQ ID NO: 641607 - RNA, 13 nt, Homo sapiens
cugagcuauuuca

SEQ ID NO: 641608 - RNA, 20 nt, Homo sapiens
cugagcugaacacauuugcc

SEQ ID NO: 641609 - RNA, 20 nt, Homo sapiens
cugagcugaacccauuuuga

SEQ ID NO: 641610 - RNA, 23 nt, Homo sapiens
cugagcuggaaggggccacgugg

SEQ ID NO: 641611 - RNA, 19 nt, Homo sapiens
cugagcuggcccuugggga

SEQ ID NO: 641612 - RNA, 19 nt, Homo sapiens
cugagcuggccuccuaugc

SEQ ID NO: 641613 - RNA, 13 nt, Homo sapiens
cugagcugugcag

SEQ ID NO: 641614 - RNA, 23 nt, Homo sapiens
cugaggacaagagaaaaaagcca

SEQ ID NO: 641615 - RNA, 17 nt, Homo sapiens
cugaggacuguccuccc

SEQ ID NO: 641616 - RNA, 21 nt, Homo sapiens
cugaggagcuguuacugaaua

SEQ ID NO: 641617 - RNA, 19 nt, Homo sapiens
cugaggaggaggacacagc

SEQ ID NO: 641618 - RNA, 19 nt, Homo sapiens
cugaggaguaaguguacaa

SEQ ID NO: 641619 - RNA, 15 nt, Homo sapiens
cugaggaugcaucuu

SEQ ID NO: 641620 - RNA, 22 nt, Homo sapiens
cugaggcaagagaauugcuuga

SEQ ID NO: 641621 - RNA, 22 nt, Homo sapiens
cugaggcaggagagucacuuga

SEQ ID NO: 641622 - RNA, 18 nt, Homo sapiens
cugaggcaggaggauugc

SEQ ID NO: 641623 - RNA, 15 nt, Homo sapiens
cugaggccacacuca

SEQ ID NO: 641624 - RNA, 16 nt, Homo sapiens
cugaggccaucagggc

SEQ ID NO: 641625 - RNA, 17 nt, Homo sapiens
cugaggccaucagggcc

SEQ ID NO: 641626 - RNA, 21 nt, Homo sapiens
cugaggcggagaauugcuuga

SEQ ID NO: 641627 - RNA, 16 nt, Homo sapiens
cugaggcuuccagaga

SEQ ID NO: 641628 - RNA, 20 nt, Homo sapiens
cugaggggauaccauaaaaa

SEQ ID NO: 641629 - RNA, 19 nt, Homo sapiens
cugaggggcuaccaggaaa

SEQ ID NO: 641630 - RNA, 17 nt, Homo sapiens
cugaggguggcacucaa

SEQ ID NO: 641631 - RNA, 14 nt, Homo sapiens
cugagguacagaga

SEQ ID NO: 641632 - RNA, 20 nt, Homo sapiens
cugaggugccugcucaggug

SEQ ID NO: 641633 - RNA, 21 nt, Homo sapiens
cugaggugccugcucaggugc

SEQ ID NO: 641634 - RNA, 23 nt, Homo sapiens
cugaggugugugccacucagaga

SEQ ID NO: 641635 - RNA, 17 nt, Homo sapiens
cugaguacguugugcau

SEQ ID NO: 641636 - RNA, 14 nt, Homo sapiens
cugaguacuggaau

SEQ ID NO: 641637 - RNA, 19 nt, Homo sapiens
cugaguagcuggauuacag

SEQ ID NO: 641638 - RNA, 13 nt, Homo sapiens
cugaguccagagc

SEQ ID NO: 641639 - RNA, 15 nt, Homo sapiens
cugaguccaugaaaa

SEQ ID NO: 641640 - RNA, 19 nt, Homo sapiens
cugagugaaugaacaaaug

SEQ ID NO: 641641 - RNA, 23 nt, Homo sapiens
cugagugacugcagcuugccaaa

SEQ ID NO: 641642 - RNA, 20 nt, Homo sapiens
cugagugaguguuuggccga

SEQ ID NO: 641643 - RNA, 15 nt, Homo sapiens
cugagugcugaaaua

SEQ ID NO: 641644 - RNA, 20 nt, Homo sapiens
cugaguggaaugcagggaag

SEQ ID NO: 641645 - RNA, 14 nt, Homo sapiens
cugaguggaucucc

SEQ ID NO: 641646 - RNA, 18 nt, Homo sapiens
cugaguggcaggggacag

SEQ ID NO: 641647 - RNA, 18 nt, Homo sapiens
cugagugggcccagcaca

SEQ ID NO: 641648 - RNA, 18 nt, Homo sapiens
cugagugggggaucacag

SEQ ID NO: 641649 - RNA, 17 nt, Homo sapiens
cugaguggugucugcuu

SEQ ID NO: 641650 - RNA, 17 nt, Homo sapiens
cugaguguuuaauuuca

SEQ ID NO: 641651 - RNA, 18 nt, Homo sapiens
cugaguuaugauguaauc

SEQ ID NO: 641652 - RNA, 14 nt, Homo sapiens
cugaguugcuuuua

SEQ ID NO: 641653 - RNA, 22 nt, Homo sapiens
cugauaaacauuaaacacugua

SEQ ID NO: 641654 - RNA, 14 nt, Homo sapiens
cugauaagcauuga

SEQ ID NO: 641655 - RNA, 18 nt, Homo sapiens
cugauaaggaucuaggag

SEQ ID NO: 641656 - RNA, 13 nt, Homo sapiens
cugauaaugcuca

SEQ ID NO: 641657 - RNA, 13 nt, Homo sapiens
cugauacauuaaa

SEQ ID NO: 641658 - RNA, 13 nt, Homo sapiens
cugauaccacugc

SEQ ID NO: 641659 - RNA, 15 nt, Homo sapiens
cugauacccagagca

SEQ ID NO: 641660 - RNA, 13 nt, Homo sapiens
cugauacguguau

SEQ ID NO: 641661 - RNA, 17 nt, Homo sapiens
gucaggcagggugcagu

SEQ ID NO: 641662 - RNA, 21 nt, Homo sapiens
gucaggcagguuugccaguga

SEQ ID NO: 641663 - RNA, 23 nt, Homo sapiens
gucaggcccucugccugcacucc

SEQ ID NO: 641664 - RNA, 14 nt, Homo sapiens
gucaggccuaccuc

SEQ ID NO: 641665 - RNA, 23 nt, Homo sapiens
gucaggcgcaguggcucaugccu

SEQ ID NO: 641666 - RNA, 16 nt, Homo sapiens
gucagggccagacugg

SEQ ID NO: 641667 - RNA, 19 nt, Homo sapiens
gucagggggagucuuugca

SEQ ID NO: 641668 - RNA, 17 nt, Homo sapiens
gucagggguuucuucaa

SEQ ID NO: 641669 - RNA, 14 nt, Homo sapiens
gucaguauuaucua

SEQ ID NO: 641670 - RNA, 12 nt, Homo sapiens
gucagucaggga

SEQ ID NO: 641671 - RNA, 16 nt, Homo sapiens
gucagugccaugacug

SEQ ID NO: 641672 - RNA, 13 nt, Homo sapiens
gucagugcucaga

SEQ ID NO: 641673 - RNA, 17 nt, Homo sapiens
gucaguucuaaccuccu

SEQ ID NO: 641674 - RNA, 21 nt, Homo sapiens
gucaguuucauggaggggaaa

SEQ ID NO: 641675 - RNA, 22 nt, Homo sapiens
gucauagaauuaauuuucagcc

SEQ ID NO: 641676 - RNA, 19 nt, Homo sapiens
gucaucaaccgaugguccu

SEQ ID NO: 641677 - RNA, 14 nt, Homo sapiens
gucaucacuuugac

SEQ ID NO: 641678 - RNA, 20 nt, Homo sapiens
gucaucuccaucagcuguaa

SEQ ID NO: 641679 - RNA, 21 nt, Homo sapiens
gucaucucucacacauuccag

SEQ ID NO: 641680 - RNA, 15 nt, Homo sapiens
gucaucugucuuuca

SEQ ID NO: 641681 - RNA, 13 nt, Homo sapiens
gucaucugugcac

SEQ ID NO: 641682 - RNA, 20 nt, Homo sapiens
gucaucuuucuuuucuuuga

SEQ ID NO: 641683 - RNA, 21 nt, Homo sapiens
gucaugacggggacagaguga

SEQ ID NO: 641684 - RNA, 23 nt, Homo sapiens
gucaugauggcaccacugcacuc

SEQ ID NO: 641685 - RNA, 15 nt, Homo sapiens
gucauggcaccaaag

SEQ ID NO: 641686 - RNA, 16 nt, Homo sapiens
gucauggccugagaug

SEQ ID NO: 641687 - RNA, 13 nt, Homo sapiens
gucaugugccuug

SEQ ID NO: 641688 - RNA, 21 nt, Homo sapiens
gucauguuugcaggggugacg

SEQ ID NO: 641689 - RNA, 18 nt, Homo sapiens
gucauuaaacaugacauu

SEQ ID NO: 641690 - RNA, 20 nt, Homo sapiens
gucauucagcgggagcacug

SEQ ID NO: 641691 - RNA, 23 nt, Homo sapiens
gucauucgcuacuaugauuuaau

SEQ ID NO: 641692 - RNA, 22 nt, Homo sapiens
gucauucuaggauguggagcua

SEQ ID NO: 641693 - RNA, 21 nt, Homo sapiens
gucauucuuuauucuuuacua

SEQ ID NO: 641694 - RNA, 19 nt, Homo sapiens
gucauugauagaacuacuu

SEQ ID NO: 641695 - RNA, 11 nt, Homo sapiens
gucauugcugu

SEQ ID NO: 641696 - RNA, 20 nt, Homo sapiens
gucauuggccgacaucacag

SEQ ID NO: 641697 - RNA, 14 nt, Homo sapiens
gucauuguauguua

SEQ ID NO: 641698 - RNA, 22 nt, Homo sapiens
gucauuuauauuccuuuuccca

SEQ ID NO: 641699 - RNA, 12 nt, Homo sapiens
guccaaauccaa

SEQ ID NO: 641700 - RNA, 23 nt, Homo sapiens
guccaagcuguggagacucuugu

SEQ ID NO: 641701 - RNA, 16 nt, Homo sapiens
guccaaguccaaccug

SEQ ID NO: 641702 - RNA, 19 nt, Homo sapiens
guccaauuccaaagccaga

SEQ ID NO: 641703 - RNA, 17 nt, Homo sapiens
guccaauuuuuacucag

SEQ ID NO: 641704 - RNA, 13 nt, Homo sapiens
guccacaaagcau

SEQ ID NO: 641705 - RNA, 21 nt, Homo sapiens
guccacaacacacagauuuga

SEQ ID NO: 641706 - RNA, 13 nt, Homo sapiens
guccacacccagc

SEQ ID NO: 641707 - RNA, 14 nt, Homo sapiens
guccacagaccuac

SEQ ID NO: 641708 - RNA, 22 nt, Homo sapiens
guccacagaccuacugcacuga

SEQ ID NO: 641709 - RNA, 13 nt, Homo sapiens
guccaccucccau

SEQ ID NO: 641710 - RNA, 18 nt, Homo sapiens
guccacucucggggcccu

SEQ ID NO: 641711 - RNA, 15 nt, Homo sapiens
guccacugcuccauu

SEQ ID NO: 641712 - RNA, 14 nt, Homo sapiens
guccacugucaggg

SEQ ID NO: 641713 - RNA, 23 nt, Homo sapiens
guccacugugagaggugacacug

SEQ ID NO: 641714 - RNA, 14 nt, Homo sapiens
guccagauuuacac

SEQ ID NO: 641715 - RNA, 20 nt, Homo sapiens
guccagauuuacacugggag

SEQ ID NO: 641716 - RNA, 23 nt, Homo sapiens
guccagccgccauugccaccagg

SEQ ID NO: 641717 - RNA, 15 nt, Homo sapiens
guccagcucugacau

SEQ ID NO: 641718 - RNA, 15 nt, Homo sapiens
guccagcuguggaag

SEQ ID NO: 641719 - RNA, 18 nt, Homo sapiens
guccagcuugcucuucag

SEQ ID NO: 641720 - RNA, 16 nt, Homo sapiens
guccaggaacaagcua

SEQ ID NO: 641721 - RNA, 19 nt, Homo sapiens
guccaggaaggcagcugcu

SEQ ID NO: 641722 - RNA, 16 nt, Homo sapiens
guccaggcacugagau

SEQ ID NO: 641723 - RNA, 19 nt, Homo sapiens
guccaggcuggagugcaau

SEQ ID NO: 641724 - RNA, 15 nt, Homo sapiens
guccaggcuggucuu

SEQ ID NO: 641725 - RNA, 16 nt, Homo sapiens
guccaggguccucuag

SEQ ID NO: 641726 - RNA, 23 nt, Homo sapiens
guccagguaaaugguaugaucaa

SEQ ID NO: 641727 - RNA, 23 nt, Homo sapiens
guccaucuucuuuauacaaugac

SEQ ID NO: 641728 - RNA, 15 nt, Homo sapiens
guccaugccuuccau

SEQ ID NO: 641729 - RNA, 18 nt, Homo sapiens
guccaugugugugcaagu

SEQ ID NO: 641730 - RNA, 17 nt, Homo sapiens
guccauguguucuuauu

SEQ ID NO: 641731 - RNA, 14 nt, Homo sapiens
guccauugauguau

SEQ ID NO: 641732 - RNA, 19 nt, Homo sapiens
guccauuuauccacaggaa

SEQ ID NO: 641733 - RNA, 15 nt, Homo sapiens
gucccagacaauucc

SEQ ID NO: 641734 - RNA, 19 nt, Homo sapiens
gucccagagguuaucugcc

SEQ ID NO: 641735 - RNA, 16 nt, Homo sapiens
gucccagccacagugu

SEQ ID NO: 641736 - RNA, 18 nt, Homo sapiens
gucccagccacaguguua

SEQ ID NO: 641737 - RNA, 17 nt, Homo sapiens
gucccagcuacucagaa

SEQ ID NO: 641738 - RNA, 14 nt, Homo sapiens
gucccauuccucag

SEQ ID NO: 641739 - RNA, 17 nt, Homo sapiens
guccccacccuccacuc

SEQ ID NO: 641740 - RNA, 19 nt, Homo sapiens
guccccagagcuacaggcc

SEQ ID NO: 641741 - RNA, 16 nt, Homo sapiens
guccccagcauugcag

SEQ ID NO: 641742 - RNA, 19 nt, Homo sapiens
gucccccugcuugucuuca

SEQ ID NO: 641743 - RNA, 17 nt, Homo sapiens
guccccguaccugucau

SEQ ID NO: 641744 - RNA, 22 nt, Homo sapiens
guccccuaacccccaguccuca

SEQ ID NO: 641745 - RNA, 18 nt, Homo sapiens
guccccucacucugucag

SEQ ID NO: 641746 - RNA, 17 nt, Homo sapiens
cuuaggggaacccuguc

SEQ ID NO: 641747 - RNA, 17 nt, Homo sapiens
cuuagguugacauucag

SEQ ID NO: 641748 - RNA, 13 nt, Homo sapiens
cuuagucauuacu

SEQ ID NO: 641749 - RNA, 23 nt, Homo sapiens
cuuaguccaauuccuugcacaua

SEQ ID NO: 641750 - RNA, 17 nt, Homo sapiens
cuuagucccucaugcaa

SEQ ID NO: 641751 - RNA, 16 nt, Homo sapiens
cuuagugacaaaauag

SEQ ID NO: 641752 - RNA, 14 nt, Homo sapiens
cuuagugauugaga

SEQ ID NO: 641753 - RNA, 21 nt, Homo sapiens
cuuaguucuucuccugccuaa

SEQ ID NO: 641754 - RNA, 11 nt, Homo sapiens
cuuaguugaaa

SEQ ID NO: 641755 - RNA, 15 nt, Homo sapiens
cuuaguugcaugacc

SEQ ID NO: 641756 - RNA, 12 nt, Homo sapiens
cuuaguuuccac

SEQ ID NO: 641757 - RNA, 19 nt, Homo sapiens
cuuauaagaaagaucaaag

SEQ ID NO: 641758 - RNA, 12 nt, Homo sapiens
cuuauacagagc

SEQ ID NO: 641759 - RNA, 14 nt, Homo sapiens
cuuauacauuugau

SEQ ID NO: 641760 - RNA, 15 nt, Homo sapiens
cuuauaccaaaggga

SEQ ID NO: 641761 - RNA, 14 nt, Homo sapiens
cuuauauucaucca

SEQ ID NO: 641762 - RNA, 18 nt, Homo sapiens
cuuauauucauccaugcc

SEQ ID NO: 641763 - RNA, 12 nt, Homo sapiens
cuuauauuguaa

SEQ ID NO: 641764 - RNA, 15 nt, Homo sapiens
cuuauccacaaagua

SEQ ID NO: 641765 - RNA, 14 nt, Homo sapiens
cuuauccacuuuga

SEQ ID NO: 641766 - RNA, 20 nt, Homo sapiens
cuuauccaggacucugucaa

SEQ ID NO: 641767 - RNA, 18 nt, Homo sapiens
cuuaucccagugaucacc

SEQ ID NO: 641768 - RNA, 22 nt, Homo sapiens
cuuaucucggggagaaaugcaa

SEQ ID NO: 641769 - RNA, 19 nt, Homo sapiens
cuuaucugaaaugcuugaa

SEQ ID NO: 641770 - RNA, 22 nt, Homo sapiens
cuuaucuggcccucgacacuca

SEQ ID NO: 641771 - RNA, 14 nt, Homo sapiens
cuuaucugucacac

SEQ ID NO: 641772 - RNA, 22 nt, Homo sapiens
cuuaucugugcgugaaacacac

SEQ ID NO: 641773 - RNA, 12 nt, Homo sapiens
cuuaucuugcac

SEQ ID NO: 641774 - RNA, 19 nt, Homo sapiens
cuuaucuuucuaaaacugc

SEQ ID NO: 641775 - RNA, 17 nt, Homo sapiens
cuuaugacuugcuacuu

SEQ ID NO: 641776 - RNA, 13 nt, Homo sapiens
cuuaugauacuug

SEQ ID NO: 641777 - RNA, 16 nt, Homo sapiens
cuuaugccagcgugac

SEQ ID NO: 641778 - RNA, 18 nt, Homo sapiens
cuuauggaauugauuugc

SEQ ID NO: 641779 - RNA, 23 nt, Homo sapiens
cuuauggaauugauuugcauuga

SEQ ID NO: 641780 - RNA, 23 nt, Homo sapiens
cuuauggauucauauaggccaga

SEQ ID NO: 641781 - RNA, 12 nt, Homo sapiens
cuuauggccaau

SEQ ID NO: 641782 - RNA, 22 nt, Homo sapiens
cuuaugggucccccucagcaag

SEQ ID NO: 641783 - RNA, 14 nt, Homo sapiens
cuuauguguuuuaa

SEQ ID NO: 641784 - RNA, 14 nt, Homo sapiens
cuuauuaaagcaaa

SEQ ID NO: 641785 - RNA, 17 nt, Homo sapiens
cuuauuaggacuuugaa

SEQ ID NO: 641786 - RNA, 14 nt, Homo sapiens
cuuauuaugcauaa

SEQ ID NO: 641787 - RNA, 23 nt, Homo sapiens
cuuauuccccugcccagguguga

SEQ ID NO: 641788 - RNA, 16 nt, Homo sapiens
cuuauuguaacccugu

SEQ ID NO: 641789 - RNA, 22 nt, Homo sapiens
cuuauuguccuucuaccuugaa

SEQ ID NO: 641790 - RNA, 23 nt, Homo sapiens
cuuauuuaaugccgauauacucu

SEQ ID NO: 641791 - RNA, 21 nt, Homo sapiens
cuuauuucacuaaauguaaaa

SEQ ID NO: 641792 - RNA, 13 nt, Homo sapiens
cuuauuucuauga

SEQ ID NO: 641793 - RNA, 20 nt, Homo sapiens
cuuauuuuauuuuuuaccau

SEQ ID NO: 641794 - RNA, 15 nt, Homo sapiens
cuuauuuugcauucc

SEQ ID NO: 641795 - RNA, 18 nt, Homo sapiens
cuuauuuugcauuccaga

SEQ ID NO: 641796 - RNA, 17 nt, Homo sapiens
cuucaaaccccuacuga

SEQ ID NO: 641797 - RNA, 18 nt, Homo sapiens
cuucaaacuauacuacaa

SEQ ID NO: 641798 - RNA, 20 nt, Homo sapiens
cuucaaacugugaagcauuu

SEQ ID NO: 641799 - RNA, 19 nt, Homo sapiens
cuucaaaguuaaugggaug

SEQ ID NO: 641800 - RNA, 21 nt, Homo sapiens
cuucaaauuagaagacauuua

SEQ ID NO: 641801 - RNA, 18 nt, Homo sapiens
cuucaaauuggucugaaa

SEQ ID NO: 641802 - RNA, 19 nt, Homo sapiens
guuuuuucagucugugaaa

SEQ ID NO: 641803 - RNA, 21 nt, Homo sapiens
guuuuuugaaauuaugugaca

SEQ ID NO: 641804 - RNA, 16 nt, Homo sapiens
guuuuuugccauguua

SEQ ID NO: 641805 - RNA, 13 nt, Homo sapiens
guuuuuuucccag

SEQ ID NO: 641806 - RNA, 23 nt, Homo sapiens
guuuuuuuuuuuuuuaacaugua

SEQ ID NO: 641807 - RNA, 22 nt, Homo sapiens
uaaaaaaaaagucagagacaga

SEQ ID NO: 641808 - RNA, 22 nt, Homo sapiens
uaaaaaaaacaaaaagaacaaa

SEQ ID NO: 641809 - RNA, 17 nt, Homo sapiens
uaaaaaaaacaauucca

SEQ ID NO: 641810 - RNA, 12 nt, Homo sapiens
uaaaaaaacuga

SEQ ID NO: 641811 - RNA, 18 nt, Homo sapiens
uaaaaaaagaacauaaaa

SEQ ID NO: 641812 - RNA, 19 nt, Homo sapiens
uaaaaaaauacaugcaucu

SEQ ID NO: 641813 - RNA, 15 nt, Homo sapiens
uaaaaaaauuacugu

SEQ ID NO: 641814 - RNA, 21 nt, Homo sapiens
uaaaaaaauuagugaguauaa

SEQ ID NO: 641815 - RNA, 12 nt, Homo sapiens
uaaaaaagccug

SEQ ID NO: 641816 - RNA, 18 nt, Homo sapiens
uaaaaaauaaaguaccac

SEQ ID NO: 641817 - RNA, 15 nt, Homo sapiens
uaaaaaauacuguug

SEQ ID NO: 641818 - RNA, 19 nt, Homo sapiens
uaaaaaaugucucauguca

SEQ ID NO: 641819 - RNA, 13 nt, Homo sapiens
uaaaaaauuugua

SEQ ID NO: 641820 - RNA, 16 nt, Homo sapiens
uaaaaacaaggucugc

SEQ ID NO: 641821 - RNA, 17 nt, Homo sapiens
uaaaaacacuaccucuu

SEQ ID NO: 641822 - RNA, 12 nt, Homo sapiens
uaaaaacuaaaa

SEQ ID NO: 641823 - RNA, 22 nt, Homo sapiens
uaaaaacucuuauaaauuucua

SEQ ID NO: 641824 - RNA, 22 nt, Homo sapiens
uaaaaacuuccuucaaucuuca

SEQ ID NO: 641825 - RNA, 12 nt, Homo sapiens
uaaaaacuugua

SEQ ID NO: 641826 - RNA, 13 nt, Homo sapiens
uaaaaagaggcau

SEQ ID NO: 641827 - RNA, 16 nt, Homo sapiens
uaaaaagauaaucuca

SEQ ID NO: 641828 - RNA, 16 nt, Homo sapiens
uaaaaagauccugcau

SEQ ID NO: 641829 - RNA, 15 nt, Homo sapiens
uaaaaagaucuacau

SEQ ID NO: 641830 - RNA, 20 nt, Homo sapiens
uaaaaagaucuacauacaaa

SEQ ID NO: 641831 - RNA, 14 nt, Homo sapiens
uaaaaagccugcau

SEQ ID NO: 641832 - RNA, 21 nt, Homo sapiens
uaaaaaggaaacuucaguuga

SEQ ID NO: 641833 - RNA, 20 nt, Homo sapiens
uaaaaaggaaauuagucuuu

SEQ ID NO: 641834 - RNA, 20 nt, Homo sapiens
uaaaaaggaacaagacugac

SEQ ID NO: 641835 - RNA, 18 nt, Homo sapiens
uaaaaaggcuaaauggaa

SEQ ID NO: 641836 - RNA, 16 nt, Homo sapiens
uaaaaagguuggccuu

SEQ ID NO: 641837 - RNA, 15 nt, Homo sapiens
uaaaaagucuucacu

SEQ ID NO: 641838 - RNA, 13 nt, Homo sapiens
uaaaaagugacac

SEQ ID NO: 641839 - RNA, 13 nt, Homo sapiens
uaaaaaguucaua

SEQ ID NO: 641840 - RNA, 22 nt, Homo sapiens
uaaaaauaaauucaaauuauuc

SEQ ID NO: 641841 - RNA, 15 nt, Homo sapiens
uaaaaauacaaaaau

SEQ ID NO: 641842 - RNA, 17 nt, Homo sapiens
uaaaaauacaacacuga

SEQ ID NO: 641843 - RNA, 19 nt, Homo sapiens
uaaaaauauagcaaaugca

SEQ ID NO: 641844 - RNA, 19 nt, Homo sapiens
uaaaaaucauugauuguca

SEQ ID NO: 641845 - RNA, 14 nt, Homo sapiens
uaaaaaucugagaa

SEQ ID NO: 641846 - RNA, 18 nt, Homo sapiens
uaaaaaugagugcuuaaa

SEQ ID NO: 641847 - RNA, 15 nt, Homo sapiens
uaaaaaugcaacuuc

SEQ ID NO: 641848 - RNA, 16 nt, Homo sapiens
uaaaaaugcuauaauu

SEQ ID NO: 641849 - RNA, 16 nt, Homo sapiens
uaaaaaugucaucuca

SEQ ID NO: 641850 - RNA, 17 nt, Homo sapiens
uaaaaauguccugccuu

SEQ ID NO: 641851 - RNA, 17 nt, Homo sapiens
uaaaaauuguagcuuuu

SEQ ID NO: 641852 - RNA, 23 nt, Homo sapiens
uaaaaauuuuuuugcauuuucac

SEQ ID NO: 641853 - RNA, 16 nt, Homo sapiens
uaaaacaaaaccaagc

SEQ ID NO: 641854 - RNA, 12 nt, Homo sapiens
uaaaacaaaaga

SEQ ID NO: 641855 - RNA, 13 nt, Homo sapiens
uaaaacaaaagag

SEQ ID NO: 641856 - RNA, 16 nt, Homo sapiens
uaaaacaaaauuugac

SEQ ID NO: 641857 - RNA, 18 nt, Homo sapiens
uaaaacaaagccaugcca

SEQ ID NO: 641858 - RNA, 22 nt, Homo sapiens
uaaaacaaauccauaauuauua

SEQ ID NO: 641859 - RNA, 14 nt, Homo sapiens
uaaaacaagccuua

SEQ ID NO: 641860 - RNA, 21 nt, Homo sapiens
uaaaacaggcaaaguuuuaca

SEQ ID NO: 641861 - RNA, 13 nt, Homo sapiens
uaaaacaucucau

SEQ ID NO: 641862 - RNA, 21 nt, Homo sapiens
uaaaacaugcugaaaacuaca

SEQ ID NO: 641863 - RNA, 21 nt, Homo sapiens
uaaaacauuacuuauuuaacu

SEQ ID NO: 641864 - RNA, 14 nt, Homo sapiens
uaaaacauuaguca

SEQ ID NO: 641865 - RNA, 23 nt, Homo sapiens
uaaaacauuagucaguugcucau

SEQ ID NO: 641866 - RNA, 12 nt, Homo sapiens
uaaaacauuccc

SEQ ID NO: 641867 - RNA, 16 nt, Homo sapiens
uaaaacauuggcauuu

SEQ ID NO: 641868 - RNA, 23 nt, Homo sapiens
uaaacaugaccacgaagaaugcu

SEQ ID NO: 641869 - RNA, 18 nt, Homo sapiens
uaaacaugucacaauaca

SEQ ID NO: 641870 - RNA, 22 nt, Homo sapiens
uaaacauuacuguuuuccaugc

SEQ ID NO: 641871 - RNA, 17 nt, Homo sapiens
uaaacauugaaguaaug

SEQ ID NO: 641872 - RNA, 22 nt, Homo sapiens
uaaacauugguaagaaugagcu

SEQ ID NO: 641873 - RNA, 17 nt, Homo sapiens
uaaacauuucaauguca

SEQ ID NO: 641874 - RNA, 20 nt, Homo sapiens
uaaacauuuuucacaucucu

SEQ ID NO: 641875 - RNA, 15 nt, Homo sapiens
uaaaccaaaaacuga

SEQ ID NO: 641876 - RNA, 19 nt, Homo sapiens
uaaaccaaaaacugaaagu

SEQ ID NO: 641877 - RNA, 20 nt, Homo sapiens
uaaaccaagaaggagaccuu

SEQ ID NO: 641878 - RNA, 19 nt, Homo sapiens
uaaaccaaggacugagcac

SEQ ID NO: 641879 - RNA, 17 nt, Homo sapiens
uaaaccaauguggcaag

SEQ ID NO: 641880 - RNA, 13 nt, Homo sapiens
uaaaccacugguc

SEQ ID NO: 641881 - RNA, 18 nt, Homo sapiens
uaaacccaguugccaucu

SEQ ID NO: 641882 - RNA, 14 nt, Homo sapiens
uaaacccuuaccaa

SEQ ID NO: 641883 - RNA, 17 nt, Homo sapiens
uaaacccuuuagugcuu

SEQ ID NO: 641884 - RNA, 18 nt, Homo sapiens
uaaacccuuuagugcuuu

SEQ ID NO: 641885 - RNA, 19 nt, Homo sapiens
uaaaccuagaguuuuauca

SEQ ID NO: 641886 - RNA, 13 nt, Homo sapiens
uaaaccuccauac

SEQ ID NO: 641887 - RNA, 16 nt, Homo sapiens
uaaaccuccuucggga

SEQ ID NO: 641888 - RNA, 16 nt, Homo sapiens
uaaaccugaagauguc

SEQ ID NO: 641889 - RNA, 23 nt, Homo sapiens
uaaaccuggaaucuacaagccaa

SEQ ID NO: 641890 - RNA, 20 nt, Homo sapiens
uaaaccugucuccacugugc

SEQ ID NO: 641891 - RNA, 13 nt, Homo sapiens
uaaacgggaacau

SEQ ID NO: 641892 - RNA, 15 nt, Homo sapiens
uaaacuacaaaguaa

SEQ ID NO: 641893 - RNA, 15 nt, Homo sapiens
uaaacuacaacgaac

SEQ ID NO: 641894 - RNA, 14 nt, Homo sapiens
uaaacuacucuuug

SEQ ID NO: 641895 - RNA, 16 nt, Homo sapiens
uaaacuauaaccucuc

SEQ ID NO: 641896 - RNA, 23 nt, Homo sapiens
uaaacuauacacuuaaugauaca

SEQ ID NO: 641897 - RNA, 13 nt, Homo sapiens
uaaacucagggac

SEQ ID NO: 641898 - RNA, 13 nt, Homo sapiens
uaaacuccuacua

SEQ ID NO: 641899 - RNA, 17 nt, Homo sapiens
uaaacuccuacuaaauc

SEQ ID NO: 641900 - RNA, 18 nt, Homo sapiens
uaaacugaaaaaugucag

SEQ ID NO: 641901 - RNA, 22 nt, Homo sapiens
uaaacuggcuggcccagaguuu

SEQ ID NO: 641902 - RNA, 16 nt, Homo sapiens
uaaacugguacaauuu

SEQ ID NO: 641903 - RNA, 13 nt, Homo sapiens
uaaacugugcacc

SEQ ID NO: 641904 - RNA, 12 nt, Homo sapiens
uaaacuguguau

SEQ ID NO: 641905 - RNA, 17 nt, Homo sapiens
uaaacuguuagcacugu

SEQ ID NO: 641906 - RNA, 18 nt, Homo sapiens
uaaacuguuagcacuguu

SEQ ID NO: 641907 - RNA, 21 nt, Homo sapiens
uaaacuuaccugggcauucuu

SEQ ID NO: 641908 - RNA, 20 nt, Homo sapiens
uaaacuuacuuaguguuaug

SEQ ID NO: 641909 - RNA, 13 nt, Homo sapiens
uaaacuucacuga

SEQ ID NO: 641910 - RNA, 13 nt, Homo sapiens
uaaacuugcauca

SEQ ID NO: 641911 - RNA, 16 nt, Homo sapiens
uaaacuugccuguuca

SEQ ID NO: 641912 - RNA, 23 nt, Homo sapiens
uaaacuuguguauugagucuuaa

SEQ ID NO: 641913 - RNA, 17 nt, Homo sapiens
uaaacuuuauuuguaaa

SEQ ID NO: 641914 - RNA, 19 nt, Homo sapiens
uaaacuuuccaaaaccuuc

SEQ ID NO: 641915 - RNA, 13 nt, Homo sapiens
uaaacuuuucaaa

SEQ ID NO: 641916 - RNA, 23 nt, Homo sapiens
uaaacuuuuuuucuguaccaguu

SEQ ID NO: 641917 - RNA, 17 nt, Homo sapiens
uaaagaaaaauaugaua

SEQ ID NO: 641918 - RNA, 21 nt, Homo sapiens
uaaagaaaaguagguuuacau

SEQ ID NO: 641919 - RNA, 19 nt, Homo sapiens
uaaagaaaauaaacaccau

SEQ ID NO: 641920 - RNA, 18 nt, Homo sapiens
uaaagaacgcgacuucca

SEQ ID NO: 641921 - RNA, 13 nt, Homo sapiens
uaaagaagccagc

SEQ ID NO: 641922 - RNA, 22 nt, Homo sapiens
uaaagaagguuggugaauuuca

SEQ ID NO: 641923 - RNA, 15 nt, Homo sapiens
uaaagaauaauacuu

SEQ ID NO: 641924 - RNA, 12 nt, Homo sapiens
uaaagaauacac

SEQ ID NO: 641925 - RNA, 20 nt, Homo sapiens
uaaagaauaugaaguucuau

SEQ ID NO: 641926 - RNA, 18 nt, Homo sapiens
uaaagaaucuaauucugu

SEQ ID NO: 641927 - RNA, 14 nt, Homo sapiens
uaaagaaugccauu

SEQ ID NO: 641928 - RNA, 21 nt, Homo sapiens
cuuccuagaggugugcuauac

SEQ ID NO: 641929 - RNA, 14 nt, Homo sapiens
cuuccucaccacuu

SEQ ID NO: 641930 - RNA, 21 nt, Homo sapiens
cuuccucagggccccugggga

SEQ ID NO: 641931 - RNA, 15 nt, Homo sapiens
cuuccuccagaggag

SEQ ID NO: 641932 - RNA, 17 nt, Homo sapiens
cuuccucuagagucuca

SEQ ID NO: 641933 - RNA, 12 nt, Homo sapiens
cuuccucuccac

SEQ ID NO: 641934 - RNA, 13 nt, Homo sapiens
cuuccucucucua

SEQ ID NO: 641935 - RNA, 15 nt, Homo sapiens
cuuccucucugcaau

SEQ ID NO: 641936 - RNA, 15 nt, Homo sapiens
cuuccucugcagaau

SEQ ID NO: 641937 - RNA, 14 nt, Homo sapiens
cuuccucugccaug

SEQ ID NO: 641938 - RNA, 14 nt, Homo sapiens
cuuccucuucuuca

SEQ ID NO: 641939 - RNA, 15 nt, Homo sapiens
cuuccugacacuuua

SEQ ID NO: 641940 - RNA, 15 nt, Homo sapiens
cuuccugagcuuucu

SEQ ID NO: 641941 - RNA, 16 nt, Homo sapiens
cuuccugccaccaguc

SEQ ID NO: 641942 - RNA, 19 nt, Homo sapiens
cuuccugccagcaggggug

SEQ ID NO: 641943 - RNA, 14 nt, Homo sapiens
cuuccuggacacac

SEQ ID NO: 641944 - RNA, 15 nt, Homo sapiens
cuuccuggccucuuc

SEQ ID NO: 641945 - RNA, 20 nt, Homo sapiens
cuuccuggcuccaacacugc

SEQ ID NO: 641946 - RNA, 20 nt, Homo sapiens
cuuccugggucaagugcuaa

SEQ ID NO: 641947 - RNA, 23 nt, Homo sapiens
cuuccuggguccuguucccuacc

SEQ ID NO: 641948 - RNA, 21 nt, Homo sapiens
cuuccugucccacuacuguag

SEQ ID NO: 641949 - RNA, 16 nt, Homo sapiens
cuuccugugacuucag

SEQ ID NO: 641950 - RNA, 14 nt, Homo sapiens
cuuccuguguccug

SEQ ID NO: 641951 - RNA, 15 nt, Homo sapiens
cuuccuguguccuga

SEQ ID NO: 641952 - RNA, 20 nt, Homo sapiens
cuuccuuaauucacucccac

SEQ ID NO: 641953 - RNA, 23 nt, Homo sapiens
cuuccuuauuuagccuaggagua

SEQ ID NO: 641954 - RNA, 16 nt, Homo sapiens
cuuccuucacuuugca

SEQ ID NO: 641955 - RNA, 18 nt, Homo sapiens
cuuccuucaggacucugc

SEQ ID NO: 641956 - RNA, 19 nt, Homo sapiens
cuuccuugaagaacugcag

SEQ ID NO: 641957 - RNA, 21 nt, Homo sapiens
cuuccuugcaggagugacuca

SEQ ID NO: 641958 - RNA, 20 nt, Homo sapiens
cuuccuugggaugaucuuga

SEQ ID NO: 641959 - RNA, 14 nt, Homo sapiens
cuuccuuuacuuuc

SEQ ID NO: 641960 - RNA, 15 nt, Homo sapiens
cuuccuuucuugucu

SEQ ID NO: 641961 - RNA, 19 nt, Homo sapiens
cuuccuuugucguguuucu

SEQ ID NO: 641962 - RNA, 14 nt, Homo sapiens
cuucgacucaggau

SEQ ID NO: 641963 - RNA, 14 nt, Homo sapiens
cuucgaguccagga

SEQ ID NO: 641964 - RNA, 13 nt, Homo sapiens
cuucgcacucaau

SEQ ID NO: 641965 - RNA, 22 nt, Homo sapiens
cuucgggcugugcccggggaaa

SEQ ID NO: 641966 - RNA, 18 nt, Homo sapiens
cuucguacauagucuguu

SEQ ID NO: 641967 - RNA, 12 nt, Homo sapiens
cuucgugccugu

SEQ ID NO: 641968 - RNA, 15 nt, Homo sapiens
cuucguguauagcug

SEQ ID NO: 641969 - RNA, 16 nt, Homo sapiens
cuucgugugcugcugc

SEQ ID NO: 641970 - RNA, 18 nt, Homo sapiens
cuucuaaaaacuucucaa

SEQ ID NO: 641971 - RNA, 21 nt, Homo sapiens
cuucuaaacccaauccaaaug

SEQ ID NO: 641972 - RNA, 14 nt, Homo sapiens
cuucuaacacaaaa

SEQ ID NO: 641973 - RNA, 20 nt, Homo sapiens
cuucuaagagguagauacca

SEQ ID NO: 641974 - RNA, 18 nt, Homo sapiens
cuucuacagcagcacugu

SEQ ID NO: 641975 - RNA, 21 nt, Homo sapiens
cuucuacuacccccacagacc

SEQ ID NO: 641976 - RNA, 19 nt, Homo sapiens
cuucuaggcccauuguccu

SEQ ID NO: 641977 - RNA, 18 nt, Homo sapiens
cuucuaggguuauugcau

SEQ ID NO: 641978 - RNA, 21 nt, Homo sapiens
cuucuaggucacuucucacaa

SEQ ID NO: 641979 - RNA, 14 nt, Homo sapiens
cuucuagugcuuuu

SEQ ID NO: 641980 - RNA, 21 nt, Homo sapiens
cuucuaguggucucaccugga

SEQ ID NO: 641981 - RNA, 14 nt, Homo sapiens
cuucuauguauuag

SEQ ID NO: 641982 - RNA, 14 nt, Homo sapiens
cuucuauuaaucaa

SEQ ID NO: 641983 - RNA, 17 nt, Homo sapiens
cuucuauucaaaugaag

SEQ ID NO: 641984 - RNA, 23 nt, Homo sapiens
cuucuauuuuuaucaugaauucc

SEQ ID NO: 641985 - RNA, 19 nt, Homo sapiens
cuucucaaauuagcugcaa

SEQ ID NO: 641986 - RNA, 16 nt, Homo sapiens
cuucucacaucugucc

SEQ ID NO: 641987 - RNA, 20 nt, Homo sapiens
cuucucagauuucugaggaa

SEQ ID NO: 641988 - RNA, 11 nt, Homo sapiens
cuucucaggaa

SEQ ID NO: 641989 - RNA, 17 nt, Homo sapiens
cuucuccaaaugagauc

SEQ ID NO: 641990 - RNA, 16 nt, Homo sapiens
uagaagagucuauugu

SEQ ID NO: 641991 - RNA, 18 nt, Homo sapiens
uagaagauagaugcacuu

SEQ ID NO: 641992 - RNA, 18 nt, Homo sapiens
uagaagauccacauccuc

SEQ ID NO: 641993 - RNA, 20 nt, Homo sapiens
uagaagauguguaaacaggu

SEQ ID NO: 641994 - RNA, 17 nt, Homo sapiens
uagaagcaaagauuuca

SEQ ID NO: 641995 - RNA, 21 nt, Homo sapiens
uagaagcaaaugacaaaaagc

SEQ ID NO: 641996 - RNA, 14 nt, Homo sapiens
uagaagcacuacac

SEQ ID NO: 641997 - RNA, 15 nt, Homo sapiens
uagaagcaucacagg

SEQ ID NO: 641998 - RNA, 23 nt, Homo sapiens
uagaagccugcagaauccagcua

SEQ ID NO: 641999 - RNA, 22 nt, Homo sapiens
uagaagcuaauaaauaaucauc

SEQ ID NO: 642000 - RNA, 18 nt, Homo sapiens
uagaagcuguaacagaau

SEQ ID NO: 642001 - RNA, 19 nt, Homo sapiens
uagaaggacucaguauuau

SEQ ID NO: 642002 - RNA, 19 nt, Homo sapiens
uagaaguagcaaaaaguau

SEQ ID NO: 642003 - RNA, 20 nt, Homo sapiens
uagaagugguuuccugauaa

SEQ ID NO: 642004 - RNA, 18 nt, Homo sapiens
uagaaguuccuagugaug

SEQ ID NO: 642005 - RNA, 15 nt, Homo sapiens
uagaauaaaugaaga

SEQ ID NO: 642006 - RNA, 15 nt, Homo sapiens
uagaauaaauuccca

SEQ ID NO: 642007 - RNA, 19 nt, Homo sapiens
uagaauagcauuugccacu

SEQ ID NO: 642008 - RNA, 19 nt, Homo sapiens
uagaauaggcagggggccc

SEQ ID NO: 642009 - RNA, 20 nt, Homo sapiens
uagaauauuuauuaccucug

SEQ ID NO: 642010 - RNA, 13 nt, Homo sapiens
uagaaucaauuua

SEQ ID NO: 642011 - RNA, 16 nt, Homo sapiens
uagaauccgaagggaa

SEQ ID NO: 642012 - RNA, 12 nt, Homo sapiens
uagaaugcagcu

SEQ ID NO: 642013 - RNA, 12 nt, Homo sapiens
uagaaugccaua

SEQ ID NO: 642014 - RNA, 23 nt, Homo sapiens
uagaauggaggggacuccaaagc

SEQ ID NO: 642015 - RNA, 23 nt, Homo sapiens
uagaaugggaagggucauagaaa

SEQ ID NO: 642016 - RNA, 17 nt, Homo sapiens
uagaauuauaucacuuc

SEQ ID NO: 642017 - RNA, 16 nt, Homo sapiens
uagaauucuagugcug

SEQ ID NO: 642018 - RNA, 12 nt, Homo sapiens
uagaauucugaa

SEQ ID NO: 642019 - RNA, 17 nt, Homo sapiens
uagaauuggagaguaaa

SEQ ID NO: 642020 - RNA, 20 nt, Homo sapiens
uagaauuugggggaaaauuu

SEQ ID NO: 642021 - RNA, 15 nt, Homo sapiens
uagacaaaaaguaua

SEQ ID NO: 642022 - RNA, 15 nt, Homo sapiens
uagacaaacagcauc

SEQ ID NO: 642023 - RNA, 18 nt, Homo sapiens
uagacaaauagaaaaugg

SEQ ID NO: 642024 - RNA, 18 nt, Homo sapiens
uagacacaucaaaugccc

SEQ ID NO: 642025 - RNA, 12 nt, Homo sapiens
uagacacaugaa

SEQ ID NO: 642026 - RNA, 23 nt, Homo sapiens
uagacacccauuuucacauuccc

SEQ ID NO: 642027 - RNA, 13 nt, Homo sapiens
uagacacuggaca

SEQ ID NO: 642028 - RNA, 17 nt, Homo sapiens
uagacagguguuacuua

SEQ ID NO: 642029 - RNA, 20 nt, Homo sapiens
uagacagguguuacuuacag

SEQ ID NO: 642030 - RNA, 16 nt, Homo sapiens
uagacauacagagaua

SEQ ID NO: 642031 - RNA, 18 nt, Homo sapiens
uagacauuucuccaaaga

SEQ ID NO: 642032 - RNA, 19 nt, Homo sapiens
uagacauuucuccaaagaa

SEQ ID NO: 642033 - RNA, 19 nt, Homo sapiens
uagacauuuuugugccauu

SEQ ID NO: 642034 - RNA, 21 nt, Homo sapiens
uagacccugcauuuauagcau

SEQ ID NO: 642035 - RNA, 22 nt, Homo sapiens
uagaccgcgugauaaaacuggg

SEQ ID NO: 642036 - RNA, 13 nt, Homo sapiens
uagaccugagcug

SEQ ID NO: 642037 - RNA, 19 nt, Homo sapiens
uagacuagguuuauuuauc

SEQ ID NO: 642038 - RNA, 17 nt, Homo sapiens
uagacucuugaagacaa

SEQ ID NO: 642039 - RNA, 19 nt, Homo sapiens
uagacugaauucagcacca

SEQ ID NO: 642040 - RNA, 23 nt, Homo sapiens
uagacugacuuguuugucuucca

SEQ ID NO: 642041 - RNA, 12 nt, Homo sapiens
uagacugaggua

SEQ ID NO: 642042 - RNA, 14 nt, Homo sapiens
uagacugagucaga

SEQ ID NO: 642043 - RNA, 20 nt, Homo sapiens
uagacugauggaacagaaua

SEQ ID NO: 642044 - RNA, 12 nt, Homo sapiens
uagacugccagg

SEQ ID NO: 642045 - RNA, 11 nt, Homo sapiens
uagacuguaac

SEQ ID NO: 642046 - RNA, 19 nt, Homo sapiens
uagacuguuucacauugca

SEQ ID NO: 642047 - RNA, 12 nt, Homo sapiens
uagacuuaccuu

SEQ ID NO: 642048 - RNA, 15 nt, Homo sapiens
uagacuuacuuuccu

SEQ ID NO: 642049 - RNA, 16 nt, Homo sapiens
uagacuuuugcuuuau

SEQ ID NO: 642050 - RNA, 17 nt, Homo sapiens
uagacuuuugcuuuaug

SEQ ID NO: 642051 - RNA, 19 nt, Homo sapiens
uagagaaacacuaaagcau

SEQ ID NO: 642052 - RNA, 17 nt, Homo sapiens
uagagaaugucacugua

SEQ ID NO: 642053 - RNA, 20 nt, Homo sapiens
uagagaauuuucugcauuau

SEQ ID NO: 642054 - RNA, 23 nt, Homo sapiens
uagagacaggacagaauguguuc

SEQ ID NO: 642055 - RNA, 19 nt, Homo sapiens
uagagacgggguuucucca

SEQ ID NO: 642056 - RNA, 20 nt, Homo sapiens
uagagacgguguuuugccau

SEQ ID NO: 642057 - RNA, 15 nt, Homo sapiens
uagagacuguagauu

SEQ ID NO: 642058 - RNA, 14 nt, Homo sapiens
uagagagagacuau

SEQ ID NO: 642059 - RNA, 16 nt, Homo sapiens
uagagagcuguuccca

SEQ ID NO: 642060 - RNA, 17 nt, Homo sapiens
uagagauaaaacagaau

SEQ ID NO: 642061 - RNA, 13 nt, Homo sapiens
uagagauacagua

SEQ ID NO: 642062 - RNA, 18 nt, Homo sapiens
uagagauagcuacagugu

SEQ ID NO: 642063 - RNA, 18 nt, Homo sapiens
uagagaucuauguacugu

SEQ ID NO: 642064 - RNA, 14 nt, Homo sapiens
uagagaugcaguuu

SEQ ID NO: 642065 - RNA, 17 nt, Homo sapiens
uagagauggaguuugcu

SEQ ID NO: 642066 - RNA, 18 nt, Homo sapiens
uagagauuaccuccugag

SEQ ID NO: 642067 - RNA, 14 nt, Homo sapiens
uagagcaaccucug

SEQ ID NO: 642068 - RNA, 19 nt, Homo sapiens
uagagcagccacaaccaaa

SEQ ID NO: 642069 - RNA, 15 nt, Homo sapiens
uagagcuagaugugu

SEQ ID NO: 642070 - RNA, 22 nt, Homo sapiens
uagagcuagaugugucuuacca

SEQ ID NO: 642071 - RNA, 21 nt, Homo sapiens
uagaggaaggcugaacucuuc

SEQ ID NO: 642072 - RNA, 15 nt, Homo sapiens
uagaggaauguguuc

SEQ ID NO: 642073 - RNA, 12 nt, Homo sapiens
gaaggcaaaauu

SEQ ID NO: 642074 - RNA, 21 nt, Homo sapiens
gaaggcaauuuuaguguauua

SEQ ID NO: 642075 - RNA, 19 nt, Homo sapiens
gaaggcagagguugcagug

SEQ ID NO: 642076 - RNA, 13 nt, Homo sapiens
gaaggcaugccua

SEQ ID NO: 642077 - RNA, 18 nt, Homo sapiens
gaaggccgggcgcagugg

SEQ ID NO: 642078 - RNA, 23 nt, Homo sapiens
gaaggccucuuguugagugccag

SEQ ID NO: 642079 - RNA, 16 nt, Homo sapiens
gaaggccuuucugcug

SEQ ID NO: 642080 - RNA, 24 nt, Homo sapiens
gaaggcuacauauacauaguugcu

SEQ ID NO: 642081 - RNA, 14 nt, Homo sapiens
gaaggcuacuugag

SEQ ID NO: 642082 - RNA, 15 nt, Homo sapiens
gaaggcugagugucc

SEQ ID NO: 642083 - RNA, 21 nt, Homo sapiens
gaaggcuuuaauaaaggccac

SEQ ID NO: 642084 - RNA, 22 nt, Homo sapiens
gaaggcuuucaggcuaccuuuu

SEQ ID NO: 642085 - RNA, 15 nt, Homo sapiens
gaagggcucuaugga

SEQ ID NO: 642086 - RNA, 15 nt, Homo sapiens
gaagggguuccucaa

SEQ ID NO: 642087 - RNA, 22 nt, Homo sapiens
gaagggguuuucccaugacucu

SEQ ID NO: 642088 - RNA, 16 nt, Homo sapiens
gaagguaucaguuaua

SEQ ID NO: 642089 - RNA, 20 nt, Homo sapiens
gaaggucccaccuccauuug

SEQ ID NO: 642090 - RNA, 21 nt, Homo sapiens
gaaggucccaccuccauuugc

SEQ ID NO: 642091 - RNA, 21 nt, Homo sapiens
gaaggucuguacuaacaaagc

SEQ ID NO: 642092 - RNA, 19 nt, Homo sapiens
gaaggugaaagugcaguuc

SEQ ID NO: 642093 - RNA, 16 nt, Homo sapiens
gaaggugccuggccau

SEQ ID NO: 642094 - RNA, 23 nt, Homo sapiens
gaaggugcugauccuaagaauuu

SEQ ID NO: 642095 - RNA, 14 nt, Homo sapiens
gaagguuaucagug

SEQ ID NO: 642096 - RNA, 16 nt, Homo sapiens
gaagguucucugugcu

SEQ ID NO: 642097 - RNA, 19 nt, Homo sapiens
gaagguuggugaauuucac

SEQ ID NO: 642098 - RNA, 20 nt, Homo sapiens
gaagguuggugaauuucaca

SEQ ID NO: 642099 - RNA, 19 nt, Homo sapiens
gaagguuuguauauuguca

SEQ ID NO: 642100 - RNA, 18 nt, Homo sapiens
gaaguaaccauuugcacu

SEQ ID NO: 642101 - RNA, 19 nt, Homo sapiens
gaaguaagccucaucauca

SEQ ID NO: 642102 - RNA, 20 nt, Homo sapiens
gaaguacuuuaccugaaaga

SEQ ID NO: 642103 - RNA, 22 nt, Homo sapiens
gaaguagaauuuguccaauaac

SEQ ID NO: 642104 - RNA, 19 nt, Homo sapiens
gaaguagauuaagagccau

SEQ ID NO: 642105 - RNA, 21 nt, Homo sapiens
gaaguagauuaagagccauau

SEQ ID NO: 642106 - RNA, 18 nt, Homo sapiens
gaaguagcagugucugua

SEQ ID NO: 642107 - RNA, 16 nt, Homo sapiens
gaaguagcuucagagg

SEQ ID NO: 642108 - RNA, 15 nt, Homo sapiens
gaaguaggcauauau

SEQ ID NO: 642109 - RNA, 16 nt, Homo sapiens
gaaguaggggcaagcu

SEQ ID NO: 642110 - RNA, 14 nt, Homo sapiens
gaaguauguauauu

SEQ ID NO: 642111 - RNA, 18 nt, Homo sapiens
gaaucuauaguucacuga

SEQ ID NO: 642112 - RNA, 13 nt, Homo sapiens
gaaucucucccuc

SEQ ID NO: 642113 - RNA, 15 nt, Homo sapiens
gaaucugagugaauu

SEQ ID NO: 642114 - RNA, 15 nt, Homo sapiens
gaaucuguacauguu

SEQ ID NO: 642115 - RNA, 19 nt, Homo sapiens
gaaucugugggucugggag

SEQ ID NO: 642116 - RNA, 12 nt, Homo sapiens
gaaucuugacuu

SEQ ID NO: 642117 - RNA, 13 nt, Homo sapiens
gaaugaacacucc

SEQ ID NO: 642118 - RNA, 15 nt, Homo sapiens
gaaugaacuguggaa

SEQ ID NO: 642119 - RNA, 15 nt, Homo sapiens
gaaugaagaacugca

SEQ ID NO: 642120 - RNA, 16 nt, Homo sapiens
gaaugaagguaauauu

SEQ ID NO: 642121 - RNA, 23 nt, Homo sapiens
gaaugaaucucaagauucaguag

SEQ ID NO: 642122 - RNA, 15 nt, Homo sapiens
gaaugacaacagaag

SEQ ID NO: 642123 - RNA, 21 nt, Homo sapiens
gaaugacuccaccuucucacc

SEQ ID NO: 642124 - RNA, 20 nt, Homo sapiens
gaaugagacugaacugugug

SEQ ID NO: 642125 - RNA, 19 nt, Homo sapiens
gaaugagcacccauuccaa

SEQ ID NO: 642126 - RNA, 18 nt, Homo sapiens
gaaugaggucccaggcag

SEQ ID NO: 642127 - RNA, 20 nt, Homo sapiens
gaaugaucagcaucugugau

SEQ ID NO: 642128 - RNA, 21 nt, Homo sapiens
gaaugaucagcaucugugaug

SEQ ID NO: 642129 - RNA, 15 nt, Homo sapiens
gaaugaugcuaugaa

SEQ ID NO: 642130 - RNA, 16 nt, Homo sapiens
gaaugaugugauacaa

SEQ ID NO: 642131 - RNA, 21 nt, Homo sapiens
gaaugauucacauccucucaa

SEQ ID NO: 642132 - RNA, 15 nt, Homo sapiens
gaaugauucauguua

SEQ ID NO: 642133 - RNA, 14 nt, Homo sapiens
gaaugcaauaucau

SEQ ID NO: 642134 - RNA, 17 nt, Homo sapiens
gaaugcacaguacuguu

SEQ ID NO: 642135 - RNA, 19 nt, Homo sapiens
gaaugccuaaauauaauua

SEQ ID NO: 642136 - RNA, 17 nt, Homo sapiens
gaaugccucaaugugac

SEQ ID NO: 642137 - RNA, 20 nt, Homo sapiens
gaaugcggccgcauucccug

SEQ ID NO: 642138 - RNA, 16 nt, Homo sapiens
gaaugcuugcuguaau

SEQ ID NO: 642139 - RNA, 16 nt, Homo sapiens
gaauggaaaacacaug

SEQ ID NO: 642140 - RNA, 18 nt, Homo sapiens
gaauggaauaacuaucuc

SEQ ID NO: 642141 - RNA, 19 nt, Homo sapiens
gaauggacauccuguauaa

SEQ ID NO: 642142 - RNA, 21 nt, Homo sapiens
gaauggacgugcugggaccaa

SEQ ID NO: 642143 - RNA, 21 nt, Homo sapiens
gaauggagaaaguaagucuuu

SEQ ID NO: 642144 - RNA, 17 nt, Homo sapiens
gaauggagcuggcccuc

SEQ ID NO: 642145 - RNA, 17 nt, Homo sapiens
gaauggaggagucucaa

SEQ ID NO: 642146 - RNA, 21 nt, Homo sapiens
gaauggagggaaugcucagaa

SEQ ID NO: 642147 - RNA, 19 nt, Homo sapiens
gaauggcaggugucauaug

SEQ ID NO: 642148 - RNA, 17 nt, Homo sapiens
gaaugggccacuguagg

SEQ ID NO: 642149 - RNA, 16 nt, Homo sapiens
gaauggggacacggug

SEQ ID NO: 642150 - RNA, 19 nt, Homo sapiens
gaauggggggcgggccagg

SEQ ID NO: 642151 - RNA, 16 nt, Homo sapiens
gaauggguuugcuaga

SEQ ID NO: 642152 - RNA, 20 nt, Homo sapiens
gaaugguacaugucuuccau

SEQ ID NO: 642153 - RNA, 22 nt, Homo sapiens
gaauggucuggcaauauucugu

SEQ ID NO: 642154 - RNA, 16 nt, Homo sapiens
gaaugguguuuuguca

SEQ ID NO: 642155 - RNA, 19 nt, Homo sapiens
gaaugguuaauaaaacugc

SEQ ID NO: 642156 - RNA, 20 nt, Homo sapiens
gaauguagcuuccaccucau

SEQ ID NO: 642157 - RNA, 13 nt, Homo sapiens
gaaugucacuggu

SEQ ID NO: 642158 - RNA, 19 nt, Homo sapiens
gaauguccucuuggagaaa

SEQ ID NO: 642159 - RNA, 15 nt, Homo sapiens
gaaugugauauuuga

SEQ ID NO: 642160 - RNA, 12 nt, Homo sapiens
gaaugugucuuu

SEQ ID NO: 642161 - RNA, 18 nt, Homo sapiens
gaaugugugggguauaga

SEQ ID NO: 642162 - RNA, 20 nt, Homo sapiens
gaauguguuauuugucacaa

SEQ ID NO: 642163 - RNA, 20 nt, Homo sapiens
gaauguuagauuccucuugc

SEQ ID NO: 642164 - RNA, 17 nt, Homo sapiens
gaauguucaucucucca

SEQ ID NO: 642165 - RNA, 13 nt, Homo sapiens
gaauguugguuuu

SEQ ID NO: 642166 - RNA, 17 nt, Homo sapiens
gaauguuuaaagaucau

SEQ ID NO: 642167 - RNA, 19 nt, Homo sapiens
gaauuaauucagauguuuu

SEQ ID NO: 642168 - RNA, 17 nt, Homo sapiens
gaauuaauuuucagcca

SEQ ID NO: 642169 - RNA, 17 nt, Homo sapiens
gaauuacuuguguuacu

SEQ ID NO: 642170 - RNA, 23 nt, Homo sapiens
gaauuacuuguguuacuugccaa

SEQ ID NO: 642171 - RNA, 10 nt, Homo sapiens
gaauuacuuu

SEQ ID NO: 642172 - RNA, 19 nt, Homo sapiens
gaauuagcaauaacauaca

SEQ ID NO: 642173 - RNA, 17 nt, Homo sapiens
gaauuaggaagaccaag

SEQ ID NO: 642174 - RNA, 16 nt, Homo sapiens
gaauuauaacuguaaa

SEQ ID NO: 642175 - RNA, 21 nt, Homo sapiens
gaauuauguaauauauuguac

SEQ ID NO: 642176 - RNA, 24 nt, Homo sapiens
gaauuauucagugaauuuguccau

SEQ ID NO: 642177 - RNA, 16 nt, Homo sapiens
gaauuauugacacuga

SEQ ID NO: 642178 - RNA, 22 nt, Homo sapiens
gaauuauuguagacaugcccaa

SEQ ID NO: 642179 - RNA, 19 nt, Homo sapiens
gaauuauuuuuguguuucu

SEQ ID NO: 642180 - RNA, 12 nt, Homo sapiens
gaauucaaacaa

SEQ ID NO: 642181 - RNA, 12 nt, Homo sapiens
gaauucagcuca

SEQ ID NO: 642182 - RNA, 21 nt, Homo sapiens
gaauucauuuucaucacuggg

SEQ ID NO: 642183 - RNA, 15 nt, Homo sapiens
gaauuccaaagcaaa

SEQ ID NO: 642184 - RNA, 18 nt, Homo sapiens
gaauuccauaguggacca

SEQ ID NO: 642185 - RNA, 18 nt, Homo sapiens
gaauucccuuucauuuga

SEQ ID NO: 642186 - RNA, 19 nt, Homo sapiens
gaauuccucuuuugcuuaa

SEQ ID NO: 642187 - RNA, 15 nt, Homo sapiens
gaauucuccaaaaca

SEQ ID NO: 642188 - RNA, 20 nt, Homo sapiens
gaauucucucuucuggaauc

SEQ ID NO: 642189 - RNA, 18 nt, Homo sapiens
gaauugaacgacuaccca

SEQ ID NO: 642190 - RNA, 14 nt, Homo sapiens
gaauugacauugaa

SEQ ID NO: 642191 - RNA, 22 nt, Homo sapiens
gaauugauauugaaugauguga

SEQ ID NO: 642192 - RNA, 17 nt, Homo sapiens
gaauugauugucagcca

SEQ ID NO: 642193 - RNA, 22 nt, Homo sapiens
gaauugauugucagccaccucc

SEQ ID NO: 642194 - RNA, 15 nt, Homo sapiens
gaauugcacugaaca

SEQ ID NO: 642195 - RNA, 18 nt, Homo sapiens
gaauuggaaucacauucu

SEQ ID NO: 642196 - RNA, 23 nt, Homo sapiens
gaauuguaccuauuucugaugau

SEQ ID NO: 642197 - RNA, 15 nt, Homo sapiens
uagcuauauccaugu

SEQ ID NO: 642198 - RNA, 14 nt, Homo sapiens
uagcuauggaauca

SEQ ID NO: 642199 - RNA, 19 nt, Homo sapiens
uagcuauggaaucaauuca

SEQ ID NO: 642200 - RNA, 20 nt, Homo sapiens
uagcuauuuguuuacaugca

SEQ ID NO: 642201 - RNA, 12 nt, Homo sapiens
uagcucacugaa

SEQ ID NO: 642202 - RNA, 13 nt, Homo sapiens
uagcucacugaau

SEQ ID NO: 642203 - RNA, 15 nt, Homo sapiens
uagcucagucaucaa

SEQ ID NO: 642204 - RNA, 19 nt, Homo sapiens
uagcuccauaaaguacaaa

SEQ ID NO: 642205 - RNA, 14 nt, Homo sapiens
uagcucuuuggucu

SEQ ID NO: 642206 - RNA, 16 nt, Homo sapiens
uagcugacuacaaauu

SEQ ID NO: 642207 - RNA, 20 nt, Homo sapiens
uagcugagaagcaauggguc

SEQ ID NO: 642208 - RNA, 19 nt, Homo sapiens
uagcugaguuuaacaugug

SEQ ID NO: 642209 - RNA, 17 nt, Homo sapiens
uagcugggaagaccaau

SEQ ID NO: 642210 - RNA, 20 nt, Homo sapiens
uagcuggugguugugccuuu

SEQ ID NO: 642211 - RNA, 17 nt, Homo sapiens
uagcuguaaggcaugaa

SEQ ID NO: 642212 - RNA, 15 nt, Homo sapiens
uagcugucugcucag

SEQ ID NO: 642213 - RNA, 15 nt, Homo sapiens
uagcugucugugaau

SEQ ID NO: 642214 - RNA, 18 nt, Homo sapiens
uagcugugcaagaccuag

SEQ ID NO: 642215 - RNA, 19 nt, Homo sapiens
uagcuuacaggaagcuuuu

SEQ ID NO: 642216 - RNA, 17 nt, Homo sapiens
uagcuuacccaauggga

SEQ ID NO: 642217 - RNA, 16 nt, Homo sapiens
uagcuuagaccucagc

SEQ ID NO: 642218 - RNA, 21 nt, Homo sapiens
uagcuuagcuaugucagccaa

SEQ ID NO: 642219 - RNA, 14 nt, Homo sapiens
uagcuuagcugucu

SEQ ID NO: 642220 - RNA, 15 nt, Homo sapiens
uagcuuccaccucau

SEQ ID NO: 642221 - RNA, 13 nt, Homo sapiens
uagcuugcaccuu

SEQ ID NO: 642222 - RNA, 20 nt, Homo sapiens
uagcuuggagggauggagag

SEQ ID NO: 642223 - RNA, 11 nt, Homo sapiens
uagcuuuucau

SEQ ID NO: 642224 - RNA, 15 nt, Homo sapiens
uagcuuuuguuuaca

SEQ ID NO: 642225 - RNA, 18 nt, Homo sapiens
uaggaaaaaaauaguaaa

SEQ ID NO: 642226 - RNA, 17 nt, Homo sapiens
uaggaaaaguacauuua

SEQ ID NO: 642227 - RNA, 14 nt, Homo sapiens
uaggaaaauuucac

SEQ ID NO: 642228 - RNA, 13 nt, Homo sapiens
uaggaaacuugaa

SEQ ID NO: 642229 - RNA, 17 nt, Homo sapiens
uaggaaagcauaugcag

SEQ ID NO: 642230 - RNA, 15 nt, Homo sapiens
uaggaaauucugaug

SEQ ID NO: 642231 - RNA, 19 nt, Homo sapiens
uaggaagauggagguuuac

SEQ ID NO: 642232 - RNA, 13 nt, Homo sapiens
uaggaagcacuga

SEQ ID NO: 642233 - RNA, 15 nt, Homo sapiens
gacauacuuaaugca

SEQ ID NO: 642234 - RNA, 21 nt, Homo sapiens
gacauauguagaugugcugca

SEQ ID NO: 642235 - RNA, 16 nt, Homo sapiens
gacauauucaagugau

SEQ ID NO: 642236 - RNA, 21 nt, Homo sapiens
gacaucaaagugguaaauacu

SEQ ID NO: 642237 - RNA, 23 nt, Homo sapiens
gacaucaaagugguaaauacugu

SEQ ID NO: 642238 - RNA, 12 nt, Homo sapiens
gacaucaucaag

SEQ ID NO: 642239 - RNA, 20 nt, Homo sapiens
gacauccccccgccaaaagc

SEQ ID NO: 642240 - RNA, 22 nt, Homo sapiens
gacaucgguguucuucuuccca

SEQ ID NO: 642241 - RNA, 24 nt, Homo sapiens
gacaucgguucauauuaagacaua

SEQ ID NO: 642242 - RNA, 14 nt, Homo sapiens
gacaucuacauuuu

SEQ ID NO: 642243 - RNA, 14 nt, Homo sapiens
gacaucucaggggc

SEQ ID NO: 642244 - RNA, 15 nt, Homo sapiens
gacaucugcuguuau

SEQ ID NO: 642245 - RNA, 16 nt, Homo sapiens
gacaucuguggccaac

SEQ ID NO: 642246 - RNA, 19 nt, Homo sapiens
gacaucuuaggcuggccag

SEQ ID NO: 642247 - RNA, 14 nt, Homo sapiens
gacaugacauucuu

SEQ ID NO: 642248 - RNA, 17 nt, Homo sapiens
gacaugcccaaggccac

SEQ ID NO: 642249 - RNA, 15 nt, Homo sapiens
gacaugcccugugug

SEQ ID NO: 642250 - RNA, 14 nt, Homo sapiens
gacauguaauguug

SEQ ID NO: 642251 - RNA, 22 nt, Homo sapiens
gacauguagguaggaagcacug

SEQ ID NO: 642252 - RNA, 23 nt, Homo sapiens
gacauguagguaggaagcacuga

SEQ ID NO: 642253 - RNA, 18 nt, Homo sapiens
gacaugucuagccacuga

SEQ ID NO: 642254 - RNA, 17 nt, Homo sapiens
gacaugugaagcuauuu

SEQ ID NO: 642255 - RNA, 22 nt, Homo sapiens
gacaugugcuggacacugucca

SEQ ID NO: 642256 - RNA, 17 nt, Homo sapiens
gacauguuuuuauaugu

SEQ ID NO: 642257 - RNA, 20 nt, Homo sapiens
gacauuaaggaccaauagca

SEQ ID NO: 642258 - RNA, 13 nt, Homo sapiens
gacauuccagggg

SEQ ID NO: 642259 - RNA, 14 nt, Homo sapiens
gacauuuauucaaa

SEQ ID NO: 642260 - RNA, 20 nt, Homo sapiens
gacauuuccaagcagacugu

SEQ ID NO: 642261 - RNA, 18 nt, Homo sapiens
gacauuucuaacauaugu

SEQ ID NO: 642262 - RNA, 21 nt, Homo sapiens
gacauuugggagacaugugac

SEQ ID NO: 642263 - RNA, 17 nt, Homo sapiens
gaccaaaaaaccucacu

SEQ ID NO: 642264 - RNA, 22 nt, Homo sapiens
gaccaaaauaccuuggucauuu

SEQ ID NO: 642265 - RNA, 21 nt, Homo sapiens
gaccaaaaugacaaugaugau

SEQ ID NO: 642266 - RNA, 16 nt, Homo sapiens
gaccaaacuacuucau

SEQ ID NO: 642267 - RNA, 17 nt, Homo sapiens
gaccaaagagcccucaa

SEQ ID NO: 642268 - RNA, 13 nt, Homo sapiens
gaccaaagcaaga

SEQ ID NO: 642269 - RNA, 17 nt, Homo sapiens
gaccaaauaaaguacca

SEQ ID NO: 642270 - RNA, 18 nt, Homo sapiens
gaccaaauaaaguaccau

SEQ ID NO: 642271 - RNA, 13 nt, Homo sapiens
gaccaaaucucag

SEQ ID NO: 642272 - RNA, 24 nt, Homo sapiens
gaccaaaugccugguaccagagga

SEQ ID NO: 642273 - RNA, 18 nt, Homo sapiens
gaccaacgcacaacagga

SEQ ID NO: 642274 - RNA, 15 nt, Homo sapiens
gaccaacugggccca

SEQ ID NO: 642275 - RNA, 20 nt, Homo sapiens
gaccaagacuuuugucugau

SEQ ID NO: 642276 - RNA, 15 nt, Homo sapiens
gaccaauguccuugu

SEQ ID NO: 642277 - RNA, 20 nt, Homo sapiens
gaccaauucuaacagcaaau

SEQ ID NO: 642278 - RNA, 12 nt, Homo sapiens
gaccacaccacu

SEQ ID NO: 642279 - RNA, 23 nt, Homo sapiens
gaccacacugcacacagugacuu

SEQ ID NO: 642280 - RNA, 19 nt, Homo sapiens
gaccacagagggcaggaac

SEQ ID NO: 642281 - RNA, 14 nt, Homo sapiens
gaccacaucuuuau

SEQ ID NO: 642282 - RNA, 15 nt, Homo sapiens
gaccaccacuucgaa

SEQ ID NO: 642283 - RNA, 16 nt, Homo sapiens
gaccacccccaaacac

SEQ ID NO: 642284 - RNA, 14 nt, Homo sapiens
gaccacccccuguu

SEQ ID NO: 642285 - RNA, 22 nt, Homo sapiens
gaccacugaagcaccacaggga

SEQ ID NO: 642286 - RNA, 14 nt, Homo sapiens
gaccacuggcagaa

SEQ ID NO: 642287 - RNA, 16 nt, Homo sapiens
gaccagaaguguuuca

SEQ ID NO: 642288 - RNA, 12 nt, Homo sapiens
gaccagcccauu

SEQ ID NO: 642289 - RNA, 14 nt, Homo sapiens
gaccagccugggca

SEQ ID NO: 642290 - RNA, 18 nt, Homo sapiens
gaccaggccaagacucaa

SEQ ID NO: 642291 - RNA, 21 nt, Homo sapiens
gaccaggccuggagggcacuu

SEQ ID NO: 642292 - RNA, 17 nt, Homo sapiens
gaccaguccuguuugca

SEQ ID NO: 642293 - RNA, 15 nt, Homo sapiens
gaccagucugacccu

SEQ ID NO: 642294 - RNA, 18 nt, Homo sapiens
gaccagugcaguuucuaa

SEQ ID NO: 642295 - RNA, 20 nt, Homo sapiens
gaccaguugaagcugacuca

SEQ ID NO: 642296 - RNA, 15 nt, Homo sapiens
gaccauaaagggugu

SEQ ID NO: 642297 - RNA, 16 nt, Homo sapiens
gaccauaguauaauca

SEQ ID NO: 642298 - RNA, 17 nt, Homo sapiens
gaccaucugcugcaguu

SEQ ID NO: 642299 - RNA, 18 nt, Homo sapiens
gaccaucugcugcaguua

SEQ ID NO: 642300 - RNA, 18 nt, Homo sapiens
gaccaugguauauuccua

SEQ ID NO: 642301 - RNA, 11 nt, Homo sapiens
gaccauuccag

SEQ ID NO: 642302 - RNA, 14 nt, Homo sapiens
gaccauuccaggaa

SEQ ID NO: 642303 - RNA, 20 nt, Homo sapiens
gaccauuccaggaaaacugg

SEQ ID NO: 642304 - RNA, 17 nt, Homo sapiens
gaccauuguaacaauag

SEQ ID NO: 642305 - RNA, 20 nt, Homo sapiens
gacccaaagaccaauauuca

SEQ ID NO: 642306 - RNA, 11 nt, Homo sapiens
gacccaauccc

SEQ ID NO: 642307 - RNA, 19 nt, Homo sapiens
gacccaauccccagacuca

SEQ ID NO: 642308 - RNA, 13 nt, Homo sapiens
gacccacacugcc

SEQ ID NO: 642309 - RNA, 15 nt, Homo sapiens
gacccacacuuccau

SEQ ID NO: 642310 - RNA, 18 nt, Homo sapiens
gacccacagcucugggcc

SEQ ID NO: 642311 - RNA, 13 nt, Homo sapiens
gacccaccuucaa

SEQ ID NO: 642312 - RNA, 19 nt, Homo sapiens
gacccaccuucaagcagcu

SEQ ID NO: 642313 - RNA, 23 nt, Homo sapiens
gacccacggagcccuuaugacau

SEQ ID NO: 642314 - RNA, 18 nt, Homo sapiens
gacccacucugcggcccg

SEQ ID NO: 642315 - RNA, 23 nt, Homo sapiens
gacccacugaaaugaccaagaca

SEQ ID NO: 642316 - RNA, 19 nt, Homo sapiens
gacccagaacaggacucca

SEQ ID NO: 642317 - RNA, 15 nt, Homo sapiens
gacccaggaaugcca

SEQ ID NO: 642318 - RNA, 17 nt, Homo sapiens
gacccaggagagacaga

SEQ ID NO: 642319 - RNA, 12 nt, Homo sapiens
gacccagggucc

SEQ ID NO: 642320 - RNA, 21 nt, Homo sapiens
gaccccaaagagccuggagaa

SEQ ID NO: 642321 - RNA, 22 nt, Homo sapiens
gaccccaaaucaccacaaagga

SEQ ID NO: 642322 - RNA, 20 nt, Homo sapiens
gaccccaaauuaagaaucua

SEQ ID NO: 642323 - RNA, 13 nt, Homo sapiens
gaccccacucccc

SEQ ID NO: 642324 - RNA, 13 nt, Homo sapiens
gaccccaggaaca

SEQ ID NO: 642325 - RNA, 16 nt, Homo sapiens
gaccccaucugugaau

SEQ ID NO: 642326 - RNA, 15 nt, Homo sapiens
gacccccagcacuug

SEQ ID NO: 642327 - RNA, 19 nt, Homo sapiens
gacccccaucucuacaaaa

SEQ ID NO: 642328 - RNA, 17 nt, Homo sapiens
gacccccucgccagcuu

SEQ ID NO: 642329 - RNA, 20 nt, Homo sapiens
gaccccuccccagugccucu

SEQ ID NO: 642330 - RNA, 19 nt, Homo sapiens
gaccccucuccucaaggga

SEQ ID NO: 642331 - RNA, 14 nt, Homo sapiens
gaccccuuacacaa

SEQ ID NO: 642332 - RNA, 13 nt, Homo sapiens
gacccgaggccca

SEQ ID NO: 642333 - RNA, 17 nt, Homo sapiens
gacccgcucuggaccaa

SEQ ID NO: 642334 - RNA, 20 nt, Homo sapiens
gacccggaggggccuggcag

SEQ ID NO: 642335 - RNA, 21 nt, Homo sapiens
gacccuacuucuuuugcucuu

SEQ ID NO: 642336 - RNA, 18 nt, Homo sapiens
gacccuagggauuugcac

SEQ ID NO: 642337 - RNA, 23 nt, Homo sapiens
gacccucccaugcgggugcacac

SEQ ID NO: 642338 - RNA, 18 nt, Homo sapiens
gacccucgcccaacucca

SEQ ID NO: 642339 - RNA, 23 nt, Homo sapiens
gacccucgggccccauccucauc

SEQ ID NO: 642340 - RNA, 21 nt, Homo sapiens
gacccucugaaugguccaggg

SEQ ID NO: 642341 - RNA, 15 nt, Homo sapiens
gacccugccauucca

SEQ ID NO: 642342 - RNA, 13 nt, Homo sapiens
gacccugggacca

SEQ ID NO: 642343 - RNA, 22 nt, Homo sapiens
gacccuggugaccuccugucac

SEQ ID NO: 642344 - RNA, 23 nt, Homo sapiens
gacccuggugggcuguucagcuu

SEQ ID NO: 642345 - RNA, 21 nt, Homo sapiens
gacccuguccugcagucccac

SEQ ID NO: 642346 - RNA, 23 nt, Homo sapiens
gacccuguccugcagucccacac

SEQ ID NO: 642347 - RNA, 15 nt, Homo sapiens
gacccuugcugugaa

SEQ ID NO: 642348 - RNA, 22 nt, Homo sapiens
gacccuugguguuucccuuccu

SEQ ID NO: 642349 - RNA, 24 nt, Homo sapiens
gacccuuguggguccaugcuaaca

SEQ ID NO: 642350 - RNA, 20 nt, Homo sapiens
gacccuuuggggguugaaua

SEQ ID NO: 642351 - RNA, 18 nt, Homo sapiens
gaccgcccccuccucuag

SEQ ID NO: 642352 - RNA, 17 nt, Homo sapiens
gaccggugcaugaugcu

SEQ ID NO: 642353 - RNA, 13 nt, Homo sapiens
gaccguccagggg

SEQ ID NO: 642354 - RNA, 20 nt, Homo sapiens
gaccgugaccguuugcuaua

SEQ ID NO: 642355 - RNA, 21 nt, Homo sapiens
gaccguuaugaggaaauaucc

SEQ ID NO: 642356 - RNA, 20 nt, Homo sapiens
gaccguuugcuauauuccuu

SEQ ID NO: 642357 - RNA, 13 nt, Homo sapiens
gaccuaaccacuu

SEQ ID NO: 642358 - RNA, 15 nt, Homo sapiens
gaccuacagugcugu

SEQ ID NO: 642359 - RNA, 22 nt, Homo sapiens
gaccuacagugcuguguacccu

SEQ ID NO: 642360 - RNA, 12 nt, Homo sapiens
gaccuaccuccc

SEQ ID NO: 642361 - RNA, 20 nt, Homo sapiens
gaccuaccucccucccucuc

SEQ ID NO: 642362 - RNA, 17 nt, Homo sapiens
gaccuacugcacugagu

SEQ ID NO: 642363 - RNA, 20 nt, Homo sapiens
gaccuacuguucggacaaaa

SEQ ID NO: 642364 - RNA, 18 nt, Homo sapiens
gaccuaguauaucaguga

SEQ ID NO: 642365 - RNA, 15 nt, Homo sapiens
gaccucaagccauca

SEQ ID NO: 642366 - RNA, 12 nt, Homo sapiens
gaccucaaguga

SEQ ID NO: 642367 - RNA, 13 nt, Homo sapiens
gaccucaggugau

SEQ ID NO: 642368 - RNA, 14 nt, Homo sapiens
gaccucauguuguu

SEQ ID NO: 642369 - RNA, 16 nt, Homo sapiens
gaccucccagcccuau

SEQ ID NO: 642370 - RNA, 15 nt, Homo sapiens
gaccuccucccucau

SEQ ID NO: 642371 - RNA, 12 nt, Homo sapiens
gaccucuagccc

SEQ ID NO: 642372 - RNA, 17 nt, Homo sapiens
gaccucucucagcccca

SEQ ID NO: 642373 - RNA, 13 nt, Homo sapiens
gaccucugacaca

SEQ ID NO: 642374 - RNA, 22 nt, Homo sapiens
gaccucugcugagugcugggca

SEQ ID NO: 642375 - RNA, 12 nt, Homo sapiens
gaccucugugac

SEQ ID NO: 642376 - RNA, 19 nt, Homo sapiens
gaccucuugcugccagcua

SEQ ID NO: 642377 - RNA, 19 nt, Homo sapiens
gaccugagcccgcagccca

SEQ ID NO: 642378 - RNA, 17 nt, Homo sapiens
gaccugaggcugugguc

SEQ ID NO: 642379 - RNA, 14 nt, Homo sapiens
gaccugcaggccaa

SEQ ID NO: 642380 - RNA, 14 nt, Homo sapiens
gaccugcggcagua

SEQ ID NO: 642381 - RNA, 22 nt, Homo sapiens
gaccugcucugcccucucccca

SEQ ID NO: 642382 - RNA, 13 nt, Homo sapiens
gaccuggaaccag

SEQ ID NO: 642383 - RNA, 20 nt, Homo sapiens
gaccuggaaccagagccaca

SEQ ID NO: 642384 - RNA, 12 nt, Homo sapiens
gaccuggcacug

SEQ ID NO: 642385 - RNA, 17 nt, Homo sapiens
gaccuggugcugccucu

SEQ ID NO: 642386 - RNA, 22 nt, Homo sapiens
gaccugugaccagcacugucuc

SEQ ID NO: 642387 - RNA, 19 nt, Homo sapiens
gaccuguucaaaaaggaaa

SEQ ID NO: 642388 - RNA, 17 nt, Homo sapiens
gaccuuaggccuuccuc

SEQ ID NO: 642389 - RNA, 18 nt, Homo sapiens
gaccuuaggccuuccucu

SEQ ID NO: 642390 - RNA, 17 nt, Homo sapiens
gaccuucuccccauucu

SEQ ID NO: 642391 - RNA, 12 nt, Homo sapiens
gaccuugcacaa

SEQ ID NO: 642392 - RNA, 15 nt, Homo sapiens
gaccuuggcagccca

SEQ ID NO: 642393 - RNA, 17 nt, Homo sapiens
gaccuugggguacaauu

SEQ ID NO: 642394 - RNA, 18 nt, Homo sapiens
gacgaauuugcacaguga

SEQ ID NO: 642395 - RNA, 16 nt, Homo sapiens
gacgaguaacuccccu

SEQ ID NO: 642396 - RNA, 16 nt, Homo sapiens
gacgauggguguugcu

SEQ ID NO: 642397 - RNA, 15 nt, Homo sapiens
gacgcacagugcagu

SEQ ID NO: 642398 - RNA, 12 nt, Homo sapiens
gacgcacugcuc

SEQ ID NO: 642399 - RNA, 21 nt, Homo sapiens
gacgccacucauuucaucuca

SEQ ID NO: 642400 - RNA, 22 nt, Homo sapiens
gacgccacucauuucaucucau

SEQ ID NO: 642401 - RNA, 17 nt, Homo sapiens
gacgcuggccugggaug

SEQ ID NO: 642402 - RNA, 15 nt, Homo sapiens
gacggaguccugugu

SEQ ID NO: 642403 - RNA, 15 nt, Homo sapiens
gacggaugauuggau

SEQ ID NO: 642404 - RNA, 21 nt, Homo sapiens
gacggcccucaucuaugagga

SEQ ID NO: 642405 - RNA, 22 nt, Homo sapiens
gacggcgugccuggacacugua

SEQ ID NO: 642406 - RNA, 20 nt, Homo sapiens
gacgggcacacagacuggag

SEQ ID NO: 642407 - RNA, 23 nt, Homo sapiens
gacgggcugaagcgagcccucag

SEQ ID NO: 642408 - RNA, 20 nt, Homo sapiens
gacgguaaguguucucauga

SEQ ID NO: 642409 - RNA, 11 nt, Homo sapiens
gacggugccaa

SEQ ID NO: 642410 - RNA, 18 nt, Homo sapiens
gacggugcccaagccaga

SEQ ID NO: 642411 - RNA, 21 nt, Homo sapiens
gacgguuucaaaccaggauuu

SEQ ID NO: 642412 - RNA, 14 nt, Homo sapiens
gacguagaaagauc

SEQ ID NO: 642413 - RNA, 20 nt, Homo sapiens
gacguccucccugaucccac

SEQ ID NO: 642414 - RNA, 18 nt, Homo sapiens
gacgugauuuugcuguag

SEQ ID NO: 642415 - RNA, 14 nt, Homo sapiens
gacgugcacugaca

SEQ ID NO: 642416 - RNA, 12 nt, Homo sapiens
gacgugcacugu

SEQ ID NO: 642417 - RNA, 21 nt, Homo sapiens
gacgugccuaccucuuagaca

SEQ ID NO: 642418 - RNA, 16 nt, Homo sapiens
gacgugcugggaccaa

SEQ ID NO: 642419 - RNA, 20 nt, Homo sapiens
gacguggagcgggguaugaa

SEQ ID NO: 642420 - RNA, 19 nt, Homo sapiens
gacgugugagggaggacag

SEQ ID NO: 642421 - RNA, 15 nt, Homo sapiens
gacgugugccuauag

SEQ ID NO: 642422 - RNA, 13 nt, Homo sapiens
gacguugcagggu

SEQ ID NO: 642423 - RNA, 14 nt, Homo sapiens
gacuaaaugaacua

SEQ ID NO: 642424 - RNA, 16 nt, Homo sapiens
gacuaacccaaugccu

SEQ ID NO: 642425 - RNA, 17 nt, Homo sapiens
gacuaacccaaugccug

SEQ ID NO: 642426 - RNA, 13 nt, Homo sapiens
gacuaacuaucaa

SEQ ID NO: 642427 - RNA, 18 nt, Homo sapiens
gacuaaucaccuacucaa

SEQ ID NO: 642428 - RNA, 15 nt, Homo sapiens
gacuaauuaggcaag

SEQ ID NO: 642429 - RNA, 12 nt, Homo sapiens
gacuacaaccaa

SEQ ID NO: 642430 - RNA, 13 nt, Homo sapiens
gacuacaaccaau

SEQ ID NO: 642431 - RNA, 20 nt, Homo sapiens
gacuacaaccaauuuacacu

SEQ ID NO: 642432 - RNA, 14 nt, Homo sapiens
gacuacacaggaug

SEQ ID NO: 642433 - RNA, 15 nt, Homo sapiens
gacuaccucagaaca

SEQ ID NO: 642434 - RNA, 21 nt, Homo sapiens
gacuagaauagugcauuguau

SEQ ID NO: 642435 - RNA, 16 nt, Homo sapiens
gacuaggaaauuccaa

SEQ ID NO: 642436 - RNA, 18 nt, Homo sapiens
gacuagugacacauugua

SEQ ID NO: 642437 - RNA, 20 nt, Homo sapiens
gacuauggauguguucucua

SEQ ID NO: 642438 - RNA, 13 nt, Homo sapiens
gacucaaacugcc

SEQ ID NO: 642439 - RNA, 22 nt, Homo sapiens
gacucaagaagugaagaaugca

SEQ ID NO: 642440 - RNA, 16 nt, Homo sapiens
gacucaaguguagaag

SEQ ID NO: 642441 - RNA, 22 nt, Homo sapiens
gacucaccaacuugccacaugu

SEQ ID NO: 642442 - RNA, 18 nt, Homo sapiens
gacucacccuccacaaag

SEQ ID NO: 642443 - RNA, 18 nt, Homo sapiens
gacucacugggaagcucc

SEQ ID NO: 642444 - RNA, 21 nt, Homo sapiens
gacucagaacaccaacuuaag

SEQ ID NO: 642445 - RNA, 21 nt, Homo sapiens
gacucagagaaccagugcaga

SEQ ID NO: 642446 - RNA, 21 nt, Homo sapiens
gacucagggccccagcacuaa

SEQ ID NO: 642447 - RNA, 13 nt, Homo sapiens
gacucaguauuau

SEQ ID NO: 642448 - RNA, 23 nt, Homo sapiens
gacucauggcagcuguuucucau

SEQ ID NO: 642449 - RNA, 15 nt, Homo sapiens
gacucauuguagaaa

SEQ ID NO: 642450 - RNA, 17 nt, Homo sapiens
gacuccaaccucaggga

SEQ ID NO: 642451 - RNA, 23 nt, Homo sapiens
gacuccagaaucugcuguugcca

SEQ ID NO: 642452 - RNA, 12 nt, Homo sapiens
gacuccaugcug

SEQ ID NO: 642453 - RNA, 17 nt, Homo sapiens
gacucccacucaguacu

SEQ ID NO: 642454 - RNA, 10 nt, Homo sapiens
gacuccucaa

SEQ ID NO: 642455 - RNA, 14 nt, Homo sapiens
gacuccugaggaca

SEQ ID NO: 642456 - RNA, 18 nt, Homo sapiens
gacuccugaggacagcug

SEQ ID NO: 642457 - RNA, 13 nt, Homo sapiens
gacuccugugcaa

SEQ ID NO: 642458 - RNA, 20 nt, Homo sapiens
gacuccuuguggacuggcug

SEQ ID NO: 642459 - RNA, 15 nt, Homo sapiens
gacucgcagcaccca

SEQ ID NO: 642460 - RNA, 13 nt, Homo sapiens
gacucgggaccaa

SEQ ID NO: 642461 - RNA, 21 nt, Homo sapiens
gacucgggauuaguacacacu

SEQ ID NO: 642462 - RNA, 15 nt, Homo sapiens
gacucucacacugaa

SEQ ID NO: 642463 - RNA, 19 nt, Homo sapiens
gacucucacacugaaucag

SEQ ID NO: 642464 - RNA, 20 nt, Homo sapiens
gacucuccaaauagcauuag

SEQ ID NO: 642465 - RNA, 20 nt, Homo sapiens
gacucuccuccuugagcccu

SEQ ID NO: 642466 - RNA, 15 nt, Homo sapiens
gacucugaccacagc

SEQ ID NO: 642467 - RNA, 19 nt, Homo sapiens
gacucugagaacuccucau

SEQ ID NO: 642468 - RNA, 17 nt, Homo sapiens
gacucuguaauugaaua

SEQ ID NO: 642469 - RNA, 22 nt, Homo sapiens
gacucuuacguggagagugcac

SEQ ID NO: 642470 - RNA, 17 nt, Homo sapiens
gacucuuccugcaaagg

SEQ ID NO: 642471 - RNA, 13 nt, Homo sapiens
gacucuugcucuu

SEQ ID NO: 642472 - RNA, 19 nt, Homo sapiens
gacucuuuccuaaagccaa

SEQ ID NO: 642473 - RNA, 14 nt, Homo sapiens
gacugaaaauauau

SEQ ID NO: 642474 - RNA, 16 nt, Homo sapiens
gacugaagacucagcc

SEQ ID NO: 642475 - RNA, 17 nt, Homo sapiens
gacugagagaugcagaa

SEQ ID NO: 642476 - RNA, 14 nt, Homo sapiens
gacugagauggagu

SEQ ID NO: 642477 - RNA, 20 nt, Homo sapiens
uauuaagauacuuagauuag

SEQ ID NO: 642478 - RNA, 12 nt, Homo sapiens
uauuaagcacuu

SEQ ID NO: 642479 - RNA, 15 nt, Homo sapiens
uauuaagcacuuuaa

SEQ ID NO: 642480 - RNA, 15 nt, Homo sapiens
uauuaagccaggaaa

SEQ ID NO: 642481 - RNA, 19 nt, Homo sapiens
uauuaagguaacuacugcu

SEQ ID NO: 642482 - RNA, 17 nt, Homo sapiens
uauuaagguguggcuuu

SEQ ID NO: 642483 - RNA, 16 nt, Homo sapiens
uauuaagugugcuuau

SEQ ID NO: 642484 - RNA, 15 nt, Homo sapiens
uauuaauaaagcauu

SEQ ID NO: 642485 - RNA, 19 nt, Homo sapiens
uauuaauaguucaguguau

SEQ ID NO: 642486 - RNA, 15 nt, Homo sapiens
uauuaaucagcauua

SEQ ID NO: 642487 - RNA, 17 nt, Homo sapiens
uauuaaucauagauuau

SEQ ID NO: 642488 - RNA, 23 nt, Homo sapiens
uauuaauuuuuaaggauguugcc

SEQ ID NO: 642489 - RNA, 12 nt, Homo sapiens
uauuacagugaa

SEQ ID NO: 642490 - RNA, 17 nt, Homo sapiens
uauuacauuuucaguga

SEQ ID NO: 642491 - RNA, 13 nt, Homo sapiens
uauuaccaugaga

SEQ ID NO: 642492 - RNA, 14 nt, Homo sapiens
uauuacccuccuaa

SEQ ID NO: 642493 - RNA, 16 nt, Homo sapiens
uauuacgugcaauacu

SEQ ID NO: 642494 - RNA, 15 nt, Homo sapiens
uauuacuaaggagua

SEQ ID NO: 642495 - RNA, 18 nt, Homo sapiens
uauuacugaaaaugauuc

SEQ ID NO: 642496 - RNA, 20 nt, Homo sapiens
uauuacuguugcauuuacuu

SEQ ID NO: 642497 - RNA, 17 nt, Homo sapiens
uauuagauaaauuucaa

SEQ ID NO: 642498 - RNA, 13 nt, Homo sapiens
uauuagauuuauu

SEQ ID NO: 642499 - RNA, 15 nt, Homo sapiens
uauuagcucacugaa

SEQ ID NO: 642500 - RNA, 22 nt, Homo sapiens
uauuagcucacugaaucuucac

SEQ ID NO: 642501 - RNA, 13 nt, Homo sapiens
uauuagcuuauau

SEQ ID NO: 642502 - RNA, 16 nt, Homo sapiens
uauuaggguacuuuau

SEQ ID NO: 642503 - RNA, 19 nt, Homo sapiens
uauuaggugguucucuuca

SEQ ID NO: 642504 - RNA, 15 nt, Homo sapiens
uauuaguacugcucu

SEQ ID NO: 642505 - RNA, 15 nt, Homo sapiens
uauuaguuaaucucc

SEQ ID NO: 642506 - RNA, 14 nt, Homo sapiens
uauuauaaacuaua

SEQ ID NO: 642507 - RNA, 14 nt, Homo sapiens
uauuauaaagccaa

SEQ ID NO: 642508 - RNA, 15 nt, Homo sapiens
uauuauacuaagaaa

SEQ ID NO: 642509 - RNA, 14 nt, Homo sapiens
uauuaucacaucaa

SEQ ID NO: 642510 - RNA, 23 nt, Homo sapiens
uauuaucagagacuauguagcaa

SEQ ID NO: 642511 - RNA, 20 nt, Homo sapiens
uauuaucuacaaacacugca

SEQ ID NO: 642512 - RNA, 22 nt, Homo sapiens
uauuaucuacaaacacugcaga

SEQ ID NO: 642513 - RNA, 12 nt, Homo sapiens
uauuaugaagga

SEQ ID NO: 642514 - RNA, 23 nt, Homo sapiens
uauuauggcaagugauaucaccu

SEQ ID NO: 642515 - RNA, 17 nt, Homo sapiens
uauuauucuucauaaca

SEQ ID NO: 642516 - RNA, 19 nt, Homo sapiens
uauuauugauucacuuacu

SEQ ID NO: 642517 - RNA, 15 nt, Homo sapiens
uauuauuugauaucu

SEQ ID NO: 642518 - RNA, 19 nt, Homo sapiens
uauuauuuuuaccuaaaga

SEQ ID NO: 642519 - RNA, 14 nt, Homo sapiens
uauucaaaugaagg

SEQ ID NO: 642520 - RNA, 17 nt, Homo sapiens
uauucaagccuguuguc

SEQ ID NO: 642521 - RNA, 16 nt, Homo sapiens
uauucaaguaacacuu

SEQ ID NO: 642522 - RNA, 22 nt, Homo sapiens
uauucaauaccgcucaguauuu

SEQ ID NO: 642523 - RNA, 22 nt, Homo sapiens
uauucagaaaagaugugcagau

SEQ ID NO: 642524 - RNA, 15 nt, Homo sapiens
uauucagacauugga

SEQ ID NO: 642525 - RNA, 12 nt, Homo sapiens
uauucagaugua

SEQ ID NO: 642526 - RNA, 18 nt, Homo sapiens
uauucaguaauaacucua

SEQ ID NO: 642527 - RNA, 19 nt, Homo sapiens
uauucauccuaaaaaguuc

SEQ ID NO: 642528 - RNA, 21 nt, Homo sapiens
uauucauuggcagcucaaaga

SEQ ID NO: 642529 - RNA, 14 nt, Homo sapiens
uauuccauguauaa

SEQ ID NO: 642530 - RNA, 18 nt, Homo sapiens
uauucccaagcccaugag

SEQ ID NO: 642531 - RNA, 20 nt, Homo sapiens
uauucccaaguaugccuuaa

SEQ ID NO: 642532 - RNA, 19 nt, Homo sapiens
uauuccucagauugcugaa

SEQ ID NO: 642533 - RNA, 11 nt, Homo sapiens
uauuccugcug

SEQ ID NO: 642534 - RNA, 18 nt, Homo sapiens
uauuccuuugcauauuau

SEQ ID NO: 642535 - RNA, 15 nt, Homo sapiens
uauuccuuuucccag

SEQ ID NO: 642536 - RNA, 15 nt, Homo sapiens
uauucgauguacuuu

SEQ ID NO: 642537 - RNA, 21 nt, Homo sapiens
uauucgugcauuuuuggauca

SEQ ID NO: 642538 - RNA, 15 nt, Homo sapiens
uauucuaaaaccauu

SEQ ID NO: 642539 - RNA, 21 nt, Homo sapiens
uauucuaagaaauaucuguga

SEQ ID NO: 642540 - RNA, 18 nt, Homo sapiens
uauucuaaguuagacucu

SEQ ID NO: 642541 - RNA, 13 nt, Homo sapiens
uauucuacuaugc

SEQ ID NO: 642542 - RNA, 19 nt, Homo sapiens
uauucucaaagaugcauuu

SEQ ID NO: 642543 - RNA, 17 nt, Homo sapiens
uauucucacuccaccac

SEQ ID NO: 642544 - RNA, 16 nt, Homo sapiens
uauucucaguguaggg

SEQ ID NO: 642545 - RNA, 23 nt, Homo sapiens
uauucucaguguagggcagagag

SEQ ID NO: 642546 - RNA, 16 nt, Homo sapiens
uauucucucuaugcaa

SEQ ID NO: 642547 - RNA, 18 nt, Homo sapiens
uauucucugcugcaucuu

SEQ ID NO: 642548 - RNA, 17 nt, Homo sapiens
uauucucuuaauuuuuc

SEQ ID NO: 642549 - RNA, 21 nt, Homo sapiens
uauucucuuaugauacuugag

SEQ ID NO: 642550 - RNA, 15 nt, Homo sapiens
uauucugauuccacu

SEQ ID NO: 642551 - RNA, 15 nt, Homo sapiens
uauucugcauggaaa

SEQ ID NO: 642552 - RNA, 21 nt, Homo sapiens
uauucugggcaccacaaaaua

SEQ ID NO: 642553 - RNA, 20 nt, Homo sapiens
uauucugucuggcauuacaa

SEQ ID NO: 642554 - RNA, 20 nt, Homo sapiens
uauucuguuugcguacuugu

SEQ ID NO: 642555 - RNA, 21 nt, Homo sapiens
uauucuguuugcguacuugua

SEQ ID NO: 642556 - RNA, 23 nt, Homo sapiens
uauucuuaagggaacuuccacau

SEQ ID NO: 642557 - RNA, 22 nt, Homo sapiens
uauucuuuaaacaaauaugaaa

SEQ ID NO: 642558 - RNA, 15 nt, Homo sapiens
uauugaaaacacuua

SEQ ID NO: 642559 - RNA, 19 nt, Homo sapiens
uauugaaaguugcuuuuau

SEQ ID NO: 642560 - RNA, 14 nt, Homo sapiens
uauugaaauucuau

SEQ ID NO: 642561 - RNA, 13 nt, Homo sapiens
uauugaagacaau

SEQ ID NO: 642562 - RNA, 19 nt, Homo sapiens
uauugaaguuguuuaucaa

SEQ ID NO: 642563 - RNA, 13 nt, Homo sapiens
uauugaaucuaca

SEQ ID NO: 642564 - RNA, 13 nt, Homo sapiens
uauugacacugaa

SEQ ID NO: 642565 - RNA, 19 nt, Homo sapiens
uauugacacugaacuuaau

SEQ ID NO: 642566 - RNA, 12 nt, Homo sapiens
uauugacugccu

SEQ ID NO: 642567 - RNA, 20 nt, Homo sapiens
uauugacugggcaacacugc

SEQ ID NO: 642568 - RNA, 19 nt, Homo sapiens
uauugacuuuauguuguau

SEQ ID NO: 642569 - RNA, 18 nt, Homo sapiens
uauugagcuguacaugca

SEQ ID NO: 642570 - RNA, 19 nt, Homo sapiens
uauugagggccagugauga

SEQ ID NO: 642571 - RNA, 17 nt, Homo sapiens
uauugauucaccuccua

SEQ ID NO: 642572 - RNA, 10 nt, Homo sapiens
uauugcacua

SEQ ID NO: 642573 - RNA, 15 nt, Homo sapiens
uauugcagcuuauau

SEQ ID NO: 642574 - RNA, 19 nt, Homo sapiens
uauugcagcuuauauucau

SEQ ID NO: 642575 - RNA, 19 nt, Homo sapiens
uauugcaugcucaacuuag

SEQ ID NO: 642576 - RNA, 18 nt, Homo sapiens
uauugcauuuauauguac

SEQ ID NO: 642577 - RNA, 16 nt, Homo sapiens
uauugcgaaugugcag

SEQ ID NO: 642578 - RNA, 21 nt, Homo sapiens
uauugcugcuggggcucccca

SEQ ID NO: 642579 - RNA, 19 nt, Homo sapiens
uauugcuuaccugaucuca

SEQ ID NO: 642580 - RNA, 16 nt, Homo sapiens
uauugcuugaguuaua

SEQ ID NO: 642581 - RNA, 22 nt, Homo sapiens
uauuggacauccccagaaaaga

SEQ ID NO: 642582 - RNA, 23 nt, Homo sapiens
uauuggcgcaccaagaucuccaa

SEQ ID NO: 642583 - RNA, 15 nt, Homo sapiens
uauugggauaucauu

SEQ ID NO: 642584 - RNA, 23 nt, Homo sapiens
uauugguuuugguuuugacucac

SEQ ID NO: 642585 - RNA, 15 nt, Homo sapiens
uauuguaaacaugug

SEQ ID NO: 642586 - RNA, 16 nt, Homo sapiens
uauuguagcucaauac

SEQ ID NO: 642587 - RNA, 23 nt, Homo sapiens
uauuguagcucaauacaauguga

SEQ ID NO: 642588 - RNA, 15 nt, Homo sapiens
uauugucauaaccaa

SEQ ID NO: 642589 - RNA, 16 nt, Homo sapiens
uauugucauaaccaac

SEQ ID NO: 642590 - RNA, 22 nt, Homo sapiens
uauuguccccuaaaccaaaaac

SEQ ID NO: 642591 - RNA, 19 nt, Homo sapiens
uauuguccugcuccccugu

SEQ ID NO: 642592 - RNA, 16 nt, Homo sapiens
uauugucgcuauguga

SEQ ID NO: 642593 - RNA, 15 nt, Homo sapiens
uauugucugccuuaa

SEQ ID NO: 642594 - RNA, 20 nt, Homo sapiens
uauuguggaauugacucaaa

SEQ ID NO: 642595 - RNA, 16 nt, Homo sapiens
uauuguuacuuccaau

SEQ ID NO: 642596 - RNA, 17 nt, Homo sapiens
uauuguuccaagacauu

SEQ ID NO: 642597 - RNA, 18 nt, Homo sapiens
uauuguugacaacuguga

SEQ ID NO: 642598 - RNA, 21 nt, Homo sapiens
uauuguugcuuuuuuuccaau

SEQ ID NO: 642599 - RNA, 23 nt, Homo sapiens
gcagugacgugcaccuguacuca

SEQ ID NO: 642600 - RNA, 16 nt, Homo sapiens
gcagugccuugugcaa

SEQ ID NO: 642601 - RNA, 23 nt, Homo sapiens
gcaguggcuccgaucucugcuca

SEQ ID NO: 642602 - RNA, 15 nt, Homo sapiens
gcaguggcucucaga

SEQ ID NO: 642603 - RNA, 18 nt, Homo sapiens
gcaguggcuucuuuccag

SEQ ID NO: 642604 - RNA, 21 nt, Homo sapiens
gcaguguuucccguauugaca

SEQ ID NO: 642605 - RNA, 16 nt, Homo sapiens
gcaguuaacaaguaua

SEQ ID NO: 642606 - RNA, 21 nt, Homo sapiens
gcaguucccuccgcagaacac

SEQ ID NO: 642607 - RNA, 20 nt, Homo sapiens
gcaguucuggaauggaaggg

SEQ ID NO: 642608 - RNA, 22 nt, Homo sapiens
gcaguugaaacaagaagccaca

SEQ ID NO: 642609 - RNA, 17 nt, Homo sapiens
gcaguuggacucucagg

SEQ ID NO: 642610 - RNA, 21 nt, Homo sapiens
gcaguuggggcccucuugcca

SEQ ID NO: 642611 - RNA, 23 nt, Homo sapiens
gcaguuucaucaaagaacaaaca

SEQ ID NO: 642612 - RNA, 16 nt, Homo sapiens
gcaguuucauugugau

SEQ ID NO: 642613 - RNA, 17 nt, Homo sapiens
gcaguuucuaagcaugu

SEQ ID NO: 642614 - RNA, 22 nt, Homo sapiens
gcaguuuuacuaaaacacugaa

SEQ ID NO: 642615 - RNA, 14 nt, Homo sapiens
gcauaaaaccuaaa

SEQ ID NO: 642616 - RNA, 22 nt, Homo sapiens
gcauaaaauguaugaccacugg

SEQ ID NO: 642617 - RNA, 14 nt, Homo sapiens
gcauaacaaaaaga

SEQ ID NO: 642618 - RNA, 19 nt, Homo sapiens
gcauaacaaaaagaugacc

SEQ ID NO: 642619 - RNA, 14 nt, Homo sapiens
gcauaaccuuuaca

SEQ ID NO: 642620 - RNA, 17 nt, Homo sapiens
gcauaacuaaauuauuu

SEQ ID NO: 642621 - RNA, 19 nt, Homo sapiens
gcauaagaaaacuaagaaa

SEQ ID NO: 642622 - RNA, 20 nt, Homo sapiens
gcauaagagcuuaagaacca

SEQ ID NO: 642623 - RNA, 21 nt, Homo sapiens
gcauaaguuucugggaccuca

SEQ ID NO: 642624 - RNA, 23 nt, Homo sapiens
gcauaaguuuggagcacuaguuu

SEQ ID NO: 642625 - RNA, 18 nt, Homo sapiens
gcauaauaagcuaaagag

SEQ ID NO: 642626 - RNA, 18 nt, Homo sapiens
gcauaauaugaagccuuu

SEQ ID NO: 642627 - RNA, 20 nt, Homo sapiens
gcauaauguuaagcuuuauu

SEQ ID NO: 642628 - RNA, 14 nt, Homo sapiens
gcauacaaaauauu

SEQ ID NO: 642629 - RNA, 19 nt, Homo sapiens
gcauacaccacugcaaaau

SEQ ID NO: 642630 - RNA, 14 nt, Homo sapiens
gcauacagccuuug

SEQ ID NO: 642631 - RNA, 16 nt, Homo sapiens
gcauacccuuacucug

SEQ ID NO: 642632 - RNA, 23 nt, Homo sapiens
gcauacgguaugauauugcagcu

SEQ ID NO: 642633 - RNA, 11 nt, Homo sapiens
gcauacuacag

SEQ ID NO: 642634 - RNA, 17 nt, Homo sapiens
gcauagaaauggaagaa

SEQ ID NO: 642635 - RNA, 23 nt, Homo sapiens
gcauagagugugauguaugugua

SEQ ID NO: 642636 - RNA, 19 nt, Homo sapiens
gcauagauugaucaaagug

SEQ ID NO: 642637 - RNA, 20 nt, Homo sapiens
gcauagcaaaugacauaagc

SEQ ID NO: 642638 - RNA, 20 nt, Homo sapiens
gcauagcaguauauguuaau

SEQ ID NO: 642639 - RNA, 16 nt, Homo sapiens
gcauagcucuauuuua

SEQ ID NO: 642640 - RNA, 13 nt, Homo sapiens
gcauagcuuucac

SEQ ID NO: 642641 - RNA, 20 nt, Homo sapiens
gcauaggccauauaauguua

SEQ ID NO: 642642 - RNA, 20 nt, Homo sapiens
gcauagggucacuuugccau

SEQ ID NO: 642643 - RNA, 16 nt, Homo sapiens
gcauaguauuccauug

SEQ ID NO: 642644 - RNA, 18 nt, Homo sapiens
gcauagugaacacacuga

SEQ ID NO: 642645 - RNA, 14 nt, Homo sapiens
gcauauaacuuaua

SEQ ID NO: 642646 - RNA, 24 nt, Homo sapiens
gcauauauaaguuuacaccuuuau

SEQ ID NO: 642647 - RNA, 14 nt, Homo sapiens
gcauauauucaguu

SEQ ID NO: 642648 - RNA, 17 nt, Homo sapiens
gcauaugauagaugaca

SEQ ID NO: 642649 - RNA, 15 nt, Homo sapiens
gcauaugcacaguca

SEQ ID NO: 642650 - RNA, 14 nt, Homo sapiens
gcauaugcagccaa

SEQ ID NO: 642651 - RNA, 16 nt, Homo sapiens
gcauauggugcuuaaa

SEQ ID NO: 642652 - RNA, 21 nt, Homo sapiens
gcauauguguaaagauuuaua

SEQ ID NO: 642653 - RNA, 19 nt, Homo sapiens
gcauauuaauuucuucccc

SEQ ID NO: 642654 - RNA, 13 nt, Homo sapiens
gcauauucauggu

SEQ ID NO: 642655 - RNA, 23 nt, Homo sapiens
gcauauuuauuucagauguuucg

SEQ ID NO: 642656 - RNA, 19 nt, Homo sapiens
gcauauuuuuaaacaaaga

SEQ ID NO: 642657 - RNA, 17 nt, Homo sapiens
gcaucaaacagggcaaa

SEQ ID NO: 642658 - RNA, 17 nt, Homo sapiens
gcaucaauacaaccagc

SEQ ID NO: 642659 - RNA, 19 nt, Homo sapiens
gcaucaauacaaccagccc

SEQ ID NO: 642660 - RNA, 15 nt, Homo sapiens
gcaucaaugcugagu

SEQ ID NO: 642661 - RNA, 12 nt, Homo sapiens
gcaucacugccu

SEQ ID NO: 642662 - RNA, 11 nt, Homo sapiens
gcaucacuggg

SEQ ID NO: 642663 - RNA, 22 nt, Homo sapiens
gcaucacuuaacggaccaaagc

SEQ ID NO: 642664 - RNA, 19 nt, Homo sapiens
gcaucagagguuugcuucc

SEQ ID NO: 642665 - RNA, 14 nt, Homo sapiens
gcaucagaugaauu

SEQ ID NO: 642666 - RNA, 15 nt, Homo sapiens
gcaucagcacuuuaa

SEQ ID NO: 642667 - RNA, 16 nt, Homo sapiens
gcaucagguccuuugg

SEQ ID NO: 642668 - RNA, 20 nt, Homo sapiens
gcaucagucugaaagccagg

SEQ ID NO: 642669 - RNA, 17 nt, Homo sapiens
gcaucauuaaugcacau

SEQ ID NO: 642670 - RNA, 13 nt, Homo sapiens
gcaucauuacugu

SEQ ID NO: 642671 - RNA, 22 nt, Homo sapiens
gcaucauuauuugcagagacag

SEQ ID NO: 642672 - RNA, 21 nt, Homo sapiens
gcaucauuuccccaacagggc

SEQ ID NO: 642673 - RNA, 19 nt, Homo sapiens
gcauccauuuacugacacu

SEQ ID NO: 642674 - RNA, 17 nt, Homo sapiens
gcaucccagcaccugcc

SEQ ID NO: 642675 - RNA, 19 nt, Homo sapiens
gcaucccugaaacaucuca

SEQ ID NO: 642676 - RNA, 19 nt, Homo sapiens
gcaucccugagacagggag

SEQ ID NO: 642677 - RNA, 16 nt, Homo sapiens
gcauccuaugcuuaau

SEQ ID NO: 642678 - RNA, 18 nt, Homo sapiens
gcaucggacaagaccccc

SEQ ID NO: 642679 - RNA, 23 nt, Homo sapiens
gcaucgggagcacccagagcacc

SEQ ID NO: 642680 - RNA, 20 nt, Homo sapiens
gcaucguggccuugaccucc

SEQ ID NO: 642681 - RNA, 15 nt, Homo sapiens
gcaucuacacaauuu

SEQ ID NO: 642682 - RNA, 11 nt, Homo sapiens
gcaucuacucu

SEQ ID NO: 642683 - RNA, 21 nt, Homo sapiens
gcaucuauuuccucugugcaa

SEQ ID NO: 642684 - RNA, 9 nt, Homo sapiens
gcaucuccc

SEQ ID NO: 642685 - RNA, 17 nt, Homo sapiens
gcaucucccagcaagac

SEQ ID NO: 642686 - RNA, 17 nt, Homo sapiens
gcaucuccccucagauu

SEQ ID NO: 642687 - RNA, 14 nt, Homo sapiens
gcaucugacucaca

SEQ ID NO: 642688 - RNA, 23 nt, Homo sapiens
gcaucugagugggcccagcacau

SEQ ID NO: 642689 - RNA, 18 nt, Homo sapiens
gcaucugcaacaaaaagu

SEQ ID NO: 642690 - RNA, 18 nt, Homo sapiens
gcaucuggguagcuguaa

SEQ ID NO: 642691 - RNA, 17 nt, Homo sapiens
gcaucugugccagagau

SEQ ID NO: 642692 - RNA, 16 nt, Homo sapiens
gcaugaaacauuucag

SEQ ID NO: 642693 - RNA, 20 nt, Homo sapiens
gcaugaauaaaggcuacagg

SEQ ID NO: 642694 - RNA, 20 nt, Homo sapiens
gcaugacaaacacacaucca

SEQ ID NO: 642695 - RNA, 14 nt, Homo sapiens
gcaugaccugauca

SEQ ID NO: 642696 - RNA, 14 nt, Homo sapiens
gcaugaccugugac

SEQ ID NO: 642697 - RNA, 20 nt, Homo sapiens
gcaugaccugugaccagcac

SEQ ID NO: 642698 - RNA, 12 nt, Homo sapiens
gcaugacugugc

SEQ ID NO: 642699 - RNA, 19 nt, Homo sapiens
gcaugauauuguucuccaa

SEQ ID NO: 642700 - RNA, 16 nt, Homo sapiens
gcaugcagugcccuca

SEQ ID NO: 642701 - RNA, 13 nt, Homo sapiens
gcaugcuuaccuu

SEQ ID NO: 642702 - RNA, 21 nt, Homo sapiens
gcauggacaccccuuauccag

SEQ ID NO: 642703 - RNA, 17 nt, Homo sapiens
gcauggagagccucuua

SEQ ID NO: 642704 - RNA, 15 nt, Homo sapiens
gcauggagcauggga

SEQ ID NO: 642705 - RNA, 13 nt, Homo sapiens
gcauggagcuaua

SEQ ID NO: 642706 - RNA, 23 nt, Homo sapiens
gcauggaggcugcgacugaugaa

SEQ ID NO: 642707 - RNA, 21 nt, Homo sapiens
gcauggcaagucacaugcgua

SEQ ID NO: 642708 - RNA, 23 nt, Homo sapiens
gcaugggcuuugucuuggacucu

SEQ ID NO: 642709 - RNA, 14 nt, Homo sapiens
gcaugguagcucau

SEQ ID NO: 642710 - RNA, 22 nt, Homo sapiens
ucaagcacuuacagcucuggcc

SEQ ID NO: 642711 - RNA, 22 nt, Homo sapiens
ucaagcagacauagaagagcca

SEQ ID NO: 642712 - RNA, 14 nt, Homo sapiens
ucaagcauauugga

SEQ ID NO: 642713 - RNA, 15 nt, Homo sapiens
ucaagcauauuggaa

SEQ ID NO: 642714 - RNA, 19 nt, Homo sapiens
ucaagccaguacgugcuaa

SEQ ID NO: 642715 - RNA, 15 nt, Homo sapiens
ucaagccauuccaaa

SEQ ID NO: 642716 - RNA, 15 nt, Homo sapiens
ucaagcuagaaggcc

SEQ ID NO: 642717 - RNA, 15 nt, Homo sapiens
ucaaggaaagaauga

SEQ ID NO: 642718 - RNA, 15 nt, Homo sapiens
ucaaggaaagccagg

SEQ ID NO: 642719 - RNA, 20 nt, Homo sapiens
ucaaggaauaauucaaguca

SEQ ID NO: 642720 - RNA, 21 nt, Homo sapiens
uuuuucuaaaacauuccccuc

SEQ ID NO: 642721 - RNA, 13 nt, Homo sapiens
uuuuucuauauuc

SEQ ID NO: 642722 - RNA, 13 nt, Homo sapiens
uuuuucuccagcu

SEQ ID NO: 642723 - RNA, 19 nt, Homo sapiens
uuuuucucuuugugguuuc

SEQ ID NO: 642724 - RNA, 22 nt, Homo sapiens
uuuuucugauagaaaugguuuc

SEQ ID NO: 642725 - RNA, 15 nt, Homo sapiens
uuuuucuguggucuu

SEQ ID NO: 642726 - RNA, 14 nt, Homo sapiens
uuuuucuugguuuc

SEQ ID NO: 642727 - RNA, 20 nt, Homo sapiens
uuuuucuuugacaucauuca

SEQ ID NO: 642728 - RNA, 13 nt, Homo sapiens
uuuuugagcacaa

SEQ ID NO: 642729 - RNA, 20 nt, Homo sapiens
uuuuugaguacuguacuauc

SEQ ID NO: 642730 - RNA, 14 nt, Homo sapiens
uuuuugcacuauug

SEQ ID NO: 642731 - RNA, 11 nt, Homo sapiens
uuuuugccaug

SEQ ID NO: 642732 - RNA, 11 nt, Homo sapiens
uuuuugcucuc

SEQ ID NO: 642733 - RNA, 15 nt, Homo sapiens
uuuuuggaaagucag

SEQ ID NO: 642734 - RNA, 21 nt, Homo sapiens
uuuuuggaccccuaaugucag

SEQ ID NO: 642735 - RNA, 12 nt, Homo sapiens
uuuuugggacca

SEQ ID NO: 642736 - RNA, 15 nt, Homo sapiens
uuuuugguaguuguu

SEQ ID NO: 642737 - RNA, 12 nt, Homo sapiens
uuuuugugauca

SEQ ID NO: 642738 - RNA, 13 nt, Homo sapiens
uuuuuguuauuaa

SEQ ID NO: 642739 - RNA, 21 nt, Homo sapiens
uuuuuguuucuuccaaagcac

SEQ ID NO: 642740 - RNA, 18 nt, Homo sapiens
uuuuuuaaaaaagcuuaa

SEQ ID NO: 642741 - RNA, 19 nt, Homo sapiens
uuuuuuaaauaaaagcagc

SEQ ID NO: 642742 - RNA, 21 nt, Homo sapiens
uuuuuuaggaagcaagcuuaa

SEQ ID NO: 642743 - RNA, 13 nt, Homo sapiens
uuuuuuauuggaa

SEQ ID NO: 642744 - RNA, 14 nt, Homo sapiens
uuuuuuccuaagga

SEQ ID NO: 642745 - RNA, 22 nt, Homo sapiens
uuuuuucuuuuuugccaaauug

SEQ ID NO: 642746 - RNA, 12 nt, Homo sapiens
uuuuuugauuga

SEQ ID NO: 642747 - RNA, 17 nt, Homo sapiens
uuuuuugccaaggcuaa

SEQ ID NO: 642748 - RNA, 12 nt, Homo sapiens
uuuuaacugcau

SEQ ID NO: 642749 - RNA, 21 nt, Homo sapiens
uuuuaagaaaaaggaugcaca

SEQ ID NO: 642750 - RNA, 19 nt, Homo sapiens
uuuuaagaugugucuucaa

SEQ ID NO: 642751 - RNA, 13 nt, Homo sapiens
uuuuaagcuauca

SEQ ID NO: 642752 - RNA, 16 nt, Homo sapiens
uuuuaagcuaucagca

SEQ ID NO: 642753 - RNA, 19 nt, Homo sapiens
uuuuaagcugaaugauuca

SEQ ID NO: 642754 - RNA, 15 nt, Homo sapiens
uuuuaagugauguca

SEQ ID NO: 642755 - RNA, 14 nt, Homo sapiens
uuuuaaguugucaa

SEQ ID NO: 642756 - RNA, 15 nt, Homo sapiens
uuuuaauagcacuaa

SEQ ID NO: 642757 - RNA, 12 nt, Homo sapiens
uuuuaaugggag

SEQ ID NO: 642758 - RNA, 15 nt, Homo sapiens
uuuuaauggugaugg

SEQ ID NO: 642759 - RNA, 21 nt, Homo sapiens
uuuuaauuuaaacaccuccuc

SEQ ID NO: 642760 - RNA, 23 nt, Homo sapiens
uuuuacaauaaaacuuugcugcc

SEQ ID NO: 642761 - RNA, 14 nt, Homo sapiens
uuuuacacauuaga

SEQ ID NO: 642762 - RNA, 12 nt, Homo sapiens
uuuuacacugau

SEQ ID NO: 642763 - RNA, 15 nt, Homo sapiens
uuuuacacuugcauc

SEQ ID NO: 642764 - RNA, 16 nt, Homo sapiens
uuuuacaguugcauca

SEQ ID NO: 642765 - RNA, 16 nt, Homo sapiens
uuuuacauacugcugu

SEQ ID NO: 642766 - RNA, 12 nt, Homo sapiens
uuuuacauuuca

SEQ ID NO: 642767 - RNA, 17 nt, Homo sapiens
uuuuacauuucauacaa

SEQ ID NO: 642768 - RNA, 21 nt, Homo sapiens
uuuuacauuucauacaacaga

SEQ ID NO: 642769 - RNA, 12 nt, Homo sapiens
uuuuacauuucu

SEQ ID NO: 642770 - RNA, 19 nt, Homo sapiens
uuuuaccuuugucuuucug

SEQ ID NO: 642771 - RNA, 22 nt, Homo sapiens
uuuuacgaucuguuuccaaauc

SEQ ID NO: 642772 - RNA, 12 nt, Homo sapiens
uuuuacuauaaa

SEQ ID NO: 642773 - RNA, 20 nt, Homo sapiens
uuuuacugugaaacuggcac

SEQ ID NO: 642774 - RNA, 18 nt, Homo sapiens
uuuuacuucucuauacaa

SEQ ID NO: 642775 - RNA, 13 nt, Homo sapiens
uuuuagaacaguc

SEQ ID NO: 642776 - RNA, 22 nt, Homo sapiens
uuuuagaauuaaaaaagcauac

SEQ ID NO: 642777 - RNA, 19 nt, Homo sapiens
uuuuagacccuauugcugc

SEQ ID NO: 642778 - RNA, 16 nt, Homo sapiens
uuuuagagcuuccaaa

SEQ ID NO: 642779 - RNA, 18 nt, Homo sapiens
uuuuagcaguucugcaaa

SEQ ID NO: 642780 - RNA, 18 nt, Homo sapiens
aaagacgauuugucaguu

SEQ ID NO: 642781 - RNA, 17 nt, Homo sapiens
aaagacuaugaggaaua

SEQ ID NO: 642782 - RNA, 20 nt, Homo sapiens
aaagacucuuaaugcagacu

SEQ ID NO: 642783 - RNA, 23 nt, Homo sapiens
aaagacugaaucuaccugcccua

SEQ ID NO: 642784 - RNA, 20 nt, Homo sapiens
aaagacugauuuugcuuuuu

SEQ ID NO: 642785 - RNA, 19 nt, Homo sapiens
aaagacugcagcugcugaa

SEQ ID NO: 642786 - RNA, 15 nt, Homo sapiens
aaagacuguacuggc

SEQ ID NO: 642787 - RNA, 11 nt, Homo sapiens
aaagacuguag

SEQ ID NO: 642788 - RNA, 13 nt, Homo sapiens
aaagacugugggu

SEQ ID NO: 642789 - RNA, 14 nt, Homo sapiens
aaagagaaugagaa

SEQ ID NO: 642790 - RNA, 13 nt, Homo sapiens
aaagagaguuugu

SEQ ID NO: 642791 - RNA, 20 nt, Homo sapiens
aaagagaucacccacuccua

SEQ ID NO: 642792 - RNA, 13 nt, Homo sapiens
aaagagcagucag

SEQ ID NO: 642793 - RNA, 22 nt, Homo sapiens
aaagagccuucagaaugcuccu

SEQ ID NO: 642794 - RNA, 13 nt, Homo sapiens
aaagagcugcaca

SEQ ID NO: 642795 - RNA, 19 nt, Homo sapiens
aaagagcuguuauacugug

SEQ ID NO: 642796 - RNA, 23 nt, Homo sapiens
aaagaggaacgggcuuggaagaa

SEQ ID NO: 642797 - RNA, 24 nt, Homo sapiens
aaagaggagaaggaaaacaugcug

SEQ ID NO: 642798 - RNA, 22 nt, Homo sapiens
aaagaggcugccccucucacca

SEQ ID NO: 642799 - RNA, 17 nt, Homo sapiens
aaagagggcuuccucua

SEQ ID NO: 642800 - RNA, 15 nt, Homo sapiens
aaagagucagcccuu

SEQ ID NO: 642801 - RNA, 13 nt, Homo sapiens
aaagauacuagag

SEQ ID NO: 642802 - RNA, 20 nt, Homo sapiens
aaagauauaugaauaugaca

SEQ ID NO: 642803 - RNA, 13 nt, Homo sapiens
aaagaucacacau

SEQ ID NO: 642804 - RNA, 22 nt, Homo sapiens
aaagauccaagaaggccuucau

SEQ ID NO: 642805 - RNA, 22 nt, Homo sapiens
aaagauccacccucaaauguca

SEQ ID NO: 642806 - RNA, 16 nt, Homo sapiens
aaagaucucugucaca

SEQ ID NO: 642807 - RNA, 22 nt, Homo sapiens
aaagaucuugaauagucucauc

SEQ ID NO: 642808 - RNA, 21 nt, Homo sapiens
aaagaucuuucaggacucuac

SEQ ID NO: 642809 - RNA, 23 nt, Homo sapiens
aaagaucuuuuccagaguaugca

SEQ ID NO: 642810 - RNA, 16 nt, Homo sapiens
aaagaugaaguuuuau

SEQ ID NO: 642811 - RNA, 13 nt, Homo sapiens
aaagaugacaaaa

SEQ ID NO: 642812 - RNA, 15 nt, Homo sapiens
aaagaugacaaaaga

SEQ ID NO: 642813 - RNA, 19 nt, Homo sapiens
aaagaugaccuacagugcu

SEQ ID NO: 642814 - RNA, 19 nt, Homo sapiens
aaagaugaccuuugucuca

SEQ ID NO: 642815 - RNA, 12 nt, Homo sapiens
aaagaugcagug

SEQ ID NO: 642816 - RNA, 15 nt, Homo sapiens
aaagaugccauagca

SEQ ID NO: 642817 - RNA, 18 nt, Homo sapiens
aaagauggcuuaugucau

SEQ ID NO: 642818 - RNA, 23 nt, Homo sapiens
aaagauguacaaaacaguuugaa

SEQ ID NO: 642819 - RNA, 17 nt, Homo sapiens
aaagauguagauuuauu

SEQ ID NO: 642820 - RNA, 19 nt, Homo sapiens
aaagaugucuauguagcug

SEQ ID NO: 642821 - RNA, 20 nt, Homo sapiens
aaagaugugcagauaucaca

SEQ ID NO: 642822 - RNA, 20 nt, Homo sapiens
aaagauguuaguaguuucuc

SEQ ID NO: 642823 - RNA, 21 nt, Homo sapiens
aaagauguuugaaaaugcucu

SEQ ID NO: 642824 - RNA, 16 nt, Homo sapiens
aaagauguuugucaga

SEQ ID NO: 642825 - RNA, 14 nt, Homo sapiens
aaagauuaaaugug

SEQ ID NO: 642826 - RNA, 19 nt, Homo sapiens
aaagauuaaaugugucauu

SEQ ID NO: 642827 - RNA, 21 nt, Homo sapiens
aaaguuccaugaauucuugau

SEQ ID NO: 642828 - RNA, 12 nt, Homo sapiens
aaaguucccuga

SEQ ID NO: 642829 - RNA, 16 nt, Homo sapiens
aaaguucucaaugcaa

SEQ ID NO: 642830 - RNA, 16 nt, Homo sapiens
aaaguugagcgucauu

SEQ ID NO: 642831 - RNA, 13 nt, Homo sapiens
aaaguugagggaa

SEQ ID NO: 642832 - RNA, 22 nt, Homo sapiens
aaaguuggggacaugcugcuac

SEQ ID NO: 642833 - RNA, 21 nt, Homo sapiens
aaaguuguaguucuugugcau

SEQ ID NO: 642834 - RNA, 22 nt, Homo sapiens
aaaguuguaguucuugugcaug

SEQ ID NO: 642835 - RNA, 16 nt, Homo sapiens
aaaguuuaaagacacu

SEQ ID NO: 642836 - RNA, 22 nt, Homo sapiens
aaaguuuaacaaaugacuguau

SEQ ID NO: 642837 - RNA, 14 nt, Homo sapiens
aaaguuuacaacau

SEQ ID NO: 642838 - RNA, 12 nt, Homo sapiens
aaaguuugcuca

SEQ ID NO: 642839 - RNA, 13 nt, Homo sapiens
aaaguuugcucaa

SEQ ID NO: 642840 - RNA, 14 nt, Homo sapiens
aaaguuugcucaag

SEQ ID NO: 642841 - RNA, 17 nt, Homo sapiens
aaaguuuggaagcacug

SEQ ID NO: 642842 - RNA, 15 nt, Homo sapiens
aaaguuuugaugaaa

SEQ ID NO: 642843 - RNA, 15 nt, Homo sapiens
aaauaaaacuaagcu

SEQ ID NO: 642844 - RNA, 17 nt, Homo sapiens
aaauaaaagaucuugaa

SEQ ID NO: 642845 - RNA, 15 nt, Homo sapiens
aaauaaaauguguac

SEQ ID NO: 642846 - RNA, 13 nt, Homo sapiens
aaauaaacuucac

SEQ ID NO: 642847 - RNA, 18 nt, Homo sapiens
aaauaaaggugacuggga

SEQ ID NO: 642848 - RNA, 14 nt, Homo sapiens
aaauaaaguaccac

SEQ ID NO: 642849 - RNA, 16 nt, Homo sapiens
aaauaaaguaccacac

SEQ ID NO: 642850 - RNA, 14 nt, Homo sapiens
aaauaaaguaccau

SEQ ID NO: 642851 - RNA, 15 nt, Homo sapiens
aaauaaauacauucu

SEQ ID NO: 642852 - RNA, 15 nt, Homo sapiens
aaauaaauagcuaua

SEQ ID NO: 642853 - RNA, 16 nt, Homo sapiens
aaauaaaucaguucau

SEQ ID NO: 642854 - RNA, 23 nt, Homo sapiens
aaauaacagaaagccugggugac

SEQ ID NO: 642855 - RNA, 21 nt, Homo sapiens
aaauaaccacaagguccacuc

SEQ ID NO: 642856 - RNA, 23 nt, Homo sapiens
aaauaacuaaaagguaugcaauc

SEQ ID NO: 642857 - RNA, 21 nt, Homo sapiens
aaauaacuaggcguggacuua

SEQ ID NO: 642858 - RNA, 20 nt, Homo sapiens
aaauaacuggaaaacagaac

SEQ ID NO: 642859 - RNA, 14 nt, Homo sapiens
aaauaagagauuug

SEQ ID NO: 642860 - RNA, 15 nt, Homo sapiens
aaauaagcccagugc

SEQ ID NO: 642861 - RNA, 22 nt, Homo sapiens
aaauaagccuugaaaaagaaca

SEQ ID NO: 642862 - RNA, 18 nt, Homo sapiens
aaauaagcucuccccaaa

SEQ ID NO: 642863 - RNA, 14 nt, Homo sapiens
aaauaaguguuuua

SEQ ID NO: 642864 - RNA, 14 nt, Homo sapiens
aaauaauaacaauc

SEQ ID NO: 642865 - RNA, 17 nt, Homo sapiens
aaauaaucuacuguaca

SEQ ID NO: 642866 - RNA, 21 nt, Homo sapiens
aaauaaugguguccagucuuu

SEQ ID NO: 642867 - RNA, 14 nt, Homo sapiens
aaauaauucuuccu

SEQ ID NO: 642868 - RNA, 16 nt, Homo sapiens
aaauaauugauuucaa

SEQ ID NO: 642869 - RNA, 13 nt, Homo sapiens
aaauaauugccac

SEQ ID NO: 642870 - RNA, 19 nt, Homo sapiens
aaauaauuucuacucuguc

SEQ ID NO: 642871 - RNA, 15 nt, Homo sapiens
aaauaauuugcacug

SEQ ID NO: 642872 - RNA, 20 nt, Homo sapiens
aaauaauuuuauuaugcaac

SEQ ID NO: 642873 - RNA, 16 nt, Homo sapiens
aaauacaaaacuucca

SEQ ID NO: 642874 - RNA, 15 nt, Homo sapiens
aaauacaacacugag

SEQ ID NO: 642875 - RNA, 11 nt, Homo sapiens
aaauacaauaa

SEQ ID NO: 642876 - RNA, 14 nt, Homo sapiens
aaauacacaacaca

SEQ ID NO: 642877 - RNA, 23 nt, Homo sapiens
aaauacacagaugauaauaugcu

SEQ ID NO: 642878 - RNA, 22 nt, Homo sapiens
aaauacacagugcugaccagac

SEQ ID NO: 642879 - RNA, 23 nt, Homo sapiens
aaauacacagugcugaccagaca

SEQ ID NO: 642880 - RNA, 21 nt, Homo sapiens
aaaucaacagaagcauuugua

SEQ ID NO: 642881 - RNA, 15 nt, Homo sapiens
aaaucaacuugugua

SEQ ID NO: 642882 - RNA, 15 nt, Homo sapiens
aaaucaaugucacuu

SEQ ID NO: 642883 - RNA, 19 nt, Homo sapiens
aaaucacgaccacugauag

SEQ ID NO: 642884 - RNA, 18 nt, Homo sapiens
aaaucacuucaauccuca

SEQ ID NO: 642885 - RNA, 20 nt, Homo sapiens
aaaucagcagacacaggugu

SEQ ID NO: 642886 - RNA, 15 nt, Homo sapiens
aaaucagcaugacaa

SEQ ID NO: 642887 - RNA, 16 nt, Homo sapiens
aaaucagcaugacaaa

SEQ ID NO: 642888 - RNA, 20 nt, Homo sapiens
aaaucagcugcuacuacucc

SEQ ID NO: 642889 - RNA, 18 nt, Homo sapiens
aaaucaggaaccacagau

SEQ ID NO: 642890 - RNA, 11 nt, Homo sapiens
aaaucauagaa

SEQ ID NO: 642891 - RNA, 21 nt, Homo sapiens
aaaucauaguuuaaacugcau

SEQ ID NO: 642892 - RNA, 23 nt, Homo sapiens
aaaucauaguuuaaacugcauua

SEQ ID NO: 642893 - RNA, 18 nt, Homo sapiens
aaaucaugccaguauuuu

SEQ ID NO: 642894 - RNA, 22 nt, Homo sapiens
aaaucauuucaguaucaucucc

SEQ ID NO: 642895 - RNA, 14 nt, Homo sapiens
aaauccaaguagau

SEQ ID NO: 642896 - RNA, 17 nt, Homo sapiens
aaauccagaaguuuuaa

SEQ ID NO: 642897 - RNA, 20 nt, Homo sapiens
aaauccagugagcacuagaa

SEQ ID NO: 642898 - RNA, 21 nt, Homo sapiens
aaauccagugagcacuagaau

SEQ ID NO: 642899 - RNA, 24 nt, Homo sapiens
aaaucccuuguucucaguggugca

SEQ ID NO: 642900 - RNA, 21 nt, Homo sapiens
aaauccuaagacacaaaugca

SEQ ID NO: 642901 - RNA, 17 nt, Homo sapiens
aaauccuagacuugaaa

SEQ ID NO: 642902 - RNA, 18 nt, Homo sapiens
aaauccucauguuacuca

SEQ ID NO: 642903 - RNA, 21 nt, Homo sapiens
aaauccuuccuaaacccaaug

SEQ ID NO: 642904 - RNA, 22 nt, Homo sapiens
aaaucgaaacaacaacgagaua

SEQ ID NO: 642905 - RNA, 20 nt, Homo sapiens
aaaucgagagugugcucucc

SEQ ID NO: 642906 - RNA, 23 nt, Homo sapiens
aaaucggaucuggggcucuggga

SEQ ID NO: 642907 - RNA, 16 nt, Homo sapiens
aaaucuaccacuguau

SEQ ID NO: 642908 - RNA, 12 nt, Homo sapiens
aaaucuagaaga

SEQ ID NO: 642909 - RNA, 17 nt, Homo sapiens
aaaucuaggaugugaug

SEQ ID NO: 642910 - RNA, 14 nt, Homo sapiens
aaaucuauuacuuu

SEQ ID NO: 642911 - RNA, 15 nt, Homo sapiens
aaaucuccaagaccu

SEQ ID NO: 642912 - RNA, 13 nt, Homo sapiens
aaaucucccaaag

SEQ ID NO: 642913 - RNA, 13 nt, Homo sapiens
aaaucucuaauau

SEQ ID NO: 642914 - RNA, 23 nt, Homo sapiens
aaaucucucauauucgcuagugu

SEQ ID NO: 642915 - RNA, 12 nt, Homo sapiens
aaaucugaauaa

SEQ ID NO: 642916 - RNA, 23 nt, Homo sapiens
aaaucugaauaaauaauucuucc

SEQ ID NO: 642917 - RNA, 15 nt, Homo sapiens
aaaucugaguauaua

SEQ ID NO: 642918 - RNA, 18 nt, Homo sapiens
aaaucugauggccuuaau

SEQ ID NO: 642919 - RNA, 20 nt, Homo sapiens
aaaucugauuagaaguauaa

SEQ ID NO: 642920 - RNA, 18 nt, Homo sapiens
aaaucugauuucauuaca

SEQ ID NO: 642921 - RNA, 19 nt, Homo sapiens
aaaucuggguaucuuucca

SEQ ID NO: 642922 - RNA, 12 nt, Homo sapiens
aaaucuguaaau

SEQ ID NO: 642923 - RNA, 20 nt, Homo sapiens
aaaucuguaaucagcaauaa

SEQ ID NO: 642924 - RNA, 12 nt, Homo sapiens
aaaucugugaug

SEQ ID NO: 642925 - RNA, 15 nt, Homo sapiens
aaaucuugacuacag

SEQ ID NO: 642926 - RNA, 22 nt, Homo sapiens
aaaucuugguugaugccaaaaa

SEQ ID NO: 642927 - RNA, 19 nt, Homo sapiens
aaaucuuguuggcaaauca

SEQ ID NO: 642928 - RNA, 14 nt, Homo sapiens
aaaucuuucucuca

SEQ ID NO: 642929 - RNA, 21 nt, Homo sapiens
aaaucuuuuucuauauucuca

SEQ ID NO: 642930 - RNA, 15 nt, Homo sapiens
aaaugaaaauguuuc

SEQ ID NO: 642931 - RNA, 16 nt, Homo sapiens
aaaugaaacuuggcca

SEQ ID NO: 642932 - RNA, 15 nt, Homo sapiens
aaaugaacaaaagau

SEQ ID NO: 642933 - RNA, 14 nt, Homo sapiens
aaaugaacauuuca

SEQ ID NO: 642934 - RNA, 17 nt, Homo sapiens
aacuaguaaacauaugu

SEQ ID NO: 642935 - RNA, 12 nt, Homo sapiens
aacuagugaugu

SEQ ID NO: 642936 - RNA, 23 nt, Homo sapiens
aacuauaaggugccucaguuuuc

SEQ ID NO: 642937 - RNA, 20 nt, Homo sapiens
aacuaucauuuuuacacuau

SEQ ID NO: 642938 - RNA, 16 nt, Homo sapiens
aacuauccaaguguua

SEQ ID NO: 642939 - RNA, 17 nt, Homo sapiens
aacuaucucuacugaau

SEQ ID NO: 642940 - RNA, 22 nt, Homo sapiens
aacuaucugcauuaucuaugca

SEQ ID NO: 642941 - RNA, 21 nt, Homo sapiens
aacuaugaucacagugacuuu

SEQ ID NO: 642942 - RNA, 18 nt, Homo sapiens
aacuauguguucaaugaa

SEQ ID NO: 642943 - RNA, 17 nt, Homo sapiens
aacuauuacaccaaaua

SEQ ID NO: 642944 - RNA, 22 nt, Homo sapiens
aacuauugagccuugcauguac

SEQ ID NO: 642945 - RNA, 20 nt, Homo sapiens
aacuauugcauuuauaugua

SEQ ID NO: 642946 - RNA, 16 nt, Homo sapiens
aacuauugggugaaua

SEQ ID NO: 642947 - RNA, 22 nt, Homo sapiens
aacuauuggugcuugacucuca

SEQ ID NO: 642948 - RNA, 17 nt, Homo sapiens
aacuauuuaagaguuua

SEQ ID NO: 642949 - RNA, 19 nt, Homo sapiens
aacucaaaaauauuugcug

SEQ ID NO: 642950 - RNA, 16 nt, Homo sapiens
aacucaacuuugacaa

SEQ ID NO: 642951 - RNA, 21 nt, Homo sapiens
aacucaaggaaaucuguguca

SEQ ID NO: 642952 - RNA, 18 nt, Homo sapiens
aacucaaggauaccuucu

SEQ ID NO: 642953 - RNA, 14 nt, Homo sapiens
aacucaagguucua

SEQ ID NO: 642954 - RNA, 13 nt, Homo sapiens
aacucaaugagcu

SEQ ID NO: 642955 - RNA, 13 nt, Homo sapiens
aacucacacuccc

SEQ ID NO: 642956 - RNA, 15 nt, Homo sapiens
aacucacagagcuuu

SEQ ID NO: 642957 - RNA, 23 nt, Homo sapiens
aacucaccuuauucuucauuucg

SEQ ID NO: 642958 - RNA, 18 nt, Homo sapiens
aacucacggaccacucga

SEQ ID NO: 642959 - RNA, 17 nt, Homo sapiens
aacucacuaacagggag

SEQ ID NO: 642960 - RNA, 23 nt, Homo sapiens
aacucacugauucucuacaugcu

SEQ ID NO: 642961 - RNA, 14 nt, Homo sapiens
aacucacugugauc

SEQ ID NO: 642962 - RNA, 14 nt, Homo sapiens
aacucaggugauuc

SEQ ID NO: 642963 - RNA, 16 nt, Homo sapiens
aacucagugcuguuuc

SEQ ID NO: 642964 - RNA, 13 nt, Homo sapiens
aacucaucuucac

SEQ ID NO: 642965 - RNA, 19 nt, Homo sapiens
aacucaugaggagggaaaa

SEQ ID NO: 642966 - RNA, 18 nt, Homo sapiens
aacucauuacuuuuccau

SEQ ID NO: 642967 - RNA, 17 nt, Homo sapiens
aacucauuagacuggaa

SEQ ID NO: 642968 - RNA, 20 nt, Homo sapiens
aacucauuugagaucagucu

SEQ ID NO: 642969 - RNA, 23 nt, Homo sapiens
aacuccacugcuuaccuacuuuc

SEQ ID NO: 642970 - RNA, 20 nt, Homo sapiens
aacuccagcaacuucuucuc

SEQ ID NO: 642971 - RNA, 14 nt, Homo sapiens
aacuccauuugaac

SEQ ID NO: 642972 - RNA, 15 nt, Homo sapiens
aacucccgaccucag

SEQ ID NO: 642973 - RNA, 23 nt, Homo sapiens
aacucccugccccccagcccucc

SEQ ID NO: 642974 - RNA, 16 nt, Homo sapiens
aacuccugaccucagg

SEQ ID NO: 642975 - RNA, 20 nt, Homo sapiens
aacuccugaccucaggugau

SEQ ID NO: 642976 - RNA, 21 nt, Homo sapiens
aacuccugaccucaggugauc

SEQ ID NO: 642977 - RNA, 18 nt, Homo sapiens
aacuccuuguuaauccag

SEQ ID NO: 642978 - RNA, 19 nt, Homo sapiens
aacuccuuuagcagguggu

SEQ ID NO: 642979 - RNA, 17 nt, Homo sapiens
aacucgcacaaccauga

SEQ ID NO: 642980 - RNA, 14 nt, Homo sapiens
aacucggaaacuau

SEQ ID NO: 642981 - RNA, 18 nt, Homo sapiens
aacucuccccagugccug

SEQ ID NO: 642982 - RNA, 14 nt, Homo sapiens
aacucucuagcuua

SEQ ID NO: 642983 - RNA, 12 nt, Homo sapiens
aacucucuccac

SEQ ID NO: 642984 - RNA, 23 nt, Homo sapiens
aacucucugucuucucuccacuu

SEQ ID NO: 642985 - RNA, 18 nt, Homo sapiens
aacucugagaucuaagga

SEQ ID NO: 642986 - RNA, 16 nt, Homo sapiens
aacucugcaaaggccu

SEQ ID NO: 642987 - RNA, 15 nt, Homo sapiens
aacucugcacuccau

SEQ ID NO: 642988 - RNA, 21 nt, Homo sapiens
aacucuggagaguaagaauau

SEQ ID NO: 642989 - RNA, 17 nt, Homo sapiens
aacucugggcugccaug

SEQ ID NO: 642990 - RNA, 18 nt, Homo sapiens
aacucugggcugccaugu

SEQ ID NO: 642991 - RNA, 21 nt, Homo sapiens
aacucuggggcuuguccugug

SEQ ID NO: 642992 - RNA, 12 nt, Homo sapiens
aacucuguuaca

SEQ ID NO: 642993 - RNA, 14 nt, Homo sapiens
aacucuuaaaaccc

SEQ ID NO: 642994 - RNA, 18 nt, Homo sapiens
aagaaaaccucuggcaca

SEQ ID NO: 642995 - RNA, 23 nt, Homo sapiens
aagaaaaccuuucuucaccaaau

SEQ ID NO: 642996 - RNA, 11 nt, Homo sapiens
aagaaaacugg

SEQ ID NO: 642997 - RNA, 13 nt, Homo sapiens
aagaaaaggacaa

SEQ ID NO: 642998 - RNA, 22 nt, Homo sapiens
aagaaaaguagguuuacauuca

SEQ ID NO: 642999 - RNA, 13 nt, Homo sapiens
aagaaaaguuuau

SEQ ID NO: 643000 - RNA, 14 nt, Homo sapiens
aagaaaaugagaca

SEQ ID NO: 643001 - RNA, 21 nt, Homo sapiens
aagaaaauuagggcaaggugu

SEQ ID NO: 643002 - RNA, 17 nt, Homo sapiens
aagaaacagaguggccu

SEQ ID NO: 643003 - RNA, 13 nt, Homo sapiens
aagaaacauguga

SEQ ID NO: 643004 - RNA, 13 nt, Homo sapiens
aagaaacccaagu

SEQ ID NO: 643005 - RNA, 22 nt, Homo sapiens
aagaaaccuucagauuuguguu

SEQ ID NO: 643006 - RNA, 15 nt, Homo sapiens
aagaaacgucuucua

SEQ ID NO: 643007 - RNA, 14 nt, Homo sapiens
aagaaacuccgaag

SEQ ID NO: 643008 - RNA, 20 nt, Homo sapiens
aagaaacuggggcuccucca

SEQ ID NO: 643009 - RNA, 14 nt, Homo sapiens
aagaaagaaugcau

SEQ ID NO: 643010 - RNA, 14 nt, Homo sapiens
aagaaagaucaaag

SEQ ID NO: 643011 - RNA, 13 nt, Homo sapiens
aagaaagauccac

SEQ ID NO: 643012 - RNA, 20 nt, Homo sapiens
aagaaaggcgcgcgacaaug

SEQ ID NO: 643013 - RNA, 18 nt, Homo sapiens
aagaaaggggacccaaga

SEQ ID NO: 643014 - RNA, 20 nt, Homo sapiens
aagaaagugcgaguccucca

SEQ ID NO: 643015 - RNA, 14 nt, Homo sapiens
aagaaauaaugccu

SEQ ID NO: 643016 - RNA, 17 nt, Homo sapiens
aagaaauaaugccucca

SEQ ID NO: 643017 - RNA, 17 nt, Homo sapiens
aagaaauacagacugga

SEQ ID NO: 643018 - RNA, 14 nt, Homo sapiens
aagaaaucuugucu

SEQ ID NO: 643019 - RNA, 17 nt, Homo sapiens
aagaaaugcccaaaaga

SEQ ID NO: 643020 - RNA, 21 nt, Homo sapiens
aagaaauuccuguagcaucuu

SEQ ID NO: 643021 - RNA, 14 nt, Homo sapiens
aagaaauuuuauga

SEQ ID NO: 643022 - RNA, 18 nt, Homo sapiens
aagaacaacugccaagaa

SEQ ID NO: 643023 - RNA, 12 nt, Homo sapiens
aagaacaaugcc

SEQ ID NO: 643024 - RNA, 14 nt, Homo sapiens
aagaacacaugugc

SEQ ID NO: 643025 - RNA, 21 nt, Homo sapiens
aagaacaugauuuuacaagua

SEQ ID NO: 643026 - RNA, 20 nt, Homo sapiens
aagaacauuauucaucucuc

SEQ ID NO: 643027 - RNA, 17 nt, Homo sapiens
aagaaccaaaagagauc

SEQ ID NO: 643028 - RNA, 23 nt, Homo sapiens
aagaaccacucauugucuuugag

SEQ ID NO: 643029 - RNA, 15 nt, Homo sapiens
aagaaccccucugcu

SEQ ID NO: 643030 - RNA, 20 nt, Homo sapiens
aagaaccccucugucuucaa

SEQ ID NO: 643031 - RNA, 20 nt, Homo sapiens
aagaacccucaggucacaag

SEQ ID NO: 643032 - RNA, 16 nt, Homo sapiens
aagaaccgagcaauuu

SEQ ID NO: 643033 - RNA, 17 nt, Homo sapiens
aagaacgcgacuuccac

SEQ ID NO: 643034 - RNA, 20 nt, Homo sapiens
aagaacugucuauuuucuca

SEQ ID NO: 643035 - RNA, 15 nt, Homo sapiens
aagaagacacagaag

SEQ ID NO: 643036 - RNA, 22 nt, Homo sapiens
aagaagacaccucuaaucugga

SEQ ID NO: 643037 - RNA, 21 nt, Homo sapiens
aagaagacaucuguggccaac

SEQ ID NO: 643038 - RNA, 16 nt, Homo sapiens
aagaagacauggagac

SEQ ID NO: 643039 - RNA, 13 nt, Homo sapiens
aagaagaccagac

SEQ ID NO: 643040 - RNA, 15 nt, Homo sapiens
aagaagagaaaauuu

SEQ ID NO: 643041 - RNA, 20 nt, Homo sapiens
aagaagauagauccaauuaa

SEQ ID NO: 643042 - RNA, 21 nt, Homo sapiens
aagaagaugagccuugcagau

SEQ ID NO: 643043 - RNA, 12 nt, Homo sapiens
aagaagcauuuc

SEQ ID NO: 643044 - RNA, 13 nt, Homo sapiens
aagaagcauuucu

SEQ ID NO: 643045 - RNA, 18 nt, Homo sapiens
aagaagcuuccacaaaau

SEQ ID NO: 643046 - RNA, 24 nt, Homo sapiens
aagaaggcaauuuuaguguauuaa

SEQ ID NO: 643047 - RNA, 13 nt, Homo sapiens
aagaaggcauuug

SEQ ID NO: 643048 - RNA, 19 nt, Homo sapiens
aagaagggaguuccaguca

SEQ ID NO: 643049 - RNA, 15 nt, Homo sapiens
aagaagguuuguguu

SEQ ID NO: 643050 - RNA, 18 nt, Homo sapiens
aagaaguacauuguuacc

SEQ ID NO: 643051 - RNA, 14 nt, Homo sapiens
aagaagucacugaa

SEQ ID NO: 643052 - RNA, 15 nt, Homo sapiens
aagaagucaucuccu

SEQ ID NO: 643053 - RNA, 17 nt, Homo sapiens
aagaaguuacuuugcuu

SEQ ID NO: 643054 - RNA, 20 nt, Homo sapiens
aagaaguuguuugaggcaaa

SEQ ID NO: 643055 - RNA, 15 nt, Homo sapiens
aagaaguuugaccau

SEQ ID NO: 643056 - RNA, 22 nt, Homo sapiens
aagaauaaaaaagaaauccaua

SEQ ID NO: 643057 - RNA, 21 nt, Homo sapiens
aagaauaaaauugcacuuuua

SEQ ID NO: 643058 - RNA, 17 nt, Homo sapiens
aagaauaaauucuaccu

SEQ ID NO: 643059 - RNA, 18 nt, Homo sapiens
aagauucccauuggcucc

SEQ ID NO: 643060 - RNA, 16 nt, Homo sapiens
aagauucuacuuggug

SEQ ID NO: 643061 - RNA, 13 nt, Homo sapiens
aagauucuauuua

SEQ ID NO: 643062 - RNA, 20 nt, Homo sapiens
aagauucuggggcuguguua

SEQ ID NO: 643063 - RNA, 23 nt, Homo sapiens
aagauucuuuauaucugaaccaa

SEQ ID NO: 643064 - RNA, 16 nt, Homo sapiens
aagauugaaaauggac

SEQ ID NO: 643065 - RNA, 21 nt, Homo sapiens
aagauugccaauuuucuucau

SEQ ID NO: 643066 - RNA, 14 nt, Homo sapiens
aagauugcugaaaa

SEQ ID NO: 643067 - RNA, 20 nt, Homo sapiens
aagauuguccuuuucuccca

SEQ ID NO: 643068 - RNA, 15 nt, Homo sapiens
aagauuuaugaugca

SEQ ID NO: 643069 - RNA, 17 nt, Homo sapiens
aagauuuccuacuuucu

SEQ ID NO: 643070 - RNA, 19 nt, Homo sapiens
aagauuuggaagcucuucu

SEQ ID NO: 643071 - RNA, 19 nt, Homo sapiens
aagauuuuauuuauggaau

SEQ ID NO: 643072 - RNA, 14 nt, Homo sapiens
aagauuuucuauua

SEQ ID NO: 643073 - RNA, 17 nt, Homo sapiens
aagauuuuuggcacuuu

SEQ ID NO: 643074 - RNA, 18 nt, Homo sapiens
aagauuuuuuuugucaga

SEQ ID NO: 643075 - RNA, 16 nt, Homo sapiens
aagcaaaaugcuuaca

SEQ ID NO: 643076 - RNA, 22 nt, Homo sapiens
aagcaaagacaaaagaaacuua

SEQ ID NO: 643077 - RNA, 21 nt, Homo sapiens
aagcaaagacuaugaggaaua

SEQ ID NO: 643078 - RNA, 14 nt, Homo sapiens
aagcaaaguaucaa

SEQ ID NO: 643079 - RNA, 23 nt, Homo sapiens
aagcaaauagaucaugcauuuaa

SEQ ID NO: 643080 - RNA, 14 nt, Homo sapiens
aagcaaauggggga

SEQ ID NO: 643081 - RNA, 14 nt, Homo sapiens
aagcaaauuuugua

SEQ ID NO: 643082 - RNA, 12 nt, Homo sapiens
aagcaacaaaga

SEQ ID NO: 643083 - RNA, 18 nt, Homo sapiens
aagcaacagacucucaca

SEQ ID NO: 643084 - RNA, 14 nt, Homo sapiens
aagcaacaggccau

SEQ ID NO: 643085 - RNA, 21 nt, Homo sapiens
aagcaacaguaaucuaugugu

SEQ ID NO: 643086 - RNA, 20 nt, Homo sapiens
aagcaacaucuagcaaaugu

SEQ ID NO: 643087 - RNA, 14 nt, Homo sapiens
aagcaacuuuccuu

SEQ ID NO: 643088 - RNA, 15 nt, Homo sapiens
aagcaaggcuuuaaa

SEQ ID NO: 643089 - RNA, 17 nt, Homo sapiens
aagcaaguuuucuucca

SEQ ID NO: 643090 - RNA, 20 nt, Homo sapiens
aagcaauccaccugccuugg

SEQ ID NO: 643091 - RNA, 13 nt, Homo sapiens
aagcaauccuccu

SEQ ID NO: 643092 - RNA, 21 nt, Homo sapiens
aagcaaugggucacucauuaa

SEQ ID NO: 643093 - RNA, 15 nt, Homo sapiens
aagcaauuuguugcu

SEQ ID NO: 643094 - RNA, 17 nt, Homo sapiens
aagcacaacugaaacca

SEQ ID NO: 643095 - RNA, 15 nt, Homo sapiens
aagcacaaguacuuu

SEQ ID NO: 643096 - RNA, 17 nt, Homo sapiens
aagcacaaguacuuuug

SEQ ID NO: 643097 - RNA, 23 nt, Homo sapiens
aagcacaaucacuaaacuuuauu

SEQ ID NO: 643098 - RNA, 13 nt, Homo sapiens
aagcacagaauau

SEQ ID NO: 643099 - RNA, 19 nt, Homo sapiens
aagcacagauguucuucaa

SEQ ID NO: 643100 - RNA, 17 nt, Homo sapiens
aagcacagccucagaau

SEQ ID NO: 643101 - RNA, 21 nt, Homo sapiens
aagcacauuuuaaaagugcca

SEQ ID NO: 643102 - RNA, 19 nt, Homo sapiens
aagcaccugccucagcaau

SEQ ID NO: 643103 - RNA, 22 nt, Homo sapiens
aagcaccugccucagcaauugu

SEQ ID NO: 643104 - RNA, 21 nt, Homo sapiens
aagcaccuuugcucucagcca

SEQ ID NO: 643105 - RNA, 13 nt, Homo sapiens
aagcacuguggau

SEQ ID NO: 643106 - RNA, 12 nt, Homo sapiens
aagcacuugugg

SEQ ID NO: 643107 - RNA, 20 nt, Homo sapiens
aagcacuuuauauuuuccuc

SEQ ID NO: 643108 - RNA, 13 nt, Homo sapiens
aagcacuuuguua

SEQ ID NO: 643109 - RNA, 22 nt, Homo sapiens
aagcacuuuuuugaacuuccca

SEQ ID NO: 643110 - RNA, 15 nt, Homo sapiens
aagcagaccacugau

SEQ ID NO: 643111 - RNA, 14 nt, Homo sapiens
aagcagacuuuuca

SEQ ID NO: 643112 - RNA, 20 nt, Homo sapiens
aagcagagccuccugggaac

SEQ ID NO: 643113 - RNA, 20 nt, Homo sapiens
aagcagaggcaacacuggaa

SEQ ID NO: 643114 - RNA, 17 nt, Homo sapiens
aagcagauuuaacaauu

SEQ ID NO: 643115 - RNA, 21 nt, Homo sapiens
aagcagauuucugcuuccuuu

SEQ ID NO: 643116 - RNA, 14 nt, Homo sapiens
aagcagcaagacaa

SEQ ID NO: 643117 - RNA, 23 nt, Homo sapiens
aagcagcauggaaaaaugguuga

SEQ ID NO: 643118 - RNA, 19 nt, Homo sapiens
aagcagcuuuuuauucccu

SEQ ID NO: 643119 - RNA, 16 nt, Homo sapiens
aagcaggguacccuuu

SEQ ID NO: 643120 - RNA, 22 nt, Homo sapiens
aagcaggugcuacaacauguga

SEQ ID NO: 643121 - RNA, 21 nt, Homo sapiens
aagcagguucccaagcucaga

SEQ ID NO: 643122 - RNA, 15 nt, Homo sapiens
aagcagguucuugau

SEQ ID NO: 643123 - RNA, 13 nt, Homo sapiens
aagcagguuuguu

SEQ ID NO: 643124 - RNA, 20 nt, Homo sapiens
aagcaguaagcuaucuucaa

SEQ ID NO: 643125 - RNA, 16 nt, Homo sapiens
aagcagucagcccuua

SEQ ID NO: 643126 - RNA, 20 nt, Homo sapiens
aagcagucuucucuucugcc

SEQ ID NO: 643127 - RNA, 12 nt, Homo sapiens
aagcuuauguca

SEQ ID NO: 643128 - RNA, 13 nt, Homo sapiens
aagcuucaaaaag

SEQ ID NO: 643129 - RNA, 16 nt, Homo sapiens
aagcuucaugcacuua

SEQ ID NO: 643130 - RNA, 20 nt, Homo sapiens
aagcuucccucucagcugcu

SEQ ID NO: 643131 - RNA, 12 nt, Homo sapiens
aagcuucuaucc

SEQ ID NO: 643132 - RNA, 17 nt, Homo sapiens
aagcuuuacuacugugg

SEQ ID NO: 643133 - RNA, 19 nt, Homo sapiens
aagcuuucagguguuacag

SEQ ID NO: 643134 - RNA, 10 nt, Homo sapiens
aagcuuucuc

SEQ ID NO: 643135 - RNA, 22 nt, Homo sapiens
aagcuuuuccuuucucuuacac

SEQ ID NO: 643136 - RNA, 13 nt, Homo sapiens
aaggaaaaauaau

SEQ ID NO: 643137 - RNA, 19 nt, Homo sapiens
aaggaaaaucacaucucca

SEQ ID NO: 643138 - RNA, 13 nt, Homo sapiens
aaggaaaaugggg

SEQ ID NO: 643139 - RNA, 12 nt, Homo sapiens
aaggaaacacuu

SEQ ID NO: 643140 - RNA, 16 nt, Homo sapiens
aaggaaacacuucuau

SEQ ID NO: 643141 - RNA, 18 nt, Homo sapiens
aaggaaaccaagugguca

SEQ ID NO: 643142 - RNA, 15 nt, Homo sapiens
aaggaaacgaugaaa

SEQ ID NO: 643143 - RNA, 22 nt, Homo sapiens
aaggaaacuugaaucaaagcag

SEQ ID NO: 643144 - RNA, 13 nt, Homo sapiens
aaggaaacuuuau

SEQ ID NO: 643145 - RNA, 13 nt, Homo sapiens
aaggaaagccagg

SEQ ID NO: 643146 - RNA, 20 nt, Homo sapiens
aaggaaaguuuuuacuuuuu

SEQ ID NO: 643147 - RNA, 15 nt, Homo sapiens
aaggaaaucucaccc

SEQ ID NO: 643148 - RNA, 13 nt, Homo sapiens
aaggaaaucuccu

SEQ ID NO: 643149 - RNA, 16 nt, Homo sapiens
aaggaaaucuccucuu

SEQ ID NO: 643150 - RNA, 17 nt, Homo sapiens
aaggaacacuggcuuga

SEQ ID NO: 643151 - RNA, 14 nt, Homo sapiens
aaggaacaucucug

SEQ ID NO: 643152 - RNA, 16 nt, Homo sapiens
aaggaacucuacuuca

SEQ ID NO: 643153 - RNA, 21 nt, Homo sapiens
aaggaacugcaauaauaucaa

SEQ ID NO: 643154 - RNA, 22 nt, Homo sapiens
aaggaacugcaauaauaucaaa

SEQ ID NO: 643155 - RNA, 22 nt, Homo sapiens
aaggaagcaaguuuucuuccau

SEQ ID NO: 643156 - RNA, 18 nt, Homo sapiens
aaggaagcuccacuguca

SEQ ID NO: 643157 - RNA, 15 nt, Homo sapiens
aaggaaguacugcac

SEQ ID NO: 643158 - RNA, 18 nt, Homo sapiens
aaggaaguuucaguauua

SEQ ID NO: 643159 - RNA, 15 nt, Homo sapiens
aaggaauaaaaccau

SEQ ID NO: 643160 - RNA, 20 nt, Homo sapiens
aaggaauuuccucccaauuc

SEQ ID NO: 643161 - RNA, 15 nt, Homo sapiens
aaggacaaaguuuua

SEQ ID NO: 643162 - RNA, 21 nt, Homo sapiens
aaggacaccauuuuggcaagc

SEQ ID NO: 643163 - RNA, 18 nt, Homo sapiens
aaggacacuagaagauuu

SEQ ID NO: 643164 - RNA, 18 nt, Homo sapiens
aaggacacuuccugccua

SEQ ID NO: 643165 - RNA, 18 nt, Homo sapiens
aaggacagaacauugccu

SEQ ID NO: 643166 - RNA, 19 nt, Homo sapiens
aaggacagaguaugaacac

SEQ ID NO: 643167 - RNA, 22 nt, Homo sapiens
aaggacagugucaaagugauaa

SEQ ID NO: 643168 - RNA, 21 nt, Homo sapiens
aaggacaucagcaaacaggau

SEQ ID NO: 643169 - RNA, 15 nt, Homo sapiens
aaggacgaauuugca

SEQ ID NO: 643170 - RNA, 21 nt, Homo sapiens
aaggacggccuucaacugaaa

SEQ ID NO: 643171 - RNA, 20 nt, Homo sapiens
aaggacucuccaaauagcau

SEQ ID NO: 643172 - RNA, 20 nt, Homo sapiens
aaggacucugcuucagucca

SEQ ID NO: 643173 - RNA, 22 nt, Homo sapiens
aaggacugccgaccgaggcugg

SEQ ID NO: 643174 - RNA, 17 nt, Homo sapiens
aaggacuuaaggacagc

SEQ ID NO: 643175 - RNA, 14 nt, Homo sapiens
aaggagaaaagugg

SEQ ID NO: 643176 - RNA, 16 nt, Homo sapiens
aaggagaacuauccaa

SEQ ID NO: 643177 - RNA, 17 nt, Homo sapiens
aaggagaacuauccaaa

SEQ ID NO: 643178 - RNA, 23 nt, Homo sapiens
aaggagacucaccucugccucaa

SEQ ID NO: 643179 - RNA, 15 nt, Homo sapiens
aaggagagcuuugca

SEQ ID NO: 643180 - RNA, 14 nt, Homo sapiens
aaggucugaugucu

SEQ ID NO: 643181 - RNA, 19 nt, Homo sapiens
aaggucugcacuccuuuau

SEQ ID NO: 643182 - RNA, 15 nt, Homo sapiens
aaggucuucagccau

SEQ ID NO: 643183 - RNA, 17 nt, Homo sapiens
aaggugaaccaugucag

SEQ ID NO: 643184 - RNA, 17 nt, Homo sapiens
aaggugaguuugagcug

SEQ ID NO: 643185 - RNA, 13 nt, Homo sapiens
aaggugcacugcu

SEQ ID NO: 643186 - RNA, 21 nt, Homo sapiens
aaggugcaggggccaggggug

SEQ ID NO: 643187 - RNA, 21 nt, Homo sapiens
aaggugccacuccagugccca

SEQ ID NO: 643188 - RNA, 21 nt, Homo sapiens
aaggugcgagggccacagccc

SEQ ID NO: 643189 - RNA, 14 nt, Homo sapiens
aaggugcuacuuga

SEQ ID NO: 643190 - RNA, 15 nt, Homo sapiens
aagguggaaguugca

SEQ ID NO: 643191 - RNA, 22 nt, Homo sapiens
aagguggccacagugucacugg

SEQ ID NO: 643192 - RNA, 13 nt, Homo sapiens
aagguggccucug

SEQ ID NO: 643193 - RNA, 15 nt, Homo sapiens
aaggugggcagauca

SEQ ID NO: 643194 - RNA, 20 nt, Homo sapiens
aaggugggcggaucaccuga

SEQ ID NO: 643195 - RNA, 17 nt, Homo sapiens
aagguggggaccugggg

SEQ ID NO: 643196 - RNA, 18 nt, Homo sapiens
aagguggggauugcccau

SEQ ID NO: 643197 - RNA, 20 nt, Homo sapiens
aagguggguggaucacuuga

SEQ ID NO: 643198 - RNA, 14 nt, Homo sapiens
aaggugucucuggu

SEQ ID NO: 643199 - RNA, 15 nt, Homo sapiens
aagguguucucugua

SEQ ID NO: 643200 - RNA, 18 nt, Homo sapiens
aagguuaaaaaguucaua

SEQ ID NO: 643201 - RNA, 16 nt, Homo sapiens
aagguuaagucaggga

SEQ ID NO: 643202 - RNA, 15 nt, Homo sapiens
aagguucacucucaa

SEQ ID NO: 643203 - RNA, 18 nt, Homo sapiens
aagguucccucugagaau

SEQ ID NO: 643204 - RNA, 18 nt, Homo sapiens
aagguucgacuagugaua

SEQ ID NO: 643205 - RNA, 17 nt, Homo sapiens
aagguucucauuucuca

SEQ ID NO: 643206 - RNA, 18 nt, Homo sapiens
aagguugaaaagacaaua

SEQ ID NO: 643207 - RNA, 22 nt, Homo sapiens
aagguuguguagcugugucaug

SEQ ID NO: 643208 - RNA, 23 nt, Homo sapiens
aagguuuaaaguuugaagauuau

SEQ ID NO: 643209 - RNA, 23 nt, Homo sapiens
aagguuuggugcaaaguauugua

SEQ ID NO: 643210 - RNA, 20 nt, Homo sapiens
aaguaaaaacacuaccucuu

SEQ ID NO: 643211 - RNA, 19 nt, Homo sapiens
aaguaaagauuaaaaccaa

SEQ ID NO: 643212 - RNA, 15 nt, Homo sapiens
aaguaaauacaguag

SEQ ID NO: 643213 - RNA, 13 nt, Homo sapiens
aaguaaauuaaac

SEQ ID NO: 643214 - RNA, 20 nt, Homo sapiens
aaguaacuucugacuuacug

SEQ ID NO: 643215 - RNA, 14 nt, Homo sapiens
aaguaagcauuucc

SEQ ID NO: 643216 - RNA, 12 nt, Homo sapiens
aaguaagcccuu

SEQ ID NO: 643217 - RNA, 15 nt, Homo sapiens
aaguaaggcaugguu

SEQ ID NO: 643218 - RNA, 15 nt, Homo sapiens
aaguaaguaccacuc

SEQ ID NO: 643219 - RNA, 17 nt, Homo sapiens
aaguaaguuugauuuca

SEQ ID NO: 643220 - RNA, 15 nt, Homo sapiens
aaguaauacaaacua

SEQ ID NO: 643221 - RNA, 13 nt, Homo sapiens
aaguaaugaauuu

SEQ ID NO: 643222 - RNA, 14 nt, Homo sapiens
aaguaaugaugaaa

SEQ ID NO: 643223 - RNA, 15 nt, Homo sapiens
aaguaauugccuaca

SEQ ID NO: 643224 - RNA, 22 nt, Homo sapiens
aaguaauuucuuugaucuggac

SEQ ID NO: 643225 - RNA, 15 nt, Homo sapiens
aaguacaaagggcac

SEQ ID NO: 643226 - RNA, 22 nt, Homo sapiens
aaguacaaagguugcagugcug

SEQ ID NO: 643227 - RNA, 16 nt, Homo sapiens
aaguaccacacauauu

SEQ ID NO: 643228 - RNA, 17 nt, Homo sapiens
aaguaccacacauauug

SEQ ID NO: 643229 - RNA, 15 nt, Homo sapiens
aaguaccacucaggc

SEQ ID NO: 643230 - RNA, 20 nt, Homo sapiens
aaguacucaaauauuucuga

SEQ ID NO: 643231 - RNA, 21 nt, Homo sapiens
aaguacugguugacuuucuaa

SEQ ID NO: 643232 - RNA, 13 nt, Homo sapiens
aaguacuugucau

SEQ ID NO: 643233 - RNA, 16 nt, Homo sapiens
aaguacuuuaccugaa

SEQ ID NO: 643234 - RNA, 18 nt, Homo sapiens
aaguacuuuucuguucau

SEQ ID NO: 643235 - RNA, 17 nt, Homo sapiens
aaguagaaauggugaga

SEQ ID NO: 643236 - RNA, 20 nt, Homo sapiens
aaguagaagucauauguugu

SEQ ID NO: 643237 - RNA, 23 nt, Homo sapiens
aaguagaaguuacuuaauugcca

SEQ ID NO: 643238 - RNA, 13 nt, Homo sapiens
aaguagaggaauc

SEQ ID NO: 643239 - RNA, 19 nt, Homo sapiens
aaguagaggaauccaugua

SEQ ID NO: 643240 - RNA, 18 nt, Homo sapiens
aaguagauuuuaaaagau

SEQ ID NO: 643241 - RNA, 20 nt, Homo sapiens
aaguagcaaaaaguauugaa

SEQ ID NO: 643242 - RNA, 12 nt, Homo sapiens
aaguagcaauuu

SEQ ID NO: 643243 - RNA, 21 nt, Homo sapiens
aaguagcaugaucaguguaug

SEQ ID NO: 643244 - RNA, 19 nt, Homo sapiens
aaguagccucuuucauccc

SEQ ID NO: 643245 - RNA, 21 nt, Homo sapiens
aaguaggaacucuuaagcaau

SEQ ID NO: 643246 - RNA, 22 nt, Homo sapiens
aaguaggauucaucauuccaua

SEQ ID NO: 643247 - RNA, 13 nt, Homo sapiens
aaguauaaaugaa

SEQ ID NO: 643248 - RNA, 15 nt, Homo sapiens
aaguauaacaacuuu

SEQ ID NO: 643249 - RNA, 17 nt, Homo sapiens
aaguauaacaacuuuga

SEQ ID NO: 643250 - RNA, 23 nt, Homo sapiens
aaguauaacugaguuaaauuaua

SEQ ID NO: 643251 - RNA, 21 nt, Homo sapiens
aaguauacuuuuccccuguua

SEQ ID NO: 643252 - RNA, 14 nt, Homo sapiens
aaugagccaaaaug

SEQ ID NO: 643253 - RNA, 12 nt, Homo sapiens
aaugagccuuag

SEQ ID NO: 643254 - RNA, 15 nt, Homo sapiens
aaugagguaaauaag

SEQ ID NO: 643255 - RNA, 17 nt, Homo sapiens
aaugaggucuguuuaaa

SEQ ID NO: 643256 - RNA, 19 nt, Homo sapiens
aaugaguuagaacuauuaa

SEQ ID NO: 643257 - RNA, 23 nt, Homo sapiens
aaugauacugcuuuucaccaaaa

SEQ ID NO: 643258 - RNA, 16 nt, Homo sapiens
aaugauagacaauuga

SEQ ID NO: 643259 - RNA, 17 nt, Homo sapiens
aaugauaugaccaaaau

SEQ ID NO: 643260 - RNA, 22 nt, Homo sapiens
aaugaucacaucuaaagcuuua

SEQ ID NO: 643261 - RNA, 23 nt, Homo sapiens
aaugaucaccauguuagccuuag

SEQ ID NO: 643262 - RNA, 18 nt, Homo sapiens
aaugaucagcaucuguga

SEQ ID NO: 643263 - RNA, 20 nt, Homo sapiens
aaugaucagcaucugugaug

SEQ ID NO: 643264 - RNA, 23 nt, Homo sapiens
aaugaucuugaagaugacaaaag

SEQ ID NO: 643265 - RNA, 19 nt, Homo sapiens
aaugaugcagcuguugaga

SEQ ID NO: 643266 - RNA, 14 nt, Homo sapiens
aaugaugcuaugaa

SEQ ID NO: 643267 - RNA, 15 nt, Homo sapiens
aaugaugcuaugaaa

SEQ ID NO: 643268 - RNA, 14 nt, Homo sapiens
aaugaugcucaaaa

SEQ ID NO: 643269 - RNA, 13 nt, Homo sapiens
aaugaugugauac

SEQ ID NO: 643270 - RNA, 14 nt, Homo sapiens
aaugaugugauaca

SEQ ID NO: 643271 - RNA, 15 nt, Homo sapiens
aaugauuacuaauau

SEQ ID NO: 643272 - RNA, 11 nt, Homo sapiens
aaugauuagaa

SEQ ID NO: 643273 - RNA, 18 nt, Homo sapiens
aaugauucauaagacacu

SEQ ID NO: 643274 - RNA, 20 nt, Homo sapiens
aaugauuguuugucaauaua

SEQ ID NO: 643275 - RNA, 18 nt, Homo sapiens
aaugauuuuaucugugaa

SEQ ID NO: 643276 - RNA, 18 nt, Homo sapiens
aaugauuuuucuuuacaa

SEQ ID NO: 643277 - RNA, 17 nt, Homo sapiens
aaugcaaaguacaugua

SEQ ID NO: 643278 - RNA, 20 nt, Homo sapiens
aaugcaaauuaaaacauauu

SEQ ID NO: 643279 - RNA, 13 nt, Homo sapiens
aaugcaaccauuu

SEQ ID NO: 643280 - RNA, 14 nt, Homo sapiens
aaugcaaucaggau

SEQ ID NO: 643281 - RNA, 17 nt, Homo sapiens
aaugcaauuagcauuau

SEQ ID NO: 643282 - RNA, 13 nt, Homo sapiens
aaugcacuuucua

SEQ ID NO: 643283 - RNA, 11 nt, Homo sapiens
aaugcagagaa

SEQ ID NO: 643284 - RNA, 20 nt, Homo sapiens
aaugcagcagggaugcccug

SEQ ID NO: 643285 - RNA, 18 nt, Homo sapiens
aaugcagcucaucacuug

SEQ ID NO: 643286 - RNA, 19 nt, Homo sapiens
aaugcagggacaaaugcca

SEQ ID NO: 643287 - RNA, 22 nt, Homo sapiens
aaugcauauuugcaaaguguau

SEQ ID NO: 643288 - RNA, 20 nt, Homo sapiens
aaugcauauuugccacaaaa

SEQ ID NO: 643289 - RNA, 18 nt, Homo sapiens
aaugcaucacauauucau

SEQ ID NO: 643290 - RNA, 14 nt, Homo sapiens
aaugcauggugcag

SEQ ID NO: 643291 - RNA, 21 nt, Homo sapiens
aaugcauuauaggaucauuug

SEQ ID NO: 643292 - RNA, 21 nt, Homo sapiens
aaugucuuuugaauauuccca

SEQ ID NO: 643293 - RNA, 22 nt, Homo sapiens
aaugucuuuuuucaaacuuuau

SEQ ID NO: 643294 - RNA, 23 nt, Homo sapiens
aaugugaacguccuuccuugacu

SEQ ID NO: 643295 - RNA, 21 nt, Homo sapiens
aaugugauauuugaagcauca

SEQ ID NO: 643296 - RNA, 22 nt, Homo sapiens
aaugugauuuuucuucagguaa

SEQ ID NO: 643297 - RNA, 15 nt, Homo sapiens
aaugugcaacauucu

SEQ ID NO: 643298 - RNA, 12 nt, Homo sapiens
aaugugcacucu

SEQ ID NO: 643299 - RNA, 21 nt, Homo sapiens
aaugugcagcucccauuuggc

SEQ ID NO: 643300 - RNA, 22 nt, Homo sapiens
aaugugcagggauauugccuua

SEQ ID NO: 643301 - RNA, 21 nt, Homo sapiens
aaugugcuggugaacacugug

SEQ ID NO: 643302 - RNA, 19 nt, Homo sapiens
aauguggauaaaacugugu

SEQ ID NO: 643303 - RNA, 14 nt, Homo sapiens
aauguggauuugau

SEQ ID NO: 643304 - RNA, 16 nt, Homo sapiens
aaugugguuacuuccu

SEQ ID NO: 643305 - RNA, 16 nt, Homo sapiens
aaugugguuggucaaa

SEQ ID NO: 643306 - RNA, 18 nt, Homo sapiens
aaugugguuuuccugaaa

SEQ ID NO: 643307 - RNA, 12 nt, Homo sapiens
aauguguacaaa

SEQ ID NO: 643308 - RNA, 16 nt, Homo sapiens
aauguguacagugaau

SEQ ID NO: 643309 - RNA, 23 nt, Homo sapiens
aauguguccuaucuaucuuccaa

SEQ ID NO: 643310 - RNA, 17 nt, Homo sapiens
aauguguuaagugcagg

SEQ ID NO: 643311 - RNA, 19 nt, Homo sapiens
aauguguuucaaaaccaug

SEQ ID NO: 643312 - RNA, 23 nt, Homo sapiens
aauguguuuucuguagacucuaa

SEQ ID NO: 643313 - RNA, 20 nt, Homo sapiens
aauguuaacuaaauaacuuu

SEQ ID NO: 643314 - RNA, 16 nt, Homo sapiens
aauguuacauuauuau

SEQ ID NO: 643315 - RNA, 13 nt, Homo sapiens
aauguuaccucua

SEQ ID NO: 643316 - RNA, 16 nt, Homo sapiens
aauguuagccaugacu

SEQ ID NO: 643317 - RNA, 17 nt, Homo sapiens
aauguuaugacuaugua

SEQ ID NO: 643318 - RNA, 18 nt, Homo sapiens
aauguuaugacuauguaa

SEQ ID NO: 643319 - RNA, 14 nt, Homo sapiens
aauguucacaacau

SEQ ID NO: 643320 - RNA, 15 nt, Homo sapiens
aauguucacuuuuga

SEQ ID NO: 643321 - RNA, 21 nt, Homo sapiens
aauguucauuguaauguuacu

SEQ ID NO: 643322 - RNA, 17 nt, Homo sapiens
aauguucucaugaacua

SEQ ID NO: 643323 - RNA, 22 nt, Homo sapiens
aauguucuguuugcuguggaac

SEQ ID NO: 643324 - RNA, 20 nt, Homo sapiens
aauguucuuugucucaaaau

SEQ ID NO: 643325 - RNA, 19 nt, Homo sapiens
aauguucuuuugacugaag

SEQ ID NO: 643326 - RNA, 21 nt, Homo sapiens
aauguugcauuuaugaugcag

SEQ ID NO: 643327 - RNA, 20 nt, Homo sapiens
aauguugguuuuaauacuug

SEQ ID NO: 643328 - RNA, 21 nt, Homo sapiens
aauguuuaaauucucuuucac

SEQ ID NO: 643329 - RNA, 14 nt, Homo sapiens
aauguuuacacucu

SEQ ID NO: 643330 - RNA, 18 nt, Homo sapiens
aauguuugucucauccca

SEQ ID NO: 643331 - RNA, 19 nt, Homo sapiens
aauguuugucucaucccau

SEQ ID NO: 643332 - RNA, 21 nt, Homo sapiens
aauguuuuucccuccccagaa

SEQ ID NO: 643333 - RNA, 14 nt, Homo sapiens
aauuaaaaccugau

SEQ ID NO: 643334 - RNA, 12 nt, Homo sapiens
aauuaaaacuga

SEQ ID NO: 643335 - RNA, 21 nt, Homo sapiens
aauuaaaauucguuuuugcaa

SEQ ID NO: 643336 - RNA, 15 nt, Homo sapiens
aauuaaacuaaagag

SEQ ID NO: 643337 - RNA, 16 nt, Homo sapiens
aauuaaacuaguuuaa

SEQ ID NO: 643338 - RNA, 16 nt, Homo sapiens
aauuaaacuuccaaag

SEQ ID NO: 643339 - RNA, 21 nt, Homo sapiens
aauuaacaguauuucuuuaca

SEQ ID NO: 643340 - RNA, 17 nt, Homo sapiens
aauuaaccuggugcugg

SEQ ID NO: 643341 - RNA, 15 nt, Homo sapiens
aauuaaccuuacuaa

SEQ ID NO: 643342 - RNA, 14 nt, Homo sapiens
aauuaagacuuuau

SEQ ID NO: 643343 - RNA, 12 nt, Homo sapiens
aauuaagcauuu

SEQ ID NO: 643344 - RNA, 13 nt, Homo sapiens
aauuaauagcuuu

SEQ ID NO: 643345 - RNA, 21 nt, Homo sapiens
aauuaaucacccuaccaacuu

SEQ ID NO: 643346 - RNA, 21 nt, Homo sapiens
aauuaauuugugaauuugcaa

SEQ ID NO: 643347 - RNA, 15 nt, Homo sapiens
aauuacagccuuauu

SEQ ID NO: 643348 - RNA, 15 nt, Homo sapiens
aauuacagugcaguu

SEQ ID NO: 643349 - RNA, 19 nt, Homo sapiens
aauuacccuuucauucagc

SEQ ID NO: 643350 - RNA, 16 nt, Homo sapiens
aauuacccuuuugcag

SEQ ID NO: 643351 - RNA, 14 nt, Homo sapiens
aauuaccuugccaa

SEQ ID NO: 643352 - RNA, 14 nt, Homo sapiens
aauuacugccuuac

SEQ ID NO: 643353 - RNA, 21 nt, Homo sapiens
aauuacuggcaaaaacaaaac

SEQ ID NO: 643354 - RNA, 15 nt, Homo sapiens
aauuacuguguaaau

SEQ ID NO: 643355 - RNA, 18 nt, Homo sapiens
aauuacuuuuucauucuu

SEQ ID NO: 643356 - RNA, 16 nt, Homo sapiens
aauuagaaaguagcca

SEQ ID NO: 643357 - RNA, 23 nt, Homo sapiens
aauuagaucgguucugugccuuu

SEQ ID NO: 643358 - RNA, 22 nt, Homo sapiens
aauuagcauuuuucaaaugauc

SEQ ID NO: 643359 - RNA, 22 nt, Homo sapiens
aauuagccauuucacucucaaa

SEQ ID NO: 643360 - RNA, 19 nt, Homo sapiens
aauuagccggucauggugg

SEQ ID NO: 643361 - RNA, 17 nt, Homo sapiens
aauuagggaugcucaaa

SEQ ID NO: 643362 - RNA, 14 nt, Homo sapiens
aauuagggcccaau

SEQ ID NO: 643363 - RNA, 21 nt, Homo sapiens
aauuagggguuaaagcagaca

SEQ ID NO: 643364 - RNA, 19 nt, Homo sapiens
aauuaguguggcuaaccaa

SEQ ID NO: 643365 - RNA, 21 nt, Homo sapiens
aauuaguuccucauuagcauu

SEQ ID NO: 643366 - RNA, 12 nt, Homo sapiens
aauuaguucucc

SEQ ID NO: 643367 - RNA, 15 nt, Homo sapiens
aauuauaagcauaca

SEQ ID NO: 643368 - RNA, 21 nt, Homo sapiens
aauuauauaacuguauuugaa

SEQ ID NO: 643369 - RNA, 23 nt, Homo sapiens
aauuauccauuacgugcauuuaa

SEQ ID NO: 643370 - RNA, 19 nt, Homo sapiens
aauuauccuguaguacaag

SEQ ID NO: 643371 - RNA, 20 nt, Homo sapiens
aauuaucggaagcagugccu

SEQ ID NO: 643372 - RNA, 18 nt, Homo sapiens
aauuaucuugauacauuc

SEQ ID NO: 643373 - RNA, 22 nt, Homo sapiens
aauuaugucucuugagcaucaa

SEQ ID NO: 643374 - RNA, 14 nt, Homo sapiens
aauuauuacagugu

SEQ ID NO: 643375 - RNA, 18 nt, Homo sapiens
aauuauuauauguaacug

SEQ ID NO: 643376 - RNA, 21 nt, Homo sapiens
uuguuucccaucagacuguca

SEQ ID NO: 643377 - RNA, 22 nt, Homo sapiens
uuguuugguuagugacugaugu

SEQ ID NO: 643378 - RNA, 14 nt, Homo sapiens
uuguuugucuucca

SEQ ID NO: 643379 - RNA, 21 nt, Homo sapiens
uuguuuuaacguucugcugcu

SEQ ID NO: 643380 - RNA, 14 nt, Homo sapiens
uuguuuugccacuu

SEQ ID NO: 643381 - RNA, 20 nt, Homo sapiens
uuguuuuuaaguccuguaua

SEQ ID NO: 643382 - RNA, 14 nt, Homo sapiens
uuguuuuucuccac

SEQ ID NO: 643383 - RNA, 19 nt, Homo sapiens
uuuaaaaaaaaagucagag

SEQ ID NO: 643384 - RNA, 20 nt, Homo sapiens
uuuaaaaaaaaagucagaga

SEQ ID NO: 643385 - RNA, 21 nt, Homo sapiens
uuuaaaaaaaaagucagagac

SEQ ID NO: 643386 - RNA, 23 nt, Homo sapiens
uuuaaaaaaaagaaucaccaaau

SEQ ID NO: 643387 - RNA, 19 nt, Homo sapiens
uuuaaaaaaagaacauaaa

SEQ ID NO: 643388 - RNA, 19 nt, Homo sapiens
uuuaaaaaauauuuucucu

SEQ ID NO: 643389 - RNA, 13 nt, Homo sapiens
uuuaaaaacaaag

SEQ ID NO: 643390 - RNA, 19 nt, Homo sapiens
uuuaaaaaugucuugcugu

SEQ ID NO: 643391 - RNA, 22 nt, Homo sapiens
uuuaaaaauguuugaguauucu

SEQ ID NO: 643392 - RNA, 16 nt, Homo sapiens
uuuaaaacaggcaaag

SEQ ID NO: 643393 - RNA, 16 nt, Homo sapiens
uuuaaaacauucacac

SEQ ID NO: 643394 - RNA, 18 nt, Homo sapiens
uuuaaaacgcgucugccu

SEQ ID NO: 643395 - RNA, 20 nt, Homo sapiens
uuuaaaacuaguuagauuca

SEQ ID NO: 643396 - RNA, 19 nt, Homo sapiens
uuuaaaagaaaaaugcugu

SEQ ID NO: 643397 - RNA, 15 nt, Homo sapiens
uuuaaaagcuucuca

SEQ ID NO: 643398 - RNA, 15 nt, Homo sapiens
uuuaaaauaaauucc

SEQ ID NO: 643399 - RNA, 14 nt, Homo sapiens
uuuaaaauagcaaa

SEQ ID NO: 643400 - RNA, 15 nt, Homo sapiens
uuuaaaauauccugu

SEQ ID NO: 643401 - RNA, 16 nt, Homo sapiens
uuuaaaauauuacaca

SEQ ID NO: 643402 - RNA, 13 nt, Homo sapiens
uuuaaaauuucau

SEQ ID NO: 643403 - RNA, 13 nt, Homo sapiens
uuuaaacauuuca

SEQ ID NO: 643404 - RNA, 20 nt, Homo sapiens
uuuaaacuaucuugugugau

SEQ ID NO: 643405 - RNA, 17 nt, Homo sapiens
uuuaaagaaagaaugca

SEQ ID NO: 643406 - RNA, 19 nt, Homo sapiens
uuuaaagacagggucuugc

SEQ ID NO: 643407 - RNA, 15 nt, Homo sapiens
uuuaaagcacaugcc

SEQ ID NO: 643408 - RNA, 17 nt, Homo sapiens
uuuaaagccauucugau

SEQ ID NO: 643409 - RNA, 23 nt, Homo sapiens
uuuaaagcuacaaucuguucaau

SEQ ID NO: 643410 - RNA, 18 nt, Homo sapiens
uuuaaaguggcaaucuca

SEQ ID NO: 643411 - RNA, 18 nt, Homo sapiens
uuuaaauaaaguaucaug

SEQ ID NO: 643412 - RNA, 20 nt, Homo sapiens
uuuaaauaaaguuacuugaa

SEQ ID NO: 643413 - RNA, 16 nt, Homo sapiens
uuuaaauagcauaaaa

SEQ ID NO: 643414 - RNA, 22 nt, Homo sapiens
uuuaaaucaacgaguacuucaa

SEQ ID NO: 643415 - RNA, 12 nt, Homo sapiens
uuuaaaucugag

SEQ ID NO: 643416 - RNA, 14 nt, Homo sapiens
uuuaaaucugugau

SEQ ID NO: 643417 - RNA, 12 nt, Homo sapiens
uuuaaaugaagu

SEQ ID NO: 643418 - RNA, 13 nt, Homo sapiens
uuuaaaugauaca

SEQ ID NO: 643419 - RNA, 13 nt, Homo sapiens
uuuaaaugauuua

SEQ ID NO: 643420 - RNA, 21 nt, Homo sapiens
uuuaaauggcuuuaugcuagu

SEQ ID NO: 643421 - RNA, 17 nt, Homo sapiens
uuuaaauguuacuggua

SEQ ID NO: 643422 - RNA, 19 nt, Homo sapiens
uuuaaauuacacacacucu

SEQ ID NO: 643423 - RNA, 19 nt, Homo sapiens
uuuaaauuccacagauuau

SEQ ID NO: 643424 - RNA, 15 nt, Homo sapiens
uuuaacaagcugucu

SEQ ID NO: 643425 - RNA, 16 nt, Homo sapiens
uuuaacacuucuguau

SEQ ID NO: 643426 - RNA, 22 nt, Homo sapiens
uuuaacacuuuguauuacuuag

SEQ ID NO: 643427 - RNA, 13 nt, Homo sapiens
uuuaacauauaua

SEQ ID NO: 643428 - RNA, 17 nt, Homo sapiens
uuuaacauucacagccc

SEQ ID NO: 643429 - RNA, 13 nt, Homo sapiens
uuuaaccaaaaca

SEQ ID NO: 643430 - RNA, 22 nt, Homo sapiens
uuuaaccagucugaaguuucau

SEQ ID NO: 643431 - RNA, 17 nt, Homo sapiens
uuuaaccccccuguaca

SEQ ID NO: 643432 - RNA, 16 nt, Homo sapiens
uuuaacccucucuucc

SEQ ID NO: 643433 - RNA, 21 nt, Homo sapiens
uuuaaccucuagagucacuga

SEQ ID NO: 643434 - RNA, 23 nt, Homo sapiens
uuuaaccuuccaagacugaagac

SEQ ID NO: 643435 - RNA, 20 nt, Homo sapiens
uuuaacggaugguugaauga

SEQ ID NO: 643436 - RNA, 20 nt, Homo sapiens
uuuaacucaguuucuaggca

SEQ ID NO: 643437 - RNA, 19 nt, Homo sapiens
uuuaacugccaauccuuaa

SEQ ID NO: 643438 - RNA, 16 nt, Homo sapiens
uuuaacuuguauggag

SEQ ID NO: 643439 - RNA, 20 nt, Homo sapiens
uuuaacuuuaaccacaguga

SEQ ID NO: 643440 - RNA, 14 nt, Homo sapiens
uuuaagaacuguau

SEQ ID NO: 643441 - RNA, 22 nt, Homo sapiens
uuuaagaagaaauacccacuaa

SEQ ID NO: 643442 - RNA, 20 nt, Homo sapiens
uuuaagacagggucucauuc

SEQ ID NO: 643443 - RNA, 19 nt, Homo sapiens
uuuaagauauauacaugga

SEQ ID NO: 643444 - RNA, 21 nt, Homo sapiens
uuuaagccaaagaaacaagcu

SEQ ID NO: 643445 - RNA, 11 nt, Homo sapiens
uuuaagccaua

SEQ ID NO: 643446 - RNA, 22 nt, Homo sapiens
uuuaaggagauugggagacaau

SEQ ID NO: 643447 - RNA, 19 nt, Homo sapiens
uuuaaggcaggacagagaa

SEQ ID NO: 643448 - RNA, 21 nt, Homo sapiens
uuuaagguacugaagcuuuau

SEQ ID NO: 643449 - RNA, 13 nt, Homo sapiens
uuuaagguacuua

SEQ ID NO: 643450 - RNA, 20 nt, Homo sapiens
uuuaaguaaaagucuaccug

SEQ ID NO: 643451 - RNA, 13 nt, Homo sapiens
uuuaaguacuuug

SEQ ID NO: 643452 - RNA, 13 nt, Homo sapiens
uuuaaguaggaau

SEQ ID NO: 643453 - RNA, 15 nt, Homo sapiens
uuuaaguaugugaag

SEQ ID NO: 643454 - RNA, 13 nt, Homo sapiens
uuuaagucaguga

SEQ ID NO: 643455 - RNA, 12 nt, Homo sapiens
uuuaagucucac

SEQ ID NO: 643456 - RNA, 21 nt, Homo sapiens
uuuaaguggcauuucuaugca

SEQ ID NO: 643457 - RNA, 20 nt, Homo sapiens
uuuaaguuacucagcucuau

SEQ ID NO: 643458 - RNA, 17 nt, Homo sapiens
uuuaaguugucaaagaa

SEQ ID NO: 643459 - RNA, 14 nt, Homo sapiens
uuuaaguuuugaca

SEQ ID NO: 643460 - RNA, 14 nt, Homo sapiens
uuuaauaacauacu

SEQ ID NO: 643461 - RNA, 14 nt, Homo sapiens
uuuaauacagugag

SEQ ID NO: 643462 - RNA, 12 nt, Homo sapiens
uuuaauagcaaa

SEQ ID NO: 643463 - RNA, 19 nt, Homo sapiens
uuuaauagcuauggaauca

SEQ ID NO: 643464 - RNA, 21 nt, Homo sapiens
uuuaauagggaauauaucucu

SEQ ID NO: 643465 - RNA, 12 nt, Homo sapiens
uuuaauauguca

SEQ ID NO: 643466 - RNA, 16 nt, Homo sapiens
uuuaaucaaguugaau

SEQ ID NO: 643467 - RNA, 15 nt, Homo sapiens
uuuaaucaguuugcu

SEQ ID NO: 643468 - RNA, 16 nt, Homo sapiens
uuuaauccuaccucaa

SEQ ID NO: 643469 - RNA, 19 nt, Homo sapiens
uuuaaugaacuaccaucug

SEQ ID NO: 643470 - RNA, 17 nt, Homo sapiens
uuuaaugagucagucaa

SEQ ID NO: 643471 - RNA, 12 nt, Homo sapiens
uuuaauuaucuu

SEQ ID NO: 643472 - RNA, 23 nt, Homo sapiens
uuuaauuaugaaaacuagcauua

SEQ ID NO: 643473 - RNA, 13 nt, Homo sapiens
uuuaauucugucu

SEQ ID NO: 643474 - RNA, 19 nt, Homo sapiens
uuuaauuucuucaugugau

SEQ ID NO: 643475 - RNA, 17 nt, Homo sapiens
uuuaauuuuaaugcugu

SEQ ID NO: 643476 - RNA, 18 nt, Homo sapiens
uuuaauuuugacacugaa

SEQ ID NO: 643477 - RNA, 17 nt, Homo sapiens
uuuacaaaguauuugcu

SEQ ID NO: 643478 - RNA, 15 nt, Homo sapiens
uuuacaaggugacaa

SEQ ID NO: 643479 - RNA, 15 nt, Homo sapiens
uuuacaaucugcacu

SEQ ID NO: 643480 - RNA, 17 nt, Homo sapiens
uuuacaauguucauccc

SEQ ID NO: 643481 - RNA, 21 nt, Homo sapiens
uuuacacaauuaauucauccc

SEQ ID NO: 643482 - RNA, 13 nt, Homo sapiens
uuuacacacauga

SEQ ID NO: 643483 - RNA, 18 nt, Homo sapiens
uuuacacacuguacacau

SEQ ID NO: 643484 - RNA, 18 nt, Homo sapiens
uuuacacgcuuuugugau

SEQ ID NO: 643485 - RNA, 20 nt, Homo sapiens
uuuacagaauggaaccaaaa

SEQ ID NO: 643486 - RNA, 19 nt, Homo sapiens
uuuacagauaucugaaugg

SEQ ID NO: 643487 - RNA, 22 nt, Homo sapiens
uuuacagauaucugaauggaag

SEQ ID NO: 643488 - RNA, 17 nt, Homo sapiens
uuuacagcaaguagaua

SEQ ID NO: 643489 - RNA, 15 nt, Homo sapiens
uuuacauacacugua

SEQ ID NO: 643490 - RNA, 14 nt, Homo sapiens
uuuacauacuuuau

SEQ ID NO: 643491 - RNA, 21 nt, Homo sapiens
uuuacauaucaccucauggcc

SEQ ID NO: 643492 - RNA, 13 nt, Homo sapiens
uuuacauaugcuu

SEQ ID NO: 643493 - RNA, 12 nt, Homo sapiens
uuuacauucaau

SEQ ID NO: 643494 - RNA, 14 nt, Homo sapiens
uuuacauucaucaa

SEQ ID NO: 643495 - RNA, 11 nt, Homo sapiens
uuuacauuucu

SEQ ID NO: 643496 - RNA, 21 nt, Homo sapiens
uuuaccaaaaccauccauccc

SEQ ID NO: 643497 - RNA, 14 nt, Homo sapiens
uuuaccacagcagc

SEQ ID NO: 643498 - RNA, 19 nt, Homo sapiens
uuuaccaguuaauuacuca

SEQ ID NO: 643499 - RNA, 13 nt, Homo sapiens
uuguacucaaagc

SEQ ID NO: 643500 - RNA, 11 nt, Homo sapiens
uuguacugaua

SEQ ID NO: 643501 - RNA, 17 nt, Homo sapiens
uuguacuucuguguuca

SEQ ID NO: 643502 - RNA, 19 nt, Homo sapiens
uuguagaguggugcugcuu

SEQ ID NO: 643503 - RNA, 16 nt, Homo sapiens
uuguagaguuguacug

SEQ ID NO: 643504 - RNA, 16 nt, Homo sapiens
uuguagcacugagggu

SEQ ID NO: 643505 - RNA, 18 nt, Homo sapiens
uuguagccagguacugca

SEQ ID NO: 643506 - RNA, 16 nt, Homo sapiens
uuguaggcuguggggu

SEQ ID NO: 643507 - RNA, 18 nt, Homo sapiens
uuguaguauaauucuugg

SEQ ID NO: 643508 - RNA, 21 nt, Homo sapiens
uuguauaaaugcaauaagaaa

SEQ ID NO: 643509 - RNA, 21 nt, Homo sapiens
uuguauaagaagauacacugc

SEQ ID NO: 643510 - RNA, 23 nt, Homo sapiens
uuguauaagaagauacacugcag

SEQ ID NO: 643511 - RNA, 14 nt, Homo sapiens
uuguauaugcauuc

SEQ ID NO: 643512 - RNA, 19 nt, Homo sapiens
uuguauauugucagauauu

SEQ ID NO: 643513 - RNA, 20 nt, Homo sapiens
uuguaucaaaugugacauua

SEQ ID NO: 643514 - RNA, 15 nt, Homo sapiens
uuguaucaacacugu

SEQ ID NO: 643515 - RNA, 22 nt, Homo sapiens
uuguauccguucaauaagcauu

SEQ ID NO: 643516 - RNA, 15 nt, Homo sapiens
uuguaucuugccuaa

SEQ ID NO: 643517 - RNA, 15 nt, Homo sapiens
uuguaugagguccuc

SEQ ID NO: 643518 - RNA, 23 nt, Homo sapiens
uuguauguuuaguagaaacgggg

SEQ ID NO: 643519 - RNA, 15 nt, Homo sapiens
uuguauuaccauuac

SEQ ID NO: 643520 - RNA, 23 nt, Homo sapiens
uuguauugaaaacacuuaguaug

SEQ ID NO: 643521 - RNA, 14 nt, Homo sapiens
uugucaaaaaguuc

SEQ ID NO: 643522 - RNA, 22 nt, Homo sapiens
uugucaauaaaccugucaugug

SEQ ID NO: 643523 - RNA, 13 nt, Homo sapiens
uugucaccaugau

SEQ ID NO: 643524 - RNA, 19 nt, Homo sapiens
uugucacgucuucugagaa

SEQ ID NO: 643525 - RNA, 19 nt, Homo sapiens
uugucacuuuuuaugcuau

SEQ ID NO: 643526 - RNA, 12 nt, Homo sapiens
uugucaguucuu

SEQ ID NO: 643527 - RNA, 13 nt, Homo sapiens
uugucauacaaau

SEQ ID NO: 643528 - RNA, 13 nt, Homo sapiens
uugucauaccuuu

SEQ ID NO: 643529 - RNA, 11 nt, Homo sapiens
uugucaugaau

SEQ ID NO: 643530 - RNA, 18 nt, Homo sapiens
uugucauucaagccugug

SEQ ID NO: 643531 - RNA, 11 nt, Homo sapiens
uugucauugcc

SEQ ID NO: 643532 - RNA, 13 nt, Homo sapiens
uugucauuuauaa

SEQ ID NO: 643533 - RNA, 13 nt, Homo sapiens
uugucccaaugaa

SEQ ID NO: 643534 - RNA, 20 nt, Homo sapiens
uugucccagccuggggcucc

SEQ ID NO: 643535 - RNA, 15 nt, Homo sapiens
uugucccaucugccc

SEQ ID NO: 643536 - RNA, 19 nt, Homo sapiens
uugucccguggcauuucaa

SEQ ID NO: 643537 - RNA, 18 nt, Homo sapiens
uugucccuaugcauauca

SEQ ID NO: 643538 - RNA, 18 nt, Homo sapiens
uuguccugagauggaaaa

SEQ ID NO: 643539 - RNA, 17 nt, Homo sapiens
uuguccugccagcugcc

SEQ ID NO: 643540 - RNA, 16 nt, Homo sapiens
uuguccugugcuugcu

SEQ ID NO: 643541 - RNA, 16 nt, Homo sapiens
uugucgguuaccucug

SEQ ID NO: 643542 - RNA, 16 nt, Homo sapiens
uugucuccugaaguuu

SEQ ID NO: 643543 - RNA, 16 nt, Homo sapiens
uugucucugucucuca

SEQ ID NO: 643544 - RNA, 17 nt, Homo sapiens
uugucugaacaaagugc

SEQ ID NO: 643545 - RNA, 11 nt, Homo sapiens
uugucugagac

SEQ ID NO: 643546 - RNA, 18 nt, Homo sapiens
uugucuguacauacuggc

SEQ ID NO: 643547 - RNA, 20 nt, Homo sapiens
uugucuguuaucgaacacau

SEQ ID NO: 643548 - RNA, 13 nt, Homo sapiens
uugucuguuuauu

SEQ ID NO: 643549 - RNA, 21 nt, Homo sapiens
uugucuguuuguuucaagaac

SEQ ID NO: 643550 - RNA, 19 nt, Homo sapiens
uugucuuaaucguccugcu

SEQ ID NO: 643551 - RNA, 17 nt, Homo sapiens
uugucuuacuguugcau

SEQ ID NO: 643552 - RNA, 17 nt, Homo sapiens
uugucuucaaacuguga

SEQ ID NO: 643553 - RNA, 16 nt, Homo sapiens
uugugaacuccaucau

SEQ ID NO: 643554 - RNA, 21 nt, Homo sapiens
uugugaacuuuuuguagggga

SEQ ID NO: 643555 - RNA, 13 nt, Homo sapiens
uugugaauuguga

SEQ ID NO: 643556 - RNA, 17 nt, Homo sapiens
uugugacuucacuguau

SEQ ID NO: 643557 - RNA, 15 nt, Homo sapiens
uugugagagcccagu

SEQ ID NO: 643558 - RNA, 15 nt, Homo sapiens
uugugagccaccacg

SEQ ID NO: 643559 - RNA, 16 nt, Homo sapiens
uugugagccuaugaua

SEQ ID NO: 643560 - RNA, 18 nt, Homo sapiens
uugugaguggauaaucag

SEQ ID NO: 643561 - RNA, 20 nt, Homo sapiens
uugugauacaaugcugugcc

SEQ ID NO: 643562 - RNA, 20 nt, Homo sapiens
uugugauauauuagggacac

SEQ ID NO: 643563 - RNA, 13 nt, Homo sapiens
uugugaugaacau

SEQ ID NO: 643564 - RNA, 17 nt, Homo sapiens
uugugauuacguguaug

SEQ ID NO: 643565 - RNA, 19 nt, Homo sapiens
uugugauuagacagaacac

SEQ ID NO: 643566 - RNA, 22 nt, Homo sapiens
uugugauuuauuucacuuuuaa

SEQ ID NO: 643567 - RNA, 23 nt, Homo sapiens
uugugauuuuuuuaauagugcuu

SEQ ID NO: 643568 - RNA, 10 nt, Homo sapiens
uugugcaaac

SEQ ID NO: 643569 - RNA, 21 nt, Homo sapiens
uugugcauuaucuagauacug

SEQ ID NO: 643570 - RNA, 20 nt, Homo sapiens
uugugccacuacacuccagc

SEQ ID NO: 643571 - RNA, 20 nt, Homo sapiens
uugugcugugggcagcaccc

SEQ ID NO: 643572 - RNA, 16 nt, Homo sapiens
uuguggaaacugucau

SEQ ID NO: 643573 - RNA, 21 nt, Homo sapiens
uuguggagcgccagcucugcc

SEQ ID NO: 643574 - RNA, 16 nt, Homo sapiens
uuguggaugucuuccu

SEQ ID NO: 643575 - RNA, 21 nt, Homo sapiens
uugugggacacaacacagaua

SEQ ID NO: 643576 - RNA, 13 nt, Homo sapiens
uuguguacuguaa

SEQ ID NO: 643577 - RNA, 17 nt, Homo sapiens
uuguguagaaagccaaa

SEQ ID NO: 643578 - RNA, 17 nt, Homo sapiens
uugugucuggcaguuua

SEQ ID NO: 643579 - RNA, 18 nt, Homo sapiens
uugugugaccaacugugu

SEQ ID NO: 643580 - RNA, 15 nt, Homo sapiens
uugugugaguguacc

SEQ ID NO: 643581 - RNA, 13 nt, Homo sapiens
uugugugaugcgc

SEQ ID NO: 643582 - RNA, 12 nt, Homo sapiens
uuguguggcucc

SEQ ID NO: 643583 - RNA, 22 nt, Homo sapiens
uuguguguguguguugauccca

SEQ ID NO: 643584 - RNA, 14 nt, Homo sapiens
uuguguuaccugua

SEQ ID NO: 643585 - RNA, 17 nt, Homo sapiens
uuguguuaccuguagau

SEQ ID NO: 643586 - RNA, 22 nt, Homo sapiens
uuguuaaaacauuggcauuuga

SEQ ID NO: 643587 - RNA, 18 nt, Homo sapiens
uuguuacauuauguggaa

SEQ ID NO: 643588 - RNA, 12 nt, Homo sapiens
uuguuacuguga

SEQ ID NO: 643589 - RNA, 21 nt, Homo sapiens
uuguuaguaugaggcauuugu

SEQ ID NO: 643590 - RNA, 18 nt, Homo sapiens
uuguuaucagauauguga

SEQ ID NO: 643591 - RNA, 13 nt, Homo sapiens
uuguuaugccaug

SEQ ID NO: 643592 - RNA, 13 nt, Homo sapiens
uuguuauguacaa

SEQ ID NO: 643593 - RNA, 17 nt, Homo sapiens
uuguuauuugaaaacau

SEQ ID NO: 643594 - RNA, 21 nt, Homo sapiens
uuguucaaaaugcagauuccu

SEQ ID NO: 643595 - RNA, 19 nt, Homo sapiens
uuguucaauaauuacugua

SEQ ID NO: 643596 - RNA, 20 nt, Homo sapiens
uuguucaauguuccauucuu

SEQ ID NO: 643597 - RNA, 13 nt, Homo sapiens
uuguucagaauua

SEQ ID NO: 643598 - RNA, 18 nt, Homo sapiens
uuguucagggcugugauc

SEQ ID NO: 643599 - RNA, 16 nt, Homo sapiens
uuguucaguaugcaaa

SEQ ID NO: 643600 - RNA, 23 nt, Homo sapiens
uuguucaucagacuccugugcaa

SEQ ID NO: 643601 - RNA, 14 nt, Homo sapiens
uuguuccacugcaa

SEQ ID NO: 643602 - RNA, 16 nt, Homo sapiens
uuguuccccacugaca

SEQ ID NO: 643603 - RNA, 18 nt, Homo sapiens
uuguuccuuaagucagaa

SEQ ID NO: 643604 - RNA, 17 nt, Homo sapiens
uuguucgggugugcaau

SEQ ID NO: 643605 - RNA, 14 nt, Homo sapiens
uuguucuacugaga

SEQ ID NO: 643606 - RNA, 15 nt, Homo sapiens
uuguucuuacaguua

SEQ ID NO: 643607 - RNA, 20 nt, Homo sapiens
uuguucuuuggaaauacaca

SEQ ID NO: 643608 - RNA, 22 nt, Homo sapiens
uucuccuugccuugcuucuccc

SEQ ID NO: 643609 - RNA, 23 nt, Homo sapiens
uucuccuuuuauucucuguauug

SEQ ID NO: 643610 - RNA, 17 nt, Homo sapiens
uucauagggauggcagu

SEQ ID NO: 643611 - RNA, 17 nt, Homo sapiens
uuccuuaagagcuauuu

SEQ ID NO: 643612 - RNA, 22 nt, Homo sapiens
uuacgaaaaaaugguagcauuu

SEQ ID NO: 643613 - RNA, 16 nt, Homo sapiens
uuacgaucuguuucca

SEQ ID NO: 643614 - RNA, 13 nt, Homo sapiens
uuacguacuguaa

SEQ ID NO: 643615 - RNA, 21 nt, Homo sapiens
uuacgugcauuuaaacucugc

SEQ ID NO: 643616 - RNA, 13 nt, Homo sapiens
uuacuaacacugg

SEQ ID NO: 643617 - RNA, 16 nt, Homo sapiens
uuacuaacuaaacucu

SEQ ID NO: 643618 - RNA, 16 nt, Homo sapiens
uuauguuuucaacuca

SEQ ID NO: 643619 - RNA, 18 nt, Homo sapiens
uuauguuuucuuucucac

SEQ ID NO: 643620 - RNA, 22 nt, Homo sapiens
uuauuaaauguagcuucaguca

SEQ ID NO: 643621 - RNA, 13 nt, Homo sapiens
uuauuaacuaaga

SEQ ID NO: 643622 - RNA, 20 nt, Homo sapiens
uuauuaagagguaagacuua

SEQ ID NO: 643623 - RNA, 13 nt, Homo sapiens
uuauuaaguaaaa

SEQ ID NO: 643624 - RNA, 18 nt, Homo sapiens
uuauuaauauuauuauga

SEQ ID NO: 643625 - RNA, 14 nt, Homo sapiens
uuauuaaugacaaa

SEQ ID NO: 643626 - RNA, 14 nt, Homo sapiens
uuauuaauuucagu

SEQ ID NO: 643627 - RNA, 17 nt, Homo sapiens
uuauuacauggggucua

SEQ ID NO: 643628 - RNA, 13 nt, Homo sapiens
uuauuacauguaa

SEQ ID NO: 643629 - RNA, 19 nt, Homo sapiens
uuauuacauugcugccuuu

SEQ ID NO: 643630 - RNA, 12 nt, Homo sapiens
uuauuaccucuc

SEQ ID NO: 643631 - RNA, 21 nt, Homo sapiens
uuauuaccucugauaccucaa

SEQ ID NO: 643632 - RNA, 14 nt, Homo sapiens
uuauuacugaacua

SEQ ID NO: 643633 - RNA, 22 nt, Homo sapiens
uuauuacuguuuauuacuucca

SEQ ID NO: 643634 - RNA, 19 nt, Homo sapiens
uuauuagagugucuuucca

SEQ ID NO: 643635 - RNA, 14 nt, Homo sapiens
uuauuauacaccuu

SEQ ID NO: 643636 - RNA, 15 nt, Homo sapiens
uuauuauaugacuag

SEQ ID NO: 643637 - RNA, 13 nt, Homo sapiens
uuauuaucuauua

SEQ ID NO: 643638 - RNA, 18 nt, Homo sapiens
uuauuaugagcuacaaca

SEQ ID NO: 643639 - RNA, 21 nt, Homo sapiens
uuauucacaaccucaccaaac

SEQ ID NO: 643640 - RNA, 13 nt, Homo sapiens
uuauucacuguaa

SEQ ID NO: 643641 - RNA, 22 nt, Homo sapiens
uuauucagaaaagaugugcaga

SEQ ID NO: 643642 - RNA, 22 nt, Homo sapiens
uuauucauuuggugacugugua

SEQ ID NO: 643643 - RNA, 15 nt, Homo sapiens
uuauuccaaaguuau

SEQ ID NO: 643644 - RNA, 18 nt, Homo sapiens
uuauuccagagaagccag

SEQ ID NO: 643645 - RNA, 17 nt, Homo sapiens
uuauuccuccugcucau

SEQ ID NO: 643646 - RNA, 12 nt, Homo sapiens
uuauucuaaggu

SEQ ID NO: 643647 - RNA, 23 nt, Homo sapiens
uuauucuaauaaauauacuauga

SEQ ID NO: 643648 - RNA, 15 nt, Homo sapiens
uuauucuacaucauu

SEQ ID NO: 643649 - RNA, 16 nt, Homo sapiens
uuauucugauuccacu

SEQ ID NO: 643650 - RNA, 17 nt, Homo sapiens
uuauucugucuggcauu

SEQ ID NO: 643651 - RNA, 21 nt, Homo sapiens
uuauucuguuuugcacaguua

SEQ ID NO: 643652 - RNA, 22 nt, Homo sapiens
uuauugaaagagucugggaccc

SEQ ID NO: 643653 - RNA, 13 nt, Homo sapiens
uuauugacacuga

SEQ ID NO: 643654 - RNA, 22 nt, Homo sapiens
uuauugacaucucuuuugagcu

SEQ ID NO: 643655 - RNA, 20 nt, Homo sapiens
uuauugaccaauuccugaca

SEQ ID NO: 643656 - RNA, 20 nt, Homo sapiens
uuauugacugggcaacacug

SEQ ID NO: 643657 - RNA, 23 nt, Homo sapiens
uuauugccuggagugugaacugu

SEQ ID NO: 643658 - RNA, 19 nt, Homo sapiens
uuauuggcugagauaugaa

SEQ ID NO: 643659 - RNA, 18 nt, Homo sapiens
uuauugguguuuacccag

SEQ ID NO: 643660 - RNA, 14 nt, Homo sapiens
uuauuguaccucuc

SEQ ID NO: 643661 - RNA, 13 nt, Homo sapiens
uuauugugauuac

SEQ ID NO: 643662 - RNA, 12 nt, Homo sapiens
uuauuguuccaa

SEQ ID NO: 643663 - RNA, 19 nt, Homo sapiens
uuauuguuguugccaaaga

SEQ ID NO: 643664 - RNA, 12 nt, Homo sapiens
uuauuuacauuu

SEQ ID NO: 643665 - RNA, 20 nt, Homo sapiens
uuauuuacugacauauaucu

SEQ ID NO: 643666 - RNA, 23 nt, Homo sapiens
uuauuuagauccccccuuuccuu

SEQ ID NO: 643667 - RNA, 15 nt, Homo sapiens
uuauuuagcucugaa

SEQ ID NO: 643668 - RNA, 14 nt, Homo sapiens
uuauuuauguaugu

SEQ ID NO: 643669 - RNA, 14 nt, Homo sapiens
uuauuucacuaaau

SEQ ID NO: 643670 - RNA, 21 nt, Homo sapiens
uuauuucaggaaggucuucaa

SEQ ID NO: 643671 - RNA, 19 nt, Homo sapiens
uuauuucucauugccucuu

SEQ ID NO: 643672 - RNA, 19 nt, Homo sapiens
uuauuucugaucuauacaa

SEQ ID NO: 643673 - RNA, 20 nt, Homo sapiens
uuauuucugaucuauacaaa

SEQ ID NO: 643674 - RNA, 17 nt, Homo sapiens
uuauuugaaaacauaua

SEQ ID NO: 643675 - RNA, 17 nt, Homo sapiens
uuauuugucaagcaaau

SEQ ID NO: 643676 - RNA, 22 nt, Homo sapiens
uuauuuguguuuaaaugcugcu

SEQ ID NO: 643677 - RNA, 13 nt, Homo sapiens
uuauuuugacaaa

SEQ ID NO: 643678 - RNA, 16 nt, Homo sapiens
uuauuuugguugcagu

SEQ ID NO: 643679 - RNA, 19 nt, Homo sapiens
uuauuuuuguuagcaaaga

SEQ ID NO: 643680 - RNA, 21 nt, Homo sapiens
uuauuuuuucgugcacucugc

SEQ ID NO: 643681 - RNA, 14 nt, Homo sapiens
uucaaaacauugug

SEQ ID NO: 643682 - RNA, 22 nt, Homo sapiens
uucaaaacauugugccauguca

SEQ ID NO: 643683 - RNA, 18 nt, Homo sapiens
uucaaaagguuauauacc

SEQ ID NO: 643684 - RNA, 18 nt, Homo sapiens
uucaaaauauacauucaa

SEQ ID NO: 643685 - RNA, 19 nt, Homo sapiens
uucaaaauguucuauuuaa

SEQ ID NO: 643686 - RNA, 12 nt, Homo sapiens
uucaaacagaac

SEQ ID NO: 643687 - RNA, 12 nt, Homo sapiens
uucaaacauaua

SEQ ID NO: 643688 - RNA, 15 nt, Homo sapiens
uucaaaccagcuuca

SEQ ID NO: 643689 - RNA, 19 nt, Homo sapiens
uucaaacugcaugauucau

SEQ ID NO: 643690 - RNA, 13 nt, Homo sapiens
uucaaacugugaa

SEQ ID NO: 643691 - RNA, 16 nt, Homo sapiens
uucaaagaaguacuuu

SEQ ID NO: 643692 - RNA, 19 nt, Homo sapiens
uucaaagcaauugaaaugc

SEQ ID NO: 643693 - RNA, 13 nt, Homo sapiens
uucaaaguuaaaa

SEQ ID NO: 643694 - RNA, 18 nt, Homo sapiens
uucaaaguuaaaagcaaa

SEQ ID NO: 643695 - RNA, 12 nt, Homo sapiens
uucaaaguuuag

SEQ ID NO: 643696 - RNA, 14 nt, Homo sapiens
uucaaauaauccau

SEQ ID NO: 643697 - RNA, 21 nt, Homo sapiens
uucaaauaauccauuccaaaa

SEQ ID NO: 643698 - RNA, 17 nt, Homo sapiens
uucaaaucaaaccucag

SEQ ID NO: 643699 - RNA, 22 nt, Homo sapiens
uucaaaucacauggaacuuuag

SEQ ID NO: 643700 - RNA, 15 nt, Homo sapiens
uucaaaucagugauc

SEQ ID NO: 643701 - RNA, 14 nt, Homo sapiens
uucaaaucucagca

SEQ ID NO: 643702 - RNA, 23 nt, Homo sapiens
uucaaaugggagacucuuugaaa

SEQ ID NO: 643703 - RNA, 15 nt, Homo sapiens
uucaaauuuguacag

SEQ ID NO: 643704 - RNA, 20 nt, Homo sapiens
uucaaauuugugcagugucu

SEQ ID NO: 643705 - RNA, 17 nt, Homo sapiens
uucaaauuuuaucucca

SEQ ID NO: 643706 - RNA, 15 nt, Homo sapiens
uucaacagagacuga

SEQ ID NO: 643707 - RNA, 15 nt, Homo sapiens
uucaaccucauugac

SEQ ID NO: 643708 - RNA, 22 nt, Homo sapiens
uucaacucagaaugcacuugau

SEQ ID NO: 643709 - RNA, 13 nt, Homo sapiens
uucaacucugauc

SEQ ID NO: 643710 - RNA, 19 nt, Homo sapiens
uucaagaccagccugggca

SEQ ID NO: 643711 - RNA, 21 nt, Homo sapiens
uucaagaccauccuggacuga

SEQ ID NO: 643712 - RNA, 19 nt, Homo sapiens
uucaagagucuaaacccca

SEQ ID NO: 643713 - RNA, 22 nt, Homo sapiens
uucaagaucucauccaagcaaa

SEQ ID NO: 643714 - RNA, 15 nt, Homo sapiens
uucaagccauuccaa

SEQ ID NO: 643715 - RNA, 15 nt, Homo sapiens
uucaagccucuaaac

SEQ ID NO: 643716 - RNA, 16 nt, Homo sapiens
uucaagccuuagauaa

SEQ ID NO: 643717 - RNA, 22 nt, Homo sapiens
uucaagcugagaaaaguauucu

SEQ ID NO: 643718 - RNA, 14 nt, Homo sapiens
uucaaggaaaguga

SEQ ID NO: 643719 - RNA, 22 nt, Homo sapiens
uucaaggacuguuucaguguga

SEQ ID NO: 643720 - RNA, 17 nt, Homo sapiens
uucaaggcccucagcau

SEQ ID NO: 643721 - RNA, 16 nt, Homo sapiens
uucaaguaauugugaa

SEQ ID NO: 643722 - RNA, 16 nt, Homo sapiens
uucaagugcacugagc

SEQ ID NO: 643723 - RNA, 12 nt, Homo sapiens
uucaagugcuaa

SEQ ID NO: 643724 - RNA, 15 nt, Homo sapiens
uucaagugguucucc

SEQ ID NO: 643725 - RNA, 12 nt, Homo sapiens
uucaaguguaaa

SEQ ID NO: 643726 - RNA, 13 nt, Homo sapiens
uucaaguguacag

SEQ ID NO: 643727 - RNA, 23 nt, Homo sapiens
uucaaguguccuggaaauucugc

SEQ ID NO: 643728 - RNA, 18 nt, Homo sapiens
uucaaguuagcucaggag

SEQ ID NO: 643729 - RNA, 23 nt, Homo sapiens
uucaauaaaagaauaguugccaa

SEQ ID NO: 643730 - RNA, 20 nt, Homo sapiens
uucaauaaagcacugagcaa

SEQ ID NO: 643731 - RNA, 14 nt, Homo sapiens
uucaauauuaugaa

SEQ ID NO: 643732 - RNA, 14 nt, Homo sapiens
uucaauauugacau

SEQ ID NO: 643733 - RNA, 20 nt, Homo sapiens
uucaauauuuguuacuguua

SEQ ID NO: 643734 - RNA, 12 nt, Homo sapiens
uucaaucucuug

SEQ ID NO: 643735 - RNA, 10 nt, Homo sapiens
uucaaugagg

SEQ ID NO: 643736 - RNA, 16 nt, Homo sapiens
uucaaugcaaaguaca

SEQ ID NO: 643737 - RNA, 21 nt, Homo sapiens
uucaaugguuuaacauauaau

SEQ ID NO: 643738 - RNA, 17 nt, Homo sapiens
ugugaacguguauguac

SEQ ID NO: 643739 - RNA, 17 nt, Homo sapiens
ugugaacucaccaaaca

SEQ ID NO: 643740 - RNA, 17 nt, Homo sapiens
ugugaacuccaucauuc

SEQ ID NO: 643741 - RNA, 21 nt, Homo sapiens
ugugaagaaaaagaccugcau

SEQ ID NO: 643742 - RNA, 17 nt, Homo sapiens
ugugaagaccacagucu

SEQ ID NO: 643743 - RNA, 17 nt, Homo sapiens
ugugaagacccaggaga

SEQ ID NO: 643744 - RNA, 15 nt, Homo sapiens
ugugaagcuaauaca

SEQ ID NO: 643745 - RNA, 19 nt, Homo sapiens
ugugaagcuaaugaacucu

SEQ ID NO: 643746 - RNA, 17 nt, Homo sapiens
ugugaagcucacacuga

SEQ ID NO: 643747 - RNA, 15 nt, Homo sapiens
ugugaaguagguaua

SEQ ID NO: 643748 - RNA, 17 nt, Homo sapiens
ugugaagugcagaugag

SEQ ID NO: 643749 - RNA, 18 nt, Homo sapiens
ugugaaguuugcuuugua

SEQ ID NO: 643750 - RNA, 20 nt, Homo sapiens
ugugaauuauucugauucuu

SEQ ID NO: 643751 - RNA, 18 nt, Homo sapiens
ugugacauuuuacauuaa

SEQ ID NO: 643752 - RNA, 21 nt, Homo sapiens
ugugaccaaaaguuacauguu

SEQ ID NO: 643753 - RNA, 19 nt, Homo sapiens
ugugaccaacuguguugua

SEQ ID NO: 643754 - RNA, 19 nt, Homo sapiens
ugugaccacauacguguua

SEQ ID NO: 643755 - RNA, 21 nt, Homo sapiens
ugugaccccuccccagugccu

SEQ ID NO: 643756 - RNA, 20 nt, Homo sapiens
ugugaccccuccuuucuucc

SEQ ID NO: 643757 - RNA, 13 nt, Homo sapiens
ugugaccuugacu

SEQ ID NO: 643758 - RNA, 22 nt, Homo sapiens
ugugacgcagacagaggggaug

SEQ ID NO: 643759 - RNA, 17 nt, Homo sapiens
ugugacuuacaauuugc

SEQ ID NO: 643760 - RNA, 14 nt, Homo sapiens
ugugacuucacugu

SEQ ID NO: 643761 - RNA, 15 nt, Homo sapiens
ugugacuugcaauaa

SEQ ID NO: 643762 - RNA, 13 nt, Homo sapiens
ugugacuuuccua

SEQ ID NO: 643763 - RNA, 19 nt, Homo sapiens
ugugacuuuuucagaguug

SEQ ID NO: 643764 - RNA, 18 nt, Homo sapiens
ugugagaauaaacuagac

SEQ ID NO: 643765 - RNA, 15 nt, Homo sapiens
ugugagagaaagugu

SEQ ID NO: 643766 - RNA, 22 nt, Homo sapiens
ugugagagagacugaugggguc

SEQ ID NO: 643767 - RNA, 15 nt, Homo sapiens
ugugagagcccaguc

SEQ ID NO: 643768 - RNA, 16 nt, Homo sapiens
ugugagauccuucaca

SEQ ID NO: 643769 - RNA, 21 nt, Homo sapiens
ugugagcauccugcaagguga

SEQ ID NO: 643770 - RNA, 15 nt, Homo sapiens
ugugagguaacuggg

SEQ ID NO: 643771 - RNA, 19 nt, Homo sapiens
ugugagguucgcuuaucaa

SEQ ID NO: 643772 - RNA, 15 nt, Homo sapiens
ugugaguccuguuga

SEQ ID NO: 643773 - RNA, 18 nt, Homo sapiens
ugugagugugugcaagua

SEQ ID NO: 643774 - RNA, 19 nt, Homo sapiens
ugugagugugugcaaguau

SEQ ID NO: 643775 - RNA, 20 nt, Homo sapiens
ugugaguuuugccuuucuaa

SEQ ID NO: 643776 - RNA, 12 nt, Homo sapiens
ugugauaccuua

SEQ ID NO: 643777 - RNA, 16 nt, Homo sapiens
ugugauauacaaagug

SEQ ID NO: 643778 - RNA, 19 nt, Homo sapiens
ugugauauuuuuacuugca

SEQ ID NO: 643779 - RNA, 15 nt, Homo sapiens
ugugaucacuguaaa

SEQ ID NO: 643780 - RNA, 18 nt, Homo sapiens
ugugaugaugcugugaca

SEQ ID NO: 643781 - RNA, 13 nt, Homo sapiens
ugugaugucagaa

SEQ ID NO: 643782 - RNA, 17 nt, Homo sapiens
ugugcaaccauguuugg

SEQ ID NO: 643783 - RNA, 16 nt, Homo sapiens
ugugcaauauucuuaa

SEQ ID NO: 643784 - RNA, 18 nt, Homo sapiens
ugugcacacacaccacac

SEQ ID NO: 643785 - RNA, 22 nt, Homo sapiens
ugugcacacccaugcacacuca

SEQ ID NO: 643786 - RNA, 11 nt, Homo sapiens
ugugcacauuu

SEQ ID NO: 643787 - RNA, 23 nt, Homo sapiens
ugugcacuuaguaguuuuuacaa

SEQ ID NO: 643788 - RNA, 23 nt, Homo sapiens
ugugcacuugcacgcccaugugu

SEQ ID NO: 643789 - RNA, 15 nt, Homo sapiens
ugugcagaaccuccu

SEQ ID NO: 643790 - RNA, 13 nt, Homo sapiens
ugugcagauauca

SEQ ID NO: 643791 - RNA, 18 nt, Homo sapiens
ugugcagaugcugcugaa

SEQ ID NO: 643792 - RNA, 15 nt, Homo sapiens
ugugcagcuucgagg

SEQ ID NO: 643793 - RNA, 18 nt, Homo sapiens
ugugcaggagccucccug

SEQ ID NO: 643794 - RNA, 22 nt, Homo sapiens
ugugcaggguguguacugcaca

SEQ ID NO: 643795 - RNA, 22 nt, Homo sapiens
ugugcauacuuucccucaucca

SEQ ID NO: 643796 - RNA, 15 nt, Homo sapiens
ugugcauaucugccu

SEQ ID NO: 643797 - RNA, 12 nt, Homo sapiens
ugugcaugaccu

SEQ ID NO: 643798 - RNA, 15 nt, Homo sapiens
ugugcaugugagcac

SEQ ID NO: 643799 - RNA, 20 nt, Homo sapiens
ugugccaccgccuucccuga

SEQ ID NO: 643800 - RNA, 23 nt, Homo sapiens
ugugccaggaggcggcagcucuu

SEQ ID NO: 643801 - RNA, 19 nt, Homo sapiens
ugugccaguucuuuccaua

SEQ ID NO: 643802 - RNA, 12 nt, Homo sapiens
ugugccaugccc

SEQ ID NO: 643803 - RNA, 15 nt, Homo sapiens
ugugcccagcaggcc

SEQ ID NO: 643804 - RNA, 17 nt, Homo sapiens
ugugcccccagccucag

SEQ ID NO: 643805 - RNA, 14 nt, Homo sapiens
ugugccgcacucug

SEQ ID NO: 643806 - RNA, 20 nt, Homo sapiens
ugugccggcuuucaaguuug

SEQ ID NO: 643807 - RNA, 15 nt, Homo sapiens
ugugccuacauuuaa

SEQ ID NO: 643808 - RNA, 12 nt, Homo sapiens
ugugccuauagu

SEQ ID NO: 643809 - RNA, 16 nt, Homo sapiens
ugugccugcacugaga

SEQ ID NO: 643810 - RNA, 18 nt, Homo sapiens
ugugccuuugaccaucuc

SEQ ID NO: 643811 - RNA, 22 nt, Homo sapiens
ugugcgcugacaaccaccgcuc

SEQ ID NO: 643812 - RNA, 17 nt, Homo sapiens
ugugcgugaaacacacc

SEQ ID NO: 643813 - RNA, 17 nt, Homo sapiens
ugugcgugcaugugcac

SEQ ID NO: 643814 - RNA, 15 nt, Homo sapiens
ugugcgugugugcaa

SEQ ID NO: 643815 - RNA, 16 nt, Homo sapiens
ugugcgugugugcaag

SEQ ID NO: 643816 - RNA, 17 nt, Homo sapiens
ugugcuaagcuuuacag

SEQ ID NO: 643817 - RNA, 18 nt, Homo sapiens
ugugcucagagaccccuc

SEQ ID NO: 643818 - RNA, 15 nt, Homo sapiens
ugugcucauuuugca

SEQ ID NO: 643819 - RNA, 16 nt, Homo sapiens
ugugcuccgugccucc

SEQ ID NO: 643820 - RNA, 18 nt, Homo sapiens
ugugcuccgugccuccac

SEQ ID NO: 643821 - RNA, 22 nt, Homo sapiens
ugugcuccuccuacccuuccag

SEQ ID NO: 643822 - RNA, 20 nt, Homo sapiens
ugugcugcucaaggccacag

SEQ ID NO: 643823 - RNA, 13 nt, Homo sapiens
ugugcugcugucu

SEQ ID NO: 643824 - RNA, 18 nt, Homo sapiens
ugugcugggugagcucuu

SEQ ID NO: 643825 - RNA, 22 nt, Homo sapiens
ugugcuggucauggaauggcag

SEQ ID NO: 643826 - RNA, 14 nt, Homo sapiens
ugugcugguguccu

SEQ ID NO: 643827 - RNA, 14 nt, Homo sapiens
ugugcuucagugcc

SEQ ID NO: 643828 - RNA, 14 nt, Homo sapiens
ugugcuucugcuca

SEQ ID NO: 643829 - RNA, 13 nt, Homo sapiens
uguggaagcacuu

SEQ ID NO: 643830 - RNA, 20 nt, Homo sapiens
uguggaauugacucaaaaau

SEQ ID NO: 643831 - RNA, 23 nt, Homo sapiens
uguggaauuuuccacuucuggca

SEQ ID NO: 643832 - RNA, 23 nt, Homo sapiens
uguggacacagaucccacuggaa

SEQ ID NO: 643833 - RNA, 12 nt, Homo sapiens
uguggacacugc

SEQ ID NO: 643834 - RNA, 12 nt, Homo sapiens
uguggaccugga

SEQ ID NO: 643835 - RNA, 18 nt, Homo sapiens
uguggagacacugaguca

SEQ ID NO: 643836 - RNA, 20 nt, Homo sapiens
uguggagaugagucagugcc

SEQ ID NO: 643837 - RNA, 16 nt, Homo sapiens
uguggaggauugcuau

SEQ ID NO: 643838 - RNA, 19 nt, Homo sapiens
uguggagggagggcagcug

SEQ ID NO: 643839 - RNA, 18 nt, Homo sapiens
uguggaguggguaaucca

SEQ ID NO: 643840 - RNA, 17 nt, Homo sapiens
uguggaugauaaaacac

SEQ ID NO: 643841 - RNA, 19 nt, Homo sapiens
uguggaugcugagcuguga

SEQ ID NO: 643842 - RNA, 17 nt, Homo sapiens
uguggauggucauugca

SEQ ID NO: 643843 - RNA, 23 nt, Homo sapiens
uguggauggugucuccuuuacua

SEQ ID NO: 643844 - RNA, 21 nt, Homo sapiens
uguggauucuucccacacaga

SEQ ID NO: 643845 - RNA, 17 nt, Homo sapiens
uguaguauaauucuugg

SEQ ID NO: 643846 - RNA, 18 nt, Homo sapiens
uguagucccagcuacuca

SEQ ID NO: 643847 - RNA, 20 nt, Homo sapiens
uguagucccagcuacuugag

SEQ ID NO: 643848 - RNA, 15 nt, Homo sapiens
uguaguuaaugaugg

SEQ ID NO: 643849 - RNA, 14 nt, Homo sapiens
uguaguuuaguucu

SEQ ID NO: 643850 - RNA, 20 nt, Homo sapiens
uguaguuuugaguguauaca

SEQ ID NO: 643851 - RNA, 16 nt, Homo sapiens
uguauaaaaaggaaau

SEQ ID NO: 643852 - RNA, 18 nt, Homo sapiens
uguauaaagauuguacuu

SEQ ID NO: 643853 - RNA, 22 nt, Homo sapiens
uguauaagcacugaaaaacaac

SEQ ID NO: 643854 - RNA, 16 nt, Homo sapiens
uguauaauuaacuuaa

SEQ ID NO: 643855 - RNA, 14 nt, Homo sapiens
uguauacaugccag

SEQ ID NO: 643856 - RNA, 19 nt, Homo sapiens
uguauagauccacagggag

SEQ ID NO: 643857 - RNA, 19 nt, Homo sapiens
uguauagcuggcaccuuag

SEQ ID NO: 643858 - RNA, 23 nt, Homo sapiens
uguauagcugugugaacguguau

SEQ ID NO: 643859 - RNA, 20 nt, Homo sapiens
uguauauaaauacaugcaca

SEQ ID NO: 643860 - RNA, 23 nt, Homo sapiens
uguauauguagauguaugcacac

SEQ ID NO: 643861 - RNA, 16 nt, Homo sapiens
uguauauuacauacau

SEQ ID NO: 643862 - RNA, 20 nt, Homo sapiens
uguauauuguggauguguuc

SEQ ID NO: 643863 - RNA, 17 nt, Homo sapiens
uguauauuuucucuaua

SEQ ID NO: 643864 - RNA, 22 nt, Homo sapiens
uguauauuuuuaaagaauguua

SEQ ID NO: 643865 - RNA, 17 nt, Homo sapiens
uguaucaaacuagugca

SEQ ID NO: 643866 - RNA, 15 nt, Homo sapiens
uguaucaaaugugac

SEQ ID NO: 643867 - RNA, 16 nt, Homo sapiens
uguaucaaaugugaca

SEQ ID NO: 643868 - RNA, 17 nt, Homo sapiens
uguaucaagucauggca

SEQ ID NO: 643869 - RNA, 23 nt, Homo sapiens
uguaucaauggagcaugugugca

SEQ ID NO: 643870 - RNA, 14 nt, Homo sapiens
uguauccagaggaa

SEQ ID NO: 643871 - RNA, 19 nt, Homo sapiens
uguaucccaacuccuauaa

SEQ ID NO: 643872 - RNA, 17 nt, Homo sapiens
uguaucggagacaguga

SEQ ID NO: 643873 - RNA, 15 nt, Homo sapiens
uguaucgggcaaaaa

SEQ ID NO: 643874 - RNA, 14 nt, Homo sapiens
uguaucguauugag

SEQ ID NO: 643875 - RNA, 20 nt, Homo sapiens
uguaucuacaauacauauau

SEQ ID NO: 643876 - RNA, 22 nt, Homo sapiens
uguaucugucuuuccacucugg

SEQ ID NO: 643877 - RNA, 18 nt, Homo sapiens
uguaugaaaaauugggga

SEQ ID NO: 643878 - RNA, 16 nt, Homo sapiens
uguaugaaaauccuuu

SEQ ID NO: 643879 - RNA, 13 nt, Homo sapiens
uguaugacaguga

SEQ ID NO: 643880 - RNA, 15 nt, Homo sapiens
uguaugaccacuggg

SEQ ID NO: 643881 - RNA, 23 nt, Homo sapiens
uguaugaguaucuguauguauau

SEQ ID NO: 643882 - RNA, 14 nt, Homo sapiens
uguaugauguguug

SEQ ID NO: 643883 - RNA, 23 nt, Homo sapiens
uguaugccuuuugggcauucucc

SEQ ID NO: 643884 - RNA, 16 nt, Homo sapiens
uguauggaaaaaccau

SEQ ID NO: 643885 - RNA, 15 nt, Homo sapiens
uguauggcacuggca

SEQ ID NO: 643886 - RNA, 23 nt, Homo sapiens
uguaugggagauggcagcaguga

SEQ ID NO: 643887 - RNA, 14 nt, Homo sapiens
uguaugguuccaaa

SEQ ID NO: 643888 - RNA, 20 nt, Homo sapiens
uguauguauuuucaguuaca

SEQ ID NO: 643889 - RNA, 13 nt, Homo sapiens
uguaugugcauua

SEQ ID NO: 643890 - RNA, 17 nt, Homo sapiens
uguauguguguagacaa

SEQ ID NO: 643891 - RNA, 22 nt, Homo sapiens
uguauguuuuaauugcauuuaa

SEQ ID NO: 643892 - RNA, 18 nt, Homo sapiens
uguauuaaacucuucaca

SEQ ID NO: 643893 - RNA, 14 nt, Homo sapiens
uguauuaagccaau

SEQ ID NO: 643894 - RNA, 15 nt, Homo sapiens
uguauuaauaaagca

SEQ ID NO: 643895 - RNA, 14 nt, Homo sapiens
uguauuaaugcuau

SEQ ID NO: 643896 - RNA, 13 nt, Homo sapiens
uguauuaaugucu

SEQ ID NO: 643897 - RNA, 22 nt, Homo sapiens
uguauuacaucuaaugcuucaa

SEQ ID NO: 643898 - RNA, 22 nt, Homo sapiens
uguauuauuauuauugcugcca

SEQ ID NO: 643899 - RNA, 19 nt, Homo sapiens
uguauucaugaacuuggcu

SEQ ID NO: 643900 - RNA, 14 nt, Homo sapiens
uguauuccacuuag

SEQ ID NO: 643901 - RNA, 14 nt, Homo sapiens
uguauucgugcauu

SEQ ID NO: 643902 - RNA, 21 nt, Homo sapiens
uguauucucugagcugugcag

SEQ ID NO: 643903 - RNA, 17 nt, Homo sapiens
uguauucuucaaccuca

SEQ ID NO: 643904 - RNA, 22 nt, Homo sapiens
uguauugacuguaccacagaca

SEQ ID NO: 643905 - RNA, 18 nt, Homo sapiens
uguauugagggccaguga

SEQ ID NO: 643906 - RNA, 23 nt, Homo sapiens
uguauuggcgcaccaagaucucc

SEQ ID NO: 643907 - RNA, 18 nt, Homo sapiens
uguauuggcuaugauggu

SEQ ID NO: 643908 - RNA, 16 nt, Homo sapiens
uguauuguauugccca

SEQ ID NO: 643909 - RNA, 19 nt, Homo sapiens
uguauuguucccagugaca

SEQ ID NO: 643910 - RNA, 18 nt, Homo sapiens
uguauuuauggagugccu

SEQ ID NO: 643911 - RNA, 14 nt, Homo sapiens
uguauuucagggac

SEQ ID NO: 643912 - RNA, 17 nt, Homo sapiens
uguauuuccagugcaau

SEQ ID NO: 643913 - RNA, 16 nt, Homo sapiens
uguauuuuaugaucuu

SEQ ID NO: 643914 - RNA, 15 nt, Homo sapiens
uguauuuucagcuca

SEQ ID NO: 643915 - RNA, 16 nt, Homo sapiens
uguauuuugacacugg

SEQ ID NO: 643916 - RNA, 19 nt, Homo sapiens
uguauuuuuaauauaugca

SEQ ID NO: 643917 - RNA, 15 nt, Homo sapiens
ugucaaaacaagacu

SEQ ID NO: 643918 - RNA, 18 nt, Homo sapiens
ugucaaaauuguuuacca

SEQ ID NO: 643919 - RNA, 14 nt, Homo sapiens
ugucaaagaagcuu

SEQ ID NO: 643920 - RNA, 21 nt, Homo sapiens
ugucaaagcauugagaucucc

SEQ ID NO: 643921 - RNA, 13 nt, Homo sapiens
ugucaaagugaua

SEQ ID NO: 643922 - RNA, 19 nt, Homo sapiens
ugucaaaugaugugcaaaa

SEQ ID NO: 643923 - RNA, 14 nt, Homo sapiens
ugucaaaugcagua

SEQ ID NO: 643924 - RNA, 11 nt, Homo sapiens
ugucaagcaau

SEQ ID NO: 643925 - RNA, 19 nt, Homo sapiens
ugucaagccggaugccuaa

SEQ ID NO: 643926 - RNA, 22 nt, Homo sapiens
ugucaagcugcucugagccaca

SEQ ID NO: 643927 - RNA, 13 nt, Homo sapiens
ugucaaggugugg

SEQ ID NO: 643928 - RNA, 15 nt, Homo sapiens
ugucaauaaaccugu

SEQ ID NO: 643929 - RNA, 16 nt, Homo sapiens
ugucaauauaagcuca

SEQ ID NO: 643930 - RNA, 13 nt, Homo sapiens
ugucaaugugaac

SEQ ID NO: 643931 - RNA, 12 nt, Homo sapiens
ugucacaaagau

SEQ ID NO: 643932 - RNA, 18 nt, Homo sapiens
ugucacaaccucucugau

SEQ ID NO: 643933 - RNA, 21 nt, Homo sapiens
ugucacaaccucucugaucuu

SEQ ID NO: 643934 - RNA, 20 nt, Homo sapiens
ugucacaauacaguaaguaa

SEQ ID NO: 643935 - RNA, 20 nt, Homo sapiens
ugucacauagagugaucuuu

SEQ ID NO: 643936 - RNA, 15 nt, Homo sapiens
ugucacauaggcaaa

SEQ ID NO: 643937 - RNA, 23 nt, Homo sapiens
ugucaccaaauuuguaccucuaa

SEQ ID NO: 643938 - RNA, 14 nt, Homo sapiens
ugucaccagcaaca

SEQ ID NO: 643939 - RNA, 22 nt, Homo sapiens
ugucaccagcuaucugucaucu

SEQ ID NO: 643940 - RNA, 19 nt, Homo sapiens
ugucacccuggauaggcaa

SEQ ID NO: 643941 - RNA, 20 nt, Homo sapiens
ugucaccucagcugauauua

SEQ ID NO: 643942 - RNA, 19 nt, Homo sapiens
ugucaccugcucacaggga

SEQ ID NO: 643943 - RNA, 18 nt, Homo sapiens
ugucacgucuucugagaa

SEQ ID NO: 643944 - RNA, 16 nt, Homo sapiens
ugucacuaaacugaaa

SEQ ID NO: 643945 - RNA, 18 nt, Homo sapiens
ugucacuacacacuaaaa

SEQ ID NO: 643946 - RNA, 12 nt, Homo sapiens
ugucacugccaa

SEQ ID NO: 643947 - RNA, 16 nt, Homo sapiens
ugucacuggaugucaa

SEQ ID NO: 643948 - RNA, 14 nt, Homo sapiens
aauucuacuuugag

SEQ ID NO: 643949 - RNA, 15 nt, Homo sapiens
aauucuagagccagc

SEQ ID NO: 643950 - RNA, 19 nt, Homo sapiens
aauucuauuacgugcaaua

SEQ ID NO: 643951 - RNA, 21 nt, Homo sapiens
aauucuauuacgugcaauacu

SEQ ID NO: 643952 - RNA, 16 nt, Homo sapiens
aauucucagaaucuca

SEQ ID NO: 643953 - RNA, 17 nt, Homo sapiens
aauucuccugccucagc

SEQ ID NO: 643954 - RNA, 19 nt, Homo sapiens
aauucuccugccucagccu

SEQ ID NO: 643955 - RNA, 16 nt, Homo sapiens
aauucucuagggcuag

SEQ ID NO: 643956 - RNA, 20 nt, Homo sapiens
aauucucuaguuugauuaaa

SEQ ID NO: 643957 - RNA, 17 nt, Homo sapiens
aauucucucucuugcag

SEQ ID NO: 643958 - RNA, 13 nt, Homo sapiens
aauucucugugga

SEQ ID NO: 643959 - RNA, 21 nt, Homo sapiens
aauucucuuaaucacuacugu

SEQ ID NO: 643960 - RNA, 21 nt, Homo sapiens
aauucucuuauccaacaucaa

SEQ ID NO: 643961 - RNA, 14 nt, Homo sapiens
aauucucuuucaaa

SEQ ID NO: 643962 - RNA, 19 nt, Homo sapiens
aauucugauguuacugaga

SEQ ID NO: 643963 - RNA, 20 nt, Homo sapiens
aauucuggaaacuccugaca

SEQ ID NO: 643964 - RNA, 22 nt, Homo sapiens
aauucugggugcgagugugaga

SEQ ID NO: 643965 - RNA, 13 nt, Homo sapiens
aauucugguauac

SEQ ID NO: 643966 - RNA, 17 nt, Homo sapiens
aauucugguguuuacac

SEQ ID NO: 643967 - RNA, 22 nt, Homo sapiens
aauucugugacauacauauuau

SEQ ID NO: 643968 - RNA, 16 nt, Homo sapiens
aauucuguggcaguuu

SEQ ID NO: 643969 - RNA, 14 nt, Homo sapiens
aauucuuagaauau

SEQ ID NO: 643970 - RNA, 17 nt, Homo sapiens
aauucuuagaauaucua

SEQ ID NO: 643971 - RNA, 17 nt, Homo sapiens
aauucuuagucacaaaa

SEQ ID NO: 643972 - RNA, 21 nt, Homo sapiens
aauucuuaguggaagacaaua

SEQ ID NO: 643973 - RNA, 12 nt, Homo sapiens
aauucuucaugc

SEQ ID NO: 643974 - RNA, 11 nt, Homo sapiens
aauucuugaua

SEQ ID NO: 643975 - RNA, 21 nt, Homo sapiens
aauucuuucccagucugucga

SEQ ID NO: 643976 - RNA, 17 nt, Homo sapiens
aauucuuuguauaugca

SEQ ID NO: 643977 - RNA, 18 nt, Homo sapiens
aauucuuuguauaugcau

SEQ ID NO: 643978 - RNA, 20 nt, Homo sapiens
aauucuuuguauaugcauuc

SEQ ID NO: 643979 - RNA, 18 nt, Homo sapiens
aauugaaaaguacaacua

SEQ ID NO: 643980 - RNA, 15 nt, Homo sapiens
aauugaaaaugcauu

SEQ ID NO: 643981 - RNA, 16 nt, Homo sapiens
aauugaacgacuguau

SEQ ID NO: 643982 - RNA, 17 nt, Homo sapiens
aauugaaucuacaaaag

SEQ ID NO: 643983 - RNA, 14 nt, Homo sapiens
aauugaauucugga

SEQ ID NO: 643984 - RNA, 13 nt, Homo sapiens
aauugacaaugau

SEQ ID NO: 643985 - RNA, 13 nt, Homo sapiens
aauugacagauca

SEQ ID NO: 643986 - RNA, 23 nt, Homo sapiens
aauugacagaucaagcugugaga

SEQ ID NO: 643987 - RNA, 19 nt, Homo sapiens
aauugaccccuuccuccag

SEQ ID NO: 643988 - RNA, 13 nt, Homo sapiens
aauugacuaaaaa

SEQ ID NO: 643989 - RNA, 13 nt, Homo sapiens
aauugacugucac

SEQ ID NO: 643990 - RNA, 20 nt, Homo sapiens
aauugauccucccaucucag

SEQ ID NO: 643991 - RNA, 12 nt, Homo sapiens
aauugauuucaa

SEQ ID NO: 643992 - RNA, 13 nt, Homo sapiens
aauugauuugcau

SEQ ID NO: 643993 - RNA, 16 nt, Homo sapiens
aauugauuugcauuga

SEQ ID NO: 643994 - RNA, 16 nt, Homo sapiens
aauugcaaaacccaac

SEQ ID NO: 643995 - RNA, 18 nt, Homo sapiens
aauugcaaauaaaccacu

SEQ ID NO: 643996 - RNA, 23 nt, Homo sapiens
aauugcaaauaaaccacuuucua

SEQ ID NO: 643997 - RNA, 21 nt, Homo sapiens
aauugcaacagaagcaaaaau

SEQ ID NO: 643998 - RNA, 12 nt, Homo sapiens
aauugcaauaca

SEQ ID NO: 643999 - RNA, 17 nt, Homo sapiens
aauugcaauacauuuca

SEQ ID NO: 644000 - RNA, 22 nt, Homo sapiens
aauugcacauaguucugcccaa

SEQ ID NO: 644001 - RNA, 20 nt, Homo sapiens
aauugcacuuuuaaaccucu

SEQ ID NO: 644002 - RNA, 14 nt, Homo sapiens
aauugcucagagaa

SEQ ID NO: 644003 - RNA, 21 nt, Homo sapiens
aauugcucccuaccagcugaa

SEQ ID NO: 644004 - RNA, 16 nt, Homo sapiens
aauugcuccugcaugc

SEQ ID NO: 644005 - RNA, 15 nt, Homo sapiens
aauugcuucugugua

SEQ ID NO: 644006 - RNA, 20 nt, Homo sapiens
aauugcuucuguguagucaa

SEQ ID NO: 644007 - RNA, 23 nt, Homo sapiens
aauugcuuuugaaaaacaacugc

SEQ ID NO: 644008 - RNA, 15 nt, Homo sapiens
aauuggcacuaaaga

SEQ ID NO: 644009 - RNA, 17 nt, Homo sapiens
aauuggcucuagucacu

SEQ ID NO: 644010 - RNA, 13 nt, Homo sapiens
aauuggcuuuuca

SEQ ID NO: 644011 - RNA, 16 nt, Homo sapiens
aauugggaaugcaaua

SEQ ID NO: 644012 - RNA, 15 nt, Homo sapiens
aauugggcaggugaa

SEQ ID NO: 644013 - RNA, 19 nt, Homo sapiens
aauuggggggaggugcugu

SEQ ID NO: 644014 - RNA, 20 nt, Homo sapiens
aauugguauuaacuaugauc

SEQ ID NO: 644015 - RNA, 13 nt, Homo sapiens
aauugguguauau

SEQ ID NO: 644016 - RNA, 16 nt, Homo sapiens
aauuguauuacuuccu

SEQ ID NO: 644017 - RNA, 23 nt, Homo sapiens
aauuguauuauaauucauuguga

SEQ ID NO: 644018 - RNA, 22 nt, Homo sapiens
aauuguccuggccucucagcca

SEQ ID NO: 644019 - RNA, 22 nt, Homo sapiens
aauugugaaaggaaguguaguu

SEQ ID NO: 644020 - RNA, 21 nt, Homo sapiens
aauugugagcgaauuagcaau

SEQ ID NO: 644021 - RNA, 14 nt, Homo sapiens
aauugugcuuucac

SEQ ID NO: 644022 - RNA, 21 nt, Homo sapiens
aauuguguguuaaugucuuca

SEQ ID NO: 644023 - RNA, 13 nt, Homo sapiens
aauuguuaggaag

SEQ ID NO: 644024 - RNA, 13 nt, Homo sapiens
aauuguugagaua

SEQ ID NO: 644025 - RNA, 21 nt, Homo sapiens
aauuguuuauaaaacaaugac

SEQ ID NO: 644026 - RNA, 18 nt, Homo sapiens
aauuguuucauucauccu

SEQ ID NO: 644027 - RNA, 18 nt, Homo sapiens
aauuguuuucacuuguau

SEQ ID NO: 644028 - RNA, 21 nt, Homo sapiens
aauuuaaaaaagcaaauggaa

SEQ ID NO: 644029 - RNA, 18 nt, Homo sapiens
aauuuaaaaaaugggcua

SEQ ID NO: 644030 - RNA, 14 nt, Homo sapiens
aauuuaaaagcaca

SEQ ID NO: 644031 - RNA, 19 nt, Homo sapiens
aauuuaaacuuguuuacaa

SEQ ID NO: 644032 - RNA, 12 nt, Homo sapiens
aauuuaacaaga

SEQ ID NO: 644033 - RNA, 13 nt, Homo sapiens
aauuuaaccauaa

SEQ ID NO: 644034 - RNA, 13 nt, Homo sapiens
aauuuaaggcaaa

SEQ ID NO: 644035 - RNA, 18 nt, Homo sapiens
aauuucugucaaaugcag

SEQ ID NO: 644036 - RNA, 15 nt, Homo sapiens
aauuucuuacuaaac

SEQ ID NO: 644037 - RNA, 15 nt, Homo sapiens
aauuucuucauguga

SEQ ID NO: 644038 - RNA, 14 nt, Homo sapiens
aauuucuuugucau

SEQ ID NO: 644039 - RNA, 16 nt, Homo sapiens
aauuugaaaauguccu

SEQ ID NO: 644040 - RNA, 17 nt, Homo sapiens
aauuugaacucaaacca

SEQ ID NO: 644041 - RNA, 13 nt, Homo sapiens
aauuugaauuuau

SEQ ID NO: 644042 - RNA, 15 nt, Homo sapiens
aauuugagauucuac

SEQ ID NO: 644043 - RNA, 18 nt, Homo sapiens
aauuugagauucuacagu

SEQ ID NO: 644044 - RNA, 14 nt, Homo sapiens
aauuugauacauaa

SEQ ID NO: 644045 - RNA, 17 nt, Homo sapiens
aauuugaugauuuucau

SEQ ID NO: 644046 - RNA, 22 nt, Homo sapiens
aauuugaugguauuucuuucuc

SEQ ID NO: 644047 - RNA, 23 nt, Homo sapiens
aauuugauugcuuugcugcacag

SEQ ID NO: 644048 - RNA, 18 nt, Homo sapiens
aauuugcaacaguaauca

SEQ ID NO: 644049 - RNA, 18 nt, Homo sapiens
aauuugcauugugucaga

SEQ ID NO: 644050 - RNA, 18 nt, Homo sapiens
aauuuggagacucugugg

SEQ ID NO: 644051 - RNA, 18 nt, Homo sapiens
aauuuggccugcacuaau

SEQ ID NO: 644052 - RNA, 17 nt, Homo sapiens
aauuugggagagccaua

SEQ ID NO: 644053 - RNA, 20 nt, Homo sapiens
aauuugggggaaaauggcac

SEQ ID NO: 644054 - RNA, 21 nt, Homo sapiens
aauuuggguacugggugcugu

SEQ ID NO: 644055 - RNA, 20 nt, Homo sapiens
aauuugguaaaaaugcugcu

SEQ ID NO: 644056 - RNA, 12 nt, Homo sapiens
aauuuguacaua

SEQ ID NO: 644057 - RNA, 13 nt, Homo sapiens
aauuugucuuaaa

SEQ ID NO: 644058 - RNA, 15 nt, Homo sapiens
aauuuuaaacauauc

SEQ ID NO: 644059 - RNA, 22 nt, Homo sapiens
aauuuuaaauguucacaacaua

SEQ ID NO: 644060 - RNA, 15 nt, Homo sapiens
aauuuuaaguaggaa

SEQ ID NO: 644061 - RNA, 15 nt, Homo sapiens
aauuuuacacucugu

SEQ ID NO: 644062 - RNA, 15 nt, Homo sapiens
aauuuuaccauucag

SEQ ID NO: 644063 - RNA, 15 nt, Homo sapiens
aauuuuacuuaucau

SEQ ID NO: 644064 - RNA, 15 nt, Homo sapiens
aauuuuaguauucau

SEQ ID NO: 644065 - RNA, 22 nt, Homo sapiens
aauuuuaguguuaaugacucuu

SEQ ID NO: 644066 - RNA, 17 nt, Homo sapiens
aauuuuauaacagaauu

SEQ ID NO: 644067 - RNA, 14 nt, Homo sapiens
aauuuuauugcaaa

SEQ ID NO: 644068 - RNA, 18 nt, Homo sapiens
aauuuuauuggggggcaa

SEQ ID NO: 644069 - RNA, 17 nt, Homo sapiens
aauuuucaaguuuacac

SEQ ID NO: 644070 - RNA, 13 nt, Homo sapiens
aauuuucauucau

SEQ ID NO: 644071 - RNA, 19 nt, Homo sapiens
aauuuucuuuccagccagu

SEQ ID NO: 644072 - RNA, 22 nt, Homo sapiens
aauuuugagauuaagaaugcca

SEQ ID NO: 644073 - RNA, 17 nt, Homo sapiens
aauuuuguaauguauca

SEQ ID NO: 644074 - RNA, 20 nt, Homo sapiens
aauuuugugcaugaaacaga

SEQ ID NO: 644075 - RNA, 14 nt, Homo sapiens
aauuuuguugauau

SEQ ID NO: 644076 - RNA, 12 nt, Homo sapiens
aauuuuguugca

SEQ ID NO: 644077 - RNA, 19 nt, Homo sapiens
aauuuuguuucaaagggau

SEQ ID NO: 644078 - RNA, 18 nt, Homo sapiens
aauuuuuaagcuacuuau

SEQ ID NO: 644079 - RNA, 19 nt, Homo sapiens
aauuuuuaaggauguugcc

SEQ ID NO: 644080 - RNA, 14 nt, Homo sapiens
aauuuuuacauuca

SEQ ID NO: 644081 - RNA, 17 nt, Homo sapiens
aauuuuucagacuuuaa

SEQ ID NO: 644082 - RNA, 12 nt, Homo sapiens
aauuuuucauag

SEQ ID NO: 644083 - RNA, 11 nt, Homo sapiens
aauuuuuccau

SEQ ID NO: 644084 - RNA, 18 nt, Homo sapiens
aauuuuuccuaugcuauu

SEQ ID NO: 644085 - RNA, 21 nt, Homo sapiens
aauuuuucucuaacucagaaa

SEQ ID NO: 644086 - RNA, 15 nt, Homo sapiens
aauuuuuuaaauuga

SEQ ID NO: 644087 - RNA, 19 nt, Homo sapiens
aauuuuuuugaaucuuucg

SEQ ID NO: 644088 - RNA, 18 nt, Homo sapiens
aauuuuuuugcauuuuca

SEQ ID NO: 644089 - RNA, 16 nt, Homo sapiens
acaaaaaaaccucuau

SEQ ID NO: 644090 - RNA, 20 nt, Homo sapiens
acaaaaaaaccucuaugcaa

SEQ ID NO: 644091 - RNA, 13 nt, Homo sapiens
acaaaaaaauuaa

SEQ ID NO: 644092 - RNA, 14 nt, Homo sapiens
acaaaaaaccacaa

SEQ ID NO: 644093 - RNA, 21 nt, Homo sapiens
acaaaaaauuugagaaagccu

SEQ ID NO: 644094 - RNA, 22 nt, Homo sapiens
acaaaaacagguauauacuuug

SEQ ID NO: 644095 - RNA, 14 nt, Homo sapiens
acaaaaaccaaaaa

SEQ ID NO: 644096 - RNA, 22 nt, Homo sapiens
acaaaaagaacaaaucagcuua

SEQ ID NO: 644097 - RNA, 14 nt, Homo sapiens
acaaaaagagcuuu

SEQ ID NO: 644098 - RNA, 21 nt, Homo sapiens
acaaaaaggugcagaaggcaa

SEQ ID NO: 644099 - RNA, 15 nt, Homo sapiens
acaaaaauuaacuca

SEQ ID NO: 644100 - RNA, 13 nt, Homo sapiens
acaaaaauugaga

SEQ ID NO: 644101 - RNA, 15 nt, Homo sapiens
acaaaaccacuggga

SEQ ID NO: 644102 - RNA, 13 nt, Homo sapiens
acaaaacccacug

SEQ ID NO: 644103 - RNA, 23 nt, Homo sapiens
acaaaaccuacacacauaccuuc

SEQ ID NO: 644104 - RNA, 19 nt, Homo sapiens
acaaaacugcuuugugcau

SEQ ID NO: 644105 - RNA, 16 nt, Homo sapiens
acaaaagauuaaucuu

SEQ ID NO: 644106 - RNA, 12 nt, Homo sapiens
acaaaagcuuuu

SEQ ID NO: 644107 - RNA, 12 nt, Homo sapiens
acaaaaguaaaa

SEQ ID NO: 644108 - RNA, 19 nt, Homo sapiens
acaaaauagacaauuugca

SEQ ID NO: 644109 - RNA, 19 nt, Homo sapiens
acaaaauagccuauccuua

SEQ ID NO: 644110 - RNA, 14 nt, Homo sapiens
acaaaauaguuuua

SEQ ID NO: 644111 - RNA, 13 nt, Homo sapiens
acaaaauguucac

SEQ ID NO: 644112 - RNA, 20 nt, Homo sapiens
acaaaauuggaagcugucau

SEQ ID NO: 644113 - RNA, 14 nt, Homo sapiens
acaaacaaguggau

SEQ ID NO: 644114 - RNA, 14 nt, Homo sapiens
acaaacaauaugaa

SEQ ID NO: 644115 - RNA, 16 nt, Homo sapiens
acaaacagcucaguuc

SEQ ID NO: 644116 - RNA, 18 nt, Homo sapiens
acaaacauuugcugaaua

SEQ ID NO: 644117 - RNA, 14 nt, Homo sapiens
acaaaccaagccau

SEQ ID NO: 644118 - RNA, 15 nt, Homo sapiens
acaaaccaagccaug

SEQ ID NO: 644119 - RNA, 14 nt, Homo sapiens
acaaaccacuguga

SEQ ID NO: 644120 - RNA, 14 nt, Homo sapiens
acaaaccauuaccu

SEQ ID NO: 644121 - RNA, 17 nt, Homo sapiens
acaaaccauuaccugua

SEQ ID NO: 644122 - RNA, 20 nt, Homo sapiens
acaaacccccacuccagcuc

SEQ ID NO: 644123 - RNA, 15 nt, Homo sapiens
acaaaccuagaauuu

SEQ ID NO: 644124 - RNA, 18 nt, Homo sapiens
acaaaccugcaugguguu

SEQ ID NO: 644125 - RNA, 20 nt, Homo sapiens
acaauaaaggcugagcucuu

SEQ ID NO: 644126 - RNA, 18 nt, Homo sapiens
acaauaaauagacacgca

SEQ ID NO: 644127 - RNA, 14 nt, Homo sapiens
acaauaaauguauu

SEQ ID NO: 644128 - RNA, 19 nt, Homo sapiens
acaauaagacaugcuuacu

SEQ ID NO: 644129 - RNA, 22 nt, Homo sapiens
acaauagauaagguuuccugcu

SEQ ID NO: 644130 - RNA, 22 nt, Homo sapiens
acaauagccgauaucagaauuu

SEQ ID NO: 644131 - RNA, 18 nt, Homo sapiens
acaauagugauugauaga

SEQ ID NO: 644132 - RNA, 16 nt, Homo sapiens
acaauaguucuguggg

SEQ ID NO: 644133 - RNA, 16 nt, Homo sapiens
acaauaucaaucacau

SEQ ID NO: 644134 - RNA, 17 nt, Homo sapiens
acaauaugggcacuuua

SEQ ID NO: 644135 - RNA, 23 nt, Homo sapiens
acaaucaacucuaauagugcuua

SEQ ID NO: 644136 - RNA, 20 nt, Homo sapiens
acaaucaugaacagcucuga

SEQ ID NO: 644137 - RNA, 18 nt, Homo sapiens
acaauccacaauucauuc

SEQ ID NO: 644138 - RNA, 16 nt, Homo sapiens
acaauccaucucucaa

SEQ ID NO: 644139 - RNA, 23 nt, Homo sapiens
acaauccaucucucaaguagugu

SEQ ID NO: 644140 - RNA, 14 nt, Homo sapiens
acaauccuguggau

SEQ ID NO: 644141 - RNA, 20 nt, Homo sapiens
acaaucuaauuaaauggcau

SEQ ID NO: 644142 - RNA, 18 nt, Homo sapiens
acaaucugggacuuucac

SEQ ID NO: 644143 - RNA, 21 nt, Homo sapiens
acaaucuguuuuggcuuuaug

SEQ ID NO: 644144 - RNA, 17 nt, Homo sapiens
acaaugaaaacaaauaa

SEQ ID NO: 644145 - RNA, 15 nt, Homo sapiens
acaaugaacacuuau

SEQ ID NO: 644146 - RNA, 19 nt, Homo sapiens
acaaugaacccccaugaug

SEQ ID NO: 644147 - RNA, 20 nt, Homo sapiens
acaaugaacccccaugaugu

SEQ ID NO: 644148 - RNA, 14 nt, Homo sapiens
acaaugacgugccu

SEQ ID NO: 644149 - RNA, 18 nt, Homo sapiens
acaaugacuuuauugcau

SEQ ID NO: 644150 - RNA, 16 nt, Homo sapiens
acaaugagaugcauga

SEQ ID NO: 644151 - RNA, 22 nt, Homo sapiens
acaaugauaugcaagugcaaaa

SEQ ID NO: 644152 - RNA, 21 nt, Homo sapiens
acaaugcaaccaacuauccaa

SEQ ID NO: 644153 - RNA, 15 nt, Homo sapiens
acaaugcaugugcug

SEQ ID NO: 644154 - RNA, 11 nt, Homo sapiens
acaaugccaau

SEQ ID NO: 644155 - RNA, 15 nt, Homo sapiens
acaaugcugagguua

SEQ ID NO: 644156 - RNA, 18 nt, Homo sapiens
acaaugcugagguuauga

SEQ ID NO: 644157 - RNA, 20 nt, Homo sapiens
acacgaugcauuuaauaaag

SEQ ID NO: 644158 - RNA, 21 nt, Homo sapiens
acacgccagcuccucucugaa

SEQ ID NO: 644159 - RNA, 14 nt, Homo sapiens
acacggaggcaucu

SEQ ID NO: 644160 - RNA, 18 nt, Homo sapiens
acacguacaaaauccagc

SEQ ID NO: 644161 - RNA, 13 nt, Homo sapiens
acacguacuucua

SEQ ID NO: 644162 - RNA, 21 nt, Homo sapiens
acacguagacugauggaacag

SEQ ID NO: 644163 - RNA, 22 nt, Homo sapiens
acacguguggcgggcaguggga

SEQ ID NO: 644164 - RNA, 14 nt, Homo sapiens
acacguuggcucag

SEQ ID NO: 644165 - RNA, 16 nt, Homo sapiens
acacuaaaaaaaugca

SEQ ID NO: 644166 - RNA, 15 nt, Homo sapiens
acacuaaaaggugac

SEQ ID NO: 644167 - RNA, 19 nt, Homo sapiens
acacuaaauccccucacua

SEQ ID NO: 644168 - RNA, 15 nt, Homo sapiens
acacuaacucaccag

SEQ ID NO: 644169 - RNA, 17 nt, Homo sapiens
acacuaaggcugcuuca

SEQ ID NO: 644170 - RNA, 14 nt, Homo sapiens
acacuacugcuaaa

SEQ ID NO: 644171 - RNA, 14 nt, Homo sapiens
acacuagccagaca

SEQ ID NO: 644172 - RNA, 20 nt, Homo sapiens
acacuaugaagauguuucaa

SEQ ID NO: 644173 - RNA, 22 nt, Homo sapiens
acacuauuuaaguaaauacagu

SEQ ID NO: 644174 - RNA, 22 nt, Homo sapiens
acacucaauaaauugcaacaua

SEQ ID NO: 644175 - RNA, 20 nt, Homo sapiens
acacucacuccacaacccaa

SEQ ID NO: 644176 - RNA, 19 nt, Homo sapiens
acacucaucuuagugccug

SEQ ID NO: 644177 - RNA, 13 nt, Homo sapiens
acacucaugaagc

SEQ ID NO: 644178 - RNA, 14 nt, Homo sapiens
acacucaugaagca

SEQ ID NO: 644179 - RNA, 10 nt, Homo sapiens
acacuccacu

SEQ ID NO: 644180 - RNA, 21 nt, Homo sapiens
acacuccacuugaagcacuua

SEQ ID NO: 644181 - RNA, 15 nt, Homo sapiens
acacuccagugccag

SEQ ID NO: 644182 - RNA, 20 nt, Homo sapiens
acacuccuacaagauuuaga

SEQ ID NO: 644183 - RNA, 23 nt, Homo sapiens
acacucuauaagauuccaaaaag

SEQ ID NO: 644184 - RNA, 19 nt, Homo sapiens
acacucuccaaacagucac

SEQ ID NO: 644185 - RNA, 23 nt, Homo sapiens
acacucuugagucucuuuaccua

SEQ ID NO: 644186 - RNA, 19 nt, Homo sapiens
acacugaaaaauauuccaa

SEQ ID NO: 644187 - RNA, 15 nt, Homo sapiens
acacugaaaccaaaa

SEQ ID NO: 644188 - RNA, 17 nt, Homo sapiens
acacugaaaccaaaaca

SEQ ID NO: 644189 - RNA, 23 nt, Homo sapiens
acacugaagaagucacugaacaa

SEQ ID NO: 644190 - RNA, 16 nt, Homo sapiens
acacugacaaagucau

SEQ ID NO: 644191 - RNA, 15 nt, Homo sapiens
acacugagagagugg

SEQ ID NO: 644192 - RNA, 18 nt, Homo sapiens
acacugagauauucagcc

SEQ ID NO: 644193 - RNA, 14 nt, Homo sapiens
acacugaggacugu

SEQ ID NO: 644194 - RNA, 23 nt, Homo sapiens
acacugaggccuuguguccuuua

SEQ ID NO: 644195 - RNA, 22 nt, Homo sapiens
acacugaguucuaucaguuauc

SEQ ID NO: 644196 - RNA, 13 nt, Homo sapiens
acacugauacacu

SEQ ID NO: 644197 - RNA, 17 nt, Homo sapiens
acacugaucaauuucaa

SEQ ID NO: 644198 - RNA, 14 nt, Homo sapiens
acacugaucuggcu

SEQ ID NO: 644199 - RNA, 15 nt, Homo sapiens
acacugauggcucaa

SEQ ID NO: 644200 - RNA, 16 nt, Homo sapiens
acacugcacacaguga

SEQ ID NO: 644201 - RNA, 18 nt, Homo sapiens
acacugcacacagugacu

SEQ ID NO: 644202 - RNA, 22 nt, Homo sapiens
acacugcacagaagacagcagc

SEQ ID NO: 644203 - RNA, 24 nt, Homo sapiens
acacugccuagucgggacuuguaa

SEQ ID NO: 644204 - RNA, 16 nt, Homo sapiens
acacuggaacauucca

SEQ ID NO: 644205 - RNA, 17 nt, Homo sapiens
acacuggaacauuccag

SEQ ID NO: 644206 - RNA, 23 nt, Homo sapiens
acacuggaauauaaaacagucau

SEQ ID NO: 644207 - RNA, 21 nt, Homo sapiens
acacuggaggagagaagaaug

SEQ ID NO: 644208 - RNA, 23 nt, Homo sapiens
acacugggccuggagcccugggc

SEQ ID NO: 644209 - RNA, 15 nt, Homo sapiens
acacuggugguucua

SEQ ID NO: 644210 - RNA, 22 nt, Homo sapiens
acacuguaccgacuuugauaga

SEQ ID NO: 644211 - RNA, 16 nt, Homo sapiens
acacuguccaugaagc

SEQ ID NO: 644212 - RNA, 21 nt, Homo sapiens
acacuguccaugaagcacuga

SEQ ID NO: 644213 - RNA, 22 nt, Homo sapiens
acacuguucugaaagugacuca

SEQ ID NO: 644214 - RNA, 14 nt, Homo sapiens
acacuuaaugauac

SEQ ID NO: 644215 - RNA, 14 nt, Homo sapiens
acacuuacugcaaa

SEQ ID NO: 644216 - RNA, 12 nt, Homo sapiens
acacuuacuguu

SEQ ID NO: 644217 - RNA, 16 nt, Homo sapiens
acacuuauauuuugau

SEQ ID NO: 644218 - RNA, 16 nt, Homo sapiens
acacuuaugggccaag

SEQ ID NO: 644219 - RNA, 13 nt, Homo sapiens
acacuucagaucu

SEQ ID NO: 644220 - RNA, 14 nt, Homo sapiens
acacuuccccaucu

SEQ ID NO: 644221 - RNA, 19 nt, Homo sapiens
acacuucugugagaccccc

SEQ ID NO: 644222 - RNA, 17 nt, Homo sapiens
acacuugaugaugugga

SEQ ID NO: 644223 - RNA, 14 nt, Homo sapiens
acacuuggaugcag

SEQ ID NO: 644224 - RNA, 13 nt, Homo sapiens
acacuugugccag

SEQ ID NO: 644225 - RNA, 17 nt, Homo sapiens
acacuuuugaugacgau

SEQ ID NO: 644226 - RNA, 20 nt, Homo sapiens
acacuuuuuggaagugaaaa

SEQ ID NO: 644227 - RNA, 18 nt, Homo sapiens
acagaaaacaucccacug

SEQ ID NO: 644228 - RNA, 15 nt, Homo sapiens
acagaaaacucccaa

SEQ ID NO: 644229 - RNA, 15 nt, Homo sapiens
acagaaacgcaucca

SEQ ID NO: 644230 - RNA, 12 nt, Homo sapiens
acagaaacugca

SEQ ID NO: 644231 - RNA, 19 nt, Homo sapiens
acagaaagcuccuuccaga

SEQ ID NO: 644232 - RNA, 21 nt, Homo sapiens
acagaaagcuccuuccagacc

SEQ ID NO: 644233 - RNA, 18 nt, Homo sapiens
acagaaauacugcucuga

SEQ ID NO: 644234 - RNA, 13 nt, Homo sapiens
acagaaauuguau

SEQ ID NO: 644235 - RNA, 13 nt, Homo sapiens
acagaacacuuau

SEQ ID NO: 644236 - RNA, 22 nt, Homo sapiens
acagaacacuuauguuauacaa

SEQ ID NO: 644237 - RNA, 13 nt, Homo sapiens
acagaacauuuau

SEQ ID NO: 644238 - RNA, 22 nt, Homo sapiens
acagaacuaagaugaucaucuc

SEQ ID NO: 644239 - RNA, 17 nt, Homo sapiens
acagaacucaacuguau

SEQ ID NO: 644240 - RNA, 14 nt, Homo sapiens
acagaacucacagu

SEQ ID NO: 644241 - RNA, 19 nt, Homo sapiens
acagaacucgaugcacuga

SEQ ID NO: 644242 - RNA, 21 nt, Homo sapiens
acagaacuucagaaagacuug

SEQ ID NO: 644243 - RNA, 16 nt, Homo sapiens
acagaagccaagcucc

SEQ ID NO: 644244 - RNA, 22 nt, Homo sapiens
acagaagcuuaaaaucugugaa

SEQ ID NO: 644245 - RNA, 15 nt, Homo sapiens
acagaaggauguccc

SEQ ID NO: 644246 - RNA, 17 nt, Homo sapiens
accagucugacccuuac

SEQ ID NO: 644247 - RNA, 12 nt, Homo sapiens
accagugaaaag

SEQ ID NO: 644248 - RNA, 23 nt, Homo sapiens
accagugaaccaaagagacugga

SEQ ID NO: 644249 - RNA, 16 nt, Homo sapiens
accagugauccauguc

SEQ ID NO: 644250 - RNA, 11 nt, Homo sapiens
accaguguucc

SEQ ID NO: 644251 - RNA, 19 nt, Homo sapiens
accaguuaaaagcauuuua

SEQ ID NO: 644252 - RNA, 20 nt, Homo sapiens
accaguugaauaaaagugca

SEQ ID NO: 644253 - RNA, 15 nt, Homo sapiens
accaguuuauacaga

SEQ ID NO: 644254 - RNA, 21 nt, Homo sapiens
accauaacacuugaugccguu

SEQ ID NO: 644255 - RNA, 14 nt, Homo sapiens
accauaacagccaa

SEQ ID NO: 644256 - RNA, 14 nt, Homo sapiens
accauaacuguuuc

SEQ ID NO: 644257 - RNA, 21 nt, Homo sapiens
accauaagggacugugccaga

SEQ ID NO: 644258 - RNA, 15 nt, Homo sapiens
accauacaauuucau

SEQ ID NO: 644259 - RNA, 16 nt, Homo sapiens
accauacucaaauggu

SEQ ID NO: 644260 - RNA, 14 nt, Homo sapiens
accauacugaggga

SEQ ID NO: 644261 - RNA, 17 nt, Homo sapiens
accauagcacaggcuaa

SEQ ID NO: 644262 - RNA, 20 nt, Homo sapiens
accauagggacccauucuac

SEQ ID NO: 644263 - RNA, 15 nt, Homo sapiens
accauaguaccauuu

SEQ ID NO: 644264 - RNA, 16 nt, Homo sapiens
accauauaccaucucc

SEQ ID NO: 644265 - RNA, 20 nt, Homo sapiens
accauauaccaucuccagcu

SEQ ID NO: 644266 - RNA, 22 nt, Homo sapiens
accauauagagguguaacacuu

SEQ ID NO: 644267 - RNA, 19 nt, Homo sapiens
accgaccccuccccagugc

SEQ ID NO: 644268 - RNA, 23 nt, Homo sapiens
accgaccccuccccagugccucu

SEQ ID NO: 644269 - RNA, 22 nt, Homo sapiens
accgacuagccaggaaguacuu

SEQ ID NO: 644270 - RNA, 15 nt, Homo sapiens
accgagacacuuuau

SEQ ID NO: 644271 - RNA, 13 nt, Homo sapiens
accgagcaauuuu

SEQ ID NO: 644272 - RNA, 16 nt, Homo sapiens
accgagucucuucucc

SEQ ID NO: 644273 - RNA, 20 nt, Homo sapiens
accgagucuugcucuguuac

SEQ ID NO: 644274 - RNA, 16 nt, Homo sapiens
accgaguggcugucau

SEQ ID NO: 644275 - RNA, 14 nt, Homo sapiens
accgauaugcacuu

SEQ ID NO: 644276 - RNA, 15 nt, Homo sapiens
accgaugguccucac

SEQ ID NO: 644277 - RNA, 16 nt, Homo sapiens
accgcaaggagcaaac

SEQ ID NO: 644278 - RNA, 13 nt, Homo sapiens
accgccacugggc

SEQ ID NO: 644279 - RNA, 22 nt, Homo sapiens
accgcccaucaggguucucuua

SEQ ID NO: 644280 - RNA, 18 nt, Homo sapiens
accgccggccacacuggu

SEQ ID NO: 644281 - RNA, 21 nt, Homo sapiens
accgccggccacacuggucac

SEQ ID NO: 644282 - RNA, 17 nt, Homo sapiens
accgcugccagcacaga

SEQ ID NO: 644283 - RNA, 20 nt, Homo sapiens
accggaaggaggccaaccag

SEQ ID NO: 644284 - RNA, 22 nt, Homo sapiens
accggaugcugugccuggccuc

SEQ ID NO: 644285 - RNA, 22 nt, Homo sapiens
accgggagccucccccucagau

SEQ ID NO: 644286 - RNA, 13 nt, Homo sapiens
accuuucccucac

SEQ ID NO: 644287 - RNA, 21 nt, Homo sapiens
accuuuccucucccucagggg

SEQ ID NO: 644288 - RNA, 14 nt, Homo sapiens
accuuucuagccuu

SEQ ID NO: 644289 - RNA, 22 nt, Homo sapiens
accuuugaggucuaaacaaaua

SEQ ID NO: 644290 - RNA, 21 nt, Homo sapiens
accuuugguuuuaaaagagaa

SEQ ID NO: 644291 - RNA, 22 nt, Homo sapiens
accuuuguauucucuccuguac

SEQ ID NO: 644292 - RNA, 16 nt, Homo sapiens
accuuuuauguagcac

SEQ ID NO: 644293 - RNA, 16 nt, Homo sapiens
accuuuucaccuccaa

SEQ ID NO: 644294 - RNA, 23 nt, Homo sapiens
accuuuucauguacagcauuaaa

SEQ ID NO: 644295 - RNA, 19 nt, Homo sapiens
accuuuuccugcggcauca

SEQ ID NO: 644296 - RNA, 18 nt, Homo sapiens
accuuuuuuauacauaaa

SEQ ID NO: 644297 - RNA, 15 nt, Homo sapiens
acgaacccaccugcu

SEQ ID NO: 644298 - RNA, 22 nt, Homo sapiens
acgaauauagaggguuuugcuc

SEQ ID NO: 644299 - RNA, 22 nt, Homo sapiens
acgacaagauuuucuacuuuuu

SEQ ID NO: 644300 - RNA, 17 nt, Homo sapiens
acgacagugcauuugcc

SEQ ID NO: 644301 - RNA, 14 nt, Homo sapiens
acgacauacaugcu

SEQ ID NO: 644302 - RNA, 23 nt, Homo sapiens
acgaccgccccaguuccuguggc

SEQ ID NO: 644303 - RNA, 14 nt, Homo sapiens
acgacuaaccuauc

SEQ ID NO: 644304 - RNA, 11 nt, Homo sapiens
acgacucuucc

SEQ ID NO: 644305 - RNA, 17 nt, Homo sapiens
acgacugucuccauggc

SEQ ID NO: 644306 - RNA, 14 nt, Homo sapiens
acgagauaauguau

SEQ ID NO: 644307 - RNA, 12 nt, Homo sapiens
acgagcagggau

SEQ ID NO: 644308 - RNA, 13 nt, Homo sapiens
acgagguggcagu

SEQ ID NO: 644309 - RNA, 15 nt, Homo sapiens
acgagugaaacuccg

SEQ ID NO: 644310 - RNA, 13 nt, Homo sapiens
acgauaaagggau

SEQ ID NO: 644311 - RNA, 16 nt, Homo sapiens
acgaucuucuccacau

SEQ ID NO: 644312 - RNA, 21 nt, Homo sapiens
acgauggggcaugaccucagu

SEQ ID NO: 644313 - RNA, 17 nt, Homo sapiens
acgauuucacuaggacu

SEQ ID NO: 644314 - RNA, 17 nt, Homo sapiens
acgcaacccacguguaa

SEQ ID NO: 644315 - RNA, 20 nt, Homo sapiens
acgcacacacacacacagga

SEQ ID NO: 644316 - RNA, 18 nt, Homo sapiens
acgcacacacacauacag

SEQ ID NO: 644317 - RNA, 23 nt, Homo sapiens
acgcacacccugccccuggugcc

SEQ ID NO: 644318 - RNA, 17 nt, Homo sapiens
acgcagacacugagauc

SEQ ID NO: 644319 - RNA, 15 nt, Homo sapiens
acgcaucacuggggc

SEQ ID NO: 644320 - RNA, 19 nt, Homo sapiens
acgcauguggcaaagcuca

SEQ ID NO: 644321 - RNA, 17 nt, Homo sapiens
acgccaacuucucccac

SEQ ID NO: 644322 - RNA, 21 nt, Homo sapiens
acgcccuugagcuacuucaaa

SEQ ID NO: 644323 - RNA, 21 nt, Homo sapiens
acgccucacugaaacauggcu

SEQ ID NO: 644324 - RNA, 23 nt, Homo sapiens
acgccugcaggcuggagacugga

SEQ ID NO: 644325 - RNA, 16 nt, Homo sapiens
acgccuggcuaauaag

SEQ ID NO: 644326 - RNA, 13 nt, Homo sapiens
acgccuguagucc

SEQ ID NO: 644327 - RNA, 12 nt, Homo sapiens
acgccuuccucu

SEQ ID NO: 644328 - RNA, 22 nt, Homo sapiens
acgcgggacgucccugcccaug

SEQ ID NO: 644329 - RNA, 14 nt, Homo sapiens
acgcuccccugaga

SEQ ID NO: 644330 - RNA, 23 nt, Homo sapiens
acgcuccuuugugugugugucag

SEQ ID NO: 644331 - RNA, 20 nt, Homo sapiens
acgcugcccugcaugcugcc

SEQ ID NO: 644332 - RNA, 21 nt, Homo sapiens
acgcugccugccaaaguaguc

SEQ ID NO: 644333 - RNA, 16 nt, Homo sapiens
acgcuguuuguuucau

SEQ ID NO: 644334 - RNA, 19 nt, Homo sapiens
acgcuugcuuuagcacagg

SEQ ID NO: 644335 - RNA, 19 nt, Homo sapiens
acgcuuguaauuggaauac

SEQ ID NO: 644336 - RNA, 17 nt, Homo sapiens
acggacacucaaaagcu

SEQ ID NO: 644337 - RNA, 20 nt, Homo sapiens
acggacugugcauacuuucc

SEQ ID NO: 644338 - RNA, 22 nt, Homo sapiens
acggagccacuccucugacuca

SEQ ID NO: 644339 - RNA, 21 nt, Homo sapiens
acggaguauucuuuaccucag

SEQ ID NO: 644340 - RNA, 23 nt, Homo sapiens
acggaguccuguguuugugaguc

SEQ ID NO: 644341 - RNA, 20 nt, Homo sapiens
acggagucucacucugucac

SEQ ID NO: 644342 - RNA, 16 nt, Homo sapiens
acggagucuugcucug

SEQ ID NO: 644343 - RNA, 15 nt, Homo sapiens
acggauggugcaugg

SEQ ID NO: 644344 - RNA, 13 nt, Homo sapiens
acggcaaccacau

SEQ ID NO: 644345 - RNA, 18 nt, Homo sapiens
acggccacgucaugucuc

SEQ ID NO: 644346 - RNA, 15 nt, Homo sapiens
acggcgcugccucag

SEQ ID NO: 644347 - RNA, 14 nt, Homo sapiens
acggcucuuagcac

SEQ ID NO: 644348 - RNA, 16 nt, Homo sapiens
acggcugcgcacugug

SEQ ID NO: 644349 - RNA, 19 nt, Homo sapiens
acggcugcgcacugugucc

SEQ ID NO: 644350 - RNA, 20 nt, Homo sapiens
acggcugcgcacuguguccu

SEQ ID NO: 644351 - RNA, 14 nt, Homo sapiens
acgggaagcaagau

SEQ ID NO: 644352 - RNA, 17 nt, Homo sapiens
acgggagaauauacaaa

SEQ ID NO: 644353 - RNA, 23 nt, Homo sapiens
acgggagugacccagcuacugaa

SEQ ID NO: 644354 - RNA, 12 nt, Homo sapiens
acgggcagccac

SEQ ID NO: 644355 - RNA, 15 nt, Homo sapiens
acgggcagucugcuc

SEQ ID NO: 644356 - RNA, 16 nt, Homo sapiens
acgggcagucugcucu

SEQ ID NO: 644357 - RNA, 18 nt, Homo sapiens
acgggcaugggcacuccc

SEQ ID NO: 644358 - RNA, 14 nt, Homo sapiens
acgggcucagcaaa

SEQ ID NO: 644359 - RNA, 13 nt, Homo sapiens
acggggacugggg

SEQ ID NO: 644360 - RNA, 16 nt, Homo sapiens
acgguaaguguucuca

SEQ ID NO: 644361 - RNA, 14 nt, Homo sapiens
acgguauccucccu

SEQ ID NO: 644362 - RNA, 13 nt, Homo sapiens
acggucaguccau

SEQ ID NO: 644363 - RNA, 14 nt, Homo sapiens
acgguccaugccuu

SEQ ID NO: 644364 - RNA, 11 nt, Homo sapiens
acggugcaguc

SEQ ID NO: 644365 - RNA, 19 nt, Homo sapiens
acggugcagucugggugcu

SEQ ID NO: 644366 - RNA, 20 nt, Homo sapiens
acggugcuaaaaaugaaaau

SEQ ID NO: 644367 - RNA, 22 nt, Homo sapiens
acgguggccuaggguacaggca

SEQ ID NO: 644368 - RNA, 20 nt, Homo sapiens
acgguguccaugccuuccau

SEQ ID NO: 644369 - RNA, 15 nt, Homo sapiens
acgguguuuugccau

SEQ ID NO: 644370 - RNA, 14 nt, Homo sapiens
acgguuaugaaggc

SEQ ID NO: 644371 - RNA, 23 nt, Homo sapiens
acguaacccauuaaaaugaauuu

SEQ ID NO: 644372 - RNA, 13 nt, Homo sapiens
acguacugguuua

SEQ ID NO: 644373 - RNA, 22 nt, Homo sapiens
acguagccugggcucacugugc

SEQ ID NO: 644374 - RNA, 11 nt, Homo sapiens
acguaucccac

SEQ ID NO: 644375 - RNA, 22 nt, Homo sapiens
acguaucccaccugacaugucc

SEQ ID NO: 644376 - RNA, 17 nt, Homo sapiens
acguaugcaugugaaga

SEQ ID NO: 644377 - RNA, 14 nt, Homo sapiens
acguauggcuccac

SEQ ID NO: 644378 - RNA, 19 nt, Homo sapiens
acguauuuaugucccugac

SEQ ID NO: 644379 - RNA, 22 nt, Homo sapiens
acguauuuuuucuaaugugcau

SEQ ID NO: 644380 - RNA, 14 nt, Homo sapiens
acgucaagucuccu

SEQ ID NO: 644381 - RNA, 15 nt, Homo sapiens
acgucugccuucuuu

SEQ ID NO: 644382 - RNA, 14 nt, Homo sapiens
acgucuucugagaa

SEQ ID NO: 644383 - RNA, 15 nt, Homo sapiens
acgugaaaugcucaa

SEQ ID NO: 644384 - RNA, 13 nt, Homo sapiens
acgugacaggcuc

SEQ ID NO: 644385 - RNA, 14 nt, Homo sapiens
acgugagccaggua

SEQ ID NO: 644386 - RNA, 16 nt, Homo sapiens
acgugauuuccaguga

SEQ ID NO: 644387 - RNA, 18 nt, Homo sapiens
acgugauuuugcuguaga

SEQ ID NO: 644388 - RNA, 23 nt, Homo sapiens
acgugcacugacagccuugccca

SEQ ID NO: 644389 - RNA, 20 nt, Homo sapiens
acgugcagacaggcuggcau

SEQ ID NO: 644390 - RNA, 22 nt, Homo sapiens
acgugcaggacagcucuugauu

SEQ ID NO: 644391 - RNA, 15 nt, Homo sapiens
acguggagagugcac

SEQ ID NO: 644392 - RNA, 19 nt, Homo sapiens
acguggagauagugccagg

SEQ ID NO: 644393 - RNA, 13 nt, Homo sapiens
acguggcacuggu

SEQ ID NO: 644394 - RNA, 20 nt, Homo sapiens
acguggccucuugagcagug

SEQ ID NO: 644395 - RNA, 14 nt, Homo sapiens
acguggcucagcca

SEQ ID NO: 644396 - RNA, 16 nt, Homo sapiens
acguggcucagccagc

SEQ ID NO: 644397 - RNA, 20 nt, Homo sapiens
acgugguaugaaaugucuga

SEQ ID NO: 644398 - RNA, 22 nt, Homo sapiens
acguguccguccacccuuccau

SEQ ID NO: 644399 - RNA, 15 nt, Homo sapiens
acgugucuuccacuu

SEQ ID NO: 644400 - RNA, 18 nt, Homo sapiens
acgugucuuccacuuugc

SEQ ID NO: 644401 - RNA, 19 nt, Homo sapiens
acgugucuuccacuuugca

SEQ ID NO: 644402 - RNA, 22 nt, Homo sapiens
acgugucuuccacuuugcauau

SEQ ID NO: 644403 - RNA, 22 nt, Homo sapiens
acguuagauuugccguaccaau

SEQ ID NO: 644404 - RNA, 18 nt, Homo sapiens
acguuaguucuacauuau

SEQ ID NO: 644405 - RNA, 14 nt, Homo sapiens
acguucugcugcuu

SEQ ID NO: 644406 - RNA, 23 nt, Homo sapiens
acguugaucccagagagcagcuu

SEQ ID NO: 644407 - RNA, 18 nt, Homo sapiens
acguugccucuacuuuau

SEQ ID NO: 644408 - RNA, 22 nt, Homo sapiens
acguuggucuugaacuccugac

SEQ ID NO: 644409 - RNA, 20 nt, Homo sapiens
acguuucucauuaaaaucca

SEQ ID NO: 644410 - RNA, 23 nt, Homo sapiens
acuaaaaaaauuuuugacacuuu

SEQ ID NO: 644411 - RNA, 17 nt, Homo sapiens
acuaaaaaguauugcau

SEQ ID NO: 644412 - RNA, 20 nt, Homo sapiens
acuaaaaaguggauuacaaa

SEQ ID NO: 644413 - RNA, 20 nt, Homo sapiens
acuaaaagcagcgucacucu

SEQ ID NO: 644414 - RNA, 18 nt, Homo sapiens
acuaaaaguugcauuuua

SEQ ID NO: 644415 - RNA, 12 nt, Homo sapiens
acuaaacucaac

SEQ ID NO: 644416 - RNA, 19 nt, Homo sapiens
acuaaacugguugucaguu

SEQ ID NO: 644417 - RNA, 18 nt, Homo sapiens
acuaaagacgguauuaaa

SEQ ID NO: 644418 - RNA, 13 nt, Homo sapiens
acuaaagauuaaa

SEQ ID NO: 644419 - RNA, 18 nt, Homo sapiens
acuaaaggugcacugcuu

SEQ ID NO: 644420 - RNA, 12 nt, Homo sapiens
acuaaaguauau

SEQ ID NO: 644421 - RNA, 17 nt, Homo sapiens
acuaaaguauaucuuua

SEQ ID NO: 644422 - RNA, 13 nt, Homo sapiens
acuaaaucccucc

SEQ ID NO: 644423 - RNA, 24 nt, Homo sapiens
acuaaaugcucauacacaguuaaa

SEQ ID NO: 644424 - RNA, 15 nt, Homo sapiens
acuaacagauaagca

SEQ ID NO: 644425 - RNA, 17 nt, Homo sapiens
acuaacagauaagcaag

SEQ ID NO: 644426 - RNA, 20 nt, Homo sapiens
acuaacaggagaaugcacag

SEQ ID NO: 644427 - RNA, 14 nt, Homo sapiens
acuaaccaaugccu

SEQ ID NO: 644428 - RNA, 14 nt, Homo sapiens
acuaacccuguggu

SEQ ID NO: 644429 - RNA, 18 nt, Homo sapiens
acuaaccuggguucccuu

SEQ ID NO: 644430 - RNA, 22 nt, Homo sapiens
acuaacgcaaccaagugugcua

SEQ ID NO: 644431 - RNA, 16 nt, Homo sapiens
acuaacuccugagaaa

SEQ ID NO: 644432 - RNA, 21 nt, Homo sapiens
acuaacuccugagaaauguua

SEQ ID NO: 644433 - RNA, 14 nt, Homo sapiens
acuaacuuacuguc

SEQ ID NO: 644434 - RNA, 17 nt, Homo sapiens
acuaacuuacuguccac

SEQ ID NO: 644435 - RNA, 15 nt, Homo sapiens
acuaagauacuccau

SEQ ID NO: 644436 - RNA, 15 nt, Homo sapiens
acuaagaucuguuaa

SEQ ID NO: 644437 - RNA, 19 nt, Homo sapiens
acuaagaugaaaugcacug

SEQ ID NO: 644438 - RNA, 21 nt, Homo sapiens
acuaagaugaaaugcacugua

SEQ ID NO: 644439 - RNA, 20 nt, Homo sapiens
acuaagaugaucaucuccag

SEQ ID NO: 644440 - RNA, 20 nt, Homo sapiens
acuaagcaguaagcuaucuu

SEQ ID NO: 644441 - RNA, 15 nt, Homo sapiens
acuaagcuuugccag

SEQ ID NO: 644442 - RNA, 15 nt, Homo sapiens
acuaaggagcaugau

SEQ ID NO: 644443 - RNA, 21 nt, Homo sapiens
acuaaggaguaaucuguguac

SEQ ID NO: 644444 - RNA, 20 nt, Homo sapiens
acuaagggauggggcagucu

SEQ ID NO: 644445 - RNA, 18 nt, Homo sapiens
acuaagggguauguuccc

SEQ ID NO: 644446 - RNA, 12 nt, Homo sapiens
acuaagugaugc

SEQ ID NO: 644447 - RNA, 23 nt, Homo sapiens
acuaauagaauaaaggcaguuuu

SEQ ID NO: 644448 - RNA, 17 nt, Homo sapiens
acuaaucgaaugaacaa

SEQ ID NO: 644449 - RNA, 22 nt, Homo sapiens
acuaaucugauguuaaccaaug

SEQ ID NO: 644450 - RNA, 21 nt, Homo sapiens
acuaaucuuauucauuuucuc

SEQ ID NO: 644451 - RNA, 15 nt, Homo sapiens
acuaaugaacaaaua

SEQ ID NO: 644452 - RNA, 12 nt, Homo sapiens
acuaaugaagug

SEQ ID NO: 644453 - RNA, 14 nt, Homo sapiens
acuaauggaaauau

SEQ ID NO: 644454 - RNA, 17 nt, Homo sapiens
acuaauguacuguacau

SEQ ID NO: 644455 - RNA, 14 nt, Homo sapiens
acuaauuaggcaag

SEQ ID NO: 644456 - RNA, 18 nt, Homo sapiens
acuaauucuaauguggac

SEQ ID NO: 644457 - RNA, 21 nt, Homo sapiens
acuaauuuuaguauucauucu

SEQ ID NO: 644458 - RNA, 14 nt, Homo sapiens
acuaauuuuugcuu

SEQ ID NO: 644459 - RNA, 16 nt, Homo sapiens
acuacaaagcuucuau

SEQ ID NO: 644460 - RNA, 19 nt, Homo sapiens
acuacacacuaaaacuuuc

SEQ ID NO: 644461 - RNA, 14 nt, Homo sapiens
acuacacagcacac

SEQ ID NO: 644462 - RNA, 21 nt, Homo sapiens
acuacaccuggcugagguucc

SEQ ID NO: 644463 - RNA, 13 nt, Homo sapiens
acuacacugagga

SEQ ID NO: 644464 - RNA, 21 nt, Homo sapiens
acuacagaauaauguguuaaa

SEQ ID NO: 644465 - RNA, 22 nt, Homo sapiens
acuacagggagaaaauccaggu

SEQ ID NO: 644466 - RNA, 16 nt, Homo sapiens
acuacauaacuuccua

SEQ ID NO: 644467 - RNA, 23 nt, Homo sapiens
acuacaugugacuggcaguauua

SEQ ID NO: 644468 - RNA, 19 nt, Homo sapiens
acuacauuugugaacaaaa

SEQ ID NO: 644469 - RNA, 23 nt, Homo sapiens
acuaccccuccucagacaacagc

SEQ ID NO: 644470 - RNA, 13 nt, Homo sapiens
acuaccuguguau

SEQ ID NO: 644471 - RNA, 19 nt, Homo sapiens
acuacgguugaucuugcaa

SEQ ID NO: 644472 - RNA, 21 nt, Homo sapiens
acuacuccucugcagugccuu

SEQ ID NO: 644473 - RNA, 13 nt, Homo sapiens
acuacugcuaaug

SEQ ID NO: 644474 - RNA, 13 nt, Homo sapiens
acuacugcuccug

SEQ ID NO: 644475 - RNA, 16 nt, Homo sapiens
acuacuguacacggac

SEQ ID NO: 644476 - RNA, 16 nt, Homo sapiens
acuacuucucuuguua

SEQ ID NO: 644477 - RNA, 21 nt, Homo sapiens
acuacuuggaacuaggcucuu

SEQ ID NO: 644478 - RNA, 20 nt, Homo sapiens
acuacuuugaaaacaauuca

SEQ ID NO: 644479 - RNA, 14 nt, Homo sapiens
acuagaacucucca

SEQ ID NO: 644480 - RNA, 23 nt, Homo sapiens
acuagaagaaaagcccauuuuca

SEQ ID NO: 644481 - RNA, 20 nt, Homo sapiens
acuagaauagugcauuguau

SEQ ID NO: 644482 - RNA, 18 nt, Homo sapiens
acuagaggcuugcauaau

SEQ ID NO: 644483 - RNA, 19 nt, Homo sapiens
acuagagugcucugacccu

SEQ ID NO: 644484 - RNA, 15 nt, Homo sapiens
acuagauucuuguca

SEQ ID NO: 644485 - RNA, 19 nt, Homo sapiens
acuagcaggcaaugcugua

SEQ ID NO: 644486 - RNA, 16 nt, Homo sapiens
acuagcaggcaugccg

SEQ ID NO: 644487 - RNA, 18 nt, Homo sapiens
acuagccaaaccaggacc

SEQ ID NO: 644488 - RNA, 21 nt, Homo sapiens
acuagccagacaaaauuugag

SEQ ID NO: 644489 - RNA, 17 nt, Homo sapiens
acuagccagacacucug

SEQ ID NO: 644490 - RNA, 14 nt, Homo sapiens
acuagccugugauu

SEQ ID NO: 644491 - RNA, 15 nt, Homo sapiens
acuagccugugauua

SEQ ID NO: 644492 - RNA, 16 nt, Homo sapiens
acuagcuuacugauga

SEQ ID NO: 644493 - RNA, 19 nt, Homo sapiens
acuagcuuacugaugaugu

SEQ ID NO: 644494 - RNA, 15 nt, Homo sapiens
acuaggaaauuccaa

SEQ ID NO: 644495 - RNA, 13 nt, Homo sapiens
acuaggacacucc

SEQ ID NO: 644496 - RNA, 14 nt, Homo sapiens
acuaggagcacugu

SEQ ID NO: 644497 - RNA, 14 nt, Homo sapiens
acuaggcuguguau

SEQ ID NO: 644498 - RNA, 19 nt, Homo sapiens
acuaguaguuccugcuaca

SEQ ID NO: 644499 - RNA, 19 nt, Homo sapiens
acuagucacauucuuguuu

SEQ ID NO: 644500 - RNA, 21 nt, Homo sapiens
acuagucuguguaacuuuaaa

SEQ ID NO: 644501 - RNA, 11 nt, Homo sapiens
acuagugcaau

SEQ ID NO: 644502 - RNA, 18 nt, Homo sapiens
acuaguggcucucaguua

SEQ ID NO: 644503 - RNA, 20 nt, Homo sapiens
acuaguuagauucacuuuga

SEQ ID NO: 644504 - RNA, 18 nt, Homo sapiens
acuaguucaaaugaugaa

SEQ ID NO: 644505 - RNA, 20 nt, Homo sapiens
acuaguucagacacuuugga

SEQ ID NO: 644506 - RNA, 16 nt, Homo sapiens
acuaguuuaaugugga

SEQ ID NO: 644507 - RNA, 17 nt, Homo sapiens
acuaguuuuuauuccuu

SEQ ID NO: 644508 - RNA, 13 nt, Homo sapiens
acuauaaacauuu

SEQ ID NO: 644509 - RNA, 20 nt, Homo sapiens
acuauaaacuuaagggcaag

SEQ ID NO: 644510 - RNA, 21 nt, Homo sapiens
acuauaagcagaagcacauau

SEQ ID NO: 644511 - RNA, 15 nt, Homo sapiens
acuauacagccauaa

SEQ ID NO: 644512 - RNA, 12 nt, Homo sapiens
acuauacuugau

SEQ ID NO: 644513 - RNA, 17 nt, Homo sapiens
acuauauuuauacugua

SEQ ID NO: 644514 - RNA, 15 nt, Homo sapiens
acuaugugcaaaaau

SEQ ID NO: 644515 - RNA, 15 nt, Homo sapiens
acuauguuucuauuc

SEQ ID NO: 644516 - RNA, 18 nt, Homo sapiens
acuauguuuggaguuuaa

SEQ ID NO: 644517 - RNA, 15 nt, Homo sapiens
acuauuaagcaguaa

SEQ ID NO: 644518 - RNA, 22 nt, Homo sapiens
acuauucuaaugaaaacauuaa

SEQ ID NO: 644519 - RNA, 11 nt, Homo sapiens
acuauugcaca

SEQ ID NO: 644520 - RNA, 20 nt, Homo sapiens
acuauugcagaccugucacc

SEQ ID NO: 644521 - RNA, 14 nt, Homo sapiens
acuauugcauuuau

SEQ ID NO: 644522 - RNA, 21 nt, Homo sapiens
acuauuguuacauuaugugga

SEQ ID NO: 644523 - RNA, 22 nt, Homo sapiens
acuauuguuacauuauguggaa

SEQ ID NO: 644524 - RNA, 23 nt, Homo sapiens
acuauuuaguuuuuuuaaugugu

SEQ ID NO: 644525 - RNA, 17 nt, Homo sapiens
acuauuuaucugugcaa

SEQ ID NO: 644526 - RNA, 21 nt, Homo sapiens
acuauuuucauucucuuguua

SEQ ID NO: 644527 - RNA, 22 nt, Homo sapiens
acucaaaagcugggaaccagca

SEQ ID NO: 644528 - RNA, 17 nt, Homo sapiens
acucaaacagucuuucu

SEQ ID NO: 644529 - RNA, 23 nt, Homo sapiens
acucaaacgccgcugacugccac

SEQ ID NO: 644530 - RNA, 14 nt, Homo sapiens
acucaaacugagga

SEQ ID NO: 644531 - RNA, 19 nt, Homo sapiens
acucaacucugagcccaua

SEQ ID NO: 644532 - RNA, 12 nt, Homo sapiens
acucaacuuuca

SEQ ID NO: 644533 - RNA, 23 nt, Homo sapiens
acucaaggggcuggaaucucaug

SEQ ID NO: 644534 - RNA, 18 nt, Homo sapiens
acucaaugagcucuucca

SEQ ID NO: 644535 - RNA, 17 nt, Homo sapiens
acucaauggccuaaaac

SEQ ID NO: 644536 - RNA, 14 nt, Homo sapiens
acucacaagcaauc

SEQ ID NO: 644537 - RNA, 11 nt, Homo sapiens
acucacacagg

SEQ ID NO: 644538 - RNA, 17 nt, Homo sapiens
acucacacaugccacaa

SEQ ID NO: 644539 - RNA, 13 nt, Homo sapiens
acucacaccugua

SEQ ID NO: 644540 - RNA, 12 nt, Homo sapiens
acucacacuccc

SEQ ID NO: 644541 - RNA, 19 nt, Homo sapiens
acucacacuuacugcaaag

SEQ ID NO: 644542 - RNA, 20 nt, Homo sapiens
acucacauccugaccuugca

SEQ ID NO: 644543 - RNA, 18 nt, Homo sapiens
acucacauucucuuccca

SEQ ID NO: 644544 - RNA, 15 nt, Homo sapiens
acucaccaaacacaa

SEQ ID NO: 644545 - RNA, 21 nt, Homo sapiens
acucaccacuaccagccagcc

SEQ ID NO: 644546 - RNA, 21 nt, Homo sapiens
acucaccagccccacugccag

SEQ ID NO: 644547 - RNA, 17 nt, Homo sapiens
acucaccucugccucaa

SEQ ID NO: 644548 - RNA, 17 nt, Homo sapiens
acucaccugcacuaaca

SEQ ID NO: 644549 - RNA, 15 nt, Homo sapiens
acucacucacuccaa

SEQ ID NO: 644550 - RNA, 20 nt, Homo sapiens
acucacuccacaacccaaga

SEQ ID NO: 644551 - RNA, 23 nt, Homo sapiens
acucacugaggguaucugacaau

SEQ ID NO: 644552 - RNA, 14 nt, Homo sapiens
acucacugcucaag

SEQ ID NO: 644553 - RNA, 20 nt, Homo sapiens
acucacuuaucccaagagaa

SEQ ID NO: 644554 - RNA, 15 nt, Homo sapiens
acucacuuguaagaa

SEQ ID NO: 644555 - RNA, 20 nt, Homo sapiens
acucagaaauguaguuugca

SEQ ID NO: 644556 - RNA, 21 nt, Homo sapiens
acucagaacuucugccucuaa

SEQ ID NO: 644557 - RNA, 15 nt, Homo sapiens
acucagagcagauga

SEQ ID NO: 644558 - RNA, 17 nt, Homo sapiens
acucagagggcuggauu

SEQ ID NO: 644559 - RNA, 15 nt, Homo sapiens
acucagcaguugaca

SEQ ID NO: 644560 - RNA, 12 nt, Homo sapiens
acucagcauuug

SEQ ID NO: 644561 - RNA, 16 nt, Homo sapiens
acucagcuaucagcuc

SEQ ID NO: 644562 - RNA, 19 nt, Homo sapiens
acucagcucuuggcuccac

SEQ ID NO: 644563 - RNA, 12 nt, Homo sapiens
acucagcugcca

SEQ ID NO: 644564 - RNA, 18 nt, Homo sapiens
acucagggcagcugccug

SEQ ID NO: 644565 - RNA, 19 nt, Homo sapiens
acucagggccccagcacua

SEQ ID NO: 644566 - RNA, 20 nt, Homo sapiens
acucagggcuccucccagcu

SEQ ID NO: 644567 - RNA, 22 nt, Homo sapiens
acucagguaccucuuucagggu

SEQ ID NO: 644568 - RNA, 16 nt, Homo sapiens
acucaggugauuccag

SEQ ID NO: 644569 - RNA, 20 nt, Homo sapiens
acucaggugauuccaggaug

SEQ ID NO: 644570 - RNA, 19 nt, Homo sapiens
acucaguaaaauguuuaau

SEQ ID NO: 644571 - RNA, 15 nt, Homo sapiens
acucaguacuguaca

SEQ ID NO: 644572 - RNA, 18 nt, Homo sapiens
acucaguauagcauugaa

SEQ ID NO: 644573 - RNA, 12 nt, Homo sapiens
acucaguauuau

SEQ ID NO: 644574 - RNA, 16 nt, Homo sapiens
acucagucucuuccac

SEQ ID NO: 644575 - RNA, 12 nt, Homo sapiens
acucagugcuaa

SEQ ID NO: 644576 - RNA, 11 nt, Homo sapiens
acucaguucca

SEQ ID NO: 644577 - RNA, 16 nt, Homo sapiens
acucaguuucuaggca

SEQ ID NO: 644578 - RNA, 22 nt, Homo sapiens
acucaguuugucagacuuuaaa

SEQ ID NO: 644579 - RNA, 23 nt, Homo sapiens
acucauagcgggggccuaaaaaa

SEQ ID NO: 644580 - RNA, 19 nt, Homo sapiens
acucaucaauggggccagu

SEQ ID NO: 644581 - RNA, 18 nt, Homo sapiens
acucaucgggcccaggga

SEQ ID NO: 644582 - RNA, 17 nt, Homo sapiens
acucaucuuagugccug

SEQ ID NO: 644583 - RNA, 19 nt, Homo sapiens
acucauuaaugaaucacau

SEQ ID NO: 644584 - RNA, 19 nt, Homo sapiens
acucauuaucacagugaau

SEQ ID NO: 644585 - RNA, 22 nt, Homo sapiens
acucauucccauguugucaaua

SEQ ID NO: 644586 - RNA, 11 nt, Homo sapiens
acucauuucac

SEQ ID NO: 644587 - RNA, 21 nt, Homo sapiens
acuccaaaaggcccuuuucag

SEQ ID NO: 644588 - RNA, 14 nt, Homo sapiens
acuccaagaccacc

SEQ ID NO: 644589 - RNA, 12 nt, Homo sapiens
acuccacacucu

SEQ ID NO: 644590 - RNA, 14 nt, Homo sapiens
acuccacagaguga

SEQ ID NO: 644591 - RNA, 15 nt, Homo sapiens
acuccacccuguuag

SEQ ID NO: 644592 - RNA, 20 nt, Homo sapiens
acuccaccgaccaacugccc

SEQ ID NO: 644593 - RNA, 12 nt, Homo sapiens
acuccaccucaa

SEQ ID NO: 644594 - RNA, 13 nt, Homo sapiens
acuccacugcccu

SEQ ID NO: 644595 - RNA, 16 nt, Homo sapiens
acuccagagacaggga

SEQ ID NO: 644596 - RNA, 20 nt, Homo sapiens
acuccagauuuuuuacagcu

SEQ ID NO: 644597 - RNA, 15 nt, Homo sapiens
acuccagccugggca

SEQ ID NO: 644598 - RNA, 19 nt, Homo sapiens
acuccagcgcugaguggga

SEQ ID NO: 644599 - RNA, 21 nt, Homo sapiens
acuccagcuugggcaacagag

SEQ ID NO: 644600 - RNA, 14 nt, Homo sapiens
acuccauacauaac

SEQ ID NO: 644601 - RNA, 22 nt, Homo sapiens
acuccauaguuugggcuuguac

SEQ ID NO: 644602 - RNA, 22 nt, Homo sapiens
acuccaucuugguaguucugug

SEQ ID NO: 644603 - RNA, 13 nt, Homo sapiens
acuccaugcugcc

SEQ ID NO: 644604 - RNA, 22 nt, Homo sapiens
acuccauggcuaagaccacaga

SEQ ID NO: 644605 - RNA, 23 nt, Homo sapiens
acuccauggcuaagaccacagac

SEQ ID NO: 644606 - RNA, 20 nt, Homo sapiens
acuccauucaaaucuacggu

SEQ ID NO: 644607 - RNA, 16 nt, Homo sapiens
acuccccaacugaguu

SEQ ID NO: 644608 - RNA, 20 nt, Homo sapiens
acuccccagagcugugccag

SEQ ID NO: 644609 - RNA, 16 nt, Homo sapiens
acucccccagcuuucc

SEQ ID NO: 644610 - RNA, 17 nt, Homo sapiens
acucccgccacauuuua

SEQ ID NO: 644611 - RNA, 21 nt, Homo sapiens
acucccuaauuuaugugcuau

SEQ ID NO: 644612 - RNA, 17 nt, Homo sapiens
acucccugcagaugcca

SEQ ID NO: 644613 - RNA, 18 nt, Homo sapiens
acucccugcugugugacu

SEQ ID NO: 644614 - RNA, 20 nt, Homo sapiens
acucccuguuuuaauucaac

SEQ ID NO: 644615 - RNA, 22 nt, Homo sapiens
acuccggcuuguccucaucucu

SEQ ID NO: 644616 - RNA, 20 nt, Homo sapiens
acuccgggaccauugaccuc

SEQ ID NO: 644617 - RNA, 13 nt, Homo sapiens
acuccuacuaaau

SEQ ID NO: 644618 - RNA, 13 nt, Homo sapiens
acuccuagacuuu

SEQ ID NO: 644619 - RNA, 19 nt, Homo sapiens
acuccucaggcagcgugug

SEQ ID NO: 644620 - RNA, 19 nt, Homo sapiens
acuccuccaaggaaaggga

SEQ ID NO: 644621 - RNA, 16 nt, Homo sapiens
acuccuccaaggcaca

SEQ ID NO: 644622 - RNA, 14 nt, Homo sapiens
acuccuuugcuaau

SEQ ID NO: 644623 - RNA, 21 nt, Homo sapiens
acuccuuuugguuuaccuggg

SEQ ID NO: 644624 - RNA, 19 nt, Homo sapiens
acuccuuuuuugcaugugc

SEQ ID NO: 644625 - RNA, 19 nt, Homo sapiens
acucgagaccauccuggcc

SEQ ID NO: 644626 - RNA, 16 nt, Homo sapiens
acucgagagugggcag

SEQ ID NO: 644627 - RNA, 17 nt, Homo sapiens
acucgagucacacucaa

SEQ ID NO: 644628 - RNA, 16 nt, Homo sapiens
acucgcccuaggcccu

SEQ ID NO: 644629 - RNA, 14 nt, Homo sapiens
acucgcuagcacuc

SEQ ID NO: 644630 - RNA, 14 nt, Homo sapiens
acucggauuccagc

SEQ ID NO: 644631 - RNA, 15 nt, Homo sapiens
acucggccacugugu

SEQ ID NO: 644632 - RNA, 21 nt, Homo sapiens
acucggggcaggccagcaaua

SEQ ID NO: 644633 - RNA, 13 nt, Homo sapiens
acucuacaauucc

SEQ ID NO: 644634 - RNA, 13 nt, Homo sapiens
acucuacacugaa

SEQ ID NO: 644635 - RNA, 19 nt, Homo sapiens
acucuaccaaauaauuuca

SEQ ID NO: 644636 - RNA, 13 nt, Homo sapiens
acucuacccuaua

SEQ ID NO: 644637 - RNA, 23 nt, Homo sapiens
acucuacuucagucaauagccau

SEQ ID NO: 644638 - RNA, 18 nt, Homo sapiens
acucuagaagaccaaaug

SEQ ID NO: 644639 - RNA, 16 nt, Homo sapiens
acucuagaauguccau

SEQ ID NO: 644640 - RNA, 21 nt, Homo sapiens
acucuagaugaaguuuuacau

SEQ ID NO: 644641 - RNA, 20 nt, Homo sapiens
acucuaggggucaggcucca

SEQ ID NO: 644642 - RNA, 14 nt, Homo sapiens
acucuagugcuaca

SEQ ID NO: 644643 - RNA, 18 nt, Homo sapiens
acucuagugcuacaugau

SEQ ID NO: 644644 - RNA, 20 nt, Homo sapiens
acucuauaagauuccaaaaa

SEQ ID NO: 644645 - RNA, 23 nt, Homo sapiens
acucucacaagauggaaaucaca

SEQ ID NO: 644646 - RNA, 15 nt, Homo sapiens
acucucacacugaau

SEQ ID NO: 644647 - RNA, 18 nt, Homo sapiens
acucucaucaccccagag

SEQ ID NO: 644648 - RNA, 17 nt, Homo sapiens
acucuccaaacagucac

SEQ ID NO: 644649 - RNA, 14 nt, Homo sapiens
acucuccccuuguc

SEQ ID NO: 644650 - RNA, 20 nt, Homo sapiens
acucucugucuucucuccac

SEQ ID NO: 644651 - RNA, 12 nt, Homo sapiens
acucucuguuca

SEQ ID NO: 644652 - RNA, 22 nt, Homo sapiens
acucugaaaaacauuccaggaa

SEQ ID NO: 644653 - RNA, 23 nt, Homo sapiens
acucugacguugaucccagagag

SEQ ID NO: 644654 - RNA, 15 nt, Homo sapiens
acucugagaacuccu

SEQ ID NO: 644655 - RNA, 18 nt, Homo sapiens
acucugagaacuccucau

SEQ ID NO: 644656 - RNA, 15 nt, Homo sapiens
acucugagaucuaag

SEQ ID NO: 644657 - RNA, 14 nt, Homo sapiens
acucugagcccaua

SEQ ID NO: 644658 - RNA, 13 nt, Homo sapiens
acucugagcugcu

SEQ ID NO: 644659 - RNA, 21 nt, Homo sapiens
acucugauggaaugugccacc

SEQ ID NO: 644660 - RNA, 16 nt, Homo sapiens
acucugauguggaaug

SEQ ID NO: 644661 - RNA, 16 nt, Homo sapiens
acucugauucaccucu

SEQ ID NO: 644662 - RNA, 16 nt, Homo sapiens
acucugcaaaggccug

SEQ ID NO: 644663 - RNA, 16 nt, Homo sapiens
acucugcauccagaga

SEQ ID NO: 644664 - RNA, 24 nt, Homo sapiens
acucugccagaguagugaagcuaa

SEQ ID NO: 644665 - RNA, 22 nt, Homo sapiens
acucugcccucuagagccuuca

SEQ ID NO: 644666 - RNA, 20 nt, Homo sapiens
acucugccuuuaugaugcua

SEQ ID NO: 644667 - RNA, 15 nt, Homo sapiens
acucugccuuucuaa

SEQ ID NO: 644668 - RNA, 16 nt, Homo sapiens
acucugcuccaaagua

SEQ ID NO: 644669 - RNA, 16 nt, Homo sapiens
acucuggagcauuucu

SEQ ID NO: 644670 - RNA, 22 nt, Homo sapiens
acucugggcagggacccggggu

SEQ ID NO: 644671 - RNA, 23 nt, Homo sapiens
acucugggcuguaacguggcacu

SEQ ID NO: 644672 - RNA, 22 nt, Homo sapiens
acucuggguuuauuacauggca

SEQ ID NO: 644673 - RNA, 15 nt, Homo sapiens
acucugguggccacu

SEQ ID NO: 644674 - RNA, 17 nt, Homo sapiens
acucugguuucuaccag

SEQ ID NO: 644675 - RNA, 22 nt, Homo sapiens
acucuguaauugaauauaaaug

SEQ ID NO: 644676 - RNA, 18 nt, Homo sapiens
acucuguaguuacugugg

SEQ ID NO: 644677 - RNA, 17 nt, Homo sapiens
acucuguuauuuagacu

SEQ ID NO: 644678 - RNA, 16 nt, Homo sapiens
acucuuacagagccuu

SEQ ID NO: 644679 - RNA, 19 nt, Homo sapiens
acucuuagccccagacucu

SEQ ID NO: 644680 - RNA, 14 nt, Homo sapiens
acucuuaucuacau

SEQ ID NO: 644681 - RNA, 15 nt, Homo sapiens
acucuucagaggaau

SEQ ID NO: 644682 - RNA, 13 nt, Homo sapiens
acucuucauucag

SEQ ID NO: 644683 - RNA, 16 nt, Homo sapiens
acucuuccaaaggcau

SEQ ID NO: 644684 - RNA, 13 nt, Homo sapiens
acucuucccacau

SEQ ID NO: 644685 - RNA, 21 nt, Homo sapiens
acucuucccucucucacuccc

SEQ ID NO: 644686 - RNA, 23 nt, Homo sapiens
acucuucccuuccccucucucau

SEQ ID NO: 644687 - RNA, 21 nt, Homo sapiens
acucuuccgaaaaauccucuu

SEQ ID NO: 644688 - RNA, 21 nt, Homo sapiens
acucuuccuuccuaauaggca

SEQ ID NO: 644689 - RNA, 16 nt, Homo sapiens
acucuucuuugcugca

SEQ ID NO: 644690 - RNA, 16 nt, Homo sapiens
acucuugaacugggcg

SEQ ID NO: 644691 - RNA, 15 nt, Homo sapiens
acucuugugaauuau

SEQ ID NO: 644692 - RNA, 24 nt, Homo sapiens
acucuuuaaaggauaauuauccaa

SEQ ID NO: 644693 - RNA, 21 nt, Homo sapiens
acucuuucugaggagcuguua

SEQ ID NO: 644694 - RNA, 20 nt, Homo sapiens
acugaaaaaucuaagugaua

SEQ ID NO: 644695 - RNA, 16 nt, Homo sapiens
acugaaaaaugucagu

SEQ ID NO: 644696 - RNA, 22 nt, Homo sapiens
acugaaaaugauuccuggacau

SEQ ID NO: 644697 - RNA, 14 nt, Homo sapiens
acugaaacauuuaa

SEQ ID NO: 644698 - RNA, 18 nt, Homo sapiens
acugaaacgccuugcacg

SEQ ID NO: 644699 - RNA, 12 nt, Homo sapiens
acugaaacugga

SEQ ID NO: 644700 - RNA, 13 nt, Homo sapiens
acugaaacuggaa

SEQ ID NO: 644701 - RNA, 15 nt, Homo sapiens
acugaaagaagacau

SEQ ID NO: 644702 - RNA, 16 nt, Homo sapiens
acugaaagaugaucau

SEQ ID NO: 644703 - RNA, 17 nt, Homo sapiens
acugaaagguagacuuu

SEQ ID NO: 644704 - RNA, 21 nt, Homo sapiens
acugaaauaaaccugcacuga

SEQ ID NO: 644705 - RNA, 17 nt, Homo sapiens
acugaaaugaccaagac

SEQ ID NO: 644706 - RNA, 20 nt, Homo sapiens
acugaacaaaaccuacacac

SEQ ID NO: 644707 - RNA, 17 nt, Homo sapiens
acugaaccacucuccca

SEQ ID NO: 644708 - RNA, 20 nt, Homo sapiens
acugaaccauuccaacuuca

SEQ ID NO: 644709 - RNA, 15 nt, Homo sapiens
acugaacucacuuuc

SEQ ID NO: 644710 - RNA, 16 nt, Homo sapiens
acugaacuguguguaa

SEQ ID NO: 644711 - RNA, 21 nt, Homo sapiens
acugaacuuaauaacugugua

SEQ ID NO: 644712 - RNA, 19 nt, Homo sapiens
acugaaggagaaggugccc

SEQ ID NO: 644713 - RNA, 13 nt, Homo sapiens
acugaaggcauau

SEQ ID NO: 644714 - RNA, 16 nt, Homo sapiens
acugaaggugauggag

SEQ ID NO: 644715 - RNA, 19 nt, Homo sapiens
acugaagucuuuucuguca

SEQ ID NO: 644716 - RNA, 14 nt, Homo sapiens
acugaaguuucaca

SEQ ID NO: 644717 - RNA, 22 nt, Homo sapiens
acugaauagauaugaaagcuga

SEQ ID NO: 644718 - RNA, 23 nt, Homo sapiens
acugaauauuaaaaagauagacu

SEQ ID NO: 644719 - RNA, 11 nt, Homo sapiens
acugaaucuau

SEQ ID NO: 644720 - RNA, 22 nt, Homo sapiens
acugaaucuucaagaccaaagc

SEQ ID NO: 644721 - RNA, 18 nt, Homo sapiens
acugaauguaaacaaagg

SEQ ID NO: 644722 - RNA, 15 nt, Homo sapiens
acugaauucagcacc

SEQ ID NO: 644723 - RNA, 13 nt, Homo sapiens
acugaauucugcc

SEQ ID NO: 644724 - RNA, 23 nt, Homo sapiens
acugaauucugccuugguucugg

SEQ ID NO: 644725 - RNA, 15 nt, Homo sapiens
acugaauugcaaaau

SEQ ID NO: 644726 - RNA, 19 nt, Homo sapiens
acugaauuugggccucuug

SEQ ID NO: 644727 - RNA, 22 nt, Homo sapiens
acugacaacaugcuagguagug

SEQ ID NO: 644728 - RNA, 21 nt, Homo sapiens
acugacaacauuauaacugua

SEQ ID NO: 644729 - RNA, 23 nt, Homo sapiens
acugacacauugcugauaugcaa

SEQ ID NO: 644730 - RNA, 13 nt, Homo sapiens
acugacaguuuac

SEQ ID NO: 644731 - RNA, 11 nt, Homo sapiens
acugaccagcc

SEQ ID NO: 644732 - RNA, 15 nt, Homo sapiens
acugaccagccucca

SEQ ID NO: 644733 - RNA, 20 nt, Homo sapiens
agacaugcacuaugaggaau

SEQ ID NO: 644734 - RNA, 16 nt, Homo sapiens
agacauguaucacugu

SEQ ID NO: 644735 - RNA, 23 nt, Homo sapiens
agacaugucuagccacugaucau

SEQ ID NO: 644736 - RNA, 14 nt, Homo sapiens
agacaugugacauu

SEQ ID NO: 644737 - RNA, 16 nt, Homo sapiens
agacauuacaaugugu

SEQ ID NO: 644738 - RNA, 20 nt, Homo sapiens
agacauucaaaacgugaugu

SEQ ID NO: 644739 - RNA, 13 nt, Homo sapiens
agacauuccacca

SEQ ID NO: 644740 - RNA, 23 nt, Homo sapiens
agacauuccugcgcauggugcag

SEQ ID NO: 644741 - RNA, 13 nt, Homo sapiens
agacauugcucua

SEQ ID NO: 644742 - RNA, 14 nt, Homo sapiens
agacauugcucuca

SEQ ID NO: 644743 - RNA, 19 nt, Homo sapiens
agacauuucugcacauggu

SEQ ID NO: 644744 - RNA, 12 nt, Homo sapiens
agaccaaaauaa

SEQ ID NO: 644745 - RNA, 15 nt, Homo sapiens
agaccaaagaccaag

SEQ ID NO: 644746 - RNA, 22 nt, Homo sapiens
agaccaacuuuucaaugugauu

SEQ ID NO: 644747 - RNA, 15 nt, Homo sapiens
agaccaaguuaucau

SEQ ID NO: 644748 - RNA, 19 nt, Homo sapiens
agaccaauucuaacagcaa

SEQ ID NO: 644749 - RNA, 21 nt, Homo sapiens
agaccacgcccguccugccug

SEQ ID NO: 644750 - RNA, 22 nt, Homo sapiens
agaccacgcccguccugccugu

SEQ ID NO: 644751 - RNA, 15 nt, Homo sapiens
agaccacuguuauca

SEQ ID NO: 644752 - RNA, 18 nt, Homo sapiens
agaccagaagauucuauc

SEQ ID NO: 644753 - RNA, 23 nt, Homo sapiens
agaccagccuggccaacauguca

SEQ ID NO: 644754 - RNA, 19 nt, Homo sapiens
agaccagccuggccaagag

SEQ ID NO: 644755 - RNA, 17 nt, Homo sapiens
agaccagcuuugcagug

SEQ ID NO: 644756 - RNA, 13 nt, Homo sapiens
agaccaguacugg

SEQ ID NO: 644757 - RNA, 13 nt, Homo sapiens
agaccaguccaug

SEQ ID NO: 644758 - RNA, 17 nt, Homo sapiens
agaccaugccagaccca

SEQ ID NO: 644759 - RNA, 20 nt, Homo sapiens
agaccauuuaucugggauua

SEQ ID NO: 644760 - RNA, 18 nt, Homo sapiens
agacccaaggcucacugc

SEQ ID NO: 644761 - RNA, 13 nt, Homo sapiens
agacccacagacu

SEQ ID NO: 644762 - RNA, 17 nt, Homo sapiens
agacccaccacaccgca

SEQ ID NO: 644763 - RNA, 12 nt, Homo sapiens
agacccacugaa

SEQ ID NO: 644764 - RNA, 21 nt, Homo sapiens
agacccagccaugcugugaua

SEQ ID NO: 644765 - RNA, 15 nt, Homo sapiens
agacccagcccagac

SEQ ID NO: 644766 - RNA, 18 nt, Homo sapiens
agacccauaccuuuccag

SEQ ID NO: 644767 - RNA, 16 nt, Homo sapiens
agaccccaaagaucuc

SEQ ID NO: 644768 - RNA, 17 nt, Homo sapiens
agacccccacaccucag

SEQ ID NO: 644769 - RNA, 18 nt, Homo sapiens
agacccccugagccacag

SEQ ID NO: 644770 - RNA, 18 nt, Homo sapiens
agaccccuguucaugccg

SEQ ID NO: 644771 - RNA, 19 nt, Homo sapiens
agacccguagaugccaggg

SEQ ID NO: 644772 - RNA, 21 nt, Homo sapiens
agacccugagaaggacccugg

SEQ ID NO: 644773 - RNA, 19 nt, Homo sapiens
agacccugagacuccagaa

SEQ ID NO: 644774 - RNA, 22 nt, Homo sapiens
agacccuuauugcuguccugga

SEQ ID NO: 644775 - RNA, 15 nt, Homo sapiens
agaccggacccaggu

SEQ ID NO: 644776 - RNA, 19 nt, Homo sapiens
agaccucuuuuucuuacca

SEQ ID NO: 644777 - RNA, 16 nt, Homo sapiens
agaccugacaagcacu

SEQ ID NO: 644778 - RNA, 19 nt, Homo sapiens
agaccugacaagcacugcu

SEQ ID NO: 644779 - RNA, 13 nt, Homo sapiens
agaccugagcugg

SEQ ID NO: 644780 - RNA, 15 nt, Homo sapiens
agaccugagcuggga

SEQ ID NO: 644781 - RNA, 15 nt, Homo sapiens
agaccugcucuggac

SEQ ID NO: 644782 - RNA, 18 nt, Homo sapiens
agaccugcugugaugacu

SEQ ID NO: 644783 - RNA, 16 nt, Homo sapiens
agaccuggaacaaauc

SEQ ID NO: 644784 - RNA, 19 nt, Homo sapiens
agaccuguaaucauauaau

SEQ ID NO: 644785 - RNA, 18 nt, Homo sapiens
agaccuguguuacuaaaa

SEQ ID NO: 644786 - RNA, 14 nt, Homo sapiens
agaccuguuggccu

SEQ ID NO: 644787 - RNA, 19 nt, Homo sapiens
agaccuuggcauccugugc

SEQ ID NO: 644788 - RNA, 20 nt, Homo sapiens
agaccuuggcauccugugcu

SEQ ID NO: 644789 - RNA, 17 nt, Homo sapiens
agacgaaauagugacau

SEQ ID NO: 644790 - RNA, 18 nt, Homo sapiens
agacgccuuccaggucag

SEQ ID NO: 644791 - RNA, 15 nt, Homo sapiens
agacggagucuugcu

SEQ ID NO: 644792 - RNA, 21 nt, Homo sapiens
agacgggaauucaugcaaaug

SEQ ID NO: 644793 - RNA, 21 nt, Homo sapiens
agacgggguuucacuguguua

SEQ ID NO: 644794 - RNA, 21 nt, Homo sapiens
agacgugauuuugcuguagaa

SEQ ID NO: 644795 - RNA, 20 nt, Homo sapiens
agacguggugggacuccagc

SEQ ID NO: 644796 - RNA, 14 nt, Homo sapiens
agacuaacauguca

SEQ ID NO: 644797 - RNA, 14 nt, Homo sapiens
agacuaagaauuag

SEQ ID NO: 644798 - RNA, 13 nt, Homo sapiens
agacuaaggccau

SEQ ID NO: 644799 - RNA, 13 nt, Homo sapiens
agacuaccaggag

SEQ ID NO: 644800 - RNA, 22 nt, Homo sapiens
agacuaugaggaauauuugcaa

SEQ ID NO: 644801 - RNA, 19 nt, Homo sapiens
agacuaugcaaaaguacaa

SEQ ID NO: 644802 - RNA, 21 nt, Homo sapiens
agacuauggauguguucucua

SEQ ID NO: 644803 - RNA, 17 nt, Homo sapiens
agacuauuuuauaugau

SEQ ID NO: 644804 - RNA, 22 nt, Homo sapiens
agacuauuuuucuaugacuuag

SEQ ID NO: 644805 - RNA, 17 nt, Homo sapiens
agacucaaaugcucaga

SEQ ID NO: 644806 - RNA, 14 nt, Homo sapiens
agacucacuugcca

SEQ ID NO: 644807 - RNA, 20 nt, Homo sapiens
agacucagggccccagcacu

SEQ ID NO: 644808 - RNA, 23 nt, Homo sapiens
agacucauggauuggucugaggg

SEQ ID NO: 644809 - RNA, 22 nt, Homo sapiens
agacucaugguguguuacacaa

SEQ ID NO: 644810 - RNA, 23 nt, Homo sapiens
agacucauucccuagaucuuucu

SEQ ID NO: 644811 - RNA, 19 nt, Homo sapiens
agacucugagcugcucacc

SEQ ID NO: 644812 - RNA, 22 nt, Homo sapiens
agacucugccuccugguuuccu

SEQ ID NO: 644813 - RNA, 15 nt, Homo sapiens
agacucugguguucu

SEQ ID NO: 644814 - RNA, 18 nt, Homo sapiens
agacucuguaauugaaua

SEQ ID NO: 644815 - RNA, 17 nt, Homo sapiens
agacucugucuaccugg

SEQ ID NO: 644816 - RNA, 23 nt, Homo sapiens
agacucuuuggguccauucagau

SEQ ID NO: 644817 - RNA, 22 nt, Homo sapiens
agacugaaaauauauaagcuca

SEQ ID NO: 644818 - RNA, 18 nt, Homo sapiens
agacugaaagcagcagcu

SEQ ID NO: 644819 - RNA, 23 nt, Homo sapiens
agacugaauuuuaaauguucaca

SEQ ID NO: 644820 - RNA, 22 nt, Homo sapiens
agacugacuuguuugucuucca

SEQ ID NO: 644821 - RNA, 19 nt, Homo sapiens
agacugcugggacuggcca

SEQ ID NO: 644822 - RNA, 12 nt, Homo sapiens
agacugcuuccc

SEQ ID NO: 644823 - RNA, 17 nt, Homo sapiens
agacugucagcuuccaa

SEQ ID NO: 644824 - RNA, 19 nt, Homo sapiens
agacuguggcuagugacaa

SEQ ID NO: 644825 - RNA, 15 nt, Homo sapiens
agacuguugcucaaa

SEQ ID NO: 644826 - RNA, 23 nt, Homo sapiens
agacuguugcucaaaucuauuca

SEQ ID NO: 644827 - RNA, 17 nt, Homo sapiens
agacuuaaaucacagau

SEQ ID NO: 644828 - RNA, 20 nt, Homo sapiens
agacuuauggaacagggaug

SEQ ID NO: 644829 - RNA, 16 nt, Homo sapiens
agacuucccacuguuc

SEQ ID NO: 644830 - RNA, 13 nt, Homo sapiens
agacuucccugaa

SEQ ID NO: 644831 - RNA, 19 nt, Homo sapiens
agacuugacaacaucccac

SEQ ID NO: 644832 - RNA, 18 nt, Homo sapiens
agacuugagcuugaccua

SEQ ID NO: 644833 - RNA, 16 nt, Homo sapiens
agacuuggacaucucu

SEQ ID NO: 644834 - RNA, 19 nt, Homo sapiens
agacuuggggaaauugcuu

SEQ ID NO: 644835 - RNA, 14 nt, Homo sapiens
agacuuggggccag

SEQ ID NO: 644836 - RNA, 15 nt, Homo sapiens
agacuuggggccagc

SEQ ID NO: 644837 - RNA, 22 nt, Homo sapiens
agacuuguuucuccaugggcuc

SEQ ID NO: 644838 - RNA, 17 nt, Homo sapiens
agacuuuaaaauucuaa

SEQ ID NO: 644839 - RNA, 20 nt, Homo sapiens
agacuuuacauggaugccaa

SEQ ID NO: 644840 - RNA, 20 nt, Homo sapiens
agacuuuauaauuccuucug

SEQ ID NO: 644841 - RNA, 18 nt, Homo sapiens
agacuuucuuaucacuua

SEQ ID NO: 644842 - RNA, 21 nt, Homo sapiens
agagaaaauugugaaagugac

SEQ ID NO: 644843 - RNA, 22 nt, Homo sapiens
agagaaaauugugaaagugacu

SEQ ID NO: 644844 - RNA, 22 nt, Homo sapiens
agagaaaauuugaaaauguccu

SEQ ID NO: 644845 - RNA, 15 nt, Homo sapiens
agagaaacacugcug

SEQ ID NO: 644846 - RNA, 20 nt, Homo sapiens
agagaaaggguaauuuccuu

SEQ ID NO: 644847 - RNA, 13 nt, Homo sapiens
agagaaaguguga

SEQ ID NO: 644848 - RNA, 14 nt, Homo sapiens
agagaaauacuuuc

SEQ ID NO: 644849 - RNA, 17 nt, Homo sapiens
agagaaaucaaugaagc

SEQ ID NO: 644850 - RNA, 18 nt, Homo sapiens
agagaaauccuuccuaaa

SEQ ID NO: 644851 - RNA, 13 nt, Homo sapiens
agagaaauguguc

SEQ ID NO: 644852 - RNA, 18 nt, Homo sapiens
agagaacccagauguugu

SEQ ID NO: 644853 - RNA, 15 nt, Homo sapiens
agagaaccucagauc

SEQ ID NO: 644854 - RNA, 16 nt, Homo sapiens
agaaaagugggccagu

SEQ ID NO: 644855 - RNA, 20 nt, Homo sapiens
agaaaauaguggugugauuu

SEQ ID NO: 644856 - RNA, 14 nt, Homo sapiens
agaaaaucacauca

SEQ ID NO: 644857 - RNA, 21 nt, Homo sapiens
agaaaaucaucaagaagggcu

SEQ ID NO: 644858 - RNA, 16 nt, Homo sapiens
agaaaaucuuuuacua

SEQ ID NO: 644859 - RNA, 16 nt, Homo sapiens
agaaaaugacuuuauu

SEQ ID NO: 644860 - RNA, 13 nt, Homo sapiens
agaaaaugcaguc

SEQ ID NO: 644861 - RNA, 18 nt, Homo sapiens
agaaaauggguuuauuca

SEQ ID NO: 644862 - RNA, 17 nt, Homo sapiens
agaaaauguaguuagcu

SEQ ID NO: 644863 - RNA, 18 nt, Homo sapiens
agaaaauugcaugaaacu

SEQ ID NO: 644864 - RNA, 16 nt, Homo sapiens
agaaaauugcugugcc

SEQ ID NO: 644865 - RNA, 16 nt, Homo sapiens
agaaaauuugcuuuaa

SEQ ID NO: 644866 - RNA, 14 nt, Homo sapiens
agaaacaagcugug

SEQ ID NO: 644867 - RNA, 22 nt, Homo sapiens
agaaacaauacuguucuauacg

SEQ ID NO: 644868 - RNA, 11 nt, Homo sapiens
agaaacacagg

SEQ ID NO: 644869 - RNA, 22 nt, Homo sapiens
agaaacaccccucugucuagga

SEQ ID NO: 644870 - RNA, 21 nt, Homo sapiens
agaaacacuaaagcauucaau

SEQ ID NO: 644871 - RNA, 15 nt, Homo sapiens
agaaacagugugcau

SEQ ID NO: 644872 - RNA, 16 nt, Homo sapiens
agaaacagugugcaug

SEQ ID NO: 644873 - RNA, 23 nt, Homo sapiens
agaaacauuguaaauauuuacuc

SEQ ID NO: 644874 - RNA, 13 nt, Homo sapiens
agaaacauuucag

SEQ ID NO: 644875 - RNA, 16 nt, Homo sapiens
agaaaccagagucaaa

SEQ ID NO: 644876 - RNA, 14 nt, Homo sapiens
agaaaccaugacaa

SEQ ID NO: 644877 - RNA, 11 nt, Homo sapiens
agaaacccaag

SEQ ID NO: 644878 - RNA, 12 nt, Homo sapiens
agaaacccaagc

SEQ ID NO: 644879 - RNA, 20 nt, Homo sapiens
agaaaccuuauuguaccucu

SEQ ID NO: 644880 - RNA, 21 nt, Homo sapiens
agaaaccuuauuguaccucuc

SEQ ID NO: 644881 - RNA, 14 nt, Homo sapiens
agaaacgucuucua

SEQ ID NO: 644882 - RNA, 18 nt, Homo sapiens
agaaacuaugaagaucug

SEQ ID NO: 644883 - RNA, 12 nt, Homo sapiens
agaaacucccau

SEQ ID NO: 644884 - RNA, 13 nt, Homo sapiens
agaaacuucccaa

SEQ ID NO: 644885 - RNA, 16 nt, Homo sapiens
agaaacuugcuuauca

SEQ ID NO: 644886 - RNA, 19 nt, Homo sapiens
agaaacuuuaagaacaaac

SEQ ID NO: 644887 - RNA, 17 nt, Homo sapiens
agaaacuuugccucaag

SEQ ID NO: 644888 - RNA, 22 nt, Homo sapiens
agaaagaaaaauuaucuugaau

SEQ ID NO: 644889 - RNA, 17 nt, Homo sapiens
agaaagaaguccuuucu

SEQ ID NO: 644890 - RNA, 19 nt, Homo sapiens
agaaagaaugcauuccaga

SEQ ID NO: 644891 - RNA, 19 nt, Homo sapiens
agaaagaauuggccaggca

SEQ ID NO: 644892 - RNA, 19 nt, Homo sapiens
agaaagaccaggccaaugu

SEQ ID NO: 644893 - RNA, 19 nt, Homo sapiens
agaaagagacuccgucuca

SEQ ID NO: 644894 - RNA, 14 nt, Homo sapiens
agaaagaucaaaga

SEQ ID NO: 644895 - RNA, 15 nt, Homo sapiens
agaaagaucaaagac

SEQ ID NO: 644896 - RNA, 22 nt, Homo sapiens
agaaagaugacaaaagaaaauu

SEQ ID NO: 644897 - RNA, 12 nt, Homo sapiens
agaaagccaaau

SEQ ID NO: 644898 - RNA, 23 nt, Homo sapiens
agaaagccauauuccagcaguga

SEQ ID NO: 644899 - RNA, 17 nt, Homo sapiens
agaaagcccucuaggaa

SEQ ID NO: 644900 - RNA, 20 nt, Homo sapiens
agaaagccuucauaagccua

SEQ ID NO: 644901 - RNA, 19 nt, Homo sapiens
agaaagcucauggcugugu

SEQ ID NO: 644902 - RNA, 20 nt, Homo sapiens
agaaagcugcacuggugcua

SEQ ID NO: 644903 - RNA, 14 nt, Homo sapiens
agaaaggaaccugg

SEQ ID NO: 644904 - RNA, 23 nt, Homo sapiens
agaaagggguggaaacauaggga

SEQ ID NO: 644905 - RNA, 15 nt, Homo sapiens
agaaaggucauccaa

SEQ ID NO: 644906 - RNA, 19 nt, Homo sapiens
agaaaggucauccaaagaa

SEQ ID NO: 644907 - RNA, 17 nt, Homo sapiens
agaaagguuuuauucua

SEQ ID NO: 644908 - RNA, 15 nt, Homo sapiens
agaaaguaagucuuu

SEQ ID NO: 644909 - RNA, 12 nt, Homo sapiens
agaaaguacaaa

SEQ ID NO: 644910 - RNA, 12 nt, Homo sapiens
agaaaguauuug

SEQ ID NO: 644911 - RNA, 13 nt, Homo sapiens
agaaagugccuga

SEQ ID NO: 644912 - RNA, 14 nt, Homo sapiens
agaaaguguauuug

SEQ ID NO: 644913 - RNA, 12 nt, Homo sapiens
agaaaguucuca

SEQ ID NO: 644914 - RNA, 15 nt, Homo sapiens
agaaauaaaugaaac

SEQ ID NO: 644915 - RNA, 21 nt, Homo sapiens
agaaauaaggacaagccuaac

SEQ ID NO: 644916 - RNA, 20 nt, Homo sapiens
agaaauaauaugcauuguca

SEQ ID NO: 644917 - RNA, 23 nt, Homo sapiens
agaaauacaauuuuagauaucau

SEQ ID NO: 644918 - RNA, 17 nt, Homo sapiens
agaaauacagucuucca

SEQ ID NO: 644919 - RNA, 17 nt, Homo sapiens
agaaauagaacacugcc

SEQ ID NO: 644920 - RNA, 21 nt, Homo sapiens
agaaauagaggugaugcugcu

SEQ ID NO: 644921 - RNA, 12 nt, Homo sapiens
agaaauagugug

SEQ ID NO: 644922 - RNA, 19 nt, Homo sapiens
agaaauauggaacuuacau

SEQ ID NO: 644923 - RNA, 14 nt, Homo sapiens
agaaauauggacac

SEQ ID NO: 644924 - RNA, 16 nt, Homo sapiens
agaaaucaggccuugc

SEQ ID NO: 644925 - RNA, 13 nt, Homo sapiens
agaaaucauagaa

SEQ ID NO: 644926 - RNA, 14 nt, Homo sapiens
agaaauccauaucu

SEQ ID NO: 644927 - RNA, 14 nt, Homo sapiens
agaaaugaacaaaa

SEQ ID NO: 644928 - RNA, 21 nt, Homo sapiens
agaaaugauaagugacaaaag

SEQ ID NO: 644929 - RNA, 15 nt, Homo sapiens
agaaaugaucuuuac

SEQ ID NO: 644930 - RNA, 22 nt, Homo sapiens
agaaaugauucaaauugcugcu

SEQ ID NO: 644931 - RNA, 23 nt, Homo sapiens
agaaaugauucaaauugcugcuu

SEQ ID NO: 644932 - RNA, 18 nt, Homo sapiens
agaaaugcaaccaacugc

SEQ ID NO: 644933 - RNA, 19 nt, Homo sapiens
agaaauggauguaagccug

SEQ ID NO: 644934 - RNA, 22 nt, Homo sapiens
agaaauguaccggcuuccaucc

SEQ ID NO: 644935 - RNA, 16 nt, Homo sapiens
agaaauguaguuugca

SEQ ID NO: 644936 - RNA, 15 nt, Homo sapiens
agaaauguauccuga

SEQ ID NO: 644937 - RNA, 12 nt, Homo sapiens
agaaauguccuc

SEQ ID NO: 644938 - RNA, 20 nt, Homo sapiens
agaaauuaacaaaugugcug

SEQ ID NO: 644939 - RNA, 22 nt, Homo sapiens
agaaauuccaggaaaaucugca

SEQ ID NO: 644940 - RNA, 21 nt, Homo sapiens
agaaauuccauacuucucuca

SEQ ID NO: 644941 - RNA, 13 nt, Homo sapiens
agaaauuccugua

SEQ ID NO: 644942 - RNA, 20 nt, Homo sapiens
agaaauugaaaaugaccaaa

SEQ ID NO: 644943 - RNA, 17 nt, Homo sapiens
agaaauuguuuuuaaca

SEQ ID NO: 644944 - RNA, 15 nt, Homo sapiens
agaaauuucugugcu

SEQ ID NO: 644945 - RNA, 15 nt, Homo sapiens
agaaauuuggcuaua

SEQ ID NO: 644946 - RNA, 20 nt, Homo sapiens
agaaauuuggcuauaaucuu

SEQ ID NO: 644947 - RNA, 20 nt, Homo sapiens
agaaauuuucugaucucaga

SEQ ID NO: 644948 - RNA, 19 nt, Homo sapiens
agaaauuuugccugccauu

SEQ ID NO: 644949 - RNA, 15 nt, Homo sapiens
agaacaaagccacug

SEQ ID NO: 644950 - RNA, 17 nt, Homo sapiens
agaacaaauuguuuaca

SEQ ID NO: 644951 - RNA, 22 nt, Homo sapiens
agaacaccccaugcgugcugag

SEQ ID NO: 644952 - RNA, 14 nt, Homo sapiens
agaacacuccaagc

SEQ ID NO: 644953 - RNA, 14 nt, Homo sapiens
agaacaggacucca

SEQ ID NO: 644954 - RNA, 21 nt, Homo sapiens
agaacagggucauguuugcag

SEQ ID NO: 644955 - RNA, 17 nt, Homo sapiens
agaacaguaacugccau

SEQ ID NO: 644956 - RNA, 22 nt, Homo sapiens
agaacaguuuuacaauagacau

SEQ ID NO: 644957 - RNA, 15 nt, Homo sapiens
agaacauacacugug

SEQ ID NO: 644958 - RNA, 18 nt, Homo sapiens
agaacaucauuacuuaug

SEQ ID NO: 644959 - RNA, 16 nt, Homo sapiens
agaacauucuaccaaa

SEQ ID NO: 644960 - RNA, 14 nt, Homo sapiens
agaaccaaaagaga

SEQ ID NO: 644961 - RNA, 11 nt, Homo sapiens
agaaccaaaga

SEQ ID NO: 644962 - RNA, 13 nt, Homo sapiens
agaaccacuccug

SEQ ID NO: 644963 - RNA, 20 nt, Homo sapiens
agaaccagagaggcucugag

SEQ ID NO: 644964 - RNA, 19 nt, Homo sapiens
agaaccagggcucuucuca

SEQ ID NO: 644965 - RNA, 23 nt, Homo sapiens
agaaccauaaagaaaagaugaaa

SEQ ID NO: 644966 - RNA, 23 nt, Homo sapiens
agaaccauccauaguaguaugau

SEQ ID NO: 644967 - RNA, 13 nt, Homo sapiens
agaaccauuacaa

SEQ ID NO: 644968 - RNA, 14 nt, Homo sapiens
agaaccauuuacuu

SEQ ID NO: 644969 - RNA, 17 nt, Homo sapiens
agaacccagauuuccua

SEQ ID NO: 644970 - RNA, 20 nt, Homo sapiens
agaaccccaggacgcccuca

SEQ ID NO: 644971 - RNA, 15 nt, Homo sapiens
agaaccccguggggu

SEQ ID NO: 644972 - RNA, 18 nt, Homo sapiens
agaaucauugaaguauuu

SEQ ID NO: 644973 - RNA, 21 nt, Homo sapiens
agaauccagcuacgaauauag

SEQ ID NO: 644974 - RNA, 19 nt, Homo sapiens
agaaucccuuaaaauuacc

SEQ ID NO: 644975 - RNA, 15 nt, Homo sapiens
agaaucccuuugcac

SEQ ID NO: 644976 - RNA, 20 nt, Homo sapiens
agaauccugccucuccccaa

SEQ ID NO: 644977 - RNA, 14 nt, Homo sapiens
agaaucucaaauaa

SEQ ID NO: 644978 - RNA, 19 nt, Homo sapiens
agaaucugccccuguugag

SEQ ID NO: 644979 - RNA, 16 nt, Homo sapiens
agaaugaaauguaugu

SEQ ID NO: 644980 - RNA, 16 nt, Homo sapiens
agaaugaacccauagg

SEQ ID NO: 644981 - RNA, 15 nt, Homo sapiens
agaaugaagacuguu

SEQ ID NO: 644982 - RNA, 18 nt, Homo sapiens
agaaugaauaauaauuau

SEQ ID NO: 644983 - RNA, 15 nt, Homo sapiens
agaaugaauuuaucu

SEQ ID NO: 644984 - RNA, 23 nt, Homo sapiens
agaaugaucagcaucugugaugg

SEQ ID NO: 644985 - RNA, 13 nt, Homo sapiens
agaaugcaucuca

SEQ ID NO: 644986 - RNA, 21 nt, Homo sapiens
agaaugcaucucaucaacuua

SEQ ID NO: 644987 - RNA, 16 nt, Homo sapiens
agaaugcccagugacc

SEQ ID NO: 644988 - RNA, 16 nt, Homo sapiens
agaauggaagccugaa

SEQ ID NO: 644989 - RNA, 16 nt, Homo sapiens
agaaugggccacugua

SEQ ID NO: 644990 - RNA, 16 nt, Homo sapiens
agaauggugaucacuc

SEQ ID NO: 644991 - RNA, 17 nt, Homo sapiens
agaauguaucugugaag

SEQ ID NO: 644992 - RNA, 13 nt, Homo sapiens
agaaugucacugu

SEQ ID NO: 644993 - RNA, 14 nt, Homo sapiens
agaaugucucgguc

SEQ ID NO: 644994 - RNA, 21 nt, Homo sapiens
agaaugucucggucacaucag

SEQ ID NO: 644995 - RNA, 12 nt, Homo sapiens
agaaugugauuc

SEQ ID NO: 644996 - RNA, 15 nt, Homo sapiens
agaaugugcucaugc

SEQ ID NO: 644997 - RNA, 16 nt, Homo sapiens
agaauguguguagaua

SEQ ID NO: 644998 - RNA, 17 nt, Homo sapiens
agaauguguuucaaaac

SEQ ID NO: 644999 - RNA, 20 nt, Homo sapiens
agaauguguuucaaaaccau

SEQ ID NO: 645000 - RNA, 19 nt, Homo sapiens
agaauguuacugccuuaau

SEQ ID NO: 645001 - RNA, 16 nt, Homo sapiens
agaauguucaucucuc

SEQ ID NO: 645002 - RNA, 19 nt, Homo sapiens
agaauguuccagacauucu

SEQ ID NO: 645003 - RNA, 19 nt, Homo sapiens
agaauuaagaggaugcugg

SEQ ID NO: 645004 - RNA, 24 nt, Homo sapiens
agaauuaaguuuuaaauaaaccua

SEQ ID NO: 645005 - RNA, 16 nt, Homo sapiens
agaauuaaucaguaaa

SEQ ID NO: 645006 - RNA, 19 nt, Homo sapiens
agaauuacuuguguuacuu

SEQ ID NO: 645007 - RNA, 19 nt, Homo sapiens
agaauuagaaaaguuaaca

SEQ ID NO: 645008 - RNA, 15 nt, Homo sapiens
agaauuauaacccag

SEQ ID NO: 645009 - RNA, 16 nt, Homo sapiens
agaauuauaacccaga

SEQ ID NO: 645010 - RNA, 17 nt, Homo sapiens
agaauuaucaucccaac

SEQ ID NO: 645011 - RNA, 14 nt, Homo sapiens
agaauuauguaaua

SEQ ID NO: 645012 - RNA, 23 nt, Homo sapiens
agaauucagaagaccccugacuc

SEQ ID NO: 645013 - RNA, 22 nt, Homo sapiens
agaauuccugaagccagaucca

SEQ ID NO: 645014 - RNA, 17 nt, Homo sapiens
agaauucuagugcugcu

SEQ ID NO: 645015 - RNA, 23 nt, Homo sapiens
agaauucugcuaccucacugggg

SEQ ID NO: 645016 - RNA, 18 nt, Homo sapiens
agaauucugguguuuaca

SEQ ID NO: 645017 - RNA, 15 nt, Homo sapiens
agaauucuucauccu

SEQ ID NO: 645018 - RNA, 15 nt, Homo sapiens
agaauugaccaaaua

SEQ ID NO: 645019 - RNA, 19 nt, Homo sapiens
agaauugacugcaguugaa

SEQ ID NO: 645020 - RNA, 22 nt, Homo sapiens
agaauugcucccuaccagcuga

SEQ ID NO: 645021 - RNA, 14 nt, Homo sapiens
agaauuggaaucac

SEQ ID NO: 645022 - RNA, 19 nt, Homo sapiens
agaauuggccaucuuaaaa

SEQ ID NO: 645023 - RNA, 23 nt, Homo sapiens
agaauuguaucucauacugucug

SEQ ID NO: 645024 - RNA, 17 nt, Homo sapiens
agaauugucuugcaagu

SEQ ID NO: 645025 - RNA, 18 nt, Homo sapiens
agaauuugagugcucuga

SEQ ID NO: 645026 - RNA, 11 nt, Homo sapiens
agaauuugcau

SEQ ID NO: 645027 - RNA, 15 nt, Homo sapiens
agaauuugucagaaa

SEQ ID NO: 645028 - RNA, 16 nt, Homo sapiens
agaauuuguguugaag

SEQ ID NO: 645029 - RNA, 13 nt, Homo sapiens
agaauuuuagucc

SEQ ID NO: 645030 - RNA, 15 nt, Homo sapiens
agaauuuucugcauu

SEQ ID NO: 645031 - RNA, 18 nt, Homo sapiens
agaauuuucugcauuauc

SEQ ID NO: 645032 - RNA, 21 nt, Homo sapiens
agaauuuugaguauuccauga

SEQ ID NO: 645033 - RNA, 23 nt, Homo sapiens
agacaaaaaucaaagaacagaug

SEQ ID NO: 645034 - RNA, 20 nt, Homo sapiens
agacaaaacgagucuuucau

SEQ ID NO: 645035 - RNA, 12 nt, Homo sapiens
agacaaaaugga

SEQ ID NO: 645036 - RNA, 15 nt, Homo sapiens
agacaaagccuuaag

SEQ ID NO: 645037 - RNA, 21 nt, Homo sapiens
agacaacaaaugggucccuca

SEQ ID NO: 645038 - RNA, 14 nt, Homo sapiens
agacaacacuggga

SEQ ID NO: 645039 - RNA, 13 nt, Homo sapiens
agacaacauuucu

SEQ ID NO: 645040 - RNA, 14 nt, Homo sapiens
agacaaccaaaaca

SEQ ID NO: 645041 - RNA, 18 nt, Homo sapiens
agacaacccucagauuug

SEQ ID NO: 645042 - RNA, 22 nt, Homo sapiens
agacaacccugcaaaggacugu

SEQ ID NO: 645043 - RNA, 15 nt, Homo sapiens
agacaacuagauuug

SEQ ID NO: 645044 - RNA, 12 nt, Homo sapiens
agacaacucuac

SEQ ID NO: 645045 - RNA, 17 nt, Homo sapiens
agacaagaagacuguca

SEQ ID NO: 645046 - RNA, 13 nt, Homo sapiens
agacaagauuuau

SEQ ID NO: 645047 - RNA, 21 nt, Homo sapiens
agacaagcuuguccauguaau

SEQ ID NO: 645048 - RNA, 19 nt, Homo sapiens
agacaauagcccaaagcca

SEQ ID NO: 645049 - RNA, 13 nt, Homo sapiens
agacaauauacaa

SEQ ID NO: 645050 - RNA, 18 nt, Homo sapiens
agacacaaaugcaugaac

SEQ ID NO: 645051 - RNA, 15 nt, Homo sapiens
agacacaauauguau

SEQ ID NO: 645052 - RNA, 18 nt, Homo sapiens
agacacagacuggcaaua

SEQ ID NO: 645053 - RNA, 14 nt, Homo sapiens
agacacagcaagac

SEQ ID NO: 645054 - RNA, 19 nt, Homo sapiens
agacacaugccagggccau

SEQ ID NO: 645055 - RNA, 21 nt, Homo sapiens
agacaccucccccuacccaua

SEQ ID NO: 645056 - RNA, 15 nt, Homo sapiens
agacacgcucuucua

SEQ ID NO: 645057 - RNA, 15 nt, Homo sapiens
agacacuauuuaucu

SEQ ID NO: 645058 - RNA, 13 nt, Homo sapiens
agacacugaguca

SEQ ID NO: 645059 - RNA, 12 nt, Homo sapiens
agacacuggaca

SEQ ID NO: 645060 - RNA, 19 nt, Homo sapiens
agacacuggcguuacugcu

SEQ ID NO: 645061 - RNA, 18 nt, Homo sapiens
agacacugguuuacacuu

SEQ ID NO: 645062 - RNA, 11 nt, Homo sapiens
agacacuguga

SEQ ID NO: 645063 - RNA, 14 nt, Homo sapiens
agacagaacuugaa

SEQ ID NO: 645064 - RNA, 13 nt, Homo sapiens
agacagaagcuua

SEQ ID NO: 645065 - RNA, 19 nt, Homo sapiens
agacagacaacacugggaa

SEQ ID NO: 645066 - RNA, 16 nt, Homo sapiens
agacagacauacauag

SEQ ID NO: 645067 - RNA, 12 nt, Homo sapiens
agacagaccuca

SEQ ID NO: 645068 - RNA, 22 nt, Homo sapiens
agacagauaccuccaacccugc

SEQ ID NO: 645069 - RNA, 16 nt, Homo sapiens
agacagcagggacaag

SEQ ID NO: 645070 - RNA, 19 nt, Homo sapiens
agacagcagggacaagaua

SEQ ID NO: 645071 - RNA, 16 nt, Homo sapiens
agacaggaaaaaccaa

SEQ ID NO: 645072 - RNA, 15 nt, Homo sapiens
agacaggaagaccaa

SEQ ID NO: 645073 - RNA, 16 nt, Homo sapiens
agacaggacccuggga

SEQ ID NO: 645074 - RNA, 17 nt, Homo sapiens
agacaggacccugggac

SEQ ID NO: 645075 - RNA, 16 nt, Homo sapiens
agacaggcccaagaga

SEQ ID NO: 645076 - RNA, 16 nt, Homo sapiens
agacagggucuugcua

SEQ ID NO: 645077 - RNA, 18 nt, Homo sapiens
agacaggucuagacuuuc

SEQ ID NO: 645078 - RNA, 18 nt, Homo sapiens
agacaguaugagucaaug

SEQ ID NO: 645079 - RNA, 15 nt, Homo sapiens
agacaguauugccac

SEQ ID NO: 645080 - RNA, 22 nt, Homo sapiens
agacauaaagccuuuugcuuua

SEQ ID NO: 645081 - RNA, 18 nt, Homo sapiens
agacauaaauuacuuuuu

SEQ ID NO: 645082 - RNA, 14 nt, Homo sapiens
agacauaacaaaac

SEQ ID NO: 645083 - RNA, 17 nt, Homo sapiens
agacauacuaaccagca

SEQ ID NO: 645084 - RNA, 17 nt, Homo sapiens
agacauacuccuuccau

SEQ ID NO: 645085 - RNA, 15 nt, Homo sapiens
agacauaugggccau

SEQ ID NO: 645086 - RNA, 16 nt, Homo sapiens
agacaucaguauucug

SEQ ID NO: 645087 - RNA, 12 nt, Homo sapiens
agacaucaucaa

SEQ ID NO: 645088 - RNA, 21 nt, Homo sapiens
agacaucauguaucgcauauu

SEQ ID NO: 645089 - RNA, 14 nt, Homo sapiens
agacauccauguuu

SEQ ID NO: 645090 - RNA, 17 nt, Homo sapiens
agacaucucuggagcca

SEQ ID NO: 645091 - RNA, 20 nt, Homo sapiens
agacaucuuugcuuaugaaa

SEQ ID NO: 645092 - RNA, 14 nt, Homo sapiens
agacaugaaugcac

SEQ ID NO: 645093 - RNA, 16 nt, Homo sapiens
agagaaggcugugagc

SEQ ID NO: 645094 - RNA, 13 nt, Homo sapiens
agagaaguuugaa

SEQ ID NO: 645095 - RNA, 15 nt, Homo sapiens
agagaauaccagugu

SEQ ID NO: 645096 - RNA, 19 nt, Homo sapiens
agagaaugagaagacaugg

SEQ ID NO: 645097 - RNA, 14 nt, Homo sapiens
agagaauguauuug

SEQ ID NO: 645098 - RNA, 16 nt, Homo sapiens
agagaauguuccagac

SEQ ID NO: 645099 - RNA, 17 nt, Homo sapiens
agagaauuuucugcauu

SEQ ID NO: 645100 - RNA, 13 nt, Homo sapiens
agagacaccugca

SEQ ID NO: 645101 - RNA, 12 nt, Homo sapiens
agagacagauac

SEQ ID NO: 645102 - RNA, 16 nt, Homo sapiens
agagacagauaccucc

SEQ ID NO: 645103 - RNA, 15 nt, Homo sapiens
agagaccccaggaac

SEQ ID NO: 645104 - RNA, 16 nt, Homo sapiens
agagaccccuuccuuu

SEQ ID NO: 645105 - RNA, 14 nt, Homo sapiens
agagacuccgucuc

SEQ ID NO: 645106 - RNA, 15 nt, Homo sapiens
agagacuccgucuca

SEQ ID NO: 645107 - RNA, 22 nt, Homo sapiens
agagacugcagggguccacugu

SEQ ID NO: 645108 - RNA, 19 nt, Homo sapiens
agagacugcccuucucacg

SEQ ID NO: 645109 - RNA, 19 nt, Homo sapiens
agagacuggagcaucugac

SEQ ID NO: 645110 - RNA, 20 nt, Homo sapiens
agagagaaaguuucguuaua

SEQ ID NO: 645111 - RNA, 22 nt, Homo sapiens
agagagcaucugcaacaaaaag

SEQ ID NO: 645112 - RNA, 15 nt, Homo sapiens
agagagcaucuuucc

SEQ ID NO: 645113 - RNA, 20 nt, Homo sapiens
agagagcuagagggacaaag

SEQ ID NO: 645114 - RNA, 13 nt, Homo sapiens
agagaggaagagc

SEQ ID NO: 645115 - RNA, 20 nt, Homo sapiens
agagaggagggacugucaca

SEQ ID NO: 645116 - RNA, 17 nt, Homo sapiens
agagaggaggggaccaa

SEQ ID NO: 645117 - RNA, 23 nt, Homo sapiens
agagaggagguaguuaagggaug

SEQ ID NO: 645118 - RNA, 20 nt, Homo sapiens
agagaggccuuuuguuuaaa

SEQ ID NO: 645119 - RNA, 15 nt, Homo sapiens
agagaggcucugaga

SEQ ID NO: 645120 - RNA, 23 nt, Homo sapiens
agagagucgcaucucagugcagg

SEQ ID NO: 645121 - RNA, 12 nt, Homo sapiens
agagaguugucu

SEQ ID NO: 645122 - RNA, 18 nt, Homo sapiens
agagauacaguauaccug

SEQ ID NO: 645123 - RNA, 13 nt, Homo sapiens
agagauacugaag

SEQ ID NO: 645124 - RNA, 13 nt, Homo sapiens
agagauacuguug

SEQ ID NO: 645125 - RNA, 15 nt, Homo sapiens
agagauagcuucucu

SEQ ID NO: 645126 - RNA, 13 nt, Homo sapiens
agagauaguucua

SEQ ID NO: 645127 - RNA, 19 nt, Homo sapiens
agagaucagcgacccugag

SEQ ID NO: 645128 - RNA, 20 nt, Homo sapiens
agagaucagcgacccugagg

SEQ ID NO: 645129 - RNA, 22 nt, Homo sapiens
agagaucuuucuuuccaaaaca

SEQ ID NO: 645130 - RNA, 20 nt, Homo sapiens
agagaugacuauuacuuuuc

SEQ ID NO: 645131 - RNA, 19 nt, Homo sapiens
agagaugcgaaccacccaa

SEQ ID NO: 645132 - RNA, 22 nt, Homo sapiens
agagaugcgaaccacccaaaac

SEQ ID NO: 645133 - RNA, 23 nt, Homo sapiens
agagaugcgaaccacccaaaaca

SEQ ID NO: 645134 - RNA, 16 nt, Homo sapiens
agagauggauauugaa

SEQ ID NO: 645135 - RNA, 19 nt, Homo sapiens
agagauuacuuugcugccu

SEQ ID NO: 645136 - RNA, 21 nt, Homo sapiens
agagcaaacccacucccaaau

SEQ ID NO: 645137 - RNA, 19 nt, Homo sapiens
agagcaagacucugucuca

SEQ ID NO: 645138 - RNA, 19 nt, Homo sapiens
agagcaaggguucccucaa

SEQ ID NO: 645139 - RNA, 15 nt, Homo sapiens
agagcacacuguagc

SEQ ID NO: 645140 - RNA, 20 nt, Homo sapiens
agagcacacuuaugggccaa

SEQ ID NO: 645141 - RNA, 20 nt, Homo sapiens
agagcacugccucuaugccc

SEQ ID NO: 645142 - RNA, 16 nt, Homo sapiens
agagcagcagcaccuu

SEQ ID NO: 645143 - RNA, 20 nt, Homo sapiens
agagcaggaagcauucagag

SEQ ID NO: 645144 - RNA, 14 nt, Homo sapiens
agagcaggacucca

SEQ ID NO: 645145 - RNA, 17 nt, Homo sapiens
agagcaggggcuccagc

SEQ ID NO: 645146 - RNA, 15 nt, Homo sapiens
agagcaguuggccaa

SEQ ID NO: 645147 - RNA, 12 nt, Homo sapiens
agagcaucucuu

SEQ ID NO: 645148 - RNA, 14 nt, Homo sapiens
agagcaucugcaac

SEQ ID NO: 645149 - RNA, 12 nt, Homo sapiens
agagcauuucaa

SEQ ID NO: 645150 - RNA, 22 nt, Homo sapiens
agagcauuuccaacaccacaga

SEQ ID NO: 645151 - RNA, 21 nt, Homo sapiens
agagccaaccucggcuugugg

SEQ ID NO: 645152 - RNA, 13 nt, Homo sapiens
agagccagcagca

SEQ ID NO: 645153 - RNA, 19 nt, Homo sapiens
agagccagcagcaaaaacu

SEQ ID NO: 645154 - RNA, 18 nt, Homo sapiens
agagccagugaaggagcc

SEQ ID NO: 645155 - RNA, 20 nt, Homo sapiens
agagccucucccacaccacu

SEQ ID NO: 645156 - RNA, 15 nt, Homo sapiens
agagccucugagaug

SEQ ID NO: 645157 - RNA, 18 nt, Homo sapiens
agagccuguaaacuuuau

SEQ ID NO: 645158 - RNA, 22 nt, Homo sapiens
agagccuguccccgccuucccu

SEQ ID NO: 645159 - RNA, 20 nt, Homo sapiens
agagcgauggagcagucucc

SEQ ID NO: 645160 - RNA, 19 nt, Homo sapiens
agagcggcugcccgacuca

SEQ ID NO: 645161 - RNA, 21 nt, Homo sapiens
agagcgggguccccucugugc

SEQ ID NO: 645162 - RNA, 16 nt, Homo sapiens
agagcgugcuuucaag

SEQ ID NO: 645163 - RNA, 16 nt, Homo sapiens
agagcuagagggacaa

SEQ ID NO: 645164 - RNA, 14 nt, Homo sapiens
agagcuagaugugu

SEQ ID NO: 645165 - RNA, 14 nt, Homo sapiens
agagcuauggugag

SEQ ID NO: 645166 - RNA, 14 nt, Homo sapiens
agagcugagcacuu

SEQ ID NO: 645167 - RNA, 21 nt, Homo sapiens
agagcugagggcccuguggag

SEQ ID NO: 645168 - RNA, 18 nt, Homo sapiens
agagcugcacagcaaaag

SEQ ID NO: 645169 - RNA, 13 nt, Homo sapiens
agagcuggaugca

SEQ ID NO: 645170 - RNA, 12 nt, Homo sapiens
agagcugucacu

SEQ ID NO: 645171 - RNA, 21 nt, Homo sapiens
agagcugugccugcucagcag

SEQ ID NO: 645172 - RNA, 22 nt, Homo sapiens
agaggaaaccaguuuggugaua

SEQ ID NO: 645173 - RNA, 22 nt, Homo sapiens
agaggaagacaucuguagggaa

SEQ ID NO: 645174 - RNA, 13 nt, Homo sapiens
agaggaauccaug

SEQ ID NO: 645175 - RNA, 13 nt, Homo sapiens
agaggaauccugg

SEQ ID NO: 645176 - RNA, 20 nt, Homo sapiens
agaggaauuuuuucuuuuga

SEQ ID NO: 645177 - RNA, 22 nt, Homo sapiens
agaggacagagcaggggcucca

SEQ ID NO: 645178 - RNA, 17 nt, Homo sapiens
agaggaccccagggugg

SEQ ID NO: 645179 - RNA, 19 nt, Homo sapiens
agaggacccuuacgugaga

SEQ ID NO: 645180 - RNA, 20 nt, Homo sapiens
agaggacuggacgugcucag

SEQ ID NO: 645181 - RNA, 20 nt, Homo sapiens
agaggacuucuggcagggaa

SEQ ID NO: 645182 - RNA, 13 nt, Homo sapiens
agaggagaacaaa

SEQ ID NO: 645183 - RNA, 20 nt, Homo sapiens
agaggagccaccaguucuca

SEQ ID NO: 645184 - RNA, 19 nt, Homo sapiens
agaggaggggacccaugua

SEQ ID NO: 645185 - RNA, 22 nt, Homo sapiens
agaggagugauugaaccagcuc

SEQ ID NO: 645186 - RNA, 20 nt, Homo sapiens
agaggaucuccuguccauca

SEQ ID NO: 645187 - RNA, 23 nt, Homo sapiens
agaggaugaauguaugugcacug

SEQ ID NO: 645188 - RNA, 19 nt, Homo sapiens
agaggauuuaacugugaac

SEQ ID NO: 645189 - RNA, 13 nt, Homo sapiens
agaggcaccugcu

SEQ ID NO: 645190 - RNA, 22 nt, Homo sapiens
agaggccagcacauuaucuuca

SEQ ID NO: 645191 - RNA, 23 nt, Homo sapiens
agaggccagcacauuaucuucau

SEQ ID NO: 645192 - RNA, 14 nt, Homo sapiens
agaggccauggcag

SEQ ID NO: 645193 - RNA, 18 nt, Homo sapiens
agaggcccugccacgucc

SEQ ID NO: 645194 - RNA, 22 nt, Homo sapiens
agaggcuauuauuuucacugua

SEQ ID NO: 645195 - RNA, 16 nt, Homo sapiens
agaggcucagcacuuu

SEQ ID NO: 645196 - RNA, 16 nt, Homo sapiens
agaggcugcaaggauu

SEQ ID NO: 645197 - RNA, 17 nt, Homo sapiens
agaggcugccccucuca

SEQ ID NO: 645198 - RNA, 17 nt, Homo sapiens
agagggaccauguguca

SEQ ID NO: 645199 - RNA, 24 nt, Homo sapiens
agagggaccaugugucacuugugc

SEQ ID NO: 645200 - RNA, 16 nt, Homo sapiens
agagggagagcagaga

SEQ ID NO: 645201 - RNA, 16 nt, Homo sapiens
agagggaggucacugg

SEQ ID NO: 645202 - RNA, 19 nt, Homo sapiens
agagggccuugcuucucuu

SEQ ID NO: 645203 - RNA, 12 nt, Homo sapiens
agagggggaccu

SEQ ID NO: 645204 - RNA, 22 nt, Homo sapiens
agagggggcgauauagagaaua

SEQ ID NO: 645205 - RNA, 22 nt, Homo sapiens
agaggggugggauccacacuga

SEQ ID NO: 645206 - RNA, 21 nt, Homo sapiens
agaggguaaguaaacagauuu

SEQ ID NO: 645207 - RNA, 21 nt, Homo sapiens
agagguagucucacugcuuga

SEQ ID NO: 645208 - RNA, 13 nt, Homo sapiens
agagguccagccc

SEQ ID NO: 645209 - RNA, 19 nt, Homo sapiens
agagguccuggccaucaaa

SEQ ID NO: 645210 - RNA, 21 nt, Homo sapiens
agaggucucagguucuuucca

SEQ ID NO: 645211 - RNA, 13 nt, Homo sapiens
agaggucugagcc

SEQ ID NO: 645212 - RNA, 19 nt, Homo sapiens
agaggugcaagaccuaguc

SEQ ID NO: 645213 - RNA, 13 nt, Homo sapiens
agaggugggagac

SEQ ID NO: 645214 - RNA, 19 nt, Homo sapiens
agauuccaccuagagcuag

SEQ ID NO: 645215 - RNA, 12 nt, Homo sapiens
agauucccacug

SEQ ID NO: 645216 - RNA, 17 nt, Homo sapiens
agauuccccugugucau

SEQ ID NO: 645217 - RNA, 19 nt, Homo sapiens
agcugcuuugagcuacagg

SEQ ID NO: 645218 - RNA, 19 nt, Homo sapiens
agcuggcaaagguggcucu

SEQ ID NO: 645219 - RNA, 21 nt, Homo sapiens
agcuggccuuuguaagugcag

SEQ ID NO: 645220 - RNA, 14 nt, Homo sapiens
agcuggcucuguga

SEQ ID NO: 645221 - RNA, 19 nt, Homo sapiens
agcugggaaccagcaucuc

SEQ ID NO: 645222 - RNA, 18 nt, Homo sapiens
agcugggacuacaggugu

SEQ ID NO: 645223 - RNA, 14 nt, Homo sapiens
agcugggagcacag

SEQ ID NO: 645224 - RNA, 16 nt, Homo sapiens
agcugggagcacuggu

SEQ ID NO: 645225 - RNA, 17 nt, Homo sapiens
agcugggagcacuggug

SEQ ID NO: 645226 - RNA, 15 nt, Homo sapiens
agcugggaguagcau

SEQ ID NO: 645227 - RNA, 17 nt, Homo sapiens
agcugggauuacaggca

SEQ ID NO: 645228 - RNA, 16 nt, Homo sapiens
agcugggcagaccccu

SEQ ID NO: 645229 - RNA, 20 nt, Homo sapiens
agcugggccccaugcucugc

SEQ ID NO: 645230 - RNA, 15 nt, Homo sapiens
agcugggcuuggccu

SEQ ID NO: 645231 - RNA, 19 nt, Homo sapiens
agcuggggccgucugugug

SEQ ID NO: 645232 - RNA, 17 nt, Homo sapiens
agcuggguguguuggca

SEQ ID NO: 645233 - RNA, 14 nt, Homo sapiens
agcugguaaacuau

SEQ ID NO: 645234 - RNA, 19 nt, Homo sapiens
agcugguccuccacuuugc

SEQ ID NO: 645235 - RNA, 14 nt, Homo sapiens
agcuggucugccag

SEQ ID NO: 645236 - RNA, 14 nt, Homo sapiens
agcuggucugggug

SEQ ID NO: 645237 - RNA, 16 nt, Homo sapiens
agcugguggcaauaaa

SEQ ID NO: 645238 - RNA, 21 nt, Homo sapiens
agcugguggcaauaaauauua

SEQ ID NO: 645239 - RNA, 20 nt, Homo sapiens
agcuguaacuuaacuauuaa

SEQ ID NO: 645240 - RNA, 21 nt, Homo sapiens
agcuguaagauaauguugcuu

SEQ ID NO: 645241 - RNA, 20 nt, Homo sapiens
agcuguaauuucgccuuaaa

SEQ ID NO: 645242 - RNA, 23 nt, Homo sapiens
agcuguauaauuaauugucauua

SEQ ID NO: 645243 - RNA, 18 nt, Homo sapiens
agcugucaggcugauuau

SEQ ID NO: 645244 - RNA, 23 nt, Homo sapiens
agcuguccugaaccgacugaccc

SEQ ID NO: 645245 - RNA, 15 nt, Homo sapiens
agcugucgacuucau

SEQ ID NO: 645246 - RNA, 21 nt, Homo sapiens
agcugucgucugacucugggu

SEQ ID NO: 645247 - RNA, 22 nt, Homo sapiens
agcugucgucugacucuggguu

SEQ ID NO: 645248 - RNA, 15 nt, Homo sapiens
agcugugacuucucc

SEQ ID NO: 645249 - RNA, 19 nt, Homo sapiens
agcugugcgcaauugcuca

SEQ ID NO: 645250 - RNA, 17 nt, Homo sapiens
agcugugggacaauuau

SEQ ID NO: 645251 - RNA, 13 nt, Homo sapiens
agcugugucugcc

SEQ ID NO: 645252 - RNA, 17 nt, Homo sapiens
agcuguuccuguucagu

SEQ ID NO: 645253 - RNA, 15 nt, Homo sapiens
agcuguugccucagu

SEQ ID NO: 645254 - RNA, 14 nt, Homo sapiens
agcuguugggaaca

SEQ ID NO: 645255 - RNA, 20 nt, Homo sapiens
agcuguuuaugcauagauaa

SEQ ID NO: 645256 - RNA, 12 nt, Homo sapiens
agcuguuuauuu

SEQ ID NO: 645257 - RNA, 16 nt, Homo sapiens
agcuuaaaaucuguga

SEQ ID NO: 645258 - RNA, 22 nt, Homo sapiens
agcuuaaaguuauguuauuaua

SEQ ID NO: 645259 - RNA, 16 nt, Homo sapiens
agcuuaagccacugcc

SEQ ID NO: 645260 - RNA, 12 nt, Homo sapiens
agcuuacacuga

SEQ ID NO: 645261 - RNA, 13 nt, Homo sapiens
agcuuagaccuca

SEQ ID NO: 645262 - RNA, 15 nt, Homo sapiens
agcuuagaguucuuc

SEQ ID NO: 645263 - RNA, 22 nt, Homo sapiens
agcuuagggaugagauacuuau

SEQ ID NO: 645264 - RNA, 14 nt, Homo sapiens
agcuuaucucaggg

SEQ ID NO: 645265 - RNA, 19 nt, Homo sapiens
agcuuaucuuucuuuccau

SEQ ID NO: 645266 - RNA, 19 nt, Homo sapiens
agcuuauuauagaauugca

SEQ ID NO: 645267 - RNA, 15 nt, Homo sapiens
agcuuauugauccca

SEQ ID NO: 645268 - RNA, 13 nt, Homo sapiens
agcuucaacuuuu

SEQ ID NO: 645269 - RNA, 20 nt, Homo sapiens
agcuucaccagagcauuucc

SEQ ID NO: 645270 - RNA, 22 nt, Homo sapiens
agcuucagcucaacucacagcu

SEQ ID NO: 645271 - RNA, 21 nt, Homo sapiens
agcuucauauaccagcaauau

SEQ ID NO: 645272 - RNA, 17 nt, Homo sapiens
agcuucauuuugguaag

SEQ ID NO: 645273 - RNA, 17 nt, Homo sapiens
agcuuccaaauguguca

SEQ ID NO: 645274 - RNA, 16 nt, Homo sapiens
agcuuccgccgucuca

SEQ ID NO: 645275 - RNA, 17 nt, Homo sapiens
agcuuccgccgucucaa

SEQ ID NO: 645276 - RNA, 12 nt, Homo sapiens
agcuuccuccag

SEQ ID NO: 645277 - RNA, 16 nt, Homo sapiens
agcuucuaucccagga

SEQ ID NO: 645278 - RNA, 20 nt, Homo sapiens
agcuucucuacagacuccaa

SEQ ID NO: 645279 - RNA, 14 nt, Homo sapiens
agcuucucugugaa

SEQ ID NO: 645280 - RNA, 19 nt, Homo sapiens
agcuucugcuuuucugccc

SEQ ID NO: 645281 - RNA, 17 nt, Homo sapiens
agcuucuuccuaggucc

SEQ ID NO: 645282 - RNA, 22 nt, Homo sapiens
agcuugacucccaaguuuccau

SEQ ID NO: 645283 - RNA, 14 nt, Homo sapiens
agcuugcaacaaaa

SEQ ID NO: 645284 - RNA, 13 nt, Homo sapiens
agcuugcagugag

SEQ ID NO: 645285 - RNA, 20 nt, Homo sapiens
agcuugccaaaucuuugugu

SEQ ID NO: 645286 - RNA, 14 nt, Homo sapiens
agcuugcugagggg

SEQ ID NO: 645287 - RNA, 14 nt, Homo sapiens
agcuugcugucacu

SEQ ID NO: 645288 - RNA, 20 nt, Homo sapiens
agcuugcugucacuucuuca

SEQ ID NO: 645289 - RNA, 19 nt, Homo sapiens
agcuuggauuaaauacaua

SEQ ID NO: 645290 - RNA, 24 nt, Homo sapiens
agcuuggccagaagggggccauga

SEQ ID NO: 645291 - RNA, 15 nt, Homo sapiens
agcuuguaggagcug

SEQ ID NO: 645292 - RNA, 14 nt, Homo sapiens
agcuugucaaagau

SEQ ID NO: 645293 - RNA, 18 nt, Homo sapiens
agcuuuaaaaccacagcu

SEQ ID NO: 645294 - RNA, 15 nt, Homo sapiens
agcuuuaaugauaug

SEQ ID NO: 645295 - RNA, 22 nt, Homo sapiens
agcuuuauuuuuuaaguauuua

SEQ ID NO: 645296 - RNA, 19 nt, Homo sapiens
agcuuucagagccagugaa

SEQ ID NO: 645297 - RNA, 22 nt, Homo sapiens
agcuuucauguaaacugugcac

SEQ ID NO: 645298 - RNA, 16 nt, Homo sapiens
agcuuuccauguugcu

SEQ ID NO: 645299 - RNA, 21 nt, Homo sapiens
agcuuucccugccucucauca

SEQ ID NO: 645300 - RNA, 22 nt, Homo sapiens
agcuuucccugccucucaucaa

SEQ ID NO: 645301 - RNA, 19 nt, Homo sapiens
agcuuucuccucugcuaug

SEQ ID NO: 645302 - RNA, 19 nt, Homo sapiens
agcuuucugccuuagccua

SEQ ID NO: 645303 - RNA, 12 nt, Homo sapiens
agcuuucugucc

SEQ ID NO: 645304 - RNA, 16 nt, Homo sapiens
agcuuugaaaauucag

SEQ ID NO: 645305 - RNA, 23 nt, Homo sapiens
agcuuugcuccgcucccaccgcc

SEQ ID NO: 645306 - RNA, 12 nt, Homo sapiens
agcuuugcugcu

SEQ ID NO: 645307 - RNA, 20 nt, Homo sapiens
agcuuuggaauauuuuaucc

SEQ ID NO: 645308 - RNA, 16 nt, Homo sapiens
agcuuugggugccuuu

SEQ ID NO: 645309 - RNA, 22 nt, Homo sapiens
agcuuugucucugucacaucag

SEQ ID NO: 645310 - RNA, 23 nt, Homo sapiens
agcuuugugaaaacuacugaugu

SEQ ID NO: 645311 - RNA, 23 nt, Homo sapiens
agcuuugugcuugucauuccaga

SEQ ID NO: 645312 - RNA, 18 nt, Homo sapiens
agcuuuguguuuacuuuu

SEQ ID NO: 645313 - RNA, 17 nt, Homo sapiens
agcuuuuaguauccaca

SEQ ID NO: 645314 - RNA, 22 nt, Homo sapiens
agcuuuuauuccuuugaauauu

SEQ ID NO: 645315 - RNA, 20 nt, Homo sapiens
agcuuuugaggggcugacuu

SEQ ID NO: 645316 - RNA, 15 nt, Homo sapiens
agcuuuuucccucac

SEQ ID NO: 645317 - RNA, 15 nt, Homo sapiens
aggaaaaaaaugacu

SEQ ID NO: 645318 - RNA, 15 nt, Homo sapiens
aggaaaaaccaacag

SEQ ID NO: 645319 - RNA, 19 nt, Homo sapiens
aggaaaaaugaggaaucca

SEQ ID NO: 645320 - RNA, 16 nt, Homo sapiens
aggaaaaaugaguaau

SEQ ID NO: 645321 - RNA, 17 nt, Homo sapiens
aggaaaacauugcaaua

SEQ ID NO: 645322 - RNA, 16 nt, Homo sapiens
aggaaaacuacugaua

SEQ ID NO: 645323 - RNA, 22 nt, Homo sapiens
aggaaaacuacugauacuuuca

SEQ ID NO: 645324 - RNA, 21 nt, Homo sapiens
aggaaaaggccccugcaaugu

SEQ ID NO: 645325 - RNA, 19 nt, Homo sapiens
aggaaaagguccuugccuc

SEQ ID NO: 645326 - RNA, 17 nt, Homo sapiens
aggaaaagguugaauaa

SEQ ID NO: 645327 - RNA, 17 nt, Homo sapiens
aggaaaaucacaucucc

SEQ ID NO: 645328 - RNA, 18 nt, Homo sapiens
aggaaaaucaugugcuca

SEQ ID NO: 645329 - RNA, 23 nt, Homo sapiens
aggaaaauguauccagaggaauu

SEQ ID NO: 645330 - RNA, 17 nt, Homo sapiens
aggaaacaacagcuuua

SEQ ID NO: 645331 - RNA, 22 nt, Homo sapiens
aggaaacaaggggucugaggau

SEQ ID NO: 645332 - RNA, 12 nt, Homo sapiens
aggaaacaguua

SEQ ID NO: 645333 - RNA, 13 nt, Homo sapiens
aggaaacaguuaa

SEQ ID NO: 645334 - RNA, 17 nt, Homo sapiens
aggaaacaucagcuuuc

SEQ ID NO: 645335 - RNA, 13 nt, Homo sapiens
aggaaacaugcag

SEQ ID NO: 645336 - RNA, 11 nt, Homo sapiens
aggaaaccaca

SEQ ID NO: 645337 - RNA, 15 nt, Homo sapiens
aggaaaccacaguga

SEQ ID NO: 645338 - RNA, 21 nt, Homo sapiens
aggaaaccucacgacugguca

SEQ ID NO: 645339 - RNA, 16 nt, Homo sapiens
aggaaacuucaguuga

SEQ ID NO: 645340 - RNA, 15 nt, Homo sapiens
aggcaggcauuccug

SEQ ID NO: 645341 - RNA, 23 nt, Homo sapiens
aggcagggugcaguaucaugccc

SEQ ID NO: 645342 - RNA, 18 nt, Homo sapiens
aggcaguauuuugugucc

SEQ ID NO: 645343 - RNA, 18 nt, Homo sapiens
aggcagugcugagaggga

SEQ ID NO: 645344 - RNA, 12 nt, Homo sapiens
aggcaguggccu

SEQ ID NO: 645345 - RNA, 17 nt, Homo sapiens
aggcaguuggccagaga

SEQ ID NO: 645346 - RNA, 15 nt, Homo sapiens
aggcauacugacacu

SEQ ID NO: 645347 - RNA, 19 nt, Homo sapiens
aggcauaggcuuauucuga

SEQ ID NO: 645348 - RNA, 21 nt, Homo sapiens
aggcaucauacuaaacuucac

SEQ ID NO: 645349 - RNA, 19 nt, Homo sapiens
aggcaucgcaauguaagac

SEQ ID NO: 645350 - RNA, 20 nt, Homo sapiens
aggcaugagccaccgcgccu

SEQ ID NO: 645351 - RNA, 16 nt, Homo sapiens
aggcaugagccacugc

SEQ ID NO: 645352 - RNA, 16 nt, Homo sapiens
aggcaugauguuaacc

SEQ ID NO: 645353 - RNA, 13 nt, Homo sapiens
aggcauggcagaa

SEQ ID NO: 645354 - RNA, 14 nt, Homo sapiens
aggcauggcucaga

SEQ ID NO: 645355 - RNA, 15 nt, Homo sapiens
aggcaugguagcuca

SEQ ID NO: 645356 - RNA, 22 nt, Homo sapiens
aggcauggucccuuaaggcaca

SEQ ID NO: 645357 - RNA, 16 nt, Homo sapiens
aggcaugguggcucau

SEQ ID NO: 645358 - RNA, 19 nt, Homo sapiens
aggcaugguguguggugcu

SEQ ID NO: 645359 - RNA, 18 nt, Homo sapiens
aggcaugugccaccacgc

SEQ ID NO: 645360 - RNA, 21 nt, Homo sapiens
aggcauguggccuuuaucuca

SEQ ID NO: 645361 - RNA, 19 nt, Homo sapiens
aggcaugugucccuuccaa

SEQ ID NO: 645362 - RNA, 15 nt, Homo sapiens
aggcauucucugaag

SEQ ID NO: 645363 - RNA, 20 nt, Homo sapiens
aggcauucuguggccagcca

SEQ ID NO: 645364 - RNA, 19 nt, Homo sapiens
aggcauugccuucucugcc

SEQ ID NO: 645365 - RNA, 16 nt, Homo sapiens
aggcauuuauugccau

SEQ ID NO: 645366 - RNA, 14 nt, Homo sapiens
aggcauuucuauca

SEQ ID NO: 645367 - RNA, 18 nt, Homo sapiens
aggcauuugcaggguccu

SEQ ID NO: 645368 - RNA, 14 nt, Homo sapiens
aggcauuugccuaa

SEQ ID NO: 645369 - RNA, 20 nt, Homo sapiens
aggccaaggaaauauuuugu

SEQ ID NO: 645370 - RNA, 19 nt, Homo sapiens
aggccacacucagcacaag

SEQ ID NO: 645371 - RNA, 13 nt, Homo sapiens
aggccacaguggg

SEQ ID NO: 645372 - RNA, 14 nt, Homo sapiens
aggccacagugggg

SEQ ID NO: 645373 - RNA, 20 nt, Homo sapiens
aggccacccccuauccucug

SEQ ID NO: 645374 - RNA, 19 nt, Homo sapiens
aggccacccgggcugccug

SEQ ID NO: 645375 - RNA, 18 nt, Homo sapiens
aggccacccuagaaagaa

SEQ ID NO: 645376 - RNA, 14 nt, Homo sapiens
aggccacugugagc

SEQ ID NO: 645377 - RNA, 16 nt, Homo sapiens
aggccagcaagcucuu

SEQ ID NO: 645378 - RNA, 21 nt, Homo sapiens
aggccaggcgagccugacucu

SEQ ID NO: 645379 - RNA, 17 nt, Homo sapiens
aggccaguaugauuuau

SEQ ID NO: 645380 - RNA, 19 nt, Homo sapiens
aggccaguugaucugcucu

SEQ ID NO: 645381 - RNA, 17 nt, Homo sapiens
aggcccaacuaacaguc

SEQ ID NO: 645382 - RNA, 13 nt, Homo sapiens
aggcccaagagau

SEQ ID NO: 645383 - RNA, 20 nt, Homo sapiens
aggccccccagaaagcugcc

SEQ ID NO: 645384 - RNA, 21 nt, Homo sapiens
aggccccccagaaagcugcca

SEQ ID NO: 645385 - RNA, 18 nt, Homo sapiens
aggcccggacucaccaac

SEQ ID NO: 645386 - RNA, 10 nt, Homo sapiens
aggcccuccc

SEQ ID NO: 645387 - RNA, 20 nt, Homo sapiens
aggcccuugucgugggaugg

SEQ ID NO: 645388 - RNA, 20 nt, Homo sapiens
aggccgggcgcaguggcuca

SEQ ID NO: 645389 - RNA, 22 nt, Homo sapiens
aggccgggcgcaguggcucacg

SEQ ID NO: 645390 - RNA, 17 nt, Homo sapiens
aggccguccucccgggc

SEQ ID NO: 645391 - RNA, 22 nt, Homo sapiens
aggccguugguugucugaagag

SEQ ID NO: 645392 - RNA, 23 nt, Homo sapiens
aggccuagacucugucuaccugg

SEQ ID NO: 645393 - RNA, 23 nt, Homo sapiens
aggccuauaacuuuugguaucua

SEQ ID NO: 645394 - RNA, 22 nt, Homo sapiens
aggccucaagaacaaacacugc

SEQ ID NO: 645395 - RNA, 15 nt, Homo sapiens
aggccucaucuccuu

SEQ ID NO: 645396 - RNA, 13 nt, Homo sapiens
aggccucccagca

SEQ ID NO: 645397 - RNA, 19 nt, Homo sapiens
aggccucuccaguuugcac

SEQ ID NO: 645398 - RNA, 22 nt, Homo sapiens
aggccucuccaguuugcaccug

SEQ ID NO: 645399 - RNA, 19 nt, Homo sapiens
aggccucucucaccucucc

SEQ ID NO: 645400 - RNA, 10 nt, Homo sapiens
aggccugaag

SEQ ID NO: 645401 - RNA, 20 nt, Homo sapiens
aggccugcagacagaccuca

SEQ ID NO: 645402 - RNA, 16 nt, Homo sapiens
aggccuggccaugugg

SEQ ID NO: 645403 - RNA, 20 nt, Homo sapiens
aggccugggcaggacccugc

SEQ ID NO: 645404 - RNA, 18 nt, Homo sapiens
aggccuggggaggcccua

SEQ ID NO: 645405 - RNA, 22 nt, Homo sapiens
aggccuggguuuguacuuccac

SEQ ID NO: 645406 - RNA, 12 nt, Homo sapiens
aggccugucagc

SEQ ID NO: 645407 - RNA, 21 nt, Homo sapiens
aggccuucaguuuauuuccac

SEQ ID NO: 645408 - RNA, 14 nt, Homo sapiens
aggccuuccaacgc

SEQ ID NO: 645409 - RNA, 16 nt, Homo sapiens
aggccuugcucacuca

SEQ ID NO: 645410 - RNA, 14 nt, Homo sapiens
aggccuuuugcccg

SEQ ID NO: 645411 - RNA, 13 nt, Homo sapiens
aggcgaugugcaa

SEQ ID NO: 645412 - RNA, 14 nt, Homo sapiens
aggcgaugugcaag

SEQ ID NO: 645413 - RNA, 21 nt, Homo sapiens
aggcgcccgggauccagcuca

SEQ ID NO: 645414 - RNA, 20 nt, Homo sapiens
aggcgccugccaucaugccu

SEQ ID NO: 645415 - RNA, 14 nt, Homo sapiens
aggcgcuaauuuau

SEQ ID NO: 645416 - RNA, 19 nt, Homo sapiens
aggcgcugagacugugcug

SEQ ID NO: 645417 - RNA, 18 nt, Homo sapiens
aggcggagcuugcaguga

SEQ ID NO: 645418 - RNA, 16 nt, Homo sapiens
aggcgggagaacugaa

SEQ ID NO: 645419 - RNA, 20 nt, Homo sapiens
aggcgggguuucaccaugcu

SEQ ID NO: 645420 - RNA, 18 nt, Homo sapiens
aggcggguggaucaccug

SEQ ID NO: 645421 - RNA, 18 nt, Homo sapiens
aggcggucaugugugcau

SEQ ID NO: 645422 - RNA, 23 nt, Homo sapiens
aggcguccgcgcgccagcacaga

SEQ ID NO: 645423 - RNA, 13 nt, Homo sapiens
aggcuaagcacuu

SEQ ID NO: 645424 - RNA, 15 nt, Homo sapiens
aggcuaaggcaggaa

SEQ ID NO: 645425 - RNA, 18 nt, Homo sapiens
aggcuacaguaaccaaaa

SEQ ID NO: 645426 - RNA, 12 nt, Homo sapiens
aggcuacauaua

SEQ ID NO: 645427 - RNA, 15 nt, Homo sapiens
aggcuacauauacau

SEQ ID NO: 645428 - RNA, 17 nt, Homo sapiens
aggcuaccucaccuggg

SEQ ID NO: 645429 - RNA, 20 nt, Homo sapiens
aggcuacucauucaguccca

SEQ ID NO: 645430 - RNA, 14 nt, Homo sapiens
aggcuagagugcaa

SEQ ID NO: 645431 - RNA, 15 nt, Homo sapiens
aggcuagagugcaau

SEQ ID NO: 645432 - RNA, 23 nt, Homo sapiens
aggcuagguggguugaaagccaa

SEQ ID NO: 645433 - RNA, 21 nt, Homo sapiens
aggcuauguaaacaaaccaca

SEQ ID NO: 645434 - RNA, 20 nt, Homo sapiens
aggcucagggaaaggccagu

SEQ ID NO: 645435 - RNA, 18 nt, Homo sapiens
aggcucauuuaaaacagg

SEQ ID NO: 645436 - RNA, 21 nt, Homo sapiens
aggcuccaucguccauccucu

SEQ ID NO: 645437 - RNA, 21 nt, Homo sapiens
aggcucccucuuccucuccau

SEQ ID NO: 645438 - RNA, 21 nt, Homo sapiens
aggcuccugccaguguggaac

SEQ ID NO: 645439 - RNA, 15 nt, Homo sapiens
aggcucuaauguaca

SEQ ID NO: 645440 - RNA, 22 nt, Homo sapiens
aggcucuaauguacaauaaagc

SEQ ID NO: 645441 - RNA, 19 nt, Homo sapiens
aggcucucgcacaccucug

SEQ ID NO: 645442 - RNA, 16 nt, Homo sapiens
aggcucugaggggcac

SEQ ID NO: 645443 - RNA, 23 nt, Homo sapiens
aggcucuuaagcagcauggaaaa

SEQ ID NO: 645444 - RNA, 20 nt, Homo sapiens
aggcucuuaugugugccuuu

SEQ ID NO: 645445 - RNA, 15 nt, Homo sapiens
aggcucuuccuugaa

SEQ ID NO: 645446 - RNA, 19 nt, Homo sapiens
aggcugacacagccacugc

SEQ ID NO: 645447 - RNA, 16 nt, Homo sapiens
aggcugacagacucac

SEQ ID NO: 645448 - RNA, 19 nt, Homo sapiens
aggcugaccacagcacagc

SEQ ID NO: 645449 - RNA, 15 nt, Homo sapiens
agggcuagugacuug

SEQ ID NO: 645450 - RNA, 18 nt, Homo sapiens
agggcuccaaaucugccu

SEQ ID NO: 645451 - RNA, 23 nt, Homo sapiens
agggcuccaaaucugccuagaaa

SEQ ID NO: 645452 - RNA, 19 nt, Homo sapiens
agggcuccagcauccagcc

SEQ ID NO: 645453 - RNA, 14 nt, Homo sapiens
agggcuccuaucuu

SEQ ID NO: 645454 - RNA, 23 nt, Homo sapiens
agggcucuaccuccccugcguca

SEQ ID NO: 645455 - RNA, 13 nt, Homo sapiens
agggcugacauuu

SEQ ID NO: 645456 - RNA, 15 nt, Homo sapiens
agggcugagugucca

SEQ ID NO: 645457 - RNA, 18 nt, Homo sapiens
agggcugauggaggaaaa

SEQ ID NO: 645458 - RNA, 19 nt, Homo sapiens
agggcuggaagcuuucauu

SEQ ID NO: 645459 - RNA, 19 nt, Homo sapiens
agggcuggcagaaagggaa

SEQ ID NO: 645460 - RNA, 13 nt, Homo sapiens
agggcugggcuag

SEQ ID NO: 645461 - RNA, 14 nt, Homo sapiens
aggggaagaaggaa

SEQ ID NO: 645462 - RNA, 19 nt, Homo sapiens
aggggaagagauuagucuc

SEQ ID NO: 645463 - RNA, 12 nt, Homo sapiens
aguuacuugaaa

SEQ ID NO: 645464 - RNA, 19 nt, Homo sapiens
aguuacuuuagauggcaag

SEQ ID NO: 645465 - RNA, 24 nt, Homo sapiens
aguuacuuuugacccaugugcaag

SEQ ID NO: 645466 - RNA, 15 nt, Homo sapiens
aguuagcucauuuga

SEQ ID NO: 645467 - RNA, 12 nt, Homo sapiens
aguuaggauauu

SEQ ID NO: 645468 - RNA, 15 nt, Homo sapiens
aguuagguagcuuua

SEQ ID NO: 645469 - RNA, 13 nt, Homo sapiens
aguuaggugcuga

SEQ ID NO: 645470 - RNA, 14 nt, Homo sapiens
aguuagucaauccu

SEQ ID NO: 645471 - RNA, 15 nt, Homo sapiens
aguuagucaauccug

SEQ ID NO: 645472 - RNA, 23 nt, Homo sapiens
aguuaguguuuugccucaccuaa

SEQ ID NO: 645473 - RNA, 14 nt, Homo sapiens
aguuauaugauauu

SEQ ID NO: 645474 - RNA, 16 nt, Homo sapiens
aguuauauugaauaua

SEQ ID NO: 645475 - RNA, 14 nt, Homo sapiens
aguuaucaucucac

SEQ ID NO: 645476 - RNA, 23 nt, Homo sapiens
aguuaucaucucaccacaccaca

SEQ ID NO: 645477 - RNA, 16 nt, Homo sapiens
aguuauguucagucac

SEQ ID NO: 645478 - RNA, 17 nt, Homo sapiens
aguuauuaaacaguguu

SEQ ID NO: 645479 - RNA, 18 nt, Homo sapiens
aguuauucauauucuguu

SEQ ID NO: 645480 - RNA, 19 nt, Homo sapiens
aguuauucucuucacuccc

SEQ ID NO: 645481 - RNA, 15 nt, Homo sapiens
aguucaauacaguga

SEQ ID NO: 645482 - RNA, 13 nt, Homo sapiens
agauucuaccaca

SEQ ID NO: 645483 - RNA, 15 nt, Homo sapiens
agauucugaccuuaa

SEQ ID NO: 645484 - RNA, 18 nt, Homo sapiens
agauucuggguuugccca

SEQ ID NO: 645485 - RNA, 21 nt, Homo sapiens
agauucuuuuuuucugucagu

SEQ ID NO: 645486 - RNA, 18 nt, Homo sapiens
agauugaaccugaauauu

SEQ ID NO: 645487 - RNA, 23 nt, Homo sapiens
agauugcgccauugcacuccagc

SEQ ID NO: 645488 - RNA, 16 nt, Homo sapiens
agauuggaaagacagg

SEQ ID NO: 645489 - RNA, 18 nt, Homo sapiens
agauuggccagcaaaaac

SEQ ID NO: 645490 - RNA, 22 nt, Homo sapiens
agauuguuaggagugguucuca

SEQ ID NO: 645491 - RNA, 22 nt, Homo sapiens
agauuuaaaaaaagaacauaaa

SEQ ID NO: 645492 - RNA, 15 nt, Homo sapiens
agauuuaaagcacau

SEQ ID NO: 645493 - RNA, 15 nt, Homo sapiens
agauuuaacauuauc

SEQ ID NO: 645494 - RNA, 15 nt, Homo sapiens
agauuuccuaacucu

SEQ ID NO: 645495 - RNA, 20 nt, Homo sapiens
agauuugagcucagcccugg

SEQ ID NO: 645496 - RNA, 21 nt, Homo sapiens
agauuugcuguucacccacau

SEQ ID NO: 645497 - RNA, 18 nt, Homo sapiens
agauuugucuaauugcau

SEQ ID NO: 645498 - RNA, 18 nt, Homo sapiens
agauuugugcccauuccu

SEQ ID NO: 645499 - RNA, 18 nt, Homo sapiens
agauuuuagacuuaccuu

SEQ ID NO: 645500 - RNA, 15 nt, Homo sapiens
agauuuuaugcacag

SEQ ID NO: 645501 - RNA, 18 nt, Homo sapiens
agauuuuauuuauggaau

SEQ ID NO: 645502 - RNA, 22 nt, Homo sapiens
agauuuugaaugcuuccugaca

SEQ ID NO: 645503 - RNA, 16 nt, Homo sapiens
agauuuugcugagaug

SEQ ID NO: 645504 - RNA, 17 nt, Homo sapiens
agauuuugcugagauga

SEQ ID NO: 645505 - RNA, 17 nt, Homo sapiens
agauuuuuaagaacuuc

SEQ ID NO: 645506 - RNA, 22 nt, Homo sapiens
agauuuuuuccucugcauuuac

SEQ ID NO: 645507 - RNA, 18 nt, Homo sapiens
agauuuuuuuguguaugu

SEQ ID NO: 645508 - RNA, 19 nt, Homo sapiens
agauuuuuuuuggacuguu

SEQ ID NO: 645509 - RNA, 20 nt, Homo sapiens
agcaaaaaaauuauuuucuc

SEQ ID NO: 645510 - RNA, 17 nt, Homo sapiens
agcaaaacaucucugca

SEQ ID NO: 645511 - RNA, 17 nt, Homo sapiens
agcaaaacuccaucuca

SEQ ID NO: 645512 - RNA, 13 nt, Homo sapiens
agcaaaacuuucc

SEQ ID NO: 645513 - RNA, 15 nt, Homo sapiens
agcaaaaggcagcuc

SEQ ID NO: 645514 - RNA, 18 nt, Homo sapiens
agcaaaagggaggaacac

SEQ ID NO: 645515 - RNA, 15 nt, Homo sapiens
agcaaaaguagccau

SEQ ID NO: 645516 - RNA, 17 nt, Homo sapiens
agcaaaagucauuacac

SEQ ID NO: 645517 - RNA, 23 nt, Homo sapiens
agcaaaauaguauugcugaacuc

SEQ ID NO: 645518 - RNA, 13 nt, Homo sapiens
agcaaacaaguug

SEQ ID NO: 645519 - RNA, 16 nt, Homo sapiens
agcaaacaaugguguc

SEQ ID NO: 645520 - RNA, 13 nt, Homo sapiens
agcaaagacaaaa

SEQ ID NO: 645521 - RNA, 19 nt, Homo sapiens
agcaaagauuaaauguguc

SEQ ID NO: 645522 - RNA, 20 nt, Homo sapiens
agcaaagauugugccacuac

SEQ ID NO: 645523 - RNA, 20 nt, Homo sapiens
agcaaauaaaugccuuccac

SEQ ID NO: 645524 - RNA, 20 nt, Homo sapiens
agcaaauaauuuccuggugu

SEQ ID NO: 645525 - RNA, 18 nt, Homo sapiens
agcaaauagaucaugcau

SEQ ID NO: 645526 - RNA, 15 nt, Homo sapiens
agcaaaucacgacca

SEQ ID NO: 645527 - RNA, 12 nt, Homo sapiens
agcaaaugacaa

SEQ ID NO: 645528 - RNA, 16 nt, Homo sapiens
agcaaaugaucagccu

SEQ ID NO: 645529 - RNA, 17 nt, Homo sapiens
agcaaaugaucagccuu

SEQ ID NO: 645530 - RNA, 18 nt, Homo sapiens
agcaaaugcuacauauau

SEQ ID NO: 645531 - RNA, 20 nt, Homo sapiens
agcaaaugcuauuugauaac

SEQ ID NO: 645532 - RNA, 18 nt, Homo sapiens
agcaaauggcagaaccaa

SEQ ID NO: 645533 - RNA, 19 nt, Homo sapiens
agcaaauggccucauguca

SEQ ID NO: 645534 - RNA, 15 nt, Homo sapiens
agcaaauguggcucc

SEQ ID NO: 645535 - RNA, 16 nt, Homo sapiens
agcaaauguggcuccu

SEQ ID NO: 645536 - RNA, 18 nt, Homo sapiens
agcaaauguuaugcauaa

SEQ ID NO: 645537 - RNA, 20 nt, Homo sapiens
agcaacaccuccagcagaga

SEQ ID NO: 645538 - RNA, 16 nt, Homo sapiens
agcaacagacucucac

SEQ ID NO: 645539 - RNA, 18 nt, Homo sapiens
agcaacaggccauuguga

SEQ ID NO: 645540 - RNA, 15 nt, Homo sapiens
agcaacaucucggga

SEQ ID NO: 645541 - RNA, 22 nt, Homo sapiens
agcaacaucuuuuuaaccugca

SEQ ID NO: 645542 - RNA, 19 nt, Homo sapiens
agcaacauucauagucuuu

SEQ ID NO: 645543 - RNA, 18 nt, Homo sapiens
agcaacccuaacaguaag

SEQ ID NO: 645544 - RNA, 20 nt, Homo sapiens
agcaaccuauauaaaccugg

SEQ ID NO: 645545 - RNA, 19 nt, Homo sapiens
agcaaccuguaacucacau

SEQ ID NO: 645546 - RNA, 22 nt, Homo sapiens
agcaacugaauaaauaccucuu

SEQ ID NO: 645547 - RNA, 23 nt, Homo sapiens
agcaacugcuggggagacaaauc

SEQ ID NO: 645548 - RNA, 16 nt, Homo sapiens
agcaacuucaaguaua

SEQ ID NO: 645549 - RNA, 13 nt, Homo sapiens
agcaacuugaugg

SEQ ID NO: 645550 - RNA, 13 nt, Homo sapiens
agcaacuuuccuu

SEQ ID NO: 645551 - RNA, 17 nt, Homo sapiens
agcaagacauacuuaau

SEQ ID NO: 645552 - RNA, 17 nt, Homo sapiens
agcaagacuccaucuca

SEQ ID NO: 645553 - RNA, 18 nt, Homo sapiens
agcaagacucugucucaa

SEQ ID NO: 645554 - RNA, 15 nt, Homo sapiens
agcaagagacaauaa

SEQ ID NO: 645555 - RNA, 19 nt, Homo sapiens
agcaagaugugaaagaaga

SEQ ID NO: 645556 - RNA, 18 nt, Homo sapiens
agcaagccgagcucuccu

SEQ ID NO: 645557 - RNA, 20 nt, Homo sapiens
agcaagcgcuguaaacccug

SEQ ID NO: 645558 - RNA, 14 nt, Homo sapiens
agcaagcuauucaa

SEQ ID NO: 645559 - RNA, 14 nt, Homo sapiens
agcaagucacuuaa

SEQ ID NO: 645560 - RNA, 20 nt, Homo sapiens
agcaaguguguguuugccaa

SEQ ID NO: 645561 - RNA, 20 nt, Homo sapiens
agcaaguuccugagugcgug

SEQ ID NO: 645562 - RNA, 18 nt, Homo sapiens
agcaauacagacuacuuc

SEQ ID NO: 645563 - RNA, 16 nt, Homo sapiens
agcaauacuaagggaa

SEQ ID NO: 645564 - RNA, 14 nt, Homo sapiens
agcaauacucauca

SEQ ID NO: 645565 - RNA, 16 nt, Homo sapiens
agcaauacucaucaga

SEQ ID NO: 645566 - RNA, 16 nt, Homo sapiens
agcaauacuguuucca

SEQ ID NO: 645567 - RNA, 14 nt, Homo sapiens
agcaaucaagcacc

SEQ ID NO: 645568 - RNA, 21 nt, Homo sapiens
agcaaucucgcaguacauguu

SEQ ID NO: 645569 - RNA, 23 nt, Homo sapiens
agcaauggccagagccucuggcc

SEQ ID NO: 645570 - RNA, 18 nt, Homo sapiens
agcaauggggaauacaag

SEQ ID NO: 645571 - RNA, 21 nt, Homo sapiens
agcaaugugccuugauugauu

SEQ ID NO: 645572 - RNA, 18 nt, Homo sapiens
agcaauuaguaagccaug

SEQ ID NO: 645573 - RNA, 15 nt, Homo sapiens
agcaauuagugauau

SEQ ID NO: 645574 - RNA, 16 nt, Homo sapiens
agcaauuccagggugg

SEQ ID NO: 645575 - RNA, 16 nt, Homo sapiens
agcaauucuccugccu

SEQ ID NO: 645576 - RNA, 18 nt, Homo sapiens
agcaauugaaaugcauug

SEQ ID NO: 645577 - RNA, 19 nt, Homo sapiens
agcaauugguuguuuaaca

SEQ ID NO: 645578 - RNA, 21 nt, Homo sapiens
agcaauuucccccuaaaccaa

SEQ ID NO: 645579 - RNA, 14 nt, Homo sapiens
agcaauuucuaauu

SEQ ID NO: 645580 - RNA, 18 nt, Homo sapiens
agcacaaccggucccuuc

SEQ ID NO: 645581 - RNA, 22 nt, Homo sapiens
agcacaagcaggugaacuggga

SEQ ID NO: 645582 - RNA, 22 nt, Homo sapiens
agcacaauggucuuacauugga

SEQ ID NO: 645583 - RNA, 14 nt, Homo sapiens
agcacaauuugcac

SEQ ID NO: 645584 - RNA, 21 nt, Homo sapiens
agcacaauuugcacuaaauca

SEQ ID NO: 645585 - RNA, 11 nt, Homo sapiens
agcacacugua

SEQ ID NO: 645586 - RNA, 17 nt, Homo sapiens
agcacacuuaugggcca

SEQ ID NO: 645587 - RNA, 19 nt, Homo sapiens
agcacagaauuugucagaa

SEQ ID NO: 645588 - RNA, 23 nt, Homo sapiens
agcacagagagggacacaugccc

SEQ ID NO: 645589 - RNA, 16 nt, Homo sapiens
agcacagccucagaau

SEQ ID NO: 645590 - RNA, 18 nt, Homo sapiens
agcacagccucagaauaa

SEQ ID NO: 645591 - RNA, 15 nt, Homo sapiens
agcacagcugcauua

SEQ ID NO: 645592 - RNA, 23 nt, Homo sapiens
agcacaggagcugccaugucaga

SEQ ID NO: 645593 - RNA, 18 nt, Homo sapiens
agcacaggcacugcagga

SEQ ID NO: 645594 - RNA, 12 nt, Homo sapiens
agcacagguguc

SEQ ID NO: 645595 - RNA, 16 nt, Homo sapiens
agcacauagcuugccu

SEQ ID NO: 645596 - RNA, 18 nt, Homo sapiens
agcacaucaauuacaagc

SEQ ID NO: 645597 - RNA, 17 nt, Homo sapiens
agcacaugccuacugcu

SEQ ID NO: 645598 - RNA, 13 nt, Homo sapiens
agcacauggccau

SEQ ID NO: 645599 - RNA, 18 nt, Homo sapiens
agcacauguauugacaac

SEQ ID NO: 645600 - RNA, 22 nt, Homo sapiens
auacaacacugagccauuugcu

SEQ ID NO: 645601 - RNA, 15 nt, Homo sapiens
auacaacagcugccg

SEQ ID NO: 645602 - RNA, 19 nt, Homo sapiens
auacaacauuaaggaauuu

SEQ ID NO: 645603 - RNA, 22 nt, Homo sapiens
auacaaccauauaaaugaaggc

SEQ ID NO: 645604 - RNA, 17 nt, Homo sapiens
auacaacuccuauucac

SEQ ID NO: 645605 - RNA, 21 nt, Homo sapiens
auacaacuguaaagcaaauau

SEQ ID NO: 645606 - RNA, 21 nt, Homo sapiens
auacaaggugagugugacuuc

SEQ ID NO: 645607 - RNA, 17 nt, Homo sapiens
auacaaguauccaguca

SEQ ID NO: 645608 - RNA, 23 nt, Homo sapiens
auacaauggguaucgcugagacu

SEQ ID NO: 645609 - RNA, 19 nt, Homo sapiens
auacaauuauuuuuacagu

SEQ ID NO: 645610 - RNA, 22 nt, Homo sapiens
auacaauuauuuuuacaguucu

SEQ ID NO: 645611 - RNA, 19 nt, Homo sapiens
auacaauuccaaacacaua

SEQ ID NO: 645612 - RNA, 20 nt, Homo sapiens
auacaauuuuuuuuauuagu

SEQ ID NO: 645613 - RNA, 12 nt, Homo sapiens
auacacacaaaa

SEQ ID NO: 645614 - RNA, 16 nt, Homo sapiens
auacacacacaaacca

SEQ ID NO: 645615 - RNA, 13 nt, Homo sapiens
auacacacauaua

SEQ ID NO: 645616 - RNA, 17 nt, Homo sapiens
auacacacuguugucaa

SEQ ID NO: 645617 - RNA, 20 nt, Homo sapiens
auacacagaugauaauaugc

SEQ ID NO: 645618 - RNA, 22 nt, Homo sapiens
auacacagcuuuaugauaucaa

SEQ ID NO: 645619 - RNA, 15 nt, Homo sapiens
auacacauaagcaua

SEQ ID NO: 645620 - RNA, 16 nt, Homo sapiens
auacacauacauacac

SEQ ID NO: 645621 - RNA, 23 nt, Homo sapiens
auacacauauauacccacaugua

SEQ ID NO: 645622 - RNA, 20 nt, Homo sapiens
auacaccacugcaaaauguc

SEQ ID NO: 645623 - RNA, 21 nt, Homo sapiens
auacacgguauuuauagagag

SEQ ID NO: 645624 - RNA, 18 nt, Homo sapiens
auacacuaaaaaucugag

SEQ ID NO: 645625 - RNA, 13 nt, Homo sapiens
auacacuaugaag

SEQ ID NO: 645626 - RNA, 22 nt, Homo sapiens
auacacugaaguuaacagagac

SEQ ID NO: 645627 - RNA, 16 nt, Homo sapiens
auacacugucacgugg

SEQ ID NO: 645628 - RNA, 13 nt, Homo sapiens
auacacuuaauga

SEQ ID NO: 645629 - RNA, 12 nt, Homo sapiens
auacacuugaag

SEQ ID NO: 645630 - RNA, 23 nt, Homo sapiens
auacagaaguccccucuacuuua

SEQ ID NO: 645631 - RNA, 22 nt, Homo sapiens
auacaggaggcagacaaugacc

SEQ ID NO: 645632 - RNA, 23 nt, Homo sapiens
auacaguuuggcuuuuuucacau

SEQ ID NO: 645633 - RNA, 23 nt, Homo sapiens
auacauaagcggcguaaguuuaa

SEQ ID NO: 645634 - RNA, 19 nt, Homo sapiens
auacauacggucagguuua

SEQ ID NO: 645635 - RNA, 15 nt, Homo sapiens
auacauaggcaucau

SEQ ID NO: 645636 - RNA, 19 nt, Homo sapiens
auacauaucgcugacuuca

SEQ ID NO: 645637 - RNA, 14 nt, Homo sapiens
auacauauuaucuc

SEQ ID NO: 645638 - RNA, 17 nt, Homo sapiens
auacauauuaucucauu

SEQ ID NO: 645639 - RNA, 20 nt, Homo sapiens
auacauauuuuguauuguuc

SEQ ID NO: 645640 - RNA, 18 nt, Homo sapiens
auacauccacagauucac

SEQ ID NO: 645641 - RNA, 22 nt, Homo sapiens
auacauccacaggguuuugaca

SEQ ID NO: 645642 - RNA, 13 nt, Homo sapiens
auacaugauugca

SEQ ID NO: 645643 - RNA, 18 nt, Homo sapiens
auacaugcauacaaagag

SEQ ID NO: 645644 - RNA, 13 nt, Homo sapiens
auacaugcauaua

SEQ ID NO: 645645 - RNA, 22 nt, Homo sapiens
auacaugccagugacacuucca

SEQ ID NO: 645646 - RNA, 13 nt, Homo sapiens
auacaugcugcua

SEQ ID NO: 645647 - RNA, 23 nt, Homo sapiens
auacauggaaucgaaguguuuau

SEQ ID NO: 645648 - RNA, 14 nt, Homo sapiens
auacauguaauucu

SEQ ID NO: 645649 - RNA, 15 nt, Homo sapiens
auacauguaauucua

SEQ ID NO: 645650 - RNA, 15 nt, Homo sapiens
auacaugugccgaau

SEQ ID NO: 645651 - RNA, 15 nt, Homo sapiens
auacauucuaugaca

SEQ ID NO: 645652 - RNA, 13 nt, Homo sapiens
auacauugcaauc

SEQ ID NO: 645653 - RNA, 18 nt, Homo sapiens
auacauuguauaggccau

SEQ ID NO: 645654 - RNA, 18 nt, Homo sapiens
auacauuuaugcacauuc

SEQ ID NO: 645655 - RNA, 15 nt, Homo sapiens
auacauuuccaaaau

SEQ ID NO: 645656 - RNA, 15 nt, Homo sapiens
auacauuugauaaag

SEQ ID NO: 645657 - RNA, 23 nt, Homo sapiens
auaccaaacaugcggugccauga

SEQ ID NO: 645658 - RNA, 14 nt, Homo sapiens
auaccaaagacaca

SEQ ID NO: 645659 - RNA, 23 nt, Homo sapiens
auaccaaaguguuuggucauuuu

SEQ ID NO: 645660 - RNA, 14 nt, Homo sapiens
auaccaauauuuac

SEQ ID NO: 645661 - RNA, 16 nt, Homo sapiens
auaccaccuuuacugu

SEQ ID NO: 645662 - RNA, 20 nt, Homo sapiens
auaccacuaauuuucgcuua

SEQ ID NO: 645663 - RNA, 13 nt, Homo sapiens
auaccacugcacu

SEQ ID NO: 645664 - RNA, 23 nt, Homo sapiens
auaccagcaggagguucugggcc

SEQ ID NO: 645665 - RNA, 18 nt, Homo sapiens
auaccagcauacgcucac

SEQ ID NO: 645666 - RNA, 21 nt, Homo sapiens
auaccagguuuuacacuugca

SEQ ID NO: 645667 - RNA, 22 nt, Homo sapiens
auaccagguuuuacacuugcau

SEQ ID NO: 645668 - RNA, 19 nt, Homo sapiens
auaccagugaaccaaagag

SEQ ID NO: 645669 - RNA, 13 nt, Homo sapiens
auaccauguggau

SEQ ID NO: 645670 - RNA, 15 nt, Homo sapiens
auaccauuauauguu

SEQ ID NO: 645671 - RNA, 17 nt, Homo sapiens
auaccauucacuacuca

SEQ ID NO: 645672 - RNA, 17 nt, Homo sapiens
auacccaaaugucccug

SEQ ID NO: 645673 - RNA, 20 nt, Homo sapiens
auacccaaaugucccugcaa

SEQ ID NO: 645674 - RNA, 16 nt, Homo sapiens
auacccuauccuggug

SEQ ID NO: 645675 - RNA, 14 nt, Homo sapiens
auaccgcucaguau

SEQ ID NO: 645676 - RNA, 19 nt, Homo sapiens
auaccuaugucaacaguau

SEQ ID NO: 645677 - RNA, 15 nt, Homo sapiens
auaccucaguuugca

SEQ ID NO: 645678 - RNA, 19 nt, Homo sapiens
auaccuuauuaacaaaaua

SEQ ID NO: 645679 - RNA, 17 nt, Homo sapiens
auaccuucaaugaauua

SEQ ID NO: 645680 - RNA, 15 nt, Homo sapiens
auaccuuccuucccu

SEQ ID NO: 645681 - RNA, 16 nt, Homo sapiens
auaccuuccuucccug

SEQ ID NO: 645682 - RNA, 22 nt, Homo sapiens
auaccuucugaacuacacugca

SEQ ID NO: 645683 - RNA, 21 nt, Homo sapiens
auaccuuggcugauguugcag

SEQ ID NO: 645684 - RNA, 17 nt, Homo sapiens
auaccuuguaaguggau

SEQ ID NO: 645685 - RNA, 12 nt, Homo sapiens
auaccuuuccag

SEQ ID NO: 645686 - RNA, 15 nt, Homo sapiens
auaccuuuccagggu

SEQ ID NO: 645687 - RNA, 15 nt, Homo sapiens
auaccuuuuuguguc

SEQ ID NO: 645688 - RNA, 16 nt, Homo sapiens
auacgcccucuuucau

SEQ ID NO: 645689 - RNA, 21 nt, Homo sapiens
auacgccuguaguccuagcca

SEQ ID NO: 645690 - RNA, 16 nt, Homo sapiens
auacguuucuguggag

SEQ ID NO: 645691 - RNA, 19 nt, Homo sapiens
auacuaacauuuucauuga

SEQ ID NO: 645692 - RNA, 18 nt, Homo sapiens
auacuaagggaagaaaca

SEQ ID NO: 645693 - RNA, 22 nt, Homo sapiens
auacuacaguaacugugacuga

SEQ ID NO: 645694 - RNA, 22 nt, Homo sapiens
auacuacugugugugcauugaa

SEQ ID NO: 645695 - RNA, 20 nt, Homo sapiens
auacuagaguugauuauaga

SEQ ID NO: 645696 - RNA, 23 nt, Homo sapiens
auacuagcaacaaacaauaugaa

SEQ ID NO: 645697 - RNA, 13 nt, Homo sapiens
auaugcacuugaa

SEQ ID NO: 645698 - RNA, 14 nt, Homo sapiens
auaugcacuugaaa

SEQ ID NO: 645699 - RNA, 22 nt, Homo sapiens
auaugcagaacguauuuagcca

SEQ ID NO: 645700 - RNA, 21 nt, Homo sapiens
auaugcagaauggcauuugca

SEQ ID NO: 645701 - RNA, 13 nt, Homo sapiens
auaugcagccgcu

SEQ ID NO: 645702 - RNA, 13 nt, Homo sapiens
auaugcgcuuaaa

SEQ ID NO: 645703 - RNA, 18 nt, Homo sapiens
auaugcugaacgcagaag

SEQ ID NO: 645704 - RNA, 19 nt, Homo sapiens
auaugcuggagauggacaa

SEQ ID NO: 645705 - RNA, 20 nt, Homo sapiens
auaugcuuauacacuuacac

SEQ ID NO: 645706 - RNA, 16 nt, Homo sapiens
auauggaaauucugcu

SEQ ID NO: 645707 - RNA, 18 nt, Homo sapiens
auauggaagcaaccagca

SEQ ID NO: 645708 - RNA, 16 nt, Homo sapiens
auauggagcucauguc

SEQ ID NO: 645709 - RNA, 18 nt, Homo sapiens
auaugguugauaguuuac

SEQ ID NO: 645710 - RNA, 19 nt, Homo sapiens
auauguaaauagugcagaa

SEQ ID NO: 645711 - RNA, 14 nt, Homo sapiens
auauguaccaugua

SEQ ID NO: 645712 - RNA, 21 nt, Homo sapiens
auauguauuauaggaggagcu

SEQ ID NO: 645713 - RNA, 18 nt, Homo sapiens
auaugucaccuggcacau

SEQ ID NO: 645714 - RNA, 22 nt, Homo sapiens
auaugugaaaggauaugaaucu

SEQ ID NO: 645715 - RNA, 21 nt, Homo sapiens
auaugugacugugacuuucaa

SEQ ID NO: 645716 - RNA, 12 nt, Homo sapiens
auaugugaugcc

SEQ ID NO: 645717 - RNA, 19 nt, Homo sapiens
auaugugauuuacauuuca

SEQ ID NO: 645718 - RNA, 18 nt, Homo sapiens
auaugugcgucucucuuu

SEQ ID NO: 645719 - RNA, 18 nt, Homo sapiens
auauguguaaagauuuau

SEQ ID NO: 645720 - RNA, 19 nt, Homo sapiens
auauguguauauauauaug

SEQ ID NO: 645721 - RNA, 15 nt, Homo sapiens
auauguugcuauaau

SEQ ID NO: 645722 - RNA, 19 nt, Homo sapiens
auauguuuauauacugggu

SEQ ID NO: 645723 - RNA, 15 nt, Homo sapiens
auauuaaaacacuua

SEQ ID NO: 645724 - RNA, 17 nt, Homo sapiens
auauuaaaauauggcua

SEQ ID NO: 645725 - RNA, 16 nt, Homo sapiens
auauuaaaaucugaug

SEQ ID NO: 645726 - RNA, 20 nt, Homo sapiens
augaagcaagccccacuuau

SEQ ID NO: 645727 - RNA, 19 nt, Homo sapiens
augaagcacaucaauuaca

SEQ ID NO: 645728 - RNA, 23 nt, Homo sapiens
augaagcagcuuuaaacaaauuc

SEQ ID NO: 645729 - RNA, 20 nt, Homo sapiens
augaaggauuacucuccaua

SEQ ID NO: 645730 - RNA, 23 nt, Homo sapiens
augaaggccaucuugauggucuc

SEQ ID NO: 645731 - RNA, 13 nt, Homo sapiens
augaagguaauau

SEQ ID NO: 645732 - RNA, 14 nt, Homo sapiens
augaagguaauauu

SEQ ID NO: 645733 - RNA, 17 nt, Homo sapiens
augaaguaucuuugaca

SEQ ID NO: 645734 - RNA, 15 nt, Homo sapiens
augaauaaaacacuc

SEQ ID NO: 645735 - RNA, 14 nt, Homo sapiens
augaauacagcauu

SEQ ID NO: 645736 - RNA, 22 nt, Homo sapiens
augaauagaggggcauucacaa

SEQ ID NO: 645737 - RNA, 20 nt, Homo sapiens
augaauagaugugaucacug

SEQ ID NO: 645738 - RNA, 23 nt, Homo sapiens
augaauagccaggccugaccuca

SEQ ID NO: 645739 - RNA, 11 nt, Homo sapiens
augaauaucag

SEQ ID NO: 645740 - RNA, 21 nt, Homo sapiens
augaaucucaagauucaguag

SEQ ID NO: 645741 - RNA, 22 nt, Homo sapiens
augaaugacaguagucacacau

SEQ ID NO: 645742 - RNA, 20 nt, Homo sapiens
augaauggacucaaacugcc

SEQ ID NO: 645743 - RNA, 23 nt, Homo sapiens
augaauggcuuggagugcacuga

SEQ ID NO: 645744 - RNA, 19 nt, Homo sapiens
augaauguaaacucggggg

SEQ ID NO: 645745 - RNA, 16 nt, Homo sapiens
augaauuaguucuccu

SEQ ID NO: 645746 - RNA, 17 nt, Homo sapiens
augaauuauuacagugu

SEQ ID NO: 645747 - RNA, 18 nt, Homo sapiens
augaauucaagaaaggaa

SEQ ID NO: 645748 - RNA, 12 nt, Homo sapiens
augaauuuccac

SEQ ID NO: 645749 - RNA, 23 nt, Homo sapiens
augaauuuuguaucugcuuccau

SEQ ID NO: 645750 - RNA, 16 nt, Homo sapiens
augacaaaaagccuuu

SEQ ID NO: 645751 - RNA, 17 nt, Homo sapiens
augacaaaaaggugcag

SEQ ID NO: 645752 - RNA, 15 nt, Homo sapiens
augacaaucaguuau

SEQ ID NO: 645753 - RNA, 18 nt, Homo sapiens
augacaauguuuacucaa

SEQ ID NO: 645754 - RNA, 22 nt, Homo sapiens
augacacacaaaucccauuaaa

SEQ ID NO: 645755 - RNA, 16 nt, Homo sapiens
augacacuacuugaua

SEQ ID NO: 645756 - RNA, 18 nt, Homo sapiens
augacagcugucccuguc

SEQ ID NO: 645757 - RNA, 16 nt, Homo sapiens
augacaguagcauuau

SEQ ID NO: 645758 - RNA, 16 nt, Homo sapiens
augacaguauuccauu

SEQ ID NO: 645759 - RNA, 19 nt, Homo sapiens
ugaauuucauuaaauggaa

SEQ ID NO: 645760 - RNA, 15 nt, Homo sapiens
ugaauuucuaaaaaa

SEQ ID NO: 645761 - RNA, 20 nt, Homo sapiens
ugaauuucuagacaguauug

SEQ ID NO: 645762 - RNA, 15 nt, Homo sapiens
ugaauuucugaaaga

SEQ ID NO: 645763 - RNA, 21 nt, Homo sapiens
ugaauuuguauuaaaaagccu

SEQ ID NO: 645764 - RNA, 23 nt, Homo sapiens
ugaauuuuaguuugguucacuua

SEQ ID NO: 645765 - RNA, 20 nt, Homo sapiens
ugaauuuuguguguaccugu

SEQ ID NO: 645766 - RNA, 18 nt, Homo sapiens
ugaauuuuugccuaucuu

SEQ ID NO: 645767 - RNA, 22 nt, Homo sapiens
ugacaaaaccuuuaaucugcac

SEQ ID NO: 645768 - RNA, 14 nt, Homo sapiens
ugacaaaagaaaau

SEQ ID NO: 645769 - RNA, 20 nt, Homo sapiens
ugacaaaagcagcacaagga

SEQ ID NO: 645770 - RNA, 18 nt, Homo sapiens
ugacaaaauucauuugcu

SEQ ID NO: 645771 - RNA, 14 nt, Homo sapiens
ugacaaagacuccu

SEQ ID NO: 645772 - RNA, 19 nt, Homo sapiens
ugacaaccugaauuaucua

SEQ ID NO: 645773 - RNA, 15 nt, Homo sapiens
ugacaacuacuuuaa

SEQ ID NO: 645774 - RNA, 20 nt, Homo sapiens
ugacaagcugacuuggcacu

SEQ ID NO: 645775 - RNA, 23 nt, Homo sapiens
ugacaaggcuacgcugacaauca

SEQ ID NO: 645776 - RNA, 13 nt, Homo sapiens
ugacaagugagac

SEQ ID NO: 645777 - RNA, 20 nt, Homo sapiens
ugacaaucaguuaaacacac

SEQ ID NO: 645778 - RNA, 15 nt, Homo sapiens
ugacaauggcagcua

SEQ ID NO: 645779 - RNA, 14 nt, Homo sapiens
ugacacaaugaagu

SEQ ID NO: 645780 - RNA, 21 nt, Homo sapiens
ugacacauagaaaacaaucaa

SEQ ID NO: 645781 - RNA, 19 nt, Homo sapiens
ugacacaucaagcuuuucu

SEQ ID NO: 645782 - RNA, 12 nt, Homo sapiens
ugacacccagac

SEQ ID NO: 645783 - RNA, 20 nt, Homo sapiens
ugacaccggggggcucccag

SEQ ID NO: 645784 - RNA, 22 nt, Homo sapiens
ugacaccgucccucagugauac

SEQ ID NO: 645785 - RNA, 21 nt, Homo sapiens
ugacaccgugggucauuacaa

SEQ ID NO: 645786 - RNA, 23 nt, Homo sapiens
ugacaccgugggucauuacaaaa

SEQ ID NO: 645787 - RNA, 21 nt, Homo sapiens
ugacacggccucccucugcua

SEQ ID NO: 645788 - RNA, 19 nt, Homo sapiens
ugacacuagcuaauaucaa

SEQ ID NO: 645789 - RNA, 23 nt, Homo sapiens
ugacacucuauaagauuccaaaa

SEQ ID NO: 645790 - RNA, 10 nt, Homo sapiens
ugacacugaa

SEQ ID NO: 645791 - RNA, 17 nt, Homo sapiens
ugacacuguuuuccuua

SEQ ID NO: 645792 - RNA, 11 nt, Homo sapiens
ugacacuuuuu

SEQ ID NO: 645793 - RNA, 16 nt, Homo sapiens
ugacagagaauaacuc

SEQ ID NO: 645794 - RNA, 19 nt, Homo sapiens
ugacagauauuuuaucuau

SEQ ID NO: 645795 - RNA, 19 nt, Homo sapiens
ugacagaucaagcugugag

SEQ ID NO: 645796 - RNA, 20 nt, Homo sapiens
ugacagauggugaaguaaca

SEQ ID NO: 645797 - RNA, 11 nt, Homo sapiens
ugacagcaaua

SEQ ID NO: 645798 - RNA, 12 nt, Homo sapiens
ugacagcaauaa

SEQ ID NO: 645799 - RNA, 19 nt, Homo sapiens
ugacagcucccgggucccc

SEQ ID NO: 645800 - RNA, 16 nt, Homo sapiens
ugacaggaaagcccuc

SEQ ID NO: 645801 - RNA, 20 nt, Homo sapiens
ugacagggacaugcccugug

SEQ ID NO: 645802 - RNA, 16 nt, Homo sapiens
ugacagggaugccaac

SEQ ID NO: 645803 - RNA, 14 nt, Homo sapiens
ugacagggccagug

SEQ ID NO: 645804 - RNA, 19 nt, Homo sapiens
ugacaggugccuguccuug

SEQ ID NO: 645805 - RNA, 19 nt, Homo sapiens
ugacaguccacaggggcca

SEQ ID NO: 645806 - RNA, 17 nt, Homo sapiens
ugacaguccuccaucca

SEQ ID NO: 645807 - RNA, 20 nt, Homo sapiens
ugacagugaagcagcacugu

SEQ ID NO: 645808 - RNA, 12 nt, Homo sapiens
ugacagugaauu

SEQ ID NO: 645809 - RNA, 15 nt, Homo sapiens
ugacauaaguaacuu

SEQ ID NO: 645810 - RNA, 13 nt, Homo sapiens
ugacauacauauu

SEQ ID NO: 645811 - RNA, 19 nt, Homo sapiens
ugacauacauauuaucuca

SEQ ID NO: 645812 - RNA, 17 nt, Homo sapiens
ugacauaggcaauaaua

SEQ ID NO: 645813 - RNA, 16 nt, Homo sapiens
ugacauauacuaaaua

SEQ ID NO: 645814 - RNA, 22 nt, Homo sapiens
ugacauauacucaaaacaguaa

SEQ ID NO: 645815 - RNA, 20 nt, Homo sapiens
ugacauauucaagugauagg

SEQ ID NO: 645816 - RNA, 18 nt, Homo sapiens
ugacaucauucaugacaa

SEQ ID NO: 645817 - RNA, 22 nt, Homo sapiens
ugacauccagaaagcugaggaa

SEQ ID NO: 645818 - RNA, 14 nt, Homo sapiens
ugacaucucagggg

SEQ ID NO: 645819 - RNA, 15 nt, Homo sapiens
ugacaugcacucagc

SEQ ID NO: 645820 - RNA, 20 nt, Homo sapiens
ugacaugugaagcuauuuga

SEQ ID NO: 645821 - RNA, 15 nt, Homo sapiens
ugacaugugccauuu

SEQ ID NO: 645822 - RNA, 17 nt, Homo sapiens
ugacauuauaugcacua

SEQ ID NO: 645823 - RNA, 13 nt, Homo sapiens
ugacauuccaggg

SEQ ID NO: 645824 - RNA, 23 nt, Homo sapiens
ugacauugcguuugaccuuuuau

SEQ ID NO: 645825 - RNA, 15 nt, Homo sapiens
ugacauuuaggauuu

SEQ ID NO: 645826 - RNA, 20 nt, Homo sapiens
ugacauuuauauauugaauu

SEQ ID NO: 645827 - RNA, 19 nt, Homo sapiens
ugacauuucuaacauaugu

SEQ ID NO: 645828 - RNA, 20 nt, Homo sapiens
ugaccaaaacaaacaaacag

SEQ ID NO: 645829 - RNA, 17 nt, Homo sapiens
ugaccaaacagccaaga

SEQ ID NO: 645830 - RNA, 17 nt, Homo sapiens
ugaccaaagagcccuca

SEQ ID NO: 645831 - RNA, 11 nt, Homo sapiens
ugaacacuccc

SEQ ID NO: 645832 - RNA, 12 nt, Homo sapiens
ugaacacucccc

SEQ ID NO: 645833 - RNA, 21 nt, Homo sapiens
ugaacacucuuuugcuuuauu

SEQ ID NO: 645834 - RNA, 18 nt, Homo sapiens
ugaacacuggcuaaagau

SEQ ID NO: 645835 - RNA, 15 nt, Homo sapiens
ugaacacuguucuac

SEQ ID NO: 645836 - RNA, 22 nt, Homo sapiens
ugaacacuuuagguagaugaac

SEQ ID NO: 645837 - RNA, 15 nt, Homo sapiens
ugaacagaaacuaca

SEQ ID NO: 645838 - RNA, 15 nt, Homo sapiens
ugaacagaaaugcau

SEQ ID NO: 645839 - RNA, 20 nt, Homo sapiens
ugaacagcucaccacugugc

SEQ ID NO: 645840 - RNA, 23 nt, Homo sapiens
ugaacauaggaaaauagaaacuu

SEQ ID NO: 645841 - RNA, 16 nt, Homo sapiens
ugaacauccccuccca

SEQ ID NO: 645842 - RNA, 22 nt, Homo sapiens
ugaacaucccuuuuucaaugaa

SEQ ID NO: 645843 - RNA, 17 nt, Homo sapiens
ugaacauccuuccuucc

SEQ ID NO: 645844 - RNA, 21 nt, Homo sapiens
ugaacaucuuuaggagacuaa

SEQ ID NO: 645845 - RNA, 19 nt, Homo sapiens
ugaacauuguacuguugcu

SEQ ID NO: 645846 - RNA, 11 nt, Homo sapiens
ugaacauuuca

SEQ ID NO: 645847 - RNA, 14 nt, Homo sapiens
ugaaccaacaucuu

SEQ ID NO: 645848 - RNA, 17 nt, Homo sapiens
ugaaccagugauccaug

SEQ ID NO: 645849 - RNA, 12 nt, Homo sapiens
ugaaccauaaag

SEQ ID NO: 645850 - RNA, 13 nt, Homo sapiens
ugaaccaucucag

SEQ ID NO: 645851 - RNA, 15 nt, Homo sapiens
ugaacccacugcugc

SEQ ID NO: 645852 - RNA, 15 nt, Homo sapiens
ugaacccagaaggca

SEQ ID NO: 645853 - RNA, 17 nt, Homo sapiens
ugaaccgaggggcucag

SEQ ID NO: 645854 - RNA, 20 nt, Homo sapiens
ugaaccgaggggcucaggaa

SEQ ID NO: 645855 - RNA, 18 nt, Homo sapiens
ugaaccgcacagcucagg

SEQ ID NO: 645856 - RNA, 18 nt, Homo sapiens
ugaaccugaauauugcca

SEQ ID NO: 645857 - RNA, 20 nt, Homo sapiens
ugaaccugaggaugcaucuu

SEQ ID NO: 645858 - RNA, 22 nt, Homo sapiens
ugaacgaccuuacaaaugagga

SEQ ID NO: 645859 - RNA, 19 nt, Homo sapiens
ugaacgacuguauauugcu

SEQ ID NO: 645860 - RNA, 18 nt, Homo sapiens
ugaacggcugaauaugaa

SEQ ID NO: 645861 - RNA, 14 nt, Homo sapiens
ugaacuaacugaca

SEQ ID NO: 645862 - RNA, 17 nt, Homo sapiens
ugaacuaaucugauguu

SEQ ID NO: 645863 - RNA, 19 nt, Homo sapiens
ugaacuagauugcaugcuu

SEQ ID NO: 645864 - RNA, 20 nt, Homo sapiens
ugaacuaguuuaauguggau

SEQ ID NO: 645865 - RNA, 14 nt, Homo sapiens
ugaacucccgccac

SEQ ID NO: 645866 - RNA, 16 nt, Homo sapiens
ugaacuccuuccccac

SEQ ID NO: 645867 - RNA, 20 nt, Homo sapiens
ugaacucuuaggcacaucaa

SEQ ID NO: 645868 - RNA, 18 nt, Homo sapiens
ugaacugaaguuucacau

SEQ ID NO: 645869 - RNA, 14 nt, Homo sapiens
ugaacugacaauga

SEQ ID NO: 645870 - RNA, 23 nt, Homo sapiens
ugaacuguuuggucgagucuuug

SEQ ID NO: 645871 - RNA, 18 nt, Homo sapiens
ugaacuuggcuguaauca

SEQ ID NO: 645872 - RNA, 16 nt, Homo sapiens
ugaagaaaagaccuuu

SEQ ID NO: 645873 - RNA, 16 nt, Homo sapiens
ugaagaaaagagucca

SEQ ID NO: 645874 - RNA, 14 nt, Homo sapiens
ugaagaaacuuccc

SEQ ID NO: 645875 - RNA, 12 nt, Homo sapiens
ugaagaaaggga

SEQ ID NO: 645876 - RNA, 23 nt, Homo sapiens
ugaagaacugcaggcccuggccu

SEQ ID NO: 645877 - RNA, 19 nt, Homo sapiens
ugaagaacugcauguggcu

SEQ ID NO: 645878 - RNA, 23 nt, Homo sapiens
ugaagaagagacucuuugcauau

SEQ ID NO: 645879 - RNA, 17 nt, Homo sapiens
ugaagaaugcauucaaa

SEQ ID NO: 645880 - RNA, 16 nt, Homo sapiens
ugaagacaacagcaua

SEQ ID NO: 645881 - RNA, 13 nt, Homo sapiens
ugaagacauucca

SEQ ID NO: 645882 - RNA, 17 nt, Homo sapiens
ugaagacugaggacaaa

SEQ ID NO: 645883 - RNA, 20 nt, Homo sapiens
ugaagacugcacaggugaca

SEQ ID NO: 645884 - RNA, 20 nt, Homo sapiens
ugaagagaaccgagcaaaga

SEQ ID NO: 645885 - RNA, 21 nt, Homo sapiens
ugaagagauccuucuguaaag

SEQ ID NO: 645886 - RNA, 18 nt, Homo sapiens
ugaagagcgauugugagg

SEQ ID NO: 645887 - RNA, 15 nt, Homo sapiens
ugaagagcuauuaua

SEQ ID NO: 645888 - RNA, 18 nt, Homo sapiens
ugaagagggagaagggau

SEQ ID NO: 645889 - RNA, 23 nt, Homo sapiens
ugaagaguauccuuccuucaggg

SEQ ID NO: 645890 - RNA, 19 nt, Homo sapiens
ugaagaguccucugaauga

SEQ ID NO: 645891 - RNA, 14 nt, Homo sapiens
ugaagaguuucaca

SEQ ID NO: 645892 - RNA, 20 nt, Homo sapiens
ugaagauaagaaaugaucuu

SEQ ID NO: 645893 - RNA, 19 nt, Homo sapiens
ugaagauaauaaucuuggc

SEQ ID NO: 645894 - RNA, 20 nt, Homo sapiens
ugaagauaucuugaaaugaa

SEQ ID NO: 645895 - RNA, 19 nt, Homo sapiens
ugaagaucauauacgugaa

SEQ ID NO: 645896 - RNA, 20 nt, Homo sapiens
ugaagaucugguuccagaac

SEQ ID NO: 645897 - RNA, 21 nt, Homo sapiens
ugaagauggcauccugugaag

SEQ ID NO: 645898 - RNA, 13 nt, Homo sapiens
ugaagaugucucc

SEQ ID NO: 645899 - RNA, 20 nt, Homo sapiens
ugaagauucuccugugcuag

SEQ ID NO: 645900 - RNA, 16 nt, Homo sapiens
ugaagcaaaucagaaa

SEQ ID NO: 645901 - RNA, 13 nt, Homo sapiens
ugaagcaaaugug

SEQ ID NO: 645902 - RNA, 18 nt, Homo sapiens
ugaagcaaccuacuuuug

SEQ ID NO: 645903 - RNA, 13 nt, Homo sapiens
ugaagcaauaacu

SEQ ID NO: 645904 - RNA, 17 nt, Homo sapiens
ugaagcacaacucccuu

SEQ ID NO: 645905 - RNA, 13 nt, Homo sapiens
ugaagcacaucaa

SEQ ID NO: 645906 - RNA, 11 nt, Homo sapiens
ugaagcacuua

SEQ ID NO: 645907 - RNA, 23 nt, Homo sapiens
ugaagcacuuaagucuuccuuaa

SEQ ID NO: 645908 - RNA, 15 nt, Homo sapiens
ugaagcagcacugug

SEQ ID NO: 645909 - RNA, 23 nt, Homo sapiens
ugaagcauaccccggccucucag

SEQ ID NO: 645910 - RNA, 14 nt, Homo sapiens
ugaagccaauucag

SEQ ID NO: 645911 - RNA, 19 nt, Homo sapiens
ugaagccauguagccaccc

SEQ ID NO: 645912 - RNA, 19 nt, Homo sapiens
ugaagcccagcgacacaga

SEQ ID NO: 645913 - RNA, 22 nt, Homo sapiens
ugaagcccaggcugaugcuuga

SEQ ID NO: 645914 - RNA, 23 nt, Homo sapiens
ugaagccccccuuuggcacugga

SEQ ID NO: 645915 - RNA, 18 nt, Homo sapiens
ugaagccuauguaugcca

SEQ ID NO: 645916 - RNA, 22 nt, Homo sapiens
ugaagccucugcccugccuccc

SEQ ID NO: 645917 - RNA, 14 nt, Homo sapiens
ugaagccugcaugu

SEQ ID NO: 645918 - RNA, 14 nt, Homo sapiens
ugaagcugaggcuc

SEQ ID NO: 645919 - RNA, 16 nt, Homo sapiens
ugaagcuuuaagcaaa

SEQ ID NO: 645920 - RNA, 21 nt, Homo sapiens
ugaagcuuuaggcagagccau

SEQ ID NO: 645921 - RNA, 19 nt, Homo sapiens
ugaaggacagaacauugcc

SEQ ID NO: 645922 - RNA, 22 nt, Homo sapiens
ugaaggaggugagggaugugaa

SEQ ID NO: 645923 - RNA, 14 nt, Homo sapiens
ugaaggcauaugca

SEQ ID NO: 645924 - RNA, 14 nt, Homo sapiens
ugaaggcaugccua

SEQ ID NO: 645925 - RNA, 21 nt, Homo sapiens
ugaaggccucuuguugagugc

SEQ ID NO: 645926 - RNA, 19 nt, Homo sapiens
ugaaggcuagaagugugaa

SEQ ID NO: 645927 - RNA, 15 nt, Homo sapiens
ugaagggaagugcau

SEQ ID NO: 645928 - RNA, 22 nt, Homo sapiens
ugaaggugccacuccagugccc

SEQ ID NO: 645929 - RNA, 16 nt, Homo sapiens
ugaagguucccaagga

SEQ ID NO: 645930 - RNA, 13 nt, Homo sapiens
ugaaguagaaucc

SEQ ID NO: 645931 - RNA, 16 nt, Homo sapiens
ugaaguagaauccuaa

SEQ ID NO: 645932 - RNA, 22 nt, Homo sapiens
ugaaguauaucucuagaugcaa

SEQ ID NO: 645933 - RNA, 15 nt, Homo sapiens
ugaaguauuucucac

SEQ ID NO: 645934 - RNA, 18 nt, Homo sapiens
ugaagucaccgggaugaa

SEQ ID NO: 645935 - RNA, 17 nt, Homo sapiens
ugaagucaucagcuuug

SEQ ID NO: 645936 - RNA, 20 nt, Homo sapiens
ugaagucaugaccuccaggg

SEQ ID NO: 645937 - RNA, 16 nt, Homo sapiens
ugaaguccuucaccuc

SEQ ID NO: 645938 - RNA, 11 nt, Homo sapiens
ugaagugcaga

SEQ ID NO: 645939 - RNA, 16 nt, Homo sapiens
ugaagugcauccaaag

SEQ ID NO: 645940 - RNA, 17 nt, Homo sapiens
ugaaguggccagaugag

SEQ ID NO: 645941 - RNA, 16 nt, Homo sapiens
ugaagugguugcauuc

SEQ ID NO: 645942 - RNA, 16 nt, Homo sapiens
ugaaguguaauugaga

SEQ ID NO: 645943 - RNA, 17 nt, Homo sapiens
ugaagugucacagccug

SEQ ID NO: 645944 - RNA, 19 nt, Homo sapiens
ugaaguguggcugcaucuu

SEQ ID NO: 645945 - RNA, 16 nt, Homo sapiens
ugaaguucaaaugccc

SEQ ID NO: 645946 - RNA, 16 nt, Homo sapiens
ugaaguuuuuauuuag

SEQ ID NO: 645947 - RNA, 22 nt, Homo sapiens
ugaauaaacugaaaauggaccu

SEQ ID NO: 645948 - RNA, 19 nt, Homo sapiens
ugaauaaauaccucuuagc

SEQ ID NO: 645949 - RNA, 13 nt, Homo sapiens
ugaauaacaguag

SEQ ID NO: 645950 - RNA, 14 nt, Homo sapiens
ugaauaacauuuaa

SEQ ID NO: 645951 - RNA, 22 nt, Homo sapiens
ugaauaacauuuaaauuccaca

SEQ ID NO: 645952 - RNA, 17 nt, Homo sapiens
ugaauaagcuuucucuc

SEQ ID NO: 645953 - RNA, 18 nt, Homo sapiens
ugaauaaugcuguuuuau

SEQ ID NO: 645954 - RNA, 19 nt, Homo sapiens
ugaaaaagauguacagaac

SEQ ID NO: 645955 - RNA, 22 nt, Homo sapiens
ugaaaaaguuuggaagcacuga

SEQ ID NO: 645956 - RNA, 13 nt, Homo sapiens
ugaaaaaugcuca

SEQ ID NO: 645957 - RNA, 14 nt, Homo sapiens
ugaaaaauguauau

SEQ ID NO: 645958 - RNA, 20 nt, Homo sapiens
ugaaaaauguguuccauugc

SEQ ID NO: 645959 - RNA, 16 nt, Homo sapiens
ugaaaaauuacagcuu

SEQ ID NO: 645960 - RNA, 15 nt, Homo sapiens
ugaaaacaaguccuu

SEQ ID NO: 645961 - RNA, 16 nt, Homo sapiens
ugaaaacacugugcac

SEQ ID NO: 645962 - RNA, 17 nt, Homo sapiens
ugaaaacacugugcaca

SEQ ID NO: 645963 - RNA, 12 nt, Homo sapiens
ugaaaacacuua

SEQ ID NO: 645964 - RNA, 22 nt, Homo sapiens
ugaaaacauaacccacucuguc

SEQ ID NO: 645965 - RNA, 17 nt, Homo sapiens
ugaaaacaucuggaagg

SEQ ID NO: 645966 - RNA, 12 nt, Homo sapiens
ugaaaacauuca

SEQ ID NO: 645967 - RNA, 13 nt, Homo sapiens
ugaaaacauucaa

SEQ ID NO: 645968 - RNA, 22 nt, Homo sapiens
ugaaaacucacagaacuaugua

SEQ ID NO: 645969 - RNA, 23 nt, Homo sapiens
ugaaaacuuagagagguacaagu

SEQ ID NO: 645970 - RNA, 13 nt, Homo sapiens
ugaaaacuucaaa

SEQ ID NO: 645971 - RNA, 16 nt, Homo sapiens
ugaaaagaaucagcau

SEQ ID NO: 645972 - RNA, 23 nt, Homo sapiens
ugaaaagcacagccucagaauaa

SEQ ID NO: 645973 - RNA, 17 nt, Homo sapiens
ugaaaagggacugugag

SEQ ID NO: 645974 - RNA, 12 nt, Homo sapiens
ugaaaagucaaa

SEQ ID NO: 645975 - RNA, 23 nt, Homo sapiens
ugaaaauaaaaugacgucacaag

SEQ ID NO: 645976 - RNA, 22 nt, Homo sapiens
ugaaaauaauuguuccaaauga

SEQ ID NO: 645977 - RNA, 22 nt, Homo sapiens
ugaaaauacaacuuaaauaaua

SEQ ID NO: 645978 - RNA, 14 nt, Homo sapiens
ugaaaauacaucuu

SEQ ID NO: 645979 - RNA, 21 nt, Homo sapiens
ugaaaauauagacauucucac

SEQ ID NO: 645980 - RNA, 19 nt, Homo sapiens
ugaaaauauuuuguugccu

SEQ ID NO: 645981 - RNA, 16 nt, Homo sapiens
ugaaaaucaaaguaaa

SEQ ID NO: 645982 - RNA, 16 nt, Homo sapiens
ugaaaauccaucucau

SEQ ID NO: 645983 - RNA, 13 nt, Homo sapiens
ugaaaaucuccau

SEQ ID NO: 645984 - RNA, 15 nt, Homo sapiens
ugaaaaugacauuaa

SEQ ID NO: 645985 - RNA, 12 nt, Homo sapiens
ugaaaauguuca

SEQ ID NO: 645986 - RNA, 11 nt, Homo sapiens
ugaaaauugca

SEQ ID NO: 645987 - RNA, 15 nt, Homo sapiens
ugaaaauuguagggu

SEQ ID NO: 645988 - RNA, 12 nt, Homo sapiens
ugaaacaaacau

SEQ ID NO: 645989 - RNA, 15 nt, Homo sapiens
ugaaacaaacaugga

SEQ ID NO: 645990 - RNA, 17 nt, Homo sapiens
ugaaacaauguugucca

SEQ ID NO: 645991 - RNA, 19 nt, Homo sapiens
ugaaacacacaauguggac

SEQ ID NO: 645992 - RNA, 16 nt, Homo sapiens
ugaaacacacauggac

SEQ ID NO: 645993 - RNA, 17 nt, Homo sapiens
ugaaacacacauggaca

SEQ ID NO: 645994 - RNA, 13 nt, Homo sapiens
ugaaacacuggac

SEQ ID NO: 645995 - RNA, 17 nt, Homo sapiens
ugaaacagccaugucca

SEQ ID NO: 645996 - RNA, 12 nt, Homo sapiens
ugaaacaugaac

SEQ ID NO: 645997 - RNA, 12 nt, Homo sapiens
ugaaaccaaaac

SEQ ID NO: 645998 - RNA, 20 nt, Homo sapiens
ugaaaccaccgugaaccaga

SEQ ID NO: 645999 - RNA, 20 nt, Homo sapiens
ugaaaccccaucucuacuga

SEQ ID NO: 646000 - RNA, 19 nt, Homo sapiens
ugaaaccuacacacuguca

SEQ ID NO: 646001 - RNA, 17 nt, Homo sapiens
ugaaaccuaccuaggca

SEQ ID NO: 646002 - RNA, 15 nt, Homo sapiens
ugaaaccucaucucu

SEQ ID NO: 646003 - RNA, 13 nt, Homo sapiens
ugaaaccuguaca

SEQ ID NO: 646004 - RNA, 23 nt, Homo sapiens
ugaaaccuuaguuucaagagucu

SEQ ID NO: 646005 - RNA, 15 nt, Homo sapiens
ucuugaaguggauuu

SEQ ID NO: 646006 - RNA, 19 nt, Homo sapiens
ucuugaauaguacauuuuc

SEQ ID NO: 646007 - RNA, 15 nt, Homo sapiens
ucuugaauagucuca

SEQ ID NO: 646008 - RNA, 21 nt, Homo sapiens
ucuugaauguggucucaggau

SEQ ID NO: 646009 - RNA, 22 nt, Homo sapiens
ucuugaauuagcauuuuucaaa

SEQ ID NO: 646010 - RNA, 14 nt, Homo sapiens
ucuugacuagugca

SEQ ID NO: 646011 - RNA, 18 nt, Homo sapiens
ucuugaguuccucugcag

SEQ ID NO: 646012 - RNA, 18 nt, Homo sapiens
ucuugauugcggcuuuau

SEQ ID NO: 646013 - RNA, 17 nt, Homo sapiens
ucuugcaacucuguaaa

SEQ ID NO: 646014 - RNA, 14 nt, Homo sapiens
ucuugcacauggau

SEQ ID NO: 646015 - RNA, 21 nt, Homo sapiens
ucuugcaccaaauuaucuuga

SEQ ID NO: 646016 - RNA, 14 nt, Homo sapiens
ucuugccacugcac

SEQ ID NO: 646017 - RNA, 17 nt, Homo sapiens
ucuugccauccugaugg

SEQ ID NO: 646018 - RNA, 23 nt, Homo sapiens
ucuugccccagugugguuugcau

SEQ ID NO: 646019 - RNA, 15 nt, Homo sapiens
ucuugccccaguuug

SEQ ID NO: 646020 - RNA, 19 nt, Homo sapiens
ucuugccccccaccccagc

SEQ ID NO: 646021 - RNA, 23 nt, Homo sapiens
ucuugccuaaggugcguagucca

SEQ ID NO: 646022 - RNA, 13 nt, Homo sapiens
ucuugccugcaug

SEQ ID NO: 646023 - RNA, 20 nt, Homo sapiens
ucuugcgggccuggacaagg

SEQ ID NO: 646024 - RNA, 23 nt, Homo sapiens
ucuugcuagauuuugcugagaug

SEQ ID NO: 646025 - RNA, 19 nt, Homo sapiens
ucuugcuuucuaugcuguu

SEQ ID NO: 646026 - RNA, 17 nt, Homo sapiens
ucuuggaauuacaagcc

SEQ ID NO: 646027 - RNA, 20 nt, Homo sapiens
ucuuggagaaaauaacaaga

SEQ ID NO: 646028 - RNA, 15 nt, Homo sapiens
ucuuggcuucuuaaa

SEQ ID NO: 646029 - RNA, 15 nt, Homo sapiens
ucuuggcuuugccac

SEQ ID NO: 646030 - RNA, 16 nt, Homo sapiens
ucuuggcuuugccaca

SEQ ID NO: 646031 - RNA, 20 nt, Homo sapiens
ucuugggcccaggacuguug

SEQ ID NO: 646032 - RNA, 21 nt, Homo sapiens
ucuugggcccaggacuguuga

SEQ ID NO: 646033 - RNA, 13 nt, Homo sapiens
ucuuggggccacu

SEQ ID NO: 646034 - RNA, 23 nt, Homo sapiens
ucuuggggggguggccgcugagu

SEQ ID NO: 646035 - RNA, 11 nt, Homo sapiens
ucuugggucuu

SEQ ID NO: 646036 - RNA, 13 nt, Homo sapiens
ucuuggugaagau

SEQ ID NO: 646037 - RNA, 22 nt, Homo sapiens
ucuuggugccuuuugugugaug

SEQ ID NO: 646038 - RNA, 16 nt, Homo sapiens
ucuuggugcucugugu

SEQ ID NO: 646039 - RNA, 24 nt, Homo sapiens
ucuuguagguuccaucaaugguga

SEQ ID NO: 646040 - RNA, 13 nt, Homo sapiens
ucuugucuuuauu

SEQ ID NO: 646041 - RNA, 12 nt, Homo sapiens
ucuugugccaaa

SEQ ID NO: 646042 - RNA, 14 nt, Homo sapiens
ucuuguggugcauu

SEQ ID NO: 646043 - RNA, 14 nt, Homo sapiens
ucuuguuaauguca

SEQ ID NO: 646044 - RNA, 14 nt, Homo sapiens
ucuuguuacuguga

SEQ ID NO: 646045 - RNA, 15 nt, Homo sapiens
ucuuguuacugugau

SEQ ID NO: 646046 - RNA, 15 nt, Homo sapiens
ucuuguucuacugag

SEQ ID NO: 646047 - RNA, 13 nt, Homo sapiens
ucuuguugcugca

SEQ ID NO: 646048 - RNA, 16 nt, Homo sapiens
ucuuguuguuauugau

SEQ ID NO: 646049 - RNA, 20 nt, Homo sapiens
ucuuguuuaacauauauauu

SEQ ID NO: 646050 - RNA, 15 nt, Homo sapiens
ucuuguuucccagau

SEQ ID NO: 646051 - RNA, 19 nt, Homo sapiens
ucuuuaaaaacucacuuac

SEQ ID NO: 646052 - RNA, 15 nt, Homo sapiens
ucuuuaaacugcuuu

SEQ ID NO: 646053 - RNA, 18 nt, Homo sapiens
ucuuuaauaaauugcuua

SEQ ID NO: 646054 - RNA, 23 nt, Homo sapiens
ucuuuaauaaauugcuuacugau

SEQ ID NO: 646055 - RNA, 23 nt, Homo sapiens
ucuuuaccaaaaaccauguugcg

SEQ ID NO: 646056 - RNA, 22 nt, Homo sapiens
ucugccugaaggcucacaccuc

SEQ ID NO: 646057 - RNA, 20 nt, Homo sapiens
ucugccuuaaaaccaaagag

SEQ ID NO: 646058 - RNA, 23 nt, Homo sapiens
ucugccuuaaacacacauugcag

SEQ ID NO: 646059 - RNA, 13 nt, Homo sapiens
ucugccuucaggc

SEQ ID NO: 646060 - RNA, 18 nt, Homo sapiens
ucugccuuguccugaugc

SEQ ID NO: 646061 - RNA, 14 nt, Homo sapiens
ucugcgcaccaagg

SEQ ID NO: 646062 - RNA, 21 nt, Homo sapiens
ucugcgcaccaaggaauggag

SEQ ID NO: 646063 - RNA, 23 nt, Homo sapiens
ucugcgcuuggucuuucugugcu

SEQ ID NO: 646064 - RNA, 13 nt, Homo sapiens
ucugcggaucuca

SEQ ID NO: 646065 - RNA, 20 nt, Homo sapiens
ucugcgugucaccugugcuu

SEQ ID NO: 646066 - RNA, 14 nt, Homo sapiens
ucugcuaaauauca

SEQ ID NO: 646067 - RNA, 14 nt, Homo sapiens
ucugcucaucauuc

SEQ ID NO: 646068 - RNA, 17 nt, Homo sapiens
ucugcuccagguucacu

SEQ ID NO: 646069 - RNA, 20 nt, Homo sapiens
ucugcuccccuaaagccuca

SEQ ID NO: 646070 - RNA, 17 nt, Homo sapiens
ucugcuccugaagcccu

SEQ ID NO: 646071 - RNA, 13 nt, Homo sapiens
ucugcuccugcuu

SEQ ID NO: 646072 - RNA, 17 nt, Homo sapiens
ucugcuccuuauuccca

SEQ ID NO: 646073 - RNA, 16 nt, Homo sapiens
ucugcucucauauaag

SEQ ID NO: 646074 - RNA, 22 nt, Homo sapiens
ucugcucugaggcuuccagaga

SEQ ID NO: 646075 - RNA, 18 nt, Homo sapiens
ucugcucuugaucugugu

SEQ ID NO: 646076 - RNA, 12 nt, Homo sapiens
ucugcugaggag

SEQ ID NO: 646077 - RNA, 21 nt, Homo sapiens
ucugcugauuaucacacauca

SEQ ID NO: 646078 - RNA, 18 nt, Homo sapiens
ucugcugcauagcucuau

SEQ ID NO: 646079 - RNA, 23 nt, Homo sapiens
ucugcuggaaacagacucgauuc

SEQ ID NO: 646080 - RNA, 12 nt, Homo sapiens
ucugcuguagaa

SEQ ID NO: 646081 - RNA, 15 nt, Homo sapiens
ucugcuguggucuau

SEQ ID NO: 646082 - RNA, 14 nt, Homo sapiens
ucugcuguucagga

SEQ ID NO: 646083 - RNA, 23 nt, Homo sapiens
ucugcuguuuuuuuugcugcuaa

SEQ ID NO: 646084 - RNA, 19 nt, Homo sapiens
ucugcuuacaauucccugc

SEQ ID NO: 646085 - RNA, 20 nt, Homo sapiens
ucugcuuucacucuuuagaa

SEQ ID NO: 646086 - RNA, 23 nt, Homo sapiens
ucugcuuuuuaaagaaugcucuu

SEQ ID NO: 646087 - RNA, 14 nt, Homo sapiens
ucuggaaacuacca

SEQ ID NO: 646088 - RNA, 16 nt, Homo sapiens
ucuggaaagaggcucu

SEQ ID NO: 646089 - RNA, 13 nt, Homo sapiens
ucuggaagaccug

SEQ ID NO: 646090 - RNA, 15 nt, Homo sapiens
ucuggaaggacaucu

SEQ ID NO: 646091 - RNA, 13 nt, Homo sapiens
ucuggaaucugga

SEQ ID NO: 646092 - RNA, 19 nt, Homo sapiens
ucuggaauugauauugaau

SEQ ID NO: 646093 - RNA, 21 nt, Homo sapiens
ucuggacaaagacuaccugag

SEQ ID NO: 646094 - RNA, 19 nt, Homo sapiens
ucuggacacagccccaugu

SEQ ID NO: 646095 - RNA, 15 nt, Homo sapiens
ucuggacacugagag

SEQ ID NO: 646096 - RNA, 12 nt, Homo sapiens
ucuggacacuug

SEQ ID NO: 646097 - RNA, 20 nt, Homo sapiens
ucuggacagaugaauaccuu

SEQ ID NO: 646098 - RNA, 15 nt, Homo sapiens
ucuggaccagccugu

SEQ ID NO: 646099 - RNA, 15 nt, Homo sapiens
ucuggacuccaccuu

SEQ ID NO: 646100 - RNA, 14 nt, Homo sapiens
ucuggacugcacac

SEQ ID NO: 646101 - RNA, 12 nt, Homo sapiens
ucuggagcauuu

SEQ ID NO: 646102 - RNA, 21 nt, Homo sapiens
ucuggaggacggucaguccau

SEQ ID NO: 646103 - RNA, 17 nt, Homo sapiens
ucuggagucuccagugg

SEQ ID NO: 646104 - RNA, 20 nt, Homo sapiens
ucuggauaccauuauauguu

SEQ ID NO: 646105 - RNA, 22 nt, Homo sapiens
ucuggaugggaggagagccacu

SEQ ID NO: 646106 - RNA, 12 nt, Homo sapiens
ucuggauuucau

SEQ ID NO: 646107 - RNA, 20 nt, Homo sapiens
ucuggauuucauacuguaac

SEQ ID NO: 646108 - RNA, 20 nt, Homo sapiens
ucuggcagccucccauccag

SEQ ID NO: 646109 - RNA, 20 nt, Homo sapiens
ucuggcauuacaauugcagu

SEQ ID NO: 646110 - RNA, 22 nt, Homo sapiens
ucuggcauuacaauugcaguuu

SEQ ID NO: 646111 - RNA, 15 nt, Homo sapiens
ucuggccacugucaa

SEQ ID NO: 646112 - RNA, 16 nt, Homo sapiens
ucuggccacugucaag

SEQ ID NO: 646113 - RNA, 13 nt, Homo sapiens
ucuggcccagaaa

SEQ ID NO: 646114 - RNA, 20 nt, Homo sapiens
ucuggcccgcaauacuguag

SEQ ID NO: 646115 - RNA, 18 nt, Homo sapiens
ucuggcccucgacacuca

SEQ ID NO: 646116 - RNA, 16 nt, Homo sapiens
ucuggcccuugcuuac

SEQ ID NO: 646117 - RNA, 17 nt, Homo sapiens
ucuggccggagcugccu

SEQ ID NO: 646118 - RNA, 21 nt, Homo sapiens
ucuggcucagggucaaagaca

SEQ ID NO: 646119 - RNA, 18 nt, Homo sapiens
ucuggcucccaucaccuc

SEQ ID NO: 646120 - RNA, 16 nt, Homo sapiens
ucuggcuccucggggc

SEQ ID NO: 646121 - RNA, 20 nt, Homo sapiens
ucccagcagcggcaccaagg

SEQ ID NO: 646122 - RNA, 17 nt, Homo sapiens
ucccagcgcucugggag

SEQ ID NO: 646123 - RNA, 13 nt, Homo sapiens
ucccagcuacuca

SEQ ID NO: 646124 - RNA, 15 nt, Homo sapiens
ucccagcuacucggg

SEQ ID NO: 646125 - RNA, 17 nt, Homo sapiens
ucccagcuacucgggag

SEQ ID NO: 646126 - RNA, 15 nt, Homo sapiens
ucccagcuacuuggg

SEQ ID NO: 646127 - RNA, 15 nt, Homo sapiens
ucccagcugcacuuu

SEQ ID NO: 646128 - RNA, 16 nt, Homo sapiens
ucccagcugcacuuua

SEQ ID NO: 646129 - RNA, 17 nt, Homo sapiens
ucccagcuucggcauuu

SEQ ID NO: 646130 - RNA, 17 nt, Homo sapiens
ucccaggaaagaagcau

SEQ ID NO: 646131 - RNA, 19 nt, Homo sapiens
ucccaggaaagaagcauuu

SEQ ID NO: 646132 - RNA, 23 nt, Homo sapiens
ucccaggccagcaagcucuucac

SEQ ID NO: 646133 - RNA, 22 nt, Homo sapiens
ucccaggccugccugcauggca

SEQ ID NO: 646134 - RNA, 23 nt, Homo sapiens
ucccaggcugcuggagugcagug

SEQ ID NO: 646135 - RNA, 21 nt, Homo sapiens
ucccagggaccagcaccuuca

SEQ ID NO: 646136 - RNA, 21 nt, Homo sapiens
ucccaggguuauagacagucg

SEQ ID NO: 646137 - RNA, 17 nt, Homo sapiens
ucccagucucaucuccu

SEQ ID NO: 646138 - RNA, 19 nt, Homo sapiens
ucccagugucaguauuuac

SEQ ID NO: 646139 - RNA, 23 nt, Homo sapiens
ucccaguguguguuuaacauuca

SEQ ID NO: 646140 - RNA, 18 nt, Homo sapiens
ucccaguguuccauuuga

SEQ ID NO: 646141 - RNA, 17 nt, Homo sapiens
ucccaguuacucaggag

SEQ ID NO: 646142 - RNA, 15 nt, Homo sapiens
ucccaucaauucuua

SEQ ID NO: 646143 - RNA, 21 nt, Homo sapiens
ucccaucaauucuuagaauau

SEQ ID NO: 646144 - RNA, 13 nt, Homo sapiens
ucccaucacucuu

SEQ ID NO: 646145 - RNA, 15 nt, Homo sapiens
ucccaucauuacccu

SEQ ID NO: 646146 - RNA, 16 nt, Homo sapiens
ucccauccugauccca

SEQ ID NO: 646147 - RNA, 16 nt, Homo sapiens
ucccaucgcugucaca

SEQ ID NO: 646148 - RNA, 12 nt, Homo sapiens
ucccaucuccuu

SEQ ID NO: 646149 - RNA, 14 nt, Homo sapiens
ucccaucucuacaa

SEQ ID NO: 646150 - RNA, 13 nt, Homo sapiens
ucccaucugguca

SEQ ID NO: 646151 - RNA, 13 nt, Homo sapiens
ucccaucuucacu

SEQ ID NO: 646152 - RNA, 10 nt, Homo sapiens
ucccaugaga

SEQ ID NO: 646153 - RNA, 17 nt, Homo sapiens
ucccaugaggucuuccc

SEQ ID NO: 646154 - RNA, 23 nt, Homo sapiens
ucccaugcuuuguaggugucuca

SEQ ID NO: 646155 - RNA, 17 nt, Homo sapiens
ucccauguugcaugccu

SEQ ID NO: 646156 - RNA, 13 nt, Homo sapiens
ucccauguuguca

SEQ ID NO: 646157 - RNA, 15 nt, Homo sapiens
ucccauuacuuugau

SEQ ID NO: 646158 - RNA, 13 nt, Homo sapiens
ucccauucacucu

SEQ ID NO: 646159 - RNA, 16 nt, Homo sapiens
ucccauucagcuguga

SEQ ID NO: 646160 - RNA, 12 nt, Homo sapiens
ucccauuggcaa

SEQ ID NO: 646161 - RNA, 14 nt, Homo sapiens
ucccauuggcaaaa

SEQ ID NO: 646162 - RNA, 17 nt, Homo sapiens
ucccauuggcaaaagag

SEQ ID NO: 646163 - RNA, 22 nt, Homo sapiens
ucccauuguggcuccuaucugu

SEQ ID NO: 646164 - RNA, 17 nt, Homo sapiens
ucccauuucaucagcaa

SEQ ID NO: 646165 - RNA, 14 nt, Homo sapiens
ucccauuucccaaa

SEQ ID NO: 646166 - RNA, 19 nt, Homo sapiens
ucccauuucuguugcugga

SEQ ID NO: 646167 - RNA, 15 nt, Homo sapiens
ucccauuucuugcua

SEQ ID NO: 646168 - RNA, 21 nt, Homo sapiens
ucccauuuuucucuugccauu

SEQ ID NO: 646169 - RNA, 22 nt, Homo sapiens
uccccaaaagaaaccaugacaa

SEQ ID NO: 646170 - RNA, 15 nt, Homo sapiens
uccccaacaugcacu

SEQ ID NO: 646171 - RNA, 17 nt, Homo sapiens
uccccaacugaguucaa

SEQ ID NO: 646172 - RNA, 16 nt, Homo sapiens
uccccaagcacggugu

SEQ ID NO: 646173 - RNA, 21 nt, Homo sapiens
uccccaagcuggccacuauca

SEQ ID NO: 646174 - RNA, 14 nt, Homo sapiens
uccccaagggccaa

SEQ ID NO: 646175 - RNA, 13 nt, Homo sapiens
uccccaauaccua

SEQ ID NO: 646176 - RNA, 17 nt, Homo sapiens
uccccacacagggcacu

SEQ ID NO: 646177 - RNA, 17 nt, Homo sapiens
uccccacauaccaucug

SEQ ID NO: 646178 - RNA, 14 nt, Homo sapiens
uccccaccccgaaa

SEQ ID NO: 646179 - RNA, 15 nt, Homo sapiens
uccccaccccuucca

SEQ ID NO: 646180 - RNA, 19 nt, Homo sapiens
uccccaccccuuccaauga

SEQ ID NO: 646181 - RNA, 23 nt, Homo sapiens
uccccacgagggcuggcuggccu

SEQ ID NO: 646182 - RNA, 19 nt, Homo sapiens
uccccacucccccacccau

SEQ ID NO: 646183 - RNA, 15 nt, Homo sapiens
uccccagacuccacc

SEQ ID NO: 646184 - RNA, 15 nt, Homo sapiens
uccccagagcuacag

SEQ ID NO: 646185 - RNA, 14 nt, Homo sapiens
uccccagagcugug

SEQ ID NO: 646186 - RNA, 16 nt, Homo sapiens
uccccagaugugacua

SEQ ID NO: 646187 - RNA, 16 nt, Homo sapiens
uccccagcagggucuu

SEQ ID NO: 646188 - RNA, 21 nt, Homo sapiens
uccccagcagggucuuuucau

SEQ ID NO: 646189 - RNA, 23 nt, Homo sapiens
uccccagcccuggcucugcaaug

SEQ ID NO: 646190 - RNA, 18 nt, Homo sapiens
uccccaggggaaaaugaa

SEQ ID NO: 646191 - RNA, 16 nt, Homo sapiens
uccccauaacucaaug

SEQ ID NO: 646192 - RNA, 23 nt, Homo sapiens
uccccauccaggucuugacucau

SEQ ID NO: 646193 - RNA, 19 nt, Homo sapiens
uccccaucuggguccuugc

SEQ ID NO: 646194 - RNA, 20 nt, Homo sapiens
uccccauucgguguggugca

SEQ ID NO: 646195 - RNA, 19 nt, Homo sapiens
uccccauucucugccugua

SEQ ID NO: 646196 - RNA, 17 nt, Homo sapiens
uccccauuugcuuacuu

SEQ ID NO: 646197 - RNA, 15 nt, Homo sapiens
ucccccaaagccgga

SEQ ID NO: 646198 - RNA, 14 nt, Homo sapiens
ucccccaaaguuca

SEQ ID NO: 646199 - RNA, 15 nt, Homo sapiens
uccucccugcaucug

SEQ ID NO: 646200 - RNA, 14 nt, Homo sapiens
uccucccuugggaa

SEQ ID NO: 646201 - RNA, 16 nt, Homo sapiens
uccuccguccauauca

SEQ ID NO: 646202 - RNA, 17 nt, Homo sapiens
uccuccguccauaucag

SEQ ID NO: 646203 - RNA, 15 nt, Homo sapiens
uccuccuacuguauu

SEQ ID NO: 646204 - RNA, 20 nt, Homo sapiens
uccuccuuggcggcaaaagc

SEQ ID NO: 646205 - RNA, 14 nt, Homo sapiens
uccucgacugcuuu

SEQ ID NO: 646206 - RNA, 13 nt, Homo sapiens
uccucgcugccag

SEQ ID NO: 646207 - RNA, 14 nt, Homo sapiens
uccucguuugagaa

SEQ ID NO: 646208 - RNA, 20 nt, Homo sapiens
uccucuaagccacucuucca

SEQ ID NO: 646209 - RNA, 17 nt, Homo sapiens
uccucuaaugaagaauu

SEQ ID NO: 646210 - RNA, 13 nt, Homo sapiens
uccucuauugaug

SEQ ID NO: 646211 - RNA, 17 nt, Homo sapiens
uccucuauuuugugaug

SEQ ID NO: 646212 - RNA, 16 nt, Homo sapiens
uccucucacucuucag

SEQ ID NO: 646213 - RNA, 16 nt, Homo sapiens
uccucuccacugccuu

SEQ ID NO: 646214 - RNA, 18 nt, Homo sapiens
uccucuccacugccuucg

SEQ ID NO: 646215 - RNA, 19 nt, Homo sapiens
uccucucccauccuugaug

SEQ ID NO: 646216 - RNA, 14 nt, Homo sapiens
uccucuccuacuuu

SEQ ID NO: 646217 - RNA, 19 nt, Homo sapiens
uccucucgagcccagaugg

SEQ ID NO: 646218 - RNA, 17 nt, Homo sapiens
uccucucgcacaaugca

SEQ ID NO: 646219 - RNA, 13 nt, Homo sapiens
uccucucucucag

SEQ ID NO: 646220 - RNA, 14 nt, Homo sapiens
uccucucugcacac

SEQ ID NO: 646221 - RNA, 13 nt, Homo sapiens
uccucugacucag

SEQ ID NO: 646222 - RNA, 12 nt, Homo sapiens
uccucugaucuc

SEQ ID NO: 646223 - RNA, 15 nt, Homo sapiens
uccucugcauuuaca

SEQ ID NO: 646224 - RNA, 15 nt, Homo sapiens
uccucugccaccucc

SEQ ID NO: 646225 - RNA, 16 nt, Homo sapiens
uccucuggaucacaga

SEQ ID NO: 646226 - RNA, 20 nt, Homo sapiens
uccucuggaucacagacacu

SEQ ID NO: 646227 - RNA, 23 nt, Homo sapiens
uccucuggaucacagacacugca

SEQ ID NO: 646228 - RNA, 19 nt, Homo sapiens
uccucuggauggcaccaga

SEQ ID NO: 646229 - RNA, 16 nt, Homo sapiens
uccucuguaaacuuuu

SEQ ID NO: 646230 - RNA, 16 nt, Homo sapiens
uccucugugaccaaug

SEQ ID NO: 646231 - RNA, 19 nt, Homo sapiens
uccucugugaccaaugucu

SEQ ID NO: 646232 - RNA, 12 nt, Homo sapiens
uccucugugauu

SEQ ID NO: 646233 - RNA, 13 nt, Homo sapiens
uccucuuaccaga

SEQ ID NO: 646234 - RNA, 14 nt, Homo sapiens
uccucuucagagga

SEQ ID NO: 646235 - RNA, 17 nt, Homo sapiens
uccucuuccaugcugug

SEQ ID NO: 646236 - RNA, 14 nt, Homo sapiens
uccucuugauuccu

SEQ ID NO: 646237 - RNA, 14 nt, Homo sapiens
uccucuugccacug

SEQ ID NO: 646238 - RNA, 16 nt, Homo sapiens
uccugaacugcuuucc

SEQ ID NO: 646239 - RNA, 18 nt, Homo sapiens
uccugaacugcuuuccau

SEQ ID NO: 646240 - RNA, 17 nt, Homo sapiens
uccugaagagcauuugg

SEQ ID NO: 646241 - RNA, 17 nt, Homo sapiens
uccugaagaucaagcca

SEQ ID NO: 646242 - RNA, 19 nt, Homo sapiens
uccugaagaucaagccagu

SEQ ID NO: 646243 - RNA, 16 nt, Homo sapiens
uccugaaucugugcaa

SEQ ID NO: 646244 - RNA, 14 nt, Homo sapiens
uccugacacuauuc

SEQ ID NO: 646245 - RNA, 15 nt, Homo sapiens
uccugacacuuuaau

SEQ ID NO: 646246 - RNA, 23 nt, Homo sapiens
uccugaccucaaguaauccaccu

SEQ ID NO: 646247 - RNA, 20 nt, Homo sapiens
uccugaccuugugauccacc

SEQ ID NO: 646248 - RNA, 20 nt, Homo sapiens
uccugacuucaugauccacc

SEQ ID NO: 646249 - RNA, 23 nt, Homo sapiens
uccugacuuugcccccuugccca

SEQ ID NO: 646250 - RNA, 20 nt, Homo sapiens
uccacagucccccacccacc

SEQ ID NO: 646251 - RNA, 16 nt, Homo sapiens
uccacaguguucauuu

SEQ ID NO: 646252 - RNA, 14 nt, Homo sapiens
uccacauuauacau

SEQ ID NO: 646253 - RNA, 12 nt, Homo sapiens
uccaccaagaaa

SEQ ID NO: 646254 - RNA, 18 nt, Homo sapiens
uccaccaagaucaagcag

SEQ ID NO: 646255 - RNA, 17 nt, Homo sapiens
uccaccacaucugccag

SEQ ID NO: 646256 - RNA, 13 nt, Homo sapiens
uccaccagcagca

SEQ ID NO: 646257 - RNA, 19 nt, Homo sapiens
uccaccauucacauuugau

SEQ ID NO: 646258 - RNA, 16 nt, Homo sapiens
uccaccccgacugcuc

SEQ ID NO: 646259 - RNA, 14 nt, Homo sapiens
uccacccuaucccu

SEQ ID NO: 646260 - RNA, 17 nt, Homo sapiens
uccacccuccucuagcc

SEQ ID NO: 646261 - RNA, 16 nt, Homo sapiens
uccaccgccacugggc

SEQ ID NO: 646262 - RNA, 16 nt, Homo sapiens
uccaccgucagcugua

SEQ ID NO: 646263 - RNA, 15 nt, Homo sapiens
uccaccuagacugua

SEQ ID NO: 646264 - RNA, 17 nt, Homo sapiens
uccaccuccuaccccau

SEQ ID NO: 646265 - RNA, 13 nt, Homo sapiens
uccaccugucuca

SEQ ID NO: 646266 - RNA, 16 nt, Homo sapiens
uccaccugugcugcug

SEQ ID NO: 646267 - RNA, 18 nt, Homo sapiens
uccaccugugcugcugca

SEQ ID NO: 646268 - RNA, 12 nt, Homo sapiens
uccaccuuccau

SEQ ID NO: 646269 - RNA, 14 nt, Homo sapiens
uccaccuugcucuu

SEQ ID NO: 646270 - RNA, 21 nt, Homo sapiens
uccaccuuggaccucagugac

SEQ ID NO: 646271 - RNA, 20 nt, Homo sapiens
uccaccuuguuacacauuau

SEQ ID NO: 646272 - RNA, 20 nt, Homo sapiens
uccacgaagccuuaagccau

SEQ ID NO: 646273 - RNA, 17 nt, Homo sapiens
uccacgccucugcugua

SEQ ID NO: 646274 - RNA, 20 nt, Homo sapiens
uccacgggucucacuuauac

SEQ ID NO: 646275 - RNA, 19 nt, Homo sapiens
uccacgugauuuccaguga

SEQ ID NO: 646276 - RNA, 20 nt, Homo sapiens
uccacgugauuuccagugag

SEQ ID NO: 646277 - RNA, 17 nt, Homo sapiens
uccacuaacacuuuagu

SEQ ID NO: 646278 - RNA, 14 nt, Homo sapiens
uccacuacugcuac

SEQ ID NO: 646279 - RNA, 19 nt, Homo sapiens
uccacuaggguccaccagg

SEQ ID NO: 646280 - RNA, 21 nt, Homo sapiens
uccacuaggguccaccaggag

SEQ ID NO: 646281 - RNA, 21 nt, Homo sapiens
uccacucagguucuucagggc

SEQ ID NO: 646282 - RNA, 20 nt, Homo sapiens
uccacuccuccuacuguauu

SEQ ID NO: 646283 - RNA, 13 nt, Homo sapiens
uccacuggaaaag

SEQ ID NO: 646284 - RNA, 21 nt, Homo sapiens
uccacuggcuuuugccuguaa

SEQ ID NO: 646285 - RNA, 19 nt, Homo sapiens
uccacuggggaaugcuccc

SEQ ID NO: 646286 - RNA, 15 nt, Homo sapiens
uccacugucuuucaa

SEQ ID NO: 646287 - RNA, 14 nt, Homo sapiens
uccacugugccuuu

SEQ ID NO: 646288 - RNA, 11 nt, Homo sapiens
uccacuuuuau

SEQ ID NO: 646289 - RNA, 23 nt, Homo sapiens
uccagaaaaaugaaaagcaauac

SEQ ID NO: 646290 - RNA, 18 nt, Homo sapiens
uccagaaaguaaagguga

SEQ ID NO: 646291 - RNA, 13 nt, Homo sapiens
uccagaagcugcu

SEQ ID NO: 646292 - RNA, 16 nt, Homo sapiens
uccagaaggcaaaaag

SEQ ID NO: 646293 - RNA, 12 nt, Homo sapiens
uccagaauucac

SEQ ID NO: 646294 - RNA, 21 nt, Homo sapiens
uccagacaaugccagcauaaa

SEQ ID NO: 646295 - RNA, 20 nt, Homo sapiens
uccagaccagccugggcaac

SEQ ID NO: 646296 - RNA, 17 nt, Homo sapiens
uccagaccauucaggac

SEQ ID NO: 646297 - RNA, 23 nt, Homo sapiens
uccagacccagccaugcugugau

SEQ ID NO: 646298 - RNA, 14 nt, Homo sapiens
uccagaccuuauca

SEQ ID NO: 646299 - RNA, 15 nt, Homo sapiens
uccagacggugugca

SEQ ID NO: 646300 - RNA, 20 nt, Homo sapiens
uccagacuuccuugagacac

SEQ ID NO: 646301 - RNA, 15 nt, Homo sapiens
uccagagaccccagg

SEQ ID NO: 646302 - RNA, 22 nt, Homo sapiens
uccagagaccccaggaacaaua

SEQ ID NO: 646303 - RNA, 15 nt, Homo sapiens
uccagagaguggcuc

SEQ ID NO: 646304 - RNA, 15 nt, Homo sapiens
uccagaucacugcca

SEQ ID NO: 646305 - RNA, 17 nt, Homo sapiens
uccagaucacugccaca

SEQ ID NO: 646306 - RNA, 17 nt, Homo sapiens
uccagauccagacugua

SEQ ID NO: 646307 - RNA, 17 nt, Homo sapiens
uccagauccuucaaaga

SEQ ID NO: 646308 - RNA, 19 nt, Homo sapiens
uccagauccuucaaagagu

SEQ ID NO: 646309 - RNA, 20 nt, Homo sapiens
uccagauugggugccagcau

SEQ ID NO: 646310 - RNA, 14 nt, Homo sapiens
uccagcaacugaac

SEQ ID NO: 646311 - RNA, 13 nt, Homo sapiens
uccagcaccaagg

SEQ ID NO: 646312 - RNA, 16 nt, Homo sapiens
uccagcagcugccaga

SEQ ID NO: 646313 - RNA, 13 nt, Homo sapiens
uccagcagcugcg

SEQ ID NO: 646314 - RNA, 15 nt, Homo sapiens
uccagccccagacaa

SEQ ID NO: 646315 - RNA, 19 nt, Homo sapiens
uccagccuggcuacagggc

SEQ ID NO: 646316 - RNA, 22 nt, Homo sapiens
uccagccuuaauagacuucucu

SEQ ID NO: 646317 - RNA, 17 nt, Homo sapiens
uccagcuaccaccacgg

SEQ ID NO: 646318 - RNA, 18 nt, Homo sapiens
uccagcucaugacacugu

SEQ ID NO: 646319 - RNA, 12 nt, Homo sapiens
uccagcucugag

SEQ ID NO: 646320 - RNA, 14 nt, Homo sapiens
uccagcugauccag

SEQ ID NO: 646321 - RNA, 17 nt, Homo sapiens
uccagcugcaagggagu

SEQ ID NO: 646322 - RNA, 21 nt, Homo sapiens
uccagcuguacuagugccauu

SEQ ID NO: 646323 - RNA, 18 nt, Homo sapiens
uccagcuguucuuaguga

SEQ ID NO: 646324 - RNA, 20 nt, Homo sapiens
uccagcuuauagucuuccag

SEQ ID NO: 646325 - RNA, 22 nt, Homo sapiens
uccaggaauaggcauuugccua

SEQ ID NO: 646326 - RNA, 14 nt, Homo sapiens
uccaggacugagau

SEQ ID NO: 646327 - RNA, 16 nt, Homo sapiens
uccaggagagagccag

SEQ ID NO: 646328 - RNA, 14 nt, Homo sapiens
uccaggaggcccug

SEQ ID NO: 646329 - RNA, 20 nt, Homo sapiens
uccaggauuuauaaagcaaa

SEQ ID NO: 646330 - RNA, 19 nt, Homo sapiens
uccaggauuuuaauuucag

SEQ ID NO: 646331 - RNA, 21 nt, Homo sapiens
uccaggcauuuagcccucaca

SEQ ID NO: 646332 - RNA, 18 nt, Homo sapiens
uccaggccaaagccccau

SEQ ID NO: 646333 - RNA, 21 nt, Homo sapiens
uccaggccccaaaaccacagc

SEQ ID NO: 646334 - RNA, 13 nt, Homo sapiens
uccaggcccucca

SEQ ID NO: 646335 - RNA, 15 nt, Homo sapiens
uccaggccugaaguc

SEQ ID NO: 646336 - RNA, 16 nt, Homo sapiens
uccaggcgaugugcaa

SEQ ID NO: 646337 - RNA, 17 nt, Homo sapiens
uccaggcgaugugcaag

SEQ ID NO: 646338 - RNA, 19 nt, Homo sapiens
uccaggcuggagugcaaug

SEQ ID NO: 646339 - RNA, 19 nt, Homo sapiens
uccagggaauggagcucag

SEQ ID NO: 646340 - RNA, 15 nt, Homo sapiens
uccagggaguccccu

SEQ ID NO: 646341 - RNA, 19 nt, Homo sapiens
uccaggggaagccagugac

SEQ ID NO: 646342 - RNA, 18 nt, Homo sapiens
uccagguauuuuccacuu

SEQ ID NO: 646343 - RNA, 19 nt, Homo sapiens
uccaggugaggcccaagag

SEQ ID NO: 646344 - RNA, 21 nt, Homo sapiens
uccagguuuccuuaagggaca

SEQ ID NO: 646345 - RNA, 15 nt, Homo sapiens
uccagguuuuccacc

SEQ ID NO: 646346 - RNA, 14 nt, Homo sapiens
uccaguacaguauu

SEQ ID NO: 646347 - RNA, 18 nt, Homo sapiens
uccaguagaaagcauaac

SEQ ID NO: 646348 - RNA, 20 nt, Homo sapiens
uccaguagcgagagacggca

SEQ ID NO: 646349 - RNA, 14 nt, Homo sapiens
uccaguaucuccaa

SEQ ID NO: 646350 - RNA, 19 nt, Homo sapiens
uccagucagaugaggcaaa

SEQ ID NO: 646351 - RNA, 22 nt, Homo sapiens
uccagucuuccugacacuuuaa

SEQ ID NO: 646352 - RNA, 15 nt, Homo sapiens
uccagugcaggagac

SEQ ID NO: 646353 - RNA, 14 nt, Homo sapiens
uccagugggacccc

SEQ ID NO: 646354 - RNA, 23 nt, Homo sapiens
uccagugggcugaugcugggacc

SEQ ID NO: 646355 - RNA, 13 nt, Homo sapiens
uccagugucucac

SEQ ID NO: 646356 - RNA, 21 nt, Homo sapiens
uccaguuauaagcguauuuag

SEQ ID NO: 646357 - RNA, 17 nt, Homo sapiens
uccaguucauaaacaac

SEQ ID NO: 646358 - RNA, 16 nt, Homo sapiens
uccaguuuaaguaauu

SEQ ID NO: 646359 - RNA, 18 nt, Homo sapiens
uccaguuucccaccaccu

SEQ ID NO: 646360 - RNA, 16 nt, Homo sapiens
uccaguuugcaccugu

SEQ ID NO: 646361 - RNA, 22 nt, Homo sapiens
uccaguuuuauaaaaaguggag

SEQ ID NO: 646362 - RNA, 23 nt, Homo sapiens
uccaguuuucuccucugcuucuu

SEQ ID NO: 646363 - RNA, 18 nt, Homo sapiens
uccauaaacacccaugaa

SEQ ID NO: 646364 - RNA, 19 nt, Homo sapiens
uccauaaacacccaugaau

SEQ ID NO: 646365 - RNA, 15 nt, Homo sapiens
uccauaaaguacaaa

SEQ ID NO: 646366 - RNA, 23 nt, Homo sapiens
uccauaaaugacacuacuugaua

SEQ ID NO: 646367 - RNA, 18 nt, Homo sapiens
uccauaaguuuaacuuua

SEQ ID NO: 646368 - RNA, 17 nt, Homo sapiens
uccauaaugcuacuguc

SEQ ID NO: 646369 - RNA, 15 nt, Homo sapiens
uccauacacuuuguu

SEQ ID NO: 646370 - RNA, 15 nt, Homo sapiens
uccauacuucucuca

SEQ ID NO: 646371 - RNA, 23 nt, Homo sapiens
ucauucaacucuccaauguucua

SEQ ID NO: 646372 - RNA, 16 nt, Homo sapiens
ucauucaagccuguga

SEQ ID NO: 646373 - RNA, 20 nt, Homo sapiens
ucauucagcaucuacucuaa

SEQ ID NO: 646374 - RNA, 14 nt, Homo sapiens
ucauucauucacuc

SEQ ID NO: 646375 - RNA, 13 nt, Homo sapiens
ucauuccaccuuc

SEQ ID NO: 646376 - RNA, 23 nt, Homo sapiens
ucauucccauuuuguuacauuuc

SEQ ID NO: 646377 - RNA, 22 nt, Homo sapiens
ucauucccucucaucucaggua

SEQ ID NO: 646378 - RNA, 15 nt, Homo sapiens
ucauuccuaacacag

SEQ ID NO: 646379 - RNA, 16 nt, Homo sapiens
uuucacuauaauguga

SEQ ID NO: 646380 - RNA, 22 nt, Homo sapiens
uuucacucucaaacuucacuaa

SEQ ID NO: 646381 - RNA, 13 nt, Homo sapiens
uuucacucugcau

SEQ ID NO: 646382 - RNA, 16 nt, Homo sapiens
uuucacuucuuccuau

SEQ ID NO: 646383 - RNA, 17 nt, Homo sapiens
uuucacuuuauugcuau

SEQ ID NO: 646384 - RNA, 15 nt, Homo sapiens
uuucacuuucugucu

SEQ ID NO: 646385 - RNA, 16 nt, Homo sapiens
uuucacuuugcucuca

SEQ ID NO: 646386 - RNA, 14 nt, Homo sapiens
uuucagaaauucca

SEQ ID NO: 646387 - RNA, 22 nt, Homo sapiens
uuucagaagagacugauccaaa

SEQ ID NO: 646388 - RNA, 20 nt, Homo sapiens
uuucagaagcucuucuaaaa

SEQ ID NO: 646389 - RNA, 14 nt, Homo sapiens
uuucagaauuuugc

SEQ ID NO: 646390 - RNA, 15 nt, Homo sapiens
uuucagagcauaaaa

SEQ ID NO: 646391 - RNA, 23 nt, Homo sapiens
uuucagaguguggauuguauaac

SEQ ID NO: 646392 - RNA, 14 nt, Homo sapiens
uuucagccaugaua

SEQ ID NO: 646393 - RNA, 12 nt, Homo sapiens
uuucagcuaaag

SEQ ID NO: 646394 - RNA, 19 nt, Homo sapiens
uuucagcucauuuaauccc

SEQ ID NO: 646395 - RNA, 15 nt, Homo sapiens
uuucaggaaucagaa

SEQ ID NO: 646396 - RNA, 18 nt, Homo sapiens
uuucaggaccuuaguucc

SEQ ID NO: 646397 - RNA, 11 nt, Homo sapiens
uuucaggagag

SEQ ID NO: 646398 - RNA, 17 nt, Homo sapiens
uuucaggauacaugugc

SEQ ID NO: 646399 - RNA, 21 nt, Homo sapiens
uuucagguccagaguaguuuc

SEQ ID NO: 646400 - RNA, 23 nt, Homo sapiens
uuucaguaguuugaucaguugaa

SEQ ID NO: 646401 - RNA, 18 nt, Homo sapiens
uuucaguauaauuuaacu

SEQ ID NO: 646402 - RNA, 17 nt, Homo sapiens
uuucagucaaaacuuua

SEQ ID NO: 646403 - RNA, 16 nt, Homo sapiens
uuucagucucucugaa

SEQ ID NO: 646404 - RNA, 19 nt, Homo sapiens
uuucagugcuuuuacuauc

SEQ ID NO: 646405 - RNA, 23 nt, Homo sapiens
uuucaguggcuaccuacauacaa

SEQ ID NO: 646406 - RNA, 10 nt, Homo sapiens
uuucauaaac

SEQ ID NO: 646407 - RNA, 14 nt, Homo sapiens
uuucauacaacaga

SEQ ID NO: 646408 - RNA, 17 nt, Homo sapiens
uuucauaccacuugaau

SEQ ID NO: 646409 - RNA, 13 nt, Homo sapiens
uuucauagauuug

SEQ ID NO: 646410 - RNA, 17 nt, Homo sapiens
uuucauaucauucucac

SEQ ID NO: 646411 - RNA, 23 nt, Homo sapiens
uuucauauucucuuugugaggac

SEQ ID NO: 646412 - RNA, 21 nt, Homo sapiens
uuucaucccagaaacuccaga

SEQ ID NO: 646413 - RNA, 22 nt, Homo sapiens
uuucauccggggcuuugccaga

SEQ ID NO: 646414 - RNA, 20 nt, Homo sapiens
uuucauccuauaagcuuaaa

SEQ ID NO: 646415 - RNA, 15 nt, Homo sapiens
uuucaucuaauguga

SEQ ID NO: 646416 - RNA, 23 nt, Homo sapiens
uuucaucuucaguugucucugau

SEQ ID NO: 646417 - RNA, 14 nt, Homo sapiens
uuucaugauauaau

SEQ ID NO: 646418 - RNA, 15 nt, Homo sapiens
uuucaugcuccuuac

SEQ ID NO: 646419 - RNA, 20 nt, Homo sapiens
uuucaugcuuuuucagccau

SEQ ID NO: 646420 - RNA, 19 nt, Homo sapiens
uuucauggucugcugagua

SEQ ID NO: 646421 - RNA, 13 nt, Homo sapiens
uuucauguaaucc

SEQ ID NO: 646422 - RNA, 19 nt, Homo sapiens
uuucauguuuugugacuau

SEQ ID NO: 646423 - RNA, 21 nt, Homo sapiens
uuucauugcccgaaaccagag

SEQ ID NO: 646424 - RNA, 22 nt, Homo sapiens
uuucauugccuguguauggaaa

SEQ ID NO: 646425 - RNA, 15 nt, Homo sapiens
uuucauuuccauuua

SEQ ID NO: 646426 - RNA, 18 nt, Homo sapiens
uuucauuugaauaggcaa

SEQ ID NO: 646427 - RNA, 14 nt, Homo sapiens
uuucauuugccggg

SEQ ID NO: 646428 - RNA, 22 nt, Homo sapiens
uuucauuuggaaugaauacagc

SEQ ID NO: 646429 - RNA, 21 nt, Homo sapiens
uuucauuugguucauuaauuc

SEQ ID NO: 646430 - RNA, 12 nt, Homo sapiens
uuuccaaaacau

SEQ ID NO: 646431 - RNA, 17 nt, Homo sapiens
uuuccaaaacuguccag

SEQ ID NO: 646432 - RNA, 14 nt, Homo sapiens
uuuccaaaacuuua

SEQ ID NO: 646433 - RNA, 19 nt, Homo sapiens
uuuccaaagaaaaguauug

SEQ ID NO: 646434 - RNA, 11 nt, Homo sapiens
uuuccaaagag

SEQ ID NO: 646435 - RNA, 17 nt, Homo sapiens
uuuccaaauaacaucaa

SEQ ID NO: 646436 - RNA, 20 nt, Homo sapiens
uuuccaaauauuuugcuuua

SEQ ID NO: 646437 - RNA, 22 nt, Homo sapiens
uuuccaacuggcacucuguggg

SEQ ID NO: 646438 - RNA, 22 nt, Homo sapiens
uuuccaaucaacagcagugagu

SEQ ID NO: 646439 - RNA, 23 nt, Homo sapiens
uuuccaauccagaggaacaagca

SEQ ID NO: 646440 - RNA, 16 nt, Homo sapiens
uuuccaaugaaggaaa

SEQ ID NO: 646441 - RNA, 17 nt, Homo sapiens
uuuccaauuuuguugca

SEQ ID NO: 646442 - RNA, 15 nt, Homo sapiens
uuuccacuacugcua

SEQ ID NO: 646443 - RNA, 20 nt, Homo sapiens
uuuccacuauuuucaaagaa

SEQ ID NO: 646444 - RNA, 21 nt, Homo sapiens
uuuccacucaaaauaugucaa

SEQ ID NO: 646445 - RNA, 12 nt, Homo sapiens
uuuccagaauug

SEQ ID NO: 646446 - RNA, 22 nt, Homo sapiens
uuuccagacuuugaaacuauua

SEQ ID NO: 646447 - RNA, 17 nt, Homo sapiens
uuuccagagaacugcag

SEQ ID NO: 646448 - RNA, 12 nt, Homo sapiens
uuuccagaguau

SEQ ID NO: 646449 - RNA, 17 nt, Homo sapiens
uuuccagcagaagacaa

SEQ ID NO: 646450 - RNA, 18 nt, Homo sapiens
uuuccaggagacauauau

SEQ ID NO: 646451 - RNA, 16 nt, Homo sapiens
uuuccaguguuuacaa

SEQ ID NO: 646452 - RNA, 23 nt, Homo sapiens
uuuccaguuuauaagacuggaau

SEQ ID NO: 646453 - RNA, 21 nt, Homo sapiens
uuuccauaaacacccaugaau

SEQ ID NO: 646454 - RNA, 18 nt, Homo sapiens
uuuccauaaauuuggacu

SEQ ID NO: 646455 - RNA, 14 nt, Homo sapiens
uuuccauagucaca

SEQ ID NO: 646456 - RNA, 19 nt, Homo sapiens
uuuccaucagcccaucuca

SEQ ID NO: 646457 - RNA, 22 nt, Homo sapiens
uuuccaugcacccucauacaca

SEQ ID NO: 646458 - RNA, 17 nt, Homo sapiens
uuuccauuguagcucuu

SEQ ID NO: 646459 - RNA, 18 nt, Homo sapiens
uuucccaaauguauugau

SEQ ID NO: 646460 - RNA, 16 nt, Homo sapiens
uuucccaacauaugcc

SEQ ID NO: 646461 - RNA, 22 nt, Homo sapiens
uuucccacgaggaaucuguggg

SEQ ID NO: 646462 - RNA, 18 nt, Homo sapiens
uuucccaggaauauccca

SEQ ID NO: 646463 - RNA, 21 nt, Homo sapiens
uuucccagucccauuccucag

SEQ ID NO: 646464 - RNA, 15 nt, Homo sapiens
uuucccauuuaucua

SEQ ID NO: 646465 - RNA, 14 nt, Homo sapiens
uuuccccagaucaa

SEQ ID NO: 646466 - RNA, 23 nt, Homo sapiens
uuucccccuugaggauuguggaa

SEQ ID NO: 646467 - RNA, 14 nt, Homo sapiens
uuuccccucagagc

SEQ ID NO: 646468 - RNA, 22 nt, Homo sapiens
uuucccucucccaguccauuuc

SEQ ID NO: 646469 - RNA, 23 nt, Homo sapiens
uuucccugcagaccucaagccau

SEQ ID NO: 646470 - RNA, 19 nt, Homo sapiens
uuucccuucaaaaugcuuu

SEQ ID NO: 646471 - RNA, 17 nt, Homo sapiens
uuuccgccagaccucaa

SEQ ID NO: 646472 - RNA, 18 nt, Homo sapiens
uuuccuaaaugcagugaa

SEQ ID NO: 646473 - RNA, 15 nt, Homo sapiens
uuuccuacuaucauc

SEQ ID NO: 646474 - RNA, 18 nt, Homo sapiens
uuuccuaugcuauugaca

SEQ ID NO: 646475 - RNA, 17 nt, Homo sapiens
uuuccucaaaacuggag

SEQ ID NO: 646476 - RNA, 16 nt, Homo sapiens
uuuccucagugcauuu

SEQ ID NO: 646477 - RNA, 18 nt, Homo sapiens
uuuccugaucacuaugca

SEQ ID NO: 646478 - RNA, 15 nt, Homo sapiens
uuuccugaucuagca

SEQ ID NO: 646479 - RNA, 15 nt, Homo sapiens
uuuccugugccaacc

SEQ ID NO: 646480 - RNA, 14 nt, Homo sapiens
uuuccuucauucau

SEQ ID NO: 646481 - RNA, 18 nt, Homo sapiens
uuuccuugacuucuuuga

SEQ ID NO: 646482 - RNA, 15 nt, Homo sapiens
uuuccuuggauguga

SEQ ID NO: 646483 - RNA, 16 nt, Homo sapiens
uuuccuuuaugugaau

SEQ ID NO: 646484 - RNA, 17 nt, Homo sapiens
uuuccuuuaugugaauu

SEQ ID NO: 646485 - RNA, 16 nt, Homo sapiens
uuucguaccuucccac

SEQ ID NO: 646486 - RNA, 12 nt, Homo sapiens
uuucguguauau

SEQ ID NO: 646487 - RNA, 19 nt, Homo sapiens
uuucguuaacauugaccaa

SEQ ID NO: 646488 - RNA, 14 nt, Homo sapiens
uuucuaaaaacaca

SEQ ID NO: 646489 - RNA, 16 nt, Homo sapiens
uuucuaaaaucuaaaa

SEQ ID NO: 646490 - RNA, 16 nt, Homo sapiens
uuucuaaagacuugua

SEQ ID NO: 646491 - RNA, 14 nt, Homo sapiens
uuucuaaaguaaaa

SEQ ID NO: 646492 - RNA, 13 nt, Homo sapiens
uuucuaaauuccu

SEQ ID NO: 646493 - RNA, 19 nt, Homo sapiens
uuucuaacgccagcacacu

SEQ ID NO: 646494 - RNA, 17 nt, Homo sapiens
uuucuaagaaaagcauu

SEQ ID NO: 646495 - RNA, 20 nt, Homo sapiens
uuucuaagcaguuaugguga

SEQ ID NO: 646496 - RNA, 21 nt, Homo sapiens
uuucuaaguguucgucuuuag

SEQ ID NO: 646497 - RNA, 13 nt, Homo sapiens
uagcuuagcuguc

SEQ ID NO: 646498 - RNA, 16 nt, Homo sapiens
uagcuugcaccuuguc

SEQ ID NO: 646499 - RNA, 19 nt, Homo sapiens
uagcuuuauauauggacau

SEQ ID NO: 646500 - RNA, 15 nt, Homo sapiens
uagcuuuauucuuca

SEQ ID NO: 646501 - RNA, 20 nt, Homo sapiens
uagcuuucccaaauaaacuc

SEQ ID NO: 646502 - RNA, 17 nt, Homo sapiens
uagcuuugggugccuuu

SEQ ID NO: 646503 - RNA, 21 nt, Homo sapiens
uaggaaaaauaaaacuucaca

SEQ ID NO: 646504 - RNA, 14 nt, Homo sapiens
uaggaaaaugccau

SEQ ID NO: 646505 - RNA, 17 nt, Homo sapiens
uaggaaaaugcuucugu

SEQ ID NO: 646506 - RNA, 17 nt, Homo sapiens
uaggaaagaugagaaau

SEQ ID NO: 646507 - RNA, 17 nt, Homo sapiens
uaggaaaguuucuucaa

SEQ ID NO: 646508 - RNA, 19 nt, Homo sapiens
uaggaaaucuagaaguagu

SEQ ID NO: 646509 - RNA, 13 nt, Homo sapiens
uaggaaccuugca

SEQ ID NO: 646510 - RNA, 22 nt, Homo sapiens
uaggaaggcagcauuccaugac

SEQ ID NO: 646511 - RNA, 14 nt, Homo sapiens
uaggaaucaccaau

SEQ ID NO: 646512 - RNA, 13 nt, Homo sapiens
uaggaaucccaga

SEQ ID NO: 646513 - RNA, 20 nt, Homo sapiens
uaggaauucaauuuggcaaa

SEQ ID NO: 646514 - RNA, 17 nt, Homo sapiens
uaggaauucuuugcauu

SEQ ID NO: 646515 - RNA, 13 nt, Homo sapiens
uaggacuuugaau

SEQ ID NO: 646516 - RNA, 15 nt, Homo sapiens
uaggagacuaaugga

SEQ ID NO: 646517 - RNA, 21 nt, Homo sapiens
uaggagcuccccuguuugcau

SEQ ID NO: 646518 - RNA, 16 nt, Homo sapiens
uaggaggaaacaguuc

SEQ ID NO: 646519 - RNA, 15 nt, Homo sapiens
uaggaggcaaagguu

SEQ ID NO: 646520 - RNA, 16 nt, Homo sapiens
uaggaggcugaggcag

SEQ ID NO: 646521 - RNA, 18 nt, Homo sapiens
uaggagggugacaugggg

SEQ ID NO: 646522 - RNA, 20 nt, Homo sapiens
uaggagggugugaguggcau

SEQ ID NO: 646523 - RNA, 16 nt, Homo sapiens
uaggagugguucucau

SEQ ID NO: 646524 - RNA, 21 nt, Homo sapiens
uaggaguucucugaugcagaa

SEQ ID NO: 646525 - RNA, 15 nt, Homo sapiens
uaggauaucuuggcu

SEQ ID NO: 646526 - RNA, 15 nt, Homo sapiens
uaggauggggcuccc

SEQ ID NO: 646527 - RNA, 19 nt, Homo sapiens
uaggcaaagcaaucaagca

SEQ ID NO: 646528 - RNA, 15 nt, Homo sapiens
uaggcaaccuucuaa

SEQ ID NO: 646529 - RNA, 14 nt, Homo sapiens
uaggcacuguucaa

SEQ ID NO: 646530 - RNA, 21 nt, Homo sapiens
uaggcagaaacaaaaugacug

SEQ ID NO: 646531 - RNA, 17 nt, Homo sapiens
uaggcagccucucugcu

SEQ ID NO: 646532 - RNA, 15 nt, Homo sapiens
uaggcauauaucacu

SEQ ID NO: 646533 - RNA, 14 nt, Homo sapiens
uaggcauuugcuga

SEQ ID NO: 646534 - RNA, 21 nt, Homo sapiens
uaggcauuugcugaauacaga

SEQ ID NO: 646535 - RNA, 17 nt, Homo sapiens
uaggcauuuuaaguaaa

SEQ ID NO: 646536 - RNA, 14 nt, Homo sapiens
uaggccaucuguaa

SEQ ID NO: 646537 - RNA, 22 nt, Homo sapiens
uaggccuggggacggcuuuuac

SEQ ID NO: 646538 - RNA, 22 nt, Homo sapiens
uaggcgggaugggcucgcugaa

SEQ ID NO: 646539 - RNA, 17 nt, Homo sapiens
uaggcggggcacggugg

SEQ ID NO: 646540 - RNA, 21 nt, Homo sapiens
uaggcggucaugugugcaugu

SEQ ID NO: 646541 - RNA, 12 nt, Homo sapiens
uaggcucugcac

SEQ ID NO: 646542 - RNA, 23 nt, Homo sapiens
uaggcuggaaaugguuucacuug

SEQ ID NO: 646543 - RNA, 18 nt, Homo sapiens
uaggcugucugugccaug

SEQ ID NO: 646544 - RNA, 15 nt, Homo sapiens
uagggaaaacuuaau

SEQ ID NO: 646545 - RNA, 14 nt, Homo sapiens
uagggaacugggga

SEQ ID NO: 646546 - RNA, 13 nt, Homo sapiens
uagggacuggagg

SEQ ID NO: 646547 - RNA, 14 nt, Homo sapiens
uagggaucccucau

SEQ ID NO: 646548 - RNA, 15 nt, Homo sapiens
uagggaugugugaga

SEQ ID NO: 646549 - RNA, 13 nt, Homo sapiens
uagggcacuuuaa

SEQ ID NO: 646550 - RNA, 16 nt, Homo sapiens
uagggcagacaugccu

SEQ ID NO: 646551 - RNA, 14 nt, Homo sapiens
uagggcugagcucu

SEQ ID NO: 646552 - RNA, 23 nt, Homo sapiens
uagggcugcugcuucugcuccag

SEQ ID NO: 646553 - RNA, 15 nt, Homo sapiens
uagggggaagacaga

SEQ ID NO: 646554 - RNA, 23 nt, Homo sapiens
uagggggccuugcggaagccaua

SEQ ID NO: 646555 - RNA, 15 nt, Homo sapiens
uagguagaugaacua

SEQ ID NO: 646556 - RNA, 12 nt, Homo sapiens
uagguagcuuua

SEQ ID NO: 646557 - RNA, 15 nt, Homo sapiens
uagguaggcaccaca

SEQ ID NO: 646558 - RNA, 17 nt, Homo sapiens
uagguauauauaugcca

SEQ ID NO: 646559 - RNA, 21 nt, Homo sapiens
uagguccagaaguccuuaugu

SEQ ID NO: 646560 - RNA, 23 nt, Homo sapiens
uagguccuuguuguuucuugccu

SEQ ID NO: 646561 - RNA, 13 nt, Homo sapiens
uaggucggcacuu

SEQ ID NO: 646562 - RNA, 18 nt, Homo sapiens
uaggugauccuguugaga

SEQ ID NO: 646563 - RNA, 15 nt, Homo sapiens
uaggugcaguuugcu

SEQ ID NO: 646564 - RNA, 16 nt, Homo sapiens
uaggugcuauuuguca

SEQ ID NO: 646565 - RNA, 16 nt, Homo sapiens
uagguguggcugugaa

SEQ ID NO: 646566 - RNA, 18 nt, Homo sapiens
uagguuaaaaaaaaaagu

SEQ ID NO: 646567 - RNA, 15 nt, Homo sapiens
uagguuaaaggccag

SEQ ID NO: 646568 - RNA, 22 nt, Homo sapiens
uagguuaguagcccuucagucu

SEQ ID NO: 646569 - RNA, 15 nt, Homo sapiens
uagguugagcaauuu

SEQ ID NO: 646570 - RNA, 14 nt, Homo sapiens
uagguugugcaaau

SEQ ID NO: 646571 - RNA, 19 nt, Homo sapiens
uagguuugauucaacacuu

SEQ ID NO: 646572 - RNA, 13 nt, Homo sapiens
uaguaaagcuuuu

SEQ ID NO: 646573 - RNA, 13 nt, Homo sapiens
uaguaaaucuccc

SEQ ID NO: 646574 - RNA, 18 nt, Homo sapiens
uaguaagggaacuaugga

SEQ ID NO: 646575 - RNA, 21 nt, Homo sapiens
uaguaauguuuuauacuguuu

SEQ ID NO: 646576 - RNA, 11 nt, Homo sapiens
uaguacuccuu

SEQ ID NO: 646577 - RNA, 23 nt, Homo sapiens
uaguacuugggagaccuguaauc

SEQ ID NO: 646578 - RNA, 16 nt, Homo sapiens
uaguaggcacuaaaua

SEQ ID NO: 646579 - RNA, 14 nt, Homo sapiens
uaguagggacuuaa

SEQ ID NO: 646580 - RNA, 18 nt, Homo sapiens
uaguaucagagaugucca

SEQ ID NO: 646581 - RNA, 17 nt, Homo sapiens
uaguaugaggcauuugu

SEQ ID NO: 646582 - RNA, 13 nt, Homo sapiens
uaguauugcugaa

SEQ ID NO: 646583 - RNA, 16 nt, Homo sapiens
uaguauuggagcacau

SEQ ID NO: 646584 - RNA, 16 nt, Homo sapiens
uaguauuuuugccaaa

SEQ ID NO: 646585 - RNA, 20 nt, Homo sapiens
uagucaagugcguccacgag

SEQ ID NO: 646586 - RNA, 19 nt, Homo sapiens
uagucaauaacuaaacuaa

SEQ ID NO: 646587 - RNA, 13 nt, Homo sapiens
uagucaauaucaa

SEQ ID NO: 646588 - RNA, 14 nt, Homo sapiens
uucaggaggcugga

SEQ ID NO: 646589 - RNA, 13 nt, Homo sapiens
uucaggagucuca

SEQ ID NO: 646590 - RNA, 14 nt, Homo sapiens
uucaggccagugug

SEQ ID NO: 646591 - RNA, 15 nt, Homo sapiens
uucaggccagugugg

SEQ ID NO: 646592 - RNA, 23 nt, Homo sapiens
uucaggccauucuccugccucag

SEQ ID NO: 646593 - RNA, 21 nt, Homo sapiens
uucaggcuaagaagagauuuc

SEQ ID NO: 646594 - RNA, 14 nt, Homo sapiens
uucaggcuaccuuu

SEQ ID NO: 646595 - RNA, 17 nt, Homo sapiens
uucaggcuacucauuca

SEQ ID NO: 646596 - RNA, 19 nt, Homo sapiens
uucaggcucugagacacac

SEQ ID NO: 646597 - RNA, 15 nt, Homo sapiens
uucagggaacugcau

SEQ ID NO: 646598 - RNA, 18 nt, Homo sapiens
uucagggaauuucaggaa

SEQ ID NO: 646599 - RNA, 19 nt, Homo sapiens
uucagggagcucgcauucu

SEQ ID NO: 646600 - RNA, 12 nt, Homo sapiens
uucagggccagg

SEQ ID NO: 646601 - RNA, 15 nt, Homo sapiens
uucagguaacacuac

SEQ ID NO: 646602 - RNA, 18 nt, Homo sapiens
uucagguauguguguaua

SEQ ID NO: 646603 - RNA, 15 nt, Homo sapiens
uucaguaagucucau

SEQ ID NO: 646604 - RNA, 21 nt, Homo sapiens
uucaguacacuugguguacug

SEQ ID NO: 646605 - RNA, 20 nt, Homo sapiens
uucaguagguugaacuauga

SEQ ID NO: 646606 - RNA, 13 nt, Homo sapiens
uucaguauguguc

SEQ ID NO: 646607 - RNA, 22 nt, Homo sapiens
uucaguauuaaauuagauaucu

SEQ ID NO: 646608 - RNA, 22 nt, Homo sapiens
uucagucauugucuuauaugcu

SEQ ID NO: 646609 - RNA, 17 nt, Homo sapiens
uucaguccacaguacau

SEQ ID NO: 646610 - RNA, 17 nt, Homo sapiens
uucagugauaacucuga

SEQ ID NO: 646611 - RNA, 16 nt, Homo sapiens
uucagugauguggggu

SEQ ID NO: 646612 - RNA, 13 nt, Homo sapiens
uucagugcaccua

SEQ ID NO: 646613 - RNA, 13 nt, Homo sapiens
uucagugcuucuu

SEQ ID NO: 646614 - RNA, 16 nt, Homo sapiens
uucaguggacuauaau

SEQ ID NO: 646615 - RNA, 15 nt, Homo sapiens
uucaguuuugcuuau

SEQ ID NO: 646616 - RNA, 14 nt, Homo sapiens
uucaguuuuuacug

SEQ ID NO: 646617 - RNA, 21 nt, Homo sapiens
uucauaaaaaauaaugguguc

SEQ ID NO: 646618 - RNA, 23 nt, Homo sapiens
uucauaaaaaauaauggugucca

SEQ ID NO: 646619 - RNA, 13 nt, Homo sapiens
uucauaaaaacca

SEQ ID NO: 646620 - RNA, 18 nt, Homo sapiens
uucauaauaaacuacaca

SEQ ID NO: 646621 - RNA, 16 nt, Homo sapiens
uucauaauuuuaguaa

SEQ ID NO: 646622 - RNA, 12 nt, Homo sapiens
uucauacuguaa

SEQ ID NO: 646623 - RNA, 17 nt, Homo sapiens
uucauacuucaugaaau

SEQ ID NO: 646624 - RNA, 22 nt, Homo sapiens
uucauagauagauaaguaucag

SEQ ID NO: 646625 - RNA, 15 nt, Homo sapiens
uucauaguuggaaaa

SEQ ID NO: 646626 - RNA, 21 nt, Homo sapiens
uucauaguuucaaaucuguaa

SEQ ID NO: 646627 - RNA, 15 nt, Homo sapiens
uucauauauacaggc

SEQ ID NO: 646628 - RNA, 22 nt, Homo sapiens
uucauaucuggagaagacuauu

SEQ ID NO: 646629 - RNA, 14 nt, Homo sapiens
uucauaugcagaug

SEQ ID NO: 646630 - RNA, 18 nt, Homo sapiens
uucauauuuauugauuaa

SEQ ID NO: 646631 - RNA, 19 nt, Homo sapiens
uucauauuuauugauuaaa

SEQ ID NO: 646632 - RNA, 18 nt, Homo sapiens
uucauauuuuaaacagag

SEQ ID NO: 646633 - RNA, 22 nt, Homo sapiens
uucaucagacuccugugcaacu

SEQ ID NO: 646634 - RNA, 20 nt, Homo sapiens
uucauccuaaaaaguuccau

SEQ ID NO: 646635 - RNA, 12 nt, Homo sapiens
uucaucuaauaa

SEQ ID NO: 646636 - RNA, 18 nt, Homo sapiens
uucaucuauuucugagaa

SEQ ID NO: 646637 - RNA, 16 nt, Homo sapiens
uucaucucucuaccuc

SEQ ID NO: 646638 - RNA, 21 nt, Homo sapiens
uucaucucugguuuucuugcc

SEQ ID NO: 646639 - RNA, 23 nt, Homo sapiens
uucaucucuuguuuacgauuuca

SEQ ID NO: 646640 - RNA, 19 nt, Homo sapiens
uucaugauuagcaaguuac

SEQ ID NO: 646641 - RNA, 12 nt, Homo sapiens
uucaugccagcu

SEQ ID NO: 646642 - RNA, 14 nt, Homo sapiens
uucaugccagguua

SEQ ID NO: 646643 - RNA, 13 nt, Homo sapiens
uucauggacacuu

SEQ ID NO: 646644 - RNA, 13 nt, Homo sapiens
uucauggccccag

SEQ ID NO: 646645 - RNA, 19 nt, Homo sapiens
uucauggcugaagucaccu

SEQ ID NO: 646646 - RNA, 21 nt, Homo sapiens
uucaugggaaaacagaccugu

SEQ ID NO: 646647 - RNA, 21 nt, Homo sapiens
uucauggguuuaccacuaacu

SEQ ID NO: 646648 - RNA, 16 nt, Homo sapiens
uucaugucacuaaaca

SEQ ID NO: 646649 - RNA, 13 nt, Homo sapiens
uucaugugagaaa

SEQ ID NO: 646650 - RNA, 21 nt, Homo sapiens
uucaugugguucagugccuuc

SEQ ID NO: 646651 - RNA, 23 nt, Homo sapiens
uucaugugguucagugccuuccu

SEQ ID NO: 646652 - RNA, 20 nt, Homo sapiens
uucaugugugugaguuugcu

SEQ ID NO: 646653 - RNA, 12 nt, Homo sapiens
uucauguucacu

SEQ ID NO: 646654 - RNA, 22 nt, Homo sapiens
uucauguuggucugacaucaag

SEQ ID NO: 646655 - RNA, 22 nt, Homo sapiens
uucauuaacaaaauguaugucu

SEQ ID NO: 646656 - RNA, 18 nt, Homo sapiens
uucauuaauacagggcau

SEQ ID NO: 646657 - RNA, 17 nt, Homo sapiens
uucauuagggaaaugca

SEQ ID NO: 646658 - RNA, 15 nt, Homo sapiens
uucauuauaaucuca

SEQ ID NO: 646659 - RNA, 15 nt, Homo sapiens
uucauucagccuuua

SEQ ID NO: 646660 - RNA, 22 nt, Homo sapiens
uucauucucccuuucacuaaaa

SEQ ID NO: 646661 - RNA, 16 nt, Homo sapiens
uucauugccuuuccag

SEQ ID NO: 646662 - RNA, 14 nt, Homo sapiens
uucauuggagcauu

SEQ ID NO: 646663 - RNA, 22 nt, Homo sapiens
uucauugugagauugcaguucu

SEQ ID NO: 646664 - RNA, 18 nt, Homo sapiens
uucauuguguuaccugua

SEQ ID NO: 646665 - RNA, 20 nt, Homo sapiens
uucauuguguuaccuguaga

SEQ ID NO: 646666 - RNA, 22 nt, Homo sapiens
uucauuuaauggggauuccacu

SEQ ID NO: 646667 - RNA, 14 nt, Homo sapiens
uucauuuaucuaua

SEQ ID NO: 646668 - RNA, 13 nt, Homo sapiens
uucauuucagcau

SEQ ID NO: 646669 - RNA, 16 nt, Homo sapiens
uucauuucuagacuca

SEQ ID NO: 646670 - RNA, 17 nt, Homo sapiens
uucauuuucucuaauau

SEQ ID NO: 646671 - RNA, 14 nt, Homo sapiens
uucauuuugcagaa

SEQ ID NO: 646672 - RNA, 16 nt, Homo sapiens
uucauuuuucuccuca

SEQ ID NO: 646673 - RNA, 23 nt, Homo sapiens
uucauuuuugauagcugucccau

SEQ ID NO: 646674 - RNA, 19 nt, Homo sapiens
uuccaaaacuguccagggc

SEQ ID NO: 646675 - RNA, 16 nt, Homo sapiens
uuccaaaaugccaaau

SEQ ID NO: 646676 - RNA, 19 nt, Homo sapiens
uuccaaacacauacaggaa

SEQ ID NO: 646677 - RNA, 13 nt, Homo sapiens
uuccaaacaucca

SEQ ID NO: 646678 - RNA, 18 nt, Homo sapiens
uuccaaagaaaaguauug

SEQ ID NO: 646679 - RNA, 20 nt, Homo sapiens
uuccaaagcagccugugaag

SEQ ID NO: 646680 - RNA, 21 nt, Homo sapiens
uuccaaagcuuuauuaccagu

SEQ ID NO: 646681 - RNA, 17 nt, Homo sapiens
uuccaaaugauccuagu

SEQ ID NO: 646682 - RNA, 22 nt, Homo sapiens
uuccaacagcaacacagccacu

SEQ ID NO: 646683 - RNA, 20 nt, Homo sapiens
uuccaacauuucucacugaa

SEQ ID NO: 646684 - RNA, 23 nt, Homo sapiens
uuccaacccagccacgacugcca

SEQ ID NO: 646685 - RNA, 23 nt, Homo sapiens
uuccaagaaaauaucacuguaau

SEQ ID NO: 646686 - RNA, 19 nt, Homo sapiens
uuccaaggguacuaaggaa

SEQ ID NO: 646687 - RNA, 23 nt, Homo sapiens
uuccaaggguaugggaagccaua

SEQ ID NO: 646688 - RNA, 13 nt, Homo sapiens
uuccaaugcauug

SEQ ID NO: 646689 - RNA, 23 nt, Homo sapiens
uuccaauguagcucaguaauucc

SEQ ID NO: 646690 - RNA, 16 nt, Homo sapiens
uuccaauuauuugacu

SEQ ID NO: 646691 - RNA, 20 nt, Homo sapiens
uuccaauuuacauacucugc

SEQ ID NO: 646692 - RNA, 16 nt, Homo sapiens
uuccacaauucacuag

SEQ ID NO: 646693 - RNA, 12 nt, Homo sapiens
uuccacaggaca

SEQ ID NO: 646694 - RNA, 21 nt, Homo sapiens
uuccacaguugccaccaccuc

SEQ ID NO: 646695 - RNA, 22 nt, Homo sapiens
uuccacauaggaaaaugccaug

SEQ ID NO: 646696 - RNA, 12 nt, Homo sapiens
uuccaccucacc

SEQ ID NO: 646697 - RNA, 20 nt, Homo sapiens
uuccaccuccaccacaucug

SEQ ID NO: 646698 - RNA, 20 nt, Homo sapiens
uuccacucaaaauaugucaa

SEQ ID NO: 646699 - RNA, 16 nt, Homo sapiens
uuccacugucuuucaa

SEQ ID NO: 646700 - RNA, 17 nt, Homo sapiens
uuccacuuaggaagaaa

SEQ ID NO: 646701 - RNA, 23 nt, Homo sapiens
uuccacuuugaguaccaaaucca

SEQ ID NO: 646702 - RNA, 22 nt, Homo sapiens
uuccagaaggcaaaaagacauu

SEQ ID NO: 646703 - RNA, 16 nt, Homo sapiens
uuccagaaucuugacu

SEQ ID NO: 646704 - RNA, 15 nt, Homo sapiens
uuccagaaugcugaa

SEQ ID NO: 646705 - RNA, 22 nt, Homo sapiens
uuccagacuuugaaacuauuaa

SEQ ID NO: 646706 - RNA, 16 nt, Homo sapiens
uuccagaggacagcuc

SEQ ID NO: 646707 - RNA, 23 nt, Homo sapiens
uuccagauguggauuuggcaaaa

SEQ ID NO: 646708 - RNA, 20 nt, Homo sapiens
uuccagcagaggugauucuu

SEQ ID NO: 646709 - RNA, 15 nt, Homo sapiens
uuccagccaggguga

SEQ ID NO: 646710 - RNA, 13 nt, Homo sapiens
uagucaauccaag

SEQ ID NO: 646711 - RNA, 20 nt, Homo sapiens
uagucaauccugucauauaa

SEQ ID NO: 646712 - RNA, 17 nt, Homo sapiens
uagucaauuucuacuuc

SEQ ID NO: 646713 - RNA, 15 nt, Homo sapiens
uagucaccuucauga

SEQ ID NO: 646714 - RNA, 19 nt, Homo sapiens
uagucagacugacacuacu

SEQ ID NO: 646715 - RNA, 13 nt, Homo sapiens
uagucagauuuca

SEQ ID NO: 646716 - RNA, 20 nt, Homo sapiens
uagucaguaaagauauuuga

SEQ ID NO: 646717 - RNA, 20 nt, Homo sapiens
uagucauacucccuggugua

SEQ ID NO: 646718 - RNA, 19 nt, Homo sapiens
uagucccagcuacuccgga

SEQ ID NO: 646719 - RNA, 18 nt, Homo sapiens
uaguccccuuuccucuaa

SEQ ID NO: 646720 - RNA, 22 nt, Homo sapiens
uagucccugcacagugacuucu

SEQ ID NO: 646721 - RNA, 21 nt, Homo sapiens
uagucgggugccaggacaaug

SEQ ID NO: 646722 - RNA, 18 nt, Homo sapiens
uagucucaccuacuccag

SEQ ID NO: 646723 - RNA, 18 nt, Homo sapiens
uagucuccuuugcacuga

SEQ ID NO: 646724 - RNA, 21 nt, Homo sapiens
uagucucuggaaaaagacuga

SEQ ID NO: 646725 - RNA, 20 nt, Homo sapiens
uagucugcgucucugcuuua

SEQ ID NO: 646726 - RNA, 13 nt, Homo sapiens
uagucugucaggg

SEQ ID NO: 646727 - RNA, 19 nt, Homo sapiens
uagucuuuuguaauaucaa

SEQ ID NO: 646728 - RNA, 22 nt, Homo sapiens
uagugaagcuaauuaaacacau

SEQ ID NO: 646729 - RNA, 17 nt, Homo sapiens
uagugaaucacguaaag

SEQ ID NO: 646730 - RNA, 16 nt, Homo sapiens
uagugacacacacugu

SEQ ID NO: 646731 - RNA, 17 nt, Homo sapiens
uagugaccuaaccacuu

SEQ ID NO: 646732 - RNA, 14 nt, Homo sapiens
uagugacuaugaac

SEQ ID NO: 646733 - RNA, 16 nt, Homo sapiens
uagugacuaugaacuu

SEQ ID NO: 646734 - RNA, 17 nt, Homo sapiens
uagugacuuccugguga

SEQ ID NO: 646735 - RNA, 19 nt, Homo sapiens
uagugagaaacugauuuau

SEQ ID NO: 646736 - RNA, 13 nt, Homo sapiens
uagugaugcaguu

SEQ ID NO: 646737 - RNA, 17 nt, Homo sapiens
uagugauuaccaaaaua

SEQ ID NO: 646738 - RNA, 16 nt, Homo sapiens
uagugauuuccuuaau

SEQ ID NO: 646739 - RNA, 17 nt, Homo sapiens
uagugcaauuccaagaa

SEQ ID NO: 646740 - RNA, 17 nt, Homo sapiens
uagugcacaagcacuau

SEQ ID NO: 646741 - RNA, 16 nt, Homo sapiens
uagugcagaaucucau

SEQ ID NO: 646742 - RNA, 16 nt, Homo sapiens
uagugccccgcacugu

SEQ ID NO: 646743 - RNA, 17 nt, Homo sapiens
uagugccccgcacugug

SEQ ID NO: 646744 - RNA, 13 nt, Homo sapiens
uagugcugugaaa

SEQ ID NO: 646745 - RNA, 20 nt, Homo sapiens
uaguggccugugcuuuucag

SEQ ID NO: 646746 - RNA, 20 nt, Homo sapiens
uagugggcaccccacugcaa

SEQ ID NO: 646747 - RNA, 23 nt, Homo sapiens
uagugggccagggcugcccugag

SEQ ID NO: 646748 - RNA, 19 nt, Homo sapiens
uaguggguacaucaagucc

SEQ ID NO: 646749 - RNA, 14 nt, Homo sapiens
uaguggugugauuu

SEQ ID NO: 646750 - RNA, 17 nt, Homo sapiens
uaguguauaccaccugu

SEQ ID NO: 646751 - RNA, 12 nt, Homo sapiens
uagugucacuua

SEQ ID NO: 646752 - RNA, 14 nt, Homo sapiens
uagugucauccuca

SEQ ID NO: 646753 - RNA, 19 nt, Homo sapiens
uagugugaaauaguucugc

SEQ ID NO: 646754 - RNA, 16 nt, Homo sapiens
uagugugaauauuaau

SEQ ID NO: 646755 - RNA, 23 nt, Homo sapiens
uaguguuaucaggcgucccauac

SEQ ID NO: 646756 - RNA, 14 nt, Homo sapiens
uaguguucacaaac

SEQ ID NO: 646757 - RNA, 18 nt, Homo sapiens
uaguguuguggacacugc

SEQ ID NO: 646758 - RNA, 18 nt, Homo sapiens
uaguguuuugaccuuucu

SEQ ID NO: 646759 - RNA, 14 nt, Homo sapiens
uaguuaaaguaaug

SEQ ID NO: 646760 - RNA, 12 nt, Homo sapiens
uaguuaaucucc

SEQ ID NO: 646761 - RNA, 18 nt, Homo sapiens
uaguuauaaaacuaugug

SEQ ID NO: 646762 - RNA, 22 nt, Homo sapiens
uaguucaaaugaugaagaccaa

SEQ ID NO: 646763 - RNA, 23 nt, Homo sapiens
uaguucaaaugaugaagaccaaa

SEQ ID NO: 646764 - RNA, 13 nt, Homo sapiens
uaguucagccauu

SEQ ID NO: 646765 - RNA, 14 nt, Homo sapiens
uaguucuacauuau

SEQ ID NO: 646766 - RNA, 20 nt, Homo sapiens
uaguucuccccgauggggca

SEQ ID NO: 646767 - RNA, 16 nt, Homo sapiens
uaguucugaguccuga

SEQ ID NO: 646768 - RNA, 21 nt, Homo sapiens
uaguugaucuacaaaggccau

SEQ ID NO: 646769 - RNA, 12 nt, Homo sapiens
uaguugcuguau

SEQ ID NO: 646770 - RNA, 23 nt, Homo sapiens
uaguuguaaaccaagugaucaaa

SEQ ID NO: 646771 - RNA, 13 nt, Homo sapiens
uaguugugcuuuu

SEQ ID NO: 646772 - RNA, 22 nt, Homo sapiens
uaguuuacagaauggaaccaaa

SEQ ID NO: 646773 - RNA, 14 nt, Homo sapiens
uaguuuaccucauc

SEQ ID NO: 646774 - RNA, 16 nt, Homo sapiens
uaguuuaccucaucca

SEQ ID NO: 646775 - RNA, 19 nt, Homo sapiens
uaguuuaggagaaaccagc

SEQ ID NO: 646776 - RNA, 21 nt, Homo sapiens
uaguuucuguaaaugacacuu

SEQ ID NO: 646777 - RNA, 21 nt, Homo sapiens
uaguuucuucauuucaggaag

SEQ ID NO: 646778 - RNA, 22 nt, Homo sapiens
uaguuugauacucccagucuug

SEQ ID NO: 646779 - RNA, 22 nt, Homo sapiens
uaguuuguaugccaagugagaa

SEQ ID NO: 646780 - RNA, 14 nt, Homo sapiens
uaguuuuacuuuua

SEQ ID NO: 646781 - RNA, 15 nt, Homo sapiens
uaguuuuacuuuuaa

SEQ ID NO: 646782 - RNA, 20 nt, Homo sapiens
uaguuuugucaaacuguaga

SEQ ID NO: 646783 - RNA, 20 nt, Homo sapiens
uaguuuuguuuaauuugcuu

SEQ ID NO: 646784 - RNA, 20 nt, Homo sapiens
uaguuuuuccuaucauguua

SEQ ID NO: 646785 - RNA, 15 nt, Homo sapiens
uauaaaaagcuucca

SEQ ID NO: 646786 - RNA, 23 nt, Homo sapiens
uauaaaacuauguguucaaugaa

SEQ ID NO: 646787 - RNA, 12 nt, Homo sapiens
uauaaaauacug

SEQ ID NO: 646788 - RNA, 20 nt, Homo sapiens
uauaaaauagacuuacugca

SEQ ID NO: 646789 - RNA, 21 nt, Homo sapiens
uauaaaauauguacauaauau

SEQ ID NO: 646790 - RNA, 17 nt, Homo sapiens
uauaaacaaaagaaucu

SEQ ID NO: 646791 - RNA, 20 nt, Homo sapiens
uauaaacagacaauauguga

SEQ ID NO: 646792 - RNA, 13 nt, Homo sapiens
uauaaacuccuua

SEQ ID NO: 646793 - RNA, 22 nt, Homo sapiens
uauaaacugagaggucacaaag

SEQ ID NO: 646794 - RNA, 17 nt, Homo sapiens
uauaaacugcugucaau

SEQ ID NO: 646795 - RNA, 16 nt, Homo sapiens
uauaaagaagaacuug

SEQ ID NO: 646796 - RNA, 22 nt, Homo sapiens
uauaaagaagaacuugcaugga

SEQ ID NO: 646797 - RNA, 13 nt, Homo sapiens
uauaaagaucacc

SEQ ID NO: 646798 - RNA, 17 nt, Homo sapiens
uauaaagauuguacuua

SEQ ID NO: 646799 - RNA, 19 nt, Homo sapiens
uauaaagcaaauuacucca

SEQ ID NO: 646800 - RNA, 16 nt, Homo sapiens
uauaaagcaacuguua

SEQ ID NO: 646801 - RNA, 13 nt, Homo sapiens
uauaaaggauaaa

SEQ ID NO: 646802 - RNA, 14 nt, Homo sapiens
uauaaaguauucaa

SEQ ID NO: 646803 - RNA, 14 nt, Homo sapiens
uauaaauacaugca

SEQ ID NO: 646804 - RNA, 18 nt, Homo sapiens
uauaaauacguauuacaa

SEQ ID NO: 646805 - RNA, 15 nt, Homo sapiens
uauaaauacugcaaa

SEQ ID NO: 646806 - RNA, 17 nt, Homo sapiens
uauaaaucaugaugcua

SEQ ID NO: 646807 - RNA, 14 nt, Homo sapiens
uauaaaugcuauuu

SEQ ID NO: 646808 - RNA, 15 nt, Homo sapiens
uauaaauguugcuau

SEQ ID NO: 646809 - RNA, 13 nt, Homo sapiens
uauaaauguuugu

SEQ ID NO: 646810 - RNA, 19 nt, Homo sapiens
uauaaauguuugucuggau

SEQ ID NO: 646811 - RNA, 19 nt, Homo sapiens
uauaaauuguacauuuugu

SEQ ID NO: 646812 - RNA, 16 nt, Homo sapiens
uauaaauuuaagcaaa

SEQ ID NO: 646813 - RNA, 18 nt, Homo sapiens
uauaaauuuuuaccuguu

SEQ ID NO: 646814 - RNA, 21 nt, Homo sapiens
uauaacaaacuacauguaauc

SEQ ID NO: 646815 - RNA, 15 nt, Homo sapiens
uauaacaacaaugaa

SEQ ID NO: 646816 - RNA, 19 nt, Homo sapiens
uauaacauucaguucccac

SEQ ID NO: 646817 - RNA, 13 nt, Homo sapiens
uauaaccaaaagg

SEQ ID NO: 646818 - RNA, 19 nt, Homo sapiens
uauaaccauaugauacuau

SEQ ID NO: 646819 - RNA, 22 nt, Homo sapiens
uauaacccuaggaauuuagaca

SEQ ID NO: 646820 - RNA, 23 nt, Homo sapiens
uauaacccuaggaauuuagacaa

SEQ ID NO: 646821 - RNA, 21 nt, Homo sapiens
uauaaccuuaauuuauuauua

SEQ ID NO: 646822 - RNA, 22 nt, Homo sapiens
uauaacuagacaucugcuguua

SEQ ID NO: 646823 - RNA, 12 nt, Homo sapiens
uauaacuguaaa

SEQ ID NO: 646824 - RNA, 19 nt, Homo sapiens
uauaagauucauauuuacu

SEQ ID NO: 646825 - RNA, 15 nt, Homo sapiens
uauaagauuccaaaa

SEQ ID NO: 646826 - RNA, 18 nt, Homo sapiens
uauaagauuccaaaaagc

SEQ ID NO: 646827 - RNA, 20 nt, Homo sapiens
uauaagcagaagcacauaug

SEQ ID NO: 646828 - RNA, 16 nt, Homo sapiens
uauaagcagcaagaca

SEQ ID NO: 646829 - RNA, 17 nt, Homo sapiens
uauaagcauacaacugg

SEQ ID NO: 646830 - RNA, 22 nt, Homo sapiens
uauaagcccacuguuaauauuc

SEQ ID NO: 646831 - RNA, 17 nt, Homo sapiens
uauaagcccugcauaau

SEQ ID NO: 646832 - RNA, 22 nt, Homo sapiens
uauaagcucaauuuaauuuugc

SEQ ID NO: 646833 - RNA, 11 nt, Homo sapiens
uuccagcugcu

SEQ ID NO: 646834 - RNA, 12 nt, Homo sapiens
uuccagcugcug

SEQ ID NO: 646835 - RNA, 17 nt, Homo sapiens
uuccagcugcugucuuc

SEQ ID NO: 646836 - RNA, 22 nt, Homo sapiens
uuccaggaaagcaacugcuuug

SEQ ID NO: 646837 - RNA, 15 nt, Homo sapiens
uuccaggaaccaaaa

SEQ ID NO: 646838 - RNA, 16 nt, Homo sapiens
uuccaggaaccaaaaa

SEQ ID NO: 646839 - RNA, 20 nt, Homo sapiens
uuccaggaccagaagcauuu

SEQ ID NO: 646840 - RNA, 17 nt, Homo sapiens
uuccaggagacauauau

SEQ ID NO: 646841 - RNA, 20 nt, Homo sapiens
uuccaggauaaggagacuga

SEQ ID NO: 646842 - RNA, 16 nt, Homo sapiens
uuccaggcgaugugca

SEQ ID NO: 646843 - RNA, 18 nt, Homo sapiens
uuccagguguuacuguaa

SEQ ID NO: 646844 - RNA, 21 nt, Homo sapiens
uuccagugguuugagacacug

SEQ ID NO: 646845 - RNA, 18 nt, Homo sapiens
uuccauaaacacccauga

SEQ ID NO: 646846 - RNA, 22 nt, Homo sapiens
uuccauaagcuuggugacaaaa

SEQ ID NO: 646847 - RNA, 17 nt, Homo sapiens
uuccauauucuguauua

SEQ ID NO: 646848 - RNA, 18 nt, Homo sapiens
uuccaucagcccaucuca

SEQ ID NO: 646849 - RNA, 19 nt, Homo sapiens
uuccauccugucaccauga

SEQ ID NO: 646850 - RNA, 16 nt, Homo sapiens
uuccaucucugacuua

SEQ ID NO: 646851 - RNA, 15 nt, Homo sapiens
uuccaugcuugagca

SEQ ID NO: 646852 - RNA, 22 nt, Homo sapiens
uuccauggaaauaaaaaguaug

SEQ ID NO: 646853 - RNA, 17 nt, Homo sapiens
uuccaugguuaccugac

SEQ ID NO: 646854 - RNA, 15 nt, Homo sapiens
uuccauuauguucau

SEQ ID NO: 646855 - RNA, 15 nt, Homo sapiens
uuccauuccaagccu

SEQ ID NO: 646856 - RNA, 22 nt, Homo sapiens
uuccauugaagccgacucuggc

SEQ ID NO: 646857 - RNA, 23 nt, Homo sapiens
uuccauugaagccgacucuggcc

SEQ ID NO: 646858 - RNA, 13 nt, Homo sapiens
uuccauugauuca

SEQ ID NO: 646859 - RNA, 13 nt, Homo sapiens
uuccauuuaguaa

SEQ ID NO: 646860 - RNA, 19 nt, Homo sapiens
uuccauuugugugugugca

SEQ ID NO: 646861 - RNA, 23 nt, Homo sapiens
uuccauuuugugaauugugacau

SEQ ID NO: 646862 - RNA, 23 nt, Homo sapiens
uuccauuuuuuucuaauggaaug

SEQ ID NO: 646863 - RNA, 18 nt, Homo sapiens
uucccaaaagauugcuga

SEQ ID NO: 646864 - RNA, 19 nt, Homo sapiens
uucccaagaguauccuacc

SEQ ID NO: 646865 - RNA, 23 nt, Homo sapiens
uucccaagcgucaucuguguaaa

SEQ ID NO: 646866 - RNA, 13 nt, Homo sapiens
uucccacacggca

SEQ ID NO: 646867 - RNA, 16 nt, Homo sapiens
uucccacaggacauuu

SEQ ID NO: 646868 - RNA, 17 nt, Homo sapiens
uucccacaggacauuuc

SEQ ID NO: 646869 - RNA, 15 nt, Homo sapiens
uucccacagugccua

SEQ ID NO: 646870 - RNA, 17 nt, Homo sapiens
uucccagagucaucuga

SEQ ID NO: 646871 - RNA, 14 nt, Homo sapiens
uucccagcaguggg

SEQ ID NO: 646872 - RNA, 14 nt, Homo sapiens
uucccagcucuccc

SEQ ID NO: 646873 - RNA, 22 nt, Homo sapiens
uucccagcuucugccacauaaa

SEQ ID NO: 646874 - RNA, 17 nt, Homo sapiens
uucccaggaauauccca

SEQ ID NO: 646875 - RNA, 20 nt, Homo sapiens
uucccagggaccagcaccuu

SEQ ID NO: 646876 - RNA, 21 nt, Homo sapiens
uucccaggguuauagacaguc

SEQ ID NO: 646877 - RNA, 12 nt, Homo sapiens
uucccaguguuc

SEQ ID NO: 646878 - RNA, 16 nt, Homo sapiens
uucccaguucuugacc

SEQ ID NO: 646879 - RNA, 16 nt, Homo sapiens
uuccccaaugcuccau

SEQ ID NO: 646880 - RNA, 19 nt, Homo sapiens
uuccccaauuacaggguga

SEQ ID NO: 646881 - RNA, 22 nt, Homo sapiens
uuccccaccccagcucaugccc

SEQ ID NO: 646882 - RNA, 17 nt, Homo sapiens
uuccccacugcucucug

SEQ ID NO: 646883 - RNA, 23 nt, Homo sapiens
uuccccagcgucccagucucugg

SEQ ID NO: 646884 - RNA, 18 nt, Homo sapiens
uucccccaauguuuaaaa

SEQ ID NO: 646885 - RNA, 19 nt, Homo sapiens
uucccccacuacugcagca

SEQ ID NO: 646886 - RNA, 15 nt, Homo sapiens
uuccccccauguugu

SEQ ID NO: 646887 - RNA, 18 nt, Homo sapiens
uuccccgaaucacacaga

SEQ ID NO: 646888 - RNA, 13 nt, Homo sapiens
uuccccugcugac

SEQ ID NO: 646889 - RNA, 16 nt, Homo sapiens
uuccccuuccacugag

SEQ ID NO: 646890 - RNA, 22 nt, Homo sapiens
uucccgacacccggagcucuac

SEQ ID NO: 646891 - RNA, 24 nt, Homo sapiens
uucccgacauaacauuguacugua

SEQ ID NO: 646892 - RNA, 14 nt, Homo sapiens
uucccgccuuccaa

SEQ ID NO: 646893 - RNA, 13 nt, Homo sapiens
uucccuccccaga

SEQ ID NO: 646894 - RNA, 13 nt, Homo sapiens
uucccucccuauc

SEQ ID NO: 646895 - RNA, 16 nt, Homo sapiens
uucccucccuaucuaa

SEQ ID NO: 646896 - RNA, 18 nt, Homo sapiens
uucccuccucccauguca

SEQ ID NO: 646897 - RNA, 21 nt, Homo sapiens
uucccuccucccaugucacug

SEQ ID NO: 646898 - RNA, 21 nt, Homo sapiens
uucccucuuggugugauugca

SEQ ID NO: 646899 - RNA, 19 nt, Homo sapiens
uucccugaaaccguuaaaa

SEQ ID NO: 646900 - RNA, 19 nt, Homo sapiens
uucccugaccucccaacuc

SEQ ID NO: 646901 - RNA, 17 nt, Homo sapiens
uucccugacuugcuuua

SEQ ID NO: 646902 - RNA, 18 nt, Homo sapiens
uucccugauugaccugcu

SEQ ID NO: 646903 - RNA, 22 nt, Homo sapiens
uucccugcucuugcaguugcuc

SEQ ID NO: 646904 - RNA, 14 nt, Homo sapiens
uucccuggggagcc

SEQ ID NO: 646905 - RNA, 14 nt, Homo sapiens
uucccuuaaauaca

SEQ ID NO: 646906 - RNA, 15 nt, Homo sapiens
uucccuuaacuccaa

SEQ ID NO: 646907 - RNA, 22 nt, Homo sapiens
uucccuucacuccccuauccca

SEQ ID NO: 646908 - RNA, 15 nt, Homo sapiens
uucccuucauuuaaa

SEQ ID NO: 646909 - RNA, 17 nt, Homo sapiens
uucccuuccuccauugc

SEQ ID NO: 646910 - RNA, 22 nt, Homo sapiens
uucccuucuacaaggacuccau

SEQ ID NO: 646911 - RNA, 14 nt, Homo sapiens
uucccuugcuggaa

SEQ ID NO: 646912 - RNA, 17 nt, Homo sapiens
uucccuuuuccauccuc

SEQ ID NO: 646913 - RNA, 19 nt, Homo sapiens
uucccuuuuguauucucuu

SEQ ID NO: 646914 - RNA, 16 nt, Homo sapiens
uuccgauacaaagugu

SEQ ID NO: 646915 - RNA, 13 nt, Homo sapiens
uuccgcagugugg

SEQ ID NO: 646916 - RNA, 17 nt, Homo sapiens
uuccggguucaagugac

SEQ ID NO: 646917 - RNA, 15 nt, Homo sapiens
uuccguaaacauaua

SEQ ID NO: 646918 - RNA, 12 nt, Homo sapiens
uuccgucucccc

SEQ ID NO: 646919 - RNA, 17 nt, Homo sapiens
uuccguggcacugcaua

SEQ ID NO: 646920 - RNA, 15 nt, Homo sapiens
uuccuaauacuguca

SEQ ID NO: 646921 - RNA, 20 nt, Homo sapiens
uuccuacagcacuacugggu

SEQ ID NO: 646922 - RNA, 17 nt, Homo sapiens
uuccuacccaaccacuc

SEQ ID NO: 646923 - RNA, 20 nt, Homo sapiens
uuccuaguagaacucacaga

SEQ ID NO: 646924 - RNA, 19 nt, Homo sapiens
uuccuauaauaaaauggca

SEQ ID NO: 646925 - RNA, 12 nt, Homo sapiens
uuccucacauuu

SEQ ID NO: 646926 - RNA, 22 nt, Homo sapiens
uuccucagcaccccuagcauga

SEQ ID NO: 646927 - RNA, 14 nt, Homo sapiens
uuccucagcugcca

SEQ ID NO: 646928 - RNA, 13 nt, Homo sapiens
uuccucauguaac

SEQ ID NO: 646929 - RNA, 12 nt, Homo sapiens
uuccuccauugc

SEQ ID NO: 646930 - RNA, 23 nt, Homo sapiens
uuccucccagcauaggauucauu

SEQ ID NO: 646931 - RNA, 20 nt, Homo sapiens
uuccuccccagucggcugaa

SEQ ID NO: 646932 - RNA, 15 nt, Homo sapiens
uuccucccccagcgu

SEQ ID NO: 646933 - RNA, 19 nt, Homo sapiens
uuccuccccgagucagggc

SEQ ID NO: 646934 - RNA, 18 nt, Homo sapiens
uuccucccugguuugcag

SEQ ID NO: 646935 - RNA, 21 nt, Homo sapiens
uuccuccgaggccaguaccuu

SEQ ID NO: 646936 - RNA, 23 nt, Homo sapiens
uuccuccucacccugccggguag

SEQ ID NO: 646937 - RNA, 19 nt, Homo sapiens
uuccuccuccaucaccuga

SEQ ID NO: 646938 - RNA, 22 nt, Homo sapiens
uuccuccucuauuuaagauaua

SEQ ID NO: 646939 - RNA, 22 nt, Homo sapiens
uuccucuauccuguacauuuca

SEQ ID NO: 646940 - RNA, 22 nt, Homo sapiens
uuccucuaugaaaauuauaucu

SEQ ID NO: 646941 - RNA, 11 nt, Homo sapiens
uuccucugcau

SEQ ID NO: 646942 - RNA, 12 nt, Homo sapiens
uuccucugccac

SEQ ID NO: 646943 - RNA, 13 nt, Homo sapiens
uuccucuggagac

SEQ ID NO: 646944 - RNA, 12 nt, Homo sapiens
uuccucugucaa

SEQ ID NO: 646945 - RNA, 14 nt, Homo sapiens
uuccucuuacugua

SEQ ID NO: 646946 - RNA, 17 nt, Homo sapiens
uuccucuugacccugca

SEQ ID NO: 646947 - RNA, 13 nt, Homo sapiens
uuccucuugccuc

SEQ ID NO: 646948 - RNA, 21 nt, Homo sapiens
uuccugaaauauaaacuguag

SEQ ID NO: 646949 - RNA, 15 nt, Homo sapiens
uuccugaagcugcug

SEQ ID NO: 646950 - RNA, 22 nt, Homo sapiens
uuccugaccuccgccauccacc

SEQ ID NO: 646951 - RNA, 23 nt, Homo sapiens
uuccugagccagcccuccuugac

SEQ ID NO: 646952 - RNA, 19 nt, Homo sapiens
uuccugaguggugccaaac

SEQ ID NO: 646953 - RNA, 18 nt, Homo sapiens
uuccugcgcauggugcag

SEQ ID NO: 646954 - RNA, 11 nt, Homo sapiens
uuccuggugcu

SEQ ID NO: 646955 - RNA, 17 nt, Homo sapiens
uuccugguuugacucag

SEQ ID NO: 646956 - RNA, 13 nt, Homo sapiens
uauaagcuuuuag

SEQ ID NO: 646957 - RNA, 15 nt, Homo sapiens
uauaaggcauuccac

SEQ ID NO: 646958 - RNA, 15 nt, Homo sapiens
uauaagguaauguag

SEQ ID NO: 646959 - RNA, 16 nt, Homo sapiens
uauaagguaugugcua

SEQ ID NO: 646960 - RNA, 15 nt, Homo sapiens
uauaagucaagcaca

SEQ ID NO: 646961 - RNA, 17 nt, Homo sapiens
uauaauaaacuuuucaa

SEQ ID NO: 646962 - RNA, 22 nt, Homo sapiens
uauaauaacuuuauugcauaua

SEQ ID NO: 646963 - RNA, 14 nt, Homo sapiens
uauaauacuguauu

SEQ ID NO: 646964 - RNA, 14 nt, Homo sapiens
uauaauauaccaau

SEQ ID NO: 646965 - RNA, 17 nt, Homo sapiens
uauaaucccagcacuuu

SEQ ID NO: 646966 - RNA, 12 nt, Homo sapiens
uauaaucuacuc

SEQ ID NO: 646967 - RNA, 21 nt, Homo sapiens
uauaaucugcagugaugcaau

SEQ ID NO: 646968 - RNA, 22 nt, Homo sapiens
uauaaugaaaaaggauaaugca

SEQ ID NO: 646969 - RNA, 19 nt, Homo sapiens
uauaaugaacacgugggua

SEQ ID NO: 646970 - RNA, 16 nt, Homo sapiens
uauaauuggugcauag

SEQ ID NO: 646971 - RNA, 22 nt, Homo sapiens
uauaauuucaaaccacacauua

SEQ ID NO: 646972 - RNA, 23 nt, Homo sapiens
uauaauuucaaaccacacauuag

SEQ ID NO: 646973 - RNA, 15 nt, Homo sapiens
uauacaaaacuuuau

SEQ ID NO: 646974 - RNA, 12 nt, Homo sapiens
uauacaaagugu

SEQ ID NO: 646975 - RNA, 17 nt, Homo sapiens
uauacaauaacccaguu

SEQ ID NO: 646976 - RNA, 15 nt, Homo sapiens
uauacaauacagauc

SEQ ID NO: 646977 - RNA, 18 nt, Homo sapiens
uauacacaacuuugcaaa

SEQ ID NO: 646978 - RNA, 16 nt, Homo sapiens
uauacacacaaaaagg

SEQ ID NO: 646979 - RNA, 17 nt, Homo sapiens
uauacaccagcaauuua

SEQ ID NO: 646980 - RNA, 17 nt, Homo sapiens
uauacacuucuggcuca

SEQ ID NO: 646981 - RNA, 19 nt, Homo sapiens
uauacagaacucacaguac

SEQ ID NO: 646982 - RNA, 23 nt, Homo sapiens
uauacagauagaguuccauauau

SEQ ID NO: 646983 - RNA, 20 nt, Homo sapiens
uauacagauucgaaacucca

SEQ ID NO: 646984 - RNA, 14 nt, Homo sapiens
uauacagauuuucu

SEQ ID NO: 646985 - RNA, 16 nt, Homo sapiens
uauacaggcauaaaau

SEQ ID NO: 646986 - RNA, 11 nt, Homo sapiens
uauacauacuu

SEQ ID NO: 646987 - RNA, 14 nt, Homo sapiens
uauacauaggcauc

SEQ ID NO: 646988 - RNA, 21 nt, Homo sapiens
uauacauaugagaauauaccu

SEQ ID NO: 646989 - RNA, 16 nt, Homo sapiens
uauacauugugauaua

SEQ ID NO: 646990 - RNA, 18 nt, Homo sapiens
uauacauuugauguauug

SEQ ID NO: 646991 - RNA, 17 nt, Homo sapiens
uauaccaucuccagcua

SEQ ID NO: 646992 - RNA, 15 nt, Homo sapiens
uauaccucaaugucc

SEQ ID NO: 646993 - RNA, 15 nt, Homo sapiens
uauacgcaucuauaa

SEQ ID NO: 646994 - RNA, 16 nt, Homo sapiens
uauacgcccuugagcu

SEQ ID NO: 646995 - RNA, 12 nt, Homo sapiens
uauacuaugaaa

SEQ ID NO: 646996 - RNA, 18 nt, Homo sapiens
uauacucagguaccucuu

SEQ ID NO: 646997 - RNA, 21 nt, Homo sapiens
uauacuguaugugccaaagcu

SEQ ID NO: 646998 - RNA, 20 nt, Homo sapiens
uauacuuaagaauacacagg

SEQ ID NO: 646999 - RNA, 14 nt, Homo sapiens
uauacuuaaucuca

SEQ ID NO: 647000 - RNA, 18 nt, Homo sapiens
uauacuucaaaagccaua

SEQ ID NO: 647001 - RNA, 20 nt, Homo sapiens
uauacuucucuauuaucuca

SEQ ID NO: 647002 - RNA, 21 nt, Homo sapiens
uauagaaaucuagaauuuuua

SEQ ID NO: 647003 - RNA, 14 nt, Homo sapiens
uauagaacuucaug

SEQ ID NO: 647004 - RNA, 18 nt, Homo sapiens
uauagaauaaaagcuaua

SEQ ID NO: 647005 - RNA, 17 nt, Homo sapiens
uauagagccuaccugua

SEQ ID NO: 647006 - RNA, 16 nt, Homo sapiens
uauagaguagaagauu

SEQ ID NO: 647007 - RNA, 14 nt, Homo sapiens
uauagauuguccuu

SEQ ID NO: 647008 - RNA, 20 nt, Homo sapiens
uauagcuaggugacauauac

SEQ ID NO: 647009 - RNA, 22 nt, Homo sapiens
uauagcucaggaccugggaccu

SEQ ID NO: 647010 - RNA, 16 nt, Homo sapiens
uauaggaaacuaagca

SEQ ID NO: 647011 - RNA, 18 nt, Homo sapiens
uauaggauagacacugga

SEQ ID NO: 647012 - RNA, 11 nt, Homo sapiens
uauaggauuuu

SEQ ID NO: 647013 - RNA, 19 nt, Homo sapiens
uauaggucucaucucuuca

SEQ ID NO: 647014 - RNA, 20 nt, Homo sapiens
uauaggugauguuugcucuu

SEQ ID NO: 647015 - RNA, 16 nt, Homo sapiens
uauaguaaguuucuau

SEQ ID NO: 647016 - RNA, 14 nt, Homo sapiens
uauaguacaugaua

SEQ ID NO: 647017 - RNA, 17 nt, Homo sapiens
uauaguauaagcagugu

SEQ ID NO: 647018 - RNA, 21 nt, Homo sapiens
uauagugacccacccuagauc

SEQ ID NO: 647019 - RNA, 11 nt, Homo sapiens
uauagugcaau

SEQ ID NO: 647020 - RNA, 21 nt, Homo sapiens
uauauaaacacuccacagugu

SEQ ID NO: 647021 - RNA, 15 nt, Homo sapiens
uauauaaguguacau

SEQ ID NO: 647022 - RNA, 13 nt, Homo sapiens
uauauaaguugcu

SEQ ID NO: 647023 - RNA, 13 nt, Homo sapiens
uauauaaguuuac

SEQ ID NO: 647024 - RNA, 19 nt, Homo sapiens
uauauaauaaagcuacuga

SEQ ID NO: 647025 - RNA, 14 nt, Homo sapiens
uauauaauauguca

SEQ ID NO: 647026 - RNA, 19 nt, Homo sapiens
uauauaauuuauuuccacu

SEQ ID NO: 647027 - RNA, 17 nt, Homo sapiens
uauauacccacauguac

SEQ ID NO: 647028 - RNA, 22 nt, Homo sapiens
uauauaccuggcuuuuacuuua

SEQ ID NO: 647029 - RNA, 12 nt, Homo sapiens
uauauacuuaag

SEQ ID NO: 647030 - RNA, 23 nt, Homo sapiens
uauauaguuaugcauacauacac

SEQ ID NO: 647031 - RNA, 14 nt, Homo sapiens
uauauauguauaua

SEQ ID NO: 647032 - RNA, 12 nt, Homo sapiens
uauauaugugcu

SEQ ID NO: 647033 - RNA, 19 nt, Homo sapiens
uauauauuuguaacauugu

SEQ ID NO: 647034 - RNA, 19 nt, Homo sapiens
uauauauuuuaaagaccaa

SEQ ID NO: 647035 - RNA, 20 nt, Homo sapiens
uauauauuuuugugcacauu

SEQ ID NO: 647036 - RNA, 14 nt, Homo sapiens
uauaucacuaagcu

SEQ ID NO: 647037 - RNA, 21 nt, Homo sapiens
uauaucauaacuauacuugau

SEQ ID NO: 647038 - RNA, 20 nt, Homo sapiens
uauaucauucuacagaauaa

SEQ ID NO: 647039 - RNA, 15 nt, Homo sapiens
uauauccucuggaaa

SEQ ID NO: 647040 - RNA, 14 nt, Homo sapiens
uauaucuaccccag

SEQ ID NO: 647041 - RNA, 12 nt, Homo sapiens
uauaucuauuac

SEQ ID NO: 647042 - RNA, 18 nt, Homo sapiens
uauaugaauuuccacuuu

SEQ ID NO: 647043 - RNA, 14 nt, Homo sapiens
uauaugauucacau

SEQ ID NO: 647044 - RNA, 21 nt, Homo sapiens
uauaugccucauacacauaau

SEQ ID NO: 647045 - RNA, 21 nt, Homo sapiens
uauaugcuucacauagcaugu

SEQ ID NO: 647046 - RNA, 14 nt, Homo sapiens
uauauggggggcca

SEQ ID NO: 647047 - RNA, 15 nt, Homo sapiens
uauauggggggccaa

SEQ ID NO: 647048 - RNA, 14 nt, Homo sapiens
uauauguacaugag

SEQ ID NO: 647049 - RNA, 12 nt, Homo sapiens
uauauguaccgu

SEQ ID NO: 647050 - RNA, 13 nt, Homo sapiens
uauauguacuugu

SEQ ID NO: 647051 - RNA, 17 nt, Homo sapiens
uauauguguguguauau

SEQ ID NO: 647052 - RNA, 17 nt, Homo sapiens
uauauuacaagccuaca

SEQ ID NO: 647053 - RNA, 17 nt, Homo sapiens
uauauuacaagggauaa

SEQ ID NO: 647054 - RNA, 21 nt, Homo sapiens
uauauuagggacacuuucaca

SEQ ID NO: 647055 - RNA, 17 nt, Homo sapiens
uauauuauaaucuucca

SEQ ID NO: 647056 - RNA, 13 nt, Homo sapiens
uauauuauggaag

SEQ ID NO: 647057 - RNA, 11 nt, Homo sapiens
uauauucacag

SEQ ID NO: 647058 - RNA, 19 nt, Homo sapiens
uauauuccgcacucaagga

SEQ ID NO: 647059 - RNA, 16 nt, Homo sapiens
uauauugaauauauca

SEQ ID NO: 647060 - RNA, 12 nt, Homo sapiens
uauauugcagua

SEQ ID NO: 647061 - RNA, 12 nt, Homo sapiens
uauauugcccag

SEQ ID NO: 647062 - RNA, 16 nt, Homo sapiens
uauauuggaagcugcu

SEQ ID NO: 647063 - RNA, 17 nt, Homo sapiens
uauauugggcgauuugg

SEQ ID NO: 647064 - RNA, 18 nt, Homo sapiens
uauauuguauaggggcaa

SEQ ID NO: 647065 - RNA, 14 nt, Homo sapiens
uauauuuauacucu

SEQ ID NO: 647066 - RNA, 15 nt, Homo sapiens
uauauuuauacucua

SEQ ID NO: 647067 - RNA, 16 nt, Homo sapiens
uauauuuauugugcuu

SEQ ID NO: 647068 - RNA, 18 nt, Homo sapiens
uauauuuguaaacuacaa

SEQ ID NO: 647069 - RNA, 19 nt, Homo sapiens
uauauuuguaaacuacaaa

SEQ ID NO: 647070 - RNA, 14 nt, Homo sapiens
uauauuuguacaaa

SEQ ID NO: 647071 - RNA, 20 nt, Homo sapiens
uauauuugugauagcacuuu

SEQ ID NO: 647072 - RNA, 17 nt, Homo sapiens
uauauuuugaugagcuu

SEQ ID NO: 647073 - RNA, 20 nt, Homo sapiens
uauauuuugugcuaucagac

SEQ ID NO: 647074 - RNA, 19 nt, Homo sapiens
uauauuuuugguugucaau

SEQ ID NO: 647075 - RNA, 22 nt, Homo sapiens
uauauuuuuguacugaaucuca

SEQ ID NO: 647076 - RNA, 19 nt, Homo sapiens
uaucaaaaaguacaauaau

SEQ ID NO: 647077 - RNA, 12 nt, Homo sapiens
uaucaaagucau

SEQ ID NO: 647078 - RNA, 21 nt, Homo sapiens
uaucaaaucuguauauguugu

SEQ ID NO: 647079 - RNA, 16 nt, Homo sapiens
uaucaagaggaucuga

SEQ ID NO: 647080 - RNA, 14 nt, Homo sapiens
uuccuguagccuuc

SEQ ID NO: 647081 - RNA, 19 nt, Homo sapiens
uuccugucccacuacugua

SEQ ID NO: 647082 - RNA, 15 nt, Homo sapiens
uuccuguucagugag

SEQ ID NO: 647083 - RNA, 23 nt, Homo sapiens
uuccuguugauguucagaaugga

SEQ ID NO: 647084 - RNA, 14 nt, Homo sapiens
uuccuuaaagcauu

SEQ ID NO: 647085 - RNA, 18 nt, Homo sapiens
uuccuuaagagcuauuug

SEQ ID NO: 647086 - RNA, 21 nt, Homo sapiens
uuccuuaggaggacuuuggua

SEQ ID NO: 647087 - RNA, 21 nt, Homo sapiens
uuccuucaagaggaccaaaug

SEQ ID NO: 647088 - RNA, 12 nt, Homo sapiens
uuccuucacuca

SEQ ID NO: 647089 - RNA, 14 nt, Homo sapiens
uuccuucacucauc

SEQ ID NO: 647090 - RNA, 17 nt, Homo sapiens
uuccuucacuuugcaga

SEQ ID NO: 647091 - RNA, 19 nt, Homo sapiens
uuccuucagacagauucca

SEQ ID NO: 647092 - RNA, 19 nt, Homo sapiens
uuccuuccagauccugggu

SEQ ID NO: 647093 - RNA, 15 nt, Homo sapiens
uuccuucccagagau

SEQ ID NO: 647094 - RNA, 15 nt, Homo sapiens
uuccuucuacuccuc

SEQ ID NO: 647095 - RNA, 19 nt, Homo sapiens
uuccuucucaucugugauu

SEQ ID NO: 647096 - RNA, 18 nt, Homo sapiens
uuccuucucugaaagugg

SEQ ID NO: 647097 - RNA, 20 nt, Homo sapiens
uuccuucuugacauuuauca

SEQ ID NO: 647098 - RNA, 18 nt, Homo sapiens
uuccuugacuucuuugag

SEQ ID NO: 647099 - RNA, 21 nt, Homo sapiens
uuccuugccuaaggugucuga

SEQ ID NO: 647100 - RNA, 17 nt, Homo sapiens
uuccuugccugugacuu

SEQ ID NO: 647101 - RNA, 15 nt, Homo sapiens
uuccuugcucugcac

SEQ ID NO: 647102 - RNA, 16 nt, Homo sapiens
uuccuuggaacacaua

SEQ ID NO: 647103 - RNA, 16 nt, Homo sapiens
uuccuugggaugaucu

SEQ ID NO: 647104 - RNA, 17 nt, Homo sapiens
uuccuugggaugaucuu

SEQ ID NO: 647105 - RNA, 19 nt, Homo sapiens
uuccuuuauacacagugga

SEQ ID NO: 647106 - RNA, 17 nt, Homo sapiens
uuccuuucacuggccac

SEQ ID NO: 647107 - RNA, 14 nt, Homo sapiens
uuccuuuccauugu

SEQ ID NO: 647108 - RNA, 16 nt, Homo sapiens
uuccuuuccauuguag

SEQ ID NO: 647109 - RNA, 16 nt, Homo sapiens
uuccuuugaagauagu

SEQ ID NO: 647110 - RNA, 20 nt, Homo sapiens
uuccuuuuaaaacacuucca

SEQ ID NO: 647111 - RNA, 15 nt, Homo sapiens
uuccuuuucauuuaa

SEQ ID NO: 647112 - RNA, 15 nt, Homo sapiens
uuccuuuucccagga

SEQ ID NO: 647113 - RNA, 16 nt, Homo sapiens
uucgaaacuccauuga

SEQ ID NO: 647114 - RNA, 13 nt, Homo sapiens
uucgaaacugcca

SEQ ID NO: 647115 - RNA, 20 nt, Homo sapiens
uucgaugaaccugacaaaaa

SEQ ID NO: 647116 - RNA, 12 nt, Homo sapiens
uucgauggcuca

SEQ ID NO: 647117 - RNA, 23 nt, Homo sapiens
uucgcgaauccguaucugcagaa

SEQ ID NO: 647118 - RNA, 20 nt, Homo sapiens
uucgcgugcccucgcugcuu

SEQ ID NO: 647119 - RNA, 15 nt, Homo sapiens
uucgcucgugcagua

SEQ ID NO: 647120 - RNA, 20 nt, Homo sapiens
uucggacaugcuuuucugcc

SEQ ID NO: 647121 - RNA, 12 nt, Homo sapiens
uucggcauuuga

SEQ ID NO: 647122 - RNA, 14 nt, Homo sapiens
uucggucuuuccca

SEQ ID NO: 647123 - RNA, 14 nt, Homo sapiens
uucggugugcugcc

SEQ ID NO: 647124 - RNA, 20 nt, Homo sapiens
uucguucugcugaccaaaug

SEQ ID NO: 647125 - RNA, 19 nt, Homo sapiens
uucuaaaaccuuagucauc

SEQ ID NO: 647126 - RNA, 14 nt, Homo sapiens
uucuaaacuacaac

SEQ ID NO: 647127 - RNA, 15 nt, Homo sapiens
uucuaaagcuaguaa

SEQ ID NO: 647128 - RNA, 13 nt, Homo sapiens
uucuaaaguaaaa

SEQ ID NO: 647129 - RNA, 20 nt, Homo sapiens
uucuaacauguuuugugcag

SEQ ID NO: 647130 - RNA, 23 nt, Homo sapiens
uucuaacccaagacaugacauuc

SEQ ID NO: 647131 - RNA, 17 nt, Homo sapiens
uucuaaccuccuaagca

SEQ ID NO: 647132 - RNA, 16 nt, Homo sapiens
uucuaacuucuuucac

SEQ ID NO: 647133 - RNA, 16 nt, Homo sapiens
uucuaagaaauaucug

SEQ ID NO: 647134 - RNA, 19 nt, Homo sapiens
uucuaagaaauaucuguga

SEQ ID NO: 647135 - RNA, 17 nt, Homo sapiens
uucuaagacuacuauga

SEQ ID NO: 647136 - RNA, 21 nt, Homo sapiens
uucuaagagcgaacuucacau

SEQ ID NO: 647137 - RNA, 22 nt, Homo sapiens
uucuaagauaagaguugagauu

SEQ ID NO: 647138 - RNA, 12 nt, Homo sapiens
uucuaagcaugu

SEQ ID NO: 647139 - RNA, 18 nt, Homo sapiens
uucuaaguauuuuauucc

SEQ ID NO: 647140 - RNA, 13 nt, Homo sapiens
uucuaauauggag

SEQ ID NO: 647141 - RNA, 16 nt, Homo sapiens
uucuaaucacaguguu

SEQ ID NO: 647142 - RNA, 20 nt, Homo sapiens
uucuaauuuauauuauccau

SEQ ID NO: 647143 - RNA, 19 nt, Homo sapiens
uucuaauuucaaaaauaua

SEQ ID NO: 647144 - RNA, 13 nt, Homo sapiens
uucuacaagcaua

SEQ ID NO: 647145 - RNA, 13 nt, Homo sapiens
uucuacagauauu

SEQ ID NO: 647146 - RNA, 22 nt, Homo sapiens
uucuacauuauucuucacuuaa

SEQ ID NO: 647147 - RNA, 12 nt, Homo sapiens
uucuaccuugaa

SEQ ID NO: 647148 - RNA, 15 nt, Homo sapiens
uucuacuaugaucag

SEQ ID NO: 647149 - RNA, 21 nt, Homo sapiens
uucuacucaggcugguggaga

SEQ ID NO: 647150 - RNA, 15 nt, Homo sapiens
uucuacucugucuua

SEQ ID NO: 647151 - RNA, 17 nt, Homo sapiens
uucuacugaacagucca

SEQ ID NO: 647152 - RNA, 11 nt, Homo sapiens
uucuacuguaa

SEQ ID NO: 647153 - RNA, 17 nt, Homo sapiens
uucuacugucaaaugau

SEQ ID NO: 647154 - RNA, 18 nt, Homo sapiens
uucuacuuccccauuuca

SEQ ID NO: 647155 - RNA, 14 nt, Homo sapiens
uucuacuuguaaaa

SEQ ID NO: 647156 - RNA, 14 nt, Homo sapiens
uucuagauucacug

SEQ ID NO: 647157 - RNA, 12 nt, Homo sapiens
uucuagccuuag

SEQ ID NO: 647158 - RNA, 17 nt, Homo sapiens
uucuagcugucugugaa

SEQ ID NO: 647159 - RNA, 14 nt, Homo sapiens
uucuaggauagcua

SEQ ID NO: 647160 - RNA, 17 nt, Homo sapiens
uucuaggccaagcauuu

SEQ ID NO: 647161 - RNA, 18 nt, Homo sapiens
uucuaggcccauuguccu

SEQ ID NO: 647162 - RNA, 16 nt, Homo sapiens
uucuaggcucacugca

SEQ ID NO: 647163 - RNA, 17 nt, Homo sapiens
uucuagguaggggccca

SEQ ID NO: 647164 - RNA, 13 nt, Homo sapiens
uucuaggugcccg

SEQ ID NO: 647165 - RNA, 22 nt, Homo sapiens
uucuagguggagguugugcaug

SEQ ID NO: 647166 - RNA, 15 nt, Homo sapiens
uucuagucuuggcca

SEQ ID NO: 647167 - RNA, 15 nt, Homo sapiens
uucuaguuagucauc

SEQ ID NO: 647168 - RNA, 13 nt, Homo sapiens
uucuaguuucacg

SEQ ID NO: 647169 - RNA, 20 nt, Homo sapiens
uucuauaauuuugccuuuaa

SEQ ID NO: 647170 - RNA, 15 nt, Homo sapiens
uucuaucauggaaua

SEQ ID NO: 647171 - RNA, 19 nt, Homo sapiens
uucuauccuuuugccugca

SEQ ID NO: 647172 - RNA, 19 nt, Homo sapiens
uucuaucugggcuguugcu

SEQ ID NO: 647173 - RNA, 14 nt, Homo sapiens
uucuaugccuuuag

SEQ ID NO: 647174 - RNA, 23 nt, Homo sapiens
uucuaugcuguuuguagugaaau

SEQ ID NO: 647175 - RNA, 19 nt, Homo sapiens
uucuauguauuagugucaa

SEQ ID NO: 647176 - RNA, 22 nt, Homo sapiens
uucuauuaauaucaacucugaa

SEQ ID NO: 647177 - RNA, 21 nt, Homo sapiens
uucuauuuauauguacaugag

SEQ ID NO: 647178 - RNA, 10 nt, Homo sapiens
uucucaaaaa

SEQ ID NO: 647179 - RNA, 16 nt, Homo sapiens
uucucaaccuuaucaa

SEQ ID NO: 647180 - RNA, 19 nt, Homo sapiens
uucucaaucagugcaguga

SEQ ID NO: 647181 - RNA, 19 nt, Homo sapiens
uucucacccaggcaaucuu

SEQ ID NO: 647182 - RNA, 18 nt, Homo sapiens
uucucacuagaugacugu

SEQ ID NO: 647183 - RNA, 22 nt, Homo sapiens
uucucagaaucuacccaaagga

SEQ ID NO: 647184 - RNA, 17 nt, Homo sapiens
uucucagacacugccga

SEQ ID NO: 647185 - RNA, 23 nt, Homo sapiens
uucucagauguugaaacuuugaa

SEQ ID NO: 647186 - RNA, 19 nt, Homo sapiens
uucucagcuauuuccagag

SEQ ID NO: 647187 - RNA, 21 nt, Homo sapiens
uucucagguguugccaaauau

SEQ ID NO: 647188 - RNA, 21 nt, Homo sapiens
uucucaguaguuguccgugau

SEQ ID NO: 647189 - RNA, 22 nt, Homo sapiens
uucucagucauuuuuaaccucu

SEQ ID NO: 647190 - RNA, 18 nt, Homo sapiens
uucucaucauauuguaug

SEQ ID NO: 647191 - RNA, 14 nt, Homo sapiens
uucucaucccacgc

SEQ ID NO: 647192 - RNA, 21 nt, Homo sapiens
uucucaucccccagccacagu

SEQ ID NO: 647193 - RNA, 19 nt, Homo sapiens
uucucaugaauaaauuccu

SEQ ID NO: 647194 - RNA, 14 nt, Homo sapiens
uucuccaaagaaga

SEQ ID NO: 647195 - RNA, 13 nt, Homo sapiens
uucuccaagcauc

SEQ ID NO: 647196 - RNA, 18 nt, Homo sapiens
uucuccauaucaaaacga

SEQ ID NO: 647197 - RNA, 19 nt, Homo sapiens
uucuccaucccucuaauga

SEQ ID NO: 647198 - RNA, 21 nt, Homo sapiens
uucuccaucccucuaaugaga

SEQ ID NO: 647199 - RNA, 22 nt, Homo sapiens
uucucccaccaccucaccaguu

SEQ ID NO: 647200 - RNA, 21 nt, Homo sapiens
uucuccccuuccuggacacac

SEQ ID NO: 647201 - RNA, 17 nt, Homo sapiens
uucucccucacccaagu

SEQ ID NO: 647202 - RNA, 22 nt, Homo sapiens
uucucccucucaugucccucca

SEQ ID NO: 647203 - RNA, 21 nt, Homo sapiens
uaucaagccaguacgugcuaa

SEQ ID NO: 647204 - RNA, 13 nt, Homo sapiens
uaucaagccauaa

SEQ ID NO: 647205 - RNA, 13 nt, Homo sapiens
uaucaagcuuuua

SEQ ID NO: 647206 - RNA, 15 nt, Homo sapiens
uaucaagucauggca

SEQ ID NO: 647207 - RNA, 22 nt, Homo sapiens
uaucaauggagcaugugugcaa

SEQ ID NO: 647208 - RNA, 16 nt, Homo sapiens
uaucaauggauuuauc

SEQ ID NO: 647209 - RNA, 16 nt, Homo sapiens
uaucaauuuuucccag

SEQ ID NO: 647210 - RNA, 18 nt, Homo sapiens
uaucacagugaaugcacu

SEQ ID NO: 647211 - RNA, 16 nt, Homo sapiens
uaucacauauuugaua

SEQ ID NO: 647212 - RNA, 21 nt, Homo sapiens
uaucacauuuaccauaauuua

SEQ ID NO: 647213 - RNA, 21 nt, Homo sapiens
uaucaccuagcagccucaaaa

SEQ ID NO: 647214 - RNA, 14 nt, Homo sapiens
uaucaccucucuuc

SEQ ID NO: 647215 - RNA, 17 nt, Homo sapiens
uaucacugaacaaacua

SEQ ID NO: 647216 - RNA, 23 nt, Homo sapiens
uaucagccgauaucaacacuugu

SEQ ID NO: 647217 - RNA, 18 nt, Homo sapiens
uaucagcggcagcauucu

SEQ ID NO: 647218 - RNA, 22 nt, Homo sapiens
uaucaggauuguguugugugga

SEQ ID NO: 647219 - RNA, 19 nt, Homo sapiens
uaucaggguauaaauuaua

SEQ ID NO: 647220 - RNA, 13 nt, Homo sapiens
uaucaggucccau

SEQ ID NO: 647221 - RNA, 15 nt, Homo sapiens
uaucaguuacccacu

SEQ ID NO: 647222 - RNA, 19 nt, Homo sapiens
uaucauacccuuuauucuc

SEQ ID NO: 647223 - RNA, 23 nt, Homo sapiens
uaucaugaagcacaucaauuaca

SEQ ID NO: 647224 - RNA, 22 nt, Homo sapiens
uaucaugcaaauuucaugacca

SEQ ID NO: 647225 - RNA, 16 nt, Homo sapiens
uaucauggcauauaac

SEQ ID NO: 647226 - RNA, 16 nt, Homo sapiens
uaucauguuaaauuag

SEQ ID NO: 647227 - RNA, 19 nt, Homo sapiens
uaucauucagcaucuacuc

SEQ ID NO: 647228 - RNA, 16 nt, Homo sapiens
uaucauuggaacaacu

SEQ ID NO: 647229 - RNA, 14 nt, Homo sapiens
uaucauuucacugu

SEQ ID NO: 647230 - RNA, 13 nt, Homo sapiens
uauccaaauugau

SEQ ID NO: 647231 - RNA, 14 nt, Homo sapiens
uauccaaguuggac

SEQ ID NO: 647232 - RNA, 12 nt, Homo sapiens
uauccaauucaa

SEQ ID NO: 647233 - RNA, 13 nt, Homo sapiens
uauccacauaaau

SEQ ID NO: 647234 - RNA, 13 nt, Homo sapiens
uauccaccaccuc

SEQ ID NO: 647235 - RNA, 14 nt, Homo sapiens
uauccagccuccca

SEQ ID NO: 647236 - RNA, 21 nt, Homo sapiens
uauccauguaauaagcacuug

SEQ ID NO: 647237 - RNA, 18 nt, Homo sapiens
uauccauuacgugcauuu

SEQ ID NO: 647238 - RNA, 20 nt, Homo sapiens
uaucccaguuuaauauucca

SEQ ID NO: 647239 - RNA, 17 nt, Homo sapiens
uaucccgagucugggac

SEQ ID NO: 647240 - RNA, 14 nt, Homo sapiens
uaucccuacaugua

SEQ ID NO: 647241 - RNA, 21 nt, Homo sapiens
uaucccuagauagcuauuaag

SEQ ID NO: 647242 - RNA, 15 nt, Homo sapiens
uauccgaacuuuaau

SEQ ID NO: 647243 - RNA, 20 nt, Homo sapiens
uauccgaacuuuaauuucag

SEQ ID NO: 647244 - RNA, 23 nt, Homo sapiens
uauccuaaacuuuagacuuccca

SEQ ID NO: 647245 - RNA, 17 nt, Homo sapiens
uauccuccuguucugaa

SEQ ID NO: 647246 - RNA, 15 nt, Homo sapiens
uauccugccucagcc

SEQ ID NO: 647247 - RNA, 22 nt, Homo sapiens
uauccugcgaccuugcaaccuc

SEQ ID NO: 647248 - RNA, 22 nt, Homo sapiens
uauccuggugccccccaccccu

SEQ ID NO: 647249 - RNA, 22 nt, Homo sapiens
uauccuguacauuucacaaaaa

SEQ ID NO: 647250 - RNA, 15 nt, Homo sapiens
uauccugugacuguc

SEQ ID NO: 647251 - RNA, 14 nt, Homo sapiens
uauccuuagcucac

SEQ ID NO: 647252 - RNA, 14 nt, Homo sapiens
uauccuucuacuug

SEQ ID NO: 647253 - RNA, 15 nt, Homo sapiens
uaucgaacacauuca

SEQ ID NO: 647254 - RNA, 13 nt, Homo sapiens
uaucgaucucuua

SEQ ID NO: 647255 - RNA, 22 nt, Homo sapiens
uaucggagacagugaucuccau

SEQ ID NO: 647256 - RNA, 15 nt, Homo sapiens
uaucuacagaacugg

SEQ ID NO: 647257 - RNA, 15 nt, Homo sapiens
uaucuacauaaggau

SEQ ID NO: 647258 - RNA, 20 nt, Homo sapiens
uaucuauagcuaaguacaca

SEQ ID NO: 647259 - RNA, 19 nt, Homo sapiens
uaucuauuaucucaauuua

SEQ ID NO: 647260 - RNA, 23 nt, Homo sapiens
uaucuauuugagauugaugacaa

SEQ ID NO: 647261 - RNA, 20 nt, Homo sapiens
uaucuauuuguacaauuuua

SEQ ID NO: 647262 - RNA, 17 nt, Homo sapiens
uaucucacacaguuuaa

SEQ ID NO: 647263 - RNA, 14 nt, Homo sapiens
uaucucagccauag

SEQ ID NO: 647264 - RNA, 16 nt, Homo sapiens
uaucucaguaccccau

SEQ ID NO: 647265 - RNA, 23 nt, Homo sapiens
uaucucauuuuacacaaagggaa

SEQ ID NO: 647266 - RNA, 21 nt, Homo sapiens
uaucuccagauggaauggggu

SEQ ID NO: 647267 - RNA, 23 nt, Homo sapiens
uaucucggggagaaaugcaacca

SEQ ID NO: 647268 - RNA, 14 nt, Homo sapiens
uaucucugagacag

SEQ ID NO: 647269 - RNA, 16 nt, Homo sapiens
uaucugacaaugcuga

SEQ ID NO: 647270 - RNA, 22 nt, Homo sapiens
uaucugcacucuaaacugcaaa

SEQ ID NO: 647271 - RNA, 16 nt, Homo sapiens
uaucugguuucucuag

SEQ ID NO: 647272 - RNA, 11 nt, Homo sapiens
uaucugucaca

SEQ ID NO: 647273 - RNA, 16 nt, Homo sapiens
uaucugucaucucucu

SEQ ID NO: 647274 - RNA, 11 nt, Homo sapiens
uaucugugaaa

SEQ ID NO: 647275 - RNA, 19 nt, Homo sapiens
uaucugugggaguccucua

SEQ ID NO: 647276 - RNA, 21 nt, Homo sapiens
uaucuguguagacuauuugcu

SEQ ID NO: 647277 - RNA, 15 nt, Homo sapiens
uaucugugucaaaag

SEQ ID NO: 647278 - RNA, 19 nt, Homo sapiens
uaucugugucaaaagccag

SEQ ID NO: 647279 - RNA, 19 nt, Homo sapiens
uaucugugugugauuugcu

SEQ ID NO: 647280 - RNA, 14 nt, Homo sapiens
uaucuguucuugcu

SEQ ID NO: 647281 - RNA, 14 nt, Homo sapiens
uaucuguugccuua

SEQ ID NO: 647282 - RNA, 18 nt, Homo sapiens
uaucuuacuuuccucuga

SEQ ID NO: 647283 - RNA, 20 nt, Homo sapiens
uaucuuaucccuugacaaaa

SEQ ID NO: 647284 - RNA, 13 nt, Homo sapiens
uaucuuccuuugg

SEQ ID NO: 647285 - RNA, 22 nt, Homo sapiens
uaucuugaaacauagagaucua

SEQ ID NO: 647286 - RNA, 17 nt, Homo sapiens
uaucuugcaacuuguua

SEQ ID NO: 647287 - RNA, 16 nt, Homo sapiens
uaucuugcaccccaaa

SEQ ID NO: 647288 - RNA, 22 nt, Homo sapiens
uaucuugcgaauccaagcuccc

SEQ ID NO: 647289 - RNA, 15 nt, Homo sapiens
uaucuuggcuuugcc

SEQ ID NO: 647290 - RNA, 14 nt, Homo sapiens
uaucuugugcuucu

SEQ ID NO: 647291 - RNA, 20 nt, Homo sapiens
uaucuuuaaagccgugcucu

SEQ ID NO: 647292 - RNA, 24 nt, Homo sapiens
uaucuuuaccaaaaaccauguugc

SEQ ID NO: 647293 - RNA, 23 nt, Homo sapiens
uaucuuugagcgcccacuagacc

SEQ ID NO: 647294 - RNA, 20 nt, Homo sapiens
uaucuuugucuguucacuuu

SEQ ID NO: 647295 - RNA, 14 nt, Homo sapiens
uaugaaaagaauuu

SEQ ID NO: 647296 - RNA, 18 nt, Homo sapiens
uaugaaaagaggggacca

SEQ ID NO: 647297 - RNA, 23 nt, Homo sapiens
uaugaaaaggauauuaucuaccu

SEQ ID NO: 647298 - RNA, 18 nt, Homo sapiens
uaugaaaaucuccaucuc

SEQ ID NO: 647299 - RNA, 15 nt, Homo sapiens
uaugaaacauaucau

SEQ ID NO: 647300 - RNA, 15 nt, Homo sapiens
uaugaaacugcacau

SEQ ID NO: 647301 - RNA, 16 nt, Homo sapiens
uaugaaauccuugacu

SEQ ID NO: 647302 - RNA, 19 nt, Homo sapiens
uaugaaauuauaaucugug

SEQ ID NO: 647303 - RNA, 21 nt, Homo sapiens
uaugaacagcugugucugcca

SEQ ID NO: 647304 - RNA, 15 nt, Homo sapiens
uaugaaccuucuuaa

SEQ ID NO: 647305 - RNA, 17 nt, Homo sapiens
uaugaagaaaaaguaca

SEQ ID NO: 647306 - RNA, 19 nt, Homo sapiens
uaugaagagcugucuuccc

SEQ ID NO: 647307 - RNA, 17 nt, Homo sapiens
uaugaaggaaucauucc

SEQ ID NO: 647308 - RNA, 21 nt, Homo sapiens
uaugaaggauuacucuccaua

SEQ ID NO: 647309 - RNA, 20 nt, Homo sapiens
uaugaagugacucucacaag

SEQ ID NO: 647310 - RNA, 21 nt, Homo sapiens
uaugaagugacucucacaaga

SEQ ID NO: 647311 - RNA, 14 nt, Homo sapiens
uaugaauauuacuc

SEQ ID NO: 647312 - RNA, 15 nt, Homo sapiens
uaugaaugaaauucu

SEQ ID NO: 647313 - RNA, 15 nt, Homo sapiens
uaugacccacacugc

SEQ ID NO: 647314 - RNA, 22 nt, Homo sapiens
uaugacuaaagagagaauguag

SEQ ID NO: 647315 - RNA, 18 nt, Homo sapiens
uaugacucagagaaccag

SEQ ID NO: 647316 - RNA, 23 nt, Homo sapiens
uaugacucagagaaccagugcag

SEQ ID NO: 647317 - RNA, 14 nt, Homo sapiens
uaugacugauuacu

SEQ ID NO: 647318 - RNA, 17 nt, Homo sapiens
uaugagaaauuagucac

SEQ ID NO: 647319 - RNA, 22 nt, Homo sapiens
uaugagccgugaacugugcaua

SEQ ID NO: 647320 - RNA, 15 nt, Homo sapiens
uaugaggaccuuuau

SEQ ID NO: 647321 - RNA, 12 nt, Homo sapiens
uaugagggaaaa

SEQ ID NO: 647322 - RNA, 18 nt, Homo sapiens
uaugagggaaaaugagua

SEQ ID NO: 647323 - RNA, 18 nt, Homo sapiens
uaugaguaauacaucaaa

SEQ ID NO: 647324 - RNA, 17 nt, Homo sapiens
uaugaguaguguggaau

SEQ ID NO: 647325 - RNA, 15 nt, Homo sapiens
uucuccucauccauu

SEQ ID NO: 647326 - RNA, 19 nt, Homo sapiens
uucuccucaugcuuagaaa

SEQ ID NO: 647327 - RNA, 12 nt, Homo sapiens
uucuccugaaac

SEQ ID NO: 647328 - RNA, 14 nt, Homo sapiens
uucuccugccucag

SEQ ID NO: 647329 - RNA, 16 nt, Homo sapiens
uucuccugugacccca

SEQ ID NO: 647330 - RNA, 17 nt, Homo sapiens
uucucgaacuccugacc

SEQ ID NO: 647331 - RNA, 14 nt, Homo sapiens
uucucgaacugcau

SEQ ID NO: 647332 - RNA, 16 nt, Homo sapiens
uucucgcauuguagaa

SEQ ID NO: 647333 - RNA, 17 nt, Homo sapiens
uucucuacagacuccaa

SEQ ID NO: 647334 - RNA, 16 nt, Homo sapiens
uucucuauugcugcuc

SEQ ID NO: 647335 - RNA, 15 nt, Homo sapiens
uucucucguaacugg

SEQ ID NO: 647336 - RNA, 22 nt, Homo sapiens
uucucucugacccucuccccac

SEQ ID NO: 647337 - RNA, 17 nt, Homo sapiens
uucucucugaccuuuca

SEQ ID NO: 647338 - RNA, 13 nt, Homo sapiens
uucucucuguaau

SEQ ID NO: 647339 - RNA, 23 nt, Homo sapiens
uucucucugugguggagaaccac

SEQ ID NO: 647340 - RNA, 15 nt, Homo sapiens
uucucucuucucuca

SEQ ID NO: 647341 - RNA, 17 nt, Homo sapiens
uucucugaggacacaga

SEQ ID NO: 647342 - RNA, 15 nt, Homo sapiens
uucucugccagugac

SEQ ID NO: 647343 - RNA, 19 nt, Homo sapiens
uucucugccgcuaccuccc

SEQ ID NO: 647344 - RNA, 18 nt, Homo sapiens
uucucugcuugccuagcc

SEQ ID NO: 647345 - RNA, 17 nt, Homo sapiens
uucucuggaaccugacu

SEQ ID NO: 647346 - RNA, 19 nt, Homo sapiens
uucucuggcgacaguuuuc

SEQ ID NO: 647347 - RNA, 14 nt, Homo sapiens
uucucugguaauau

SEQ ID NO: 647348 - RNA, 12 nt, Homo sapiens
uucucugugaag

SEQ ID NO: 647349 - RNA, 14 nt, Homo sapiens
uucucuguugucaa

SEQ ID NO: 647350 - RNA, 21 nt, Homo sapiens
uucucuuaaguggucuaguca

SEQ ID NO: 647351 - RNA, 19 nt, Homo sapiens
ucaauaaaagagcugucug

SEQ ID NO: 647352 - RNA, 22 nt, Homo sapiens
ucaauaaacaacagcugaagca

SEQ ID NO: 647353 - RNA, 14 nt, Homo sapiens
ucaauaaagcacug

SEQ ID NO: 647354 - RNA, 18 nt, Homo sapiens
ucaauaccuguacuauga

SEQ ID NO: 647355 - RNA, 20 nt, Homo sapiens
ucaauacuauggaguaccau

SEQ ID NO: 647356 - RNA, 21 nt, Homo sapiens
ucaauacuuaaaaauagucuu

SEQ ID NO: 647357 - RNA, 16 nt, Homo sapiens
ucaauacuuaccuaau

SEQ ID NO: 647358 - RNA, 15 nt, Homo sapiens
ucaauagaucuccag

SEQ ID NO: 647359 - RNA, 12 nt, Homo sapiens
ucaauagucuaa

SEQ ID NO: 647360 - RNA, 24 nt, Homo sapiens
ucaauauacauaauacaugauugc

SEQ ID NO: 647361 - RNA, 14 nt, Homo sapiens
ucaauaugugaaag

SEQ ID NO: 647362 - RNA, 16 nt, Homo sapiens
ucaaucaacuuuacug

SEQ ID NO: 647363 - RNA, 16 nt, Homo sapiens
ucaaucacagucucag

SEQ ID NO: 647364 - RNA, 16 nt, Homo sapiens
ucaaucagugcaguga

SEQ ID NO: 647365 - RNA, 16 nt, Homo sapiens
ucaauccgaaguauga

SEQ ID NO: 647366 - RNA, 14 nt, Homo sapiens
ucaauccugucaua

SEQ ID NO: 647367 - RNA, 17 nt, Homo sapiens
ucaauccugucauauaa

SEQ ID NO: 647368 - RNA, 23 nt, Homo sapiens
ucaaucuaaggccuucccuguca

SEQ ID NO: 647369 - RNA, 21 nt, Homo sapiens
ucaaucuuuggaggcuuuuaa

SEQ ID NO: 647370 - RNA, 24 nt, Homo sapiens
ucaaugaagccagcucacagugcu

SEQ ID NO: 647371 - RNA, 12 nt, Homo sapiens
ucaaugaccugu

SEQ ID NO: 647372 - RNA, 13 nt, Homo sapiens
ucaaugaccugua

SEQ ID NO: 647373 - RNA, 22 nt, Homo sapiens
ucaauggagcaugugugcaaaa

SEQ ID NO: 647374 - RNA, 22 nt, Homo sapiens
ucaauggcuuguucaucaucca

SEQ ID NO: 647375 - RNA, 16 nt, Homo sapiens
ucaauguccagugagu

SEQ ID NO: 647376 - RNA, 22 nt, Homo sapiens
ucaauguguuggaaacuguaaa

SEQ ID NO: 647377 - RNA, 17 nt, Homo sapiens
ucaauguucauuguaau

SEQ ID NO: 647378 - RNA, 23 nt, Homo sapiens
ucaauguuuacuuuuuugguacu

SEQ ID NO: 647379 - RNA, 23 nt, Homo sapiens
ucaauguuuguaauaauugcuca

SEQ ID NO: 647380 - RNA, 19 nt, Homo sapiens
ucaauuauacuaaaccuca

SEQ ID NO: 647381 - RNA, 15 nt, Homo sapiens
ucaauucaguucuag

SEQ ID NO: 647382 - RNA, 22 nt, Homo sapiens
ucaauucccacguagacucuua

SEQ ID NO: 647383 - RNA, 22 nt, Homo sapiens
ucaauucuuuguauaugcauuc

SEQ ID NO: 647384 - RNA, 18 nt, Homo sapiens
ucaauuuauuacugaaaa

SEQ ID NO: 647385 - RNA, 17 nt, Homo sapiens
ucaauuuccugaugcau

SEQ ID NO: 647386 - RNA, 17 nt, Homo sapiens
ucaauuuuaaacauauc

SEQ ID NO: 647387 - RNA, 15 nt, Homo sapiens
ucaauuuugacuuaa

SEQ ID NO: 647388 - RNA, 13 nt, Homo sapiens
ucacaaacaguug

SEQ ID NO: 647389 - RNA, 13 nt, Homo sapiens
ucacaaagaucau

SEQ ID NO: 647390 - RNA, 16 nt, Homo sapiens
ucacaaaggcugaugu

SEQ ID NO: 647391 - RNA, 13 nt, Homo sapiens
ucacaacagugaa

SEQ ID NO: 647392 - RNA, 20 nt, Homo sapiens
ucacaacauuuacuuaacag

SEQ ID NO: 647393 - RNA, 18 nt, Homo sapiens
ucacaaccucaccaaacu

SEQ ID NO: 647394 - RNA, 19 nt, Homo sapiens
ucacaaccucaccaaacua

SEQ ID NO: 647395 - RNA, 15 nt, Homo sapiens
ucacaagauggaauu

SEQ ID NO: 647396 - RNA, 11 nt, Homo sapiens
ucacaagcaau

SEQ ID NO: 647397 - RNA, 15 nt, Homo sapiens
ucacaagcaauccau

SEQ ID NO: 647398 - RNA, 12 nt, Homo sapiens
ucacaagcuauu

SEQ ID NO: 647399 - RNA, 18 nt, Homo sapiens
ucacaaggcauucaagug

SEQ ID NO: 647400 - RNA, 13 nt, Homo sapiens
ucacaaggucaag

SEQ ID NO: 647401 - RNA, 21 nt, Homo sapiens
ucacaauaaauggccagugcu

SEQ ID NO: 647402 - RNA, 20 nt, Homo sapiens
ucacaauaccucaugcuuca

SEQ ID NO: 647403 - RNA, 15 nt, Homo sapiens
ucacaaugagauuga

SEQ ID NO: 647404 - RNA, 24 nt, Homo sapiens
ucacaaugucccuucagcaccuga

SEQ ID NO: 647405 - RNA, 15 nt, Homo sapiens
ucacacacacagcug

SEQ ID NO: 647406 - RNA, 21 nt, Homo sapiens
ucacacacacagcugggcaaa

SEQ ID NO: 647407 - RNA, 23 nt, Homo sapiens
ucacacacacccccccacaagga

SEQ ID NO: 647408 - RNA, 13 nt, Homo sapiens
ucacacacuggac

SEQ ID NO: 647409 - RNA, 12 nt, Homo sapiens
ucacacagugaa

SEQ ID NO: 647410 - RNA, 16 nt, Homo sapiens
ucacacauuacaaagu

SEQ ID NO: 647411 - RNA, 14 nt, Homo sapiens
ucacaccaacagug

SEQ ID NO: 647412 - RNA, 15 nt, Homo sapiens
ucacaccaguccaaa

SEQ ID NO: 647413 - RNA, 16 nt, Homo sapiens
ucacacuaugugcaaa

SEQ ID NO: 647414 - RNA, 17 nt, Homo sapiens
ucacacuaugugcaaaa

SEQ ID NO: 647415 - RNA, 19 nt, Homo sapiens
ucacacucaaggacaggag

SEQ ID NO: 647416 - RNA, 22 nt, Homo sapiens
ucacacuccccuagggggagaa

SEQ ID NO: 647417 - RNA, 17 nt, Homo sapiens
ucacagaauagcacaaa

SEQ ID NO: 647418 - RNA, 19 nt, Homo sapiens
ucacagaauuuaagcaaga

SEQ ID NO: 647419 - RNA, 22 nt, Homo sapiens
ucacagacacugcacagaccuu

SEQ ID NO: 647420 - RNA, 19 nt, Homo sapiens
ucacagagacccaccuuca

SEQ ID NO: 647421 - RNA, 17 nt, Homo sapiens
ucacagaguagaaacuc

SEQ ID NO: 647422 - RNA, 21 nt, Homo sapiens
ucacagccacaccuggacuga

SEQ ID NO: 647423 - RNA, 23 nt, Homo sapiens
ucacagcccagcccgcccacugg

SEQ ID NO: 647424 - RNA, 17 nt, Homo sapiens
ucacagcccugagaguc

SEQ ID NO: 647425 - RNA, 14 nt, Homo sapiens
ucacagcguuucag

SEQ ID NO: 647426 - RNA, 21 nt, Homo sapiens
ucacagcuggacccugcuuca

SEQ ID NO: 647427 - RNA, 20 nt, Homo sapiens
ucacaggaaucugauugcau

SEQ ID NO: 647428 - RNA, 14 nt, Homo sapiens
ucacaggacauuaa

SEQ ID NO: 647429 - RNA, 22 nt, Homo sapiens
ucacaggacauuaaggaccaau

SEQ ID NO: 647430 - RNA, 19 nt, Homo sapiens
ucacaggacucugccuccu

SEQ ID NO: 647431 - RNA, 16 nt, Homo sapiens
ucacagggacugaaaa

SEQ ID NO: 647432 - RNA, 12 nt, Homo sapiens
ucacagggccaa

SEQ ID NO: 647433 - RNA, 15 nt, Homo sapiens
ucacagguugaccaa

SEQ ID NO: 647434 - RNA, 19 nt, Homo sapiens
ucacaguaaugcaagcaaa

SEQ ID NO: 647435 - RNA, 21 nt, Homo sapiens
ucacaguguuuuuauugcucg

SEQ ID NO: 647436 - RNA, 22 nt, Homo sapiens
ucacauaaaaaagaagcacuuu

SEQ ID NO: 647437 - RNA, 21 nt, Homo sapiens
ucacauaagcucagaauccaa

SEQ ID NO: 647438 - RNA, 21 nt, Homo sapiens
ucacauacccacacauuccag

SEQ ID NO: 647439 - RNA, 14 nt, Homo sapiens
ucacauaggcaaag

SEQ ID NO: 647440 - RNA, 22 nt, Homo sapiens
ucacauauucauauuguucaau

SEQ ID NO: 647441 - RNA, 14 nt, Homo sapiens
ucacaucuguccag

SEQ ID NO: 647442 - RNA, 16 nt, Homo sapiens
ucacaugaugcacuuc

SEQ ID NO: 647443 - RNA, 12 nt, Homo sapiens
ucacaugcacag

SEQ ID NO: 647444 - RNA, 20 nt, Homo sapiens
ucacaugggcagaaaaaugg

SEQ ID NO: 647445 - RNA, 17 nt, Homo sapiens
ucacaugucaguaccuu

SEQ ID NO: 647446 - RNA, 18 nt, Homo sapiens
ucacauuaauauuugcug

SEQ ID NO: 647447 - RNA, 16 nt, Homo sapiens
ucacauuaucaucuga

SEQ ID NO: 647448 - RNA, 14 nt, Homo sapiens
ucacauucccaugg

SEQ ID NO: 647449 - RNA, 23 nt, Homo sapiens
ucacauucuauuuuggguauuaa

SEQ ID NO: 647450 - RNA, 23 nt, Homo sapiens
ucacauuggcuauuuaaagacaa

SEQ ID NO: 647451 - RNA, 21 nt, Homo sapiens
ucacauuuuaagugcuucaca

SEQ ID NO: 647452 - RNA, 17 nt, Homo sapiens
ucacauuuuuacaaaua

SEQ ID NO: 647453 - RNA, 22 nt, Homo sapiens
ucaccaaaauagucuucucaaa

SEQ ID NO: 647454 - RNA, 17 nt, Homo sapiens
ucaccaaacacaagaaa

SEQ ID NO: 647455 - RNA, 20 nt, Homo sapiens
ucaccaaaguauuaauguac

SEQ ID NO: 647456 - RNA, 14 nt, Homo sapiens
uuguagaugugauu

SEQ ID NO: 647457 - RNA, 13 nt, Homo sapiens
uuguagcacugag

SEQ ID NO: 647458 - RNA, 21 nt, Homo sapiens
uuguaggagaaacucccaugu

SEQ ID NO: 647459 - RNA, 16 nt, Homo sapiens
uuguagugugugcuua

SEQ ID NO: 647460 - RNA, 20 nt, Homo sapiens
uuguaguuuuggcuaguccu

SEQ ID NO: 647461 - RNA, 20 nt, Homo sapiens
uuguauaaauuuauuuacug

SEQ ID NO: 647462 - RNA, 13 nt, Homo sapiens
uuguauaacccau

SEQ ID NO: 647463 - RNA, 11 nt, Homo sapiens
uuguauacaca

SEQ ID NO: 647464 - RNA, 14 nt, Homo sapiens
uuguauaggccauc

SEQ ID NO: 647465 - RNA, 23 nt, Homo sapiens
uuguauaguguugauuugugcug

SEQ ID NO: 647466 - RNA, 22 nt, Homo sapiens
uuguauauauggaucagaggag

SEQ ID NO: 647467 - RNA, 16 nt, Homo sapiens
uuguauauuauggaag

SEQ ID NO: 647468 - RNA, 21 nt, Homo sapiens
uuguauauuccaccauucaca

SEQ ID NO: 647469 - RNA, 17 nt, Homo sapiens
uuguaucaaagugugau

SEQ ID NO: 647470 - RNA, 19 nt, Homo sapiens
uuguaucaacacuguuacu

SEQ ID NO: 647471 - RNA, 23 nt, Homo sapiens
uuguaucucauacugucugggau

SEQ ID NO: 647472 - RNA, 16 nt, Homo sapiens
ucaccauauugcccag

SEQ ID NO: 647473 - RNA, 13 nt, Homo sapiens
ucaccaugaucac

SEQ ID NO: 647474 - RNA, 23 nt, Homo sapiens
ucaccaugcugaauguacacuga

SEQ ID NO: 647475 - RNA, 17 nt, Homo sapiens
ucaccauguuagccuua

SEQ ID NO: 647476 - RNA, 13 nt, Homo sapiens
ucaccauguugcc

SEQ ID NO: 647477 - RNA, 20 nt, Homo sapiens
ucaccauugugaagcaccua

SEQ ID NO: 647478 - RNA, 13 nt, Homo sapiens
ucacccaaccuga

SEQ ID NO: 647479 - RNA, 14 nt, Homo sapiens
ucacccacaucuaa

SEQ ID NO: 647480 - RNA, 19 nt, Homo sapiens
ucacccaccucuugugcaa

SEQ ID NO: 647481 - RNA, 22 nt, Homo sapiens
ucacccacucugguggccacuu

SEQ ID NO: 647482 - RNA, 21 nt, Homo sapiens
ucacccagcuaaucuguaggg

SEQ ID NO: 647483 - RNA, 14 nt, Homo sapiens
ucacccaggaggau

SEQ ID NO: 647484 - RNA, 18 nt, Homo sapiens
ucacccaggcaaucuugc

SEQ ID NO: 647485 - RNA, 17 nt, Homo sapiens
ucaccccacagacacuu

SEQ ID NO: 647486 - RNA, 14 nt, Homo sapiens
ucacccccugagau

SEQ ID NO: 647487 - RNA, 18 nt, Homo sapiens
ucaccccuacacugugaa

SEQ ID NO: 647488 - RNA, 13 nt, Homo sapiens
ucaccccugacau

SEQ ID NO: 647489 - RNA, 14 nt, Homo sapiens
ucacccuaccugug

SEQ ID NO: 647490 - RNA, 20 nt, Homo sapiens
ucacccuccacaaagcaaag

SEQ ID NO: 647491 - RNA, 21 nt, Homo sapiens
ucacccucuccagcaagagaa

SEQ ID NO: 647492 - RNA, 19 nt, Homo sapiens
ucacccucuuccugugauc

SEQ ID NO: 647493 - RNA, 13 nt, Homo sapiens
ucacccugccuua

SEQ ID NO: 647494 - RNA, 18 nt, Homo sapiens
ucacccuggauaggcaag

SEQ ID NO: 647495 - RNA, 16 nt, Homo sapiens
ucacccugugggaccg

SEQ ID NO: 647496 - RNA, 14 nt, Homo sapiens
ucacccuuugccua

SEQ ID NO: 647497 - RNA, 22 nt, Homo sapiens
ucaccggagcuuucaaagaagg

SEQ ID NO: 647498 - RNA, 18 nt, Homo sapiens
ucaccggucagugccuuu

SEQ ID NO: 647499 - RNA, 23 nt, Homo sapiens
ucaccgugccugaucugcacauu

SEQ ID NO: 647500 - RNA, 14 nt, Homo sapiens
ucaccuaacuagag

SEQ ID NO: 647501 - RNA, 21 nt, Homo sapiens
ucaccuaagucucugugaauu

SEQ ID NO: 647502 - RNA, 16 nt, Homo sapiens
ucaccuacauuaucuc

SEQ ID NO: 647503 - RNA, 17 nt, Homo sapiens
ucaccuacauuaucuca

SEQ ID NO: 647504 - RNA, 20 nt, Homo sapiens
ucaccuagcagccucaaaac

SEQ ID NO: 647505 - RNA, 23 nt, Homo sapiens
ucaccuauguuauuuuguguaca

SEQ ID NO: 647506 - RNA, 16 nt, Homo sapiens
ucaccucagcugauau

SEQ ID NO: 647507 - RNA, 17 nt, Homo sapiens
ucaccucccgaagccac

SEQ ID NO: 647508 - RNA, 21 nt, Homo sapiens
ucaccucuacccaaacccuag

SEQ ID NO: 647509 - RNA, 14 nt, Homo sapiens
ucaccucucaaggu

SEQ ID NO: 647510 - RNA, 21 nt, Homo sapiens
ucaccucucccuccaccuccu

SEQ ID NO: 647511 - RNA, 14 nt, Homo sapiens
ucaccucucuucag

SEQ ID NO: 647512 - RNA, 14 nt, Homo sapiens
ucaccucuugccuu

SEQ ID NO: 647513 - RNA, 16 nt, Homo sapiens
ucaccugaaacacugg

SEQ ID NO: 647514 - RNA, 17 nt, Homo sapiens
ucaccugcccugcugag

SEQ ID NO: 647515 - RNA, 17 nt, Homo sapiens
ucaccuggcacauucau

SEQ ID NO: 647516 - RNA, 23 nt, Homo sapiens
ucaccugggagggugggaccaau

SEQ ID NO: 647517 - RNA, 16 nt, Homo sapiens
ucaccuguaaaccuga

SEQ ID NO: 647518 - RNA, 13 nt, Homo sapiens
ucaccuuacaggg

SEQ ID NO: 647519 - RNA, 14 nt, Homo sapiens
ucaccuuaucugga

SEQ ID NO: 647520 - RNA, 17 nt, Homo sapiens
ucaccuuuguaagacau

SEQ ID NO: 647521 - RNA, 20 nt, Homo sapiens
ucaccuuuuugacuuuucca

SEQ ID NO: 647522 - RNA, 15 nt, Homo sapiens
ucacgaacuguucac

SEQ ID NO: 647523 - RNA, 22 nt, Homo sapiens
ucacgacucuaccauguccaau

SEQ ID NO: 647524 - RNA, 18 nt, Homo sapiens
ucacgcaugugugcugca

SEQ ID NO: 647525 - RNA, 14 nt, Homo sapiens
ucacgccuacuuaa

SEQ ID NO: 647526 - RNA, 20 nt, Homo sapiens
ucacgucacguuggucuuga

SEQ ID NO: 647527 - RNA, 14 nt, Homo sapiens
ucacgucucucuuc

SEQ ID NO: 647528 - RNA, 17 nt, Homo sapiens
ucacguuuccuuuucau

SEQ ID NO: 647529 - RNA, 20 nt, Homo sapiens
ucacuaaaaaggaaacuuca

SEQ ID NO: 647530 - RNA, 14 nt, Homo sapiens
ucacuaaacaagaa

SEQ ID NO: 647531 - RNA, 23 nt, Homo sapiens
ucacuaaagcaguagaaauaaua

SEQ ID NO: 647532 - RNA, 19 nt, Homo sapiens
ucacuaaaguauaucuuua

SEQ ID NO: 647533 - RNA, 21 nt, Homo sapiens
ucacuaagcuguggcuggaau

SEQ ID NO: 647534 - RNA, 19 nt, Homo sapiens
ucacuaccaagcagcucac

SEQ ID NO: 647535 - RNA, 18 nt, Homo sapiens
ucacuacugaacacaugu

SEQ ID NO: 647536 - RNA, 15 nt, Homo sapiens
ucacuaugguaugcu

SEQ ID NO: 647537 - RNA, 21 nt, Homo sapiens
ucacuauucuuaagcacuuug

SEQ ID NO: 647538 - RNA, 22 nt, Homo sapiens
ucacucaagaguucagugcuca

SEQ ID NO: 647539 - RNA, 15 nt, Homo sapiens
ucacucaauuucucu

SEQ ID NO: 647540 - RNA, 20 nt, Homo sapiens
ucacucauuccuucacucau

SEQ ID NO: 647541 - RNA, 19 nt, Homo sapiens
ucacuccacaacccaagaa

SEQ ID NO: 647542 - RNA, 19 nt, Homo sapiens
ucacuccccacaucccauc

SEQ ID NO: 647543 - RNA, 18 nt, Homo sapiens
ucacuccucucuagggca

SEQ ID NO: 647544 - RNA, 19 nt, Homo sapiens
ucacucgcaggaccaaggg

SEQ ID NO: 647545 - RNA, 16 nt, Homo sapiens
ucacucucaaacuuca

SEQ ID NO: 647546 - RNA, 19 nt, Homo sapiens
ucacucucaaacuucacua

SEQ ID NO: 647547 - RNA, 18 nt, Homo sapiens
ucacucuuccugcaagga

SEQ ID NO: 647548 - RNA, 23 nt, Homo sapiens
ucacucuuugaagcgagcaguca

SEQ ID NO: 647549 - RNA, 13 nt, Homo sapiens
ucacugaacucca

SEQ ID NO: 647550 - RNA, 17 nt, Homo sapiens
ucacugacucaagacac

SEQ ID NO: 647551 - RNA, 18 nt, Homo sapiens
ucacugacucugacucau

SEQ ID NO: 647552 - RNA, 9 nt, Homo sapiens
ucacugaga

SEQ ID NO: 647553 - RNA, 13 nt, Homo sapiens
ucacugagaccaa

SEQ ID NO: 647554 - RNA, 15 nt, Homo sapiens
ucacugagagcugcc

SEQ ID NO: 647555 - RNA, 16 nt, Homo sapiens
ucacugagagcugccu

SEQ ID NO: 647556 - RNA, 19 nt, Homo sapiens
ucacugagcuccccagauc

SEQ ID NO: 647557 - RNA, 18 nt, Homo sapiens
ucacugaugcagaaagac

SEQ ID NO: 647558 - RNA, 23 nt, Homo sapiens
ucacugauucucuacaugcucuu

SEQ ID NO: 647559 - RNA, 14 nt, Homo sapiens
ucacugcaaccucu

SEQ ID NO: 647560 - RNA, 18 nt, Homo sapiens
ucacugcaacuucugccu

SEQ ID NO: 647561 - RNA, 13 nt, Homo sapiens
ucacugcacucca

SEQ ID NO: 647562 - RNA, 16 nt, Homo sapiens
ucacugcagccuccac

SEQ ID NO: 647563 - RNA, 21 nt, Homo sapiens
ucacugcagcgcgcuccugac

SEQ ID NO: 647564 - RNA, 18 nt, Homo sapiens
ucacugcauccucugccu

SEQ ID NO: 647565 - RNA, 12 nt, Homo sapiens
ucacugccaacg

SEQ ID NO: 647566 - RNA, 17 nt, Homo sapiens
ucacugcccccagcucu

SEQ ID NO: 647567 - RNA, 15 nt, Homo sapiens
ucacugcugaucgua

SEQ ID NO: 647568 - RNA, 21 nt, Homo sapiens
ucacugcugcaaauacuguau

SEQ ID NO: 647569 - RNA, 17 nt, Homo sapiens
ucacugcuuguugacau

SEQ ID NO: 647570 - RNA, 17 nt, Homo sapiens
ucacuggaccacugggc

SEQ ID NO: 647571 - RNA, 21 nt, Homo sapiens
ucacuggagguugaagccaag

SEQ ID NO: 647572 - RNA, 13 nt, Homo sapiens
ucacuggaugaaa

SEQ ID NO: 647573 - RNA, 21 nt, Homo sapiens
ucacuggccacaguuguuuga

SEQ ID NO: 647574 - RNA, 16 nt, Homo sapiens
ucacuggcuggccuga

SEQ ID NO: 647575 - RNA, 18 nt, Homo sapiens
ucacuggggaugguggca

SEQ ID NO: 647576 - RNA, 15 nt, Homo sapiens
ucacugucccucaaa

SEQ ID NO: 647577 - RNA, 18 nt, Homo sapiens
ucacuguguuagccagga

SEQ ID NO: 647578 - RNA, 22 nt, Homo sapiens
ucacuuaaacuugcaucacuua

SEQ ID NO: 647579 - RNA, 14 nt, Homo sapiens
ucacuuaagccugg

SEQ ID NO: 647580 - RNA, 16 nt, Homo sapiens
uuguuuguacaguaau

SEQ ID NO: 647581 - RNA, 23 nt, Homo sapiens
uuguuugucaauauaagcucaau

SEQ ID NO: 647582 - RNA, 15 nt, Homo sapiens
uuguuugucuuccau

SEQ ID NO: 647583 - RNA, 19 nt, Homo sapiens
uuguuugugacccugagaa

SEQ ID NO: 647584 - RNA, 21 nt, Homo sapiens
uuguuuuaugcucagggucaa

SEQ ID NO: 647585 - RNA, 22 nt, Homo sapiens
uuguuuucagcacugauggaaa

SEQ ID NO: 647586 - RNA, 22 nt, Homo sapiens
uuguuuuggggacagacuuuua

SEQ ID NO: 647587 - RNA, 15 nt, Homo sapiens
uuguuuuugcaugaa

SEQ ID NO: 647588 - RNA, 17 nt, Homo sapiens
uuguuuuuuucuccauc

SEQ ID NO: 647589 - RNA, 23 nt, Homo sapiens
uuuaaaaaaaaaaaaaaagccaa

SEQ ID NO: 647590 - RNA, 15 nt, Homo sapiens
uuuaaaaaacuaaaa

SEQ ID NO: 647591 - RNA, 14 nt, Homo sapiens
uuuaaaaaagcaaa

SEQ ID NO: 647592 - RNA, 19 nt, Homo sapiens
uuuaaaaaauucuuguauu

SEQ ID NO: 647593 - RNA, 19 nt, Homo sapiens
uuuaaaaagcuaguucuau

SEQ ID NO: 647594 - RNA, 15 nt, Homo sapiens
ucagaaaagugacag

SEQ ID NO: 647595 - RNA, 22 nt, Homo sapiens
ucagaaaauguucuguuugcug

SEQ ID NO: 647596 - RNA, 22 nt, Homo sapiens
ucagaaacaaugacauccagaa

SEQ ID NO: 647597 - RNA, 12 nt, Homo sapiens
ucagaaaccaaa

SEQ ID NO: 647598 - RNA, 19 nt, Homo sapiens
ucagaaacuagaaauguga

SEQ ID NO: 647599 - RNA, 12 nt, Homo sapiens
ucagaaagggau

SEQ ID NO: 647600 - RNA, 21 nt, Homo sapiens
ucagaaaguaacaaucuaugg

SEQ ID NO: 647601 - RNA, 18 nt, Homo sapiens
ucagaaauguaguuugca

SEQ ID NO: 647602 - RNA, 17 nt, Homo sapiens
ucagaaauguguuauca

SEQ ID NO: 647603 - RNA, 12 nt, Homo sapiens
ucagaacagccu

SEQ ID NO: 647604 - RNA, 19 nt, Homo sapiens
ucagaacauguuaagauaa

SEQ ID NO: 647605 - RNA, 16 nt, Homo sapiens
ucagaacccacaguga

SEQ ID NO: 647606 - RNA, 13 nt, Homo sapiens
ucagaacuaacca

SEQ ID NO: 647607 - RNA, 13 nt, Homo sapiens
ucagaacugcccu

SEQ ID NO: 647608 - RNA, 22 nt, Homo sapiens
ucagaacuucugccucuaagcu

SEQ ID NO: 647609 - RNA, 15 nt, Homo sapiens
ucagaagacacugca

SEQ ID NO: 647610 - RNA, 17 nt, Homo sapiens
ucagaagcuuggcauga

SEQ ID NO: 647611 - RNA, 18 nt, Homo sapiens
ucagaagucaucuugcua

SEQ ID NO: 647612 - RNA, 17 nt, Homo sapiens
ucagaauaaaagaugau

SEQ ID NO: 647613 - RNA, 22 nt, Homo sapiens
ucagaauagcuguuuuguguau

SEQ ID NO: 647614 - RNA, 15 nt, Homo sapiens
ucagaauccaaguga

SEQ ID NO: 647615 - RNA, 17 nt, Homo sapiens
ucagaauccacucuucu

SEQ ID NO: 647616 - RNA, 21 nt, Homo sapiens
ucagaauuaagcagaacacug

SEQ ID NO: 647617 - RNA, 19 nt, Homo sapiens
ucagaauucuucauccuaa

SEQ ID NO: 647618 - RNA, 19 nt, Homo sapiens
ucagaauuucuuugucauu

SEQ ID NO: 647619 - RNA, 15 nt, Homo sapiens
ucagacagaacuuga

SEQ ID NO: 647620 - RNA, 19 nt, Homo sapiens
ucagacagggucugaagga

SEQ ID NO: 647621 - RNA, 20 nt, Homo sapiens
ucagacaucagucaauggaa

SEQ ID NO: 647622 - RNA, 14 nt, Homo sapiens
ucagacaucuccag

SEQ ID NO: 647623 - RNA, 22 nt, Homo sapiens
ucagacaucuccagugugccag

SEQ ID NO: 647624 - RNA, 22 nt, Homo sapiens
ucagaccaagcagcaggaauuc

SEQ ID NO: 647625 - RNA, 17 nt, Homo sapiens
ucagaccaguacuggga

SEQ ID NO: 647626 - RNA, 15 nt, Homo sapiens
ucagacccaacagca

SEQ ID NO: 647627 - RNA, 16 nt, Homo sapiens
ucagacccacaacgaa

SEQ ID NO: 647628 - RNA, 16 nt, Homo sapiens
ucagacuaaugauagu

SEQ ID NO: 647629 - RNA, 19 nt, Homo sapiens
ucagacuccugugcaacuu

SEQ ID NO: 647630 - RNA, 15 nt, Homo sapiens
ucagacugucagaaa

SEQ ID NO: 647631 - RNA, 11 nt, Homo sapiens
ucagacuguua

SEQ ID NO: 647632 - RNA, 23 nt, Homo sapiens
ucagacuuggaguaaaacuguau

SEQ ID NO: 647633 - RNA, 21 nt, Homo sapiens
ucagacuuuguguucauuuca

SEQ ID NO: 647634 - RNA, 17 nt, Homo sapiens
ucagagaaccagugcag

SEQ ID NO: 647635 - RNA, 13 nt, Homo sapiens
ucagagacagaua

SEQ ID NO: 647636 - RNA, 13 nt, Homo sapiens
ucagagaccagca

SEQ ID NO: 647637 - RNA, 16 nt, Homo sapiens
ucagagaccugaagug

SEQ ID NO: 647638 - RNA, 17 nt, Homo sapiens
ucagagcacucauuccu

SEQ ID NO: 647639 - RNA, 19 nt, Homo sapiens
ucagagcaugauacaaauu

SEQ ID NO: 647640 - RNA, 14 nt, Homo sapiens
ucagagcauuucaa

SEQ ID NO: 647641 - RNA, 15 nt, Homo sapiens
ucagagccagugaag

SEQ ID NO: 647642 - RNA, 15 nt, Homo sapiens
ucagagcuaauaagu

SEQ ID NO: 647643 - RNA, 23 nt, Homo sapiens
ucagaggccugcugccagugcag

SEQ ID NO: 647644 - RNA, 23 nt, Homo sapiens
ucagaggucuaauuuaguagaaa

SEQ ID NO: 647645 - RNA, 17 nt, Homo sapiens
ucagaggucucugcuag

SEQ ID NO: 647646 - RNA, 14 nt, Homo sapiens
ucagaguccuugca

SEQ ID NO: 647647 - RNA, 20 nt, Homo sapiens
ucagagucucugauacacag

SEQ ID NO: 647648 - RNA, 12 nt, Homo sapiens
ucagaguggcuc

SEQ ID NO: 647649 - RNA, 21 nt, Homo sapiens
ucagaguugcugcaaaccuga

SEQ ID NO: 647650 - RNA, 22 nt, Homo sapiens
ucagauaaagcacccuguauca

SEQ ID NO: 647651 - RNA, 22 nt, Homo sapiens
ucagauacccaguggaauucca

SEQ ID NO: 647652 - RNA, 16 nt, Homo sapiens
ucagauagaucugugu

SEQ ID NO: 647653 - RNA, 17 nt, Homo sapiens
ucagaucucuaacuuca

SEQ ID NO: 647654 - RNA, 17 nt, Homo sapiens
ucagaucugaacacagu

SEQ ID NO: 647655 - RNA, 16 nt, Homo sapiens
ucagaugacucucucc

SEQ ID NO: 647656 - RNA, 16 nt, Homo sapiens
ucagaugaucucucca

SEQ ID NO: 647657 - RNA, 20 nt, Homo sapiens
ucagaugauucuaugucuca

SEQ ID NO: 647658 - RNA, 18 nt, Homo sapiens
ucagauggagguucucag

SEQ ID NO: 647659 - RNA, 19 nt, Homo sapiens
ucagaugggaaaucugccu

SEQ ID NO: 647660 - RNA, 14 nt, Homo sapiens
ucagauguaaauag

SEQ ID NO: 647661 - RNA, 13 nt, Homo sapiens
ucagauguauuaa

SEQ ID NO: 647662 - RNA, 15 nt, Homo sapiens
ucagauuccaccuag

SEQ ID NO: 647663 - RNA, 23 nt, Homo sapiens
ucagauuguggaauguuggauaa

SEQ ID NO: 647664 - RNA, 20 nt, Homo sapiens
ucagauuguuaucuaucaac

SEQ ID NO: 647665 - RNA, 22 nt, Homo sapiens
ucagauuguuaucuaucaacua

SEQ ID NO: 647666 - RNA, 17 nt, Homo sapiens
ucagauuuccauugugu

SEQ ID NO: 647667 - RNA, 18 nt, Homo sapiens
ucagauuugccauucaag

SEQ ID NO: 647668 - RNA, 18 nt, Homo sapiens
ucagcaaaaugguccugu

SEQ ID NO: 647669 - RNA, 13 nt, Homo sapiens
ucagcaaaccauu

SEQ ID NO: 647670 - RNA, 18 nt, Homo sapiens
ucagcaaacuaaccagca

SEQ ID NO: 647671 - RNA, 17 nt, Homo sapiens
ucagcaagaauuugauc

SEQ ID NO: 647672 - RNA, 20 nt, Homo sapiens
ucagcaagcccuacagagcu

SEQ ID NO: 647673 - RNA, 18 nt, Homo sapiens
ucagcaauacucaucaga

SEQ ID NO: 647674 - RNA, 21 nt, Homo sapiens
ucagcaauugucuacauucag

SEQ ID NO: 647675 - RNA, 15 nt, Homo sapiens
ucagcacacacuuac

SEQ ID NO: 647676 - RNA, 19 nt, Homo sapiens
ucagcacauucgggaccaa

SEQ ID NO: 647677 - RNA, 22 nt, Homo sapiens
ucagcaccuacaguguacaguc

SEQ ID NO: 647678 - RNA, 23 nt, Homo sapiens
ucagcacugauggaaaauaccag

SEQ ID NO: 647679 - RNA, 21 nt, Homo sapiens
ucagcaguucagcuccuucca

SEQ ID NO: 647680 - RNA, 12 nt, Homo sapiens
ucagcaugacaa

SEQ ID NO: 647681 - RNA, 23 nt, Homo sapiens
ucagcauuuucuucucugcacuu

SEQ ID NO: 647682 - RNA, 14 nt, Homo sapiens
ucagccacauucua

SEQ ID NO: 647683 - RNA, 22 nt, Homo sapiens
ucagccacuugccugugcuaca

SEQ ID NO: 647684 - RNA, 14 nt, Homo sapiens
ucagccagcaagag

SEQ ID NO: 647685 - RNA, 21 nt, Homo sapiens
ucagccagcaagagggaacaa

SEQ ID NO: 647686 - RNA, 18 nt, Homo sapiens
ucagcccccaccagggga

SEQ ID NO: 647687 - RNA, 21 nt, Homo sapiens
ucagccccugaucucugaccu

SEQ ID NO: 647688 - RNA, 20 nt, Homo sapiens
ucagccccugggaacaggcc

SEQ ID NO: 647689 - RNA, 21 nt, Homo sapiens
ucagcccgccaagguagccau

SEQ ID NO: 647690 - RNA, 17 nt, Homo sapiens
ucagcccugacccugug

SEQ ID NO: 647691 - RNA, 14 nt, Homo sapiens
ucagcccugccagg

SEQ ID NO: 647692 - RNA, 20 nt, Homo sapiens
ucagcccuggccccuguggg

SEQ ID NO: 647693 - RNA, 19 nt, Homo sapiens
ucagccuccccuucuuccc

SEQ ID NO: 647694 - RNA, 19 nt, Homo sapiens
ucagccuccgccauuccaa

SEQ ID NO: 647695 - RNA, 19 nt, Homo sapiens
ucagccuccugagccugug

SEQ ID NO: 647696 - RNA, 18 nt, Homo sapiens
ucagccuccugaguagcu

SEQ ID NO: 647697 - RNA, 14 nt, Homo sapiens
ucagccugagucuc

SEQ ID NO: 647698 - RNA, 14 nt, Homo sapiens
ucagccuuaggaag

SEQ ID NO: 647699 - RNA, 22 nt, Homo sapiens
ucagccuugcaaauaaucacag

SEQ ID NO: 647700 - RNA, 16 nt, Homo sapiens
ucagcgggagcacugc

SEQ ID NO: 647701 - RNA, 21 nt, Homo sapiens
ucagcuaacauuccauguuuc

SEQ ID NO: 647702 - RNA, 10 nt, Homo sapiens
uuuacauuca

SEQ ID NO: 647703 - RNA, 14 nt, Homo sapiens
uuuacauucugcaa

SEQ ID NO: 647704 - RNA, 20 nt, Homo sapiens
uuuaccaaagagauauugau

SEQ ID NO: 647705 - RNA, 13 nt, Homo sapiens
uuuaccacuccca

SEQ ID NO: 647706 - RNA, 17 nt, Homo sapiens
uuuaccaguugccuuuu

SEQ ID NO: 647707 - RNA, 16 nt, Homo sapiens
uuuaccauuuguaaua

SEQ ID NO: 647708 - RNA, 19 nt, Homo sapiens
uuuacccagacucaaggag

SEQ ID NO: 647709 - RNA, 20 nt, Homo sapiens
uuuaccccucauccaaaguu

SEQ ID NO: 647710 - RNA, 20 nt, Homo sapiens
uuuacccuauacauccacag

SEQ ID NO: 647711 - RNA, 14 nt, Homo sapiens
uuuacccucaggca

SEQ ID NO: 647712 - RNA, 15 nt, Homo sapiens
uuuaccguguguuau

SEQ ID NO: 647713 - RNA, 21 nt, Homo sapiens
uuuaccugaaauaaaauucau

SEQ ID NO: 647714 - RNA, 17 nt, Homo sapiens
uuuaccuucaaacuuua

SEQ ID NO: 647715 - RNA, 22 nt, Homo sapiens
ucagcuuuuucccucacuugca

SEQ ID NO: 647716 - RNA, 19 nt, Homo sapiens
ucaggaaaaaugaggaauc

SEQ ID NO: 647717 - RNA, 18 nt, Homo sapiens
ucaggaaaacuacugaua

SEQ ID NO: 647718 - RNA, 20 nt, Homo sapiens
ucaggaaaacuguuccaauc

SEQ ID NO: 647719 - RNA, 13 nt, Homo sapiens
ucaggaaaccaca

SEQ ID NO: 647720 - RNA, 14 nt, Homo sapiens
ucaggaaaccacaa

SEQ ID NO: 647721 - RNA, 21 nt, Homo sapiens
ucaggaaggucuucaaucuua

SEQ ID NO: 647722 - RNA, 17 nt, Homo sapiens
ucaggaaucagaaauca

SEQ ID NO: 647723 - RNA, 21 nt, Homo sapiens
ucaggaccuuuuggucuucag

SEQ ID NO: 647724 - RNA, 15 nt, Homo sapiens
ucaggagagccagcc

SEQ ID NO: 647725 - RNA, 20 nt, Homo sapiens
ucaggagagugugcaacugg

SEQ ID NO: 647726 - RNA, 17 nt, Homo sapiens
ucaggagaucgagacca

SEQ ID NO: 647727 - RNA, 18 nt, Homo sapiens
ucaggaguuuugggaaug

SEQ ID NO: 647728 - RNA, 16 nt, Homo sapiens
ucaggauccagugaca

SEQ ID NO: 647729 - RNA, 20 nt, Homo sapiens
ucaggaugacaugugccauu

SEQ ID NO: 647730 - RNA, 14 nt, Homo sapiens
ucaggaugcacauu

SEQ ID NO: 647731 - RNA, 17 nt, Homo sapiens
ucaggaugcacauuucu

SEQ ID NO: 647732 - RNA, 18 nt, Homo sapiens
ucaggcaaagugcugcug

SEQ ID NO: 647733 - RNA, 15 nt, Homo sapiens
ucaggcaacgcacaa

SEQ ID NO: 647734 - RNA, 16 nt, Homo sapiens
ucaggcagggugcagu

SEQ ID NO: 647735 - RNA, 17 nt, Homo sapiens
ucaggcagggugcagua

SEQ ID NO: 647736 - RNA, 20 nt, Homo sapiens
ucaggcagguuugccaguga

SEQ ID NO: 647737 - RNA, 13 nt, Homo sapiens
ucaggccagccca

SEQ ID NO: 647738 - RNA, 14 nt, Homo sapiens
ucaggccagccugu

SEQ ID NO: 647739 - RNA, 16 nt, Homo sapiens
ucaggcuacaagguag

SEQ ID NO: 647740 - RNA, 19 nt, Homo sapiens
ucagggaaaaggguccagg

SEQ ID NO: 647741 - RNA, 21 nt, Homo sapiens
ucagggagaggucaccagcug

SEQ ID NO: 647742 - RNA, 15 nt, Homo sapiens
ucagggauccaauau

SEQ ID NO: 647743 - RNA, 17 nt, Homo sapiens
ucagggcaugcuuuauu

SEQ ID NO: 647744 - RNA, 17 nt, Homo sapiens
ucagggccagggcucca

SEQ ID NO: 647745 - RNA, 15 nt, Homo sapiens
ucagggccaggugca

SEQ ID NO: 647746 - RNA, 14 nt, Homo sapiens
ucagggcugugauc

SEQ ID NO: 647747 - RNA, 22 nt, Homo sapiens
ucaggggcaccuccggcugccu

SEQ ID NO: 647748 - RNA, 21 nt, Homo sapiens
ucaggggcucccuacauuccc

SEQ ID NO: 647749 - RNA, 21 nt, Homo sapiens
ucaggguaccuggggccaaac

SEQ ID NO: 647750 - RNA, 13 nt, Homo sapiens
ucagggucacugu

SEQ ID NO: 647751 - RNA, 20 nt, Homo sapiens
ucagguacagcgggcugugc

SEQ ID NO: 647752 - RNA, 16 nt, Homo sapiens
ucagguauguugccuu

SEQ ID NO: 647753 - RNA, 14 nt, Homo sapiens
ucagguccaauuug

SEQ ID NO: 647754 - RNA, 17 nt, Homo sapiens
ucaggucccaggccagc

SEQ ID NO: 647755 - RNA, 14 nt, Homo sapiens
ucaggucccaucaa

SEQ ID NO: 647756 - RNA, 19 nt, Homo sapiens
ucaggucccccccaggugc

SEQ ID NO: 647757 - RNA, 21 nt, Homo sapiens
ucaggugauccgccuaccuca

SEQ ID NO: 647758 - RNA, 23 nt, Homo sapiens
ucaggugccuccaauuggugcuu

SEQ ID NO: 647759 - RNA, 18 nt, Homo sapiens
ucaggugccuuacaucuu

SEQ ID NO: 647760 - RNA, 13 nt, Homo sapiens
ucagguugcaaaa

SEQ ID NO: 647761 - RNA, 16 nt, Homo sapiens
ucaguaaauaacugga

SEQ ID NO: 647762 - RNA, 12 nt, Homo sapiens
ucaguaacauaa

SEQ ID NO: 647763 - RNA, 15 nt, Homo sapiens
ucaguacacuuggug

SEQ ID NO: 647764 - RNA, 15 nt, Homo sapiens
ucaguacagcacucc

SEQ ID NO: 647765 - RNA, 19 nt, Homo sapiens
ucaguacaugccuagaccu

SEQ ID NO: 647766 - RNA, 24 nt, Homo sapiens
ucaguaccccugguaaaccaagcc

SEQ ID NO: 647767 - RNA, 22 nt, Homo sapiens
ucaguaggaacuguacaugugu

SEQ ID NO: 647768 - RNA, 20 nt, Homo sapiens
ucaguagguugaacuaugaa

SEQ ID NO: 647769 - RNA, 14 nt, Homo sapiens
ucaguaguguacau

SEQ ID NO: 647770 - RNA, 15 nt, Homo sapiens
ucaguaguucacaua

SEQ ID NO: 647771 - RNA, 18 nt, Homo sapiens
ucaguauaaaagacaaaa

SEQ ID NO: 647772 - RNA, 14 nt, Homo sapiens
ucaguauacugugu

SEQ ID NO: 647773 - RNA, 13 nt, Homo sapiens
ucaguauagcauu

SEQ ID NO: 647774 - RNA, 14 nt, Homo sapiens
ucaguauguuuuua

SEQ ID NO: 647775 - RNA, 13 nt, Homo sapiens
ucaguauuaucua

SEQ ID NO: 647776 - RNA, 17 nt, Homo sapiens
ucaguauuuaauaucug

SEQ ID NO: 647777 - RNA, 17 nt, Homo sapiens
ucagucaaaacuuuaaa

SEQ ID NO: 647778 - RNA, 13 nt, Homo sapiens
ucagucaagcugu

SEQ ID NO: 647779 - RNA, 12 nt, Homo sapiens
ucagucagggac

SEQ ID NO: 647780 - RNA, 19 nt, Homo sapiens
ucagucauuuuuaaccucu

SEQ ID NO: 647781 - RNA, 20 nt, Homo sapiens
ucaguccugcuccagaauuu

SEQ ID NO: 647782 - RNA, 23 nt, Homo sapiens
ucagucuaaggucucaugcuguu

SEQ ID NO: 647783 - RNA, 19 nt, Homo sapiens
ucagucucugaauacacag

SEQ ID NO: 647784 - RNA, 16 nt, Homo sapiens
ucagugaaaacaaguc

SEQ ID NO: 647785 - RNA, 21 nt, Homo sapiens
ucagugaagaauacuucucau

SEQ ID NO: 647786 - RNA, 18 nt, Homo sapiens
ucagugaagaugcaauca

SEQ ID NO: 647787 - RNA, 22 nt, Homo sapiens
ucagugaagaugcaaucagaca

SEQ ID NO: 647788 - RNA, 19 nt, Homo sapiens
ucagugaagccaaagggac

SEQ ID NO: 647789 - RNA, 17 nt, Homo sapiens
ucagugaagucuagaau

SEQ ID NO: 647790 - RNA, 23 nt, Homo sapiens
ucagugacugaauucugccuugg

SEQ ID NO: 647791 - RNA, 17 nt, Homo sapiens
ucagugauaacucugag

SEQ ID NO: 647792 - RNA, 14 nt, Homo sapiens
ucagugcuuugcau

SEQ ID NO: 647793 - RNA, 16 nt, Homo sapiens
ucaguggcuuugcaua

SEQ ID NO: 647794 - RNA, 17 nt, Homo sapiens
ucagugguggucuucaa

SEQ ID NO: 647795 - RNA, 21 nt, Homo sapiens
ucagugguugaugaaagccaa

SEQ ID NO: 647796 - RNA, 17 nt, Homo sapiens
ucaguguaccauuugcc

SEQ ID NO: 647797 - RNA, 13 nt, Homo sapiens
ucagugucacugg

SEQ ID NO: 647798 - RNA, 19 nt, Homo sapiens
ucaguguccucuugcucaa

SEQ ID NO: 647799 - RNA, 12 nt, Homo sapiens
ucagugugcaua

SEQ ID NO: 647800 - RNA, 18 nt, Homo sapiens
ucaguuaaaucuuugaag

SEQ ID NO: 647801 - RNA, 15 nt, Homo sapiens
ucaguuccauggcaa

SEQ ID NO: 647802 - RNA, 20 nt, Homo sapiens
ucaguucccuuggccucaga

SEQ ID NO: 647803 - RNA, 17 nt, Homo sapiens
ucaguucuuggugcucu

SEQ ID NO: 647804 - RNA, 17 nt, Homo sapiens
ucaguuguuuugcauaa

SEQ ID NO: 647805 - RNA, 22 nt, Homo sapiens
ucaguuugcuagcagaaaucua

SEQ ID NO: 647806 - RNA, 22 nt, Homo sapiens
ucaguuuuaucuuuaaucuccu

SEQ ID NO: 647807 - RNA, 23 nt, Homo sapiens
ucaguuuuauuuuugccaaggca

SEQ ID NO: 647808 - RNA, 20 nt, Homo sapiens
ucaguuuuguucacuuguua

SEQ ID NO: 647809 - RNA, 17 nt, Homo sapiens
ucauaaacuucagggau

SEQ ID NO: 647810 - RNA, 18 nt, Homo sapiens
ucauaaagaaaugcaagg

SEQ ID NO: 647811 - RNA, 19 nt, Homo sapiens
ucauaacagguaucauuaa

SEQ ID NO: 647812 - RNA, 14 nt, Homo sapiens
ucauaacagucuua

SEQ ID NO: 647813 - RNA, 16 nt, Homo sapiens
ucauaacuauacuuga

SEQ ID NO: 647814 - RNA, 19 nt, Homo sapiens
ucauaagacuuugggauag

SEQ ID NO: 647815 - RNA, 20 nt, Homo sapiens
ucauaaucuauaaacaauga

SEQ ID NO: 647816 - RNA, 18 nt, Homo sapiens
ucauaauggaaaaaaaga

SEQ ID NO: 647817 - RNA, 13 nt, Homo sapiens
ucauacacuuauu

SEQ ID NO: 647818 - RNA, 15 nt, Homo sapiens
ucauaccacuugaau

SEQ ID NO: 647819 - RNA, 21 nt, Homo sapiens
ucauacgucuuuauuacccaa

SEQ ID NO: 647820 - RNA, 22 nt, Homo sapiens
ucauacugucugggauuaaggg

SEQ ID NO: 647821 - RNA, 16 nt, Homo sapiens
ucauacuguucaaugg

SEQ ID NO: 647822 - RNA, 15 nt, Homo sapiens
ucauagcaacauuau

SEQ ID NO: 647823 - RNA, 13 nt, Homo sapiens
ucauagcauuaac

SEQ ID NO: 647824 - RNA, 15 nt, Homo sapiens
ucauagcucacugua

SEQ ID NO: 647825 - RNA, 19 nt, Homo sapiens
ucauagggaugcugugagc

SEQ ID NO: 647826 - RNA, 15 nt, Homo sapiens
ucauaggucccugac

SEQ ID NO: 647827 - RNA, 13 nt, Homo sapiens
ucauagugccuuu

SEQ ID NO: 647828 - RNA, 13 nt, Homo sapiens
ucauagugcucag

SEQ ID NO: 647829 - RNA, 14 nt, Homo sapiens
ucauagugcucaga

SEQ ID NO: 647830 - RNA, 20 nt, Homo sapiens
ucauauaggccagaguugca

SEQ ID NO: 647831 - RNA, 16 nt, Homo sapiens
ucauaucaaaggguaa

SEQ ID NO: 647832 - RNA, 17 nt, Homo sapiens
ucauaucauuucacugu

SEQ ID NO: 647833 - RNA, 16 nt, Homo sapiens
ucauauucgauguacu

SEQ ID NO: 647834 - RNA, 10 nt, Homo sapiens
ucauauugau

SEQ ID NO: 647835 - RNA, 20 nt, Homo sapiens
ucauauugaugugugucuag

SEQ ID NO: 647836 - RNA, 14 nt, Homo sapiens
ucauauuggacuga

SEQ ID NO: 647837 - RNA, 23 nt, Homo sapiens
uuuugauuaagugguuacuuugu

SEQ ID NO: 647838 - RNA, 17 nt, Homo sapiens
uuuugauuaguauaaua

SEQ ID NO: 647839 - RNA, 23 nt, Homo sapiens
uuuugcaaauaaaauacuaaaca

SEQ ID NO: 647840 - RNA, 13 nt, Homo sapiens
uuuugcaagugcu

SEQ ID NO: 647841 - RNA, 22 nt, Homo sapiens
uuuugcauaacgucugccuucu

SEQ ID NO: 647842 - RNA, 21 nt, Homo sapiens
uuuugcauguaugacuuaaua

SEQ ID NO: 647843 - RNA, 18 nt, Homo sapiens
uuuugccaaggcaaaaaa

SEQ ID NO: 647844 - RNA, 15 nt, Homo sapiens
uuuugccaguauuau

SEQ ID NO: 647845 - RNA, 21 nt, Homo sapiens
uuuugccaguauuaugcauau

SEQ ID NO: 647846 - RNA, 17 nt, Homo sapiens
uuuugccucaccuaaua

SEQ ID NO: 647847 - RNA, 18 nt, Homo sapiens
uuuugccucaccuaauag

SEQ ID NO: 647848 - RNA, 15 nt, Homo sapiens
uuuugccuguaagaa

SEQ ID NO: 647849 - RNA, 15 nt, Homo sapiens
uuuugcuacauucua

SEQ ID NO: 647850 - RNA, 13 nt, Homo sapiens
uuuugcuauugua

SEQ ID NO: 647851 - RNA, 11 nt, Homo sapiens
uuuugcuggag

SEQ ID NO: 647852 - RNA, 14 nt, Homo sapiens
uuuuggaaagucag

SEQ ID NO: 647853 - RNA, 15 nt, Homo sapiens
uuuuggaacauuucu

SEQ ID NO: 647854 - RNA, 15 nt, Homo sapiens
uuuuggaacuguccu

SEQ ID NO: 647855 - RNA, 15 nt, Homo sapiens
uuuuggcagccagac

SEQ ID NO: 647856 - RNA, 13 nt, Homo sapiens
uuuuggccaaagu

SEQ ID NO: 647857 - RNA, 13 nt, Homo sapiens
uuuuggcuugacu

SEQ ID NO: 647858 - RNA, 21 nt, Homo sapiens
uuuuggggggagagacacaga

SEQ ID NO: 647859 - RNA, 14 nt, Homo sapiens
uuuuggguauuaau

SEQ ID NO: 647860 - RNA, 18 nt, Homo sapiens
uuuuggguguuccuggca

SEQ ID NO: 647861 - RNA, 20 nt, Homo sapiens
uuuugguagaugcaugacuu

SEQ ID NO: 647862 - RNA, 15 nt, Homo sapiens
uacucccucuuccaa

SEQ ID NO: 647863 - RNA, 21 nt, Homo sapiens
uacuccuagaagaaccaaaua

SEQ ID NO: 647864 - RNA, 16 nt, Homo sapiens
uacuccucucaucccc

SEQ ID NO: 647865 - RNA, 14 nt, Homo sapiens
uacuccuggcuuua

SEQ ID NO: 647866 - RNA, 13 nt, Homo sapiens
uacucgucuuccu

SEQ ID NO: 647867 - RNA, 22 nt, Homo sapiens
uacucuacagauuuuacaaaua

SEQ ID NO: 647868 - RNA, 22 nt, Homo sapiens
uacucucaaaaucuuuguauaa

SEQ ID NO: 647869 - RNA, 14 nt, Homo sapiens
uacucuccuagaga

SEQ ID NO: 647870 - RNA, 22 nt, Homo sapiens
uacucugaagggcaucaugcau

SEQ ID NO: 647871 - RNA, 14 nt, Homo sapiens
uacucugcagugau

SEQ ID NO: 647872 - RNA, 12 nt, Homo sapiens
uauuuacauuua

SEQ ID NO: 647873 - RNA, 16 nt, Homo sapiens
uauuuaccagaccaca

SEQ ID NO: 647874 - RNA, 21 nt, Homo sapiens
uauuuacugagcuucucugug

SEQ ID NO: 647875 - RNA, 22 nt, Homo sapiens
ucaaagaaauccaaauuucuca

SEQ ID NO: 647876 - RNA, 20 nt, Homo sapiens
ucaaagaauuacaguacaca

SEQ ID NO: 647877 - RNA, 20 nt, Homo sapiens
ucaaagacauagaugugaaa

SEQ ID NO: 647878 - RNA, 16 nt, Homo sapiens
ucaaagacugugaaca

SEQ ID NO: 647879 - RNA, 16 nt, Homo sapiens
ucaaggucacuguuuc

SEQ ID NO: 647880 - RNA, 23 nt, Homo sapiens
ucaaggugggccuugcuaccuca

SEQ ID NO: 647881 - RNA, 17 nt, Homo sapiens
ucaagguggucaguaaa

SEQ ID NO: 647882 - RNA, 15 nt, Homo sapiens
ucaagguguucucug

SEQ ID NO: 647883 - RNA, 21 nt, Homo sapiens
ucaaguaacuauuuguaaaag

SEQ ID NO: 647884 - RNA, 20 nt, Homo sapiens
ucacauacccacacauucca

SEQ ID NO: 647885 - RNA, 17 nt, Homo sapiens
ucacaucagcaauuuca

SEQ ID NO: 647886 - RNA, 21 nt, Homo sapiens
ucacaucccauugggacucca

SEQ ID NO: 647887 - RNA, 20 nt, Homo sapiens
ucacauccuguaagugcuua

SEQ ID NO: 647888 - RNA, 17 nt, Homo sapiens
ucacaucuaaagcuuua

SEQ ID NO: 647889 - RNA, 12 nt, Homo sapiens
ucacaucuccag

SEQ ID NO: 647890 - RNA, 17 nt, Homo sapiens
ucagauuugccauucaa

SEQ ID NO: 647891 - RNA, 20 nt, Homo sapiens
ucagauuugcuguucaccca

SEQ ID NO: 647892 - RNA, 15 nt, Homo sapiens
ucagauuuguguuau

SEQ ID NO: 647893 - RNA, 21 nt, Homo sapiens
ucagauuuuaaaaagucuuca

SEQ ID NO: 647894 - RNA, 18 nt, Homo sapiens
ucagauuuugguugcuaa

SEQ ID NO: 647895 - RNA, 21 nt, Homo sapiens
ucagauuuuuuccucugcauu

SEQ ID NO: 647896 - RNA, 20 nt, Homo sapiens
ucagcaaaaagcaaaaucau

SEQ ID NO: 647897 - RNA, 20 nt, Homo sapiens
ucgagauggcagauucccac

SEQ ID NO: 647898 - RNA, 15 nt, Homo sapiens
ucgagauugcacugc

SEQ ID NO: 647899 - RNA, 16 nt, Homo sapiens
ucgagggacuuuaugu

SEQ ID NO: 647900 - RNA, 17 nt, Homo sapiens
ucgagguagguggauca

SEQ ID NO: 647901 - RNA, 13 nt, Homo sapiens
ucgagguggauca

SEQ ID NO: 647902 - RNA, 21 nt, Homo sapiens
ucgaguaaggcacacccaaau

SEQ ID NO: 647903 - RNA, 17 nt, Homo sapiens
ucgaguuuuaaacuggu

SEQ ID NO: 647904 - RNA, 22 nt, Homo sapiens
ucgauauaaauugggauaaaca

SEQ ID NO: 647905 - RNA, 20 nt, Homo sapiens
ucgauccuggauucacucac

SEQ ID NO: 647906 - RNA, 19 nt, Homo sapiens
ucgaugaauguaaacucgg

SEQ ID NO: 647907 - RNA, 17 nt, Homo sapiens
ucgaugcagugcuucca

SEQ ID NO: 647908 - RNA, 22 nt, Homo sapiens
ucgauggaugggaugcacucuc

SEQ ID NO: 647909 - RNA, 11 nt, Homo sapiens
ucgaugugcuc

SEQ ID NO: 647910 - RNA, 12 nt, Homo sapiens
ucgauuagacug

SEQ ID NO: 647911 - RNA, 20 nt, Homo sapiens
ucgauuagacuggacagcuu

SEQ ID NO: 647912 - RNA, 20 nt, Homo sapiens
ucgcaaaaacguaucuccua

SEQ ID NO: 647913 - RNA, 18 nt, Homo sapiens
ucgcaccacugcacucca

SEQ ID NO: 647914 - RNA, 18 nt, Homo sapiens
ucgcaccauugcacucca

SEQ ID NO: 647915 - RNA, 20 nt, Homo sapiens
ucgcaccuaccaucagggac

SEQ ID NO: 647916 - RNA, 15 nt, Homo sapiens
ucgcagcuacuaggg

SEQ ID NO: 647917 - RNA, 21 nt, Homo sapiens
ucgcauauugcugaguuuucu

SEQ ID NO: 647918 - RNA, 22 nt, Homo sapiens
ugucagaaaaagcuagcacuaa

SEQ ID NO: 647919 - RNA, 20 nt, Homo sapiens
ugucagaaaauaacagaugc

SEQ ID NO: 647920 - RNA, 21 nt, Homo sapiens
ugucagacacuacaugaugac

SEQ ID NO: 647921 - RNA, 21 nt, Homo sapiens
ugucagagcugggaguagcau

SEQ ID NO: 647922 - RNA, 13 nt, Homo sapiens
ugucagaguagaa

SEQ ID NO: 647923 - RNA, 17 nt, Homo sapiens
ugucagaguagaagauu

SEQ ID NO: 647924 - RNA, 17 nt, Homo sapiens
ugucagauaaguguaaa

SEQ ID NO: 647925 - RNA, 15 nt, Homo sapiens
ugucagccaugacca

SEQ ID NO: 647926 - RNA, 16 nt, Homo sapiens
ugucagcuacuaauga

SEQ ID NO: 647927 - RNA, 16 nt, Homo sapiens
ugucaggaaacauuca

SEQ ID NO: 647928 - RNA, 12 nt, Homo sapiens
ugucagggucuu

SEQ ID NO: 647929 - RNA, 19 nt, Homo sapiens
ugucaguaguggacauugu

SEQ ID NO: 647930 - RNA, 14 nt, Homo sapiens
ugucaguauuuuaa

SEQ ID NO: 647931 - RNA, 17 nt, Homo sapiens
ugucagugucacuggau

SEQ ID NO: 647932 - RNA, 19 nt, Homo sapiens
ugucaguuacaauaugaga

SEQ ID NO: 647933 - RNA, 16 nt, Homo sapiens
ugucauaaaaagacaa

SEQ ID NO: 647934 - RNA, 22 nt, Homo sapiens
ugucauaaacgauucugagcca

SEQ ID NO: 647935 - RNA, 15 nt, Homo sapiens
ugucauaacauuuaa

SEQ ID NO: 647936 - RNA, 20 nt, Homo sapiens
ugucauaacauuuaaagaga

SEQ ID NO: 647937 - RNA, 14 nt, Homo sapiens
ugucauaugacuga

SEQ ID NO: 647938 - RNA, 21 nt, Homo sapiens
ugucauccucaaagaaagugu

SEQ ID NO: 647939 - RNA, 22 nt, Homo sapiens
ugucaucuuccuggaagcagag

SEQ ID NO: 647940 - RNA, 19 nt, Homo sapiens
ugucaugaggaaacuacug

SEQ ID NO: 647941 - RNA, 22 nt, Homo sapiens
ugucauguaaggcuuaacacag

SEQ ID NO: 647942 - RNA, 13 nt, Homo sapiens
ugucaugugccuu

SEQ ID NO: 647943 - RNA, 23 nt, Homo sapiens
ugucauuaaauggggcucacaaa

SEQ ID NO: 647944 - RNA, 15 nt, Homo sapiens
ugucauuacauagaa

SEQ ID NO: 647945 - RNA, 22 nt, Homo sapiens
ugucauuaguauuucacaagaa

SEQ ID NO: 647946 - RNA, 19 nt, Homo sapiens
ugucauugauacaugcauu

SEQ ID NO: 647947 - RNA, 18 nt, Homo sapiens
ugucauuguaaacaaacu

SEQ ID NO: 647948 - RNA, 13 nt, Homo sapiens
ugucauuguauuc

SEQ ID NO: 647949 - RNA, 16 nt, Homo sapiens
ugucauuuuuaucuau

SEQ ID NO: 647950 - RNA, 12 nt, Homo sapiens
uguccaaagagg

SEQ ID NO: 647951 - RNA, 19 nt, Homo sapiens
uguccacauuuuacaggca

SEQ ID NO: 647952 - RNA, 21 nt, Homo sapiens
uguccaccagacccaccugga

SEQ ID NO: 647953 - RNA, 17 nt, Homo sapiens
uguccacgauucacuca

SEQ ID NO: 647954 - RNA, 12 nt, Homo sapiens
uguccagacuca

SEQ ID NO: 647955 - RNA, 13 nt, Homo sapiens
uguccagcagcug

SEQ ID NO: 647956 - RNA, 22 nt, Homo sapiens
uguccagccaagggcugagugu

SEQ ID NO: 647957 - RNA, 13 nt, Homo sapiens
uguccagccuuaa

SEQ ID NO: 647958 - RNA, 15 nt, Homo sapiens
uguccaggagcuaau

SEQ ID NO: 647959 - RNA, 14 nt, Homo sapiens
uguccaggcagcuc

SEQ ID NO: 647960 - RNA, 17 nt, Homo sapiens
uguccaggguccucuag

SEQ ID NO: 647961 - RNA, 15 nt, Homo sapiens
uguccaggugagaac

SEQ ID NO: 647962 - RNA, 14 nt, Homo sapiens
uguccauaaauaaa

SEQ ID NO: 647963 - RNA, 16 nt, Homo sapiens
uguccaugaagcacug

SEQ ID NO: 647964 - RNA, 16 nt, Homo sapiens
ugucccaacccagaca

SEQ ID NO: 647965 - RNA, 15 nt, Homo sapiens
ugucccaaguuccac

SEQ ID NO: 647966 - RNA, 23 nt, Homo sapiens
ugucccacgugucuuccacuuug

SEQ ID NO: 647967 - RNA, 22 nt, Homo sapiens
ugucccagcgauggugccugcu

SEQ ID NO: 647968 - RNA, 12 nt, Homo sapiens
ugucccaggacu

SEQ ID NO: 647969 - RNA, 19 nt, Homo sapiens
uguccccacuuacagaucu

SEQ ID NO: 647970 - RNA, 21 nt, Homo sapiens
uguccccagcccuguccuggu

SEQ ID NO: 647971 - RNA, 14 nt, Homo sapiens
ugucccccuaccca

SEQ ID NO: 647972 - RNA, 18 nt, Homo sapiens
ugucccccuacccaccga

SEQ ID NO: 647973 - RNA, 22 nt, Homo sapiens
uguccccgccgggcagugucac

SEQ ID NO: 647974 - RNA, 13 nt, Homo sapiens
uguccccuaagag

SEQ ID NO: 647975 - RNA, 21 nt, Homo sapiens
ugucccuuaaaauaacuugua

SEQ ID NO: 647976 - RNA, 19 nt, Homo sapiens
uguccggucccugucccag

SEQ ID NO: 647977 - RNA, 15 nt, Homo sapiens
uguccuaaaugcaaa

SEQ ID NO: 647978 - RNA, 15 nt, Homo sapiens
uguccuaagcacuuu

SEQ ID NO: 647979 - RNA, 13 nt, Homo sapiens
uguccuacaguga

SEQ ID NO: 647980 - RNA, 15 nt, Homo sapiens
uguccuccaagccag

SEQ ID NO: 647981 - RNA, 22 nt, Homo sapiens
uguccuccugauccugacacau

SEQ ID NO: 647982 - RNA, 20 nt, Homo sapiens
uguccuccuuccugggaccc

SEQ ID NO: 647983 - RNA, 13 nt, Homo sapiens
uguccucucugug

SEQ ID NO: 647984 - RNA, 16 nt, Homo sapiens
uguccucuugcucaaa

SEQ ID NO: 647985 - RNA, 18 nt, Homo sapiens
uguccucuuugugauaau

SEQ ID NO: 647986 - RNA, 18 nt, Homo sapiens
uguccugaaccgacugac

SEQ ID NO: 647987 - RNA, 17 nt, Homo sapiens
uguccugauggcccaaa

SEQ ID NO: 647988 - RNA, 16 nt, Homo sapiens
uguccugcaucaucuu

SEQ ID NO: 647989 - RNA, 16 nt, Homo sapiens
uguccugccuccucau

SEQ ID NO: 647990 - RNA, 19 nt, Homo sapiens
uguccuggugcucucugcc

SEQ ID NO: 647991 - RNA, 21 nt, Homo sapiens
uguccuggugcucucugccac

SEQ ID NO: 647992 - RNA, 16 nt, Homo sapiens
uguccuuaugcuuuua

SEQ ID NO: 647993 - RNA, 15 nt, Homo sapiens
uguccuuucuugcag

SEQ ID NO: 647994 - RNA, 20 nt, Homo sapiens
uguccuuuuucacuuugaaa

SEQ ID NO: 647995 - RNA, 18 nt, Homo sapiens
ugucgccaccacuuccag

SEQ ID NO: 647996 - RNA, 19 nt, Homo sapiens
ugucgccaggcuagagugc

SEQ ID NO: 647997 - RNA, 20 nt, Homo sapiens
ugucgcccaggcuggagugc

SEQ ID NO: 647998 - RNA, 16 nt, Homo sapiens
ugucggcggcuugaua

SEQ ID NO: 647999 - RNA, 15 nt, Homo sapiens
ugucgggacaugguu

SEQ ID NO: 648000 - RNA, 18 nt, Homo sapiens
ugucguauaggcauguaa

SEQ ID NO: 648001 - RNA, 17 nt, Homo sapiens
ugucgucuuagcaagaa

SEQ ID NO: 648002 - RNA, 21 nt, Homo sapiens
ugucuaauaaaauauaaucua

SEQ ID NO: 648003 - RNA, 16 nt, Homo sapiens
ugucuaauaguuauuc

SEQ ID NO: 648004 - RNA, 23 nt, Homo sapiens
ugucuacacacccugcauaucau

SEQ ID NO: 648005 - RNA, 13 nt, Homo sapiens
ugucuacauucag

SEQ ID NO: 648006 - RNA, 18 nt, Homo sapiens
ugucuacgggggcacuug

SEQ ID NO: 648007 - RNA, 23 nt, Homo sapiens
ugucuacgugcgcucugccauuc

SEQ ID NO: 648008 - RNA, 23 nt, Homo sapiens
ugucuagaauguggauuugauuc

SEQ ID NO: 648009 - RNA, 17 nt, Homo sapiens
ugucuauguagcugaaa

SEQ ID NO: 648010 - RNA, 18 nt, Homo sapiens
ugucuauuaucacauuaa

SEQ ID NO: 648011 - RNA, 13 nt, Homo sapiens
ugucuauucuugu

SEQ ID NO: 648012 - RNA, 20 nt, Homo sapiens
ugucuauuuaagugcaauua

SEQ ID NO: 648013 - RNA, 18 nt, Homo sapiens
ugucuauuuucucaguca

SEQ ID NO: 648014 - RNA, 21 nt, Homo sapiens
ugucucagaugguguguccag

SEQ ID NO: 648015 - RNA, 14 nt, Homo sapiens
ugucucagccuccc

SEQ ID NO: 648016 - RNA, 23 nt, Homo sapiens
ugucucaugucaaugaccauuca

SEQ ID NO: 648017 - RNA, 17 nt, Homo sapiens
ugucuccacugugccuu

SEQ ID NO: 648018 - RNA, 15 nt, Homo sapiens
ugucuccagcugccu

SEQ ID NO: 648019 - RNA, 18 nt, Homo sapiens
ugucuccugaccugaaau

SEQ ID NO: 648020 - RNA, 19 nt, Homo sapiens
ugucuccuggacucagggu

SEQ ID NO: 648021 - RNA, 23 nt, Homo sapiens
ugucuccuuugaaguagacucau

SEQ ID NO: 648022 - RNA, 20 nt, Homo sapiens
ugucucgcgcgacugagaac

SEQ ID NO: 648023 - RNA, 23 nt, Homo sapiens
ugucucucuaguugaacccuggg

SEQ ID NO: 648024 - RNA, 14 nt, Homo sapiens
ugucucucugccaa

SEQ ID NO: 648025 - RNA, 23 nt, Homo sapiens
ugucucugccucccucacccuga

SEQ ID NO: 648026 - RNA, 12 nt, Homo sapiens
ugucucugccug

SEQ ID NO: 648027 - RNA, 19 nt, Homo sapiens
ugucucuggggcagauccc

SEQ ID NO: 648028 - RNA, 20 nt, Homo sapiens
ugucucugucucuccuagcc

SEQ ID NO: 648029 - RNA, 18 nt, Homo sapiens
ugucucuugagcaucaau

SEQ ID NO: 648030 - RNA, 19 nt, Homo sapiens
ugucugaacggcugaauau

SEQ ID NO: 648031 - RNA, 14 nt, Homo sapiens
ugucugacaaccuc

SEQ ID NO: 648032 - RNA, 22 nt, Homo sapiens
ugucugacacgcaaguguguga

SEQ ID NO: 648033 - RNA, 18 nt, Homo sapiens
ugucugauguggcaaaag

SEQ ID NO: 648034 - RNA, 21 nt, Homo sapiens
ugucugauuggcucacccaag

SEQ ID NO: 648035 - RNA, 17 nt, Homo sapiens
ugucugauuuuggccau

SEQ ID NO: 648036 - RNA, 18 nt, Homo sapiens
ugucugccuucacaaaug

SEQ ID NO: 648037 - RNA, 15 nt, Homo sapiens
ugucuggaugcacac

SEQ ID NO: 648038 - RNA, 21 nt, Homo sapiens
ugucuggcccgcaauacugua

SEQ ID NO: 648039 - RNA, 20 nt, Homo sapiens
ugucugggucuaccaggaac

SEQ ID NO: 648040 - RNA, 19 nt, Homo sapiens
ugugacaucuacaacucca

SEQ ID NO: 648041 - RNA, 20 nt, Homo sapiens
ugugaccaacuguguuguau

SEQ ID NO: 648042 - RNA, 20 nt, Homo sapiens
ugugaccaaugucuugaugc

SEQ ID NO: 648043 - RNA, 18 nt, Homo sapiens
ugugaccaggaaggaagu

SEQ ID NO: 648044 - RNA, 15 nt, Homo sapiens
ugugaccagggguga

SEQ ID NO: 648045 - RNA, 12 nt, Homo sapiens
ugugaccuugac

SEQ ID NO: 648046 - RNA, 16 nt, Homo sapiens
ugugaccuugggacca

SEQ ID NO: 648047 - RNA, 16 nt, Homo sapiens
ugugacgagguggcag

SEQ ID NO: 648048 - RNA, 21 nt, Homo sapiens
ugugacgugcacugugaaucc

SEQ ID NO: 648049 - RNA, 20 nt, Homo sapiens
ugugacucccccucuuucac

SEQ ID NO: 648050 - RNA, 18 nt, Homo sapiens
ugugacucgggagcugca

SEQ ID NO: 648051 - RNA, 22 nt, Homo sapiens
ugugacucuuuccuaaagccaa

SEQ ID NO: 648052 - RNA, 20 nt, Homo sapiens
ugugacuugaacuagauugc

SEQ ID NO: 648053 - RNA, 17 nt, Homo sapiens
ugugagaauaaacuaga

SEQ ID NO: 648054 - RNA, 20 nt, Homo sapiens
ugugagaauugugcuuucac

SEQ ID NO: 648055 - RNA, 19 nt, Homo sapiens
ugugagagcccagucauug

SEQ ID NO: 648056 - RNA, 16 nt, Homo sapiens
ugugagccggagcuca

SEQ ID NO: 648057 - RNA, 17 nt, Homo sapiens
ugugagccggagcucau

SEQ ID NO: 648058 - RNA, 12 nt, Homo sapiens
ugugaggcuucu

SEQ ID NO: 648059 - RNA, 19 nt, Homo sapiens
ugugaguaagagcuggugu

SEQ ID NO: 648060 - RNA, 14 nt, Homo sapiens
ugugaguccaaaga

SEQ ID NO: 648061 - RNA, 17 nt, Homo sapiens
ugugaguguaaguguga

SEQ ID NO: 648062 - RNA, 15 nt, Homo sapiens
ugugagugugugcaa

SEQ ID NO: 648063 - RNA, 18 nt, Homo sapiens
ugugaguuuccugcuaua

SEQ ID NO: 648064 - RNA, 22 nt, Homo sapiens
ugugauaauauauugcuaaaau

SEQ ID NO: 648065 - RNA, 18 nt, Homo sapiens
ugugauacgaugcuucaa

SEQ ID NO: 648066 - RNA, 15 nt, Homo sapiens
ugugauagcacuuuc

SEQ ID NO: 648067 - RNA, 20 nt, Homo sapiens
ugugauauauuagggacacu

SEQ ID NO: 648068 - RNA, 23 nt, Homo sapiens
ugugauauauuagggacacuuuc

SEQ ID NO: 648069 - RNA, 16 nt, Homo sapiens
ugugauguuuguccug

SEQ ID NO: 648070 - RNA, 14 nt, Homo sapiens
ugugauuagugucu

SEQ ID NO: 648071 - RNA, 19 nt, Homo sapiens
ugugauucaaucuguaaac

SEQ ID NO: 648072 - RNA, 12 nt, Homo sapiens
ugugauugcaca

SEQ ID NO: 648073 - RNA, 18 nt, Homo sapiens
ugugauugcacagaauuu

SEQ ID NO: 648074 - RNA, 17 nt, Homo sapiens
ugugauugugagcuugc

SEQ ID NO: 648075 - RNA, 21 nt, Homo sapiens
ugugauuuccuaauaugaucu

SEQ ID NO: 648076 - RNA, 13 nt, Homo sapiens
ugugcaacauucu

SEQ ID NO: 648077 - RNA, 23 nt, Homo sapiens
ugugcaagcgacgacagaugcua

SEQ ID NO: 648078 - RNA, 16 nt, Homo sapiens
ugugcaagggcaguga

SEQ ID NO: 648079 - RNA, 21 nt, Homo sapiens
ugugcaagguauuacacucug

SEQ ID NO: 648080 - RNA, 21 nt, Homo sapiens
ugugcaagugucugugugcaa

SEQ ID NO: 648081 - RNA, 22 nt, Homo sapiens
ugugcaagugugugcaugugug

SEQ ID NO: 648082 - RNA, 21 nt, Homo sapiens
ugugcaccaauuaucaucuuu

SEQ ID NO: 648083 - RNA, 17 nt, Homo sapiens
ugugcacugucacuuug

SEQ ID NO: 648084 - RNA, 18 nt, Homo sapiens
ugugcacugucacuuugc

SEQ ID NO: 648085 - RNA, 12 nt, Homo sapiens
ugugcagaauaa

SEQ ID NO: 648086 - RNA, 14 nt, Homo sapiens
ugugcagauaucac

SEQ ID NO: 648087 - RNA, 18 nt, Homo sapiens
ugugcagcucccauuugg

SEQ ID NO: 648088 - RNA, 13 nt, Homo sapiens
ugugcaguacuua

SEQ ID NO: 648089 - RNA, 12 nt, Homo sapiens
ugugcauauaaa

SEQ ID NO: 648090 - RNA, 15 nt, Homo sapiens
ugugcaucuggugua

SEQ ID NO: 648091 - RNA, 13 nt, Homo sapiens
ugugcaugccaug

SEQ ID NO: 648092 - RNA, 14 nt, Homo sapiens
ugugcaugcucagc

SEQ ID NO: 648093 - RNA, 22 nt, Homo sapiens
ugugcauuaaaacaaauccaua

SEQ ID NO: 648094 - RNA, 17 nt, Homo sapiens
ugugcauuaaacaaaaa

SEQ ID NO: 648095 - RNA, 20 nt, Homo sapiens
ugugcauuucaccugugaca

SEQ ID NO: 648096 - RNA, 19 nt, Homo sapiens
ugugccacaccccaugcac

SEQ ID NO: 648097 - RNA, 20 nt, Homo sapiens
ugugccaccaccccuugacc

SEQ ID NO: 648098 - RNA, 19 nt, Homo sapiens
ugugccauuauauuugcau

SEQ ID NO: 648099 - RNA, 21 nt, Homo sapiens
ugugcccagcaggcccagcau

SEQ ID NO: 648100 - RNA, 20 nt, Homo sapiens
ugugccccagcagugccuug

SEQ ID NO: 648101 - RNA, 19 nt, Homo sapiens
uccaugaccuaguuuucca

SEQ ID NO: 648102 - RNA, 20 nt, Homo sapiens
uccaugauuuuaaauuguga

SEQ ID NO: 648103 - RNA, 14 nt, Homo sapiens
uccaugcuccucac

SEQ ID NO: 648104 - RNA, 18 nt, Homo sapiens
uccaugcugccagccuuc

SEQ ID NO: 648105 - RNA, 13 nt, Homo sapiens
uccaugcuggaua

SEQ ID NO: 648106 - RNA, 14 nt, Homo sapiens
uccaugcugugcgc

SEQ ID NO: 648107 - RNA, 20 nt, Homo sapiens
uccauggcuaagaccacaga

SEQ ID NO: 648108 - RNA, 22 nt, Homo sapiens
uccaugucgccucugcauucag

SEQ ID NO: 648109 - RNA, 16 nt, Homo sapiens
uccaugugugugcaag

SEQ ID NO: 648110 - RNA, 17 nt, Homo sapiens
uccauguuggucaggcu

SEQ ID NO: 648111 - RNA, 20 nt, Homo sapiens
uccauguuugauguaucuga

SEQ ID NO: 648112 - RNA, 15 nt, Homo sapiens
uccauguuugcaccu

SEQ ID NO: 648113 - RNA, 17 nt, Homo sapiens
uccauguuugcaccugu

SEQ ID NO: 648114 - RNA, 22 nt, Homo sapiens
uccauguuuuuggggacacuga

SEQ ID NO: 648115 - RNA, 18 nt, Homo sapiens
ugugugugccaugucaca

SEQ ID NO: 648116 - RNA, 12 nt, Homo sapiens
ugugugugccuc

SEQ ID NO: 648117 - RNA, 12 nt, Homo sapiens
uguguguggcag

SEQ ID NO: 648118 - RNA, 16 nt, Homo sapiens
uguguguucuguagag

SEQ ID NO: 648119 - RNA, 17 nt, Homo sapiens
uguguguuuaacauuca

SEQ ID NO: 648120 - RNA, 15 nt, Homo sapiens
uguguuaagugcagg

SEQ ID NO: 648121 - RNA, 15 nt, Homo sapiens
uguguuagcacugau

SEQ ID NO: 648122 - RNA, 22 nt, Homo sapiens
uguguuagcguggguuagggga

SEQ ID NO: 648123 - RNA, 22 nt, Homo sapiens
uguguuauauuccaaggaaaau

SEQ ID NO: 648124 - RNA, 14 nt, Homo sapiens
uguguuaucucuua

SEQ ID NO: 648125 - RNA, 18 nt, Homo sapiens
uguguucucuauugcugc

SEQ ID NO: 648126 - RNA, 14 nt, Homo sapiens
uguguucugucacc

SEQ ID NO: 648127 - RNA, 20 nt, Homo sapiens
uguguugaaggaacuugucu

SEQ ID NO: 648128 - RNA, 15 nt, Homo sapiens
uguguuggcacaugc

SEQ ID NO: 648129 - RNA, 22 nt, Homo sapiens
uguguugucaacaaaccaagca

SEQ ID NO: 648130 - RNA, 14 nt, Homo sapiens
uguguugucuucag

SEQ ID NO: 648131 - RNA, 21 nt, Homo sapiens
uguguuuauauggaagaaagu

SEQ ID NO: 648132 - RNA, 17 nt, Homo sapiens
uguguuuauuucacuug

SEQ ID NO: 648133 - RNA, 16 nt, Homo sapiens
uguguuugacauguga

SEQ ID NO: 648134 - RNA, 19 nt, Homo sapiens
uguguuuggauacaucugc

SEQ ID NO: 648135 - RNA, 20 nt, Homo sapiens
uguguuuucccaaagcacuu

SEQ ID NO: 648136 - RNA, 22 nt, Homo sapiens
uguguuuugaaugguguuguau

SEQ ID NO: 648137 - RNA, 14 nt, Homo sapiens
uguguuuuucacau

SEQ ID NO: 648138 - RNA, 18 nt, Homo sapiens
uguuaaaaaaaaugauaa

SEQ ID NO: 648139 - RNA, 13 nt, Homo sapiens
uguuaaaauaacu

SEQ ID NO: 648140 - RNA, 17 nt, Homo sapiens
uguuaaaauacucagug

SEQ ID NO: 648141 - RNA, 16 nt, Homo sapiens
uguuaaaauggggaua

SEQ ID NO: 648142 - RNA, 15 nt, Homo sapiens
uguuaaaauguacac

SEQ ID NO: 648143 - RNA, 13 nt, Homo sapiens
uguuaaacacgug

SEQ ID NO: 648144 - RNA, 16 nt, Homo sapiens
uguuaaacaugcuaaa

SEQ ID NO: 648145 - RNA, 23 nt, Homo sapiens
uguuaaagcuggaacauuugaua

SEQ ID NO: 648146 - RNA, 15 nt, Homo sapiens
uguuaaauacaggaa

SEQ ID NO: 648147 - RNA, 21 nt, Homo sapiens
uguuaaauguuauuauuacca

SEQ ID NO: 648148 - RNA, 21 nt, Homo sapiens
uguuaacauggacaugaucuu

SEQ ID NO: 648149 - RNA, 13 nt, Homo sapiens
uguuaagcauuua

SEQ ID NO: 648150 - RNA, 20 nt, Homo sapiens
uguuaauaaaaguacauguu

SEQ ID NO: 648151 - RNA, 13 nt, Homo sapiens
uguuaaucaucca

SEQ ID NO: 648152 - RNA, 16 nt, Homo sapiens
uguuaaucauccauca

SEQ ID NO: 648153 - RNA, 15 nt, Homo sapiens
uguuaauguucauau

SEQ ID NO: 648154 - RNA, 16 nt, Homo sapiens
uguuaauuacaccaua

SEQ ID NO: 648155 - RNA, 13 nt, Homo sapiens
uguuacaaaaaga

SEQ ID NO: 648156 - RNA, 13 nt, Homo sapiens
uguuacagauuaa

SEQ ID NO: 648157 - RNA, 22 nt, Homo sapiens
uguuacaggaagucccuugcca

SEQ ID NO: 648158 - RNA, 22 nt, Homo sapiens
uguuacauuauuccaaugauac

SEQ ID NO: 648159 - RNA, 21 nt, Homo sapiens
uguuaccauacugucucugga

SEQ ID NO: 648160 - RNA, 15 nt, Homo sapiens
uguuaccuccuauaa

SEQ ID NO: 648161 - RNA, 20 nt, Homo sapiens
uguuaccugaaaacacugug

SEQ ID NO: 648162 - RNA, 23 nt, Homo sapiens
uguuaccugaaaacacugugcac

SEQ ID NO: 648163 - RNA, 20 nt, Homo sapiens
uguuacgcacacguacuuaa

SEQ ID NO: 648164 - RNA, 17 nt, Homo sapiens
uguuacuaaaugguguu

SEQ ID NO: 648165 - RNA, 13 nt, Homo sapiens
uguuacuagccuc

SEQ ID NO: 648166 - RNA, 16 nt, Homo sapiens
uguuacucaguguuag

SEQ ID NO: 648167 - RNA, 16 nt, Homo sapiens
uguuacucugguucuu

SEQ ID NO: 648168 - RNA, 16 nt, Homo sapiens
uguuacugaucaugca

SEQ ID NO: 648169 - RNA, 18 nt, Homo sapiens
uguuacugccuaucagca

SEQ ID NO: 648170 - RNA, 15 nt, Homo sapiens
uguuacugucuucag

SEQ ID NO: 648171 - RNA, 18 nt, Homo sapiens
uguuacuuuuaguucuau

SEQ ID NO: 648172 - RNA, 17 nt, Homo sapiens
uguuagaucaaccucca

SEQ ID NO: 648173 - RNA, 19 nt, Homo sapiens
uguuagauuccucuugccu

SEQ ID NO: 648174 - RNA, 20 nt, Homo sapiens
uuccaagacugaagacugca

SEQ ID NO: 648175 - RNA, 17 nt, Homo sapiens
uuccaagucaacacucu

SEQ ID NO: 648176 - RNA, 20 nt, Homo sapiens
uuccaauuuuguugcaucau

SEQ ID NO: 648177 - RNA, 15 nt, Homo sapiens
uuccacaaaccugga

SEQ ID NO: 648178 - RNA, 21 nt, Homo sapiens
uuccacaaagaaaauuccuau

SEQ ID NO: 648179 - RNA, 20 nt, Homo sapiens
uuccacaagaugcugcaaug

SEQ ID NO: 648180 - RNA, 17 nt, Homo sapiens
uuccacaaguuaaauaa

SEQ ID NO: 648181 - RNA, 19 nt, Homo sapiens
uuccacaauucuucuguca

SEQ ID NO: 648182 - RNA, 20 nt, Homo sapiens
uuccacauaggaaaaugcca

SEQ ID NO: 648183 - RNA, 19 nt, Homo sapiens
uuccaccaaaugugcuuug

SEQ ID NO: 648184 - RNA, 21 nt, Homo sapiens
uuccaccaagcguuucccagu

SEQ ID NO: 648185 - RNA, 15 nt, Homo sapiens
uuccacccuggagac

SEQ ID NO: 648186 - RNA, 18 nt, Homo sapiens
uuccacuaucauucccau

SEQ ID NO: 648187 - RNA, 18 nt, Homo sapiens
uuccacucccuuugccag

SEQ ID NO: 648188 - RNA, 15 nt, Homo sapiens
uuccacugaacaaaa

SEQ ID NO: 648189 - RNA, 23 nt, Homo sapiens
uuccacuuagaaauugcauuucc

SEQ ID NO: 648190 - RNA, 13 nt, Homo sapiens
uuccacuucuucc

SEQ ID NO: 648191 - RNA, 14 nt, Homo sapiens
uuccacuuugcaua

SEQ ID NO: 648192 - RNA, 17 nt, Homo sapiens
uuccacuuugcauauga

SEQ ID NO: 648193 - RNA, 14 nt, Homo sapiens
uuccagaaaggaua

SEQ ID NO: 648194 - RNA, 14 nt, Homo sapiens
uuccagaaugguau

SEQ ID NO: 648195 - RNA, 13 nt, Homo sapiens
uuccagacccagc

SEQ ID NO: 648196 - RNA, 14 nt, Homo sapiens
uuccagagccagaa

SEQ ID NO: 648197 - RNA, 13 nt, Homo sapiens
uuccagauauuca

SEQ ID NO: 648198 - RNA, 18 nt, Homo sapiens
uuccagauccuucaaaga

SEQ ID NO: 648199 - RNA, 22 nt, Homo sapiens
uuccagccccuauguuauugau

SEQ ID NO: 648200 - RNA, 17 nt, Homo sapiens
uuccagcuucuuuugcc

SEQ ID NO: 648201 - RNA, 20 nt, Homo sapiens
uuccaggccugaucuugccu

SEQ ID NO: 648202 - RNA, 18 nt, Homo sapiens
uuccaggcgaugugcaag

SEQ ID NO: 648203 - RNA, 19 nt, Homo sapiens
uuccaggggucguuugcuu

SEQ ID NO: 648204 - RNA, 14 nt, Homo sapiens
uuccagguguuacu

SEQ ID NO: 648205 - RNA, 23 nt, Homo sapiens
uuccaguacuuccugcaguacaa

SEQ ID NO: 648206 - RNA, 15 nt, Homo sapiens
uuccaguauugaaaa

SEQ ID NO: 648207 - RNA, 19 nt, Homo sapiens
uuccagugaacauucccag

SEQ ID NO: 648208 - RNA, 19 nt, Homo sapiens
uuccagugguuugagacac

SEQ ID NO: 648209 - RNA, 18 nt, Homo sapiens
uuccaguguucuaugaac

SEQ ID NO: 648210 - RNA, 16 nt, Homo sapiens
uuccaguuccacgaaa

SEQ ID NO: 648211 - RNA, 23 nt, Homo sapiens
uuccaguuuaaugaacuaccauc

SEQ ID NO: 648212 - RNA, 17 nt, Homo sapiens
uuccaguuuagugcuug

SEQ ID NO: 648213 - RNA, 19 nt, Homo sapiens
uuccauaaacacccaugaa

SEQ ID NO: 648214 - RNA, 23 nt, Homo sapiens
uuccauaugugggugucagucag

SEQ ID NO: 648215 - RNA, 13 nt, Homo sapiens
uuccauauugaug

SEQ ID NO: 648216 - RNA, 22 nt, Homo sapiens
uuccaucacaagaaagucauua

SEQ ID NO: 648217 - RNA, 19 nt, Homo sapiens
uuccaucagcccaucucaa

SEQ ID NO: 648218 - RNA, 12 nt, Homo sapiens
uguugaucccaa

SEQ ID NO: 648219 - RNA, 21 nt, Homo sapiens
uguugaugaggccucuuggac

SEQ ID NO: 648220 - RNA, 15 nt, Homo sapiens
uguugauugacugca

SEQ ID NO: 648221 - RNA, 12 nt, Homo sapiens
uguugcaaaaaa

SEQ ID NO: 648222 - RNA, 14 nt, Homo sapiens
uguugcagguucau

SEQ ID NO: 648223 - RNA, 23 nt, Homo sapiens
uguugcaucccugaaacaucuca

SEQ ID NO: 648224 - RNA, 11 nt, Homo sapiens
uguugcaugga

SEQ ID NO: 648225 - RNA, 24 nt, Homo sapiens
uguugccacuggcaaauguaacug

SEQ ID NO: 648226 - RNA, 14 nt, Homo sapiens
uguugcccuaauaa

SEQ ID NO: 648227 - RNA, 18 nt, Homo sapiens
uguugcuaagcuguaacc

SEQ ID NO: 648228 - RNA, 23 nt, Homo sapiens
uguugcuauagagccuaccugua

SEQ ID NO: 648229 - RNA, 15 nt, Homo sapiens
uguugcugcaucucc

SEQ ID NO: 648230 - RNA, 21 nt, Homo sapiens
uguugcuggacugucauagaa

SEQ ID NO: 648231 - RNA, 17 nt, Homo sapiens
uguugcuuccguucaug

SEQ ID NO: 648232 - RNA, 19 nt, Homo sapiens
uguugcuuccguucaugga

SEQ ID NO: 648233 - RNA, 15 nt, Homo sapiens
uguugcuuguaauca

SEQ ID NO: 648234 - RNA, 14 nt, Homo sapiens
uguuggagccugca

SEQ ID NO: 648235 - RNA, 13 nt, Homo sapiens
uguuggcaauuau

SEQ ID NO: 648236 - RNA, 21 nt, Homo sapiens
uguuguaaccugcugugauac

SEQ ID NO: 648237 - RNA, 14 nt, Homo sapiens
uguuguacauuuca

SEQ ID NO: 648238 - RNA, 13 nt, Homo sapiens
uguuguacuuuau

SEQ ID NO: 648239 - RNA, 19 nt, Homo sapiens
uguuguagugaaauuauac

SEQ ID NO: 648240 - RNA, 21 nt, Homo sapiens
uguugucauuguaaacaaacu

SEQ ID NO: 648241 - RNA, 13 nt, Homo sapiens
uguugugugcaug

SEQ ID NO: 648242 - RNA, 18 nt, Homo sapiens
uguuguucccucccucaa

SEQ ID NO: 648243 - RNA, 16 nt, Homo sapiens
uguuguuuuaggggcu

SEQ ID NO: 648244 - RNA, 14 nt, Homo sapiens
uguuuaaauucaca

SEQ ID NO: 648245 - RNA, 19 nt, Homo sapiens
uguuuaaauucucuuucac

SEQ ID NO: 648246 - RNA, 14 nt, Homo sapiens
uguuuaacauauau

SEQ ID NO: 648247 - RNA, 17 nt, Homo sapiens
uguuuacaaggugacaa

SEQ ID NO: 648248 - RNA, 15 nt, Homo sapiens
uguuuacagacugug

SEQ ID NO: 648249 - RNA, 23 nt, Homo sapiens
uguuuacauaucaccucauggcc

SEQ ID NO: 648250 - RNA, 23 nt, Homo sapiens
uguuuaccauagaaagaugacaa

SEQ ID NO: 648251 - RNA, 15 nt, Homo sapiens
uguuuacgauuucac

SEQ ID NO: 648252 - RNA, 18 nt, Homo sapiens
uguuuacguuugauacaa

SEQ ID NO: 648253 - RNA, 16 nt, Homo sapiens
uguuuacuacauuucc

SEQ ID NO: 648254 - RNA, 17 nt, Homo sapiens
uguuuacuuuuuggcug

SEQ ID NO: 648255 - RNA, 18 nt, Homo sapiens
uguuuagcccaaaaccaa

SEQ ID NO: 648256 - RNA, 17 nt, Homo sapiens
uguuuagcuuccuccag

SEQ ID NO: 648257 - RNA, 17 nt, Homo sapiens
uguuuauauacuggguu

SEQ ID NO: 648258 - RNA, 19 nt, Homo sapiens
uguuuauccuuagcucaca

SEQ ID NO: 648259 - RNA, 14 nt, Homo sapiens
uguuuaugagccag

SEQ ID NO: 648260 - RNA, 23 nt, Homo sapiens
uguuuauuucaggcauuggauau

SEQ ID NO: 648261 - RNA, 19 nt, Homo sapiens
uguuuauuuuuaacucuug

SEQ ID NO: 648262 - RNA, 23 nt, Homo sapiens
uguuucaaacaagaaacauuuca

SEQ ID NO: 648263 - RNA, 17 nt, Homo sapiens
uguuucagcuaaaugca

SEQ ID NO: 648264 - RNA, 17 nt, Homo sapiens
uguuucccccacaguuu

SEQ ID NO: 648265 - RNA, 18 nt, Homo sapiens
uguuuccccccuuuucag

SEQ ID NO: 648266 - RNA, 14 nt, Homo sapiens
uguuucccguauug

SEQ ID NO: 648267 - RNA, 17 nt, Homo sapiens
uguuuccuaacugugau

SEQ ID NO: 648268 - RNA, 15 nt, Homo sapiens
uguuuccuguuggag

SEQ ID NO: 648269 - RNA, 22 nt, Homo sapiens
uguuuccuuuaauuuuuuacua

SEQ ID NO: 648270 - RNA, 18 nt, Homo sapiens
uguuucgaguaaacuuga

SEQ ID NO: 648271 - RNA, 14 nt, Homo sapiens
uguuucuauucuaa

SEQ ID NO: 648272 - RNA, 21 nt, Homo sapiens
uguuucugagaccacaguuua

SEQ ID NO: 648273 - RNA, 13 nt, Homo sapiens
uguuucuguuauu

SEQ ID NO: 648274 - RNA, 15 nt, Homo sapiens
uguuucuguuauuaa

SEQ ID NO: 648275 - RNA, 15 nt, Homo sapiens
uuaggaaucaccaau

SEQ ID NO: 648276 - RNA, 16 nt, Homo sapiens
uuaggaguuaccuuaa

SEQ ID NO: 648277 - RNA, 22 nt, Homo sapiens
uuaggaguucauaguuggaaaa

SEQ ID NO: 648278 - RNA, 13 nt, Homo sapiens
uuaggauuacuua

SEQ ID NO: 648279 - RNA, 15 nt, Homo sapiens
uuaggcuggaaaugg

SEQ ID NO: 648280 - RNA, 22 nt, Homo sapiens
uuagggaagaaaaagcaagugu

SEQ ID NO: 648281 - RNA, 14 nt, Homo sapiens
uuagggcuguagac

SEQ ID NO: 648282 - RNA, 14 nt, Homo sapiens
uuagggugcaagaa

SEQ ID NO: 648283 - RNA, 21 nt, Homo sapiens
uuaggucagcagccucccuga

SEQ ID NO: 648284 - RNA, 18 nt, Homo sapiens
uuaggugagacaguugcc

SEQ ID NO: 648285 - RNA, 15 nt, Homo sapiens
uuaggugucuguccu

SEQ ID NO: 648286 - RNA, 22 nt, Homo sapiens
uuaguagaaacgggguuucacc

SEQ ID NO: 648287 - RNA, 22 nt, Homo sapiens
uuaguagagacgggguuucacc

SEQ ID NO: 648288 - RNA, 22 nt, Homo sapiens
uuaguagagaugggguuucacc

SEQ ID NO: 648289 - RNA, 14 nt, Homo sapiens
uuaguauaaguaca

SEQ ID NO: 648290 - RNA, 21 nt, Homo sapiens
uuaguauaauugaccuacuuu

SEQ ID NO: 648291 - RNA, 18 nt, Homo sapiens
uuaguaugcaguugauaa

SEQ ID NO: 648292 - RNA, 15 nt, Homo sapiens
uuaguauuguugucc

SEQ ID NO: 648293 - RNA, 18 nt, Homo sapiens
uuaguauuuaacuacauc

SEQ ID NO: 648294 - RNA, 14 nt, Homo sapiens
uuagucaagguaca

SEQ ID NO: 648295 - RNA, 17 nt, Homo sapiens
uuagucaggaauggcug

SEQ ID NO: 648296 - RNA, 13 nt, Homo sapiens
uuagucaugugac

SEQ ID NO: 648297 - RNA, 22 nt, Homo sapiens
uuagucgcuaacuuaguaagug

SEQ ID NO: 648298 - RNA, 19 nt, Homo sapiens
uuagucuuuuguaauauca

SEQ ID NO: 648299 - RNA, 19 nt, Homo sapiens
uuagugaaugacuuuucuc

SEQ ID NO: 648300 - RNA, 15 nt, Homo sapiens
uuagugauggagcuu

SEQ ID NO: 648301 - RNA, 22 nt, Homo sapiens
uuagugccguuaucauggagaa

SEQ ID NO: 648302 - RNA, 14 nt, Homo sapiens
uuaguggagccagg

SEQ ID NO: 648303 - RNA, 21 nt, Homo sapiens
uuagugucaacuuuuaacuuu

SEQ ID NO: 648304 - RNA, 14 nt, Homo sapiens
uuaguuaacugaau

SEQ ID NO: 648305 - RNA, 15 nt, Homo sapiens
uuaguuacaaaguua

SEQ ID NO: 648306 - RNA, 15 nt, Homo sapiens
uuaguuauauucacu

SEQ ID NO: 648307 - RNA, 19 nt, Homo sapiens
uuaguucaauacagugaag

SEQ ID NO: 648308 - RNA, 13 nt, Homo sapiens
uuaguuccacaaa

SEQ ID NO: 648309 - RNA, 20 nt, Homo sapiens
uuaguugguuugugugauca

SEQ ID NO: 648310 - RNA, 22 nt, Homo sapiens
uuaguugguuugugugaucaua

SEQ ID NO: 648311 - RNA, 21 nt, Homo sapiens
uuaguuucaaauuuaccucag

SEQ ID NO: 648312 - RNA, 14 nt, Homo sapiens
uuaguuuucuagua

SEQ ID NO: 648313 - RNA, 15 nt, Homo sapiens
uuauaaaaagaauga

SEQ ID NO: 648314 - RNA, 16 nt, Homo sapiens
uuauaaaaagaaugaa

SEQ ID NO: 648315 - RNA, 13 nt, Homo sapiens
uuauaaaaaugag

SEQ ID NO: 648316 - RNA, 20 nt, Homo sapiens
uuauaaaaaugagugcuuaa

SEQ ID NO: 648317 - RNA, 16 nt, Homo sapiens
uuauaaaccuucagaa

SEQ ID NO: 648318 - RNA, 17 nt, Homo sapiens
uuauaaagacacaugca

SEQ ID NO: 648319 - RNA, 19 nt, Homo sapiens
uuauaaagaggucacauag

SEQ ID NO: 648320 - RNA, 21 nt, Homo sapiens
uuauaaauaaacuguugcucg

SEQ ID NO: 648321 - RNA, 21 nt, Homo sapiens
uuauaaauuuuauaacagaau

SEQ ID NO: 648322 - RNA, 22 nt, Homo sapiens
uuauaacagaauuaaaguagau

SEQ ID NO: 648323 - RNA, 13 nt, Homo sapiens
uuauaacaguguu

SEQ ID NO: 648324 - RNA, 15 nt, Homo sapiens
uuauaaccuggcaaa

SEQ ID NO: 648325 - RNA, 13 nt, Homo sapiens
uuauaacucugua

SEQ ID NO: 648326 - RNA, 20 nt, Homo sapiens
uuauaagaaagaucaaagac

SEQ ID NO: 648327 - RNA, 23 nt, Homo sapiens
uuauaagcagguguauacuuuua

SEQ ID NO: 648328 - RNA, 17 nt, Homo sapiens
uuauaagucuuacauaa

SEQ ID NO: 648329 - RNA, 14 nt, Homo sapiens
uuauaauauccaua

SEQ ID NO: 648330 - RNA, 12 nt, Homo sapiens
uuauaaucuacu

SEQ ID NO: 648331 - RNA, 12 nt, Homo sapiens
uuauaaucuuuu

SEQ ID NO: 648332 - RNA, 22 nt, Homo sapiens
uuauaauguguguugugugagc

SEQ ID NO: 648333 - RNA, 13 nt, Homo sapiens
uuauaauuggaag

SEQ ID NO: 648334 - RNA, 19 nt, Homo sapiens
uuauacaaaccuaccaaaa

SEQ ID NO: 648335 - RNA, 14 nt, Homo sapiens
uuauacaauacaga

SEQ ID NO: 648336 - RNA, 15 nt, Homo sapiens
uuauacacaguggau

SEQ ID NO: 648337 - RNA, 16 nt, Homo sapiens
uuauacagaacucaca

SEQ ID NO: 648338 - RNA, 20 nt, Homo sapiens
uuauacagauagaguuccau

SEQ ID NO: 648339 - RNA, 14 nt, Homo sapiens
uuauacagcagaga

SEQ ID NO: 648340 - RNA, 17 nt, Homo sapiens
uuauacauuauuuuaca

SEQ ID NO: 648341 - RNA, 18 nt, Homo sapiens
uuauaccagagaccugag

SEQ ID NO: 648342 - RNA, 23 nt, Homo sapiens
uuauacccccaggaaacuagcuu

SEQ ID NO: 648343 - RNA, 16 nt, Homo sapiens
uuauacgcuggcaaca

SEQ ID NO: 648344 - RNA, 19 nt, Homo sapiens
uuauacuaaauaugugacu

SEQ ID NO: 648345 - RNA, 16 nt, Homo sapiens
uuauacuccauacaua

SEQ ID NO: 648346 - RNA, 11 nt, Homo sapiens
uuauacuccuc

SEQ ID NO: 648347 - RNA, 14 nt, Homo sapiens
uuauacugagcuuu

SEQ ID NO: 648348 - RNA, 21 nt, Homo sapiens
uuauacuucucuauuaucuca

SEQ ID NO: 648349 - RNA, 12 nt, Homo sapiens
uuauacuuucag

SEQ ID NO: 648350 - RNA, 15 nt, Homo sapiens
uuauagaaguagcaa

SEQ ID NO: 648351 - RNA, 21 nt, Homo sapiens
uuauagaauauuuauuaccuc

SEQ ID NO: 648352 - RNA, 15 nt, Homo sapiens
uuauagaugcugcug

SEQ ID NO: 648353 - RNA, 15 nt, Homo sapiens
uuauagcaacuuuaa

SEQ ID NO: 648354 - RNA, 18 nt, Homo sapiens
uuauagcuaucaacauua

SEQ ID NO: 648355 - RNA, 18 nt, Homo sapiens
uuauaggacgaaugccaa

SEQ ID NO: 648356 - RNA, 13 nt, Homo sapiens
uuauaguacauga

SEQ ID NO: 648357 - RNA, 15 nt, Homo sapiens
uuauagucaauggcu

SEQ ID NO: 648358 - RNA, 17 nt, Homo sapiens
uuauauaauuguugaac

SEQ ID NO: 648359 - RNA, 22 nt, Homo sapiens
uuauauauacaguaacuuuaug

SEQ ID NO: 648360 - RNA, 14 nt, Homo sapiens
uuauauauggcaua

SEQ ID NO: 648361 - RNA, 21 nt, Homo sapiens
uuauauauggggaugguaguu

SEQ ID NO: 648362 - RNA, 19 nt, Homo sapiens
uuauauauuuauaacucau

SEQ ID NO: 648363 - RNA, 14 nt, Homo sapiens
uuauaucacuucac

SEQ ID NO: 648364 - RNA, 15 nt, Homo sapiens
uuauaucagccugag

SEQ ID NO: 648365 - RNA, 15 nt, Homo sapiens
uuauaucauauguau

SEQ ID NO: 648366 - RNA, 21 nt, Homo sapiens
uuauaucugugaauugcaggu

SEQ ID NO: 648367 - RNA, 18 nt, Homo sapiens
uuauaugauucacaugcu

SEQ ID NO: 648368 - RNA, 16 nt, Homo sapiens
uuauauggaugauuca

SEQ ID NO: 648369 - RNA, 18 nt, Homo sapiens
uuauauuaaaacacuuag

SEQ ID NO: 648370 - RNA, 16 nt, Homo sapiens
uuauauuaaaauaugg

SEQ ID NO: 648371 - RNA, 12 nt, Homo sapiens
uuauauugcuag

SEQ ID NO: 648372 - RNA, 14 nt, Homo sapiens
uuauauuucacuau

SEQ ID NO: 648373 - RNA, 19 nt, Homo sapiens
uuauauuuuccucuuagau

SEQ ID NO: 648374 - RNA, 15 nt, Homo sapiens
uuauauuuuuagccu

SEQ ID NO: 648375 - RNA, 16 nt, Homo sapiens
uuauauuuuuagccua

SEQ ID NO: 648376 - RNA, 20 nt, Homo sapiens
uuaucaaaaaguacaauaau

SEQ ID NO: 648377 - RNA, 17 nt, Homo sapiens
uuaucaaauuugccaug

SEQ ID NO: 648378 - RNA, 19 nt, Homo sapiens
uuaucaacuucgcuagaaa

SEQ ID NO: 648379 - RNA, 18 nt, Homo sapiens
uuaucaauuaaugacaau

SEQ ID NO: 648380 - RNA, 12 nt, Homo sapiens
uuaucaccucau

SEQ ID NO: 648381 - RNA, 20 nt, Homo sapiens
uuaucaccucugauggcuga

SEQ ID NO: 648382 - RNA, 16 nt, Homo sapiens
uuaucacuuaaacuug

SEQ ID NO: 648383 - RNA, 22 nt, Homo sapiens
uuaucagacucuguaauugaau

SEQ ID NO: 648384 - RNA, 14 nt, Homo sapiens
uuaucaguaagaaa

SEQ ID NO: 648385 - RNA, 15 nt, Homo sapiens
uuaucaucaccucaa

SEQ ID NO: 648386 - RNA, 16 nt, Homo sapiens
uuaucaugguauuuga

SEQ ID NO: 648387 - RNA, 14 nt, Homo sapiens
uuauccaagaccug

SEQ ID NO: 648388 - RNA, 20 nt, Homo sapiens
uuauccacaggaaaguguua

SEQ ID NO: 648389 - RNA, 21 nt, Homo sapiens
uuauccaccaagaacauaaga

SEQ ID NO: 648390 - RNA, 12 nt, Homo sapiens
uuauccaccucc

SEQ ID NO: 648391 - RNA, 18 nt, Homo sapiens
uuaucccagugaucaccu

SEQ ID NO: 648392 - RNA, 17 nt, Homo sapiens
uuauccgcuguccagca

SEQ ID NO: 648393 - RNA, 20 nt, Homo sapiens
uuauccuccaccgucuuucu

SEQ ID NO: 648394 - RNA, 23 nt, Homo sapiens
uuaucgggcuccagccaucucau

SEQ ID NO: 648395 - RNA, 18 nt, Homo sapiens
uuaucuacaaacacugca

SEQ ID NO: 648396 - RNA, 15 nt, Homo sapiens
uuaucuacuucucuc

SEQ ID NO: 648397 - RNA, 16 nt, Homo sapiens
uuaucuagcuguccag

SEQ ID NO: 648398 - RNA, 16 nt, Homo sapiens
uuaucuaucaacuaua

SEQ ID NO: 648399 - RNA, 21 nt, Homo sapiens
uuaucuauuccugaaauuucu

SEQ ID NO: 648400 - RNA, 13 nt, Homo sapiens
uuaucugauacuu

SEQ ID NO: 648401 - RNA, 21 nt, Homo sapiens
uuaucuguaauuguaauucca

SEQ ID NO: 648402 - RNA, 23 nt, Homo sapiens
uuaucugugcgugaaacacacca

SEQ ID NO: 648403 - RNA, 17 nt, Homo sapiens
uuaucuguuuccugaca

SEQ ID NO: 648404 - RNA, 20 nt, Homo sapiens
uuaucuugcaccccaaagcu

SEQ ID NO: 648405 - RNA, 13 nt, Homo sapiens
uuaucuugggaua

SEQ ID NO: 648406 - RNA, 15 nt, Homo sapiens
uuaucuugucucugg

SEQ ID NO: 648407 - RNA, 20 nt, Homo sapiens
uuaugaaaccuguacauaug

SEQ ID NO: 648408 - RNA, 22 nt, Homo sapiens
uuaugaccaugguauauuccua

SEQ ID NO: 648409 - RNA, 12 nt, Homo sapiens
uuaugacuguuu

SEQ ID NO: 648410 - RNA, 19 nt, Homo sapiens
uuaugacuuuccucagaac

SEQ ID NO: 648411 - RNA, 18 nt, Homo sapiens
uuaugagaaaguucucau

SEQ ID NO: 648412 - RNA, 16 nt, Homo sapiens
uuaugagcgucacugc

SEQ ID NO: 648413 - RNA, 14 nt, Homo sapiens
uuaugaggaaacaa

SEQ ID NO: 648414 - RNA, 23 nt, Homo sapiens
uuaugaucaaggugaaauaaaca

SEQ ID NO: 648415 - RNA, 13 nt, Homo sapiens
uuaugaucuuggc

SEQ ID NO: 648416 - RNA, 15 nt, Homo sapiens
uuaugaugcauacag

SEQ ID NO: 648417 - RNA, 22 nt, Homo sapiens
uuaugauuacuaucauggcaua

SEQ ID NO: 648418 - RNA, 20 nt, Homo sapiens
uuaugcacacagagauuuga

SEQ ID NO: 648419 - RNA, 13 nt, Homo sapiens
uuaugcagagcca

SEQ ID NO: 648420 - RNA, 10 nt, Homo sapiens
uuaugccaug

SEQ ID NO: 648421 - RNA, 18 nt, Homo sapiens
uuaugccggaugugcuuu

SEQ ID NO: 648422 - RNA, 15 nt, Homo sapiens
uuaugccuucacuuu

SEQ ID NO: 648423 - RNA, 14 nt, Homo sapiens
uuaugcuuccacag

SEQ ID NO: 648424 - RNA, 15 nt, Homo sapiens
uuauggaaaaggggu

SEQ ID NO: 648425 - RNA, 21 nt, Homo sapiens
uuauggaaaaggggugaccua

SEQ ID NO: 648426 - RNA, 13 nt, Homo sapiens
uuauggacacugc

SEQ ID NO: 648427 - RNA, 20 nt, Homo sapiens
uuauggcaugauuuauauau

SEQ ID NO: 648428 - RNA, 22 nt, Homo sapiens
uuaugggagaauugcacacaga

SEQ ID NO: 648429 - RNA, 21 nt, Homo sapiens
uuauguaugaaaaguaacuga

SEQ ID NO: 648430 - RNA, 20 nt, Homo sapiens
uuauguauguauguauuuau

SEQ ID NO: 648431 - RNA, 14 nt, Homo sapiens
uuaugucaaaugga

SEQ ID NO: 648432 - RNA, 14 nt, Homo sapiens
uuaugucugcugaa

SEQ ID NO: 648433 - RNA, 21 nt, Homo sapiens
uuaugucuggggcagaaacac

SEQ ID NO: 648434 - RNA, 20 nt, Homo sapiens
uuaugugagagaaaguguga

SEQ ID NO: 648435 - RNA, 21 nt, Homo sapiens
uuaugugcaaaaucuguuaua

SEQ ID NO: 648436 - RNA, 12 nt, Homo sapiens
uuaugugcuaua

SEQ ID NO: 648437 - RNA, 20 nt, Homo sapiens
uuauguguuaugaacaucca

SEQ ID NO: 648438 - RNA, 10 nt, Homo sapiens
uuauguguuu

SEQ ID NO: 648439 - RNA, 12 nt, Homo sapiens
uuauguuccuca

SEQ ID NO: 648440 - RNA, 21 nt, Homo sapiens
uuauguugaauccacccaaau

SEQ ID NO: 648441 - RNA, 14 nt, Homo sapiens
uuauguuugcuaaa

SEQ ID NO: 648442 - RNA, 20 nt, Homo sapiens
uuauguuuucaacucaggaa

SEQ ID NO: 648443 - RNA, 13 nt, Homo sapiens
uuauuaaaaacug

SEQ ID NO: 648444 - RNA, 17 nt, Homo sapiens
uuauuaaaauucugaau

SEQ ID NO: 648445 - RNA, 15 nt, Homo sapiens
uuauuacaauguauc

SEQ ID NO: 648446 - RNA, 11 nt, Homo sapiens
uuauuacauaa

SEQ ID NO: 648447 - RNA, 19 nt, Homo sapiens
uuauuacauggggucuaga

SEQ ID NO: 648448 - RNA, 14 nt, Homo sapiens
uuauuacauguaau

SEQ ID NO: 648449 - RNA, 19 nt, Homo sapiens
uuauuacauguaauuugau

SEQ ID NO: 648450 - RNA, 15 nt, Homo sapiens
uuauuaccagcauuu

SEQ ID NO: 648451 - RNA, 16 nt, Homo sapiens
uuauuaccauuagcau

SEQ ID NO: 648452 - RNA, 18 nt, Homo sapiens
uuauuaccccacacaucc

SEQ ID NO: 648453 - RNA, 12 nt, Homo sapiens
uuauuaccucug

SEQ ID NO: 648454 - RNA, 18 nt, Homo sapiens
uuauuauagaauugcaca

SEQ ID NO: 648455 - RNA, 15 nt, Homo sapiens
uuauuauauugucga

SEQ ID NO: 648456 - RNA, 17 nt, Homo sapiens
uuauuauuucuguucuu

SEQ ID NO: 648457 - RNA, 17 nt, Homo sapiens
uuauucaagugccucuu

SEQ ID NO: 648458 - RNA, 22 nt, Homo sapiens
uuauucacauauaucaaaguga

SEQ ID NO: 648459 - RNA, 12 nt, Homo sapiens
uuauucagugau

SEQ ID NO: 648460 - RNA, 21 nt, Homo sapiens
uuauuccaaaauaacaaaaua

SEQ ID NO: 648461 - RNA, 17 nt, Homo sapiens
uuauucuguuauauagu

SEQ ID NO: 648462 - RNA, 11 nt, Homo sapiens
uuauugaacau

SEQ ID NO: 648463 - RNA, 13 nt, Homo sapiens
uuauugacuaaca

SEQ ID NO: 648464 - RNA, 21 nt, Homo sapiens
uuauugaguucgaggacuaca

SEQ ID NO: 648465 - RNA, 21 nt, Homo sapiens
uuauugauauuuaauuaugaa

SEQ ID NO: 648466 - RNA, 14 nt, Homo sapiens
uuauugaucccaca

SEQ ID NO: 648467 - RNA, 17 nt, Homo sapiens
uuauugauucacuuacu

SEQ ID NO: 648468 - RNA, 15 nt, Homo sapiens
uuauugcacauuguu

SEQ ID NO: 648469 - RNA, 13 nt, Homo sapiens
uuauugcaguuua

SEQ ID NO: 648470 - RNA, 17 nt, Homo sapiens
uuauugcaugcugauaa

SEQ ID NO: 648471 - RNA, 13 nt, Homo sapiens
uuauugcuauuaa

SEQ ID NO: 648472 - RNA, 15 nt, Homo sapiens
uuauuggcugagaua

SEQ ID NO: 648473 - RNA, 19 nt, Homo sapiens
uuauugggcaagugauuga

SEQ ID NO: 648474 - RNA, 20 nt, Homo sapiens
uuauuguccuucuaccuuga

SEQ ID NO: 648475 - RNA, 21 nt, Homo sapiens
uuauuguuugaaaugucgauc

SEQ ID NO: 648476 - RNA, 14 nt, Homo sapiens
uuauuuaaagaaga

SEQ ID NO: 648477 - RNA, 17 nt, Homo sapiens
uuauuuaaaugggaaua

SEQ ID NO: 648478 - RNA, 18 nt, Homo sapiens
uuauuuaaguauggaaua

SEQ ID NO: 648479 - RNA, 23 nt, Homo sapiens
uuauuuaccugaaauaaaauuca

SEQ ID NO: 648480 - RNA, 23 nt, Homo sapiens
uuauuuagcucugaagcaagagu

SEQ ID NO: 648481 - RNA, 18 nt, Homo sapiens
uuauuuauuuugugguaa

SEQ ID NO: 648482 - RNA, 16 nt, Homo sapiens
uuauuuccuaaucaaa

SEQ ID NO: 648483 - RNA, 14 nt, Homo sapiens
uuauuucuacuaua

SEQ ID NO: 648484 - RNA, 17 nt, Homo sapiens
uuauuugcuaagcauau

SEQ ID NO: 648485 - RNA, 23 nt, Homo sapiens
uuauuugcuaccacagcaacuau

SEQ ID NO: 648486 - RNA, 17 nt, Homo sapiens
uuauuugcuucuucgaa

SEQ ID NO: 648487 - RNA, 22 nt, Homo sapiens
uuauuuuucauauugugccaau

SEQ ID NO: 648488 - RNA, 14 nt, Homo sapiens
uuauuuuucuuguc

SEQ ID NO: 648489 - RNA, 20 nt, Homo sapiens
uuauuuuugcuuguuucuga

SEQ ID NO: 648490 - RNA, 13 nt, Homo sapiens
uuauuuuuugcca

SEQ ID NO: 648491 - RNA, 17 nt, Homo sapiens
uuauuuuuuuacuuccu

SEQ ID NO: 648492 - RNA, 14 nt, Homo sapiens
uucaaaaauuucac

SEQ ID NO: 648493 - RNA, 21 nt, Homo sapiens
uucaaaacaaaaugaaacaaa

SEQ ID NO: 648494 - RNA, 21 nt, Homo sapiens
uucaaaacauucauaggcagu

SEQ ID NO: 648495 - RNA, 21 nt, Homo sapiens
uucaaaauaagaaaauaaccu

SEQ ID NO: 648496 - RNA, 15 nt, Homo sapiens
uucaaacaaccugcc

SEQ ID NO: 648497 - RNA, 20 nt, Homo sapiens
uucaaacuauacuacaaggc

SEQ ID NO: 648498 - RNA, 12 nt, Homo sapiens
uucaaacuuuac

SEQ ID NO: 648499 - RNA, 13 nt, Homo sapiens
uucaaagacugug

SEQ ID NO: 648500 - RNA, 19 nt, Homo sapiens
uucaaagagaugggccuuu

SEQ ID NO: 648501 - RNA, 22 nt, Homo sapiens
uucaaagagucauauugcccag

SEQ ID NO: 648502 - RNA, 18 nt, Homo sapiens
uucaaagaguccuaagga

SEQ ID NO: 648503 - RNA, 12 nt, Homo sapiens
uucaaagcuaaa

SEQ ID NO: 648504 - RNA, 18 nt, Homo sapiens
uucaaagcugcuugcugu

SEQ ID NO: 648505 - RNA, 12 nt, Homo sapiens
uucaaaugaaac

SEQ ID NO: 648506 - RNA, 12 nt, Homo sapiens
uucaaaugauga

SEQ ID NO: 648507 - RNA, 22 nt, Homo sapiens
uucaaaugaugaagaccaaaga

SEQ ID NO: 648508 - RNA, 12 nt, Homo sapiens
uucaaaugggcu

SEQ ID NO: 648509 - RNA, 13 nt, Homo sapiens
uucaacaauuuca

SEQ ID NO: 648510 - RNA, 17 nt, Homo sapiens
uucaacaugcuccaaau

SEQ ID NO: 648511 - RNA, 16 nt, Homo sapiens
uucaacuggcuacuga

SEQ ID NO: 648512 - RNA, 16 nt, Homo sapiens
uucaacuugcauccaa

SEQ ID NO: 648513 - RNA, 22 nt, Homo sapiens
uucaacuuggugacacucuaua

SEQ ID NO: 648514 - RNA, 20 nt, Homo sapiens
uucaagaccagccugaccaa

SEQ ID NO: 648515 - RNA, 16 nt, Homo sapiens
uucaagacugacauuu

SEQ ID NO: 648516 - RNA, 12 nt, Homo sapiens
uucaagauccuc

SEQ ID NO: 648517 - RNA, 20 nt, Homo sapiens
uucaagcaaaaugcuuacag

SEQ ID NO: 648518 - RNA, 21 nt, Homo sapiens
uucaagcaauccuccuaccuc

SEQ ID NO: 648519 - RNA, 17 nt, Homo sapiens
uucaagcacacuggaau

SEQ ID NO: 648520 - RNA, 23 nt, Homo sapiens
uucaagcagucgugccugugucc

SEQ ID NO: 648521 - RNA, 13 nt, Homo sapiens
uucaagcauuuag

SEQ ID NO: 648522 - RNA, 15 nt, Homo sapiens
uucaaggaucuccug

SEQ ID NO: 648523 - RNA, 11 nt, Homo sapiens
uucaagugauu

SEQ ID NO: 648524 - RNA, 22 nt, Homo sapiens
uucaagugauucuuccaccuca

SEQ ID NO: 648525 - RNA, 12 nt, Homo sapiens
uucaaguguaca

SEQ ID NO: 648526 - RNA, 15 nt, Homo sapiens
uucaaguguacaugu

SEQ ID NO: 648527 - RNA, 14 nt, Homo sapiens
uucaaguuucccca

SEQ ID NO: 648528 - RNA, 20 nt, Homo sapiens
uucaaguuugucacuaaacu

SEQ ID NO: 648529 - RNA, 22 nt, Homo sapiens
uucaauaaaucgugcugggaua

SEQ ID NO: 648530 - RNA, 11 nt, Homo sapiens
uucaauaacaa

SEQ ID NO: 648531 - RNA, 23 nt, Homo sapiens
uucaauauaagaagcaaucuuug

SEQ ID NO: 648532 - RNA, 18 nt, Homo sapiens
uucaaucuguaaacugug

SEQ ID NO: 648533 - RNA, 15 nt, Homo sapiens
uucaaugaccuguau

SEQ ID NO: 648534 - RNA, 17 nt, Homo sapiens
uucaaugguugggacaa

SEQ ID NO: 648535 - RNA, 16 nt, Homo sapiens
uucaaugugaaacaca

SEQ ID NO: 648536 - RNA, 17 nt, Homo sapiens
uucaaugugaaacacau

SEQ ID NO: 648537 - RNA, 21 nt, Homo sapiens
uucaaugugcauaaugauaaa

SEQ ID NO: 648538 - RNA, 22 nt, Homo sapiens
uucaauuauacuaaaccucaca

SEQ ID NO: 648539 - RNA, 22 nt, Homo sapiens
uucaauucuguaauuacauauu

SEQ ID NO: 648540 - RNA, 15 nt, Homo sapiens
uucaauuuggcaaaa

SEQ ID NO: 648541 - RNA, 16 nt, Homo sapiens
uucacaaauccuucaa

SEQ ID NO: 648542 - RNA, 20 nt, Homo sapiens
uucacaaccucaccaaacua

SEQ ID NO: 648543 - RNA, 21 nt, Homo sapiens
uucacaaggucaguaaugcug

SEQ ID NO: 648544 - RNA, 15 nt, Homo sapiens
uucacacaacuacuu

SEQ ID NO: 648545 - RNA, 24 nt, Homo sapiens
uucacacauagucuugaugacauu

SEQ ID NO: 648546 - RNA, 23 nt, Homo sapiens
uucacagccacaccuggacugac

SEQ ID NO: 648547 - RNA, 18 nt, Homo sapiens
uucacagcccagaaccac

SEQ ID NO: 648548 - RNA, 12 nt, Homo sapiens
uucacagugugu

SEQ ID NO: 648549 - RNA, 19 nt, Homo sapiens
uucacauauaucaaaguga

SEQ ID NO: 648550 - RNA, 14 nt, Homo sapiens
uucacaucugucac

SEQ ID NO: 648551 - RNA, 15 nt, Homo sapiens
uucacaucugucacg

SEQ ID NO: 648552 - RNA, 13 nt, Homo sapiens
uucacauugcacu

SEQ ID NO: 648553 - RNA, 16 nt, Homo sapiens
uucacauugcacucau

SEQ ID NO: 648554 - RNA, 16 nt, Homo sapiens
uucacauuuguauuaa

SEQ ID NO: 648555 - RNA, 11 nt, Homo sapiens
uucaccaaaau

SEQ ID NO: 648556 - RNA, 23 nt, Homo sapiens
uucaccaauauuucucagacauc

SEQ ID NO: 648557 - RNA, 11 nt, Homo sapiens
uucaccagagc

SEQ ID NO: 648558 - RNA, 15 nt, Homo sapiens
uucaccagauuugcu

SEQ ID NO: 648559 - RNA, 22 nt, Homo sapiens
uucaccauauugcccagggugg

SEQ ID NO: 648560 - RNA, 19 nt, Homo sapiens
uucaccauauuggccaguc

SEQ ID NO: 648561 - RNA, 22 nt, Homo sapiens
uucacccagcaccuugcagauu

SEQ ID NO: 648562 - RNA, 18 nt, Homo sapiens
uucacccuuaacccaagg

SEQ ID NO: 648563 - RNA, 16 nt, Homo sapiens
uucaccuacauuaucu

SEQ ID NO: 648564 - RNA, 18 nt, Homo sapiens
uucaccuacauuaucuca

SEQ ID NO: 648565 - RNA, 19 nt, Homo sapiens
uucaccuccaagcauuuca

SEQ ID NO: 648566 - RNA, 16 nt, Homo sapiens
uucaccucuucuuucc

SEQ ID NO: 648567 - RNA, 16 nt, Homo sapiens
uucaccuggaagcauu

SEQ ID NO: 648568 - RNA, 20 nt, Homo sapiens
uucaccuguaaaacuuuauu

SEQ ID NO: 648569 - RNA, 15 nt, Homo sapiens
uucacgaacuguuca

SEQ ID NO: 648570 - RNA, 13 nt, Homo sapiens
uucacgcaugugu

SEQ ID NO: 648571 - RNA, 17 nt, Homo sapiens
uucacguaaauauucau

SEQ ID NO: 648572 - RNA, 15 nt, Homo sapiens
uucacugaaggugau

SEQ ID NO: 648573 - RNA, 22 nt, Homo sapiens
uucacugagcuccccagaucuc

SEQ ID NO: 648574 - RNA, 13 nt, Homo sapiens
uucacugccuucc

SEQ ID NO: 648575 - RNA, 11 nt, Homo sapiens
uucacugcuga

SEQ ID NO: 648576 - RNA, 12 nt, Homo sapiens
uucacugcugag

SEQ ID NO: 648577 - RNA, 20 nt, Homo sapiens
uucacuggggcaugagauuu

SEQ ID NO: 648578 - RNA, 18 nt, Homo sapiens
uucacuguagaaugauuu

SEQ ID NO: 648579 - RNA, 19 nt, Homo sapiens
uucacuuaaguuaguucca

SEQ ID NO: 648580 - RNA, 14 nt, Homo sapiens
uucacuuuacaaau

SEQ ID NO: 648581 - RNA, 16 nt, Homo sapiens
uucacuuugugauuau

SEQ ID NO: 648582 - RNA, 17 nt, Homo sapiens
uucacuuuuaauuugcu

SEQ ID NO: 648583 - RNA, 21 nt, Homo sapiens
uucagaaauguaaauguuauu

SEQ ID NO: 648584 - RNA, 21 nt, Homo sapiens
uucagaaauuccaacuccuga

SEQ ID NO: 648585 - RNA, 19 nt, Homo sapiens
uucagaacagaggcauuua

SEQ ID NO: 648586 - RNA, 21 nt, Homo sapiens
uucagaacuaaauuuuucaua

SEQ ID NO: 648587 - RNA, 15 nt, Homo sapiens
uucagaagacacugc

SEQ ID NO: 648588 - RNA, 17 nt, Homo sapiens
uucagaagguugcucua

SEQ ID NO: 648589 - RNA, 16 nt, Homo sapiens
uucagaagugagcuuu

SEQ ID NO: 648590 - RNA, 14 nt, Homo sapiens
uucagacaccuguu

SEQ ID NO: 648591 - RNA, 23 nt, Homo sapiens
uucagacccucauuccuucccag

SEQ ID NO: 648592 - RNA, 18 nt, Homo sapiens
uucagacuuggacuauga

SEQ ID NO: 648593 - RNA, 19 nt, Homo sapiens
uucagacuuuaaaauucua

SEQ ID NO: 648594 - RNA, 13 nt, Homo sapiens
uucagagaauuac

SEQ ID NO: 648595 - RNA, 19 nt, Homo sapiens
uucagagcuaauaagugcu

SEQ ID NO: 648596 - RNA, 23 nt, Homo sapiens
uucagaggcagcaccaccacaca

SEQ ID NO: 648597 - RNA, 17 nt, Homo sapiens
uucagagucucugauac

SEQ ID NO: 648598 - RNA, 12 nt, Homo sapiens
uucagauauuau

SEQ ID NO: 648599 - RNA, 17 nt, Homo sapiens
uucagaucauauuucac

SEQ ID NO: 648600 - RNA, 19 nt, Homo sapiens
uucagauccugaauuccag

SEQ ID NO: 648601 - RNA, 21 nt, Homo sapiens
uucagauggcaauuucacuga

SEQ ID NO: 648602 - RNA, 22 nt, Homo sapiens
uucagauuuuaaaaagucuuca

SEQ ID NO: 648603 - RNA, 15 nt, Homo sapiens
uucagcacacacaaa

SEQ ID NO: 648604 - RNA, 22 nt, Homo sapiens
uucagcacugucccuugccuca

SEQ ID NO: 648605 - RNA, 16 nt, Homo sapiens
uucagccaacauguga

SEQ ID NO: 648606 - RNA, 17 nt, Homo sapiens
uucagccacuucugcag

SEQ ID NO: 648607 - RNA, 19 nt, Homo sapiens
uucagcgaagucucauggg

SEQ ID NO: 648608 - RNA, 14 nt, Homo sapiens
uucagcuccaggga

SEQ ID NO: 648609 - RNA, 14 nt, Homo sapiens
uucagcucugcaag

SEQ ID NO: 648610 - RNA, 21 nt, Homo sapiens
uucagcugacuccaguauaau

SEQ ID NO: 648611 - RNA, 15 nt, Homo sapiens
uucagcugguugagg

SEQ ID NO: 648612 - RNA, 17 nt, Homo sapiens
uucagcuguacauacuc

SEQ ID NO: 648613 - RNA, 19 nt, Homo sapiens
uucaggaaacaagcuuuau

SEQ ID NO: 648614 - RNA, 17 nt, Homo sapiens
uucaggaaggucuucaa

SEQ ID NO: 648615 - RNA, 19 nt, Homo sapiens
uucaggagggaaccagcuu

SEQ ID NO: 648616 - RNA, 14 nt, Homo sapiens
uucaggcaggccaa

SEQ ID NO: 648617 - RNA, 21 nt, Homo sapiens
uucaggcccauuaccuagaaa

SEQ ID NO: 648618 - RNA, 16 nt, Homo sapiens
uucagggaccguccag

SEQ ID NO: 648619 - RNA, 13 nt, Homo sapiens
uucaggggcuccc

SEQ ID NO: 648620 - RNA, 23 nt, Homo sapiens
uucagguccgugggccguaucug

SEQ ID NO: 648621 - RNA, 13 nt, Homo sapiens
uucaguaauaacu

SEQ ID NO: 648622 - RNA, 20 nt, Homo sapiens
uucaguauuagaugcacuua

SEQ ID NO: 648623 - RNA, 17 nt, Homo sapiens
uucagucaaaacuuuaa

SEQ ID NO: 648624 - RNA, 20 nt, Homo sapiens
uucagucacacacacauaca

SEQ ID NO: 648625 - RNA, 15 nt, Homo sapiens
uucagucuuguagug

SEQ ID NO: 648626 - RNA, 19 nt, Homo sapiens
uucagugagccccucccca

SEQ ID NO: 648627 - RNA, 21 nt, Homo sapiens
uucagugcaaauuguaucuua

SEQ ID NO: 648628 - RNA, 19 nt, Homo sapiens
uucagugcaccuacugcuu

SEQ ID NO: 648629 - RNA, 22 nt, Homo sapiens
uucagugcaccuacugcuuacu

SEQ ID NO: 648630 - RNA, 14 nt, Homo sapiens
uucagugccuuccu

SEQ ID NO: 648631 - RNA, 22 nt, Homo sapiens
uucaguggcuaccuacauacaa

SEQ ID NO: 648632 - RNA, 16 nt, Homo sapiens
uucaguguacauggaa

SEQ ID NO: 648633 - RNA, 17 nt, Homo sapiens
uucaguguuaagguaau

SEQ ID NO: 648634 - RNA, 15 nt, Homo sapiens
uucaguuaauucuua

SEQ ID NO: 648635 - RNA, 16 nt, Homo sapiens
uucaguuagcaaagag

SEQ ID NO: 648636 - RNA, 16 nt, Homo sapiens
uucaguucuacgugaa

SEQ ID NO: 648637 - RNA, 18 nt, Homo sapiens
uucaguugcuuugcccaa

SEQ ID NO: 648638 - RNA, 15 nt, Homo sapiens
uucaguuuucaggag

SEQ ID NO: 648639 - RNA, 15 nt, Homo sapiens
uucaguuuuuacuga

SEQ ID NO: 648640 - RNA, 15 nt, Homo sapiens
uucauaaaaaccaaa

SEQ ID NO: 648641 - RNA, 16 nt, Homo sapiens
uucauaaagaaaugca

SEQ ID NO: 648642 - RNA, 16 nt, Homo sapiens
uucauaaaguaaugau

SEQ ID NO: 648643 - RNA, 16 nt, Homo sapiens
uucauaagguaauuca

SEQ ID NO: 648644 - RNA, 16 nt, Homo sapiens
uucauaaguauuucaa

SEQ ID NO: 648645 - RNA, 14 nt, Homo sapiens
uucauaauaccuca

SEQ ID NO: 648646 - RNA, 13 nt, Homo sapiens
uucauacuccuuu

SEQ ID NO: 648647 - RNA, 16 nt, Homo sapiens
uucauacuccuuuuaa

SEQ ID NO: 648648 - RNA, 16 nt, Homo sapiens
uucauagcaaugucuc

SEQ ID NO: 648649 - RNA, 23 nt, Homo sapiens
uucauaggaauugguaaggccuc

SEQ ID NO: 648650 - RNA, 20 nt, Homo sapiens
uucauaguggauuaaugcau

SEQ ID NO: 648651 - RNA, 13 nt, Homo sapiens
uucauaucuauaa

SEQ ID NO: 648652 - RNA, 17 nt, Homo sapiens
uucauauuaugaugcca

SEQ ID NO: 648653 - RNA, 16 nt, Homo sapiens
uucauauuguugcauu

SEQ ID NO: 648654 - RNA, 17 nt, Homo sapiens
uucauauuuuaaacaga

SEQ ID NO: 648655 - RNA, 14 nt, Homo sapiens
uucaucaaacauug

SEQ ID NO: 648656 - RNA, 22 nt, Homo sapiens
uucaucaauaucccucuuguaa

SEQ ID NO: 648657 - RNA, 13 nt, Homo sapiens
uucaucacacugg

SEQ ID NO: 648658 - RNA, 20 nt, Homo sapiens
uucaucagacuccugugcaa

SEQ ID NO: 648659 - RNA, 17 nt, Homo sapiens
uucauccauaacugaac

SEQ ID NO: 648660 - RNA, 18 nt, Homo sapiens
uucaucccagaaacucca

SEQ ID NO: 648661 - RNA, 14 nt, Homo sapiens
uucauccccuuccu

SEQ ID NO: 648662 - RNA, 20 nt, Homo sapiens
uucaucccguaucacagugu

SEQ ID NO: 648663 - RNA, 21 nt, Homo sapiens
uucaucccucgggugugcuau

SEQ ID NO: 648664 - RNA, 15 nt, Homo sapiens
uucauccguguaacc

SEQ ID NO: 648665 - RNA, 11 nt, Homo sapiens
uucaucucuug

SEQ ID NO: 648666 - RNA, 18 nt, Homo sapiens
uucaucuucacugcaauu

SEQ ID NO: 648667 - RNA, 18 nt, Homo sapiens
uucaucuugcaagcaaau

SEQ ID NO: 648668 - RNA, 17 nt, Homo sapiens
uucaugaaacuguccac

SEQ ID NO: 648669 - RNA, 16 nt, Homo sapiens
uucaugacaagcauuu

SEQ ID NO: 648670 - RNA, 18 nt, Homo sapiens
uucaugagcuugaacaag

SEQ ID NO: 648671 - RNA, 15 nt, Homo sapiens
uucaugaucaucaca

SEQ ID NO: 648672 - RNA, 15 nt, Homo sapiens
uucauggacacuuug

SEQ ID NO: 648673 - RNA, 17 nt, Homo sapiens
uucauggccucaggaga

SEQ ID NO: 648674 - RNA, 23 nt, Homo sapiens
uucaugggaaaacagaccugugu

SEQ ID NO: 648675 - RNA, 19 nt, Homo sapiens
uucauggugaaaauguacu

SEQ ID NO: 648676 - RNA, 14 nt, Homo sapiens
uucaugucacuaaa

SEQ ID NO: 648677 - RNA, 20 nt, Homo sapiens
uucaugugagaaagcuaaaa

SEQ ID NO: 648678 - RNA, 14 nt, Homo sapiens
uucauguggcugua

SEQ ID NO: 648679 - RNA, 14 nt, Homo sapiens
uucauguuacucau

SEQ ID NO: 648680 - RNA, 19 nt, Homo sapiens
uucauguuaguuaccuuau

SEQ ID NO: 648681 - RNA, 15 nt, Homo sapiens
uucauguuugcuuca

SEQ ID NO: 648682 - RNA, 20 nt, Homo sapiens
uucauguuugcuucauaaau

SEQ ID NO: 648683 - RNA, 19 nt, Homo sapiens
uucauuaaaucaacuuuau

SEQ ID NO: 648684 - RNA, 17 nt, Homo sapiens
uucauuaaugaugaucu

SEQ ID NO: 648685 - RNA, 18 nt, Homo sapiens
uucauuaucauaugaacu

SEQ ID NO: 648686 - RNA, 14 nt, Homo sapiens
uucauuauguauga

SEQ ID NO: 648687 - RNA, 23 nt, Homo sapiens
uucauuccuaaagaaaaauaucu

SEQ ID NO: 648688 - RNA, 21 nt, Homo sapiens
uucauuccuaacacagcaugu

SEQ ID NO: 648689 - RNA, 19 nt, Homo sapiens
uucauuccuucagauuugg

SEQ ID NO: 648690 - RNA, 16 nt, Homo sapiens
uucauugcacuuugau

SEQ ID NO: 648691 - RNA, 19 nt, Homo sapiens
uucauuguuuccuucugac

SEQ ID NO: 648692 - RNA, 18 nt, Homo sapiens
uucauuuaaaaugauuag

SEQ ID NO: 648693 - RNA, 18 nt, Homo sapiens
uucauuuagucaugugac

SEQ ID NO: 648694 - RNA, 13 nt, Homo sapiens
uucauuucacaca

SEQ ID NO: 648695 - RNA, 17 nt, Homo sapiens
uucauuucauguauagu

SEQ ID NO: 648696 - RNA, 14 nt, Homo sapiens
uucauuucauuuca

SEQ ID NO: 648697 - RNA, 15 nt, Homo sapiens
uucauuucauuucag

SEQ ID NO: 648698 - RNA, 12 nt, Homo sapiens
uucauuuguaug

SEQ ID NO: 648699 - RNA, 17 nt, Homo sapiens
uucauuuucaucacugg

SEQ ID NO: 648700 - RNA, 17 nt, Homo sapiens
uucauuuuuuucacugg

SEQ ID NO: 648701 - RNA, 16 nt, Homo sapiens
uuccaaaaacauuuua

SEQ ID NO: 648702 - RNA, 15 nt, Homo sapiens
uuccaaaacauuucu

SEQ ID NO: 648703 - RNA, 12 nt, Homo sapiens
uuccaaaccauc

SEQ ID NO: 648704 - RNA, 17 nt, Homo sapiens
uuccaaacucuucccuc

SEQ ID NO: 648705 - RNA, 11 nt, Homo sapiens
uuccaaagaca

SEQ ID NO: 648706 - RNA, 11 nt, Homo sapiens
uuccaaagcaa

SEQ ID NO: 648707 - RNA, 20 nt, Homo sapiens
uuccaaaggcauaagacccu

SEQ ID NO: 648708 - RNA, 15 nt, Homo sapiens
uuccaaaugcccaag

SEQ ID NO: 648709 - RNA, 21 nt, Homo sapiens
uuccaaauguggccuccaugu

SEQ ID NO: 648710 - RNA, 22 nt, Homo sapiens
uuccaacaagaagggacugaga

SEQ ID NO: 648711 - RNA, 23 nt, Homo sapiens
uuccaacaagaagggacugagag

SEQ ID NO: 648712 - RNA, 16 nt, Homo sapiens
uuccaacaagccucaa

SEQ ID NO: 648713 - RNA, 21 nt, Homo sapiens
uuccaacaccacagacacaca

SEQ ID NO: 648714 - RNA, 23 nt, Homo sapiens
uuccaacaccacagacacacaca

SEQ ID NO: 648715 - RNA, 16 nt, Homo sapiens
uuccaaccuuuggaag

SEQ ID NO: 648716 - RNA, 23 nt, Homo sapiens
uuccaacucgaaucugugugaaa

SEQ ID NO: 648717 - RNA, 14 nt, Homo sapiens
uuccaacuugucug

SEQ ID NO: 648718 - RNA, 22 nt, Homo sapiens
uuccugguuugacucaguucca

SEQ ID NO: 648719 - RNA, 21 nt, Homo sapiens
uuccuguaaagaaacauuucc

SEQ ID NO: 648720 - RNA, 18 nt, Homo sapiens
uuccuguauguuguccaa

SEQ ID NO: 648721 - RNA, 16 nt, Homo sapiens
uuccuguccaaacuca

SEQ ID NO: 648722 - RNA, 14 nt, Homo sapiens
uuccuguccagaga

SEQ ID NO: 648723 - RNA, 15 nt, Homo sapiens
uuccuguccagagag

SEQ ID NO: 648724 - RNA, 13 nt, Homo sapiens
uuccugugaucca

SEQ ID NO: 648725 - RNA, 19 nt, Homo sapiens
uuccuguucccuuggaaua

SEQ ID NO: 648726 - RNA, 13 nt, Homo sapiens
uuccuguugucaa

SEQ ID NO: 648727 - RNA, 14 nt, Homo sapiens
uuccuguuugucua

SEQ ID NO: 648728 - RNA, 16 nt, Homo sapiens
uuccuuaaacugugug

SEQ ID NO: 648729 - RNA, 21 nt, Homo sapiens
uuccuuaaugaaaaauacaua

SEQ ID NO: 648730 - RNA, 15 nt, Homo sapiens
uuccuuagacuuacu

SEQ ID NO: 648731 - RNA, 20 nt, Homo sapiens
uuccuuagcuaaaugcaauu

SEQ ID NO: 648732 - RNA, 14 nt, Homo sapiens
uuccuuaugacuca

SEQ ID NO: 648733 - RNA, 18 nt, Homo sapiens
uuccuuaugggaucauuu

SEQ ID NO: 648734 - RNA, 18 nt, Homo sapiens
uuccuucagacagauucc

SEQ ID NO: 648735 - RNA, 13 nt, Homo sapiens
uuccuucugcuau

SEQ ID NO: 648736 - RNA, 21 nt, Homo sapiens
uuccuucuggccucugcugaa

SEQ ID NO: 648737 - RNA, 21 nt, Homo sapiens
uuccuugaauguggcuugaga

SEQ ID NO: 648738 - RNA, 21 nt, Homo sapiens
uuccuugauggagauauuuac

SEQ ID NO: 648739 - RNA, 13 nt, Homo sapiens
uuccuugccuuaa

SEQ ID NO: 648740 - RNA, 19 nt, Homo sapiens
uuccuuggcaguggacuca

SEQ ID NO: 648741 - RNA, 22 nt, Homo sapiens
uuccuuguuccaauuugacaaa

SEQ ID NO: 648742 - RNA, 16 nt, Homo sapiens
uuccuuuaaaugaaua

SEQ ID NO: 648743 - RNA, 18 nt, Homo sapiens
uuccuuuauccacuuuuc

SEQ ID NO: 648744 - RNA, 22 nt, Homo sapiens
uuccuuuaugaugacugcuuaa

SEQ ID NO: 648745 - RNA, 22 nt, Homo sapiens
uuccuuuauuuaggaaacacca

SEQ ID NO: 648746 - RNA, 18 nt, Homo sapiens
uuccuuucuacaauuuca

SEQ ID NO: 648747 - RNA, 14 nt, Homo sapiens
uuccuuucugccac

SEQ ID NO: 648748 - RNA, 17 nt, Homo sapiens
uuccuuugggucuguga

SEQ ID NO: 648749 - RNA, 23 nt, Homo sapiens
uuccuuuuauuuuuauaggaaua

SEQ ID NO: 648750 - RNA, 20 nt, Homo sapiens
uuccuuuucccugcuuccag

SEQ ID NO: 648751 - RNA, 19 nt, Homo sapiens
uuccuuuugauggggagaa

SEQ ID NO: 648752 - RNA, 20 nt, Homo sapiens
uuccuuuuuaaccauuccaa

SEQ ID NO: 648753 - RNA, 20 nt, Homo sapiens
uuccuuuuuaauaugcuuaa

SEQ ID NO: 648754 - RNA, 19 nt, Homo sapiens
uuccuuuuucuaugaaaua

SEQ ID NO: 648755 - RNA, 17 nt, Homo sapiens
uuccuuuuugacacuga

SEQ ID NO: 648756 - RNA, 20 nt, Homo sapiens
uucgaaaagcacuuugaaaa

SEQ ID NO: 648757 - RNA, 13 nt, Homo sapiens
uucgaacuccagg

SEQ ID NO: 648758 - RNA, 12 nt, Homo sapiens
uucgaacuuaac

SEQ ID NO: 648759 - RNA, 18 nt, Homo sapiens
uucgaccgacuuucccca

SEQ ID NO: 648760 - RNA, 13 nt, Homo sapiens
uucgacuaccuuu

SEQ ID NO: 648761 - RNA, 19 nt, Homo sapiens
uucgagaccagccugacca

SEQ ID NO: 648762 - RNA, 18 nt, Homo sapiens
uucgaggacuacaaccaa

SEQ ID NO: 648763 - RNA, 13 nt, Homo sapiens
uucgagggguccu

SEQ ID NO: 648764 - RNA, 13 nt, Homo sapiens
uucgauguacuug

SEQ ID NO: 648765 - RNA, 13 nt, Homo sapiens
uucgauguacuuu

SEQ ID NO: 648766 - RNA, 21 nt, Homo sapiens
uucgcacacugugauuuugcc

SEQ ID NO: 648767 - RNA, 19 nt, Homo sapiens
uucggaagggguuccucaa

SEQ ID NO: 648768 - RNA, 17 nt, Homo sapiens
uucggacaaaauaucuc

SEQ ID NO: 648769 - RNA, 21 nt, Homo sapiens
uucggggagggcgccuagucc

SEQ ID NO: 648770 - RNA, 16 nt, Homo sapiens
uucgggggcugaccua

SEQ ID NO: 648771 - RNA, 20 nt, Homo sapiens
uucguagguugacuaucuuu

SEQ ID NO: 648772 - RNA, 13 nt, Homo sapiens
uucguaguuuuca

SEQ ID NO: 648773 - RNA, 17 nt, Homo sapiens
uucgucuguugugcgaa

SEQ ID NO: 648774 - RNA, 15 nt, Homo sapiens
uucgugacaacaugc

SEQ ID NO: 648775 - RNA, 19 nt, Homo sapiens
uucguguauagcuguguga

SEQ ID NO: 648776 - RNA, 19 nt, Homo sapiens
uucguguggcuccugguaa

SEQ ID NO: 648777 - RNA, 14 nt, Homo sapiens
uucguucugcugac

SEQ ID NO: 648778 - RNA, 22 nt, Homo sapiens
uucguuuaccaaauaggauuaa

SEQ ID NO: 648779 - RNA, 21 nt, Homo sapiens
uucguuuuuuuaaaucacaag

SEQ ID NO: 648780 - RNA, 17 nt, Homo sapiens
uucguuuuuuuggucac

SEQ ID NO: 648781 - RNA, 21 nt, Homo sapiens
uucuaaaagccauuauuauga

SEQ ID NO: 648782 - RNA, 21 nt, Homo sapiens
uucuaaagacuuguauagcau

SEQ ID NO: 648783 - RNA, 21 nt, Homo sapiens
uucuaaaggaaaucaaaugaa

SEQ ID NO: 648784 - RNA, 17 nt, Homo sapiens
uucuaaaggcuugauau

SEQ ID NO: 648785 - RNA, 18 nt, Homo sapiens
uucuaaauaaauuuccca

SEQ ID NO: 648786 - RNA, 21 nt, Homo sapiens
uucuaaaucaaaccaggugca

SEQ ID NO: 648787 - RNA, 21 nt, Homo sapiens
uucuaaauccgacuugaauau

SEQ ID NO: 648788 - RNA, 17 nt, Homo sapiens
uucuaagaaccaaaaaa

SEQ ID NO: 648789 - RNA, 13 nt, Homo sapiens
uucuaagcaugua

SEQ ID NO: 648790 - RNA, 18 nt, Homo sapiens
uucuaaucccagcacuuu

SEQ ID NO: 648791 - RNA, 19 nt, Homo sapiens
uucuaaucccagcacuuug

SEQ ID NO: 648792 - RNA, 20 nt, Homo sapiens
uucuaaugguagucagauuu

SEQ ID NO: 648793 - RNA, 15 nt, Homo sapiens
uucuaaugugcauua

SEQ ID NO: 648794 - RNA, 21 nt, Homo sapiens
uucuaauuugcacuaaugugu

SEQ ID NO: 648795 - RNA, 22 nt, Homo sapiens
uucuacaauuucaauuucuccc

SEQ ID NO: 648796 - RNA, 19 nt, Homo sapiens
uucuacacuguauuacaua

SEQ ID NO: 648797 - RNA, 21 nt, Homo sapiens
uuguuacuuuuaguucuauaa

SEQ ID NO: 648798 - RNA, 15 nt, Homo sapiens
uuguuaguacuuugg

SEQ ID NO: 648799 - RNA, 12 nt, Homo sapiens
uuguuauaccau

SEQ ID NO: 648800 - RNA, 13 nt, Homo sapiens
uuguuauaccauu

SEQ ID NO: 648801 - RNA, 16 nt, Homo sapiens
uuguuaucagucaaua

SEQ ID NO: 648802 - RNA, 15 nt, Homo sapiens
uuguuauccuguaua

SEQ ID NO: 648803 - RNA, 14 nt, Homo sapiens
uuguuauguacaaa

SEQ ID NO: 648804 - RNA, 14 nt, Homo sapiens
uuguuauuuacacu

SEQ ID NO: 648805 - RNA, 19 nt, Homo sapiens
uuguuauuuacacuggucu

SEQ ID NO: 648806 - RNA, 16 nt, Homo sapiens
uuguucaguugccaag

SEQ ID NO: 648807 - RNA, 22 nt, Homo sapiens
uuguuccugccacuguguacug

SEQ ID NO: 648808 - RNA, 13 nt, Homo sapiens
uuguucugaguaa

SEQ ID NO: 648809 - RNA, 16 nt, Homo sapiens
uuguucugugguuauc

SEQ ID NO: 648810 - RNA, 15 nt, Homo sapiens
uuguugaaaccugcu

SEQ ID NO: 648811 - RNA, 23 nt, Homo sapiens
uuguugaaagcugaaaagcauac

SEQ ID NO: 648812 - RNA, 14 nt, Homo sapiens
uuguugacugugau

SEQ ID NO: 648813 - RNA, 14 nt, Homo sapiens
uuguugagugcacu

SEQ ID NO: 648814 - RNA, 16 nt, Homo sapiens
uuguugagugcacuga

SEQ ID NO: 648815 - RNA, 18 nt, Homo sapiens
uuguugagugcacugacu

SEQ ID NO: 648816 - RNA, 14 nt, Homo sapiens
uuguugcagccaaa

SEQ ID NO: 648817 - RNA, 20 nt, Homo sapiens
uuguuggaucuucaauggcu

SEQ ID NO: 648818 - RNA, 16 nt, Homo sapiens
uuguuguccuuuucau

SEQ ID NO: 648819 - RNA, 13 nt, Homo sapiens
uuguuguuugcca

SEQ ID NO: 648820 - RNA, 22 nt, Homo sapiens
uuguuuauacacaacuuugcaa

SEQ ID NO: 648821 - RNA, 14 nt, Homo sapiens
uuguuuauauugca

SEQ ID NO: 648822 - RNA, 21 nt, Homo sapiens
uuguuucaagacugacauuuu

SEQ ID NO: 648823 - RNA, 21 nt, Homo sapiens
uuguuucccagauuucaggaa

SEQ ID NO: 648824 - RNA, 13 nt, Homo sapiens
uuguuucuacuuu

SEQ ID NO: 648825 - RNA, 14 nt, Homo sapiens
uuguuucugauuaa

SEQ ID NO: 648826 - RNA, 12 nt, Homo sapiens
uuguuucuguca

SEQ ID NO: 648827 - RNA, 17 nt, Homo sapiens
uuguuucuguuucuugc

SEQ ID NO: 648828 - RNA, 15 nt, Homo sapiens
uuguuugcuuguuug

SEQ ID NO: 648829 - RNA, 17 nt, Homo sapiens
uuguuuucacuuguauu

SEQ ID NO: 648830 - RNA, 14 nt, Homo sapiens
uuguuuucagugaa

SEQ ID NO: 648831 - RNA, 19 nt, Homo sapiens
uuguuuugaagcuguugcu

SEQ ID NO: 648832 - RNA, 19 nt, Homo sapiens
uuguuuugacggaugauug

SEQ ID NO: 648833 - RNA, 22 nt, Homo sapiens
uuguuuuugcaugaaauuguau

SEQ ID NO: 648834 - RNA, 15 nt, Homo sapiens
uuguuuuugccaaag

SEQ ID NO: 648835 - RNA, 14 nt, Homo sapiens
uuguuuuuguacag

SEQ ID NO: 648836 - RNA, 14 nt, Homo sapiens
uuguuuuuuacuca

SEQ ID NO: 648837 - RNA, 22 nt, Homo sapiens
uuguuuuuuacucaaauuggga

SEQ ID NO: 648838 - RNA, 20 nt, Homo sapiens
uuguuuuuuagcagugcuga

SEQ ID NO: 648839 - RNA, 14 nt, Homo sapiens
uuguuuuuugccau

SEQ ID NO: 648840 - RNA, 22 nt, Homo sapiens
uuuaaaaaaaacaauuccacac

SEQ ID NO: 648841 - RNA, 16 nt, Homo sapiens
uuuaaaaaaaagcaua

SEQ ID NO: 648842 - RNA, 14 nt, Homo sapiens
uuuaaaaauaaagg

SEQ ID NO: 648843 - RNA, 14 nt, Homo sapiens
uuuaaaaccaguaa

SEQ ID NO: 648844 - RNA, 20 nt, Homo sapiens
uuuaaaacgcaugugcagcu

SEQ ID NO: 648845 - RNA, 21 nt, Homo sapiens
uuuaaaacuuuuaggaccaua

SEQ ID NO: 648846 - RNA, 17 nt, Homo sapiens
uuuaaaagauuaucuca

SEQ ID NO: 648847 - RNA, 15 nt, Homo sapiens
uuuaaaagcaucuca

SEQ ID NO: 648848 - RNA, 17 nt, Homo sapiens
uuuaaaauaaggauaau

SEQ ID NO: 648849 - RNA, 18 nt, Homo sapiens
uuuaaaauauuugaauga

SEQ ID NO: 648850 - RNA, 14 nt, Homo sapiens
uuuaaaaucuguca

SEQ ID NO: 648851 - RNA, 16 nt, Homo sapiens
uuuaaaauuacauucu

SEQ ID NO: 648852 - RNA, 12 nt, Homo sapiens
uuuaaaauucuc

SEQ ID NO: 648853 - RNA, 14 nt, Homo sapiens
uuuaaacacaugcc

SEQ ID NO: 648854 - RNA, 15 nt, Homo sapiens
uuuaaaccgcuaaaa

SEQ ID NO: 648855 - RNA, 19 nt, Homo sapiens
uuuaaaccuuuuucuugau

SEQ ID NO: 648856 - RNA, 18 nt, Homo sapiens
uuuaaacuauaagcaaga

SEQ ID NO: 648857 - RNA, 14 nt, Homo sapiens
uuuaaacucaggga

SEQ ID NO: 648858 - RNA, 15 nt, Homo sapiens
uuuaaacucagggac

SEQ ID NO: 648859 - RNA, 22 nt, Homo sapiens
uuuaaacucagggacagagcca

SEQ ID NO: 648860 - RNA, 12 nt, Homo sapiens
uuuaaacugcau

SEQ ID NO: 648861 - RNA, 14 nt, Homo sapiens
uuuaaagaagggaa

SEQ ID NO: 648862 - RNA, 17 nt, Homo sapiens
uuuaaagagcauaauaa

SEQ ID NO: 648863 - RNA, 13 nt, Homo sapiens
uuuaaagcaaaca

SEQ ID NO: 648864 - RNA, 14 nt, Homo sapiens
uuuaaagcuuucaa

SEQ ID NO: 648865 - RNA, 17 nt, Homo sapiens
uuuaaauaaaagcacaa

SEQ ID NO: 648866 - RNA, 20 nt, Homo sapiens
uuuaaauaauagacauacag

SEQ ID NO: 648867 - RNA, 14 nt, Homo sapiens
uuuaaauagccuaa

SEQ ID NO: 648868 - RNA, 15 nt, Homo sapiens
uuuaaaucaaacuaa

SEQ ID NO: 648869 - RNA, 13 nt, Homo sapiens
uuuaaaugaucau

SEQ ID NO: 648870 - RNA, 16 nt, Homo sapiens
uuuaaaugcaccugga

SEQ ID NO: 648871 - RNA, 16 nt, Homo sapiens
uuuaaauuccacagau

SEQ ID NO: 648872 - RNA, 15 nt, Homo sapiens
uuuaaauuccacuga

SEQ ID NO: 648873 - RNA, 15 nt, Homo sapiens
uuuaaauuguuucau

SEQ ID NO: 648874 - RNA, 16 nt, Homo sapiens
uuuaacaacauggcuu

SEQ ID NO: 648875 - RNA, 15 nt, Homo sapiens
uuuaacaaugucuga

SEQ ID NO: 648876 - RNA, 15 nt, Homo sapiens
uuuaacagcugauaa

SEQ ID NO: 648877 - RNA, 16 nt, Homo sapiens
uuuaacauacaaucau

SEQ ID NO: 648878 - RNA, 12 nt, Homo sapiens
uuuaacauucac

SEQ ID NO: 648879 - RNA, 21 nt, Homo sapiens
uuuaaccaaggaggggccagu

SEQ ID NO: 648880 - RNA, 13 nt, Homo sapiens
uuuaaccauucca

SEQ ID NO: 648881 - RNA, 19 nt, Homo sapiens
uuuaaccccuugguacuga

SEQ ID NO: 648882 - RNA, 15 nt, Homo sapiens
uuuaaccuuccaaga

SEQ ID NO: 648883 - RNA, 16 nt, Homo sapiens
uuuaacuuuaccaugc

SEQ ID NO: 648884 - RNA, 13 nt, Homo sapiens
uuuaacuuugaaa

SEQ ID NO: 648885 - RNA, 21 nt, Homo sapiens
uuuaagaaaaaggaugcacag

SEQ ID NO: 648886 - RNA, 14 nt, Homo sapiens
uuuaagaauuucac

SEQ ID NO: 648887 - RNA, 14 nt, Homo sapiens
uuuaagacuaugau

SEQ ID NO: 648888 - RNA, 21 nt, Homo sapiens
uuuacaagaaguuuauucuca

SEQ ID NO: 648889 - RNA, 19 nt, Homo sapiens
uuuacaagggcauaaagua

SEQ ID NO: 648890 - RNA, 18 nt, Homo sapiens
uuuacaauguucauccca

SEQ ID NO: 648891 - RNA, 15 nt, Homo sapiens
uuuacacaaagggaa

SEQ ID NO: 648892 - RNA, 19 nt, Homo sapiens
uuuacacuacauuguacaa

SEQ ID NO: 648893 - RNA, 23 nt, Homo sapiens
uuuacagaaucaaaugcaauuuu

SEQ ID NO: 648894 - RNA, 13 nt, Homo sapiens
uuuacagacacac

SEQ ID NO: 648895 - RNA, 17 nt, Homo sapiens
uuuacagcccucagcaa

SEQ ID NO: 648896 - RNA, 13 nt, Homo sapiens
uuuacagcugccu

SEQ ID NO: 648897 - RNA, 17 nt, Homo sapiens
uuuacaguuacaguuga

SEQ ID NO: 648898 - RNA, 21 nt, Homo sapiens
uuuacauacugcugucuaugu

SEQ ID NO: 648899 - RNA, 17 nt, Homo sapiens
uuuacauuauuaagaaa

SEQ ID NO: 648900 - RNA, 11 nt, Homo sapiens
uuuacauuuca

SEQ ID NO: 648901 - RNA, 16 nt, Homo sapiens
uuuacauuucauacaa

SEQ ID NO: 648902 - RNA, 11 nt, Homo sapiens
uuuaccaaagc

SEQ ID NO: 648903 - RNA, 20 nt, Homo sapiens
uuuaccaaggauauuuacag

SEQ ID NO: 648904 - RNA, 14 nt, Homo sapiens
uuuacccaagagaa

SEQ ID NO: 648905 - RNA, 16 nt, Homo sapiens
uuuacccugugucaga

SEQ ID NO: 648906 - RNA, 19 nt, Homo sapiens
uuuaccucaggugugccug

SEQ ID NO: 648907 - RNA, 18 nt, Homo sapiens
uuuaccuucaaacuuuag

SEQ ID NO: 648908 - RNA, 14 nt, Homo sapiens
uuuacgaaaccaaa

SEQ ID NO: 648909 - RNA, 20 nt, Homo sapiens
uuuacgaucuguuuccaaau

SEQ ID NO: 648910 - RNA, 16 nt, Homo sapiens
uuuacuaucauucuca

SEQ ID NO: 648911 - RNA, 23 nt, Homo sapiens
uuuacucacacuaugugcaaaaa

SEQ ID NO: 648912 - RNA, 17 nt, Homo sapiens
uuuacucaucaggucau

SEQ ID NO: 648913 - RNA, 12 nt, Homo sapiens
uuuacucugugu

SEQ ID NO: 648914 - RNA, 15 nt, Homo sapiens
uuuacucuguguaaa

SEQ ID NO: 648915 - RNA, 19 nt, Homo sapiens
uuuacucuguuaccacauu

SEQ ID NO: 648916 - RNA, 12 nt, Homo sapiens
uuuacugaggaa

SEQ ID NO: 648917 - RNA, 15 nt, Homo sapiens
uuuacugaggugaug

SEQ ID NO: 648918 - RNA, 18 nt, Homo sapiens
uuuacugauacuacaacu

SEQ ID NO: 648919 - RNA, 16 nt, Homo sapiens
uuuacugaugauguag

SEQ ID NO: 648920 - RNA, 16 nt, Homo sapiens
uuuacugguugcaugg

SEQ ID NO: 648921 - RNA, 18 nt, Homo sapiens
uuuacuguuuuaauugua

SEQ ID NO: 648922 - RNA, 17 nt, Homo sapiens
uuuacuuuuaaacugug

SEQ ID NO: 648923 - RNA, 20 nt, Homo sapiens
uuuacuuuuaccacuauuua

SEQ ID NO: 648924 - RNA, 23 nt, Homo sapiens
uuuagaaaaaaguuuacaacaua

SEQ ID NO: 648925 - RNA, 16 nt, Homo sapiens
uuuagaaaaugcaguc

SEQ ID NO: 648926 - RNA, 13 nt, Homo sapiens
uuuagaaccagcc

SEQ ID NO: 648927 - RNA, 17 nt, Homo sapiens
uuuagaacuguauguca

SEQ ID NO: 648928 - RNA, 18 nt, Homo sapiens
uuuagacccugcauuuau

SEQ ID NO: 648929 - RNA, 16 nt, Homo sapiens
uuuagagauacuguug

SEQ ID NO: 648930 - RNA, 20 nt, Homo sapiens
uuuagaucccaugucaccuc

SEQ ID NO: 648931 - RNA, 20 nt, Homo sapiens
uuuagcaauuuauacaauau

SEQ ID NO: 648932 - RNA, 14 nt, Homo sapiens
uuuagccagugacu

SEQ ID NO: 648933 - RNA, 22 nt, Homo sapiens
uuuagcccugggcccucccuuu

SEQ ID NO: 648934 - RNA, 18 nt, Homo sapiens
uuuagccuggauguugcu

SEQ ID NO: 648935 - RNA, 11 nt, Homo sapiens
uuuagccuuua

SEQ ID NO: 648936 - RNA, 23 nt, Homo sapiens
uuuagcuaccucacuaugcugcu

SEQ ID NO: 648937 - RNA, 15 nt, Homo sapiens
uuuagcuucccuuaa

SEQ ID NO: 648938 - RNA, 19 nt, Homo sapiens
uuuaggaagcaagcuuaau

SEQ ID NO: 648939 - RNA, 16 nt, Homo sapiens
uuuaggacaucuuaaa

SEQ ID NO: 648940 - RNA, 19 nt, Homo sapiens
uuuaggaccaauaccuccu

SEQ ID NO: 648941 - RNA, 16 nt, Homo sapiens
uuuaggcacuguucaa

SEQ ID NO: 648942 - RNA, 18 nt, Homo sapiens
uuuagggcagcuugcccc

SEQ ID NO: 648943 - RNA, 12 nt, Homo sapiens
uuuagucacuaa

SEQ ID NO: 648944 - RNA, 12 nt, Homo sapiens
uuuaguggagcc

SEQ ID NO: 648945 - RNA, 23 nt, Homo sapiens
uuuaguuguaaaccaagugauca

SEQ ID NO: 648946 - RNA, 12 nt, Homo sapiens
uuuaguuucaug

SEQ ID NO: 648947 - RNA, 19 nt, Homo sapiens
uuuaguuuuacacuaggaa

SEQ ID NO: 648948 - RNA, 16 nt, Homo sapiens
uuuauaaaaguguuca

SEQ ID NO: 648949 - RNA, 18 nt, Homo sapiens
uuuauaaacaacaucaaa

SEQ ID NO: 648950 - RNA, 15 nt, Homo sapiens
uuuauaaacugagag

SEQ ID NO: 648951 - RNA, 19 nt, Homo sapiens
uuuauaaaucuuaugcucu

SEQ ID NO: 648952 - RNA, 16 nt, Homo sapiens
uuuauaagagugccgu

SEQ ID NO: 648953 - RNA, 17 nt, Homo sapiens
uuuauacucagaacugu

SEQ ID NO: 648954 - RNA, 12 nt, Homo sapiens
uuuauagcucua

SEQ ID NO: 648955 - RNA, 20 nt, Homo sapiens
uuuauagucgaacaauucau

SEQ ID NO: 648956 - RNA, 18 nt, Homo sapiens
uuuauauaaggcauucca

SEQ ID NO: 648957 - RNA, 16 nt, Homo sapiens
uuuauaucacaauuua

SEQ ID NO: 648958 - RNA, 17 nt, Homo sapiens
uuuauaucaugcaaaau

SEQ ID NO: 648959 - RNA, 14 nt, Homo sapiens
uuuauauuugucaa

SEQ ID NO: 648960 - RNA, 18 nt, Homo sapiens
uuuaucaccucauucuga

SEQ ID NO: 648961 - RNA, 13 nt, Homo sapiens
uuuaucauaugcu

SEQ ID NO: 648962 - RNA, 20 nt, Homo sapiens
uuuaucauucaaguguaaaa

SEQ ID NO: 648963 - RNA, 14 nt, Homo sapiens
uuuauccacuuuuc

SEQ ID NO: 648964 - RNA, 14 nt, Homo sapiens
uuuaucccauggaa

SEQ ID NO: 648965 - RNA, 15 nt, Homo sapiens
uuuaucgaaguauau

SEQ ID NO: 648966 - RNA, 20 nt, Homo sapiens
uuuaucugaucugugauuaa

SEQ ID NO: 648967 - RNA, 14 nt, Homo sapiens
uuuaucuguucuug

SEQ ID NO: 648968 - RNA, 13 nt, Homo sapiens
uuuaugacucuua

SEQ ID NO: 648969 - RNA, 11 nt, Homo sapiens
uuuaugcacau

SEQ ID NO: 648970 - RNA, 15 nt, Homo sapiens
uuuauguagcacuac

SEQ ID NO: 648971 - RNA, 19 nt, Homo sapiens
uuuaugugcaaaaucuguu

SEQ ID NO: 648972 - RNA, 13 nt, Homo sapiens
uuuaugugcaaua

SEQ ID NO: 648973 - RNA, 13 nt, Homo sapiens
uuuaugugcagcg

SEQ ID NO: 648974 - RNA, 18 nt, Homo sapiens
uuuaugugcucuccaaau

SEQ ID NO: 648975 - RNA, 16 nt, Homo sapiens
uuuauuaacuacugaa

SEQ ID NO: 648976 - RNA, 15 nt, Homo sapiens
uuuauuaaucuuagu

SEQ ID NO: 648977 - RNA, 11 nt, Homo sapiens
uuuauuacaaa

SEQ ID NO: 648978 - RNA, 17 nt, Homo sapiens
uuuauuacauugcugcc

SEQ ID NO: 648979 - RNA, 21 nt, Homo sapiens
uuuccucgccuaggccuguga

SEQ ID NO: 648980 - RNA, 14 nt, Homo sapiens
uuuccucugcagca

SEQ ID NO: 648981 - RNA, 12 nt, Homo sapiens
uuuccucugcau

SEQ ID NO: 648982 - RNA, 19 nt, Homo sapiens
uuuccucugugcaaaggga

SEQ ID NO: 648983 - RNA, 14 nt, Homo sapiens
uuuccuugcucaac

SEQ ID NO: 648984 - RNA, 15 nt, Homo sapiens
uuuccuuuccauugu

SEQ ID NO: 648985 - RNA, 16 nt, Homo sapiens
uuuccuuucugccacc

SEQ ID NO: 648986 - RNA, 15 nt, Homo sapiens
uuuccuuugcuucaa

SEQ ID NO: 648987 - RNA, 18 nt, Homo sapiens
uuuccuuuguaaguuccu

SEQ ID NO: 648988 - RNA, 22 nt, Homo sapiens
uuuccuuuuaaaaggcccugug

SEQ ID NO: 648989 - RNA, 18 nt, Homo sapiens
uuuccuuuuugacacuga

SEQ ID NO: 648990 - RNA, 16 nt, Homo sapiens
uuucguagguugacua

SEQ ID NO: 648991 - RNA, 20 nt, Homo sapiens
uuucuaaaaacacacacaaa

SEQ ID NO: 648992 - RNA, 18 nt, Homo sapiens
uuucuaaaaagcuaugua

SEQ ID NO: 648993 - RNA, 22 nt, Homo sapiens
uuucuaaaccuugugauucugc

SEQ ID NO: 648994 - RNA, 13 nt, Homo sapiens
uuucuaagagaag

SEQ ID NO: 648995 - RNA, 14 nt, Homo sapiens
uuucuaaugugcau

SEQ ID NO: 648996 - RNA, 18 nt, Homo sapiens
uuucuaccuugaggucuu

SEQ ID NO: 648997 - RNA, 16 nt, Homo sapiens
uuucuaccuuuacuac

SEQ ID NO: 648998 - RNA, 22 nt, Homo sapiens
uuucuacuuugaagucauacca

SEQ ID NO: 648999 - RNA, 20 nt, Homo sapiens
uuucuagacaguauugccac

SEQ ID NO: 649000 - RNA, 13 nt, Homo sapiens
uuucuagacuguc

SEQ ID NO: 649001 - RNA, 15 nt, Homo sapiens
uuucuagagacacau

SEQ ID NO: 649002 - RNA, 14 nt, Homo sapiens
uuucuagccuuaga

SEQ ID NO: 649003 - RNA, 14 nt, Homo sapiens
uuucuauaucaaaa

SEQ ID NO: 649004 - RNA, 16 nt, Homo sapiens
uuucuaucacauauuu

SEQ ID NO: 649005 - RNA, 12 nt, Homo sapiens
uuucuaugugua

SEQ ID NO: 649006 - RNA, 12 nt, Homo sapiens
uuucucaaaaau

SEQ ID NO: 649007 - RNA, 12 nt, Homo sapiens
uuucucacugag

SEQ ID NO: 649008 - RNA, 19 nt, Homo sapiens
uuuggacauggcucacaaa

SEQ ID NO: 649009 - RNA, 16 nt, Homo sapiens
uuuggacccaguucag

SEQ ID NO: 649010 - RNA, 20 nt, Homo sapiens
uuuggacugucuauaucaua

SEQ ID NO: 649011 - RNA, 15 nt, Homo sapiens
uuuggagagugcuau

SEQ ID NO: 649012 - RNA, 20 nt, Homo sapiens
uuuggagcacaaaauucaaa

SEQ ID NO: 649013 - RNA, 19 nt, Homo sapiens
uuuggagcauuaacuaaau

SEQ ID NO: 649014 - RNA, 17 nt, Homo sapiens
uuuggagccugccaaga

SEQ ID NO: 649015 - RNA, 22 nt, Homo sapiens
uuuggaguaaauauauauguca

SEQ ID NO: 649016 - RNA, 16 nt, Homo sapiens
uuuggagucacuguag

SEQ ID NO: 649017 - RNA, 16 nt, Homo sapiens
uuuggaugauugucau

SEQ ID NO: 649018 - RNA, 14 nt, Homo sapiens
uuuggcaaugcuaa

SEQ ID NO: 649019 - RNA, 14 nt, Homo sapiens
uuuggccauuccaa

SEQ ID NO: 649020 - RNA, 18 nt, Homo sapiens
uuuggcuagguaucauuc

SEQ ID NO: 649021 - RNA, 18 nt, Homo sapiens
uuuggcuauaagugcuca

SEQ ID NO: 649022 - RNA, 21 nt, Homo sapiens
uuuggcucuucuaaucagagc

SEQ ID NO: 649023 - RNA, 22 nt, Homo sapiens
uuuggcugccuuuggaagucca

SEQ ID NO: 649024 - RNA, 18 nt, Homo sapiens
uuuggcuugcuguuuacu

SEQ ID NO: 649025 - RNA, 14 nt, Homo sapiens
uuugggaaccaagc

SEQ ID NO: 649026 - RNA, 21 nt, Homo sapiens
uuugggaaugagaacaugcaa

SEQ ID NO: 649027 - RNA, 11 nt, Homo sapiens
uuugggagaca

SEQ ID NO: 649028 - RNA, 19 nt, Homo sapiens
uuugggauagagaauguuc

SEQ ID NO: 649029 - RNA, 16 nt, Homo sapiens
uuugggcagacccuga

SEQ ID NO: 649030 - RNA, 19 nt, Homo sapiens
uuugggccccucagagccc

SEQ ID NO: 649031 - RNA, 13 nt, Homo sapiens
uuugggcugucuu

SEQ ID NO: 649032 - RNA, 19 nt, Homo sapiens
uuuggggacuuguagggau

SEQ ID NO: 649033 - RNA, 22 nt, Homo sapiens
uuuggggagaaauaaauuuugu

SEQ ID NO: 649034 - RNA, 19 nt, Homo sapiens
uuugggggaaaauggcacu

SEQ ID NO: 649035 - RNA, 20 nt, Homo sapiens
uuugggggaacuggacacaa

SEQ ID NO: 649036 - RNA, 21 nt, Homo sapiens
uuugggggauuaaagauguga

SEQ ID NO: 649037 - RNA, 20 nt, Homo sapiens
uuuggggggagagacacaga

SEQ ID NO: 649038 - RNA, 11 nt, Homo sapiens
uuugggguccu

SEQ ID NO: 649039 - RNA, 20 nt, Homo sapiens
uuugggguccuagcccagug

SEQ ID NO: 649040 - RNA, 20 nt, Homo sapiens
uuugggguugaaaauucaaa

SEQ ID NO: 649041 - RNA, 23 nt, Homo sapiens
uuuggguaaaaucuguaauugau

SEQ ID NO: 649042 - RNA, 19 nt, Homo sapiens
uuugguaaaaaugcugcuc

SEQ ID NO: 649043 - RNA, 19 nt, Homo sapiens
uuugguagaugcaugacuu

SEQ ID NO: 649044 - RNA, 21 nt, Homo sapiens
uuuggucaaguaguuugacuc

SEQ ID NO: 649045 - RNA, 18 nt, Homo sapiens
uuugguguuacacagccc

SEQ ID NO: 649046 - RNA, 16 nt, Homo sapiens
uuugguuaaacccaug

SEQ ID NO: 649047 - RNA, 17 nt, Homo sapiens
uuuguaaacgacaagaa

SEQ ID NO: 649048 - RNA, 16 nt, Homo sapiens
uuuguaaaguuagccu

SEQ ID NO: 649049 - RNA, 13 nt, Homo sapiens
uuuguaacuuuag

SEQ ID NO: 649050 - RNA, 17 nt, Homo sapiens
uuuguaauacuuuacaa

SEQ ID NO: 649051 - RNA, 16 nt, Homo sapiens
uuuguaaugcaaaagg

SEQ ID NO: 649052 - RNA, 20 nt, Homo sapiens
uuuguaaugcugcacagaaa

SEQ ID NO: 649053 - RNA, 22 nt, Homo sapiens
uuuguaaugggaacugccucuu

SEQ ID NO: 649054 - RNA, 11 nt, Homo sapiens
uuuguaccauu

SEQ ID NO: 649055 - RNA, 16 nt, Homo sapiens
uuuguagccagguacu

SEQ ID NO: 649056 - RNA, 21 nt, Homo sapiens
uuuguagguaauguuccugaa

SEQ ID NO: 649057 - RNA, 19 nt, Homo sapiens
uuuguaguguuauugccag

SEQ ID NO: 649058 - RNA, 19 nt, Homo sapiens
uuuguauaaaauagacaaa

SEQ ID NO: 649059 - RNA, 16 nt, Homo sapiens
uuuguauacacauaau

SEQ ID NO: 649060 - RNA, 22 nt, Homo sapiens
uuuguauauuuguaaacuacaa

SEQ ID NO: 649061 - RNA, 19 nt, Homo sapiens
uuuguauuaauaaagcauu

SEQ ID NO: 649062 - RNA, 20 nt, Homo sapiens
uuuguauuuugcauacucaa

SEQ ID NO: 649063 - RNA, 23 nt, Homo sapiens
uuugucagaggcacaaaaggguu

SEQ ID NO: 649064 - RNA, 21 nt, Homo sapiens
uuugucauauaagauucauau

SEQ ID NO: 649065 - RNA, 22 nt, Homo sapiens
uuuguccaucuugagaugguga

SEQ ID NO: 649066 - RNA, 22 nt, Homo sapiens
uuugucccggggcuccacugaa

SEQ ID NO: 649067 - RNA, 17 nt, Homo sapiens
uuugugaacgcugugau

SEQ ID NO: 649068 - RNA, 23 nt, Homo sapiens
uuugugacccugagaaggcaaaa

SEQ ID NO: 649069 - RNA, 16 nt, Homo sapiens
uuugugacuuuccuaa

SEQ ID NO: 649070 - RNA, 23 nt, Homo sapiens
uuugugccagaggaauccuggca

SEQ ID NO: 649071 - RNA, 15 nt, Homo sapiens
uuugugcuuugucca

SEQ ID NO: 649072 - RNA, 18 nt, Homo sapiens
uuuguggcaucuugccaa

SEQ ID NO: 649073 - RNA, 22 nt, Homo sapiens
uuuguggccuuggcugacauga

SEQ ID NO: 649074 - RNA, 22 nt, Homo sapiens
uuugugugaucauacaguuaug

SEQ ID NO: 649075 - RNA, 13 nt, Homo sapiens
uuugugugauuga

SEQ ID NO: 649076 - RNA, 20 nt, Homo sapiens
uuuguguguaccugugacua

SEQ ID NO: 649077 - RNA, 15 nt, Homo sapiens
uuugugugugugaua

SEQ ID NO: 649078 - RNA, 23 nt, Homo sapiens
uuuguuagauauuaggucccauc

SEQ ID NO: 649079 - RNA, 14 nt, Homo sapiens
uuuguugagccagg

SEQ ID NO: 649080 - RNA, 15 nt, Homo sapiens
uuuguugccaugugc

SEQ ID NO: 649081 - RNA, 12 nt, Homo sapiens
uuuguuguaaaa

SEQ ID NO: 649082 - RNA, 14 nt, Homo sapiens
uuuguuguauggaa

SEQ ID NO: 649083 - RNA, 22 nt, Homo sapiens
uuuguuguuugauucagcaaaa

SEQ ID NO: 649084 - RNA, 13 nt, Homo sapiens
uuuguuucaauga

SEQ ID NO: 649085 - RNA, 16 nt, Homo sapiens
uuuguuuccagcauga

SEQ ID NO: 649086 - RNA, 18 nt, Homo sapiens
uuuguuucuuucauauga

SEQ ID NO: 649087 - RNA, 14 nt, Homo sapiens
uuuguuugggauca

SEQ ID NO: 649088 - RNA, 18 nt, Homo sapiens
uuuguuuucagcacugau

SEQ ID NO: 649089 - RNA, 24 nt, Homo sapiens
uuuguuuugagacaaagacucacu

SEQ ID NO: 649090 - RNA, 22 nt, Homo sapiens
uuuguuuugauguuuguggccu

SEQ ID NO: 649091 - RNA, 18 nt, Homo sapiens
uuuguuuuuuaagggagg

SEQ ID NO: 649092 - RNA, 16 nt, Homo sapiens
uuuguuuuuuaaucuu

SEQ ID NO: 649093 - RNA, 23 nt, Homo sapiens
uuuuaaaaacuccuuuugguuua

SEQ ID NO: 649094 - RNA, 17 nt, Homo sapiens
uuuuaaaacauucacac

SEQ ID NO: 649095 - RNA, 18 nt, Homo sapiens
uuuuaaaagugccauuaa

SEQ ID NO: 649096 - RNA, 15 nt, Homo sapiens
uuuuaaaaguuucaa

SEQ ID NO: 649097 - RNA, 22 nt, Homo sapiens
uuuuaaaaguuucaaugugauu

SEQ ID NO: 649098 - RNA, 23 nt, Homo sapiens
uuuuaaaaugagagucacuugau

SEQ ID NO: 649099 - RNA, 22 nt, Homo sapiens
uuuuaaagacccaacuugccaa

SEQ ID NO: 649100 - RNA, 18 nt, Homo sapiens
uuuuaaagagcauggaaa

SEQ ID NO: 649101 - RNA, 21 nt, Homo sapiens
uuuuaaagccagaagucacau

SEQ ID NO: 649102 - RNA, 22 nt, Homo sapiens
augccuuucuguaaccaaaaau

SEQ ID NO: 649103 - RNA, 12 nt, Homo sapiens
augcggccaaag

SEQ ID NO: 649104 - RNA, 19 nt, Homo sapiens
augcgguucuuacagcaca

SEQ ID NO: 649105 - RNA, 14 nt, Homo sapiens
augcguauucugug

SEQ ID NO: 649106 - RNA, 14 nt, Homo sapiens
augcuaacaaagac

SEQ ID NO: 649107 - RNA, 23 nt, Homo sapiens
augcuaacccccaaauacucuga

SEQ ID NO: 649108 - RNA, 21 nt, Homo sapiens
augcuaagaaugcauuauuga

SEQ ID NO: 649109 - RNA, 22 nt, Homo sapiens
augcuagacagaaaccaagcca

SEQ ID NO: 649110 - RNA, 21 nt, Homo sapiens
augcuaugcugaagacauuca

SEQ ID NO: 649111 - RNA, 16 nt, Homo sapiens
augcuauuucacuuga

SEQ ID NO: 649112 - RNA, 12 nt, Homo sapiens
augcucacuuua

SEQ ID NO: 649113 - RNA, 19 nt, Homo sapiens
augcucaguuggugcugcu

SEQ ID NO: 649114 - RNA, 23 nt, Homo sapiens
augcucaguuggugcugcuuucu

SEQ ID NO: 649115 - RNA, 15 nt, Homo sapiens
augcucaugucccug

SEQ ID NO: 649116 - RNA, 17 nt, Homo sapiens
augcucccagcugugcu

SEQ ID NO: 649117 - RNA, 23 nt, Homo sapiens
augcucccuccccugcccugguc

SEQ ID NO: 649118 - RNA, 19 nt, Homo sapiens
augcucugccccaagcccc

SEQ ID NO: 649119 - RNA, 18 nt, Homo sapiens
augcucuggcuugcccca

SEQ ID NO: 649120 - RNA, 16 nt, Homo sapiens
augcugaacauugcau

SEQ ID NO: 649121 - RNA, 17 nt, Homo sapiens
augcugaagacauucaa

SEQ ID NO: 649122 - RNA, 20 nt, Homo sapiens
augcugcaggaaaagcaaaa

SEQ ID NO: 649123 - RNA, 18 nt, Homo sapiens
augcugcaggacuugaga

SEQ ID NO: 649124 - RNA, 21 nt, Homo sapiens
augcugcuauggaaggugcua

SEQ ID NO: 649125 - RNA, 17 nt, Homo sapiens
augcugcucauccaaag

SEQ ID NO: 649126 - RNA, 20 nt, Homo sapiens
augcugcugggccucugccu

SEQ ID NO: 649127 - RNA, 19 nt, Homo sapiens
augcugcuuuccccugugg

SEQ ID NO: 649128 - RNA, 20 nt, Homo sapiens
augcuggacggcauuccugc

SEQ ID NO: 649129 - RNA, 21 nt, Homo sapiens
augcuggcuuuucaccccaga

SEQ ID NO: 649130 - RNA, 18 nt, Homo sapiens
augcugggcccccagccu

SEQ ID NO: 649131 - RNA, 14 nt, Homo sapiens
augcuguacaugac

SEQ ID NO: 649132 - RNA, 18 nt, Homo sapiens
augcuguacguacugcau

SEQ ID NO: 649133 - RNA, 15 nt, Homo sapiens
augcugucaugugga

SEQ ID NO: 649134 - RNA, 17 nt, Homo sapiens
augcugucugaacaggu

SEQ ID NO: 649135 - RNA, 20 nt, Homo sapiens
augcugugcucaaucagccu

SEQ ID NO: 649136 - RNA, 15 nt, Homo sapiens
augcugugcucuuug

SEQ ID NO: 649137 - RNA, 19 nt, Homo sapiens
augcuguggcuccuuccua

SEQ ID NO: 649138 - RNA, 13 nt, Homo sapiens
cccacacugucca

SEQ ID NO: 649139 - RNA, 15 nt, Homo sapiens
cccacagaaccuuca

SEQ ID NO: 649140 - RNA, 13 nt, Homo sapiens
cccacagaccuca

SEQ ID NO: 649141 - RNA, 17 nt, Homo sapiens
cccacagcuaccugaga

SEQ ID NO: 649142 - RNA, 21 nt, Homo sapiens
cccacagcuucucuacagacu

SEQ ID NO: 649143 - RNA, 15 nt, Homo sapiens
cccacauaccaucug

SEQ ID NO: 649144 - RNA, 19 nt, Homo sapiens
cccacaugcuccagauuag

SEQ ID NO: 649145 - RNA, 11 nt, Homo sapiens
cccacauucua

SEQ ID NO: 649146 - RNA, 14 nt, Homo sapiens
cccacauucugaug

SEQ ID NO: 649147 - RNA, 22 nt, Homo sapiens
cccacauuugggcucaggguug

SEQ ID NO: 649148 - RNA, 15 nt, Homo sapiens
cccacauuuuccuua

SEQ ID NO: 649149 - RNA, 21 nt, Homo sapiens
cccaccaacucugcacuccau

SEQ ID NO: 649150 - RNA, 23 nt, Homo sapiens
cccaccaaugggccuccagagac

SEQ ID NO: 649151 - RNA, 16 nt, Homo sapiens
cccaccacugauauca

SEQ ID NO: 649152 - RNA, 13 nt, Homo sapiens
cccaccccaucca

SEQ ID NO: 649153 - RNA, 17 nt, Homo sapiens
cccacccccuucucugc

SEQ ID NO: 649154 - RNA, 21 nt, Homo sapiens
cccacccccuucucugcucca

SEQ ID NO: 649155 - RNA, 20 nt, Homo sapiens
cccacccgggagcagugucc

SEQ ID NO: 649156 - RNA, 22 nt, Homo sapiens
cccaccuauccccauucucugc

SEQ ID NO: 649157 - RNA, 15 nt, Homo sapiens
cccaccucacaguga

SEQ ID NO: 649158 - RNA, 13 nt, Homo sapiens
cccaccuccagcc

SEQ ID NO: 649159 - RNA, 21 nt, Homo sapiens
cccaccuugccagggcagggu

SEQ ID NO: 649160 - RNA, 22 nt, Homo sapiens
cccacgagggucaggacuguga

SEQ ID NO: 649161 - RNA, 12 nt, Homo sapiens
cccacuacugua

SEQ ID NO: 649162 - RNA, 14 nt, Homo sapiens
cccacuccagucca

SEQ ID NO: 649163 - RNA, 13 nt, Homo sapiens
cccacugccagca

SEQ ID NO: 649164 - RNA, 14 nt, Homo sapiens
cccacugcucauuu

SEQ ID NO: 649165 - RNA, 17 nt, Homo sapiens
cccacuguaugauuuau

SEQ ID NO: 649166 - RNA, 19 nt, Homo sapiens
cccacuuaugcugcuguga

SEQ ID NO: 649167 - RNA, 15 nt, Homo sapiens
cccacuucacuguga

SEQ ID NO: 649168 - RNA, 22 nt, Homo sapiens
cccacuugggccacacuaccca

SEQ ID NO: 649169 - RNA, 10 nt, Homo sapiens
cccacuuuga

SEQ ID NO: 649170 - RNA, 21 nt, Homo sapiens
cccagaaaaacuggcucugau

SEQ ID NO: 649171 - RNA, 17 nt, Homo sapiens
cccagaaacagugugca

SEQ ID NO: 649172 - RNA, 19 nt, Homo sapiens
cccagaaacagugugcaug

SEQ ID NO: 649173 - RNA, 13 nt, Homo sapiens
cccagacaauggc

SEQ ID NO: 649174 - RNA, 18 nt, Homo sapiens
cccagacaauuccauuca

SEQ ID NO: 649175 - RNA, 20 nt, Homo sapiens
cccagacaauuccauucaau

SEQ ID NO: 649176 - RNA, 19 nt, Homo sapiens
cccagacacagacuggcaa

SEQ ID NO: 649177 - RNA, 21 nt, Homo sapiens
cccagacaccaugugcaauaa

SEQ ID NO: 649178 - RNA, 13 nt, Homo sapiens
cccagacacuggc

SEQ ID NO: 649179 - RNA, 21 nt, Homo sapiens
cccagaccuguuagcagacag

SEQ ID NO: 649180 - RNA, 17 nt, Homo sapiens
cccagacuccaccguca

SEQ ID NO: 649181 - RNA, 13 nt, Homo sapiens
cccagacucugag

SEQ ID NO: 649182 - RNA, 16 nt, Homo sapiens
cccagagaacaaucac

SEQ ID NO: 649183 - RNA, 23 nt, Homo sapiens
cccagagaccccuuccuuuccuc

SEQ ID NO: 649184 - RNA, 15 nt, Homo sapiens
cccagagagagcucu

SEQ ID NO: 649185 - RNA, 16 nt, Homo sapiens
cccagagcacuuugca

SEQ ID NO: 649186 - RNA, 20 nt, Homo sapiens
cccagagcaggaagcauuca

SEQ ID NO: 649187 - RNA, 17 nt, Homo sapiens
cccagagggaguagaau

SEQ ID NO: 649188 - RNA, 15 nt, Homo sapiens
cccagagguggcccu

SEQ ID NO: 649189 - RNA, 15 nt, Homo sapiens
cccagauacauggug

SEQ ID NO: 649190 - RNA, 15 nt, Homo sapiens
cccagauacuuccca

SEQ ID NO: 649191 - RNA, 21 nt, Homo sapiens
cccagauagguggugccagug

SEQ ID NO: 649192 - RNA, 18 nt, Homo sapiens
cccagaugaucccaguca

SEQ ID NO: 649193 - RNA, 19 nt, Homo sapiens
cccagaugaucccagucac

SEQ ID NO: 649194 - RNA, 13 nt, Homo sapiens
cccagauguugca

SEQ ID NO: 649195 - RNA, 14 nt, Homo sapiens
cccagauguugcau

SEQ ID NO: 649196 - RNA, 12 nt, Homo sapiens
cccagcaaagag

SEQ ID NO: 649197 - RNA, 19 nt, Homo sapiens
cccagcacacgaguuccag

SEQ ID NO: 649198 - RNA, 11 nt, Homo sapiens
cccagcacuuu

SEQ ID NO: 649199 - RNA, 18 nt, Homo sapiens
cccagcacuuuagaucac

SEQ ID NO: 649200 - RNA, 12 nt, Homo sapiens
cccagcacuuug

SEQ ID NO: 649201 - RNA, 17 nt, Homo sapiens
cccagcagcucaagaag

SEQ ID NO: 649202 - RNA, 21 nt, Homo sapiens
cccagcaggcccagcaugcag

SEQ ID NO: 649203 - RNA, 15 nt, Homo sapiens
cccagcagggccuca

SEQ ID NO: 649204 - RNA, 22 nt, Homo sapiens
cccagcagugccuugugcaaug

SEQ ID NO: 649205 - RNA, 24 nt, Homo sapiens
cccagccacaguggccaaagaggc

SEQ ID NO: 649206 - RNA, 16 nt, Homo sapiens
cccagcccacccugcu

SEQ ID NO: 649207 - RNA, 16 nt, Homo sapiens
cccagcccagcucagc

SEQ ID NO: 649208 - RNA, 17 nt, Homo sapiens
cccagcccuauggaugu

SEQ ID NO: 649209 - RNA, 23 nt, Homo sapiens
cccagcccuccuuaucaaaggac

SEQ ID NO: 649210 - RNA, 15 nt, Homo sapiens
cccagccugaaagau

SEQ ID NO: 649211 - RNA, 13 nt, Homo sapiens
cccagccuggcca

SEQ ID NO: 649212 - RNA, 20 nt, Homo sapiens
cccagccuguggugcuugaa

SEQ ID NO: 649213 - RNA, 21 nt, Homo sapiens
cccagcgacacagaagggggu

SEQ ID NO: 649214 - RNA, 14 nt, Homo sapiens
cccagcuaccccuu

SEQ ID NO: 649215 - RNA, 21 nt, Homo sapiens
cccagcuccuuucuccuguga

SEQ ID NO: 649216 - RNA, 16 nt, Homo sapiens
cccagcucuggaugaa

SEQ ID NO: 649217 - RNA, 14 nt, Homo sapiens
cccagcuucaucuu

SEQ ID NO: 649218 - RNA, 13 nt, Homo sapiens
cccagcuugccaa

SEQ ID NO: 649219 - RNA, 22 nt, Homo sapiens
cccagcuuuuagaaaaugcagu

SEQ ID NO: 649220 - RNA, 20 nt, Homo sapiens
cccaggaaagaagcauuucu

SEQ ID NO: 649221 - RNA, 23 nt, Homo sapiens
cccaggaacaauaaaaugucuuc

SEQ ID NO: 649222 - RNA, 16 nt, Homo sapiens
cccaggaacugggcca

SEQ ID NO: 649223 - RNA, 21 nt, Homo sapiens
cccaggaaucugugugguaca

SEQ ID NO: 649224 - RNA, 17 nt, Homo sapiens
cccaggaccaagccaca

SEQ ID NO: 649225 - RNA, 16 nt, Homo sapiens
cccaggacugcauugu

SEQ ID NO: 649226 - RNA, 23 nt, Homo sapiens
cccaggagacagaccacuugcca

SEQ ID NO: 649227 - RNA, 13 nt, Homo sapiens
cccaggagcaaca

SEQ ID NO: 649228 - RNA, 23 nt, Homo sapiens
cccaggaggucgaccccaaagcc

SEQ ID NO: 649229 - RNA, 23 nt, Homo sapiens
cccaggagguggagguugcagug

SEQ ID NO: 649230 - RNA, 16 nt, Homo sapiens
cccaggaguguggcca

SEQ ID NO: 649231 - RNA, 15 nt, Homo sapiens
cccaggauacuggca

SEQ ID NO: 649232 - RNA, 14 nt, Homo sapiens
cccaggcaggucug

SEQ ID NO: 649233 - RNA, 21 nt, Homo sapiens
cccaggccccagacagggugg

SEQ ID NO: 649234 - RNA, 18 nt, Homo sapiens
cccaggcccuuggcugca

SEQ ID NO: 649235 - RNA, 16 nt, Homo sapiens
cccaggccugggaugc

SEQ ID NO: 649236 - RNA, 17 nt, Homo sapiens
cccaggcuagagugcaa

SEQ ID NO: 649237 - RNA, 18 nt, Homo sapiens
cccaggcugagccucagu

SEQ ID NO: 649238 - RNA, 14 nt, Homo sapiens
cccaggcugcacug

SEQ ID NO: 649239 - RNA, 21 nt, Homo sapiens
cccaggcugcuggagugcagu

SEQ ID NO: 649240 - RNA, 17 nt, Homo sapiens
cccaggcuggagugcag

SEQ ID NO: 649241 - RNA, 19 nt, Homo sapiens
cccaggcuggagugcagua

SEQ ID NO: 649242 - RNA, 23 nt, Homo sapiens
cauuagcugcccaggaugcugcu

SEQ ID NO: 649243 - RNA, 14 nt, Homo sapiens
cauuaggcaaagua

SEQ ID NO: 649244 - RNA, 18 nt, Homo sapiens
cauuaggcaaaguacaaa

SEQ ID NO: 649245 - RNA, 19 nt, Homo sapiens
cauuaggcaaaguacaaaa

SEQ ID NO: 649246 - RNA, 20 nt, Homo sapiens
cauuaggucccucacuccac

SEQ ID NO: 649247 - RNA, 16 nt, Homo sapiens
cauuagucucauguga

SEQ ID NO: 649248 - RNA, 17 nt, Homo sapiens
cauuauaaacgugauga

SEQ ID NO: 649249 - RNA, 20 nt, Homo sapiens
cauuauaugcacuagcaaua

SEQ ID NO: 649250 - RNA, 20 nt, Homo sapiens
cauuauccuugcuaugauga

SEQ ID NO: 649251 - RNA, 18 nt, Homo sapiens
cauuaucgagcagcauuu

SEQ ID NO: 649252 - RNA, 19 nt, Homo sapiens
cauuaucgagcagcauuuu

SEQ ID NO: 649253 - RNA, 19 nt, Homo sapiens
cauuaucuagauacuguau

SEQ ID NO: 649254 - RNA, 17 nt, Homo sapiens
cauuaucugaguugcau

SEQ ID NO: 649255 - RNA, 20 nt, Homo sapiens
cauuaugaaaaacaucccaa

SEQ ID NO: 649256 - RNA, 15 nt, Homo sapiens
cauuaugcaaaugga

SEQ ID NO: 649257 - RNA, 17 nt, Homo sapiens
cauuaugcaaauggaga

SEQ ID NO: 649258 - RNA, 16 nt, Homo sapiens
cauuaugccacuuccu

SEQ ID NO: 649259 - RNA, 21 nt, Homo sapiens
cauuaugugaguuuccugcua

SEQ ID NO: 649260 - RNA, 13 nt, Homo sapiens
cauuauuagcacu

SEQ ID NO: 649261 - RNA, 16 nt, Homo sapiens
cauuauuccuccagga

SEQ ID NO: 649262 - RNA, 16 nt, Homo sapiens
cauuauuuaauuugua

SEQ ID NO: 649263 - RNA, 18 nt, Homo sapiens
cauuauuucucucugacc

SEQ ID NO: 649264 - RNA, 15 nt, Homo sapiens
cauuauuuucuguca

SEQ ID NO: 649265 - RNA, 16 nt, Homo sapiens
cauuauuuucugucag

SEQ ID NO: 649266 - RNA, 16 nt, Homo sapiens
cauucaauauugacau

SEQ ID NO: 649267 - RNA, 21 nt, Homo sapiens
cauucaauauugacauuugua

SEQ ID NO: 649268 - RNA, 19 nt, Homo sapiens
cauucaggcaacgcacaaa

SEQ ID NO: 649269 - RNA, 22 nt, Homo sapiens
cauucagugauuacugucaagg

SEQ ID NO: 649270 - RNA, 15 nt, Homo sapiens
cauucaucuugcaag

SEQ ID NO: 649271 - RNA, 15 nt, Homo sapiens
cauuccaaauaugag

SEQ ID NO: 649272 - RNA, 14 nt, Homo sapiens
cauuccaccuuccc

SEQ ID NO: 649273 - RNA, 13 nt, Homo sapiens
cauuccauuugaa

SEQ ID NO: 649274 - RNA, 15 nt, Homo sapiens
cauuccauuuuguga

SEQ ID NO: 649275 - RNA, 19 nt, Homo sapiens
cauucccauguugucaaua

SEQ ID NO: 649276 - RNA, 17 nt, Homo sapiens
cauucccucucaucuca

SEQ ID NO: 649277 - RNA, 12 nt, Homo sapiens
cauuccuaacac

SEQ ID NO: 649278 - RNA, 21 nt, Homo sapiens
cauuccugaaagaaacaguua

SEQ ID NO: 649279 - RNA, 13 nt, Homo sapiens
cauuccugcucaa

SEQ ID NO: 649280 - RNA, 23 nt, Homo sapiens
cauuccuguagucaaaaucuggu

SEQ ID NO: 649281 - RNA, 18 nt, Homo sapiens
cauuccuuacuugcacug

SEQ ID NO: 649282 - RNA, 14 nt, Homo sapiens
cauucgagguguca

SEQ ID NO: 649283 - RNA, 17 nt, Homo sapiens
cauucggugugaacuuu

SEQ ID NO: 649284 - RNA, 14 nt, Homo sapiens
cauucuacugaaca

SEQ ID NO: 649285 - RNA, 17 nt, Homo sapiens
cauucuacuucagcuuu

SEQ ID NO: 649286 - RNA, 21 nt, Homo sapiens
cauucuauuccauguuugcac

SEQ ID NO: 649287 - RNA, 17 nt, Homo sapiens
cauucucaaagccucuu

SEQ ID NO: 649288 - RNA, 17 nt, Homo sapiens
cauucuccuuguguuac

SEQ ID NO: 649289 - RNA, 19 nt, Homo sapiens
cauucucgugagucauuua

SEQ ID NO: 649290 - RNA, 18 nt, Homo sapiens
cauucucugccuguacug

SEQ ID NO: 649291 - RNA, 12 nt, Homo sapiens
cauucucugucu

SEQ ID NO: 649292 - RNA, 14 nt, Homo sapiens
cauucugauccuca

SEQ ID NO: 649293 - RNA, 16 nt, Homo sapiens
cauucugaugagcaac

SEQ ID NO: 649294 - RNA, 20 nt, Homo sapiens
cauucugauucgaaugacac

SEQ ID NO: 649295 - RNA, 20 nt, Homo sapiens
cauucugccucuccucagga

SEQ ID NO: 649296 - RNA, 15 nt, Homo sapiens
cauucugcuucucau

SEQ ID NO: 649297 - RNA, 20 nt, Homo sapiens
cauucuguuuaucaagccau

SEQ ID NO: 649298 - RNA, 18 nt, Homo sapiens
cauucuuguucagauuaa

SEQ ID NO: 649299 - RNA, 18 nt, Homo sapiens
cauucuuuuucuguugaa

SEQ ID NO: 649300 - RNA, 14 nt, Homo sapiens
cauugaaagugaaa

SEQ ID NO: 649301 - RNA, 20 nt, Homo sapiens
cauugaaaucagcaugacaa

SEQ ID NO: 649302 - RNA, 22 nt, Homo sapiens
cauugaaaugcacagaucugcu

SEQ ID NO: 649303 - RNA, 10 nt, Homo sapiens
cauugaacaa

SEQ ID NO: 649304 - RNA, 16 nt, Homo sapiens
cauugaacacaaacug

SEQ ID NO: 649305 - RNA, 14 nt, Homo sapiens
cauugaacucacca

SEQ ID NO: 649306 - RNA, 22 nt, Homo sapiens
cauugaagaauguuagaguaau

SEQ ID NO: 649307 - RNA, 22 nt, Homo sapiens
cauugaagacccugucucaaaa

SEQ ID NO: 649308 - RNA, 20 nt, Homo sapiens
cauugaagauccgaguguga

SEQ ID NO: 649309 - RNA, 16 nt, Homo sapiens
cauugacaagaacuga

SEQ ID NO: 649310 - RNA, 18 nt, Homo sapiens
cauugagcaguuagcuca

SEQ ID NO: 649311 - RNA, 19 nt, Homo sapiens
cauugagccaguggugcua

SEQ ID NO: 649312 - RNA, 17 nt, Homo sapiens
cauugagucauuauccu

SEQ ID NO: 649313 - RNA, 17 nt, Homo sapiens
cauugauaaucuucagg

SEQ ID NO: 649314 - RNA, 14 nt, Homo sapiens
cauugaucugggau

SEQ ID NO: 649315 - RNA, 13 nt, Homo sapiens
cauugaugacccu

SEQ ID NO: 649316 - RNA, 17 nt, Homo sapiens
cauugauuuaauguaau

SEQ ID NO: 649317 - RNA, 14 nt, Homo sapiens
cauugcacuuuaua

SEQ ID NO: 649318 - RNA, 21 nt, Homo sapiens
cauugccacggaaacauacag

SEQ ID NO: 649319 - RNA, 18 nt, Homo sapiens
cauugcccgaaaccagag

SEQ ID NO: 649320 - RNA, 13 nt, Homo sapiens
cauugccuagcuc

SEQ ID NO: 649321 - RNA, 18 nt, Homo sapiens
cauugccuucuggagcug

SEQ ID NO: 649322 - RNA, 16 nt, Homo sapiens
cauugccuuugaaugu

SEQ ID NO: 649323 - RNA, 13 nt, Homo sapiens
cauugcugccaag

SEQ ID NO: 649324 - RNA, 19 nt, Homo sapiens
cauuggaauaaaacugucu

SEQ ID NO: 649325 - RNA, 15 nt, Homo sapiens
cauuggacuuccucc

SEQ ID NO: 649326 - RNA, 21 nt, Homo sapiens
cauuggagcaagcuugcccua

SEQ ID NO: 649327 - RNA, 20 nt, Homo sapiens
cauuggauucaucagcauuu

SEQ ID NO: 649328 - RNA, 12 nt, Homo sapiens
cauuggcuuaaa

SEQ ID NO: 649329 - RNA, 17 nt, Homo sapiens
cauugguaagaaugagc

SEQ ID NO: 649330 - RNA, 13 nt, Homo sapiens
cauugguguuguc

SEQ ID NO: 649331 - RNA, 18 nt, Homo sapiens
cauuguacuaccugugua

SEQ ID NO: 649332 - RNA, 13 nt, Homo sapiens
cauuguacuuaaa

SEQ ID NO: 649333 - RNA, 15 nt, Homo sapiens
cauuguagaaacaca

SEQ ID NO: 649334 - RNA, 22 nt, Homo sapiens
cauuguagccucaaucgaguga

SEQ ID NO: 649335 - RNA, 23 nt, Homo sapiens
cccaggcuggagugcagugccac

SEQ ID NO: 649336 - RNA, 15 nt, Homo sapiens
cccaggcugggaacu

SEQ ID NO: 649337 - RNA, 14 nt, Homo sapiens
cccaggcugucacc

SEQ ID NO: 649338 - RNA, 17 nt, Homo sapiens
cccaggcugugcagcgc

SEQ ID NO: 649339 - RNA, 14 nt, Homo sapiens
cccagggaaggugg

SEQ ID NO: 649340 - RNA, 15 nt, Homo sapiens
cccagggaucacugg

SEQ ID NO: 649341 - RNA, 14 nt, Homo sapiens
cccagggcaacaag

SEQ ID NO: 649342 - RNA, 24 nt, Homo sapiens
cccagggcacuacauaauugcugu

SEQ ID NO: 649343 - RNA, 15 nt, Homo sapiens
cccagggcagggugg

SEQ ID NO: 649344 - RNA, 22 nt, Homo sapiens
cccagggccuccugggggaccu

SEQ ID NO: 649345 - RNA, 20 nt, Homo sapiens
cccagggccugggggcagug

SEQ ID NO: 649346 - RNA, 21 nt, Homo sapiens
cccagggcuaguauaaacaug

SEQ ID NO: 649347 - RNA, 21 nt, Homo sapiens
cccagggcugcgucugcaaag

SEQ ID NO: 649348 - RNA, 19 nt, Homo sapiens
cccaggggccggccagugg

SEQ ID NO: 649349 - RNA, 15 nt, Homo sapiens
cccagggggccuuuc

SEQ ID NO: 649350 - RNA, 10 nt, Homo sapiens
cccagggugg

SEQ ID NO: 649351 - RNA, 15 nt, Homo sapiens
cccagguaccacccu

SEQ ID NO: 649352 - RNA, 18 nt, Homo sapiens
cccccacgugacagugcc

SEQ ID NO: 649353 - RNA, 12 nt, Homo sapiens
cccccacuccag

SEQ ID NO: 649354 - RNA, 12 nt, Homo sapiens
cccccagcacuu

SEQ ID NO: 649355 - RNA, 17 nt, Homo sapiens
cccccagccugccaaau

SEQ ID NO: 649356 - RNA, 22 nt, Homo sapiens
cccccaguccuguccuaucacu

SEQ ID NO: 649357 - RNA, 15 nt, Homo sapiens
ccccccagugugcaa

SEQ ID NO: 649358 - RNA, 13 nt, Homo sapiens
cccccgccaaaag

SEQ ID NO: 649359 - RNA, 14 nt, Homo sapiens
cccccgccaccuca

SEQ ID NO: 649360 - RNA, 13 nt, Homo sapiens
cccccuucacaaa

SEQ ID NO: 649361 - RNA, 17 nt, Homo sapiens
cccccuuucacacugga

SEQ ID NO: 649362 - RNA, 22 nt, Homo sapiens
ccccgaaucacacagacaguuu

SEQ ID NO: 649363 - RNA, 19 nt, Homo sapiens
ccccgagcccaggcagcua

SEQ ID NO: 649364 - RNA, 22 nt, Homo sapiens
ccccgauugaaagaaccagaga

SEQ ID NO: 649365 - RNA, 12 nt, Homo sapiens
ccccgcacugug

SEQ ID NO: 649366 - RNA, 16 nt, Homo sapiens
ccccgcccagugcagu

SEQ ID NO: 649367 - RNA, 22 nt, Homo sapiens
ccccgcucccagauguaaagaa

SEQ ID NO: 649368 - RNA, 22 nt, Homo sapiens
cccucuggaguggccacuaagc

SEQ ID NO: 649369 - RNA, 17 nt, Homo sapiens
cccucuggguuccagca

SEQ ID NO: 649370 - RNA, 19 nt, Homo sapiens
cccucugucauccucagga

SEQ ID NO: 649371 - RNA, 21 nt, Homo sapiens
cccucuguggccugucucuau

SEQ ID NO: 649372 - RNA, 12 nt, Homo sapiens
cccucugugguc

SEQ ID NO: 649373 - RNA, 15 nt, Homo sapiens
cccucuuaucucauc

SEQ ID NO: 649374 - RNA, 14 nt, Homo sapiens
cccucuucaaagca

SEQ ID NO: 649375 - RNA, 14 nt, Homo sapiens
cccucuuucccacc

SEQ ID NO: 649376 - RNA, 14 nt, Homo sapiens
cccucuuugcugca

SEQ ID NO: 649377 - RNA, 22 nt, Homo sapiens
cccucuuuucugaucugcaguu

SEQ ID NO: 649378 - RNA, 23 nt, Homo sapiens
cccucuuuucugaucugcaguuu

SEQ ID NO: 649379 - RNA, 17 nt, Homo sapiens
cccugaaaacccagaga

SEQ ID NO: 649380 - RNA, 16 nt, Homo sapiens
cccugaaacacugcuu

SEQ ID NO: 649381 - RNA, 19 nt, Homo sapiens
cccugaaacaucucaacaa

SEQ ID NO: 649382 - RNA, 14 nt, Homo sapiens
cccugaaagacuga

SEQ ID NO: 649383 - RNA, 16 nt, Homo sapiens
cccugaaccacgaggc

SEQ ID NO: 649384 - RNA, 16 nt, Homo sapiens
cccugaagaaauccug

SEQ ID NO: 649385 - RNA, 20 nt, Homo sapiens
cccugaccucacugugaccu

SEQ ID NO: 649386 - RNA, 11 nt, Homo sapiens
cccugaccucc

SEQ ID NO: 649387 - RNA, 16 nt, Homo sapiens
cccugaccucccagcc

SEQ ID NO: 649388 - RNA, 16 nt, Homo sapiens
cccugacucaucauuu

SEQ ID NO: 649389 - RNA, 21 nt, Homo sapiens
cccugacugggaguugaucgc

SEQ ID NO: 649390 - RNA, 21 nt, Homo sapiens
cccugagacagacacacagcc

SEQ ID NO: 649391 - RNA, 19 nt, Homo sapiens
cccugagcaggaaaguuua

SEQ ID NO: 649392 - RNA, 18 nt, Homo sapiens
cccugagcuuucugcuau

SEQ ID NO: 649393 - RNA, 23 nt, Homo sapiens
cccugagcuuuguccugaaggaa

SEQ ID NO: 649394 - RNA, 18 nt, Homo sapiens
cccugaggaaugaaaaag

SEQ ID NO: 649395 - RNA, 17 nt, Homo sapiens
cccugaucuagugcagu

SEQ ID NO: 649396 - RNA, 18 nt, Homo sapiens
cccugaucuagugcagua

SEQ ID NO: 649397 - RNA, 19 nt, Homo sapiens
cccugauuguguauauuca

SEQ ID NO: 649398 - RNA, 17 nt, Homo sapiens
cccugcaaacagaacag

SEQ ID NO: 649399 - RNA, 13 nt, Homo sapiens
cccugcaaucacu

SEQ ID NO: 649400 - RNA, 15 nt, Homo sapiens
cccugcccaaugaga

SEQ ID NO: 649401 - RNA, 16 nt, Homo sapiens
cccugcccauacugag

SEQ ID NO: 649402 - RNA, 17 nt, Homo sapiens
cccugcccauacugagc

SEQ ID NO: 649403 - RNA, 23 nt, Homo sapiens
cccugccccagcuggggaaauca

SEQ ID NO: 649404 - RNA, 15 nt, Homo sapiens
cccugccccugccuu

SEQ ID NO: 649405 - RNA, 20 nt, Homo sapiens
cccugcccuccccucucugc

SEQ ID NO: 649406 - RNA, 17 nt, Homo sapiens
cccugcccucucccaaa

SEQ ID NO: 649407 - RNA, 15 nt, Homo sapiens
cccugcccuggucca

SEQ ID NO: 649408 - RNA, 21 nt, Homo sapiens
cccugccgggacccugcucac

SEQ ID NO: 649409 - RNA, 22 nt, Homo sapiens
cccugccugccucuuggccuca

SEQ ID NO: 649410 - RNA, 23 nt, Homo sapiens
cccugccuguuaaggaaacuuua

SEQ ID NO: 649411 - RNA, 14 nt, Homo sapiens
cccugccuugccgc

SEQ ID NO: 649412 - RNA, 16 nt, Homo sapiens
cccugcgggccagggu

SEQ ID NO: 649413 - RNA, 19 nt, Homo sapiens
cccugcgggugaacaaagc

SEQ ID NO: 649414 - RNA, 15 nt, Homo sapiens
cccugcucauccacu

SEQ ID NO: 649415 - RNA, 17 nt, Homo sapiens
cccugcugugugacuuu

SEQ ID NO: 649416 - RNA, 12 nt, Homo sapiens
cccugcuugcac

SEQ ID NO: 649417 - RNA, 18 nt, Homo sapiens
cccuggaccauuccagga

SEQ ID NO: 649418 - RNA, 14 nt, Homo sapiens
cccuggagcaagac

SEQ ID NO: 649419 - RNA, 17 nt, Homo sapiens
cccuggagcaagaccug

SEQ ID NO: 649420 - RNA, 20 nt, Homo sapiens
cccuggagcccauccagucu

SEQ ID NO: 649421 - RNA, 16 nt, Homo sapiens
cccuggccagcucuga

SEQ ID NO: 649422 - RNA, 15 nt, Homo sapiens
cccuggcccaucuca

SEQ ID NO: 649423 - RNA, 19 nt, Homo sapiens
cccuggccuccccugccac

SEQ ID NO: 649424 - RNA, 14 nt, Homo sapiens
cccugggacaucag

SEQ ID NO: 649425 - RNA, 20 nt, Homo sapiens
cccugggccaaaaccaaugc

SEQ ID NO: 649426 - RNA, 14 nt, Homo sapiens
cccugggccagggu

SEQ ID NO: 649427 - RNA, 18 nt, Homo sapiens
cccugggcuggaggcuga

SEQ ID NO: 649428 - RNA, 19 nt, Homo sapiens
cccuguagacuagugccgu

SEQ ID NO: 649429 - RNA, 14 nt, Homo sapiens
cccuguauuaccuc

SEQ ID NO: 649430 - RNA, 15 nt, Homo sapiens
cccugucccaugcag

SEQ ID NO: 649431 - RNA, 19 nt, Homo sapiens
cccuguccuaagcacuuua

SEQ ID NO: 649432 - RNA, 17 nt, Homo sapiens
cccuguccuuugcaauu

SEQ ID NO: 649433 - RNA, 14 nt, Homo sapiens
cccugucucaaaaa

SEQ ID NO: 649434 - RNA, 16 nt, Homo sapiens
cccugucucccaaaaa

SEQ ID NO: 649435 - RNA, 22 nt, Homo sapiens
cccugucucuacuaaaaauaca

SEQ ID NO: 649436 - RNA, 14 nt, Homo sapiens
cccugucugaagga

SEQ ID NO: 649437 - RNA, 17 nt, Homo sapiens
cccugucuuccacagcc

SEQ ID NO: 649438 - RNA, 12 nt, Homo sapiens
cccugucuugcu

SEQ ID NO: 649439 - RNA, 12 nt, Homo sapiens
cccugugcaacc

SEQ ID NO: 649440 - RNA, 18 nt, Homo sapiens
cccuguggcccuggccac

SEQ ID NO: 649441 - RNA, 13 nt, Homo sapiens
cccugugggucaa

SEQ ID NO: 649442 - RNA, 13 nt, Homo sapiens
cccugugguugcc

SEQ ID NO: 649443 - RNA, 13 nt, Homo sapiens
cccugugugauau

SEQ ID NO: 649444 - RNA, 20 nt, Homo sapiens
cccuguguugucccaucugc

SEQ ID NO: 649445 - RNA, 15 nt, Homo sapiens
cccuguuggcagcuc

SEQ ID NO: 649446 - RNA, 16 nt, Homo sapiens
cccuuaaacuuccaaa

SEQ ID NO: 649447 - RNA, 22 nt, Homo sapiens
cccuuaacugacaugggccuuu

SEQ ID NO: 649448 - RNA, 20 nt, Homo sapiens
cccuuaauauugaggcugca

SEQ ID NO: 649449 - RNA, 20 nt, Homo sapiens
cccuuaauuauuaacaaagu

SEQ ID NO: 649450 - RNA, 21 nt, Homo sapiens
cccuuaccugaaccagccugg

SEQ ID NO: 649451 - RNA, 14 nt, Homo sapiens
cccuuauacagugg

SEQ ID NO: 649452 - RNA, 16 nt, Homo sapiens
cccuuaucaccagcug

SEQ ID NO: 649453 - RNA, 16 nt, Homo sapiens
cccuuauuuucaagaa

SEQ ID NO: 649454 - RNA, 12 nt, Homo sapiens
cccuucaaaagc

SEQ ID NO: 649455 - RNA, 22 nt, Homo sapiens
cccuucaaccauuccccauggg

SEQ ID NO: 649456 - RNA, 19 nt, Homo sapiens
cccuucaaggccuccccaa

SEQ ID NO: 649457 - RNA, 11 nt, Homo sapiens
cccuucacugu

SEQ ID NO: 649458 - RNA, 16 nt, Homo sapiens
cccuucacugucacca

SEQ ID NO: 649459 - RNA, 12 nt, Homo sapiens
cccuucagggau

SEQ ID NO: 649460 - RNA, 12 nt, Homo sapiens
cccuuccagugg

SEQ ID NO: 649461 - RNA, 14 nt, Homo sapiens
cccuucccaguggg

SEQ ID NO: 649462 - RNA, 16 nt, Homo sapiens
cccuucccucugggca

SEQ ID NO: 649463 - RNA, 18 nt, Homo sapiens
cccuucccuguccuugcc

SEQ ID NO: 649464 - RNA, 16 nt, Homo sapiens
cccuuccuaagucugu

SEQ ID NO: 649465 - RNA, 23 nt, Homo sapiens
cccuuccuauucuccugccaugg

SEQ ID NO: 649466 - RNA, 13 nt, Homo sapiens
cccuuccuggaaa

SEQ ID NO: 649467 - RNA, 17 nt, Homo sapiens
cccuucuugggucugcc

SEQ ID NO: 649468 - RNA, 17 nt, Homo sapiens
cccuucuuuacuuccca

SEQ ID NO: 649469 - RNA, 13 nt, Homo sapiens
cccuucuuugcag

SEQ ID NO: 649470 - RNA, 23 nt, Homo sapiens
cccuugaauuucuagacaguauu

SEQ ID NO: 649471 - RNA, 23 nt, Homo sapiens
cccuugccauccuaaaagccacc

SEQ ID NO: 649472 - RNA, 22 nt, Homo sapiens
cccuugcuuagccugugcugga

SEQ ID NO: 649473 - RNA, 18 nt, Homo sapiens
cccuuggaaaacaaaagu

SEQ ID NO: 649474 - RNA, 18 nt, Homo sapiens
cccuuggggguucaggga

SEQ ID NO: 649475 - RNA, 17 nt, Homo sapiens
cccuugguucugcacug

SEQ ID NO: 649476 - RNA, 17 nt, Homo sapiens
ccucaggcccagcugcu

SEQ ID NO: 649477 - RNA, 15 nt, Homo sapiens
ccucaggggccucuc

SEQ ID NO: 649478 - RNA, 15 nt, Homo sapiens
ccucagguaguacug

SEQ ID NO: 649479 - RNA, 17 nt, Homo sapiens
ccucagugcauccccac

SEQ ID NO: 649480 - RNA, 22 nt, Homo sapiens
ccucaguuuccucaucugcaaa

SEQ ID NO: 649481 - RNA, 14 nt, Homo sapiens
ccucauaccaugga

SEQ ID NO: 649482 - RNA, 20 nt, Homo sapiens
ccucauauggcccaguguca

SEQ ID NO: 649483 - RNA, 19 nt, Homo sapiens
ccucaucaguguguaaaua

SEQ ID NO: 649484 - RNA, 14 nt, Homo sapiens
ccucauccaaaguu

SEQ ID NO: 649485 - RNA, 19 nt, Homo sapiens
ccucaugaaaacacacaua

SEQ ID NO: 649486 - RNA, 17 nt, Homo sapiens
ccucauggagaccucau

SEQ ID NO: 649487 - RNA, 18 nt, Homo sapiens
ccucauggcucuggcaca

SEQ ID NO: 649488 - RNA, 21 nt, Homo sapiens
ccucauuacugggccuuagug

SEQ ID NO: 649489 - RNA, 19 nt, Homo sapiens
ccucauuagcauuuugcua

SEQ ID NO: 649490 - RNA, 20 nt, Homo sapiens
ccucauuagcauuuugcuaa

SEQ ID NO: 649491 - RNA, 15 nt, Homo sapiens
ccucauuaguaauaa

SEQ ID NO: 649492 - RNA, 18 nt, Homo sapiens
ccucauucagagacugcc

SEQ ID NO: 649493 - RNA, 13 nt, Homo sapiens
ccucauucaucuu

SEQ ID NO: 649494 - RNA, 20 nt, Homo sapiens
ccucauuccggccacaucau

SEQ ID NO: 649495 - RNA, 19 nt, Homo sapiens
ccucauugcugucuugccc

SEQ ID NO: 649496 - RNA, 22 nt, Homo sapiens
ccucauuuaaguaaaagguuag

SEQ ID NO: 649497 - RNA, 19 nt, Homo sapiens
ccuccaaaucugauuucau

SEQ ID NO: 649498 - RNA, 13 nt, Homo sapiens
ccuccaaaugcca

SEQ ID NO: 649499 - RNA, 16 nt, Homo sapiens
ccuccaaaugccaacu

SEQ ID NO: 649500 - RNA, 14 nt, Homo sapiens
ccuccaacaccaag

SEQ ID NO: 649501 - RNA, 13 nt, Homo sapiens
ccuccaagcauuu

SEQ ID NO: 649502 - RNA, 20 nt, Homo sapiens
ccuccaagcuccaucuccac

SEQ ID NO: 649503 - RNA, 17 nt, Homo sapiens
ccuccaaucuugagauu

SEQ ID NO: 649504 - RNA, 21 nt, Homo sapiens
ccuccacaaagcaaaggcagu

SEQ ID NO: 649505 - RNA, 19 nt, Homo sapiens
ccuccacagcuaccucuuc

SEQ ID NO: 649506 - RNA, 20 nt, Homo sapiens
ccuccaccuccuaggcucaa

SEQ ID NO: 649507 - RNA, 22 nt, Homo sapiens
ccuccacgguccgcggccugca

SEQ ID NO: 649508 - RNA, 12 nt, Homo sapiens
ccuccacuccac

SEQ ID NO: 649509 - RNA, 18 nt, Homo sapiens
ccuccagaagcugcuccu

SEQ ID NO: 649510 - RNA, 16 nt, Homo sapiens
ccuccagaauggagcu

SEQ ID NO: 649511 - RNA, 17 nt, Homo sapiens
ccuccagagaccccagg

SEQ ID NO: 649512 - RNA, 19 nt, Homo sapiens
ccuccagagaccccaggaa

SEQ ID NO: 649513 - RNA, 15 nt, Homo sapiens
ccuccagcauuuaaa

SEQ ID NO: 649514 - RNA, 20 nt, Homo sapiens
ccuccagcucaugacacugu

SEQ ID NO: 649515 - RNA, 17 nt, Homo sapiens
ccuccagcuucaggcag

SEQ ID NO: 649516 - RNA, 10 nt, Homo sapiens
ccuccaggga

SEQ ID NO: 649517 - RNA, 23 nt, Homo sapiens
ccuccaggugugcacguggcaug

SEQ ID NO: 649518 - RNA, 19 nt, Homo sapiens
ccuccagugcaguccauuu

SEQ ID NO: 649519 - RNA, 15 nt, Homo sapiens
ccuccauaugcugua

SEQ ID NO: 649520 - RNA, 22 nt, Homo sapiens
ccuccauaugcuguacaugaca

SEQ ID NO: 649521 - RNA, 22 nt, Homo sapiens
ccuccaucaccugaaacacugg

SEQ ID NO: 649522 - RNA, 16 nt, Homo sapiens
ccuccaugugggugcu

SEQ ID NO: 649523 - RNA, 12 nt, Homo sapiens
ccuccauucuga

SEQ ID NO: 649524 - RNA, 18 nt, Homo sapiens
ccucccaaaauacuggga

SEQ ID NO: 649525 - RNA, 20 nt, Homo sapiens
ccucccaaagugcugagauu

SEQ ID NO: 649526 - RNA, 19 nt, Homo sapiens
ccucccaagguccucucag

SEQ ID NO: 649527 - RNA, 16 nt, Homo sapiens
ccucccaaucuugccc

SEQ ID NO: 649528 - RNA, 17 nt, Homo sapiens
ccucccacggugcccaa

SEQ ID NO: 649529 - RNA, 21 nt, Homo sapiens
ccucccagagugcugggauua

SEQ ID NO: 649530 - RNA, 16 nt, Homo sapiens
ccucccaggcucaagc

SEQ ID NO: 649531 - RNA, 17 nt, Homo sapiens
ccucccagucucaucuc

SEQ ID NO: 649532 - RNA, 19 nt, Homo sapiens
ccucccagucucaucuccu

SEQ ID NO: 649533 - RNA, 20 nt, Homo sapiens
ccucccagugugcugggauu

SEQ ID NO: 649534 - RNA, 20 nt, Homo sapiens
ccucccaugcgggugcacac

SEQ ID NO: 649535 - RNA, 12 nt, Homo sapiens
ccucccauguca

SEQ ID NO: 649536 - RNA, 24 nt, Homo sapiens
ccucccauuacuuugauaucugau

SEQ ID NO: 649537 - RNA, 14 nt, Homo sapiens
ccuccccacccucc

SEQ ID NO: 649538 - RNA, 15 nt, Homo sapiens
ccuccccagauauca

SEQ ID NO: 649539 - RNA, 21 nt, Homo sapiens
ccuccccagcgccaucugugu

SEQ ID NO: 649540 - RNA, 18 nt, Homo sapiens
ccuccccgugccaaaaau

SEQ ID NO: 649541 - RNA, 23 nt, Homo sapiens
ccuccccuuuuaugcacuucaaa

SEQ ID NO: 649542 - RNA, 20 nt, Homo sapiens
ccucccggguucgcaccauu

SEQ ID NO: 649543 - RNA, 21 nt, Homo sapiens
ccucccuagccagcacuugua

SEQ ID NO: 649544 - RNA, 14 nt, Homo sapiens
ccucccucauucca

SEQ ID NO: 649545 - RNA, 16 nt, Homo sapiens
ccucccucuacucuuc

SEQ ID NO: 649546 - RNA, 15 nt, Homo sapiens
ccucccucuuuccca

SEQ ID NO: 649547 - RNA, 16 nt, Homo sapiens
ccucccugacuuuucu

SEQ ID NO: 649548 - RNA, 17 nt, Homo sapiens
ccucccugccugcuccu

SEQ ID NO: 649549 - RNA, 20 nt, Homo sapiens
ccucccugcgcccuugaggg

SEQ ID NO: 649550 - RNA, 16 nt, Homo sapiens
ccucccuuucugggag

SEQ ID NO: 649551 - RNA, 13 nt, Homo sapiens
ccucccuuugaug

SEQ ID NO: 649552 - RNA, 17 nt, Homo sapiens
ccuccggcgucuugccc

SEQ ID NO: 649553 - RNA, 15 nt, Homo sapiens
ccuccgggaggucau

SEQ ID NO: 649554 - RNA, 14 nt, Homo sapiens
ccuccgucauccau

SEQ ID NO: 649555 - RNA, 15 nt, Homo sapiens
ccuccgucuucccag

SEQ ID NO: 649556 - RNA, 11 nt, Homo sapiens
ccuccuacccu

SEQ ID NO: 649557 - RNA, 13 nt, Homo sapiens
ccuccuacuguau

SEQ ID NO: 649558 - RNA, 16 nt, Homo sapiens
ccuccuagagugcagg

SEQ ID NO: 649559 - RNA, 21 nt, Homo sapiens
ccuccuagccccuucuuccaa

SEQ ID NO: 649560 - RNA, 15 nt, Homo sapiens
ccuccuccacuugga

SEQ ID NO: 649561 - RNA, 23 nt, Homo sapiens
ccuccuccagccgccaugcuccu

SEQ ID NO: 649562 - RNA, 18 nt, Homo sapiens
ccuccucccuaaugcuca

SEQ ID NO: 649563 - RNA, 19 nt, Homo sapiens
ccuccucggaucaccgaga

SEQ ID NO: 649564 - RNA, 21 nt, Homo sapiens
ccuccucucaguguuuuggac

SEQ ID NO: 649565 - RNA, 16 nt, Homo sapiens
ccuccugacagcaaua

SEQ ID NO: 649566 - RNA, 20 nt, Homo sapiens
ccuccugauggagugugcag

SEQ ID NO: 649567 - RNA, 14 nt, Homo sapiens
ccuccugcacacag

SEQ ID NO: 649568 - RNA, 16 nt, Homo sapiens
ccuccugcacacaggg

SEQ ID NO: 649569 - RNA, 19 nt, Homo sapiens
ccuccuggagcucuguggg

SEQ ID NO: 649570 - RNA, 16 nt, Homo sapiens
ccuccuggcugucuga

SEQ ID NO: 649571 - RNA, 17 nt, Homo sapiens
ccuccugggaacacauc

SEQ ID NO: 649572 - RNA, 16 nt, Homo sapiens
ccuccugggcccucuc

SEQ ID NO: 649573 - RNA, 13 nt, Homo sapiens
ccuccuguaaaug

SEQ ID NO: 649574 - RNA, 15 nt, Homo sapiens
ccuccuguaaauggu

SEQ ID NO: 649575 - RNA, 19 nt, Homo sapiens
ccuccugugacccgugaau

SEQ ID NO: 649576 - RNA, 23 nt, Homo sapiens
ccuccugugccucccuuuucucc

SEQ ID NO: 649577 - RNA, 14 nt, Homo sapiens
ccuccuucgggaca

SEQ ID NO: 649578 - RNA, 13 nt, Homo sapiens
ccuccuucucugc

SEQ ID NO: 649579 - RNA, 12 nt, Homo sapiens
ccuccuugcaac

SEQ ID NO: 649580 - RNA, 23 nt, Homo sapiens
ccuccuuggcggcaaaagcccau

SEQ ID NO: 649581 - RNA, 16 nt, Homo sapiens
ccuccuuugccuucca

SEQ ID NO: 649582 - RNA, 16 nt, Homo sapiens
ccuccuuugcuggcau

SEQ ID NO: 649583 - RNA, 15 nt, Homo sapiens
ccuccuuuugcuuga

SEQ ID NO: 649584 - RNA, 19 nt, Homo sapiens
ccucgacguuuacaagccc

SEQ ID NO: 649585 - RNA, 19 nt, Homo sapiens
ccucgcaacccugccuguc

SEQ ID NO: 649586 - RNA, 14 nt, Homo sapiens
ccucgcacacaggg

SEQ ID NO: 649587 - RNA, 14 nt, Homo sapiens
ccucgcggucuugg

SEQ ID NO: 649588 - RNA, 21 nt, Homo sapiens
ccucgcuuggacggcugggca

SEQ ID NO: 649589 - RNA, 16 nt, Homo sapiens
ccucguagccaucucu

SEQ ID NO: 649590 - RNA, 21 nt, Homo sapiens
ccucgucaagagcaugcacau

SEQ ID NO: 649591 - RNA, 22 nt, Homo sapiens
ccucguuggaagaggaacagca

SEQ ID NO: 649592 - RNA, 19 nt, Homo sapiens
ccucguugggccgcucuga

SEQ ID NO: 649593 - RNA, 16 nt, Homo sapiens
ccucuacaauuugcca

SEQ ID NO: 649594 - RNA, 17 nt, Homo sapiens
ccucuacuguugcacag

SEQ ID NO: 649595 - RNA, 16 nt, Homo sapiens
ccucuacuuaaugaga

SEQ ID NO: 649596 - RNA, 15 nt, Homo sapiens
ccucuaguaguauau

SEQ ID NO: 649597 - RNA, 14 nt, Homo sapiens
ccucucaacugccu

SEQ ID NO: 649598 - RNA, 16 nt, Homo sapiens
ccucucacuagugcca

SEQ ID NO: 649599 - RNA, 18 nt, Homo sapiens
ccucucucacacaucaca

SEQ ID NO: 649600 - RNA, 20 nt, Homo sapiens
ccucucucuaccagucuauu

SEQ ID NO: 649601 - RNA, 12 nt, Homo sapiens
ccucucucucag

SEQ ID NO: 649602 - RNA, 19 nt, Homo sapiens
ccucucucuucugcuccac

SEQ ID NO: 649603 - RNA, 12 nt, Homo sapiens
ccucucugcucu

SEQ ID NO: 649604 - RNA, 16 nt, Homo sapiens
ccucucuuaaaugcaa

SEQ ID NO: 649605 - RNA, 21 nt, Homo sapiens
ccucugacauuuauccaagac

SEQ ID NO: 649606 - RNA, 19 nt, Homo sapiens
ccucugacccuagcucuuu

SEQ ID NO: 649607 - RNA, 16 nt, Homo sapiens
ccucugacccuccuuc

SEQ ID NO: 649608 - RNA, 18 nt, Homo sapiens
ccucugacgcaccacugc

SEQ ID NO: 649609 - RNA, 21 nt, Homo sapiens
ccucugacuuaagcugccuca

SEQ ID NO: 649610 - RNA, 18 nt, Homo sapiens
ccucugaggcacucaucu

SEQ ID NO: 649611 - RNA, 21 nt, Homo sapiens
ccucugauuuccuucugcuau

SEQ ID NO: 649612 - RNA, 17 nt, Homo sapiens
ccucugcagcacuuuaa

SEQ ID NO: 649613 - RNA, 22 nt, Homo sapiens
ccucugcauggaacagcauuac

SEQ ID NO: 649614 - RNA, 14 nt, Homo sapiens
ccucugcauuuaca

SEQ ID NO: 649615 - RNA, 20 nt, Homo sapiens
ccucugcccaaccagguugc

SEQ ID NO: 649616 - RNA, 12 nt, Homo sapiens
ccucugccucaa

SEQ ID NO: 649617 - RNA, 14 nt, Homo sapiens
ccucugcugggacu

SEQ ID NO: 649618 - RNA, 16 nt, Homo sapiens
ccucugcuguucagga

SEQ ID NO: 649619 - RNA, 13 nt, Homo sapiens
ccucuggacaaag

SEQ ID NO: 649620 - RNA, 15 nt, Homo sapiens
ccucuggacacagcc

SEQ ID NO: 649621 - RNA, 14 nt, Homo sapiens
ccucuggacuggcc

SEQ ID NO: 649622 - RNA, 15 nt, Homo sapiens
ccucuggauucccuu

SEQ ID NO: 649623 - RNA, 21 nt, Homo sapiens
ccucuggccaaauaugcacuu

SEQ ID NO: 649624 - RNA, 20 nt, Homo sapiens
ccucugggcagccugcuuug

SEQ ID NO: 649625 - RNA, 18 nt, Homo sapiens
ccucuggggccuucggga

SEQ ID NO: 649626 - RNA, 15 nt, Homo sapiens
ccucuggucccacaa

SEQ ID NO: 649627 - RNA, 22 nt, Homo sapiens
ccucugucaaugaaaaaaagua

SEQ ID NO: 649628 - RNA, 14 nt, Homo sapiens
ccucugugaccaac

SEQ ID NO: 649629 - RNA, 21 nt, Homo sapiens
ccucugugcuucgacuacugc

SEQ ID NO: 649630 - RNA, 11 nt, Homo sapiens
ccucuguggaa

SEQ ID NO: 649631 - RNA, 13 nt, Homo sapiens
ccucuguucucuc

SEQ ID NO: 649632 - RNA, 23 nt, Homo sapiens
ccucuuaaaaaauaaaaacugac

SEQ ID NO: 649633 - RNA, 19 nt, Homo sapiens
ccucuuaaagcugccugua

SEQ ID NO: 649634 - RNA, 15 nt, Homo sapiens
ccucuuaaaucauag

SEQ ID NO: 649635 - RNA, 17 nt, Homo sapiens
ccucuuagaaaaaccac

SEQ ID NO: 649636 - RNA, 18 nt, Homo sapiens
ccucuuagauauucacua

SEQ ID NO: 649637 - RNA, 13 nt, Homo sapiens
ccucuuagcugag

SEQ ID NO: 649638 - RNA, 24 nt, Homo sapiens
ccucuuccccagaaaggagacuag

SEQ ID NO: 649639 - RNA, 10 nt, Homo sapiens
ccucuucucu

SEQ ID NO: 649640 - RNA, 19 nt, Homo sapiens
ccucuugaagcauagcuuu

SEQ ID NO: 649641 - RNA, 12 nt, Homo sapiens
ccucuugcaaag

SEQ ID NO: 649642 - RNA, 13 nt, Homo sapiens
ccucuugcucaaa

SEQ ID NO: 649643 - RNA, 18 nt, Homo sapiens
ccucuugucccuuggcac

SEQ ID NO: 649644 - RNA, 16 nt, Homo sapiens
ccucuuucaucuguaa

SEQ ID NO: 649645 - RNA, 17 nt, Homo sapiens
ccucuuucuucccauga

SEQ ID NO: 649646 - RNA, 13 nt, Homo sapiens
ccucuuugaggga

SEQ ID NO: 649647 - RNA, 22 nt, Homo sapiens
ccucuuugagggaggggagcua

SEQ ID NO: 649648 - RNA, 16 nt, Homo sapiens
ccucuuuguuuaucuc

SEQ ID NO: 649649 - RNA, 21 nt, Homo sapiens
ccugaaaaaugcucaaucuca

SEQ ID NO: 649650 - RNA, 19 nt, Homo sapiens
ccugaaaaggguguugcua

SEQ ID NO: 649651 - RNA, 15 nt, Homo sapiens
ccugaaaauugcaau

SEQ ID NO: 649652 - RNA, 17 nt, Homo sapiens
ccugaaaauugcaauac

SEQ ID NO: 649653 - RNA, 15 nt, Homo sapiens
ccugaaacacuggac

SEQ ID NO: 649654 - RNA, 21 nt, Homo sapiens
ccugaaagagaagauggccau

SEQ ID NO: 649655 - RNA, 13 nt, Homo sapiens
ccugaaagccaca

SEQ ID NO: 649656 - RNA, 21 nt, Homo sapiens
ccugaaaguuuagaucuagaa

SEQ ID NO: 649657 - RNA, 14 nt, Homo sapiens
ccugaaauuaauuu

SEQ ID NO: 649658 - RNA, 14 nt, Homo sapiens
ccugaaccccaugg

SEQ ID NO: 649659 - RNA, 17 nt, Homo sapiens
ccugaaccuugagcaaa

SEQ ID NO: 649660 - RNA, 19 nt, Homo sapiens
ccugaaccuugagcaaauu

SEQ ID NO: 649661 - RNA, 16 nt, Homo sapiens
ccugaacuaaucugau

SEQ ID NO: 649662 - RNA, 21 nt, Homo sapiens
ccugaacuacauaacuuccua

SEQ ID NO: 649663 - RNA, 19 nt, Homo sapiens
ccugaacuccagagguguc

SEQ ID NO: 649664 - RNA, 19 nt, Homo sapiens
ccugaacuuucucccucau

SEQ ID NO: 649665 - RNA, 20 nt, Homo sapiens
ccugaagcccagcgacacag

SEQ ID NO: 649666 - RNA, 20 nt, Homo sapiens
ccugaagggggacacuccau

SEQ ID NO: 649667 - RNA, 14 nt, Homo sapiens
ccugaaggugccac

SEQ ID NO: 649668 - RNA, 12 nt, Homo sapiens
ccugaaguauuu

SEQ ID NO: 649669 - RNA, 23 nt, Homo sapiens
ccugaagucuucuccuccaugaa

SEQ ID NO: 649670 - RNA, 18 nt, Homo sapiens
ccugaaguugcugcugug

SEQ ID NO: 649671 - RNA, 17 nt, Homo sapiens
ccugaaucagcuggaca

SEQ ID NO: 649672 - RNA, 13 nt, Homo sapiens
ccugaaucauucu

SEQ ID NO: 649673 - RNA, 13 nt, Homo sapiens
ccugaaugaaaua

SEQ ID NO: 649674 - RNA, 23 nt, Homo sapiens
ccugaauucaguugcuuugccca

SEQ ID NO: 649675 - RNA, 17 nt, Homo sapiens
ccugaauuuuguugcug

SEQ ID NO: 649676 - RNA, 14 nt, Homo sapiens
ccugacaauggcag

SEQ ID NO: 649677 - RNA, 21 nt, Homo sapiens
ccugacaccgucccucaguga

SEQ ID NO: 649678 - RNA, 17 nt, Homo sapiens
ccugacacggacugugc

SEQ ID NO: 649679 - RNA, 18 nt, Homo sapiens
ccugacacggacugugca

SEQ ID NO: 649680 - RNA, 14 nt, Homo sapiens
ccugacacuauuca

SEQ ID NO: 649681 - RNA, 17 nt, Homo sapiens
ccugacacuccuuucag

SEQ ID NO: 649682 - RNA, 18 nt, Homo sapiens
ccugacagcuuuaucucc

SEQ ID NO: 649683 - RNA, 20 nt, Homo sapiens
ccugacagggccagugcagu

SEQ ID NO: 649684 - RNA, 15 nt, Homo sapiens
ccugaccaugcauuu

SEQ ID NO: 649685 - RNA, 16 nt, Homo sapiens
ccugaccucacuguga

SEQ ID NO: 649686 - RNA, 12 nt, Homo sapiens
ccugaccuguca

SEQ ID NO: 649687 - RNA, 18 nt, Homo sapiens
ccugacuccugacuugua

SEQ ID NO: 649688 - RNA, 17 nt, Homo sapiens
ccugacuuuuaauguca

SEQ ID NO: 649689 - RNA, 14 nt, Homo sapiens
ccugagaaggcaaa

SEQ ID NO: 649690 - RNA, 10 nt, Homo sapiens
ccugagacag

SEQ ID NO: 649691 - RNA, 18 nt, Homo sapiens
ccugagagguuucugggg

SEQ ID NO: 649692 - RNA, 13 nt, Homo sapiens
ccugagagugggu

SEQ ID NO: 649693 - RNA, 17 nt, Homo sapiens
ccugagaguggugcccu

SEQ ID NO: 649694 - RNA, 19 nt, Homo sapiens
ccugagauucagaugucau

SEQ ID NO: 649695 - RNA, 19 nt, Homo sapiens
ccugagcaacagagugaga

SEQ ID NO: 649696 - RNA, 22 nt, Homo sapiens
ccugagcaggaaaguuuaccca

SEQ ID NO: 649697 - RNA, 15 nt, Homo sapiens
ccugagccaaaagag

SEQ ID NO: 649698 - RNA, 16 nt, Homo sapiens
ccugagcgagugucca

SEQ ID NO: 649699 - RNA, 20 nt, Homo sapiens
ccugaggaggaggacacagc

SEQ ID NO: 649700 - RNA, 20 nt, Homo sapiens
ccugaggguggagacuaagc

SEQ ID NO: 649701 - RNA, 13 nt, Homo sapiens
ccugaggugggag

SEQ ID NO: 649702 - RNA, 23 nt, Homo sapiens
ccugaggugggagaaucacuuaa

SEQ ID NO: 649703 - RNA, 22 nt, Homo sapiens
ccugagguuugccagcauuuag

SEQ ID NO: 649704 - RNA, 15 nt, Homo sapiens
ccugagucagugcuc

SEQ ID NO: 649705 - RNA, 23 nt, Homo sapiens
ccugaguggugccaaacaaaaag

SEQ ID NO: 649706 - RNA, 19 nt, Homo sapiens
ccugaguuugggauugugg

SEQ ID NO: 649707 - RNA, 24 nt, Homo sapiens
ccugauaaacauuaaacacuguaa

SEQ ID NO: 649708 - RNA, 14 nt, Homo sapiens
ccugaucaccugcc

SEQ ID NO: 649709 - RNA, 19 nt, Homo sapiens
ccugaucgccaaccuuucc

SEQ ID NO: 649710 - RNA, 17 nt, Homo sapiens
ccugaucuagcacuccu

SEQ ID NO: 649711 - RNA, 17 nt, Homo sapiens
ccugaucucugaccucu

SEQ ID NO: 649712 - RNA, 14 nt, Homo sapiens
cguguggacugugc

SEQ ID NO: 649713 - RNA, 19 nt, Homo sapiens
cguguguagauaguaugca

SEQ ID NO: 649714 - RNA, 15 nt, Homo sapiens
cguguguccaugugu

SEQ ID NO: 649715 - RNA, 12 nt, Homo sapiens
cgugugugcaag

SEQ ID NO: 649716 - RNA, 20 nt, Homo sapiens
cguguugcaugaaggagcag

SEQ ID NO: 649717 - RNA, 18 nt, Homo sapiens
cguguuucugacucugag

SEQ ID NO: 649718 - RNA, 18 nt, Homo sapiens
cguuaccauuuacauguu

SEQ ID NO: 649719 - RNA, 23 nt, Homo sapiens
cguuaguguauuuuauguguggc

SEQ ID NO: 649720 - RNA, 17 nt, Homo sapiens
cguuaguucuacauuau

SEQ ID NO: 649721 - RNA, 14 nt, Homo sapiens
cguucagccccuga

SEQ ID NO: 649722 - RNA, 20 nt, Homo sapiens
cguuccccgcuccacagaga

SEQ ID NO: 649723 - RNA, 17 nt, Homo sapiens
cguuccuggcauuugcu

SEQ ID NO: 649724 - RNA, 17 nt, Homo sapiens
cguuccuguugggcuga

SEQ ID NO: 649725 - RNA, 20 nt, Homo sapiens
cguucucuucucucuucaau

SEQ ID NO: 649726 - RNA, 13 nt, Homo sapiens
cguucugcugcuu

SEQ ID NO: 649727 - RNA, 13 nt, Homo sapiens
cguugaggaugag

SEQ ID NO: 649728 - RNA, 14 nt, Homo sapiens
cguugcagcacugc

SEQ ID NO: 649729 - RNA, 15 nt, Homo sapiens
cguugcccagcacug

SEQ ID NO: 649730 - RNA, 15 nt, Homo sapiens
cguuggcucaguccu

SEQ ID NO: 649731 - RNA, 22 nt, Homo sapiens
cguuguuuugguuguacuuugg

SEQ ID NO: 649732 - RNA, 21 nt, Homo sapiens
cguuucccagagucaucugau

SEQ ID NO: 649733 - RNA, 19 nt, Homo sapiens
cguuucuaugacacaugca

SEQ ID NO: 649734 - RNA, 14 nt, Homo sapiens
cguuucuguauaca

SEQ ID NO: 649735 - RNA, 18 nt, Homo sapiens
cguuugcuuaaacccuuu

SEQ ID NO: 649736 - RNA, 19 nt, Homo sapiens
cguuugugaacgcugugau

SEQ ID NO: 649737 - RNA, 19 nt, Homo sapiens
cguuuuacaauguaacuau

SEQ ID NO: 649738 - RNA, 13 nt, Homo sapiens
cguuuuaugauuu

SEQ ID NO: 649739 - RNA, 13 nt, Homo sapiens
cguuuuauuccag

SEQ ID NO: 649740 - RNA, 16 nt, Homo sapiens
cguuuugaagacgugg

SEQ ID NO: 649741 - RNA, 17 nt, Homo sapiens
cuaaaaaauggugggag

SEQ ID NO: 649742 - RNA, 17 nt, Homo sapiens
cuaaaaaggucuguuaa

SEQ ID NO: 649743 - RNA, 17 nt, Homo sapiens
cuaaaaaguuccaugaa

SEQ ID NO: 649744 - RNA, 18 nt, Homo sapiens
cuaaaaaugagcuugauu

SEQ ID NO: 649745 - RNA, 15 nt, Homo sapiens
cuaaaaaugcaaaaa

SEQ ID NO: 649746 - RNA, 13 nt, Homo sapiens
cuaaaacaucuca

SEQ ID NO: 649747 - RNA, 18 nt, Homo sapiens
cuaaaacuaugguuccca

SEQ ID NO: 649748 - RNA, 12 nt, Homo sapiens
cuaaaacuuaac

SEQ ID NO: 649749 - RNA, 21 nt, Homo sapiens
cuaaaagcguuggauguagca

SEQ ID NO: 649750 - RNA, 16 nt, Homo sapiens
cuaaaaggaaaagguu

SEQ ID NO: 649751 - RNA, 21 nt, Homo sapiens
cuaaaauaauuuuauuaugca

SEQ ID NO: 649752 - RNA, 19 nt, Homo sapiens
cuaaaauguaucuaagaau

SEQ ID NO: 649753 - RNA, 13 nt, Homo sapiens
cuaaaauucuguc

SEQ ID NO: 649754 - RNA, 14 nt, Homo sapiens
cuaaaauucuguca

SEQ ID NO: 649755 - RNA, 17 nt, Homo sapiens
cuaaaauucugucaggg

SEQ ID NO: 649756 - RNA, 22 nt, Homo sapiens
cuaaaauuguaucaaaugugac

SEQ ID NO: 649757 - RNA, 20 nt, Homo sapiens
cuaaacaaugcugauuuggu

SEQ ID NO: 649758 - RNA, 12 nt, Homo sapiens
cuaaacauccau

SEQ ID NO: 649759 - RNA, 20 nt, Homo sapiens
cuaaaccaagauuaugugac

SEQ ID NO: 649760 - RNA, 20 nt, Homo sapiens
cuaaaccaaggacugagcac

SEQ ID NO: 649761 - RNA, 16 nt, Homo sapiens
cuaaacccaauccaaa

SEQ ID NO: 649762 - RNA, 17 nt, Homo sapiens
cuaaacccgcaccccag

SEQ ID NO: 649763 - RNA, 17 nt, Homo sapiens
cuaaacuacaacgaaca

SEQ ID NO: 649764 - RNA, 22 nt, Homo sapiens
cuaaacuaguuuuuccuaucau

SEQ ID NO: 649765 - RNA, 17 nt, Homo sapiens
cuaaacucucuagcuua

SEQ ID NO: 649766 - RNA, 13 nt, Homo sapiens
cuaaacucugggg

SEQ ID NO: 649767 - RNA, 11 nt, Homo sapiens
cuaaacugcag

SEQ ID NO: 649768 - RNA, 12 nt, Homo sapiens
cuaaacugcagc

SEQ ID NO: 649769 - RNA, 21 nt, Homo sapiens
cuaaagaaaaauaucuuggcc

SEQ ID NO: 649770 - RNA, 18 nt, Homo sapiens
cuaaagacuaacuugaaa

SEQ ID NO: 649771 - RNA, 20 nt, Homo sapiens
cuaaagagcugcacagcaaa

SEQ ID NO: 649772 - RNA, 24 nt, Homo sapiens
cuaaagagcugcacagcaaaagaa

SEQ ID NO: 649773 - RNA, 21 nt, Homo sapiens
cuaaagaguuauucaaaugaa

SEQ ID NO: 649774 - RNA, 12 nt, Homo sapiens
cuaaagauauca

SEQ ID NO: 649775 - RNA, 15 nt, Homo sapiens
cuaaagauguuuuaa

SEQ ID NO: 649776 - RNA, 11 nt, Homo sapiens
cuaaagcacuu

SEQ ID NO: 649777 - RNA, 12 nt, Homo sapiens
cuaaagcacuuu

SEQ ID NO: 649778 - RNA, 20 nt, Homo sapiens
cuaaagcacuuugcacuuaa

SEQ ID NO: 649779 - RNA, 20 nt, Homo sapiens
cuaaagcagaggcaacacug

SEQ ID NO: 649780 - RNA, 23 nt, Homo sapiens
cuaaagccaaaguuucuguugaa

SEQ ID NO: 649781 - RNA, 16 nt, Homo sapiens
cuaaagccagccugac

SEQ ID NO: 649782 - RNA, 11 nt, Homo sapiens
cuaaagccagg

SEQ ID NO: 649783 - RNA, 21 nt, Homo sapiens
cuaaagccaggacuauucccu

SEQ ID NO: 649784 - RNA, 16 nt, Homo sapiens
cuaaagcuucuauaaa

SEQ ID NO: 649785 - RNA, 14 nt, Homo sapiens
cuaaaggacuaaca

SEQ ID NO: 649786 - RNA, 16 nt, Homo sapiens
cuaaaguaucuguauu

SEQ ID NO: 649787 - RNA, 18 nt, Homo sapiens
cuaaagucuguugauuaa

SEQ ID NO: 649788 - RNA, 13 nt, Homo sapiens
cuaaagugucaag

SEQ ID NO: 649789 - RNA, 16 nt, Homo sapiens
cuaaaguuacuacuga

SEQ ID NO: 649790 - RNA, 23 nt, Homo sapiens
cuaaauaaaaauauguaauuuca

SEQ ID NO: 649791 - RNA, 13 nt, Homo sapiens
cuaaauaaaugaa

SEQ ID NO: 649792 - RNA, 17 nt, Homo sapiens
cuaaauaagaaaauaac

SEQ ID NO: 649793 - RNA, 20 nt, Homo sapiens
cuaaauaagcuuccacgcca

SEQ ID NO: 649794 - RNA, 14 nt, Homo sapiens
cuaaauaaguuaau

SEQ ID NO: 649795 - RNA, 16 nt, Homo sapiens
cuaaauaccucaauca

SEQ ID NO: 649796 - RNA, 19 nt, Homo sapiens
cuaaauauccaaagacugu

SEQ ID NO: 649797 - RNA, 22 nt, Homo sapiens
cuaaauauggacugcucaggaa

SEQ ID NO: 649798 - RNA, 17 nt, Homo sapiens
cuaaaucaauucuauua

SEQ ID NO: 649799 - RNA, 13 nt, Homo sapiens
cuaaaucagagac

SEQ ID NO: 649800 - RNA, 18 nt, Homo sapiens
cuaaaugagauacacuga

SEQ ID NO: 649801 - RNA, 15 nt, Homo sapiens
cuaaaugcaccaaga

SEQ ID NO: 649802 - RNA, 12 nt, Homo sapiens
cuaaaugcacug

SEQ ID NO: 649803 - RNA, 16 nt, Homo sapiens
cuaaaugcagugaauu

SEQ ID NO: 649804 - RNA, 23 nt, Homo sapiens
cuaaaugcuguucuuacacauaa

SEQ ID NO: 649805 - RNA, 23 nt, Homo sapiens
cuaaauuauuuacugcaaaaaga

SEQ ID NO: 649806 - RNA, 16 nt, Homo sapiens
cuaaauuuaaugcugc

SEQ ID NO: 649807 - RNA, 15 nt, Homo sapiens
cuaaauuugguucua

SEQ ID NO: 649808 - RNA, 21 nt, Homo sapiens
cuaaauuuucugaaacugcau

SEQ ID NO: 649809 - RNA, 16 nt, Homo sapiens
cuaaauuuuucauaga

SEQ ID NO: 649810 - RNA, 19 nt, Homo sapiens
cuaacaaagaacaagcauu

SEQ ID NO: 649811 - RNA, 22 nt, Homo sapiens
cuaacaaguagcacccuggauu

SEQ ID NO: 649812 - RNA, 14 nt, Homo sapiens
cuaacacauuucau

SEQ ID NO: 649813 - RNA, 13 nt, Homo sapiens
cuaacacuggcau

SEQ ID NO: 649814 - RNA, 20 nt, Homo sapiens
cuaacaggagaaugcacagu

SEQ ID NO: 649815 - RNA, 20 nt, Homo sapiens
cuaacaugacaguauuccau

SEQ ID NO: 649816 - RNA, 18 nt, Homo sapiens
cuaacauuccauguuuca

SEQ ID NO: 649817 - RNA, 12 nt, Homo sapiens
cuaacauuuccu

SEQ ID NO: 649818 - RNA, 22 nt, Homo sapiens
cuaaccagauggaacacuggaa

SEQ ID NO: 649819 - RNA, 17 nt, Homo sapiens
cuaaccagccuggucaa

SEQ ID NO: 649820 - RNA, 14 nt, Homo sapiens
cuaaccauguguua

SEQ ID NO: 649821 - RNA, 23 nt, Homo sapiens
cuaacccccagcccacagagccu

SEQ ID NO: 649822 - RNA, 18 nt, Homo sapiens
cuaacccucacaagcaug

SEQ ID NO: 649823 - RNA, 16 nt, Homo sapiens
cuaaccuugaaugcug

SEQ ID NO: 649824 - RNA, 16 nt, Homo sapiens
cuaacguccacuagcu

SEQ ID NO: 649825 - RNA, 18 nt, Homo sapiens
cuaacuaaauaccauuca

SEQ ID NO: 649826 - RNA, 15 nt, Homo sapiens
cuaacugacagcuuc

SEQ ID NO: 649827 - RNA, 23 nt, Homo sapiens
cuaacugcaauguggauguuuua

SEQ ID NO: 649828 - RNA, 21 nt, Homo sapiens
cuaacuggggauauaauacua

SEQ ID NO: 649829 - RNA, 15 nt, Homo sapiens
cuaacuugaaaagaa

SEQ ID NO: 649830 - RNA, 17 nt, Homo sapiens
cuaagaaaaaaagcaca

SEQ ID NO: 649831 - RNA, 21 nt, Homo sapiens
cuaagaaagaggagugcuugu

SEQ ID NO: 649832 - RNA, 18 nt, Homo sapiens
cuaagaauucaaacuggg

SEQ ID NO: 649833 - RNA, 14 nt, Homo sapiens
cuaagaauucucuc

SEQ ID NO: 649834 - RNA, 16 nt, Homo sapiens
cuaagacacaaaugca

SEQ ID NO: 649835 - RNA, 14 nt, Homo sapiens
cuaagacauauuca

SEQ ID NO: 649836 - RNA, 23 nt, Homo sapiens
cuaagacauauucagacaucaac

SEQ ID NO: 649837 - RNA, 16 nt, Homo sapiens
cuaagagaacaaugug

SEQ ID NO: 649838 - RNA, 17 nt, Homo sapiens
cuaagauaauuuacuua

SEQ ID NO: 649839 - RNA, 14 nt, Homo sapiens
cuaagaucuguuaa

SEQ ID NO: 649840 - RNA, 13 nt, Homo sapiens
cuaagaugaucau

SEQ ID NO: 649841 - RNA, 18 nt, Homo sapiens
cuaagcaaauaggcaaaa

SEQ ID NO: 649842 - RNA, 20 nt, Homo sapiens
cuaagcaacuaggccuucag

SEQ ID NO: 649843 - RNA, 13 nt, Homo sapiens
cuaagcacuuuau

SEQ ID NO: 649844 - RNA, 20 nt, Homo sapiens
cuaagccaacuugaugugaa

SEQ ID NO: 649845 - RNA, 15 nt, Homo sapiens
cuaagccaacuuuaa

SEQ ID NO: 649846 - RNA, 17 nt, Homo sapiens
cuaagccccguccccua

SEQ ID NO: 649847 - RNA, 18 nt, Homo sapiens
cuaagccuggaagccauc

SEQ ID NO: 649848 - RNA, 13 nt, Homo sapiens
cuaagccuguugc

SEQ ID NO: 649849 - RNA, 21 nt, Homo sapiens
cuaagcgcucauucuauuuua

SEQ ID NO: 649850 - RNA, 20 nt, Homo sapiens
cuaagcugccgguucuuaaa

SEQ ID NO: 649851 - RNA, 15 nt, Homo sapiens
cuaagcugcucuaaa

SEQ ID NO: 649852 - RNA, 14 nt, Homo sapiens
cuaaggaaauugag

SEQ ID NO: 649853 - RNA, 13 nt, Homo sapiens
cuaaggaaccuuc

SEQ ID NO: 649854 - RNA, 18 nt, Homo sapiens
cuaaggaagauuacucag

SEQ ID NO: 649855 - RNA, 16 nt, Homo sapiens
cuaaggagccuggaaa

SEQ ID NO: 649856 - RNA, 21 nt, Homo sapiens
cuaaggagcugauacuuugac

SEQ ID NO: 649857 - RNA, 19 nt, Homo sapiens
cuaaggaguaaucugugua

SEQ ID NO: 649858 - RNA, 13 nt, Homo sapiens
cuaaggcagcuaa

SEQ ID NO: 649859 - RNA, 13 nt, Homo sapiens
cuaaggcaggaau

SEQ ID NO: 649860 - RNA, 17 nt, Homo sapiens
cuaagggaacaauccau

SEQ ID NO: 649861 - RNA, 23 nt, Homo sapiens
cuaaggggcccggccagccaugu

SEQ ID NO: 649862 - RNA, 21 nt, Homo sapiens
cuaaggggguagaaguaguuu

SEQ ID NO: 649863 - RNA, 18 nt, Homo sapiens
cuaagggugggugcucag

SEQ ID NO: 649864 - RNA, 18 nt, Homo sapiens
cuaagguacacacuuuca

SEQ ID NO: 649865 - RNA, 21 nt, Homo sapiens
cuaaggucauuucuuugcuua

SEQ ID NO: 649866 - RNA, 22 nt, Homo sapiens
cuaagguccaacaagaaugcau

SEQ ID NO: 649867 - RNA, 17 nt, Homo sapiens
cuaaggucccugggggu

SEQ ID NO: 649868 - RNA, 17 nt, Homo sapiens
cuaagguucagccugaa

SEQ ID NO: 649869 - RNA, 15 nt, Homo sapiens
cuaaguacacaauaa

SEQ ID NO: 649870 - RNA, 18 nt, Homo sapiens
cuaaguauauuaauauca

SEQ ID NO: 649871 - RNA, 22 nt, Homo sapiens
cuaagucaagaucaacauucca

SEQ ID NO: 649872 - RNA, 12 nt, Homo sapiens
cuaagugaugcu

SEQ ID NO: 649873 - RNA, 18 nt, Homo sapiens
cuaagugccacccuccuc

SEQ ID NO: 649874 - RNA, 15 nt, Homo sapiens
cuaaguuauuuacuu

SEQ ID NO: 649875 - RNA, 17 nt, Homo sapiens
cuaauaaacauccuuca

SEQ ID NO: 649876 - RNA, 16 nt, Homo sapiens
cuaauaacaugugaaa

SEQ ID NO: 649877 - RNA, 16 nt, Homo sapiens
cuaauaagaagugcca

SEQ ID NO: 649878 - RNA, 15 nt, Homo sapiens
cuaauaagcaguaug

SEQ ID NO: 649879 - RNA, 15 nt, Homo sapiens
cuaauaaguauauaa

SEQ ID NO: 649880 - RNA, 14 nt, Homo sapiens
cuaauaaugcugaa

SEQ ID NO: 649881 - RNA, 13 nt, Homo sapiens
cuaauaauuauuc

SEQ ID NO: 649882 - RNA, 16 nt, Homo sapiens
cuaauaccugucaaca

SEQ ID NO: 649883 - RNA, 14 nt, Homo sapiens
cuaauacuaauuca

SEQ ID NO: 649884 - RNA, 16 nt, Homo sapiens
cuaauagucuuugcca

SEQ ID NO: 649885 - RNA, 17 nt, Homo sapiens
cuaauagucuuugccag

SEQ ID NO: 649886 - RNA, 16 nt, Homo sapiens
cuaauaucaaaugcag

SEQ ID NO: 649887 - RNA, 18 nt, Homo sapiens
cuaauaugccuagcacaa

SEQ ID NO: 649888 - RNA, 23 nt, Homo sapiens
cuaaucagaugauggccauuucu

SEQ ID NO: 649889 - RNA, 18 nt, Homo sapiens
cuaaucaguuguaacaau

SEQ ID NO: 649890 - RNA, 12 nt, Homo sapiens
cuaauccuaucu

SEQ ID NO: 649891 - RNA, 16 nt, Homo sapiens
cuaaucgaaugaacaa

SEQ ID NO: 649892 - RNA, 21 nt, Homo sapiens
cuaaucugauguuaaccaaug

SEQ ID NO: 649893 - RNA, 16 nt, Homo sapiens
cuaaugaacucuuuca

SEQ ID NO: 649894 - RNA, 18 nt, Homo sapiens
cuaaugagagugcacugc

SEQ ID NO: 649895 - RNA, 11 nt, Homo sapiens
cuaaugcucac

SEQ ID NO: 649896 - RNA, 16 nt, Homo sapiens
cuaaugcucucaggga

SEQ ID NO: 649897 - RNA, 19 nt, Homo sapiens
cuaauggcuuucacuuucu

SEQ ID NO: 649898 - RNA, 12 nt, Homo sapiens
cuaauggucucu

SEQ ID NO: 649899 - RNA, 13 nt, Homo sapiens
cuaauguacaaua

SEQ ID NO: 649900 - RNA, 19 nt, Homo sapiens
cuaauguacaauaaagcaa

SEQ ID NO: 649901 - RNA, 20 nt, Homo sapiens
cuaauguacaauaaagcaau

SEQ ID NO: 649902 - RNA, 17 nt, Homo sapiens
cuaaugugaucauauga

SEQ ID NO: 649903 - RNA, 23 nt, Homo sapiens
cuaaugugccccauguccaaguc

SEQ ID NO: 649904 - RNA, 23 nt, Homo sapiens
cuaauuaaaaaacacaucuggcc

SEQ ID NO: 649905 - RNA, 14 nt, Homo sapiens
cuaauuaaauggca

SEQ ID NO: 649906 - RNA, 17 nt, Homo sapiens
cuaauucggauuugcca

SEQ ID NO: 649907 - RNA, 16 nt, Homo sapiens
cuaauucucuguggaa

SEQ ID NO: 649908 - RNA, 22 nt, Homo sapiens
cuaauucuggcaggaccucacc

SEQ ID NO: 649909 - RNA, 16 nt, Homo sapiens
cuaauuguaagugaaa

SEQ ID NO: 649910 - RNA, 16 nt, Homo sapiens
cuaauuuacuggacaa

SEQ ID NO: 649911 - RNA, 16 nt, Homo sapiens
cuaauuuaguagaaag

SEQ ID NO: 649912 - RNA, 18 nt, Homo sapiens
cuaauuugauguuuacag

SEQ ID NO: 649913 - RNA, 21 nt, Homo sapiens
cuaauuugcauuaaauucaca

SEQ ID NO: 649914 - RNA, 15 nt, Homo sapiens
cuaauuuuguugaaa

SEQ ID NO: 649915 - RNA, 20 nt, Homo sapiens
cuaauuuuuaccgauguuaa

SEQ ID NO: 649916 - RNA, 20 nt, Homo sapiens
cuaauuuuuaugaugcaaau

SEQ ID NO: 649917 - RNA, 17 nt, Homo sapiens
cuaauuuuuuguuguuu

SEQ ID NO: 649918 - RNA, 18 nt, Homo sapiens
cuacaaaauuggaaagaa

SEQ ID NO: 649919 - RNA, 14 nt, Homo sapiens
cuacaaacacugca

SEQ ID NO: 649920 - RNA, 23 nt, Homo sapiens
cuacaaacucccacuugucaugu

SEQ ID NO: 649921 - RNA, 14 nt, Homo sapiens
cuacaacagaauuu

SEQ ID NO: 649922 - RNA, 13 nt, Homo sapiens
cuacaacauguga

SEQ ID NO: 649923 - RNA, 17 nt, Homo sapiens
cuacaacgaacacaaga

SEQ ID NO: 649924 - RNA, 21 nt, Homo sapiens
cuacaagacacagugaccaua

SEQ ID NO: 649925 - RNA, 10 nt, Homo sapiens
cuacaaggac

SEQ ID NO: 649926 - RNA, 19 nt, Homo sapiens
cuacaaguauaugugaaaa

SEQ ID NO: 649927 - RNA, 19 nt, Homo sapiens
cuacaaguauuauuuuaca

SEQ ID NO: 649928 - RNA, 15 nt, Homo sapiens
cuacaauacauauau

SEQ ID NO: 649929 - RNA, 23 nt, Homo sapiens
cuacaauacggcuaaucuuucau

SEQ ID NO: 649930 - RNA, 13 nt, Homo sapiens
cuacaauucauug

SEQ ID NO: 649931 - RNA, 20 nt, Homo sapiens
cuacaauuccucugauaaua

SEQ ID NO: 649932 - RNA, 13 nt, Homo sapiens
cuacaauuugcca

SEQ ID NO: 649933 - RNA, 14 nt, Homo sapiens
cuacacacaaacca

SEQ ID NO: 649934 - RNA, 14 nt, Homo sapiens
cuacacacaguacg

SEQ ID NO: 649935 - RNA, 20 nt, Homo sapiens
cuacacacguaccuucaugu

SEQ ID NO: 649936 - RNA, 14 nt, Homo sapiens
cuacacacugucau

SEQ ID NO: 649937 - RNA, 21 nt, Homo sapiens
cuacacagagcaggacugcac

SEQ ID NO: 649938 - RNA, 18 nt, Homo sapiens
cuacacagcacaccagcc

SEQ ID NO: 649939 - RNA, 22 nt, Homo sapiens
cuacacaguaaaaacuuguacu

SEQ ID NO: 649940 - RNA, 12 nt, Homo sapiens
cuacacauacag

SEQ ID NO: 649941 - RNA, 15 nt, Homo sapiens
cuacacauguaaaau

SEQ ID NO: 649942 - RNA, 16 nt, Homo sapiens
cuacacccaccagagu

SEQ ID NO: 649943 - RNA, 15 nt, Homo sapiens
cuacacggcugugac

SEQ ID NO: 649944 - RNA, 14 nt, Homo sapiens
cuacacucuugacu

SEQ ID NO: 649945 - RNA, 20 nt, Homo sapiens
cuacacugauacacuugaag

SEQ ID NO: 649946 - RNA, 13 nt, Homo sapiens
cuacacuguauua

SEQ ID NO: 649947 - RNA, 22 nt, Homo sapiens
cuacagacaccaaguuccguca

SEQ ID NO: 649948 - RNA, 15 nt, Homo sapiens
cuacagaggugaaau

SEQ ID NO: 649949 - RNA, 21 nt, Homo sapiens
cuacagaugguagaacuaaac

SEQ ID NO: 649950 - RNA, 17 nt, Homo sapiens
cuacagggcuuaggacu

SEQ ID NO: 649951 - RNA, 14 nt, Homo sapiens
cuacaguaaccaaa

SEQ ID NO: 649952 - RNA, 22 nt, Homo sapiens
cuacagucuaaaauugcuucuu

SEQ ID NO: 649953 - RNA, 13 nt, Homo sapiens
cuacagugcugug

SEQ ID NO: 649954 - RNA, 22 nt, Homo sapiens
cugaggguccccaccugggacc

SEQ ID NO: 649955 - RNA, 13 nt, Homo sapiens
cugagggugggag

SEQ ID NO: 649956 - RNA, 16 nt, Homo sapiens
cugaggucucuugagg

SEQ ID NO: 649957 - RNA, 16 nt, Homo sapiens
cugaggugaaagggag

SEQ ID NO: 649958 - RNA, 12 nt, Homo sapiens
cugaggugggag

SEQ ID NO: 649959 - RNA, 14 nt, Homo sapiens
cugagguuaugaac

SEQ ID NO: 649960 - RNA, 19 nt, Homo sapiens
cugagguuuugaauaaaaa

SEQ ID NO: 649961 - RNA, 19 nt, Homo sapiens
cugaguaagcccucaggag

SEQ ID NO: 649962 - RNA, 19 nt, Homo sapiens
cugaguacguugugcauuu

SEQ ID NO: 649963 - RNA, 22 nt, Homo sapiens
cugaguagcugggccugugcac

SEQ ID NO: 649964 - RNA, 14 nt, Homo sapiens
cugagucaccuccu

SEQ ID NO: 649965 - RNA, 16 nt, Homo sapiens
cugagucagacuguca

SEQ ID NO: 649966 - RNA, 19 nt, Homo sapiens
cugcagcaggccacugggg

SEQ ID NO: 649967 - RNA, 18 nt, Homo sapiens
cugcagcaggugaccucc

SEQ ID NO: 649968 - RNA, 19 nt, Homo sapiens
cugcagccugcaggaccuc

SEQ ID NO: 649969 - RNA, 20 nt, Homo sapiens
cugcagcucccgaagccuga

SEQ ID NO: 649970 - RNA, 23 nt, Homo sapiens
cugcaggagagaaugcccaguga

SEQ ID NO: 649971 - RNA, 20 nt, Homo sapiens
cugcagggacuccaugcugc

SEQ ID NO: 649972 - RNA, 23 nt, Homo sapiens
cugcagggguugagagcuuucug

SEQ ID NO: 649973 - RNA, 14 nt, Homo sapiens
cugcagggugggau

SEQ ID NO: 649974 - RNA, 22 nt, Homo sapiens
cugcagguggcagagugaaugu

SEQ ID NO: 649975 - RNA, 20 nt, Homo sapiens
cugcagucccacacugugca

SEQ ID NO: 649976 - RNA, 15 nt, Homo sapiens
cugcagugaugcaau

SEQ ID NO: 649977 - RNA, 16 nt, Homo sapiens
cugcagugaugcaaua

SEQ ID NO: 649978 - RNA, 16 nt, Homo sapiens
cugcaguucuacucag

SEQ ID NO: 649979 - RNA, 16 nt, Homo sapiens
cugcauaaacuguugu

SEQ ID NO: 649980 - RNA, 18 nt, Homo sapiens
cugcauaaccuuuacacu

SEQ ID NO: 649981 - RNA, 15 nt, Homo sapiens
cugcauagcaguuug

SEQ ID NO: 649982 - RNA, 12 nt, Homo sapiens
cugcauaugaua

SEQ ID NO: 649983 - RNA, 15 nt, Homo sapiens
cugcauccagagauu

SEQ ID NO: 649984 - RNA, 17 nt, Homo sapiens
cugcauccagagauuca

SEQ ID NO: 649985 - RNA, 21 nt, Homo sapiens
cugcauccauuugaacacauu

SEQ ID NO: 649986 - RNA, 16 nt, Homo sapiens
cugcauccucacugug

SEQ ID NO: 649987 - RNA, 13 nt, Homo sapiens
cugcaucuaagca

SEQ ID NO: 649988 - RNA, 15 nt, Homo sapiens
cugcaucuugcugcu

SEQ ID NO: 649989 - RNA, 17 nt, Homo sapiens
cugcaucuuggggacau

SEQ ID NO: 649990 - RNA, 22 nt, Homo sapiens
cugcauggagaaggguucugcc

SEQ ID NO: 649991 - RNA, 21 nt, Homo sapiens
cugcaugguguuuaugcacac

SEQ ID NO: 649992 - RNA, 14 nt, Homo sapiens
cugcauguacugua

SEQ ID NO: 649993 - RNA, 15 nt, Homo sapiens
cugcauguuacauaa

SEQ ID NO: 649994 - RNA, 14 nt, Homo sapiens
cugcauguucugcu

SEQ ID NO: 649995 - RNA, 21 nt, Homo sapiens
cugcauucaccuuagugcaac

SEQ ID NO: 649996 - RNA, 20 nt, Homo sapiens
cugcauugagaacugcauau

SEQ ID NO: 649997 - RNA, 13 nt, Homo sapiens
cugcauugcugag

SEQ ID NO: 649998 - RNA, 21 nt, Homo sapiens
cugcauuuuacacaugugcug

SEQ ID NO: 649999 - RNA, 15 nt, Homo sapiens
cugcauuuuacugua

SEQ ID NO: 650000 - RNA, 15 nt, Homo sapiens
cugcauuuugcuauu

SEQ ID NO: 650001 - RNA, 22 nt, Homo sapiens
cugccaaaaauauaauucuuag

SEQ ID NO: 650002 - RNA, 14 nt, Homo sapiens
cugccaaacacauu

SEQ ID NO: 650003 - RNA, 18 nt, Homo sapiens
cugccaaaggaugugaua

SEQ ID NO: 650004 - RNA, 19 nt, Homo sapiens
cugccaagagguacuguaa

SEQ ID NO: 650005 - RNA, 22 nt, Homo sapiens
cugccaagggcaggaccaaugg

SEQ ID NO: 650006 - RNA, 12 nt, Homo sapiens
cugccaaggugg

SEQ ID NO: 650007 - RNA, 17 nt, Homo sapiens
cugccacagacuguggu

SEQ ID NO: 650008 - RNA, 23 nt, Homo sapiens
cugccaccccucuucugcuccuu

SEQ ID NO: 650009 - RNA, 19 nt, Homo sapiens
cugccacuguguacugugg

SEQ ID NO: 650010 - RNA, 14 nt, Homo sapiens
cugccagacacuga

SEQ ID NO: 650011 - RNA, 15 nt, Homo sapiens
cugccagacacugag

SEQ ID NO: 650012 - RNA, 19 nt, Homo sapiens
cugccagccccuuugccau

SEQ ID NO: 650013 - RNA, 15 nt, Homo sapiens
cugccagcucucuga

SEQ ID NO: 650014 - RNA, 21 nt, Homo sapiens
cugccaggcaugguagcucau

SEQ ID NO: 650015 - RNA, 13 nt, Homo sapiens
cugccagggagcu

SEQ ID NO: 650016 - RNA, 20 nt, Homo sapiens
cugccagugccuuaccuccu

SEQ ID NO: 650017 - RNA, 21 nt, Homo sapiens
cugccaguugucuuaugugaa

SEQ ID NO: 650018 - RNA, 18 nt, Homo sapiens
cugccaucgcugugaugc

SEQ ID NO: 650019 - RNA, 17 nt, Homo sapiens
cugccaugacagaggcu

SEQ ID NO: 650020 - RNA, 13 nt, Homo sapiens
cugccaugauagc

SEQ ID NO: 650021 - RNA, 15 nt, Homo sapiens
cugccaugccagcuu

SEQ ID NO: 650022 - RNA, 13 nt, Homo sapiens
cugccaugucaga

SEQ ID NO: 650023 - RNA, 23 nt, Homo sapiens
cugccauuaaauccgcaaacagc

SEQ ID NO: 650024 - RNA, 20 nt, Homo sapiens
cugccauuauuuucugucag

SEQ ID NO: 650025 - RNA, 22 nt, Homo sapiens
cugccauucacuucauaaucca

SEQ ID NO: 650026 - RNA, 18 nt, Homo sapiens
cugccauuggacuaugga

SEQ ID NO: 650027 - RNA, 12 nt, Homo sapiens
cugccauuuccc

SEQ ID NO: 650028 - RNA, 14 nt, Homo sapiens
cugcccaagcacuu

SEQ ID NO: 650029 - RNA, 13 nt, Homo sapiens
cugcccaaugaga

SEQ ID NO: 650030 - RNA, 17 nt, Homo sapiens
cugcccagacugaugag

SEQ ID NO: 650031 - RNA, 22 nt, Homo sapiens
cugcccagacugaugagcacau

SEQ ID NO: 650032 - RNA, 17 nt, Homo sapiens
cugcccaucagugacag

SEQ ID NO: 650033 - RNA, 14 nt, Homo sapiens
cugccccaccugcc

SEQ ID NO: 650034 - RNA, 16 nt, Homo sapiens
cugcccccaauccaug

SEQ ID NO: 650035 - RNA, 18 nt, Homo sapiens
cugcccccaucaccucua

SEQ ID NO: 650036 - RNA, 20 nt, Homo sapiens
cugccccggaccuaccuccc

SEQ ID NO: 650037 - RNA, 16 nt, Homo sapiens
cugccccuacccugga

SEQ ID NO: 650038 - RNA, 12 nt, Homo sapiens
cugccccucggg

SEQ ID NO: 650039 - RNA, 17 nt, Homo sapiens
cugccccucucaccaaa

SEQ ID NO: 650040 - RNA, 16 nt, Homo sapiens
cugccccugccugaca

SEQ ID NO: 650041 - RNA, 17 nt, Homo sapiens
cugcccgaaaagcauuu

SEQ ID NO: 650042 - RNA, 15 nt, Homo sapiens
cugcccgacucaggu

SEQ ID NO: 650043 - RNA, 19 nt, Homo sapiens
cugcccgcgggagacagcu

SEQ ID NO: 650044 - RNA, 20 nt, Homo sapiens
cugcccucugggucccuccu

SEQ ID NO: 650045 - RNA, 20 nt, Homo sapiens
cugcccugcccccucggggg

SEQ ID NO: 650046 - RNA, 14 nt, Homo sapiens
cugcccugccugag

SEQ ID NO: 650047 - RNA, 18 nt, Homo sapiens
cugcccugguccagggaa

SEQ ID NO: 650048 - RNA, 19 nt, Homo sapiens
cugcccuguacugaagaaa

SEQ ID NO: 650049 - RNA, 19 nt, Homo sapiens
cugcccuucccccugcaaa

SEQ ID NO: 650050 - RNA, 14 nt, Homo sapiens
cugcccuuggcacc

SEQ ID NO: 650051 - RNA, 17 nt, Homo sapiens
cugccgaaccaaaagaa

SEQ ID NO: 650052 - RNA, 15 nt, Homo sapiens
cugccgcuaccuccc

SEQ ID NO: 650053 - RNA, 21 nt, Homo sapiens
cugccggcucuuuccuugcuc

SEQ ID NO: 650054 - RNA, 19 nt, Homo sapiens
cugccgggcugagggccug

SEQ ID NO: 650055 - RNA, 19 nt, Homo sapiens
cugccuaauaguaacuggu

SEQ ID NO: 650056 - RNA, 16 nt, Homo sapiens
cugccuaauuuugcca

SEQ ID NO: 650057 - RNA, 21 nt, Homo sapiens
cugccuacuuuuaguugacuc

SEQ ID NO: 650058 - RNA, 19 nt, Homo sapiens
cugccuaggaggcuggcca

SEQ ID NO: 650059 - RNA, 21 nt, Homo sapiens
cugccuagucgggacuuguaa

SEQ ID NO: 650060 - RNA, 21 nt, Homo sapiens
cugccuauaaucuuauacaac

SEQ ID NO: 650061 - RNA, 13 nt, Homo sapiens
cugccuaugucau

SEQ ID NO: 650062 - RNA, 15 nt, Homo sapiens
cugccuaugucauac

SEQ ID NO: 650063 - RNA, 23 nt, Homo sapiens
cugccuccagaauggucuuucua

SEQ ID NO: 650064 - RNA, 15 nt, Homo sapiens
cugccucucuucuuc

SEQ ID NO: 650065 - RNA, 22 nt, Homo sapiens
cugccucugaguuuugaugcug

SEQ ID NO: 650066 - RNA, 21 nt, Homo sapiens
cugccucugggcagccugcuu

SEQ ID NO: 650067 - RNA, 14 nt, Homo sapiens
cugccucuguggaa

SEQ ID NO: 650068 - RNA, 15 nt, Homo sapiens
cugccugacacugag

SEQ ID NO: 650069 - RNA, 20 nt, Homo sapiens
cugccugccgcugcaccugc

SEQ ID NO: 650070 - RNA, 20 nt, Homo sapiens
cugccuggcccccaaccuca

SEQ ID NO: 650071 - RNA, 17 nt, Homo sapiens
cugccugggccaugcga

SEQ ID NO: 650072 - RNA, 19 nt, Homo sapiens
cugccugggccguggcaca

SEQ ID NO: 650073 - RNA, 20 nt, Homo sapiens
cugccugggccguggcacag

SEQ ID NO: 650074 - RNA, 23 nt, Homo sapiens
cugccuggggcccaaguugcagu

SEQ ID NO: 650075 - RNA, 16 nt, Homo sapiens
cuggacaaggucucuu

SEQ ID NO: 650076 - RNA, 18 nt, Homo sapiens
cuggacacaauaggucuu

SEQ ID NO: 650077 - RNA, 18 nt, Homo sapiens
cuggacacagccccaugu

SEQ ID NO: 650078 - RNA, 22 nt, Homo sapiens
cuggacaccgggccaguaucua

SEQ ID NO: 650079 - RNA, 21 nt, Homo sapiens
cuggacagaugaauaccuuuu

SEQ ID NO: 650080 - RNA, 20 nt, Homo sapiens
cuggacauuuuuucagucau

SEQ ID NO: 650081 - RNA, 14 nt, Homo sapiens
cuggaccagccugu

SEQ ID NO: 650082 - RNA, 13 nt, Homo sapiens
cuggaccauucca

SEQ ID NO: 650083 - RNA, 18 nt, Homo sapiens
cuggaccccaucugugaa

SEQ ID NO: 650084 - RNA, 18 nt, Homo sapiens
cuggacggggacugggga

SEQ ID NO: 650085 - RNA, 13 nt, Homo sapiens
cuggacucagggu

SEQ ID NO: 650086 - RNA, 13 nt, Homo sapiens
cuggacucucagu

SEQ ID NO: 650087 - RNA, 19 nt, Homo sapiens
cuggagaagcucccaggaa

SEQ ID NO: 650088 - RNA, 21 nt, Homo sapiens
cuggagaccagggagccuuug

SEQ ID NO: 650089 - RNA, 14 nt, Homo sapiens
cugggcagauccuc

SEQ ID NO: 650090 - RNA, 22 nt, Homo sapiens
cugggcagcauagcaagacaca

SEQ ID NO: 650091 - RNA, 21 nt, Homo sapiens
cugggcagccguuuuccucau

SEQ ID NO: 650092 - RNA, 14 nt, Homo sapiens
cugggcagccuuuc

SEQ ID NO: 650093 - RNA, 13 nt, Homo sapiens
cugggcagguggg

SEQ ID NO: 650094 - RNA, 18 nt, Homo sapiens
cugggcauuguugagguu

SEQ ID NO: 650095 - RNA, 22 nt, Homo sapiens
cugggccaggagcccacagugc

SEQ ID NO: 650096 - RNA, 12 nt, Homo sapiens
cugggccagugc

SEQ ID NO: 650097 - RNA, 10 nt, Homo sapiens
cugggccaug

SEQ ID NO: 650098 - RNA, 14 nt, Homo sapiens
cugggccaugucca

SEQ ID NO: 650099 - RNA, 15 nt, Homo sapiens
cugggccauguccaa

SEQ ID NO: 650100 - RNA, 13 nt, Homo sapiens
cugggcccaaagg

SEQ ID NO: 650101 - RNA, 22 nt, Homo sapiens
cugggcccaagugauccuucca

SEQ ID NO: 650102 - RNA, 13 nt, Homo sapiens
cugggcccagaag

SEQ ID NO: 650103 - RNA, 23 nt, Homo sapiens
cugggcccaguaccuagcuggcu

SEQ ID NO: 650104 - RNA, 15 nt, Homo sapiens
cugggccccaccacc

SEQ ID NO: 650105 - RNA, 22 nt, Homo sapiens
cugggccccaccaccuaggcca

SEQ ID NO: 650106 - RNA, 20 nt, Homo sapiens
cugggccccacuggacaaca

SEQ ID NO: 650107 - RNA, 22 nt, Homo sapiens
cugggccccacuggacaacacu

SEQ ID NO: 650108 - RNA, 19 nt, Homo sapiens
cugggccccaugcucugcc

SEQ ID NO: 650109 - RNA, 22 nt, Homo sapiens
cugggccccuccccucagagcc

SEQ ID NO: 650110 - RNA, 22 nt, Homo sapiens
cugggcccucucugcucugcgu

SEQ ID NO: 650111 - RNA, 20 nt, Homo sapiens
cugggcccucucuucucacc

SEQ ID NO: 650112 - RNA, 16 nt, Homo sapiens
cugggccgcugccacg

SEQ ID NO: 650113 - RNA, 21 nt, Homo sapiens
cugggccuccugacagcaaua

SEQ ID NO: 650114 - RNA, 15 nt, Homo sapiens
cugggccugaccaaa

SEQ ID NO: 650115 - RNA, 21 nt, Homo sapiens
cugggccuuuccugugccaac

SEQ ID NO: 650116 - RNA, 24 nt, Homo sapiens
cugggcgcugucuugugucuccua

SEQ ID NO: 650117 - RNA, 15 nt, Homo sapiens
cugggcuacugccac

SEQ ID NO: 650118 - RNA, 16 nt, Homo sapiens
cugggcuagggagaau

SEQ ID NO: 650119 - RNA, 16 nt, Homo sapiens
cugggcucaagugauc

SEQ ID NO: 650120 - RNA, 13 nt, Homo sapiens
cugggcugugcua

SEQ ID NO: 650121 - RNA, 17 nt, Homo sapiens
cuggggaacuagaggga

SEQ ID NO: 650122 - RNA, 19 nt, Homo sapiens
cuggggaagcugugaaaga

SEQ ID NO: 650123 - RNA, 15 nt, Homo sapiens
cuggggacucaggga

SEQ ID NO: 650124 - RNA, 23 nt, Homo sapiens
cuggggaggcaggcauuccugaa

SEQ ID NO: 650125 - RNA, 18 nt, Homo sapiens
cuggggaggccaguguug

SEQ ID NO: 650126 - RNA, 20 nt, Homo sapiens
cuggggaggccaguguugug

SEQ ID NO: 650127 - RNA, 15 nt, Homo sapiens
cuggggccacccagc

SEQ ID NO: 650128 - RNA, 20 nt, Homo sapiens
cuggggccuacagcuuugau

SEQ ID NO: 650129 - RNA, 19 nt, Homo sapiens
cuggggccuagcgaucucu

SEQ ID NO: 650130 - RNA, 15 nt, Homo sapiens
cuggggccuccagaa

SEQ ID NO: 650131 - RNA, 21 nt, Homo sapiens
cugggggcaggccagggcagu

SEQ ID NO: 650132 - RNA, 22 nt, Homo sapiens
cugggggcugccgagccaccau

SEQ ID NO: 650133 - RNA, 20 nt, Homo sapiens
cuggggguggggagguguca

SEQ ID NO: 650134 - RNA, 21 nt, Homo sapiens
cuggggugcauccuccucagc

SEQ ID NO: 650135 - RNA, 17 nt, Homo sapiens
cuggggugggcaguuuu

SEQ ID NO: 650136 - RNA, 15 nt, Homo sapiens
cuggguaagagcaca

SEQ ID NO: 650137 - RNA, 13 nt, Homo sapiens
cugggucacuugc

SEQ ID NO: 650138 - RNA, 22 nt, Homo sapiens
cugggucuuucugacaucagca

SEQ ID NO: 650139 - RNA, 12 nt, Homo sapiens
cugggugcaaag

SEQ ID NO: 650140 - RNA, 20 nt, Homo sapiens
cuggguggcuuaugagagag

SEQ ID NO: 650141 - RNA, 20 nt, Homo sapiens
cuggguucccuuuccuucca

SEQ ID NO: 650142 - RNA, 15 nt, Homo sapiens
cuggguuugagaaau

SEQ ID NO: 650143 - RNA, 19 nt, Homo sapiens
cugguaccgagccccugaa

SEQ ID NO: 650144 - RNA, 17 nt, Homo sapiens
cugguagguugggacac

SEQ ID NO: 650145 - RNA, 17 nt, Homo sapiens
cugguauacauugaauu

SEQ ID NO: 650146 - RNA, 15 nt, Homo sapiens
cuggucaaguuguaa

SEQ ID NO: 650147 - RNA, 17 nt, Homo sapiens
cuggucaccuugcacuc

SEQ ID NO: 650148 - RNA, 16 nt, Homo sapiens
cuggucaguacccacu

SEQ ID NO: 650149 - RNA, 23 nt, Homo sapiens
cuggucauggaauggcagguguc

SEQ ID NO: 650150 - RNA, 23 nt, Homo sapiens
cuggucccaagacagugagacag

SEQ ID NO: 650151 - RNA, 18 nt, Homo sapiens
cuggucccggucaccgcg

SEQ ID NO: 650152 - RNA, 14 nt, Homo sapiens
cugguccuguggau

SEQ ID NO: 650153 - RNA, 13 nt, Homo sapiens
cugguccuuccag

SEQ ID NO: 650154 - RNA, 23 nt, Homo sapiens
cuggucuagucacgcaugcagug

SEQ ID NO: 650155 - RNA, 23 nt, Homo sapiens
cuggucucaaacuccugggcuca

SEQ ID NO: 650156 - RNA, 16 nt, Homo sapiens
cuggucuuggugaaca

SEQ ID NO: 650157 - RNA, 13 nt, Homo sapiens
cuggucuugugga

SEQ ID NO: 650158 - RNA, 18 nt, Homo sapiens
cuggugaaggaucuugcc

SEQ ID NO: 650159 - RNA, 15 nt, Homo sapiens
cuggugagaggugca

SEQ ID NO: 650160 - RNA, 22 nt, Homo sapiens
cuggugauggauuaacauauag

SEQ ID NO: 650161 - RNA, 16 nt, Homo sapiens
cuggugcaaauucaga

SEQ ID NO: 650162 - RNA, 18 nt, Homo sapiens
cuggugccucugugcaca

SEQ ID NO: 650163 - RNA, 20 nt, Homo sapiens
cugguggcaccagaugcaac

SEQ ID NO: 650164 - RNA, 15 nt, Homo sapiens
cuggugggcagagag

SEQ ID NO: 650165 - RNA, 18 nt, Homo sapiens
cuggugggucugagcugg

SEQ ID NO: 650166 - RNA, 18 nt, Homo sapiens
cuggugguggcaccaucu

SEQ ID NO: 650167 - RNA, 19 nt, Homo sapiens
cuggugucggcaucauacu

SEQ ID NO: 650168 - RNA, 12 nt, Homo sapiens
cugguguucuau

SEQ ID NO: 650169 - RNA, 23 nt, Homo sapiens
cugguuagaaaaaggacucugcu

SEQ ID NO: 650170 - RNA, 14 nt, Homo sapiens
cugguucuugcaaa

SEQ ID NO: 650171 - RNA, 17 nt, Homo sapiens
cugguugaaaaauggca

SEQ ID NO: 650172 - RNA, 13 nt, Homo sapiens
cugguugauuugu

SEQ ID NO: 650173 - RNA, 21 nt, Homo sapiens
cugguugcuucagaccugaca

SEQ ID NO: 650174 - RNA, 15 nt, Homo sapiens
cugguuuaaccuccu

SEQ ID NO: 650175 - RNA, 15 nt, Homo sapiens
cugguuuaauuacau

SEQ ID NO: 650176 - RNA, 17 nt, Homo sapiens
cugguuucuaccagcuc

SEQ ID NO: 650177 - RNA, 20 nt, Homo sapiens
cugguuugaaagaugcagug

SEQ ID NO: 650178 - RNA, 19 nt, Homo sapiens
cugguuugaaagauuauga

SEQ ID NO: 650179 - RNA, 15 nt, Homo sapiens
cugguuuucugccaa

SEQ ID NO: 650180 - RNA, 14 nt, Homo sapiens
cugguuuucuugcc

SEQ ID NO: 650181 - RNA, 17 nt, Homo sapiens
cuguaaaaacacugaaa

SEQ ID NO: 650182 - RNA, 16 nt, Homo sapiens
cuguaaaacagguuau

SEQ ID NO: 650183 - RNA, 12 nt, Homo sapiens
cuguaaaaccag

SEQ ID NO: 650184 - RNA, 16 nt, Homo sapiens
cuguaaaauacaugua

SEQ ID NO: 650185 - RNA, 23 nt, Homo sapiens
cuguaaacuguguauuccaagac

SEQ ID NO: 650186 - RNA, 15 nt, Homo sapiens
cuguaaacuuggaau

SEQ ID NO: 650187 - RNA, 21 nt, Homo sapiens
cuguaaagauguuuauuucag

SEQ ID NO: 650188 - RNA, 15 nt, Homo sapiens
cuguaacaauuaugu

SEQ ID NO: 650189 - RNA, 14 nt, Homo sapiens
cuguaaccucuuca

SEQ ID NO: 650190 - RNA, 19 nt, Homo sapiens
cuguaacucagacauucca

SEQ ID NO: 650191 - RNA, 14 nt, Homo sapiens
cuguaacugucuca

SEQ ID NO: 650192 - RNA, 20 nt, Homo sapiens
cuguaacuuccaaauaaaua

SEQ ID NO: 650193 - RNA, 18 nt, Homo sapiens
cuguaaguaauugccaca

SEQ ID NO: 650194 - RNA, 19 nt, Homo sapiens
cuguaagugcuuaaucaua

SEQ ID NO: 650195 - RNA, 22 nt, Homo sapiens
cuguaauaaauaaauauacuca

SEQ ID NO: 650196 - RNA, 21 nt, Homo sapiens
cuguaauauuguaaauacugg

SEQ ID NO: 650197 - RNA, 16 nt, Homo sapiens
cuuggaauacguucuc

SEQ ID NO: 650198 - RNA, 21 nt, Homo sapiens
cuuggacccuggugaccuccu

SEQ ID NO: 650199 - RNA, 15 nt, Homo sapiens
cuuggaccguaucac

SEQ ID NO: 650200 - RNA, 15 nt, Homo sapiens
cuuggaccucaguga

SEQ ID NO: 650201 - RNA, 15 nt, Homo sapiens
cuuggagcaggcaaa

SEQ ID NO: 650202 - RNA, 18 nt, Homo sapiens
cuuggagcccgugcagua

SEQ ID NO: 650203 - RNA, 12 nt, Homo sapiens
cuuggagcugcc

SEQ ID NO: 650204 - RNA, 18 nt, Homo sapiens
cuuggaggaggaugccac

SEQ ID NO: 650205 - RNA, 20 nt, Homo sapiens
cuuggagggcucagggcagu

SEQ ID NO: 650206 - RNA, 20 nt, Homo sapiens
cuuggagucuguucuaggga

SEQ ID NO: 650207 - RNA, 19 nt, Homo sapiens
cuuggauaauuccccaaga

SEQ ID NO: 650208 - RNA, 18 nt, Homo sapiens
cuuggaucagaugaacuc

SEQ ID NO: 650209 - RNA, 19 nt, Homo sapiens
cuuggaugguuaguuucac

SEQ ID NO: 650210 - RNA, 18 nt, Homo sapiens
cuuggcacccccaugcug

SEQ ID NO: 650211 - RNA, 21 nt, Homo sapiens
cuuggcaggaugaugcuguca

SEQ ID NO: 650212 - RNA, 23 nt, Homo sapiens
cuuggcaguguggacaugagcag

SEQ ID NO: 650213 - RNA, 19 nt, Homo sapiens
cuuggcccgcggccugcac

SEQ ID NO: 650214 - RNA, 20 nt, Homo sapiens
cuuggccuccccugcugaag

SEQ ID NO: 650215 - RNA, 21 nt, Homo sapiens
cuuggcucacugcaaccucua

SEQ ID NO: 650216 - RNA, 14 nt, Homo sapiens
cuuggcugcuuaaa

SEQ ID NO: 650217 - RNA, 13 nt, Homo sapiens
cuuggcugugagg

SEQ ID NO: 650218 - RNA, 15 nt, Homo sapiens
cuuggcuuccagaag

SEQ ID NO: 650219 - RNA, 16 nt, Homo sapiens
cuuggcuucugugaug

SEQ ID NO: 650220 - RNA, 21 nt, Homo sapiens
cuugggaaacuauucaugaau

SEQ ID NO: 650221 - RNA, 19 nt, Homo sapiens
cuugggaaagagacagagu

SEQ ID NO: 650222 - RNA, 19 nt, Homo sapiens
cuugggaaggaaggcagug

SEQ ID NO: 650223 - RNA, 15 nt, Homo sapiens
cuugggacauggcac

SEQ ID NO: 650224 - RNA, 17 nt, Homo sapiens
cuugggagcaccgccug

SEQ ID NO: 650225 - RNA, 12 nt, Homo sapiens
cuugggagcugc

SEQ ID NO: 650226 - RNA, 14 nt, Homo sapiens
cuugggaugaucuu

SEQ ID NO: 650227 - RNA, 13 nt, Homo sapiens
cuuggggacuaac

SEQ ID NO: 650228 - RNA, 23 nt, Homo sapiens
cuuggggacuaacccaaugccug

SEQ ID NO: 650229 - RNA, 20 nt, Homo sapiens
cuuggggcggaacucacugc

SEQ ID NO: 650230 - RNA, 13 nt, Homo sapiens
cuuggggggccaa

SEQ ID NO: 650231 - RNA, 22 nt, Homo sapiens
cuugggucucauuuagaacuug

SEQ ID NO: 650232 - RNA, 18 nt, Homo sapiens
cuuggucacauacaauua

SEQ ID NO: 650233 - RNA, 18 nt, Homo sapiens
cuuggugacaaaauucau

SEQ ID NO: 650234 - RNA, 16 nt, Homo sapiens
cuuggugcugcugaau

SEQ ID NO: 650235 - RNA, 21 nt, Homo sapiens
cuugguggcgcgcaccuguag

SEQ ID NO: 650236 - RNA, 16 nt, Homo sapiens
cuugguucacugcaac

SEQ ID NO: 650237 - RNA, 16 nt, Homo sapiens
cuugguuccuucugcc

SEQ ID NO: 650238 - RNA, 15 nt, Homo sapiens
cuugguucuggccac

SEQ ID NO: 650239 - RNA, 14 nt, Homo sapiens
cuugguucuuucag

SEQ ID NO: 650240 - RNA, 20 nt, Homo sapiens
cuugguugucuggcaaggac

SEQ ID NO: 650241 - RNA, 23 nt, Homo sapiens
cuuguaaaaagggggcugcauuc

SEQ ID NO: 650242 - RNA, 23 nt, Homo sapiens
cuuguaaaaugcuuuucacuuuc

SEQ ID NO: 650243 - RNA, 14 nt, Homo sapiens
cuuguaaagacaga

SEQ ID NO: 650244 - RNA, 14 nt, Homo sapiens
cuuguaaagacugu

SEQ ID NO: 650245 - RNA, 15 nt, Homo sapiens
cuuguaaagacugua

SEQ ID NO: 650246 - RNA, 16 nt, Homo sapiens
cuuguaaagacuguag

SEQ ID NO: 650247 - RNA, 23 nt, Homo sapiens
cuuguaacaagaaaacauaagag

SEQ ID NO: 650248 - RNA, 15 nt, Homo sapiens
cuuguaacuaaaaua

SEQ ID NO: 650249 - RNA, 13 nt, Homo sapiens
cuuguaaguuauu

SEQ ID NO: 650250 - RNA, 22 nt, Homo sapiens
cuuguaaucgauuugucuguca

SEQ ID NO: 650251 - RNA, 22 nt, Homo sapiens
cuuguacagugucugugccaug

SEQ ID NO: 650252 - RNA, 19 nt, Homo sapiens
cuuguacaguuaacucucc

SEQ ID NO: 650253 - RNA, 21 nt, Homo sapiens
cuuguacauaaugcgugcaua

SEQ ID NO: 650254 - RNA, 21 nt, Homo sapiens
cuuguagaaugggaugugaua

SEQ ID NO: 650255 - RNA, 14 nt, Homo sapiens
cuuguagaugcauu

SEQ ID NO: 650256 - RNA, 23 nt, Homo sapiens
cuuguaguauuuugggagcaaaa

SEQ ID NO: 650257 - RNA, 21 nt, Homo sapiens
cuuguaguuccauguacugua

SEQ ID NO: 650258 - RNA, 20 nt, Homo sapiens
cuuguauauauggaucagag

SEQ ID NO: 650259 - RNA, 16 nt, Homo sapiens
cuuguaucaacacugu

SEQ ID NO: 650260 - RNA, 13 nt, Homo sapiens
cuugucagaauuu

SEQ ID NO: 650261 - RNA, 13 nt, Homo sapiens
cuugucauauucg

SEQ ID NO: 650262 - RNA, 19 nt, Homo sapiens
cuugucauggaaaaugucc

SEQ ID NO: 650263 - RNA, 13 nt, Homo sapiens
cuugucauuccag

SEQ ID NO: 650264 - RNA, 20 nt, Homo sapiens
cuuguccaggaacugccugg

SEQ ID NO: 650265 - RNA, 17 nt, Homo sapiens
cuuguccaucacucuag

SEQ ID NO: 650266 - RNA, 15 nt, Homo sapiens
cuuguccaugugguu

SEQ ID NO: 650267 - RNA, 16 nt, Homo sapiens
cuugucccuuucccua

SEQ ID NO: 650268 - RNA, 15 nt, Homo sapiens
cuuguccuaugucaa

SEQ ID NO: 650269 - RNA, 16 nt, Homo sapiens
cuuguccucauucuug

SEQ ID NO: 650270 - RNA, 13 nt, Homo sapiens
cuuguccugaugc

SEQ ID NO: 650271 - RNA, 16 nt, Homo sapiens
cuugucucacuugugc

SEQ ID NO: 650272 - RNA, 17 nt, Homo sapiens
cuugucucuaccaaaau

SEQ ID NO: 650273 - RNA, 21 nt, Homo sapiens
cuugucucugggccacuugga

SEQ ID NO: 650274 - RNA, 21 nt, Homo sapiens
cuugucuuuugagcuauucac

SEQ ID NO: 650275 - RNA, 16 nt, Homo sapiens
cuugugaccauuguaa

SEQ ID NO: 650276 - RNA, 11 nt, Homo sapiens
cuugugccuug

SEQ ID NO: 650277 - RNA, 19 nt, Homo sapiens
cuuguggaugacucuguaa

SEQ ID NO: 650278 - RNA, 23 nt, Homo sapiens
cuuguggauggaaauguagugcu

SEQ ID NO: 650279 - RNA, 22 nt, Homo sapiens
cuuguggcuucucucucuagca

SEQ ID NO: 650280 - RNA, 17 nt, Homo sapiens
cuugugguuauaacuua

SEQ ID NO: 650281 - RNA, 15 nt, Homo sapiens
cuuguuaccauugua

SEQ ID NO: 650282 - RNA, 15 nt, Homo sapiens
cuuguuacugugaua

SEQ ID NO: 650283 - RNA, 23 nt, Homo sapiens
cuuguucccuaggggacacuucc

SEQ ID NO: 650284 - RNA, 15 nt, Homo sapiens
cuuguucuacugaga

SEQ ID NO: 650285 - RNA, 20 nt, Homo sapiens
cuuguugagauccccguguu

SEQ ID NO: 650286 - RNA, 13 nt, Homo sapiens
cuuguugcucaaa

SEQ ID NO: 650287 - RNA, 22 nt, Homo sapiens
cuuguuggauuccagugcaggu

SEQ ID NO: 650288 - RNA, 18 nt, Homo sapiens
cuuguuguuucuugccug

SEQ ID NO: 650289 - RNA, 15 nt, Homo sapiens
cuuguuuaacauaua

SEQ ID NO: 650290 - RNA, 24 nt, Homo sapiens
cuuguuuacagcacuacucugugc

SEQ ID NO: 650291 - RNA, 15 nt, Homo sapiens
cuuguuuacagugag

SEQ ID NO: 650292 - RNA, 22 nt, Homo sapiens
cuuguuucccagauuucaggaa

SEQ ID NO: 650293 - RNA, 14 nt, Homo sapiens
cuuguuucuccugc

SEQ ID NO: 650294 - RNA, 16 nt, Homo sapiens
cuuguuugucuuccau

SEQ ID NO: 650295 - RNA, 13 nt, Homo sapiens
cuuguuuguugca

SEQ ID NO: 650296 - RNA, 15 nt, Homo sapiens
cuucaagcucucugu

SEQ ID NO: 650297 - RNA, 19 nt, Homo sapiens
cuucaaggcccucagagau

SEQ ID NO: 650298 - RNA, 14 nt, Homo sapiens
cuucaaguacuguu

SEQ ID NO: 650299 - RNA, 14 nt, Homo sapiens
cuucaaguggcagg

SEQ ID NO: 650300 - RNA, 16 nt, Homo sapiens
cuucaaguuagcucag

SEQ ID NO: 650301 - RNA, 19 nt, Homo sapiens
cuucaaguuagcucaggag

SEQ ID NO: 650302 - RNA, 21 nt, Homo sapiens
cuucaaucucuugcacucaaa

SEQ ID NO: 650303 - RNA, 16 nt, Homo sapiens
cuucaaucuuaaaaca

SEQ ID NO: 650304 - RNA, 22 nt, Homo sapiens
cuucaaugcaaaguacauguau

SEQ ID NO: 650305 - RNA, 19 nt, Homo sapiens
cuucaaugucaacagaucc

SEQ ID NO: 650306 - RNA, 22 nt, Homo sapiens
cuucaauuuggauauuuggagg

SEQ ID NO: 650307 - RNA, 13 nt, Homo sapiens
cuucacaacuagg

SEQ ID NO: 650308 - RNA, 13 nt, Homo sapiens
cuucacaguguuu

SEQ ID NO: 650309 - RNA, 15 nt, Homo sapiens
cuucaccaagugcaa

SEQ ID NO: 650310 - RNA, 11 nt, Homo sapiens
cuucaccaucu

SEQ ID NO: 650311 - RNA, 17 nt, Homo sapiens
cuucacccuggagccca

SEQ ID NO: 650312 - RNA, 17 nt, Homo sapiens
cuucaccuaagucucug

SEQ ID NO: 650313 - RNA, 23 nt, Homo sapiens
cuucacuccccuaucccauucuc

SEQ ID NO: 650314 - RNA, 19 nt, Homo sapiens
cuucacucgacauuuggug

SEQ ID NO: 650315 - RNA, 11 nt, Homo sapiens
cuucacugagc

SEQ ID NO: 650316 - RNA, 22 nt, Homo sapiens
cuucacugcagaauguaaaggu

SEQ ID NO: 650317 - RNA, 11 nt, Homo sapiens
cuucacuguau

SEQ ID NO: 650318 - RNA, 19 nt, Homo sapiens
cuucacuguccuccaagcc

SEQ ID NO: 650319 - RNA, 23 nt, Homo sapiens
cuucacuguccuccaagccagcg

SEQ ID NO: 650320 - RNA, 22 nt, Homo sapiens
cuucagaacugcccuugcugcc

SEQ ID NO: 650321 - RNA, 13 nt, Homo sapiens
cuucagaauuaga

SEQ ID NO: 650322 - RNA, 19 nt, Homo sapiens
cuucagacacaggaaaaau

SEQ ID NO: 650323 - RNA, 12 nt, Homo sapiens
cuucagacaccc

SEQ ID NO: 650324 - RNA, 14 nt, Homo sapiens
cuucagacauguaa

SEQ ID NO: 650325 - RNA, 16 nt, Homo sapiens
cuucagacucauggau

SEQ ID NO: 650326 - RNA, 23 nt, Homo sapiens
cuucagagacuucguaauuaaag

SEQ ID NO: 650327 - RNA, 12 nt, Homo sapiens
cuucagagccag

SEQ ID NO: 650328 - RNA, 17 nt, Homo sapiens
cuucagaggagaaagaa

SEQ ID NO: 650329 - RNA, 14 nt, Homo sapiens
cuucagagugaaga

SEQ ID NO: 650330 - RNA, 19 nt, Homo sapiens
cuucagaguuuguguguau

SEQ ID NO: 650331 - RNA, 17 nt, Homo sapiens
cuucagauacaaacugc

SEQ ID NO: 650332 - RNA, 20 nt, Homo sapiens
cuucagaucucuaacuucac

SEQ ID NO: 650333 - RNA, 15 nt, Homo sapiens
cuucagaucugaggu

SEQ ID NO: 650334 - RNA, 16 nt, Homo sapiens
cuucagauugaacuua

SEQ ID NO: 650335 - RNA, 15 nt, Homo sapiens
cuucagcacauucca

SEQ ID NO: 650336 - RNA, 16 nt, Homo sapiens
cuucagcacauuccac

SEQ ID NO: 650337 - RNA, 23 nt, Homo sapiens
cuucagcaccugccccggcagug

SEQ ID NO: 650338 - RNA, 20 nt, Homo sapiens
cuucagccccuagugcuauu

SEQ ID NO: 650339 - RNA, 20 nt, Homo sapiens
cuucagcuccugaguagcug

SEQ ID NO: 650340 - RNA, 12 nt, Homo sapiens
cuucagcuguac

SEQ ID NO: 650341 - RNA, 20 nt, Homo sapiens
cuucagcuguacauacucag

SEQ ID NO: 650342 - RNA, 15 nt, Homo sapiens
cuucaggacucuaga

SEQ ID NO: 650343 - RNA, 18 nt, Homo sapiens
cuucaggcagccagugug

SEQ ID NO: 650344 - RNA, 21 nt, Homo sapiens
cuucagggcagggcucugaua

SEQ ID NO: 650345 - RNA, 23 nt, Homo sapiens
cuucaggggcacuucauugagag

SEQ ID NO: 650346 - RNA, 13 nt, Homo sapiens
cuucaggugcuuu

SEQ ID NO: 650347 - RNA, 14 nt, Homo sapiens
cuucagguggaaaa

SEQ ID NO: 650348 - RNA, 22 nt, Homo sapiens
cuucagguucuuagugucacuu

SEQ ID NO: 650349 - RNA, 22 nt, Homo sapiens
cuucaguauuuuuaaauuguaa

SEQ ID NO: 650350 - RNA, 22 nt, Homo sapiens
cuucagucuugaauuucuaaaa

SEQ ID NO: 650351 - RNA, 16 nt, Homo sapiens
cuucagugugguacaa

SEQ ID NO: 650352 - RNA, 22 nt, Homo sapiens
cuucauaagguaauucauggca

SEQ ID NO: 650353 - RNA, 14 nt, Homo sapiens
cuucauacuccuuu

SEQ ID NO: 650354 - RNA, 16 nt, Homo sapiens
cuucauagaaaccucu

SEQ ID NO: 650355 - RNA, 19 nt, Homo sapiens
cuucauauaccagcaauau

SEQ ID NO: 650356 - RNA, 21 nt, Homo sapiens
cuucauaugucaccuuugcua

SEQ ID NO: 650357 - RNA, 17 nt, Homo sapiens
cuucauauuuuugauca

SEQ ID NO: 650358 - RNA, 13 nt, Homo sapiens
cuucaucagugug

SEQ ID NO: 650359 - RNA, 16 nt, Homo sapiens
cuucaucaucuuaccu

SEQ ID NO: 650360 - RNA, 23 nt, Homo sapiens
cuucaucauucccucucaucuca

SEQ ID NO: 650361 - RNA, 21 nt, Homo sapiens
cuucauccucugagugugacc

SEQ ID NO: 650362 - RNA, 20 nt, Homo sapiens
cuucaucugaaacccacaga

SEQ ID NO: 650363 - RNA, 21 nt, Homo sapiens
cuucaucuggcaacaucuuua

SEQ ID NO: 650364 - RNA, 16 nt, Homo sapiens
cuucaucugggacaaa

SEQ ID NO: 650365 - RNA, 18 nt, Homo sapiens
cuucaucuucacugcaau

SEQ ID NO: 650366 - RNA, 16 nt, Homo sapiens
cuucaucuuugccaua

SEQ ID NO: 650367 - RNA, 16 nt, Homo sapiens
cuucaugcauuugcac

SEQ ID NO: 650368 - RNA, 19 nt, Homo sapiens
cuucaugcuugacauaccu

SEQ ID NO: 650369 - RNA, 14 nt, Homo sapiens
cuucauggggguga

SEQ ID NO: 650370 - RNA, 22 nt, Homo sapiens
cuucauguggcucagugccuuc

SEQ ID NO: 650371 - RNA, 21 nt, Homo sapiens
cuucaugugguucagugccuu

SEQ ID NO: 650372 - RNA, 16 nt, Homo sapiens
cuucauucuaaaccaa

SEQ ID NO: 650373 - RNA, 20 nt, Homo sapiens
cuucauugcaguuauuuaga

SEQ ID NO: 650374 - RNA, 15 nt, Homo sapiens
cuucauuucaaucau

SEQ ID NO: 650375 - RNA, 15 nt, Homo sapiens
cuucauuucaggaag

SEQ ID NO: 650376 - RNA, 16 nt, Homo sapiens
cuucauuucauguaua

SEQ ID NO: 650377 - RNA, 20 nt, Homo sapiens
cuucauuucauguauaguuu

SEQ ID NO: 650378 - RNA, 16 nt, Homo sapiens
cuucauuugugccaca

SEQ ID NO: 650379 - RNA, 14 nt, Homo sapiens
cuuccaaaccugac

SEQ ID NO: 650380 - RNA, 18 nt, Homo sapiens
cuuccaaaugucccucca

SEQ ID NO: 650381 - RNA, 20 nt, Homo sapiens
cuuccaacccgaggcaauaa

SEQ ID NO: 650382 - RNA, 21 nt, Homo sapiens
cuuccaacucaaacucuuaaa

SEQ ID NO: 650383 - RNA, 18 nt, Homo sapiens
cuuccacaagagugaauu

SEQ ID NO: 650384 - RNA, 13 nt, Homo sapiens
cuuccacauguac

SEQ ID NO: 650385 - RNA, 19 nt, Homo sapiens
cuuccacccccaccaucca

SEQ ID NO: 650386 - RNA, 21 nt, Homo sapiens
cuuccacgcugucuccagacc

SEQ ID NO: 650387 - RNA, 18 nt, Homo sapiens
cuuccacucgaugaugcu

SEQ ID NO: 650388 - RNA, 16 nt, Homo sapiens
cuuccacugccugaaa

SEQ ID NO: 650389 - RNA, 17 nt, Homo sapiens
cuuccagaucacugcca

SEQ ID NO: 650390 - RNA, 18 nt, Homo sapiens
cuuccagauuuccuuuca

SEQ ID NO: 650391 - RNA, 20 nt, Homo sapiens
cuuccaggagccaccuugcc

SEQ ID NO: 650392 - RNA, 19 nt, Homo sapiens
cuuccagguaucuccagga

SEQ ID NO: 650393 - RNA, 20 nt, Homo sapiens
cuuccagugcccuaggccug

SEQ ID NO: 650394 - RNA, 14 nt, Homo sapiens
cuuccagugguuug

SEQ ID NO: 650395 - RNA, 16 nt, Homo sapiens
cuuccaguguccuuag

SEQ ID NO: 650396 - RNA, 16 nt, Homo sapiens
cuuccauaauguauaa

SEQ ID NO: 650397 - RNA, 22 nt, Homo sapiens
cuuuaauaguuuugauccuaaa

SEQ ID NO: 650398 - RNA, 19 nt, Homo sapiens
cuuuaaucacugcauuuca

SEQ ID NO: 650399 - RNA, 16 nt, Homo sapiens
cuuuaauccaguguua

SEQ ID NO: 650400 - RNA, 15 nt, Homo sapiens
cuuuaauguugccca

SEQ ID NO: 650401 - RNA, 19 nt, Homo sapiens
cuuuaauucagguauguaa

SEQ ID NO: 650402 - RNA, 21 nt, Homo sapiens
cuuuacaaaccauuaccugua

SEQ ID NO: 650403 - RNA, 20 nt, Homo sapiens
cuuuacaaucugcacuuuaa

SEQ ID NO: 650404 - RNA, 16 nt, Homo sapiens
cuuuacaauuucacuu

SEQ ID NO: 650405 - RNA, 18 nt, Homo sapiens
cuuuacaccaacuccuaa

SEQ ID NO: 650406 - RNA, 20 nt, Homo sapiens
cuuuacaggagguuguggau

SEQ ID NO: 650407 - RNA, 14 nt, Homo sapiens
cuuuacaguggcaa

SEQ ID NO: 650408 - RNA, 16 nt, Homo sapiens
cuuuacauggaugcca

SEQ ID NO: 650409 - RNA, 16 nt, Homo sapiens
cuuuaccacucuacca

SEQ ID NO: 650410 - RNA, 11 nt, Homo sapiens
cuuuaccucag

SEQ ID NO: 650411 - RNA, 18 nt, Homo sapiens
cuuuaccuccuuuucucu

SEQ ID NO: 650412 - RNA, 14 nt, Homo sapiens
cuuuacguacugua

SEQ ID NO: 650413 - RNA, 17 nt, Homo sapiens
cuuuacguacuguaacu

SEQ ID NO: 650414 - RNA, 16 nt, Homo sapiens
cuuuacuaacacuggc

SEQ ID NO: 650415 - RNA, 15 nt, Homo sapiens
cuuuacuccguaaca

SEQ ID NO: 650416 - RNA, 19 nt, Homo sapiens
cuuuacuguuucucaagug

SEQ ID NO: 650417 - RNA, 13 nt, Homo sapiens
cuuuacuucucac

SEQ ID NO: 650418 - RNA, 16 nt, Homo sapiens
cuuuacuuucccaaau

SEQ ID NO: 650419 - RNA, 21 nt, Homo sapiens
cuuuagaaagcugacauugcc

SEQ ID NO: 650420 - RNA, 16 nt, Homo sapiens
cuuuagaacagggaaa

SEQ ID NO: 650421 - RNA, 13 nt, Homo sapiens
cuuuagaaugaga

SEQ ID NO: 650422 - RNA, 19 nt, Homo sapiens
cuuuagaccuauuuuugaa

SEQ ID NO: 650423 - RNA, 22 nt, Homo sapiens
cuuuagagccagcccauggcuu

SEQ ID NO: 650424 - RNA, 14 nt, Homo sapiens
cuuuagagcucagc

SEQ ID NO: 650425 - RNA, 14 nt, Homo sapiens
cuuuagagugcaag

SEQ ID NO: 650426 - RNA, 19 nt, Homo sapiens
cuuuaggagacuaauggaa

SEQ ID NO: 650427 - RNA, 17 nt, Homo sapiens
cuuuaguagacauuuau

SEQ ID NO: 650428 - RNA, 15 nt, Homo sapiens
cuuuauauauggaca

SEQ ID NO: 650429 - RNA, 12 nt, Homo sapiens
cuuuauaugcag

SEQ ID NO: 650430 - RNA, 16 nt, Homo sapiens
cuuuaucgcccugaga

SEQ ID NO: 650431 - RNA, 21 nt, Homo sapiens
cuuuaucuuuggagaaggcaa

SEQ ID NO: 650432 - RNA, 15 nt, Homo sapiens
cuuuaucuuugugua

SEQ ID NO: 650433 - RNA, 21 nt, Homo sapiens
cuuuaugauaucaaagacuca

SEQ ID NO: 650434 - RNA, 23 nt, Homo sapiens
cuuuaugaugacugcuuaacucc

SEQ ID NO: 650435 - RNA, 15 nt, Homo sapiens
cuuuaugcagagcca

SEQ ID NO: 650436 - RNA, 14 nt, Homo sapiens
cuuuaugugcaaaa

SEQ ID NO: 650437 - RNA, 13 nt, Homo sapiens
cuuuauguggaaa

SEQ ID NO: 650438 - RNA, 18 nt, Homo sapiens
cuuuauuaacccucugag

SEQ ID NO: 650439 - RNA, 14 nt, Homo sapiens
cuuuauuaaguaaa

SEQ ID NO: 650440 - RNA, 19 nt, Homo sapiens
cuuuauucagagcuaauaa

SEQ ID NO: 650441 - RNA, 13 nt, Homo sapiens
cuuuauugcacua

SEQ ID NO: 650442 - RNA, 18 nt, Homo sapiens
cuuuauugcacuaggaau

SEQ ID NO: 650443 - RNA, 12 nt, Homo sapiens
cuuuauuguggg

SEQ ID NO: 650444 - RNA, 16 nt, Homo sapiens
cuuucaaccucaguga

SEQ ID NO: 650445 - RNA, 20 nt, Homo sapiens
cuuucaagcagucgugccug

SEQ ID NO: 650446 - RNA, 21 nt, Homo sapiens
cuuucaauuacaaagcaguua

SEQ ID NO: 650447 - RNA, 14 nt, Homo sapiens
cuuucacaguccug

SEQ ID NO: 650448 - RNA, 21 nt, Homo sapiens
cuuucacccgcuccuacagcu

SEQ ID NO: 650449 - RNA, 15 nt, Homo sapiens
cuuucacccucauga

SEQ ID NO: 650450 - RNA, 16 nt, Homo sapiens
cuuucaccuuugugua

SEQ ID NO: 650451 - RNA, 19 nt, Homo sapiens
cuuucacuggaaugaagac

SEQ ID NO: 650452 - RNA, 12 nt, Homo sapiens
cuuucacuuuga

SEQ ID NO: 650453 - RNA, 20 nt, Homo sapiens
cuuucagaacacucaaaggu

SEQ ID NO: 650454 - RNA, 20 nt, Homo sapiens
cuuucagacaagaaugugca

SEQ ID NO: 650455 - RNA, 15 nt, Homo sapiens
cuuucagagccagcc

SEQ ID NO: 650456 - RNA, 19 nt, Homo sapiens
cuuucagccaaaacagauc

SEQ ID NO: 650457 - RNA, 13 nt, Homo sapiens
cuuucagggccaa

SEQ ID NO: 650458 - RNA, 13 nt, Homo sapiens
cuuucagucccaa

SEQ ID NO: 650459 - RNA, 14 nt, Homo sapiens
cuuucagugcuuuu

SEQ ID NO: 650460 - RNA, 16 nt, Homo sapiens
cuuucauaaaaaccaa

SEQ ID NO: 650461 - RNA, 14 nt, Homo sapiens
cuuucauauaguua

SEQ ID NO: 650462 - RNA, 20 nt, Homo sapiens
cuuucaucucucuaccucca

SEQ ID NO: 650463 - RNA, 16 nt, Homo sapiens
cuuucaucuuugugga

SEQ ID NO: 650464 - RNA, 13 nt, Homo sapiens
cuuucaugcuccu

SEQ ID NO: 650465 - RNA, 14 nt, Homo sapiens
cuuucaugcuccuu

SEQ ID NO: 650466 - RNA, 16 nt, Homo sapiens
cuuucaugucuuucca

SEQ ID NO: 650467 - RNA, 21 nt, Homo sapiens
cuuucauuauuaguacugcuc

SEQ ID NO: 650468 - RNA, 17 nt, Homo sapiens
cuuucauucagccuuua

SEQ ID NO: 650469 - RNA, 22 nt, Homo sapiens
cuuucauucggugugaacuuuu

SEQ ID NO: 650470 - RNA, 16 nt, Homo sapiens
cuuucauucuucucac

SEQ ID NO: 650471 - RNA, 16 nt, Homo sapiens
cuuuccaaaaccuucc

SEQ ID NO: 650472 - RNA, 18 nt, Homo sapiens
cuuuccaauguagcucag

SEQ ID NO: 650473 - RNA, 13 nt, Homo sapiens
cuuuccaccaagc

SEQ ID NO: 650474 - RNA, 17 nt, Homo sapiens
cuuuccaccaagcguuu

SEQ ID NO: 650475 - RNA, 15 nt, Homo sapiens
cuuuccagcuuagaa

SEQ ID NO: 650476 - RNA, 21 nt, Homo sapiens
cuuuccagggucaaaguacag

SEQ ID NO: 650477 - RNA, 22 nt, Homo sapiens
cuuuccagggucaaaguacaga

SEQ ID NO: 650478 - RNA, 13 nt, Homo sapiens
cuuucccaaauaa

SEQ ID NO: 650479 - RNA, 14 nt, Homo sapiens
cuuucccacccucc

SEQ ID NO: 650480 - RNA, 14 nt, Homo sapiens
cuuucccaguccca

SEQ ID NO: 650481 - RNA, 21 nt, Homo sapiens
cuuucccagucccauuccuca

SEQ ID NO: 650482 - RNA, 16 nt, Homo sapiens
cuuucccaucuuccaa

SEQ ID NO: 650483 - RNA, 23 nt, Homo sapiens
cuuucccauucuguuuggaucua

SEQ ID NO: 650484 - RNA, 21 nt, Homo sapiens
cuuuccccuccccuggcaugg

SEQ ID NO: 650485 - RNA, 13 nt, Homo sapiens
cuuucccuaccuu

SEQ ID NO: 650486 - RNA, 14 nt, Homo sapiens
cuuucccucaucca

SEQ ID NO: 650487 - RNA, 18 nt, Homo sapiens
cuuucccucauccaugcu

SEQ ID NO: 650488 - RNA, 23 nt, Homo sapiens
cuuucccucucccaguccauuuc

SEQ ID NO: 650489 - RNA, 15 nt, Homo sapiens
cuuucccuggagcug

SEQ ID NO: 650490 - RNA, 19 nt, Homo sapiens
cuuucccuggagcugaggu

SEQ ID NO: 650491 - RNA, 17 nt, Homo sapiens
cuuuccuaaggcugcaa

SEQ ID NO: 650492 - RNA, 19 nt, Homo sapiens
cuuuccuacuguccuggaa

SEQ ID NO: 650493 - RNA, 15 nt, Homo sapiens
cuuuccuccccauac

SEQ ID NO: 650494 - RNA, 20 nt, Homo sapiens
cuuuccucgccugacaacca

SEQ ID NO: 650495 - RNA, 15 nt, Homo sapiens
cuuuccugaaccaug

SEQ ID NO: 650496 - RNA, 20 nt, Homo sapiens
cuuuccugaucacuaugcau

SEQ ID NO: 650497 - RNA, 13 nt, Homo sapiens
cuuucuuccaaac

SEQ ID NO: 650498 - RNA, 20 nt, Homo sapiens
cuuucuugaaagacagucca

SEQ ID NO: 650499 - RNA, 15 nt, Homo sapiens
cuuucuuguugcugc

SEQ ID NO: 650500 - RNA, 17 nt, Homo sapiens
cuuucuuguugcugcau

SEQ ID NO: 650501 - RNA, 17 nt, Homo sapiens
cuuucuuuaccugagac

SEQ ID NO: 650502 - RNA, 18 nt, Homo sapiens
cuuucuuugcaccaaaga

SEQ ID NO: 650503 - RNA, 15 nt, Homo sapiens
cuuugaaaacaauuc

SEQ ID NO: 650504 - RNA, 16 nt, Homo sapiens
cuuugaaaacacuaca

SEQ ID NO: 650505 - RNA, 21 nt, Homo sapiens
cuuugaaaagagaauauuuac

SEQ ID NO: 650506 - RNA, 13 nt, Homo sapiens
cuuugaaccauaa

SEQ ID NO: 650507 - RNA, 19 nt, Homo sapiens
cuuugaagcaguuguguca

SEQ ID NO: 650508 - RNA, 19 nt, Homo sapiens
cuuugaaguagguggcuug

SEQ ID NO: 650509 - RNA, 17 nt, Homo sapiens
cuuugaauacugugaaa

SEQ ID NO: 650510 - RNA, 17 nt, Homo sapiens
cuuugaaucucuguaua

SEQ ID NO: 650511 - RNA, 21 nt, Homo sapiens
cuuugaaugcuaagaaugcau

SEQ ID NO: 650512 - RNA, 13 nt, Homo sapiens
cuuugacaguguu

SEQ ID NO: 650513 - RNA, 16 nt, Homo sapiens
cuuugacaucauucau

SEQ ID NO: 650514 - RNA, 19 nt, Homo sapiens
cuuugacucaccuguuacu

SEQ ID NO: 650515 - RNA, 15 nt, Homo sapiens
cuuugacuccuuuga

SEQ ID NO: 650516 - RNA, 17 nt, Homo sapiens
cuuugagacugggucuc

SEQ ID NO: 650517 - RNA, 15 nt, Homo sapiens
cuuugagcugagugc

SEQ ID NO: 650518 - RNA, 19 nt, Homo sapiens
cuuugagcugagugcugaa

SEQ ID NO: 650519 - RNA, 21 nt, Homo sapiens
cuuugagcugcugacugccaa

SEQ ID NO: 650520 - RNA, 13 nt, Homo sapiens
cuuugaguaccaa

SEQ ID NO: 650521 - RNA, 14 nt, Homo sapiens
cuuugaguccagca

SEQ ID NO: 650522 - RNA, 16 nt, Homo sapiens
cuuugagugacugggu

SEQ ID NO: 650523 - RNA, 14 nt, Homo sapiens
cuuugauaucugau

SEQ ID NO: 650524 - RNA, 16 nt, Homo sapiens
cuuugauuauuugcau

SEQ ID NO: 650525 - RNA, 20 nt, Homo sapiens
cuuugauuuguaccauuccu

SEQ ID NO: 650526 - RNA, 13 nt, Homo sapiens
cuuugcaaacccu

SEQ ID NO: 650527 - RNA, 13 nt, Homo sapiens
cuuugcaaagacc

SEQ ID NO: 650528 - RNA, 18 nt, Homo sapiens
cuuugcaaaucaguguuu

SEQ ID NO: 650529 - RNA, 14 nt, Homo sapiens
cuuugcacauguga

SEQ ID NO: 650530 - RNA, 14 nt, Homo sapiens
cuuugcaccaaaga

SEQ ID NO: 650531 - RNA, 15 nt, Homo sapiens
cuuugcaccaaagac

SEQ ID NO: 650532 - RNA, 22 nt, Homo sapiens
cuuugcaccaaagauguccuga

SEQ ID NO: 650533 - RNA, 13 nt, Homo sapiens
cuuugcacugagg

SEQ ID NO: 650534 - RNA, 20 nt, Homo sapiens
cuuugcagagaaccucagau

SEQ ID NO: 650535 - RNA, 14 nt, Homo sapiens
cuuugcagcacagc

SEQ ID NO: 650536 - RNA, 21 nt, Homo sapiens
cuuugcauuccuuacuugcac

SEQ ID NO: 650537 - RNA, 19 nt, Homo sapiens
cuuugccagaaagcauaaa

SEQ ID NO: 650538 - RNA, 12 nt, Homo sapiens
cuuugccucaag

SEQ ID NO: 650539 - RNA, 15 nt, Homo sapiens
cuuugccuuuaucuc

SEQ ID NO: 650540 - RNA, 20 nt, Homo sapiens
cuuugcgcagcccuaccuua

SEQ ID NO: 650541 - RNA, 20 nt, Homo sapiens
cuuugcuacaaauuuaugca

SEQ ID NO: 650542 - RNA, 20 nt, Homo sapiens
cuuugcuccagauaacucuc

SEQ ID NO: 650543 - RNA, 15 nt, Homo sapiens
cuuugcucuuuggua

SEQ ID NO: 650544 - RNA, 19 nt, Homo sapiens
cuuugcugaaugucauuuu

SEQ ID NO: 650545 - RNA, 21 nt, Homo sapiens
cuuugcugccagccacuucau

SEQ ID NO: 650546 - RNA, 11 nt, Homo sapiens
cuuugcugcug

SEQ ID NO: 650547 - RNA, 23 nt, Homo sapiens
cuuugcugugaggcuguccugua

SEQ ID NO: 650548 - RNA, 15 nt, Homo sapiens
cuuugcuucccauug

SEQ ID NO: 650549 - RNA, 21 nt, Homo sapiens
cuuugcuuuaaguguaacugg

SEQ ID NO: 650550 - RNA, 20 nt, Homo sapiens
cuuuggaaaauaguuugcaa

SEQ ID NO: 650551 - RNA, 17 nt, Homo sapiens
cuuuggaacaagacagc

SEQ ID NO: 650552 - RNA, 18 nt, Homo sapiens
cuuuggaagauggcauaa

SEQ ID NO: 650553 - RNA, 17 nt, Homo sapiens
cuuuggaagucaugagc

SEQ ID NO: 650554 - RNA, 22 nt, Homo sapiens
cuuuggacauagcgaauacaaa

SEQ ID NO: 650555 - RNA, 16 nt, Homo sapiens
cuuuggacauggcuca

SEQ ID NO: 650556 - RNA, 21 nt, Homo sapiens
cuuuggacuguucaagcaaaa

SEQ ID NO: 650557 - RNA, 20 nt, Homo sapiens
cuuuggagaaaugcuuagaa

SEQ ID NO: 650558 - RNA, 17 nt, Homo sapiens
cuuuggagcagcuucug

SEQ ID NO: 650559 - RNA, 21 nt, Homo sapiens
cuuuggagcagcuucugggac

SEQ ID NO: 650560 - RNA, 14 nt, Homo sapiens
cuuuggcacugggg

SEQ ID NO: 650561 - RNA, 14 nt, Homo sapiens
cuuuggccauucca

SEQ ID NO: 650562 - RNA, 18 nt, Homo sapiens
cuuugggauucuuuccau

SEQ ID NO: 650563 - RNA, 19 nt, Homo sapiens
cuuuggggacaguuggcag

SEQ ID NO: 650564 - RNA, 21 nt, Homo sapiens
cuuugggugccuuugccacaa

SEQ ID NO: 650565 - RNA, 18 nt, Homo sapiens
cuuuggucaaaguuuucu

SEQ ID NO: 650566 - RNA, 12 nt, Homo sapiens
cuuuggucuauc

SEQ ID NO: 650567 - RNA, 22 nt, Homo sapiens
cuuuggucuauuuucugcagaa

SEQ ID NO: 650568 - RNA, 11 nt, Homo sapiens
cuuuggugggg

SEQ ID NO: 650569 - RNA, 18 nt, Homo sapiens
cuuugguuaauguugauu

SEQ ID NO: 650570 - RNA, 19 nt, Homo sapiens
cuuuguaacggcucuuagc

SEQ ID NO: 650571 - RNA, 15 nt, Homo sapiens
cuuuguaagugcagg

SEQ ID NO: 650572 - RNA, 15 nt, Homo sapiens
cuuuguaauaccaga

SEQ ID NO: 650573 - RNA, 16 nt, Homo sapiens
cuuuguaauauuuucc

SEQ ID NO: 650574 - RNA, 14 nt, Homo sapiens
cuuuguaggugucu

SEQ ID NO: 650575 - RNA, 19 nt, Homo sapiens
cuuuguauacaaguacugg

SEQ ID NO: 650576 - RNA, 16 nt, Homo sapiens
cuuuguauauuacaua

SEQ ID NO: 650577 - RNA, 17 nt, Homo sapiens
cuuuguaugacagugaa

SEQ ID NO: 650578 - RNA, 17 nt, Homo sapiens
cuuuguaugcacuuugu

SEQ ID NO: 650579 - RNA, 18 nt, Homo sapiens
cuuuguauuguauauuac

SEQ ID NO: 650580 - RNA, 16 nt, Homo sapiens
cuuugucaaaaggaag

SEQ ID NO: 650581 - RNA, 16 nt, Homo sapiens
cuuugucacuugccac

SEQ ID NO: 650582 - RNA, 18 nt, Homo sapiens
cuuuguccccacacagcc

SEQ ID NO: 650583 - RNA, 22 nt, Homo sapiens
cuuuguccccacacagccucua

SEQ ID NO: 650584 - RNA, 19 nt, Homo sapiens
cuuugucggcggcuugaua

SEQ ID NO: 650585 - RNA, 18 nt, Homo sapiens
cuuugucgugguucuuaa

SEQ ID NO: 650586 - RNA, 16 nt, Homo sapiens
cuuugucuaauaaaga

SEQ ID NO: 650587 - RNA, 19 nt, Homo sapiens
cuuugucuaauaaagagau

SEQ ID NO: 650588 - RNA, 14 nt, Homo sapiens
cuuugucucaaaau

SEQ ID NO: 650589 - RNA, 16 nt, Homo sapiens
cuuugucucaaaauaa

SEQ ID NO: 650590 - RNA, 13 nt, Homo sapiens
cuuugucugaaaa

SEQ ID NO: 650591 - RNA, 16 nt, Homo sapiens
cuuugucugucaauca

SEQ ID NO: 650592 - RNA, 14 nt, Homo sapiens
cuuugucuucuaua

SEQ ID NO: 650593 - RNA, 18 nt, Homo sapiens
cuuugugaaaacuacuga

SEQ ID NO: 650594 - RNA, 15 nt, Homo sapiens
cuuugugaggacaaa

SEQ ID NO: 650595 - RNA, 15 nt, Homo sapiens
cuuuuacagcucuug

SEQ ID NO: 650596 - RNA, 16 nt, Homo sapiens
cuuuuacauacugcug

SEQ ID NO: 650597 - RNA, 16 nt, Homo sapiens
cuuuuaccacugacag

SEQ ID NO: 650598 - RNA, 21 nt, Homo sapiens
cuuuuaggacugucugaaaau

SEQ ID NO: 650599 - RNA, 16 nt, Homo sapiens
cuuuuaguuguaucuc

SEQ ID NO: 650600 - RNA, 19 nt, Homo sapiens
cuuuuauacucagcuuucu

SEQ ID NO: 650601 - RNA, 14 nt, Homo sapiens
cuuuuauagcugcu

SEQ ID NO: 650602 - RNA, 19 nt, Homo sapiens
cuuuuaucuacuucucucu

SEQ ID NO: 650603 - RNA, 19 nt, Homo sapiens
cuuuuaucuuggacugaca

SEQ ID NO: 650604 - RNA, 17 nt, Homo sapiens
cuuuuaugcaaccauaa

SEQ ID NO: 650605 - RNA, 18 nt, Homo sapiens
cuuuuaugcaaccauaag

SEQ ID NO: 650606 - RNA, 21 nt, Homo sapiens
cuuuuauguaguaauugacau

SEQ ID NO: 650607 - RNA, 17 nt, Homo sapiens
cuuuuauugacacagaa

SEQ ID NO: 650608 - RNA, 23 nt, Homo sapiens
cuuuucaccaaaauuucuacacc

SEQ ID NO: 650609 - RNA, 21 nt, Homo sapiens
cuuuucaccaaugagccuuag

SEQ ID NO: 650610 - RNA, 12 nt, Homo sapiens
cuuuucacggga

SEQ ID NO: 650611 - RNA, 13 nt, Homo sapiens
cuuuucaggguuu

SEQ ID NO: 650612 - RNA, 15 nt, Homo sapiens
cuuuucagugauacu

SEQ ID NO: 650613 - RNA, 15 nt, Homo sapiens
cuuuucauagugcuc

SEQ ID NO: 650614 - RNA, 16 nt, Homo sapiens
cuuuucauagugcuca

SEQ ID NO: 650615 - RNA, 19 nt, Homo sapiens
cuuuucauagugcucagau

SEQ ID NO: 650616 - RNA, 18 nt, Homo sapiens
cuuuucauaucucuugcc

SEQ ID NO: 650617 - RNA, 14 nt, Homo sapiens
cuuuucauguagaa

SEQ ID NO: 650618 - RNA, 23 nt, Homo sapiens
cuuuucauuagcaguugcucaca

SEQ ID NO: 650619 - RNA, 20 nt, Homo sapiens
cuuuuccaaaugcccaagga

SEQ ID NO: 650620 - RNA, 19 nt, Homo sapiens
cuuuuccacacgcauuaau

SEQ ID NO: 650621 - RNA, 14 nt, Homo sapiens
cuuuuccacuuuaa

SEQ ID NO: 650622 - RNA, 12 nt, Homo sapiens
cuuuuccagaag

SEQ ID NO: 650623 - RNA, 14 nt, Homo sapiens
cuuuuccagaguau

SEQ ID NO: 650624 - RNA, 12 nt, Homo sapiens
cuuuuccagucu

SEQ ID NO: 650625 - RNA, 17 nt, Homo sapiens
cuuuucccauugccaug

SEQ ID NO: 650626 - RNA, 17 nt, Homo sapiens
cuuuuccccagucccag

SEQ ID NO: 650627 - RNA, 21 nt, Homo sapiens
cuuuuccccggucccuugaga

SEQ ID NO: 650628 - RNA, 15 nt, Homo sapiens
cuuuuccucuauuga

SEQ ID NO: 650629 - RNA, 18 nt, Homo sapiens
cuuuucuaaaaucuaaaa

SEQ ID NO: 650630 - RNA, 21 nt, Homo sapiens
cuuuucucacaaaaaggcaaa

SEQ ID NO: 650631 - RNA, 15 nt, Homo sapiens
cuuuucuccaugagu

SEQ ID NO: 650632 - RNA, 23 nt, Homo sapiens
cuuuucuccuccgccugugucca

SEQ ID NO: 650633 - RNA, 16 nt, Homo sapiens
cuuuucugaucugcag

SEQ ID NO: 650634 - RNA, 21 nt, Homo sapiens
cuuuucugcauuuugcuauug

SEQ ID NO: 650635 - RNA, 19 nt, Homo sapiens
cuuuucuggaauguaauca

SEQ ID NO: 650636 - RNA, 22 nt, Homo sapiens
cuuuucugugccagacauugcu

SEQ ID NO: 650637 - RNA, 18 nt, Homo sapiens
cuuuucuuacuauagucu

SEQ ID NO: 650638 - RNA, 20 nt, Homo sapiens
cuuuucuuuggucaaaguuu

SEQ ID NO: 650639 - RNA, 16 nt, Homo sapiens
cuuuucuuuuucuccc

SEQ ID NO: 650640 - RNA, 19 nt, Homo sapiens
cuuuucuuuuuuuguccac

SEQ ID NO: 650641 - RNA, 16 nt, Homo sapiens
cuuuugaaaagcuuuu

SEQ ID NO: 650642 - RNA, 16 nt, Homo sapiens
cuuuugaaauccagaa

SEQ ID NO: 650643 - RNA, 14 nt, Homo sapiens
cuuuugaauugcac

SEQ ID NO: 650644 - RNA, 13 nt, Homo sapiens
cuuuugaggggcu

SEQ ID NO: 650645 - RNA, 21 nt, Homo sapiens
cuuuugaugaugucuacagaa

SEQ ID NO: 650646 - RNA, 13 nt, Homo sapiens
cuuuugcauuucc

SEQ ID NO: 650647 - RNA, 20 nt, Homo sapiens
cuuuugcccauuuugaauca

SEQ ID NO: 650648 - RNA, 13 nt, Homo sapiens
cuuuugccuuuug

SEQ ID NO: 650649 - RNA, 16 nt, Homo sapiens
cuuuugcuaaugcaau

SEQ ID NO: 650650 - RNA, 23 nt, Homo sapiens
cuuuugcuacaguauauuuuaaa

SEQ ID NO: 650651 - RNA, 13 nt, Homo sapiens
cuuuugcuugcaa

SEQ ID NO: 650652 - RNA, 15 nt, Homo sapiens
cuuuuggccuugugg

SEQ ID NO: 650653 - RNA, 17 nt, Homo sapiens
cuuuuggcuucugcaga

SEQ ID NO: 650654 - RNA, 22 nt, Homo sapiens
cuuuugggccuccuucccaugc

SEQ ID NO: 650655 - RNA, 19 nt, Homo sapiens
cuuuugguaucuacuucua

SEQ ID NO: 650656 - RNA, 24 nt, Homo sapiens
cuuuugguuucaccuucccucgac

SEQ ID NO: 650657 - RNA, 24 nt, Homo sapiens
cuuuuguaaauauucuuguccaca

SEQ ID NO: 650658 - RNA, 12 nt, Homo sapiens
cuuuuguacuga

SEQ ID NO: 650659 - RNA, 23 nt, Homo sapiens
cuuuugugaauuaggcuguaacu

SEQ ID NO: 650660 - RNA, 18 nt, Homo sapiens
cuuuugugaugaacauau

SEQ ID NO: 650661 - RNA, 17 nt, Homo sapiens
cuuuugugcaaagccaa

SEQ ID NO: 650662 - RNA, 13 nt, Homo sapiens
cuuuugugcauua

SEQ ID NO: 650663 - RNA, 18 nt, Homo sapiens
cuuuuguguccugcucug

SEQ ID NO: 650664 - RNA, 16 nt, Homo sapiens
cuuuugugugaugcgc

SEQ ID NO: 650665 - RNA, 19 nt, Homo sapiens
cuuuuguucagggcuguga

SEQ ID NO: 650666 - RNA, 20 nt, Homo sapiens
cuuuuguuguccuugcccca

SEQ ID NO: 650667 - RNA, 18 nt, Homo sapiens
cuuuuguuuugaguuacu

SEQ ID NO: 650668 - RNA, 20 nt, Homo sapiens
cuuuuuaaaguuuguucacu

SEQ ID NO: 650669 - RNA, 14 nt, Homo sapiens
cuuuuuaaugcugu

SEQ ID NO: 650670 - RNA, 13 nt, Homo sapiens
cuuuuuaugcauu

SEQ ID NO: 650671 - RNA, 16 nt, Homo sapiens
cuuuuuauuagagcuc

SEQ ID NO: 650672 - RNA, 17 nt, Homo sapiens
cuuuuucauauguugcu

SEQ ID NO: 650673 - RNA, 16 nt, Homo sapiens
cuuuuuccagcaaaau

SEQ ID NO: 650674 - RNA, 19 nt, Homo sapiens
cuuuuuccccuugauggaa

SEQ ID NO: 650675 - RNA, 16 nt, Homo sapiens
cuuuuucuaaaaagcu

SEQ ID NO: 650676 - RNA, 15 nt, Homo sapiens
cuuuuucuauauucu

SEQ ID NO: 650677 - RNA, 18 nt, Homo sapiens
cuuuuucuggacucugga

SEQ ID NO: 650678 - RNA, 21 nt, Homo sapiens
cuuuuucugugauaacucugc

SEQ ID NO: 650679 - RNA, 18 nt, Homo sapiens
cuuuuucuucuucccucc

SEQ ID NO: 650680 - RNA, 19 nt, Homo sapiens
cuuuuugcguacacagaga

SEQ ID NO: 650681 - RNA, 14 nt, Homo sapiens
cuuuuuuaauuucc

SEQ ID NO: 650682 - RNA, 15 nt, Homo sapiens
cuuuuuucacauuga

SEQ ID NO: 650683 - RNA, 16 nt, Homo sapiens
cuuuuuucuaguuuca

SEQ ID NO: 650684 - RNA, 23 nt, Homo sapiens
cuuuuuugauuaagugguuacuu

SEQ ID NO: 650685 - RNA, 13 nt, Homo sapiens
cuuuuuugccaaa

SEQ ID NO: 650686 - RNA, 14 nt, Homo sapiens
cuuuuuugccaaau

SEQ ID NO: 650687 - RNA, 22 nt, Homo sapiens
cuuuuuuuauaucagaaugagg

SEQ ID NO: 650688 - RNA, 15 nt, Homo sapiens
cuuuuuuuccaauuu

SEQ ID NO: 650689 - RNA, 16 nt, Homo sapiens
cuuuuuuucuaugaaa

SEQ ID NO: 650690 - RNA, 14 nt, Homo sapiens
cuuuuuuuguaugu

SEQ ID NO: 650691 - RNA, 14 nt, Homo sapiens
gaaaaaaacauaaa

SEQ ID NO: 650692 - RNA, 16 nt, Homo sapiens
gaaaacaucucaauaa

SEQ ID NO: 650693 - RNA, 18 nt, Homo sapiens
gaaaacaucucaauaaca

SEQ ID NO: 650694 - RNA, 16 nt, Homo sapiens
gaaaacaugcugcucu

SEQ ID NO: 650695 - RNA, 17 nt, Homo sapiens
gaaaaccacaacuaaaa

SEQ ID NO: 650696 - RNA, 20 nt, Homo sapiens
gaaaaccugaagaguucacu

SEQ ID NO: 650697 - RNA, 20 nt, Homo sapiens
gaaaacuacugauacuuuca

SEQ ID NO: 650698 - RNA, 15 nt, Homo sapiens
gaaaacuacuuuuug

SEQ ID NO: 650699 - RNA, 18 nt, Homo sapiens
gaaaacucaaccagaguc

SEQ ID NO: 650700 - RNA, 13 nt, Homo sapiens
gaaaacucuucau

SEQ ID NO: 650701 - RNA, 23 nt, Homo sapiens
gaaaacugccuuuuaucugccca

SEQ ID NO: 650702 - RNA, 13 nt, Homo sapiens
gaaaacugugcaa

SEQ ID NO: 650703 - RNA, 15 nt, Homo sapiens
gaaaacugugcaaug

SEQ ID NO: 650704 - RNA, 20 nt, Homo sapiens
gaaaacuuaaggaagcaaau

SEQ ID NO: 650705 - RNA, 19 nt, Homo sapiens
gaaaacuuaugcugauuua

SEQ ID NO: 650706 - RNA, 23 nt, Homo sapiens
gaaaagaaaacauuuaacauaau

SEQ ID NO: 650707 - RNA, 17 nt, Homo sapiens
gaaaagagaaugaugcu

SEQ ID NO: 650708 - RNA, 15 nt, Homo sapiens
gaaaagagcuuugua

SEQ ID NO: 650709 - RNA, 12 nt, Homo sapiens
gaaaagauuuua

SEQ ID NO: 650710 - RNA, 22 nt, Homo sapiens
gaaaagauuuuauuuauggaau

SEQ ID NO: 650711 - RNA, 17 nt, Homo sapiens
gaaaagcauacaagauu

SEQ ID NO: 650712 - RNA, 22 nt, Homo sapiens
gaaaagccuccgccugcugugu

SEQ ID NO: 650713 - RNA, 14 nt, Homo sapiens
gaaaaggauaugca

SEQ ID NO: 650714 - RNA, 15 nt, Homo sapiens
gaaaaggccauuaaa

SEQ ID NO: 650715 - RNA, 16 nt, Homo sapiens
gaaaagggucuuggga

SEQ ID NO: 650716 - RNA, 15 nt, Homo sapiens
gaaaagguugccuga

SEQ ID NO: 650717 - RNA, 15 nt, Homo sapiens
gaaaaguaagcccuu

SEQ ID NO: 650718 - RNA, 23 nt, Homo sapiens
gaaaaguaucccggaagcucaca

SEQ ID NO: 650719 - RNA, 15 nt, Homo sapiens
gaaaaguauucucaa

SEQ ID NO: 650720 - RNA, 16 nt, Homo sapiens
gaaaaguccacauaac

SEQ ID NO: 650721 - RNA, 14 nt, Homo sapiens
gaaaagucuacccc

SEQ ID NO: 650722 - RNA, 15 nt, Homo sapiens
gaaaagugauagaaa

SEQ ID NO: 650723 - RNA, 14 nt, Homo sapiens
gaaaaguuagucaa

SEQ ID NO: 650724 - RNA, 11 nt, Homo sapiens
gaaaaguuauu

SEQ ID NO: 650725 - RNA, 21 nt, Homo sapiens
gaaaaguuuaaagacacuuag

SEQ ID NO: 650726 - RNA, 20 nt, Homo sapiens
gaaaaguuuauaaaagugaa

SEQ ID NO: 650727 - RNA, 15 nt, Homo sapiens
gaaaauaaacaccau

SEQ ID NO: 650728 - RNA, 14 nt, Homo sapiens
gaaaauaaacauca

SEQ ID NO: 650729 - RNA, 17 nt, Homo sapiens
gaaaauaaaugguuuca

SEQ ID NO: 650730 - RNA, 15 nt, Homo sapiens
gaaaauaaugcuguu

SEQ ID NO: 650731 - RNA, 18 nt, Homo sapiens
gaaaauaauuaauuucau

SEQ ID NO: 650732 - RNA, 20 nt, Homo sapiens
gaaaauacgaaaaucccaug

SEQ ID NO: 650733 - RNA, 16 nt, Homo sapiens
gaaaauagcucuuuca

SEQ ID NO: 650734 - RNA, 18 nt, Homo sapiens
gaaaauauagacauucuc

SEQ ID NO: 650735 - RNA, 16 nt, Homo sapiens
gaaaaucacaucucca

SEQ ID NO: 650736 - RNA, 17 nt, Homo sapiens
gaaaaucaucaagaagg

SEQ ID NO: 650737 - RNA, 23 nt, Homo sapiens
gaaaaucaucaagaagggcugca

SEQ ID NO: 650738 - RNA, 14 nt, Homo sapiens
gaaaaucauguuga

SEQ ID NO: 650739 - RNA, 22 nt, Homo sapiens
gaaaauccucgcacacacuggc

SEQ ID NO: 650740 - RNA, 16 nt, Homo sapiens
gaaaaucuccaucuca

SEQ ID NO: 650741 - RNA, 12 nt, Homo sapiens
gaaaaucuuaca

SEQ ID NO: 650742 - RNA, 19 nt, Homo sapiens
gaaaaucuuuaggcuuuca

SEQ ID NO: 650743 - RNA, 14 nt, Homo sapiens
gaaaaugagaaaau

SEQ ID NO: 650744 - RNA, 13 nt, Homo sapiens
gaaaaugcauuag

SEQ ID NO: 650745 - RNA, 14 nt, Homo sapiens
gaaaaugccaugaa

SEQ ID NO: 650746 - RNA, 13 nt, Homo sapiens
gaaaaugccucaa

SEQ ID NO: 650747 - RNA, 21 nt, Homo sapiens
gaaaaugcgagacucugaugg

SEQ ID NO: 650748 - RNA, 10 nt, Homo sapiens
gaaaauggaa

SEQ ID NO: 650749 - RNA, 15 nt, Homo sapiens
gaaaaugugcaauau

SEQ ID NO: 650750 - RNA, 15 nt, Homo sapiens
gaaaauguucuuugu

SEQ ID NO: 650751 - RNA, 21 nt, Homo sapiens
gaaaauguugagaaucccaaa

SEQ ID NO: 650752 - RNA, 16 nt, Homo sapiens
gaaaauguuuaugcca

SEQ ID NO: 650753 - RNA, 23 nt, Homo sapiens
gaaaauguuuccuugugccugcu

SEQ ID NO: 650754 - RNA, 12 nt, Homo sapiens
gaaaauugcaau

SEQ ID NO: 650755 - RNA, 18 nt, Homo sapiens
gaaaauuuuaaaaauaca

SEQ ID NO: 650756 - RNA, 20 nt, Homo sapiens
gaaaauuuuccacauaggaa

SEQ ID NO: 650757 - RNA, 19 nt, Homo sapiens
gaaacaaaauguucugcua

SEQ ID NO: 650758 - RNA, 15 nt, Homo sapiens
gaaacaaacaucuaa

SEQ ID NO: 650759 - RNA, 23 nt, Homo sapiens
gaaacaaauagcuguugacguuu

SEQ ID NO: 650760 - RNA, 13 nt, Homo sapiens
gaaacaacagcuu

SEQ ID NO: 650761 - RNA, 19 nt, Homo sapiens
gaaacaagcaacagaugga

SEQ ID NO: 650762 - RNA, 24 nt, Homo sapiens
gaaacacaaacgauuuggaucaaa

SEQ ID NO: 650763 - RNA, 19 nt, Homo sapiens
gaaacacacauggacaugu

SEQ ID NO: 650764 - RNA, 23 nt, Homo sapiens
gaaacacaucuucccuagagggu

SEQ ID NO: 650765 - RNA, 13 nt, Homo sapiens
gaaacacauucuu

SEQ ID NO: 650766 - RNA, 15 nt, Homo sapiens
gaaacacuaaagcau

SEQ ID NO: 650767 - RNA, 19 nt, Homo sapiens
gaaacacuaaagcauucaa

SEQ ID NO: 650768 - RNA, 17 nt, Homo sapiens
gaaacagccauguccaa

SEQ ID NO: 650769 - RNA, 23 nt, Homo sapiens
gaaacaguaagaaauuggaguga

SEQ ID NO: 650770 - RNA, 12 nt, Homo sapiens
gaaacaguucuc

SEQ ID NO: 650771 - RNA, 12 nt, Homo sapiens
gaaacaucucaa

SEQ ID NO: 650772 - RNA, 19 nt, Homo sapiens
gaaacaucucaacaaccug

SEQ ID NO: 650773 - RNA, 19 nt, Homo sapiens
gaaacaugaacccaaaaag

SEQ ID NO: 650774 - RNA, 16 nt, Homo sapiens
gaaacaugaugugaga

SEQ ID NO: 650775 - RNA, 11 nt, Homo sapiens
gaaacauuuac

SEQ ID NO: 650776 - RNA, 22 nt, Homo sapiens
gaaaccaaaguaaccuuuugca

SEQ ID NO: 650777 - RNA, 20 nt, Homo sapiens
gaaaccaaggaaagugaaac

SEQ ID NO: 650778 - RNA, 21 nt, Homo sapiens
gaaaccaaggccccgagcuca

SEQ ID NO: 650779 - RNA, 20 nt, Homo sapiens
gaaaccagaauuguuuugca

SEQ ID NO: 650780 - RNA, 14 nt, Homo sapiens
gaaaccaguucaug

SEQ ID NO: 650781 - RNA, 12 nt, Homo sapiens
gaaaccaugacu

SEQ ID NO: 650782 - RNA, 13 nt, Homo sapiens
gaaacccacagau

SEQ ID NO: 650783 - RNA, 21 nt, Homo sapiens
gaaaccccuucuuuacuuccc

SEQ ID NO: 650784 - RNA, 15 nt, Homo sapiens
gaaacccucugucau

SEQ ID NO: 650785 - RNA, 17 nt, Homo sapiens
gaaacccuugagcucaa

SEQ ID NO: 650786 - RNA, 17 nt, Homo sapiens
gaaacccuugcugcuuu

SEQ ID NO: 650787 - RNA, 18 nt, Homo sapiens
gaaaccgccuaguuuacu

SEQ ID NO: 650788 - RNA, 14 nt, Homo sapiens
gaccuccacauuaa

SEQ ID NO: 650789 - RNA, 18 nt, Homo sapiens
gaccucuugcugccagcu

SEQ ID NO: 650790 - RNA, 10 nt, Homo sapiens
gaccucuugu

SEQ ID NO: 650791 - RNA, 15 nt, Homo sapiens
gaccugagcugggag

SEQ ID NO: 650792 - RNA, 12 nt, Homo sapiens
gaccugcaguga

SEQ ID NO: 650793 - RNA, 15 nt, Homo sapiens
gaccugccagccggu

SEQ ID NO: 650794 - RNA, 22 nt, Homo sapiens
gaccuggccccaggcugucacc

SEQ ID NO: 650795 - RNA, 20 nt, Homo sapiens
gaccugggcccacagagccu

SEQ ID NO: 650796 - RNA, 17 nt, Homo sapiens
gaccugucucuaccuaa

SEQ ID NO: 650797 - RNA, 13 nt, Homo sapiens
gaccuguguuuca

SEQ ID NO: 650798 - RNA, 16 nt, Homo sapiens
gaccuguguuucacuu

SEQ ID NO: 650799 - RNA, 16 nt, Homo sapiens
gaccuguucaaaaagg

SEQ ID NO: 650800 - RNA, 23 nt, Homo sapiens
gaccuuaucaggauaccagagga

SEQ ID NO: 650801 - RNA, 19 nt, Homo sapiens
gaccuuaucugugcgugaa

SEQ ID NO: 650802 - RNA, 15 nt, Homo sapiens
gaccuuccucaucca

SEQ ID NO: 650803 - RNA, 21 nt, Homo sapiens
gaccuuccugauucauucuuc

SEQ ID NO: 650804 - RNA, 18 nt, Homo sapiens
gaccuugaaggguaaaga

SEQ ID NO: 650805 - RNA, 19 nt, Homo sapiens
gaccuuggaggaaugacaa

SEQ ID NO: 650806 - RNA, 23 nt, Homo sapiens
gaccuuggcugcucacuguccac

SEQ ID NO: 650807 - RNA, 19 nt, Homo sapiens
gaccuuguagagaacacgc

SEQ ID NO: 650808 - RNA, 18 nt, Homo sapiens
gaccuuuuggaaugacug

SEQ ID NO: 650809 - RNA, 22 nt, Homo sapiens
gaccuuuuuuaggaagcaagcu

SEQ ID NO: 650810 - RNA, 23 nt, Homo sapiens
gaccuuuuuuuuuuuaauggcaa

SEQ ID NO: 650811 - RNA, 14 nt, Homo sapiens
gacgacaagugcug

SEQ ID NO: 650812 - RNA, 17 nt, Homo sapiens
gacgacaagugcugaac

SEQ ID NO: 650813 - RNA, 12 nt, Homo sapiens
gacgacaguacu

SEQ ID NO: 650814 - RNA, 18 nt, Homo sapiens
gacgacauacaugcuacu

SEQ ID NO: 650815 - RNA, 14 nt, Homo sapiens
gacgauucuuaaca

SEQ ID NO: 650816 - RNA, 16 nt, Homo sapiens
gacgcacagugcaguu

SEQ ID NO: 650817 - RNA, 18 nt, Homo sapiens
gacgcagggguugcagug

SEQ ID NO: 650818 - RNA, 13 nt, Homo sapiens
gacgccaaaaaca

SEQ ID NO: 650819 - RNA, 14 nt, Homo sapiens
gacgccaugugaug

SEQ ID NO: 650820 - RNA, 19 nt, Homo sapiens
gacgccucucccugcaguc

SEQ ID NO: 650821 - RNA, 19 nt, Homo sapiens
gacgccugauggugcugcu

SEQ ID NO: 650822 - RNA, 17 nt, Homo sapiens
gacgccugcccugccca

SEQ ID NO: 650823 - RNA, 15 nt, Homo sapiens
gacgcugacugcccu

SEQ ID NO: 650824 - RNA, 21 nt, Homo sapiens
gacgcugcccugcaugcugcc

SEQ ID NO: 650825 - RNA, 22 nt, Homo sapiens
gacgcugcugucacaaccaaga

SEQ ID NO: 650826 - RNA, 15 nt, Homo sapiens
gacggaauuggguuu

SEQ ID NO: 650827 - RNA, 17 nt, Homo sapiens
gacggaguccuguguuu

SEQ ID NO: 650828 - RNA, 18 nt, Homo sapiens
gacggccggggacugccu

SEQ ID NO: 650829 - RNA, 22 nt, Homo sapiens
gacggucaguccaugucucgga

SEQ ID NO: 650830 - RNA, 22 nt, Homo sapiens
gacggugcucacucccaaggga

SEQ ID NO: 650831 - RNA, 15 nt, Homo sapiens
gacguaaucuccaca

SEQ ID NO: 650832 - RNA, 19 nt, Homo sapiens
gacguccucccugauccca

SEQ ID NO: 650833 - RNA, 16 nt, Homo sapiens
gacguccuccguccau

SEQ ID NO: 650834 - RNA, 18 nt, Homo sapiens
gacgugcacugacagccu

SEQ ID NO: 650835 - RNA, 18 nt, Homo sapiens
gacgugcgcgaugccugg

SEQ ID NO: 650836 - RNA, 15 nt, Homo sapiens
gacguuccaccuggg

SEQ ID NO: 650837 - RNA, 21 nt, Homo sapiens
gacuaacauaaaaucugugaa

SEQ ID NO: 650838 - RNA, 21 nt, Homo sapiens
gacuaacccaaugccugugaa

SEQ ID NO: 650839 - RNA, 23 nt, Homo sapiens
gacuaagaugaaaugcacuguau

SEQ ID NO: 650840 - RNA, 15 nt, Homo sapiens
gacuaagcauugagc

SEQ ID NO: 650841 - RNA, 13 nt, Homo sapiens
gacuaauguugga

SEQ ID NO: 650842 - RNA, 20 nt, Homo sapiens
gacuacauuugugaacaaaa

SEQ ID NO: 650843 - RNA, 15 nt, Homo sapiens
gacuaccaacuuuca

SEQ ID NO: 650844 - RNA, 13 nt, Homo sapiens
gacuacuauacaa

SEQ ID NO: 650845 - RNA, 21 nt, Homo sapiens
gacuacuuggaacuaggcucu

SEQ ID NO: 650846 - RNA, 18 nt, Homo sapiens
gacuagauguaguauuuu

SEQ ID NO: 650847 - RNA, 15 nt, Homo sapiens
gacuaggagcacugu

SEQ ID NO: 650848 - RNA, 19 nt, Homo sapiens
gacuagugagucagcaccu

SEQ ID NO: 650849 - RNA, 14 nt, Homo sapiens
gacuaugaaaagcu

SEQ ID NO: 650850 - RNA, 19 nt, Homo sapiens
gacuaugaggaauauuugc

SEQ ID NO: 650851 - RNA, 20 nt, Homo sapiens
gacuaugauuuaccuauaca

SEQ ID NO: 650852 - RNA, 13 nt, Homo sapiens
gacuaugcaaaag

SEQ ID NO: 650853 - RNA, 21 nt, Homo sapiens
gacuauggagugcaccaaaga

SEQ ID NO: 650854 - RNA, 15 nt, Homo sapiens
gacuauguaaacuac

SEQ ID NO: 650855 - RNA, 16 nt, Homo sapiens
gacuauuuaugaaggc

SEQ ID NO: 650856 - RNA, 15 nt, Homo sapiens
gacuauuuuauauga

SEQ ID NO: 650857 - RNA, 18 nt, Homo sapiens
gacucaagacacugagau

SEQ ID NO: 650858 - RNA, 23 nt, Homo sapiens
gacucaaggggcuggaaucucau

SEQ ID NO: 650859 - RNA, 20 nt, Homo sapiens
gacucaaggucacacaguga

SEQ ID NO: 650860 - RNA, 18 nt, Homo sapiens
gacucacaagaagaccag

SEQ ID NO: 650861 - RNA, 12 nt, Homo sapiens
gacucacauccu

SEQ ID NO: 650862 - RNA, 24 nt, Homo sapiens
gacucaggagucugccacuuguca

SEQ ID NO: 650863 - RNA, 17 nt, Homo sapiens
gacucaggauccaguga

SEQ ID NO: 650864 - RNA, 19 nt, Homo sapiens
gacucagggccccagcacu

SEQ ID NO: 650865 - RNA, 22 nt, Homo sapiens
gacucaggucuguaacugccca

SEQ ID NO: 650866 - RNA, 12 nt, Homo sapiens
gacucaguucca

SEQ ID NO: 650867 - RNA, 18 nt, Homo sapiens
gacucauggccgggcuga

SEQ ID NO: 650868 - RNA, 18 nt, Homo sapiens
gacucaugguguguuaca

SEQ ID NO: 650869 - RNA, 13 nt, Homo sapiens
gacucauuucacu

SEQ ID NO: 650870 - RNA, 20 nt, Homo sapiens
gacuccaaacagaccccugu

SEQ ID NO: 650871 - RNA, 16 nt, Homo sapiens
gacuccaccucaaaaa

SEQ ID NO: 650872 - RNA, 13 nt, Homo sapiens
gacuccaguuaaa

SEQ ID NO: 650873 - RNA, 13 nt, Homo sapiens
gacuccaucucaa

SEQ ID NO: 650874 - RNA, 12 nt, Homo sapiens
gacuccaucucu

SEQ ID NO: 650875 - RNA, 21 nt, Homo sapiens
gacucccacaacaacaaaagc

SEQ ID NO: 650876 - RNA, 20 nt, Homo sapiens
gacucccagcagagcccacc

SEQ ID NO: 650877 - RNA, 16 nt, Homo sapiens
gacuccggaggacuga

SEQ ID NO: 650878 - RNA, 15 nt, Homo sapiens
gacuccggcccuccu

SEQ ID NO: 650879 - RNA, 22 nt, Homo sapiens
gacuccggggccccacuggcug

SEQ ID NO: 650880 - RNA, 16 nt, Homo sapiens
gacuccgucucaaaaa

SEQ ID NO: 650881 - RNA, 16 nt, Homo sapiens
gacuccuggucuguga

SEQ ID NO: 650882 - RNA, 16 nt, Homo sapiens
gacucgguuucuccaa

SEQ ID NO: 650883 - RNA, 20 nt, Homo sapiens
gacucuaaagucuguugauu

SEQ ID NO: 650884 - RNA, 22 nt, Homo sapiens
gacucuauucuuuaacucccau

SEQ ID NO: 650885 - RNA, 15 nt, Homo sapiens
gacucucacuaggcu

SEQ ID NO: 650886 - RNA, 17 nt, Homo sapiens
gacucucccccuuucaa

SEQ ID NO: 650887 - RNA, 18 nt, Homo sapiens
gacucugagaacuccuca

SEQ ID NO: 650888 - RNA, 10 nt, Homo sapiens
gacucuggac

SEQ ID NO: 650889 - RNA, 18 nt, Homo sapiens
gacucugggcuauggaca

SEQ ID NO: 650890 - RNA, 17 nt, Homo sapiens
gacucugucacaaaggg

SEQ ID NO: 650891 - RNA, 17 nt, Homo sapiens
gacucuuuggacacuca

SEQ ID NO: 650892 - RNA, 19 nt, Homo sapiens
gacucuuuugagugguaau

SEQ ID NO: 650893 - RNA, 22 nt, Homo sapiens
gacucuuuuuuugagugacagc

SEQ ID NO: 650894 - RNA, 12 nt, Homo sapiens
gacugaacucca

SEQ ID NO: 650895 - RNA, 18 nt, Homo sapiens
gacugaaggggcacacca

SEQ ID NO: 650896 - RNA, 15 nt, Homo sapiens
gacugaauaaccacu

SEQ ID NO: 650897 - RNA, 23 nt, Homo sapiens
gacugaauauggacccugcugaa

SEQ ID NO: 650898 - RNA, 22 nt, Homo sapiens
gacugaaugugccuaauggaga

SEQ ID NO: 650899 - RNA, 14 nt, Homo sapiens
gacugacacuacua

SEQ ID NO: 650900 - RNA, 13 nt, Homo sapiens
gacugacaguuua

SEQ ID NO: 650901 - RNA, 20 nt, Homo sapiens
gacugaccccagugguaucc

SEQ ID NO: 650902 - RNA, 20 nt, Homo sapiens
gacugagggcagcuuugcaa

SEQ ID NO: 650903 - RNA, 15 nt, Homo sapiens
gacugaugacuuuau

SEQ ID NO: 650904 - RNA, 22 nt, Homo sapiens
gacugaugccagacaaaccuug

SEQ ID NO: 650905 - RNA, 23 nt, Homo sapiens
gacugauguuacaucacaguguu

SEQ ID NO: 650906 - RNA, 12 nt, Homo sapiens
gacugauuucag

SEQ ID NO: 650907 - RNA, 17 nt, Homo sapiens
gacugccccugccuuuu

SEQ ID NO: 650908 - RNA, 14 nt, Homo sapiens
gacugccugugaag

SEQ ID NO: 650909 - RNA, 19 nt, Homo sapiens
gacugcuaaaugcacugac

SEQ ID NO: 650910 - RNA, 19 nt, Homo sapiens
gacugcucagaacuugcug

SEQ ID NO: 650911 - RNA, 22 nt, Homo sapiens
gagacacugagucagaauucuu

SEQ ID NO: 650912 - RNA, 17 nt, Homo sapiens
gagacagauaccuccaa

SEQ ID NO: 650913 - RNA, 15 nt, Homo sapiens
gagacaggagccuag

SEQ ID NO: 650914 - RNA, 18 nt, Homo sapiens
gagacagggcugcucccc

SEQ ID NO: 650915 - RNA, 19 nt, Homo sapiens
gagacagucucacucuguu

SEQ ID NO: 650916 - RNA, 15 nt, Homo sapiens
gagacauaggccaug

SEQ ID NO: 650917 - RNA, 13 nt, Homo sapiens
gagacaugugaca

SEQ ID NO: 650918 - RNA, 15 nt, Homo sapiens
gagacaugugacauu

SEQ ID NO: 650919 - RNA, 13 nt, Homo sapiens
gagacauugcucu

SEQ ID NO: 650920 - RNA, 19 nt, Homo sapiens
gagaccacaguuuaccuca

SEQ ID NO: 650921 - RNA, 20 nt, Homo sapiens
gagaccaccuuuuugaguga

SEQ ID NO: 650922 - RNA, 15 nt, Homo sapiens
gagaccauccuggcc

SEQ ID NO: 650923 - RNA, 14 nt, Homo sapiens
gagaccauguuuca

SEQ ID NO: 650924 - RNA, 16 nt, Homo sapiens
gagacccaacagcagu

SEQ ID NO: 650925 - RNA, 17 nt, Homo sapiens
gagacccaagcugccuc

SEQ ID NO: 650926 - RNA, 22 nt, Homo sapiens
gagacccaagggcagagcauuu

SEQ ID NO: 650927 - RNA, 14 nt, Homo sapiens
gagaccccaggaac

SEQ ID NO: 650928 - RNA, 20 nt, Homo sapiens
gagaccccaggaacaauaaa

SEQ ID NO: 650929 - RNA, 16 nt, Homo sapiens
gagaccccagucguga

SEQ ID NO: 650930 - RNA, 17 nt, Homo sapiens
gagaccccuuguugcac

SEQ ID NO: 650931 - RNA, 18 nt, Homo sapiens
gagacccuuuucucagga

SEQ ID NO: 650932 - RNA, 17 nt, Homo sapiens
gagaccuggaaccagag

SEQ ID NO: 650933 - RNA, 17 nt, Homo sapiens
gagaccuuuucaacuug

SEQ ID NO: 650934 - RNA, 15 nt, Homo sapiens
gagacgggcaucgca

SEQ ID NO: 650935 - RNA, 14 nt, Homo sapiens
gagacucacaggaa

SEQ ID NO: 650936 - RNA, 20 nt, Homo sapiens
gagacucaccucugccucaa

SEQ ID NO: 650937 - RNA, 14 nt, Homo sapiens
gagacuccgucuca

SEQ ID NO: 650938 - RNA, 13 nt, Homo sapiens
gagacucuagggu

SEQ ID NO: 650939 - RNA, 16 nt, Homo sapiens
gagacugaaaauugca

SEQ ID NO: 650940 - RNA, 17 nt, Homo sapiens
gagacugcccuucucac

SEQ ID NO: 650941 - RNA, 17 nt, Homo sapiens
gagacuggagcaucuga

SEQ ID NO: 650942 - RNA, 17 nt, Homo sapiens
gagacuggauacugccc

SEQ ID NO: 650943 - RNA, 17 nt, Homo sapiens
gagacugguuagugaug

SEQ ID NO: 650944 - RNA, 19 nt, Homo sapiens
gagacuucacgggcaauca

SEQ ID NO: 650945 - RNA, 19 nt, Homo sapiens
gagacuuuaaaagcauuuu

SEQ ID NO: 650946 - RNA, 19 nt, Homo sapiens
gagacuuucugcugggauc

SEQ ID NO: 650947 - RNA, 13 nt, Homo sapiens
gagagaaagggag

SEQ ID NO: 650948 - RNA, 13 nt, Homo sapiens
gagagaacuggag

SEQ ID NO: 650949 - RNA, 15 nt, Homo sapiens
gagagaagaaagugu

SEQ ID NO: 650950 - RNA, 22 nt, Homo sapiens
gagagaaguuaauccacaucuu

SEQ ID NO: 650951 - RNA, 19 nt, Homo sapiens
gagagaccagcagcccaag

SEQ ID NO: 650952 - RNA, 11 nt, Homo sapiens
gagagaccucu

SEQ ID NO: 650953 - RNA, 14 nt, Homo sapiens
gagagagaaggcag

SEQ ID NO: 650954 - RNA, 15 nt, Homo sapiens
gagagagacaggcag

SEQ ID NO: 650955 - RNA, 18 nt, Homo sapiens
gagagauuagaauaucug

SEQ ID NO: 650956 - RNA, 13 nt, Homo sapiens
gagagcagcagca

SEQ ID NO: 650957 - RNA, 20 nt, Homo sapiens
gagagcaggggagcuuggga

SEQ ID NO: 650958 - RNA, 15 nt, Homo sapiens
gagagcccagucauu

SEQ ID NO: 650959 - RNA, 14 nt, Homo sapiens
gagagcccauuccc

SEQ ID NO: 650960 - RNA, 22 nt, Homo sapiens
gagagcccccaccuugauccca

SEQ ID NO: 650961 - RNA, 16 nt, Homo sapiens
gagagcugcauguguc

SEQ ID NO: 650962 - RNA, 13 nt, Homo sapiens
gagagcuggccaa

SEQ ID NO: 650963 - RNA, 22 nt, Homo sapiens
gagagcuguucccaaauuuucu

SEQ ID NO: 650964 - RNA, 12 nt, Homo sapiens
gagaggacucug

SEQ ID NO: 650965 - RNA, 18 nt, Homo sapiens
gagaggcacucagugagc

SEQ ID NO: 650966 - RNA, 22 nt, Homo sapiens
gagaggcagcaagguggccaca

SEQ ID NO: 650967 - RNA, 13 nt, Homo sapiens
gagaggcaggcau

SEQ ID NO: 650968 - RNA, 22 nt, Homo sapiens
gagaggcccucuggaguggcca

SEQ ID NO: 650969 - RNA, 18 nt, Homo sapiens
gagaggccuuuuggaaug

SEQ ID NO: 650970 - RNA, 22 nt, Homo sapiens
gagaggcugagaaaugcagaga

SEQ ID NO: 650971 - RNA, 14 nt, Homo sapiens
gagaggcuuuccaa

SEQ ID NO: 650972 - RNA, 23 nt, Homo sapiens
gagaggucucagguucuuuccau

SEQ ID NO: 650973 - RNA, 14 nt, Homo sapiens
gagaggugggagac

SEQ ID NO: 650974 - RNA, 19 nt, Homo sapiens
gagaguaguuuuucagcua

SEQ ID NO: 650975 - RNA, 18 nt, Homo sapiens
gagaguauauuauguauu

SEQ ID NO: 650976 - RNA, 16 nt, Homo sapiens
gagagucaaaugggaa

SEQ ID NO: 650977 - RNA, 13 nt, Homo sapiens
gagagucacuuga

SEQ ID NO: 650978 - RNA, 23 nt, Homo sapiens
gagagucagacccuucaauggaa

SEQ ID NO: 650979 - RNA, 12 nt, Homo sapiens
gagaguccugug

SEQ ID NO: 650980 - RNA, 14 nt, Homo sapiens
gagagugaaaccau

SEQ ID NO: 650981 - RNA, 15 nt, Homo sapiens
gagagugaaaccaug

SEQ ID NO: 650982 - RNA, 22 nt, Homo sapiens
gagagugaaaccaugacuguga

SEQ ID NO: 650983 - RNA, 19 nt, Homo sapiens
gagaguuauccugauaaau

SEQ ID NO: 650984 - RNA, 14 nt, Homo sapiens
gagaguuucuguua

SEQ ID NO: 650985 - RNA, 14 nt, Homo sapiens
gagauaaagucaaa

SEQ ID NO: 650986 - RNA, 14 nt, Homo sapiens
gagauaccaucuca

SEQ ID NO: 650987 - RNA, 23 nt, Homo sapiens
gagauacucucccugacauuucu

SEQ ID NO: 650988 - RNA, 14 nt, Homo sapiens
gagauagaaccugg

SEQ ID NO: 650989 - RNA, 19 nt, Homo sapiens
gagauauggcauugcacug

SEQ ID NO: 650990 - RNA, 15 nt, Homo sapiens
gagaucacauuucag

SEQ ID NO: 650991 - RNA, 20 nt, Homo sapiens
gagaucaucacuuccuugcc

SEQ ID NO: 650992 - RNA, 14 nt, Homo sapiens
gagaucgagaccau

SEQ ID NO: 650993 - RNA, 19 nt, Homo sapiens
gagaucuaaggaugucaca

SEQ ID NO: 650994 - RNA, 16 nt, Homo sapiens
gagaucuaaugugaaa

SEQ ID NO: 650995 - RNA, 19 nt, Homo sapiens
gagccuuggcccacacuga

SEQ ID NO: 650996 - RNA, 18 nt, Homo sapiens
gagcgagacuccgucuca

SEQ ID NO: 650997 - RNA, 14 nt, Homo sapiens
gagcgagacuuggu

SEQ ID NO: 650998 - RNA, 13 nt, Homo sapiens
gagcgagauucca

SEQ ID NO: 650999 - RNA, 13 nt, Homo sapiens
gagcgauggagca

SEQ ID NO: 651000 - RNA, 21 nt, Homo sapiens
gagcggauggagaagcagcag

SEQ ID NO: 651001 - RNA, 14 nt, Homo sapiens
gagcgugcuuucaa

SEQ ID NO: 651002 - RNA, 16 nt, Homo sapiens
gagcuaagucacccag

SEQ ID NO: 651003 - RNA, 16 nt, Homo sapiens
gagcuaaucuucauuu

SEQ ID NO: 651004 - RNA, 13 nt, Homo sapiens
gagcuacaacaaa

SEQ ID NO: 651005 - RNA, 13 nt, Homo sapiens
gagcuacugauga

SEQ ID NO: 651006 - RNA, 19 nt, Homo sapiens
gagcuaggaagagucuacc

SEQ ID NO: 651007 - RNA, 21 nt, Homo sapiens
gagcucacacuccaguggcag

SEQ ID NO: 651008 - RNA, 12 nt, Homo sapiens
gagcucagagag

SEQ ID NO: 651009 - RNA, 19 nt, Homo sapiens
gagcucccgggcacaucca

SEQ ID NO: 651010 - RNA, 19 nt, Homo sapiens
gagcucgcauuugucaaug

SEQ ID NO: 651011 - RNA, 21 nt, Homo sapiens
gagcucgguggacccagggau

SEQ ID NO: 651012 - RNA, 19 nt, Homo sapiens
gagcugaaaaaucacaucc

SEQ ID NO: 651013 - RNA, 20 nt, Homo sapiens
gagcugacccagaguggagu

SEQ ID NO: 651014 - RNA, 14 nt, Homo sapiens
gagcugagcacuuu

SEQ ID NO: 651015 - RNA, 19 nt, Homo sapiens
gagcugagugcugaaauaa

SEQ ID NO: 651016 - RNA, 15 nt, Homo sapiens
gagcugcacuaucac

SEQ ID NO: 651017 - RNA, 14 nt, Homo sapiens
gagcugcaggggug

SEQ ID NO: 651018 - RNA, 22 nt, Homo sapiens
gagcugccaagagugaagggaa

SEQ ID NO: 651019 - RNA, 15 nt, Homo sapiens
gagcugccagccggg

SEQ ID NO: 651020 - RNA, 22 nt, Homo sapiens
gagcugcgcccuggauccucac

SEQ ID NO: 651021 - RNA, 13 nt, Homo sapiens
gagcugcucugcu

SEQ ID NO: 651022 - RNA, 14 nt, Homo sapiens
gagcuggaaggcag

SEQ ID NO: 651023 - RNA, 17 nt, Homo sapiens
gagcuggcaaagguggc

SEQ ID NO: 651024 - RNA, 13 nt, Homo sapiens
gagcugggggcca

SEQ ID NO: 651025 - RNA, 21 nt, Homo sapiens
gagcuggugacuuuggggaca

SEQ ID NO: 651026 - RNA, 21 nt, Homo sapiens
gagcugguuccucucucccac

SEQ ID NO: 651027 - RNA, 21 nt, Homo sapiens
gagcuguaucuguaauuaaua

SEQ ID NO: 651028 - RNA, 22 nt, Homo sapiens
gagcuguccccguguugcauga

SEQ ID NO: 651029 - RNA, 20 nt, Homo sapiens
gagcuguuuucccugaccuc

SEQ ID NO: 651030 - RNA, 13 nt, Homo sapiens
gagcuucaguaua

SEQ ID NO: 651031 - RNA, 18 nt, Homo sapiens
gagcuucaguauaaaaga

SEQ ID NO: 651032 - RNA, 22 nt, Homo sapiens
gagcuuccaacccgaggcaaua

SEQ ID NO: 651033 - RNA, 14 nt, Homo sapiens
gagcuugcuccaga

SEQ ID NO: 651034 - RNA, 23 nt, Homo sapiens
gagcuugcuccagauucugaugc

SEQ ID NO: 651035 - RNA, 23 nt, Homo sapiens
gagcuuggccagaagggggccau

SEQ ID NO: 651036 - RNA, 19 nt, Homo sapiens
gaucuacacccaccagagu

SEQ ID NO: 651037 - RNA, 13 nt, Homo sapiens
gaucuaccagcau

SEQ ID NO: 651038 - RNA, 13 nt, Homo sapiens
gaucuaguucuca

SEQ ID NO: 651039 - RNA, 20 nt, Homo sapiens
gaucucaauuugcaguauuc

SEQ ID NO: 651040 - RNA, 17 nt, Homo sapiens
gaucucagagcauuuca

SEQ ID NO: 651041 - RNA, 14 nt, Homo sapiens
gaucucagggcaga

SEQ ID NO: 651042 - RNA, 19 nt, Homo sapiens
gaucuccaaggaccagguu

SEQ ID NO: 651043 - RNA, 18 nt, Homo sapiens
gaucucggcucacugcaa

SEQ ID NO: 651044 - RNA, 16 nt, Homo sapiens
gaucucgguuugccaa

SEQ ID NO: 651045 - RNA, 16 nt, Homo sapiens
gaucucuaauuagucu

SEQ ID NO: 651046 - RNA, 19 nt, Homo sapiens
gaucucugaccucugcuga

SEQ ID NO: 651047 - RNA, 18 nt, Homo sapiens
gaucucugggaguuauag

SEQ ID NO: 651048 - RNA, 15 nt, Homo sapiens
gaucugcaaacaaug

SEQ ID NO: 651049 - RNA, 14 nt, Homo sapiens
gaucugcaguuuuu

SEQ ID NO: 651050 - RNA, 16 nt, Homo sapiens
gaucugcuagugcugu

SEQ ID NO: 651051 - RNA, 16 nt, Homo sapiens
gaucuggcacacuccc

SEQ ID NO: 651052 - RNA, 15 nt, Homo sapiens
gaucuggcagacuca

SEQ ID NO: 651053 - RNA, 17 nt, Homo sapiens
gaucuggucccuugcag

SEQ ID NO: 651054 - RNA, 15 nt, Homo sapiens
gaucuguacuuugug

SEQ ID NO: 651055 - RNA, 14 nt, Homo sapiens
gaucugucccuuaa

SEQ ID NO: 651056 - RNA, 19 nt, Homo sapiens
gaucuguguuuuauugaca

SEQ ID NO: 651057 - RNA, 18 nt, Homo sapiens
gaucuguuuugaaggcaa

SEQ ID NO: 651058 - RNA, 22 nt, Homo sapiens
gaucuuaaaaaaugaauuauuc

SEQ ID NO: 651059 - RNA, 18 nt, Homo sapiens
gaucuuaacaaagccuuu

SEQ ID NO: 651060 - RNA, 19 nt, Homo sapiens
gaucuucagggaacugcau

SEQ ID NO: 651061 - RNA, 22 nt, Homo sapiens
gaucuucuucauccaacuucca

SEQ ID NO: 651062 - RNA, 23 nt, Homo sapiens
gaucuucuucauccaacuuccaa

SEQ ID NO: 651063 - RNA, 17 nt, Homo sapiens
gaucuugaauagucuca

SEQ ID NO: 651064 - RNA, 15 nt, Homo sapiens
gaucuuuacucuuga

SEQ ID NO: 651065 - RNA, 17 nt, Homo sapiens
gaucuuucuauuccaaa

SEQ ID NO: 651066 - RNA, 19 nt, Homo sapiens
gaucuuucuuuccaaaaca

SEQ ID NO: 651067 - RNA, 15 nt, Homo sapiens
gaucuuugagcccau

SEQ ID NO: 651068 - RNA, 22 nt, Homo sapiens
gaugaaaaauaugugcuugaaa

SEQ ID NO: 651069 - RNA, 13 nt, Homo sapiens
gaugaaacauuca

SEQ ID NO: 651070 - RNA, 22 nt, Homo sapiens
gaugaaaucugcuagaaaguua

SEQ ID NO: 651071 - RNA, 16 nt, Homo sapiens
gaugaaaugcacugua

SEQ ID NO: 651072 - RNA, 16 nt, Homo sapiens
gaugaaauugccaaaa

SEQ ID NO: 651073 - RNA, 22 nt, Homo sapiens
gaugaacaauuaugaacaucca

SEQ ID NO: 651074 - RNA, 20 nt, Homo sapiens
gaugaacccgaggcugagaa

SEQ ID NO: 651075 - RNA, 23 nt, Homo sapiens
gaugaaccugacaaaaacaagca

SEQ ID NO: 651076 - RNA, 18 nt, Homo sapiens
gaugaacuugagcucugu

SEQ ID NO: 651077 - RNA, 22 nt, Homo sapiens
gaugaagaacacagcaugugcc

SEQ ID NO: 651078 - RNA, 15 nt, Homo sapiens
gaugaagacaacagc

SEQ ID NO: 651079 - RNA, 12 nt, Homo sapiens
gaugaagaccaa

SEQ ID NO: 651080 - RNA, 16 nt, Homo sapiens
gaugaagaccaaagac

SEQ ID NO: 651081 - RNA, 21 nt, Homo sapiens
gaugaagauucuccugugcua

SEQ ID NO: 651082 - RNA, 12 nt, Homo sapiens
gaugaagcuucc

SEQ ID NO: 651083 - RNA, 17 nt, Homo sapiens
gaugaaggggcucuuca

SEQ ID NO: 651084 - RNA, 21 nt, Homo sapiens
gaugacaaaagaaaauuuucc

SEQ ID NO: 651085 - RNA, 13 nt, Homo sapiens
gaugacauuucac

SEQ ID NO: 651086 - RNA, 16 nt, Homo sapiens
gaugaccagugccuug

SEQ ID NO: 651087 - RNA, 15 nt, Homo sapiens
gaugaccguguacaa

SEQ ID NO: 651088 - RNA, 17 nt, Homo sapiens
gaugaccguguacaaua

SEQ ID NO: 651089 - RNA, 18 nt, Homo sapiens
gaugaccuacagugcugu

SEQ ID NO: 651090 - RNA, 18 nt, Homo sapiens
gaugacgacgacaacgau

SEQ ID NO: 651091 - RNA, 13 nt, Homo sapiens
gaugacucaaggc

SEQ ID NO: 651092 - RNA, 21 nt, Homo sapiens
gaugagcuuugucuacuucaa

SEQ ID NO: 651093 - RNA, 15 nt, Homo sapiens
gaugaggcacuggaa

SEQ ID NO: 651094 - RNA, 18 nt, Homo sapiens
gaugaggcacuucuguca

SEQ ID NO: 651095 - RNA, 17 nt, Homo sapiens
gaugaggcuggccaagc

SEQ ID NO: 651096 - RNA, 13 nt, Homo sapiens
gaugagggggcca

SEQ ID NO: 651097 - RNA, 15 nt, Homo sapiens
gaugaguugcaguuu

SEQ ID NO: 651098 - RNA, 18 nt, Homo sapiens
gaugaguuuaucauguca

SEQ ID NO: 651099 - RNA, 14 nt, Homo sapiens
gaugauacauccaa

SEQ ID NO: 651100 - RNA, 13 nt, Homo sapiens
gaugaucuacuca

SEQ ID NO: 651101 - RNA, 12 nt, Homo sapiens
gaugaugaaggg

SEQ ID NO: 651102 - RNA, 15 nt, Homo sapiens
gaugaugacguccuc

SEQ ID NO: 651103 - RNA, 12 nt, Homo sapiens
gaugaugcaguu

SEQ ID NO: 651104 - RNA, 13 nt, Homo sapiens
gaugaugcaguuu

SEQ ID NO: 651105 - RNA, 19 nt, Homo sapiens
gaugaugcaugaugcccuc

SEQ ID NO: 651106 - RNA, 10 nt, Homo sapiens
gaugaugcug

SEQ ID NO: 651107 - RNA, 12 nt, Homo sapiens
gaugaugucuuc

SEQ ID NO: 651108 - RNA, 22 nt, Homo sapiens
gaugaugucuucuggugucaug

SEQ ID NO: 651109 - RNA, 22 nt, Homo sapiens
gaugauuuccuaguagaacuca

SEQ ID NO: 651110 - RNA, 23 nt, Homo sapiens
gaugauuuuguaauucuuaugac

SEQ ID NO: 651111 - RNA, 12 nt, Homo sapiens
gcacaguuugaa

SEQ ID NO: 651112 - RNA, 19 nt, Homo sapiens
gcacaguuuguggcuuaua

SEQ ID NO: 651113 - RNA, 15 nt, Homo sapiens
gcacauaacaugcuu

SEQ ID NO: 651114 - RNA, 18 nt, Homo sapiens
gcacauaccuucaugugg

SEQ ID NO: 651115 - RNA, 20 nt, Homo sapiens
gcacauauacacauuuucaa

SEQ ID NO: 651116 - RNA, 17 nt, Homo sapiens
gcacaucugcugugguc

SEQ ID NO: 651117 - RNA, 19 nt, Homo sapiens
gcacaugaacauaugucca

SEQ ID NO: 651118 - RNA, 21 nt, Homo sapiens
gcacaugaacauauguccauc

SEQ ID NO: 651119 - RNA, 20 nt, Homo sapiens
gcacauguaauaaauucaaa

SEQ ID NO: 651120 - RNA, 13 nt, Homo sapiens
gcacauguauuga

SEQ ID NO: 651121 - RNA, 19 nt, Homo sapiens
gcacauucuuaaauauuuc

SEQ ID NO: 651122 - RNA, 22 nt, Homo sapiens
gcacauuuaugaaucacaguau

SEQ ID NO: 651123 - RNA, 18 nt, Homo sapiens
gcacauuucauaguuuca

SEQ ID NO: 651124 - RNA, 22 nt, Homo sapiens
gcacauuugucaguauuuuugc

SEQ ID NO: 651125 - RNA, 17 nt, Homo sapiens
gcacauuuuccacggaa

SEQ ID NO: 651126 - RNA, 10 nt, Homo sapiens
gcaccaaaga

SEQ ID NO: 651127 - RNA, 17 nt, Homo sapiens
gcaccaaagacaucagu

SEQ ID NO: 651128 - RNA, 21 nt, Homo sapiens
gcaccacacuagggacuauca

SEQ ID NO: 651129 - RNA, 16 nt, Homo sapiens
gcaccaccaagccaag

SEQ ID NO: 651130 - RNA, 13 nt, Homo sapiens
gcaccaccagggu

SEQ ID NO: 651131 - RNA, 14 nt, Homo sapiens
gcaccacccuaguc

SEQ ID NO: 651132 - RNA, 14 nt, Homo sapiens
gcaccacugcacuc

SEQ ID NO: 651133 - RNA, 19 nt, Homo sapiens
gcaccacuguguauuuaac

SEQ ID NO: 651134 - RNA, 12 nt, Homo sapiens
gcaccacuuauu

SEQ ID NO: 651135 - RNA, 18 nt, Homo sapiens
gcaccagagggauaaaaa

SEQ ID NO: 651136 - RNA, 13 nt, Homo sapiens
gcaccagcauuug

SEQ ID NO: 651137 - RNA, 18 nt, Homo sapiens
gcaccaggaaguguuuau

SEQ ID NO: 651138 - RNA, 13 nt, Homo sapiens
gcaccaucucuga

SEQ ID NO: 651139 - RNA, 20 nt, Homo sapiens
gcaccauucuccugccucag

SEQ ID NO: 651140 - RNA, 19 nt, Homo sapiens
gcaccauugcacuccagcu

SEQ ID NO: 651141 - RNA, 12 nt, Homo sapiens
gcacccauucca

SEQ ID NO: 651142 - RNA, 17 nt, Homo sapiens
gcaccccaaagcuuucc

SEQ ID NO: 651143 - RNA, 17 nt, Homo sapiens
gcaccccccaagcuguu

SEQ ID NO: 651144 - RNA, 13 nt, Homo sapiens
gcaccccuacuca

SEQ ID NO: 651145 - RNA, 21 nt, Homo sapiens
gcaccccuccuauaccauaug

SEQ ID NO: 651146 - RNA, 18 nt, Homo sapiens
gcacccugcccaccaaga

SEQ ID NO: 651147 - RNA, 15 nt, Homo sapiens
gcacccugcccucau

SEQ ID NO: 651148 - RNA, 12 nt, Homo sapiens
gcacccuggauu

SEQ ID NO: 651149 - RNA, 19 nt, Homo sapiens
gcacccuguaucacagacu

SEQ ID NO: 651150 - RNA, 22 nt, Homo sapiens
gcacccuucuuuucucaugugu

SEQ ID NO: 651151 - RNA, 20 nt, Homo sapiens
gcaccgaguggccauggcau

SEQ ID NO: 651152 - RNA, 16 nt, Homo sapiens
gcaccguucugugcac

SEQ ID NO: 651153 - RNA, 19 nt, Homo sapiens
gcaccuacacucaccugca

SEQ ID NO: 651154 - RNA, 12 nt, Homo sapiens
gcaccuaccuca

SEQ ID NO: 651155 - RNA, 13 nt, Homo sapiens
gcaccuacugcuu

SEQ ID NO: 651156 - RNA, 20 nt, Homo sapiens
gcaccucaccucccgaagcc

SEQ ID NO: 651157 - RNA, 17 nt, Homo sapiens
gcaccuccagccugaac

SEQ ID NO: 651158 - RNA, 20 nt, Homo sapiens
gcaccucggggacaccagag

SEQ ID NO: 651159 - RNA, 20 nt, Homo sapiens
gcaccugagacccuacugaa

SEQ ID NO: 651160 - RNA, 13 nt, Homo sapiens
gcaccugcucaac

SEQ ID NO: 651161 - RNA, 18 nt, Homo sapiens
gcaccugggcagcuccuc

SEQ ID NO: 651162 - RNA, 20 nt, Homo sapiens
gcaccugggccccacuggac

SEQ ID NO: 651163 - RNA, 23 nt, Homo sapiens
gcaccugggggccuggccuugca

SEQ ID NO: 651164 - RNA, 12 nt, Homo sapiens
gcaccuguggug

SEQ ID NO: 651165 - RNA, 22 nt, Homo sapiens
gcaccuugucauguaccaucaa

SEQ ID NO: 651166 - RNA, 13 nt, Homo sapiens
gcaccuuugcacg

SEQ ID NO: 651167 - RNA, 14 nt, Homo sapiens
gcaccuuugcacgu

SEQ ID NO: 651168 - RNA, 15 nt, Homo sapiens
gcacgcccaugugug

SEQ ID NO: 651169 - RNA, 14 nt, Homo sapiens
gcacgcccuccuca

SEQ ID NO: 651170 - RNA, 23 nt, Homo sapiens
gcacggagccgcgggacagccaa

SEQ ID NO: 651171 - RNA, 16 nt, Homo sapiens
gcacgggggccaagga

SEQ ID NO: 651172 - RNA, 18 nt, Homo sapiens
gcacgguggcucaggccu

SEQ ID NO: 651173 - RNA, 20 nt, Homo sapiens
gcacuaaagaauacauuuaa

SEQ ID NO: 651174 - RNA, 16 nt, Homo sapiens
gcacuaaaucagagac

SEQ ID NO: 651175 - RNA, 22 nt, Homo sapiens
gcacuacaggcacccgccacca

SEQ ID NO: 651176 - RNA, 13 nt, Homo sapiens
gcacuacucugug

SEQ ID NO: 651177 - RNA, 18 nt, Homo sapiens
gcacuacugggugucauu

SEQ ID NO: 651178 - RNA, 12 nt, Homo sapiens
gcacuagcauuu

SEQ ID NO: 651179 - RNA, 21 nt, Homo sapiens
gcagcucccauuucaucagca

SEQ ID NO: 651180 - RNA, 14 nt, Homo sapiens
gcagcucuugcccu

SEQ ID NO: 651181 - RNA, 13 nt, Homo sapiens
gcagcucuuggga

SEQ ID NO: 651182 - RNA, 13 nt, Homo sapiens
gcagcugauucca

SEQ ID NO: 651183 - RNA, 17 nt, Homo sapiens
gcagcugccucugcucc

SEQ ID NO: 651184 - RNA, 17 nt, Homo sapiens
gcagcugcugugccuga

SEQ ID NO: 651185 - RNA, 19 nt, Homo sapiens
gcagcugucagaacacucc

SEQ ID NO: 651186 - RNA, 20 nt, Homo sapiens
gcagcuuagacuaaggccau

SEQ ID NO: 651187 - RNA, 19 nt, Homo sapiens
gcaggaacauacagacaca

SEQ ID NO: 651188 - RNA, 14 nt, Homo sapiens
gcaggaaggaacaa

SEQ ID NO: 651189 - RNA, 16 nt, Homo sapiens
gcaggaagugguggca

SEQ ID NO: 651190 - RNA, 15 nt, Homo sapiens
gcaggaagugucuag

SEQ ID NO: 651191 - RNA, 12 nt, Homo sapiens
gcaggaccagga

SEQ ID NO: 651192 - RNA, 17 nt, Homo sapiens
gcaggaccuugggcaca

SEQ ID NO: 651193 - RNA, 13 nt, Homo sapiens
gcaggacugcaca

SEQ ID NO: 651194 - RNA, 17 nt, Homo sapiens
gcaggacuggauuuuaa

SEQ ID NO: 651195 - RNA, 21 nt, Homo sapiens
gcaggacuugagaagaccuca

SEQ ID NO: 651196 - RNA, 18 nt, Homo sapiens
gcaggagaaucacuggaa

SEQ ID NO: 651197 - RNA, 18 nt, Homo sapiens
gcaggagaaucacuugaa

SEQ ID NO: 651198 - RNA, 21 nt, Homo sapiens
gcaggagaaucacuugcacuc

SEQ ID NO: 651199 - RNA, 17 nt, Homo sapiens
gcaggagaauggcguga

SEQ ID NO: 651200 - RNA, 18 nt, Homo sapiens
gcaggagagucacuugaa

SEQ ID NO: 651201 - RNA, 17 nt, Homo sapiens
gcaggaggauugcuuga

SEQ ID NO: 651202 - RNA, 17 nt, Homo sapiens
gcaggagguuacagggc

SEQ ID NO: 651203 - RNA, 14 nt, Homo sapiens
gcaggaugagggaa

SEQ ID NO: 651204 - RNA, 15 nt, Homo sapiens
gcaggaugaugcugu

SEQ ID NO: 651205 - RNA, 20 nt, Homo sapiens
gcaggauuuggcuaugacau

SEQ ID NO: 651206 - RNA, 16 nt, Homo sapiens
gcaggauuuguuguuc

SEQ ID NO: 651207 - RNA, 15 nt, Homo sapiens
gcaggcaaucacuug

SEQ ID NO: 651208 - RNA, 15 nt, Homo sapiens
gcaggcaauuucacc

SEQ ID NO: 651209 - RNA, 19 nt, Homo sapiens
gcaggcacaaaucuugggu

SEQ ID NO: 651210 - RNA, 14 nt, Homo sapiens
gcaggcacagagga

SEQ ID NO: 651211 - RNA, 15 nt, Homo sapiens
gcaggccacugggga

SEQ ID NO: 651212 - RNA, 21 nt, Homo sapiens
gcaggcuauuuguucagagag

SEQ ID NO: 651213 - RNA, 16 nt, Homo sapiens
gcaggcuccaguugaa

SEQ ID NO: 651214 - RNA, 22 nt, Homo sapiens
gcaggcuccuuuguucuguauu

SEQ ID NO: 651215 - RNA, 16 nt, Homo sapiens
gcaggcugcagucccu

SEQ ID NO: 651216 - RNA, 19 nt, Homo sapiens
gcaggcugggccaugucca

SEQ ID NO: 651217 - RNA, 23 nt, Homo sapiens
gcaggcugggccauguccaaaga

SEQ ID NO: 651218 - RNA, 19 nt, Homo sapiens
gcaggcuuugaguccagca

SEQ ID NO: 651219 - RNA, 19 nt, Homo sapiens
gcaggcuuugccauuguga

SEQ ID NO: 651220 - RNA, 18 nt, Homo sapiens
gcagggaagaggggugca

SEQ ID NO: 651221 - RNA, 14 nt, Homo sapiens
gcagggacccgggg

SEQ ID NO: 651222 - RNA, 16 nt, Homo sapiens
gcagggacugccaguc

SEQ ID NO: 651223 - RNA, 14 nt, Homo sapiens
gcagggagcacugu

SEQ ID NO: 651224 - RNA, 15 nt, Homo sapiens
gcagggaugauggca

SEQ ID NO: 651225 - RNA, 18 nt, Homo sapiens
gcagggauuagguguuca

SEQ ID NO: 651226 - RNA, 15 nt, Homo sapiens
gcagggccaccugca

SEQ ID NO: 651227 - RNA, 19 nt, Homo sapiens
gcagggcgccccugggaga

SEQ ID NO: 651228 - RNA, 23 nt, Homo sapiens
gcagggcuggcaggaugccgugg

SEQ ID NO: 651229 - RNA, 20 nt, Homo sapiens
gcaggggaauucccuccccc

SEQ ID NO: 651230 - RNA, 13 nt, Homo sapiens
gcaggggagacag

SEQ ID NO: 651231 - RNA, 15 nt, Homo sapiens
gcagguauggaaggg

SEQ ID NO: 651232 - RNA, 12 nt, Homo sapiens
gcaggugccaac

SEQ ID NO: 651233 - RNA, 12 nt, Homo sapiens
gcaggugccuug

SEQ ID NO: 651234 - RNA, 13 nt, Homo sapiens
gcaggugccuugu

SEQ ID NO: 651235 - RNA, 22 nt, Homo sapiens
gcaggugcugacuucaucuccc

SEQ ID NO: 651236 - RNA, 14 nt, Homo sapiens
gaaucaguuuccaa

SEQ ID NO: 651237 - RNA, 21 nt, Homo sapiens
gaaucauacuuaacauuucau

SEQ ID NO: 651238 - RNA, 23 nt, Homo sapiens
gaaucaucaaagcucacaccaaa

SEQ ID NO: 651239 - RNA, 22 nt, Homo sapiens
gaauccaagugaacacuagcca

SEQ ID NO: 651240 - RNA, 20 nt, Homo sapiens
gaauccauaaauguguuccu

SEQ ID NO: 651241 - RNA, 12 nt, Homo sapiens
gaauccaugcuu

SEQ ID NO: 651242 - RNA, 19 nt, Homo sapiens
gaauccauguaaauugcaa

SEQ ID NO: 651243 - RNA, 16 nt, Homo sapiens
gaaucccaauguuuga

SEQ ID NO: 651244 - RNA, 16 nt, Homo sapiens
gaauccccaacaugca

SEQ ID NO: 651245 - RNA, 17 nt, Homo sapiens
gaauccuauuuaucaga

SEQ ID NO: 651246 - RNA, 16 nt, Homo sapiens
gaauccuccaggcccu

SEQ ID NO: 651247 - RNA, 15 nt, Homo sapiens
gaaucuaagcuguuu

SEQ ID NO: 651248 - RNA, 19 nt, Homo sapiens
gaaucuaauucuguugauu

SEQ ID NO: 651249 - RNA, 16 nt, Homo sapiens
gaaucuagaaaaucag

SEQ ID NO: 651250 - RNA, 18 nt, Homo sapiens
gaaucuccccuccucaca

SEQ ID NO: 651251 - RNA, 18 nt, Homo sapiens
gaaucucgcaguguuucu

SEQ ID NO: 651252 - RNA, 15 nt, Homo sapiens
gaaucugaacugcuc

SEQ ID NO: 651253 - RNA, 17 nt, Homo sapiens
gaaucugcuguugccau

SEQ ID NO: 651254 - RNA, 19 nt, Homo sapiens
gaaucuguaaagaaauaua

SEQ ID NO: 651255 - RNA, 15 nt, Homo sapiens
gaaucuguuaccaga

SEQ ID NO: 651256 - RNA, 18 nt, Homo sapiens
gaaucuucaagaccaaag

SEQ ID NO: 651257 - RNA, 20 nt, Homo sapiens
gaaucuucacaaaacacuuc

SEQ ID NO: 651258 - RNA, 22 nt, Homo sapiens
gaaucuuucuccuggugacuca

SEQ ID NO: 651259 - RNA, 15 nt, Homo sapiens
gaaucuuuguuagau

SEQ ID NO: 651260 - RNA, 13 nt, Homo sapiens
gaaugaaacugau

SEQ ID NO: 651261 - RNA, 15 nt, Homo sapiens
gaaugaacgucauug

SEQ ID NO: 651262 - RNA, 16 nt, Homo sapiens
gaaugaagcguugcca

SEQ ID NO: 651263 - RNA, 17 nt, Homo sapiens
gaaugaagcguugccau

SEQ ID NO: 651264 - RNA, 13 nt, Homo sapiens
gaaugacacuguu

SEQ ID NO: 651265 - RNA, 20 nt, Homo sapiens
gaaugagccaaaaugacuuu

SEQ ID NO: 651266 - RNA, 19 nt, Homo sapiens
gaaugagccuacgcugaag

SEQ ID NO: 651267 - RNA, 21 nt, Homo sapiens
gaaugagucaaucagccuuua

SEQ ID NO: 651268 - RNA, 16 nt, Homo sapiens
gaaugaugcucaaaau

SEQ ID NO: 651269 - RNA, 23 nt, Homo sapiens
gaaugaugcucaaaaucuuucca

SEQ ID NO: 651270 - RNA, 22 nt, Homo sapiens
gaaugauuaaucaaaggcauau

SEQ ID NO: 651271 - RNA, 14 nt, Homo sapiens
gaaugauucagugu

SEQ ID NO: 651272 - RNA, 20 nt, Homo sapiens
gaaugauuuagguacgucaa

SEQ ID NO: 651273 - RNA, 17 nt, Homo sapiens
gaaugcaaaccauagca

SEQ ID NO: 651274 - RNA, 19 nt, Homo sapiens
gaaugcaaaguagcaauuu

SEQ ID NO: 651275 - RNA, 22 nt, Homo sapiens
gaaugcaaaguagcaauuucca

SEQ ID NO: 651276 - RNA, 24 nt, Homo sapiens
gaaugcacacuagccucuccagga

SEQ ID NO: 651277 - RNA, 17 nt, Homo sapiens
gaaugcagaggucucca

SEQ ID NO: 651278 - RNA, 13 nt, Homo sapiens
gaaugcagggaag

SEQ ID NO: 651279 - RNA, 16 nt, Homo sapiens
gaaugcaguggggaca

SEQ ID NO: 651280 - RNA, 21 nt, Homo sapiens
gaaugcauuauuuauugcugu

SEQ ID NO: 651281 - RNA, 12 nt, Homo sapiens
gaaugcauucaa

SEQ ID NO: 651282 - RNA, 15 nt, Homo sapiens
gaaugccacugccuu

SEQ ID NO: 651283 - RNA, 14 nt, Homo sapiens
gaaugcggcaagaa

SEQ ID NO: 651284 - RNA, 21 nt, Homo sapiens
gaaugcucuuuacuucaugga

SEQ ID NO: 651285 - RNA, 19 nt, Homo sapiens
gaaugcuguccuagugguc

SEQ ID NO: 651286 - RNA, 17 nt, Homo sapiens
gaauggagcucaggucc

SEQ ID NO: 651287 - RNA, 17 nt, Homo sapiens
gaauggagggagcucca

SEQ ID NO: 651288 - RNA, 17 nt, Homo sapiens
gaauggauuuaucagaa

SEQ ID NO: 651289 - RNA, 21 nt, Homo sapiens
gaauggcagguucaaguucca

SEQ ID NO: 651290 - RNA, 22 nt, Homo sapiens
gaauggcccaguccucucccaa

SEQ ID NO: 651291 - RNA, 21 nt, Homo sapiens
gaauggcugcaccuuuuugca

SEQ ID NO: 651292 - RNA, 14 nt, Homo sapiens
gaaugggagccaga

SEQ ID NO: 651293 - RNA, 17 nt, Homo sapiens
gaaugggagcugcaaac

SEQ ID NO: 651294 - RNA, 14 nt, Homo sapiens
gaaugggcugagaa

SEQ ID NO: 651295 - RNA, 15 nt, Homo sapiens
gaaugguccaggguu

SEQ ID NO: 651296 - RNA, 13 nt, Homo sapiens
gaauggucuuucu

SEQ ID NO: 651297 - RNA, 22 nt, Homo sapiens
gaaugguggaguguagccucca

SEQ ID NO: 651298 - RNA, 15 nt, Homo sapiens
gaauguaauuggaau

SEQ ID NO: 651299 - RNA, 17 nt, Homo sapiens
gaauguagcagaucccc

SEQ ID NO: 651300 - RNA, 16 nt, Homo sapiens
gaaugucacuggugga

SEQ ID NO: 651301 - RNA, 15 nt, Homo sapiens
gaaugucagggccag

SEQ ID NO: 651302 - RNA, 14 nt, Homo sapiens
gaaugucaguucau

SEQ ID NO: 651303 - RNA, 18 nt, Homo sapiens
gaauguggauucuuccca

SEQ ID NO: 651304 - RNA, 23 nt, Homo sapiens
gaauguguggccugcacagugaa

SEQ ID NO: 651305 - RNA, 19 nt, Homo sapiens
gaaugugugggguauagaa

SEQ ID NO: 651306 - RNA, 16 nt, Homo sapiens
gaauguuaagacuuga

SEQ ID NO: 651307 - RNA, 23 nt, Homo sapiens
gaauguucccugcacccuggaaa

SEQ ID NO: 651308 - RNA, 19 nt, Homo sapiens
gaauguuuacuacauuucc

SEQ ID NO: 651309 - RNA, 18 nt, Homo sapiens
gaauguuugucucauccc

SEQ ID NO: 651310 - RNA, 18 nt, Homo sapiens
gaauguuuguuucagugc

SEQ ID NO: 651311 - RNA, 15 nt, Homo sapiens
gaauuaaauaaugua

SEQ ID NO: 651312 - RNA, 19 nt, Homo sapiens
gaauuaaaucaucccuuaa

SEQ ID NO: 651313 - RNA, 22 nt, Homo sapiens
gaauuaccauuaauuacauaca

SEQ ID NO: 651314 - RNA, 15 nt, Homo sapiens
gaauuagaagccauc

SEQ ID NO: 651315 - RNA, 15 nt, Homo sapiens
gaauuauaaaggcca

SEQ ID NO: 651316 - RNA, 20 nt, Homo sapiens
gaauuaucaugggaaaagac

SEQ ID NO: 651317 - RNA, 13 nt, Homo sapiens
gaauuaugcuucc

SEQ ID NO: 651318 - RNA, 14 nt, Homo sapiens
gaauuaugggagaa

SEQ ID NO: 651319 - RNA, 15 nt, Homo sapiens
gaauuauucagugaa

SEQ ID NO: 651320 - RNA, 13 nt, Homo sapiens
gaauucaaacugg

SEQ ID NO: 651321 - RNA, 15 nt, Homo sapiens
gaauucacagauauu

SEQ ID NO: 651322 - RNA, 17 nt, Homo sapiens
gaauucaccaguguucc

SEQ ID NO: 651323 - RNA, 19 nt, Homo sapiens
gaauuccaaagcaaaacca

SEQ ID NO: 651324 - RNA, 14 nt, Homo sapiens
gaauuccagcaaaa

SEQ ID NO: 651325 - RNA, 20 nt, Homo sapiens
gaauuccuaaaauuauggaa

SEQ ID NO: 651326 - RNA, 18 nt, Homo sapiens
gaauuccugcuaugacag

SEQ ID NO: 651327 - RNA, 16 nt, Homo sapiens
gaauuccugggcucaa

SEQ ID NO: 651328 - RNA, 15 nt, Homo sapiens
gcauagugcugggau

SEQ ID NO: 651329 - RNA, 18 nt, Homo sapiens
gcauaucaaaaaguauua

SEQ ID NO: 651330 - RNA, 12 nt, Homo sapiens
gcauaugcaaua

SEQ ID NO: 651331 - RNA, 21 nt, Homo sapiens
gcauaugcagccaaccaagau

SEQ ID NO: 651332 - RNA, 12 nt, Homo sapiens
gcauauggugcu

SEQ ID NO: 651333 - RNA, 19 nt, Homo sapiens
gcauauuaagcacuuuaag

SEQ ID NO: 651334 - RNA, 18 nt, Homo sapiens
gcauauuaguugaugaaa

SEQ ID NO: 651335 - RNA, 18 nt, Homo sapiens
gcauauuuuaaugcaguu

SEQ ID NO: 651336 - RNA, 14 nt, Homo sapiens
gcaucaauuuucaa

SEQ ID NO: 651337 - RNA, 21 nt, Homo sapiens
gcaucaauuuucaaacaaccg

SEQ ID NO: 651338 - RNA, 16 nt, Homo sapiens
gcaucacacaucacuc

SEQ ID NO: 651339 - RNA, 14 nt, Homo sapiens
gcaucaccuacccc

SEQ ID NO: 651340 - RNA, 12 nt, Homo sapiens
gcaucacugggg

SEQ ID NO: 651341 - RNA, 12 nt, Homo sapiens
gcaucacuuaac

SEQ ID NO: 651342 - RNA, 19 nt, Homo sapiens
gcaucaucaaaaacuuugg

SEQ ID NO: 651343 - RNA, 13 nt, Homo sapiens
gcaucaucuaugg

SEQ ID NO: 651344 - RNA, 15 nt, Homo sapiens
gcaucauuaguacau

SEQ ID NO: 651345 - RNA, 14 nt, Homo sapiens
gcauccacuggaaa

SEQ ID NO: 651346 - RNA, 21 nt, Homo sapiens
gcauccacuggaaaaggugaa

SEQ ID NO: 651347 - RNA, 20 nt, Homo sapiens
gcauccagagauucauuuuc

SEQ ID NO: 651348 - RNA, 19 nt, Homo sapiens
gcaucccaucucucccacu

SEQ ID NO: 651349 - RNA, 22 nt, Homo sapiens
gcaucccugaaacaucucaaca

SEQ ID NO: 651350 - RNA, 12 nt, Homo sapiens
gcauccugugac

SEQ ID NO: 651351 - RNA, 20 nt, Homo sapiens
gcauccuuuaggguucugcc

SEQ ID NO: 651352 - RNA, 14 nt, Homo sapiens
gcauccuuugcacu

SEQ ID NO: 651353 - RNA, 13 nt, Homo sapiens
gcaucggcagcug

SEQ ID NO: 651354 - RNA, 20 nt, Homo sapiens
gcaucuauuuccucugugca

SEQ ID NO: 651355 - RNA, 23 nt, Homo sapiens
gcaucuauuuccucugugcaaag

SEQ ID NO: 651356 - RNA, 14 nt, Homo sapiens
gcaucucacuuuau

SEQ ID NO: 651357 - RNA, 16 nt, Homo sapiens
gcaucucccagcaaga

SEQ ID NO: 651358 - RNA, 12 nt, Homo sapiens
gcaucugacaca

SEQ ID NO: 651359 - RNA, 10 nt, Homo sapiens
gcaucugacc

SEQ ID NO: 651360 - RNA, 17 nt, Homo sapiens
gcaucugagugggccca

SEQ ID NO: 651361 - RNA, 23 nt, Homo sapiens
gcaucuggaaauuuuuacuuuaa

SEQ ID NO: 651362 - RNA, 19 nt, Homo sapiens
gcaucuguaacagcauuaa

SEQ ID NO: 651363 - RNA, 15 nt, Homo sapiens
gcaucugugccagag

SEQ ID NO: 651364 - RNA, 21 nt, Homo sapiens
gcaucuucccaaaaccauuga

SEQ ID NO: 651365 - RNA, 13 nt, Homo sapiens
gcaucuugccagc

SEQ ID NO: 651366 - RNA, 18 nt, Homo sapiens
gcaugaaaaacauuccac

SEQ ID NO: 651367 - RNA, 16 nt, Homo sapiens
gcaugaaggaugccaa

SEQ ID NO: 651368 - RNA, 18 nt, Homo sapiens
gcaugaaguaauaugcac

SEQ ID NO: 651369 - RNA, 15 nt, Homo sapiens
gcaugaauagauucu

SEQ ID NO: 651370 - RNA, 17 nt, Homo sapiens
gcaugaauccaguccag

SEQ ID NO: 651371 - RNA, 15 nt, Homo sapiens
gcaugacaaaccuua

SEQ ID NO: 651372 - RNA, 22 nt, Homo sapiens
gcaugagacuuucugcugggau

SEQ ID NO: 651373 - RNA, 13 nt, Homo sapiens
gcaugauagacac

SEQ ID NO: 651374 - RNA, 22 nt, Homo sapiens
gcaugaucuuucugcaggaaau

SEQ ID NO: 651375 - RNA, 18 nt, Homo sapiens
gcaugcaauaaugugcaa

SEQ ID NO: 651376 - RNA, 17 nt, Homo sapiens
gcaugcagugcccucac

SEQ ID NO: 651377 - RNA, 14 nt, Homo sapiens
gcaugccacccuca

SEQ ID NO: 651378 - RNA, 14 nt, Homo sapiens
gcaugccuauguac

SEQ ID NO: 651379 - RNA, 16 nt, Homo sapiens
gcauggaaggggcuuc

SEQ ID NO: 651380 - RNA, 14 nt, Homo sapiens
gcauggacauuuag

SEQ ID NO: 651381 - RNA, 20 nt, Homo sapiens
gcaugggauggggaugaagu

SEQ ID NO: 651382 - RNA, 13 nt, Homo sapiens
gcaugggcacucc

SEQ ID NO: 651383 - RNA, 22 nt, Homo sapiens
gcaugggcgcaggcccagugac

SEQ ID NO: 651384 - RNA, 18 nt, Homo sapiens
gcauguaagccaagucau

SEQ ID NO: 651385 - RNA, 21 nt, Homo sapiens
gcaugucacuucccugcuuaa

SEQ ID NO: 651386 - RNA, 23 nt, Homo sapiens
gcgagcugcucugcuauaugccu

SEQ ID NO: 651387 - RNA, 14 nt, Homo sapiens
gcgaggacaucaaa

SEQ ID NO: 651388 - RNA, 17 nt, Homo sapiens
gcgagucuuacuuugag

SEQ ID NO: 651389 - RNA, 11 nt, Homo sapiens
gcgaguucucu

SEQ ID NO: 651390 - RNA, 22 nt, Homo sapiens
gcgauccaccugucucagccuc

SEQ ID NO: 651391 - RNA, 21 nt, Homo sapiens
gcgauggcaggccugacccac

SEQ ID NO: 651392 - RNA, 19 nt, Homo sapiens
gcgauucccuguguagcuc

SEQ ID NO: 651393 - RNA, 17 nt, Homo sapiens
gcgauucuccccauggg

SEQ ID NO: 651394 - RNA, 17 nt, Homo sapiens
gcgcaaaggugccucau

SEQ ID NO: 651395 - RNA, 22 nt, Homo sapiens
gcgcaagccuguaaucccagcu

SEQ ID NO: 651396 - RNA, 19 nt, Homo sapiens
gcgcacagagggaagccau

SEQ ID NO: 651397 - RNA, 21 nt, Homo sapiens
gcgcaccaaaacuauccugau

SEQ ID NO: 651398 - RNA, 22 nt, Homo sapiens
gcgcagcgcgugcggugcaaag

SEQ ID NO: 651399 - RNA, 16 nt, Homo sapiens
gcgcaggcccagugac

SEQ ID NO: 651400 - RNA, 17 nt, Homo sapiens
gcgcagggcuggcacgu

SEQ ID NO: 651401 - RNA, 15 nt, Homo sapiens
gcgcauggugcagug

SEQ ID NO: 651402 - RNA, 19 nt, Homo sapiens
gcgccagaacccagauuuc

SEQ ID NO: 651403 - RNA, 17 nt, Homo sapiens
gcgccagcgaccucucu

SEQ ID NO: 651404 - RNA, 13 nt, Homo sapiens
gcgccagcucuac

SEQ ID NO: 651405 - RNA, 20 nt, Homo sapiens
gcgccaggcugaccacagca

SEQ ID NO: 651406 - RNA, 20 nt, Homo sapiens
gcgcccagggaggagucagu

SEQ ID NO: 651407 - RNA, 19 nt, Homo sapiens
gcgcccaguccuuccaccu

SEQ ID NO: 651408 - RNA, 23 nt, Homo sapiens
gcgccccugccaccucccugacc

SEQ ID NO: 651409 - RNA, 16 nt, Homo sapiens
gcgcccgccgucugcu

SEQ ID NO: 651410 - RNA, 16 nt, Homo sapiens
gcgcccgggauccagc

SEQ ID NO: 651411 - RNA, 14 nt, Homo sapiens
gcgcccucucugcu

SEQ ID NO: 651412 - RNA, 21 nt, Homo sapiens
gcgcccuuaacugcauccagc

SEQ ID NO: 651413 - RNA, 21 nt, Homo sapiens
gcgcccuuggcuucugugaug

SEQ ID NO: 651414 - RNA, 15 nt, Homo sapiens
gcgcguccagcugcc

SEQ ID NO: 651415 - RNA, 20 nt, Homo sapiens
gcgcgugaguggucuucaaa

SEQ ID NO: 651416 - RNA, 22 nt, Homo sapiens
gcgcgugcuggugggcauguga

SEQ ID NO: 651417 - RNA, 22 nt, Homo sapiens
gcgcguuugugcauaucugccu

SEQ ID NO: 651418 - RNA, 14 nt, Homo sapiens
gcgcucagggccau

SEQ ID NO: 651419 - RNA, 22 nt, Homo sapiens
gcgcucucagcuuucccugcca

SEQ ID NO: 651420 - RNA, 16 nt, Homo sapiens
gcgcucuggacagaug

SEQ ID NO: 651421 - RNA, 10 nt, Homo sapiens
gcgcugcuaa

SEQ ID NO: 651422 - RNA, 14 nt, Homo sapiens
gcgcuucuggucug

SEQ ID NO: 651423 - RNA, 12 nt, Homo sapiens
gcggaagccaua

SEQ ID NO: 651424 - RNA, 21 nt, Homo sapiens
gcggaaggagggagcucugau

SEQ ID NO: 651425 - RNA, 13 nt, Homo sapiens
gcggaagugacca

SEQ ID NO: 651426 - RNA, 14 nt, Homo sapiens
gcggacaucagcug

SEQ ID NO: 651427 - RNA, 22 nt, Homo sapiens
gcggaccccucgucaucaggug

SEQ ID NO: 651428 - RNA, 15 nt, Homo sapiens
gcggagaguacagug

SEQ ID NO: 651429 - RNA, 13 nt, Homo sapiens
gcggaucaucuaa

SEQ ID NO: 651430 - RNA, 19 nt, Homo sapiens
gcggcaggaagggggccga

SEQ ID NO: 651431 - RNA, 15 nt, Homo sapiens
gcggccagggcggcc

SEQ ID NO: 651432 - RNA, 18 nt, Homo sapiens
gcggccauaagaggugau

SEQ ID NO: 651433 - RNA, 15 nt, Homo sapiens
gcggcccagacccag

SEQ ID NO: 651434 - RNA, 21 nt, Homo sapiens
gcggccucgugccaugaucug

SEQ ID NO: 651435 - RNA, 20 nt, Homo sapiens
gcggcucaaaaggaaaccaa

SEQ ID NO: 651436 - RNA, 16 nt, Homo sapiens
gcggcuuucacugcug

SEQ ID NO: 651437 - RNA, 20 nt, Homo sapiens
gcgggaaaauaaaccacugg

SEQ ID NO: 651438 - RNA, 16 nt, Homo sapiens
gcgggaggcaccagcu

SEQ ID NO: 651439 - RNA, 16 nt, Homo sapiens
gcgggcauggcgugga

SEQ ID NO: 651440 - RNA, 18 nt, Homo sapiens
gcgggccuaacauguugu

SEQ ID NO: 651441 - RNA, 15 nt, Homo sapiens
gcgggcgcgugagug

SEQ ID NO: 651442 - RNA, 12 nt, Homo sapiens
gcggucuugggc

SEQ ID NO: 651443 - RNA, 12 nt, Homo sapiens
gcgguggcucac

SEQ ID NO: 651444 - RNA, 23 nt, Homo sapiens
gcgguuccucaucugagaggcuc

SEQ ID NO: 651445 - RNA, 12 nt, Homo sapiens
gcguacacagag

SEQ ID NO: 651446 - RNA, 13 nt, Homo sapiens
gcguauauacuua

SEQ ID NO: 651447 - RNA, 12 nt, Homo sapiens
gcgucaguuuuu

SEQ ID NO: 651448 - RNA, 12 nt, Homo sapiens
gcguccugguca

SEQ ID NO: 651449 - RNA, 21 nt, Homo sapiens
gcgucucccccagagugcugu

SEQ ID NO: 651450 - RNA, 22 nt, Homo sapiens
gcuccugauggugucauucugc

SEQ ID NO: 651451 - RNA, 18 nt, Homo sapiens
gcuccugcccagccaccc

SEQ ID NO: 651452 - RNA, 15 nt, Homo sapiens
gcuccuggggcaaug

SEQ ID NO: 651453 - RNA, 16 nt, Homo sapiens
gcuccuggguuucaug

SEQ ID NO: 651454 - RNA, 14 nt, Homo sapiens
gcuccuguucacac

SEQ ID NO: 651455 - RNA, 21 nt, Homo sapiens
gcuccuucacugaacaugccu

SEQ ID NO: 651456 - RNA, 15 nt, Homo sapiens
gcuccuuccagaccu

SEQ ID NO: 651457 - RNA, 15 nt, Homo sapiens
gcuccuugcccucaa

SEQ ID NO: 651458 - RNA, 17 nt, Homo sapiens
gcuccuuggcuuaccug

SEQ ID NO: 651459 - RNA, 19 nt, Homo sapiens
gcucgagucacauucugcu

SEQ ID NO: 651460 - RNA, 13 nt, Homo sapiens
gcucgagugaauu

SEQ ID NO: 651461 - RNA, 15 nt, Homo sapiens
gcucgcucaggugau

SEQ ID NO: 651462 - RNA, 21 nt, Homo sapiens
gcucgcugccaucaccgcugg

SEQ ID NO: 651463 - RNA, 16 nt, Homo sapiens
gcucguggacugugcu

SEQ ID NO: 651464 - RNA, 20 nt, Homo sapiens
gcucgugggauguccuacua

SEQ ID NO: 651465 - RNA, 16 nt, Homo sapiens
gcucuagaaaguauag

SEQ ID NO: 651466 - RNA, 21 nt, Homo sapiens
gcucuagccugggcaacaaca

SEQ ID NO: 651467 - RNA, 12 nt, Homo sapiens
gcucuagucacu

SEQ ID NO: 651468 - RNA, 13 nt, Homo sapiens
gcucuagucacug

SEQ ID NO: 651469 - RNA, 23 nt, Homo sapiens
gcucuauaagagcuggaugcaca

SEQ ID NO: 651470 - RNA, 12 nt, Homo sapiens
gcucucagcuca

SEQ ID NO: 651471 - RNA, 14 nt, Homo sapiens
gcucucauguuccu

SEQ ID NO: 651472 - RNA, 23 nt, Homo sapiens
gcucuccccaaacuugcuuuaug

SEQ ID NO: 651473 - RNA, 21 nt, Homo sapiens
gcucuccccucagagugcaag

SEQ ID NO: 651474 - RNA, 13 nt, Homo sapiens
gcucucuguggug

SEQ ID NO: 651475 - RNA, 21 nt, Homo sapiens
gcucucuugugacgugcacug

SEQ ID NO: 651476 - RNA, 16 nt, Homo sapiens
gcucugaccugagcua

SEQ ID NO: 651477 - RNA, 19 nt, Homo sapiens
gcucugagaaaccucggga

SEQ ID NO: 651478 - RNA, 17 nt, Homo sapiens
gcucugagaaaguacaa

SEQ ID NO: 651479 - RNA, 20 nt, Homo sapiens
gcucugagacccuuuucuca

SEQ ID NO: 651480 - RNA, 19 nt, Homo sapiens
gcucugagccacaguggga

SEQ ID NO: 651481 - RNA, 23 nt, Homo sapiens
gcucugaggauguauaccccugg

SEQ ID NO: 651482 - RNA, 22 nt, Homo sapiens
gcucugaggggaggcaccucca

SEQ ID NO: 651483 - RNA, 13 nt, Homo sapiens
gcucugauuucag

SEQ ID NO: 651484 - RNA, 20 nt, Homo sapiens
gcucugccccgcagacgguc

SEQ ID NO: 651485 - RNA, 23 nt, Homo sapiens
gcucugccccucagggggccagc

SEQ ID NO: 651486 - RNA, 16 nt, Homo sapiens
gcucugccuguggagu

SEQ ID NO: 651487 - RNA, 19 nt, Homo sapiens
gcucugccuuacccuggua

SEQ ID NO: 651488 - RNA, 18 nt, Homo sapiens
gcucugcgucgguccugg

SEQ ID NO: 651489 - RNA, 17 nt, Homo sapiens
gcucugcuggucuucaa

SEQ ID NO: 651490 - RNA, 12 nt, Homo sapiens
gcucuggaagac

SEQ ID NO: 651491 - RNA, 15 nt, Homo sapiens
gcucuggagugugca

SEQ ID NO: 651492 - RNA, 14 nt, Homo sapiens
gcucuggccacaac

SEQ ID NO: 651493 - RNA, 10 nt, Homo sapiens
gcucugggaa

SEQ ID NO: 651494 - RNA, 19 nt, Homo sapiens
gcucugggagacuuugaag

SEQ ID NO: 651495 - RNA, 17 nt, Homo sapiens
gcucugggauagcugac

SEQ ID NO: 651496 - RNA, 16 nt, Homo sapiens
gcucugguuagaaaaa

SEQ ID NO: 651497 - RNA, 20 nt, Homo sapiens
gcucuguaggucauuggcca

SEQ ID NO: 651498 - RNA, 22 nt, Homo sapiens
gcucugucuacccagugcucca

SEQ ID NO: 651499 - RNA, 20 nt, Homo sapiens
gcucugugcagucacuggag

SEQ ID NO: 651500 - RNA, 14 nt, Homo sapiens
gcucuguuacccag

SEQ ID NO: 651501 - RNA, 14 nt, Homo sapiens
gcucuuaaauguag

SEQ ID NO: 651502 - RNA, 18 nt, Homo sapiens
gcucuuaaugauuuacag

SEQ ID NO: 651503 - RNA, 19 nt, Homo sapiens
gcucuuaggugcuucuuca

SEQ ID NO: 651504 - RNA, 20 nt, Homo sapiens
gcucuuaugugugccuuugu

SEQ ID NO: 651505 - RNA, 11 nt, Homo sapiens
gcucuucacau

SEQ ID NO: 651506 - RNA, 13 nt, Homo sapiens
gcucuucacugaa

SEQ ID NO: 651507 - RNA, 14 nt, Homo sapiens
gcucuucaucugcc

SEQ ID NO: 651508 - RNA, 19 nt, Homo sapiens
gcucuuccaggagccaccu

SEQ ID NO: 651509 - RNA, 18 nt, Homo sapiens
gcucuucuaccauuugaa

SEQ ID NO: 651510 - RNA, 19 nt, Homo sapiens
gcucuucuaccauuugaau

SEQ ID NO: 651511 - RNA, 21 nt, Homo sapiens
gcucuucuguggaccacugca

SEQ ID NO: 651512 - RNA, 18 nt, Homo sapiens
gcucuugaggcauuucca

SEQ ID NO: 651513 - RNA, 16 nt, Homo sapiens
gcucuuggaagagcuc

SEQ ID NO: 651514 - RNA, 16 nt, Homo sapiens
gcucuuggacaacagc

SEQ ID NO: 651515 - RNA, 19 nt, Homo sapiens
gcucuugggaagaccagcu

SEQ ID NO: 651516 - RNA, 17 nt, Homo sapiens
gcuguauuuaauggcau

SEQ ID NO: 651517 - RNA, 22 nt, Homo sapiens
gcugucaacuucccaucuggcu

SEQ ID NO: 651518 - RNA, 21 nt, Homo sapiens
gcugucaaggccgagggccag

SEQ ID NO: 651519 - RNA, 13 nt, Homo sapiens
gcugucacuuuuu

SEQ ID NO: 651520 - RNA, 16 nt, Homo sapiens
gcugucaucugugcac

SEQ ID NO: 651521 - RNA, 18 nt, Homo sapiens
gcugucaucugugcacug

SEQ ID NO: 651522 - RNA, 16 nt, Homo sapiens
gcuguccacaugaccu

SEQ ID NO: 651523 - RNA, 19 nt, Homo sapiens
gcuguccacaugaccucca

SEQ ID NO: 651524 - RNA, 21 nt, Homo sapiens
gcuguccccacagcuucucua

SEQ ID NO: 651525 - RNA, 17 nt, Homo sapiens
gcugucccgugcauggg

SEQ ID NO: 651526 - RNA, 19 nt, Homo sapiens
gcugucuccaugcuggaua

SEQ ID NO: 651527 - RNA, 21 nt, Homo sapiens
gcugucuccaugcuggauacu

SEQ ID NO: 651528 - RNA, 12 nt, Homo sapiens
gcugucugcuca

SEQ ID NO: 651529 - RNA, 13 nt, Homo sapiens
gcugucugugaau

SEQ ID NO: 651530 - RNA, 12 nt, Homo sapiens
gcugucuuccaa

SEQ ID NO: 651531 - RNA, 18 nt, Homo sapiens
gcugugacuucuccaggu

SEQ ID NO: 651532 - RNA, 19 nt, Homo sapiens
gcugugaucacuccagugc

SEQ ID NO: 651533 - RNA, 20 nt, Homo sapiens
gcugugaucggccuggggaa

SEQ ID NO: 651534 - RNA, 13 nt, Homo sapiens
gcugugaugaugu

SEQ ID NO: 651535 - RNA, 18 nt, Homo sapiens
gcugugauuugcugugua

SEQ ID NO: 651536 - RNA, 14 nt, Homo sapiens
gcugugcacaccug

SEQ ID NO: 651537 - RNA, 16 nt, Homo sapiens
gcugugccccuccccc

SEQ ID NO: 651538 - RNA, 14 nt, Homo sapiens
gcuguggacugucc

SEQ ID NO: 651539 - RNA, 14 nt, Homo sapiens
gcuguggagcaaaa

SEQ ID NO: 651540 - RNA, 15 nt, Homo sapiens
gcuguggccacucca

SEQ ID NO: 651541 - RNA, 15 nt, Homo sapiens
gcuguggccagggug

SEQ ID NO: 651542 - RNA, 15 nt, Homo sapiens
gcugugggccaaaau

SEQ ID NO: 651543 - RNA, 13 nt, Homo sapiens
gcuguggggcccu

SEQ ID NO: 651544 - RNA, 14 nt, Homo sapiens
gcuguuaacacugc

SEQ ID NO: 651545 - RNA, 15 nt, Homo sapiens
gcuguuccugagaaa

SEQ ID NO: 651546 - RNA, 14 nt, Homo sapiens
gcuguugcucagga

SEQ ID NO: 651547 - RNA, 21 nt, Homo sapiens
gcuguuggacagcugcuugug

SEQ ID NO: 651548 - RNA, 13 nt, Homo sapiens
gcuguugugaagc

SEQ ID NO: 651549 - RNA, 14 nt, Homo sapiens
gcuguuuacugcuu

SEQ ID NO: 651550 - RNA, 17 nt, Homo sapiens
gcuguuuaguaguugaa

SEQ ID NO: 651551 - RNA, 21 nt, Homo sapiens
gcuguuuauuuauucacugua

SEQ ID NO: 651552 - RNA, 20 nt, Homo sapiens
gcuguuuccauagggugaca

SEQ ID NO: 651553 - RNA, 14 nt, Homo sapiens
gcuguuuuauaugu

SEQ ID NO: 651554 - RNA, 19 nt, Homo sapiens
gcuguuuuuauauauguga

SEQ ID NO: 651555 - RNA, 20 nt, Homo sapiens
gcuuaaacccuuuagugcuu

SEQ ID NO: 651556 - RNA, 21 nt, Homo sapiens
gcuuaaacccuuuagugcuuu

SEQ ID NO: 651557 - RNA, 13 nt, Homo sapiens
gcuuaaacuaaug

SEQ ID NO: 651558 - RNA, 16 nt, Homo sapiens
gcuuaaaggcaguauu

SEQ ID NO: 651559 - RNA, 18 nt, Homo sapiens
gcuuaaaguuauguuauu

SEQ ID NO: 651560 - RNA, 23 nt, Homo sapiens
gcuuaagaaagaacauuuugccu

SEQ ID NO: 651561 - RNA, 15 nt, Homo sapiens
gcuuaagugacaaag

SEQ ID NO: 651562 - RNA, 19 nt, Homo sapiens
gcuuaauaaacaugucaca

SEQ ID NO: 651563 - RNA, 12 nt, Homo sapiens
gcuuacaggaag

SEQ ID NO: 651564 - RNA, 15 nt, Homo sapiens
gcuuaccaucucuac

SEQ ID NO: 651565 - RNA, 22 nt, Homo sapiens
gcuuacccaagcuguggcagcc

SEQ ID NO: 651566 - RNA, 13 nt, Homo sapiens
gcuuaccccuuca

SEQ ID NO: 651567 - RNA, 23 nt, Homo sapiens
gcuuagaaaauucaagcauuuag

SEQ ID NO: 651568 - RNA, 17 nt, Homo sapiens
gcuuagaaaguuccaaa

SEQ ID NO: 651569 - RNA, 19 nt, Homo sapiens
gcuuagaaaguuccaaaug

SEQ ID NO: 651570 - RNA, 20 nt, Homo sapiens
gcuuagaaauucagcauuug

SEQ ID NO: 651571 - RNA, 20 nt, Homo sapiens
gcuuagacuucgacucagga

SEQ ID NO: 651572 - RNA, 15 nt, Homo sapiens
gcuuagcauaucuga

SEQ ID NO: 651573 - RNA, 12 nt, Homo sapiens
gcuuagcauucc

SEQ ID NO: 651574 - RNA, 14 nt, Homo sapiens
gcuuagccugccuc

SEQ ID NO: 651575 - RNA, 14 nt, Homo sapiens
gcuuaggauguuuu

SEQ ID NO: 651576 - RNA, 15 nt, Homo sapiens
gcuuaguaacuagug

SEQ ID NO: 651577 - RNA, 16 nt, Homo sapiens
gcuuaguauuucucag

SEQ ID NO: 651578 - RNA, 19 nt, Homo sapiens
gcuuaguauuucucaggaa

SEQ ID NO: 651579 - RNA, 22 nt, Homo sapiens
gcuuaguccaauuccuugcaca

SEQ ID NO: 651580 - RNA, 14 nt, Homo sapiens
gcuuaguucuugaa

SEQ ID NO: 651581 - RNA, 18 nt, Homo sapiens
gcuuauaucuggccucug

SEQ ID NO: 651582 - RNA, 18 nt, Homo sapiens
gcuuaucuuagaagcacu

SEQ ID NO: 651583 - RNA, 15 nt, Homo sapiens
gcuuauggauucaua

SEQ ID NO: 651584 - RNA, 15 nt, Homo sapiens
gcuuauucuugagca

SEQ ID NO: 651585 - RNA, 21 nt, Homo sapiens
gcuucaaauaaaguccugaca

SEQ ID NO: 651586 - RNA, 23 nt, Homo sapiens
gcuucaaauaaaguccugacacu

SEQ ID NO: 651587 - RNA, 14 nt, Homo sapiens
gcuucaacaacuuu

SEQ ID NO: 651588 - RNA, 14 nt, Homo sapiens
gcuucaaguggcag

SEQ ID NO: 651589 - RNA, 19 nt, Homo sapiens
gcuucaaguguugcucuug

SEQ ID NO: 651590 - RNA, 13 nt, Homo sapiens
gcuucacaguacc

SEQ ID NO: 651591 - RNA, 13 nt, Homo sapiens
gcuucacauuugu

SEQ ID NO: 651592 - RNA, 12 nt, Homo sapiens
gcuucaccaguc

SEQ ID NO: 651593 - RNA, 16 nt, Homo sapiens
gcuucaccccaauccc

SEQ ID NO: 651594 - RNA, 12 nt, Homo sapiens
gcuucagaguuu

SEQ ID NO: 651595 - RNA, 21 nt, Homo sapiens
gcuucagcccccaccagggga

SEQ ID NO: 651596 - RNA, 12 nt, Homo sapiens
gcuucaguccac

SEQ ID NO: 651597 - RNA, 20 nt, Homo sapiens
gcuucauauaccagcaauau

SEQ ID NO: 651598 - RNA, 17 nt, Homo sapiens
gcuucauuccaaucuau

SEQ ID NO: 651599 - RNA, 23 nt, Homo sapiens
gcuuccacgccaguugccucuug

SEQ ID NO: 651600 - RNA, 15 nt, Homo sapiens
gcuuccacuguguuc

SEQ ID NO: 651601 - RNA, 14 nt, Homo sapiens
gcuuccagcaguau

SEQ ID NO: 651602 - RNA, 11 nt, Homo sapiens
gcuuccaugau

SEQ ID NO: 651603 - RNA, 16 nt, Homo sapiens
gcuucccaacuucaua

SEQ ID NO: 651604 - RNA, 15 nt, Homo sapiens
gcuucccacuauuua

SEQ ID NO: 651605 - RNA, 21 nt, Homo sapiens
gcuucccagcaccaacaugua

SEQ ID NO: 651606 - RNA, 17 nt, Homo sapiens
gcuucccccacauuggg

SEQ ID NO: 651607 - RNA, 15 nt, Homo sapiens
gcuucccuaaucuau

SEQ ID NO: 651608 - RNA, 22 nt, Homo sapiens
gcuucccucucagcugcuggga

SEQ ID NO: 651609 - RNA, 10 nt, Homo sapiens
gcuuccucua

SEQ ID NO: 651610 - RNA, 13 nt, Homo sapiens
gcuuccuguuucu

SEQ ID NO: 651611 - RNA, 12 nt, Homo sapiens
gcuucgacuacu

SEQ ID NO: 651612 - RNA, 14 nt, Homo sapiens
gcuucgacuacugc

SEQ ID NO: 651613 - RNA, 21 nt, Homo sapiens
gcuucuagcugacuugcacag

SEQ ID NO: 651614 - RNA, 19 nt, Homo sapiens
gcuucuaguuugcaacuuc

SEQ ID NO: 651615 - RNA, 18 nt, Homo sapiens
gcuucuauaauuuugccu

SEQ ID NO: 651616 - RNA, 21 nt, Homo sapiens
gcuucucagauuucugaggaa

SEQ ID NO: 651617 - RNA, 13 nt, Homo sapiens
gcuucuccugacc

SEQ ID NO: 651618 - RNA, 16 nt, Homo sapiens
gcuucuccugugugau

SEQ ID NO: 651619 - RNA, 22 nt, Homo sapiens
gcuucuccugugugauugacag

SEQ ID NO: 651620 - RNA, 22 nt, Homo sapiens
gcuucuccuucuccuucccauu

SEQ ID NO: 651621 - RNA, 17 nt, Homo sapiens
gcuucucuacagacucc

SEQ ID NO: 651622 - RNA, 12 nt, Homo sapiens
gcuucucuccac

SEQ ID NO: 651623 - RNA, 16 nt, Homo sapiens
gcuucucuccacugaa

SEQ ID NO: 651624 - RNA, 15 nt, Homo sapiens
gcuucucucuucucu

SEQ ID NO: 651625 - RNA, 19 nt, Homo sapiens
gcuucucuugagucacacu

SEQ ID NO: 651626 - RNA, 15 nt, Homo sapiens
gcuucugcacuucau

SEQ ID NO: 651627 - RNA, 21 nt, Homo sapiens
gcuucugcguccaccaggccu

SEQ ID NO: 651628 - RNA, 16 nt, Homo sapiens
gcuucuggagcccuug

SEQ ID NO: 651629 - RNA, 21 nt, Homo sapiens
gcuucuggggguagaucucaa

SEQ ID NO: 651630 - RNA, 19 nt, Homo sapiens
gcuucuguaguacuccuua

SEQ ID NO: 651631 - RNA, 17 nt, Homo sapiens
gcuucuguccaggacau

SEQ ID NO: 651632 - RNA, 15 nt, Homo sapiens
gcuucuucacaggca

SEQ ID NO: 651633 - RNA, 21 nt, Homo sapiens
gcuucuuccuccuccaucacc

SEQ ID NO: 651634 - RNA, 13 nt, Homo sapiens
gcuucuuggagcu

SEQ ID NO: 651635 - RNA, 13 nt, Homo sapiens
gcuucuuuaccaa

SEQ ID NO: 651636 - RNA, 19 nt, Homo sapiens
gcuucuuugccucccucag

SEQ ID NO: 651637 - RNA, 14 nt, Homo sapiens
gcuugaagccaaag

SEQ ID NO: 651638 - RNA, 16 nt, Homo sapiens
gcuugaagccaaagaa

SEQ ID NO: 651639 - RNA, 22 nt, Homo sapiens
gcuugaagcuguggagggccac

SEQ ID NO: 651640 - RNA, 21 nt, Homo sapiens
gcuugagaauccucuccuuuc

SEQ ID NO: 651641 - RNA, 13 nt, Homo sapiens
gcuugagucacca

SEQ ID NO: 651642 - RNA, 14 nt, Homo sapiens
gcuugagucucaag

SEQ ID NO: 651643 - RNA, 22 nt, Homo sapiens
gcuugauauuuuccaaauggau

SEQ ID NO: 651644 - RNA, 22 nt, Homo sapiens
gcuugaucaauucccuugaaua

SEQ ID NO: 651645 - RNA, 21 nt, Homo sapiens
gcuugaucacagcucccuagg

SEQ ID NO: 651646 - RNA, 15 nt, Homo sapiens
gcuugcacacuuccc

SEQ ID NO: 651647 - RNA, 14 nt, Homo sapiens
gcuugcacagccaa

SEQ ID NO: 651648 - RNA, 22 nt, Homo sapiens
gcuugcucagauagaucugugu

SEQ ID NO: 651649 - RNA, 14 nt, Homo sapiens
gcuugcuuuugccu

SEQ ID NO: 651650 - RNA, 11 nt, Homo sapiens
gcuuggaagaa

SEQ ID NO: 651651 - RNA, 17 nt, Homo sapiens
gcuuggaagccagguac

SEQ ID NO: 651652 - RNA, 15 nt, Homo sapiens
gcuuggcaucugugu

SEQ ID NO: 651653 - RNA, 16 nt, Homo sapiens
gcuuggcaugaccuca

SEQ ID NO: 651654 - RNA, 20 nt, Homo sapiens
gcuugggaaacucaacuucu

SEQ ID NO: 651655 - RNA, 17 nt, Homo sapiens
gcuuggggaacccauga

SEQ ID NO: 651656 - RNA, 16 nt, Homo sapiens
gcuuggggcaccauga

SEQ ID NO: 651657 - RNA, 13 nt, Homo sapiens
gcuugucaggggg

SEQ ID NO: 651658 - RNA, 20 nt, Homo sapiens
gcuugucuuaaaauaaugaa

SEQ ID NO: 651659 - RNA, 15 nt, Homo sapiens
gcuuuaaaagucauu

SEQ ID NO: 651660 - RNA, 22 nt, Homo sapiens
gcuuuaaacucagggacagagc

SEQ ID NO: 651661 - RNA, 16 nt, Homo sapiens
gcuuuaaacugcauuu

SEQ ID NO: 651662 - RNA, 17 nt, Homo sapiens
gcuuuaaaugucugcau

SEQ ID NO: 651663 - RNA, 23 nt, Homo sapiens
gcuuuaauaaaggccacaggaga

SEQ ID NO: 651664 - RNA, 21 nt, Homo sapiens
gcuuuaauuuuuuuaaccaaa

SEQ ID NO: 651665 - RNA, 17 nt, Homo sapiens
gcuuuacucaagcagau

SEQ ID NO: 651666 - RNA, 15 nt, Homo sapiens
gcuuuacugcaugaa

SEQ ID NO: 651667 - RNA, 13 nt, Homo sapiens
gcuuuacugccuu

SEQ ID NO: 651668 - RNA, 15 nt, Homo sapiens
gcuuuagagugcaag

SEQ ID NO: 651669 - RNA, 12 nt, Homo sapiens
gcuuuagcuuca

SEQ ID NO: 651670 - RNA, 22 nt, Homo sapiens
gcuuuaucaaaaaguacaauaa

SEQ ID NO: 651671 - RNA, 14 nt, Homo sapiens
gcuuuauugugauu

SEQ ID NO: 651672 - RNA, 14 nt, Homo sapiens
gcuuucacauugua

SEQ ID NO: 651673 - RNA, 17 nt, Homo sapiens
gcuuucagguguuacag

SEQ ID NO: 651674 - RNA, 17 nt, Homo sapiens
gcuuucauaaaucaugu

SEQ ID NO: 651675 - RNA, 15 nt, Homo sapiens
gcuuucauccugugu

SEQ ID NO: 651676 - RNA, 18 nt, Homo sapiens
gcuuuccaauguagcuca

SEQ ID NO: 651677 - RNA, 16 nt, Homo sapiens
gcuuucccugccacau

SEQ ID NO: 651678 - RNA, 20 nt, Homo sapiens
gcuuucguaguuuucauuua

SEQ ID NO: 651679 - RNA, 14 nt, Homo sapiens
gcuuucucccucac

SEQ ID NO: 651680 - RNA, 19 nt, Homo sapiens
gcuuucugaagcuuuacca

SEQ ID NO: 651681 - RNA, 12 nt, Homo sapiens
gcuuucugccac

SEQ ID NO: 651682 - RNA, 14 nt, Homo sapiens
gcuuucuguugcca

SEQ ID NO: 651683 - RNA, 19 nt, Homo sapiens
gcuuugaauaaauguguug

SEQ ID NO: 651684 - RNA, 21 nt, Homo sapiens
gcuuugaggcucugucacuga

SEQ ID NO: 651685 - RNA, 15 nt, Homo sapiens
gcuuugcacaggaaa

SEQ ID NO: 651686 - RNA, 15 nt, Homo sapiens
gcuuugcagugacag

SEQ ID NO: 651687 - RNA, 16 nt, Homo sapiens
gcuuugcauguauuag

SEQ ID NO: 651688 - RNA, 16 nt, Homo sapiens
gcuuugcccaccccuc

SEQ ID NO: 651689 - RNA, 16 nt, Homo sapiens
gcuuugcuacaaauuu

SEQ ID NO: 651690 - RNA, 23 nt, Homo sapiens
gcuuugcugaccaaaugccuggu

SEQ ID NO: 651691 - RNA, 18 nt, Homo sapiens
gcuuugcugccaaugcaa

SEQ ID NO: 651692 - RNA, 13 nt, Homo sapiens
gcuuugcugcuac

SEQ ID NO: 651693 - RNA, 18 nt, Homo sapiens
gcuuugcuucaaauccau

SEQ ID NO: 651694 - RNA, 16 nt, Homo sapiens
gcuuuggaggauuuca

SEQ ID NO: 651695 - RNA, 20 nt, Homo sapiens
gcuuuggcugagaccuggga

SEQ ID NO: 651696 - RNA, 20 nt, Homo sapiens
gcuuugggugccuuugccac

SEQ ID NO: 651697 - RNA, 14 nt, Homo sapiens
gcuuugguuuauau

SEQ ID NO: 651698 - RNA, 21 nt, Homo sapiens
gcuuugucacuuuuccuuuuc

SEQ ID NO: 651699 - RNA, 15 nt, Homo sapiens
gcuuugucuacuuca

SEQ ID NO: 651700 - RNA, 23 nt, Homo sapiens
gcuuugugaaaacuacugauguu

SEQ ID NO: 651701 - RNA, 17 nt, Homo sapiens
gcuuuguguuuacuuuu

SEQ ID NO: 651702 - RNA, 23 nt, Homo sapiens
gcuuuguuaucuuccacuggaaa

SEQ ID NO: 651703 - RNA, 14 nt, Homo sapiens
gcuuuguugcccag

SEQ ID NO: 651704 - RNA, 19 nt, Homo sapiens
gcuuuguuuugucuuacaa

SEQ ID NO: 651705 - RNA, 22 nt, Homo sapiens
gcuuuguuuuuugugcuauuag

SEQ ID NO: 651706 - RNA, 15 nt, Homo sapiens
gcuuuuacuaucugu

SEQ ID NO: 651707 - RNA, 14 nt, Homo sapiens
gcuuuucacaucca

SEQ ID NO: 651708 - RNA, 14 nt, Homo sapiens
gcuuuucacuguga

SEQ ID NO: 651709 - RNA, 17 nt, Homo sapiens
gcuuuucauagugcuca

SEQ ID NO: 651710 - RNA, 14 nt, Homo sapiens
gcuuuucuggaauu

SEQ ID NO: 651711 - RNA, 21 nt, Homo sapiens
gcuuuucuuuucuaaccaaga

SEQ ID NO: 651712 - RNA, 23 nt, Homo sapiens
gcuuuugaaauccagaaguuuua

SEQ ID NO: 651713 - RNA, 18 nt, Homo sapiens
gcuuuugagaaccaagua

SEQ ID NO: 651714 - RNA, 19 nt, Homo sapiens
gcuuuugcauuaaucuaag

SEQ ID NO: 651715 - RNA, 13 nt, Homo sapiens
gcuuuugcauuuc

SEQ ID NO: 651716 - RNA, 11 nt, Homo sapiens
gcuuuugccau

SEQ ID NO: 651717 - RNA, 13 nt, Homo sapiens
gcuuuugccauua

SEQ ID NO: 651718 - RNA, 18 nt, Homo sapiens
gcuuuugccucugcccaa

SEQ ID NO: 651719 - RNA, 17 nt, Homo sapiens
gcuuuugcuugcaaugu

SEQ ID NO: 651720 - RNA, 19 nt, Homo sapiens
gcuuuuggucucccuggga

SEQ ID NO: 651721 - RNA, 14 nt, Homo sapiens
gcuuuuguuuucau

SEQ ID NO: 651722 - RNA, 15 nt, Homo sapiens
gcuuuuuguucagaa

SEQ ID NO: 651723 - RNA, 23 nt, Homo sapiens
gcuuuuuuuuuuuuuaacugacg

SEQ ID NO: 651724 - RNA, 15 nt, Homo sapiens
ggaaaaaaagcaaaa

SEQ ID NO: 651725 - RNA, 22 nt, Homo sapiens
ggaaaaaauaaaagaucuugaa

SEQ ID NO: 651726 - RNA, 22 nt, Homo sapiens
ggaaaaagaaugaugcuaugaa

SEQ ID NO: 651727 - RNA, 21 nt, Homo sapiens
ggaaaaaucuuggauuaugaa

SEQ ID NO: 651728 - RNA, 14 nt, Homo sapiens
ggaaaacagcuauu

SEQ ID NO: 651729 - RNA, 13 nt, Homo sapiens
ggaaaacuacuuu

SEQ ID NO: 651730 - RNA, 14 nt, Homo sapiens
ggaaaacucaggau

SEQ ID NO: 651731 - RNA, 17 nt, Homo sapiens
ggaaaagaaacacgcac

SEQ ID NO: 651732 - RNA, 21 nt, Homo sapiens
ggaaaaggaaaaaaagcaaaa

SEQ ID NO: 651733 - RNA, 17 nt, Homo sapiens
ggaaaaggggcuccuug

SEQ ID NO: 651734 - RNA, 19 nt, Homo sapiens
ggaaaagggucuugggaaa

SEQ ID NO: 651735 - RNA, 14 nt, Homo sapiens
ggaaaaguucuccu

SEQ ID NO: 651736 - RNA, 19 nt, Homo sapiens
ggaaaauaguuugcaacau

SEQ ID NO: 651737 - RNA, 20 nt, Homo sapiens
ggaaaauauaauauuuacug

SEQ ID NO: 651738 - RNA, 12 nt, Homo sapiens
ggaaaaugagua

SEQ ID NO: 651739 - RNA, 12 nt, Homo sapiens
ggaaaauggagc

SEQ ID NO: 651740 - RNA, 11 nt, Homo sapiens
ggaaaauggau

SEQ ID NO: 651741 - RNA, 15 nt, Homo sapiens
ggaaaaugucuuaaa

SEQ ID NO: 651742 - RNA, 12 nt, Homo sapiens
ggaaaaugugac

SEQ ID NO: 651743 - RNA, 20 nt, Homo sapiens
ggaaaaugugcacacauaua

SEQ ID NO: 651744 - RNA, 17 nt, Homo sapiens
ggaaaauuucacauuaa

SEQ ID NO: 651745 - RNA, 22 nt, Homo sapiens
ggaaaauuuuaaaaauacagau

SEQ ID NO: 651746 - RNA, 15 nt, Homo sapiens
ggaaacaaaugugua

SEQ ID NO: 651747 - RNA, 14 nt, Homo sapiens
ggaaacacagcuga

SEQ ID NO: 651748 - RNA, 20 nt, Homo sapiens
ggaaacauuucugacaccgu

SEQ ID NO: 651749 - RNA, 14 nt, Homo sapiens
ggaaaccaguguag

SEQ ID NO: 651750 - RNA, 21 nt, Homo sapiens
ggaaacguuuuguauaguuau

SEQ ID NO: 651751 - RNA, 16 nt, Homo sapiens
ggaaacuauucaugaa

SEQ ID NO: 651752 - RNA, 17 nt, Homo sapiens
ggaaacucacacucccc

SEQ ID NO: 651753 - RNA, 20 nt, Homo sapiens
ggaaacucggcagcccuucc

SEQ ID NO: 651754 - RNA, 14 nt, Homo sapiens
ggaaacugcuaaau

SEQ ID NO: 651755 - RNA, 21 nt, Homo sapiens
ggaaacugcucccaucauucc

SEQ ID NO: 651756 - RNA, 16 nt, Homo sapiens
ggaaacuucaguugau

SEQ ID NO: 651757 - RNA, 22 nt, Homo sapiens
ggaaagacguuuuugugcugug

SEQ ID NO: 651758 - RNA, 16 nt, Homo sapiens
ggaaagaugaucagcu

SEQ ID NO: 651759 - RNA, 22 nt, Homo sapiens
ggaaagcaucaccucaggccag

SEQ ID NO: 651760 - RNA, 21 nt, Homo sapiens
ggaaagggagacgcccuuuca

SEQ ID NO: 651761 - RNA, 14 nt, Homo sapiens
ggaaaggggugcuu

SEQ ID NO: 651762 - RNA, 16 nt, Homo sapiens
ggaaagucacccaaac

SEQ ID NO: 651763 - RNA, 17 nt, Homo sapiens
ggaaagugauaugcauu

SEQ ID NO: 651764 - RNA, 15 nt, Homo sapiens
ggaaauaacauugca

SEQ ID NO: 651765 - RNA, 20 nt, Homo sapiens
ggaaauagaaagaagccaua

SEQ ID NO: 651766 - RNA, 14 nt, Homo sapiens
ggaaauauuuccau

SEQ ID NO: 651767 - RNA, 22 nt, Homo sapiens
ggaaaucaaaagggccaaagaa

SEQ ID NO: 651768 - RNA, 18 nt, Homo sapiens
ggaaauccauuccauuuu

SEQ ID NO: 651769 - RNA, 18 nt, Homo sapiens
ggaaauccccuuaugacu

SEQ ID NO: 651770 - RNA, 15 nt, Homo sapiens
ggaaauguagcacuu

SEQ ID NO: 651771 - RNA, 17 nt, Homo sapiens
ggaaauguagugcucga

SEQ ID NO: 651772 - RNA, 12 nt, Homo sapiens
ggaaauguauau

SEQ ID NO: 651773 - RNA, 17 nt, Homo sapiens
ggaaauuaagacuuuau

SEQ ID NO: 651774 - RNA, 17 nt, Homo sapiens
ggaaauuaaugcugaga

SEQ ID NO: 651775 - RNA, 15 nt, Homo sapiens
ggaaauuuuaguuau

SEQ ID NO: 651776 - RNA, 23 nt, Homo sapiens
ggaacacggccacaucaaagagg

SEQ ID NO: 651777 - RNA, 13 nt, Homo sapiens
ggaacacugcacu

SEQ ID NO: 651778 - RNA, 14 nt, Homo sapiens
ggaacacugcacuc

SEQ ID NO: 651779 - RNA, 18 nt, Homo sapiens
ggaacacugcacucuuaa

SEQ ID NO: 651780 - RNA, 20 nt, Homo sapiens
ggaacacuggaacauuccag

SEQ ID NO: 651781 - RNA, 13 nt, Homo sapiens
ggaacagaccuga

SEQ ID NO: 651782 - RNA, 22 nt, Homo sapiens
ggaacagagggugaaagggaca

SEQ ID NO: 651783 - RNA, 23 nt, Homo sapiens
ggaacagcacuggggagucuuug

SEQ ID NO: 651784 - RNA, 20 nt, Homo sapiens
ggaacagcagcagugccaua

SEQ ID NO: 651785 - RNA, 21 nt, Homo sapiens
ggaacagcagcagugccauag

SEQ ID NO: 651786 - RNA, 13 nt, Homo sapiens
ggaacauacuguu

SEQ ID NO: 651787 - RNA, 12 nt, Homo sapiens
ggaacauaugca

SEQ ID NO: 651788 - RNA, 16 nt, Homo sapiens
ggaacaucacauuccu

SEQ ID NO: 651789 - RNA, 21 nt, Homo sapiens
ggaacaugacccagccugaaa

SEQ ID NO: 651790 - RNA, 17 nt, Homo sapiens
ggaaccaaaauguauaa

SEQ ID NO: 651791 - RNA, 20 nt, Homo sapiens
ggaacccugcuugcacuuug

SEQ ID NO: 651792 - RNA, 19 nt, Homo sapiens
ggaacguugccacaccaau

SEQ ID NO: 651793 - RNA, 21 nt, Homo sapiens
ggaacuagagggauacacuga

SEQ ID NO: 651794 - RNA, 13 nt, Homo sapiens
ggaacucucucca

SEQ ID NO: 651795 - RNA, 14 nt, Homo sapiens
ggaacucucuccac

SEQ ID NO: 651796 - RNA, 20 nt, Homo sapiens
ggaacucuggcuuccaggua

SEQ ID NO: 651797 - RNA, 16 nt, Homo sapiens
ggaacucuuaagcaau

SEQ ID NO: 651798 - RNA, 14 nt, Homo sapiens
ggaacuuagccauu

SEQ ID NO: 651799 - RNA, 18 nt, Homo sapiens
ggaacuuuagugaaacau

SEQ ID NO: 651800 - RNA, 22 nt, Homo sapiens
ggaacuuuagugaaacauaaua

SEQ ID NO: 651801 - RNA, 19 nt, Homo sapiens
ggaacuuuccccagaucaa

SEQ ID NO: 651802 - RNA, 19 nt, Homo sapiens
ggaacuuuuauuacugggg

SEQ ID NO: 651803 - RNA, 22 nt, Homo sapiens
ggaagaacccucaggucacaag

SEQ ID NO: 651804 - RNA, 18 nt, Homo sapiens
ggaagaaugaacacuccc

SEQ ID NO: 651805 - RNA, 19 nt, Homo sapiens
ggaagaauuauaacccaga

SEQ ID NO: 651806 - RNA, 12 nt, Homo sapiens
ggaagaccaaga

SEQ ID NO: 651807 - RNA, 13 nt, Homo sapiens
ggaagacugacag

SEQ ID NO: 651808 - RNA, 18 nt, Homo sapiens
ggaagacuugaagcacag

SEQ ID NO: 651809 - RNA, 19 nt, Homo sapiens
ggaagagagagacccucac

SEQ ID NO: 651810 - RNA, 14 nt, Homo sapiens
ggaagagauguuua

SEQ ID NO: 651811 - RNA, 22 nt, Homo sapiens
ggaagagcccgcagggccaugc

SEQ ID NO: 651812 - RNA, 20 nt, Homo sapiens
ggaagagcucuucaguuuuu

SEQ ID NO: 651813 - RNA, 14 nt, Homo sapiens
ggaagagggcagua

SEQ ID NO: 651814 - RNA, 15 nt, Homo sapiens
ggaagaugaaagagg

SEQ ID NO: 651815 - RNA, 14 nt, Homo sapiens
ggaagauggcauaa

SEQ ID NO: 651816 - RNA, 20 nt, Homo sapiens
ggaagcaaguuuucuuccau

SEQ ID NO: 651817 - RNA, 11 nt, Homo sapiens
ggaagccagag

SEQ ID NO: 651818 - RNA, 13 nt, Homo sapiens
ggaagccagguac

SEQ ID NO: 651819 - RNA, 17 nt, Homo sapiens
ggaagccccacuugaag

SEQ ID NO: 651820 - RNA, 17 nt, Homo sapiens
ggaagccggcggcccaa

SEQ ID NO: 651821 - RNA, 22 nt, Homo sapiens
ggaagcuaccaggggaggcagu

SEQ ID NO: 651822 - RNA, 14 nt, Homo sapiens
ggaagcuccacugu

SEQ ID NO: 651823 - RNA, 17 nt, Homo sapiens
ggaagcuccacugucac

SEQ ID NO: 651824 - RNA, 17 nt, Homo sapiens
ggaagcucugaagucac

SEQ ID NO: 651825 - RNA, 14 nt, Homo sapiens
ggaaggaaccagaa

SEQ ID NO: 651826 - RNA, 14 nt, Homo sapiens
ggaaggaaggcagu

SEQ ID NO: 651827 - RNA, 14 nt, Homo sapiens
ggaaggacaugggu

SEQ ID NO: 651828 - RNA, 22 nt, Homo sapiens
ggaaggaggccaagcagugccu

SEQ ID NO: 651829 - RNA, 21 nt, Homo sapiens
ggaaggccccucuguggagcg

SEQ ID NO: 651830 - RNA, 14 nt, Homo sapiens
ggaagggagguggc

SEQ ID NO: 651831 - RNA, 11 nt, Homo sapiens
ggaagggucaa

SEQ ID NO: 651832 - RNA, 19 nt, Homo sapiens
ggaaggucccuuguuucca

SEQ ID NO: 651833 - RNA, 17 nt, Homo sapiens
ggaagguucuacgccag

SEQ ID NO: 651834 - RNA, 16 nt, Homo sapiens
ggaaguaacauuugcc

SEQ ID NO: 651835 - RNA, 17 nt, Homo sapiens
ggaaguaacauuugccu

SEQ ID NO: 651836 - RNA, 11 nt, Homo sapiens
ggaaguacugc

SEQ ID NO: 651837 - RNA, 22 nt, Homo sapiens
ggaaguacugcacccagcagug

SEQ ID NO: 651838 - RNA, 23 nt, Homo sapiens
ggaagugaagagggagaagggau

SEQ ID NO: 651839 - RNA, 16 nt, Homo sapiens
ggaaguuaaagggcau

SEQ ID NO: 651840 - RNA, 12 nt, Homo sapiens
ggaaguucuccu

SEQ ID NO: 651841 - RNA, 16 nt, Homo sapiens
ggaaguuuuaaucucu

SEQ ID NO: 651842 - RNA, 12 nt, Homo sapiens
ggaaguuuucag

SEQ ID NO: 651843 - RNA, 15 nt, Homo sapiens
ggaauaaggccuuaa

SEQ ID NO: 651844 - RNA, 14 nt, Homo sapiens
ggaauaaguguuua

SEQ ID NO: 651845 - RNA, 12 nt, Homo sapiens
ggaauaauguaa

SEQ ID NO: 651846 - RNA, 12 nt, Homo sapiens
ggaauaauucaa

SEQ ID NO: 651847 - RNA, 15 nt, Homo sapiens
ggaauacagaagcag

SEQ ID NO: 651848 - RNA, 15 nt, Homo sapiens
ggaauacucacauuu

SEQ ID NO: 651849 - RNA, 13 nt, Homo sapiens
ggaauacuggcca

SEQ ID NO: 651850 - RNA, 21 nt, Homo sapiens
ggaauauaaggaaagcaauaa

SEQ ID NO: 651851 - RNA, 18 nt, Homo sapiens
ggaauauaucaguaccuc

SEQ ID NO: 651852 - RNA, 21 nt, Homo sapiens
ggaaucacaaaccaagccaug

SEQ ID NO: 651853 - RNA, 13 nt, Homo sapiens
ggaaucagugaag

SEQ ID NO: 651854 - RNA, 20 nt, Homo sapiens
ggaaucauuuuagcuggugu

SEQ ID NO: 651855 - RNA, 20 nt, Homo sapiens
ggaauccaagccuccacagc

SEQ ID NO: 651856 - RNA, 15 nt, Homo sapiens
ggaauccucagagaa

SEQ ID NO: 651857 - RNA, 19 nt, Homo sapiens
ggaauccugcucacaaaau

SEQ ID NO: 651858 - RNA, 18 nt, Homo sapiens
ggaaucucaugauuccau

SEQ ID NO: 651859 - RNA, 16 nt, Homo sapiens
ggaaucuucaccucag

SEQ ID NO: 651860 - RNA, 22 nt, Homo sapiens
ggaaucuucuccaguaugaaau

SEQ ID NO: 651861 - RNA, 18 nt, Homo sapiens
ggaaucuuuguaccaaaa

SEQ ID NO: 651862 - RNA, 22 nt, Homo sapiens
ggaaugacuggggagggcugca

SEQ ID NO: 651863 - RNA, 22 nt, Homo sapiens
ggaaugacuuggguuuaacaag

SEQ ID NO: 651864 - RNA, 12 nt, Homo sapiens
ggaaugcaauau

SEQ ID NO: 651865 - RNA, 21 nt, Homo sapiens
ggaaugcaguccucaucucca

SEQ ID NO: 651866 - RNA, 11 nt, Homo sapiens
ggaaugcuacu

SEQ ID NO: 651867 - RNA, 21 nt, Homo sapiens
ggaaugcucccagcugugcug

SEQ ID NO: 651868 - RNA, 12 nt, Homo sapiens
ggaaugggagac

SEQ ID NO: 651869 - RNA, 16 nt, Homo sapiens
ggaauuacgugcucug

SEQ ID NO: 651870 - RNA, 20 nt, Homo sapiens
ggaauuacgugcucuguggg

SEQ ID NO: 651871 - RNA, 19 nt, Homo sapiens
ggaauuauuuugaauguca

SEQ ID NO: 651872 - RNA, 15 nt, Homo sapiens
ggaauucagugacaa

SEQ ID NO: 651873 - RNA, 18 nt, Homo sapiens
ggaauucuuucuguugaa

SEQ ID NO: 651874 - RNA, 18 nt, Homo sapiens
ggaauugaacgacuguau

SEQ ID NO: 651875 - RNA, 15 nt, Homo sapiens
ggaauugauuugcau

SEQ ID NO: 651876 - RNA, 14 nt, Homo sapiens
ggaauugguguaua

SEQ ID NO: 651877 - RNA, 20 nt, Homo sapiens
ggaauuuccucccaauucau

SEQ ID NO: 651878 - RNA, 24 nt, Homo sapiens
ggacaaaagggguuaauguuacuu

SEQ ID NO: 651879 - RNA, 18 nt, Homo sapiens
ggacaaaauuuguacuau

SEQ ID NO: 651880 - RNA, 18 nt, Homo sapiens
ggacaaaccgagugcaau

SEQ ID NO: 651881 - RNA, 21 nt, Homo sapiens
ggacaaaccgagugcaaugaa

SEQ ID NO: 651882 - RNA, 23 nt, Homo sapiens
ggacaaagaauuccaaagcaaaa

SEQ ID NO: 651883 - RNA, 19 nt, Homo sapiens
ggacaaauuagcaugcaag

SEQ ID NO: 651884 - RNA, 19 nt, Homo sapiens
ggcccccgggccugcacag

SEQ ID NO: 651885 - RNA, 23 nt, Homo sapiens
ggcccccgucagggagaggucac

SEQ ID NO: 651886 - RNA, 21 nt, Homo sapiens
ggccccgugaggcaaugggag

SEQ ID NO: 651887 - RNA, 22 nt, Homo sapiens
ggccccuccuugcaaccaggca

SEQ ID NO: 651888 - RNA, 21 nt, Homo sapiens
ggccccugaugcuccaaccuc

SEQ ID NO: 651889 - RNA, 15 nt, Homo sapiens
ggcccgcaccgcugg

SEQ ID NO: 651890 - RNA, 18 nt, Homo sapiens
ggcccggagcagcaggaa

SEQ ID NO: 651891 - RNA, 21 nt, Homo sapiens
ggcccguggcuuggcaucugu

SEQ ID NO: 651892 - RNA, 23 nt, Homo sapiens
ggcccuccucucccauccuugau

SEQ ID NO: 651893 - RNA, 16 nt, Homo sapiens
ggcccuccuucccucc

SEQ ID NO: 651894 - RNA, 17 nt, Homo sapiens
ggcccucugccugcacu

SEQ ID NO: 651895 - RNA, 15 nt, Homo sapiens
ggcccugagcucggu

SEQ ID NO: 651896 - RNA, 13 nt, Homo sapiens
ggcccugcugagu

SEQ ID NO: 651897 - RNA, 15 nt, Homo sapiens
ggcccugcugaguca

SEQ ID NO: 651898 - RNA, 17 nt, Homo sapiens
ggcccuggcagcaggaa

SEQ ID NO: 651899 - RNA, 23 nt, Homo sapiens
ggcccuggccuagcauacguaca

SEQ ID NO: 651900 - RNA, 12 nt, Homo sapiens
ggcccugugguc

SEQ ID NO: 651901 - RNA, 24 nt, Homo sapiens
ggcccuuagggaaguugucuccuu

SEQ ID NO: 651902 - RNA, 15 nt, Homo sapiens
ggcccuucacuucca

SEQ ID NO: 651903 - RNA, 20 nt, Homo sapiens
ggcccuuccugcagcgccug

SEQ ID NO: 651904 - RNA, 14 nt, Homo sapiens
ggccgccagcgugu

SEQ ID NO: 651905 - RNA, 17 nt, Homo sapiens
ggccgcccugcggguga

SEQ ID NO: 651906 - RNA, 18 nt, Homo sapiens
ggccgcucgaugccuuug

SEQ ID NO: 651907 - RNA, 20 nt, Homo sapiens
ggccggcugugcucagagac

SEQ ID NO: 651908 - RNA, 13 nt, Homo sapiens
ggccgucuucacu

SEQ ID NO: 651909 - RNA, 13 nt, Homo sapiens
ggccguggcacag

SEQ ID NO: 651910 - RNA, 18 nt, Homo sapiens
ggccguggcacagcuggg

SEQ ID NO: 651911 - RNA, 16 nt, Homo sapiens
ggccuaaaacaguauu

SEQ ID NO: 651912 - RNA, 13 nt, Homo sapiens
ggccuaacauguu

SEQ ID NO: 651913 - RNA, 21 nt, Homo sapiens
ggccuauuccaggaauuccuc

SEQ ID NO: 651914 - RNA, 10 nt, Homo sapiens
ggccucagaa

SEQ ID NO: 651915 - RNA, 19 nt, Homo sapiens
ggccucagcugaaugccuc

SEQ ID NO: 651916 - RNA, 11 nt, Homo sapiens
ggccucaggug

SEQ ID NO: 651917 - RNA, 13 nt, Homo sapiens
ggccucagguuug

SEQ ID NO: 651918 - RNA, 21 nt, Homo sapiens
ggccuccagaagcugcuccuu

SEQ ID NO: 651919 - RNA, 20 nt, Homo sapiens
ggccucccaaagugcuggga

SEQ ID NO: 651920 - RNA, 22 nt, Homo sapiens
ggccucccaaagugcugggauu

SEQ ID NO: 651921 - RNA, 20 nt, Homo sapiens
ggccucccaaaugagccaug

SEQ ID NO: 651922 - RNA, 22 nt, Homo sapiens
ggccucccaccagagacuggga

SEQ ID NO: 651923 - RNA, 20 nt, Homo sapiens
ggccucccggggcccaggac

SEQ ID NO: 651924 - RNA, 18 nt, Homo sapiens
ggccucgaaaaccaucac

SEQ ID NO: 651925 - RNA, 19 nt, Homo sapiens
ggccucucugccugggaug

SEQ ID NO: 651926 - RNA, 15 nt, Homo sapiens
ggccucugacucuga

SEQ ID NO: 651927 - RNA, 20 nt, Homo sapiens
ggccucugacucugagucca

SEQ ID NO: 651928 - RNA, 14 nt, Homo sapiens
ggccucugcaaagg

SEQ ID NO: 651929 - RNA, 19 nt, Homo sapiens
ggccucugcccuucagaag

SEQ ID NO: 651930 - RNA, 20 nt, Homo sapiens
ggccucuggcucucaugggg

SEQ ID NO: 651931 - RNA, 23 nt, Homo sapiens
ggccugaaucaaggaaagccagg

SEQ ID NO: 651932 - RNA, 15 nt, Homo sapiens
ggccugaccaaacag

SEQ ID NO: 651933 - RNA, 15 nt, Homo sapiens
ggccugagagucagc

SEQ ID NO: 651934 - RNA, 19 nt, Homo sapiens
ggccugagaugcaggugau

SEQ ID NO: 651935 - RNA, 21 nt, Homo sapiens
ggccugagaugcaggugaugc

SEQ ID NO: 651936 - RNA, 22 nt, Homo sapiens
ggccugauuuaucuagcugucc

SEQ ID NO: 651937 - RNA, 15 nt, Homo sapiens
ggccugcacagauac

SEQ ID NO: 651938 - RNA, 14 nt, Homo sapiens
ggccugcccagaca

SEQ ID NO: 651939 - RNA, 16 nt, Homo sapiens
ggccugcccucaggga

SEQ ID NO: 651940 - RNA, 23 nt, Homo sapiens
ggccugccuugaagccacugaag

SEQ ID NO: 651941 - RNA, 22 nt, Homo sapiens
ggccugcggaggcgguggcaga

SEQ ID NO: 651942 - RNA, 17 nt, Homo sapiens
ggccugcugaggccuuc

SEQ ID NO: 651943 - RNA, 17 nt, Homo sapiens
ggccuggcaagugggug

SEQ ID NO: 651944 - RNA, 13 nt, Homo sapiens
ggccuggccaugu

SEQ ID NO: 651945 - RNA, 20 nt, Homo sapiens
ggccuggcccaaagcagugu

SEQ ID NO: 651946 - RNA, 17 nt, Homo sapiens
ggccuggggaggcccua

SEQ ID NO: 651947 - RNA, 22 nt, Homo sapiens
ggccugggggcagugacuggca

SEQ ID NO: 651948 - RNA, 19 nt, Homo sapiens
ggccuggguuuguuccugg

SEQ ID NO: 651949 - RNA, 15 nt, Homo sapiens
ggccugguccaugau

SEQ ID NO: 651950 - RNA, 14 nt, Homo sapiens
ggccuguccuccaa

SEQ ID NO: 651951 - RNA, 11 nt, Homo sapiens
ggccuguggug

SEQ ID NO: 651952 - RNA, 17 nt, Homo sapiens
ggccuuagugggccagg

SEQ ID NO: 651953 - RNA, 11 nt, Homo sapiens
ggccuucucac

SEQ ID NO: 651954 - RNA, 17 nt, Homo sapiens
ggccuucugaacuccau

SEQ ID NO: 651955 - RNA, 17 nt, Homo sapiens
ggccuugaagaggccaa

SEQ ID NO: 651956 - RNA, 16 nt, Homo sapiens
ggccuugugugaugau

SEQ ID NO: 651957 - RNA, 20 nt, Homo sapiens
ggccuuucagguccaggcca

SEQ ID NO: 651958 - RNA, 18 nt, Homo sapiens
ggccuuucccucuucccu

SEQ ID NO: 651959 - RNA, 14 nt, Homo sapiens
ggcuccaccccagg

SEQ ID NO: 651960 - RNA, 22 nt, Homo sapiens
ggcuccaccccauccaguucau

SEQ ID NO: 651961 - RNA, 17 nt, Homo sapiens
ggcucccaugucaagag

SEQ ID NO: 651962 - RNA, 21 nt, Homo sapiens
ggcucccugccugagggucac

SEQ ID NO: 651963 - RNA, 21 nt, Homo sapiens
ggcuccgagggcggccaggga

SEQ ID NO: 651964 - RNA, 22 nt, Homo sapiens
ggcuccuccucacccaccucug

SEQ ID NO: 651965 - RNA, 15 nt, Homo sapiens
ggcuccugauggugu

SEQ ID NO: 651966 - RNA, 22 nt, Homo sapiens
ggcuccugauggugucauucug

SEQ ID NO: 651967 - RNA, 17 nt, Homo sapiens
ggcucuaauguacaaua

SEQ ID NO: 651968 - RNA, 21 nt, Homo sapiens
ggcucuaauucacagugcucu

SEQ ID NO: 651969 - RNA, 21 nt, Homo sapiens
ggcucuaugccugcacuggga

SEQ ID NO: 651970 - RNA, 18 nt, Homo sapiens
ggcucuccucgcaggugu

SEQ ID NO: 651971 - RNA, 17 nt, Homo sapiens
ggcucucuguaggcaca

SEQ ID NO: 651972 - RNA, 20 nt, Homo sapiens
ggcucugcuucuccaaggaa

SEQ ID NO: 651973 - RNA, 18 nt, Homo sapiens
ggcucuggagccagagag

SEQ ID NO: 651974 - RNA, 22 nt, Homo sapiens
ggcucugggagacuuugaagac

SEQ ID NO: 651975 - RNA, 15 nt, Homo sapiens
ggcucugggggaccc

SEQ ID NO: 651976 - RNA, 17 nt, Homo sapiens
ggcucuuaaaugcugca

SEQ ID NO: 651977 - RNA, 19 nt, Homo sapiens
ggcucuuaugugugccuuu

SEQ ID NO: 651978 - RNA, 11 nt, Homo sapiens
ggcucuuccaa

SEQ ID NO: 651979 - RNA, 14 nt, Homo sapiens
ggcucuuccuugaa

SEQ ID NO: 651980 - RNA, 19 nt, Homo sapiens
ggcucuucuaaucagagcg

SEQ ID NO: 651981 - RNA, 13 nt, Homo sapiens
ggcucuuuccuug

SEQ ID NO: 651982 - RNA, 14 nt, Homo sapiens
ggcucuuucuaucc

SEQ ID NO: 651983 - RNA, 14 nt, Homo sapiens
ggcugaacccugug

SEQ ID NO: 651984 - RNA, 22 nt, Homo sapiens
ggcugaagcgagcccucaggag

SEQ ID NO: 651985 - RNA, 15 nt, Homo sapiens
ggcugaagugucaca

SEQ ID NO: 651986 - RNA, 14 nt, Homo sapiens
ggcugacaagggac

SEQ ID NO: 651987 - RNA, 21 nt, Homo sapiens
ggcugacaccuaccaugcugc

SEQ ID NO: 651988 - RNA, 15 nt, Homo sapiens
ggcugaggauuucaa

SEQ ID NO: 651989 - RNA, 16 nt, Homo sapiens
ggcugaggcuggcaca

SEQ ID NO: 651990 - RNA, 14 nt, Homo sapiens
ggcugaugaugucu

SEQ ID NO: 651991 - RNA, 23 nt, Homo sapiens
ggcugaugaugucuucugguguc

SEQ ID NO: 651992 - RNA, 14 nt, Homo sapiens
ggcugcacaacagc

SEQ ID NO: 651993 - RNA, 19 nt, Homo sapiens
ggcugcacaggcugaaaua

SEQ ID NO: 651994 - RNA, 18 nt, Homo sapiens
ggcugcacccacccagga

SEQ ID NO: 651995 - RNA, 17 nt, Homo sapiens
ggcugcaguucuacuca

SEQ ID NO: 651996 - RNA, 16 nt, Homo sapiens
ggcugcccacuggaga

SEQ ID NO: 651997 - RNA, 15 nt, Homo sapiens
ggcugcccucuccac

SEQ ID NO: 651998 - RNA, 22 nt, Homo sapiens
ggcugccgagacagacccucug

SEQ ID NO: 651999 - RNA, 14 nt, Homo sapiens
ggcugccuccuuug

SEQ ID NO: 652000 - RNA, 22 nt, Homo sapiens
ggcugccuggugguugaugguu

SEQ ID NO: 652001 - RNA, 15 nt, Homo sapiens
ggcugccugugugca

SEQ ID NO: 652002 - RNA, 22 nt, Homo sapiens
ggcugccuuuguggugggcgcu

SEQ ID NO: 652003 - RNA, 18 nt, Homo sapiens
ggcugcgagagaaaggga

SEQ ID NO: 652004 - RNA, 24 nt, Homo sapiens
ggcugcuagaggugcucauccuca

SEQ ID NO: 652005 - RNA, 11 nt, Homo sapiens
ggcugcucccc

SEQ ID NO: 652006 - RNA, 20 nt, Homo sapiens
ggcugcucggcuugaucaca

SEQ ID NO: 652007 - RNA, 20 nt, Homo sapiens
ggcugcugaaacucauuuga

SEQ ID NO: 652008 - RNA, 17 nt, Homo sapiens
ggcugcuggagugcagu

SEQ ID NO: 652009 - RNA, 14 nt, Homo sapiens
ggcugcuuccugug

SEQ ID NO: 652010 - RNA, 22 nt, Homo sapiens
ggcugcuuccugugacagugaa

SEQ ID NO: 652011 - RNA, 21 nt, Homo sapiens
ggcuggaaugcuggguaugcu

SEQ ID NO: 652012 - RNA, 20 nt, Homo sapiens
ggcuggagccuggggugucc

SEQ ID NO: 652013 - RNA, 19 nt, Homo sapiens
ggcuggaggcugagcugca

SEQ ID NO: 652014 - RNA, 15 nt, Homo sapiens
ggcuggagugcaaug

SEQ ID NO: 652015 - RNA, 20 nt, Homo sapiens
ggcuggagugcaaugacaca

SEQ ID NO: 652016 - RNA, 14 nt, Homo sapiens
ggcuggagugcagu

SEQ ID NO: 652017 - RNA, 22 nt, Homo sapiens
ggcuggagugugaggguccugc

SEQ ID NO: 652018 - RNA, 19 nt, Homo sapiens
ggcuggaugugguggcaua

SEQ ID NO: 652019 - RNA, 21 nt, Homo sapiens
ggcuggauugccuuguaugca

SEQ ID NO: 652020 - RNA, 13 nt, Homo sapiens
ggcuggcacugac

SEQ ID NO: 652021 - RNA, 16 nt, Homo sapiens
ggcuggcagcucucca

SEQ ID NO: 652022 - RNA, 19 nt, Homo sapiens
ggcuggccuuccccuccaa

SEQ ID NO: 652023 - RNA, 17 nt, Homo sapiens
ggcuggcuccugaucca

SEQ ID NO: 652024 - RNA, 19 nt, Homo sapiens
ggcugggagacagagucag

SEQ ID NO: 652025 - RNA, 18 nt, Homo sapiens
ggcugggcaccguguccu

SEQ ID NO: 652026 - RNA, 15 nt, Homo sapiens
ggcugggcaucccag

SEQ ID NO: 652027 - RNA, 11 nt, Homo sapiens
ggcugggcuac

SEQ ID NO: 652028 - RNA, 20 nt, Homo sapiens
ggcuggggccaccuuugugc

SEQ ID NO: 652029 - RNA, 22 nt, Homo sapiens
ggcuggggccaccuuugugcag

SEQ ID NO: 652030 - RNA, 16 nt, Homo sapiens
ggcuggguaccaaugc

SEQ ID NO: 652031 - RNA, 13 nt, Homo sapiens
ggcugggugguau

SEQ ID NO: 652032 - RNA, 22 nt, Homo sapiens
ggcugguccagggcuagugacu

SEQ ID NO: 652033 - RNA, 23 nt, Homo sapiens
ggcuggugacagaacaugcagca

SEQ ID NO: 652034 - RNA, 23 nt, Homo sapiens
ggcuggugcuguggccaggguga

SEQ ID NO: 652035 - RNA, 16 nt, Homo sapiens
gcugcacccacccagg

SEQ ID NO: 652036 - RNA, 17 nt, Homo sapiens
gcugcacccacccagga

SEQ ID NO: 652037 - RNA, 22 nt, Homo sapiens
gcugcacccugcgccuccagag

SEQ ID NO: 652038 - RNA, 21 nt, Homo sapiens
gcugcacugaucacccaaugc

SEQ ID NO: 652039 - RNA, 14 nt, Homo sapiens
gcugcagaaggcca

SEQ ID NO: 652040 - RNA, 19 nt, Homo sapiens
gcugcagacaaguggacag

SEQ ID NO: 652041 - RNA, 17 nt, Homo sapiens
gcugcagagcaccuuug

SEQ ID NO: 652042 - RNA, 18 nt, Homo sapiens
gcugcagcgcuuguuaau

SEQ ID NO: 652043 - RNA, 18 nt, Homo sapiens
gcugcaggaaaagcaaaa

SEQ ID NO: 652044 - RNA, 17 nt, Homo sapiens
gcugcaggggugccugg

SEQ ID NO: 652045 - RNA, 14 nt, Homo sapiens
gcugcagucaucua

SEQ ID NO: 652046 - RNA, 14 nt, Homo sapiens
gcugcauaaacugu

SEQ ID NO: 652047 - RNA, 19 nt, Homo sapiens
gcugcauugauccaggaga

SEQ ID NO: 652048 - RNA, 15 nt, Homo sapiens
gcugcauuuuacaca

SEQ ID NO: 652049 - RNA, 14 nt, Homo sapiens
gcugccaaaugcgu

SEQ ID NO: 652050 - RNA, 14 nt, Homo sapiens
gcugccacugggca

SEQ ID NO: 652051 - RNA, 19 nt, Homo sapiens
gcugccagacacugagcuu

SEQ ID NO: 652052 - RNA, 16 nt, Homo sapiens
gcugccagccuucucc

SEQ ID NO: 652053 - RNA, 16 nt, Homo sapiens
gcugcccagccacucc

SEQ ID NO: 652054 - RNA, 20 nt, Homo sapiens
gcugccccaaccugcugaag

SEQ ID NO: 652055 - RNA, 19 nt, Homo sapiens
gcugccccuacugcaaaug

SEQ ID NO: 652056 - RNA, 20 nt, Homo sapiens
gcugccucugggccaugcca

SEQ ID NO: 652057 - RNA, 15 nt, Homo sapiens
gcugccucuguggaa

SEQ ID NO: 652058 - RNA, 19 nt, Homo sapiens
gcugccucuuggcuucuca

SEQ ID NO: 652059 - RNA, 19 nt, Homo sapiens
gcugccugcugugcuggga

SEQ ID NO: 652060 - RNA, 21 nt, Homo sapiens
gcugccuggccuuguccucag

SEQ ID NO: 652061 - RNA, 21 nt, Homo sapiens
gcugccugugugcauguuccc

SEQ ID NO: 652062 - RNA, 13 nt, Homo sapiens
gcugcgcacugug

SEQ ID NO: 652063 - RNA, 13 nt, Homo sapiens
gcugcuagcacuu

SEQ ID NO: 652064 - RNA, 14 nt, Homo sapiens
gcugcuaggccaga

SEQ ID NO: 652065 - RNA, 16 nt, Homo sapiens
gcugcucaaggaccaa

SEQ ID NO: 652066 - RNA, 22 nt, Homo sapiens
gcugcucacuguccacauguga

SEQ ID NO: 652067 - RNA, 15 nt, Homo sapiens
gcugcucaggcccau

SEQ ID NO: 652068 - RNA, 13 nt, Homo sapiens
gcugcucagggaa

SEQ ID NO: 652069 - RNA, 12 nt, Homo sapiens
gcugcucauggg

SEQ ID NO: 652070 - RNA, 21 nt, Homo sapiens
gcugcuccccuggaggacaga

SEQ ID NO: 652071 - RNA, 15 nt, Homo sapiens
gcugcuccgguuugg

SEQ ID NO: 652072 - RNA, 13 nt, Homo sapiens
gcugcucugcuau

SEQ ID NO: 652073 - RNA, 23 nt, Homo sapiens
gcugcuggccaugaaucucugcc

SEQ ID NO: 652074 - RNA, 18 nt, Homo sapiens
gcugcugggcugagugac

SEQ ID NO: 652075 - RNA, 19 nt, Homo sapiens
gcugcuuccuccuggaaau

SEQ ID NO: 652076 - RNA, 19 nt, Homo sapiens
gcugcuuccugucugagua

SEQ ID NO: 652077 - RNA, 22 nt, Homo sapiens
gcugcuucuuauuaaucauaca

SEQ ID NO: 652078 - RNA, 18 nt, Homo sapiens
gcugcuugaccuagcucu

SEQ ID NO: 652079 - RNA, 15 nt, Homo sapiens
gcugcuuguccugcu

SEQ ID NO: 652080 - RNA, 16 nt, Homo sapiens
gcugcuugugaucuca

SEQ ID NO: 652081 - RNA, 19 nt, Homo sapiens
gcugcuuucuguugucauu

SEQ ID NO: 652082 - RNA, 12 nt, Homo sapiens
gcugcuuugaca

SEQ ID NO: 652083 - RNA, 14 nt, Homo sapiens
gcugcuuugacaag

SEQ ID NO: 652084 - RNA, 17 nt, Homo sapiens
gcuggaaaaaggugaau

SEQ ID NO: 652085 - RNA, 23 nt, Homo sapiens
gcuggaaaaccuccuuuaccaga

SEQ ID NO: 652086 - RNA, 23 nt, Homo sapiens
gcuggaaacacagucacuuggga

SEQ ID NO: 652087 - RNA, 14 nt, Homo sapiens
gcuggaaaugcuga

SEQ ID NO: 652088 - RNA, 15 nt, Homo sapiens
gcuggaagcaaagua

SEQ ID NO: 652089 - RNA, 12 nt, Homo sapiens
gcuggaauucua

SEQ ID NO: 652090 - RNA, 13 nt, Homo sapiens
gcuggaccacaca

SEQ ID NO: 652091 - RNA, 15 nt, Homo sapiens
gcuggacgugcgcga

SEQ ID NO: 652092 - RNA, 22 nt, Homo sapiens
gcuggacgugcgcgaugccugg

SEQ ID NO: 652093 - RNA, 20 nt, Homo sapiens
gcuggacuguuccaggcccu

SEQ ID NO: 652094 - RNA, 17 nt, Homo sapiens
gcuggacuucuaccugc

SEQ ID NO: 652095 - RNA, 23 nt, Homo sapiens
gcuggagagguuaaggugcaaua

SEQ ID NO: 652096 - RNA, 14 nt, Homo sapiens
gcuggagcagcgga

SEQ ID NO: 652097 - RNA, 15 nt, Homo sapiens
gcuggagcccacagc

SEQ ID NO: 652098 - RNA, 19 nt, Homo sapiens
gcuggaggacaguggcaca

SEQ ID NO: 652099 - RNA, 23 nt, Homo sapiens
gcuggaggccucaggugcugucc

SEQ ID NO: 652100 - RNA, 20 nt, Homo sapiens
gcuggagugcaaugguguga

SEQ ID NO: 652101 - RNA, 20 nt, Homo sapiens
gcuggagugcaguagcacga

SEQ ID NO: 652102 - RNA, 12 nt, Homo sapiens
ggucaaacuccc

SEQ ID NO: 652103 - RNA, 22 nt, Homo sapiens
ggucaaaguguuuucucugaac

SEQ ID NO: 652104 - RNA, 19 nt, Homo sapiens
ggucaaaucccaaaccauu

SEQ ID NO: 652105 - RNA, 15 nt, Homo sapiens
ggucaagaaacagcc

SEQ ID NO: 652106 - RNA, 16 nt, Homo sapiens
ggucaagaacaugcaa

SEQ ID NO: 652107 - RNA, 17 nt, Homo sapiens
ggucaauuaaauugacu

SEQ ID NO: 652108 - RNA, 13 nt, Homo sapiens
ggucacacucuca

SEQ ID NO: 652109 - RNA, 12 nt, Homo sapiens
ggucaccuggug

SEQ ID NO: 652110 - RNA, 15 nt, Homo sapiens
ggucaccuugcacuc

SEQ ID NO: 652111 - RNA, 21 nt, Homo sapiens
ggucacguuuggugcuucuca

SEQ ID NO: 652112 - RNA, 12 nt, Homo sapiens
ggucacugguca

SEQ ID NO: 652113 - RNA, 21 nt, Homo sapiens
ggucagcagaugccagugaag

SEQ ID NO: 652114 - RNA, 13 nt, Homo sapiens
ggucagcauguac

SEQ ID NO: 652115 - RNA, 22 nt, Homo sapiens
ggucagccauuuuuaaugaucu

SEQ ID NO: 652116 - RNA, 18 nt, Homo sapiens
ggucaggaacaguggcug

SEQ ID NO: 652117 - RNA, 19 nt, Homo sapiens
ggucaggaccaucagagag

SEQ ID NO: 652118 - RNA, 21 nt, Homo sapiens
ggucaggagaaugaaacagcu

SEQ ID NO: 652119 - RNA, 18 nt, Homo sapiens
ggucagggcucagaguga

SEQ ID NO: 652120 - RNA, 19 nt, Homo sapiens
ggucagguguucaagacca

SEQ ID NO: 652121 - RNA, 19 nt, Homo sapiens
ggucaguaaauaacaggca

SEQ ID NO: 652122 - RNA, 21 nt, Homo sapiens
ggucagugguggucuucaaga

SEQ ID NO: 652123 - RNA, 21 nt, Homo sapiens
ggucauagcccagaucagcuc

SEQ ID NO: 652124 - RNA, 14 nt, Homo sapiens
ggucaucacuuuga

SEQ ID NO: 652125 - RNA, 17 nt, Homo sapiens
ggucaugcuuuugccac

SEQ ID NO: 652126 - RNA, 17 nt, Homo sapiens
ggucauuucauuugaaa

SEQ ID NO: 652127 - RNA, 18 nt, Homo sapiens
gguccacccagcaaagag

SEQ ID NO: 652128 - RNA, 16 nt, Homo sapiens
gguccauacaccagca

SEQ ID NO: 652129 - RNA, 12 nt, Homo sapiens
ggucccaagaca

SEQ ID NO: 652130 - RNA, 15 nt, Homo sapiens
ggucccaauuaagaa

SEQ ID NO: 652131 - RNA, 20 nt, Homo sapiens
ggucccacuaauuauuagaa

SEQ ID NO: 652132 - RNA, 18 nt, Homo sapiens
ggucccaucaauucuuag

SEQ ID NO: 652133 - RNA, 19 nt, Homo sapiens
gguccccgguugcugguca

SEQ ID NO: 652134 - RNA, 13 nt, Homo sapiens
ggucccggggcca

SEQ ID NO: 652135 - RNA, 21 nt, Homo sapiens
ggucccuccucucaccucucc

SEQ ID NO: 652136 - RNA, 21 nt, Homo sapiens
ggucccugaggaugggucaga

SEQ ID NO: 652137 - RNA, 17 nt, Homo sapiens
gguccgaagucuuccau

SEQ ID NO: 652138 - RNA, 23 nt, Homo sapiens
gguccucacaagccucuucugaa

SEQ ID NO: 652139 - RNA, 18 nt, Homo sapiens
gguccugaaaguaacuca

SEQ ID NO: 652140 - RNA, 16 nt, Homo sapiens
gguccugacucacacu

SEQ ID NO: 652141 - RNA, 19 nt, Homo sapiens
gguccuggccgucccuaag

SEQ ID NO: 652142 - RNA, 17 nt, Homo sapiens
gguccuguucccuaccc

SEQ ID NO: 652143 - RNA, 21 nt, Homo sapiens
gguccuuccacugugcaccug

SEQ ID NO: 652144 - RNA, 15 nt, Homo sapiens
gguccuucugacccc

SEQ ID NO: 652145 - RNA, 23 nt, Homo sapiens
gguccuugaugccagagggccag

SEQ ID NO: 652146 - RNA, 22 nt, Homo sapiens
gguccuugcaccccucacucug

SEQ ID NO: 652147 - RNA, 22 nt, Homo sapiens
ggucuaagcaccuuggugcuua

SEQ ID NO: 652148 - RNA, 15 nt, Homo sapiens
ggucuaggacacagu

SEQ ID NO: 652149 - RNA, 18 nt, Homo sapiens
ggucucaagguucucauu

SEQ ID NO: 652150 - RNA, 20 nt, Homo sapiens
ggucucacucugucgcucag

SEQ ID NO: 652151 - RNA, 14 nt, Homo sapiens
ggucuccaagggag

SEQ ID NO: 652152 - RNA, 22 nt, Homo sapiens
ggucucccaaagugcugggauu

SEQ ID NO: 652153 - RNA, 20 nt, Homo sapiens
ggucuccuggaccuugacag

SEQ ID NO: 652154 - RNA, 20 nt, Homo sapiens
ggucucgcuuuguugcccag

SEQ ID NO: 652155 - RNA, 19 nt, Homo sapiens
ggucucucucccucugucu

SEQ ID NO: 652156 - RNA, 22 nt, Homo sapiens
ggucugacaccaaaacaugccg

SEQ ID NO: 652157 - RNA, 21 nt, Homo sapiens
ggucugacaugaacacuuuuu

SEQ ID NO: 652158 - RNA, 16 nt, Homo sapiens
ggucugagaauggaau

SEQ ID NO: 652159 - RNA, 18 nt, Homo sapiens
ggucugauauuaaucaaa

SEQ ID NO: 652160 - RNA, 16 nt, Homo sapiens
ggucugauuucaggau

SEQ ID NO: 652161 - RNA, 18 nt, Homo sapiens
ggucugguuguugcacca

SEQ ID NO: 652162 - RNA, 13 nt, Homo sapiens
ggucugugacugg

SEQ ID NO: 652163 - RNA, 12 nt, Homo sapiens
ggucugugucac

SEQ ID NO: 652164 - RNA, 18 nt, Homo sapiens
ggucugugugaauguggg

SEQ ID NO: 652165 - RNA, 23 nt, Homo sapiens
ggucuguuuugguccccucccuc

SEQ ID NO: 652166 - RNA, 14 nt, Homo sapiens
ggucuuacauugga

SEQ ID NO: 652167 - RNA, 19 nt, Homo sapiens
ggucuucuaccucagacac

SEQ ID NO: 652168 - RNA, 13 nt, Homo sapiens
ggucuucuuacau

SEQ ID NO: 652169 - RNA, 20 nt, Homo sapiens
ggucuuugcaagaaucauua

SEQ ID NO: 652170 - RNA, 22 nt, Homo sapiens
ggucuuugucagacauucugga

SEQ ID NO: 652171 - RNA, 13 nt, Homo sapiens
ggugaaaugaaug

SEQ ID NO: 652172 - RNA, 15 nt, Homo sapiens
ggugacacaggucag

SEQ ID NO: 652173 - RNA, 13 nt, Homo sapiens
ggugacagaucau

SEQ ID NO: 652174 - RNA, 18 nt, Homo sapiens
ggugacaggcccagugga

SEQ ID NO: 652175 - RNA, 16 nt, Homo sapiens
ggugacauuguggacu

SEQ ID NO: 652176 - RNA, 16 nt, Homo sapiens
ggugaccucacuuuag

SEQ ID NO: 652177 - RNA, 20 nt, Homo sapiens
ggugaccucuagagcuggag

SEQ ID NO: 652178 - RNA, 17 nt, Homo sapiens
ggugaccugcggcagua

SEQ ID NO: 652179 - RNA, 19 nt, Homo sapiens
ggugacuguguaacuuucu

SEQ ID NO: 652180 - RNA, 22 nt, Homo sapiens
ggugagaaauuugccuuguuca

SEQ ID NO: 652181 - RNA, 22 nt, Homo sapiens
ggugagaagcuagaugccccug

SEQ ID NO: 652182 - RNA, 18 nt, Homo sapiens
ggugagagugauuguguu

SEQ ID NO: 652183 - RNA, 19 nt, Homo sapiens
ggugagccgagauugcacc

SEQ ID NO: 652184 - RNA, 17 nt, Homo sapiens
ggugaggggcuggcacu

SEQ ID NO: 652185 - RNA, 16 nt, Homo sapiens
ggugaggguuggcgcu

SEQ ID NO: 652186 - RNA, 15 nt, Homo sapiens
ggugagugugcagua

SEQ ID NO: 652187 - RNA, 17 nt, Homo sapiens
ggugauggggcugagca

SEQ ID NO: 652188 - RNA, 11 nt, Homo sapiens
ggugauggugu

SEQ ID NO: 652189 - RNA, 23 nt, Homo sapiens
ggugcacagauugcugaaacugu

SEQ ID NO: 652190 - RNA, 17 nt, Homo sapiens
ggugcacucacuccuga

SEQ ID NO: 652191 - RNA, 22 nt, Homo sapiens
ggugcagucacggcucacugca

SEQ ID NO: 652192 - RNA, 21 nt, Homo sapiens
ggugcaguuuuccaggaauag

SEQ ID NO: 652193 - RNA, 19 nt, Homo sapiens
ggugcauagcaagugaaag

SEQ ID NO: 652194 - RNA, 12 nt, Homo sapiens
ggugcauauacg

SEQ ID NO: 652195 - RNA, 21 nt, Homo sapiens
ggugcaugauaagagcaucuc

SEQ ID NO: 652196 - RNA, 15 nt, Homo sapiens
ggugcaugaugcugc

SEQ ID NO: 652197 - RNA, 21 nt, Homo sapiens
ggugccaggcuguaagcauuc

SEQ ID NO: 652198 - RNA, 21 nt, Homo sapiens
ggugcccaaacaccagucacc

SEQ ID NO: 652199 - RNA, 13 nt, Homo sapiens
ggugcccacaggc

SEQ ID NO: 652200 - RNA, 15 nt, Homo sapiens
ggugcccucucaggu

SEQ ID NO: 652201 - RNA, 19 nt, Homo sapiens
ggugcccuuuggggucccg

SEQ ID NO: 652202 - RNA, 16 nt, Homo sapiens
ggugccucucuuggcu

SEQ ID NO: 652203 - RNA, 16 nt, Homo sapiens
ggugccugcucaggug

SEQ ID NO: 652204 - RNA, 20 nt, Homo sapiens
ggugccuuuugugugaugcg

SEQ ID NO: 652205 - RNA, 19 nt, Homo sapiens
ggugcgcccugucucugug

SEQ ID NO: 652206 - RNA, 12 nt, Homo sapiens
ggugcguggcug

SEQ ID NO: 652207 - RNA, 15 nt, Homo sapiens
ggugcugccgugccc

SEQ ID NO: 652208 - RNA, 17 nt, Homo sapiens
ggugcuuccgcugcuug

SEQ ID NO: 652209 - RNA, 14 nt, Homo sapiens
ggugcuucucacca

SEQ ID NO: 652210 - RNA, 17 nt, Homo sapiens
ggugcuucucagauuuc

SEQ ID NO: 652211 - RNA, 19 nt, Homo sapiens
ggugcuuugcgacuuguca

SEQ ID NO: 652212 - RNA, 16 nt, Homo sapiens
gguggaagaccuggac

SEQ ID NO: 652213 - RNA, 19 nt, Homo sapiens
gguggacaagggcccauga

SEQ ID NO: 652214 - RNA, 22 nt, Homo sapiens
gguggacuucaguguguguauu

SEQ ID NO: 652215 - RNA, 17 nt, Homo sapiens
gguggagcuugcaguga

SEQ ID NO: 652216 - RNA, 13 nt, Homo sapiens
gguggagggccac

SEQ ID NO: 652217 - RNA, 15 nt, Homo sapiens
gguggagguugcagu

SEQ ID NO: 652218 - RNA, 17 nt, Homo sapiens
gguggagguugcaguga

SEQ ID NO: 652219 - RNA, 22 nt, Homo sapiens
gguggauauuaaaaaucuguaa

SEQ ID NO: 652220 - RNA, 16 nt, Homo sapiens
gguggaucuguccaag

SEQ ID NO: 652221 - RNA, 21 nt, Homo sapiens
gguggaugaggagacagaaua

SEQ ID NO: 652222 - RNA, 18 nt, Homo sapiens
gguggcacacaccuguag

SEQ ID NO: 652223 - RNA, 19 nt, Homo sapiens
gguggcacucaacucugag

SEQ ID NO: 652224 - RNA, 21 nt, Homo sapiens
gguggccacuucauuccagca

SEQ ID NO: 652225 - RNA, 15 nt, Homo sapiens
gguggcccugugccu

SEQ ID NO: 652226 - RNA, 19 nt, Homo sapiens
gguggcccuugcaguucag

SEQ ID NO: 652227 - RNA, 19 nt, Homo sapiens
gguggccgcugaguggcag

SEQ ID NO: 652228 - RNA, 14 nt, Homo sapiens
gguggccugggauc

SEQ ID NO: 652229 - RNA, 14 nt, Homo sapiens
gguggcucaugccu

SEQ ID NO: 652230 - RNA, 14 nt, Homo sapiens
ggugggacagggac

SEQ ID NO: 652231 - RNA, 15 nt, Homo sapiens
ggugggauuccacuc

SEQ ID NO: 652232 - RNA, 16 nt, Homo sapiens
ggugggcccccaauga

SEQ ID NO: 652233 - RNA, 22 nt, Homo sapiens
ggugggcccccaaugacaccca

SEQ ID NO: 652234 - RNA, 14 nt, Homo sapiens
ggugggggugggca

SEQ ID NO: 652235 - RNA, 15 nt, Homo sapiens
ggugggguacuggag

SEQ ID NO: 652236 - RNA, 11 nt, Homo sapiens
ggugggguccu

SEQ ID NO: 652237 - RNA, 12 nt, Homo sapiens
gguggggugcac

SEQ ID NO: 652238 - RNA, 19 nt, Homo sapiens
gguggguguggccagcaca

SEQ ID NO: 652239 - RNA, 15 nt, Homo sapiens
ggugggugugggaca

SEQ ID NO: 652240 - RNA, 16 nt, Homo sapiens
ggugguaagcaccagg

SEQ ID NO: 652241 - RNA, 24 nt, Homo sapiens
gguguagaugggggaacugugaau

SEQ ID NO: 652242 - RNA, 20 nt, Homo sapiens
gguguagccagguauggcuc

SEQ ID NO: 652243 - RNA, 20 nt, Homo sapiens
gguguauccuggcccugggg

SEQ ID NO: 652244 - RNA, 20 nt, Homo sapiens
ggugucauucugccugcucc

SEQ ID NO: 652245 - RNA, 16 nt, Homo sapiens
gguguccaccaucccc

SEQ ID NO: 652246 - RNA, 13 nt, Homo sapiens
ggugucugugaag

SEQ ID NO: 652247 - RNA, 15 nt, Homo sapiens
ggugugaaagucaga

SEQ ID NO: 652248 - RNA, 18 nt, Homo sapiens
ggugugaagaaagccaga

SEQ ID NO: 652249 - RNA, 21 nt, Homo sapiens
ggugugaccauguucauuaua

SEQ ID NO: 652250 - RNA, 18 nt, Homo sapiens
ggugugggaagaccaaag

SEQ ID NO: 652251 - RNA, 15 nt, Homo sapiens
ggugugggggcugca

SEQ ID NO: 652252 - RNA, 18 nt, Homo sapiens
ggugugugugccauguca

SEQ ID NO: 652253 - RNA, 21 nt, Homo sapiens
gguguuccuagaaugcagcug

SEQ ID NO: 652254 - RNA, 16 nt, Homo sapiens
gguguucuucuuccca

SEQ ID NO: 652255 - RNA, 17 nt, Homo sapiens
gguguuguaugccuuua

SEQ ID NO: 652256 - RNA, 16 nt, Homo sapiens
gguguuuuaagacuga

SEQ ID NO: 652257 - RNA, 14 nt, Homo sapiens
gguuaaaaaggcca

SEQ ID NO: 652258 - RNA, 15 nt, Homo sapiens
gguuaacaccuucau

SEQ ID NO: 652259 - RNA, 15 nt, Homo sapiens
gguuaaggccugaau

SEQ ID NO: 652260 - RNA, 17 nt, Homo sapiens
gguuaauuucugucaaa

SEQ ID NO: 652261 - RNA, 12 nt, Homo sapiens
gguuacaaagac

SEQ ID NO: 652262 - RNA, 20 nt, Homo sapiens
gguuacuaagaugaaauugc

SEQ ID NO: 652263 - RNA, 14 nt, Homo sapiens
gguuacuauuucuu

SEQ ID NO: 652264 - RNA, 20 nt, Homo sapiens
gguuagaaaaaggacucugc

SEQ ID NO: 652265 - RNA, 15 nt, Homo sapiens
uaaaaaagcaaaaac

SEQ ID NO: 652266 - RNA, 15 nt, Homo sapiens
uaaaaaagccuuccu

SEQ ID NO: 652267 - RNA, 14 nt, Homo sapiens
uaaaaaauagacau

SEQ ID NO: 652268 - RNA, 19 nt, Homo sapiens
uaaaaaauuaugacaaugu

SEQ ID NO: 652269 - RNA, 16 nt, Homo sapiens
uaaaaacaagauggag

SEQ ID NO: 652270 - RNA, 15 nt, Homo sapiens
uaaaaacagauucug

SEQ ID NO: 652271 - RNA, 19 nt, Homo sapiens
uaaaaacaguugccaguga

SEQ ID NO: 652272 - RNA, 20 nt, Homo sapiens
uaaaaacaguuuuccaaaua

SEQ ID NO: 652273 - RNA, 15 nt, Homo sapiens
uaaaaacauugccuu

SEQ ID NO: 652274 - RNA, 23 nt, Homo sapiens
uaaaaacccuguauggcacuuau

SEQ ID NO: 652275 - RNA, 12 nt, Homo sapiens
uaaaaaccgaau

SEQ ID NO: 652276 - RNA, 15 nt, Homo sapiens
uaaaaacucuuauaa

SEQ ID NO: 652277 - RNA, 21 nt, Homo sapiens
uaaaaacuguuuaccacuguu

SEQ ID NO: 652278 - RNA, 23 nt, Homo sapiens
uaaaaacuuccuucaaucuucau

SEQ ID NO: 652279 - RNA, 23 nt, Homo sapiens
uaaaaagaaacagaaaugaccac

SEQ ID NO: 652280 - RNA, 20 nt, Homo sapiens
uaaaaagaagagacugcuac

SEQ ID NO: 652281 - RNA, 17 nt, Homo sapiens
uaaaaagauagacuuca

SEQ ID NO: 652282 - RNA, 18 nt, Homo sapiens
uaaaaagcagcugcauuu

SEQ ID NO: 652283 - RNA, 12 nt, Homo sapiens
uaaaaaggaaua

SEQ ID NO: 652284 - RNA, 23 nt, Homo sapiens
uaaaaaggaccagagaauucuua

SEQ ID NO: 652285 - RNA, 17 nt, Homo sapiens
uaaaaaggcaguuugca

SEQ ID NO: 652286 - RNA, 12 nt, Homo sapiens
uaaaaaggccaa

SEQ ID NO: 652287 - RNA, 13 nt, Homo sapiens
uaaaaagguuuaa

SEQ ID NO: 652288 - RNA, 12 nt, Homo sapiens
uaaaaagucugu

SEQ ID NO: 652289 - RNA, 16 nt, Homo sapiens
uaaaaagugaacaguu

SEQ ID NO: 652290 - RNA, 20 nt, Homo sapiens
uaaaaagugacacagcagcu

SEQ ID NO: 652291 - RNA, 18 nt, Homo sapiens
uaaaaauaaaaaacauau

SEQ ID NO: 652292 - RNA, 16 nt, Homo sapiens
uaaaaauacaaaaaau

SEQ ID NO: 652293 - RNA, 19 nt, Homo sapiens
uaaaaauacaacacugagc

SEQ ID NO: 652294 - RNA, 17 nt, Homo sapiens
uaaaaauagucuuccac

SEQ ID NO: 652295 - RNA, 19 nt, Homo sapiens
uaaaaauauaaauuguaca

SEQ ID NO: 652296 - RNA, 15 nt, Homo sapiens
uaaaaaugagugcuu

SEQ ID NO: 652297 - RNA, 19 nt, Homo sapiens
uaaaaaugcugcucucagc

SEQ ID NO: 652298 - RNA, 11 nt, Homo sapiens
uaaaaauggaa

SEQ ID NO: 652299 - RNA, 13 nt, Homo sapiens
uaaaaauuagcug

SEQ ID NO: 652300 - RNA, 15 nt, Homo sapiens
uaaaaauugugauca

SEQ ID NO: 652301 - RNA, 23 nt, Homo sapiens
uaaaaauugugaucagaccauaa

SEQ ID NO: 652302 - RNA, 21 nt, Homo sapiens
uaaaaauuguuuuaaacuaca

SEQ ID NO: 652303 - RNA, 19 nt, Homo sapiens
uaaaaauuuauaagcauuu

SEQ ID NO: 652304 - RNA, 20 nt, Homo sapiens
uaaaaauuuauaagcauuug

SEQ ID NO: 652305 - RNA, 15 nt, Homo sapiens
uaaaacaaaaccaac

SEQ ID NO: 652306 - RNA, 22 nt, Homo sapiens
uaaaacaaauaaauuagucucu

SEQ ID NO: 652307 - RNA, 17 nt, Homo sapiens
uaaaacaagugugaugc

SEQ ID NO: 652308 - RNA, 12 nt, Homo sapiens
uaaaacaauucu

SEQ ID NO: 652309 - RNA, 15 nt, Homo sapiens
uaaaacacauauuca

SEQ ID NO: 652310 - RNA, 13 nt, Homo sapiens
uaaaacagaaucu

SEQ ID NO: 652311 - RNA, 21 nt, Homo sapiens
uaaaacagguuauaacagugu

SEQ ID NO: 652312 - RNA, 13 nt, Homo sapiens
uaaaacaguauuc

SEQ ID NO: 652313 - RNA, 12 nt, Homo sapiens
uaaaacauagca

SEQ ID NO: 652314 - RNA, 14 nt, Homo sapiens
uaaaacauagcaaa

SEQ ID NO: 652315 - RNA, 23 nt, Homo sapiens
uaaaacaugcugaaaacuacaca

SEQ ID NO: 652316 - RNA, 15 nt, Homo sapiens
uaaaacauuaagaaa

SEQ ID NO: 652317 - RNA, 19 nt, Homo sapiens
uaaaacauugaaugaaacu

SEQ ID NO: 652318 - RNA, 17 nt, Homo sapiens
uaaaacauuggcauuug

SEQ ID NO: 652319 - RNA, 13 nt, Homo sapiens
uaaaacauuugaa

SEQ ID NO: 652320 - RNA, 17 nt, Homo sapiens
uaaaaccagcauacagu

SEQ ID NO: 652321 - RNA, 18 nt, Homo sapiens
uaaaacccaaaacaguaa

SEQ ID NO: 652322 - RNA, 16 nt, Homo sapiens
uaaaacccaagugccu

SEQ ID NO: 652323 - RNA, 21 nt, Homo sapiens
uaaaaccccaucucuacuaaa

SEQ ID NO: 652324 - RNA, 22 nt, Homo sapiens
uaaaaccccaucucuacuaaaa

SEQ ID NO: 652325 - RNA, 17 nt, Homo sapiens
uaaaaccuugaaggucu

SEQ ID NO: 652326 - RNA, 16 nt, Homo sapiens
uaaaacgcaugugcag

SEQ ID NO: 652327 - RNA, 14 nt, Homo sapiens
uaaaacuaagcaca

SEQ ID NO: 652328 - RNA, 17 nt, Homo sapiens
uaaaacuacacaucccu

SEQ ID NO: 652329 - RNA, 20 nt, Homo sapiens
uaaaacuagugacagcuugu

SEQ ID NO: 652330 - RNA, 19 nt, Homo sapiens
uaaaacuaugguucccaau

SEQ ID NO: 652331 - RNA, 15 nt, Homo sapiens
uaaaacugaaucuca

SEQ ID NO: 652332 - RNA, 16 nt, Homo sapiens
uaaaacugauguuacu

SEQ ID NO: 652333 - RNA, 19 nt, Homo sapiens
uaaaacugcacagugcugu

SEQ ID NO: 652334 - RNA, 19 nt, Homo sapiens
uaaaacugccuuucuggug

SEQ ID NO: 652335 - RNA, 17 nt, Homo sapiens
uaaaacuuaacauucau

SEQ ID NO: 652336 - RNA, 16 nt, Homo sapiens
uaaaacuucaguuuca

SEQ ID NO: 652337 - RNA, 12 nt, Homo sapiens
uaaaacuuuccu

SEQ ID NO: 652338 - RNA, 20 nt, Homo sapiens
uaaaagaacuuacugauuau

SEQ ID NO: 652339 - RNA, 15 nt, Homo sapiens
uaaaagaaugacuau

SEQ ID NO: 652340 - RNA, 11 nt, Homo sapiens
uaaaagacagc

SEQ ID NO: 652341 - RNA, 12 nt, Homo sapiens
uaaaagacauua

SEQ ID NO: 652342 - RNA, 18 nt, Homo sapiens
uaaaagagaagcaucauu

SEQ ID NO: 652343 - RNA, 18 nt, Homo sapiens
uaaaagaggaaaagccaa

SEQ ID NO: 652344 - RNA, 15 nt, Homo sapiens
uaaaagaucuugaau

SEQ ID NO: 652345 - RNA, 16 nt, Homo sapiens
uaaaagaucuugaaua

SEQ ID NO: 652346 - RNA, 17 nt, Homo sapiens
uaaaagaucuugaauag

SEQ ID NO: 652347 - RNA, 20 nt, Homo sapiens
uaaaagaugaaggcuguauc

SEQ ID NO: 652348 - RNA, 17 nt, Homo sapiens
uaaaagaugaauuccua

SEQ ID NO: 652349 - RNA, 17 nt, Homo sapiens
uaaaagaugauuucuca

SEQ ID NO: 652350 - RNA, 18 nt, Homo sapiens
uaaaagaugauuucucaa

SEQ ID NO: 652351 - RNA, 19 nt, Homo sapiens
uaaaagaugauuucucaaa

SEQ ID NO: 652352 - RNA, 19 nt, Homo sapiens
uaaaagaugguaaaccaga

SEQ ID NO: 652353 - RNA, 22 nt, Homo sapiens
uaaaagcaauucugacugucca

SEQ ID NO: 652354 - RNA, 15 nt, Homo sapiens
uaaaagcacacuccc

SEQ ID NO: 652355 - RNA, 19 nt, Homo sapiens
uaaaagcagcaucugcuaa

SEQ ID NO: 652356 - RNA, 18 nt, Homo sapiens
uaaaagcgaccucucuug

SEQ ID NO: 652357 - RNA, 13 nt, Homo sapiens
uaaaagcuaucuu

SEQ ID NO: 652358 - RNA, 15 nt, Homo sapiens
uaaaagcuugaugaa

SEQ ID NO: 652359 - RNA, 16 nt, Homo sapiens
uaaaagcuuucugcca

SEQ ID NO: 652360 - RNA, 16 nt, Homo sapiens
uaaaaggaaucuggca

SEQ ID NO: 652361 - RNA, 23 nt, Homo sapiens
uaaaaggacucuccaaauagcau

SEQ ID NO: 652362 - RNA, 19 nt, Homo sapiens
uaaaaggcaaauguguaca

SEQ ID NO: 652363 - RNA, 16 nt, Homo sapiens
uaaaagguaauaacau

SEQ ID NO: 652364 - RNA, 21 nt, Homo sapiens
uaaaagguuaauuucugucaa

SEQ ID NO: 652365 - RNA, 22 nt, Homo sapiens
uaauccccaucauuacugguaa

SEQ ID NO: 652366 - RNA, 14 nt, Homo sapiens
uaauccuaccucaa

SEQ ID NO: 652367 - RNA, 19 nt, Homo sapiens
uaaucgauuugucugucaa

SEQ ID NO: 652368 - RNA, 16 nt, Homo sapiens
uaaucgcucuuuucca

SEQ ID NO: 652369 - RNA, 21 nt, Homo sapiens
uaaucuacuguaaaguacucu

SEQ ID NO: 652370 - RNA, 14 nt, Homo sapiens
uaaucucacauuca

SEQ ID NO: 652371 - RNA, 18 nt, Homo sapiens
uaaucuccucugcucauu

SEQ ID NO: 652372 - RNA, 13 nt, Homo sapiens
uaaucucucagcu

SEQ ID NO: 652373 - RNA, 17 nt, Homo sapiens
uaaucucucugcagcug

SEQ ID NO: 652374 - RNA, 19 nt, Homo sapiens
uaaucucuuaauauugaga

SEQ ID NO: 652375 - RNA, 16 nt, Homo sapiens
uaaucugcaugaagga

SEQ ID NO: 652376 - RNA, 16 nt, Homo sapiens
uaaucugcugccauau

SEQ ID NO: 652377 - RNA, 19 nt, Homo sapiens
uaaucuuauuuauaccuca

SEQ ID NO: 652378 - RNA, 19 nt, Homo sapiens
uaaucuuccauacuucuuc

SEQ ID NO: 652379 - RNA, 21 nt, Homo sapiens
uaaucuucugccuucucauga

SEQ ID NO: 652380 - RNA, 17 nt, Homo sapiens
uaaugaaaaacuauguc

SEQ ID NO: 652381 - RNA, 15 nt, Homo sapiens
uaaugaaaaugaaua

SEQ ID NO: 652382 - RNA, 20 nt, Homo sapiens
uaaugaaaaugaauaucuau

SEQ ID NO: 652383 - RNA, 23 nt, Homo sapiens
uaaugaaaaugaauaucuauuaa

SEQ ID NO: 652384 - RNA, 15 nt, Homo sapiens
uaaugaaaaugucag

SEQ ID NO: 652385 - RNA, 15 nt, Homo sapiens
uaaugaaauggagga

SEQ ID NO: 652386 - RNA, 13 nt, Homo sapiens
uaaugaacaugug

SEQ ID NO: 652387 - RNA, 15 nt, Homo sapiens
uaaugaaggugccau

SEQ ID NO: 652388 - RNA, 16 nt, Homo sapiens
uaaugaauacauuucc

SEQ ID NO: 652389 - RNA, 14 nt, Homo sapiens
uaaugacaacacuu

SEQ ID NO: 652390 - RNA, 13 nt, Homo sapiens
uaaugacauuccc

SEQ ID NO: 652391 - RNA, 16 nt, Homo sapiens
uaaugagacugaccau

SEQ ID NO: 652392 - RNA, 22 nt, Homo sapiens
uaaugagagaaaauguuuugaa

SEQ ID NO: 652393 - RNA, 16 nt, Homo sapiens
uaaugagccaucacua

SEQ ID NO: 652394 - RNA, 22 nt, Homo sapiens
uaaugaguaacaucuacuuagu

SEQ ID NO: 652395 - RNA, 14 nt, Homo sapiens
uaaugaucacauuc

SEQ ID NO: 652396 - RNA, 19 nt, Homo sapiens
uaaugauuguuugucaaua

SEQ ID NO: 652397 - RNA, 16 nt, Homo sapiens
uaaugcaagcaaagua

SEQ ID NO: 652398 - RNA, 17 nt, Homo sapiens
uaaugccauaggugaga

SEQ ID NO: 652399 - RNA, 20 nt, Homo sapiens
uaaugcuacugucucacuga

SEQ ID NO: 652400 - RNA, 14 nt, Homo sapiens
uaaugcucucaggg

SEQ ID NO: 652401 - RNA, 21 nt, Homo sapiens
uaaugcugaaacaucauuaca

SEQ ID NO: 652402 - RNA, 13 nt, Homo sapiens
uaaugcugcagga

SEQ ID NO: 652403 - RNA, 15 nt, Homo sapiens
uaaugcugucuuugu

SEQ ID NO: 652404 - RNA, 17 nt, Homo sapiens
uaaugcuguugccucau

SEQ ID NO: 652405 - RNA, 15 nt, Homo sapiens
uaaugcuuccaggga

SEQ ID NO: 652406 - RNA, 21 nt, Homo sapiens
uaauggaaacauuuacaauaa

SEQ ID NO: 652407 - RNA, 13 nt, Homo sapiens
uaauggaaaccaa

SEQ ID NO: 652408 - RNA, 14 nt, Homo sapiens
uaauggaaugaagg

SEQ ID NO: 652409 - RNA, 19 nt, Homo sapiens
uaauggagcaucaagccac

SEQ ID NO: 652410 - RNA, 16 nt, Homo sapiens
uaauggcacugagaaa

SEQ ID NO: 652411 - RNA, 12 nt, Homo sapiens
uaauggcauuuu

SEQ ID NO: 652412 - RNA, 17 nt, Homo sapiens
uaauggcuaguacugua

SEQ ID NO: 652413 - RNA, 18 nt, Homo sapiens
uaauggcuaguacuguau

SEQ ID NO: 652414 - RNA, 19 nt, Homo sapiens
uaauggcucaugaccugga

SEQ ID NO: 652415 - RNA, 17 nt, Homo sapiens
uaauggggacacagauc

SEQ ID NO: 652416 - RNA, 12 nt, Homo sapiens
uaauggguuuau

SEQ ID NO: 652417 - RNA, 23 nt, Homo sapiens
uaauggucacaauaaaugccacu

SEQ ID NO: 652418 - RNA, 16 nt, Homo sapiens
uaaugguugacugggu

SEQ ID NO: 652419 - RNA, 14 nt, Homo sapiens
uaauguaaaaccca

SEQ ID NO: 652420 - RNA, 15 nt, Homo sapiens
uaauguaauuguaau

SEQ ID NO: 652421 - RNA, 21 nt, Homo sapiens
uaauguacaauaaagcaaugu

SEQ ID NO: 652422 - RNA, 18 nt, Homo sapiens
uaauguacacauugcauu

SEQ ID NO: 652423 - RNA, 20 nt, Homo sapiens
uaauguacacauugcauuuu

SEQ ID NO: 652424 - RNA, 14 nt, Homo sapiens
uaauguacaucugg

SEQ ID NO: 652425 - RNA, 14 nt, Homo sapiens
uaauguacuguaca

SEQ ID NO: 652426 - RNA, 17 nt, Homo sapiens
uaauguauuaugagcca

SEQ ID NO: 652427 - RNA, 19 nt, Homo sapiens
uaauguauuuguuugcaau

SEQ ID NO: 652428 - RNA, 16 nt, Homo sapiens
uaaugucuucacucua

SEQ ID NO: 652429 - RNA, 11 nt, Homo sapiens
uaaugugaagg

SEQ ID NO: 652430 - RNA, 23 nt, Homo sapiens
uaaugugaaguagaauccuaaau

SEQ ID NO: 652431 - RNA, 23 nt, Homo sapiens
uaaugugcaaauuuugcauuuag

SEQ ID NO: 652432 - RNA, 12 nt, Homo sapiens
uaauguguuucu

SEQ ID NO: 652433 - RNA, 15 nt, Homo sapiens
uaauguuaauucagc

SEQ ID NO: 652434 - RNA, 22 nt, Homo sapiens
uaauguuccugaaaauugcaau

SEQ ID NO: 652435 - RNA, 22 nt, Homo sapiens
uaauguugauuuuaauccugua

SEQ ID NO: 652436 - RNA, 20 nt, Homo sapiens
uaauguuguaauucaugcca

SEQ ID NO: 652437 - RNA, 12 nt, Homo sapiens
uaauuaacaaua

SEQ ID NO: 652438 - RNA, 14 nt, Homo sapiens
uaauuaauauucau

SEQ ID NO: 652439 - RNA, 14 nt, Homo sapiens
uaauuacagccuua

SEQ ID NO: 652440 - RNA, 16 nt, Homo sapiens
uaauuacauauuugac

SEQ ID NO: 652441 - RNA, 18 nt, Homo sapiens
uaauuaccaaccuguuac

SEQ ID NO: 652442 - RNA, 16 nt, Homo sapiens
uaauuacccuuuugca

SEQ ID NO: 652443 - RNA, 14 nt, Homo sapiens
uaauuacuucacua

SEQ ID NO: 652444 - RNA, 19 nt, Homo sapiens
uaauuagaucaauuacuua

SEQ ID NO: 652445 - RNA, 14 nt, Homo sapiens
uaauuauuuugaca

SEQ ID NO: 652446 - RNA, 16 nt, Homo sapiens
uaauucaacccagcca

SEQ ID NO: 652447 - RNA, 13 nt, Homo sapiens
uaauucaauguga

SEQ ID NO: 652448 - RNA, 14 nt, Homo sapiens
uaauucagcacuua

SEQ ID NO: 652449 - RNA, 19 nt, Homo sapiens
uaauucaguacaacccaua

SEQ ID NO: 652450 - RNA, 23 nt, Homo sapiens
uaauucaugguuguuccaaagau

SEQ ID NO: 652451 - RNA, 17 nt, Homo sapiens
uaauucauugugauuua

SEQ ID NO: 652452 - RNA, 19 nt, Homo sapiens
uaauucauuugguucaaau

SEQ ID NO: 652453 - RNA, 19 nt, Homo sapiens
uaauuccacaggucaucag

SEQ ID NO: 652454 - RNA, 22 nt, Homo sapiens
uaauuccccaagaggucccaag

SEQ ID NO: 652455 - RNA, 16 nt, Homo sapiens
uaauuccugaucuucc

SEQ ID NO: 652456 - RNA, 18 nt, Homo sapiens
uaauuccuguuacuuuac

SEQ ID NO: 652457 - RNA, 20 nt, Homo sapiens
uaauuccuguuacuuuacag

SEQ ID NO: 652458 - RNA, 20 nt, Homo sapiens
uaauucuuauuuaaguuauu

SEQ ID NO: 652459 - RNA, 13 nt, Homo sapiens
uaauugaucagau

SEQ ID NO: 652460 - RNA, 13 nt, Homo sapiens
uaauugauuucaa

SEQ ID NO: 652461 - RNA, 14 nt, Homo sapiens
uaauugauuucaag

SEQ ID NO: 652462 - RNA, 19 nt, Homo sapiens
uaauugcagucuaauguca

SEQ ID NO: 652463 - RNA, 13 nt, Homo sapiens
uaauugcauuuaa

SEQ ID NO: 652464 - RNA, 22 nt, Homo sapiens
uaauugcauuucugcucuucca

SEQ ID NO: 652465 - RNA, 15 nt, Homo sapiens
uaauugccagcaaau

SEQ ID NO: 652466 - RNA, 22 nt, Homo sapiens
uaauugccuagaaauaucuuuc

SEQ ID NO: 652467 - RNA, 16 nt, Homo sapiens
uaauugcuuacauuuu

SEQ ID NO: 652468 - RNA, 14 nt, Homo sapiens
uaauugcuuugaag

SEQ ID NO: 652469 - RNA, 21 nt, Homo sapiens
uaauuggaagaaauuccugua

SEQ ID NO: 652470 - RNA, 15 nt, Homo sapiens
uaauuggaagugcag

SEQ ID NO: 652471 - RNA, 21 nt, Homo sapiens
uaauuggaaucuucaccucag

SEQ ID NO: 652472 - RNA, 18 nt, Homo sapiens
uaauuggccaugucgcca

SEQ ID NO: 652473 - RNA, 20 nt, Homo sapiens
uacagacagaaggugcuaag

SEQ ID NO: 652474 - RNA, 15 nt, Homo sapiens
uacagacagacauac

SEQ ID NO: 652475 - RNA, 21 nt, Homo sapiens
uacagacuccaaaaggcccuu

SEQ ID NO: 652476 - RNA, 16 nt, Homo sapiens
uacagacugaugccag

SEQ ID NO: 652477 - RNA, 21 nt, Homo sapiens
uacagacugcagacauucuca

SEQ ID NO: 652478 - RNA, 13 nt, Homo sapiens
uacagacugugag

SEQ ID NO: 652479 - RNA, 19 nt, Homo sapiens
uacagaggggccaggggau

SEQ ID NO: 652480 - RNA, 21 nt, Homo sapiens
uacagauagaaaauaugauau

SEQ ID NO: 652481 - RNA, 15 nt, Homo sapiens
uacagauagauauau

SEQ ID NO: 652482 - RNA, 20 nt, Homo sapiens
uacagauagauauaugcucu

SEQ ID NO: 652483 - RNA, 17 nt, Homo sapiens
uacagauauuugucaug

SEQ ID NO: 652484 - RNA, 13 nt, Homo sapiens
uacagaugggcaa

SEQ ID NO: 652485 - RNA, 14 nt, Homo sapiens
uacagcacuacucu

SEQ ID NO: 652486 - RNA, 13 nt, Homo sapiens
ucccugggcauug

SEQ ID NO: 652487 - RNA, 20 nt, Homo sapiens
ucccugggccuuagguuuga

SEQ ID NO: 652488 - RNA, 16 nt, Homo sapiens
ucccugggcugugcua

SEQ ID NO: 652489 - RNA, 18 nt, Homo sapiens
ucccuggggcacuuucau

SEQ ID NO: 652490 - RNA, 13 nt, Homo sapiens
ucccugggggccu

SEQ ID NO: 652491 - RNA, 20 nt, Homo sapiens
ucccugggguuuacugaggu

SEQ ID NO: 652492 - RNA, 19 nt, Homo sapiens
ucccuggucccucguccac

SEQ ID NO: 652493 - RNA, 17 nt, Homo sapiens
ucccuggucucugccag

SEQ ID NO: 652494 - RNA, 21 nt, Homo sapiens
ucccuggugccucugugcaca

SEQ ID NO: 652495 - RNA, 22 nt, Homo sapiens
ucccugguugccucucuugccc

SEQ ID NO: 652496 - RNA, 14 nt, Homo sapiens
ucccuguaaccucu

SEQ ID NO: 652497 - RNA, 21 nt, Homo sapiens
ucccuguaauuguuguuugua

SEQ ID NO: 652498 - RNA, 22 nt, Homo sapiens
ucccuguacaguagauuuucca

SEQ ID NO: 652499 - RNA, 19 nt, Homo sapiens
ucccugucacacacuggac

SEQ ID NO: 652500 - RNA, 23 nt, Homo sapiens
ucccugucaggacacauggauuu

SEQ ID NO: 652501 - RNA, 18 nt, Homo sapiens
ucccugucauuuuuaaca

SEQ ID NO: 652502 - RNA, 20 nt, Homo sapiens
ucccugucccucuagugccu

SEQ ID NO: 652503 - RNA, 14 nt, Homo sapiens
cuuucaccuuucua

SEQ ID NO: 652504 - RNA, 17 nt, Homo sapiens
cuuucacgggccccauu

SEQ ID NO: 652505 - RNA, 18 nt, Homo sapiens
cuuucacggggccgugac

SEQ ID NO: 652506 - RNA, 10 nt, Homo sapiens
cuuucaggaa

SEQ ID NO: 652507 - RNA, 14 nt, Homo sapiens
cuuucaggacucua

SEQ ID NO: 652508 - RNA, 21 nt, Homo sapiens
cuuucagggguggcccaauga

SEQ ID NO: 652509 - RNA, 19 nt, Homo sapiens
cuuucaggguuuucuaacc

SEQ ID NO: 652510 - RNA, 21 nt, Homo sapiens
cuuucauaccacuugaauuua

SEQ ID NO: 652511 - RNA, 18 nt, Homo sapiens
cuuucauccucaagcuca

SEQ ID NO: 652512 - RNA, 17 nt, Homo sapiens
cuuucaucggugccugg

SEQ ID NO: 652513 - RNA, 18 nt, Homo sapiens
cuuucauucagccuuuag

SEQ ID NO: 652514 - RNA, 21 nt, Homo sapiens
cuuucauuccuucagauuugg

SEQ ID NO: 652515 - RNA, 14 nt, Homo sapiens
cuuuccaaaaccuu

SEQ ID NO: 652516 - RNA, 20 nt, Homo sapiens
cuuuccaaaaggaacucuag

SEQ ID NO: 652517 - RNA, 11 nt, Homo sapiens
cuuuccaagcu

SEQ ID NO: 652518 - RNA, 13 nt, Homo sapiens
cuuuccacuuugu

SEQ ID NO: 652519 - RNA, 19 nt, Homo sapiens
cuuuccauggcaaaugggc

SEQ ID NO: 652520 - RNA, 15 nt, Homo sapiens
cuuuccauguugcug

SEQ ID NO: 652521 - RNA, 18 nt, Homo sapiens
cuuuccauuaaaucaauc

SEQ ID NO: 652522 - RNA, 22 nt, Homo sapiens
cuuucccagaaaaaaaaaaacu

SEQ ID NO: 652523 - RNA, 15 nt, Homo sapiens
cuuucccagucccau

SEQ ID NO: 652524 - RNA, 20 nt, Homo sapiens
cuuucccgggcuguccacua

SEQ ID NO: 652525 - RNA, 20 nt, Homo sapiens
cuuucccuaauacaggguug

SEQ ID NO: 652526 - RNA, 21 nt, Homo sapiens
cuuucccuccuuuucccaaag

SEQ ID NO: 652527 - RNA, 15 nt, Homo sapiens
cuuuccuaaagccaa

SEQ ID NO: 652528 - RNA, 18 nt, Homo sapiens
cuuuccuccccauacaca

SEQ ID NO: 652529 - RNA, 13 nt, Homo sapiens
cuuuccucuagcu

SEQ ID NO: 652530 - RNA, 16 nt, Homo sapiens
cuuuccugacuuacaa

SEQ ID NO: 652531 - RNA, 17 nt, Homo sapiens
cuuuccuuaugucuccu

SEQ ID NO: 652532 - RNA, 17 nt, Homo sapiens
cuuucggggugcuccug

SEQ ID NO: 652533 - RNA, 18 nt, Homo sapiens
cuuucguuuugguuuuca

SEQ ID NO: 652534 - RNA, 15 nt, Homo sapiens
cuuucuaaacuacaa

SEQ ID NO: 652535 - RNA, 13 nt, Homo sapiens
cuuucuaaaucaa

SEQ ID NO: 652536 - RNA, 22 nt, Homo sapiens
cuuucuaggagggagacacugg

SEQ ID NO: 652537 - RNA, 14 nt, Homo sapiens
cuuucuauuugacu

SEQ ID NO: 652538 - RNA, 15 nt, Homo sapiens
cuuucucagccacaa

SEQ ID NO: 652539 - RNA, 12 nt, Homo sapiens
cuuucucucaga

SEQ ID NO: 652540 - RNA, 18 nt, Homo sapiens
cuuucucugccagugaca

SEQ ID NO: 652541 - RNA, 22 nt, Homo sapiens
cuuucucugccagugacagaca

SEQ ID NO: 652542 - RNA, 17 nt, Homo sapiens
cuuucugcacacaaaua

SEQ ID NO: 652543 - RNA, 21 nt, Homo sapiens
cuuucugcaugaccaaaguga

SEQ ID NO: 652544 - RNA, 13 nt, Homo sapiens
cuuucugccuuua

SEQ ID NO: 652545 - RNA, 18 nt, Homo sapiens
cuuucugcuaucaaagag

SEQ ID NO: 652546 - RNA, 20 nt, Homo sapiens
cuuucugugaagcuaauaca

SEQ ID NO: 652547 - RNA, 21 nt, Homo sapiens
cuuucuguguugaagcacugu

SEQ ID NO: 652548 - RNA, 13 nt, Homo sapiens
cuuucuguugaaa

SEQ ID NO: 652549 - RNA, 13 nt, Homo sapiens
cuuucuguugcca

SEQ ID NO: 652550 - RNA, 19 nt, Homo sapiens
cuuucuuagcucaagagag

SEQ ID NO: 652551 - RNA, 14 nt, Homo sapiens
cuuucuuaucccag

SEQ ID NO: 652552 - RNA, 17 nt, Homo sapiens
cuuucuucagcucugaa

SEQ ID NO: 652553 - RNA, 20 nt, Homo sapiens
cuuucuucccuacaguugaa

SEQ ID NO: 652554 - RNA, 21 nt, Homo sapiens
cuuucuuccuccaauccccag

SEQ ID NO: 652555 - RNA, 14 nt, Homo sapiens
cuuucuucuagugc

SEQ ID NO: 652556 - RNA, 16 nt, Homo sapiens
cuuucuucuuuagcaa

SEQ ID NO: 652557 - RNA, 22 nt, Homo sapiens
cuuucuugauugguucuuccaa

SEQ ID NO: 652558 - RNA, 23 nt, Homo sapiens
cuuucuugugcccugggccaaaa

SEQ ID NO: 652559 - RNA, 18 nt, Homo sapiens
cuuucuuuagcaugcuac

SEQ ID NO: 652560 - RNA, 20 nt, Homo sapiens
cuuucuuuccaaaacauuuc

SEQ ID NO: 652561 - RNA, 17 nt, Homo sapiens
cuuucuuuuucuggaaa

SEQ ID NO: 652562 - RNA, 16 nt, Homo sapiens
cuuugaaaacaauuca

SEQ ID NO: 652563 - RNA, 17 nt, Homo sapiens
cuuugaaaacaauucag

SEQ ID NO: 652564 - RNA, 15 nt, Homo sapiens
cuuugaaaacacuac

SEQ ID NO: 652565 - RNA, 12 nt, Homo sapiens
cuuugaaaacug

SEQ ID NO: 652566 - RNA, 20 nt, Homo sapiens
cuuugaaacuccaugcaaac

SEQ ID NO: 652567 - RNA, 11 nt, Homo sapiens
cuuugaaauga

SEQ ID NO: 652568 - RNA, 20 nt, Homo sapiens
cuuugaaauguguuucugua

SEQ ID NO: 652569 - RNA, 15 nt, Homo sapiens
cuuugaagaaaaaga

SEQ ID NO: 652570 - RNA, 22 nt, Homo sapiens
cuuugaagaauauuuguaguua

SEQ ID NO: 652571 - RNA, 23 nt, Homo sapiens
cuuugaagauaguaacuguagau

SEQ ID NO: 652572 - RNA, 22 nt, Homo sapiens
cuuugaauauguaguaucuaua

SEQ ID NO: 652573 - RNA, 22 nt, Homo sapiens
cuuugacacuuuucauaucauu

SEQ ID NO: 652574 - RNA, 14 nt, Homo sapiens
cuuugacaguguuu

SEQ ID NO: 652575 - RNA, 15 nt, Homo sapiens
cuuugacaguguuuu

SEQ ID NO: 652576 - RNA, 20 nt, Homo sapiens
cuuugaccuaaauuauuuac

SEQ ID NO: 652577 - RNA, 20 nt, Homo sapiens
cuuugaccucaaccugugau

SEQ ID NO: 652578 - RNA, 21 nt, Homo sapiens
cuuugagcacacuuuacacaa

SEQ ID NO: 652579 - RNA, 18 nt, Homo sapiens
cuuugagcugagugcuga

SEQ ID NO: 652580 - RNA, 21 nt, Homo sapiens
cuuugauccuucugagcucca

SEQ ID NO: 652581 - RNA, 18 nt, Homo sapiens
cuuugaucuacuugccuc

SEQ ID NO: 652582 - RNA, 17 nt, Homo sapiens
cuuugaucuucagggaa

SEQ ID NO: 652583 - RNA, 20 nt, Homo sapiens
cuuugauucuccaguauucc

SEQ ID NO: 652584 - RNA, 11 nt, Homo sapiens
cuuugcacuug

SEQ ID NO: 652585 - RNA, 14 nt, Homo sapiens
cuuugcauagcuuu

SEQ ID NO: 652586 - RNA, 18 nt, Homo sapiens
cuuugcauagcuuucaca

SEQ ID NO: 652587 - RNA, 19 nt, Homo sapiens
cuuugcauagcuuucacaa

SEQ ID NO: 652588 - RNA, 14 nt, Homo sapiens
cuuugcauggauuu

SEQ ID NO: 652589 - RNA, 19 nt, Homo sapiens
cuuugccacacacaguuac

SEQ ID NO: 652590 - RNA, 17 nt, Homo sapiens
cuuugccuucauucugc

SEQ ID NO: 652591 - RNA, 16 nt, Homo sapiens
cuuugccuuuaggggu

SEQ ID NO: 652592 - RNA, 19 nt, Homo sapiens
cuuugcgcagcccuaccuu

SEQ ID NO: 652593 - RNA, 19 nt, Homo sapiens
cuuugcuaaugcuaugcaa

SEQ ID NO: 652594 - RNA, 14 nt, Homo sapiens
cuuugcucccugca

SEQ ID NO: 652595 - RNA, 17 nt, Homo sapiens
cuuugcucccugcaaga

SEQ ID NO: 652596 - RNA, 17 nt, Homo sapiens
cuuugcugcauuuuaca

SEQ ID NO: 652597 - RNA, 19 nt, Homo sapiens
cuuugcugcauuuuacaca

SEQ ID NO: 652598 - RNA, 12 nt, Homo sapiens
cuuugcugccag

SEQ ID NO: 652599 - RNA, 17 nt, Homo sapiens
cuuugcugcugcucuca

SEQ ID NO: 652600 - RNA, 18 nt, Homo sapiens
cuuugcugcuggugcuaa

SEQ ID NO: 652601 - RNA, 20 nt, Homo sapiens
cuuugcugcuggugcuaaaa

SEQ ID NO: 652602 - RNA, 12 nt, Homo sapiens
cuuuggaaaaua

SEQ ID NO: 652603 - RNA, 19 nt, Homo sapiens
cuuuggaaucuaaccacuu

SEQ ID NO: 652604 - RNA, 18 nt, Homo sapiens
cuuuggacauggaaagaa

SEQ ID NO: 652605 - RNA, 19 nt, Homo sapiens
cuuuggaccuaauccaagc

SEQ ID NO: 652606 - RNA, 17 nt, Homo sapiens
cuuuggagaugcugagg

SEQ ID NO: 652607 - RNA, 19 nt, Homo sapiens
cuuuggaggggaaaugggg

SEQ ID NO: 652608 - RNA, 20 nt, Homo sapiens
cuuuggcaaaacuuaggcau

SEQ ID NO: 652609 - RNA, 15 nt, Homo sapiens
cuuuggccauuccaa

SEQ ID NO: 652610 - RNA, 17 nt, Homo sapiens
cuuuggccccacuuuga

SEQ ID NO: 652611 - RNA, 21 nt, Homo sapiens
cuuuggccccuggacuauggu

SEQ ID NO: 652612 - RNA, 22 nt, Homo sapiens
cuuuggcccuauuuaaggcaga

SEQ ID NO: 652613 - RNA, 15 nt, Homo sapiens
cuuuggccugugagc

SEQ ID NO: 652614 - RNA, 19 nt, Homo sapiens
cuuuggccugugagccauu

SEQ ID NO: 652615 - RNA, 22 nt, Homo sapiens
cuuuggggagcaggaggccaau

SEQ ID NO: 652616 - RNA, 21 nt, Homo sapiens
cuuugguccccagcauugcag

SEQ ID NO: 652617 - RNA, 16 nt, Homo sapiens
cuuugguggcauggaa

SEQ ID NO: 652618 - RNA, 20 nt, Homo sapiens
cuuuguaauaucuaaaaacu

SEQ ID NO: 652619 - RNA, 17 nt, Homo sapiens
cuuuguaauauuuucca

SEQ ID NO: 652620 - RNA, 14 nt, Homo sapiens
cuuuguauauuaca

SEQ ID NO: 652621 - RNA, 15 nt, Homo sapiens
cuuuguauuccuuaa

SEQ ID NO: 652622 - RNA, 11 nt, Homo sapiens
cuuugucacaa

SEQ ID NO: 652623 - RNA, 17 nt, Homo sapiens
cuuugucgugguucuua

SEQ ID NO: 652624 - RNA, 12 nt, Homo sapiens
cuuugucugucg

SEQ ID NO: 652625 - RNA, 13 nt, Homo sapiens
gcauucaaauggg

SEQ ID NO: 652626 - RNA, 14 nt, Homo sapiens
gcauuccagccuug

SEQ ID NO: 652627 - RNA, 20 nt, Homo sapiens
gcauuccaucccuuccugaa

SEQ ID NO: 652628 - RNA, 14 nt, Homo sapiens
gcauuccucaucac

SEQ ID NO: 652629 - RNA, 14 nt, Homo sapiens
gcauuccugaaggg

SEQ ID NO: 652630 - RNA, 15 nt, Homo sapiens
gcauuccugaugacc

SEQ ID NO: 652631 - RNA, 18 nt, Homo sapiens
gcauuccuuacuugcacu

SEQ ID NO: 652632 - RNA, 19 nt, Homo sapiens
gcauucucaauacuugaau

SEQ ID NO: 652633 - RNA, 22 nt, Homo sapiens
gcauucucguauccaacccaag

SEQ ID NO: 652634 - RNA, 19 nt, Homo sapiens
gcauucuucugagcacugu

SEQ ID NO: 652635 - RNA, 22 nt, Homo sapiens
gcauugaauauauuauaaucuu

SEQ ID NO: 652636 - RNA, 20 nt, Homo sapiens
gcauugagccaguggugcua

SEQ ID NO: 652637 - RNA, 12 nt, Homo sapiens
gcauugcacuug

SEQ ID NO: 652638 - RNA, 14 nt, Homo sapiens
gcauugcauggaca

SEQ ID NO: 652639 - RNA, 23 nt, Homo sapiens
gcauugcugauuuugucugccca

SEQ ID NO: 652640 - RNA, 16 nt, Homo sapiens
gcauuggugacucacu

SEQ ID NO: 652641 - RNA, 21 nt, Homo sapiens
gcauuguugagguggucugaa

SEQ ID NO: 652642 - RNA, 21 nt, Homo sapiens
gcauuuaaaaggacugcugau

SEQ ID NO: 652643 - RNA, 19 nt, Homo sapiens
gcauuuaaauuugauuucc

SEQ ID NO: 652644 - RNA, 14 nt, Homo sapiens
gcauuuaagaguga

SEQ ID NO: 652645 - RNA, 12 nt, Homo sapiens
gcauuuacuuuu

SEQ ID NO: 652646 - RNA, 15 nt, Homo sapiens
gcauuuaugaugcag

SEQ ID NO: 652647 - RNA, 22 nt, Homo sapiens
gcauuuauggucaacacuuaag

SEQ ID NO: 652648 - RNA, 15 nt, Homo sapiens
gcauuuccagccuau

SEQ ID NO: 652649 - RNA, 18 nt, Homo sapiens
gcauuuccuggucagugg

SEQ ID NO: 652650 - RNA, 19 nt, Homo sapiens
gcauuucuuuucuggccaa

SEQ ID NO: 652651 - RNA, 15 nt, Homo sapiens
gcauuugaggggcca

SEQ ID NO: 652652 - RNA, 11 nt, Homo sapiens
gcauuugccac

SEQ ID NO: 652653 - RNA, 14 nt, Homo sapiens
gcauuugcugguua

SEQ ID NO: 652654 - RNA, 20 nt, Homo sapiens
gcauuugugcccacucucca

SEQ ID NO: 652655 - RNA, 13 nt, Homo sapiens
gcauuuguuugaa

SEQ ID NO: 652656 - RNA, 20 nt, Homo sapiens
gcauuuuaaguaaaagucua

SEQ ID NO: 652657 - RNA, 19 nt, Homo sapiens
gcauuuucuucucugcacu

SEQ ID NO: 652658 - RNA, 14 nt, Homo sapiens
gcauuuuucuggga

SEQ ID NO: 652659 - RNA, 15 nt, Homo sapiens
gcauuuuuugcaagu

SEQ ID NO: 652660 - RNA, 23 nt, Homo sapiens
gcauuuuuuuuuuaugauuuguc

SEQ ID NO: 652661 - RNA, 23 nt, Homo sapiens
gccaaaaauacagccuauaguaa

SEQ ID NO: 652662 - RNA, 14 nt, Homo sapiens
gccaaaaauagcua

SEQ ID NO: 652663 - RNA, 14 nt, Homo sapiens
gccaaaagcugcuc

SEQ ID NO: 652664 - RNA, 20 nt, Homo sapiens
gccaaaagucccucccugcc

SEQ ID NO: 652665 - RNA, 19 nt, Homo sapiens
gccaaaaugacuuugaacu

SEQ ID NO: 652666 - RNA, 18 nt, Homo sapiens
gccaaaccacaagacucu

SEQ ID NO: 652667 - RNA, 21 nt, Homo sapiens
gccaaaccuguguaggcauuu

SEQ ID NO: 652668 - RNA, 20 nt, Homo sapiens
gccaaaguuuucaaacugcu

SEQ ID NO: 652669 - RNA, 21 nt, Homo sapiens
gccaaauaggagggagacugu

SEQ ID NO: 652670 - RNA, 16 nt, Homo sapiens
gccaaauaugcacuuu

SEQ ID NO: 652671 - RNA, 13 nt, Homo sapiens
gccaaauguaauu

SEQ ID NO: 652672 - RNA, 20 nt, Homo sapiens
gccaaauguuccauaugugg

SEQ ID NO: 652673 - RNA, 17 nt, Homo sapiens
gccaaauugacugucac

SEQ ID NO: 652674 - RNA, 13 nt, Homo sapiens
gccaaauuuccag

SEQ ID NO: 652675 - RNA, 14 nt, Homo sapiens
gccaaauuuuggcc

SEQ ID NO: 652676 - RNA, 20 nt, Homo sapiens
gccaacaagguuauaugaau

SEQ ID NO: 652677 - RNA, 14 nt, Homo sapiens
gccaacauggugaa

SEQ ID NO: 652678 - RNA, 21 nt, Homo sapiens
gccaacauguggcuccuccca

SEQ ID NO: 652679 - RNA, 17 nt, Homo sapiens
gccaaccccacccagcu

SEQ ID NO: 652680 - RNA, 22 nt, Homo sapiens
gccaacccggcacugcccucag

SEQ ID NO: 652681 - RNA, 18 nt, Homo sapiens
gccaaccggucacccagg

SEQ ID NO: 652682 - RNA, 19 nt, Homo sapiens
gccaaccggucacccagga

SEQ ID NO: 652683 - RNA, 15 nt, Homo sapiens
gccaacucaacuuuc

SEQ ID NO: 652684 - RNA, 13 nt, Homo sapiens
gccaacuccucac

SEQ ID NO: 652685 - RNA, 14 nt, Homo sapiens
gccaacugcaaaaa

SEQ ID NO: 652686 - RNA, 13 nt, Homo sapiens
gccaacuucccac

SEQ ID NO: 652687 - RNA, 16 nt, Homo sapiens
gccaacuugccauguu

SEQ ID NO: 652688 - RNA, 14 nt, Homo sapiens
gccaagaacgcagg

SEQ ID NO: 652689 - RNA, 19 nt, Homo sapiens
gccaagaaucaagcuagaa

SEQ ID NO: 652690 - RNA, 22 nt, Homo sapiens
gccaagacccaacaggugcuga

SEQ ID NO: 652691 - RNA, 21 nt, Homo sapiens
gccaagagccgacaaugcccu

SEQ ID NO: 652692 - RNA, 21 nt, Homo sapiens
gccaagauucuacucuuguca

SEQ ID NO: 652693 - RNA, 14 nt, Homo sapiens
gccaaggacugacu

SEQ ID NO: 652694 - RNA, 14 nt, Homo sapiens
gccaaggagcugcu

SEQ ID NO: 652695 - RNA, 16 nt, Homo sapiens
gccaaggagcugcuau

SEQ ID NO: 652696 - RNA, 20 nt, Homo sapiens
gccaagggggugacuggaag

SEQ ID NO: 652697 - RNA, 20 nt, Homo sapiens
gccaaggucaugccacugca

SEQ ID NO: 652698 - RNA, 18 nt, Homo sapiens
gccaaguaagaaagugaa

SEQ ID NO: 652699 - RNA, 15 nt, Homo sapiens
gccaagucauagcca

SEQ ID NO: 652700 - RNA, 16 nt, Homo sapiens
gccaaguggggugcug

SEQ ID NO: 652701 - RNA, 23 nt, Homo sapiens
gccaauaacuuuucaccaaugag

SEQ ID NO: 652702 - RNA, 18 nt, Homo sapiens
gccaauaauaaaugcccu

SEQ ID NO: 652703 - RNA, 14 nt, Homo sapiens
gccaauagugucau

SEQ ID NO: 652704 - RNA, 18 nt, Homo sapiens
gccaauauuucugauaua

SEQ ID NO: 652705 - RNA, 22 nt, Homo sapiens
gccaaugcuguacguacugcau

SEQ ID NO: 652706 - RNA, 14 nt, Homo sapiens
gccaauuagcaauu

SEQ ID NO: 652707 - RNA, 16 nt, Homo sapiens
gccaauucacaaguua

SEQ ID NO: 652708 - RNA, 15 nt, Homo sapiens
gccaauuuucuucau

SEQ ID NO: 652709 - RNA, 11 nt, Homo sapiens
gccacaaccaa

SEQ ID NO: 652710 - RNA, 19 nt, Homo sapiens
gccacacaaacguuuacuu

SEQ ID NO: 652711 - RNA, 15 nt, Homo sapiens
gccacacagugacuu

SEQ ID NO: 652712 - RNA, 21 nt, Homo sapiens
gccacaccaaucagagagccu

SEQ ID NO: 652713 - RNA, 23 nt, Homo sapiens
gccacacccaggggaaggcccug

SEQ ID NO: 652714 - RNA, 15 nt, Homo sapiens
gccacacccagguga

SEQ ID NO: 652715 - RNA, 21 nt, Homo sapiens
gccacacggagaggccacugu

SEQ ID NO: 652716 - RNA, 16 nt, Homo sapiens
gccacacggcucucac

SEQ ID NO: 652717 - RNA, 21 nt, Homo sapiens
gccacacuggucacaggcaaa

SEQ ID NO: 652718 - RNA, 12 nt, Homo sapiens
gccacagacuga

SEQ ID NO: 652719 - RNA, 22 nt, Homo sapiens
gccacagguguugauuguuaua

SEQ ID NO: 652720 - RNA, 17 nt, Homo sapiens
gccacauggcugggauu

SEQ ID NO: 652721 - RNA, 11 nt, Homo sapiens
gccacauggga

SEQ ID NO: 652722 - RNA, 19 nt, Homo sapiens
gccacauuucauugucuua

SEQ ID NO: 652723 - RNA, 14 nt, Homo sapiens
gccacauuuuagcc

SEQ ID NO: 652724 - RNA, 22 nt, Homo sapiens
gccaccacauuuagaacuuugg

SEQ ID NO: 652725 - RNA, 21 nt, Homo sapiens
gccaccacccacaaucacaag

SEQ ID NO: 652726 - RNA, 20 nt, Homo sapiens
gccaccacccucaggugccu

SEQ ID NO: 652727 - RNA, 17 nt, Homo sapiens
gccaccagaaaccacaa

SEQ ID NO: 652728 - RNA, 18 nt, Homo sapiens
gccaccagacugacaaau

SEQ ID NO: 652729 - RNA, 15 nt, Homo sapiens
gccaccagggagcuu

SEQ ID NO: 652730 - RNA, 23 nt, Homo sapiens
gccaccccuccccaguacagggg

SEQ ID NO: 652731 - RNA, 14 nt, Homo sapiens
gccacccuagccaa

SEQ ID NO: 652732 - RNA, 20 nt, Homo sapiens
gccaccggaggucacuccac

SEQ ID NO: 652733 - RNA, 13 nt, Homo sapiens
gccaccucaccaa

SEQ ID NO: 652734 - RNA, 23 nt, Homo sapiens
gccaccucucagggccacuggca

SEQ ID NO: 652735 - RNA, 22 nt, Homo sapiens
gccacgugggcaaacaggcagu

SEQ ID NO: 652736 - RNA, 17 nt, Homo sapiens
gccacuaucacauaugc

SEQ ID NO: 652737 - RNA, 16 nt, Homo sapiens
gccacuauuacuggga

SEQ ID NO: 652738 - RNA, 21 nt, Homo sapiens
gccacucaggaggcugaggca

SEQ ID NO: 652739 - RNA, 22 nt, Homo sapiens
gccacucccagauggcucuuuc

SEQ ID NO: 652740 - RNA, 23 nt, Homo sapiens
gccacuccccuaaacuccaggau

SEQ ID NO: 652741 - RNA, 21 nt, Homo sapiens
gccacuccuggggucacucag

SEQ ID NO: 652742 - RNA, 13 nt, Homo sapiens
gccacugcacucu

SEQ ID NO: 652743 - RNA, 21 nt, Homo sapiens
gccacugggccugucacugau

SEQ ID NO: 652744 - RNA, 22 nt, Homo sapiens
gccacugggcucuggaccucag

SEQ ID NO: 652745 - RNA, 14 nt, Homo sapiens
gccacuguaggggu

SEQ ID NO: 652746 - RNA, 16 nt, Homo sapiens
gccacuguggccagag

SEQ ID NO: 652747 - RNA, 14 nt, Homo sapiens
gccucccaccacuc

SEQ ID NO: 652748 - RNA, 13 nt, Homo sapiens
gccucccaccaga

SEQ ID NO: 652749 - RNA, 19 nt, Homo sapiens
gccucccacccccaucucu

SEQ ID NO: 652750 - RNA, 18 nt, Homo sapiens
gccucccccgaaugcauu

SEQ ID NO: 652751 - RNA, 17 nt, Homo sapiens
gccuccccuucuucccg

SEQ ID NO: 652752 - RNA, 20 nt, Homo sapiens
gccucccggguucacgccau

SEQ ID NO: 652753 - RNA, 20 nt, Homo sapiens
gccucccucaaaggaccugc

SEQ ID NO: 652754 - RNA, 18 nt, Homo sapiens
gccucccugaaacacugc

SEQ ID NO: 652755 - RNA, 20 nt, Homo sapiens
gccucccuucccagugggcu

SEQ ID NO: 652756 - RNA, 20 nt, Homo sapiens
gccucccuugacuuugcucc

SEQ ID NO: 652757 - RNA, 16 nt, Homo sapiens
gccucccuuucuggga

SEQ ID NO: 652758 - RNA, 10 nt, Homo sapiens
gccuccucaa

SEQ ID NO: 652759 - RNA, 19 nt, Homo sapiens
gccuccucagccucugcaa

SEQ ID NO: 652760 - RNA, 10 nt, Homo sapiens
gccuccucau

SEQ ID NO: 652761 - RNA, 19 nt, Homo sapiens
gccuccucccauccagcgu

SEQ ID NO: 652762 - RNA, 19 nt, Homo sapiens
gccuccucuacaauuugcc

SEQ ID NO: 652763 - RNA, 13 nt, Homo sapiens
gccuccuggccag

SEQ ID NO: 652764 - RNA, 16 nt, Homo sapiens
gccuccugggggaccu

SEQ ID NO: 652765 - RNA, 17 nt, Homo sapiens
gccuccuuugcuggcau

SEQ ID NO: 652766 - RNA, 14 nt, Homo sapiens
gccucgagugcccc

SEQ ID NO: 652767 - RNA, 20 nt, Homo sapiens
gccucgggacaucaaaaaca

SEQ ID NO: 652768 - RNA, 24 nt, Homo sapiens
gccucuaagcgugcugacaucaga

SEQ ID NO: 652769 - RNA, 13 nt, Homo sapiens
gccucuacuuuau

SEQ ID NO: 652770 - RNA, 14 nt, Homo sapiens
gccucuacuuuauc

SEQ ID NO: 652771 - RNA, 15 nt, Homo sapiens
gccucucccaucacu

SEQ ID NO: 652772 - RNA, 22 nt, Homo sapiens
gccucuccuguauuuaacaaaa

SEQ ID NO: 652773 - RNA, 13 nt, Homo sapiens
gccucucugacau

SEQ ID NO: 652774 - RNA, 15 nt, Homo sapiens
gccucugaacccccu

SEQ ID NO: 652775 - RNA, 22 nt, Homo sapiens
gccucugacagcagccugugag

SEQ ID NO: 652776 - RNA, 16 nt, Homo sapiens
gccucugcuuacuuuu

SEQ ID NO: 652777 - RNA, 12 nt, Homo sapiens
gccucuggaaaa

SEQ ID NO: 652778 - RNA, 16 nt, Homo sapiens
gccucuggacagccag

SEQ ID NO: 652779 - RNA, 16 nt, Homo sapiens
gccucuguguucaucc

SEQ ID NO: 652780 - RNA, 20 nt, Homo sapiens
gccucuuaccggaaauacuu

SEQ ID NO: 652781 - RNA, 24 nt, Homo sapiens
gccucuuccagugaacauucccag

SEQ ID NO: 652782 - RNA, 21 nt, Homo sapiens
gccucuuccuguugugacugc

SEQ ID NO: 652783 - RNA, 22 nt, Homo sapiens
gccucuucuccccggcacuucc

SEQ ID NO: 652784 - RNA, 11 nt, Homo sapiens
gccucuugccc

SEQ ID NO: 652785 - RNA, 17 nt, Homo sapiens
gccucuuguacaguuaa

SEQ ID NO: 652786 - RNA, 14 nt, Homo sapiens
gccucuuucaucca

SEQ ID NO: 652787 - RNA, 16 nt, Homo sapiens
gccugaacauccuucc

SEQ ID NO: 652788 - RNA, 13 nt, Homo sapiens
gccugacaaccac

SEQ ID NO: 652789 - RNA, 15 nt, Homo sapiens
gccugacacauagaa

SEQ ID NO: 652790 - RNA, 13 nt, Homo sapiens
gccugaccaacau

SEQ ID NO: 652791 - RNA, 20 nt, Homo sapiens
gccugagaggcaggcauaga

SEQ ID NO: 652792 - RNA, 20 nt, Homo sapiens
gccugagcaacucuugauua

SEQ ID NO: 652793 - RNA, 22 nt, Homo sapiens
gccugaggaggaggacacagca

SEQ ID NO: 652794 - RNA, 20 nt, Homo sapiens
gccugaggaugagcuggaag

SEQ ID NO: 652795 - RNA, 13 nt, Homo sapiens
gccugaggcaauu

SEQ ID NO: 652796 - RNA, 22 nt, Homo sapiens
gccugaggcaauuagacacuuu

SEQ ID NO: 652797 - RNA, 17 nt, Homo sapiens
gccugagguuugccagc

SEQ ID NO: 652798 - RNA, 21 nt, Homo sapiens
gccugagguuugccagcauuu

SEQ ID NO: 652799 - RNA, 16 nt, Homo sapiens
gccugauccagccuuu

SEQ ID NO: 652800 - RNA, 19 nt, Homo sapiens
gccugaucugcacauuuca

SEQ ID NO: 652801 - RNA, 14 nt, Homo sapiens
gccugaugcugaca

SEQ ID NO: 652802 - RNA, 18 nt, Homo sapiens
gccugaugcugacauuca

SEQ ID NO: 652803 - RNA, 23 nt, Homo sapiens
gccugauggugcucacgacucuu

SEQ ID NO: 652804 - RNA, 13 nt, Homo sapiens
gccugcaagcuuc

SEQ ID NO: 652805 - RNA, 21 nt, Homo sapiens
gccugcacagauaccucauca

SEQ ID NO: 652806 - RNA, 16 nt, Homo sapiens
gccugcacuaauuuga

SEQ ID NO: 652807 - RNA, 11 nt, Homo sapiens
gccugcacugg

SEQ ID NO: 652808 - RNA, 17 nt, Homo sapiens
gccugcaggaccucgug

SEQ ID NO: 652809 - RNA, 21 nt, Homo sapiens
gccugcaggagagagcagcac

SEQ ID NO: 652810 - RNA, 20 nt, Homo sapiens
gccugcaucuucuugcaucu

SEQ ID NO: 652811 - RNA, 16 nt, Homo sapiens
gccugcauggagaagg

SEQ ID NO: 652812 - RNA, 21 nt, Homo sapiens
gccugccaagagguacuguaa

SEQ ID NO: 652813 - RNA, 13 nt, Homo sapiens
gccugcccagaca

SEQ ID NO: 652814 - RNA, 23 nt, Homo sapiens
gccugccccaaacaaauaugcaa

SEQ ID NO: 652815 - RNA, 22 nt, Homo sapiens
gccugccccccucaucucauuc

SEQ ID NO: 652816 - RNA, 20 nt, Homo sapiens
gccugcccccuugggugacc

SEQ ID NO: 652817 - RNA, 17 nt, Homo sapiens
gccugccccgacaccca

SEQ ID NO: 652818 - RNA, 23 nt, Homo sapiens
gccugccgaaaacaggagcaaau

SEQ ID NO: 652819 - RNA, 18 nt, Homo sapiens
gccugccgcugcaggaaa

SEQ ID NO: 652820 - RNA, 14 nt, Homo sapiens
gccugccucuucca

SEQ ID NO: 652821 - RNA, 16 nt, Homo sapiens
gccugccuggcaggcu

SEQ ID NO: 652822 - RNA, 13 nt, Homo sapiens
gccugccuuaggg

SEQ ID NO: 652823 - RNA, 18 nt, Homo sapiens
gccugcgcccugguaaag

SEQ ID NO: 652824 - RNA, 19 nt, Homo sapiens
gccugcuaauagcugcuag

SEQ ID NO: 652825 - RNA, 14 nt, Homo sapiens
gccugcuucuucuc

SEQ ID NO: 652826 - RNA, 15 nt, Homo sapiens
gccuggacaguaucc

SEQ ID NO: 652827 - RNA, 22 nt, Homo sapiens
gccuggaccccuggaccgcuuu

SEQ ID NO: 652828 - RNA, 15 nt, Homo sapiens
gccuggacuuuccug

SEQ ID NO: 652829 - RNA, 17 nt, Homo sapiens
gccuggacuuuccugca

SEQ ID NO: 652830 - RNA, 21 nt, Homo sapiens
gccuggaggaaucacugggga

SEQ ID NO: 652831 - RNA, 19 nt, Homo sapiens
gccuggauuccagcaguga

SEQ ID NO: 652832 - RNA, 15 nt, Homo sapiens
gccuggcaucugugu

SEQ ID NO: 652833 - RNA, 15 nt, Homo sapiens
gccuggcccaaagca

SEQ ID NO: 652834 - RNA, 19 nt, Homo sapiens
gccuggcccucugugguca

SEQ ID NO: 652835 - RNA, 20 nt, Homo sapiens
gccuggccuccaaaauauua

SEQ ID NO: 652836 - RNA, 15 nt, Homo sapiens
gccuggcuauguccu

SEQ ID NO: 652837 - RNA, 16 nt, Homo sapiens
gccuggcuccccacga

SEQ ID NO: 652838 - RNA, 15 nt, Homo sapiens
gccuggcuucuggag

SEQ ID NO: 652839 - RNA, 14 nt, Homo sapiens
gccugggcaccagc

SEQ ID NO: 652840 - RNA, 18 nt, Homo sapiens
gccugggcuguggacaga

SEQ ID NO: 652841 - RNA, 21 nt, Homo sapiens
gccugggcuguuggcacucac

SEQ ID NO: 652842 - RNA, 23 nt, Homo sapiens
gccuggggucugacaauaccucg

SEQ ID NO: 652843 - RNA, 19 nt, Homo sapiens
gccuggggugggacaggga

SEQ ID NO: 652844 - RNA, 22 nt, Homo sapiens
gccugggguggggucaugcccu

SEQ ID NO: 652845 - RNA, 13 nt, Homo sapiens
gccuggguuugua

SEQ ID NO: 652846 - RNA, 17 nt, Homo sapiens
gccugguagaauuggga

SEQ ID NO: 652847 - RNA, 21 nt, Homo sapiens
gccuggucccacgagggugcc

SEQ ID NO: 652848 - RNA, 20 nt, Homo sapiens
gccuguaaucccagcacuuu

SEQ ID NO: 652849 - RNA, 20 nt, Homo sapiens
gccuguaaucucagcacuuu

SEQ ID NO: 652850 - RNA, 17 nt, Homo sapiens
gccuguagccccaguga

SEQ ID NO: 652851 - RNA, 18 nt, Homo sapiens
gccugucaguuucaugga

SEQ ID NO: 652852 - RNA, 13 nt, Homo sapiens
gccugucucuagc

SEQ ID NO: 652853 - RNA, 14 nt, Homo sapiens
gccugugaugcugg

SEQ ID NO: 652854 - RNA, 14 nt, Homo sapiens
gccugugauuuccu

SEQ ID NO: 652855 - RNA, 18 nt, Homo sapiens
gccugugcugugacucga

SEQ ID NO: 652856 - RNA, 18 nt, Homo sapiens
gccuguggcuggcuggaa

SEQ ID NO: 652857 - RNA, 16 nt, Homo sapiens
gccugugggaggggga

SEQ ID NO: 652858 - RNA, 19 nt, Homo sapiens
gccugugguuacagugcag

SEQ ID NO: 652859 - RNA, 17 nt, Homo sapiens
gccugugucccaugacc

SEQ ID NO: 652860 - RNA, 15 nt, Homo sapiens
gccuguuaacuggua

SEQ ID NO: 652861 - RNA, 14 nt, Homo sapiens
gccuguugaaucug

SEQ ID NO: 652862 - RNA, 19 nt, Homo sapiens
gccuuaaacacacauugca

SEQ ID NO: 652863 - RNA, 15 nt, Homo sapiens
gccuuaaccaugagg

SEQ ID NO: 652864 - RNA, 16 nt, Homo sapiens
gccuuaaugcuucaua

SEQ ID NO: 652865 - RNA, 13 nt, Homo sapiens
gccuuagccucuu

SEQ ID NO: 652866 - RNA, 17 nt, Homo sapiens
gccuuauuaauauccaa

SEQ ID NO: 652867 - RNA, 10 nt, Homo sapiens
gccuucacag

SEQ ID NO: 652868 - RNA, 21 nt, Homo sapiens
gccuucacuccggugugccug

SEQ ID NO: 652869 - RNA, 19 nt, Homo sapiens
guacagaaaaauacuuuga

SEQ ID NO: 652870 - RNA, 21 nt, Homo sapiens
guacagaauagaauacauuga

SEQ ID NO: 652871 - RNA, 18 nt, Homo sapiens
guacagagaaauucugug

SEQ ID NO: 652872 - RNA, 11 nt, Homo sapiens
guacagagaug

SEQ ID NO: 652873 - RNA, 14 nt, Homo sapiens
guacagaguggaau

SEQ ID NO: 652874 - RNA, 11 nt, Homo sapiens
guacagauuag

SEQ ID NO: 652875 - RNA, 17 nt, Homo sapiens
guacaggaaggugccug

SEQ ID NO: 652876 - RNA, 15 nt, Homo sapiens
guacaggacauauau

SEQ ID NO: 652877 - RNA, 14 nt, Homo sapiens
guacaggcaguuag

SEQ ID NO: 652878 - RNA, 18 nt, Homo sapiens
guacagguuuugcccuga

SEQ ID NO: 652879 - RNA, 14 nt, Homo sapiens
guacagugagccaa

SEQ ID NO: 652880 - RNA, 17 nt, Homo sapiens
guacagugucugugcca

SEQ ID NO: 652881 - RNA, 18 nt, Homo sapiens
guacaguuaucauuauca

SEQ ID NO: 652882 - RNA, 21 nt, Homo sapiens
guacaguucugggguacaugu

SEQ ID NO: 652883 - RNA, 15 nt, Homo sapiens
guacaucugcaauau

SEQ ID NO: 652884 - RNA, 13 nt, Homo sapiens
guacaucuuugga

SEQ ID NO: 652885 - RNA, 11 nt, Homo sapiens
guacaugagaa

SEQ ID NO: 652886 - RNA, 21 nt, Homo sapiens
guacauuggcugguaacaguu

SEQ ID NO: 652887 - RNA, 17 nt, Homo sapiens
guacauuguuaccucua

SEQ ID NO: 652888 - RNA, 20 nt, Homo sapiens
guaccaaaacauccacuuaa

SEQ ID NO: 652889 - RNA, 21 nt, Homo sapiens
guaccaaauccacaagccauu

SEQ ID NO: 652890 - RNA, 14 nt, Homo sapiens
guaccaauucagug

SEQ ID NO: 652891 - RNA, 13 nt, Homo sapiens
guaccacacauau

SEQ ID NO: 652892 - RNA, 17 nt, Homo sapiens
guaccacacauauugca

SEQ ID NO: 652893 - RNA, 18 nt, Homo sapiens
guaccaccaugcacugua

SEQ ID NO: 652894 - RNA, 22 nt, Homo sapiens
guaccacccuucagaccccagu

SEQ ID NO: 652895 - RNA, 11 nt, Homo sapiens
guaccaguuaa

SEQ ID NO: 652896 - RNA, 12 nt, Homo sapiens
guaccauagaaa

SEQ ID NO: 652897 - RNA, 22 nt, Homo sapiens
guaccauuuucuaucauggaau

SEQ ID NO: 652898 - RNA, 17 nt, Homo sapiens
guacccagccaucugcc

SEQ ID NO: 652899 - RNA, 20 nt, Homo sapiens
guacccucgcaugacuguua

SEQ ID NO: 652900 - RNA, 14 nt, Homo sapiens
guacccucucagcu

SEQ ID NO: 652901 - RNA, 18 nt, Homo sapiens
guacccuuuggggagcag

SEQ ID NO: 652902 - RNA, 21 nt, Homo sapiens
guaccucucaacauuaccaaa

SEQ ID NO: 652903 - RNA, 20 nt, Homo sapiens
guaccuguacuaaaccaccu

SEQ ID NO: 652904 - RNA, 13 nt, Homo sapiens
guaccugugcacg

SEQ ID NO: 652905 - RNA, 21 nt, Homo sapiens
guaccuucaaacuagggccaa

SEQ ID NO: 652906 - RNA, 22 nt, Homo sapiens
guaccuucaggcagccagugug

SEQ ID NO: 652907 - RNA, 18 nt, Homo sapiens
guaccuuucuagccuuag

SEQ ID NO: 652908 - RNA, 22 nt, Homo sapiens
guaccuuuguguccuuguucau

SEQ ID NO: 652909 - RNA, 20 nt, Homo sapiens
guacgaucuuucuggcaaau

SEQ ID NO: 652910 - RNA, 14 nt, Homo sapiens
guacgcccaggaca

SEQ ID NO: 652911 - RNA, 22 nt, Homo sapiens
guacggcaaccacaugucccag

SEQ ID NO: 652912 - RNA, 14 nt, Homo sapiens
guacgggccaguuu

SEQ ID NO: 652913 - RNA, 17 nt, Homo sapiens
guacguuaaaagcaaaa

SEQ ID NO: 652914 - RNA, 23 nt, Homo sapiens
guacuaucgucaggaaaccaaau

SEQ ID NO: 652915 - RNA, 14 nt, Homo sapiens
guacuauugcagac

SEQ ID NO: 652916 - RNA, 17 nt, Homo sapiens
guacucacuuuucacuu

SEQ ID NO: 652917 - RNA, 21 nt, Homo sapiens
guacuccagcccggcacucca

SEQ ID NO: 652918 - RNA, 15 nt, Homo sapiens
guacucucugcucua

SEQ ID NO: 652919 - RNA, 15 nt, Homo sapiens
guacugagggacaag

SEQ ID NO: 652920 - RNA, 22 nt, Homo sapiens
guacugauauaauuuaguucca

SEQ ID NO: 652921 - RNA, 16 nt, Homo sapiens
guacugauggacuuaa

SEQ ID NO: 652922 - RNA, 12 nt, Homo sapiens
guacuggcacaa

SEQ ID NO: 652923 - RNA, 18 nt, Homo sapiens
guacugguugacuuucua

SEQ ID NO: 652924 - RNA, 17 nt, Homo sapiens
guacuuaagaguggcau

SEQ ID NO: 652925 - RNA, 14 nt, Homo sapiens
guacuucagugcac

SEQ ID NO: 652926 - RNA, 15 nt, Homo sapiens
guacuucucacccag

SEQ ID NO: 652927 - RNA, 15 nt, Homo sapiens
guacuuggaguaauu

SEQ ID NO: 652928 - RNA, 17 nt, Homo sapiens
guacuuuggaugcaauu

SEQ ID NO: 652929 - RNA, 15 nt, Homo sapiens
guacuuuucuguuca

SEQ ID NO: 652930 - RNA, 19 nt, Homo sapiens
guagaaacacaguuuugaa

SEQ ID NO: 652931 - RNA, 18 nt, Homo sapiens
guagaaagacaucugccu

SEQ ID NO: 652932 - RNA, 17 nt, Homo sapiens
guagaagccacuauuac

SEQ ID NO: 652933 - RNA, 21 nt, Homo sapiens
guagaaggggaggacacuggu

SEQ ID NO: 652934 - RNA, 20 nt, Homo sapiens
guagaagguaacucuuugca

SEQ ID NO: 652935 - RNA, 16 nt, Homo sapiens
guagaauaaaugaaga

SEQ ID NO: 652936 - RNA, 15 nt, Homo sapiens
guagaauugcauuga

SEQ ID NO: 652937 - RNA, 14 nt, Homo sapiens
guagacuacuuugg

SEQ ID NO: 652938 - RNA, 12 nt, Homo sapiens
guagacuuugcu

SEQ ID NO: 652939 - RNA, 19 nt, Homo sapiens
guagagaaugucacuguag

SEQ ID NO: 652940 - RNA, 21 nt, Homo sapiens
guagagagguuuuucuuggga

SEQ ID NO: 652941 - RNA, 15 nt, Homo sapiens
guagagucaucucca

SEQ ID NO: 652942 - RNA, 21 nt, Homo sapiens
guagaguuuuuaaaaagugaa

SEQ ID NO: 652943 - RNA, 17 nt, Homo sapiens
guagauaauuucagggu

SEQ ID NO: 652944 - RNA, 14 nt, Homo sapiens
guagauaccagcuu

SEQ ID NO: 652945 - RNA, 15 nt, Homo sapiens
guagauacuagcuau

SEQ ID NO: 652946 - RNA, 18 nt, Homo sapiens
guagaucuucaauuugga

SEQ ID NO: 652947 - RNA, 22 nt, Homo sapiens
guagcaaugugccuugauugau

SEQ ID NO: 652948 - RNA, 12 nt, Homo sapiens
guagcacugagg

SEQ ID NO: 652949 - RNA, 22 nt, Homo sapiens
guagcagggggagugcugguca

SEQ ID NO: 652950 - RNA, 15 nt, Homo sapiens
guagcauaacuguag

SEQ ID NO: 652951 - RNA, 18 nt, Homo sapiens
guagcauuucuugauguu

SEQ ID NO: 652952 - RNA, 20 nt, Homo sapiens
guagccaaagguucacucuc

SEQ ID NO: 652953 - RNA, 13 nt, Homo sapiens
guagcccauccuu

SEQ ID NO: 652954 - RNA, 16 nt, Homo sapiens
guagcccauccuuccc

SEQ ID NO: 652955 - RNA, 21 nt, Homo sapiens
guagcuauuuuucuuguugca

SEQ ID NO: 652956 - RNA, 15 nt, Homo sapiens
guagcucaaucugca

SEQ ID NO: 652957 - RNA, 10 nt, Homo sapiens
guagcucucc

SEQ ID NO: 652958 - RNA, 16 nt, Homo sapiens
guagcucuccugacuu

SEQ ID NO: 652959 - RNA, 11 nt, Homo sapiens
guagcucuuug

SEQ ID NO: 652960 - RNA, 13 nt, Homo sapiens
guagcucuuugcc

SEQ ID NO: 652961 - RNA, 12 nt, Homo sapiens
guagcugaugaa

SEQ ID NO: 652962 - RNA, 21 nt, Homo sapiens
guagcugugaaauccauauau

SEQ ID NO: 652963 - RNA, 17 nt, Homo sapiens
guagcuugcucccugug

SEQ ID NO: 652964 - RNA, 19 nt, Homo sapiens
guaggaaucugccuuccag

SEQ ID NO: 652965 - RNA, 17 nt, Homo sapiens
guaggagcccuucucuu

SEQ ID NO: 652966 - RNA, 16 nt, Homo sapiens
guaggaugaaucauau

SEQ ID NO: 652967 - RNA, 15 nt, Homo sapiens
guaggcauauaucac

SEQ ID NO: 652968 - RNA, 19 nt, Homo sapiens
guaggcugucugugccaug

SEQ ID NO: 652969 - RNA, 21 nt, Homo sapiens
guaggcuuuguauucaaaaau

SEQ ID NO: 652970 - RNA, 14 nt, Homo sapiens
guaggguugccaga

SEQ ID NO: 652971 - RNA, 15 nt, Homo sapiens
guagguaauguuccu

SEQ ID NO: 652972 - RNA, 22 nt, Homo sapiens
guagguacuucacauugcaaac

SEQ ID NO: 652973 - RNA, 21 nt, Homo sapiens
guagguaggaagcacugaaaa

SEQ ID NO: 652974 - RNA, 17 nt, Homo sapiens
guaggucggcacuugga

SEQ ID NO: 652975 - RNA, 13 nt, Homo sapiens
guaggugucucau

SEQ ID NO: 652976 - RNA, 15 nt, Homo sapiens
guaggugucugcacc

SEQ ID NO: 652977 - RNA, 14 nt, Homo sapiens
guagguucuugaua

SEQ ID NO: 652978 - RNA, 13 nt, Homo sapiens
guaguacuugaaa

SEQ ID NO: 652979 - RNA, 21 nt, Homo sapiens
guagucagacugacacuacua

SEQ ID NO: 652980 - RNA, 17 nt, Homo sapiens
guagugaaauuauacag

SEQ ID NO: 652981 - RNA, 20 nt, Homo sapiens
guagugaaauuauacagaua

SEQ ID NO: 652982 - RNA, 21 nt, Homo sapiens
guaguguauucucuaaaagcu

SEQ ID NO: 652983 - RNA, 17 nt, Homo sapiens
guaguuaaggagccuaa

SEQ ID NO: 652984 - RNA, 13 nt, Homo sapiens
guaguucucagga

SEQ ID NO: 652985 - RNA, 13 nt, Homo sapiens
guaguucuugucu

SEQ ID NO: 652986 - RNA, 16 nt, Homo sapiens
guaguuggcagaaaua

SEQ ID NO: 652987 - RNA, 18 nt, Homo sapiens
guaguuguugaguucaag

SEQ ID NO: 652988 - RNA, 24 nt, Homo sapiens
guaguuucuguaaaugacacuuuc

SEQ ID NO: 652989 - RNA, 18 nt, Homo sapiens
guaguuugaucaguugaa

SEQ ID NO: 652990 - RNA, 15 nt, Homo sapiens
guauaaacuaucagu

SEQ ID NO: 652991 - RNA, 14 nt, Homo sapiens
guauaaagauugua

SEQ ID NO: 652992 - RNA, 13 nt, Homo sapiens
gucauguuugcag

SEQ ID NO: 652993 - RNA, 18 nt, Homo sapiens
gucauuagacgguaccaa

SEQ ID NO: 652994 - RNA, 16 nt, Homo sapiens
gucauuauuuuuguua

SEQ ID NO: 652995 - RNA, 14 nt, Homo sapiens
gucauucauucaag

SEQ ID NO: 652996 - RNA, 20 nt, Homo sapiens
gucauugauagaacuacuuu

SEQ ID NO: 652997 - RNA, 22 nt, Homo sapiens
gucauugauagaacuacuuuga

SEQ ID NO: 652998 - RNA, 13 nt, Homo sapiens
gucauuguauuca

SEQ ID NO: 652999 - RNA, 16 nt, Homo sapiens
gucauuucagcucuug

SEQ ID NO: 653000 - RNA, 14 nt, Homo sapiens
gucauuucauucca

SEQ ID NO: 653001 - RNA, 20 nt, Homo sapiens
guccaaaacugccucaggag

SEQ ID NO: 653002 - RNA, 17 nt, Homo sapiens
guccaaacucagugcug

SEQ ID NO: 653003 - RNA, 21 nt, Homo sapiens
guccaagucuucucaagaucc

SEQ ID NO: 653004 - RNA, 18 nt, Homo sapiens
guccaauacacgcgugug

SEQ ID NO: 653005 - RNA, 20 nt, Homo sapiens
guccaauacacgcgugugcu

SEQ ID NO: 653006 - RNA, 13 nt, Homo sapiens
guccaauauuugg

SEQ ID NO: 653007 - RNA, 23 nt, Homo sapiens
guccacaacaauaugaaguacag

SEQ ID NO: 653008 - RNA, 16 nt, Homo sapiens
guccacaacacacaga

SEQ ID NO: 653009 - RNA, 15 nt, Homo sapiens
guccacaugaccucc

SEQ ID NO: 653010 - RNA, 21 nt, Homo sapiens
guccacccaggcugcacugca

SEQ ID NO: 653011 - RNA, 22 nt, Homo sapiens
guccaccucccauuacuuugau

SEQ ID NO: 653012 - RNA, 24 nt, Homo sapiens
guccacgagcuguuuacuagggau

SEQ ID NO: 653013 - RNA, 17 nt, Homo sapiens
guccacgauucacucau

SEQ ID NO: 653014 - RNA, 19 nt, Homo sapiens
guccacuccuccuacugua

SEQ ID NO: 653015 - RNA, 20 nt, Homo sapiens
guccacuccuccuacuguau

SEQ ID NO: 653016 - RNA, 15 nt, Homo sapiens
guccacuguggcacu

SEQ ID NO: 653017 - RNA, 18 nt, Homo sapiens
guccagaagaauauucag

SEQ ID NO: 653018 - RNA, 21 nt, Homo sapiens
guccagagcggaggcugugug

SEQ ID NO: 653019 - RNA, 12 nt, Homo sapiens
guccagcccauc

SEQ ID NO: 653020 - RNA, 15 nt, Homo sapiens
guccagcucguucuc

SEQ ID NO: 653021 - RNA, 23 nt, Homo sapiens
guccaggaacugccugggccaug

SEQ ID NO: 653022 - RNA, 19 nt, Homo sapiens
guccaggccucucucugcu

SEQ ID NO: 653023 - RNA, 15 nt, Homo sapiens
guccaggcucugggc

SEQ ID NO: 653024 - RNA, 14 nt, Homo sapiens
guccauacaccagc

SEQ ID NO: 653025 - RNA, 17 nt, Homo sapiens
guccauccgacugcccc

SEQ ID NO: 653026 - RNA, 22 nt, Homo sapiens
guccaucugucuguccuacccg

SEQ ID NO: 653027 - RNA, 17 nt, Homo sapiens
guccaugugugugcaag

SEQ ID NO: 653028 - RNA, 15 nt, Homo sapiens
guccauuaacugcuu

SEQ ID NO: 653029 - RNA, 11 nt, Homo sapiens
guccauucucu

SEQ ID NO: 653030 - RNA, 17 nt, Homo sapiens
guccauuguccaauccu

SEQ ID NO: 653031 - RNA, 19 nt, Homo sapiens
guccauuuugcccuuccau

SEQ ID NO: 653032 - RNA, 15 nt, Homo sapiens
gucccacacugugca

SEQ ID NO: 653033 - RNA, 16 nt, Homo sapiens
gucccacacugugcag

SEQ ID NO: 653034 - RNA, 14 nt, Homo sapiens
gucccacacugugg

SEQ ID NO: 653035 - RNA, 19 nt, Homo sapiens
gucccacccggacaggugg

SEQ ID NO: 653036 - RNA, 15 nt, Homo sapiens
gucccagaguggcug

SEQ ID NO: 653037 - RNA, 17 nt, Homo sapiens
gucccagcggcaccaac

SEQ ID NO: 653038 - RNA, 15 nt, Homo sapiens
gucccagcuacucag

SEQ ID NO: 653039 - RNA, 12 nt, Homo sapiens
gucccagucucu

SEQ ID NO: 653040 - RNA, 20 nt, Homo sapiens
gucccaucaauucuuagaau

SEQ ID NO: 653041 - RNA, 13 nt, Homo sapiens
gucccaucugccc

SEQ ID NO: 653042 - RNA, 18 nt, Homo sapiens
gucccauucccugggauc

SEQ ID NO: 653043 - RNA, 16 nt, Homo sapiens
gucccauugugcagaa

SEQ ID NO: 653044 - RNA, 21 nt, Homo sapiens
guccccacccuccacucagcu

SEQ ID NO: 653045 - RNA, 21 nt, Homo sapiens
guccccagaccaacccuggga

SEQ ID NO: 653046 - RNA, 17 nt, Homo sapiens
guccccaguuugcagaa

SEQ ID NO: 653047 - RNA, 16 nt, Homo sapiens
gucccccaaacauguu

SEQ ID NO: 653048 - RNA, 19 nt, Homo sapiens
guccccccgcugucuuuga

SEQ ID NO: 653049 - RNA, 21 nt, Homo sapiens
gucccccgagaggugggagac

SEQ ID NO: 653050 - RNA, 19 nt, Homo sapiens
guccccgcucagucuuuga

SEQ ID NO: 653051 - RNA, 23 nt, Homo sapiens
guccccgggguuccccacacagg

SEQ ID NO: 653052 - RNA, 17 nt, Homo sapiens
guccccuaaaccaaaaa

SEQ ID NO: 653053 - RNA, 18 nt, Homo sapiens
guccccuaaaccaaaaac

SEQ ID NO: 653054 - RNA, 19 nt, Homo sapiens
guccccuaacccccagucc

SEQ ID NO: 653055 - RNA, 16 nt, Homo sapiens
guccccuacucccucu

SEQ ID NO: 653056 - RNA, 17 nt, Homo sapiens
guccccucaccuccucu

SEQ ID NO: 653057 - RNA, 23 nt, Homo sapiens
guccccuccacugucacauugua

SEQ ID NO: 653058 - RNA, 18 nt, Homo sapiens
guccccucuuccuacccu

SEQ ID NO: 653059 - RNA, 22 nt, Homo sapiens
guccccuuuucuuuucuacccu

SEQ ID NO: 653060 - RNA, 18 nt, Homo sapiens
gucccggggccagcacuu

SEQ ID NO: 653061 - RNA, 19 nt, Homo sapiens
gucccggggccagcacuuc

SEQ ID NO: 653062 - RNA, 15 nt, Homo sapiens
gucccgucgugcagu

SEQ ID NO: 653063 - RNA, 16 nt, Homo sapiens
gucccgucgugcaguc

SEQ ID NO: 653064 - RNA, 13 nt, Homo sapiens
gucccguggcauu

SEQ ID NO: 653065 - RNA, 21 nt, Homo sapiens
gucccucaaaugacccaaaga

SEQ ID NO: 653066 - RNA, 15 nt, Homo sapiens
gucccucacguuucu

SEQ ID NO: 653067 - RNA, 15 nt, Homo sapiens
gucccucagugauac

SEQ ID NO: 653068 - RNA, 20 nt, Homo sapiens
gucccucauggagaccucau

SEQ ID NO: 653069 - RNA, 18 nt, Homo sapiens
gucccucccaucucuacc

SEQ ID NO: 653070 - RNA, 22 nt, Homo sapiens
gucccuccuaacaaguguaucu

SEQ ID NO: 653071 - RNA, 13 nt, Homo sapiens
gucccucucaggc

SEQ ID NO: 653072 - RNA, 21 nt, Homo sapiens
gucccucuggaaagaaacaug

SEQ ID NO: 653073 - RNA, 19 nt, Homo sapiens
gucccucuucucuccucag

SEQ ID NO: 653074 - RNA, 22 nt, Homo sapiens
gucccugaaaccuaguacugcc

SEQ ID NO: 653075 - RNA, 18 nt, Homo sapiens
gucccugucaccaagcuc

SEQ ID NO: 653076 - RNA, 21 nt, Homo sapiens
gucccuucagcaccugacccu

SEQ ID NO: 653077 - RNA, 19 nt, Homo sapiens
gucccuugcuguaugcuga

SEQ ID NO: 653078 - RNA, 13 nt, Homo sapiens
gucccuuggagac

SEQ ID NO: 653079 - RNA, 20 nt, Homo sapiens
gucccuuuaugcagagccac

SEQ ID NO: 653080 - RNA, 14 nt, Homo sapiens
guccgcaccagcug

SEQ ID NO: 653081 - RNA, 20 nt, Homo sapiens
guccgcgcgccagcacagaa

SEQ ID NO: 653082 - RNA, 21 nt, Homo sapiens
guccgugggccguaucuguca

SEQ ID NO: 653083 - RNA, 18 nt, Homo sapiens
guccuaaagaugcugacu

SEQ ID NO: 653084 - RNA, 12 nt, Homo sapiens
guccuacaguga

SEQ ID NO: 653085 - RNA, 19 nt, Homo sapiens
guccuagcaaccuccacau

SEQ ID NO: 653086 - RNA, 16 nt, Homo sapiens
guccuaggacuuaaaa

SEQ ID NO: 653087 - RNA, 20 nt, Homo sapiens
guccuaucuccagcggcccu

SEQ ID NO: 653088 - RNA, 21 nt, Homo sapiens
guccuaugucaauuuguauau

SEQ ID NO: 653089 - RNA, 23 nt, Homo sapiens
guccucacccaucaaaagcacca

SEQ ID NO: 653090 - RNA, 18 nt, Homo sapiens
guccucaucucuacccau

SEQ ID NO: 653091 - RNA, 21 nt, Homo sapiens
guccucauuauaaaaugggaa

SEQ ID NO: 653092 - RNA, 12 nt, Homo sapiens
guccucauucuu

SEQ ID NO: 653093 - RNA, 15 nt, Homo sapiens
guccucgaauucuca

SEQ ID NO: 653094 - RNA, 21 nt, Homo sapiens
guccucuggaucacagacacu

SEQ ID NO: 653095 - RNA, 22 nt, Homo sapiens
guccucugucagucacagccac

SEQ ID NO: 653096 - RNA, 17 nt, Homo sapiens
guccucuucugcaucuu

SEQ ID NO: 653097 - RNA, 16 nt, Homo sapiens
guccucuugaagcaua

SEQ ID NO: 653098 - RNA, 15 nt, Homo sapiens
guccucuuugugaua

SEQ ID NO: 653099 - RNA, 23 nt, Homo sapiens
guccugaaaaaugcucaaucuca

SEQ ID NO: 653100 - RNA, 20 nt, Homo sapiens
guccugaaaguaacucauaa

SEQ ID NO: 653101 - RNA, 20 nt, Homo sapiens
guccugaaccgacugacccu

SEQ ID NO: 653102 - RNA, 20 nt, Homo sapiens
guccugaaggaaaaugacuc

SEQ ID NO: 653103 - RNA, 20 nt, Homo sapiens
guccugagaaagcucaaagg

SEQ ID NO: 653104 - RNA, 16 nt, Homo sapiens
guccugauggcccaaa

SEQ ID NO: 653105 - RNA, 22 nt, Homo sapiens
guccugcccaaugccuugacaa

SEQ ID NO: 653106 - RNA, 14 nt, Homo sapiens
guccugcucucuuc

SEQ ID NO: 653107 - RNA, 17 nt, Homo sapiens
guccuggaaauucugcu

SEQ ID NO: 653108 - RNA, 18 nt, Homo sapiens
guccuggcugcacucuug

SEQ ID NO: 653109 - RNA, 14 nt, Homo sapiens
guccuggguucugg

SEQ ID NO: 653110 - RNA, 22 nt, Homo sapiens
guccugguugggaucacaccca

SEQ ID NO: 653111 - RNA, 22 nt, Homo sapiens
guccugugcggugucaccauga

SEQ ID NO: 653112 - RNA, 13 nt, Homo sapiens
guccuguuugcag

SEQ ID NO: 653113 - RNA, 12 nt, Homo sapiens
uacuguuuccau

SEQ ID NO: 653114 - RNA, 16 nt, Homo sapiens
uacuguuuuugauaaa

SEQ ID NO: 653115 - RNA, 17 nt, Homo sapiens
uacuuaaaaugacaaag

SEQ ID NO: 653116 - RNA, 14 nt, Homo sapiens
uacuuaacauaucu

SEQ ID NO: 653117 - RNA, 17 nt, Homo sapiens
uacuuaacauaucugau

SEQ ID NO: 653118 - RNA, 14 nt, Homo sapiens
uacuuacacuguau

SEQ ID NO: 653119 - RNA, 15 nt, Homo sapiens
uacuuagaaugccau

SEQ ID NO: 653120 - RNA, 16 nt, Homo sapiens
uacuuagauacuaaua

SEQ ID NO: 653121 - RNA, 20 nt, Homo sapiens
uacuuaucuugcuccauugu

SEQ ID NO: 653122 - RNA, 14 nt, Homo sapiens
uacuuaugaugaug

SEQ ID NO: 653123 - RNA, 19 nt, Homo sapiens
uacuuaugaugaugaaggg

SEQ ID NO: 653124 - RNA, 13 nt, Homo sapiens
uacuuaugcaaga

SEQ ID NO: 653125 - RNA, 15 nt, Homo sapiens
uacuuauguugcaca

SEQ ID NO: 653126 - RNA, 21 nt, Homo sapiens
uacuuauguugcacaaugaga

SEQ ID NO: 653127 - RNA, 20 nt, Homo sapiens
uacuuauuguauuuaugugu

SEQ ID NO: 653128 - RNA, 12 nt, Homo sapiens
uacuucacuacu

SEQ ID NO: 653129 - RNA, 24 nt, Homo sapiens
uacuucacugguguacaucguuua

SEQ ID NO: 653130 - RNA, 20 nt, Homo sapiens
uacuucaguauuaaauuaga

SEQ ID NO: 653131 - RNA, 17 nt, Homo sapiens
uacuucagugcaccuac

SEQ ID NO: 653132 - RNA, 23 nt, Homo sapiens
uacuuccaggauggaugcaucac

SEQ ID NO: 653133 - RNA, 15 nt, Homo sapiens
uacuucccaguauaa

SEQ ID NO: 653134 - RNA, 19 nt, Homo sapiens
uacuuccuguguacucuuu

SEQ ID NO: 653135 - RNA, 22 nt, Homo sapiens
uacuucgucuucgcccucugaa

SEQ ID NO: 653136 - RNA, 19 nt, Homo sapiens
uacuucuacauccaaugua

SEQ ID NO: 653137 - RNA, 15 nt, Homo sapiens
uacuucuguguucau

SEQ ID NO: 653138 - RNA, 22 nt, Homo sapiens
uacuugaaauaccagugaacca

SEQ ID NO: 653139 - RNA, 19 nt, Homo sapiens
uacuugagccggacaccaa

SEQ ID NO: 653140 - RNA, 21 nt, Homo sapiens
uacuugauaauauuagugauu

SEQ ID NO: 653141 - RNA, 17 nt, Homo sapiens
uacuugcaagccucaaa

SEQ ID NO: 653142 - RNA, 16 nt, Homo sapiens
uacuugcacuguuacu

SEQ ID NO: 653143 - RNA, 14 nt, Homo sapiens
uacuugccaagaaa

SEQ ID NO: 653144 - RNA, 18 nt, Homo sapiens
uacuuggaauccuguguc

SEQ ID NO: 653145 - RNA, 20 nt, Homo sapiens
uacuuguagaguggugcugc

SEQ ID NO: 653146 - RNA, 14 nt, Homo sapiens
uacuugucauauca

SEQ ID NO: 653147 - RNA, 21 nt, Homo sapiens
uacuugucauaucacuaaaua

SEQ ID NO: 653148 - RNA, 15 nt, Homo sapiens
uacuugugcacuuag

SEQ ID NO: 653149 - RNA, 19 nt, Homo sapiens
uacuuguggugugaccaug

SEQ ID NO: 653150 - RNA, 14 nt, Homo sapiens
uacuuguuccagau

SEQ ID NO: 653151 - RNA, 17 nt, Homo sapiens
uacuuguuuucacuuua

SEQ ID NO: 653152 - RNA, 18 nt, Homo sapiens
uacuuguuuucacuuuau

SEQ ID NO: 653153 - RNA, 17 nt, Homo sapiens
uacuuuaaaaugccaau

SEQ ID NO: 653154 - RNA, 13 nt, Homo sapiens
uacuuuaaaggaa

SEQ ID NO: 653155 - RNA, 21 nt, Homo sapiens
uacuuuacuaauaaacugugu

SEQ ID NO: 653156 - RNA, 21 nt, Homo sapiens
uacuuuauauaaggcauucca

SEQ ID NO: 653157 - RNA, 16 nt, Homo sapiens
uacuuuaucaaugugu

SEQ ID NO: 653158 - RNA, 15 nt, Homo sapiens
uacuuuauuguacag

SEQ ID NO: 653159 - RNA, 22 nt, Homo sapiens
uacuuuauuucugaucuauaca

SEQ ID NO: 653160 - RNA, 16 nt, Homo sapiens
uacuuucccucaucca

SEQ ID NO: 653161 - RNA, 17 nt, Homo sapiens
uacuuucuguugccaca

SEQ ID NO: 653162 - RNA, 19 nt, Homo sapiens
uacuuugccaacuugccau

SEQ ID NO: 653163 - RNA, 24 nt, Homo sapiens
uacuuugggacgcccacguggcag

SEQ ID NO: 653164 - RNA, 17 nt, Homo sapiens
uacuuugguaguggaau

SEQ ID NO: 653165 - RNA, 18 nt, Homo sapiens
uacuuuguugaguauuau

SEQ ID NO: 653166 - RNA, 18 nt, Homo sapiens
uacuuuuaaacuguguac

SEQ ID NO: 653167 - RNA, 16 nt, Homo sapiens
uacuuuuacucugccu

SEQ ID NO: 653168 - RNA, 20 nt, Homo sapiens
uacuuuuauaauaaaaggaa

SEQ ID NO: 653169 - RNA, 19 nt, Homo sapiens
uacuuuuaugcaaccauaa

SEQ ID NO: 653170 - RNA, 23 nt, Homo sapiens
uacuuuuauuuuauucugaagga

SEQ ID NO: 653171 - RNA, 18 nt, Homo sapiens
uacuuuucuguucaucac

SEQ ID NO: 653172 - RNA, 15 nt, Homo sapiens
uacuuuuuaguaauu

SEQ ID NO: 653173 - RNA, 17 nt, Homo sapiens
uacuuuuuauacuccau

SEQ ID NO: 653174 - RNA, 21 nt, Homo sapiens
uacuuuuucuggucucuacca

SEQ ID NO: 653175 - RNA, 19 nt, Homo sapiens
uagaaaaaaaaauucacau

SEQ ID NO: 653176 - RNA, 12 nt, Homo sapiens
uagaaaaaccac

SEQ ID NO: 653177 - RNA, 22 nt, Homo sapiens
uagaaaaauagcugugaacaga

SEQ ID NO: 653178 - RNA, 13 nt, Homo sapiens
uagaaaaguauuc

SEQ ID NO: 653179 - RNA, 18 nt, Homo sapiens
uagaaaauuagacuguga

SEQ ID NO: 653180 - RNA, 17 nt, Homo sapiens
uagaaacaauacuguuc

SEQ ID NO: 653181 - RNA, 13 nt, Homo sapiens
uagaaacuacaaa

SEQ ID NO: 653182 - RNA, 20 nt, Homo sapiens
uagaaacucaggauggucau

SEQ ID NO: 653183 - RNA, 17 nt, Homo sapiens
uagaaagaaaaauugga

SEQ ID NO: 653184 - RNA, 19 nt, Homo sapiens
uagaaagcugacauugcca

SEQ ID NO: 653185 - RNA, 18 nt, Homo sapiens
uagaaaggaagacagauu

SEQ ID NO: 653186 - RNA, 20 nt, Homo sapiens
uagaaaggcaguucagguau

SEQ ID NO: 653187 - RNA, 14 nt, Homo sapiens
uagaaagggccuug

SEQ ID NO: 653188 - RNA, 15 nt, Homo sapiens
uagaaagggugcugc

SEQ ID NO: 653189 - RNA, 15 nt, Homo sapiens
uagaaaggucaucca

SEQ ID NO: 653190 - RNA, 16 nt, Homo sapiens
uagaaauaauaugcau

SEQ ID NO: 653191 - RNA, 15 nt, Homo sapiens
uagaaauagauuuaa

SEQ ID NO: 653192 - RNA, 15 nt, Homo sapiens
uagaaauauagccaa

SEQ ID NO: 653193 - RNA, 18 nt, Homo sapiens
uagaaauucagcauuuga

SEQ ID NO: 653194 - RNA, 14 nt, Homo sapiens
uagaaauuccccac

SEQ ID NO: 653195 - RNA, 18 nt, Homo sapiens
uagaaauuggcuggaugu

SEQ ID NO: 653196 - RNA, 17 nt, Homo sapiens
uagaacaaugcuauaau

SEQ ID NO: 653197 - RNA, 13 nt, Homo sapiens
uagaacacugccu

SEQ ID NO: 653198 - RNA, 22 nt, Homo sapiens
uagaacaguggaaacuaugugu

SEQ ID NO: 653199 - RNA, 19 nt, Homo sapiens
uagaacaucccugggcaag

SEQ ID NO: 653200 - RNA, 12 nt, Homo sapiens
uagaaccaguga

SEQ ID NO: 653201 - RNA, 18 nt, Homo sapiens
uagaacuccaauacucac

SEQ ID NO: 653202 - RNA, 22 nt, Homo sapiens
uagaacuggaucccaacaccaa

SEQ ID NO: 653203 - RNA, 16 nt, Homo sapiens
uagaacugucugugaa

SEQ ID NO: 653204 - RNA, 17 nt, Homo sapiens
uagaacugucugugaac

SEQ ID NO: 653205 - RNA, 18 nt, Homo sapiens
uagaacugucugugaaca

SEQ ID NO: 653206 - RNA, 17 nt, Homo sapiens
uagaacuucauggauca

SEQ ID NO: 653207 - RNA, 12 nt, Homo sapiens
uagaacuugccu

SEQ ID NO: 653208 - RNA, 19 nt, Homo sapiens
uagaacuuuaccuauggaa

SEQ ID NO: 653209 - RNA, 20 nt, Homo sapiens
uagaacuuuauuaaguaaaa

SEQ ID NO: 653210 - RNA, 19 nt, Homo sapiens
uagaacuuugccagucuuu

SEQ ID NO: 653211 - RNA, 17 nt, Homo sapiens
uagaagacaacaggcau

SEQ ID NO: 653212 - RNA, 17 nt, Homo sapiens
uagaagagaaaugcugc

SEQ ID NO: 653213 - RNA, 14 nt, Homo sapiens
uagaagauggcacu

SEQ ID NO: 653214 - RNA, 19 nt, Homo sapiens
uagaagauuuuaugcugcu

SEQ ID NO: 653215 - RNA, 22 nt, Homo sapiens
uagaagcaacuaggaaaaucac

SEQ ID NO: 653216 - RNA, 21 nt, Homo sapiens
uagaagcuguaacagaauaca

SEQ ID NO: 653217 - RNA, 22 nt, Homo sapiens
uagaaguagcaaaaaguauuga

SEQ ID NO: 653218 - RNA, 11 nt, Homo sapiens
uagaaguaguu

SEQ ID NO: 653219 - RNA, 17 nt, Homo sapiens
uagaagucuuagaugua

SEQ ID NO: 653220 - RNA, 19 nt, Homo sapiens
uagaagucuuucaguggaa

SEQ ID NO: 653221 - RNA, 12 nt, Homo sapiens
uagaagugcuaa

SEQ ID NO: 653222 - RNA, 18 nt, Homo sapiens
uagaagugugaagugcag

SEQ ID NO: 653223 - RNA, 23 nt, Homo sapiens
uagaauaaauucccaacuucucu

SEQ ID NO: 653224 - RNA, 13 nt, Homo sapiens
uagaauaagccuu

SEQ ID NO: 653225 - RNA, 14 nt, Homo sapiens
uagaauaagccuuc

SEQ ID NO: 653226 - RNA, 14 nt, Homo sapiens
uagaauaaucuauu

SEQ ID NO: 653227 - RNA, 14 nt, Homo sapiens
uagaauaaucucau

SEQ ID NO: 653228 - RNA, 15 nt, Homo sapiens
uagaauacuuuuuaa

SEQ ID NO: 653229 - RNA, 18 nt, Homo sapiens
uagaauagcauuugccac

SEQ ID NO: 653230 - RNA, 22 nt, Homo sapiens
uagaauagcauuugccacuuag

SEQ ID NO: 653231 - RNA, 16 nt, Homo sapiens
uagaauagugcauugu

SEQ ID NO: 653232 - RNA, 16 nt, Homo sapiens
uagaauauaggucucu

SEQ ID NO: 653233 - RNA, 17 nt, Homo sapiens
uagaauauccaugaccu

SEQ ID NO: 653234 - RNA, 17 nt, Homo sapiens
uagaauauuuauuaccu

SEQ ID NO: 653235 - RNA, 14 nt, Homo sapiens
uaggcuauucacaa

SEQ ID NO: 653236 - RNA, 18 nt, Homo sapiens
uaggcuggaggacagugg

SEQ ID NO: 653237 - RNA, 13 nt, Homo sapiens
uaggcuguggggu

SEQ ID NO: 653238 - RNA, 22 nt, Homo sapiens
uaggcuguguauuucuuuucag

SEQ ID NO: 653239 - RNA, 21 nt, Homo sapiens
uaggcuuuaggagcucuguaa

SEQ ID NO: 653240 - RNA, 20 nt, Homo sapiens
uaggcuuuguauacuuuuau

SEQ ID NO: 653241 - RNA, 20 nt, Homo sapiens
uaggcuuuguaugacaguga

SEQ ID NO: 653242 - RNA, 21 nt, Homo sapiens
uaggcuuuguaugacagugaa

SEQ ID NO: 653243 - RNA, 14 nt, Homo sapiens
uagggaaaaaccag

SEQ ID NO: 653244 - RNA, 17 nt, Homo sapiens
uagggaaggccucccag

SEQ ID NO: 653245 - RNA, 14 nt, Homo sapiens
uagggacacuuuca

SEQ ID NO: 653246 - RNA, 20 nt, Homo sapiens
uagggacacuuucacagucc

SEQ ID NO: 653247 - RNA, 15 nt, Homo sapiens
uagggaguaccugcu

SEQ ID NO: 653248 - RNA, 23 nt, Homo sapiens
uagggaguuagaggcuguacaag

SEQ ID NO: 653249 - RNA, 14 nt, Homo sapiens
uagggaugcucaaa

SEQ ID NO: 653250 - RNA, 23 nt, Homo sapiens
uagggcaacaauacaugcugcua

SEQ ID NO: 653251 - RNA, 13 nt, Homo sapiens
uagggcuguaaaa

SEQ ID NO: 653252 - RNA, 23 nt, Homo sapiens
uagggcuucaaggcccucagaga

SEQ ID NO: 653253 - RNA, 11 nt, Homo sapiens
uaggggaugag

SEQ ID NO: 653254 - RNA, 23 nt, Homo sapiens
uagggggagccccuucugcucag

SEQ ID NO: 653255 - RNA, 21 nt, Homo sapiens
uaggggugugggucaaaccaa

SEQ ID NO: 653256 - RNA, 22 nt, Homo sapiens
uagggugcaagaagccauuuag

SEQ ID NO: 653257 - RNA, 16 nt, Homo sapiens
uaggguggcccuugca

SEQ ID NO: 653258 - RNA, 17 nt, Homo sapiens
uaggguguguguucacc

SEQ ID NO: 653259 - RNA, 13 nt, Homo sapiens
uagguagacuuug

SEQ ID NO: 653260 - RNA, 17 nt, Homo sapiens
uagguauuuacccaaga

SEQ ID NO: 653261 - RNA, 16 nt, Homo sapiens
uaggucauuggccacu

SEQ ID NO: 653262 - RNA, 23 nt, Homo sapiens
uaggugacagggccgugagcaug

SEQ ID NO: 653263 - RNA, 21 nt, Homo sapiens
uaggugacuuguuuacucauu

SEQ ID NO: 653264 - RNA, 22 nt, Homo sapiens
uaggugccaggcuguaagcauu

SEQ ID NO: 653265 - RNA, 18 nt, Homo sapiens
uaggugcccgaguagcau

SEQ ID NO: 653266 - RNA, 11 nt, Homo sapiens
uagguggcaag

SEQ ID NO: 653267 - RNA, 19 nt, Homo sapiens
uagguggguugaaagccaa

SEQ ID NO: 653268 - RNA, 16 nt, Homo sapiens
uagguggugccagugg

SEQ ID NO: 653269 - RNA, 19 nt, Homo sapiens
uagguuugauauguaguua

SEQ ID NO: 653270 - RNA, 17 nt, Homo sapiens
uagguuuugcuugggaa

SEQ ID NO: 653271 - RNA, 12 nt, Homo sapiens
uaguaaagcaaa

SEQ ID NO: 653272 - RNA, 19 nt, Homo sapiens
uaguaaagugauaauuucu

SEQ ID NO: 653273 - RNA, 14 nt, Homo sapiens
uaguaaaugcgugc

SEQ ID NO: 653274 - RNA, 15 nt, Homo sapiens
uaguaacaguuguga

SEQ ID NO: 653275 - RNA, 14 nt, Homo sapiens
uaguaacauagaca

SEQ ID NO: 653276 - RNA, 21 nt, Homo sapiens
uaguaacuacuuuuuauacuc

SEQ ID NO: 653277 - RNA, 19 nt, Homo sapiens
uaguaacuuuccauagggc

SEQ ID NO: 653278 - RNA, 22 nt, Homo sapiens
uaguaaggcaauccuaagcaaa

SEQ ID NO: 653279 - RNA, 13 nt, Homo sapiens
uaguaagugcuuu

SEQ ID NO: 653280 - RNA, 15 nt, Homo sapiens
uaguaaucacaguug

SEQ ID NO: 653281 - RNA, 14 nt, Homo sapiens
uaguacaauucuua

SEQ ID NO: 653282 - RNA, 20 nt, Homo sapiens
uaguacagguuuugcccuga

SEQ ID NO: 653283 - RNA, 14 nt, Homo sapiens
uaguacuggcacaa

SEQ ID NO: 653284 - RNA, 15 nt, Homo sapiens
uaguacuucuucugu

SEQ ID NO: 653285 - RNA, 13 nt, Homo sapiens
uaguagaaacggg

SEQ ID NO: 653286 - RNA, 22 nt, Homo sapiens
uaguagaaaggucauccaaaga

SEQ ID NO: 653287 - RNA, 14 nt, Homo sapiens
uaguagcauuucaa

SEQ ID NO: 653288 - RNA, 17 nt, Homo sapiens
uaguauauuuauacucu

SEQ ID NO: 653289 - RNA, 15 nt, Homo sapiens
uaguaugaaugcagu

SEQ ID NO: 653290 - RNA, 11 nt, Homo sapiens
uaguaugcagu

SEQ ID NO: 653291 - RNA, 23 nt, Homo sapiens
uaguaugcuggcuuguacauagu

SEQ ID NO: 653292 - RNA, 19 nt, Homo sapiens
uaguauucucuugugcauu

SEQ ID NO: 653293 - RNA, 22 nt, Homo sapiens
uaguauuggagcacauguuacu

SEQ ID NO: 653294 - RNA, 13 nt, Homo sapiens
uaguauuuaugaa

SEQ ID NO: 653295 - RNA, 18 nt, Homo sapiens
uaguauuucucaggaaga

SEQ ID NO: 653296 - RNA, 18 nt, Homo sapiens
uagucaaauuauguauug

SEQ ID NO: 653297 - RNA, 20 nt, Homo sapiens
uagucaaggaggaaagggau

SEQ ID NO: 653298 - RNA, 16 nt, Homo sapiens
uagucaauccaagacu

SEQ ID NO: 653299 - RNA, 15 nt, Homo sapiens
uagucaauccuguca

SEQ ID NO: 653300 - RNA, 17 nt, Homo sapiens
uagucaauccugucaua

SEQ ID NO: 653301 - RNA, 18 nt, Homo sapiens
uagucaauccugucauau

SEQ ID NO: 653302 - RNA, 14 nt, Homo sapiens
uagucacaccaucu

SEQ ID NO: 653303 - RNA, 14 nt, Homo sapiens
uagucaccagagac

SEQ ID NO: 653304 - RNA, 19 nt, Homo sapiens
uagucagaagcagguucuu

SEQ ID NO: 653305 - RNA, 18 nt, Homo sapiens
uagucaggaauggcugca

SEQ ID NO: 653306 - RNA, 15 nt, Homo sapiens
uagucaguugcucau

SEQ ID NO: 653307 - RNA, 21 nt, Homo sapiens
uagucaucagauaugcuuacu

SEQ ID NO: 653308 - RNA, 13 nt, Homo sapiens
uagucaugugacc

SEQ ID NO: 653309 - RNA, 22 nt, Homo sapiens
uagucauucuuacaauugcacu

SEQ ID NO: 653310 - RNA, 20 nt, Homo sapiens
uaguccaccucccauuacuu

SEQ ID NO: 653311 - RNA, 18 nt, Homo sapiens
uagucccagcuacucaga

SEQ ID NO: 653312 - RNA, 17 nt, Homo sapiens
uagucccagcuacuccg

SEQ ID NO: 653313 - RNA, 20 nt, Homo sapiens
uagucccagcuacuugagag

SEQ ID NO: 653314 - RNA, 20 nt, Homo sapiens
uaguccccagccugcucccu

SEQ ID NO: 653315 - RNA, 23 nt, Homo sapiens
uaguccccguacuagguuggaca

SEQ ID NO: 653316 - RNA, 21 nt, Homo sapiens
uagucccgauaggguauuuga

SEQ ID NO: 653317 - RNA, 21 nt, Homo sapiens
uaguccgugcugacagcugcu

SEQ ID NO: 653318 - RNA, 22 nt, Homo sapiens
uaguccgugcugacagcugcuc

SEQ ID NO: 653319 - RNA, 19 nt, Homo sapiens
uaguccuugggcaguucuc

SEQ ID NO: 653320 - RNA, 17 nt, Homo sapiens
uagucgucuaaacauaa

SEQ ID NO: 653321 - RNA, 21 nt, Homo sapiens
uagucuccacuuucucaaugc

SEQ ID NO: 653322 - RNA, 13 nt, Homo sapiens
uagucuccaugca

SEQ ID NO: 653323 - RNA, 15 nt, Homo sapiens
uagucuguuugcaaa

SEQ ID NO: 653324 - RNA, 14 nt, Homo sapiens
uagucuuauguaaa

SEQ ID NO: 653325 - RNA, 15 nt, Homo sapiens
uagugaaaugccaca

SEQ ID NO: 653326 - RNA, 15 nt, Homo sapiens
uagugaacauaugga

SEQ ID NO: 653327 - RNA, 17 nt, Homo sapiens
uagugaauacugcuaca

SEQ ID NO: 653328 - RNA, 22 nt, Homo sapiens
uagugaaucacguaaagcuaga

SEQ ID NO: 653329 - RNA, 14 nt, Homo sapiens
uagugacacacaga

SEQ ID NO: 653330 - RNA, 17 nt, Homo sapiens
uagugacuguaauuaau

SEQ ID NO: 653331 - RNA, 21 nt, Homo sapiens
uagugacuuaauucuuucuaa

SEQ ID NO: 653332 - RNA, 17 nt, Homo sapiens
uagugagccugggccag

SEQ ID NO: 653333 - RNA, 13 nt, Homo sapiens
uagugaucauuua

SEQ ID NO: 653334 - RNA, 14 nt, Homo sapiens
uagugauggagcuu

SEQ ID NO: 653335 - RNA, 14 nt, Homo sapiens
uagugauuaccaaa

SEQ ID NO: 653336 - RNA, 18 nt, Homo sapiens
uagugauucugauuucag

SEQ ID NO: 653337 - RNA, 17 nt, Homo sapiens
uagugcauuucaaggaa

SEQ ID NO: 653338 - RNA, 23 nt, Homo sapiens
uagugccaggaaacuaauuuccu

SEQ ID NO: 653339 - RNA, 23 nt, Homo sapiens
uagugccagguggcucagugcca

SEQ ID NO: 653340 - RNA, 19 nt, Homo sapiens
uagugcucuuaacuuguua

SEQ ID NO: 653341 - RNA, 11 nt, Homo sapiens
uagugcugcug

SEQ ID NO: 653342 - RNA, 21 nt, Homo sapiens
uagugcuguaauauuguaaau

SEQ ID NO: 653343 - RNA, 22 nt, Homo sapiens
uagugcuuugugauaguucagu

SEQ ID NO: 653344 - RNA, 16 nt, Homo sapiens
uaguggaccacuugga

SEQ ID NO: 653345 - RNA, 21 nt, Homo sapiens
uagugggcaccccacugcaau

SEQ ID NO: 653346 - RNA, 14 nt, Homo sapiens
uagugguuacccag

SEQ ID NO: 653347 - RNA, 17 nt, Homo sapiens
uaguguaacuugcuuaa

SEQ ID NO: 653348 - RNA, 13 nt, Homo sapiens
uaguguaccuccu

SEQ ID NO: 653349 - RNA, 14 nt, Homo sapiens
uaguguacuuggag

SEQ ID NO: 653350 - RNA, 18 nt, Homo sapiens
uaguguauuuugcacaaa

SEQ ID NO: 653351 - RNA, 14 nt, Homo sapiens
uagugucacugaug

SEQ ID NO: 653352 - RNA, 14 nt, Homo sapiens
uaguguccauaaau

SEQ ID NO: 653353 - RNA, 18 nt, Homo sapiens
uaguguccccccuugaag

SEQ ID NO: 653354 - RNA, 21 nt, Homo sapiens
uagugugaaauauauuacuua

SEQ ID NO: 653355 - RNA, 14 nt, Homo sapiens
uagugugccuucca

SEQ ID NO: 653356 - RNA, 21 nt, Homo sapiens
uaguguggaagcauagugaac

SEQ ID NO: 653357 - RNA, 15 nt, Homo sapiens
ucucugagcagugaa

SEQ ID NO: 653358 - RNA, 20 nt, Homo sapiens
ucucugaguccuuugcuaau

SEQ ID NO: 653359 - RNA, 15 nt, Homo sapiens
ucucugauauuugga

SEQ ID NO: 653360 - RNA, 17 nt, Homo sapiens
ucucugauuccccaaau

SEQ ID NO: 653361 - RNA, 17 nt, Homo sapiens
ucucugcagacuuccca

SEQ ID NO: 653362 - RNA, 15 nt, Homo sapiens
ucucugcagcucuga

SEQ ID NO: 653363 - RNA, 18 nt, Homo sapiens
ucucugcaguuuuuccca

SEQ ID NO: 653364 - RNA, 21 nt, Homo sapiens
ucucugccccguuucuugccc

SEQ ID NO: 653365 - RNA, 18 nt, Homo sapiens
ucucugcuccaccacauc

SEQ ID NO: 653366 - RNA, 20 nt, Homo sapiens
ucucugcugccucuguggaa

SEQ ID NO: 653367 - RNA, 19 nt, Homo sapiens
ucucuggagccaaguccag

SEQ ID NO: 653368 - RNA, 16 nt, Homo sapiens
ucucugggucccgggg

SEQ ID NO: 653369 - RNA, 13 nt, Homo sapiens
ucucugguaauau

SEQ ID NO: 653370 - RNA, 14 nt, Homo sapiens
ucucuguaaccaga

SEQ ID NO: 653371 - RNA, 18 nt, Homo sapiens
ucucuguaaccagacuuu

SEQ ID NO: 653372 - RNA, 13 nt, Homo sapiens
ucucugugccauc

SEQ ID NO: 653373 - RNA, 20 nt, Homo sapiens
ucucugugugcacacccaug

SEQ ID NO: 653374 - RNA, 14 nt, Homo sapiens
ucucuguugucgua

SEQ ID NO: 653375 - RNA, 19 nt, Homo sapiens
ucucuuaaaguuggaauuu

SEQ ID NO: 653376 - RNA, 20 nt, Homo sapiens
ucucuuaaguggucuaguca

SEQ ID NO: 653377 - RNA, 14 nt, Homo sapiens
ucucuuacaaucug

SEQ ID NO: 653378 - RNA, 22 nt, Homo sapiens
ucucuuacaaucuguuuuagac

SEQ ID NO: 653379 - RNA, 18 nt, Homo sapiens
ucucuuacaccugccaug

SEQ ID NO: 653380 - RNA, 16 nt, Homo sapiens
ucucuuauagaauauu

SEQ ID NO: 653381 - RNA, 21 nt, Homo sapiens
ucucuuaugauacuugaggua

SEQ ID NO: 653382 - RNA, 14 nt, Homo sapiens
ucucuucaccacug

SEQ ID NO: 653383 - RNA, 22 nt, Homo sapiens
ucucuucagccccuagugcuau

SEQ ID NO: 653384 - RNA, 15 nt, Homo sapiens
ucucuuccuacccuu

SEQ ID NO: 653385 - RNA, 22 nt, Homo sapiens
ucucuuccucauauuucagcag

SEQ ID NO: 653386 - RNA, 14 nt, Homo sapiens
ucucuucucaccuu

SEQ ID NO: 653387 - RNA, 17 nt, Homo sapiens
ucucuucugcugucucu

SEQ ID NO: 653388 - RNA, 22 nt, Homo sapiens
ucucuucuuuuggcuuccauga

SEQ ID NO: 653389 - RNA, 20 nt, Homo sapiens
ucucuugaaaaguucaggga

SEQ ID NO: 653390 - RNA, 22 nt, Homo sapiens
ucucuugaauuugguaucuuau

SEQ ID NO: 653391 - RNA, 17 nt, Homo sapiens
ucucuugacguuuacau

SEQ ID NO: 653392 - RNA, 17 nt, Homo sapiens
ucucuugccagcauuuu

SEQ ID NO: 653393 - RNA, 21 nt, Homo sapiens
ucucuugccagcauuuucaca

SEQ ID NO: 653394 - RNA, 11 nt, Homo sapiens
ucucuugcccc

SEQ ID NO: 653395 - RNA, 15 nt, Homo sapiens
ucucuugguaugcau

SEQ ID NO: 653396 - RNA, 12 nt, Homo sapiens
ucucuuguccug

SEQ ID NO: 653397 - RNA, 20 nt, Homo sapiens
ucucuuucacauuguuugcu

SEQ ID NO: 653398 - RNA, 16 nt, Homo sapiens
ucucuuugguguuaca

SEQ ID NO: 653399 - RNA, 21 nt, Homo sapiens
ucucuuuugagcuaaucuuca

SEQ ID NO: 653400 - RNA, 12 nt, Homo sapiens
ucugaaaaccaa

SEQ ID NO: 653401 - RNA, 14 nt, Homo sapiens
ucugaaaauuccag

SEQ ID NO: 653402 - RNA, 23 nt, Homo sapiens
ucugaaacugcauaagugaaaau

SEQ ID NO: 653403 - RNA, 14 nt, Homo sapiens
ucugaaagacagaa

SEQ ID NO: 653404 - RNA, 17 nt, Homo sapiens
ucugaaaggauguggaa

SEQ ID NO: 653405 - RNA, 19 nt, Homo sapiens
ucugaaaucuccuuuagcc

SEQ ID NO: 653406 - RNA, 20 nt, Homo sapiens
ucugaaauuuuaauugaacu

SEQ ID NO: 653407 - RNA, 20 nt, Homo sapiens
ucugaacguggaauucaccu

SEQ ID NO: 653408 - RNA, 17 nt, Homo sapiens
ucugaacuacacugcau

SEQ ID NO: 653409 - RNA, 19 nt, Homo sapiens
ucugaacuugcauugugau

SEQ ID NO: 653410 - RNA, 15 nt, Homo sapiens
ucugaagacagucuu

SEQ ID NO: 653411 - RNA, 19 nt, Homo sapiens
ucugaaggucccaccucca

SEQ ID NO: 653412 - RNA, 13 nt, Homo sapiens
ucugaagucacau

SEQ ID NO: 653413 - RNA, 21 nt, Homo sapiens
ucugaauaaaguguaacaauu

SEQ ID NO: 653414 - RNA, 16 nt, Homo sapiens
ucugaauaacauuugu

SEQ ID NO: 653415 - RNA, 13 nt, Homo sapiens
ucugaauccuuuu

SEQ ID NO: 653416 - RNA, 20 nt, Homo sapiens
ucugaaugcugccacaacca

SEQ ID NO: 653417 - RNA, 18 nt, Homo sapiens
ucugaauggaagaguguu

SEQ ID NO: 653418 - RNA, 15 nt, Homo sapiens
ucugaauuaauuaau

SEQ ID NO: 653419 - RNA, 14 nt, Homo sapiens
ucugacacauuaau

SEQ ID NO: 653420 - RNA, 13 nt, Homo sapiens
ucugaccaaaaca

SEQ ID NO: 653421 - RNA, 14 nt, Homo sapiens
ucugaccacagcau

SEQ ID NO: 653422 - RNA, 13 nt, Homo sapiens
ucugaccagcagc

SEQ ID NO: 653423 - RNA, 13 nt, Homo sapiens
ucugaccauuuca

SEQ ID NO: 653424 - RNA, 16 nt, Homo sapiens
ucugaccuuccagagc

SEQ ID NO: 653425 - RNA, 23 nt, Homo sapiens
ucugacgucaacccaagcucugg

SEQ ID NO: 653426 - RNA, 20 nt, Homo sapiens
ucugacuaagguugacauaa

SEQ ID NO: 653427 - RNA, 17 nt, Homo sapiens
ucugacucagggcuccu

SEQ ID NO: 653428 - RNA, 21 nt, Homo sapiens
ucugacucauccccacagcug

SEQ ID NO: 653429 - RNA, 17 nt, Homo sapiens
ucugacucuaagaauuc

SEQ ID NO: 653430 - RNA, 13 nt, Homo sapiens
ucugacuguuguc

SEQ ID NO: 653431 - RNA, 23 nt, Homo sapiens
ucugacuuaagcugccucaagga

SEQ ID NO: 653432 - RNA, 16 nt, Homo sapiens
ucugagaaaguacaaa

SEQ ID NO: 653433 - RNA, 15 nt, Homo sapiens
ucugagaacuccuca

SEQ ID NO: 653434 - RNA, 17 nt, Homo sapiens
ucugagaaggugagaua

SEQ ID NO: 653435 - RNA, 21 nt, Homo sapiens
ucugagaaucacggugguaaa

SEQ ID NO: 653436 - RNA, 17 nt, Homo sapiens
ucugagaauuccaagga

SEQ ID NO: 653437 - RNA, 14 nt, Homo sapiens
ucugagaauuucca

SEQ ID NO: 653438 - RNA, 15 nt, Homo sapiens
ucugagacauuccac

SEQ ID NO: 653439 - RNA, 22 nt, Homo sapiens
ucugagacuccucauaccucag

SEQ ID NO: 653440 - RNA, 22 nt, Homo sapiens
ucugagagugaaaccaugacug

SEQ ID NO: 653441 - RNA, 20 nt, Homo sapiens
ucugagcacagcugcauuaa

SEQ ID NO: 653442 - RNA, 22 nt, Homo sapiens
ucugagcacaggugacagauca

SEQ ID NO: 653443 - RNA, 20 nt, Homo sapiens
ucugagcacggacucuccca

SEQ ID NO: 653444 - RNA, 19 nt, Homo sapiens
ucugagcagugaaugauuc

SEQ ID NO: 653445 - RNA, 23 nt, Homo sapiens
ucugagcagugaaugauucagug

SEQ ID NO: 653446 - RNA, 21 nt, Homo sapiens
ucugagcaguuucauugugau

SEQ ID NO: 653447 - RNA, 15 nt, Homo sapiens
ucugagccaagggag

SEQ ID NO: 653448 - RNA, 17 nt, Homo sapiens
ucugagcuccaccucug

SEQ ID NO: 653449 - RNA, 13 nt, Homo sapiens
ucugagcugugca

SEQ ID NO: 653450 - RNA, 18 nt, Homo sapiens
ucugaggaagaagggaua

SEQ ID NO: 653451 - RNA, 21 nt, Homo sapiens
ucugaggaguaaguguacaau

SEQ ID NO: 653452 - RNA, 17 nt, Homo sapiens
ucugaggaugcauucga

SEQ ID NO: 653453 - RNA, 20 nt, Homo sapiens
ucugaggcccugcccaauga

SEQ ID NO: 653454 - RNA, 18 nt, Homo sapiens
ucugaggcuuccagagag

SEQ ID NO: 653455 - RNA, 17 nt, Homo sapiens
ucugagggaaagugcau

SEQ ID NO: 653456 - RNA, 21 nt, Homo sapiens
ucugagggaggaggccaccuc

SEQ ID NO: 653457 - RNA, 20 nt, Homo sapiens
ucugaguaagaaacagaauc

SEQ ID NO: 653458 - RNA, 20 nt, Homo sapiens
ucugaguaagcccucaggag

SEQ ID NO: 653459 - RNA, 13 nt, Homo sapiens
ucugaguccuuug

SEQ ID NO: 653460 - RNA, 18 nt, Homo sapiens
ucugauaaaagauggcca

SEQ ID NO: 653461 - RNA, 21 nt, Homo sapiens
ucugauaaaagauggccauau

SEQ ID NO: 653462 - RNA, 15 nt, Homo sapiens
ucugauaaugcucac

SEQ ID NO: 653463 - RNA, 13 nt, Homo sapiens
ucugauacagaca

SEQ ID NO: 653464 - RNA, 19 nt, Homo sapiens
ucugauaccacugcacugu

SEQ ID NO: 653465 - RNA, 20 nt, Homo sapiens
ucugauacccagagcauuac

SEQ ID NO: 653466 - RNA, 14 nt, Homo sapiens
ucugaucacauugc

SEQ ID NO: 653467 - RNA, 22 nt, Homo sapiens
ucugauggaacuguguauuuau

SEQ ID NO: 653468 - RNA, 20 nt, Homo sapiens
ucugauggcugaagaaugua

SEQ ID NO: 653469 - RNA, 14 nt, Homo sapiens
ucugaugucuccac

SEQ ID NO: 653470 - RNA, 13 nt, Homo sapiens
ucugauguggaau

SEQ ID NO: 653471 - RNA, 18 nt, Homo sapiens
ucugauuaaaaugcuucc

SEQ ID NO: 653472 - RNA, 15 nt, Homo sapiens
ucugauuuacauuca

SEQ ID NO: 653473 - RNA, 16 nt, Homo sapiens
ucugauuucauaauuc

SEQ ID NO: 653474 - RNA, 17 nt, Homo sapiens
ucugauuucugcccuug

SEQ ID NO: 653475 - RNA, 20 nt, Homo sapiens
ucugcaaaaauggauauuau

SEQ ID NO: 653476 - RNA, 20 nt, Homo sapiens
ucugcaaaaggccucuugua

SEQ ID NO: 653477 - RNA, 20 nt, Homo sapiens
ucugcaacaaaaagucauuu

SEQ ID NO: 653478 - RNA, 16 nt, Homo sapiens
ucugcaacacuuugag

SEQ ID NO: 653479 - RNA, 21 nt, Homo sapiens
uuucuaaccuugaaugcugcc

SEQ ID NO: 653480 - RNA, 17 nt, Homo sapiens
uuucuaagaaccaaaaa

SEQ ID NO: 653481 - RNA, 20 nt, Homo sapiens
uuucuacaaugugaacuuua

SEQ ID NO: 653482 - RNA, 22 nt, Homo sapiens
uuucuagauacaauaaauugcu

SEQ ID NO: 653483 - RNA, 19 nt, Homo sapiens
uuucuauauuauugcccau

SEQ ID NO: 653484 - RNA, 21 nt, Homo sapiens
uuucuaugccuacugauguca

SEQ ID NO: 653485 - RNA, 21 nt, Homo sapiens
uuucuauuauggaaaacugug

SEQ ID NO: 653486 - RNA, 14 nt, Homo sapiens
uuucuauuucacua

SEQ ID NO: 653487 - RNA, 23 nt, Homo sapiens
uuucucagauguugaaacuuuga

SEQ ID NO: 653488 - RNA, 13 nt, Homo sapiens
uuucucauuaaau

SEQ ID NO: 653489 - RNA, 15 nt, Homo sapiens
uuucuccauaucaaa

SEQ ID NO: 653490 - RNA, 17 nt, Homo sapiens
uuucucccuauuaggga

SEQ ID NO: 653491 - RNA, 20 nt, Homo sapiens
uuucuccucacuguauccag

SEQ ID NO: 653492 - RNA, 17 nt, Homo sapiens
uuucuccuuuuacuuca

SEQ ID NO: 653493 - RNA, 15 nt, Homo sapiens
uuucucgggugcauu

SEQ ID NO: 653494 - RNA, 20 nt, Homo sapiens
uuucucuacacaaaugugua

SEQ ID NO: 653495 - RNA, 21 nt, Homo sapiens
uuucucugagcagucagggug

SEQ ID NO: 653496 - RNA, 15 nt, Homo sapiens
uuucucugccaguga

SEQ ID NO: 653497 - RNA, 15 nt, Homo sapiens
uuucucuguauagua

SEQ ID NO: 653498 - RNA, 19 nt, Homo sapiens
uuucucuguuguaagaaua

SEQ ID NO: 653499 - RNA, 14 nt, Homo sapiens
uuucucuuacaauc

SEQ ID NO: 653500 - RNA, 14 nt, Homo sapiens
uuucucuuaugcuu

SEQ ID NO: 653501 - RNA, 17 nt, Homo sapiens
uuucugacucugagcua

SEQ ID NO: 653502 - RNA, 15 nt, Homo sapiens
uuucugauaccacug

SEQ ID NO: 653503 - RNA, 16 nt, Homo sapiens
uuucugauacugcuga

SEQ ID NO: 653504 - RNA, 18 nt, Homo sapiens
uuucugauuacuguccag

SEQ ID NO: 653505 - RNA, 17 nt, Homo sapiens
uuucugcauagagucuu

SEQ ID NO: 653506 - RNA, 14 nt, Homo sapiens
uuucuggccaaaag

SEQ ID NO: 653507 - RNA, 20 nt, Homo sapiens
uuucuggccaaaagcaguaa

SEQ ID NO: 653508 - RNA, 19 nt, Homo sapiens
uuucuggcuaugcauuuga

SEQ ID NO: 653509 - RNA, 22 nt, Homo sapiens
uuucuggggaugucccagggug

SEQ ID NO: 653510 - RNA, 16 nt, Homo sapiens
uuucuguauauacuca

SEQ ID NO: 653511 - RNA, 16 nt, Homo sapiens
uuucugucaagcauau

SEQ ID NO: 653512 - RNA, 21 nt, Homo sapiens
uuucugucaagcauauuggaa

SEQ ID NO: 653513 - RNA, 16 nt, Homo sapiens
uuucugucucugccuc

SEQ ID NO: 653514 - RNA, 22 nt, Homo sapiens
uuucugugggaggagaagggga

SEQ ID NO: 653515 - RNA, 19 nt, Homo sapiens
uuucuguucuguuggauga

SEQ ID NO: 653516 - RNA, 19 nt, Homo sapiens
uuucuuaaggaaauggugg

SEQ ID NO: 653517 - RNA, 18 nt, Homo sapiens
uuucuuaaugaaccuuag

SEQ ID NO: 653518 - RNA, 20 nt, Homo sapiens
uuucuuagaauugaccaaau

SEQ ID NO: 653519 - RNA, 20 nt, Homo sapiens
uuucuuauuggugauuguca

SEQ ID NO: 653520 - RNA, 16 nt, Homo sapiens
uuucuucaccaagugc

SEQ ID NO: 653521 - RNA, 18 nt, Homo sapiens
uuucuucagaauuaucca

SEQ ID NO: 653522 - RNA, 16 nt, Homo sapiens
uuucuucagggcugcu

SEQ ID NO: 653523 - RNA, 16 nt, Homo sapiens
uuucuucaugcaauga

SEQ ID NO: 653524 - RNA, 13 nt, Homo sapiens
uuucuuccaugau

SEQ ID NO: 653525 - RNA, 20 nt, Homo sapiens
uuucuugccuuaaccagucu

SEQ ID NO: 653526 - RNA, 16 nt, Homo sapiens
uuucuuguagcuaaaa

SEQ ID NO: 653527 - RNA, 18 nt, Homo sapiens
uuucuuguugcaaaaaau

SEQ ID NO: 653528 - RNA, 16 nt, Homo sapiens
uuucuuguugcugcau

SEQ ID NO: 653529 - RNA, 22 nt, Homo sapiens
uuucuuuaauaguuuugauccu

SEQ ID NO: 653530 - RNA, 14 nt, Homo sapiens
uuucuuuaucauug

SEQ ID NO: 653531 - RNA, 13 nt, Homo sapiens
uuucuuucugcca

SEQ ID NO: 653532 - RNA, 15 nt, Homo sapiens
uuucuuuuaagcuau

SEQ ID NO: 653533 - RNA, 18 nt, Homo sapiens
uuugaaaaagagaacaga

SEQ ID NO: 653534 - RNA, 20 nt, Homo sapiens
uuugaaaaagagaacagaaa

SEQ ID NO: 653535 - RNA, 16 nt, Homo sapiens
uuugaaaaagcgaaaa

SEQ ID NO: 653536 - RNA, 16 nt, Homo sapiens
uuugaaaacauaaucu

SEQ ID NO: 653537 - RNA, 14 nt, Homo sapiens
uuugaaacuauuaa

SEQ ID NO: 653538 - RNA, 15 nt, Homo sapiens
uuugaaacugaaugu

SEQ ID NO: 653539 - RNA, 13 nt, Homo sapiens
uuugaaagaugca

SEQ ID NO: 653540 - RNA, 20 nt, Homo sapiens
uuugaaaucaaugcaagagu

SEQ ID NO: 653541 - RNA, 13 nt, Homo sapiens
uuugaaaugcacc

SEQ ID NO: 653542 - RNA, 16 nt, Homo sapiens
uuugaacaaagcucaa

SEQ ID NO: 653543 - RNA, 19 nt, Homo sapiens
uuugaacccuugcuugcaa

SEQ ID NO: 653544 - RNA, 23 nt, Homo sapiens
uuugaagaauauuuguaguuauc

SEQ ID NO: 653545 - RNA, 14 nt, Homo sapiens
uuugaagaccaguc

SEQ ID NO: 653546 - RNA, 21 nt, Homo sapiens
uuugaagcgagcagucagcau

SEQ ID NO: 653547 - RNA, 16 nt, Homo sapiens
uuugaaggacaacagc

SEQ ID NO: 653548 - RNA, 22 nt, Homo sapiens
uuugaaguagacucauucuuca

SEQ ID NO: 653549 - RNA, 12 nt, Homo sapiens
uuugaaguagga

SEQ ID NO: 653550 - RNA, 18 nt, Homo sapiens
uuugaaguggccagauga

SEQ ID NO: 653551 - RNA, 15 nt, Homo sapiens
uuugaaucacaugaa

SEQ ID NO: 653552 - RNA, 12 nt, Homo sapiens
uuugaaucugag

SEQ ID NO: 653553 - RNA, 22 nt, Homo sapiens
uuugaaucuuucguagccuaaa

SEQ ID NO: 653554 - RNA, 20 nt, Homo sapiens
uuugaaugaacuaguuuaau

SEQ ID NO: 653555 - RNA, 23 nt, Homo sapiens
uuugaaugaugagccuucgugcc

SEQ ID NO: 653556 - RNA, 19 nt, Homo sapiens
uuugaauggaaaacacaug

SEQ ID NO: 653557 - RNA, 22 nt, Homo sapiens
uuugaaugucacaaauugauca

SEQ ID NO: 653558 - RNA, 14 nt, Homo sapiens
uuugaaugugugaa

SEQ ID NO: 653559 - RNA, 18 nt, Homo sapiens
uuugaauucuugaucucu

SEQ ID NO: 653560 - RNA, 14 nt, Homo sapiens
uuugacaaccauga

SEQ ID NO: 653561 - RNA, 12 nt, Homo sapiens
uuugacacugaa

SEQ ID NO: 653562 - RNA, 15 nt, Homo sapiens
uuugacagcauuucc

SEQ ID NO: 653563 - RNA, 16 nt, Homo sapiens
uuugaccagugcaguu

SEQ ID NO: 653564 - RNA, 14 nt, Homo sapiens
uuugaccccuuaca

SEQ ID NO: 653565 - RNA, 21 nt, Homo sapiens
uuugaccuuucuagguucaaa

SEQ ID NO: 653566 - RNA, 14 nt, Homo sapiens
uuugacuuugccaa

SEQ ID NO: 653567 - RNA, 22 nt, Homo sapiens
uuugacuuugccaaaguguaga

SEQ ID NO: 653568 - RNA, 16 nt, Homo sapiens
uuugagaauacauaaa

SEQ ID NO: 653569 - RNA, 14 nt, Homo sapiens
uuugagaaugguua

SEQ ID NO: 653570 - RNA, 13 nt, Homo sapiens
uuugagaauguuu

SEQ ID NO: 653571 - RNA, 13 nt, Homo sapiens
uuugagacacugg

SEQ ID NO: 653572 - RNA, 16 nt, Homo sapiens
uuugagacagucucac

SEQ ID NO: 653573 - RNA, 15 nt, Homo sapiens
uuugagcacaacuuu

SEQ ID NO: 653574 - RNA, 18 nt, Homo sapiens
uuugagcugagugcugaa

SEQ ID NO: 653575 - RNA, 16 nt, Homo sapiens
uuugaggaacauucaa

SEQ ID NO: 653576 - RNA, 11 nt, Homo sapiens
uuugaggacau

SEQ ID NO: 653577 - RNA, 23 nt, Homo sapiens
uuugaggaccccuuaaucuugcu

SEQ ID NO: 653578 - RNA, 22 nt, Homo sapiens
uuugaggauauauuuucacuuu

SEQ ID NO: 653579 - RNA, 21 nt, Homo sapiens
uuugaggcaaauuaacuguau

SEQ ID NO: 653580 - RNA, 17 nt, Homo sapiens
uuugaggccaaaacaga

SEQ ID NO: 653581 - RNA, 19 nt, Homo sapiens
uuugaggccuuuuuugcca

SEQ ID NO: 653582 - RNA, 16 nt, Homo sapiens
uuugaggggcugacuu

SEQ ID NO: 653583 - RNA, 14 nt, Homo sapiens
uuugaggucuacau

SEQ ID NO: 653584 - RNA, 15 nt, Homo sapiens
uuugaguugaauuua

SEQ ID NO: 653585 - RNA, 21 nt, Homo sapiens
uuugauacaggcaauucagug

SEQ ID NO: 653586 - RNA, 13 nt, Homo sapiens
uuugaucagacag

SEQ ID NO: 653587 - RNA, 13 nt, Homo sapiens
uuugaucaguuga

SEQ ID NO: 653588 - RNA, 17 nt, Homo sapiens
uuugauccaggugccaa

SEQ ID NO: 653589 - RNA, 18 nt, Homo sapiens
uuugauccugggggacca

SEQ ID NO: 653590 - RNA, 22 nt, Homo sapiens
uuugaugccaagaaaguauuug

SEQ ID NO: 653591 - RNA, 14 nt, Homo sapiens
uuugauguuuacag

SEQ ID NO: 653592 - RNA, 17 nt, Homo sapiens
uuugauuaaagacucca

SEQ ID NO: 653593 - RNA, 15 nt, Homo sapiens
uuugauucagcaaaa

SEQ ID NO: 653594 - RNA, 16 nt, Homo sapiens
uuugauucagcaaaaa

SEQ ID NO: 653595 - RNA, 20 nt, Homo sapiens
uuugauucagcaaaaaucuc

SEQ ID NO: 653596 - RNA, 20 nt, Homo sapiens
uuugauuccauuccauggaa

SEQ ID NO: 653597 - RNA, 22 nt, Homo sapiens
uuugauugaggagcugcacuga

SEQ ID NO: 653598 - RNA, 23 nt, Homo sapiens
uuugauugaggagcugcacugau

SEQ ID NO: 653599 - RNA, 23 nt, Homo sapiens
uuugauuuuucuaaccuugaaug

SEQ ID NO: 653600 - RNA, 21 nt, Homo sapiens
uuugcaaaauuuccaguaccu

SEQ ID NO: 653601 - RNA, 13 nt, Homo sapiens
aaaaaaaaaucac

SEQ ID NO: 653602 - RNA, 15 nt, Homo sapiens
aaaaaaaagugucuc

SEQ ID NO: 653603 - RNA, 12 nt, Homo sapiens
aaaaaaaauccc

SEQ ID NO: 653604 - RNA, 13 nt, Homo sapiens
aaaaaaacuucau

SEQ ID NO: 653605 - RNA, 19 nt, Homo sapiens
aaaaaaagaaaagugugua

SEQ ID NO: 653606 - RNA, 12 nt, Homo sapiens
aaaaaaagccaa

SEQ ID NO: 653607 - RNA, 12 nt, Homo sapiens
aaaaaaagggag

SEQ ID NO: 653608 - RNA, 21 nt, Homo sapiens
aaaaaaauuuuauagugucuu

SEQ ID NO: 653609 - RNA, 15 nt, Homo sapiens
aaaaaacaaucugga

SEQ ID NO: 653610 - RNA, 16 nt, Homo sapiens
aaaaaacacaucuggc

SEQ ID NO: 653611 - RNA, 12 nt, Homo sapiens
aaaaaacagugg

SEQ ID NO: 653612 - RNA, 22 nt, Homo sapiens
aaaaaacauacuuacauuucag

SEQ ID NO: 653613 - RNA, 19 nt, Homo sapiens
aaaaaagaacaacugccaa

SEQ ID NO: 653614 - RNA, 12 nt, Homo sapiens
aaaaaagccaaa

SEQ ID NO: 653615 - RNA, 16 nt, Homo sapiens
aaaaaagccuccaagg

SEQ ID NO: 653616 - RNA, 12 nt, Homo sapiens
aaaaaaguucau

SEQ ID NO: 653617 - RNA, 13 nt, Homo sapiens
aaaaaauagagag

SEQ ID NO: 653618 - RNA, 17 nt, Homo sapiens
aaaaaauuaauacugaa

SEQ ID NO: 653619 - RNA, 15 nt, Homo sapiens
aaaaacaauuuugac

SEQ ID NO: 653620 - RNA, 16 nt, Homo sapiens
aaaaacacguggagau

SEQ ID NO: 653621 - RNA, 12 nt, Homo sapiens
aaaaacagguuu

SEQ ID NO: 653622 - RNA, 21 nt, Homo sapiens
aaaaacauagaaaaauucagc

SEQ ID NO: 653623 - RNA, 13 nt, Homo sapiens
aaaaacauucuua

SEQ ID NO: 653624 - RNA, 18 nt, Homo sapiens
aaaaaccaacagguuuau

SEQ ID NO: 653625 - RNA, 22 nt, Homo sapiens
aaaaaccuagugcugauucaca

SEQ ID NO: 653626 - RNA, 15 nt, Homo sapiens
aaaaaccugauggaa

SEQ ID NO: 653627 - RNA, 12 nt, Homo sapiens
aaaaacuacuuc

SEQ ID NO: 653628 - RNA, 18 nt, Homo sapiens
aaaaacuccccuuccuca

SEQ ID NO: 653629 - RNA, 20 nt, Homo sapiens
aaaaacugccuuugauacag

SEQ ID NO: 653630 - RNA, 11 nt, Homo sapiens
aaaaacuggaa

SEQ ID NO: 653631 - RNA, 12 nt, Homo sapiens
aaaaacuuccau

SEQ ID NO: 653632 - RNA, 12 nt, Homo sapiens
aaaaacuugggu

SEQ ID NO: 653633 - RNA, 22 nt, Homo sapiens
aaaaagaagaacuauaugugaa

SEQ ID NO: 653634 - RNA, 14 nt, Homo sapiens
aaaaagacaacuca

SEQ ID NO: 653635 - RNA, 12 nt, Homo sapiens
aaaaagauguac

SEQ ID NO: 653636 - RNA, 16 nt, Homo sapiens
aaaaagccacaaugaa

SEQ ID NO: 653637 - RNA, 17 nt, Homo sapiens
aaaaagccaguuugggu

SEQ ID NO: 653638 - RNA, 20 nt, Homo sapiens
aaaaagccugguuuuucuca

SEQ ID NO: 653639 - RNA, 22 nt, Homo sapiens
aaaaagccugguuuuucucaau

SEQ ID NO: 653640 - RNA, 15 nt, Homo sapiens
aaaaagccugucauu

SEQ ID NO: 653641 - RNA, 19 nt, Homo sapiens
aaaaagcuaaugugcaggg

SEQ ID NO: 653642 - RNA, 12 nt, Homo sapiens
aaaaagcuucca

SEQ ID NO: 653643 - RNA, 16 nt, Homo sapiens
aaaaaggcauaugcaa

SEQ ID NO: 653644 - RNA, 17 nt, Homo sapiens
aaaaaggcauaugcaau

SEQ ID NO: 653645 - RNA, 14 nt, Homo sapiens
aaaaaguauugcau

SEQ ID NO: 653646 - RNA, 13 nt, Homo sapiens
aaaaagucacaaa

SEQ ID NO: 653647 - RNA, 14 nt, Homo sapiens
aaaaagucagagac

SEQ ID NO: 653648 - RNA, 22 nt, Homo sapiens
aaaaagucagagacagauaccu

SEQ ID NO: 653649 - RNA, 12 nt, Homo sapiens
aaaaaguguuua

SEQ ID NO: 653650 - RNA, 19 nt, Homo sapiens
aaaaaguuucuuaaggaaa

SEQ ID NO: 653651 - RNA, 16 nt, Homo sapiens
aaaaauaaaaaagauc

SEQ ID NO: 653652 - RNA, 19 nt, Homo sapiens
aaaaauaaaaaagaucucc

SEQ ID NO: 653653 - RNA, 17 nt, Homo sapiens
aaaaauaaaguaccaca

SEQ ID NO: 653654 - RNA, 12 nt, Homo sapiens
aaaaauaaugug

SEQ ID NO: 653655 - RNA, 13 nt, Homo sapiens
aaaaauaaugugc

SEQ ID NO: 653656 - RNA, 16 nt, Homo sapiens
aaacccaagugcugca

SEQ ID NO: 653657 - RNA, 13 nt, Homo sapiens
aaacccaauccaa

SEQ ID NO: 653658 - RNA, 15 nt, Homo sapiens
aaaccccaaacuguu

SEQ ID NO: 653659 - RNA, 22 nt, Homo sapiens
aaaccccagucauggcuuccuu

SEQ ID NO: 653660 - RNA, 18 nt, Homo sapiens
aaaccccuucuuuacuuc

SEQ ID NO: 653661 - RNA, 21 nt, Homo sapiens
aaacccugcugaacacagugu

SEQ ID NO: 653662 - RNA, 19 nt, Homo sapiens
aaacccuugagcucaagug

SEQ ID NO: 653663 - RNA, 16 nt, Homo sapiens
aaaccgagugcaauga

SEQ ID NO: 653664 - RNA, 15 nt, Homo sapiens
aaaccuaacuugcgc

SEQ ID NO: 653665 - RNA, 13 nt, Homo sapiens
aaaccuaccaaaa

SEQ ID NO: 653666 - RNA, 16 nt, Homo sapiens
aaaccuagcuaggcua

SEQ ID NO: 653667 - RNA, 18 nt, Homo sapiens
aaaccuagcuaggcuaag

SEQ ID NO: 653668 - RNA, 16 nt, Homo sapiens
aaaccuaggucuccag

SEQ ID NO: 653669 - RNA, 15 nt, Homo sapiens
aaaccuaguacugcc

SEQ ID NO: 653670 - RNA, 20 nt, Homo sapiens
aaaccucugggucaucucuc

SEQ ID NO: 653671 - RNA, 13 nt, Homo sapiens
aaaccugaccaca

SEQ ID NO: 653672 - RNA, 9 nt, Homo sapiens
aaaccuggg

SEQ ID NO: 653673 - RNA, 19 nt, Homo sapiens
aaaccuggggugaauacuu

SEQ ID NO: 653674 - RNA, 19 nt, Homo sapiens
aaaccugucuccacugugc

SEQ ID NO: 653675 - RNA, 13 nt, Homo sapiens
aaaccugugccag

SEQ ID NO: 653676 - RNA, 17 nt, Homo sapiens
aaaccugugugccauuu

SEQ ID NO: 653677 - RNA, 17 nt, Homo sapiens
aaaccuuaagugcugca

SEQ ID NO: 653678 - RNA, 15 nt, Homo sapiens
aaaccuuaguuucaa

SEQ ID NO: 653679 - RNA, 20 nt, Homo sapiens
aaaccuuauuuuuucccaaa

SEQ ID NO: 653680 - RNA, 13 nt, Homo sapiens
aaaccuucaguga

SEQ ID NO: 653681 - RNA, 19 nt, Homo sapiens
aaaccuucaguuaugauuu

SEQ ID NO: 653682 - RNA, 17 nt, Homo sapiens
aaacgagggcugaugga

SEQ ID NO: 653683 - RNA, 21 nt, Homo sapiens
aaacgcaaaaccugcaguucc

SEQ ID NO: 653684 - RNA, 13 nt, Homo sapiens
aaacgcuaccucu

SEQ ID NO: 653685 - RNA, 16 nt, Homo sapiens
aaacggauuccaaaga

SEQ ID NO: 653686 - RNA, 18 nt, Homo sapiens
aaacgguaauacgugaaa

SEQ ID NO: 653687 - RNA, 17 nt, Homo sapiens
aaacguauucagaguua

SEQ ID NO: 653688 - RNA, 12 nt, Homo sapiens
aaacuaaacaga

SEQ ID NO: 653689 - RNA, 16 nt, Homo sapiens
aaacuaaaucucuaau

SEQ ID NO: 653690 - RNA, 16 nt, Homo sapiens
aaacuaacacccaguc

SEQ ID NO: 653691 - RNA, 11 nt, Homo sapiens
aaacuaacuug

SEQ ID NO: 653692 - RNA, 12 nt, Homo sapiens
aaacuaagccag

SEQ ID NO: 653693 - RNA, 21 nt, Homo sapiens
aaacuaauuuaguaauagccu

SEQ ID NO: 653694 - RNA, 12 nt, Homo sapiens
aaacuacuucuu

SEQ ID NO: 653695 - RNA, 20 nt, Homo sapiens
aaacuaggcuucuguaauca

SEQ ID NO: 653696 - RNA, 13 nt, Homo sapiens
aaacuaguaucag

SEQ ID NO: 653697 - RNA, 17 nt, Homo sapiens
aaacuaugguucccaau

SEQ ID NO: 653698 - RNA, 17 nt, Homo sapiens
aaacuauguaacaugua

SEQ ID NO: 653699 - RNA, 19 nt, Homo sapiens
aaacuauguguucaaugaa

SEQ ID NO: 653700 - RNA, 15 nt, Homo sapiens
aaacuauugagccuu

SEQ ID NO: 653701 - RNA, 22 nt, Homo sapiens
aaacucaaccuaacacauuaaa

SEQ ID NO: 653702 - RNA, 12 nt, Homo sapiens
aaacucagggac

SEQ ID NO: 653703 - RNA, 20 nt, Homo sapiens
aaacucagggacagagccau

SEQ ID NO: 653704 - RNA, 20 nt, Homo sapiens
aaacucaggugauuccagga

SEQ ID NO: 653705 - RNA, 19 nt, Homo sapiens
aaacuccacaucugccuua

SEQ ID NO: 653706 - RNA, 16 nt, Homo sapiens
aaacuccagaugccac

SEQ ID NO: 653707 - RNA, 23 nt, Homo sapiens
aaacuccugauuuuguaguuaau

SEQ ID NO: 653708 - RNA, 20 nt, Homo sapiens
aaacuccugggcucaaguga

SEQ ID NO: 653709 - RNA, 18 nt, Homo sapiens
aaacuccugggcucaggc

SEQ ID NO: 653710 - RNA, 19 nt, Homo sapiens
aaacuccugugucugugua

SEQ ID NO: 653711 - RNA, 19 nt, Homo sapiens
aaacuccuguuucuccuua

SEQ ID NO: 653712 - RNA, 13 nt, Homo sapiens
aaacucucugaac

SEQ ID NO: 653713 - RNA, 13 nt, Homo sapiens
aaacucuggcuca

SEQ ID NO: 653714 - RNA, 13 nt, Homo sapiens
aaacucuucagug

SEQ ID NO: 653715 - RNA, 21 nt, Homo sapiens
aaacucuuucauucuucucac

SEQ ID NO: 653716 - RNA, 16 nt, Homo sapiens
aaacugacaguauuaa

SEQ ID NO: 653717 - RNA, 16 nt, Homo sapiens
aaacugacuuuauccu

SEQ ID NO: 653718 - RNA, 22 nt, Homo sapiens
aaacugagacacauuggcuuug

SEQ ID NO: 653719 - RNA, 19 nt, Homo sapiens
aaacugagguauggccaug

SEQ ID NO: 653720 - RNA, 23 nt, Homo sapiens
aaacugauacccuuugaaaaagu

SEQ ID NO: 653721 - RNA, 11 nt, Homo sapiens
aaacugcauuu

SEQ ID NO: 653722 - RNA, 17 nt, Homo sapiens
aaacugccuuccacaau

SEQ ID NO: 653723 - RNA, 21 nt, Homo sapiens
aaacugccuuucugguggcuu

SEQ ID NO: 653724 - RNA, 21 nt, Homo sapiens
aaacugcuuacuuaugccaua

SEQ ID NO: 653725 - RNA, 16 nt, Homo sapiens
aaacugcuuugugcau

SEQ ID NO: 653726 - RNA, 17 nt, Homo sapiens
aaacugcuuugugcaua

SEQ ID NO: 653727 - RNA, 23 nt, Homo sapiens
aaacugcuuuuuuuuuuccagca

SEQ ID NO: 653728 - RNA, 16 nt, Homo sapiens
aaacuggagaugcauc

SEQ ID NO: 653729 - RNA, 21 nt, Homo sapiens
aaacuggguugagggaugcug

SEQ ID NO: 653730 - RNA, 19 nt, Homo sapiens
aaacugguugucaguuaca

SEQ ID NO: 653731 - RNA, 18 nt, Homo sapiens
aaacugguuuguugcagc

SEQ ID NO: 653732 - RNA, 17 nt, Homo sapiens
aaacuguaugugcaguu

SEQ ID NO: 653733 - RNA, 21 nt, Homo sapiens
aaacuguaugugcaguuauuu

SEQ ID NO: 653734 - RNA, 21 nt, Homo sapiens
aaacugugacugcagugcugu

SEQ ID NO: 653735 - RNA, 17 nt, Homo sapiens
aaacugugucacaguuu

SEQ ID NO: 653736 - RNA, 19 nt, Homo sapiens
aaacugugucacaguuuca

SEQ ID NO: 653737 - RNA, 20 nt, Homo sapiens
aaacuguuagcacuguugau

SEQ ID NO: 653738 - RNA, 19 nt, Homo sapiens
aaacuguuccaaucaugaa

SEQ ID NO: 653739 - RNA, 23 nt, Homo sapiens
aaacuguucucuauuagacuuua

SEQ ID NO: 653740 - RNA, 23 nt, Homo sapiens
aaacuguucuuuugcauuuugcc

SEQ ID NO: 653741 - RNA, 16 nt, Homo sapiens
aaacuguuuugacaaa

SEQ ID NO: 653742 - RNA, 19 nt, Homo sapiens
aaacuuaaaaaaagcacau

SEQ ID NO: 653743 - RNA, 23 nt, Homo sapiens
aaacuuaaggaagcaaaugcuac

SEQ ID NO: 653744 - RNA, 22 nt, Homo sapiens
aaacuuaagggaaaaguucucc

SEQ ID NO: 653745 - RNA, 13 nt, Homo sapiens
aaacuuagccaga

SEQ ID NO: 653746 - RNA, 17 nt, Homo sapiens
aaacuuaggcaugcaca

SEQ ID NO: 653747 - RNA, 22 nt, Homo sapiens
aaacuuaucacgccuacuuaag

SEQ ID NO: 653748 - RNA, 22 nt, Homo sapiens
aaacuucaccuacauuaucuca

SEQ ID NO: 653749 - RNA, 19 nt, Homo sapiens
aaacuuggaaccuuggaaa

SEQ ID NO: 653750 - RNA, 16 nt, Homo sapiens
aaacuugggucucuua

SEQ ID NO: 653751 - RNA, 18 nt, Homo sapiens
aaacuuguacaccaaugu

SEQ ID NO: 653752 - RNA, 21 nt, Homo sapiens
aaacuugugaaauaaagauuc

SEQ ID NO: 653753 - RNA, 16 nt, Homo sapiens
aaacuuuauugacaag

SEQ ID NO: 653754 - RNA, 22 nt, Homo sapiens
aaacuuuccugacuuacaauac

SEQ ID NO: 653755 - RNA, 18 nt, Homo sapiens
aaacuuugcaucucagua

SEQ ID NO: 653756 - RNA, 18 nt, Homo sapiens
aaacuuuggaaccagacu

SEQ ID NO: 653757 - RNA, 14 nt, Homo sapiens
aaacuuuggcuuuc

SEQ ID NO: 653758 - RNA, 16 nt, Homo sapiens
aaacuuuggcuuucau

SEQ ID NO: 653759 - RNA, 23 nt, Homo sapiens
aaacuuugugccuuugaccaucu

SEQ ID NO: 653760 - RNA, 23 nt, Homo sapiens
aaacuuuuguucuuuaauaugcu

SEQ ID NO: 653761 - RNA, 18 nt, Homo sapiens
aaagaaaaagaccuauga

SEQ ID NO: 653762 - RNA, 14 nt, Homo sapiens
aaagaaaaaucaga

SEQ ID NO: 653763 - RNA, 15 nt, Homo sapiens
aaagaaaaaugccug

SEQ ID NO: 653764 - RNA, 12 nt, Homo sapiens
aaagaaaacugg

SEQ ID NO: 653765 - RNA, 14 nt, Homo sapiens
aaagaaaaguuuau

SEQ ID NO: 653766 - RNA, 14 nt, Homo sapiens
aaagaaacuaucaa

SEQ ID NO: 653767 - RNA, 15 nt, Homo sapiens
aaagaaagaaggaag

SEQ ID NO: 653768 - RNA, 18 nt, Homo sapiens
aaagaaaggaacuaaguc

SEQ ID NO: 653769 - RNA, 19 nt, Homo sapiens
aaagaaauaaaccaaagga

SEQ ID NO: 653770 - RNA, 15 nt, Homo sapiens
aaagaaaucuugucu

SEQ ID NO: 653771 - RNA, 13 nt, Homo sapiens
aaagaaccaaaga

SEQ ID NO: 653772 - RNA, 18 nt, Homo sapiens
aaagaacguggucagagu

SEQ ID NO: 653773 - RNA, 22 nt, Homo sapiens
aaagaacguggucagaguagaa

SEQ ID NO: 653774 - RNA, 18 nt, Homo sapiens
aaagaagaaaacaguaca

SEQ ID NO: 653775 - RNA, 13 nt, Homo sapiens
aaagaagaacuug

SEQ ID NO: 653776 - RNA, 16 nt, Homo sapiens
aaagaagaccugagaa

SEQ ID NO: 653777 - RNA, 23 nt, Homo sapiens
aaagaagagaugagaaaugauga

SEQ ID NO: 653778 - RNA, 22 nt, Homo sapiens
aagcauaugcagccaaccaaga

SEQ ID NO: 653779 - RNA, 15 nt, Homo sapiens
aagcaucaccucagg

SEQ ID NO: 653780 - RNA, 16 nt, Homo sapiens
aagcaucaccucaggc

SEQ ID NO: 653781 - RNA, 20 nt, Homo sapiens
aagcaucauuauuugcagag

SEQ ID NO: 653782 - RNA, 23 nt, Homo sapiens
aagcaucucagccuaccaugaga

SEQ ID NO: 653783 - RNA, 17 nt, Homo sapiens
aagcaugaaacauuuca

SEQ ID NO: 653784 - RNA, 20 nt, Homo sapiens
aagcaugcaauaaugugcaa

SEQ ID NO: 653785 - RNA, 14 nt, Homo sapiens
aagcaugcauauca

SEQ ID NO: 653786 - RNA, 19 nt, Homo sapiens
aagcaugucucugcuucca

SEQ ID NO: 653787 - RNA, 17 nt, Homo sapiens
aagcauuaacuucucug

SEQ ID NO: 653788 - RNA, 19 nt, Homo sapiens
aagcauucacaacuuguuu

SEQ ID NO: 653789 - RNA, 15 nt, Homo sapiens
aagcauucuuuaaca

SEQ ID NO: 653790 - RNA, 15 nt, Homo sapiens
aagcauuucaccuuu

SEQ ID NO: 653791 - RNA, 11 nt, Homo sapiens
aagcauuucag

SEQ ID NO: 653792 - RNA, 21 nt, Homo sapiens
aagcauuuccagccuaucuaa

SEQ ID NO: 653793 - RNA, 22 nt, Homo sapiens
aagcauuucuagcagugaugaa

SEQ ID NO: 653794 - RNA, 15 nt, Homo sapiens
aagcauuuguagcaa

SEQ ID NO: 653795 - RNA, 17 nt, Homo sapiens
aagccaaacucugccag

SEQ ID NO: 653796 - RNA, 21 nt, Homo sapiens
aagccaacaucuggaucaaug

SEQ ID NO: 653797 - RNA, 23 nt, Homo sapiens
aagccaagaaagaaaaauuaucu

SEQ ID NO: 653798 - RNA, 16 nt, Homo sapiens
aagccaaggucaugcc

SEQ ID NO: 653799 - RNA, 17 nt, Homo sapiens
aagccacaagucuucca

SEQ ID NO: 653800 - RNA, 18 nt, Homo sapiens
aagccacaagucuuccag

SEQ ID NO: 653801 - RNA, 15 nt, Homo sapiens
aagccacacucuggg

SEQ ID NO: 653802 - RNA, 20 nt, Homo sapiens
aagccacagcagguccucca

SEQ ID NO: 653803 - RNA, 22 nt, Homo sapiens
aagccacucggggcaggccagc

SEQ ID NO: 653804 - RNA, 20 nt, Homo sapiens
aagccacucugucccuuccu

SEQ ID NO: 653805 - RNA, 17 nt, Homo sapiens
aagccacuugucuugaa

SEQ ID NO: 653806 - RNA, 15 nt, Homo sapiens
aagccagaccagaag

SEQ ID NO: 653807 - RNA, 16 nt, Homo sapiens
aagccagaguguauua

SEQ ID NO: 653808 - RNA, 20 nt, Homo sapiens
aagccagcacucacaccacu

SEQ ID NO: 653809 - RNA, 17 nt, Homo sapiens
aagccagccagaggcau

SEQ ID NO: 653810 - RNA, 21 nt, Homo sapiens
aagccagcccccuccagcuca

SEQ ID NO: 653811 - RNA, 18 nt, Homo sapiens
aagccagccugguccaug

SEQ ID NO: 653812 - RNA, 18 nt, Homo sapiens
aagccauagggggcugca

SEQ ID NO: 653813 - RNA, 22 nt, Homo sapiens
aagccauaguggagagaacuga

SEQ ID NO: 653814 - RNA, 14 nt, Homo sapiens
aagccaugaguucc

SEQ ID NO: 653815 - RNA, 13 nt, Homo sapiens
aagccauuccaaa

SEQ ID NO: 653816 - RNA, 23 nt, Homo sapiens
aagcccaacugggguugcgucug

SEQ ID NO: 653817 - RNA, 17 nt, Homo sapiens
aagcccaagugaaauca

SEQ ID NO: 653818 - RNA, 15 nt, Homo sapiens
aagcccagugcacug

SEQ ID NO: 653819 - RNA, 17 nt, Homo sapiens
aagcccagugcacugaa

SEQ ID NO: 653820 - RNA, 15 nt, Homo sapiens
aagcccagugcugcu

SEQ ID NO: 653821 - RNA, 23 nt, Homo sapiens
aagccccugucgcccacccagcu

SEQ ID NO: 653822 - RNA, 13 nt, Homo sapiens
aagccccugugac

SEQ ID NO: 653823 - RNA, 14 nt, Homo sapiens
aagcccgccuccag

SEQ ID NO: 653824 - RNA, 14 nt, Homo sapiens
aagcccuaagugac

SEQ ID NO: 653825 - RNA, 19 nt, Homo sapiens
aagcccuccaaaagcacuu

SEQ ID NO: 653826 - RNA, 21 nt, Homo sapiens
aagccgaccuucccuccgccu

SEQ ID NO: 653827 - RNA, 15 nt, Homo sapiens
aagccgugauuuuca

SEQ ID NO: 653828 - RNA, 14 nt, Homo sapiens
aagccuaaaugccu

SEQ ID NO: 653829 - RNA, 15 nt, Homo sapiens
aagccuaagaaucuu

SEQ ID NO: 653830 - RNA, 20 nt, Homo sapiens
aagccuaagggauccugccu

SEQ ID NO: 653831 - RNA, 15 nt, Homo sapiens
aagccuaccaaugua

SEQ ID NO: 653832 - RNA, 16 nt, Homo sapiens
aagccuacccuauucu

SEQ ID NO: 653833 - RNA, 22 nt, Homo sapiens
aagccuauuugaacuacuuaaa

SEQ ID NO: 653834 - RNA, 18 nt, Homo sapiens
aagccucaaagucccuug

SEQ ID NO: 653835 - RNA, 20 nt, Homo sapiens
aagccucagugacccaugag

SEQ ID NO: 653836 - RNA, 14 nt, Homo sapiens
aagccucauuugaa

SEQ ID NO: 653837 - RNA, 12 nt, Homo sapiens
aagccuccucau

SEQ ID NO: 653838 - RNA, 24 nt, Homo sapiens
aagccuccugcccccugccaguga

SEQ ID NO: 653839 - RNA, 13 nt, Homo sapiens
aagccucucagua

SEQ ID NO: 653840 - RNA, 13 nt, Homo sapiens
aagccucucucuc

SEQ ID NO: 653841 - RNA, 21 nt, Homo sapiens
aagccugccgaaaacaggagc

SEQ ID NO: 653842 - RNA, 21 nt, Homo sapiens
aagccugcggcgccagccuca

SEQ ID NO: 653843 - RNA, 12 nt, Homo sapiens
aagccugucauu

SEQ ID NO: 653844 - RNA, 12 nt, Homo sapiens
aagccuguccau

SEQ ID NO: 653845 - RNA, 14 nt, Homo sapiens
aagccuguccucac

SEQ ID NO: 653846 - RNA, 15 nt, Homo sapiens
aagccuguugcugaa

SEQ ID NO: 653847 - RNA, 18 nt, Homo sapiens
aagccuuaaaaugcauug

SEQ ID NO: 653848 - RNA, 15 nt, Homo sapiens
aagccuuaagcaaau

SEQ ID NO: 653849 - RNA, 23 nt, Homo sapiens
aagccuuaaguggcagaauauaa

SEQ ID NO: 653850 - RNA, 23 nt, Homo sapiens
aagccuuauuucuagaagcacau

SEQ ID NO: 653851 - RNA, 16 nt, Homo sapiens
aagccuuuaaaaccag

SEQ ID NO: 653852 - RNA, 16 nt, Homo sapiens
aagccuuuugcucaca

SEQ ID NO: 653853 - RNA, 18 nt, Homo sapiens
aagccuuuugcucacaaa

SEQ ID NO: 653854 - RNA, 15 nt, Homo sapiens
aagcgaccaaggaug

SEQ ID NO: 653855 - RNA, 18 nt, Homo sapiens
aagcgagguccaagcaca

SEQ ID NO: 653856 - RNA, 19 nt, Homo sapiens
aagcgagguccaagcacau

SEQ ID NO: 653857 - RNA, 17 nt, Homo sapiens
aagcgauucuccugccu

SEQ ID NO: 653858 - RNA, 17 nt, Homo sapiens
aagcgcacauucaugug

SEQ ID NO: 653859 - RNA, 15 nt, Homo sapiens
aagcgccgacucccu

SEQ ID NO: 653860 - RNA, 22 nt, Homo sapiens
aagcgcuuggccucuccuucuc

SEQ ID NO: 653861 - RNA, 16 nt, Homo sapiens
aagcgucaucugugua

SEQ ID NO: 653862 - RNA, 21 nt, Homo sapiens
aagcguuucuuuacuucucac

SEQ ID NO: 653863 - RNA, 15 nt, Homo sapiens
aagcguuugcacaga

SEQ ID NO: 653864 - RNA, 14 nt, Homo sapiens
aagcuaaauuccac

SEQ ID NO: 653865 - RNA, 18 nt, Homo sapiens
aagcuaacaccagacaga

SEQ ID NO: 653866 - RNA, 22 nt, Homo sapiens
aagcuaaugacgaggaaccgaa

SEQ ID NO: 653867 - RNA, 21 nt, Homo sapiens
aagcuaccccucaaacugcac

SEQ ID NO: 653868 - RNA, 17 nt, Homo sapiens
aagcuaguggcuucaaa

SEQ ID NO: 653869 - RNA, 18 nt, Homo sapiens
aagcuaguguaccuccuc

SEQ ID NO: 653870 - RNA, 16 nt, Homo sapiens
aagcuauauaagacaa

SEQ ID NO: 653871 - RNA, 14 nt, Homo sapiens
aagcuaucagcaau

SEQ ID NO: 653872 - RNA, 22 nt, Homo sapiens
aagcuauggugagaugcagcug

SEQ ID NO: 653873 - RNA, 18 nt, Homo sapiens
aagcuauugucuguaaua

SEQ ID NO: 653874 - RNA, 21 nt, Homo sapiens
aagcuauuuuuuuaagcuauc

SEQ ID NO: 653875 - RNA, 18 nt, Homo sapiens
aagcucacugcugaucgu

SEQ ID NO: 653876 - RNA, 21 nt, Homo sapiens
aagcucagaggcgcacuguga

SEQ ID NO: 653877 - RNA, 15 nt, Homo sapiens
aagcuccacugucac

SEQ ID NO: 653878 - RNA, 13 nt, Homo sapiens
aagcuccucguga

SEQ ID NO: 653879 - RNA, 14 nt, Homo sapiens
aagcucgagugaau

SEQ ID NO: 653880 - RNA, 17 nt, Homo sapiens
aagcucuauuaagauuu

SEQ ID NO: 653881 - RNA, 13 nt, Homo sapiens
aagcucuucuaaa

SEQ ID NO: 653882 - RNA, 18 nt, Homo sapiens
aagcugaaggcugaggca

SEQ ID NO: 653883 - RNA, 13 nt, Homo sapiens
aagcugacuuuau

SEQ ID NO: 653884 - RNA, 17 nt, Homo sapiens
aagcugagaagaaugaa

SEQ ID NO: 653885 - RNA, 16 nt, Homo sapiens
aagcugagauugagca

SEQ ID NO: 653886 - RNA, 16 nt, Homo sapiens
aagcugagugacugua

SEQ ID NO: 653887 - RNA, 21 nt, Homo sapiens
aagcugagugacuguaggcag

SEQ ID NO: 653888 - RNA, 14 nt, Homo sapiens
aagcugaugaggcu

SEQ ID NO: 653889 - RNA, 23 nt, Homo sapiens
aagcugcacaugugccacacagu

SEQ ID NO: 653890 - RNA, 17 nt, Homo sapiens
aagcugccgguucuuaa

SEQ ID NO: 653891 - RNA, 18 nt, Homo sapiens
aagcugccucaaggaauu

SEQ ID NO: 653892 - RNA, 23 nt, Homo sapiens
aagcugcucagggaaaagcagcu

SEQ ID NO: 653893 - RNA, 12 nt, Homo sapiens
aagcugcuccuu

SEQ ID NO: 653894 - RNA, 23 nt, Homo sapiens
aagcugcuugcuguaacugugug

SEQ ID NO: 653895 - RNA, 14 nt, Homo sapiens
aagcuggaagcaca

SEQ ID NO: 653896 - RNA, 14 nt, Homo sapiens
aagcuggagugcug

SEQ ID NO: 653897 - RNA, 21 nt, Homo sapiens
aagcuggauuauuuagaucua

SEQ ID NO: 653898 - RNA, 15 nt, Homo sapiens
aagcuggcauuguga

SEQ ID NO: 653899 - RNA, 11 nt, Homo sapiens
aagcugggaac

SEQ ID NO: 653900 - RNA, 15 nt, Homo sapiens
aauaucagacaagca

SEQ ID NO: 653901 - RNA, 14 nt, Homo sapiens
aauaucaguauucu

SEQ ID NO: 653902 - RNA, 15 nt, Homo sapiens
aauaucaguuacuca

SEQ ID NO: 653903 - RNA, 20 nt, Homo sapiens
aauaucaugcacaacuauaa

SEQ ID NO: 653904 - RNA, 12 nt, Homo sapiens
aauaucauguua

SEQ ID NO: 653905 - RNA, 22 nt, Homo sapiens
aauauccagccucccacaagaa

SEQ ID NO: 653906 - RNA, 14 nt, Homo sapiens
aauaucccagagaa

SEQ ID NO: 653907 - RNA, 17 nt, Homo sapiens
aauauccgaacuuuaau

SEQ ID NO: 653908 - RNA, 21 nt, Homo sapiens
aauauccuguguaacacuugg

SEQ ID NO: 653909 - RNA, 15 nt, Homo sapiens
aauaucuugcuuuca

SEQ ID NO: 653910 - RNA, 19 nt, Homo sapiens
aauaugagcuucaauauaa

SEQ ID NO: 653911 - RNA, 19 nt, Homo sapiens
aauaugauaauaaaggcau

SEQ ID NO: 653912 - RNA, 17 nt, Homo sapiens
aauaugauacucucaga

SEQ ID NO: 653913 - RNA, 16 nt, Homo sapiens
aauaugaugccacuuu

SEQ ID NO: 653914 - RNA, 18 nt, Homo sapiens
aauaugauuuuauuugac

SEQ ID NO: 653915 - RNA, 16 nt, Homo sapiens
aauaugcaaaccagga

SEQ ID NO: 653916 - RNA, 22 nt, Homo sapiens
aauaugccuagcacaaguacca

SEQ ID NO: 653917 - RNA, 17 nt, Homo sapiens
aauaugcuuauaaccua

SEQ ID NO: 653918 - RNA, 16 nt, Homo sapiens
aauaugggcacuuuaa

SEQ ID NO: 653919 - RNA, 15 nt, Homo sapiens
aauaugggggccuuu

SEQ ID NO: 653920 - RNA, 20 nt, Homo sapiens
aauauggugggcacagaagu

SEQ ID NO: 653921 - RNA, 17 nt, Homo sapiens
aauauguagcucauccu

SEQ ID NO: 653922 - RNA, 22 nt, Homo sapiens
aauauguauuguaaacaugugu

SEQ ID NO: 653923 - RNA, 20 nt, Homo sapiens
aauaugucaccuggcacauu

SEQ ID NO: 653924 - RNA, 13 nt, Homo sapiens
aauaugugaaaga

SEQ ID NO: 653925 - RNA, 16 nt, Homo sapiens
aauauguuaaugcaaa

SEQ ID NO: 653926 - RNA, 15 nt, Homo sapiens
aauauuaaagcucuu

SEQ ID NO: 653927 - RNA, 13 nt, Homo sapiens
aauauuacaguga

SEQ ID NO: 653928 - RNA, 13 nt, Homo sapiens
aauauuacucuca

SEQ ID NO: 653929 - RNA, 18 nt, Homo sapiens
aauauuagaagccugcag

SEQ ID NO: 653930 - RNA, 17 nt, Homo sapiens
aauauuagggaguaaaa

SEQ ID NO: 653931 - RNA, 14 nt, Homo sapiens
aauauuaugaauuc

SEQ ID NO: 653932 - RNA, 18 nt, Homo sapiens
aauauucaaguaacacuu

SEQ ID NO: 653933 - RNA, 19 nt, Homo sapiens
aauauucagccagcuuaaa

SEQ ID NO: 653934 - RNA, 19 nt, Homo sapiens
aauauuccuuuauuuugcu

SEQ ID NO: 653935 - RNA, 12 nt, Homo sapiens
aauauugccaau

SEQ ID NO: 653936 - RNA, 20 nt, Homo sapiens
aauauuuaagacacugaaaa

SEQ ID NO: 653937 - RNA, 17 nt, Homo sapiens
aauauuuaaguauauag

SEQ ID NO: 653938 - RNA, 13 nt, Homo sapiens
aauauuuacucau

SEQ ID NO: 653939 - RNA, 20 nt, Homo sapiens
aauauuuauaaaugagcaaa

SEQ ID NO: 653940 - RNA, 15 nt, Homo sapiens
aauauuuaucugauu

SEQ ID NO: 653941 - RNA, 20 nt, Homo sapiens
aauauuuauuaccucugaua

SEQ ID NO: 653942 - RNA, 13 nt, Homo sapiens
aauauuucacauc

SEQ ID NO: 653943 - RNA, 20 nt, Homo sapiens
aauauuucccauuugugcca

SEQ ID NO: 653944 - RNA, 22 nt, Homo sapiens
aauauuucugauacugcugagu

SEQ ID NO: 653945 - RNA, 19 nt, Homo sapiens
aauauuucuucaaauaucu

SEQ ID NO: 653946 - RNA, 22 nt, Homo sapiens
aauauuugcuuuauacugagcu

SEQ ID NO: 653947 - RNA, 11 nt, Homo sapiens
aauauuuggaa

SEQ ID NO: 653948 - RNA, 13 nt, Homo sapiens
aauauuuguauac

SEQ ID NO: 653949 - RNA, 17 nt, Homo sapiens
aauauuuguauacacau

SEQ ID NO: 653950 - RNA, 16 nt, Homo sapiens
aauauuuuagccuuaa

SEQ ID NO: 653951 - RNA, 15 nt, Homo sapiens
aauauuuuaucuuuc

SEQ ID NO: 653952 - RNA, 12 nt, Homo sapiens
aauauuuuccau

SEQ ID NO: 653953 - RNA, 22 nt, Homo sapiens
aauauuuuuauauuuccuuuau

SEQ ID NO: 653954 - RNA, 18 nt, Homo sapiens
aauauuuuuccacuuaaa

SEQ ID NO: 653955 - RNA, 13 nt, Homo sapiens
aaucaaacugcaa

SEQ ID NO: 653956 - RNA, 14 nt, Homo sapiens
aaucaaagccaggg

SEQ ID NO: 653957 - RNA, 14 nt, Homo sapiens
aaucaaaugcaauu

SEQ ID NO: 653958 - RNA, 18 nt, Homo sapiens
aaucaacagaaguaucaa

SEQ ID NO: 653959 - RNA, 21 nt, Homo sapiens
aaucaacagaugauaguccaa

SEQ ID NO: 653960 - RNA, 23 nt, Homo sapiens
aaucaacccugcaaucacuuuuu

SEQ ID NO: 653961 - RNA, 14 nt, Homo sapiens
aaucaacucaaaac

SEQ ID NO: 653962 - RNA, 15 nt, Homo sapiens
aaucaacuuuacugu

SEQ ID NO: 653963 - RNA, 18 nt, Homo sapiens
aaucaagcuuuugcuuga

SEQ ID NO: 653964 - RNA, 21 nt, Homo sapiens
aaucaaggaaagaccaguuuc

SEQ ID NO: 653965 - RNA, 20 nt, Homo sapiens
aaucaagguaagcucaggau

SEQ ID NO: 653966 - RNA, 22 nt, Homo sapiens
aaucaaguuugaccagugcagu

SEQ ID NO: 653967 - RNA, 22 nt, Homo sapiens
aaucaauaagaagguagaauga

SEQ ID NO: 653968 - RNA, 19 nt, Homo sapiens
aaucaaugcaagagugauu

SEQ ID NO: 653969 - RNA, 11 nt, Homo sapiens
aaucacaaaaa

SEQ ID NO: 653970 - RNA, 11 nt, Homo sapiens
aaucacaagaa

SEQ ID NO: 653971 - RNA, 18 nt, Homo sapiens
aaucacaagaagauuccc

SEQ ID NO: 653972 - RNA, 22 nt, Homo sapiens
aaucacagucucaguucucuug

SEQ ID NO: 653973 - RNA, 12 nt, Homo sapiens
aaucacaucucc

SEQ ID NO: 653974 - RNA, 23 nt, Homo sapiens
aaucacauucuguuuaucaagcc

SEQ ID NO: 653975 - RNA, 22 nt, Homo sapiens
aaucaccaauaaauaagugcau

SEQ ID NO: 653976 - RNA, 13 nt, Homo sapiens
aaucaccacucaa

SEQ ID NO: 653977 - RNA, 16 nt, Homo sapiens
aaucaccacucaaaaa

SEQ ID NO: 653978 - RNA, 16 nt, Homo sapiens
aaucacuaaacuuuau

SEQ ID NO: 653979 - RNA, 13 nt, Homo sapiens
aaucacuacugua

SEQ ID NO: 653980 - RNA, 14 nt, Homo sapiens
aaucacuacuguau

SEQ ID NO: 653981 - RNA, 13 nt, Homo sapiens
aaucacucacaag

SEQ ID NO: 653982 - RNA, 17 nt, Homo sapiens
aaucacuuaagccugga

SEQ ID NO: 653983 - RNA, 15 nt, Homo sapiens
aaucagaacuaacca

SEQ ID NO: 653984 - RNA, 17 nt, Homo sapiens
aaucagaacuaaccagu

SEQ ID NO: 653985 - RNA, 20 nt, Homo sapiens
aaucagaauuggaaucacau

SEQ ID NO: 653986 - RNA, 20 nt, Homo sapiens
aaucagacuucacacugcaa

SEQ ID NO: 653987 - RNA, 14 nt, Homo sapiens
aaucagagacaaaa

SEQ ID NO: 653988 - RNA, 20 nt, Homo sapiens
aaucagagcuccaguuugca

SEQ ID NO: 653989 - RNA, 15 nt, Homo sapiens
aaucagaucauuuca

SEQ ID NO: 653990 - RNA, 13 nt, Homo sapiens
aaucagcauuuag

SEQ ID NO: 653991 - RNA, 12 nt, Homo sapiens
aaucagccauaa

SEQ ID NO: 653992 - RNA, 19 nt, Homo sapiens
aaucagccauaagaaagca

SEQ ID NO: 653993 - RNA, 21 nt, Homo sapiens
aaucagccuuuaggucuuuag

SEQ ID NO: 653994 - RNA, 19 nt, Homo sapiens
aaucagcugcugacuggca

SEQ ID NO: 653995 - RNA, 14 nt, Homo sapiens
aaucaggaaacuca

SEQ ID NO: 653996 - RNA, 22 nt, Homo sapiens
aaucaggcugaggugucuuaag

SEQ ID NO: 653997 - RNA, 18 nt, Homo sapiens
aaucagguccucagagaa

SEQ ID NO: 653998 - RNA, 18 nt, Homo sapiens
aaucaguaagagguguua

SEQ ID NO: 653999 - RNA, 22 nt, Homo sapiens
aaucaguaucagaauacuugca

SEQ ID NO: 654000 - RNA, 22 nt, Homo sapiens
aaucagucuuccuuguggaaug

SEQ ID NO: 654001 - RNA, 21 nt, Homo sapiens
aaucagugaagaugcaaucag

SEQ ID NO: 654002 - RNA, 17 nt, Homo sapiens
aaucagugccugguguu

SEQ ID NO: 654003 - RNA, 22 nt, Homo sapiens
aaucaguucuuagauucagggg

SEQ ID NO: 654004 - RNA, 19 nt, Homo sapiens
aaucauauaauaaauguac

SEQ ID NO: 654005 - RNA, 21 nt, Homo sapiens
aaucauaucuuuuaauugugu

SEQ ID NO: 654006 - RNA, 16 nt, Homo sapiens
aaucaucaaguaauac

SEQ ID NO: 654007 - RNA, 18 nt, Homo sapiens
aaucaugccauugcacuc

SEQ ID NO: 654008 - RNA, 22 nt, Homo sapiens
aaucaugccauugcacuccagc

SEQ ID NO: 654009 - RNA, 22 nt, Homo sapiens
aaucaugcucauguauauuuag

SEQ ID NO: 654010 - RNA, 11 nt, Homo sapiens
aaucaugucag

SEQ ID NO: 654011 - RNA, 21 nt, Homo sapiens
aaucaugugaaauuuaggcag

SEQ ID NO: 654012 - RNA, 21 nt, Homo sapiens
aaucaugugggugagccagug

SEQ ID NO: 654013 - RNA, 16 nt, Homo sapiens
aaucauuaauacucuu

SEQ ID NO: 654014 - RNA, 22 nt, Homo sapiens
aaucauuccuuagauaccuuga

SEQ ID NO: 654015 - RNA, 21 nt, Homo sapiens
aaucauuuguuuacauuugau

SEQ ID NO: 654016 - RNA, 15 nt, Homo sapiens
aaucauuuuaaauuc

SEQ ID NO: 654017 - RNA, 19 nt, Homo sapiens
aaucauuuuauaugucaaa

SEQ ID NO: 654018 - RNA, 18 nt, Homo sapiens
aaucauuuucauuccuaa

SEQ ID NO: 654019 - RNA, 18 nt, Homo sapiens
aauccaaauuucucaugu

SEQ ID NO: 654020 - RNA, 13 nt, Homo sapiens
aauccaacaucca

SEQ ID NO: 654021 - RNA, 13 nt, Homo sapiens
aauccaauacugc

SEQ ID NO: 654022 - RNA, 13 nt, Homo sapiens
acaaaaacuugua

SEQ ID NO: 654023 - RNA, 21 nt, Homo sapiens
acaaaaauguaaugaucauaa

SEQ ID NO: 654024 - RNA, 13 nt, Homo sapiens
acaaaaauuagcu

SEQ ID NO: 654025 - RNA, 22 nt, Homo sapiens
acaaaaauugagacauuuacau

SEQ ID NO: 654026 - RNA, 17 nt, Homo sapiens
acaaaacacagccaagg

SEQ ID NO: 654027 - RNA, 17 nt, Homo sapiens
acaaaaccaagccuugg

SEQ ID NO: 654028 - RNA, 20 nt, Homo sapiens
acaaaacccucagcacuguu

SEQ ID NO: 654029 - RNA, 23 nt, Homo sapiens
acaaaaccgcauucagugcaccu

SEQ ID NO: 654030 - RNA, 16 nt, Homo sapiens
acaaaaccuaacuugc

SEQ ID NO: 654031 - RNA, 11 nt, Homo sapiens
acaaaacuaca

SEQ ID NO: 654032 - RNA, 16 nt, Homo sapiens
acaaaacuacaugaga

SEQ ID NO: 654033 - RNA, 13 nt, Homo sapiens
acaaaacugccaa

SEQ ID NO: 654034 - RNA, 12 nt, Homo sapiens
acaaaagaauaa

SEQ ID NO: 654035 - RNA, 20 nt, Homo sapiens
acaaaagaauaacauuuucu

SEQ ID NO: 654036 - RNA, 16 nt, Homo sapiens
acaaaagacagaccca

SEQ ID NO: 654037 - RNA, 14 nt, Homo sapiens
acaaaagauguauc

SEQ ID NO: 654038 - RNA, 15 nt, Homo sapiens
acaaaagauguaucc

SEQ ID NO: 654039 - RNA, 15 nt, Homo sapiens
acaaaagcccaaugu

SEQ ID NO: 654040 - RNA, 11 nt, Homo sapiens
acaaaagcuau

SEQ ID NO: 654041 - RNA, 20 nt, Homo sapiens
acaaaauaaccaauccugga

SEQ ID NO: 654042 - RNA, 16 nt, Homo sapiens
acaaaauaauaccuua

SEQ ID NO: 654043 - RNA, 19 nt, Homo sapiens
acaaaaucuuguaggucau

SEQ ID NO: 654044 - RNA, 22 nt, Homo sapiens
acaaaauggucauccaaacuca

SEQ ID NO: 654045 - RNA, 15 nt, Homo sapiens
acaaaauuaugcaaa

SEQ ID NO: 654046 - RNA, 21 nt, Homo sapiens
acaaaauuuuauuuugugcuc

SEQ ID NO: 654047 - RNA, 11 nt, Homo sapiens
acaaacagacc

SEQ ID NO: 654048 - RNA, 20 nt, Homo sapiens
acaaacauggauacuuccug

SEQ ID NO: 654049 - RNA, 14 nt, Homo sapiens
acaaaccauuuugu

SEQ ID NO: 654050 - RNA, 20 nt, Homo sapiens
acaaacccucuguagcuaua

SEQ ID NO: 654051 - RNA, 15 nt, Homo sapiens
acaaaccuaccaaaa

SEQ ID NO: 654052 - RNA, 21 nt, Homo sapiens
acaaaccuucuuuaaggcaua

SEQ ID NO: 654053 - RNA, 19 nt, Homo sapiens
acaaacucugaaagaccua

SEQ ID NO: 654054 - RNA, 13 nt, Homo sapiens
acaaacugaagag

SEQ ID NO: 654055 - RNA, 23 nt, Homo sapiens
acaaacuggcugcuuuguucaau

SEQ ID NO: 654056 - RNA, 12 nt, Homo sapiens
acaaacugugaa

SEQ ID NO: 654057 - RNA, 22 nt, Homo sapiens
acaaagacuccucugggccugg

SEQ ID NO: 654058 - RNA, 23 nt, Homo sapiens
acaaagagaaugagaagacaugg

SEQ ID NO: 654059 - RNA, 17 nt, Homo sapiens
acaaagaggagcugcug

SEQ ID NO: 654060 - RNA, 13 nt, Homo sapiens
acaaagaugacug

SEQ ID NO: 654061 - RNA, 19 nt, Homo sapiens
acaaagaugccacauucaa

SEQ ID NO: 654062 - RNA, 18 nt, Homo sapiens
acaaagcccuuccauguc

SEQ ID NO: 654063 - RNA, 12 nt, Homo sapiens
acaaagccuuau

SEQ ID NO: 654064 - RNA, 19 nt, Homo sapiens
acaaaggacccaaucccca

SEQ ID NO: 654065 - RNA, 14 nt, Homo sapiens
acaaagggcacuua

SEQ ID NO: 654066 - RNA, 22 nt, Homo sapiens
acaaagggccaucguucaucca

SEQ ID NO: 654067 - RNA, 13 nt, Homo sapiens
acaaagucauccc

SEQ ID NO: 654068 - RNA, 21 nt, Homo sapiens
acaaaguccacuuuacucaaa

SEQ ID NO: 654069 - RNA, 17 nt, Homo sapiens
acaaaguguauacaugu

SEQ ID NO: 654070 - RNA, 19 nt, Homo sapiens
acaaaguuauauucacagu

SEQ ID NO: 654071 - RNA, 17 nt, Homo sapiens
acaaauacuaaaugugc

SEQ ID NO: 654072 - RNA, 16 nt, Homo sapiens
acaaauacuugacuca

SEQ ID NO: 654073 - RNA, 23 nt, Homo sapiens
acaaauagucuaucaaccccaga

SEQ ID NO: 654074 - RNA, 14 nt, Homo sapiens
acaaaucaucugua

SEQ ID NO: 654075 - RNA, 17 nt, Homo sapiens
acaaauccauaauuauu

SEQ ID NO: 654076 - RNA, 18 nt, Homo sapiens
acaaaucucaaaguguac

SEQ ID NO: 654077 - RNA, 18 nt, Homo sapiens
acaaaugaacgauaugua

SEQ ID NO: 654078 - RNA, 12 nt, Homo sapiens
acaaaugaucac

SEQ ID NO: 654079 - RNA, 22 nt, Homo sapiens
acaaaugccacacggcucucac

SEQ ID NO: 654080 - RNA, 15 nt, Homo sapiens
acaaaugguagcaua

SEQ ID NO: 654081 - RNA, 20 nt, Homo sapiens
acaaauguauuaaugcuaua

SEQ ID NO: 654082 - RNA, 14 nt, Homo sapiens
acaaaugugauaau

SEQ ID NO: 654083 - RNA, 17 nt, Homo sapiens
acaaauuagccauuuca

SEQ ID NO: 654084 - RNA, 20 nt, Homo sapiens
acaaauuagccauuucacuc

SEQ ID NO: 654085 - RNA, 18 nt, Homo sapiens
acaaauuauaagcauaca

SEQ ID NO: 654086 - RNA, 19 nt, Homo sapiens
acaaauuauaagcauacaa

SEQ ID NO: 654087 - RNA, 16 nt, Homo sapiens
acaaauucaagccuua

SEQ ID NO: 654088 - RNA, 13 nt, Homo sapiens
acaaauuccacau

SEQ ID NO: 654089 - RNA, 22 nt, Homo sapiens
acaaauuuaugcauuucauuca

SEQ ID NO: 654090 - RNA, 21 nt, Homo sapiens
acaaauuucauuuccauuuaa

SEQ ID NO: 654091 - RNA, 23 nt, Homo sapiens
acaaauuuuguauaacuuuugau

SEQ ID NO: 654092 - RNA, 15 nt, Homo sapiens
acaacaaaaggacuu

SEQ ID NO: 654093 - RNA, 12 nt, Homo sapiens
acaacaaacuug

SEQ ID NO: 654094 - RNA, 14 nt, Homo sapiens
acaacaacauguac

SEQ ID NO: 654095 - RNA, 17 nt, Homo sapiens
acaacaaccuggucaca

SEQ ID NO: 654096 - RNA, 18 nt, Homo sapiens
acaacaacgagauaccau

SEQ ID NO: 654097 - RNA, 19 nt, Homo sapiens
acaacacccaagaugaauu

SEQ ID NO: 654098 - RNA, 16 nt, Homo sapiens
acaacacugagccauu

SEQ ID NO: 654099 - RNA, 11 nt, Homo sapiens
acaacacuuaa

SEQ ID NO: 654100 - RNA, 23 nt, Homo sapiens
acaacagaaguauuucuguggau

SEQ ID NO: 654101 - RNA, 14 nt, Homo sapiens
acaacagugagaaa

SEQ ID NO: 654102 - RNA, 17 nt, Homo sapiens
acaacauaaggagaaug

SEQ ID NO: 654103 - RNA, 19 nt, Homo sapiens
acaacauccuuaagucaaa

SEQ ID NO: 654104 - RNA, 23 nt, Homo sapiens
acaacaugcuagguagugaccua

SEQ ID NO: 654105 - RNA, 21 nt, Homo sapiens
acaacauguaccuguauuaaa

SEQ ID NO: 654106 - RNA, 19 nt, Homo sapiens
acaacauuuacuuaacaga

SEQ ID NO: 654107 - RNA, 14 nt, Homo sapiens
acaacauuucucaa

SEQ ID NO: 654108 - RNA, 19 nt, Homo sapiens
acaacauuucucaaaugca

SEQ ID NO: 654109 - RNA, 21 nt, Homo sapiens
acaaccaugagaccacuguua

SEQ ID NO: 654110 - RNA, 19 nt, Homo sapiens
acaacccaccccgcuuucg

SEQ ID NO: 654111 - RNA, 22 nt, Homo sapiens
acaaccugaaauuuauucacau

SEQ ID NO: 654112 - RNA, 21 nt, Homo sapiens
acaacgaaagaaggcauggac

SEQ ID NO: 654113 - RNA, 14 nt, Homo sapiens
acaacgaugaugcu

SEQ ID NO: 654114 - RNA, 19 nt, Homo sapiens
acaacgcaccagacacuca

SEQ ID NO: 654115 - RNA, 18 nt, Homo sapiens
acaacucuagucagcaca

SEQ ID NO: 654116 - RNA, 20 nt, Homo sapiens
acaacugauacuucacuacu

SEQ ID NO: 654117 - RNA, 15 nt, Homo sapiens
acaacugcauaaccu

SEQ ID NO: 654118 - RNA, 16 nt, Homo sapiens
acaacugcauaaccuu

SEQ ID NO: 654119 - RNA, 17 nt, Homo sapiens
acaacugccagcucucu

SEQ ID NO: 654120 - RNA, 12 nt, Homo sapiens
acaacuggacaa

SEQ ID NO: 654121 - RNA, 23 nt, Homo sapiens
acaacuggacucauuaucacagu

SEQ ID NO: 654122 - RNA, 12 nt, Homo sapiens
acaacugugacu

SEQ ID NO: 654123 - RNA, 13 nt, Homo sapiens
acaacugugacug

SEQ ID NO: 654124 - RNA, 12 nt, Homo sapiens
acaacugugguc

SEQ ID NO: 654125 - RNA, 17 nt, Homo sapiens
acaacuguggucaaucc

SEQ ID NO: 654126 - RNA, 18 nt, Homo sapiens
acaacuguggucaauccg

SEQ ID NO: 654127 - RNA, 16 nt, Homo sapiens
acaacuucagcaguac

SEQ ID NO: 654128 - RNA, 22 nt, Homo sapiens
acaacuuccucccuuacagagc

SEQ ID NO: 654129 - RNA, 18 nt, Homo sapiens
acaacuugaauaauacac

SEQ ID NO: 654130 - RNA, 20 nt, Homo sapiens
acaacuuggguucuucucag

SEQ ID NO: 654131 - RNA, 14 nt, Homo sapiens
acaacuuucagugg

SEQ ID NO: 654132 - RNA, 14 nt, Homo sapiens
acaagaaaucugac

SEQ ID NO: 654133 - RNA, 14 nt, Homo sapiens
acaagaaccucucc

SEQ ID NO: 654134 - RNA, 20 nt, Homo sapiens
acaagaacuuuaaauugugu

SEQ ID NO: 654135 - RNA, 11 nt, Homo sapiens
acaagaagcug

SEQ ID NO: 654136 - RNA, 16 nt, Homo sapiens
acaagaaugcauuccc

SEQ ID NO: 654137 - RNA, 16 nt, Homo sapiens
acaagaauggucuuuc

SEQ ID NO: 654138 - RNA, 17 nt, Homo sapiens
acaagacaaaaccaaaa

SEQ ID NO: 654139 - RNA, 13 nt, Homo sapiens
acaagacacagug

SEQ ID NO: 654140 - RNA, 15 nt, Homo sapiens
acaagacacagugac

SEQ ID NO: 654141 - RNA, 15 nt, Homo sapiens
acaagacaccaaauu

SEQ ID NO: 654142 - RNA, 19 nt, Homo sapiens
acaagacaccaaauugaac

SEQ ID NO: 654143 - RNA, 18 nt, Homo sapiens
acaagagacuuaacuuau

SEQ ID NO: 654144 - RNA, 14 nt, Homo sapiens
accuggagacuguc

SEQ ID NO: 654145 - RNA, 17 nt, Homo sapiens
accuggauccagcacug

SEQ ID NO: 654146 - RNA, 16 nt, Homo sapiens
accuggcacaauggcu

SEQ ID NO: 654147 - RNA, 14 nt, Homo sapiens
accuggcacauuca

SEQ ID NO: 654148 - RNA, 20 nt, Homo sapiens
accuggcagggcucacacuc

SEQ ID NO: 654149 - RNA, 16 nt, Homo sapiens
accuggcccuugcaau

SEQ ID NO: 654150 - RNA, 16 nt, Homo sapiens
accuggcgugcucaga

SEQ ID NO: 654151 - RNA, 20 nt, Homo sapiens
accugggagaccagggacca

SEQ ID NO: 654152 - RNA, 20 nt, Homo sapiens
accugggagggugggaccaa

SEQ ID NO: 654153 - RNA, 15 nt, Homo sapiens
accugggcaaagccu

SEQ ID NO: 654154 - RNA, 23 nt, Homo sapiens
accuggggauccaauugauguau

SEQ ID NO: 654155 - RNA, 19 nt, Homo sapiens
accuggggcacaguccagg

SEQ ID NO: 654156 - RNA, 23 nt, Homo sapiens
accugguggcuacgaaucuuccg

SEQ ID NO: 654157 - RNA, 19 nt, Homo sapiens
accuguaaucccagcacuu

SEQ ID NO: 654158 - RNA, 11 nt, Homo sapiens
accuguagcug

SEQ ID NO: 654159 - RNA, 23 nt, Homo sapiens
accuguaggucaggaccaucaga

SEQ ID NO: 654160 - RNA, 19 nt, Homo sapiens
accuguagucccaguuacu

SEQ ID NO: 654161 - RNA, 20 nt, Homo sapiens
accuguagugagaaacugau

SEQ ID NO: 654162 - RNA, 16 nt, Homo sapiens
accuguauuuugccag

SEQ ID NO: 654163 - RNA, 16 nt, Homo sapiens
accugucaacauuugg

SEQ ID NO: 654164 - RNA, 21 nt, Homo sapiens
accugucaucauggaggucau

SEQ ID NO: 654165 - RNA, 20 nt, Homo sapiens
accuguccaggugaguguga

SEQ ID NO: 654166 - RNA, 22 nt, Homo sapiens
accugucgguggcugccuuuga

SEQ ID NO: 654167 - RNA, 18 nt, Homo sapiens
accugucuaggucuccuc

SEQ ID NO: 654168 - RNA, 19 nt, Homo sapiens
accugugacaaaggaugaa

SEQ ID NO: 654169 - RNA, 14 nt, Homo sapiens
accugugaccagca

SEQ ID NO: 654170 - RNA, 11 nt, Homo sapiens
accugugauga

SEQ ID NO: 654171 - RNA, 19 nt, Homo sapiens
accuguggccaaguucuua

SEQ ID NO: 654172 - RNA, 14 nt, Homo sapiens
accuguggugaccc

SEQ ID NO: 654173 - RNA, 19 nt, Homo sapiens
accuguggugauguugcca

SEQ ID NO: 654174 - RNA, 15 nt, Homo sapiens
accuguguucuugcu

SEQ ID NO: 654175 - RNA, 20 nt, Homo sapiens
accuguguucuugcugagca

SEQ ID NO: 654176 - RNA, 20 nt, Homo sapiens
accuguguuucguguauaug

SEQ ID NO: 654177 - RNA, 22 nt, Homo sapiens
accuguuaauuuuuauacugac

SEQ ID NO: 654178 - RNA, 15 nt, Homo sapiens
accuguuacuugaaa

SEQ ID NO: 654179 - RNA, 19 nt, Homo sapiens
accuguuagcagacaggcc

SEQ ID NO: 654180 - RNA, 15 nt, Homo sapiens
accuguucaaaaagg

SEQ ID NO: 654181 - RNA, 16 nt, Homo sapiens
accuguucuguagcuu

SEQ ID NO: 654182 - RNA, 11 nt, Homo sapiens
accuguugaag

SEQ ID NO: 654183 - RNA, 17 nt, Homo sapiens
accuuaagacacuguga

SEQ ID NO: 654184 - RNA, 20 nt, Homo sapiens
accuuacaacucggggacaa

SEQ ID NO: 654185 - RNA, 12 nt, Homo sapiens
accuuacaggga

SEQ ID NO: 654186 - RNA, 20 nt, Homo sapiens
accuuagagcaaccucugua

SEQ ID NO: 654187 - RNA, 19 nt, Homo sapiens
accuuagauuagcucugga

SEQ ID NO: 654188 - RNA, 16 nt, Homo sapiens
accuuauucuacauca

SEQ ID NO: 654189 - RNA, 18 nt, Homo sapiens
accuuauucuacaucauu

SEQ ID NO: 654190 - RNA, 13 nt, Homo sapiens
accuucaauacuu

SEQ ID NO: 654191 - RNA, 15 nt, Homo sapiens
accuucaauacuuaa

SEQ ID NO: 654192 - RNA, 14 nt, Homo sapiens
accuucagagccag

SEQ ID NO: 654193 - RNA, 15 nt, Homo sapiens
accuucagagccagc

SEQ ID NO: 654194 - RNA, 18 nt, Homo sapiens
accuucaggcagccagug

SEQ ID NO: 654195 - RNA, 14 nt, Homo sapiens
accuucagugaaag

SEQ ID NO: 654196 - RNA, 22 nt, Homo sapiens
accuucaugugauucacugccu

SEQ ID NO: 654197 - RNA, 23 nt, Homo sapiens
accuucauguggcucagugccuu

SEQ ID NO: 654198 - RNA, 20 nt, Homo sapiens
accuucauuuuuaagacugu

SEQ ID NO: 654199 - RNA, 18 nt, Homo sapiens
accuuccauucacaccag

SEQ ID NO: 654200 - RNA, 19 nt, Homo sapiens
accuucccagcaguuugcu

SEQ ID NO: 654201 - RNA, 18 nt, Homo sapiens
accuuccccagcguccca

SEQ ID NO: 654202 - RNA, 16 nt, Homo sapiens
accuucguuaagugau

SEQ ID NO: 654203 - RNA, 17 nt, Homo sapiens
accuucucuggagccaa

SEQ ID NO: 654204 - RNA, 15 nt, Homo sapiens
accuugaacacuggg

SEQ ID NO: 654205 - RNA, 22 nt, Homo sapiens
accuugacuugauuagugccuu

SEQ ID NO: 654206 - RNA, 16 nt, Homo sapiens
accuugagcaaauuag

SEQ ID NO: 654207 - RNA, 20 nt, Homo sapiens
accuugcacaaacagccccu

SEQ ID NO: 654208 - RNA, 13 nt, Homo sapiens
accuuggaccuca

SEQ ID NO: 654209 - RNA, 15 nt, Homo sapiens
accuuggaccucagu

SEQ ID NO: 654210 - RNA, 16 nt, Homo sapiens
accuuggaccucagug

SEQ ID NO: 654211 - RNA, 15 nt, Homo sapiens
accuuggacuccucc

SEQ ID NO: 654212 - RNA, 18 nt, Homo sapiens
accuuggacuccucccac

SEQ ID NO: 654213 - RNA, 22 nt, Homo sapiens
accuuggagaggagaguggcag

SEQ ID NO: 654214 - RNA, 23 nt, Homo sapiens
accuuggagcgagucugccccag

SEQ ID NO: 654215 - RNA, 20 nt, Homo sapiens
accuuggcccaggagcucug

SEQ ID NO: 654216 - RNA, 20 nt, Homo sapiens
accuuggcugcugagccagg

SEQ ID NO: 654217 - RNA, 18 nt, Homo sapiens
accuugggggaagacuuu

SEQ ID NO: 654218 - RNA, 22 nt, Homo sapiens
accuugguguuucucucuguaa

SEQ ID NO: 654219 - RNA, 12 nt, Homo sapiens
accuugugagag

SEQ ID NO: 654220 - RNA, 14 nt, Homo sapiens
accuugugccuugg

SEQ ID NO: 654221 - RNA, 23 nt, Homo sapiens
accuuguuuugcugucuucauca

SEQ ID NO: 654222 - RNA, 15 nt, Homo sapiens
accuuuaucuuucca

SEQ ID NO: 654223 - RNA, 17 nt, Homo sapiens
accuuucaaauuucaca

SEQ ID NO: 654224 - RNA, 21 nt, Homo sapiens
accuuucacgaacaugggcau

SEQ ID NO: 654225 - RNA, 14 nt, Homo sapiens
accuuuccauuuau

SEQ ID NO: 654226 - RNA, 20 nt, Homo sapiens
accuuuccauuuauucuuug

SEQ ID NO: 654227 - RNA, 18 nt, Homo sapiens
accuuuccucucccucag

SEQ ID NO: 654228 - RNA, 14 nt, Homo sapiens
accuuuccugaugc

SEQ ID NO: 654229 - RNA, 16 nt, Homo sapiens
accuuucuagccuuag

SEQ ID NO: 654230 - RNA, 23 nt, Homo sapiens
accuuucuagccuuagacaaaug

SEQ ID NO: 654231 - RNA, 19 nt, Homo sapiens
accuuucuagggacaugaa

SEQ ID NO: 654232 - RNA, 19 nt, Homo sapiens
accuuuggaugcacuuuau

SEQ ID NO: 654233 - RNA, 22 nt, Homo sapiens
accuuugggucuacaaguauau

SEQ ID NO: 654234 - RNA, 22 nt, Homo sapiens
accuuuguacgcuuugcucaaa

SEQ ID NO: 654235 - RNA, 22 nt, Homo sapiens
accuuuucaccuccaacuggau

SEQ ID NO: 654236 - RNA, 20 nt, Homo sapiens
accuuuuccccaaccacaga

SEQ ID NO: 654237 - RNA, 21 nt, Homo sapiens
accuuuuccccaaccacagag

SEQ ID NO: 654238 - RNA, 20 nt, Homo sapiens
accuuuuccuuauacuguau

SEQ ID NO: 654239 - RNA, 22 nt, Homo sapiens
accuuuugaggagccccagcua

SEQ ID NO: 654240 - RNA, 15 nt, Homo sapiens
accuuuuuauuugca

SEQ ID NO: 654241 - RNA, 14 nt, Homo sapiens
acgaaaagccagcu

SEQ ID NO: 654242 - RNA, 14 nt, Homo sapiens
acgaaaauaaagua

SEQ ID NO: 654243 - RNA, 22 nt, Homo sapiens
acgaacacaagaauugaauagu

SEQ ID NO: 654244 - RNA, 21 nt, Homo sapiens
acgaagagacagaacugucca

SEQ ID NO: 654245 - RNA, 18 nt, Homo sapiens
acgaagccuuaagccaua

SEQ ID NO: 654246 - RNA, 13 nt, Homo sapiens
acgaaggggcccc

SEQ ID NO: 654247 - RNA, 19 nt, Homo sapiens
acgaaugaaugaacagcca

SEQ ID NO: 654248 - RNA, 13 nt, Homo sapiens
acgacaacgauga

SEQ ID NO: 654249 - RNA, 17 nt, Homo sapiens
acgacaacgaugaugcu

SEQ ID NO: 654250 - RNA, 18 nt, Homo sapiens
acgacaagugcugaacag

SEQ ID NO: 654251 - RNA, 14 nt, Homo sapiens
acgacacauuugcc

SEQ ID NO: 654252 - RNA, 22 nt, Homo sapiens
acgacucaaaaugacaguuuca

SEQ ID NO: 654253 - RNA, 21 nt, Homo sapiens
acgacuggucaccuugcacuc

SEQ ID NO: 654254 - RNA, 16 nt, Homo sapiens
acgagacccagaggaa

SEQ ID NO: 654255 - RNA, 16 nt, Homo sapiens
acgagggguggugcua

SEQ ID NO: 654256 - RNA, 13 nt, Homo sapiens
acgaggugcaaca

SEQ ID NO: 654257 - RNA, 17 nt, Homo sapiens
acgagguggcagucgca

SEQ ID NO: 654258 - RNA, 20 nt, Homo sapiens
acgagugaaacuccgucuca

SEQ ID NO: 654259 - RNA, 23 nt, Homo sapiens
acgaguugcagccagggccagug

SEQ ID NO: 654260 - RNA, 15 nt, Homo sapiens
acgaucuuccuggcu

SEQ ID NO: 654261 - RNA, 11 nt, Homo sapiens
acgaugcauuu

SEQ ID NO: 654262 - RNA, 13 nt, Homo sapiens
acgaugcauuuaa

SEQ ID NO: 654263 - RNA, 17 nt, Homo sapiens
acgauucuuaacaauaa

SEQ ID NO: 654264 - RNA, 13 nt, Homo sapiens
acgauuucagcua

SEQ ID NO: 654265 - RNA, 20 nt, Homo sapiens
acucuggggcuuguccugug

SEQ ID NO: 654266 - RNA, 22 nt, Homo sapiens
acucuggguuucauauccagcu

SEQ ID NO: 654267 - RNA, 12 nt, Homo sapiens
acucugguggcc

SEQ ID NO: 654268 - RNA, 18 nt, Homo sapiens
acucuguaaaaacacuga

SEQ ID NO: 654269 - RNA, 22 nt, Homo sapiens
acucuguaguuacuguggucac

SEQ ID NO: 654270 - RNA, 21 nt, Homo sapiens
acucuguccacgauucacuca

SEQ ID NO: 654271 - RNA, 17 nt, Homo sapiens
acucuguccaggccacu

SEQ ID NO: 654272 - RNA, 15 nt, Homo sapiens
acucugucuaccugg

SEQ ID NO: 654273 - RNA, 12 nt, Homo sapiens
acucugucuugu

SEQ ID NO: 654274 - RNA, 16 nt, Homo sapiens
acucuuagccccagac

SEQ ID NO: 654275 - RNA, 17 nt, Homo sapiens
acucuuaggcacaucaa

SEQ ID NO: 654276 - RNA, 15 nt, Homo sapiens
acucuucacuccaaa

SEQ ID NO: 654277 - RNA, 18 nt, Homo sapiens
acucuuccagaaucccaa

SEQ ID NO: 654278 - RNA, 16 nt, Homo sapiens
acucuucuaacacaaa

SEQ ID NO: 654279 - RNA, 23 nt, Homo sapiens
acucuugaggauguaaugcauua

SEQ ID NO: 654280 - RNA, 15 nt, Homo sapiens
acucuugaugugaag

SEQ ID NO: 654281 - RNA, 22 nt, Homo sapiens
acucuugggugaaggugcaucu

SEQ ID NO: 654282 - RNA, 21 nt, Homo sapiens
acucuugugaauuauucugau

SEQ ID NO: 654283 - RNA, 17 nt, Homo sapiens
acucuuuccuaaagcca

SEQ ID NO: 654284 - RNA, 21 nt, Homo sapiens
acucuuuccuaaagccaaagu

SEQ ID NO: 654285 - RNA, 21 nt, Homo sapiens
acucuuuggguccauucagau

SEQ ID NO: 654286 - RNA, 23 nt, Homo sapiens
acugaaaaaugguaauuguugcu

SEQ ID NO: 654287 - RNA, 18 nt, Homo sapiens
acugaaaacuuagccaga

SEQ ID NO: 654288 - RNA, 14 nt, Homo sapiens
acugaaaaugugcu

SEQ ID NO: 654289 - RNA, 13 nt, Homo sapiens
acugaaaccaaaa

SEQ ID NO: 654290 - RNA, 14 nt, Homo sapiens
acugaaaccaaaac

SEQ ID NO: 654291 - RNA, 14 nt, Homo sapiens
acugaaagugaaag

SEQ ID NO: 654292 - RNA, 16 nt, Homo sapiens
acugaaaugccugcuu

SEQ ID NO: 654293 - RNA, 19 nt, Homo sapiens
acugaacauguacacuggu

SEQ ID NO: 654294 - RNA, 14 nt, Homo sapiens
acugaacauuccag

SEQ ID NO: 654295 - RNA, 15 nt, Homo sapiens
acugaaccauuccaa

SEQ ID NO: 654296 - RNA, 12 nt, Homo sapiens
acugaacuccau

SEQ ID NO: 654297 - RNA, 20 nt, Homo sapiens
acugaacuuaauaacugugu

SEQ ID NO: 654298 - RNA, 17 nt, Homo sapiens
acugaagaagaugagcc

SEQ ID NO: 654299 - RNA, 21 nt, Homo sapiens
acugaagaauuuugagugaau

SEQ ID NO: 654300 - RNA, 15 nt, Homo sapiens
acugaagacucugca

SEQ ID NO: 654301 - RNA, 21 nt, Homo sapiens
acugaagccugcguuggucca

SEQ ID NO: 654302 - RNA, 14 nt, Homo sapiens
acugaagugcuugc

SEQ ID NO: 654303 - RNA, 14 nt, Homo sapiens
acugaauaauauca

SEQ ID NO: 654304 - RNA, 16 nt, Homo sapiens
acugaauacagucuca

SEQ ID NO: 654305 - RNA, 16 nt, Homo sapiens
acugaaugaauccauu

SEQ ID NO: 654306 - RNA, 14 nt, Homo sapiens
acugaaugagguca

SEQ ID NO: 654307 - RNA, 17 nt, Homo sapiens
acugaauucugccuugg

SEQ ID NO: 654308 - RNA, 14 nt, Homo sapiens
acugacacuacuaa

SEQ ID NO: 654309 - RNA, 19 nt, Homo sapiens
acugacacuuugccagaaa

SEQ ID NO: 654310 - RNA, 15 nt, Homo sapiens
acugacagggagcag

SEQ ID NO: 654311 - RNA, 16 nt, Homo sapiens
acugaccaggcccaag

SEQ ID NO: 654312 - RNA, 17 nt, Homo sapiens
acugaccauauugugcu

SEQ ID NO: 654313 - RNA, 20 nt, Homo sapiens
acugaccauauugugcuuca

SEQ ID NO: 654314 - RNA, 13 nt, Homo sapiens
acugacgcuggag

SEQ ID NO: 654315 - RNA, 12 nt, Homo sapiens
acugacuacccu

SEQ ID NO: 654316 - RNA, 12 nt, Homo sapiens
acugacuacugg

SEQ ID NO: 654317 - RNA, 17 nt, Homo sapiens
acugacugagcaggcug

SEQ ID NO: 654318 - RNA, 18 nt, Homo sapiens
acugacugagcaggcugu

SEQ ID NO: 654319 - RNA, 23 nt, Homo sapiens
acugacugggcgugguggcucau

SEQ ID NO: 654320 - RNA, 12 nt, Homo sapiens
acugacuuucuc

SEQ ID NO: 654321 - RNA, 17 nt, Homo sapiens
acugacuuucugauuac

SEQ ID NO: 654322 - RNA, 16 nt, Homo sapiens
acugagacuuaaggga

SEQ ID NO: 654323 - RNA, 21 nt, Homo sapiens
acugagagcccacugcaguua

SEQ ID NO: 654324 - RNA, 13 nt, Homo sapiens
acugagagcugcc

SEQ ID NO: 654325 - RNA, 14 nt, Homo sapiens
acugagaugcaaau

SEQ ID NO: 654326 - RNA, 15 nt, Homo sapiens
acugagauggaguga

SEQ ID NO: 654327 - RNA, 21 nt, Homo sapiens
acugagcaaugguaacugcac

SEQ ID NO: 654328 - RNA, 19 nt, Homo sapiens
acugagcaggcuguggggu

SEQ ID NO: 654329 - RNA, 16 nt, Homo sapiens
acugagcauuugcacc

SEQ ID NO: 654330 - RNA, 15 nt, Homo sapiens
acugagugugcucuu

SEQ ID NO: 654331 - RNA, 22 nt, Homo sapiens
acugaguuaaauuauacuggag

SEQ ID NO: 654332 - RNA, 19 nt, Homo sapiens
acugauagggguucaugcu

SEQ ID NO: 654333 - RNA, 14 nt, Homo sapiens
acugaucaauuuca

SEQ ID NO: 654334 - RNA, 23 nt, Homo sapiens
acugaucaauuucaacauggacu

SEQ ID NO: 654335 - RNA, 13 nt, Homo sapiens
acugaucacccaa

SEQ ID NO: 654336 - RNA, 19 nt, Homo sapiens
acugaucauccaggccuca

SEQ ID NO: 654337 - RNA, 12 nt, Homo sapiens
acugaugaaggc

SEQ ID NO: 654338 - RNA, 20 nt, Homo sapiens
acugauggaaaauaccagug

SEQ ID NO: 654339 - RNA, 12 nt, Homo sapiens
acugaugguuca

SEQ ID NO: 654340 - RNA, 19 nt, Homo sapiens
acugauguuacuagccucu

SEQ ID NO: 654341 - RNA, 14 nt, Homo sapiens
acugauguucaaua

SEQ ID NO: 654342 - RNA, 24 nt, Homo sapiens
acugauuccuuuaugaugacugcu

SEQ ID NO: 654343 - RNA, 22 nt, Homo sapiens
acugauuuaugaucacuuggaa

SEQ ID NO: 654344 - RNA, 17 nt, Homo sapiens
acugauuuuuagcuuua

SEQ ID NO: 654345 - RNA, 16 nt, Homo sapiens
acugcaaaaaaagccu

SEQ ID NO: 654346 - RNA, 20 nt, Homo sapiens
acugcaaaccauggugagaa

SEQ ID NO: 654347 - RNA, 14 nt, Homo sapiens
acugcaagcauuuu

SEQ ID NO: 654348 - RNA, 16 nt, Homo sapiens
acugcaagcucugccu

SEQ ID NO: 654349 - RNA, 15 nt, Homo sapiens
acugcacaaacaaua

SEQ ID NO: 654350 - RNA, 16 nt, Homo sapiens
acugcacagaagacag

SEQ ID NO: 654351 - RNA, 16 nt, Homo sapiens
acugcacaguagagca

SEQ ID NO: 654352 - RNA, 18 nt, Homo sapiens
acugcacagugcaucuca

SEQ ID NO: 654353 - RNA, 19 nt, Homo sapiens
acugcacuccagccuggca

SEQ ID NO: 654354 - RNA, 20 nt, Homo sapiens
acugcacucuagccugggug

SEQ ID NO: 654355 - RNA, 16 nt, Homo sapiens
acugcagacauucuca

SEQ ID NO: 654356 - RNA, 18 nt, Homo sapiens
acugcagagggacagaug

SEQ ID NO: 654357 - RNA, 21 nt, Homo sapiens
acugcagcucccgaagccuga

SEQ ID NO: 654358 - RNA, 20 nt, Homo sapiens
acugcagggacugccagucc

SEQ ID NO: 654359 - RNA, 22 nt, Homo sapiens
acugcagugcuguaaacuuaac

SEQ ID NO: 654360 - RNA, 22 nt, Homo sapiens
acugcauaaccuuuacacuccu

SEQ ID NO: 654361 - RNA, 12 nt, Homo sapiens
acugcauccuca

SEQ ID NO: 654362 - RNA, 16 nt, Homo sapiens
acugccacacucucca

SEQ ID NO: 654363 - RNA, 20 nt, Homo sapiens
acugccaggauaaagcuucc

SEQ ID NO: 654364 - RNA, 17 nt, Homo sapiens
acugccaggcuguuuca

SEQ ID NO: 654365 - RNA, 13 nt, Homo sapiens
acugccaucuuag

SEQ ID NO: 654366 - RNA, 22 nt, Homo sapiens
acugcccacaugggaccuggcc

SEQ ID NO: 654367 - RNA, 14 nt, Homo sapiens
acugcccaccaaag

SEQ ID NO: 654368 - RNA, 15 nt, Homo sapiens
acugcccaccaaagg

SEQ ID NO: 654369 - RNA, 15 nt, Homo sapiens
acugcccauggacag

SEQ ID NO: 654370 - RNA, 14 nt, Homo sapiens
acugcccccgccac

SEQ ID NO: 654371 - RNA, 22 nt, Homo sapiens
acugcccccugcugccaugugg

SEQ ID NO: 654372 - RNA, 21 nt, Homo sapiens
acugccccugcugugcugcuc

SEQ ID NO: 654373 - RNA, 16 nt, Homo sapiens
acugcccuggcagcag

SEQ ID NO: 654374 - RNA, 16 nt, Homo sapiens
acugcccuuccaggug

SEQ ID NO: 654375 - RNA, 15 nt, Homo sapiens
acugccgacaucccu

SEQ ID NO: 654376 - RNA, 17 nt, Homo sapiens
acugccguccucaggug

SEQ ID NO: 654377 - RNA, 13 nt, Homo sapiens
acugccucuggaa

SEQ ID NO: 654378 - RNA, 20 nt, Homo sapiens
acugccugugaaguggaugg

SEQ ID NO: 654379 - RNA, 18 nt, Homo sapiens
acugccuuccacaauuca

SEQ ID NO: 654380 - RNA, 21 nt, Homo sapiens
acugccuucgcuucuugccuc

SEQ ID NO: 654381 - RNA, 14 nt, Homo sapiens
acugcgacugugac

SEQ ID NO: 654382 - RNA, 16 nt, Homo sapiens
acugcgauaacugaga

SEQ ID NO: 654383 - RNA, 18 nt, Homo sapiens
acugcgaucuucagagca

SEQ ID NO: 654384 - RNA, 15 nt, Homo sapiens
acugcggaguccagg

SEQ ID NO: 654385 - RNA, 18 nt, Homo sapiens
acugcguuguccacaaga

SEQ ID NO: 654386 - RNA, 16 nt, Homo sapiens
acugcuaugccauuuc

SEQ ID NO: 654387 - RNA, 22 nt, Homo sapiens
acuuugcuaacugugcuccuca

SEQ ID NO: 654388 - RNA, 22 nt, Homo sapiens
acuuuggaaccagacucuugcc

SEQ ID NO: 654389 - RNA, 14 nt, Homo sapiens
acuuuggaaucuaa

SEQ ID NO: 654390 - RNA, 21 nt, Homo sapiens
acuuuggaguccccucaccuc

SEQ ID NO: 654391 - RNA, 22 nt, Homo sapiens
acuuugggcuuaguauuucuca

SEQ ID NO: 654392 - RNA, 13 nt, Homo sapiens
acuuuggggacag

SEQ ID NO: 654393 - RNA, 16 nt, Homo sapiens
acuuugguaguggaau

SEQ ID NO: 654394 - RNA, 21 nt, Homo sapiens
acuuugguaguggaauaguga

SEQ ID NO: 654395 - RNA, 22 nt, Homo sapiens
acuuugguggccacauaagcca

SEQ ID NO: 654396 - RNA, 14 nt, Homo sapiens
acuuuguacauuug

SEQ ID NO: 654397 - RNA, 23 nt, Homo sapiens
acuuuguauuuguucaguaugca

SEQ ID NO: 654398 - RNA, 22 nt, Homo sapiens
acuuugucuguacauacuggcc

SEQ ID NO: 654399 - RNA, 18 nt, Homo sapiens
acuuugugaauuaacaca

SEQ ID NO: 654400 - RNA, 19 nt, Homo sapiens
acuuuguggcaaucugugg

SEQ ID NO: 654401 - RNA, 17 nt, Homo sapiens
acuuuguguucauuuca

SEQ ID NO: 654402 - RNA, 16 nt, Homo sapiens
acuuuguugaguauua

SEQ ID NO: 654403 - RNA, 12 nt, Homo sapiens
acuuuuaaugaa

SEQ ID NO: 654404 - RNA, 14 nt, Homo sapiens
acuuuuaaugaacu

SEQ ID NO: 654405 - RNA, 21 nt, Homo sapiens
acuuuuacagaaugcauuaaa

SEQ ID NO: 654406 - RNA, 22 nt, Homo sapiens
acuuuuaguagagacaggguuu

SEQ ID NO: 654407 - RNA, 15 nt, Homo sapiens
acuuuucaccaauga

SEQ ID NO: 654408 - RNA, 16 nt, Homo sapiens
acuuuucaccaaugag

SEQ ID NO: 654409 - RNA, 16 nt, Homo sapiens
acuuuucccauucagc

SEQ ID NO: 654410 - RNA, 18 nt, Homo sapiens
acuuuucguuaacauuga

SEQ ID NO: 654411 - RNA, 21 nt, Homo sapiens
acuuuucuguucaucaccagu

SEQ ID NO: 654412 - RNA, 17 nt, Homo sapiens
acuuuugaaaagcuuuu

SEQ ID NO: 654413 - RNA, 21 nt, Homo sapiens
acuuuugaagucuucccucag

SEQ ID NO: 654414 - RNA, 17 nt, Homo sapiens
acuuuugcaugaaaaua

SEQ ID NO: 654415 - RNA, 17 nt, Homo sapiens
acuuuuggaaccaugcc

SEQ ID NO: 654416 - RNA, 20 nt, Homo sapiens
acuuuuguaaauuauugaug

SEQ ID NO: 654417 - RNA, 17 nt, Homo sapiens
acuuuuguggaccaaua

SEQ ID NO: 654418 - RNA, 22 nt, Homo sapiens
acuuuuguuauuaugcucuuaa

SEQ ID NO: 654419 - RNA, 22 nt, Homo sapiens
acuuuuguugaaauagcuuuac

SEQ ID NO: 654420 - RNA, 19 nt, Homo sapiens
acuuuuuaaaguguaagaa

SEQ ID NO: 654421 - RNA, 11 nt, Homo sapiens
acuuuuugccc

SEQ ID NO: 654422 - RNA, 16 nt, Homo sapiens
acuuuuuggucaugaa

SEQ ID NO: 654423 - RNA, 22 nt, Homo sapiens
acuuuuuuaaauuaagacaaaa

SEQ ID NO: 654424 - RNA, 15 nt, Homo sapiens
acuuuuuuacacuga

SEQ ID NO: 654425 - RNA, 18 nt, Homo sapiens
acuuuuuuuuaacacuuu

SEQ ID NO: 654426 - RNA, 22 nt, Homo sapiens
acuuuuuuuuaacacuuuggac

SEQ ID NO: 654427 - RNA, 16 nt, Homo sapiens
acuuuuuuuugacaua

SEQ ID NO: 654428 - RNA, 23 nt, Homo sapiens
agaaaaaaaaaaaaaaucacugu

SEQ ID NO: 654429 - RNA, 16 nt, Homo sapiens
agaaaaaaaaucuuau

SEQ ID NO: 654430 - RNA, 17 nt, Homo sapiens
agaaaaaaaauguaccc

SEQ ID NO: 654431 - RNA, 17 nt, Homo sapiens
agaaaaaaagagugaaa

SEQ ID NO: 654432 - RNA, 19 nt, Homo sapiens
agaaaaaaagagugaaaaa

SEQ ID NO: 654433 - RNA, 23 nt, Homo sapiens
agaaaaaaauucaugauacucau

SEQ ID NO: 654434 - RNA, 12 nt, Homo sapiens
agaaaaaagaga

SEQ ID NO: 654435 - RNA, 15 nt, Homo sapiens
agaaaaacaucccaa

SEQ ID NO: 654436 - RNA, 20 nt, Homo sapiens
agaaaaagaagugccuuuaa

SEQ ID NO: 654437 - RNA, 17 nt, Homo sapiens
agaaaaagcuagcacua

SEQ ID NO: 654438 - RNA, 20 nt, Homo sapiens
agaaaaaggacucugcuuca

SEQ ID NO: 654439 - RNA, 20 nt, Homo sapiens
agaaaaaggccgggugacac

SEQ ID NO: 654440 - RNA, 20 nt, Homo sapiens
agaaaaauaagcucgaguga

SEQ ID NO: 654441 - RNA, 15 nt, Homo sapiens
agaaaaauagcugug

SEQ ID NO: 654442 - RNA, 17 nt, Homo sapiens
agaaaaauauauacuaa

SEQ ID NO: 654443 - RNA, 20 nt, Homo sapiens
agaaaaauauauacuaaaca

SEQ ID NO: 654444 - RNA, 15 nt, Homo sapiens
agaaaaaugcugaau

SEQ ID NO: 654445 - RNA, 13 nt, Homo sapiens
agaaaaaugucau

SEQ ID NO: 654446 - RNA, 21 nt, Homo sapiens
agaaaacagcccccacuccag

SEQ ID NO: 654447 - RNA, 20 nt, Homo sapiens
agaaaaccgagaauauucaa

SEQ ID NO: 654448 - RNA, 19 nt, Homo sapiens
agaaaagcccaaguucaug

SEQ ID NO: 654449 - RNA, 13 nt, Homo sapiens
agaaaagcccauu

SEQ ID NO: 654450 - RNA, 11 nt, Homo sapiens
agaaaagcuau

SEQ ID NO: 654451 - RNA, 15 nt, Homo sapiens
agaaaagcugaugag

SEQ ID NO: 654452 - RNA, 19 nt, Homo sapiens
agaaaaggacaaauaucuu

SEQ ID NO: 654453 - RNA, 18 nt, Homo sapiens
agaaaaguaauuuuguca

SEQ ID NO: 654454 - RNA, 21 nt, Homo sapiens
agaaaaguagguuuacauuca

SEQ ID NO: 654455 - RNA, 21 nt, Homo sapiens
agaaaagugcauauuuaucca

SEQ ID NO: 654456 - RNA, 18 nt, Homo sapiens
agaaaagugggccagugu

SEQ ID NO: 654457 - RNA, 18 nt, Homo sapiens
agaaaaguugggcuuuca

SEQ ID NO: 654458 - RNA, 15 nt, Homo sapiens
agaaaauaauuaauu

SEQ ID NO: 654459 - RNA, 12 nt, Homo sapiens
agaaaauaucuu

SEQ ID NO: 654460 - RNA, 23 nt, Homo sapiens
agaaaaugacuuauuucugcucu

SEQ ID NO: 654461 - RNA, 21 nt, Homo sapiens
agaaaauguuacuucucucau

SEQ ID NO: 654462 - RNA, 18 nt, Homo sapiens
agaaaauucaagcauuua

SEQ ID NO: 654463 - RNA, 22 nt, Homo sapiens
agaaaauuggaacucuacucaa

SEQ ID NO: 654464 - RNA, 19 nt, Homo sapiens
agaaacaaaauccucagga

SEQ ID NO: 654465 - RNA, 23 nt, Homo sapiens
agaaacaaccguuggaaacauaa

SEQ ID NO: 654466 - RNA, 21 nt, Homo sapiens
agaaacaccacccauuucuac

SEQ ID NO: 654467 - RNA, 19 nt, Homo sapiens
agaaacacucuuauuccca

SEQ ID NO: 654468 - RNA, 21 nt, Homo sapiens
agaaacacugacuccugugga

SEQ ID NO: 654469 - RNA, 14 nt, Homo sapiens
agaaacagcuuuca

SEQ ID NO: 654470 - RNA, 19 nt, Homo sapiens
agaaacaguugguaacuuu

SEQ ID NO: 654471 - RNA, 13 nt, Homo sapiens
agaaaccaagcca

SEQ ID NO: 654472 - RNA, 19 nt, Homo sapiens
agaaaccagaaaagcaaua

SEQ ID NO: 654473 - RNA, 12 nt, Homo sapiens
agaaacccaagu

SEQ ID NO: 654474 - RNA, 23 nt, Homo sapiens
agaaaccuggggugaauacuuau

SEQ ID NO: 654475 - RNA, 22 nt, Homo sapiens
agaaacgucuauguguacagau

SEQ ID NO: 654476 - RNA, 11 nt, Homo sapiens
agaaacuacug

SEQ ID NO: 654477 - RNA, 21 nt, Homo sapiens
agaaacuagaaaugugaauga

SEQ ID NO: 654478 - RNA, 17 nt, Homo sapiens
agaaacuagcagauuug

SEQ ID NO: 654479 - RNA, 21 nt, Homo sapiens
agaaacuccuguuucuccuua

SEQ ID NO: 654480 - RNA, 21 nt, Homo sapiens
agaaacuuauucgcaauagac

SEQ ID NO: 654481 - RNA, 14 nt, Homo sapiens
agaaacuuuccauc

SEQ ID NO: 654482 - RNA, 14 nt, Homo sapiens
agaaagaaagggaa

SEQ ID NO: 654483 - RNA, 15 nt, Homo sapiens
agaaagaaugcaaga

SEQ ID NO: 654484 - RNA, 22 nt, Homo sapiens
agaaagacuugguugguagggu

SEQ ID NO: 654485 - RNA, 16 nt, Homo sapiens
agaaagaugacaaaag

SEQ ID NO: 654486 - RNA, 23 nt, Homo sapiens
agaaagcacgugucucagacugc

SEQ ID NO: 654487 - RNA, 13 nt, Homo sapiens
agaaagcacugac

SEQ ID NO: 654488 - RNA, 21 nt, Homo sapiens
agaaagcauccuaaauauauc

SEQ ID NO: 654489 - RNA, 14 nt, Homo sapiens
agaaagcaugauau

SEQ ID NO: 654490 - RNA, 18 nt, Homo sapiens
agaaagccagacaacuuc

SEQ ID NO: 654491 - RNA, 19 nt, Homo sapiens
agaaagccuucauaagccu

SEQ ID NO: 654492 - RNA, 13 nt, Homo sapiens
agaaagcuacaga

SEQ ID NO: 654493 - RNA, 19 nt, Homo sapiens
agaaagcuagauaugccuu

SEQ ID NO: 654494 - RNA, 20 nt, Homo sapiens
agaaagcucauggcuguguc

SEQ ID NO: 654495 - RNA, 17 nt, Homo sapiens
agaaagggaaacuggcu

SEQ ID NO: 654496 - RNA, 20 nt, Homo sapiens
agaaagucauagauuucuga

SEQ ID NO: 654497 - RNA, 20 nt, Homo sapiens
agaaaguguuuaacuuguca

SEQ ID NO: 654498 - RNA, 17 nt, Homo sapiens
agaaaguuccaaauguu

SEQ ID NO: 654499 - RNA, 23 nt, Homo sapiens
agaaauaacagaagaaaauagaa

SEQ ID NO: 654500 - RNA, 12 nt, Homo sapiens
agaaauaagccc

SEQ ID NO: 654501 - RNA, 13 nt, Homo sapiens
agaaauacuugug

SEQ ID NO: 654502 - RNA, 17 nt, Homo sapiens
agaaauacuuucaggca

SEQ ID NO: 654503 - RNA, 19 nt, Homo sapiens
agaaauaucugaaaaugua

SEQ ID NO: 654504 - RNA, 14 nt, Homo sapiens
agaaauauuccaaa

SEQ ID NO: 654505 - RNA, 18 nt, Homo sapiens
agaaauauuugugacaaa

SEQ ID NO: 654506 - RNA, 19 nt, Homo sapiens
agaaaucaauaguugaauu

SEQ ID NO: 654507 - RNA, 14 nt, Homo sapiens
agaaaucagccaug

SEQ ID NO: 654508 - RNA, 14 nt, Homo sapiens
agacuaugauuuac

SEQ ID NO: 654509 - RNA, 20 nt, Homo sapiens
agacuauggccucgccuccc

SEQ ID NO: 654510 - RNA, 16 nt, Homo sapiens
agacuauucuaaugaa

SEQ ID NO: 654511 - RNA, 14 nt, Homo sapiens
agacuauuugccau

SEQ ID NO: 654512 - RNA, 14 nt, Homo sapiens
agacucaagacuua

SEQ ID NO: 654513 - RNA, 18 nt, Homo sapiens
agacucaagacuuaugga

SEQ ID NO: 654514 - RNA, 16 nt, Homo sapiens
agacucagccaagaca

SEQ ID NO: 654515 - RNA, 18 nt, Homo sapiens
agacucagcuccagaaua

SEQ ID NO: 654516 - RNA, 16 nt, Homo sapiens
agacucagcucugaca

SEQ ID NO: 654517 - RNA, 19 nt, Homo sapiens
agacucagguuccagaaca

SEQ ID NO: 654518 - RNA, 17 nt, Homo sapiens
agacucaucuuacugua

SEQ ID NO: 654519 - RNA, 14 nt, Homo sapiens
agacucauggauug

SEQ ID NO: 654520 - RNA, 15 nt, Homo sapiens
agacucauucuucac

SEQ ID NO: 654521 - RNA, 17 nt, Homo sapiens
agacuccaaaaggcccu

SEQ ID NO: 654522 - RNA, 14 nt, Homo sapiens
agacuccaccucaa

SEQ ID NO: 654523 - RNA, 15 nt, Homo sapiens
agacuccggccugua

SEQ ID NO: 654524 - RNA, 18 nt, Homo sapiens
agacuccgucucaaaaga

SEQ ID NO: 654525 - RNA, 17 nt, Homo sapiens
agacuccucaucaugau

SEQ ID NO: 654526 - RNA, 17 nt, Homo sapiens
agacucgcuagucagua

SEQ ID NO: 654527 - RNA, 12 nt, Homo sapiens
agacucugaccu

SEQ ID NO: 654528 - RNA, 16 nt, Homo sapiens
agacucugccauuaaa

SEQ ID NO: 654529 - RNA, 19 nt, Homo sapiens
agacucuguaauugaauau

SEQ ID NO: 654530 - RNA, 22 nt, Homo sapiens
agacucuugaagacaacucuga

SEQ ID NO: 654531 - RNA, 23 nt, Homo sapiens
agacucuuuuuuugagugacagc

SEQ ID NO: 654532 - RNA, 14 nt, Homo sapiens
agacugaacauguu

SEQ ID NO: 654533 - RNA, 14 nt, Homo sapiens
agacugaagaaagu

SEQ ID NO: 654534 - RNA, 17 nt, Homo sapiens
agacugaagacugcaca

SEQ ID NO: 654535 - RNA, 17 nt, Homo sapiens
agacugaagauggcuuu

SEQ ID NO: 654536 - RNA, 19 nt, Homo sapiens
agacugacacuacuaaagc

SEQ ID NO: 654537 - RNA, 13 nt, Homo sapiens
agacugagcucuc

SEQ ID NO: 654538 - RNA, 21 nt, Homo sapiens
agacugaucauccaggccuca

SEQ ID NO: 654539 - RNA, 18 nt, Homo sapiens
agacugcagcugcugaag

SEQ ID NO: 654540 - RNA, 22 nt, Homo sapiens
agacugcauguaccauuugcau

SEQ ID NO: 654541 - RNA, 17 nt, Homo sapiens
agacugcuacagugcau

SEQ ID NO: 654542 - RNA, 16 nt, Homo sapiens
agacuggaaaagugau

SEQ ID NO: 654543 - RNA, 20 nt, Homo sapiens
agacuggcaauaaacuccua

SEQ ID NO: 654544 - RNA, 21 nt, Homo sapiens
agacugggacuauggcuuauu

SEQ ID NO: 654545 - RNA, 16 nt, Homo sapiens
agacugggcugaggga

SEQ ID NO: 654546 - RNA, 20 nt, Homo sapiens
agacugggucucgcuuuguu

SEQ ID NO: 654547 - RNA, 17 nt, Homo sapiens
agacugguuuucugcca

SEQ ID NO: 654548 - RNA, 14 nt, Homo sapiens
agacuguacuggcc

SEQ ID NO: 654549 - RNA, 22 nt, Homo sapiens
agacuguacuggccagugucau

SEQ ID NO: 654550 - RNA, 20 nt, Homo sapiens
agacugucagaaaaagcuag

SEQ ID NO: 654551 - RNA, 15 nt, Homo sapiens
agacugucaggaagu

SEQ ID NO: 654552 - RNA, 19 nt, Homo sapiens
agacugucucaagagggca

SEQ ID NO: 654553 - RNA, 20 nt, Homo sapiens
agacuguggcuagugacaaa

SEQ ID NO: 654554 - RNA, 14 nt, Homo sapiens
agacuguggcucaa

SEQ ID NO: 654555 - RNA, 18 nt, Homo sapiens
agacuguugccacuuaac

SEQ ID NO: 654556 - RNA, 19 nt, Homo sapiens
agacuuaagcccagugcac

SEQ ID NO: 654557 - RNA, 12 nt, Homo sapiens
agacuuacugca

SEQ ID NO: 654558 - RNA, 16 nt, Homo sapiens
agacuucaccuaacua

SEQ ID NO: 654559 - RNA, 13 nt, Homo sapiens
agacuucuuggcu

SEQ ID NO: 654560 - RNA, 18 nt, Homo sapiens
agacuugaaaccagaaga

SEQ ID NO: 654561 - RNA, 18 nt, Homo sapiens
agacuugaaauacuacuu

SEQ ID NO: 654562 - RNA, 15 nt, Homo sapiens
agacuugacagugga

SEQ ID NO: 654563 - RNA, 23 nt, Homo sapiens
agacuugagcuugaccuaaggau

SEQ ID NO: 654564 - RNA, 18 nt, Homo sapiens
agacuuggacaucucucu

SEQ ID NO: 654565 - RNA, 20 nt, Homo sapiens
agacuugggaaacuauucau

SEQ ID NO: 654566 - RNA, 13 nt, Homo sapiens
agacuugggaugg

SEQ ID NO: 654567 - RNA, 14 nt, Homo sapiens
agacuugguuucaa

SEQ ID NO: 654568 - RNA, 17 nt, Homo sapiens
agacuuuaaaccaccua

SEQ ID NO: 654569 - RNA, 16 nt, Homo sapiens
agacuuuccauuacaa

SEQ ID NO: 654570 - RNA, 13 nt, Homo sapiens
agacuuugcccag

SEQ ID NO: 654571 - RNA, 19 nt, Homo sapiens
agacuuuguauauuuguua

SEQ ID NO: 654572 - RNA, 19 nt, Homo sapiens
agacuuuugacacuuuuaa

SEQ ID NO: 654573 - RNA, 19 nt, Homo sapiens
agacuuuuuuuuaacacuu

SEQ ID NO: 654574 - RNA, 15 nt, Homo sapiens
agagaaaaacuaacu

SEQ ID NO: 654575 - RNA, 15 nt, Homo sapiens
agagaaaagacauaa

SEQ ID NO: 654576 - RNA, 18 nt, Homo sapiens
agagaaagaaguaggcau

SEQ ID NO: 654577 - RNA, 18 nt, Homo sapiens
agagaaaggguaauuucc

SEQ ID NO: 654578 - RNA, 20 nt, Homo sapiens
agagaaaguuucagauuugc

SEQ ID NO: 654579 - RNA, 14 nt, Homo sapiens
agagaaauuugcca

SEQ ID NO: 654580 - RNA, 14 nt, Homo sapiens
agagaacaacuacu

SEQ ID NO: 654581 - RNA, 18 nt, Homo sapiens
agagaacaaucacuauuc

SEQ ID NO: 654582 - RNA, 22 nt, Homo sapiens
agagaacaaugugcuaugugaa

SEQ ID NO: 654583 - RNA, 23 nt, Homo sapiens
agagaacaguuuuacaauagaca

SEQ ID NO: 654584 - RNA, 17 nt, Homo sapiens
agagaaccgagcaaaga

SEQ ID NO: 654585 - RNA, 16 nt, Homo sapiens
agagaaccucagauca

SEQ ID NO: 654586 - RNA, 19 nt, Homo sapiens
agagaacuaaagcuggaga

SEQ ID NO: 654587 - RNA, 14 nt, Homo sapiens
agagaacucuuuca

SEQ ID NO: 654588 - RNA, 17 nt, Homo sapiens
agagaagaccuagcuau

SEQ ID NO: 654589 - RNA, 18 nt, Homo sapiens
agagaagcaaguaaaaag

SEQ ID NO: 654590 - RNA, 18 nt, Homo sapiens
agagaagcugccauccac

SEQ ID NO: 654591 - RNA, 22 nt, Homo sapiens
agagaaggcugugagccaagga

SEQ ID NO: 654592 - RNA, 22 nt, Homo sapiens
agagaaguaaaacaugcugaaa

SEQ ID NO: 654593 - RNA, 14 nt, Homo sapiens
agagaauauacaug

SEQ ID NO: 654594 - RNA, 17 nt, Homo sapiens
agagaaucaacagauga

SEQ ID NO: 654595 - RNA, 22 nt, Homo sapiens
agagaaugagaagaggcugcug

SEQ ID NO: 654596 - RNA, 15 nt, Homo sapiens
agagaaugugcucau

SEQ ID NO: 654597 - RNA, 14 nt, Homo sapiens
agagaauucaugug

SEQ ID NO: 654598 - RNA, 15 nt, Homo sapiens
agagaauuggcucaa

SEQ ID NO: 654599 - RNA, 19 nt, Homo sapiens
agagacagauaacucuccu

SEQ ID NO: 654600 - RNA, 17 nt, Homo sapiens
agagacagauaccucca

SEQ ID NO: 654601 - RNA, 21 nt, Homo sapiens
agagacagcucuucuacuacc

SEQ ID NO: 654602 - RNA, 12 nt, Homo sapiens
agagacaucaaa

SEQ ID NO: 654603 - RNA, 17 nt, Homo sapiens
agagaccacacauuuua

SEQ ID NO: 654604 - RNA, 16 nt, Homo sapiens
agagacccaagcugcc

SEQ ID NO: 654605 - RNA, 17 nt, Homo sapiens
agagaccccaggaacaa

SEQ ID NO: 654606 - RNA, 18 nt, Homo sapiens
agagaccccaggaacaau

SEQ ID NO: 654607 - RNA, 21 nt, Homo sapiens
agagaccugacccuucucuca

SEQ ID NO: 654608 - RNA, 14 nt, Homo sapiens
agagaccuuggcug

SEQ ID NO: 654609 - RNA, 18 nt, Homo sapiens
agagacgguguuuugcca

SEQ ID NO: 654610 - RNA, 19 nt, Homo sapiens
agagacgguguuuugccau

SEQ ID NO: 654611 - RNA, 18 nt, Homo sapiens
agagacuaucugauuucc

SEQ ID NO: 654612 - RNA, 19 nt, Homo sapiens
agagacucagaugaggaca

SEQ ID NO: 654613 - RNA, 14 nt, Homo sapiens
agagacucauuuca

SEQ ID NO: 654614 - RNA, 16 nt, Homo sapiens
agagacugucccugaa

SEQ ID NO: 654615 - RNA, 11 nt, Homo sapiens
agagacuucac

SEQ ID NO: 654616 - RNA, 20 nt, Homo sapiens
agagagaaccaccacugccu

SEQ ID NO: 654617 - RNA, 19 nt, Homo sapiens
agagagcaacucugagauc

SEQ ID NO: 654618 - RNA, 21 nt, Homo sapiens
agagagcagcuucagugacaa

SEQ ID NO: 654619 - RNA, 22 nt, Homo sapiens
agagagcagcuucagugacaaa

SEQ ID NO: 654620 - RNA, 15 nt, Homo sapiens
agagagcaucugcaa

SEQ ID NO: 654621 - RNA, 19 nt, Homo sapiens
agagagccuggugcugcug

SEQ ID NO: 654622 - RNA, 19 nt, Homo sapiens
agagagcuagagggacaaa

SEQ ID NO: 654623 - RNA, 13 nt, Homo sapiens
agagagcugccau

SEQ ID NO: 654624 - RNA, 14 nt, Homo sapiens
agagaggaugugca

SEQ ID NO: 654625 - RNA, 19 nt, Homo sapiens
agagagguuuuucuuggga

SEQ ID NO: 654626 - RNA, 16 nt, Homo sapiens
agagagucgcaucuca

SEQ ID NO: 654627 - RNA, 15 nt, Homo sapiens
agagaguuugccacu

SEQ ID NO: 654628 - RNA, 12 nt, Homo sapiens
agagauacagua

SEQ ID NO: 654629 - RNA, 17 nt, Homo sapiens
agagauacuuacauuuc

SEQ ID NO: 654630 - RNA, 14 nt, Homo sapiens
aggagcucacugug

SEQ ID NO: 654631 - RNA, 15 nt, Homo sapiens
aggagcucugcgcca

SEQ ID NO: 654632 - RNA, 19 nt, Homo sapiens
aggagcugauuuccaggcc

SEQ ID NO: 654633 - RNA, 15 nt, Homo sapiens
aggagcugccauguc

SEQ ID NO: 654634 - RNA, 16 nt, Homo sapiens
aggagcugccauguca

SEQ ID NO: 654635 - RNA, 18 nt, Homo sapiens
aggagcuuuggaccuaau

SEQ ID NO: 654636 - RNA, 20 nt, Homo sapiens
aggaggaggcugcccugagg

SEQ ID NO: 654637 - RNA, 18 nt, Homo sapiens
aggaggagggaggccagg

SEQ ID NO: 654638 - RNA, 22 nt, Homo sapiens
aggaggcaaagguucuaucugc

SEQ ID NO: 654639 - RNA, 20 nt, Homo sapiens
aggaggcagagguugcagug

SEQ ID NO: 654640 - RNA, 21 nt, Homo sapiens
aggaggccgcuuagugcugcu

SEQ ID NO: 654641 - RNA, 19 nt, Homo sapiens
aggaggcugcaugcucugg

SEQ ID NO: 654642 - RNA, 17 nt, Homo sapiens
aggaggcugcccugagg

SEQ ID NO: 654643 - RNA, 19 nt, Homo sapiens
aggaggcugcccugagggg

SEQ ID NO: 654644 - RNA, 17 nt, Homo sapiens
aggaggcuggcagguau

SEQ ID NO: 654645 - RNA, 20 nt, Homo sapiens
aggaggcuuuaagcuccagc

SEQ ID NO: 654646 - RNA, 20 nt, Homo sapiens
aggagggacaugauggggaa

SEQ ID NO: 654647 - RNA, 16 nt, Homo sapiens
aggagggcccuaccug

SEQ ID NO: 654648 - RNA, 23 nt, Homo sapiens
aggagggcgugacucacccaagc

SEQ ID NO: 654649 - RNA, 22 nt, Homo sapiens
aggaggggaggaacacugcacu

SEQ ID NO: 654650 - RNA, 12 nt, Homo sapiens
aggaggggccag

SEQ ID NO: 654651 - RNA, 19 nt, Homo sapiens
aggaggggugaguccccua

SEQ ID NO: 654652 - RNA, 19 nt, Homo sapiens
aggagggguuaaagcugcc

SEQ ID NO: 654653 - RNA, 21 nt, Homo sapiens
aggagggucccgguguauccu

SEQ ID NO: 654654 - RNA, 14 nt, Homo sapiens
aggagggugugagu

SEQ ID NO: 654655 - RNA, 13 nt, Homo sapiens
aggagguggcuuc

SEQ ID NO: 654656 - RNA, 19 nt, Homo sapiens
aggagguucacugagcucc

SEQ ID NO: 654657 - RNA, 12 nt, Homo sapiens
aggagguucugg

SEQ ID NO: 654658 - RNA, 14 nt, Homo sapiens
aggagguuugcagg

SEQ ID NO: 654659 - RNA, 19 nt, Homo sapiens
aggagguuuggggucugcc

SEQ ID NO: 654660 - RNA, 22 nt, Homo sapiens
aggagguuuggggucugccacc

SEQ ID NO: 654661 - RNA, 18 nt, Homo sapiens
aggaguaguugauaaauu

SEQ ID NO: 654662 - RNA, 16 nt, Homo sapiens
aggagucaaaacuaca

SEQ ID NO: 654663 - RNA, 14 nt, Homo sapiens
aggagucugugcag

SEQ ID NO: 654664 - RNA, 15 nt, Homo sapiens
aggagugacaugaag

SEQ ID NO: 654665 - RNA, 17 nt, Homo sapiens
aggaguggcagcugucc

SEQ ID NO: 654666 - RNA, 20 nt, Homo sapiens
aggaguggugggugcagucc

SEQ ID NO: 654667 - RNA, 23 nt, Homo sapiens
aggagugugugacauuccagggg

SEQ ID NO: 654668 - RNA, 23 nt, Homo sapiens
aggaguuaccuuaaacuguguaa

SEQ ID NO: 654669 - RNA, 21 nt, Homo sapiens
aggaguucgagaccaaccuag

SEQ ID NO: 654670 - RNA, 22 nt, Homo sapiens
aggaguucucaucccucuguca

SEQ ID NO: 654671 - RNA, 22 nt, Homo sapiens
aggaguugugagcccucuaggg

SEQ ID NO: 654672 - RNA, 13 nt, Homo sapiens
aggaguuuugcaa

SEQ ID NO: 654673 - RNA, 16 nt, Homo sapiens
aggauaaaaagccagg

SEQ ID NO: 654674 - RNA, 14 nt, Homo sapiens
aggauaaagccacu

SEQ ID NO: 654675 - RNA, 18 nt, Homo sapiens
aggauaaccuugugccuu

SEQ ID NO: 654676 - RNA, 13 nt, Homo sapiens
aggauaagccacu

SEQ ID NO: 654677 - RNA, 13 nt, Homo sapiens
aggauacccagau

SEQ ID NO: 654678 - RNA, 15 nt, Homo sapiens
aggauauaaugugug

SEQ ID NO: 654679 - RNA, 13 nt, Homo sapiens
aggauaugcagua

SEQ ID NO: 654680 - RNA, 20 nt, Homo sapiens
aggauauugggucucagccc

SEQ ID NO: 654681 - RNA, 14 nt, Homo sapiens
aggauauugucagu

SEQ ID NO: 654682 - RNA, 16 nt, Homo sapiens
aggauauuuucuucca

SEQ ID NO: 654683 - RNA, 17 nt, Homo sapiens
aggauauuuucuuccaa

SEQ ID NO: 654684 - RNA, 16 nt, Homo sapiens
aggaucaggcugcugg

SEQ ID NO: 654685 - RNA, 19 nt, Homo sapiens
aggaucaguugaggccagg

SEQ ID NO: 654686 - RNA, 17 nt, Homo sapiens
aggauccccccaugccc

SEQ ID NO: 654687 - RNA, 16 nt, Homo sapiens
aggaucccuacugcca

SEQ ID NO: 654688 - RNA, 22 nt, Homo sapiens
aggaucccuacugccaaccugg

SEQ ID NO: 654689 - RNA, 14 nt, Homo sapiens
aggaucuguacaau

SEQ ID NO: 654690 - RNA, 19 nt, Homo sapiens
aggaucuugccugcaugaa

SEQ ID NO: 654691 - RNA, 13 nt, Homo sapiens
aggaugacaguga

SEQ ID NO: 654692 - RNA, 17 nt, Homo sapiens
aggaugacaugugccau

SEQ ID NO: 654693 - RNA, 12 nt, Homo sapiens
aggaugagcugg

SEQ ID NO: 654694 - RNA, 22 nt, Homo sapiens
aggaugagggaauccugucacc

SEQ ID NO: 654695 - RNA, 23 nt, Homo sapiens
aggaugaggugguggaguggagu

SEQ ID NO: 654696 - RNA, 15 nt, Homo sapiens
aggaugaugccaguu

SEQ ID NO: 654697 - RNA, 17 nt, Homo sapiens
aggaugcagcacugcgc

SEQ ID NO: 654698 - RNA, 20 nt, Homo sapiens
aggaugccacgcacuuccuc

SEQ ID NO: 654699 - RNA, 13 nt, Homo sapiens
aggaugcugucaa

SEQ ID NO: 654700 - RNA, 21 nt, Homo sapiens
aggauggcuugcgcucaggag

SEQ ID NO: 654701 - RNA, 20 nt, Homo sapiens
aggauggggugucuguguua

SEQ ID NO: 654702 - RNA, 19 nt, Homo sapiens
aggaugguccagaauucac

SEQ ID NO: 654703 - RNA, 19 nt, Homo sapiens
aggauguagagaaacuggu

SEQ ID NO: 654704 - RNA, 14 nt, Homo sapiens
aggauguaguucug

SEQ ID NO: 654705 - RNA, 13 nt, Homo sapiens
aggaugugcaagc

SEQ ID NO: 654706 - RNA, 21 nt, Homo sapiens
aggauguggaagagcauuagc

SEQ ID NO: 654707 - RNA, 13 nt, Homo sapiens
aggauguggagcu

SEQ ID NO: 654708 - RNA, 11 nt, Homo sapiens
aggauguugcc

SEQ ID NO: 654709 - RNA, 21 nt, Homo sapiens
aggauuuucacauucuuggcu

SEQ ID NO: 654710 - RNA, 14 nt, Homo sapiens
aggcaaaauugcaa

SEQ ID NO: 654711 - RNA, 19 nt, Homo sapiens
aggcaaacugcaaaccaug

SEQ ID NO: 654712 - RNA, 15 nt, Homo sapiens
aggcaaagguucuau

SEQ ID NO: 654713 - RNA, 19 nt, Homo sapiens
aggcaaagugcugcuggaa

SEQ ID NO: 654714 - RNA, 17 nt, Homo sapiens
aggcaaaguuuacagau

SEQ ID NO: 654715 - RNA, 14 nt, Homo sapiens
aggcaacauccaaa

SEQ ID NO: 654716 - RNA, 21 nt, Homo sapiens
aggcaacugugaguccgggaa

SEQ ID NO: 654717 - RNA, 13 nt, Homo sapiens
aggcaagcagcug

SEQ ID NO: 654718 - RNA, 17 nt, Homo sapiens
aggcaagccccucagcc

SEQ ID NO: 654719 - RNA, 16 nt, Homo sapiens
aggcaaggggcauuuc

SEQ ID NO: 654720 - RNA, 23 nt, Homo sapiens
aggcaauaauaagugaugugcug

SEQ ID NO: 654721 - RNA, 14 nt, Homo sapiens
aggcaauccuaccu

SEQ ID NO: 654722 - RNA, 15 nt, Homo sapiens
aggcaauccuaccuu

SEQ ID NO: 654723 - RNA, 19 nt, Homo sapiens
aggcacacaccaccacgcc

SEQ ID NO: 654724 - RNA, 15 nt, Homo sapiens
aggcacacuuugcac

SEQ ID NO: 654725 - RNA, 17 nt, Homo sapiens
aggcacaggcuguugaa

SEQ ID NO: 654726 - RNA, 19 nt, Homo sapiens
aggcacccgccaccaugcc

SEQ ID NO: 654727 - RNA, 19 nt, Homo sapiens
aggcaccugcuggaaacca

SEQ ID NO: 654728 - RNA, 15 nt, Homo sapiens
aggcaccugugguga

SEQ ID NO: 654729 - RNA, 20 nt, Homo sapiens
aggcacugcccuuuucagga

SEQ ID NO: 654730 - RNA, 16 nt, Homo sapiens
aggcacugguggcauc

SEQ ID NO: 654731 - RNA, 12 nt, Homo sapiens
aggcacugucag

SEQ ID NO: 654732 - RNA, 20 nt, Homo sapiens
aggcagagaaucauacuuag

SEQ ID NO: 654733 - RNA, 21 nt, Homo sapiens
aggcagagauagaaccuggag

SEQ ID NO: 654734 - RNA, 18 nt, Homo sapiens
aggcagagguugcagugu

SEQ ID NO: 654735 - RNA, 12 nt, Homo sapiens
aggcagaucugu

SEQ ID NO: 654736 - RNA, 15 nt, Homo sapiens
aggcagcagagcauu

SEQ ID NO: 654737 - RNA, 15 nt, Homo sapiens
aggcagccaguguga

SEQ ID NO: 654738 - RNA, 16 nt, Homo sapiens
aggcagcccccuccac

SEQ ID NO: 654739 - RNA, 16 nt, Homo sapiens
aggcagccuugaccac

SEQ ID NO: 654740 - RNA, 21 nt, Homo sapiens
aggcagcuaucugcacucuaa

SEQ ID NO: 654741 - RNA, 12 nt, Homo sapiens
aggcagcucaag

SEQ ID NO: 654742 - RNA, 15 nt, Homo sapiens
aggcagcugagacca

SEQ ID NO: 654743 - RNA, 20 nt, Homo sapiens
aggcagcugccucugcuccc

SEQ ID NO: 654744 - RNA, 15 nt, Homo sapiens
aggcaggaacauaca

SEQ ID NO: 654745 - RNA, 20 nt, Homo sapiens
aggcaggagaaucacucgaa

SEQ ID NO: 654746 - RNA, 17 nt, Homo sapiens
aggcaggagaaucucuu

SEQ ID NO: 654747 - RNA, 20 nt, Homo sapiens
aggcaggagaaucucuugaa

SEQ ID NO: 654748 - RNA, 15 nt, Homo sapiens
aggcaggaggaucac

SEQ ID NO: 654749 - RNA, 20 nt, Homo sapiens
aggcaggaggaucacuugag

SEQ ID NO: 654750 - RNA, 15 nt, Homo sapiens
aggcaggaguggcag

SEQ ID NO: 654751 - RNA, 15 nt, Homo sapiens
aggcaggcacugugg

SEQ ID NO: 654752 - RNA, 15 nt, Homo sapiens
agguaguacugggaa

SEQ ID NO: 654753 - RNA, 17 nt, Homo sapiens
agguauacuuuaguaga

SEQ ID NO: 654754 - RNA, 20 nt, Homo sapiens
agguaucaguuauaugauau

SEQ ID NO: 654755 - RNA, 20 nt, Homo sapiens
agguauggcagaggugcaag

SEQ ID NO: 654756 - RNA, 16 nt, Homo sapiens
agguauggccaugccc

SEQ ID NO: 654757 - RNA, 16 nt, Homo sapiens
agguaugugucagcca

SEQ ID NO: 654758 - RNA, 18 nt, Homo sapiens
agguauucaauacuguag

SEQ ID NO: 654759 - RNA, 18 nt, Homo sapiens
aggucacauugugccuuu

SEQ ID NO: 654760 - RNA, 15 nt, Homo sapiens
aggucacguguggaa

SEQ ID NO: 654761 - RNA, 16 nt, Homo sapiens
aggucacguguggaau

SEQ ID NO: 654762 - RNA, 12 nt, Homo sapiens
aggucacuccug

SEQ ID NO: 654763 - RNA, 16 nt, Homo sapiens
aggucacugucacugc

SEQ ID NO: 654764 - RNA, 20 nt, Homo sapiens
aggucagcagccucccugaa

SEQ ID NO: 654765 - RNA, 21 nt, Homo sapiens
aggucaggacggcuccucaga

SEQ ID NO: 654766 - RNA, 15 nt, Homo sapiens
aggucaggaugcaca

SEQ ID NO: 654767 - RNA, 14 nt, Homo sapiens
aggucagguguuca

SEQ ID NO: 654768 - RNA, 17 nt, Homo sapiens
aggucaguaaugcugca

SEQ ID NO: 654769 - RNA, 18 nt, Homo sapiens
aggucaguuuagcaagaa

SEQ ID NO: 654770 - RNA, 22 nt, Homo sapiens
aggucauauauuuuuugcuacu

SEQ ID NO: 654771 - RNA, 23 nt, Homo sapiens
aggucaucaaacauuugccaagu

SEQ ID NO: 654772 - RNA, 22 nt, Homo sapiens
aggucaucaugaaagguuaaaa

SEQ ID NO: 654773 - RNA, 15 nt, Homo sapiens
aggucauccaaagaa

SEQ ID NO: 654774 - RNA, 23 nt, Homo sapiens
aggucauccaaagaacaucugca

SEQ ID NO: 654775 - RNA, 19 nt, Homo sapiens
aggucaugccacugcacuc

SEQ ID NO: 654776 - RNA, 21 nt, Homo sapiens
aggucaugccacugcacucua

SEQ ID NO: 654777 - RNA, 12 nt, Homo sapiens
agguccacagac

SEQ ID NO: 654778 - RNA, 20 nt, Homo sapiens
agguccaggccagugggccu

SEQ ID NO: 654779 - RNA, 11 nt, Homo sapiens
agguccauuua

SEQ ID NO: 654780 - RNA, 20 nt, Homo sapiens
aggucccggcuccugugcug

SEQ ID NO: 654781 - RNA, 13 nt, Homo sapiens
aggucccugacau

SEQ ID NO: 654782 - RNA, 13 nt, Homo sapiens
agguccucuacuu

SEQ ID NO: 654783 - RNA, 21 nt, Homo sapiens
agguccuuaggccucugagaa

SEQ ID NO: 654784 - RNA, 21 nt, Homo sapiens
agguccuuguuguuucuugcc

SEQ ID NO: 654785 - RNA, 14 nt, Homo sapiens
aggucuaaugauau

SEQ ID NO: 654786 - RNA, 23 nt, Homo sapiens
aggucuauuuaaaaaaaaaguca

SEQ ID NO: 654787 - RNA, 18 nt, Homo sapiens
aggucucagaugagcuua

SEQ ID NO: 654788 - RNA, 22 nt, Homo sapiens
aggucugcucggccgucuucac

SEQ ID NO: 654789 - RNA, 20 nt, Homo sapiens
aggucuguacguuaccucuu

SEQ ID NO: 654790 - RNA, 21 nt, Homo sapiens
aggucuugcaguggcuuuuca

SEQ ID NO: 654791 - RNA, 13 nt, Homo sapiens
aggucuuuggucu

SEQ ID NO: 654792 - RNA, 18 nt, Homo sapiens
aggugaaaauccaucuca

SEQ ID NO: 654793 - RNA, 16 nt, Homo sapiens
aggugaaagaaaccac

SEQ ID NO: 654794 - RNA, 17 nt, Homo sapiens
aggugaaauaugugaug

SEQ ID NO: 654795 - RNA, 17 nt, Homo sapiens
aggugaacacuuaguga

SEQ ID NO: 654796 - RNA, 21 nt, Homo sapiens
aggugaacacuuagugaucau

SEQ ID NO: 654797 - RNA, 14 nt, Homo sapiens
aggugaagggaugg

SEQ ID NO: 654798 - RNA, 16 nt, Homo sapiens
aggugaauagcacagg

SEQ ID NO: 654799 - RNA, 19 nt, Homo sapiens
aggugacuucuagcagaga

SEQ ID NO: 654800 - RNA, 22 nt, Homo sapiens
aggugacuuguuuacucauuga

SEQ ID NO: 654801 - RNA, 16 nt, Homo sapiens
aggugaggcucuucac

SEQ ID NO: 654802 - RNA, 19 nt, Homo sapiens
aggugaguuugagcugccu

SEQ ID NO: 654803 - RNA, 15 nt, Homo sapiens
aggugauagcauugc

SEQ ID NO: 654804 - RNA, 19 nt, Homo sapiens
aggugauccacccaccuca

SEQ ID NO: 654805 - RNA, 20 nt, Homo sapiens
aggugauccgcccaccucag

SEQ ID NO: 654806 - RNA, 15 nt, Homo sapiens
aggugaugcucuggc

SEQ ID NO: 654807 - RNA, 23 nt, Homo sapiens
aggugauugucaccaugaucacu

SEQ ID NO: 654808 - RNA, 21 nt, Homo sapiens
aggugcagaccuugggggaag

SEQ ID NO: 654809 - RNA, 15 nt, Homo sapiens
aggugcagcuccuca

SEQ ID NO: 654810 - RNA, 17 nt, Homo sapiens
aggugcccgcguggcau

SEQ ID NO: 654811 - RNA, 20 nt, Homo sapiens
aggugccuccaauuggugcu

SEQ ID NO: 654812 - RNA, 21 nt, Homo sapiens
aggugccuccaauuggugcuu

SEQ ID NO: 654813 - RNA, 17 nt, Homo sapiens
aggugccuguccuugaa

SEQ ID NO: 654814 - RNA, 20 nt, Homo sapiens
aggugcgcgccaccgugccu

SEQ ID NO: 654815 - RNA, 20 nt, Homo sapiens
aggugcguaguccaacucuu

SEQ ID NO: 654816 - RNA, 16 nt, Homo sapiens
aggugcgugugucucu

SEQ ID NO: 654817 - RNA, 17 nt, Homo sapiens
aggugcuacaacaugug

SEQ ID NO: 654818 - RNA, 19 nt, Homo sapiens
aggugcuacaacaugugag

SEQ ID NO: 654819 - RNA, 13 nt, Homo sapiens
aggugcucugugg

SEQ ID NO: 654820 - RNA, 19 nt, Homo sapiens
aggugcugacuucaucucc

SEQ ID NO: 654821 - RNA, 21 nt, Homo sapiens
aggugcugggcuggacuggcc

SEQ ID NO: 654822 - RNA, 20 nt, Homo sapiens
agguggaaaagcaacauuca

SEQ ID NO: 654823 - RNA, 16 nt, Homo sapiens
agguggaucaccugag

SEQ ID NO: 654824 - RNA, 22 nt, Homo sapiens
agguggauuuggagaccgaaga

SEQ ID NO: 654825 - RNA, 11 nt, Homo sapiens
agguggcaagc

SEQ ID NO: 654826 - RNA, 18 nt, Homo sapiens
agguggccacagugucac

SEQ ID NO: 654827 - RNA, 21 nt, Homo sapiens
agguggccacagugucacugg

SEQ ID NO: 654828 - RNA, 22 nt, Homo sapiens
agguggccccaguucaaucucc

SEQ ID NO: 654829 - RNA, 15 nt, Homo sapiens
agguggccucugccu

SEQ ID NO: 654830 - RNA, 13 nt, Homo sapiens
agguggcucagug

SEQ ID NO: 654831 - RNA, 13 nt, Homo sapiens
agguggcucucca

SEQ ID NO: 654832 - RNA, 18 nt, Homo sapiens
aggugggagaggccucau

SEQ ID NO: 654833 - RNA, 19 nt, Homo sapiens
aggugggaucacuaaggga

SEQ ID NO: 654834 - RNA, 19 nt, Homo sapiens
aggugggccuugcuaccuc

SEQ ID NO: 654835 - RNA, 22 nt, Homo sapiens
agguggggccucagccuggggc

SEQ ID NO: 654836 - RNA, 20 nt, Homo sapiens
aggugguaagcaccaggacg

SEQ ID NO: 654837 - RNA, 16 nt, Homo sapiens
agguggugccuucuca

SEQ ID NO: 654838 - RNA, 17 nt, Homo sapiens
agguggugggacacugg

SEQ ID NO: 654839 - RNA, 14 nt, Homo sapiens
agguguaaccguaa

SEQ ID NO: 654840 - RNA, 16 nt, Homo sapiens
agguguauugaagucc

SEQ ID NO: 654841 - RNA, 13 nt, Homo sapiens
aggugucauauga

SEQ ID NO: 654842 - RNA, 17 nt, Homo sapiens
aggugucuagacugcca

SEQ ID NO: 654843 - RNA, 14 nt, Homo sapiens
aggugucucugggc

SEQ ID NO: 654844 - RNA, 15 nt, Homo sapiens
aggugucugcaccca

SEQ ID NO: 654845 - RNA, 21 nt, Homo sapiens
aggugugcccuguacacaggc

SEQ ID NO: 654846 - RNA, 14 nt, Homo sapiens
aggugugguagcuc

SEQ ID NO: 654847 - RNA, 20 nt, Homo sapiens
agguguuauaucuaugcaaa

SEQ ID NO: 654848 - RNA, 16 nt, Homo sapiens
agguguuucuuuccug

SEQ ID NO: 654849 - RNA, 14 nt, Homo sapiens
agguuaaaggccag

SEQ ID NO: 654850 - RNA, 16 nt, Homo sapiens
agguuaaauuucaagc

SEQ ID NO: 654851 - RNA, 13 nt, Homo sapiens
agguuaaggcaua

SEQ ID NO: 654852 - RNA, 17 nt, Homo sapiens
agguuaauucucuaggg

SEQ ID NO: 654853 - RNA, 16 nt, Homo sapiens
agguuacaagccugca

SEQ ID NO: 654854 - RNA, 19 nt, Homo sapiens
agguuacuaaaacagggug

SEQ ID NO: 654855 - RNA, 14 nt, Homo sapiens
agguuagaaaggca

SEQ ID NO: 654856 - RNA, 21 nt, Homo sapiens
agguuaggaaggcagcauucc

SEQ ID NO: 654857 - RNA, 17 nt, Homo sapiens
agguuagggcucugccc

SEQ ID NO: 654858 - RNA, 18 nt, Homo sapiens
agguuaugaaacauauca

SEQ ID NO: 654859 - RNA, 11 nt, Homo sapiens
agguucacuuu

SEQ ID NO: 654860 - RNA, 15 nt, Homo sapiens
agguucagccugaaa

SEQ ID NO: 654861 - RNA, 19 nt, Homo sapiens
agguuccuuaucugucaca

SEQ ID NO: 654862 - RNA, 17 nt, Homo sapiens
agguuccuuuuucaaaa

SEQ ID NO: 654863 - RNA, 20 nt, Homo sapiens
agguucucagguguugccaa

SEQ ID NO: 654864 - RNA, 21 nt, Homo sapiens
agguucugcccuuauggagcu

SEQ ID NO: 654865 - RNA, 18 nt, Homo sapiens
agguucuuagugucacuu

SEQ ID NO: 654866 - RNA, 19 nt, Homo sapiens
agguucuuagugucacuua

SEQ ID NO: 654867 - RNA, 14 nt, Homo sapiens
agguucuucagggc

SEQ ID NO: 654868 - RNA, 17 nt, Homo sapiens
agguucuucagggccag

SEQ ID NO: 654869 - RNA, 22 nt, Homo sapiens
agguucuuuuuuuuuucaggaa

SEQ ID NO: 654870 - RNA, 17 nt, Homo sapiens
agguugaagccaugucu

SEQ ID NO: 654871 - RNA, 17 nt, Homo sapiens
agguugagcaauuuccc

SEQ ID NO: 654872 - RNA, 20 nt, Homo sapiens
agguugaggggcuccuggaa

SEQ ID NO: 654873 - RNA, 17 nt, Homo sapiens
agugaugaaaacauuca

SEQ ID NO: 654874 - RNA, 21 nt, Homo sapiens
agugauggcuuaugauagcaa

SEQ ID NO: 654875 - RNA, 12 nt, Homo sapiens
agugauguaauc

SEQ ID NO: 654876 - RNA, 20 nt, Homo sapiens
agugaugugaucauagcuca

SEQ ID NO: 654877 - RNA, 14 nt, Homo sapiens
agugauuacuguca

SEQ ID NO: 654878 - RNA, 19 nt, Homo sapiens
agugauucuccugccucag

SEQ ID NO: 654879 - RNA, 16 nt, Homo sapiens
agugauucucuugacg

SEQ ID NO: 654880 - RNA, 17 nt, Homo sapiens
agugauugauagagugu

SEQ ID NO: 654881 - RNA, 22 nt, Homo sapiens
agugauugauagaguguuauca

SEQ ID NO: 654882 - RNA, 14 nt, Homo sapiens
agugauugcagcuu

SEQ ID NO: 654883 - RNA, 14 nt, Homo sapiens
agugcaaaaaacau

SEQ ID NO: 654884 - RNA, 16 nt, Homo sapiens
agugcaacagcacugg

SEQ ID NO: 654885 - RNA, 17 nt, Homo sapiens
agugcaacagcacuggc

SEQ ID NO: 654886 - RNA, 18 nt, Homo sapiens
agugcaacagcacuggcu

SEQ ID NO: 654887 - RNA, 20 nt, Homo sapiens
agugcaaccucgcugagggc

SEQ ID NO: 654888 - RNA, 19 nt, Homo sapiens
agugcaagccccugcucca

SEQ ID NO: 654889 - RNA, 21 nt, Homo sapiens
agugcaauggcgcgaucucag

SEQ ID NO: 654890 - RNA, 12 nt, Homo sapiens
agugcaccacuu

SEQ ID NO: 654891 - RNA, 16 nt, Homo sapiens
agugcaccuacugcuu

SEQ ID NO: 654892 - RNA, 23 nt, Homo sapiens
agugcacugagaacagcauauga

SEQ ID NO: 654893 - RNA, 19 nt, Homo sapiens
agugcacuuuaagaggugg

SEQ ID NO: 654894 - RNA, 23 nt, Homo sapiens
agugcagcugcugugccugaugu

SEQ ID NO: 654895 - RNA, 17 nt, Homo sapiens
agugcaguccauuuccu

SEQ ID NO: 654896 - RNA, 16 nt, Homo sapiens
agugcagugaugcaau

SEQ ID NO: 654897 - RNA, 14 nt, Homo sapiens
agugcaguggcaca

SEQ ID NO: 654898 - RNA, 19 nt, Homo sapiens
agugcaguggcaugaucau

SEQ ID NO: 654899 - RNA, 19 nt, Homo sapiens
agugcaguggcgugaucuc

SEQ ID NO: 654900 - RNA, 20 nt, Homo sapiens
agugcaguggcgugaucucg

SEQ ID NO: 654901 - RNA, 20 nt, Homo sapiens
agugcaguggugugaucucg

SEQ ID NO: 654902 - RNA, 20 nt, Homo sapiens
agugcaguuugguguguccu

SEQ ID NO: 654903 - RNA, 12 nt, Homo sapiens
agugcauaugca

SEQ ID NO: 654904 - RNA, 19 nt, Homo sapiens
agugcaucuaaucacuuag

SEQ ID NO: 654905 - RNA, 13 nt, Homo sapiens
agugcaucuugcu

SEQ ID NO: 654906 - RNA, 13 nt, Homo sapiens
agugcauuugccu

SEQ ID NO: 654907 - RNA, 16 nt, Homo sapiens
agugcauuugugcuag

SEQ ID NO: 654908 - RNA, 14 nt, Homo sapiens
agugccaacuccuc

SEQ ID NO: 654909 - RNA, 20 nt, Homo sapiens
agugccacuugacauuccuu

SEQ ID NO: 654910 - RNA, 13 nt, Homo sapiens
agugccagcuuuc

SEQ ID NO: 654911 - RNA, 13 nt, Homo sapiens
agugccauguuag

SEQ ID NO: 654912 - RNA, 20 nt, Homo sapiens
agugccauuacuacuguaca

SEQ ID NO: 654913 - RNA, 12 nt, Homo sapiens
agugccauucca

SEQ ID NO: 654914 - RNA, 19 nt, Homo sapiens
agugccauuccacuccacu

SEQ ID NO: 654915 - RNA, 16 nt, Homo sapiens
agugcccaagcgcuug

SEQ ID NO: 654916 - RNA, 9 nt, Homo sapiens
agugcccua

SEQ ID NO: 654917 - RNA, 20 nt, Homo sapiens
agugcccucucugaaccuca

SEQ ID NO: 654918 - RNA, 21 nt, Homo sapiens
agugccguaacaacugugguc

SEQ ID NO: 654919 - RNA, 14 nt, Homo sapiens
agugccuaccccag

SEQ ID NO: 654920 - RNA, 21 nt, Homo sapiens
agugccucuccuggcccugaa

SEQ ID NO: 654921 - RNA, 17 nt, Homo sapiens
agugccucuuucaucca

SEQ ID NO: 654922 - RNA, 14 nt, Homo sapiens
agugccugggaaug

SEQ ID NO: 654923 - RNA, 17 nt, Homo sapiens
agugccugguguucuga

SEQ ID NO: 654924 - RNA, 21 nt, Homo sapiens
agugccuuccucucucuacca

SEQ ID NO: 654925 - RNA, 14 nt, Homo sapiens
agugccuugcccac

SEQ ID NO: 654926 - RNA, 18 nt, Homo sapiens
agugccuugcccacaggu

SEQ ID NO: 654927 - RNA, 14 nt, Homo sapiens
agugccuuuaguuu

SEQ ID NO: 654928 - RNA, 16 nt, Homo sapiens
agugccuuuuuccuua

SEQ ID NO: 654929 - RNA, 13 nt, Homo sapiens
agugcgguuuacu

SEQ ID NO: 654930 - RNA, 14 nt, Homo sapiens
agugcucaauagcu

SEQ ID NO: 654931 - RNA, 11 nt, Homo sapiens
agugcugccau

SEQ ID NO: 654932 - RNA, 23 nt, Homo sapiens
agugcugccccuugcaagccaua

SEQ ID NO: 654933 - RNA, 23 nt, Homo sapiens
agugcugcuauaucuauccauuu

SEQ ID NO: 654934 - RNA, 14 nt, Homo sapiens
agugcuggcucaca

SEQ ID NO: 654935 - RNA, 13 nt, Homo sapiens
agugcugggauga

SEQ ID NO: 654936 - RNA, 21 nt, Homo sapiens
agugcugggauuacaggcaug

SEQ ID NO: 654937 - RNA, 17 nt, Homo sapiens
agugcuguccaugaugu

SEQ ID NO: 654938 - RNA, 14 nt, Homo sapiens
agugcugugucauu

SEQ ID NO: 654939 - RNA, 17 nt, Homo sapiens
agugcuuaguguacuug

SEQ ID NO: 654940 - RNA, 17 nt, Homo sapiens
agugcuucagaguuugu

SEQ ID NO: 654941 - RNA, 23 nt, Homo sapiens
agugcuugcagaucaucugggga

SEQ ID NO: 654942 - RNA, 22 nt, Homo sapiens
agugcuuggaacauacuguuca

SEQ ID NO: 654943 - RNA, 15 nt, Homo sapiens
agugcuugggcucca

SEQ ID NO: 654944 - RNA, 22 nt, Homo sapiens
agugcuuguuccucucaucucc

SEQ ID NO: 654945 - RNA, 14 nt, Homo sapiens
agugcuuugugaua

SEQ ID NO: 654946 - RNA, 21 nt, Homo sapiens
agugcuuuucagugauacuca

SEQ ID NO: 654947 - RNA, 21 nt, Homo sapiens
aguggaaaacaaagccaaaca

SEQ ID NO: 654948 - RNA, 16 nt, Homo sapiens
aguggaaaaugcaaug

SEQ ID NO: 654949 - RNA, 18 nt, Homo sapiens
aguggaaauuaagacuuu

SEQ ID NO: 654950 - RNA, 13 nt, Homo sapiens
aguggacaccgcu

SEQ ID NO: 654951 - RNA, 13 nt, Homo sapiens
aguggacaggaag

SEQ ID NO: 654952 - RNA, 17 nt, Homo sapiens
aguggacccuggaccau

SEQ ID NO: 654953 - RNA, 20 nt, Homo sapiens
aguggacccuggaccauucc

SEQ ID NO: 654954 - RNA, 21 nt, Homo sapiens
aguggacccuggaccauucca

SEQ ID NO: 654955 - RNA, 18 nt, Homo sapiens
aguggacgugguaugaaa

SEQ ID NO: 654956 - RNA, 14 nt, Homo sapiens
aguggacuauaaua

SEQ ID NO: 654957 - RNA, 22 nt, Homo sapiens
aguggacucagcagugaccaca

SEQ ID NO: 654958 - RNA, 15 nt, Homo sapiens
aguggagacaguccu

SEQ ID NO: 654959 - RNA, 15 nt, Homo sapiens
aguggagagugacau

SEQ ID NO: 654960 - RNA, 14 nt, Homo sapiens
aguggaguugacuc

SEQ ID NO: 654961 - RNA, 16 nt, Homo sapiens
aguggaguuggugaau

SEQ ID NO: 654962 - RNA, 15 nt, Homo sapiens
aguggaucuccaagg

SEQ ID NO: 654963 - RNA, 22 nt, Homo sapiens
aguggaucuucagaacugcccu

SEQ ID NO: 654964 - RNA, 21 nt, Homo sapiens
aguggauuggcuuugugcuug

SEQ ID NO: 654965 - RNA, 20 nt, Homo sapiens
aguggcacugaaguggcccu

SEQ ID NO: 654966 - RNA, 14 nt, Homo sapiens
aguggcagccaugc

SEQ ID NO: 654967 - RNA, 19 nt, Homo sapiens
aguggcaggggacaggagu

SEQ ID NO: 654968 - RNA, 18 nt, Homo sapiens
aguggcauuuccugguca

SEQ ID NO: 654969 - RNA, 19 nt, Homo sapiens
aguggcauuuccuggucag

SEQ ID NO: 654970 - RNA, 15 nt, Homo sapiens
aguggccagccagug

SEQ ID NO: 654971 - RNA, 23 nt, Homo sapiens
aguggccagccagugccauucca

SEQ ID NO: 654972 - RNA, 19 nt, Homo sapiens
aguggcccauggcauuuua

SEQ ID NO: 654973 - RNA, 16 nt, Homo sapiens
aguggcccucccucag

SEQ ID NO: 654974 - RNA, 14 nt, Homo sapiens
aguggccuggccag

SEQ ID NO: 654975 - RNA, 20 nt, Homo sapiens
aguggcgcgaucucggcuca

SEQ ID NO: 654976 - RNA, 23 nt, Homo sapiens
aguggcggggggguuuugccuaa

SEQ ID NO: 654977 - RNA, 15 nt, Homo sapiens
aguggcgugaucucg

SEQ ID NO: 654978 - RNA, 20 nt, Homo sapiens
aguggcgugaucucggcuca

SEQ ID NO: 654979 - RNA, 21 nt, Homo sapiens
aguggcgugaucuuggcucac

SEQ ID NO: 654980 - RNA, 22 nt, Homo sapiens
aguggcguuguugcauguuuga

SEQ ID NO: 654981 - RNA, 13 nt, Homo sapiens
aguggcuagcgca

SEQ ID NO: 654982 - RNA, 21 nt, Homo sapiens
aguggcucacgccuaugaucc

SEQ ID NO: 654983 - RNA, 19 nt, Homo sapiens
aguggcuggugcccaugaa

SEQ ID NO: 654984 - RNA, 20 nt, Homo sapiens
aguggcuucccagcucugac

SEQ ID NO: 654985 - RNA, 16 nt, Homo sapiens
aguggcuucuuuugaa

SEQ ID NO: 654986 - RNA, 19 nt, Homo sapiens
agugggaaauauuuagcaa

SEQ ID NO: 654987 - RNA, 17 nt, Homo sapiens
agugggaauccgggaca

SEQ ID NO: 654988 - RNA, 20 nt, Homo sapiens
agugggagcugagcuggaag

SEQ ID NO: 654989 - RNA, 21 nt, Homo sapiens
agugggaggguaccagcagaa

SEQ ID NO: 654990 - RNA, 19 nt, Homo sapiens
agugggccugguagcacau

SEQ ID NO: 654991 - RNA, 16 nt, Homo sapiens
agugggcugugacucc

SEQ ID NO: 654992 - RNA, 15 nt, Homo sapiens
aguggggauccugcc

SEQ ID NO: 654993 - RNA, 16 nt, Homo sapiens
aguggggcugcaggca

SEQ ID NO: 654994 - RNA, 15 nt, Homo sapiens
agugggggagccuga

SEQ ID NO: 654995 - RNA, 17 nt, Homo sapiens
auaacauuuaaauucca

SEQ ID NO: 654996 - RNA, 15 nt, Homo sapiens
auaacauuuuauaca

SEQ ID NO: 654997 - RNA, 18 nt, Homo sapiens
auaaccucucugugccau

SEQ ID NO: 654998 - RNA, 14 nt, Homo sapiens
auaacuauacuuga

SEQ ID NO: 654999 - RNA, 16 nt, Homo sapiens
auaacucaagaaauca

SEQ ID NO: 655000 - RNA, 16 nt, Homo sapiens
auaacuccaagcagac

SEQ ID NO: 655001 - RNA, 17 nt, Homo sapiens
auaacucggauuccagc

SEQ ID NO: 655002 - RNA, 14 nt, Homo sapiens
auaacucuccagua

SEQ ID NO: 655003 - RNA, 23 nt, Homo sapiens
auaacucuguaaaaacacugaaa

SEQ ID NO: 655004 - RNA, 22 nt, Homo sapiens
auaacucuuuauuuuuugccau

SEQ ID NO: 655005 - RNA, 13 nt, Homo sapiens
auaacuguucuca

SEQ ID NO: 655006 - RNA, 17 nt, Homo sapiens
auaacuuagguggcaag

SEQ ID NO: 655007 - RNA, 22 nt, Homo sapiens
auaacuuccuggcuccuucacu

SEQ ID NO: 655008 - RNA, 16 nt, Homo sapiens
auaacuugagaccuaa

SEQ ID NO: 655009 - RNA, 20 nt, Homo sapiens
auaacuuggccauguucucc

SEQ ID NO: 655010 - RNA, 21 nt, Homo sapiens
auaacuuuuuuuuaaguuaca

SEQ ID NO: 655011 - RNA, 18 nt, Homo sapiens
auaagaaagcacuauuaa

SEQ ID NO: 655012 - RNA, 13 nt, Homo sapiens
auaagaacaaaga

SEQ ID NO: 655013 - RNA, 14 nt, Homo sapiens
auaagaauuugcau

SEQ ID NO: 655014 - RNA, 13 nt, Homo sapiens
auaagacaaugac

SEQ ID NO: 655015 - RNA, 14 nt, Homo sapiens
auaagacuacugaa

SEQ ID NO: 655016 - RNA, 13 nt, Homo sapiens
auaagagauuugg

SEQ ID NO: 655017 - RNA, 20 nt, Homo sapiens
auaagaguugagauuuugca

SEQ ID NO: 655018 - RNA, 15 nt, Homo sapiens
auaagaucugagauu

SEQ ID NO: 655019 - RNA, 13 nt, Homo sapiens
auaagaugacaau

SEQ ID NO: 655020 - RNA, 19 nt, Homo sapiens
auaagcaaaaacaaaaaga

SEQ ID NO: 655021 - RNA, 17 nt, Homo sapiens
auaagcaaagacuauga

SEQ ID NO: 655022 - RNA, 11 nt, Homo sapiens
auaagcaagag

SEQ ID NO: 655023 - RNA, 12 nt, Homo sapiens
auaagcagagag

SEQ ID NO: 655024 - RNA, 17 nt, Homo sapiens
auaagcauacaacugga

SEQ ID NO: 655025 - RNA, 14 nt, Homo sapiens
auaagcccaguuca

SEQ ID NO: 655026 - RNA, 15 nt, Homo sapiens
auaagcccugcauaa

SEQ ID NO: 655027 - RNA, 20 nt, Homo sapiens
auaagccuuuuuaaccuucc

SEQ ID NO: 655028 - RNA, 21 nt, Homo sapiens
auaagcucuaguucuuaacaa

SEQ ID NO: 655029 - RNA, 13 nt, Homo sapiens
auaagcugaauaa

SEQ ID NO: 655030 - RNA, 11 nt, Homo sapiens
auaagcuuucu

SEQ ID NO: 655031 - RNA, 19 nt, Homo sapiens
auaaggaucagaacagcag

SEQ ID NO: 655032 - RNA, 21 nt, Homo sapiens
auaaggggccuugcucugagc

SEQ ID NO: 655033 - RNA, 22 nt, Homo sapiens
auaaggggccuugcucugagca

SEQ ID NO: 655034 - RNA, 19 nt, Homo sapiens
auaaggugccucaguuuuc

SEQ ID NO: 655035 - RNA, 16 nt, Homo sapiens
auaaggugcuaucugu

SEQ ID NO: 655036 - RNA, 13 nt, Homo sapiens
auaaguaggccau

SEQ ID NO: 655037 - RNA, 17 nt, Homo sapiens
auaaguguuugucauau

SEQ ID NO: 655038 - RNA, 14 nt, Homo sapiens
auaaguuauacagu

SEQ ID NO: 655039 - RNA, 17 nt, Homo sapiens
auaaguuuuagaaucuu

SEQ ID NO: 655040 - RNA, 24 nt, Homo sapiens
auaauaaaaaaauuagugaguaua

SEQ ID NO: 655041 - RNA, 15 nt, Homo sapiens
auaauaaaaagcauu

SEQ ID NO: 655042 - RNA, 21 nt, Homo sapiens
auaauaaaacuaaacuuucau

SEQ ID NO: 655043 - RNA, 18 nt, Homo sapiens
auaauaaaaggaguucag

SEQ ID NO: 655044 - RNA, 16 nt, Homo sapiens
auaauaaacaguggaa

SEQ ID NO: 655045 - RNA, 15 nt, Homo sapiens
auaauaaacuacaca

SEQ ID NO: 655046 - RNA, 17 nt, Homo sapiens
auaauaaaggcauuuca

SEQ ID NO: 655047 - RNA, 22 nt, Homo sapiens
auaauaacccugccagugccag

SEQ ID NO: 655048 - RNA, 16 nt, Homo sapiens
auaauaagcuaaagag

SEQ ID NO: 655049 - RNA, 15 nt, Homo sapiens
auaauaauagcagug

SEQ ID NO: 655050 - RNA, 17 nt, Homo sapiens
auaauaaugaugaugau

SEQ ID NO: 655051 - RNA, 12 nt, Homo sapiens
auaauacuguau

SEQ ID NO: 655052 - RNA, 12 nt, Homo sapiens
auaauagucaau

SEQ ID NO: 655053 - RNA, 17 nt, Homo sapiens
auaauauauuugcagau

SEQ ID NO: 655054 - RNA, 16 nt, Homo sapiens
auaauauauuuucaag

SEQ ID NO: 655055 - RNA, 23 nt, Homo sapiens
auaauauuaaggaagacaaugug

SEQ ID NO: 655056 - RNA, 20 nt, Homo sapiens
auaauauuagugauucugau

SEQ ID NO: 655057 - RNA, 15 nt, Homo sapiens
auaaucaaagcucau

SEQ ID NO: 655058 - RNA, 20 nt, Homo sapiens
auaaucacauuaucaucuga

SEQ ID NO: 655059 - RNA, 21 nt, Homo sapiens
auaaucacauuaucaucugaa

SEQ ID NO: 655060 - RNA, 14 nt, Homo sapiens
auaaucacauugac

SEQ ID NO: 655061 - RNA, 15 nt, Homo sapiens
auaaucacucuaauu

SEQ ID NO: 655062 - RNA, 16 nt, Homo sapiens
auaaucagucaugugu

SEQ ID NO: 655063 - RNA, 20 nt, Homo sapiens
auaaucaucaaguaauacaa

SEQ ID NO: 655064 - RNA, 16 nt, Homo sapiens
auaaucguguccugaa

SEQ ID NO: 655065 - RNA, 14 nt, Homo sapiens
auaaucucaucccc

SEQ ID NO: 655066 - RNA, 22 nt, Homo sapiens
auaaucucuuuaaauggcuuua

SEQ ID NO: 655067 - RNA, 17 nt, Homo sapiens
auaaucugcaugaagga

SEQ ID NO: 655068 - RNA, 12 nt, Homo sapiens
auaaucugucaa

SEQ ID NO: 655069 - RNA, 22 nt, Homo sapiens
auaaucugucaaaacacugugg

SEQ ID NO: 655070 - RNA, 13 nt, Homo sapiens
auaaucuucugcc

SEQ ID NO: 655071 - RNA, 14 nt, Homo sapiens
auaaugaacacgug

SEQ ID NO: 655072 - RNA, 11 nt, Homo sapiens
auaaugcucac

SEQ ID NO: 655073 - RNA, 19 nt, Homo sapiens
auaaugguguccagucuuu

SEQ ID NO: 655074 - RNA, 19 nt, Homo sapiens
auaaugguugacuggguuu

SEQ ID NO: 655075 - RNA, 21 nt, Homo sapiens
auaaugucauuaaacaugaca

SEQ ID NO: 655076 - RNA, 19 nt, Homo sapiens
auaaugugcaaaucugaca

SEQ ID NO: 655077 - RNA, 22 nt, Homo sapiens
auaauguuaacuaaauaacuuu

SEQ ID NO: 655078 - RNA, 16 nt, Homo sapiens
auaauguuacauuauu

SEQ ID NO: 655079 - RNA, 21 nt, Homo sapiens
auaauguuacauuauuaucaa

SEQ ID NO: 655080 - RNA, 21 nt, Homo sapiens
auaauuaaaaaaaaaacuuca

SEQ ID NO: 655081 - RNA, 20 nt, Homo sapiens
auaauuaaccaccaauccaa

SEQ ID NO: 655082 - RNA, 22 nt, Homo sapiens
auaauuaccaauaucuugccag

SEQ ID NO: 655083 - RNA, 14 nt, Homo sapiens
auaauucagcacuu

SEQ ID NO: 655084 - RNA, 15 nt, Homo sapiens
auaauucagcacuua

SEQ ID NO: 655085 - RNA, 22 nt, Homo sapiens
auaauucagcacuuaacuauga

SEQ ID NO: 655086 - RNA, 18 nt, Homo sapiens
auaauuguaccaaccuca

SEQ ID NO: 655087 - RNA, 20 nt, Homo sapiens
auaauuucuagaaacaaaca

SEQ ID NO: 655088 - RNA, 19 nt, Homo sapiens
auaauuucuauuaauauca

SEQ ID NO: 655089 - RNA, 16 nt, Homo sapiens
auaauuuguaguauaa

SEQ ID NO: 655090 - RNA, 19 nt, Homo sapiens
auaauuugucuuaguugau

SEQ ID NO: 655091 - RNA, 16 nt, Homo sapiens
auaauuuuaugcugga

SEQ ID NO: 655092 - RNA, 10 nt, Homo sapiens
auaauuuugu

SEQ ID NO: 655093 - RNA, 14 nt, Homo sapiens
auacaaaccacugu

SEQ ID NO: 655094 - RNA, 13 nt, Homo sapiens
auacaaacucuca

SEQ ID NO: 655095 - RNA, 21 nt, Homo sapiens
auacaaaguguaccaacauaa

SEQ ID NO: 655096 - RNA, 13 nt, Homo sapiens
auacaaauggauu

SEQ ID NO: 655097 - RNA, 14 nt, Homo sapiens
auacaaauuccaca

SEQ ID NO: 655098 - RNA, 20 nt, Homo sapiens
auacaaauugauagucaaua

SEQ ID NO: 655099 - RNA, 14 nt, Homo sapiens
auacaacacagacg

SEQ ID NO: 655100 - RNA, 13 nt, Homo sapiens
auacaacauguag

SEQ ID NO: 655101 - RNA, 22 nt, Homo sapiens
auacaacauuaaggaauuugau

SEQ ID NO: 655102 - RNA, 14 nt, Homo sapiens
auacaaggaugcac

SEQ ID NO: 655103 - RNA, 14 nt, Homo sapiens
auacaaucauguga

SEQ ID NO: 655104 - RNA, 22 nt, Homo sapiens
auacaauguauguacaauacaa

SEQ ID NO: 655105 - RNA, 22 nt, Homo sapiens
auacacaaggacccuucaggug

SEQ ID NO: 655106 - RNA, 19 nt, Homo sapiens
auacacacauauacauaua

SEQ ID NO: 655107 - RNA, 14 nt, Homo sapiens
auacacaguacuuu

SEQ ID NO: 655108 - RNA, 15 nt, Homo sapiens
auacacagugcugac

SEQ ID NO: 655109 - RNA, 15 nt, Homo sapiens
auacacauacauaca

SEQ ID NO: 655110 - RNA, 14 nt, Homo sapiens
auacaccagcaaug

SEQ ID NO: 655111 - RNA, 18 nt, Homo sapiens
auacacccaaacacuuac

SEQ ID NO: 655112 - RNA, 22 nt, Homo sapiens
auacacuccacuugaagcacuu

SEQ ID NO: 655113 - RNA, 23 nt, Homo sapiens
auacacuccacuugaagcacuua

SEQ ID NO: 655114 - RNA, 15 nt, Homo sapiens
auacacuuaaugaua

SEQ ID NO: 655115 - RNA, 23 nt, Homo sapiens
auacacuucuggcucacaggaaa

SEQ ID NO: 655116 - RNA, 21 nt, Homo sapiens
auacagaagcagugugagcag

SEQ ID NO: 655117 - RNA, 22 nt, Homo sapiens
augcaaccuuuggaugcacuuu

SEQ ID NO: 655118 - RNA, 16 nt, Homo sapiens
augcaacucaucuuca

SEQ ID NO: 655119 - RNA, 13 nt, Homo sapiens
augcaagacccca

SEQ ID NO: 655120 - RNA, 21 nt, Homo sapiens
augcaaggggaaaaucucagc

SEQ ID NO: 655121 - RNA, 22 nt, Homo sapiens
augcaaggggaaaaucucagca

SEQ ID NO: 655122 - RNA, 15 nt, Homo sapiens
augcaaggucauuuu

SEQ ID NO: 655123 - RNA, 14 nt, Homo sapiens
augcaaucagacaa

SEQ ID NO: 655124 - RNA, 16 nt, Homo sapiens
augcaaucuuggcuca

SEQ ID NO: 655125 - RNA, 15 nt, Homo sapiens
augcaaugccaaaua

SEQ ID NO: 655126 - RNA, 21 nt, Homo sapiens
augcacacacacacaucucau

SEQ ID NO: 655127 - RNA, 13 nt, Homo sapiens
augcacacagugc

SEQ ID NO: 655128 - RNA, 15 nt, Homo sapiens
augcacaggggccca

SEQ ID NO: 655129 - RNA, 12 nt, Homo sapiens
augcacaguaau

SEQ ID NO: 655130 - RNA, 12 nt, Homo sapiens
augcacaugccu

SEQ ID NO: 655131 - RNA, 19 nt, Homo sapiens
augcacucagcucuuggcu

SEQ ID NO: 655132 - RNA, 15 nt, Homo sapiens
augcacugauguugu

SEQ ID NO: 655133 - RNA, 22 nt, Homo sapiens
augcacuguucccccugugcag

SEQ ID NO: 655134 - RNA, 11 nt, Homo sapiens
augcacuucaa

SEQ ID NO: 655135 - RNA, 19 nt, Homo sapiens
augcacuugaaaugauggu

SEQ ID NO: 655136 - RNA, 19 nt, Homo sapiens
augcagaaauuauugggcu

SEQ ID NO: 655137 - RNA, 23 nt, Homo sapiens
augcagaacaccaauauuaacac

SEQ ID NO: 655138 - RNA, 19 nt, Homo sapiens
augcagaauggcauuugca

SEQ ID NO: 655139 - RNA, 13 nt, Homo sapiens
augcagacuuccu

SEQ ID NO: 655140 - RNA, 19 nt, Homo sapiens
augcagagguccacaacac

SEQ ID NO: 655141 - RNA, 18 nt, Homo sapiens
augcagauuccucagauu

SEQ ID NO: 655142 - RNA, 21 nt, Homo sapiens
augcagcaaggggacaucuua

SEQ ID NO: 655143 - RNA, 17 nt, Homo sapiens
augcagcaggaaggaac

SEQ ID NO: 655144 - RNA, 20 nt, Homo sapiens
augcagccaaccaagaugca

SEQ ID NO: 655145 - RNA, 22 nt, Homo sapiens
augcagccacugugcugaauuc

SEQ ID NO: 655146 - RNA, 18 nt, Homo sapiens
augcagccagccaucaaa

SEQ ID NO: 655147 - RNA, 22 nt, Homo sapiens
augcagcgccguguccucucug

SEQ ID NO: 655148 - RNA, 23 nt, Homo sapiens
augcaggaagugguggcaaaggu

SEQ ID NO: 655149 - RNA, 21 nt, Homo sapiens
augcagguggugggacacugg

SEQ ID NO: 655150 - RNA, 13 nt, Homo sapiens
augcagguggugu

SEQ ID NO: 655151 - RNA, 21 nt, Homo sapiens
augcaguuucaaguaccaaaa

SEQ ID NO: 655152 - RNA, 13 nt, Homo sapiens
augcaguuuucau

SEQ ID NO: 655153 - RNA, 14 nt, Homo sapiens
augcauaaagccaa

SEQ ID NO: 655154 - RNA, 16 nt, Homo sapiens
augcauaaaugcgauc

SEQ ID NO: 655155 - RNA, 17 nt, Homo sapiens
augcauacaaguuucau

SEQ ID NO: 655156 - RNA, 24 nt, Homo sapiens
augcauacuguugauacaaaccac

SEQ ID NO: 655157 - RNA, 20 nt, Homo sapiens
augcauaggaaguauggcau

SEQ ID NO: 655158 - RNA, 13 nt, Homo sapiens
augcauaggauuc

SEQ ID NO: 655159 - RNA, 13 nt, Homo sapiens
augcaucacuggg

SEQ ID NO: 655160 - RNA, 20 nt, Homo sapiens
augcaucuggcucaccgggu

SEQ ID NO: 655161 - RNA, 20 nt, Homo sapiens
augcaucugggaaaugaggu

SEQ ID NO: 655162 - RNA, 16 nt, Homo sapiens
augcaucuuguuucau

SEQ ID NO: 655163 - RNA, 13 nt, Homo sapiens
augcaugaacaag

SEQ ID NO: 655164 - RNA, 18 nt, Homo sapiens
augcaugcgcaggcucau

SEQ ID NO: 655165 - RNA, 12 nt, Homo sapiens
augcauuauuaa

SEQ ID NO: 655166 - RNA, 17 nt, Homo sapiens
augcauuuucuucagaa

SEQ ID NO: 655167 - RNA, 16 nt, Homo sapiens
augccaaacacuagcu

SEQ ID NO: 655168 - RNA, 18 nt, Homo sapiens
augccaaacacuagcucu

SEQ ID NO: 655169 - RNA, 19 nt, Homo sapiens
augccaaacacuagcucug

SEQ ID NO: 655170 - RNA, 21 nt, Homo sapiens
augccaaacaggaacaaucca

SEQ ID NO: 655171 - RNA, 20 nt, Homo sapiens
augccaauaaaguuugccca

SEQ ID NO: 655172 - RNA, 21 nt, Homo sapiens
augccacagaauuugcuaaua

SEQ ID NO: 655173 - RNA, 13 nt, Homo sapiens
augccacauucaa

SEQ ID NO: 655174 - RNA, 17 nt, Homo sapiens
augccaccaacuuacaa

SEQ ID NO: 655175 - RNA, 13 nt, Homo sapiens
augccacccucac

SEQ ID NO: 655176 - RNA, 15 nt, Homo sapiens
augccagagggccag

SEQ ID NO: 655177 - RNA, 18 nt, Homo sapiens
augccagcauauacugaa

SEQ ID NO: 655178 - RNA, 19 nt, Homo sapiens
augccagcuucucucucca

SEQ ID NO: 655179 - RNA, 16 nt, Homo sapiens
augccaggaaccuguc

SEQ ID NO: 655180 - RNA, 22 nt, Homo sapiens
augccagugaaacuucaagcaa

SEQ ID NO: 655181 - RNA, 18 nt, Homo sapiens
augccauguuugcucuaa

SEQ ID NO: 655182 - RNA, 13 nt, Homo sapiens
augccauuacaga

SEQ ID NO: 655183 - RNA, 21 nt, Homo sapiens
augccauuacagaaccaaauc

SEQ ID NO: 655184 - RNA, 16 nt, Homo sapiens
augccauuucuucucu

SEQ ID NO: 655185 - RNA, 16 nt, Homo sapiens
augcccaaccuauccu

SEQ ID NO: 655186 - RNA, 14 nt, Homo sapiens
augcccaacugccu

SEQ ID NO: 655187 - RNA, 21 nt, Homo sapiens
augccccccucaaaccuccuc

SEQ ID NO: 655188 - RNA, 21 nt, Homo sapiens
augcccccucccuucacaggg

SEQ ID NO: 655189 - RNA, 20 nt, Homo sapiens
augcccucaggggacuugaa

SEQ ID NO: 655190 - RNA, 21 nt, Homo sapiens
augcccucaggggacuugaau

SEQ ID NO: 655191 - RNA, 22 nt, Homo sapiens
augcccucauaaaccaaugugg

SEQ ID NO: 655192 - RNA, 18 nt, Homo sapiens
augcccugcagagcaaua

SEQ ID NO: 655193 - RNA, 20 nt, Homo sapiens
augccgggcgcaguggcuca

SEQ ID NO: 655194 - RNA, 17 nt, Homo sapiens
augccuaaauauaauua

SEQ ID NO: 655195 - RNA, 18 nt, Homo sapiens
augccuauaaaaugccca

SEQ ID NO: 655196 - RNA, 15 nt, Homo sapiens
augccucagagggua

SEQ ID NO: 655197 - RNA, 19 nt, Homo sapiens
augccucagccuacuuuca

SEQ ID NO: 655198 - RNA, 15 nt, Homo sapiens
augccucauacacau

SEQ ID NO: 655199 - RNA, 22 nt, Homo sapiens
augccucccugggccaccuccu

SEQ ID NO: 655200 - RNA, 22 nt, Homo sapiens
augccucuggaggccucuggcc

SEQ ID NO: 655201 - RNA, 23 nt, Homo sapiens
augccucuggaggccucuggccc

SEQ ID NO: 655202 - RNA, 14 nt, Homo sapiens
augccugcaaucug

SEQ ID NO: 655203 - RNA, 13 nt, Homo sapiens
augccugguacca

SEQ ID NO: 655204 - RNA, 17 nt, Homo sapiens
augccugguaccagagg

SEQ ID NO: 655205 - RNA, 15 nt, Homo sapiens
augccuguaauccca

SEQ ID NO: 655206 - RNA, 17 nt, Homo sapiens
augccuguaaucccagc

SEQ ID NO: 655207 - RNA, 20 nt, Homo sapiens
augccuguggugaagugugg

SEQ ID NO: 655208 - RNA, 19 nt, Homo sapiens
augccuucacuuuacaaau

SEQ ID NO: 655209 - RNA, 22 nt, Homo sapiens
augccuucccccaguauguccu

SEQ ID NO: 655210 - RNA, 13 nt, Homo sapiens
augccuugcacac

SEQ ID NO: 655211 - RNA, 13 nt, Homo sapiens
augccuuggugcc

SEQ ID NO: 655212 - RNA, 16 nt, Homo sapiens
augcgcacaaggcuga

SEQ ID NO: 655213 - RNA, 17 nt, Homo sapiens
augcgccaccaugcccu

SEQ ID NO: 655214 - RNA, 14 nt, Homo sapiens
augcgggggugccu

SEQ ID NO: 655215 - RNA, 16 nt, Homo sapiens
augcgucaggggccua

SEQ ID NO: 655216 - RNA, 18 nt, Homo sapiens
augcgugugucagggaug

SEQ ID NO: 655217 - RNA, 15 nt, Homo sapiens
augcguucacuccaa

SEQ ID NO: 655218 - RNA, 20 nt, Homo sapiens
augcuaaauaguucuaucag

SEQ ID NO: 655219 - RNA, 15 nt, Homo sapiens
augcuaaucuugucc

SEQ ID NO: 655220 - RNA, 20 nt, Homo sapiens
augcuacuuuauuuauacac

SEQ ID NO: 655221 - RNA, 23 nt, Homo sapiens
augcuagaacaacgccugucaca

SEQ ID NO: 655222 - RNA, 13 nt, Homo sapiens
augcuauauugca

SEQ ID NO: 655223 - RNA, 19 nt, Homo sapiens
augcucaaacgcaacuguu

SEQ ID NO: 655224 - RNA, 13 nt, Homo sapiens
augcucaaucuca

SEQ ID NO: 655225 - RNA, 13 nt, Homo sapiens
augcucaccaagg

SEQ ID NO: 655226 - RNA, 14 nt, Homo sapiens
augcucacuuuauu

SEQ ID NO: 655227 - RNA, 19 nt, Homo sapiens
augcucagaccagcucuuc

SEQ ID NO: 655228 - RNA, 22 nt, Homo sapiens
augcucagcccugacuggugcu

SEQ ID NO: 655229 - RNA, 22 nt, Homo sapiens
augcucaguuggugcugcuuuc

SEQ ID NO: 655230 - RNA, 21 nt, Homo sapiens
augcuccaaauauaagacauu

SEQ ID NO: 655231 - RNA, 16 nt, Homo sapiens
augcuccagauuagag

SEQ ID NO: 655232 - RNA, 21 nt, Homo sapiens
augcuccaucccaaccaggca

SEQ ID NO: 655233 - RNA, 16 nt, Homo sapiens
augcucugcauguuac

SEQ ID NO: 655234 - RNA, 12 nt, Homo sapiens
augcucugugac

SEQ ID NO: 655235 - RNA, 16 nt, Homo sapiens
augcucuuuacuucau

SEQ ID NO: 655236 - RNA, 18 nt, Homo sapiens
augcucuuuucacagcua

SEQ ID NO: 655237 - RNA, 18 nt, Homo sapiens
augcugaaaaauauagcc

SEQ ID NO: 655238 - RNA, 22 nt, Homo sapiens
augcugaaaaauauagccuuua

SEQ ID NO: 655239 - RNA, 20 nt, Homo sapiens
auguuaauuauuuugacaaa

SEQ ID NO: 655240 - RNA, 23 nt, Homo sapiens
auguuaauugggcaggugaaaag

SEQ ID NO: 655241 - RNA, 21 nt, Homo sapiens
auguuaauuuuuugguacaaa

SEQ ID NO: 655242 - RNA, 21 nt, Homo sapiens
auguuacggcaucacacuuau

SEQ ID NO: 655243 - RNA, 17 nt, Homo sapiens
auguuacucucuugcac

SEQ ID NO: 655244 - RNA, 16 nt, Homo sapiens
auguuacugaccagca

SEQ ID NO: 655245 - RNA, 15 nt, Homo sapiens
auguuacugccuuaa

SEQ ID NO: 655246 - RNA, 21 nt, Homo sapiens
auguuagauuccucuugccuc

SEQ ID NO: 655247 - RNA, 13 nt, Homo sapiens
auguuagccuuag

SEQ ID NO: 655248 - RNA, 14 nt, Homo sapiens
auguuagccuuaga

SEQ ID NO: 655249 - RNA, 23 nt, Homo sapiens
auguuaggaaaauuucacauuaa

SEQ ID NO: 655250 - RNA, 20 nt, Homo sapiens
auguuaggccuaagaggcuu

SEQ ID NO: 655251 - RNA, 17 nt, Homo sapiens
auguuauagaacuucau

SEQ ID NO: 655252 - RNA, 13 nt, Homo sapiens
auguuaugcauaa

SEQ ID NO: 655253 - RNA, 20 nt, Homo sapiens
auguucaacuauuaauggau

SEQ ID NO: 655254 - RNA, 21 nt, Homo sapiens
auguucauuguaauguuacug

SEQ ID NO: 655255 - RNA, 22 nt, Homo sapiens
auguuccccaggauucagcuau

SEQ ID NO: 655256 - RNA, 19 nt, Homo sapiens
auguuccucugucaaugaa

SEQ ID NO: 655257 - RNA, 15 nt, Homo sapiens
auguucuaacagauc

SEQ ID NO: 655258 - RNA, 12 nt, Homo sapiens
auguucuuggcu

SEQ ID NO: 655259 - RNA, 19 nt, Homo sapiens
auguucuuuaaaggcaucu

SEQ ID NO: 655260 - RNA, 23 nt, Homo sapiens
auguucuuuuaaaugauugaauu

SEQ ID NO: 655261 - RNA, 17 nt, Homo sapiens
auguugaaagaucaaaa

SEQ ID NO: 655262 - RNA, 15 nt, Homo sapiens
auguugaccuuugag

SEQ ID NO: 655263 - RNA, 17 nt, Homo sapiens
auguugcaucccugaaa

SEQ ID NO: 655264 - RNA, 22 nt, Homo sapiens
auguugcauuuaugaugcaguu

SEQ ID NO: 655265 - RNA, 11 nt, Homo sapiens
auguugcccaa

SEQ ID NO: 655266 - RNA, 21 nt, Homo sapiens
auguugcccacauuaagcacu

SEQ ID NO: 655267 - RNA, 18 nt, Homo sapiens
auguugcuuuugcaccua

SEQ ID NO: 655268 - RNA, 19 nt, Homo sapiens
auguugguuucacugagag

SEQ ID NO: 655269 - RNA, 20 nt, Homo sapiens
auguuuaaauucucuuucac

SEQ ID NO: 655270 - RNA, 21 nt, Homo sapiens
auguuuauaaaucuuaugcuc

SEQ ID NO: 655271 - RNA, 17 nt, Homo sapiens
auguuuauuuacuaauu

SEQ ID NO: 655272 - RNA, 13 nt, Homo sapiens
auguuucaaaaaa

SEQ ID NO: 655273 - RNA, 21 nt, Homo sapiens
auguuuccacuggcuuuugcc

SEQ ID NO: 655274 - RNA, 16 nt, Homo sapiens
auguuuccuccaaauc

SEQ ID NO: 655275 - RNA, 21 nt, Homo sapiens
auguuucgaguaaacuugaaa

SEQ ID NO: 655276 - RNA, 15 nt, Homo sapiens
auguuucuacagaua

SEQ ID NO: 655277 - RNA, 24 nt, Homo sapiens
auguuugacaaaacacagccaagg

SEQ ID NO: 655278 - RNA, 14 nt, Homo sapiens
auguuugccaugag

SEQ ID NO: 655279 - RNA, 21 nt, Homo sapiens
auguuuggaaaaaacucugaa

SEQ ID NO: 655280 - RNA, 18 nt, Homo sapiens
auguuuggaauaaaguca

SEQ ID NO: 655281 - RNA, 22 nt, Homo sapiens
auguuuguaaauuaauacuuca

SEQ ID NO: 655282 - RNA, 13 nt, Homo sapiens
auguuugucagau

SEQ ID NO: 655283 - RNA, 19 nt, Homo sapiens
auguuuuaaauaguugcaa

SEQ ID NO: 655284 - RNA, 18 nt, Homo sapiens
auguuuucccuuuauuca

SEQ ID NO: 655285 - RNA, 21 nt, Homo sapiens
auguuuugguguauugucagc

SEQ ID NO: 655286 - RNA, 18 nt, Homo sapiens
auguuuuuugccacagcu

SEQ ID NO: 655287 - RNA, 13 nt, Homo sapiens
auuaaaaccaauu

SEQ ID NO: 655288 - RNA, 17 nt, Homo sapiens
auuaaaacuaagcacaa

SEQ ID NO: 655289 - RNA, 19 nt, Homo sapiens
auuaaaacuaagcacaaag

SEQ ID NO: 655290 - RNA, 14 nt, Homo sapiens
auuaaaacuaugaa

SEQ ID NO: 655291 - RNA, 23 nt, Homo sapiens
auuaaaagguaauuguagcacau

SEQ ID NO: 655292 - RNA, 17 nt, Homo sapiens
auuaaaauaaauguugu

SEQ ID NO: 655293 - RNA, 18 nt, Homo sapiens
auuaaaauuccaaauuca

SEQ ID NO: 655294 - RNA, 13 nt, Homo sapiens
auuaaacacugua

SEQ ID NO: 655295 - RNA, 14 nt, Homo sapiens
auuaaacauuacug

SEQ ID NO: 655296 - RNA, 15 nt, Homo sapiens
auuaaacguaugcau

SEQ ID NO: 655297 - RNA, 19 nt, Homo sapiens
auuaaacuugucagaauuu

SEQ ID NO: 655298 - RNA, 20 nt, Homo sapiens
auuaaacuugucagaauuuc

SEQ ID NO: 655299 - RNA, 23 nt, Homo sapiens
auuaaagaaagaaaaaugcugaa

SEQ ID NO: 655300 - RNA, 19 nt, Homo sapiens
auuaaagaauguuuuggaa

SEQ ID NO: 655301 - RNA, 11 nt, Homo sapiens
auuaaagucag

SEQ ID NO: 655302 - RNA, 17 nt, Homo sapiens
auuaaauacagacacua

SEQ ID NO: 655303 - RNA, 14 nt, Homo sapiens
auuaaaugugucau

SEQ ID NO: 655304 - RNA, 18 nt, Homo sapiens
auuaaauuaccuugccaa

SEQ ID NO: 655305 - RNA, 20 nt, Homo sapiens
auuaaauuuuagucagauuu

SEQ ID NO: 655306 - RNA, 20 nt, Homo sapiens
auuaacaacaauaacacugu

SEQ ID NO: 655307 - RNA, 19 nt, Homo sapiens
auuaacaguuuuccaugaa

SEQ ID NO: 655308 - RNA, 12 nt, Homo sapiens
auuaacauauag

SEQ ID NO: 655309 - RNA, 11 nt, Homo sapiens
auuaacuaauc

SEQ ID NO: 655310 - RNA, 12 nt, Homo sapiens
auuaacuugagu

SEQ ID NO: 655311 - RNA, 15 nt, Homo sapiens
auuaagacaugcacu

SEQ ID NO: 655312 - RNA, 16 nt, Homo sapiens
auuaagaggaugcugg

SEQ ID NO: 655313 - RNA, 13 nt, Homo sapiens
auuaagcacugug

SEQ ID NO: 655314 - RNA, 17 nt, Homo sapiens
auuaaguacaugugcca

SEQ ID NO: 655315 - RNA, 22 nt, Homo sapiens
auuaagucccuuuuaguuugau

SEQ ID NO: 655316 - RNA, 14 nt, Homo sapiens
auuaagugacuaua

SEQ ID NO: 655317 - RNA, 13 nt, Homo sapiens
auuaaguuaucuu

SEQ ID NO: 655318 - RNA, 23 nt, Homo sapiens
auuaaguuguuauuucaguuuua

SEQ ID NO: 655319 - RNA, 16 nt, Homo sapiens
auuaauaaaaaucaac

SEQ ID NO: 655320 - RNA, 20 nt, Homo sapiens
auuaauaaaagaguuaacau

SEQ ID NO: 655321 - RNA, 15 nt, Homo sapiens
auuaauaaagcauuc

SEQ ID NO: 655322 - RNA, 21 nt, Homo sapiens
auuaauaaagcauucuuuaac

SEQ ID NO: 655323 - RNA, 18 nt, Homo sapiens
auuaauaaucuuauuagg

SEQ ID NO: 655324 - RNA, 17 nt, Homo sapiens
auuaauacucugcagug

SEQ ID NO: 655325 - RNA, 13 nt, Homo sapiens
auuaauacugaag

SEQ ID NO: 655326 - RNA, 19 nt, Homo sapiens
auuaauauuuguuuaguuc

SEQ ID NO: 655327 - RNA, 15 nt, Homo sapiens
auuaaucaaguaccu

SEQ ID NO: 655328 - RNA, 16 nt, Homo sapiens
auuaauccacacauca

SEQ ID NO: 655329 - RNA, 18 nt, Homo sapiens
auuaaugauaaacucaga

SEQ ID NO: 655330 - RNA, 12 nt, Homo sapiens
auuaaugaugau

SEQ ID NO: 655331 - RNA, 15 nt, Homo sapiens
auuaaugcacuuucu

SEQ ID NO: 655332 - RNA, 23 nt, Homo sapiens
auuaauguuaauucagcacugau

SEQ ID NO: 655333 - RNA, 13 nt, Homo sapiens
auuaauguuuaca

SEQ ID NO: 655334 - RNA, 14 nt, Homo sapiens
auuaauuacauaca

SEQ ID NO: 655335 - RNA, 21 nt, Homo sapiens
auuaauuauauuucuacagag

SEQ ID NO: 655336 - RNA, 20 nt, Homo sapiens
auuaauucuauaaggccaua

SEQ ID NO: 655337 - RNA, 16 nt, Homo sapiens
auuaauugugugucac

SEQ ID NO: 655338 - RNA, 14 nt, Homo sapiens
auuaauuucagucu

SEQ ID NO: 655339 - RNA, 23 nt, Homo sapiens
auuaauuuggagcacaaaauuca

SEQ ID NO: 655340 - RNA, 23 nt, Homo sapiens
auuacaaauuuucacugcugcuc

SEQ ID NO: 655341 - RNA, 14 nt, Homo sapiens
auuacaaguggcuc

SEQ ID NO: 655342 - RNA, 14 nt, Homo sapiens
auuacaauugugag

SEQ ID NO: 655343 - RNA, 14 nt, Homo sapiens
auuacacucuguaa

SEQ ID NO: 655344 - RNA, 12 nt, Homo sapiens
auuacacugugc

SEQ ID NO: 655345 - RNA, 14 nt, Homo sapiens
auuacagaucugca

SEQ ID NO: 655346 - RNA, 17 nt, Homo sapiens
auuacaggcacgugcca

SEQ ID NO: 655347 - RNA, 20 nt, Homo sapiens
auuacaguacacauccccag

SEQ ID NO: 655348 - RNA, 23 nt, Homo sapiens
auuacaguauccaaugucuuuug

SEQ ID NO: 655349 - RNA, 15 nt, Homo sapiens
auuacaguguagcua

SEQ ID NO: 655350 - RNA, 22 nt, Homo sapiens
auuacauagaacacuucagaca

SEQ ID NO: 655351 - RNA, 14 nt, Homo sapiens
auuacauauuugac

SEQ ID NO: 655352 - RNA, 17 nt, Homo sapiens
auuacauggcugugguu

SEQ ID NO: 655353 - RNA, 23 nt, Homo sapiens
auuacauuccuaacuagaauuag

SEQ ID NO: 655354 - RNA, 18 nt, Homo sapiens
auuacauugcugccuuug

SEQ ID NO: 655355 - RNA, 21 nt, Homo sapiens
auuaccaaccuguuaccuacu

SEQ ID NO: 655356 - RNA, 14 nt, Homo sapiens
auuaccauuuguua

SEQ ID NO: 655357 - RNA, 14 nt, Homo sapiens
auuacccuuuugca

SEQ ID NO: 655358 - RNA, 12 nt, Homo sapiens
auuaccuucuau

SEQ ID NO: 655359 - RNA, 13 nt, Homo sapiens
auuacgugcaaua

SEQ ID NO: 655360 - RNA, 23 nt, Homo sapiens
auuacuaauaaauugacauaacc

SEQ ID NO: 655361 - RNA, 14 nt, Homo sapiens
auugaccucagcug

SEQ ID NO: 655362 - RNA, 22 nt, Homo sapiens
auugacgacuucacacuaugga

SEQ ID NO: 655363 - RNA, 21 nt, Homo sapiens
auugacucaaucuuugccuaa

SEQ ID NO: 655364 - RNA, 15 nt, Homo sapiens
auugacuccuuucca

SEQ ID NO: 655365 - RNA, 13 nt, Homo sapiens
auugacugucacg

SEQ ID NO: 655366 - RNA, 18 nt, Homo sapiens
auugacuuguuacaugaa

SEQ ID NO: 655367 - RNA, 18 nt, Homo sapiens
auugacuuugacaauuac

SEQ ID NO: 655368 - RNA, 16 nt, Homo sapiens
auugagaccugaguga

SEQ ID NO: 655369 - RNA, 17 nt, Homo sapiens
auugagccaguggugcu

SEQ ID NO: 655370 - RNA, 18 nt, Homo sapiens
auugagccuugcauguac

SEQ ID NO: 655371 - RNA, 14 nt, Homo sapiens
auugagcugcagaa

SEQ ID NO: 655372 - RNA, 16 nt, Homo sapiens
auugagcuguacaugc

SEQ ID NO: 655373 - RNA, 17 nt, Homo sapiens
auugaggagcugcacug

SEQ ID NO: 655374 - RNA, 15 nt, Homo sapiens
auugaggaguugccu

SEQ ID NO: 655375 - RNA, 23 nt, Homo sapiens
auugaggccaagaauauugcaaa

SEQ ID NO: 655376 - RNA, 17 nt, Homo sapiens
auugagggccagugaug

SEQ ID NO: 655377 - RNA, 15 nt, Homo sapiens
auugagggucauucu

SEQ ID NO: 655378 - RNA, 23 nt, Homo sapiens
auugauaaucuucaggugaacac

SEQ ID NO: 655379 - RNA, 22 nt, Homo sapiens
auugauacaugcauugcucuua

SEQ ID NO: 655380 - RNA, 22 nt, Homo sapiens
auugauagaaaucaggccuugc

SEQ ID NO: 655381 - RNA, 16 nt, Homo sapiens
auugauagaacuacuu

SEQ ID NO: 655382 - RNA, 18 nt, Homo sapiens
auugauagcagauaucac

SEQ ID NO: 655383 - RNA, 14 nt, Homo sapiens
auugauccaggaga

SEQ ID NO: 655384 - RNA, 23 nt, Homo sapiens
auugaucuguuuuaaguaugaga

SEQ ID NO: 655385 - RNA, 15 nt, Homo sapiens
auugaugagcaagac

SEQ ID NO: 655386 - RNA, 17 nt, Homo sapiens
auugauggaugucuucu

SEQ ID NO: 655387 - RNA, 16 nt, Homo sapiens
auugauguuaacaaga

SEQ ID NO: 655388 - RNA, 21 nt, Homo sapiens
auugauguuuuacgugcaaac

SEQ ID NO: 655389 - RNA, 22 nt, Homo sapiens
auugauguuuuacgugcaaaca

SEQ ID NO: 655390 - RNA, 13 nt, Homo sapiens
auugauuacaauu

SEQ ID NO: 655391 - RNA, 19 nt, Homo sapiens
auugcacagagcacacuua

SEQ ID NO: 655392 - RNA, 22 nt, Homo sapiens
auugcacauaguucugcccaaa

SEQ ID NO: 655393 - RNA, 19 nt, Homo sapiens
auugcacucuagccuggca

SEQ ID NO: 655394 - RNA, 12 nt, Homo sapiens
auugcacugcug

SEQ ID NO: 655395 - RNA, 20 nt, Homo sapiens
auugcacuuggccucaugcu

SEQ ID NO: 655396 - RNA, 16 nt, Homo sapiens
auugcagaauucaaaa

SEQ ID NO: 655397 - RNA, 17 nt, Homo sapiens
auugcagaccugucacc

SEQ ID NO: 655398 - RNA, 18 nt, Homo sapiens
auugcagcaggugguaau

SEQ ID NO: 655399 - RNA, 14 nt, Homo sapiens
auugcagcauuuau

SEQ ID NO: 655400 - RNA, 17 nt, Homo sapiens
auugcaguuucauguau

SEQ ID NO: 655401 - RNA, 23 nt, Homo sapiens
auugcauuuaaaaauauauagcu

SEQ ID NO: 655402 - RNA, 15 nt, Homo sapiens
auugcauuuauaugu

SEQ ID NO: 655403 - RNA, 12 nt, Homo sapiens
auugccaaaaag

SEQ ID NO: 655404 - RNA, 19 nt, Homo sapiens
auugccacaaguccagcug

SEQ ID NO: 655405 - RNA, 16 nt, Homo sapiens
auugcccgaaaccaga

SEQ ID NO: 655406 - RNA, 18 nt, Homo sapiens
auugccuacaauaaaaag

SEQ ID NO: 655407 - RNA, 16 nt, Homo sapiens
auugccuauaauacuu

SEQ ID NO: 655408 - RNA, 19 nt, Homo sapiens
auugccuuauuugucugua

SEQ ID NO: 655409 - RNA, 15 nt, Homo sapiens
auugcuagauaaaag

SEQ ID NO: 655410 - RNA, 15 nt, Homo sapiens
auugcuaguuuauuu

SEQ ID NO: 655411 - RNA, 14 nt, Homo sapiens
auugcucucagugc

SEQ ID NO: 655412 - RNA, 24 nt, Homo sapiens
auugcucuucuccacgucuuuccu

SEQ ID NO: 655413 - RNA, 13 nt, Homo sapiens
auugcugacuuua

SEQ ID NO: 655414 - RNA, 13 nt, Homo sapiens
auugcugccaaga

SEQ ID NO: 655415 - RNA, 22 nt, Homo sapiens
auugcugccccaucagugcucc

SEQ ID NO: 655416 - RNA, 17 nt, Homo sapiens
auugcuggaaaccaagu

SEQ ID NO: 655417 - RNA, 15 nt, Homo sapiens
auugcuggaacccag

SEQ ID NO: 655418 - RNA, 20 nt, Homo sapiens
auugcuggcaucugugcuaa

SEQ ID NO: 655419 - RNA, 17 nt, Homo sapiens
auugcuuaaaagacauu

SEQ ID NO: 655420 - RNA, 18 nt, Homo sapiens
auugcuuaccugaucuca

SEQ ID NO: 655421 - RNA, 18 nt, Homo sapiens
auugcuucaauaauauua

SEQ ID NO: 655422 - RNA, 21 nt, Homo sapiens
auugcuucaauaauauuagcu

SEQ ID NO: 655423 - RNA, 15 nt, Homo sapiens
auugcuugagccugg

SEQ ID NO: 655424 - RNA, 16 nt, Homo sapiens
auugcuuuuccauuuc

SEQ ID NO: 655425 - RNA, 19 nt, Homo sapiens
auuggaacagaauguuuua

SEQ ID NO: 655426 - RNA, 21 nt, Homo sapiens
auuggaauaaaauugauucau

SEQ ID NO: 655427 - RNA, 15 nt, Homo sapiens
auuggaccuguucaa

SEQ ID NO: 655428 - RNA, 23 nt, Homo sapiens
auuggagucacugccaagucaua

SEQ ID NO: 655429 - RNA, 15 nt, Homo sapiens
auuggauuuccuaau

SEQ ID NO: 655430 - RNA, 21 nt, Homo sapiens
auuggcaaacuuuguauuaau

SEQ ID NO: 655431 - RNA, 23 nt, Homo sapiens
auuggccacugggucucacuccu

SEQ ID NO: 655432 - RNA, 15 nt, Homo sapiens
auuggccuguucccc

SEQ ID NO: 655433 - RNA, 17 nt, Homo sapiens
auuggcuaugaugguga

SEQ ID NO: 655434 - RNA, 21 nt, Homo sapiens
auuggcuaugauggugacaug

SEQ ID NO: 655435 - RNA, 13 nt, Homo sapiens
auuggcugagaua

SEQ ID NO: 655436 - RNA, 20 nt, Homo sapiens
auuggcugguaacaguucau

SEQ ID NO: 655437 - RNA, 22 nt, Homo sapiens
auuggcuuuucauagugcucag

SEQ ID NO: 655438 - RNA, 21 nt, Homo sapiens
auugggagcaugggaggggag

SEQ ID NO: 655439 - RNA, 16 nt, Homo sapiens
auugggaguccaggca

SEQ ID NO: 655440 - RNA, 19 nt, Homo sapiens
auugggcuugugauuucca

SEQ ID NO: 655441 - RNA, 21 nt, Homo sapiens
auugggcuugugauuuccauu

SEQ ID NO: 655442 - RNA, 15 nt, Homo sapiens
auugggggacguggg

SEQ ID NO: 655443 - RNA, 17 nt, Homo sapiens
auuggguucaaggaauc

SEQ ID NO: 655444 - RNA, 24 nt, Homo sapiens
auuggguuuugcuuuagagugcaa

SEQ ID NO: 655445 - RNA, 20 nt, Homo sapiens
auugguauacuuuugcuuca

SEQ ID NO: 655446 - RNA, 21 nt, Homo sapiens
auugguccgaucuuugacucu

SEQ ID NO: 655447 - RNA, 17 nt, Homo sapiens
auuggugcauagcagau

SEQ ID NO: 655448 - RNA, 20 nt, Homo sapiens
auugguggcagauuuuacaa

SEQ ID NO: 655449 - RNA, 16 nt, Homo sapiens
auugguuuaguucuua

SEQ ID NO: 655450 - RNA, 14 nt, Homo sapiens
auuguaaacaugug

SEQ ID NO: 655451 - RNA, 17 nt, Homo sapiens
auuguaaauacuggacu

SEQ ID NO: 655452 - RNA, 18 nt, Homo sapiens
auuguaacaauagcacaa

SEQ ID NO: 655453 - RNA, 13 nt, Homo sapiens
auuguaacgacuu

SEQ ID NO: 655454 - RNA, 20 nt, Homo sapiens
auuguaacuaauacuacugu

SEQ ID NO: 655455 - RNA, 15 nt, Homo sapiens
auuguaagaaauacu

SEQ ID NO: 655456 - RNA, 12 nt, Homo sapiens
auuguaauauua

SEQ ID NO: 655457 - RNA, 14 nt, Homo sapiens
auuguacagaauca

SEQ ID NO: 655458 - RNA, 21 nt, Homo sapiens
auuguacauauuuguggaaua

SEQ ID NO: 655459 - RNA, 18 nt, Homo sapiens
auuguacaugguacgaau

SEQ ID NO: 655460 - RNA, 14 nt, Homo sapiens
auuguaccaugaaa

SEQ ID NO: 655461 - RNA, 13 nt, Homo sapiens
auuguagccucaa

SEQ ID NO: 655462 - RNA, 15 nt, Homo sapiens
auuguagugcaaaau

SEQ ID NO: 655463 - RNA, 20 nt, Homo sapiens
auuguaucaaaugugacauu

SEQ ID NO: 655464 - RNA, 21 nt, Homo sapiens
auuguaucaaguggcaugugc

SEQ ID NO: 655465 - RNA, 17 nt, Homo sapiens
auuguauuugugacuuu

SEQ ID NO: 655466 - RNA, 23 nt, Homo sapiens
auugucaaauguaaauuuacuga

SEQ ID NO: 655467 - RNA, 15 nt, Homo sapiens
auugucaacacuaua

SEQ ID NO: 655468 - RNA, 16 nt, Homo sapiens
auugucagaguucugc

SEQ ID NO: 655469 - RNA, 19 nt, Homo sapiens
auugucagcuacuaaugau

SEQ ID NO: 655470 - RNA, 18 nt, Homo sapiens
auuguccauuacuugcca

SEQ ID NO: 655471 - RNA, 18 nt, Homo sapiens
auuguccccuaaaccaaa

SEQ ID NO: 655472 - RNA, 17 nt, Homo sapiens
auuguccucuuugacua

SEQ ID NO: 655473 - RNA, 16 nt, Homo sapiens
auugucuuaaaaccag

SEQ ID NO: 655474 - RNA, 16 nt, Homo sapiens
auugugaaguacauau

SEQ ID NO: 655475 - RNA, 21 nt, Homo sapiens
auugugaauaaaaauugauga

SEQ ID NO: 655476 - RNA, 15 nt, Homo sapiens
auugugauuagacag

SEQ ID NO: 655477 - RNA, 14 nt, Homo sapiens
auugugcacuguau

SEQ ID NO: 655478 - RNA, 16 nt, Homo sapiens
auugugcuucacagua

SEQ ID NO: 655479 - RNA, 14 nt, Homo sapiens
auuguggucauuuc

SEQ ID NO: 655480 - RNA, 18 nt, Homo sapiens
auuguguaauugauuuau

SEQ ID NO: 655481 - RNA, 18 nt, Homo sapiens
auugugucauagaauuaa

SEQ ID NO: 655482 - RNA, 20 nt, Homo sapiens
auugugugaguguaccauaa

SEQ ID NO: 655483 - RNA, 13 nt, Homo sapiens
caaacacacugua

SEQ ID NO: 655484 - RNA, 18 nt, Homo sapiens
caaacacaggauuuguaa

SEQ ID NO: 655485 - RNA, 17 nt, Homo sapiens
caaacacaguuacacuu

SEQ ID NO: 655486 - RNA, 18 nt, Homo sapiens
caaacacaguuacacuug

SEQ ID NO: 655487 - RNA, 13 nt, Homo sapiens
caaacaccaguca

SEQ ID NO: 655488 - RNA, 13 nt, Homo sapiens
caaacaccuucca

SEQ ID NO: 655489 - RNA, 22 nt, Homo sapiens
caaacacuagcucuguauuaau

SEQ ID NO: 655490 - RNA, 18 nt, Homo sapiens
caaacacugcaguuuccu

SEQ ID NO: 655491 - RNA, 12 nt, Homo sapiens
caaacagaacua

SEQ ID NO: 655492 - RNA, 17 nt, Homo sapiens
caaacagaacuauggaa

SEQ ID NO: 655493 - RNA, 18 nt, Homo sapiens
caaacagaccccuguuca

SEQ ID NO: 655494 - RNA, 13 nt, Homo sapiens
caaacagcaagaa

SEQ ID NO: 655495 - RNA, 23 nt, Homo sapiens
caaacagccccucuggacacagc

SEQ ID NO: 655496 - RNA, 14 nt, Homo sapiens
caaacaggaacacu

SEQ ID NO: 655497 - RNA, 18 nt, Homo sapiens
caaacagggcaaaguguu

SEQ ID NO: 655498 - RNA, 11 nt, Homo sapiens
caaacauauuc

SEQ ID NO: 655499 - RNA, 23 nt, Homo sapiens
caaacaugcggugccaugaaggg

SEQ ID NO: 655500 - RNA, 20 nt, Homo sapiens
caaacauguuguacauuuca

SEQ ID NO: 655501 - RNA, 14 nt, Homo sapiens
caaacauuugccaa

SEQ ID NO: 655502 - RNA, 13 nt, Homo sapiens
caaaccaagccau

SEQ ID NO: 655503 - RNA, 22 nt, Homo sapiens
caaaccacuucuccaugcugca

SEQ ID NO: 655504 - RNA, 23 nt, Homo sapiens
caaaccagcccuugagucuguca

SEQ ID NO: 655505 - RNA, 13 nt, Homo sapiens
caaaccaggauuu

SEQ ID NO: 655506 - RNA, 17 nt, Homo sapiens
caaaccaggauuuccuu

SEQ ID NO: 655507 - RNA, 16 nt, Homo sapiens
caaaccaggugcaauu

SEQ ID NO: 655508 - RNA, 15 nt, Homo sapiens
caaaccauugcucuu

SEQ ID NO: 655509 - RNA, 14 nt, Homo sapiens
caaaccauuuccaa

SEQ ID NO: 655510 - RNA, 14 nt, Homo sapiens
caaacccagucuca

SEQ ID NO: 655511 - RNA, 21 nt, Homo sapiens
caaaccuaaaaucuguuuuuc

SEQ ID NO: 655512 - RNA, 14 nt, Homo sapiens
caaaccuaccaaaa

SEQ ID NO: 655513 - RNA, 15 nt, Homo sapiens
caaaccuaccaaaau

SEQ ID NO: 655514 - RNA, 22 nt, Homo sapiens
caaaccuggauuuuuuauguac

SEQ ID NO: 655515 - RNA, 22 nt, Homo sapiens
caaaccuucugccuuugauguu

SEQ ID NO: 655516 - RNA, 15 nt, Homo sapiens
caaaccuuucuggcc

SEQ ID NO: 655517 - RNA, 22 nt, Homo sapiens
caaaccuuuuguucuguaaaac

SEQ ID NO: 655518 - RNA, 19 nt, Homo sapiens
caaacuacaauuaaaacua

SEQ ID NO: 655519 - RNA, 13 nt, Homo sapiens
caaacuacuucau

SEQ ID NO: 655520 - RNA, 21 nt, Homo sapiens
caaacucacacaaccaugacg

SEQ ID NO: 655521 - RNA, 19 nt, Homo sapiens
caaacucaccuugucucau

SEQ ID NO: 655522 - RNA, 12 nt, Homo sapiens
caaacucagugc

SEQ ID NO: 655523 - RNA, 18 nt, Homo sapiens
caaacucauccucuuuua

SEQ ID NO: 655524 - RNA, 17 nt, Homo sapiens
caaacuccugaccucaa

SEQ ID NO: 655525 - RNA, 20 nt, Homo sapiens
caaacuccugggcucaagug

SEQ ID NO: 655526 - RNA, 21 nt, Homo sapiens
caaacuccugggcucaaguga

SEQ ID NO: 655527 - RNA, 12 nt, Homo sapiens
caaacugaucua

SEQ ID NO: 655528 - RNA, 22 nt, Homo sapiens
caaacugccuauauugauaaaa

SEQ ID NO: 655529 - RNA, 11 nt, Homo sapiens
caaacugccuu

SEQ ID NO: 655530 - RNA, 21 nt, Homo sapiens
caaacugcuuuuuccaacuca

SEQ ID NO: 655531 - RNA, 23 nt, Homo sapiens
caaacuguuuugacaaaugagca

SEQ ID NO: 655532 - RNA, 14 nt, Homo sapiens
caaacuuauggaca

SEQ ID NO: 655533 - RNA, 19 nt, Homo sapiens
caaacuuauggacacugcc

SEQ ID NO: 655534 - RNA, 16 nt, Homo sapiens
caaacuucagacugaa

SEQ ID NO: 655535 - RNA, 22 nt, Homo sapiens
caaacuuggauacuuggauuua

SEQ ID NO: 655536 - RNA, 19 nt, Homo sapiens
caaacuugggcccuucccu

SEQ ID NO: 655537 - RNA, 16 nt, Homo sapiens
caaacuuuuauacucu

SEQ ID NO: 655538 - RNA, 20 nt, Homo sapiens
caaacuuuuuccagcaaaau

SEQ ID NO: 655539 - RNA, 20 nt, Homo sapiens
caaagaaaaaaaaaaaagcc

SEQ ID NO: 655540 - RNA, 22 nt, Homo sapiens
caaagaaaaugaaaugcauauu

SEQ ID NO: 655541 - RNA, 14 nt, Homo sapiens
caaagaaaguguau

SEQ ID NO: 655542 - RNA, 18 nt, Homo sapiens
caaagaaaugcugaugga

SEQ ID NO: 655543 - RNA, 14 nt, Homo sapiens
caaagaacaucugc

SEQ ID NO: 655544 - RNA, 21 nt, Homo sapiens
caaagaaccccucugucuuca

SEQ ID NO: 655545 - RNA, 20 nt, Homo sapiens
caaagaauuacaguacacau

SEQ ID NO: 655546 - RNA, 17 nt, Homo sapiens
caaagaauuccaaagca

SEQ ID NO: 655547 - RNA, 22 nt, Homo sapiens
caaagacacaagcaaccaaugg

SEQ ID NO: 655548 - RNA, 15 nt, Homo sapiens
caaagaccaccucca

SEQ ID NO: 655549 - RNA, 13 nt, Homo sapiens
caaagacucugag

SEQ ID NO: 655550 - RNA, 23 nt, Homo sapiens
caaagacugaguacguugugcau

SEQ ID NO: 655551 - RNA, 14 nt, Homo sapiens
caaagacuguacug

SEQ ID NO: 655552 - RNA, 22 nt, Homo sapiens
caaagacuuaagcccagugcac

SEQ ID NO: 655553 - RNA, 12 nt, Homo sapiens
caaagagacagc

SEQ ID NO: 655554 - RNA, 13 nt, Homo sapiens
caaagaggcugcc

SEQ ID NO: 655555 - RNA, 17 nt, Homo sapiens
caaagagguaacugagg

SEQ ID NO: 655556 - RNA, 18 nt, Homo sapiens
caaagagguacaaaaaag

SEQ ID NO: 655557 - RNA, 17 nt, Homo sapiens
caaagauagauggcuga

SEQ ID NO: 655558 - RNA, 17 nt, Homo sapiens
caaagauauauacacag

SEQ ID NO: 655559 - RNA, 18 nt, Homo sapiens
caaagauauuuucaggau

SEQ ID NO: 655560 - RNA, 17 nt, Homo sapiens
caaagauccccaaaaca

SEQ ID NO: 655561 - RNA, 14 nt, Homo sapiens
caaagaugacuggu

SEQ ID NO: 655562 - RNA, 13 nt, Homo sapiens
caaagauguucau

SEQ ID NO: 655563 - RNA, 14 nt, Homo sapiens
caaagcaaaggcag

SEQ ID NO: 655564 - RNA, 18 nt, Homo sapiens
caaagcacaguuugaaca

SEQ ID NO: 655565 - RNA, 23 nt, Homo sapiens
caaagcagccacgaggugcaaca

SEQ ID NO: 655566 - RNA, 22 nt, Homo sapiens
caaagcaggaauugguggcaga

SEQ ID NO: 655567 - RNA, 18 nt, Homo sapiens
caaagcauggacauuuag

SEQ ID NO: 655568 - RNA, 13 nt, Homo sapiens
caaagccaaaacc

SEQ ID NO: 655569 - RNA, 18 nt, Homo sapiens
caaagccaaacucugcca

SEQ ID NO: 655570 - RNA, 23 nt, Homo sapiens
caaagccacacucugggcuccag

SEQ ID NO: 655571 - RNA, 18 nt, Homo sapiens
caaagccaccacauuuag

SEQ ID NO: 655572 - RNA, 14 nt, Homo sapiens
caaagccaugccaa

SEQ ID NO: 655573 - RNA, 22 nt, Homo sapiens
caaagcccugguaaaagggaua

SEQ ID NO: 655574 - RNA, 23 nt, Homo sapiens
caaagccuuaucaagugucuucc

SEQ ID NO: 655575 - RNA, 14 nt, Homo sapiens
caaagccuuuccag

SEQ ID NO: 655576 - RNA, 22 nt, Homo sapiens
caaagcguuucuuuacuucuca

SEQ ID NO: 655577 - RNA, 21 nt, Homo sapiens
caaagcuguuggccucugcaa

SEQ ID NO: 655578 - RNA, 19 nt, Homo sapiens
caaagcuuacaacauuuag

SEQ ID NO: 655579 - RNA, 23 nt, Homo sapiens
caaaggaagcauacuugugaacu

SEQ ID NO: 655580 - RNA, 18 nt, Homo sapiens
caaaggacaugaacagac

SEQ ID NO: 655581 - RNA, 18 nt, Homo sapiens
caaaggagaagcacagcu

SEQ ID NO: 655582 - RNA, 13 nt, Homo sapiens
caaaggagccuug

SEQ ID NO: 655583 - RNA, 14 nt, Homo sapiens
caaaggagcuuucu

SEQ ID NO: 655584 - RNA, 23 nt, Homo sapiens
caaaggaucuuauuuugugaacu

SEQ ID NO: 655585 - RNA, 20 nt, Homo sapiens
caaaggcaagcguauaucaa

SEQ ID NO: 655586 - RNA, 23 nt, Homo sapiens
caaaggccuaauucuaugccugu

SEQ ID NO: 655587 - RNA, 14 nt, Homo sapiens
caaagggaugagcc

SEQ ID NO: 655588 - RNA, 15 nt, Homo sapiens
caaagggcaguuuug

SEQ ID NO: 655589 - RNA, 22 nt, Homo sapiens
caaaggugccucauagcauagc

SEQ ID NO: 655590 - RNA, 14 nt, Homo sapiens
caaaggugcuaaau

SEQ ID NO: 655591 - RNA, 19 nt, Homo sapiens
caaagguuccaacuguaua

SEQ ID NO: 655592 - RNA, 15 nt, Homo sapiens
caaagguugcagugc

SEQ ID NO: 655593 - RNA, 17 nt, Homo sapiens
caaagguuuauuccaga

SEQ ID NO: 655594 - RNA, 11 nt, Homo sapiens
caaaguaccuu

SEQ ID NO: 655595 - RNA, 14 nt, Homo sapiens
caaaguacucuuua

SEQ ID NO: 655596 - RNA, 15 nt, Homo sapiens
caaaguacuugucau

SEQ ID NO: 655597 - RNA, 15 nt, Homo sapiens
caaaguagcaauuuc

SEQ ID NO: 655598 - RNA, 14 nt, Homo sapiens
caaaguaucuaaca

SEQ ID NO: 655599 - RNA, 12 nt, Homo sapiens
caaagucauccc

SEQ ID NO: 655600 - RNA, 21 nt, Homo sapiens
caaagucccuuccugcuuccu

SEQ ID NO: 655601 - RNA, 19 nt, Homo sapiens
caaaguccucugcuccagc

SEQ ID NO: 655602 - RNA, 18 nt, Homo sapiens
caaaguccuuuuuuucca

SEQ ID NO: 655603 - RNA, 20 nt, Homo sapiens
caaagugacuguuuggcuua

SEQ ID NO: 655604 - RNA, 20 nt, Homo sapiens
caaagugagacuccgucaca

SEQ ID NO: 655605 - RNA, 12 nt, Homo sapiens
cagagagucaau

SEQ ID NO: 655606 - RNA, 17 nt, Homo sapiens
cagagagucaaugucau

SEQ ID NO: 655607 - RNA, 17 nt, Homo sapiens
cagagaguccucuggau

SEQ ID NO: 655608 - RNA, 13 nt, Homo sapiens
cagagauguuaaa

SEQ ID NO: 655609 - RNA, 16 nt, Homo sapiens
cagagcaagacuccau

SEQ ID NO: 655610 - RNA, 22 nt, Homo sapiens
cagagcaaguuccugagugcgu

SEQ ID NO: 655611 - RNA, 11 nt, Homo sapiens
cagagcacaaa

SEQ ID NO: 655612 - RNA, 19 nt, Homo sapiens
cagagcacaggagcugcca

SEQ ID NO: 655613 - RNA, 11 nt, Homo sapiens
cagagcacuug

SEQ ID NO: 655614 - RNA, 17 nt, Homo sapiens
cagagcagaugaggaaa

SEQ ID NO: 655615 - RNA, 23 nt, Homo sapiens
cagagcaggaagcauucagagag

SEQ ID NO: 655616 - RNA, 15 nt, Homo sapiens
cagagcauacaacag

SEQ ID NO: 655617 - RNA, 13 nt, Homo sapiens
cagagcauuucaa

SEQ ID NO: 655618 - RNA, 11 nt, Homo sapiens
cagagccacag

SEQ ID NO: 655619 - RNA, 15 nt, Homo sapiens
cagagcccaagggaa

SEQ ID NO: 655620 - RNA, 19 nt, Homo sapiens
cagagcccaaggucaggga

SEQ ID NO: 655621 - RNA, 20 nt, Homo sapiens
cagagcccaaggucagggag

SEQ ID NO: 655622 - RNA, 15 nt, Homo sapiens
cagagcccaccagcc

SEQ ID NO: 655623 - RNA, 20 nt, Homo sapiens
cagagcccuucacugccaug

SEQ ID NO: 655624 - RNA, 21 nt, Homo sapiens
cagagccuacagaagggcagu

SEQ ID NO: 655625 - RNA, 13 nt, Homo sapiens
cagagccuaccuu

SEQ ID NO: 655626 - RNA, 23 nt, Homo sapiens
cagagccuugagagacccagcug

SEQ ID NO: 655627 - RNA, 23 nt, Homo sapiens
cagagcggaaggagggagcucug

SEQ ID NO: 655628 - RNA, 15 nt, Homo sapiens
cagagcucaccaggc

SEQ ID NO: 655629 - RNA, 19 nt, Homo sapiens
cagagcucuuuaccaagga

SEQ ID NO: 655630 - RNA, 16 nt, Homo sapiens
cagagcugagcccuca

SEQ ID NO: 655631 - RNA, 12 nt, Homo sapiens
cagagcugagga

SEQ ID NO: 655632 - RNA, 13 nt, Homo sapiens
cagagcugggaaa

SEQ ID NO: 655633 - RNA, 17 nt, Homo sapiens
cagagcugugccugcuc

SEQ ID NO: 655634 - RNA, 21 nt, Homo sapiens
cagagcuguggaggauugcua

SEQ ID NO: 655635 - RNA, 14 nt, Homo sapiens
cagagcuuuggcca

SEQ ID NO: 655636 - RNA, 16 nt, Homo sapiens
cagaggaaauucuuuc

SEQ ID NO: 655637 - RNA, 17 nt, Homo sapiens
cagaggaagagacauga

SEQ ID NO: 655638 - RNA, 17 nt, Homo sapiens
cagaggagaugugguca

SEQ ID NO: 655639 - RNA, 19 nt, Homo sapiens
cagaggagccaccaguucu

SEQ ID NO: 655640 - RNA, 15 nt, Homo sapiens
cagaggaugucacaa

SEQ ID NO: 655641 - RNA, 21 nt, Homo sapiens
cagaggauuuaacugugaacc

SEQ ID NO: 655642 - RNA, 14 nt, Homo sapiens
cagaggccaagagu

SEQ ID NO: 655643 - RNA, 15 nt, Homo sapiens
cagaggccauggcag

SEQ ID NO: 655644 - RNA, 20 nt, Homo sapiens
cagaggcugcaaggauucag

SEQ ID NO: 655645 - RNA, 15 nt, Homo sapiens
cagaggcuggaccac

SEQ ID NO: 655646 - RNA, 19 nt, Homo sapiens
cagaggcuggcacugagcc

SEQ ID NO: 655647 - RNA, 13 nt, Homo sapiens
cagaggcuuuaaa

SEQ ID NO: 655648 - RNA, 23 nt, Homo sapiens
cagagggaaaguaaauauuucag

SEQ ID NO: 655649 - RNA, 20 nt, Homo sapiens
cagaggggcugcuccagugg

SEQ ID NO: 655650 - RNA, 19 nt, Homo sapiens
cagagggggaguagccaag

SEQ ID NO: 655651 - RNA, 13 nt, Homo sapiens
cagagggugaaag

SEQ ID NO: 655652 - RNA, 22 nt, Homo sapiens
cagagggugggguacuggaguu

SEQ ID NO: 655653 - RNA, 18 nt, Homo sapiens
cagagguaaaagugugag

SEQ ID NO: 655654 - RNA, 23 nt, Homo sapiens
cagagguaaaagugugagcagug

SEQ ID NO: 655655 - RNA, 13 nt, Homo sapiens
cagaggucuccca

SEQ ID NO: 655656 - RNA, 21 nt, Homo sapiens
cagagguuaucugucugcauu

SEQ ID NO: 655657 - RNA, 21 nt, Homo sapiens
cagagguucauuucaaauaca

SEQ ID NO: 655658 - RNA, 16 nt, Homo sapiens
cagagguugcagugag

SEQ ID NO: 655659 - RNA, 19 nt, Homo sapiens
cagagguugcagugagcug

SEQ ID NO: 655660 - RNA, 23 nt, Homo sapiens
cagagguuucuggcagccaguac

SEQ ID NO: 655661 - RNA, 14 nt, Homo sapiens
cagagguuucuuga

SEQ ID NO: 655662 - RNA, 13 nt, Homo sapiens
cagaguccacugu

SEQ ID NO: 655663 - RNA, 16 nt, Homo sapiens
cagagucuguuucagg

SEQ ID NO: 655664 - RNA, 19 nt, Homo sapiens
cagagucuucagagacuuc

SEQ ID NO: 655665 - RNA, 14 nt, Homo sapiens
cagagugcuuuaaa

SEQ ID NO: 655666 - RNA, 18 nt, Homo sapiens
cagaguggacuuguguuu

SEQ ID NO: 655667 - RNA, 18 nt, Homo sapiens
cagagugugcagacugau

SEQ ID NO: 655668 - RNA, 15 nt, Homo sapiens
cagaguguucccuga

SEQ ID NO: 655669 - RNA, 22 nt, Homo sapiens
cagaguuggacuucuagacuca

SEQ ID NO: 655670 - RNA, 14 nt, Homo sapiens
cagaguuguugcuu

SEQ ID NO: 655671 - RNA, 20 nt, Homo sapiens
cagaguuucucucuguugcc

SEQ ID NO: 655672 - RNA, 13 nt, Homo sapiens
cagaguuugccuu

SEQ ID NO: 655673 - RNA, 14 nt, Homo sapiens
cagaguuugccuuc

SEQ ID NO: 655674 - RNA, 12 nt, Homo sapiens
cagaguuugugu

SEQ ID NO: 655675 - RNA, 18 nt, Homo sapiens
cagaguuuguguguauuu

SEQ ID NO: 655676 - RNA, 21 nt, Homo sapiens
cagauaaaauguucagugcaa

SEQ ID NO: 655677 - RNA, 14 nt, Homo sapiens
cagauaacuuugac

SEQ ID NO: 655678 - RNA, 14 nt, Homo sapiens
cagauaauuggcaa

SEQ ID NO: 655679 - RNA, 22 nt, Homo sapiens
cagauacagggugcuccuuguc

SEQ ID NO: 655680 - RNA, 13 nt, Homo sapiens
cagauacauuucc

SEQ ID NO: 655681 - RNA, 12 nt, Homo sapiens
cagauaccucca

SEQ ID NO: 655682 - RNA, 13 nt, Homo sapiens
cagauaccuccaa

SEQ ID NO: 655683 - RNA, 16 nt, Homo sapiens
cagauagacagugcug

SEQ ID NO: 655684 - RNA, 18 nt, Homo sapiens
cagauagagaaauaguga

SEQ ID NO: 655685 - RNA, 18 nt, Homo sapiens
cagauagauauaugcucu

SEQ ID NO: 655686 - RNA, 18 nt, Homo sapiens
cagauagaugcaggucca

SEQ ID NO: 655687 - RNA, 15 nt, Homo sapiens
cagauaggauggggu

SEQ ID NO: 655688 - RNA, 22 nt, Homo sapiens
cagauauaagagaagucucauu

SEQ ID NO: 655689 - RNA, 22 nt, Homo sapiens
cagauauauacacacaguggau

SEQ ID NO: 655690 - RNA, 14 nt, Homo sapiens
cagauaugcuuacu

SEQ ID NO: 655691 - RNA, 16 nt, Homo sapiens
cagauauuuuguucuu

SEQ ID NO: 655692 - RNA, 19 nt, Homo sapiens
cagaucaacagcaaccucu

SEQ ID NO: 655693 - RNA, 21 nt, Homo sapiens
cagaucaagaaaaaaagggag

SEQ ID NO: 655694 - RNA, 15 nt, Homo sapiens
cagaucaccaccuga

SEQ ID NO: 655695 - RNA, 14 nt, Homo sapiens
cagaucacugccac

SEQ ID NO: 655696 - RNA, 19 nt, Homo sapiens
cagaucacugccacacucu

SEQ ID NO: 655697 - RNA, 16 nt, Homo sapiens
cagaucauauuucaca

SEQ ID NO: 655698 - RNA, 17 nt, Homo sapiens
cagaucauauuucacaa

SEQ ID NO: 655699 - RNA, 15 nt, Homo sapiens
cagaucccacuggaa

SEQ ID NO: 655700 - RNA, 15 nt, Homo sapiens
cagaucccacuugca

SEQ ID NO: 655701 - RNA, 20 nt, Homo sapiens
cagaucccacuugcagccuc

SEQ ID NO: 655702 - RNA, 23 nt, Homo sapiens
cagaucccagcuucggcauuuga

SEQ ID NO: 655703 - RNA, 14 nt, Homo sapiens
cagauccucaagca

SEQ ID NO: 655704 - RNA, 17 nt, Homo sapiens
cagauccucaagcagac

SEQ ID NO: 655705 - RNA, 11 nt, Homo sapiens
cagauccugca

SEQ ID NO: 655706 - RNA, 15 nt, Homo sapiens
cagaucucccacugc

SEQ ID NO: 655707 - RNA, 19 nt, Homo sapiens
cagaucugucuccaagacc

SEQ ID NO: 655708 - RNA, 17 nt, Homo sapiens
cagaucuuugcugccag

SEQ ID NO: 655709 - RNA, 22 nt, Homo sapiens
cagaucuuugcugccagccacu

SEQ ID NO: 655710 - RNA, 21 nt, Homo sapiens
cagaugaaauuuauuuccauc

SEQ ID NO: 655711 - RNA, 16 nt, Homo sapiens
cagaugaacauuucaa

SEQ ID NO: 655712 - RNA, 20 nt, Homo sapiens
cagaugacccccaucccuca

SEQ ID NO: 655713 - RNA, 17 nt, Homo sapiens
cagaugaccguguacaa

SEQ ID NO: 655714 - RNA, 15 nt, Homo sapiens
cagaugauacuucca

SEQ ID NO: 655715 - RNA, 12 nt, Homo sapiens
cagaugcaauac

SEQ ID NO: 655716 - RNA, 16 nt, Homo sapiens
cagaugcaaugacuca

SEQ ID NO: 655717 - RNA, 23 nt, Homo sapiens
cagaugccaaccagacaccuccu

SEQ ID NO: 655718 - RNA, 21 nt, Homo sapiens
cagaugcccagaggcuccauc

SEQ ID NO: 655719 - RNA, 19 nt, Homo sapiens
cagauggaaaaacugaggc

SEQ ID NO: 655720 - RNA, 16 nt, Homo sapiens
cagauggaacacugga

SEQ ID NO: 655721 - RNA, 16 nt, Homo sapiens
cagauggcacuuugaa

SEQ ID NO: 655722 - RNA, 14 nt, Homo sapiens
cagauggggcacca

SEQ ID NO: 655723 - RNA, 16 nt, Homo sapiens
cagauggggucuguga

SEQ ID NO: 655724 - RNA, 20 nt, Homo sapiens
cagauggggucugugacugg

SEQ ID NO: 655725 - RNA, 21 nt, Homo sapiens
cagaugguagacgagcugucu

SEQ ID NO: 655726 - RNA, 21 nt, Homo sapiens
cagaugguugcaauugauccu

SEQ ID NO: 655727 - RNA, 18 nt, Homo sapiens
caggauccagaagggguu

SEQ ID NO: 655728 - RNA, 22 nt, Homo sapiens
caggauccuauucucaccagga

SEQ ID NO: 655729 - RNA, 18 nt, Homo sapiens
caggaugaguuacuugaa

SEQ ID NO: 655730 - RNA, 18 nt, Homo sapiens
caggauuggcaacucuuc

SEQ ID NO: 655731 - RNA, 12 nt, Homo sapiens
caggauuucuca

SEQ ID NO: 655732 - RNA, 19 nt, Homo sapiens
caggauuuuaaacauguaa

SEQ ID NO: 655733 - RNA, 17 nt, Homo sapiens
caggcaaagacugcagu

SEQ ID NO: 655734 - RNA, 18 nt, Homo sapiens
caggcaaagacugcagua

SEQ ID NO: 655735 - RNA, 16 nt, Homo sapiens
caggcaaagauuucau

SEQ ID NO: 655736 - RNA, 15 nt, Homo sapiens
caggcaacgcacaaa

SEQ ID NO: 655737 - RNA, 20 nt, Homo sapiens
caggcaaggggcauuucaca

SEQ ID NO: 655738 - RNA, 14 nt, Homo sapiens
caggcaauuucacc

SEQ ID NO: 655739 - RNA, 13 nt, Homo sapiens
caggcaccugcca

SEQ ID NO: 655740 - RNA, 12 nt, Homo sapiens
caggcacgggug

SEQ ID NO: 655741 - RNA, 14 nt, Homo sapiens
caggcacuccugga

SEQ ID NO: 655742 - RNA, 12 nt, Homo sapiens
caggcacucucc

SEQ ID NO: 655743 - RNA, 14 nt, Homo sapiens
caggcagauuugag

SEQ ID NO: 655744 - RNA, 17 nt, Homo sapiens
caggcagccacgucuca

SEQ ID NO: 655745 - RNA, 20 nt, Homo sapiens
caggcagccuccgggcgugu

SEQ ID NO: 655746 - RNA, 16 nt, Homo sapiens
caggcagcgccaagug

SEQ ID NO: 655747 - RNA, 13 nt, Homo sapiens
caggcagcucaag

SEQ ID NO: 655748 - RNA, 16 nt, Homo sapiens
caggcaugcaagugag

SEQ ID NO: 655749 - RNA, 19 nt, Homo sapiens
caggcauucagguugcuug

SEQ ID NO: 655750 - RNA, 11 nt, Homo sapiens
caggcauuugc

SEQ ID NO: 655751 - RNA, 20 nt, Homo sapiens
caggccaaagccccaugugc

SEQ ID NO: 655752 - RNA, 14 nt, Homo sapiens
caggccagcccagc

SEQ ID NO: 655753 - RNA, 19 nt, Homo sapiens
caggccagccugucccuga

SEQ ID NO: 655754 - RNA, 14 nt, Homo sapiens
caggccagcugccu

SEQ ID NO: 655755 - RNA, 18 nt, Homo sapiens
caggccauauuaucaaug

SEQ ID NO: 655756 - RNA, 14 nt, Homo sapiens
caggcccaagagau

SEQ ID NO: 655757 - RNA, 20 nt, Homo sapiens
caggcccacgaggagcagca

SEQ ID NO: 655758 - RNA, 19 nt, Homo sapiens
caggccccaggcaucuuuc

SEQ ID NO: 655759 - RNA, 17 nt, Homo sapiens
caggccccgcuugucca

SEQ ID NO: 655760 - RNA, 17 nt, Homo sapiens
caggcccuacaaugcuc

SEQ ID NO: 655761 - RNA, 13 nt, Homo sapiens
caggcccuagcuu

SEQ ID NO: 655762 - RNA, 22 nt, Homo sapiens
caggcccuguccuaagcacuuu

SEQ ID NO: 655763 - RNA, 13 nt, Homo sapiens
caggcccuguggc

SEQ ID NO: 655764 - RNA, 14 nt, Homo sapiens
caggcccuguggca

SEQ ID NO: 655765 - RNA, 18 nt, Homo sapiens
caggcccuuccucuccac

SEQ ID NO: 655766 - RNA, 16 nt, Homo sapiens
caggcccuucucuaca

SEQ ID NO: 655767 - RNA, 17 nt, Homo sapiens
caggccgggguggagca

SEQ ID NO: 655768 - RNA, 19 nt, Homo sapiens
caggccucgggaccaacuc

SEQ ID NO: 655769 - RNA, 18 nt, Homo sapiens
caggccucucucugcucc

SEQ ID NO: 655770 - RNA, 19 nt, Homo sapiens
caggccuugggcuccugau

SEQ ID NO: 655771 - RNA, 16 nt, Homo sapiens
caggcgagccugacuc

SEQ ID NO: 655772 - RNA, 20 nt, Homo sapiens
caggcgcaguggcucaugcc

SEQ ID NO: 655773 - RNA, 21 nt, Homo sapiens
caggcgcccgggauccagcuc

SEQ ID NO: 655774 - RNA, 20 nt, Homo sapiens
caggcgugagccaccgcgcc

SEQ ID NO: 655775 - RNA, 16 nt, Homo sapiens
caggcucauaugcguc

SEQ ID NO: 655776 - RNA, 16 nt, Homo sapiens
caggcuccaggccuca

SEQ ID NO: 655777 - RNA, 19 nt, Homo sapiens
caggcucuccgggccuuuc

SEQ ID NO: 655778 - RNA, 18 nt, Homo sapiens
caggcucucgcacaccuc

SEQ ID NO: 655779 - RNA, 11 nt, Homo sapiens
caggcucucuc

SEQ ID NO: 655780 - RNA, 12 nt, Homo sapiens
caggcucugaga

SEQ ID NO: 655781 - RNA, 21 nt, Homo sapiens
caggcucuggagccagagaga

SEQ ID NO: 655782 - RNA, 22 nt, Homo sapiens
caggcugcagaugaucagggau

SEQ ID NO: 655783 - RNA, 23 nt, Homo sapiens
caggcugcccgccgccccuccac

SEQ ID NO: 655784 - RNA, 21 nt, Homo sapiens
caggcugccucggacuccaug

SEQ ID NO: 655785 - RNA, 20 nt, Homo sapiens
caggcugcuggagugcagug

SEQ ID NO: 655786 - RNA, 21 nt, Homo sapiens
caggcugcuggagugcagugg

SEQ ID NO: 655787 - RNA, 23 nt, Homo sapiens
caggcugcuggagugcaguggca

SEQ ID NO: 655788 - RNA, 20 nt, Homo sapiens
caggcuggaguacaauggcg

SEQ ID NO: 655789 - RNA, 16 nt, Homo sapiens
caggcuggagugcaau

SEQ ID NO: 655790 - RNA, 17 nt, Homo sapiens
caggcuggagugcaaug

SEQ ID NO: 655791 - RNA, 20 nt, Homo sapiens
caggcuggagugcaaugaca

SEQ ID NO: 655792 - RNA, 14 nt, Homo sapiens
caggcuggccaguc

SEQ ID NO: 655793 - RNA, 21 nt, Homo sapiens
caggcuggcgcagccaaggcc

SEQ ID NO: 655794 - RNA, 20 nt, Homo sapiens
caggcugggccauguccaaa

SEQ ID NO: 655795 - RNA, 14 nt, Homo sapiens
caggcugugcagcg

SEQ ID NO: 655796 - RNA, 15 nt, Homo sapiens
caggcuuaugaauau

SEQ ID NO: 655797 - RNA, 23 nt, Homo sapiens
caggcuucugucaauuucauuau

SEQ ID NO: 655798 - RNA, 13 nt, Homo sapiens
caggcuuuguaca

SEQ ID NO: 655799 - RNA, 22 nt, Homo sapiens
cagggaacccugcuugcacuuu

SEQ ID NO: 655800 - RNA, 17 nt, Homo sapiens
cagggaagagggcagua

SEQ ID NO: 655801 - RNA, 20 nt, Homo sapiens
cagggaagccccacuugaag

SEQ ID NO: 655802 - RNA, 23 nt, Homo sapiens
cagggaauggagcucagguccca

SEQ ID NO: 655803 - RNA, 22 nt, Homo sapiens
cagggaccacaggccuuaggga

SEQ ID NO: 655804 - RNA, 10 nt, Homo sapiens
cagggaccag

SEQ ID NO: 655805 - RNA, 16 nt, Homo sapiens
cagggacuccaugcug

SEQ ID NO: 655806 - RNA, 20 nt, Homo sapiens
cagggacuccaugcugccag

SEQ ID NO: 655807 - RNA, 23 nt, Homo sapiens
cagggacuugaaguuguuacuaa

SEQ ID NO: 655808 - RNA, 22 nt, Homo sapiens
cagggagaaguagcuaguagca

SEQ ID NO: 655809 - RNA, 13 nt, Homo sapiens
cagggagacaucu

SEQ ID NO: 655810 - RNA, 18 nt, Homo sapiens
cagggagcuuccuggcuc

SEQ ID NO: 655811 - RNA, 15 nt, Homo sapiens
cagggagcuugccac

SEQ ID NO: 655812 - RNA, 16 nt, Homo sapiens
cagggagcuugccaca

SEQ ID NO: 655813 - RNA, 15 nt, Homo sapiens
cagggagggggaccu

SEQ ID NO: 655814 - RNA, 15 nt, Homo sapiens
cagggaguccagggu

SEQ ID NO: 655815 - RNA, 17 nt, Homo sapiens
cagggauacccagugau

SEQ ID NO: 655816 - RNA, 17 nt, Homo sapiens
cagggaugccaacaccu

SEQ ID NO: 655817 - RNA, 13 nt, Homo sapiens
cagggauggagau

SEQ ID NO: 655818 - RNA, 13 nt, Homo sapiens
cagggauggcccc

SEQ ID NO: 655819 - RNA, 21 nt, Homo sapiens
cagggauuaaccucugcacua

SEQ ID NO: 655820 - RNA, 23 nt, Homo sapiens
cagggcaaaagggcagcugugau

SEQ ID NO: 655821 - RNA, 16 nt, Homo sapiens
cagggcaacuguagaa

SEQ ID NO: 655822 - RNA, 20 nt, Homo sapiens
cagggcaaugccaucagccc

SEQ ID NO: 655823 - RNA, 22 nt, Homo sapiens
cagggcagucauuggcugucuc

SEQ ID NO: 655824 - RNA, 13 nt, Homo sapiens
cagggccacaacu

SEQ ID NO: 655825 - RNA, 21 nt, Homo sapiens
cagggccagcuuuuccucacc

SEQ ID NO: 655826 - RNA, 15 nt, Homo sapiens
cagggccaguccucc

SEQ ID NO: 655827 - RNA, 14 nt, Homo sapiens
cagggcccaagucc

SEQ ID NO: 655828 - RNA, 13 nt, Homo sapiens
cagggcccaggca

SEQ ID NO: 655829 - RNA, 16 nt, Homo sapiens
cagggcccccaucuca

SEQ ID NO: 655830 - RNA, 21 nt, Homo sapiens
cagggcccugcagaggggaaa

SEQ ID NO: 655831 - RNA, 22 nt, Homo sapiens
cagggcccuggaugguccucuu

SEQ ID NO: 655832 - RNA, 15 nt, Homo sapiens
cagggccuccagggc

SEQ ID NO: 655833 - RNA, 20 nt, Homo sapiens
cagggccuccugggggaccu

SEQ ID NO: 655834 - RNA, 21 nt, Homo sapiens
cagggccugacuugagccacu

SEQ ID NO: 655835 - RNA, 13 nt, Homo sapiens
cagggcuagugac

SEQ ID NO: 655836 - RNA, 21 nt, Homo sapiens
cagggcucagccuggugggcc

SEQ ID NO: 655837 - RNA, 22 nt, Homo sapiens
cagggcucagccuggugggccu

SEQ ID NO: 655838 - RNA, 15 nt, Homo sapiens
cagggcuggaagcuu

SEQ ID NO: 655839 - RNA, 13 nt, Homo sapiens
cagggcugggccu

SEQ ID NO: 655840 - RNA, 14 nt, Homo sapiens
cagggcugugaucg

SEQ ID NO: 655841 - RNA, 18 nt, Homo sapiens
cagggcuuccucuuccgg

SEQ ID NO: 655842 - RNA, 20 nt, Homo sapiens
cagggcuuuacuccguaaca

SEQ ID NO: 655843 - RNA, 14 nt, Homo sapiens
caggggacaaggga

SEQ ID NO: 655844 - RNA, 18 nt, Homo sapiens
caggggaggugauagcau

SEQ ID NO: 655845 - RNA, 15 nt, Homo sapiens
caggggcagguggug

SEQ ID NO: 655846 - RNA, 21 nt, Homo sapiens
caggggcucacaccuguaauc

SEQ ID NO: 655847 - RNA, 19 nt, Homo sapiens
caggggcuuaucucuucaa

SEQ ID NO: 655848 - RNA, 19 nt, Homo sapiens
caggggcuucccacuuugg

SEQ ID NO: 655849 - RNA, 12 nt, Homo sapiens
cauacaggccau

SEQ ID NO: 655850 - RNA, 14 nt, Homo sapiens
cauacauacauaca

SEQ ID NO: 655851 - RNA, 18 nt, Homo sapiens
cauacauacauacauaua

SEQ ID NO: 655852 - RNA, 14 nt, Homo sapiens
cauacauacauaua

SEQ ID NO: 655853 - RNA, 16 nt, Homo sapiens
cauacauauauaucug

SEQ ID NO: 655854 - RNA, 17 nt, Homo sapiens
cauacauauuaucucau

SEQ ID NO: 655855 - RNA, 21 nt, Homo sapiens
cauacauucccucuaauuuga

SEQ ID NO: 655856 - RNA, 15 nt, Homo sapiens
cauacauuuaugcac

SEQ ID NO: 655857 - RNA, 17 nt, Homo sapiens
cauacauuuaugcacau

SEQ ID NO: 655858 - RNA, 22 nt, Homo sapiens
cauaccaaugaaaaaauguaua

SEQ ID NO: 655859 - RNA, 18 nt, Homo sapiens
cauacccacacauuccag

SEQ ID NO: 655860 - RNA, 21 nt, Homo sapiens
cauacccacccuuacuuccug

SEQ ID NO: 655861 - RNA, 22 nt, Homo sapiens
cauacccgccuagcugcuguca

SEQ ID NO: 655862 - RNA, 19 nt, Homo sapiens
cauacgagagcagaggucu

SEQ ID NO: 655863 - RNA, 22 nt, Homo sapiens
cauacuacaguaacugugacug

SEQ ID NO: 655864 - RNA, 17 nt, Homo sapiens
cauacuaugguuuucau

SEQ ID NO: 655865 - RNA, 14 nt, Homo sapiens
cauacucaaauggu

SEQ ID NO: 655866 - RNA, 16 nt, Homo sapiens
cauacuccuuccauca

SEQ ID NO: 655867 - RNA, 11 nt, Homo sapiens
cauacugagcc

SEQ ID NO: 655868 - RNA, 13 nt, Homo sapiens
cauacugcaugua

SEQ ID NO: 655869 - RNA, 16 nt, Homo sapiens
cauacuuaaugcauau

SEQ ID NO: 655870 - RNA, 16 nt, Homo sapiens
cauacuucuucauuca

SEQ ID NO: 655871 - RNA, 17 nt, Homo sapiens
cauacuuugacaaggaa

SEQ ID NO: 655872 - RNA, 21 nt, Homo sapiens
cauagaaauuacacccaaaga

SEQ ID NO: 655873 - RNA, 14 nt, Homo sapiens
cauagaacacuuca

SEQ ID NO: 655874 - RNA, 20 nt, Homo sapiens
cauagagauagcuacagugu

SEQ ID NO: 655875 - RNA, 13 nt, Homo sapiens
cauagagaucuau

SEQ ID NO: 655876 - RNA, 23 nt, Homo sapiens
cauagagaucuauguacuguaau

SEQ ID NO: 655877 - RNA, 23 nt, Homo sapiens
cauagagcuuuuuaauagcacua

SEQ ID NO: 655878 - RNA, 21 nt, Homo sapiens
cauagagucuuuauguccaua

SEQ ID NO: 655879 - RNA, 17 nt, Homo sapiens
cauagagugaucuuucc

SEQ ID NO: 655880 - RNA, 13 nt, Homo sapiens
cauagagugugau

SEQ ID NO: 655881 - RNA, 19 nt, Homo sapiens
cauagcaagacacaucccu

SEQ ID NO: 655882 - RNA, 19 nt, Homo sapiens
cauagcauagccagcauuc

SEQ ID NO: 655883 - RNA, 19 nt, Homo sapiens
cauagcccagaucagcucc

SEQ ID NO: 655884 - RNA, 14 nt, Homo sapiens
cauagcucuccuuc

SEQ ID NO: 655885 - RNA, 16 nt, Homo sapiens
cauagcugacuacaaa

SEQ ID NO: 655886 - RNA, 22 nt, Homo sapiens
cauagcugucuagaguagcuua

SEQ ID NO: 655887 - RNA, 13 nt, Homo sapiens
cauagcuuucaca

SEQ ID NO: 655888 - RNA, 17 nt, Homo sapiens
cauaggaaaaugccaug

SEQ ID NO: 655889 - RNA, 14 nt, Homo sapiens
cauaggcucuuaag

SEQ ID NO: 655890 - RNA, 14 nt, Homo sapiens
cauagggauugucc

SEQ ID NO: 655891 - RNA, 17 nt, Homo sapiens
cauagguaaaaacugga

SEQ ID NO: 655892 - RNA, 18 nt, Homo sapiens
cauagguaaaaacuggaa

SEQ ID NO: 655893 - RNA, 16 nt, Homo sapiens
cauagguaacaguuau

SEQ ID NO: 655894 - RNA, 18 nt, Homo sapiens
cauagguugagcaauuuc

SEQ ID NO: 655895 - RNA, 18 nt, Homo sapiens
cauaguacuggcacaaaa

SEQ ID NO: 655896 - RNA, 22 nt, Homo sapiens
cauaguagguacccaauucaau

SEQ ID NO: 655897 - RNA, 15 nt, Homo sapiens
cauagucuguuccuu

SEQ ID NO: 655898 - RNA, 16 nt, Homo sapiens
cauaguucucuuuaag

SEQ ID NO: 655899 - RNA, 18 nt, Homo sapiens
cauaguuucaaaucugua

SEQ ID NO: 655900 - RNA, 14 nt, Homo sapiens
cauaguuugugaau

SEQ ID NO: 655901 - RNA, 22 nt, Homo sapiens
cauaguuuuguuuaauuugcuu

SEQ ID NO: 655902 - RNA, 13 nt, Homo sapiens
cauauaaacucau

SEQ ID NO: 655903 - RNA, 17 nt, Homo sapiens
cauauaaagcacuauac

SEQ ID NO: 655904 - RNA, 18 nt, Homo sapiens
cauauaaagcacuauaca

SEQ ID NO: 655905 - RNA, 19 nt, Homo sapiens
cauauaaagcacuauacag

SEQ ID NO: 655906 - RNA, 17 nt, Homo sapiens
cauauaauuucuuuaaa

SEQ ID NO: 655907 - RNA, 21 nt, Homo sapiens
cauauaggaaaacaauaauuu

SEQ ID NO: 655908 - RNA, 17 nt, Homo sapiens
cauauaggccagaguug

SEQ ID NO: 655909 - RNA, 20 nt, Homo sapiens
cauauaggccagaguugcaa

SEQ ID NO: 655910 - RNA, 17 nt, Homo sapiens
cauauauaaguuuacac

SEQ ID NO: 655911 - RNA, 16 nt, Homo sapiens
cauauauacaggcaua

SEQ ID NO: 655912 - RNA, 15 nt, Homo sapiens
cauauauacccacau

SEQ ID NO: 655913 - RNA, 13 nt, Homo sapiens
cauauauauguau

SEQ ID NO: 655914 - RNA, 16 nt, Homo sapiens
cauauauauguauaua

SEQ ID NO: 655915 - RNA, 13 nt, Homo sapiens
cauauauauguca

SEQ ID NO: 655916 - RNA, 16 nt, Homo sapiens
cauauauauuaauacu

SEQ ID NO: 655917 - RNA, 19 nt, Homo sapiens
cauauaugugaucugggca

SEQ ID NO: 655918 - RNA, 18 nt, Homo sapiens
cauaucauuucacugucu

SEQ ID NO: 655919 - RNA, 17 nt, Homo sapiens
cauaucccuuccucuca

SEQ ID NO: 655920 - RNA, 21 nt, Homo sapiens
cauaucccuuccucucaggcu

SEQ ID NO: 655921 - RNA, 11 nt, Homo sapiens
cauaucuccau

SEQ ID NO: 655922 - RNA, 11 nt, Homo sapiens
cauaucugccu

SEQ ID NO: 655923 - RNA, 14 nt, Homo sapiens
cauaucuucuauau

SEQ ID NO: 655924 - RNA, 14 nt, Homo sapiens
cauaugaacacaga

SEQ ID NO: 655925 - RNA, 18 nt, Homo sapiens
cauaugacugauuacuca

SEQ ID NO: 655926 - RNA, 18 nt, Homo sapiens
cauaugagaauauaccuu

SEQ ID NO: 655927 - RNA, 22 nt, Homo sapiens
cauaugaggacgaggaguaaug

SEQ ID NO: 655928 - RNA, 22 nt, Homo sapiens
cauaugaggaggaugucccugg

SEQ ID NO: 655929 - RNA, 16 nt, Homo sapiens
cauaugauacugaugc

SEQ ID NO: 655930 - RNA, 15 nt, Homo sapiens
cauaugauccaguua

SEQ ID NO: 655931 - RNA, 18 nt, Homo sapiens
cauaugaucugucugugg

SEQ ID NO: 655932 - RNA, 20 nt, Homo sapiens
cauaugaucugucuguggca

SEQ ID NO: 655933 - RNA, 19 nt, Homo sapiens
cauauggucccugggccac

SEQ ID NO: 655934 - RNA, 16 nt, Homo sapiens
cauauguaaagcacau

SEQ ID NO: 655935 - RNA, 17 nt, Homo sapiens
cauauguagaugugcug

SEQ ID NO: 655936 - RNA, 19 nt, Homo sapiens
cauaugucacgaacuugaa

SEQ ID NO: 655937 - RNA, 15 nt, Homo sapiens
cauauuaagacauaa

SEQ ID NO: 655938 - RNA, 16 nt, Homo sapiens
cauauuaagcacuuua

SEQ ID NO: 655939 - RNA, 23 nt, Homo sapiens
cauauuaccuguggaguugcaua

SEQ ID NO: 655940 - RNA, 19 nt, Homo sapiens
cauauucaugaaaugugga

SEQ ID NO: 655941 - RNA, 21 nt, Homo sapiens
cauauuccugguguagcacuu

SEQ ID NO: 655942 - RNA, 21 nt, Homo sapiens
cauauucuaaguuagacucuu

SEQ ID NO: 655943 - RNA, 23 nt, Homo sapiens
cauauucuuaaugacauuucacu

SEQ ID NO: 655944 - RNA, 15 nt, Homo sapiens
cauauuguagcucaa

SEQ ID NO: 655945 - RNA, 16 nt, Homo sapiens
cauauuuaaugaugau

SEQ ID NO: 655946 - RNA, 20 nt, Homo sapiens
cauauuuuguauuguucuaa

SEQ ID NO: 655947 - RNA, 20 nt, Homo sapiens
cauauuuuuuuuacugucag

SEQ ID NO: 655948 - RNA, 15 nt, Homo sapiens
caucaaaaugaauag

SEQ ID NO: 655949 - RNA, 20 nt, Homo sapiens
caucaaacauuggauuuuuc

SEQ ID NO: 655950 - RNA, 12 nt, Homo sapiens
caucaacaacac

SEQ ID NO: 655951 - RNA, 15 nt, Homo sapiens
caucaacaacacagc

SEQ ID NO: 655952 - RNA, 15 nt, Homo sapiens
caucaagacuaucua

SEQ ID NO: 655953 - RNA, 12 nt, Homo sapiens
caucaaggucag

SEQ ID NO: 655954 - RNA, 22 nt, Homo sapiens
caucaaucuuguuacugcugau

SEQ ID NO: 655955 - RNA, 12 nt, Homo sapiens
caucacaacauu

SEQ ID NO: 655956 - RNA, 21 nt, Homo sapiens
caucacagcugaacuuguuga

SEQ ID NO: 655957 - RNA, 13 nt, Homo sapiens
caucaccaggugc

SEQ ID NO: 655958 - RNA, 16 nt, Homo sapiens
caucacccucuuccug

SEQ ID NO: 655959 - RNA, 11 nt, Homo sapiens
caucaccgcug

SEQ ID NO: 655960 - RNA, 21 nt, Homo sapiens
caucaccucuacugucuccuc

SEQ ID NO: 655961 - RNA, 16 nt, Homo sapiens
caucacgucagugcuc

SEQ ID NO: 655962 - RNA, 22 nt, Homo sapiens
caucacuagaagaaaagcccau

SEQ ID NO: 655963 - RNA, 17 nt, Homo sapiens
caucacuguaaagacaa

SEQ ID NO: 655964 - RNA, 21 nt, Homo sapiens
caucacugucuugccagauua

SEQ ID NO: 655965 - RNA, 23 nt, Homo sapiens
caucacuucccauuuuauggaau

SEQ ID NO: 655966 - RNA, 21 nt, Homo sapiens
caucagacuccugugcaacuu

SEQ ID NO: 655967 - RNA, 20 nt, Homo sapiens
caucagagcagcuagcucuu

SEQ ID NO: 655968 - RNA, 16 nt, Homo sapiens
caucagagccuuuccu

SEQ ID NO: 655969 - RNA, 14 nt, Homo sapiens
caucagauaugcuu

SEQ ID NO: 655970 - RNA, 16 nt, Homo sapiens
caucagauguguuccu

SEQ ID NO: 655971 - RNA, 19 nt, Homo sapiens
ccauggugagcucugggaa

SEQ ID NO: 655972 - RNA, 21 nt, Homo sapiens
ccaugguguauucagagcuga

SEQ ID NO: 655973 - RNA, 17 nt, Homo sapiens
ccauguaaauugcaaau

SEQ ID NO: 655974 - RNA, 18 nt, Homo sapiens
ccauguaaauugcaaaua

SEQ ID NO: 655975 - RNA, 16 nt, Homo sapiens
ccauguaagguugugc

SEQ ID NO: 655976 - RNA, 17 nt, Homo sapiens
ccauguauuuaucucua

SEQ ID NO: 655977 - RNA, 21 nt, Homo sapiens
ccauguccaaagaggcugccc

SEQ ID NO: 655978 - RNA, 15 nt, Homo sapiens
ccauguccugaaaaa

SEQ ID NO: 655979 - RNA, 19 nt, Homo sapiens
ccaugucgccucugcauuc

SEQ ID NO: 655980 - RNA, 21 nt, Homo sapiens
ccauguggaccauauuuugua

SEQ ID NO: 655981 - RNA, 20 nt, Homo sapiens
ccaugugugagugugugcaa

SEQ ID NO: 655982 - RNA, 14 nt, Homo sapiens
ccaugugugugcaa

SEQ ID NO: 655983 - RNA, 16 nt, Homo sapiens
ccaugugugugcaagu

SEQ ID NO: 655984 - RNA, 13 nt, Homo sapiens
ccauguugaucuu

SEQ ID NO: 655985 - RNA, 16 nt, Homo sapiens
ccauuaaaguucucaa

SEQ ID NO: 655986 - RNA, 15 nt, Homo sapiens
ccauuaauccaggga

SEQ ID NO: 655987 - RNA, 15 nt, Homo sapiens
ccauuaauuacauac

SEQ ID NO: 655988 - RNA, 15 nt, Homo sapiens
ccauuacgugcauuu

SEQ ID NO: 655989 - RNA, 14 nt, Homo sapiens
ccauuacuacugua

SEQ ID NO: 655990 - RNA, 15 nt, Homo sapiens
ccauuacuacuguac

SEQ ID NO: 655991 - RNA, 13 nt, Homo sapiens
ccauuacuuugau

SEQ ID NO: 655992 - RNA, 22 nt, Homo sapiens
ccauuacuuugauaucugauca

SEQ ID NO: 655993 - RNA, 17 nt, Homo sapiens
ccauuagaauagucaua

SEQ ID NO: 655994 - RNA, 23 nt, Homo sapiens
ccauuagaaugugauuuuuguuc

SEQ ID NO: 655995 - RNA, 16 nt, Homo sapiens
ccauuagucuagccuu

SEQ ID NO: 655996 - RNA, 15 nt, Homo sapiens
ccauucaacucggaa

SEQ ID NO: 655997 - RNA, 16 nt, Homo sapiens
ccauucaacucggaaa

SEQ ID NO: 655998 - RNA, 15 nt, Homo sapiens
ccauucacaccagcu

SEQ ID NO: 655999 - RNA, 15 nt, Homo sapiens
ccauucacuacaggu

SEQ ID NO: 656000 - RNA, 12 nt, Homo sapiens
ccauucucccag

SEQ ID NO: 656001 - RNA, 11 nt, Homo sapiens
ccauucucuga

SEQ ID NO: 656002 - RNA, 13 nt, Homo sapiens
ccauugaacagcu

SEQ ID NO: 656003 - RNA, 16 nt, Homo sapiens
ccauugaacagcugug

SEQ ID NO: 656004 - RNA, 16 nt, Homo sapiens
ccauugagacuauuua

SEQ ID NO: 656005 - RNA, 20 nt, Homo sapiens
ccauugauuuaauguaauag

SEQ ID NO: 656006 - RNA, 17 nt, Homo sapiens
ccauugcccuagccagg

SEQ ID NO: 656007 - RNA, 17 nt, Homo sapiens
ccauugccuagcucuuu

SEQ ID NO: 656008 - RNA, 13 nt, Homo sapiens
ccauugcucuuga

SEQ ID NO: 656009 - RNA, 16 nt, Homo sapiens
ccauuggaucuuuuac

SEQ ID NO: 656010 - RNA, 19 nt, Homo sapiens
ccauuguaaaucugaagaa

SEQ ID NO: 656011 - RNA, 15 nt, Homo sapiens
ccauuuagggcagca

SEQ ID NO: 656012 - RNA, 20 nt, Homo sapiens
ccauuucaguguauuguuua

SEQ ID NO: 656013 - RNA, 23 nt, Homo sapiens
ccauuuccaaauguggccuccau

SEQ ID NO: 656014 - RNA, 18 nt, Homo sapiens
ccauuuccugaucuagca

SEQ ID NO: 656015 - RNA, 12 nt, Homo sapiens
ccauuucuucag

SEQ ID NO: 656016 - RNA, 19 nt, Homo sapiens
ccauuugcagaguccugca

SEQ ID NO: 656017 - RNA, 18 nt, Homo sapiens
ccauuugcuaguucugcu

SEQ ID NO: 656018 - RNA, 18 nt, Homo sapiens
ccauuugugugugugcaa

SEQ ID NO: 656019 - RNA, 16 nt, Homo sapiens
ccauuuuaaaaaccaa

SEQ ID NO: 656020 - RNA, 14 nt, Homo sapiens
ccauuuuacagagg

SEQ ID NO: 656021 - RNA, 12 nt, Homo sapiens
ccauuuucaucc

SEQ ID NO: 656022 - RNA, 18 nt, Homo sapiens
ccauuuugugaauuguga

SEQ ID NO: 656023 - RNA, 20 nt, Homo sapiens
ccauuuuuccucuguucaca

SEQ ID NO: 656024 - RNA, 17 nt, Homo sapiens
ccauuuuuuaauaaaga

SEQ ID NO: 656025 - RNA, 22 nt, Homo sapiens
cccaaaagaauuaucaucccaa

SEQ ID NO: 656026 - RNA, 13 nt, Homo sapiens
cccaaacccuuaa

SEQ ID NO: 656027 - RNA, 20 nt, Homo sapiens
cccaaacccuuaacugacau

SEQ ID NO: 656028 - RNA, 18 nt, Homo sapiens
cccaaacuggagugcagu

SEQ ID NO: 656029 - RNA, 12 nt, Homo sapiens
cccaaagcacuu

SEQ ID NO: 656030 - RNA, 20 nt, Homo sapiens
cccaaaggaugagaauguga

SEQ ID NO: 656031 - RNA, 14 nt, Homo sapiens
cccaaaggcaucca

SEQ ID NO: 656032 - RNA, 18 nt, Homo sapiens
cccaaaggcccagggagg

SEQ ID NO: 656033 - RNA, 14 nt, Homo sapiens
cccaaagugcuagu

SEQ ID NO: 656034 - RNA, 18 nt, Homo sapiens
cccaaauccaugcaagug

SEQ ID NO: 656035 - RNA, 17 nt, Homo sapiens
cccaaauccuguuccaa

SEQ ID NO: 656036 - RNA, 18 nt, Homo sapiens
cccaacaagauugcuuaa

SEQ ID NO: 656037 - RNA, 11 nt, Homo sapiens
cccaacacuuu

SEQ ID NO: 656038 - RNA, 17 nt, Homo sapiens
cccaacaucgaaugugu

SEQ ID NO: 656039 - RNA, 20 nt, Homo sapiens
cccaacauuucuuaaauuau

SEQ ID NO: 656040 - RNA, 19 nt, Homo sapiens
cccaaccaggcccugccau

SEQ ID NO: 656041 - RNA, 15 nt, Homo sapiens
cccaacccuaucucc

SEQ ID NO: 656042 - RNA, 22 nt, Homo sapiens
cccaaccuucacaucugucacg

SEQ ID NO: 656043 - RNA, 15 nt, Homo sapiens
cccaacuaacaguca

SEQ ID NO: 656044 - RNA, 20 nt, Homo sapiens
cccaacuaacagucaagaaa

SEQ ID NO: 656045 - RNA, 22 nt, Homo sapiens
cccaacugggggcaaagguuug

SEQ ID NO: 656046 - RNA, 22 nt, Homo sapiens
cccaagaaugagcuuacaaagu

SEQ ID NO: 656047 - RNA, 22 nt, Homo sapiens
cccaagaggacugagacuggca

SEQ ID NO: 656048 - RNA, 23 nt, Homo sapiens
cccaagaggucaaggcugcagug

SEQ ID NO: 656049 - RNA, 16 nt, Homo sapiens
cccaagaugagcugca

SEQ ID NO: 656050 - RNA, 23 nt, Homo sapiens
cccaagcuggccacuaucacaua

SEQ ID NO: 656051 - RNA, 14 nt, Homo sapiens
cccaagcuucccuc

SEQ ID NO: 656052 - RNA, 21 nt, Homo sapiens
cccaaggaugccuuagcaugu

SEQ ID NO: 656053 - RNA, 16 nt, Homo sapiens
cccaagggcuccagac

SEQ ID NO: 656054 - RNA, 12 nt, Homo sapiens
cccaaguauuuu

SEQ ID NO: 656055 - RNA, 21 nt, Homo sapiens
cccaagucugaacguggaauu

SEQ ID NO: 656056 - RNA, 23 nt, Homo sapiens
cccaagugauccuuccaccucag

SEQ ID NO: 656057 - RNA, 13 nt, Homo sapiens
cccaauacaaaga

SEQ ID NO: 656058 - RNA, 19 nt, Homo sapiens
cccaauccauccugcucag

SEQ ID NO: 656059 - RNA, 15 nt, Homo sapiens
cccaauccccagacu

SEQ ID NO: 656060 - RNA, 11 nt, Homo sapiens
cccaaucugcc

SEQ ID NO: 656061 - RNA, 18 nt, Homo sapiens
cccaaucugccuuugaau

SEQ ID NO: 656062 - RNA, 16 nt, Homo sapiens
cccaaugccugugaag

SEQ ID NO: 656063 - RNA, 21 nt, Homo sapiens
cccaaugggcucaaacuucua

SEQ ID NO: 656064 - RNA, 19 nt, Homo sapiens
cccaauuacagggugacuc

SEQ ID NO: 656065 - RNA, 21 nt, Homo sapiens
cccaauuacagggugacucac

SEQ ID NO: 656066 - RNA, 15 nt, Homo sapiens
cccacagacacuuac

SEQ ID NO: 656067 - RNA, 19 nt, Homo sapiens
cccacagcuggcucugaca

SEQ ID NO: 656068 - RNA, 17 nt, Homo sapiens
cccacagguguguuucc

SEQ ID NO: 656069 - RNA, 17 nt, Homo sapiens
cccacagucccauuccu

SEQ ID NO: 656070 - RNA, 14 nt, Homo sapiens
cccaccaacucugc

SEQ ID NO: 656071 - RNA, 19 nt, Homo sapiens
cccaccacauagcaugcuu

SEQ ID NO: 656072 - RNA, 19 nt, Homo sapiens
cccaccagaaauuccagua

SEQ ID NO: 656073 - RNA, 19 nt, Homo sapiens
cccaccagccuuguccuaa

SEQ ID NO: 656074 - RNA, 17 nt, Homo sapiens
cccaccaguuauuccuu

SEQ ID NO: 656075 - RNA, 18 nt, Homo sapiens
cccacccgaguaccucca

SEQ ID NO: 656076 - RNA, 16 nt, Homo sapiens
cccaccgguccagcug

SEQ ID NO: 656077 - RNA, 10 nt, Homo sapiens
cccaccugcg

SEQ ID NO: 656078 - RNA, 14 nt, Homo sapiens
cccaccuggccacc

SEQ ID NO: 656079 - RNA, 17 nt, Homo sapiens
cccaccuggugugacuu

SEQ ID NO: 656080 - RNA, 17 nt, Homo sapiens
cccacgagggugccgug

SEQ ID NO: 656081 - RNA, 20 nt, Homo sapiens
cccacgggugccaugaagug

SEQ ID NO: 656082 - RNA, 18 nt, Homo sapiens
cccacgugucuuccacuu

SEQ ID NO: 656083 - RNA, 19 nt, Homo sapiens
cccacuaucugggugcaug

SEQ ID NO: 656084 - RNA, 21 nt, Homo sapiens
cccacucccuggccaucucaa

SEQ ID NO: 656085 - RNA, 22 nt, Homo sapiens
cccacucccuggcucucagaag

SEQ ID NO: 656086 - RNA, 17 nt, Homo sapiens
cccacugaaccuucuga

SEQ ID NO: 656087 - RNA, 18 nt, Homo sapiens
cccacugacccacucgga

SEQ ID NO: 656088 - RNA, 16 nt, Homo sapiens
cccacugacuguaugg

SEQ ID NO: 656089 - RNA, 22 nt, Homo sapiens
cccacugaguuugcuguuugca

SEQ ID NO: 656090 - RNA, 19 nt, Homo sapiens
cccacuggagacgccucuc

SEQ ID NO: 656091 - RNA, 18 nt, Homo sapiens
cccacuguguuuugcuca

SEQ ID NO: 656092 - RNA, 20 nt, Homo sapiens
cccacuguucugaaaggaga

SEQ ID NO: 656093 - RNA, 21 nt, Homo sapiens
cccuuuagcgggacucaguga

SEQ ID NO: 656094 - RNA, 11 nt, Homo sapiens
cccuuucacaa

SEQ ID NO: 656095 - RNA, 18 nt, Homo sapiens
cccuuuccagauauucaa

SEQ ID NO: 656096 - RNA, 15 nt, Homo sapiens
cccuuugaagccuca

SEQ ID NO: 656097 - RNA, 19 nt, Homo sapiens
cccuuugaagccucagcua

SEQ ID NO: 656098 - RNA, 17 nt, Homo sapiens
cccuuugauucuccagu

SEQ ID NO: 656099 - RNA, 14 nt, Homo sapiens
cccuuugccuucau

SEQ ID NO: 656100 - RNA, 15 nt, Homo sapiens
cccuuuggggagcag

SEQ ID NO: 656101 - RNA, 14 nt, Homo sapiens
cccuuuucagaaua

SEQ ID NO: 656102 - RNA, 15 nt, Homo sapiens
cccuuuucucaggac

SEQ ID NO: 656103 - RNA, 19 nt, Homo sapiens
cccuuuuucuccagcuggg

SEQ ID NO: 656104 - RNA, 18 nt, Homo sapiens
ccgaaaaauccucuuccu

SEQ ID NO: 656105 - RNA, 16 nt, Homo sapiens
ccgaaaccaaagaaga

SEQ ID NO: 656106 - RNA, 16 nt, Homo sapiens
ccgaaguaugagggaa

SEQ ID NO: 656107 - RNA, 20 nt, Homo sapiens
ccgaagucuuuuguucgcau

SEQ ID NO: 656108 - RNA, 13 nt, Homo sapiens
ccgaaugugcagg

SEQ ID NO: 656109 - RNA, 23 nt, Homo sapiens
ccgacacugcugcaccagaguga

SEQ ID NO: 656110 - RNA, 12 nt, Homo sapiens
ccgacaucacag

SEQ ID NO: 656111 - RNA, 18 nt, Homo sapiens
ccgacauguguaccucag

SEQ ID NO: 656112 - RNA, 16 nt, Homo sapiens
ccgaccucaggugauc

SEQ ID NO: 656113 - RNA, 11 nt, Homo sapiens
ccgacucuggc

SEQ ID NO: 656114 - RNA, 13 nt, Homo sapiens
ccgacugccugug

SEQ ID NO: 656115 - RNA, 11 nt, Homo sapiens
ccgagaacuuu

SEQ ID NO: 656116 - RNA, 17 nt, Homo sapiens
ccgagauccaccagauc

SEQ ID NO: 656117 - RNA, 23 nt, Homo sapiens
ccgagcugggggccaugagcucc

SEQ ID NO: 656118 - RNA, 16 nt, Homo sapiens
ccgaggggcucaggaa

SEQ ID NO: 656119 - RNA, 16 nt, Homo sapiens
ccgagucuugcucugu

SEQ ID NO: 656120 - RNA, 11 nt, Homo sapiens
ccgagugcaau

SEQ ID NO: 656121 - RNA, 13 nt, Homo sapiens
ccgagugcacugc

SEQ ID NO: 656122 - RNA, 15 nt, Homo sapiens
ccgauggccauguaa

SEQ ID NO: 656123 - RNA, 15 nt, Homo sapiens
ccgauuauuguguau

SEQ ID NO: 656124 - RNA, 15 nt, Homo sapiens
ccgauuccaccaaau

SEQ ID NO: 656125 - RNA, 14 nt, Homo sapiens
ccgcaccgcuggga

SEQ ID NO: 656126 - RNA, 13 nt, Homo sapiens
ccgcaucaccuca

SEQ ID NO: 656127 - RNA, 14 nt, Homo sapiens
ccgcaugugaucuc

SEQ ID NO: 656128 - RNA, 18 nt, Homo sapiens
ccgcauuuggauuggaug

SEQ ID NO: 656129 - RNA, 12 nt, Homo sapiens
ccgccacuccag

SEQ ID NO: 656130 - RNA, 20 nt, Homo sapiens
ccgcccuaaaagcacacuca

SEQ ID NO: 656131 - RNA, 18 nt, Homo sapiens
ccgcccugacccagagga

SEQ ID NO: 656132 - RNA, 22 nt, Homo sapiens
ccgccuuccuccuccacagugc

SEQ ID NO: 656133 - RNA, 14 nt, Homo sapiens
ccgcggugcucugg

SEQ ID NO: 656134 - RNA, 18 nt, Homo sapiens
ccgcuacgcacaggaguu

SEQ ID NO: 656135 - RNA, 22 nt, Homo sapiens
ccgcucagugucagcgggugac

SEQ ID NO: 656136 - RNA, 15 nt, Homo sapiens
ccgcucccuggauau

SEQ ID NO: 656137 - RNA, 18 nt, Homo sapiens
ccgcucugaggcaacccc

SEQ ID NO: 656138 - RNA, 22 nt, Homo sapiens
ccgcucuggauccugcacucua

SEQ ID NO: 656139 - RNA, 19 nt, Homo sapiens
ccgcugacugcaccagcgc

SEQ ID NO: 656140 - RNA, 14 nt, Homo sapiens
ccgcugacugccac

SEQ ID NO: 656141 - RNA, 18 nt, Homo sapiens
ccgcugcaaugccuagac

SEQ ID NO: 656142 - RNA, 15 nt, Homo sapiens
ccgcugcgugccauc

SEQ ID NO: 656143 - RNA, 14 nt, Homo sapiens
ccgcuuguacccag

SEQ ID NO: 656144 - RNA, 15 nt, Homo sapiens
ccggaccuaccuccc

SEQ ID NO: 656145 - RNA, 18 nt, Homo sapiens
ccggaggaaaagcagcuc

SEQ ID NO: 656146 - RNA, 21 nt, Homo sapiens
ccggaggccuucccacuccua

SEQ ID NO: 656147 - RNA, 21 nt, Homo sapiens
ccggaguucugcccaugggaa

SEQ ID NO: 656148 - RNA, 18 nt, Homo sapiens
ccggaugcuucuccauga

SEQ ID NO: 656149 - RNA, 20 nt, Homo sapiens
ccggcacuuccgagauccac

SEQ ID NO: 656150 - RNA, 24 nt, Homo sapiens
ccggccccacccccugggcagaug

SEQ ID NO: 656151 - RNA, 16 nt, Homo sapiens
ccggcgccccugccac

SEQ ID NO: 656152 - RNA, 21 nt, Homo sapiens
ccggcuaugggacugcagugc

SEQ ID NO: 656153 - RNA, 21 nt, Homo sapiens
ccggcugagggugggaggcaa

SEQ ID NO: 656154 - RNA, 20 nt, Homo sapiens
ccgggaagagggugauugcu

SEQ ID NO: 656155 - RNA, 22 nt, Homo sapiens
ccgggaagcggagguugcaggg

SEQ ID NO: 656156 - RNA, 16 nt, Homo sapiens
ccgggagcaguguccu

SEQ ID NO: 656157 - RNA, 14 nt, Homo sapiens
ccgggcaagacuuu

SEQ ID NO: 656158 - RNA, 23 nt, Homo sapiens
ccgggcaccaacuccauguuugg

SEQ ID NO: 656159 - RNA, 18 nt, Homo sapiens
ccggggaggaaacacuuu

SEQ ID NO: 656160 - RNA, 20 nt, Homo sapiens
ccggggcagggacuugccuc

SEQ ID NO: 656161 - RNA, 16 nt, Homo sapiens
ccggggccagcacuuc

SEQ ID NO: 656162 - RNA, 16 nt, Homo sapiens
ccggggcuccacugaa

SEQ ID NO: 656163 - RNA, 17 nt, Homo sapiens
ccggucaugguggugga

SEQ ID NO: 656164 - RNA, 17 nt, Homo sapiens
ccgguuauuacuucugu

SEQ ID NO: 656165 - RNA, 14 nt, Homo sapiens
ccgguugcagucac

SEQ ID NO: 656166 - RNA, 20 nt, Homo sapiens
ccgguugcagucacugugau

SEQ ID NO: 656167 - RNA, 22 nt, Homo sapiens
ccgguugcuggucaggucccca

SEQ ID NO: 656168 - RNA, 12 nt, Homo sapiens
ccguaacaacug

SEQ ID NO: 656169 - RNA, 15 nt, Homo sapiens
ccguaucacaguguu

SEQ ID NO: 656170 - RNA, 13 nt, Homo sapiens
ccguccauucuuc

SEQ ID NO: 656171 - RNA, 15 nt, Homo sapiens
ccguccucacccauc

SEQ ID NO: 656172 - RNA, 22 nt, Homo sapiens
ccgucucaaaaaaaagaaaaug

SEQ ID NO: 656173 - RNA, 20 nt, Homo sapiens
ccgucuucucucucugcucc

SEQ ID NO: 656174 - RNA, 21 nt, Homo sapiens
ccgucuuggcuuauccacuuu

SEQ ID NO: 656175 - RNA, 13 nt, Homo sapiens
ccgugaccaucuu

SEQ ID NO: 656176 - RNA, 16 nt, Homo sapiens
ccgugcaguacaggca

SEQ ID NO: 656177 - RNA, 17 nt, Homo sapiens
ccguggagacugagauc

SEQ ID NO: 656178 - RNA, 15 nt, Homo sapiens
ccguggccuggcauc

SEQ ID NO: 656179 - RNA, 15 nt, Homo sapiens
ccguguaaaccaaag

SEQ ID NO: 656180 - RNA, 22 nt, Homo sapiens
ccgugucucgcgcgacugagaa

SEQ ID NO: 656181 - RNA, 15 nt, Homo sapiens
ccguuaaaaaaucaa

SEQ ID NO: 656182 - RNA, 18 nt, Homo sapiens
ccguuaaauaauucccua

SEQ ID NO: 656183 - RNA, 21 nt, Homo sapiens
ccguuucuuaaaaaacauaua

SEQ ID NO: 656184 - RNA, 18 nt, Homo sapiens
ccuaaaaauucccuuccu

SEQ ID NO: 656185 - RNA, 20 nt, Homo sapiens
ccuaaaacaccugguaggag

SEQ ID NO: 656186 - RNA, 22 nt, Homo sapiens
ccuaaaacucaaaacacccaaa

SEQ ID NO: 656187 - RNA, 17 nt, Homo sapiens
ccuaaaagcacacucau

SEQ ID NO: 656188 - RNA, 21 nt, Homo sapiens
ccuaaaaguuacuuaccacag

SEQ ID NO: 656189 - RNA, 16 nt, Homo sapiens
ccuaaacccuguuccu

SEQ ID NO: 656190 - RNA, 17 nt, Homo sapiens
ccuaaacuguacaugug

SEQ ID NO: 656191 - RNA, 22 nt, Homo sapiens
ccuaaaguaacaucagccauuu

SEQ ID NO: 656192 - RNA, 19 nt, Homo sapiens
ccuaaauaauguuaucugu

SEQ ID NO: 656193 - RNA, 15 nt, Homo sapiens
ccuaaccccuuccag

SEQ ID NO: 656194 - RNA, 11 nt, Homo sapiens
ccuaaccucua

SEQ ID NO: 656195 - RNA, 11 nt, Homo sapiens
ccuaacuguga

SEQ ID NO: 656196 - RNA, 18 nt, Homo sapiens
ccuaagagaugggacuag

SEQ ID NO: 656197 - RNA, 21 nt, Homo sapiens
ccuaagagaugggacuaggac

SEQ ID NO: 656198 - RNA, 13 nt, Homo sapiens
ccuaagcacuuua

SEQ ID NO: 656199 - RNA, 22 nt, Homo sapiens
ccuaagcggcuguuuacugcuu

SEQ ID NO: 656200 - RNA, 22 nt, Homo sapiens
ccuaagcgggggugaaagagga

SEQ ID NO: 656201 - RNA, 15 nt, Homo sapiens
ccuaaggaucucuca

SEQ ID NO: 656202 - RNA, 19 nt, Homo sapiens
ccuaaggcacccacaaaua

SEQ ID NO: 656203 - RNA, 19 nt, Homo sapiens
ccuaaguaaguuucuuccu

SEQ ID NO: 656204 - RNA, 13 nt, Homo sapiens
ccuaaguguaaug

SEQ ID NO: 656205 - RNA, 19 nt, Homo sapiens
ccuaaguuauuaccucucc

SEQ ID NO: 656206 - RNA, 16 nt, Homo sapiens
ccuaauaacgugaaac

SEQ ID NO: 656207 - RNA, 13 nt, Homo sapiens
ccuaauacaacau

SEQ ID NO: 656208 - RNA, 17 nt, Homo sapiens
ccuaauacaacauguag

SEQ ID NO: 656209 - RNA, 16 nt, Homo sapiens
ccuaauaugcuuuaca

SEQ ID NO: 656210 - RNA, 14 nt, Homo sapiens
ccuaaucacucuga

SEQ ID NO: 656211 - RNA, 20 nt, Homo sapiens
ccuaaucaggcugagguguc

SEQ ID NO: 656212 - RNA, 23 nt, Homo sapiens
ccuaaugaaggaguucacuguaa

SEQ ID NO: 656213 - RNA, 21 nt, Homo sapiens
ccuaauggcuuucacuuucuc

SEQ ID NO: 656214 - RNA, 23 nt, Homo sapiens
ccuaauggucucuaccuaaugga

SEQ ID NO: 656215 - RNA, 19 nt, Homo sapiens
ccugauacaggcauggcag

SEQ ID NO: 656216 - RNA, 12 nt, Homo sapiens
ccugaucaccug

SEQ ID NO: 656217 - RNA, 18 nt, Homo sapiens
ccugaugaaaacauagca

SEQ ID NO: 656218 - RNA, 16 nt, Homo sapiens
ccugaugcagagccuu

SEQ ID NO: 656219 - RNA, 16 nt, Homo sapiens
ccugaugcccagguca

SEQ ID NO: 656220 - RNA, 16 nt, Homo sapiens
ccugaugcuaugguca

SEQ ID NO: 656221 - RNA, 12 nt, Homo sapiens
ccugauggugcu

SEQ ID NO: 656222 - RNA, 17 nt, Homo sapiens
ccugaugugacauucca

SEQ ID NO: 656223 - RNA, 20 nt, Homo sapiens
ccugauuuguuuucauuaua

SEQ ID NO: 656224 - RNA, 13 nt, Homo sapiens
ccugcaaaaucug

SEQ ID NO: 656225 - RNA, 15 nt, Homo sapiens
ccugcaaaccuuccu

SEQ ID NO: 656226 - RNA, 17 nt, Homo sapiens
ccugcaaagggaacuga

SEQ ID NO: 656227 - RNA, 13 nt, Homo sapiens
ccugcacagugac

SEQ ID NO: 656228 - RNA, 19 nt, Homo sapiens
ccugcacagugacuucuga

SEQ ID NO: 656229 - RNA, 14 nt, Homo sapiens
ccugcacuaggcag

SEQ ID NO: 656230 - RNA, 14 nt, Homo sapiens
ccugcacucccgac

SEQ ID NO: 656231 - RNA, 23 nt, Homo sapiens
ccugcacucccuccuggagcucu

SEQ ID NO: 656232 - RNA, 16 nt, Homo sapiens
ccugcagaauccagcu

SEQ ID NO: 656233 - RNA, 17 nt, Homo sapiens
ccugcagacagaccuca

SEQ ID NO: 656234 - RNA, 13 nt, Homo sapiens
ccugcagaccuca

SEQ ID NO: 656235 - RNA, 13 nt, Homo sapiens
ccugcagaguaua

SEQ ID NO: 656236 - RNA, 13 nt, Homo sapiens
ccugcagaugcca

SEQ ID NO: 656237 - RNA, 20 nt, Homo sapiens
ccugcagcccaaaacccagg

SEQ ID NO: 656238 - RNA, 17 nt, Homo sapiens
ccugcagcccaugguga

SEQ ID NO: 656239 - RNA, 22 nt, Homo sapiens
ccugcagcccauggugagcucu

SEQ ID NO: 656240 - RNA, 20 nt, Homo sapiens
ccugcagccuccuccugacc

SEQ ID NO: 656241 - RNA, 16 nt, Homo sapiens
ccugcaggaccucgug

SEQ ID NO: 656242 - RNA, 16 nt, Homo sapiens
ccugcaggacuugcca

SEQ ID NO: 656243 - RNA, 19 nt, Homo sapiens
ccugcaggagaaagccaag

SEQ ID NO: 656244 - RNA, 19 nt, Homo sapiens
ccugcagggacuccaugcu

SEQ ID NO: 656245 - RNA, 17 nt, Homo sapiens
ccugcagucccccgaga

SEQ ID NO: 656246 - RNA, 18 nt, Homo sapiens
ccugcagugcucauucau

SEQ ID NO: 656247 - RNA, 16 nt, Homo sapiens
ccugcaugugcuguca

SEQ ID NO: 656248 - RNA, 18 nt, Homo sapiens
ccugcauugcugagucaa

SEQ ID NO: 656249 - RNA, 19 nt, Homo sapiens
ccugcauuucucuucucag

SEQ ID NO: 656250 - RNA, 11 nt, Homo sapiens
ccugccaagag

SEQ ID NO: 656251 - RNA, 12 nt, Homo sapiens
ccugccaagagg

SEQ ID NO: 656252 - RNA, 14 nt, Homo sapiens
ccugccacugugua

SEQ ID NO: 656253 - RNA, 20 nt, Homo sapiens
ccugccacuguguacugugg

SEQ ID NO: 656254 - RNA, 14 nt, Homo sapiens
ccugccagggugag

SEQ ID NO: 656255 - RNA, 23 nt, Homo sapiens
ccugccagucccagaucacacau

SEQ ID NO: 656256 - RNA, 14 nt, Homo sapiens
ccugcccacugcug

SEQ ID NO: 656257 - RNA, 19 nt, Homo sapiens
ccugcccagccaccccuca

SEQ ID NO: 656258 - RNA, 14 nt, Homo sapiens
ccugcccaggugug

SEQ ID NO: 656259 - RNA, 10 nt, Homo sapiens
ccugccccaa

SEQ ID NO: 656260 - RNA, 18 nt, Homo sapiens
ccugccccuccccaaaag

SEQ ID NO: 656261 - RNA, 17 nt, Homo sapiens
ccugccccucucccgcc

SEQ ID NO: 656262 - RNA, 17 nt, Homo sapiens
ccugcccucugcucugc

SEQ ID NO: 656263 - RNA, 15 nt, Homo sapiens
ccugcccuuccucag

SEQ ID NO: 656264 - RNA, 18 nt, Homo sapiens
ccugcccuugaacccccu

SEQ ID NO: 656265 - RNA, 15 nt, Homo sapiens
ccugcccuuggcacc

SEQ ID NO: 656266 - RNA, 14 nt, Homo sapiens
ccugccuaggaauu

SEQ ID NO: 656267 - RNA, 22 nt, Homo sapiens
ccugccucccaagguccucuca

SEQ ID NO: 656268 - RNA, 20 nt, Homo sapiens
ccugccuccugccaccccuu

SEQ ID NO: 656269 - RNA, 21 nt, Homo sapiens
ccugccugcaucugugaaaag

SEQ ID NO: 656270 - RNA, 14 nt, Homo sapiens
ccugccuggucucu

SEQ ID NO: 656271 - RNA, 10 nt, Homo sapiens
ccugccugua

SEQ ID NO: 656272 - RNA, 19 nt, Homo sapiens
ccugccuguggcgccgucu

SEQ ID NO: 656273 - RNA, 19 nt, Homo sapiens
ccugccuuaggguagugcu

SEQ ID NO: 656274 - RNA, 23 nt, Homo sapiens
ccugcgaaguggcucucaggggc

SEQ ID NO: 656275 - RNA, 18 nt, Homo sapiens
ccugcgcauggugcagug

SEQ ID NO: 656276 - RNA, 15 nt, Homo sapiens
ccugcggcccagaag

SEQ ID NO: 656277 - RNA, 23 nt, Homo sapiens
ccugcgggcgcgggcagccaccc

SEQ ID NO: 656278 - RNA, 23 nt, Homo sapiens
ccugcgugccgggagaggacucu

SEQ ID NO: 656279 - RNA, 13 nt, Homo sapiens
ccugcuaaggagu

SEQ ID NO: 656280 - RNA, 16 nt, Homo sapiens
ccugcuagcuguagaa

SEQ ID NO: 656281 - RNA, 20 nt, Homo sapiens
ccugcuagucugucagggcc

SEQ ID NO: 656282 - RNA, 22 nt, Homo sapiens
ccugcucacaaaaucacuuuaa

SEQ ID NO: 656283 - RNA, 15 nt, Homo sapiens
ccugcucacagggau

SEQ ID NO: 656284 - RNA, 21 nt, Homo sapiens
ccugcucagcagccagucuca

SEQ ID NO: 656285 - RNA, 12 nt, Homo sapiens
ccugcucaggug

SEQ ID NO: 656286 - RNA, 19 nt, Homo sapiens
ccugcuccaguguaucuca

SEQ ID NO: 656287 - RNA, 16 nt, Homo sapiens
ccugcucccuagccag

SEQ ID NO: 656288 - RNA, 17 nt, Homo sapiens
ccugcuccgcugcuccu

SEQ ID NO: 656289 - RNA, 19 nt, Homo sapiens
ccugcuccuaaggguagaa

SEQ ID NO: 656290 - RNA, 14 nt, Homo sapiens
ccugcucuccgcac

SEQ ID NO: 656291 - RNA, 18 nt, Homo sapiens
ccugcucuccucuugcca

SEQ ID NO: 656292 - RNA, 22 nt, Homo sapiens
ccugcucuggacuugcccucuc

SEQ ID NO: 656293 - RNA, 21 nt, Homo sapiens
ccugcucuggagccugcagau

SEQ ID NO: 656294 - RNA, 22 nt, Homo sapiens
ccugcucuuucuacaugacugg

SEQ ID NO: 656295 - RNA, 22 nt, Homo sapiens
ccugcugaccucccagugaccc

SEQ ID NO: 656296 - RNA, 11 nt, Homo sapiens
ccugcugagga

SEQ ID NO: 656297 - RNA, 17 nt, Homo sapiens
ccugcugcaaagccuuu

SEQ ID NO: 656298 - RNA, 16 nt, Homo sapiens
ccugcugcacuuccug

SEQ ID NO: 656299 - RNA, 22 nt, Homo sapiens
ccugcugccagccccuuugcca

SEQ ID NO: 656300 - RNA, 18 nt, Homo sapiens
ccugcugcccagugcaaa

SEQ ID NO: 656301 - RNA, 22 nt, Homo sapiens
ccugcugcuguuaucuuuuuaa

SEQ ID NO: 656302 - RNA, 17 nt, Homo sapiens
ccugcugcuucugcaaa

SEQ ID NO: 656303 - RNA, 23 nt, Homo sapiens
ccugcuggaaaccacacuucuug

SEQ ID NO: 656304 - RNA, 10 nt, Homo sapiens
ccugcuggag

SEQ ID NO: 656305 - RNA, 16 nt, Homo sapiens
ccugcugggacugaga

SEQ ID NO: 656306 - RNA, 17 nt, Homo sapiens
ccugcugggacugagaa

SEQ ID NO: 656307 - RNA, 15 nt, Homo sapiens
ccugcuggggcugaa

SEQ ID NO: 656308 - RNA, 23 nt, Homo sapiens
ccugcugucgucuuagcaagaag

SEQ ID NO: 656309 - RNA, 12 nt, Homo sapiens
ccugcugugcug

SEQ ID NO: 656310 - RNA, 18 nt, Homo sapiens
ccugcuguguggacuuca

SEQ ID NO: 656311 - RNA, 23 nt, Homo sapiens
ccugcuuagcugccuugagcuaa

SEQ ID NO: 656312 - RNA, 22 nt, Homo sapiens
ccugcuuuccuaucuagcauuu

SEQ ID NO: 656313 - RNA, 15 nt, Homo sapiens
ccugcuuugaauaaa

SEQ ID NO: 656314 - RNA, 23 nt, Homo sapiens
ccuggaaaagaagaaacuuugcc

SEQ ID NO: 656315 - RNA, 20 nt, Homo sapiens
ccuggaaagaaaaagcaaua

SEQ ID NO: 656316 - RNA, 15 nt, Homo sapiens
ccuggaagguggaag

SEQ ID NO: 656317 - RNA, 18 nt, Homo sapiens
ccuggaaucuacaagcca

SEQ ID NO: 656318 - RNA, 16 nt, Homo sapiens
ccuggacaaggucucu

SEQ ID NO: 656319 - RNA, 22 nt, Homo sapiens
ccuggacuagagggaccucucc

SEQ ID NO: 656320 - RNA, 13 nt, Homo sapiens
ccuggacugggag

SEQ ID NO: 656321 - RNA, 17 nt, Homo sapiens
ccuggagccuccacugc

SEQ ID NO: 656322 - RNA, 22 nt, Homo sapiens
ccuggaggacagagggagacag

SEQ ID NO: 656323 - RNA, 19 nt, Homo sapiens
ccuggaggccaaggugugg

SEQ ID NO: 656324 - RNA, 16 nt, Homo sapiens
ccuggagggaggcucu

SEQ ID NO: 656325 - RNA, 19 nt, Homo sapiens
ccuggagggcacuuccucc

SEQ ID NO: 656326 - RNA, 21 nt, Homo sapiens
ccuggagugcccugcaggcac

SEQ ID NO: 656327 - RNA, 21 nt, Homo sapiens
ccuggagugucggauccugug

SEQ ID NO: 656328 - RNA, 18 nt, Homo sapiens
ccuggauaguuaagggcu

SEQ ID NO: 656329 - RNA, 14 nt, Homo sapiens
ccuggauccagcac

SEQ ID NO: 656330 - RNA, 16 nt, Homo sapiens
ccuggaucuaccagca

SEQ ID NO: 656331 - RNA, 13 nt, Homo sapiens
ccuggauguugcu

SEQ ID NO: 656332 - RNA, 14 nt, Homo sapiens
ccuggauuuugccc

SEQ ID NO: 656333 - RNA, 21 nt, Homo sapiens
ccuggcagggcucacacuccu

SEQ ID NO: 656334 - RNA, 12 nt, Homo sapiens
ccuggcaguuua

SEQ ID NO: 656335 - RNA, 22 nt, Homo sapiens
ccuggcauggugcagggagaca

SEQ ID NO: 656336 - RNA, 17 nt, Homo sapiens
ccuggcauguuccugcc

SEQ ID NO: 656337 - RNA, 13 nt, Homo sapiens
cgaauucaucccc

SEQ ID NO: 656338 - RNA, 20 nt, Homo sapiens
cgacacugucacuugaccaa

SEQ ID NO: 656339 - RNA, 21 nt, Homo sapiens
cgacauaacauuguacuguaa

SEQ ID NO: 656340 - RNA, 13 nt, Homo sapiens
cgacaucuucuca

SEQ ID NO: 656341 - RNA, 13 nt, Homo sapiens
cgacauugucucc

SEQ ID NO: 656342 - RNA, 15 nt, Homo sapiens
cgaccaacugcccua

SEQ ID NO: 656343 - RNA, 18 nt, Homo sapiens
cgaccgcccccuccucua

SEQ ID NO: 656344 - RNA, 17 nt, Homo sapiens
cgacguccccaaaccua

SEQ ID NO: 656345 - RNA, 18 nt, Homo sapiens
cgacuccacgcuguccuu

SEQ ID NO: 656346 - RNA, 15 nt, Homo sapiens
cgacucuaaacacac

SEQ ID NO: 656347 - RNA, 20 nt, Homo sapiens
cgacugagaaccgugacauc

SEQ ID NO: 656348 - RNA, 22 nt, Homo sapiens
cgacugagcuuuagacagcaga

SEQ ID NO: 656349 - RNA, 12 nt, Homo sapiens
cgagacuccauc

SEQ ID NO: 656350 - RNA, 23 nt, Homo sapiens
cgagagaaagggagugcaugugc

SEQ ID NO: 656351 - RNA, 13 nt, Homo sapiens
cgagagucccugc

SEQ ID NO: 656352 - RNA, 23 nt, Homo sapiens
cgagaguguguguauauguauua

SEQ ID NO: 656353 - RNA, 21 nt, Homo sapiens
cgagaucacgucacugcacuc

SEQ ID NO: 656354 - RNA, 15 nt, Homo sapiens
cgagauccaccagau

SEQ ID NO: 656355 - RNA, 20 nt, Homo sapiens
cgagaucgcgccacugcacu

SEQ ID NO: 656356 - RNA, 21 nt, Homo sapiens
cgagaucgcgccacugcacuc

SEQ ID NO: 656357 - RNA, 21 nt, Homo sapiens
cgagcaucccccuccucuccc

SEQ ID NO: 656358 - RNA, 16 nt, Homo sapiens
cgaggaacuccaggac

SEQ ID NO: 656359 - RNA, 22 nt, Homo sapiens
cgaggacuacaaccaauuuaca

SEQ ID NO: 656360 - RNA, 12 nt, Homo sapiens
cgaggccugaag

SEQ ID NO: 656361 - RNA, 14 nt, Homo sapiens
cgaggcgaugccac

SEQ ID NO: 656362 - RNA, 14 nt, Homo sapiens
cgagggcagcugcu

SEQ ID NO: 656363 - RNA, 15 nt, Homo sapiens
cgaggggcucaggaa

SEQ ID NO: 656364 - RNA, 21 nt, Homo sapiens
cgaggugggagaggccucauc

SEQ ID NO: 656365 - RNA, 19 nt, Homo sapiens
cgagguuccaguaaucuga

SEQ ID NO: 656366 - RNA, 14 nt, Homo sapiens
cgaguaacuccccu

SEQ ID NO: 656367 - RNA, 19 nt, Homo sapiens
cgaguagcugggauuacag

SEQ ID NO: 656368 - RNA, 15 nt, Homo sapiens
cgagucacacucaag

SEQ ID NO: 656369 - RNA, 10 nt, Homo sapiens
cgaguccuca

SEQ ID NO: 656370 - RNA, 20 nt, Homo sapiens
cgagucugccccagugggga

SEQ ID NO: 656371 - RNA, 19 nt, Homo sapiens
cgagugaaacuccgucuca

SEQ ID NO: 656372 - RNA, 14 nt, Homo sapiens
cgagugugugcaug

SEQ ID NO: 656373 - RNA, 18 nt, Homo sapiens
cgauaaagggaaccacuu

SEQ ID NO: 656374 - RNA, 14 nt, Homo sapiens
cgauaaagggauuu

SEQ ID NO: 656375 - RNA, 21 nt, Homo sapiens
cgaucaaguuguugacuguga

SEQ ID NO: 656376 - RNA, 19 nt, Homo sapiens
cgaucaggaagacuggacc

SEQ ID NO: 656377 - RNA, 16 nt, Homo sapiens
cgaucuccugaccucg

SEQ ID NO: 656378 - RNA, 16 nt, Homo sapiens
cgaucuggauuuuaaa

SEQ ID NO: 656379 - RNA, 13 nt, Homo sapiens
cgaugacaguguu

SEQ ID NO: 656380 - RNA, 14 nt, Homo sapiens
cgaugacaguguuc

SEQ ID NO: 656381 - RNA, 12 nt, Homo sapiens
cgaugcauuuaa

SEQ ID NO: 656382 - RNA, 12 nt, Homo sapiens
cgaugcugcuau

SEQ ID NO: 656383 - RNA, 13 nt, Homo sapiens
cgauggagcaguc

SEQ ID NO: 656384 - RNA, 16 nt, Homo sapiens
cgauguacaguaucag

SEQ ID NO: 656385 - RNA, 12 nt, Homo sapiens
cgauguaugcag

SEQ ID NO: 656386 - RNA, 13 nt, Homo sapiens
cgauguaugcagc

SEQ ID NO: 656387 - RNA, 12 nt, Homo sapiens
cgaugugcaagu

SEQ ID NO: 656388 - RNA, 22 nt, Homo sapiens
cgauguucuguacaacuuaacu

SEQ ID NO: 656389 - RNA, 18 nt, Homo sapiens
cgauuaaaaucacucuca

SEQ ID NO: 656390 - RNA, 19 nt, Homo sapiens
cgauugaaagaaccagaga

SEQ ID NO: 656391 - RNA, 14 nt, Homo sapiens
cgauuuaucuugcu

SEQ ID NO: 656392 - RNA, 17 nt, Homo sapiens
cgauuugggaaccaagc

SEQ ID NO: 656393 - RNA, 17 nt, Homo sapiens
cgauuugucugucaagg

SEQ ID NO: 656394 - RNA, 15 nt, Homo sapiens
cgcaaagacaucaaa

SEQ ID NO: 656395 - RNA, 15 nt, Homo sapiens
cgcacaagccagacc

SEQ ID NO: 656396 - RNA, 18 nt, Homo sapiens
cgcacagagggaagccau

SEQ ID NO: 656397 - RNA, 13 nt, Homo sapiens
cgcacagcacucc

SEQ ID NO: 656398 - RNA, 13 nt, Homo sapiens
cgcacagugcagu

SEQ ID NO: 656399 - RNA, 12 nt, Homo sapiens
cgcaccacugca

SEQ ID NO: 656400 - RNA, 16 nt, Homo sapiens
cgcaccacuguguauu

SEQ ID NO: 656401 - RNA, 20 nt, Homo sapiens
cgcaccuaaccacuggucau

SEQ ID NO: 656402 - RNA, 22 nt, Homo sapiens
cgcaccugucgguggcugccuu

SEQ ID NO: 656403 - RNA, 22 nt, Homo sapiens
cgcaccuugcugugugaccuga

SEQ ID NO: 656404 - RNA, 13 nt, Homo sapiens
cgcacgcacacac

SEQ ID NO: 656405 - RNA, 15 nt, Homo sapiens
cgcacggcagccaca

SEQ ID NO: 656406 - RNA, 18 nt, Homo sapiens
cgcacucucauaugccac

SEQ ID NO: 656407 - RNA, 15 nt, Homo sapiens
cgcacuucagaauuc

SEQ ID NO: 656408 - RNA, 21 nt, Homo sapiens
cgcagaacuaccagguggcaa

SEQ ID NO: 656409 - RNA, 17 nt, Homo sapiens
cgcagaccaccagcauc

SEQ ID NO: 656410 - RNA, 20 nt, Homo sapiens
cgcagaugaggggccacuga

SEQ ID NO: 656411 - RNA, 23 nt, Homo sapiens
cgcagggacauggggcaagccag

SEQ ID NO: 656412 - RNA, 19 nt, Homo sapiens
cgcagggaugucgcugggg

SEQ ID NO: 656413 - RNA, 16 nt, Homo sapiens
cgcagggguugcagug

SEQ ID NO: 656414 - RNA, 14 nt, Homo sapiens
cgcaggguggagau

SEQ ID NO: 656415 - RNA, 18 nt, Homo sapiens
cgcaguggcucacaccug

SEQ ID NO: 656416 - RNA, 16 nt, Homo sapiens
cgcauacacacaugcc

SEQ ID NO: 656417 - RNA, 22 nt, Homo sapiens
cgcauaugcaugccaggcuggg

SEQ ID NO: 656418 - RNA, 14 nt, Homo sapiens
cgcauauuuaacuc

SEQ ID NO: 656419 - RNA, 14 nt, Homo sapiens
cgcaucauaugcag

SEQ ID NO: 656420 - RNA, 15 nt, Homo sapiens
cgcaucucagugcag

SEQ ID NO: 656421 - RNA, 16 nt, Homo sapiens
cgcaugugugcugcag

SEQ ID NO: 656422 - RNA, 15 nt, Homo sapiens
cgcauuggugacuca

SEQ ID NO: 656423 - RNA, 13 nt, Homo sapiens
cgccagacuguua

SEQ ID NO: 656424 - RNA, 21 nt, Homo sapiens
cgccagauaaaauguucagug

SEQ ID NO: 656425 - RNA, 15 nt, Homo sapiens
cgccagcagcuguca

SEQ ID NO: 656426 - RNA, 20 nt, Homo sapiens
cgccagcucuaccaguucuc

SEQ ID NO: 656427 - RNA, 13 nt, Homo sapiens
cgccagcugggag

SEQ ID NO: 656428 - RNA, 15 nt, Homo sapiens
cgccaggaagccaga

SEQ ID NO: 656429 - RNA, 14 nt, Homo sapiens
cgccauuccaaguc

SEQ ID NO: 656430 - RNA, 23 nt, Homo sapiens
cgccauuccaagucaacacucuu

SEQ ID NO: 656431 - RNA, 20 nt, Homo sapiens
cgcccaaacuggagugcagu

SEQ ID NO: 656432 - RNA, 19 nt, Homo sapiens
cgcccacccgaguaccucc

SEQ ID NO: 656433 - RNA, 21 nt, Homo sapiens
cgcccacguggcagaccguga

SEQ ID NO: 656434 - RNA, 23 nt, Homo sapiens
cgcccagugcagucggugguacc

SEQ ID NO: 656435 - RNA, 22 nt, Homo sapiens
cgccccagggcacuacauaauu

SEQ ID NO: 656436 - RNA, 19 nt, Homo sapiens
cgccccccccuccccaugc

SEQ ID NO: 656437 - RNA, 19 nt, Homo sapiens
cgccccucgcugcugcuac

SEQ ID NO: 656438 - RNA, 18 nt, Homo sapiens
cgcccgagggauggugcc

SEQ ID NO: 656439 - RNA, 20 nt, Homo sapiens
cgcccgcucccuuccugcca

SEQ ID NO: 656440 - RNA, 19 nt, Homo sapiens
cgcccggccucagugccuu

SEQ ID NO: 656441 - RNA, 14 nt, Homo sapiens
cgcccucugaaauu

SEQ ID NO: 656442 - RNA, 23 nt, Homo sapiens
cgcccugucuaaaguguauuuuc

SEQ ID NO: 656443 - RNA, 15 nt, Homo sapiens
cgccgugcuguaaau

SEQ ID NO: 656444 - RNA, 21 nt, Homo sapiens
cgccuaugaucccagcacuuu

SEQ ID NO: 656445 - RNA, 18 nt, Homo sapiens
cgccucacugaaacaugg

SEQ ID NO: 656446 - RNA, 22 nt, Homo sapiens
cgccuguaaucccagcacuuug

SEQ ID NO: 656447 - RNA, 22 nt, Homo sapiens
cgccuguggacagccugaguca

SEQ ID NO: 656448 - RNA, 11 nt, Homo sapiens
cgcgacuucca

SEQ ID NO: 656449 - RNA, 14 nt, Homo sapiens
cgcgcacuccagcg

SEQ ID NO: 656450 - RNA, 14 nt, Homo sapiens
cgcgcccuccccca

SEQ ID NO: 656451 - RNA, 14 nt, Homo sapiens
cgcgcgacugagaa

SEQ ID NO: 656452 - RNA, 12 nt, Homo sapiens
cgcgcucaggag

SEQ ID NO: 656453 - RNA, 19 nt, Homo sapiens
cgcgcucgcccagcaggag

SEQ ID NO: 656454 - RNA, 23 nt, Homo sapiens
cgcgugaucaaagccacacucug

SEQ ID NO: 656455 - RNA, 22 nt, Homo sapiens
cgcuagagauugcuacaaaucu

SEQ ID NO: 656456 - RNA, 18 nt, Homo sapiens
cgcuauagaauaaugcau

SEQ ID NO: 656457 - RNA, 20 nt, Homo sapiens
cgcucaggcuggagugcagu

SEQ ID NO: 656458 - RNA, 13 nt, Homo sapiens
cgcucaggugauc

SEQ ID NO: 656459 - RNA, 15 nt, Homo sapiens
cucugacaguccaca

SEQ ID NO: 656460 - RNA, 14 nt, Homo sapiens
cucugaccagagau

SEQ ID NO: 656461 - RNA, 17 nt, Homo sapiens
cucugaccugcacuggg

SEQ ID NO: 656462 - RNA, 19 nt, Homo sapiens
cucugacgcaccacugcca

SEQ ID NO: 656463 - RNA, 17 nt, Homo sapiens
cucugacgcuugugaca

SEQ ID NO: 656464 - RNA, 21 nt, Homo sapiens
cucugacgcuugugacagugc

SEQ ID NO: 656465 - RNA, 14 nt, Homo sapiens
cucugagaucuaag

SEQ ID NO: 656466 - RNA, 20 nt, Homo sapiens
cucugagcacccaagccagg

SEQ ID NO: 656467 - RNA, 12 nt, Homo sapiens
cucugagcaguu

SEQ ID NO: 656468 - RNA, 22 nt, Homo sapiens
cucugagcgggaggcagaguuu

SEQ ID NO: 656469 - RNA, 15 nt, Homo sapiens
cucugagcugugcag

SEQ ID NO: 656470 - RNA, 15 nt, Homo sapiens
cucugaggacacaga

SEQ ID NO: 656471 - RNA, 21 nt, Homo sapiens
cucugagguuuccgaaaucag

SEQ ID NO: 656472 - RNA, 14 nt, Homo sapiens
cucugauacagaca

SEQ ID NO: 656473 - RNA, 15 nt, Homo sapiens
cucugauacccagag

SEQ ID NO: 656474 - RNA, 12 nt, Homo sapiens
cucugauaccuc

SEQ ID NO: 656475 - RNA, 17 nt, Homo sapiens
cucugaucccauauucu

SEQ ID NO: 656476 - RNA, 17 nt, Homo sapiens
cucugaugcagaaauua

SEQ ID NO: 656477 - RNA, 14 nt, Homo sapiens
cucugaugcagcuu

SEQ ID NO: 656478 - RNA, 12 nt, Homo sapiens
cucugaugcuga

SEQ ID NO: 656479 - RNA, 16 nt, Homo sapiens
cucugauuuacauuca

SEQ ID NO: 656480 - RNA, 21 nt, Homo sapiens
cucugcaaugggcacugggau

SEQ ID NO: 656481 - RNA, 17 nt, Homo sapiens
cucugcacuacugacau

SEQ ID NO: 656482 - RNA, 15 nt, Homo sapiens
cucugcagcacuuua

SEQ ID NO: 656483 - RNA, 17 nt, Homo sapiens
cucugcagcccucagau

SEQ ID NO: 656484 - RNA, 22 nt, Homo sapiens
cucugcauccagagauucauuu

SEQ ID NO: 656485 - RNA, 20 nt, Homo sapiens
cucugcauccauuugaacac

SEQ ID NO: 656486 - RNA, 18 nt, Homo sapiens
cucugcauggaacagcau

SEQ ID NO: 656487 - RNA, 21 nt, Homo sapiens
cucugccaaaggaugugauau

SEQ ID NO: 656488 - RNA, 20 nt, Homo sapiens
cucugccacccacucaggau

SEQ ID NO: 656489 - RNA, 11 nt, Homo sapiens
cucugccaguc

SEQ ID NO: 656490 - RNA, 13 nt, Homo sapiens
cucugccagugac

SEQ ID NO: 656491 - RNA, 17 nt, Homo sapiens
cucugccccaggcccua

SEQ ID NO: 656492 - RNA, 18 nt, Homo sapiens
cucugccccucagggggc

SEQ ID NO: 656493 - RNA, 22 nt, Homo sapiens
cucugcccuuccccucccgaca

SEQ ID NO: 656494 - RNA, 21 nt, Homo sapiens
cucugccuuaaacacacauug

SEQ ID NO: 656495 - RNA, 22 nt, Homo sapiens
cucugccuuaaacacacauugc

SEQ ID NO: 656496 - RNA, 21 nt, Homo sapiens
cucugccuuuaugaugcuaag

SEQ ID NO: 656497 - RNA, 15 nt, Homo sapiens
cucugcuacuccauc

SEQ ID NO: 656498 - RNA, 20 nt, Homo sapiens
cucugcuacuccauccugaa

SEQ ID NO: 656499 - RNA, 23 nt, Homo sapiens
cucugcuaugcauuuucuucaca

SEQ ID NO: 656500 - RNA, 17 nt, Homo sapiens
cucugcuccagacucac

SEQ ID NO: 656501 - RNA, 14 nt, Homo sapiens
cucugcuccagcaa

SEQ ID NO: 656502 - RNA, 21 nt, Homo sapiens
cucugcuccagguucacuuug

SEQ ID NO: 656503 - RNA, 21 nt, Homo sapiens
cucuggacacagccccaugua

SEQ ID NO: 656504 - RNA, 15 nt, Homo sapiens
cucuggaccagccug

SEQ ID NO: 656505 - RNA, 16 nt, Homo sapiens
cucuggaucacagaca

SEQ ID NO: 656506 - RNA, 21 nt, Homo sapiens
cucuggaucacagacacugca

SEQ ID NO: 656507 - RNA, 20 nt, Homo sapiens
cucuggaugaaggcaaaaac

SEQ ID NO: 656508 - RNA, 14 nt, Homo sapiens
cucuggcaccacac

SEQ ID NO: 656509 - RNA, 18 nt, Homo sapiens
cucuggcccacugagcca

SEQ ID NO: 656510 - RNA, 22 nt, Homo sapiens
cucuggcggcuuccuguccacu

SEQ ID NO: 656511 - RNA, 23 nt, Homo sapiens
cucuggcugcucccugacagcac

SEQ ID NO: 656512 - RNA, 22 nt, Homo sapiens
cucuggcugucugucugcagug

SEQ ID NO: 656513 - RNA, 22 nt, Homo sapiens
cucugggaauuuggagugacca

SEQ ID NO: 656514 - RNA, 17 nt, Homo sapiens
cucugggccuucucacc

SEQ ID NO: 656515 - RNA, 16 nt, Homo sapiens
cucugggcuauggaca

SEQ ID NO: 656516 - RNA, 15 nt, Homo sapiens
cucugggcuccagag

SEQ ID NO: 656517 - RNA, 19 nt, Homo sapiens
cucuggggcucaagcaguu

SEQ ID NO: 656518 - RNA, 17 nt, Homo sapiens
cucuggggucuuuuuau

SEQ ID NO: 656519 - RNA, 15 nt, Homo sapiens
cucugggucuuggcc

SEQ ID NO: 656520 - RNA, 15 nt, Homo sapiens
cucuggguuucauau

SEQ ID NO: 656521 - RNA, 15 nt, Homo sapiens
cucugguaauauuga

SEQ ID NO: 656522 - RNA, 21 nt, Homo sapiens
cucugguccuucugaccccac

SEQ ID NO: 656523 - RNA, 15 nt, Homo sapiens
cucugguggccacuu

SEQ ID NO: 656524 - RNA, 16 nt, Homo sapiens
cucuggugugugguga

SEQ ID NO: 656525 - RNA, 16 nt, Homo sapiens
cucugguuuucuugcc

SEQ ID NO: 656526 - RNA, 18 nt, Homo sapiens
cucugguuuucuugccac

SEQ ID NO: 656527 - RNA, 13 nt, Homo sapiens
cucuguaacuuac

SEQ ID NO: 656528 - RNA, 18 nt, Homo sapiens
cucuguaaguguagcuca

SEQ ID NO: 656529 - RNA, 15 nt, Homo sapiens
cucuguaauugaaua

SEQ ID NO: 656530 - RNA, 21 nt, Homo sapiens
cucuguagcucaaucugcaaa

SEQ ID NO: 656531 - RNA, 14 nt, Homo sapiens
cucuguaggccaaa

SEQ ID NO: 656532 - RNA, 22 nt, Homo sapiens
cucuguauuccgauacaaagug

SEQ ID NO: 656533 - RNA, 12 nt, Homo sapiens
cucugucagcca

SEQ ID NO: 656534 - RNA, 12 nt, Homo sapiens
cucugucaguca

SEQ ID NO: 656535 - RNA, 20 nt, Homo sapiens
cucuguccacgauucacuca

SEQ ID NO: 656536 - RNA, 10 nt, Homo sapiens
cucuguccag

SEQ ID NO: 656537 - RNA, 13 nt, Homo sapiens
cucugugacuccc

SEQ ID NO: 656538 - RNA, 19 nt, Homo sapiens
cucugugcagucacuggag

SEQ ID NO: 656539 - RNA, 13 nt, Homo sapiens
cucugugcuuuga

SEQ ID NO: 656540 - RNA, 18 nt, Homo sapiens
cucugugcuuugacucac

SEQ ID NO: 656541 - RNA, 21 nt, Homo sapiens
cucugugggugcuacacagaa

SEQ ID NO: 656542 - RNA, 19 nt, Homo sapiens
cucuguguauuuauauaaa

SEQ ID NO: 656543 - RNA, 18 nt, Homo sapiens
cucugugucucuccauca

SEQ ID NO: 656544 - RNA, 15 nt, Homo sapiens
cucuguuaacaucua

SEQ ID NO: 656545 - RNA, 12 nt, Homo sapiens
cucuuaacaaga

SEQ ID NO: 656546 - RNA, 21 nt, Homo sapiens
cucuuaauagcuauacauuaa

SEQ ID NO: 656547 - RNA, 22 nt, Homo sapiens
cucuuaaucacuacuguaugua

SEQ ID NO: 656548 - RNA, 17 nt, Homo sapiens
cucuuacaauaagcuaa

SEQ ID NO: 656549 - RNA, 15 nt, Homo sapiens
cucuuacacauagca

SEQ ID NO: 656550 - RNA, 13 nt, Homo sapiens
cucuuacagcuuu

SEQ ID NO: 656551 - RNA, 19 nt, Homo sapiens
cucuuacaucaguagcauu

SEQ ID NO: 656552 - RNA, 15 nt, Homo sapiens
cucuuagaagccaug

SEQ ID NO: 656553 - RNA, 15 nt, Homo sapiens
cucuuagauucuuaa

SEQ ID NO: 656554 - RNA, 12 nt, Homo sapiens
cucuuagcacac

SEQ ID NO: 656555 - RNA, 18 nt, Homo sapiens
cucuuagccccagacucu

SEQ ID NO: 656556 - RNA, 19 nt, Homo sapiens
cucuuagcuuucucagggg

SEQ ID NO: 656557 - RNA, 17 nt, Homo sapiens
cucuuaugugugccuuu

SEQ ID NO: 656558 - RNA, 15 nt, Homo sapiens
cucuucaacugacca

SEQ ID NO: 656559 - RNA, 22 nt, Homo sapiens
cucuucagaacacacagacuuu

SEQ ID NO: 656560 - RNA, 17 nt, Homo sapiens
cucuucaugcuugacau

SEQ ID NO: 656561 - RNA, 15 nt, Homo sapiens
cucuuccaccacaga

SEQ ID NO: 656562 - RNA, 15 nt, Homo sapiens
cucuucccaguucag

SEQ ID NO: 656563 - RNA, 15 nt, Homo sapiens
cucuuccuacccucc

SEQ ID NO: 656564 - RNA, 11 nt, Homo sapiens
cucuuccucau

SEQ ID NO: 656565 - RNA, 13 nt, Homo sapiens
cucuuccugugau

SEQ ID NO: 656566 - RNA, 14 nt, Homo sapiens
cucuuccugugauc

SEQ ID NO: 656567 - RNA, 20 nt, Homo sapiens
cucuuccuugaccugcauug

SEQ ID NO: 656568 - RNA, 20 nt, Homo sapiens
cucuucuaaucagagcgcaa

SEQ ID NO: 656569 - RNA, 23 nt, Homo sapiens
cucuucucuuccuguaacacaag

SEQ ID NO: 656570 - RNA, 12 nt, Homo sapiens
cucuucugcuaa

SEQ ID NO: 656571 - RNA, 14 nt, Homo sapiens
cucuucugcuccuu

SEQ ID NO: 656572 - RNA, 13 nt, Homo sapiens
cucuucugggcua

SEQ ID NO: 656573 - RNA, 20 nt, Homo sapiens
cucuucuuuagaacagggaa

SEQ ID NO: 656574 - RNA, 22 nt, Homo sapiens
cucuucuuuauugcacuaggaa

SEQ ID NO: 656575 - RNA, 14 nt, Homo sapiens
cucuucuuuccauu

SEQ ID NO: 656576 - RNA, 22 nt, Homo sapiens
cucuugaagacaacucugaaaa

SEQ ID NO: 656577 - RNA, 13 nt, Homo sapiens
cucuugaggccag

SEQ ID NO: 656578 - RNA, 22 nt, Homo sapiens
cucuugagguggugccuucuca

SEQ ID NO: 656579 - RNA, 19 nt, Homo sapiens
cucuugaguuccucugcag

SEQ ID NO: 656580 - RNA, 22 nt, Homo sapiens
cucuugcacagucacugcucuu

SEQ ID NO: 656581 - RNA, 16 nt, Homo sapiens
cugcagaacagcauca

SEQ ID NO: 656582 - RNA, 15 nt, Homo sapiens
cugcagaagauguga

SEQ ID NO: 656583 - RNA, 13 nt, Homo sapiens
cugcagacauucu

SEQ ID NO: 656584 - RNA, 12 nt, Homo sapiens
cugcagaccuca

SEQ ID NO: 656585 - RNA, 14 nt, Homo sapiens
cugcagaccugguu

SEQ ID NO: 656586 - RNA, 15 nt, Homo sapiens
cugcagagcaccuuu

SEQ ID NO: 656587 - RNA, 20 nt, Homo sapiens
cugcagaguaggcagcugcc

SEQ ID NO: 656588 - RNA, 17 nt, Homo sapiens
cugcagaugaucaggga

SEQ ID NO: 656589 - RNA, 13 nt, Homo sapiens
cugcagcaaacac

SEQ ID NO: 656590 - RNA, 22 nt, Homo sapiens
cugcagcacgcggccuugucug

SEQ ID NO: 656591 - RNA, 17 nt, Homo sapiens
cugcagcaggaguggug

SEQ ID NO: 656592 - RNA, 15 nt, Homo sapiens
cugcagcauguugcu

SEQ ID NO: 656593 - RNA, 12 nt, Homo sapiens
cugcagccagcu

SEQ ID NO: 656594 - RNA, 21 nt, Homo sapiens
cugcagccagcucacguccag

SEQ ID NO: 656595 - RNA, 22 nt, Homo sapiens
cugcagccccagaagaaauuag

SEQ ID NO: 656596 - RNA, 24 nt, Homo sapiens
cugcagccuccaccuccuaggcuc

SEQ ID NO: 656597 - RNA, 17 nt, Homo sapiens
cugcagcucccauuuca

SEQ ID NO: 656598 - RNA, 16 nt, Homo sapiens
cugcagcucugaccca

SEQ ID NO: 656599 - RNA, 18 nt, Homo sapiens
cugcagcuuuacugccuu

SEQ ID NO: 656600 - RNA, 15 nt, Homo sapiens
cugcaggcugcaguc

SEQ ID NO: 656601 - RNA, 19 nt, Homo sapiens
cugcagggugggaucagcc

SEQ ID NO: 656602 - RNA, 19 nt, Homo sapiens
cugcaggguuacacaaaaa

SEQ ID NO: 656603 - RNA, 20 nt, Homo sapiens
cugcagguacuuccucaguc

SEQ ID NO: 656604 - RNA, 20 nt, Homo sapiens
cugcagguuuguaaugcaaa

SEQ ID NO: 656605 - RNA, 17 nt, Homo sapiens
cugcagucaucuacuuu

SEQ ID NO: 656606 - RNA, 22 nt, Homo sapiens
cugcagucccuuucgacuugca

SEQ ID NO: 656607 - RNA, 21 nt, Homo sapiens
cugcagugacgugcaccugua

SEQ ID NO: 656608 - RNA, 12 nt, Homo sapiens
cugcaguuuccu

SEQ ID NO: 656609 - RNA, 15 nt, Homo sapiens
cugcauaguauucca

SEQ ID NO: 656610 - RNA, 21 nt, Homo sapiens
cugcauccccuuggcugugag

SEQ ID NO: 656611 - RNA, 18 nt, Homo sapiens
cugcaucuccccucagau

SEQ ID NO: 656612 - RNA, 22 nt, Homo sapiens
cugcaucuccccucagauucca

SEQ ID NO: 656613 - RNA, 16 nt, Homo sapiens
cugcaugaaacauguu

SEQ ID NO: 656614 - RNA, 12 nt, Homo sapiens
cugcaugcugcc

SEQ ID NO: 656615 - RNA, 19 nt, Homo sapiens
cugcauggcaucagacuag

SEQ ID NO: 656616 - RNA, 21 nt, Homo sapiens
cugcauguaccauuugcaugg

SEQ ID NO: 656617 - RNA, 15 nt, Homo sapiens
cugcaugugcuguca

SEQ ID NO: 656618 - RNA, 12 nt, Homo sapiens
cugcauguuaca

SEQ ID NO: 656619 - RNA, 20 nt, Homo sapiens
cugcauuaacugcacaaaca

SEQ ID NO: 656620 - RNA, 23 nt, Homo sapiens
cugcauuagagcccauuucaauu

SEQ ID NO: 656621 - RNA, 17 nt, Homo sapiens
cugcauuagucucaugu

SEQ ID NO: 656622 - RNA, 12 nt, Homo sapiens
cugcauuccagc

SEQ ID NO: 656623 - RNA, 13 nt, Homo sapiens
cugcauuccagcc

SEQ ID NO: 656624 - RNA, 21 nt, Homo sapiens
cugcauucuucugagcacugu

SEQ ID NO: 656625 - RNA, 22 nt, Homo sapiens
cugcauucuucugagcacuguu

SEQ ID NO: 656626 - RNA, 22 nt, Homo sapiens
cugcauucuuuuaaaguuuuau

SEQ ID NO: 656627 - RNA, 21 nt, Homo sapiens
cugcauuguuucaagacugac

SEQ ID NO: 656628 - RNA, 22 nt, Homo sapiens
cugcauuuauagcauacgguau

SEQ ID NO: 656629 - RNA, 15 nt, Homo sapiens
cugcauuuccucgca

SEQ ID NO: 656630 - RNA, 16 nt, Homo sapiens
cugcauuuuacuguac

SEQ ID NO: 656631 - RNA, 15 nt, Homo sapiens
cugccaaaaugcucu

SEQ ID NO: 656632 - RNA, 17 nt, Homo sapiens
cugccaaaccuguguag

SEQ ID NO: 656633 - RNA, 17 nt, Homo sapiens
cugccaagacagugaag

SEQ ID NO: 656634 - RNA, 15 nt, Homo sapiens
cugccaagacuccuc

SEQ ID NO: 656635 - RNA, 11 nt, Homo sapiens
cugccaagagu

SEQ ID NO: 656636 - RNA, 15 nt, Homo sapiens
cugccacaacaccag

SEQ ID NO: 656637 - RNA, 19 nt, Homo sapiens
cugccacacugauggcuca

SEQ ID NO: 656638 - RNA, 18 nt, Homo sapiens
cugccacagccagaggag

SEQ ID NO: 656639 - RNA, 16 nt, Homo sapiens
cugccacauccagcuu

SEQ ID NO: 656640 - RNA, 19 nt, Homo sapiens
cugccaccacgucugccag

SEQ ID NO: 656641 - RNA, 17 nt, Homo sapiens
cugccaccagucacugu

SEQ ID NO: 656642 - RNA, 13 nt, Homo sapiens
cugccaccccuuc

SEQ ID NO: 656643 - RNA, 16 nt, Homo sapiens
cugccaccucccugac

SEQ ID NO: 656644 - RNA, 13 nt, Homo sapiens
cugccaccugccc

SEQ ID NO: 656645 - RNA, 22 nt, Homo sapiens
cugccacgccgcccuaaaagca

SEQ ID NO: 656646 - RNA, 12 nt, Homo sapiens
cugccacugggc

SEQ ID NO: 656647 - RNA, 16 nt, Homo sapiens
cugccagccuggcuuc

SEQ ID NO: 656648 - RNA, 12 nt, Homo sapiens
cugccagccuug

SEQ ID NO: 656649 - RNA, 14 nt, Homo sapiens
cugccaggcacucu

SEQ ID NO: 656650 - RNA, 23 nt, Homo sapiens
cugccaggggcuucccacuuugg

SEQ ID NO: 656651 - RNA, 19 nt, Homo sapiens
cugccaggugcuuggcucu

SEQ ID NO: 656652 - RNA, 17 nt, Homo sapiens
cugccagucccagauca

SEQ ID NO: 656653 - RNA, 15 nt, Homo sapiens
cugccaguguggaac

SEQ ID NO: 656654 - RNA, 15 nt, Homo sapiens
cugccaucaugccug

SEQ ID NO: 656655 - RNA, 11 nt, Homo sapiens
cugccauguca

SEQ ID NO: 656656 - RNA, 18 nt, Homo sapiens
cugccauuucugagauca

SEQ ID NO: 656657 - RNA, 20 nt, Homo sapiens
cugcccaaacauaaagagaa

SEQ ID NO: 656658 - RNA, 16 nt, Homo sapiens
cugcccaaacuccccu

SEQ ID NO: 656659 - RNA, 19 nt, Homo sapiens
cugcccaaggaugcuguca

SEQ ID NO: 656660 - RNA, 20 nt, Homo sapiens
cugcccaccucucccugcau

SEQ ID NO: 656661 - RNA, 13 nt, Homo sapiens
cugcccagacaag

SEQ ID NO: 656662 - RNA, 21 nt, Homo sapiens
cugcccagacacagacuggca

SEQ ID NO: 656663 - RNA, 13 nt, Homo sapiens
cugcccaggugug

SEQ ID NO: 656664 - RNA, 19 nt, Homo sapiens
cugcccagugcaaaccacu

SEQ ID NO: 656665 - RNA, 23 nt, Homo sapiens
cugccccaaggccccagggacag

SEQ ID NO: 656666 - RNA, 15 nt, Homo sapiens
cugccccacccucaa

SEQ ID NO: 656667 - RNA, 13 nt, Homo sapiens
cugccccaugcug

SEQ ID NO: 656668 - RNA, 21 nt, Homo sapiens
cugcccccuugggugaccucu

SEQ ID NO: 656669 - RNA, 15 nt, Homo sapiens
cugccccucucacca

SEQ ID NO: 656670 - RNA, 16 nt, Homo sapiens
cugcccgacucagguc

SEQ ID NO: 656671 - RNA, 23 nt, Homo sapiens
cugcccgaggagcccugccugcc

SEQ ID NO: 656672 - RNA, 17 nt, Homo sapiens
cugcccucagccuguug

SEQ ID NO: 656673 - RNA, 14 nt, Homo sapiens
cugcccuccaucuc

SEQ ID NO: 656674 - RNA, 17 nt, Homo sapiens
cugcccugaacccacug

SEQ ID NO: 656675 - RNA, 15 nt, Homo sapiens
cugcccuucaacaau

SEQ ID NO: 656676 - RNA, 12 nt, Homo sapiens
cugccgacuccc

SEQ ID NO: 656677 - RNA, 19 nt, Homo sapiens
cugccgcccccuccugaac

SEQ ID NO: 656678 - RNA, 15 nt, Homo sapiens
cugccggucauuuga

SEQ ID NO: 656679 - RNA, 16 nt, Homo sapiens
cugccggucauuugaa

SEQ ID NO: 656680 - RNA, 21 nt, Homo sapiens
cugccggucgggcagccagca

SEQ ID NO: 656681 - RNA, 14 nt, Homo sapiens
cugccgucuucacu

SEQ ID NO: 656682 - RNA, 18 nt, Homo sapiens
cugccgucuucacuuccc

SEQ ID NO: 656683 - RNA, 22 nt, Homo sapiens
cugccuaggaggcuggccaagg

SEQ ID NO: 656684 - RNA, 14 nt, Homo sapiens
cugccucagccucc

SEQ ID NO: 656685 - RNA, 17 nt, Homo sapiens
cugccucagccucccaa

SEQ ID NO: 656686 - RNA, 23 nt, Homo sapiens
cugccuccauucugaccauuuca

SEQ ID NO: 656687 - RNA, 17 nt, Homo sapiens
cugccucccaugccugg

SEQ ID NO: 656688 - RNA, 19 nt, Homo sapiens
cugccuccugugacgugag

SEQ ID NO: 656689 - RNA, 14 nt, Homo sapiens
cugccuccuguuuu

SEQ ID NO: 656690 - RNA, 23 nt, Homo sapiens
cugccucucucauccacuuucca

SEQ ID NO: 656691 - RNA, 14 nt, Homo sapiens
cugccucucuucuu

SEQ ID NO: 656692 - RNA, 22 nt, Homo sapiens
cugccucugacagcagccugug

SEQ ID NO: 656693 - RNA, 14 nt, Homo sapiens
cugccucuuggccu

SEQ ID NO: 656694 - RNA, 18 nt, Homo sapiens
cugccucuuggcuucuca

SEQ ID NO: 656695 - RNA, 14 nt, Homo sapiens
cugccugagcccag

SEQ ID NO: 656696 - RNA, 16 nt, Homo sapiens
cugccugagggccccu

SEQ ID NO: 656697 - RNA, 16 nt, Homo sapiens
cugccugcggcccaga

SEQ ID NO: 656698 - RNA, 19 nt, Homo sapiens
cugccuggagagcuccuau

SEQ ID NO: 656699 - RNA, 23 nt, Homo sapiens
cugccugggaacacgugugcaca

SEQ ID NO: 656700 - RNA, 16 nt, Homo sapiens
cugccuguccccaugc

SEQ ID NO: 656701 - RNA, 14 nt, Homo sapiens
cugccuuaaacaca

SEQ ID NO: 656702 - RNA, 23 nt, Homo sapiens
cugccuuacccugguaaucagca

SEQ ID NO: 656703 - RNA, 16 nt, Homo sapiens
cuggucagcuugcuca

SEQ ID NO: 656704 - RNA, 17 nt, Homo sapiens
cuggucagguauuucag

SEQ ID NO: 656705 - RNA, 19 nt, Homo sapiens
cuggucauacgggucagua

SEQ ID NO: 656706 - RNA, 21 nt, Homo sapiens
cuggucauccuuggugcucuu

SEQ ID NO: 656707 - RNA, 18 nt, Homo sapiens
cuggucauuaaugugucc

SEQ ID NO: 656708 - RNA, 19 nt, Homo sapiens
cugguccagggcuagugac

SEQ ID NO: 656709 - RNA, 12 nt, Homo sapiens
cugguccaugau

SEQ ID NO: 656710 - RNA, 22 nt, Homo sapiens
cuggucccggggccagcacuuc

SEQ ID NO: 656711 - RNA, 18 nt, Homo sapiens
cuggucccucuucucucc

SEQ ID NO: 656712 - RNA, 17 nt, Homo sapiens
cugguccuccacuuugc

SEQ ID NO: 656713 - RNA, 18 nt, Homo sapiens
cugguccuucccugaugg

SEQ ID NO: 656714 - RNA, 18 nt, Homo sapiens
cuggucucaaacuccuga

SEQ ID NO: 656715 - RNA, 18 nt, Homo sapiens
cuggucucuucaccacug

SEQ ID NO: 656716 - RNA, 22 nt, Homo sapiens
cuggucugugaagagccggugg

SEQ ID NO: 656717 - RNA, 16 nt, Homo sapiens
cuggugagucaccacu

SEQ ID NO: 656718 - RNA, 13 nt, Homo sapiens
cuggugcaaagau

SEQ ID NO: 656719 - RNA, 15 nt, Homo sapiens
cuggugcaaguugag

SEQ ID NO: 656720 - RNA, 20 nt, Homo sapiens
cuggugcagaugguugacau

SEQ ID NO: 656721 - RNA, 20 nt, Homo sapiens
cugguggagaaagcacugac

SEQ ID NO: 656722 - RNA, 19 nt, Homo sapiens
cugguggcccgacagccug

SEQ ID NO: 656723 - RNA, 14 nt, Homo sapiens
cugguggucaggga

SEQ ID NO: 656724 - RNA, 19 nt, Homo sapiens
cuggugguuuuucagcucc

SEQ ID NO: 656725 - RNA, 15 nt, Homo sapiens
cugguguagcacuua

SEQ ID NO: 656726 - RNA, 13 nt, Homo sapiens
cugguguucacca

SEQ ID NO: 656727 - RNA, 19 nt, Homo sapiens
cugguuaccaccagccuuu

SEQ ID NO: 656728 - RNA, 17 nt, Homo sapiens
cugguuagguagaggga

SEQ ID NO: 656729 - RNA, 16 nt, Homo sapiens
cugguugacuuucuaa

SEQ ID NO: 656730 - RNA, 14 nt, Homo sapiens
cugguugcuuucua

SEQ ID NO: 656731 - RNA, 18 nt, Homo sapiens
cugguuguuaugugauca

SEQ ID NO: 656732 - RNA, 15 nt, Homo sapiens
cugguuucaccagcg

SEQ ID NO: 656733 - RNA, 18 nt, Homo sapiens
cugguuuccgaaaggcaa

SEQ ID NO: 656734 - RNA, 13 nt, Homo sapiens
cugguuucuacca

SEQ ID NO: 656735 - RNA, 20 nt, Homo sapiens
cugguuucuguucuguugau

SEQ ID NO: 656736 - RNA, 15 nt, Homo sapiens
cugguuugaaagccu

SEQ ID NO: 656737 - RNA, 15 nt, Homo sapiens
cugguuuucuugcca

SEQ ID NO: 656738 - RNA, 16 nt, Homo sapiens
cuguaaaaaauggagc

SEQ ID NO: 656739 - RNA, 23 nt, Homo sapiens
cuguaaaauggaggccauugugu

SEQ ID NO: 656740 - RNA, 14 nt, Homo sapiens
cuguaaacccugac

SEQ ID NO: 656741 - RNA, 23 nt, Homo sapiens
cuguaaacuuaacuguucuuugc

SEQ ID NO: 656742 - RNA, 21 nt, Homo sapiens
cuguaaauacuguaaaugcau

SEQ ID NO: 656743 - RNA, 12 nt, Homo sapiens
cuguaaauaucc

SEQ ID NO: 656744 - RNA, 13 nt, Homo sapiens
cuguaacagcauu

SEQ ID NO: 656745 - RNA, 23 nt, Homo sapiens
cuguaacagcggcaggguguccc

SEQ ID NO: 656746 - RNA, 18 nt, Homo sapiens
cuguaacccucacccaca

SEQ ID NO: 656747 - RNA, 23 nt, Homo sapiens
cuguaacucacauucucuuccca

SEQ ID NO: 656748 - RNA, 18 nt, Homo sapiens
cuguaacucagacauucc

SEQ ID NO: 656749 - RNA, 15 nt, Homo sapiens
cuguaagauaauguu

SEQ ID NO: 656750 - RNA, 23 nt, Homo sapiens
cuguaaguaacuucacauuaaaa

SEQ ID NO: 656751 - RNA, 16 nt, Homo sapiens
cuguaauaaagcucuu

SEQ ID NO: 656752 - RNA, 12 nt, Homo sapiens
cuguaauagugu

SEQ ID NO: 656753 - RNA, 21 nt, Homo sapiens
cuguaauaguucaguagaauu

SEQ ID NO: 656754 - RNA, 21 nt, Homo sapiens
cuguaauaguuuuauauuguu

SEQ ID NO: 656755 - RNA, 22 nt, Homo sapiens
cuguaauauuguaaauacugga

SEQ ID NO: 656756 - RNA, 15 nt, Homo sapiens
cuguaaucccaacac

SEQ ID NO: 656757 - RNA, 19 nt, Homo sapiens
cuguaaucccaacacuuug

SEQ ID NO: 656758 - RNA, 18 nt, Homo sapiens
cuguaaucccagcacuuu

SEQ ID NO: 656759 - RNA, 21 nt, Homo sapiens
cuguaaucccagcacuuuggg

SEQ ID NO: 656760 - RNA, 14 nt, Homo sapiens
cuguaaucccagcu

SEQ ID NO: 656761 - RNA, 21 nt, Homo sapiens
cuguaaucccagcuacucggg

SEQ ID NO: 656762 - RNA, 17 nt, Homo sapiens
cuguaaucucagcacuu

SEQ ID NO: 656763 - RNA, 18 nt, Homo sapiens
cuguaaucucagcacuuu

SEQ ID NO: 656764 - RNA, 19 nt, Homo sapiens
cuguaaucucagcacuuug

SEQ ID NO: 656765 - RNA, 19 nt, Homo sapiens
cuguaauggguaauucuga

SEQ ID NO: 656766 - RNA, 19 nt, Homo sapiens
cuguaauuaauaucuugcu

SEQ ID NO: 656767 - RNA, 21 nt, Homo sapiens
cuguaauuuuaaccaaucaga

SEQ ID NO: 656768 - RNA, 21 nt, Homo sapiens
cuguacaaugaacccccauga

SEQ ID NO: 656769 - RNA, 13 nt, Homo sapiens
cuguacacaggcg

SEQ ID NO: 656770 - RNA, 19 nt, Homo sapiens
cuguacacugacuugagac

SEQ ID NO: 656771 - RNA, 21 nt, Homo sapiens
cuguacagaaaguaucacaaa

SEQ ID NO: 656772 - RNA, 15 nt, Homo sapiens
cuguacagugucuuu

SEQ ID NO: 656773 - RNA, 13 nt, Homo sapiens
cuguacaugacau

SEQ ID NO: 656774 - RNA, 18 nt, Homo sapiens
cuguacauugugagcucu

SEQ ID NO: 656775 - RNA, 22 nt, Homo sapiens
cuguacccuugagaccuggaac

SEQ ID NO: 656776 - RNA, 16 nt, Homo sapiens
cuguaccgacuuugau

SEQ ID NO: 656777 - RNA, 19 nt, Homo sapiens
cuguacuaacaaagccaaa

SEQ ID NO: 656778 - RNA, 21 nt, Homo sapiens
cuguacuguugggaaguuuug

SEQ ID NO: 656779 - RNA, 22 nt, Homo sapiens
cuguagaaaaaaaaauucacau

SEQ ID NO: 656780 - RNA, 22 nt, Homo sapiens
cuguagaaaagggaacugaaca

SEQ ID NO: 656781 - RNA, 20 nt, Homo sapiens
cuguagaccaccuaauauca

SEQ ID NO: 656782 - RNA, 22 nt, Homo sapiens
cuguagaccaccuaauaucaau

SEQ ID NO: 656783 - RNA, 17 nt, Homo sapiens
cuguagacuagugccgu

SEQ ID NO: 656784 - RNA, 11 nt, Homo sapiens
cuguagacuua

SEQ ID NO: 656785 - RNA, 13 nt, Homo sapiens
cuguagaguugcu

SEQ ID NO: 656786 - RNA, 18 nt, Homo sapiens
cuguagcucaaucugcaa

SEQ ID NO: 656787 - RNA, 16 nt, Homo sapiens
cuguaggaacaagcau

SEQ ID NO: 656788 - RNA, 22 nt, Homo sapiens
cuguaggaacaagcaugaucuu

SEQ ID NO: 656789 - RNA, 16 nt, Homo sapiens
cuguaggaauaagcau

SEQ ID NO: 656790 - RNA, 18 nt, Homo sapiens
cuguagguucaugcccaa

SEQ ID NO: 656791 - RNA, 17 nt, Homo sapiens
cuguaguaaauggcaau

SEQ ID NO: 656792 - RNA, 12 nt, Homo sapiens
cuguagucccag

SEQ ID NO: 656793 - RNA, 21 nt, Homo sapiens
cuguagucccagccacucggg

SEQ ID NO: 656794 - RNA, 19 nt, Homo sapiens
cuguagucccagcuacuca

SEQ ID NO: 656795 - RNA, 21 nt, Homo sapiens
cuguagucccagcuacuuggg

SEQ ID NO: 656796 - RNA, 21 nt, Homo sapiens
cuguagugagauagcauugug

SEQ ID NO: 656797 - RNA, 15 nt, Homo sapiens
cuguaguuacugugg

SEQ ID NO: 656798 - RNA, 16 nt, Homo sapiens
cuguaguuuuacauau

SEQ ID NO: 656799 - RNA, 13 nt, Homo sapiens
cuguauaagugga

SEQ ID NO: 656800 - RNA, 23 nt, Homo sapiens
cuguauagacaugcuaccacugg

SEQ ID NO: 656801 - RNA, 22 nt, Homo sapiens
cuguauaugauucucugugguu

SEQ ID NO: 656802 - RNA, 18 nt, Homo sapiens
cuguauccagaagccagu

SEQ ID NO: 656803 - RNA, 19 nt, Homo sapiens
cuguaucuuguuuuuccac

SEQ ID NO: 656804 - RNA, 16 nt, Homo sapiens
cuguaugaaugugauu

SEQ ID NO: 656805 - RNA, 23 nt, Homo sapiens
cuguaugagacaggaaaaaccaa

SEQ ID NO: 656806 - RNA, 16 nt, Homo sapiens
cuguaugauuccuuga

SEQ ID NO: 656807 - RNA, 11 nt, Homo sapiens
cuguaugcauc

SEQ ID NO: 656808 - RNA, 14 nt, Homo sapiens
cuguauggcacuua

SEQ ID NO: 656809 - RNA, 22 nt, Homo sapiens
cuguauguaaacuguuacugaa

SEQ ID NO: 656810 - RNA, 22 nt, Homo sapiens
cuguaugucaauaaacaacagc

SEQ ID NO: 656811 - RNA, 20 nt, Homo sapiens
cuguaugugccaaagcuuua

SEQ ID NO: 656812 - RNA, 16 nt, Homo sapiens
cuguauuaagccacuu

SEQ ID NO: 656813 - RNA, 15 nt, Homo sapiens
cuguauuaguuuuug

SEQ ID NO: 656814 - RNA, 21 nt, Homo sapiens
cuguauuaguuuuugaucaag

SEQ ID NO: 656815 - RNA, 21 nt, Homo sapiens
cuguauuauaauaagcaaaaa

SEQ ID NO: 656816 - RNA, 12 nt, Homo sapiens
cuguauucuggc

SEQ ID NO: 656817 - RNA, 21 nt, Homo sapiens
cuguauucuguuugcguacuu

SEQ ID NO: 656818 - RNA, 17 nt, Homo sapiens
cuguauuucaagaccuc

SEQ ID NO: 656819 - RNA, 23 nt, Homo sapiens
cuguauuuguaucucugaagcau

SEQ ID NO: 656820 - RNA, 16 nt, Homo sapiens
cugucaaaacuacuga

SEQ ID NO: 656821 - RNA, 19 nt, Homo sapiens
cugucaaguuaacaaggaa

SEQ ID NO: 656822 - RNA, 17 nt, Homo sapiens
cugucacacacuggacc

SEQ ID NO: 656823 - RNA, 12 nt, Homo sapiens
cugucaccaccc

SEQ ID NO: 656824 - RNA, 14 nt, Homo sapiens
cuuccaacaaggaa

SEQ ID NO: 656825 - RNA, 19 nt, Homo sapiens
cuuccaacccgaggcaaua

SEQ ID NO: 656826 - RNA, 23 nt, Homo sapiens
cuuccaagacugaagacugcaca

SEQ ID NO: 656827 - RNA, 11 nt, Homo sapiens
cuuccaaggau

SEQ ID NO: 656828 - RNA, 14 nt, Homo sapiens
cuuccaaggccaga

SEQ ID NO: 656829 - RNA, 19 nt, Homo sapiens
cuuccaaggguacuaagga

SEQ ID NO: 656830 - RNA, 13 nt, Homo sapiens
cuuccaccacaga

SEQ ID NO: 656831 - RNA, 19 nt, Homo sapiens
cuuccaccucagucuccca

SEQ ID NO: 656832 - RNA, 12 nt, Homo sapiens
cuuccaccucau

SEQ ID NO: 656833 - RNA, 18 nt, Homo sapiens
cuuccagaucacugccac

SEQ ID NO: 656834 - RNA, 16 nt, Homo sapiens
cuuccaggaaugcugg

SEQ ID NO: 656835 - RNA, 18 nt, Homo sapiens
cuuccaggcacucaaaag

SEQ ID NO: 656836 - RNA, 18 nt, Homo sapiens
cuuccaggggaaccugcc

SEQ ID NO: 656837 - RNA, 21 nt, Homo sapiens
cuuccagggggaaggccaagg

SEQ ID NO: 656838 - RNA, 16 nt, Homo sapiens
cuuccagugaacauuc

SEQ ID NO: 656839 - RNA, 14 nt, Homo sapiens
cuuccagugcccaa

SEQ ID NO: 656840 - RNA, 21 nt, Homo sapiens
cuuccauaggacauacugcau

SEQ ID NO: 656841 - RNA, 23 nt, Homo sapiens
cuuccauaggacauacugcaugu

SEQ ID NO: 656842 - RNA, 18 nt, Homo sapiens
cuuccaucaucacuguaa

SEQ ID NO: 656843 - RNA, 13 nt, Homo sapiens
cuuccaucaugga

SEQ ID NO: 656844 - RNA, 18 nt, Homo sapiens
cuuccauuugcaagggaa

SEQ ID NO: 656845 - RNA, 21 nt, Homo sapiens
cuucccaaguagcugggauua

SEQ ID NO: 656846 - RNA, 23 nt, Homo sapiens
cuucccaccuacugcacuuuccc

SEQ ID NO: 656847 - RNA, 13 nt, Homo sapiens
cuucccacuuugg

SEQ ID NO: 656848 - RNA, 23 nt, Homo sapiens
cuucccagcacuaugcuuuccuu

SEQ ID NO: 656849 - RNA, 20 nt, Homo sapiens
cuucccagcccucaucccac

SEQ ID NO: 656850 - RNA, 17 nt, Homo sapiens
cuucccaguucuugacc

SEQ ID NO: 656851 - RNA, 19 nt, Homo sapiens
cuucccaugggcagaggac

SEQ ID NO: 656852 - RNA, 15 nt, Homo sapiens
cuuccccaacuuccc

SEQ ID NO: 656853 - RNA, 21 nt, Homo sapiens
cuuccccagguccuuccuuua

SEQ ID NO: 656854 - RNA, 16 nt, Homo sapiens
cuuccccaucuucuaa

SEQ ID NO: 656855 - RNA, 14 nt, Homo sapiens
cuucccccuugugg

SEQ ID NO: 656856 - RNA, 14 nt, Homo sapiens
cuuccccuccaaaa

SEQ ID NO: 656857 - RNA, 21 nt, Homo sapiens
cuuccccucugcggcuuucac

SEQ ID NO: 656858 - RNA, 16 nt, Homo sapiens
cuuccccugggcaaga

SEQ ID NO: 656859 - RNA, 19 nt, Homo sapiens
cuuccccuugcccuugccc

SEQ ID NO: 656860 - RNA, 16 nt, Homo sapiens
cuucccucacaccgcg

SEQ ID NO: 656861 - RNA, 14 nt, Homo sapiens
cuucccucagauuu

SEQ ID NO: 656862 - RNA, 22 nt, Homo sapiens
cuucccuccucccaugucacug

SEQ ID NO: 656863 - RNA, 16 nt, Homo sapiens
cuucccucgacuugac

SEQ ID NO: 656864 - RNA, 13 nt, Homo sapiens
cuucccucgggga

SEQ ID NO: 656865 - RNA, 22 nt, Homo sapiens
cuucccucucugcagacuuccc

SEQ ID NO: 656866 - RNA, 13 nt, Homo sapiens
cuucccugaucaa

SEQ ID NO: 656867 - RNA, 18 nt, Homo sapiens
cuucccugauggccuuug

SEQ ID NO: 656868 - RNA, 20 nt, Homo sapiens
cuucccuggcaugauggaca

SEQ ID NO: 656869 - RNA, 21 nt, Homo sapiens
cuucccuggcuuguaacucca

SEQ ID NO: 656870 - RNA, 15 nt, Homo sapiens
cuucccuuaacucca

SEQ ID NO: 656871 - RNA, 19 nt, Homo sapiens
cuucccuucuuugcugcug

SEQ ID NO: 656872 - RNA, 17 nt, Homo sapiens
cuuccgcaguguggcca

SEQ ID NO: 656873 - RNA, 20 nt, Homo sapiens
cuuccuaaacuuuccaaaac

SEQ ID NO: 656874 - RNA, 12 nt, Homo sapiens
cuuccuaagucu

SEQ ID NO: 656875 - RNA, 12 nt, Homo sapiens
cuuccuacccug

SEQ ID NO: 656876 - RNA, 12 nt, Homo sapiens
cuuccuaccucu

SEQ ID NO: 656877 - RNA, 13 nt, Homo sapiens
cuuccuacuguag

SEQ ID NO: 656878 - RNA, 16 nt, Homo sapiens
cuuccucagcuguaga

SEQ ID NO: 656879 - RNA, 13 nt, Homo sapiens
cuuccuccagcug

SEQ ID NO: 656880 - RNA, 14 nt, Homo sapiens
cuuccucccauuca

SEQ ID NO: 656881 - RNA, 12 nt, Homo sapiens
cuuccuccucag

SEQ ID NO: 656882 - RNA, 15 nt, Homo sapiens
cuuccuccuccauca

SEQ ID NO: 656883 - RNA, 18 nt, Homo sapiens
cuuccuccucgcugccag

SEQ ID NO: 656884 - RNA, 14 nt, Homo sapiens
cuuccuccugaugg

SEQ ID NO: 656885 - RNA, 20 nt, Homo sapiens
cuuccuccugauggccaaga

SEQ ID NO: 656886 - RNA, 16 nt, Homo sapiens
cuuccucuagaagcca

SEQ ID NO: 656887 - RNA, 18 nt, Homo sapiens
cuuccucuagaagccaag

SEQ ID NO: 656888 - RNA, 21 nt, Homo sapiens
cuuccucucaggcucuugacu

SEQ ID NO: 656889 - RNA, 17 nt, Homo sapiens
cuuccucugauuuacau

SEQ ID NO: 656890 - RNA, 21 nt, Homo sapiens
cuuccucugcagaauaaaauc

SEQ ID NO: 656891 - RNA, 22 nt, Homo sapiens
cuuccugaagggggacacucca

SEQ ID NO: 656892 - RNA, 19 nt, Homo sapiens
cuuccugaguggugccaaa

SEQ ID NO: 656893 - RNA, 12 nt, Homo sapiens
cuuccugcagua

SEQ ID NO: 656894 - RNA, 19 nt, Homo sapiens
cuuccuggaguacaaacac

SEQ ID NO: 656895 - RNA, 15 nt, Homo sapiens
cuuccuggcaucaua

SEQ ID NO: 656896 - RNA, 14 nt, Homo sapiens
cuuccuggcuguaa

SEQ ID NO: 656897 - RNA, 19 nt, Homo sapiens
cuuccugguagacuagguu

SEQ ID NO: 656898 - RNA, 12 nt, Homo sapiens
cuuccugugauc

SEQ ID NO: 656899 - RNA, 20 nt, Homo sapiens
cuuccugugauccacccaac

SEQ ID NO: 656900 - RNA, 23 nt, Homo sapiens
cuuccuguguggccugccuucac

SEQ ID NO: 656901 - RNA, 14 nt, Homo sapiens
cuuccuucaggacu

SEQ ID NO: 656902 - RNA, 18 nt, Homo sapiens
cuuccuuccucucugcaa

SEQ ID NO: 656903 - RNA, 21 nt, Homo sapiens
cuuccuuggaggggggagcca

SEQ ID NO: 656904 - RNA, 13 nt, Homo sapiens
cuuccuugucucu

SEQ ID NO: 656905 - RNA, 13 nt, Homo sapiens
cuucgaaaaucua

SEQ ID NO: 656906 - RNA, 13 nt, Homo sapiens
cuucgacuacugc

SEQ ID NO: 656907 - RNA, 15 nt, Homo sapiens
cuucgaggacaggaa

SEQ ID NO: 656908 - RNA, 13 nt, Homo sapiens
cuucggcauuuga

SEQ ID NO: 656909 - RNA, 15 nt, Homo sapiens
cuucggcuugugagg

SEQ ID NO: 656910 - RNA, 16 nt, Homo sapiens
cuucguaagaaggaau

SEQ ID NO: 656911 - RNA, 13 nt, Homo sapiens
cuucuaaaagcca

SEQ ID NO: 656912 - RNA, 14 nt, Homo sapiens
cuucuaaauggcau

SEQ ID NO: 656913 - RNA, 15 nt, Homo sapiens
cuucuaacacaaaau

SEQ ID NO: 656914 - RNA, 19 nt, Homo sapiens
cuucuaaucccagcacuuu

SEQ ID NO: 656915 - RNA, 19 nt, Homo sapiens
cuucuaauuagaucaauua

SEQ ID NO: 656916 - RNA, 16 nt, Homo sapiens
cuucuaccaccagggc

SEQ ID NO: 656917 - RNA, 13 nt, Homo sapiens
cuucuacuccucc

SEQ ID NO: 656918 - RNA, 16 nt, Homo sapiens
cuucuagaacaccugc

SEQ ID NO: 656919 - RNA, 15 nt, Homo sapiens
cuucuagacagaguu

SEQ ID NO: 656920 - RNA, 13 nt, Homo sapiens
cuucuaggugccc

SEQ ID NO: 656921 - RNA, 20 nt, Homo sapiens
cuucuaguuucccacaauau

SEQ ID NO: 656922 - RNA, 14 nt, Homo sapiens
cuucuaguuugcaa

SEQ ID NO: 656923 - RNA, 19 nt, Homo sapiens
cuucuaugguugacauugu

SEQ ID NO: 656924 - RNA, 13 nt, Homo sapiens
cuucuauuaauca

SEQ ID NO: 656925 - RNA, 19 nt, Homo sapiens
cuucuauuuaaugcuucca

SEQ ID NO: 656926 - RNA, 20 nt, Homo sapiens
cuucucaaauuagcugcaau

SEQ ID NO: 656927 - RNA, 17 nt, Homo sapiens
cuucucaagugccuuaa

SEQ ID NO: 656928 - RNA, 21 nt, Homo sapiens
cuucucacccuaugugggugg

SEQ ID NO: 656929 - RNA, 16 nt, Homo sapiens
cuucucacgggcucua

SEQ ID NO: 656930 - RNA, 20 nt, Homo sapiens
cuucucagcucuuccaugau

SEQ ID NO: 656931 - RNA, 14 nt, Homo sapiens
cuucucauagcauu

SEQ ID NO: 656932 - RNA, 15 nt, Homo sapiens
cuucucaugauccaa

SEQ ID NO: 656933 - RNA, 12 nt, Homo sapiens
cuucucauuucu

SEQ ID NO: 656934 - RNA, 12 nt, Homo sapiens
cuucuccaguau

SEQ ID NO: 656935 - RNA, 17 nt, Homo sapiens
cuucuccgcccauucug

SEQ ID NO: 656936 - RNA, 14 nt, Homo sapiens
cuucuccuaauucu

SEQ ID NO: 656937 - RNA, 15 nt, Homo sapiens
cuucuccugccuaau

SEQ ID NO: 656938 - RNA, 16 nt, Homo sapiens
cuucucggagacccau

SEQ ID NO: 656939 - RNA, 15 nt, Homo sapiens
cuucucuacagacuc

SEQ ID NO: 656940 - RNA, 19 nt, Homo sapiens
cuucucuacagacuccaaa

SEQ ID NO: 656941 - RNA, 22 nt, Homo sapiens
cuucucuacagacuccaaaagg

SEQ ID NO: 656942 - RNA, 18 nt, Homo sapiens
cuucucuacagacuucuc

SEQ ID NO: 656943 - RNA, 22 nt, Homo sapiens
cuucucuauugggcacagccua

SEQ ID NO: 656944 - RNA, 17 nt, Homo sapiens
cuucucuccacaguguu

SEQ ID NO: 656945 - RNA, 19 nt, Homo sapiens
cuucucuccagcugacuaa

SEQ ID NO: 656946 - RNA, 17 nt, Homo sapiens
cuucucuccuuucuccc

SEQ ID NO: 656947 - RNA, 22 nt, Homo sapiens
gacaaugcugagguuaugaaca

SEQ ID NO: 656948 - RNA, 21 nt, Homo sapiens
gacaauuuugcuucacuuugc

SEQ ID NO: 656949 - RNA, 13 nt, Homo sapiens
gacacaaaugcau

SEQ ID NO: 656950 - RNA, 14 nt, Homo sapiens
gacacaaaugcaug

SEQ ID NO: 656951 - RNA, 12 nt, Homo sapiens
gacacaaggcac

SEQ ID NO: 656952 - RNA, 15 nt, Homo sapiens
gacacacuguuacac

SEQ ID NO: 656953 - RNA, 17 nt, Homo sapiens
gacacagaagccuuuga

SEQ ID NO: 656954 - RNA, 16 nt, Homo sapiens
gacacagauuggccag

SEQ ID NO: 656955 - RNA, 19 nt, Homo sapiens
gacacagcaccgugccaac

SEQ ID NO: 656956 - RNA, 21 nt, Homo sapiens
gacacagcagcuucaccagag

SEQ ID NO: 656957 - RNA, 17 nt, Homo sapiens
gacacagccuuggauca

SEQ ID NO: 656958 - RNA, 18 nt, Homo sapiens
gacacauagaaaacaauc

SEQ ID NO: 656959 - RNA, 19 nt, Homo sapiens
gacacauagaaaacaauca

SEQ ID NO: 656960 - RNA, 20 nt, Homo sapiens
gacacaugaagguaaauaaa

SEQ ID NO: 656961 - RNA, 17 nt, Homo sapiens
gacacaugcaaggucau

SEQ ID NO: 656962 - RNA, 15 nt, Homo sapiens
gacacauuuuuuugc

SEQ ID NO: 656963 - RNA, 18 nt, Homo sapiens
gacaccacaaggcagccu

SEQ ID NO: 656964 - RNA, 16 nt, Homo sapiens
gacaccauuaccaaaa

SEQ ID NO: 656965 - RNA, 14 nt, Homo sapiens
gacacccaacacuu

SEQ ID NO: 656966 - RNA, 20 nt, Homo sapiens
gacacccaacacuuuuucca

SEQ ID NO: 656967 - RNA, 17 nt, Homo sapiens
gacaccgcucaguauua

SEQ ID NO: 656968 - RNA, 18 nt, Homo sapiens
gacaccgucccucaguga

SEQ ID NO: 656969 - RNA, 21 nt, Homo sapiens
gacaccuagaaaggaacugca

SEQ ID NO: 656970 - RNA, 16 nt, Homo sapiens
gacaccucaccucacc

SEQ ID NO: 656971 - RNA, 14 nt, Homo sapiens
gacaccuccgagag

SEQ ID NO: 656972 - RNA, 17 nt, Homo sapiens
gacaccuggugcuuuua

SEQ ID NO: 656973 - RNA, 20 nt, Homo sapiens
gacaccuguacauucuucca

SEQ ID NO: 656974 - RNA, 14 nt, Homo sapiens
gacacuacauaucu

SEQ ID NO: 656975 - RNA, 23 nt, Homo sapiens
gacacuacaugaugacucaaggc

SEQ ID NO: 656976 - RNA, 21 nt, Homo sapiens
gacacucacacggacacucaa

SEQ ID NO: 656977 - RNA, 20 nt, Homo sapiens
gacacucagaguaaugucua

SEQ ID NO: 656978 - RNA, 19 nt, Homo sapiens
gacacuccccgaagucuuu

SEQ ID NO: 656979 - RNA, 22 nt, Homo sapiens
gacacucuauaagauuccaaaa

SEQ ID NO: 656980 - RNA, 16 nt, Homo sapiens
gacacugacaaaguca

SEQ ID NO: 656981 - RNA, 15 nt, Homo sapiens
gacacugcaaaggcg

SEQ ID NO: 656982 - RNA, 15 nt, Homo sapiens
gacacugcagacuug

SEQ ID NO: 656983 - RNA, 18 nt, Homo sapiens
gacacuggccccacagga

SEQ ID NO: 656984 - RNA, 19 nt, Homo sapiens
gacacuggcguuacugcuu

SEQ ID NO: 656985 - RNA, 12 nt, Homo sapiens
gacacugucacu

SEQ ID NO: 656986 - RNA, 14 nt, Homo sapiens
gacacuuaauacua

SEQ ID NO: 656987 - RNA, 22 nt, Homo sapiens
gacacuuaauacuaccuugaaa

SEQ ID NO: 656988 - RNA, 16 nt, Homo sapiens
gacacuucagaucuga

SEQ ID NO: 656989 - RNA, 22 nt, Homo sapiens
gacagaaacccaguaacuugca

SEQ ID NO: 656990 - RNA, 13 nt, Homo sapiens
gacagaacugucc

SEQ ID NO: 656991 - RNA, 17 nt, Homo sapiens
gacagaaugguggagug

SEQ ID NO: 656992 - RNA, 20 nt, Homo sapiens
gacagaauuguacacaauca

SEQ ID NO: 656993 - RNA, 16 nt, Homo sapiens
gacagacccagugagu

SEQ ID NO: 656994 - RNA, 22 nt, Homo sapiens
gacagagucccuggcuccucua

SEQ ID NO: 656995 - RNA, 22 nt, Homo sapiens
gacagagugaauuucaguauaa

SEQ ID NO: 656996 - RNA, 20 nt, Homo sapiens
gacagagugagaccauguuu

SEQ ID NO: 656997 - RNA, 20 nt, Homo sapiens
gacagaucaagcugugagac

SEQ ID NO: 656998 - RNA, 17 nt, Homo sapiens
gacagaugaccaaagcc

SEQ ID NO: 656999 - RNA, 13 nt, Homo sapiens
gacagauggacac

SEQ ID NO: 657000 - RNA, 16 nt, Homo sapiens
gacagauggacacugc

SEQ ID NO: 657001 - RNA, 19 nt, Homo sapiens
gacagauuuaaccucugcc

SEQ ID NO: 657002 - RNA, 12 nt, Homo sapiens
gacagcaaguga

SEQ ID NO: 657003 - RNA, 21 nt, Homo sapiens
gacagcacugggaaccuagcu

SEQ ID NO: 657004 - RNA, 14 nt, Homo sapiens
gacagcagauucca

SEQ ID NO: 657005 - RNA, 16 nt, Homo sapiens
gacagcagccugugag

SEQ ID NO: 657006 - RNA, 18 nt, Homo sapiens
gacagcaucccuucccac

SEQ ID NO: 657007 - RNA, 12 nt, Homo sapiens
gacagcaugaaa

SEQ ID NO: 657008 - RNA, 14 nt, Homo sapiens
gacagccugaguca

SEQ ID NO: 657009 - RNA, 14 nt, Homo sapiens
gacagccuugccca

SEQ ID NO: 657010 - RNA, 18 nt, Homo sapiens
gacagcugcugugcauua

SEQ ID NO: 657011 - RNA, 16 nt, Homo sapiens
gacagcuuccuuuccu

SEQ ID NO: 657012 - RNA, 15 nt, Homo sapiens
gacagcuuucuggga

SEQ ID NO: 657013 - RNA, 17 nt, Homo sapiens
gacagcuuugcugcuga

SEQ ID NO: 657014 - RNA, 13 nt, Homo sapiens
gacaggaagcugg

SEQ ID NO: 657015 - RNA, 16 nt, Homo sapiens
gacaggaauacuuaac

SEQ ID NO: 657016 - RNA, 20 nt, Homo sapiens
gacaggagccugguccuucc

SEQ ID NO: 657017 - RNA, 19 nt, Homo sapiens
gacaggcaaagacugcagu

SEQ ID NO: 657018 - RNA, 15 nt, Homo sapiens
gacaggcaaauuuca

SEQ ID NO: 657019 - RNA, 17 nt, Homo sapiens
gacaggccagaugaacu

SEQ ID NO: 657020 - RNA, 20 nt, Homo sapiens
gacaggcucugcuucuccaa

SEQ ID NO: 657021 - RNA, 20 nt, Homo sapiens
gacagggacaugcccugugu

SEQ ID NO: 657022 - RNA, 18 nt, Homo sapiens
gacagggcugcuccccaa

SEQ ID NO: 657023 - RNA, 18 nt, Homo sapiens
gacaguaccuagcuguaa

SEQ ID NO: 657024 - RNA, 10 nt, Homo sapiens
gacagucauc

SEQ ID NO: 657025 - RNA, 14 nt, Homo sapiens
gacaguccacaggg

SEQ ID NO: 657026 - RNA, 18 nt, Homo sapiens
gacaguccacaggggcca

SEQ ID NO: 657027 - RNA, 18 nt, Homo sapiens
gacagucuggaaagugau

SEQ ID NO: 657028 - RNA, 15 nt, Homo sapiens
gacagugaggcugca

SEQ ID NO: 657029 - RNA, 19 nt, Homo sapiens
gacagugcauuugccuugu

SEQ ID NO: 657030 - RNA, 21 nt, Homo sapiens
gacagugccugggaauguauu

SEQ ID NO: 657031 - RNA, 14 nt, Homo sapiens
gacaguuucugaca

SEQ ID NO: 657032 - RNA, 23 nt, Homo sapiens
gacauaaaacuuuaaaaggcaac

SEQ ID NO: 657033 - RNA, 21 nt, Homo sapiens
gacauacuagaguugauuaua

SEQ ID NO: 657034 - RNA, 21 nt, Homo sapiens
gacauacugcauguaagccaa

SEQ ID NO: 657035 - RNA, 13 nt, Homo sapiens
gacauagccucau

SEQ ID NO: 657036 - RNA, 17 nt, Homo sapiens
gacauauaucuauuaca

SEQ ID NO: 657037 - RNA, 16 nt, Homo sapiens
gacaucaaauuugcca

SEQ ID NO: 657038 - RNA, 23 nt, Homo sapiens
gacaucccugauucucucuccau

SEQ ID NO: 657039 - RNA, 16 nt, Homo sapiens
gacaucgguucauauu

SEQ ID NO: 657040 - RNA, 19 nt, Homo sapiens
gacaucuccagugugccag

SEQ ID NO: 657041 - RNA, 16 nt, Homo sapiens
gacaucuguagggaau

SEQ ID NO: 657042 - RNA, 22 nt, Homo sapiens
gacaucuucucaaccuuaucaa

SEQ ID NO: 657043 - RNA, 18 nt, Homo sapiens
gacaugaaaggacccugu

SEQ ID NO: 657044 - RNA, 19 nt, Homo sapiens
gacaugaaaggacccugug

SEQ ID NO: 657045 - RNA, 18 nt, Homo sapiens
gacaugaagaaaaggaaa

SEQ ID NO: 657046 - RNA, 22 nt, Homo sapiens
gacaugagucuguaggagcaag

SEQ ID NO: 657047 - RNA, 14 nt, Homo sapiens
gacaugagucuuug

SEQ ID NO: 657048 - RNA, 16 nt, Homo sapiens
gacauggaauuaccuu

SEQ ID NO: 657049 - RNA, 17 nt, Homo sapiens
gacauggaauuaccuua

SEQ ID NO: 657050 - RNA, 16 nt, Homo sapiens
gacaugugaagcuauu

SEQ ID NO: 657051 - RNA, 13 nt, Homo sapiens
gacaugugacauu

SEQ ID NO: 657052 - RNA, 20 nt, Homo sapiens
gacaugugcuggacacuguc

SEQ ID NO: 657053 - RNA, 16 nt, Homo sapiens
gacauguggggccagg

SEQ ID NO: 657054 - RNA, 21 nt, Homo sapiens
gacauuaacaguuuuccauga

SEQ ID NO: 657055 - RNA, 23 nt, Homo sapiens
gacauuaacaguuuuccaugaaa

SEQ ID NO: 657056 - RNA, 16 nt, Homo sapiens
gacauucaaggcauuu

SEQ ID NO: 657057 - RNA, 15 nt, Homo sapiens
gacauucacugcuga

SEQ ID NO: 657058 - RNA, 18 nt, Homo sapiens
gacauugcuggucauccu

SEQ ID NO: 657059 - RNA, 12 nt, Homo sapiens
gacauugucucc

SEQ ID NO: 657060 - RNA, 18 nt, Homo sapiens
gacauuucacugaugcuu

SEQ ID NO: 657061 - RNA, 20 nt, Homo sapiens
gacauuuuggaagcugagau

SEQ ID NO: 657062 - RNA, 16 nt, Homo sapiens
gacauuuuugugccau

SEQ ID NO: 657063 - RNA, 21 nt, Homo sapiens
gacauuuuuucagucauauaa

SEQ ID NO: 657064 - RNA, 14 nt, Homo sapiens
gaccaaaaagggga

SEQ ID NO: 657065 - RNA, 14 nt, Homo sapiens
gaccaaaacaaaca

SEQ ID NO: 657066 - RNA, 22 nt, Homo sapiens
gaccaaagggaagugaggccca

SEQ ID NO: 657067 - RNA, 16 nt, Homo sapiens
gaccaaagugauaaau

SEQ ID NO: 657068 - RNA, 16 nt, Homo sapiens
gaccaaauaaaguacc

SEQ ID NO: 657069 - RNA, 13 nt, Homo sapiens
gagacucauuuca

SEQ ID NO: 657070 - RNA, 16 nt, Homo sapiens
gagacuccgucucaaa

SEQ ID NO: 657071 - RNA, 19 nt, Homo sapiens
gagacuccgucucaaaaaa

SEQ ID NO: 657072 - RNA, 12 nt, Homo sapiens
gagacugaguca

SEQ ID NO: 657073 - RNA, 13 nt, Homo sapiens
gagacugaucccu

SEQ ID NO: 657074 - RNA, 19 nt, Homo sapiens
gagacugaucccuggccac

SEQ ID NO: 657075 - RNA, 21 nt, Homo sapiens
gagacugcagggguccacugu

SEQ ID NO: 657076 - RNA, 19 nt, Homo sapiens
gagacugcuacagugcaua

SEQ ID NO: 657077 - RNA, 24 nt, Homo sapiens
gagacuggaccgcugacugcacca

SEQ ID NO: 657078 - RNA, 13 nt, Homo sapiens
gagacugggucuc

SEQ ID NO: 657079 - RNA, 16 nt, Homo sapiens
gagacugucccugaaa

SEQ ID NO: 657080 - RNA, 21 nt, Homo sapiens
gagacugucucaagagggcac

SEQ ID NO: 657081 - RNA, 18 nt, Homo sapiens
gagacuuaaaaaauacuu

SEQ ID NO: 657082 - RNA, 14 nt, Homo sapiens
gagacuuacugggu

SEQ ID NO: 657083 - RNA, 20 nt, Homo sapiens
gagacuugaaaccagaagaa

SEQ ID NO: 657084 - RNA, 17 nt, Homo sapiens
gagacuuuacauggaug

SEQ ID NO: 657085 - RNA, 17 nt, Homo sapiens
gagacuuucuaaaucaa

SEQ ID NO: 657086 - RNA, 13 nt, Homo sapiens
gagagaaaaaaga

SEQ ID NO: 657087 - RNA, 15 nt, Homo sapiens
gagagaaacacugcu

SEQ ID NO: 657088 - RNA, 21 nt, Homo sapiens
gagagaacaacuacugugauc

SEQ ID NO: 657089 - RNA, 14 nt, Homo sapiens
gagagaaucucaag

SEQ ID NO: 657090 - RNA, 15 nt, Homo sapiens
gagagaccucauccu

SEQ ID NO: 657091 - RNA, 14 nt, Homo sapiens
gagagagugccaug

SEQ ID NO: 657092 - RNA, 12 nt, Homo sapiens
gagagauguuuu

SEQ ID NO: 657093 - RNA, 20 nt, Homo sapiens
gagagauuuaacauuaucua

SEQ ID NO: 657094 - RNA, 16 nt, Homo sapiens
gagagcacccacugaa

SEQ ID NO: 657095 - RNA, 15 nt, Homo sapiens
gagagcagaggucuc

SEQ ID NO: 657096 - RNA, 21 nt, Homo sapiens
gagagcagcuucagugacaaa

SEQ ID NO: 657097 - RNA, 14 nt, Homo sapiens
gagagcgaaggggg

SEQ ID NO: 657098 - RNA, 20 nt, Homo sapiens
gagagcggcugcccgacuca

SEQ ID NO: 657099 - RNA, 23 nt, Homo sapiens
gagagcuaaauuacaauugucau

SEQ ID NO: 657100 - RNA, 17 nt, Homo sapiens
gagagcuagagggacaa

SEQ ID NO: 657101 - RNA, 22 nt, Homo sapiens
gagagcucgcuuugagugacug

SEQ ID NO: 657102 - RNA, 23 nt, Homo sapiens
gagagcuuucuguccuuuuggca

SEQ ID NO: 657103 - RNA, 17 nt, Homo sapiens
gagaggaagagcugcaa

SEQ ID NO: 657104 - RNA, 21 nt, Homo sapiens
gagaggagggaugcugccuga

SEQ ID NO: 657105 - RNA, 15 nt, Homo sapiens
gagaggaggggacca

SEQ ID NO: 657106 - RNA, 14 nt, Homo sapiens
gagaggaugugcaa

SEQ ID NO: 657107 - RNA, 17 nt, Homo sapiens
gagagggcaaagggaug

SEQ ID NO: 657108 - RNA, 17 nt, Homo sapiens
gagagggcuagcccuga

SEQ ID NO: 657109 - RNA, 17 nt, Homo sapiens
gagagggugcuauccau

SEQ ID NO: 657110 - RNA, 14 nt, Homo sapiens
gagaggugauucuc

SEQ ID NO: 657111 - RNA, 20 nt, Homo sapiens
gagagguuuuucuugggaaa

SEQ ID NO: 657112 - RNA, 20 nt, Homo sapiens
gagaguacagugagccaaga

SEQ ID NO: 657113 - RNA, 22 nt, Homo sapiens
gagaguagaugguuugagccug

SEQ ID NO: 657114 - RNA, 14 nt, Homo sapiens
gagagucaauguca

SEQ ID NO: 657115 - RNA, 22 nt, Homo sapiens
gagagucagacccuucaaugga

SEQ ID NO: 657116 - RNA, 22 nt, Homo sapiens
gagagucauauacauuaguuuu

SEQ ID NO: 657117 - RNA, 16 nt, Homo sapiens
gagagucgcaucucag

SEQ ID NO: 657118 - RNA, 22 nt, Homo sapiens
gagagucgcaucucagugcagg

SEQ ID NO: 657119 - RNA, 15 nt, Homo sapiens
gagagucugggucca

SEQ ID NO: 657120 - RNA, 13 nt, Homo sapiens
gagagugcacuga

SEQ ID NO: 657121 - RNA, 19 nt, Homo sapiens
gagaguucuuuuuugcuua

SEQ ID NO: 657122 - RNA, 13 nt, Homo sapiens
gagaguuugccac

SEQ ID NO: 657123 - RNA, 19 nt, Homo sapiens
gagaguuugccuguucuau

SEQ ID NO: 657124 - RNA, 16 nt, Homo sapiens
gagaguuuugucuuga

SEQ ID NO: 657125 - RNA, 15 nt, Homo sapiens
gagauaaaagcaauu

SEQ ID NO: 657126 - RNA, 19 nt, Homo sapiens
gagauaacagccucuugcc

SEQ ID NO: 657127 - RNA, 13 nt, Homo sapiens
gagauaccauuca

SEQ ID NO: 657128 - RNA, 15 nt, Homo sapiens
gagauacuucccaaa

SEQ ID NO: 657129 - RNA, 13 nt, Homo sapiens
gagauagugcugg

SEQ ID NO: 657130 - RNA, 18 nt, Homo sapiens
gagauauggacucucuaa

SEQ ID NO: 657131 - RNA, 23 nt, Homo sapiens
gagauauguugaauuaacauaau

SEQ ID NO: 657132 - RNA, 17 nt, Homo sapiens
gagauauucuuauuuca

SEQ ID NO: 657133 - RNA, 20 nt, Homo sapiens
gagaucacgucacugcacuc

SEQ ID NO: 657134 - RNA, 21 nt, Homo sapiens
gagaucgcaucauugcacucu

SEQ ID NO: 657135 - RNA, 17 nt, Homo sapiens
gagaucgcgccacugca

SEQ ID NO: 657136 - RNA, 21 nt, Homo sapiens
gagaucgcgccacugcacucc

SEQ ID NO: 657137 - RNA, 21 nt, Homo sapiens
gagaucguuguuuacagugua

SEQ ID NO: 657138 - RNA, 19 nt, Homo sapiens
gagaucuauaaacagacag

SEQ ID NO: 657139 - RNA, 16 nt, Homo sapiens
gagaucuguugauuga

SEQ ID NO: 657140 - RNA, 23 nt, Homo sapiens
gagaugacaaaccauaacugaca

SEQ ID NO: 657141 - RNA, 23 nt, Homo sapiens
gagaugaccagugccuuggccac

SEQ ID NO: 657142 - RNA, 22 nt, Homo sapiens
gagaugacccaaucugccuuug

SEQ ID NO: 657143 - RNA, 15 nt, Homo sapiens
gagaugagaagccag

SEQ ID NO: 657144 - RNA, 14 nt, Homo sapiens
gagaugaggugcuc

SEQ ID NO: 657145 - RNA, 17 nt, Homo sapiens
gagaugaggugcucaau

SEQ ID NO: 657146 - RNA, 16 nt, Homo sapiens
gagaugauacauccaa

SEQ ID NO: 657147 - RNA, 20 nt, Homo sapiens
gagaugcaugcgcaggcuca

SEQ ID NO: 657148 - RNA, 19 nt, Homo sapiens
gagaugcgaaccacccaaa

SEQ ID NO: 657149 - RNA, 21 nt, Homo sapiens
gagaugggacaagcagucccu

SEQ ID NO: 657150 - RNA, 19 nt, Homo sapiens
gagaugggaugcuugccua

SEQ ID NO: 657151 - RNA, 19 nt, Homo sapiens
gagaugggggcuucuuccu

SEQ ID NO: 657152 - RNA, 13 nt, Homo sapiens
gagauggguccug

SEQ ID NO: 657153 - RNA, 17 nt, Homo sapiens
gagauggguuugacaag

SEQ ID NO: 657154 - RNA, 19 nt, Homo sapiens
gagaugguauauccuugcg

SEQ ID NO: 657155 - RNA, 15 nt, Homo sapiens
gagauguaugaaggc

SEQ ID NO: 657156 - RNA, 17 nt, Homo sapiens
gagauguggucaaugga

SEQ ID NO: 657157 - RNA, 20 nt, Homo sapiens
gagauuagucucuucugugu

SEQ ID NO: 657158 - RNA, 21 nt, Homo sapiens
gagauucaagggacccaugag

SEQ ID NO: 657159 - RNA, 19 nt, Homo sapiens
gagauucauuuucuagaua

SEQ ID NO: 657160 - RNA, 14 nt, Homo sapiens
gagauugaacucca

SEQ ID NO: 657161 - RNA, 20 nt, Homo sapiens
gagauugcaccauugcgcuc

SEQ ID NO: 657162 - RNA, 21 nt, Homo sapiens
gagauugcaccauugcgcucu

SEQ ID NO: 657163 - RNA, 20 nt, Homo sapiens
gagauugcgccauugcacuc

SEQ ID NO: 657164 - RNA, 17 nt, Homo sapiens
gagauuguuguuugcca

SEQ ID NO: 657165 - RNA, 18 nt, Homo sapiens
gagauuguuguuugccau

SEQ ID NO: 657166 - RNA, 20 nt, Homo sapiens
gagauuuacacuacauugua

SEQ ID NO: 657167 - RNA, 13 nt, Homo sapiens
gagauuuugcaau

SEQ ID NO: 657168 - RNA, 19 nt, Homo sapiens
gagauuuugcaaucugugu

SEQ ID NO: 657169 - RNA, 17 nt, Homo sapiens
gagauuuuugauaucuc

SEQ ID NO: 657170 - RNA, 13 nt, Homo sapiens
gagcaaaagccuc

SEQ ID NO: 657171 - RNA, 20 nt, Homo sapiens
gagcaaacucugcugucuaa

SEQ ID NO: 657172 - RNA, 12 nt, Homo sapiens
gagcaaauauca

SEQ ID NO: 657173 - RNA, 14 nt, Homo sapiens
gagcaacagccuaa

SEQ ID NO: 657174 - RNA, 21 nt, Homo sapiens
gagcaaccccuguacccagcu

SEQ ID NO: 657175 - RNA, 12 nt, Homo sapiens
gagcaaccucuc

SEQ ID NO: 657176 - RNA, 18 nt, Homo sapiens
gagcaagugagacccugu

SEQ ID NO: 657177 - RNA, 23 nt, Homo sapiens
gagcaagugcucagcuacuucuc

SEQ ID NO: 657178 - RNA, 15 nt, Homo sapiens
gagcaaucacaggaa

SEQ ID NO: 657179 - RNA, 15 nt, Homo sapiens
gagcaaucugacccu

SEQ ID NO: 657180 - RNA, 21 nt, Homo sapiens
gagcaaugcuuuuaaugaauu

SEQ ID NO: 657181 - RNA, 22 nt, Homo sapiens
gagcaauggaguggcugccaug

SEQ ID NO: 657182 - RNA, 16 nt, Homo sapiens
gagcacaaaaugauaa

SEQ ID NO: 657183 - RNA, 17 nt, Homo sapiens
gagcacaaacuucagaa

SEQ ID NO: 657184 - RNA, 14 nt, Homo sapiens
gagcacaagccaca

SEQ ID NO: 657185 - RNA, 18 nt, Homo sapiens
gagcacacuuaugggcca

SEQ ID NO: 657186 - RNA, 16 nt, Homo sapiens
gagcacaggagcugcc

SEQ ID NO: 657187 - RNA, 17 nt, Homo sapiens
gagcacauacuguguuc

SEQ ID NO: 657188 - RNA, 14 nt, Homo sapiens
gagcacccugccca

SEQ ID NO: 657189 - RNA, 16 nt, Homo sapiens
gagcaccgccugugaa

SEQ ID NO: 657190 - RNA, 23 nt, Homo sapiens
gagcacguggagauagugccagg

SEQ ID NO: 657191 - RNA, 17 nt, Homo sapiens
gauaauagguagccugc

SEQ ID NO: 657192 - RNA, 13 nt, Homo sapiens
gauaauaugagaa

SEQ ID NO: 657193 - RNA, 15 nt, Homo sapiens
gauaaucagccucuu

SEQ ID NO: 657194 - RNA, 17 nt, Homo sapiens
gauaaucaucucuguca

SEQ ID NO: 657195 - RNA, 17 nt, Homo sapiens
gauaaucguguccugaa

SEQ ID NO: 657196 - RNA, 17 nt, Homo sapiens
gauaaugauuugcucuu

SEQ ID NO: 657197 - RNA, 12 nt, Homo sapiens
gauaauucucag

SEQ ID NO: 657198 - RNA, 13 nt, Homo sapiens
gauaauuggugca

SEQ ID NO: 657199 - RNA, 14 nt, Homo sapiens
gauacaaacugcag

SEQ ID NO: 657200 - RNA, 23 nt, Homo sapiens
gauacacacagccacgcugauaa

SEQ ID NO: 657201 - RNA, 19 nt, Homo sapiens
gauacacuaaaaaucugag

SEQ ID NO: 657202 - RNA, 19 nt, Homo sapiens
gauacacuaugaagauguu

SEQ ID NO: 657203 - RNA, 23 nt, Homo sapiens
gauacacugaaguuaacagagac

SEQ ID NO: 657204 - RNA, 14 nt, Homo sapiens
gauacacugcagcu

SEQ ID NO: 657205 - RNA, 13 nt, Homo sapiens
gauacacuugaag

SEQ ID NO: 657206 - RNA, 18 nt, Homo sapiens
gauacacuugaaggacca

SEQ ID NO: 657207 - RNA, 15 nt, Homo sapiens
gauacaggggguccc

SEQ ID NO: 657208 - RNA, 20 nt, Homo sapiens
gauacaugcauugcucuuau

SEQ ID NO: 657209 - RNA, 16 nt, Homo sapiens
gauacauguaauucua

SEQ ID NO: 657210 - RNA, 21 nt, Homo sapiens
gauacaugugccgaaugugca

SEQ ID NO: 657211 - RNA, 16 nt, Homo sapiens
gauaccagcucagggg

SEQ ID NO: 657212 - RNA, 20 nt, Homo sapiens
gauacccaaguuauugggau

SEQ ID NO: 657213 - RNA, 13 nt, Homo sapiens
gauacccagagca

SEQ ID NO: 657214 - RNA, 16 nt, Homo sapiens
gauacccagagcauua

SEQ ID NO: 657215 - RNA, 21 nt, Homo sapiens
gauaccucaacccccauuucu

SEQ ID NO: 657216 - RNA, 20 nt, Homo sapiens
gauacgggggcugugacucu

SEQ ID NO: 657217 - RNA, 20 nt, Homo sapiens
gauacuaacauuuucauuga

SEQ ID NO: 657218 - RNA, 15 nt, Homo sapiens
gauacugcaaaggcu

SEQ ID NO: 657219 - RNA, 17 nt, Homo sapiens
gauacugcgacuuucug

SEQ ID NO: 657220 - RNA, 18 nt, Homo sapiens
gauacuguaacacuuuac

SEQ ID NO: 657221 - RNA, 22 nt, Homo sapiens
gauacuguaucaugacaaagac

SEQ ID NO: 657222 - RNA, 19 nt, Homo sapiens
gauacuugccaaaaugaga

SEQ ID NO: 657223 - RNA, 21 nt, Homo sapiens
gauagaacacaaaacuugaaa

SEQ ID NO: 657224 - RNA, 13 nt, Homo sapiens
gauagaaccugga

SEQ ID NO: 657225 - RNA, 14 nt, Homo sapiens
gauagaagauuguu

SEQ ID NO: 657226 - RNA, 20 nt, Homo sapiens
gauagaagauuguuggugaa

SEQ ID NO: 657227 - RNA, 13 nt, Homo sapiens
gauagaugucuau

SEQ ID NO: 657228 - RNA, 18 nt, Homo sapiens
gauagcaaauggccucau

SEQ ID NO: 657229 - RNA, 22 nt, Homo sapiens
gauagcaagguuuggugcaaag

SEQ ID NO: 657230 - RNA, 12 nt, Homo sapiens
gauagcaaguga

SEQ ID NO: 657231 - RNA, 15 nt, Homo sapiens
gauagcauugugaac

SEQ ID NO: 657232 - RNA, 23 nt, Homo sapiens
gauaggauggggugucuguguua

SEQ ID NO: 657233 - RNA, 14 nt, Homo sapiens
gauagggaacacuc

SEQ ID NO: 657234 - RNA, 16 nt, Homo sapiens
gauagggaacugggga

SEQ ID NO: 657235 - RNA, 16 nt, Homo sapiens
gauagguggugccagu

SEQ ID NO: 657236 - RNA, 15 nt, Homo sapiens
gauaguccaaagacu

SEQ ID NO: 657237 - RNA, 22 nt, Homo sapiens
gauagugcuggaacacugcuga

SEQ ID NO: 657238 - RNA, 22 nt, Homo sapiens
gauaguuguucuagcagugaag

SEQ ID NO: 657239 - RNA, 15 nt, Homo sapiens
gauauaaaagacuga

SEQ ID NO: 657240 - RNA, 12 nt, Homo sapiens
gauauaauacua

SEQ ID NO: 657241 - RNA, 13 nt, Homo sapiens
gauauaaucuuuc

SEQ ID NO: 657242 - RNA, 21 nt, Homo sapiens
gauauaaucuuucaaaccagc

SEQ ID NO: 657243 - RNA, 22 nt, Homo sapiens
gauauaaucuuucaaaccagcu

SEQ ID NO: 657244 - RNA, 17 nt, Homo sapiens
gauauacugcagcuuua

SEQ ID NO: 657245 - RNA, 16 nt, Homo sapiens
gauauagugcuguuua

SEQ ID NO: 657246 - RNA, 22 nt, Homo sapiens
gauauauauaugcuuggcuaac

SEQ ID NO: 657247 - RNA, 13 nt, Homo sapiens
gauauauaugugc

SEQ ID NO: 657248 - RNA, 22 nt, Homo sapiens
gauaucacagaggccuauaacu

SEQ ID NO: 657249 - RNA, 18 nt, Homo sapiens
gauaucaccucucuucag

SEQ ID NO: 657250 - RNA, 15 nt, Homo sapiens
gauaucaugccccug

SEQ ID NO: 657251 - RNA, 23 nt, Homo sapiens
gauauccuuucacucugcauggu

SEQ ID NO: 657252 - RNA, 18 nt, Homo sapiens
gauaucgugaaauccuca

SEQ ID NO: 657253 - RNA, 20 nt, Homo sapiens
gauaucuuggacaaaucaca

SEQ ID NO: 657254 - RNA, 15 nt, Homo sapiens
gauaugaaggauuac

SEQ ID NO: 657255 - RNA, 13 nt, Homo sapiens
gauaugaccaaaa

SEQ ID NO: 657256 - RNA, 18 nt, Homo sapiens
gauaugcaaguaagaaau

SEQ ID NO: 657257 - RNA, 16 nt, Homo sapiens
gauauggaagcaccca

SEQ ID NO: 657258 - RNA, 19 nt, Homo sapiens
gauauggacucucuaagga

SEQ ID NO: 657259 - RNA, 19 nt, Homo sapiens
gauauggcggccugcagug

SEQ ID NO: 657260 - RNA, 14 nt, Homo sapiens
gauauguuaagcau

SEQ ID NO: 657261 - RNA, 17 nt, Homo sapiens
gauauguucaacuggag

SEQ ID NO: 657262 - RNA, 13 nt, Homo sapiens
gauauuaaaggag

SEQ ID NO: 657263 - RNA, 20 nt, Homo sapiens
gauauuaauagauaauauga

SEQ ID NO: 657264 - RNA, 18 nt, Homo sapiens
gauauucaaauggacaaa

SEQ ID NO: 657265 - RNA, 20 nt, Homo sapiens
gauauucuguugcuuuacag

SEQ ID NO: 657266 - RNA, 21 nt, Homo sapiens
gauauugaucaaauauagaaa

SEQ ID NO: 657267 - RNA, 21 nt, Homo sapiens
gauauugaugauaacacuuaa

SEQ ID NO: 657268 - RNA, 17 nt, Homo sapiens
gauauugauuacuauca

SEQ ID NO: 657269 - RNA, 14 nt, Homo sapiens
gauauuggcuuaaa

SEQ ID NO: 657270 - RNA, 19 nt, Homo sapiens
gauauuuauuuuuugccau

SEQ ID NO: 657271 - RNA, 23 nt, Homo sapiens
gauauuuuaccucuuauugcaaa

SEQ ID NO: 657272 - RNA, 14 nt, Homo sapiens
gauauuuuaucuau

SEQ ID NO: 657273 - RNA, 20 nt, Homo sapiens
gauauuuucucuaggaaaua

SEQ ID NO: 657274 - RNA, 20 nt, Homo sapiens
gaucaaaguguaaacaccau

SEQ ID NO: 657275 - RNA, 19 nt, Homo sapiens
gaucaaauguauagacuug

SEQ ID NO: 657276 - RNA, 22 nt, Homo sapiens
gaucaaauugugcaguacuuug

SEQ ID NO: 657277 - RNA, 19 nt, Homo sapiens
gaucaacagaucaacaaua

SEQ ID NO: 657278 - RNA, 12 nt, Homo sapiens
gaucaacauucc

SEQ ID NO: 657279 - RNA, 17 nt, Homo sapiens
gaucaaggaguacaaug

SEQ ID NO: 657280 - RNA, 21 nt, Homo sapiens
gaucaaguuguugacugugau

SEQ ID NO: 657281 - RNA, 13 nt, Homo sapiens
gaucaauuacuua

SEQ ID NO: 657282 - RNA, 14 nt, Homo sapiens
gaucaauuucuccc

SEQ ID NO: 657283 - RNA, 13 nt, Homo sapiens
gaucacaccacug

SEQ ID NO: 657284 - RNA, 19 nt, Homo sapiens
gaucacaccacuguacucc

SEQ ID NO: 657285 - RNA, 23 nt, Homo sapiens
gaucacagccucugaaaaccaau

SEQ ID NO: 657286 - RNA, 17 nt, Homo sapiens
gaucacuaaaguauauc

SEQ ID NO: 657287 - RNA, 15 nt, Homo sapiens
gaucacuaaauaagc

SEQ ID NO: 657288 - RNA, 15 nt, Homo sapiens
gaucacuccagugca

SEQ ID NO: 657289 - RNA, 21 nt, Homo sapiens
gaucacuggcuggccugagca

SEQ ID NO: 657290 - RNA, 23 nt, Homo sapiens
gaucacuuguuguuuuacuaaag

SEQ ID NO: 657291 - RNA, 14 nt, Homo sapiens
gaucagaaagugac

SEQ ID NO: 657292 - RNA, 15 nt, Homo sapiens
gaucagcaucuguga

SEQ ID NO: 657293 - RNA, 22 nt, Homo sapiens
gaucagcauuuuagaaacuaca

SEQ ID NO: 657294 - RNA, 18 nt, Homo sapiens
gaucagccccgccuguca

SEQ ID NO: 657295 - RNA, 17 nt, Homo sapiens
gaucagcccugccaggu

SEQ ID NO: 657296 - RNA, 21 nt, Homo sapiens
gaucagccuccgccauuccaa

SEQ ID NO: 657297 - RNA, 19 nt, Homo sapiens
gaucagccugggcaaugug

SEQ ID NO: 657298 - RNA, 16 nt, Homo sapiens
gaucagccuugcaaau

SEQ ID NO: 657299 - RNA, 19 nt, Homo sapiens
gaucaguguuguugcucua

SEQ ID NO: 657300 - RNA, 20 nt, Homo sapiens
gaucauaccacggcacucca

SEQ ID NO: 657301 - RNA, 13 nt, Homo sapiens
gaucauauuucac

SEQ ID NO: 657302 - RNA, 20 nt, Homo sapiens
gaucaucacuuccuugcccc

SEQ ID NO: 657303 - RNA, 22 nt, Homo sapiens
gaucaucccuuucucccaguga

SEQ ID NO: 657304 - RNA, 14 nt, Homo sapiens
gaucaugcauuguu

SEQ ID NO: 657305 - RNA, 23 nt, Homo sapiens
gaucauuugcccuuaaggacaaa

SEQ ID NO: 657306 - RNA, 23 nt, Homo sapiens
gauccaagaaggccuucauggcc

SEQ ID NO: 657307 - RNA, 20 nt, Homo sapiens
gauccaagcagccugagcaa

SEQ ID NO: 657308 - RNA, 21 nt, Homo sapiens
gauccaccugucucagccucc

SEQ ID NO: 657309 - RNA, 17 nt, Homo sapiens
gauccacuaugccuuaa

SEQ ID NO: 657310 - RNA, 14 nt, Homo sapiens
gauccacuucucuc

SEQ ID NO: 657311 - RNA, 13 nt, Homo sapiens
gauccagacugua

SEQ ID NO: 657312 - RNA, 18 nt, Homo sapiens
gauuccggugccuccuga

SEQ ID NO: 657313 - RNA, 13 nt, Homo sapiens
gauuccugaccca

SEQ ID NO: 657314 - RNA, 22 nt, Homo sapiens
gauuccuuuugauggggagaaa

SEQ ID NO: 657315 - RNA, 14 nt, Homo sapiens
gauucgaaacucca

SEQ ID NO: 657316 - RNA, 18 nt, Homo sapiens
gauucgaaacuccauuga

SEQ ID NO: 657317 - RNA, 15 nt, Homo sapiens
gauucuccugccuca

SEQ ID NO: 657318 - RNA, 16 nt, Homo sapiens
gauucuccugccucag

SEQ ID NO: 657319 - RNA, 14 nt, Homo sapiens
gauucucugugguu

SEQ ID NO: 657320 - RNA, 14 nt, Homo sapiens
gauucugacauuua

SEQ ID NO: 657321 - RNA, 18 nt, Homo sapiens
gauucugauaaugcucac

SEQ ID NO: 657322 - RNA, 20 nt, Homo sapiens
gauucugcuagccuguucuu

SEQ ID NO: 657323 - RNA, 22 nt, Homo sapiens
gauucuggguuugcccaguccu

SEQ ID NO: 657324 - RNA, 12 nt, Homo sapiens
gauucuucagcu

SEQ ID NO: 657325 - RNA, 15 nt, Homo sapiens
gauucuucagcuuga

SEQ ID NO: 657326 - RNA, 14 nt, Homo sapiens
gauucuucccacac

SEQ ID NO: 657327 - RNA, 23 nt, Homo sapiens
gauucuucucuuaauuucauaga

SEQ ID NO: 657328 - RNA, 22 nt, Homo sapiens
gauucuuuucaucaaaaagccu

SEQ ID NO: 657329 - RNA, 18 nt, Homo sapiens
gauugaaaauaaugcugu

SEQ ID NO: 657330 - RNA, 16 nt, Homo sapiens
gauugaaagaaccaga

SEQ ID NO: 657331 - RNA, 17 nt, Homo sapiens
gauugaaggugaccucu

SEQ ID NO: 657332 - RNA, 17 nt, Homo sapiens
gauugaggagcugcacu

SEQ ID NO: 657333 - RNA, 19 nt, Homo sapiens
gauugauagaguguuauca

SEQ ID NO: 657334 - RNA, 16 nt, Homo sapiens
gauugcauuguaugaa

SEQ ID NO: 657335 - RNA, 23 nt, Homo sapiens
gauugccacagcucaacucgggg

SEQ ID NO: 657336 - RNA, 19 nt, Homo sapiens
gauugcgccuuuguauuau

SEQ ID NO: 657337 - RNA, 12 nt, Homo sapiens
gauugcugccau

SEQ ID NO: 657338 - RNA, 13 nt, Homo sapiens
gauuggcacagac

SEQ ID NO: 657339 - RNA, 18 nt, Homo sapiens
gauuggccagcaaaaacu

SEQ ID NO: 657340 - RNA, 12 nt, Homo sapiens
gauugggguccc

SEQ ID NO: 657341 - RNA, 17 nt, Homo sapiens
gauuguggaaaauggag

SEQ ID NO: 657342 - RNA, 16 nt, Homo sapiens
gauuguuuacagucau

SEQ ID NO: 657343 - RNA, 17 nt, Homo sapiens
gauuguuuacagucauu

SEQ ID NO: 657344 - RNA, 18 nt, Homo sapiens
gauuguuuugccacuuag

SEQ ID NO: 657345 - RNA, 18 nt, Homo sapiens
gauuuaaaauuguucuac

SEQ ID NO: 657346 - RNA, 15 nt, Homo sapiens
gauuuaacugugaac

SEQ ID NO: 657347 - RNA, 21 nt, Homo sapiens
gauuuaaucaccacucaaaaa

SEQ ID NO: 657348 - RNA, 15 nt, Homo sapiens
gauuuagauaugcaa

SEQ ID NO: 657349 - RNA, 18 nt, Homo sapiens
gauuuauaguaugugacu

SEQ ID NO: 657350 - RNA, 16 nt, Homo sapiens
gauuuaucuagcuguc

SEQ ID NO: 657351 - RNA, 15 nt, Homo sapiens
gauuuaugacauuac

SEQ ID NO: 657352 - RNA, 16 nt, Homo sapiens
gauuuaugaucacuug

SEQ ID NO: 657353 - RNA, 22 nt, Homo sapiens
gauuuauuuaagggggaaaaag

SEQ ID NO: 657354 - RNA, 17 nt, Homo sapiens
gauuuauuuuguaugaa

SEQ ID NO: 657355 - RNA, 15 nt, Homo sapiens
gauuucacagugugu

SEQ ID NO: 657356 - RNA, 13 nt, Homo sapiens
gauuucaggauac

SEQ ID NO: 657357 - RNA, 15 nt, Homo sapiens
gauuucaugauuuca

SEQ ID NO: 657358 - RNA, 20 nt, Homo sapiens
gauuucaugucacuaaacaa

SEQ ID NO: 657359 - RNA, 19 nt, Homo sapiens
gauuuccacacgccaagcu

SEQ ID NO: 657360 - RNA, 16 nt, Homo sapiens
gauuuccuucugcuau

SEQ ID NO: 657361 - RNA, 23 nt, Homo sapiens
gauuuccuugaauguggcuugag

SEQ ID NO: 657362 - RNA, 12 nt, Homo sapiens
gauuuccuugac

SEQ ID NO: 657363 - RNA, 14 nt, Homo sapiens
gauuuccuugacuu

SEQ ID NO: 657364 - RNA, 18 nt, Homo sapiens
gauuucuccaaaucuggg

SEQ ID NO: 657365 - RNA, 23 nt, Homo sapiens
gauuucucuacuugucauaucac

SEQ ID NO: 657366 - RNA, 15 nt, Homo sapiens
gauuucuuaguucau

SEQ ID NO: 657367 - RNA, 13 nt, Homo sapiens
gauuugaauccaa

SEQ ID NO: 657368 - RNA, 22 nt, Homo sapiens
gauuugaauguaaaacaggaaa

SEQ ID NO: 657369 - RNA, 14 nt, Homo sapiens
gauuugacagcauu

SEQ ID NO: 657370 - RNA, 14 nt, Homo sapiens
gauuugaccaaauc

SEQ ID NO: 657371 - RNA, 15 nt, Homo sapiens
gauuugagggagaag

SEQ ID NO: 657372 - RNA, 13 nt, Homo sapiens
gauuugccugugc

SEQ ID NO: 657373 - RNA, 11 nt, Homo sapiens
gauuugcucag

SEQ ID NO: 657374 - RNA, 12 nt, Homo sapiens
gauuugcucagg

SEQ ID NO: 657375 - RNA, 20 nt, Homo sapiens
gauuugcucccaccacgggg

SEQ ID NO: 657376 - RNA, 18 nt, Homo sapiens
gauuuggaggcuaccuca

SEQ ID NO: 657377 - RNA, 15 nt, Homo sapiens
gauuuggcugcacuu

SEQ ID NO: 657378 - RNA, 15 nt, Homo sapiens
gauuuggugaccaac

SEQ ID NO: 657379 - RNA, 13 nt, Homo sapiens
gauuugguugguu

SEQ ID NO: 657380 - RNA, 16 nt, Homo sapiens
gauuuguaccauuccu

SEQ ID NO: 657381 - RNA, 14 nt, Homo sapiens
gauuuguauuacac

SEQ ID NO: 657382 - RNA, 21 nt, Homo sapiens
gauuugucugagacauuucca

SEQ ID NO: 657383 - RNA, 12 nt, Homo sapiens
gauuuguggaaa

SEQ ID NO: 657384 - RNA, 13 nt, Homo sapiens
gauuuguguuaua

SEQ ID NO: 657385 - RNA, 18 nt, Homo sapiens
gauuuguucuuacaguua

SEQ ID NO: 657386 - RNA, 15 nt, Homo sapiens
gauuuuaacaauaac

SEQ ID NO: 657387 - RNA, 18 nt, Homo sapiens
gauuuuacaaaagaugua

SEQ ID NO: 657388 - RNA, 13 nt, Homo sapiens
gauuuuaccaaag

SEQ ID NO: 657389 - RNA, 15 nt, Homo sapiens
gauuuuaccaaagca

SEQ ID NO: 657390 - RNA, 16 nt, Homo sapiens
gauuuuauuugacaaa

SEQ ID NO: 657391 - RNA, 23 nt, Homo sapiens
gauuuuauuuuugcaaaauaagu

SEQ ID NO: 657392 - RNA, 20 nt, Homo sapiens
gauuuucuaagaaccaaaaa

SEQ ID NO: 657393 - RNA, 18 nt, Homo sapiens
gauuuugaagagauuuua

SEQ ID NO: 657394 - RNA, 12 nt, Homo sapiens
gauuuugaauag

SEQ ID NO: 657395 - RNA, 18 nt, Homo sapiens
gauuuugagaauguacua

SEQ ID NO: 657396 - RNA, 19 nt, Homo sapiens
gauuuugcaaucuguguuc

SEQ ID NO: 657397 - RNA, 23 nt, Homo sapiens
gauuuuggccaucaggacucuga

SEQ ID NO: 657398 - RNA, 16 nt, Homo sapiens
gauuuuugagcacaaa

SEQ ID NO: 657399 - RNA, 19 nt, Homo sapiens
gauuuuuuaauuguuuaaa

SEQ ID NO: 657400 - RNA, 17 nt, Homo sapiens
gauuuuuuccucugcau

SEQ ID NO: 657401 - RNA, 18 nt, Homo sapiens
gauuuuuuccucugcauu

SEQ ID NO: 657402 - RNA, 20 nt, Homo sapiens
gauuuuuuucccaauugaga

SEQ ID NO: 657403 - RNA, 23 nt, Homo sapiens
gcaaaaaaaaacuuaaagcaaaa

SEQ ID NO: 657404 - RNA, 21 nt, Homo sapiens
gcaaaaaaauuaaauuauuua

SEQ ID NO: 657405 - RNA, 14 nt, Homo sapiens
gcaaaaaauucuuu

SEQ ID NO: 657406 - RNA, 23 nt, Homo sapiens
gcaaaaacaaaugggaaaauguc

SEQ ID NO: 657407 - RNA, 18 nt, Homo sapiens
gcaaaaaguagacuuggu

SEQ ID NO: 657408 - RNA, 19 nt, Homo sapiens
gcaaaacaaaaauuaggua

SEQ ID NO: 657409 - RNA, 23 nt, Homo sapiens
gcaaaacaaaaguacauugcuua

SEQ ID NO: 657410 - RNA, 18 nt, Homo sapiens
gcaaaacucccaauggau

SEQ ID NO: 657411 - RNA, 23 nt, Homo sapiens
gcaaaaguggggcuaaaugaagu

SEQ ID NO: 657412 - RNA, 18 nt, Homo sapiens
gcaaaauacaugacauuu

SEQ ID NO: 657413 - RNA, 16 nt, Homo sapiens
gcaaaaucuuguuaau

SEQ ID NO: 657414 - RNA, 20 nt, Homo sapiens
gcaaaaucuuguuaauguca

SEQ ID NO: 657415 - RNA, 15 nt, Homo sapiens
gcaaaaugcuuacag

SEQ ID NO: 657416 - RNA, 22 nt, Homo sapiens
gcaaaauggaagcaaagacaaa

SEQ ID NO: 657417 - RNA, 21 nt, Homo sapiens
gcaaaaugucuuaacaaauca

SEQ ID NO: 657418 - RNA, 17 nt, Homo sapiens
gcaaacaaccugaaucu

SEQ ID NO: 657419 - RNA, 12 nt, Homo sapiens
gcaaacaaguug

SEQ ID NO: 657420 - RNA, 21 nt, Homo sapiens
gcaaacaugcaagaugaaccu

SEQ ID NO: 657421 - RNA, 13 nt, Homo sapiens
gcaaacaugccag

SEQ ID NO: 657422 - RNA, 21 nt, Homo sapiens
gcaaaccuuccugggaggaca

SEQ ID NO: 657423 - RNA, 17 nt, Homo sapiens
gcaaacuucagacugaa

SEQ ID NO: 657424 - RNA, 18 nt, Homo sapiens
gcaaagauccccaaaaca

SEQ ID NO: 657425 - RNA, 22 nt, Homo sapiens
gcaaagauuuucaaacaaaaua

SEQ ID NO: 657426 - RNA, 20 nt, Homo sapiens
gcaaagcaaucaagcaccag

SEQ ID NO: 657427 - RNA, 13 nt, Homo sapiens
gcaaagcccagcu

SEQ ID NO: 657428 - RNA, 20 nt, Homo sapiens
gcaaagcucaccaucuucac

SEQ ID NO: 657429 - RNA, 17 nt, Homo sapiens
gcaaagggagcacuggg

SEQ ID NO: 657430 - RNA, 22 nt, Homo sapiens
gcaaagggccugcccagacaag

SEQ ID NO: 657431 - RNA, 19 nt, Homo sapiens
gcaaagggcugaaagccau

SEQ ID NO: 657432 - RNA, 12 nt, Homo sapiens
gcaaagugcuuu

SEQ ID NO: 657433 - RNA, 17 nt, Homo sapiens
gcaaaguuuacagaugu

SEQ ID NO: 657434 - RNA, 20 nt, Homo sapiens
gcuccacuuucucauccgaa

SEQ ID NO: 657435 - RNA, 18 nt, Homo sapiens
gcuccagaagauagcuuc

SEQ ID NO: 657436 - RNA, 23 nt, Homo sapiens
gcuccagacacaccugaacacau

SEQ ID NO: 657437 - RNA, 16 nt, Homo sapiens
gcuccagaugcagggc

SEQ ID NO: 657438 - RNA, 20 nt, Homo sapiens
gcuccagcaacugcccuucc

SEQ ID NO: 657439 - RNA, 14 nt, Homo sapiens
gcuccaggccugca

SEQ ID NO: 657440 - RNA, 17 nt, Homo sapiens
gcuccaggccugcagca

SEQ ID NO: 657441 - RNA, 13 nt, Homo sapiens
gcuccagugcagg

SEQ ID NO: 657442 - RNA, 11 nt, Homo sapiens
gcuccagugua

SEQ ID NO: 657443 - RNA, 13 nt, Homo sapiens
gcuccaguuccag

SEQ ID NO: 657444 - RNA, 15 nt, Homo sapiens
gcuccauagacauca

SEQ ID NO: 657445 - RNA, 13 nt, Homo sapiens
gcucccagacaua

SEQ ID NO: 657446 - RNA, 14 nt, Homo sapiens
gcucccagacauaa

SEQ ID NO: 657447 - RNA, 21 nt, Homo sapiens
gcucccagcugugcuguggag

SEQ ID NO: 657448 - RNA, 20 nt, Homo sapiens
gcuccccuccucggcuuccu

SEQ ID NO: 657449 - RNA, 18 nt, Homo sapiens
gcuccccuuugcuugaag

SEQ ID NO: 657450 - RNA, 23 nt, Homo sapiens
gcucccgccgcggcuguugcuca

SEQ ID NO: 657451 - RNA, 13 nt, Homo sapiens
gcucccuagccag

SEQ ID NO: 657452 - RNA, 21 nt, Homo sapiens
gcucccucuauuuauguuugc

SEQ ID NO: 657453 - RNA, 20 nt, Homo sapiens
gcucccucuguuagguccau

SEQ ID NO: 657454 - RNA, 21 nt, Homo sapiens
gcucccucuguuagguccauu

SEQ ID NO: 657455 - RNA, 18 nt, Homo sapiens
gcucccugacagcaccug

SEQ ID NO: 657456 - RNA, 21 nt, Homo sapiens
gcucccuguguucucuugggg

SEQ ID NO: 657457 - RNA, 14 nt, Homo sapiens
gcuccggccugucc

SEQ ID NO: 657458 - RNA, 17 nt, Homo sapiens
gcuccguguuccucggu

SEQ ID NO: 657459 - RNA, 23 nt, Homo sapiens
gcuccuaaggguagaaaacucca

SEQ ID NO: 657460 - RNA, 13 nt, Homo sapiens
gcuccucacuucc

SEQ ID NO: 657461 - RNA, 20 nt, Homo sapiens
gcuccucagagcgccaggaa

SEQ ID NO: 657462 - RNA, 14 nt, Homo sapiens
gcuccuccacgccu

SEQ ID NO: 657463 - RNA, 15 nt, Homo sapiens
gcuccuccagggugu

SEQ ID NO: 657464 - RNA, 17 nt, Homo sapiens
gcuccucccacuucuca

SEQ ID NO: 657465 - RNA, 22 nt, Homo sapiens
gcuccuccuucccagggaccag

SEQ ID NO: 657466 - RNA, 20 nt, Homo sapiens
gcuccucuccuuacuccauc

SEQ ID NO: 657467 - RNA, 14 nt, Homo sapiens
gcuccugcugaccu

SEQ ID NO: 657468 - RNA, 14 nt, Homo sapiens
gcuccuggaaccaa

SEQ ID NO: 657469 - RNA, 15 nt, Homo sapiens
gcuccugucugccag

SEQ ID NO: 657470 - RNA, 13 nt, Homo sapiens
gcuccuguggcag

SEQ ID NO: 657471 - RNA, 18 nt, Homo sapiens
gcuccuguucacaccaga

SEQ ID NO: 657472 - RNA, 20 nt, Homo sapiens
gcuccuguuugucugaugug

SEQ ID NO: 657473 - RNA, 23 nt, Homo sapiens
gcuccuuaaccuuccaugucucc

SEQ ID NO: 657474 - RNA, 19 nt, Homo sapiens
gcuccuucacugaacaugc

SEQ ID NO: 657475 - RNA, 13 nt, Homo sapiens
gcuccuuccagac

SEQ ID NO: 657476 - RNA, 19 nt, Homo sapiens
gcuccuuggcuuaccugac

SEQ ID NO: 657477 - RNA, 14 nt, Homo sapiens
gcuccuugucaaua

SEQ ID NO: 657478 - RNA, 20 nt, Homo sapiens
gcuccuuguuuuugccaaag

SEQ ID NO: 657479 - RNA, 20 nt, Homo sapiens
gcuccuuuauuauaaucaaa

SEQ ID NO: 657480 - RNA, 19 nt, Homo sapiens
gcuccuuucuccugugaau

SEQ ID NO: 657481 - RNA, 13 nt, Homo sapiens
gcucgaugccuuu

SEQ ID NO: 657482 - RNA, 22 nt, Homo sapiens
gcucgccccagcaggugcugac

SEQ ID NO: 657483 - RNA, 22 nt, Homo sapiens
gcucggagcggcgucccuucca

SEQ ID NO: 657484 - RNA, 18 nt, Homo sapiens
gcucggauucaacuaccu

SEQ ID NO: 657485 - RNA, 21 nt, Homo sapiens
gcucuaaacaagucccuuuau

SEQ ID NO: 657486 - RNA, 22 nt, Homo sapiens
gcucuaaaguccagacuaugga

SEQ ID NO: 657487 - RNA, 14 nt, Homo sapiens
gcucuaauguacaa

SEQ ID NO: 657488 - RNA, 17 nt, Homo sapiens
gcucuaauguacaauaa

SEQ ID NO: 657489 - RNA, 23 nt, Homo sapiens
gcucuaauguacaauaaagcaau

SEQ ID NO: 657490 - RNA, 20 nt, Homo sapiens
gcucuaauucacagugcucu

SEQ ID NO: 657491 - RNA, 18 nt, Homo sapiens
gcucuaccgggaggacag

SEQ ID NO: 657492 - RNA, 22 nt, Homo sapiens
gcucuacguggcaaauuaacuu

SEQ ID NO: 657493 - RNA, 22 nt, Homo sapiens
gcucuacuaccuacguuugcac

SEQ ID NO: 657494 - RNA, 16 nt, Homo sapiens
gcucuagggaaucugg

SEQ ID NO: 657495 - RNA, 17 nt, Homo sapiens
gcucuaugccugcacug

SEQ ID NO: 657496 - RNA, 16 nt, Homo sapiens
gcucuauuaagauuuc

SEQ ID NO: 657497 - RNA, 16 nt, Homo sapiens
gcucucaaaucccucu

SEQ ID NO: 657498 - RNA, 14 nt, Homo sapiens
gcucucacaugcac

SEQ ID NO: 657499 - RNA, 16 nt, Homo sapiens
gcucucauggggucca

SEQ ID NO: 657500 - RNA, 18 nt, Homo sapiens
gcucucccaacucuugca

SEQ ID NO: 657501 - RNA, 23 nt, Homo sapiens
gcucuccccaggcauuugccaag

SEQ ID NO: 657502 - RNA, 13 nt, Homo sapiens
gcucuccuuugag

SEQ ID NO: 657503 - RNA, 13 nt, Homo sapiens
gcucucgacagua

SEQ ID NO: 657504 - RNA, 14 nt, Homo sapiens
gcucucgacaguau

SEQ ID NO: 657505 - RNA, 17 nt, Homo sapiens
gcucucguucuccuucc

SEQ ID NO: 657506 - RNA, 15 nt, Homo sapiens
gcucucugagagcaa

SEQ ID NO: 657507 - RNA, 18 nt, Homo sapiens
gcucucugagagcaaaca

SEQ ID NO: 657508 - RNA, 16 nt, Homo sapiens
gcucucuguggugaga

SEQ ID NO: 657509 - RNA, 15 nt, Homo sapiens
gcucugacaagaugg

SEQ ID NO: 657510 - RNA, 20 nt, Homo sapiens
gcucugagaaaccucgggaa

SEQ ID NO: 657511 - RNA, 23 nt, Homo sapiens
gcucugagacccuuuucucagga

SEQ ID NO: 657512 - RNA, 23 nt, Homo sapiens
gcucugcaccccucugcccucau

SEQ ID NO: 657513 - RNA, 18 nt, Homo sapiens
gcucugcaguccuacuca

SEQ ID NO: 657514 - RNA, 15 nt, Homo sapiens
gcucugcuaugagug

SEQ ID NO: 657515 - RNA, 18 nt, Homo sapiens
gcucugcuucuccaagga

SEQ ID NO: 657516 - RNA, 21 nt, Homo sapiens
gcucugggccucuuuuugccc

SEQ ID NO: 657517 - RNA, 15 nt, Homo sapiens
gcucugggcggcccg

SEQ ID NO: 657518 - RNA, 21 nt, Homo sapiens
gcucuguccagaggcuuuaaa

SEQ ID NO: 657519 - RNA, 16 nt, Homo sapiens
gcucuuagcagcuucc

SEQ ID NO: 657520 - RNA, 21 nt, Homo sapiens
gcucuuagcagcuuccagauu

SEQ ID NO: 657521 - RNA, 13 nt, Homo sapiens
gcucuuaggugcu

SEQ ID NO: 657522 - RNA, 15 nt, Homo sapiens
gcucuucaucauaua

SEQ ID NO: 657523 - RNA, 19 nt, Homo sapiens
gcucuuggcuccacuggga

SEQ ID NO: 657524 - RNA, 20 nt, Homo sapiens
gcucuuuagaaggacucagu

SEQ ID NO: 657525 - RNA, 13 nt, Homo sapiens
gcucuuucagaga

SEQ ID NO: 657526 - RNA, 17 nt, Homo sapiens
gcucuuucccuuuauca

SEQ ID NO: 657527 - RNA, 15 nt, Homo sapiens
gcucuuucucugcca

SEQ ID NO: 657528 - RNA, 18 nt, Homo sapiens
gcucuuucucugccagug

SEQ ID NO: 657529 - RNA, 17 nt, Homo sapiens
gcucuuuuguguagcuc

SEQ ID NO: 657530 - RNA, 15 nt, Homo sapiens
gcugaaaaaacaccu

SEQ ID NO: 657531 - RNA, 13 nt, Homo sapiens
gcugaaaacauaa

SEQ ID NO: 657532 - RNA, 12 nt, Homo sapiens
gcugaaaacccc

SEQ ID NO: 657533 - RNA, 17 nt, Homo sapiens
gcugaaaacuacacaaa

SEQ ID NO: 657534 - RNA, 12 nt, Homo sapiens
gcugaaagccaa

SEQ ID NO: 657535 - RNA, 16 nt, Homo sapiens
gcugaaauaaaaugau

SEQ ID NO: 657536 - RNA, 24 nt, Homo sapiens
gcugaaaugcaggaagugguggca

SEQ ID NO: 657537 - RNA, 12 nt, Homo sapiens
gcugaacacugg

SEQ ID NO: 657538 - RNA, 16 nt, Homo sapiens
gcugaacugacaauga

SEQ ID NO: 657539 - RNA, 18 nt, Homo sapiens
gcugaacugacaaugaag

SEQ ID NO: 657540 - RNA, 15 nt, Homo sapiens
gcugaagagaggugc

SEQ ID NO: 657541 - RNA, 18 nt, Homo sapiens
gcugaagaguaaaggaaa

SEQ ID NO: 657542 - RNA, 14 nt, Homo sapiens
gcugaagauggcau

SEQ ID NO: 657543 - RNA, 21 nt, Homo sapiens
gcugaaggaaaccagugcaac

SEQ ID NO: 657544 - RNA, 16 nt, Homo sapiens
gcugaauuucaggcau

SEQ ID NO: 657545 - RNA, 14 nt, Homo sapiens
gcugaccacagcac

SEQ ID NO: 657546 - RNA, 19 nt, Homo sapiens
gcugacccagaguggaguc

SEQ ID NO: 657547 - RNA, 20 nt, Homo sapiens
gcugacccaggaauagugga

SEQ ID NO: 657548 - RNA, 15 nt, Homo sapiens
gcugaccugcugacc

SEQ ID NO: 657549 - RNA, 23 nt, Homo sapiens
gcugacguccaguguacagugaa

SEQ ID NO: 657550 - RNA, 18 nt, Homo sapiens
gcugacuagaagggccag

SEQ ID NO: 657551 - RNA, 18 nt, Homo sapiens
gcugacucuggccuuaca

SEQ ID NO: 657552 - RNA, 21 nt, Homo sapiens
gcugagaauguggaauaccua

SEQ ID NO: 657553 - RNA, 17 nt, Homo sapiens
gcugagaggaagcaaga

SEQ ID NO: 657554 - RNA, 20 nt, Homo sapiens
gcugagaucacgccacugca

SEQ ID NO: 657555 - RNA, 18 nt, Homo sapiens
gcugagauuacucugaaa

SEQ ID NO: 657556 - RNA, 11 nt, Homo sapiens
ggaaaugucac

SEQ ID NO: 657557 - RNA, 11 nt, Homo sapiens
ggaaaugugag

SEQ ID NO: 657558 - RNA, 15 nt, Homo sapiens
ggaaauuaagacuuu

SEQ ID NO: 657559 - RNA, 23 nt, Homo sapiens
ggaaauucaaaacaauuggcaaa

SEQ ID NO: 657560 - RNA, 14 nt, Homo sapiens
ggaacaagcaugau

SEQ ID NO: 657561 - RNA, 18 nt, Homo sapiens
ggaacaauaaaaugucuu

SEQ ID NO: 657562 - RNA, 18 nt, Homo sapiens
ggaacacauaagaacugu

SEQ ID NO: 657563 - RNA, 21 nt, Homo sapiens
ggaacacaucuggcugcacag

SEQ ID NO: 657564 - RNA, 22 nt, Homo sapiens
ggaacacccgacuccucaaaag

SEQ ID NO: 657565 - RNA, 13 nt, Homo sapiens
ggaacacuggaac

SEQ ID NO: 657566 - RNA, 21 nt, Homo sapiens
ggaacagagggugaaagggac

SEQ ID NO: 657567 - RNA, 11 nt, Homo sapiens
ggaacagggau

SEQ ID NO: 657568 - RNA, 19 nt, Homo sapiens
ggaacauccuccacugacu

SEQ ID NO: 657569 - RNA, 22 nt, Homo sapiens
ggaacauguaaaacaguuacaa

SEQ ID NO: 657570 - RNA, 12 nt, Homo sapiens
ggaacauuauua

SEQ ID NO: 657571 - RNA, 15 nt, Homo sapiens
ggaacauuugauauu

SEQ ID NO: 657572 - RNA, 12 nt, Homo sapiens
ggaaccacagau

SEQ ID NO: 657573 - RNA, 13 nt, Homo sapiens
ggaaccaugaaga

SEQ ID NO: 657574 - RNA, 20 nt, Homo sapiens
ggaaccauguauaugagcuu

SEQ ID NO: 657575 - RNA, 20 nt, Homo sapiens
ggaacccccaucucuacuaa

SEQ ID NO: 657576 - RNA, 16 nt, Homo sapiens
ggaacccucuaaggga

SEQ ID NO: 657577 - RNA, 19 nt, Homo sapiens
ggaaccuugcuguccugau

SEQ ID NO: 657578 - RNA, 15 nt, Homo sapiens
ggaacuaaagcaaau

SEQ ID NO: 657579 - RNA, 12 nt, Homo sapiens
ggaacuacgggg

SEQ ID NO: 657580 - RNA, 23 nt, Homo sapiens
ggaacuagaaagaaggacccaga

SEQ ID NO: 657581 - RNA, 21 nt, Homo sapiens
ggaacucuagaagaccaaaug

SEQ ID NO: 657582 - RNA, 19 nt, Homo sapiens
ggaacucuggcuuccaggu

SEQ ID NO: 657583 - RNA, 22 nt, Homo sapiens
ggaacugaagagggcccaaguc

SEQ ID NO: 657584 - RNA, 16 nt, Homo sapiens
ggaacuguguauuuau

SEQ ID NO: 657585 - RNA, 14 nt, Homo sapiens
ggaacuucaucaua

SEQ ID NO: 657586 - RNA, 10 nt, Homo sapiens
ggaacuuccu

SEQ ID NO: 657587 - RNA, 19 nt, Homo sapiens
ggaagaaacaaaguugaac

SEQ ID NO: 657588 - RNA, 14 nt, Homo sapiens
ggaagaaacuuucu

SEQ ID NO: 657589 - RNA, 19 nt, Homo sapiens
ggaagaaaucuggucuaau

SEQ ID NO: 657590 - RNA, 16 nt, Homo sapiens
ggaagaaauuccugua

SEQ ID NO: 657591 - RNA, 21 nt, Homo sapiens
ggaagaacuacagcucuuaaa

SEQ ID NO: 657592 - RNA, 15 nt, Homo sapiens
ggaagacaaugugaa

SEQ ID NO: 657593 - RNA, 23 nt, Homo sapiens
ggaagaccaaaauuacuaauaaa

SEQ ID NO: 657594 - RNA, 23 nt, Homo sapiens
ggaagaccagcuuugcagugaca

SEQ ID NO: 657595 - RNA, 12 nt, Homo sapiens
ggaagacugcuc

SEQ ID NO: 657596 - RNA, 19 nt, Homo sapiens
ggaagagcugcaacggaau

SEQ ID NO: 657597 - RNA, 22 nt, Homo sapiens
ggaagaguuuguuaccuaccuu

SEQ ID NO: 657598 - RNA, 10 nt, Homo sapiens
ggaagcaaag

SEQ ID NO: 657599 - RNA, 15 nt, Homo sapiens
ggaagcaagauguga

SEQ ID NO: 657600 - RNA, 17 nt, Homo sapiens
ggaagcaauaaagcucu

SEQ ID NO: 657601 - RNA, 23 nt, Homo sapiens
ggaagcauuuguuucuacuuuga

SEQ ID NO: 657602 - RNA, 23 nt, Homo sapiens
ggaagcccaggcucggaggaccc

SEQ ID NO: 657603 - RNA, 22 nt, Homo sapiens
ggaagccucccacgacugcccg

SEQ ID NO: 657604 - RNA, 23 nt, Homo sapiens
ggaagcgagcuuugcugggagag

SEQ ID NO: 657605 - RNA, 15 nt, Homo sapiens
ggaagcuaauuugca

SEQ ID NO: 657606 - RNA, 17 nt, Homo sapiens
ggaagcucuucuuccca

SEQ ID NO: 657607 - RNA, 16 nt, Homo sapiens
ggaagcugucccucac

SEQ ID NO: 657608 - RNA, 19 nt, Homo sapiens
ggaagcuuggggaacccau

SEQ ID NO: 657609 - RNA, 20 nt, Homo sapiens
ggaagcuuguuuuccagucu

SEQ ID NO: 657610 - RNA, 14 nt, Homo sapiens
ggaaggaacaaaga

SEQ ID NO: 657611 - RNA, 17 nt, Homo sapiens
ggaaggacaugggugcc

SEQ ID NO: 657612 - RNA, 13 nt, Homo sapiens
ggaaggagggcac

SEQ ID NO: 657613 - RNA, 23 nt, Homo sapiens
ggaaggagggucccgguguaucc

SEQ ID NO: 657614 - RNA, 14 nt, Homo sapiens
ggaaggagugagau

SEQ ID NO: 657615 - RNA, 19 nt, Homo sapiens
ggaaggauguuuagcagug

SEQ ID NO: 657616 - RNA, 14 nt, Homo sapiens
ggaaggcuugcagu

SEQ ID NO: 657617 - RNA, 15 nt, Homo sapiens
ggaagggcaggucug

SEQ ID NO: 657618 - RNA, 19 nt, Homo sapiens
ggaagggccuacagcccau

SEQ ID NO: 657619 - RNA, 19 nt, Homo sapiens
ggaagggggguugcagugg

SEQ ID NO: 657620 - RNA, 23 nt, Homo sapiens
ggaagggggugcaaagacucuga

SEQ ID NO: 657621 - RNA, 19 nt, Homo sapiens
ggaaggggugcccccaggc

SEQ ID NO: 657622 - RNA, 22 nt, Homo sapiens
ggaaggucucaggagaagggau

SEQ ID NO: 657623 - RNA, 13 nt, Homo sapiens
ggaaggucuucaa

SEQ ID NO: 657624 - RNA, 13 nt, Homo sapiens
ggaaggugccacu

SEQ ID NO: 657625 - RNA, 23 nt, Homo sapiens
ggaaggugccacuccagugccca

SEQ ID NO: 657626 - RNA, 15 nt, Homo sapiens
ggaagguggggcccu

SEQ ID NO: 657627 - RNA, 16 nt, Homo sapiens
ggaaguaaagccucaa

SEQ ID NO: 657628 - RNA, 21 nt, Homo sapiens
ggaagucaggggagaagcuga

SEQ ID NO: 657629 - RNA, 13 nt, Homo sapiens
ggaagucaucuca

SEQ ID NO: 657630 - RNA, 15 nt, Homo sapiens
ggaaguguaacagcu

SEQ ID NO: 657631 - RNA, 14 nt, Homo sapiens
ggaaguugacuuau

SEQ ID NO: 657632 - RNA, 17 nt, Homo sapiens
ggaauaaaaaauacugu

SEQ ID NO: 657633 - RNA, 17 nt, Homo sapiens
ggaauaaaaacauuucu

SEQ ID NO: 657634 - RNA, 14 nt, Homo sapiens
ggaauaaaaccauc

SEQ ID NO: 657635 - RNA, 20 nt, Homo sapiens
ggaauaagcauauauucagu

SEQ ID NO: 657636 - RNA, 23 nt, Homo sapiens
ggaauaagcucuaguucuuaaca

SEQ ID NO: 657637 - RNA, 19 nt, Homo sapiens
ggaauaauagacacugggg

SEQ ID NO: 657638 - RNA, 21 nt, Homo sapiens
ggaauaauaugaugccacuuu

SEQ ID NO: 657639 - RNA, 13 nt, Homo sapiens
ggaauacauugua

SEQ ID NO: 657640 - RNA, 15 nt, Homo sapiens
ggaauacugugcaua

SEQ ID NO: 657641 - RNA, 17 nt, Homo sapiens
ggaauauaaaacaguca

SEQ ID NO: 657642 - RNA, 18 nt, Homo sapiens
ggaauauuuaaacaguag

SEQ ID NO: 657643 - RNA, 22 nt, Homo sapiens
ggaaucacuucuccaaucagug

SEQ ID NO: 657644 - RNA, 21 nt, Homo sapiens
ggaauccuuggggagcacuug

SEQ ID NO: 657645 - RNA, 20 nt, Homo sapiens
ggaauccuuuggugccaacu

SEQ ID NO: 657646 - RNA, 14 nt, Homo sapiens
ggaaucgacuguau

SEQ ID NO: 657647 - RNA, 18 nt, Homo sapiens
ggaaugaauacagcauuu

SEQ ID NO: 657648 - RNA, 19 nt, Homo sapiens
ggaaugaauacagcauuua

SEQ ID NO: 657649 - RNA, 18 nt, Homo sapiens
ggaaugacuuacuuuccu

SEQ ID NO: 657650 - RNA, 19 nt, Homo sapiens
ggaaugcagaggucuccaa

SEQ ID NO: 657651 - RNA, 16 nt, Homo sapiens
ggaauggagucuccca

SEQ ID NO: 657652 - RNA, 18 nt, Homo sapiens
ggaauggcaggugucaua

SEQ ID NO: 657653 - RNA, 21 nt, Homo sapiens
ggaauggcugcaccuuuuugc

SEQ ID NO: 657654 - RNA, 17 nt, Homo sapiens
ggaauguguccaagaca

SEQ ID NO: 657655 - RNA, 12 nt, Homo sapiens
ggaauguguucg

SEQ ID NO: 657656 - RNA, 22 nt, Homo sapiens
ggaauguugggucucacucucu

SEQ ID NO: 657657 - RNA, 16 nt, Homo sapiens
ggaauuacaagcccug

SEQ ID NO: 657658 - RNA, 12 nt, Homo sapiens
ggaauuaccuua

SEQ ID NO: 657659 - RNA, 11 nt, Homo sapiens
ggaauuacuuu

SEQ ID NO: 657660 - RNA, 16 nt, Homo sapiens
ggaauuaguugggaug

SEQ ID NO: 657661 - RNA, 21 nt, Homo sapiens
ggaauucauuuucaucacugg

SEQ ID NO: 657662 - RNA, 23 nt, Homo sapiens
ggaauucauuuucaucacuggga

SEQ ID NO: 657663 - RNA, 16 nt, Homo sapiens
ggaauuucccugugug

SEQ ID NO: 657664 - RNA, 15 nt, Homo sapiens
ggacaacauccuuaa

SEQ ID NO: 657665 - RNA, 21 nt, Homo sapiens
ggacaaggucgagacauuccu

SEQ ID NO: 657666 - RNA, 18 nt, Homo sapiens
ggacaauggguggugaau

SEQ ID NO: 657667 - RNA, 20 nt, Homo sapiens
ggacacagaauuauagaugu

SEQ ID NO: 657668 - RNA, 14 nt, Homo sapiens
ggacacagugauga

SEQ ID NO: 657669 - RNA, 20 nt, Homo sapiens
ggacacccacagcugcagca

SEQ ID NO: 657670 - RNA, 19 nt, Homo sapiens
ggacaccccuuauccagga

SEQ ID NO: 657671 - RNA, 23 nt, Homo sapiens
ggacaccucccaggggacuguuc

SEQ ID NO: 657672 - RNA, 16 nt, Homo sapiens
ggacacuguccaugaa

SEQ ID NO: 657673 - RNA, 21 nt, Homo sapiens
ggacacuuccguagacuguuu

SEQ ID NO: 657674 - RNA, 20 nt, Homo sapiens
ggacacuugcucaugcccug

SEQ ID NO: 657675 - RNA, 23 nt, Homo sapiens
ggacagaaagagacuccgucuca

SEQ ID NO: 657676 - RNA, 14 nt, Homo sapiens
ggacagacacuguu

SEQ ID NO: 657677 - RNA, 15 nt, Homo sapiens
ggacagaccacagag

SEQ ID NO: 657678 - RNA, 21 nt, Homo sapiens
ggccaaccaggacccaggguc

SEQ ID NO: 657679 - RNA, 21 nt, Homo sapiens
ggccaagaaagagucaggccu

SEQ ID NO: 657680 - RNA, 17 nt, Homo sapiens
ggccaagacuuggcaac

SEQ ID NO: 657681 - RNA, 19 nt, Homo sapiens
ggccaagagcaucgugacc

SEQ ID NO: 657682 - RNA, 19 nt, Homo sapiens
ggccaagcaauuccucuga

SEQ ID NO: 657683 - RNA, 12 nt, Homo sapiens
ggccaagcagaa

SEQ ID NO: 657684 - RNA, 22 nt, Homo sapiens
ggccaaggagggugagugcaag

SEQ ID NO: 657685 - RNA, 14 nt, Homo sapiens
ggccaagguccugc

SEQ ID NO: 657686 - RNA, 14 nt, Homo sapiens
ggccaaggugucca

SEQ ID NO: 657687 - RNA, 15 nt, Homo sapiens
ggccaaguuccucua

SEQ ID NO: 657688 - RNA, 18 nt, Homo sapiens
ggccacaccgagacacca

SEQ ID NO: 657689 - RNA, 14 nt, Homo sapiens
ggccacacuaccca

SEQ ID NO: 657690 - RNA, 12 nt, Homo sapiens
ggccacacuggu

SEQ ID NO: 657691 - RNA, 17 nt, Homo sapiens
ggccacacuggucacag

SEQ ID NO: 657692 - RNA, 17 nt, Homo sapiens
ggccacauagaugcuga

SEQ ID NO: 657693 - RNA, 21 nt, Homo sapiens
ggccaccccagagugggagag

SEQ ID NO: 657694 - RNA, 16 nt, Homo sapiens
ggccacccccauggaa

SEQ ID NO: 657695 - RNA, 23 nt, Homo sapiens
ggccacccccauggaagcaauaa

SEQ ID NO: 657696 - RNA, 22 nt, Homo sapiens
ggccacccccuauccucugagu

SEQ ID NO: 657697 - RNA, 17 nt, Homo sapiens
ggccaccccgugccacc

SEQ ID NO: 657698 - RNA, 20 nt, Homo sapiens
ggccacccgcccacagccag

SEQ ID NO: 657699 - RNA, 14 nt, Homo sapiens
ggccaccucucagg

SEQ ID NO: 657700 - RNA, 19 nt, Homo sapiens
ggccacgggggcaguguga

SEQ ID NO: 657701 - RNA, 16 nt, Homo sapiens
ggccacucuaccugaa

SEQ ID NO: 657702 - RNA, 22 nt, Homo sapiens
ggccacugggucucacuccuga

SEQ ID NO: 657703 - RNA, 19 nt, Homo sapiens
ggccagaaaaggcauuuuu

SEQ ID NO: 657704 - RNA, 22 nt, Homo sapiens
ggccagagagggcgugggcgcu

SEQ ID NO: 657705 - RNA, 14 nt, Homo sapiens
ggccagagcucaac

SEQ ID NO: 657706 - RNA, 20 nt, Homo sapiens
ggccagagggcaguggcccu

SEQ ID NO: 657707 - RNA, 17 nt, Homo sapiens
ggccagaugcacauccc

SEQ ID NO: 657708 - RNA, 14 nt, Homo sapiens
ggccagcccagcca

SEQ ID NO: 657709 - RNA, 22 nt, Homo sapiens
ggccagccccucccaccacagc

SEQ ID NO: 657710 - RNA, 20 nt, Homo sapiens
ggccaggcaggggugggaga

SEQ ID NO: 657711 - RNA, 17 nt, Homo sapiens
ggccaggcugccugugu

SEQ ID NO: 657712 - RNA, 18 nt, Homo sapiens
ggccagggacccaaagca

SEQ ID NO: 657713 - RNA, 22 nt, Homo sapiens
ggccagggugggaagagaagaa

SEQ ID NO: 657714 - RNA, 14 nt, Homo sapiens
ggccagguagcaag

SEQ ID NO: 657715 - RNA, 15 nt, Homo sapiens
ggccagguugugucc

SEQ ID NO: 657716 - RNA, 18 nt, Homo sapiens
ggccagucaggcugcaga

SEQ ID NO: 657717 - RNA, 19 nt, Homo sapiens
ggccaguuucucugccuuc

SEQ ID NO: 657718 - RNA, 17 nt, Homo sapiens
ggccauaaguuccaaaa

SEQ ID NO: 657719 - RNA, 17 nt, Homo sapiens
ggccaugccacccuguu

SEQ ID NO: 657720 - RNA, 21 nt, Homo sapiens
ggccauggaauaaaccauuuu

SEQ ID NO: 657721 - RNA, 16 nt, Homo sapiens
ggccauguccaaagag

SEQ ID NO: 657722 - RNA, 15 nt, Homo sapiens
ggccauguggccugc

SEQ ID NO: 657723 - RNA, 23 nt, Homo sapiens
ggccauuccaacagcucaagucu

SEQ ID NO: 657724 - RNA, 16 nt, Homo sapiens
ggcccaagaacugcag

SEQ ID NO: 657725 - RNA, 20 nt, Homo sapiens
ggcccacugugccucagaga

SEQ ID NO: 657726 - RNA, 17 nt, Homo sapiens
ggcccacuucaccguac

SEQ ID NO: 657727 - RNA, 12 nt, Homo sapiens
ggcccagaaaca

SEQ ID NO: 657728 - RNA, 17 nt, Homo sapiens
ggcccagagcaggaagc

SEQ ID NO: 657729 - RNA, 19 nt, Homo sapiens
ggcccagaguuuacauucu

SEQ ID NO: 657730 - RNA, 17 nt, Homo sapiens
ggcccagggacauugca

SEQ ID NO: 657731 - RNA, 21 nt, Homo sapiens
ggcccagugacaaagacuccu

SEQ ID NO: 657732 - RNA, 16 nt, Homo sapiens
ggcccauaucugugaa

SEQ ID NO: 657733 - RNA, 18 nt, Homo sapiens
ggcccaucucuucuggcc

SEQ ID NO: 657734 - RNA, 21 nt, Homo sapiens
ggcccauuggagcaccugggc

SEQ ID NO: 657735 - RNA, 15 nt, Homo sapiens
ggccccaaucuugcc

SEQ ID NO: 657736 - RNA, 14 nt, Homo sapiens
ggccccauccucau

SEQ ID NO: 657737 - RNA, 21 nt, Homo sapiens
ggcccccaguggggacaggga

SEQ ID NO: 657738 - RNA, 18 nt, Homo sapiens
ggccccccaaagugcugg

SEQ ID NO: 657739 - RNA, 18 nt, Homo sapiens
ggccccgaaugucacugg

SEQ ID NO: 657740 - RNA, 23 nt, Homo sapiens
ggccccucacauccucuccagga

SEQ ID NO: 657741 - RNA, 14 nt, Homo sapiens
ggccccuccaucca

SEQ ID NO: 657742 - RNA, 15 nt, Homo sapiens
ggccccugcaucccc

SEQ ID NO: 657743 - RNA, 14 nt, Homo sapiens
ggccccuggcccag

SEQ ID NO: 657744 - RNA, 18 nt, Homo sapiens
ggccccuugcugaugcuc

SEQ ID NO: 657745 - RNA, 14 nt, Homo sapiens
ggcccgacauuucu

SEQ ID NO: 657746 - RNA, 15 nt, Homo sapiens
ggcccggacucacca

SEQ ID NO: 657747 - RNA, 21 nt, Homo sapiens
ggcccguggccuggcaucugu

SEQ ID NO: 657748 - RNA, 12 nt, Homo sapiens
ggcccucaccag

SEQ ID NO: 657749 - RNA, 20 nt, Homo sapiens
ggcccucccccagcuccuug

SEQ ID NO: 657750 - RNA, 19 nt, Homo sapiens
ggcccugggccucaguuca

SEQ ID NO: 657751 - RNA, 22 nt, Homo sapiens
ggcccugggcugggugcuggga

SEQ ID NO: 657752 - RNA, 20 nt, Homo sapiens
ggcccugggguaccaugugg

SEQ ID NO: 657753 - RNA, 19 nt, Homo sapiens
ggcccuguccuaagcacuu

SEQ ID NO: 657754 - RNA, 12 nt, Homo sapiens
ggcccugugaua

SEQ ID NO: 657755 - RNA, 20 nt, Homo sapiens
ggcccuuaccuuuccugaug

SEQ ID NO: 657756 - RNA, 23 nt, Homo sapiens
ggcccuuccucuccacugccuuc

SEQ ID NO: 657757 - RNA, 18 nt, Homo sapiens
ggcccuugggccacgcuc

SEQ ID NO: 657758 - RNA, 17 nt, Homo sapiens
ggcccuugucauugccu

SEQ ID NO: 657759 - RNA, 17 nt, Homo sapiens
ggcccuuugaagccuca

SEQ ID NO: 657760 - RNA, 17 nt, Homo sapiens
ggccgcggcccagaccc

SEQ ID NO: 657761 - RNA, 17 nt, Homo sapiens
ggccggcugugcucaga

SEQ ID NO: 657762 - RNA, 15 nt, Homo sapiens
ggccggggacugccu

SEQ ID NO: 657763 - RNA, 12 nt, Homo sapiens
ggccgucugugu

SEQ ID NO: 657764 - RNA, 16 nt, Homo sapiens
ggccgugagggguccc

SEQ ID NO: 657765 - RNA, 13 nt, Homo sapiens
ggccgugcagugg

SEQ ID NO: 657766 - RNA, 18 nt, Homo sapiens
ggccuaggugcgcagugu

SEQ ID NO: 657767 - RNA, 22 nt, Homo sapiens
ggccucacccaccccugcacag

SEQ ID NO: 657768 - RNA, 15 nt, Homo sapiens
ggccucagccugggg

SEQ ID NO: 657769 - RNA, 17 nt, Homo sapiens
ggccucagugugcccau

SEQ ID NO: 657770 - RNA, 17 nt, Homo sapiens
ggccucaucuccuuuau

SEQ ID NO: 657771 - RNA, 12 nt, Homo sapiens
ggccuccacucc

SEQ ID NO: 657772 - RNA, 11 nt, Homo sapiens
ggccuccagaa

SEQ ID NO: 657773 - RNA, 13 nt, Homo sapiens
ggccuccagagac

SEQ ID NO: 657774 - RNA, 23 nt, Homo sapiens
ggccuccagagaccccaggaaca

SEQ ID NO: 657775 - RNA, 19 nt, Homo sapiens
ggccucccaaagugcuagu

SEQ ID NO: 657776 - RNA, 20 nt, Homo sapiens
ggccucccaaagugcugaga

SEQ ID NO: 657777 - RNA, 20 nt, Homo sapiens
ggccucccagagugcuggga

SEQ ID NO: 657778 - RNA, 20 nt, Homo sapiens
ggccuccccaauccaggcca

SEQ ID NO: 657779 - RNA, 23 nt, Homo sapiens
ggccucccucugcuacuccaucc

SEQ ID NO: 657780 - RNA, 18 nt, Homo sapiens
ggccucuccaguuugcac

SEQ ID NO: 657781 - RNA, 15 nt, Homo sapiens
ggccucucucaggag

SEQ ID NO: 657782 - RNA, 12 nt, Homo sapiens
ggccucucugac

SEQ ID NO: 657783 - RNA, 16 nt, Homo sapiens
ggccucugagaagcuc

SEQ ID NO: 657784 - RNA, 19 nt, Homo sapiens
ggccucugagaagcucuga

SEQ ID NO: 657785 - RNA, 17 nt, Homo sapiens
ggccucuggacuggccu

SEQ ID NO: 657786 - RNA, 16 nt, Homo sapiens
ggccucuggcucucau

SEQ ID NO: 657787 - RNA, 12 nt, Homo sapiens
ggccucugugau

SEQ ID NO: 657788 - RNA, 13 nt, Homo sapiens
ggccugaccucaa

SEQ ID NO: 657789 - RNA, 16 nt, Homo sapiens
ggccugacgcauucuc

SEQ ID NO: 657790 - RNA, 17 nt, Homo sapiens
ggccugaggugugaaag

SEQ ID NO: 657791 - RNA, 13 nt, Homo sapiens
ggccugauggugc

SEQ ID NO: 657792 - RNA, 17 nt, Homo sapiens
ggccugcaccgacccga

SEQ ID NO: 657793 - RNA, 15 nt, Homo sapiens
ggccuggacaguauc

SEQ ID NO: 657794 - RNA, 23 nt, Homo sapiens
ggccuggaccugcccugggccac

SEQ ID NO: 657795 - RNA, 12 nt, Homo sapiens
ggccuggcacau

SEQ ID NO: 657796 - RNA, 16 nt, Homo sapiens
ggccuggcccgggccu

SEQ ID NO: 657797 - RNA, 17 nt, Homo sapiens
ggccugggaugcaguga

SEQ ID NO: 657798 - RNA, 16 nt, Homo sapiens
ggccuggggccugaga

SEQ ID NO: 657799 - RNA, 13 nt, Homo sapiens
ggccugggguccc

SEQ ID NO: 657800 - RNA, 17 nt, Homo sapiens
ggcuggcaccaugguga

SEQ ID NO: 657801 - RNA, 17 nt, Homo sapiens
ggcuggccaaggugucc

SEQ ID NO: 657802 - RNA, 19 nt, Homo sapiens
ggcuggccugcaggcugca

SEQ ID NO: 657803 - RNA, 19 nt, Homo sapiens
ggcuggccuuucaggucca

SEQ ID NO: 657804 - RNA, 11 nt, Homo sapiens
ggcugggagac

SEQ ID NO: 657805 - RNA, 23 nt, Homo sapiens
ggcugggcuagaaagaccacugg

SEQ ID NO: 657806 - RNA, 17 nt, Homo sapiens
ggcuggggcucucucca

SEQ ID NO: 657807 - RNA, 20 nt, Homo sapiens
ggcuggguaccaaugcugca

SEQ ID NO: 657808 - RNA, 22 nt, Homo sapiens
ggcugguauucucucuaugcaa

SEQ ID NO: 657809 - RNA, 16 nt, Homo sapiens
ggcuggucugauggaa

SEQ ID NO: 657810 - RNA, 14 nt, Homo sapiens
ggcuguauauucaa

SEQ ID NO: 657811 - RNA, 18 nt, Homo sapiens
ggcuguauuuaauggcau

SEQ ID NO: 657812 - RNA, 20 nt, Homo sapiens
ggcuguauuugcuguugauu

SEQ ID NO: 657813 - RNA, 15 nt, Homo sapiens
ggcugucccgugcau

SEQ ID NO: 657814 - RNA, 22 nt, Homo sapiens
ggcugucucucccuuccaggaa

SEQ ID NO: 657815 - RNA, 14 nt, Homo sapiens
ggcuguggagcaaa

SEQ ID NO: 657816 - RNA, 19 nt, Homo sapiens
ggcuguguuuccaucucaa

SEQ ID NO: 657817 - RNA, 21 nt, Homo sapiens
ggcuguugagggccacuuuuu

SEQ ID NO: 657818 - RNA, 17 nt, Homo sapiens
ggcuuaaaccuggaauc

SEQ ID NO: 657819 - RNA, 22 nt, Homo sapiens
ggcuuaacacagugggugguga

SEQ ID NO: 657820 - RNA, 15 nt, Homo sapiens
ggcuuaacacaucuc

SEQ ID NO: 657821 - RNA, 15 nt, Homo sapiens
ggcuuaauaccuggg

SEQ ID NO: 657822 - RNA, 17 nt, Homo sapiens
ggcuuaauaccugggug

SEQ ID NO: 657823 - RNA, 21 nt, Homo sapiens
ggcuuaccuguacacugacuu

SEQ ID NO: 657824 - RNA, 19 nt, Homo sapiens
ggcuuaguauuucucagga

SEQ ID NO: 657825 - RNA, 11 nt, Homo sapiens
ggcuuagucug

SEQ ID NO: 657826 - RNA, 19 nt, Homo sapiens
ggcuuaugaauauauuuaa

SEQ ID NO: 657827 - RNA, 17 nt, Homo sapiens
ggcuuauucacauggaa

SEQ ID NO: 657828 - RNA, 21 nt, Homo sapiens
ggcuucaaagugugugugugc

SEQ ID NO: 657829 - RNA, 19 nt, Homo sapiens
ggcuuccccagguggccug

SEQ ID NO: 657830 - RNA, 17 nt, Homo sapiens
ggcuucccuaaacugca

SEQ ID NO: 657831 - RNA, 14 nt, Homo sapiens
ggcuucuaguuugc

SEQ ID NO: 657832 - RNA, 16 nt, Homo sapiens
ggcuucuaguuugcaa

SEQ ID NO: 657833 - RNA, 16 nt, Homo sapiens
ggcuucucaauagagu

SEQ ID NO: 657834 - RNA, 11 nt, Homo sapiens
ggcuucucacg

SEQ ID NO: 657835 - RNA, 13 nt, Homo sapiens
ggcuucuccugac

SEQ ID NO: 657836 - RNA, 16 nt, Homo sapiens
ggcuugaaaugcauua

SEQ ID NO: 657837 - RNA, 17 nt, Homo sapiens
ggcuugaagccaaagaa

SEQ ID NO: 657838 - RNA, 15 nt, Homo sapiens
ggcuugacucaggau

SEQ ID NO: 657839 - RNA, 18 nt, Homo sapiens
ggcuugagucaccaugcc

SEQ ID NO: 657840 - RNA, 12 nt, Homo sapiens
ggcuugaugucc

SEQ ID NO: 657841 - RNA, 10 nt, Homo sapiens
ggcuuggaag

SEQ ID NO: 657842 - RNA, 15 nt, Homo sapiens
ggcuuggaguggcca

SEQ ID NO: 657843 - RNA, 19 nt, Homo sapiens
ggcuuggccugcugugauu

SEQ ID NO: 657844 - RNA, 23 nt, Homo sapiens
ggcuuguccucaucucuacccau

SEQ ID NO: 657845 - RNA, 14 nt, Homo sapiens
ggcuuuaaagcuga

SEQ ID NO: 657846 - RNA, 20 nt, Homo sapiens
ggcuuuacaguguaaacugu

SEQ ID NO: 657847 - RNA, 14 nt, Homo sapiens
ggcuuucaugauuu

SEQ ID NO: 657848 - RNA, 14 nt, Homo sapiens
ggcuuuccagcuua

SEQ ID NO: 657849 - RNA, 23 nt, Homo sapiens
ggcuuucucuuccccuuccuguu

SEQ ID NO: 657850 - RNA, 22 nt, Homo sapiens
ggcuuucuggagaggagggaug

SEQ ID NO: 657851 - RNA, 14 nt, Homo sapiens
ggcuuucuugacau

SEQ ID NO: 657852 - RNA, 17 nt, Homo sapiens
ggcuuuguauacuuuua

SEQ ID NO: 657853 - RNA, 19 nt, Homo sapiens
ggcuuuuaagaaacacagg

SEQ ID NO: 657854 - RNA, 14 nt, Homo sapiens
ggcuuuuauugcca

SEQ ID NO: 657855 - RNA, 19 nt, Homo sapiens
ggcuuuuugccaucuguga

SEQ ID NO: 657856 - RNA, 20 nt, Homo sapiens
ggcuuuuugccaucugugau

SEQ ID NO: 657857 - RNA, 13 nt, Homo sapiens
gggaaaaggagua

SEQ ID NO: 657858 - RNA, 12 nt, Homo sapiens
gggaaacuggcu

SEQ ID NO: 657859 - RNA, 15 nt, Homo sapiens
gggaaaucaggguua

SEQ ID NO: 657860 - RNA, 21 nt, Homo sapiens
gggaacaacugggccugggau

SEQ ID NO: 657861 - RNA, 22 nt, Homo sapiens
gggaacaaggguggcaucccag

SEQ ID NO: 657862 - RNA, 16 nt, Homo sapiens
gggaacagggcccagg

SEQ ID NO: 657863 - RNA, 20 nt, Homo sapiens
gggaaccauguauaugagcu

SEQ ID NO: 657864 - RNA, 20 nt, Homo sapiens
gggaaccggcagcaucccag

SEQ ID NO: 657865 - RNA, 20 nt, Homo sapiens
gggaacgaugugucuguauu

SEQ ID NO: 657866 - RNA, 13 nt, Homo sapiens
gggaacucuccaa

SEQ ID NO: 657867 - RNA, 13 nt, Homo sapiens
gggaacugugcaa

SEQ ID NO: 657868 - RNA, 20 nt, Homo sapiens
gggaagacuuuaaaccaccu

SEQ ID NO: 657869 - RNA, 18 nt, Homo sapiens
gggaagagacagcccagg

SEQ ID NO: 657870 - RNA, 21 nt, Homo sapiens
gggaagaguggucuugagggg

SEQ ID NO: 657871 - RNA, 12 nt, Homo sapiens
gggaagccaaaa

SEQ ID NO: 657872 - RNA, 17 nt, Homo sapiens
gggaagcccacccagau

SEQ ID NO: 657873 - RNA, 19 nt, Homo sapiens
gggaagcggcccuaaggga

SEQ ID NO: 657874 - RNA, 20 nt, Homo sapiens
gggaagcucccaccccacuc

SEQ ID NO: 657875 - RNA, 13 nt, Homo sapiens
gggaaggagccca

SEQ ID NO: 657876 - RNA, 17 nt, Homo sapiens
gggaaggggccaugacu

SEQ ID NO: 657877 - RNA, 22 nt, Homo sapiens
gggaagggguccugcaggggga

SEQ ID NO: 657878 - RNA, 22 nt, Homo sapiens
gggaaggucagcccagccccuc

SEQ ID NO: 657879 - RNA, 21 nt, Homo sapiens
gggaaugagaguuccuucuca

SEQ ID NO: 657880 - RNA, 14 nt, Homo sapiens
gggaaugcaauccu

SEQ ID NO: 657881 - RNA, 20 nt, Homo sapiens
gggacaacagugcuuuguaa

SEQ ID NO: 657882 - RNA, 17 nt, Homo sapiens
gggacaacugcggugau

SEQ ID NO: 657883 - RNA, 20 nt, Homo sapiens
gggacaagacaaaaccaaaa

SEQ ID NO: 657884 - RNA, 14 nt, Homo sapiens
gggacagagccaug

SEQ ID NO: 657885 - RNA, 20 nt, Homo sapiens
gggacaggaugaccuggaua

SEQ ID NO: 657886 - RNA, 21 nt, Homo sapiens
gggacagggcugggagaagaa

SEQ ID NO: 657887 - RNA, 13 nt, Homo sapiens
gggacaugaaguu

SEQ ID NO: 657888 - RNA, 16 nt, Homo sapiens
gggacauugcagagug

SEQ ID NO: 657889 - RNA, 16 nt, Homo sapiens
gggaccacagacucac

SEQ ID NO: 657890 - RNA, 14 nt, Homo sapiens
gggaccagggaugg

SEQ ID NO: 657891 - RNA, 14 nt, Homo sapiens
gggacccugcacag

SEQ ID NO: 657892 - RNA, 14 nt, Homo sapiens
gggaccggccaggc

SEQ ID NO: 657893 - RNA, 14 nt, Homo sapiens
gggacuccaugcug

SEQ ID NO: 657894 - RNA, 18 nt, Homo sapiens
gggacucucccccuuuca

SEQ ID NO: 657895 - RNA, 18 nt, Homo sapiens
gggacugaaaaccucucc

SEQ ID NO: 657896 - RNA, 13 nt, Homo sapiens
gggacuuccuugc

SEQ ID NO: 657897 - RNA, 20 nt, Homo sapiens
gggagacacuggccccucaa

SEQ ID NO: 657898 - RNA, 22 nt, Homo sapiens
gggagacagggcugcuccccaa

SEQ ID NO: 657899 - RNA, 20 nt, Homo sapiens
gggagacaucaaaaccaccc

SEQ ID NO: 657900 - RNA, 15 nt, Homo sapiens
gggagacaugugaca

SEQ ID NO: 657901 - RNA, 15 nt, Homo sapiens
gggagagacacagau

SEQ ID NO: 657902 - RNA, 16 nt, Homo sapiens
gggagagacaggcagc

SEQ ID NO: 657903 - RNA, 23 nt, Homo sapiens
gggagagagagcuagagggacaa

SEQ ID NO: 657904 - RNA, 18 nt, Homo sapiens
gggagaggccucauccag

SEQ ID NO: 657905 - RNA, 20 nt, Homo sapiens
gggagauucuggguuugccc

SEQ ID NO: 657906 - RNA, 15 nt, Homo sapiens
gggagcagaugcaau

SEQ ID NO: 657907 - RNA, 11 nt, Homo sapiens
gggagccagcc

SEQ ID NO: 657908 - RNA, 16 nt, Homo sapiens
gggagccagggugaga

SEQ ID NO: 657909 - RNA, 21 nt, Homo sapiens
gggagccauggaaggugccag

SEQ ID NO: 657910 - RNA, 12 nt, Homo sapiens
gggagcccagug

SEQ ID NO: 657911 - RNA, 16 nt, Homo sapiens
gggagcuaucacugua

SEQ ID NO: 657912 - RNA, 16 nt, Homo sapiens
gggagcugggagccag

SEQ ID NO: 657913 - RNA, 17 nt, Homo sapiens
gggaggaagcagguuga

SEQ ID NO: 657914 - RNA, 14 nt, Homo sapiens
gggaggacaggcag

SEQ ID NO: 657915 - RNA, 20 nt, Homo sapiens
gggaggcagagguugcagug

SEQ ID NO: 657916 - RNA, 15 nt, Homo sapiens
gggaggcagggcagc

SEQ ID NO: 657917 - RNA, 17 nt, Homo sapiens
gggaggccaagugcagg

SEQ ID NO: 657918 - RNA, 16 nt, Homo sapiens
gggaggcugaggcagc

SEQ ID NO: 657919 - RNA, 12 nt, Homo sapiens
gggagggugaga

SEQ ID NO: 657920 - RNA, 16 nt, Homo sapiens
gggaggucagugcuuc

SEQ ID NO: 657921 - RNA, 20 nt, Homo sapiens
gggaguaggacauaccagcu

SEQ ID NO: 657922 - RNA, 21 nt, Homo sapiens
gugagauaaaugcacauuuca

SEQ ID NO: 657923 - RNA, 22 nt, Homo sapiens
gugagcaggguggggucuggga

SEQ ID NO: 657924 - RNA, 14 nt, Homo sapiens
gugagccaaggagg

SEQ ID NO: 657925 - RNA, 14 nt, Homo sapiens
gugagccacagugc

SEQ ID NO: 657926 - RNA, 13 nt, Homo sapiens
gugagccacugug

SEQ ID NO: 657927 - RNA, 13 nt, Homo sapiens
gugagcucuggga

SEQ ID NO: 657928 - RNA, 23 nt, Homo sapiens
gugagcucuuccaggagccaccu

SEQ ID NO: 657929 - RNA, 20 nt, Homo sapiens
gugagcuguaaaaauguuac

SEQ ID NO: 657930 - RNA, 13 nt, Homo sapiens
gugaggacaaauc

SEQ ID NO: 657931 - RNA, 20 nt, Homo sapiens
gugaggagaugcggccaaag

SEQ ID NO: 657932 - RNA, 19 nt, Homo sapiens
gugaggcuguccuguacau

SEQ ID NO: 657933 - RNA, 20 nt, Homo sapiens
gugaggugugucacaaugag

SEQ ID NO: 657934 - RNA, 15 nt, Homo sapiens
gugagucaccacuuc

SEQ ID NO: 657935 - RNA, 19 nt, Homo sapiens
gugaguccgggaaucucuu

SEQ ID NO: 657936 - RNA, 15 nt, Homo sapiens
gugaguggcagccau

SEQ ID NO: 657937 - RNA, 15 nt, Homo sapiens
gugaguguguccaag

SEQ ID NO: 657938 - RNA, 16 nt, Homo sapiens
gugagugugugcaagu

SEQ ID NO: 657939 - RNA, 20 nt, Homo sapiens
gugagugugugugcauggaa

SEQ ID NO: 657940 - RNA, 19 nt, Homo sapiens
gugaguuuaccuuguauac

SEQ ID NO: 657941 - RNA, 22 nt, Homo sapiens
gugaguuuaccuuguauacugu

SEQ ID NO: 657942 - RNA, 14 nt, Homo sapiens
gugaguuugagcug

SEQ ID NO: 657943 - RNA, 16 nt, Homo sapiens
gugauacguacagcca

SEQ ID NO: 657944 - RNA, 21 nt, Homo sapiens
gugauacucacguuugcuuaa

SEQ ID NO: 657945 - RNA, 13 nt, Homo sapiens
gugauagcacuuu

SEQ ID NO: 657946 - RNA, 18 nt, Homo sapiens
gugauauauuucuaugug

SEQ ID NO: 657947 - RNA, 17 nt, Homo sapiens
gugauauggcggccugc

SEQ ID NO: 657948 - RNA, 14 nt, Homo sapiens
gugaucaaagccac

SEQ ID NO: 657949 - RNA, 21 nt, Homo sapiens
gugaucuauucauuguuucaa

SEQ ID NO: 657950 - RNA, 14 nt, Homo sapiens
gugaucuuggcuca

SEQ ID NO: 657951 - RNA, 15 nt, Homo sapiens
gugauggacugggga

SEQ ID NO: 657952 - RNA, 18 nt, Homo sapiens
gugauggacuggggagca

SEQ ID NO: 657953 - RNA, 21 nt, Homo sapiens
gugauggagaugcagucacuu

SEQ ID NO: 657954 - RNA, 18 nt, Homo sapiens
gugauggcuaugccuugc

SEQ ID NO: 657955 - RNA, 21 nt, Homo sapiens
gugauguaccaguuuguccau

SEQ ID NO: 657956 - RNA, 14 nt, Homo sapiens
gugaugucauuuga

SEQ ID NO: 657957 - RNA, 20 nt, Homo sapiens
gugauucaccucuucuuucc

SEQ ID NO: 657958 - RNA, 23 nt, Homo sapiens
gugauugaaccagcucaucucca

SEQ ID NO: 657959 - RNA, 14 nt, Homo sapiens
gugauugcacagaa

SEQ ID NO: 657960 - RNA, 17 nt, Homo sapiens
gugauugcagcuuuaug

SEQ ID NO: 657961 - RNA, 14 nt, Homo sapiens
gugauuggaccagg

SEQ ID NO: 657962 - RNA, 17 nt, Homo sapiens
gugauugucaccaugau

SEQ ID NO: 657963 - RNA, 13 nt, Homo sapiens
gugauugugccag

SEQ ID NO: 657964 - RNA, 17 nt, Homo sapiens
gugauuuggaagagagg

SEQ ID NO: 657965 - RNA, 22 nt, Homo sapiens
gugauuuuauuuuugcaaaaua

SEQ ID NO: 657966 - RNA, 13 nt, Homo sapiens
gugcaaaccacuu

SEQ ID NO: 657967 - RNA, 12 nt, Homo sapiens
gugcaaagggaa

SEQ ID NO: 657968 - RNA, 13 nt, Homo sapiens
gugcaaagggaac

SEQ ID NO: 657969 - RNA, 22 nt, Homo sapiens
gugcaaccuguggcucagggga

SEQ ID NO: 657970 - RNA, 13 nt, Homo sapiens
gugcaaguguaug

SEQ ID NO: 657971 - RNA, 22 nt, Homo sapiens
gugcaauaagauugguguucgu

SEQ ID NO: 657972 - RNA, 12 nt, Homo sapiens
gugcacaaauac

SEQ ID NO: 657973 - RNA, 18 nt, Homo sapiens
gugcacaggcgcauccca

SEQ ID NO: 657974 - RNA, 21 nt, Homo sapiens
gugcacauuucauaguuucaa

SEQ ID NO: 657975 - RNA, 17 nt, Homo sapiens
gugcaccuguaauccca

SEQ ID NO: 657976 - RNA, 13 nt, Homo sapiens
gugcacguugcuu

SEQ ID NO: 657977 - RNA, 18 nt, Homo sapiens
gugcacuccggucccaaa

SEQ ID NO: 657978 - RNA, 14 nt, Homo sapiens
gugcacucucugcu

SEQ ID NO: 657979 - RNA, 16 nt, Homo sapiens
gugcacugacagccuu

SEQ ID NO: 657980 - RNA, 13 nt, Homo sapiens
gugcacugaccug

SEQ ID NO: 657981 - RNA, 13 nt, Homo sapiens
gugcacuggggac

SEQ ID NO: 657982 - RNA, 18 nt, Homo sapiens
gugcagacacuugcucuc

SEQ ID NO: 657983 - RNA, 22 nt, Homo sapiens
gugcagacagaaaacugcagug

SEQ ID NO: 657984 - RNA, 13 nt, Homo sapiens
gugcagccacaca

SEQ ID NO: 657985 - RNA, 17 nt, Homo sapiens
gugcagcccaaucugcc

SEQ ID NO: 657986 - RNA, 19 nt, Homo sapiens
gugcagcccaaucugccag

SEQ ID NO: 657987 - RNA, 17 nt, Homo sapiens
gugcagcugcugugccu

SEQ ID NO: 657988 - RNA, 21 nt, Homo sapiens
gugcagcuucgaggacaggaa

SEQ ID NO: 657989 - RNA, 15 nt, Homo sapiens
gugcagcuugcaguc

SEQ ID NO: 657990 - RNA, 18 nt, Homo sapiens
gugcagggauauugccuu

SEQ ID NO: 657991 - RNA, 22 nt, Homo sapiens
gugcaguacuuugugcauucug

SEQ ID NO: 657992 - RNA, 17 nt, Homo sapiens
gugcauauagaaaacaa

SEQ ID NO: 657993 - RNA, 21 nt, Homo sapiens
gugcauaugaaauccuugacu

SEQ ID NO: 657994 - RNA, 14 nt, Homo sapiens
gugcaucaaccagg

SEQ ID NO: 657995 - RNA, 20 nt, Homo sapiens
gugcaugaauagauucucuc

SEQ ID NO: 657996 - RNA, 12 nt, Homo sapiens
gugcaugugcac

SEQ ID NO: 657997 - RNA, 16 nt, Homo sapiens
gugcauuggcuaauaa

SEQ ID NO: 657998 - RNA, 17 nt, Homo sapiens
gugcauuucagcuugaa

SEQ ID NO: 657999 - RNA, 12 nt, Homo sapiens
gugccaaaaauc

SEQ ID NO: 658000 - RNA, 20 nt, Homo sapiens
gugccaaauuauucuccuau

SEQ ID NO: 658001 - RNA, 20 nt, Homo sapiens
gugccaauauguauuguaaa

SEQ ID NO: 658002 - RNA, 17 nt, Homo sapiens
gugccaauauuucugau

SEQ ID NO: 658003 - RNA, 18 nt, Homo sapiens
gugccaauauuucugaua

SEQ ID NO: 658004 - RNA, 12 nt, Homo sapiens
gugccacacagu

SEQ ID NO: 658005 - RNA, 20 nt, Homo sapiens
gugccaccaacauaaaacaa

SEQ ID NO: 658006 - RNA, 12 nt, Homo sapiens
gugccacccgca

SEQ ID NO: 658007 - RNA, 23 nt, Homo sapiens
gugccacccuccucccuccaagc

SEQ ID NO: 658008 - RNA, 14 nt, Homo sapiens
gugccacucagaga

SEQ ID NO: 658009 - RNA, 23 nt, Homo sapiens
gugccacugcccgagcuggugca

SEQ ID NO: 658010 - RNA, 22 nt, Homo sapiens
gugccacuuuaauccuuccacu

SEQ ID NO: 658011 - RNA, 21 nt, Homo sapiens
gugccagcaaugacaucucag

SEQ ID NO: 658012 - RNA, 16 nt, Homo sapiens
gugccagcaccacagc

SEQ ID NO: 658013 - RNA, 15 nt, Homo sapiens
gugccaggacaauga

SEQ ID NO: 658014 - RNA, 22 nt, Homo sapiens
gugccagguggcucagugccac

SEQ ID NO: 658015 - RNA, 15 nt, Homo sapiens
gugcccacauuugau

SEQ ID NO: 658016 - RNA, 14 nt, Homo sapiens
gugcccaccagccu

SEQ ID NO: 658017 - RNA, 22 nt, Homo sapiens
gugcccacccgucuucaaucuc

SEQ ID NO: 658018 - RNA, 18 nt, Homo sapiens
gugcccaucaagugcagu

SEQ ID NO: 658019 - RNA, 19 nt, Homo sapiens
gugccccagcagugccuug

SEQ ID NO: 658020 - RNA, 21 nt, Homo sapiens
gugccccagggaguccagggu

SEQ ID NO: 658021 - RNA, 20 nt, Homo sapiens
gugccccuuuccuucacugc

SEQ ID NO: 658022 - RNA, 19 nt, Homo sapiens
gugcccucccucacuugug

SEQ ID NO: 658023 - RNA, 17 nt, Homo sapiens
gugcccuuugggguccc

SEQ ID NO: 658024 - RNA, 14 nt, Homo sapiens
gugccgcuccugcu

SEQ ID NO: 658025 - RNA, 18 nt, Homo sapiens
gugccgugugagugugac

SEQ ID NO: 658026 - RNA, 20 nt, Homo sapiens
gugccgugugagugugacag

SEQ ID NO: 658027 - RNA, 16 nt, Homo sapiens
gugccuaaagugcugc

SEQ ID NO: 658028 - RNA, 18 nt, Homo sapiens
gugccuccaccaccacug

SEQ ID NO: 658029 - RNA, 14 nt, Homo sapiens
gugccuccucaaac

SEQ ID NO: 658030 - RNA, 17 nt, Homo sapiens
gugccuggguggccauc

SEQ ID NO: 658031 - RNA, 17 nt, Homo sapiens
gugccuucccagacacu

SEQ ID NO: 658032 - RNA, 23 nt, Homo sapiens
gugccuucuaaauggcaugacau

SEQ ID NO: 658033 - RNA, 20 nt, Homo sapiens
gugccuucucacaucugucc

SEQ ID NO: 658034 - RNA, 21 nt, Homo sapiens
gugccuuuaauuugcuacugu

SEQ ID NO: 658035 - RNA, 13 nt, Homo sapiens
gugcgaguccucc

SEQ ID NO: 658036 - RNA, 17 nt, Homo sapiens
gugcgagugugugcaug

SEQ ID NO: 658037 - RNA, 16 nt, Homo sapiens
gugcgcucugccauuc

SEQ ID NO: 658038 - RNA, 15 nt, Homo sapiens
gugcggcggucccag

SEQ ID NO: 658039 - RNA, 19 nt, Homo sapiens
gugcgugaaguaggcauau

SEQ ID NO: 658040 - RNA, 18 nt, Homo sapiens
gugcgugcaugugcacuu

SEQ ID NO: 658041 - RNA, 17 nt, Homo sapiens
gugcgugugcgugcaug

SEQ ID NO: 658042 - RNA, 14 nt, Homo sapiens
gugcgugugugcaa

SEQ ID NO: 658043 - RNA, 13 nt, Homo sapiens
gugcuaacauaaa

SEQ ID NO: 658044 - RNA, 21 nt, Homo sapiens
guuguuaauaaaaguacaugu

SEQ ID NO: 658045 - RNA, 20 nt, Homo sapiens
guuguuaaugaaaaugucag

SEQ ID NO: 658046 - RNA, 21 nt, Homo sapiens
guuguucaaauguuccuuuua

SEQ ID NO: 658047 - RNA, 19 nt, Homo sapiens
guuguucaguugccaagga

SEQ ID NO: 658048 - RNA, 18 nt, Homo sapiens
guuguugaggcugucaca

SEQ ID NO: 658049 - RNA, 22 nt, Homo sapiens
guuguugagguuugaaaagcug

SEQ ID NO: 658050 - RNA, 13 nt, Homo sapiens
guuguuguuaaca

SEQ ID NO: 658051 - RNA, 13 nt, Homo sapiens
guuguuucuugcc

SEQ ID NO: 658052 - RNA, 22 nt, Homo sapiens
guuuaaaaaggcaguuugcaaa

SEQ ID NO: 658053 - RNA, 16 nt, Homo sapiens
guuuaaaaauacaugu

SEQ ID NO: 658054 - RNA, 19 nt, Homo sapiens
guuuaaagaagcucuccag

SEQ ID NO: 658055 - RNA, 22 nt, Homo sapiens
guuuaaagucucaguuucuugc

SEQ ID NO: 658056 - RNA, 15 nt, Homo sapiens
guuuaaauagccuaa

SEQ ID NO: 658057 - RNA, 13 nt, Homo sapiens
guuuaaaugccaa

SEQ ID NO: 658058 - RNA, 16 nt, Homo sapiens
guuuaacauacaauca

SEQ ID NO: 658059 - RNA, 12 nt, Homo sapiens
guuuaacauuca

SEQ ID NO: 658060 - RNA, 20 nt, Homo sapiens
guuuaaguaauugccuacaa

SEQ ID NO: 658061 - RNA, 14 nt, Homo sapiens
guuuaauauuccaa

SEQ ID NO: 658062 - RNA, 18 nt, Homo sapiens
guuuacaaagcaucucau

SEQ ID NO: 658063 - RNA, 22 nt, Homo sapiens
guuuacaagcccccccuuccac

SEQ ID NO: 658064 - RNA, 14 nt, Homo sapiens
guuuaccacuaacu

SEQ ID NO: 658065 - RNA, 15 nt, Homo sapiens
guuuacucuguuacc

SEQ ID NO: 658066 - RNA, 21 nt, Homo sapiens
guuuacuuccugcagugaauu

SEQ ID NO: 658067 - RNA, 21 nt, Homo sapiens
guuuacuucucaccauuugag

SEQ ID NO: 658068 - RNA, 20 nt, Homo sapiens
guuuacuuuuuaacuggcuu

SEQ ID NO: 658069 - RNA, 22 nt, Homo sapiens
guuuagaucccaugucaccuca

SEQ ID NO: 658070 - RNA, 23 nt, Homo sapiens
guuuagccaaaggauaagugucc

SEQ ID NO: 658071 - RNA, 18 nt, Homo sapiens
guuuagcuuccuccagag

SEQ ID NO: 658072 - RNA, 17 nt, Homo sapiens
guuuaggaauccuuugg

SEQ ID NO: 658073 - RNA, 20 nt, Homo sapiens
guuuaggaucaucucugcag

SEQ ID NO: 658074 - RNA, 17 nt, Homo sapiens
guuuaguuuuacauuuu

SEQ ID NO: 658075 - RNA, 20 nt, Homo sapiens
guuuauacacaacuuugcaa

SEQ ID NO: 658076 - RNA, 16 nt, Homo sapiens
guuuauauuguggaau

SEQ ID NO: 658077 - RNA, 22 nt, Homo sapiens
guuuaucaguaaauaacuggaa

SEQ ID NO: 658078 - RNA, 22 nt, Homo sapiens
guuuauccacccacaacaucua

SEQ ID NO: 658079 - RNA, 18 nt, Homo sapiens
guuuauccugacauauuc

SEQ ID NO: 658080 - RNA, 22 nt, Homo sapiens
guuuaucuucuuccagauuucc

SEQ ID NO: 658081 - RNA, 19 nt, Homo sapiens
guuuaugauauuucuugcu

SEQ ID NO: 658082 - RNA, 15 nt, Homo sapiens
guuuauguagucagu

SEQ ID NO: 658083 - RNA, 22 nt, Homo sapiens
guuuauguguuaugaacaucca

SEQ ID NO: 658084 - RNA, 20 nt, Homo sapiens
guuuauuccagagaagccag

SEQ ID NO: 658085 - RNA, 19 nt, Homo sapiens
guuuauuuuuauacuuuca

SEQ ID NO: 658086 - RNA, 19 nt, Homo sapiens
guuucaaaaauaaauuugc

SEQ ID NO: 658087 - RNA, 12 nt, Homo sapiens
guuucaacagag

SEQ ID NO: 658088 - RNA, 14 nt, Homo sapiens
guuucaacugugcu

SEQ ID NO: 658089 - RNA, 18 nt, Homo sapiens
guuucacagaaaauaagg

SEQ ID NO: 658090 - RNA, 20 nt, Homo sapiens
guuucaccauauuggucacg

SEQ ID NO: 658091 - RNA, 19 nt, Homo sapiens
guuucaccauguuggucag

SEQ ID NO: 658092 - RNA, 19 nt, Homo sapiens
guuucaccguguuagccag

SEQ ID NO: 658093 - RNA, 21 nt, Homo sapiens
guuucacuguacugcauguga

SEQ ID NO: 658094 - RNA, 20 nt, Homo sapiens
guuucagaauuuuguauauu

SEQ ID NO: 658095 - RNA, 23 nt, Homo sapiens
guuucagaugauucuaugucuca

SEQ ID NO: 658096 - RNA, 22 nt, Homo sapiens
guuucauucauccugaccaaga

SEQ ID NO: 658097 - RNA, 20 nt, Homo sapiens
guuucauuuagucaugugac

SEQ ID NO: 658098 - RNA, 21 nt, Homo sapiens
guuucauuuagucaugugacc

SEQ ID NO: 658099 - RNA, 22 nt, Homo sapiens
guuuccacucaaaauaugucaa

SEQ ID NO: 658100 - RNA, 21 nt, Homo sapiens
guuuccacugccuccugugac

SEQ ID NO: 658101 - RNA, 19 nt, Homo sapiens
guuuccaucagguuccauc

SEQ ID NO: 658102 - RNA, 18 nt, Homo sapiens
guuuccaugguuaccuga

SEQ ID NO: 658103 - RNA, 13 nt, Homo sapiens
guuuccauuuaug

SEQ ID NO: 658104 - RNA, 19 nt, Homo sapiens
guuucccgguucaggacca

SEQ ID NO: 658105 - RNA, 18 nt, Homo sapiens
guuucccugccccugucc

SEQ ID NO: 658106 - RNA, 23 nt, Homo sapiens
guuuccugggcacgcacuggguu

SEQ ID NO: 658107 - RNA, 13 nt, Homo sapiens
guuuccuggucag

SEQ ID NO: 658108 - RNA, 21 nt, Homo sapiens
guuucgaagaauaaaauauga

SEQ ID NO: 658109 - RNA, 16 nt, Homo sapiens
guuucgacugguccag

SEQ ID NO: 658110 - RNA, 13 nt, Homo sapiens
guuucggaaaaaa

SEQ ID NO: 658111 - RNA, 19 nt, Homo sapiens
guuucuagagaacaguuga

SEQ ID NO: 658112 - RNA, 20 nt, Homo sapiens
guuucucaaagaugcguuug

SEQ ID NO: 658113 - RNA, 23 nt, Homo sapiens
guuucucaaagaugcguuugccu

SEQ ID NO: 658114 - RNA, 20 nt, Homo sapiens
guuucuccuuuugaccaaau

SEQ ID NO: 658115 - RNA, 22 nt, Homo sapiens
guuucucugccuucuuccagga

SEQ ID NO: 658116 - RNA, 17 nt, Homo sapiens
guuucugaagugcucuu

SEQ ID NO: 658117 - RNA, 19 nt, Homo sapiens
guuucuggggaugucccag

SEQ ID NO: 658118 - RNA, 11 nt, Homo sapiens
guuucuuccaa

SEQ ID NO: 658119 - RNA, 16 nt, Homo sapiens
guuucuugcacugaau

SEQ ID NO: 658120 - RNA, 10 nt, Homo sapiens
guuucuugcc

SEQ ID NO: 658121 - RNA, 21 nt, Homo sapiens
guuucuugcucccagaccaag

SEQ ID NO: 658122 - RNA, 23 nt, Homo sapiens
guuucuugcucccagaccaaggc

SEQ ID NO: 658123 - RNA, 12 nt, Homo sapiens
guuugaacauuu

SEQ ID NO: 658124 - RNA, 15 nt, Homo sapiens
guuugaacucuguaa

SEQ ID NO: 658125 - RNA, 21 nt, Homo sapiens
guuugaagucuuguguauuug

SEQ ID NO: 658126 - RNA, 17 nt, Homo sapiens
guuugacaccuuagaga

SEQ ID NO: 658127 - RNA, 15 nt, Homo sapiens
guuugacauuugucu

SEQ ID NO: 658128 - RNA, 14 nt, Homo sapiens
guuugaccaucacc

SEQ ID NO: 658129 - RNA, 18 nt, Homo sapiens
guuugacgacagugcauu

SEQ ID NO: 658130 - RNA, 17 nt, Homo sapiens
guuugagacuauggaau

SEQ ID NO: 658131 - RNA, 14 nt, Homo sapiens
guuugauauggaga

SEQ ID NO: 658132 - RNA, 22 nt, Homo sapiens
guuugauguccccaaaguacca

SEQ ID NO: 658133 - RNA, 15 nt, Homo sapiens
guuugcaaaugucag

SEQ ID NO: 658134 - RNA, 21 nt, Homo sapiens
guuugccaagcuaaucugccu

SEQ ID NO: 658135 - RNA, 14 nt, Homo sapiens
guuugccaccagaa

SEQ ID NO: 658136 - RNA, 22 nt, Homo sapiens
guuugcgggggucugagucuau

SEQ ID NO: 658137 - RNA, 14 nt, Homo sapiens
guuugcuagcagaa

SEQ ID NO: 658138 - RNA, 16 nt, Homo sapiens
guuugcuuagcauucc

SEQ ID NO: 658139 - RNA, 17 nt, Homo sapiens
guuuggaggagcaaagu

SEQ ID NO: 658140 - RNA, 13 nt, Homo sapiens
guuuggaguuuaa

SEQ ID NO: 658141 - RNA, 14 nt, Homo sapiens
guuuggcgggccaa

SEQ ID NO: 658142 - RNA, 18 nt, Homo sapiens
guuugggccccucagagc

SEQ ID NO: 658143 - RNA, 15 nt, Homo sapiens
guuuggggcccucua

SEQ ID NO: 658144 - RNA, 20 nt, Homo sapiens
guuuggugggccauaugccu

SEQ ID NO: 658145 - RNA, 14 nt, Homo sapiens
guuuguaaauaaga

SEQ ID NO: 658146 - RNA, 14 nt, Homo sapiens
guuuguaagacuua

SEQ ID NO: 658147 - RNA, 16 nt, Homo sapiens
guuuguaaugcaaaag

SEQ ID NO: 658148 - RNA, 14 nt, Homo sapiens
guuuguagugaaau

SEQ ID NO: 658149 - RNA, 17 nt, Homo sapiens
guuuguauuuugcauac

SEQ ID NO: 658150 - RNA, 16 nt, Homo sapiens
guuugucagacuuuaa

SEQ ID NO: 658151 - RNA, 14 nt, Homo sapiens
guuuguccugagau

SEQ ID NO: 658152 - RNA, 21 nt, Homo sapiens
guuuguccuuuuucacuuuga

SEQ ID NO: 658153 - RNA, 22 nt, Homo sapiens
guuuguccuuuuucacuuugaa

SEQ ID NO: 658154 - RNA, 21 nt, Homo sapiens
guuugucugauguggcaaaag

SEQ ID NO: 658155 - RNA, 17 nt, Homo sapiens
guuugugggacuggguu

SEQ ID NO: 658156 - RNA, 22 nt, Homo sapiens
guuugugugaucauacaguuau

SEQ ID NO: 658157 - RNA, 12 nt, Homo sapiens
guuuguguuacc

SEQ ID NO: 658158 - RNA, 16 nt, Homo sapiens
guuuguuacuauguau

SEQ ID NO: 658159 - RNA, 15 nt, Homo sapiens
guuuguucacuuaaa

SEQ ID NO: 658160 - RNA, 12 nt, Homo sapiens
guuuguuucauu

SEQ ID NO: 658161 - RNA, 17 nt, Homo sapiens
guuuuaaauguaugauu

SEQ ID NO: 658162 - RNA, 17 nt, Homo sapiens
guuuuaacuguggauau

SEQ ID NO: 658163 - RNA, 17 nt, Homo sapiens
guuuuaacuuccagugg

SEQ ID NO: 658164 - RNA, 18 nt, Homo sapiens
guuuuacaaugucauaua

SEQ ID NO: 658165 - RNA, 16 nt, Homo sapiens
uaagaaagaucaaaga

SEQ ID NO: 658166 - RNA, 13 nt, Homo sapiens
uaagaaauaucug

SEQ ID NO: 658167 - RNA, 17 nt, Homo sapiens
uaagaaaugaacaaaag

SEQ ID NO: 658168 - RNA, 15 nt, Homo sapiens
uaagaaaugaucuuu

SEQ ID NO: 658169 - RNA, 23 nt, Homo sapiens
uaagaaauuccauacuucucuca

SEQ ID NO: 658170 - RNA, 14 nt, Homo sapiens
uaagaacaaugcca

SEQ ID NO: 658171 - RNA, 21 nt, Homo sapiens
uaagaaccuuauuuugauaaa

SEQ ID NO: 658172 - RNA, 20 nt, Homo sapiens
uaagaacugugaaauuuaca

SEQ ID NO: 658173 - RNA, 20 nt, Homo sapiens
uaagaagaaugcuuaaucag

SEQ ID NO: 658174 - RNA, 12 nt, Homo sapiens
uaagaagacauu

SEQ ID NO: 658175 - RNA, 17 nt, Homo sapiens
uaagaagagccauagcu

SEQ ID NO: 658176 - RNA, 13 nt, Homo sapiens
uaagaagcauuuu

SEQ ID NO: 658177 - RNA, 21 nt, Homo sapiens
uaagaagccuuaauuugcaca

SEQ ID NO: 658178 - RNA, 14 nt, Homo sapiens
uaagaaggaaaaga

SEQ ID NO: 658179 - RNA, 14 nt, Homo sapiens
uaagaauagaaaua

SEQ ID NO: 658180 - RNA, 22 nt, Homo sapiens
uaagaaucuuuagagaaguaua

SEQ ID NO: 658181 - RNA, 14 nt, Homo sapiens
uaagaaugcugguu

SEQ ID NO: 658182 - RNA, 18 nt, Homo sapiens
uaagaauuuagggagaaa

SEQ ID NO: 658183 - RNA, 14 nt, Homo sapiens
uaagaauuugcaua

SEQ ID NO: 658184 - RNA, 19 nt, Homo sapiens
uaagaauuuuugaagugac

SEQ ID NO: 658185 - RNA, 22 nt, Homo sapiens
uaagacaaauauuccuuugcau

SEQ ID NO: 658186 - RNA, 13 nt, Homo sapiens
uaagacacauuga

SEQ ID NO: 658187 - RNA, 14 nt, Homo sapiens
uaagacacauugac

SEQ ID NO: 658188 - RNA, 16 nt, Homo sapiens
uaagacguauguaaca

SEQ ID NO: 658189 - RNA, 23 nt, Homo sapiens
uaagacuguuuuuaaguaacuua

SEQ ID NO: 658190 - RNA, 14 nt, Homo sapiens
uaagacuuucccca

SEQ ID NO: 658191 - RNA, 14 nt, Homo sapiens
uaagagaugggacu

SEQ ID NO: 658192 - RNA, 21 nt, Homo sapiens
uaagagccauauaaguuugaa

SEQ ID NO: 658193 - RNA, 22 nt, Homo sapiens
uaagaggaucuccuguccauca

SEQ ID NO: 658194 - RNA, 22 nt, Homo sapiens
uaagagugccguaacaacugug

SEQ ID NO: 658195 - RNA, 24 nt, Homo sapiens
uaagaguggaaccaacacuaacau

SEQ ID NO: 658196 - RNA, 23 nt, Homo sapiens
uaagaguugagauuuugcaaucu

SEQ ID NO: 658197 - RNA, 15 nt, Homo sapiens
uaagauaauguugcu

SEQ ID NO: 658198 - RNA, 19 nt, Homo sapiens
uaagauauucagaaguaua

SEQ ID NO: 658199 - RNA, 18 nt, Homo sapiens
uaagauauuuaguaauau

SEQ ID NO: 658200 - RNA, 20 nt, Homo sapiens
uaagauccuaaacucucuag

SEQ ID NO: 658201 - RNA, 19 nt, Homo sapiens
uaagaucuguuaaaaaaga

SEQ ID NO: 658202 - RNA, 15 nt, Homo sapiens
uaagaugacucugag

SEQ ID NO: 658203 - RNA, 21 nt, Homo sapiens
uaagauguauuugaacacuug

SEQ ID NO: 658204 - RNA, 15 nt, Homo sapiens
uaagauguguuccuu

SEQ ID NO: 658205 - RNA, 17 nt, Homo sapiens
uaagauguucacugugg

SEQ ID NO: 658206 - RNA, 18 nt, Homo sapiens
uaagauuuccaagugcca

SEQ ID NO: 658207 - RNA, 21 nt, Homo sapiens
uaagauuuuugaaaauccuga

SEQ ID NO: 658208 - RNA, 13 nt, Homo sapiens
uaagcaacaucua

SEQ ID NO: 658209 - RNA, 16 nt, Homo sapiens
uaagcagaaauccugc

SEQ ID NO: 658210 - RNA, 16 nt, Homo sapiens
uaagcagaagcauuaa

SEQ ID NO: 658211 - RNA, 17 nt, Homo sapiens
uaagcauacaacuggac

SEQ ID NO: 658212 - RNA, 15 nt, Homo sapiens
uaagcauauuuucuc

SEQ ID NO: 658213 - RNA, 20 nt, Homo sapiens
uaagccacugccucucccuc

SEQ ID NO: 658214 - RNA, 18 nt, Homo sapiens
uaagccagaauccagaag

SEQ ID NO: 658215 - RNA, 22 nt, Homo sapiens
uaagccgcagagacccucucag

SEQ ID NO: 658216 - RNA, 21 nt, Homo sapiens
uaagccuugaaaaagaacaaa

SEQ ID NO: 658217 - RNA, 16 nt, Homo sapiens
uaagcuaggaaugaaa

SEQ ID NO: 658218 - RNA, 23 nt, Homo sapiens
uaagcucacguccugagaaagcu

SEQ ID NO: 658219 - RNA, 18 nt, Homo sapiens
uaagcuccaugugcauau

SEQ ID NO: 658220 - RNA, 21 nt, Homo sapiens
uaagcuccaugugcauauaaa

SEQ ID NO: 658221 - RNA, 20 nt, Homo sapiens
uaagcucuacugaggugcua

SEQ ID NO: 658222 - RNA, 12 nt, Homo sapiens
uaagcucuggcu

SEQ ID NO: 658223 - RNA, 23 nt, Homo sapiens
uaagcuguaagauaauguugcuu

SEQ ID NO: 658224 - RNA, 12 nt, Homo sapiens
uaagcuuuuugg

SEQ ID NO: 658225 - RNA, 14 nt, Homo sapiens
uaaggacauuuccc

SEQ ID NO: 658226 - RNA, 16 nt, Homo sapiens
uaaggaccaauagcau

SEQ ID NO: 658227 - RNA, 15 nt, Homo sapiens
uaaggagacugaggc

SEQ ID NO: 658228 - RNA, 13 nt, Homo sapiens
uaaggagccuuuc

SEQ ID NO: 658229 - RNA, 19 nt, Homo sapiens
uaaggaguaaucuguguac

SEQ ID NO: 658230 - RNA, 20 nt, Homo sapiens
uaaggaguaaucuguguaca

SEQ ID NO: 658231 - RNA, 19 nt, Homo sapiens
uaaggaugacuuuagaaua

SEQ ID NO: 658232 - RNA, 15 nt, Homo sapiens
uaaggauugugauau

SEQ ID NO: 658233 - RNA, 14 nt, Homo sapiens
uaaggauuuuucaa

SEQ ID NO: 658234 - RNA, 21 nt, Homo sapiens
uaaggcaacuuauugcagugu

SEQ ID NO: 658235 - RNA, 23 nt, Homo sapiens
uaaggcauguggccuuuaucuca

SEQ ID NO: 658236 - RNA, 22 nt, Homo sapiens
uaaggcccagcaaucugcauuu

SEQ ID NO: 658237 - RNA, 16 nt, Homo sapiens
uaaggcuuuuucuucc

SEQ ID NO: 658238 - RNA, 23 nt, Homo sapiens
uaagggcuuuuccaaacaugcau

SEQ ID NO: 658239 - RNA, 20 nt, Homo sapiens
uaaggggccuugcucugagc

SEQ ID NO: 658240 - RNA, 20 nt, Homo sapiens
uaaggguuaguuuacaauca

SEQ ID NO: 658241 - RNA, 21 nt, Homo sapiens
uaagguacacacuuucauuua

SEQ ID NO: 658242 - RNA, 13 nt, Homo sapiens
uaagguacuuaaa

SEQ ID NO: 658243 - RNA, 15 nt, Homo sapiens
uaagguaugugcuau

SEQ ID NO: 658244 - RNA, 19 nt, Homo sapiens
uaaggucuccaaaccagac

SEQ ID NO: 658245 - RNA, 12 nt, Homo sapiens
uaaggucuuugu

SEQ ID NO: 658246 - RNA, 19 nt, Homo sapiens
uaaggugcaauaagaauuu

SEQ ID NO: 658247 - RNA, 13 nt, Homo sapiens
uaaggugggucca

SEQ ID NO: 658248 - RNA, 21 nt, Homo sapiens
uaagguuguuccccuaguucu

SEQ ID NO: 658249 - RNA, 17 nt, Homo sapiens
uaaguaacuucacauua

SEQ ID NO: 658250 - RNA, 20 nt, Homo sapiens
uaaguaaucacuaaugcuca

SEQ ID NO: 658251 - RNA, 15 nt, Homo sapiens
uaaguacaugugcca

SEQ ID NO: 658252 - RNA, 23 nt, Homo sapiens
uaaguacuagaugcaucacuggg

SEQ ID NO: 658253 - RNA, 22 nt, Homo sapiens
uaaguauaaaauacaacaaagg

SEQ ID NO: 658254 - RNA, 17 nt, Homo sapiens
uaaguaucuugugcuuc

SEQ ID NO: 658255 - RNA, 22 nt, Homo sapiens
uaagucaaccugccugacauuu

SEQ ID NO: 658256 - RNA, 19 nt, Homo sapiens
uaagucagggaagagcagu

SEQ ID NO: 658257 - RNA, 21 nt, Homo sapiens
uaagucaucauuacuugggaa

SEQ ID NO: 658258 - RNA, 19 nt, Homo sapiens
uaaguccagcuuggccaag

SEQ ID NO: 658259 - RNA, 15 nt, Homo sapiens
uaagucucugugaau

SEQ ID NO: 658260 - RNA, 14 nt, Homo sapiens
uaagucugauucuc

SEQ ID NO: 658261 - RNA, 15 nt, Homo sapiens
uaagucuuucccaau

SEQ ID NO: 658262 - RNA, 24 nt, Homo sapiens
uaagugaaaaucuuacaacaggcu

SEQ ID NO: 658263 - RNA, 12 nt, Homo sapiens
uaagugacaaaa

SEQ ID NO: 658264 - RNA, 11 nt, Homo sapiens
uaagugaugcu

SEQ ID NO: 658265 - RNA, 19 nt, Homo sapiens
uaagugcaauuaacauaug

SEQ ID NO: 658266 - RNA, 19 nt, Homo sapiens
uaagugccauuacuacugu

SEQ ID NO: 658267 - RNA, 22 nt, Homo sapiens
uaagugccauuacuacuguaca

SEQ ID NO: 658268 - RNA, 13 nt, Homo sapiens
uaagugcugcuau

SEQ ID NO: 658269 - RNA, 14 nt, Homo sapiens
uaagugcugcuaua

SEQ ID NO: 658270 - RNA, 19 nt, Homo sapiens
uaaguggaaaaugcaaugu

SEQ ID NO: 658271 - RNA, 15 nt, Homo sapiens
uaaguggacuggugu

SEQ ID NO: 658272 - RNA, 19 nt, Homo sapiens
uaagugguaaaauaaucca

SEQ ID NO: 658273 - RNA, 22 nt, Homo sapiens
uaaguggugcuuagaaaauuca

SEQ ID NO: 658274 - RNA, 18 nt, Homo sapiens
uaaguguguaugugcauu

SEQ ID NO: 658275 - RNA, 20 nt, Homo sapiens
uaaguguguaugugcauuaa

SEQ ID NO: 658276 - RNA, 19 nt, Homo sapiens
uaaguguuagagggaacag

SEQ ID NO: 658277 - RNA, 18 nt, Homo sapiens
uaaguguugguagcacuu

SEQ ID NO: 658278 - RNA, 23 nt, Homo sapiens
uaaguguuuagaaaucauagaag

SEQ ID NO: 658279 - RNA, 16 nt, Homo sapiens
uaaguguuugucauau

SEQ ID NO: 658280 - RNA, 16 nt, Homo sapiens
uaaguuaaaacaaagg

SEQ ID NO: 658281 - RNA, 16 nt, Homo sapiens
uaaguuagacucuucc

SEQ ID NO: 658282 - RNA, 14 nt, Homo sapiens
uaaguuucugggac

SEQ ID NO: 658283 - RNA, 21 nt, Homo sapiens
uaauaaaaaauauucuuguca

SEQ ID NO: 658284 - RNA, 21 nt, Homo sapiens
uaauaaaaccggucacugaug

SEQ ID NO: 658285 - RNA, 19 nt, Homo sapiens
uaauaaaacuaaacuuuca

SEQ ID NO: 658286 - RNA, 15 nt, Homo sapiens
uacaugaauugcauu

SEQ ID NO: 658287 - RNA, 11 nt, Homo sapiens
uacaugacugg

SEQ ID NO: 658288 - RNA, 21 nt, Homo sapiens
uacaugagaaggaacuuccag

SEQ ID NO: 658289 - RNA, 15 nt, Homo sapiens
uacaugcaacagaag

SEQ ID NO: 658290 - RNA, 18 nt, Homo sapiens
uacaugcagcccaugccc

SEQ ID NO: 658291 - RNA, 15 nt, Homo sapiens
uacaugcauugcucu

SEQ ID NO: 658292 - RNA, 13 nt, Homo sapiens
uacaugcauuuga

SEQ ID NO: 658293 - RNA, 16 nt, Homo sapiens
uacaugcuggggucaa

SEQ ID NO: 658294 - RNA, 11 nt, Homo sapiens
uacauggaaua

SEQ ID NO: 658295 - RNA, 16 nt, Homo sapiens
uacauguaauccauca

SEQ ID NO: 658296 - RNA, 16 nt, Homo sapiens
uacauguaauuugaug

SEQ ID NO: 658297 - RNA, 14 nt, Homo sapiens
uacauguauugcac

SEQ ID NO: 658298 - RNA, 11 nt, Homo sapiens
uacauguuaag

SEQ ID NO: 658299 - RNA, 14 nt, Homo sapiens
uacauguuacuugu

SEQ ID NO: 658300 - RNA, 13 nt, Homo sapiens
uacauuaccauau

SEQ ID NO: 658301 - RNA, 17 nt, Homo sapiens
uacauuagcagaagcau

SEQ ID NO: 658302 - RNA, 14 nt, Homo sapiens
uacauuauucuuca

SEQ ID NO: 658303 - RNA, 15 nt, Homo sapiens
uacauucaacagaga

SEQ ID NO: 658304 - RNA, 14 nt, Homo sapiens
uacauuccauuuca

SEQ ID NO: 658305 - RNA, 19 nt, Homo sapiens
uacauuccucagcugccaa

SEQ ID NO: 658306 - RNA, 22 nt, Homo sapiens
uacauucugcaagcacaucugc

SEQ ID NO: 658307 - RNA, 20 nt, Homo sapiens
uacauucuuuuuucuauuca

SEQ ID NO: 658308 - RNA, 21 nt, Homo sapiens
uacauugaaacccuccaaauc

SEQ ID NO: 658309 - RNA, 21 nt, Homo sapiens
uacauuguacaaggaaugaaa

SEQ ID NO: 658310 - RNA, 18 nt, Homo sapiens
uacauuucaccuacuuug

SEQ ID NO: 658311 - RNA, 16 nt, Homo sapiens
uacauuuccaaauuca

SEQ ID NO: 658312 - RNA, 18 nt, Homo sapiens
uacauuuccaaauucaca

SEQ ID NO: 658313 - RNA, 19 nt, Homo sapiens
uacauuuccaaauucacaa

SEQ ID NO: 658314 - RNA, 19 nt, Homo sapiens
uacauuuggccucugcccu

SEQ ID NO: 658315 - RNA, 23 nt, Homo sapiens
uacauuuucuuguggagcaauag

SEQ ID NO: 658316 - RNA, 19 nt, Homo sapiens
uacauuuuguaaaauauua

SEQ ID NO: 658317 - RNA, 23 nt, Homo sapiens
uacauuuuuggggggagagacac

SEQ ID NO: 658318 - RNA, 23 nt, Homo sapiens
uaccaaaaauuuugugacauucc

SEQ ID NO: 658319 - RNA, 15 nt, Homo sapiens
uaccaaaagggccau

SEQ ID NO: 658320 - RNA, 19 nt, Homo sapiens
uaccaaauccacaagccau

SEQ ID NO: 658321 - RNA, 17 nt, Homo sapiens
uaccaacauaaguguug

SEQ ID NO: 658322 - RNA, 12 nt, Homo sapiens
uaccaacuuuac

SEQ ID NO: 658323 - RNA, 20 nt, Homo sapiens
uaccaagaacugaaggcaua

SEQ ID NO: 658324 - RNA, 14 nt, Homo sapiens
uaccaaucucugaa

SEQ ID NO: 658325 - RNA, 14 nt, Homo sapiens
uaccaaugcaugca

SEQ ID NO: 658326 - RNA, 18 nt, Homo sapiens
uaccacaaacccugcuga

SEQ ID NO: 658327 - RNA, 15 nt, Homo sapiens
uaccacacauauugc

SEQ ID NO: 658328 - RNA, 13 nt, Homo sapiens
uaccacacugagu

SEQ ID NO: 658329 - RNA, 12 nt, Homo sapiens
uaccacaguguc

SEQ ID NO: 658330 - RNA, 16 nt, Homo sapiens
uaccaccaugcacugu

SEQ ID NO: 658331 - RNA, 23 nt, Homo sapiens
uaccaccccccacccuccuccag

SEQ ID NO: 658332 - RNA, 20 nt, Homo sapiens
uaccaccuuuacugugcuua

SEQ ID NO: 658333 - RNA, 11 nt, Homo sapiens
uaccacuccca

SEQ ID NO: 658334 - RNA, 23 nt, Homo sapiens
uaccacucgcguguuccccaagc

SEQ ID NO: 658335 - RNA, 19 nt, Homo sapiens
uaccacugauuuggagaua

SEQ ID NO: 658336 - RNA, 14 nt, Homo sapiens
uaccacugcacugu

SEQ ID NO: 658337 - RNA, 17 nt, Homo sapiens
uaccacuuuugcaaaua

SEQ ID NO: 658338 - RNA, 15 nt, Homo sapiens
uaccagaucuaauau

SEQ ID NO: 658339 - RNA, 16 nt, Homo sapiens
uaccaggggaggcagu

SEQ ID NO: 658340 - RNA, 20 nt, Homo sapiens
uaccaggggaggcagugucu

SEQ ID NO: 658341 - RNA, 18 nt, Homo sapiens
uaccagucuauuuccacu

SEQ ID NO: 658342 - RNA, 16 nt, Homo sapiens
uaccaguugguauuuc

SEQ ID NO: 658343 - RNA, 18 nt, Homo sapiens
uaccauaagugacaccaa

SEQ ID NO: 658344 - RNA, 13 nt, Homo sapiens
uaccaucagggac

SEQ ID NO: 658345 - RNA, 16 nt, Homo sapiens
uaccaugagugaauuu

SEQ ID NO: 658346 - RNA, 13 nt, Homo sapiens
uaccaugcugcuu

SEQ ID NO: 658347 - RNA, 17 nt, Homo sapiens
uaccauguggaugcagc

SEQ ID NO: 658348 - RNA, 22 nt, Homo sapiens
uaccauuuaauggggaggacaa

SEQ ID NO: 658349 - RNA, 13 nt, Homo sapiens
uacccaaacccua

SEQ ID NO: 658350 - RNA, 13 nt, Homo sapiens
uacccaaacguga

SEQ ID NO: 658351 - RNA, 14 nt, Homo sapiens
uacccaagcugugg

SEQ ID NO: 658352 - RNA, 14 nt, Homo sapiens
uacccaauuuccca

SEQ ID NO: 658353 - RNA, 19 nt, Homo sapiens
uacccacacauuccagggc

SEQ ID NO: 658354 - RNA, 14 nt, Homo sapiens
uacccacauguaca

SEQ ID NO: 658355 - RNA, 14 nt, Homo sapiens
uacccagagagucc

SEQ ID NO: 658356 - RNA, 15 nt, Homo sapiens
uacccagagaguccu

SEQ ID NO: 658357 - RNA, 20 nt, Homo sapiens
uacccaggcuggagugcagu

SEQ ID NO: 658358 - RNA, 16 nt, Homo sapiens
uacccagugggacaga

SEQ ID NO: 658359 - RNA, 18 nt, Homo sapiens
uacccauccccugaugcc

SEQ ID NO: 658360 - RNA, 20 nt, Homo sapiens
uaccccagacuagauguagu

SEQ ID NO: 658361 - RNA, 17 nt, Homo sapiens
uacccccucauccccca

SEQ ID NO: 658362 - RNA, 21 nt, Homo sapiens
uacccgaaagcaucacugccu

SEQ ID NO: 658363 - RNA, 14 nt, Homo sapiens
uacccuauacaucc

SEQ ID NO: 658364 - RNA, 18 nt, Homo sapiens
uacccuccucugcuggga

SEQ ID NO: 658365 - RNA, 23 nt, Homo sapiens
uacccuccuguaaaugguguaca

SEQ ID NO: 658366 - RNA, 18 nt, Homo sapiens
uacccugcgauuuugccu

SEQ ID NO: 658367 - RNA, 17 nt, Homo sapiens
uacccuuggugccuaau

SEQ ID NO: 658368 - RNA, 19 nt, Homo sapiens
uacccuuuaagauauccau

SEQ ID NO: 658369 - RNA, 17 nt, Homo sapiens
uaccgcugcauaguauu

SEQ ID NO: 658370 - RNA, 15 nt, Homo sapiens
uaccguguguuauau

SEQ ID NO: 658371 - RNA, 17 nt, Homo sapiens
uaccuaaaacugcugaa

SEQ ID NO: 658372 - RNA, 14 nt, Homo sapiens
uaccuaaacugagc

SEQ ID NO: 658373 - RNA, 13 nt, Homo sapiens
uaccuaaggacaa

SEQ ID NO: 658374 - RNA, 21 nt, Homo sapiens
uaccuaaggacaagacacuga

SEQ ID NO: 658375 - RNA, 20 nt, Homo sapiens
uaccuagagcaggcacuuga

SEQ ID NO: 658376 - RNA, 17 nt, Homo sapiens
uaccuagggcacuuuaa

SEQ ID NO: 658377 - RNA, 23 nt, Homo sapiens
uaccuauaggaaagucugucagg

SEQ ID NO: 658378 - RNA, 18 nt, Homo sapiens
uaccuauuucugaugaug

SEQ ID NO: 658379 - RNA, 20 nt, Homo sapiens
uaccucaaagggcaguuuug

SEQ ID NO: 658380 - RNA, 20 nt, Homo sapiens
uaccucaaccaaugccaaaa

SEQ ID NO: 658381 - RNA, 11 nt, Homo sapiens
uaccucaaggg

SEQ ID NO: 658382 - RNA, 23 nt, Homo sapiens
uaccuccccuuuucuauguugcu

SEQ ID NO: 658383 - RNA, 14 nt, Homo sapiens
uaccuccugagaaa

SEQ ID NO: 658384 - RNA, 21 nt, Homo sapiens
uaccucucuccucuccgcgcc

SEQ ID NO: 658385 - RNA, 22 nt, Homo sapiens
uaccucuuacuuugcuugagaa

SEQ ID NO: 658386 - RNA, 16 nt, Homo sapiens
uaccucuuauugcaaa

SEQ ID NO: 658387 - RNA, 17 nt, Homo sapiens
uaccugcgauguuuacg

SEQ ID NO: 658388 - RNA, 17 nt, Homo sapiens
uaccugcucaugguuau

SEQ ID NO: 658389 - RNA, 16 nt, Homo sapiens
uaccuguacacugacu

SEQ ID NO: 658390 - RNA, 17 nt, Homo sapiens
uaccuguauacagugca

SEQ ID NO: 658391 - RNA, 22 nt, Homo sapiens
uaccuguuccauuguugucaaa

SEQ ID NO: 658392 - RNA, 22 nt, Homo sapiens
uaccuuaaaauguaaaacaaaa

SEQ ID NO: 658393 - RNA, 15 nt, Homo sapiens
uaccuuaaacugugu

SEQ ID NO: 658394 - RNA, 17 nt, Homo sapiens
uaccuuaaacuguguaa

SEQ ID NO: 658395 - RNA, 19 nt, Homo sapiens
uaccuuaagagacacucca

SEQ ID NO: 658396 - RNA, 17 nt, Homo sapiens
uaccuuauuaacaaaau

SEQ ID NO: 658397 - RNA, 23 nt, Homo sapiens
uaccuucauguggcucagugccu

SEQ ID NO: 658398 - RNA, 17 nt, Homo sapiens
uaccuucaugugguuca

SEQ ID NO: 658399 - RNA, 23 nt, Homo sapiens
uaccuucaugugguucagugccu

SEQ ID NO: 658400 - RNA, 16 nt, Homo sapiens
uaccuucuauguauua

SEQ ID NO: 658401 - RNA, 23 nt, Homo sapiens
uaccuugaaaaaaagaaaagugu

SEQ ID NO: 658402 - RNA, 22 nt, Homo sapiens
uaccuugaaaugcuuagacucu

SEQ ID NO: 658403 - RNA, 15 nt, Homo sapiens
uaccuugaacucuua

SEQ ID NO: 658404 - RNA, 18 nt, Homo sapiens
uaccuuggcugauguugc

SEQ ID NO: 658405 - RNA, 23 nt, Homo sapiens
uaccuuuaucuuucaccuuucua

SEQ ID NO: 658406 - RNA, 17 nt, Homo sapiens
uaccuuuccagggucaa

SEQ ID NO: 658407 - RNA, 21 nt, Homo sapiens
uaccuuugaaauauuaaaauc

SEQ ID NO: 658408 - RNA, 13 nt, Homo sapiens
ucaacugccucag

SEQ ID NO: 658409 - RNA, 21 nt, Homo sapiens
ucaacuggaauggaugguaca

SEQ ID NO: 658410 - RNA, 19 nt, Homo sapiens
ucaacuggcuacugaguca

SEQ ID NO: 658411 - RNA, 20 nt, Homo sapiens
ucaacuguugauugcaggaa

SEQ ID NO: 658412 - RNA, 19 nt, Homo sapiens
ucaacuuggugacacucua

SEQ ID NO: 658413 - RNA, 22 nt, Homo sapiens
ucaacuuuagcuaguaucuuca

SEQ ID NO: 658414 - RNA, 15 nt, Homo sapiens
ucaagaaacugagga

SEQ ID NO: 658415 - RNA, 13 nt, Homo sapiens
ucaagaaagcccu

SEQ ID NO: 658416 - RNA, 13 nt, Homo sapiens
ucaagaacuauau

SEQ ID NO: 658417 - RNA, 13 nt, Homo sapiens
ucaagaagaggaa

SEQ ID NO: 658418 - RNA, 22 nt, Homo sapiens
ucaagaagcguuaugugcagua

SEQ ID NO: 658419 - RNA, 12 nt, Homo sapiens
ucaagaagucuu

SEQ ID NO: 658420 - RNA, 21 nt, Homo sapiens
ucaagaaucuagaagaugugu

SEQ ID NO: 658421 - RNA, 15 nt, Homo sapiens
ucaagaaugcaauau

SEQ ID NO: 658422 - RNA, 17 nt, Homo sapiens
ucaagacauuugcugaa

SEQ ID NO: 658423 - RNA, 15 nt, Homo sapiens
ucaagaccauaguga

SEQ ID NO: 658424 - RNA, 20 nt, Homo sapiens
ucaagacuaucuacaaaaau

SEQ ID NO: 658425 - RNA, 17 nt, Homo sapiens
ucaagacuuagcuccug

SEQ ID NO: 658426 - RNA, 21 nt, Homo sapiens
ucaagagauagagaccaucuu

SEQ ID NO: 658427 - RNA, 22 nt, Homo sapiens
ucaagagaucuuucuuuccaaa

SEQ ID NO: 658428 - RNA, 16 nt, Homo sapiens
ucaagagcuccuugac

SEQ ID NO: 658429 - RNA, 16 nt, Homo sapiens
ucaagaggaccaaaug

SEQ ID NO: 658430 - RNA, 22 nt, Homo sapiens
ucaagaggcacuucuuuauuaa

SEQ ID NO: 658431 - RNA, 14 nt, Homo sapiens
ucaagagugagcua

SEQ ID NO: 658432 - RNA, 19 nt, Homo sapiens
ucaagauacugcuacugua

SEQ ID NO: 658433 - RNA, 20 nt, Homo sapiens
ucaagaucucauccaagcaa

SEQ ID NO: 658434 - RNA, 14 nt, Homo sapiens
ucaagauucuacuu

SEQ ID NO: 658435 - RNA, 18 nt, Homo sapiens
ucaagauucuacuuggug

SEQ ID NO: 658436 - RNA, 18 nt, Homo sapiens
ucaagcaauugucugccu

SEQ ID NO: 658437 - RNA, 14 nt, Homo sapiens
ucaagcacacugga

SEQ ID NO: 658438 - RNA, 23 nt, Homo sapiens
ucaagcagacauagaagagccaa

SEQ ID NO: 658439 - RNA, 18 nt, Homo sapiens
ucaagccauaauguaagg

SEQ ID NO: 658440 - RNA, 13 nt, Homo sapiens
ucaagccauucca

SEQ ID NO: 658441 - RNA, 15 nt, Homo sapiens
ucaagccccauuucc

SEQ ID NO: 658442 - RNA, 18 nt, Homo sapiens
ucaagcccuuuacuugac

SEQ ID NO: 658443 - RNA, 18 nt, Homo sapiens
ucaagccugugcaaaaaa

SEQ ID NO: 658444 - RNA, 18 nt, Homo sapiens
ucaagccuguugucuuaa

SEQ ID NO: 658445 - RNA, 15 nt, Homo sapiens
ucaagcggugccuaa

SEQ ID NO: 658446 - RNA, 17 nt, Homo sapiens
ucaagcucaaaaggguu

SEQ ID NO: 658447 - RNA, 15 nt, Homo sapiens
ucaagcuccccucac

SEQ ID NO: 658448 - RNA, 18 nt, Homo sapiens
ucaagcugcucugagcca

SEQ ID NO: 658449 - RNA, 18 nt, Homo sapiens
ucaagcugguggccucug

SEQ ID NO: 658450 - RNA, 20 nt, Homo sapiens
ucaagcuuucaaauccuccc

SEQ ID NO: 658451 - RNA, 22 nt, Homo sapiens
ucaagcuuuuaaaaacuagagc

SEQ ID NO: 658452 - RNA, 14 nt, Homo sapiens
ucaaggaauuugca

SEQ ID NO: 658453 - RNA, 23 nt, Homo sapiens
ucaaggacgaauuugcacaguga

SEQ ID NO: 658454 - RNA, 22 nt, Homo sapiens
ucaaggauagaaguauaccuga

SEQ ID NO: 658455 - RNA, 12 nt, Homo sapiens
ucaaggcauuua

SEQ ID NO: 658456 - RNA, 17 nt, Homo sapiens
ucaaggcccucagagau

SEQ ID NO: 658457 - RNA, 21 nt, Homo sapiens
ucaaggccgagggccaggcag

SEQ ID NO: 658458 - RNA, 18 nt, Homo sapiens
ucaaggcugcagugagcc

SEQ ID NO: 658459 - RNA, 16 nt, Homo sapiens
ucaagggacaaguauu

SEQ ID NO: 658460 - RNA, 19 nt, Homo sapiens
ucaagggacaaguauuaau

SEQ ID NO: 658461 - RNA, 21 nt, Homo sapiens
ucaagggcuagcaucccugag

SEQ ID NO: 658462 - RNA, 21 nt, Homo sapiens
ucaaggggcuggaaucucaug

SEQ ID NO: 658463 - RNA, 22 nt, Homo sapiens
ucaaggggcuggaaucucauga

SEQ ID NO: 658464 - RNA, 22 nt, Homo sapiens
ucaagguguuuugaaaugcaga

SEQ ID NO: 658465 - RNA, 21 nt, Homo sapiens
ucaaguaauccaccugccucg

SEQ ID NO: 658466 - RNA, 16 nt, Homo sapiens
ucaaguaauugugaaa

SEQ ID NO: 658467 - RNA, 18 nt, Homo sapiens
ucaaguauaacaacuuug

SEQ ID NO: 658468 - RNA, 23 nt, Homo sapiens
ucaaguccauguuauucucucac

SEQ ID NO: 658469 - RNA, 16 nt, Homo sapiens
ucaagucuacugccac

SEQ ID NO: 658470 - RNA, 16 nt, Homo sapiens
ucaagucucucacccu

SEQ ID NO: 658471 - RNA, 17 nt, Homo sapiens
ucaagucugacucucca

SEQ ID NO: 658472 - RNA, 16 nt, Homo sapiens
ucaagucuucccugau

SEQ ID NO: 658473 - RNA, 19 nt, Homo sapiens
ucaagugauucuccugccu

SEQ ID NO: 658474 - RNA, 22 nt, Homo sapiens
ucaagugauucuccugccucag

SEQ ID NO: 658475 - RNA, 20 nt, Homo sapiens
ucaaguggcaugugcuguga

SEQ ID NO: 658476 - RNA, 16 nt, Homo sapiens
ucaaguguccuggaaa

SEQ ID NO: 658477 - RNA, 15 nt, Homo sapiens
ucaaguugugcuugu

SEQ ID NO: 658478 - RNA, 17 nt, Homo sapiens
ucaaguuuacacuucau

SEQ ID NO: 658479 - RNA, 18 nt, Homo sapiens
ucaaguuugaacucugua

SEQ ID NO: 658480 - RNA, 18 nt, Homo sapiens
ucaauaaaagagcugucu

SEQ ID NO: 658481 - RNA, 16 nt, Homo sapiens
ucaauaaaaugugauu

SEQ ID NO: 658482 - RNA, 22 nt, Homo sapiens
ucaauaaacagcuucaugccuu

SEQ ID NO: 658483 - RNA, 15 nt, Homo sapiens
ucaauaaaccuguca

SEQ ID NO: 658484 - RNA, 18 nt, Homo sapiens
ucaauaaagcacugagca

SEQ ID NO: 658485 - RNA, 17 nt, Homo sapiens
ucaauaaaggacaggcu

SEQ ID NO: 658486 - RNA, 14 nt, Homo sapiens
ucaauaaaguacaa

SEQ ID NO: 658487 - RNA, 15 nt, Homo sapiens
ucaauaaaguacaag

SEQ ID NO: 658488 - RNA, 14 nt, Homo sapiens
ucaauaauuacugu

SEQ ID NO: 658489 - RNA, 15 nt, Homo sapiens
ucaauaauuacugua

SEQ ID NO: 658490 - RNA, 15 nt, Homo sapiens
ucaauacaaccagcc

SEQ ID NO: 658491 - RNA, 14 nt, Homo sapiens
ucaauacagcuuca

SEQ ID NO: 658492 - RNA, 12 nt, Homo sapiens
ucaauacuaugg

SEQ ID NO: 658493 - RNA, 15 nt, Homo sapiens
ucaauagauugcuca

SEQ ID NO: 658494 - RNA, 17 nt, Homo sapiens
ucaauagcaaaugaagg

SEQ ID NO: 658495 - RNA, 19 nt, Homo sapiens
ucaauagcaccccuacuca

SEQ ID NO: 658496 - RNA, 22 nt, Homo sapiens
ucaauauaagaagcaaucuuug

SEQ ID NO: 658497 - RNA, 17 nt, Homo sapiens
ucaauauuaaauacaga

SEQ ID NO: 658498 - RNA, 14 nt, Homo sapiens
ucaauauuccugaa

SEQ ID NO: 658499 - RNA, 13 nt, Homo sapiens
ucaaucagccuuu

SEQ ID NO: 658500 - RNA, 18 nt, Homo sapiens
ucaaucauaauaccugcu

SEQ ID NO: 658501 - RNA, 21 nt, Homo sapiens
ucaaucauaauaccugcugug

SEQ ID NO: 658502 - RNA, 13 nt, Homo sapiens
ucaaucaugucag

SEQ ID NO: 658503 - RNA, 21 nt, Homo sapiens
ucaaucccuagggcuggcaga

SEQ ID NO: 658504 - RNA, 13 nt, Homo sapiens
ucaauccuaucac

SEQ ID NO: 658505 - RNA, 18 nt, Homo sapiens
ucaauccugggcaaucag

SEQ ID NO: 658506 - RNA, 20 nt, Homo sapiens
ucaaucucagcuaacauucc

SEQ ID NO: 658507 - RNA, 21 nt, Homo sapiens
ucaaucucagcuaacauucca

SEQ ID NO: 658508 - RNA, 17 nt, Homo sapiens
ucaaucucuguucugcu

SEQ ID NO: 658509 - RNA, 21 nt, Homo sapiens
ucaaucugcaaacaugccagg

SEQ ID NO: 658510 - RNA, 20 nt, Homo sapiens
ucaaugaauuuuauaaucug

SEQ ID NO: 658511 - RNA, 14 nt, Homo sapiens
ucaaugaccuguau

SEQ ID NO: 658512 - RNA, 21 nt, Homo sapiens
ucaaugacuuaacagaacuca

SEQ ID NO: 658513 - RNA, 20 nt, Homo sapiens
ucaaugcaagagugauugca

SEQ ID NO: 658514 - RNA, 22 nt, Homo sapiens
ucaaugcaggacaacucuguaa

SEQ ID NO: 658515 - RNA, 16 nt, Homo sapiens
ucaaugccuggagaca

SEQ ID NO: 658516 - RNA, 19 nt, Homo sapiens
ucaaugccuggagacagau

SEQ ID NO: 658517 - RNA, 21 nt, Homo sapiens
ucaaugcugggcccucuuauc

SEQ ID NO: 658518 - RNA, 17 nt, Homo sapiens
ucaauggaagaaaccac

SEQ ID NO: 658519 - RNA, 15 nt, Homo sapiens
ucaauggacuggaag

SEQ ID NO: 658520 - RNA, 21 nt, Homo sapiens
ucaauggagcaugugugcaaa

SEQ ID NO: 658521 - RNA, 14 nt, Homo sapiens
ucaauggauccaca

SEQ ID NO: 658522 - RNA, 14 nt, Homo sapiens
ucaauggauuugau

SEQ ID NO: 658523 - RNA, 21 nt, Homo sapiens
ucaaugggaaauacuacuccu

SEQ ID NO: 658524 - RNA, 20 nt, Homo sapiens
ucaaugggcucuuccaacaa

SEQ ID NO: 658525 - RNA, 13 nt, Homo sapiens
ucaauggugcaaa

SEQ ID NO: 658526 - RNA, 14 nt, Homo sapiens
ucaauggugcaaaa

SEQ ID NO: 658527 - RNA, 12 nt, Homo sapiens
ucaaugucuucc

SEQ ID NO: 658528 - RNA, 16 nt, Homo sapiens
ucaaugugaacacugg

SEQ ID NO: 658529 - RNA, 13 nt, Homo sapiens
ucaaugugcauaa

SEQ ID NO: 658530 - RNA, 13 nt, Homo sapiens
ucagcugcuucuc

SEQ ID NO: 658531 - RNA, 18 nt, Homo sapiens
ucagcuggucaaacaaac

SEQ ID NO: 658532 - RNA, 19 nt, Homo sapiens
ucagcugucaccugcucac

SEQ ID NO: 658533 - RNA, 13 nt, Homo sapiens
ucagcuuaucucu

SEQ ID NO: 658534 - RNA, 14 nt, Homo sapiens
ucaggaaacauuca

SEQ ID NO: 658535 - RNA, 15 nt, Homo sapiens
ucaggaaaccaaaua

SEQ ID NO: 658536 - RNA, 19 nt, Homo sapiens
ucaggaaauguuuucuuaa

SEQ ID NO: 658537 - RNA, 20 nt, Homo sapiens
ucaggaacuauggcaaggaa

SEQ ID NO: 658538 - RNA, 16 nt, Homo sapiens
ucaggaagaagagaug

SEQ ID NO: 658539 - RNA, 19 nt, Homo sapiens
ucaggaaucagaaaucaua

SEQ ID NO: 658540 - RNA, 16 nt, Homo sapiens
ucaggaccugggaccu

SEQ ID NO: 658541 - RNA, 23 nt, Homo sapiens
ucaggagaggggcagaacagccg

SEQ ID NO: 658542 - RNA, 18 nt, Homo sapiens
ucaggagaucgagaccau

SEQ ID NO: 658543 - RNA, 20 nt, Homo sapiens
ucaggagcuugggcagugcc

SEQ ID NO: 658544 - RNA, 13 nt, Homo sapiens
ucaggagucccaa

SEQ ID NO: 658545 - RNA, 16 nt, Homo sapiens
ucaggagucugccacu

SEQ ID NO: 658546 - RNA, 23 nt, Homo sapiens
ucaggaguuuugggaaugcacuu

SEQ ID NO: 658547 - RNA, 16 nt, Homo sapiens
ucaggaugaacccagg

SEQ ID NO: 658548 - RNA, 20 nt, Homo sapiens
ucaggaugauacacuaugaa

SEQ ID NO: 658549 - RNA, 14 nt, Homo sapiens
ucaggcacacagcu

SEQ ID NO: 658550 - RNA, 15 nt, Homo sapiens
ucaggcacacagcua

SEQ ID NO: 658551 - RNA, 17 nt, Homo sapiens
ucaggcacacagcuacu

SEQ ID NO: 658552 - RNA, 16 nt, Homo sapiens
ucaggcagcacaucaa

SEQ ID NO: 658553 - RNA, 21 nt, Homo sapiens
ucaggcagcaccacacugggu

SEQ ID NO: 658554 - RNA, 21 nt, Homo sapiens
ucaggcagguuugccagugaa

SEQ ID NO: 658555 - RNA, 18 nt, Homo sapiens
ucaggccaacaagccaac

SEQ ID NO: 658556 - RNA, 21 nt, Homo sapiens
ucaggccagccugucccugaa

SEQ ID NO: 658557 - RNA, 13 nt, Homo sapiens
ucaggccaggugg

SEQ ID NO: 658558 - RNA, 13 nt, Homo sapiens
ucaggcccaggca

SEQ ID NO: 658559 - RNA, 18 nt, Homo sapiens
ucaggccccacuccuucc

SEQ ID NO: 658560 - RNA, 17 nt, Homo sapiens
ucaggccuaggugcgca

SEQ ID NO: 658561 - RNA, 21 nt, Homo sapiens
ucaggccugggcaggacccug

SEQ ID NO: 658562 - RNA, 23 nt, Homo sapiens
ucaggcgauccaccugucucagc

SEQ ID NO: 658563 - RNA, 18 nt, Homo sapiens
ucaggcguuucugaagug

SEQ ID NO: 658564 - RNA, 13 nt, Homo sapiens
ucaggcucugaga

SEQ ID NO: 658565 - RNA, 22 nt, Homo sapiens
ucaggcucuguuccucaauggc

SEQ ID NO: 658566 - RNA, 13 nt, Homo sapiens
ucaggcugcugga

SEQ ID NO: 658567 - RNA, 19 nt, Homo sapiens
ucaggcuggagugcaguga

SEQ ID NO: 658568 - RNA, 14 nt, Homo sapiens
ucagggaccaagga

SEQ ID NO: 658569 - RNA, 20 nt, Homo sapiens
ucagggacucggguggccug

SEQ ID NO: 658570 - RNA, 19 nt, Homo sapiens
ucagggagaggucaccagc

SEQ ID NO: 658571 - RNA, 20 nt, Homo sapiens
ucagggagaggucaccagcu

SEQ ID NO: 658572 - RNA, 15 nt, Homo sapiens
ucagggagcauuuaa

SEQ ID NO: 658573 - RNA, 21 nt, Homo sapiens
ucagggagcucgcauucucuu

SEQ ID NO: 658574 - RNA, 17 nt, Homo sapiens
ucagggccaguccuccu

SEQ ID NO: 658575 - RNA, 16 nt, Homo sapiens
ucagggccaugccugc

SEQ ID NO: 658576 - RNA, 14 nt, Homo sapiens
ucagggcucagagu

SEQ ID NO: 658577 - RNA, 20 nt, Homo sapiens
ucaggggcggggagggugac

SEQ ID NO: 658578 - RNA, 15 nt, Homo sapiens
ucaggggugcauucu

SEQ ID NO: 658579 - RNA, 15 nt, Homo sapiens
ucagggucacugucc

SEQ ID NO: 658580 - RNA, 19 nt, Homo sapiens
ucagggucuaagcaccuug

SEQ ID NO: 658581 - RNA, 23 nt, Homo sapiens
ucagguaacagucguagauacca

SEQ ID NO: 658582 - RNA, 11 nt, Homo sapiens
ucaggucccau

SEQ ID NO: 658583 - RNA, 23 nt, Homo sapiens
ucagguccgugggccguaucugu

SEQ ID NO: 658584 - RNA, 19 nt, Homo sapiens
ucaggugaaaauccaucuc

SEQ ID NO: 658585 - RNA, 21 nt, Homo sapiens
ucagguggagagcacuagaag

SEQ ID NO: 658586 - RNA, 17 nt, Homo sapiens
ucagguguuacuagaag

SEQ ID NO: 658587 - RNA, 17 nt, Homo sapiens
ucagguuauauccaaua

SEQ ID NO: 658588 - RNA, 15 nt, Homo sapiens
ucagguucuucaggg

SEQ ID NO: 658589 - RNA, 16 nt, Homo sapiens
ucagguucuucagggc

SEQ ID NO: 658590 - RNA, 21 nt, Homo sapiens
ucagguuuguuuugugaauuu

SEQ ID NO: 658591 - RNA, 20 nt, Homo sapiens
ucaguaaaauuauacugugu

SEQ ID NO: 658592 - RNA, 16 nt, Homo sapiens
ucaguaaacaaaucag

SEQ ID NO: 658593 - RNA, 16 nt, Homo sapiens
ucaguaaauaccuuga

SEQ ID NO: 658594 - RNA, 16 nt, Homo sapiens
ucaguaaaugugauuc

SEQ ID NO: 658595 - RNA, 17 nt, Homo sapiens
ucaguacagcacuccug

SEQ ID NO: 658596 - RNA, 12 nt, Homo sapiens
ucaguaccccau

SEQ ID NO: 658597 - RNA, 14 nt, Homo sapiens
ucaguaccccaugg

SEQ ID NO: 658598 - RNA, 20 nt, Homo sapiens
ucaguacugacuuucugauu

SEQ ID NO: 658599 - RNA, 16 nt, Homo sapiens
ucaguagaccuaauga

SEQ ID NO: 658600 - RNA, 23 nt, Homo sapiens
ucaguagucacaaacugaucuaa

SEQ ID NO: 658601 - RNA, 12 nt, Homo sapiens
ucaguaguguac

SEQ ID NO: 658602 - RNA, 18 nt, Homo sapiens
ucaguaguucacauacaa

SEQ ID NO: 658603 - RNA, 23 nt, Homo sapiens
ucaguauaaauuaucuuaugaaa

SEQ ID NO: 658604 - RNA, 21 nt, Homo sapiens
ucaguauuaaauuagauaucu

SEQ ID NO: 658605 - RNA, 17 nt, Homo sapiens
ucaguauuauuucaaga

SEQ ID NO: 658606 - RNA, 14 nt, Homo sapiens
ucagucaacaacuu

SEQ ID NO: 658607 - RNA, 19 nt, Homo sapiens
ucagucaauagccauauca

SEQ ID NO: 658608 - RNA, 15 nt, Homo sapiens
ucagucacagccacc

SEQ ID NO: 658609 - RNA, 22 nt, Homo sapiens
ucagucacagccaccccugaga

SEQ ID NO: 658610 - RNA, 15 nt, Homo sapiens
ucaguccaugucucg

SEQ ID NO: 658611 - RNA, 15 nt, Homo sapiens
ucaguccuuugauca

SEQ ID NO: 658612 - RNA, 13 nt, Homo sapiens
ucagucucugagc

SEQ ID NO: 658613 - RNA, 19 nt, Homo sapiens
ucagucucugagcagugaa

SEQ ID NO: 658614 - RNA, 18 nt, Homo sapiens
ucagucuucugacuguca

SEQ ID NO: 658615 - RNA, 18 nt, Homo sapiens
ucagucuuggugguucua

SEQ ID NO: 658616 - RNA, 20 nt, Homo sapiens
ucagugaaaaagauguacag

SEQ ID NO: 658617 - RNA, 20 nt, Homo sapiens
ucagugaaagccagauucaa

SEQ ID NO: 658618 - RNA, 16 nt, Homo sapiens
ucagugaagacuauga

SEQ ID NO: 658619 - RNA, 12 nt, Homo sapiens
ucagugaaggac

SEQ ID NO: 658620 - RNA, 19 nt, Homo sapiens
ucagugaagucuagaauca

SEQ ID NO: 658621 - RNA, 13 nt, Homo sapiens
ucagugaauuugu

SEQ ID NO: 658622 - RNA, 16 nt, Homo sapiens
ucagugaauuugucca

SEQ ID NO: 658623 - RNA, 22 nt, Homo sapiens
ucagugacagaguucacuauaa

SEQ ID NO: 658624 - RNA, 11 nt, Homo sapiens
ucagugcugcc

SEQ ID NO: 658625 - RNA, 15 nt, Homo sapiens
ucaguggaucuucag

SEQ ID NO: 658626 - RNA, 15 nt, Homo sapiens
ucaguggcuuugcau

SEQ ID NO: 658627 - RNA, 16 nt, Homo sapiens
ucagugguuacucaag

SEQ ID NO: 658628 - RNA, 18 nt, Homo sapiens
ucagugguuucuacuucc

SEQ ID NO: 658629 - RNA, 15 nt, Homo sapiens
ucaguguacauggaa

SEQ ID NO: 658630 - RNA, 17 nt, Homo sapiens
ucagugucugccuuuaa

SEQ ID NO: 658631 - RNA, 15 nt, Homo sapiens
ucaguguuugggaaa

SEQ ID NO: 658632 - RNA, 20 nt, Homo sapiens
ucaguucccagacagcuuuu

SEQ ID NO: 658633 - RNA, 21 nt, Homo sapiens
ucaguugauauaaaacucugg

SEQ ID NO: 658634 - RNA, 22 nt, Homo sapiens
ucaguugggagugguugcuaua

SEQ ID NO: 658635 - RNA, 13 nt, Homo sapiens
ucaguuggugcug

SEQ ID NO: 658636 - RNA, 16 nt, Homo sapiens
ucaguuggugcugcuu

SEQ ID NO: 658637 - RNA, 19 nt, Homo sapiens
ucaguuguuuaauaauuua

SEQ ID NO: 658638 - RNA, 24 nt, Homo sapiens
ucaguuguuuguuuuugcuuguua

SEQ ID NO: 658639 - RNA, 16 nt, Homo sapiens
ucaguuucacuuucac

SEQ ID NO: 658640 - RNA, 17 nt, Homo sapiens
ucaguuucuaggcaccu

SEQ ID NO: 658641 - RNA, 15 nt, Homo sapiens
ucaguuuuuacugag

SEQ ID NO: 658642 - RNA, 19 nt, Homo sapiens
ucaguuuuuuuuuuuccag

SEQ ID NO: 658643 - RNA, 22 nt, Homo sapiens
ucauaaaaauacaacagugcau

SEQ ID NO: 658644 - RNA, 22 nt, Homo sapiens
ucauaaacaggcugacuggcag

SEQ ID NO: 658645 - RNA, 16 nt, Homo sapiens
ucauaaagaaaugcaa

SEQ ID NO: 658646 - RNA, 17 nt, Homo sapiens
ucauaaaucuucuuauu

SEQ ID NO: 658647 - RNA, 20 nt, Homo sapiens
ucauaaaugaagcagcuuua

SEQ ID NO: 658648 - RNA, 14 nt, Homo sapiens
ucauaacccaugaa

SEQ ID NO: 658649 - RNA, 15 nt, Homo sapiens
ucauaagacacuuag

SEQ ID NO: 658650 - RNA, 23 nt, Homo sapiens
ucauaagccuaccaauguagaca

SEQ ID NO: 658651 - RNA, 21 nt, Homo sapiens
ucauaaucacucuaauuaauu

SEQ ID NO: 658652 - RNA, 13 nt, Homo sapiens
uccaggacuguuu

SEQ ID NO: 658653 - RNA, 20 nt, Homo sapiens
uccaggaugaguuacuugaa

SEQ ID NO: 658654 - RNA, 12 nt, Homo sapiens
uccaggccagug

SEQ ID NO: 658655 - RNA, 23 nt, Homo sapiens
uccaggccaugauggccuuacac

SEQ ID NO: 658656 - RNA, 20 nt, Homo sapiens
uccaggcgaugugcaagugu

SEQ ID NO: 658657 - RNA, 23 nt, Homo sapiens
uccaggcuugccucaaguuccau

SEQ ID NO: 658658 - RNA, 16 nt, Homo sapiens
uccagggacacacagc

SEQ ID NO: 658659 - RNA, 17 nt, Homo sapiens
uccagggccccccaaau

SEQ ID NO: 658660 - RNA, 21 nt, Homo sapiens
uccagggcuccaaaucugccu

SEQ ID NO: 658661 - RNA, 12 nt, Homo sapiens
uccaggggucuu

SEQ ID NO: 658662 - RNA, 18 nt, Homo sapiens
uccagggucccucugugu

SEQ ID NO: 658663 - RNA, 16 nt, Homo sapiens
uccaggucuugacuca

SEQ ID NO: 658664 - RNA, 17 nt, Homo sapiens
uccaggugaggcccaag

SEQ ID NO: 658665 - RNA, 21 nt, Homo sapiens
uccagguggagacccugagaa

SEQ ID NO: 658666 - RNA, 17 nt, Homo sapiens
uccagguguuacuguaa

SEQ ID NO: 658667 - RNA, 21 nt, Homo sapiens
uccagguuauugcaauaaagu

SEQ ID NO: 658668 - RNA, 20 nt, Homo sapiens
uccaguaaucugagcagucu

SEQ ID NO: 658669 - RNA, 15 nt, Homo sapiens
uccaguacaguauuc

SEQ ID NO: 658670 - RNA, 16 nt, Homo sapiens
uccaguacaguauucu

SEQ ID NO: 658671 - RNA, 14 nt, Homo sapiens
uccaguacugggag

SEQ ID NO: 658672 - RNA, 20 nt, Homo sapiens
uccaguagugggaucaucca

SEQ ID NO: 658673 - RNA, 17 nt, Homo sapiens
uccaguauucuugucaa

SEQ ID NO: 658674 - RNA, 18 nt, Homo sapiens
uccagucaacaucgugga

SEQ ID NO: 658675 - RNA, 16 nt, Homo sapiens
uccagucccaugaccu

SEQ ID NO: 658676 - RNA, 22 nt, Homo sapiens
uccagucuuccgacaaacuaac

SEQ ID NO: 658677 - RNA, 15 nt, Homo sapiens
uccagugagcacuag

SEQ ID NO: 658678 - RNA, 18 nt, Homo sapiens
uccagugaggaacccuga

SEQ ID NO: 658679 - RNA, 14 nt, Homo sapiens
uccagugcaauugu

SEQ ID NO: 658680 - RNA, 13 nt, Homo sapiens
uccagugcaggag

SEQ ID NO: 658681 - RNA, 13 nt, Homo sapiens
uccagugugccag

SEQ ID NO: 658682 - RNA, 20 nt, Homo sapiens
uccaguguugccuccuccca

SEQ ID NO: 658683 - RNA, 13 nt, Homo sapiens
uccaguguuuaca

SEQ ID NO: 658684 - RNA, 14 nt, Homo sapiens
uccaguuaacauca

SEQ ID NO: 658685 - RNA, 15 nt, Homo sapiens
uccaguucaugagaa

SEQ ID NO: 658686 - RNA, 20 nt, Homo sapiens
uccaguuuaaugaacuacca

SEQ ID NO: 658687 - RNA, 15 nt, Homo sapiens
uccaguuuucuccuc

SEQ ID NO: 658688 - RNA, 16 nt, Homo sapiens
uccaguuuuggaucuu

SEQ ID NO: 658689 - RNA, 16 nt, Homo sapiens
uccauaaacaugaaaa

SEQ ID NO: 658690 - RNA, 21 nt, Homo sapiens
uccauaaacaugaaaacacuu

SEQ ID NO: 658691 - RNA, 19 nt, Homo sapiens
uccauaaagguaacaaagg

SEQ ID NO: 658692 - RNA, 16 nt, Homo sapiens
uccauaaauguguucc

SEQ ID NO: 658693 - RNA, 13 nt, Homo sapiens
uccauagugcacu

SEQ ID NO: 658694 - RNA, 14 nt, Homo sapiens
uccauagugcacua

SEQ ID NO: 658695 - RNA, 18 nt, Homo sapiens
uccauagugcacuagcau

SEQ ID NO: 658696 - RNA, 21 nt, Homo sapiens
uccauaguggaccacuuggaa

SEQ ID NO: 658697 - RNA, 18 nt, Homo sapiens
uccauauaacaauucagu

SEQ ID NO: 658698 - RNA, 16 nt, Homo sapiens
uccauauucuguauua

SEQ ID NO: 658699 - RNA, 17 nt, Homo sapiens
uccauauuuaacaugua

SEQ ID NO: 658700 - RNA, 18 nt, Homo sapiens
uccaucaauggugagcac

SEQ ID NO: 658701 - RNA, 11 nt, Homo sapiens
uccaucaccug

SEQ ID NO: 658702 - RNA, 18 nt, Homo sapiens
uccaucacguuagcuguc

SEQ ID NO: 658703 - RNA, 14 nt, Homo sapiens
uccaucagaugugu

SEQ ID NO: 658704 - RNA, 17 nt, Homo sapiens
uccaucagcuguaagaa

SEQ ID NO: 658705 - RNA, 14 nt, Homo sapiens
uccaucaguauuaa

SEQ ID NO: 658706 - RNA, 20 nt, Homo sapiens
uccaucagugaaaacauuuc

SEQ ID NO: 658707 - RNA, 15 nt, Homo sapiens
uccaucaucacugua

SEQ ID NO: 658708 - RNA, 15 nt, Homo sapiens
uccaucaugucugua

SEQ ID NO: 658709 - RNA, 14 nt, Homo sapiens
uccaucccuacccc

SEQ ID NO: 658710 - RNA, 21 nt, Homo sapiens
uccauccgguggccuauucca

SEQ ID NO: 658711 - RNA, 20 nt, Homo sapiens
uccauccugggugacagcaa

SEQ ID NO: 658712 - RNA, 20 nt, Homo sapiens
uccauccugucaccaugacu

SEQ ID NO: 658713 - RNA, 20 nt, Homo sapiens
uccauccuuuacguguuuaa

SEQ ID NO: 658714 - RNA, 15 nt, Homo sapiens
uccaucguccauccu

SEQ ID NO: 658715 - RNA, 17 nt, Homo sapiens
uccaucguccauccucu

SEQ ID NO: 658716 - RNA, 21 nt, Homo sapiens
uccaucucucauccuccagua

SEQ ID NO: 658717 - RNA, 16 nt, Homo sapiens
uccaucucugacuuaa

SEQ ID NO: 658718 - RNA, 12 nt, Homo sapiens
uccaucugaccg

SEQ ID NO: 658719 - RNA, 20 nt, Homo sapiens
uccaucuguacccuuuucca

SEQ ID NO: 658720 - RNA, 21 nt, Homo sapiens
uccaugaacaucauggacuga

SEQ ID NO: 658721 - RNA, 15 nt, Homo sapiens
uccaugaagcacuga

SEQ ID NO: 658722 - RNA, 16 nt, Homo sapiens
uccaugaagcacugag

SEQ ID NO: 658723 - RNA, 18 nt, Homo sapiens
uccaugaauuaguucucc

SEQ ID NO: 658724 - RNA, 23 nt, Homo sapiens
uccaugccuuuaauguugcccac

SEQ ID NO: 658725 - RNA, 15 nt, Homo sapiens
uccaugcucuugacc

SEQ ID NO: 658726 - RNA, 12 nt, Homo sapiens
uccaugcugcaa

SEQ ID NO: 658727 - RNA, 13 nt, Homo sapiens
uccaugcugccag

SEQ ID NO: 658728 - RNA, 16 nt, Homo sapiens
uccaugcugccuccag

SEQ ID NO: 658729 - RNA, 11 nt, Homo sapiens
uccaugcugug

SEQ ID NO: 658730 - RNA, 15 nt, Homo sapiens
uccauggcaaauggg

SEQ ID NO: 658731 - RNA, 23 nt, Homo sapiens
uccaugguccugucuguccuucu

SEQ ID NO: 658732 - RNA, 23 nt, Homo sapiens
uccaugguggaaguuaaagggca

SEQ ID NO: 658733 - RNA, 18 nt, Homo sapiens
uccauguaaauugcaaau

SEQ ID NO: 658734 - RNA, 23 nt, Homo sapiens
uccauguaggaaaguaaaaugga

SEQ ID NO: 658735 - RNA, 13 nt, Homo sapiens
uccaugugcauau

SEQ ID NO: 658736 - RNA, 22 nt, Homo sapiens
uccauguguaagaacaaugcca

SEQ ID NO: 658737 - RNA, 18 nt, Homo sapiens
uccaugugugugcaagug

SEQ ID NO: 658738 - RNA, 15 nt, Homo sapiens
uccauguugcugcca

SEQ ID NO: 658739 - RNA, 16 nt, Homo sapiens
uccauguuugcaaugc

SEQ ID NO: 658740 - RNA, 15 nt, Homo sapiens
uccauguuuguaaaa

SEQ ID NO: 658741 - RNA, 17 nt, Homo sapiens
uccauuacuugccaggg

SEQ ID NO: 658742 - RNA, 16 nt, Homo sapiens
uccauucacaccagcu

SEQ ID NO: 658743 - RNA, 17 nt, Homo sapiens
uccauucacaccagcua

SEQ ID NO: 658744 - RNA, 16 nt, Homo sapiens
uccauucagaugaaua

SEQ ID NO: 658745 - RNA, 16 nt, Homo sapiens
uccauucuuccuccca

SEQ ID NO: 658746 - RNA, 16 nt, Homo sapiens
uccauugccuagcucu

SEQ ID NO: 658747 - RNA, 16 nt, Homo sapiens
uccauugcucuugagu

SEQ ID NO: 658748 - RNA, 15 nt, Homo sapiens
uccauuuaagcaauu

SEQ ID NO: 658749 - RNA, 18 nt, Homo sapiens
uccauuuacagcccucag

SEQ ID NO: 658750 - RNA, 19 nt, Homo sapiens
uccauuucccacaucuuuc

SEQ ID NO: 658751 - RNA, 18 nt, Homo sapiens
uccauuuccuaauguaua

SEQ ID NO: 658752 - RNA, 23 nt, Homo sapiens
uccauuucuuuuacucuguguaa

SEQ ID NO: 658753 - RNA, 19 nt, Homo sapiens
uccauuuugugaauuguga

SEQ ID NO: 658754 - RNA, 22 nt, Homo sapiens
uccauuuugugaauugugacau

SEQ ID NO: 658755 - RNA, 21 nt, Homo sapiens
uccauuuuuaaccacuugccu

SEQ ID NO: 658756 - RNA, 21 nt, Homo sapiens
uccauuuuuccucuguucaca

SEQ ID NO: 658757 - RNA, 20 nt, Homo sapiens
ucccaaaagauugcugaaaa

SEQ ID NO: 658758 - RNA, 15 nt, Homo sapiens
ucccaaacuacagaa

SEQ ID NO: 658759 - RNA, 15 nt, Homo sapiens
ucccaaagcaucccu

SEQ ID NO: 658760 - RNA, 13 nt, Homo sapiens
ucccaaagccaga

SEQ ID NO: 658761 - RNA, 19 nt, Homo sapiens
ucccaaagugcugagauua

SEQ ID NO: 658762 - RNA, 20 nt, Homo sapiens
ucccaaagugcugagauuac

SEQ ID NO: 658763 - RNA, 18 nt, Homo sapiens
ucccaaauaaacuccaga

SEQ ID NO: 658764 - RNA, 23 nt, Homo sapiens
ucccaaaucaauaagaagguaga

SEQ ID NO: 658765 - RNA, 19 nt, Homo sapiens
ucccaaaugagccaugaga

SEQ ID NO: 658766 - RNA, 14 nt, Homo sapiens
ucccaacccauuca

SEQ ID NO: 658767 - RNA, 22 nt, Homo sapiens
ucccaacccauucacuacaggu

SEQ ID NO: 658768 - RNA, 17 nt, Homo sapiens
ucccaacucuugcacag

SEQ ID NO: 658769 - RNA, 21 nt, Homo sapiens
ucccaacuuguauuaaagaca

SEQ ID NO: 658770 - RNA, 20 nt, Homo sapiens
ucccaaguaacugggauuac

SEQ ID NO: 658771 - RNA, 20 nt, Homo sapiens
ucccaaguacccugagauac

SEQ ID NO: 658772 - RNA, 20 nt, Homo sapiens
ucccaaguagcugggauuac

SEQ ID NO: 658773 - RNA, 16 nt, Homo sapiens
ucccaaguaugccuua

SEQ ID NO: 658774 - RNA, 12 nt, Homo sapiens
uccucuguucac

SEQ ID NO: 658775 - RNA, 15 nt, Homo sapiens
uccucuucuucauug

SEQ ID NO: 658776 - RNA, 21 nt, Homo sapiens
uccucuuggagaaaauaacaa

SEQ ID NO: 658777 - RNA, 20 nt, Homo sapiens
uccucuugguaaucuuccau

SEQ ID NO: 658778 - RNA, 19 nt, Homo sapiens
uccugaaaaggguguugcu

SEQ ID NO: 658779 - RNA, 22 nt, Homo sapiens
uccugaaaucaagucaucuaua

SEQ ID NO: 658780 - RNA, 14 nt, Homo sapiens
uccugaacuuucuc

SEQ ID NO: 658781 - RNA, 22 nt, Homo sapiens
uccugaagcccagcgacacaga

SEQ ID NO: 658782 - RNA, 14 nt, Homo sapiens
uccugaagccucug

SEQ ID NO: 658783 - RNA, 17 nt, Homo sapiens
uccugaaguugcugcug

SEQ ID NO: 658784 - RNA, 13 nt, Homo sapiens
uccugaaucugau

SEQ ID NO: 658785 - RNA, 14 nt, Homo sapiens
uccugaaugcaucc

SEQ ID NO: 658786 - RNA, 19 nt, Homo sapiens
uccugacagaaggugccac

SEQ ID NO: 658787 - RNA, 23 nt, Homo sapiens
uccugaccccucuccucaaggga

SEQ ID NO: 658788 - RNA, 18 nt, Homo sapiens
uccugaccucaagugauc

SEQ ID NO: 658789 - RNA, 15 nt, Homo sapiens
uccugaccucaggug

SEQ ID NO: 658790 - RNA, 17 nt, Homo sapiens
uccugagaagcauguaa

SEQ ID NO: 658791 - RNA, 14 nt, Homo sapiens
uccugagacuuuuc

SEQ ID NO: 658792 - RNA, 20 nt, Homo sapiens
uccugagcagugccagcuuu

SEQ ID NO: 658793 - RNA, 16 nt, Homo sapiens
uccugaggagcccuga

SEQ ID NO: 658794 - RNA, 23 nt, Homo sapiens
uccugaggcuuuggauuugacau

SEQ ID NO: 658795 - RNA, 19 nt, Homo sapiens
uccugaguagcuggauuac

SEQ ID NO: 658796 - RNA, 17 nt, Homo sapiens
uccugaguagcugggau

SEQ ID NO: 658797 - RNA, 20 nt, Homo sapiens
uccugaucgccaaccuuucc

SEQ ID NO: 658798 - RNA, 19 nt, Homo sapiens
uccugauggagugugcaga

SEQ ID NO: 658799 - RNA, 15 nt, Homo sapiens
uccugauuccuuuaa

SEQ ID NO: 658800 - RNA, 16 nt, Homo sapiens
uccugcaacucaagga

SEQ ID NO: 658801 - RNA, 19 nt, Homo sapiens
uccugcagcaaacacucca

SEQ ID NO: 658802 - RNA, 18 nt, Homo sapiens
uccugcagccccagaaga

SEQ ID NO: 658803 - RNA, 20 nt, Homo sapiens
uccugcagccccagcccagc

SEQ ID NO: 658804 - RNA, 18 nt, Homo sapiens
uccugcauagucuguucc

SEQ ID NO: 658805 - RNA, 14 nt, Homo sapiens
uccugccacaugga

SEQ ID NO: 658806 - RNA, 19 nt, Homo sapiens
uccugccaccagucacugu

SEQ ID NO: 658807 - RNA, 17 nt, Homo sapiens
uccugccaguguggaac

SEQ ID NO: 658808 - RNA, 14 nt, Homo sapiens
uccugccaguugaa

SEQ ID NO: 658809 - RNA, 19 nt, Homo sapiens
uccugccauggaucucuug

SEQ ID NO: 658810 - RNA, 17 nt, Homo sapiens
uccugcccaagcacuuc

SEQ ID NO: 658811 - RNA, 22 nt, Homo sapiens
uccugcccugcccccucggggg

SEQ ID NO: 658812 - RNA, 19 nt, Homo sapiens
uccugcccuuccugaagaa

SEQ ID NO: 658813 - RNA, 17 nt, Homo sapiens
uccugccgcaacaguuu

SEQ ID NO: 658814 - RNA, 17 nt, Homo sapiens
uccugccucuuguuucu

SEQ ID NO: 658815 - RNA, 19 nt, Homo sapiens
uccugccugugcugugacu

SEQ ID NO: 658816 - RNA, 18 nt, Homo sapiens
uccugccuuuaagccaaa

SEQ ID NO: 658817 - RNA, 22 nt, Homo sapiens
uccugcggcucagccuugcaca

SEQ ID NO: 658818 - RNA, 22 nt, Homo sapiens
uccugcuacaacuucagcagua

SEQ ID NO: 658819 - RNA, 14 nt, Homo sapiens
uccugcuacuuaaa

SEQ ID NO: 658820 - RNA, 15 nt, Homo sapiens
uccugcuccaugacu

SEQ ID NO: 658821 - RNA, 19 nt, Homo sapiens
uccugcucuuuugugauga

SEQ ID NO: 658822 - RNA, 17 nt, Homo sapiens
uccugcugcuucugcaa

SEQ ID NO: 658823 - RNA, 12 nt, Homo sapiens
uccuggaaccaa

SEQ ID NO: 658824 - RNA, 23 nt, Homo sapiens
uccuggaaccaaucccgugaaag

SEQ ID NO: 658825 - RNA, 16 nt, Homo sapiens
uccuggaaccugucuc

SEQ ID NO: 658826 - RNA, 22 nt, Homo sapiens
uccuggaagaacaaaucuacca

SEQ ID NO: 658827 - RNA, 16 nt, Homo sapiens
uccuggacaaccugga

SEQ ID NO: 658828 - RNA, 20 nt, Homo sapiens
uccuggaccuugacagagca

SEQ ID NO: 658829 - RNA, 13 nt, Homo sapiens
uccuggaggacca

SEQ ID NO: 658830 - RNA, 15 nt, Homo sapiens
uccuggaggcacugg

SEQ ID NO: 658831 - RNA, 23 nt, Homo sapiens
uccuggaggcugccugcugugcu

SEQ ID NO: 658832 - RNA, 19 nt, Homo sapiens
uccuggcaaucaauacagc

SEQ ID NO: 658833 - RNA, 23 nt, Homo sapiens
uccuggcaucaguagcaucugua

SEQ ID NO: 658834 - RNA, 18 nt, Homo sapiens
uccuggcaugacacucua

SEQ ID NO: 658835 - RNA, 17 nt, Homo sapiens
uccuggcccgcccucac

SEQ ID NO: 658836 - RNA, 20 nt, Homo sapiens
uccuggccuugugucacugg

SEQ ID NO: 658837 - RNA, 19 nt, Homo sapiens
uccuggcuaacacggugaa

SEQ ID NO: 658838 - RNA, 14 nt, Homo sapiens
uccuggcugagaga

SEQ ID NO: 658839 - RNA, 12 nt, Homo sapiens
uccuggcugugc

SEQ ID NO: 658840 - RNA, 18 nt, Homo sapiens
uccugggagaaccucagg

SEQ ID NO: 658841 - RNA, 14 nt, Homo sapiens
uccugggaggacag

SEQ ID NO: 658842 - RNA, 19 nt, Homo sapiens
uccugggcacgcacugggu

SEQ ID NO: 658843 - RNA, 21 nt, Homo sapiens
uccugggcauggguccagggc

SEQ ID NO: 658844 - RNA, 17 nt, Homo sapiens
uccugggccuccugaca

SEQ ID NO: 658845 - RNA, 18 nt, Homo sapiens
uccuggggcagcacuccc

SEQ ID NO: 658846 - RNA, 18 nt, Homo sapiens
uccuggguggacuuuuga

SEQ ID NO: 658847 - RNA, 22 nt, Homo sapiens
uccuggucugaacucccgccac

SEQ ID NO: 658848 - RNA, 17 nt, Homo sapiens
uccugguggauacugua

SEQ ID NO: 658849 - RNA, 16 nt, Homo sapiens
uccugguuugacucag

SEQ ID NO: 658850 - RNA, 17 nt, Homo sapiens
uccugucaccaugacuu

SEQ ID NO: 658851 - RNA, 16 nt, Homo sapiens
uccugucagaugacac

SEQ ID NO: 658852 - RNA, 11 nt, Homo sapiens
uccugucauau

SEQ ID NO: 658853 - RNA, 19 nt, Homo sapiens
uccugucccuguagcucag

SEQ ID NO: 658854 - RNA, 15 nt, Homo sapiens
uccuguccuuuacac

SEQ ID NO: 658855 - RNA, 13 nt, Homo sapiens
uccugucugccag

SEQ ID NO: 658856 - RNA, 21 nt, Homo sapiens
uccugucuuaugguccagaaa

SEQ ID NO: 658857 - RNA, 16 nt, Homo sapiens
uccugugaaaauauga

SEQ ID NO: 658858 - RNA, 18 nt, Homo sapiens
uccugugacauguaacag

SEQ ID NO: 658859 - RNA, 16 nt, Homo sapiens
uccugugauacauuuc

SEQ ID NO: 658860 - RNA, 11 nt, Homo sapiens
uccugugcaac

SEQ ID NO: 658861 - RNA, 13 nt, Homo sapiens
uccugugcuggaa

SEQ ID NO: 658862 - RNA, 18 nt, Homo sapiens
uccugugcuugcuuagag

SEQ ID NO: 658863 - RNA, 16 nt, Homo sapiens
uccugugcuuucugca

SEQ ID NO: 658864 - RNA, 15 nt, Homo sapiens
uccuguguaacacuu

SEQ ID NO: 658865 - RNA, 23 nt, Homo sapiens
uccuguguccccugaccugucca

SEQ ID NO: 658866 - RNA, 14 nt, Homo sapiens
uccuguguccugaa

SEQ ID NO: 658867 - RNA, 17 nt, Homo sapiens
uccuguguguacucugu

SEQ ID NO: 658868 - RNA, 22 nt, Homo sapiens
uccugugugucgcuuaugucua

SEQ ID NO: 658869 - RNA, 14 nt, Homo sapiens
uccuguucagugag

SEQ ID NO: 658870 - RNA, 16 nt, Homo sapiens
uccuguuucuccuuag

SEQ ID NO: 658871 - RNA, 21 nt, Homo sapiens
uccuguuuuucacauuuuccu

SEQ ID NO: 658872 - RNA, 15 nt, Homo sapiens
uccuuaaaguuuucc

SEQ ID NO: 658873 - RNA, 18 nt, Homo sapiens
uccuuaaauuuuuagcca

SEQ ID NO: 658874 - RNA, 18 nt, Homo sapiens
uccuuaacgcuagagauu

SEQ ID NO: 658875 - RNA, 14 nt, Homo sapiens
uccuuaagggacaa

SEQ ID NO: 658876 - RNA, 19 nt, Homo sapiens
uccuuaauagccauaugca

SEQ ID NO: 658877 - RNA, 21 nt, Homo sapiens
uccuuacuguuuacaguuuag

SEQ ID NO: 658878 - RNA, 12 nt, Homo sapiens
uccuuacuugca

SEQ ID NO: 658879 - RNA, 13 nt, Homo sapiens
uccuuacuugcac

SEQ ID NO: 658880 - RNA, 16 nt, Homo sapiens
uccuuagagacaucaa

SEQ ID NO: 658881 - RNA, 19 nt, Homo sapiens
uccuuagcuuagaccucag

SEQ ID NO: 658882 - RNA, 15 nt, Homo sapiens
uccuuaggaaaaaca

SEQ ID NO: 658883 - RNA, 19 nt, Homo sapiens
uccuuagucucaagggcua

SEQ ID NO: 658884 - RNA, 15 nt, Homo sapiens
uccuuaucugucaca

SEQ ID NO: 658885 - RNA, 13 nt, Homo sapiens
uccuuauguuaag

SEQ ID NO: 658886 - RNA, 14 nt, Homo sapiens
uccuucaaacaaug

SEQ ID NO: 658887 - RNA, 20 nt, Homo sapiens
uccuucaacuggcuacugag

SEQ ID NO: 658888 - RNA, 14 nt, Homo sapiens
uccuucaaugcaaa

SEQ ID NO: 658889 - RNA, 22 nt, Homo sapiens
uccuucacaggcagugcaugug

SEQ ID NO: 658890 - RNA, 18 nt, Homo sapiens
uccuucaugaucaucaca

SEQ ID NO: 658891 - RNA, 18 nt, Homo sapiens
uccuuccacaaugacugc

SEQ ID NO: 658892 - RNA, 16 nt, Homo sapiens
uccuuccacauguaca

SEQ ID NO: 658893 - RNA, 18 nt, Homo sapiens
uccuuccaguguccuuag

SEQ ID NO: 658894 - RNA, 16 nt, Homo sapiens
uccuuccaucccuacc

SEQ ID NO: 658895 - RNA, 22 nt, Homo sapiens
uccuucccacccccaguccugu

SEQ ID NO: 658896 - RNA, 15 nt, Homo sapiens
ugacauuauaugcac

SEQ ID NO: 658897 - RNA, 20 nt, Homo sapiens
ugacauuuaucaccucugau

SEQ ID NO: 658898 - RNA, 22 nt, Homo sapiens
ugacauuuaugucucauguaau

SEQ ID NO: 658899 - RNA, 10 nt, Homo sapiens
ugaccaaaua

SEQ ID NO: 658900 - RNA, 20 nt, Homo sapiens
ugaccaacgcacaacaggaa

SEQ ID NO: 658901 - RNA, 16 nt, Homo sapiens
ugaccaagaacugcau

SEQ ID NO: 658902 - RNA, 16 nt, Homo sapiens
ugaccaaugggaugag

SEQ ID NO: 658903 - RNA, 16 nt, Homo sapiens
ugaccacaccuuggcc

SEQ ID NO: 658904 - RNA, 10 nt, Homo sapiens
ugaccacaga

SEQ ID NO: 658905 - RNA, 19 nt, Homo sapiens
ugaccaccgauuccagcug

SEQ ID NO: 658906 - RNA, 22 nt, Homo sapiens
ugaccacucuucuuuaagccau

SEQ ID NO: 658907 - RNA, 21 nt, Homo sapiens
ugaccacugaagcaccacagg

SEQ ID NO: 658908 - RNA, 13 nt, Homo sapiens
ugaccagaagccu

SEQ ID NO: 658909 - RNA, 13 nt, Homo sapiens
ugaccaucuccca

SEQ ID NO: 658910 - RNA, 12 nt, Homo sapiens
ugaccauggcac

SEQ ID NO: 658911 - RNA, 13 nt, Homo sapiens
ugacccaaagacc

SEQ ID NO: 658912 - RNA, 17 nt, Homo sapiens
ugacccagcaucuccca

SEQ ID NO: 658913 - RNA, 18 nt, Homo sapiens
ugaccccagaaacugaac

SEQ ID NO: 658914 - RNA, 15 nt, Homo sapiens
ugaccccaugucucc

SEQ ID NO: 658915 - RNA, 17 nt, Homo sapiens
ugaccccuccccagugc

SEQ ID NO: 658916 - RNA, 21 nt, Homo sapiens
ugaccccuucccuguccuugc

SEQ ID NO: 658917 - RNA, 14 nt, Homo sapiens
ugaccccuuguccc

SEQ ID NO: 658918 - RNA, 18 nt, Homo sapiens
ugacccucuccccacugc

SEQ ID NO: 658919 - RNA, 20 nt, Homo sapiens
ugacccucugacccuagcuc

SEQ ID NO: 658920 - RNA, 18 nt, Homo sapiens
ugacccugauacaggcau

SEQ ID NO: 658921 - RNA, 18 nt, Homo sapiens
ugacccuugugucucaua

SEQ ID NO: 658922 - RNA, 13 nt, Homo sapiens
ugacccuuuucau

SEQ ID NO: 658923 - RNA, 17 nt, Homo sapiens
ugaccgagaacuuuuaa

SEQ ID NO: 658924 - RNA, 14 nt, Homo sapiens
ugaccuaaauuauu

SEQ ID NO: 658925 - RNA, 14 nt, Homo sapiens
ugaccucagcugca

SEQ ID NO: 658926 - RNA, 18 nt, Homo sapiens
ugaccucauuuguaaaau

SEQ ID NO: 658927 - RNA, 16 nt, Homo sapiens
ugaccuccauuuccca

SEQ ID NO: 658928 - RNA, 14 nt, Homo sapiens
ugaccucugcugag

SEQ ID NO: 658929 - RNA, 13 nt, Homo sapiens
ugaccucugugac

SEQ ID NO: 658930 - RNA, 13 nt, Homo sapiens
ugaccucuugcug

SEQ ID NO: 658931 - RNA, 21 nt, Homo sapiens
ugaccucuugcugucucugcu

SEQ ID NO: 658932 - RNA, 19 nt, Homo sapiens
ugaccuggaaucagugaag

SEQ ID NO: 658933 - RNA, 14 nt, Homo sapiens
ugaccugugaccag

SEQ ID NO: 658934 - RNA, 16 nt, Homo sapiens
ugaccuguuauuacca

SEQ ID NO: 658935 - RNA, 19 nt, Homo sapiens
ugaccuugggguacaauug

SEQ ID NO: 658936 - RNA, 21 nt, Homo sapiens
ugaccuuugucuucuauaaua

SEQ ID NO: 658937 - RNA, 16 nt, Homo sapiens
ugaccuuuuugcagug

SEQ ID NO: 658938 - RNA, 22 nt, Homo sapiens
ugacgacaagugcugaacagug

SEQ ID NO: 658939 - RNA, 16 nt, Homo sapiens
ugacgacagugcauuu

SEQ ID NO: 658940 - RNA, 14 nt, Homo sapiens
ugacgcacugcuca

SEQ ID NO: 658941 - RNA, 23 nt, Homo sapiens
ugacgccugauggugcugcucag

SEQ ID NO: 658942 - RNA, 18 nt, Homo sapiens
ugacgcggcucaaaagga

SEQ ID NO: 658943 - RNA, 14 nt, Homo sapiens
ugacgcuugcuuag

SEQ ID NO: 658944 - RNA, 20 nt, Homo sapiens
ugacgcuugugacagugccu

SEQ ID NO: 658945 - RNA, 18 nt, Homo sapiens
ugacggcgcccccagugu

SEQ ID NO: 658946 - RNA, 12 nt, Homo sapiens
ugacggugucca

SEQ ID NO: 658947 - RNA, 20 nt, Homo sapiens
ugacgguguccaugccuucc

SEQ ID NO: 658948 - RNA, 22 nt, Homo sapiens
ugacgugccuuuugcaccccuc

SEQ ID NO: 658949 - RNA, 20 nt, Homo sapiens
ugacguguaaaugcugguau

SEQ ID NO: 658950 - RNA, 16 nt, Homo sapiens
ugacguuguugucauu

SEQ ID NO: 658951 - RNA, 16 nt, Homo sapiens
ugacguuuacauauau

SEQ ID NO: 658952 - RNA, 22 nt, Homo sapiens
ugacuaaacaacuaccuccuca

SEQ ID NO: 658953 - RNA, 19 nt, Homo sapiens
ugacuaaagcuauguuaca

SEQ ID NO: 658954 - RNA, 15 nt, Homo sapiens
ugacuaagagucucc

SEQ ID NO: 658955 - RNA, 15 nt, Homo sapiens
ugacuaaucagauga

SEQ ID NO: 658956 - RNA, 22 nt, Homo sapiens
ugacuaugggagucaacucaac

SEQ ID NO: 658957 - RNA, 16 nt, Homo sapiens
ugacucaagaagugaa

SEQ ID NO: 658958 - RNA, 23 nt, Homo sapiens
ugacucacaagaagaccagacug

SEQ ID NO: 658959 - RNA, 22 nt, Homo sapiens
ugacucagcauagauuguauaa

SEQ ID NO: 658960 - RNA, 23 nt, Homo sapiens
ugacucaggauuuaaaaacugga

SEQ ID NO: 658961 - RNA, 22 nt, Homo sapiens
ugacuccauucaaaucuacggu

SEQ ID NO: 658962 - RNA, 20 nt, Homo sapiens
ugacucccgaugcaggggau

SEQ ID NO: 658963 - RNA, 21 nt, Homo sapiens
ugacuccuccaaggaaaggga

SEQ ID NO: 658964 - RNA, 19 nt, Homo sapiens
ugacuccucuaagccacuc

SEQ ID NO: 658965 - RNA, 22 nt, Homo sapiens
ugacuccuuucucuaaaacugc

SEQ ID NO: 658966 - RNA, 16 nt, Homo sapiens
ugacucgaaacugaca

SEQ ID NO: 658967 - RNA, 23 nt, Homo sapiens
ugacucgggagcugcacacaccu

SEQ ID NO: 658968 - RNA, 18 nt, Homo sapiens
ugacucgguguucugucc

SEQ ID NO: 658969 - RNA, 22 nt, Homo sapiens
ugacucuccugccucagccucc

SEQ ID NO: 658970 - RNA, 21 nt, Homo sapiens
ugacucugaguccacugcucc

SEQ ID NO: 658971 - RNA, 23 nt, Homo sapiens
ugacucuggccuuacaaccuucc

SEQ ID NO: 658972 - RNA, 22 nt, Homo sapiens
ugacugagaauauaauacugua

SEQ ID NO: 658973 - RNA, 14 nt, Homo sapiens
ugacugccacccac

SEQ ID NO: 658974 - RNA, 12 nt, Homo sapiens
ugacugcugcuc

SEQ ID NO: 658975 - RNA, 18 nt, Homo sapiens
ugacuggaguaaaccaug

SEQ ID NO: 658976 - RNA, 15 nt, Homo sapiens
ugacugggccacagc

SEQ ID NO: 658977 - RNA, 19 nt, Homo sapiens
ugacugggucagccuuccg

SEQ ID NO: 658978 - RNA, 15 nt, Homo sapiens
ugacugucucacuua

SEQ ID NO: 658979 - RNA, 23 nt, Homo sapiens
ugacugugcaugacagcggcaau

SEQ ID NO: 658980 - RNA, 17 nt, Homo sapiens
ugacuguuuucuuuaug

SEQ ID NO: 658981 - RNA, 15 nt, Homo sapiens
ugacuuaaguggcau

SEQ ID NO: 658982 - RNA, 18 nt, Homo sapiens
ugacuuagcgucaagaca

SEQ ID NO: 658983 - RNA, 15 nt, Homo sapiens
ugacuuauaguacau

SEQ ID NO: 658984 - RNA, 21 nt, Homo sapiens
ugacuuccccaaacccagaaa

SEQ ID NO: 658985 - RNA, 23 nt, Homo sapiens
ugacuucccuggucaccaaggca

SEQ ID NO: 658986 - RNA, 14 nt, Homo sapiens
ugacuuccucccac

SEQ ID NO: 658987 - RNA, 17 nt, Homo sapiens
ugacuuccucccacugu

SEQ ID NO: 658988 - RNA, 16 nt, Homo sapiens
ugacuuccucugccac

SEQ ID NO: 658989 - RNA, 19 nt, Homo sapiens
ugacuuccucugccacucc

SEQ ID NO: 658990 - RNA, 14 nt, Homo sapiens
ugacuuccugccau

SEQ ID NO: 658991 - RNA, 23 nt, Homo sapiens
ugacuucuuuacuaacacuggcu

SEQ ID NO: 658992 - RNA, 21 nt, Homo sapiens
ugacuucuuuugaguuagguu

SEQ ID NO: 658993 - RNA, 20 nt, Homo sapiens
ugacuugugguugaauuaaa

SEQ ID NO: 658994 - RNA, 19 nt, Homo sapiens
ugacuuguuugucuuccau

SEQ ID NO: 658995 - RNA, 14 nt, Homo sapiens
ugacuuucagucuc

SEQ ID NO: 658996 - RNA, 17 nt, Homo sapiens
ugacuuucuaaguagga

SEQ ID NO: 658997 - RNA, 21 nt, Homo sapiens
ugacuuugcccccuugcccau

SEQ ID NO: 658998 - RNA, 20 nt, Homo sapiens
ugacuuugcuugcuuugaag

SEQ ID NO: 658999 - RNA, 19 nt, Homo sapiens
ugacuuugggcaagccaag

SEQ ID NO: 659000 - RNA, 15 nt, Homo sapiens
ugacuuuucugcccu

SEQ ID NO: 659001 - RNA, 15 nt, Homo sapiens
ugagaaaacagggaa

SEQ ID NO: 659002 - RNA, 19 nt, Homo sapiens
ugagaaaaguucaauacuc

SEQ ID NO: 659003 - RNA, 16 nt, Homo sapiens
ugagaaaauaucuugc

SEQ ID NO: 659004 - RNA, 23 nt, Homo sapiens
ugagaaaccuuauuguaccucuc

SEQ ID NO: 659005 - RNA, 14 nt, Homo sapiens
ugagaaacugggaa

SEQ ID NO: 659006 - RNA, 20 nt, Homo sapiens
ugagaaagccuucauaagcc

SEQ ID NO: 659007 - RNA, 14 nt, Homo sapiens
ugagaaaguucuca

SEQ ID NO: 659008 - RNA, 17 nt, Homo sapiens
ugagaaauuugccuugu

SEQ ID NO: 659009 - RNA, 12 nt, Homo sapiens
ugagaacaaagc

SEQ ID NO: 659010 - RNA, 14 nt, Homo sapiens
ugagaacugcauau

SEQ ID NO: 659011 - RNA, 13 nt, Homo sapiens
ugagaacuuccaa

SEQ ID NO: 659012 - RNA, 14 nt, Homo sapiens
ugagaacuugacaa

SEQ ID NO: 659013 - RNA, 21 nt, Homo sapiens
ugagaagaaugaaaaugcagu

SEQ ID NO: 659014 - RNA, 16 nt, Homo sapiens
ugagaagacuggcuag

SEQ ID NO: 659015 - RNA, 17 nt, Homo sapiens
ugagaagaggcugcugc

SEQ ID NO: 659016 - RNA, 13 nt, Homo sapiens
ugagaagaucuga

SEQ ID NO: 659017 - RNA, 21 nt, Homo sapiens
ugagaagauuuuaaaaccauu

SEQ ID NO: 659018 - RNA, 19 nt, Homo sapiens
ugauuuuguuuacugaaau

SEQ ID NO: 659019 - RNA, 14 nt, Homo sapiens
ugauuuuuacuuca

SEQ ID NO: 659020 - RNA, 14 nt, Homo sapiens
ugcaaaaaaagccu

SEQ ID NO: 659021 - RNA, 13 nt, Homo sapiens
ugcaaaaaacaua

SEQ ID NO: 659022 - RNA, 17 nt, Homo sapiens
ugcaaaacacuaaagau

SEQ ID NO: 659023 - RNA, 20 nt, Homo sapiens
ugcaaaaggcugauuacuga

SEQ ID NO: 659024 - RNA, 23 nt, Homo sapiens
ugcaaaaggcugauuacugaaau

SEQ ID NO: 659025 - RNA, 20 nt, Homo sapiens
ugcaaaaguaaauguugaca

SEQ ID NO: 659026 - RNA, 18 nt, Homo sapiens
ugcaaaauuuuacaguaa

SEQ ID NO: 659027 - RNA, 20 nt, Homo sapiens
ugcaaacacagcucucucca

SEQ ID NO: 659028 - RNA, 17 nt, Homo sapiens
ugcaaacaguucuugga

SEQ ID NO: 659029 - RNA, 21 nt, Homo sapiens
ugcaaaccacuucuccaugcu

SEQ ID NO: 659030 - RNA, 17 nt, Homo sapiens
ugcaaacccugguggua

SEQ ID NO: 659031 - RNA, 21 nt, Homo sapiens
ugcaaaccucacagggucccc

SEQ ID NO: 659032 - RNA, 15 nt, Homo sapiens
ugcaaaccucaucuu

SEQ ID NO: 659033 - RNA, 13 nt, Homo sapiens
ugcaaaccuuccu

SEQ ID NO: 659034 - RNA, 17 nt, Homo sapiens
ugcaaacuaugcaucug

SEQ ID NO: 659035 - RNA, 16 nt, Homo sapiens
ugcaaacugcuuuauu

SEQ ID NO: 659036 - RNA, 21 nt, Homo sapiens
ugcaaacuguggcaacugaga

SEQ ID NO: 659037 - RNA, 15 nt, Homo sapiens
ugcaaagacucugag

SEQ ID NO: 659038 - RNA, 12 nt, Homo sapiens
ugcaaagacuga

SEQ ID NO: 659039 - RNA, 16 nt, Homo sapiens
ugcaaaggagaagcac

SEQ ID NO: 659040 - RNA, 20 nt, Homo sapiens
ugcaaaggagaagcacagcu

SEQ ID NO: 659041 - RNA, 16 nt, Homo sapiens
ugcaaaguacauguau

SEQ ID NO: 659042 - RNA, 14 nt, Homo sapiens
ugcaaauaccuccu

SEQ ID NO: 659043 - RNA, 19 nt, Homo sapiens
ugcaaauacuguauauuca

SEQ ID NO: 659044 - RNA, 21 nt, Homo sapiens
ugcaaauauugguuaguauuu

SEQ ID NO: 659045 - RNA, 13 nt, Homo sapiens
ugcaaaugcucaa

SEQ ID NO: 659046 - RNA, 16 nt, Homo sapiens
ugcaaauuaaaacaua

SEQ ID NO: 659047 - RNA, 19 nt, Homo sapiens
ugcaaauucauuucauggu

SEQ ID NO: 659048 - RNA, 15 nt, Homo sapiens
ugcaacagacuugaa

SEQ ID NO: 659049 - RNA, 16 nt, Homo sapiens
ugcaaccaacugcugc

SEQ ID NO: 659050 - RNA, 20 nt, Homo sapiens
ugcaaccacugcaauaucuu

SEQ ID NO: 659051 - RNA, 19 nt, Homo sapiens
ugcaacccugucauuacgu

SEQ ID NO: 659052 - RNA, 16 nt, Homo sapiens
ugcaaccucacuaugg

SEQ ID NO: 659053 - RNA, 21 nt, Homo sapiens
ugcaacucaaggacuuugcag

SEQ ID NO: 659054 - RNA, 16 nt, Homo sapiens
ugcaacucaucuucac

SEQ ID NO: 659055 - RNA, 20 nt, Homo sapiens
ugcaacucuuuuaagugccu

SEQ ID NO: 659056 - RNA, 16 nt, Homo sapiens
ugcaacuucuauccuu

SEQ ID NO: 659057 - RNA, 18 nt, Homo sapiens
ugcaacuugugaacucca

SEQ ID NO: 659058 - RNA, 19 nt, Homo sapiens
ugcaagaaaucagccauaa

SEQ ID NO: 659059 - RNA, 12 nt, Homo sapiens
ugcaagacauag

SEQ ID NO: 659060 - RNA, 17 nt, Homo sapiens
ugcaagaccuagugcuc

SEQ ID NO: 659061 - RNA, 21 nt, Homo sapiens
ugcaagaccuagugcucuuaa

SEQ ID NO: 659062 - RNA, 15 nt, Homo sapiens
ugcaagagugacagu

SEQ ID NO: 659063 - RNA, 19 nt, Homo sapiens
ugcaagcaaaucccauuuc

SEQ ID NO: 659064 - RNA, 15 nt, Homo sapiens
ugcaagcacaucugc

SEQ ID NO: 659065 - RNA, 11 nt, Homo sapiens
ugcaagccaua

SEQ ID NO: 659066 - RNA, 14 nt, Homo sapiens
ugcaaggggcugca

SEQ ID NO: 659067 - RNA, 16 nt, Homo sapiens
ugcaagggucccuuaa

SEQ ID NO: 659068 - RNA, 22 nt, Homo sapiens
ugcaagguacucuggugaguca

SEQ ID NO: 659069 - RNA, 22 nt, Homo sapiens
ugcaagguauuacacucuguaa

SEQ ID NO: 659070 - RNA, 17 nt, Homo sapiens
ugcaagguauuucucca

SEQ ID NO: 659071 - RNA, 13 nt, Homo sapiens
ugcaaggucauuu

SEQ ID NO: 659072 - RNA, 17 nt, Homo sapiens
ugcaagucaaaaucaca

SEQ ID NO: 659073 - RNA, 13 nt, Homo sapiens
ugcaagugcaaaa

SEQ ID NO: 659074 - RNA, 23 nt, Homo sapiens
ugcaagugcuggagucuccugag

SEQ ID NO: 659075 - RNA, 20 nt, Homo sapiens
ugcaagugucugugugcaag

SEQ ID NO: 659076 - RNA, 23 nt, Homo sapiens
ugcaagugugugcacaugugugc

SEQ ID NO: 659077 - RNA, 22 nt, Homo sapiens
ugcaauaaaaaaauuacccuga

SEQ ID NO: 659078 - RNA, 17 nt, Homo sapiens
ugcaauaacagcugcaa

SEQ ID NO: 659079 - RNA, 22 nt, Homo sapiens
ugcaauaaugacaaaugcccug

SEQ ID NO: 659080 - RNA, 14 nt, Homo sapiens
ugcaauacauuuca

SEQ ID NO: 659081 - RNA, 20 nt, Homo sapiens
ugcaauagugcaacaucucu

SEQ ID NO: 659082 - RNA, 17 nt, Homo sapiens
ugcaaucacagcucacu

SEQ ID NO: 659083 - RNA, 20 nt, Homo sapiens
ugcaaucgguuuaaacaugg

SEQ ID NO: 659084 - RNA, 14 nt, Homo sapiens
ugcaaucuguguuc

SEQ ID NO: 659085 - RNA, 23 nt, Homo sapiens
ugcaaucuguguucgauggcuca

SEQ ID NO: 659086 - RNA, 12 nt, Homo sapiens
ugcaaucuucua

SEQ ID NO: 659087 - RNA, 20 nt, Homo sapiens
ugcaaugacucaggacaucc

SEQ ID NO: 659088 - RNA, 13 nt, Homo sapiens
ugcaauguaguca

SEQ ID NO: 659089 - RNA, 16 nt, Homo sapiens
ugcaauguagucaaua

SEQ ID NO: 659090 - RNA, 12 nt, Homo sapiens
ugcaauguauua

SEQ ID NO: 659091 - RNA, 13 nt, Homo sapiens
ugcaaugugcuac

SEQ ID NO: 659092 - RNA, 15 nt, Homo sapiens
ugcaauguggugaca

SEQ ID NO: 659093 - RNA, 15 nt, Homo sapiens
ugcaauuuuucaaga

SEQ ID NO: 659094 - RNA, 18 nt, Homo sapiens
ugcaauuuuucaagagcu

SEQ ID NO: 659095 - RNA, 22 nt, Homo sapiens
ugcacaaaagcagauacuugag

SEQ ID NO: 659096 - RNA, 21 nt, Homo sapiens
ugcacaaaagggacuuggaaa

SEQ ID NO: 659097 - RNA, 15 nt, Homo sapiens
ugcacaaagcccuuc

SEQ ID NO: 659098 - RNA, 16 nt, Homo sapiens
ugcacaaagcccuucc

SEQ ID NO: 659099 - RNA, 17 nt, Homo sapiens
ugcacaaagcccuucca

SEQ ID NO: 659100 - RNA, 22 nt, Homo sapiens
ugcacaaugauuuuuugcaaaa

SEQ ID NO: 659101 - RNA, 20 nt, Homo sapiens
ugcacacaagcucugcgcca

SEQ ID NO: 659102 - RNA, 14 nt, Homo sapiens
ugcacacacauaua

SEQ ID NO: 659103 - RNA, 15 nt, Homo sapiens
ugcacacacauauau

SEQ ID NO: 659104 - RNA, 21 nt, Homo sapiens
ugcacacagcacgggggccaa

SEQ ID NO: 659105 - RNA, 15 nt, Homo sapiens
ugcacacauauacau

SEQ ID NO: 659106 - RNA, 19 nt, Homo sapiens
ugcacacauauacauguag

SEQ ID NO: 659107 - RNA, 14 nt, Homo sapiens
ugcacacaucacca

SEQ ID NO: 659108 - RNA, 17 nt, Homo sapiens
ugcacacauuaggcauu

SEQ ID NO: 659109 - RNA, 16 nt, Homo sapiens
ugcacacucacuugua

SEQ ID NO: 659110 - RNA, 21 nt, Homo sapiens
ugcacacucaugcacacagau

SEQ ID NO: 659111 - RNA, 21 nt, Homo sapiens
ugcacacugccuggcccaaaa

SEQ ID NO: 659112 - RNA, 19 nt, Homo sapiens
ugcacagaauauguaugua

SEQ ID NO: 659113 - RNA, 22 nt, Homo sapiens
ugcacagaucugcuugaucaau

SEQ ID NO: 659114 - RNA, 20 nt, Homo sapiens
ugcacaggugacaagcguca

SEQ ID NO: 659115 - RNA, 16 nt, Homo sapiens
ugcacaguagagcaaa

SEQ ID NO: 659116 - RNA, 19 nt, Homo sapiens
ugcacagucacugcucuuc

SEQ ID NO: 659117 - RNA, 22 nt, Homo sapiens
ugcacagugaagugcuggcaac

SEQ ID NO: 659118 - RNA, 20 nt, Homo sapiens
ugcacagugacuucugagau

SEQ ID NO: 659119 - RNA, 23 nt, Homo sapiens
ugcacaucuugucuaauuuucac

SEQ ID NO: 659120 - RNA, 14 nt, Homo sapiens
ugcacaugaaaguu

SEQ ID NO: 659121 - RNA, 18 nt, Homo sapiens
ugcacaugcgcacucuca

SEQ ID NO: 659122 - RNA, 23 nt, Homo sapiens
ugcacaugugagcaugucacuuc

SEQ ID NO: 659123 - RNA, 21 nt, Homo sapiens
ugcacaugugccacacaguga

SEQ ID NO: 659124 - RNA, 24 nt, Homo sapiens
ugcacaugugugcgugugcgugca

SEQ ID NO: 659125 - RNA, 20 nt, Homo sapiens
ugcacauuggucauugugaa

SEQ ID NO: 659126 - RNA, 17 nt, Homo sapiens
ugcacauuuaugaauca

SEQ ID NO: 659127 - RNA, 11 nt, Homo sapiens
ugcaccaaaga

SEQ ID NO: 659128 - RNA, 13 nt, Homo sapiens
ugcaccaaagaca

SEQ ID NO: 659129 - RNA, 20 nt, Homo sapiens
ugcaccaaagagaaugcccu

SEQ ID NO: 659130 - RNA, 10 nt, Homo sapiens
ugcaccaaau

SEQ ID NO: 659131 - RNA, 15 nt, Homo sapiens
ugcaccaacgagcug

SEQ ID NO: 659132 - RNA, 16 nt, Homo sapiens
ugcaccaagcaggaaa

SEQ ID NO: 659133 - RNA, 18 nt, Homo sapiens
ugcaccaauuaucaucuu

SEQ ID NO: 659134 - RNA, 17 nt, Homo sapiens
ugcaccacaccuggcau

SEQ ID NO: 659135 - RNA, 17 nt, Homo sapiens
ugcaccacuucaaguga

SEQ ID NO: 659136 - RNA, 19 nt, Homo sapiens
ugcaccagagcaaccucuc

SEQ ID NO: 659137 - RNA, 19 nt, Homo sapiens
ugcaccagcgcccccagaa

SEQ ID NO: 659138 - RNA, 14 nt, Homo sapiens
ugcacccaccuguu

SEQ ID NO: 659139 - RNA, 18 nt, Homo sapiens
ugcacccagcagugucac

SEQ ID NO: 659140 - RNA, 20 nt, Homo sapiens
ugcuauuguaaggucuuugu

SEQ ID NO: 659141 - RNA, 19 nt, Homo sapiens
ugcuauuuauuuuccuaaa

SEQ ID NO: 659142 - RNA, 23 nt, Homo sapiens
ugcuauuuauuuuccuaaagaga

SEQ ID NO: 659143 - RNA, 15 nt, Homo sapiens
ugcuauuucaucugg

SEQ ID NO: 659144 - RNA, 15 nt, Homo sapiens
ugcuauuugucaucu

SEQ ID NO: 659145 - RNA, 22 nt, Homo sapiens
ugcucaagccggaaacucggca

SEQ ID NO: 659146 - RNA, 22 nt, Homo sapiens
ugcucaauaaaguacaagagcu

SEQ ID NO: 659147 - RNA, 21 nt, Homo sapiens
ugcucaauuaaacauuacugu

SEQ ID NO: 659148 - RNA, 22 nt, Homo sapiens
ugcucacgucaaaugcauacaa

SEQ ID NO: 659149 - RNA, 17 nt, Homo sapiens
ugcucacguuaccuuga

SEQ ID NO: 659150 - RNA, 14 nt, Homo sapiens
ugcucagagcuuua

SEQ ID NO: 659151 - RNA, 16 nt, Homo sapiens
ugcucagcagccaguc

SEQ ID NO: 659152 - RNA, 19 nt, Homo sapiens
ugcucagcagccagucuca

SEQ ID NO: 659153 - RNA, 13 nt, Homo sapiens
ugcucagugccuc

SEQ ID NO: 659154 - RNA, 20 nt, Homo sapiens
ugcucaguguccagcuucca

SEQ ID NO: 659155 - RNA, 18 nt, Homo sapiens
ugcucaguuggugcugcu

SEQ ID NO: 659156 - RNA, 16 nt, Homo sapiens
ugcucauauugugauu

SEQ ID NO: 659157 - RNA, 16 nt, Homo sapiens
ugcucauguaccucug

SEQ ID NO: 659158 - RNA, 17 nt, Homo sapiens
ugcucauguauauuuag

SEQ ID NO: 659159 - RNA, 17 nt, Homo sapiens
ugcuccaagggacaggu

SEQ ID NO: 659160 - RNA, 13 nt, Homo sapiens
ugcuccaccagca

SEQ ID NO: 659161 - RNA, 15 nt, Homo sapiens
ugcuccagacucacu

SEQ ID NO: 659162 - RNA, 20 nt, Homo sapiens
ugcuccagacucacuugcca

SEQ ID NO: 659163 - RNA, 23 nt, Homo sapiens
ugcuccaguguaucucaaaagac

SEQ ID NO: 659164 - RNA, 13 nt, Homo sapiens
ugcuccauuguca

SEQ ID NO: 659165 - RNA, 20 nt, Homo sapiens
ugcuccauugucaugagucc

SEQ ID NO: 659166 - RNA, 22 nt, Homo sapiens
ugcucccaccacggggucugca

SEQ ID NO: 659167 - RNA, 13 nt, Homo sapiens
ugcucccaucauu

SEQ ID NO: 659168 - RNA, 20 nt, Homo sapiens
ugcucccuagccagaggcuc

SEQ ID NO: 659169 - RNA, 23 nt, Homo sapiens
ugcucccucuguuagguccauuu

SEQ ID NO: 659170 - RNA, 20 nt, Homo sapiens
ugcuccgaggacccaggaaa

SEQ ID NO: 659171 - RNA, 16 nt, Homo sapiens
ugcuccgcugcuccuu

SEQ ID NO: 659172 - RNA, 15 nt, Homo sapiens
ugcuccguuggucag

SEQ ID NO: 659173 - RNA, 15 nt, Homo sapiens
ugcuccucacuggag

SEQ ID NO: 659174 - RNA, 17 nt, Homo sapiens
ugcuccuggagccuuug

SEQ ID NO: 659175 - RNA, 21 nt, Homo sapiens
ugcuccuguacuuguccucag

SEQ ID NO: 659176 - RNA, 20 nt, Homo sapiens
ugcuccuuuuguaucuuccu

SEQ ID NO: 659177 - RNA, 15 nt, Homo sapiens
ugcucgagacacagu

SEQ ID NO: 659178 - RNA, 17 nt, Homo sapiens
ugcucggccgucuucac

SEQ ID NO: 659179 - RNA, 14 nt, Homo sapiens
ugcucgugugauuu

SEQ ID NO: 659180 - RNA, 21 nt, Homo sapiens
ugcucuaugaaacugcacauu

SEQ ID NO: 659181 - RNA, 22 nt, Homo sapiens
ugcucucauaaugaagacauag

SEQ ID NO: 659182 - RNA, 22 nt, Homo sapiens
ugcucucgcaccuuuccaaagu

SEQ ID NO: 659183 - RNA, 17 nt, Homo sapiens
ugcucucucucccugcc

SEQ ID NO: 659184 - RNA, 21 nt, Homo sapiens
ugcucucuugugacgugcacu

SEQ ID NO: 659185 - RNA, 20 nt, Homo sapiens
ugcucugaggcuuccagaga

SEQ ID NO: 659186 - RNA, 21 nt, Homo sapiens
ugcucugguuguuucuguucc

SEQ ID NO: 659187 - RNA, 16 nt, Homo sapiens
ugcucuuaacuuguua

SEQ ID NO: 659188 - RNA, 21 nt, Homo sapiens
ugcucuuagcucuaccgggag

SEQ ID NO: 659189 - RNA, 20 nt, Homo sapiens
ugcucuuaucuuucuugacu

SEQ ID NO: 659190 - RNA, 21 nt, Homo sapiens
ugcucuucagagauguuaaaa

SEQ ID NO: 659191 - RNA, 16 nt, Homo sapiens
ugcucuucaucauaua

SEQ ID NO: 659192 - RNA, 16 nt, Homo sapiens
ugcucuugagucuuug

SEQ ID NO: 659193 - RNA, 18 nt, Homo sapiens
ugcucuugagucuuugca

SEQ ID NO: 659194 - RNA, 20 nt, Homo sapiens
ugcucuugagucuuugcaga

SEQ ID NO: 659195 - RNA, 13 nt, Homo sapiens
ugcugaaaaagua

SEQ ID NO: 659196 - RNA, 21 nt, Homo sapiens
ugcugaaaaaguagauugagu

SEQ ID NO: 659197 - RNA, 19 nt, Homo sapiens
ugcugaaacucagugcaaa

SEQ ID NO: 659198 - RNA, 13 nt, Homo sapiens
ugcugaacagugg

SEQ ID NO: 659199 - RNA, 15 nt, Homo sapiens
ugcugaacauugcau

SEQ ID NO: 659200 - RNA, 18 nt, Homo sapiens
ugcugaacuccuuguuag

SEQ ID NO: 659201 - RNA, 22 nt, Homo sapiens
ugcugaaggaagaaaaaguguu

SEQ ID NO: 659202 - RNA, 13 nt, Homo sapiens
ugcugaagggcag

SEQ ID NO: 659203 - RNA, 22 nt, Homo sapiens
ugcugaagguccaggcuugccu

SEQ ID NO: 659204 - RNA, 14 nt, Homo sapiens
ugcugaaugaagcu

SEQ ID NO: 659205 - RNA, 14 nt, Homo sapiens
ugcugacaggugau

SEQ ID NO: 659206 - RNA, 18 nt, Homo sapiens
ugcugaccaaaugccugg

SEQ ID NO: 659207 - RNA, 15 nt, Homo sapiens
ugcugaccaaauggc

SEQ ID NO: 659208 - RNA, 19 nt, Homo sapiens
ugcugaccucccagugacc

SEQ ID NO: 659209 - RNA, 18 nt, Homo sapiens
ugcugacgggacccacau

SEQ ID NO: 659210 - RNA, 13 nt, Homo sapiens
ugcugacguccag

SEQ ID NO: 659211 - RNA, 17 nt, Homo sapiens
ugcugacuacuacucug

SEQ ID NO: 659212 - RNA, 18 nt, Homo sapiens
ugcugacucuggccuuac

SEQ ID NO: 659213 - RNA, 20 nt, Homo sapiens
ugcugacucuggccuuacaa

SEQ ID NO: 659214 - RNA, 19 nt, Homo sapiens
ugcugagagaaauauggaa

SEQ ID NO: 659215 - RNA, 15 nt, Homo sapiens
ugcugagcacccucu

SEQ ID NO: 659216 - RNA, 14 nt, Homo sapiens
ugcugagcugugau

SEQ ID NO: 659217 - RNA, 17 nt, Homo sapiens
ugcugaggcccagugca

SEQ ID NO: 659218 - RNA, 23 nt, Homo sapiens
ugcugaggcccagugcauaugca

SEQ ID NO: 659219 - RNA, 15 nt, Homo sapiens
ugcugaguagugaca

SEQ ID NO: 659220 - RNA, 20 nt, Homo sapiens
ugcugaguauguuaagcucu

SEQ ID NO: 659221 - RNA, 19 nt, Homo sapiens
ugcugagugaaugaacaaa

SEQ ID NO: 659222 - RNA, 17 nt, Homo sapiens
ugcugaguuucuguucu

SEQ ID NO: 659223 - RNA, 15 nt, Homo sapiens
ugcugauaaguagca

SEQ ID NO: 659224 - RNA, 22 nt, Homo sapiens
ugcugaugaucaaaaccugugc

SEQ ID NO: 659225 - RNA, 21 nt, Homo sapiens
ugcugaugcuguuaaccaaag

SEQ ID NO: 659226 - RNA, 23 nt, Homo sapiens
ugcugauggcuugacaugugcaa

SEQ ID NO: 659227 - RNA, 15 nt, Homo sapiens
ugcugauguuuacaa

SEQ ID NO: 659228 - RNA, 19 nt, Homo sapiens
ugcugauuauuuaugaccu

SEQ ID NO: 659229 - RNA, 19 nt, Homo sapiens
ugcugcaaagccuuuccag

SEQ ID NO: 659230 - RNA, 20 nt, Homo sapiens
ugcugcagacaaguggacag

SEQ ID NO: 659231 - RNA, 13 nt, Homo sapiens
ugcugcagagaaa

SEQ ID NO: 659232 - RNA, 23 nt, Homo sapiens
ugcugcaggccgugugucuguca

SEQ ID NO: 659233 - RNA, 20 nt, Homo sapiens
ugcugcagguggcagaguga

SEQ ID NO: 659234 - RNA, 22 nt, Homo sapiens
ugcugcauacuuugacaaggaa

SEQ ID NO: 659235 - RNA, 15 nt, Homo sapiens
ugcugcaucaguggg

SEQ ID NO: 659236 - RNA, 16 nt, Homo sapiens
ugcugcauugauccag

SEQ ID NO: 659237 - RNA, 21 nt, Homo sapiens
ugcugcauuuuucugucagaa

SEQ ID NO: 659238 - RNA, 14 nt, Homo sapiens
ugcugccaugugga

SEQ ID NO: 659239 - RNA, 14 nt, Homo sapiens
ugcugccauuugau

SEQ ID NO: 659240 - RNA, 18 nt, Homo sapiens
ugcugcccagccacucca

SEQ ID NO: 659241 - RNA, 20 nt, Homo sapiens
ugcugcccagugcaaaccac

SEQ ID NO: 659242 - RNA, 21 nt, Homo sapiens
ugcugccccuugcaagccaua

SEQ ID NO: 659243 - RNA, 19 nt, Homo sapiens
ugcugcugagugcaccacu

SEQ ID NO: 659244 - RNA, 23 nt, Homo sapiens
ugcugcugagugcaccacuucaa

SEQ ID NO: 659245 - RNA, 12 nt, Homo sapiens
ugcugcuguaaa

SEQ ID NO: 659246 - RNA, 12 nt, Homo sapiens
ugcugcugugca

SEQ ID NO: 659247 - RNA, 14 nt, Homo sapiens
ugcugcuucuccau

SEQ ID NO: 659248 - RNA, 18 nt, Homo sapiens
ugcugcuuucuuguugcu

SEQ ID NO: 659249 - RNA, 12 nt, Homo sapiens
ugcugcuuuguc

SEQ ID NO: 659250 - RNA, 15 nt, Homo sapiens
ugcuggaacacugcu

SEQ ID NO: 659251 - RNA, 22 nt, Homo sapiens
ugcuggaaguagaauuugucca

SEQ ID NO: 659252 - RNA, 18 nt, Homo sapiens
ugcuggaagucuccauga

SEQ ID NO: 659253 - RNA, 16 nt, Homo sapiens
ugcuggaauuccuaac

SEQ ID NO: 659254 - RNA, 19 nt, Homo sapiens
ugcuggacuguuccaggcc

SEQ ID NO: 659255 - RNA, 15 nt, Homo sapiens
ugcuggaucacagcu

SEQ ID NO: 659256 - RNA, 17 nt, Homo sapiens
ugcuggccggagcaaac

SEQ ID NO: 659257 - RNA, 18 nt, Homo sapiens
ugcuggccuggaucuccc

SEQ ID NO: 659258 - RNA, 19 nt, Homo sapiens
ugcuggcgacacucagggc

SEQ ID NO: 659259 - RNA, 20 nt, Homo sapiens
ugcugggcacuucaucugau

SEQ ID NO: 659260 - RNA, 17 nt, Homo sapiens
ugcugggcccaccaccu

SEQ ID NO: 659261 - RNA, 18 nt, Homo sapiens
ugugccacuacacuccag

SEQ ID NO: 659262 - RNA, 20 nt, Homo sapiens
ugugccagaaacagugggag

SEQ ID NO: 659263 - RNA, 17 nt, Homo sapiens
ugugccagcaccacagc

SEQ ID NO: 659264 - RNA, 21 nt, Homo sapiens
ugugccaggcugaauuacagu

SEQ ID NO: 659265 - RNA, 16 nt, Homo sapiens
ugugccccuucacuca

SEQ ID NO: 659266 - RNA, 12 nt, Homo sapiens
ugugcccgggga

SEQ ID NO: 659267 - RNA, 16 nt, Homo sapiens
ugugccgaaugugcag

SEQ ID NO: 659268 - RNA, 20 nt, Homo sapiens
ugugccuccuagagugcagg

SEQ ID NO: 659269 - RNA, 19 nt, Homo sapiens
ugugccugcucagcagagc

SEQ ID NO: 659270 - RNA, 21 nt, Homo sapiens
ugugccugcucagcagccagu

SEQ ID NO: 659271 - RNA, 16 nt, Homo sapiens
ugugccugcuccugua

SEQ ID NO: 659272 - RNA, 16 nt, Homo sapiens
ugugccuugggucuca

SEQ ID NO: 659273 - RNA, 19 nt, Homo sapiens
ugugcguguguccaugugu

SEQ ID NO: 659274 - RNA, 14 nt, Homo sapiens
ugugcuaagucuuu

SEQ ID NO: 659275 - RNA, 17 nt, Homo sapiens
ugugcuauacacacaca

SEQ ID NO: 659276 - RNA, 18 nt, Homo sapiens
ugugcucaauguguaaau

SEQ ID NO: 659277 - RNA, 23 nt, Homo sapiens
ugugcucucuuuaaaucaagucc

SEQ ID NO: 659278 - RNA, 17 nt, Homo sapiens
ugugcucuggggguccc

SEQ ID NO: 659279 - RNA, 21 nt, Homo sapiens
ugugcuggaaagcguugaugg

SEQ ID NO: 659280 - RNA, 15 nt, Homo sapiens
ugugcuggacuuuaa

SEQ ID NO: 659281 - RNA, 14 nt, Homo sapiens
ugugcuggguccca

SEQ ID NO: 659282 - RNA, 11 nt, Homo sapiens
ugugcugugac

SEQ ID NO: 659283 - RNA, 14 nt, Homo sapiens
ugugcuuacaguaa

SEQ ID NO: 659284 - RNA, 16 nt, Homo sapiens
ugugcuucauuccaau

SEQ ID NO: 659285 - RNA, 16 nt, Homo sapiens
uguggaaaugcuuaaa

SEQ ID NO: 659286 - RNA, 15 nt, Homo sapiens
uguggaagagcauua

SEQ ID NO: 659287 - RNA, 13 nt, Homo sapiens
uguggaauguugg

SEQ ID NO: 659288 - RNA, 16 nt, Homo sapiens
uguggacgugcacuga

SEQ ID NO: 659289 - RNA, 19 nt, Homo sapiens
uguggacgugcacugacag

SEQ ID NO: 659290 - RNA, 13 nt, Homo sapiens
uguggacugugau

SEQ ID NO: 659291 - RNA, 12 nt, Homo sapiens
uguggacugugc

SEQ ID NO: 659292 - RNA, 17 nt, Homo sapiens
uguggagacuucaucaa

SEQ ID NO: 659293 - RNA, 16 nt, Homo sapiens
uguggagcacguggag

SEQ ID NO: 659294 - RNA, 18 nt, Homo sapiens
uguggaggccugaugcug

SEQ ID NO: 659295 - RNA, 12 nt, Homo sapiens
uguggagugucu

SEQ ID NO: 659296 - RNA, 14 nt, Homo sapiens
uguggauaagggag

SEQ ID NO: 659297 - RNA, 16 nt, Homo sapiens
uguggauacagugccc

SEQ ID NO: 659298 - RNA, 16 nt, Homo sapiens
uguggaugagaggaac

SEQ ID NO: 659299 - RNA, 13 nt, Homo sapiens
uguggcacuccaa

SEQ ID NO: 659300 - RNA, 15 nt, Homo sapiens
uguggcaucuugcca

SEQ ID NO: 659301 - RNA, 14 nt, Homo sapiens
uguggccacagccc

SEQ ID NO: 659302 - RNA, 22 nt, Homo sapiens
uguggccaggccuuacaucugg

SEQ ID NO: 659303 - RNA, 15 nt, Homo sapiens
uguggccaucacuca

SEQ ID NO: 659304 - RNA, 15 nt, Homo sapiens
uguggccccaacaca

SEQ ID NO: 659305 - RNA, 16 nt, Homo sapiens
uguggccccaacacaa

SEQ ID NO: 659306 - RNA, 16 nt, Homo sapiens
uguggccugccuucac

SEQ ID NO: 659307 - RNA, 23 nt, Homo sapiens
uguggccuugcccgccagccuca

SEQ ID NO: 659308 - RNA, 13 nt, Homo sapiens
uguggcugaugau

SEQ ID NO: 659309 - RNA, 21 nt, Homo sapiens
uguggcugcuagcacuuggag

SEQ ID NO: 659310 - RNA, 23 nt, Homo sapiens
ugugggaggagugacaugaagca

SEQ ID NO: 659311 - RNA, 18 nt, Homo sapiens
ugugggaucauugcauuu

SEQ ID NO: 659312 - RNA, 16 nt, Homo sapiens
ugugggcaggaaguga

SEQ ID NO: 659313 - RNA, 17 nt, Homo sapiens
ugugggcaugagcugcu

SEQ ID NO: 659314 - RNA, 17 nt, Homo sapiens
uguggggaagaggggcu

SEQ ID NO: 659315 - RNA, 13 nt, Homo sapiens
uguggggauuuuc

SEQ ID NO: 659316 - RNA, 20 nt, Homo sapiens
uguggggggaagcuuugaua

SEQ ID NO: 659317 - RNA, 13 nt, Homo sapiens
ugugggggguccu

SEQ ID NO: 659318 - RNA, 15 nt, Homo sapiens
ugugggucaaaccaa

SEQ ID NO: 659319 - RNA, 17 nt, Homo sapiens
ugugggugcagcuguca

SEQ ID NO: 659320 - RNA, 19 nt, Homo sapiens
ugugggugcagcugucaca

SEQ ID NO: 659321 - RNA, 23 nt, Homo sapiens
ugugggugcagcugucacagccc

SEQ ID NO: 659322 - RNA, 19 nt, Homo sapiens
ugugguaacuguagucauc

SEQ ID NO: 659323 - RNA, 13 nt, Homo sapiens
uguggucaauccg

SEQ ID NO: 659324 - RNA, 19 nt, Homo sapiens
uguggucagcagaugccag

SEQ ID NO: 659325 - RNA, 13 nt, Homo sapiens
uguggucucagga

SEQ ID NO: 659326 - RNA, 19 nt, Homo sapiens
uguggugccggugcuucca

SEQ ID NO: 659327 - RNA, 19 nt, Homo sapiens
ugugguuguuagguucaca

SEQ ID NO: 659328 - RNA, 13 nt, Homo sapiens
ugugguuuacuag

SEQ ID NO: 659329 - RNA, 23 nt, Homo sapiens
ugugguuuuuaaagaagggggcu

SEQ ID NO: 659330 - RNA, 12 nt, Homo sapiens
uguguaaucuaa

SEQ ID NO: 659331 - RNA, 17 nt, Homo sapiens
uguguaaucuaaguaua

SEQ ID NO: 659332 - RNA, 15 nt, Homo sapiens
uguguacaacuuaag

SEQ ID NO: 659333 - RNA, 18 nt, Homo sapiens
uguguacaauuuuaguca

SEQ ID NO: 659334 - RNA, 21 nt, Homo sapiens
uguguacacaucuauucucaa

SEQ ID NO: 659335 - RNA, 20 nt, Homo sapiens
uguguacuuuuggguucaca

SEQ ID NO: 659336 - RNA, 12 nt, Homo sapiens
uguguagucaag

SEQ ID NO: 659337 - RNA, 16 nt, Homo sapiens
uguguauauaguauga

SEQ ID NO: 659338 - RNA, 9 nt, Homo sapiens
uguguauga

SEQ ID NO: 659339 - RNA, 13 nt, Homo sapiens
uguguaugugcgu

SEQ ID NO: 659340 - RNA, 16 nt, Homo sapiens
uguguauguuugcaca

SEQ ID NO: 659341 - RNA, 17 nt, Homo sapiens
uguguauucacauaguc

SEQ ID NO: 659342 - RNA, 14 nt, Homo sapiens
ugugucaacugaga

SEQ ID NO: 659343 - RNA, 20 nt, Homo sapiens
ugugucaacugagagucaua

SEQ ID NO: 659344 - RNA, 21 nt, Homo sapiens
ugugucagagcccaggggaga

SEQ ID NO: 659345 - RNA, 15 nt, Homo sapiens
ugugucagcuacugc

SEQ ID NO: 659346 - RNA, 13 nt, Homo sapiens
ugugucauagaau

SEQ ID NO: 659347 - RNA, 11 nt, Homo sapiens
uguguccaaaa

SEQ ID NO: 659348 - RNA, 23 nt, Homo sapiens
uguguccacugcaauugguggua

SEQ ID NO: 659349 - RNA, 19 nt, Homo sapiens
ugugucccccucuguccag

SEQ ID NO: 659350 - RNA, 21 nt, Homo sapiens
uguguccccucacgcaagugc

SEQ ID NO: 659351 - RNA, 17 nt, Homo sapiens
uguguccccugaccugu

SEQ ID NO: 659352 - RNA, 22 nt, Homo sapiens
uguguccuaaaugcaaagcaca

SEQ ID NO: 659353 - RNA, 15 nt, Homo sapiens
uguguccuggugcuc

SEQ ID NO: 659354 - RNA, 12 nt, Homo sapiens
ugugucuucaau

SEQ ID NO: 659355 - RNA, 23 nt, Homo sapiens
ugugugaaaggaagcuccacugu

SEQ ID NO: 659356 - RNA, 15 nt, Homo sapiens
ugugugaacguguau

SEQ ID NO: 659357 - RNA, 16 nt, Homo sapiens
ugugugaccaacugug

SEQ ID NO: 659358 - RNA, 12 nt, Homo sapiens
ugugugaucaaa

SEQ ID NO: 659359 - RNA, 14 nt, Homo sapiens
ugugugaucuugau

SEQ ID NO: 659360 - RNA, 12 nt, Homo sapiens
ugugugauuucc

SEQ ID NO: 659361 - RNA, 15 nt, Homo sapiens
ugugugauuuucaua

SEQ ID NO: 659362 - RNA, 21 nt, Homo sapiens
ugugugcauggaacaaauaau

SEQ ID NO: 659363 - RNA, 13 nt, Homo sapiens
uguguggugcuac

SEQ ID NO: 659364 - RNA, 13 nt, Homo sapiens
uguguguacucug

SEQ ID NO: 659365 - RNA, 11 nt, Homo sapiens
uguguguauau

SEQ ID NO: 659366 - RNA, 19 nt, Homo sapiens
uguguguauguuugcacac

SEQ ID NO: 659367 - RNA, 13 nt, Homo sapiens
ugugugugucacc

SEQ ID NO: 659368 - RNA, 13 nt, Homo sapiens
ugugugugugcaa

SEQ ID NO: 659369 - RNA, 14 nt, Homo sapiens
ugugugugugcaag

SEQ ID NO: 659370 - RNA, 22 nt, Homo sapiens
uguguguuagcagucaaaucua

SEQ ID NO: 659371 - RNA, 17 nt, Homo sapiens
uguguguucaccuucaa

SEQ ID NO: 659372 - RNA, 15 nt, Homo sapiens
uguguucaccuucaa

SEQ ID NO: 659373 - RNA, 19 nt, Homo sapiens
uguguucauccccuuccug

SEQ ID NO: 659374 - RNA, 23 nt, Homo sapiens
uguguuccacggaaaaugcuauc

SEQ ID NO: 659375 - RNA, 18 nt, Homo sapiens
uguguucugucaccaacu

SEQ ID NO: 659376 - RNA, 22 nt, Homo sapiens
uguguucugucaccaacugaag

SEQ ID NO: 659377 - RNA, 19 nt, Homo sapiens
uguguugaagcacuguugg

SEQ ID NO: 659378 - RNA, 13 nt, Homo sapiens
uguguugcaagau

SEQ ID NO: 659379 - RNA, 15 nt, Homo sapiens
uguguugcaagauau

SEQ ID NO: 659380 - RNA, 20 nt, Homo sapiens
uguguuguauuaacaaaagu

SEQ ID NO: 659381 - RNA, 18 nt, Homo sapiens
uguguuucaaguggggcu

SEQ ID NO: 659382 - RNA, 18 nt, Homo sapiens
uguguuucuauugacuuc

SEQ ID NO: 659383 - RNA, 13 nt, Homo sapiens
uguguuucuuuag

SEQ ID NO: 659384 - RNA, 17 nt, Homo sapiens
uguuggcaaaucagaug

SEQ ID NO: 659385 - RNA, 15 nt, Homo sapiens
uguuggcaagcugca

SEQ ID NO: 659386 - RNA, 16 nt, Homo sapiens
uguuggcauagcucug

SEQ ID NO: 659387 - RNA, 18 nt, Homo sapiens
uguuggguugaauauauu

SEQ ID NO: 659388 - RNA, 19 nt, Homo sapiens
uguuggguuguuacagagu

SEQ ID NO: 659389 - RNA, 23 nt, Homo sapiens
uguugguaccuuucuagccuuag

SEQ ID NO: 659390 - RNA, 20 nt, Homo sapiens
uguugguauuauauaauuca

SEQ ID NO: 659391 - RNA, 17 nt, Homo sapiens
uguugguuguaccaaaa

SEQ ID NO: 659392 - RNA, 17 nt, Homo sapiens
uguugguuucacugaga

SEQ ID NO: 659393 - RNA, 15 nt, Homo sapiens
uguuguacuugaaaa

SEQ ID NO: 659394 - RNA, 20 nt, Homo sapiens
uguuguaucaaagugugaua

SEQ ID NO: 659395 - RNA, 21 nt, Homo sapiens
uguuguauuuucuuacugaag

SEQ ID NO: 659396 - RNA, 18 nt, Homo sapiens
uguuguguauuccacuua

SEQ ID NO: 659397 - RNA, 17 nt, Homo sapiens
uguuguuccguuaaccu

SEQ ID NO: 659398 - RNA, 14 nt, Homo sapiens
uguuguuuaccuga

SEQ ID NO: 659399 - RNA, 15 nt, Homo sapiens
uguuguuuucugacu

SEQ ID NO: 659400 - RNA, 19 nt, Homo sapiens
uguuuaaaaauugaaaaaa

SEQ ID NO: 659401 - RNA, 21 nt, Homo sapiens
uguuuaaagcauuacaguauu

SEQ ID NO: 659402 - RNA, 15 nt, Homo sapiens
uguuuaaaguggcaa

SEQ ID NO: 659403 - RNA, 19 nt, Homo sapiens
uguuuaaauaaaguaucau

SEQ ID NO: 659404 - RNA, 17 nt, Homo sapiens
uguuuaaauagccuaaa

SEQ ID NO: 659405 - RNA, 18 nt, Homo sapiens
uguuuacaaagcaucuca

SEQ ID NO: 659406 - RNA, 18 nt, Homo sapiens
uguuuacagauccccaag

SEQ ID NO: 659407 - RNA, 15 nt, Homo sapiens
uguuuacagcacuac

SEQ ID NO: 659408 - RNA, 19 nt, Homo sapiens
uguuuacagcacuacucug

SEQ ID NO: 659409 - RNA, 13 nt, Homo sapiens
uguuuacagugga

SEQ ID NO: 659410 - RNA, 13 nt, Homo sapiens
uguuuacccagua

SEQ ID NO: 659411 - RNA, 16 nt, Homo sapiens
uguuuacccaguauuc

SEQ ID NO: 659412 - RNA, 12 nt, Homo sapiens
uguuuacucauu

SEQ ID NO: 659413 - RNA, 21 nt, Homo sapiens
uguuuacuucucaccauuuga

SEQ ID NO: 659414 - RNA, 18 nt, Homo sapiens
uguuuagaaaaguauucg

SEQ ID NO: 659415 - RNA, 22 nt, Homo sapiens
uguuuauacacaacuuugcaaa

SEQ ID NO: 659416 - RNA, 18 nt, Homo sapiens
uguuuaucucugagacag

SEQ ID NO: 659417 - RNA, 14 nt, Homo sapiens
uguuuauuccugau

SEQ ID NO: 659418 - RNA, 22 nt, Homo sapiens
uguuuauugagcuguacaugca

SEQ ID NO: 659419 - RNA, 16 nt, Homo sapiens
uguuuauuuagcucug

SEQ ID NO: 659420 - RNA, 20 nt, Homo sapiens
uguuucaauugcaucuccca

SEQ ID NO: 659421 - RNA, 13 nt, Homo sapiens
uguuucagagcau

SEQ ID NO: 659422 - RNA, 20 nt, Homo sapiens
uguuucagcccgaagcugcu

SEQ ID NO: 659423 - RNA, 13 nt, Homo sapiens
uguuucaguguga

SEQ ID NO: 659424 - RNA, 17 nt, Homo sapiens
uguuucauuggucucua

SEQ ID NO: 659425 - RNA, 14 nt, Homo sapiens
uguuuccagaauug

SEQ ID NO: 659426 - RNA, 15 nt, Homo sapiens
uguuucccagauuuc

SEQ ID NO: 659427 - RNA, 17 nt, Homo sapiens
uguuuccuaauaucaaa

SEQ ID NO: 659428 - RNA, 21 nt, Homo sapiens
uguuucgcauuaagcacacac

SEQ ID NO: 659429 - RNA, 23 nt, Homo sapiens
uguuucuccuuaguuggcuggaa

SEQ ID NO: 659430 - RNA, 22 nt, Homo sapiens
uguuucucugccgcuaccuccc

SEQ ID NO: 659431 - RNA, 22 nt, Homo sapiens
uguuucuggaauugauauugaa

SEQ ID NO: 659432 - RNA, 16 nt, Homo sapiens
uguuucuggauuugca

SEQ ID NO: 659433 - RNA, 19 nt, Homo sapiens
uguuucuuauucuuucuaa

SEQ ID NO: 659434 - RNA, 19 nt, Homo sapiens
uguuucuucaaugguucuc

SEQ ID NO: 659435 - RNA, 21 nt, Homo sapiens
uguuucuuccccuuacucuca

SEQ ID NO: 659436 - RNA, 22 nt, Homo sapiens
uguuucuugccugaacuccugc

SEQ ID NO: 659437 - RNA, 17 nt, Homo sapiens
uguuucuuucauaugaa

SEQ ID NO: 659438 - RNA, 16 nt, Homo sapiens
uguuugaaauucuaga

SEQ ID NO: 659439 - RNA, 22 nt, Homo sapiens
uguuugaaauucuagagccagc

SEQ ID NO: 659440 - RNA, 12 nt, Homo sapiens
uguuugacaaaa

SEQ ID NO: 659441 - RNA, 23 nt, Homo sapiens
uguuugacgacagugcauuugcc

SEQ ID NO: 659442 - RNA, 18 nt, Homo sapiens
uguuugcacuuggcaaaa

SEQ ID NO: 659443 - RNA, 19 nt, Homo sapiens
uguuugcacuuggcaaaaa

SEQ ID NO: 659444 - RNA, 14 nt, Homo sapiens
uguuugcauaaagu

SEQ ID NO: 659445 - RNA, 21 nt, Homo sapiens
uguuugccacuugauggggcc

SEQ ID NO: 659446 - RNA, 20 nt, Homo sapiens
uguuugcuuaaacaaaguga

SEQ ID NO: 659447 - RNA, 16 nt, Homo sapiens
uguuuggaaaagacag

SEQ ID NO: 659448 - RNA, 23 nt, Homo sapiens
uguuuggaaauaaacugugcaau

SEQ ID NO: 659449 - RNA, 19 nt, Homo sapiens
uguuuggaacggcaaaaaa

SEQ ID NO: 659450 - RNA, 23 nt, Homo sapiens
uguuuggcuuauaaacacauuga

SEQ ID NO: 659451 - RNA, 16 nt, Homo sapiens
uguuugggggaaaaaa

SEQ ID NO: 659452 - RNA, 20 nt, Homo sapiens
uguuugguguuugucugugu

SEQ ID NO: 659453 - RNA, 14 nt, Homo sapiens
uguuugucuuccau

SEQ ID NO: 659454 - RNA, 23 nt, Homo sapiens
uguuugugacccugagaaggcaa

SEQ ID NO: 659455 - RNA, 15 nt, Homo sapiens
uguuuguugagugca

SEQ ID NO: 659456 - RNA, 13 nt, Homo sapiens
uguuuuaaguuua

SEQ ID NO: 659457 - RNA, 19 nt, Homo sapiens
uguuuuaauucaacccagc

SEQ ID NO: 659458 - RNA, 14 nt, Homo sapiens
uguuuuaguucuug

SEQ ID NO: 659459 - RNA, 19 nt, Homo sapiens
uguuuucaagaugguguua

SEQ ID NO: 659460 - RNA, 17 nt, Homo sapiens
uguuuucacuuguauug

SEQ ID NO: 659461 - RNA, 19 nt, Homo sapiens
uguuuucauaauaccucac

SEQ ID NO: 659462 - RNA, 14 nt, Homo sapiens
uguuuuccuauaau

SEQ ID NO: 659463 - RNA, 21 nt, Homo sapiens
uguuuucugacuaauuaggca

SEQ ID NO: 659464 - RNA, 17 nt, Homo sapiens
uguuuucugacuaggcu

SEQ ID NO: 659465 - RNA, 21 nt, Homo sapiens
uguuuucuguucccuugccau

SEQ ID NO: 659466 - RNA, 20 nt, Homo sapiens
uguuuucuugccaaugaggu

SEQ ID NO: 659467 - RNA, 15 nt, Homo sapiens
uguuuucuuugcaaa

SEQ ID NO: 659468 - RNA, 20 nt, Homo sapiens
uguuuugaaaguuuaacaaa

SEQ ID NO: 659469 - RNA, 16 nt, Homo sapiens
uguuuuuaaacuaaua

SEQ ID NO: 659470 - RNA, 14 nt, Homo sapiens
uguuuuuaaguccu

SEQ ID NO: 659471 - RNA, 12 nt, Homo sapiens
uguuuuuacuaa

SEQ ID NO: 659472 - RNA, 20 nt, Homo sapiens
uguuuuuagcugguggcaau

SEQ ID NO: 659473 - RNA, 12 nt, Homo sapiens
uguuuuugauaa

SEQ ID NO: 659474 - RNA, 14 nt, Homo sapiens
uguuuuugaucaaa

SEQ ID NO: 659475 - RNA, 15 nt, Homo sapiens
uguuuuuucuugcca

SEQ ID NO: 659476 - RNA, 12 nt, Homo sapiens
uguuuuuugcca

SEQ ID NO: 659477 - RNA, 22 nt, Homo sapiens
uguuuuuugccacagcuuuugc

SEQ ID NO: 659478 - RNA, 13 nt, Homo sapiens
uguuuuuuuccaa

SEQ ID NO: 659479 - RNA, 20 nt, Homo sapiens
uguuuuuuucccaaguguga

SEQ ID NO: 659480 - RNA, 13 nt, Homo sapiens
uguuuuuuuucag

SEQ ID NO: 659481 - RNA, 19 nt, Homo sapiens
uguuuuuuuuuuccacuua

SEQ ID NO: 659482 - RNA, 22 nt, Homo sapiens
uuaaaaaaaaaaagaacacagg

SEQ ID NO: 659483 - RNA, 16 nt, Homo sapiens
uuaaaaaaaaauuccc

SEQ ID NO: 659484 - RNA, 20 nt, Homo sapiens
uuaaaaaaaacaauuccaca

SEQ ID NO: 659485 - RNA, 22 nt, Homo sapiens
uuaaaaaacuauuuuauguuca

SEQ ID NO: 659486 - RNA, 22 nt, Homo sapiens
uuaaaaacaaaacacuaacaau

SEQ ID NO: 659487 - RNA, 17 nt, Homo sapiens
uuaaaaacaguuuucca

SEQ ID NO: 659488 - RNA, 21 nt, Homo sapiens
uuaaaaagccaguuuggguaa

SEQ ID NO: 659489 - RNA, 17 nt, Homo sapiens
uuaaaaauaaauucaaa

SEQ ID NO: 659490 - RNA, 15 nt, Homo sapiens
uuaaaaauacuucuc

SEQ ID NO: 659491 - RNA, 16 nt, Homo sapiens
uuaaaaaucuguaaau

SEQ ID NO: 659492 - RNA, 20 nt, Homo sapiens
uuaaaaaugucuugcuguug

SEQ ID NO: 659493 - RNA, 21 nt, Homo sapiens
uuaaaaauuguuaauuuuucc

SEQ ID NO: 659494 - RNA, 19 nt, Homo sapiens
uuaaaacaaaacaaaacaa

SEQ ID NO: 659495 - RNA, 14 nt, Homo sapiens
uuaaaacaaaagag

SEQ ID NO: 659496 - RNA, 20 nt, Homo sapiens
uuaaaacaaaggaacuaacu

SEQ ID NO: 659497 - RNA, 16 nt, Homo sapiens
uuaaaacacauaucaa

SEQ ID NO: 659498 - RNA, 13 nt, Homo sapiens
uuaaaacauuucu

SEQ ID NO: 659499 - RNA, 13 nt, Homo sapiens
uuaaaaccaaaga

SEQ ID NO: 659500 - RNA, 14 nt, Homo sapiens
uuaaaaccaaagag

SEQ ID NO: 659501 - RNA, 22 nt, Homo sapiens
uuaaaacuucaguuucacagaa

SEQ ID NO: 659502 - RNA, 21 nt, Homo sapiens
uuaaaagaaaucuugcuucag

SEQ ID NO: 659503 - RNA, 18 nt, Homo sapiens
uuaaaagaacucauucau

SEQ ID NO: 659504 - RNA, 17 nt, Homo sapiens
uuaaaagaauguaaaau

SEQ ID NO: 659505 - RNA, 17 nt, Homo sapiens
uuagaaacaccauucau

SEQ ID NO: 659506 - RNA, 19 nt, Homo sapiens
uuagaaacucaaaaacuga

SEQ ID NO: 659507 - RNA, 22 nt, Homo sapiens
uuagaaagcugacauugccaaa

SEQ ID NO: 659508 - RNA, 13 nt, Homo sapiens
uuagaaaggggug

SEQ ID NO: 659509 - RNA, 16 nt, Homo sapiens
uuagaaauacugcaag

SEQ ID NO: 659510 - RNA, 20 nt, Homo sapiens
uuagaaauauucuacuucuc

SEQ ID NO: 659511 - RNA, 21 nt, Homo sapiens
uuagaacaaaagaauaacauu

SEQ ID NO: 659512 - RNA, 12 nt, Homo sapiens
uuagaacuauua

SEQ ID NO: 659513 - RNA, 13 nt, Homo sapiens
uuagaagacauuu

SEQ ID NO: 659514 - RNA, 18 nt, Homo sapiens
uuagaagccaacuaugau

SEQ ID NO: 659515 - RNA, 16 nt, Homo sapiens
uuagaaggcuuaagaa

SEQ ID NO: 659516 - RNA, 18 nt, Homo sapiens
uuagaauaagaauuugca

SEQ ID NO: 659517 - RNA, 14 nt, Homo sapiens
uuagaauacaguuu

SEQ ID NO: 659518 - RNA, 21 nt, Homo sapiens
uuagaauaguguucugcaaaa

SEQ ID NO: 659519 - RNA, 17 nt, Homo sapiens
uuagaauccgaagggaa

SEQ ID NO: 659520 - RNA, 19 nt, Homo sapiens
uuagaauccgaagggaauu

SEQ ID NO: 659521 - RNA, 19 nt, Homo sapiens
uuagaauuaaaaaagcaua

SEQ ID NO: 659522 - RNA, 19 nt, Homo sapiens
uuagaccccauacaaguuu

SEQ ID NO: 659523 - RNA, 14 nt, Homo sapiens
uuagacuacauuua

SEQ ID NO: 659524 - RNA, 18 nt, Homo sapiens
uuagacucaucuuacugu

SEQ ID NO: 659525 - RNA, 22 nt, Homo sapiens
uuagagagauuggccagcaaaa

SEQ ID NO: 659526 - RNA, 18 nt, Homo sapiens
uuagagauuauaacaaau

SEQ ID NO: 659527 - RNA, 17 nt, Homo sapiens
uuagagauugccccaga

SEQ ID NO: 659528 - RNA, 16 nt, Homo sapiens
uuagaguaaugaaaug

SEQ ID NO: 659529 - RNA, 17 nt, Homo sapiens
uuagaguaaugaaaugg

SEQ ID NO: 659530 - RNA, 19 nt, Homo sapiens
uuagaguaaugaaauggag

SEQ ID NO: 659531 - RNA, 18 nt, Homo sapiens
uuagaguccuaguuuucc

SEQ ID NO: 659532 - RNA, 16 nt, Homo sapiens
uuagaguguagcugua

SEQ ID NO: 659533 - RNA, 19 nt, Homo sapiens
uuagaguguaggugaaaug

SEQ ID NO: 659534 - RNA, 18 nt, Homo sapiens
uuagaguugcaacuuaag

SEQ ID NO: 659535 - RNA, 16 nt, Homo sapiens
uuagauaauucuuaaa

SEQ ID NO: 659536 - RNA, 18 nt, Homo sapiens
uuagauagcccugaauuc

SEQ ID NO: 659537 - RNA, 21 nt, Homo sapiens
uuagauauuaggucccaucaa

SEQ ID NO: 659538 - RNA, 21 nt, Homo sapiens
uuagaugagggugacugucaa

SEQ ID NO: 659539 - RNA, 14 nt, Homo sapiens
uuagauuaguauuu

SEQ ID NO: 659540 - RNA, 20 nt, Homo sapiens
uuagcacagagagggacaca

SEQ ID NO: 659541 - RNA, 18 nt, Homo sapiens
uuagcacuauuuacauac

SEQ ID NO: 659542 - RNA, 12 nt, Homo sapiens
uuagcagacagg

SEQ ID NO: 659543 - RNA, 20 nt, Homo sapiens
uuagcagggauucucucauc

SEQ ID NO: 659544 - RNA, 23 nt, Homo sapiens
uuagcaguggcuggugcccauga

SEQ ID NO: 659545 - RNA, 13 nt, Homo sapiens
uuagccaaaggau

SEQ ID NO: 659546 - RNA, 17 nt, Homo sapiens
uuagccagguaauguga

SEQ ID NO: 659547 - RNA, 16 nt, Homo sapiens
uuagccauuucuccau

SEQ ID NO: 659548 - RNA, 22 nt, Homo sapiens
uuagccauuuuucaaagcaauu

SEQ ID NO: 659549 - RNA, 15 nt, Homo sapiens
uuagccugcaaacaa

SEQ ID NO: 659550 - RNA, 22 nt, Homo sapiens
uuagcuaccucacuaugcugcu

SEQ ID NO: 659551 - RNA, 23 nt, Homo sapiens
uuagcuaccucacuaugcugcuu

SEQ ID NO: 659552 - RNA, 20 nt, Homo sapiens
uuagcuccauaaaguacaaa

SEQ ID NO: 659553 - RNA, 14 nt, Homo sapiens
uuagcucuguggaa

SEQ ID NO: 659554 - RNA, 20 nt, Homo sapiens
uuagcugguggcaauaaaua

SEQ ID NO: 659555 - RNA, 15 nt, Homo sapiens
uuagcuggugucagc

SEQ ID NO: 659556 - RNA, 15 nt, Homo sapiens
uuagcuguacuauaa

SEQ ID NO: 659557 - RNA, 22 nt, Homo sapiens
uuagcugugcgcaauugcucau

SEQ ID NO: 659558 - RNA, 22 nt, Homo sapiens
uuaggaaauuuaagacuagaua

SEQ ID NO: 659559 - RNA, 13 nt, Homo sapiens
uuaggacuuucca

SEQ ID NO: 659560 - RNA, 23 nt, Homo sapiens
uuaggaguacugauagggguuca

SEQ ID NO: 659561 - RNA, 16 nt, Homo sapiens
uuaggauggggcuccc

SEQ ID NO: 659562 - RNA, 19 nt, Homo sapiens
uuaggauuuguuucuucuc

SEQ ID NO: 659563 - RNA, 18 nt, Homo sapiens
uuaggauuuucacauucu

SEQ ID NO: 659564 - RNA, 15 nt, Homo sapiens
uuaggcaaaguacaa

SEQ ID NO: 659565 - RNA, 20 nt, Homo sapiens
uuaggcaggaucuguacaau

SEQ ID NO: 659566 - RNA, 16 nt, Homo sapiens
uuaggccacauugaca

SEQ ID NO: 659567 - RNA, 16 nt, Homo sapiens
uuaggccauauauauu

SEQ ID NO: 659568 - RNA, 15 nt, Homo sapiens
uuaggcuauucacaa

SEQ ID NO: 659569 - RNA, 22 nt, Homo sapiens
uuagggagcagaugacugagaa

SEQ ID NO: 659570 - RNA, 12 nt, Homo sapiens
uuagggcacugg

SEQ ID NO: 659571 - RNA, 23 nt, Homo sapiens
uuagggcugaaucuucuggagaa

SEQ ID NO: 659572 - RNA, 16 nt, Homo sapiens
uuaggggaacccuguc

SEQ ID NO: 659573 - RNA, 20 nt, Homo sapiens
uuaggucccaucaauucuua

SEQ ID NO: 659574 - RNA, 11 nt, Homo sapiens
uuaggugcuga

SEQ ID NO: 659575 - RNA, 12 nt, Homo sapiens
uuagguugacau

SEQ ID NO: 659576 - RNA, 18 nt, Homo sapiens
uuagguugucuccaggcc

SEQ ID NO: 659577 - RNA, 12 nt, Homo sapiens
uuaguaauuucu

SEQ ID NO: 659578 - RNA, 14 nt, Homo sapiens
uuaguacacacuug

SEQ ID NO: 659579 - RNA, 18 nt, Homo sapiens
uuaguaguuuuuacaaaa

SEQ ID NO: 659580 - RNA, 15 nt, Homo sapiens
uuaguauaauauuuc

SEQ ID NO: 659581 - RNA, 16 nt, Homo sapiens
uuaguauucauucugc

SEQ ID NO: 659582 - RNA, 19 nt, Homo sapiens
uuaguauugcagccaaaga

SEQ ID NO: 659583 - RNA, 20 nt, Homo sapiens
uuaguauugcagccaaagaa

SEQ ID NO: 659584 - RNA, 14 nt, Homo sapiens
uuaguauuucacaa

SEQ ID NO: 659585 - RNA, 15 nt, Homo sapiens
uuagucacuaagacu

SEQ ID NO: 659586 - RNA, 22 nt, Homo sapiens
uuagucauugauagaacuacuu

SEQ ID NO: 659587 - RNA, 18 nt, Homo sapiens
uuagucgucuaaacauaa

SEQ ID NO: 659588 - RNA, 11 nt, Homo sapiens
uuagucuccca

SEQ ID NO: 659589 - RNA, 21 nt, Homo sapiens
uuagucuguuuucuaaagcca

SEQ ID NO: 659590 - RNA, 11 nt, Homo sapiens
uuagugcuugu

SEQ ID NO: 659591 - RNA, 19 nt, Homo sapiens
uuagugguuacccaguuag

SEQ ID NO: 659592 - RNA, 19 nt, Homo sapiens
uuagugugaauauuccuuu

SEQ ID NO: 659593 - RNA, 18 nt, Homo sapiens
uuaguguggcuaaccaag

SEQ ID NO: 659594 - RNA, 16 nt, Homo sapiens
uuaguguuuugccuca

SEQ ID NO: 659595 - RNA, 21 nt, Homo sapiens
uuaguuaaaaaaaaauucccu

SEQ ID NO: 659596 - RNA, 14 nt, Homo sapiens
uuaguucaauacag

SEQ ID NO: 659597 - RNA, 12 nt, Homo sapiens
uuaguugagggg

SEQ ID NO: 659598 - RNA, 13 nt, Homo sapiens
uuaguuggcugga

SEQ ID NO: 659599 - RNA, 16 nt, Homo sapiens
uuaguuuuauauugcu

SEQ ID NO: 659600 - RNA, 20 nt, Homo sapiens
uuaguuuugggaauaggcau

SEQ ID NO: 659601 - RNA, 16 nt, Homo sapiens
uuaguuuuugaucaag

SEQ ID NO: 659602 - RNA, 14 nt, Homo sapiens
uuauaaaaguuuau

SEQ ID NO: 659603 - RNA, 16 nt, Homo sapiens
uuauaaaauuaagcaa

SEQ ID NO: 659604 - RNA, 13 nt, Homo sapiens
uuauaaaccuuca

SEQ ID NO: 659605 - RNA, 14 nt, Homo sapiens
uuauaaacugagag

SEQ ID NO: 659606 - RNA, 21 nt, Homo sapiens
uuauaaacuuuagaguagcau

SEQ ID NO: 659607 - RNA, 15 nt, Homo sapiens
uuauaaagcagauua

SEQ ID NO: 659608 - RNA, 16 nt, Homo sapiens
uuauaaagucaaggac

SEQ ID NO: 659609 - RNA, 21 nt, Homo sapiens
uuauaaauuucgcuucuuaga

SEQ ID NO: 659610 - RNA, 14 nt, Homo sapiens
uuauaacagaauua

SEQ ID NO: 659611 - RNA, 18 nt, Homo sapiens
uuauaacccauauuuucc

SEQ ID NO: 659612 - RNA, 19 nt, Homo sapiens
uuauaacguguucaauauu

SEQ ID NO: 659613 - RNA, 17 nt, Homo sapiens
uuauaagacuacuauac

SEQ ID NO: 659614 - RNA, 14 nt, Homo sapiens
uuauaagcauuugu

SEQ ID NO: 659615 - RNA, 15 nt, Homo sapiens
uuauaauaaaaggaa

SEQ ID NO: 659616 - RNA, 21 nt, Homo sapiens
uuauaauucauugugauuuau

SEQ ID NO: 659617 - RNA, 18 nt, Homo sapiens
uuauaauuccuauauccu

SEQ ID NO: 659618 - RNA, 21 nt, Homo sapiens
uuauaauucuugaaugaggca

SEQ ID NO: 659619 - RNA, 18 nt, Homo sapiens
uuauaauuggugcauagc

SEQ ID NO: 659620 - RNA, 12 nt, Homo sapiens
uuauaauuugaa

SEQ ID NO: 659621 - RNA, 18 nt, Homo sapiens
uuauacaaaccuaccaaa

SEQ ID NO: 659622 - RNA, 21 nt, Homo sapiens
uuauacaucaccuuuuugacu

SEQ ID NO: 659623 - RNA, 13 nt, Homo sapiens
uuauacauuugau

SEQ ID NO: 659624 - RNA, 14 nt, Homo sapiens
uuauacuacuuugu

SEQ ID NO: 659625 - RNA, 13 nt, Homo sapiens
uuauacuguacaa

SEQ ID NO: 659626 - RNA, 14 nt, Homo sapiens
uuauacuguacaau

SEQ ID NO: 659627 - RNA, 14 nt, Homo sapiens
uuccagggaagcaa

SEQ ID NO: 659628 - RNA, 14 nt, Homo sapiens
uuccaggguugcuu

SEQ ID NO: 659629 - RNA, 22 nt, Homo sapiens
uuccagguagcucggcaccaac

SEQ ID NO: 659630 - RNA, 23 nt, Homo sapiens
uuccagguagcucggcaccaacu

SEQ ID NO: 659631 - RNA, 14 nt, Homo sapiens
uuccaguacuuccu

SEQ ID NO: 659632 - RNA, 16 nt, Homo sapiens
uuccagucuacuugag

SEQ ID NO: 659633 - RNA, 15 nt, Homo sapiens
uuccaguuaaccuau

SEQ ID NO: 659634 - RNA, 16 nt, Homo sapiens
uuccaguuauaaauau

SEQ ID NO: 659635 - RNA, 21 nt, Homo sapiens
uuccauaagcuuggugacaaa

SEQ ID NO: 659636 - RNA, 19 nt, Homo sapiens
uuccauaaucuggacuccu

SEQ ID NO: 659637 - RNA, 17 nt, Homo sapiens
uuccauaaugcuacugu

SEQ ID NO: 659638 - RNA, 16 nt, Homo sapiens
uuccauacuucucuca

SEQ ID NO: 659639 - RNA, 18 nt, Homo sapiens
uuccauaggacauacugc

SEQ ID NO: 659640 - RNA, 14 nt, Homo sapiens
uuccauauucugua

SEQ ID NO: 659641 - RNA, 17 nt, Homo sapiens
uuccaucagcccaucuc

SEQ ID NO: 659642 - RNA, 18 nt, Homo sapiens
uuccaugaauucuugauu

SEQ ID NO: 659643 - RNA, 22 nt, Homo sapiens
uuccauguaucuuuugaacugg

SEQ ID NO: 659644 - RNA, 23 nt, Homo sapiens
uuccaugucagauaaguguaaau

SEQ ID NO: 659645 - RNA, 17 nt, Homo sapiens
uuccaugucaggccagc

SEQ ID NO: 659646 - RNA, 16 nt, Homo sapiens
uuccauucacaccagc

SEQ ID NO: 659647 - RNA, 16 nt, Homo sapiens
uuccauugccuagcuc

SEQ ID NO: 659648 - RNA, 18 nt, Homo sapiens
uuccauuuccaagcacuu

SEQ ID NO: 659649 - RNA, 22 nt, Homo sapiens
uuccauuugaaccagugaucca

SEQ ID NO: 659650 - RNA, 19 nt, Homo sapiens
uuccauuugaagcagugau

SEQ ID NO: 659651 - RNA, 16 nt, Homo sapiens
uuccauuugcaaggga

SEQ ID NO: 659652 - RNA, 16 nt, Homo sapiens
uuccauuuuaugcaga

SEQ ID NO: 659653 - RNA, 14 nt, Homo sapiens
uucccaaaacugau

SEQ ID NO: 659654 - RNA, 14 nt, Homo sapiens
uucccaaauguauu

SEQ ID NO: 659655 - RNA, 13 nt, Homo sapiens
uucccacacuguc

SEQ ID NO: 659656 - RNA, 15 nt, Homo sapiens
uucccacacugucca

SEQ ID NO: 659657 - RNA, 14 nt, Homo sapiens
uucccaccaauuug

SEQ ID NO: 659658 - RNA, 13 nt, Homo sapiens
uucccacgaggaa

SEQ ID NO: 659659 - RNA, 21 nt, Homo sapiens
uucccagagcacuuugcaacu

SEQ ID NO: 659660 - RNA, 16 nt, Homo sapiens
uucccagcaacacucc

SEQ ID NO: 659661 - RNA, 16 nt, Homo sapiens
uucccaggcccacugu

SEQ ID NO: 659662 - RNA, 20 nt, Homo sapiens
uucccaguggucaaaccgca

SEQ ID NO: 659663 - RNA, 17 nt, Homo sapiens
uucccauaguggggccu

SEQ ID NO: 659664 - RNA, 20 nt, Homo sapiens
uucccaucuuccaaggguac

SEQ ID NO: 659665 - RNA, 18 nt, Homo sapiens
uucccaucuuuacuccca

SEQ ID NO: 659666 - RNA, 13 nt, Homo sapiens
uucccaugacugc

SEQ ID NO: 659667 - RNA, 16 nt, Homo sapiens
uucccauuugugccag

SEQ ID NO: 659668 - RNA, 17 nt, Homo sapiens
uucccauuuuugcuuag

SEQ ID NO: 659669 - RNA, 20 nt, Homo sapiens
uuccccaacagggcaacugu

SEQ ID NO: 659670 - RNA, 15 nt, Homo sapiens
uuccccaaccacaga

SEQ ID NO: 659671 - RNA, 17 nt, Homo sapiens
uuccccaagaaggugag

SEQ ID NO: 659672 - RNA, 15 nt, Homo sapiens
uuccccacugcacac

SEQ ID NO: 659673 - RNA, 21 nt, Homo sapiens
uuccccagcgucccagucucu

SEQ ID NO: 659674 - RNA, 14 nt, Homo sapiens
uucccccacuacuu

SEQ ID NO: 659675 - RNA, 13 nt, Homo sapiens
uucccccacugau

SEQ ID NO: 659676 - RNA, 15 nt, Homo sapiens
uucccccaguaccuc

SEQ ID NO: 659677 - RNA, 16 nt, Homo sapiens
uucccccugcaaaaag

SEQ ID NO: 659678 - RNA, 22 nt, Homo sapiens
uuccccgcccccaaccccagca

SEQ ID NO: 659679 - RNA, 14 nt, Homo sapiens
uuccccucacuauc

SEQ ID NO: 659680 - RNA, 19 nt, Homo sapiens
uuccccucccuggguucag

SEQ ID NO: 659681 - RNA, 12 nt, Homo sapiens
uuccccucugcu

SEQ ID NO: 659682 - RNA, 15 nt, Homo sapiens
uuccccuggccucag

SEQ ID NO: 659683 - RNA, 17 nt, Homo sapiens
uuccccugugucauccc

SEQ ID NO: 659684 - RNA, 19 nt, Homo sapiens
uuccccuuuucccaaccug

SEQ ID NO: 659685 - RNA, 18 nt, Homo sapiens
uucccgcacaaauuccac

SEQ ID NO: 659686 - RNA, 20 nt, Homo sapiens
uucccgcacaaauuccacau

SEQ ID NO: 659687 - RNA, 19 nt, Homo sapiens
uucccggcgucccuaccuc

SEQ ID NO: 659688 - RNA, 18 nt, Homo sapiens
uucccgggcuguccacua

SEQ ID NO: 659689 - RNA, 14 nt, Homo sapiens
uucccuaaacugca

SEQ ID NO: 659690 - RNA, 19 nt, Homo sapiens
uucccuacuuccugugacu

SEQ ID NO: 659691 - RNA, 12 nt, Homo sapiens
uucccuagcuuu

SEQ ID NO: 659692 - RNA, 23 nt, Homo sapiens
uucccuaggaaacucacacuccc

SEQ ID NO: 659693 - RNA, 19 nt, Homo sapiens
uucccuaugcuacccuuaa

SEQ ID NO: 659694 - RNA, 17 nt, Homo sapiens
uucccucagauuuccau

SEQ ID NO: 659695 - RNA, 14 nt, Homo sapiens
uucccuccugcuuu

SEQ ID NO: 659696 - RNA, 19 nt, Homo sapiens
uucccucucaugacuugca

SEQ ID NO: 659697 - RNA, 18 nt, Homo sapiens
uucccucucccaguccau

SEQ ID NO: 659698 - RNA, 23 nt, Homo sapiens
uucccugcuuccaggaaacucca

SEQ ID NO: 659699 - RNA, 20 nt, Homo sapiens
uucccuggggaaaacuugca

SEQ ID NO: 659700 - RNA, 18 nt, Homo sapiens
uucccuggugccaccagc

SEQ ID NO: 659701 - RNA, 21 nt, Homo sapiens
uucccugucacuacacacuaa

SEQ ID NO: 659702 - RNA, 20 nt, Homo sapiens
uucccugucagccugacucu

SEQ ID NO: 659703 - RNA, 19 nt, Homo sapiens
uucccuuccaguuccggga

SEQ ID NO: 659704 - RNA, 14 nt, Homo sapiens
uucccuuccuccau

SEQ ID NO: 659705 - RNA, 23 nt, Homo sapiens
uucccuucuuucaggaauacuug

SEQ ID NO: 659706 - RNA, 18 nt, Homo sapiens
uucccuuggauguagucu

SEQ ID NO: 659707 - RNA, 17 nt, Homo sapiens
uucccuuucacuggcau

SEQ ID NO: 659708 - RNA, 15 nt, Homo sapiens
uucccuuugugcaca

SEQ ID NO: 659709 - RNA, 13 nt, Homo sapiens
uuccgcagcucag

SEQ ID NO: 659710 - RNA, 14 nt, Homo sapiens
uuccgccacuccag

SEQ ID NO: 659711 - RNA, 15 nt, Homo sapiens
uuccgccacuccagu

SEQ ID NO: 659712 - RNA, 12 nt, Homo sapiens
uuccgccuccag

SEQ ID NO: 659713 - RNA, 21 nt, Homo sapiens
uuccgcgcccagcgcucgcca

SEQ ID NO: 659714 - RNA, 12 nt, Homo sapiens
uuccguaucucc

SEQ ID NO: 659715 - RNA, 21 nt, Homo sapiens
uuccgucaccacgacuggcca

SEQ ID NO: 659716 - RNA, 11 nt, Homo sapiens
uuccuaaacau

SEQ ID NO: 659717 - RNA, 14 nt, Homo sapiens
uuccuaaacccaau

SEQ ID NO: 659718 - RNA, 14 nt, Homo sapiens
uuccuaaagccaaa

SEQ ID NO: 659719 - RNA, 17 nt, Homo sapiens
uuccuaacuagaauuag

SEQ ID NO: 659720 - RNA, 13 nt, Homo sapiens
uuccuaaggcaug

SEQ ID NO: 659721 - RNA, 15 nt, Homo sapiens
uuccuaauaugaucu

SEQ ID NO: 659722 - RNA, 16 nt, Homo sapiens
uuccuaauaugcuuua

SEQ ID NO: 659723 - RNA, 22 nt, Homo sapiens
uuccuacacguuagauuugccg

SEQ ID NO: 659724 - RNA, 16 nt, Homo sapiens
uuccuaccucugguga

SEQ ID NO: 659725 - RNA, 18 nt, Homo sapiens
uuccuacuccguuccugg

SEQ ID NO: 659726 - RNA, 22 nt, Homo sapiens
uuccuagcaccgcuuauccccu

SEQ ID NO: 659727 - RNA, 24 nt, Homo sapiens
uuccuaugaaguuggcacauuuca

SEQ ID NO: 659728 - RNA, 12 nt, Homo sapiens
uuccuaugcaaa

SEQ ID NO: 659729 - RNA, 15 nt, Homo sapiens
uuccuauguaacugc

SEQ ID NO: 659730 - RNA, 16 nt, Homo sapiens
uuccuauguaacugca

SEQ ID NO: 659731 - RNA, 19 nt, Homo sapiens
uuccuauuuguuuucaugg

SEQ ID NO: 659732 - RNA, 13 nt, Homo sapiens
uuccucacucaga

SEQ ID NO: 659733 - RNA, 12 nt, Homo sapiens
uuccucacugcc

SEQ ID NO: 659734 - RNA, 17 nt, Homo sapiens
uuccucagauggacaag

SEQ ID NO: 659735 - RNA, 23 nt, Homo sapiens
uuccucagauugcugaaucccau

SEQ ID NO: 659736 - RNA, 15 nt, Homo sapiens
uuccucaucaccauc

SEQ ID NO: 659737 - RNA, 17 nt, Homo sapiens
uuccucauccuuucccu

SEQ ID NO: 659738 - RNA, 14 nt, Homo sapiens
uuccucauuaguaa

SEQ ID NO: 659739 - RNA, 20 nt, Homo sapiens
uuccuccaagcuauucaauu

SEQ ID NO: 659740 - RNA, 23 nt, Homo sapiens
uuccuccacugcgcuuacuccuc

SEQ ID NO: 659741 - RNA, 17 nt, Homo sapiens
uuccuccccacacucca

SEQ ID NO: 659742 - RNA, 18 nt, Homo sapiens
uuccuccuccaucaccug

SEQ ID NO: 659743 - RNA, 18 nt, Homo sapiens
uuccuccucgcugccaga

SEQ ID NO: 659744 - RNA, 18 nt, Homo sapiens
uuccuccuuuaccuuuca

SEQ ID NO: 659745 - RNA, 19 nt, Homo sapiens
uuccucgaaguucuaggaa

SEQ ID NO: 659746 - RNA, 14 nt, Homo sapiens
uuccucgccugaca

SEQ ID NO: 659747 - RNA, 18 nt, Homo sapiens
uuccucucucuaccaguc

SEQ ID NO: 659748 - RNA, 20 nt, Homo sapiens
uuccucucucuaccagucua

SEQ ID NO: 659749 - RNA, 19 nt, Homo sapiens
uugaagucagccacacugg

SEQ ID NO: 659750 - RNA, 13 nt, Homo sapiens
uugaagugcacau

SEQ ID NO: 659751 - RNA, 19 nt, Homo sapiens
uugaagugucuucuguucc

SEQ ID NO: 659752 - RNA, 13 nt, Homo sapiens
uugaaguuuacaa

SEQ ID NO: 659753 - RNA, 21 nt, Homo sapiens
uugaauagaucuuuauaaccu

SEQ ID NO: 659754 - RNA, 20 nt, Homo sapiens
uugaauagauuuucucugga

SEQ ID NO: 659755 - RNA, 13 nt, Homo sapiens
uugaauagucuca

SEQ ID NO: 659756 - RNA, 18 nt, Homo sapiens
uugaaucugaaucagcca

SEQ ID NO: 659757 - RNA, 22 nt, Homo sapiens
uugaaucuucucccuuguccug

SEQ ID NO: 659758 - RNA, 15 nt, Homo sapiens
uugaaugaacuaguu

SEQ ID NO: 659759 - RNA, 14 nt, Homo sapiens
uugaaugcugccag

SEQ ID NO: 659760 - RNA, 21 nt, Homo sapiens
uugaauggagauucugauuca

SEQ ID NO: 659761 - RNA, 15 nt, Homo sapiens
uugaauuaccauaga

SEQ ID NO: 659762 - RNA, 12 nt, Homo sapiens
uugaauucuuga

SEQ ID NO: 659763 - RNA, 16 nt, Homo sapiens
uugaauucuugauaaa

SEQ ID NO: 659764 - RNA, 19 nt, Homo sapiens
uugaauugaugaugcaguu

SEQ ID NO: 659765 - RNA, 11 nt, Homo sapiens
uugaauuugca

SEQ ID NO: 659766 - RNA, 17 nt, Homo sapiens
uugacaacugcacauga

SEQ ID NO: 659767 - RNA, 20 nt, Homo sapiens
uugacacauaugaacacaga

SEQ ID NO: 659768 - RNA, 11 nt, Homo sapiens
uugacaccugc

SEQ ID NO: 659769 - RNA, 18 nt, Homo sapiens
uugacacugaaaguuuug

SEQ ID NO: 659770 - RNA, 22 nt, Homo sapiens
uugacacuuuucauaucauuuc

SEQ ID NO: 659771 - RNA, 15 nt, Homo sapiens
uugacagcaucauaa

SEQ ID NO: 659772 - RNA, 19 nt, Homo sapiens
uugacaguucauauguacc

SEQ ID NO: 659773 - RNA, 19 nt, Homo sapiens
uugacauaccuaccaguau

SEQ ID NO: 659774 - RNA, 21 nt, Homo sapiens
uugacauaggcaauaauaagu

SEQ ID NO: 659775 - RNA, 14 nt, Homo sapiens
uugacaucauucau

SEQ ID NO: 659776 - RNA, 17 nt, Homo sapiens
uugacaugauauacaau

SEQ ID NO: 659777 - RNA, 13 nt, Homo sapiens
uugacaugugcaa

SEQ ID NO: 659778 - RNA, 11 nt, Homo sapiens
uugacauuccu

SEQ ID NO: 659779 - RNA, 18 nt, Homo sapiens
uugaccaagaacugcaug

SEQ ID NO: 659780 - RNA, 12 nt, Homo sapiens
uugaccacagag

SEQ ID NO: 659781 - RNA, 18 nt, Homo sapiens
uugaccggaucuacaccc

SEQ ID NO: 659782 - RNA, 21 nt, Homo sapiens
uugaccucuauaaacuucaga

SEQ ID NO: 659783 - RNA, 19 nt, Homo sapiens
uugacguuucuucuuucua

SEQ ID NO: 659784 - RNA, 20 nt, Homo sapiens
uugacguuucuucuuucuag

SEQ ID NO: 659785 - RNA, 13 nt, Homo sapiens
uugacucaguucc

SEQ ID NO: 659786 - RNA, 17 nt, Homo sapiens
uugacuucgacugugac

SEQ ID NO: 659787 - RNA, 17 nt, Homo sapiens
uugagaaagccuucaua

SEQ ID NO: 659788 - RNA, 14 nt, Homo sapiens
uugagacaggagac

SEQ ID NO: 659789 - RNA, 12 nt, Homo sapiens
uugagacauuua

SEQ ID NO: 659790 - RNA, 22 nt, Homo sapiens
uugagaccuaaucucuguaaag

SEQ ID NO: 659791 - RNA, 22 nt, Homo sapiens
uugagacggggucuggcugugu

SEQ ID NO: 659792 - RNA, 15 nt, Homo sapiens
uugagacugauucag

SEQ ID NO: 659793 - RNA, 18 nt, Homo sapiens
uugagaguugcuggugua

SEQ ID NO: 659794 - RNA, 17 nt, Homo sapiens
uugagaugccuguugaa

SEQ ID NO: 659795 - RNA, 22 nt, Homo sapiens
uugagcacacuuuacacaagaa

SEQ ID NO: 659796 - RNA, 19 nt, Homo sapiens
uugagcagaagaucaagga

SEQ ID NO: 659797 - RNA, 20 nt, Homo sapiens
uugagcaguggcugguccag

SEQ ID NO: 659798 - RNA, 22 nt, Homo sapiens
uugagcaguggcugguccaggg

SEQ ID NO: 659799 - RNA, 17 nt, Homo sapiens
uugagcaguuagcucau

SEQ ID NO: 659800 - RNA, 18 nt, Homo sapiens
uugagccaguggugcuaa

SEQ ID NO: 659801 - RNA, 18 nt, Homo sapiens
uugagcccacaaagccuu

SEQ ID NO: 659802 - RNA, 18 nt, Homo sapiens
uugagcccaggaguucaa

SEQ ID NO: 659803 - RNA, 20 nt, Homo sapiens
uugagccugcaucuucuugc

SEQ ID NO: 659804 - RNA, 14 nt, Homo sapiens
uugagcuacaguag

SEQ ID NO: 659805 - RNA, 23 nt, Homo sapiens
uugagcuacuucaaaugugguau

SEQ ID NO: 659806 - RNA, 20 nt, Homo sapiens
uugagcucaggaguuugaga

SEQ ID NO: 659807 - RNA, 17 nt, Homo sapiens
uugagcucuucuuaaag

SEQ ID NO: 659808 - RNA, 16 nt, Homo sapiens
uugagcugagugcuga

SEQ ID NO: 659809 - RNA, 18 nt, Homo sapiens
uugagcugagugcugaaa

SEQ ID NO: 659810 - RNA, 10 nt, Homo sapiens
uugagcugca

SEQ ID NO: 659811 - RNA, 21 nt, Homo sapiens
uugagcuucauauaccagcaa

SEQ ID NO: 659812 - RNA, 22 nt, Homo sapiens
uugaggaaguggcugucccugu

SEQ ID NO: 659813 - RNA, 21 nt, Homo sapiens
uugaggacaaccauuccagac

SEQ ID NO: 659814 - RNA, 12 nt, Homo sapiens
uugaggagcauu

SEQ ID NO: 659815 - RNA, 17 nt, Homo sapiens
uugaggagcugcacuga

SEQ ID NO: 659816 - RNA, 16 nt, Homo sapiens
uugaggauuguggaaa

SEQ ID NO: 659817 - RNA, 14 nt, Homo sapiens
uugaggcaggagga

SEQ ID NO: 659818 - RNA, 20 nt, Homo sapiens
uugaggccaagaauauugca

SEQ ID NO: 659819 - RNA, 19 nt, Homo sapiens
uugaggccuuuuuugccag

SEQ ID NO: 659820 - RNA, 15 nt, Homo sapiens
uugagggccagugau

SEQ ID NO: 659821 - RNA, 18 nt, Homo sapiens
uugaggggcccuggccag

SEQ ID NO: 659822 - RNA, 18 nt, Homo sapiens
uugaggggcugacuucaa

SEQ ID NO: 659823 - RNA, 23 nt, Homo sapiens
uugaggucaaguaagaagacaug

SEQ ID NO: 659824 - RNA, 16 nt, Homo sapiens
uugaggugaaaugggg

SEQ ID NO: 659825 - RNA, 19 nt, Homo sapiens
uugagguucucuauauucg

SEQ ID NO: 659826 - RNA, 20 nt, Homo sapiens
uugaguaucccuuauccaaa

SEQ ID NO: 659827 - RNA, 22 nt, Homo sapiens
uugagugugauuugaaugauuu

SEQ ID NO: 659828 - RNA, 21 nt, Homo sapiens
uugaguuguuuggaugauuaa

SEQ ID NO: 659829 - RNA, 16 nt, Homo sapiens
uugaguuuguaauuaa

SEQ ID NO: 659830 - RNA, 22 nt, Homo sapiens
uugauaaaguaauaaugugcaa

SEQ ID NO: 659831 - RNA, 22 nt, Homo sapiens
uugauaaaugacacaaugaagu

SEQ ID NO: 659832 - RNA, 22 nt, Homo sapiens
uugauaagaggaauuugguaua

SEQ ID NO: 659833 - RNA, 15 nt, Homo sapiens
uugauaagcacauua

SEQ ID NO: 659834 - RNA, 15 nt, Homo sapiens
uugauaauacuugac

SEQ ID NO: 659835 - RNA, 14 nt, Homo sapiens
uugauacaaaguac

SEQ ID NO: 659836 - RNA, 11 nt, Homo sapiens
uugauacaugc

SEQ ID NO: 659837 - RNA, 17 nt, Homo sapiens
uugauagaaccauugca

SEQ ID NO: 659838 - RNA, 16 nt, Homo sapiens
uugauaguuuggcuau

SEQ ID NO: 659839 - RNA, 17 nt, Homo sapiens
uugauauaaucuuucaa

SEQ ID NO: 659840 - RNA, 18 nt, Homo sapiens
uugauaucucaaucugca

SEQ ID NO: 659841 - RNA, 20 nt, Homo sapiens
uugauauguaaguacuucca

SEQ ID NO: 659842 - RNA, 19 nt, Homo sapiens
uugauauugccacccucca

SEQ ID NO: 659843 - RNA, 17 nt, Homo sapiens
uugauauuuuccaaaug

SEQ ID NO: 659844 - RNA, 19 nt, Homo sapiens
uugauauuuuccaaaugga

SEQ ID NO: 659845 - RNA, 17 nt, Homo sapiens
uugauauuuuuucucuc

SEQ ID NO: 659846 - RNA, 18 nt, Homo sapiens
uugaucaagaaugcaaua

SEQ ID NO: 659847 - RNA, 13 nt, Homo sapiens
uugaucagacagc

SEQ ID NO: 659848 - RNA, 15 nt, Homo sapiens
uugaucauuucugcc

SEQ ID NO: 659849 - RNA, 14 nt, Homo sapiens
uugauccaggagau

SEQ ID NO: 659850 - RNA, 20 nt, Homo sapiens
uugaucccuguuacccagag

SEQ ID NO: 659851 - RNA, 17 nt, Homo sapiens
uugaucuuugagcccau

SEQ ID NO: 659852 - RNA, 21 nt, Homo sapiens
uugaucuuuugcuaaugcaau

SEQ ID NO: 659853 - RNA, 20 nt, Homo sapiens
uugaucuuuuuuaauucagu

SEQ ID NO: 659854 - RNA, 12 nt, Homo sapiens
uugaugaugcag

SEQ ID NO: 659855 - RNA, 16 nt, Homo sapiens
uugaugaugcaguuuu

SEQ ID NO: 659856 - RNA, 19 nt, Homo sapiens
uugaugggugcugcccuca

SEQ ID NO: 659857 - RNA, 23 nt, Homo sapiens
uugauguauauaucuauuauuca

SEQ ID NO: 659858 - RNA, 18 nt, Homo sapiens
uugauguuuuacgugcaa

SEQ ID NO: 659859 - RNA, 19 nt, Homo sapiens
uugauguuuuacgugcaaa

SEQ ID NO: 659860 - RNA, 20 nt, Homo sapiens
uugauuccugguuugacuca

SEQ ID NO: 659861 - RNA, 14 nt, Homo sapiens
uugauucugauaau

SEQ ID NO: 659862 - RNA, 21 nt, Homo sapiens
uugauugaggagcugcacuga

SEQ ID NO: 659863 - RNA, 19 nt, Homo sapiens
uugauugucagcuacuaau

SEQ ID NO: 659864 - RNA, 19 nt, Homo sapiens
uugauuugcauggauuuug

SEQ ID NO: 659865 - RNA, 15 nt, Homo sapiens
uugauuuuaaugaau

SEQ ID NO: 659866 - RNA, 21 nt, Homo sapiens
uugauuuuauuuuuucucugu

SEQ ID NO: 659867 - RNA, 14 nt, Homo sapiens
uugauuuugugaua

SEQ ID NO: 659868 - RNA, 16 nt, Homo sapiens
uugauuuuugaaguug

SEQ ID NO: 659869 - RNA, 21 nt, Homo sapiens
uugcaaaaugagacuuucuaa

SEQ ID NO: 659870 - RNA, 18 nt, Homo sapiens
uugcaaacccaacuaagc

SEQ ID NO: 659871 - RNA, 12 nt, Homo sapiens
aacaacuguggu

SEQ ID NO: 659872 - RNA, 15 nt, Homo sapiens
aacaacuuacacuua

SEQ ID NO: 659873 - RNA, 14 nt, Homo sapiens
aacaacuuggcauu

SEQ ID NO: 659874 - RNA, 16 nt, Homo sapiens
aacaagaaaguggucu

SEQ ID NO: 659875 - RNA, 14 nt, Homo sapiens
aacaagaauuggaa

SEQ ID NO: 659876 - RNA, 20 nt, Homo sapiens
aacaagacuccucaucauga

SEQ ID NO: 659877 - RNA, 14 nt, Homo sapiens
aacaagauggagau

SEQ ID NO: 659878 - RNA, 14 nt, Homo sapiens
aacaagauuuccac

SEQ ID NO: 659879 - RNA, 14 nt, Homo sapiens
aacaagcauuucaa

SEQ ID NO: 659880 - RNA, 22 nt, Homo sapiens
aacaagccaacgacaaagccaa

SEQ ID NO: 659881 - RNA, 14 nt, Homo sapiens
aacaaggucugcuc

SEQ ID NO: 659882 - RNA, 19 nt, Homo sapiens
aacaaggugucuuuuccac

SEQ ID NO: 659883 - RNA, 22 nt, Homo sapiens
aacaaguauauaauuuacuuug

SEQ ID NO: 659884 - RNA, 17 nt, Homo sapiens
aacaagucccuuuaugc

SEQ ID NO: 659885 - RNA, 17 nt, Homo sapiens
aacaaguuuuucuguca

SEQ ID NO: 659886 - RNA, 14 nt, Homo sapiens
aacaauaaaauguc

SEQ ID NO: 659887 - RNA, 15 nt, Homo sapiens
aacaauaaaaugucu

SEQ ID NO: 659888 - RNA, 18 nt, Homo sapiens
aacaauaacgauacaaau

SEQ ID NO: 659889 - RNA, 21 nt, Homo sapiens
aacaauacaugcugcuaauuc

SEQ ID NO: 659890 - RNA, 22 nt, Homo sapiens
aacaauaguucuuagcuuugaa

SEQ ID NO: 659891 - RNA, 23 nt, Homo sapiens
aacaauauuguauacuaccauag

SEQ ID NO: 659892 - RNA, 13 nt, Homo sapiens
aacaauccauuca

SEQ ID NO: 659893 - RNA, 22 nt, Homo sapiens
aacaaucuaauuaaauggcauc

SEQ ID NO: 659894 - RNA, 20 nt, Homo sapiens
aacaaucuauggcuuauuuc

SEQ ID NO: 659895 - RNA, 16 nt, Homo sapiens
aacaauucaguggucu

SEQ ID NO: 659896 - RNA, 22 nt, Homo sapiens
aacaauuccaaaggaaucucca

SEQ ID NO: 659897 - RNA, 13 nt, Homo sapiens
aacaauuccacac

SEQ ID NO: 659898 - RNA, 15 nt, Homo sapiens
aacaauucugugaca

SEQ ID NO: 659899 - RNA, 16 nt, Homo sapiens
aacaauugcaacagaa

SEQ ID NO: 659900 - RNA, 18 nt, Homo sapiens
aacaauuuuuuugaaucu

SEQ ID NO: 659901 - RNA, 15 nt, Homo sapiens
aacacaaaacauuca

SEQ ID NO: 659902 - RNA, 16 nt, Homo sapiens
aacacaaacaucauuu

SEQ ID NO: 659903 - RNA, 14 nt, Homo sapiens
aacacaauaugaau

SEQ ID NO: 659904 - RNA, 15 nt, Homo sapiens
aacacacacauauac

SEQ ID NO: 659905 - RNA, 20 nt, Homo sapiens
aacacacagauuugagcuca

SEQ ID NO: 659906 - RNA, 21 nt, Homo sapiens
aacacacaggugcaacagacu

SEQ ID NO: 659907 - RNA, 23 nt, Homo sapiens
aacacagagaagcggauuuccag

SEQ ID NO: 659908 - RNA, 19 nt, Homo sapiens
aacacagcaacaaugacuu

SEQ ID NO: 659909 - RNA, 20 nt, Homo sapiens
aacacagcaacaaugacuua

SEQ ID NO: 659910 - RNA, 18 nt, Homo sapiens
aacacagcaugugccaag

SEQ ID NO: 659911 - RNA, 20 nt, Homo sapiens
aacacaggcaaguccacccc

SEQ ID NO: 659912 - RNA, 16 nt, Homo sapiens
aacacauacaaaagaa

SEQ ID NO: 659913 - RNA, 11 nt, Homo sapiens
aacacaucugg

SEQ ID NO: 659914 - RNA, 19 nt, Homo sapiens
aacacauguucugugccug

SEQ ID NO: 659915 - RNA, 14 nt, Homo sapiens
aacaccacagacac

SEQ ID NO: 659916 - RNA, 20 nt, Homo sapiens
aacaccaggagagcuucucc

SEQ ID NO: 659917 - RNA, 22 nt, Homo sapiens
aacacccuuucaucucagaguc

SEQ ID NO: 659918 - RNA, 18 nt, Homo sapiens
aacaccgcuucugccuuu

SEQ ID NO: 659919 - RNA, 19 nt, Homo sapiens
aacaccgcuucugccuuuu

SEQ ID NO: 659920 - RNA, 20 nt, Homo sapiens
aacaccgucccagggcucug

SEQ ID NO: 659921 - RNA, 13 nt, Homo sapiens
aacaccuaugcaa

SEQ ID NO: 659922 - RNA, 12 nt, Homo sapiens
aacaccugccuc

SEQ ID NO: 659923 - RNA, 21 nt, Homo sapiens
aacaccuucucuggagccaag

SEQ ID NO: 659924 - RNA, 22 nt, Homo sapiens
aacaccuuuccuuaugucuccu

SEQ ID NO: 659925 - RNA, 16 nt, Homo sapiens
aacacgcguauuuaca

SEQ ID NO: 659926 - RNA, 23 nt, Homo sapiens
aacacguguuccgguggcagauu

SEQ ID NO: 659927 - RNA, 13 nt, Homo sapiens
aacacuaccucuu

SEQ ID NO: 659928 - RNA, 22 nt, Homo sapiens
aacacuacugcuaaauccucau

SEQ ID NO: 659929 - RNA, 23 nt, Homo sapiens
aacacuagagaccaaaaagggga

SEQ ID NO: 659930 - RNA, 18 nt, Homo sapiens
aacacuagagucugucau

SEQ ID NO: 659931 - RNA, 12 nt, Homo sapiens
aacacuccucua

SEQ ID NO: 659932 - RNA, 17 nt, Homo sapiens
aacacucuucuugagca

SEQ ID NO: 659933 - RNA, 22 nt, Homo sapiens
aacacugaaaaaauacuaccua

SEQ ID NO: 659934 - RNA, 10 nt, Homo sapiens
aacacugcug

SEQ ID NO: 659935 - RNA, 13 nt, Homo sapiens
aacacugcugcuc

SEQ ID NO: 659936 - RNA, 18 nt, Homo sapiens
aacacuggaacauuccag

SEQ ID NO: 659937 - RNA, 11 nt, Homo sapiens
aacacuggcau

SEQ ID NO: 659938 - RNA, 13 nt, Homo sapiens
aacacugugcaaa

SEQ ID NO: 659939 - RNA, 22 nt, Homo sapiens
aacacuucguucgcagagcuuu

SEQ ID NO: 659940 - RNA, 14 nt, Homo sapiens
aacacuucucauca

SEQ ID NO: 659941 - RNA, 15 nt, Homo sapiens
aacacuuggugagua

SEQ ID NO: 659942 - RNA, 22 nt, Homo sapiens
aacacuuuacaauguucauccc

SEQ ID NO: 659943 - RNA, 14 nt, Homo sapiens
aacacuuucauccg

SEQ ID NO: 659944 - RNA, 16 nt, Homo sapiens
aacacuuugagcauuu

SEQ ID NO: 659945 - RNA, 18 nt, Homo sapiens
aacagaaaacaucccacu

SEQ ID NO: 659946 - RNA, 15 nt, Homo sapiens
aacagaaacaugcca

SEQ ID NO: 659947 - RNA, 22 nt, Homo sapiens
aacagaaagccugggugacauu

SEQ ID NO: 659948 - RNA, 13 nt, Homo sapiens
aacagaagccuga

SEQ ID NO: 659949 - RNA, 14 nt, Homo sapiens
aacagaagcuucca

SEQ ID NO: 659950 - RNA, 16 nt, Homo sapiens
aacagaagcuuccauu

SEQ ID NO: 659951 - RNA, 14 nt, Homo sapiens
aacagaaguaucaa

SEQ ID NO: 659952 - RNA, 20 nt, Homo sapiens
aacagaaguaucaagccaug

SEQ ID NO: 659953 - RNA, 15 nt, Homo sapiens
aacagacaacagaag

SEQ ID NO: 659954 - RNA, 20 nt, Homo sapiens
aacagacucgcuagcacuca

SEQ ID NO: 659955 - RNA, 12 nt, Homo sapiens
aacagacuugaa

SEQ ID NO: 659956 - RNA, 14 nt, Homo sapiens
aacagagacugaau

SEQ ID NO: 659957 - RNA, 22 nt, Homo sapiens
aacagagcaagacuccaucuca

SEQ ID NO: 659958 - RNA, 14 nt, Homo sapiens
aacagaguccaauu

SEQ ID NO: 659959 - RNA, 15 nt, Homo sapiens
aacagauaagcaaga

SEQ ID NO: 659960 - RNA, 22 nt, Homo sapiens
aacagauaaucccuguauuuca

SEQ ID NO: 659961 - RNA, 22 nt, Homo sapiens
aacagauaccccccuacuuaau

SEQ ID NO: 659962 - RNA, 13 nt, Homo sapiens
aacagauauuuag

SEQ ID NO: 659963 - RNA, 16 nt, Homo sapiens
aacagaucuugaaauc

SEQ ID NO: 659964 - RNA, 21 nt, Homo sapiens
aacagaugaccguguacaaua

SEQ ID NO: 659965 - RNA, 21 nt, Homo sapiens
aacagauuuggaaagacugga

SEQ ID NO: 659966 - RNA, 21 nt, Homo sapiens
aacagcaaaacuccaucucaa

SEQ ID NO: 659967 - RNA, 13 nt, Homo sapiens
aacagcaaauaac

SEQ ID NO: 659968 - RNA, 19 nt, Homo sapiens
aacagcagauuucagauca

SEQ ID NO: 659969 - RNA, 14 nt, Homo sapiens
aacagccagugugu

SEQ ID NO: 659970 - RNA, 21 nt, Homo sapiens
aacagcguguaaacacauguu

SEQ ID NO: 659971 - RNA, 22 nt, Homo sapiens
aacagcguguucuaaguauuug

SEQ ID NO: 659972 - RNA, 18 nt, Homo sapiens
aacagcuaggaaauauca

SEQ ID NO: 659973 - RNA, 19 nt, Homo sapiens
aacagcuccuaggaaaaug

SEQ ID NO: 659974 - RNA, 23 nt, Homo sapiens
aacagcugaggucucuugaggga

SEQ ID NO: 659975 - RNA, 17 nt, Homo sapiens
aacaggagaaugcacag

SEQ ID NO: 659976 - RNA, 12 nt, Homo sapiens
aacaggcaguug

SEQ ID NO: 659977 - RNA, 15 nt, Homo sapiens
aacaggccauuguga

SEQ ID NO: 659978 - RNA, 13 nt, Homo sapiens
aacaggcccucug

SEQ ID NO: 659979 - RNA, 14 nt, Homo sapiens
aacagggacaaaga

SEQ ID NO: 659980 - RNA, 15 nt, Homo sapiens
aacagggucacuugg

SEQ ID NO: 659981 - RNA, 17 nt, Homo sapiens
aacagguaaaacagggc

SEQ ID NO: 659982 - RNA, 22 nt, Homo sapiens
aaauccccuuaugacuugcuac

SEQ ID NO: 659983 - RNA, 16 nt, Homo sapiens
aaaucccuuguucuca

SEQ ID NO: 659984 - RNA, 19 nt, Homo sapiens
aaauccuaguaugccaaaa

SEQ ID NO: 659985 - RNA, 19 nt, Homo sapiens
aaauccuauaagauuuaaa

SEQ ID NO: 659986 - RNA, 17 nt, Homo sapiens
aaauccugaacuuucuc

SEQ ID NO: 659987 - RNA, 13 nt, Homo sapiens
aaauccuuccuaa

SEQ ID NO: 659988 - RNA, 12 nt, Homo sapiens
aaauccuugaua

SEQ ID NO: 659989 - RNA, 16 nt, Homo sapiens
aaaucuaagugauaua

SEQ ID NO: 659990 - RNA, 19 nt, Homo sapiens
aaaucuaaucucuuauucu

SEQ ID NO: 659991 - RNA, 20 nt, Homo sapiens
aaaucuaggugauuguucau

SEQ ID NO: 659992 - RNA, 23 nt, Homo sapiens
aaaucuaugccuaaaaaguauca

SEQ ID NO: 659993 - RNA, 13 nt, Homo sapiens
aaaucucacaaau

SEQ ID NO: 659994 - RNA, 22 nt, Homo sapiens
aaaucucacuuuucuccaugag

SEQ ID NO: 659995 - RNA, 23 nt, Homo sapiens
aaaucucacuuuucuccaugagu

SEQ ID NO: 659996 - RNA, 21 nt, Homo sapiens
aaaucucagcaaugauuacuc

SEQ ID NO: 659997 - RNA, 16 nt, Homo sapiens
aaaucuccagucucau

SEQ ID NO: 659998 - RNA, 12 nt, Homo sapiens
aaaucuccagug

SEQ ID NO: 659999 - RNA, 13 nt, Homo sapiens
aaaucucuuccac

SEQ ID NO: 660000 - RNA, 19 nt, Homo sapiens
aaaucucuuccacaugggu

SEQ ID NO: 660001 - RNA, 12 nt, Homo sapiens
aaaucugaggga

SEQ ID NO: 660002 - RNA, 19 nt, Homo sapiens
aaaucugcauccuuuucaa

SEQ ID NO: 660003 - RNA, 23 nt, Homo sapiens
aaaucuguaucuguagugagaua

SEQ ID NO: 660004 - RNA, 16 nt, Homo sapiens
aaaucuguccucugua

SEQ ID NO: 660005 - RNA, 20 nt, Homo sapiens
aaaucuuuaagaauaguucu

SEQ ID NO: 660006 - RNA, 15 nt, Homo sapiens
aaaucuuuagggaau

SEQ ID NO: 660007 - RNA, 17 nt, Homo sapiens
aaaucuuuuaaaucuuu

SEQ ID NO: 660008 - RNA, 22 nt, Homo sapiens
aaaugaaaagcuuaggaccaga

SEQ ID NO: 660009 - RNA, 20 nt, Homo sapiens
aaaugaaacaagucuagucu

SEQ ID NO: 660010 - RNA, 16 nt, Homo sapiens
aaaugaagggauauaa

SEQ ID NO: 660011 - RNA, 21 nt, Homo sapiens
aaaugaagguuaggauuuaac

SEQ ID NO: 660012 - RNA, 15 nt, Homo sapiens
aaaugaaucuucaca

SEQ ID NO: 660013 - RNA, 22 nt, Homo sapiens
aaaugaauggaggaacuuucca

SEQ ID NO: 660014 - RNA, 14 nt, Homo sapiens
aaaugacacuacuu

SEQ ID NO: 660015 - RNA, 17 nt, Homo sapiens
aaaugacagauguugaa

SEQ ID NO: 660016 - RNA, 13 nt, Homo sapiens
aaaugacauuaaa

SEQ ID NO: 660017 - RNA, 17 nt, Homo sapiens
aaaugacugccggucau

SEQ ID NO: 660018 - RNA, 15 nt, Homo sapiens
aaaugagaaguacuu

SEQ ID NO: 660019 - RNA, 22 nt, Homo sapiens
aaaugagaauuuuauauucuaa

SEQ ID NO: 660020 - RNA, 19 nt, Homo sapiens
aaaugagacuuacugggug

SEQ ID NO: 660021 - RNA, 17 nt, Homo sapiens
aaaugagagcagaaagu

SEQ ID NO: 660022 - RNA, 19 nt, Homo sapiens
aaaugagccccuucauccg

SEQ ID NO: 660023 - RNA, 13 nt, Homo sapiens
aaaugagugcuua

SEQ ID NO: 660024 - RNA, 18 nt, Homo sapiens
aaaugaguugugaugaau

SEQ ID NO: 660025 - RNA, 16 nt, Homo sapiens
aaaugauaaacaaguc

SEQ ID NO: 660026 - RNA, 14 nt, Homo sapiens
aaaugauacaguau

SEQ ID NO: 660027 - RNA, 18 nt, Homo sapiens
aaaugauacuuacugaac

SEQ ID NO: 660028 - RNA, 19 nt, Homo sapiens
aaaugauauauaccacuuu

SEQ ID NO: 660029 - RNA, 14 nt, Homo sapiens
aaaugaucaugaaa

SEQ ID NO: 660030 - RNA, 13 nt, Homo sapiens
aaaugaugaagac

SEQ ID NO: 660031 - RNA, 22 nt, Homo sapiens
aaaugaugauggggugggagac

SEQ ID NO: 660032 - RNA, 17 nt, Homo sapiens
aaaugauggaaguucau

SEQ ID NO: 660033 - RNA, 18 nt, Homo sapiens
aaaugauguguacccaaa

SEQ ID NO: 660034 - RNA, 16 nt, Homo sapiens
aaaugauuacuaagga

SEQ ID NO: 660035 - RNA, 16 nt, Homo sapiens
aaaugauuuuaucugu

SEQ ID NO: 660036 - RNA, 11 nt, Homo sapiens
aaaugcaacuu

SEQ ID NO: 660037 - RNA, 13 nt, Homo sapiens
aaaugcauacugu

SEQ ID NO: 660038 - RNA, 22 nt, Homo sapiens
aaaugcauauuugcaaagugua

SEQ ID NO: 660039 - RNA, 18 nt, Homo sapiens
aaaugcauccauuccuca

SEQ ID NO: 660040 - RNA, 12 nt, Homo sapiens
aaaugcauggca

SEQ ID NO: 660041 - RNA, 13 nt, Homo sapiens
aaaugcauggugc

SEQ ID NO: 660042 - RNA, 20 nt, Homo sapiens
aaaugcccaaggaugccuua

SEQ ID NO: 660043 - RNA, 18 nt, Homo sapiens
aaaugccucaauucacau

SEQ ID NO: 660044 - RNA, 21 nt, Homo sapiens
aaaugcgcgugugcacgugug

SEQ ID NO: 660045 - RNA, 15 nt, Homo sapiens
aaaugcucaaucuca

SEQ ID NO: 660046 - RNA, 13 nt, Homo sapiens
aaaugcugcagga

SEQ ID NO: 660047 - RNA, 19 nt, Homo sapiens
aaauggaccauccuugaca

SEQ ID NO: 660048 - RNA, 22 nt, Homo sapiens
aaauggaugaaugagagaggga

SEQ ID NO: 660049 - RNA, 24 nt, Homo sapiens
aaauggcacuauccguguacgaau

SEQ ID NO: 660050 - RNA, 21 nt, Homo sapiens
aaauggcagggauacccagug

SEQ ID NO: 660051 - RNA, 14 nt, Homo sapiens
aaauggcaugacau

SEQ ID NO: 660052 - RNA, 22 nt, Homo sapiens
aaauggcaugacauauguagau

SEQ ID NO: 660053 - RNA, 17 nt, Homo sapiens
aaauggcugcuuugaca

SEQ ID NO: 660054 - RNA, 17 nt, Homo sapiens
aaaugggaaaaccagac

SEQ ID NO: 660055 - RNA, 21 nt, Homo sapiens
aaaugggagaaaacgccagug

SEQ ID NO: 660056 - RNA, 21 nt, Homo sapiens
aaaugggggcaggaaagccac

SEQ ID NO: 660057 - RNA, 16 nt, Homo sapiens
aaauggguuggugcuu

SEQ ID NO: 660058 - RNA, 13 nt, Homo sapiens
aaaugguauguca

SEQ ID NO: 660059 - RNA, 16 nt, Homo sapiens
aaauggucaguauuau

SEQ ID NO: 660060 - RNA, 15 nt, Homo sapiens
aaauguaauugaaua

SEQ ID NO: 660061 - RNA, 15 nt, Homo sapiens
aaauguacaacugca

SEQ ID NO: 660062 - RNA, 13 nt, Homo sapiens
aaauguacagcaa

SEQ ID NO: 660063 - RNA, 21 nt, Homo sapiens
aaauguagacuuuugcuuuau

SEQ ID NO: 660064 - RNA, 17 nt, Homo sapiens
aaauguagguaugaaua

SEQ ID NO: 660065 - RNA, 20 nt, Homo sapiens
aaauguauaauuaacuuaac

SEQ ID NO: 660066 - RNA, 14 nt, Homo sapiens
aaauguauacuaua

SEQ ID NO: 660067 - RNA, 13 nt, Homo sapiens
aaauguaugugcu

SEQ ID NO: 660068 - RNA, 22 nt, Homo sapiens
aaauguauugauucaacaggga

SEQ ID NO: 660069 - RNA, 23 nt, Homo sapiens
aaaugucaaauugaugugcccua

SEQ ID NO: 660070 - RNA, 14 nt, Homo sapiens
aaaugucacaguaa

SEQ ID NO: 660071 - RNA, 15 nt, Homo sapiens
aaaugucacugccaa

SEQ ID NO: 660072 - RNA, 17 nt, Homo sapiens
aaaugucuaagguagua

SEQ ID NO: 660073 - RNA, 23 nt, Homo sapiens
aaaugugaacguccuuccuugac

SEQ ID NO: 660074 - RNA, 17 nt, Homo sapiens
aaaugugcuauacugca

SEQ ID NO: 660075 - RNA, 15 nt, Homo sapiens
aaaugugucuugcug

SEQ ID NO: 660076 - RNA, 20 nt, Homo sapiens
aaauguguuagcacugauag

SEQ ID NO: 660077 - RNA, 19 nt, Homo sapiens
aaauguguuccauugccau

SEQ ID NO: 660078 - RNA, 18 nt, Homo sapiens
aaauguuaacaaugccua

SEQ ID NO: 660079 - RNA, 15 nt, Homo sapiens
aaauguuaacacuca

SEQ ID NO: 660080 - RNA, 15 nt, Homo sapiens
aaauguuaacuacau

SEQ ID NO: 660081 - RNA, 14 nt, Homo sapiens
aaauguuaugacua

SEQ ID NO: 660082 - RNA, 21 nt, Homo sapiens
aaauguuauuaaaauauccag

SEQ ID NO: 660083 - RNA, 22 nt, Homo sapiens
aaauguucaagucaugccugag

SEQ ID NO: 660084 - RNA, 23 nt, Homo sapiens
aaauguuccauauguggguguca

SEQ ID NO: 660085 - RNA, 20 nt, Homo sapiens
aaauguugagggcaagccac

SEQ ID NO: 660086 - RNA, 18 nt, Homo sapiens
aaauguuuguuauuuaca

SEQ ID NO: 660087 - RNA, 23 nt, Homo sapiens
aaauguuuguuauuuacacuggu

SEQ ID NO: 660088 - RNA, 16 nt, Homo sapiens
aaauguuuuacucaga

SEQ ID NO: 660089 - RNA, 16 nt, Homo sapiens
aaauguuuugcucaau

SEQ ID NO: 660090 - RNA, 15 nt, Homo sapiens
aaauuaaaaugauuu

SEQ ID NO: 660091 - RNA, 17 nt, Homo sapiens
aaauuaaaccaacaaca

SEQ ID NO: 660092 - RNA, 20 nt, Homo sapiens
aaauuaaccucucacaguua

SEQ ID NO: 660093 - RNA, 14 nt, Homo sapiens
aaauuaacuguaug

SEQ ID NO: 660094 - RNA, 15 nt, Homo sapiens
aaauuaagaaggcaa

SEQ ID NO: 660095 - RNA, 16 nt, Homo sapiens
aaauuaagacagcauu

SEQ ID NO: 660096 - RNA, 18 nt, Homo sapiens
aaauuaagacuugugcau

SEQ ID NO: 660097 - RNA, 14 nt, Homo sapiens
aaauuaagacuuua

SEQ ID NO: 660098 - RNA, 13 nt, Homo sapiens
aaauuaagcacac

SEQ ID NO: 660099 - RNA, 13 nt, Homo sapiens
aaauuaauccuca

SEQ ID NO: 660100 - RNA, 15 nt, Homo sapiens
aaauuacaauuguca

SEQ ID NO: 660101 - RNA, 14 nt, Homo sapiens
aaauuaccugugga

SEQ ID NO: 660102 - RNA, 22 nt, Homo sapiens
aaauuacguucuuacaagcuua

SEQ ID NO: 660103 - RNA, 18 nt, Homo sapiens
aaauuacuggaaggcuuc

SEQ ID NO: 660104 - RNA, 20 nt, Homo sapiens
aaauuagaaaguagccacgu

SEQ ID NO: 660105 - RNA, 16 nt, Homo sapiens
aaauuagccauuucac

SEQ ID NO: 660106 - RNA, 15 nt, Homo sapiens
aaauuagccggucau

SEQ ID NO: 660107 - RNA, 15 nt, Homo sapiens
aaauuagcugggcau

SEQ ID NO: 660108 - RNA, 19 nt, Homo sapiens
aaauuagcuugagcaaccu

SEQ ID NO: 660109 - RNA, 17 nt, Homo sapiens
aaauuaggacuguauaa

SEQ ID NO: 660110 - RNA, 21 nt, Homo sapiens
aaauuaguugguuugugugau

SEQ ID NO: 660111 - RNA, 23 nt, Homo sapiens
aaauuauaagcauacaacuggac

SEQ ID NO: 660112 - RNA, 23 nt, Homo sapiens
aaauuauacuguagcugaugaaa

SEQ ID NO: 660113 - RNA, 15 nt, Homo sapiens
aaauuauacuuuaua

SEQ ID NO: 660114 - RNA, 12 nt, Homo sapiens
aaauuauauccg

SEQ ID NO: 660115 - RNA, 14 nt, Homo sapiens
aaauuauaucucag

SEQ ID NO: 660116 - RNA, 21 nt, Homo sapiens
aaauuauaucugugaauugca

SEQ ID NO: 660117 - RNA, 19 nt, Homo sapiens
aaauuauauuugugcuaua

SEQ ID NO: 660118 - RNA, 17 nt, Homo sapiens
aaauuaugaccauggua

SEQ ID NO: 660119 - RNA, 18 nt, Homo sapiens
aaauuauguauguuuaca

SEQ ID NO: 660120 - RNA, 13 nt, Homo sapiens
aaauuaugugaca

SEQ ID NO: 660121 - RNA, 15 nt, Homo sapiens
aaauuauucugcccu

SEQ ID NO: 660122 - RNA, 14 nt, Homo sapiens
aaauuauuugcuaa

SEQ ID NO: 660123 - RNA, 14 nt, Homo sapiens
aaauuauuugucau

SEQ ID NO: 660124 - RNA, 21 nt, Homo sapiens
aaauucaaauaauccauucca

SEQ ID NO: 660125 - RNA, 16 nt, Homo sapiens
aaauucaaauuauucu

SEQ ID NO: 660126 - RNA, 15 nt, Homo sapiens
aaauucaagccuuag

SEQ ID NO: 660127 - RNA, 21 nt, Homo sapiens
aaauucacaugaugcacuuca

SEQ ID NO: 660128 - RNA, 11 nt, Homo sapiens
aaauucacugu

SEQ ID NO: 660129 - RNA, 17 nt, Homo sapiens
aaauucagaugcuguua

SEQ ID NO: 660130 - RNA, 17 nt, Homo sapiens
aaauucagcauuugacc

SEQ ID NO: 660131 - RNA, 19 nt, Homo sapiens
aaauucagccaacauguga

SEQ ID NO: 660132 - RNA, 13 nt, Homo sapiens
aaauucauauaaa

SEQ ID NO: 660133 - RNA, 21 nt, Homo sapiens
aaauucauuaguuguuaguga

SEQ ID NO: 660134 - RNA, 16 nt, Homo sapiens
aaauucauuucuagac

SEQ ID NO: 660135 - RNA, 22 nt, Homo sapiens
aaauucauuuuuuucacuggag

SEQ ID NO: 660136 - RNA, 16 nt, Homo sapiens
aaauuccacagauuau

SEQ ID NO: 660137 - RNA, 14 nt, Homo sapiens
aaauuccagaagaa

SEQ ID NO: 660138 - RNA, 23 nt, Homo sapiens
aaauuccagaagaagagaagcug

SEQ ID NO: 660139 - RNA, 18 nt, Homo sapiens
aaauuccaguuaaccuau

SEQ ID NO: 660140 - RNA, 19 nt, Homo sapiens
aaauuccauacuucucuca

SEQ ID NO: 660141 - RNA, 21 nt, Homo sapiens
aaauuccuacucccucuucca

SEQ ID NO: 660142 - RNA, 13 nt, Homo sapiens
aaauuccuaucuc

SEQ ID NO: 660143 - RNA, 17 nt, Homo sapiens
aaauuccucaacagugu

SEQ ID NO: 660144 - RNA, 18 nt, Homo sapiens
aaauuccucuuacuguaa

SEQ ID NO: 660145 - RNA, 23 nt, Homo sapiens
aaauucuacucuaaagcuucuau

SEQ ID NO: 660146 - RNA, 19 nt, Homo sapiens
aaauucuagagccagcugu

SEQ ID NO: 660147 - RNA, 24 nt, Homo sapiens
aaauucucagucaguaauugccaa

SEQ ID NO: 660148 - RNA, 18 nt, Homo sapiens
aaauucucucucuugcag

SEQ ID NO: 660149 - RNA, 21 nt, Homo sapiens
aaauucuguuuuucuaggccu

SEQ ID NO: 660150 - RNA, 18 nt, Homo sapiens
aaauugaaaaugaccaaa

SEQ ID NO: 660151 - RNA, 14 nt, Homo sapiens
aaauugaagcaacu

SEQ ID NO: 660152 - RNA, 15 nt, Homo sapiens
aaauugacugucacg

SEQ ID NO: 660153 - RNA, 17 nt, Homo sapiens
aaauugagacauuuaca

SEQ ID NO: 660154 - RNA, 20 nt, Homo sapiens
aaauugagaccugagugaag

SEQ ID NO: 660155 - RNA, 13 nt, Homo sapiens
aaauugaugagag

SEQ ID NO: 660156 - RNA, 13 nt, Homo sapiens
aaauugcugcuug

SEQ ID NO: 660157 - RNA, 17 nt, Homo sapiens
aaauugcuuacugauau

SEQ ID NO: 660158 - RNA, 18 nt, Homo sapiens
aaauuggaagcugucaua

SEQ ID NO: 660159 - RNA, 17 nt, Homo sapiens
aaauuggacugucuuua

SEQ ID NO: 660160 - RNA, 16 nt, Homo sapiens
aaauugguaauauaca

SEQ ID NO: 660161 - RNA, 22 nt, Homo sapiens
aaauuguacaagauaaguucca

SEQ ID NO: 660162 - RNA, 14 nt, Homo sapiens
aaauuguagcuuuu

SEQ ID NO: 660163 - RNA, 22 nt, Homo sapiens
aaauuguauacauuuuguuaua

SEQ ID NO: 660164 - RNA, 19 nt, Homo sapiens
aaauuguaucucagucuaa

SEQ ID NO: 660165 - RNA, 16 nt, Homo sapiens
aaauuguuuuuacuga

SEQ ID NO: 660166 - RNA, 12 nt, Homo sapiens
aaauuuacugag

SEQ ID NO: 660167 - RNA, 14 nt, Homo sapiens
aaauuuacugugag

SEQ ID NO: 660168 - RNA, 21 nt, Homo sapiens
aaauuuaugaagcagauuuau

SEQ ID NO: 660169 - RNA, 16 nt, Homo sapiens
aaauuuaugcauuuca

SEQ ID NO: 660170 - RNA, 22 nt, Homo sapiens
aaauuuaugcauuucauucaaa

SEQ ID NO: 660171 - RNA, 19 nt, Homo sapiens
aaauuucuagucaaugugu

SEQ ID NO: 660172 - RNA, 22 nt, Homo sapiens
aaauuucucauuagugguacug

SEQ ID NO: 660173 - RNA, 16 nt, Homo sapiens
aaauuugaauuucagu

SEQ ID NO: 660174 - RNA, 18 nt, Homo sapiens
aaauuugauugauuugaa

SEQ ID NO: 660175 - RNA, 15 nt, Homo sapiens
aaauuuggccuuaag

SEQ ID NO: 660176 - RNA, 12 nt, Homo sapiens
aaauuuggugcu

SEQ ID NO: 660177 - RNA, 21 nt, Homo sapiens
aaauuugugcuggguuauuca

SEQ ID NO: 660178 - RNA, 14 nt, Homo sapiens
aaauuuuacaauag

SEQ ID NO: 660179 - RNA, 12 nt, Homo sapiens
aaauuuuacuuc

SEQ ID NO: 660180 - RNA, 20 nt, Homo sapiens
aaauuuuagaacuuuaccua

SEQ ID NO: 660181 - RNA, 15 nt, Homo sapiens
aaauuuuaugaaguu

SEQ ID NO: 660182 - RNA, 16 nt, Homo sapiens
aaauuuucugaucuca

SEQ ID NO: 660183 - RNA, 16 nt, Homo sapiens
aaauuuugaaaacugu

SEQ ID NO: 660184 - RNA, 23 nt, Homo sapiens
aaauuuugaaccauucccuaguc

SEQ ID NO: 660185 - RNA, 23 nt, Homo sapiens
aaauuuugggggaaaaaauccaa

SEQ ID NO: 660186 - RNA, 18 nt, Homo sapiens
aaauuuuggggggaacau

SEQ ID NO: 660187 - RNA, 18 nt, Homo sapiens
aaauuuuguccauuuuaa

SEQ ID NO: 660188 - RNA, 16 nt, Homo sapiens
aaauuuuuauuacuua

SEQ ID NO: 660189 - RNA, 23 nt, Homo sapiens
aaauuuuuuuuuuuuacuugaaa

SEQ ID NO: 660190 - RNA, 18 nt, Homo sapiens
aacaaaaaaacuauaaaa

SEQ ID NO: 660191 - RNA, 14 nt, Homo sapiens
aacaaaaaccaaaa

SEQ ID NO: 660192 - RNA, 23 nt, Homo sapiens
aacaaaaaucuguguaacuguaa

SEQ ID NO: 660193 - RNA, 20 nt, Homo sapiens
aacaaaaauguaaugaucau

SEQ ID NO: 660194 - RNA, 20 nt, Homo sapiens
aacaaaaauuaaaauccuca

SEQ ID NO: 660195 - RNA, 13 nt, Homo sapiens
aacaaaaccaacu

SEQ ID NO: 660196 - RNA, 12 nt, Homo sapiens
aacaaaaccaag

SEQ ID NO: 660197 - RNA, 22 nt, Homo sapiens
aacaaaaccuacgcacauaccu

SEQ ID NO: 660198 - RNA, 14 nt, Homo sapiens
aacaaaacuucuua

SEQ ID NO: 660199 - RNA, 22 nt, Homo sapiens
aacaaaagcuugaagcugugga

SEQ ID NO: 660200 - RNA, 16 nt, Homo sapiens
aacaaaaguacauugc

SEQ ID NO: 660201 - RNA, 12 nt, Homo sapiens
aacaaaauccuc

SEQ ID NO: 660202 - RNA, 18 nt, Homo sapiens
aacaaacauccuugcaaa

SEQ ID NO: 660203 - RNA, 20 nt, Homo sapiens
aacaaacauggauacuuccu

SEQ ID NO: 660204 - RNA, 18 nt, Homo sapiens
aacaaaccucacugagag

SEQ ID NO: 660205 - RNA, 20 nt, Homo sapiens
aacaaagaaccccucugucu

SEQ ID NO: 660206 - RNA, 14 nt, Homo sapiens
aacaaagaaugggc

SEQ ID NO: 660207 - RNA, 20 nt, Homo sapiens
aacaaagaugccacauucaa

SEQ ID NO: 660208 - RNA, 13 nt, Homo sapiens
aacaaagcccuua

SEQ ID NO: 660209 - RNA, 22 nt, Homo sapiens
aacaaagugacuguuuggcuua

SEQ ID NO: 660210 - RNA, 14 nt, Homo sapiens
aacaaauacugaac

SEQ ID NO: 660211 - RNA, 17 nt, Homo sapiens
aacaaauagucuaucaa

SEQ ID NO: 660212 - RNA, 13 nt, Homo sapiens
aacaaauaugcaa

SEQ ID NO: 660213 - RNA, 19 nt, Homo sapiens
agccccaagcuucugaguc

SEQ ID NO: 660214 - RNA, 13 nt, Homo sapiens
agccccacugcca

SEQ ID NO: 660215 - RNA, 17 nt, Homo sapiens
agccccacuucuggguc

SEQ ID NO: 660216 - RNA, 13 nt, Homo sapiens
agccccagcaccu

SEQ ID NO: 660217 - RNA, 17 nt, Homo sapiens
agccccagugacagcua

SEQ ID NO: 660218 - RNA, 14 nt, Homo sapiens
agcccccaccucag

SEQ ID NO: 660219 - RNA, 14 nt, Homo sapiens
agcccccacuccag

SEQ ID NO: 660220 - RNA, 15 nt, Homo sapiens
agcccccccuuccac

SEQ ID NO: 660221 - RNA, 14 nt, Homo sapiens
agccccgccuguca

SEQ ID NO: 660222 - RNA, 16 nt, Homo sapiens
agccccgccugucaca

SEQ ID NO: 660223 - RNA, 12 nt, Homo sapiens
agccccgucucu

SEQ ID NO: 660224 - RNA, 14 nt, Homo sapiens
agccccuccaaagg

SEQ ID NO: 660225 - RNA, 20 nt, Homo sapiens
agccccuccucccccggcug

SEQ ID NO: 660226 - RNA, 16 nt, Homo sapiens
agccccucuaccuccu

SEQ ID NO: 660227 - RNA, 22 nt, Homo sapiens
agccccucucucacacaucaca

SEQ ID NO: 660228 - RNA, 11 nt, Homo sapiens
agccccugaaa

SEQ ID NO: 660229 - RNA, 20 nt, Homo sapiens
agccccuguauggcacuggc

SEQ ID NO: 660230 - RNA, 17 nt, Homo sapiens
agcccgacagugccauc

SEQ ID NO: 660231 - RNA, 19 nt, Homo sapiens
agcccgcuucaagcucucu

SEQ ID NO: 660232 - RNA, 19 nt, Homo sapiens
agcccggaugcuucuccau

SEQ ID NO: 660233 - RNA, 15 nt, Homo sapiens
agcccgggugugccu

SEQ ID NO: 660234 - RNA, 21 nt, Homo sapiens
agcccguuaaauaauucccua

SEQ ID NO: 660235 - RNA, 21 nt, Homo sapiens
agcccuaggauaaaaagccag

SEQ ID NO: 660236 - RNA, 13 nt, Homo sapiens
agcccucacauua

SEQ ID NO: 660237 - RNA, 15 nt, Homo sapiens
agcccucacauuaga

SEQ ID NO: 660238 - RNA, 18 nt, Homo sapiens
agcccuccaaaagcacuu

SEQ ID NO: 660239 - RNA, 15 nt, Homo sapiens
agcccuccuuaucaa

SEQ ID NO: 660240 - RNA, 16 nt, Homo sapiens
agcccucugucuaccu

SEQ ID NO: 660241 - RNA, 15 nt, Homo sapiens
agcccugaacauuuc

SEQ ID NO: 660242 - RNA, 18 nt, Homo sapiens
agcccugagagucagggu

SEQ ID NO: 660243 - RNA, 15 nt, Homo sapiens
agcccugagcuuucu

SEQ ID NO: 660244 - RNA, 16 nt, Homo sapiens
agcccugaguggucac

SEQ ID NO: 660245 - RNA, 18 nt, Homo sapiens
agcccuggcauguuccug

SEQ ID NO: 660246 - RNA, 17 nt, Homo sapiens
agcccugggaucacugu

SEQ ID NO: 660247 - RNA, 20 nt, Homo sapiens
agcccuggugcuacuugcuu

SEQ ID NO: 660248 - RNA, 19 nt, Homo sapiens
agcccugucaugugccuug

SEQ ID NO: 660249 - RNA, 21 nt, Homo sapiens
agcccugucuguuugccacac

SEQ ID NO: 660250 - RNA, 21 nt, Homo sapiens
agcccuguuggcagcucuagc

SEQ ID NO: 660251 - RNA, 18 nt, Homo sapiens
agcccuuauggccaauaa

SEQ ID NO: 660252 - RNA, 22 nt, Homo sapiens
agcccuuauuuguggggugaga

SEQ ID NO: 660253 - RNA, 19 nt, Homo sapiens
agcccuucaccaucuaccu

SEQ ID NO: 660254 - RNA, 20 nt, Homo sapiens
agcccuucaccaucuaccug

SEQ ID NO: 660255 - RNA, 18 nt, Homo sapiens
agcccuucacugccauga

SEQ ID NO: 660256 - RNA, 15 nt, Homo sapiens
agcccuucagucuua

SEQ ID NO: 660257 - RNA, 17 nt, Homo sapiens
agcccuuccuaccucug

SEQ ID NO: 660258 - RNA, 21 nt, Homo sapiens
agcccuuccuaccucugguga

SEQ ID NO: 660259 - RNA, 13 nt, Homo sapiens
agcgguaccccag

SEQ ID NO: 660260 - RNA, 22 nt, Homo sapiens
agcgguaucucuggcaccacac

SEQ ID NO: 660261 - RNA, 13 nt, Homo sapiens
agcgguccaaagu

SEQ ID NO: 660262 - RNA, 21 nt, Homo sapiens
agcggugaccagccugucacc

SEQ ID NO: 660263 - RNA, 20 nt, Homo sapiens
agcggugguuuguaauuccu

SEQ ID NO: 660264 - RNA, 12 nt, Homo sapiens
agcguacuugaa

SEQ ID NO: 660265 - RNA, 15 nt, Homo sapiens
agcguagcuaaguga

SEQ ID NO: 660266 - RNA, 22 nt, Homo sapiens
agcguaguguuuugaccuuucu

SEQ ID NO: 660267 - RNA, 15 nt, Homo sapiens
agcgucaagacauuu

SEQ ID NO: 660268 - RNA, 18 nt, Homo sapiens
agcgucacggccaagugu

SEQ ID NO: 660269 - RNA, 19 nt, Homo sapiens
agcgucccagucucuggca

SEQ ID NO: 660270 - RNA, 14 nt, Homo sapiens
agcgugcucacuga

SEQ ID NO: 660271 - RNA, 23 nt, Homo sapiens
agcgugcuggcgacacucagggc

SEQ ID NO: 660272 - RNA, 21 nt, Homo sapiens
agcguguuuuugcuccugagg

SEQ ID NO: 660273 - RNA, 16 nt, Homo sapiens
agcguuaugugcagua

SEQ ID NO: 660274 - RNA, 23 nt, Homo sapiens
agcguuguaguaaaugcgugcuu

SEQ ID NO: 660275 - RNA, 20 nt, Homo sapiens
agcguuucuuuacuucucac

SEQ ID NO: 660276 - RNA, 11 nt, Homo sapiens
agcguuugcac

SEQ ID NO: 660277 - RNA, 20 nt, Homo sapiens
agcguuuuuuaaauguauac

SEQ ID NO: 660278 - RNA, 21 nt, Homo sapiens
agcuaaaaaauuguuaaacuu

SEQ ID NO: 660279 - RNA, 18 nt, Homo sapiens
agcuaaaaugauuuuauc

SEQ ID NO: 660280 - RNA, 14 nt, Homo sapiens
agcuaaaccaagaa

SEQ ID NO: 660281 - RNA, 21 nt, Homo sapiens
agcuaaaccaaggacugagca

SEQ ID NO: 660282 - RNA, 13 nt, Homo sapiens
agcuaacaccaga

SEQ ID NO: 660283 - RNA, 13 nt, Homo sapiens
agcuaacacuggc

SEQ ID NO: 660284 - RNA, 14 nt, Homo sapiens
agcuaacauuccau

SEQ ID NO: 660285 - RNA, 23 nt, Homo sapiens
agcuaacccucacaagcaugaag

SEQ ID NO: 660286 - RNA, 13 nt, Homo sapiens
agcuaagccacau

SEQ ID NO: 660287 - RNA, 18 nt, Homo sapiens
agcuaagccacauggcug

SEQ ID NO: 660288 - RNA, 18 nt, Homo sapiens
agcuaaggaggggaaaaa

SEQ ID NO: 660289 - RNA, 12 nt, Homo sapiens
agcuaagugaaa

SEQ ID NO: 660290 - RNA, 19 nt, Homo sapiens
agcuaagugaaaaggucau

SEQ ID NO: 660291 - RNA, 14 nt, Homo sapiens
agcuaauaagugcu

SEQ ID NO: 660292 - RNA, 13 nt, Homo sapiens
agcuaaucugccu

SEQ ID NO: 660293 - RNA, 17 nt, Homo sapiens
agcuaauuaaacacauu

SEQ ID NO: 660294 - RNA, 21 nt, Homo sapiens
agcuacaauuuguuuuugcau

SEQ ID NO: 660295 - RNA, 13 nt, Homo sapiens
agcuaccaggugu

SEQ ID NO: 660296 - RNA, 16 nt, Homo sapiens
agcuacccacuauccu

SEQ ID NO: 660297 - RNA, 16 nt, Homo sapiens
agcuaccucaaacuuc

SEQ ID NO: 660298 - RNA, 23 nt, Homo sapiens
agcuaccucaaccaaugccaaaa

SEQ ID NO: 660299 - RNA, 18 nt, Homo sapiens
agcuacggguaggucuau

SEQ ID NO: 660300 - RNA, 23 nt, Homo sapiens
agcuacguauuuaauagcaaaga

SEQ ID NO: 660301 - RNA, 16 nt, Homo sapiens
agcuacuaaugauguu

SEQ ID NO: 660302 - RNA, 19 nt, Homo sapiens
agcuacucacuuaucugau

SEQ ID NO: 660303 - RNA, 15 nt, Homo sapiens
agcuacugacauucc

SEQ ID NO: 660304 - RNA, 16 nt, Homo sapiens
agcuacugccaagggc

SEQ ID NO: 660305 - RNA, 12 nt, Homo sapiens
agcuacuggaau

SEQ ID NO: 660306 - RNA, 11 nt, Homo sapiens
agcuacuguaa

SEQ ID NO: 660307 - RNA, 12 nt, Homo sapiens
agcuagaaggcc

SEQ ID NO: 660308 - RNA, 17 nt, Homo sapiens
agcuagaauaccaccua

SEQ ID NO: 660309 - RNA, 14 nt, Homo sapiens
agcuagauacugga

SEQ ID NO: 660310 - RNA, 19 nt, Homo sapiens
agcuagaugugucuuacca

SEQ ID NO: 660311 - RNA, 18 nt, Homo sapiens
agcuagcacuaacucgug

SEQ ID NO: 660312 - RNA, 12 nt, Homo sapiens
agcuagccagag

SEQ ID NO: 660313 - RNA, 13 nt, Homo sapiens
agcuagccuccag

SEQ ID NO: 660314 - RNA, 16 nt, Homo sapiens
agcuaggcuaagucaa

SEQ ID NO: 660315 - RNA, 16 nt, Homo sapiens
agcuauaacuaagcau

SEQ ID NO: 660316 - RNA, 13 nt, Homo sapiens
agcuauacaggaa

SEQ ID NO: 660317 - RNA, 23 nt, Homo sapiens
agcuauaucgaauauaguucugu

SEQ ID NO: 660318 - RNA, 13 nt, Homo sapiens
agcuaucaccuag

SEQ ID NO: 660319 - RNA, 12 nt, Homo sapiens
agcuaucacugu

SEQ ID NO: 660320 - RNA, 18 nt, Homo sapiens
agcuauccagugacuugu

SEQ ID NO: 660321 - RNA, 19 nt, Homo sapiens
agcuaucugucaucucucu

SEQ ID NO: 660322 - RNA, 15 nt, Homo sapiens
agcuaugaaaccacu

SEQ ID NO: 660323 - RNA, 17 nt, Homo sapiens
agcuaugggagccccag

SEQ ID NO: 660324 - RNA, 21 nt, Homo sapiens
agcuauggugagaugcagcug

SEQ ID NO: 660325 - RNA, 17 nt, Homo sapiens
agcuauuagaacuaaua

SEQ ID NO: 660326 - RNA, 17 nt, Homo sapiens
agcuauuugauaugcac

SEQ ID NO: 660327 - RNA, 22 nt, Homo sapiens
agcuauuuucaacauaacugaa

SEQ ID NO: 660328 - RNA, 14 nt, Homo sapiens
agcucaaagacuuc

SEQ ID NO: 660329 - RNA, 20 nt, Homo sapiens
agcucaagaacacaugugca

SEQ ID NO: 660330 - RNA, 19 nt, Homo sapiens
agcucaauuuaauuuugca

SEQ ID NO: 660331 - RNA, 17 nt, Homo sapiens
agcucacacuccagugg

SEQ ID NO: 660332 - RNA, 16 nt, Homo sapiens
agcucacagugacauu

SEQ ID NO: 660333 - RNA, 17 nt, Homo sapiens
agcucacggaacuggag

SEQ ID NO: 660334 - RNA, 12 nt, Homo sapiens
agcucacugaau

SEQ ID NO: 660335 - RNA, 14 nt, Homo sapiens
agcucacugcugau

SEQ ID NO: 660336 - RNA, 20 nt, Homo sapiens
agcucacuguggugucugug

SEQ ID NO: 660337 - RNA, 16 nt, Homo sapiens
agcucagacuugccag

SEQ ID NO: 660338 - RNA, 16 nt, Homo sapiens
agcauuacauuauuaa

SEQ ID NO: 660339 - RNA, 18 nt, Homo sapiens
agcauuacauuauuaaac

SEQ ID NO: 660340 - RNA, 17 nt, Homo sapiens
agcauuagucacuuuga

SEQ ID NO: 660341 - RNA, 12 nt, Homo sapiens
agcauuccucag

SEQ ID NO: 660342 - RNA, 19 nt, Homo sapiens
agcauucugccuaacagaa

SEQ ID NO: 660343 - RNA, 14 nt, Homo sapiens
agcauucuuuaaca

SEQ ID NO: 660344 - RNA, 15 nt, Homo sapiens
agcauugccauuccu

SEQ ID NO: 660345 - RNA, 14 nt, Homo sapiens
agcauugcuuucug

SEQ ID NO: 660346 - RNA, 14 nt, Homo sapiens
agcauuuucuugaa

SEQ ID NO: 660347 - RNA, 21 nt, Homo sapiens
agcauuuucuugaaccaauaa

SEQ ID NO: 660348 - RNA, 20 nt, Homo sapiens
agcauuuugcuaaaugugaa

SEQ ID NO: 660349 - RNA, 19 nt, Homo sapiens
agccaaaaugacuuugaac

SEQ ID NO: 660350 - RNA, 13 nt, Homo sapiens
agccaaacaaaac

SEQ ID NO: 660351 - RNA, 14 nt, Homo sapiens
agccaaacccauga

SEQ ID NO: 660352 - RNA, 19 nt, Homo sapiens
agccaaacccuugucagug

SEQ ID NO: 660353 - RNA, 14 nt, Homo sapiens
agccaaacucugcc

SEQ ID NO: 660354 - RNA, 21 nt, Homo sapiens
agccaaaguuucuguugaauu

SEQ ID NO: 660355 - RNA, 16 nt, Homo sapiens
agccaaauaaaaucua

SEQ ID NO: 660356 - RNA, 12 nt, Homo sapiens
agccaaauucau

SEQ ID NO: 660357 - RNA, 15 nt, Homo sapiens
agccaacaacucugc

SEQ ID NO: 660358 - RNA, 18 nt, Homo sapiens
agccaaccaagaugcaaa

SEQ ID NO: 660359 - RNA, 15 nt, Homo sapiens
agccaaccccugugg

SEQ ID NO: 660360 - RNA, 16 nt, Homo sapiens
agccaaccccugugga

SEQ ID NO: 660361 - RNA, 21 nt, Homo sapiens
agccaacugccccgggugccu

SEQ ID NO: 660362 - RNA, 18 nt, Homo sapiens
agccaacuuuaauugcuu

SEQ ID NO: 660363 - RNA, 15 nt, Homo sapiens
agccaagccagucaa

SEQ ID NO: 660364 - RNA, 23 nt, Homo sapiens
agccaagcucccuggagcccugu

SEQ ID NO: 660365 - RNA, 19 nt, Homo sapiens
agccaagggaaaggggugc

SEQ ID NO: 660366 - RNA, 20 nt, Homo sapiens
agccaaggucaugccacugc

SEQ ID NO: 660367 - RNA, 15 nt, Homo sapiens
agccaagugcccucu

SEQ ID NO: 660368 - RNA, 17 nt, Homo sapiens
agccacaagucuuccag

SEQ ID NO: 660369 - RNA, 15 nt, Homo sapiens
agccacacuuccuuu

SEQ ID NO: 660370 - RNA, 11 nt, Homo sapiens
agccacagaug

SEQ ID NO: 660371 - RNA, 21 nt, Homo sapiens
agccacagccugacacagugc

SEQ ID NO: 660372 - RNA, 15 nt, Homo sapiens
agccacagcugugca

SEQ ID NO: 660373 - RNA, 19 nt, Homo sapiens
agccacaucccuuugaaac

SEQ ID NO: 660374 - RNA, 20 nt, Homo sapiens
agccacaucuugcucugcau

SEQ ID NO: 660375 - RNA, 18 nt, Homo sapiens
agccaccacccucaggug

SEQ ID NO: 660376 - RNA, 20 nt, Homo sapiens
agccaccagggaguggccau

SEQ ID NO: 660377 - RNA, 23 nt, Homo sapiens
agccaccgcgcccagccucaucu

SEQ ID NO: 660378 - RNA, 23 nt, Homo sapiens
agccaccuagcccuaucaagcca

SEQ ID NO: 660379 - RNA, 16 nt, Homo sapiens
agccaccucucccuca

SEQ ID NO: 660380 - RNA, 13 nt, Homo sapiens
agccaccugcaag

SEQ ID NO: 660381 - RNA, 19 nt, Homo sapiens
agccacgggggacugacgc

SEQ ID NO: 660382 - RNA, 15 nt, Homo sapiens
agccacgucaaugca

SEQ ID NO: 660383 - RNA, 14 nt, Homo sapiens
agccacgugaaugg

SEQ ID NO: 660384 - RNA, 17 nt, Homo sapiens
agccacuggcuuggaac

SEQ ID NO: 660385 - RNA, 20 nt, Homo sapiens
aacaguucauguuugcuuca

SEQ ID NO: 660386 - RNA, 18 nt, Homo sapiens
aacaguuguauguuugcu

SEQ ID NO: 660387 - RNA, 17 nt, Homo sapiens
aacaguugugucauaaa

SEQ ID NO: 660388 - RNA, 15 nt, Homo sapiens
aacaguuuuccauga

SEQ ID NO: 660389 - RNA, 22 nt, Homo sapiens
aacauaaaaaauaaaguaccac

SEQ ID NO: 660390 - RNA, 22 nt, Homo sapiens
aacauaaguguugguagcacuu

SEQ ID NO: 660391 - RNA, 20 nt, Homo sapiens
aacauaauaccaccauuuaa

SEQ ID NO: 660392 - RNA, 20 nt, Homo sapiens
aacauacccgccuagcugcu

SEQ ID NO: 660393 - RNA, 15 nt, Homo sapiens
aacauacuguucacu

SEQ ID NO: 660394 - RNA, 20 nt, Homo sapiens
aacauagauuuaagugaaua

SEQ ID NO: 660395 - RNA, 15 nt, Homo sapiens
aacauagcaucucag

SEQ ID NO: 660396 - RNA, 17 nt, Homo sapiens
aacauagcaucucagga

SEQ ID NO: 660397 - RNA, 22 nt, Homo sapiens
aacauagugaaaccccaucucu

SEQ ID NO: 660398 - RNA, 20 nt, Homo sapiens
aacauauaaagcacuauaca

SEQ ID NO: 660399 - RNA, 21 nt, Homo sapiens
aacauaucauuugugaagaau

SEQ ID NO: 660400 - RNA, 19 nt, Homo sapiens
aacauauccuuucaagaca

SEQ ID NO: 660401 - RNA, 12 nt, Homo sapiens
aacauaugucac

SEQ ID NO: 660402 - RNA, 22 nt, Homo sapiens
aacauaugucacgaacuugaaa

SEQ ID NO: 660403 - RNA, 13 nt, Homo sapiens
aacauauguccau

SEQ ID NO: 660404 - RNA, 18 nt, Homo sapiens
aacauauguccauccaua

SEQ ID NO: 660405 - RNA, 16 nt, Homo sapiens
aacauauuuaagagau

SEQ ID NO: 660406 - RNA, 21 nt, Homo sapiens
aacaucaacuggggaauugaa

SEQ ID NO: 660407 - RNA, 16 nt, Homo sapiens
aacaucacucuugucu

SEQ ID NO: 660408 - RNA, 21 nt, Homo sapiens
aacaucacugucuugccagau

SEQ ID NO: 660409 - RNA, 17 nt, Homo sapiens
aacaucauggacugagc

SEQ ID NO: 660410 - RNA, 18 nt, Homo sapiens
aacaucauuacuuaugau

SEQ ID NO: 660411 - RNA, 16 nt, Homo sapiens
aacauccauguuguca

SEQ ID NO: 660412 - RNA, 15 nt, Homo sapiens
aacaucccacagugg

SEQ ID NO: 660413 - RNA, 16 nt, Homo sapiens
aacauccuacaagaca

SEQ ID NO: 660414 - RNA, 19 nt, Homo sapiens
aacaucuaauaaguauaua

SEQ ID NO: 660415 - RNA, 19 nt, Homo sapiens
aacaucucaacaaccugaa

SEQ ID NO: 660416 - RNA, 19 nt, Homo sapiens
aacaucucugcuuucacuc

SEQ ID NO: 660417 - RNA, 19 nt, Homo sapiens
aacaucuuaagauccacaa

SEQ ID NO: 660418 - RNA, 20 nt, Homo sapiens
aacaucuugaauacucugcc

SEQ ID NO: 660419 - RNA, 22 nt, Homo sapiens
aacaucuuuacguacuguaacu

SEQ ID NO: 660420 - RNA, 16 nt, Homo sapiens
aacaucuuuagugucu

SEQ ID NO: 660421 - RNA, 21 nt, Homo sapiens
aacaucuuuuuaaccugcaaa

SEQ ID NO: 660422 - RNA, 18 nt, Homo sapiens
aacaugaaaaacagguga

SEQ ID NO: 660423 - RNA, 15 nt, Homo sapiens
aacaugaaaugcccu

SEQ ID NO: 660424 - RNA, 14 nt, Homo sapiens
aacaugaacucuug

SEQ ID NO: 660425 - RNA, 14 nt, Homo sapiens
aacaugaagcauaa

SEQ ID NO: 660426 - RNA, 22 nt, Homo sapiens
aacaugaauuuagaaauauuca

SEQ ID NO: 660427 - RNA, 18 nt, Homo sapiens
aacaugacaguauuccau

SEQ ID NO: 660428 - RNA, 19 nt, Homo sapiens
aacaugauuguuuacagcu

SEQ ID NO: 660429 - RNA, 12 nt, Homo sapiens
aacaugauuuca

SEQ ID NO: 660430 - RNA, 21 nt, Homo sapiens
aacaugcggugccaugaaggg

SEQ ID NO: 660431 - RNA, 23 nt, Homo sapiens
aacauggcaauugcacucaugug

SEQ ID NO: 660432 - RNA, 24 nt, Homo sapiens
aacauggugaaaccucaucucuac

SEQ ID NO: 660433 - RNA, 23 nt, Homo sapiens
aacauggugaaacuccaucucua

SEQ ID NO: 660434 - RNA, 19 nt, Homo sapiens
aacauguaaaacaguuaca

SEQ ID NO: 660435 - RNA, 13 nt, Homo sapiens
aacauguacaaaa

SEQ ID NO: 660436 - RNA, 13 nt, Homo sapiens
aacauguaugugc

SEQ ID NO: 660437 - RNA, 15 nt, Homo sapiens
aacauguaugugcau

SEQ ID NO: 660438 - RNA, 21 nt, Homo sapiens
aacauguuagaagcaaugaau

SEQ ID NO: 660439 - RNA, 23 nt, Homo sapiens
aacauguuccccaucuggugcuc

SEQ ID NO: 660440 - RNA, 17 nt, Homo sapiens
aacauguucucaauaaa

SEQ ID NO: 660441 - RNA, 18 nt, Homo sapiens
aacauuaacaaaagcaau

SEQ ID NO: 660442 - RNA, 14 nt, Homo sapiens
aacauuaggaguaa

SEQ ID NO: 660443 - RNA, 18 nt, Homo sapiens
aacauuaggaguaacuuu

SEQ ID NO: 660444 - RNA, 22 nt, Homo sapiens
aacauuauucaucucuccuccc

SEQ ID NO: 660445 - RNA, 18 nt, Homo sapiens
aacauuccuuagucucaa

SEQ ID NO: 660446 - RNA, 18 nt, Homo sapiens
aacauugauuauaagcau

SEQ ID NO: 660447 - RNA, 13 nt, Homo sapiens
aacauuguacugu

SEQ ID NO: 660448 - RNA, 13 nt, Homo sapiens
aacauugugaugu

SEQ ID NO: 660449 - RNA, 23 nt, Homo sapiens
aacauuguucugaacacuuuagg

SEQ ID NO: 660450 - RNA, 16 nt, Homo sapiens
aacauuguugauuuca

SEQ ID NO: 660451 - RNA, 14 nt, Homo sapiens
aacauuuaaauucc

SEQ ID NO: 660452 - RNA, 19 nt, Homo sapiens
aacauuuaaauuccacaga

SEQ ID NO: 660453 - RNA, 20 nt, Homo sapiens
aacauuucuauagccaaaaa

SEQ ID NO: 660454 - RNA, 13 nt, Homo sapiens
aacauuucucacu

SEQ ID NO: 660455 - RNA, 16 nt, Homo sapiens
aacauuucucacugaa

SEQ ID NO: 660456 - RNA, 20 nt, Homo sapiens
aacauuugagauauguugaa

SEQ ID NO: 660457 - RNA, 22 nt, Homo sapiens
aacauuuguuucccccacaguu

SEQ ID NO: 660458 - RNA, 14 nt, Homo sapiens
aacauuuuacuacu

SEQ ID NO: 660459 - RNA, 16 nt, Homo sapiens
aacauuuuauacaauu

SEQ ID NO: 660460 - RNA, 23 nt, Homo sapiens
aacauuuuauuuuuaaaauauua

SEQ ID NO: 660461 - RNA, 24 nt, Homo sapiens
aacauuuucagaccaugaaugaau

SEQ ID NO: 660462 - RNA, 20 nt, Homo sapiens
aacauuuuguuauugggcaa

SEQ ID NO: 660463 - RNA, 15 nt, Homo sapiens
aaccaaaacaugucu

SEQ ID NO: 660464 - RNA, 16 nt, Homo sapiens
aaccaaacuaguauca

SEQ ID NO: 660465 - RNA, 16 nt, Homo sapiens
aaccaaagagacugga

SEQ ID NO: 660466 - RNA, 19 nt, Homo sapiens
aaccaaagagggcuuccuc

SEQ ID NO: 660467 - RNA, 21 nt, Homo sapiens
aaccaaagucuaaacugagcu

SEQ ID NO: 660468 - RNA, 14 nt, Homo sapiens
aaccaacacuaaca

SEQ ID NO: 660469 - RNA, 20 nt, Homo sapiens
aaccaacagaaaacauccca

SEQ ID NO: 660470 - RNA, 13 nt, Homo sapiens
aaccaacugcccc

SEQ ID NO: 660471 - RNA, 22 nt, Homo sapiens
aaccaacugcugcugugcacau

SEQ ID NO: 660472 - RNA, 16 nt, Homo sapiens
aaccaagaggauuucu

SEQ ID NO: 660473 - RNA, 14 nt, Homo sapiens
aaccaagcaaauua

SEQ ID NO: 660474 - RNA, 19 nt, Homo sapiens
aaccaaguggcucccacac

SEQ ID NO: 660475 - RNA, 19 nt, Homo sapiens
aaccaaucauuuuaagaag

SEQ ID NO: 660476 - RNA, 12 nt, Homo sapiens
aaccaaugagcu

SEQ ID NO: 660477 - RNA, 20 nt, Homo sapiens
aaccaaugcugaugaccuua

SEQ ID NO: 660478 - RNA, 17 nt, Homo sapiens
aaccacagaaagcacuc

SEQ ID NO: 660479 - RNA, 14 nt, Homo sapiens
aaccacagaugugu

SEQ ID NO: 660480 - RNA, 14 nt, Homo sapiens
aaccaccaauccaa

SEQ ID NO: 660481 - RNA, 19 nt, Homo sapiens
aaccaccuggucugcaugu

SEQ ID NO: 660482 - RNA, 19 nt, Homo sapiens
aaccacggaggaugaugcc

SEQ ID NO: 660483 - RNA, 13 nt, Homo sapiens
aaccacucaaauu

SEQ ID NO: 660484 - RNA, 15 nt, Homo sapiens
aaccacucauugucu

SEQ ID NO: 660485 - RNA, 18 nt, Homo sapiens
aaccacugugccacugac

SEQ ID NO: 660486 - RNA, 21 nt, Homo sapiens
aaccacuuaaaaaauguccau

SEQ ID NO: 660487 - RNA, 14 nt, Homo sapiens
aaccacuucagcug

SEQ ID NO: 660488 - RNA, 13 nt, Homo sapiens
aaccacuuucuaa

SEQ ID NO: 660489 - RNA, 16 nt, Homo sapiens
aaccagaaaagcaaua

SEQ ID NO: 660490 - RNA, 21 nt, Homo sapiens
aaccagacuugaauacaacau

SEQ ID NO: 660491 - RNA, 12 nt, Homo sapiens
aaccagacuuug

SEQ ID NO: 660492 - RNA, 15 nt, Homo sapiens
aaccagcccaaccau

SEQ ID NO: 660493 - RNA, 18 nt, Homo sapiens
aaccagcccgucuucucu

SEQ ID NO: 660494 - RNA, 23 nt, Homo sapiens
aaccagcccgucuucucucucug

SEQ ID NO: 660495 - RNA, 17 nt, Homo sapiens
aaccaggacccugucca

SEQ ID NO: 660496 - RNA, 16 nt, Homo sapiens
aaccaggugcaauuau

SEQ ID NO: 660497 - RNA, 16 nt, Homo sapiens
aaccagguuuagacag

SEQ ID NO: 660498 - RNA, 11 nt, Homo sapiens
agaccaaagac

SEQ ID NO: 660499 - RNA, 14 nt, Homo sapiens
agaccaaaucucag

SEQ ID NO: 660500 - RNA, 14 nt, Homo sapiens
agaccaaggcacug

SEQ ID NO: 660501 - RNA, 22 nt, Homo sapiens
agaccaaggcgggagcaucucu

SEQ ID NO: 660502 - RNA, 14 nt, Homo sapiens
agaccaaguuauca

SEQ ID NO: 660503 - RNA, 19 nt, Homo sapiens
agaccaaguuaucaucuca

SEQ ID NO: 660504 - RNA, 21 nt, Homo sapiens
agaccacacugcacacaguga

SEQ ID NO: 660505 - RNA, 15 nt, Homo sapiens
agaccaccagggucc

SEQ ID NO: 660506 - RNA, 14 nt, Homo sapiens
agaccacugauaaa

SEQ ID NO: 660507 - RNA, 13 nt, Homo sapiens
agaccagaaccag

SEQ ID NO: 660508 - RNA, 23 nt, Homo sapiens
agaccagacuguggagaaauaaa

SEQ ID NO: 660509 - RNA, 12 nt, Homo sapiens
agaccagcuuug

SEQ ID NO: 660510 - RNA, 20 nt, Homo sapiens
agaccagggcuccagccccu

SEQ ID NO: 660511 - RNA, 16 nt, Homo sapiens
agaccaggucuuguuu

SEQ ID NO: 660512 - RNA, 17 nt, Homo sapiens
agaccaguacugggaag

SEQ ID NO: 660513 - RNA, 18 nt, Homo sapiens
agaccaguugggagcacu

SEQ ID NO: 660514 - RNA, 15 nt, Homo sapiens
agaccauaauguuac

SEQ ID NO: 660515 - RNA, 16 nt, Homo sapiens
agaccauaauguuaca

SEQ ID NO: 660516 - RNA, 15 nt, Homo sapiens
agaccauagugacca

SEQ ID NO: 660517 - RNA, 21 nt, Homo sapiens
agaccauucaggacacaggga

SEQ ID NO: 660518 - RNA, 18 nt, Homo sapiens
agaccauuuguauuacca

SEQ ID NO: 660519 - RNA, 17 nt, Homo sapiens
agacccaacuugccaaa

SEQ ID NO: 660520 - RNA, 16 nt, Homo sapiens
agacccacuggacuca

SEQ ID NO: 660521 - RNA, 14 nt, Homo sapiens
agacccagccaugc

SEQ ID NO: 660522 - RNA, 23 nt, Homo sapiens
agacccagcccagaccucugaca

SEQ ID NO: 660523 - RNA, 17 nt, Homo sapiens
agacccaggagagacag

SEQ ID NO: 660524 - RNA, 18 nt, Homo sapiens
agacccaggagagacaga

SEQ ID NO: 660525 - RNA, 19 nt, Homo sapiens
agacccauagcagcuuugu

SEQ ID NO: 660526 - RNA, 18 nt, Homo sapiens
agaccccucccacuccug

SEQ ID NO: 660527 - RNA, 17 nt, Homo sapiens
agacccgauuccaccaa

SEQ ID NO: 660528 - RNA, 15 nt, Homo sapiens
agacccgcucuccau

SEQ ID NO: 660529 - RNA, 20 nt, Homo sapiens
agacccucauuccuucccag

SEQ ID NO: 660530 - RNA, 22 nt, Homo sapiens
agacccugguuuuuuuccugug

SEQ ID NO: 660531 - RNA, 22 nt, Homo sapiens
agaccuaacccaccauagucaa

SEQ ID NO: 660532 - RNA, 19 nt, Homo sapiens
agaccuaaucucuguaaag

SEQ ID NO: 660533 - RNA, 16 nt, Homo sapiens
agaccuaggauuucau

SEQ ID NO: 660534 - RNA, 16 nt, Homo sapiens
agaccucuaguagcug

SEQ ID NO: 660535 - RNA, 22 nt, Homo sapiens
agaccucucaauuucuggaaaa

SEQ ID NO: 660536 - RNA, 12 nt, Homo sapiens
agaccugaggga

SEQ ID NO: 660537 - RNA, 15 nt, Homo sapiens
agaccuggcacugga

SEQ ID NO: 660538 - RNA, 12 nt, Homo sapiens
agaccugggauu

SEQ ID NO: 660539 - RNA, 14 nt, Homo sapiens
agaccugugcuagu

SEQ ID NO: 660540 - RNA, 22 nt, Homo sapiens
agaccuugaugcuuggccuccc

SEQ ID NO: 660541 - RNA, 21 nt, Homo sapiens
agaccuuuacugauacuacaa

SEQ ID NO: 660542 - RNA, 23 nt, Homo sapiens
agaccuuuuggcccaaucucugc

SEQ ID NO: 660543 - RNA, 21 nt, Homo sapiens
agacgcccuauuucuauguca

SEQ ID NO: 660544 - RNA, 12 nt, Homo sapiens
agacgccuguua

SEQ ID NO: 660545 - RNA, 23 nt, Homo sapiens
agacgcugcugucacaaccaaga

SEQ ID NO: 660546 - RNA, 21 nt, Homo sapiens
agacggccuagggguggcgcu

SEQ ID NO: 660547 - RNA, 21 nt, Homo sapiens
agacggggucuggcuguguug

SEQ ID NO: 660548 - RNA, 17 nt, Homo sapiens
agacgguguuuugccau

SEQ ID NO: 660549 - RNA, 21 nt, Homo sapiens
agacguccuccguccauauca

SEQ ID NO: 660550 - RNA, 23 nt, Homo sapiens
agacgucguacccagccaugugu

SEQ ID NO: 660551 - RNA, 19 nt, Homo sapiens
agacgugauuuugcuguag

SEQ ID NO: 660552 - RNA, 13 nt, Homo sapiens
agacuaacauguc

SEQ ID NO: 660553 - RNA, 15 nt, Homo sapiens
agacuacacaggaug

SEQ ID NO: 660554 - RNA, 18 nt, Homo sapiens
agacuacacaggaugagg

SEQ ID NO: 660555 - RNA, 16 nt, Homo sapiens
agacuagacuacucaa

SEQ ID NO: 660556 - RNA, 22 nt, Homo sapiens
agacuagauggaccugccugca

SEQ ID NO: 660557 - RNA, 12 nt, Homo sapiens
agacuagccacu

SEQ ID NO: 660558 - RNA, 17 nt, Homo sapiens
agacuagccacuccugc

SEQ ID NO: 660559 - RNA, 14 nt, Homo sapiens
agacuauagccauc

SEQ ID NO: 660560 - RNA, 22 nt, Homo sapiens
agacuauguagcaauauaucag

SEQ ID NO: 660561 - RNA, 19 nt, Homo sapiens
agacuauuuucuauuuucc

SEQ ID NO: 660562 - RNA, 16 nt, Homo sapiens
agacucaaaugcucag

SEQ ID NO: 660563 - RNA, 21 nt, Homo sapiens
aaacuggguuugggcuuugcu

SEQ ID NO: 660564 - RNA, 21 nt, Homo sapiens
aaacugguuuaggauuacuua

SEQ ID NO: 660565 - RNA, 14 nt, Homo sapiens
aaacuguacuacau

SEQ ID NO: 660566 - RNA, 20 nt, Homo sapiens
aaacuguagcgaccccagac

SEQ ID NO: 660567 - RNA, 16 nt, Homo sapiens
aaacuguccaccaaga

SEQ ID NO: 660568 - RNA, 19 nt, Homo sapiens
aaacuguccucuacaucaa

SEQ ID NO: 660569 - RNA, 15 nt, Homo sapiens
aaacugugaagcauu

SEQ ID NO: 660570 - RNA, 19 nt, Homo sapiens
aaacugugcuagugcugac

SEQ ID NO: 660571 - RNA, 15 nt, Homo sapiens
aaacuguuacugaaa

SEQ ID NO: 660572 - RNA, 20 nt, Homo sapiens
aaacuguuccaaucaugaaa

SEQ ID NO: 660573 - RNA, 18 nt, Homo sapiens
aaacuuaaaaguauucau

SEQ ID NO: 660574 - RNA, 18 nt, Homo sapiens
aaacuuaccuacugggga

SEQ ID NO: 660575 - RNA, 19 nt, Homo sapiens
aaacuuaccuuuacugaag

SEQ ID NO: 660576 - RNA, 18 nt, Homo sapiens
aaacuuaugcuaguuuau

SEQ ID NO: 660577 - RNA, 17 nt, Homo sapiens
aaacuuauuuacaaaua

SEQ ID NO: 660578 - RNA, 16 nt, Homo sapiens
aaacuucaaagcugaa

SEQ ID NO: 660579 - RNA, 17 nt, Homo sapiens
aaacuucacuaaugauc

SEQ ID NO: 660580 - RNA, 13 nt, Homo sapiens
aaacuuccaguca

SEQ ID NO: 660581 - RNA, 19 nt, Homo sapiens
aaacuucugaagacugaga

SEQ ID NO: 660582 - RNA, 21 nt, Homo sapiens
aaacuugcauacagagacaga

SEQ ID NO: 660583 - RNA, 11 nt, Homo sapiens
aaacuugccug

SEQ ID NO: 660584 - RNA, 23 nt, Homo sapiens
aaacuuggaauuuguaaccucag

SEQ ID NO: 660585 - RNA, 18 nt, Homo sapiens
aaacuuggauacuuggau

SEQ ID NO: 660586 - RNA, 23 nt, Homo sapiens
aaacuuggcucgaaucucugugc

SEQ ID NO: 660587 - RNA, 17 nt, Homo sapiens
aaacuuguacuauguua

SEQ ID NO: 660588 - RNA, 22 nt, Homo sapiens
aaacuuguuagaucaaccucca

SEQ ID NO: 660589 - RNA, 23 nt, Homo sapiens
aaacuuguuauugugaaugauuc

SEQ ID NO: 660590 - RNA, 19 nt, Homo sapiens
aaacuuuaaaaugcgaaau

SEQ ID NO: 660591 - RNA, 16 nt, Homo sapiens
aaacuuuaagaacaaa

SEQ ID NO: 660592 - RNA, 23 nt, Homo sapiens
aaacuuucuccauuuaagacaca

SEQ ID NO: 660593 - RNA, 20 nt, Homo sapiens
aaacuuugaggaacauucaa

SEQ ID NO: 660594 - RNA, 16 nt, Homo sapiens
aaacuuugcaucucag

SEQ ID NO: 660595 - RNA, 14 nt, Homo sapiens
aaacuuugucaugg

SEQ ID NO: 660596 - RNA, 16 nt, Homo sapiens
aaacuuuuaacugaga

SEQ ID NO: 660597 - RNA, 19 nt, Homo sapiens
aaagaaaaauaucuuggcc

SEQ ID NO: 660598 - RNA, 23 nt, Homo sapiens
aaagaaaaauaucuuggccuaaa

SEQ ID NO: 660599 - RNA, 19 nt, Homo sapiens
aaagaaaaauuaucuugaa

SEQ ID NO: 660600 - RNA, 16 nt, Homo sapiens
aaagaaaagaaaaaga

SEQ ID NO: 660601 - RNA, 15 nt, Homo sapiens
aaagaaaaucuuuag

SEQ ID NO: 660602 - RNA, 18 nt, Homo sapiens
aaagaaaauuuuccacau

SEQ ID NO: 660603 - RNA, 16 nt, Homo sapiens
aaagaaacuuaccaau

SEQ ID NO: 660604 - RNA, 16 nt, Homo sapiens
aaagaaagcugagaag

SEQ ID NO: 660605 - RNA, 18 nt, Homo sapiens
aaagaaaucuucauuuau

SEQ ID NO: 660606 - RNA, 16 nt, Homo sapiens
aaagaaauuaaagaag

SEQ ID NO: 660607 - RNA, 17 nt, Homo sapiens
aaagaaauugcaugcag

SEQ ID NO: 660608 - RNA, 18 nt, Homo sapiens
aaagaaauuguauuauca

SEQ ID NO: 660609 - RNA, 16 nt, Homo sapiens
aaagaaauuuugccug

SEQ ID NO: 660610 - RNA, 22 nt, Homo sapiens
aaagaagaaacgucuaugugua

SEQ ID NO: 660611 - RNA, 13 nt, Homo sapiens
aaagaagcucucc

SEQ ID NO: 660612 - RNA, 19 nt, Homo sapiens
aaagaaggcauggacuucu

SEQ ID NO: 660613 - RNA, 23 nt, Homo sapiens
aaagaaggcauuugcaggguccu

SEQ ID NO: 660614 - RNA, 18 nt, Homo sapiens
aaagaagggggcuuucuu

SEQ ID NO: 660615 - RNA, 22 nt, Homo sapiens
aaagaagguuggugaauuucac

SEQ ID NO: 660616 - RNA, 14 nt, Homo sapiens
aaagaaguaaaagc

SEQ ID NO: 660617 - RNA, 23 nt, Homo sapiens
aaagaagugccuuuaauuugcua

SEQ ID NO: 660618 - RNA, 22 nt, Homo sapiens
aaagaaucccuguucauuguaa

SEQ ID NO: 660619 - RNA, 16 nt, Homo sapiens
aaagacagaagcuuaa

SEQ ID NO: 660620 - RNA, 16 nt, Homo sapiens
aaagacauaaucaugg

SEQ ID NO: 660621 - RNA, 14 nt, Homo sapiens
aaagacauagccaa

SEQ ID NO: 660622 - RNA, 12 nt, Homo sapiens
aaagacaucagu

SEQ ID NO: 660623 - RNA, 17 nt, Homo sapiens
aaagacaucagucucca

SEQ ID NO: 660624 - RNA, 17 nt, Homo sapiens
aaagacauccauaaaga

SEQ ID NO: 660625 - RNA, 15 nt, Homo sapiens
aaagacguucccuuu

SEQ ID NO: 660626 - RNA, 23 nt, Homo sapiens
aaagacuaacaggagaaugcaca

SEQ ID NO: 660627 - RNA, 14 nt, Homo sapiens
aaagacucugacca

SEQ ID NO: 660628 - RNA, 13 nt, Homo sapiens
aaagacucugagc

SEQ ID NO: 660629 - RNA, 11 nt, Homo sapiens
aaagacugcag

SEQ ID NO: 660630 - RNA, 16 nt, Homo sapiens
aaagacugcagcugcu

SEQ ID NO: 660631 - RNA, 16 nt, Homo sapiens
aaagacuggcuuuuau

SEQ ID NO: 660632 - RNA, 14 nt, Homo sapiens
aaagacuguagaag

SEQ ID NO: 660633 - RNA, 12 nt, Homo sapiens
aaagacugucaa

SEQ ID NO: 660634 - RNA, 13 nt, Homo sapiens
aaagacugucaaa

SEQ ID NO: 660635 - RNA, 19 nt, Homo sapiens
aaagacugucaaaugaacu

SEQ ID NO: 660636 - RNA, 18 nt, Homo sapiens
aaagacugugaacagcuu

SEQ ID NO: 660637 - RNA, 23 nt, Homo sapiens
aaagacugugcugagaagcagua

SEQ ID NO: 660638 - RNA, 18 nt, Homo sapiens
aaagacuuaacugguuca

SEQ ID NO: 660639 - RNA, 16 nt, Homo sapiens
aaagagaauauuuaca

SEQ ID NO: 660640 - RNA, 19 nt, Homo sapiens
aaagagacauauacuaaga

SEQ ID NO: 660641 - RNA, 21 nt, Homo sapiens
aaagagacccacaauaaacuc

SEQ ID NO: 660642 - RNA, 21 nt, Homo sapiens
aaagagacuggagcaucugac

SEQ ID NO: 660643 - RNA, 17 nt, Homo sapiens
aaagagagggcuuuaau

SEQ ID NO: 660644 - RNA, 18 nt, Homo sapiens
aaagagagucgcaucuca

SEQ ID NO: 660645 - RNA, 19 nt, Homo sapiens
aaagagagucgcaucucag

SEQ ID NO: 660646 - RNA, 16 nt, Homo sapiens
aaagagauauugauau

SEQ ID NO: 660647 - RNA, 18 nt, Homo sapiens
aaagagaucugggcauua

SEQ ID NO: 660648 - RNA, 15 nt, Homo sapiens
aaagaggcugccccu

SEQ ID NO: 660649 - RNA, 21 nt, Homo sapiens
aaagaguaugagucuucugua

SEQ ID NO: 660650 - RNA, 20 nt, Homo sapiens
aaagauaugcuuauacacug

SEQ ID NO: 660651 - RNA, 15 nt, Homo sapiens
aaagauccacccuca

SEQ ID NO: 660652 - RNA, 23 nt, Homo sapiens
aaagauccagccucauaccuaca

SEQ ID NO: 660653 - RNA, 23 nt, Homo sapiens
aaagauccccaaaacaggccagg

SEQ ID NO: 660654 - RNA, 18 nt, Homo sapiens
aaagaucuugaauagucu

SEQ ID NO: 660655 - RNA, 19 nt, Homo sapiens
aaagaucuugaauagucuc

SEQ ID NO: 660656 - RNA, 20 nt, Homo sapiens
aaagaucuugaauagucuca

SEQ ID NO: 660657 - RNA, 16 nt, Homo sapiens
aaagaugaaaaguaua

SEQ ID NO: 660658 - RNA, 15 nt, Homo sapiens
aaagaugauggaaac

SEQ ID NO: 660659 - RNA, 20 nt, Homo sapiens
aaagaugauuucucaaaaau

SEQ ID NO: 660660 - RNA, 22 nt, Homo sapiens
aaagaugcaaggaccaggacuc

SEQ ID NO: 660661 - RNA, 13 nt, Homo sapiens
aaagaugcagugg

SEQ ID NO: 660662 - RNA, 19 nt, Homo sapiens
aaagauggcuuauucacau

SEQ ID NO: 660663 - RNA, 18 nt, Homo sapiens
aaagauguaaaaccuaac

SEQ ID NO: 660664 - RNA, 13 nt, Homo sapiens
aaagauguauaua

SEQ ID NO: 660665 - RNA, 23 nt, Homo sapiens
aaagauguccugacuuugccccc

SEQ ID NO: 660666 - RNA, 18 nt, Homo sapiens
aacuauaagcccacuguu

SEQ ID NO: 660667 - RNA, 16 nt, Homo sapiens
aacuaucucacuucca

SEQ ID NO: 660668 - RNA, 22 nt, Homo sapiens
aacuaucucuacugaaugucau

SEQ ID NO: 660669 - RNA, 23 nt, Homo sapiens
aacuaugacuggaguaaaccaug

SEQ ID NO: 660670 - RNA, 21 nt, Homo sapiens
aacuaugcaauaauccacccc

SEQ ID NO: 660671 - RNA, 11 nt, Homo sapiens
aaguguugcau

SEQ ID NO: 660672 - RNA, 18 nt, Homo sapiens
aaguguugcucuuggaaa

SEQ ID NO: 660673 - RNA, 16 nt, Homo sapiens
aaguguuucuguuauu

SEQ ID NO: 660674 - RNA, 15 nt, Homo sapiens
aaguuaacuuccaau

SEQ ID NO: 660675 - RNA, 15 nt, Homo sapiens
aaguuacucugccuu

SEQ ID NO: 660676 - RNA, 14 nt, Homo sapiens
aaguuacuugaauu

SEQ ID NO: 660677 - RNA, 22 nt, Homo sapiens
aaguuagccuccaccacccuuu

SEQ ID NO: 660678 - RNA, 12 nt, Homo sapiens
aaguuagucaau

SEQ ID NO: 660679 - RNA, 19 nt, Homo sapiens
aaguuagucaauccuguca

SEQ ID NO: 660680 - RNA, 23 nt, Homo sapiens
aaguuagucaauccugucauaua

SEQ ID NO: 660681 - RNA, 18 nt, Homo sapiens
aaguuauaauaacugaac

SEQ ID NO: 660682 - RNA, 18 nt, Homo sapiens
aaguuauacuguggcuau

SEQ ID NO: 660683 - RNA, 24 nt, Homo sapiens
aaguuauuaacgggcauguauuau

SEQ ID NO: 660684 - RNA, 20 nt, Homo sapiens
aaguuauugaugagagggaa

SEQ ID NO: 660685 - RNA, 13 nt, Homo sapiens
aaguuauuuacuu

SEQ ID NO: 660686 - RNA, 21 nt, Homo sapiens
aaguucaaccucuuacaauaa

SEQ ID NO: 660687 - RNA, 14 nt, Homo sapiens
aaguucaacuucca

SEQ ID NO: 660688 - RNA, 17 nt, Homo sapiens
aaguucaauacucuuga

SEQ ID NO: 660689 - RNA, 18 nt, Homo sapiens
aaguucaggcucugagac

SEQ ID NO: 660690 - RNA, 18 nt, Homo sapiens
aaguucaguuuuuacuga

SEQ ID NO: 660691 - RNA, 18 nt, Homo sapiens
aaguuccaguguucucuc

SEQ ID NO: 660692 - RNA, 16 nt, Homo sapiens
aaguuccuacuaggca

SEQ ID NO: 660693 - RNA, 21 nt, Homo sapiens
aaguucuccagcuucagcuca

SEQ ID NO: 660694 - RNA, 23 nt, Homo sapiens
aaguucuccuuuugaacuuguca

SEQ ID NO: 660695 - RNA, 18 nt, Homo sapiens
aaguucuuaguugcugua

SEQ ID NO: 660696 - RNA, 14 nt, Homo sapiens
aaguucuucaccuc

SEQ ID NO: 660697 - RNA, 22 nt, Homo sapiens
aaguucuucuccaauccuauca

SEQ ID NO: 660698 - RNA, 20 nt, Homo sapiens
aaguugaagcuaagauuuag

SEQ ID NO: 660699 - RNA, 11 nt, Homo sapiens
aaguugcagcu

SEQ ID NO: 660700 - RNA, 23 nt, Homo sapiens
aaguugcagcuguuuuguugaca

SEQ ID NO: 660701 - RNA, 14 nt, Homo sapiens
aaguugcuaauaca

SEQ ID NO: 660702 - RNA, 13 nt, Homo sapiens
aaguugcugucac

SEQ ID NO: 660703 - RNA, 16 nt, Homo sapiens
aaguuggacuugagaa

SEQ ID NO: 660704 - RNA, 23 nt, Homo sapiens
aaguuggggacaugcugcuacaa

SEQ ID NO: 660705 - RNA, 19 nt, Homo sapiens
aaguuggguucacuugcca

SEQ ID NO: 660706 - RNA, 17 nt, Homo sapiens
aaguugucuccuuccau

SEQ ID NO: 660707 - RNA, 20 nt, Homo sapiens
aaguuguuauuucaguuuua

SEQ ID NO: 660708 - RNA, 17 nt, Homo sapiens
aaguuguugacugugau

SEQ ID NO: 660709 - RNA, 14 nt, Homo sapiens
aaguuuaaugccua

SEQ ID NO: 660710 - RNA, 17 nt, Homo sapiens
aaguuuacaacuugauu

SEQ ID NO: 660711 - RNA, 19 nt, Homo sapiens
aaguuuacaaucaaaggaa

SEQ ID NO: 660712 - RNA, 16 nt, Homo sapiens
aaguuuacccaugaag

SEQ ID NO: 660713 - RNA, 12 nt, Homo sapiens
aaguuuacuuuu

SEQ ID NO: 660714 - RNA, 20 nt, Homo sapiens
aaguuucagauuugccauuc

SEQ ID NO: 660715 - RNA, 23 nt, Homo sapiens
aaguuucccuucucccaguccaa

SEQ ID NO: 660716 - RNA, 13 nt, Homo sapiens
aaguuucuaaaaa

SEQ ID NO: 660717 - RNA, 22 nt, Homo sapiens
aaguuucuguuucaaagcacaa

SEQ ID NO: 660718 - RNA, 20 nt, Homo sapiens
aaguuucuuaaggaaauggu

SEQ ID NO: 660719 - RNA, 12 nt, Homo sapiens
aaguuugaacuu

SEQ ID NO: 660720 - RNA, 17 nt, Homo sapiens
aaguuugcacucuuuga

SEQ ID NO: 660721 - RNA, 16 nt, Homo sapiens
aaguuugucacuaaac

SEQ ID NO: 660722 - RNA, 23 nt, Homo sapiens
aaguuuucagaaccucuucccca

SEQ ID NO: 660723 - RNA, 14 nt, Homo sapiens
aaguuuucagugga

SEQ ID NO: 660724 - RNA, 19 nt, Homo sapiens
aaguuuucuuccaugauuu

SEQ ID NO: 660725 - RNA, 14 nt, Homo sapiens
aaguuuugaugaaa

SEQ ID NO: 660726 - RNA, 19 nt, Homo sapiens
aaguuuuuuuagaagacaa

SEQ ID NO: 660727 - RNA, 17 nt, Homo sapiens
aauaaaaaagcaaaaac

SEQ ID NO: 660728 - RNA, 16 nt, Homo sapiens
aauaaaaacauugccu

SEQ ID NO: 660729 - RNA, 14 nt, Homo sapiens
aauaaaaacugacu

SEQ ID NO: 660730 - RNA, 16 nt, Homo sapiens
aauaaaaagaucacuu

SEQ ID NO: 660731 - RNA, 17 nt, Homo sapiens
aauaaaaaggcaaucac

SEQ ID NO: 660732 - RNA, 21 nt, Homo sapiens
aauaaaaaguacaaagggcac

SEQ ID NO: 660733 - RNA, 13 nt, Homo sapiens
aauaaaaauaccu

SEQ ID NO: 660734 - RNA, 14 nt, Homo sapiens
aauaaaaaucacuu

SEQ ID NO: 660735 - RNA, 15 nt, Homo sapiens
aauaaaaaucuuaca

SEQ ID NO: 660736 - RNA, 17 nt, Homo sapiens
aauaaaaauuguagcuu

SEQ ID NO: 660737 - RNA, 24 nt, Homo sapiens
aauaaaacccaacagauacuggaa

SEQ ID NO: 660738 - RNA, 11 nt, Homo sapiens
aauaaaacuga

SEQ ID NO: 660739 - RNA, 12 nt, Homo sapiens
aauaaaacugau

SEQ ID NO: 660740 - RNA, 17 nt, Homo sapiens
aauaaaacugauguuac

SEQ ID NO: 660741 - RNA, 18 nt, Homo sapiens
aauaaaacugcacagugc

SEQ ID NO: 660742 - RNA, 18 nt, Homo sapiens
aauaaaacuuaugcuagu

SEQ ID NO: 660743 - RNA, 20 nt, Homo sapiens
aauaaaagaugauuucucaa

SEQ ID NO: 660744 - RNA, 21 nt, Homo sapiens
aauaaaagccaauuagcucua

SEQ ID NO: 660745 - RNA, 17 nt, Homo sapiens
aauaaaauccuaagaca

SEQ ID NO: 660746 - RNA, 18 nt, Homo sapiens
aauaaaauuccuaucuca

SEQ ID NO: 660747 - RNA, 19 nt, Homo sapiens
aauaaaauuccuaucucau

SEQ ID NO: 660748 - RNA, 19 nt, Homo sapiens
aauaaacagcuucaugccu

SEQ ID NO: 660749 - RNA, 13 nt, Homo sapiens
aauaaacauguca

SEQ ID NO: 660750 - RNA, 19 nt, Homo sapiens
aauaaacaugucacaauac

SEQ ID NO: 660751 - RNA, 17 nt, Homo sapiens
aauaaaccaaacccagc

SEQ ID NO: 660752 - RNA, 23 nt, Homo sapiens
aauaaaccauuggacagauuuca

SEQ ID NO: 660753 - RNA, 12 nt, Homo sapiens
aauaaaccgugu

SEQ ID NO: 660754 - RNA, 23 nt, Homo sapiens
aauaaaccuuugguaaucuucaa

SEQ ID NO: 660755 - RNA, 20 nt, Homo sapiens
aauaaacuagauuacauuca

SEQ ID NO: 660756 - RNA, 17 nt, Homo sapiens
aauaaacucaaugagcu

SEQ ID NO: 660757 - RNA, 12 nt, Homo sapiens
aauaaacugugc

SEQ ID NO: 660758 - RNA, 14 nt, Homo sapiens
aauaaacugugcaa

SEQ ID NO: 660759 - RNA, 17 nt, Homo sapiens
aauaaagaauuaacaga

SEQ ID NO: 660760 - RNA, 20 nt, Homo sapiens
aauaaagaugcccacugagg

SEQ ID NO: 660761 - RNA, 11 nt, Homo sapiens
aauaaagcaau

SEQ ID NO: 660762 - RNA, 18 nt, Homo sapiens
aauaaagcaaugugguag

SEQ ID NO: 660763 - RNA, 16 nt, Homo sapiens
aauaaagcacugagca

SEQ ID NO: 660764 - RNA, 13 nt, Homo sapiens
aauaaagcauucu

SEQ ID NO: 660765 - RNA, 19 nt, Homo sapiens
aauaaagcauucuuuaaca

SEQ ID NO: 660766 - RNA, 20 nt, Homo sapiens
aauaaaggaugugauugugg

SEQ ID NO: 660767 - RNA, 18 nt, Homo sapiens
aauaaaggcagcugccuc

SEQ ID NO: 660768 - RNA, 20 nt, Homo sapiens
aauaaaguacccugugcuca

SEQ ID NO: 660769 - RNA, 12 nt, Homo sapiens
aauaaaguguau

SEQ ID NO: 660770 - RNA, 16 nt, Homo sapiens
aauaaaguuacuugaa

SEQ ID NO: 660771 - RNA, 17 nt, Homo sapiens
aauaaaguuuccauuag

SEQ ID NO: 660772 - RNA, 21 nt, Homo sapiens
aauaaauaagcaaaaugccaa

SEQ ID NO: 660773 - RNA, 13 nt, Homo sapiens
aauaaauauuaca

SEQ ID NO: 660774 - RNA, 16 nt, Homo sapiens
aauaaauauuuaauga

SEQ ID NO: 660775 - RNA, 18 nt, Homo sapiens
aauaaauauuuaaugaau

SEQ ID NO: 660776 - RNA, 14 nt, Homo sapiens
aauaaaugacaaau

SEQ ID NO: 660777 - RNA, 13 nt, Homo sapiens
aauaaaugauuau

SEQ ID NO: 660778 - RNA, 16 nt, Homo sapiens
aauaaauggccagugc

SEQ ID NO: 660779 - RNA, 15 nt, Homo sapiens
aauaaauguauucaa

SEQ ID NO: 660780 - RNA, 18 nt, Homo sapiens
aauaaaugucacugccaa

SEQ ID NO: 660781 - RNA, 19 nt, Homo sapiens
aauaaauucaucagaaucc

SEQ ID NO: 660782 - RNA, 13 nt, Homo sapiens
aauaaauuccuaa

SEQ ID NO: 660783 - RNA, 13 nt, Homo sapiens
aauaaauugaugg

SEQ ID NO: 660784 - RNA, 14 nt, Homo sapiens
aauaaauugugaaa

SEQ ID NO: 660785 - RNA, 20 nt, Homo sapiens
aauaaauuuucaaauccuua

SEQ ID NO: 660786 - RNA, 13 nt, Homo sapiens
aauaacacuaaaa

SEQ ID NO: 660787 - RNA, 12 nt, Homo sapiens
aauaacagagag

SEQ ID NO: 660788 - RNA, 14 nt, Homo sapiens
aauaacaggcauuu

SEQ ID NO: 660789 - RNA, 20 nt, Homo sapiens
aauaacaucaacaacacagc

SEQ ID NO: 660790 - RNA, 13 nt, Homo sapiens
aauaacauugcac

SEQ ID NO: 660791 - RNA, 16 nt, Homo sapiens
aauaacauuuuauaca

SEQ ID NO: 660792 - RNA, 20 nt, Homo sapiens
aauaacgucuuuuuauaucu

SEQ ID NO: 660793 - RNA, 22 nt, Homo sapiens
aauaacucuuauaacacaacaa

SEQ ID NO: 660794 - RNA, 19 nt, Homo sapiens
aauauaagaccucuggcau

SEQ ID NO: 660795 - RNA, 22 nt, Homo sapiens
aauauaaucagacagguuuaaa

SEQ ID NO: 660796 - RNA, 20 nt, Homo sapiens
aauauacuuuuuuuguuaua

SEQ ID NO: 660797 - RNA, 16 nt, Homo sapiens
aauauagaaaguugau

SEQ ID NO: 660798 - RNA, 12 nt, Homo sapiens
aauauagccaug

SEQ ID NO: 660799 - RNA, 23 nt, Homo sapiens
aauauaggauuggugaccaauug

SEQ ID NO: 660800 - RNA, 13 nt, Homo sapiens
aauauagugacua

SEQ ID NO: 660801 - RNA, 13 nt, Homo sapiens
aauauaguucugu

SEQ ID NO: 660802 - RNA, 17 nt, Homo sapiens
aauauauaauguugcca

SEQ ID NO: 660803 - RNA, 13 nt, Homo sapiens
aaauacuugcaug

SEQ ID NO: 660804 - RNA, 19 nt, Homo sapiens
aaauacuuuuacucugccu

SEQ ID NO: 660805 - RNA, 15 nt, Homo sapiens
aaauagaacacugcc

SEQ ID NO: 660806 - RNA, 13 nt, Homo sapiens
aaauagacaugua

SEQ ID NO: 660807 - RNA, 22 nt, Homo sapiens
aaauagagcuuuuaaaaauguc

SEQ ID NO: 660808 - RNA, 20 nt, Homo sapiens
aaauagauaaacuauacacu

SEQ ID NO: 660809 - RNA, 13 nt, Homo sapiens
aaauagauccaau

SEQ ID NO: 660810 - RNA, 21 nt, Homo sapiens
aaauagauuucuuugcacaau

SEQ ID NO: 660811 - RNA, 15 nt, Homo sapiens
aaauaggauugcuuc

SEQ ID NO: 660812 - RNA, 17 nt, Homo sapiens
aaauagguagagucauu

SEQ ID NO: 660813 - RNA, 13 nt, Homo sapiens
aaauagucacuca

SEQ ID NO: 660814 - RNA, 16 nt, Homo sapiens
aaauagucuuccacaa

SEQ ID NO: 660815 - RNA, 21 nt, Homo sapiens
aaauaguguaagaacuguaca

SEQ ID NO: 660816 - RNA, 20 nt, Homo sapiens
aaauauaaaacugcguuaaa

SEQ ID NO: 660817 - RNA, 15 nt, Homo sapiens
aaauauaaacuguag

SEQ ID NO: 660818 - RNA, 13 nt, Homo sapiens
aaauauacucaag

SEQ ID NO: 660819 - RNA, 19 nt, Homo sapiens
aaauauagacauucucaca

SEQ ID NO: 660820 - RNA, 15 nt, Homo sapiens
aaauauauacuaaac

SEQ ID NO: 660821 - RNA, 22 nt, Homo sapiens
aaauauauagugaaaaauguca

SEQ ID NO: 660822 - RNA, 16 nt, Homo sapiens
aaauauauguauuuaa

SEQ ID NO: 660823 - RNA, 22 nt, Homo sapiens
aaauauaugucuauauacacag

SEQ ID NO: 660824 - RNA, 13 nt, Homo sapiens
aaauauauuguac

SEQ ID NO: 660825 - RNA, 18 nt, Homo sapiens
aaauauauuuuggaaaac

SEQ ID NO: 660826 - RNA, 21 nt, Homo sapiens
aaauaucaaagucauuaaaga

SEQ ID NO: 660827 - RNA, 19 nt, Homo sapiens
aaauaucaguauucugaca

SEQ ID NO: 660828 - RNA, 17 nt, Homo sapiens
aaauauccaaagacugu

SEQ ID NO: 660829 - RNA, 19 nt, Homo sapiens
aaauauccaaagacuguac

SEQ ID NO: 660830 - RNA, 20 nt, Homo sapiens
aaauauccacccagcaggca

SEQ ID NO: 660831 - RNA, 17 nt, Homo sapiens
aaauaucuugcuuucaa

SEQ ID NO: 660832 - RNA, 21 nt, Homo sapiens
aaauaugauuuuauuugacaa

SEQ ID NO: 660833 - RNA, 16 nt, Homo sapiens
aaauaugugacugaca

SEQ ID NO: 660834 - RNA, 16 nt, Homo sapiens
aaauauuaacauucuu

SEQ ID NO: 660835 - RNA, 18 nt, Homo sapiens
aaauauugcuucaauaau

SEQ ID NO: 660836 - RNA, 19 nt, Homo sapiens
aaauauugugcuuacucaa

SEQ ID NO: 660837 - RNA, 19 nt, Homo sapiens
aaauauuuacucuuugcaa

SEQ ID NO: 660838 - RNA, 15 nt, Homo sapiens
aaauauuucccucac

SEQ ID NO: 660839 - RNA, 16 nt, Homo sapiens
aaauauuuccuuaaac

SEQ ID NO: 660840 - RNA, 16 nt, Homo sapiens
aaauauuuggaaugaa

SEQ ID NO: 660841 - RNA, 17 nt, Homo sapiens
aaauauuuuaaaaucag

SEQ ID NO: 660842 - RNA, 13 nt, Homo sapiens
aaauauuuugcuu

SEQ ID NO: 660843 - RNA, 20 nt, Homo sapiens
aaauauuuuguaaugcugca

SEQ ID NO: 660844 - RNA, 15 nt, Homo sapiens
aaauauuuugucuaa

SEQ ID NO: 660845 - RNA, 20 nt, Homo sapiens
aaauauuuuuaugugcaaua

SEQ ID NO: 660846 - RNA, 16 nt, Homo sapiens
aaauauuuuucccucc

SEQ ID NO: 660847 - RNA, 22 nt, Homo sapiens
aaaucaaaaagggaaugcauua

SEQ ID NO: 660848 - RNA, 17 nt, Homo sapiens
aaaucaaaccaggugca

SEQ ID NO: 660849 - RNA, 22 nt, Homo sapiens
aaaucaacccugcaaucacuuu

SEQ ID NO: 660850 - RNA, 13 nt, Homo sapiens
aaaucaaguccuu

SEQ ID NO: 660851 - RNA, 18 nt, Homo sapiens
aaaucaaucaauggugca

SEQ ID NO: 660852 - RNA, 21 nt, Homo sapiens
aaaucaaucaauggugcaaaa

SEQ ID NO: 660853 - RNA, 16 nt, Homo sapiens
aaaucaaugaagcaag

SEQ ID NO: 660854 - RNA, 16 nt, Homo sapiens
aaaucaaugucacuua

SEQ ID NO: 660855 - RNA, 23 nt, Homo sapiens
aaaucaauuuaaaaaaugggcua

SEQ ID NO: 660856 - RNA, 13 nt, Homo sapiens
aaaucacaucucc

SEQ ID NO: 660857 - RNA, 13 nt, Homo sapiens
aaaucacuugcca

SEQ ID NO: 660858 - RNA, 22 nt, Homo sapiens
aaaucagaagucaucuugcuac

SEQ ID NO: 660859 - RNA, 16 nt, Homo sapiens
aaaucagccauaagaa

SEQ ID NO: 660860 - RNA, 23 nt, Homo sapiens
aaaucagcuuuauagguuuauua

SEQ ID NO: 660861 - RNA, 23 nt, Homo sapiens
aaaucaggacagguggugcaaau

SEQ ID NO: 660862 - RNA, 15 nt, Homo sapiens
aaaucauaguuuaaa

SEQ ID NO: 660863 - RNA, 21 nt, Homo sapiens
aaaucauauccuaugacccag

SEQ ID NO: 660864 - RNA, 16 nt, Homo sapiens
aaaucaugaaaagagg

SEQ ID NO: 660865 - RNA, 19 nt, Homo sapiens
aaaucaugccauugcacuc

SEQ ID NO: 660866 - RNA, 18 nt, Homo sapiens
aaaucauggguccagccu

SEQ ID NO: 660867 - RNA, 23 nt, Homo sapiens
aaaucauguguugcagcuuuaua

SEQ ID NO: 660868 - RNA, 15 nt, Homo sapiens
aaaucauuaagacaa

SEQ ID NO: 660869 - RNA, 19 nt, Homo sapiens
aaaucauuaauacucuucu

SEQ ID NO: 660870 - RNA, 15 nt, Homo sapiens
aaaucauuguagaaa

SEQ ID NO: 660871 - RNA, 17 nt, Homo sapiens
aaaucauuucaguauca

SEQ ID NO: 660872 - RNA, 18 nt, Homo sapiens
aaauccaaggaaacaugc

SEQ ID NO: 660873 - RNA, 13 nt, Homo sapiens
aaauccaauauca

SEQ ID NO: 660874 - RNA, 15 nt, Homo sapiens
aaauccaauaucaug

SEQ ID NO: 660875 - RNA, 14 nt, Homo sapiens
aaauccaguauuau

SEQ ID NO: 660876 - RNA, 15 nt, Homo sapiens
aaaucccuccuucau

SEQ ID NO: 660877 - RNA, 17 nt, Homo sapiens
aaaucccuccuucaucc

SEQ ID NO: 660878 - RNA, 15 nt, Homo sapiens
aaauccgacuugaau

SEQ ID NO: 660879 - RNA, 22 nt, Homo sapiens
aaauccucaccauccacagcaa

SEQ ID NO: 660880 - RNA, 22 nt, Homo sapiens
aaauccucauguuacucagugu

SEQ ID NO: 660881 - RNA, 13 nt, Homo sapiens
aaauccucauugu

SEQ ID NO: 660882 - RNA, 21 nt, Homo sapiens
aaauccuuuuaaaucuugaua

SEQ ID NO: 660883 - RNA, 19 nt, Homo sapiens
aaauccuuuugaaugaugc

SEQ ID NO: 660884 - RNA, 13 nt, Homo sapiens
aaaucgugccuug

SEQ ID NO: 660885 - RNA, 16 nt, Homo sapiens
aaaucgugcugggaua

SEQ ID NO: 660886 - RNA, 13 nt, Homo sapiens
aaaucguuucuca

SEQ ID NO: 660887 - RNA, 15 nt, Homo sapiens
aaaucuaccacugua

SEQ ID NO: 660888 - RNA, 16 nt, Homo sapiens
aaaucuagaagacugu

SEQ ID NO: 660889 - RNA, 15 nt, Homo sapiens
aaaucuaggauuauu

SEQ ID NO: 660890 - RNA, 22 nt, Homo sapiens
aaaucucaaugaagccagcuca

SEQ ID NO: 660891 - RNA, 15 nt, Homo sapiens
aaaucucacaaauga

SEQ ID NO: 660892 - RNA, 15 nt, Homo sapiens
aaaucuccaucucaa

SEQ ID NO: 660893 - RNA, 16 nt, Homo sapiens
aaaucuccugcugauu

SEQ ID NO: 660894 - RNA, 15 nt, Homo sapiens
aaaucucuuccacau

SEQ ID NO: 660895 - RNA, 23 nt, Homo sapiens
aaaucucuucuuugcugcaguca

SEQ ID NO: 660896 - RNA, 14 nt, Homo sapiens
aaaucugacaauag

SEQ ID NO: 660897 - RNA, 20 nt, Homo sapiens
aaaucugagggagcugagua

SEQ ID NO: 660898 - RNA, 22 nt, Homo sapiens
aaaucugccacaaaaacaggua

SEQ ID NO: 660899 - RNA, 15 nt, Homo sapiens
aaaucugccuagaaa

SEQ ID NO: 660900 - RNA, 11 nt, Homo sapiens
aaaucugugau

SEQ ID NO: 660901 - RNA, 15 nt, Homo sapiens
aaaucuuaaguacca

SEQ ID NO: 660902 - RNA, 18 nt, Homo sapiens
aaaucuuagaaagaaaca

SEQ ID NO: 660903 - RNA, 19 nt, Homo sapiens
aaaucuugcuucagaccau

SEQ ID NO: 660904 - RNA, 21 nt, Homo sapiens
aaaucuugcuucagaccauca

SEQ ID NO: 660905 - RNA, 13 nt, Homo sapiens
aaaucuuguuaau

SEQ ID NO: 660906 - RNA, 17 nt, Homo sapiens
aaaucuuguuaauguca

SEQ ID NO: 660907 - RNA, 13 nt, Homo sapiens
aaaugaaaagaga

SEQ ID NO: 660908 - RNA, 19 nt, Homo sapiens
aaaugaaacaaauaaucac

SEQ ID NO: 660909 - RNA, 15 nt, Homo sapiens
aaaugaaagcaugug

SEQ ID NO: 660910 - RNA, 19 nt, Homo sapiens
aaaugaaccugaucacuuu

SEQ ID NO: 660911 - RNA, 13 nt, Homo sapiens
aaaugaacugaag

SEQ ID NO: 660912 - RNA, 14 nt, Homo sapiens
aaaugacaaaaagc

SEQ ID NO: 660913 - RNA, 15 nt, Homo sapiens
aaaugacaaagccau

SEQ ID NO: 660914 - RNA, 12 nt, Homo sapiens
aaaugaccaaga

SEQ ID NO: 660915 - RNA, 13 nt, Homo sapiens
aaaugacccaaag

SEQ ID NO: 660916 - RNA, 14 nt, Homo sapiens
aaaugacccaaaga

SEQ ID NO: 660917 - RNA, 20 nt, Homo sapiens
aaaugacucuggggagguga

SEQ ID NO: 660918 - RNA, 12 nt, Homo sapiens
aaaugagacaaa

SEQ ID NO: 660919 - RNA, 16 nt, Homo sapiens
aaaugagacuuucuaa

SEQ ID NO: 660920 - RNA, 22 nt, Homo sapiens
aaaugagucaggcaauugauug

SEQ ID NO: 660921 - RNA, 13 nt, Homo sapiens
aaaugauacagua

SEQ ID NO: 660922 - RNA, 15 nt, Homo sapiens
aaaugauagacaauu

SEQ ID NO: 660923 - RNA, 21 nt, Homo sapiens
aaaugaucaccauguuagccu

SEQ ID NO: 660924 - RNA, 13 nt, Homo sapiens
aaaugaucuuuac

SEQ ID NO: 660925 - RNA, 19 nt, Homo sapiens
aaaugaugaagaccaaaga

SEQ ID NO: 660926 - RNA, 12 nt, Homo sapiens
aacacccaugaa

SEQ ID NO: 660927 - RNA, 21 nt, Homo sapiens
aacaccuagcuuuauucuuca

SEQ ID NO: 660928 - RNA, 14 nt, Homo sapiens
aacaccuaugcaaa

SEQ ID NO: 660929 - RNA, 18 nt, Homo sapiens
aacaccuucauccagauu

SEQ ID NO: 660930 - RNA, 15 nt, Homo sapiens
aacaccuucuuggcu

SEQ ID NO: 660931 - RNA, 21 nt, Homo sapiens
aacaccuuuccuuaugucucc

SEQ ID NO: 660932 - RNA, 18 nt, Homo sapiens
aacacgucgauucugucc

SEQ ID NO: 660933 - RNA, 18 nt, Homo sapiens
aacacguggguauuuaau

SEQ ID NO: 660934 - RNA, 17 nt, Homo sapiens
aacacguuggcucaguc

SEQ ID NO: 660935 - RNA, 22 nt, Homo sapiens
aacacuagagaccaaaaagggg

SEQ ID NO: 660936 - RNA, 19 nt, Homo sapiens
aacacuauaaaaacagcuc

SEQ ID NO: 660937 - RNA, 15 nt, Homo sapiens
aacacucaugaagca

SEQ ID NO: 660938 - RNA, 10 nt, Homo sapiens
aacacugcac

SEQ ID NO: 660939 - RNA, 14 nt, Homo sapiens
aacacugcccucuu

SEQ ID NO: 660940 - RNA, 16 nt, Homo sapiens
aacacugcuguccaca

SEQ ID NO: 660941 - RNA, 17 nt, Homo sapiens
aacacuggaacauucca

SEQ ID NO: 660942 - RNA, 22 nt, Homo sapiens
aacacuggaacauuccagugga

SEQ ID NO: 660943 - RNA, 23 nt, Homo sapiens
aacacuggaacauuccaguggac

SEQ ID NO: 660944 - RNA, 17 nt, Homo sapiens
aacacuuaguaugcagu

SEQ ID NO: 660945 - RNA, 18 nt, Homo sapiens
aacacuuauguuauacaa

SEQ ID NO: 660946 - RNA, 22 nt, Homo sapiens
aacacuuauguuauacaauaca

SEQ ID NO: 660947 - RNA, 16 nt, Homo sapiens
aacacuuggcauacaa

SEQ ID NO: 660948 - RNA, 19 nt, Homo sapiens
aacacuuggcauacaaaau

SEQ ID NO: 660949 - RNA, 14 nt, Homo sapiens
aacacuugucaaga

SEQ ID NO: 660950 - RNA, 23 nt, Homo sapiens
aacacuuuacaauguucauccca

SEQ ID NO: 660951 - RNA, 22 nt, Homo sapiens
aacacuuuggacuucucugaaa

SEQ ID NO: 660952 - RNA, 12 nt, Homo sapiens
aacagaaaccau

SEQ ID NO: 660953 - RNA, 17 nt, Homo sapiens
aacagaaagcauccuaa

SEQ ID NO: 660954 - RNA, 22 nt, Homo sapiens
aacagaaauguuuuuuggcauu

SEQ ID NO: 660955 - RNA, 23 nt, Homo sapiens
aacagaaauuaucugucauuuga

SEQ ID NO: 660956 - RNA, 21 nt, Homo sapiens
aacagaaauuguauauuguaa

SEQ ID NO: 660957 - RNA, 20 nt, Homo sapiens
aacagaacauagacagaaga

SEQ ID NO: 660958 - RNA, 16 nt, Homo sapiens
aacagaagcauuugua

SEQ ID NO: 660959 - RNA, 17 nt, Homo sapiens
aacagaauuaaguggau

SEQ ID NO: 660960 - RNA, 21 nt, Homo sapiens
aacagaauuuuuuaaauugac

SEQ ID NO: 660961 - RNA, 13 nt, Homo sapiens
aacagacaacaga

SEQ ID NO: 660962 - RNA, 21 nt, Homo sapiens
aacagagaaaggguccaugaa

SEQ ID NO: 660963 - RNA, 21 nt, Homo sapiens
aacagagcaagacuccaucuc

SEQ ID NO: 660964 - RNA, 16 nt, Homo sapiens
aacagaggcauuuaaa

SEQ ID NO: 660965 - RNA, 22 nt, Homo sapiens
aacagagggaguuuaauacagg

SEQ ID NO: 660966 - RNA, 19 nt, Homo sapiens
aacagauauuuagcucugu

SEQ ID NO: 660967 - RNA, 17 nt, Homo sapiens
aacagauggcacuuuga

SEQ ID NO: 660968 - RNA, 13 nt, Homo sapiens
aacagcaaaucac

SEQ ID NO: 660969 - RNA, 18 nt, Homo sapiens
aacagcaacacagccacu

SEQ ID NO: 660970 - RNA, 23 nt, Homo sapiens
aacagcaagaguaagcaguguua

SEQ ID NO: 660971 - RNA, 14 nt, Homo sapiens
aacagcaccucccc

SEQ ID NO: 660972 - RNA, 21 nt, Homo sapiens
aacagcaccuccccgcuggga

SEQ ID NO: 660973 - RNA, 12 nt, Homo sapiens
aacagcacuggc

SEQ ID NO: 660974 - RNA, 18 nt, Homo sapiens
aacagcagcagugccaua

SEQ ID NO: 660975 - RNA, 20 nt, Homo sapiens
aacagcagugaucucagggc

SEQ ID NO: 660976 - RNA, 13 nt, Homo sapiens
aacagcauaacua

SEQ ID NO: 660977 - RNA, 15 nt, Homo sapiens
aacagcaucauguca

SEQ ID NO: 660978 - RNA, 18 nt, Homo sapiens
aacagcaucaugucauaa

SEQ ID NO: 660979 - RNA, 14 nt, Homo sapiens
aacagcaugaauaa

SEQ ID NO: 660980 - RNA, 19 nt, Homo sapiens
aacagccaaaaaggacuuu

SEQ ID NO: 660981 - RNA, 17 nt, Homo sapiens
aacagcccccacuccag

SEQ ID NO: 660982 - RNA, 20 nt, Homo sapiens
aacagccccucuggacacag

SEQ ID NO: 660983 - RNA, 15 nt, Homo sapiens
aacagccucuugccc

SEQ ID NO: 660984 - RNA, 20 nt, Homo sapiens
aacagcuaucacguugaacc

SEQ ID NO: 660985 - RNA, 13 nt, Homo sapiens
aacagcucaguuc

SEQ ID NO: 660986 - RNA, 14 nt, Homo sapiens
aacagcucucaccu

SEQ ID NO: 660987 - RNA, 16 nt, Homo sapiens
aacagcugcauuagaa

SEQ ID NO: 660988 - RNA, 22 nt, Homo sapiens
aacagcugguccuccacuuugc

SEQ ID NO: 660989 - RNA, 17 nt, Homo sapiens
aacagcuguuccugugu

SEQ ID NO: 660990 - RNA, 19 nt, Homo sapiens
aacagcuguuccuguguuc

SEQ ID NO: 660991 - RNA, 17 nt, Homo sapiens
aacagcuugcugucacu

SEQ ID NO: 660992 - RNA, 20 nt, Homo sapiens
aacaggaauuuuuaaaccaa

SEQ ID NO: 660993 - RNA, 20 nt, Homo sapiens
aacaggauuacaguguagcu

SEQ ID NO: 660994 - RNA, 21 nt, Homo sapiens
aacaggauuacaguguagcua

SEQ ID NO: 660995 - RNA, 23 nt, Homo sapiens
aacaggcaaaguuuuacagagag

SEQ ID NO: 660996 - RNA, 21 nt, Homo sapiens
aacaggcacccacaaccagag

SEQ ID NO: 660997 - RNA, 18 nt, Homo sapiens
aacaggcucaauauuccu

SEQ ID NO: 660998 - RNA, 15 nt, Homo sapiens
aacagggcaacugua

SEQ ID NO: 660999 - RNA, 13 nt, Homo sapiens
aacagggcauuuu

SEQ ID NO: 661000 - RNA, 20 nt, Homo sapiens
aacaggugugugugaacugg

SEQ ID NO: 661001 - RNA, 20 nt, Homo sapiens
aacagguuuguuugugcuuu

SEQ ID NO: 661002 - RNA, 22 nt, Homo sapiens
aacaguaaaagccuuauucuaa

SEQ ID NO: 661003 - RNA, 19 nt, Homo sapiens
aacaguaaagaaagcagaa

SEQ ID NO: 661004 - RNA, 15 nt, Homo sapiens
aacaguaacugccau

SEQ ID NO: 661005 - RNA, 16 nt, Homo sapiens
aacagugagaaaccau

SEQ ID NO: 661006 - RNA, 14 nt, Homo sapiens
aacagugcccucca

SEQ ID NO: 661007 - RNA, 22 nt, Homo sapiens
aacagugucuggugcacauaau

SEQ ID NO: 661008 - RNA, 21 nt, Homo sapiens
aacaguucugagcuguaauuu

SEQ ID NO: 661009 - RNA, 13 nt, Homo sapiens
aacaguucuugga

SEQ ID NO: 661010 - RNA, 13 nt, Homo sapiens
aacaguuuuccaa

SEQ ID NO: 661011 - RNA, 16 nt, Homo sapiens
aacaguuuuccaugaa

SEQ ID NO: 661012 - RNA, 22 nt, Homo sapiens
aacauaaaacaaaaccaagccu

SEQ ID NO: 661013 - RNA, 21 nt, Homo sapiens
aacauaaauuucuuuaaucau

SEQ ID NO: 661014 - RNA, 23 nt, Homo sapiens
aacauaagagagccuugguucau

SEQ ID NO: 661015 - RNA, 17 nt, Homo sapiens
aacauaaugcacuuuag

SEQ ID NO: 661016 - RNA, 15 nt, Homo sapiens
aacauaauucucuca

SEQ ID NO: 661017 - RNA, 21 nt, Homo sapiens
aacauacaugagauaacucaa

SEQ ID NO: 661018 - RNA, 20 nt, Homo sapiens
aacauacuggccuggacugu

SEQ ID NO: 661019 - RNA, 12 nt, Homo sapiens
aacauagacaga

SEQ ID NO: 661020 - RNA, 16 nt, Homo sapiens
aacauagacagaagaa

SEQ ID NO: 661021 - RNA, 17 nt, Homo sapiens
aacauaggccugcucag

SEQ ID NO: 661022 - RNA, 13 nt, Homo sapiens
aacauauaugugu

SEQ ID NO: 661023 - RNA, 14 nt, Homo sapiens
aacauaucucugcc

SEQ ID NO: 661024 - RNA, 19 nt, Homo sapiens
aacauaugaggaaucugca

SEQ ID NO: 661025 - RNA, 16 nt, Homo sapiens
aacaucaacaacacag

SEQ ID NO: 661026 - RNA, 18 nt, Homo sapiens
aacaucaacuccugaagu

SEQ ID NO: 661027 - RNA, 15 nt, Homo sapiens
aacaucacaccugcc

SEQ ID NO: 661028 - RNA, 19 nt, Homo sapiens
aacaucaguuacucugaag

SEQ ID NO: 661029 - RNA, 15 nt, Homo sapiens
aacauccuacaagac

SEQ ID NO: 661030 - RNA, 22 nt, Homo sapiens
aacaucgugaaaccccaucucu

SEQ ID NO: 661031 - RNA, 16 nt, Homo sapiens
aacaucucaauaacaa

SEQ ID NO: 661032 - RNA, 17 nt, Homo sapiens
aacaucuuuuacauucu

SEQ ID NO: 661033 - RNA, 14 nt, Homo sapiens
aacaugaacccaaa

SEQ ID NO: 661034 - RNA, 23 nt, Homo sapiens
aacaugacauccagagaugacua

SEQ ID NO: 661035 - RNA, 20 nt, Homo sapiens
aacaugaugugaaaacccau

SEQ ID NO: 661036 - RNA, 17 nt, Homo sapiens
aauuuuuuuuccuugcc

SEQ ID NO: 661037 - RNA, 19 nt, Homo sapiens
aauuuuuuuuccuugccug

SEQ ID NO: 661038 - RNA, 23 nt, Homo sapiens
aauuuuuuuuuuuuaacuuuaag

SEQ ID NO: 661039 - RNA, 22 nt, Homo sapiens
acaaaaaaaaaacccuauuuaa

SEQ ID NO: 661040 - RNA, 21 nt, Homo sapiens
acaaaaaaaacaaaaaaccca

SEQ ID NO: 661041 - RNA, 14 nt, Homo sapiens
acaaaaaauuagcu

SEQ ID NO: 661042 - RNA, 13 nt, Homo sapiens
acaaaaacagaau

SEQ ID NO: 661043 - RNA, 12 nt, Homo sapiens
acaaaaaccaaa

SEQ ID NO: 661044 - RNA, 13 nt, Homo sapiens
acaaaaaccaaaa

SEQ ID NO: 661045 - RNA, 15 nt, Homo sapiens
acaaaaaccaaaaaa

SEQ ID NO: 661046 - RNA, 16 nt, Homo sapiens
acaaaaagcuucccca

SEQ ID NO: 661047 - RNA, 13 nt, Homo sapiens
acaaaaaggcaaa

SEQ ID NO: 661048 - RNA, 17 nt, Homo sapiens
acaaaaaggcauaugca

SEQ ID NO: 661049 - RNA, 22 nt, Homo sapiens
acaaaaaucacaaggcauucaa

SEQ ID NO: 661050 - RNA, 13 nt, Homo sapiens
acaaaaaugagcu

SEQ ID NO: 661051 - RNA, 15 nt, Homo sapiens
acaaaacaagugcaa

SEQ ID NO: 661052 - RNA, 14 nt, Homo sapiens
acaaaacaguuuga

SEQ ID NO: 661053 - RNA, 22 nt, Homo sapiens
acaaaacugacaguaaaucuca

SEQ ID NO: 661054 - RNA, 18 nt, Homo sapiens
acaaaagcagcacaagga

SEQ ID NO: 661055 - RNA, 21 nt, Homo sapiens
acaaaagcccaauguaaugca

SEQ ID NO: 661056 - RNA, 22 nt, Homo sapiens
acaaaaggaaaggucucagcuu

SEQ ID NO: 661057 - RNA, 22 nt, Homo sapiens
acaaaaggguguauaguguuca

SEQ ID NO: 661058 - RNA, 12 nt, Homo sapiens
acaaaagucugu

SEQ ID NO: 661059 - RNA, 15 nt, Homo sapiens
acaaaagucugucuu

SEQ ID NO: 661060 - RNA, 19 nt, Homo sapiens
acaaaagugaaccaucuca

SEQ ID NO: 661061 - RNA, 14 nt, Homo sapiens
acaaaaguuaacca

SEQ ID NO: 661062 - RNA, 22 nt, Homo sapiens
acaaaauaacucuccaguaaca

SEQ ID NO: 661063 - RNA, 16 nt, Homo sapiens
acaaaauauauuuugu

SEQ ID NO: 661064 - RNA, 18 nt, Homo sapiens
acaaaaugauuuugaaga

SEQ ID NO: 661065 - RNA, 12 nt, Homo sapiens
acaaaaugccaa

SEQ ID NO: 661066 - RNA, 15 nt, Homo sapiens
acaaaauggauacau

SEQ ID NO: 661067 - RNA, 21 nt, Homo sapiens
acaaaauggucauccaaacuc

SEQ ID NO: 661068 - RNA, 19 nt, Homo sapiens
acaaaauguagaauauuca

SEQ ID NO: 661069 - RNA, 20 nt, Homo sapiens
agucacacacacauacaaaa

SEQ ID NO: 661070 - RNA, 13 nt, Homo sapiens
agucacacagugu

SEQ ID NO: 661071 - RNA, 13 nt, Homo sapiens
agucacaccaucu

SEQ ID NO: 661072 - RNA, 21 nt, Homo sapiens
agucacaguuagguagcuuua

SEQ ID NO: 661073 - RNA, 19 nt, Homo sapiens
agucaccaaauagugugaa

SEQ ID NO: 661074 - RNA, 13 nt, Homo sapiens
agucaccaggaau

SEQ ID NO: 661075 - RNA, 16 nt, Homo sapiens
agucaccgaagguccu

SEQ ID NO: 661076 - RNA, 16 nt, Homo sapiens
agucaccuucugggca

SEQ ID NO: 661077 - RNA, 19 nt, Homo sapiens
agucacggcugcgcacugu

SEQ ID NO: 661078 - RNA, 22 nt, Homo sapiens
agucacggcugcgcacuguguc

SEQ ID NO: 661079 - RNA, 14 nt, Homo sapiens
agucacugcacagu

SEQ ID NO: 661080 - RNA, 21 nt, Homo sapiens
agucacuggcaucucacuuua

SEQ ID NO: 661081 - RNA, 20 nt, Homo sapiens
agucacuggucuguuugcau

SEQ ID NO: 661082 - RNA, 11 nt, Homo sapiens
agucacuguag

SEQ ID NO: 661083 - RNA, 21 nt, Homo sapiens
agucacugucccucaaaugac

SEQ ID NO: 661084 - RNA, 16 nt, Homo sapiens
agucacuuauugucca

SEQ ID NO: 661085 - RNA, 17 nt, Homo sapiens
agucacuugaugugcca

SEQ ID NO: 661086 - RNA, 14 nt, Homo sapiens
agucagacugucag

SEQ ID NO: 661087 - RNA, 22 nt, Homo sapiens
agucagacuuuguguucauuuc

SEQ ID NO: 661088 - RNA, 21 nt, Homo sapiens
agucagagacagauaccucca

SEQ ID NO: 661089 - RNA, 21 nt, Homo sapiens
agucagaggagaagagacaug

SEQ ID NO: 661090 - RNA, 19 nt, Homo sapiens
agucagaguccagugcucu

SEQ ID NO: 661091 - RNA, 14 nt, Homo sapiens
agucagaugaggca

SEQ ID NO: 661092 - RNA, 15 nt, Homo sapiens
agucagaugaggcaa

SEQ ID NO: 661093 - RNA, 13 nt, Homo sapiens
agucagcauucuu

SEQ ID NO: 661094 - RNA, 23 nt, Homo sapiens
agucagccaguggcuagcgcaag

SEQ ID NO: 661095 - RNA, 15 nt, Homo sapiens
agucagccuacauaa

SEQ ID NO: 661096 - RNA, 13 nt, Homo sapiens
agucaggcccuga

SEQ ID NO: 661097 - RNA, 17 nt, Homo sapiens
agucaggcgcugaccca

SEQ ID NO: 661098 - RNA, 19 nt, Homo sapiens
agucagggcaugcuuuauu

SEQ ID NO: 661099 - RNA, 17 nt, Homo sapiens
agucagugacagccccu

SEQ ID NO: 661100 - RNA, 15 nt, Homo sapiens
agucagugcucucag

SEQ ID NO: 661101 - RNA, 16 nt, Homo sapiens
agucaguggcuuugca

SEQ ID NO: 661102 - RNA, 15 nt, Homo sapiens
agucauauauaugau

SEQ ID NO: 661103 - RNA, 13 nt, Homo sapiens
agucauauugccc

SEQ ID NO: 661104 - RNA, 21 nt, Homo sapiens
agucaucacauuucuaugcca

SEQ ID NO: 661105 - RNA, 23 nt, Homo sapiens
agucauccaacaagaagaaauau

SEQ ID NO: 661106 - RNA, 20 nt, Homo sapiens
agucauccugcccugcagca

SEQ ID NO: 661107 - RNA, 14 nt, Homo sapiens
agucaucuacuuaa

SEQ ID NO: 661108 - RNA, 14 nt, Homo sapiens
agucaucuauucaa

SEQ ID NO: 661109 - RNA, 22 nt, Homo sapiens
agucaucugucuuucacuggaa

SEQ ID NO: 661110 - RNA, 21 nt, Homo sapiens
agucaucuguuuaauuuacac

SEQ ID NO: 661111 - RNA, 22 nt, Homo sapiens
agucauggagaaucugcugcau

SEQ ID NO: 661112 - RNA, 16 nt, Homo sapiens
agucauuaaagacagg

SEQ ID NO: 661113 - RNA, 21 nt, Homo sapiens
agucauugaaauuuacuguga

SEQ ID NO: 661114 - RNA, 21 nt, Homo sapiens
agucauugauagaacuacuuu

SEQ ID NO: 661115 - RNA, 15 nt, Homo sapiens
agucauuuaucuaau

SEQ ID NO: 661116 - RNA, 21 nt, Homo sapiens
aguccaagaggguccuuuagu

SEQ ID NO: 661117 - RNA, 20 nt, Homo sapiens
aguccaauuccuugcacaua

SEQ ID NO: 661118 - RNA, 16 nt, Homo sapiens
aguccacaguacauaa

SEQ ID NO: 661119 - RNA, 23 nt, Homo sapiens
aguccaccucccauuacuuugau

SEQ ID NO: 661120 - RNA, 16 nt, Homo sapiens
aguccacuucugcucu

SEQ ID NO: 661121 - RNA, 16 nt, Homo sapiens
aguccagauauuucac

SEQ ID NO: 661122 - RNA, 14 nt, Homo sapiens
aguccagauuuaca

SEQ ID NO: 661123 - RNA, 15 nt, Homo sapiens
aguccaggagcucag

SEQ ID NO: 661124 - RNA, 24 nt, Homo sapiens
aguccaggccucucucugcuccau

SEQ ID NO: 661125 - RNA, 24 nt, Homo sapiens
aguccaggcugcuagaggugcuca

SEQ ID NO: 661126 - RNA, 18 nt, Homo sapiens
aguccaucuaacaucaua

SEQ ID NO: 661127 - RNA, 17 nt, Homo sapiens
aguccaugaaaauacca

SEQ ID NO: 661128 - RNA, 13 nt, Homo sapiens
aguccaugcuucu

SEQ ID NO: 661129 - RNA, 14 nt, Homo sapiens
agucccacacugug

SEQ ID NO: 661130 - RNA, 22 nt, Homo sapiens
agucccagacaauuccauucaa

SEQ ID NO: 661131 - RNA, 16 nt, Homo sapiens
agucccagcuacucag

SEQ ID NO: 661132 - RNA, 16 nt, Homo sapiens
agucccagcuacuuga

SEQ ID NO: 661133 - RNA, 14 nt, Homo sapiens
agucccaguauucu

SEQ ID NO: 661134 - RNA, 17 nt, Homo sapiens
aguccccuuuccucuaa

SEQ ID NO: 661135 - RNA, 19 nt, Homo sapiens
agucccucacguuucuucc

SEQ ID NO: 661136 - RNA, 23 nt, Homo sapiens
agucccugacucucugugaccug

SEQ ID NO: 661137 - RNA, 23 nt, Homo sapiens
agucccuuuaugcagagccacag

SEQ ID NO: 661138 - RNA, 17 nt, Homo sapiens
aguccuacccugaaccu

SEQ ID NO: 661139 - RNA, 18 nt, Homo sapiens
aguccuacccugaaccua

SEQ ID NO: 661140 - RNA, 17 nt, Homo sapiens
aguccuagccacucagg

SEQ ID NO: 661141 - RNA, 15 nt, Homo sapiens
aguccuagcuacuca

SEQ ID NO: 661142 - RNA, 18 nt, Homo sapiens
aguccuccacucgaccca

SEQ ID NO: 661143 - RNA, 22 nt, Homo sapiens
aguccugaagaucaagccaguu

SEQ ID NO: 661144 - RNA, 19 nt, Homo sapiens
aguccugacacuauucauu

SEQ ID NO: 661145 - RNA, 19 nt, Homo sapiens
aguccugucacugagcaca

SEQ ID NO: 661146 - RNA, 17 nt, Homo sapiens
aguccuguccucuggau

SEQ ID NO: 661147 - RNA, 13 nt, Homo sapiens
aguccuguucaga

SEQ ID NO: 661148 - RNA, 13 nt, Homo sapiens
aguccuuaccucg

SEQ ID NO: 661149 - RNA, 20 nt, Homo sapiens
aguccuuauguuaagcccug

SEQ ID NO: 661150 - RNA, 16 nt, Homo sapiens
aguccuucugccauuu

SEQ ID NO: 661151 - RNA, 19 nt, Homo sapiens
aguccuugggcaguucuca

SEQ ID NO: 661152 - RNA, 12 nt, Homo sapiens
aguccuuuccaa

SEQ ID NO: 661153 - RNA, 19 nt, Homo sapiens
aguccuuucuaaguauuuu

SEQ ID NO: 661154 - RNA, 15 nt, Homo sapiens
agucgaacaauucau

SEQ ID NO: 661155 - RNA, 13 nt, Homo sapiens
agucgagaccuca

SEQ ID NO: 661156 - RNA, 21 nt, Homo sapiens
agucgcaggauccgcugccac

SEQ ID NO: 661157 - RNA, 14 nt, Homo sapiens
agucgguuagucau

SEQ ID NO: 661158 - RNA, 19 nt, Homo sapiens
agugcaggaaaccgaguag

SEQ ID NO: 661159 - RNA, 18 nt, Homo sapiens
agugcaggagagacagug

SEQ ID NO: 661160 - RNA, 13 nt, Homo sapiens
agugcagugccac

SEQ ID NO: 661161 - RNA, 16 nt, Homo sapiens
agugcaguggugcaau

SEQ ID NO: 661162 - RNA, 18 nt, Homo sapiens
agugcaucagauguaaca

SEQ ID NO: 661163 - RNA, 14 nt, Homo sapiens
agugcaucucagcc

SEQ ID NO: 661164 - RNA, 20 nt, Homo sapiens
agugcaugggacccacgaaa

SEQ ID NO: 661165 - RNA, 23 nt, Homo sapiens
agugcauuugccuugucaccugu

SEQ ID NO: 661166 - RNA, 16 nt, Homo sapiens
agugccaacuccucac

SEQ ID NO: 661167 - RNA, 17 nt, Homo sapiens
agugccaauauuucuga

SEQ ID NO: 661168 - RNA, 20 nt, Homo sapiens
agugccaauauuucugauau

SEQ ID NO: 661169 - RNA, 18 nt, Homo sapiens
agugccacaugccuacga

SEQ ID NO: 661170 - RNA, 19 nt, Homo sapiens
agugccacuugacauuccu

SEQ ID NO: 661171 - RNA, 21 nt, Homo sapiens
agugccagcaaugacaucuca

SEQ ID NO: 661172 - RNA, 19 nt, Homo sapiens
agugccagcccuggcagac

SEQ ID NO: 661173 - RNA, 12 nt, Homo sapiens
agugccaggacu

SEQ ID NO: 661174 - RNA, 17 nt, Homo sapiens
agugccauuacuacugu

SEQ ID NO: 661175 - RNA, 14 nt, Homo sapiens
agugccauuccacu

SEQ ID NO: 661176 - RNA, 17 nt, Homo sapiens
agugcccaacuguuaua

SEQ ID NO: 661177 - RNA, 16 nt, Homo sapiens
agugcccacauuugau

SEQ ID NO: 661178 - RNA, 22 nt, Homo sapiens
agugcccaccgcccuccuccac

SEQ ID NO: 661179 - RNA, 14 nt, Homo sapiens
agugccggcugugg

SEQ ID NO: 661180 - RNA, 20 nt, Homo sapiens
agugccguagggaguaccug

SEQ ID NO: 661181 - RNA, 17 nt, Homo sapiens
agugccuauugauacuu

SEQ ID NO: 661182 - RNA, 21 nt, Homo sapiens
agugccucuguuuuccagaag

SEQ ID NO: 661183 - RNA, 17 nt, Homo sapiens
agugccugccuaugaaa

SEQ ID NO: 661184 - RNA, 21 nt, Homo sapiens
agugccuuaaacucuguuaca

SEQ ID NO: 661185 - RNA, 22 nt, Homo sapiens
agugccuuccucucucuaccag

SEQ ID NO: 661186 - RNA, 20 nt, Homo sapiens
agugccuucuaaagguguug

SEQ ID NO: 661187 - RNA, 15 nt, Homo sapiens
agugccuuuaucuca

SEQ ID NO: 661188 - RNA, 18 nt, Homo sapiens
agugcggacaaguuuuaa

SEQ ID NO: 661189 - RNA, 18 nt, Homo sapiens
agugcuaaacaaguaaga

SEQ ID NO: 661190 - RNA, 14 nt, Homo sapiens
agugcuaguauuau

SEQ ID NO: 661191 - RNA, 23 nt, Homo sapiens
agugcuccuccguguggacugug

SEQ ID NO: 661192 - RNA, 14 nt, Homo sapiens
agugcucucagcug

SEQ ID NO: 661193 - RNA, 22 nt, Homo sapiens
agugcugaaauaaaaugauaaa

SEQ ID NO: 661194 - RNA, 23 nt, Homo sapiens
acaaguuggaugcggccauucaa

SEQ ID NO: 661195 - RNA, 21 nt, Homo sapiens
acaaguuucugauaccacugc

SEQ ID NO: 661196 - RNA, 19 nt, Homo sapiens
acaauaaaaaauccucaac

SEQ ID NO: 661197 - RNA, 17 nt, Homo sapiens
acaauaaaaacauugcc

SEQ ID NO: 661198 - RNA, 16 nt, Homo sapiens
acaauaaaacauuaau

SEQ ID NO: 661199 - RNA, 19 nt, Homo sapiens
acaauaaaaugucuucucc

SEQ ID NO: 661200 - RNA, 20 nt, Homo sapiens
acaauaaaaugucuucuccc

SEQ ID NO: 661201 - RNA, 14 nt, Homo sapiens
acaauaaagcaaug

SEQ ID NO: 661202 - RNA, 13 nt, Homo sapiens
acaauaaauacag

SEQ ID NO: 661203 - RNA, 13 nt, Homo sapiens
acaauaaauuauu

SEQ ID NO: 661204 - RNA, 12 nt, Homo sapiens
acaauacaguaa

SEQ ID NO: 661205 - RNA, 13 nt, Homo sapiens
acaauacauauau

SEQ ID NO: 661206 - RNA, 23 nt, Homo sapiens
acaauacugggguuggacuguaa

SEQ ID NO: 661207 - RNA, 13 nt, Homo sapiens
acaauacuguucu

SEQ ID NO: 661208 - RNA, 17 nt, Homo sapiens
acaauagcccaaagcca

SEQ ID NO: 661209 - RNA, 16 nt, Homo sapiens
acaauaggucuuucuc

SEQ ID NO: 661210 - RNA, 14 nt, Homo sapiens
acaauaguucugug

SEQ ID NO: 661211 - RNA, 13 nt, Homo sapiens
acaauaugugcca

SEQ ID NO: 661212 - RNA, 16 nt, Homo sapiens
acaauauguggucaau

SEQ ID NO: 661213 - RNA, 16 nt, Homo sapiens
acaauauuaaguccaa

SEQ ID NO: 661214 - RNA, 20 nt, Homo sapiens
acaauauuguauacuaccau

SEQ ID NO: 661215 - RNA, 15 nt, Homo sapiens
acaaucaaagcacuu

SEQ ID NO: 661216 - RNA, 22 nt, Homo sapiens
acaaucaaaucuccugcugauu

SEQ ID NO: 661217 - RNA, 16 nt, Homo sapiens
acaaucaacaaaaugg

SEQ ID NO: 661218 - RNA, 18 nt, Homo sapiens
acaaucaugaacagcucu

SEQ ID NO: 661219 - RNA, 22 nt, Homo sapiens
acaaucaugaacagcucugaga

SEQ ID NO: 661220 - RNA, 20 nt, Homo sapiens
acaaucccuuucuaaggaag

SEQ ID NO: 661221 - RNA, 18 nt, Homo sapiens
acaauccuauuacucuuc

SEQ ID NO: 661222 - RNA, 12 nt, Homo sapiens
acaauccuccaa

SEQ ID NO: 661223 - RNA, 22 nt, Homo sapiens
acaauccuccaagaauuugacu

SEQ ID NO: 661224 - RNA, 19 nt, Homo sapiens
acaaucucuguuuguaugu

SEQ ID NO: 661225 - RNA, 18 nt, Homo sapiens
acaaucuuauugucaaca

SEQ ID NO: 661226 - RNA, 19 nt, Homo sapiens
acaaugaccacauccugaa

SEQ ID NO: 661227 - RNA, 22 nt, Homo sapiens
acaaugacugcuuuguuuggau

SEQ ID NO: 661228 - RNA, 14 nt, Homo sapiens
acaaugccaauagg

SEQ ID NO: 661229 - RNA, 21 nt, Homo sapiens
acaaugcccugcuggccuguc

SEQ ID NO: 661230 - RNA, 15 nt, Homo sapiens
acaauggcaauagga

SEQ ID NO: 661231 - RNA, 16 nt, Homo sapiens
acaauggcaccucugc

SEQ ID NO: 661232 - RNA, 14 nt, Homo sapiens
acaauggcccaggu

SEQ ID NO: 661233 - RNA, 21 nt, Homo sapiens
acaauggcuaauucccagagu

SEQ ID NO: 661234 - RNA, 14 nt, Homo sapiens
acaauguacaauua

SEQ ID NO: 661235 - RNA, 11 nt, Homo sapiens
acaauguaucu

SEQ ID NO: 661236 - RNA, 16 nt, Homo sapiens
acaauguauguacaau

SEQ ID NO: 661237 - RNA, 14 nt, Homo sapiens
acaauguucauccc

SEQ ID NO: 661238 - RNA, 19 nt, Homo sapiens
acaauuaaaaugacaagca

SEQ ID NO: 661239 - RNA, 18 nt, Homo sapiens
acaauuacuaaauuguau

SEQ ID NO: 661240 - RNA, 18 nt, Homo sapiens
acaauuauaucaguccuc

SEQ ID NO: 661241 - RNA, 18 nt, Homo sapiens
acaauuaugaacauccaa

SEQ ID NO: 661242 - RNA, 14 nt, Homo sapiens
acaauuauguuuuc

SEQ ID NO: 661243 - RNA, 14 nt, Homo sapiens
acaauucaagcuga

SEQ ID NO: 661244 - RNA, 12 nt, Homo sapiens
acaauucugcau

SEQ ID NO: 661245 - RNA, 14 nt, Homo sapiens
acaauucugucccu

SEQ ID NO: 661246 - RNA, 16 nt, Homo sapiens
acaauucuucugucaa

SEQ ID NO: 661247 - RNA, 21 nt, Homo sapiens
acaauugcaacagaagcaaaa

SEQ ID NO: 661248 - RNA, 14 nt, Homo sapiens
acaauugcaguuuu

SEQ ID NO: 661249 - RNA, 17 nt, Homo sapiens
acaauuggcacuaaaga

SEQ ID NO: 661250 - RNA, 23 nt, Homo sapiens
acaauugguaaaacucacuguga

SEQ ID NO: 661251 - RNA, 23 nt, Homo sapiens
acaauuuccauauagucuauuca

SEQ ID NO: 661252 - RNA, 16 nt, Homo sapiens
acaauuugacauacaa

SEQ ID NO: 661253 - RNA, 16 nt, Homo sapiens
acaauuugauacauaa

SEQ ID NO: 661254 - RNA, 17 nt, Homo sapiens
acaauuugauacauaau

SEQ ID NO: 661255 - RNA, 17 nt, Homo sapiens
acaauuuguuuuugcau

SEQ ID NO: 661256 - RNA, 18 nt, Homo sapiens
acaauuuuaaaguucuua

SEQ ID NO: 661257 - RNA, 23 nt, Homo sapiens
acaauuuuuuuuauuaguauugu

SEQ ID NO: 661258 - RNA, 22 nt, Homo sapiens
acacaaaacguuaagugaugaa

SEQ ID NO: 661259 - RNA, 14 nt, Homo sapiens
acacaaacaaggcc

SEQ ID NO: 661260 - RNA, 13 nt, Homo sapiens
acacaaagacauu

SEQ ID NO: 661261 - RNA, 18 nt, Homo sapiens
acacaaagacauugauuc

SEQ ID NO: 661262 - RNA, 13 nt, Homo sapiens
acacaaagcacau

SEQ ID NO: 661263 - RNA, 19 nt, Homo sapiens
acacaagccacagaagcca

SEQ ID NO: 661264 - RNA, 18 nt, Homo sapiens
acacaaggugcaaaucaa

SEQ ID NO: 661265 - RNA, 19 nt, Homo sapiens
acacaauguggacgugcac

SEQ ID NO: 661266 - RNA, 12 nt, Homo sapiens
acacacacaaac

SEQ ID NO: 661267 - RNA, 14 nt, Homo sapiens
acacacacauacag

SEQ ID NO: 661268 - RNA, 14 nt, Homo sapiens
acacacacauauac

SEQ ID NO: 661269 - RNA, 14 nt, Homo sapiens
acacacacaucuca

SEQ ID NO: 661270 - RNA, 21 nt, Homo sapiens
acacacacucaccaguggccu

SEQ ID NO: 661271 - RNA, 22 nt, Homo sapiens
acacacauaccuucaugugguu

SEQ ID NO: 661272 - RNA, 16 nt, Homo sapiens
acacacauugcagcuu

SEQ ID NO: 661273 - RNA, 16 nt, Homo sapiens
acacacccugagguca

SEQ ID NO: 661274 - RNA, 16 nt, Homo sapiens
acacaccugaacacau

SEQ ID NO: 661275 - RNA, 21 nt, Homo sapiens
acacaccuggguggacacaag

SEQ ID NO: 661276 - RNA, 15 nt, Homo sapiens
acacacgaugcauuu

SEQ ID NO: 661277 - RNA, 20 nt, Homo sapiens
acacacgcacacaaaccaca

SEQ ID NO: 661278 - RNA, 20 nt, Homo sapiens
acacacuaccgaaugugucu

SEQ ID NO: 661279 - RNA, 14 nt, Homo sapiens
acacacuccgucca

SEQ ID NO: 661280 - RNA, 19 nt, Homo sapiens
acacugcagaacagcauca

SEQ ID NO: 661281 - RNA, 14 nt, Homo sapiens
acacugcagcugaa

SEQ ID NO: 661282 - RNA, 20 nt, Homo sapiens
acacugcauguuugugauug

SEQ ID NO: 661283 - RNA, 15 nt, Homo sapiens
acacugccucugagu

SEQ ID NO: 661284 - RNA, 19 nt, Homo sapiens
acacugcuaggugggccag

SEQ ID NO: 661285 - RNA, 23 nt, Homo sapiens
acacugcugagguuuuauacuca

SEQ ID NO: 661286 - RNA, 13 nt, Homo sapiens
acacugcuuuaaa

SEQ ID NO: 661287 - RNA, 18 nt, Homo sapiens
acacuggaacauggcuag

SEQ ID NO: 661288 - RNA, 16 nt, Homo sapiens
acacuggagccaucuc

SEQ ID NO: 661289 - RNA, 19 nt, Homo sapiens
acacugggagaggugccag

SEQ ID NO: 661290 - RNA, 21 nt, Homo sapiens
acacugguuugagcuuaguga

SEQ ID NO: 661291 - RNA, 21 nt, Homo sapiens
acacuguaaucuuaaaagugu

SEQ ID NO: 661292 - RNA, 12 nt, Homo sapiens
acacugucuucc

SEQ ID NO: 661293 - RNA, 19 nt, Homo sapiens
acacugugaacucaaucuc

SEQ ID NO: 661294 - RNA, 14 nt, Homo sapiens
acacuguggccagg

SEQ ID NO: 661295 - RNA, 16 nt, Homo sapiens
acacugugggacucuu

SEQ ID NO: 661296 - RNA, 15 nt, Homo sapiens
acacuuaauagcaac

SEQ ID NO: 661297 - RNA, 15 nt, Homo sapiens
acacuuaaugauaca

SEQ ID NO: 661298 - RNA, 16 nt, Homo sapiens
acacuuacagaauuau

SEQ ID NO: 661299 - RNA, 20 nt, Homo sapiens
acacuuaugggccaagccca

SEQ ID NO: 661300 - RNA, 21 nt, Homo sapiens
acacuucguucgcagagcuuu

SEQ ID NO: 661301 - RNA, 24 nt, Homo sapiens
acacuucguucgcagagcuuuuca

SEQ ID NO: 661302 - RNA, 14 nt, Homo sapiens
acacuucuauuuaa

SEQ ID NO: 661303 - RNA, 20 nt, Homo sapiens
acacuucugcuuucacuuaa

SEQ ID NO: 661304 - RNA, 16 nt, Homo sapiens
acacuuggaugcaggg

SEQ ID NO: 661305 - RNA, 16 nt, Homo sapiens
acacuuggcauacaaa

SEQ ID NO: 661306 - RNA, 23 nt, Homo sapiens
acacuugggauugucuuacuguu

SEQ ID NO: 661307 - RNA, 14 nt, Homo sapiens
acacuuucuaugcu

SEQ ID NO: 661308 - RNA, 16 nt, Homo sapiens
acagaaaccaagccau

SEQ ID NO: 661309 - RNA, 20 nt, Homo sapiens
acagaaaugauuacuaagga

SEQ ID NO: 661310 - RNA, 18 nt, Homo sapiens
acagaacaccuaugcaaa

SEQ ID NO: 661311 - RNA, 13 nt, Homo sapiens
acagaacuacuuc

SEQ ID NO: 661312 - RNA, 21 nt, Homo sapiens
acagaacugcagucagcauga

SEQ ID NO: 661313 - RNA, 15 nt, Homo sapiens
acagaagacagcagc

SEQ ID NO: 661314 - RNA, 22 nt, Homo sapiens
acagaagacagcagcaagugug

SEQ ID NO: 661315 - RNA, 23 nt, Homo sapiens
acagaagacagcagcaagugugc

SEQ ID NO: 661316 - RNA, 17 nt, Homo sapiens
acagaagcaaaaauuca

SEQ ID NO: 661317 - RNA, 18 nt, Homo sapiens
acagaagcaaaaauucac

SEQ ID NO: 661318 - RNA, 20 nt, Homo sapiens
acagaagccuggacucugcc

SEQ ID NO: 661319 - RNA, 13 nt, Homo sapiens
aguuacuggcaca

SEQ ID NO: 661320 - RNA, 19 nt, Homo sapiens
aguuacuguggucacuugu

SEQ ID NO: 661321 - RNA, 12 nt, Homo sapiens
aguuacugugua

SEQ ID NO: 661322 - RNA, 12 nt, Homo sapiens
aguuacuuuaga

SEQ ID NO: 661323 - RNA, 20 nt, Homo sapiens
aguuacuuuuuuacacugau

SEQ ID NO: 661324 - RNA, 13 nt, Homo sapiens
aguuagauucacu

SEQ ID NO: 661325 - RNA, 16 nt, Homo sapiens
aguuagguagcuuuag

SEQ ID NO: 661326 - RNA, 14 nt, Homo sapiens
aguuaggugggucu

SEQ ID NO: 661327 - RNA, 16 nt, Homo sapiens
aguuaguauagcuuua

SEQ ID NO: 661328 - RNA, 12 nt, Homo sapiens
aguuagucaauc

SEQ ID NO: 661329 - RNA, 13 nt, Homo sapiens
aguuagucaaucc

SEQ ID NO: 661330 - RNA, 18 nt, Homo sapiens
aguuauaauaacugaacu

SEQ ID NO: 661331 - RNA, 13 nt, Homo sapiens
aguuaucaucuca

SEQ ID NO: 661332 - RNA, 18 nt, Homo sapiens
aguuaucaucucaccaca

SEQ ID NO: 661333 - RNA, 22 nt, Homo sapiens
aguuaucuuagcuggauauaau

SEQ ID NO: 661334 - RNA, 17 nt, Homo sapiens
aguuaugauguaaucuc

SEQ ID NO: 661335 - RNA, 21 nt, Homo sapiens
aguuaugauguaaucucucug

SEQ ID NO: 661336 - RNA, 16 nt, Homo sapiens
aguuauggugaaccca

SEQ ID NO: 661337 - RNA, 19 nt, Homo sapiens
aguuauguaguuucuuguc

SEQ ID NO: 661338 - RNA, 16 nt, Homo sapiens
aguuauuaaacagugu

SEQ ID NO: 661339 - RNA, 20 nt, Homo sapiens
aguuauuacugucucuggca

SEQ ID NO: 661340 - RNA, 21 nt, Homo sapiens
aguucaaaugaugaagaccaa

SEQ ID NO: 661341 - RNA, 22 nt, Homo sapiens
aguucaaauucuucugaacuca

SEQ ID NO: 661342 - RNA, 15 nt, Homo sapiens
aguucacauacaaau

SEQ ID NO: 661343 - RNA, 17 nt, Homo sapiens
aguucagcuccuuccac

SEQ ID NO: 661344 - RNA, 17 nt, Homo sapiens
aguucaggcagcacauc

SEQ ID NO: 661345 - RNA, 16 nt, Homo sapiens
aguucaggcucugaga

SEQ ID NO: 661346 - RNA, 19 nt, Homo sapiens
aguucaggcucugagacac

SEQ ID NO: 661347 - RNA, 21 nt, Homo sapiens
aguucagggaccguccagggg

SEQ ID NO: 661348 - RNA, 16 nt, Homo sapiens
aguucauaaacaacag

SEQ ID NO: 661349 - RNA, 18 nt, Homo sapiens
aguucauagggucucuuc

SEQ ID NO: 661350 - RNA, 17 nt, Homo sapiens
aguucauauguaccaug

SEQ ID NO: 661351 - RNA, 18 nt, Homo sapiens
aguucauauguaccaugu

SEQ ID NO: 661352 - RNA, 23 nt, Homo sapiens
aguuccaggccugaucuugccug

SEQ ID NO: 661353 - RNA, 23 nt, Homo sapiens
aguuccaguugaaguuaguggaa

SEQ ID NO: 661354 - RNA, 19 nt, Homo sapiens
aguuccaugaagaccacau

SEQ ID NO: 661355 - RNA, 15 nt, Homo sapiens
aguuccccaaauaca

SEQ ID NO: 661356 - RNA, 19 nt, Homo sapiens
aguucccccaguaccucca

SEQ ID NO: 661357 - RNA, 17 nt, Homo sapiens
aguucccggagcacagc

SEQ ID NO: 661358 - RNA, 17 nt, Homo sapiens
aguuccgccucccgggu

SEQ ID NO: 661359 - RNA, 22 nt, Homo sapiens
aguuccggccugggcaccagca

SEQ ID NO: 661360 - RNA, 20 nt, Homo sapiens
aguuccuaugacacaguuau

SEQ ID NO: 661361 - RNA, 17 nt, Homo sapiens
aguuccucugcaguuuu

SEQ ID NO: 661362 - RNA, 21 nt, Homo sapiens
aguuccugcuccguggacugc

SEQ ID NO: 661363 - RNA, 18 nt, Homo sapiens
aguuccuuacuguuuaca

SEQ ID NO: 661364 - RNA, 18 nt, Homo sapiens
aguucgaggcugcaguca

SEQ ID NO: 661365 - RNA, 19 nt, Homo sapiens
aguucuacauuauucuuca

SEQ ID NO: 661366 - RNA, 24 nt, Homo sapiens
aguucuacgugggagucugugcau

SEQ ID NO: 661367 - RNA, 14 nt, Homo sapiens
aguucuacugaccu

SEQ ID NO: 661368 - RNA, 14 nt, Homo sapiens
aguucucaauguuc

SEQ ID NO: 661369 - RNA, 23 nt, Homo sapiens
aguucucccuguacaguguuacc

SEQ ID NO: 661370 - RNA, 19 nt, Homo sapiens
aguucucuagggucugaua

SEQ ID NO: 661371 - RNA, 15 nt, Homo sapiens
aguucugaacuggaa

SEQ ID NO: 661372 - RNA, 18 nt, Homo sapiens
aguucugaauaacuugaa

SEQ ID NO: 661373 - RNA, 15 nt, Homo sapiens
aguucugaguccuga

SEQ ID NO: 661374 - RNA, 23 nt, Homo sapiens
aguucugcaaaaaugaccuauaa

SEQ ID NO: 661375 - RNA, 21 nt, Homo sapiens
aguucugcagguugaagccau

SEQ ID NO: 661376 - RNA, 21 nt, Homo sapiens
aguucuugagggccuccccac

SEQ ID NO: 661377 - RNA, 19 nt, Homo sapiens
aguucuugggcuggaccug

SEQ ID NO: 661378 - RNA, 16 nt, Homo sapiens
aguucuuguucuucag

SEQ ID NO: 661379 - RNA, 20 nt, Homo sapiens
aguugaagggaauacugugc

SEQ ID NO: 661380 - RNA, 19 nt, Homo sapiens
aguugaauaaaagugcaca

SEQ ID NO: 661381 - RNA, 16 nt, Homo sapiens
aguugaccguuuucau

SEQ ID NO: 661382 - RNA, 14 nt, Homo sapiens
aguugagacuuaaa

SEQ ID NO: 661383 - RNA, 19 nt, Homo sapiens
aguugagagagaaucucaa

SEQ ID NO: 661384 - RNA, 20 nt, Homo sapiens
aguugaucuacaaaggccau

SEQ ID NO: 661385 - RNA, 14 nt, Homo sapiens
aguugauucagcuc

SEQ ID NO: 661386 - RNA, 21 nt, Homo sapiens
aguugauuccucaaguuauga

SEQ ID NO: 661387 - RNA, 18 nt, Homo sapiens
aguugauuuuacaauuga

SEQ ID NO: 661388 - RNA, 19 nt, Homo sapiens
aguugcagugagcagggug

SEQ ID NO: 661389 - RNA, 17 nt, Homo sapiens
aguugccguugaggguu

SEQ ID NO: 661390 - RNA, 17 nt, Homo sapiens
aguugcucacaugucuu

SEQ ID NO: 661391 - RNA, 21 nt, Homo sapiens
aguugcugggauuacaggugu

SEQ ID NO: 661392 - RNA, 13 nt, Homo sapiens
aguugcuguaugu

SEQ ID NO: 661393 - RNA, 23 nt, Homo sapiens
aguugcugugaacuuucauguca

SEQ ID NO: 661394 - RNA, 16 nt, Homo sapiens
aguugcuuuuauugca

SEQ ID NO: 661395 - RNA, 17 nt, Homo sapiens
aguugcuuuucagcuga

SEQ ID NO: 661396 - RNA, 21 nt, Homo sapiens
aguuggaaaaacaaaugccau

SEQ ID NO: 661397 - RNA, 14 nt, Homo sapiens
aguuggaauguugu

SEQ ID NO: 661398 - RNA, 18 nt, Homo sapiens
aguuggaauucaccaaga

SEQ ID NO: 661399 - RNA, 17 nt, Homo sapiens
aguuggacucucaggga

SEQ ID NO: 661400 - RNA, 15 nt, Homo sapiens
aguuggcacauuuca

SEQ ID NO: 661401 - RNA, 17 nt, Homo sapiens
acaguacuuuauuguac

SEQ ID NO: 661402 - RNA, 15 nt, Homo sapiens
acaguagaacugucu

SEQ ID NO: 661403 - RNA, 14 nt, Homo sapiens
acaguagaagcuca

SEQ ID NO: 661404 - RNA, 22 nt, Homo sapiens
acaguagagcaaaucuaugaga

SEQ ID NO: 661405 - RNA, 16 nt, Homo sapiens
acaguagauuuuccaa

SEQ ID NO: 661406 - RNA, 14 nt, Homo sapiens
acaguauccacaau

SEQ ID NO: 661407 - RNA, 23 nt, Homo sapiens
acaguaucuacuugcauguguau

SEQ ID NO: 661408 - RNA, 13 nt, Homo sapiens
acaguauugccac

SEQ ID NO: 661409 - RNA, 23 nt, Homo sapiens
acaguauuucauugccuguguau

SEQ ID NO: 661410 - RNA, 16 nt, Homo sapiens
acaguauuuugguucu

SEQ ID NO: 661411 - RNA, 17 nt, Homo sapiens
acagucaauggauccac

SEQ ID NO: 661412 - RNA, 20 nt, Homo sapiens
acagucaccgacaacaugcu

SEQ ID NO: 661413 - RNA, 23 nt, Homo sapiens
acagucacgcaagcuaguuccca

SEQ ID NO: 661414 - RNA, 20 nt, Homo sapiens
acagucacuugggagcugcu

SEQ ID NO: 661415 - RNA, 22 nt, Homo sapiens
acagucauaaauacugucaaac

SEQ ID NO: 661416 - RNA, 17 nt, Homo sapiens
acagucaucugccacca

SEQ ID NO: 661417 - RNA, 13 nt, Homo sapiens
acaguccacaggg

SEQ ID NO: 661418 - RNA, 22 nt, Homo sapiens
acaguccaggaacaagcuaauu

SEQ ID NO: 661419 - RNA, 22 nt, Homo sapiens
acaguccugggagaaccucagg

SEQ ID NO: 661420 - RNA, 13 nt, Homo sapiens
acagucuaaaaau

SEQ ID NO: 661421 - RNA, 21 nt, Homo sapiens
acagucuacauugagcauuug

SEQ ID NO: 661422 - RNA, 19 nt, Homo sapiens
acagucuucuaauuccuca

SEQ ID NO: 661423 - RNA, 19 nt, Homo sapiens
acagugaagcagcacugug

SEQ ID NO: 661424 - RNA, 14 nt, Homo sapiens
acagugaauccaga

SEQ ID NO: 661425 - RNA, 15 nt, Homo sapiens
acagugacacccaga

SEQ ID NO: 661426 - RNA, 21 nt, Homo sapiens
acagugacuguacaguuauca

SEQ ID NO: 661427 - RNA, 16 nt, Homo sapiens
acagugagaaaccaua

SEQ ID NO: 661428 - RNA, 22 nt, Homo sapiens
acagugaucuccauauguuaca

SEQ ID NO: 661429 - RNA, 17 nt, Homo sapiens
acagugaugaauguacu

SEQ ID NO: 661430 - RNA, 12 nt, Homo sapiens
acagugaugcug

SEQ ID NO: 661431 - RNA, 13 nt, Homo sapiens
acagugcagacag

SEQ ID NO: 661432 - RNA, 12 nt, Homo sapiens
acagugcaguga

SEQ ID NO: 661433 - RNA, 15 nt, Homo sapiens
acagugccugggaau

SEQ ID NO: 661434 - RNA, 19 nt, Homo sapiens
acagugcucgaccuugaua

SEQ ID NO: 661435 - RNA, 21 nt, Homo sapiens
acaguggaggaagagggacag

SEQ ID NO: 661436 - RNA, 22 nt, Homo sapiens
acaguggaggaagagggacaga

SEQ ID NO: 661437 - RNA, 15 nt, Homo sapiens
acaguggcacaauca

SEQ ID NO: 661438 - RNA, 18 nt, Homo sapiens
acaguggcacaaucaugg

SEQ ID NO: 661439 - RNA, 16 nt, Homo sapiens
acaguggccaaagagg

SEQ ID NO: 661440 - RNA, 18 nt, Homo sapiens
acaguggggcugcaggca

SEQ ID NO: 661441 - RNA, 15 nt, Homo sapiens
acaguguacucuaua

SEQ ID NO: 661442 - RNA, 19 nt, Homo sapiens
acaguguauguacuaagca

SEQ ID NO: 661443 - RNA, 19 nt, Homo sapiens
auaaaucaaugucacuuaa

SEQ ID NO: 661444 - RNA, 23 nt, Homo sapiens
auaaaucagagagcaaggcaucg

SEQ ID NO: 661445 - RNA, 13 nt, Homo sapiens
auaaaucagucaa

SEQ ID NO: 661446 - RNA, 20 nt, Homo sapiens
auaaaucauucuuacuaaaa

SEQ ID NO: 661447 - RNA, 18 nt, Homo sapiens
auaaaucucaaugaauuc

SEQ ID NO: 661448 - RNA, 17 nt, Homo sapiens
auaaaucucuccuauaa

SEQ ID NO: 661449 - RNA, 22 nt, Homo sapiens
auaaaucucuucuuugcugcag

SEQ ID NO: 661450 - RNA, 20 nt, Homo sapiens
auaaaugaaguauuucucac

SEQ ID NO: 661451 - RNA, 16 nt, Homo sapiens
auaaaugacacaauga

SEQ ID NO: 661452 - RNA, 22 nt, Homo sapiens
auaaaugagggcugcacauugc

SEQ ID NO: 661453 - RNA, 20 nt, Homo sapiens
auaaaugauuaaaaaaucag

SEQ ID NO: 661454 - RNA, 16 nt, Homo sapiens
auaaaugggaaaucag

SEQ ID NO: 661455 - RNA, 17 nt, Homo sapiens
auaaauguacauuaauu

SEQ ID NO: 661456 - RNA, 17 nt, Homo sapiens
auaaauguauccagaua

SEQ ID NO: 661457 - RNA, 22 nt, Homo sapiens
auaaauguuauguuugcuaaaa

SEQ ID NO: 661458 - RNA, 20 nt, Homo sapiens
auaaauuaaacaugcuguua

SEQ ID NO: 661459 - RNA, 16 nt, Homo sapiens
auaaauuacacaauaa

SEQ ID NO: 661460 - RNA, 16 nt, Homo sapiens
auaaauuacagucauc

SEQ ID NO: 661461 - RNA, 21 nt, Homo sapiens
auaaauuacuuuuucauucuu

SEQ ID NO: 661462 - RNA, 13 nt, Homo sapiens
auaaauucaucag

SEQ ID NO: 661463 - RNA, 16 nt, Homo sapiens
auaaauucaucagaau

SEQ ID NO: 661464 - RNA, 14 nt, Homo sapiens
auaaauucuacucu

SEQ ID NO: 661465 - RNA, 14 nt, Homo sapiens
auaaauugauuugu

SEQ ID NO: 661466 - RNA, 22 nt, Homo sapiens
auaaauugcuuacugauauuau

SEQ ID NO: 661467 - RNA, 17 nt, Homo sapiens
auaaauuguagggcuuu

SEQ ID NO: 661468 - RNA, 23 nt, Homo sapiens
auaaauuucugggauauuuaacu

SEQ ID NO: 661469 - RNA, 15 nt, Homo sapiens
auaaauuugcacugu

SEQ ID NO: 661470 - RNA, 20 nt, Homo sapiens
auaaauuuggacugucuaua

SEQ ID NO: 661471 - RNA, 14 nt, Homo sapiens
auaaauuugguucu

SEQ ID NO: 661472 - RNA, 20 nt, Homo sapiens
auaaauuuuagugugccuuc

SEQ ID NO: 661473 - RNA, 23 nt, Homo sapiens
auaaauuuuauaacagaauuaaa

SEQ ID NO: 661474 - RNA, 20 nt, Homo sapiens
auaaauuuuuugugaucagu

SEQ ID NO: 661475 - RNA, 17 nt, Homo sapiens
auaacaaagcacauaac

SEQ ID NO: 661476 - RNA, 14 nt, Homo sapiens
auaacaaagcccuu

SEQ ID NO: 661477 - RNA, 15 nt, Homo sapiens
auaacaaagcccuua

SEQ ID NO: 661478 - RNA, 20 nt, Homo sapiens
auaacaagaucuuucaggaa

SEQ ID NO: 661479 - RNA, 13 nt, Homo sapiens
auaacaaucacaa

SEQ ID NO: 661480 - RNA, 20 nt, Homo sapiens
auaacagcuggggacaacug

SEQ ID NO: 661481 - RNA, 16 nt, Homo sapiens
auaacaguuacuccag

SEQ ID NO: 661482 - RNA, 21 nt, Homo sapiens
auaacaugucuuucagcauua

SEQ ID NO: 661483 - RNA, 23 nt, Homo sapiens
auaacauugcacuuuauaaacac

SEQ ID NO: 661484 - RNA, 18 nt, Homo sapiens
auaacauuuaaauuccac

SEQ ID NO: 661485 - RNA, 19 nt, Homo sapiens
auaacauuuaaauuccaca

SEQ ID NO: 661486 - RNA, 22 nt, Homo sapiens
auaacauuuaaauuccacagau

SEQ ID NO: 661487 - RNA, 12 nt, Homo sapiens
auaaccacuuaa

SEQ ID NO: 661488 - RNA, 19 nt, Homo sapiens
auaaccagccauuggcuau

SEQ ID NO: 661489 - RNA, 10 nt, Homo sapiens
auaacccaua

SEQ ID NO: 661490 - RNA, 20 nt, Homo sapiens
auaaccccagcucccuagga

SEQ ID NO: 661491 - RNA, 22 nt, Homo sapiens
auaaccucaaagugacuauuca

SEQ ID NO: 661492 - RNA, 17 nt, Homo sapiens
auaaccucucugugcca

SEQ ID NO: 661493 - RNA, 14 nt, Homo sapiens
auaaccucuggccc

SEQ ID NO: 661494 - RNA, 19 nt, Homo sapiens
auaaccugaugccauaaau

SEQ ID NO: 661495 - RNA, 19 nt, Homo sapiens
auaaccuuuuuguauauca

SEQ ID NO: 661496 - RNA, 17 nt, Homo sapiens
auaacgagguuccagua

SEQ ID NO: 661497 - RNA, 18 nt, Homo sapiens
auaacuaguguugcuugg

SEQ ID NO: 661498 - RNA, 18 nt, Homo sapiens
auaacuaucucacuucca

SEQ ID NO: 661499 - RNA, 22 nt, Homo sapiens
auaacuccuuguuucagaugau

SEQ ID NO: 661500 - RNA, 18 nt, Homo sapiens
auaacugaaaaugugcua

SEQ ID NO: 661501 - RNA, 14 nt, Homo sapiens
auaacugaacuguu

SEQ ID NO: 661502 - RNA, 22 nt, Homo sapiens
auaacuggaaaacagaacacuu

SEQ ID NO: 661503 - RNA, 23 nt, Homo sapiens
auaacuggaaaacagaacacuua

SEQ ID NO: 661504 - RNA, 22 nt, Homo sapiens
auaacuguaaaugugacauuga

SEQ ID NO: 661505 - RNA, 22 nt, Homo sapiens
auaacuguauuugaaauaagaa

SEQ ID NO: 661506 - RNA, 15 nt, Homo sapiens
auaacugucuuguuu

SEQ ID NO: 661507 - RNA, 17 nt, Homo sapiens
auaacuugaagaacagg

SEQ ID NO: 661508 - RNA, 13 nt, Homo sapiens
auaacuugauaua

SEQ ID NO: 661509 - RNA, 19 nt, Homo sapiens
auaacuuggggaggcaaga

SEQ ID NO: 661510 - RNA, 18 nt, Homo sapiens
auaacuuguccuauguca

SEQ ID NO: 661511 - RNA, 16 nt, Homo sapiens
auaacuuuauugcaua

SEQ ID NO: 661512 - RNA, 20 nt, Homo sapiens
auaacuuuucaccaaugagc

SEQ ID NO: 661513 - RNA, 19 nt, Homo sapiens
auaagaaaaaauucuuuca

SEQ ID NO: 661514 - RNA, 17 nt, Homo sapiens
auaagaaagaucaaaga

SEQ ID NO: 661515 - RNA, 14 nt, Homo sapiens
auaagaaagcacua

SEQ ID NO: 661516 - RNA, 16 nt, Homo sapiens
auaagaaaguauaaag

SEQ ID NO: 661517 - RNA, 16 nt, Homo sapiens
auaagaaagugcgagu

SEQ ID NO: 661518 - RNA, 22 nt, Homo sapiens
auaagaaagugcgaguccucca

SEQ ID NO: 661519 - RNA, 13 nt, Homo sapiens
auaagaagugcca

SEQ ID NO: 661520 - RNA, 13 nt, Homo sapiens
auaagacauuugu

SEQ ID NO: 661521 - RNA, 15 nt, Homo sapiens
auaagaccucuggca

SEQ ID NO: 661522 - RNA, 15 nt, Homo sapiens
auacauguaccuaua

SEQ ID NO: 661523 - RNA, 15 nt, Homo sapiens
auacauguacuccag

SEQ ID NO: 661524 - RNA, 23 nt, Homo sapiens
auacauguaucugguuugucagg

SEQ ID NO: 661525 - RNA, 21 nt, Homo sapiens
auacaugugccgaaugugcag

SEQ ID NO: 661526 - RNA, 16 nt, Homo sapiens
auacauucuaugacau

SEQ ID NO: 661527 - RNA, 16 nt, Homo sapiens
auacauucugcuuuca

SEQ ID NO: 661528 - RNA, 23 nt, Homo sapiens
auacauuguauuaauaccaaagu

SEQ ID NO: 661529 - RNA, 20 nt, Homo sapiens
auacauuucaauuauacuaa

SEQ ID NO: 661530 - RNA, 18 nt, Homo sapiens
auaccaaagacacaagca

SEQ ID NO: 661531 - RNA, 19 nt, Homo sapiens
auaccaaagacacaagcaa

SEQ ID NO: 661532 - RNA, 13 nt, Homo sapiens
auaccaagcuugu

SEQ ID NO: 661533 - RNA, 19 nt, Homo sapiens
auaccagagaccugaggca

SEQ ID NO: 661534 - RNA, 12 nt, Homo sapiens
auaccagcaaua

SEQ ID NO: 661535 - RNA, 16 nt, Homo sapiens
auaccagugaaccaaa

SEQ ID NO: 661536 - RNA, 15 nt, Homo sapiens
auacccacuaacaaa

SEQ ID NO: 661537 - RNA, 13 nt, Homo sapiens
auacccaguuuag

SEQ ID NO: 661538 - RNA, 15 nt, Homo sapiens
auacccauauguccu

SEQ ID NO: 661539 - RNA, 14 nt, Homo sapiens
auacccaugaacuu

SEQ ID NO: 661540 - RNA, 16 nt, Homo sapiens
auacccccugcaaagc

SEQ ID NO: 661541 - RNA, 21 nt, Homo sapiens
auaccccggugugccugugga

SEQ ID NO: 661542 - RNA, 17 nt, Homo sapiens
auacccugaauuuggcc

SEQ ID NO: 661543 - RNA, 23 nt, Homo sapiens
auaccgcugcauaguauuccauu

SEQ ID NO: 661544 - RNA, 19 nt, Homo sapiens
auaccucaguuugcauauu

SEQ ID NO: 661545 - RNA, 22 nt, Homo sapiens
auaccuccucccuaaugcucac

SEQ ID NO: 661546 - RNA, 19 nt, Homo sapiens
auaccucuuagcugagugg

SEQ ID NO: 661547 - RNA, 23 nt, Homo sapiens
auaccugauugaucacacagugu

SEQ ID NO: 661548 - RNA, 22 nt, Homo sapiens
auaccugcucuuguucuacuga

SEQ ID NO: 661549 - RNA, 18 nt, Homo sapiens
auaccuggcuuuuacuuu

SEQ ID NO: 661550 - RNA, 19 nt, Homo sapiens
auaccuggcuuuuacuuua

SEQ ID NO: 661551 - RNA, 17 nt, Homo sapiens
auacgaaaaucccauga

SEQ ID NO: 661552 - RNA, 17 nt, Homo sapiens
auacgcucaccuuacag

SEQ ID NO: 661553 - RNA, 19 nt, Homo sapiens
auacgcucaggugguugug

SEQ ID NO: 661554 - RNA, 20 nt, Homo sapiens
auacgcucaggugguugugg

SEQ ID NO: 661555 - RNA, 21 nt, Homo sapiens
auacuaaugaugagcauuuag

SEQ ID NO: 661556 - RNA, 16 nt, Homo sapiens
auacuaguagucauac

SEQ ID NO: 661557 - RNA, 16 nt, Homo sapiens
auacuauccaguuacu

SEQ ID NO: 661558 - RNA, 23 nt, Homo sapiens
auacuaugacaaucuuauuguca

SEQ ID NO: 661559 - RNA, 19 nt, Homo sapiens
auacuauucuuuaauugca

SEQ ID NO: 661560 - RNA, 17 nt, Homo sapiens
auacuauuuucauucuc

SEQ ID NO: 661561 - RNA, 17 nt, Homo sapiens
auacucaaaagagagag

SEQ ID NO: 661562 - RNA, 19 nt, Homo sapiens
auacucacguuugcuuaaa

SEQ ID NO: 661563 - RNA, 14 nt, Homo sapiens
auacucaugaauga

SEQ ID NO: 661564 - RNA, 13 nt, Homo sapiens
auacuccauauuc

SEQ ID NO: 661565 - RNA, 22 nt, Homo sapiens
auacucugcccucuagagccuu

SEQ ID NO: 661566 - RNA, 21 nt, Homo sapiens
auacucuuuuuucauggacac

SEQ ID NO: 661567 - RNA, 15 nt, Homo sapiens
acaugaaaguccuca

SEQ ID NO: 661568 - RNA, 22 nt, Homo sapiens
acaugaagcuucaugcacuuaa

SEQ ID NO: 661569 - RNA, 20 nt, Homo sapiens
acaugacacaguuggauuua

SEQ ID NO: 661570 - RNA, 21 nt, Homo sapiens
acaugacacaguuggauuuau

SEQ ID NO: 661571 - RNA, 20 nt, Homo sapiens
acaugacauucuuagcugua

SEQ ID NO: 661572 - RNA, 13 nt, Homo sapiens
acaugacuggugg

SEQ ID NO: 661573 - RNA, 21 nt, Homo sapiens
acaugacuuauuaugcauaaa

SEQ ID NO: 661574 - RNA, 19 nt, Homo sapiens
acaugagaaggaacuucca

SEQ ID NO: 661575 - RNA, 23 nt, Homo sapiens
acaugagggcugguguucauuaa

SEQ ID NO: 661576 - RNA, 14 nt, Homo sapiens
acaugauacugaug

SEQ ID NO: 661577 - RNA, 18 nt, Homo sapiens
acaugaucuucuuuauaa

SEQ ID NO: 661578 - RNA, 20 nt, Homo sapiens
acaugcaaagauccccaaaa

SEQ ID NO: 661579 - RNA, 18 nt, Homo sapiens
acaugcaacagaagugac

SEQ ID NO: 661580 - RNA, 23 nt, Homo sapiens
acaugcacacacacacaucucau

SEQ ID NO: 661581 - RNA, 14 nt, Homo sapiens
acaugcacauuuau

SEQ ID NO: 661582 - RNA, 13 nt, Homo sapiens
acaugcacucagc

SEQ ID NO: 661583 - RNA, 17 nt, Homo sapiens
acaugcacucagcucuu

SEQ ID NO: 661584 - RNA, 17 nt, Homo sapiens
acaugcauugcucuuau

SEQ ID NO: 661585 - RNA, 21 nt, Homo sapiens
acaugccaggccucagggauc

SEQ ID NO: 661586 - RNA, 15 nt, Homo sapiens
acaugccagggccau

SEQ ID NO: 661587 - RNA, 10 nt, Homo sapiens
acaugccagu

SEQ ID NO: 661588 - RNA, 15 nt, Homo sapiens
acaugccagugacac

SEQ ID NO: 661589 - RNA, 19 nt, Homo sapiens
acaugcccaaaacuuaucc

SEQ ID NO: 661590 - RNA, 19 nt, Homo sapiens
acaugcccacaacuuguca

SEQ ID NO: 661591 - RNA, 13 nt, Homo sapiens
acaugcccugugu

SEQ ID NO: 661592 - RNA, 18 nt, Homo sapiens
acaugcccuguguggcug

SEQ ID NO: 661593 - RNA, 18 nt, Homo sapiens
acaugcccuguucagcua

SEQ ID NO: 661594 - RNA, 15 nt, Homo sapiens
acaugcgaccgugac

SEQ ID NO: 661595 - RNA, 15 nt, Homo sapiens
acaugcgugugucag

SEQ ID NO: 661596 - RNA, 17 nt, Homo sapiens
acaugcgugugucaggg

SEQ ID NO: 661597 - RNA, 17 nt, Homo sapiens
acaugcuaccacuggua

SEQ ID NO: 661598 - RNA, 23 nt, Homo sapiens
acaugcuauguucugucuuccca

SEQ ID NO: 661599 - RNA, 22 nt, Homo sapiens
acaugcucaccucuagccuuaa

SEQ ID NO: 661600 - RNA, 21 nt, Homo sapiens
acaugcugaaaaauauagccu

SEQ ID NO: 661601 - RNA, 18 nt, Homo sapiens
acaugcugcuaauucaaa

SEQ ID NO: 661602 - RNA, 15 nt, Homo sapiens
acaugcugugcucuu

SEQ ID NO: 661603 - RNA, 18 nt, Homo sapiens
acaugcuuagcuuaucuu

SEQ ID NO: 661604 - RNA, 23 nt, Homo sapiens
acaugcuugaauaacugagcuua

SEQ ID NO: 661605 - RNA, 14 nt, Homo sapiens
acauggaacuuuag

SEQ ID NO: 661606 - RNA, 20 nt, Homo sapiens
acauggaauuaccuuagauu

SEQ ID NO: 661607 - RNA, 17 nt, Homo sapiens
acauggacugcuucauc

SEQ ID NO: 661608 - RNA, 14 nt, Homo sapiens
acauggcacaggcc

SEQ ID NO: 661609 - RNA, 15 nt, Homo sapiens
acauggcuagccuuu

SEQ ID NO: 661610 - RNA, 14 nt, Homo sapiens
acaugggagcucuu

SEQ ID NO: 661611 - RNA, 13 nt, Homo sapiens
acaugggugcaau

SEQ ID NO: 661612 - RNA, 14 nt, Homo sapiens
acaugggugcaauc

SEQ ID NO: 661613 - RNA, 22 nt, Homo sapiens
acaugguacgaauggcagcaua

SEQ ID NO: 661614 - RNA, 21 nt, Homo sapiens
acauggucuaauuauuuacuc

SEQ ID NO: 661615 - RNA, 23 nt, Homo sapiens
acauggugugaguccaaagaagg

SEQ ID NO: 661616 - RNA, 18 nt, Homo sapiens
acauguaauaaauucaaa

SEQ ID NO: 661617 - RNA, 15 nt, Homo sapiens
acauguaauuugaug

SEQ ID NO: 661618 - RNA, 22 nt, Homo sapiens
acauguagagauuugagugcag

SEQ ID NO: 661619 - RNA, 12 nt, Homo sapiens
acauguauugca

SEQ ID NO: 661620 - RNA, 19 nt, Homo sapiens
acauguauugcacauugua

SEQ ID NO: 661621 - RNA, 14 nt, Homo sapiens
acaugucagaacua

SEQ ID NO: 661622 - RNA, 21 nt, Homo sapiens
acaugucuuuucuuccacugc

SEQ ID NO: 661623 - RNA, 12 nt, Homo sapiens
acaugugacauu

SEQ ID NO: 661624 - RNA, 14 nt, Homo sapiens
acaugugcagucac

SEQ ID NO: 661625 - RNA, 15 nt, Homo sapiens
acauguggcaaaaua

SEQ ID NO: 661626 - RNA, 19 nt, Homo sapiens
acaugugucccagccacag

SEQ ID NO: 661627 - RNA, 21 nt, Homo sapiens
acaugugucccagccacagug

SEQ ID NO: 661628 - RNA, 22 nt, Homo sapiens
acaugugugcgugugcgugcau

SEQ ID NO: 661629 - RNA, 16 nt, Homo sapiens
acauguuacugcuuca

SEQ ID NO: 661630 - RNA, 13 nt, Homo sapiens
acauguuccccau

SEQ ID NO: 661631 - RNA, 19 nt, Homo sapiens
acauuaaacaaugaucaca

SEQ ID NO: 661632 - RNA, 23 nt, Homo sapiens
acauuaaacacaaagcuguugaa

SEQ ID NO: 661633 - RNA, 17 nt, Homo sapiens
acauuaagaaaaucaua

SEQ ID NO: 661634 - RNA, 16 nt, Homo sapiens
acauuaaggaauuuga

SEQ ID NO: 661635 - RNA, 20 nt, Homo sapiens
acauuaaggaccaauagcau

SEQ ID NO: 661636 - RNA, 17 nt, Homo sapiens
acauuaaucaccaaagu

SEQ ID NO: 661637 - RNA, 16 nt, Homo sapiens
acauuacaauccugca

SEQ ID NO: 661638 - RNA, 13 nt, Homo sapiens
acauuagaucuag

SEQ ID NO: 661639 - RNA, 22 nt, Homo sapiens
acauuagccuugaacaaccaga

SEQ ID NO: 661640 - RNA, 17 nt, Homo sapiens
acauuagcuaaaacugc

SEQ ID NO: 661641 - RNA, 16 nt, Homo sapiens
acauuagucucaguga

SEQ ID NO: 661642 - RNA, 14 nt, Homo sapiens
acauuaucaucuga

SEQ ID NO: 661643 - RNA, 13 nt, Homo sapiens
auccugauuccaa

SEQ ID NO: 661644 - RNA, 20 nt, Homo sapiens
auccugcagaaguacuccua

SEQ ID NO: 661645 - RNA, 18 nt, Homo sapiens
auccugcagggcuucucc

SEQ ID NO: 661646 - RNA, 16 nt, Homo sapiens
auccugccauccucaa

SEQ ID NO: 661647 - RNA, 16 nt, Homo sapiens
auccugcuagcuguag

SEQ ID NO: 661648 - RNA, 19 nt, Homo sapiens
auccugcucuuuugugaug

SEQ ID NO: 661649 - RNA, 14 nt, Homo sapiens
auccuggaaggaca

SEQ ID NO: 661650 - RNA, 20 nt, Homo sapiens
auccuggaaggacacaguga

SEQ ID NO: 661651 - RNA, 16 nt, Homo sapiens
auccuggccuggcaca

SEQ ID NO: 661652 - RNA, 22 nt, Homo sapiens
auccuguauucuucaaccagug

SEQ ID NO: 661653 - RNA, 18 nt, Homo sapiens
auccugucuuuaaggaaa

SEQ ID NO: 661654 - RNA, 17 nt, Homo sapiens
auccugugacugucuca

SEQ ID NO: 661655 - RNA, 20 nt, Homo sapiens
auccuguguucauggaucag

SEQ ID NO: 661656 - RNA, 19 nt, Homo sapiens
auccuuaggaaaaugcuuc

SEQ ID NO: 661657 - RNA, 15 nt, Homo sapiens
auccuuccaccucag

SEQ ID NO: 661658 - RNA, 13 nt, Homo sapiens
auccuuccccaac

SEQ ID NO: 661659 - RNA, 19 nt, Homo sapiens
auccuucgugaacaucccc

SEQ ID NO: 661660 - RNA, 13 nt, Homo sapiens
auccuucuacuug

SEQ ID NO: 661661 - RNA, 17 nt, Homo sapiens
auccuucucacugccau

SEQ ID NO: 661662 - RNA, 22 nt, Homo sapiens
auccuucuuucuaguucagcug

SEQ ID NO: 661663 - RNA, 22 nt, Homo sapiens
auccuugccaauagugucaucc

SEQ ID NO: 661664 - RNA, 24 nt, Homo sapiens
auccuuggaaauuggaagagcaca

SEQ ID NO: 661665 - RNA, 21 nt, Homo sapiens
auccuugggagucauuaccac

SEQ ID NO: 661666 - RNA, 20 nt, Homo sapiens
auccuuucaagacagaaaga

SEQ ID NO: 661667 - RNA, 20 nt, Homo sapiens
auccuuugagaaugugauuc

SEQ ID NO: 661668 - RNA, 19 nt, Homo sapiens
auccuuuuaaaucuugaua

SEQ ID NO: 661669 - RNA, 23 nt, Homo sapiens
auccuuuuuucucuucuguccau

SEQ ID NO: 661670 - RNA, 13 nt, Homo sapiens
aucgaacuucaca

SEQ ID NO: 661671 - RNA, 14 nt, Homo sapiens
aucgaagucuuccc

SEQ ID NO: 661672 - RNA, 13 nt, Homo sapiens
aucgaauagggaa

SEQ ID NO: 661673 - RNA, 13 nt, Homo sapiens
aucgagaccaucc

SEQ ID NO: 661674 - RNA, 22 nt, Homo sapiens
aucgaggaaccagagccaugga

SEQ ID NO: 661675 - RNA, 14 nt, Homo sapiens
aucgaucaugaugu

SEQ ID NO: 661676 - RNA, 19 nt, Homo sapiens
aucgauggaugggaugcac

SEQ ID NO: 661677 - RNA, 22 nt, Homo sapiens
aucgcaccuuuuauaccagaga

SEQ ID NO: 661678 - RNA, 20 nt, Homo sapiens
aucgcaggagucucugccac

SEQ ID NO: 661679 - RNA, 23 nt, Homo sapiens
aucgccugaguugcuuuuacuuc

SEQ ID NO: 661680 - RNA, 15 nt, Homo sapiens
aucgcuagacuaaga

SEQ ID NO: 661681 - RNA, 21 nt, Homo sapiens
aucgcuggaaaugaauagcca

SEQ ID NO: 661682 - RNA, 21 nt, Homo sapiens
aucggggggugggagggaugg

SEQ ID NO: 661683 - RNA, 14 nt, Homo sapiens
aucgucaaccacuu

SEQ ID NO: 661684 - RNA, 22 nt, Homo sapiens
aucguccagcgaccuuccucau

SEQ ID NO: 661685 - RNA, 19 nt, Homo sapiens
aucgugaaaccccaucucu

SEQ ID NO: 661686 - RNA, 19 nt, Homo sapiens
aucguggccuugaccucca

SEQ ID NO: 661687 - RNA, 20 nt, Homo sapiens
aucguucauugccuuuccag

SEQ ID NO: 661688 - RNA, 23 nt, Homo sapiens
aucguucauugccuuuccagggu

SEQ ID NO: 661689 - RNA, 20 nt, Homo sapiens
aucguuccaguucccacuug

SEQ ID NO: 661690 - RNA, 17 nt, Homo sapiens
aucguucucugccucac

SEQ ID NO: 661691 - RNA, 15 nt, Homo sapiens
aucuaaaaucugcua

SEQ ID NO: 661692 - RNA, 16 nt, Homo sapiens
aucuaaauauuuccau

SEQ ID NO: 661693 - RNA, 18 nt, Homo sapiens
aucuaagccuuuccauaa

SEQ ID NO: 661694 - RNA, 18 nt, Homo sapiens
aucuaaggaugucacagg

SEQ ID NO: 661695 - RNA, 17 nt, Homo sapiens
aucuaagggucucucau

SEQ ID NO: 661696 - RNA, 16 nt, Homo sapiens
aucuaauauauaugaa

SEQ ID NO: 661697 - RNA, 17 nt, Homo sapiens
aucuaauuaaauggcau

SEQ ID NO: 661698 - RNA, 20 nt, Homo sapiens
aucuaauuuuacacucugua

SEQ ID NO: 661699 - RNA, 22 nt, Homo sapiens
aucuacaaaaaacaacaaauaa

SEQ ID NO: 661700 - RNA, 17 nt, Homo sapiens
aucuacagcucaccucu

SEQ ID NO: 661701 - RNA, 21 nt, Homo sapiens
accuucaggcagccaguguga

SEQ ID NO: 661702 - RNA, 23 nt, Homo sapiens
accuucaugugguucagugccuu

SEQ ID NO: 661703 - RNA, 22 nt, Homo sapiens
accuucauuuuuaagacuguaa

SEQ ID NO: 661704 - RNA, 15 nt, Homo sapiens
accuuccaagacuga

SEQ ID NO: 661705 - RNA, 18 nt, Homo sapiens
accuuccaaggacauauu

SEQ ID NO: 661706 - RNA, 22 nt, Homo sapiens
accuuccggggccgcaucccuu

SEQ ID NO: 661707 - RNA, 21 nt, Homo sapiens
accuuccuccugcagacaccu

SEQ ID NO: 661708 - RNA, 14 nt, Homo sapiens
accuuccucuucca

SEQ ID NO: 661709 - RNA, 20 nt, Homo sapiens
accuucuguggcucacagaa

SEQ ID NO: 661710 - RNA, 15 nt, Homo sapiens
accuucuugcuccua

SEQ ID NO: 661711 - RNA, 17 nt, Homo sapiens
accuucuuuaaggcaua

SEQ ID NO: 661712 - RNA, 17 nt, Homo sapiens
accuucuuucuggacug

SEQ ID NO: 661713 - RNA, 19 nt, Homo sapiens
accuugaagaaccucucac

SEQ ID NO: 661714 - RNA, 14 nt, Homo sapiens
accuugacagagca

SEQ ID NO: 661715 - RNA, 21 nt, Homo sapiens
accuugacuugauuagugccu

SEQ ID NO: 661716 - RNA, 18 nt, Homo sapiens
accuugaucccaauccuu

SEQ ID NO: 661717 - RNA, 22 nt, Homo sapiens
accuugaugcuuggccucccaa

SEQ ID NO: 661718 - RNA, 12 nt, Homo sapiens
accuugcacucc

SEQ ID NO: 661719 - RNA, 22 nt, Homo sapiens
accuugccacccauucuucccg

SEQ ID NO: 661720 - RNA, 23 nt, Homo sapiens
accuugcccacggcaacugccuu

SEQ ID NO: 661721 - RNA, 19 nt, Homo sapiens
accuugcugggacuuggau

SEQ ID NO: 661722 - RNA, 22 nt, Homo sapiens
accuugcuuuugcuucuagagc

SEQ ID NO: 661723 - RNA, 19 nt, Homo sapiens
accuuggaggaaugacaau

SEQ ID NO: 661724 - RNA, 17 nt, Homo sapiens
accuuggcaguguggac

SEQ ID NO: 661725 - RNA, 15 nt, Homo sapiens
accuuggcuuguuau

SEQ ID NO: 661726 - RNA, 19 nt, Homo sapiens
accuugggaagauguauca

SEQ ID NO: 661727 - RNA, 19 nt, Homo sapiens
accuugggcacaucugcug

SEQ ID NO: 661728 - RNA, 17 nt, Homo sapiens
accuugggggaagacuu

SEQ ID NO: 661729 - RNA, 17 nt, Homo sapiens
accuugucccagccagu

SEQ ID NO: 661730 - RNA, 12 nt, Homo sapiens
accuugucucau

SEQ ID NO: 661731 - RNA, 18 nt, Homo sapiens
accuugugauucugcuua

SEQ ID NO: 661732 - RNA, 18 nt, Homo sapiens
accuuguuuugcugucuu

SEQ ID NO: 661733 - RNA, 18 nt, Homo sapiens
accuuuaaauauuucaca

SEQ ID NO: 661734 - RNA, 14 nt, Homo sapiens
accuuuauauuugg

SEQ ID NO: 661735 - RNA, 20 nt, Homo sapiens
accuuuauuuuucuaucugg

SEQ ID NO: 661736 - RNA, 17 nt, Homo sapiens
accuuucacccucauga

SEQ ID NO: 661737 - RNA, 17 nt, Homo sapiens
accuuucuagccuuaga

SEQ ID NO: 661738 - RNA, 22 nt, Homo sapiens
accuuucuagccuuagacaaau

SEQ ID NO: 661739 - RNA, 14 nt, Homo sapiens
accuuucucugaga

SEQ ID NO: 661740 - RNA, 16 nt, Homo sapiens
accuuugaaauauuaa

SEQ ID NO: 661741 - RNA, 14 nt, Homo sapiens
accuuuggaaguca

SEQ ID NO: 661742 - RNA, 17 nt, Homo sapiens
accuuuggaugcacuuu

SEQ ID NO: 661743 - RNA, 18 nt, Homo sapiens
accuuuggcugguagcag

SEQ ID NO: 661744 - RNA, 19 nt, Homo sapiens
accuuugucuucuauaaua

SEQ ID NO: 661745 - RNA, 15 nt, Homo sapiens
accuuuguguggcuc

SEQ ID NO: 661746 - RNA, 13 nt, Homo sapiens
accuuuuccccaa

SEQ ID NO: 661747 - RNA, 22 nt, Homo sapiens
accuuuuccccaaccacagaga

SEQ ID NO: 661748 - RNA, 20 nt, Homo sapiens
accuuuugggaauguuuuaa

SEQ ID NO: 661749 - RNA, 22 nt, Homo sapiens
accuuuuggucuucagccuccc

SEQ ID NO: 661750 - RNA, 16 nt, Homo sapiens
accuuuuuauuugcau

SEQ ID NO: 661751 - RNA, 14 nt, Homo sapiens
acgaaacacugugc

SEQ ID NO: 661752 - RNA, 13 nt, Homo sapiens
acgaaaucuaggu

SEQ ID NO: 661753 - RNA, 12 nt, Homo sapiens
acgaacuguuca

SEQ ID NO: 661754 - RNA, 19 nt, Homo sapiens
acgaagagacagaacuguc

SEQ ID NO: 661755 - RNA, 17 nt, Homo sapiens
acgaaucguacuucuuu

SEQ ID NO: 661756 - RNA, 21 nt, Homo sapiens
acgaauggcagcauacacaga

SEQ ID NO: 661757 - RNA, 20 nt, Homo sapiens
acgaauucuucuggggucag

SEQ ID NO: 661758 - RNA, 15 nt, Homo sapiens
acgaauuugcacagu

SEQ ID NO: 661759 - RNA, 17 nt, Homo sapiens
acgacaguacacuguca

SEQ ID NO: 661760 - RNA, 16 nt, Homo sapiens
acgacauacaugcuac

SEQ ID NO: 661761 - RNA, 19 nt, Homo sapiens
acgacuaaucaccuacuca

SEQ ID NO: 661762 - RNA, 16 nt, Homo sapiens
acgacucuaaacacac

SEQ ID NO: 661763 - RNA, 21 nt, Homo sapiens
acgagggguggugcuagaaga

SEQ ID NO: 661764 - RNA, 17 nt, Homo sapiens
aucucuuagaagccaug

SEQ ID NO: 661765 - RNA, 18 nt, Homo sapiens
aucucuucagguucucau

SEQ ID NO: 661766 - RNA, 14 nt, Homo sapiens
aucucuuccuugac

SEQ ID NO: 661767 - RNA, 14 nt, Homo sapiens
aucucuucuggccg

SEQ ID NO: 661768 - RNA, 17 nt, Homo sapiens
aucucuugaccucguga

SEQ ID NO: 661769 - RNA, 19 nt, Homo sapiens
aucucuugcacucaaagcu

SEQ ID NO: 661770 - RNA, 23 nt, Homo sapiens
aucucuuguauaugaugaucugg

SEQ ID NO: 661771 - RNA, 21 nt, Homo sapiens
aucucuuguuuacgauuucac

SEQ ID NO: 661772 - RNA, 22 nt, Homo sapiens
aucucuuguuuacgauuucacu

SEQ ID NO: 661773 - RNA, 21 nt, Homo sapiens
aucucuuuugaauccaugcuu

SEQ ID NO: 661774 - RNA, 13 nt, Homo sapiens
aucugaacauucu

SEQ ID NO: 661775 - RNA, 14 nt, Homo sapiens
aucugaacucucaa

SEQ ID NO: 661776 - RNA, 14 nt, Homo sapiens
aucugaaugcugau

SEQ ID NO: 661777 - RNA, 14 nt, Homo sapiens
aucugacaauauac

SEQ ID NO: 661778 - RNA, 20 nt, Homo sapiens
aucugacccucccagucuca

SEQ ID NO: 661779 - RNA, 13 nt, Homo sapiens
aucugaguugcau

SEQ ID NO: 661780 - RNA, 20 nt, Homo sapiens
aucugaguugccaagacaaa

SEQ ID NO: 661781 - RNA, 16 nt, Homo sapiens
aucugaucaaauguau

SEQ ID NO: 661782 - RNA, 23 nt, Homo sapiens
aucugaucgggggcguagcauca

SEQ ID NO: 661783 - RNA, 18 nt, Homo sapiens
aucugauguuaaccaaug

SEQ ID NO: 661784 - RNA, 15 nt, Homo sapiens
aucugauguuucaua

SEQ ID NO: 661785 - RNA, 20 nt, Homo sapiens
aucugauguuucauauuuaa

SEQ ID NO: 661786 - RNA, 16 nt, Homo sapiens
aucugauuucauuaca

SEQ ID NO: 661787 - RNA, 14 nt, Homo sapiens
aucugcaaacauua

SEQ ID NO: 661788 - RNA, 19 nt, Homo sapiens
aucugcaacaaaaagucau

SEQ ID NO: 661789 - RNA, 22 nt, Homo sapiens
aucugcagcguugcuuggugca

SEQ ID NO: 661790 - RNA, 16 nt, Homo sapiens
aucugccagaccuuaa

SEQ ID NO: 661791 - RNA, 15 nt, Homo sapiens
aucugccaucugcuu

SEQ ID NO: 661792 - RNA, 14 nt, Homo sapiens
aucugccaugugaa

SEQ ID NO: 661793 - RNA, 23 nt, Homo sapiens
aucugcugaaggcagucauauca

SEQ ID NO: 661794 - RNA, 18 nt, Homo sapiens
aucugcugccagaauuaa

SEQ ID NO: 661795 - RNA, 17 nt, Homo sapiens
aucugcuguugccagug

SEQ ID NO: 661796 - RNA, 22 nt, Homo sapiens
aucugcuuccauuaaaagcaua

SEQ ID NO: 661797 - RNA, 23 nt, Homo sapiens
aucugcuuccauuaaaagcauaa

SEQ ID NO: 661798 - RNA, 17 nt, Homo sapiens
aucuggaaggacaucua

SEQ ID NO: 661799 - RNA, 20 nt, Homo sapiens
aucuggaguugaacagcaaa

SEQ ID NO: 661800 - RNA, 15 nt, Homo sapiens
aucuggcacacuccc

SEQ ID NO: 661801 - RNA, 16 nt, Homo sapiens
aucuggcacacucccu

SEQ ID NO: 661802 - RNA, 16 nt, Homo sapiens
aucuggcucaccgggu

SEQ ID NO: 661803 - RNA, 18 nt, Homo sapiens
aucugggagaauuuucaa

SEQ ID NO: 661804 - RNA, 16 nt, Homo sapiens
aucugggagagucuca

SEQ ID NO: 661805 - RNA, 17 nt, Homo sapiens
aucugggcaaaugaaaa

SEQ ID NO: 661806 - RNA, 19 nt, Homo sapiens
aucugggcaaaugaaaaug

SEQ ID NO: 661807 - RNA, 18 nt, Homo sapiens
aucugggcugugggcaag

SEQ ID NO: 661808 - RNA, 19 nt, Homo sapiens
aucugggucucccaggaca

SEQ ID NO: 661809 - RNA, 17 nt, Homo sapiens
aucugggugacugagca

SEQ ID NO: 661810 - RNA, 22 nt, Homo sapiens
aucuggucaaccuccuggacau

SEQ ID NO: 661811 - RNA, 16 nt, Homo sapiens
aucuggugacaaauau

SEQ ID NO: 661812 - RNA, 13 nt, Homo sapiens
aucuguaacucua

SEQ ID NO: 661813 - RNA, 18 nt, Homo sapiens
aucuguacccuuuuccau

SEQ ID NO: 661814 - RNA, 23 nt, Homo sapiens
aucuguauauacaauaacauaau

SEQ ID NO: 661815 - RNA, 21 nt, Homo sapiens
aucuguaucuuugacaauucu

SEQ ID NO: 661816 - RNA, 20 nt, Homo sapiens
aucuguccguucacaugugu

SEQ ID NO: 661817 - RNA, 13 nt, Homo sapiens
aucugucuguccu

SEQ ID NO: 661818 - RNA, 17 nt, Homo sapiens
aucugucuucagcacau

SEQ ID NO: 661819 - RNA, 19 nt, Homo sapiens
aucugugaaguaguucugu

SEQ ID NO: 661820 - RNA, 22 nt, Homo sapiens
aucugugcaaauccuugauacu

SEQ ID NO: 661821 - RNA, 23 nt, Homo sapiens
aucugugcacugcccauggacag

SEQ ID NO: 661822 - RNA, 15 nt, Homo sapiens
aucuguguacaaaga

SEQ ID NO: 661823 - RNA, 14 nt, Homo sapiens
aucuguguacaauu

SEQ ID NO: 661824 - RNA, 13 nt, Homo sapiens
acuaguagucaua

SEQ ID NO: 661825 - RNA, 14 nt, Homo sapiens
acuagucuguguaa

SEQ ID NO: 661826 - RNA, 22 nt, Homo sapiens
acuaguguguguguguauauau

SEQ ID NO: 661827 - RNA, 21 nt, Homo sapiens
acuaguucagacacuuuggaa

SEQ ID NO: 661828 - RNA, 23 nt, Homo sapiens
acuaguucucuuguccugugauc

SEQ ID NO: 661829 - RNA, 22 nt, Homo sapiens
acuaguuugcuuugcugaccaa

SEQ ID NO: 661830 - RNA, 16 nt, Homo sapiens
acuauaaaaaucaugu

SEQ ID NO: 661831 - RNA, 17 nt, Homo sapiens
acuauaagcccacuguu

SEQ ID NO: 661832 - RNA, 16 nt, Homo sapiens
acuauaaggugccuca

SEQ ID NO: 661833 - RNA, 17 nt, Homo sapiens
acuauaauuugacuuga

SEQ ID NO: 661834 - RNA, 17 nt, Homo sapiens
acuauacucuaaaaugg

SEQ ID NO: 661835 - RNA, 14 nt, Homo sapiens
acuauagcccaggu

SEQ ID NO: 661836 - RNA, 18 nt, Homo sapiens
acuauauguuuacacaau

SEQ ID NO: 661837 - RNA, 16 nt, Homo sapiens
acuauauucucagugu

SEQ ID NO: 661838 - RNA, 18 nt, Homo sapiens
acuauauuuauacuguau

SEQ ID NO: 661839 - RNA, 19 nt, Homo sapiens
acuauauuuauacuguaua

SEQ ID NO: 661840 - RNA, 15 nt, Homo sapiens
acuauauuugcuaga

SEQ ID NO: 661841 - RNA, 15 nt, Homo sapiens
acuaucacugaacaa

SEQ ID NO: 661842 - RNA, 18 nt, Homo sapiens
acuauccaacuuaacaug

SEQ ID NO: 661843 - RNA, 17 nt, Homo sapiens
acuauccaaguguuaua

SEQ ID NO: 661844 - RNA, 15 nt, Homo sapiens
acuauccuaccccac

SEQ ID NO: 661845 - RNA, 22 nt, Homo sapiens
acuauccucacucccauaagcu

SEQ ID NO: 661846 - RNA, 17 nt, Homo sapiens
acuauccugauuccaaa

SEQ ID NO: 661847 - RNA, 22 nt, Homo sapiens
acuaucgucaggaaaccaaaua

SEQ ID NO: 661848 - RNA, 17 nt, Homo sapiens
acuaugaaccuucuuaa

SEQ ID NO: 661849 - RNA, 19 nt, Homo sapiens
acuaugaaguaagcaacaa

SEQ ID NO: 661850 - RNA, 13 nt, Homo sapiens
acuaugacaucua

SEQ ID NO: 661851 - RNA, 13 nt, Homo sapiens
acuaugaucacag

SEQ ID NO: 661852 - RNA, 14 nt, Homo sapiens
acuaugauuauuaa

SEQ ID NO: 661853 - RNA, 17 nt, Homo sapiens
acuauggcuuauucagu

SEQ ID NO: 661854 - RNA, 19 nt, Homo sapiens
acuaugggcccgagcucau

SEQ ID NO: 661855 - RNA, 20 nt, Homo sapiens
acuaugguuuucauuuacuc

SEQ ID NO: 661856 - RNA, 15 nt, Homo sapiens
acuauguaacaugua

SEQ ID NO: 661857 - RNA, 16 nt, Homo sapiens
acuaugugaugccucu

SEQ ID NO: 661858 - RNA, 17 nt, Homo sapiens
acuauguguucaaugaa

SEQ ID NO: 661859 - RNA, 20 nt, Homo sapiens
acuauguucuaggucagucu

SEQ ID NO: 661860 - RNA, 16 nt, Homo sapiens
acuauuacaccaaaua

SEQ ID NO: 661861 - RNA, 12 nt, Homo sapiens
acuauuacuggg

SEQ ID NO: 661862 - RNA, 14 nt, Homo sapiens
acuauucacuaaaa

SEQ ID NO: 661863 - RNA, 20 nt, Homo sapiens
acuauucuuaagcacuuuga

SEQ ID NO: 661864 - RNA, 14 nt, Homo sapiens
acuauugaaaaaua

SEQ ID NO: 661865 - RNA, 20 nt, Homo sapiens
acuauugagccuugcaugua

SEQ ID NO: 661866 - RNA, 21 nt, Homo sapiens
acuauuuaaagccuccucauc

SEQ ID NO: 661867 - RNA, 18 nt, Homo sapiens
acuauuuagauauaacac

SEQ ID NO: 661868 - RNA, 22 nt, Homo sapiens
acuauuuagauauaacacuaug

SEQ ID NO: 661869 - RNA, 15 nt, Homo sapiens
acuauuuucaaagaa

SEQ ID NO: 661870 - RNA, 18 nt, Homo sapiens
acuauuuucaaagacuua

SEQ ID NO: 661871 - RNA, 13 nt, Homo sapiens
acuauuuucauuc

SEQ ID NO: 661872 - RNA, 18 nt, Homo sapiens
acucaaaacacccaaaaa

SEQ ID NO: 661873 - RNA, 13 nt, Homo sapiens
acucaaacuugag

SEQ ID NO: 661874 - RNA, 20 nt, Homo sapiens
acucaaagagguaacugagg

SEQ ID NO: 661875 - RNA, 19 nt, Homo sapiens
acucaaaucgaauagggaa

SEQ ID NO: 661876 - RNA, 24 nt, Homo sapiens
acucaaauuggugaacaguguaua

SEQ ID NO: 661877 - RNA, 23 nt, Homo sapiens
acucaacauguuacugaccagca

SEQ ID NO: 661878 - RNA, 19 nt, Homo sapiens
acucaagaggcugaggcag

SEQ ID NO: 661879 - RNA, 17 nt, Homo sapiens
acucaaggcuugaguca

SEQ ID NO: 661880 - RNA, 18 nt, Homo sapiens
acucaaggcuugagucac

SEQ ID NO: 661881 - RNA, 17 nt, Homo sapiens
acucacacaaccaugac

SEQ ID NO: 661882 - RNA, 23 nt, Homo sapiens
acucacacggacacucaaaagcu

SEQ ID NO: 661883 - RNA, 19 nt, Homo sapiens
acucacacuaugugcaaaa

SEQ ID NO: 661884 - RNA, 22 nt, Homo sapiens
acucacacuaugugcaaaaauc

SEQ ID NO: 661885 - RNA, 22 nt, Homo sapiens
ccuuucacuuuuaguuggcauu

SEQ ID NO: 661886 - RNA, 14 nt, Homo sapiens
ccuuucagucccaa

SEQ ID NO: 661887 - RNA, 21 nt, Homo sapiens
ccuuucaguggcccuuucaac

SEQ ID NO: 661888 - RNA, 18 nt, Homo sapiens
ccuuucauaaaaaccaaa

SEQ ID NO: 661889 - RNA, 19 nt, Homo sapiens
ccuuucauaaaaaccaaac

SEQ ID NO: 661890 - RNA, 21 nt, Homo sapiens
ccuuucaucucucuaccucca

SEQ ID NO: 661891 - RNA, 14 nt, Homo sapiens
aaucuguaucugua

SEQ ID NO: 661892 - RNA, 18 nt, Homo sapiens
aaucuguccgugaccuau

SEQ ID NO: 661893 - RNA, 14 nt, Homo sapiens
aaucuguguacaaa

SEQ ID NO: 661894 - RNA, 13 nt, Homo sapiens
aaucugugugcau

SEQ ID NO: 661895 - RNA, 12 nt, Homo sapiens
aaucuguugcua

SEQ ID NO: 661896 - RNA, 19 nt, Homo sapiens
aaucuguuuguugacuuau

SEQ ID NO: 661897 - RNA, 14 nt, Homo sapiens
aaucuuaugcucuc

SEQ ID NO: 661898 - RNA, 17 nt, Homo sapiens
aaucuuauggggccgga

SEQ ID NO: 661899 - RNA, 18 nt, Homo sapiens
aaucuuauguuuccaaga

SEQ ID NO: 661900 - RNA, 22 nt, Homo sapiens
aaucuuauuccgagcauuccag

SEQ ID NO: 661901 - RNA, 14 nt, Homo sapiens
aaucuucaccucag

SEQ ID NO: 661902 - RNA, 17 nt, Homo sapiens
aaucuucagaccuagaa

SEQ ID NO: 661903 - RNA, 13 nt, Homo sapiens
aaucuucauuucu

SEQ ID NO: 661904 - RNA, 15 nt, Homo sapiens
agaacuguacauugu

SEQ ID NO: 661905 - RNA, 13 nt, Homo sapiens
agaacugugccac

SEQ ID NO: 661906 - RNA, 22 nt, Homo sapiens
agaacuuaagucucgaauguaa

SEQ ID NO: 661907 - RNA, 13 nt, Homo sapiens
agaacuuaaucug

SEQ ID NO: 661908 - RNA, 19 nt, Homo sapiens
agaacuucagaaagacuug

SEQ ID NO: 661909 - RNA, 19 nt, Homo sapiens
agaacuucauggaucagau

SEQ ID NO: 661910 - RNA, 20 nt, Homo sapiens
agaacuuccaacaagccuca

SEQ ID NO: 661911 - RNA, 21 nt, Homo sapiens
agaacuucccugauugaccug

SEQ ID NO: 661912 - RNA, 19 nt, Homo sapiens
agaacuuuaaagcucagga

SEQ ID NO: 661913 - RNA, 22 nt, Homo sapiens
agaacuuucuaguugcccucua

SEQ ID NO: 661914 - RNA, 18 nt, Homo sapiens
agaacuuuggcugccuuu

SEQ ID NO: 661915 - RNA, 18 nt, Homo sapiens
agaagaaaauaguggugu

SEQ ID NO: 661916 - RNA, 15 nt, Homo sapiens
agaagaaauagcaga

SEQ ID NO: 661917 - RNA, 18 nt, Homo sapiens
agaagaaauucugucaua

SEQ ID NO: 661918 - RNA, 21 nt, Homo sapiens
agaagaaccauuuacaugcac

SEQ ID NO: 661919 - RNA, 17 nt, Homo sapiens
agaagaauaucaaauaa

SEQ ID NO: 661920 - RNA, 16 nt, Homo sapiens
agaagaaugacuaugc

SEQ ID NO: 661921 - RNA, 20 nt, Homo sapiens
agaagaccuucguauccccu

SEQ ID NO: 661922 - RNA, 15 nt, Homo sapiens
agaagacugucagga

SEQ ID NO: 661923 - RNA, 15 nt, Homo sapiens
agaagagaagcugcu

SEQ ID NO: 661924 - RNA, 19 nt, Homo sapiens
agaagagaauucaguauuu

SEQ ID NO: 661925 - RNA, 22 nt, Homo sapiens
agaagagacugcuacagugcau

SEQ ID NO: 661926 - RNA, 19 nt, Homo sapiens
agaagagaugacaaaccau

SEQ ID NO: 661927 - RNA, 13 nt, Homo sapiens
agaagagauuucu

SEQ ID NO: 661928 - RNA, 13 nt, Homo sapiens
agaagagcacaga

SEQ ID NO: 661929 - RNA, 21 nt, Homo sapiens
agaagauaauguucuuuaaug

SEQ ID NO: 661930 - RNA, 21 nt, Homo sapiens
agaagauagaugcacuuaugc

SEQ ID NO: 661931 - RNA, 21 nt, Homo sapiens
agaagaugagccuugcagaua

SEQ ID NO: 661932 - RNA, 14 nt, Homo sapiens
agaagaugccagcu

SEQ ID NO: 661933 - RNA, 12 nt, Homo sapiens
agaagauuucag

SEQ ID NO: 661934 - RNA, 14 nt, Homo sapiens
agaagcaaaccgcc

SEQ ID NO: 661935 - RNA, 23 nt, Homo sapiens
agaagcaauaacuauuuuuccuc

SEQ ID NO: 661936 - RNA, 12 nt, Homo sapiens
agaagcaauggg

SEQ ID NO: 661937 - RNA, 18 nt, Homo sapiens
agaagcacugggugacca

SEQ ID NO: 661938 - RNA, 18 nt, Homo sapiens
agaagcagagagaugcgg

SEQ ID NO: 661939 - RNA, 13 nt, Homo sapiens
agaagcagcugca

SEQ ID NO: 661940 - RNA, 22 nt, Homo sapiens
agaagcagcuucuuuugucucc

SEQ ID NO: 661941 - RNA, 10 nt, Homo sapiens
agaagccagu

SEQ ID NO: 661942 - RNA, 23 nt, Homo sapiens
agaagccccaagcaacuuuccuu

SEQ ID NO: 661943 - RNA, 15 nt, Homo sapiens
agaagccccgucucu

SEQ ID NO: 661944 - RNA, 22 nt, Homo sapiens
agaagccccuuauuuuuagcca

SEQ ID NO: 661945 - RNA, 22 nt, Homo sapiens
agaagcccugauguguccucag

SEQ ID NO: 661946 - RNA, 21 nt, Homo sapiens
agaagcccuguccuccacuca

SEQ ID NO: 661947 - RNA, 21 nt, Homo sapiens
agaagccuccaagccugccuc

SEQ ID NO: 661948 - RNA, 15 nt, Homo sapiens
agaagccugagcuca

SEQ ID NO: 661949 - RNA, 23 nt, Homo sapiens
agaagccugaugcugacauucac

SEQ ID NO: 661950 - RNA, 18 nt, Homo sapiens
agaagccuuaauuugcac

SEQ ID NO: 661951 - RNA, 17 nt, Homo sapiens
agaagcucggacuuggc

SEQ ID NO: 661952 - RNA, 21 nt, Homo sapiens
agaagcuggcuaguccuuucu

SEQ ID NO: 661953 - RNA, 20 nt, Homo sapiens
agaagcuuaaaaucugugaa

SEQ ID NO: 661954 - RNA, 12 nt, Homo sapiens
agaagcuuccau

SEQ ID NO: 661955 - RNA, 22 nt, Homo sapiens
agaagcuugcugguagcacuug

SEQ ID NO: 661956 - RNA, 23 nt, Homo sapiens
agaaggaaaaaauaaaagaucuu

SEQ ID NO: 661957 - RNA, 15 nt, Homo sapiens
agaaggaguguauga

SEQ ID NO: 661958 - RNA, 13 nt, Homo sapiens
agaaggauuaccu

SEQ ID NO: 661959 - RNA, 15 nt, Homo sapiens
agaaggcaugagaaa

SEQ ID NO: 661960 - RNA, 20 nt, Homo sapiens
agaaggcugugagccaagga

SEQ ID NO: 661961 - RNA, 16 nt, Homo sapiens
agaagggauaucuacu

SEQ ID NO: 661962 - RNA, 22 nt, Homo sapiens
agaagggauaucuacugugguc

SEQ ID NO: 661963 - RNA, 15 nt, Homo sapiens
agaagggcacuguaa

SEQ ID NO: 661964 - RNA, 13 nt, Homo sapiens
agaagggggccau

SEQ ID NO: 661965 - RNA, 17 nt, Homo sapiens
agaagggggccaugagg

SEQ ID NO: 661966 - RNA, 22 nt, Homo sapiens
agaagggugguaaauauuuuca

SEQ ID NO: 661967 - RNA, 21 nt, Homo sapiens
agaaggugccacuuuacccac

SEQ ID NO: 661968 - RNA, 22 nt, Homo sapiens
agaagguuggugaauuucacaa

SEQ ID NO: 661969 - RNA, 15 nt, Homo sapiens
agaagguugugauga

SEQ ID NO: 661970 - RNA, 21 nt, Homo sapiens
agaaguacaaagguugcagug

SEQ ID NO: 661971 - RNA, 14 nt, Homo sapiens
agaaguacuccuau

SEQ ID NO: 661972 - RNA, 12 nt, Homo sapiens
agaaguacuuua

SEQ ID NO: 661973 - RNA, 16 nt, Homo sapiens
agaaguauaaggugcu

SEQ ID NO: 661974 - RNA, 20 nt, Homo sapiens
agaaguauaaggugcucuga

SEQ ID NO: 661975 - RNA, 22 nt, Homo sapiens
agaagucaugaagcccaaguga

SEQ ID NO: 661976 - RNA, 15 nt, Homo sapiens
agaaguccagcucuu

SEQ ID NO: 661977 - RNA, 19 nt, Homo sapiens
agaaguccccucuacuuua

SEQ ID NO: 661978 - RNA, 20 nt, Homo sapiens
agaagucccucccaucucua

SEQ ID NO: 661979 - RNA, 18 nt, Homo sapiens
agaaguccuuauguuaag

SEQ ID NO: 661980 - RNA, 23 nt, Homo sapiens
agaaguuacacagaaaugcugcu

SEQ ID NO: 661981 - RNA, 22 nt, Homo sapiens
agaaguucuggcugaacacugg

SEQ ID NO: 661982 - RNA, 23 nt, Homo sapiens
agaaguugcugcuugugaucuca

SEQ ID NO: 661983 - RNA, 15 nt, Homo sapiens
agaaguuuauucuca

SEQ ID NO: 661984 - RNA, 21 nt, Homo sapiens
agaauaaaaaagaaauccaua

SEQ ID NO: 661985 - RNA, 14 nt, Homo sapiens
auuucacuugauga

SEQ ID NO: 661986 - RNA, 15 nt, Homo sapiens
auuucagaagccuaa

SEQ ID NO: 661987 - RNA, 20 nt, Homo sapiens
auuucagaaguuaguuugua

SEQ ID NO: 661988 - RNA, 19 nt, Homo sapiens
auuucagaucauauuucac

SEQ ID NO: 661989 - RNA, 22 nt, Homo sapiens
auuucagaucauauuucacaau

SEQ ID NO: 661990 - RNA, 18 nt, Homo sapiens
auuucaggaagacugaca

SEQ ID NO: 661991 - RNA, 12 nt, Homo sapiens
auuucaggcaua

SEQ ID NO: 661992 - RNA, 23 nt, Homo sapiens
auuucagguuuuguaaagaugcc

SEQ ID NO: 661993 - RNA, 20 nt, Homo sapiens
auuucauaaauaaaggugua

SEQ ID NO: 661994 - RNA, 14 nt, Homo sapiens
auuucauaccucag

SEQ ID NO: 661995 - RNA, 15 nt, Homo sapiens
auuucauacuguaac

SEQ ID NO: 661996 - RNA, 12 nt, Homo sapiens
auuucaucucuu

SEQ ID NO: 661997 - RNA, 22 nt, Homo sapiens
auuucaugaaaaugacauuaaa

SEQ ID NO: 661998 - RNA, 21 nt, Homo sapiens
auuucaugcacugauuaaaau

SEQ ID NO: 661999 - RNA, 13 nt, Homo sapiens
auuucauggugac

SEQ ID NO: 662000 - RNA, 16 nt, Homo sapiens
auuucaugucacuaaa

SEQ ID NO: 662001 - RNA, 17 nt, Homo sapiens
auuucaugucacuaaac

SEQ ID NO: 662002 - RNA, 14 nt, Homo sapiens
auuucaugugaauc

SEQ ID NO: 662003 - RNA, 16 nt, Homo sapiens
auuuccaaacauccaa

SEQ ID NO: 662004 - RNA, 17 nt, Homo sapiens
auuuccaaaccaucagc

SEQ ID NO: 662005 - RNA, 16 nt, Homo sapiens
auuuccaaauucacaa

SEQ ID NO: 662006 - RNA, 17 nt, Homo sapiens
auuuccaaauucacaag

SEQ ID NO: 662007 - RNA, 12 nt, Homo sapiens
auuuccaccucc

SEQ ID NO: 662008 - RNA, 12 nt, Homo sapiens
auuuccacugaa

SEQ ID NO: 662009 - RNA, 13 nt, Homo sapiens
auuuccagacaaa

SEQ ID NO: 662010 - RNA, 12 nt, Homo sapiens
auuuccagugag

SEQ ID NO: 662011 - RNA, 20 nt, Homo sapiens
auuuccaucagcccaucuca

SEQ ID NO: 662012 - RNA, 21 nt, Homo sapiens
auuuccaucagcccaucucaa

SEQ ID NO: 662013 - RNA, 22 nt, Homo sapiens
auuuccauuuacuuaagacuua

SEQ ID NO: 662014 - RNA, 16 nt, Homo sapiens
auuucccagcacauga

SEQ ID NO: 662015 - RNA, 23 nt, Homo sapiens
auuucccauuugugccagaggaa

SEQ ID NO: 662016 - RNA, 20 nt, Homo sapiens
auuucccuucauacuccuuu

SEQ ID NO: 662017 - RNA, 23 nt, Homo sapiens
auuucccuuccaaagagggaugu

SEQ ID NO: 662018 - RNA, 17 nt, Homo sapiens
auuuccuaauacuguca

SEQ ID NO: 662019 - RNA, 17 nt, Homo sapiens
auuuccuaauaugaucu

SEQ ID NO: 662020 - RNA, 22 nt, Homo sapiens
auuuccuaaugucagaguagaa

SEQ ID NO: 662021 - RNA, 22 nt, Homo sapiens
auuuccuacgggcuguguucca

SEQ ID NO: 662022 - RNA, 18 nt, Homo sapiens
auuuccuaguagaacuca

SEQ ID NO: 662023 - RNA, 20 nt, Homo sapiens
auuuccuaguagaacucaca

SEQ ID NO: 662024 - RNA, 15 nt, Homo sapiens
auuuccuaugcaaau

SEQ ID NO: 662025 - RNA, 20 nt, Homo sapiens
auuuuacagagcgcaccuca

SEQ ID NO: 662026 - RNA, 18 nt, Homo sapiens
auuuuacaggugcgaaug

SEQ ID NO: 662027 - RNA, 16 nt, Homo sapiens
auuuuacaugacagau

SEQ ID NO: 662028 - RNA, 19 nt, Homo sapiens
auuuuaccaaagcaucaau

SEQ ID NO: 662029 - RNA, 18 nt, Homo sapiens
auuuuaccuaguuugcac

SEQ ID NO: 662030 - RNA, 14 nt, Homo sapiens
auuuuagacacuuc

SEQ ID NO: 662031 - RNA, 16 nt, Homo sapiens
auuuuagacuuaccuu

SEQ ID NO: 662032 - RNA, 18 nt, Homo sapiens
auuuuagauaauucuuaa

SEQ ID NO: 662033 - RNA, 18 nt, Homo sapiens
auuuuagcuucaguuguu

SEQ ID NO: 662034 - RNA, 15 nt, Homo sapiens
auuuuaggcacuguu

SEQ ID NO: 662035 - RNA, 18 nt, Homo sapiens
auuuuagucacuaagacu

SEQ ID NO: 662036 - RNA, 20 nt, Homo sapiens
auuuuaguuaaacucugaca

SEQ ID NO: 662037 - RNA, 18 nt, Homo sapiens
auuuuauaggcauaccuc

SEQ ID NO: 662038 - RNA, 20 nt, Homo sapiens
auuuuauaugaugggggaaa

SEQ ID NO: 662039 - RNA, 15 nt, Homo sapiens
auuuuauuaguuguu

SEQ ID NO: 662040 - RNA, 13 nt, Homo sapiens
auuuuauuauaau

SEQ ID NO: 662041 - RNA, 19 nt, Homo sapiens
auuuuauucaagaaugcca

SEQ ID NO: 662042 - RNA, 14 nt, Homo sapiens
auuuuauucccaag

SEQ ID NO: 662043 - RNA, 23 nt, Homo sapiens
auuuuauuguauaaaaaguuuca

SEQ ID NO: 662044 - RNA, 21 nt, Homo sapiens
auuuuauuuaugcguaauuua

SEQ ID NO: 662045 - RNA, 13 nt, Homo sapiens
auuuuauuucaau

SEQ ID NO: 662046 - RNA, 19 nt, Homo sapiens
auuuucaacauaacugaag

SEQ ID NO: 662047 - RNA, 24 nt, Homo sapiens
auuuucaagaauaaucacgcuuuc

SEQ ID NO: 662048 - RNA, 19 nt, Homo sapiens
auuuucaaguuuacacuuc

SEQ ID NO: 662049 - RNA, 15 nt, Homo sapiens
auuuucagccuacag

SEQ ID NO: 662050 - RNA, 14 nt, Homo sapiens
auuuucaguauaau

SEQ ID NO: 662051 - RNA, 18 nt, Homo sapiens
auuuucaguauacugugu

SEQ ID NO: 662052 - RNA, 19 nt, Homo sapiens
auuuucagugcaucauuac

SEQ ID NO: 662053 - RNA, 16 nt, Homo sapiens
auuuucauguauaugu

SEQ ID NO: 662054 - RNA, 20 nt, Homo sapiens
auuuucauugaaaugcacag

SEQ ID NO: 662055 - RNA, 19 nt, Homo sapiens
auuuucccuacuugcagcg

SEQ ID NO: 662056 - RNA, 19 nt, Homo sapiens
auuuuccgccagaccucaa

SEQ ID NO: 662057 - RNA, 15 nt, Homo sapiens
auuuuccuguuuacu

SEQ ID NO: 662058 - RNA, 20 nt, Homo sapiens
auuuuccuuaggaaaaacau

SEQ ID NO: 662059 - RNA, 20 nt, Homo sapiens
auuuucuaagaaccaaaaaa

SEQ ID NO: 662060 - RNA, 14 nt, Homo sapiens
auuuucuacaauua

SEQ ID NO: 662061 - RNA, 16 nt, Homo sapiens
auuuucuauuuaugua

SEQ ID NO: 662062 - RNA, 23 nt, Homo sapiens
auuuucucccaggaagcuuugau

SEQ ID NO: 662063 - RNA, 18 nt, Homo sapiens
auuuucucccuuuaugua

SEQ ID NO: 662064 - RNA, 19 nt, Homo sapiens
auuuucucuuaacaagacu

SEQ ID NO: 662065 - RNA, 22 nt, Homo sapiens
auuuucucuuuguaugucuguu

SEQ ID NO: 662066 - RNA, 14 nt, Homo sapiens
auuuucugaucuca

SEQ ID NO: 662067 - RNA, 15 nt, Homo sapiens
auuuucugcuugaag

SEQ ID NO: 662068 - RNA, 21 nt, Homo sapiens
auuuucuuacacugugucauu

SEQ ID NO: 662069 - RNA, 16 nt, Homo sapiens
auuuucuucacagugc

SEQ ID NO: 662070 - RNA, 12 nt, Homo sapiens
auuuucuuccaa

SEQ ID NO: 662071 - RNA, 17 nt, Homo sapiens
auuuucuuuuuauacua

SEQ ID NO: 662072 - RNA, 19 nt, Homo sapiens
auuuugaaaacugugcaau

SEQ ID NO: 662073 - RNA, 20 nt, Homo sapiens
auuuugaacagaacugcuau

SEQ ID NO: 662074 - RNA, 17 nt, Homo sapiens
auuuugacaaagugccu

SEQ ID NO: 662075 - RNA, 19 nt, Homo sapiens
auuuugauauaaucuuuca

SEQ ID NO: 662076 - RNA, 20 nt, Homo sapiens
auuuugauuuuuaauggaaa

SEQ ID NO: 662077 - RNA, 15 nt, Homo sapiens
auuuugcaggauuug

SEQ ID NO: 662078 - RNA, 17 nt, Homo sapiens
auuuugcauaguaccaa

SEQ ID NO: 662079 - RNA, 14 nt, Homo sapiens
auuuugcaucugac

SEQ ID NO: 662080 - RNA, 14 nt, Homo sapiens
auuuugcauuccag

SEQ ID NO: 662081 - RNA, 15 nt, Homo sapiens
auuuugcauuccaga

SEQ ID NO: 662082 - RNA, 18 nt, Homo sapiens
auuuugccauaaagucaa

SEQ ID NO: 662083 - RNA, 15 nt, Homo sapiens
auuuugcccaaccua

SEQ ID NO: 662084 - RNA, 19 nt, Homo sapiens
auuuugcccaaccuaaugc

SEQ ID NO: 662085 - RNA, 11 nt, Homo sapiens
auuuugcccag

SEQ ID NO: 662086 - RNA, 20 nt, Homo sapiens
auuuugcccaggcaacagua

SEQ ID NO: 662087 - RNA, 20 nt, Homo sapiens
auuuuggauaaaucauuuca

SEQ ID NO: 662088 - RNA, 17 nt, Homo sapiens
auuuuggcaagcucuau

SEQ ID NO: 662089 - RNA, 16 nt, Homo sapiens
auuuuggcgaaucuca

SEQ ID NO: 662090 - RNA, 16 nt, Homo sapiens
auuuuguaaauaugca

SEQ ID NO: 662091 - RNA, 15 nt, Homo sapiens
auuuugugcaugaaa

SEQ ID NO: 662092 - RNA, 23 nt, Homo sapiens
auuuugugucuuuuaaacuggaa

SEQ ID NO: 662093 - RNA, 21 nt, Homo sapiens
auuuuguguguaccugugacu

SEQ ID NO: 662094 - RNA, 22 nt, Homo sapiens
auuuuguuacaaaaagacaaaa

SEQ ID NO: 662095 - RNA, 19 nt, Homo sapiens
auuuuguuauugacuaaca

SEQ ID NO: 662096 - RNA, 15 nt, Homo sapiens
auuuuguugcaucau

SEQ ID NO: 662097 - RNA, 21 nt, Homo sapiens
auuuuguugccuucaucuuca

SEQ ID NO: 662098 - RNA, 17 nt, Homo sapiens
auuuuguuuuguucagu

SEQ ID NO: 662099 - RNA, 15 nt, Homo sapiens
auuuuuaaacaaaga

SEQ ID NO: 662100 - RNA, 19 nt, Homo sapiens
auuuuuaaggauguugcca

SEQ ID NO: 662101 - RNA, 17 nt, Homo sapiens
auuuuuaauauuacugu

SEQ ID NO: 662102 - RNA, 13 nt, Homo sapiens
auuuuuacauuca

SEQ ID NO: 662103 - RNA, 14 nt, Homo sapiens
auuuuuauaaccug

SEQ ID NO: 662104 - RNA, 16 nt, Homo sapiens
auuuuuauaaccuggc

SEQ ID NO: 662105 - RNA, 19 nt, Homo sapiens
auuuuuaucuauccuaugu

SEQ ID NO: 662106 - RNA, 16 nt, Homo sapiens
auuuuuaucugaguua

SEQ ID NO: 662107 - RNA, 22 nt, Homo sapiens
auuuuuaugucuggggcagaaa

SEQ ID NO: 662108 - RNA, 15 nt, Homo sapiens
auuuuuaugugcaau

SEQ ID NO: 662109 - RNA, 15 nt, Homo sapiens
auuuuuaugugcagc

SEQ ID NO: 662110 - RNA, 11 nt, Homo sapiens
agacagaggaa

SEQ ID NO: 662111 - RNA, 14 nt, Homo sapiens
agacagauaccucc

SEQ ID NO: 662112 - RNA, 15 nt, Homo sapiens
agacagauaccucca

SEQ ID NO: 662113 - RNA, 20 nt, Homo sapiens
agacagauaccuccaacccu

SEQ ID NO: 662114 - RNA, 18 nt, Homo sapiens
agacagauggacacugcc

SEQ ID NO: 662115 - RNA, 14 nt, Homo sapiens
agacagauugcuga

SEQ ID NO: 662116 - RNA, 20 nt, Homo sapiens
agacagauuuaaagcacaug

SEQ ID NO: 662117 - RNA, 22 nt, Homo sapiens
agacagcaccacugcugaggag

SEQ ID NO: 662118 - RNA, 23 nt, Homo sapiens
agacagcaggcagcgccaagugc

SEQ ID NO: 662119 - RNA, 16 nt, Homo sapiens
agacagcuucucugca

SEQ ID NO: 662120 - RNA, 18 nt, Homo sapiens
agacaggaacccuugcau

SEQ ID NO: 662121 - RNA, 19 nt, Homo sapiens
agacaggaagguggugcuu

SEQ ID NO: 662122 - RNA, 23 nt, Homo sapiens
agacaggcaaauaaaagugaccu

SEQ ID NO: 662123 - RNA, 22 nt, Homo sapiens
agacaggcaaauguacuucuca

SEQ ID NO: 662124 - RNA, 14 nt, Homo sapiens
agacagggucucac

SEQ ID NO: 662125 - RNA, 23 nt, Homo sapiens
agacaguaugagucaaugugcag

SEQ ID NO: 662126 - RNA, 18 nt, Homo sapiens
agacaguauuuugacaaa

SEQ ID NO: 662127 - RNA, 20 nt, Homo sapiens
agacaguccuuucccaccau

SEQ ID NO: 662128 - RNA, 22 nt, Homo sapiens
agacagucuucuaauuccucau

SEQ ID NO: 662129 - RNA, 14 nt, Homo sapiens
agacagugagacag

SEQ ID NO: 662130 - RNA, 16 nt, Homo sapiens
agacagugcugagauu

SEQ ID NO: 662131 - RNA, 19 nt, Homo sapiens
agacaguguuuucugggau

SEQ ID NO: 662132 - RNA, 14 nt, Homo sapiens
agacaguucaagaa

SEQ ID NO: 662133 - RNA, 19 nt, Homo sapiens
agacaguuuacuuugccaa

SEQ ID NO: 662134 - RNA, 21 nt, Homo sapiens
agacauagccgauucucugcc

SEQ ID NO: 662135 - RNA, 17 nt, Homo sapiens
agacauaggccaugaaa

SEQ ID NO: 662136 - RNA, 13 nt, Homo sapiens
agacaucucagga

SEQ ID NO: 662137 - RNA, 22 nt, Homo sapiens
agacaucucaggauuucaccag

SEQ ID NO: 662138 - RNA, 14 nt, Homo sapiens
agacaugaaccaag

SEQ ID NO: 662139 - RNA, 17 nt, Homo sapiens
agacaugauuuccuuga

SEQ ID NO: 662140 - RNA, 13 nt, Homo sapiens
agacaugccuugg

SEQ ID NO: 662141 - RNA, 20 nt, Homo sapiens
agacaugccuuggugccggu

SEQ ID NO: 662142 - RNA, 18 nt, Homo sapiens
agacauggaauuaccuua

SEQ ID NO: 662143 - RNA, 18 nt, Homo sapiens
agacauggagacuccugc

SEQ ID NO: 662144 - RNA, 17 nt, Homo sapiens
agacaugugacauuuau

SEQ ID NO: 662145 - RNA, 13 nt, Homo sapiens
agacauucucaca

SEQ ID NO: 662146 - RNA, 22 nt, Homo sapiens
agacauucucgcuucccugaaa

SEQ ID NO: 662147 - RNA, 13 nt, Homo sapiens
agagaaucccagg

SEQ ID NO: 662148 - RNA, 17 nt, Homo sapiens
agagaaugcccagugac

SEQ ID NO: 662149 - RNA, 20 nt, Homo sapiens
agagaauucucuuauccaac

SEQ ID NO: 662150 - RNA, 22 nt, Homo sapiens
agagaauuguaucauuugaaca

SEQ ID NO: 662151 - RNA, 13 nt, Homo sapiens
agagacacuccaa

SEQ ID NO: 662152 - RNA, 17 nt, Homo sapiens
agagacagggaaagguc

SEQ ID NO: 662153 - RNA, 21 nt, Homo sapiens
agagacaggguuucacugugu

SEQ ID NO: 662154 - RNA, 17 nt, Homo sapiens
agagacccucucagccc

SEQ ID NO: 662155 - RNA, 16 nt, Homo sapiens
agagacuauguagcaa

SEQ ID NO: 662156 - RNA, 13 nt, Homo sapiens
agagacugaguca

SEQ ID NO: 662157 - RNA, 12 nt, Homo sapiens
agagacuguaga

SEQ ID NO: 662158 - RNA, 18 nt, Homo sapiens
agagagaacaggugggcu

SEQ ID NO: 662159 - RNA, 22 nt, Homo sapiens
agagagaacuuuucgacauauu

SEQ ID NO: 662160 - RNA, 14 nt, Homo sapiens
agagagaagugccc

SEQ ID NO: 662161 - RNA, 18 nt, Homo sapiens
agagagaauagagcugcc

SEQ ID NO: 662162 - RNA, 18 nt, Homo sapiens
agagagacagacuugaga

SEQ ID NO: 662163 - RNA, 16 nt, Homo sapiens
agagagaggcauuuag

SEQ ID NO: 662164 - RNA, 14 nt, Homo sapiens
agagagauguuccu

SEQ ID NO: 662165 - RNA, 17 nt, Homo sapiens
agagagcaucugcaaca

SEQ ID NO: 662166 - RNA, 18 nt, Homo sapiens
agagagcaucugcaacaa

SEQ ID NO: 662167 - RNA, 16 nt, Homo sapiens
agagagcuguauuaag

SEQ ID NO: 662168 - RNA, 15 nt, Homo sapiens
agagagcuguuccca

SEQ ID NO: 662169 - RNA, 21 nt, Homo sapiens
agagaggcgucugcugucuca

SEQ ID NO: 662170 - RNA, 18 nt, Homo sapiens
agagaggcucauccugua

SEQ ID NO: 662171 - RNA, 12 nt, Homo sapiens
agagaguaccau

SEQ ID NO: 662172 - RNA, 12 nt, Homo sapiens
agagagucccag

SEQ ID NO: 662173 - RNA, 16 nt, Homo sapiens
agagaguccucuggau

SEQ ID NO: 662174 - RNA, 22 nt, Homo sapiens
agagauacuguuguuacuucug

SEQ ID NO: 662175 - RNA, 19 nt, Homo sapiens
agagaucacaauacucaaa

SEQ ID NO: 662176 - RNA, 12 nt, Homo sapiens
agagaucuauaa

SEQ ID NO: 662177 - RNA, 21 nt, Homo sapiens
agagaucuuucuuuccaaaac

SEQ ID NO: 662178 - RNA, 15 nt, Homo sapiens
agagaugacugucca

SEQ ID NO: 662179 - RNA, 16 nt, Homo sapiens
agagaugggacuagga

SEQ ID NO: 662180 - RNA, 17 nt, Homo sapiens
agagaugggacuaggac

SEQ ID NO: 662181 - RNA, 21 nt, Homo sapiens
agagaugggguuucaccauau

SEQ ID NO: 662182 - RNA, 17 nt, Homo sapiens
agagauuagaauaucug

SEQ ID NO: 662183 - RNA, 17 nt, Homo sapiens
agagauuauaacaaauu

SEQ ID NO: 662184 - RNA, 12 nt, Homo sapiens
agagauucugug

SEQ ID NO: 662185 - RNA, 21 nt, Homo sapiens
agagauucuguugcauagacu

SEQ ID NO: 662186 - RNA, 17 nt, Homo sapiens
agagcaaaucuaugaga

SEQ ID NO: 662187 - RNA, 20 nt, Homo sapiens
agagcaagacucugucucaa

SEQ ID NO: 662188 - RNA, 22 nt, Homo sapiens
agagcaagguuucguggcagca

SEQ ID NO: 662189 - RNA, 19 nt, Homo sapiens
agagcacacuguagcauua

SEQ ID NO: 662190 - RNA, 10 nt, Homo sapiens
agagcacugg

SEQ ID NO: 662191 - RNA, 23 nt, Homo sapiens
agagcacuugagaaccagucucc

SEQ ID NO: 662192 - RNA, 17 nt, Homo sapiens
agagcacuuugcaacuc

SEQ ID NO: 662193 - RNA, 15 nt, Homo sapiens
agagcagagguggaa

SEQ ID NO: 662194 - RNA, 21 nt, Homo sapiens
agagcagcuucggugugcaga

SEQ ID NO: 662195 - RNA, 23 nt, Homo sapiens
agagcagcuuuaaacucagggac

SEQ ID NO: 662196 - RNA, 17 nt, Homo sapiens
agagcaggaagcauuca

SEQ ID NO: 662197 - RNA, 23 nt, Homo sapiens
agagcaggcuggcagcucuccag

SEQ ID NO: 662198 - RNA, 16 nt, Homo sapiens
agagcaggggcuccag

SEQ ID NO: 662199 - RNA, 22 nt, Homo sapiens
agagcaggggcuccagcaccuu

SEQ ID NO: 662200 - RNA, 21 nt, Homo sapiens
agagcaucugcaacaaaaagu

SEQ ID NO: 662201 - RNA, 17 nt, Homo sapiens
agagcaugauacaaauu

SEQ ID NO: 662202 - RNA, 22 nt, Homo sapiens
agagccaccaaagucacaucca

SEQ ID NO: 662203 - RNA, 21 nt, Homo sapiens
agagccaccuggcagggcuca

SEQ ID NO: 662204 - RNA, 17 nt, Homo sapiens
agagccaggaugcccag

SEQ ID NO: 662205 - RNA, 16 nt, Homo sapiens
agagccagggcugaug

SEQ ID NO: 662206 - RNA, 20 nt, Homo sapiens
agagccagucucaccuucaa

SEQ ID NO: 662207 - RNA, 18 nt, Homo sapiens
agagcccagucauuguac

SEQ ID NO: 662208 - RNA, 18 nt, Homo sapiens
agagccccuacagcauug

SEQ ID NO: 662209 - RNA, 13 nt, Homo sapiens
agagcccuugccu

SEQ ID NO: 662210 - RNA, 19 nt, Homo sapiens
agagcccuugccuccccau

SEQ ID NO: 662211 - RNA, 20 nt, Homo sapiens
agagcgcaguguuuugcaag

SEQ ID NO: 662212 - RNA, 20 nt, Homo sapiens
agagcgcuuuugucugcaau

SEQ ID NO: 662213 - RNA, 22 nt, Homo sapiens
agagcggaaggagggagcucug

SEQ ID NO: 662214 - RNA, 23 nt, Homo sapiens
agagcuaagggugggugcucaga

SEQ ID NO: 662215 - RNA, 21 nt, Homo sapiens
agagcuagaugugucuuacca

SEQ ID NO: 662216 - RNA, 15 nt, Homo sapiens
agagcuagcugccac

SEQ ID NO: 662217 - RNA, 10 nt, Homo sapiens
agagcucuau

SEQ ID NO: 662218 - RNA, 22 nt, Homo sapiens
agagcucuuuaccaaggaugaa

SEQ ID NO: 662219 - RNA, 18 nt, Homo sapiens
agagcugccaucgcugug

SEQ ID NO: 662220 - RNA, 18 nt, Homo sapiens
agagcugggaguagcaug

SEQ ID NO: 662221 - RNA, 17 nt, Homo sapiens
agagcuguuauacugug

SEQ ID NO: 662222 - RNA, 14 nt, Homo sapiens
agagcuucccugac

SEQ ID NO: 662223 - RNA, 21 nt, Homo sapiens
agagcuugugcuccucuugau

SEQ ID NO: 662224 - RNA, 20 nt, Homo sapiens
agagcuuuuaaaaauguccu

SEQ ID NO: 662225 - RNA, 20 nt, Homo sapiens
agagcuuuuuaauagcacua

SEQ ID NO: 662226 - RNA, 22 nt, Homo sapiens
agaggaaaaguaaggugcaguu

SEQ ID NO: 662227 - RNA, 14 nt, Homo sapiens
agaggaaacugaag

SEQ ID NO: 662228 - RNA, 13 nt, Homo sapiens
agaggaaagaccu

SEQ ID NO: 662229 - RNA, 13 nt, Homo sapiens
agaggaaagggau

SEQ ID NO: 662230 - RNA, 21 nt, Homo sapiens
agaggaaaugucacagaagca

SEQ ID NO: 662231 - RNA, 15 nt, Homo sapiens
agaggaauguguucg

SEQ ID NO: 662232 - RNA, 12 nt, Homo sapiens
agaggaauuugg

SEQ ID NO: 662233 - RNA, 12 nt, Homo sapiens
agaggacacaau

SEQ ID NO: 662234 - RNA, 18 nt, Homo sapiens
caaaauaaucuauauuaa

SEQ ID NO: 662235 - RNA, 17 nt, Homo sapiens
caaaauacagcuaugaa

SEQ ID NO: 662236 - RNA, 18 nt, Homo sapiens
caaaauagacaauuugca

SEQ ID NO: 662237 - RNA, 15 nt, Homo sapiens
caaaauaguucugca

SEQ ID NO: 662238 - RNA, 19 nt, Homo sapiens
caaaauauaauuuacauua

SEQ ID NO: 662239 - RNA, 15 nt, Homo sapiens
caaaauauauauuaa

SEQ ID NO: 662240 - RNA, 21 nt, Homo sapiens
caaaauauauuuuguuuacaa

SEQ ID NO: 662241 - RNA, 19 nt, Homo sapiens
caaaauauuaacauucuuu

SEQ ID NO: 662242 - RNA, 20 nt, Homo sapiens
caaaauauuuaagugaagga

SEQ ID NO: 662243 - RNA, 19 nt, Homo sapiens
caaaauauuuggaaugaag

SEQ ID NO: 662244 - RNA, 19 nt, Homo sapiens
caaaaucaacaugacuggu

SEQ ID NO: 662245 - RNA, 14 nt, Homo sapiens
caaaauccaaggca

SEQ ID NO: 662246 - RNA, 21 nt, Homo sapiens
caaaauccaugugaccauucu

SEQ ID NO: 662247 - RNA, 14 nt, Homo sapiens
caaaaucuuuccaa

SEQ ID NO: 662248 - RNA, 16 nt, Homo sapiens
caaaaugagcaguaaa

SEQ ID NO: 662249 - RNA, 15 nt, Homo sapiens
caaaaugauuuugaa

SEQ ID NO: 662250 - RNA, 20 nt, Homo sapiens
caaaaugcagauuccucaga

SEQ ID NO: 662251 - RNA, 19 nt, Homo sapiens
caaaaugcucuaaugagca

SEQ ID NO: 662252 - RNA, 13 nt, Homo sapiens
caaaaugcuuuuu

SEQ ID NO: 662253 - RNA, 19 nt, Homo sapiens
caaaauggauacauaaaga

SEQ ID NO: 662254 - RNA, 14 nt, Homo sapiens
caaaauguacuuaa

SEQ ID NO: 662255 - RNA, 18 nt, Homo sapiens
caaaauguaugucugguu

SEQ ID NO: 662256 - RNA, 19 nt, Homo sapiens
caaaaugucuuaaugcaaa

SEQ ID NO: 662257 - RNA, 16 nt, Homo sapiens
caaaauguucuauuua

SEQ ID NO: 662258 - RNA, 17 nt, Homo sapiens
caaaauguucuauuuaa

SEQ ID NO: 662259 - RNA, 20 nt, Homo sapiens
caaaauguucuauuuaacaa

SEQ ID NO: 662260 - RNA, 17 nt, Homo sapiens
caaaauuaauacauucu

SEQ ID NO: 662261 - RNA, 18 nt, Homo sapiens
caaaauuacacaguuaau

SEQ ID NO: 662262 - RNA, 20 nt, Homo sapiens
caaaauucauuugcuugcaa

SEQ ID NO: 662263 - RNA, 11 nt, Homo sapiens
caaaauuccaa

SEQ ID NO: 662264 - RNA, 20 nt, Homo sapiens
caaaauuugaugccaggaca

SEQ ID NO: 662265 - RNA, 16 nt, Homo sapiens
caaaauuugcugccaa

SEQ ID NO: 662266 - RNA, 14 nt, Homo sapiens
caaacaaauaugca

SEQ ID NO: 662267 - RNA, 15 nt, Homo sapiens
caaacaauaaaggga

SEQ ID NO: 662268 - RNA, 19 nt, Homo sapiens
caaacaaugcauaggauuc

SEQ ID NO: 662269 - RNA, 13 nt, Homo sapiens
agagguacuguaa

SEQ ID NO: 662270 - RNA, 18 nt, Homo sapiens
agagguagcgagcugcuc

SEQ ID NO: 662271 - RNA, 19 nt, Homo sapiens
agagguauuccucucuuaa

SEQ ID NO: 662272 - RNA, 20 nt, Homo sapiens
agaggucaaggcugcaguga

SEQ ID NO: 662273 - RNA, 14 nt, Homo sapiens
agaggucaccagcu

SEQ ID NO: 662274 - RNA, 14 nt, Homo sapiens
agaggucccaagga

SEQ ID NO: 662275 - RNA, 14 nt, Homo sapiens
agaggucugugcug

SEQ ID NO: 662276 - RNA, 19 nt, Homo sapiens
agaggugccagcaacugaa

SEQ ID NO: 662277 - RNA, 22 nt, Homo sapiens
agagguggagugucacaucucu

SEQ ID NO: 662278 - RNA, 19 nt, Homo sapiens
agagguggccccaccugag

SEQ ID NO: 662279 - RNA, 19 nt, Homo sapiens
agagguguaacacuuguca

SEQ ID NO: 662280 - RNA, 17 nt, Homo sapiens
agaggugugggugucug

SEQ ID NO: 662281 - RNA, 21 nt, Homo sapiens
agagguuucuggcagccagua

SEQ ID NO: 662282 - RNA, 12 nt, Homo sapiens
agaguaaccuau

SEQ ID NO: 662283 - RNA, 16 nt, Homo sapiens
agaguacagauaugaa

SEQ ID NO: 662284 - RNA, 19 nt, Homo sapiens
agaguacagauaugaacac

SEQ ID NO: 662285 - RNA, 22 nt, Homo sapiens
agaguacucacuuuucacuugu

SEQ ID NO: 662286 - RNA, 18 nt, Homo sapiens
agaguagaauugcauuga

SEQ ID NO: 662287 - RNA, 20 nt, Homo sapiens
agaguauaugcacuuuccaa

SEQ ID NO: 662288 - RNA, 15 nt, Homo sapiens
agaguaucacuccca

SEQ ID NO: 662289 - RNA, 21 nt, Homo sapiens
agaguauuuuuaacacuuaaa

SEQ ID NO: 662290 - RNA, 12 nt, Homo sapiens
agagucacugau

SEQ ID NO: 662291 - RNA, 14 nt, Homo sapiens
agagucacugauac

SEQ ID NO: 662292 - RNA, 12 nt, Homo sapiens
agagucagcucu

SEQ ID NO: 662293 - RNA, 17 nt, Homo sapiens
agaguccacuguggcac

SEQ ID NO: 662294 - RNA, 17 nt, Homo sapiens
agaguccagugcucugc

SEQ ID NO: 662295 - RNA, 14 nt, Homo sapiens
agagucgcaucuca

SEQ ID NO: 662296 - RNA, 21 nt, Homo sapiens
agagucgcaucucagugcagg

SEQ ID NO: 662297 - RNA, 21 nt, Homo sapiens
agagucuaggcuaagcacuuu

SEQ ID NO: 662298 - RNA, 17 nt, Homo sapiens
agagucuuaaagcauuu

SEQ ID NO: 662299 - RNA, 17 nt, Homo sapiens
agagugaaaccaugacu

SEQ ID NO: 662300 - RNA, 16 nt, Homo sapiens
agagugaauuucagua

SEQ ID NO: 662301 - RNA, 18 nt, Homo sapiens
agagugaauuucaguaua

SEQ ID NO: 662302 - RNA, 13 nt, Homo sapiens
agagugacaguca

SEQ ID NO: 662303 - RNA, 22 nt, Homo sapiens
agagugagcaagggggcccaaa

SEQ ID NO: 662304 - RNA, 14 nt, Homo sapiens
agagugaggacuga

SEQ ID NO: 662305 - RNA, 18 nt, Homo sapiens
agagugaggcagcgccuc

SEQ ID NO: 662306 - RNA, 13 nt, Homo sapiens
agagugagugcau

SEQ ID NO: 662307 - RNA, 19 nt, Homo sapiens
agagugauugcagcuuuau

SEQ ID NO: 662308 - RNA, 13 nt, Homo sapiens
agagugcaauggu

SEQ ID NO: 662309 - RNA, 11 nt, Homo sapiens
agagugcccag

SEQ ID NO: 662310 - RNA, 23 nt, Homo sapiens
agagugccguaacaacugugguc

SEQ ID NO: 662311 - RNA, 23 nt, Homo sapiens
agagugcggcgugggggcacuga

SEQ ID NO: 662312 - RNA, 18 nt, Homo sapiens
agagugcuauaaaagacu

SEQ ID NO: 662313 - RNA, 19 nt, Homo sapiens
agagugcuccuguauugaa

SEQ ID NO: 662314 - RNA, 15 nt, Homo sapiens
agaguggcuuggccu

SEQ ID NO: 662315 - RNA, 23 nt, Homo sapiens
agagugggcagccccucuaccuc

SEQ ID NO: 662316 - RNA, 19 nt, Homo sapiens
agaguggucuuucuggaga

SEQ ID NO: 662317 - RNA, 19 nt, Homo sapiens
agaguggugcugcuuuaau

SEQ ID NO: 662318 - RNA, 15 nt, Homo sapiens
agaguguaaugggga

SEQ ID NO: 662319 - RNA, 14 nt, Homo sapiens
agaguguagcugua

SEQ ID NO: 662320 - RNA, 16 nt, Homo sapiens
agaguucuauccccaa

SEQ ID NO: 662321 - RNA, 15 nt, Homo sapiens
agaguucugcucuag

SEQ ID NO: 662322 - RNA, 13 nt, Homo sapiens
agaguugccaaaa

SEQ ID NO: 662323 - RNA, 19 nt, Homo sapiens
agaguuguuguuugccaag

SEQ ID NO: 662324 - RNA, 15 nt, Homo sapiens
agaguuucaaaagca

SEQ ID NO: 662325 - RNA, 14 nt, Homo sapiens
agaguuucuccuuu

SEQ ID NO: 662326 - RNA, 20 nt, Homo sapiens
agaguuucuccuuuugacca

SEQ ID NO: 662327 - RNA, 18 nt, Homo sapiens
agaguuugccuguucuau

SEQ ID NO: 662328 - RNA, 22 nt, Homo sapiens
agaguuuuuguuaguacuuugg

SEQ ID NO: 662329 - RNA, 13 nt, Homo sapiens
agauaaacacaaa

SEQ ID NO: 662330 - RNA, 15 nt, Homo sapiens
agauaaacuauacac

SEQ ID NO: 662331 - RNA, 22 nt, Homo sapiens
agauaaagauuucuaguaggca

SEQ ID NO: 662332 - RNA, 20 nt, Homo sapiens
agauaaagucaaaugccaaa

SEQ ID NO: 662333 - RNA, 21 nt, Homo sapiens
agauaaagucaaaugccaaac

SEQ ID NO: 662334 - RNA, 18 nt, Homo sapiens
agauaaccuguacuucaa

SEQ ID NO: 662335 - RNA, 17 nt, Homo sapiens
agauaacucaagaaauc

SEQ ID NO: 662336 - RNA, 20 nt, Homo sapiens
agauaacuguaaaugugaca

SEQ ID NO: 662337 - RNA, 16 nt, Homo sapiens
agauaacuuacuguau

SEQ ID NO: 662338 - RNA, 17 nt, Homo sapiens
agauaagaaaugaucuu

SEQ ID NO: 662339 - RNA, 13 nt, Homo sapiens
agauaagcaagag

SEQ ID NO: 662340 - RNA, 18 nt, Homo sapiens
agauaagucuacauuaaa

SEQ ID NO: 662341 - RNA, 19 nt, Homo sapiens
agauaaucucuccauuccc

SEQ ID NO: 662342 - RNA, 22 nt, Homo sapiens
agauaauuggcaacugggugaa

SEQ ID NO: 662343 - RNA, 15 nt, Homo sapiens
agauaauuguuucau

SEQ ID NO: 662344 - RNA, 22 nt, Homo sapiens
agauaauuguuucauucauccu

SEQ ID NO: 662345 - RNA, 13 nt, Homo sapiens
agauaauuugcau

SEQ ID NO: 662346 - RNA, 17 nt, Homo sapiens
agauaauuugcauauuc

SEQ ID NO: 662347 - RNA, 18 nt, Homo sapiens
agauaccagaauguugcu

SEQ ID NO: 662348 - RNA, 17 nt, Homo sapiens
agauaccauucaaccca

SEQ ID NO: 662349 - RNA, 21 nt, Homo sapiens
agauacccuacgcuguccaga

SEQ ID NO: 662350 - RNA, 18 nt, Homo sapiens
agauaccuccaacccugc

SEQ ID NO: 662351 - RNA, 22 nt, Homo sapiens
agauacugaugcauugaccuca

SEQ ID NO: 662352 - RNA, 14 nt, Homo sapiens
agauacuucccaaa

SEQ ID NO: 662353 - RNA, 18 nt, Homo sapiens
agauacuuuuguaaauaa

SEQ ID NO: 662354 - RNA, 21 nt, Homo sapiens
agauagaacacaaaacuugaa

SEQ ID NO: 662355 - RNA, 14 nt, Homo sapiens
agauagaaccugga

SEQ ID NO: 662356 - RNA, 14 nt, Homo sapiens
agauagacaaucac

SEQ ID NO: 662357 - RNA, 14 nt, Homo sapiens
agauagaucugugu

SEQ ID NO: 662358 - RNA, 18 nt, Homo sapiens
caaagccauucuuuuaaa

SEQ ID NO: 662359 - RNA, 21 nt, Homo sapiens
caaagcccuuauguuuaauca

SEQ ID NO: 662360 - RNA, 9 nt, Homo sapiens
caaagccuc

SEQ ID NO: 662361 - RNA, 23 nt, Homo sapiens
caaagccuccuccagccgccaug

SEQ ID NO: 662362 - RNA, 17 nt, Homo sapiens
caaagcgagcaagagaa

SEQ ID NO: 662363 - RNA, 23 nt, Homo sapiens
caaagcuaaaauaaaauuuuccu

SEQ ID NO: 662364 - RNA, 14 nt, Homo sapiens
caaagcuaccugug

SEQ ID NO: 662365 - RNA, 14 nt, Homo sapiens
caaagcugccuguc

SEQ ID NO: 662366 - RNA, 22 nt, Homo sapiens
caaagcugccugugccaugccc

SEQ ID NO: 662367 - RNA, 17 nt, Homo sapiens
caaaggaaaauugcacu

SEQ ID NO: 662368 - RNA, 16 nt, Homo sapiens
caaaggaagacuugaa

SEQ ID NO: 662369 - RNA, 15 nt, Homo sapiens
caaaggacccaaucc

SEQ ID NO: 662370 - RNA, 19 nt, Homo sapiens
caaaggagaaaaaaaaccu

SEQ ID NO: 662371 - RNA, 16 nt, Homo sapiens
caaaggagacaaagca

SEQ ID NO: 662372 - RNA, 14 nt, Homo sapiens
caaaggauacugua

SEQ ID NO: 662373 - RNA, 13 nt, Homo sapiens
caaaggaucuccu

SEQ ID NO: 662374 - RNA, 21 nt, Homo sapiens
caaaggaugugauauauaagu

SEQ ID NO: 662375 - RNA, 15 nt, Homo sapiens
caaaggcacugaggc

SEQ ID NO: 662376 - RNA, 22 nt, Homo sapiens
caaaggcagggccacuuuugaa

SEQ ID NO: 662377 - RNA, 17 nt, Homo sapiens
caaaggccacaggcagu

SEQ ID NO: 662378 - RNA, 20 nt, Homo sapiens
caaagggccugcccagacaa

SEQ ID NO: 662379 - RNA, 17 nt, Homo sapiens
caaaggggacagcugug

SEQ ID NO: 662380 - RNA, 17 nt, Homo sapiens
caaagguagggacugga

SEQ ID NO: 662381 - RNA, 22 nt, Homo sapiens
caaaggucagggacacaucccc

SEQ ID NO: 662382 - RNA, 14 nt, Homo sapiens
caaagguugcagug

SEQ ID NO: 662383 - RNA, 12 nt, Homo sapiens
caaaguaaaaaa

SEQ ID NO: 662384 - RNA, 15 nt, Homo sapiens
caaaguagaagucuu

SEQ ID NO: 662385 - RNA, 20 nt, Homo sapiens
caaaguagaggaauccaugu

SEQ ID NO: 662386 - RNA, 24 nt, Homo sapiens
caaaguauaaccauaugauacuau

SEQ ID NO: 662387 - RNA, 18 nt, Homo sapiens
caaagucagcagggacca

SEQ ID NO: 662388 - RNA, 17 nt, Homo sapiens
caaagucuaaacugagc

SEQ ID NO: 662389 - RNA, 18 nt, Homo sapiens
caaagucugugugaugaa

SEQ ID NO: 662390 - RNA, 20 nt, Homo sapiens
caaagugacauuccugaguc

SEQ ID NO: 662391 - RNA, 21 nt, Homo sapiens
agauccucaucuuggagcuuu

SEQ ID NO: 662392 - RNA, 14 nt, Homo sapiens
agauccucuuuacu

SEQ ID NO: 662393 - RNA, 20 nt, Homo sapiens
agauccucuuuacucugggc

SEQ ID NO: 662394 - RNA, 22 nt, Homo sapiens
agauccugcagaaguacuccua

SEQ ID NO: 662395 - RNA, 20 nt, Homo sapiens
agauccuggagugauaugau

SEQ ID NO: 662396 - RNA, 16 nt, Homo sapiens
agauccuggguacuga

SEQ ID NO: 662397 - RNA, 19 nt, Homo sapiens
agaucgaggcuacagugag

SEQ ID NO: 662398 - RNA, 17 nt, Homo sapiens
agaucgcaccacugcac

SEQ ID NO: 662399 - RNA, 18 nt, Homo sapiens
agaucgcaccacugcacu

SEQ ID NO: 662400 - RNA, 19 nt, Homo sapiens
agaucgcaccacugcacuc

SEQ ID NO: 662401 - RNA, 18 nt, Homo sapiens
agaucgcgccacugcacu

SEQ ID NO: 662402 - RNA, 19 nt, Homo sapiens
agaucgcgccacugcacuc

SEQ ID NO: 662403 - RNA, 20 nt, Homo sapiens
agaucgcgccacugcacucc

SEQ ID NO: 662404 - RNA, 18 nt, Homo sapiens
agaucgugcuacugcacu

SEQ ID NO: 662405 - RNA, 17 nt, Homo sapiens
agaucuaucuugucaau

SEQ ID NO: 662406 - RNA, 16 nt, Homo sapiens
agaucuauguacugua

SEQ ID NO: 662407 - RNA, 22 nt, Homo sapiens
agaucuggucccuugcagcuag

SEQ ID NO: 662408 - RNA, 16 nt, Homo sapiens
agaucuucacucuggg

SEQ ID NO: 662409 - RNA, 18 nt, Homo sapiens
agaucuugaauagucuca

SEQ ID NO: 662410 - RNA, 17 nt, Homo sapiens
agaucuuuaaacugcuu

SEQ ID NO: 662411 - RNA, 17 nt, Homo sapiens
agaugaaaugcacugua

SEQ ID NO: 662412 - RNA, 21 nt, Homo sapiens
agaugaacccgaggcugagaa

SEQ ID NO: 662413 - RNA, 14 nt, Homo sapiens
agaugaagacauca

SEQ ID NO: 662414 - RNA, 18 nt, Homo sapiens
agaugaauggucuggcaa

SEQ ID NO: 662415 - RNA, 21 nt, Homo sapiens
agaugaauggucuggcaauau

SEQ ID NO: 662416 - RNA, 20 nt, Homo sapiens
agaugaauguagcagauccc

SEQ ID NO: 662417 - RNA, 14 nt, Homo sapiens
agaugacaguauuu

SEQ ID NO: 662418 - RNA, 17 nt, Homo sapiens
agaugacccaaucugcc

SEQ ID NO: 662419 - RNA, 16 nt, Homo sapiens
agaugaccguguacaa

SEQ ID NO: 662420 - RNA, 24 nt, Homo sapiens
agaugaccuacagugcuguguacc

SEQ ID NO: 662421 - RNA, 13 nt, Homo sapiens
agaugacuacuug

SEQ ID NO: 662422 - RNA, 15 nt, Homo sapiens
agaugagaacaaagc

SEQ ID NO: 662423 - RNA, 22 nt, Homo sapiens
agaugagaacaaagcuguuaaa

SEQ ID NO: 662424 - RNA, 16 nt, Homo sapiens
agaugaggcacuggaa

SEQ ID NO: 662425 - RNA, 14 nt, Homo sapiens
agaugagggggcca

SEQ ID NO: 662426 - RNA, 15 nt, Homo sapiens
agaugaggugcucaa

SEQ ID NO: 662427 - RNA, 18 nt, Homo sapiens
agaugaucagggauccaa

SEQ ID NO: 662428 - RNA, 17 nt, Homo sapiens
agaugauggaugccaau

SEQ ID NO: 662429 - RNA, 14 nt, Homo sapiens
agaugauugaauaa

SEQ ID NO: 662430 - RNA, 15 nt, Homo sapiens
agaugauuguucaaa

SEQ ID NO: 662431 - RNA, 13 nt, Homo sapiens
agaugauuucuca

SEQ ID NO: 662432 - RNA, 14 nt, Homo sapiens
agaugauuucucaa

SEQ ID NO: 662433 - RNA, 22 nt, Homo sapiens
agaugcacagaauauguaugua

SEQ ID NO: 662434 - RNA, 19 nt, Homo sapiens
agaugcagccagcauuacc

SEQ ID NO: 662435 - RNA, 18 nt, Homo sapiens
agaugcagcuacuggaau

SEQ ID NO: 662436 - RNA, 15 nt, Homo sapiens
agaugccuguugaag

SEQ ID NO: 662437 - RNA, 20 nt, Homo sapiens
agaugcguuguuacaggaag

SEQ ID NO: 662438 - RNA, 16 nt, Homo sapiens
agaugcuacuggacuu

SEQ ID NO: 662439 - RNA, 15 nt, Homo sapiens
agaugcuaggaagcu

SEQ ID NO: 662440 - RNA, 20 nt, Homo sapiens
agaugcugacuguacuccuc

SEQ ID NO: 662441 - RNA, 18 nt, Homo sapiens
agaugcugcaaugugagu

SEQ ID NO: 662442 - RNA, 16 nt, Homo sapiens
agaugcuggguuggug

SEQ ID NO: 662443 - RNA, 18 nt, Homo sapiens
agaugcuguugugaagcu

SEQ ID NO: 662444 - RNA, 17 nt, Homo sapiens
agaugcuuuugugagaa

SEQ ID NO: 662445 - RNA, 15 nt, Homo sapiens
agauggaaaaacuga

SEQ ID NO: 662446 - RNA, 22 nt, Homo sapiens
agauggaacacuggaacauucc

SEQ ID NO: 662447 - RNA, 15 nt, Homo sapiens
agauggagguuuacc

SEQ ID NO: 662448 - RNA, 14 nt, Homo sapiens
agauggaguuucac

SEQ ID NO: 662449 - RNA, 16 nt, Homo sapiens
agauggauagucuguc

SEQ ID NO: 662450 - RNA, 18 nt, Homo sapiens
agauggauagucugucca

SEQ ID NO: 662451 - RNA, 15 nt, Homo sapiens
agauggcaauuucac

SEQ ID NO: 662452 - RNA, 16 nt, Homo sapiens
agauggcagcagugaa

SEQ ID NO: 662453 - RNA, 18 nt, Homo sapiens
agauggcgaccaccaaag

SEQ ID NO: 662454 - RNA, 14 nt, Homo sapiens
agauggcuuuuccu

SEQ ID NO: 662455 - RNA, 21 nt, Homo sapiens
agaugggcaaaagacgggaag

SEQ ID NO: 662456 - RNA, 15 nt, Homo sapiens
agaugguccgugccc

SEQ ID NO: 662457 - RNA, 22 nt, Homo sapiens
agaugguccgugcccaggcccu

SEQ ID NO: 662458 - RNA, 18 nt, Homo sapiens
agaugguguggguguccu

SEQ ID NO: 662459 - RNA, 22 nt, Homo sapiens
agaugguguggguguccugccu

SEQ ID NO: 662460 - RNA, 22 nt, Homo sapiens
agauguaagaaauguucuugca

SEQ ID NO: 662461 - RNA, 22 nt, Homo sapiens
agauguaauguuuucuuugcaa

SEQ ID NO: 662462 - RNA, 10 nt, Homo sapiens
agauguagag

SEQ ID NO: 662463 - RNA, 16 nt, Homo sapiens
agauguauauauuucc

SEQ ID NO: 662464 - RNA, 17 nt, Homo sapiens
agauguauauauuuccu

SEQ ID NO: 662465 - RNA, 21 nt, Homo sapiens
agauguauuauaccagugaaa

SEQ ID NO: 662466 - RNA, 22 nt, Homo sapiens
agauguauuuuugauguauaua

SEQ ID NO: 662467 - RNA, 15 nt, Homo sapiens
agaugugcauuucac

SEQ ID NO: 662468 - RNA, 20 nt, Homo sapiens
agauguggcaaagugcugua

SEQ ID NO: 662469 - RNA, 20 nt, Homo sapiens
agauguggucaauggaagaa

SEQ ID NO: 662470 - RNA, 16 nt, Homo sapiens
agaugugucuuaccag

SEQ ID NO: 662471 - RNA, 17 nt, Homo sapiens
agauguguuauuacuuc

SEQ ID NO: 662472 - RNA, 16 nt, Homo sapiens
agauguuauuacuguu

SEQ ID NO: 662473 - RNA, 19 nt, Homo sapiens
agauguucuggauaccauu

SEQ ID NO: 662474 - RNA, 20 nt, Homo sapiens
agauguugagaauguucauc

SEQ ID NO: 662475 - RNA, 14 nt, Homo sapiens
agauguuggaccaa

SEQ ID NO: 662476 - RNA, 17 nt, Homo sapiens
agauguuguguggcaau

SEQ ID NO: 662477 - RNA, 12 nt, Homo sapiens
agauguuuauau

SEQ ID NO: 662478 - RNA, 12 nt, Homo sapiens
agauguuuauuu

SEQ ID NO: 662479 - RNA, 14 nt, Homo sapiens
agauguuuauuuca

SEQ ID NO: 662480 - RNA, 20 nt, Homo sapiens
agauguuuuauuuugccagu

SEQ ID NO: 662481 - RNA, 19 nt, Homo sapiens
agauguuuuggggacucau

SEQ ID NO: 662482 - RNA, 22 nt, Homo sapiens
caaauuugccaugacauuucau

SEQ ID NO: 662483 - RNA, 12 nt, Homo sapiens
caaauuuguaca

SEQ ID NO: 662484 - RNA, 18 nt, Homo sapiens
caaauuuuaucuccagau

SEQ ID NO: 662485 - RNA, 22 nt, Homo sapiens
caaauuuuguauaacuuuugau

SEQ ID NO: 662486 - RNA, 16 nt, Homo sapiens
caaauuuuguauuucu

SEQ ID NO: 662487 - RNA, 16 nt, Homo sapiens
caaauuuuucuaucaa

SEQ ID NO: 662488 - RNA, 11 nt, Homo sapiens
caacaaaccau

SEQ ID NO: 662489 - RNA, 20 nt, Homo sapiens
caacaaagaaugggcuugaa

SEQ ID NO: 662490 - RNA, 17 nt, Homo sapiens
caacaacaacaaaaagc

SEQ ID NO: 662491 - RNA, 14 nt, Homo sapiens
caacaagauuucca

SEQ ID NO: 662492 - RNA, 15 nt, Homo sapiens
caacaaggacagccc

SEQ ID NO: 662493 - RNA, 21 nt, Homo sapiens
caacaaggguccguggaccag

SEQ ID NO: 662494 - RNA, 15 nt, Homo sapiens
caacaauugguaaaa

SEQ ID NO: 662495 - RNA, 20 nt, Homo sapiens
caacaauugugugaauuaau

SEQ ID NO: 662496 - RNA, 23 nt, Homo sapiens
caacaccuucuuggcuucuggga

SEQ ID NO: 662497 - RNA, 23 nt, Homo sapiens
caacacugcugcuccagugcagg

SEQ ID NO: 662498 - RNA, 17 nt, Homo sapiens
caacacuguacacauaa

SEQ ID NO: 662499 - RNA, 19 nt, Homo sapiens
caacacuguuacuuucgua

SEQ ID NO: 662500 - RNA, 11 nt, Homo sapiens
caacacuuaag

SEQ ID NO: 662501 - RNA, 14 nt, Homo sapiens
caacacuuuuucca

SEQ ID NO: 662502 - RNA, 18 nt, Homo sapiens
caacagaagcuuccauuc

SEQ ID NO: 662503 - RNA, 14 nt, Homo sapiens
caacagaaguauca

SEQ ID NO: 662504 - RNA, 12 nt, Homo sapiens
caacagacugaa

SEQ ID NO: 662505 - RNA, 13 nt, Homo sapiens
caacagacuugaa

SEQ ID NO: 662506 - RNA, 17 nt, Homo sapiens
caacagagcgagauucc

SEQ ID NO: 662507 - RNA, 14 nt, Homo sapiens
caacagaucugcag

SEQ ID NO: 662508 - RNA, 21 nt, Homo sapiens
caacagaugaccguguacaau

SEQ ID NO: 662509 - RNA, 22 nt, Homo sapiens
caacagauggauagucugucca

SEQ ID NO: 662510 - RNA, 23 nt, Homo sapiens
caacagcaccuccccgcugggaa

SEQ ID NO: 662511 - RNA, 12 nt, Homo sapiens
caacagcacugg

SEQ ID NO: 662512 - RNA, 23 nt, Homo sapiens
caacagcaucuucccaaaaccau

SEQ ID NO: 662513 - RNA, 13 nt, Homo sapiens
caccaacuuguag

SEQ ID NO: 662514 - RNA, 22 nt, Homo sapiens
caccaaggaaacgcuaccucuc

SEQ ID NO: 662515 - RNA, 16 nt, Homo sapiens
caccaaggcagugcau

SEQ ID NO: 662516 - RNA, 21 nt, Homo sapiens
caccaauauuucucagacauc

SEQ ID NO: 662517 - RNA, 21 nt, Homo sapiens
caccaauauuucuucacaaag

SEQ ID NO: 662518 - RNA, 20 nt, Homo sapiens
caccaaugggccuccagaga

SEQ ID NO: 662519 - RNA, 17 nt, Homo sapiens
caccaauuccaccaaga

SEQ ID NO: 662520 - RNA, 22 nt, Homo sapiens
caccaauuuggaaggcauugaa

SEQ ID NO: 662521 - RNA, 12 nt, Homo sapiens
caccacaaacuu

SEQ ID NO: 662522 - RNA, 14 nt, Homo sapiens
caccacagacacac

SEQ ID NO: 662523 - RNA, 16 nt, Homo sapiens
caccacagacacacac

SEQ ID NO: 662524 - RNA, 21 nt, Homo sapiens
caccacagccggucagaggag

SEQ ID NO: 662525 - RNA, 14 nt, Homo sapiens
caccaccaccugac

SEQ ID NO: 662526 - RNA, 18 nt, Homo sapiens
caccaccaugcucaacua

SEQ ID NO: 662527 - RNA, 17 nt, Homo sapiens
caccacccccacuggug

SEQ ID NO: 662528 - RNA, 17 nt, Homo sapiens
caccacuccacuccucc

SEQ ID NO: 662529 - RNA, 22 nt, Homo sapiens
caccacugaaacccugcacuua

SEQ ID NO: 662530 - RNA, 13 nt, Homo sapiens
caccacugcugag

SEQ ID NO: 662531 - RNA, 16 nt, Homo sapiens
caccacuguugccuuu

SEQ ID NO: 662532 - RNA, 14 nt, Homo sapiens
caccagacccaccu

SEQ ID NO: 662533 - RNA, 20 nt, Homo sapiens
caccagagagagauucuucc

SEQ ID NO: 662534 - RNA, 20 nt, Homo sapiens
caccagcacuuuauacacuu

SEQ ID NO: 662535 - RNA, 18 nt, Homo sapiens
caccagccccacugccag

SEQ ID NO: 662536 - RNA, 23 nt, Homo sapiens
caccaggaauccccaacaugcac

SEQ ID NO: 662537 - RNA, 19 nt, Homo sapiens
caccaggagagagggcaaa

SEQ ID NO: 662538 - RNA, 19 nt, Homo sapiens
caccaggagcagcagccag

SEQ ID NO: 662539 - RNA, 16 nt, Homo sapiens
caccagggucccagga

SEQ ID NO: 662540 - RNA, 17 nt, Homo sapiens
caccagggucccaggaa

SEQ ID NO: 662541 - RNA, 14 nt, Homo sapiens
caccagucaccucg

SEQ ID NO: 662542 - RNA, 11 nt, Homo sapiens
caccaguucuc

SEQ ID NO: 662543 - RNA, 22 nt, Homo sapiens
caccauauuaccacagacauac

SEQ ID NO: 662544 - RNA, 18 nt, Homo sapiens
caccauccugcagccucc

SEQ ID NO: 662545 - RNA, 23 nt, Homo sapiens
caccaugaagcgaaacacagaga

SEQ ID NO: 662546 - RNA, 14 nt, Homo sapiens
caccaugcacugua

SEQ ID NO: 662547 - RNA, 23 nt, Homo sapiens
caccaugcucggcuuuugcauua

SEQ ID NO: 662548 - RNA, 18 nt, Homo sapiens
caccauguuugagcucag

SEQ ID NO: 662549 - RNA, 19 nt, Homo sapiens
caccauucacauuugaugu

SEQ ID NO: 662550 - RNA, 22 nt, Homo sapiens
cacccaacccuaucuccugaca

SEQ ID NO: 662551 - RNA, 18 nt, Homo sapiens
cacccaaccugacuuccu

SEQ ID NO: 662552 - RNA, 14 nt, Homo sapiens
cacccacaaucaca

SEQ ID NO: 662553 - RNA, 14 nt, Homo sapiens
cacccacccaggag

SEQ ID NO: 662554 - RNA, 23 nt, Homo sapiens
cacccaccccacagacuccggcc

SEQ ID NO: 662555 - RNA, 15 nt, Homo sapiens
cacccacuuugucca

SEQ ID NO: 662556 - RNA, 13 nt, Homo sapiens
cacccagcaauag

SEQ ID NO: 662557 - RNA, 23 nt, Homo sapiens
cacccagcucagcauuuccacac

SEQ ID NO: 662558 - RNA, 12 nt, Homo sapiens
cacccaggcaau

SEQ ID NO: 662559 - RNA, 20 nt, Homo sapiens
cacccaggcuggacugcaau

SEQ ID NO: 662560 - RNA, 20 nt, Homo sapiens
cacccaggcuggaguacagu

SEQ ID NO: 662561 - RNA, 16 nt, Homo sapiens
cacccagugcugccau

SEQ ID NO: 662562 - RNA, 15 nt, Homo sapiens
cacccauaugguccc

SEQ ID NO: 662563 - RNA, 23 nt, Homo sapiens
cacccaucguccaccccagugug

SEQ ID NO: 662564 - RNA, 18 nt, Homo sapiens
cacccaugaaucaaagac

SEQ ID NO: 662565 - RNA, 22 nt, Homo sapiens
caccccaauugggaaugcaaua

SEQ ID NO: 662566 - RNA, 15 nt, Homo sapiens
caccccacagacucc

SEQ ID NO: 662567 - RNA, 21 nt, Homo sapiens
caccccagccucauugugcca

SEQ ID NO: 662568 - RNA, 13 nt, Homo sapiens
caccccagugugc

SEQ ID NO: 662569 - RNA, 22 nt, Homo sapiens
cacccccacccaccuccaccca

SEQ ID NO: 662570 - RNA, 16 nt, Homo sapiens
cacccccagcaagaag

SEQ ID NO: 662571 - RNA, 14 nt, Homo sapiens
cacccccagcucaa

SEQ ID NO: 662572 - RNA, 15 nt, Homo sapiens
cacccccuguucccu

SEQ ID NO: 662573 - RNA, 21 nt, Homo sapiens
caccccggggacccugugaca

SEQ ID NO: 662574 - RNA, 16 nt, Homo sapiens
caccccuaaguacaag

SEQ ID NO: 662575 - RNA, 19 nt, Homo sapiens
caccccucaguuaauugca

SEQ ID NO: 662576 - RNA, 13 nt, Homo sapiens
caccccugcaguu

SEQ ID NO: 662577 - RNA, 21 nt, Homo sapiens
caccccuucgacaugcugcca

SEQ ID NO: 662578 - RNA, 22 nt, Homo sapiens
cacccgaagcgcuucugcacca

SEQ ID NO: 662579 - RNA, 16 nt, Homo sapiens
cacccgcccacagcca

SEQ ID NO: 662580 - RNA, 19 nt, Homo sapiens
cacccgugugaagaugaag

SEQ ID NO: 662581 - RNA, 14 nt, Homo sapiens
cacccuaccagcuc

SEQ ID NO: 662582 - RNA, 14 nt, Homo sapiens
cacccuauauauaa

SEQ ID NO: 662583 - RNA, 22 nt, Homo sapiens
cacccuaucccuguacagagua

SEQ ID NO: 662584 - RNA, 22 nt, Homo sapiens
cacccucacacacacagcuggg

SEQ ID NO: 662585 - RNA, 18 nt, Homo sapiens
cacccuccacaaagcaaa

SEQ ID NO: 662586 - RNA, 17 nt, Homo sapiens
cacccuccaccgagcca

SEQ ID NO: 662587 - RNA, 18 nt, Homo sapiens
cacccuccaccucucacg

SEQ ID NO: 662588 - RNA, 20 nt, Homo sapiens
cacccuccaugcuccucacc

SEQ ID NO: 662589 - RNA, 22 nt, Homo sapiens
cacccucccccgccacuccuga

SEQ ID NO: 662590 - RNA, 17 nt, Homo sapiens
cacccuccuugcaggau

SEQ ID NO: 662591 - RNA, 19 nt, Homo sapiens
cacccucuggggacaggau

SEQ ID NO: 662592 - RNA, 18 nt, Homo sapiens
cacccucuuccugugauc

SEQ ID NO: 662593 - RNA, 17 nt, Homo sapiens
cacccugccccuugcca

SEQ ID NO: 662594 - RNA, 20 nt, Homo sapiens
cacccugcccuuguugucuc

SEQ ID NO: 662595 - RNA, 14 nt, Homo sapiens
cacccugcgggcca

SEQ ID NO: 662596 - RNA, 18 nt, Homo sapiens
cacccugcgggccagggu

SEQ ID NO: 662597 - RNA, 13 nt, Homo sapiens
cacccugcugcac

SEQ ID NO: 662598 - RNA, 21 nt, Homo sapiens
cacccuggaggauuucaucuc

SEQ ID NO: 662599 - RNA, 16 nt, Homo sapiens
cacccugggaguuucc

SEQ ID NO: 662600 - RNA, 16 nt, Homo sapiens
cacccuuaacccaagg

SEQ ID NO: 662601 - RNA, 22 nt, Homo sapiens
cacccuuguccuugagugcucu

SEQ ID NO: 662602 - RNA, 19 nt, Homo sapiens
cacccuuuacuccccagag

SEQ ID NO: 662603 - RNA, 14 nt, Homo sapiens
caccgacuagccag

SEQ ID NO: 662604 - RNA, 18 nt, Homo sapiens
caccgagacaccaccuau

SEQ ID NO: 662605 - RNA, 22 nt, Homo sapiens
caccgcgcccggccucagugcc

SEQ ID NO: 662606 - RNA, 18 nt, Homo sapiens
caccgucccucagugaua

SEQ ID NO: 662607 - RNA, 21 nt, Homo sapiens
caccguggaccuuccugccac

SEQ ID NO: 662608 - RNA, 19 nt, Homo sapiens
caccguggggaaggggugc

SEQ ID NO: 662609 - RNA, 12 nt, Homo sapiens
caccguucugug

SEQ ID NO: 662610 - RNA, 22 nt, Homo sapiens
caccuaagaucucgguuugcca

SEQ ID NO: 662611 - RNA, 16 nt, Homo sapiens
caccuacauuaucuca

SEQ ID NO: 662612 - RNA, 23 nt, Homo sapiens
caccuaccuuagaaaacaaguau

SEQ ID NO: 662613 - RNA, 19 nt, Homo sapiens
caccuacgcgagucuuacu

SEQ ID NO: 662614 - RNA, 12 nt, Homo sapiens
caccuacuccag

SEQ ID NO: 662615 - RNA, 14 nt, Homo sapiens
agccuuuguuuuuc

SEQ ID NO: 662616 - RNA, 20 nt, Homo sapiens
agccuuuuccagaagaucug

SEQ ID NO: 662617 - RNA, 16 nt, Homo sapiens
agcgaagucucauggg

SEQ ID NO: 662618 - RNA, 14 nt, Homo sapiens
agcgaaucucugcc

SEQ ID NO: 662619 - RNA, 21 nt, Homo sapiens
agcgacguuuauuucaucucu

SEQ ID NO: 662620 - RNA, 11 nt, Homo sapiens
agcgagaagau

SEQ ID NO: 662621 - RNA, 18 nt, Homo sapiens
agcgaggaggcuccagag

SEQ ID NO: 662622 - RNA, 18 nt, Homo sapiens
agcgagguccaagcacau

SEQ ID NO: 662623 - RNA, 20 nt, Homo sapiens
agcgaguuuucugaccagcu

SEQ ID NO: 662624 - RNA, 15 nt, Homo sapiens
agcgauggugccugc

SEQ ID NO: 662625 - RNA, 18 nt, Homo sapiens
agcgauguaugcagcuau

SEQ ID NO: 662626 - RNA, 21 nt, Homo sapiens
agcgcagggcuggcacgugac

SEQ ID NO: 662627 - RNA, 18 nt, Homo sapiens
agcgcaguguuuugcaag

SEQ ID NO: 662628 - RNA, 18 nt, Homo sapiens
agcgcaucaggccuggca

SEQ ID NO: 662629 - RNA, 22 nt, Homo sapiens
agcgccaaauguucauccucau

SEQ ID NO: 662630 - RNA, 19 nt, Homo sapiens
agcgccuuuccugccaugu

SEQ ID NO: 662631 - RNA, 15 nt, Homo sapiens
agcgcgcacacgcac

SEQ ID NO: 662632 - RNA, 19 nt, Homo sapiens
agcgcugagugggagaagg

SEQ ID NO: 662633 - RNA, 20 nt, Homo sapiens
agcgcuguauuuacagacac

SEQ ID NO: 662634 - RNA, 19 nt, Homo sapiens
agcugaagugcauccaaag

SEQ ID NO: 662635 - RNA, 19 nt, Homo sapiens
agcugacaauuuccaaagc

SEQ ID NO: 662636 - RNA, 18 nt, Homo sapiens
agcugagaccagggucuu

SEQ ID NO: 662637 - RNA, 15 nt, Homo sapiens
agcugagagacuuuu

SEQ ID NO: 662638 - RNA, 16 nt, Homo sapiens
agcugagauugcacua

SEQ ID NO: 662639 - RNA, 20 nt, Homo sapiens
agcugagauugcacuauugc

SEQ ID NO: 662640 - RNA, 14 nt, Homo sapiens
agcugagcugugac

SEQ ID NO: 662641 - RNA, 14 nt, Homo sapiens
agcugaguaaaaug

SEQ ID NO: 662642 - RNA, 22 nt, Homo sapiens
agcugagugacugcagcuugcc

SEQ ID NO: 662643 - RNA, 14 nt, Homo sapiens
agcugagugcugaa

SEQ ID NO: 662644 - RNA, 18 nt, Homo sapiens
agcugaguuuaacaugug

SEQ ID NO: 662645 - RNA, 22 nt, Homo sapiens
agcugauauuauggcaagugau

SEQ ID NO: 662646 - RNA, 14 nt, Homo sapiens
agcugauccauagg

SEQ ID NO: 662647 - RNA, 23 nt, Homo sapiens
agcugaucugcggaucucagcuu

SEQ ID NO: 662648 - RNA, 20 nt, Homo sapiens
agcugaugaacuguggugcc

SEQ ID NO: 662649 - RNA, 21 nt, Homo sapiens
agcugauuccagaacaaauca

SEQ ID NO: 662650 - RNA, 14 nt, Homo sapiens
agcugcacacaccu

SEQ ID NO: 662651 - RNA, 23 nt, Homo sapiens
agcugcaccagagcaaccucuca

SEQ ID NO: 662652 - RNA, 14 nt, Homo sapiens
agcugcaccagcag

SEQ ID NO: 662653 - RNA, 13 nt, Homo sapiens
agcugcacccuca

SEQ ID NO: 662654 - RNA, 14 nt, Homo sapiens
agcugcaccugcca

SEQ ID NO: 662655 - RNA, 21 nt, Homo sapiens
agcugcagcaggugaccuccc

SEQ ID NO: 662656 - RNA, 14 nt, Homo sapiens
agcugcaggggugc

SEQ ID NO: 662657 - RNA, 13 nt, Homo sapiens
agcugcauaugau

SEQ ID NO: 662658 - RNA, 23 nt, Homo sapiens
agcugcaugggugccugcugcug

SEQ ID NO: 662659 - RNA, 22 nt, Homo sapiens
agcugccacuuucacguggccu

SEQ ID NO: 662660 - RNA, 13 nt, Homo sapiens
agcugccauguca

SEQ ID NO: 662661 - RNA, 10 nt, Homo sapiens
agcugccauu

SEQ ID NO: 662662 - RNA, 16 nt, Homo sapiens
agcugccccucccuca

SEQ ID NO: 662663 - RNA, 18 nt, Homo sapiens
agcugcccuagcugaccc

SEQ ID NO: 662664 - RNA, 13 nt, Homo sapiens
agcugccgugccu

SEQ ID NO: 662665 - RNA, 12 nt, Homo sapiens
agcugccuaccu

SEQ ID NO: 662666 - RNA, 14 nt, Homo sapiens
agcugccucugcuc

SEQ ID NO: 662667 - RNA, 15 nt, Homo sapiens
agcugccuguuuccu

SEQ ID NO: 662668 - RNA, 16 nt, Homo sapiens
agcugccuuggcucag

SEQ ID NO: 662669 - RNA, 16 nt, Homo sapiens
agcugcucccaaauaa

SEQ ID NO: 662670 - RNA, 19 nt, Homo sapiens
agcugcuccuagagggagg

SEQ ID NO: 662671 - RNA, 19 nt, Homo sapiens
agcugcugggauugggaag

SEQ ID NO: 662672 - RNA, 23 nt, Homo sapiens
agcugcugucuucuggacaggcu

SEQ ID NO: 662673 - RNA, 21 nt, Homo sapiens
agcuggaagguacuaugccag

SEQ ID NO: 662674 - RNA, 16 nt, Homo sapiens
agcuggacagagggga

SEQ ID NO: 662675 - RNA, 13 nt, Homo sapiens
agcuggacugcag

SEQ ID NO: 662676 - RNA, 14 nt, Homo sapiens
agcuggaggcacaa

SEQ ID NO: 662677 - RNA, 21 nt, Homo sapiens
agcuggauagacuugggaugg

SEQ ID NO: 662678 - RNA, 23 nt, Homo sapiens
agcuggcgaacccugggccaucc

SEQ ID NO: 662679 - RNA, 14 nt, Homo sapiens
agcuggcgucuguc

SEQ ID NO: 662680 - RNA, 16 nt, Homo sapiens
agcuggcucugugagg

SEQ ID NO: 662681 - RNA, 14 nt, Homo sapiens
agcugggaaccagc

SEQ ID NO: 662682 - RNA, 17 nt, Homo sapiens
agcugggacuacagggg

SEQ ID NO: 662683 - RNA, 22 nt, Homo sapiens
agcugggagcacaggcacugca

SEQ ID NO: 662684 - RNA, 14 nt, Homo sapiens
agcugggagcacug

SEQ ID NO: 662685 - RNA, 20 nt, Homo sapiens
agcugggcagagcucuggga

SEQ ID NO: 662686 - RNA, 17 nt, Homo sapiens
agcugggcucugcaauu

SEQ ID NO: 662687 - RNA, 17 nt, Homo sapiens
agcuggggcuacaggag

SEQ ID NO: 662688 - RNA, 22 nt, Homo sapiens
agcuggggcuuauggguggcuu

SEQ ID NO: 662689 - RNA, 20 nt, Homo sapiens
agcugggggccaugagcucc

SEQ ID NO: 662690 - RNA, 14 nt, Homo sapiens
agcugguccuccac

SEQ ID NO: 662691 - RNA, 18 nt, Homo sapiens
agcuggugacugguuggg

SEQ ID NO: 662692 - RNA, 19 nt, Homo sapiens
agcuggugccccacugaau

SEQ ID NO: 662693 - RNA, 20 nt, Homo sapiens
agcuggugccccacugaauu

SEQ ID NO: 662694 - RNA, 18 nt, Homo sapiens
agcuguacuagugccauu

SEQ ID NO: 662695 - RNA, 14 nt, Homo sapiens
agcuguagccaugg

SEQ ID NO: 662696 - RNA, 17 nt, Homo sapiens
agcuguagccauggcuc

SEQ ID NO: 662697 - RNA, 22 nt, Homo sapiens
agcuguagcucccgagcuacuc

SEQ ID NO: 662698 - RNA, 14 nt, Homo sapiens
agcuguaucuguaa

SEQ ID NO: 662699 - RNA, 11 nt, Homo sapiens
agcuguauuaa

SEQ ID NO: 662700 - RNA, 14 nt, Homo sapiens
agcugucacuuuug

SEQ ID NO: 662701 - RNA, 17 nt, Homo sapiens
agcugucaggcugauua

SEQ ID NO: 662702 - RNA, 15 nt, Homo sapiens
agcugucauaaaaag

SEQ ID NO: 662703 - RNA, 16 nt, Homo sapiens
agcugucccacaucac

SEQ ID NO: 662704 - RNA, 22 nt, Homo sapiens
agcugucuuagagugggaccaa

SEQ ID NO: 662705 - RNA, 11 nt, Homo sapiens
agcugugaugg

SEQ ID NO: 662706 - RNA, 23 nt, Homo sapiens
agcugugauggcgggcacugggu

SEQ ID NO: 662707 - RNA, 23 nt, Homo sapiens
agcugugcugggugagcucuucc

SEQ ID NO: 662708 - RNA, 19 nt, Homo sapiens
agcuguggccagcuuguua

SEQ ID NO: 662709 - RNA, 13 nt, Homo sapiens
agcuguucagcug

SEQ ID NO: 662710 - RNA, 13 nt, Homo sapiens
agcuguugcuauu

SEQ ID NO: 662711 - RNA, 22 nt, Homo sapiens
agcuguuguacguacuacggag

SEQ ID NO: 662712 - RNA, 18 nt, Homo sapiens
agcuuaaaaacuacccau

SEQ ID NO: 662713 - RNA, 17 nt, Homo sapiens
agcuuaaaaucugugaa

SEQ ID NO: 662714 - RNA, 17 nt, Homo sapiens
agcuuaaaucauggguc

SEQ ID NO: 662715 - RNA, 14 nt, Homo sapiens
agcuuaaauugcuu

SEQ ID NO: 662716 - RNA, 14 nt, Homo sapiens
agcuuaagaaccau

SEQ ID NO: 662717 - RNA, 16 nt, Homo sapiens
agcuuaaucaacagaa

SEQ ID NO: 662718 - RNA, 13 nt, Homo sapiens
agcuuacuacagu

SEQ ID NO: 662719 - RNA, 18 nt, Homo sapiens
agcuuagcaucagagguu

SEQ ID NO: 662720 - RNA, 14 nt, Homo sapiens
agcuuauacagagc

SEQ ID NO: 662721 - RNA, 15 nt, Homo sapiens
agcuuauacagagcc

SEQ ID NO: 662722 - RNA, 17 nt, Homo sapiens
agcuuauagucuuccag

SEQ ID NO: 662723 - RNA, 18 nt, Homo sapiens
agcuuauauauuacuugu

SEQ ID NO: 662724 - RNA, 17 nt, Homo sapiens
agcuucaccagagcauu

SEQ ID NO: 662725 - RNA, 21 nt, Homo sapiens
agcuucaggagggaaccagcu

SEQ ID NO: 662726 - RNA, 23 nt, Homo sapiens
agcuucagugauugggggaggaa

SEQ ID NO: 662727 - RNA, 12 nt, Homo sapiens
agcuucaugccu

SEQ ID NO: 662728 - RNA, 19 nt, Homo sapiens
agcuuccaaaugugucaga

SEQ ID NO: 662729 - RNA, 23 nt, Homo sapiens
agcuuccaacccgaggcaauaaa

SEQ ID NO: 662730 - RNA, 12 nt, Homo sapiens
agcuuccaugag

SEQ ID NO: 662731 - RNA, 15 nt, Homo sapiens
agcuucggcauuuga

SEQ ID NO: 662732 - RNA, 23 nt, Homo sapiens
agcuucgucuuguguuugcugca

SEQ ID NO: 662733 - RNA, 18 nt, Homo sapiens
agcuucucagccuuccua

SEQ ID NO: 662734 - RNA, 12 nt, Homo sapiens
agcuucucuaca

SEQ ID NO: 662735 - RNA, 21 nt, Homo sapiens
agcuucucuacagacuccaaa

SEQ ID NO: 662736 - RNA, 22 nt, Homo sapiens
agcuucucugcaguaaaacaca

SEQ ID NO: 662737 - RNA, 17 nt, Homo sapiens
agcuucuggggaugcag

SEQ ID NO: 662738 - RNA, 17 nt, Homo sapiens
agcuucuucacaggcac

SEQ ID NO: 662739 - RNA, 12 nt, Homo sapiens
agcuucuuguuu

SEQ ID NO: 662740 - RNA, 13 nt, Homo sapiens
cacuccacagugu

SEQ ID NO: 662741 - RNA, 22 nt, Homo sapiens
cacuccaccacccaaaagucaa

SEQ ID NO: 662742 - RNA, 15 nt, Homo sapiens
cacuccacucagguu

SEQ ID NO: 662743 - RNA, 16 nt, Homo sapiens
cacuccagucuggcaa

SEQ ID NO: 662744 - RNA, 14 nt, Homo sapiens
cacuccagugccca

SEQ ID NO: 662745 - RNA, 19 nt, Homo sapiens
cacuccagugcccaucagc

SEQ ID NO: 662746 - RNA, 23 nt, Homo sapiens
cacucccaccugacacaccaggc

SEQ ID NO: 662747 - RNA, 19 nt, Homo sapiens
cacuccccuaucccauucu

SEQ ID NO: 662748 - RNA, 16 nt, Homo sapiens
cacucccuggcucuca

SEQ ID NO: 662749 - RNA, 20 nt, Homo sapiens
cacuccgcgccgaugccacc

SEQ ID NO: 662750 - RNA, 16 nt, Homo sapiens
cacuccucuaagacaa

SEQ ID NO: 662751 - RNA, 13 nt, Homo sapiens
cacuccugaaccc

SEQ ID NO: 662752 - RNA, 14 nt, Homo sapiens
cacuccugaacccc

SEQ ID NO: 662753 - RNA, 17 nt, Homo sapiens
cacuccugaauucaguu

SEQ ID NO: 662754 - RNA, 19 nt, Homo sapiens
cacuccuggacaaccugga

SEQ ID NO: 662755 - RNA, 21 nt, Homo sapiens
cacuccuucucucacuguguu

SEQ ID NO: 662756 - RNA, 16 nt, Homo sapiens
agucuuagacaucaua

SEQ ID NO: 662757 - RNA, 22 nt, Homo sapiens
agucuuccaguuuaaugaacua

SEQ ID NO: 662758 - RNA, 23 nt, Homo sapiens
agucuuccaguuuaaugaacuac

SEQ ID NO: 662759 - RNA, 21 nt, Homo sapiens
agucuucccucagauuuccau

SEQ ID NO: 662760 - RNA, 19 nt, Homo sapiens
agucuuccugacacuuuaa

SEQ ID NO: 662761 - RNA, 18 nt, Homo sapiens
agucuucuccuccaugaa

SEQ ID NO: 662762 - RNA, 18 nt, Homo sapiens
agucuucugacugucacc

SEQ ID NO: 662763 - RNA, 23 nt, Homo sapiens
agucuugguuucucucuacagug

SEQ ID NO: 662764 - RNA, 13 nt, Homo sapiens
agucuugugccaa

SEQ ID NO: 662765 - RNA, 22 nt, Homo sapiens
agucuuuauguccauaagcuac

SEQ ID NO: 662766 - RNA, 20 nt, Homo sapiens
agucuuuauuguguaucaua

SEQ ID NO: 662767 - RNA, 12 nt, Homo sapiens
agucuuucccaa

SEQ ID NO: 662768 - RNA, 13 nt, Homo sapiens
agucuuugccagu

SEQ ID NO: 662769 - RNA, 19 nt, Homo sapiens
agucuuuucuggcaaauaa

SEQ ID NO: 662770 - RNA, 13 nt, Homo sapiens
agugaaaaaucug

SEQ ID NO: 662771 - RNA, 17 nt, Homo sapiens
agugaaaacaaguccuu

SEQ ID NO: 662772 - RNA, 15 nt, Homo sapiens
agugaaaacuuugua

SEQ ID NO: 662773 - RNA, 21 nt, Homo sapiens
agugaaaaucuuggagacccu

SEQ ID NO: 662774 - RNA, 17 nt, Homo sapiens
agugaaacuccgucuca

SEQ ID NO: 662775 - RNA, 23 nt, Homo sapiens
agugaaacuugggcacaugcuca

SEQ ID NO: 662776 - RNA, 16 nt, Homo sapiens
agugaagaugccagug

SEQ ID NO: 662777 - RNA, 18 nt, Homo sapiens
agugaaggugguggggcu

SEQ ID NO: 662778 - RNA, 21 nt, Homo sapiens
agugaagguucccaaggacau

SEQ ID NO: 662779 - RNA, 23 nt, Homo sapiens
agugaauacauuaacggugcuaa

SEQ ID NO: 662780 - RNA, 20 nt, Homo sapiens
agugaauggugccauuuucg

SEQ ID NO: 662781 - RNA, 15 nt, Homo sapiens
agugacacagcagcu

SEQ ID NO: 662782 - RNA, 21 nt, Homo sapiens
agugacagcuuucugggaugu

SEQ ID NO: 662783 - RNA, 12 nt, Homo sapiens
agugacagucau

SEQ ID NO: 662784 - RNA, 12 nt, Homo sapiens
agugacauguag

SEQ ID NO: 662785 - RNA, 21 nt, Homo sapiens
agugacaugugcuggacacug

SEQ ID NO: 662786 - RNA, 22 nt, Homo sapiens
agugacaugugcuggacacugu

SEQ ID NO: 662787 - RNA, 12 nt, Homo sapiens
agugacauuugu

SEQ ID NO: 662788 - RNA, 13 nt, Homo sapiens
agugaccauggca

SEQ ID NO: 662789 - RNA, 22 nt, Homo sapiens
agugaccauuauucacaggugg

SEQ ID NO: 662790 - RNA, 20 nt, Homo sapiens
agugaccccugaccucacug

SEQ ID NO: 662791 - RNA, 21 nt, Homo sapiens
agugaccuggaaucagugaag

SEQ ID NO: 662792 - RNA, 15 nt, Homo sapiens
agugacuaugaacuu

SEQ ID NO: 662793 - RNA, 20 nt, Homo sapiens
agugacucagaacuucugcc

SEQ ID NO: 662794 - RNA, 13 nt, Homo sapiens
agugacugacccc

SEQ ID NO: 662795 - RNA, 19 nt, Homo sapiens
agugacuguacaguuauca

SEQ ID NO: 662796 - RNA, 18 nt, Homo sapiens
agugacuguaucugugua

SEQ ID NO: 662797 - RNA, 17 nt, Homo sapiens
agugacuguuuggcuua

SEQ ID NO: 662798 - RNA, 22 nt, Homo sapiens
agugacuguuuggcuuauaaac

SEQ ID NO: 662799 - RNA, 24 nt, Homo sapiens
agugacuucuggagaaagcucaug

SEQ ID NO: 662800 - RNA, 19 nt, Homo sapiens
agugacuuguucugaguaa

SEQ ID NO: 662801 - RNA, 18 nt, Homo sapiens
agugagaaaaugccucaa

SEQ ID NO: 662802 - RNA, 22 nt, Homo sapiens
agugagacaaaaagcacuagua

SEQ ID NO: 662803 - RNA, 13 nt, Homo sapiens
agugagacagacu

SEQ ID NO: 662804 - RNA, 13 nt, Homo sapiens
agugagacccugu

SEQ ID NO: 662805 - RNA, 13 nt, Homo sapiens
agugagagcuucc

SEQ ID NO: 662806 - RNA, 13 nt, Homo sapiens
agugagagggcau

SEQ ID NO: 662807 - RNA, 12 nt, Homo sapiens
agugagcacuag

SEQ ID NO: 662808 - RNA, 16 nt, Homo sapiens
agugagcugugaucac

SEQ ID NO: 662809 - RNA, 14 nt, Homo sapiens
agugaggaaagccu

SEQ ID NO: 662810 - RNA, 21 nt, Homo sapiens
agugaggaagccuauuugaac

SEQ ID NO: 662811 - RNA, 23 nt, Homo sapiens
agugaggacucggccacuguguc

SEQ ID NO: 662812 - RNA, 17 nt, Homo sapiens
agugagggcucacucag

SEQ ID NO: 662813 - RNA, 13 nt, Homo sapiens
agugaggggaaca

SEQ ID NO: 662814 - RNA, 19 nt, Homo sapiens
agugagucgagauugcacu

SEQ ID NO: 662815 - RNA, 13 nt, Homo sapiens
agugagugaucac

SEQ ID NO: 662816 - RNA, 14 nt, Homo sapiens
agugagugaucacu

SEQ ID NO: 662817 - RNA, 15 nt, Homo sapiens
agugagugaucacug

SEQ ID NO: 662818 - RNA, 16 nt, Homo sapiens
agugaguuacagcgag

SEQ ID NO: 662819 - RNA, 23 nt, Homo sapiens
agugaguuuguugaagugcacau

SEQ ID NO: 662820 - RNA, 21 nt, Homo sapiens
agugauaucccccagccucaa

SEQ ID NO: 662821 - RNA, 15 nt, Homo sapiens
agugauccacccacc

SEQ ID NO: 662822 - RNA, 14 nt, Homo sapiens
agugaucuucccac

SEQ ID NO: 662823 - RNA, 19 nt, Homo sapiens
agugaucuucccacaccag

SEQ ID NO: 662824 - RNA, 19 nt, Homo sapiens
agugaugacuggcuugaga

SEQ ID NO: 662825 - RNA, 15 nt, Homo sapiens
agugauguguggucu

SEQ ID NO: 662826 - RNA, 23 nt, Homo sapiens
agugauguuagcagacccagcuu

SEQ ID NO: 662827 - RNA, 16 nt, Homo sapiens
agugauucuccugccu

SEQ ID NO: 662828 - RNA, 16 nt, Homo sapiens
agugauuucagcacau

SEQ ID NO: 662829 - RNA, 19 nt, Homo sapiens
agugcaaaacugugucaca

SEQ ID NO: 662830 - RNA, 16 nt, Homo sapiens
agugcaaaagugagaa

SEQ ID NO: 662831 - RNA, 15 nt, Homo sapiens
agugcaacaucucug

SEQ ID NO: 662832 - RNA, 18 nt, Homo sapiens
agugcaacaucucugaau

SEQ ID NO: 662833 - RNA, 13 nt, Homo sapiens
agugcaccaaaga

SEQ ID NO: 662834 - RNA, 14 nt, Homo sapiens
agugcaccaaagag

SEQ ID NO: 662835 - RNA, 12 nt, Homo sapiens
agugcacugcuc

SEQ ID NO: 662836 - RNA, 16 nt, Homo sapiens
agugcacuguauauag

SEQ ID NO: 662837 - RNA, 12 nt, Homo sapiens
agugcagacuca

SEQ ID NO: 662838 - RNA, 21 nt, Homo sapiens
agugcagagaaagaaagggaa

SEQ ID NO: 662839 - RNA, 18 nt, Homo sapiens
agugcagcugcugugccu

SEQ ID NO: 662840 - RNA, 21 nt, Homo sapiens
agugcaggcuggcaccgccuu

SEQ ID NO: 662841 - RNA, 12 nt, Homo sapiens
agugcagugaau

SEQ ID NO: 662842 - RNA, 23 nt, Homo sapiens
agugcaguggcgugaucuuggcu

SEQ ID NO: 662843 - RNA, 16 nt, Homo sapiens
agugcauuauguacac

SEQ ID NO: 662844 - RNA, 18 nt, Homo sapiens
agugccaauauuucugau

SEQ ID NO: 662845 - RNA, 14 nt, Homo sapiens
agugccagcaauga

SEQ ID NO: 662846 - RNA, 23 nt, Homo sapiens
agugccauagccaggcucucugc

SEQ ID NO: 662847 - RNA, 13 nt, Homo sapiens
agugccauuccac

SEQ ID NO: 662848 - RNA, 18 nt, Homo sapiens
agugccauuccacuccac

SEQ ID NO: 662849 - RNA, 17 nt, Homo sapiens
agugcccaucagccuug

SEQ ID NO: 662850 - RNA, 13 nt, Homo sapiens
agugcccaugaau

SEQ ID NO: 662851 - RNA, 13 nt, Homo sapiens
agugcccuaggcc

SEQ ID NO: 662852 - RNA, 13 nt, Homo sapiens
agugcccucucug

SEQ ID NO: 662853 - RNA, 16 nt, Homo sapiens
agugcccucucugaac

SEQ ID NO: 662854 - RNA, 17 nt, Homo sapiens
agugccggcugccaaga

SEQ ID NO: 662855 - RNA, 21 nt, Homo sapiens
agugccuaugcaaaccagcuu

SEQ ID NO: 662856 - RNA, 13 nt, Homo sapiens
agugccugcugaa

SEQ ID NO: 662857 - RNA, 21 nt, Homo sapiens
agugccuggaguugacugacu

SEQ ID NO: 662858 - RNA, 13 nt, Homo sapiens
agugccugggaau

SEQ ID NO: 662859 - RNA, 14 nt, Homo sapiens
agugccuucucuau

SEQ ID NO: 662860 - RNA, 20 nt, Homo sapiens
agugccuucugcccucccug

SEQ ID NO: 662861 - RNA, 19 nt, Homo sapiens
agugccuuuugguuucacc

SEQ ID NO: 662862 - RNA, 22 nt, Homo sapiens
aguguuuuagagagagaacuuu

SEQ ID NO: 662863 - RNA, 13 nt, Homo sapiens
aguguuuucacaa

SEQ ID NO: 662864 - RNA, 15 nt, Homo sapiens
aguguuuuuuauuca

SEQ ID NO: 662865 - RNA, 22 nt, Homo sapiens
aguuaaaaauaaaaaacauaua

SEQ ID NO: 662866 - RNA, 21 nt, Homo sapiens
aguuaaaacaaaggaacuaac

SEQ ID NO: 662867 - RNA, 16 nt, Homo sapiens
aguuaaaagacugcag

SEQ ID NO: 662868 - RNA, 18 nt, Homo sapiens
aguuaaaaucacauuuua

SEQ ID NO: 662869 - RNA, 19 nt, Homo sapiens
aguuaaacauugaaguaau

SEQ ID NO: 662870 - RNA, 18 nt, Homo sapiens
aguuaaagccacagaugg

SEQ ID NO: 662871 - RNA, 15 nt, Homo sapiens
aguuaacaucaucac

SEQ ID NO: 662872 - RNA, 23 nt, Homo sapiens
aguuaacccugucugagaugcag

SEQ ID NO: 662873 - RNA, 12 nt, Homo sapiens
aguuaacuauug

SEQ ID NO: 662874 - RNA, 18 nt, Homo sapiens
aguuaacucacugagggu

SEQ ID NO: 662875 - RNA, 15 nt, Homo sapiens
aguuaagaacaucaa

SEQ ID NO: 662876 - RNA, 20 nt, Homo sapiens
aguuaagaaugucgauuaaa

SEQ ID NO: 662877 - RNA, 12 nt, Homo sapiens
aguuaagacaug

SEQ ID NO: 662878 - RNA, 14 nt, Homo sapiens
aguuaagcaaauag

SEQ ID NO: 662879 - RNA, 15 nt, Homo sapiens
aguuaaggagccuaa

SEQ ID NO: 662880 - RNA, 12 nt, Homo sapiens
aguuaaggguua

SEQ ID NO: 662881 - RNA, 16 nt, Homo sapiens
aguuaagucuaucugg

SEQ ID NO: 662882 - RNA, 19 nt, Homo sapiens
aguuaauccacaucuuuac

SEQ ID NO: 662883 - RNA, 16 nt, Homo sapiens
aguuaaugucagugac

SEQ ID NO: 662884 - RNA, 15 nt, Homo sapiens
caugaauuccuuaaa

SEQ ID NO: 662885 - RNA, 18 nt, Homo sapiens
caugaauucuuaugcuua

SEQ ID NO: 662886 - RNA, 14 nt, Homo sapiens
caugacagcugucu

SEQ ID NO: 662887 - RNA, 18 nt, Homo sapiens
caugacauauguagaugu

SEQ ID NO: 662888 - RNA, 20 nt, Homo sapiens
caugacauauguagaugugc

SEQ ID NO: 662889 - RNA, 19 nt, Homo sapiens
caugacauucuuagcugua

SEQ ID NO: 662890 - RNA, 17 nt, Homo sapiens
caugaccacauagcaug

SEQ ID NO: 662891 - RNA, 18 nt, Homo sapiens
caugacccaccccugugc

SEQ ID NO: 662892 - RNA, 21 nt, Homo sapiens
caugacccagccugaaagaua

SEQ ID NO: 662893 - RNA, 19 nt, Homo sapiens
caugacgcacugcucaaga

SEQ ID NO: 662894 - RNA, 13 nt, Homo sapiens
caugacggggaca

SEQ ID NO: 662895 - RNA, 18 nt, Homo sapiens
caugacgguguccaugcc

SEQ ID NO: 662896 - RNA, 23 nt, Homo sapiens
caugacuucuuuacuaacacugg

SEQ ID NO: 662897 - RNA, 20 nt, Homo sapiens
caugagacaauuuugcuuca

SEQ ID NO: 662898 - RNA, 18 nt, Homo sapiens
caugagaccacuguuauc

SEQ ID NO: 662899 - RNA, 19 nt, Homo sapiens
caugagaugauacauccaa

SEQ ID NO: 662900 - RNA, 14 nt, Homo sapiens
caugagcaucccca

SEQ ID NO: 662901 - RNA, 15 nt, Homo sapiens
caugaggccaucuca

SEQ ID NO: 662902 - RNA, 16 nt, Homo sapiens
caugaggccaucucag

SEQ ID NO: 662903 - RNA, 22 nt, Homo sapiens
caugaguagauaauuucagggu

SEQ ID NO: 662904 - RNA, 17 nt, Homo sapiens
caugagucagauacaca

SEQ ID NO: 662905 - RNA, 16 nt, Homo sapiens
caugauaaaugauaga

SEQ ID NO: 662906 - RNA, 15 nt, Homo sapiens
caugauaacugcaau

SEQ ID NO: 662907 - RNA, 16 nt, Homo sapiens
caugauagacuuguua

SEQ ID NO: 662908 - RNA, 14 nt, Homo sapiens
caugauaggauuug

SEQ ID NO: 662909 - RNA, 17 nt, Homo sapiens
caugaucaucacaauca

SEQ ID NO: 662910 - RNA, 18 nt, Homo sapiens
caugaucuauacacauaa

SEQ ID NO: 662911 - RNA, 19 nt, Homo sapiens
caugaugacucaaggccaa

SEQ ID NO: 662912 - RNA, 21 nt, Homo sapiens
caugauggggaaggaguacaa

SEQ ID NO: 662913 - RNA, 12 nt, Homo sapiens
caugauggugaa

SEQ ID NO: 662914 - RNA, 19 nt, Homo sapiens
caugaugugugaguguaau

SEQ ID NO: 662915 - RNA, 21 nt, Homo sapiens
caugauuauagaaggcugucu

SEQ ID NO: 662916 - RNA, 11 nt, Homo sapiens
caugauuuaga

SEQ ID NO: 662917 - RNA, 23 nt, Homo sapiens
caugcaccuuauauuucugugua

SEQ ID NO: 662918 - RNA, 21 nt, Homo sapiens
caugcacuuaaagaaguauuu

SEQ ID NO: 662919 - RNA, 19 nt, Homo sapiens
caugcagccagccaucaaa

SEQ ID NO: 662920 - RNA, 15 nt, Homo sapiens
caugcagcucuucaa

SEQ ID NO: 662921 - RNA, 20 nt, Homo sapiens
caugcauagagugugaugua

SEQ ID NO: 662922 - RNA, 16 nt, Homo sapiens
caugcauguuugguua

SEQ ID NO: 662923 - RNA, 16 nt, Homo sapiens
caugccaaauguucca

SEQ ID NO: 662924 - RNA, 14 nt, Homo sapiens
caugccagaaggaa

SEQ ID NO: 662925 - RNA, 19 nt, Homo sapiens
caugccagacccacugaaa

SEQ ID NO: 662926 - RNA, 19 nt, Homo sapiens
caugccccucccccagcug

SEQ ID NO: 662927 - RNA, 14 nt, Homo sapiens
caugccccuggcug

SEQ ID NO: 662928 - RNA, 16 nt, Homo sapiens
caugcccucaauccca

SEQ ID NO: 662929 - RNA, 20 nt, Homo sapiens
caugcccucccaggacccuc

SEQ ID NO: 662930 - RNA, 15 nt, Homo sapiens
caugcccugccaagc

SEQ ID NO: 662931 - RNA, 13 nt, Homo sapiens
caugcccuguuca

SEQ ID NO: 662932 - RNA, 14 nt, Homo sapiens
caugccuaguccaa

SEQ ID NO: 662933 - RNA, 15 nt, Homo sapiens
caugccuggagacau

SEQ ID NO: 662934 - RNA, 17 nt, Homo sapiens
caugccuuaagccaguu

SEQ ID NO: 662935 - RNA, 13 nt, Homo sapiens
caugcgggugcac

SEQ ID NO: 662936 - RNA, 14 nt, Homo sapiens
caugcgggugcaca

SEQ ID NO: 662937 - RNA, 16 nt, Homo sapiens
caugcguccuggucaa

SEQ ID NO: 662938 - RNA, 15 nt, Homo sapiens
caugcuacaguuauu

SEQ ID NO: 662939 - RNA, 15 nt, Homo sapiens
caugcucaccaagga

SEQ ID NO: 662940 - RNA, 15 nt, Homo sapiens
caugcuccaagacuu

SEQ ID NO: 662941 - RNA, 22 nt, Homo sapiens
caugcuccagauuagagccugu

SEQ ID NO: 662942 - RNA, 22 nt, Homo sapiens
caugcuccuggcccacugcauc

SEQ ID NO: 662943 - RNA, 15 nt, Homo sapiens
caugcucuugaccuu

SEQ ID NO: 662944 - RNA, 17 nt, Homo sapiens
caugcugccuggcacag

SEQ ID NO: 662945 - RNA, 22 nt, Homo sapiens
caugcugcuaauucaaagcucu

SEQ ID NO: 662946 - RNA, 15 nt, Homo sapiens
caugcugcuacaaua

SEQ ID NO: 662947 - RNA, 20 nt, Homo sapiens
caugcugcuuuuuggcacag

SEQ ID NO: 662948 - RNA, 15 nt, Homo sapiens
caugcugugugcugg

SEQ ID NO: 662949 - RNA, 20 nt, Homo sapiens
caugcuuaauaaacauguca

SEQ ID NO: 662950 - RNA, 21 nt, Homo sapiens
caugcuuaauaaacaugucac

SEQ ID NO: 662951 - RNA, 23 nt, Homo sapiens
caugcuuaauaaacaugucacaa

SEQ ID NO: 662952 - RNA, 21 nt, Homo sapiens
caugcuuagucacugccugca

SEQ ID NO: 662953 - RNA, 19 nt, Homo sapiens
caugcuuguggaugacucu

SEQ ID NO: 662954 - RNA, 16 nt, Homo sapiens
cauggaaaacagagua

SEQ ID NO: 662955 - RNA, 19 nt, Homo sapiens
cauggaaaacccccuuccu

SEQ ID NO: 662956 - RNA, 13 nt, Homo sapiens
cauggaaccacua

SEQ ID NO: 662957 - RNA, 16 nt, Homo sapiens
cauggaauaaaccauu

SEQ ID NO: 662958 - RNA, 17 nt, Homo sapiens
cauggaaucgaaguguu

SEQ ID NO: 662959 - RNA, 20 nt, Homo sapiens
cauggaauuucuaguaugag

SEQ ID NO: 662960 - RNA, 15 nt, Homo sapiens
cauggacauguguac

SEQ ID NO: 662961 - RNA, 13 nt, Homo sapiens
cauggacauuuag

SEQ ID NO: 662962 - RNA, 15 nt, Homo sapiens
cauggagaaacccug

SEQ ID NO: 662963 - RNA, 10 nt, Homo sapiens
cauggaugau

SEQ ID NO: 662964 - RNA, 12 nt, Homo sapiens
cauggaugccaa

SEQ ID NO: 662965 - RNA, 20 nt, Homo sapiens
cauggcaaaucaggggccag

SEQ ID NO: 662966 - RNA, 15 nt, Homo sapiens
cauggcagccaucaa

SEQ ID NO: 662967 - RNA, 18 nt, Homo sapiens
cauggcagcuguuucuca

SEQ ID NO: 662968 - RNA, 22 nt, Homo sapiens
cauggcagcuguuucucaugaa

SEQ ID NO: 662969 - RNA, 12 nt, Homo sapiens
cauggcaucaga

SEQ ID NO: 662970 - RNA, 14 nt, Homo sapiens
cauggcucacaaac

SEQ ID NO: 662971 - RNA, 20 nt, Homo sapiens
cauggcuccagaaaugucua

SEQ ID NO: 662972 - RNA, 15 nt, Homo sapiens
caugggaaaacagac

SEQ ID NO: 662973 - RNA, 20 nt, Homo sapiens
caugggaaccucauaugcaa

SEQ ID NO: 662974 - RNA, 21 nt, Homo sapiens
caugggaaggguccaucucag

SEQ ID NO: 662975 - RNA, 12 nt, Homo sapiens
caugggagaccc

SEQ ID NO: 662976 - RNA, 19 nt, Homo sapiens
caugggccaccgcccagcu

SEQ ID NO: 662977 - RNA, 21 nt, Homo sapiens
caugggcgcaggcccagugac

SEQ ID NO: 662978 - RNA, 19 nt, Homo sapiens
caugggcuaaugaagauca

SEQ ID NO: 662979 - RNA, 16 nt, Homo sapiens
cauggggcaagccagg

SEQ ID NO: 662980 - RNA, 20 nt, Homo sapiens
caugggggacccugugcauc

SEQ ID NO: 662981 - RNA, 16 nt, Homo sapiens
cauggguccacugcac

SEQ ID NO: 662982 - RNA, 14 nt, Homo sapiens
cauggguccagggc

SEQ ID NO: 662983 - RNA, 20 nt, Homo sapiens
cauggucuaauuauuuacuc

SEQ ID NO: 662984 - RNA, 15 nt, Homo sapiens
auaaggaaacuuuau

SEQ ID NO: 662985 - RNA, 15 nt, Homo sapiens
auaaggaaagcaaua

SEQ ID NO: 662986 - RNA, 16 nt, Homo sapiens
auaaggaaagcaauaa

SEQ ID NO: 662987 - RNA, 13 nt, Homo sapiens
auaaggcccagag

SEQ ID NO: 662988 - RNA, 16 nt, Homo sapiens
auaaggugcucugaag

SEQ ID NO: 662989 - RNA, 15 nt, Homo sapiens
auaagucaagcacau

SEQ ID NO: 662990 - RNA, 13 nt, Homo sapiens
auaagugaagguu

SEQ ID NO: 662991 - RNA, 22 nt, Homo sapiens
auaagugaagugauacuaucca

SEQ ID NO: 662992 - RNA, 20 nt, Homo sapiens
auaagugcucaauagcuuga

SEQ ID NO: 662993 - RNA, 16 nt, Homo sapiens
auaagugcuuuccuua

SEQ ID NO: 662994 - RNA, 14 nt, Homo sapiens
auaaguuuacugaa

SEQ ID NO: 662995 - RNA, 17 nt, Homo sapiens
auaauaaaaaauauucu

SEQ ID NO: 662996 - RNA, 14 nt, Homo sapiens
auaauaaaaggaaa

SEQ ID NO: 662997 - RNA, 15 nt, Homo sapiens
auaauaaaaugcaaa

SEQ ID NO: 662998 - RNA, 17 nt, Homo sapiens
auaauaaagaugcucuu

SEQ ID NO: 662999 - RNA, 18 nt, Homo sapiens
auaauaaaugcccucuuc

SEQ ID NO: 663000 - RNA, 14 nt, Homo sapiens
auaauaaauuugau

SEQ ID NO: 663001 - RNA, 13 nt, Homo sapiens
auaauaacucaua

SEQ ID NO: 663002 - RNA, 12 nt, Homo sapiens
auaauaauagca

SEQ ID NO: 663003 - RNA, 16 nt, Homo sapiens
auaauacaguaucuca

SEQ ID NO: 663004 - RNA, 13 nt, Homo sapiens
auaauacucuguu

SEQ ID NO: 663005 - RNA, 13 nt, Homo sapiens
auaauacuugcaa

SEQ ID NO: 663006 - RNA, 17 nt, Homo sapiens
auaauaguccaccuccc

SEQ ID NO: 663007 - RNA, 14 nt, Homo sapiens
auaauauaagccau

SEQ ID NO: 663008 - RNA, 24 nt, Homo sapiens
auaauauccagccucccacaagaa

SEQ ID NO: 663009 - RNA, 18 nt, Homo sapiens
auaauaucccacugggag

SEQ ID NO: 663010 - RNA, 17 nt, Homo sapiens
auaauaugaagccuuug

SEQ ID NO: 663011 - RNA, 14 nt, Homo sapiens
auaauaugaugcca

SEQ ID NO: 663012 - RNA, 20 nt, Homo sapiens
auaauaugcacacagugcuu

SEQ ID NO: 663013 - RNA, 22 nt, Homo sapiens
auaauaugucaccuggcacauu

SEQ ID NO: 663014 - RNA, 17 nt, Homo sapiens
auaaucaaaagcuauuu

SEQ ID NO: 663015 - RNA, 15 nt, Homo sapiens
auaaucacauuauca

SEQ ID NO: 663016 - RNA, 13 nt, Homo sapiens
auaaucacuacua

SEQ ID NO: 663017 - RNA, 15 nt, Homo sapiens
auaaucaucaaguaa

SEQ ID NO: 663018 - RNA, 16 nt, Homo sapiens
auaaucccagcacuuu

SEQ ID NO: 663019 - RNA, 13 nt, Homo sapiens
auaaucgcucuuu

SEQ ID NO: 663020 - RNA, 14 nt, Homo sapiens
auaaucuaauuaca

SEQ ID NO: 663021 - RNA, 17 nt, Homo sapiens
auaaucuacuguacaca

SEQ ID NO: 663022 - RNA, 17 nt, Homo sapiens
ccacuauccucacuccc

SEQ ID NO: 663023 - RNA, 17 nt, Homo sapiens
ccacuauuuaaguuauc

SEQ ID NO: 663024 - RNA, 16 nt, Homo sapiens
ccacucagcucaccuc

SEQ ID NO: 663025 - RNA, 15 nt, Homo sapiens
ccacucaggugcaca

SEQ ID NO: 663026 - RNA, 16 nt, Homo sapiens
ccacucauugucuuug

SEQ ID NO: 663027 - RNA, 23 nt, Homo sapiens
ccacuccaaaaaucagugcauuu

SEQ ID NO: 663028 - RNA, 12 nt, Homo sapiens
ccacuccacuca

SEQ ID NO: 663029 - RNA, 12 nt, Homo sapiens
ccacuccagaga

SEQ ID NO: 663030 - RNA, 16 nt, Homo sapiens
ccacucccuuugccag

SEQ ID NO: 663031 - RNA, 22 nt, Homo sapiens
ccacucgagugcccaaggagcc

SEQ ID NO: 663032 - RNA, 18 nt, Homo sapiens
ccacucucugggacucuc

SEQ ID NO: 663033 - RNA, 10 nt, Homo sapiens
ccacucugga

SEQ ID NO: 663034 - RNA, 16 nt, Homo sapiens
ccacugagaagucaaa

SEQ ID NO: 663035 - RNA, 14 nt, Homo sapiens
ccacugagcuccau

SEQ ID NO: 663036 - RNA, 20 nt, Homo sapiens
ccacugaucucuacuaccac

SEQ ID NO: 663037 - RNA, 19 nt, Homo sapiens
ccacugcccccugcugcca

SEQ ID NO: 663038 - RNA, 14 nt, Homo sapiens
ccacugcucgugga

SEQ ID NO: 663039 - RNA, 16 nt, Homo sapiens
ccacuggacucaccuc

SEQ ID NO: 663040 - RNA, 20 nt, Homo sapiens
ccacuggcuuuugccuguaa

SEQ ID NO: 663041 - RNA, 19 nt, Homo sapiens
ccacugggaccaacccugg

SEQ ID NO: 663042 - RNA, 18 nt, Homo sapiens
ccacuggggaaugcuccc

SEQ ID NO: 663043 - RNA, 13 nt, Homo sapiens
ccacuggucugua

SEQ ID NO: 663044 - RNA, 14 nt, Homo sapiens
ccacuguaugauuc

SEQ ID NO: 663045 - RNA, 16 nt, Homo sapiens
ccacuguaugauucuc

SEQ ID NO: 663046 - RNA, 13 nt, Homo sapiens
ccacugucuuuca

SEQ ID NO: 663047 - RNA, 14 nt, Homo sapiens
ccacugucuuucaa

SEQ ID NO: 663048 - RNA, 19 nt, Homo sapiens
ccacugugaagagaaccau

SEQ ID NO: 663049 - RNA, 20 nt, Homo sapiens
ccacugugguggcaguggag

SEQ ID NO: 663050 - RNA, 23 nt, Homo sapiens
ccacuguugguauuauauaauuc

SEQ ID NO: 663051 - RNA, 22 nt, Homo sapiens
ccacuuacagaucuaucuccuc

SEQ ID NO: 663052 - RNA, 19 nt, Homo sapiens
ccacuuaugcugcugugaa

SEQ ID NO: 663053 - RNA, 13 nt, Homo sapiens
ccacuucaccccc

SEQ ID NO: 663054 - RNA, 11 nt, Homo sapiens
ccacuucucac

SEQ ID NO: 663055 - RNA, 18 nt, Homo sapiens
ccacuucucacucaccac

SEQ ID NO: 663056 - RNA, 17 nt, Homo sapiens
ccacuucuccaugcugc

SEQ ID NO: 663057 - RNA, 19 nt, Homo sapiens
ccacuucuggcaugggaca

SEQ ID NO: 663058 - RNA, 21 nt, Homo sapiens
ccacuugacauuccuugucac

SEQ ID NO: 663059 - RNA, 20 nt, Homo sapiens
ccacuugccugugcuacaau

SEQ ID NO: 663060 - RNA, 22 nt, Homo sapiens
ccacuugccugugcuacaauuc

SEQ ID NO: 663061 - RNA, 21 nt, Homo sapiens
ccacuuuggcugaacuacaag

SEQ ID NO: 663062 - RNA, 20 nt, Homo sapiens
ccacuuuucugcuguugccu

SEQ ID NO: 663063 - RNA, 19 nt, Homo sapiens
ccagaaaaaaaaaaacuua

SEQ ID NO: 663064 - RNA, 22 nt, Homo sapiens
ccagaaaauguaaggcaaugcu

SEQ ID NO: 663065 - RNA, 15 nt, Homo sapiens
ccagaaacagggaca

SEQ ID NO: 663066 - RNA, 22 nt, Homo sapiens
ccagaaacugaaccaacagaag

SEQ ID NO: 663067 - RNA, 13 nt, Homo sapiens
ccagaaacuguuc

SEQ ID NO: 663068 - RNA, 19 nt, Homo sapiens
ccagaaagcuaggucgugg

SEQ ID NO: 663069 - RNA, 17 nt, Homo sapiens
ccagaaagcugccagag

SEQ ID NO: 663070 - RNA, 14 nt, Homo sapiens
ccagaaaggugauu

SEQ ID NO: 663071 - RNA, 17 nt, Homo sapiens
ccagaaaucacugugaa

SEQ ID NO: 663072 - RNA, 13 nt, Homo sapiens
ccagaaaugucua

SEQ ID NO: 663073 - RNA, 12 nt, Homo sapiens
ccagaaccacag

SEQ ID NO: 663074 - RNA, 12 nt, Homo sapiens
ccagaacccaga

SEQ ID NO: 663075 - RNA, 15 nt, Homo sapiens
ccagaacugccccca

SEQ ID NO: 663076 - RNA, 17 nt, Homo sapiens
ccagaacuuucuuucac

SEQ ID NO: 663077 - RNA, 21 nt, Homo sapiens
ccagaagaauauucaggacuu

SEQ ID NO: 663078 - RNA, 14 nt, Homo sapiens
ccagaagagguaua

SEQ ID NO: 663079 - RNA, 15 nt, Homo sapiens
ccagaagcugggaaa

SEQ ID NO: 663080 - RNA, 23 nt, Homo sapiens
ccagaagcuuccauaguggugca

SEQ ID NO: 663081 - RNA, 23 nt, Homo sapiens
ccagaaggagggcagagccaugg

SEQ ID NO: 663082 - RNA, 22 nt, Homo sapiens
ccagaaggcagggaaaggcucu

SEQ ID NO: 663083 - RNA, 12 nt, Homo sapiens
ccagaaggggag

SEQ ID NO: 663084 - RNA, 17 nt, Homo sapiens
ccagaagggggccauga

SEQ ID NO: 663085 - RNA, 14 nt, Homo sapiens
ccagaauacugggu

SEQ ID NO: 663086 - RNA, 16 nt, Homo sapiens
ccagaaucuugacuuu

SEQ ID NO: 663087 - RNA, 19 nt, Homo sapiens
ccagaauguugcuuucuga

SEQ ID NO: 663088 - RNA, 19 nt, Homo sapiens
ccagaauuguuuugcauuu

SEQ ID NO: 663089 - RNA, 13 nt, Homo sapiens
ccagacaaaugga

SEQ ID NO: 663090 - RNA, 14 nt, Homo sapiens
ccagacaaccaaaa

SEQ ID NO: 663091 - RNA, 20 nt, Homo sapiens
ccagacaacuuguccugacu

SEQ ID NO: 663092 - RNA, 22 nt, Homo sapiens
ccagacacuggcguuacugcuu

SEQ ID NO: 663093 - RNA, 19 nt, Homo sapiens
ccagacauuuguuucugua

SEQ ID NO: 663094 - RNA, 20 nt, Homo sapiens
ccagaccauucaggacacag

SEQ ID NO: 663095 - RNA, 15 nt, Homo sapiens
ccagacccacugaaa

SEQ ID NO: 663096 - RNA, 17 nt, Homo sapiens
ccagaccccguggcucu

SEQ ID NO: 663097 - RNA, 22 nt, Homo sapiens
ccagaccuagcaggcuguucca

SEQ ID NO: 663098 - RNA, 11 nt, Homo sapiens
ccagaccucaa

SEQ ID NO: 663099 - RNA, 14 nt, Homo sapiens
ccagaccucugaca

SEQ ID NO: 663100 - RNA, 22 nt, Homo sapiens
ccagaccuuaagacacugugag

SEQ ID NO: 663101 - RNA, 15 nt, Homo sapiens
ccagacucagagggc

SEQ ID NO: 663102 - RNA, 22 nt, Homo sapiens
ccagacucagguuccagaacag

SEQ ID NO: 663103 - RNA, 17 nt, Homo sapiens
ccagacucugagcugcu

SEQ ID NO: 663104 - RNA, 14 nt, Homo sapiens
ccagacucuugccu

SEQ ID NO: 663105 - RNA, 10 nt, Homo sapiens
ccagacuguu

SEQ ID NO: 663106 - RNA, 14 nt, Homo sapiens
ccagagaauucuua

SEQ ID NO: 663107 - RNA, 20 nt, Homo sapiens
auacauagacugauugauua

SEQ ID NO: 663108 - RNA, 18 nt, Homo sapiens
auacauauauauauacac

SEQ ID NO: 663109 - RNA, 23 nt, Homo sapiens
auacauauaugaguugccuauau

SEQ ID NO: 663110 - RNA, 17 nt, Homo sapiens
auacauaucuuuauuaa

SEQ ID NO: 663111 - RNA, 17 nt, Homo sapiens
auacauaugaggacaag

SEQ ID NO: 663112 - RNA, 19 nt, Homo sapiens
auacaucacagcagugcau

SEQ ID NO: 663113 - RNA, 23 nt, Homo sapiens
auacaugcaacagaagugacuuc

SEQ ID NO: 663114 - RNA, 23 nt, Homo sapiens
auacauucccucuaauuugaacu

SEQ ID NO: 663115 - RNA, 20 nt, Homo sapiens
auacauucuuuaucuugaca

SEQ ID NO: 663116 - RNA, 17 nt, Homo sapiens
auacauuugaggggaaa

SEQ ID NO: 663117 - RNA, 16 nt, Homo sapiens
auacauuuuugucaga

SEQ ID NO: 663118 - RNA, 14 nt, Homo sapiens
auaccaacuguaca

SEQ ID NO: 663119 - RNA, 15 nt, Homo sapiens
auaccagcucagggg

SEQ ID NO: 663120 - RNA, 17 nt, Homo sapiens
auaccaguacucaguau

SEQ ID NO: 663121 - RNA, 18 nt, Homo sapiens
auaccagugaaccaaaga

SEQ ID NO: 663122 - RNA, 18 nt, Homo sapiens
auaccaucucacaccagu

SEQ ID NO: 663123 - RNA, 19 nt, Homo sapiens
auaccauuuuuuaaggaaa

SEQ ID NO: 663124 - RNA, 16 nt, Homo sapiens
auacccacacauucca

SEQ ID NO: 663125 - RNA, 14 nt, Homo sapiens
auacccaguggaau

SEQ ID NO: 663126 - RNA, 17 nt, Homo sapiens
auaccgaccaucgucca

SEQ ID NO: 663127 - RNA, 17 nt, Homo sapiens
auaccgcucaguauuuu

SEQ ID NO: 663128 - RNA, 21 nt, Homo sapiens
auaccuaugucaacaguauaa

SEQ ID NO: 663129 - RNA, 17 nt, Homo sapiens
auaccuccaacccugcc

SEQ ID NO: 663130 - RNA, 13 nt, Homo sapiens
auaccuggcuuuu

SEQ ID NO: 663131 - RNA, 15 nt, Homo sapiens
auaccuggcuuuuac

SEQ ID NO: 663132 - RNA, 15 nt, Homo sapiens
auaccuuaugcuaca

SEQ ID NO: 663133 - RNA, 23 nt, Homo sapiens
auaccuuauuuauuuuuguguag

SEQ ID NO: 663134 - RNA, 22 nt, Homo sapiens
auaccuuguuuuuaaucuccug

SEQ ID NO: 663135 - RNA, 16 nt, Homo sapiens
auaccuuuuuguguca

SEQ ID NO: 663136 - RNA, 20 nt, Homo sapiens
auacguuugaaauaguugau

SEQ ID NO: 663137 - RNA, 18 nt, Homo sapiens
auacuaaaccagcauacc

SEQ ID NO: 663138 - RNA, 21 nt, Homo sapiens
auacuaaaccagcauacccuu

SEQ ID NO: 663139 - RNA, 15 nt, Homo sapiens
auacuaaauauguga

SEQ ID NO: 663140 - RNA, 20 nt, Homo sapiens
auacuaauuuuugcuuaaca

SEQ ID NO: 663141 - RNA, 21 nt, Homo sapiens
auacuacuccuguaauuccua

SEQ ID NO: 663142 - RNA, 17 nt, Homo sapiens
auacuagcaacaaacaa

SEQ ID NO: 663143 - RNA, 16 nt, Homo sapiens
auacuagcauacuuaa

SEQ ID NO: 663144 - RNA, 20 nt, Homo sapiens
auacuauauuuauacuguau

SEQ ID NO: 663145 - RNA, 17 nt, Homo sapiens
auacucaaaacaguaau

SEQ ID NO: 663146 - RNA, 19 nt, Homo sapiens
ccagaugaucccagucacu

SEQ ID NO: 663147 - RNA, 22 nt, Homo sapiens
ccagaugaucccagucacuccu

SEQ ID NO: 663148 - RNA, 17 nt, Homo sapiens
ccagaugccaaccagac

SEQ ID NO: 663149 - RNA, 13 nt, Homo sapiens
ccagaugccaggg

SEQ ID NO: 663150 - RNA, 22 nt, Homo sapiens
ccagaugcccuuuggaaagcca

SEQ ID NO: 663151 - RNA, 19 nt, Homo sapiens
ccagauggaacacuggaac

SEQ ID NO: 663152 - RNA, 20 nt, Homo sapiens
ccagauucugccucucugga

SEQ ID NO: 663153 - RNA, 18 nt, Homo sapiens
ccagauugacgacaagug

SEQ ID NO: 663154 - RNA, 22 nt, Homo sapiens
ccagauuggauauggacucuuu

SEQ ID NO: 663155 - RNA, 16 nt, Homo sapiens
ccagcaacacaagcug

SEQ ID NO: 663156 - RNA, 20 nt, Homo sapiens
ccagcaaugauguccagaag

SEQ ID NO: 663157 - RNA, 17 nt, Homo sapiens
ccagcacacagggcagu

SEQ ID NO: 663158 - RNA, 21 nt, Homo sapiens
ccagcacagcuuagauuucau

SEQ ID NO: 663159 - RNA, 12 nt, Homo sapiens
ccagcacagggg

SEQ ID NO: 663160 - RNA, 15 nt, Homo sapiens
ccagcaccaccuaca

SEQ ID NO: 663161 - RNA, 12 nt, Homo sapiens
ccagcaccucau

SEQ ID NO: 663162 - RNA, 17 nt, Homo sapiens
ccagcaccuguggcuga

SEQ ID NO: 663163 - RNA, 17 nt, Homo sapiens
ccagcacucacaccacu

SEQ ID NO: 663164 - RNA, 12 nt, Homo sapiens
ccagcacuggaa

SEQ ID NO: 663165 - RNA, 20 nt, Homo sapiens
ccagcacuuugggaguccaa

SEQ ID NO: 663166 - RNA, 21 nt, Homo sapiens
ccagcagaggugauucuuaca

SEQ ID NO: 663167 - RNA, 20 nt, Homo sapiens
ccagcaggagcucugacuaa

SEQ ID NO: 663168 - RNA, 20 nt, Homo sapiens
ccagcaggcaacucaaagag

SEQ ID NO: 663169 - RNA, 14 nt, Homo sapiens
ccagcagugccuug

SEQ ID NO: 663170 - RNA, 22 nt, Homo sapiens
ccagcauacccuuacucugcca

SEQ ID NO: 663171 - RNA, 15 nt, Homo sapiens
ccagcauauacugaa

SEQ ID NO: 663172 - RNA, 21 nt, Homo sapiens
ccagcauauacugaagucuuu

SEQ ID NO: 663173 - RNA, 16 nt, Homo sapiens
ccagcaucagccugua

SEQ ID NO: 663174 - RNA, 16 nt, Homo sapiens
ccagcaucuggaagau

SEQ ID NO: 663175 - RNA, 22 nt, Homo sapiens
ccagcauugaagagaacugcaa

SEQ ID NO: 663176 - RNA, 21 nt, Homo sapiens
ccagcauugcaguauggugug

SEQ ID NO: 663177 - RNA, 20 nt, Homo sapiens
ccagccaccacccucaggug

SEQ ID NO: 663178 - RNA, 21 nt, Homo sapiens
ccagccaccacccucaggugc

SEQ ID NO: 663179 - RNA, 19 nt, Homo sapiens
ccagccagauggacuccag

SEQ ID NO: 663180 - RNA, 14 nt, Homo sapiens
ccagccagugccau

SEQ ID NO: 663181 - RNA, 15 nt, Homo sapiens
ccagccagugccauu

SEQ ID NO: 663182 - RNA, 18 nt, Homo sapiens
ccagccagugccauucca

SEQ ID NO: 663183 - RNA, 22 nt, Homo sapiens
ccagccaucccauuggcaaaag

SEQ ID NO: 663184 - RNA, 14 nt, Homo sapiens
ccagccaugcaaug

SEQ ID NO: 663185 - RNA, 17 nt, Homo sapiens
ccagccaugucugcauu

SEQ ID NO: 663186 - RNA, 16 nt, Homo sapiens
ccagcccaaugccaag

SEQ ID NO: 663187 - RNA, 17 nt, Homo sapiens
ccagcccauaaccagua

SEQ ID NO: 663188 - RNA, 21 nt, Homo sapiens
ccagcccauggcccccaauaa

SEQ ID NO: 663189 - RNA, 12 nt, Homo sapiens
ccagcccauugc

SEQ ID NO: 663190 - RNA, 16 nt, Homo sapiens
ccagccccaagcuggg

SEQ ID NO: 663191 - RNA, 15 nt, Homo sapiens
ccagccccacuccuc

SEQ ID NO: 663192 - RNA, 18 nt, Homo sapiens
ccagccccggcaagccac

SEQ ID NO: 663193 - RNA, 22 nt, Homo sapiens
ccagccccucuccccucucugc

SEQ ID NO: 663194 - RNA, 14 nt, Homo sapiens
ccagcccgucuucu

SEQ ID NO: 663195 - RNA, 22 nt, Homo sapiens
ccagcccgucuucucucucugc

SEQ ID NO: 663196 - RNA, 22 nt, Homo sapiens
ccagcccuccccaucucggggc

SEQ ID NO: 663197 - RNA, 16 nt, Homo sapiens
ccagcccugggaacca

SEQ ID NO: 663198 - RNA, 19 nt, Homo sapiens
ccagcccuuagcacagaga

SEQ ID NO: 663199 - RNA, 19 nt, Homo sapiens
ccagcccuugagucuguca

SEQ ID NO: 663200 - RNA, 16 nt, Homo sapiens
ccagccguauuuuaca

SEQ ID NO: 663201 - RNA, 17 nt, Homo sapiens
ccagccguauuuuacau

SEQ ID NO: 663202 - RNA, 20 nt, Homo sapiens
ccagccgugaugcucaggcu

SEQ ID NO: 663203 - RNA, 19 nt, Homo sapiens
ccagccuaaaaaccaccau

SEQ ID NO: 663204 - RNA, 21 nt, Homo sapiens
ccagccuaugagcauccugag

SEQ ID NO: 663205 - RNA, 14 nt, Homo sapiens
ccagccucaucucu

SEQ ID NO: 663206 - RNA, 16 nt, Homo sapiens
ccagccuccaugcugc

SEQ ID NO: 663207 - RNA, 21 nt, Homo sapiens
ccagccuggccaacaugguga

SEQ ID NO: 663208 - RNA, 22 nt, Homo sapiens
ccagccuggccaagagaccagc

SEQ ID NO: 663209 - RNA, 22 nt, Homo sapiens
ccagccugggacucccagugaa

SEQ ID NO: 663210 - RNA, 20 nt, Homo sapiens
ccagccugggcagccaggcu

SEQ ID NO: 663211 - RNA, 21 nt, Homo sapiens
ccagccuuccucugcagcuga

SEQ ID NO: 663212 - RNA, 14 nt, Homo sapiens
ccagcgagccacag

SEQ ID NO: 663213 - RNA, 15 nt, Homo sapiens
ccagcgaggugggag

SEQ ID NO: 663214 - RNA, 19 nt, Homo sapiens
ccagcgcccgcugggcuga

SEQ ID NO: 663215 - RNA, 17 nt, Homo sapiens
ccagcggcccugucauc

SEQ ID NO: 663216 - RNA, 17 nt, Homo sapiens
ccagcggucccugcaga

SEQ ID NO: 663217 - RNA, 15 nt, Homo sapiens
ccagcguguggagca

SEQ ID NO: 663218 - RNA, 17 nt, Homo sapiens
ccagcuaaggacauuuc

SEQ ID NO: 663219 - RNA, 14 nt, Homo sapiens
ccagcuaucuguca

SEQ ID NO: 663220 - RNA, 15 nt, Homo sapiens
ccagcuauuuacaca

SEQ ID NO: 663221 - RNA, 18 nt, Homo sapiens
ccagcucauacaaaauaa

SEQ ID NO: 663222 - RNA, 16 nt, Homo sapiens
ccagcuccccaagaaa

SEQ ID NO: 663223 - RNA, 17 nt, Homo sapiens
ccagcucccuagacugc

SEQ ID NO: 663224 - RNA, 20 nt, Homo sapiens
ccagcuccuuucaugcucca

SEQ ID NO: 663225 - RNA, 18 nt, Homo sapiens
ccagcugaauaguuacug

SEQ ID NO: 663226 - RNA, 23 nt, Homo sapiens
ccagcugcugugccccaccacgu

SEQ ID NO: 663227 - RNA, 22 nt, Homo sapiens
ccagcugugcacuuucuucucu

SEQ ID NO: 663228 - RNA, 19 nt, Homo sapiens
ccagugaugaaaacauuca

SEQ ID NO: 663229 - RNA, 16 nt, Homo sapiens
ccagugcaaaccacuu

SEQ ID NO: 663230 - RNA, 17 nt, Homo sapiens
ccagugcagacucaaga

SEQ ID NO: 663231 - RNA, 15 nt, Homo sapiens
ccagugccauuccac

SEQ ID NO: 663232 - RNA, 12 nt, Homo sapiens
ccagugccucuc

SEQ ID NO: 663233 - RNA, 23 nt, Homo sapiens
ccagugcuccaggcacccagcuu

SEQ ID NO: 663234 - RNA, 22 nt, Homo sapiens
ccagugcugcucuaagcaccgu

SEQ ID NO: 663235 - RNA, 21 nt, Homo sapiens
ccagugcuuugcacacaagcu

SEQ ID NO: 663236 - RNA, 17 nt, Homo sapiens
ccaguggauucccacag

SEQ ID NO: 663237 - RNA, 20 nt, Homo sapiens
ccaguggauucccacagcac

SEQ ID NO: 663238 - RNA, 9 nt, Homo sapiens
ccaguggga

SEQ ID NO: 663239 - RNA, 21 nt, Homo sapiens
ccagugggccugguagcacau

SEQ ID NO: 663240 - RNA, 16 nt, Homo sapiens
ccagugggcuguguug

SEQ ID NO: 663241 - RNA, 20 nt, Homo sapiens
ccaguguauaaauccaauau

SEQ ID NO: 663242 - RNA, 14 nt, Homo sapiens
ccaguguaucucaa

SEQ ID NO: 663243 - RNA, 14 nt, Homo sapiens
ccagugugcaaggg

SEQ ID NO: 663244 - RNA, 13 nt, Homo sapiens
ccaguguuuacaa

SEQ ID NO: 663245 - RNA, 15 nt, Homo sapiens
ccaguuaacaucauc

SEQ ID NO: 663246 - RNA, 23 nt, Homo sapiens
ccaguuacgacugaagucagugu

SEQ ID NO: 663247 - RNA, 13 nt, Homo sapiens
ccaguuacuugcu

SEQ ID NO: 663248 - RNA, 19 nt, Homo sapiens
ccaguuauaaagaggucac

SEQ ID NO: 663249 - RNA, 22 nt, Homo sapiens
ccaguuauuuaaccuguaaaau

SEQ ID NO: 663250 - RNA, 20 nt, Homo sapiens
ccaguucauugcacuuugau

SEQ ID NO: 663251 - RNA, 22 nt, Homo sapiens
ccaguuccucuuuugugcugcu

SEQ ID NO: 663252 - RNA, 16 nt, Homo sapiens
ccaguugaucugcucu

SEQ ID NO: 663253 - RNA, 14 nt, Homo sapiens
ccaguugccuuuua

SEQ ID NO: 663254 - RNA, 20 nt, Homo sapiens
ccaguuugcaccugucccca

SEQ ID NO: 663255 - RNA, 19 nt, Homo sapiens
ccaguuuuuguuuuugcau

SEQ ID NO: 663256 - RNA, 14 nt, Homo sapiens
ccauaaagccuuua

SEQ ID NO: 663257 - RNA, 14 nt, Homo sapiens
ccauaaaguacaaa

SEQ ID NO: 663258 - RNA, 14 nt, Homo sapiens
ccauaacacuugau

SEQ ID NO: 663259 - RNA, 13 nt, Homo sapiens
ccauaacagccaa

SEQ ID NO: 663260 - RNA, 16 nt, Homo sapiens
ccauaagaaagcacua

SEQ ID NO: 663261 - RNA, 23 nt, Homo sapiens
ccauaagaggugaucucugggag

SEQ ID NO: 663262 - RNA, 22 nt, Homo sapiens
ccauaauuauuauuuccagugu

SEQ ID NO: 663263 - RNA, 19 nt, Homo sapiens
ccauaauuuauuuugucca

SEQ ID NO: 663264 - RNA, 14 nt, Homo sapiens
ccauacgagcaccu

SEQ ID NO: 663265 - RNA, 13 nt, Homo sapiens
ccauacucaaaau

SEQ ID NO: 663266 - RNA, 23 nt, Homo sapiens
ccauacuccucuccuucaaagaa

SEQ ID NO: 663267 - RNA, 19 nt, Homo sapiens
ccauacuuugucugaaaaa

SEQ ID NO: 663268 - RNA, 16 nt, Homo sapiens
ccauagagacuuugug

SEQ ID NO: 663269 - RNA, 13 nt, Homo sapiens
auaguggaccacu

SEQ ID NO: 663270 - RNA, 17 nt, Homo sapiens
auaguguaagaacugua

SEQ ID NO: 663271 - RNA, 17 nt, Homo sapiens
auaguguagcugaggag

SEQ ID NO: 663272 - RNA, 20 nt, Homo sapiens
auaguguucacaaacuguga

SEQ ID NO: 663273 - RNA, 15 nt, Homo sapiens
auaguuacuguguaa

SEQ ID NO: 663274 - RNA, 15 nt, Homo sapiens
auaguugauucuugc

SEQ ID NO: 663275 - RNA, 16 nt, Homo sapiens
auaguugcuucuuucc

SEQ ID NO: 663276 - RNA, 21 nt, Homo sapiens
auaguuguuuuauauguugcu

SEQ ID NO: 663277 - RNA, 22 nt, Homo sapiens
auaguuuaggagaaaccagcuu

SEQ ID NO: 663278 - RNA, 15 nt, Homo sapiens
auauaaaaaaucaug

SEQ ID NO: 663279 - RNA, 14 nt, Homo sapiens
auauaaaaggcaaa

SEQ ID NO: 663280 - RNA, 20 nt, Homo sapiens
auauaaacacuccacagugu

SEQ ID NO: 663281 - RNA, 12 nt, Homo sapiens
auauaaaccugg

SEQ ID NO: 663282 - RNA, 17 nt, Homo sapiens
auauaaagacugccugc

SEQ ID NO: 663283 - RNA, 18 nt, Homo sapiens
auauaaaguacaucucua

SEQ ID NO: 663284 - RNA, 15 nt, Homo sapiens
auauaaaguguaaua

SEQ ID NO: 663285 - RNA, 13 nt, Homo sapiens
auauaacaaauaa

SEQ ID NO: 663286 - RNA, 19 nt, Homo sapiens
auauaacauucuauugacu

SEQ ID NO: 663287 - RNA, 16 nt, Homo sapiens
auauaacuuccuggcu

SEQ ID NO: 663288 - RNA, 16 nt, Homo sapiens
auauaaggaaagcaau

SEQ ID NO: 663289 - RNA, 15 nt, Homo sapiens
auauaaggcauucca

SEQ ID NO: 663290 - RNA, 15 nt, Homo sapiens
auauaauaacuuuau

SEQ ID NO: 663291 - RNA, 15 nt, Homo sapiens
auauaauacugacug

SEQ ID NO: 663292 - RNA, 20 nt, Homo sapiens
auauaauaugcacacagugc

SEQ ID NO: 663293 - RNA, 13 nt, Homo sapiens
auauaauauguau

SEQ ID NO: 663294 - RNA, 13 nt, Homo sapiens
auauaauauguca

SEQ ID NO: 663295 - RNA, 14 nt, Homo sapiens
auauaauccuguga

SEQ ID NO: 663296 - RNA, 21 nt, Homo sapiens
auauaaugcuugcaccucagg

SEQ ID NO: 663297 - RNA, 17 nt, Homo sapiens
auauaauggugauguca

SEQ ID NO: 663298 - RNA, 20 nt, Homo sapiens
auauaauuauccaaauugau

SEQ ID NO: 663299 - RNA, 17 nt, Homo sapiens
auauacaaaacuuuauc

SEQ ID NO: 663300 - RNA, 15 nt, Homo sapiens
auauacaauaacaua

SEQ ID NO: 663301 - RNA, 19 nt, Homo sapiens
auauacagcaggugcucaa

SEQ ID NO: 663302 - RNA, 16 nt, Homo sapiens
auauacaguaacuuua

SEQ ID NO: 663303 - RNA, 17 nt, Homo sapiens
auauacauaauacauga

SEQ ID NO: 663304 - RNA, 20 nt, Homo sapiens
auauacauacuuacaugugu

SEQ ID NO: 663305 - RNA, 15 nt, Homo sapiens
auauacauuucauaa

SEQ ID NO: 663306 - RNA, 12 nt, Homo sapiens
auauaccaaagc

SEQ ID NO: 663307 - RNA, 11 nt, Homo sapiens
auauaccaaau

SEQ ID NO: 663308 - RNA, 12 nt, Homo sapiens
auauaccaagcu

SEQ ID NO: 663309 - RNA, 19 nt, Homo sapiens
auauaccuggcuuuuacuu

SEQ ID NO: 663310 - RNA, 21 nt, Homo sapiens
auauaccuggcuuuuacuuua

SEQ ID NO: 663311 - RNA, 13 nt, Homo sapiens
auauacuaugaaa

SEQ ID NO: 663312 - RNA, 20 nt, Homo sapiens
auauacuauuuucauucucu

SEQ ID NO: 663313 - RNA, 18 nt, Homo sapiens
auauacugguucacaucc

SEQ ID NO: 663314 - RNA, 15 nt, Homo sapiens
auauacugugugcuu

SEQ ID NO: 663315 - RNA, 21 nt, Homo sapiens
auauacuucacugguguacau

SEQ ID NO: 663316 - RNA, 17 nt, Homo sapiens
auauacuuuugugaaca

SEQ ID NO: 663317 - RNA, 23 nt, Homo sapiens
auauagcaaaugcagaaccacaa

SEQ ID NO: 663318 - RNA, 12 nt, Homo sapiens
auauagcacaua

SEQ ID NO: 663319 - RNA, 13 nt, Homo sapiens
auauagccaauau

SEQ ID NO: 663320 - RNA, 16 nt, Homo sapiens
auauaggaaaacaaua

SEQ ID NO: 663321 - RNA, 19 nt, Homo sapiens
auauaggccagaguugcaa

SEQ ID NO: 663322 - RNA, 15 nt, Homo sapiens
auauaggcuucucac

SEQ ID NO: 663323 - RNA, 17 nt, Homo sapiens
auauaggugugugagac

SEQ ID NO: 663324 - RNA, 17 nt, Homo sapiens
auauagguuugauucaa

SEQ ID NO: 663325 - RNA, 20 nt, Homo sapiens
auauagguuuuucucaugua

SEQ ID NO: 663326 - RNA, 17 nt, Homo sapiens
auauaguaaacacucaa

SEQ ID NO: 663327 - RNA, 22 nt, Homo sapiens
auauaguauauuuauacucuag

SEQ ID NO: 663328 - RNA, 19 nt, Homo sapiens
auauaguccagacacuuaa

SEQ ID NO: 663329 - RNA, 23 nt, Homo sapiens
auauaguccagacacuuaacuca

SEQ ID NO: 663330 - RNA, 16 nt, Homo sapiens
auauagugacuaugaa

SEQ ID NO: 663331 - RNA, 16 nt, Homo sapiens
auauauaaguguacau

SEQ ID NO: 663332 - RNA, 15 nt, Homo sapiens
auauauacacacagu

SEQ ID NO: 663333 - RNA, 16 nt, Homo sapiens
auauauaguagcauuu

SEQ ID NO: 663334 - RNA, 20 nt, Homo sapiens
auauauaguuaugcauacau

SEQ ID NO: 663335 - RNA, 15 nt, Homo sapiens
auauauauauaguaa

SEQ ID NO: 663336 - RNA, 21 nt, Homo sapiens
auauauauguauauacauauc

SEQ ID NO: 663337 - RNA, 20 nt, Homo sapiens
auauauauuuuugugcacau

SEQ ID NO: 663338 - RNA, 15 nt, Homo sapiens
auauaucacuaagcu

SEQ ID NO: 663339 - RNA, 20 nt, Homo sapiens
auauaugauguggacauaug

SEQ ID NO: 663340 - RNA, 20 nt, Homo sapiens
auauauggggcuuuagcaag

SEQ ID NO: 663341 - RNA, 19 nt, Homo sapiens
auauauguguauacauaca

SEQ ID NO: 663342 - RNA, 22 nt, Homo sapiens
auauauuaauaaucuuggcaau

SEQ ID NO: 663343 - RNA, 12 nt, Homo sapiens
auauauugaacu

SEQ ID NO: 663344 - RNA, 21 nt, Homo sapiens
auauauuguguugacuuuaua

SEQ ID NO: 663345 - RNA, 20 nt, Homo sapiens
auauauuuaaaaauaaguca

SEQ ID NO: 663346 - RNA, 17 nt, Homo sapiens
auauauuuaauauguca

SEQ ID NO: 663347 - RNA, 20 nt, Homo sapiens
auauauuuacaaggaguuau

SEQ ID NO: 663348 - RNA, 16 nt, Homo sapiens
auauauuuauaacuca

SEQ ID NO: 663349 - RNA, 22 nt, Homo sapiens
auauauuuauuuaagcuuaugu

SEQ ID NO: 663350 - RNA, 17 nt, Homo sapiens
aggacagggcugagcgu

SEQ ID NO: 663351 - RNA, 19 nt, Homo sapiens
aggacaguggaugcugcug

SEQ ID NO: 663352 - RNA, 17 nt, Homo sapiens
aggacaguuaaguauuu

SEQ ID NO: 663353 - RNA, 15 nt, Homo sapiens
aggacauaaagagag

SEQ ID NO: 663354 - RNA, 23 nt, Homo sapiens
aggacaugaacagacacuuuuca

SEQ ID NO: 663355 - RNA, 12 nt, Homo sapiens
aggacauucuau

SEQ ID NO: 663356 - RNA, 20 nt, Homo sapiens
aggaccaaaaaaccucacug

SEQ ID NO: 663357 - RNA, 14 nt, Homo sapiens
aggaccaagccaca

SEQ ID NO: 663358 - RNA, 18 nt, Homo sapiens
aggaccaauugacucuca

SEQ ID NO: 663359 - RNA, 18 nt, Homo sapiens
aggaccacucagccccua

SEQ ID NO: 663360 - RNA, 19 nt, Homo sapiens
aggaccagaagcauuucac

SEQ ID NO: 663361 - RNA, 14 nt, Homo sapiens
aggacccugugagc

SEQ ID NO: 663362 - RNA, 20 nt, Homo sapiens
aggaccgccugcccugccug

SEQ ID NO: 663363 - RNA, 18 nt, Homo sapiens
aggaccuaaaacaucuca

SEQ ID NO: 663364 - RNA, 15 nt, Homo sapiens
aggaccuuuccacca

SEQ ID NO: 663365 - RNA, 14 nt, Homo sapiens
aggacgaauuugca

SEQ ID NO: 663366 - RNA, 20 nt, Homo sapiens
aggacgauggggcaugaccu

SEQ ID NO: 663367 - RNA, 17 nt, Homo sapiens
aggacgcacgcucgcug

SEQ ID NO: 663368 - RNA, 16 nt, Homo sapiens
aggacggacucacuuc

SEQ ID NO: 663369 - RNA, 17 nt, Homo sapiens
aggacguugaggacuuu

SEQ ID NO: 663370 - RNA, 14 nt, Homo sapiens
aggacuacaaccaa

SEQ ID NO: 663371 - RNA, 14 nt, Homo sapiens
aggacuacagacau

SEQ ID NO: 663372 - RNA, 23 nt, Homo sapiens
aggacuaccagccauacaaauag

SEQ ID NO: 663373 - RNA, 15 nt, Homo sapiens
aggacucaccacugc

SEQ ID NO: 663374 - RNA, 14 nt, Homo sapiens
aggacucagaggau

SEQ ID NO: 663375 - RNA, 21 nt, Homo sapiens
aggacucuauuuuaaggacug

SEQ ID NO: 663376 - RNA, 15 nt, Homo sapiens
aggacucugcuucag

SEQ ID NO: 663377 - RNA, 20 nt, Homo sapiens
aggacucuggacaaucucac

SEQ ID NO: 663378 - RNA, 16 nt, Homo sapiens
aggacugaaaagggaa

SEQ ID NO: 663379 - RNA, 17 nt, Homo sapiens
aggacugaaaagggaau

SEQ ID NO: 663380 - RNA, 18 nt, Homo sapiens
aggacugaccucuuccuc

SEQ ID NO: 663381 - RNA, 22 nt, Homo sapiens
aggacugagcacccucuggauu

SEQ ID NO: 663382 - RNA, 22 nt, Homo sapiens
aggacugcaggggccacuccaa

SEQ ID NO: 663383 - RNA, 23 nt, Homo sapiens
aggacuuagggugucguuuucac

SEQ ID NO: 663384 - RNA, 19 nt, Homo sapiens
aggacuuagugcaucagau

SEQ ID NO: 663385 - RNA, 15 nt, Homo sapiens
aggacuucuggcuau

SEQ ID NO: 663386 - RNA, 20 nt, Homo sapiens
aggacuugcuaaagcacuuu

SEQ ID NO: 663387 - RNA, 17 nt, Homo sapiens
aggagaaaaagcuuaau

SEQ ID NO: 663388 - RNA, 19 nt, Homo sapiens
aggagaaggaugguucaua

SEQ ID NO: 663389 - RNA, 18 nt, Homo sapiens
aggagaauuuaaacaaug

SEQ ID NO: 663390 - RNA, 18 nt, Homo sapiens
aggagacaaagcaggagu

SEQ ID NO: 663391 - RNA, 14 nt, Homo sapiens
aggagacauugcuc

SEQ ID NO: 663392 - RNA, 21 nt, Homo sapiens
aggagaccagcgguccauggg

SEQ ID NO: 663393 - RNA, 22 nt, Homo sapiens
aggagaccuggcacuggaugca

SEQ ID NO: 663394 - RNA, 23 nt, Homo sapiens
aggagagcacugccucuaugccc

SEQ ID NO: 663395 - RNA, 16 nt, Homo sapiens
aggagagccaaccucg

SEQ ID NO: 663396 - RNA, 17 nt, Homo sapiens
aggagauaauuguuuca

SEQ ID NO: 663397 - RNA, 18 nt, Homo sapiens
aggagaugcggccaaaga

SEQ ID NO: 663398 - RNA, 15 nt, Homo sapiens
aggagauggccucau

SEQ ID NO: 663399 - RNA, 17 nt, Homo sapiens
aggagauuccggugccu

SEQ ID NO: 663400 - RNA, 19 nt, Homo sapiens
aggagauuggccagugaga

SEQ ID NO: 663401 - RNA, 14 nt, Homo sapiens
aggagcaaaacgcc

SEQ ID NO: 663402 - RNA, 21 nt, Homo sapiens
aggagcaagggcacaaacugc

SEQ ID NO: 663403 - RNA, 17 nt, Homo sapiens
aggagcaggcacgggug

SEQ ID NO: 663404 - RNA, 17 nt, Homo sapiens
aggagccaccuugccac

SEQ ID NO: 663405 - RNA, 17 nt, Homo sapiens
aggagcccacagugccu

SEQ ID NO: 663406 - RNA, 21 nt, Homo sapiens
aggagcccccaacacaggcaa

SEQ ID NO: 663407 - RNA, 17 nt, Homo sapiens
aggagccggugcucugg

SEQ ID NO: 663408 - RNA, 19 nt, Homo sapiens
aggagccuugcugggccag

SEQ ID NO: 663409 - RNA, 15 nt, Homo sapiens
aggagcgcuacccac

SEQ ID NO: 663410 - RNA, 20 nt, Homo sapiens
aggagcggccagaagaucua

SEQ ID NO: 663411 - RNA, 11 nt, Homo sapiens
aggagcucucc

SEQ ID NO: 663412 - RNA, 14 nt, Homo sapiens
aggagcugcaaauu

SEQ ID NO: 663413 - RNA, 14 nt, Homo sapiens
aggagcugccaugu

SEQ ID NO: 663414 - RNA, 21 nt, Homo sapiens
aggagcugcuggcuugcagug

SEQ ID NO: 663415 - RNA, 16 nt, Homo sapiens
aggagcuggaaccaug

SEQ ID NO: 663416 - RNA, 14 nt, Homo sapiens
aggagcugggccag

SEQ ID NO: 663417 - RNA, 18 nt, Homo sapiens
aggagcuucuuguuuccu

SEQ ID NO: 663418 - RNA, 14 nt, Homo sapiens
aggagcuuucucaa

SEQ ID NO: 663419 - RNA, 23 nt, Homo sapiens
aggagcuuucucaaugucuuccc

SEQ ID NO: 663420 - RNA, 13 nt, Homo sapiens
aggaggaauuuac

SEQ ID NO: 663421 - RNA, 13 nt, Homo sapiens
aggaggaugccac

SEQ ID NO: 663422 - RNA, 19 nt, Homo sapiens
aggaggauuugucugagac

SEQ ID NO: 663423 - RNA, 18 nt, Homo sapiens
aggaggcaaagguucuau

SEQ ID NO: 663424 - RNA, 18 nt, Homo sapiens
aggaggccaccucuccaa

SEQ ID NO: 663425 - RNA, 14 nt, Homo sapiens
aggaggccguggcu

SEQ ID NO: 663426 - RNA, 19 nt, Homo sapiens
aggaggccguggcucugau

SEQ ID NO: 663427 - RNA, 17 nt, Homo sapiens
aggaggccucaccauac

SEQ ID NO: 663428 - RNA, 13 nt, Homo sapiens
aggaggccugcac

SEQ ID NO: 663429 - RNA, 21 nt, Homo sapiens
aggaggccugcaccaaauguc

SEQ ID NO: 663430 - RNA, 16 nt, Homo sapiens
aggaggcugcaugcuc

SEQ ID NO: 663431 - RNA, 17 nt, Homo sapiens
aggagggagaaaggaga

SEQ ID NO: 663432 - RNA, 22 nt, Homo sapiens
aggagggaugcugccugaguca

SEQ ID NO: 663433 - RNA, 23 nt, Homo sapiens
aggagggccagcgcuguggaccu

SEQ ID NO: 663434 - RNA, 19 nt, Homo sapiens
aggagggccgaggugggcu

SEQ ID NO: 663435 - RNA, 15 nt, Homo sapiens
aggagggcucaggga

SEQ ID NO: 663436 - RNA, 19 nt, Homo sapiens
aggagggugacgcccagcu

SEQ ID NO: 663437 - RNA, 22 nt, Homo sapiens
aggaggugcuaucgcaccacug

SEQ ID NO: 663438 - RNA, 18 nt, Homo sapiens
aggagguuuuuuugucaa

SEQ ID NO: 663439 - RNA, 18 nt, Homo sapiens
aggaguaaguguacaauu

SEQ ID NO: 663440 - RNA, 11 nt, Homo sapiens
aggaguacaau

SEQ ID NO: 663441 - RNA, 17 nt, Homo sapiens
aggagucagaaacuguu

SEQ ID NO: 663442 - RNA, 14 nt, Homo sapiens
aggagucucugcca

SEQ ID NO: 663443 - RNA, 17 nt, Homo sapiens
aggaguggccacagcac

SEQ ID NO: 663444 - RNA, 18 nt, Homo sapiens
aggaguggccacagcacc

SEQ ID NO: 663445 - RNA, 22 nt, Homo sapiens
aggagugggaaaacacugccau

SEQ ID NO: 663446 - RNA, 14 nt, Homo sapiens
aggagugguucuca

SEQ ID NO: 663447 - RNA, 19 nt, Homo sapiens
aggagugugugacauucca

SEQ ID NO: 663448 - RNA, 14 nt, Homo sapiens
aggaguuaccuuaa

SEQ ID NO: 663449 - RNA, 17 nt, Homo sapiens
aggaguugccugacucc

SEQ ID NO: 663450 - RNA, 22 nt, Homo sapiens
aggaguuguuucugacccacug

SEQ ID NO: 663451 - RNA, 18 nt, Homo sapiens
aggaguuuauuacaaugu

SEQ ID NO: 663452 - RNA, 16 nt, Homo sapiens
aggauaauuauccaau

SEQ ID NO: 663453 - RNA, 22 nt, Homo sapiens
aggauacauaaugggccacuga

SEQ ID NO: 663454 - RNA, 17 nt, Homo sapiens
aggauacccagaugcca

SEQ ID NO: 663455 - RNA, 17 nt, Homo sapiens
aggauagaauacaugga

SEQ ID NO: 663456 - RNA, 15 nt, Homo sapiens
aggauagacacugga

SEQ ID NO: 663457 - RNA, 22 nt, Homo sapiens
aggauagggccgacgcugugcc

SEQ ID NO: 663458 - RNA, 18 nt, Homo sapiens
aggauauacugcagcuuu

SEQ ID NO: 663459 - RNA, 19 nt, Homo sapiens
aggauauuaacaacaauaa

SEQ ID NO: 663460 - RNA, 19 nt, Homo sapiens
cagaagaugccagcuucuc

SEQ ID NO: 663461 - RNA, 18 nt, Homo sapiens
cagaagauuauuuacuga

SEQ ID NO: 663462 - RNA, 20 nt, Homo sapiens
cagaagcaggguacccuuug

SEQ ID NO: 663463 - RNA, 14 nt, Homo sapiens
cagaagcauuucac

SEQ ID NO: 663464 - RNA, 18 nt, Homo sapiens
cagaagccugaugcugac

SEQ ID NO: 663465 - RNA, 16 nt, Homo sapiens
cagaagccuuugauau

SEQ ID NO: 663466 - RNA, 19 nt, Homo sapiens
cagaaggaaaaauguguaa

SEQ ID NO: 663467 - RNA, 20 nt, Homo sapiens
cagaaggagaugcugcugag

SEQ ID NO: 663468 - RNA, 20 nt, Homo sapiens
cagaaggcaaaguuuacaga

SEQ ID NO: 663469 - RNA, 19 nt, Homo sapiens
cagaagguaucaguuauau

SEQ ID NO: 663470 - RNA, 11 nt, Homo sapiens
cagaaggugac

SEQ ID NO: 663471 - RNA, 14 nt, Homo sapiens
cagaaggugccacu

SEQ ID NO: 663472 - RNA, 20 nt, Homo sapiens
cagaagugagcuuugcugcu

SEQ ID NO: 663473 - RNA, 15 nt, Homo sapiens
cagaagugauuuagu

SEQ ID NO: 663474 - RNA, 21 nt, Homo sapiens
cagaaguuugcaaauaggcag

SEQ ID NO: 663475 - RNA, 20 nt, Homo sapiens
cagaauaaaagaugauuucu

SEQ ID NO: 663476 - RNA, 22 nt, Homo sapiens
cagaauaaaagaugauuucuca

SEQ ID NO: 663477 - RNA, 23 nt, Homo sapiens
cagaauagcuuugaauguggccc

SEQ ID NO: 663478 - RNA, 22 nt, Homo sapiens
cagaauauccaaauaagccuug

SEQ ID NO: 663479 - RNA, 14 nt, Homo sapiens
cagaauccacaacu

SEQ ID NO: 663480 - RNA, 21 nt, Homo sapiens
cagaauccauaaauguguucc

SEQ ID NO: 663481 - RNA, 21 nt, Homo sapiens
cagaaucccuuaacaguugua

SEQ ID NO: 663482 - RNA, 16 nt, Homo sapiens
cagaauccugauggua

SEQ ID NO: 663483 - RNA, 18 nt, Homo sapiens
cagaaucuccaucccuga

SEQ ID NO: 663484 - RNA, 18 nt, Homo sapiens
cagaaucugcuguugcca

SEQ ID NO: 663485 - RNA, 19 nt, Homo sapiens
cagaaucuguuaccagagg

SEQ ID NO: 663486 - RNA, 17 nt, Homo sapiens
cagaaugcuauuucacu

SEQ ID NO: 663487 - RNA, 21 nt, Homo sapiens
cagaaugcucagggucacuga

SEQ ID NO: 663488 - RNA, 21 nt, Homo sapiens
cagaauguauauuaaggugug

SEQ ID NO: 663489 - RNA, 17 nt, Homo sapiens
cagaauguugcuuucug

SEQ ID NO: 663490 - RNA, 18 nt, Homo sapiens
cagaauuaaagaccuauu

SEQ ID NO: 663491 - RNA, 12 nt, Homo sapiens
cagaauucccuu

SEQ ID NO: 663492 - RNA, 17 nt, Homo sapiens
cagaauucuaagcuggu

SEQ ID NO: 663493 - RNA, 16 nt, Homo sapiens
cagaauucuucauccu

SEQ ID NO: 663494 - RNA, 19 nt, Homo sapiens
cagaauucuucauccuaaa

SEQ ID NO: 663495 - RNA, 22 nt, Homo sapiens
cagaauuuguugcuaauuugcc

SEQ ID NO: 663496 - RNA, 16 nt, Homo sapiens
cagaauuuuaaagagc

SEQ ID NO: 663497 - RNA, 21 nt, Homo sapiens
cagaauuuuuaacaaaaugag

SEQ ID NO: 663498 - RNA, 20 nt, Homo sapiens
cagacaaaauuugagaauac

SEQ ID NO: 663499 - RNA, 15 nt, Homo sapiens
cagacaaagugacau

SEQ ID NO: 663500 - RNA, 19 nt, Homo sapiens
cagacaacacugggaaaca

SEQ ID NO: 663501 - RNA, 12 nt, Homo sapiens
cagacaacagaa

SEQ ID NO: 663502 - RNA, 13 nt, Homo sapiens
cagacaaccaaaa

SEQ ID NO: 663503 - RNA, 15 nt, Homo sapiens
cagacaaccaaaaca

SEQ ID NO: 663504 - RNA, 19 nt, Homo sapiens
cagacaagaaugugcacuc

SEQ ID NO: 663505 - RNA, 15 nt, Homo sapiens
cagacacagacuggc

SEQ ID NO: 663506 - RNA, 20 nt, Homo sapiens
cagacacagacuggcaauaa

SEQ ID NO: 663507 - RNA, 23 nt, Homo sapiens
cagacacaugcuauguucugucu

SEQ ID NO: 663508 - RNA, 19 nt, Homo sapiens
cagacacauugucaucaga

SEQ ID NO: 663509 - RNA, 13 nt, Homo sapiens
cagacaccagccu

SEQ ID NO: 663510 - RNA, 15 nt, Homo sapiens
cagacaccaugugca

SEQ ID NO: 663511 - RNA, 20 nt, Homo sapiens
cagacaccuccuucuuccua

SEQ ID NO: 663512 - RNA, 20 nt, Homo sapiens
cagacacuaacgaaauauca

SEQ ID NO: 663513 - RNA, 13 nt, Homo sapiens
cagacacuacaug

SEQ ID NO: 663514 - RNA, 12 nt, Homo sapiens
cagacacugcac

SEQ ID NO: 663515 - RNA, 18 nt, Homo sapiens
cagacacuuuucaaaaga

SEQ ID NO: 663516 - RNA, 16 nt, Homo sapiens
cagacagaaggugcua

SEQ ID NO: 663517 - RNA, 20 nt, Homo sapiens
cagacagacaacacugggaa

SEQ ID NO: 663518 - RNA, 14 nt, Homo sapiens
cagacagaccucaa

SEQ ID NO: 663519 - RNA, 18 nt, Homo sapiens
cagacagaccucaaggga

SEQ ID NO: 663520 - RNA, 13 nt, Homo sapiens
cagacagauucca

SEQ ID NO: 663521 - RNA, 15 nt, Homo sapiens
cagacagauugcuga

SEQ ID NO: 663522 - RNA, 13 nt, Homo sapiens
cagacagcacccu

SEQ ID NO: 663523 - RNA, 10 nt, Homo sapiens
cagacauauu

SEQ ID NO: 663524 - RNA, 14 nt, Homo sapiens
cagacaugccuugg

SEQ ID NO: 663525 - RNA, 16 nt, Homo sapiens
cagacaugugcaacca

SEQ ID NO: 663526 - RNA, 13 nt, Homo sapiens
cagacauugcucu

SEQ ID NO: 663527 - RNA, 13 nt, Homo sapiens
cagaccaccagca

SEQ ID NO: 663528 - RNA, 20 nt, Homo sapiens
cagaccacugauaaaaccau

SEQ ID NO: 663529 - RNA, 15 nt, Homo sapiens
cagaccagaccccaa

SEQ ID NO: 663530 - RNA, 19 nt, Homo sapiens
cagaccagaccccaaacca

SEQ ID NO: 663531 - RNA, 15 nt, Homo sapiens
cagaccauccagagg

SEQ ID NO: 663532 - RNA, 16 nt, Homo sapiens
cagaccauucaggaca

SEQ ID NO: 663533 - RNA, 21 nt, Homo sapiens
cagacccaacucgccugugga

SEQ ID NO: 663534 - RNA, 19 nt, Homo sapiens
cagaccccacccuacgcuc

SEQ ID NO: 663535 - RNA, 19 nt, Homo sapiens
cagacccugccacucucac

SEQ ID NO: 663536 - RNA, 20 nt, Homo sapiens
cagaccgggguucaagccau

SEQ ID NO: 663537 - RNA, 20 nt, Homo sapiens
cagaccgugaccaucuuugu

SEQ ID NO: 663538 - RNA, 21 nt, Homo sapiens
cagaccuuuacugauacuaca

SEQ ID NO: 663539 - RNA, 19 nt, Homo sapiens
cagacgggucugagacuga

SEQ ID NO: 663540 - RNA, 17 nt, Homo sapiens
cagacguugccugagaa

SEQ ID NO: 663541 - RNA, 22 nt, Homo sapiens
cagacuaaagauugcagcauuu

SEQ ID NO: 663542 - RNA, 20 nt, Homo sapiens
cagacuaaaggauccagaga

SEQ ID NO: 663543 - RNA, 15 nt, Homo sapiens
cagacuacacaggau

SEQ ID NO: 663544 - RNA, 21 nt, Homo sapiens
cagacuauggauguguucucu

SEQ ID NO: 663545 - RNA, 16 nt, Homo sapiens
cagacucaguuuguca

SEQ ID NO: 663546 - RNA, 14 nt, Homo sapiens
cagacucgggacca

SEQ ID NO: 663547 - RNA, 19 nt, Homo sapiens
cagacucuguaauugaaua

SEQ ID NO: 663548 - RNA, 18 nt, Homo sapiens
cagacuggucuugaacuc

SEQ ID NO: 663549 - RNA, 16 nt, Homo sapiens
cagacuguaggauuug

SEQ ID NO: 663550 - RNA, 17 nt, Homo sapiens
cagacuugguccuaagc

SEQ ID NO: 663551 - RNA, 18 nt, Homo sapiens
cagacuugguccuaagca

SEQ ID NO: 663552 - RNA, 17 nt, Homo sapiens
cagagaaaauugugaaa

SEQ ID NO: 663553 - RNA, 22 nt, Homo sapiens
cagagaaagaaaaggcaaaaga

SEQ ID NO: 663554 - RNA, 14 nt, Homo sapiens
cagagaaaggauug

SEQ ID NO: 663555 - RNA, 17 nt, Homo sapiens
cagagaaauacaaaaua

SEQ ID NO: 663556 - RNA, 22 nt, Homo sapiens
cagagaagauaauguucuuuaa

SEQ ID NO: 663557 - RNA, 17 nt, Homo sapiens
cagagaaguuuguagcc

SEQ ID NO: 663558 - RNA, 18 nt, Homo sapiens
cagagaauauauacauuc

SEQ ID NO: 663559 - RNA, 17 nt, Homo sapiens
cagagaauuacuauuua

SEQ ID NO: 663560 - RNA, 12 nt, Homo sapiens
cagagacagaua

SEQ ID NO: 663561 - RNA, 20 nt, Homo sapiens
cagagacaggcccaagagau

SEQ ID NO: 663562 - RNA, 14 nt, Homo sapiens
cagagacagggaaa

SEQ ID NO: 663563 - RNA, 15 nt, Homo sapiens
cagagaccagcacuc

SEQ ID NO: 663564 - RNA, 21 nt, Homo sapiens
cagagacccaacagcagugau

SEQ ID NO: 663565 - RNA, 15 nt, Homo sapiens
cagagaccccaggaa

SEQ ID NO: 663566 - RNA, 21 nt, Homo sapiens
cagagaccccaggaacaauaa

SEQ ID NO: 663567 - RNA, 18 nt, Homo sapiens
cagagacccucucagccc

SEQ ID NO: 663568 - RNA, 14 nt, Homo sapiens
cagagaccuaugua

SEQ ID NO: 663569 - RNA, 19 nt, Homo sapiens
cagagaccugaagugugca

SEQ ID NO: 663570 - RNA, 20 nt, Homo sapiens
cagagaccugaagugugcac

SEQ ID NO: 663571 - RNA, 20 nt, Homo sapiens
cagagacuaucugauuuccu

SEQ ID NO: 663572 - RNA, 13 nt, Homo sapiens
cagagacugaaaa

SEQ ID NO: 663573 - RNA, 20 nt, Homo sapiens
cagagacugggaugggaaca

SEQ ID NO: 663574 - RNA, 16 nt, Homo sapiens
cagagacugucccuga

SEQ ID NO: 663575 - RNA, 15 nt, Homo sapiens
cagagagaacaacag

SEQ ID NO: 663576 - RNA, 19 nt, Homo sapiens
cagagagaacaacaggcag

SEQ ID NO: 663577 - RNA, 22 nt, Homo sapiens
cagagagagaagugccccugcu

SEQ ID NO: 663578 - RNA, 20 nt, Homo sapiens
cagagagagagaaggcagca

SEQ ID NO: 663579 - RNA, 16 nt, Homo sapiens
cagagagcaacucuga

SEQ ID NO: 663580 - RNA, 14 nt, Homo sapiens
cagagagcaggcag

SEQ ID NO: 663581 - RNA, 19 nt, Homo sapiens
cagagagccuggugcugcu

SEQ ID NO: 663582 - RNA, 23 nt, Homo sapiens
cagagagggcagagggguaggca

SEQ ID NO: 663583 - RNA, 21 nt, Homo sapiens
aggaucagaugacucucucca

SEQ ID NO: 663584 - RNA, 18 nt, Homo sapiens
aggauccccucucuuccu

SEQ ID NO: 663585 - RNA, 20 nt, Homo sapiens
aggauccccucucuuccuac

SEQ ID NO: 663586 - RNA, 22 nt, Homo sapiens
aggaucuaagggaagaucacug

SEQ ID NO: 663587 - RNA, 21 nt, Homo sapiens
aggaugaaagugaccauguuu

SEQ ID NO: 663588 - RNA, 17 nt, Homo sapiens
aggaugaaucauauuca

SEQ ID NO: 663589 - RNA, 14 nt, Homo sapiens
aggaugaauguaug

SEQ ID NO: 663590 - RNA, 16 nt, Homo sapiens
aggaugacuacagaca

SEQ ID NO: 663591 - RNA, 18 nt, Homo sapiens
aggaugagaugacagaua

SEQ ID NO: 663592 - RNA, 15 nt, Homo sapiens
aggaugcacauuucu

SEQ ID NO: 663593 - RNA, 20 nt, Homo sapiens
cagagcaagacucugucuca

SEQ ID NO: 663594 - RNA, 12 nt, Homo sapiens
cagagcacuccc

SEQ ID NO: 663595 - RNA, 23 nt, Homo sapiens
cagagcagaggaaggcuacuuga

SEQ ID NO: 663596 - RNA, 20 nt, Homo sapiens
cagagcagagguggaaaaac

SEQ ID NO: 663597 - RNA, 16 nt, Homo sapiens
cagagcagagucugaa

SEQ ID NO: 663598 - RNA, 13 nt, Homo sapiens
cagagcaggcuca

SEQ ID NO: 663599 - RNA, 16 nt, Homo sapiens
cagagcauacaacaga

SEQ ID NO: 663600 - RNA, 21 nt, Homo sapiens
cagagccagccggcuaugaaa

SEQ ID NO: 663601 - RNA, 16 nt, Homo sapiens
cagagccagucucacc

SEQ ID NO: 663602 - RNA, 15 nt, Homo sapiens
cagagcccuggaccu

SEQ ID NO: 663603 - RNA, 21 nt, Homo sapiens
cagagcccuucacugccauga

SEQ ID NO: 663604 - RNA, 22 nt, Homo sapiens
cagagccucggcccuagcauug

SEQ ID NO: 663605 - RNA, 22 nt, Homo sapiens
cagagccucguuucugcuuuca

SEQ ID NO: 663606 - RNA, 16 nt, Homo sapiens
cagagccuuuuacccc

SEQ ID NO: 663607 - RNA, 15 nt, Homo sapiens
cagagcgcaccucaa

SEQ ID NO: 663608 - RNA, 17 nt, Homo sapiens
cagagcuauaaaaugcu

SEQ ID NO: 663609 - RNA, 17 nt, Homo sapiens
cagagcuggaucucuca

SEQ ID NO: 663610 - RNA, 22 nt, Homo sapiens
cagagcuggguggggacaguga

SEQ ID NO: 663611 - RNA, 20 nt, Homo sapiens
cagagcuuuaaaaguaucuu

SEQ ID NO: 663612 - RNA, 19 nt, Homo sapiens
cagaggaacuguccagaga

SEQ ID NO: 663613 - RNA, 19 nt, Homo sapiens
cagaggaaggcuacuugag

SEQ ID NO: 663614 - RNA, 20 nt, Homo sapiens
cagaggaaggcuacuugagc

SEQ ID NO: 663615 - RNA, 13 nt, Homo sapiens
cagaggaccugag

SEQ ID NO: 663616 - RNA, 18 nt, Homo sapiens
cagaggagaagcaauggg

SEQ ID NO: 663617 - RNA, 20 nt, Homo sapiens
cagaggagggcgugacucac

SEQ ID NO: 663618 - RNA, 14 nt, Homo sapiens
cagaggagugcagc

SEQ ID NO: 663619 - RNA, 20 nt, Homo sapiens
cagaggauaucggcauuugu

SEQ ID NO: 663620 - RNA, 17 nt, Homo sapiens
cagaggauucuguguuc

SEQ ID NO: 663621 - RNA, 16 nt, Homo sapiens
cagaggcaacacugga

SEQ ID NO: 663622 - RNA, 20 nt, Homo sapiens
cagaggcagccucugcacuc

SEQ ID NO: 663623 - RNA, 22 nt, Homo sapiens
cagaggcagcgaguuguggaaa

SEQ ID NO: 663624 - RNA, 19 nt, Homo sapiens
cagaggcaguaaccaugcc

SEQ ID NO: 663625 - RNA, 21 nt, Homo sapiens
cagaggcauuuaaaauggaaa

SEQ ID NO: 663626 - RNA, 22 nt, Homo sapiens
cagaggccuauaacuuuuggua

SEQ ID NO: 663627 - RNA, 20 nt, Homo sapiens
cagaggcucagcacuuugga

SEQ ID NO: 663628 - RNA, 23 nt, Homo sapiens
cagaggcucuugaugguggacua

SEQ ID NO: 663629 - RNA, 18 nt, Homo sapiens
cagaggcugcagaaggcc

SEQ ID NO: 663630 - RNA, 15 nt, Homo sapiens
cagaggcuggcacug

SEQ ID NO: 663631 - RNA, 20 nt, Homo sapiens
cagaggcuuccguguccucu

SEQ ID NO: 663632 - RNA, 14 nt, Homo sapiens
cagagggaagccau

SEQ ID NO: 663633 - RNA, 14 nt, Homo sapiens
cagagggauaaaaa

SEQ ID NO: 663634 - RNA, 20 nt, Homo sapiens
cagagggauaaaaacaauac

SEQ ID NO: 663635 - RNA, 17 nt, Homo sapiens
cagagggcaguggcccu

SEQ ID NO: 663636 - RNA, 15 nt, Homo sapiens
cagaggguacuuuaa

SEQ ID NO: 663637 - RNA, 19 nt, Homo sapiens
cagagggucuuacuguucc

SEQ ID NO: 663638 - RNA, 13 nt, Homo sapiens
cagagguauuccu

SEQ ID NO: 663639 - RNA, 22 nt, Homo sapiens
cagagguccacaacacacagau

SEQ ID NO: 663640 - RNA, 16 nt, Homo sapiens
cagagguuugcuuccu

SEQ ID NO: 663641 - RNA, 22 nt, Homo sapiens
cagagguuugcuuccucaguaa

SEQ ID NO: 663642 - RNA, 15 nt, Homo sapiens
cagaguagaaacuca

SEQ ID NO: 663643 - RNA, 19 nt, Homo sapiens
cagagucaggcuguugcgc

SEQ ID NO: 663644 - RNA, 13 nt, Homo sapiens
cagagucaucuga

SEQ ID NO: 663645 - RNA, 19 nt, Homo sapiens
cagaguccacuguggcacu

SEQ ID NO: 663646 - RNA, 17 nt, Homo sapiens
cagaguccuugcaaaau

SEQ ID NO: 663647 - RNA, 15 nt, Homo sapiens
cagagucuuggucug

SEQ ID NO: 663648 - RNA, 14 nt, Homo sapiens
cagagugaacacuc

SEQ ID NO: 663649 - RNA, 14 nt, Homo sapiens
cagagugaauuuca

SEQ ID NO: 663650 - RNA, 15 nt, Homo sapiens
cagagugaauuucag

SEQ ID NO: 663651 - RNA, 20 nt, Homo sapiens
cagagugagaccauguuuca

SEQ ID NO: 663652 - RNA, 22 nt, Homo sapiens
cagagugagacccagcccucau

SEQ ID NO: 663653 - RNA, 21 nt, Homo sapiens
cagagugagcaagggggccca

SEQ ID NO: 663654 - RNA, 23 nt, Homo sapiens
cagagugagccagugagggcagu

SEQ ID NO: 663655 - RNA, 22 nt, Homo sapiens
cagagugccugcauucccagga

SEQ ID NO: 663656 - RNA, 19 nt, Homo sapiens
cagagugcuggacuguucc

SEQ ID NO: 663657 - RNA, 24 nt, Homo sapiens
cagaguggaguugaaacugcuaua

SEQ ID NO: 663658 - RNA, 21 nt, Homo sapiens
cagaguggccccucaccuggg

SEQ ID NO: 663659 - RNA, 16 nt, Homo sapiens
cagaguguucccugac

SEQ ID NO: 663660 - RNA, 23 nt, Homo sapiens
cagaguugcaaagaucuuuucca

SEQ ID NO: 663661 - RNA, 15 nt, Homo sapiens
cagaguugcuuuaaa

SEQ ID NO: 663662 - RNA, 23 nt, Homo sapiens
cagaguuggacuucuagacucac

SEQ ID NO: 663663 - RNA, 18 nt, Homo sapiens
cagaguuugccuuccuuu

SEQ ID NO: 663664 - RNA, 18 nt, Homo sapiens
cagauaaacaacaaauaa

SEQ ID NO: 663665 - RNA, 16 nt, Homo sapiens
cagauaaauagaacua

SEQ ID NO: 663666 - RNA, 15 nt, Homo sapiens
cagauaaguuugcag

SEQ ID NO: 663667 - RNA, 18 nt, Homo sapiens
cagauaccucaucaucca

SEQ ID NO: 663668 - RNA, 19 nt, Homo sapiens
cagauaccuccaacccugc

SEQ ID NO: 663669 - RNA, 19 nt, Homo sapiens
cagauacgggggcugugac

SEQ ID NO: 663670 - RNA, 14 nt, Homo sapiens
cagauagagcuggg

SEQ ID NO: 663671 - RNA, 23 nt, Homo sapiens
cagauagguggugccaguggcuu

SEQ ID NO: 663672 - RNA, 23 nt, Homo sapiens
cagauaucagaaucauugaagua

SEQ ID NO: 663673 - RNA, 13 nt, Homo sapiens
cagauauuucaca

SEQ ID NO: 663674 - RNA, 20 nt, Homo sapiens
cagaucaagaguuuuggaga

SEQ ID NO: 663675 - RNA, 15 nt, Homo sapiens
cagaucaauuuguaa

SEQ ID NO: 663676 - RNA, 22 nt, Homo sapiens
cagaucacccggggcuuacuua

SEQ ID NO: 663677 - RNA, 21 nt, Homo sapiens
cagaucaucuuggaacugcau

SEQ ID NO: 663678 - RNA, 12 nt, Homo sapiens
cagaucaugccc

SEQ ID NO: 663679 - RNA, 16 nt, Homo sapiens
cagauccccacugucc

SEQ ID NO: 663680 - RNA, 15 nt, Homo sapiens
cagauccccagccuc

SEQ ID NO: 663681 - RNA, 19 nt, Homo sapiens
cagauccgcaagaguaaag

SEQ ID NO: 663682 - RNA, 17 nt, Homo sapiens
cagaucgaaauuggacu

SEQ ID NO: 663683 - RNA, 16 nt, Homo sapiens
cagaucguucauugcc

SEQ ID NO: 663684 - RNA, 17 nt, Homo sapiens
cagaucuaucuugucaa

SEQ ID NO: 663685 - RNA, 19 nt, Homo sapiens
cagaucugcaccaccaugc

SEQ ID NO: 663686 - RNA, 19 nt, Homo sapiens
cagaucugcccacaucuuu

SEQ ID NO: 663687 - RNA, 22 nt, Homo sapiens
cagaucuggucuaguuaaccua

SEQ ID NO: 663688 - RNA, 16 nt, Homo sapiens
cagaucugugccccau

SEQ ID NO: 663689 - RNA, 14 nt, Homo sapiens
cagaucugugccug

SEQ ID NO: 663690 - RNA, 23 nt, Homo sapiens
cagaucuguuucgugcauuggaa

SEQ ID NO: 663691 - RNA, 15 nt, Homo sapiens
cagaugaaaugcauc

SEQ ID NO: 663692 - RNA, 19 nt, Homo sapiens
cagaugaagacaucaggaa

SEQ ID NO: 663693 - RNA, 17 nt, Homo sapiens
cagaugaccaaagccac

SEQ ID NO: 663694 - RNA, 19 nt, Homo sapiens
cagaugauucuaugucuca

SEQ ID NO: 663695 - RNA, 22 nt, Homo sapiens
cagaugauucuaugucucauga

SEQ ID NO: 663696 - RNA, 15 nt, Homo sapiens
cagaugauuguucaa

SEQ ID NO: 663697 - RNA, 17 nt, Homo sapiens
cagaugcaagacacugu

SEQ ID NO: 663698 - RNA, 19 nt, Homo sapiens
cagaugcaagacacugugc

SEQ ID NO: 663699 - RNA, 12 nt, Homo sapiens
cagaugcaauga

SEQ ID NO: 663700 - RNA, 23 nt, Homo sapiens
cagaugcccacguaugugaaaca

SEQ ID NO: 663701 - RNA, 21 nt, Homo sapiens
cagaugccucagccuacuuuc

SEQ ID NO: 663702 - RNA, 21 nt, Homo sapiens
cagaugcuacgcuccagcuga

SEQ ID NO: 663703 - RNA, 15 nt, Homo sapiens
cagauggaacacugg

SEQ ID NO: 663704 - RNA, 22 nt, Homo sapiens
cagauggaaugggguccuagca

SEQ ID NO: 663705 - RNA, 17 nt, Homo sapiens
aggcccuucucuacacc

SEQ ID NO: 663706 - RNA, 21 nt, Homo sapiens
aggccgauuugggaaccaagc

SEQ ID NO: 663707 - RNA, 23 nt, Homo sapiens
aggccggaaaaggcgcaucuaac

SEQ ID NO: 663708 - RNA, 20 nt, Homo sapiens
aggccgggcgcgguggcuca

SEQ ID NO: 663709 - RNA, 21 nt, Homo sapiens
aggccggugugggcugugucg

SEQ ID NO: 663710 - RNA, 13 nt, Homo sapiens
aggccgugugucu

SEQ ID NO: 663711 - RNA, 15 nt, Homo sapiens
aggccgugugucugu

SEQ ID NO: 663712 - RNA, 15 nt, Homo sapiens
aggccuagacucugu

SEQ ID NO: 663713 - RNA, 13 nt, Homo sapiens
cccuuuucagggc

SEQ ID NO: 663714 - RNA, 22 nt, Homo sapiens
cccuuuuguauucucuuccuca

SEQ ID NO: 663715 - RNA, 18 nt, Homo sapiens
cccuuuuuuuacauuuca

SEQ ID NO: 663716 - RNA, 18 nt, Homo sapiens
ccgaaaaggauaugcagu

SEQ ID NO: 663717 - RNA, 19 nt, Homo sapiens
ccgaaaaggauaugcagua

SEQ ID NO: 663718 - RNA, 12 nt, Homo sapiens
ccgaaaccagag

SEQ ID NO: 663719 - RNA, 15 nt, Homo sapiens
ccgaaacuaagccag

SEQ ID NO: 663720 - RNA, 18 nt, Homo sapiens
ccgaaggguuuugcuaca

SEQ ID NO: 663721 - RNA, 14 nt, Homo sapiens
ccgaagucuuccau

SEQ ID NO: 663722 - RNA, 14 nt, Homo sapiens
ccgaauaaauguuu

SEQ ID NO: 663723 - RNA, 19 nt, Homo sapiens
ccgacagcccaucaccucu

SEQ ID NO: 663724 - RNA, 15 nt, Homo sapiens
ccgaccggugcauga

SEQ ID NO: 663725 - RNA, 18 nt, Homo sapiens
ccgaccucaggugaucca

SEQ ID NO: 663726 - RNA, 22 nt, Homo sapiens
ccgacggugggcauuugugagg

SEQ ID NO: 663727 - RNA, 23 nt, Homo sapiens
ccgacugccccugcugugcugcu

SEQ ID NO: 663728 - RNA, 18 nt, Homo sapiens
ccgacuuccccugggcaa

SEQ ID NO: 663729 - RNA, 19 nt, Homo sapiens
ccgacuuuccauugauuca

SEQ ID NO: 663730 - RNA, 12 nt, Homo sapiens
ccgagaagaaca

SEQ ID NO: 663731 - RNA, 18 nt, Homo sapiens
ccgagaagggggugacag

SEQ ID NO: 663732 - RNA, 21 nt, Homo sapiens
ccgagaauauucaaaauucca

SEQ ID NO: 663733 - RNA, 16 nt, Homo sapiens
ccgagauagugcugga

SEQ ID NO: 663734 - RNA, 12 nt, Homo sapiens
ccgagcaaagau

SEQ ID NO: 663735 - RNA, 23 nt, Homo sapiens
ccgagcccagcuacauuccucag

SEQ ID NO: 663736 - RNA, 22 nt, Homo sapiens
ccgagcucagggcagcugugcu

SEQ ID NO: 663737 - RNA, 20 nt, Homo sapiens
ccgagcugggggccaugagc

SEQ ID NO: 663738 - RNA, 22 nt, Homo sapiens
ccgagcuuugaaaauucagugg

SEQ ID NO: 663739 - RNA, 14 nt, Homo sapiens
ccgaggaagcacag

SEQ ID NO: 663740 - RNA, 14 nt, Homo sapiens
ccgaggacuuugau

SEQ ID NO: 663741 - RNA, 20 nt, Homo sapiens
ccgaggagcaggagugcuca

SEQ ID NO: 663742 - RNA, 15 nt, Homo sapiens
ccgagggauggugcc

SEQ ID NO: 663743 - RNA, 15 nt, Homo sapiens
ccgagucucuucucc

SEQ ID NO: 663744 - RNA, 18 nt, Homo sapiens
ccgaguggccauggcaug

SEQ ID NO: 663745 - RNA, 18 nt, Homo sapiens
ccgauaaacuuucucaaa

SEQ ID NO: 663746 - RNA, 12 nt, Homo sapiens
ccgauaccaugc

SEQ ID NO: 663747 - RNA, 19 nt, Homo sapiens
ccgauauacucuagaugaa

SEQ ID NO: 663748 - RNA, 16 nt, Homo sapiens
ccgaugaacaaguuua

SEQ ID NO: 663749 - RNA, 20 nt, Homo sapiens
ccgaugcaggggauggugug

SEQ ID NO: 663750 - RNA, 13 nt, Homo sapiens
ccgauucucugcc

SEQ ID NO: 663751 - RNA, 19 nt, Homo sapiens
ccgcaaaagacaagucuuu

SEQ ID NO: 663752 - RNA, 17 nt, Homo sapiens
ccgcaaaccacacugga

SEQ ID NO: 663753 - RNA, 22 nt, Homo sapiens
ccgcaauguugguuucacugag

SEQ ID NO: 663754 - RNA, 23 nt, Homo sapiens
ccgcaauguugguuucacugaga

SEQ ID NO: 663755 - RNA, 12 nt, Homo sapiens
ccgcacaugcac

SEQ ID NO: 663756 - RNA, 12 nt, Homo sapiens
ccgcacuuccuu

SEQ ID NO: 663757 - RNA, 21 nt, Homo sapiens
ccgcagacggucugugugcug

SEQ ID NO: 663758 - RNA, 14 nt, Homo sapiens
ccgcagccuggcau

SEQ ID NO: 663759 - RNA, 18 nt, Homo sapiens
auuagccaaacacuguaa

SEQ ID NO: 663760 - RNA, 19 nt, Homo sapiens
auuagccauuucacucuca

SEQ ID NO: 663761 - RNA, 17 nt, Homo sapiens
auuagccgggcauggug

SEQ ID NO: 663762 - RNA, 20 nt, Homo sapiens
auuagccgggcaugguggca

SEQ ID NO: 663763 - RNA, 19 nt, Homo sapiens
auuagccgucccagugaaa

SEQ ID NO: 663764 - RNA, 15 nt, Homo sapiens
auuagcucacugaau

SEQ ID NO: 663765 - RNA, 18 nt, Homo sapiens
auuagcucacugaaucuu

SEQ ID NO: 663766 - RNA, 22 nt, Homo sapiens
auuagcucacugaaucuucacg

SEQ ID NO: 663767 - RNA, 19 nt, Homo sapiens
auuagcuuugggugccuuu

SEQ ID NO: 663768 - RNA, 15 nt, Homo sapiens
auuaggaaaauauaa

SEQ ID NO: 663769 - RNA, 15 nt, Homo sapiens
auuaggaaguguaac

SEQ ID NO: 663770 - RNA, 20 nt, Homo sapiens
auuagguagaccuugaauac

SEQ ID NO: 663771 - RNA, 15 nt, Homo sapiens
auuaggucccaucaa

SEQ ID NO: 663772 - RNA, 15 nt, Homo sapiens
auuaguaaaagugcu

SEQ ID NO: 663773 - RNA, 20 nt, Homo sapiens
auuaguaaauaugugaagaa

SEQ ID NO: 663774 - RNA, 20 nt, Homo sapiens
auuaguacuuauguugcaca

SEQ ID NO: 663775 - RNA, 19 nt, Homo sapiens
auuaguauucaggcacuga

SEQ ID NO: 663776 - RNA, 21 nt, Homo sapiens
auuaguguugaaccaaugcuu

SEQ ID NO: 663777 - RNA, 20 nt, Homo sapiens
auuaguugaaaggccucaag

SEQ ID NO: 663778 - RNA, 22 nt, Homo sapiens
auuaguuguuuagagaaugaga

SEQ ID NO: 663779 - RNA, 15 nt, Homo sapiens
auuauaaaggccagc

SEQ ID NO: 663780 - RNA, 23 nt, Homo sapiens
auuauaagggagagcugagccag

SEQ ID NO: 663781 - RNA, 17 nt, Homo sapiens
auuauaauauacuauau

SEQ ID NO: 663782 - RNA, 15 nt, Homo sapiens
auuauaccucaaugu

SEQ ID NO: 663783 - RNA, 12 nt, Homo sapiens
auuauacuugag

SEQ ID NO: 663784 - RNA, 16 nt, Homo sapiens
auuauagaauugcaca

SEQ ID NO: 663785 - RNA, 17 nt, Homo sapiens
auuauaugcacuagcaa

SEQ ID NO: 663786 - RNA, 20 nt, Homo sapiens
auuauauuaucauaucucuc

SEQ ID NO: 663787 - RNA, 14 nt, Homo sapiens
auuauauucacaga

SEQ ID NO: 663788 - RNA, 14 nt, Homo sapiens
auuauauuucuaca

SEQ ID NO: 663789 - RNA, 19 nt, Homo sapiens
auuaucacauuaaucucaa

SEQ ID NO: 663790 - RNA, 13 nt, Homo sapiens
auuaucaucugaa

SEQ ID NO: 663791 - RNA, 17 nt, Homo sapiens
auuauccuucuacuugu

SEQ ID NO: 663792 - RNA, 17 nt, Homo sapiens
auuaucgggaacagugu

SEQ ID NO: 663793 - RNA, 17 nt, Homo sapiens
auuaucuauuaucucaa

SEQ ID NO: 663794 - RNA, 22 nt, Homo sapiens
auuaucuugaauguaguauuca

SEQ ID NO: 663795 - RNA, 15 nt, Homo sapiens
auuaugaacauccaa

SEQ ID NO: 663796 - RNA, 14 nt, Homo sapiens
auuaugacaguuau

SEQ ID NO: 663797 - RNA, 16 nt, Homo sapiens
auuaugagaggcaaug

SEQ ID NO: 663798 - RNA, 17 nt, Homo sapiens
auuaugcauaaagccaa

SEQ ID NO: 663799 - RNA, 21 nt, Homo sapiens
auuaugcauauauaaguuuac

SEQ ID NO: 663800 - RNA, 23 nt, Homo sapiens
auuaugcgcuguggccacuccaa

SEQ ID NO: 663801 - RNA, 18 nt, Homo sapiens
auuauggaaacagaugaa

SEQ ID NO: 663802 - RNA, 12 nt, Homo sapiens
auuauguaaaua

SEQ ID NO: 663803 - RNA, 12 nt, Homo sapiens
auuauguacaaa

SEQ ID NO: 663804 - RNA, 16 nt, Homo sapiens
auuaugucguaaguca

SEQ ID NO: 663805 - RNA, 20 nt, Homo sapiens
auuaugucucuucugagcua

SEQ ID NO: 663806 - RNA, 19 nt, Homo sapiens
auuaugugacauuuuacau

SEQ ID NO: 663807 - RNA, 20 nt, Homo sapiens
auuauguuuccuaacuguga

SEQ ID NO: 663808 - RNA, 18 nt, Homo sapiens
auuauuauucuucauaac

SEQ ID NO: 663809 - RNA, 13 nt, Homo sapiens
auuauuauuucca

SEQ ID NO: 663810 - RNA, 15 nt, Homo sapiens
auuauucaaaaacau

SEQ ID NO: 663811 - RNA, 13 nt, Homo sapiens
auuauucaucucu

SEQ ID NO: 663812 - RNA, 23 nt, Homo sapiens
auuauucauuagggaaaugcaag

SEQ ID NO: 663813 - RNA, 13 nt, Homo sapiens
auuauuccaaagu

SEQ ID NO: 663814 - RNA, 17 nt, Homo sapiens
auuauuccaagccuuau

SEQ ID NO: 663815 - RNA, 21 nt, Homo sapiens
auuauuccucagauugcugaa

SEQ ID NO: 663816 - RNA, 23 nt, Homo sapiens
auuauucugggcaccacaaaaua

SEQ ID NO: 663817 - RNA, 14 nt, Homo sapiens
auuauugacacuga

SEQ ID NO: 663818 - RNA, 16 nt, Homo sapiens
auuauugugacuucac

SEQ ID NO: 663819 - RNA, 23 nt, Homo sapiens
auuauuuacugacauauaucuau

SEQ ID NO: 663820 - RNA, 19 nt, Homo sapiens
auuauuuauugcuguguaa

SEQ ID NO: 663821 - RNA, 22 nt, Homo sapiens
auuauuucacuuuagaugcuga

SEQ ID NO: 663822 - RNA, 16 nt, Homo sapiens
auuauuugcuuaugaa

SEQ ID NO: 663823 - RNA, 19 nt, Homo sapiens
auucaaaaacauaacugag

SEQ ID NO: 663824 - RNA, 19 nt, Homo sapiens
auucaaaaauuaucuauag

SEQ ID NO: 663825 - RNA, 14 nt, Homo sapiens
auucaaaagaucaa

SEQ ID NO: 663826 - RNA, 13 nt, Homo sapiens
auucaaagcagca

SEQ ID NO: 663827 - RNA, 22 nt, Homo sapiens
auucaaauguuuuaaaguuuaa

SEQ ID NO: 663828 - RNA, 16 nt, Homo sapiens
auucaaauugcugcuu

SEQ ID NO: 663829 - RNA, 20 nt, Homo sapiens
auucaaauuuuaucuccaga

SEQ ID NO: 663830 - RNA, 21 nt, Homo sapiens
auucaaauuuuaucuccagau

SEQ ID NO: 663831 - RNA, 13 nt, Homo sapiens
auucaacaaauau

SEQ ID NO: 663832 - RNA, 21 nt, Homo sapiens
auucaacaucaaaacuuaaga

SEQ ID NO: 663833 - RNA, 16 nt, Homo sapiens
auucaacucuccaaug

SEQ ID NO: 663834 - RNA, 22 nt, Homo sapiens
auucaacugccauguuuugcca

SEQ ID NO: 663835 - RNA, 14 nt, Homo sapiens
auucaagaaugcca

SEQ ID NO: 663836 - RNA, 20 nt, Homo sapiens
ccuaaauauccaaagacugu

SEQ ID NO: 663837 - RNA, 14 nt, Homo sapiens
ccuaaauguuaacu

SEQ ID NO: 663838 - RNA, 17 nt, Homo sapiens
ccuaacacacuccaaga

SEQ ID NO: 663839 - RNA, 19 nt, Homo sapiens
ccuaacauaacacuaaaug

SEQ ID NO: 663840 - RNA, 15 nt, Homo sapiens
ccuaaccucauuccc

SEQ ID NO: 663841 - RNA, 23 nt, Homo sapiens
ccuaaccucuuuucugcaucauc

SEQ ID NO: 663842 - RNA, 14 nt, Homo sapiens
ccuaacugcaaugu

SEQ ID NO: 663843 - RNA, 20 nt, Homo sapiens
ccuaacuuuucuacguauaa

SEQ ID NO: 663844 - RNA, 17 nt, Homo sapiens
ccuaagacuuauguauu

SEQ ID NO: 663845 - RNA, 23 nt, Homo sapiens
ccuaagagauuuaucuuuauaca

SEQ ID NO: 663846 - RNA, 14 nt, Homo sapiens
ccuaagaugaagcu

SEQ ID NO: 663847 - RNA, 13 nt, Homo sapiens
ccuaagcaaaaag

SEQ ID NO: 663848 - RNA, 22 nt, Homo sapiens
ccuaagcacuuuauaaauauca

SEQ ID NO: 663849 - RNA, 18 nt, Homo sapiens
ccuaagcagaccacugau

SEQ ID NO: 663850 - RNA, 17 nt, Homo sapiens
ccuaagcauguguccca

SEQ ID NO: 663851 - RNA, 19 nt, Homo sapiens
ccuaaggacaagacacuga

SEQ ID NO: 663852 - RNA, 18 nt, Homo sapiens
ccuaaguuuacuucucua

SEQ ID NO: 663853 - RNA, 23 nt, Homo sapiens
ccuaauauuuuguucugcaaauu

SEQ ID NO: 663854 - RNA, 15 nt, Homo sapiens
ccuaaucacucugag

SEQ ID NO: 663855 - RNA, 19 nt, Homo sapiens
ccuaaugcuuuauccauca

SEQ ID NO: 663856 - RNA, 18 nt, Homo sapiens
ccuaauuccacagcugcu

SEQ ID NO: 663857 - RNA, 14 nt, Homo sapiens
ccuaauucuuguag

SEQ ID NO: 663858 - RNA, 22 nt, Homo sapiens
ccuaauucuuguagaugcauua

SEQ ID NO: 663859 - RNA, 23 nt, Homo sapiens
ccuaauuuuguacauacuguauu

SEQ ID NO: 663860 - RNA, 19 nt, Homo sapiens
ccuacaauguuguauuugu

SEQ ID NO: 663861 - RNA, 21 nt, Homo sapiens
ccuacagcaaguuugacacaa

SEQ ID NO: 663862 - RNA, 18 nt, Homo sapiens
ccuacagcacuacugggu

SEQ ID NO: 663863 - RNA, 23 nt, Homo sapiens
ccuacagucaucugccaccacac

SEQ ID NO: 663864 - RNA, 23 nt, Homo sapiens
ccuacaguugaaaaacagcugag

SEQ ID NO: 663865 - RNA, 16 nt, Homo sapiens
ccuacauccagcuccu

SEQ ID NO: 663866 - RNA, 16 nt, Homo sapiens
ccuacaugacacaguu

SEQ ID NO: 663867 - RNA, 20 nt, Homo sapiens
ccuacaugucuuuucuucca

SEQ ID NO: 663868 - RNA, 11 nt, Homo sapiens
ccuacauuccc

SEQ ID NO: 663869 - RNA, 15 nt, Homo sapiens
ccuacauucuuuauu

SEQ ID NO: 663870 - RNA, 14 nt, Homo sapiens
ccuaccacaguguc

SEQ ID NO: 663871 - RNA, 21 nt, Homo sapiens
ccuacccaaugucucccacac

SEQ ID NO: 663872 - RNA, 15 nt, Homo sapiens
ccuacccacaugcac

SEQ ID NO: 663873 - RNA, 19 nt, Homo sapiens
ccuacccaccgauggagcc

SEQ ID NO: 663874 - RNA, 22 nt, Homo sapiens
ccuacccuccuuccacauguac

SEQ ID NO: 663875 - RNA, 18 nt, Homo sapiens
ccuacccugcaacuucua

SEQ ID NO: 663876 - RNA, 22 nt, Homo sapiens
ccuacccugccucccuugacuu

SEQ ID NO: 663877 - RNA, 15 nt, Homo sapiens
ccuacccuucccgcc

SEQ ID NO: 663878 - RNA, 19 nt, Homo sapiens
ccuaccguacucccugcac

SEQ ID NO: 663879 - RNA, 17 nt, Homo sapiens
ccuacgcagaugcuguc

SEQ ID NO: 663880 - RNA, 17 nt, Homo sapiens
ccuacgugacaacacaa

SEQ ID NO: 663881 - RNA, 17 nt, Homo sapiens
ccuacuccgcucacuga

SEQ ID NO: 663882 - RNA, 21 nt, Homo sapiens
ccuacuccguuccuggcauuu

SEQ ID NO: 663883 - RNA, 22 nt, Homo sapiens
ccuacuccguuccuggcauuug

SEQ ID NO: 663884 - RNA, 14 nt, Homo sapiens
ccuacugcacugag

SEQ ID NO: 663885 - RNA, 14 nt, Homo sapiens
ccuacugcccacau

SEQ ID NO: 663886 - RNA, 16 nt, Homo sapiens
ccuacuucuuuugcuc

SEQ ID NO: 663887 - RNA, 16 nt, Homo sapiens
ccuacuuugacuuuuu

SEQ ID NO: 663888 - RNA, 19 nt, Homo sapiens
ccuacuuugacuuuuugca

SEQ ID NO: 663889 - RNA, 20 nt, Homo sapiens
ccuagaaaggaacugcaaua

SEQ ID NO: 663890 - RNA, 21 nt, Homo sapiens
ccuagaaaggaacugcaauaa

SEQ ID NO: 663891 - RNA, 19 nt, Homo sapiens
ccuagacaaacaagggaga

SEQ ID NO: 663892 - RNA, 16 nt, Homo sapiens
ccuagaccugggcucc

SEQ ID NO: 663893 - RNA, 13 nt, Homo sapiens
ccuagacuuccca

SEQ ID NO: 663894 - RNA, 22 nt, Homo sapiens
ccuagagaaggcugugagccaa

SEQ ID NO: 663895 - RNA, 17 nt, Homo sapiens
ccuagagcuagaugugu

SEQ ID NO: 663896 - RNA, 20 nt, Homo sapiens
ccuagauguuuaacaaaucu

SEQ ID NO: 663897 - RNA, 20 nt, Homo sapiens
ccuagcaaccuccacauguu

SEQ ID NO: 663898 - RNA, 20 nt, Homo sapiens
ccuagcacuuugggaggcca

SEQ ID NO: 663899 - RNA, 21 nt, Homo sapiens
ccuagcacuuugggaggccaa

SEQ ID NO: 663900 - RNA, 14 nt, Homo sapiens
ccuagcaugaacuu

SEQ ID NO: 663901 - RNA, 15 nt, Homo sapiens
ccuagcauugcacuu

SEQ ID NO: 663902 - RNA, 18 nt, Homo sapiens
ccuagccaaugucuccuc

SEQ ID NO: 663903 - RNA, 15 nt, Homo sapiens
ccuagccaauucaca

SEQ ID NO: 663904 - RNA, 11 nt, Homo sapiens
ccuagccagag

SEQ ID NO: 663905 - RNA, 17 nt, Homo sapiens
ccuagccccucucucac

SEQ ID NO: 663906 - RNA, 17 nt, Homo sapiens
ccuagcccuucucucau

SEQ ID NO: 663907 - RNA, 15 nt, Homo sapiens
ccuagccgaccucag

SEQ ID NO: 663908 - RNA, 21 nt, Homo sapiens
ccuagcugcccacagagggca

SEQ ID NO: 663909 - RNA, 21 nt, Homo sapiens
ccuagcuggcucugugagggu

SEQ ID NO: 663910 - RNA, 21 nt, Homo sapiens
ccuagcugguagcauaaauaa

SEQ ID NO: 663911 - RNA, 13 nt, Homo sapiens
ccuagcuguccca

SEQ ID NO: 663912 - RNA, 16 nt, Homo sapiens
ccuaggaaaccagcuc

SEQ ID NO: 663913 - RNA, 15 nt, Homo sapiens
ccuaggauacccaga

SEQ ID NO: 663914 - RNA, 17 nt, Homo sapiens
ccuaggcauuugcugaa

SEQ ID NO: 663915 - RNA, 14 nt, Homo sapiens
ccuaggggacacuu

SEQ ID NO: 663916 - RNA, 17 nt, Homo sapiens
ccuaggggacacuuccc

SEQ ID NO: 663917 - RNA, 22 nt, Homo sapiens
ccuagguaggcaccacagagaa

SEQ ID NO: 663918 - RNA, 17 nt, Homo sapiens
ccuagguauuuacccaa

SEQ ID NO: 663919 - RNA, 22 nt, Homo sapiens
ccuaguaagggaacuauggaaa

SEQ ID NO: 663920 - RNA, 22 nt, Homo sapiens
ccuaguauaucagugacaguug

SEQ ID NO: 663921 - RNA, 14 nt, Homo sapiens
ccuaguuugcacua

SEQ ID NO: 663922 - RNA, 19 nt, Homo sapiens
ccuauaaauggaccauccu

SEQ ID NO: 663923 - RNA, 22 nt, Homo sapiens
ccuauaagcaugacauacuuuu

SEQ ID NO: 663924 - RNA, 15 nt, Homo sapiens
ccuauacucuauaac

SEQ ID NO: 663925 - RNA, 20 nt, Homo sapiens
ccuauagucccagcuacuca

SEQ ID NO: 663926 - RNA, 18 nt, Homo sapiens
ccuauauugcauuaauuu

SEQ ID NO: 663927 - RNA, 16 nt, Homo sapiens
ccuauauuguuuucag

SEQ ID NO: 663928 - RNA, 18 nt, Homo sapiens
ccuaucaguuauuaauuu

SEQ ID NO: 663929 - RNA, 14 nt, Homo sapiens
ccuaucauguuaac

SEQ ID NO: 663930 - RNA, 12 nt, Homo sapiens
ccuaucuuuaaa

SEQ ID NO: 663931 - RNA, 15 nt, Homo sapiens
ccuaugaaauuucaa

SEQ ID NO: 663932 - RNA, 15 nt, Homo sapiens
ccuaugaaguagcaa

SEQ ID NO: 663933 - RNA, 22 nt, Homo sapiens
ccuaugaaguuggcacauuuca

SEQ ID NO: 663934 - RNA, 12 nt, Homo sapiens
ccuaugauccca

SEQ ID NO: 663935 - RNA, 22 nt, Homo sapiens
ccuaugauggauggcagacucu

SEQ ID NO: 663936 - RNA, 19 nt, Homo sapiens
ccuaugcagacaucucugg

SEQ ID NO: 663937 - RNA, 17 nt, Homo sapiens
ccuaugcuauugacaau

SEQ ID NO: 663938 - RNA, 15 nt, Homo sapiens
ccuaugggaaguagu

SEQ ID NO: 663939 - RNA, 20 nt, Homo sapiens
ccuaugggucuaggacacag

SEQ ID NO: 663940 - RNA, 15 nt, Homo sapiens
ccuauguccuaagga

SEQ ID NO: 663941 - RNA, 22 nt, Homo sapiens
ccuauguuugcggaaugcauug

SEQ ID NO: 663942 - RNA, 14 nt, Homo sapiens
ccuauuaucagaag

SEQ ID NO: 663943 - RNA, 21 nt, Homo sapiens
ccuauucccucucucucccag

SEQ ID NO: 663944 - RNA, 19 nt, Homo sapiens
ccuauuuagaaauggauuu

SEQ ID NO: 663945 - RNA, 20 nt, Homo sapiens
ccuauuuaugaaaaccauau

SEQ ID NO: 663946 - RNA, 15 nt, Homo sapiens
ccuauuuucauuccu

SEQ ID NO: 663947 - RNA, 17 nt, Homo sapiens
ccuauuuucuuuuccau

SEQ ID NO: 663948 - RNA, 11 nt, Homo sapiens
ccucaaaagac

SEQ ID NO: 663949 - RNA, 18 nt, Homo sapiens
ccucaaaccagucacuuu

SEQ ID NO: 663950 - RNA, 12 nt, Homo sapiens
ccucaaacugca

SEQ ID NO: 663951 - RNA, 22 nt, Homo sapiens
ccucaaaguuggggcaggcugg

SEQ ID NO: 663952 - RNA, 22 nt, Homo sapiens
ccucaaaugacccaaagaccaa

SEQ ID NO: 663953 - RNA, 14 nt, Homo sapiens
ccucaacaagaaga

SEQ ID NO: 663954 - RNA, 22 nt, Homo sapiens
ccucaacaucacacaguauacu

SEQ ID NO: 663955 - RNA, 20 nt, Homo sapiens
ccucaagccccauuuccuca

SEQ ID NO: 663956 - RNA, 14 nt, Homo sapiens
ccucaagugagcca

SEQ ID NO: 663957 - RNA, 21 nt, Homo sapiens
ccucaaguucuuggaccaguu

SEQ ID NO: 663958 - RNA, 15 nt, Homo sapiens
auucaagaaugccag

SEQ ID NO: 663959 - RNA, 14 nt, Homo sapiens
auucaagcauuuag

SEQ ID NO: 663960 - RNA, 12 nt, Homo sapiens
auucaaggccuu

SEQ ID NO: 663961 - RNA, 12 nt, Homo sapiens
auucaaggggag

SEQ ID NO: 663962 - RNA, 18 nt, Homo sapiens
auucacaaaauuuccaca

SEQ ID NO: 663963 - RNA, 13 nt, Homo sapiens
auucacaaauggg

SEQ ID NO: 663964 - RNA, 23 nt, Homo sapiens
auucacaaaugggaucuaauuaa

SEQ ID NO: 663965 - RNA, 20 nt, Homo sapiens
auucacaagcuaacuuccac

SEQ ID NO: 663966 - RNA, 21 nt, Homo sapiens
auucacaauagaaacucacca

SEQ ID NO: 663967 - RNA, 19 nt, Homo sapiens
auucacagaauagcacaaa

SEQ ID NO: 663968 - RNA, 21 nt, Homo sapiens
auucacagcccagaaccacag

SEQ ID NO: 663969 - RNA, 21 nt, Homo sapiens
auucacaguaauaugguuccc

SEQ ID NO: 663970 - RNA, 14 nt, Homo sapiens
auucacagugcucu

SEQ ID NO: 663971 - RNA, 17 nt, Homo sapiens
auucacauauaucaaag

SEQ ID NO: 663972 - RNA, 12 nt, Homo sapiens
auucacauuuag

SEQ ID NO: 663973 - RNA, 16 nt, Homo sapiens
auucacauuugaugua

SEQ ID NO: 663974 - RNA, 13 nt, Homo sapiens
auucaccaaaaua

SEQ ID NO: 663975 - RNA, 23 nt, Homo sapiens
auucacgcuguuuguuucauaua

SEQ ID NO: 663976 - RNA, 15 nt, Homo sapiens
auucacuaaggacuu

SEQ ID NO: 663977 - RNA, 16 nt, Homo sapiens
auucacuaaggacuua

SEQ ID NO: 663978 - RNA, 13 nt, Homo sapiens
auucacuacaggu

SEQ ID NO: 663979 - RNA, 12 nt, Homo sapiens
auucacugugca

SEQ ID NO: 663980 - RNA, 16 nt, Homo sapiens
auucacuugcauuucu

SEQ ID NO: 663981 - RNA, 20 nt, Homo sapiens
auucagaaaagaugugcaga

SEQ ID NO: 663982 - RNA, 17 nt, Homo sapiens
auucagaaagcuucaaa

SEQ ID NO: 663983 - RNA, 15 nt, Homo sapiens
auucagaacuauuua

SEQ ID NO: 663984 - RNA, 19 nt, Homo sapiens
auucagacaaaauggauac

SEQ ID NO: 663985 - RNA, 18 nt, Homo sapiens
auucagcaaaaaucuccc

SEQ ID NO: 663986 - RNA, 22 nt, Homo sapiens
auucagcaaaaaucucccagug

SEQ ID NO: 663987 - RNA, 13 nt, Homo sapiens
auucagcacuuaa

SEQ ID NO: 663988 - RNA, 22 nt, Homo sapiens
auucagcauuauuccuccagga

SEQ ID NO: 663989 - RNA, 15 nt, Homo sapiens
auucagccagcuuaa

SEQ ID NO: 663990 - RNA, 16 nt, Homo sapiens
auucagccagcuuaaa

SEQ ID NO: 663991 - RNA, 13 nt, Homo sapiens
auucagccuuuag

SEQ ID NO: 663992 - RNA, 15 nt, Homo sapiens
auucagccuuuagaa

SEQ ID NO: 663993 - RNA, 18 nt, Homo sapiens
auucagcgggagcacugc

SEQ ID NO: 663994 - RNA, 23 nt, Homo sapiens
auucagcguuauuuaagcacaua

SEQ ID NO: 663995 - RNA, 18 nt, Homo sapiens
auucaggacuccaaccaa

SEQ ID NO: 663996 - RNA, 17 nt, Homo sapiens
auucaggcaacgcacaa

SEQ ID NO: 663997 - RNA, 18 nt, Homo sapiens
auucaggcuacucauuca

SEQ ID NO: 663998 - RNA, 14 nt, Homo sapiens
auucagguaauaca

SEQ ID NO: 663999 - RNA, 21 nt, Homo sapiens
auucaguaugauuuauccuca

SEQ ID NO: 664000 - RNA, 12 nt, Homo sapiens
auucaguguuaa

SEQ ID NO: 664001 - RNA, 17 nt, Homo sapiens
auucauagucuuuggag

SEQ ID NO: 664002 - RNA, 14 nt, Homo sapiens
auucauaguggauu

SEQ ID NO: 664003 - RNA, 20 nt, Homo sapiens
auucauauaggccagaguug

SEQ ID NO: 664004 - RNA, 21 nt, Homo sapiens
auucauauuaagacaguguac

SEQ ID NO: 664005 - RNA, 12 nt, Homo sapiens
auucaucucucc

SEQ ID NO: 664006 - RNA, 12 nt, Homo sapiens
auucaucucugg

SEQ ID NO: 664007 - RNA, 14 nt, Homo sapiens
auucaucuuuucau

SEQ ID NO: 664008 - RNA, 16 nt, Homo sapiens
auucaugaaaugugga

SEQ ID NO: 664009 - RNA, 22 nt, Homo sapiens
auucaugccagggacugacaaa

SEQ ID NO: 664010 - RNA, 22 nt, Homo sapiens
auucaugugggcauuucuugcg

SEQ ID NO: 664011 - RNA, 15 nt, Homo sapiens
auucauuauuccuca

SEQ ID NO: 664012 - RNA, 22 nt, Homo sapiens
auucauuauuuuuccacuuugu

SEQ ID NO: 664013 - RNA, 15 nt, Homo sapiens
auucauugugauuua

SEQ ID NO: 664014 - RNA, 20 nt, Homo sapiens
auucauuuaaaaugauuaga

SEQ ID NO: 664015 - RNA, 22 nt, Homo sapiens
auucauuuuuaagauagaacac

SEQ ID NO: 664016 - RNA, 23 nt, Homo sapiens
auucauuuuucuuucugauguca

SEQ ID NO: 664017 - RNA, 13 nt, Homo sapiens
auuccaaagcaaa

SEQ ID NO: 664018 - RNA, 14 nt, Homo sapiens
auuccaacuugaag

SEQ ID NO: 664019 - RNA, 17 nt, Homo sapiens
auuccaacuugaaggau

SEQ ID NO: 664020 - RNA, 19 nt, Homo sapiens
auuccaaggaguuccauga

SEQ ID NO: 664021 - RNA, 13 nt, Homo sapiens
auuccaagucaac

SEQ ID NO: 664022 - RNA, 14 nt, Homo sapiens
auuccacagauuau

SEQ ID NO: 664023 - RNA, 15 nt, Homo sapiens
auuccaccaaaugug

SEQ ID NO: 664024 - RNA, 14 nt, Homo sapiens
auuccaccaagaca

SEQ ID NO: 664025 - RNA, 13 nt, Homo sapiens
auuccacugaaaa

SEQ ID NO: 664026 - RNA, 18 nt, Homo sapiens
auuccacuuuuauucauu

SEQ ID NO: 664027 - RNA, 23 nt, Homo sapiens
auuccagaacaaaucauuauguu

SEQ ID NO: 664028 - RNA, 23 nt, Homo sapiens
auuccagaagaacaacuuuagca

SEQ ID NO: 664029 - RNA, 20 nt, Homo sapiens
auuccagagaagccaggaag

SEQ ID NO: 664030 - RNA, 20 nt, Homo sapiens
auuccagucaaaucugggcu

SEQ ID NO: 664031 - RNA, 18 nt, Homo sapiens
auuccagucacaguuuuu

SEQ ID NO: 664032 - RNA, 21 nt, Homo sapiens
auuccagugguucugcuucaa

SEQ ID NO: 664033 - RNA, 14 nt, Homo sapiens
auucccaagcuuuu

SEQ ID NO: 664034 - RNA, 18 nt, Homo sapiens
auucccaagcuuuuggag

SEQ ID NO: 664035 - RNA, 23 nt, Homo sapiens
auucccaucuuuacucccaagac

SEQ ID NO: 664036 - RNA, 17 nt, Homo sapiens
auucccauguugucaau

SEQ ID NO: 664037 - RNA, 15 nt, Homo sapiens
auucccauuggcucc

SEQ ID NO: 664038 - RNA, 21 nt, Homo sapiens
auucccauuggcucccugugu

SEQ ID NO: 664039 - RNA, 18 nt, Homo sapiens
auuccccauuuccuguac

SEQ ID NO: 664040 - RNA, 16 nt, Homo sapiens
auuccccugugucauc

SEQ ID NO: 664041 - RNA, 22 nt, Homo sapiens
auucccgacgacacauauacau

SEQ ID NO: 664042 - RNA, 22 nt, Homo sapiens
auucccuaaagacuaacuugaa

SEQ ID NO: 664043 - RNA, 18 nt, Homo sapiens
auucccugucacuacaca

SEQ ID NO: 664044 - RNA, 11 nt, Homo sapiens
auucccugugu

SEQ ID NO: 664045 - RNA, 19 nt, Homo sapiens
auucccuuggauguagucu

SEQ ID NO: 664046 - RNA, 14 nt, Homo sapiens
auuccgauacaaag

SEQ ID NO: 664047 - RNA, 13 nt, Homo sapiens
auuccgucuuaaa

SEQ ID NO: 664048 - RNA, 23 nt, Homo sapiens
auuccuagaaauugaacaaaaau

SEQ ID NO: 664049 - RNA, 19 nt, Homo sapiens
auuccuauuggaaacagag

SEQ ID NO: 664050 - RNA, 15 nt, Homo sapiens
auuccucagcugcca

SEQ ID NO: 664051 - RNA, 12 nt, Homo sapiens
auuccucuugcc

SEQ ID NO: 664052 - RNA, 13 nt, Homo sapiens
auuccugauaaua

SEQ ID NO: 664053 - RNA, 21 nt, Homo sapiens
auuccugauggaaaaugcaaa

SEQ ID NO: 664054 - RNA, 19 nt, Homo sapiens
auuccugcccaaacagcug

SEQ ID NO: 664055 - RNA, 22 nt, Homo sapiens
auuccugccuuuaagccaaaga

SEQ ID NO: 664056 - RNA, 15 nt, Homo sapiens
auuccuggcaugaca

SEQ ID NO: 664057 - RNA, 20 nt, Homo sapiens
auuccugggccuguccccca

SEQ ID NO: 664058 - RNA, 22 nt, Homo sapiens
auuccugguggauacuguagaa

SEQ ID NO: 664059 - RNA, 21 nt, Homo sapiens
auuccugguguagcacuuaac

SEQ ID NO: 664060 - RNA, 17 nt, Homo sapiens
auuccugguuugacuca

SEQ ID NO: 664061 - RNA, 14 nt, Homo sapiens
auuccuguuuccau

SEQ ID NO: 664062 - RNA, 14 nt, Homo sapiens
auuccuuacuugca

SEQ ID NO: 664063 - RNA, 18 nt, Homo sapiens
auuccuucacucauccag

SEQ ID NO: 664064 - RNA, 13 nt, Homo sapiens
auuccuuccaucu

SEQ ID NO: 664065 - RNA, 15 nt, Homo sapiens
auuccuugguaauau

SEQ ID NO: 664066 - RNA, 23 nt, Homo sapiens
auuccuugucaccagcaacaucu

SEQ ID NO: 664067 - RNA, 18 nt, Homo sapiens
auuccuuucucaucccac

SEQ ID NO: 664068 - RNA, 15 nt, Homo sapiens
auuccuuugcauauu

SEQ ID NO: 664069 - RNA, 16 nt, Homo sapiens
auuccuuugucuucaa

SEQ ID NO: 664070 - RNA, 15 nt, Homo sapiens
auucgaaugacacug

SEQ ID NO: 664071 - RNA, 23 nt, Homo sapiens
auucgcccacccgaguaccucca

SEQ ID NO: 664072 - RNA, 17 nt, Homo sapiens
auucgugacaacaugcg

SEQ ID NO: 664073 - RNA, 18 nt, Homo sapiens
auucuaaauaaugcaaac

SEQ ID NO: 664074 - RNA, 16 nt, Homo sapiens
auucuaacaagucaua

SEQ ID NO: 664075 - RNA, 18 nt, Homo sapiens
auucuaaguuauuuacuu

SEQ ID NO: 664076 - RNA, 21 nt, Homo sapiens
auucuaaguuauuuacuuuua

SEQ ID NO: 664077 - RNA, 22 nt, Homo sapiens
auucuaauaaauauacuaugaa

SEQ ID NO: 664078 - RNA, 18 nt, Homo sapiens
auucuaauggggacacag

SEQ ID NO: 664079 - RNA, 18 nt, Homo sapiens
auucuaccugaggccagg

SEQ ID NO: 664080 - RNA, 16 nt, Homo sapiens
auucuacuagcaggca

SEQ ID NO: 664081 - RNA, 20 nt, Homo sapiens
ccucaaucuauucuguaaaa

SEQ ID NO: 664082 - RNA, 13 nt, Homo sapiens
ccucaaugugacc

SEQ ID NO: 664083 - RNA, 14 nt, Homo sapiens
ccucacaagcauga

SEQ ID NO: 664084 - RNA, 23 nt, Homo sapiens
ccucacaugugacaaagggccag

SEQ ID NO: 664085 - RNA, 21 nt, Homo sapiens
ccucacccccagguguugcca

SEQ ID NO: 664086 - RNA, 22 nt, Homo sapiens
ccucaccuagccugaugagauu

SEQ ID NO: 664087 - RNA, 14 nt, Homo sapiens
ccucaccugggcag

SEQ ID NO: 664088 - RNA, 17 nt, Homo sapiens
ccucacgugucucagau

SEQ ID NO: 664089 - RNA, 23 nt, Homo sapiens
ccucacuaaaaaggaaacuucag

SEQ ID NO: 664090 - RNA, 12 nt, Homo sapiens
ccucacugggug

SEQ ID NO: 664091 - RNA, 18 nt, Homo sapiens
ccucacuugauucaucuc

SEQ ID NO: 664092 - RNA, 14 nt, Homo sapiens
ccucagaaagggau

SEQ ID NO: 664093 - RNA, 21 nt, Homo sapiens
ccucagaaagggauugcuuug

SEQ ID NO: 664094 - RNA, 15 nt, Homo sapiens
ccucagaacuuucua

SEQ ID NO: 664095 - RNA, 20 nt, Homo sapiens
ccucagaaggccccagagag

SEQ ID NO: 664096 - RNA, 17 nt, Homo sapiens
ccucagacguugccuga

SEQ ID NO: 664097 - RNA, 19 nt, Homo sapiens
ccucagacuucaagaccau

SEQ ID NO: 664098 - RNA, 20 nt, Homo sapiens
ccucagacuucaagaccauc

SEQ ID NO: 664099 - RNA, 17 nt, Homo sapiens
ccucagagcucuuaugu

SEQ ID NO: 664100 - RNA, 14 nt, Homo sapiens
ccucagagugcaag

SEQ ID NO: 664101 - RNA, 12 nt, Homo sapiens
ccucagauucca

SEQ ID NO: 664102 - RNA, 15 nt, Homo sapiens
ccucagauuuccauu

SEQ ID NO: 664103 - RNA, 23 nt, Homo sapiens
ccucagcaauugucuacauucag

SEQ ID NO: 664104 - RNA, 21 nt, Homo sapiens
ccucagcaguccacaaagcau

SEQ ID NO: 664105 - RNA, 21 nt, Homo sapiens
ccucagccuuccaacuagcug

SEQ ID NO: 664106 - RNA, 22 nt, Homo sapiens
ccucagcuccccggcacugcag

SEQ ID NO: 664107 - RNA, 18 nt, Homo sapiens
ccucagcucucugggacc

SEQ ID NO: 664108 - RNA, 18 nt, Homo sapiens
ccucagcuucuucacagg

SEQ ID NO: 664109 - RNA, 15 nt, Homo sapiens
ccucagggacagaga

SEQ ID NO: 664110 - RNA, 13 nt, Homo sapiens
ccucagggccaag

SEQ ID NO: 664111 - RNA, 15 nt, Homo sapiens
ccucaggggacuuga

SEQ ID NO: 664112 - RNA, 14 nt, Homo sapiens
ccucagggggccag

SEQ ID NO: 664113 - RNA, 21 nt, Homo sapiens
ccucagguggccccaguucaa

SEQ ID NO: 664114 - RNA, 15 nt, Homo sapiens
ccucagguuugccug

SEQ ID NO: 664115 - RNA, 23 nt, Homo sapiens
ccucaguaaauguacaacugcac

SEQ ID NO: 664116 - RNA, 20 nt, Homo sapiens
ccucaguauuuauguaauuu

SEQ ID NO: 664117 - RNA, 13 nt, Homo sapiens
ccucagucuggca

SEQ ID NO: 664118 - RNA, 21 nt, Homo sapiens
ccucagucuggugcuccaguu

SEQ ID NO: 664119 - RNA, 13 nt, Homo sapiens
ccucagugccuuc

SEQ ID NO: 664120 - RNA, 18 nt, Homo sapiens
ccucaguuucucaaagau

SEQ ID NO: 664121 - RNA, 20 nt, Homo sapiens
ccucaguuuuaucauuuuca

SEQ ID NO: 664122 - RNA, 14 nt, Homo sapiens
ccucauacacagaa

SEQ ID NO: 664123 - RNA, 14 nt, Homo sapiens
ccucaucaucagag

SEQ ID NO: 664124 - RNA, 17 nt, Homo sapiens
ccucauccaugcacuuu

SEQ ID NO: 664125 - RNA, 18 nt, Homo sapiens
ccucaucccgagcaccuc

SEQ ID NO: 664126 - RNA, 18 nt, Homo sapiens
ccucauccuuuccugcca

SEQ ID NO: 664127 - RNA, 18 nt, Homo sapiens
ccucaucugagaggcucu

SEQ ID NO: 664128 - RNA, 15 nt, Homo sapiens
ccucaucugcaaaau

SEQ ID NO: 664129 - RNA, 13 nt, Homo sapiens
ccucaugcccagc

SEQ ID NO: 664130 - RNA, 20 nt, Homo sapiens
ccucauggaagaugcaagua

SEQ ID NO: 664131 - RNA, 23 nt, Homo sapiens
ccucauggcucuggcacagugua

SEQ ID NO: 664132 - RNA, 16 nt, Homo sapiens
ccucauggucauggac

SEQ ID NO: 664133 - RNA, 16 nt, Homo sapiens
ccucauuuauagaugu

SEQ ID NO: 664134 - RNA, 15 nt, Homo sapiens
ccuccaaaagcacuu

SEQ ID NO: 664135 - RNA, 16 nt, Homo sapiens
ccuccaaaggucugau

SEQ ID NO: 664136 - RNA, 13 nt, Homo sapiens
ccuccacaccucu

SEQ ID NO: 664137 - RNA, 23 nt, Homo sapiens
ccuccacagagaggaggggacca

SEQ ID NO: 664138 - RNA, 14 nt, Homo sapiens
ccuccacaugcugc

SEQ ID NO: 664139 - RNA, 22 nt, Homo sapiens
ccuccacaugcugccuggcaca

SEQ ID NO: 664140 - RNA, 15 nt, Homo sapiens
ccuccacccauccag

SEQ ID NO: 664141 - RNA, 16 nt, Homo sapiens
ccuccacgccauuucc

SEQ ID NO: 664142 - RNA, 19 nt, Homo sapiens
ccuccacugccucuggaau

SEQ ID NO: 664143 - RNA, 13 nt, Homo sapiens
ccuccagaacuca

SEQ ID NO: 664144 - RNA, 22 nt, Homo sapiens
ccuccagaagcagccccucgga

SEQ ID NO: 664145 - RNA, 13 nt, Homo sapiens
ccuccagccacca

SEQ ID NO: 664146 - RNA, 22 nt, Homo sapiens
ccuccagcuucaggcaggccaa

SEQ ID NO: 664147 - RNA, 17 nt, Homo sapiens
ccuccagggacaaagag

SEQ ID NO: 664148 - RNA, 16 nt, Homo sapiens
ccuccauacucaggac

SEQ ID NO: 664149 - RNA, 16 nt, Homo sapiens
ccuccaugaacaucau

SEQ ID NO: 664150 - RNA, 23 nt, Homo sapiens
ccuccaugaacaucauggacuga

SEQ ID NO: 664151 - RNA, 17 nt, Homo sapiens
ccuccauucugaccauu

SEQ ID NO: 664152 - RNA, 22 nt, Homo sapiens
ccuccauuugcaauugaccucu

SEQ ID NO: 664153 - RNA, 15 nt, Homo sapiens
ccucccaaagugcug

SEQ ID NO: 664154 - RNA, 18 nt, Homo sapiens
ccucccaaaugagccaug

SEQ ID NO: 664155 - RNA, 14 nt, Homo sapiens
ccucccaacucuaa

SEQ ID NO: 664156 - RNA, 15 nt, Homo sapiens
ccucccacacuuccc

SEQ ID NO: 664157 - RNA, 16 nt, Homo sapiens
ccucccaccaccccau

SEQ ID NO: 664158 - RNA, 13 nt, Homo sapiens
ccucccaccagag

SEQ ID NO: 664159 - RNA, 13 nt, Homo sapiens
ccucccacugagg

SEQ ID NO: 664160 - RNA, 13 nt, Homo sapiens
ccucccacuggga

SEQ ID NO: 664161 - RNA, 18 nt, Homo sapiens
ccucccagagguccagcc

SEQ ID NO: 664162 - RNA, 12 nt, Homo sapiens
ccucccagcugc

SEQ ID NO: 664163 - RNA, 23 nt, Homo sapiens
ccucccagugaccccugaccuca

SEQ ID NO: 664164 - RNA, 14 nt, Homo sapiens
ccuccccaaauggc

SEQ ID NO: 664165 - RNA, 18 nt, Homo sapiens
ccuccccaaauggcugcu

SEQ ID NO: 664166 - RNA, 17 nt, Homo sapiens
ccuccccagauaucauu

SEQ ID NO: 664167 - RNA, 21 nt, Homo sapiens
ccuccccaguagcugggauua

SEQ ID NO: 664168 - RNA, 13 nt, Homo sapiens
ccuccccaguuca

SEQ ID NO: 664169 - RNA, 16 nt, Homo sapiens
ccucccccaugggcug

SEQ ID NO: 664170 - RNA, 20 nt, Homo sapiens
ccucccccuuucacacugga

SEQ ID NO: 664171 - RNA, 15 nt, Homo sapiens
ccucccuaaugcuca

SEQ ID NO: 664172 - RNA, 16 nt, Homo sapiens
ccucccuaccaaaaau

SEQ ID NO: 664173 - RNA, 10 nt, Homo sapiens
ccucccugaa

SEQ ID NO: 664174 - RNA, 15 nt, Homo sapiens
ccucccugcaucuga

SEQ ID NO: 664175 - RNA, 17 nt, Homo sapiens
ccucccugccaccaggc

SEQ ID NO: 664176 - RNA, 17 nt, Homo sapiens
ccucccugcuugcacac

SEQ ID NO: 664177 - RNA, 20 nt, Homo sapiens
ccucccuuccccuuuuccca

SEQ ID NO: 664178 - RNA, 18 nt, Homo sapiens
ccuccgccagauccugca

SEQ ID NO: 664179 - RNA, 16 nt, Homo sapiens
ccuccgccuccaggaa

SEQ ID NO: 664180 - RNA, 16 nt, Homo sapiens
ccuccgcuuauccugc

SEQ ID NO: 664181 - RNA, 18 nt, Homo sapiens
ccuccggcgucuugccca

SEQ ID NO: 664182 - RNA, 19 nt, Homo sapiens
ccuccgucauccaugcccu

SEQ ID NO: 664183 - RNA, 13 nt, Homo sapiens
ccuccguccagcc

SEQ ID NO: 664184 - RNA, 13 nt, Homo sapiens
ccuccuaaggcuc

SEQ ID NO: 664185 - RNA, 15 nt, Homo sapiens
ccuccuagagugcag

SEQ ID NO: 664186 - RNA, 18 nt, Homo sapiens
ccuccuauggguugucac

SEQ ID NO: 664187 - RNA, 20 nt, Homo sapiens
ccuccucaggcacacagcua

SEQ ID NO: 664188 - RNA, 14 nt, Homo sapiens
ccuccuccugacca

SEQ ID NO: 664189 - RNA, 21 nt, Homo sapiens
ccuccucuacaauuugccauu

SEQ ID NO: 664190 - RNA, 22 nt, Homo sapiens
ccuccucuucccuuagccucuc

SEQ ID NO: 664191 - RNA, 14 nt, Homo sapiens
ccuccucuugacuu

SEQ ID NO: 664192 - RNA, 12 nt, Homo sapiens
ccuccugaaccg

SEQ ID NO: 664193 - RNA, 23 nt, Homo sapiens
ccuccugacaacgucucuucaag

SEQ ID NO: 664194 - RNA, 14 nt, Homo sapiens
ccuccugaccucaa

SEQ ID NO: 664195 - RNA, 22 nt, Homo sapiens
ccuccugcaaaccucacagggu

SEQ ID NO: 664196 - RNA, 22 nt, Homo sapiens
ccuccugcuaacuccuagcuga

SEQ ID NO: 664197 - RNA, 18 nt, Homo sapiens
ccuccugcuggcucucuc

SEQ ID NO: 664198 - RNA, 17 nt, Homo sapiens
ccuccuggaaucaguau

SEQ ID NO: 664199 - RNA, 13 nt, Homo sapiens
ccuccuggcagcc

SEQ ID NO: 664200 - RNA, 23 nt, Homo sapiens
ccuccugggcccacaacagcgug

SEQ ID NO: 664201 - RNA, 22 nt, Homo sapiens
ccuccuguaaaugguguacaua

SEQ ID NO: 664202 - RNA, 16 nt, Homo sapiens
ccuccuguauuccuga

SEQ ID NO: 664203 - RNA, 18 nt, Homo sapiens
ccuccuuagaccugaggg

SEQ ID NO: 664204 - RNA, 14 nt, Homo sapiens
auucuacugaacag

SEQ ID NO: 664205 - RNA, 21 nt, Homo sapiens
auucuacuuuaagcacuacau

SEQ ID NO: 664206 - RNA, 13 nt, Homo sapiens
auucuaggcaucc

SEQ ID NO: 664207 - RNA, 20 nt, Homo sapiens
auucuagugaaugaaucuca

SEQ ID NO: 664208 - RNA, 14 nt, Homo sapiens
auucuagugcugcu

SEQ ID NO: 664209 - RNA, 19 nt, Homo sapiens
auucuauuacgugcaauac

SEQ ID NO: 664210 - RNA, 13 nt, Homo sapiens
auucuauuccaug

SEQ ID NO: 664211 - RNA, 21 nt, Homo sapiens
auucuauuuauauguacauga

SEQ ID NO: 664212 - RNA, 22 nt, Homo sapiens
auucuauuuuauaaaacaaaua

SEQ ID NO: 664213 - RNA, 14 nt, Homo sapiens
auucucacuccuac

SEQ ID NO: 664214 - RNA, 19 nt, Homo sapiens
auucucaucaguccauugc

SEQ ID NO: 664215 - RNA, 13 nt, Homo sapiens
auucuccaguauu

SEQ ID NO: 664216 - RNA, 17 nt, Homo sapiens
auucucccuuucacuaa

SEQ ID NO: 664217 - RNA, 15 nt, Homo sapiens
auucucugcaauuug

SEQ ID NO: 664218 - RNA, 16 nt, Homo sapiens
auucucugcugcaucu

SEQ ID NO: 664219 - RNA, 17 nt, Homo sapiens
auucucuuaaucacuac

SEQ ID NO: 664220 - RNA, 22 nt, Homo sapiens
auucucuuaaucacuacuguau

SEQ ID NO: 664221 - RNA, 12 nt, Homo sapiens
auucucuuucac

SEQ ID NO: 664222 - RNA, 21 nt, Homo sapiens
auucugaaaauaccagugugu

SEQ ID NO: 664223 - RNA, 22 nt, Homo sapiens
auucugaaucagaaucucgcag

SEQ ID NO: 664224 - RNA, 14 nt, Homo sapiens
auucugacucauau

SEQ ID NO: 664225 - RNA, 16 nt, Homo sapiens
auucugauauguaucc

SEQ ID NO: 664226 - RNA, 14 nt, Homo sapiens
auucugaugcauac

SEQ ID NO: 664227 - RNA, 21 nt, Homo sapiens
auucugauuauugaguuccag

SEQ ID NO: 664228 - RNA, 17 nt, Homo sapiens
auucugauuuauuccua

SEQ ID NO: 664229 - RNA, 16 nt, Homo sapiens
auucugcaccacaccu

SEQ ID NO: 664230 - RNA, 20 nt, Homo sapiens
auucugcaccucuuggcucg

SEQ ID NO: 664231 - RNA, 14 nt, Homo sapiens
auucugcuaccaau

SEQ ID NO: 664232 - RNA, 20 nt, Homo sapiens
auucugcuacuucacuguca

SEQ ID NO: 664233 - RNA, 22 nt, Homo sapiens
auucugcucagauagaaugaca

SEQ ID NO: 664234 - RNA, 17 nt, Homo sapiens
auucuggaaaagcaaaa

SEQ ID NO: 664235 - RNA, 12 nt, Homo sapiens
auucuggaagau

SEQ ID NO: 664236 - RNA, 17 nt, Homo sapiens
auucuggcaggaccuca

SEQ ID NO: 664237 - RNA, 22 nt, Homo sapiens
auucuggcaucuuagaccucca

SEQ ID NO: 664238 - RNA, 11 nt, Homo sapiens
auucuggguuu

SEQ ID NO: 664239 - RNA, 15 nt, Homo sapiens
auucugguuucuaga

SEQ ID NO: 664240 - RNA, 18 nt, Homo sapiens
auucugguuuugacauca

SEQ ID NO: 664241 - RNA, 17 nt, Homo sapiens
auucugugaccaaaaua

SEQ ID NO: 664242 - RNA, 17 nt, Homo sapiens
auucugugccuccagga

SEQ ID NO: 664243 - RNA, 20 nt, Homo sapiens
auucugugccuccaggacca

SEQ ID NO: 664244 - RNA, 14 nt, Homo sapiens
auucuguggaacaa

SEQ ID NO: 664245 - RNA, 23 nt, Homo sapiens
auucuguggugggaacauucgag

SEQ ID NO: 664246 - RNA, 19 nt, Homo sapiens
auucuguuuaucaagccau

SEQ ID NO: 664247 - RNA, 19 nt, Homo sapiens
auucuguuugcguacuugu

SEQ ID NO: 664248 - RNA, 19 nt, Homo sapiens
auucuuaaauauuuccauc

SEQ ID NO: 664249 - RNA, 15 nt, Homo sapiens
auucuuaagcacuuu

SEQ ID NO: 664250 - RNA, 19 nt, Homo sapiens
auucuuaagggaacuucca

SEQ ID NO: 664251 - RNA, 17 nt, Homo sapiens
auucuuaaugacauuuc

SEQ ID NO: 664252 - RNA, 17 nt, Homo sapiens
auucuuacauuuuacuu

SEQ ID NO: 664253 - RNA, 20 nt, Homo sapiens
auucuuagaauaucuaaaca

SEQ ID NO: 664254 - RNA, 22 nt, Homo sapiens
auucuuauuaguuccccaaaua

SEQ ID NO: 664255 - RNA, 23 nt, Homo sapiens
auucuucauuucgccuggugaau

SEQ ID NO: 664256 - RNA, 17 nt, Homo sapiens
auucuucuaauuaacag

SEQ ID NO: 664257 - RNA, 15 nt, Homo sapiens
auucuugaguucugg

SEQ ID NO: 664258 - RNA, 18 nt, Homo sapiens
auucuuguagaugcauua

SEQ ID NO: 664259 - RNA, 20 nt, Homo sapiens
auucuuguaguuuaccucuu

SEQ ID NO: 664260 - RNA, 19 nt, Homo sapiens
auucuuguauauuauggaa

SEQ ID NO: 664261 - RNA, 14 nt, Homo sapiens
auucuuguucagau

SEQ ID NO: 664262 - RNA, 22 nt, Homo sapiens
auucuuguuggagacaugggau

SEQ ID NO: 664263 - RNA, 19 nt, Homo sapiens
auucuuguuuuaagugccu

SEQ ID NO: 664264 - RNA, 17 nt, Homo sapiens
auucuuuaaacaaauau

SEQ ID NO: 664265 - RNA, 22 nt, Homo sapiens
auucuuuaaacaaauaugaaaa

SEQ ID NO: 664266 - RNA, 16 nt, Homo sapiens
auucuuuaagaaccuu

SEQ ID NO: 664267 - RNA, 17 nt, Homo sapiens
auucuuuaauuuuggaa

SEQ ID NO: 664268 - RNA, 18 nt, Homo sapiens
auucuuuagagauuauaa

SEQ ID NO: 664269 - RNA, 16 nt, Homo sapiens
auucuuuaucuugcaa

SEQ ID NO: 664270 - RNA, 20 nt, Homo sapiens
auucuuucccaauucacauc

SEQ ID NO: 664271 - RNA, 24 nt, Homo sapiens
auucuuuccccucagagcucuuau

SEQ ID NO: 664272 - RNA, 22 nt, Homo sapiens
auucuuugaccucaaccuguga

SEQ ID NO: 664273 - RNA, 18 nt, Homo sapiens
auucuuuguauaugcauu

SEQ ID NO: 664274 - RNA, 20 nt, Homo sapiens
auucuuuugaauuguuacau

SEQ ID NO: 664275 - RNA, 18 nt, Homo sapiens
auucuuuuguuuccaugg

SEQ ID NO: 664276 - RNA, 20 nt, Homo sapiens
auucuuuuuucuauucaaua

SEQ ID NO: 664277 - RNA, 13 nt, Homo sapiens
auugaaaaugcau

SEQ ID NO: 664278 - RNA, 20 nt, Homo sapiens
auugaaagagucugggaccc

SEQ ID NO: 664279 - RNA, 17 nt, Homo sapiens
auugaaaggcauucucu

SEQ ID NO: 664280 - RNA, 13 nt, Homo sapiens
auugaaaugcauu

SEQ ID NO: 664281 - RNA, 22 nt, Homo sapiens
auugaacuuucacauagcacag

SEQ ID NO: 664282 - RNA, 24 nt, Homo sapiens
auugaacuuucacauagcacagaa

SEQ ID NO: 664283 - RNA, 14 nt, Homo sapiens
auugaagaacugca

SEQ ID NO: 664284 - RNA, 15 nt, Homo sapiens
auugaagaaucugcc

SEQ ID NO: 664285 - RNA, 23 nt, Homo sapiens
auugaagcccuccaaaagcacuu

SEQ ID NO: 664286 - RNA, 12 nt, Homo sapiens
auugaaguaaug

SEQ ID NO: 664287 - RNA, 19 nt, Homo sapiens
auugaaguccuccagacaa

SEQ ID NO: 664288 - RNA, 15 nt, Homo sapiens
auugaaguuguuuau

SEQ ID NO: 664289 - RNA, 16 nt, Homo sapiens
auugaaugaugugaua

SEQ ID NO: 664290 - RNA, 22 nt, Homo sapiens
auugaaugaugugauacaaauu

SEQ ID NO: 664291 - RNA, 21 nt, Homo sapiens
auugaauuauauguucagauu

SEQ ID NO: 664292 - RNA, 13 nt, Homo sapiens
auugaauuugcac

SEQ ID NO: 664293 - RNA, 19 nt, Homo sapiens
auugaccaagaacugcaug

SEQ ID NO: 664294 - RNA, 14 nt, Homo sapiens
auugaccccuuccu

SEQ ID NO: 664295 - RNA, 14 nt, Homo sapiens
auugacccuagcca

SEQ ID NO: 664296 - RNA, 18 nt, Homo sapiens
auugacgacaagugcuga

SEQ ID NO: 664297 - RNA, 19 nt, Homo sapiens
auugacgacaagugcugaa

SEQ ID NO: 664298 - RNA, 15 nt, Homo sapiens
auugacgcauauuua

SEQ ID NO: 664299 - RNA, 20 nt, Homo sapiens
auugacuaacaggccaaaga

SEQ ID NO: 664300 - RNA, 17 nt, Homo sapiens
auugacuaucaaacuga

SEQ ID NO: 664301 - RNA, 21 nt, Homo sapiens
auugacucaaaaaugagguac

SEQ ID NO: 664302 - RNA, 16 nt, Homo sapiens
auugacuccuuuccaa

SEQ ID NO: 664303 - RNA, 21 nt, Homo sapiens
auugacugggcaacacugcag

SEQ ID NO: 664304 - RNA, 17 nt, Homo sapiens
auugacugucacuguuc

SEQ ID NO: 664305 - RNA, 14 nt, Homo sapiens
auugacuugugaaa

SEQ ID NO: 664306 - RNA, 19 nt, Homo sapiens
auugagaaagaaacuaaua

SEQ ID NO: 664307 - RNA, 22 nt, Homo sapiens
auugagaaagauguuccaguga

SEQ ID NO: 664308 - RNA, 14 nt, Homo sapiens
auugagaacugaca

SEQ ID NO: 664309 - RNA, 13 nt, Homo sapiens
auugagaccugag

SEQ ID NO: 664310 - RNA, 14 nt, Homo sapiens
auugagaccugagu

SEQ ID NO: 664311 - RNA, 19 nt, Homo sapiens
auugagauaaugauacuua

SEQ ID NO: 664312 - RNA, 20 nt, Homo sapiens
auugagcagaagaucaagga

SEQ ID NO: 664313 - RNA, 19 nt, Homo sapiens
auugagcagaauucauuca

SEQ ID NO: 664314 - RNA, 17 nt, Homo sapiens
auugagcaguuagcuca

SEQ ID NO: 664315 - RNA, 18 nt, Homo sapiens
auugagccaguggugcua

SEQ ID NO: 664316 - RNA, 18 nt, Homo sapiens
auugagugcacuaaacaa

SEQ ID NO: 664317 - RNA, 21 nt, Homo sapiens
auugaguuccaguugaaguua

SEQ ID NO: 664318 - RNA, 19 nt, Homo sapiens
auugauagaaaucaggccu

SEQ ID NO: 664319 - RNA, 21 nt, Homo sapiens
auugaucauuuuuauaugaaa

SEQ ID NO: 664320 - RNA, 13 nt, Homo sapiens
auugaucccacau

SEQ ID NO: 664321 - RNA, 19 nt, Homo sapiens
auugauccucccaucucag

SEQ ID NO: 664322 - RNA, 21 nt, Homo sapiens
auugaucuuuugcuaaugcaa

SEQ ID NO: 664323 - RNA, 14 nt, Homo sapiens
auugaugacccucu

SEQ ID NO: 664324 - RNA, 17 nt, Homo sapiens
auugaugauaacacuua

SEQ ID NO: 664325 - RNA, 13 nt, Homo sapiens
auugauguugcug

SEQ ID NO: 664326 - RNA, 17 nt, Homo sapiens
ccuccuuccacauguac

SEQ ID NO: 664327 - RNA, 21 nt, Homo sapiens
ccuccuuuuuaauacauuaag

SEQ ID NO: 664328 - RNA, 16 nt, Homo sapiens
ccucgcaugacuguua

SEQ ID NO: 664329 - RNA, 18 nt, Homo sapiens
ccucgcuccccucuggaa

SEQ ID NO: 664330 - RNA, 14 nt, Homo sapiens
ccucgcugccagcu

SEQ ID NO: 664331 - RNA, 20 nt, Homo sapiens
ccucggagagcagcagcacc

SEQ ID NO: 664332 - RNA, 18 nt, Homo sapiens
ccucgggggccuguggug

SEQ ID NO: 664333 - RNA, 15 nt, Homo sapiens
ccucgugucagcuca

SEQ ID NO: 664334 - RNA, 13 nt, Homo sapiens
ccucuaacccuca

SEQ ID NO: 664335 - RNA, 20 nt, Homo sapiens
ccucuaagucaggcccugau

SEQ ID NO: 664336 - RNA, 22 nt, Homo sapiens
ccucuacggaccucacauccau

SEQ ID NO: 664337 - RNA, 13 nt, Homo sapiens
ccucuacuguugc

SEQ ID NO: 664338 - RNA, 18 nt, Homo sapiens
ccucuacuuaaugagaua

SEQ ID NO: 664339 - RNA, 21 nt, Homo sapiens
ccucuacuuuaacuuuuacaa

SEQ ID NO: 664340 - RNA, 18 nt, Homo sapiens
ccucuagagccuucagcc

SEQ ID NO: 664341 - RNA, 14 nt, Homo sapiens
ccucuagaggcaag

SEQ ID NO: 664342 - RNA, 13 nt, Homo sapiens
ccucuauaaacuu

SEQ ID NO: 664343 - RNA, 21 nt, Homo sapiens
ccucuauuuuaauuacugcua

SEQ ID NO: 664344 - RNA, 20 nt, Homo sapiens
ccucucaacauuaccaaaau

SEQ ID NO: 664345 - RNA, 13 nt, Homo sapiens
ccucucacuccag

SEQ ID NO: 664346 - RNA, 19 nt, Homo sapiens
ccucucagaacauacugau

SEQ ID NO: 664347 - RNA, 19 nt, Homo sapiens
ccucucagcugcugggacg

SEQ ID NO: 664348 - RNA, 18 nt, Homo sapiens
ccucucaggcucuugacu

SEQ ID NO: 664349 - RNA, 13 nt, Homo sapiens
ccucucagguggg

SEQ ID NO: 664350 - RNA, 17 nt, Homo sapiens
ccucuccagagaggcuc

SEQ ID NO: 664351 - RNA, 16 nt, Homo sapiens
ccucucccauccagug

SEQ ID NO: 664352 - RNA, 18 nt, Homo sapiens
ccucucccggcaacaucu

SEQ ID NO: 664353 - RNA, 16 nt, Homo sapiens
ccucuccgcaguuccu

SEQ ID NO: 664354 - RNA, 15 nt, Homo sapiens
ccucuccuccagugu

SEQ ID NO: 664355 - RNA, 20 nt, Homo sapiens
ccucuccugcccaagcacuu

SEQ ID NO: 664356 - RNA, 14 nt, Homo sapiens
ccucucgcggcccu

SEQ ID NO: 664357 - RNA, 22 nt, Homo sapiens
ccucucucacacaucacauucc

SEQ ID NO: 664358 - RNA, 16 nt, Homo sapiens
ccucucucagugucaa

SEQ ID NO: 664359 - RNA, 19 nt, Homo sapiens
ccucucucccggagguugg

SEQ ID NO: 664360 - RNA, 14 nt, Homo sapiens
ccucucucugcucc

SEQ ID NO: 664361 - RNA, 21 nt, Homo sapiens
ccucucuggcacuuugaguua

SEQ ID NO: 664362 - RNA, 12 nt, Homo sapiens
ccucucuuugac

SEQ ID NO: 664363 - RNA, 17 nt, Homo sapiens
ccucugaccugccugua

SEQ ID NO: 664364 - RNA, 12 nt, Homo sapiens
ccucugacucag

SEQ ID NO: 664365 - RNA, 20 nt, Homo sapiens
ccucugagaauuccaaggag

SEQ ID NO: 664366 - RNA, 19 nt, Homo sapiens
ccucugaggcacucaucua

SEQ ID NO: 664367 - RNA, 13 nt, Homo sapiens
ccuuuacaccaac

SEQ ID NO: 664368 - RNA, 15 nt, Homo sapiens
ccuuuacuagauucu

SEQ ID NO: 664369 - RNA, 16 nt, Homo sapiens
ccuuuacugugcuuau

SEQ ID NO: 664370 - RNA, 18 nt, Homo sapiens
ccuuuagagccagcccau

SEQ ID NO: 664371 - RNA, 16 nt, Homo sapiens
ccuuuagcgggacuca

SEQ ID NO: 664372 - RNA, 17 nt, Homo sapiens
ccuuuaggauguuuucc

SEQ ID NO: 664373 - RNA, 17 nt, Homo sapiens
ccuuuaucauccuuaaa

SEQ ID NO: 664374 - RNA, 12 nt, Homo sapiens
ccuuuaucucaa

SEQ ID NO: 664375 - RNA, 14 nt, Homo sapiens
ccuuuaucucugag

SEQ ID NO: 664376 - RNA, 13 nt, Homo sapiens
ccuuuaugugaau

SEQ ID NO: 664377 - RNA, 21 nt, Homo sapiens
ccuuuauugauaucuccauga

SEQ ID NO: 664378 - RNA, 18 nt, Homo sapiens
ccuuucaagacagaaaga

SEQ ID NO: 664379 - RNA, 15 nt, Homo sapiens
ccuuucacucugcau

SEQ ID NO: 664380 - RNA, 20 nt, Homo sapiens
ccuuucagaugucuucugcc

SEQ ID NO: 664381 - RNA, 20 nt, Homo sapiens
ccuuucagucauugucuuau

SEQ ID NO: 664382 - RNA, 17 nt, Homo sapiens
ccuuucaucacacuggg

SEQ ID NO: 664383 - RNA, 11 nt, Homo sapiens
ccuuucaucuu

SEQ ID NO: 664384 - RNA, 21 nt, Homo sapiens
ccuuucauuaggcaaaguaca

SEQ ID NO: 664385 - RNA, 22 nt, Homo sapiens
ccuuuccaagcuccucgugaua

SEQ ID NO: 664386 - RNA, 12 nt, Homo sapiens
ccuuuccagggu

SEQ ID NO: 664387 - RNA, 14 nt, Homo sapiens
ccuuuccaggguca

SEQ ID NO: 664388 - RNA, 23 nt, Homo sapiens
ccuuuccagggucaaaguacaga

SEQ ID NO: 664389 - RNA, 16 nt, Homo sapiens
ccuuucccaucuucca

SEQ ID NO: 664390 - RNA, 19 nt, Homo sapiens
ccuuucccccuucucuuag

SEQ ID NO: 664391 - RNA, 16 nt, Homo sapiens
ccuuucccuggagcug

SEQ ID NO: 664392 - RNA, 17 nt, Homo sapiens
ccuuuccugaugccccu

SEQ ID NO: 664393 - RNA, 19 nt, Homo sapiens
ccuuuccuuccaucccuac

SEQ ID NO: 664394 - RNA, 15 nt, Homo sapiens
ccuuucuaaacaaga

SEQ ID NO: 664395 - RNA, 21 nt, Homo sapiens
ccuuucucagccacaaaauaa

SEQ ID NO: 664396 - RNA, 14 nt, Homo sapiens
ccuuucucauccca

SEQ ID NO: 664397 - RNA, 11 nt, Homo sapiens
ccuuucucuga

SEQ ID NO: 664398 - RNA, 19 nt, Homo sapiens
ccuuucuugagggaguuca

SEQ ID NO: 664399 - RNA, 19 nt, Homo sapiens
ccuuucuugcagauucuau

SEQ ID NO: 664400 - RNA, 19 nt, Homo sapiens
ccuuugaauaaaaaugcac

SEQ ID NO: 664401 - RNA, 22 nt, Homo sapiens
ccuuugagcaagccgagcucuc

SEQ ID NO: 664402 - RNA, 23 nt, Homo sapiens
ccuuugagcccacaaagccuuau

SEQ ID NO: 664403 - RNA, 14 nt, Homo sapiens
ccuuugagguugau

SEQ ID NO: 664404 - RNA, 22 nt, Homo sapiens
ccuuugaguuuuguauucaaua

SEQ ID NO: 664405 - RNA, 21 nt, Homo sapiens
ccuuugauaaauguauauaug

SEQ ID NO: 664406 - RNA, 16 nt, Homo sapiens
ccuuugaucaguauaa

SEQ ID NO: 664407 - RNA, 14 nt, Homo sapiens
ccuuugaugaauuc

SEQ ID NO: 664408 - RNA, 21 nt, Homo sapiens
ccuuugcaguuggacucucag

SEQ ID NO: 664409 - RNA, 12 nt, Homo sapiens
ccuuugccagug

SEQ ID NO: 664410 - RNA, 22 nt, Homo sapiens
ccuuugcucccuguugcugaaa

SEQ ID NO: 664411 - RNA, 13 nt, Homo sapiens
ccuuugcuucaaa

SEQ ID NO: 664412 - RNA, 18 nt, Homo sapiens
ccuuugcuucaaauucaa

SEQ ID NO: 664413 - RNA, 23 nt, Homo sapiens
ccuuuggagcuuuuuucuuuaag

SEQ ID NO: 664414 - RNA, 18 nt, Homo sapiens
ccuuuggccccacuuuga

SEQ ID NO: 664415 - RNA, 16 nt, Homo sapiens
ccuuuggggacuuuuc

SEQ ID NO: 664416 - RNA, 14 nt, Homo sapiens
ccuuuggggagcag

SEQ ID NO: 664417 - RNA, 21 nt, Homo sapiens
ccuuuggggugaacuaccuug

SEQ ID NO: 664418 - RNA, 20 nt, Homo sapiens
ccuuugguuuuaaaagagaa

SEQ ID NO: 664419 - RNA, 16 nt, Homo sapiens
ccuuuguaagugcagg

SEQ ID NO: 664420 - RNA, 23 nt, Homo sapiens
ccuuugucgcugggucagugcug

SEQ ID NO: 664421 - RNA, 16 nt, Homo sapiens
ccuuugugagucaaua

SEQ ID NO: 664422 - RNA, 16 nt, Homo sapiens
ccuuugugcacauuua

SEQ ID NO: 664423 - RNA, 17 nt, Homo sapiens
ccuuuuacauacugcug

SEQ ID NO: 664424 - RNA, 12 nt, Homo sapiens
ccuuuucagggc

SEQ ID NO: 664425 - RNA, 12 nt, Homo sapiens
ccuuuuccagaa

SEQ ID NO: 664426 - RNA, 21 nt, Homo sapiens
ccuuuucuuuguucaagauga

SEQ ID NO: 664427 - RNA, 19 nt, Homo sapiens
ccuuuugaaugaugccuuu

SEQ ID NO: 664428 - RNA, 17 nt, Homo sapiens
ccuuuugcaaccaggaa

SEQ ID NO: 664429 - RNA, 18 nt, Homo sapiens
ccuuuuggcauguuccca

SEQ ID NO: 664430 - RNA, 13 nt, Homo sapiens
ccuuuugggcuca

SEQ ID NO: 664431 - RNA, 17 nt, Homo sapiens
ccuuuuggucuucagcc

SEQ ID NO: 664432 - RNA, 13 nt, Homo sapiens
ccuuuuguaaaau

SEQ ID NO: 664433 - RNA, 15 nt, Homo sapiens
ccuuuuguguaauaa

SEQ ID NO: 664434 - RNA, 19 nt, Homo sapiens
ccuuuuuauucagcuagaa

SEQ ID NO: 664435 - RNA, 15 nt, Homo sapiens
ccuuuuucacuuuga

SEQ ID NO: 664436 - RNA, 15 nt, Homo sapiens
ccuuuuugacacuga

SEQ ID NO: 664437 - RNA, 19 nt, Homo sapiens
ccuuuuugagauacuauuu

SEQ ID NO: 664438 - RNA, 15 nt, Homo sapiens
ccuuuuuguuauuag

SEQ ID NO: 664439 - RNA, 15 nt, Homo sapiens
ccuuuuuuauaacua

SEQ ID NO: 664440 - RNA, 17 nt, Homo sapiens
ccuuuuuuauacaggaa

SEQ ID NO: 664441 - RNA, 19 nt, Homo sapiens
ccuuuuuuauacaggaaaa

SEQ ID NO: 664442 - RNA, 12 nt, Homo sapiens
ccuuuuuuccca

SEQ ID NO: 664443 - RNA, 21 nt, Homo sapiens
ccuuuuuuguuuuuucaaaau

SEQ ID NO: 664444 - RNA, 17 nt, Homo sapiens
ccuuuuuuuaaguagua

SEQ ID NO: 664445 - RNA, 14 nt, Homo sapiens
cgaaaaccaucaca

SEQ ID NO: 664446 - RNA, 21 nt, Homo sapiens
cgaaaccugggauucaggaau

SEQ ID NO: 664447 - RNA, 16 nt, Homo sapiens
cgaaagcaucacugcc

SEQ ID NO: 664448 - RNA, 17 nt, Homo sapiens
cgaaauguucucaugaa

SEQ ID NO: 664449 - RNA, 18 nt, Homo sapiens
cgaaauguucucaugaac

SEQ ID NO: 664450 - RNA, 19 nt, Homo sapiens
cgaaccaugccuuccucag

SEQ ID NO: 664451 - RNA, 22 nt, Homo sapiens
cgaacgcucuuagcuuucucag

SEQ ID NO: 664452 - RNA, 15 nt, Homo sapiens
cgaacucauuaacaa

SEQ ID NO: 664453 - RNA, 16 nt, Homo sapiens
cgaacuccugaccuca

SEQ ID NO: 664454 - RNA, 12 nt, Homo sapiens
cgaacuuaacag

SEQ ID NO: 664455 - RNA, 17 nt, Homo sapiens
cgaagaauugucuugca

SEQ ID NO: 664456 - RNA, 11 nt, Homo sapiens
auuuuuugcca

SEQ ID NO: 664457 - RNA, 18 nt, Homo sapiens
auuuuuugggcagcaauu

SEQ ID NO: 664458 - RNA, 18 nt, Homo sapiens
auuuuuuugcauuuucac

SEQ ID NO: 664459 - RNA, 20 nt, Homo sapiens
auuuuuuuuaacauuccaau

SEQ ID NO: 664460 - RNA, 13 nt, Homo sapiens
auuuuuuuuacau

SEQ ID NO: 664461 - RNA, 23 nt, Homo sapiens
auuuuuuuuuuuuaaauuaugca

SEQ ID NO: 664462 - RNA, 22 nt, Homo sapiens
caaaaaaaaaaaaaggcagugg

SEQ ID NO: 664463 - RNA, 20 nt, Homo sapiens
caaaaaaaaccuucagugaa

SEQ ID NO: 664464 - RNA, 19 nt, Homo sapiens
caaaaaaaccucuaugcaa

SEQ ID NO: 664465 - RNA, 16 nt, Homo sapiens
caaaaaaagaaaaaga

SEQ ID NO: 664466 - RNA, 15 nt, Homo sapiens
caaaaaaaucugcag

SEQ ID NO: 664467 - RNA, 16 nt, Homo sapiens
caaaaaaccacaaaaa

SEQ ID NO: 664468 - RNA, 14 nt, Homo sapiens
caaaaaacuacuuc

SEQ ID NO: 664469 - RNA, 21 nt, Homo sapiens
caaaaaagucaacaaacugca

SEQ ID NO: 664470 - RNA, 20 nt, Homo sapiens
caaaaaaguccaauuuuaau

SEQ ID NO: 664471 - RNA, 18 nt, Homo sapiens
caaaaaaucauguuuauu

SEQ ID NO: 664472 - RNA, 13 nt, Homo sapiens
caaaaacaagcaa

SEQ ID NO: 664473 - RNA, 22 nt, Homo sapiens
caaaaacauucuuacauuuuac

SEQ ID NO: 664474 - RNA, 14 nt, Homo sapiens
caaaaacauuucau

SEQ ID NO: 664475 - RNA, 14 nt, Homo sapiens
caaaaaccaaaaaa

SEQ ID NO: 664476 - RNA, 16 nt, Homo sapiens
caaaaacguaucuccu

SEQ ID NO: 664477 - RNA, 19 nt, Homo sapiens
caaaaacuacauuuugcaa

SEQ ID NO: 664478 - RNA, 12 nt, Homo sapiens
caaaaacugaaa

SEQ ID NO: 664479 - RNA, 19 nt, Homo sapiens
caaaaacuguacuguguuu

SEQ ID NO: 664480 - RNA, 15 nt, Homo sapiens
caaaaagagacugau

SEQ ID NO: 664481 - RNA, 21 nt, Homo sapiens
caaaaagccuuuuccagaaga

SEQ ID NO: 664482 - RNA, 22 nt, Homo sapiens
caaaaagggauccguacauuca

SEQ ID NO: 664483 - RNA, 15 nt, Homo sapiens
caaaaaguagacuug

SEQ ID NO: 664484 - RNA, 15 nt, Homo sapiens
caaaaauauauucau

SEQ ID NO: 664485 - RNA, 20 nt, Homo sapiens
caaaaaucuguguaacugua

SEQ ID NO: 664486 - RNA, 21 nt, Homo sapiens
caaaaaugaaagcaugucuca

SEQ ID NO: 664487 - RNA, 19 nt, Homo sapiens
caaaaaugaaauccaguga

SEQ ID NO: 664488 - RNA, 12 nt, Homo sapiens
caaaaaugaacu

SEQ ID NO: 664489 - RNA, 21 nt, Homo sapiens
caaaaaugaagcugcucugaa

SEQ ID NO: 664490 - RNA, 22 nt, Homo sapiens
caaaaaugggaaaccaguucau

SEQ ID NO: 664491 - RNA, 21 nt, Homo sapiens
caaaaauuaacucaagaugga

SEQ ID NO: 664492 - RNA, 23 nt, Homo sapiens
caaaacaaaacccucagcacugu

SEQ ID NO: 664493 - RNA, 15 nt, Homo sapiens
caaaacaagugcaag

SEQ ID NO: 664494 - RNA, 12 nt, Homo sapiens
caaaacaauuaa

SEQ ID NO: 664495 - RNA, 18 nt, Homo sapiens
caaaacaauuaaucauuu

SEQ ID NO: 664496 - RNA, 15 nt, Homo sapiens
caaaacacauaguua

SEQ ID NO: 664497 - RNA, 14 nt, Homo sapiens
caaaacacccaaaa

SEQ ID NO: 664498 - RNA, 21 nt, Homo sapiens
caaaacacccaaaaauaucuc

SEQ ID NO: 664499 - RNA, 19 nt, Homo sapiens
caaaacacucggcauuuca

SEQ ID NO: 664500 - RNA, 13 nt, Homo sapiens
caaaacacugugg

SEQ ID NO: 664501 - RNA, 15 nt, Homo sapiens
caaaacacuguggaa

SEQ ID NO: 664502 - RNA, 17 nt, Homo sapiens
caaaacagaaaaugaag

SEQ ID NO: 664503 - RNA, 13 nt, Homo sapiens
caaaacagcauag

SEQ ID NO: 664504 - RNA, 19 nt, Homo sapiens
caaaacaucaaaaugaaua

SEQ ID NO: 664505 - RNA, 16 nt, Homo sapiens
caaaacaucucugcag

SEQ ID NO: 664506 - RNA, 11 nt, Homo sapiens
caaaaccaaac

SEQ ID NO: 664507 - RNA, 21 nt, Homo sapiens
caaaaccaaacuuguucauuu

SEQ ID NO: 664508 - RNA, 12 nt, Homo sapiens
caaaaccaaugc

SEQ ID NO: 664509 - RNA, 21 nt, Homo sapiens
caaaaccucauuuaaguaaaa

SEQ ID NO: 664510 - RNA, 11 nt, Homo sapiens
caaaaccucca

SEQ ID NO: 664511 - RNA, 17 nt, Homo sapiens
caaaaccugauguuaaa

SEQ ID NO: 664512 - RNA, 18 nt, Homo sapiens
caaaaccugauguuaaaa

SEQ ID NO: 664513 - RNA, 18 nt, Homo sapiens
caaaaccuuuaaucugca

SEQ ID NO: 664514 - RNA, 19 nt, Homo sapiens
caaaaccuuuaaucugcac

SEQ ID NO: 664515 - RNA, 17 nt, Homo sapiens
caaaacggaugaguuau

SEQ ID NO: 664516 - RNA, 17 nt, Homo sapiens
caaaacuaaccaucuga

SEQ ID NO: 664517 - RNA, 15 nt, Homo sapiens
caaaacuaauuuccu

SEQ ID NO: 664518 - RNA, 15 nt, Homo sapiens
caaaacuacaugaga

SEQ ID NO: 664519 - RNA, 16 nt, Homo sapiens
caaaacuccaucucaa

SEQ ID NO: 664520 - RNA, 12 nt, Homo sapiens
caaaacucuccu

SEQ ID NO: 664521 - RNA, 16 nt, Homo sapiens
caaaacugaaccacaa

SEQ ID NO: 664522 - RNA, 17 nt, Homo sapiens
caaaacugacaguaaau

SEQ ID NO: 664523 - RNA, 20 nt, Homo sapiens
caaaacugauacccuuugaa

SEQ ID NO: 664524 - RNA, 18 nt, Homo sapiens
caaaacugcuuugugcau

SEQ ID NO: 664525 - RNA, 17 nt, Homo sapiens
caaaacuggagucccaa

SEQ ID NO: 664526 - RNA, 22 nt, Homo sapiens
caaaacugugucacaguuucag

SEQ ID NO: 664527 - RNA, 21 nt, Homo sapiens
caaaacuguucuuuugcauuu

SEQ ID NO: 664528 - RNA, 19 nt, Homo sapiens
caaaacuuaaaaguauuca

SEQ ID NO: 664529 - RNA, 22 nt, Homo sapiens
caaaacuuuaaugaacuaacug

SEQ ID NO: 664530 - RNA, 17 nt, Homo sapiens
caaaagaaaauuuucca

SEQ ID NO: 664531 - RNA, 13 nt, Homo sapiens
caaaagaagacaa

SEQ ID NO: 664532 - RNA, 20 nt, Homo sapiens
caaaagaagacaacauuucu

SEQ ID NO: 664533 - RNA, 22 nt, Homo sapiens
caaaagaagacaacauuucuca

SEQ ID NO: 664534 - RNA, 18 nt, Homo sapiens
caaaagauuguguuccca

SEQ ID NO: 664535 - RNA, 18 nt, Homo sapiens
caaaagcaauuguauuac

SEQ ID NO: 664536 - RNA, 17 nt, Homo sapiens
caaaagcagcacaagga

SEQ ID NO: 664537 - RNA, 19 nt, Homo sapiens
caaaagccauaacuugaaa

SEQ ID NO: 664538 - RNA, 21 nt, Homo sapiens
caaaagcccaauguaaugcau

SEQ ID NO: 664539 - RNA, 22 nt, Homo sapiens
caaaaggaacucuagaagacca

SEQ ID NO: 664540 - RNA, 16 nt, Homo sapiens
caaaaggcagcucacc

SEQ ID NO: 664541 - RNA, 13 nt, Homo sapiens
caaaaggcccuuu

SEQ ID NO: 664542 - RNA, 23 nt, Homo sapiens
caaaagggccaaagaaccaaaga

SEQ ID NO: 664543 - RNA, 20 nt, Homo sapiens
caaaagggguuaauguuacu

SEQ ID NO: 664544 - RNA, 18 nt, Homo sapiens
caaaaggguguauagugu

SEQ ID NO: 664545 - RNA, 15 nt, Homo sapiens
caaaagucagucuua

SEQ ID NO: 664546 - RNA, 17 nt, Homo sapiens
caaaauaaaacagaugu

SEQ ID NO: 664547 - RNA, 14 nt, Homo sapiens
caaaauacaaaagu

SEQ ID NO: 664548 - RNA, 19 nt, Homo sapiens
caaaauacaugaagcuuca

SEQ ID NO: 664549 - RNA, 24 nt, Homo sapiens
caaaauacgaaguggagauuuaca

SEQ ID NO: 664550 - RNA, 17 nt, Homo sapiens
caaaauagaaaaguuau

SEQ ID NO: 664551 - RNA, 15 nt, Homo sapiens
caaaaucaacaugac

SEQ ID NO: 664552 - RNA, 16 nt, Homo sapiens
caaaaucaacaugacu

SEQ ID NO: 664553 - RNA, 18 nt, Homo sapiens
caaaaucaacaugacugg

SEQ ID NO: 664554 - RNA, 18 nt, Homo sapiens
caaaaucaggaaccacag

SEQ ID NO: 664555 - RNA, 14 nt, Homo sapiens
caaaaucuuaauca

SEQ ID NO: 664556 - RNA, 19 nt, Homo sapiens
caaaaucuugaucaguuaa

SEQ ID NO: 664557 - RNA, 15 nt, Homo sapiens
caaaaucuuguuaau

SEQ ID NO: 664558 - RNA, 17 nt, Homo sapiens
caaaaugaauucuggga

SEQ ID NO: 664559 - RNA, 18 nt, Homo sapiens
caaaaugacaaugaugau

SEQ ID NO: 664560 - RNA, 14 nt, Homo sapiens
caaaaugacuuuga

SEQ ID NO: 664561 - RNA, 18 nt, Homo sapiens
caaaaugagacuuucuaa

SEQ ID NO: 664562 - RNA, 23 nt, Homo sapiens
caaaauguaaugucagacuuugc

SEQ ID NO: 664563 - RNA, 13 nt, Homo sapiens
caaaauguagcau

SEQ ID NO: 664564 - RNA, 14 nt, Homo sapiens
caaaauguucacaa

SEQ ID NO: 664565 - RNA, 18 nt, Homo sapiens
caaaauuaauacauucua

SEQ ID NO: 664566 - RNA, 16 nt, Homo sapiens
caaaauuaauagcuuu

SEQ ID NO: 664567 - RNA, 16 nt, Homo sapiens
caaaauuacacaguua

SEQ ID NO: 664568 - RNA, 17 nt, Homo sapiens
caaaauuacacaguuaa

SEQ ID NO: 664569 - RNA, 20 nt, Homo sapiens
caaaauucacuaaucuugaa

SEQ ID NO: 664570 - RNA, 19 nt, Homo sapiens
caaaauugauaauuacguu

SEQ ID NO: 664571 - RNA, 12 nt, Homo sapiens
caaaauugcaau

SEQ ID NO: 664572 - RNA, 15 nt, Homo sapiens
caaaauuuccaguac

SEQ ID NO: 664573 - RNA, 17 nt, Homo sapiens
caaaauuuguacuauua

SEQ ID NO: 664574 - RNA, 21 nt, Homo sapiens
caaaauuuuguaaauaugcaa

SEQ ID NO: 664575 - RNA, 13 nt, Homo sapiens
caaacaaaaaacu

SEQ ID NO: 664576 - RNA, 16 nt, Homo sapiens
caaacaaacaaugcau

SEQ ID NO: 664577 - RNA, 22 nt, Homo sapiens
caaacaaagaugccacauucaa

SEQ ID NO: 664578 - RNA, 20 nt, Homo sapiens
caaacaagaaacauuucaga

SEQ ID NO: 664579 - RNA, 20 nt, Homo sapiens
cgaagagacaagaucuugaa

SEQ ID NO: 664580 - RNA, 13 nt, Homo sapiens
cgaagucuuccau

SEQ ID NO: 664581 - RNA, 20 nt, Homo sapiens
cgaauguaauuggaaucuuc

SEQ ID NO: 664582 - RNA, 20 nt, Homo sapiens
cgaauuagcaauaacauaca

SEQ ID NO: 664583 - RNA, 20 nt, Homo sapiens
cgacaaaggccacaggcagu

SEQ ID NO: 664584 - RNA, 16 nt, Homo sapiens
cgacaacuuguaacuc

SEQ ID NO: 664585 - RNA, 13 nt, Homo sapiens
cgacaccguguca

SEQ ID NO: 664586 - RNA, 13 nt, Homo sapiens
cgacacucagggc

SEQ ID NO: 664587 - RNA, 12 nt, Homo sapiens
cgacaguuuucc

SEQ ID NO: 664588 - RNA, 17 nt, Homo sapiens
cgacauguguaccucag

SEQ ID NO: 664589 - RNA, 11 nt, Homo sapiens
cgacccauuca

SEQ ID NO: 664590 - RNA, 16 nt, Homo sapiens
cgacgcugacugcccu

SEQ ID NO: 664591 - RNA, 13 nt, Homo sapiens
cgacggcugugac

SEQ ID NO: 664592 - RNA, 19 nt, Homo sapiens
cgacugagaaccgugacau

SEQ ID NO: 664593 - RNA, 15 nt, Homo sapiens
cgagacuccgucuca

SEQ ID NO: 664594 - RNA, 20 nt, Homo sapiens
cgagacuugguuucaaaaaa

SEQ ID NO: 664595 - RNA, 23 nt, Homo sapiens
cgagaguggguguuggacagugu

SEQ ID NO: 664596 - RNA, 15 nt, Homo sapiens
cgagauaccaucuca

SEQ ID NO: 664597 - RNA, 14 nt, Homo sapiens
cgagaucaagagau

SEQ ID NO: 664598 - RNA, 17 nt, Homo sapiens
cgagaucacgccacugc

SEQ ID NO: 664599 - RNA, 15 nt, Homo sapiens
cgagauuccgucuca

SEQ ID NO: 664600 - RNA, 21 nt, Homo sapiens
cgagauugcaccauugcgcuc

SEQ ID NO: 664601 - RNA, 21 nt, Homo sapiens
cgagauugcgccauugcacuc

SEQ ID NO: 664602 - RNA, 14 nt, Homo sapiens
cgagcaggguguuu

SEQ ID NO: 664603 - RNA, 13 nt, Homo sapiens
cgagcagucagca

SEQ ID NO: 664604 - RNA, 16 nt, Homo sapiens
cgagcagucagcauuc

SEQ ID NO: 664605 - RNA, 14 nt, Homo sapiens
cgagcauguuguuu

SEQ ID NO: 664606 - RNA, 15 nt, Homo sapiens
cgagccaccaugcuu

SEQ ID NO: 664607 - RNA, 19 nt, Homo sapiens
cgagcccagcuacauuccu

SEQ ID NO: 664608 - RNA, 18 nt, Homo sapiens
cgagcuacucucuugcca

SEQ ID NO: 664609 - RNA, 16 nt, Homo sapiens
cgaggacccaggaaag

SEQ ID NO: 664610 - RNA, 18 nt, Homo sapiens
cgaggaguaacaauacaa

SEQ ID NO: 664611 - RNA, 18 nt, Homo sapiens
cgaggggcucucagcuca

SEQ ID NO: 664612 - RNA, 22 nt, Homo sapiens
cgaggguaugucagugucacug

SEQ ID NO: 664613 - RNA, 18 nt, Homo sapiens
cgagggucaggacuguga

SEQ ID NO: 664614 - RNA, 23 nt, Homo sapiens
cgagguauggcagaggugcaaga

SEQ ID NO: 664615 - RNA, 14 nt, Homo sapiens
cgaggucaggagau

SEQ ID NO: 664616 - RNA, 16 nt, Homo sapiens
cgagguccaagcacau

SEQ ID NO: 664617 - RNA, 21 nt, Homo sapiens
cgaggugcaaauucauuucau

SEQ ID NO: 664618 - RNA, 10 nt, Homo sapiens
cgaguacuuc

SEQ ID NO: 664619 - RNA, 19 nt, Homo sapiens
cgagucucuucuccacugg

SEQ ID NO: 664620 - RNA, 15 nt, Homo sapiens
cgagugcacugcauu

SEQ ID NO: 664621 - RNA, 22 nt, Homo sapiens
cgaguguccagccaagggcuga

SEQ ID NO: 664622 - RNA, 15 nt, Homo sapiens
cgagugugauuugaa

SEQ ID NO: 664623 - RNA, 16 nt, Homo sapiens
cgaguuuuaaacuggu

SEQ ID NO: 664624 - RNA, 12 nt, Homo sapiens
cgauaaagggau

SEQ ID NO: 664625 - RNA, 13 nt, Homo sapiens
cgauacaaagugu

SEQ ID NO: 664626 - RNA, 18 nt, Homo sapiens
cgauauaaauugggauaa

SEQ ID NO: 664627 - RNA, 18 nt, Homo sapiens
cgauccuggauucacuca

SEQ ID NO: 664628 - RNA, 22 nt, Homo sapiens
cgaucgauggaugggaugcacu

SEQ ID NO: 664629 - RNA, 13 nt, Homo sapiens
cgaucucagcuca

SEQ ID NO: 664630 - RNA, 17 nt, Homo sapiens
cgaugcguucacuccaa

SEQ ID NO: 664631 - RNA, 18 nt, Homo sapiens
cgauuauuuccaguguuc

SEQ ID NO: 664632 - RNA, 13 nt, Homo sapiens
cgauucuuaacaa

SEQ ID NO: 664633 - RNA, 14 nt, Homo sapiens
cgauugaaggugac

SEQ ID NO: 664634 - RNA, 16 nt, Homo sapiens
cgauugagaacugaca

SEQ ID NO: 664635 - RNA, 18 nt, Homo sapiens
cgauugagaacugacaaa

SEQ ID NO: 664636 - RNA, 24 nt, Homo sapiens
cgauugauugauguacagaacaca

SEQ ID NO: 664637 - RNA, 16 nt, Homo sapiens
cgauuucauaccuuau

SEQ ID NO: 664638 - RNA, 12 nt, Homo sapiens
cgauuugaggga

SEQ ID NO: 664639 - RNA, 19 nt, Homo sapiens
cgauuugggggcucgggga

SEQ ID NO: 664640 - RNA, 20 nt, Homo sapiens
cgcaaagggcugaaagccau

SEQ ID NO: 664641 - RNA, 13 nt, Homo sapiens
cgcaacaguuuuu

SEQ ID NO: 664642 - RNA, 21 nt, Homo sapiens
cgcaacccacguguaacuguc

SEQ ID NO: 664643 - RNA, 15 nt, Homo sapiens
cgcaauugcucaugc

SEQ ID NO: 664644 - RNA, 23 nt, Homo sapiens
cgcaauuuuaccuaguuugcacu

SEQ ID NO: 664645 - RNA, 14 nt, Homo sapiens
cgcacaaauuccac

SEQ ID NO: 664646 - RNA, 21 nt, Homo sapiens
cgcacagugcaguugaggucu

SEQ ID NO: 664647 - RNA, 13 nt, Homo sapiens
cgcaccacugcca

SEQ ID NO: 664648 - RNA, 15 nt, Homo sapiens
cgcaccagacacuca

SEQ ID NO: 664649 - RNA, 11 nt, Homo sapiens
cgcaccugccc

SEQ ID NO: 664650 - RNA, 16 nt, Homo sapiens
cgcaccuugucaugua

SEQ ID NO: 664651 - RNA, 21 nt, Homo sapiens
cgcagaaaacaagaugagauu

SEQ ID NO: 664652 - RNA, 17 nt, Homo sapiens
cgcaggcccggacucac

SEQ ID NO: 664653 - RNA, 15 nt, Homo sapiens
cgcaggguccaaagg

SEQ ID NO: 664654 - RNA, 18 nt, Homo sapiens
cgcaguuuggagucacug

SEQ ID NO: 664655 - RNA, 16 nt, Homo sapiens
cgcauccuaugcuuaa

SEQ ID NO: 664656 - RNA, 15 nt, Homo sapiens
cgcaugacuguuaca

SEQ ID NO: 664657 - RNA, 19 nt, Homo sapiens
cgcaugagaacauuaacaa

SEQ ID NO: 664658 - RNA, 11 nt, Homo sapiens
cgcaugugcag

SEQ ID NO: 664659 - RNA, 21 nt, Homo sapiens
cgcauugccacggaaacauac

SEQ ID NO: 664660 - RNA, 16 nt, Homo sapiens
cgcauuggugacucac

SEQ ID NO: 664661 - RNA, 14 nt, Homo sapiens
cgcauuucucaugc

SEQ ID NO: 664662 - RNA, 16 nt, Homo sapiens
cgccaaaacaagccaa

SEQ ID NO: 664663 - RNA, 18 nt, Homo sapiens
cgccacucccgggccaag

SEQ ID NO: 664664 - RNA, 20 nt, Homo sapiens
cgccagacagauugcugaua

SEQ ID NO: 664665 - RNA, 15 nt, Homo sapiens
cgccagcgaccucuc

SEQ ID NO: 664666 - RNA, 18 nt, Homo sapiens
cgcccaaaagauugaacu

SEQ ID NO: 664667 - RNA, 20 nt, Homo sapiens
cgcccacccgaguaccucca

SEQ ID NO: 664668 - RNA, 20 nt, Homo sapiens
cgcccaccucggccucccaa

SEQ ID NO: 664669 - RNA, 18 nt, Homo sapiens
cgcccagcucucccacau

SEQ ID NO: 664670 - RNA, 21 nt, Homo sapiens
cgcccaugugugagugugugc

SEQ ID NO: 664671 - RNA, 12 nt, Homo sapiens
cgcccauuuaga

SEQ ID NO: 664672 - RNA, 20 nt, Homo sapiens
cgccccccccuccccaugca

SEQ ID NO: 664673 - RNA, 19 nt, Homo sapiens
cgcccccuccgcccugcca

SEQ ID NO: 664674 - RNA, 16 nt, Homo sapiens
cgcccgaccaggauca

SEQ ID NO: 664675 - RNA, 15 nt, Homo sapiens
cgcccgcugagcuga

SEQ ID NO: 664676 - RNA, 12 nt, Homo sapiens
cgcccucagggg

SEQ ID NO: 664677 - RNA, 18 nt, Homo sapiens
cgcccucuaucaugguga

SEQ ID NO: 664678 - RNA, 19 nt, Homo sapiens
cgcccucucaugcagaagc

SEQ ID NO: 664679 - RNA, 19 nt, Homo sapiens
cgcccuuggcuucugugau

SEQ ID NO: 664680 - RNA, 13 nt, Homo sapiens
cgccgugcuguaa

SEQ ID NO: 664681 - RNA, 19 nt, Homo sapiens
cgccuacuggacgcugccc

SEQ ID NO: 664682 - RNA, 15 nt, Homo sapiens
cgccuaugaucccag

SEQ ID NO: 664683 - RNA, 20 nt, Homo sapiens
cgccuccaacccuagcaaaa

SEQ ID NO: 664684 - RNA, 15 nt, Homo sapiens
cgccugacaaccacu

SEQ ID NO: 664685 - RNA, 16 nt, Homo sapiens
cgccugcccagacuga

SEQ ID NO: 664686 - RNA, 15 nt, Homo sapiens
cgccugccugccacc

SEQ ID NO: 664687 - RNA, 12 nt, Homo sapiens
cgccugcuccuc

SEQ ID NO: 664688 - RNA, 16 nt, Homo sapiens
cgccuggcugcugcuu

SEQ ID NO: 664689 - RNA, 23 nt, Homo sapiens
cgccuuccucucuggauacugca

SEQ ID NO: 664690 - RNA, 15 nt, Homo sapiens
cgccuucucccacau

SEQ ID NO: 664691 - RNA, 12 nt, Homo sapiens
cgcgacuuccac

SEQ ID NO: 664692 - RNA, 14 nt, Homo sapiens
cgcgcccggccuca

SEQ ID NO: 664693 - RNA, 14 nt, Homo sapiens
cgcggcuaacuuau

SEQ ID NO: 664694 - RNA, 13 nt, Homo sapiens
cgcguguguacac

SEQ ID NO: 664695 - RNA, 21 nt, Homo sapiens
cgcuaaauauuuaccuugaaa

SEQ ID NO: 664696 - RNA, 18 nt, Homo sapiens
cgcuacccacuucuaaau

SEQ ID NO: 664697 - RNA, 20 nt, Homo sapiens
cgcuaugugacuugcgcuua

SEQ ID NO: 664698 - RNA, 22 nt, Homo sapiens
cgcuauuccucacucagaggaa

SEQ ID NO: 664699 - RNA, 12 nt, Homo sapiens
cgcuauugauuu

SEQ ID NO: 664700 - RNA, 13 nt, Homo sapiens
cgcucaucaccua

SEQ ID NO: 664701 - RNA, 17 nt, Homo sapiens
cgcuccaaugccuacug

SEQ ID NO: 664702 - RNA, 13 nt, Homo sapiens
cgcuccucgggaa

SEQ ID NO: 664703 - RNA, 20 nt, Homo sapiens
caaacaagggagaagagugu

SEQ ID NO: 664704 - RNA, 14 nt, Homo sapiens
caaacaaugguguc

SEQ ID NO: 664705 - RNA, 15 nt, Homo sapiens
caaacacuagcucug

SEQ ID NO: 664706 - RNA, 19 nt, Homo sapiens
caaacacucaguccacugu

SEQ ID NO: 664707 - RNA, 15 nt, Homo sapiens
caaacagaaacacaa

SEQ ID NO: 664708 - RNA, 16 nt, Homo sapiens
caaacagaaacacaaa

SEQ ID NO: 664709 - RNA, 16 nt, Homo sapiens
caaacagccacacugu

SEQ ID NO: 664710 - RNA, 17 nt, Homo sapiens
caaacagccacacugug

SEQ ID NO: 664711 - RNA, 17 nt, Homo sapiens
caaacagcccaaacugu

SEQ ID NO: 664712 - RNA, 20 nt, Homo sapiens
caaacagccccagucuuccu

SEQ ID NO: 664713 - RNA, 21 nt, Homo sapiens
caaacagccccucuggacaca

SEQ ID NO: 664714 - RNA, 22 nt, Homo sapiens
caaacagccccucuggacacag

SEQ ID NO: 664715 - RNA, 11 nt, Homo sapiens
caaacauauau

SEQ ID NO: 664716 - RNA, 23 nt, Homo sapiens
caaacauauccuuucaagacaga

SEQ ID NO: 664717 - RNA, 12 nt, Homo sapiens
caaacaucuaau

SEQ ID NO: 664718 - RNA, 18 nt, Homo sapiens
caaacaugcauccauuua

SEQ ID NO: 664719 - RNA, 12 nt, Homo sapiens
caaacaugccag

SEQ ID NO: 664720 - RNA, 21 nt, Homo sapiens
caaacauggguuuaguuuuca

SEQ ID NO: 664721 - RNA, 13 nt, Homo sapiens
caaaccaagcaaa

SEQ ID NO: 664722 - RNA, 13 nt, Homo sapiens
caaaccacuugcc

SEQ ID NO: 664723 - RNA, 14 nt, Homo sapiens
caaaccacuugccu

SEQ ID NO: 664724 - RNA, 15 nt, Homo sapiens
caaaccagacaccug

SEQ ID NO: 664725 - RNA, 18 nt, Homo sapiens
caaaccagcccuugaguc

SEQ ID NO: 664726 - RNA, 21 nt, Homo sapiens
caaaccaggauuuccuugacu

SEQ ID NO: 664727 - RNA, 15 nt, Homo sapiens
caaaccaggugcaau

SEQ ID NO: 664728 - RNA, 17 nt, Homo sapiens
caaaccaggugcaauua

SEQ ID NO: 664729 - RNA, 20 nt, Homo sapiens
caaaccaugagaauuugcaa

SEQ ID NO: 664730 - RNA, 21 nt, Homo sapiens
caaacccacgauuuucuccag

SEQ ID NO: 664731 - RNA, 16 nt, Homo sapiens
caaaccccgaccaccu

SEQ ID NO: 664732 - RNA, 17 nt, Homo sapiens
caaaccgagugcaauga

SEQ ID NO: 664733 - RNA, 17 nt, Homo sapiens
caaaccggacccggccg

SEQ ID NO: 664734 - RNA, 14 nt, Homo sapiens
caaaccuacuguau

SEQ ID NO: 664735 - RNA, 13 nt, Homo sapiens
caaaccuauggaa

SEQ ID NO: 664736 - RNA, 16 nt, Homo sapiens
caaaccugaccacaga

SEQ ID NO: 664737 - RNA, 22 nt, Homo sapiens
caaacgauuuggaucaaaagga

SEQ ID NO: 664738 - RNA, 12 nt, Homo sapiens
caaacgcuuauu

SEQ ID NO: 664739 - RNA, 18 nt, Homo sapiens
caaacuacagaauaaugu

SEQ ID NO: 664740 - RNA, 14 nt, Homo sapiens
caaacuacauguaa

SEQ ID NO: 664741 - RNA, 11 nt, Homo sapiens
caaacuaguau

SEQ ID NO: 664742 - RNA, 14 nt, Homo sapiens
caaacuaugaucac

SEQ ID NO: 664743 - RNA, 19 nt, Homo sapiens
caaacuaugaucacaguga

SEQ ID NO: 664744 - RNA, 12 nt, Homo sapiens
caaacuaugcau

SEQ ID NO: 664745 - RNA, 17 nt, Homo sapiens
caaacucaaacuugaga

SEQ ID NO: 664746 - RNA, 18 nt, Homo sapiens
caaacucacugcucaaga

SEQ ID NO: 664747 - RNA, 19 nt, Homo sapiens
caaacuccauucuccaggg

SEQ ID NO: 664748 - RNA, 15 nt, Homo sapiens
caaacuccugaccuc

SEQ ID NO: 664749 - RNA, 23 nt, Homo sapiens
caaacucuggggcucaagcaguu

SEQ ID NO: 664750 - RNA, 16 nt, Homo sapiens
caaacugaaagaucug

SEQ ID NO: 664751 - RNA, 11 nt, Homo sapiens
caaacugaaga

SEQ ID NO: 664752 - RNA, 13 nt, Homo sapiens
caaacugcaaaua

SEQ ID NO: 664753 - RNA, 12 nt, Homo sapiens
caaacugcaaua

SEQ ID NO: 664754 - RNA, 20 nt, Homo sapiens
caaacugccuauauugauaa

SEQ ID NO: 664755 - RNA, 23 nt, Homo sapiens
caaacuggggccuccagaacuca

SEQ ID NO: 664756 - RNA, 19 nt, Homo sapiens
caaacuguagcaagaugca

SEQ ID NO: 664757 - RNA, 19 nt, Homo sapiens
caaacuguauacauuacaa

SEQ ID NO: 664758 - RNA, 15 nt, Homo sapiens
caaacuucaaagagg

SEQ ID NO: 664759 - RNA, 16 nt, Homo sapiens
caaacuugaaaacaga

SEQ ID NO: 664760 - RNA, 22 nt, Homo sapiens
caaacuuugcaucucaguauga

SEQ ID NO: 664761 - RNA, 11 nt, Homo sapiens
caaacuuuuca

SEQ ID NO: 664762 - RNA, 19 nt, Homo sapiens
caaacuuuuuccagcaaaa

SEQ ID NO: 664763 - RNA, 23 nt, Homo sapiens
caaagaaaaaguaaaucaaagau

SEQ ID NO: 664764 - RNA, 15 nt, Homo sapiens
caaagaaagaugaaa

SEQ ID NO: 664765 - RNA, 14 nt, Homo sapiens
caaagaaccaaaga

SEQ ID NO: 664766 - RNA, 22 nt, Homo sapiens
caaagaagacucaguaugcuuu

SEQ ID NO: 664767 - RNA, 20 nt, Homo sapiens
caaagaagcuuccacaaaau

SEQ ID NO: 664768 - RNA, 20 nt, Homo sapiens
caaagaaggaauucuaggca

SEQ ID NO: 664769 - RNA, 13 nt, Homo sapiens
caaagaagguguu

SEQ ID NO: 664770 - RNA, 17 nt, Homo sapiens
caaagaaucuacuggaa

SEQ ID NO: 664771 - RNA, 17 nt, Homo sapiens
caaagaaucuaucacua

SEQ ID NO: 664772 - RNA, 14 nt, Homo sapiens
caaagaaugggcuu

SEQ ID NO: 664773 - RNA, 18 nt, Homo sapiens
caaagaaugggcuugaaa

SEQ ID NO: 664774 - RNA, 15 nt, Homo sapiens
caaagaauuacagua

SEQ ID NO: 664775 - RNA, 12 nt, Homo sapiens
caaagaauucca

SEQ ID NO: 664776 - RNA, 21 nt, Homo sapiens
caaagaauuucuucaguccag

SEQ ID NO: 664777 - RNA, 19 nt, Homo sapiens
caaagacaguauuuugaca

SEQ ID NO: 664778 - RNA, 14 nt, Homo sapiens
caaagaccaccucc

SEQ ID NO: 664779 - RNA, 17 nt, Homo sapiens
caaagacccagagcaaa

SEQ ID NO: 664780 - RNA, 11 nt, Homo sapiens
caaagacugua

SEQ ID NO: 664781 - RNA, 14 nt, Homo sapiens
caaagacuguaaau

SEQ ID NO: 664782 - RNA, 12 nt, Homo sapiens
caaagacuguac

SEQ ID NO: 664783 - RNA, 15 nt, Homo sapiens
caaagacuuaacugg

SEQ ID NO: 664784 - RNA, 22 nt, Homo sapiens
caaagagaaaaagaaaugcaaa

SEQ ID NO: 664785 - RNA, 19 nt, Homo sapiens
caaagagaaaucacagggg

SEQ ID NO: 664786 - RNA, 21 nt, Homo sapiens
caaagagaaugagaagacaug

SEQ ID NO: 664787 - RNA, 16 nt, Homo sapiens
caaagagagaaaguuu

SEQ ID NO: 664788 - RNA, 15 nt, Homo sapiens
caaagagguguacag

SEQ ID NO: 664789 - RNA, 19 nt, Homo sapiens
caaagaguauauguucccu

SEQ ID NO: 664790 - RNA, 13 nt, Homo sapiens
caaagaugcccca

SEQ ID NO: 664791 - RNA, 17 nt, Homo sapiens
caaagaugguggcugug

SEQ ID NO: 664792 - RNA, 15 nt, Homo sapiens
caaagauguuuacau

SEQ ID NO: 664793 - RNA, 13 nt, Homo sapiens
caaagauucucca

SEQ ID NO: 664794 - RNA, 21 nt, Homo sapiens
caaagauuuuuggcacuuugu

SEQ ID NO: 664795 - RNA, 16 nt, Homo sapiens
caaagcacaguuugaa

SEQ ID NO: 664796 - RNA, 14 nt, Homo sapiens
caaagcacauuggg

SEQ ID NO: 664797 - RNA, 21 nt, Homo sapiens
caaagcaggaguggaagguga

SEQ ID NO: 664798 - RNA, 21 nt, Homo sapiens
caaagcaggggaguaugcaaa

SEQ ID NO: 664799 - RNA, 19 nt, Homo sapiens
caaagcauuuucauuucua

SEQ ID NO: 664800 - RNA, 10 nt, Homo sapiens
caaagccaaa

SEQ ID NO: 664801 - RNA, 20 nt, Homo sapiens
caaagccaagggcaacagau

SEQ ID NO: 664802 - RNA, 15 nt, Homo sapiens
caaagccuuuccaga

SEQ ID NO: 664803 - RNA, 20 nt, Homo sapiens
caaagccuuuggcucuucua

SEQ ID NO: 664804 - RNA, 14 nt, Homo sapiens
caaagcgacagauu

SEQ ID NO: 664805 - RNA, 23 nt, Homo sapiens
caaagcguuucuuuacuucucac

SEQ ID NO: 664806 - RNA, 16 nt, Homo sapiens
caaagcuagaauguga

SEQ ID NO: 664807 - RNA, 17 nt, Homo sapiens
caaagcugaauacauuc

SEQ ID NO: 664808 - RNA, 19 nt, Homo sapiens
caaagcugccugugccaug

SEQ ID NO: 664809 - RNA, 12 nt, Homo sapiens
caaagcuguuaa

SEQ ID NO: 664810 - RNA, 20 nt, Homo sapiens
caaagcuguuaaacuguuag

SEQ ID NO: 664811 - RNA, 22 nt, Homo sapiens
caaagcuucccacggccuuucu

SEQ ID NO: 664812 - RNA, 17 nt, Homo sapiens
caaagcuugucaaagau

SEQ ID NO: 664813 - RNA, 19 nt, Homo sapiens
caaagcuuuggcugagacc

SEQ ID NO: 664814 - RNA, 20 nt, Homo sapiens
caaaggacagaguaugaaca

SEQ ID NO: 664815 - RNA, 18 nt, Homo sapiens
caaaggacccaaucccca

SEQ ID NO: 664816 - RNA, 23 nt, Homo sapiens
caaaggaccuucguuaagugaua

SEQ ID NO: 664817 - RNA, 16 nt, Homo sapiens
caaaggagcuuucuca

SEQ ID NO: 664818 - RNA, 17 nt, Homo sapiens
caaaggagcuuucucaa

SEQ ID NO: 664819 - RNA, 22 nt, Homo sapiens
caaaggaggggaaacaaugaaa

SEQ ID NO: 664820 - RNA, 15 nt, Homo sapiens
caaaggauacuguaa

SEQ ID NO: 664821 - RNA, 19 nt, Homo sapiens
caaaggcagagagucagac

SEQ ID NO: 664822 - RNA, 21 nt, Homo sapiens
caaaggcauccauagugcacu

SEQ ID NO: 664823 - RNA, 23 nt, Homo sapiens
caaagggaacugaagaccuccac

SEQ ID NO: 664824 - RNA, 16 nt, Homo sapiens
caaagggcacauauac

SEQ ID NO: 664825 - RNA, 17 nt, Homo sapiens
caaagggccagcagucu

SEQ ID NO: 664826 - RNA, 18 nt, Homo sapiens
caaagggccaucguucau

SEQ ID NO: 664827 - RNA, 16 nt, Homo sapiens
cgcuccucugccuugg

SEQ ID NO: 664828 - RNA, 18 nt, Homo sapiens
cgcucuccuccuucucug

SEQ ID NO: 664829 - RNA, 12 nt, Homo sapiens
cgcucugccauu

SEQ ID NO: 664830 - RNA, 10 nt, Homo sapiens
cgcucuggac

SEQ ID NO: 664831 - RNA, 14 nt, Homo sapiens
cgcugacugcacca

SEQ ID NO: 664832 - RNA, 16 nt, Homo sapiens
cgcugacugccaccca

SEQ ID NO: 664833 - RNA, 18 nt, Homo sapiens
cgcugcaccuaaagccua

SEQ ID NO: 664834 - RNA, 16 nt, Homo sapiens
cgcuggcuggugggcc

SEQ ID NO: 664835 - RNA, 14 nt, Homo sapiens
cgcugggugccugc

SEQ ID NO: 664836 - RNA, 12 nt, Homo sapiens
cgcugggugguu

SEQ ID NO: 664837 - RNA, 19 nt, Homo sapiens
cgcuguuuggauuuccuga

SEQ ID NO: 664838 - RNA, 16 nt, Homo sapiens
cgcuuaaccuuuccag

SEQ ID NO: 664839 - RNA, 20 nt, Homo sapiens
cgcuucugccuuuucacugu

SEQ ID NO: 664840 - RNA, 13 nt, Homo sapiens
cgcuugcuuuagc

SEQ ID NO: 664841 - RNA, 15 nt, Homo sapiens
cgcuuuguugcccag

SEQ ID NO: 664842 - RNA, 23 nt, Homo sapiens
cggaaacggucacgagacccaga

SEQ ID NO: 664843 - RNA, 19 nt, Homo sapiens
cggaagaggcugcugagaa

SEQ ID NO: 664844 - RNA, 19 nt, Homo sapiens
cggaagcccuugccugaaa

SEQ ID NO: 664845 - RNA, 18 nt, Homo sapiens
cggaagcucacagugaca

SEQ ID NO: 664846 - RNA, 18 nt, Homo sapiens
cggaagcugucgacuuca

SEQ ID NO: 664847 - RNA, 14 nt, Homo sapiens
cggacaaguuuuaa

SEQ ID NO: 664848 - RNA, 17 nt, Homo sapiens
cggacaguuuauuuguu

SEQ ID NO: 664849 - RNA, 15 nt, Homo sapiens
cggaccaaagcaaga

SEQ ID NO: 664850 - RNA, 16 nt, Homo sapiens
cggacccaucuuugcu

SEQ ID NO: 664851 - RNA, 23 nt, Homo sapiens
cggacgcaccugggacccugcac

SEQ ID NO: 664852 - RNA, 16 nt, Homo sapiens
cggagaagagcgcagu

SEQ ID NO: 664853 - RNA, 18 nt, Homo sapiens
cggagagagaauguauuu

SEQ ID NO: 664854 - RNA, 17 nt, Homo sapiens
cggagcugcugcugcuc

SEQ ID NO: 664855 - RNA, 16 nt, Homo sapiens
cggagcuugcagugag

SEQ ID NO: 664856 - RNA, 20 nt, Homo sapiens
cggagcuugcagugagccga

SEQ ID NO: 664857 - RNA, 20 nt, Homo sapiens
caaauaaugaguaguguaaa

SEQ ID NO: 664858 - RNA, 22 nt, Homo sapiens
caaauagaaccacuaugaagcu

SEQ ID NO: 664859 - RNA, 17 nt, Homo sapiens
caaauagauuucuuugc

SEQ ID NO: 664860 - RNA, 13 nt, Homo sapiens
caaauagcaaaga

SEQ ID NO: 664861 - RNA, 23 nt, Homo sapiens
caaauagguagagucauucauau

SEQ ID NO: 664862 - RNA, 15 nt, Homo sapiens
caaauauaagacauu

SEQ ID NO: 664863 - RNA, 15 nt, Homo sapiens
caaaucaaaccucag

SEQ ID NO: 664864 - RNA, 15 nt, Homo sapiens
caaaucaaagauuug

SEQ ID NO: 664865 - RNA, 17 nt, Homo sapiens
caaaucacgaccacuga

SEQ ID NO: 664866 - RNA, 21 nt, Homo sapiens
caaaucagcugcuacuacucc

SEQ ID NO: 664867 - RNA, 19 nt, Homo sapiens
caaaucauuauguuuccua

SEQ ID NO: 664868 - RNA, 17 nt, Homo sapiens
caaauccacaagccauu

SEQ ID NO: 664869 - RNA, 22 nt, Homo sapiens
caaaucccaagcaucauaucau

SEQ ID NO: 664870 - RNA, 23 nt, Homo sapiens
caaauccuggaaggacacaguga

SEQ ID NO: 664871 - RNA, 20 nt, Homo sapiens
caaauccugucggucuccag

SEQ ID NO: 664872 - RNA, 23 nt, Homo sapiens
caaauccuuucugccccccaggg

SEQ ID NO: 664873 - RNA, 15 nt, Homo sapiens
caaaucgaaacaaca

SEQ ID NO: 664874 - RNA, 14 nt, Homo sapiens
caaaucgcccccuu

SEQ ID NO: 664875 - RNA, 16 nt, Homo sapiens
caaaucguauaccuua

SEQ ID NO: 664876 - RNA, 14 nt, Homo sapiens
caaaucgugccuug

SEQ ID NO: 664877 - RNA, 18 nt, Homo sapiens
caaaucucaaaguguaca

SEQ ID NO: 664878 - RNA, 12 nt, Homo sapiens
caaaucucaguu

SEQ ID NO: 664879 - RNA, 22 nt, Homo sapiens
caaaucuccaguauucuuguca

SEQ ID NO: 664880 - RNA, 13 nt, Homo sapiens
caaaucucucaua

SEQ ID NO: 664881 - RNA, 14 nt, Homo sapiens
caaaucucuuccac

SEQ ID NO: 664882 - RNA, 20 nt, Homo sapiens
caaaucucuuccacaugggu

SEQ ID NO: 664883 - RNA, 15 nt, Homo sapiens
caaaucugauuucau

SEQ ID NO: 664884 - RNA, 23 nt, Homo sapiens
caaaucugauuucauuacauuuc

SEQ ID NO: 664885 - RNA, 21 nt, Homo sapiens
caaaucuggguaucuuuccag

SEQ ID NO: 664886 - RNA, 19 nt, Homo sapiens
caaaucuguaaucagcaau

SEQ ID NO: 664887 - RNA, 20 nt, Homo sapiens
caaaucuguccucuguagua

SEQ ID NO: 664888 - RNA, 21 nt, Homo sapiens
caaaucuugguugaugccaaa

SEQ ID NO: 664889 - RNA, 15 nt, Homo sapiens
caaaugacagauucu

SEQ ID NO: 664890 - RNA, 23 nt, Homo sapiens
caaaugacagauucugacauuua

SEQ ID NO: 664891 - RNA, 15 nt, Homo sapiens
caaaugcacaucuca

SEQ ID NO: 664892 - RNA, 16 nt, Homo sapiens
caaaugcacaucucau

SEQ ID NO: 664893 - RNA, 20 nt, Homo sapiens
caaaugcauacaaguuucau

SEQ ID NO: 664894 - RNA, 15 nt, Homo sapiens
caaaugccacacggc

SEQ ID NO: 664895 - RNA, 19 nt, Homo sapiens
caaaugccugguaccagag

SEQ ID NO: 664896 - RNA, 19 nt, Homo sapiens
caaaugcuacauauaugca

SEQ ID NO: 664897 - RNA, 21 nt, Homo sapiens
caaaugcuuuaacagcugaua

SEQ ID NO: 664898 - RNA, 19 nt, Homo sapiens
caaauggacauaagacaga

SEQ ID NO: 664899 - RNA, 21 nt, Homo sapiens
caaauggcaccgagacaauga

SEQ ID NO: 664900 - RNA, 19 nt, Homo sapiens
caaauggcgacaguugcuu

SEQ ID NO: 664901 - RNA, 18 nt, Homo sapiens
caaaugggaaaaccagac

SEQ ID NO: 664902 - RNA, 22 nt, Homo sapiens
caaaugggggaaaaguuaguca

SEQ ID NO: 664903 - RNA, 15 nt, Homo sapiens
caaaugggucccuca

SEQ ID NO: 664904 - RNA, 15 nt, Homo sapiens
caaauggugcugaau

SEQ ID NO: 664905 - RNA, 19 nt, Homo sapiens
caaauguacagugguccuu

SEQ ID NO: 664906 - RNA, 12 nt, Homo sapiens
caaaugucauca

SEQ ID NO: 664907 - RNA, 19 nt, Homo sapiens
caaaugucuaucaacuuua

SEQ ID NO: 664908 - RNA, 14 nt, Homo sapiens
caaaugugcugcuu

SEQ ID NO: 664909 - RNA, 16 nt, Homo sapiens
caaaugugcugucaaa

SEQ ID NO: 664910 - RNA, 18 nt, Homo sapiens
caaauguugaccuuugag

SEQ ID NO: 664911 - RNA, 15 nt, Homo sapiens
caaauuaacuguaug

SEQ ID NO: 664912 - RNA, 15 nt, Homo sapiens
caaauuaaggcauaa

SEQ ID NO: 664913 - RNA, 20 nt, Homo sapiens
caaauuagaaacaccauuca

SEQ ID NO: 664914 - RNA, 15 nt, Homo sapiens
caaauuagcaugcaa

SEQ ID NO: 664915 - RNA, 14 nt, Homo sapiens
caaauuaucuucac

SEQ ID NO: 664916 - RNA, 15 nt, Homo sapiens
caaauuaucuugaua

SEQ ID NO: 664917 - RNA, 23 nt, Homo sapiens
caaauuauuuauuacuugugcac

SEQ ID NO: 664918 - RNA, 17 nt, Homo sapiens
caaauucaguuucauaa

SEQ ID NO: 664919 - RNA, 13 nt, Homo sapiens
caaauucauggca

SEQ ID NO: 664920 - RNA, 19 nt, Homo sapiens
caaauucuguuucuugaga

SEQ ID NO: 664921 - RNA, 17 nt, Homo sapiens
caaauucuuuugaauug

SEQ ID NO: 664922 - RNA, 17 nt, Homo sapiens
caaauugaugugcccua

SEQ ID NO: 664923 - RNA, 13 nt, Homo sapiens
caaauugcugcuu

SEQ ID NO: 664924 - RNA, 23 nt, Homo sapiens
caaauuggaauggaacuacugua

SEQ ID NO: 664925 - RNA, 23 nt, Homo sapiens
caaauugggaaauccauuccauu

SEQ ID NO: 664926 - RNA, 19 nt, Homo sapiens
caaauuguaguucuugucu

SEQ ID NO: 664927 - RNA, 18 nt, Homo sapiens
caaauuuauacacugauu

SEQ ID NO: 664928 - RNA, 20 nt, Homo sapiens
caaauuuaugcauuucauuc

SEQ ID NO: 664929 - RNA, 13 nt, Homo sapiens
caaauuucaugca

SEQ ID NO: 664930 - RNA, 20 nt, Homo sapiens
caaauuuuagaacuuuaccu

SEQ ID NO: 664931 - RNA, 14 nt, Homo sapiens
caaauuuucaaguu

SEQ ID NO: 664932 - RNA, 16 nt, Homo sapiens
caaauuuuucaaauca

SEQ ID NO: 664933 - RNA, 20 nt, Homo sapiens
caacaaaaacaaacaaaagc

SEQ ID NO: 664934 - RNA, 16 nt, Homo sapiens
caacaaaaaccaaaaa

SEQ ID NO: 664935 - RNA, 17 nt, Homo sapiens
caacaaaaaccaaaaaa

SEQ ID NO: 664936 - RNA, 13 nt, Homo sapiens
caacaaaccaagc

SEQ ID NO: 664937 - RNA, 19 nt, Homo sapiens
caacaaagccaacagucaa

SEQ ID NO: 664938 - RNA, 15 nt, Homo sapiens
caacaagaccaccac

SEQ ID NO: 664939 - RNA, 14 nt, Homo sapiens
caacaagccauagu

SEQ ID NO: 664940 - RNA, 14 nt, Homo sapiens
caacaagccucaaa

SEQ ID NO: 664941 - RNA, 20 nt, Homo sapiens
caacaaggaucaggcugcug

SEQ ID NO: 664942 - RNA, 14 nt, Homo sapiens
caacaaggcaaaau

SEQ ID NO: 664943 - RNA, 20 nt, Homo sapiens
caacaaggcugcacagcuca

SEQ ID NO: 664944 - RNA, 17 nt, Homo sapiens
caacaauauauguccua

SEQ ID NO: 664945 - RNA, 21 nt, Homo sapiens
caacaauccaucucucaagua

SEQ ID NO: 664946 - RNA, 17 nt, Homo sapiens
caacaauccuauggaaa

SEQ ID NO: 664947 - RNA, 20 nt, Homo sapiens
caacacaucucccuuuucca

SEQ ID NO: 664948 - RNA, 15 nt, Homo sapiens
caacaccaagcacag

SEQ ID NO: 664949 - RNA, 18 nt, Homo sapiens
caacacccaaguugaaga

SEQ ID NO: 664950 - RNA, 12 nt, Homo sapiens
cguccaccaggc

SEQ ID NO: 664951 - RNA, 20 nt, Homo sapiens
cguccagcuggaagggucaa

SEQ ID NO: 664952 - RNA, 13 nt, Homo sapiens
cgucccaccagcu

SEQ ID NO: 664953 - RNA, 16 nt, Homo sapiens
cgucccauaccuuguu

SEQ ID NO: 664954 - RNA, 17 nt, Homo sapiens
cgucccccaaacauguu

SEQ ID NO: 664955 - RNA, 13 nt, Homo sapiens
cguccuacuguau

SEQ ID NO: 664956 - RNA, 13 nt, Homo sapiens
cguccuccgucca

SEQ ID NO: 664957 - RNA, 17 nt, Homo sapiens
cguccugucacugaugg

SEQ ID NO: 664958 - RNA, 16 nt, Homo sapiens
cgucgguccuggugcc

SEQ ID NO: 664959 - RNA, 12 nt, Homo sapiens
cgucgugcaguc

SEQ ID NO: 664960 - RNA, 13 nt, Homo sapiens
cgucucaaucucc

SEQ ID NO: 664961 - RNA, 17 nt, Homo sapiens
cgucuccgaagauuugg

SEQ ID NO: 664962 - RNA, 15 nt, Homo sapiens
cgucuccuucacuga

SEQ ID NO: 664963 - RNA, 19 nt, Homo sapiens
cgucucggccccucugauu

SEQ ID NO: 664964 - RNA, 21 nt, Homo sapiens
cgucucuacuaaaaaauacaa

SEQ ID NO: 664965 - RNA, 12 nt, Homo sapiens
cgugaaacacac

SEQ ID NO: 664966 - RNA, 17 nt, Homo sapiens
cgugaaaccccaucucu

SEQ ID NO: 664967 - RNA, 15 nt, Homo sapiens
cgugacaacacaaau

SEQ ID NO: 664968 - RNA, 21 nt, Homo sapiens
cgugacccguccauucuucag

SEQ ID NO: 664969 - RNA, 12 nt, Homo sapiens
cgugagaaggag

SEQ ID NO: 664970 - RNA, 22 nt, Homo sapiens
cgugagggcaagagggggaccu

SEQ ID NO: 664971 - RNA, 16 nt, Homo sapiens
cgugauuuugcuguag

SEQ ID NO: 664972 - RNA, 20 nt, Homo sapiens
cgugcauuuuuggaucauuu

SEQ ID NO: 664973 - RNA, 14 nt, Homo sapiens
cgugccaugaucug

SEQ ID NO: 664974 - RNA, 18 nt, Homo sapiens
cgugcccgugugcauguc

SEQ ID NO: 664975 - RNA, 17 nt, Homo sapiens
cgugccgccugcuccuc

SEQ ID NO: 664976 - RNA, 15 nt, Homo sapiens
cgugcgagcacacac

SEQ ID NO: 664977 - RNA, 21 nt, Homo sapiens
cgugcgcgugagugugugagc

SEQ ID NO: 664978 - RNA, 21 nt, Homo sapiens
cgugcugagaggcgagcuccu

SEQ ID NO: 664979 - RNA, 17 nt, Homo sapiens
caacauuaaacacaaag

SEQ ID NO: 664980 - RNA, 16 nt, Homo sapiens
caacauugugauguau

SEQ ID NO: 664981 - RNA, 18 nt, Homo sapiens
caaccaagucaugugcau

SEQ ID NO: 664982 - RNA, 22 nt, Homo sapiens
caaccaggaagaguucuauccc

SEQ ID NO: 664983 - RNA, 22 nt, Homo sapiens
caaccaguuaaagccacagaug

SEQ ID NO: 664984 - RNA, 13 nt, Homo sapiens
caaccauauuugu

SEQ ID NO: 664985 - RNA, 21 nt, Homo sapiens
caacccaggcaguaccauuca

SEQ ID NO: 664986 - RNA, 16 nt, Homo sapiens
caaccccagacacugg

SEQ ID NO: 664987 - RNA, 21 nt, Homo sapiens
caacccgacauguguaccuca

SEQ ID NO: 664988 - RNA, 13 nt, Homo sapiens
caacccgaggcaa

SEQ ID NO: 664989 - RNA, 22 nt, Homo sapiens
caacccgucuggcccaccaggg

SEQ ID NO: 664990 - RNA, 13 nt, Homo sapiens
caacccuaucucc

SEQ ID NO: 664991 - RNA, 20 nt, Homo sapiens
caacccucagauuugaugau

SEQ ID NO: 664992 - RNA, 19 nt, Homo sapiens
caaccgaguggcugucauc

SEQ ID NO: 664993 - RNA, 22 nt, Homo sapiens
caaccgcuucccuauuuauuua

SEQ ID NO: 664994 - RNA, 18 nt, Homo sapiens
caaccggucacccaggag

SEQ ID NO: 664995 - RNA, 19 nt, Homo sapiens
caaccuaaugcucucaggg

SEQ ID NO: 664996 - RNA, 13 nt, Homo sapiens
caaccuccugggu

SEQ ID NO: 664997 - RNA, 16 nt, Homo sapiens
caaccugacuuccucu

SEQ ID NO: 664998 - RNA, 18 nt, Homo sapiens
caaccugccugugcauga

SEQ ID NO: 664999 - RNA, 21 nt, Homo sapiens
caaccugcucuccucuugcca

SEQ ID NO: 665000 - RNA, 22 nt, Homo sapiens
caaccugcugaagggcagaggu

SEQ ID NO: 665001 - RNA, 16 nt, Homo sapiens
caaccuguuaccuacu

SEQ ID NO: 665002 - RNA, 20 nt, Homo sapiens
caaccuuaucaaggauuuuc

SEQ ID NO: 665003 - RNA, 16 nt, Homo sapiens
caaccuuccauucaca

SEQ ID NO: 665004 - RNA, 14 nt, Homo sapiens
caaccuugcaguau

SEQ ID NO: 665005 - RNA, 15 nt, Homo sapiens
caaccuuguuucuac

SEQ ID NO: 665006 - RNA, 14 nt, Homo sapiens
caaccuuucccuca

SEQ ID NO: 665007 - RNA, 17 nt, Homo sapiens
caaccuuuguguggcuc

SEQ ID NO: 665008 - RNA, 19 nt, Homo sapiens
caacgagugaaacuccguc

SEQ ID NO: 665009 - RNA, 16 nt, Homo sapiens
caacggccgacugccu

SEQ ID NO: 665010 - RNA, 22 nt, Homo sapiens
caacgguauccagggacuauga

SEQ ID NO: 665011 - RNA, 14 nt, Homo sapiens
caacuaaugccuua

SEQ ID NO: 665012 - RNA, 15 nt, Homo sapiens
caacuacugugauca

SEQ ID NO: 665013 - RNA, 13 nt, Homo sapiens
caacuaggccuca

SEQ ID NO: 665014 - RNA, 21 nt, Homo sapiens
caacuaguagcuaaccaucac

SEQ ID NO: 665015 - RNA, 19 nt, Homo sapiens
caacuaucaauucuugaga

SEQ ID NO: 665016 - RNA, 15 nt, Homo sapiens
caacucacagcuucu

SEQ ID NO: 665017 - RNA, 21 nt, Homo sapiens
caacuccuccauuuuccuccc

SEQ ID NO: 665018 - RNA, 12 nt, Homo sapiens
caacuccuggaa

SEQ ID NO: 665019 - RNA, 21 nt, Homo sapiens
caacucuaaagccaagcacuu

SEQ ID NO: 665020 - RNA, 20 nt, Homo sapiens
caacucuaccccugcuccca

SEQ ID NO: 665021 - RNA, 15 nt, Homo sapiens
caacucuccacucca

SEQ ID NO: 665022 - RNA, 22 nt, Homo sapiens
caacucuccccugaccugugag

SEQ ID NO: 665023 - RNA, 18 nt, Homo sapiens
caacucugagaucuaagg

SEQ ID NO: 665024 - RNA, 20 nt, Homo sapiens
caacucugagaucuaaggau

SEQ ID NO: 665025 - RNA, 18 nt, Homo sapiens
caacucugauguggaaug

SEQ ID NO: 665026 - RNA, 17 nt, Homo sapiens
caacucugggaaaacca

SEQ ID NO: 665027 - RNA, 22 nt, Homo sapiens
caacucuguaaauauguaugua

SEQ ID NO: 665028 - RNA, 14 nt, Homo sapiens
caacucuugcacag

SEQ ID NO: 665029 - RNA, 21 nt, Homo sapiens
caacugaagccuucuucugcc

SEQ ID NO: 665030 - RNA, 10 nt, Homo sapiens
caacugacca

SEQ ID NO: 665031 - RNA, 20 nt, Homo sapiens
caacugagagucauauacau

SEQ ID NO: 665032 - RNA, 17 nt, Homo sapiens
caacugcaaaaaaagcc

SEQ ID NO: 665033 - RNA, 15 nt, Homo sapiens
caacugcauaaccuu

SEQ ID NO: 665034 - RNA, 15 nt, Homo sapiens
caacugcgacuguga

SEQ ID NO: 665035 - RNA, 22 nt, Homo sapiens
caacugcuguucauguuacuca

SEQ ID NO: 665036 - RNA, 13 nt, Homo sapiens
caacuggacucau

SEQ ID NO: 665037 - RNA, 19 nt, Homo sapiens
caacuggcugaaagguuaa

SEQ ID NO: 665038 - RNA, 20 nt, Homo sapiens
caacuggcuucugugcacua

SEQ ID NO: 665039 - RNA, 21 nt, Homo sapiens
caacuggggaauugaagccaa

SEQ ID NO: 665040 - RNA, 18 nt, Homo sapiens
caacugucucucuucuca

SEQ ID NO: 665041 - RNA, 23 nt, Homo sapiens
caacuguuuuaauaaaagauuua

SEQ ID NO: 665042 - RNA, 21 nt, Homo sapiens
caacuuaaaagucaguaucau

SEQ ID NO: 665043 - RNA, 23 nt, Homo sapiens
caacuuaacaaaacaagugcaag

SEQ ID NO: 665044 - RNA, 14 nt, Homo sapiens
caacuuaacucacu

SEQ ID NO: 665045 - RNA, 20 nt, Homo sapiens
caacuucagaaagacaguga

SEQ ID NO: 665046 - RNA, 14 nt, Homo sapiens
caacuucagcagua

SEQ ID NO: 665047 - RNA, 23 nt, Homo sapiens
caacuucaguuuuauuuuugcca

SEQ ID NO: 665048 - RNA, 13 nt, Homo sapiens
caacuucccacac

SEQ ID NO: 665049 - RNA, 11 nt, Homo sapiens
caacuugagau

SEQ ID NO: 665050 - RNA, 13 nt, Homo sapiens
caacuuuacugua

SEQ ID NO: 665051 - RNA, 20 nt, Homo sapiens
caacuuuguggaugucuucc

SEQ ID NO: 665052 - RNA, 15 nt, Homo sapiens
caacuuuguuuucca

SEQ ID NO: 665053 - RNA, 17 nt, Homo sapiens
caacuuuuuguuacaga

SEQ ID NO: 665054 - RNA, 13 nt, Homo sapiens
caagaaaaauaau

SEQ ID NO: 665055 - RNA, 14 nt, Homo sapiens
caagaaaaccacaa

SEQ ID NO: 665056 - RNA, 17 nt, Homo sapiens
caagaaaauaaaacuaa

SEQ ID NO: 665057 - RNA, 16 nt, Homo sapiens
caagaaacgucuucua

SEQ ID NO: 665058 - RNA, 19 nt, Homo sapiens
caagaaaggggacccaaga

SEQ ID NO: 665059 - RNA, 17 nt, Homo sapiens
caagaaaguauuuggua

SEQ ID NO: 665060 - RNA, 19 nt, Homo sapiens
caagaaauccaguuuccca

SEQ ID NO: 665061 - RNA, 13 nt, Homo sapiens
caagaacacugga

SEQ ID NO: 665062 - RNA, 15 nt, Homo sapiens
caagaacugaaacca

SEQ ID NO: 665063 - RNA, 18 nt, Homo sapiens
caagaacugcauggaccu

SEQ ID NO: 665064 - RNA, 22 nt, Homo sapiens
caagaagaaauaugaaauucca

SEQ ID NO: 665065 - RNA, 15 nt, Homo sapiens
caagaagaaugaacu

SEQ ID NO: 665066 - RNA, 19 nt, Homo sapiens
caagaagaccagacugugg

SEQ ID NO: 665067 - RNA, 18 nt, Homo sapiens
caagaagaggaaagggag

SEQ ID NO: 665068 - RNA, 15 nt, Homo sapiens
caagaagcaugcaga

SEQ ID NO: 665069 - RNA, 12 nt, Homo sapiens
caagaaggugag

SEQ ID NO: 665070 - RNA, 17 nt, Homo sapiens
caagaagucaaaguaaa

SEQ ID NO: 665071 - RNA, 20 nt, Homo sapiens
caagaaguucuuguucuuca

SEQ ID NO: 665072 - RNA, 13 nt, Homo sapiens
caagaauaauuca

SEQ ID NO: 665073 - RNA, 17 nt, Homo sapiens
caagaauauugcaaaau

SEQ ID NO: 665074 - RNA, 15 nt, Homo sapiens
cuaaagcaauaugca

SEQ ID NO: 665075 - RNA, 21 nt, Homo sapiens
cuaaagcagaggcaacacugg

SEQ ID NO: 665076 - RNA, 20 nt, Homo sapiens
cuaaagccaaggguauccaa

SEQ ID NO: 665077 - RNA, 18 nt, Homo sapiens
cuaaagccuuaacuaaga

SEQ ID NO: 665078 - RNA, 17 nt, Homo sapiens
cuaaagcuuuggacaag

SEQ ID NO: 665079 - RNA, 11 nt, Homo sapiens
cuaaagggcag

SEQ ID NO: 665080 - RNA, 15 nt, Homo sapiens
cuaaaggugcacugc

SEQ ID NO: 665081 - RNA, 16 nt, Homo sapiens
cuaaaggugcacugcu

SEQ ID NO: 665082 - RNA, 14 nt, Homo sapiens
cuaaagguuaccug

SEQ ID NO: 665083 - RNA, 18 nt, Homo sapiens
cuaaagguuaccuguugu

SEQ ID NO: 665084 - RNA, 22 nt, Homo sapiens
cuaaagguuuuaaccgcacaug

SEQ ID NO: 665085 - RNA, 17 nt, Homo sapiens
cuaaaguauaucuuuaa

SEQ ID NO: 665086 - RNA, 17 nt, Homo sapiens
cuaaagucauccauccu

SEQ ID NO: 665087 - RNA, 22 nt, Homo sapiens
cuaaaguuaaauaggauauuaa

SEQ ID NO: 665088 - RNA, 18 nt, Homo sapiens
cuaaaguuacaaacagac

SEQ ID NO: 665089 - RNA, 19 nt, Homo sapiens
cuaaauaaaaaaaugaaua

SEQ ID NO: 665090 - RNA, 17 nt, Homo sapiens
cuaaauaaaaauaugua

SEQ ID NO: 665091 - RNA, 13 nt, Homo sapiens
cuaaauaaauggg

SEQ ID NO: 665092 - RNA, 14 nt, Homo sapiens
cuaaauaggagaua

SEQ ID NO: 665093 - RNA, 20 nt, Homo sapiens
cuaaauauccaaagacugua

SEQ ID NO: 665094 - RNA, 18 nt, Homo sapiens
cuaaaucagagacaaaau

SEQ ID NO: 665095 - RNA, 18 nt, Homo sapiens
cuaaauccuuuacuguua

SEQ ID NO: 665096 - RNA, 20 nt, Homo sapiens
cuaaauccuuuuguuuugaa

SEQ ID NO: 665097 - RNA, 15 nt, Homo sapiens
cuaaaucucuaauau

SEQ ID NO: 665098 - RNA, 14 nt, Homo sapiens
cuaaaugaacuaau

SEQ ID NO: 665099 - RNA, 18 nt, Homo sapiens
cuaaaugaaugagccaaa

SEQ ID NO: 665100 - RNA, 22 nt, Homo sapiens
cuaaaugcagacaacaccuucc

SEQ ID NO: 665101 - RNA, 16 nt, Homo sapiens
aguacaaggugguaug

SEQ ID NO: 665102 - RNA, 13 nt, Homo sapiens
aguacaaguauau

SEQ ID NO: 665103 - RNA, 14 nt, Homo sapiens
aguacaaugcccag

SEQ ID NO: 665104 - RNA, 20 nt, Homo sapiens
aguacaauguuaacccuaaa

SEQ ID NO: 665105 - RNA, 23 nt, Homo sapiens
aguacacuguuucaaacuuuacu

SEQ ID NO: 665106 - RNA, 20 nt, Homo sapiens
aguacacuugguguacuggg

SEQ ID NO: 665107 - RNA, 14 nt, Homo sapiens
aguacagacagaag

SEQ ID NO: 665108 - RNA, 16 nt, Homo sapiens
aguacauaauugauua

SEQ ID NO: 665109 - RNA, 12 nt, Homo sapiens
aguacaucucua

SEQ ID NO: 665110 - RNA, 17 nt, Homo sapiens
aguacaucucuacuaaa

SEQ ID NO: 665111 - RNA, 18 nt, Homo sapiens
aguacaucucuacuaaaa

SEQ ID NO: 665112 - RNA, 19 nt, Homo sapiens
aguacaugauaaaugauag

SEQ ID NO: 665113 - RNA, 14 nt, Homo sapiens
aguaccacacauau

SEQ ID NO: 665114 - RNA, 15 nt, Homo sapiens
aguaccacucaggcc

SEQ ID NO: 665115 - RNA, 22 nt, Homo sapiens
aguaccauuaaaaccagaaagg

SEQ ID NO: 665116 - RNA, 16 nt, Homo sapiens
aguaccccugggaggu

SEQ ID NO: 665117 - RNA, 20 nt, Homo sapiens
aguaccccugguaaaccaag

SEQ ID NO: 665118 - RNA, 16 nt, Homo sapiens
aguaccgccagcagcu

SEQ ID NO: 665119 - RNA, 21 nt, Homo sapiens
aguaccuagcuggcucuguga

SEQ ID NO: 665120 - RNA, 18 nt, Homo sapiens
aguaccuauauugauuua

SEQ ID NO: 665121 - RNA, 22 nt, Homo sapiens
aguaccucuguauagaaaucua

SEQ ID NO: 665122 - RNA, 17 nt, Homo sapiens
aguaccuucaauacuua

SEQ ID NO: 665123 - RNA, 17 nt, Homo sapiens
aguacgaaccuacaguu

SEQ ID NO: 665124 - RNA, 18 nt, Homo sapiens
aguacguugugcauuugg

SEQ ID NO: 665125 - RNA, 22 nt, Homo sapiens
aguacuagaugcaucacugggu

SEQ ID NO: 665126 - RNA, 19 nt, Homo sapiens
aguacucaaauauuucuga

SEQ ID NO: 665127 - RNA, 20 nt, Homo sapiens
aguacucaguauagcauuga

SEQ ID NO: 665128 - RNA, 12 nt, Homo sapiens
aguacuggcaca

SEQ ID NO: 665129 - RNA, 17 nt, Homo sapiens
aguacuguacagggugg

SEQ ID NO: 665130 - RNA, 16 nt, Homo sapiens
aguacuuauguugcac

SEQ ID NO: 665131 - RNA, 17 nt, Homo sapiens
aguacuugaaacaguca

SEQ ID NO: 665132 - RNA, 13 nt, Homo sapiens
aguacuugucaua

SEQ ID NO: 665133 - RNA, 15 nt, Homo sapiens
aguacuuuauuguac

SEQ ID NO: 665134 - RNA, 15 nt, Homo sapiens
aguacuuugugcauu

SEQ ID NO: 665135 - RNA, 16 nt, Homo sapiens
aguacuuuucuguuca

SEQ ID NO: 665136 - RNA, 21 nt, Homo sapiens
aguacuuuucuguucaucacc

SEQ ID NO: 665137 - RNA, 22 nt, Homo sapiens
aguagaaagcauaacaaaaaga

SEQ ID NO: 665138 - RNA, 13 nt, Homo sapiens
aguagaacugucu

SEQ ID NO: 665139 - RNA, 15 nt, Homo sapiens
aguagaauuaccauu

SEQ ID NO: 665140 - RNA, 13 nt, Homo sapiens
aguagacauuuau

SEQ ID NO: 665141 - RNA, 17 nt, Homo sapiens
aguagacuuggacccaa

SEQ ID NO: 665142 - RNA, 20 nt, Homo sapiens
aguagagaugggguuucacc

SEQ ID NO: 665143 - RNA, 20 nt, Homo sapiens
aguagaggacuaaccaugug

SEQ ID NO: 665144 - RNA, 21 nt, Homo sapiens
aguagauucuuacaaggcccu

SEQ ID NO: 665145 - RNA, 16 nt, Homo sapiens
aguagauuuuuaacaa

SEQ ID NO: 665146 - RNA, 22 nt, Homo sapiens
aguagcaggacuaggcauguca

SEQ ID NO: 665147 - RNA, 18 nt, Homo sapiens
aguagcaggucaaaaacc

SEQ ID NO: 665148 - RNA, 15 nt, Homo sapiens
aguagcauccuguga

SEQ ID NO: 665149 - RNA, 16 nt, Homo sapiens
aguagccccuaaucac

SEQ ID NO: 665150 - RNA, 19 nt, Homo sapiens
aguagcugcccuuccugcc

SEQ ID NO: 665151 - RNA, 16 nt, Homo sapiens
aguagcuggauuacag

SEQ ID NO: 665152 - RNA, 23 nt, Homo sapiens
aguagcuuaccagaagcuuccau

SEQ ID NO: 665153 - RNA, 16 nt, Homo sapiens
aguaggacuuuccuaa

SEQ ID NO: 665154 - RNA, 19 nt, Homo sapiens
aguaggcauauaucacuaa

SEQ ID NO: 665155 - RNA, 16 nt, Homo sapiens
aguagggguugaagaa

SEQ ID NO: 665156 - RNA, 16 nt, Homo sapiens
aguagguuuacauuca

SEQ ID NO: 665157 - RNA, 22 nt, Homo sapiens
aguagguuuacauucaucucau

SEQ ID NO: 665158 - RNA, 17 nt, Homo sapiens
aguaguacuucuucugu

SEQ ID NO: 665159 - RNA, 23 nt, Homo sapiens
aguaguacuucuucuguaauauu

SEQ ID NO: 665160 - RNA, 16 nt, Homo sapiens
aguaguauuaccaccc

SEQ ID NO: 665161 - RNA, 18 nt, Homo sapiens
aguagucaaaaacaaagc

SEQ ID NO: 665162 - RNA, 18 nt, Homo sapiens
aguagucccugcacagug

SEQ ID NO: 665163 - RNA, 12 nt, Homo sapiens
aguagucucugu

SEQ ID NO: 665164 - RNA, 16 nt, Homo sapiens
aguaguuuuucagcua

SEQ ID NO: 665165 - RNA, 14 nt, Homo sapiens
aguauaacaacuuu

SEQ ID NO: 665166 - RNA, 14 nt, Homo sapiens
aguauaaucuuuuc

SEQ ID NO: 665167 - RNA, 14 nt, Homo sapiens
aguauaauuuaacu

SEQ ID NO: 665168 - RNA, 19 nt, Homo sapiens
aguauacuagggagccauu

SEQ ID NO: 665169 - RNA, 18 nt, Homo sapiens
aguauauaauaugucacc

SEQ ID NO: 665170 - RNA, 22 nt, Homo sapiens
aguauaugaauuacccuuucau

SEQ ID NO: 665171 - RNA, 12 nt, Homo sapiens
aguauauguuaa

SEQ ID NO: 665172 - RNA, 21 nt, Homo sapiens
aguauauuuccgcacuucaga

SEQ ID NO: 665173 - RNA, 18 nt, Homo sapiens
aguauauuuuuacuucuu

SEQ ID NO: 665174 - RNA, 17 nt, Homo sapiens
aguaucacgauuugcag

SEQ ID NO: 665175 - RNA, 21 nt, Homo sapiens
aguaucaggucucccacgugg

SEQ ID NO: 665176 - RNA, 14 nt, Homo sapiens
aguaucauacuuac

SEQ ID NO: 665177 - RNA, 15 nt, Homo sapiens
aguauccaggcuuug

SEQ ID NO: 665178 - RNA, 15 nt, Homo sapiens
aguauccaugcucuu

SEQ ID NO: 665179 - RNA, 14 nt, Homo sapiens
aguaucccacaucc

SEQ ID NO: 665180 - RNA, 16 nt, Homo sapiens
aguaugaggcauuugu

SEQ ID NO: 665181 - RNA, 13 nt, Homo sapiens
aguaugccuuaag

SEQ ID NO: 665182 - RNA, 17 nt, Homo sapiens
aguaugccuuaagcaga

SEQ ID NO: 665183 - RNA, 18 nt, Homo sapiens
aguaugguauuacaaaac

SEQ ID NO: 665184 - RNA, 17 nt, Homo sapiens
aguauguugucauaaca

SEQ ID NO: 665185 - RNA, 14 nt, Homo sapiens
aguauuacugcugc

SEQ ID NO: 665186 - RNA, 16 nt, Homo sapiens
aguauuacuuucugcc

SEQ ID NO: 665187 - RNA, 21 nt, Homo sapiens
aguauuauaggccaaacuggc

SEQ ID NO: 665188 - RNA, 22 nt, Homo sapiens
aguauuaucauugcuccccuga

SEQ ID NO: 665189 - RNA, 19 nt, Homo sapiens
aguauucaggcacugagaa

SEQ ID NO: 665190 - RNA, 21 nt, Homo sapiens
aguauuccaugagcugcucau

SEQ ID NO: 665191 - RNA, 14 nt, Homo sapiens
aguauucucagagc

SEQ ID NO: 665192 - RNA, 12 nt, Homo sapiens
aguauucugcau

SEQ ID NO: 665193 - RNA, 23 nt, Homo sapiens
aguauugaaauguuugcauaaag

SEQ ID NO: 665194 - RNA, 18 nt, Homo sapiens
aguauugcgaaugugcag

SEQ ID NO: 665195 - RNA, 20 nt, Homo sapiens
aguauugcgaaugugcagaa

SEQ ID NO: 665196 - RNA, 22 nt, Homo sapiens
aguauugcgaaugugcagaaag

SEQ ID NO: 665197 - RNA, 23 nt, Homo sapiens
aguauugcugaacucuuaggcac

SEQ ID NO: 665198 - RNA, 19 nt, Homo sapiens
aguauuggcauucaaaaag

SEQ ID NO: 665199 - RNA, 17 nt, Homo sapiens
aguauugucgguuaccu

SEQ ID NO: 665200 - RNA, 20 nt, Homo sapiens
aguauugucgguuaccucug

SEQ ID NO: 665201 - RNA, 18 nt, Homo sapiens
aguauuuaggauaaccuu

SEQ ID NO: 665202 - RNA, 21 nt, Homo sapiens
aguauuuuccuccaggcaaaa

SEQ ID NO: 665203 - RNA, 15 nt, Homo sapiens
aguauuuuucuugac

SEQ ID NO: 665204 - RNA, 13 nt, Homo sapiens
aguauuuuugcca

SEQ ID NO: 665205 - RNA, 19 nt, Homo sapiens
aguauuuuugcugcuucug

SEQ ID NO: 665206 - RNA, 23 nt, Homo sapiens
aguauuuuuuaauccuaccucaa

SEQ ID NO: 665207 - RNA, 22 nt, Homo sapiens
agucaaaacagagaugugauaa

SEQ ID NO: 665208 - RNA, 17 nt, Homo sapiens
agucaaaacuacaaauc

SEQ ID NO: 665209 - RNA, 17 nt, Homo sapiens
agucaaaaggugccugu

SEQ ID NO: 665210 - RNA, 21 nt, Homo sapiens
cagauggacuccagccugccu

SEQ ID NO: 665211 - RNA, 20 nt, Homo sapiens
cagauggagaucagagguua

SEQ ID NO: 665212 - RNA, 22 nt, Homo sapiens
cagauggagguucucagagcca

SEQ ID NO: 665213 - RNA, 14 nt, Homo sapiens
cagauggcacuuug

SEQ ID NO: 665214 - RNA, 17 nt, Homo sapiens
cagauggcacuuugaag

SEQ ID NO: 665215 - RNA, 15 nt, Homo sapiens
aggggcuuccucuag

SEQ ID NO: 665216 - RNA, 16 nt, Homo sapiens
agggggaacaaaucac

SEQ ID NO: 665217 - RNA, 15 nt, Homo sapiens
agggggaaggcuugg

SEQ ID NO: 665218 - RNA, 14 nt, Homo sapiens
agggggaccugucc

SEQ ID NO: 665219 - RNA, 15 nt, Homo sapiens
agggggagaaugggu

SEQ ID NO: 665220 - RNA, 20 nt, Homo sapiens
agggggagcccuggugcuac

SEQ ID NO: 665221 - RNA, 18 nt, Homo sapiens
aggggggggugggugaga

SEQ ID NO: 665222 - RNA, 12 nt, Homo sapiens
agggggugacug

SEQ ID NO: 665223 - RNA, 17 nt, Homo sapiens
agggggugggauuccac

SEQ ID NO: 665224 - RNA, 16 nt, Homo sapiens
cauagucuguuccuuu

SEQ ID NO: 665225 - RNA, 18 nt, Homo sapiens
cauagucuugaugacauu

SEQ ID NO: 665226 - RNA, 16 nt, Homo sapiens
cauagugaacacacug

SEQ ID NO: 665227 - RNA, 20 nt, Homo sapiens
cauagugcaaaacuguguca

SEQ ID NO: 665228 - RNA, 16 nt, Homo sapiens
cauaguggaucacuca

SEQ ID NO: 665229 - RNA, 20 nt, Homo sapiens
cauagugugagaacuuccaa

SEQ ID NO: 665230 - RNA, 19 nt, Homo sapiens
cauaguguuaacugucagu

SEQ ID NO: 665231 - RNA, 22 nt, Homo sapiens
cauaguuucaaaucuguaauca

SEQ ID NO: 665232 - RNA, 14 nt, Homo sapiens
cauauaacaauuca

SEQ ID NO: 665233 - RNA, 14 nt, Homo sapiens
cauauaaccaaaau

SEQ ID NO: 665234 - RNA, 18 nt, Homo sapiens
cauauaaccuaugccaau

SEQ ID NO: 665235 - RNA, 21 nt, Homo sapiens
cauauacuuuggggacuugua

SEQ ID NO: 665236 - RNA, 20 nt, Homo sapiens
cauauagaaaucuagaauuu

SEQ ID NO: 665237 - RNA, 19 nt, Homo sapiens
cauauauaaauucuaagcc

SEQ ID NO: 665238 - RNA, 19 nt, Homo sapiens
cauauauacccacauguac

SEQ ID NO: 665239 - RNA, 21 nt, Homo sapiens
cauauauauaguuaugcauac

SEQ ID NO: 665240 - RNA, 21 nt, Homo sapiens
cauauauauuaauacugguau

SEQ ID NO: 665241 - RNA, 15 nt, Homo sapiens
cauauaucaaaguga

SEQ ID NO: 665242 - RNA, 12 nt, Homo sapiens
cauauaucacua

SEQ ID NO: 665243 - RNA, 17 nt, Homo sapiens
cauauaucuuacauaua

SEQ ID NO: 665244 - RNA, 18 nt, Homo sapiens
cauauauuuaauauguca

SEQ ID NO: 665245 - RNA, 13 nt, Homo sapiens
cauaucaaaaagu

SEQ ID NO: 665246 - RNA, 13 nt, Homo sapiens
cauaucacucaau

SEQ ID NO: 665247 - RNA, 14 nt, Homo sapiens
cauaucagaacugu

SEQ ID NO: 665248 - RNA, 13 nt, Homo sapiens
cauaucagugaac

SEQ ID NO: 665249 - RNA, 17 nt, Homo sapiens
cauaucagugaaccuuu

SEQ ID NO: 665250 - RNA, 18 nt, Homo sapiens
cauaucaguugagcuuca

SEQ ID NO: 665251 - RNA, 18 nt, Homo sapiens
cauaucaugguaaugaca

SEQ ID NO: 665252 - RNA, 22 nt, Homo sapiens
cauauccaaguuugaauuccua

SEQ ID NO: 665253 - RNA, 16 nt, Homo sapiens
cauaucccuuccucuc

SEQ ID NO: 665254 - RNA, 15 nt, Homo sapiens
cauauccugagccau

SEQ ID NO: 665255 - RNA, 19 nt, Homo sapiens
cauauccuuucaagacaga

SEQ ID NO: 665256 - RNA, 15 nt, Homo sapiens
cauaucuauaaaaug

SEQ ID NO: 665257 - RNA, 20 nt, Homo sapiens
cauaucuauaaaaugacaga

SEQ ID NO: 665258 - RNA, 20 nt, Homo sapiens
cauaucuccuuccccuacac

SEQ ID NO: 665259 - RNA, 20 nt, Homo sapiens
cauaucucuuaucuuacgaa

SEQ ID NO: 665260 - RNA, 20 nt, Homo sapiens
cauaucuuuuaauuguguau

SEQ ID NO: 665261 - RNA, 15 nt, Homo sapiens
cauaugaacuuguca

SEQ ID NO: 665262 - RNA, 19 nt, Homo sapiens
cauaugagaauauaccuua

SEQ ID NO: 665263 - RNA, 21 nt, Homo sapiens
cauaugaggaggaugucccug

SEQ ID NO: 665264 - RNA, 14 nt, Homo sapiens
cauaugauacugau

SEQ ID NO: 665265 - RNA, 16 nt, Homo sapiens
cauaugcagaacguau

SEQ ID NO: 665266 - RNA, 20 nt, Homo sapiens
cauaugccaccccaugugcc

SEQ ID NO: 665267 - RNA, 15 nt, Homo sapiens
cauaugcuguacaug

SEQ ID NO: 665268 - RNA, 13 nt, Homo sapiens
cauaugucugcuu

SEQ ID NO: 665269 - RNA, 14 nt, Homo sapiens
cauauguguaaaag

SEQ ID NO: 665270 - RNA, 18 nt, Homo sapiens
cauauguguaaaagcuua

SEQ ID NO: 665271 - RNA, 23 nt, Homo sapiens
cauauguuuccccaucucugucu

SEQ ID NO: 665272 - RNA, 15 nt, Homo sapiens
cauauuaacauauuc

SEQ ID NO: 665273 - RNA, 17 nt, Homo sapiens
cauauuaagcacuuuaa

SEQ ID NO: 665274 - RNA, 16 nt, Homo sapiens
cauauuaccacagaca

SEQ ID NO: 665275 - RNA, 20 nt, Homo sapiens
cauauucgauguacuuuaag

SEQ ID NO: 665276 - RNA, 15 nt, Homo sapiens
cauauucuaaaacca

SEQ ID NO: 665277 - RNA, 13 nt, Homo sapiens
cauauucuuaaca

SEQ ID NO: 665278 - RNA, 18 nt, Homo sapiens
cauauuguauguaaguaa

SEQ ID NO: 665279 - RNA, 15 nt, Homo sapiens
cauauugucuggaaa

SEQ ID NO: 665280 - RNA, 18 nt, Homo sapiens
cauauuguugcauugcuu

SEQ ID NO: 665281 - RNA, 21 nt, Homo sapiens
cauauuuauuuuuauguucuu

SEQ ID NO: 665282 - RNA, 23 nt, Homo sapiens
cauauuuccuauuguucacuuua

SEQ ID NO: 665283 - RNA, 21 nt, Homo sapiens
cauauuucuaccugagugaag

SEQ ID NO: 665284 - RNA, 23 nt, Homo sapiens
cauauuuguauaguugcuugccu

SEQ ID NO: 665285 - RNA, 23 nt, Homo sapiens
cauauuuuaggacagguaaaaua

SEQ ID NO: 665286 - RNA, 13 nt, Homo sapiens
cauauuuugccac

SEQ ID NO: 665287 - RNA, 19 nt, Homo sapiens
cauauuuugccacugccuu

SEQ ID NO: 665288 - RNA, 19 nt, Homo sapiens
cauauuuuguauuguucua

SEQ ID NO: 665289 - RNA, 21 nt, Homo sapiens
caucaaaaaaacaaguuuaga

SEQ ID NO: 665290 - RNA, 11 nt, Homo sapiens
caucaaaaaga

SEQ ID NO: 665291 - RNA, 15 nt, Homo sapiens
caucaaaaagaacaa

SEQ ID NO: 665292 - RNA, 15 nt, Homo sapiens
caucaaaaagccuua

SEQ ID NO: 665293 - RNA, 14 nt, Homo sapiens
caucaacaacacag

SEQ ID NO: 665294 - RNA, 23 nt, Homo sapiens
caucaacaacacagcaaaaccau

SEQ ID NO: 665295 - RNA, 23 nt, Homo sapiens
caucaacaagaguugucuugucc

SEQ ID NO: 665296 - RNA, 13 nt, Homo sapiens
caucaaguucucc

SEQ ID NO: 665297 - RNA, 14 nt, Homo sapiens
caucaauucuuaga

SEQ ID NO: 665298 - RNA, 15 nt, Homo sapiens
caucaauucuuagaa

SEQ ID NO: 665299 - RNA, 22 nt, Homo sapiens
caucaauucuuagaauaucuaa

SEQ ID NO: 665300 - RNA, 16 nt, Homo sapiens
caucacagcagugcau

SEQ ID NO: 665301 - RNA, 15 nt, Homo sapiens
caucacaugaccaca

SEQ ID NO: 665302 - RNA, 20 nt, Homo sapiens
caucacccucuuccugugau

SEQ ID NO: 665303 - RNA, 19 nt, Homo sapiens
caucaccugaaacacugga

SEQ ID NO: 665304 - RNA, 22 nt, Homo sapiens
caucacgcugcaucccauugcu

SEQ ID NO: 665305 - RNA, 17 nt, Homo sapiens
caucacgucagugcuca

SEQ ID NO: 665306 - RNA, 22 nt, Homo sapiens
caucacucaaccauaacacuug

SEQ ID NO: 665307 - RNA, 17 nt, Homo sapiens
caucacuuccuugcccc

SEQ ID NO: 665308 - RNA, 12 nt, Homo sapiens
caucacuuugac

SEQ ID NO: 665309 - RNA, 21 nt, Homo sapiens
caucacuuugugaauuaacac

SEQ ID NO: 665310 - RNA, 18 nt, Homo sapiens
caucagacuccugugcaa

SEQ ID NO: 665311 - RNA, 12 nt, Homo sapiens
caucagcaaaca

SEQ ID NO: 665312 - RNA, 12 nt, Homo sapiens
caucagcauuug

SEQ ID NO: 665313 - RNA, 15 nt, Homo sapiens
caucagccauuugcc

SEQ ID NO: 665314 - RNA, 14 nt, Homo sapiens
caucagccuccucc

SEQ ID NO: 665315 - RNA, 14 nt, Homo sapiens
caucagccugugua

SEQ ID NO: 665316 - RNA, 17 nt, Homo sapiens
caucagcgggucuccuc

SEQ ID NO: 665317 - RNA, 18 nt, Homo sapiens
caucaggaaacaggaaga

SEQ ID NO: 665318 - RNA, 16 nt, Homo sapiens
caucaggccuguuuua

SEQ ID NO: 665319 - RNA, 14 nt, Homo sapiens
caucaggcucagcu

SEQ ID NO: 665320 - RNA, 18 nt, Homo sapiens
caucagggacaggaugac

SEQ ID NO: 665321 - RNA, 23 nt, Homo sapiens
caucagguuuuguuuuuuuucag

SEQ ID NO: 665322 - RNA, 18 nt, Homo sapiens
caucaguaagguagcauu

SEQ ID NO: 665323 - RNA, 16 nt, Homo sapiens
caucaguauucugcca

SEQ ID NO: 665324 - RNA, 16 nt, Homo sapiens
caucagucaacaacuu

SEQ ID NO: 665325 - RNA, 23 nt, Homo sapiens
caucagucaucacucucaaauau

SEQ ID NO: 665326 - RNA, 15 nt, Homo sapiens
caucaguccauugcu

SEQ ID NO: 665327 - RNA, 20 nt, Homo sapiens
caucauacuaaaagcaaugu

SEQ ID NO: 665328 - RNA, 18 nt, Homo sapiens
caucaucaaaaacuuugg

SEQ ID NO: 665329 - RNA, 23 nt, Homo sapiens
caucauccuugcuuuaccacaau

SEQ ID NO: 665330 - RNA, 12 nt, Homo sapiens
caucaucuaugg

SEQ ID NO: 665331 - RNA, 21 nt, Homo sapiens
caucaugcggugggugcugcc

SEQ ID NO: 665332 - RNA, 19 nt, Homo sapiens
caucauggaggucauacau

SEQ ID NO: 665333 - RNA, 23 nt, Homo sapiens
caucauggaggucauacaugcau

SEQ ID NO: 665334 - RNA, 13 nt, Homo sapiens
caucauuacagau

SEQ ID NO: 665335 - RNA, 22 nt, Homo sapiens
caucauuacuguuccagauucc

SEQ ID NO: 665336 - RNA, 12 nt, Homo sapiens
caucauuacuug

SEQ ID NO: 665337 - RNA, 16 nt, Homo sapiens
aggugacccugaugaa

SEQ ID NO: 665338 - RNA, 21 nt, Homo sapiens
aggugaggauuccaaaaacau

SEQ ID NO: 665339 - RNA, 14 nt, Homo sapiens
aggugaggcccaag

SEQ ID NO: 665340 - RNA, 19 nt, Homo sapiens
aggugauccgccuaccuca

SEQ ID NO: 665341 - RNA, 14 nt, Homo sapiens
aggugaugccauua

SEQ ID NO: 665342 - RNA, 15 nt, Homo sapiens
aggugcagucuuuga

SEQ ID NO: 665343 - RNA, 18 nt, Homo sapiens
aggugcauagcaagugaa

SEQ ID NO: 665344 - RNA, 21 nt, Homo sapiens
aggugcauuuucucaucaucc

SEQ ID NO: 665345 - RNA, 15 nt, Homo sapiens
aggugccagaaggaa

SEQ ID NO: 665346 - RNA, 17 nt, Homo sapiens
aggugccuccaggugug

SEQ ID NO: 665347 - RNA, 18 nt, Homo sapiens
aggugcuacaacauguga

SEQ ID NO: 665348 - RNA, 15 nt, Homo sapiens
aggugcuauguccca

SEQ ID NO: 665349 - RNA, 14 nt, Homo sapiens
aggugcugacaaua

SEQ ID NO: 665350 - RNA, 21 nt, Homo sapiens
aggugcuggugggucugagcu

SEQ ID NO: 665351 - RNA, 22 nt, Homo sapiens
aggugcuuaagcagaagcauua

SEQ ID NO: 665352 - RNA, 15 nt, Homo sapiens
aggugcuucuucacu

SEQ ID NO: 665353 - RNA, 15 nt, Homo sapiens
aggugcuuggaguuu

SEQ ID NO: 665354 - RNA, 22 nt, Homo sapiens
agguggagaaagcauaucccac

SEQ ID NO: 665355 - RNA, 18 nt, Homo sapiens
agguggaggcaaguggaa

SEQ ID NO: 665356 - RNA, 18 nt, Homo sapiens
agguggagguugugcaug

SEQ ID NO: 665357 - RNA, 20 nt, Homo sapiens
agguggagugucacaucucu

SEQ ID NO: 665358 - RNA, 20 nt, Homo sapiens
agguggcaaaguacuuguca

SEQ ID NO: 665359 - RNA, 16 nt, Homo sapiens
agguggccccaguuca

SEQ ID NO: 665360 - RNA, 16 nt, Homo sapiens
agguggcucagugcca

SEQ ID NO: 665361 - RNA, 16 nt, Homo sapiens
aggugggaaaugguau

SEQ ID NO: 665362 - RNA, 20 nt, Homo sapiens
aggugggaggaucucuugag

SEQ ID NO: 665363 - RNA, 20 nt, Homo sapiens
aggugggccagucuguggau

SEQ ID NO: 665364 - RNA, 14 nt, Homo sapiens
aggugggccuggga

SEQ ID NO: 665365 - RNA, 21 nt, Homo sapiens
aggugggccuugcuaccucaa

SEQ ID NO: 665366 - RNA, 22 nt, Homo sapiens
aggugggcugccugcuguguua

SEQ ID NO: 665367 - RNA, 19 nt, Homo sapiens
agguggggauccugccuaa

SEQ ID NO: 665368 - RNA, 13 nt, Homo sapiens
agguggugccagu

SEQ ID NO: 665369 - RNA, 13 nt, Homo sapiens
agguggugccuuc

SEQ ID NO: 665370 - RNA, 13 nt, Homo sapiens
agguguagaccag

SEQ ID NO: 665371 - RNA, 16 nt, Homo sapiens
aggugucauaugacug

SEQ ID NO: 665372 - RNA, 18 nt, Homo sapiens
aggugucgggacaugguu

SEQ ID NO: 665373 - RNA, 18 nt, Homo sapiens
aggugucuagacugccag

SEQ ID NO: 665374 - RNA, 21 nt, Homo sapiens
aggugucugcacccaggggug

SEQ ID NO: 665375 - RNA, 19 nt, Homo sapiens
aggugucuuaauacugucc

SEQ ID NO: 665376 - RNA, 14 nt, Homo sapiens
aggugugacuugaa

SEQ ID NO: 665377 - RNA, 20 nt, Homo sapiens
aggugugagccacagugccu

SEQ ID NO: 665378 - RNA, 16 nt, Homo sapiens
aggugugugugaacug

SEQ ID NO: 665379 - RNA, 22 nt, Homo sapiens
agguguucaagaccagccugac

SEQ ID NO: 665380 - RNA, 19 nt, Homo sapiens
agguguuggcugcacgugc

SEQ ID NO: 665381 - RNA, 15 nt, Homo sapiens
agguguuuaguugca

SEQ ID NO: 665382 - RNA, 14 nt, Homo sapiens
agguguuucuuucc

SEQ ID NO: 665383 - RNA, 17 nt, Homo sapiens
agguuaaacugaagcaa

SEQ ID NO: 665384 - RNA, 17 nt, Homo sapiens
agguuaaagaagcugca

SEQ ID NO: 665385 - RNA, 18 nt, Homo sapiens
agguuagggugugugcca

SEQ ID NO: 665386 - RNA, 14 nt, Homo sapiens
agguuauauccaau

SEQ ID NO: 665387 - RNA, 13 nt, Homo sapiens
agguuaucugugc

SEQ ID NO: 665388 - RNA, 23 nt, Homo sapiens
agguuauuuuccgccagaccuca

SEQ ID NO: 665389 - RNA, 14 nt, Homo sapiens
agguucaagugauu

SEQ ID NO: 665390 - RNA, 22 nt, Homo sapiens
agguucacucauugacaugaua

SEQ ID NO: 665391 - RNA, 13 nt, Homo sapiens
agguucacugagc

SEQ ID NO: 665392 - RNA, 20 nt, Homo sapiens
agguucacuuuggauaugau

SEQ ID NO: 665393 - RNA, 14 nt, Homo sapiens
agguucagccugaa

SEQ ID NO: 665394 - RNA, 12 nt, Homo sapiens
agguucccaaga

SEQ ID NO: 665395 - RNA, 20 nt, Homo sapiens
agguucccaggaggccucac

SEQ ID NO: 665396 - RNA, 22 nt, Homo sapiens
agguucccuguucuuccuccag

SEQ ID NO: 665397 - RNA, 20 nt, Homo sapiens
agguuccuuaucugucacac

SEQ ID NO: 665398 - RNA, 18 nt, Homo sapiens
agguucuucagggccagu

SEQ ID NO: 665399 - RNA, 22 nt, Homo sapiens
agguugaagaaaggaaccuggg

SEQ ID NO: 665400 - RNA, 14 nt, Homo sapiens
agguugaagccaag

SEQ ID NO: 665401 - RNA, 18 nt, Homo sapiens
agguugagcucuucuuaa

SEQ ID NO: 665402 - RNA, 18 nt, Homo sapiens
agguugcaguaagccaag

SEQ ID NO: 665403 - RNA, 13 nt, Homo sapiens
agguuggauuugc

SEQ ID NO: 665404 - RNA, 14 nt, Homo sapiens
agguuggcaaaaag

SEQ ID NO: 665405 - RNA, 12 nt, Homo sapiens
agguuggcagua

SEQ ID NO: 665406 - RNA, 17 nt, Homo sapiens
agguuggugaauuucac

SEQ ID NO: 665407 - RNA, 19 nt, Homo sapiens
agguuguuaauguacaaaa

SEQ ID NO: 665408 - RNA, 15 nt, Homo sapiens
agguuuaaagcugaa

SEQ ID NO: 665409 - RNA, 13 nt, Homo sapiens
agguuuacauuca

SEQ ID NO: 665410 - RNA, 15 nt, Homo sapiens
agguuuacauuguca

SEQ ID NO: 665411 - RNA, 22 nt, Homo sapiens
agguuucacccuuaacccaagg

SEQ ID NO: 665412 - RNA, 19 nt, Homo sapiens
agguuucagcaacaagacu

SEQ ID NO: 665413 - RNA, 13 nt, Homo sapiens
agguuuccuucag

SEQ ID NO: 665414 - RNA, 13 nt, Homo sapiens
agguuugcaaaga

SEQ ID NO: 665415 - RNA, 16 nt, Homo sapiens
agguuugccagcauuu

SEQ ID NO: 665416 - RNA, 17 nt, Homo sapiens
agguuuuaaagugauua

SEQ ID NO: 665417 - RNA, 23 nt, Homo sapiens
agguuuuaaccgcacaugcacac

SEQ ID NO: 665418 - RNA, 21 nt, Homo sapiens
agguuuugaauaaaaagugaa

SEQ ID NO: 665419 - RNA, 17 nt, Homo sapiens
aguaaaaacacuaccuc

SEQ ID NO: 665420 - RNA, 19 nt, Homo sapiens
aguaaaaacuguucucuau

SEQ ID NO: 665421 - RNA, 13 nt, Homo sapiens
aguaaaaauccaa

SEQ ID NO: 665422 - RNA, 19 nt, Homo sapiens
aguaaaacggauaccaagu

SEQ ID NO: 665423 - RNA, 15 nt, Homo sapiens
aguaaaacuguggua

SEQ ID NO: 665424 - RNA, 12 nt, Homo sapiens
aguaaaagcaac

SEQ ID NO: 665425 - RNA, 19 nt, Homo sapiens
aguaaaaggaaaugcaagu

SEQ ID NO: 665426 - RNA, 16 nt, Homo sapiens
aguaaaagucuaccug

SEQ ID NO: 665427 - RNA, 17 nt, Homo sapiens
aguaaaggcugcugcua

SEQ ID NO: 665428 - RNA, 17 nt, Homo sapiens
aguaaauauauauguca

SEQ ID NO: 665429 - RNA, 14 nt, Homo sapiens
aguaaaucaaagau

SEQ ID NO: 665430 - RNA, 13 nt, Homo sapiens
aguaaauccucau

SEQ ID NO: 665431 - RNA, 13 nt, Homo sapiens
aguaaaucucaca

SEQ ID NO: 665432 - RNA, 20 nt, Homo sapiens
aguaacaauacaaauggauu

SEQ ID NO: 665433 - RNA, 15 nt, Homo sapiens
aguaacacaaacauc

SEQ ID NO: 665434 - RNA, 14 nt, Homo sapiens
aguaacacuuuaaa

SEQ ID NO: 665435 - RNA, 17 nt, Homo sapiens
aguaacaggaaaccacu

SEQ ID NO: 665436 - RNA, 13 nt, Homo sapiens
aguaaccaaaaca

SEQ ID NO: 665437 - RNA, 16 nt, Homo sapiens
aguaaccagaauccaa

SEQ ID NO: 665438 - RNA, 17 nt, Homo sapiens
aguaacgcgucuuccug

SEQ ID NO: 665439 - RNA, 18 nt, Homo sapiens
aguaacuagguguaaaaa

SEQ ID NO: 665440 - RNA, 15 nt, Homo sapiens
aguaacuccccucag

SEQ ID NO: 665441 - RNA, 17 nt, Homo sapiens
aguaagaaccuugccug

SEQ ID NO: 665442 - RNA, 21 nt, Homo sapiens
aguaagaaccuugccugaaca

SEQ ID NO: 665443 - RNA, 16 nt, Homo sapiens
aguaagaacugcucua

SEQ ID NO: 665444 - RNA, 18 nt, Homo sapiens
aguaagagcuuuguuuca

SEQ ID NO: 665445 - RNA, 15 nt, Homo sapiens
aguaagaugcacuga

SEQ ID NO: 665446 - RNA, 16 nt, Homo sapiens
aguaagaugcacugaa

SEQ ID NO: 665447 - RNA, 17 nt, Homo sapiens
aguaagaugcacugaaa

SEQ ID NO: 665448 - RNA, 13 nt, Homo sapiens
aguaagcaucuac

SEQ ID NO: 665449 - RNA, 23 nt, Homo sapiens
aguaagcauuuccagccuaucua

SEQ ID NO: 665450 - RNA, 20 nt, Homo sapiens
aguaagcccggauagacuua

SEQ ID NO: 665451 - RNA, 22 nt, Homo sapiens
aguaaggcaauccuaagcaaaa

SEQ ID NO: 665452 - RNA, 20 nt, Homo sapiens
aguaaguaccacucaggcca

SEQ ID NO: 665453 - RNA, 12 nt, Homo sapiens
aguaagugcuuu

SEQ ID NO: 665454 - RNA, 13 nt, Homo sapiens
aguaaguguacaa

SEQ ID NO: 665455 - RNA, 17 nt, Homo sapiens
aguaaguuaauaaugua

SEQ ID NO: 665456 - RNA, 20 nt, Homo sapiens
aguaaguuaauguauauaaa

SEQ ID NO: 665457 - RNA, 15 nt, Homo sapiens
aguaaguuuauccaa

SEQ ID NO: 665458 - RNA, 19 nt, Homo sapiens
aguaaguuuauccaaaucu

SEQ ID NO: 665459 - RNA, 18 nt, Homo sapiens
aguaauaaauuaaaccaa

SEQ ID NO: 665460 - RNA, 13 nt, Homo sapiens
ugauaaaguaauu

SEQ ID NO: 665461 - RNA, 16 nt, Homo sapiens
ugauaaaguuccuuaa

SEQ ID NO: 665462 - RNA, 14 nt, Homo sapiens
ugauaaauugcugc

SEQ ID NO: 665463 - RNA, 13 nt, Homo sapiens
ugauaacucugag

SEQ ID NO: 665464 - RNA, 22 nt, Homo sapiens
ugauaagcuauugucuguaaua

SEQ ID NO: 665465 - RNA, 20 nt, Homo sapiens
ugauaauagagggcuggaau

SEQ ID NO: 665466 - RNA, 18 nt, Homo sapiens
ugauaaucuucaggugaa

SEQ ID NO: 665467 - RNA, 13 nt, Homo sapiens
ugauacaaaccac

SEQ ID NO: 665468 - RNA, 12 nt, Homo sapiens
ugauacauccaa

SEQ ID NO: 665469 - RNA, 15 nt, Homo sapiens
ugauacaugcauugc

SEQ ID NO: 665470 - RNA, 11 nt, Homo sapiens
ugauacauuuu

SEQ ID NO: 665471 - RNA, 19 nt, Homo sapiens
ugauacauuuuuguacuaa

SEQ ID NO: 665472 - RNA, 22 nt, Homo sapiens
ugauaccaccuuuacugugcuu

SEQ ID NO: 665473 - RNA, 16 nt, Homo sapiens
ugauacuucacuacuu

SEQ ID NO: 665474 - RNA, 23 nt, Homo sapiens
ugauagaacuuugccagucuuua

SEQ ID NO: 665475 - RNA, 12 nt, Homo sapiens
ugauagaagauu

SEQ ID NO: 665476 - RNA, 16 nt, Homo sapiens
ugauagaauacaaaga

SEQ ID NO: 665477 - RNA, 19 nt, Homo sapiens
ugauagauuucuacacuga

SEQ ID NO: 665478 - RNA, 14 nt, Homo sapiens
ugauagcccagaac

SEQ ID NO: 665479 - RNA, 21 nt, Homo sapiens
ugauaggaagcgucuggcaga

SEQ ID NO: 665480 - RNA, 13 nt, Homo sapiens
ugauagucaauau

SEQ ID NO: 665481 - RNA, 14 nt, Homo sapiens
ugauauaaaugcaa

SEQ ID NO: 665482 - RNA, 13 nt, Homo sapiens
ugauauaccaaau

SEQ ID NO: 665483 - RNA, 17 nt, Homo sapiens
ugauauauaaaugugau

SEQ ID NO: 665484 - RNA, 14 nt, Homo sapiens
ugauauauauaugc

SEQ ID NO: 665485 - RNA, 13 nt, Homo sapiens
ugauaucaccucu

SEQ ID NO: 665486 - RNA, 14 nt, Homo sapiens
ugauaucugaucaa

SEQ ID NO: 665487 - RNA, 18 nt, Homo sapiens
ugauaugcaagugcaaaa

SEQ ID NO: 665488 - RNA, 19 nt, Homo sapiens
ugauauguaaguacuucca

SEQ ID NO: 665489 - RNA, 23 nt, Homo sapiens
ugauauucaggcuacucauucag

SEQ ID NO: 665490 - RNA, 18 nt, Homo sapiens
ugauauucuuuaaacaaa

SEQ ID NO: 665491 - RNA, 15 nt, Homo sapiens
ugauauuguucucca

SEQ ID NO: 665492 - RNA, 15 nt, Homo sapiens
ugauauuucuugcuu

SEQ ID NO: 665493 - RNA, 14 nt, Homo sapiens
ugauauuuuaguca

SEQ ID NO: 665494 - RNA, 19 nt, Homo sapiens
ugaucaaaaccugugccag

SEQ ID NO: 665495 - RNA, 18 nt, Homo sapiens
ugaucaaagccacacucu

SEQ ID NO: 665496 - RNA, 15 nt, Homo sapiens
ugaucaagaaugcaa

SEQ ID NO: 665497 - RNA, 21 nt, Homo sapiens
ugaucaauauuuuuauaucau

SEQ ID NO: 665498 - RNA, 22 nt, Homo sapiens
ugaucaauucuuuaauuuugga

SEQ ID NO: 665499 - RNA, 15 nt, Homo sapiens
ugaucacacucuggg

SEQ ID NO: 665500 - RNA, 15 nt, Homo sapiens
ugaucacagcucccu

SEQ ID NO: 665501 - RNA, 21 nt, Homo sapiens
ugaucagacauacagcugccu

SEQ ID NO: 665502 - RNA, 21 nt, Homo sapiens
ugaucaggcuauguauggaau

SEQ ID NO: 665503 - RNA, 12 nt, Homo sapiens
ugaucagggauc

SEQ ID NO: 665504 - RNA, 19 nt, Homo sapiens
ugaucagugcaauugaccu

SEQ ID NO: 665505 - RNA, 21 nt, Homo sapiens
ugaucaguuaagaaauuucac

SEQ ID NO: 665506 - RNA, 13 nt, Homo sapiens
ugaucauagcuca

SEQ ID NO: 665507 - RNA, 17 nt, Homo sapiens
ugauccacuucucucag

SEQ ID NO: 665508 - RNA, 20 nt, Homo sapiens
ugauccagcccugguucugg

SEQ ID NO: 665509 - RNA, 13 nt, Homo sapiens
ugaucccagucac

SEQ ID NO: 665510 - RNA, 17 nt, Homo sapiens
ugauccuccaacagcug

SEQ ID NO: 665511 - RNA, 15 nt, Homo sapiens
ugauccugggggacc

SEQ ID NO: 665512 - RNA, 15 nt, Homo sapiens
ugauccuuccaccuc

SEQ ID NO: 665513 - RNA, 21 nt, Homo sapiens
ugaucgcgccacuacacucca

SEQ ID NO: 665514 - RNA, 18 nt, Homo sapiens
ugaucuaagcaguggcau

SEQ ID NO: 665515 - RNA, 15 nt, Homo sapiens
ugaucuacccgugcc

SEQ ID NO: 665516 - RNA, 19 nt, Homo sapiens
ugaucuacuucauagcucc

SEQ ID NO: 665517 - RNA, 19 nt, Homo sapiens
ugaucucggcucacugcaa

SEQ ID NO: 665518 - RNA, 15 nt, Homo sapiens
ugaucuguaccauga

SEQ ID NO: 665519 - RNA, 23 nt, Homo sapiens
ugaucuguguacaauuuuaguca

SEQ ID NO: 665520 - RNA, 17 nt, Homo sapiens
ugaucuuguuacuguga

SEQ ID NO: 665521 - RNA, 15 nt, Homo sapiens
ugaucuuugagccca

SEQ ID NO: 665522 - RNA, 16 nt, Homo sapiens
ugaucuuugagcccau

SEQ ID NO: 665523 - RNA, 21 nt, Homo sapiens
ugaucuuuguuuaaaugccaa

SEQ ID NO: 665524 - RNA, 19 nt, Homo sapiens
ugaugaaaaauaugugcuu

SEQ ID NO: 665525 - RNA, 15 nt, Homo sapiens
ugaugaaaacauuca

SEQ ID NO: 665526 - RNA, 16 nt, Homo sapiens
ugaugaaaauggcagu

SEQ ID NO: 665527 - RNA, 17 nt, Homo sapiens
ugaugaagaccaaagac

SEQ ID NO: 665528 - RNA, 20 nt, Homo sapiens
ugaugaauguacuaugucug

SEQ ID NO: 665529 - RNA, 17 nt, Homo sapiens
ugaugacucaaggccaa

SEQ ID NO: 665530 - RNA, 20 nt, Homo sapiens
ugaugagagaauggagacag

SEQ ID NO: 665531 - RNA, 22 nt, Homo sapiens
ugaugagccauauuaauugccu

SEQ ID NO: 665532 - RNA, 18 nt, Homo sapiens
ugaugaggcagauggaga

SEQ ID NO: 665533 - RNA, 18 nt, Homo sapiens
ugaugaggccucuuggac

SEQ ID NO: 665534 - RNA, 13 nt, Homo sapiens
ugaugaugaaggg

SEQ ID NO: 665535 - RNA, 13 nt, Homo sapiens
ugaugaugcaguu

SEQ ID NO: 665536 - RNA, 18 nt, Homo sapiens
ugaugauuuucauuucau

SEQ ID NO: 665537 - RNA, 10 nt, Homo sapiens
ugaugcaaau

SEQ ID NO: 665538 - RNA, 22 nt, Homo sapiens
ugaugcauauugcccuggagaa

SEQ ID NO: 665539 - RNA, 13 nt, Homo sapiens
ugaugccaagaaa

SEQ ID NO: 665540 - RNA, 21 nt, Homo sapiens
ugaugccauaaauacaagauu

SEQ ID NO: 665541 - RNA, 15 nt, Homo sapiens
ugaugccauucuucc

SEQ ID NO: 665542 - RNA, 14 nt, Homo sapiens
ugaugcccagguca

SEQ ID NO: 665543 - RNA, 15 nt, Homo sapiens
ugaugccguccugcu

SEQ ID NO: 665544 - RNA, 13 nt, Homo sapiens
ugaugcucaaaau

SEQ ID NO: 665545 - RNA, 21 nt, Homo sapiens
ugaugcucaaaaucuuuccaa

SEQ ID NO: 665546 - RNA, 15 nt, Homo sapiens
ugaugcugggacccu

SEQ ID NO: 665547 - RNA, 21 nt, Homo sapiens
ugauggaagaugguccgugcc

SEQ ID NO: 665548 - RNA, 21 nt, Homo sapiens
ugauggacacuccagggacac

SEQ ID NO: 665549 - RNA, 22 nt, Homo sapiens
ugauggaccuccuucgcuggaa

SEQ ID NO: 665550 - RNA, 16 nt, Homo sapiens
gucgagauugcacugc

SEQ ID NO: 665551 - RNA, 14 nt, Homo sapiens
gucgcaucucagug

SEQ ID NO: 665552 - RNA, 21 nt, Homo sapiens
gucgcccaggcuggagugcag

SEQ ID NO: 665553 - RNA, 12 nt, Homo sapiens
gucggucuugca

SEQ ID NO: 665554 - RNA, 14 nt, Homo sapiens
gucguaagucacug

SEQ ID NO: 665555 - RNA, 23 nt, Homo sapiens
gucguguaauuggcccaagucau

SEQ ID NO: 665556 - RNA, 14 nt, Homo sapiens
gucuaaaagcagaa

SEQ ID NO: 665557 - RNA, 15 nt, Homo sapiens
gucuaaaaugccuca

SEQ ID NO: 665558 - RNA, 13 nt, Homo sapiens
gucuaaagcuuug

SEQ ID NO: 665559 - RNA, 12 nt, Homo sapiens
gucuaaagugua

SEQ ID NO: 665560 - RNA, 18 nt, Homo sapiens
gucuaaaguuacuacuga

SEQ ID NO: 665561 - RNA, 14 nt, Homo sapiens
gucuaacaguuaau

SEQ ID NO: 665562 - RNA, 16 nt, Homo sapiens
gucuaacauauucaau

SEQ ID NO: 665563 - RNA, 12 nt, Homo sapiens
gucuaacgcuga

SEQ ID NO: 665564 - RNA, 19 nt, Homo sapiens
gucuaagguucagccugaa

SEQ ID NO: 665565 - RNA, 13 nt, Homo sapiens
gucuaauguuugu

SEQ ID NO: 665566 - RNA, 13 nt, Homo sapiens
gucuaauuugcac

SEQ ID NO: 665567 - RNA, 17 nt, Homo sapiens
gucuacauugagcauuu

SEQ ID NO: 665568 - RNA, 13 nt, Homo sapiens
gucuagacuuucu

SEQ ID NO: 665569 - RNA, 18 nt, Homo sapiens
gucuagagcagacccagc

SEQ ID NO: 665570 - RNA, 17 nt, Homo sapiens
gucuagccacugaucau

SEQ ID NO: 665571 - RNA, 13 nt, Homo sapiens
gucuagugucugg

SEQ ID NO: 665572 - RNA, 23 nt, Homo sapiens
gucuaguucuuuucauuuggaau

SEQ ID NO: 665573 - RNA, 23 nt, Homo sapiens
gucuauaucauaacuauacuuga

SEQ ID NO: 665574 - RNA, 14 nt, Homo sapiens
gucuaugaauauga

SEQ ID NO: 665575 - RNA, 13 nt, Homo sapiens
gucuauguguaca

SEQ ID NO: 665576 - RNA, 22 nt, Homo sapiens
gucuauguucaaagacugugaa

SEQ ID NO: 665577 - RNA, 17 nt, Homo sapiens
gucucaaacuccugacc

SEQ ID NO: 665578 - RNA, 15 nt, Homo sapiens
gucucaaacuccugg

SEQ ID NO: 665579 - RNA, 20 nt, Homo sapiens
gucucaaccccucacaggag

SEQ ID NO: 665580 - RNA, 23 nt, Homo sapiens
gucucaccacauaccauguggau

SEQ ID NO: 665581 - RNA, 18 nt, Homo sapiens
gucucaccucauagcuaa

SEQ ID NO: 665582 - RNA, 23 nt, Homo sapiens
gucucaccuggacuuaagcaucu

SEQ ID NO: 665583 - RNA, 23 nt, Homo sapiens
gucucacugucccccguuugccu

SEQ ID NO: 665584 - RNA, 19 nt, Homo sapiens
gucucacuguucugcaaag

SEQ ID NO: 665585 - RNA, 19 nt, Homo sapiens
ugauugaggagcugcacug

SEQ ID NO: 665586 - RNA, 20 nt, Homo sapiens
ugauugaggagcugcacuga

SEQ ID NO: 665587 - RNA, 12 nt, Homo sapiens
ugauugcagcuu

SEQ ID NO: 665588 - RNA, 13 nt, Homo sapiens
ugauugcugccau

SEQ ID NO: 665589 - RNA, 14 nt, Homo sapiens
ugauuggugauuca

SEQ ID NO: 665590 - RNA, 12 nt, Homo sapiens
ugauuguacaaa

SEQ ID NO: 665591 - RNA, 19 nt, Homo sapiens
ugauuuaccuauacauuau

SEQ ID NO: 665592 - RNA, 22 nt, Homo sapiens
ugauuuagggaagcagggacac

SEQ ID NO: 665593 - RNA, 16 nt, Homo sapiens
ugauuuaugaucacuu

SEQ ID NO: 665594 - RNA, 14 nt, Homo sapiens
ugauuucauuucaa

SEQ ID NO: 665595 - RNA, 20 nt, Homo sapiens
ugauuuccuaauaugaucua

SEQ ID NO: 665596 - RNA, 16 nt, Homo sapiens
ugauuucuaguguaua

SEQ ID NO: 665597 - RNA, 18 nt, Homo sapiens
ugauuucuuucuuugcac

SEQ ID NO: 665598 - RNA, 16 nt, Homo sapiens
ugauuuggugaccaac

SEQ ID NO: 665599 - RNA, 18 nt, Homo sapiens
ugauuugucccuaugcau

SEQ ID NO: 665600 - RNA, 16 nt, Homo sapiens
ugauuuuaucugugaa

SEQ ID NO: 665601 - RNA, 15 nt, Homo sapiens
ugauuuugcuuucca

SEQ ID NO: 665602 - RNA, 14 nt, Homo sapiens
ugauuuuguaaaag

SEQ ID NO: 665603 - RNA, 19 nt, Homo sapiens
ugauuuuuuuaaaguaguu

SEQ ID NO: 665604 - RNA, 18 nt, Homo sapiens
ugauuuuuuuuauugccu

SEQ ID NO: 665605 - RNA, 14 nt, Homo sapiens
ugcaaaacacuaaa

SEQ ID NO: 665606 - RNA, 22 nt, Homo sapiens
ugcaaaaggacucucaggacca

SEQ ID NO: 665607 - RNA, 14 nt, Homo sapiens
ugcaaaaguucuca

SEQ ID NO: 665608 - RNA, 22 nt, Homo sapiens
ugcaaaauacaugaagcuucau

SEQ ID NO: 665609 - RNA, 19 nt, Homo sapiens
ugcaaaaugggaacaauga

SEQ ID NO: 665610 - RNA, 22 nt, Homo sapiens
ugcaaaauuguuuucacuugua

SEQ ID NO: 665611 - RNA, 13 nt, Homo sapiens
ugcaaaauuucca

SEQ ID NO: 665612 - RNA, 15 nt, Homo sapiens
ugcaaacacagcucu

SEQ ID NO: 665613 - RNA, 22 nt, Homo sapiens
ugcaaacaguaacgugugcgca

SEQ ID NO: 665614 - RNA, 19 nt, Homo sapiens
ugcaaacauuaccuaaaua

SEQ ID NO: 665615 - RNA, 17 nt, Homo sapiens
ugcaaacucagugcaaa

SEQ ID NO: 665616 - RNA, 18 nt, Homo sapiens
ugcaaacugaaagaucug

SEQ ID NO: 665617 - RNA, 17 nt, Homo sapiens
ugcaaagcccagcuuga

SEQ ID NO: 665618 - RNA, 18 nt, Homo sapiens
ugcaaagcccagcuugaa

SEQ ID NO: 665619 - RNA, 17 nt, Homo sapiens
ugcaaaguguauuagga

SEQ ID NO: 665620 - RNA, 16 nt, Homo sapiens
ugcaaauaaucacaga

SEQ ID NO: 665621 - RNA, 14 nt, Homo sapiens
ugcaaauacuguau

SEQ ID NO: 665622 - RNA, 21 nt, Homo sapiens
ugcaaauccuugauacugcuc

SEQ ID NO: 665623 - RNA, 13 nt, Homo sapiens
ugcaaaugaauca

SEQ ID NO: 665624 - RNA, 17 nt, Homo sapiens
ugcaaaugcuauauugc

SEQ ID NO: 665625 - RNA, 18 nt, Homo sapiens
ugcaaaugcuauauugca

SEQ ID NO: 665626 - RNA, 21 nt, Homo sapiens
ugcaaauggcuacuaagcaca

SEQ ID NO: 665627 - RNA, 15 nt, Homo sapiens
ugcaaauucauuuca

SEQ ID NO: 665628 - RNA, 19 nt, Homo sapiens
ugcaaauuuugcauuuagu

SEQ ID NO: 665629 - RNA, 16 nt, Homo sapiens
ugcaacaaaaagucau

SEQ ID NO: 665630 - RNA, 16 nt, Homo sapiens
ugcaacagaagcaaaa

SEQ ID NO: 665631 - RNA, 18 nt, Homo sapiens
ugcaacagcuacagucua

SEQ ID NO: 665632 - RNA, 15 nt, Homo sapiens
ugcaaccacugcuuc

SEQ ID NO: 665633 - RNA, 23 nt, Homo sapiens
ugcaaccgggcccucucucugcg

SEQ ID NO: 665634 - RNA, 13 nt, Homo sapiens
ugcaaccucugcc

SEQ ID NO: 665635 - RNA, 22 nt, Homo sapiens
ugcaacucacugauucucuaca

SEQ ID NO: 665636 - RNA, 17 nt, Homo sapiens
ugcaacuuaaguauauu

SEQ ID NO: 665637 - RNA, 17 nt, Homo sapiens
ugcaagaauuaaaacug

SEQ ID NO: 665638 - RNA, 22 nt, Homo sapiens
ugcaagaauugaagcaggacua

SEQ ID NO: 665639 - RNA, 18 nt, Homo sapiens
ugcaagagugauugcagc

SEQ ID NO: 665640 - RNA, 19 nt, Homo sapiens
ugcaagcacaucugcauuu

SEQ ID NO: 665641 - RNA, 16 nt, Homo sapiens
ugcaagcagaugacaa

SEQ ID NO: 665642 - RNA, 17 nt, Homo sapiens
ugcaagcagaugacaaa

SEQ ID NO: 665643 - RNA, 12 nt, Homo sapiens
ugcaagccauaa

SEQ ID NO: 665644 - RNA, 18 nt, Homo sapiens
ugcaagccauaacgugcc

SEQ ID NO: 665645 - RNA, 17 nt, Homo sapiens
ugcaagcuggaugccug

SEQ ID NO: 665646 - RNA, 23 nt, Homo sapiens
ugcaaggaccuaaaacaucucau

SEQ ID NO: 665647 - RNA, 20 nt, Homo sapiens
ugcaaggauucagcauuauu

SEQ ID NO: 665648 - RNA, 12 nt, Homo sapiens
ugcaagugcaaa

SEQ ID NO: 665649 - RNA, 16 nt, Homo sapiens
ugcaaguguaucuccu

SEQ ID NO: 665650 - RNA, 21 nt, Homo sapiens
ugcaagugugugcaugugugc

SEQ ID NO: 665651 - RNA, 20 nt, Homo sapiens
ugcaaguuagggucuaugua

SEQ ID NO: 665652 - RNA, 14 nt, Homo sapiens
ugcaaguugaggac

SEQ ID NO: 665653 - RNA, 19 nt, Homo sapiens
ugcaauaaauggcuugauu

SEQ ID NO: 665654 - RNA, 13 nt, Homo sapiens
ugcaauagauuac

SEQ ID NO: 665655 - RNA, 18 nt, Homo sapiens
ugcaauaggugugcguca

SEQ ID NO: 665656 - RNA, 17 nt, Homo sapiens
ugcaauagucuuauuaa

SEQ ID NO: 665657 - RNA, 16 nt, Homo sapiens
ugcaauauaacauucu

SEQ ID NO: 665658 - RNA, 17 nt, Homo sapiens
ugcaauauuuacauuuu

SEQ ID NO: 665659 - RNA, 19 nt, Homo sapiens
ugcaaugccuagacuuccc

SEQ ID NO: 665660 - RNA, 12 nt, Homo sapiens
ugcaaugucaca

SEQ ID NO: 665661 - RNA, 22 nt, Homo sapiens
ugcaaugucacaaccucucuga

SEQ ID NO: 665662 - RNA, 14 nt, Homo sapiens
ugcaaugucuaaaa

SEQ ID NO: 665663 - RNA, 13 nt, Homo sapiens
ugcaaugucugag

SEQ ID NO: 665664 - RNA, 13 nt, Homo sapiens
ugcaauuccaaga

SEQ ID NO: 665665 - RNA, 12 nt, Homo sapiens
ugcacaaccugg

SEQ ID NO: 665666 - RNA, 14 nt, Homo sapiens
ugcacaagaaugga

SEQ ID NO: 665667 - RNA, 14 nt, Homo sapiens
ugcacaagcacuau

SEQ ID NO: 665668 - RNA, 18 nt, Homo sapiens
ugcacacagaaugcucag

SEQ ID NO: 665669 - RNA, 22 nt, Homo sapiens
ugcacacagcacgggggccaag

SEQ ID NO: 665670 - RNA, 13 nt, Homo sapiens
ugcacacaggaca

SEQ ID NO: 665671 - RNA, 13 nt, Homo sapiens
ugcacacauauac

SEQ ID NO: 665672 - RNA, 23 nt, Homo sapiens
ugcacacauuuuuuaaaugcacc

SEQ ID NO: 665673 - RNA, 18 nt, Homo sapiens
ucaucuuggucacauaca

SEQ ID NO: 665674 - RNA, 23 nt, Homo sapiens
ucaucuuuugaagagcaaaggga

SEQ ID NO: 665675 - RNA, 16 nt, Homo sapiens
ucaugaaaacacacau

SEQ ID NO: 665676 - RNA, 15 nt, Homo sapiens
ucaugaaauaugcau

SEQ ID NO: 665677 - RNA, 13 nt, Homo sapiens
ucaugaaaucagc

SEQ ID NO: 665678 - RNA, 20 nt, Homo sapiens
ucaugaacuaccccacaaca

SEQ ID NO: 665679 - RNA, 18 nt, Homo sapiens
ucaugaagaaaagaccuu

SEQ ID NO: 665680 - RNA, 15 nt, Homo sapiens
ucaugaccuagauga

SEQ ID NO: 665681 - RNA, 18 nt, Homo sapiens
ucaugacuuggcuguuaa

SEQ ID NO: 665682 - RNA, 14 nt, Homo sapiens
ucaugagcugucug

SEQ ID NO: 665683 - RNA, 13 nt, Homo sapiens
ucaugagcuugaa

SEQ ID NO: 665684 - RNA, 20 nt, Homo sapiens
ucaugagcuugaacaaggac

SEQ ID NO: 665685 - RNA, 22 nt, Homo sapiens
ucaugaggaccaggguggagcu

SEQ ID NO: 665686 - RNA, 21 nt, Homo sapiens
ucaugaguagugggcuaugca

SEQ ID NO: 665687 - RNA, 14 nt, Homo sapiens
ucaugagugaauaa

SEQ ID NO: 665688 - RNA, 16 nt, Homo sapiens
ucaugaucaagauaua

SEQ ID NO: 665689 - RNA, 17 nt, Homo sapiens
ucaugauccaacuaaug

SEQ ID NO: 665690 - RNA, 12 nt, Homo sapiens
ucaugaugcuag

SEQ ID NO: 665691 - RNA, 12 nt, Homo sapiens
ucaugcacugag

SEQ ID NO: 665692 - RNA, 14 nt, Homo sapiens
ucaugcauuugcac

SEQ ID NO: 665693 - RNA, 14 nt, Homo sapiens
ucaugccauugcac

SEQ ID NO: 665694 - RNA, 23 nt, Homo sapiens
ucaugcccccaccccugcucucc

SEQ ID NO: 665695 - RNA, 22 nt, Homo sapiens
ucaugcccccuuucagaugucu

SEQ ID NO: 665696 - RNA, 13 nt, Homo sapiens
ucaugcccugugc

SEQ ID NO: 665697 - RNA, 18 nt, Homo sapiens
ucaugccuguaaucccag

SEQ ID NO: 665698 - RNA, 15 nt, Homo sapiens
ucaugcgcacagagg

SEQ ID NO: 665699 - RNA, 23 nt, Homo sapiens
ucaugcucagcccugacuggugc

SEQ ID NO: 665700 - RNA, 19 nt, Homo sapiens
ucaugcugaauacuccucc

SEQ ID NO: 665701 - RNA, 15 nt, Homo sapiens
ucaugcuuuugcuau

SEQ ID NO: 665702 - RNA, 15 nt, Homo sapiens
ucauggaaagacugg

SEQ ID NO: 665703 - RNA, 17 nt, Homo sapiens
ucauggauaacuacauu

SEQ ID NO: 665704 - RNA, 14 nt, Homo sapiens
ucauggauuacuuc

SEQ ID NO: 665705 - RNA, 20 nt, Homo sapiens
ucauggcagcuaagccacau

SEQ ID NO: 665706 - RNA, 21 nt, Homo sapiens
ucaugggacuaaaugaacuaa

SEQ ID NO: 665707 - RNA, 22 nt, Homo sapiens
ucaugggacuaaaugaacuaau

SEQ ID NO: 665708 - RNA, 20 nt, Homo sapiens
ucaugggagggggcuugaag

SEQ ID NO: 665709 - RNA, 15 nt, Homo sapiens
ucaugguacauuuau

SEQ ID NO: 665710 - RNA, 22 nt, Homo sapiens
ucaugguacauuuaucacugaa

SEQ ID NO: 665711 - RNA, 22 nt, Homo sapiens
ucauggugaaaagcuccaucaa

SEQ ID NO: 665712 - RNA, 17 nt, Homo sapiens
ucauguaaacugugcac

SEQ ID NO: 665713 - RNA, 21 nt, Homo sapiens
ucauguaaauaaauacauucu

SEQ ID NO: 665714 - RNA, 17 nt, Homo sapiens
ucauguaaauuugguuu

SEQ ID NO: 665715 - RNA, 23 nt, Homo sapiens
ucauguaauuugcauuacucugg

SEQ ID NO: 665716 - RNA, 19 nt, Homo sapiens
ucauguaccucagaucucu

SEQ ID NO: 665717 - RNA, 22 nt, Homo sapiens
ucauguacuuuggcaucuuuug

SEQ ID NO: 665718 - RNA, 13 nt, Homo sapiens
ucauguauguuau

SEQ ID NO: 665719 - RNA, 18 nt, Homo sapiens
ucaugucuaauugcuuaa

SEQ ID NO: 665720 - RNA, 18 nt, Homo sapiens
ucaugugaccacucuguc

SEQ ID NO: 665721 - RNA, 20 nt, Homo sapiens
ucaugugguacuugagggau

SEQ ID NO: 665722 - RNA, 20 nt, Homo sapiens
ucaugugguucagugccuuc

SEQ ID NO: 665723 - RNA, 23 nt, Homo sapiens
ucauguguguccacgacugucuc

SEQ ID NO: 665724 - RNA, 13 nt, Homo sapiens
ucauguuacucag

SEQ ID NO: 665725 - RNA, 15 nt, Homo sapiens
ucauguucacuguga

SEQ ID NO: 665726 - RNA, 20 nt, Homo sapiens
ucauguucacugugagugaa

SEQ ID NO: 665727 - RNA, 19 nt, Homo sapiens
ucauguuuacuuguuuuau

SEQ ID NO: 665728 - RNA, 19 nt, Homo sapiens
ucauguuugcuucauaaau

SEQ ID NO: 665729 - RNA, 14 nt, Homo sapiens
ucauuaacugcuaa

SEQ ID NO: 665730 - RNA, 17 nt, Homo sapiens
ucauuaaugcacaucug

SEQ ID NO: 665731 - RNA, 12 nt, Homo sapiens
ucauuacauuuc

SEQ ID NO: 665732 - RNA, 12 nt, Homo sapiens
ucauuaggcaaa

SEQ ID NO: 665733 - RNA, 16 nt, Homo sapiens
ucauuaguauuucaca

SEQ ID NO: 665734 - RNA, 14 nt, Homo sapiens
ucauuauaaaaugg

SEQ ID NO: 665735 - RNA, 20 nt, Homo sapiens
ucauuauaaacgugaugauc

SEQ ID NO: 665736 - RNA, 17 nt, Homo sapiens
ucauuauaucauuggaa

SEQ ID NO: 665737 - RNA, 20 nt, Homo sapiens
ucauuauuuuuccacuuugu

SEQ ID NO: 665738 - RNA, 22 nt, Homo sapiens
ucauuauuuuuguuagcaaaga

SEQ ID NO: 665739 - RNA, 16 nt, Homo sapiens
ucauuauuuuuuacaa

SEQ ID NO: 665740 - RNA, 18 nt, Homo sapiens
ucauucaacucuccaaug

SEQ ID NO: 665741 - RNA, 21 nt, Homo sapiens
ucauucagcaucuacucuaaa

SEQ ID NO: 665742 - RNA, 20 nt, Homo sapiens
ucauucagguauuuguaaua

SEQ ID NO: 665743 - RNA, 13 nt, Homo sapiens
ucauucauggcua

SEQ ID NO: 665744 - RNA, 21 nt, Homo sapiens
ucauuccaaucuauugcuuca

SEQ ID NO: 665745 - RNA, 17 nt, Homo sapiens
ucauuccaccuucccau

SEQ ID NO: 665746 - RNA, 18 nt, Homo sapiens
ucauucccccaccuaucc

SEQ ID NO: 665747 - RNA, 21 nt, Homo sapiens
ucauuccugaaagaaacaguu

SEQ ID NO: 665748 - RNA, 22 nt, Homo sapiens
ucauuccugaaagaaacaguua

SEQ ID NO: 665749 - RNA, 18 nt, Homo sapiens
ucauucgcuacuaugauu

SEQ ID NO: 665750 - RNA, 15 nt, Homo sapiens
ucauucucagaauuc

SEQ ID NO: 665751 - RNA, 12 nt, Homo sapiens
ucauucuuuauu

SEQ ID NO: 665752 - RNA, 15 nt, Homo sapiens
ucauugaaguauuuu

SEQ ID NO: 665753 - RNA, 21 nt, Homo sapiens
ucauugaaguauuuuccucca

SEQ ID NO: 665754 - RNA, 20 nt, Homo sapiens
ucauugauagaacuacuuug

SEQ ID NO: 665755 - RNA, 22 nt, Homo sapiens
ucauugauagaacuacuuugaa

SEQ ID NO: 665756 - RNA, 11 nt, Homo sapiens
ucauugccucu

SEQ ID NO: 665757 - RNA, 23 nt, Homo sapiens
ucauugcgauuuaucuugcuuca

SEQ ID NO: 665758 - RNA, 17 nt, Homo sapiens
ucauugcuuugaagcag

SEQ ID NO: 665759 - RNA, 17 nt, Homo sapiens
ucauuggccacugucuc

SEQ ID NO: 665760 - RNA, 23 nt, Homo sapiens
ucauuggccacugucuccacuca

SEQ ID NO: 665761 - RNA, 23 nt, Homo sapiens
ucauugugagauugcaguucugu

SEQ ID NO: 665762 - RNA, 14 nt, Homo sapiens
ucauuguguucucu

SEQ ID NO: 665763 - RNA, 15 nt, Homo sapiens
ucauuguuucugcau

SEQ ID NO: 665764 - RNA, 14 nt, Homo sapiens
ucauuuaaaacagg

SEQ ID NO: 665765 - RNA, 17 nt, Homo sapiens
ucauuuauaaaaccauc

SEQ ID NO: 665766 - RNA, 14 nt, Homo sapiens
ucauuuauauuccu

SEQ ID NO: 665767 - RNA, 14 nt, Homo sapiens
ucauuucaaauaca

SEQ ID NO: 665768 - RNA, 17 nt, Homo sapiens
ucauuucagauaaacaa

SEQ ID NO: 665769 - RNA, 18 nt, Homo sapiens
ucauuucagcucuugcuu

SEQ ID NO: 665770 - RNA, 15 nt, Homo sapiens
ucauuucauguauag

SEQ ID NO: 665771 - RNA, 18 nt, Homo sapiens
ucauuuccccauaacuca

SEQ ID NO: 665772 - RNA, 21 nt, Homo sapiens
ucauuuccuauguaacugcau

SEQ ID NO: 665773 - RNA, 19 nt, Homo sapiens
ucauuucugcagauggaaa

SEQ ID NO: 665774 - RNA, 16 nt, Homo sapiens
ucauuucugccaugau

SEQ ID NO: 665775 - RNA, 20 nt, Homo sapiens
ucauuucuggaaagugcaau

SEQ ID NO: 665776 - RNA, 16 nt, Homo sapiens
ucauuucuuaucacau

SEQ ID NO: 665777 - RNA, 21 nt, Homo sapiens
ucauuugaaugugugaauuca

SEQ ID NO: 665778 - RNA, 18 nt, Homo sapiens
ucauuugagauaaaguca

SEQ ID NO: 665779 - RNA, 23 nt, Homo sapiens
ucauuuggaaugaauacagcauu

SEQ ID NO: 665780 - RNA, 18 nt, Homo sapiens
ucauuuguaguugccuua

SEQ ID NO: 665781 - RNA, 19 nt, Homo sapiens
ucauuuuacacaaagggaa

SEQ ID NO: 665782 - RNA, 15 nt, Homo sapiens
ucauuuucuacguca

SEQ ID NO: 665783 - RNA, 16 nt, Homo sapiens
ucauuuugcagaagga

SEQ ID NO: 665784 - RNA, 14 nt, Homo sapiens
ucauuuuguugcuu

SEQ ID NO: 665785 - RNA, 19 nt, Homo sapiens
uccaaaaagcacauauuag

SEQ ID NO: 665786 - RNA, 18 nt, Homo sapiens
uccaaaaauguguaagaa

SEQ ID NO: 665787 - RNA, 15 nt, Homo sapiens
uccaaaacaaaaaga

SEQ ID NO: 665788 - RNA, 14 nt, Homo sapiens
uccaaaacuuuaau

SEQ ID NO: 665789 - RNA, 21 nt, Homo sapiens
uccaaaacuuuaaugaacuaa

SEQ ID NO: 665790 - RNA, 12 nt, Homo sapiens
uccaaacagugu

SEQ ID NO: 665791 - RNA, 17 nt, Homo sapiens
uccaaaccccaggguag

SEQ ID NO: 665792 - RNA, 15 nt, Homo sapiens
uccaaacucuucccu

SEQ ID NO: 665793 - RNA, 15 nt, Homo sapiens
uccaaagaaauggaa

SEQ ID NO: 665794 - RNA, 16 nt, Homo sapiens
gccugggagccagggu

SEQ ID NO: 665795 - RNA, 15 nt, Homo sapiens
uccagaacaaagcac

SEQ ID NO: 665796 - RNA, 19 nt, Homo sapiens
gcggaaggucccucagaca

SEQ ID NO: 665797 - RNA, 17 nt, Homo sapiens
gcggaggcgguggcaga

SEQ ID NO: 665798 - RNA, 13 nt, Homo sapiens
gcggagguugcag

SEQ ID NO: 665799 - RNA, 21 nt, Homo sapiens
gcggcgugggggcacugacca

SEQ ID NO: 665800 - RNA, 19 nt, Homo sapiens
gcggcuuucacugcugagu

SEQ ID NO: 665801 - RNA, 17 nt, Homo sapiens
gcgggccaaggacugcc

SEQ ID NO: 665802 - RNA, 21 nt, Homo sapiens
gcgggcgcucgcucaggugau

SEQ ID NO: 665803 - RNA, 15 nt, Homo sapiens
gcggggaagggugca

SEQ ID NO: 665804 - RNA, 19 nt, Homo sapiens
gcggggacccuuaccugaa

SEQ ID NO: 665805 - RNA, 19 nt, Homo sapiens
gcgggguuagagccaagcu

SEQ ID NO: 665806 - RNA, 17 nt, Homo sapiens
gcgguaccuguguuucc

SEQ ID NO: 665807 - RNA, 14 nt, Homo sapiens
gcggugaugaugua

SEQ ID NO: 665808 - RNA, 13 nt, Homo sapiens
gcggugcacucac

SEQ ID NO: 665809 - RNA, 20 nt, Homo sapiens
gcgguucauacgcaucccau

SEQ ID NO: 665810 - RNA, 21 nt, Homo sapiens
gcgguucauacgcaucccauc

SEQ ID NO: 665811 - RNA, 17 nt, Homo sapiens
gcgguuccugugcagau

SEQ ID NO: 665812 - RNA, 17 nt, Homo sapiens
gcguaaacgacacucuc

SEQ ID NO: 665813 - RNA, 14 nt, Homo sapiens
gcguagacaggugu

SEQ ID NO: 665814 - RNA, 16 nt, Homo sapiens
gcguaguccgcuuucu

SEQ ID NO: 665815 - RNA, 15 nt, Homo sapiens
gcgucaccguccacu

SEQ ID NO: 665816 - RNA, 16 nt, Homo sapiens
gcgucacggccaagug

SEQ ID NO: 665817 - RNA, 20 nt, Homo sapiens
gcgucaucucugacacggcc

SEQ ID NO: 665818 - RNA, 15 nt, Homo sapiens
gcgucaucuguguaa

SEQ ID NO: 665819 - RNA, 23 nt, Homo sapiens
gcguccaauacacgcgugugcuc

SEQ ID NO: 665820 - RNA, 18 nt, Homo sapiens
gcgucccagucucuggca

SEQ ID NO: 665821 - RNA, 16 nt, Homo sapiens
gcgucucugcuuuaaa

SEQ ID NO: 665822 - RNA, 15 nt, Homo sapiens
gcgucuggguucuca

SEQ ID NO: 665823 - RNA, 12 nt, Homo sapiens
gcgugacaauaa

SEQ ID NO: 665824 - RNA, 19 nt, Homo sapiens
gcgugauccaccacaccug

SEQ ID NO: 665825 - RNA, 20 nt, Homo sapiens
gcgugauggcuaugccuugc

SEQ ID NO: 665826 - RNA, 15 nt, Homo sapiens
gcgugcacaucugcu

SEQ ID NO: 665827 - RNA, 12 nt, Homo sapiens
gcgugcaugugc

SEQ ID NO: 665828 - RNA, 14 nt, Homo sapiens
gcgugcaugugcac

SEQ ID NO: 665829 - RNA, 17 nt, Homo sapiens
gcgugcccagcucuuca

SEQ ID NO: 665830 - RNA, 19 nt, Homo sapiens
gcgugcucccgaugcugcu

SEQ ID NO: 665831 - RNA, 21 nt, Homo sapiens
gcgugguauaaucuccauuuc

SEQ ID NO: 665832 - RNA, 11 nt, Homo sapiens
gcgugugacag

SEQ ID NO: 665833 - RNA, 20 nt, Homo sapiens
gcguguguccaugugugugc

SEQ ID NO: 665834 - RNA, 22 nt, Homo sapiens
gcguguuucugacucugagcua

SEQ ID NO: 665835 - RNA, 23 nt, Homo sapiens
gcguuuggacccaguucagugag

SEQ ID NO: 665836 - RNA, 14 nt, Homo sapiens
gcuaaaaagcaaca

SEQ ID NO: 665837 - RNA, 13 nt, Homo sapiens
gcuaaaacugcuc

SEQ ID NO: 665838 - RNA, 18 nt, Homo sapiens
gcuaaacccagaugguuu

SEQ ID NO: 665839 - RNA, 16 nt, Homo sapiens
gcuaaacugaugacuu

SEQ ID NO: 665840 - RNA, 21 nt, Homo sapiens
gcuaaagagcuuugugauaua

SEQ ID NO: 665841 - RNA, 20 nt, Homo sapiens
gcuaaauauuuaccuugaaa

SEQ ID NO: 665842 - RNA, 13 nt, Homo sapiens
gcuaaaugcaauu

SEQ ID NO: 665843 - RNA, 11 nt, Homo sapiens
gcuaaaugcac

SEQ ID NO: 665844 - RNA, 22 nt, Homo sapiens
gcuaaauucacagcgcuaugca

SEQ ID NO: 665845 - RNA, 21 nt, Homo sapiens
gcuaagauagaggggcucugg

SEQ ID NO: 665846 - RNA, 14 nt, Homo sapiens
gcuaagcuuuacag

SEQ ID NO: 665847 - RNA, 17 nt, Homo sapiens
gcuaagggugggugcuc

SEQ ID NO: 665848 - RNA, 20 nt, Homo sapiens
gcuaagugaaagaagccagg

SEQ ID NO: 665849 - RNA, 21 nt, Homo sapiens
gcuaauaaauaaucaucccuc

SEQ ID NO: 665850 - RNA, 20 nt, Homo sapiens
gcuaauggaauuacugccuu

SEQ ID NO: 665851 - RNA, 12 nt, Homo sapiens
gcuaauguugcu

SEQ ID NO: 665852 - RNA, 23 nt, Homo sapiens
gcuaauucuacucacagugcuuu

SEQ ID NO: 665853 - RNA, 14 nt, Homo sapiens
gcuaauugagacca

SEQ ID NO: 665854 - RNA, 21 nt, Homo sapiens
gcuaauuuacuggacaaagaa

SEQ ID NO: 665855 - RNA, 15 nt, Homo sapiens
gcuaauuucuggccc

SEQ ID NO: 665856 - RNA, 21 nt, Homo sapiens
gcuacaaauuuaugcauuuca

SEQ ID NO: 665857 - RNA, 21 nt, Homo sapiens
gcuacaaucuguucaauguuu

SEQ ID NO: 665858 - RNA, 20 nt, Homo sapiens
gcuacagaugguagaacuaa

SEQ ID NO: 665859 - RNA, 23 nt, Homo sapiens
gcuacauucuuuuuucuauucaa

SEQ ID NO: 665860 - RNA, 12 nt, Homo sapiens
gcuaccaggaaa

SEQ ID NO: 665861 - RNA, 14 nt, Homo sapiens
gcuaccaguauuua

SEQ ID NO: 665862 - RNA, 19 nt, Homo sapiens
gcuaccauuuuacauuucu

SEQ ID NO: 665863 - RNA, 19 nt, Homo sapiens
gcuacccugaguucaucca

SEQ ID NO: 665864 - RNA, 20 nt, Homo sapiens
gcuaccugggucaacccaac

SEQ ID NO: 665865 - RNA, 14 nt, Homo sapiens
gcuacuaagcacau

SEQ ID NO: 665866 - RNA, 20 nt, Homo sapiens
gcuacuaccuagggcacuuu

SEQ ID NO: 665867 - RNA, 21 nt, Homo sapiens
gcuacuaccuagggcacuuua

SEQ ID NO: 665868 - RNA, 21 nt, Homo sapiens
gcuacuagagauauucuuauu

SEQ ID NO: 665869 - RNA, 16 nt, Homo sapiens
gcuacuccauccugaa

SEQ ID NO: 665870 - RNA, 15 nt, Homo sapiens
gcuacucucuugcca

SEQ ID NO: 665871 - RNA, 22 nt, Homo sapiens
gcuacucucuugccagcauuuu

SEQ ID NO: 665872 - RNA, 20 nt, Homo sapiens
gcuacucuguuccuucacau

SEQ ID NO: 665873 - RNA, 19 nt, Homo sapiens
gcuacugcaaaugcuauau

SEQ ID NO: 665874 - RNA, 22 nt, Homo sapiens
gcuacuuuuuuuuaguucaaua

SEQ ID NO: 665875 - RNA, 20 nt, Homo sapiens
gcuagaaauaagcccaacag

SEQ ID NO: 665876 - RNA, 12 nt, Homo sapiens
gcuagaaggaau

SEQ ID NO: 665877 - RNA, 18 nt, Homo sapiens
gcuagacaagcuugucca

SEQ ID NO: 665878 - RNA, 13 nt, Homo sapiens
gcuagagugcaau

SEQ ID NO: 665879 - RNA, 14 nt, Homo sapiens
gcuagaugugucuu

SEQ ID NO: 665880 - RNA, 13 nt, Homo sapiens
gcuagcacuaacu

SEQ ID NO: 665881 - RNA, 17 nt, Homo sapiens
gcuaggaaugaaauccu

SEQ ID NO: 665882 - RNA, 15 nt, Homo sapiens
gcuagggaauaucaa

SEQ ID NO: 665883 - RNA, 19 nt, Homo sapiens
gcuaggguggcccuugcag

SEQ ID NO: 665884 - RNA, 20 nt, Homo sapiens
gcuaggguggcccuugcagu

SEQ ID NO: 665885 - RNA, 13 nt, Homo sapiens
gcuaguacuguau

SEQ ID NO: 665886 - RNA, 18 nt, Homo sapiens
gcuagucugcccuaugga

SEQ ID NO: 665887 - RNA, 18 nt, Homo sapiens
gcuagucugucagggccu

SEQ ID NO: 665888 - RNA, 13 nt, Homo sapiens
gcuagugccaaau

SEQ ID NO: 665889 - RNA, 19 nt, Homo sapiens
gcuagugcuguagaguuca

SEQ ID NO: 665890 - RNA, 21 nt, Homo sapiens
gcuaguucccaugacuccugg

SEQ ID NO: 665891 - RNA, 22 nt, Homo sapiens
gcuaguuuauuggaaguguuca

SEQ ID NO: 665892 - RNA, 15 nt, Homo sapiens
gcuaguuugaccuca

SEQ ID NO: 665893 - RNA, 16 nt, Homo sapiens
gcuauaaguuuuagaa

SEQ ID NO: 665894 - RNA, 15 nt, Homo sapiens
gcuauagugaacucc

SEQ ID NO: 665895 - RNA, 16 nt, Homo sapiens
gcuauauuucagugac

SEQ ID NO: 665896 - RNA, 23 nt, Homo sapiens
gcuaucagacuguaggauuugaa

SEQ ID NO: 665897 - RNA, 15 nt, Homo sapiens
gcuauccaaauaacu

SEQ ID NO: 665898 - RNA, 20 nt, Homo sapiens
gcuaucuaauuuuacacucu

SEQ ID NO: 665899 - RNA, 11 nt, Homo sapiens
gcuaucucugu

SEQ ID NO: 665900 - RNA, 21 nt, Homo sapiens
gcuaucuggccugagacaaca

SEQ ID NO: 665901 - RNA, 21 nt, Homo sapiens
gcuaugaacagaaacuacauu

SEQ ID NO: 665902 - RNA, 14 nt, Homo sapiens
gcuaugcauuugaa

SEQ ID NO: 665903 - RNA, 23 nt, Homo sapiens
gcuaugccauuucuucucucugu

SEQ ID NO: 665904 - RNA, 14 nt, Homo sapiens
gcuaugccuugcac

SEQ ID NO: 665905 - RNA, 16 nt, Homo sapiens
gcuaugccuugcacac

SEQ ID NO: 665906 - RNA, 17 nt, Homo sapiens
gcuauggcccagaaaca

SEQ ID NO: 665907 - RNA, 23 nt, Homo sapiens
gcuauggucagguuauacuccuc

SEQ ID NO: 665908 - RNA, 20 nt, Homo sapiens
gcuauggugagaugcagcug

SEQ ID NO: 665909 - RNA, 23 nt, Homo sapiens
gcuaugguuuucuccaagagcua

SEQ ID NO: 665910 - RNA, 22 nt, Homo sapiens
gcuaugugaagaguaagucaac

SEQ ID NO: 665911 - RNA, 21 nt, Homo sapiens
gcuauguuggaaaugugcaac

SEQ ID NO: 665912 - RNA, 16 nt, Homo sapiens
gcuauugccaaccagu

SEQ ID NO: 665913 - RNA, 18 nt, Homo sapiens
gcuauugugauaugacaa

SEQ ID NO: 665914 - RNA, 13 nt, Homo sapiens
gcuauuuaugcaa

SEQ ID NO: 665915 - RNA, 22 nt, Homo sapiens
gcuauuucaucuauuuuuggca

SEQ ID NO: 665916 - RNA, 15 nt, Homo sapiens
ucccaacagccaaga

SEQ ID NO: 665917 - RNA, 14 nt, Homo sapiens
ucccaacagccuua

SEQ ID NO: 665918 - RNA, 15 nt, Homo sapiens
ucccaacauaugccc

SEQ ID NO: 665919 - RNA, 11 nt, Homo sapiens
gcuauuugccu

SEQ ID NO: 665920 - RNA, 14 nt, Homo sapiens
gcuauuugucaucu

SEQ ID NO: 665921 - RNA, 20 nt, Homo sapiens
gcuauuuguguguaugcuga

SEQ ID NO: 665922 - RNA, 17 nt, Homo sapiens
gcuauuuguucagagag

SEQ ID NO: 665923 - RNA, 14 nt, Homo sapiens
gcuauuuucauuua

SEQ ID NO: 665924 - RNA, 18 nt, Homo sapiens
gcuauuuugugaagccau

SEQ ID NO: 665925 - RNA, 16 nt, Homo sapiens
gcucaaaucuauucag

SEQ ID NO: 665926 - RNA, 14 nt, Homo sapiens
gcucaacaucucag

SEQ ID NO: 665927 - RNA, 16 nt, Homo sapiens
gcucaacaucucagga

SEQ ID NO: 665928 - RNA, 11 nt, Homo sapiens
gcucaagaaca

SEQ ID NO: 665929 - RNA, 15 nt, Homo sapiens
gcucaagaacacaug

SEQ ID NO: 665930 - RNA, 17 nt, Homo sapiens
gcucaaggcugugcagg

SEQ ID NO: 665931 - RNA, 21 nt, Homo sapiens
gcucaagucacuuuuauuuga

SEQ ID NO: 665932 - RNA, 19 nt, Homo sapiens
gcucaauauuccugaauga

SEQ ID NO: 665933 - RNA, 23 nt, Homo sapiens
gcucaauuuaauuuugcaggauu

SEQ ID NO: 665934 - RNA, 19 nt, Homo sapiens
gcucacaaaccaugcaaau

SEQ ID NO: 665935 - RNA, 12 nt, Homo sapiens
gcucaccagccc

SEQ ID NO: 665936 - RNA, 15 nt, Homo sapiens
gcucaccuuuaucac

SEQ ID NO: 665937 - RNA, 21 nt, Homo sapiens
gcucaccuuuaucaccucauu

SEQ ID NO: 665938 - RNA, 16 nt, Homo sapiens
gcucacggcacgcuug

SEQ ID NO: 665939 - RNA, 21 nt, Homo sapiens
gcucacguuaccuugacacau

SEQ ID NO: 665940 - RNA, 18 nt, Homo sapiens
gcucacugaaucuucacg

SEQ ID NO: 665941 - RNA, 20 nt, Homo sapiens
gcucacuguccacaugugaa

SEQ ID NO: 665942 - RNA, 15 nt, Homo sapiens
gcucacuugccuuag

SEQ ID NO: 665943 - RNA, 16 nt, Homo sapiens
gcucagaacuugcugc

SEQ ID NO: 665944 - RNA, 16 nt, Homo sapiens
gcucagagcuuuguca

SEQ ID NO: 665945 - RNA, 16 nt, Homo sapiens
gcucagauuauuuaaa

SEQ ID NO: 665946 - RNA, 20 nt, Homo sapiens
gcucagcaugcauccuuugc

SEQ ID NO: 665947 - RNA, 12 nt, Homo sapiens
gcucagccacag

SEQ ID NO: 665948 - RNA, 22 nt, Homo sapiens
gcucagccagcacuuguccagc

SEQ ID NO: 665949 - RNA, 21 nt, Homo sapiens
gcucagcccugacuggugcua

SEQ ID NO: 665950 - RNA, 15 nt, Homo sapiens
gcucaggcacauaca

SEQ ID NO: 665951 - RNA, 19 nt, Homo sapiens
gcucaggcuggagugcagu

SEQ ID NO: 665952 - RNA, 21 nt, Homo sapiens
gcucagggaaaagcagcucuc

SEQ ID NO: 665953 - RNA, 15 nt, Homo sapiens
gcucaggggcgugug

SEQ ID NO: 665954 - RNA, 19 nt, Homo sapiens
gcucaggguuaauguagug

SEQ ID NO: 665955 - RNA, 12 nt, Homo sapiens
gcucaguauuuu

SEQ ID NO: 665956 - RNA, 19 nt, Homo sapiens
gcucagucgcuagcauuuc

SEQ ID NO: 665957 - RNA, 15 nt, Homo sapiens
gcucaguuggugcug

SEQ ID NO: 665958 - RNA, 18 nt, Homo sapiens
gcucaguuggugcugcuu

SEQ ID NO: 665959 - RNA, 20 nt, Homo sapiens
gcucaguuggugcugcuuuc

SEQ ID NO: 665960 - RNA, 21 nt, Homo sapiens
gcucauaagcaauaccagcaa

SEQ ID NO: 665961 - RNA, 18 nt, Homo sapiens
gcucaugagcgucugugg

SEQ ID NO: 665962 - RNA, 19 nt, Homo sapiens
gcucaugccuguaaucuca

SEQ ID NO: 665963 - RNA, 22 nt, Homo sapiens
gcucauuugagauaaagucaaa

SEQ ID NO: 665964 - RNA, 21 nt, Homo sapiens
gcuccaaaggaaauccaaaaa

SEQ ID NO: 665965 - RNA, 13 nt, Homo sapiens
gcuccaaauccaa

SEQ ID NO: 665966 - RNA, 17 nt, Homo sapiens
gcuccaaugccuacuga

SEQ ID NO: 665967 - RNA, 20 nt, Homo sapiens
gcuccaccagcagcauggca

SEQ ID NO: 665968 - RNA, 13 nt, Homo sapiens
gcuccaccccagg

SEQ ID NO: 665969 - RNA, 20 nt, Homo sapiens
gcuccacccuggccgagucc

SEQ ID NO: 665970 - RNA, 16 nt, Homo sapiens
gcuccacgaagccuua

SEQ ID NO: 665971 - RNA, 17 nt, Homo sapiens
gcuccacgaagccuuaa

SEQ ID NO: 665972 - RNA, 11 nt, Homo sapiens
gcuccacugaa

SEQ ID NO: 665973 - RNA, 14 nt, Homo sapiens
gcuccagaaauguc

SEQ ID NO: 665974 - RNA, 14 nt, Homo sapiens
gcuccagcaccuuc

SEQ ID NO: 665975 - RNA, 21 nt, Homo sapiens
gcuccagcucauaugcugaca

SEQ ID NO: 665976 - RNA, 22 nt, Homo sapiens
gcuccagcugauccagauguua

SEQ ID NO: 665977 - RNA, 17 nt, Homo sapiens
gcuccagugcaggagac

SEQ ID NO: 665978 - RNA, 19 nt, Homo sapiens
gcuccaucguccauccucu

SEQ ID NO: 665979 - RNA, 20 nt, Homo sapiens
gcuccauguagaagccacua

SEQ ID NO: 665980 - RNA, 19 nt, Homo sapiens
gcucccacacuugugccag

SEQ ID NO: 665981 - RNA, 22 nt, Homo sapiens
gcucccaccacggggucugcag

SEQ ID NO: 665982 - RNA, 19 nt, Homo sapiens
gcucccagacggucaggaa

SEQ ID NO: 665983 - RNA, 13 nt, Homo sapiens
gcuccccaagaaa

SEQ ID NO: 665984 - RNA, 21 nt, Homo sapiens
gcuccccuuggaccuccaggg

SEQ ID NO: 665985 - RNA, 21 nt, Homo sapiens
gcucccuccucuccuacccac

SEQ ID NO: 665986 - RNA, 23 nt, Homo sapiens
gcucccucuguuagguccauuuu

SEQ ID NO: 665987 - RNA, 14 nt, Homo sapiens
gcucccuuccugcc

SEQ ID NO: 665988 - RNA, 14 nt, Homo sapiens
gcuccgaccucucu

SEQ ID NO: 665989 - RNA, 17 nt, Homo sapiens
gcuccgaggacccagga

SEQ ID NO: 665990 - RNA, 16 nt, Homo sapiens
gcuccgcugcuccuug

SEQ ID NO: 665991 - RNA, 15 nt, Homo sapiens
gcuccgggcuuucac

SEQ ID NO: 665992 - RNA, 14 nt, Homo sapiens
gcuccuaggugaug

SEQ ID NO: 665993 - RNA, 16 nt, Homo sapiens
gcuccuccccucuuga

SEQ ID NO: 665994 - RNA, 18 nt, Homo sapiens
gcuccuccgucugacccu

SEQ ID NO: 665995 - RNA, 12 nt, Homo sapiens
gcuccuccuucc

SEQ ID NO: 665996 - RNA, 20 nt, Homo sapiens
gcuccuccuugcccagacua

SEQ ID NO: 665997 - RNA, 22 nt, Homo sapiens
gcuccucuaguaagaugcacug

SEQ ID NO: 665998 - RNA, 16 nt, Homo sapiens
gcuccugcccagccac

SEQ ID NO: 665999 - RNA, 21 nt, Homo sapiens
gcuccuggggagcuccuggga

SEQ ID NO: 666000 - RNA, 18 nt, Homo sapiens
gcuccugggggaugcucu

SEQ ID NO: 666001 - RNA, 15 nt, Homo sapiens
gcuccuggguuucau

SEQ ID NO: 666002 - RNA, 22 nt, Homo sapiens
gcuccuuauucccaguguucca

SEQ ID NO: 666003 - RNA, 17 nt, Homo sapiens
gcuccuugcugcauuga

SEQ ID NO: 666004 - RNA, 20 nt, Homo sapiens
gcuccuuggcggacacuggg

SEQ ID NO: 666005 - RNA, 18 nt, Homo sapiens
gcuccuuggcuuaccuga

SEQ ID NO: 666006 - RNA, 21 nt, Homo sapiens
gcuccuuucuccagccagcaa

SEQ ID NO: 666007 - RNA, 15 nt, Homo sapiens
gcucgagcaguccug

SEQ ID NO: 666008 - RNA, 13 nt, Homo sapiens
gcucgcugccauc

SEQ ID NO: 666009 - RNA, 16 nt, Homo sapiens
gcucgcuuugagugac

SEQ ID NO: 666010 - RNA, 22 nt, Homo sapiens
gcucggacuuggcacuccugga

SEQ ID NO: 666011 - RNA, 12 nt, Homo sapiens
gcucggggucca

SEQ ID NO: 666012 - RNA, 23 nt, Homo sapiens
gcucguucucuucucucuucaau

SEQ ID NO: 666013 - RNA, 20 nt, Homo sapiens
gcucguugccugccacugag

SEQ ID NO: 666014 - RNA, 19 nt, Homo sapiens
gcucuaaauuaagacagca

SEQ ID NO: 666015 - RNA, 15 nt, Homo sapiens
gcucuaauguacaau

SEQ ID NO: 666016 - RNA, 12 nt, Homo sapiens
gcucuacaaaua

SEQ ID NO: 666017 - RNA, 14 nt, Homo sapiens
gcucuacaucuucu

SEQ ID NO: 666018 - RNA, 18 nt, Homo sapiens
gcucuacguuacaggugg

SEQ ID NO: 666019 - RNA, 20 nt, Homo sapiens
gcucuagagaaaagucuacc

SEQ ID NO: 666020 - RNA, 22 nt, Homo sapiens
gcucuagagaaaagucuacccc

SEQ ID NO: 666021 - RNA, 13 nt, Homo sapiens
gcucuaguuuuca

SEQ ID NO: 666022 - RNA, 19 nt, Homo sapiens
gcucucagaagguauuccu

SEQ ID NO: 666023 - RNA, 21 nt, Homo sapiens
gcucucccaacucuugcacag

SEQ ID NO: 666024 - RNA, 21 nt, Homo sapiens
gcucuccccaaacuugcuuua

SEQ ID NO: 666025 - RNA, 17 nt, Homo sapiens
gcucuccugacuuuuaa

SEQ ID NO: 666026 - RNA, 16 nt, Homo sapiens
gcucucgcacaccucu

SEQ ID NO: 666027 - RNA, 22 nt, Homo sapiens
gcucucuaaaugggaauucuca

SEQ ID NO: 666028 - RNA, 21 nt, Homo sapiens
gcucucugacgcuugugacag

SEQ ID NO: 666029 - RNA, 19 nt, Homo sapiens
gcucucuggagguacugag

SEQ ID NO: 666030 - RNA, 18 nt, Homo sapiens
gcucucuugugacgugca

SEQ ID NO: 666031 - RNA, 24 nt, Homo sapiens
gcucugaacaaacacugaaucaug

SEQ ID NO: 666032 - RNA, 21 nt, Homo sapiens
gcucugaacacacacgccagc

SEQ ID NO: 666033 - RNA, 18 nt, Homo sapiens
gcucugaaguguccuaaa

SEQ ID NO: 666034 - RNA, 14 nt, Homo sapiens
gcucugaaucugua

SEQ ID NO: 666035 - RNA, 20 nt, Homo sapiens
gcucugaaucuguacauguu

SEQ ID NO: 666036 - RNA, 21 nt, Homo sapiens
gcucugagacccuuuucucag

SEQ ID NO: 666037 - RNA, 15 nt, Homo sapiens
ucgggacuaacccag

SEQ ID NO: 666038 - RNA, 19 nt, Homo sapiens
ucgggacuugaaaaccacu

SEQ ID NO: 666039 - RNA, 15 nt, Homo sapiens
ucgggauuaguacac

SEQ ID NO: 666040 - RNA, 17 nt, Homo sapiens
ucggguuuuauaugcaa

SEQ ID NO: 666041 - RNA, 13 nt, Homo sapiens
ucggucacuccaa

SEQ ID NO: 666042 - RNA, 15 nt, Homo sapiens
ucgguguucuguccc

SEQ ID NO: 666043 - RNA, 17 nt, Homo sapiens
ucgguuugguagacuug

SEQ ID NO: 666044 - RNA, 16 nt, Homo sapiens
ucguacauagucuguu

SEQ ID NO: 666045 - RNA, 10 nt, Homo sapiens
ucguagccaa

SEQ ID NO: 666046 - RNA, 16 nt, Homo sapiens
ucguagcuuguacaga

SEQ ID NO: 666047 - RNA, 13 nt, Homo sapiens
ucguauaccuuau

SEQ ID NO: 666048 - RNA, 15 nt, Homo sapiens
ggaauggugaaugaa

SEQ ID NO: 666049 - RNA, 18 nt, Homo sapiens
ggaaugugccaccugucc

SEQ ID NO: 666050 - RNA, 10 nt, Homo sapiens
ggaauuacaa

SEQ ID NO: 666051 - RNA, 23 nt, Homo sapiens
ggaauuacaaaacucagagaaau

SEQ ID NO: 666052 - RNA, 21 nt, Homo sapiens
ggaauuaggaagaccaagaca

SEQ ID NO: 666053 - RNA, 18 nt, Homo sapiens
ggaauuaugucugcugaa

SEQ ID NO: 666054 - RNA, 20 nt, Homo sapiens
ggaauucuaaauaaauuucc

SEQ ID NO: 666055 - RNA, 23 nt, Homo sapiens
ggaauugcuuuuaaaauacauuu

SEQ ID NO: 666056 - RNA, 20 nt, Homo sapiens
ggaauuuccucuauugaugu

SEQ ID NO: 666057 - RNA, 14 nt, Homo sapiens
ggaauuuggaguga

SEQ ID NO: 666058 - RNA, 16 nt, Homo sapiens
ggaauuuucucuccau

SEQ ID NO: 666059 - RNA, 21 nt, Homo sapiens
ggacaaaauaaaccguguauu

SEQ ID NO: 666060 - RNA, 23 nt, Homo sapiens
ggacaaacaagauuccuaaggaa

SEQ ID NO: 666061 - RNA, 20 nt, Homo sapiens
ggacaaacagcucaguucua

SEQ ID NO: 666062 - RNA, 14 nt, Homo sapiens
ggacaaacugccag

SEQ ID NO: 666063 - RNA, 19 nt, Homo sapiens
ggacaaacugccaguuuug

SEQ ID NO: 666064 - RNA, 21 nt, Homo sapiens
ggacaaauguuguccuguuaa

SEQ ID NO: 666065 - RNA, 14 nt, Homo sapiens
ggacaacugcggug

SEQ ID NO: 666066 - RNA, 22 nt, Homo sapiens
ggacaaggagugugaccacuga

SEQ ID NO: 666067 - RNA, 15 nt, Homo sapiens
ggacaagggcccaug

SEQ ID NO: 666068 - RNA, 13 nt, Homo sapiens
ggacacagaccca

SEQ ID NO: 666069 - RNA, 20 nt, Homo sapiens
ggacaccacgauucucccaa

SEQ ID NO: 666070 - RNA, 17 nt, Homo sapiens
ggacaccauuaccaaaa

SEQ ID NO: 666071 - RNA, 22 nt, Homo sapiens
ggacacccaacacuuuuuccau

SEQ ID NO: 666072 - RNA, 20 nt, Homo sapiens
ggacaccccuuauccaggac

SEQ ID NO: 666073 - RNA, 18 nt, Homo sapiens
ggacaccuuuuaacucac

SEQ ID NO: 666074 - RNA, 16 nt, Homo sapiens
ggacacuaucacucau

SEQ ID NO: 666075 - RNA, 19 nt, Homo sapiens
ggacacuccaugagugucu

SEQ ID NO: 666076 - RNA, 22 nt, Homo sapiens
ggacacuguccaugaagcacug

SEQ ID NO: 666077 - RNA, 23 nt, Homo sapiens
ggacacuuaauacuaccuugaaa

SEQ ID NO: 666078 - RNA, 22 nt, Homo sapiens
ggacagaauuggauacauacac

SEQ ID NO: 666079 - RNA, 12 nt, Homo sapiens
ggacagagccau

SEQ ID NO: 666080 - RNA, 20 nt, Homo sapiens
ggacagccaggagcucucca

SEQ ID NO: 666081 - RNA, 15 nt, Homo sapiens
ggacaggcacuccaa

SEQ ID NO: 666082 - RNA, 23 nt, Homo sapiens
ggacaguaucccacauccaacuc

SEQ ID NO: 666083 - RNA, 20 nt, Homo sapiens
ggacagucagcucucuccuu

SEQ ID NO: 666084 - RNA, 21 nt, Homo sapiens
ggacagucuggccacugucaa

SEQ ID NO: 666085 - RNA, 16 nt, Homo sapiens
ggacaguggaugcugc

SEQ ID NO: 666086 - RNA, 18 nt, Homo sapiens
ggacaguggcacaaucau

SEQ ID NO: 666087 - RNA, 23 nt, Homo sapiens
ggacauaaugggguccuggccau

SEQ ID NO: 666088 - RNA, 17 nt, Homo sapiens
ggacaucaaauuugcca

SEQ ID NO: 666089 - RNA, 20 nt, Homo sapiens
ggacauugagauacuaucau

SEQ ID NO: 666090 - RNA, 19 nt, Homo sapiens
ggacauuuaaaauucaauu

SEQ ID NO: 666091 - RNA, 13 nt, Homo sapiens
ggaccacaccucc

SEQ ID NO: 666092 - RNA, 13 nt, Homo sapiens
ggaccacauuuua

SEQ ID NO: 666093 - RNA, 20 nt, Homo sapiens
ggaccacucagccccuagga

SEQ ID NO: 666094 - RNA, 22 nt, Homo sapiens
ggaccagccuguaccuugcugu

SEQ ID NO: 666095 - RNA, 22 nt, Homo sapiens
ggaccagcuggccugggguccc

SEQ ID NO: 666096 - RNA, 18 nt, Homo sapiens
ggaccaggacugcagcuc

SEQ ID NO: 666097 - RNA, 17 nt, Homo sapiens
ggaccaggccauucugc

SEQ ID NO: 666098 - RNA, 12 nt, Homo sapiens
ggaccagggaug

SEQ ID NO: 666099 - RNA, 21 nt, Homo sapiens
ggaccauaaacguuguguuca

SEQ ID NO: 666100 - RNA, 15 nt, Homo sapiens
ggaccaucacugaga

SEQ ID NO: 666101 - RNA, 14 nt, Homo sapiens
ggaccaucagagag

SEQ ID NO: 666102 - RNA, 15 nt, Homo sapiens
ggaccauuccaggaa

SEQ ID NO: 666103 - RNA, 15 nt, Homo sapiens
ggaccccaucuguga

SEQ ID NO: 666104 - RNA, 21 nt, Homo sapiens
ggacccuggaccauuccagga

SEQ ID NO: 666105 - RNA, 12 nt, Homo sapiens
ggaccucaaagg

SEQ ID NO: 666106 - RNA, 17 nt, Homo sapiens
ggaccugcccugggcca

SEQ ID NO: 666107 - RNA, 19 nt, Homo sapiens
ggaccuuccugccaccagu

SEQ ID NO: 666108 - RNA, 14 nt, Homo sapiens
ggaccuuggcgcuu

SEQ ID NO: 666109 - RNA, 20 nt, Homo sapiens
ggaccuuuguauuaagccaa

SEQ ID NO: 666110 - RNA, 12 nt, Homo sapiens
ggacgaauuugc

SEQ ID NO: 666111 - RNA, 13 nt, Homo sapiens
ggacgaauuugca

SEQ ID NO: 666112 - RNA, 18 nt, Homo sapiens
ggacgcaauugugggaug

SEQ ID NO: 666113 - RNA, 18 nt, Homo sapiens
ggacgccacucauuucau

SEQ ID NO: 666114 - RNA, 15 nt, Homo sapiens
ggacggcaggcucac

SEQ ID NO: 666115 - RNA, 18 nt, Homo sapiens
ggacgguuucuagccucu

SEQ ID NO: 666116 - RNA, 17 nt, Homo sapiens
ggacuaacccaaugccu

SEQ ID NO: 666117 - RNA, 18 nt, Homo sapiens
ggacuaacccaaugccug

SEQ ID NO: 666118 - RNA, 20 nt, Homo sapiens
ggacuaacccaaugccugug

SEQ ID NO: 666119 - RNA, 23 nt, Homo sapiens
ggacuaacccaaugccugugaag

SEQ ID NO: 666120 - RNA, 18 nt, Homo sapiens
ggacuacacccaagccug

SEQ ID NO: 666121 - RNA, 13 nt, Homo sapiens
ggacuacaggugu

SEQ ID NO: 666122 - RNA, 20 nt, Homo sapiens
ggacuagugagucagcaccu

SEQ ID NO: 666123 - RNA, 15 nt, Homo sapiens
ggacucaagggucca

SEQ ID NO: 666124 - RNA, 21 nt, Homo sapiens
ggacuccaccuuggaccucag

SEQ ID NO: 666125 - RNA, 20 nt, Homo sapiens
ggacuccauccaccucauca

SEQ ID NO: 666126 - RNA, 22 nt, Homo sapiens
ggacuccaucucucauccucca

SEQ ID NO: 666127 - RNA, 17 nt, Homo sapiens
ggacuccggaggacuga

SEQ ID NO: 666128 - RNA, 21 nt, Homo sapiens
ggacuccucaaaccacuugcc

SEQ ID NO: 666129 - RNA, 14 nt, Homo sapiens
ggacucuggacaau

SEQ ID NO: 666130 - RNA, 20 nt, Homo sapiens
ggacugacagcaugugcccu

SEQ ID NO: 666131 - RNA, 17 nt, Homo sapiens
ggacuggaaccagggag

SEQ ID NO: 666132 - RNA, 19 nt, Homo sapiens
ggacuggaggugggcaugc

SEQ ID NO: 666133 - RNA, 22 nt, Homo sapiens
ggacuggaggugggcaugccac

SEQ ID NO: 666134 - RNA, 11 nt, Homo sapiens
ggacuguguuu

SEQ ID NO: 666135 - RNA, 17 nt, Homo sapiens
ggacuguugaugccuuu

SEQ ID NO: 666136 - RNA, 23 nt, Homo sapiens
ggacuuccuauuaagacuuacuu

SEQ ID NO: 666137 - RNA, 18 nt, Homo sapiens
ggacuuugagcacacuuu

SEQ ID NO: 666138 - RNA, 23 nt, Homo sapiens
ggagaaaauuggaacucuacuca

SEQ ID NO: 666139 - RNA, 19 nt, Homo sapiens
ggagaaagacuuccuugca

SEQ ID NO: 666140 - RNA, 13 nt, Homo sapiens
ggagaaaugccag

SEQ ID NO: 666141 - RNA, 14 nt, Homo sapiens
ggagaacaguuuca

SEQ ID NO: 666142 - RNA, 13 nt, Homo sapiens
ggagaacuagaga

SEQ ID NO: 666143 - RNA, 14 nt, Homo sapiens
ggagaacuagagaa

SEQ ID NO: 666144 - RNA, 21 nt, Homo sapiens
ggagaagagaugcugccauuu

SEQ ID NO: 666145 - RNA, 17 nt, Homo sapiens
ggagaagagcgcagugu

SEQ ID NO: 666146 - RNA, 17 nt, Homo sapiens
ggagaagcaugaaaaag

SEQ ID NO: 666147 - RNA, 17 nt, Homo sapiens
ggagaaggcagugauua

SEQ ID NO: 666148 - RNA, 23 nt, Homo sapiens
ggagaagucucagcuaagcucac

SEQ ID NO: 666149 - RNA, 18 nt, Homo sapiens
ggagaaucacuugcacuc

SEQ ID NO: 666150 - RNA, 17 nt, Homo sapiens
ggagaaugaagacuguu

SEQ ID NO: 666151 - RNA, 23 nt, Homo sapiens
ggagacacuauuuaucugugcaa

SEQ ID NO: 666152 - RNA, 15 nt, Homo sapiens
ggagaccacacugca

SEQ ID NO: 666153 - RNA, 21 nt, Homo sapiens
ggagaccccuuguugcacugc

SEQ ID NO: 666154 - RNA, 19 nt, Homo sapiens
ggagacccguagaugccag

SEQ ID NO: 666155 - RNA, 14 nt, Homo sapiens
ggagaccucaugcc

SEQ ID NO: 666156 - RNA, 15 nt, Homo sapiens
ggagaccuggcacug

SEQ ID NO: 666157 - RNA, 16 nt, Homo sapiens
ggagacgccaugugau

SEQ ID NO: 666158 - RNA, 18 nt, Homo sapiens
ggauauuaaauguugcuu

SEQ ID NO: 666159 - RNA, 21 nt, Homo sapiens
ggauauuaaauguugcuuuaa

SEQ ID NO: 666160 - RNA, 22 nt, Homo sapiens
ggauauuaguuaaugagccauc

SEQ ID NO: 666161 - RNA, 22 nt, Homo sapiens
ggauauugguucuuccccucau

SEQ ID NO: 666162 - RNA, 21 nt, Homo sapiens
ggauauuuacugcucuuuauu

SEQ ID NO: 666163 - RNA, 15 nt, Homo sapiens
ggauauuuucuucca

SEQ ID NO: 666164 - RNA, 16 nt, Homo sapiens
ggaucacaagauggaa

SEQ ID NO: 666165 - RNA, 21 nt, Homo sapiens
ggaucagaugacucucuccaa

SEQ ID NO: 666166 - RNA, 21 nt, Homo sapiens
ggaucagccuccgccauucca

SEQ ID NO: 666167 - RNA, 18 nt, Homo sapiens
ggaucaggcugcuggaaa

SEQ ID NO: 666168 - RNA, 11 nt, Homo sapiens
ggaucaucucu

SEQ ID NO: 666169 - RNA, 11 nt, Homo sapiens
ggauccaguga

SEQ ID NO: 666170 - RNA, 15 nt, Homo sapiens
ggaucccuacugcca

SEQ ID NO: 666171 - RNA, 17 nt, Homo sapiens
ucuauacacauaagcau

SEQ ID NO: 666172 - RNA, 19 nt, Homo sapiens
ucuauacacauaagcauaa

SEQ ID NO: 666173 - RNA, 16 nt, Homo sapiens
ucuauacuuaaucuca

SEQ ID NO: 666174 - RNA, 13 nt, Homo sapiens
ucuauagcagauu

SEQ ID NO: 666175 - RNA, 16 nt, Homo sapiens
ucuauaggaacauaug

SEQ ID NO: 666176 - RNA, 15 nt, Homo sapiens
ucuauaguuaagaau

SEQ ID NO: 666177 - RNA, 16 nt, Homo sapiens
ucuauaguucacugac

SEQ ID NO: 666178 - RNA, 13 nt, Homo sapiens
ucuauauaccaaa

SEQ ID NO: 666179 - RNA, 20 nt, Homo sapiens
ucuauauaccaaagcacauu

SEQ ID NO: 666180 - RNA, 11 nt, Homo sapiens
ucuauaucuca

SEQ ID NO: 666181 - RNA, 18 nt, Homo sapiens
ucuauauguacuugucaa

SEQ ID NO: 666182 - RNA, 18 nt, Homo sapiens
ucuauauuuuuguccaaa

SEQ ID NO: 666183 - RNA, 19 nt, Homo sapiens
ucuaucaaaugaaacucuu

SEQ ID NO: 666184 - RNA, 13 nt, Homo sapiens
ucuaucaucucag

SEQ ID NO: 666185 - RNA, 12 nt, Homo sapiens
ucuauccaaauc

SEQ ID NO: 666186 - RNA, 19 nt, Homo sapiens
ucuaucccacccaacagcu

SEQ ID NO: 666187 - RNA, 16 nt, Homo sapiens
ucuauccuuuugccug

SEQ ID NO: 666188 - RNA, 20 nt, Homo sapiens
ucuaucgugacucaauucaa

SEQ ID NO: 666189 - RNA, 19 nt, Homo sapiens
ucuaucuugucaaucccaa

SEQ ID NO: 666190 - RNA, 16 nt, Homo sapiens
ucuaucuuugagcgcc

SEQ ID NO: 666191 - RNA, 14 nt, Homo sapiens
ucuaugaaacugca

SEQ ID NO: 666192 - RNA, 14 nt, Homo sapiens
ucuaugacacaugc

SEQ ID NO: 666193 - RNA, 15 nt, Homo sapiens
ucuaugacacaugca

SEQ ID NO: 666194 - RNA, 23 nt, Homo sapiens
ucuaugaccucgcccuccacaaa

SEQ ID NO: 666195 - RNA, 19 nt, Homo sapiens
ucuaugaucuggacuuccu

SEQ ID NO: 666196 - RNA, 13 nt, Homo sapiens
ucuaugccuuuag

SEQ ID NO: 666197 - RNA, 19 nt, Homo sapiens
ucuaugcuggauaagaaau

SEQ ID NO: 666198 - RNA, 14 nt, Homo sapiens
ucuaugguugacau

SEQ ID NO: 666199 - RNA, 13 nt, Homo sapiens
ucuauguacugua

SEQ ID NO: 666200 - RNA, 15 nt, Homo sapiens
ucuaugucucaugau

SEQ ID NO: 666201 - RNA, 12 nt, Homo sapiens
ucuauguucccc

SEQ ID NO: 666202 - RNA, 12 nt, Homo sapiens
ucuauuacauuu

SEQ ID NO: 666203 - RNA, 16 nt, Homo sapiens
ucuauuaucaugguau

SEQ ID NO: 666204 - RNA, 20 nt, Homo sapiens
ucuauugagugaacagaauu

SEQ ID NO: 666205 - RNA, 21 nt, Homo sapiens
ucuauugagugaacagaauug

SEQ ID NO: 666206 - RNA, 13 nt, Homo sapiens
ucuauugcugcuc

SEQ ID NO: 666207 - RNA, 14 nt, Homo sapiens
ucuauuguuaccuc

SEQ ID NO: 666208 - RNA, 14 nt, Homo sapiens
ucuauuuccacuga

SEQ ID NO: 666209 - RNA, 17 nt, Homo sapiens
ucuauuuccacugaaca

SEQ ID NO: 666210 - RNA, 13 nt, Homo sapiens
ucuauuugagauu

SEQ ID NO: 666211 - RNA, 20 nt, Homo sapiens
ucuauuugccuccagugcag

SEQ ID NO: 666212 - RNA, 21 nt, Homo sapiens
ucuauuuuaagacugauuuua

SEQ ID NO: 666213 - RNA, 15 nt, Homo sapiens
ucuauuuuacuuugu

SEQ ID NO: 666214 - RNA, 15 nt, Homo sapiens
ucuauuuucugcaga

SEQ ID NO: 666215 - RNA, 11 nt, Homo sapiens
ucucaaaagga

SEQ ID NO: 666216 - RNA, 20 nt, Homo sapiens
ucucaaacuccugggcucaa

SEQ ID NO: 666217 - RNA, 12 nt, Homo sapiens
ucucaaacuuca

SEQ ID NO: 666218 - RNA, 18 nt, Homo sapiens
ucucaaaugcacaucuca

SEQ ID NO: 666219 - RNA, 19 nt, Homo sapiens
ucucaaaugcacaucucau

SEQ ID NO: 666220 - RNA, 15 nt, Homo sapiens
ucucaaauuagaaag

SEQ ID NO: 666221 - RNA, 22 nt, Homo sapiens
ucucaacaaccugaauguccca

SEQ ID NO: 666222 - RNA, 18 nt, Homo sapiens
ucucaacaauauaugucc

SEQ ID NO: 666223 - RNA, 17 nt, Homo sapiens
ucucaacauuaccaaaa

SEQ ID NO: 666224 - RNA, 14 nt, Homo sapiens
ucucaagacuuuag

SEQ ID NO: 666225 - RNA, 16 nt, Homo sapiens
ucucaagcuagccaga

SEQ ID NO: 666226 - RNA, 23 nt, Homo sapiens
ucucaauaaauuuuuauuacuua

SEQ ID NO: 666227 - RNA, 15 nt, Homo sapiens
ucucacacauuccag

SEQ ID NO: 666228 - RNA, 19 nt, Homo sapiens
ucucacccauuaucuggaa

SEQ ID NO: 666229 - RNA, 20 nt, Homo sapiens
ucucacccucaucacuagga

SEQ ID NO: 666230 - RNA, 16 nt, Homo sapiens
ucucaccuacuccaga

SEQ ID NO: 666231 - RNA, 16 nt, Homo sapiens
ucucaccuggacucca

SEQ ID NO: 666232 - RNA, 23 nt, Homo sapiens
ucucacgggcaugggcacucccu

SEQ ID NO: 666233 - RNA, 16 nt, Homo sapiens
ucucacuccagccaaa

SEQ ID NO: 666234 - RNA, 17 nt, Homo sapiens
ucucacugaaacauuua

SEQ ID NO: 666235 - RNA, 16 nt, Homo sapiens
ucucacugccauggaa

SEQ ID NO: 666236 - RNA, 21 nt, Homo sapiens
ucucacuuauaccaaagggaa

SEQ ID NO: 666237 - RNA, 18 nt, Homo sapiens
ucucacuuuuauugauaa

SEQ ID NO: 666238 - RNA, 14 nt, Homo sapiens
ucucagaagguauu

SEQ ID NO: 666239 - RNA, 23 nt, Homo sapiens
ucucagaauucggugugcugcca

SEQ ID NO: 666240 - RNA, 12 nt, Homo sapiens
ucucagacacua

SEQ ID NO: 666241 - RNA, 22 nt, Homo sapiens
ucucagacacugccgacaucag

SEQ ID NO: 666242 - RNA, 19 nt, Homo sapiens
ucucagacccuuuagccaa

SEQ ID NO: 666243 - RNA, 20 nt, Homo sapiens
ucucagaccugcgcacucca

SEQ ID NO: 666244 - RNA, 17 nt, Homo sapiens
ucucagagcauguguca

SEQ ID NO: 666245 - RNA, 15 nt, Homo sapiens
ucucagagcauuuca

SEQ ID NO: 666246 - RNA, 21 nt, Homo sapiens
ucucagccuaccaugagaaua

SEQ ID NO: 666247 - RNA, 12 nt, Homo sapiens
ucucagccucug

SEQ ID NO: 666248 - RNA, 17 nt, Homo sapiens
ucucagcuccaauuuca

SEQ ID NO: 666249 - RNA, 15 nt, Homo sapiens
ucucagcucuuccau

SEQ ID NO: 666250 - RNA, 21 nt, Homo sapiens
ucucagcuuucccugccacau

SEQ ID NO: 666251 - RNA, 16 nt, Homo sapiens
ucucaggaccucugua

SEQ ID NO: 666252 - RNA, 23 nt, Homo sapiens
ucucaggagcaggggcauugcug

SEQ ID NO: 666253 - RNA, 23 nt, Homo sapiens
ucucaggaguaucuuaccuguaa

SEQ ID NO: 666254 - RNA, 15 nt, Homo sapiens
ucucaggauugcuag

SEQ ID NO: 666255 - RNA, 21 nt, Homo sapiens
ucucaggggccagaggaacug

SEQ ID NO: 666256 - RNA, 23 nt, Homo sapiens
ucucagguaggaagcaacagcuu

SEQ ID NO: 666257 - RNA, 24 nt, Homo sapiens
ucucagguaggaagcaacagcuuc

SEQ ID NO: 666258 - RNA, 20 nt, Homo sapiens
ucucaguaccccauggagcu

SEQ ID NO: 666259 - RNA, 14 nt, Homo sapiens
ucucagugcuucuu

SEQ ID NO: 666260 - RNA, 16 nt, Homo sapiens
ucucaguggagccuua

SEQ ID NO: 666261 - RNA, 14 nt, Homo sapiens
ucucauaaaugagg

SEQ ID NO: 666262 - RNA, 14 nt, Homo sapiens
ucucauaauuccua

SEQ ID NO: 666263 - RNA, 20 nt, Homo sapiens
ucucauacugucugggauua

SEQ ID NO: 666264 - RNA, 17 nt, Homo sapiens
ucucauagguugccaau

SEQ ID NO: 666265 - RNA, 18 nt, Homo sapiens
ucucauauaagacaaaua

SEQ ID NO: 666266 - RNA, 23 nt, Homo sapiens
ucucauaucaugguagucacuaa

SEQ ID NO: 666267 - RNA, 16 nt, Homo sapiens
ucucaucaguaguuca

SEQ ID NO: 666268 - RNA, 14 nt, Homo sapiens
ucucaucaguccau

SEQ ID NO: 666269 - RNA, 13 nt, Homo sapiens
ucucauccacuuu

SEQ ID NO: 666270 - RNA, 13 nt, Homo sapiens
ucucauccaucau

SEQ ID NO: 666271 - RNA, 15 nt, Homo sapiens
ucucaucccaaccuc

SEQ ID NO: 666272 - RNA, 22 nt, Homo sapiens
ucucauccuccaguaccuugcu

SEQ ID NO: 666273 - RNA, 13 nt, Homo sapiens
ucucaugauucca

SEQ ID NO: 666274 - RNA, 23 nt, Homo sapiens
ucucaugcagaagccugagcuca

SEQ ID NO: 666275 - RNA, 21 nt, Homo sapiens
ucucauguuuuuuccuuuuca

SEQ ID NO: 666276 - RNA, 16 nt, Homo sapiens
ucucauuaaaauccag

SEQ ID NO: 666277 - RNA, 19 nt, Homo sapiens
ucucauuuaaaaugagauc

SEQ ID NO: 666278 - RNA, 10 nt, Homo sapiens
ucucauuucu

SEQ ID NO: 666279 - RNA, 13 nt, Homo sapiens
ucuccaaacaguc

SEQ ID NO: 666280 - RNA, 17 nt, Homo sapiens
ucuccaaaugagaucua

SEQ ID NO: 666281 - RNA, 11 nt, Homo sapiens
ggcacuuugaa

SEQ ID NO: 666282 - RNA, 16 nt, Homo sapiens
ggcagaaaaaugucau

SEQ ID NO: 666283 - RNA, 21 nt, Homo sapiens
ggcagaaacacucaaguugau

SEQ ID NO: 666284 - RNA, 14 nt, Homo sapiens
ggcagaagcagcug

SEQ ID NO: 666285 - RNA, 13 nt, Homo sapiens
ggcagaagggaac

SEQ ID NO: 666286 - RNA, 20 nt, Homo sapiens
ggcagaauaaauaagcaaaa

SEQ ID NO: 666287 - RNA, 16 nt, Homo sapiens
ggcagacacauuguca

SEQ ID NO: 666288 - RNA, 18 nt, Homo sapiens
ggcagacuacacaggaug

SEQ ID NO: 666289 - RNA, 19 nt, Homo sapiens
ggcagacugugaacuugac

SEQ ID NO: 666290 - RNA, 22 nt, Homo sapiens
ggcagagaaucucuugggaguc

SEQ ID NO: 666291 - RNA, 13 nt, Homo sapiens
ggcagagccuuug

SEQ ID NO: 666292 - RNA, 18 nt, Homo sapiens
ggcagagguugcagugaa

SEQ ID NO: 666293 - RNA, 20 nt, Homo sapiens
ggcagauuuucaugcaaaag

SEQ ID NO: 666294 - RNA, 23 nt, Homo sapiens
ggcagcaaaacgacacugcgcau

SEQ ID NO: 666295 - RNA, 15 nt, Homo sapiens
ggcagcaacaauaaa

SEQ ID NO: 666296 - RNA, 19 nt, Homo sapiens
ggcagcaagggaccugcuc

SEQ ID NO: 666297 - RNA, 13 nt, Homo sapiens
ggcagcagugaag

SEQ ID NO: 666298 - RNA, 10 nt, Homo sapiens
ggcagccacc

SEQ ID NO: 666299 - RNA, 16 nt, Homo sapiens
ggcagccaucaaagag

SEQ ID NO: 666300 - RNA, 16 nt, Homo sapiens
ggcagcuagugccuuu

SEQ ID NO: 666301 - RNA, 22 nt, Homo sapiens
ggcagcugacaguuuguggcau

SEQ ID NO: 666302 - RNA, 16 nt, Homo sapiens
ggcagcugccucugcu

SEQ ID NO: 666303 - RNA, 22 nt, Homo sapiens
ggcagcugcuauccccaucucc

SEQ ID NO: 666304 - RNA, 22 nt, Homo sapiens
ggcagcuguagcucccgagcua

SEQ ID NO: 666305 - RNA, 14 nt, Homo sapiens
ggcagcuuugcaaa

SEQ ID NO: 666306 - RNA, 15 nt, Homo sapiens
ggcaggaaagccaca

SEQ ID NO: 666307 - RNA, 22 nt, Homo sapiens
ggcaggaagggaagcguauaua

SEQ ID NO: 666308 - RNA, 18 nt, Homo sapiens
ggcaggagaaucacuuga

SEQ ID NO: 666309 - RNA, 19 nt, Homo sapiens
ggcaggagaaucgcuugaa

SEQ ID NO: 666310 - RNA, 20 nt, Homo sapiens
ggcaggagaaucgcuugaac

SEQ ID NO: 666311 - RNA, 20 nt, Homo sapiens
ggcaggagaauggcgugaac

SEQ ID NO: 666312 - RNA, 16 nt, Homo sapiens
ggcaggagccggcugc

SEQ ID NO: 666313 - RNA, 13 nt, Homo sapiens
ggcaggauccaag

SEQ ID NO: 666314 - RNA, 16 nt, Homo sapiens
ggcaggccagggcagu

SEQ ID NO: 666315 - RNA, 22 nt, Homo sapiens
ggcaggccuauuucaucacaag

SEQ ID NO: 666316 - RNA, 15 nt, Homo sapiens
ggcaggcugggccau

SEQ ID NO: 666317 - RNA, 19 nt, Homo sapiens
ggcagggagugggagccaa

SEQ ID NO: 666318 - RNA, 18 nt, Homo sapiens
ggcagggccccugacccu

SEQ ID NO: 666319 - RNA, 12 nt, Homo sapiens
ggcagggccuug

SEQ ID NO: 666320 - RNA, 23 nt, Homo sapiens
ggcaggggugggagagccagcuc

SEQ ID NO: 666321 - RNA, 18 nt, Homo sapiens
ggcagggugagaagcuag

SEQ ID NO: 666322 - RNA, 15 nt, Homo sapiens
ggcaggucacuuuac

SEQ ID NO: 666323 - RNA, 17 nt, Homo sapiens
ggcaggugccuguugaa

SEQ ID NO: 666324 - RNA, 13 nt, Homo sapiens
ggcaggugccuug

SEQ ID NO: 666325 - RNA, 14 nt, Homo sapiens
ggcagguuugccag

SEQ ID NO: 666326 - RNA, 15 nt, Homo sapiens
ggcaguauuaagugu

SEQ ID NO: 666327 - RNA, 21 nt, Homo sapiens
ggcagucaugcugggucucca

SEQ ID NO: 666328 - RNA, 10 nt, Homo sapiens
ggcaguuuuu

SEQ ID NO: 666329 - RNA, 16 nt, Homo sapiens
ggcauaaacuugaaaa

SEQ ID NO: 666330 - RNA, 11 nt, Homo sapiens
ggcauagcucu

SEQ ID NO: 666331 - RNA, 11 nt, Homo sapiens
ggcauaugcaa

SEQ ID NO: 666332 - RNA, 13 nt, Homo sapiens
ggcauaugcacag

SEQ ID NO: 666333 - RNA, 15 nt, Homo sapiens
ggcauauucaucuac

SEQ ID NO: 666334 - RNA, 19 nt, Homo sapiens
ggcaucaggucugggcaag

SEQ ID NO: 666335 - RNA, 16 nt, Homo sapiens
ggcaucuccugugcau

SEQ ID NO: 666336 - RNA, 14 nt, Homo sapiens
ggcaugacacucua

SEQ ID NO: 666337 - RNA, 21 nt, Homo sapiens
ggcaugauuagauugcaaagc

SEQ ID NO: 666338 - RNA, 18 nt, Homo sapiens
ggcauggccagguggcca

SEQ ID NO: 666339 - RNA, 20 nt, Homo sapiens
ggcauggcccugggguccca

SEQ ID NO: 666340 - RNA, 14 nt, Homo sapiens
ggcaugguggcaca

SEQ ID NO: 666341 - RNA, 18 nt, Homo sapiens
ggcaugguguguggugcu

SEQ ID NO: 666342 - RNA, 19 nt, Homo sapiens
ggcauuacaauugcaguuu

SEQ ID NO: 666343 - RNA, 23 nt, Homo sapiens
ggcauucuguggccagccaaaag

SEQ ID NO: 666344 - RNA, 19 nt, Homo sapiens
ggcauucuuguacagugua

SEQ ID NO: 666345 - RNA, 22 nt, Homo sapiens
ggcauugaagcuugcaccuuuu

SEQ ID NO: 666346 - RNA, 15 nt, Homo sapiens
ggcauuguaguuaau

SEQ ID NO: 666347 - RNA, 22 nt, Homo sapiens
ggcauuucacgaacuguucaca

SEQ ID NO: 666348 - RNA, 14 nt, Homo sapiens
ggcauuugaucaga

SEQ ID NO: 666349 - RNA, 20 nt, Homo sapiens
ggcauuugcaccuaccucac

SEQ ID NO: 666350 - RNA, 10 nt, Homo sapiens
ggccaaagaa

SEQ ID NO: 666351 - RNA, 21 nt, Homo sapiens
ggccaaagagucuccaguuua

SEQ ID NO: 666352 - RNA, 17 nt, Homo sapiens
ggccaacggcaacagca

SEQ ID NO: 666353 - RNA, 15 nt, Homo sapiens
ggccaacugcaaaaa

SEQ ID NO: 666354 - RNA, 22 nt, Homo sapiens
ggccaagcauuucuagcaguga

SEQ ID NO: 666355 - RNA, 14 nt, Homo sapiens
ggccaagcccagga

SEQ ID NO: 666356 - RNA, 22 nt, Homo sapiens
ggccaaggggugggccugugaa

SEQ ID NO: 666357 - RNA, 22 nt, Homo sapiens
ggccaaggugggauuuguaaag

SEQ ID NO: 666358 - RNA, 19 nt, Homo sapiens
ggccaaggugggcagauca

SEQ ID NO: 666359 - RNA, 23 nt, Homo sapiens
ggccaagguggguggaucacuug

SEQ ID NO: 666360 - RNA, 22 nt, Homo sapiens
ggccaaugcuuauacccaguga

SEQ ID NO: 666361 - RNA, 12 nt, Homo sapiens
ggccacacagaa

SEQ ID NO: 666362 - RNA, 15 nt, Homo sapiens
ggccacaccaucucc

SEQ ID NO: 666363 - RNA, 15 nt, Homo sapiens
ggccacacccaggaa

SEQ ID NO: 666364 - RNA, 14 nt, Homo sapiens
ggccacacugguca

SEQ ID NO: 666365 - RNA, 16 nt, Homo sapiens
ggccacacuggucaca

SEQ ID NO: 666366 - RNA, 20 nt, Homo sapiens
ggccacacuggucacaggca

SEQ ID NO: 666367 - RNA, 10 nt, Homo sapiens
ggccacagac

SEQ ID NO: 666368 - RNA, 13 nt, Homo sapiens
ggccacauugaca

SEQ ID NO: 666369 - RNA, 14 nt, Homo sapiens
ggccaccaggcugg

SEQ ID NO: 666370 - RNA, 15 nt, Homo sapiens
ggccacccagccagg

SEQ ID NO: 666371 - RNA, 20 nt, Homo sapiens
ggccaccccagagugggaga

SEQ ID NO: 666372 - RNA, 16 nt, Homo sapiens
ggccacccgggcugcc

SEQ ID NO: 666373 - RNA, 22 nt, Homo sapiens
ggccacugcucccuaagccagc

SEQ ID NO: 666374 - RNA, 23 nt, Homo sapiens
ggccacugcugcuucuccauggc

SEQ ID NO: 666375 - RNA, 15 nt, Homo sapiens
ggccagaagaucuac

SEQ ID NO: 666376 - RNA, 19 nt, Homo sapiens
ggccagaagggggccauga

SEQ ID NO: 666377 - RNA, 15 nt, Homo sapiens
ggccagcacuuccau

SEQ ID NO: 666378 - RNA, 16 nt, Homo sapiens
ggccagccacagagca

SEQ ID NO: 666379 - RNA, 18 nt, Homo sapiens
ggccagccagugccauuc

SEQ ID NO: 666380 - RNA, 19 nt, Homo sapiens
ggccagccccagcaccuca

SEQ ID NO: 666381 - RNA, 20 nt, Homo sapiens
ggccagccccagcaccucau

SEQ ID NO: 666382 - RNA, 16 nt, Homo sapiens
ggccagcccugcagcc

SEQ ID NO: 666383 - RNA, 23 nt, Homo sapiens
ggccagccuccggcggggaccca

SEQ ID NO: 666384 - RNA, 19 nt, Homo sapiens
ggccagggcaaugccauca

SEQ ID NO: 666385 - RNA, 22 nt, Homo sapiens
ggccaggugagguccaccggcc

SEQ ID NO: 666386 - RNA, 23 nt, Homo sapiens
ggccaggugcuuuucccuaucca

SEQ ID NO: 666387 - RNA, 13 nt, Homo sapiens
ggccagguggcca

SEQ ID NO: 666388 - RNA, 23 nt, Homo sapiens
ggccaguauuuuuauuucuuuaa

SEQ ID NO: 666389 - RNA, 23 nt, Homo sapiens
ggccagucaggcugcagaggcac

SEQ ID NO: 666390 - RNA, 18 nt, Homo sapiens
ggccagugagaagcugag

SEQ ID NO: 666391 - RNA, 12 nt, Homo sapiens
ggccaguggccu

SEQ ID NO: 666392 - RNA, 14 nt, Homo sapiens
ggccauacugccuu

SEQ ID NO: 666393 - RNA, 13 nt, Homo sapiens
ggccauauuaccc

SEQ ID NO: 666394 - RNA, 12 nt, Homo sapiens
ggccaucacuca

SEQ ID NO: 666395 - RNA, 17 nt, Homo sapiens
ggccaugagcuccagac

SEQ ID NO: 666396 - RNA, 15 nt, Homo sapiens
ggccaugauggccuu

SEQ ID NO: 666397 - RNA, 12 nt, Homo sapiens
ggccaugcccuc

SEQ ID NO: 666398 - RNA, 15 nt, Homo sapiens
ggccauggcaugugu

SEQ ID NO: 666399 - RNA, 15 nt, Homo sapiens
ggccaugggcauuug

SEQ ID NO: 666400 - RNA, 17 nt, Homo sapiens
ggccccaccggggucua

SEQ ID NO: 666401 - RNA, 21 nt, Homo sapiens
ggccccagacgcauagacuga

SEQ ID NO: 666402 - RNA, 16 nt, Homo sapiens
ggccccagaucugccu

SEQ ID NO: 666403 - RNA, 14 nt, Homo sapiens
ucucuugacagucu

SEQ ID NO: 666404 - RNA, 17 nt, Homo sapiens
ucucuugauucugggau

SEQ ID NO: 666405 - RNA, 17 nt, Homo sapiens
ucucuuggcucuacucc

SEQ ID NO: 666406 - RNA, 24 nt, Homo sapiens
ucucuugggcccaggacuguugau

SEQ ID NO: 666407 - RNA, 13 nt, Homo sapiens
ucucuuguaaaag

SEQ ID NO: 666408 - RNA, 16 nt, Homo sapiens
ucucuuguuauugcau

SEQ ID NO: 666409 - RNA, 21 nt, Homo sapiens
ucucuuugauuauuugcaugu

SEQ ID NO: 666410 - RNA, 14 nt, Homo sapiens
ucucuuuugagcua

SEQ ID NO: 666411 - RNA, 19 nt, Homo sapiens
ucucuuuuuaccuuuaaca

SEQ ID NO: 666412 - RNA, 19 nt, Homo sapiens
ucugaaaauauaaccagcc

SEQ ID NO: 666413 - RNA, 15 nt, Homo sapiens
ucugaaaaucuccuu

SEQ ID NO: 666414 - RNA, 21 nt, Homo sapiens
ucugaaacccacagaugucuc

SEQ ID NO: 666415 - RNA, 16 nt, Homo sapiens
ucugaaacugcauaag

SEQ ID NO: 666416 - RNA, 15 nt, Homo sapiens
ucugaaauggaauau

SEQ ID NO: 666417 - RNA, 12 nt, Homo sapiens
ucugaacacauu

SEQ ID NO: 666418 - RNA, 20 nt, Homo sapiens
ucugaacauacagagcccac

SEQ ID NO: 666419 - RNA, 17 nt, Homo sapiens
ggcccugacuucuggag

SEQ ID NO: 666420 - RNA, 17 nt, Homo sapiens
ggcccugagccaaaaga

SEQ ID NO: 666421 - RNA, 21 nt, Homo sapiens
ggcccuggaugguccucuuac

SEQ ID NO: 666422 - RNA, 20 nt, Homo sapiens
ggcccuggggaucuucccac

SEQ ID NO: 666423 - RNA, 20 nt, Homo sapiens
ggcccuucuguccaccagac

SEQ ID NO: 666424 - RNA, 21 nt, Homo sapiens
ggcccuucuugccuacuaugc

SEQ ID NO: 666425 - RNA, 15 nt, Homo sapiens
ggcccuuugaagccu

SEQ ID NO: 666426 - RNA, 12 nt, Homo sapiens
ggccgacuccac

SEQ ID NO: 666427 - RNA, 15 nt, Homo sapiens
ggccgggcagggugu

SEQ ID NO: 666428 - RNA, 19 nt, Homo sapiens
ggccgggcgcgguggcuca

SEQ ID NO: 666429 - RNA, 23 nt, Homo sapiens
ggccgggcugcgccugcugcacu

SEQ ID NO: 666430 - RNA, 22 nt, Homo sapiens
ggccggggcagggacuugccuc

SEQ ID NO: 666431 - RNA, 22 nt, Homo sapiens
ggccggggcccugcaccugugc

SEQ ID NO: 666432 - RNA, 14 nt, Homo sapiens
ggccguaucuguca

SEQ ID NO: 666433 - RNA, 17 nt, Homo sapiens
ggccguccuugucucug

SEQ ID NO: 666434 - RNA, 14 nt, Homo sapiens
ggccuacagcuuug

SEQ ID NO: 666435 - RNA, 16 nt, Homo sapiens
ggccuacggagucagc

SEQ ID NO: 666436 - RNA, 15 nt, Homo sapiens
ggccuagcgaucucu

SEQ ID NO: 666437 - RNA, 24 nt, Homo sapiens
ggccuaugcagagguccacaacac

SEQ ID NO: 666438 - RNA, 15 nt, Homo sapiens
ggccuauuccugcug

SEQ ID NO: 666439 - RNA, 12 nt, Homo sapiens
ggccucaaggga

SEQ ID NO: 666440 - RNA, 13 nt, Homo sapiens
ggccucaggagca

SEQ ID NO: 666441 - RNA, 12 nt, Homo sapiens
ggccucaggguc

SEQ ID NO: 666442 - RNA, 17 nt, Homo sapiens
ggccuccaaacacagau

SEQ ID NO: 666443 - RNA, 21 nt, Homo sapiens
ggccuccagagaccccaggaa

SEQ ID NO: 666444 - RNA, 18 nt, Homo sapiens
ggccucccacagacucaa

SEQ ID NO: 666445 - RNA, 19 nt, Homo sapiens
ggccuccccaugggcacag

SEQ ID NO: 666446 - RNA, 16 nt, Homo sapiens
ggccuccccugcugaa

SEQ ID NO: 666447 - RNA, 15 nt, Homo sapiens
ggccuccgaugccug

SEQ ID NO: 666448 - RNA, 21 nt, Homo sapiens
ggccuccuacacguacuucua

SEQ ID NO: 666449 - RNA, 20 nt, Homo sapiens
ggccuccucucucaguuuuu

SEQ ID NO: 666450 - RNA, 17 nt, Homo sapiens
ggccuccugggggaccu

SEQ ID NO: 666451 - RNA, 14 nt, Homo sapiens
ggccucucucagga

SEQ ID NO: 666452 - RNA, 14 nt, Homo sapiens
ggccucugugauua

SEQ ID NO: 666453 - RNA, 11 nt, Homo sapiens
ggccucuugcu

SEQ ID NO: 666454 - RNA, 22 nt, Homo sapiens
ggccugaggugugugccacuca

SEQ ID NO: 666455 - RNA, 19 nt, Homo sapiens
ggccugcaccaaaugucag

SEQ ID NO: 666456 - RNA, 17 nt, Homo sapiens
ggccugcaccgaccccg

SEQ ID NO: 666457 - RNA, 23 nt, Homo sapiens
ggccugcagacagaccucaaggg

SEQ ID NO: 666458 - RNA, 17 nt, Homo sapiens
ggccugcccucagggau

SEQ ID NO: 666459 - RNA, 19 nt, Homo sapiens
ggccugcugccagugcagc

SEQ ID NO: 666460 - RNA, 16 nt, Homo sapiens
ggccuggaccuaugca

SEQ ID NO: 666461 - RNA, 16 nt, Homo sapiens
ggccuggccaccucuc

SEQ ID NO: 666462 - RNA, 18 nt, Homo sapiens
ggccugggaucuggcaca

SEQ ID NO: 666463 - RNA, 22 nt, Homo sapiens
ggccugggaucuggcacacucc

SEQ ID NO: 666464 - RNA, 17 nt, Homo sapiens
ggccugggauggggcuu

SEQ ID NO: 666465 - RNA, 19 nt, Homo sapiens
ggccugggugugugugagc

SEQ ID NO: 666466 - RNA, 21 nt, Homo sapiens
ggccuggguuuguuccugggg

SEQ ID NO: 666467 - RNA, 21 nt, Homo sapiens
ggccugugagguaacugggau

SEQ ID NO: 666468 - RNA, 14 nt, Homo sapiens
ggccugugugugaa
